United States Patent 7,888,497 (BIOINFORMATICALLY DETECTABLE GROUP OF NOVEL REGULATORY OLIGONUCLEOTIDES AND USES THEREOF) - sequence listing, part 108

SEQ ID NO: 4570436 - DNA, 12 bp, Homo sapiens
gctagccagagg

SEQ ID NO: 4570437 - DNA, 14 bp, Homo sapiens
gctagcgctgccgc

SEQ ID NO: 4570438 - DNA, 21 bp, Homo sapiens
gctagcgctgccgcaccccag

SEQ ID NO: 4570439 - DNA, 22 bp, Homo sapiens
gctagcgctgccgcaccccaga

SEQ ID NO: 4570440 - DNA, 23 bp, Homo sapiens
gctagcgctgccgcaccccagag

SEQ ID NO: 4570441 - DNA, 22 bp, Homo sapiens
gctagcttctgcttttctgccc

SEQ ID NO: 4570442 - DNA, 23 bp, Homo sapiens
gctagcttctgcttttctgccct

SEQ ID NO: 4570443 - DNA, 18 bp, Homo sapiens
gctaggcgctggggagac

SEQ ID NO: 4570444 - DNA, 18 bp, Homo sapiens
gctagggtggggagagac

SEQ ID NO: 4570445 - DNA, 22 bp, Homo sapiens
gctaggtcttgccaactccatc

SEQ ID NO: 4570446 - DNA, 17 bp, Homo sapiens
gctagtagcaatgtgcc

SEQ ID NO: 4570447 - DNA, 18 bp, Homo sapiens
gctagtagcaatgtgcct

SEQ ID NO: 4570448 - DNA, 21 bp, Homo sapiens
gctagtagcaatgtgccttga

SEQ ID NO: 4570449 - DNA, 16 bp, Homo sapiens
gctagtatcaaaagaa

SEQ ID NO: 4570450 - DNA, 16 bp, Homo sapiens
gctagtcactggaaat

SEQ ID NO: 4570451 - DNA, 14 bp, Homo sapiens
gctagtcagagaga

SEQ ID NO: 4570452 - DNA, 22 bp, Homo sapiens
gctataacagtgtctttctagc

SEQ ID NO: 4570453 - DNA, 18 bp, Homo sapiens
gctatagctacaggaagc

SEQ ID NO: 4570454 - DNA, 14 bp, Homo sapiens
gctatagtatttga

SEQ ID NO: 4570455 - DNA, 18 bp, Homo sapiens
gctatccccatctccctg

SEQ ID NO: 4570456 - DNA, 21 bp, Homo sapiens
gctatccccatctccctgcct

SEQ ID NO: 4570457 - DNA, 20 bp, Homo sapiens
gctatcctgctgaaagtcct

SEQ ID NO: 4570458 - DNA, 13 bp, Homo sapiens
gctatccttggct

SEQ ID NO: 4570459 - DNA, 17 bp, Homo sapiens
gctatctatacctgcct

SEQ ID NO: 4570460 - DNA, 14 bp, Homo sapiens
gctatcttcatgta

SEQ ID NO: 4570461 - DNA, 13 bp, Homo sapiens
gctatgggagccc

SEQ ID NO: 4570462 - DNA, 17 bp, Homo sapiens
gctatgggagccccagg

SEQ ID NO: 4570463 - DNA, 18 bp, Homo sapiens
gctatgtcccaggaatca

SEQ ID NO: 4570464 - DNA, 18 bp, Homo sapiens
gctatgtttttaatgtat

SEQ ID NO: 4570465 - DNA, 12 bp, Homo sapiens
gctattaaaaaa

SEQ ID NO: 4570466 - DNA, 15 bp, Homo sapiens
gctattaaaaaagtc

SEQ ID NO: 4570467 - DNA, 12 bp, Homo sapiens
gctattaatatt

SEQ ID NO: 4570468 - DNA, 13 bp, Homo sapiens
gctattgcataag

SEQ ID NO: 4570469 - DNA, 15 bp, Homo sapiens
gctatttaacatttt

SEQ ID NO: 4570470 - DNA, 12 bp, Homo sapiens
gctatttcaata

SEQ ID NO: 4570471 - DNA, 15 bp, Homo sapiens
gctattttcctctgg

SEQ ID NO: 4570472 - DNA, 15 bp, Homo sapiens
gctatttttttccta

SEQ ID NO: 4570473 - DNA, 15 bp, Homo sapiens
gctcaaaaaatgagc

SEQ ID NO: 4570474 - DNA, 23 bp, Homo sapiens
gctcaaaaacttgatcacatgct

SEQ ID NO: 4570475 - DNA, 15 bp, Homo sapiens
gctcaaatgaaatgt

SEQ ID NO: 4570476 - DNA, 17 bp, Homo sapiens
gctcaagcaatcctcct

SEQ ID NO: 4570477 - DNA, 19 bp, Homo sapiens
gctcaagtctgcacagagc

SEQ ID NO: 4570478 - DNA, 14 bp, Homo sapiens
gctcaagtttttat

SEQ ID NO: 4570479 - DNA, 20 bp, Homo sapiens
gctcaatccctgaggactga

SEQ ID NO: 4570480 - DNA, 14 bp, Homo sapiens
gctcacaaattccg

SEQ ID NO: 4570481 - DNA, 19 bp, Homo sapiens
gctcacaatgttctggcac

SEQ ID NO: 4570482 - DNA, 13 bp, Homo sapiens
gctcacactgaga

SEQ ID NO: 4570483 - DNA, 19 bp, Homo sapiens
gctcacagttcctcgccct

SEQ ID NO: 4570484 - DNA, 18 bp, Homo sapiens
gctcaccagccctgcagc

SEQ ID NO: 4570485 - DNA, 20 bp, Homo sapiens
gctcaccagccctgcagccc

SEQ ID NO: 4570486 - DNA, 21 bp, Homo sapiens
gctcaccagccctgcagccca

SEQ ID NO: 4570487 - DNA, 16 bp, Homo sapiens
gctcacccccttctcc

SEQ ID NO: 4570488 - DNA, 17 bp, Homo sapiens
gctcaccgctggccctt

SEQ ID NO: 4570489 - DNA, 22 bp, Homo sapiens
gctcacgcctgtaatcccagca

SEQ ID NO: 4570490 - DNA, 23 bp, Homo sapiens
gctcacgcctgtaatcccagcac

SEQ ID NO: 4570491 - DNA, 18 bp, Homo sapiens
gctcactgcagcctcata

SEQ ID NO: 4570492 - DNA, 13 bp, Homo sapiens
gctcactgccagg

SEQ ID NO: 4570493 - DNA, 17 bp, Homo sapiens
gctcactgccaggccag

SEQ ID NO: 4570494 - DNA, 13 bp, Homo sapiens
gctcactgggccc

SEQ ID NO: 4570495 - DNA, 19 bp, Homo sapiens
gctcactgggcccgagcct

SEQ ID NO: 4570496 - DNA, 15 bp, Homo sapiens
gctcactgtgctggg

SEQ ID NO: 4570497 - DNA, 18 bp, Homo sapiens
gctcactgtgctggggca

SEQ ID NO: 4570498 - DNA, 15 bp, Homo sapiens
gctcacttctgggct

SEQ ID NO: 4570499 - DNA, 15 bp, Homo sapiens
gctcagacccccact

SEQ ID NO: 4570500 - DNA, 17 bp, Homo sapiens
gctcagacccctcagcc

SEQ ID NO: 4570501 - DNA, 19 bp, Homo sapiens
gctcagacccctcagcccc

SEQ ID NO: 4570502 - DNA, 20 bp, Homo sapiens
gctcagacccctcagcccca

SEQ ID NO: 4570503 - DNA, 21 bp, Homo sapiens
gctcagactgggcactggggc

SEQ ID NO: 4570504 - DNA, 17 bp, Homo sapiens
gctcagacttgccaggc

SEQ ID NO: 4570505 - DNA, 22 bp, Homo sapiens
gctcagacttgccaggctccct

SEQ ID NO: 4570506 - DNA, 12 bp, Homo sapiens
gctcagagcttt

SEQ ID NO: 4570507 - DNA, 16 bp, Homo sapiens
gctcagagctttgtca

SEQ ID NO: 4570508 - DNA, 20 bp, Homo sapiens
gctcagagctttgtcacttg

SEQ ID NO: 4570509 - DNA, 21 bp, Homo sapiens
gctcagagggtgtcctgcacc

SEQ ID NO: 4570510 - DNA, 15 bp, Homo sapiens
gctcagcagccctag

SEQ ID NO: 4570511 - DNA, 15 bp, Homo sapiens
gctcagccccaggcc

SEQ ID NO: 4570512 - DNA, 21 bp, Homo sapiens
gctcagccccaggccagctgc

SEQ ID NO: 4570513 - DNA, 18 bp, Homo sapiens
gctcagctcatccatgcc

SEQ ID NO: 4570514 - DNA, 21 bp, Homo sapiens
gctcaggaaccgaggcaggga

SEQ ID NO: 4570515 - DNA, 20 bp, Homo sapiens
gctcaggaggaggggtgaga

SEQ ID NO: 4570516 - DNA, 22 bp, Homo sapiens
gctcagggtgctagaggattag

SEQ ID NO: 4570517 - DNA, 16 bp, Homo sapiens
gctcaggtcctgctgc

SEQ ID NO: 4570518 - DNA, 16 bp, Homo sapiens
gctcagtgccacctat

SEQ ID NO: 4570519 - DNA, 17 bp, Homo sapiens
gctcagtgcttgggctc

SEQ ID NO: 4570520 - DNA, 21 bp, Homo sapiens
gctcagtgcttgggctccacg

SEQ ID NO: 4570521 - DNA, 20 bp, Homo sapiens
gctcatcattctctgtctca

SEQ ID NO: 4570522 - DNA, 13 bp, Homo sapiens
gctcatccctgga

SEQ ID NO: 4570523 - DNA, 14 bp, Homo sapiens
gctcatccctggac

SEQ ID NO: 4570524 - DNA, 16 bp, Homo sapiens
gctcatccctggactt

SEQ ID NO: 4570525 - DNA, 20 bp, Homo sapiens
gctcatggctgtgtccactg

SEQ ID NO: 4570526 - DNA, 19 bp, Homo sapiens
gctcattaaactgattcca

SEQ ID NO: 4570527 - DNA, 11 bp, Homo sapiens
gctcatttaaa

SEQ ID NO: 4570528 - DNA, 15 bp, Homo sapiens
gctccaatctgtcac

SEQ ID NO: 4570529 - DNA, 17 bp, Homo sapiens
gctccaatgactgagca

SEQ ID NO: 4570530 - DNA, 16 bp, Homo sapiens
gctccaatttccccac

SEQ ID NO: 4570531 - DNA, 14 bp, Homo sapiens
gctccacacgcccc

SEQ ID NO: 4570532 - DNA, 15 bp, Homo sapiens
gctccaccacatcct

SEQ ID NO: 4570533 - DNA, 14 bp, Homo sapiens
gctccacccttggc

SEQ ID NO: 4570534 - DNA, 17 bp, Homo sapiens
gctccacccttggcctg

SEQ ID NO: 4570535 - DNA, 22 bp, Homo sapiens
gctccactcttgatctctcttg

SEQ ID NO: 4570536 - DNA, 21 bp, Homo sapiens
gctccagagggcactctgctt

SEQ ID NO: 4570537 - DNA, 20 bp, Homo sapiens
gctccagcaccttctttctg

SEQ ID NO: 4570538 - DNA, 13 bp, Homo sapiens
gctccagcctctg

SEQ ID NO: 4570539 - DNA, 17 bp, Homo sapiens
gctccagcctctgccgc

SEQ ID NO: 4570540 - DNA, 19 bp, Homo sapiens
gctccagcctctgccgctg

SEQ ID NO: 4570541 - DNA, 22 bp, Homo sapiens
gctccagcgatggtgctgccca

SEQ ID NO: 4570542 - DNA, 18 bp, Homo sapiens
gctccagctctggcacag

SEQ ID NO: 4570543 - DNA, 12 bp, Homo sapiens
gctccagctgcc

SEQ ID NO: 4570544 - DNA, 16 bp, Homo sapiens
gctccagctgccccgg

SEQ ID NO: 4570545 - DNA, 17 bp, Homo sapiens
gctccaggagcctcatc

SEQ ID NO: 4570546 - DNA, 18 bp, Homo sapiens
gctccaggagcctcatcc

SEQ ID NO: 4570547 - DNA, 23 bp, Homo sapiens
gctccaggagcctcatccagcct

SEQ ID NO: 4570548 - DNA, 16 bp, Homo sapiens
gctccaggcctgcatt

SEQ ID NO: 4570549 - DNA, 19 bp, Homo sapiens
gctccagggatgattcaag

SEQ ID NO: 4570550 - DNA, 23 bp, Homo sapiens
gctccagggatgattcaagccat

SEQ ID NO: 4570551 - DNA, 18 bp, Homo sapiens
gctccagtctcatcctcc

SEQ ID NO: 4570552 - DNA, 20 bp, Homo sapiens
gctccagtctcatcctccca

SEQ ID NO: 4570553 - DNA, 18 bp, Homo sapiens
gctccatccccctgcctc

SEQ ID NO: 4570554 - DNA, 19 bp, Homo sapiens
gctccatctccgcctccac

SEQ ID NO: 4570555 - DNA, 16 bp, Homo sapiens
gctccatgctgggtct

SEQ ID NO: 4570556 - DNA, 16 bp, Homo sapiens
gctccatgtgcctctt

SEQ ID NO: 4570557 - DNA, 24 bp, Homo sapiens
gctcccacaccgcgtcccagctcc

SEQ ID NO: 4570558 - DNA, 15 bp, Homo sapiens
gctcccacagcttcc

SEQ ID NO: 4570559 - DNA, 22 bp, Homo sapiens
gctcccacagcttcctgagggc

SEQ ID NO: 4570560 - DNA, 17 bp, Homo sapiens
gctcccacctgtttctg

SEQ ID NO: 4570561 - DNA, 22 bp, Homo sapiens
gctcccaggggtctccctggct

SEQ ID NO: 4570562 - DNA, 14 bp, Homo sapiens
gctcccagtcctgc

SEQ ID NO: 4570563 - DNA, 23 bp, Homo sapiens
gctcccagtcctgcctgaacagc

SEQ ID NO: 4570564 - DNA, 16 bp, Homo sapiens
gctcccattcctccct

SEQ ID NO: 4570565 - DNA, 20 bp, Homo sapiens
gctccccaacacctgcctct

SEQ ID NO: 4570566 - DNA, 14 bp, Homo sapiens
gctccccctcccca

SEQ ID NO: 4570567 - DNA, 14 bp, Homo sapiens
gctccccgcctcca

SEQ ID NO: 4570568 - DNA, 18 bp, Homo sapiens
gctcccctcggagaagag

SEQ ID NO: 4570569 - DNA, 21 bp, Homo sapiens
gctcccctcggagaagagctg

SEQ ID NO: 4570570 - DNA, 21 bp, Homo sapiens
gctcccctctgcttctcatcc

SEQ ID NO: 4570571 - DNA, 16 bp, Homo sapiens
gctcccctcttttgta

SEQ ID NO: 4570572 - DNA, 17 bp, Homo sapiens
gctcccctgcccagcct

SEQ ID NO: 4570573 - DNA, 21 bp, Homo sapiens
gctcccctgcccagcctgctc

SEQ ID NO: 4570574 - DNA, 13 bp, Homo sapiens
gctcccctggctg

SEQ ID NO: 4570575 - DNA, 17 bp, Homo sapiens
gctccctcccctgccct

SEQ ID NO: 4570576 - DNA, 20 bp, Homo sapiens
gctccctcccctgccctggt

SEQ ID NO: 4570577 - DNA, 22 bp, Homo sapiens
gctccctctccaagacagcagc

SEQ ID NO: 4570578 - DNA, 16 bp, Homo sapiens
gctccctgactgggag

SEQ ID NO: 4570579 - DNA, 20 bp, Homo sapiens
gctccctgcaagctccgcct

SEQ ID NO: 4570580 - DNA, 15 bp, Homo sapiens
gctccctgcctcctg

SEQ ID NO: 4570581 - DNA, 18 bp, Homo sapiens
gctccctgcctcctgcct

SEQ ID NO: 4570582 - DNA, 21 bp, Homo sapiens
gctccctgtaacctcttcaga

SEQ ID NO: 4570583 - DNA, 17 bp, Homo sapiens
gctccctgtagctctgc

SEQ ID NO: 4570584 - DNA, 19 bp, Homo sapiens
gctccctgtagctctgcct

SEQ ID NO: 4570585 - DNA, 18 bp, Homo sapiens
gctcccttccacctgtca

SEQ ID NO: 4570586 - DNA, 13 bp, Homo sapiens
gctccctttctca

SEQ ID NO: 4570587 - DNA, 17 bp, Homo sapiens
gctccgggaacagtgca

SEQ ID NO: 4570588 - DNA, 15 bp, Homo sapiens
gctccgggcaccagg

SEQ ID NO: 4570589 - DNA, 16 bp, Homo sapiens
gctcctagaagtctta

SEQ ID NO: 4570590 - DNA, 15 bp, Homo sapiens
gctcctagcaccctg

SEQ ID NO: 4570591 - DNA, 17 bp, Homo sapiens
gctcctagcaccctgga

SEQ ID NO: 4570592 - DNA, 13 bp, Homo sapiens
gctcctcagagcg

SEQ ID NO: 4570593 - DNA, 15 bp, Homo sapiens
gctcctccagggcca

SEQ ID NO: 4570594 - DNA, 18 bp, Homo sapiens
gctcctccagggccacgt

SEQ ID NO: 4570595 - DNA, 14 bp, Homo sapiens
gctcctccctccag

SEQ ID NO: 4570596 - DNA, 18 bp, Homo sapiens
gctcctcgagatcccaac

SEQ ID NO: 4570597 - DNA, 18 bp, Homo sapiens
gctcctctcctggaggat

SEQ ID NO: 4570598 - DNA, 22 bp, Homo sapiens
gctcctgaggggcatctgcccc

SEQ ID NO: 4570599 - DNA, 13 bp, Homo sapiens
gctcctgcatgca

SEQ ID NO: 4570600 - DNA, 14 bp, Homo sapiens
gctcctgcccaggc

SEQ ID NO: 4570601 - DNA, 22 bp, Homo sapiens
gctcctgcccaggccacagaga

SEQ ID NO: 4570602 - DNA, 18 bp, Homo sapiens
gctcctgccgcagagctg

SEQ ID NO: 4570603 - DNA, 17 bp, Homo sapiens
gctcctggaccaggccc

SEQ ID NO: 4570604 - DNA, 17 bp, Homo sapiens
gctcctgggacccttgg

SEQ ID NO: 4570605 - DNA, 18 bp, Homo sapiens
gctcctgggacccttggc

SEQ ID NO: 4570606 - DNA, 23 bp, Homo sapiens
gctcctggggagctcctgggacc

SEQ ID NO: 4570607 - DNA, 11 bp, Homo sapiens
gctcctgtgct

SEQ ID NO: 4570608 - DNA, 18 bp, Homo sapiens
gctcctgtgctcaccctc

SEQ ID NO: 4570609 - DNA, 13 bp, Homo sapiens
gctccttccagac

SEQ ID NO: 4570610 - DNA, 12 bp, Homo sapiens
gctccttctggc

SEQ ID NO: 4570611 - DNA, 20 bp, Homo sapiens
gctcgatccaaattgtgctt

SEQ ID NO: 4570612 - DNA, 22 bp, Homo sapiens
gctcgcccagacaccatgtgca

SEQ ID NO: 4570613 - DNA, 13 bp, Homo sapiens
gctcgcccagcag

SEQ ID NO: 4570614 - DNA, 16 bp, Homo sapiens
gctcgcccctgttttt

SEQ ID NO: 4570615 - DNA, 18 bp, Homo sapiens
gctcgcccctgttttttg

SEQ ID NO: 4570616 - DNA, 16 bp, Homo sapiens
gctcgccgtgtctcag

SEQ ID NO: 4570617 - DNA, 20 bp, Homo sapiens
gctcgctgacagcttgggag

SEQ ID NO: 4570618 - DNA, 14 bp, Homo sapiens
gctcgcttgctgga

SEQ ID NO: 4570619 - DNA, 14 bp, Homo sapiens
gctcggacacagtt

SEQ ID NO: 4570620 - DNA, 15 bp, Homo sapiens
gctcggacccacccc

SEQ ID NO: 4570621 - DNA, 20 bp, Homo sapiens
gctcggacccaccccaactc

SEQ ID NO: 4570622 - DNA, 15 bp, Homo sapiens
gctcggaggctaccc

SEQ ID NO: 4570623 - DNA, 19 bp, Homo sapiens
gctcggaggctacccgctg

SEQ ID NO: 4570624 - DNA, 15 bp, Homo sapiens
gctcggaggctgccc

SEQ ID NO: 4570625 - DNA, 16 bp, Homo sapiens
gctcgtggactgtgct

SEQ ID NO: 4570626 - DNA, 21 bp, Homo sapiens
gctcgtggactgtgctggtgc

SEQ ID NO: 4570627 - DNA, 15 bp, Homo sapiens
gctctaacagccctc

SEQ ID NO: 4570628 - DNA, 18 bp, Homo sapiens
gctctaggctgttctgta

SEQ ID NO: 4570629 - DNA, 19 bp, Homo sapiens
gctctaggtacgatgacag

SEQ ID NO: 4570630 - DNA, 20 bp, Homo sapiens
gctctagtaccttttcagta

SEQ ID NO: 4570631 - DNA, 14 bp, Homo sapiens
gctctatgtctgcc

SEQ ID NO: 4570632 - DNA, 18 bp, Homo sapiens
gctctcacccccatccct

SEQ ID NO: 4570633 - DNA, 20 bp, Homo sapiens
gctctcatggtacttcctct

SEQ ID NO: 4570634 - DNA, 22 bp, Homo sapiens
gctctccaagtctcagtggctt

SEQ ID NO: 4570635 - DNA, 16 bp, Homo sapiens
gctctccacctcagcc

SEQ ID NO: 4570636 - DNA, 14 bp, Homo sapiens
gctctcccagtgaa

SEQ ID NO: 4570637 - DNA, 18 bp, Homo sapiens
gctctcccctctcgcccc

SEQ ID NO: 4570638 - DNA, 11 bp, Homo sapiens
gctctccctct

SEQ ID NO: 4570639 - DNA, 21 bp, Homo sapiens
gctctccctctggccctgcct

SEQ ID NO: 4570640 - DNA, 17 bp, Homo sapiens
gctctcctccacctcaa

SEQ ID NO: 4570641 - DNA, 16 bp, Homo sapiens
gctctcctcccgcccc

SEQ ID NO: 4570642 - DNA, 20 bp, Homo sapiens
gctctcctcccgccccgccc

SEQ ID NO: 4570643 - DNA, 14 bp, Homo sapiens
gctctcctgctgca

SEQ ID NO: 4570644 - DNA, 12 bp, Homo sapiens
gctctcctggct

SEQ ID NO: 4570645 - DNA, 22 bp, Homo sapiens
gctctccttcctggagcccaga

SEQ ID NO: 4570646 - DNA, 19 bp, Homo sapiens
gctctctcacctgctccca

SEQ ID NO: 4570647 - DNA, 15 bp, Homo sapiens
gctctctgcagccag

SEQ ID NO: 4570648 - DNA, 20 bp, Homo sapiens
gctctctgcagccagcccag

SEQ ID NO: 4570649 - DNA, 21 bp, Homo sapiens
gctctctgcagccagcccagc

SEQ ID NO: 4570650 - DNA, 15 bp, Homo sapiens
gctctctgtgaccct

SEQ ID NO: 4570651 - DNA, 14 bp, Homo sapiens
gctctcttcaataa

SEQ ID NO: 4570652 - DNA, 14 bp, Homo sapiens
gctctctttctgtc

SEQ ID NO: 4570653 - DNA, 19 bp, Homo sapiens
gctctcttttctgtacttc

SEQ ID NO: 4570654 - DNA, 20 bp, Homo sapiens
gctctgacagaaagcagata

SEQ ID NO: 4570655 - DNA, 16 bp, Homo sapiens
gctctgacagccctgc

SEQ ID NO: 4570656 - DNA, 19 bp, Homo sapiens
gctctgacctcctctgggc

SEQ ID NO: 4570657 - DNA, 19 bp, Homo sapiens
gctctgaccttccagagcc

SEQ ID NO: 4570658 - DNA, 22 bp, Homo sapiens
gctctgatccctctacagagct

SEQ ID NO: 4570659 - DNA, 21 bp, Homo sapiens
gctctgatctgaggctaagac

SEQ ID NO: 4570660 - DNA, 17 bp, Homo sapiens
gctctgcaggctgggga

SEQ ID NO: 4570661 - DNA, 15 bp, Homo sapiens
gctctgcatgcggcc

SEQ ID NO: 4570662 - DNA, 20 bp, Homo sapiens
gctctgcatgcggcccagcc

SEQ ID NO: 4570663 - DNA, 15 bp, Homo sapiens
gctctgcatttgtct

SEQ ID NO: 4570664 - DNA, 15 bp, Homo sapiens
gctctgcccatcctg

SEQ ID NO: 4570665 - DNA, 17 bp, Homo sapiens
gctctgccccctccccc

SEQ ID NO: 4570666 - DNA, 12 bp, Homo sapiens
gctctgccctgg

SEQ ID NO: 4570667 - DNA, 14 bp, Homo sapiens
gctctgccctggaa

SEQ ID NO: 4570668 - DNA, 16 bp, Homo sapiens
gctctgccctggaaag

SEQ ID NO: 4570669 - DNA, 13 bp, Homo sapiens
gctctgcctcaga

SEQ ID NO: 4570670 - DNA, 23 bp, Homo sapiens
gctctgcctcagacgttgcctga

SEQ ID NO: 4570671 - DNA, 23 bp, Homo sapiens
gctctgcctccctctccatatct

SEQ ID NO: 4570672 - DNA, 17 bp, Homo sapiens
gctctgcgtgtcacctg

SEQ ID NO: 4570673 - DNA, 18 bp, Homo sapiens
gctctggacagcagaagc

SEQ ID NO: 4570674 - DNA, 20 bp, Homo sapiens
gctctggacagcagaagcct

SEQ ID NO: 4570675 - DNA, 14 bp, Homo sapiens
gctctggcacagtg

SEQ ID NO: 4570676 - DNA, 15 bp, Homo sapiens
gctctgggggtggga

SEQ ID NO: 4570677 - DNA, 17 bp, Homo sapiens
gctctgggggtgggaag

SEQ ID NO: 4570678 - DNA, 19 bp, Homo sapiens
gctctgggggtgggaagtg

SEQ ID NO: 4570679 - DNA, 17 bp, Homo sapiens
gctctggttatttttct

SEQ ID NO: 4570680 - DNA, 22 bp, Homo sapiens
gctctggttgtttctgttccaa

SEQ ID NO: 4570681 - DNA, 14 bp, Homo sapiens
gctctgtaaaacac

SEQ ID NO: 4570682 - DNA, 19 bp, Homo sapiens
gctctgtatcaggacccag

SEQ ID NO: 4570683 - DNA, 20 bp, Homo sapiens
gctctgtcccccaggctgga

SEQ ID NO: 4570684 - DNA, 19 bp, Homo sapiens
gctctgtcgcccaggctgg

SEQ ID NO: 4570685 - DNA, 22 bp, Homo sapiens
gctctgtgagggtgctgactgg

SEQ ID NO: 4570686 - DNA, 19 bp, Homo sapiens
gctctgtgcagtcactgga

SEQ ID NO: 4570687 - DNA, 14 bp, Homo sapiens
gctctgtgctgacc

SEQ ID NO: 4570688 - DNA, 15 bp, Homo sapiens
gctctgtgtatatct

SEQ ID NO: 4570689 - DNA, 21 bp, Homo sapiens
gctctgtgtatatctcttgga

SEQ ID NO: 4570690 - DNA, 15 bp, Homo sapiens
gctcttagtcccaag

SEQ ID NO: 4570691 - DNA, 16 bp, Homo sapiens
gctcttagtcccaagc

SEQ ID NO: 4570692 - DNA, 18 bp, Homo sapiens
gctcttcaacatgacatc

SEQ ID NO: 4570693 - DNA, 13 bp, Homo sapiens
gctcttctcaggg

SEQ ID NO: 4570694 - DNA, 16 bp, Homo sapiens
gctcttctcatttcac

SEQ ID NO: 4570695 - DNA, 13 bp, Homo sapiens
gctcttctctccc

SEQ ID NO: 4570696 - DNA, 18 bp, Homo sapiens
gctcttctctccccagcc

SEQ ID NO: 4570697 - DNA, 21 bp, Homo sapiens
gctcttctctccccagccccc

SEQ ID NO: 4570698 - DNA, 22 bp, Homo sapiens
gctcttctctccccagccccct

SEQ ID NO: 4570699 - DNA, 13 bp, Homo sapiens
gctcttggcccgg

SEQ ID NO: 4570700 - DNA, 18 bp, Homo sapiens
gctcttggcccggcaggg

SEQ ID NO: 4570701 - DNA, 16 bp, Homo sapiens
gctcttgttctgttcc

SEQ ID NO: 4570702 - DNA, 12 bp, Homo sapiens
gctctttaaata

SEQ ID NO: 4570703 - DNA, 15 bp, Homo sapiens
gctcttttcacagct

SEQ ID NO: 4570704 - DNA, 12 bp, Homo sapiens
gctcttttcctg

SEQ ID NO: 4570705 - DNA, 14 bp, Homo sapiens
gctcttttgtgatg

SEQ ID NO: 4570706 - DNA, 22 bp, Homo sapiens
gctcttttttgtttgtttcttt

SEQ ID NO: 4570707 - DNA, 16 bp, Homo sapiens
gctgaaacaacaaata

SEQ ID NO: 4570708 - DNA, 19 bp, Homo sapiens
gctgaaagtcctgctttcc

SEQ ID NO: 4570709 - DNA, 15 bp, Homo sapiens
gctgaaattttatat

SEQ ID NO: 4570710 - DNA, 15 bp, Homo sapiens
gctgaaccacagaaa

SEQ ID NO: 4570711 - DNA, 16 bp, Homo sapiens
gctgaagatccccaac

SEQ ID NO: 4570712 - DNA, 17 bp, Homo sapiens
gctgaagatccccaact

SEQ ID NO: 4570713 - DNA, 23 bp, Homo sapiens
gctgaagatccccaactgctcca

SEQ ID NO: 4570714 - DNA, 16 bp, Homo sapiens
gctgaagatggagggg

SEQ ID NO: 4570715 - DNA, 22 bp, Homo sapiens
gctgaagatggagggggctggg

SEQ ID NO: 4570716 - DNA, 20 bp, Homo sapiens
gctgaagtcaaaatatgtaa

SEQ ID NO: 4570717 - DNA, 13 bp, Homo sapiens
gctgaattccttt

SEQ ID NO: 4570718 - DNA, 14 bp, Homo sapiens
gctgaattgagaat

SEQ ID NO: 4570719 - DNA, 20 bp, Homo sapiens
gctgaatttacagtagttaa

SEQ ID NO: 4570720 - DNA, 19 bp, Homo sapiens
gctgacaaccattaaagtc

SEQ ID NO: 4570721 - DNA, 22 bp, Homo sapiens
gctgacaaccattaaagtcaga

SEQ ID NO: 4570722 - DNA, 19 bp, Homo sapiens
gctgacagcactaaacttg

SEQ ID NO: 4570723 - DNA, 13 bp, Homo sapiens
gctgacattcact

SEQ ID NO: 4570724 - DNA, 16 bp, Homo sapiens
gctgacccagtccctg

SEQ ID NO: 4570725 - DNA, 22 bp, Homo sapiens
gctgaccctcctgttgcaccca

SEQ ID NO: 4570726 - DNA, 21 bp, Homo sapiens
gctgactatttgacccccaca

SEQ ID NO: 4570727 - DNA, 23 bp, Homo sapiens
gctgactatttgacccccacaac

SEQ ID NO: 4570728 - DNA, 20 bp, Homo sapiens
gctgactggtttctcctggt

SEQ ID NO: 4570729 - DNA, 17 bp, Homo sapiens
gctgacttagcctcctc

SEQ ID NO: 4570730 - DNA, 16 bp, Homo sapiens
gctgagaaggaacagg

SEQ ID NO: 4570731 - DNA, 22 bp, Homo sapiens
gctgagacaggagaatcacctg

SEQ ID NO: 4570732 - DNA, 22 bp, Homo sapiens
gctgagagacccaaggaggaaa

SEQ ID NO: 4570733 - DNA, 13 bp, Homo sapiens
gctgagagccctg

SEQ ID NO: 4570734 - DNA, 14 bp, Homo sapiens
gctgagaggatgaa

SEQ ID NO: 4570735 - DNA, 21 bp, Homo sapiens
gctgagcacccagctctgtct

SEQ ID NO: 4570736 - DNA, 14 bp, Homo sapiens
gctgagcagcctct

SEQ ID NO: 4570737 - DNA, 17 bp, Homo sapiens
gctgagcagcctctgga

SEQ ID NO: 4570738 - DNA, 20 bp, Homo sapiens
gctgagcagcctctggacag

SEQ ID NO: 4570739 - DNA, 12 bp, Homo sapiens
gctgagccagct

SEQ ID NO: 4570740 - DNA, 15 bp, Homo sapiens
gctgagccagctgca

SEQ ID NO: 4570741 - DNA, 13 bp, Homo sapiens
gctgagccctgcc

SEQ ID NO: 4570742 - DNA, 23 bp, Homo sapiens
gctgagcgaggagatgctccttg

SEQ ID NO: 4570743 - DNA, 12 bp, Homo sapiens
gctgagcgcccc

SEQ ID NO: 4570744 - DNA, 21 bp, Homo sapiens
gctgaggaggcctccatctca

SEQ ID NO: 4570745 - DNA, 23 bp, Homo sapiens
gctgaggcagcagtgtgaggcca

SEQ ID NO: 4570746 - DNA, 14 bp, Homo sapiens
gctgaggccagagt

SEQ ID NO: 4570747 - DNA, 17 bp, Homo sapiens
gctgaggggtctcggat

SEQ ID NO: 4570748 - DNA, 21 bp, Homo sapiens
gctgaggggtctcggatgaca

SEQ ID NO: 4570749 - DNA, 16 bp, Homo sapiens
gctgaggttcctctgc

SEQ ID NO: 4570750 - DNA, 17 bp, Homo sapiens
gctgaggttcctctgcc

SEQ ID NO: 4570751 - DNA, 18 bp, Homo sapiens
gctgaggttcctctgcct

SEQ ID NO: 4570752 - DNA, 15 bp, Homo sapiens
gctgagtaaacataa

SEQ ID NO: 4570753 - DNA, 18 bp, Homo sapiens
gctgagtccctccatgca

SEQ ID NO: 4570754 - DNA, 14 bp, Homo sapiens
gctgagtctccagg

SEQ ID NO: 4570755 - DNA, 15 bp, Homo sapiens
gctgagtctccaggg

SEQ ID NO: 4570756 - DNA, 18 bp, Homo sapiens
gctgagtctccagggccc

SEQ ID NO: 4570757 - DNA, 15 bp, Homo sapiens
gctgagttggcctgg

SEQ ID NO: 4570758 - DNA, 15 bp, Homo sapiens
gctgataattttaaa

SEQ ID NO: 4570759 - DNA, 19 bp, Homo sapiens
gctgataattttaaattct

SEQ ID NO: 4570760 - DNA, 17 bp, Homo sapiens
gctgattatttatgacc

SEQ ID NO: 4570761 - DNA, 14 bp, Homo sapiens
gctgattcttgtaa

SEQ ID NO: 4570762 - DNA, 21 bp, Homo sapiens
gctgattcttgtaaatctttt

SEQ ID NO: 4570763 - DNA, 11 bp, Homo sapiens
gctgcaaagtg

SEQ ID NO: 4570764 - DNA, 15 bp, Homo sapiens
gctgcaacaaaatgt

SEQ ID NO: 4570765 - DNA, 20 bp, Homo sapiens
gctgcaacaagctcatccct

SEQ ID NO: 4570766 - DNA, 18 bp, Homo sapiens
gctgcaatccatttattt

SEQ ID NO: 4570767 - DNA, 17 bp, Homo sapiens
gctgcacagggcagctg

SEQ ID NO: 4570768 - DNA, 20 bp, Homo sapiens
gctgcacagggcagctgggc

SEQ ID NO: 4570769 - DNA, 21 bp, Homo sapiens
gctgcacagggcagctgggcc

SEQ ID NO: 4570770 - DNA, 11 bp, Homo sapiens
gctgcactgtg

SEQ ID NO: 4570771 - DNA, 12 bp, Homo sapiens
gctgcactgtga

SEQ ID NO: 4570772 - DNA, 13 bp, Homo sapiens
gctgcactgtgaa

SEQ ID NO: 4570773 - DNA, 14 bp, Homo sapiens
gctgcactgtgaac

SEQ ID NO: 4570774 - DNA, 21 bp, Homo sapiens
gctgcactgtgaacctgggca

SEQ ID NO: 4570775 - DNA, 18 bp, Homo sapiens
gctgcagcatgaaggcag

SEQ ID NO: 4570776 - DNA, 16 bp, Homo sapiens
gctgcagctccctggc

SEQ ID NO: 4570777 - DNA, 19 bp, Homo sapiens
gctgcagctccctggcttc

SEQ ID NO: 4570778 - DNA, 23 bp, Homo sapiens
gctgcagctccctggcttctgtg

SEQ ID NO: 4570779 - DNA, 13 bp, Homo sapiens
gctgcagtcagcc

SEQ ID NO: 4570780 - DNA, 14 bp, Homo sapiens
gctgcagtcatcta

SEQ ID NO: 4570781 - DNA, 21 bp, Homo sapiens
gctgcatgacctaccaggaca

SEQ ID NO: 4570782 - DNA, 13 bp, Homo sapiens
gctgccacccgcc

SEQ ID NO: 4570783 - DNA, 21 bp, Homo sapiens
gctgccagccttgagccctgg

SEQ ID NO: 4570784 - DNA, 17 bp, Homo sapiens
gctgccagtgcagccac

SEQ ID NO: 4570785 - DNA, 22 bp, Homo sapiens
gctgccagtgcagccactggct

SEQ ID NO: 4570786 - DNA, 14 bp, Homo sapiens
gctgccagtgcctg

SEQ ID NO: 4570787 - DNA, 21 bp, Homo sapiens
gctgcccagcagcccctgaga

SEQ ID NO: 4570788 - DNA, 15 bp, Homo sapiens
gctgcccagccctgg

SEQ ID NO: 4570789 - DNA, 16 bp, Homo sapiens
gctgcccaggagacag

SEQ ID NO: 4570790 - DNA, 22 bp, Homo sapiens
gctgcccaggcctctcggtgct

SEQ ID NO: 4570791 - DNA, 12 bp, Homo sapiens
gctgccccagcc

SEQ ID NO: 4570792 - DNA, 20 bp, Homo sapiens
gctgcccccaccccggggac

SEQ ID NO: 4570793 - DNA, 18 bp, Homo sapiens
gctgcccccggccccctg

SEQ ID NO: 4570794 - DNA, 13 bp, Homo sapiens
gctgccccggccc

SEQ ID NO: 4570795 - DNA, 15 bp, Homo sapiens
gctgcccctctcacc

SEQ ID NO: 4570796 - DNA, 16 bp, Homo sapiens
gctgcccctctcacca

SEQ ID NO: 4570797 - DNA, 13 bp, Homo sapiens
gctgcccctgtct

SEQ ID NO: 4570798 - DNA, 23 bp, Homo sapiens
gctgcccgcgggagacagcttct

SEQ ID NO: 4570799 - DNA, 21 bp, Homo sapiens
gctgcccttatgcccggcgcc

SEQ ID NO: 4570800 - DNA, 19 bp, Homo sapiens
gctgcccttgcagggtggg

SEQ ID NO: 4570801 - DNA, 13 bp, Homo sapiens
gctgccgagggct

SEQ ID NO: 4570802 - DNA, 14 bp, Homo sapiens
gctgccgagggctg

SEQ ID NO: 4570803 - DNA, 16 bp, Homo sapiens
gctgccgagggctggc

SEQ ID NO: 4570804 - DNA, 20 bp, Homo sapiens
gctgccgagggctggccggg

SEQ ID NO: 4570805 - DNA, 14 bp, Homo sapiens
gctgccgcacccca

SEQ ID NO: 4570806 - DNA, 22 bp, Homo sapiens
gctgccgcaccccagagtgtgg

SEQ ID NO: 4570807 - DNA, 17 bp, Homo sapiens
gctgccgctgccgctgc

SEQ ID NO: 4570808 - DNA, 22 bp, Homo sapiens
gctgcctaaatccactctgcag

SEQ ID NO: 4570809 - DNA, 16 bp, Homo sapiens
gctgcctaagtggctg

SEQ ID NO: 4570810 - DNA, 22 bp, Homo sapiens
gctgcctcccaacagtggggaa

SEQ ID NO: 4570811 - DNA, 15 bp, Homo sapiens
gctgcctcctgccct

SEQ ID NO: 4570812 - DNA, 15 bp, Homo sapiens
gctgcctcctgcgcc

SEQ ID NO: 4570813 - DNA, 22 bp, Homo sapiens
gctgcctcgtagagtgacctcg

SEQ ID NO: 4570814 - DNA, 21 bp, Homo sapiens
gctgcctctacctgacactcc

SEQ ID NO: 4570815 - DNA, 12 bp, Homo sapiens
gctgcctctgct

SEQ ID NO: 4570816 - DNA, 13 bp, Homo sapiens
gctgcctctgctc

SEQ ID NO: 4570817 - DNA, 16 bp, Homo sapiens
gctgcctctgctccct

SEQ ID NO: 4570818 - DNA, 22 bp, Homo sapiens
gctgcctgcgcccaccccgctc

SEQ ID NO: 4570819 - DNA, 20 bp, Homo sapiens
gctgcctttggacttgtccc

SEQ ID NO: 4570820 - DNA, 18 bp, Homo sapiens
gctgcgacgcttgctctg

SEQ ID NO: 4570821 - DNA, 21 bp, Homo sapiens
gctgcgcctgcaggcagagct

SEQ ID NO: 4570822 - DNA, 16 bp, Homo sapiens
gctgcggccaggcctg

SEQ ID NO: 4570823 - DNA, 18 bp, Homo sapiens
gctgctaaatctcctatt

SEQ ID NO: 4570824 - DNA, 17 bp, Homo sapiens
gctgctatccccatctc

SEQ ID NO: 4570825 - DNA, 22 bp, Homo sapiens
gctgctatccccatctccctgc

SEQ ID NO: 4570826 - DNA, 23 bp, Homo sapiens
gctgctatccccatctccctgcc

SEQ ID NO: 4570827 - DNA, 17 bp, Homo sapiens
gctgctcacccacctct

SEQ ID NO: 4570828 - DNA, 23 bp, Homo sapiens
gctgctcacccacctcttgtgca

SEQ ID NO: 4570829 - DNA, 21 bp, Homo sapiens
gctgctccccaacacctgcct

SEQ ID NO: 4570830 - DNA, 20 bp, Homo sapiens
gctgctccgaggacccagga

SEQ ID NO: 4570831 - DNA, 22 bp, Homo sapiens
gctgctcctaggacccgtctcc

SEQ ID NO: 4570832 - DNA, 13 bp, Homo sapiens
gctgctcctcatg

SEQ ID NO: 4570833 - DNA, 11 bp, Homo sapiens
gctgctcctcc

SEQ ID NO: 4570834 - DNA, 17 bp, Homo sapiens
gctgctctcccaagggt

SEQ ID NO: 4570835 - DNA, 23 bp, Homo sapiens
gctgctctccttcactctgacag

SEQ ID NO: 4570836 - DNA, 13 bp, Homo sapiens
gctgctctgggaa

SEQ ID NO: 4570837 - DNA, 18 bp, Homo sapiens
gctgctgccatgtctcag

SEQ ID NO: 4570838 - DNA, 13 bp, Homo sapiens
gctgctggatgac

SEQ ID NO: 4570839 - DNA, 12 bp, Homo sapiens
gctgctggcgcc

SEQ ID NO: 4570840 - DNA, 19 bp, Homo sapiens
gctgctggcgcctctgcaa

SEQ ID NO: 4570841 - DNA, 19 bp, Homo sapiens
gctgctgggacttgaacaa

SEQ ID NO: 4570842 - DNA, 21 bp, Homo sapiens
gctgctgtctgagtagtggcc

SEQ ID NO: 4570843 - DNA, 22 bp, Homo sapiens
gctgctgtctgagtagtggcca

SEQ ID NO: 4570844 - DNA, 22 bp, Homo sapiens
gctgctgtgtgctttttttgtg

SEQ ID NO: 4570845 - DNA, 24 bp, Homo sapiens
gctgctgtgtgtgagcagtggaca

SEQ ID NO: 4570846 - DNA, 15 bp, Homo sapiens
gctgctgttctcagg

SEQ ID NO: 4570847 - DNA, 16 bp, Homo sapiens
gctgctgttctcagga

SEQ ID NO: 4570848 - DNA, 17 bp, Homo sapiens
gctgctgttctcaggac

SEQ ID NO: 4570849 - DNA, 20 bp, Homo sapiens
gctgctgttctcaggacagc

SEQ ID NO: 4570850 - DNA, 13 bp, Homo sapiens
gctgcttccagtg

SEQ ID NO: 4570851 - DNA, 14 bp, Homo sapiens
gctgcttgtcctgg

SEQ ID NO: 4570852 - DNA, 13 bp, Homo sapiens
gctggaacacagg

SEQ ID NO: 4570853 - DNA, 15 bp, Homo sapiens
gctggaacacagggg

SEQ ID NO: 4570854 - DNA, 20 bp, Homo sapiens
gctggaacacaggggccttt

SEQ ID NO: 4570855 - DNA, 21 bp, Homo sapiens
gctggaacctgcaaaaaatac

SEQ ID NO: 4570856 - DNA, 16 bp, Homo sapiens
gctggaagaaccactg

SEQ ID NO: 4570857 - DNA, 14 bp, Homo sapiens
gctggaaggcagca

SEQ ID NO: 4570858 - DNA, 19 bp, Homo sapiens
gctggaatctggagagcta

SEQ ID NO: 4570859 - DNA, 16 bp, Homo sapiens
gctggaatgtgccaca

SEQ ID NO: 4570860 - DNA, 17 bp, Homo sapiens
gctggaatgtgccacag

SEQ ID NO: 4570861 - DNA, 20 bp, Homo sapiens
gctggaatgtgccacagagg

SEQ ID NO: 4570862 - DNA, 23 bp, Homo sapiens
gctggaatgtgccacagaggccc

SEQ ID NO: 4570863 - DNA, 17 bp, Homo sapiens
gctggactgaggcctga

SEQ ID NO: 4570864 - DNA, 17 bp, Homo sapiens
gctggactgttccaggc

SEQ ID NO: 4570865 - DNA, 19 bp, Homo sapiens
gctggactgttccaggccc

SEQ ID NO: 4570866 - DNA, 20 bp, Homo sapiens
gctggagaataaatttggga

SEQ ID NO: 4570867 - DNA, 13 bp, Homo sapiens
gctggagccccca

SEQ ID NO: 4570868 - DNA, 15 bp, Homo sapiens
gctggagctcctccc

SEQ ID NO: 4570869 - DNA, 14 bp, Homo sapiens
gctggagctctgcc

SEQ ID NO: 4570870 - DNA, 21 bp, Homo sapiens
gctggaggactagaacctgga

SEQ ID NO: 4570871 - DNA, 19 bp, Homo sapiens
gctggaggagcagcagctt

SEQ ID NO: 4570872 - DNA, 22 bp, Homo sapiens
gctggaggagcagcagcttggg

SEQ ID NO: 4570873 - DNA, 14 bp, Homo sapiens
gctggaggcagggc

SEQ ID NO: 4570874 - DNA, 16 bp, Homo sapiens
gctggaggcagggcct

SEQ ID NO: 4570875 - DNA, 13 bp, Homo sapiens
gctggaggcccag

SEQ ID NO: 4570876 - DNA, 14 bp, Homo sapiens
gctggaggcccagg

SEQ ID NO: 4570877 - DNA, 16 bp, Homo sapiens
gctggaggcccaggct

SEQ ID NO: 4570878 - DNA, 16 bp, Homo sapiens
gctggaggggtggccc

SEQ ID NO: 4570879 - DNA, 22 bp, Homo sapiens
gctggaggggtggcccagagcc

SEQ ID NO: 4570880 - DNA, 15 bp, Homo sapiens
gctggagtaatcaga

SEQ ID NO: 4570881 - DNA, 15 bp, Homo sapiens
gctggagtgcagtgg

SEQ ID NO: 4570882 - DNA, 20 bp, Homo sapiens
gctggagtgcagtggtgcca

SEQ ID NO: 4570883 - DNA, 14 bp, Homo sapiens
gctggatcgctgca

SEQ ID NO: 4570884 - DNA, 20 bp, Homo sapiens
gctggatctgtagtgatgga

SEQ ID NO: 4570885 - DNA, 13 bp, Homo sapiens
gctggatctgtga

SEQ ID NO: 4570886 - DNA, 15 bp, Homo sapiens
gctggattgtgcttt

SEQ ID NO: 4570887 - DNA, 19 bp, Homo sapiens
gctggcaacacagaggcag

SEQ ID NO: 4570888 - DNA, 17 bp, Homo sapiens
gctggcacagcccctgg

SEQ ID NO: 4570889 - DNA, 18 bp, Homo sapiens
gctggcacagcccctgga

SEQ ID NO: 4570890 - DNA, 16 bp, Homo sapiens
gctggcacccaccgtg

SEQ ID NO: 4570891 - DNA, 15 bp, Homo sapiens
gctggcagctgagag

SEQ ID NO: 4570892 - DNA, 17 bp, Homo sapiens
gctggcagtcctggaag

SEQ ID NO: 4570893 - DNA, 13 bp, Homo sapiens
gctggccagcacc

SEQ ID NO: 4570894 - DNA, 17 bp, Homo sapiens
gctggccagcaccctct

SEQ ID NO: 4570895 - DNA, 15 bp, Homo sapiens
gctggcccacccagt

SEQ ID NO: 4570896 - DNA, 14 bp, Homo sapiens
gctggcccagccct

SEQ ID NO: 4570897 - DNA, 20 bp, Homo sapiens
gctggcccagccctgctggc

SEQ ID NO: 4570898 - DNA, 20 bp, Homo sapiens
gctggccccgcccctgcccc

SEQ ID NO: 4570899 - DNA, 22 bp, Homo sapiens
gctggcccttagagaccccgag

SEQ ID NO: 4570900 - DNA, 19 bp, Homo sapiens
gctggccgagggtcctggc

SEQ ID NO: 4570901 - DNA, 18 bp, Homo sapiens
gctggccgggactgctgc

SEQ ID NO: 4570902 - DNA, 21 bp, Homo sapiens
gctggccgggactgctgctct

SEQ ID NO: 4570903 - DNA, 21 bp, Homo sapiens
gctggcctcacccacccctgc

SEQ ID NO: 4570904 - DNA, 20 bp, Homo sapiens
gctggcgacacactccgtcc

SEQ ID NO: 4570905 - DNA, 12 bp, Homo sapiens
gctggcgcctct

SEQ ID NO: 4570906 - DNA, 15 bp, Homo sapiens
gctggcgctcagcag

SEQ ID NO: 4570907 - DNA, 18 bp, Homo sapiens
gctggcgctcagcagccc

SEQ ID NO: 4570908 - DNA, 21 bp, Homo sapiens
gctggcggctactcagcagcc

SEQ ID NO: 4570909 - DNA, 20 bp, Homo sapiens
gctggctccccctccccagg

SEQ ID NO: 4570910 - DNA, 23 bp, Homo sapiens
gctggctccccctccccaggctg

SEQ ID NO: 4570911 - DNA, 21 bp, Homo sapiens
gctggctctaccttcctgtcc

SEQ ID NO: 4570912 - DNA, 19 bp, Homo sapiens
gctggctctgtgagggtgc

SEQ ID NO: 4570913 - DNA, 18 bp, Homo sapiens
gctggctcttctgcccaa

SEQ ID NO: 4570914 - DNA, 20 bp, Homo sapiens
gctggctttgaaacctcagg

SEQ ID NO: 4570915 - DNA, 15 bp, Homo sapiens
gctgggaagaatgta

SEQ ID NO: 4570916 - DNA, 16 bp, Homo sapiens
gctgggaggagggaga

SEQ ID NO: 4570917 - DNA, 21 bp, Homo sapiens
gctgggagtccctacctgctt

SEQ ID NO: 4570918 - DNA, 16 bp, Homo sapiens
gctgggcaaggaaaaa

SEQ ID NO: 4570919 - DNA, 17 bp, Homo sapiens
gctgggcagagggaggt

SEQ ID NO: 4570920 - DNA, 16 bp, Homo sapiens
gctgggccaccaggga

SEQ ID NO: 4570921 - DNA, 13 bp, Homo sapiens
gctgggccactgg

SEQ ID NO: 4570922 - DNA, 17 bp, Homo sapiens
gctgggccactggggac

SEQ ID NO: 4570923 - DNA, 19 bp, Homo sapiens
gctgggcccaaccctgtct

SEQ ID NO: 4570924 - DNA, 12 bp, Homo sapiens
gctgggcccctc

SEQ ID NO: 4570925 - DNA, 17 bp, Homo sapiens
gctgggcccctccagga

SEQ ID NO: 4570926 - DNA, 17 bp, Homo sapiens
gctgggcccctgcacag

SEQ ID NO: 4570927 - DNA, 14 bp, Homo sapiens
gctgggcccctggg

SEQ ID NO: 4570928 - DNA, 23 bp, Homo sapiens
gctgggcccctgggatgggacca

SEQ ID NO: 4570929 - DNA, 12 bp, Homo sapiens
gctgggccctgc

SEQ ID NO: 4570930 - DNA, 14 bp, Homo sapiens
gctgggccctgcct

SEQ ID NO: 4570931 - DNA, 18 bp, Homo sapiens
gctgggccctgcctgcag

SEQ ID NO: 4570932 - DNA, 22 bp, Homo sapiens
gctgggctaccccccctcctgc

SEQ ID NO: 4570933 - DNA, 13 bp, Homo sapiens
gctgggctctcca

SEQ ID NO: 4570934 - DNA, 21 bp, Homo sapiens
gctgggctctccacctcagcc

SEQ ID NO: 4570935 - DNA, 22 bp, Homo sapiens
gctgggctctccacctcagcct

SEQ ID NO: 4570936 - DNA, 19 bp, Homo sapiens
gctggggaagaacagcccc

SEQ ID NO: 4570937 - DNA, 22 bp, Homo sapiens
gctggggacggggggccccagt

SEQ ID NO: 4570938 - DNA, 23 bp, Homo sapiens
gctggggacggggggccccagtc

SEQ ID NO: 4570939 - DNA, 15 bp, Homo sapiens
gctggggactcaggg

SEQ ID NO: 4570940 - DNA, 14 bp, Homo sapiens
gctggggatgtctc

SEQ ID NO: 4570941 - DNA, 19 bp, Homo sapiens
gctggggccacctttgtgc

SEQ ID NO: 4570942 - DNA, 15 bp, Homo sapiens
gctggggccccatct

SEQ ID NO: 4570943 - DNA, 20 bp, Homo sapiens
gctggggttgccagaggccc

SEQ ID NO: 4570944 - DNA, 22 bp, Homo sapiens
gctggggttgccagaggccctg

SEQ ID NO: 4570945 - DNA, 15 bp, Homo sapiens
gctgggtattggaaa

SEQ ID NO: 4570946 - DNA, 16 bp, Homo sapiens
gctgggtcctgccagc

SEQ ID NO: 4570947 - DNA, 19 bp, Homo sapiens
gctgggtcctgccagctgg

SEQ ID NO: 4570948 - DNA, 21 bp, Homo sapiens
gctgggtctgaggcccctgcc

SEQ ID NO: 4570949 - DNA, 13 bp, Homo sapiens
gctgggtgtttca

SEQ ID NO: 4570950 - DNA, 18 bp, Homo sapiens
gctggtagagacccccag

SEQ ID NO: 4570951 - DNA, 16 bp, Homo sapiens
gctggtagcagcaggc

SEQ ID NO: 4570952 - DNA, 18 bp, Homo sapiens
gctggtcacagcctcctc

SEQ ID NO: 4570953 - DNA, 18 bp, Homo sapiens
gctggtccttatttattt

SEQ ID NO: 4570954 - DNA, 24 bp, Homo sapiens
gctggtctcaaacttgtggcctca

SEQ ID NO: 4570955 - DNA, 13 bp, Homo sapiens
gctggtgcccgga

SEQ ID NO: 4570956 - DNA, 14 bp, Homo sapiens
gctggtgcccggag

SEQ ID NO: 4570957 - DNA, 19 bp, Homo sapiens
gctggtggaggaagggctg

SEQ ID NO: 4570958 - DNA, 20 bp, Homo sapiens
gctggtggaggaagggctgg

SEQ ID NO: 4570959 - DNA, 22 bp, Homo sapiens
gctggtggaggaagggctgggc

SEQ ID NO: 4570960 - DNA, 21 bp, Homo sapiens
gctggtgtgtcatactgtgca

SEQ ID NO: 4570961 - DNA, 15 bp, Homo sapiens
gctggtttaatgttt

SEQ ID NO: 4570962 - DNA, 13 bp, Homo sapiens
gctggttttgctt

SEQ ID NO: 4570963 - DNA, 22 bp, Homo sapiens
gctggttttgcttccccgtgca

SEQ ID NO: 4570964 - DNA, 18 bp, Homo sapiens
gctgtaaaatttgtgtaa

SEQ ID NO: 4570965 - DNA, 23 bp, Homo sapiens
gctgtaaggatccggaaagaaga

SEQ ID NO: 4570966 - DNA, 21 bp, Homo sapiens
gctgtaatttcgccttaaact

SEQ ID NO: 4570967 - DNA, 18 bp, Homo sapiens
gctgtacaaatcctctgt

SEQ ID NO: 4570968 - DNA, 20 bp, Homo sapiens
gctgtacatctattttggat

SEQ ID NO: 4570969 - DNA, 18 bp, Homo sapiens
gctgtacttcttgaatat

SEQ ID NO: 4570970 - DNA, 20 bp, Homo sapiens
gctgtacttcttgaatataa

SEQ ID NO: 4570971 - DNA, 14 bp, Homo sapiens
gctgtatctgtgct

SEQ ID NO: 4570972 - DNA, 15 bp, Homo sapiens
gctgtattttgatat

SEQ ID NO: 4570973 - DNA, 17 bp, Homo sapiens
gctgtattttgatataa

SEQ ID NO: 4570974 - DNA, 15 bp, Homo sapiens
gctgtatttttacag

SEQ ID NO: 4570975 - DNA, 21 bp, Homo sapiens
gctgtcaaaactactgacagg

SEQ ID NO: 4570976 - DNA, 14 bp, Homo sapiens
gctgtcacatacaa

SEQ ID NO: 4570977 - DNA, 21 bp, Homo sapiens
gctgtcacctctcagctgctg

SEQ ID NO: 4570978 - DNA, 22 bp, Homo sapiens
gctgtcatggtcctttctggaa

SEQ ID NO: 4570979 - DNA, 16 bp, Homo sapiens
gctgtccagacagcct

SEQ ID NO: 4570980 - DNA, 14 bp, Homo sapiens
gctgtcccagcccc

SEQ ID NO: 4570981 - DNA, 18 bp, Homo sapiens
gctgtccccactgcccca

SEQ ID NO: 4570982 - DNA, 18 bp, Homo sapiens
gctgtccctgtcaccaag

SEQ ID NO: 4570983 - DNA, 18 bp, Homo sapiens
gctgtcgccccaggccct

SEQ ID NO: 4570984 - DNA, 18 bp, Homo sapiens
gctgtctgagtagtggcc

SEQ ID NO: 4570985 - DNA, 20 bp, Homo sapiens
gctgtctgagtagtggccac

SEQ ID NO: 4570986 - DNA, 21 bp, Homo sapiens
gctgtctgagtagtggccact

SEQ ID NO: 4570987 - DNA, 23 bp, Homo sapiens
gctgtctgagtagtggccactgg

SEQ ID NO: 4570988 - DNA, 19 bp, Homo sapiens
gctgtctgatctgtgcttt

SEQ ID NO: 4570989 - DNA, 13 bp, Homo sapiens
gctgtctggccag

SEQ ID NO: 4570990 - DNA, 14 bp, Homo sapiens
gctgtctgggactc

SEQ ID NO: 4570991 - DNA, 21 bp, Homo sapiens
gctgtctgtcaccagctatct

SEQ ID NO: 4570992 - DNA, 12 bp, Homo sapiens
gctgtgaatctg

SEQ ID NO: 4570993 - DNA, 18 bp, Homo sapiens
gctgtgaatgccaaagcc

SEQ ID NO: 4570994 - DNA, 14 bp, Homo sapiens
gctgtgataaccag

SEQ ID NO: 4570995 - DNA, 17 bp, Homo sapiens
gctgtgccatgctgggc

SEQ ID NO: 4570996 - DNA, 16 bp, Homo sapiens
gctgtgccgaggcttg

SEQ ID NO: 4570997 - DNA, 22 bp, Homo sapiens
gctgtgccgaggcttgggctcc

SEQ ID NO: 4570998 - DNA, 20 bp, Homo sapiens
gctgtgccgggaggcagcca

SEQ ID NO: 4570999 - DNA, 15 bp, Homo sapiens
gctgtgcgctgctct

SEQ ID NO: 4571000 - DNA, 13 bp, Homo sapiens
gctgtgctgctca

SEQ ID NO: 4571001 - DNA, 13 bp, Homo sapiens
gctgtgctgtgga

SEQ ID NO: 4571002 - DNA, 15 bp, Homo sapiens
gctgtggaagcaaca

SEQ ID NO: 4571003 - DNA, 22 bp, Homo sapiens
gctgtggccggtgccagctgcc

SEQ ID NO: 4571004 - DNA, 23 bp, Homo sapiens
gctgtggccggtgccagctgccc

SEQ ID NO: 4571005 - DNA, 22 bp, Homo sapiens
gctgtggccgtctcctccctca

SEQ ID NO: 4571006 - DNA, 20 bp, Homo sapiens
gctgtggcctaacctgccga

SEQ ID NO: 4571007 - DNA, 14 bp, Homo sapiens
gctgtgggcagcac

SEQ ID NO: 4571008 - DNA, 19 bp, Homo sapiens
gctgtgggcggctcctggt

SEQ ID NO: 4571009 - DNA, 22 bp, Homo sapiens
gctgtgggcggctcctggtgct

SEQ ID NO: 4571010 - DNA, 23 bp, Homo sapiens
gctgtggtgtgtccccctctgtc

SEQ ID NO: 4571011 - DNA, 18 bp, Homo sapiens
gctgtgtccttgcacctg

SEQ ID NO: 4571012 - DNA, 19 bp, Homo sapiens
gctgtgtccttgcacctgc

SEQ ID NO: 4571013 - DNA, 16 bp, Homo sapiens
gctgtgtgtgtgttca

SEQ ID NO: 4571014 - DNA, 22 bp, Homo sapiens
gctgtgtttatatggaagaaag

SEQ ID NO: 4571015 - DNA, 15 bp, Homo sapiens
gctgttaaatacagg

SEQ ID NO: 4571016 - DNA, 14 bp, Homo sapiens
gctgttaggacagc

SEQ ID NO: 4571017 - DNA, 19 bp, Homo sapiens
gctgttatttcttccctgc

SEQ ID NO: 4571018 - DNA, 22 bp, Homo sapiens
gctgttatttcttccctgcttt

SEQ ID NO: 4571019 - DNA, 16 bp, Homo sapiens
gctgttcacagccaga

SEQ ID NO: 4571020 - DNA, 23 bp, Homo sapiens
gctgttcacagccagactggcac

SEQ ID NO: 4571021 - DNA, 20 bp, Homo sapiens
gctgttcacccacagggcta

SEQ ID NO: 4571022 - DNA, 14 bp, Homo sapiens
gctgttccagactc

SEQ ID NO: 4571023 - DNA, 18 bp, Homo sapiens
gctgttccagactcaggt

SEQ ID NO: 4571024 - DNA, 12 bp, Homo sapiens
gctgttctcagc

SEQ ID NO: 4571025 - DNA, 16 bp, Homo sapiens
gctgttctcaggacag

SEQ ID NO: 4571026 - DNA, 16 bp, Homo sapiens
gctgttgaagtctcag

SEQ ID NO: 4571027 - DNA, 19 bp, Homo sapiens
gctgttgacatatttaatg

SEQ ID NO: 4571028 - DNA, 23 bp, Homo sapiens
gctgttgacatatttaatgtttt

SEQ ID NO: 4571029 - DNA, 16 bp, Homo sapiens
gctgttgggtttttgc

SEQ ID NO: 4571030 - DNA, 22 bp, Homo sapiens
gctgtttaaagtcacatccctg

SEQ ID NO: 4571031 - DNA, 17 bp, Homo sapiens
gctgtttatgtttttat

SEQ ID NO: 4571032 - DNA, 19 bp, Homo sapiens
gctgtttgagattctcaaa

SEQ ID NO: 4571033 - DNA, 12 bp, Homo sapiens
gctgtttggaaa

SEQ ID NO: 4571034 - DNA, 21 bp, Homo sapiens
gctgtttgtttgacaaagaaa

SEQ ID NO: 4571035 - DNA, 18 bp, Homo sapiens
gctgttttccctctgctg

SEQ ID NO: 4571036 - DNA, 13 bp, Homo sapiens
gcttaaaaatact

SEQ ID NO: 4571037 - DNA, 17 bp, Homo sapiens
gcttaaaaatacttcta

SEQ ID NO: 4571038 - DNA, 12 bp, Homo sapiens
gcttaaaacttt

SEQ ID NO: 4571039 - DNA, 13 bp, Homo sapiens
gcttaaaactttg

SEQ ID NO: 4571040 - DNA, 15 bp, Homo sapiens
gcttaaaatatgtga

SEQ ID NO: 4571041 - DNA, 19 bp, Homo sapiens
gcttaaacccatacaatgt

SEQ ID NO: 4571042 - DNA, 22 bp, Homo sapiens
gcttaaacttgacccaggtggc

SEQ ID NO: 4571043 - DNA, 11 bp, Homo sapiens
gcttaaagctt

SEQ ID NO: 4571044 - DNA, 17 bp, Homo sapiens
gcttaaaggtgtcttcc

SEQ ID NO: 4571045 - DNA, 22 bp, Homo sapiens
gcttaaaggtgtcttcctccca

SEQ ID NO: 4571046 - DNA, 14 bp, Homo sapiens
gcttaaatttcaga

SEQ ID NO: 4571047 - DNA, 13 bp, Homo sapiens
gcttaaatttctt

SEQ ID NO: 4571048 - DNA, 21 bp, Homo sapiens
gcttaaatttcttatgtgaca

SEQ ID NO: 4571049 - DNA, 14 bp, Homo sapiens
gcttaaattttaac

SEQ ID NO: 4571050 - DNA, 16 bp, Homo sapiens
gcttaagtgtaaatga

SEQ ID NO: 4571051 - DNA, 18 bp, Homo sapiens
gcttaagtgtaaatgaag

SEQ ID NO: 4571052 - DNA, 21 bp, Homo sapiens
gcttagatgttccaaatttag

SEQ ID NO: 4571053 - DNA, 20 bp, Homo sapiens
gcttagctcaattagtgtgg

SEQ ID NO: 4571054 - DNA, 21 bp, Homo sapiens
gcttaggagaagtcttctatt

SEQ ID NO: 4571055 - DNA, 23 bp, Homo sapiens
gcttaggatgggggatgtggcca

SEQ ID NO: 4571056 - DNA, 15 bp, Homo sapiens
gcttagtaaaattta

SEQ ID NO: 4571057 - DNA, 16 bp, Homo sapiens
gcttagtaaaatttat

SEQ ID NO: 4571058 - DNA, 19 bp, Homo sapiens
gcttagtaagtatttccat

SEQ ID NO: 4571059 - DNA, 19 bp, Homo sapiens
gcttagtgtgaagttgata

SEQ ID NO: 4571060 - DNA, 11 bp, Homo sapiens
gcttatatctg

SEQ ID NO: 4571061 - DNA, 15 bp, Homo sapiens
gcttatatctggcct

SEQ ID NO: 4571062 - DNA, 15 bp, Homo sapiens
gcttatatgtacttt

SEQ ID NO: 4571063 - DNA, 22 bp, Homo sapiens
gcttatatgtacttttattttt

SEQ ID NO: 4571064 - DNA, 17 bp, Homo sapiens
gcttatctgcccctccc

SEQ ID NO: 4571065 - DNA, 18 bp, Homo sapiens
gcttatctgcccctcccc

SEQ ID NO: 4571066 - DNA, 17 bp, Homo sapiens
gcttatgagatactttg

SEQ ID NO: 4571067 - DNA, 18 bp, Homo sapiens
gcttatgagatactttgc

SEQ ID NO: 4571068 - DNA, 21 bp, Homo sapiens
gcttatgtagctttttattat

SEQ ID NO: 4571069 - DNA, 13 bp, Homo sapiens
gcttatgtcatca

SEQ ID NO: 4571070 - DNA, 17 bp, Homo sapiens
gcttattgcttagtaaa

SEQ ID NO: 4571071 - DNA, 18 bp, Homo sapiens
gcttcaatataagaagca

SEQ ID NO: 4571072 - DNA, 17 bp, Homo sapiens
gcttcaatttcaaactt

SEQ ID NO: 4571073 - DNA, 20 bp, Homo sapiens
gcttcacaaaatgcacttct

SEQ ID NO: 4571074 - DNA, 17 bp, Homo sapiens
gcttcaggttgcattgg

SEQ ID NO: 4571075 - DNA, 18 bp, Homo sapiens
gcttcatctgtgggatgc

SEQ ID NO: 4571076 - DNA, 21 bp, Homo sapiens
gcttcatctgtgggatgctga

SEQ ID NO: 4571077 - DNA, 22 bp, Homo sapiens
gcttcatctgtgggatgctgaa

SEQ ID NO: 4571078 - DNA, 17 bp, Homo sapiens
gcttcatgtggcttccc

SEQ ID NO: 4571079 - DNA, 13 bp, Homo sapiens
gcttccacaaaat

SEQ ID NO: 4571080 - DNA, 19 bp, Homo sapiens
gcttccacaaaattagaaa

SEQ ID NO: 4571081 - DNA, 15 bp, Homo sapiens
gcttccatgattcta

SEQ ID NO: 4571082 - DNA, 19 bp, Homo sapiens
gcttcccattgtggctcct

SEQ ID NO: 4571083 - DNA, 18 bp, Homo sapiens
gcttccctgactcattct

SEQ ID NO: 4571084 - DNA, 19 bp, Homo sapiens
gcttccctgacttgcttta

SEQ ID NO: 4571085 - DNA, 14 bp, Homo sapiens
gcttccctgtccca

SEQ ID NO: 4571086 - DNA, 15 bp, Homo sapiens
gcttccctgtcccag

SEQ ID NO: 4571087 - DNA, 22 bp, Homo sapiens
gcttccgggaaaacagctatta

SEQ ID NO: 4571088 - DNA, 23 bp, Homo sapiens
gcttcctacccacacctctgcca

SEQ ID NO: 4571089 - DNA, 23 bp, Homo sapiens
gcttcctcaaatacatgcacagt

SEQ ID NO: 4571090 - DNA, 15 bp, Homo sapiens
gcttcctcctcaggc

SEQ ID NO: 4571091 - DNA, 17 bp, Homo sapiens
gcttcctctagaagcca

SEQ ID NO: 4571092 - DNA, 20 bp, Homo sapiens
gcttcctctagaagccaagg

SEQ ID NO: 4571093 - DNA, 22 bp, Homo sapiens
gcttcctctagaagccaaggga

SEQ ID NO: 4571094 - DNA, 11 bp, Homo sapiens
gcttcctgccc

SEQ ID NO: 4571095 - DNA, 21 bp, Homo sapiens
gcttcctgcccttccctctgg

SEQ ID NO: 4571096 - DNA, 21 bp, Homo sapiens
gcttcctggaacttgctctca

SEQ ID NO: 4571097 - DNA, 19 bp, Homo sapiens
gcttcctgtctgtttatat

SEQ ID NO: 4571098 - DNA, 22 bp, Homo sapiens
gcttcgcttccttagccttgct

SEQ ID NO: 4571099 - DNA, 17 bp, Homo sapiens
gcttcggagtgaatgtg

SEQ ID NO: 4571100 - DNA, 23 bp, Homo sapiens
gcttcggagtgaatgtggcagtt

SEQ ID NO: 4571101 - DNA, 15 bp, Homo sapiens
gcttcggccacaggc

SEQ ID NO: 4571102 - DNA, 16 bp, Homo sapiens
gcttcggccgcgccac

SEQ ID NO: 4571103 - DNA, 20 bp, Homo sapiens
gcttcgggcccttcccacag

SEQ ID NO: 4571104 - DNA, 14 bp, Homo sapiens
gcttctaatattag

SEQ ID NO: 4571105 - DNA, 15 bp, Homo sapiens
gcttctactttcatc

SEQ ID NO: 4571106 - DNA, 16 bp, Homo sapiens
gcttctagctgacttg

SEQ ID NO: 4571107 - DNA, 23 bp, Homo sapiens
gcttctaggagtcaactggctgg

SEQ ID NO: 4571108 - DNA, 20 bp, Homo sapiens
gcttctagttctgccaggag

SEQ ID NO: 4571109 - DNA, 19 bp, Homo sapiens
gcttctcacgctttgttta

SEQ ID NO: 4571110 - DNA, 21 bp, Homo sapiens
gcttctcacgctttgtttact

SEQ ID NO: 4571111 - DNA, 21 bp, Homo sapiens
gcttctcagatttctgaggaa

SEQ ID NO: 4571112 - DNA, 16 bp, Homo sapiens
gcttctcatcttgtga

SEQ ID NO: 4571113 - DNA, 21 bp, Homo sapiens
gcttctccagggaattcttac

SEQ ID NO: 4571114 - DNA, 14 bp, Homo sapiens
gcttctccccagaa

SEQ ID NO: 4571115 - DNA, 15 bp, Homo sapiens
gcttctccccagaat

SEQ ID NO: 4571116 - DNA, 23 bp, Homo sapiens
gcttctccgccagcctcctctgg

SEQ ID NO: 4571117 - DNA, 18 bp, Homo sapiens
gcttctcctgttttatat

SEQ ID NO: 4571118 - DNA, 23 bp, Homo sapiens
gcttctcctgttttatatattat

SEQ ID NO: 4571119 - DNA, 14 bp, Homo sapiens
gcttctctccttgc

SEQ ID NO: 4571120 - DNA, 16 bp, Homo sapiens
gcttctctctgtggga

SEQ ID NO: 4571121 - DNA, 16 bp, Homo sapiens
gcttctcttctttctg

SEQ ID NO: 4571122 - DNA, 21 bp, Homo sapiens
gcttctctttgtgcagtgtta

SEQ ID NO: 4571123 - DNA, 15 bp, Homo sapiens
gcttctgagcagggg

SEQ ID NO: 4571124 - DNA, 18 bp, Homo sapiens
gcttctgcagcaactccc

SEQ ID NO: 4571125 - DNA, 15 bp, Homo sapiens
gcttctgcttttctg

SEQ ID NO: 4571126 - DNA, 19 bp, Homo sapiens
gcttctgcttttctgccct

SEQ ID NO: 4571127 - DNA, 23 bp, Homo sapiens
gcttctggctacctgtttgaagg

SEQ ID NO: 4571128 - DNA, 11 bp, Homo sapiens
gcttctgtctc

SEQ ID NO: 4571129 - DNA, 12 bp, Homo sapiens
gcttctgtctcc

SEQ ID NO: 4571130 - DNA, 13 bp, Homo sapiens
gcttctgtctcca

SEQ ID NO: 4571131 - DNA, 15 bp, Homo sapiens
gcttctgtctccagc

SEQ ID NO: 4571132 - DNA, 18 bp, Homo sapiens
gcttctgtggggcccctc

SEQ ID NO: 4571133 - DNA, 14 bp, Homo sapiens
gcttctgtttctag

SEQ ID NO: 4571134 - DNA, 15 bp, Homo sapiens
gcttcttcagctgac

SEQ ID NO: 4571135 - DNA, 12 bp, Homo sapiens
gcttctttccag

SEQ ID NO: 4571136 - DNA, 19 bp, Homo sapiens
gcttgaactaggctgagca

SEQ ID NO: 4571137 - DNA, 12 bp, Homo sapiens
gcttgaagccaa

SEQ ID NO: 4571138 - DNA, 19 bp, Homo sapiens
gcttgaccatgttgcactg

SEQ ID NO: 4571139 - DNA, 21 bp, Homo sapiens
gcttgactggatggaaggaga

SEQ ID NO: 4571140 - DNA, 21 bp, Homo sapiens
gcttgagagccctgaggccta

SEQ ID NO: 4571141 - DNA, 13 bp, Homo sapiens
gcttgagcccagg

SEQ ID NO: 4571142 - DNA, 15 bp, Homo sapiens
gcttgaggctgaata

SEQ ID NO: 4571143 - DNA, 19 bp, Homo sapiens
gcttgagtttggggaatgc

SEQ ID NO: 4571144 - DNA, 15 bp, Homo sapiens
gcttgatccagaaga

SEQ ID NO: 4571145 - DNA, 21 bp, Homo sapiens
gcttgatccagaagagcccat

SEQ ID NO: 4571146 - DNA, 13 bp, Homo sapiens
gcttgattaaatc

SEQ ID NO: 4571147 - DNA, 14 bp, Homo sapiens
gcttgattctgcag

SEQ ID NO: 4571148 - DNA, 19 bp, Homo sapiens
gcttgcaatctaatctgaa

SEQ ID NO: 4571149 - DNA, 16 bp, Homo sapiens
gcttgcaatgtagtca

SEQ ID NO: 4571150 - DNA, 17 bp, Homo sapiens
gcttgcatctgcacata

SEQ ID NO: 4571151 - DNA, 22 bp, Homo sapiens
gcttgccaaagtacagaatttg

SEQ ID NO: 4571152 - DNA, 22 bp, Homo sapiens
gcttgcccagtacatttaaatt

SEQ ID NO: 4571153 - DNA, 17 bp, Homo sapiens
gcttgccctggtgcctc

SEQ ID NO: 4571154 - DNA, 19 bp, Homo sapiens
gcttgccctggtgcctcac

SEQ ID NO: 4571155 - DNA, 19 bp, Homo sapiens
gcttgctctgtttgtgggg

SEQ ID NO: 4571156 - DNA, 23 bp, Homo sapiens
gcttgctcttcagtgggagaaaa

SEQ ID NO: 4571157 - DNA, 22 bp, Homo sapiens
gcttgctggaacacaggggcct

SEQ ID NO: 4571158 - DNA, 14 bp, Homo sapiens
gcttgcttctgcag

SEQ ID NO: 4571159 - DNA, 16 bp, Homo sapiens
gcttgcttctgcagca

SEQ ID NO: 4571160 - DNA, 21 bp, Homo sapiens
gcttgcttctgcagcaactcc

SEQ ID NO: 4571161 - DNA, 15 bp, Homo sapiens
gcttggaatgggaga

SEQ ID NO: 4571162 - DNA, 15 bp, Homo sapiens
gcttggactacacaa

SEQ ID NO: 4571163 - DNA, 16 bp, Homo sapiens
gcttggatctggggtg

SEQ ID NO: 4571164 - DNA, 21 bp, Homo sapiens
gcttggatctggggtgggagt

SEQ ID NO: 4571165 - DNA, 18 bp, Homo sapiens
gcttggcagttgcagtgc

SEQ ID NO: 4571166 - DNA, 15 bp, Homo sapiens
gcttggccctttcct

SEQ ID NO: 4571167 - DNA, 13 bp, Homo sapiens
gcttggcctgctg

SEQ ID NO: 4571168 - DNA, 14 bp, Homo sapiens
gcttggcctgctgt

SEQ ID NO: 4571169 - DNA, 20 bp, Homo sapiens
gcttgggaagtcgaggctgc

SEQ ID NO: 4571170 - DNA, 15 bp, Homo sapiens
gcttgggatttgctg

SEQ ID NO: 4571171 - DNA, 17 bp, Homo sapiens
gcttgggatttgctgtg

SEQ ID NO: 4571172 - DNA, 15 bp, Homo sapiens
gcttgggcctgcacc

SEQ ID NO: 4571173 - DNA, 15 bp, Homo sapiens
gcttggggacctgaa

SEQ ID NO: 4571174 - DNA, 18 bp, Homo sapiens
gcttggggacctgaactg

SEQ ID NO: 4571175 - DNA, 23 bp, Homo sapiens
gcttgggtctctctcggcccctg

SEQ ID NO: 4571176 - DNA, 13 bp, Homo sapiens
gcttggttggctg

SEQ ID NO: 4571177 - DNA, 16 bp, Homo sapiens
gcttgtaactccacca

SEQ ID NO: 4571178 - DNA, 15 bp, Homo sapiens
gcttgtgcaacaata

SEQ ID NO: 4571179 - DNA, 14 bp, Homo sapiens
gcttgtggagcccc

SEQ ID NO: 4571180 - DNA, 20 bp, Homo sapiens
gcttgtggagccccacactg

SEQ ID NO: 4571181 - DNA, 19 bp, Homo sapiens
gcttgttccaatgccacat

SEQ ID NO: 4571182 - DNA, 18 bp, Homo sapiens
gcttgtttttcttcagca

SEQ ID NO: 4571183 - DNA, 15 bp, Homo sapiens
gctttaaaatatatc

SEQ ID NO: 4571184 - DNA, 16 bp, Homo sapiens
gctttaaataaattaa

SEQ ID NO: 4571185 - DNA, 19 bp, Homo sapiens
gctttaagtgtgctgggca

SEQ ID NO: 4571186 - DNA, 14 bp, Homo sapiens
gctttaatatgagc

SEQ ID NO: 4571187 - DNA, 23 bp, Homo sapiens
gctttaatatgagcttcaatata

SEQ ID NO: 4571188 - DNA, 19 bp, Homo sapiens
gctttactccgtaacagat

SEQ ID NO: 4571189 - DNA, 12 bp, Homo sapiens
gctttagaaaca

SEQ ID NO: 4571190 - DNA, 14 bp, Homo sapiens
gctttagaccctgg

SEQ ID NO: 4571191 - DNA, 15 bp, Homo sapiens
gctttagaccctggg

SEQ ID NO: 4571192 - DNA, 16 bp, Homo sapiens
gctttagaccctgggt

SEQ ID NO: 4571193 - DNA, 17 bp, Homo sapiens
gctttagaccctgggtg

SEQ ID NO: 4571194 - DNA, 21 bp, Homo sapiens
gctttatccccgtttcttgca

SEQ ID NO: 4571195 - DNA, 17 bp, Homo sapiens
gctttatctttgtgtaa

SEQ ID NO: 4571196 - DNA, 15 bp, Homo sapiens
gctttatgattttca

SEQ ID NO: 4571197 - DNA, 14 bp, Homo sapiens
gctttattgaatta

SEQ ID NO: 4571198 - DNA, 20 bp, Homo sapiens
gctttattgaattagaaaat

SEQ ID NO: 4571199 - DNA, 13 bp, Homo sapiens
gctttcagagcca

SEQ ID NO: 4571200 - DNA, 20 bp, Homo sapiens
gctttcataaatcatgttgt

SEQ ID NO: 4571201 - DNA, 12 bp, Homo sapiens
gctttcatgatt

SEQ ID NO: 4571202 - DNA, 12 bp, Homo sapiens
gctttcatgtaa

SEQ ID NO: 4571203 - DNA, 11 bp, Homo sapiens
gctttccagct

SEQ ID NO: 4571204 - DNA, 20 bp, Homo sapiens
gctttcccagtcccattcct

SEQ ID NO: 4571205 - DNA, 19 bp, Homo sapiens
gctttcctgggcctttgca

SEQ ID NO: 4571206 - DNA, 21 bp, Homo sapiens
gctttctaccacacacagcct

SEQ ID NO: 4571207 - DNA, 24 bp, Homo sapiens
gctttctaccacacacagcctgtc

SEQ ID NO: 4571208 - DNA, 17 bp, Homo sapiens
gctttctacgccaatgt

SEQ ID NO: 4571209 - DNA, 18 bp, Homo sapiens
gctttctatgctgtttgt

SEQ ID NO: 4571210 - DNA, 17 bp, Homo sapiens
gctttctggggcctagc

SEQ ID NO: 4571211 - DNA, 14 bp, Homo sapiens
gctttctgttccaa

SEQ ID NO: 4571212 - DNA, 16 bp, Homo sapiens
gctttctgttccaaat

SEQ ID NO: 4571213 - DNA, 17 bp, Homo sapiens
gctttctttgattctcc

SEQ ID NO: 4571214 - DNA, 18 bp, Homo sapiens
gctttgaaaaatctcatt

SEQ ID NO: 4571215 - DNA, 16 bp, Homo sapiens
gctttgaactttagtt

SEQ ID NO: 4571216 - DNA, 19 bp, Homo sapiens
gctttgacaaaatgactgg

SEQ ID NO: 4571217 - DNA, 19 bp, Homo sapiens
gctttgacgtattatctgt

SEQ ID NO: 4571218 - DNA, 20 bp, Homo sapiens
gctttgacgtattatctgtt

SEQ ID NO: 4571219 - DNA, 12 bp, Homo sapiens
gctttgattcat

SEQ ID NO: 4571220 - DNA, 21 bp, Homo sapiens
gctttgatttagattgagtaa

SEQ ID NO: 4571221 - DNA, 13 bp, Homo sapiens
gctttgcagctgc

SEQ ID NO: 4571222 - DNA, 14 bp, Homo sapiens
gctttgcagctgct

SEQ ID NO: 4571223 - DNA, 23 bp, Homo sapiens
gctttgcatgttccactaacccc

SEQ ID NO: 4571224 - DNA, 23 bp, Homo sapiens
gctttgccaaaataccagagcct

SEQ ID NO: 4571225 - DNA, 20 bp, Homo sapiens
gctttggaaaaatgggtctt

SEQ ID NO: 4571226 - DNA, 17 bp, Homo sapiens
gctttggacctaatcca

SEQ ID NO: 4571227 - DNA, 17 bp, Homo sapiens
gctttggatttgacatt

SEQ ID NO: 4571228 - DNA, 12 bp, Homo sapiens
gctttggcactc

SEQ ID NO: 4571229 - DNA, 21 bp, Homo sapiens
gctttggggtcctagcccagt

SEQ ID NO: 4571230 - DNA, 22 bp, Homo sapiens
gctttggtaaaacagtttcatc

SEQ ID NO: 4571231 - DNA, 20 bp, Homo sapiens
gctttgtacttgtgatgaga

SEQ ID NO: 4571232 - DNA, 16 bp, Homo sapiens
gctttgtagtttgctt

SEQ ID NO: 4571233 - DNA, 21 bp, Homo sapiens
gctttgtgaccagaaagcttc

SEQ ID NO: 4571234 - DNA, 15 bp, Homo sapiens
gctttgttaaaaaaa

SEQ ID NO: 4571235 - DNA, 16 bp, Homo sapiens
gctttgtttactctct

SEQ ID NO: 4571236 - DNA, 14 bp, Homo sapiens
gctttgttttgcac

SEQ ID NO: 4571237 - DNA, 23 bp, Homo sapiens
gctttgttttgcacactttgcca

SEQ ID NO: 4571238 - DNA, 20 bp, Homo sapiens
gcttttaatgaaaaggaatc

SEQ ID NO: 4571239 - DNA, 12 bp, Homo sapiens
gcttttagaaaa

SEQ ID NO: 4571240 - DNA, 19 bp, Homo sapiens
gcttttatagaggctagct

SEQ ID NO: 4571241 - DNA, 22 bp, Homo sapiens
gcttttatctcagatgttaaaa

SEQ ID NO: 4571242 - DNA, 20 bp, Homo sapiens
gcttttatggatgattaaat

SEQ ID NO: 4571243 - DNA, 15 bp, Homo sapiens
gcttttattaatgca

SEQ ID NO: 4571244 - DNA, 19 bp, Homo sapiens
gcttttattaatgcacttt

SEQ ID NO: 4571245 - DNA, 22 bp, Homo sapiens
gcttttattaatgcactttcta

SEQ ID NO: 4571246 - DNA, 17 bp, Homo sapiens
gcttttattcctttgaa

SEQ ID NO: 4571247 - DNA, 21 bp, Homo sapiens
gcttttattgcaccattttca

SEQ ID NO: 4571248 - DNA, 20 bp, Homo sapiens
gcttttcactttctgtctag

SEQ ID NO: 4571249 - DNA, 23 bp, Homo sapiens
gcttttcagattgtggaatgttg

SEQ ID NO: 4571250 - DNA, 15 bp, Homo sapiens
gcttttcattttaat

SEQ ID NO: 4571251 - DNA, 14 bp, Homo sapiens
gcttttcccaggag

SEQ ID NO: 4571252 - DNA, 22 bp, Homo sapiens
gcttttccccggtcccttgaga

SEQ ID NO: 4571253 - DNA, 13 bp, Homo sapiens
gcttttctcagga

SEQ ID NO: 4571254 - DNA, 14 bp, Homo sapiens
gcttttctgccctg

SEQ ID NO: 4571255 - DNA, 15 bp, Homo sapiens
gcttttctgccctgg

SEQ ID NO: 4571256 - DNA, 16 bp, Homo sapiens
gcttttctgccctggc

SEQ ID NO: 4571257 - DNA, 22 bp, Homo sapiens
gcttttctgccctggctgctgc

SEQ ID NO: 4571258 - DNA, 18 bp, Homo sapiens
gcttttctgtattttatt

SEQ ID NO: 4571259 - DNA, 13 bp, Homo sapiens
gcttttgatgtct

SEQ ID NO: 4571260 - DNA, 22 bp, Homo sapiens
gcttttggttaatatgtctttt

SEQ ID NO: 4571261 - DNA, 13 bp, Homo sapiens
gcttttgttctag

SEQ ID NO: 4571262 - DNA, 13 bp, Homo sapiens
gctttttataaaa

SEQ ID NO: 4571263 - DNA, 19 bp, Homo sapiens
gctttttattcctcctgct

SEQ ID NO: 4571264 - DNA, 15 bp, Homo sapiens
gctttttatttctgc

SEQ ID NO: 4571265 - DNA, 17 bp, Homo sapiens
gctttttgttcagaatt

SEQ ID NO: 4571266 - DNA, 22 bp, Homo sapiens
gctttttttgtgtgtatttgct

SEQ ID NO: 4571267 - DNA, 15 bp, Homo sapiens
ggaaaaaaactggga

SEQ ID NO: 4571268 - DNA, 23 bp, Homo sapiens
ggaaaaaaacttttataaattaa

SEQ ID NO: 4571269 - DNA, 19 bp, Homo sapiens
ggaaaaaaatcatctattt

SEQ ID NO: 4571270 - DNA, 21 bp, Homo sapiens
ggaaaaaaatcatctattttg

SEQ ID NO: 4571271 - DNA, 21 bp, Homo sapiens
ggaaaaaagatttttaaaatg

SEQ ID NO: 4571272 - DNA, 13 bp, Homo sapiens
ggaaaaacacaag

SEQ ID NO: 4571273 - DNA, 21 bp, Homo sapiens
ggaaaaacatctgaaagccac

SEQ ID NO: 4571274 - DNA, 19 bp, Homo sapiens
ggaaaaatgccatcaaatg

SEQ ID NO: 4571275 - DNA, 13 bp, Homo sapiens
ggaaaacaaaaaa

SEQ ID NO: 4571276 - DNA, 20 bp, Homo sapiens
ggaaaacaaaagttttaatt

SEQ ID NO: 4571277 - DNA, 13 bp, Homo sapiens
ggaaaacagaaaa

SEQ ID NO: 4571278 - DNA, 21 bp, Homo sapiens
ggaaaacgggcagtctgctct

SEQ ID NO: 4571279 - DNA, 13 bp, Homo sapiens
ggaaaactgtgtt

SEQ ID NO: 4571280 - DNA, 22 bp, Homo sapiens
ggaaaacttgcagctaaggagg

SEQ ID NO: 4571281 - DNA, 17 bp, Homo sapiens
ggaaaaggcccctgcaa

SEQ ID NO: 4571282 - DNA, 15 bp, Homo sapiens
ggaaaaggttgaata

SEQ ID NO: 4571283 - DNA, 14 bp, Homo sapiens
ggaaaagtgcaatg

SEQ ID NO: 4571284 - DNA, 15 bp, Homo sapiens
ggaaaagttctttca

SEQ ID NO: 4571285 - DNA, 16 bp, Homo sapiens
ggaaaatgacatttta

SEQ ID NO: 4571286 - DNA, 18 bp, Homo sapiens
ggaaaattctaacccagg

SEQ ID NO: 4571287 - DNA, 22 bp, Homo sapiens
ggaaacaaaccttgccttgaaa

SEQ ID NO: 4571288 - DNA, 17 bp, Homo sapiens
ggaaacaatgaaaacaa

SEQ ID NO: 4571289 - DNA, 22 bp, Homo sapiens
ggaaacaccgagtctctgtata

SEQ ID NO: 4571290 - DNA, 18 bp, Homo sapiens
ggaaacagttgcatgtag

SEQ ID NO: 4571291 - DNA, 17 bp, Homo sapiens
ggaaaccttccacccag

SEQ ID NO: 4571292 - DNA, 18 bp, Homo sapiens
ggaaaccttccacccagt

SEQ ID NO: 4571293 - DNA, 16 bp, Homo sapiens
ggaaactaagattctt

SEQ ID NO: 4571294 - DNA, 16 bp, Homo sapiens
ggaaactactgccttt

SEQ ID NO: 4571295 - DNA, 23 bp, Homo sapiens
ggaaactatgtgtttttctcata

SEQ ID NO: 4571296 - DNA, 14 bp, Homo sapiens
ggaaactgaagcat

SEQ ID NO: 4571297 - DNA, 11 bp, Homo sapiens
ggaaactggct

SEQ ID NO: 4571298 - DNA, 13 bp, Homo sapiens
ggaaactgggaaa

SEQ ID NO: 4571299 - DNA, 17 bp, Homo sapiens
ggaaactgggaaactgg

SEQ ID NO: 4571300 - DNA, 19 bp, Homo sapiens
ggaaactgggtttctcatt

SEQ ID NO: 4571301 - DNA, 16 bp, Homo sapiens
ggaaagacgtttttgt

SEQ ID NO: 4571302 - DNA, 14 bp, Homo sapiens
ggaaagcatgcatt

SEQ ID NO: 4571303 - DNA, 12 bp, Homo sapiens
ggaaagccctcc

SEQ ID NO: 4571304 - DNA, 23 bp, Homo sapiens
ggaaagctcttcctaatcgctaa

SEQ ID NO: 4571305 - DNA, 16 bp, Homo sapiens
ggaaaggctcatttaa

SEQ ID NO: 4571306 - DNA, 13 bp, Homo sapiens
ggaaaggggagag

SEQ ID NO: 4571307 - DNA, 16 bp, Homo sapiens
ggaaagggggtgacct

SEQ ID NO: 4571308 - DNA, 20 bp, Homo sapiens
ggaaaggtgtgagactggga

SEQ ID NO: 4571309 - DNA, 13 bp, Homo sapiens
ggaaagtgccagc

SEQ ID NO: 4571310 - DNA, 21 bp, Homo sapiens
ggaaagtgtgagctcttccct

SEQ ID NO: 4571311 - DNA, 14 bp, Homo sapiens
ggaaataaaaaagt

SEQ ID NO: 4571312 - DNA, 19 bp, Homo sapiens
ggaaatacagttctgctct

SEQ ID NO: 4571313 - DNA, 16 bp, Homo sapiens
ggaaatatcagttact

SEQ ID NO: 4571314 - DNA, 21 bp, Homo sapiens
ggaaatcagtagaaagctaaa

SEQ ID NO: 4571315 - DNA, 23 bp, Homo sapiens
ggaaatctcagattcttcactgg

SEQ ID NO: 4571316 - DNA, 16 bp, Homo sapiens
ggaaatgggaaaaaac

SEQ ID NO: 4571317 - DNA, 22 bp, Homo sapiens
ggaaatgggaattgcgctcagg

SEQ ID NO: 4571318 - DNA, 17 bp, Homo sapiens
ggaaatgtacacttttt

SEQ ID NO: 4571319 - DNA, 20 bp, Homo sapiens
ggaaattgtaaatcctgtgt

SEQ ID NO: 4571320 - DNA, 21 bp, Homo sapiens
ggaaattttatatgtaaatgt

SEQ ID NO: 4571321 - DNA, 14 bp, Homo sapiens
ggaacaaagacagg

SEQ ID NO: 4571322 - DNA, 13 bp, Homo sapiens
ggaacaacttgta

SEQ ID NO: 4571323 - DNA, 19 bp, Homo sapiens
ggaacaacttgtagcagct

SEQ ID NO: 4571324 - DNA, 14 bp, Homo sapiens
ggaacacaggggcc

SEQ ID NO: 4571325 - DNA, 23 bp, Homo sapiens
ggaacacctgatcttacagaaaa

SEQ ID NO: 4571326 - DNA, 16 bp, Homo sapiens
ggaacagacaggagaa

SEQ ID NO: 4571327 - DNA, 18 bp, Homo sapiens
ggaacataaaaaggacat

SEQ ID NO: 4571328 - DNA, 15 bp, Homo sapiens
ggaacatcagtggat

SEQ ID NO: 4571329 - DNA, 20 bp, Homo sapiens
ggaacatgtgcttcatctgt

SEQ ID NO: 4571330 - DNA, 22 bp, Homo sapiens
ggaaccagccccatcagaacct

SEQ ID NO: 4571331 - DNA, 17 bp, Homo sapiens
ggaacccccaaatttaa

SEQ ID NO: 4571332 - DNA, 24 bp, Homo sapiens
ggaacccttacagtaggagcccag

SEQ ID NO: 4571333 - DNA, 16 bp, Homo sapiens
ggaaccgaggcaggga

SEQ ID NO: 4571334 - DNA, 15 bp, Homo sapiens
ggaacctgcaaaaaa

SEQ ID NO: 4571335 - DNA, 11 bp, Homo sapiens
ggaacctgcca

SEQ ID NO: 4571336 - DNA, 13 bp, Homo sapiens
ggaacctgccatg

SEQ ID NO: 4571337 - DNA, 14 bp, Homo sapiens
ggaacgactgggca

SEQ ID NO: 4571338 - DNA, 22 bp, Homo sapiens
ggaactagaaagaaggacccag

SEQ ID NO: 4571339 - DNA, 17 bp, Homo sapiens
ggaactagtcattaacc

SEQ ID NO: 4571340 - DNA, 22 bp, Homo sapiens
ggaactagtcattaacccatct

SEQ ID NO: 4571341 - DNA, 17 bp, Homo sapiens
ggaactatgaggagcct

SEQ ID NO: 4571342 - DNA, 15 bp, Homo sapiens
ggaactcctggaaat

SEQ ID NO: 4571343 - DNA, 16 bp, Homo sapiens
ggaactcctggccttt

SEQ ID NO: 4571344 - DNA, 15 bp, Homo sapiens
ggaactccttgcaca

SEQ ID NO: 4571345 - DNA, 14 bp, Homo sapiens
ggaactcttaagca

SEQ ID NO: 4571346 - DNA, 14 bp, Homo sapiens
ggaactgctgggct

SEQ ID NO: 4571347 - DNA, 22 bp, Homo sapiens
ggaactgtgtatttatttaaaa

SEQ ID NO: 4571348 - DNA, 16 bp, Homo sapiens
ggaacttgccctgagc

SEQ ID NO: 4571349 - DNA, 23 bp, Homo sapiens
ggaacttgcgagtccaaggccag

SEQ ID NO: 4571350 - DNA, 18 bp, Homo sapiens
ggaacttgtctcttcatc

SEQ ID NO: 4571351 - DNA, 22 bp, Homo sapiens
ggaagaaaattatgtaaagttt

SEQ ID NO: 4571352 - DNA, 19 bp, Homo sapiens
ggaagaaagagaaggagcc

SEQ ID NO: 4571353 - DNA, 14 bp, Homo sapiens
ggaagaacagcccc

SEQ ID NO: 4571354 - DNA, 16 bp, Homo sapiens
ggaagaacagccccgg

SEQ ID NO: 4571355 - DNA, 21 bp, Homo sapiens
ggaagaacagccccggggccc

SEQ ID NO: 4571356 - DNA, 14 bp, Homo sapiens
ggaagaagggagaa

SEQ ID NO: 4571357 - DNA, 16 bp, Homo sapiens
ggaagaagggagaaga

SEQ ID NO: 4571358 - DNA, 13 bp, Homo sapiens
ggaagactgctcc

SEQ ID NO: 4571359 - DNA, 13 bp, Homo sapiens
ggaagagaagaca

SEQ ID NO: 4571360 - DNA, 14 bp, Homo sapiens
ggaagagaagacaa

SEQ ID NO: 4571361 - DNA, 13 bp, Homo sapiens
ggaagagccttta

SEQ ID NO: 4571362 - DNA, 19 bp, Homo sapiens
ggaagagtgactctccagg

SEQ ID NO: 4571363 - DNA, 22 bp, Homo sapiens
ggaagagtgtgggggaggcgca

SEQ ID NO: 4571364 - DNA, 22 bp, Homo sapiens
ggaagatcatggacctggtgcc

SEQ ID NO: 4571365 - DNA, 20 bp, Homo sapiens
ggaagatgggaggtggaagc

SEQ ID NO: 4571366 - DNA, 17 bp, Homo sapiens
ggaagcagaggccctgc

SEQ ID NO: 4571367 - DNA, 17 bp, Homo sapiens
ggaagcatgtagactgt

SEQ ID NO: 4571368 - DNA, 20 bp, Homo sapiens
ggaagcatgtaggagaatcc

SEQ ID NO: 4571369 - DNA, 18 bp, Homo sapiens
ggaagccagagccccaag

SEQ ID NO: 4571370 - DNA, 23 bp, Homo sapiens
ggaagccatccctttttttacat

SEQ ID NO: 4571371 - DNA, 14 bp, Homo sapiens
ggaagcccaggagc

SEQ ID NO: 4571372 - DNA, 18 bp, Homo sapiens
ggaagcccatcctgacca

SEQ ID NO: 4571373 - DNA, 13 bp, Homo sapiens
ggaagcccctggg

SEQ ID NO: 4571374 - DNA, 14 bp, Homo sapiens
ggaagcccctgggc

SEQ ID NO: 4571375 - DNA, 18 bp, Homo sapiens
ggaagcccctgggcccag

SEQ ID NO: 4571376 - DNA, 19 bp, Homo sapiens
ggaagcccctgggcccagt

SEQ ID NO: 4571377 - DNA, 21 bp, Homo sapiens
ggaagcggccctaagggagtg

SEQ ID NO: 4571378 - DNA, 24 bp, Homo sapiens
ggaagctcacacatcctgtcagtg

SEQ ID NO: 4571379 - DNA, 18 bp, Homo sapiens
ggaagctggccgagggtc

SEQ ID NO: 4571380 - DNA, 17 bp, Homo sapiens
ggaagctgtgtccttgc

SEQ ID NO: 4571381 - DNA, 14 bp, Homo sapiens
ggaagctgttggtg

SEQ ID NO: 4571382 - DNA, 11 bp, Homo sapiens
ggaaggacaca

SEQ ID NO: 4571383 - DNA, 16 bp, Homo sapiens
ggaaggacagtccctg

SEQ ID NO: 4571384 - DNA, 17 bp, Homo sapiens
ggaaggacagtccctgc

SEQ ID NO: 4571385 - DNA, 18 bp, Homo sapiens
ggaaggacagtccctgct

SEQ ID NO: 4571386 - DNA, 19 bp, Homo sapiens
ggaaggacgggagtgagct

SEQ ID NO: 4571387 - DNA, 21 bp, Homo sapiens
ggaaggagactcacctctgcc

SEQ ID NO: 4571388 - DNA, 15 bp, Homo sapiens
ggaaggagagcctgc

SEQ ID NO: 4571389 - DNA, 22 bp, Homo sapiens
ggaaggagggatgcgtgttcca

SEQ ID NO: 4571390 - DNA, 16 bp, Homo sapiens
ggaaggcctgagcccc

SEQ ID NO: 4571391 - DNA, 17 bp, Homo sapiens
ggaaggcctgagcccct

SEQ ID NO: 4571392 - DNA, 13 bp, Homo sapiens
ggaaggctgaggc

SEQ ID NO: 4571393 - DNA, 14 bp, Homo sapiens
ggaaggctgtgata

SEQ ID NO: 4571394 - DNA, 21 bp, Homo sapiens
ggaagggagagttctttgctg

SEQ ID NO: 4571395 - DNA, 12 bp, Homo sapiens
ggaagggcagga

SEQ ID NO: 4571396 - DNA, 14 bp, Homo sapiens
ggaagggctgggcc

SEQ ID NO: 4571397 - DNA, 15 bp, Homo sapiens
ggaagggctgggcca

SEQ ID NO: 4571398 - DNA, 17 bp, Homo sapiens
ggaaggggccagaggct

SEQ ID NO: 4571399 - DNA, 17 bp, Homo sapiens
ggaaggtggccacagca

SEQ ID NO: 4571400 - DNA, 15 bp, Homo sapiens
ggaagtaaaacagtc

SEQ ID NO: 4571401 - DNA, 14 bp, Homo sapiens
ggaagtagaaacaa

SEQ ID NO: 4571402 - DNA, 14 bp, Homo sapiens
ggaagtagtccttg

SEQ ID NO: 4571403 - DNA, 16 bp, Homo sapiens
ggaagtagtccttggc

SEQ ID NO: 4571404 - DNA, 17 bp, Homo sapiens
ggaagtccaatgtggca

SEQ ID NO: 4571405 - DNA, 16 bp, Homo sapiens
ggaagtccggccccag

SEQ ID NO: 4571406 - DNA, 17 bp, Homo sapiens
ggaagtctaggagctgg

SEQ ID NO: 4571407 - DNA, 15 bp, Homo sapiens
ggaagtgcagagctt

SEQ ID NO: 4571408 - DNA, 13 bp, Homo sapiens
ggaagtggctcag

SEQ ID NO: 4571409 - DNA, 14 bp, Homo sapiens
ggaagtggctcaga

SEQ ID NO: 4571410 - DNA, 17 bp, Homo sapiens
ggaagttacatgctgta

SEQ ID NO: 4571411 - DNA, 11 bp, Homo sapiens
ggaataaaaaa

SEQ ID NO: 4571412 - DNA, 15 bp, Homo sapiens
ggaataaaagtatta

SEQ ID NO: 4571413 - DNA, 17 bp, Homo sapiens
ggaataaagttgcagat

SEQ ID NO: 4571414 - DNA, 21 bp, Homo sapiens
ggaataaagttgcagatgatt

SEQ ID NO: 4571415 - DNA, 15 bp, Homo sapiens
ggaataatacatact

SEQ ID NO: 4571416 - DNA, 18 bp, Homo sapiens
ggaatacattttattctg

SEQ ID NO: 4571417 - DNA, 17 bp, Homo sapiens
ggaatactttttgttat

SEQ ID NO: 4571418 - DNA, 17 bp, Homo sapiens
ggaatagctttgtattt

SEQ ID NO: 4571419 - DNA, 21 bp, Homo sapiens
ggaatattttatcctgtattc

SEQ ID NO: 4571420 - DNA, 17 bp, Homo sapiens
ggaatcaagagctgccc

SEQ ID NO: 4571421 - DNA, 17 bp, Homo sapiens
ggaatcacccctctgcc

SEQ ID NO: 4571422 - DNA, 21 bp, Homo sapiens
ggaatcagacttcacactgca

SEQ ID NO: 4571423 - DNA, 24 bp, Homo sapiens
ggaatcatttctatttctcctcca

SEQ ID NO: 4571424 - DNA, 22 bp, Homo sapiens
ggaatctaaccacttaaggacc

SEQ ID NO: 4571425 - DNA, 21 bp, Homo sapiens
ggaatgaggtgggaggtggaa

SEQ ID NO: 4571426 - DNA, 22 bp, Homo sapiens
ggaatgattggttaaaatgtga

SEQ ID NO: 4571427 - DNA, 16 bp, Homo sapiens
ggaatgcacctcccca

SEQ ID NO: 4571428 - DNA, 13 bp, Homo sapiens
ggaatgccttgga

SEQ ID NO: 4571429 - DNA, 19 bp, Homo sapiens
ggaatggaagagaaaagac

SEQ ID NO: 4571430 - DNA, 21 bp, Homo sapiens
ggaatgggtctgcacagattc

SEQ ID NO: 4571431 - DNA, 14 bp, Homo sapiens
ggaatgtgccacag

SEQ ID NO: 4571432 - DNA, 15 bp, Homo sapiens
ggaatgtgccacaga

SEQ ID NO: 4571433 - DNA, 20 bp, Homo sapiens
ggaatgtgccacagaggccc

SEQ ID NO: 4571434 - DNA, 15 bp, Homo sapiens
ggaatgttggataag

SEQ ID NO: 4571435 - DNA, 20 bp, Homo sapiens
ggaatgtttttccctcccca

SEQ ID NO: 4571436 - DNA, 16 bp, Homo sapiens
ggaattaaatagtgtg

SEQ ID NO: 4571437 - DNA, 16 bp, Homo sapiens
ggaattacaagccctg

SEQ ID NO: 4571438 - DNA, 16 bp, Homo sapiens
ggaattattgtagaca

SEQ ID NO: 4571439 - DNA, 16 bp, Homo sapiens
ggaattccctccccct

SEQ ID NO: 4571440 - DNA, 18 bp, Homo sapiens
ggaattccctccccctcc

SEQ ID NO: 4571441 - DNA, 19 bp, Homo sapiens
ggaattcttacagccaagt

SEQ ID NO: 4571442 - DNA, 20 bp, Homo sapiens
ggaatttgcgtaactaacac

SEQ ID NO: 4571443 - DNA, 14 bp, Homo sapiens
ggaatttgtatttt

SEQ ID NO: 4571444 - DNA, 13 bp, Homo sapiens
ggacaaaaggaat

SEQ ID NO: 4571445 - DNA, 21 bp, Homo sapiens
ggacaaatcacatattttaaa

SEQ ID NO: 4571446 - DNA, 16 bp, Homo sapiens
ggacaagacccccagc

SEQ ID NO: 4571447 - DNA, 13 bp, Homo sapiens
ggacaagcagtgg

SEQ ID NO: 4571448 - DNA, 18 bp, Homo sapiens
ggacacagacccaggacc

SEQ ID NO: 4571449 - DNA, 14 bp, Homo sapiens
ggacacagttcctg

SEQ ID NO: 4571450 - DNA, 17 bp, Homo sapiens
ggacaccagccaggctc

SEQ ID NO: 4571451 - DNA, 22 bp, Homo sapiens
ggacaccagccaggctctgtgc

SEQ ID NO: 4571452 - DNA, 13 bp, Homo sapiens
ggacacgagccac

SEQ ID NO: 4571453 - DNA, 16 bp, Homo sapiens
ggacacgagccacaag

SEQ ID NO: 4571454 - DNA, 16 bp, Homo sapiens
ggacacttaatactac

SEQ ID NO: 4571455 - DNA, 13 bp, Homo sapiens
ggacagaaaatgc

SEQ ID NO: 4571456 - DNA, 14 bp, Homo sapiens
ggacagaaaatgca

SEQ ID NO: 4571457 - DNA, 18 bp, Homo sapiens
ggacagaatgtgttcttt

SEQ ID NO: 4571458 - DNA, 22 bp, Homo sapiens
ggacagaatgtgttcttttctc

SEQ ID NO: 4571459 - DNA, 11 bp, Homo sapiens
ggacagaccca

SEQ ID NO: 4571460 - DNA, 14 bp, Homo sapiens
ggacagacccaccc

SEQ ID NO: 4571461 - DNA, 14 bp, Homo sapiens
ggacagagacacct

SEQ ID NO: 4571462 - DNA, 20 bp, Homo sapiens
ggacagaggagcaaggttta

SEQ ID NO: 4571463 - DNA, 14 bp, Homo sapiens
ggacagagggaagc

SEQ ID NO: 4571464 - DNA, 21 bp, Homo sapiens
ggacagcagaagggggagacc

SEQ ID NO: 4571465 - DNA, 18 bp, Homo sapiens
ggacagcatcccttccca

SEQ ID NO: 4571466 - DNA, 22 bp, Homo sapiens
ggacagcctgtggcggtgcctg

SEQ ID NO: 4571467 - DNA, 13 bp, Homo sapiens
ggacaggagcctg

SEQ ID NO: 4571468 - DNA, 17 bp, Homo sapiens
ggacaggagcctggtcc

SEQ ID NO: 4571469 - DNA, 18 bp, Homo sapiens
ggacaggatgaggacaga

SEQ ID NO: 4571470 - DNA, 11 bp, Homo sapiens
ggacaggcccg

SEQ ID NO: 4571471 - DNA, 13 bp, Homo sapiens
ggacaggcgggct

SEQ ID NO: 4571472 - DNA, 17 bp, Homo sapiens
ggacaggcgggctcgga

SEQ ID NO: 4571473 - DNA, 15 bp, Homo sapiens
ggacagggctggccc

SEQ ID NO: 4571474 - DNA, 16 bp, Homo sapiens
ggacagggctggccca

SEQ ID NO: 4571475 - DNA, 20 bp, Homo sapiens
ggacagggctggcccagccc

SEQ ID NO: 4571476 - DNA, 21 bp, Homo sapiens
ggacagggctggcccagccct

SEQ ID NO: 4571477 - DNA, 23 bp, Homo sapiens
ggacagggctggcccagccctgc

SEQ ID NO: 4571478 - DNA, 17 bp, Homo sapiens
ggacaggtgacagtggc

SEQ ID NO: 4571479 - DNA, 18 bp, Homo sapiens
ggacagtatttgtgggga

SEQ ID NO: 4571480 - DNA, 19 bp, Homo sapiens
ggacagtccctgctgggga

SEQ ID NO: 4571481 - DNA, 14 bp, Homo sapiens
ggacagtgctgcag

SEQ ID NO: 4571482 - DNA, 23 bp, Homo sapiens
ggacagtgcttgatacaggaaca

SEQ ID NO: 4571483 - DNA, 20 bp, Homo sapiens
ggacagtttatcatgaagcc

SEQ ID NO: 4571484 - DNA, 14 bp, Homo sapiens
ggacatcagcaaac

SEQ ID NO: 4571485 - DNA, 14 bp, Homo sapiens
ggacatttctctaa

SEQ ID NO: 4571486 - DNA, 15 bp, Homo sapiens
ggaccaaattgcttc

SEQ ID NO: 4571487 - DNA, 21 bp, Homo sapiens
ggaccaattctggacagacag

SEQ ID NO: 4571488 - DNA, 17 bp, Homo sapiens
ggaccaccaatggattg

SEQ ID NO: 4571489 - DNA, 15 bp, Homo sapiens
ggaccagaggagcag

SEQ ID NO: 4571490 - DNA, 14 bp, Homo sapiens
ggaccagcccattg

SEQ ID NO: 4571491 - DNA, 22 bp, Homo sapiens
ggaccagcccattggccgagct

SEQ ID NO: 4571492 - DNA, 17 bp, Homo sapiens
ggaccaggactccctcc

SEQ ID NO: 4571493 - DNA, 16 bp, Homo sapiens
ggaccagggatggggg

SEQ ID NO: 4571494 - DNA, 18 bp, Homo sapiens
ggaccaggtttgcaggag

SEQ ID NO: 4571495 - DNA, 20 bp, Homo sapiens
ggacccaaaaaatcatctca

SEQ ID NO: 4571496 - DNA, 10 bp, Homo sapiens
ggacccagac

SEQ ID NO: 4571497 - DNA, 13 bp, Homo sapiens
ggacccagaccca

SEQ ID NO: 4571498 - DNA, 14 bp, Homo sapiens
ggacccagacccag

SEQ ID NO: 4571499 - DNA, 16 bp, Homo sapiens
ggacccagacccagtg

SEQ ID NO: 4571500 - DNA, 12 bp, Homo sapiens
ggacccaggcgc

SEQ ID NO: 4571501 - DNA, 16 bp, Homo sapiens
ggacccaggcgctgca

SEQ ID NO: 4571502 - DNA, 13 bp, Homo sapiens
ggacccagggcct

SEQ ID NO: 4571503 - DNA, 18 bp, Homo sapiens
ggacccagggcctgactt

SEQ ID NO: 4571504 - DNA, 12 bp, Homo sapiens
ggaccccagcat

SEQ ID NO: 4571505 - DNA, 17 bp, Homo sapiens
ggaccccagccatccag

SEQ ID NO: 4571506 - DNA, 13 bp, Homo sapiens
ggacccctcgccc

SEQ ID NO: 4571507 - DNA, 19 bp, Homo sapiens
ggacccctcgccccagcct

SEQ ID NO: 4571508 - DNA, 22 bp, Homo sapiens
ggacccctcgccttcaggagaa

SEQ ID NO: 4571509 - DNA, 16 bp, Homo sapiens
ggaccctcagcagctc

SEQ ID NO: 4571510 - DNA, 13 bp, Homo sapiens
ggaccctgtccaa

SEQ ID NO: 4571511 - DNA, 12 bp, Homo sapiens
ggaccctgtccg

SEQ ID NO: 4571512 - DNA, 22 bp, Homo sapiens
ggaccctgtgacatggtgcctg

SEQ ID NO: 4571513 - DNA, 19 bp, Homo sapiens
ggacccttaggatggggct

SEQ ID NO: 4571514 - DNA, 18 bp, Homo sapiens
ggaccctttttgttatga

SEQ ID NO: 4571515 - DNA, 17 bp, Homo sapiens
ggaccgcaggagggcag

SEQ ID NO: 4571516 - DNA, 19 bp, Homo sapiens
ggaccggtgctgcaggagt

SEQ ID NO: 4571517 - DNA, 16 bp, Homo sapiens
ggacctgccaggcagg

SEQ ID NO: 4571518 - DNA, 17 bp, Homo sapiens
ggacctgctgctcagta

SEQ ID NO: 4571519 - DNA, 11 bp, Homo sapiens
ggacctgggaa

SEQ ID NO: 4571520 - DNA, 22 bp, Homo sapiens
ggacctgggaacgactggactg

SEQ ID NO: 4571521 - DNA, 16 bp, Homo sapiens
ggaccttttgggggag

SEQ ID NO: 4571522 - DNA, 15 bp, Homo sapiens
ggacgatcaggagga

SEQ ID NO: 4571523 - DNA, 20 bp, Homo sapiens
ggacgccactcatttcatct

SEQ ID NO: 4571524 - DNA, 13 bp, Homo sapiens
ggacggaccagca

SEQ ID NO: 4571525 - DNA, 15 bp, Homo sapiens
ggacggaccagcatc

SEQ ID NO: 4571526 - DNA, 21 bp, Homo sapiens
ggacggcctgatgctccctcc

SEQ ID NO: 4571527 - DNA, 22 bp, Homo sapiens
ggacggcctgatgctccctccc

SEQ ID NO: 4571528 - DNA, 14 bp, Homo sapiens
ggacggctcctcag

SEQ ID NO: 4571529 - DNA, 15 bp, Homo sapiens
ggacggctcctcaga

SEQ ID NO: 4571530 - DNA, 13 bp, Homo sapiens
ggacggctgagca

SEQ ID NO: 4571531 - DNA, 17 bp, Homo sapiens
ggacggtccccacccct

SEQ ID NO: 4571532 - DNA, 21 bp, Homo sapiens
ggacgtcatcggaggctgggc

SEQ ID NO: 4571533 - DNA, 16 bp, Homo sapiens
ggacgttgctgagcca

SEQ ID NO: 4571534 - DNA, 18 bp, Homo sapiens
ggacgttgctgagccagc

SEQ ID NO: 4571535 - DNA, 20 bp, Homo sapiens
ggacgttgctgagccagctg

SEQ ID NO: 4571536 - DNA, 22 bp, Homo sapiens
ggacgttgctgagccagctgca

SEQ ID NO: 4571537 - DNA, 23 bp, Homo sapiens
ggacgttgctgagccagctgcag

SEQ ID NO: 4571538 - DNA, 22 bp, Homo sapiens
ggacgtttttcttcttgggccc

SEQ ID NO: 4571539 - DNA, 20 bp, Homo sapiens
ggactaaaacattttgacta

SEQ ID NO: 4571540 - DNA, 16 bp, Homo sapiens
ggactaagcctacctg

SEQ ID NO: 4571541 - DNA, 21 bp, Homo sapiens
ggactaagcctacctgctctc

SEQ ID NO: 4571542 - DNA, 22 bp, Homo sapiens
ggactaccgagagcttggacta

SEQ ID NO: 4571543 - DNA, 14 bp, Homo sapiens
ggactagaacctgg

SEQ ID NO: 4571544 - DNA, 23 bp, Homo sapiens
ggactcaagaggaatctgtttct

SEQ ID NO: 4571545 - DNA, 15 bp, Homo sapiens
ggactcagccctgag

SEQ ID NO: 4571546 - DNA, 16 bp, Homo sapiens
ggactcaggcgggaca

SEQ ID NO: 4571547 - DNA, 22 bp, Homo sapiens
ggactcaggcgggacagtgctg

SEQ ID NO: 4571548 - DNA, 14 bp, Homo sapiens
ggactccaggccca

SEQ ID NO: 4571549 - DNA, 23 bp, Homo sapiens
ggactccaggcccaaggctcccg

SEQ ID NO: 4571550 - DNA, 14 bp, Homo sapiens
ggactccggaggac

SEQ ID NO: 4571551 - DNA, 17 bp, Homo sapiens
ggactccggaggactga

SEQ ID NO: 4571552 - DNA, 22 bp, Homo sapiens
ggactcggagactatggcctcg

SEQ ID NO: 4571553 - DNA, 11 bp, Homo sapiens
ggactctcagg

SEQ ID NO: 4571554 - DNA, 20 bp, Homo sapiens
ggactctcagggattctggg

SEQ ID NO: 4571555 - DNA, 20 bp, Homo sapiens
ggactctcagtctctgagca

SEQ ID NO: 4571556 - DNA, 20 bp, Homo sapiens
ggactctgaaatatcccggg

SEQ ID NO: 4571557 - DNA, 17 bp, Homo sapiens
ggactctgaagcctctg

SEQ ID NO: 4571558 - DNA, 18 bp, Homo sapiens
ggactctgcgggaggctg

SEQ ID NO: 4571559 - DNA, 21 bp, Homo sapiens
ggactctgcgggaggctgggg

SEQ ID NO: 4571560 - DNA, 19 bp, Homo sapiens
ggactctttccgactgccc

SEQ ID NO: 4571561 - DNA, 13 bp, Homo sapiens
ggactgaggcctg

SEQ ID NO: 4571562 - DNA, 20 bp, Homo sapiens
ggactgagggggcctggatg

SEQ ID NO: 4571563 - DNA, 15 bp, Homo sapiens
ggactgagtgggaag

SEQ ID NO: 4571564 - DNA, 23 bp, Homo sapiens
ggactgcacagcgtcctgtccac

SEQ ID NO: 4571565 - DNA, 19 bp, Homo sapiens
ggactgcatggtaatttat

SEQ ID NO: 4571566 - DNA, 18 bp, Homo sapiens
ggactgctaaataaaatt

SEQ ID NO: 4571567 - DNA, 17 bp, Homo sapiens
ggactgctgctctccca

SEQ ID NO: 4571568 - DNA, 14 bp, Homo sapiens
ggactggcccctgg

SEQ ID NO: 4571569 - DNA, 15 bp, Homo sapiens
ggactggcccctggg

SEQ ID NO: 4571570 - DNA, 20 bp, Homo sapiens
ggactggctagagtcctcac

SEQ ID NO: 4571571 - DNA, 12 bp, Homo sapiens
ggactggtgcct

SEQ ID NO: 4571572 - DNA, 13 bp, Homo sapiens
ggactgtacacac

SEQ ID NO: 4571573 - DNA, 21 bp, Homo sapiens
ggactgtcacggggttccctc

SEQ ID NO: 4571574 - DNA, 16 bp, Homo sapiens
ggactgtgcctggctc

SEQ ID NO: 4571575 - DNA, 16 bp, Homo sapiens
ggactgtgctggtgca

SEQ ID NO: 4571576 - DNA, 17 bp, Homo sapiens
ggactgtggtgacttct

SEQ ID NO: 4571577 - DNA, 20 bp, Homo sapiens
ggacttaaaattagtctttt

SEQ ID NO: 4571578 - DNA, 14 bp, Homo sapiens
ggacttaaccttga

SEQ ID NO: 4571579 - DNA, 19 bp, Homo sapiens
ggacttaaccttgaaatgg

SEQ ID NO: 4571580 - DNA, 17 bp, Homo sapiens
ggacttcaactgcccag

SEQ ID NO: 4571581 - DNA, 19 bp, Homo sapiens
ggacttcaactgcccagca

SEQ ID NO: 4571582 - DNA, 23 bp, Homo sapiens
ggacttctacctgccctcaaggg

SEQ ID NO: 4571583 - DNA, 18 bp, Homo sapiens
ggactttatttatttcta

SEQ ID NO: 4571584 - DNA, 19 bp, Homo sapiens
ggactttgtatactttaaa

SEQ ID NO: 4571585 - DNA, 19 bp, Homo sapiens
ggacttttgatagttctat

SEQ ID NO: 4571586 - DNA, 15 bp, Homo sapiens
ggagaaagccacgcc

SEQ ID NO: 4571587 - DNA, 21 bp, Homo sapiens
ggagaaagcttaatatattcc

SEQ ID NO: 4571588 - DNA, 22 bp, Homo sapiens
ggagaaatacttgaacttgcct

SEQ ID NO: 4571589 - DNA, 13 bp, Homo sapiens
ggagaaatgccag

SEQ ID NO: 4571590 - DNA, 18 bp, Homo sapiens
ggagaactagaacctgga

SEQ ID NO: 4571591 - DNA, 22 bp, Homo sapiens
ggagaactagaacctggagggc

SEQ ID NO: 4571592 - DNA, 18 bp, Homo sapiens
ggagaagagggaaaacag

SEQ ID NO: 4571593 - DNA, 19 bp, Homo sapiens
ggagaagcagtgagccgca

SEQ ID NO: 4571594 - DNA, 12 bp, Homo sapiens
ggagaaggaaaa

SEQ ID NO: 4571595 - DNA, 20 bp, Homo sapiens
ggagaaggaaaaagaaagta

SEQ ID NO: 4571596 - DNA, 15 bp, Homo sapiens
ggagaataaatttgg

SEQ ID NO: 4571597 - DNA, 20 bp, Homo sapiens
ggagaatcacttgaacccag

SEQ ID NO: 4571598 - DNA, 22 bp, Homo sapiens
ggagaatggtgtgaacccggga

SEQ ID NO: 4571599 - DNA, 16 bp, Homo sapiens
ggagacagaggaaagg

SEQ ID NO: 4571600 - DNA, 17 bp, Homo sapiens
ggagacagcttctctgc

SEQ ID NO: 4571601 - DNA, 18 bp, Homo sapiens
ggagacagcttctctgca

SEQ ID NO: 4571602 - DNA, 19 bp, Homo sapiens
ggagacagcttctctgcag

SEQ ID NO: 4571603 - DNA, 17 bp, Homo sapiens
ggagacagggctgctcc

SEQ ID NO: 4571604 - DNA, 22 bp, Homo sapiens
ggagacccccccccaactccag

SEQ ID NO: 4571605 - DNA, 22 bp, Homo sapiens
ggagaccctgaactcagaaggc

SEQ ID NO: 4571606 - DNA, 16 bp, Homo sapiens
ggagaccctgagtccg

SEQ ID NO: 4571607 - DNA, 12 bp, Homo sapiens
ggagaccctgcc

SEQ ID NO: 4571608 - DNA, 16 bp, Homo sapiens
ggagacgggaccctgc

SEQ ID NO: 4571609 - DNA, 10 bp, Homo sapiens
ggagactaga

SEQ ID NO: 4571610 - DNA, 15 bp, Homo sapiens
ggagactatggcctc

SEQ ID NO: 4571611 - DNA, 16 bp, Homo sapiens
ggagactatggcctcg

SEQ ID NO: 4571612 - DNA, 19 bp, Homo sapiens
ggagactcagccttcctcc

SEQ ID NO: 4571613 - DNA, 15 bp, Homo sapiens
ggagactgcccagct

SEQ ID NO: 4571614 - DNA, 20 bp, Homo sapiens
ggagactgggctgagggagc

SEQ ID NO: 4571615 - DNA, 23 bp, Homo sapiens
ggagactgggctgagggagcctg

SEQ ID NO: 4571616 - DNA, 19 bp, Homo sapiens
ggagactttacaaaccttt

SEQ ID NO: 4571617 - DNA, 14 bp, Homo sapiens
ggagagaaaatata

SEQ ID NO: 4571618 - DNA, 13 bp, Homo sapiens
ggagagacaggca

SEQ ID NO: 4571619 - DNA, 14 bp, Homo sapiens
ggagagacaggcag

SEQ ID NO: 4571620 - DNA, 21 bp, Homo sapiens
ggagagacaggcagcccagca

SEQ ID NO: 4571621 - DNA, 18 bp, Homo sapiens
ggagagactcccatgaag

SEQ ID NO: 4571622 - DNA, 20 bp, Homo sapiens
ggagagactcccatgaagcc

SEQ ID NO: 4571623 - DNA, 22 bp, Homo sapiens
ggagagactcccatgaagcctt

SEQ ID NO: 4571624 - DNA, 16 bp, Homo sapiens
ggagagactgagcagc

SEQ ID NO: 4571625 - DNA, 19 bp, Homo sapiens
ggagagactgagcagccgc

SEQ ID NO: 4571626 - DNA, 22 bp, Homo sapiens
ggagagatccctgcagaaccca

SEQ ID NO: 4571627 - DNA, 12 bp, Homo sapiens
ggagagcagcag

SEQ ID NO: 4571628 - DNA, 13 bp, Homo sapiens
ggagagcagcagc

SEQ ID NO: 4571629 - DNA, 23 bp, Homo sapiens
ggagagcagcagcaccaaccaca

SEQ ID NO: 4571630 - DNA, 16 bp, Homo sapiens
ggagagccagaacctg

SEQ ID NO: 4571631 - DNA, 20 bp, Homo sapiens
ggagagccagaacctggagg

SEQ ID NO: 4571632 - DNA, 21 bp, Homo sapiens
ggagagccagaacctggaggg

SEQ ID NO: 4571633 - DNA, 16 bp, Homo sapiens
ggagagcctgctggca

SEQ ID NO: 4571634 - DNA, 20 bp, Homo sapiens
ggagagctagaacccggcag

SEQ ID NO: 4571635 - DNA, 20 bp, Homo sapiens
ggagagctagaacctggagg

SEQ ID NO: 4571636 - DNA, 17 bp, Homo sapiens
ggagagggaggtcactg

SEQ ID NO: 4571637 - DNA, 18 bp, Homo sapiens
ggagagggatttccctgc

SEQ ID NO: 4571638 - DNA, 18 bp, Homo sapiens
ggagagggtctggagaag

SEQ ID NO: 4571639 - DNA, 16 bp, Homo sapiens
ggagagtgcacatgcc

SEQ ID NO: 4571640 - DNA, 21 bp, Homo sapiens
ggagagttcaagcctgtggga

SEQ ID NO: 4571641 - DNA, 22 bp, Homo sapiens
ggagagttcaagcctgtgggag

SEQ ID NO: 4571642 - DNA, 19 bp, Homo sapiens
ggagagttctttgctgccc

SEQ ID NO: 4571643 - DNA, 21 bp, Homo sapiens
ggagataaaagcaattctgac

SEQ ID NO: 4571644 - DNA, 22 bp, Homo sapiens
ggagatacagtggagacatctg

SEQ ID NO: 4571645 - DNA, 23 bp, Homo sapiens
ggagatatttatggggggagaac

SEQ ID NO: 4571646 - DNA, 19 bp, Homo sapiens
ggagatgaaactggttcct

SEQ ID NO: 4571647 - DNA, 16 bp, Homo sapiens
ggagatgaccagggat

SEQ ID NO: 4571648 - DNA, 17 bp, Homo sapiens
ggagatgaccagggatg

SEQ ID NO: 4571649 - DNA, 18 bp, Homo sapiens
ggagatgcagctactgga

SEQ ID NO: 4571650 - DNA, 21 bp, Homo sapiens
ggagatgccatgagccgccca

SEQ ID NO: 4571651 - DNA, 12 bp, Homo sapiens
ggagatggaggg

SEQ ID NO: 4571652 - DNA, 13 bp, Homo sapiens
ggagcaaacagct

SEQ ID NO: 4571653 - DNA, 16 bp, Homo sapiens
ggagcacactggctca

SEQ ID NO: 4571654 - DNA, 22 bp, Homo sapiens
ggagcactgcatgtcagagcac

SEQ ID NO: 4571655 - DNA, 23 bp, Homo sapiens
ggagcagaatcagtattgggagc

SEQ ID NO: 4571656 - DNA, 13 bp, Homo sapiens
ggagcagccctgg

SEQ ID NO: 4571657 - DNA, 17 bp, Homo sapiens
ggagcagggaaggcctg

SEQ ID NO: 4571658 - DNA, 21 bp, Homo sapiens
ggagcagggaaggcctgactt

SEQ ID NO: 4571659 - DNA, 17 bp, Homo sapiens
ggagcatcaagccactc

SEQ ID NO: 4571660 - DNA, 21 bp, Homo sapiens
ggagcatttaatggcagctag

SEQ ID NO: 4571661 - DNA, 15 bp, Homo sapiens
ggagcatttggagag

SEQ ID NO: 4571662 - DNA, 19 bp, Homo sapiens
ggagccagactgtccaggg

SEQ ID NO: 4571663 - DNA, 16 bp, Homo sapiens
ggagcccacactgcca

SEQ ID NO: 4571664 - DNA, 13 bp, Homo sapiens
ggagcccactgag

SEQ ID NO: 4571665 - DNA, 23 bp, Homo sapiens
ggagcccactgaggggccaggga

SEQ ID NO: 4571666 - DNA, 19 bp, Homo sapiens
ggagcccagtgaagcctct

SEQ ID NO: 4571667 - DNA, 15 bp, Homo sapiens
ggagccccagccccc

SEQ ID NO: 4571668 - DNA, 14 bp, Homo sapiens
ggagccccagggtc

SEQ ID NO: 4571669 - DNA, 15 bp, Homo sapiens
ggagcccccagcaga

SEQ ID NO: 4571670 - DNA, 16 bp, Homo sapiens
ggagccccgccacagc

SEQ ID NO: 4571671 - DNA, 19 bp, Homo sapiens
ggagcccgatattctccct

SEQ ID NO: 4571672 - DNA, 14 bp, Homo sapiens
ggagccgcagagcc

SEQ ID NO: 4571673 - DNA, 16 bp, Homo sapiens
ggagccgggagcctga

SEQ ID NO: 4571674 - DNA, 16 bp, Homo sapiens
ggagccggtggcggtg

SEQ ID NO: 4571675 - DNA, 20 bp, Homo sapiens
ggagcctagcggagcccagc

SEQ ID NO: 4571676 - DNA, 21 bp, Homo sapiens
ggagcctagcggagcccagcc

SEQ ID NO: 4571677 - DNA, 23 bp, Homo sapiens
ggagcctagcggagcccagcctg

SEQ ID NO: 4571678 - DNA, 14 bp, Homo sapiens
ggagcctagctcct

SEQ ID NO: 4571679 - DNA, 16 bp, Homo sapiens
ggagcctagctcctgc

SEQ ID NO: 4571680 - DNA, 19 bp, Homo sapiens
ggagcctccccatctgtcc

SEQ ID NO: 4571681 - DNA, 21 bp, Homo sapiens
ggagcctccccatctgtccag

SEQ ID NO: 4571682 - DNA, 17 bp, Homo sapiens
ggagcctccccctcaga

SEQ ID NO: 4571683 - DNA, 12 bp, Homo sapiens
ggagcctgctct

SEQ ID NO: 4571684 - DNA, 13 bp, Homo sapiens
ggagcctgctggt

SEQ ID NO: 4571685 - DNA, 22 bp, Homo sapiens
ggagcctgctggtcacagcctc

SEQ ID NO: 4571686 - DNA, 17 bp, Homo sapiens
ggagcctgtggccagca

SEQ ID NO: 4571687 - DNA, 23 bp, Homo sapiens
ggagccttcccaagttgtgcttg

SEQ ID NO: 4571688 - DNA, 19 bp, Homo sapiens
ggagcggaggttgcagtga

SEQ ID NO: 4571689 - DNA, 14 bp, Homo sapiens
ggagcgggaggcag

SEQ ID NO: 4571690 - DNA, 17 bp, Homo sapiens
ggagctagttctcagct

SEQ ID NO: 4571691 - DNA, 19 bp, Homo sapiens
ggagctagttctcagcttg

SEQ ID NO: 4571692 - DNA, 22 bp, Homo sapiens
ggagctcctccctccagctgcg

SEQ ID NO: 4571693 - DNA, 12 bp, Homo sapiens
ggagctcctggg

SEQ ID NO: 4571694 - DNA, 14 bp, Homo sapiens
ggagctcctgggac

SEQ ID NO: 4571695 - DNA, 20 bp, Homo sapiens
ggagctcttcaggcctccct

SEQ ID NO: 4571696 - DNA, 13 bp, Homo sapiens
ggagctgctggct

SEQ ID NO: 4571697 - DNA, 15 bp, Homo sapiens
ggagctgctggcttg

SEQ ID NO: 4571698 - DNA, 15 bp, Homo sapiens
ggagctgggaggaaa

SEQ ID NO: 4571699 - DNA, 15 bp, Homo sapiens
ggagctgggccctgc

SEQ ID NO: 4571700 - DNA, 16 bp, Homo sapiens
ggagctgggccctgcc

SEQ ID NO: 4571701 - DNA, 17 bp, Homo sapiens
ggagctgggccctgcct

SEQ ID NO: 4571702 - DNA, 21 bp, Homo sapiens
ggagctgggccctgcctgcag

SEQ ID NO: 4571703 - DNA, 15 bp, Homo sapiens
ggagctttggaatat

SEQ ID NO: 4571704 - DNA, 17 bp, Homo sapiens
ggaggaaaaggcccctg

SEQ ID NO: 4571705 - DNA, 13 bp, Homo sapiens
ggaggaacacctg

SEQ ID NO: 4571706 - DNA, 14 bp, Homo sapiens
ggaggaagagccac

SEQ ID NO: 4571707 - DNA, 18 bp, Homo sapiens
ggaggaagagccacctgc

SEQ ID NO: 4571708 - DNA, 23 bp, Homo sapiens
ggaggaagagccacctgcaagat

SEQ ID NO: 4571709 - DNA, 14 bp, Homo sapiens
ggaggaaggcaaga

SEQ ID NO: 4571710 - DNA, 13 bp, Homo sapiens
ggaggaagggctg

SEQ ID NO: 4571711 - DNA, 15 bp, Homo sapiens
ggaggaagggctggg

SEQ ID NO: 4571712 - DNA, 19 bp, Homo sapiens
ggaggaatttactttcttc

SEQ ID NO: 4571713 - DNA, 22 bp, Homo sapiens
ggaggacaaccatgcaaattgt

SEQ ID NO: 4571714 - DNA, 15 bp, Homo sapiens
ggaggacaggcaggc

SEQ ID NO: 4571715 - DNA, 16 bp, Homo sapiens
ggaggacaggcaggcc

SEQ ID NO: 4571716 - DNA, 18 bp, Homo sapiens
ggaggacaggcaggccag

SEQ ID NO: 4571717 - DNA, 16 bp, Homo sapiens
ggaggaccgaggctac

SEQ ID NO: 4571718 - DNA, 12 bp, Homo sapiens
ggaggacctggc

SEQ ID NO: 4571719 - DNA, 13 bp, Homo sapiens
ggaggactgagcc

SEQ ID NO: 4571720 - DNA, 18 bp, Homo sapiens
ggaggactgagcccccac

SEQ ID NO: 4571721 - DNA, 14 bp, Homo sapiens
ggaggagcagcagc

SEQ ID NO: 4571722 - DNA, 15 bp, Homo sapiens
ggaggagcagcagct

SEQ ID NO: 4571723 - DNA, 15 bp, Homo sapiens
ggaggagctggcctg

SEQ ID NO: 4571724 - DNA, 13 bp, Homo sapiens
ggaggaggaaggc

SEQ ID NO: 4571725 - DNA, 12 bp, Homo sapiens
ggaggagggaga

SEQ ID NO: 4571726 - DNA, 13 bp, Homo sapiens
ggaggagggagag

SEQ ID NO: 4571727 - DNA, 20 bp, Homo sapiens
ggaggagggcaggcatcggg

SEQ ID NO: 4571728 - DNA, 17 bp, Homo sapiens
ggaggatacagaggaga

SEQ ID NO: 4571729 - DNA, 21 bp, Homo sapiens
ggaggatggtgtcctgaggcc

SEQ ID NO: 4571730 - DNA, 22 bp, Homo sapiens
ggaggatttcctacccccgtcc

SEQ ID NO: 4571731 - DNA, 20 bp, Homo sapiens
ggaggcaagagactgggagc

SEQ ID NO: 4571732 - DNA, 21 bp, Homo sapiens
ggaggcaagcgtgttctcagc

SEQ ID NO: 4571733 - DNA, 13 bp, Homo sapiens
ggaggcagggcct

SEQ ID NO: 4571734 - DNA, 18 bp, Homo sapiens
ggaggcagggccttgccc

SEQ ID NO: 4571735 - DNA, 19 bp, Homo sapiens
ggaggcagggccttgccca

SEQ ID NO: 4571736 - DNA, 13 bp, Homo sapiens
ggaggcagggctc

SEQ ID NO: 4571737 - DNA, 16 bp, Homo sapiens
ggaggcagggctctcc

SEQ ID NO: 4571738 - DNA, 17 bp, Homo sapiens
ggaggccattgtgtgag

SEQ ID NO: 4571739 - DNA, 14 bp, Homo sapiens
ggaggcccaggctg

SEQ ID NO: 4571740 - DNA, 18 bp, Homo sapiens
ggaggcctccactccttc

SEQ ID NO: 4571741 - DNA, 19 bp, Homo sapiens
ggaggcctggggaggccct

SEQ ID NO: 4571742 - DNA, 18 bp, Homo sapiens
ggaggcctgggggcaggg

SEQ ID NO: 4571743 - DNA, 19 bp, Homo sapiens
ggaggcggacgttccagcc

SEQ ID NO: 4571744 - DNA, 21 bp, Homo sapiens
ggaggctcacccccttctcca

SEQ ID NO: 4571745 - DNA, 16 bp, Homo sapiens
ggaggctccagagggc

SEQ ID NO: 4571746 - DNA, 17 bp, Homo sapiens
ggaggctcccggggcct

SEQ ID NO: 4571747 - DNA, 23 bp, Homo sapiens
ggaggctcccggggcctggacag

SEQ ID NO: 4571748 - DNA, 19 bp, Homo sapiens
ggaggctgagatgggagaa

SEQ ID NO: 4571749 - DNA, 15 bp, Homo sapiens
ggaggctgaggcaga

SEQ ID NO: 4571750 - DNA, 16 bp, Homo sapiens
ggaggctgaggcagga

SEQ ID NO: 4571751 - DNA, 16 bp, Homo sapiens
ggaggctgcctcccaa

SEQ ID NO: 4571752 - DNA, 12 bp, Homo sapiens
ggaggctgggcc

SEQ ID NO: 4571753 - DNA, 17 bp, Homo sapiens
ggaggctgggcccctgg

SEQ ID NO: 4571754 - DNA, 19 bp, Homo sapiens
ggaggctgggcccctggga

SEQ ID NO: 4571755 - DNA, 19 bp, Homo sapiens
ggagggaaaagggaagtag

SEQ ID NO: 4571756 - DNA, 14 bp, Homo sapiens
ggagggaaggacag

SEQ ID NO: 4571757 - DNA, 21 bp, Homo sapiens
ggagggaatgaacctggaggg

SEQ ID NO: 4571758 - DNA, 16 bp, Homo sapiens
ggagggatcagccccg

SEQ ID NO: 4571759 - DNA, 16 bp, Homo sapiens
ggagggatggagaggc

SEQ ID NO: 4571760 - DNA, 15 bp, Homo sapiens
ggagggcagcagggc

SEQ ID NO: 4571761 - DNA, 17 bp, Homo sapiens
ggagggcagcagggcta

SEQ ID NO: 4571762 - DNA, 13 bp, Homo sapiens
ggagggcaggcat

SEQ ID NO: 4571763 - DNA, 14 bp, Homo sapiens
ggagggccagcgct

SEQ ID NO: 4571764 - DNA, 19 bp, Homo sapiens
ggagggcccctgcgtgggg

SEQ ID NO: 4571765 - DNA, 21 bp, Homo sapiens
ggagggcccctgcgtgggggc

SEQ ID NO: 4571766 - DNA, 17 bp, Homo sapiens
ggagggcgtgactcacc

SEQ ID NO: 4571767 - DNA, 19 bp, Homo sapiens
ggagggctagaacctggag

SEQ ID NO: 4571768 - DNA, 20 bp, Homo sapiens
ggagggctagaacctggaga

SEQ ID NO: 4571769 - DNA, 22 bp, Homo sapiens
ggagggctagaacctggagagc

SEQ ID NO: 4571770 - DNA, 18 bp, Homo sapiens
ggagggcttggggctgca

SEQ ID NO: 4571771 - DNA, 17 bp, Homo sapiens
ggaggggaaaaaaatgt

SEQ ID NO: 4571772 - DNA, 19 bp, Homo sapiens
ggaggggagcatgggaagt

SEQ ID NO: 4571773 - DNA, 16 bp, Homo sapiens
ggaggggcgcacccca

SEQ ID NO: 4571774 - DNA, 21 bp, Homo sapiens
ggaggggcgcaccccacagct

SEQ ID NO: 4571775 - DNA, 23 bp, Homo sapiens
ggaggggcgcaccccacagctgg

SEQ ID NO: 4571776 - DNA, 12 bp, Homo sapiens
ggagggggctgg

SEQ ID NO: 4571777 - DNA, 19 bp, Homo sapiens
ggaggggtggcccagagcc

SEQ ID NO: 4571778 - DNA, 13 bp, Homo sapiens
ggagggtgggaag

SEQ ID NO: 4571779 - DNA, 17 bp, Homo sapiens
ggagggtgtctggggac

SEQ ID NO: 4571780 - DNA, 15 bp, Homo sapiens
ggaggtcactccacc

SEQ ID NO: 4571781 - DNA, 20 bp, Homo sapiens
ggaggtccttaggcctctga

SEQ ID NO: 4571782 - DNA, 23 bp, Homo sapiens
ggaggtggaagcagaggccctgc

SEQ ID NO: 4571783 - DNA, 20 bp, Homo sapiens
ggaggtggaggctgcggtga

SEQ ID NO: 4571784 - DNA, 19 bp, Homo sapiens
ggaggtgtcaggctgctgg

SEQ ID NO: 4571785 - DNA, 16 bp, Homo sapiens
ggaggttgaagccaag

SEQ ID NO: 4571786 - DNA, 21 bp, Homo sapiens
ggaggttgcagtgagctgaga

SEQ ID NO: 4571787 - DNA, 16 bp, Homo sapiens
ggagtaaacggcccag

SEQ ID NO: 4571788 - DNA, 21 bp, Homo sapiens
ggagtaacagggcagaaatga

SEQ ID NO: 4571789 - DNA, 19 bp, Homo sapiens
ggagtaataggaccagagc

SEQ ID NO: 4571790 - DNA, 23 bp, Homo sapiens
ggagtagcatgaacgccaaggaa

SEQ ID NO: 4571791 - DNA, 20 bp, Homo sapiens
ggagtcacagatgaggcccc

SEQ ID NO: 4571792 - DNA, 16 bp, Homo sapiens
ggagtcagggacctgc

SEQ ID NO: 4571793 - DNA, 14 bp, Homo sapiens
ggagtccagacccc

SEQ ID NO: 4571794 - DNA, 22 bp, Homo sapiens
ggagtccagcccctcctccctc

SEQ ID NO: 4571795 - DNA, 14 bp, Homo sapiens
ggagtccaggcccc

SEQ ID NO: 4571796 - DNA, 20 bp, Homo sapiens
ggagtccagggtttctctgc

SEQ ID NO: 4571797 - DNA, 22 bp, Homo sapiens
ggagtcccaggggcagccacac

SEQ ID NO: 4571798 - DNA, 18 bp, Homo sapiens
ggagtctgagtctgagtc

SEQ ID NO: 4571799 - DNA, 13 bp, Homo sapiens
ggagtctgccact

SEQ ID NO: 4571800 - DNA, 18 bp, Homo sapiens
ggagtcttgtgaaagtgt

SEQ ID NO: 4571801 - DNA, 12 bp, Homo sapiens
ggagtcttgtgc

SEQ ID NO: 4571802 - DNA, 16 bp, Homo sapiens
ggagtgaatgtggcag

SEQ ID NO: 4571803 - DNA, 18 bp, Homo sapiens
ggagtggttaggcagcaa

SEQ ID NO: 4571804 - DNA, 14 bp, Homo sapiens
ggagtgtcctgccc

SEQ ID NO: 4571805 - DNA, 15 bp, Homo sapiens
ggagtgtcctgccca

SEQ ID NO: 4571806 - DNA, 17 bp, Homo sapiens
ggagtgtcctgcccatg

SEQ ID NO: 4571807 - DNA, 11 bp, Homo sapiens
ggagtgtgtaa

SEQ ID NO: 4571808 - DNA, 16 bp, Homo sapiens
ggagtgttatgtattt

SEQ ID NO: 4571809 - DNA, 20 bp, Homo sapiens
ggagttagaaccacagcaga

SEQ ID NO: 4571810 - DNA, 22 bp, Homo sapiens
ggagttagaaccacagcagaca

SEQ ID NO: 4571811 - DNA, 22 bp, Homo sapiens
ggagttataggattttcacaca

SEQ ID NO: 4571812 - DNA, 19 bp, Homo sapiens
ggagttcaagaccagcctg

SEQ ID NO: 4571813 - DNA, 21 bp, Homo sapiens
ggagttcaagaccagcctggg

SEQ ID NO: 4571814 - DNA, 18 bp, Homo sapiens
ggagttcaagactagcct

SEQ ID NO: 4571815 - DNA, 12 bp, Homo sapiens
ggagttccttat

SEQ ID NO: 4571816 - DNA, 19 bp, Homo sapiens
ggagtttaatacaggaaat

SEQ ID NO: 4571817 - DNA, 17 bp, Homo sapiens
ggagtttattacaatgt

SEQ ID NO: 4571818 - DNA, 19 bp, Homo sapiens
ggagtttattacaatgtat

SEQ ID NO: 4571819 - DNA, 19 bp, Homo sapiens
ggagtttgagaccaggctg

SEQ ID NO: 4571820 - DNA, 15 bp, Homo sapiens
ggatacagaggagat

SEQ ID NO: 4571821 - DNA, 15 bp, Homo sapiens
ggatagaggggctgc

SEQ ID NO: 4571822 - DNA, 18 bp, Homo sapiens
ggatagctaactgtaaat

SEQ ID NO: 4571823 - DNA, 19 bp, Homo sapiens
ggatagctaactgtaaatc

SEQ ID NO: 4571824 - DNA, 14 bp, Homo sapiens
ggataggagcctgc

SEQ ID NO: 4571825 - DNA, 17 bp, Homo sapiens
ggataggagcctgctgg

SEQ ID NO: 4571826 - DNA, 18 bp, Homo sapiens
ggatataatgtgtgcttt

SEQ ID NO: 4571827 - DNA, 20 bp, Homo sapiens
ggatatggctgcccaggaga

SEQ ID NO: 4571828 - DNA, 14 bp, Homo sapiens
ggatattatagaaa

SEQ ID NO: 4571829 - DNA, 17 bp, Homo sapiens
ggatattatagaaaatt

SEQ ID NO: 4571830 - DNA, 22 bp, Homo sapiens
ggatattgccttatttgtctgt

SEQ ID NO: 4571831 - DNA, 23 bp, Homo sapiens
ggatatttactgctctttattgc

SEQ ID NO: 4571832 - DNA, 16 bp, Homo sapiens
ggatcacagaccacag

SEQ ID NO: 4571833 - DNA, 21 bp, Homo sapiens
ggatcacagaccacaggaaga

SEQ ID NO: 4571834 - DNA, 22 bp, Homo sapiens
ggatcacttgagccccggaggt

SEQ ID NO: 4571835 - DNA, 19 bp, Homo sapiens
ggatcagagcgcacaggga

SEQ ID NO: 4571836 - DNA, 23 bp, Homo sapiens
ggatcagcaacccttcctgctgc

SEQ ID NO: 4571837 - DNA, 21 bp, Homo sapiens
ggatcagccccgcctgtcaca

SEQ ID NO: 4571838 - DNA, 18 bp, Homo sapiens
ggatcatcatgcagctca

SEQ ID NO: 4571839 - DNA, 20 bp, Homo sapiens
ggatcccatgagctccttaa

SEQ ID NO: 4571840 - DNA, 18 bp, Homo sapiens
ggatccctcatctgtccc

SEQ ID NO: 4571841 - DNA, 15 bp, Homo sapiens
ggatccgaaacggca

SEQ ID NO: 4571842 - DNA, 15 bp, Homo sapiens
ggatcctccacagag

SEQ ID NO: 4571843 - DNA, 12 bp, Homo sapiens
ggatcctccctc

SEQ ID NO: 4571844 - DNA, 12 bp, Homo sapiens
ggatcctgctgc

SEQ ID NO: 4571845 - DNA, 13 bp, Homo sapiens
ggatctaccagca

SEQ ID NO: 4571846 - DNA, 18 bp, Homo sapiens
ggatctaccagcataaat

SEQ ID NO: 4571847 - DNA, 24 bp, Homo sapiens
ggatctcattggacccttccatgg

SEQ ID NO: 4571848 - DNA, 17 bp, Homo sapiens
ggatctgctgggctctg

SEQ ID NO: 4571849 - DNA, 19 bp, Homo sapiens
ggatctgtcacaccagcca

SEQ ID NO: 4571850 - DNA, 14 bp, Homo sapiens
ggatctgtctgtgc

SEQ ID NO: 4571851 - DNA, 15 bp, Homo sapiens
ggatcttcccacagg

SEQ ID NO: 4571852 - DNA, 11 bp, Homo sapiens
ggatgaacaat

SEQ ID NO: 4571853 - DNA, 16 bp, Homo sapiens
ggatgacaccctggcc

SEQ ID NO: 4571854 - DNA, 17 bp, Homo sapiens
ggatgacaccctggcct

SEQ ID NO: 4571855 - DNA, 19 bp, Homo sapiens
ggatgacaggcgcctgcca

SEQ ID NO: 4571856 - DNA, 16 bp, Homo sapiens
ggatgacaggctctcc

SEQ ID NO: 4571857 - DNA, 18 bp, Homo sapiens
ggatgacttttttataca

SEQ ID NO: 4571858 - DNA, 21 bp, Homo sapiens
ggatgagaatttgagtgctct

SEQ ID NO: 4571859 - DNA, 16 bp, Homo sapiens
ggatgagcatggagct

SEQ ID NO: 4571860 - DNA, 17 bp, Homo sapiens
ggatgagcatggagctg

SEQ ID NO: 4571861 - DNA, 19 bp, Homo sapiens
ggatgagccaaaccagcag

SEQ ID NO: 4571862 - DNA, 20 bp, Homo sapiens
ggatgagccaaaccagcagg

SEQ ID NO: 4571863 - DNA, 21 bp, Homo sapiens
ggatgatttcagaaggagaag

SEQ ID NO: 4571864 - DNA, 15 bp, Homo sapiens
ggatgcatttcaaat

SEQ ID NO: 4571865 - DNA, 17 bp, Homo sapiens
ggatgcatttcaaatgt

SEQ ID NO: 4571866 - DNA, 17 bp, Homo sapiens
ggatgcccattcctgcc

SEQ ID NO: 4571867 - DNA, 18 bp, Homo sapiens
ggatgcccattcctgcct

SEQ ID NO: 4571868 - DNA, 14 bp, Homo sapiens
ggatgcgtgttcca

SEQ ID NO: 4571869 - DNA, 20 bp, Homo sapiens
ggatgcgtgttccagccaaa

SEQ ID NO: 4571870 - DNA, 15 bp, Homo sapiens
ggatgctgggctggg

SEQ ID NO: 4571871 - DNA, 21 bp, Homo sapiens
ggatggaagcaggacagacac

SEQ ID NO: 4571872 - DNA, 18 bp, Homo sapiens
ggatggagaggcggcctc

SEQ ID NO: 4571873 - DNA, 17 bp, Homo sapiens
ggatgggccagggttta

SEQ ID NO: 4571874 - DNA, 14 bp, Homo sapiens
ggatggggctccca

SEQ ID NO: 4571875 - DNA, 19 bp, Homo sapiens
ggatgggggatgggccagg

SEQ ID NO: 4571876 - DNA, 17 bp, Homo sapiens
ggatgggggatgtggcc

SEQ ID NO: 4571877 - DNA, 15 bp, Homo sapiens
ggatggtgactcctg

SEQ ID NO: 4571878 - DNA, 17 bp, Homo sapiens
ggatggtgcatgggctc

SEQ ID NO: 4571879 - DNA, 18 bp, Homo sapiens
ggatggtgtgccttccag

SEQ ID NO: 4571880 - DNA, 15 bp, Homo sapiens
ggatggttctgtgac

SEQ ID NO: 4571881 - DNA, 11 bp, Homo sapiens
ggatggtttgt

SEQ ID NO: 4571882 - DNA, 16 bp, Homo sapiens
ggatgtaaacagtgcc

SEQ ID NO: 4571883 - DNA, 20 bp, Homo sapiens
ggatgtagtgattaaatata

SEQ ID NO: 4571884 - DNA, 13 bp, Homo sapiens
ggatgtctgggcc

SEQ ID NO: 4571885 - DNA, 18 bp, Homo sapiens
ggatgtgctggaggggtg

SEQ ID NO: 4571886 - DNA, 16 bp, Homo sapiens
ggatgtggccaggggt

SEQ ID NO: 4571887 - DNA, 22 bp, Homo sapiens
ggatgtggccaggggtgctcct

SEQ ID NO: 4571888 - DNA, 22 bp, Homo sapiens
ggatgttagacttgctccctct

SEQ ID NO: 4571889 - DNA, 22 bp, Homo sapiens
ggattaaggcgtgagccactgc

SEQ ID NO: 4571890 - DNA, 13 bp, Homo sapiens
ggattcaggctgc

SEQ ID NO: 4571891 - DNA, 13 bp, Homo sapiens
ggattccatgcta

SEQ ID NO: 4571892 - DNA, 13 bp, Homo sapiens
ggattctgtgttt

SEQ ID NO: 4571893 - DNA, 20 bp, Homo sapiens
ggattctgttctgcaactcc

SEQ ID NO: 4571894 - DNA, 12 bp, Homo sapiens
ggattctttaaa

SEQ ID NO: 4571895 - DNA, 15 bp, Homo sapiens
ggattctttccccag

SEQ ID NO: 4571896 - DNA, 17 bp, Homo sapiens
ggattgaggggccctgg

SEQ ID NO: 4571897 - DNA, 19 bp, Homo sapiens
ggattgaggggccctggcc

SEQ ID NO: 4571898 - DNA, 19 bp, Homo sapiens
ggattgcctttaatatttt

SEQ ID NO: 4571899 - DNA, 15 bp, Homo sapiens
ggattgtaaaatgca

SEQ ID NO: 4571900 - DNA, 23 bp, Homo sapiens
ggattgtgcctaatgtgtttgag

SEQ ID NO: 4571901 - DNA, 15 bp, Homo sapiens
ggattgtgtatctgt

SEQ ID NO: 4571902 - DNA, 19 bp, Homo sapiens
ggattgttaatttcagtcc

SEQ ID NO: 4571903 - DNA, 17 bp, Homo sapiens
ggatttaaaagcctgct

SEQ ID NO: 4571904 - DNA, 18 bp, Homo sapiens
ggatttaaaagcctgctc

SEQ ID NO: 4571905 - DNA, 20 bp, Homo sapiens
ggattttaatttcaggaaaa

SEQ ID NO: 4571906 - DNA, 14 bp, Homo sapiens
ggattttaccaaag

SEQ ID NO: 4571907 - DNA, 15 bp, Homo sapiens
ggattttaccaaagc

SEQ ID NO: 4571908 - DNA, 17 bp, Homo sapiens
ggattttaccaaagcat

SEQ ID NO: 4571909 - DNA, 16 bp, Homo sapiens
ggatttttagaattaa

SEQ ID NO: 4571910 - DNA, 14 bp, Homo sapiens
ggcaaagtttaaat

SEQ ID NO: 4571911 - DNA, 19 bp, Homo sapiens
ggcaaagtttaaatgtatt

SEQ ID NO: 4571912 - DNA, 16 bp, Homo sapiens
ggcaaatattgaagtt

SEQ ID NO: 4571913 - DNA, 19 bp, Homo sapiens
ggcaacaagggtccgtgga

SEQ ID NO: 4571914 - DNA, 14 bp, Homo sapiens
ggcaacacagaggc

SEQ ID NO: 4571915 - DNA, 19 bp, Homo sapiens
ggcaacactgatcccccag

SEQ ID NO: 4571916 - DNA, 18 bp, Homo sapiens
ggcaacctgcggaaggag

SEQ ID NO: 4571917 - DNA, 17 bp, Homo sapiens
ggcaagagactgggagc

SEQ ID NO: 4571918 - DNA, 14 bp, Homo sapiens
ggcaagcatgaata

SEQ ID NO: 4571919 - DNA, 21 bp, Homo sapiens
ggcaagcatgtaacttatatt

SEQ ID NO: 4571920 - DNA, 13 bp, Homo sapiens
ggcaagccacagg

SEQ ID NO: 4571921 - DNA, 16 bp, Homo sapiens
ggcaagccacaggaag

SEQ ID NO: 4571922 - DNA, 12 bp, Homo sapiens
ggcaagccctgc

SEQ ID NO: 4571923 - DNA, 18 bp, Homo sapiens
ggcaagcgtgttctcagc

SEQ ID NO: 4571924 - DNA, 18 bp, Homo sapiens
ggcaagctagaacctgga

SEQ ID NO: 4571925 - DNA, 20 bp, Homo sapiens
ggcaagctagaacctggagg

SEQ ID NO: 4571926 - DNA, 18 bp, Homo sapiens
ggcaatcgttctgctggc

SEQ ID NO: 4571927 - DNA, 23 bp, Homo sapiens
ggcaatcgttctgctggccaaga

SEQ ID NO: 4571928 - DNA, 15 bp, Homo sapiens
ggcaatgaaaatttt

SEQ ID NO: 4571929 - DNA, 14 bp, Homo sapiens
ggcaatttcctggc

SEQ ID NO: 4571930 - DNA, 18 bp, Homo sapiens
ggcaattttagtgtatta

SEQ ID NO: 4571931 - DNA, 23 bp, Homo sapiens
ggcacaagctcaggtcctgctgc

SEQ ID NO: 4571932 - DNA, 16 bp, Homo sapiens
ggcacacagcagcccc

SEQ ID NO: 4571933 - DNA, 18 bp, Homo sapiens
ggcacacagcagcccccc

SEQ ID NO: 4571934 - DNA, 15 bp, Homo sapiens
ggcacagcccctgga

SEQ ID NO: 4571935 - DNA, 17 bp, Homo sapiens
ggcacagcccctggagc

SEQ ID NO: 4571936 - DNA, 20 bp, Homo sapiens
ggcacagcccctggagcctc

SEQ ID NO: 4571937 - DNA, 21 bp, Homo sapiens
ggcacagccgcgggccaggag

SEQ ID NO: 4571938 - DNA, 22 bp, Homo sapiens
ggcacagccgcgggccaggagg

SEQ ID NO: 4571939 - DNA, 15 bp, Homo sapiens
ggcacagcctagggt

SEQ ID NO: 4571940 - DNA, 19 bp, Homo sapiens
ggcacaggagtgtcctctt

SEQ ID NO: 4571941 - DNA, 20 bp, Homo sapiens
ggcacaggagtgtcctcttc

SEQ ID NO: 4571942 - DNA, 22 bp, Homo sapiens
ggcacagtctccatgtgtgtgc

SEQ ID NO: 4571943 - DNA, 21 bp, Homo sapiens
ggcacagttttctgagaaaga

SEQ ID NO: 4571944 - DNA, 17 bp, Homo sapiens
ggcacatgaacagcttg

SEQ ID NO: 4571945 - DNA, 15 bp, Homo sapiens
ggcaccagtccagca

SEQ ID NO: 4571946 - DNA, 21 bp, Homo sapiens
ggcacccaccgtggaggagga

SEQ ID NO: 4571947 - DNA, 12 bp, Homo sapiens
ggcacccaggca

SEQ ID NO: 4571948 - DNA, 16 bp, Homo sapiens
ggcacccccatgctgc

SEQ ID NO: 4571949 - DNA, 16 bp, Homo sapiens
ggcacccgtccccaca

SEQ ID NO: 4571950 - DNA, 20 bp, Homo sapiens
ggcacccgtccccacacgag

SEQ ID NO: 4571951 - DNA, 20 bp, Homo sapiens
ggcaccctcagggagcctcc

SEQ ID NO: 4571952 - DNA, 21 bp, Homo sapiens
ggcacctacactcacctgcac

SEQ ID NO: 4571953 - DNA, 18 bp, Homo sapiens
ggcacctcggggacacca

SEQ ID NO: 4571954 - DNA, 16 bp, Homo sapiens
ggcaccttaaaactta

SEQ ID NO: 4571955 - DNA, 21 bp, Homo sapiens
ggcacggcgggatcctccaca

SEQ ID NO: 4571956 - DNA, 20 bp, Homo sapiens
ggcactcagtgagcctcctg

SEQ ID NO: 4571957 - DNA, 12 bp, Homo sapiens
ggcactgccagc

SEQ ID NO: 4571958 - DNA, 22 bp, Homo sapiens
ggcactggcaaacagggcctct

SEQ ID NO: 4571959 - DNA, 21 bp, Homo sapiens
ggcactggccacccctcccca

SEQ ID NO: 4571960 - DNA, 22 bp, Homo sapiens
ggcactggccacccctccccag

SEQ ID NO: 4571961 - DNA, 15 bp, Homo sapiens
ggcacttaatttttg

SEQ ID NO: 4571962 - DNA, 22 bp, Homo sapiens
ggcacttattgtaaattttaga

SEQ ID NO: 4571963 - DNA, 22 bp, Homo sapiens
ggcagaaaggttctgcccggga

SEQ ID NO: 4571964 - DNA, 17 bp, Homo sapiens
ggcagaaatacagtctt

SEQ ID NO: 4571965 - DNA, 22 bp, Homo sapiens
ggcagaaatgattaaaatgttt

SEQ ID NO: 4571966 - DNA, 23 bp, Homo sapiens
ggcagaagaattgaacccaggag

SEQ ID NO: 4571967 - DNA, 14 bp, Homo sapiens
ggcagacacaaccc

SEQ ID NO: 4571968 - DNA, 21 bp, Homo sapiens
ggcagacgtctgtcaggggct

SEQ ID NO: 4571969 - DNA, 14 bp, Homo sapiens
ggcagactgtgaac

SEQ ID NO: 4571970 - DNA, 16 bp, Homo sapiens
ggcagagccataatgg

SEQ ID NO: 4571971 - DNA, 16 bp, Homo sapiens
ggcagagcccaaggga

SEQ ID NO: 4571972 - DNA, 22 bp, Homo sapiens
ggcagaggctggaggcagggcc

SEQ ID NO: 4571973 - DNA, 14 bp, Homo sapiens
ggcagagggcagag

SEQ ID NO: 4571974 - DNA, 20 bp, Homo sapiens
ggcagagggcagaggctgga

SEQ ID NO: 4571975 - DNA, 13 bp, Homo sapiens
ggcagagttacag

SEQ ID NO: 4571976 - DNA, 15 bp, Homo sapiens
ggcagatctgtgccc

SEQ ID NO: 4571977 - DNA, 16 bp, Homo sapiens
ggcagatggagcccat

SEQ ID NO: 4571978 - DNA, 24 bp, Homo sapiens
ggcagatttagtgaaagctagaga

SEQ ID NO: 4571979 - DNA, 13 bp, Homo sapiens
ggcagcaccctcc

SEQ ID NO: 4571980 - DNA, 15 bp, Homo sapiens
ggcagcaccctcccc

SEQ ID NO: 4571981 - DNA, 21 bp, Homo sapiens
ggcagcacctctggtcaggag

SEQ ID NO: 4571982 - DNA, 22 bp, Homo sapiens
ggcagcacctctggtcaggagg

SEQ ID NO: 4571983 - DNA, 18 bp, Homo sapiens
ggcagcagggctaccctg

SEQ ID NO: 4571984 - DNA, 13 bp, Homo sapiens
ggcagcagtgtga

SEQ ID NO: 4571985 - DNA, 14 bp, Homo sapiens
ggcagcagtgtgag

SEQ ID NO: 4571986 - DNA, 12 bp, Homo sapiens
ggcagccaccca

SEQ ID NO: 4571987 - DNA, 17 bp, Homo sapiens
ggcagccacccaagcct

SEQ ID NO: 4571988 - DNA, 11 bp, Homo sapiens
ggcagccagac

SEQ ID NO: 4571989 - DNA, 12 bp, Homo sapiens
ggcagccagcag

SEQ ID NO: 4571990 - DNA, 12 bp, Homo sapiens
ggcagccaggct

SEQ ID NO: 4571991 - DNA, 14 bp, Homo sapiens
ggcagcgccccacc

SEQ ID NO: 4571992 - DNA, 13 bp, Homo sapiens
ggcagctagtgcc

SEQ ID NO: 4571993 - DNA, 14 bp, Homo sapiens
ggcagctcaggata

SEQ ID NO: 4571994 - DNA, 15 bp, Homo sapiens
ggcagctcaggatag

SEQ ID NO: 4571995 - DNA, 22 bp, Homo sapiens
ggcagctcggattcaactacct

SEQ ID NO: 4571996 - DNA, 12 bp, Homo sapiens
ggcagctgcctc

SEQ ID NO: 4571997 - DNA, 13 bp, Homo sapiens
ggcagctgcctct

SEQ ID NO: 4571998 - DNA, 14 bp, Homo sapiens
ggcagctgcctctg

SEQ ID NO: 4571999 - DNA, 17 bp, Homo sapiens
ggcagctgcctctgctc

SEQ ID NO: 4572000 - DNA, 18 bp, Homo sapiens
ggcagctgcctctgctcc

SEQ ID NO: 4572001 - DNA, 22 bp, Homo sapiens
ggcagctgcctctgctccctct

SEQ ID NO: 4572002 - DNA, 19 bp, Homo sapiens
ggcagctgggcccaaccct

SEQ ID NO: 4572003 - DNA, 19 bp, Homo sapiens
ggcagctgtcctgtgatgt

SEQ ID NO: 4572004 - DNA, 20 bp, Homo sapiens
ggcagctgtcctgtgatgtc

SEQ ID NO: 4572005 - DNA, 15 bp, Homo sapiens
ggcaggacagctcct

SEQ ID NO: 4572006 - DNA, 19 bp, Homo sapiens
ggcaggagaatcacttgaa

SEQ ID NO: 4572007 - DNA, 14 bp, Homo sapiens
ggcaggagggaggt

SEQ ID NO: 4572008 - DNA, 14 bp, Homo sapiens
ggcaggagggccct

SEQ ID NO: 4572009 - DNA, 16 bp, Homo sapiens
ggcaggatggcctttc

SEQ ID NO: 4572010 - DNA, 17 bp, Homo sapiens
ggcaggatggcctttcc

SEQ ID NO: 4572011 - DNA, 19 bp, Homo sapiens
ggcaggatggcctttcctt

SEQ ID NO: 4572012 - DNA, 15 bp, Homo sapiens
ggcaggcccactccc

SEQ ID NO: 4572013 - DNA, 19 bp, Homo sapiens
ggcaggctagaacctggca

SEQ ID NO: 4572014 - DNA, 13 bp, Homo sapiens
ggcaggctcactg

SEQ ID NO: 4572015 - DNA, 16 bp, Homo sapiens
ggcaggctcactgcca

SEQ ID NO: 4572016 - DNA, 10 bp, Homo sapiens
ggcaggctgg

SEQ ID NO: 4572017 - DNA, 13 bp, Homo sapiens
ggcaggctgggcc

SEQ ID NO: 4572018 - DNA, 22 bp, Homo sapiens
ggcaggctgtctggccaggcct

SEQ ID NO: 4572019 - DNA, 13 bp, Homo sapiens
ggcagggagcagt

SEQ ID NO: 4572020 - DNA, 18 bp, Homo sapiens
ggcagggagggcttgggg

SEQ ID NO: 4572021 - DNA, 17 bp, Homo sapiens
ggcagggccaggcctct

SEQ ID NO: 4572022 - DNA, 18 bp, Homo sapiens
ggcagggccaggcctctg

SEQ ID NO: 4572023 - DNA, 23 bp, Homo sapiens
ggcagggcccccaataaaccagt

SEQ ID NO: 4572024 - DNA, 13 bp, Homo sapiens
ggcagggcctggc

SEQ ID NO: 4572025 - DNA, 16 bp, Homo sapiens
ggcagggcctggctcc

SEQ ID NO: 4572026 - DNA, 16 bp, Homo sapiens
ggcagggccttgccca

SEQ ID NO: 4572027 - DNA, 21 bp, Homo sapiens
ggcagggccttgcccagagat

SEQ ID NO: 4572028 - DNA, 19 bp, Homo sapiens
ggcagggcgagctgcagga

SEQ ID NO: 4572029 - DNA, 14 bp, Homo sapiens
ggcagggctctccc

SEQ ID NO: 4572030 - DNA, 12 bp, Homo sapiens
ggcaggggccgg

SEQ ID NO: 4572031 - DNA, 22 bp, Homo sapiens
ggcagggggccccgccagggct

SEQ ID NO: 4572032 - DNA, 15 bp, Homo sapiens
ggcagggggccctgc

SEQ ID NO: 4572033 - DNA, 17 bp, Homo sapiens
ggcagggggccctgccc

SEQ ID NO: 4572034 - DNA, 23 bp, Homo sapiens
ggcagggggccctgccccacccc

SEQ ID NO: 4572035 - DNA, 14 bp, Homo sapiens
ggcaggggtggggg

SEQ ID NO: 4572036 - DNA, 16 bp, Homo sapiens
ggcaggggtgggggtg

SEQ ID NO: 4572037 - DNA, 18 bp, Homo sapiens
ggcaggtcctcccctctc

SEQ ID NO: 4572038 - DNA, 19 bp, Homo sapiens
ggcaggtcctgcccatgtg

SEQ ID NO: 4572039 - DNA, 15 bp, Homo sapiens
ggcagtaaagagaaa

SEQ ID NO: 4572040 - DNA, 16 bp, Homo sapiens
ggcagtaaagagaaac

SEQ ID NO: 4572041 - DNA, 19 bp, Homo sapiens
ggcagtaaagagaaacttt

SEQ ID NO: 4572042 - DNA, 18 bp, Homo sapiens
ggcagtagcctcctcctg

SEQ ID NO: 4572043 - DNA, 13 bp, Homo sapiens
ggcagtccaggcc

SEQ ID NO: 4572044 - DNA, 14 bp, Homo sapiens
ggcagtctcccctt

SEQ ID NO: 4572045 - DNA, 17 bp, Homo sapiens
ggcagtctccccttcct

SEQ ID NO: 4572046 - DNA, 18 bp, Homo sapiens
ggcagtctccccttcctg

SEQ ID NO: 4572047 - DNA, 17 bp, Homo sapiens
ggcagtctgctctgctg

SEQ ID NO: 4572048 - DNA, 23 bp, Homo sapiens
ggcagtgactcgacaaaggccac

SEQ ID NO: 4572049 - DNA, 19 bp, Homo sapiens
ggcagtgagtgccatgctt

SEQ ID NO: 4572050 - DNA, 15 bp, Homo sapiens
ggcagtgccccaggg

SEQ ID NO: 4572051 - DNA, 20 bp, Homo sapiens
ggcagttccttacctccctg

SEQ ID NO: 4572052 - DNA, 13 bp, Homo sapiens
ggcatacaaaata

SEQ ID NO: 4572053 - DNA, 22 bp, Homo sapiens
ggcatacgagagcagaggtctc

SEQ ID NO: 4572054 - DNA, 16 bp, Homo sapiens
ggcatagaggcttctc

SEQ ID NO: 4572055 - DNA, 19 bp, Homo sapiens
ggcatagtccccagagctc

SEQ ID NO: 4572056 - DNA, 22 bp, Homo sapiens
ggcatcacagaccccagctggg

SEQ ID NO: 4572057 - DNA, 18 bp, Homo sapiens
ggcatccagagtccctgc

SEQ ID NO: 4572058 - DNA, 17 bp, Homo sapiens
ggcatctcttccccaga

SEQ ID NO: 4572059 - DNA, 14 bp, Homo sapiens
ggcatctgcccctc

SEQ ID NO: 4572060 - DNA, 16 bp, Homo sapiens
ggcatctgcccctccc

SEQ ID NO: 4572061 - DNA, 18 bp, Homo sapiens
ggcatctgcccctccccc

SEQ ID NO: 4572062 - DNA, 17 bp, Homo sapiens
ggcatctttgccttggg

SEQ ID NO: 4572063 - DNA, 22 bp, Homo sapiens
ggcatctttgccttgggctgct

SEQ ID NO: 4572064 - DNA, 14 bp, Homo sapiens
ggcatcttttgtat

SEQ ID NO: 4572065 - DNA, 17 bp, Homo sapiens
ggcatcttttgtattaa

SEQ ID NO: 4572066 - DNA, 13 bp, Homo sapiens
ggcatggctccct

SEQ ID NO: 4572067 - DNA, 19 bp, Homo sapiens
ggcatggtggcgcaagcct

SEQ ID NO: 4572068 - DNA, 22 bp, Homo sapiens
ggcatggtggcgcaagcctgta

SEQ ID NO: 4572069 - DNA, 13 bp, Homo sapiens
ggcatgtcatttg

SEQ ID NO: 4572070 - DNA, 12 bp, Homo sapiens
ggcatttctatt

SEQ ID NO: 4572071 - DNA, 18 bp, Homo sapiens
ggcatttgctaaggcagc

SEQ ID NO: 4572072 - DNA, 14 bp, Homo sapiens
ggcatttggtgaga

SEQ ID NO: 4572073 - DNA, 15 bp, Homo sapiens
ggcattttcctcctc

SEQ ID NO: 4572074 - DNA, 14 bp, Homo sapiens
ggccaaaaggaaaa

SEQ ID NO: 4572075 - DNA, 14 bp, Homo sapiens
ggccaaaatcaaga

SEQ ID NO: 4572076 - DNA, 23 bp, Homo sapiens
ggccaaacaacagtcttcatttt

SEQ ID NO: 4572077 - DNA, 21 bp, Homo sapiens
ggccaaatccttggagtccca

SEQ ID NO: 4572078 - DNA, 13 bp, Homo sapiens
ggccaacatggtg

SEQ ID NO: 4572079 - DNA, 15 bp, Homo sapiens
ggccaacctcaggct

SEQ ID NO: 4572080 - DNA, 17 bp, Homo sapiens
ggccaacctcaggctcc

SEQ ID NO: 4572081 - DNA, 16 bp, Homo sapiens
ggccaagattgtcctt

SEQ ID NO: 4572082 - DNA, 22 bp, Homo sapiens
ggccaagattgtccttttctcc

SEQ ID NO: 4572083 - DNA, 14 bp, Homo sapiens
ggccaagcaggctg

SEQ ID NO: 4572084 - DNA, 13 bp, Homo sapiens
ggccaagcctatc

SEQ ID NO: 4572085 - DNA, 19 bp, Homo sapiens
ggccaaggacccaggcgct

SEQ ID NO: 4572086 - DNA, 20 bp, Homo sapiens
ggccaaggacccaggcgctg

SEQ ID NO: 4572087 - DNA, 16 bp, Homo sapiens
ggccaaggctctctct

SEQ ID NO: 4572088 - DNA, 13 bp, Homo sapiens
ggccaagggacca

SEQ ID NO: 4572089 - DNA, 12 bp, Homo sapiens
ggccaagttctt

SEQ ID NO: 4572090 - DNA, 15 bp, Homo sapiens
ggccaatttcacccc

SEQ ID NO: 4572091 - DNA, 17 bp, Homo sapiens
ggccacacaggcagggc

SEQ ID NO: 4572092 - DNA, 15 bp, Homo sapiens
ggccacacccaggaa

SEQ ID NO: 4572093 - DNA, 15 bp, Homo sapiens
ggccacactggggct

SEQ ID NO: 4572094 - DNA, 14 bp, Homo sapiens
ggccacagctgctg

SEQ ID NO: 4572095 - DNA, 17 bp, Homo sapiens
ggccacagctgctggag

SEQ ID NO: 4572096 - DNA, 11 bp, Homo sapiens
ggccacaggca

SEQ ID NO: 4572097 - DNA, 21 bp, Homo sapiens
ggccacaggcagtccaggcct

SEQ ID NO: 4572098 - DNA, 20 bp, Homo sapiens
ggccacagtagtcttgatga

SEQ ID NO: 4572099 - DNA, 20 bp, Homo sapiens
ggccacatgggagcagtcca

SEQ ID NO: 4572100 - DNA, 19 bp, Homo sapiens
ggccacatgggaggctcac

SEQ ID NO: 4572101 - DNA, 19 bp, Homo sapiens
ggccaccacctttggctgg

SEQ ID NO: 4572102 - DNA, 24 bp, Homo sapiens
ggccaccacctttggctggtagca

SEQ ID NO: 4572103 - DNA, 20 bp, Homo sapiens
ggccaccagccatcctccct

SEQ ID NO: 4572104 - DNA, 22 bp, Homo sapiens
ggccaccagccatcctccctcc

SEQ ID NO: 4572105 - DNA, 13 bp, Homo sapiens
ggccaccagggat

SEQ ID NO: 4572106 - DNA, 16 bp, Homo sapiens
ggccaccccaaacccc

SEQ ID NO: 4572107 - DNA, 16 bp, Homo sapiens
ggccaccgccttgccc

SEQ ID NO: 4572108 - DNA, 22 bp, Homo sapiens
ggccacgccggccacacccctc

SEQ ID NO: 4572109 - DNA, 16 bp, Homo sapiens
ggccacgtccaggtcc

SEQ ID NO: 4572110 - DNA, 11 bp, Homo sapiens
ggccacgtgcc

SEQ ID NO: 4572111 - DNA, 13 bp, Homo sapiens
ggccactcctcca

SEQ ID NO: 4572112 - DNA, 22 bp, Homo sapiens
ggccactggatcctgctgcttt

SEQ ID NO: 4572113 - DNA, 20 bp, Homo sapiens
ggccactggggtgccttcac

SEQ ID NO: 4572114 - DNA, 20 bp, Homo sapiens
ggccactgtttggaaataaa

SEQ ID NO: 4572115 - DNA, 15 bp, Homo sapiens
ggccacttttgacta

SEQ ID NO: 4572116 - DNA, 14 bp, Homo sapiens
ggccagacatggtg

SEQ ID NO: 4572117 - DNA, 16 bp, Homo sapiens
ggccagacgctgccgc

SEQ ID NO: 4572118 - DNA, 17 bp, Homo sapiens
ggccagacgctgccgct

SEQ ID NO: 4572119 - DNA, 21 bp, Homo sapiens
ggccagagcaaacagaaaaag

SEQ ID NO: 4572120 - DNA, 15 bp, Homo sapiens
ggccagagcctctgg

SEQ ID NO: 4572121 - DNA, 14 bp, Homo sapiens
ggccagaggctggg

SEQ ID NO: 4572122 - DNA, 16 bp, Homo sapiens
ggccagagtggcctgg

SEQ ID NO: 4572123 - DNA, 15 bp, Homo sapiens
ggccagatggcccct

SEQ ID NO: 4572124 - DNA, 20 bp, Homo sapiens
ggccagcaccctctcctggg

SEQ ID NO: 4572125 - DNA, 23 bp, Homo sapiens
ggccagcaccctctcctgggggt

SEQ ID NO: 4572126 - DNA, 17 bp, Homo sapiens
ggccagcaggcgggctc

SEQ ID NO: 4572127 - DNA, 18 bp, Homo sapiens
ggccagcccagccaggcc

SEQ ID NO: 4572128 - DNA, 16 bp, Homo sapiens
ggccagccccacccag

SEQ ID NO: 4572129 - DNA, 13 bp, Homo sapiens
ggccagcccctgg

SEQ ID NO: 4572130 - DNA, 16 bp, Homo sapiens
ggccagcccctggggc

SEQ ID NO: 4572131 - DNA, 22 bp, Homo sapiens
ggccagcccctggggcccagcc

SEQ ID NO: 4572132 - DNA, 20 bp, Homo sapiens
ggccagcctccgagagggag

SEQ ID NO: 4572133 - DNA, 14 bp, Homo sapiens
ggccagcggggctg

SEQ ID NO: 4572134 - DNA, 12 bp, Homo sapiens
ggccagctcagg

SEQ ID NO: 4572135 - DNA, 19 bp, Homo sapiens
ggccagctgccccagccag

SEQ ID NO: 4572136 - DNA, 13 bp, Homo sapiens
ggccagctgcggc

SEQ ID NO: 4572137 - DNA, 19 bp, Homo sapiens
ggccagctgcggccaggcc

SEQ ID NO: 4572138 - DNA, 20 bp, Homo sapiens
ggccagctgcggccaggcct

SEQ ID NO: 4572139 - DNA, 21 bp, Homo sapiens
ggccagctgcggccaggcctg

SEQ ID NO: 4572140 - DNA, 15 bp, Homo sapiens
ggccaggacaggccc

SEQ ID NO: 4572141 - DNA, 20 bp, Homo sapiens
ggccaggcaggagcccttct

SEQ ID NO: 4572142 - DNA, 21 bp, Homo sapiens
ggccaggcctctgctggctca

SEQ ID NO: 4572143 - DNA, 23 bp, Homo sapiens
ggccaggcctctgctggctcagg

SEQ ID NO: 4572144 - DNA, 18 bp, Homo sapiens
ggccaggggtgctcctgt

SEQ ID NO: 4572145 - DNA, 12 bp, Homo sapiens
ggccagtcccca

SEQ ID NO: 4572146 - DNA, 19 bp, Homo sapiens
ggccagtccccgaggagct

SEQ ID NO: 4572147 - DNA, 23 bp, Homo sapiens
ggccagtccccgaggagctgggc

SEQ ID NO: 4572148 - DNA, 16 bp, Homo sapiens
ggccagtcctgcctgg

SEQ ID NO: 4572149 - DNA, 21 bp, Homo sapiens
ggccagtcctgcctggccagg

SEQ ID NO: 4572150 - DNA, 17 bp, Homo sapiens
ggccataattatgaaaa

SEQ ID NO: 4572151 - DNA, 13 bp, Homo sapiens
ggccatactgcct

SEQ ID NO: 4572152 - DNA, 19 bp, Homo sapiens
ggccatatatgctgtattt

SEQ ID NO: 4572153 - DNA, 14 bp, Homo sapiens
ggccatctcaggag

SEQ ID NO: 4572154 - DNA, 18 bp, Homo sapiens
ggccatctccctccccag

SEQ ID NO: 4572155 - DNA, 20 bp, Homo sapiens
ggccatgctcaacccccctc

SEQ ID NO: 4572156 - DNA, 16 bp, Homo sapiens
ggccatgtccaaagag

SEQ ID NO: 4572157 - DNA, 23 bp, Homo sapiens
ggccatgtccaaagaggctgccc

SEQ ID NO: 4572158 - DNA, 20 bp, Homo sapiens
ggccatgtgctgccctgttg

SEQ ID NO: 4572159 - DNA, 12 bp, Homo sapiens
ggcccaaaacat

SEQ ID NO: 4572160 - DNA, 17 bp, Homo sapiens
ggcccaaccctgtctgt

SEQ ID NO: 4572161 - DNA, 21 bp, Homo sapiens
ggcccaaggcggcccctcccg

SEQ ID NO: 4572162 - DNA, 17 bp, Homo sapiens
ggcccacagctcccacc

SEQ ID NO: 4572163 - DNA, 20 bp, Homo sapiens
ggcccacagctcccacccca

SEQ ID NO: 4572164 - DNA, 14 bp, Homo sapiens
ggcccactccccag

SEQ ID NO: 4572165 - DNA, 11 bp, Homo sapiens
ggcccagagcc

SEQ ID NO: 4572166 - DNA, 23 bp, Homo sapiens
ggcccagagccatactgcgtcca

SEQ ID NO: 4572167 - DNA, 22 bp, Homo sapiens
ggcccagatctggtcccttgca

SEQ ID NO: 4572168 - DNA, 16 bp, Homo sapiens
ggcccagcacgagcct

SEQ ID NO: 4572169 - DNA, 20 bp, Homo sapiens
ggcccagcacgagcctgggc

SEQ ID NO: 4572170 - DNA, 16 bp, Homo sapiens
ggcccagcccagagcc

SEQ ID NO: 4572171 - DNA, 17 bp, Homo sapiens
ggcccagcccccacagt

SEQ ID NO: 4572172 - DNA, 21 bp, Homo sapiens
ggcccagcccccacagtgctg

SEQ ID NO: 4572173 - DNA, 13 bp, Homo sapiens
ggcccagccctgc

SEQ ID NO: 4572174 - DNA, 15 bp, Homo sapiens
ggcccagccctgctg

SEQ ID NO: 4572175 - DNA, 22 bp, Homo sapiens
ggcccagccctgctggccgcct

SEQ ID NO: 4572176 - DNA, 23 bp, Homo sapiens
ggcccagctgctcccctggagga

SEQ ID NO: 4572177 - DNA, 16 bp, Homo sapiens
ggcccaggagtccagg

SEQ ID NO: 4572178 - DNA, 19 bp, Homo sapiens
ggcccaggagtccaggccc

SEQ ID NO: 4572179 - DNA, 16 bp, Homo sapiens
ggcccaggccaggtgc

SEQ ID NO: 4572180 - DNA, 10 bp, Homo sapiens
ggcccaggga

SEQ ID NO: 4572181 - DNA, 12 bp, Homo sapiens
ggcccagggcat

SEQ ID NO: 4572182 - DNA, 15 bp, Homo sapiens
ggcccagggcatctg

SEQ ID NO: 4572183 - DNA, 22 bp, Homo sapiens
ggcccagtgtcaagttgtgctt

SEQ ID NO: 4572184 - DNA, 23 bp, Homo sapiens
ggcccagtgtcaagttgtgcttg

SEQ ID NO: 4572185 - DNA, 23 bp, Homo sapiens
ggccccaagaggggcgggctcag

SEQ ID NO: 4572186 - DNA, 20 bp, Homo sapiens
ggccccaatcttgcccactg

SEQ ID NO: 4572187 - DNA, 15 bp, Homo sapiens
ggccccaccacctag

SEQ ID NO: 4572188 - DNA, 16 bp, Homo sapiens
ggccccaccagtgcct

SEQ ID NO: 4572189 - DNA, 12 bp, Homo sapiens
ggccccacctga

SEQ ID NO: 4572190 - DNA, 18 bp, Homo sapiens
ggccccacctgaagggtg

SEQ ID NO: 4572191 - DNA, 20 bp, Homo sapiens
ggccccacctgaagggtgga

SEQ ID NO: 4572192 - DNA, 17 bp, Homo sapiens
ggccccagacagggtgg

SEQ ID NO: 4572193 - DNA, 19 bp, Homo sapiens
ggccccagcccaccctcct

SEQ ID NO: 4572194 - DNA, 11 bp, Homo sapiens
ggccccagcct

SEQ ID NO: 4572195 - DNA, 22 bp, Homo sapiens
ggccccaggcattgccaagggc

SEQ ID NO: 4572196 - DNA, 13 bp, Homo sapiens
ggccccagtcagc

SEQ ID NO: 4572197 - DNA, 17 bp, Homo sapiens
ggccccagtcagcctct

SEQ ID NO: 4572198 - DNA, 17 bp, Homo sapiens
ggccccatcctcatccc

SEQ ID NO: 4572199 - DNA, 20 bp, Homo sapiens
ggccccatcctcatccctga

SEQ ID NO: 4572200 - DNA, 21 bp, Homo sapiens
ggccccatcctcatccctgac

SEQ ID NO: 4572201 - DNA, 16 bp, Homo sapiens
ggcccccaacccctcc

SEQ ID NO: 4572202 - DNA, 21 bp, Homo sapiens
ggcccccaacccctcctccct

SEQ ID NO: 4572203 - DNA, 22 bp, Homo sapiens
ggcccccaacccctcctccctc

SEQ ID NO: 4572204 - DNA, 13 bp, Homo sapiens
ggcccccaataaa

SEQ ID NO: 4572205 - DNA, 15 bp, Homo sapiens
ggcccccaataaacc

SEQ ID NO: 4572206 - DNA, 15 bp, Homo sapiens
ggcccccaataaagg

SEQ ID NO: 4572207 - DNA, 18 bp, Homo sapiens
ggcccccaataaaggcag

SEQ ID NO: 4572208 - DNA, 19 bp, Homo sapiens
ggcccccaataaaggcagc

SEQ ID NO: 4572209 - DNA, 15 bp, Homo sapiens
ggcccccagcccctc

SEQ ID NO: 4572210 - DNA, 21 bp, Homo sapiens
ggcccccagcccctcctccct

SEQ ID NO: 4572211 - DNA, 17 bp, Homo sapiens
ggcccccatcagccctg

SEQ ID NO: 4572212 - DNA, 19 bp, Homo sapiens
ggcccccatcagccctgct

SEQ ID NO: 4572213 - DNA, 21 bp, Homo sapiens
ggcccccatcagccctgctag

SEQ ID NO: 4572214 - DNA, 21 bp, Homo sapiens
ggccccccgcgctcgcccagc

SEQ ID NO: 4572215 - DNA, 22 bp, Homo sapiens
ggccccccgcgctcgcccagca

SEQ ID NO: 4572216 - DNA, 17 bp, Homo sapiens
ggccccctggtctctgg

SEQ ID NO: 4572217 - DNA, 14 bp, Homo sapiens
ggccccgccagggc

SEQ ID NO: 4572218 - DNA, 13 bp, Homo sapiens
ggccccgccccat

SEQ ID NO: 4572219 - DNA, 19 bp, Homo sapiens
ggccccgcttgtccagcgc

SEQ ID NO: 4572220 - DNA, 12 bp, Homo sapiens
ggcccctccacg

SEQ ID NO: 4572221 - DNA, 18 bp, Homo sapiens
ggcccctccacgcctcct

SEQ ID NO: 4572222 - DNA, 23 bp, Homo sapiens
ggcccctccacgcctcctggcca

SEQ ID NO: 4572223 - DNA, 12 bp, Homo sapiens
ggcccctccact

SEQ ID NO: 4572224 - DNA, 21 bp, Homo sapiens
ggcccctccctacctcaacct

SEQ ID NO: 4572225 - DNA, 13 bp, Homo sapiens
ggcccctgggatg

SEQ ID NO: 4572226 - DNA, 22 bp, Homo sapiens
ggcccctgggatgggaccaggg

SEQ ID NO: 4572227 - DNA, 22 bp, Homo sapiens
ggcccctgggcttggcctgctg

SEQ ID NO: 4572228 - DNA, 19 bp, Homo sapiens
ggcccctgtctgttcccag

SEQ ID NO: 4572229 - DNA, 22 bp, Homo sapiens
ggcccctgtctgttcccagccc

SEQ ID NO: 4572230 - DNA, 19 bp, Homo sapiens
ggcccgaggtgatcccggt

SEQ ID NO: 4572231 - DNA, 19 bp, Homo sapiens
ggcccgcctcggcctccca

SEQ ID NO: 4572232 - DNA, 12 bp, Homo sapiens
ggcccggcaggg

SEQ ID NO: 4572233 - DNA, 18 bp, Homo sapiens
ggcccggccacacccagc

SEQ ID NO: 4572234 - DNA, 21 bp, Homo sapiens
ggcccggccacacccagcggc

SEQ ID NO: 4572235 - DNA, 14 bp, Homo sapiens
ggcccggctgagcc

SEQ ID NO: 4572236 - DNA, 16 bp, Homo sapiens
ggcccggctgagccct

SEQ ID NO: 4572237 - DNA, 17 bp, Homo sapiens
ggcccggctgagccctg

SEQ ID NO: 4572238 - DNA, 19 bp, Homo sapiens
ggcccggggctggcggcta

SEQ ID NO: 4572239 - DNA, 16 bp, Homo sapiens
ggcccggtccacaggt

SEQ ID NO: 4572240 - DNA, 19 bp, Homo sapiens
ggcccggtccacaggtcca

SEQ ID NO: 4572241 - DNA, 15 bp, Homo sapiens
ggccctccagagccc

SEQ ID NO: 4572242 - DNA, 17 bp, Homo sapiens
ggccctccagagcccca

SEQ ID NO: 4572243 - DNA, 13 bp, Homo sapiens
ggccctccccaca

SEQ ID NO: 4572244 - DNA, 19 bp, Homo sapiens
ggccctccctgtctccagg

SEQ ID NO: 4572245 - DNA, 23 bp, Homo sapiens
ggccctccctgtctccagggccc

SEQ ID NO: 4572246 - DNA, 15 bp, Homo sapiens
ggccctcgggcccag

SEQ ID NO: 4572247 - DNA, 19 bp, Homo sapiens
ggccctcgggcccagcccc

SEQ ID NO: 4572248 - DNA, 14 bp, Homo sapiens
ggccctctctgctc

SEQ ID NO: 4572249 - DNA, 15 bp, Homo sapiens
ggccctctctgctct

SEQ ID NO: 4572250 - DNA, 21 bp, Homo sapiens
ggccctctctgctctgcgtgt

SEQ ID NO: 4572251 - DNA, 16 bp, Homo sapiens
ggccctgactcctctg

SEQ ID NO: 4572252 - DNA, 19 bp, Homo sapiens
ggccctgactcctctggct

SEQ ID NO: 4572253 - DNA, 11 bp, Homo sapiens
ggccctgaggc

SEQ ID NO: 4572254 - DNA, 21 bp, Homo sapiens
ggccctgaggcggaggctgtg

SEQ ID NO: 4572255 - DNA, 22 bp, Homo sapiens
ggccctgcaaaaggactctcag

SEQ ID NO: 4572256 - DNA, 16 bp, Homo sapiens
ggccctgccccacccc

SEQ ID NO: 4572257 - DNA, 20 bp, Homo sapiens
ggccctgccccaccccatcc

SEQ ID NO: 4572258 - DNA, 20 bp, Homo sapiens
ggccctgcctgcagccaggg

SEQ ID NO: 4572259 - DNA, 22 bp, Homo sapiens
ggccctgcctgcagccagggct

SEQ ID NO: 4572260 - DNA, 12 bp, Homo sapiens
ggccctggagga

SEQ ID NO: 4572261 - DNA, 13 bp, Homo sapiens
ggccctggaggat

SEQ ID NO: 4572262 - DNA, 14 bp, Homo sapiens
ggccctggagggaa

SEQ ID NO: 4572263 - DNA, 12 bp, Homo sapiens
ggccctggcctg

SEQ ID NO: 4572264 - DNA, 15 bp, Homo sapiens
ggccctggcctgctg

SEQ ID NO: 4572265 - DNA, 15 bp, Homo sapiens
ggccctgggcctcag

SEQ ID NO: 4572266 - DNA, 11 bp, Homo sapiens
ggccctgggct

SEQ ID NO: 4572267 - DNA, 15 bp, Homo sapiens
ggccctgggctgggt

SEQ ID NO: 4572268 - DNA, 20 bp, Homo sapiens
ggccctggggatcttcccac

SEQ ID NO: 4572269 - DNA, 12 bp, Homo sapiens
ggccctgtccca

SEQ ID NO: 4572270 - DNA, 14 bp, Homo sapiens
ggccctgtcccagg

SEQ ID NO: 4572271 - DNA, 12 bp, Homo sapiens
ggccctgtgcct

SEQ ID NO: 4572272 - DNA, 19 bp, Homo sapiens
ggccctttccttccagatc

SEQ ID NO: 4572273 - DNA, 19 bp, Homo sapiens
ggccctttggatggacatg

SEQ ID NO: 4572274 - DNA, 17 bp, Homo sapiens
ggccgacccactgaccc

SEQ ID NO: 4572275 - DNA, 21 bp, Homo sapiens
ggccgagctcctggggagctc

SEQ ID NO: 4572276 - DNA, 12 bp, Homo sapiens
ggccgaggcggg

SEQ ID NO: 4572277 - DNA, 14 bp, Homo sapiens
ggccgaggcgggtg

SEQ ID NO: 4572278 - DNA, 14 bp, Homo sapiens
ggccgcagggcggg

SEQ ID NO: 4572279 - DNA, 22 bp, Homo sapiens
ggccgcgccaaataatgtctct

SEQ ID NO: 4572280 - DNA, 14 bp, Homo sapiens
ggccgcgccacccg

SEQ ID NO: 4572281 - DNA, 21 bp, Homo sapiens
ggccgcgccacccgggcaagg

SEQ ID NO: 4572282 - DNA, 22 bp, Homo sapiens
ggccgctggctggtgggccccc

SEQ ID NO: 4572283 - DNA, 15 bp, Homo sapiens
ggccggcctcctcct

SEQ ID NO: 4572284 - DNA, 17 bp, Homo sapiens
ggccgggcacagtggct

SEQ ID NO: 4572285 - DNA, 15 bp, Homo sapiens
ggccgggcaggtcct

SEQ ID NO: 4572286 - DNA, 17 bp, Homo sapiens
ggccggtgccagctgcc

SEQ ID NO: 4572287 - DNA, 18 bp, Homo sapiens
ggccggtgccagctgccc

SEQ ID NO: 4572288 - DNA, 21 bp, Homo sapiens
ggccggtgccagctgcccttg

SEQ ID NO: 4572289 - DNA, 20 bp, Homo sapiens
ggccggttttcctcagctct

SEQ ID NO: 4572290 - DNA, 21 bp, Homo sapiens
ggccggttttcctcagctcta

SEQ ID NO: 4572291 - DNA, 17 bp, Homo sapiens
ggccgtctcctccctca

SEQ ID NO: 4572292 - DNA, 16 bp, Homo sapiens
ggcctaacctgccgag

SEQ ID NO: 4572293 - DNA, 21 bp, Homo sapiens
ggcctaacctgccgagagtcc

SEQ ID NO: 4572294 - DNA, 20 bp, Homo sapiens
ggcctaaggagggtctccac

SEQ ID NO: 4572295 - DNA, 17 bp, Homo sapiens
ggcctaccccagttcct

SEQ ID NO: 4572296 - DNA, 21 bp, Homo sapiens
ggcctaccccagttcctagca

SEQ ID NO: 4572297 - DNA, 18 bp, Homo sapiens
ggcctatctggaagccac

SEQ ID NO: 4572298 - DNA, 23 bp, Homo sapiens
ggcctcaaagcaagcattcagaa

SEQ ID NO: 4572299 - DNA, 20 bp, Homo sapiens
ggcctcaactcctcccatag

SEQ ID NO: 4572300 - DNA, 20 bp, Homo sapiens
ggcctcaagcaatccacctg

SEQ ID NO: 4572301 - DNA, 14 bp, Homo sapiens
ggcctcagccctca

SEQ ID NO: 4572302 - DNA, 13 bp, Homo sapiens
ggcctcagccctg

SEQ ID NO: 4572303 - DNA, 15 bp, Homo sapiens
ggcctcagccctgct

SEQ ID NO: 4572304 - DNA, 16 bp, Homo sapiens
ggcctcagccctgctc

SEQ ID NO: 4572305 - DNA, 18 bp, Homo sapiens
ggcctcagccctgctccc

SEQ ID NO: 4572306 - DNA, 19 bp, Homo sapiens
ggcctcagccctgctccct

SEQ ID NO: 4572307 - DNA, 21 bp, Homo sapiens
ggcctcagccctgctccctgc

SEQ ID NO: 4572308 - DNA, 22 bp, Homo sapiens
ggcctcagccctgctccctgcc

SEQ ID NO: 4572309 - DNA, 16 bp, Homo sapiens
ggcctcccaaagtgct

SEQ ID NO: 4572310 - DNA, 20 bp, Homo sapiens
ggcctcccaaagtgctggga

SEQ ID NO: 4572311 - DNA, 23 bp, Homo sapiens
ggcctccctctctcttctgctcc

SEQ ID NO: 4572312 - DNA, 17 bp, Homo sapiens
ggcctccctgctgtgcc

SEQ ID NO: 4572313 - DNA, 22 bp, Homo sapiens
ggcctccctgctgtgccatgct

SEQ ID NO: 4572314 - DNA, 21 bp, Homo sapiens
ggcctccggcgtcagcctcca

SEQ ID NO: 4572315 - DNA, 22 bp, Homo sapiens
ggcctccggcgtcagcctccag

SEQ ID NO: 4572316 - DNA, 15 bp, Homo sapiens
ggcctcctcctcacc

SEQ ID NO: 4572317 - DNA, 19 bp, Homo sapiens
ggcctcctcctcacccttc

SEQ ID NO: 4572318 - DNA, 17 bp, Homo sapiens
ggcctcctcggagagca

SEQ ID NO: 4572319 - DNA, 21 bp, Homo sapiens
ggcctcctcggagagcagcag

SEQ ID NO: 4572320 - DNA, 20 bp, Homo sapiens
ggcctcgtgccatgatctgt

SEQ ID NO: 4572321 - DNA, 15 bp, Homo sapiens
ggcctcgtgcgcccg

SEQ ID NO: 4572322 - DNA, 22 bp, Homo sapiens
ggcctctaaccccaggccccga

SEQ ID NO: 4572323 - DNA, 15 bp, Homo sapiens
ggcctctccccagga

SEQ ID NO: 4572324 - DNA, 16 bp, Homo sapiens
ggcctctccctgcctg

SEQ ID NO: 4572325 - DNA, 18 bp, Homo sapiens
ggcctctctcctgcctgc

SEQ ID NO: 4572326 - DNA, 15 bp, Homo sapiens
ggcctctgctggctc

SEQ ID NO: 4572327 - DNA, 15 bp, Homo sapiens
ggcctcttcaggcct

SEQ ID NO: 4572328 - DNA, 16 bp, Homo sapiens
ggcctgaactgaggag

SEQ ID NO: 4572329 - DNA, 15 bp, Homo sapiens
ggcctgacagctctg

SEQ ID NO: 4572330 - DNA, 22 bp, Homo sapiens
ggcctgacttgagccactcctt

SEQ ID NO: 4572331 - DNA, 19 bp, Homo sapiens
ggcctgagcatccagacct

SEQ ID NO: 4572332 - DNA, 20 bp, Homo sapiens
ggcctgagcatccagacctg

SEQ ID NO: 4572333 - DNA, 18 bp, Homo sapiens
ggcctgagcgctcctgcc

SEQ ID NO: 4572334 - DNA, 17 bp, Homo sapiens
ggcctgatctctgctcc

SEQ ID NO: 4572335 - DNA, 19 bp, Homo sapiens
ggcctgatctctgctccct

SEQ ID NO: 4572336 - DNA, 23 bp, Homo sapiens
ggcctgatctctgctccctgcaa

SEQ ID NO: 4572337 - DNA, 14 bp, Homo sapiens
ggcctgatgctccc

SEQ ID NO: 4572338 - DNA, 15 bp, Homo sapiens
ggcctgatgctccct

SEQ ID NO: 4572339 - DNA, 20 bp, Homo sapiens
ggcctgatgctccctcccct

SEQ ID NO: 4572340 - DNA, 24 bp, Homo sapiens
ggcctgcaaaccttcctgggagga

SEQ ID NO: 4572341 - DNA, 19 bp, Homo sapiens
ggcctgcctccagggctgg

SEQ ID NO: 4572342 - DNA, 18 bp, Homo sapiens
ggcctgctaaggctcctc

SEQ ID NO: 4572343 - DNA, 20 bp, Homo sapiens
ggcctgctaaggctcctcct

SEQ ID NO: 4572344 - DNA, 21 bp, Homo sapiens
ggcctgctaaggctcctcctt

SEQ ID NO: 4572345 - DNA, 21 bp, Homo sapiens
ggcctgctgggctctccacct

SEQ ID NO: 4572346 - DNA, 22 bp, Homo sapiens
ggcctgctgggctctccacctc

SEQ ID NO: 4572347 - DNA, 10 bp, Homo sapiens
ggcctgctgt

SEQ ID NO: 4572348 - DNA, 15 bp, Homo sapiens
ggcctggagccccat

SEQ ID NO: 4572349 - DNA, 11 bp, Homo sapiens
ggcctggatgc

SEQ ID NO: 4572350 - DNA, 14 bp, Homo sapiens
ggcctggccaggag

SEQ ID NO: 4572351 - DNA, 18 bp, Homo sapiens
ggcctggccaggagctct

SEQ ID NO: 4572352 - DNA, 15 bp, Homo sapiens
ggcctggccatttcc

SEQ ID NO: 4572353 - DNA, 12 bp, Homo sapiens
ggcctggcctca

SEQ ID NO: 4572354 - DNA, 17 bp, Homo sapiens
ggcctgggcaggaggga

SEQ ID NO: 4572355 - DNA, 15 bp, Homo sapiens
ggcctggggagccca

SEQ ID NO: 4572356 - DNA, 18 bp, Homo sapiens
ggcctggggagcccactg

SEQ ID NO: 4572357 - DNA, 22 bp, Homo sapiens
ggcctggggagcccactgaggg

SEQ ID NO: 4572358 - DNA, 18 bp, Homo sapiens
ggcctggggtgcatctcc

SEQ ID NO: 4572359 - DNA, 22 bp, Homo sapiens
ggcctggttcaaagtaaagcag

SEQ ID NO: 4572360 - DNA, 15 bp, Homo sapiens
ggcctggtttcctcg

SEQ ID NO: 4572361 - DNA, 16 bp, Homo sapiens
ggcctgtccaccctgc

SEQ ID NO: 4572362 - DNA, 19 bp, Homo sapiens
ggcctgtcccttgcctctg

SEQ ID NO: 4572363 - DNA, 21 bp, Homo sapiens
ggcctgtcccttgcctctgcc

SEQ ID NO: 4572364 - DNA, 20 bp, Homo sapiens
ggcctgtctcatccccaggg

SEQ ID NO: 4572365 - DNA, 21 bp, Homo sapiens
ggcctgtggggactgaacctg

SEQ ID NO: 4572366 - DNA, 18 bp, Homo sapiens
ggcctgtgggtctctgaa

SEQ ID NO: 4572367 - DNA, 13 bp, Homo sapiens
ggccttaagaact

SEQ ID NO: 4572368 - DNA, 16 bp, Homo sapiens
ggccttaatttccttt

SEQ ID NO: 4572369 - DNA, 14 bp, Homo sapiens
ggccttcccctggc

SEQ ID NO: 4572370 - DNA, 19 bp, Homo sapiens
ggccttcgggaccctgggg

SEQ ID NO: 4572371 - DNA, 14 bp, Homo sapiens
ggccttgcccagag

SEQ ID NO: 4572372 - DNA, 17 bp, Homo sapiens
ggccttgggtgttccac

SEQ ID NO: 4572373 - DNA, 24 bp, Homo sapiens
ggcctttaagaaccttaatgacaa

SEQ ID NO: 4572374 - DNA, 12 bp, Homo sapiens
ggcctttccttc

SEQ ID NO: 4572375 - DNA, 19 bp, Homo sapiens
ggcctttccttccctctct

SEQ ID NO: 4572376 - DNA, 21 bp, Homo sapiens
ggcctttccttccctctctga

SEQ ID NO: 4572377 - DNA, 19 bp, Homo sapiens
ggcctttgcaagatgcttg

SEQ ID NO: 4572378 - DNA, 23 bp, Homo sapiens
ggcctttgcaagatgcttggttg

SEQ ID NO: 4572379 - DNA, 15 bp, Homo sapiens
ggcctttgccagcag

SEQ ID NO: 4572380 - DNA, 16 bp, Homo sapiens
ggcctttgccagcaga

SEQ ID NO: 4572381 - DNA, 18 bp, Homo sapiens
ggcctttgtgctgcgcct

SEQ ID NO: 4572382 - DNA, 23 bp, Homo sapiens
ggcctttgtgctgcgcctgcagg

SEQ ID NO: 4572383 - DNA, 21 bp, Homo sapiens
ggccttttatgtaatttcttt

SEQ ID NO: 4572384 - DNA, 15 bp, Homo sapiens
ggcctttttcattta

SEQ ID NO: 4572385 - DNA, 22 bp, Homo sapiens
ggcgcaagcctgtaatcccagc

SEQ ID NO: 4572386 - DNA, 15 bp, Homo sapiens
ggcgcaccccacagc

SEQ ID NO: 4572387 - DNA, 20 bp, Homo sapiens
ggcgcaccccacagctgggg

SEQ ID NO: 4572388 - DNA, 15 bp, Homo sapiens
ggcgcaggtgggctg

SEQ ID NO: 4572389 - DNA, 16 bp, Homo sapiens
ggcgcaggtgggctgg

SEQ ID NO: 4572390 - DNA, 20 bp, Homo sapiens
ggcgcaggtgggctggactt

SEQ ID NO: 4572391 - DNA, 18 bp, Homo sapiens
ggcgcccctgcctgtgcc

SEQ ID NO: 4572392 - DNA, 19 bp, Homo sapiens
ggcgcccgccaacacgcct

SEQ ID NO: 4572393 - DNA, 23 bp, Homo sapiens
ggcgcctataatcccagctactg

SEQ ID NO: 4572394 - DNA, 14 bp, Homo sapiens
ggcgctcagcagcc

SEQ ID NO: 4572395 - DNA, 22 bp, Homo sapiens
ggcgctcggtctccaccccagg

SEQ ID NO: 4572396 - DNA, 21 bp, Homo sapiens
ggcgctgcatacaggggaggg

SEQ ID NO: 4572397 - DNA, 14 bp, Homo sapiens
ggcgcttggatctg

SEQ ID NO: 4572398 - DNA, 15 bp, Homo sapiens
ggcgcttggatctgg

SEQ ID NO: 4572399 - DNA, 19 bp, Homo sapiens
ggcgcttggatctggggtg

SEQ ID NO: 4572400 - DNA, 15 bp, Homo sapiens
ggcggacgttccagc

SEQ ID NO: 4572401 - DNA, 16 bp, Homo sapiens
ggcggacgttccagcc

SEQ ID NO: 4572402 - DNA, 21 bp, Homo sapiens
ggcggaggctgtgctccgcca

SEQ ID NO: 4572403 - DNA, 17 bp, Homo sapiens
ggcggcccctcccgccc

SEQ ID NO: 4572404 - DNA, 21 bp, Homo sapiens
ggcggctactcagcagccctc

SEQ ID NO: 4572405 - DNA, 14 bp, Homo sapiens
ggcggctactctgg

SEQ ID NO: 4572406 - DNA, 15 bp, Homo sapiens
ggcggctactctgga

SEQ ID NO: 4572407 - DNA, 15 bp, Homo sapiens
ggcgggatcctccac

SEQ ID NO: 4572408 - DNA, 12 bp, Homo sapiens
ggcgggcccact

SEQ ID NO: 4572409 - DNA, 16 bp, Homo sapiens
ggcgggctcagagctt

SEQ ID NO: 4572410 - DNA, 12 bp, Homo sapiens
ggcgggctcctt

SEQ ID NO: 4572411 - DNA, 13 bp, Homo sapiens
ggcgggctgagga

SEQ ID NO: 4572412 - DNA, 16 bp, Homo sapiens
ggcgggtgatggccag

SEQ ID NO: 4572413 - DNA, 20 bp, Homo sapiens
ggcgggtgatggccagcccc

SEQ ID NO: 4572414 - DNA, 13 bp, Homo sapiens
ggcggtggctgcc

SEQ ID NO: 4572415 - DNA, 14 bp, Homo sapiens
ggcgtcagcctcca

SEQ ID NO: 4572416 - DNA, 16 bp, Homo sapiens
ggcgtcagcctccagc

SEQ ID NO: 4572417 - DNA, 18 bp, Homo sapiens
ggcgtcagcctccagcct

SEQ ID NO: 4572418 - DNA, 19 bp, Homo sapiens
ggcgtcagcctccagcctc

SEQ ID NO: 4572419 - DNA, 20 bp, Homo sapiens
ggcgtcagcctccagcctct

SEQ ID NO: 4572420 - DNA, 15 bp, Homo sapiens
ggcgtgactcaccca

SEQ ID NO: 4572421 - DNA, 19 bp, Homo sapiens
ggcgtgcccccctcctcca

SEQ ID NO: 4572422 - DNA, 15 bp, Homo sapiens
ggcgtgctacctgca

SEQ ID NO: 4572423 - DNA, 19 bp, Homo sapiens
ggcgttcacctccctgctc

SEQ ID NO: 4572424 - DNA, 17 bp, Homo sapiens
ggcgttctcccaaagat

SEQ ID NO: 4572425 - DNA, 21 bp, Homo sapiens
ggctaaaaaagctgaatcaga

SEQ ID NO: 4572426 - DNA, 19 bp, Homo sapiens
ggctaaaaggcttccaggc

SEQ ID NO: 4572427 - DNA, 19 bp, Homo sapiens
ggctaacgtttatttaaaa

SEQ ID NO: 4572428 - DNA, 14 bp, Homo sapiens
ggctaactggaagc

SEQ ID NO: 4572429 - DNA, 20 bp, Homo sapiens
ggctaagagctagcgctgcc

SEQ ID NO: 4572430 - DNA, 22 bp, Homo sapiens
ggctaaggaagtatcagcacta

SEQ ID NO: 4572431 - DNA, 14 bp, Homo sapiens
ggctacagctccac

SEQ ID NO: 4572432 - DNA, 15 bp, Homo sapiens
ggctacagctccaca

SEQ ID NO: 4572433 - DNA, 15 bp, Homo sapiens
ggctacccgctgtgg

SEQ ID NO: 4572434 - DNA, 18 bp, Homo sapiens
ggctacccgctgtggccg

SEQ ID NO: 4572435 - DNA, 16 bp, Homo sapiens
ggctactcagcagccc

SEQ ID NO: 4572436 - DNA, 17 bp, Homo sapiens
ggctactcagcagccct

SEQ ID NO: 4572437 - DNA, 18 bp, Homo sapiens
ggctactcagcagccctc

SEQ ID NO: 4572438 - DNA, 21 bp, Homo sapiens
ggctagaaccaagaagggcta

SEQ ID NO: 4572439 - DNA, 21 bp, Homo sapiens
ggctagaacctagaagggcta

SEQ ID NO: 4572440 - DNA, 14 bp, Homo sapiens
ggctagaacctggc

SEQ ID NO: 4572441 - DNA, 14 bp, Homo sapiens
ggctagaatctgga

SEQ ID NO: 4572442 - DNA, 13 bp, Homo sapiens
ggctagagaaatc

SEQ ID NO: 4572443 - DNA, 21 bp, Homo sapiens
ggctagagacagatgctggtg

SEQ ID NO: 4572444 - DNA, 18 bp, Homo sapiens
ggctagagtcctcactcc

SEQ ID NO: 4572445 - DNA, 19 bp, Homo sapiens
ggctagagtcctcactccc

SEQ ID NO: 4572446 - DNA, 20 bp, Homo sapiens
ggctagagtgcggtggcgcg

SEQ ID NO: 4572447 - DNA, 22 bp, Homo sapiens
ggctagcttctgcttttctgcc

SEQ ID NO: 4572448 - DNA, 21 bp, Homo sapiens
ggctaggtagaaaaagggtca

SEQ ID NO: 4572449 - DNA, 14 bp, Homo sapiens
ggctagtcagagag

SEQ ID NO: 4572450 - DNA, 18 bp, Homo sapiens
ggctagtcagagagagtg

SEQ ID NO: 4572451 - DNA, 16 bp, Homo sapiens
ggctatcctgctgaaa

SEQ ID NO: 4572452 - DNA, 20 bp, Homo sapiens
ggctatctatacctgccttt

SEQ ID NO: 4572453 - DNA, 19 bp, Homo sapiens
ggctatgaaaatgagccct

SEQ ID NO: 4572454 - DNA, 13 bp, Homo sapiens
ggctatgaacaga

SEQ ID NO: 4572455 - DNA, 23 bp, Homo sapiens
ggctcaaccttccaacttcctgt

SEQ ID NO: 4572456 - DNA, 12 bp, Homo sapiens
ggctcaagtctg

SEQ ID NO: 4572457 - DNA, 14 bp, Homo sapiens
ggctcaagttttta

SEQ ID NO: 4572458 - DNA, 15 bp, Homo sapiens
ggctcacactgagaa

SEQ ID NO: 4572459 - DNA, 18 bp, Homo sapiens
ggctcacactgagaatgt

SEQ ID NO: 4572460 - DNA, 17 bp, Homo sapiens
ggctcacccccttctcc

SEQ ID NO: 4572461 - DNA, 13 bp, Homo sapiens
ggctcactgccag

SEQ ID NO: 4572462 - DNA, 18 bp, Homo sapiens
ggctcactgccaggccag

SEQ ID NO: 4572463 - DNA, 21 bp, Homo sapiens
ggctcactgccaggccagcct

SEQ ID NO: 4572464 - DNA, 22 bp, Homo sapiens
ggctcactgccaggccagcctc

SEQ ID NO: 4572465 - DNA, 16 bp, Homo sapiens
ggctcagacccctcag

SEQ ID NO: 4572466 - DNA, 22 bp, Homo sapiens
ggctcagacccctcagccccag

SEQ ID NO: 4572467 - DNA, 13 bp, Homo sapiens
ggctcagagatgt

SEQ ID NO: 4572468 - DNA, 18 bp, Homo sapiens
ggctcagagatgtgcacc

SEQ ID NO: 4572469 - DNA, 14 bp, Homo sapiens
ggctcagagctttg

SEQ ID NO: 4572470 - DNA, 20 bp, Homo sapiens
ggctcagagctttgtcactt

SEQ ID NO: 4572471 - DNA, 13 bp, Homo sapiens
ggctcagtgccac

SEQ ID NO: 4572472 - DNA, 17 bp, Homo sapiens
ggctcagtgccacctat

SEQ ID NO: 4572473 - DNA, 19 bp, Homo sapiens
ggctccagctctggcacag

SEQ ID NO: 4572474 - DNA, 16 bp, Homo sapiens
ggctccatgctgggtc

SEQ ID NO: 4572475 - DNA, 23 bp, Homo sapiens
ggctcccaatcagcttttgttct

SEQ ID NO: 4572476 - DNA, 16 bp, Homo sapiens
ggctcccagccaggcc

SEQ ID NO: 4572477 - DNA, 18 bp, Homo sapiens
ggctcccagccaggccct

SEQ ID NO: 4572478 - DNA, 22 bp, Homo sapiens
ggctcccaggggtctccctggc

SEQ ID NO: 4572479 - DNA, 21 bp, Homo sapiens
ggctccccctccagccagaga

SEQ ID NO: 4572480 - DNA, 15 bp, Homo sapiens
ggctccccctcccca

SEQ ID NO: 4572481 - DNA, 17 bp, Homo sapiens
ggctccccctccccagg

SEQ ID NO: 4572482 - DNA, 19 bp, Homo sapiens
ggctccccctccccaggct

SEQ ID NO: 4572483 - DNA, 21 bp, Homo sapiens
ggctccccctccccaggctgg

SEQ ID NO: 4572484 - DNA, 19 bp, Homo sapiens
ggctcccctgcccagcctg

SEQ ID NO: 4572485 - DNA, 15 bp, Homo sapiens
ggctccctcctccag

SEQ ID NO: 4572486 - DNA, 17 bp, Homo sapiens
ggctccctgatggggga

SEQ ID NO: 4572487 - DNA, 20 bp, Homo sapiens
ggctccctgtaacctcttca

SEQ ID NO: 4572488 - DNA, 21 bp, Homo sapiens
ggctccctgtaacctcttcag

SEQ ID NO: 4572489 - DNA, 12 bp, Homo sapiens
ggctcctcagag

SEQ ID NO: 4572490 - DNA, 13 bp, Homo sapiens
ggctcctcagagc

SEQ ID NO: 4572491 - DNA, 21 bp, Homo sapiens
ggctcctcagagcgccaggaa

SEQ ID NO: 4572492 - DNA, 22 bp, Homo sapiens
ggctcctcagagcgccaggaag

SEQ ID NO: 4572493 - DNA, 13 bp, Homo sapiens
ggctcctgcccag

SEQ ID NO: 4572494 - DNA, 15 bp, Homo sapiens
ggctcctgcccaggc

SEQ ID NO: 4572495 - DNA, 16 bp, Homo sapiens
ggctcctgcccaggcc

SEQ ID NO: 4572496 - DNA, 17 bp, Homo sapiens
ggctcctgcccaggcca

SEQ ID NO: 4572497 - DNA, 21 bp, Homo sapiens
ggctcctgcccaggccacaga

SEQ ID NO: 4572498 - DNA, 15 bp, Homo sapiens
ggctcctgttttgca

SEQ ID NO: 4572499 - DNA, 22 bp, Homo sapiens
ggctcgctccctgtagctctgc

SEQ ID NO: 4572500 - DNA, 16 bp, Homo sapiens
ggctcggacccacccc

SEQ ID NO: 4572501 - DNA, 13 bp, Homo sapiens
ggctcgtggactg

SEQ ID NO: 4572502 - DNA, 23 bp, Homo sapiens
ggctcgtggactgagtgggaagc

SEQ ID NO: 4572503 - DNA, 18 bp, Homo sapiens
ggctcgttgactggctgt

SEQ ID NO: 4572504 - DNA, 19 bp, Homo sapiens
ggctctaattcacagtgct

SEQ ID NO: 4572505 - DNA, 12 bp, Homo sapiens
ggctctccacct

SEQ ID NO: 4572506 - DNA, 22 bp, Homo sapiens
ggctctccacctcagccttgga

SEQ ID NO: 4572507 - DNA, 15 bp, Homo sapiens
ggctctgccccctcc

SEQ ID NO: 4572508 - DNA, 16 bp, Homo sapiens
ggctctgccccctccc

SEQ ID NO: 4572509 - DNA, 18 bp, Homo sapiens
ggctctgccccctccccc

SEQ ID NO: 4572510 - DNA, 13 bp, Homo sapiens
ggctctgccccgc

SEQ ID NO: 4572511 - DNA, 15 bp, Homo sapiens
ggctctgccctggaa

SEQ ID NO: 4572512 - DNA, 17 bp, Homo sapiens
ggctctgccctggaaag

SEQ ID NO: 4572513 - DNA, 12 bp, Homo sapiens
ggctctgcctca

SEQ ID NO: 4572514 - DNA, 16 bp, Homo sapiens
ggctctgcctcaggag

SEQ ID NO: 4572515 - DNA, 15 bp, Homo sapiens
ggctctgtccccctg

SEQ ID NO: 4572516 - DNA, 16 bp, Homo sapiens
ggctctgtgctgaccc

SEQ ID NO: 4572517 - DNA, 22 bp, Homo sapiens
ggctctgtgggtgatggggagg

SEQ ID NO: 4572518 - DNA, 19 bp, Homo sapiens
ggctctgtttgtgggactg

SEQ ID NO: 4572519 - DNA, 20 bp, Homo sapiens
ggctctgtttgtgggactgg

SEQ ID NO: 4572520 - DNA, 21 bp, Homo sapiens
ggctcttatagaagcttcagc

SEQ ID NO: 4572521 - DNA, 19 bp, Homo sapiens
ggctcttatgtgtgccttt

SEQ ID NO: 4572522 - DNA, 20 bp, Homo sapiens
ggctcttctcatttcacccc

SEQ ID NO: 4572523 - DNA, 15 bp, Homo sapiens
ggctcttgactactt

SEQ ID NO: 4572524 - DNA, 15 bp, Homo sapiens
ggctgaacggggaga

SEQ ID NO: 4572525 - DNA, 17 bp, Homo sapiens
ggctgaacggggagaaa

SEQ ID NO: 4572526 - DNA, 20 bp, Homo sapiens
ggctgaacggggagaaaagg

SEQ ID NO: 4572527 - DNA, 14 bp, Homo sapiens
ggctgaagaggacc

SEQ ID NO: 4572528 - DNA, 16 bp, Homo sapiens
ggctgaataaagcctt

SEQ ID NO: 4572529 - DNA, 16 bp, Homo sapiens
ggctgaatgtatgtaa

SEQ ID NO: 4572530 - DNA, 16 bp, Homo sapiens
ggctgacacccaggcc

SEQ ID NO: 4572531 - DNA, 18 bp, Homo sapiens
ggctgacacccaggcccg

SEQ ID NO: 4572532 - DNA, 22 bp, Homo sapiens
ggctgacatgaagctgttgtgt

SEQ ID NO: 4572533 - DNA, 22 bp, Homo sapiens
ggctgacccagtccctggggga

SEQ ID NO: 4572534 - DNA, 24 bp, Homo sapiens
ggctgactagaagggccagtcctg

SEQ ID NO: 4572535 - DNA, 19 bp, Homo sapiens
ggctgagaaggaacaggga

SEQ ID NO: 4572536 - DNA, 16 bp, Homo sapiens
ggctgagccctcctga

SEQ ID NO: 4572537 - DNA, 12 bp, Homo sapiens
ggctgagccctg

SEQ ID NO: 4572538 - DNA, 16 bp, Homo sapiens
ggctgaggcaggagaa

SEQ ID NO: 4572539 - DNA, 14 bp, Homo sapiens
ggctgaggccagag

SEQ ID NO: 4572540 - DNA, 15 bp, Homo sapiens
ggctgaggccagagt

SEQ ID NO: 4572541 - DNA, 22 bp, Homo sapiens
ggctgaggttcctctgcctgcc

SEQ ID NO: 4572542 - DNA, 18 bp, Homo sapiens
ggctgagtctccagggcc

SEQ ID NO: 4572543 - DNA, 22 bp, Homo sapiens
ggctgcacctcctaccctccca

SEQ ID NO: 4572544 - DNA, 15 bp, Homo sapiens
ggctgccaaggccag

SEQ ID NO: 4572545 - DNA, 18 bp, Homo sapiens
ggctgccacacccagggg

SEQ ID NO: 4572546 - DNA, 18 bp, Homo sapiens
ggctgccagtgcctgggt

SEQ ID NO: 4572547 - DNA, 12 bp, Homo sapiens
ggctgcccagga

SEQ ID NO: 4572548 - DNA, 23 bp, Homo sapiens
ggctgcccaggagacagaccact

SEQ ID NO: 4572549 - DNA, 13 bp, Homo sapiens
ggctgcccctctc

SEQ ID NO: 4572550 - DNA, 15 bp, Homo sapiens
ggctgccgagccacc

SEQ ID NO: 4572551 - DNA, 18 bp, Homo sapiens
ggctgcctcctgccctta

SEQ ID NO: 4572552 - DNA, 13 bp, Homo sapiens
ggctgccttcttt

SEQ ID NO: 4572553 - DNA, 19 bp, Homo sapiens
ggctgcgacgcttgctctg

SEQ ID NO: 4572554 - DNA, 14 bp, Homo sapiens
ggctgcggccccct

SEQ ID NO: 4572555 - DNA, 15 bp, Homo sapiens
ggctgctcccacctg

SEQ ID NO: 4572556 - DNA, 17 bp, Homo sapiens
ggctgctgcccccaccc

SEQ ID NO: 4572557 - DNA, 16 bp, Homo sapiens
ggctggaaggggtcca

SEQ ID NO: 4572558 - DNA, 13 bp, Homo sapiens
ggctggaatctgg

SEQ ID NO: 4572559 - DNA, 20 bp, Homo sapiens
ggctggaatctggagagcta

SEQ ID NO: 4572560 - DNA, 13 bp, Homo sapiens
ggctggactgagg

SEQ ID NO: 4572561 - DNA, 15 bp, Homo sapiens
ggctggagctcctcc

SEQ ID NO: 4572562 - DNA, 18 bp, Homo sapiens
ggctggagctcctccctc

SEQ ID NO: 4572563 - DNA, 17 bp, Homo sapiens
ggctggagtgcagtggc

SEQ ID NO: 4572564 - DNA, 20 bp, Homo sapiens
ggctggagtgcagtggtgtg

SEQ ID NO: 4572565 - DNA, 17 bp, Homo sapiens
ggctggatctgtgaggg

SEQ ID NO: 4572566 - DNA, 18 bp, Homo sapiens
ggctggcacagcccctgg

SEQ ID NO: 4572567 - DNA, 14 bp, Homo sapiens
ggctggcaggtatg

SEQ ID NO: 4572568 - DNA, 15 bp, Homo sapiens
ggctggcccagccct

SEQ ID NO: 4572569 - DNA, 22 bp, Homo sapiens
ggctggcccagccctgctggcc

SEQ ID NO: 4572570 - DNA, 19 bp, Homo sapiens
ggctggctctaccttcctg

SEQ ID NO: 4572571 - DNA, 10 bp, Homo sapiens
ggctggctgg

SEQ ID NO: 4572572 - DNA, 11 bp, Homo sapiens
ggctgggccat

SEQ ID NO: 4572573 - DNA, 16 bp, Homo sapiens
ggctgggcccctccag

SEQ ID NO: 4572574 - DNA, 15 bp, Homo sapiens
ggctgggcccctggg

SEQ ID NO: 4572575 - DNA, 22 bp, Homo sapiens
ggctgggccctctttccctgcg

SEQ ID NO: 4572576 - DNA, 14 bp, Homo sapiens
ggctggggaggtgc

SEQ ID NO: 4572577 - DNA, 17 bp, Homo sapiens
ggctgggggcaggaggg

SEQ ID NO: 4572578 - DNA, 18 bp, Homo sapiens
ggctgggggcaggagggc

SEQ ID NO: 4572579 - DNA, 19 bp, Homo sapiens
ggctggggtcacagaggca

SEQ ID NO: 4572580 - DNA, 18 bp, Homo sapiens
ggctggggttgccagagg

SEQ ID NO: 4572581 - DNA, 17 bp, Homo sapiens
ggctgggtcctgccagc

SEQ ID NO: 4572582 - DNA, 18 bp, Homo sapiens
ggctgggtcctgccagct

SEQ ID NO: 4572583 - DNA, 12 bp, Homo sapiens
ggctgggtgctg

SEQ ID NO: 4572584 - DNA, 15 bp, Homo sapiens
ggctggtaagagaag

SEQ ID NO: 4572585 - DNA, 13 bp, Homo sapiens
ggctggtagcagc

SEQ ID NO: 4572586 - DNA, 15 bp, Homo sapiens
ggctggtagcagcag

SEQ ID NO: 4572587 - DNA, 18 bp, Homo sapiens
ggctggtagcagcaggct

SEQ ID NO: 4572588 - DNA, 20 bp, Homo sapiens
ggctggtagcagcaggctca

SEQ ID NO: 4572589 - DNA, 21 bp, Homo sapiens
ggctggtagcagcaggctcag

SEQ ID NO: 4572590 - DNA, 23 bp, Homo sapiens
ggctggtagcagcaggctcaggc

SEQ ID NO: 4572591 - DNA, 16 bp, Homo sapiens
ggctggtccttattta

SEQ ID NO: 4572592 - DNA, 13 bp, Homo sapiens
ggctggtgggccc

SEQ ID NO: 4572593 - DNA, 12 bp, Homo sapiens
ggctggtgtccc

SEQ ID NO: 4572594 - DNA, 14 bp, Homo sapiens
ggctggtgtcccct

SEQ ID NO: 4572595 - DNA, 14 bp, Homo sapiens
ggctggttaatgta

SEQ ID NO: 4572596 - DNA, 21 bp, Homo sapiens
ggctgtccttaacccacctct

SEQ ID NO: 4572597 - DNA, 13 bp, Homo sapiens
ggctgtctgtcac

SEQ ID NO: 4572598 - DNA, 13 bp, Homo sapiens
ggctgtgctggga

SEQ ID NO: 4572599 - DNA, 18 bp, Homo sapiens
ggctgtgctgtattttga

SEQ ID NO: 4572600 - DNA, 21 bp, Homo sapiens
ggctgtggcatccagagtccc

SEQ ID NO: 4572601 - DNA, 22 bp, Homo sapiens
ggctgtggccgtctcctccctc

SEQ ID NO: 4572602 - DNA, 18 bp, Homo sapiens
ggctgtgtgtctgcttgt

SEQ ID NO: 4572603 - DNA, 20 bp, Homo sapiens
ggctgtgtgtcttctgcccc

SEQ ID NO: 4572604 - DNA, 16 bp, Homo sapiens
ggctgtgttatgaaaa

SEQ ID NO: 4572605 - DNA, 18 bp, Homo sapiens
ggctgtgtttccatctca

SEQ ID NO: 4572606 - DNA, 15 bp, Homo sapiens
ggctgttgcattttt

SEQ ID NO: 4572607 - DNA, 21 bp, Homo sapiens
ggctgttttccctctgctgct

SEQ ID NO: 4572608 - DNA, 23 bp, Homo sapiens
ggcttaaacccatattgtaaaac

SEQ ID NO: 4572609 - DNA, 21 bp, Homo sapiens
ggcttaattattgatgttttc

SEQ ID NO: 4572610 - DNA, 21 bp, Homo sapiens
ggcttatgtcatcagtaaagt

SEQ ID NO: 4572611 - DNA, 23 bp, Homo sapiens
ggcttccccactcccccgtttct

SEQ ID NO: 4572612 - DNA, 22 bp, Homo sapiens
ggcttcctcaaatacatgcaca

SEQ ID NO: 4572613 - DNA, 12 bp, Homo sapiens
ggcttcctgccc

SEQ ID NO: 4572614 - DNA, 11 bp, Homo sapiens
ggcttcctggg

SEQ ID NO: 4572615 - DNA, 21 bp, Homo sapiens
ggcttcggagtgaatgtggca

SEQ ID NO: 4572616 - DNA, 19 bp, Homo sapiens
ggcttcgttagaccgctct

SEQ ID NO: 4572617 - DNA, 21 bp, Homo sapiens
ggcttctccgccagcctcctc

SEQ ID NO: 4572618 - DNA, 23 bp, Homo sapiens
ggcttctccgccagcctcctctg

SEQ ID NO: 4572619 - DNA, 11 bp, Homo sapiens
ggcttctcctg

SEQ ID NO: 4572620 - DNA, 22 bp, Homo sapiens
ggcttctcgctgcgcagcctcc

SEQ ID NO: 4572621 - DNA, 23 bp, Homo sapiens
ggcttctcgctgcgcagcctcca

SEQ ID NO: 4572622 - DNA, 14 bp, Homo sapiens
ggcttctctctgtg

SEQ ID NO: 4572623 - DNA, 12 bp, Homo sapiens
ggcttgaagcca

SEQ ID NO: 4572624 - DNA, 15 bp, Homo sapiens
ggcttgaagccaaag

SEQ ID NO: 4572625 - DNA, 14 bp, Homo sapiens
ggcttgaaggccag

SEQ ID NO: 4572626 - DNA, 21 bp, Homo sapiens
ggcttgagaaatatggacact

SEQ ID NO: 4572627 - DNA, 20 bp, Homo sapiens
ggcttgagcccccgcgccca

SEQ ID NO: 4572628 - DNA, 21 bp, Homo sapiens
ggcttgctgtttactcccttc

SEQ ID NO: 4572629 - DNA, 14 bp, Homo sapiens
ggcttggcctgctg

SEQ ID NO: 4572630 - DNA, 16 bp, Homo sapiens
ggcttggcctgctgtg

SEQ ID NO: 4572631 - DNA, 18 bp, Homo sapiens
ggctttaaataaattaag

SEQ ID NO: 4572632 - DNA, 11 bp, Homo sapiens
ggctttcaaag

SEQ ID NO: 4572633 - DNA, 23 bp, Homo sapiens
ggctttcaaagctaaaatatata

SEQ ID NO: 4572634 - DNA, 21 bp, Homo sapiens
ggctttcagagccagcctggc

SEQ ID NO: 4572635 - DNA, 13 bp, Homo sapiens
ggctttcccagga

SEQ ID NO: 4572636 - DNA, 16 bp, Homo sapiens
ggctttgcagctgctg

SEQ ID NO: 4572637 - DNA, 12 bp, Homo sapiens
ggctttggattt

SEQ ID NO: 4572638 - DNA, 19 bp, Homo sapiens
ggcttttattaatgcactt

SEQ ID NO: 4572639 - DNA, 16 bp, Homo sapiens
ggctttttttttctct

SEQ ID NO: 4572640 - DNA, 22 bp, Homo sapiens
gggaaaactgccaatatagaaa

SEQ ID NO: 4572641 - DNA, 23 bp, Homo sapiens
gggaaaagcatttttcaatatat

SEQ ID NO: 4572642 - DNA, 14 bp, Homo sapiens
gggaaacagcctct

SEQ ID NO: 4572643 - DNA, 21 bp, Homo sapiens
gggaaacatcacacctgccct

SEQ ID NO: 4572644 - DNA, 18 bp, Homo sapiens
gggaaactaagattcttt

SEQ ID NO: 4572645 - DNA, 14 bp, Homo sapiens
gggaaactggctga

SEQ ID NO: 4572646 - DNA, 13 bp, Homo sapiens
gggaaagaagaaa

SEQ ID NO: 4572647 - DNA, 14 bp, Homo sapiens
gggaaagaagaaac

SEQ ID NO: 4572648 - DNA, 17 bp, Homo sapiens
gggaaaggatggagtgt

SEQ ID NO: 4572649 - DNA, 13 bp, Homo sapiens
gggaaaggggtgc

SEQ ID NO: 4572650 - DNA, 23 bp, Homo sapiens
gggaaagtgtgagctcttccctt

SEQ ID NO: 4572651 - DNA, 15 bp, Homo sapiens
gggaaatagcggccc

SEQ ID NO: 4572652 - DNA, 16 bp, Homo sapiens
gggaaatagcggccct

SEQ ID NO: 4572653 - DNA, 18 bp, Homo sapiens
gggaaatagcggccctgg

SEQ ID NO: 4572654 - DNA, 14 bp, Homo sapiens
gggaacaggtccca

SEQ ID NO: 4572655 - DNA, 20 bp, Homo sapiens
gggaacagtgcatgtgcatg

SEQ ID NO: 4572656 - DNA, 19 bp, Homo sapiens
gggaacctagctacactga

SEQ ID NO: 4572657 - DNA, 19 bp, Homo sapiens
gggaacttgcgagtccaag

SEQ ID NO: 4572658 - DNA, 15 bp, Homo sapiens
gggaagacgaggccc

SEQ ID NO: 4572659 - DNA, 16 bp, Homo sapiens
gggaagagaagacaaa

SEQ ID NO: 4572660 - DNA, 15 bp, Homo sapiens
gggaagccagtcagg

SEQ ID NO: 4572661 - DNA, 19 bp, Homo sapiens
gggaagcccatcctgacca

SEQ ID NO: 4572662 - DNA, 12 bp, Homo sapiens
gggaagccctgg

SEQ ID NO: 4572663 - DNA, 16 bp, Homo sapiens
gggaagctggcctgag

SEQ ID NO: 4572664 - DNA, 19 bp, Homo sapiens
gggaaggccctgaggcgga

SEQ ID NO: 4572665 - DNA, 11 bp, Homo sapiens
gggaaggcctc

SEQ ID NO: 4572666 - DNA, 14 bp, Homo sapiens
gggaagtaacagac

SEQ ID NO: 4572667 - DNA, 20 bp, Homo sapiens
gggaagtcgggcatggtggc

SEQ ID NO: 4572668 - DNA, 23 bp, Homo sapiens
gggaagtgaagactggaagctaa

SEQ ID NO: 4572669 - DNA, 14 bp, Homo sapiens
gggaatgaacctgg

SEQ ID NO: 4572670 - DNA, 16 bp, Homo sapiens
gggaatgaggggaagc

SEQ ID NO: 4572671 - DNA, 13 bp, Homo sapiens
gggaatgggagag

SEQ ID NO: 4572672 - DNA, 12 bp, Homo sapiens
gggaattaaata

SEQ ID NO: 4572673 - DNA, 16 bp, Homo sapiens
gggaattccctccccc

SEQ ID NO: 4572674 - DNA, 17 bp, Homo sapiens
gggaattccctccccct

SEQ ID NO: 4572675 - DNA, 18 bp, Homo sapiens
gggaattgcgctcagggg

SEQ ID NO: 4572676 - DNA, 14 bp, Homo sapiens
gggacaccagagct

SEQ ID NO: 4572677 - DNA, 14 bp, Homo sapiens
gggacaccagccag

SEQ ID NO: 4572678 - DNA, 22 bp, Homo sapiens
gggacaccagccaggctctgtg

SEQ ID NO: 4572679 - DNA, 17 bp, Homo sapiens
gggacagagacacctgc

SEQ ID NO: 4572680 - DNA, 20 bp, Homo sapiens
gggacagagacacctgcacc

SEQ ID NO: 4572681 - DNA, 17 bp, Homo sapiens
gggacagaggcctgccc

SEQ ID NO: 4572682 - DNA, 18 bp, Homo sapiens
gggacagaggcctgcccg

SEQ ID NO: 4572683 - DNA, 17 bp, Homo sapiens
gggacagggctggccca

SEQ ID NO: 4572684 - DNA, 18 bp, Homo sapiens
gggacagggctggcccag

SEQ ID NO: 4572685 - DNA, 19 bp, Homo sapiens
gggacagggctggcccagc

SEQ ID NO: 4572686 - DNA, 20 bp, Homo sapiens
gggacagggctggcccagcc

SEQ ID NO: 4572687 - DNA, 17 bp, Homo sapiens
gggacaggtgacagtgg

SEQ ID NO: 4572688 - DNA, 17 bp, Homo sapiens
gggacagtgctgcagct

SEQ ID NO: 4572689 - DNA, 21 bp, Homo sapiens
gggacagtttatcatgaagcc

SEQ ID NO: 4572690 - DNA, 17 bp, Homo sapiens
gggacatgccctgtgtg

SEQ ID NO: 4572691 - DNA, 19 bp, Homo sapiens
gggaccaaattgcttctag

SEQ ID NO: 4572692 - DNA, 17 bp, Homo sapiens
gggaccaccctgagccg

SEQ ID NO: 4572693 - DNA, 14 bp, Homo sapiens
gggaccactccagg

SEQ ID NO: 4572694 - DNA, 17 bp, Homo sapiens
gggaccactgggtgaga

SEQ ID NO: 4572695 - DNA, 20 bp, Homo sapiens
gggaccaggtttgcaggagc

SEQ ID NO: 4572696 - DNA, 13 bp, Homo sapiens
gggaccccccccc

SEQ ID NO: 4572697 - DNA, 20 bp, Homo sapiens
gggacccctcgccccagcct

SEQ ID NO: 4572698 - DNA, 23 bp, Homo sapiens
gggaccctgtgacatggtgcctg

SEQ ID NO: 4572699 - DNA, 18 bp, Homo sapiens
gggacctctccacacagg

SEQ ID NO: 4572700 - DNA, 19 bp, Homo sapiens
gggacctgaactgtcctgg

SEQ ID NO: 4572701 - DNA, 17 bp, Homo sapiens
gggacctgctgctcagt

SEQ ID NO: 4572702 - DNA, 16 bp, Homo sapiens
gggacgatcaggagga

SEQ ID NO: 4572703 - DNA, 14 bp, Homo sapiens
gggacggcttctca

SEQ ID NO: 4572704 - DNA, 21 bp, Homo sapiens
gggacggggggccccagtcag

SEQ ID NO: 4572705 - DNA, 20 bp, Homo sapiens
gggactatctttgctgcaga

SEQ ID NO: 4572706 - DNA, 17 bp, Homo sapiens
gggactcagttgttctg

SEQ ID NO: 4572707 - DNA, 21 bp, Homo sapiens
gggactccatgctccttgaga

SEQ ID NO: 4572708 - DNA, 17 bp, Homo sapiens
gggactccggctgtgct

SEQ ID NO: 4572709 - DNA, 20 bp, Homo sapiens
gggactccggctgtgctggg

SEQ ID NO: 4572710 - DNA, 21 bp, Homo sapiens
gggactctcctcctcccctcc

SEQ ID NO: 4572711 - DNA, 19 bp, Homo sapiens
gggactctgaagcctctgg

SEQ ID NO: 4572712 - DNA, 20 bp, Homo sapiens
gggactctgaagcctctggg

SEQ ID NO: 4572713 - DNA, 15 bp, Homo sapiens
gggactgctaaataa

SEQ ID NO: 4572714 - DNA, 21 bp, Homo sapiens
gggactgctacctctgagaag

SEQ ID NO: 4572715 - DNA, 14 bp, Homo sapiens
gggactgctgctct

SEQ ID NO: 4572716 - DNA, 15 bp, Homo sapiens
gggactgctgctctc

SEQ ID NO: 4572717 - DNA, 21 bp, Homo sapiens
gggactgctgctctcccaagg

SEQ ID NO: 4572718 - DNA, 16 bp, Homo sapiens
gggactgtgcctggct

SEQ ID NO: 4572719 - DNA, 18 bp, Homo sapiens
gggactgtgcctggctcc

SEQ ID NO: 4572720 - DNA, 22 bp, Homo sapiens
gggactgtggtgacttctgctg

SEQ ID NO: 4572721 - DNA, 18 bp, Homo sapiens
gggacttcaactgcccag

SEQ ID NO: 4572722 - DNA, 19 bp, Homo sapiens
gggacttcaactgcccagc

SEQ ID NO: 4572723 - DNA, 19 bp, Homo sapiens
gggagaaatacttgaactt

SEQ ID NO: 4572724 - DNA, 19 bp, Homo sapiens
gggagacagcttctctgca

SEQ ID NO: 4572725 - DNA, 18 bp, Homo sapiens
gggagacattagaaaaaa

SEQ ID NO: 4572726 - DNA, 16 bp, Homo sapiens
gggagagacaggcagc

SEQ ID NO: 4572727 - DNA, 17 bp, Homo sapiens
gggagagggaggtcact

SEQ ID NO: 4572728 - DNA, 17 bp, Homo sapiens
gggagcagtccatgcat

SEQ ID NO: 4572729 - DNA, 16 bp, Homo sapiens
gggagcatggctgtga

SEQ ID NO: 4572730 - DNA, 21 bp, Homo sapiens
gggagccagactgtccaggga

SEQ ID NO: 4572731 - DNA, 12 bp, Homo sapiens
gggagcccactg

SEQ ID NO: 4572732 - DNA, 12 bp, Homo sapiens
gggagccccagg

SEQ ID NO: 4572733 - DNA, 14 bp, Homo sapiens
gggagccccagggt

SEQ ID NO: 4572734 - DNA, 21 bp, Homo sapiens
gggagccccagggtcttccct

SEQ ID NO: 4572735 - DNA, 17 bp, Homo sapiens
gggagccgcagagcctg

SEQ ID NO: 4572736 - DNA, 18 bp, Homo sapiens
gggagccgcagagcctga

SEQ ID NO: 4572737 - DNA, 13 bp, Homo sapiens
gggagccgggagc

SEQ ID NO: 4572738 - DNA, 12 bp, Homo sapiens
gggagcctagct

SEQ ID NO: 4572739 - DNA, 15 bp, Homo sapiens
gggagcctgtggcca

SEQ ID NO: 4572740 - DNA, 17 bp, Homo sapiens
gggagcctgtggccagc

SEQ ID NO: 4572741 - DNA, 16 bp, Homo sapiens
gggagcgtctgggaac

SEQ ID NO: 4572742 - DNA, 12 bp, Homo sapiens
gggagctcagga

SEQ ID NO: 4572743 - DNA, 22 bp, Homo sapiens
gggagctcaggaaccgaggcag

SEQ ID NO: 4572744 - DNA, 23 bp, Homo sapiens
gggagctcaggaaccgaggcagg

SEQ ID NO: 4572745 - DNA, 18 bp, Homo sapiens
gggagctcctctcctgga

SEQ ID NO: 4572746 - DNA, 19 bp, Homo sapiens
gggagctcctgggaccctt

SEQ ID NO: 4572747 - DNA, 17 bp, Homo sapiens
gggagctgaaccacaga

SEQ ID NO: 4572748 - DNA, 13 bp, Homo sapiens
gggagctgggccc

SEQ ID NO: 4572749 - DNA, 16 bp, Homo sapiens
gggagctgggccctgc

SEQ ID NO: 4572750 - DNA, 19 bp, Homo sapiens
gggagctgggccctgcctg

SEQ ID NO: 4572751 - DNA, 13 bp, Homo sapiens
gggaggatacaga

SEQ ID NO: 4572752 - DNA, 18 bp, Homo sapiens
gggaggatacagaggaga

SEQ ID NO: 4572753 - DNA, 19 bp, Homo sapiens
gggaggcagatggagccca

SEQ ID NO: 4572754 - DNA, 17 bp, Homo sapiens
gggaggcagccacaggg

SEQ ID NO: 4572755 - DNA, 16 bp, Homo sapiens
gggaggccaccccaaa

SEQ ID NO: 4572756 - DNA, 15 bp, Homo sapiens
gggaggccgaggcgg

SEQ ID NO: 4572757 - DNA, 20 bp, Homo sapiens
gggaggcggacgttccagcc

SEQ ID NO: 4572758 - DNA, 21 bp, Homo sapiens
gggaggcggacgttccagccg

SEQ ID NO: 4572759 - DNA, 11 bp, Homo sapiens
gggaggctccc

SEQ ID NO: 4572760 - DNA, 16 bp, Homo sapiens
gggaggctcccggggc

SEQ ID NO: 4572761 - DNA, 15 bp, Homo sapiens
gggaggctggggccc

SEQ ID NO: 4572762 - DNA, 12 bp, Homo sapiens
gggagggaaggg

SEQ ID NO: 4572763 - DNA, 11 bp, Homo sapiens
gggagggcagc

SEQ ID NO: 4572764 - DNA, 13 bp, Homo sapiens
gggagggcagcag

SEQ ID NO: 4572765 - DNA, 12 bp, Homo sapiens
gggaggggaggc

SEQ ID NO: 4572766 - DNA, 15 bp, Homo sapiens
gggaggtcgaggtag

SEQ ID NO: 4572767 - DNA, 20 bp, Homo sapiens
gggaggtgctgggggagccc

SEQ ID NO: 4572768 - DNA, 23 bp, Homo sapiens
gggaggtggaagcagaggccctg

SEQ ID NO: 4572769 - DNA, 21 bp, Homo sapiens
gggaggttttattctgacttc

SEQ ID NO: 4572770 - DNA, 23 bp, Homo sapiens
gggaggttttattctgacttcct

SEQ ID NO: 4572771 - DNA, 18 bp, Homo sapiens
gggagtaataggaccaga

SEQ ID NO: 4572772 - DNA, 17 bp, Homo sapiens
gggagtcagggacctgc

SEQ ID NO: 4572773 - DNA, 14 bp, Homo sapiens
gggagtccagggtt

SEQ ID NO: 4572774 - DNA, 17 bp, Homo sapiens
gggagtgagacaggctg

SEQ ID NO: 4572775 - DNA, 18 bp, Homo sapiens
gggagtgcagagaaagaa

SEQ ID NO: 4572776 - DNA, 12 bp, Homo sapiens
gggagtggggcc

SEQ ID NO: 4572777 - DNA, 22 bp, Homo sapiens
gggagtggggcctttgccagca

SEQ ID NO: 4572778 - DNA, 11 bp, Homo sapiens
gggagtgtgta

SEQ ID NO: 4572779 - DNA, 17 bp, Homo sapiens
gggagtgttcccgtgcc

SEQ ID NO: 4572780 - DNA, 21 bp, Homo sapiens
gggagtgttcccgtgcctggg

SEQ ID NO: 4572781 - DNA, 23 bp, Homo sapiens
gggataactgatttctatggctt

SEQ ID NO: 4572782 - DNA, 17 bp, Homo sapiens
gggatataatacatatt

SEQ ID NO: 4572783 - DNA, 14 bp, Homo sapiens
gggatcctccacag

SEQ ID NO: 4572784 - DNA, 16 bp, Homo sapiens
gggatgattgcttgag

SEQ ID NO: 4572785 - DNA, 14 bp, Homo sapiens
gggatgcctgtctt

SEQ ID NO: 4572786 - DNA, 11 bp, Homo sapiens
gggatgctctt

SEQ ID NO: 4572787 - DNA, 19 bp, Homo sapiens
gggatggtaagagaaaaga

SEQ ID NO: 4572788 - DNA, 11 bp, Homo sapiens
gggatgtctta

SEQ ID NO: 4572789 - DNA, 15 bp, Homo sapiens
gggattcaggctgct

SEQ ID NO: 4572790 - DNA, 16 bp, Homo sapiens
gggattgtaaaatggt

SEQ ID NO: 4572791 - DNA, 20 bp, Homo sapiens
gggcaaccaactgccccagg

SEQ ID NO: 4572792 - DNA, 14 bp, Homo sapiens
gggcaagccctgcc

SEQ ID NO: 4572793 - DNA, 19 bp, Homo sapiens
gggcaagccctgcccacag

SEQ ID NO: 4572794 - DNA, 21 bp, Homo sapiens
gggcaagcctaagggatcctg

SEQ ID NO: 4572795 - DNA, 16 bp, Homo sapiens
gggcaaggaaaaagaa

SEQ ID NO: 4572796 - DNA, 14 bp, Homo sapiens
gggcaatttagaaa

SEQ ID NO: 4572797 - DNA, 22 bp, Homo sapiens
gggcactccgcgccgatgccac

SEQ ID NO: 4572798 - DNA, 22 bp, Homo sapiens
gggcactgtgccaagatttaaa

SEQ ID NO: 4572799 - DNA, 14 bp, Homo sapiens
gggcagagcccaag

SEQ ID NO: 4572800 - DNA, 14 bp, Homo sapiens
gggcagaggaagcc

SEQ ID NO: 4572801 - DNA, 14 bp, Homo sapiens
gggcagaggctgga

SEQ ID NO: 4572802 - DNA, 16 bp, Homo sapiens
gggcagaggctggagg

SEQ ID NO: 4572803 - DNA, 21 bp, Homo sapiens
gggcagaggctggaggcaggg

SEQ ID NO: 4572804 - DNA, 23 bp, Homo sapiens
gggcagaggctggaggcagggcc

SEQ ID NO: 4572805 - DNA, 14 bp, Homo sapiens
gggcagagggctgg

SEQ ID NO: 4572806 - DNA, 15 bp, Homo sapiens
gggcagagggctgga

SEQ ID NO: 4572807 - DNA, 22 bp, Homo sapiens
gggcagagggctggaggcccag

SEQ ID NO: 4572808 - DNA, 17 bp, Homo sapiens
gggcagagtgagaccca

SEQ ID NO: 4572809 - DNA, 16 bp, Homo sapiens
gggcagcaatttaaat

SEQ ID NO: 4572810 - DNA, 12 bp, Homo sapiens
gggcagcaccct

SEQ ID NO: 4572811 - DNA, 14 bp, Homo sapiens
gggcagcagggcta

SEQ ID NO: 4572812 - DNA, 18 bp, Homo sapiens
gggcagccacccaagcct

SEQ ID NO: 4572813 - DNA, 23 bp, Homo sapiens
gggcagccacccaagcctgctgg

SEQ ID NO: 4572814 - DNA, 14 bp, Homo sapiens
gggcagccaggctg

SEQ ID NO: 4572815 - DNA, 16 bp, Homo sapiens
gggcagctgggcccaa

SEQ ID NO: 4572816 - DNA, 19 bp, Homo sapiens
gggcagctgggcccaaccc

SEQ ID NO: 4572817 - DNA, 18 bp, Homo sapiens
gggcaggagggccctacc

SEQ ID NO: 4572818 - DNA, 16 bp, Homo sapiens
gggcaggctgggccat

SEQ ID NO: 4572819 - DNA, 17 bp, Homo sapiens
gggcaggtcctgcccat

SEQ ID NO: 4572820 - DNA, 23 bp, Homo sapiens
gggcagtctccccttcctggcac

SEQ ID NO: 4572821 - DNA, 14 bp, Homo sapiens
gggcagtctgctct

SEQ ID NO: 4572822 - DNA, 24 bp, Homo sapiens
gggcagtctgctctgctgctctga

SEQ ID NO: 4572823 - DNA, 16 bp, Homo sapiens
gggcagtgagtgccat

SEQ ID NO: 4572824 - DNA, 20 bp, Homo sapiens
gggcagtgagtgccatgctt

SEQ ID NO: 4572825 - DNA, 14 bp, Homo sapiens
gggcagtgccccag

SEQ ID NO: 4572826 - DNA, 18 bp, Homo sapiens
gggcatctcttccccaga

SEQ ID NO: 4572827 - DNA, 21 bp, Homo sapiens
gggcatctgagtccagctccc

SEQ ID NO: 4572828 - DNA, 19 bp, Homo sapiens
gggcatctgcccctccccc

SEQ ID NO: 4572829 - DNA, 17 bp, Homo sapiens
gggcatcttctggcttg

SEQ ID NO: 4572830 - DNA, 19 bp, Homo sapiens
gggcatttggtgagagtca

SEQ ID NO: 4572831 - DNA, 20 bp, Homo sapiens
gggcattttacaagaagtac

SEQ ID NO: 4572832 - DNA, 21 bp, Homo sapiens
gggcattttcctcctctgcct

SEQ ID NO: 4572833 - DNA, 15 bp, Homo sapiens
gggccaaaaggaaaa

SEQ ID NO: 4572834 - DNA, 18 bp, Homo sapiens
gggccaaacgctgagcca

SEQ ID NO: 4572835 - DNA, 14 bp, Homo sapiens
gggccacgtgccag

SEQ ID NO: 4572836 - DNA, 18 bp, Homo sapiens
gggccacgtgccaggccc

SEQ ID NO: 4572837 - DNA, 14 bp, Homo sapiens
gggccactggaagg

SEQ ID NO: 4572838 - DNA, 13 bp, Homo sapiens
gggccactgggga

SEQ ID NO: 4572839 - DNA, 12 bp, Homo sapiens
gggccagaggct

SEQ ID NO: 4572840 - DNA, 14 bp, Homo sapiens
gggccagaggctgg

SEQ ID NO: 4572841 - DNA, 16 bp, Homo sapiens
gggccaggacaggccc

SEQ ID NO: 4572842 - DNA, 15 bp, Homo sapiens
gggccagtcaggctg

SEQ ID NO: 4572843 - DNA, 15 bp, Homo sapiens
gggccagtcctgcct

SEQ ID NO: 4572844 - DNA, 17 bp, Homo sapiens
gggccatgtccaaagag

SEQ ID NO: 4572845 - DNA, 22 bp, Homo sapiens
gggccatgtccaaagaggctgc

SEQ ID NO: 4572846 - DNA, 12 bp, Homo sapiens
gggcccagccca

SEQ ID NO: 4572847 - DNA, 17 bp, Homo sapiens
gggcccagcccagagcc

SEQ ID NO: 4572848 - DNA, 13 bp, Homo sapiens
gggcccagccccc

SEQ ID NO: 4572849 - DNA, 15 bp, Homo sapiens
gggccccaccaccta

SEQ ID NO: 4572850 - DNA, 13 bp, Homo sapiens
gggccccagccca

SEQ ID NO: 4572851 - DNA, 19 bp, Homo sapiens
gggccccagtcagcctctc

SEQ ID NO: 4572852 - DNA, 15 bp, Homo sapiens
gggccccatcttgat

SEQ ID NO: 4572853 - DNA, 22 bp, Homo sapiens
gggcccccaataaaccagtgtg

SEQ ID NO: 4572854 - DNA, 15 bp, Homo sapiens
gggccccgccagggc

SEQ ID NO: 4572855 - DNA, 14 bp, Homo sapiens
gggcccctccacgc

SEQ ID NO: 4572856 - DNA, 17 bp, Homo sapiens
gggcccctccacgcctc

SEQ ID NO: 4572857 - DNA, 18 bp, Homo sapiens
gggcccctccacgcctcc

SEQ ID NO: 4572858 - DNA, 15 bp, Homo sapiens
gggcccctccaggag

SEQ ID NO: 4572859 - DNA, 14 bp, Homo sapiens
gggcccctccatcc

SEQ ID NO: 4572860 - DNA, 19 bp, Homo sapiens
gggcccctccctacctcaa

SEQ ID NO: 4572861 - DNA, 23 bp, Homo sapiens
gggcccgagcctgaactgagccc

SEQ ID NO: 4572862 - DNA, 23 bp, Homo sapiens
gggcccggccacacccagcggcc

SEQ ID NO: 4572863 - DNA, 17 bp, Homo sapiens
gggcccggtccacaggt

SEQ ID NO: 4572864 - DNA, 13 bp, Homo sapiens
gggccctgcctgc

SEQ ID NO: 4572865 - DNA, 20 bp, Homo sapiens
gggccctgcctgcagccagg

SEQ ID NO: 4572866 - DNA, 22 bp, Homo sapiens
gggccctgcctgcagccagggc

SEQ ID NO: 4572867 - DNA, 14 bp, Homo sapiens
gggccctggccagg

SEQ ID NO: 4572868 - DNA, 13 bp, Homo sapiens
gggccctgggcct

SEQ ID NO: 4572869 - DNA, 14 bp, Homo sapiens
gggccctgggcctc

SEQ ID NO: 4572870 - DNA, 17 bp, Homo sapiens
gggccctgggcctcagt

SEQ ID NO: 4572871 - DNA, 13 bp, Homo sapiens
gggccctgggctg

SEQ ID NO: 4572872 - DNA, 22 bp, Homo sapiens
gggccctggtggtggctcggga

SEQ ID NO: 4572873 - DNA, 14 bp, Homo sapiens
gggccgactaagag

SEQ ID NO: 4572874 - DNA, 23 bp, Homo sapiens
gggccgggcaggtcctgcccatg

SEQ ID NO: 4572875 - DNA, 20 bp, Homo sapiens
gggcctagcgatctctcctg

SEQ ID NO: 4572876 - DNA, 14 bp, Homo sapiens
gggcctcaggctcc

SEQ ID NO: 4572877 - DNA, 12 bp, Homo sapiens
gggcctctctcc

SEQ ID NO: 4572878 - DNA, 21 bp, Homo sapiens
gggcctctctcctgcctgccc

SEQ ID NO: 4572879 - DNA, 21 bp, Homo sapiens
gggcctctgcggagcacactg

SEQ ID NO: 4572880 - DNA, 22 bp, Homo sapiens
gggcctgcacccttccacagct

SEQ ID NO: 4572881 - DNA, 11 bp, Homo sapiens
gggcctgcccc

SEQ ID NO: 4572882 - DNA, 16 bp, Homo sapiens
gggcctggacaggcgg

SEQ ID NO: 4572883 - DNA, 12 bp, Homo sapiens
gggcctggatgc

SEQ ID NO: 4572884 - DNA, 12 bp, Homo sapiens
gggcctggccct

SEQ ID NO: 4572885 - DNA, 21 bp, Homo sapiens
gggccttcgggaccctggggc

SEQ ID NO: 4572886 - DNA, 17 bp, Homo sapiens
gggccttgcccagagat

SEQ ID NO: 4572887 - DNA, 18 bp, Homo sapiens
gggcctttgccagcagag

SEQ ID NO: 4572888 - DNA, 23 bp, Homo sapiens
gggcctttgccagcagagccagg

SEQ ID NO: 4572889 - DNA, 24 bp, Homo sapiens
gggcctttgccagcagagccaggg

SEQ ID NO: 4572890 - DNA, 14 bp, Homo sapiens
gggcgagctgcagg

SEQ ID NO: 4572891 - DNA, 18 bp, Homo sapiens
gggcgcaccccacagctg

SEQ ID NO: 4572892 - DNA, 23 bp, Homo sapiens
gggcgcaccccacagctggggcc

SEQ ID NO: 4572893 - DNA, 19 bp, Homo sapiens
gggcgccaagtctggcacc

SEQ ID NO: 4572894 - DNA, 23 bp, Homo sapiens
gggcgcggccagccccggccctg

SEQ ID NO: 4572895 - DNA, 22 bp, Homo sapiens
gggcgctcggtctccaccccag

SEQ ID NO: 4572896 - DNA, 13 bp, Homo sapiens
gggcggctcctgg

SEQ ID NO: 4572897 - DNA, 13 bp, Homo sapiens
gggcgggctcaga

SEQ ID NO: 4572898 - DNA, 21 bp, Homo sapiens
gggcgggctcagagctttgtc

SEQ ID NO: 4572899 - DNA, 15 bp, Homo sapiens
gggcgtggtggtgag

SEQ ID NO: 4572900 - DNA, 17 bp, Homo sapiens
gggcgttctcccaaaga

SEQ ID NO: 4572901 - DNA, 22 bp, Homo sapiens
gggctaattctgggaagggaga

SEQ ID NO: 4572902 - DNA, 23 bp, Homo sapiens
gggctaccccccctcctgctgcc

SEQ ID NO: 4572903 - DNA, 13 bp, Homo sapiens
gggctaccctgag

SEQ ID NO: 4572904 - DNA, 16 bp, Homo sapiens
gggctaccctgagctg

SEQ ID NO: 4572905 - DNA, 16 bp, Homo sapiens
gggctagaacctggca

SEQ ID NO: 4572906 - DNA, 12 bp, Homo sapiens
gggctagaatct

SEQ ID NO: 4572907 - DNA, 22 bp, Homo sapiens
gggctcaagcaatcctcctgcc

SEQ ID NO: 4572908 - DNA, 16 bp, Homo sapiens
gggctccacgggcagg

SEQ ID NO: 4572909 - DNA, 19 bp, Homo sapiens
gggctcccagccaggccct

SEQ ID NO: 4572910 - DNA, 14 bp, Homo sapiens
gggctcccagctcc

SEQ ID NO: 4572911 - DNA, 23 bp, Homo sapiens
gggctcccaggggtctccctggc

SEQ ID NO: 4572912 - DNA, 18 bp, Homo sapiens
gggctccctgactgggag

SEQ ID NO: 4572913 - DNA, 21 bp, Homo sapiens
gggctcctgcccaggccacag

SEQ ID NO: 4572914 - DNA, 21 bp, Homo sapiens
gggctcgccgtgtctcagcct

SEQ ID NO: 4572915 - DNA, 18 bp, Homo sapiens
gggctcgggtctgggcag

SEQ ID NO: 4572916 - DNA, 21 bp, Homo sapiens
gggctctccacctcagccttg

SEQ ID NO: 4572917 - DNA, 16 bp, Homo sapiens
gggctctgtgcagtca

SEQ ID NO: 4572918 - DNA, 15 bp, Homo sapiens
gggctcttctcattt

SEQ ID NO: 4572919 - DNA, 18 bp, Homo sapiens
gggctgaacggggagaaa

SEQ ID NO: 4572920 - DNA, 19 bp, Homo sapiens
gggctgagaggaagcaaga

SEQ ID NO: 4572921 - DNA, 18 bp, Homo sapiens
gggctgaggccagagtca

SEQ ID NO: 4572922 - DNA, 17 bp, Homo sapiens
gggctgccaccagcccc

SEQ ID NO: 4572923 - DNA, 19 bp, Homo sapiens
gggctgccaccagcccccg

SEQ ID NO: 4572924 - DNA, 14 bp, Homo sapiens
gggctgctcctcat

SEQ ID NO: 4572925 - DNA, 15 bp, Homo sapiens
gggctgctcctccag

SEQ ID NO: 4572926 - DNA, 15 bp, Homo sapiens
gggctggactgaggc

SEQ ID NO: 4572927 - DNA, 15 bp, Homo sapiens
gggctggagctcctc

SEQ ID NO: 4572928 - DNA, 16 bp, Homo sapiens
gggctggagctcctcc

SEQ ID NO: 4572929 - DNA, 18 bp, Homo sapiens
gggctggagctcctccct

SEQ ID NO: 4572930 - DNA, 15 bp, Homo sapiens
gggctggaggcccag

SEQ ID NO: 4572931 - DNA, 16 bp, Homo sapiens
gggctggcacagcccc

SEQ ID NO: 4572932 - DNA, 19 bp, Homo sapiens
gggctggcacagcccctgg

SEQ ID NO: 4572933 - DNA, 16 bp, Homo sapiens
gggctggcccagccct

SEQ ID NO: 4572934 - DNA, 20 bp, Homo sapiens
gggctggccgggactgctgc

SEQ ID NO: 4572935 - DNA, 19 bp, Homo sapiens
gggctggcggctactcagc

SEQ ID NO: 4572936 - DNA, 14 bp, Homo sapiens
gggctggcgggcct

SEQ ID NO: 4572937 - DNA, 11 bp, Homo sapiens
gggctggctgg

SEQ ID NO: 4572938 - DNA, 21 bp, Homo sapiens
gggctgggatggtgactcctg

SEQ ID NO: 4572939 - DNA, 17 bp, Homo sapiens
gggctgggccaccaggg

SEQ ID NO: 4572940 - DNA, 19 bp, Homo sapiens
gggctgggccaccagggat

SEQ ID NO: 4572941 - DNA, 19 bp, Homo sapiens
gggctggggacagagggtg

SEQ ID NO: 4572942 - DNA, 19 bp, Homo sapiens
gggctgggggctgccgagc

SEQ ID NO: 4572943 - DNA, 22 bp, Homo sapiens
gggctggggtcacagaggcata

SEQ ID NO: 4572944 - DNA, 21 bp, Homo sapiens
gggctggggttgccagaggcc

SEQ ID NO: 4572945 - DNA, 13 bp, Homo sapiens
gggctgggtgctg

SEQ ID NO: 4572946 - DNA, 20 bp, Homo sapiens
gggctgttaggacagcaaag

SEQ ID NO: 4572947 - DNA, 20 bp, Homo sapiens
gggcttataataaaggactg

SEQ ID NO: 4572948 - DNA, 16 bp, Homo sapiens
gggcttccctggcctc

SEQ ID NO: 4572949 - DNA, 19 bp, Homo sapiens
gggcttcctctagaagcca

SEQ ID NO: 4572950 - DNA, 18 bp, Homo sapiens
gggcttcgcttccttagc

SEQ ID NO: 4572951 - DNA, 15 bp, Homo sapiens
gggcttgaagccaaa

SEQ ID NO: 4572952 - DNA, 15 bp, Homo sapiens
gggcttggcccagcg

SEQ ID NO: 4572953 - DNA, 16 bp, Homo sapiens
gggcttggcctgctgt

SEQ ID NO: 4572954 - DNA, 23 bp, Homo sapiens
gggctttgaatctgggactgtgc

SEQ ID NO: 4572955 - DNA, 21 bp, Homo sapiens
ggggaacctgccatgccagga

SEQ ID NO: 4572956 - DNA, 22 bp, Homo sapiens
ggggaacctgccatgccaggaa

SEQ ID NO: 4572957 - DNA, 16 bp, Homo sapiens
ggggaatgcacctccc

SEQ ID NO: 4572958 - DNA, 15 bp, Homo sapiens
ggggacaccagagct

SEQ ID NO: 4572959 - DNA, 15 bp, Homo sapiens
ggggacaggatttgg

SEQ ID NO: 4572960 - DNA, 16 bp, Homo sapiens
ggggacagggctggcc

SEQ ID NO: 4572961 - DNA, 19 bp, Homo sapiens
ggggacagggctggcccag

SEQ ID NO: 4572962 - DNA, 22 bp, Homo sapiens
ggggacagggctggcccagccc

SEQ ID NO: 4572963 - DNA, 20 bp, Homo sapiens
ggggacaggtgacagtggct

SEQ ID NO: 4572964 - DNA, 18 bp, Homo sapiens
ggggacctgaactgtcct

SEQ ID NO: 4572965 - DNA, 13 bp, Homo sapiens
ggggacggcttct

SEQ ID NO: 4572966 - DNA, 18 bp, Homo sapiens
ggggacgttgctgagcca

SEQ ID NO: 4572967 - DNA, 14 bp, Homo sapiens
ggggactcagccct

SEQ ID NO: 4572968 - DNA, 18 bp, Homo sapiens
ggggactccggctgtgct

SEQ ID NO: 4572969 - DNA, 14 bp, Homo sapiens
ggggactttattta

SEQ ID NO: 4572970 - DNA, 19 bp, Homo sapiens
ggggagaacttacattgtg

SEQ ID NO: 4572971 - DNA, 21 bp, Homo sapiens
ggggagagacaggcagcccag

SEQ ID NO: 4572972 - DNA, 22 bp, Homo sapiens
ggggagagagcccttcccaggg

SEQ ID NO: 4572973 - DNA, 14 bp, Homo sapiens
ggggagagcctgct

SEQ ID NO: 4572974 - DNA, 21 bp, Homo sapiens
ggggagcccactgaggggcca

SEQ ID NO: 4572975 - DNA, 14 bp, Homo sapiens
ggggaggagggggc

SEQ ID NO: 4572976 - DNA, 16 bp, Homo sapiens
ggggaggcccaaatga

SEQ ID NO: 4572977 - DNA, 15 bp, Homo sapiens
ggggaggcgcacagt

SEQ ID NO: 4572978 - DNA, 22 bp, Homo sapiens
ggggaggcggacgttccagccg

SEQ ID NO: 4572979 - DNA, 12 bp, Homo sapiens
ggggagggcagg

SEQ ID NO: 4572980 - DNA, 13 bp, Homo sapiens
ggggaggggaagg

SEQ ID NO: 4572981 - DNA, 17 bp, Homo sapiens
ggggaggtgctggggga

SEQ ID NO: 4572982 - DNA, 22 bp, Homo sapiens
ggggagtaaacggcccaggcca

SEQ ID NO: 4572983 - DNA, 18 bp, Homo sapiens
ggggagtggttaggcagc

SEQ ID NO: 4572984 - DNA, 22 bp, Homo sapiens
ggggagtggttaggcagcaagc

SEQ ID NO: 4572985 - DNA, 23 bp, Homo sapiens
ggggattgcccctggctttgcct

SEQ ID NO: 4572986 - DNA, 20 bp, Homo sapiens
ggggcaccttccgacatccc

SEQ ID NO: 4572987 - DNA, 18 bp, Homo sapiens
ggggcagagggcagaggc

SEQ ID NO: 4572988 - DNA, 22 bp, Homo sapiens
ggggcagagggcagaggctgga

SEQ ID NO: 4572989 - DNA, 18 bp, Homo sapiens
ggggcagcaccctataaa

SEQ ID NO: 4572990 - DNA, 13 bp, Homo sapiens
ggggcagccacac

SEQ ID NO: 4572991 - DNA, 13 bp, Homo sapiens
ggggcaggctggg

SEQ ID NO: 4572992 - DNA, 14 bp, Homo sapiens
ggggcagtctcccc

SEQ ID NO: 4572993 - DNA, 19 bp, Homo sapiens
ggggcagtctgagagaggc

SEQ ID NO: 4572994 - DNA, 13 bp, Homo sapiens
ggggcagtgctca

SEQ ID NO: 4572995 - DNA, 20 bp, Homo sapiens
ggggcagtgctcacccacac

SEQ ID NO: 4572996 - DNA, 14 bp, Homo sapiens
ggggcattgctgac

SEQ ID NO: 4572997 - DNA, 18 bp, Homo sapiens
ggggcccagggaagcctg

SEQ ID NO: 4572998 - DNA, 19 bp, Homo sapiens
ggggccccagtcagcctct

SEQ ID NO: 4572999 - DNA, 13 bp, Homo sapiens
ggggccccctggt

SEQ ID NO: 4573000 - DNA, 14 bp, Homo sapiens
ggggccccctggtc

SEQ ID NO: 4573001 - DNA, 15 bp, Homo sapiens
ggggccccgccaggg

SEQ ID NO: 4573002 - DNA, 17 bp, Homo sapiens
ggggccccgccagggct

SEQ ID NO: 4573003 - DNA, 22 bp, Homo sapiens
ggggccccgccagggctgggga

SEQ ID NO: 4573004 - DNA, 14 bp, Homo sapiens
ggggccctgcccca

SEQ ID NO: 4573005 - DNA, 19 bp, Homo sapiens
ggggccctgccccacccca

SEQ ID NO: 4573006 - DNA, 11 bp, Homo sapiens
ggggccctggg

SEQ ID NO: 4573007 - DNA, 13 bp, Homo sapiens
ggggccctgggcc

SEQ ID NO: 4573008 - DNA, 17 bp, Homo sapiens
ggggccgggggcagtct

SEQ ID NO: 4573009 - DNA, 12 bp, Homo sapiens
ggggcctggaca

SEQ ID NO: 4573010 - DNA, 15 bp, Homo sapiens
ggggcctggacaggc

SEQ ID NO: 4573011 - DNA, 14 bp, Homo sapiens
ggggcctggggagc

SEQ ID NO: 4573012 - DNA, 23 bp, Homo sapiens
ggggcctttgccagcagagccag

SEQ ID NO: 4573013 - DNA, 18 bp, Homo sapiens
ggggcgcccacccggccc

SEQ ID NO: 4573014 - DNA, 21 bp, Homo sapiens
ggggctagaacctagagaagc

SEQ ID NO: 4573015 - DNA, 12 bp, Homo sapiens
ggggctcccagc

SEQ ID NO: 4573016 - DNA, 13 bp, Homo sapiens
ggggctcccagcc

SEQ ID NO: 4573017 - DNA, 20 bp, Homo sapiens
ggggctcccagccaggccct

SEQ ID NO: 4573018 - DNA, 15 bp, Homo sapiens
ggggctcccagctcc

SEQ ID NO: 4573019 - DNA, 11 bp, Homo sapiens
ggggctcctgc

SEQ ID NO: 4573020 - DNA, 15 bp, Homo sapiens
ggggctcctgcccag

SEQ ID NO: 4573021 - DNA, 20 bp, Homo sapiens
ggggctcctgcccaggccac

SEQ ID NO: 4573022 - DNA, 18 bp, Homo sapiens
ggggctgaacggggagaa

SEQ ID NO: 4573023 - DNA, 18 bp, Homo sapiens
ggggctgctcccacctgg

SEQ ID NO: 4573024 - DNA, 14 bp, Homo sapiens
ggggctgctcctcc

SEQ ID NO: 4573025 - DNA, 20 bp, Homo sapiens
ggggctggggtcacagaggc

SEQ ID NO: 4573026 - DNA, 21 bp, Homo sapiens
ggggctggggtcacagaggca

SEQ ID NO: 4573027 - DNA, 17 bp, Homo sapiens
ggggcttcacagccaca

SEQ ID NO: 4573028 - DNA, 17 bp, Homo sapiens
ggggcttgaagccaaag

SEQ ID NO: 4573029 - DNA, 21 bp, Homo sapiens
gggggaaacaggttgggatgg

SEQ ID NO: 4573030 - DNA, 11 bp, Homo sapiens
gggggacagag

SEQ ID NO: 4573031 - DNA, 22 bp, Homo sapiens
gggggacagggctggcccagcc

SEQ ID NO: 4573032 - DNA, 21 bp, Homo sapiens
gggggagcccagtgaagcctc

SEQ ID NO: 4573033 - DNA, 22 bp, Homo sapiens
gggggatagaggggctgcaggg

SEQ ID NO: 4573034 - DNA, 15 bp, Homo sapiens
gggggatgggccagg

SEQ ID NO: 4573035 - DNA, 20 bp, Homo sapiens
gggggcatctcttccccaga

SEQ ID NO: 4573036 - DNA, 14 bp, Homo sapiens
gggggccaaaagga

SEQ ID NO: 4573037 - DNA, 17 bp, Homo sapiens
gggggccaaggtcctgc

SEQ ID NO: 4573038 - DNA, 20 bp, Homo sapiens
gggggccccagtcagcctct

SEQ ID NO: 4573039 - DNA, 18 bp, Homo sapiens
gggggccccgccagggct

SEQ ID NO: 4573040 - DNA, 20 bp, Homo sapiens
gggggccgggcaggtcctgc

SEQ ID NO: 4573041 - DNA, 22 bp, Homo sapiens
gggggctatagctacaggaagc

SEQ ID NO: 4573042 - DNA, 17 bp, Homo sapiens
gggggctcctgcccagg

SEQ ID NO: 4573043 - DNA, 19 bp, Homo sapiens
gggggctcctgcccaggcc

SEQ ID NO: 4573044 - DNA, 16 bp, Homo sapiens
ggggggctcctgccca

SEQ ID NO: 4573045 - DNA, 17 bp, Homo sapiens
ggggggctcctgcccag

SEQ ID NO: 4573046 - DNA, 16 bp, Homo sapiens
gggggtgtcttccctg

SEQ ID NO: 4573047 - DNA, 21 bp, Homo sapiens
ggggtacagcccttgcactcc

SEQ ID NO: 4573048 - DNA, 20 bp, Homo sapiens
ggggtatttcaattaccttc

SEQ ID NO: 4573049 - DNA, 15 bp, Homo sapiens
ggggtcacagaggca

SEQ ID NO: 4573050 - DNA, 20 bp, Homo sapiens
ggggtcagagcactccctaa

SEQ ID NO: 4573051 - DNA, 18 bp, Homo sapiens
ggggtccatccccttccc

SEQ ID NO: 4573052 - DNA, 18 bp, Homo sapiens
ggggtccctccaccccac

SEQ ID NO: 4573053 - DNA, 22 bp, Homo sapiens
ggggtctccctctcctgcctac

SEQ ID NO: 4573054 - DNA, 17 bp, Homo sapiens
ggggtgccgcctgcccg

SEQ ID NO: 4573055 - DNA, 20 bp, Homo sapiens
ggggtgcttttatagaggct

SEQ ID NO: 4573056 - DNA, 12 bp, Homo sapiens
ggggtggaggac

SEQ ID NO: 4573057 - DNA, 17 bp, Homo sapiens
ggggtggcccagagcca

SEQ ID NO: 4573058 - DNA, 18 bp, Homo sapiens
ggggtgggggtggaggct

SEQ ID NO: 4573059 - DNA, 16 bp, Homo sapiens
ggggtgtcttccctgc

SEQ ID NO: 4573060 - DNA, 20 bp, Homo sapiens
ggggtgtcttccctgcctgt

SEQ ID NO: 4573061 - DNA, 19 bp, Homo sapiens
ggggttaacttggtcagag

SEQ ID NO: 4573062 - DNA, 23 bp, Homo sapiens
ggggttcagcccctcctctgcca

SEQ ID NO: 4573063 - DNA, 13 bp, Homo sapiens
ggggttccctcct

SEQ ID NO: 4573064 - DNA, 21 bp, Homo sapiens
ggggttccctcctagctctcc

SEQ ID NO: 4573065 - DNA, 19 bp, Homo sapiens
ggggttggctgttccagac

SEQ ID NO: 4573066 - DNA, 22 bp, Homo sapiens
gggtaagaagggtgggagtggg

SEQ ID NO: 4573067 - DNA, 17 bp, Homo sapiens
gggtaagccagagcctg

SEQ ID NO: 4573068 - DNA, 18 bp, Homo sapiens
gggtaagccagagcctgg

SEQ ID NO: 4573069 - DNA, 17 bp, Homo sapiens
gggtacatttctctgag

SEQ ID NO: 4573070 - DNA, 19 bp, Homo sapiens
gggtacatttctctgagca

SEQ ID NO: 4573071 - DNA, 21 bp, Homo sapiens
gggtagaaaaattattagaac

SEQ ID NO: 4573072 - DNA, 22 bp, Homo sapiens
gggtagcaggtaccactgattt

SEQ ID NO: 4573073 - DNA, 19 bp, Homo sapiens
gggtaggagggtgggaagg

SEQ ID NO: 4573074 - DNA, 13 bp, Homo sapiens
gggtaggggaagg

SEQ ID NO: 4573075 - DNA, 12 bp, Homo sapiens
gggtcaccctgg

SEQ ID NO: 4573076 - DNA, 19 bp, Homo sapiens
gggtcagtgcagcagagga

SEQ ID NO: 4573077 - DNA, 21 bp, Homo sapiens
gggtcatctgtacctctgcct

SEQ ID NO: 4573078 - DNA, 16 bp, Homo sapiens
gggtcatgggcctgtg

SEQ ID NO: 4573079 - DNA, 12 bp, Homo sapiens
gggtccatgggc

SEQ ID NO: 4573080 - DNA, 16 bp, Homo sapiens
gggtcccagccacccc

SEQ ID NO: 4573081 - DNA, 18 bp, Homo sapiens
gggtcccggctctgtggg

SEQ ID NO: 4573082 - DNA, 16 bp, Homo sapiens
gggtccctctaaccca

SEQ ID NO: 4573083 - DNA, 22 bp, Homo sapiens
gggtccctggagggcaagccct

SEQ ID NO: 4573084 - DNA, 14 bp, Homo sapiens
gggtccggcctctc

SEQ ID NO: 4573085 - DNA, 16 bp, Homo sapiens
gggtccggcctctccc

SEQ ID NO: 4573086 - DNA, 20 bp, Homo sapiens
gggtcctagcccttccctga

SEQ ID NO: 4573087 - DNA, 22 bp, Homo sapiens
gggtcctcacctggttgaccca

SEQ ID NO: 4573088 - DNA, 14 bp, Homo sapiens
gggtcctctcttcc

SEQ ID NO: 4573089 - DNA, 22 bp, Homo sapiens
gggtcctctcttccacagtggc

SEQ ID NO: 4573090 - DNA, 19 bp, Homo sapiens
gggtcctcttctgggcctg

SEQ ID NO: 4573091 - DNA, 14 bp, Homo sapiens
gggtcctcttttcc

SEQ ID NO: 4573092 - DNA, 23 bp, Homo sapiens
gggtcctcttttcctggcagctg

SEQ ID NO: 4573093 - DNA, 13 bp, Homo sapiens
gggtcctgccagc

SEQ ID NO: 4573094 - DNA, 18 bp, Homo sapiens
gggtcctggctcctgagg

SEQ ID NO: 4573095 - DNA, 19 bp, Homo sapiens
gggtccttttgacactgct

SEQ ID NO: 4573096 - DNA, 14 bp, Homo sapiens
gggtctagggagag

SEQ ID NO: 4573097 - DNA, 21 bp, Homo sapiens
gggtctccctggctccctcct

SEQ ID NO: 4573098 - DNA, 12 bp, Homo sapiens
gggtctctgaag

SEQ ID NO: 4573099 - DNA, 15 bp, Homo sapiens
gggtctgaggcccct

SEQ ID NO: 4573100 - DNA, 17 bp, Homo sapiens
gggtctgaggcccctgc

SEQ ID NO: 4573101 - DNA, 12 bp, Homo sapiens
gggtcttcagct

SEQ ID NO: 4573102 - DNA, 20 bp, Homo sapiens
gggtcttgctctgtccccca

SEQ ID NO: 4573103 - DNA, 22 bp, Homo sapiens
gggtcttgctctgtcccccagg

SEQ ID NO: 4573104 - DNA, 18 bp, Homo sapiens
gggtgacagtgccttctc

SEQ ID NO: 4573105 - DNA, 22 bp, Homo sapiens
gggtgacgggactcaggcggga

SEQ ID NO: 4573106 - DNA, 12 bp, Homo sapiens
gggtgagagagg

SEQ ID NO: 4573107 - DNA, 19 bp, Homo sapiens
gggtgagtccattctccca

SEQ ID NO: 4573108 - DNA, 23 bp, Homo sapiens
gggtgcccgtaatcccagctact

SEQ ID NO: 4573109 - DNA, 14 bp, Homo sapiens
gggtgccgcctgcc

SEQ ID NO: 4573110 - DNA, 18 bp, Homo sapiens
gggtgcgggatacagctg

SEQ ID NO: 4573111 - DNA, 21 bp, Homo sapiens
gggtgctcctgtgctcaccct

SEQ ID NO: 4573112 - DNA, 17 bp, Homo sapiens
gggtgctgccatgacag

SEQ ID NO: 4573113 - DNA, 15 bp, Homo sapiens
gggtggaatgagccg

SEQ ID NO: 4573114 - DNA, 15 bp, Homo sapiens
gggtggatgtgctgg

SEQ ID NO: 4573115 - DNA, 12 bp, Homo sapiens
gggtggcaggca

SEQ ID NO: 4573116 - DNA, 19 bp, Homo sapiens
gggtggccacacaggcagg

SEQ ID NO: 4573117 - DNA, 16 bp, Homo sapiens
gggtggccgggcacag

SEQ ID NO: 4573118 - DNA, 18 bp, Homo sapiens
gggtggctagtcagagag

SEQ ID NO: 4573119 - DNA, 19 bp, Homo sapiens
gggtgggacatggaaaaga

SEQ ID NO: 4573120 - DNA, 17 bp, Homo sapiens
gggtgggatggaggaga

SEQ ID NO: 4573121 - DNA, 15 bp, Homo sapiens
gggtgggcagttttt

SEQ ID NO: 4573122 - DNA, 19 bp, Homo sapiens
gggtgggcttcctgccctt

SEQ ID NO: 4573123 - DNA, 11 bp, Homo sapiens
gggtgggggtg

SEQ ID NO: 4573124 - DNA, 16 bp, Homo sapiens
gggtggggtagggctg

SEQ ID NO: 4573125 - DNA, 17 bp, Homo sapiens
gggtggggtagggctga

SEQ ID NO: 4573126 - DNA, 20 bp, Homo sapiens
gggtgggtcagaaccctgcc

SEQ ID NO: 4573127 - DNA, 15 bp, Homo sapiens
gggtggtggcctggt

SEQ ID NO: 4573128 - DNA, 24 bp, Homo sapiens
gggtgtcaaacattcgtgagctgg

SEQ ID NO: 4573129 - DNA, 17 bp, Homo sapiens
gggtgtcaagtgcctgc

SEQ ID NO: 4573130 - DNA, 20 bp, Homo sapiens
gggtgtcacgagcccattct

SEQ ID NO: 4573131 - DNA, 18 bp, Homo sapiens
gggtgtcatttcattcca

SEQ ID NO: 4573132 - DNA, 23 bp, Homo sapiens
gggtgtcctgcaccggggcctgg

SEQ ID NO: 4573133 - DNA, 15 bp, Homo sapiens
gggtgtcttccctgc

SEQ ID NO: 4573134 - DNA, 18 bp, Homo sapiens
gggtgtcttccctgcctg

SEQ ID NO: 4573135 - DNA, 12 bp, Homo sapiens
gggtgtgccctt

SEQ ID NO: 4573136 - DNA, 11 bp, Homo sapiens
gggtgtggcct

SEQ ID NO: 4573137 - DNA, 12 bp, Homo sapiens
gggtgtggcctc

SEQ ID NO: 4573138 - DNA, 13 bp, Homo sapiens
gggtgtggcctca

SEQ ID NO: 4573139 - DNA, 13 bp, Homo sapiens
gggtgtggctctg

SEQ ID NO: 4573140 - DNA, 14 bp, Homo sapiens
gggtgtggctctgc

SEQ ID NO: 4573141 - DNA, 16 bp, Homo sapiens
gggttaattcatttgg

SEQ ID NO: 4573142 - DNA, 17 bp, Homo sapiens
gggttagaggagtctgt

SEQ ID NO: 4573143 - DNA, 13 bp, Homo sapiens
gggttcactgagg

SEQ ID NO: 4573144 - DNA, 13 bp, Homo sapiens
gggttcagcccct

SEQ ID NO: 4573145 - DNA, 20 bp, Homo sapiens
gggttcagcccctcctctgc

SEQ ID NO: 4573146 - DNA, 21 bp, Homo sapiens
gggttcagcccctcctctgcc

SEQ ID NO: 4573147 - DNA, 18 bp, Homo sapiens
gggttccctttccttcca

SEQ ID NO: 4573148 - DNA, 21 bp, Homo sapiens
gggttccctttccttccatcc

SEQ ID NO: 4573149 - DNA, 17 bp, Homo sapiens
gggttcctcaaattttt

SEQ ID NO: 4573150 - DNA, 13 bp, Homo sapiens
gggttctgcctct

SEQ ID NO: 4573151 - DNA, 15 bp, Homo sapiens
gggttgagagccagt

SEQ ID NO: 4573152 - DNA, 18 bp, Homo sapiens
gggttgccagaggccctg

SEQ ID NO: 4573153 - DNA, 19 bp, Homo sapiens
gggttgccagaggccctgg

SEQ ID NO: 4573154 - DNA, 20 bp, Homo sapiens
gggtttacccagtgggacag

SEQ ID NO: 4573155 - DNA, 23 bp, Homo sapiens
gggtttttaatctttgtgacagg

SEQ ID NO: 4573156 - DNA, 19 bp, Homo sapiens
ggtaaataaaaagaaaggc

SEQ ID NO: 4573157 - DNA, 20 bp, Homo sapiens
ggtaaataaaccactgtgcg

SEQ ID NO: 4573158 - DNA, 14 bp, Homo sapiens
ggtaaatactgtga

SEQ ID NO: 4573159 - DNA, 22 bp, Homo sapiens
ggtaacctagacttcagagaga

SEQ ID NO: 4573160 - DNA, 24 bp, Homo sapiens
ggtaacttttgtgaattaggctgt

SEQ ID NO: 4573161 - DNA, 13 bp, Homo sapiens
ggtaagaagaaag

SEQ ID NO: 4573162 - DNA, 14 bp, Homo sapiens
ggtaagaagggtgg

SEQ ID NO: 4573163 - DNA, 16 bp, Homo sapiens
ggtaagaagggtggga

SEQ ID NO: 4573164 - DNA, 15 bp, Homo sapiens
ggtaagattgttatt

SEQ ID NO: 4573165 - DNA, 15 bp, Homo sapiens
ggtaagccagagcct

SEQ ID NO: 4573166 - DNA, 12 bp, Homo sapiens
ggtaagggaggg

SEQ ID NO: 4573167 - DNA, 20 bp, Homo sapiens
ggtaatctacaccaatgaaa

SEQ ID NO: 4573168 - DNA, 19 bp, Homo sapiens
ggtacaaaaataaatttat

SEQ ID NO: 4573169 - DNA, 14 bp, Homo sapiens
ggtacacctccccc

SEQ ID NO: 4573170 - DNA, 20 bp, Homo sapiens
ggtacatcattattgtagtt

SEQ ID NO: 4573171 - DNA, 23 bp, Homo sapiens
ggtacatttttcaactttgaata

SEQ ID NO: 4573172 - DNA, 14 bp, Homo sapiens
ggtaccactgattt

SEQ ID NO: 4573173 - DNA, 18 bp, Homo sapiens
ggtaccgtctacatttca

SEQ ID NO: 4573174 - DNA, 13 bp, Homo sapiens
ggtacttagagtt

SEQ ID NO: 4573175 - DNA, 12 bp, Homo sapiens
ggtacttcctct

SEQ ID NO: 4573176 - DNA, 22 bp, Homo sapiens
ggtagaaaaattattagaacat

SEQ ID NO: 4573177 - DNA, 12 bp, Homo sapiens
ggtagagacccc

SEQ ID NO: 4573178 - DNA, 15 bp, Homo sapiens
ggtagagacccccag

SEQ ID NO: 4573179 - DNA, 18 bp, Homo sapiens
ggtagagacccccaggcc

SEQ ID NO: 4573180 - DNA, 19 bp, Homo sapiens
ggtagagacccccaggcct

SEQ ID NO: 4573181 - DNA, 13 bp, Homo sapiens
ggtagcagcaggc

SEQ ID NO: 4573182 - DNA, 16 bp, Homo sapiens
ggtagcccgcctgcca

SEQ ID NO: 4573183 - DNA, 13 bp, Homo sapiens
ggtagcctgctgg

SEQ ID NO: 4573184 - DNA, 13 bp, Homo sapiens
ggtagctccagcg

SEQ ID NO: 4573185 - DNA, 20 bp, Homo sapiens
ggtagtctcactgcttgaac

SEQ ID NO: 4573186 - DNA, 23 bp, Homo sapiens
ggtagtgtccccagcctacctct

SEQ ID NO: 4573187 - DNA, 19 bp, Homo sapiens
ggtagttgggtagaaaaat

SEQ ID NO: 4573188 - DNA, 13 bp, Homo sapiens
ggtatagaaatgc

SEQ ID NO: 4573189 - DNA, 22 bp, Homo sapiens
ggtatatcattataactgaagg

SEQ ID NO: 4573190 - DNA, 16 bp, Homo sapiens
ggtatatccaaaagct

SEQ ID NO: 4573191 - DNA, 17 bp, Homo sapiens
ggtatatttgaaataaa

SEQ ID NO: 4573192 - DNA, 19 bp, Homo sapiens
ggtatcattcaactctcca

SEQ ID NO: 4573193 - DNA, 22 bp, Homo sapiens
ggtatcgaaatttgttgtttgt

SEQ ID NO: 4573194 - DNA, 20 bp, Homo sapiens
ggtatgctggccagcaccct

SEQ ID NO: 4573195 - DNA, 17 bp, Homo sapiens
ggtatggagctgtgccg

SEQ ID NO: 4573196 - DNA, 13 bp, Homo sapiens
ggtcaagatcagc

SEQ ID NO: 4573197 - DNA, 12 bp, Homo sapiens
ggtcaatgctat

SEQ ID NO: 4573198 - DNA, 14 bp, Homo sapiens
ggtcacacactgat

SEQ ID NO: 4573199 - DNA, 22 bp, Homo sapiens
ggtcacagaaaggcaggtttca

SEQ ID NO: 4573200 - DNA, 12 bp, Homo sapiens
ggtcacagaggc

SEQ ID NO: 4573201 - DNA, 13 bp, Homo sapiens
ggtcacagcctcc

SEQ ID NO: 4573202 - DNA, 16 bp, Homo sapiens
ggtcacagcctcctct

SEQ ID NO: 4573203 - DNA, 17 bp, Homo sapiens
ggtcacagcctcctctg

SEQ ID NO: 4573204 - DNA, 12 bp, Homo sapiens
ggtcacagctgt

SEQ ID NO: 4573205 - DNA, 19 bp, Homo sapiens
ggtcaccctggcctgccag

SEQ ID NO: 4573206 - DNA, 24 bp, Homo sapiens
ggtcaccgagactcagcctctgct

SEQ ID NO: 4573207 - DNA, 23 bp, Homo sapiens
ggtcactttgccattatgcaaat

SEQ ID NO: 4573208 - DNA, 17 bp, Homo sapiens
ggtcaggagatcgagac

SEQ ID NO: 4573209 - DNA, 16 bp, Homo sapiens
ggtcagtagtcacaaa

SEQ ID NO: 4573210 - DNA, 16 bp, Homo sapiens
ggtcagtctggtggga

SEQ ID NO: 4573211 - DNA, 17 bp, Homo sapiens
ggtcagtgcagcagagg

SEQ ID NO: 4573212 - DNA, 22 bp, Homo sapiens
ggtcagtgccttttggaactgt

SEQ ID NO: 4573213 - DNA, 21 bp, Homo sapiens
ggtcatgacaagatgggacag

SEQ ID NO: 4573214 - DNA, 14 bp, Homo sapiens
ggtcatgggcctgt

SEQ ID NO: 4573215 - DNA, 18 bp, Homo sapiens
ggtcattcttttgccaca

SEQ ID NO: 4573216 - DNA, 21 bp, Homo sapiens
ggtcattcttttgccacatcc

SEQ ID NO: 4573217 - DNA, 22 bp, Homo sapiens
ggtccaatgccacctagactct

SEQ ID NO: 4573218 - DNA, 18 bp, Homo sapiens
ggtccacaggtccaagga

SEQ ID NO: 4573219 - DNA, 18 bp, Homo sapiens
ggtccagagaccacacca

SEQ ID NO: 4573220 - DNA, 20 bp, Homo sapiens
ggtccagagaccacaccact

SEQ ID NO: 4573221 - DNA, 22 bp, Homo sapiens
ggtccagcctcgttggaagagg

SEQ ID NO: 4573222 - DNA, 11 bp, Homo sapiens
ggtccaggaat

SEQ ID NO: 4573223 - DNA, 11 bp, Homo sapiens
ggtccaggaga

SEQ ID NO: 4573224 - DNA, 12 bp, Homo sapiens
ggtccaggcccc

SEQ ID NO: 4573225 - DNA, 18 bp, Homo sapiens
ggtccaggcccccaaccc

SEQ ID NO: 4573226 - DNA, 11 bp, Homo sapiens
ggtccagggag

SEQ ID NO: 4573227 - DNA, 20 bp, Homo sapiens
ggtccaggggcccctccagc

SEQ ID NO: 4573228 - DNA, 20 bp, Homo sapiens
ggtccaggtcccagcccctc

SEQ ID NO: 4573229 - DNA, 20 bp, Homo sapiens
ggtccatagagatgagccca

SEQ ID NO: 4573230 - DNA, 20 bp, Homo sapiens
ggtccatggagtacggctgg

SEQ ID NO: 4573231 - DNA, 13 bp, Homo sapiens
ggtccatgggcag

SEQ ID NO: 4573232 - DNA, 18 bp, Homo sapiens
ggtccatgggcagagccc

SEQ ID NO: 4573233 - DNA, 22 bp, Homo sapiens
ggtccatgggggaaatcaagga

SEQ ID NO: 4573234 - DNA, 15 bp, Homo sapiens
ggtcccaagctgggc

SEQ ID NO: 4573235 - DNA, 20 bp, Homo sapiens
ggtcccaagctgggccccag

SEQ ID NO: 4573236 - DNA, 21 bp, Homo sapiens
ggtcccaagctgggccccagc

SEQ ID NO: 4573237 - DNA, 23 bp, Homo sapiens
ggtcccaagctgggccccagccc

SEQ ID NO: 4573238 - DNA, 19 bp, Homo sapiens
ggtcccacgccaggccagc

SEQ ID NO: 4573239 - DNA, 15 bp, Homo sapiens
ggtcccagccacccc

SEQ ID NO: 4573240 - DNA, 11 bp, Homo sapiens
ggtcccagccc

SEQ ID NO: 4573241 - DNA, 22 bp, Homo sapiens
ggtcccagcccctcctccctca

SEQ ID NO: 4573242 - DNA, 13 bp, Homo sapiens
ggtcccccagagc

SEQ ID NO: 4573243 - DNA, 14 bp, Homo sapiens
ggtcccccagagca

SEQ ID NO: 4573244 - DNA, 14 bp, Homo sapiens
ggtcccccaggagg

SEQ ID NO: 4573245 - DNA, 17 bp, Homo sapiens
ggtcccggctctgtggg

SEQ ID NO: 4573246 - DNA, 23 bp, Homo sapiens
ggtccctgataacaacctggaga

SEQ ID NO: 4573247 - DNA, 22 bp, Homo sapiens
ggtccctggagggcaagccctg

SEQ ID NO: 4573248 - DNA, 23 bp, Homo sapiens
ggtccctggagggcaagccctgc

SEQ ID NO: 4573249 - DNA, 23 bp, Homo sapiens
ggtcccttgcagctagttttcta

SEQ ID NO: 4573250 - DNA, 13 bp, Homo sapiens
ggtccgcaccctg

SEQ ID NO: 4573251 - DNA, 22 bp, Homo sapiens
ggtccggcctctccctgcctgt

SEQ ID NO: 4573252 - DNA, 22 bp, Homo sapiens
ggtccgtagctcccctggctgg

SEQ ID NO: 4573253 - DNA, 18 bp, Homo sapiens
ggtccgtttccttacaca

SEQ ID NO: 4573254 - DNA, 13 bp, Homo sapiens
ggtcctagcccag

SEQ ID NO: 4573255 - DNA, 16 bp, Homo sapiens
ggtcctagcccttccc

SEQ ID NO: 4573256 - DNA, 17 bp, Homo sapiens
ggtcctagcccttccct

SEQ ID NO: 4573257 - DNA, 11 bp, Homo sapiens
ggtcctctctt

SEQ ID NO: 4573258 - DNA, 12 bp, Homo sapiens
ggtcctctcttc

SEQ ID NO: 4573259 - DNA, 14 bp, Homo sapiens
ggtcctctcttcca

SEQ ID NO: 4573260 - DNA, 17 bp, Homo sapiens
ggtcctctcttccacag

SEQ ID NO: 4573261 - DNA, 19 bp, Homo sapiens
ggtcctctcttccacagtg

SEQ ID NO: 4573262 - DNA, 19 bp, Homo sapiens
ggtcctcttctgggcctga

SEQ ID NO: 4573263 - DNA, 22 bp, Homo sapiens
ggtcctcttctgggcctgacca

SEQ ID NO: 4573264 - DNA, 19 bp, Homo sapiens
ggtcctcttttcctggcag

SEQ ID NO: 4573265 - DNA, 20 bp, Homo sapiens
ggtcctcttttcctggcagc

SEQ ID NO: 4573266 - DNA, 23 bp, Homo sapiens
ggtcctcttttcctggcagctgc

SEQ ID NO: 4573267 - DNA, 20 bp, Homo sapiens
ggtcctgcccatgtgtcccc

SEQ ID NO: 4573268 - DNA, 22 bp, Homo sapiens
ggtcctgcccatgtgtcccctc

SEQ ID NO: 4573269 - DNA, 12 bp, Homo sapiens
ggtcctggctcc

SEQ ID NO: 4573270 - DNA, 13 bp, Homo sapiens
ggtcctggtgctg

SEQ ID NO: 4573271 - DNA, 15 bp, Homo sapiens
ggtcctggtgctgcc

SEQ ID NO: 4573272 - DNA, 15 bp, Homo sapiens
ggtccttatttattt

SEQ ID NO: 4573273 - DNA, 14 bp, Homo sapiens
ggtccttctccaca

SEQ ID NO: 4573274 - DNA, 17 bp, Homo sapiens
ggtcggaggtgctgtcc

SEQ ID NO: 4573275 - DNA, 17 bp, Homo sapiens
ggtcggccgccatagcc

SEQ ID NO: 4573276 - DNA, 17 bp, Homo sapiens
ggtcgggacagctgtgc

SEQ ID NO: 4573277 - DNA, 19 bp, Homo sapiens
ggtcgggacagctgtgccg

SEQ ID NO: 4573278 - DNA, 14 bp, Homo sapiens
ggtcgtgggccagt

SEQ ID NO: 4573279 - DNA, 16 bp, Homo sapiens
ggtcgttttccaaaga

SEQ ID NO: 4573280 - DNA, 14 bp, Homo sapiens
ggtctagggagaga

SEQ ID NO: 4573281 - DNA, 22 bp, Homo sapiens
ggtctcaaacttgtggcctcaa

SEQ ID NO: 4573282 - DNA, 16 bp, Homo sapiens
ggtctcatctcccagg

SEQ ID NO: 4573283 - DNA, 22 bp, Homo sapiens
ggtctccctctcctgcctactc

SEQ ID NO: 4573284 - DNA, 12 bp, Homo sapiens
ggtctccctggc

SEQ ID NO: 4573285 - DNA, 15 bp, Homo sapiens
ggtctccctggctcc

SEQ ID NO: 4573286 - DNA, 20 bp, Homo sapiens
ggtctcccttctctacactc

SEQ ID NO: 4573287 - DNA, 17 bp, Homo sapiens
ggtctctctcggcccct

SEQ ID NO: 4573288 - DNA, 15 bp, Homo sapiens
ggtctgagccacagc

SEQ ID NO: 4573289 - DNA, 12 bp, Homo sapiens
ggtctgagccct

SEQ ID NO: 4573290 - DNA, 16 bp, Homo sapiens
ggtctgaggcccctgc

SEQ ID NO: 4573291 - DNA, 20 bp, Homo sapiens
ggtctgaggcccctgcctcc

SEQ ID NO: 4573292 - DNA, 21 bp, Homo sapiens
ggtctgatggaactgtgtatt

SEQ ID NO: 4573293 - DNA, 20 bp, Homo sapiens
ggtctgggagtcacacagtg

SEQ ID NO: 4573294 - DNA, 17 bp, Homo sapiens
ggtctggtaactgcaga

SEQ ID NO: 4573295 - DNA, 21 bp, Homo sapiens
ggtctgtgtgtgtgtatgtgg

SEQ ID NO: 4573296 - DNA, 15 bp, Homo sapiens
ggtctgtttaaagtg

SEQ ID NO: 4573297 - DNA, 12 bp, Homo sapiens
ggtctgtttgca

SEQ ID NO: 4573298 - DNA, 15 bp, Homo sapiens
ggtcttacagcaggc

SEQ ID NO: 4573299 - DNA, 17 bp, Homo sapiens
ggtcttccctacctcag

SEQ ID NO: 4573300 - DNA, 21 bp, Homo sapiens
ggtcttgaactcctggactca

SEQ ID NO: 4573301 - DNA, 14 bp, Homo sapiens
ggtcttgctctgtc

SEQ ID NO: 4573302 - DNA, 15 bp, Homo sapiens
ggtcttggctgcctg

SEQ ID NO: 4573303 - DNA, 20 bp, Homo sapiens
ggtctttcagtactttttta

SEQ ID NO: 4573304 - DNA, 21 bp, Homo sapiens
ggtgaaaataagacaaaaata

SEQ ID NO: 4573305 - DNA, 21 bp, Homo sapiens
ggtgaactgagctgggcagga

SEQ ID NO: 4573306 - DNA, 15 bp, Homo sapiens
ggtgaagtaaattag

SEQ ID NO: 4573307 - DNA, 13 bp, Homo sapiens
ggtgaagtgtggc

SEQ ID NO: 4573308 - DNA, 16 bp, Homo sapiens
ggtgaagtgtggctgg

SEQ ID NO: 4573309 - DNA, 14 bp, Homo sapiens
ggtgacagagtgag

SEQ ID NO: 4573310 - DNA, 15 bp, Homo sapiens
ggtgacagtggctgc

SEQ ID NO: 4573311 - DNA, 18 bp, Homo sapiens
ggtgacagtggctgctct

SEQ ID NO: 4573312 - DNA, 20 bp, Homo sapiens
ggtgacagtggctgctctgg

SEQ ID NO: 4573313 - DNA, 15 bp, Homo sapiens
ggtgacatccgtccc

SEQ ID NO: 4573314 - DNA, 13 bp, Homo sapiens
ggtgacctcctgc

SEQ ID NO: 4573315 - DNA, 13 bp, Homo sapiens
ggtgactgtccca

SEQ ID NO: 4573316 - DNA, 21 bp, Homo sapiens
ggtgacttcaggtggagagca

SEQ ID NO: 4573317 - DNA, 18 bp, Homo sapiens
ggtgagagacctgctcag

SEQ ID NO: 4573318 - DNA, 20 bp, Homo sapiens
ggtgagagacctgctcaggc

SEQ ID NO: 4573319 - DNA, 19 bp, Homo sapiens
ggtgagagagacaggcagc

SEQ ID NO: 4573320 - DNA, 18 bp, Homo sapiens
ggtgagctctcaggccga

SEQ ID NO: 4573321 - DNA, 21 bp, Homo sapiens
ggtgagctctcaggccgagag

SEQ ID NO: 4573322 - DNA, 16 bp, Homo sapiens
ggtgataggtaaattt

SEQ ID NO: 4573323 - DNA, 20 bp, Homo sapiens
ggtgatggaaactgccaaac

SEQ ID NO: 4573324 - DNA, 13 bp, Homo sapiens
ggtgatggggagg

SEQ ID NO: 4573325 - DNA, 19 bp, Homo sapiens
ggtgcagccttcccctccc

SEQ ID NO: 4573326 - DNA, 21 bp, Homo sapiens
ggtgcagccttcccctccctg

SEQ ID NO: 4573327 - DNA, 12 bp, Homo sapiens
ggtgcagggaga

SEQ ID NO: 4573328 - DNA, 17 bp, Homo sapiens
ggtgcaggtctccacct

SEQ ID NO: 4573329 - DNA, 15 bp, Homo sapiens
ggtgcatctcctccc

SEQ ID NO: 4573330 - DNA, 12 bp, Homo sapiens
ggtgccagaagc

SEQ ID NO: 4573331 - DNA, 13 bp, Homo sapiens
ggtgccagctgcc

SEQ ID NO: 4573332 - DNA, 15 bp, Homo sapiens
ggtgccagttatggc

SEQ ID NO: 4573333 - DNA, 23 bp, Homo sapiens
ggtgcccagaataagttattgca

SEQ ID NO: 4573334 - DNA, 18 bp, Homo sapiens
ggtgccccgactgtggga

SEQ ID NO: 4573335 - DNA, 22 bp, Homo sapiens
ggtgcccctgctcactgggccc

SEQ ID NO: 4573336 - DNA, 20 bp, Homo sapiens
ggtgcccgtaatcccagcta

SEQ ID NO: 4573337 - DNA, 14 bp, Homo sapiens
ggtgccgcctgccc

SEQ ID NO: 4573338 - DNA, 15 bp, Homo sapiens
ggtgcctgagaggca

SEQ ID NO: 4573339 - DNA, 17 bp, Homo sapiens
ggtgcctgagaggcagg

SEQ ID NO: 4573340 - DNA, 19 bp, Homo sapiens
ggtgcctgggtggggctgc

SEQ ID NO: 4573341 - DNA, 22 bp, Homo sapiens
ggtgcctgggtggggctgctcc

SEQ ID NO: 4573342 - DNA, 18 bp, Homo sapiens
ggtgccttcactgggcca

SEQ ID NO: 4573343 - DNA, 23 bp, Homo sapiens
ggtgccttcttattctcactcca

SEQ ID NO: 4573344 - DNA, 19 bp, Homo sapiens
ggtgcctttcaaatttaga

SEQ ID NO: 4573345 - DNA, 16 bp, Homo sapiens
ggtgcctttcctgttc

SEQ ID NO: 4573346 - DNA, 17 bp, Homo sapiens
ggtgcgggatacagctg

SEQ ID NO: 4573347 - DNA, 22 bp, Homo sapiens
ggtgcgtggcttccctgtccca

SEQ ID NO: 4573348 - DNA, 19 bp, Homo sapiens
ggtgctacaaaaacacagc

SEQ ID NO: 4573349 - DNA, 23 bp, Homo sapiens
ggtgctacaaaaacacagcaagg

SEQ ID NO: 4573350 - DNA, 16 bp, Homo sapiens
ggtgctcctgtgctca

SEQ ID NO: 4573351 - DNA, 20 bp, Homo sapiens
ggtgctgacaatactgctgc

SEQ ID NO: 4573352 - DNA, 14 bp, Homo sapiens
ggtgctgcaggagt

SEQ ID NO: 4573353 - DNA, 17 bp, Homo sapiens
ggtgctgccgagggctg

SEQ ID NO: 4573354 - DNA, 18 bp, Homo sapiens
ggtgctgccgagggctgg

SEQ ID NO: 4573355 - DNA, 11 bp, Homo sapiens
ggtgctggtcc

SEQ ID NO: 4573356 - DNA, 22 bp, Homo sapiens
ggtgctgtcttttgttctctga

SEQ ID NO: 4573357 - DNA, 14 bp, Homo sapiens
ggtgctgtgaggga

SEQ ID NO: 4573358 - DNA, 17 bp, Homo sapiens
ggtgctgtgagggaggg

SEQ ID NO: 4573359 - DNA, 17 bp, Homo sapiens
ggtgctgtttaaagtca

SEQ ID NO: 4573360 - DNA, 14 bp, Homo sapiens
ggtgctttccttca

SEQ ID NO: 4573361 - DNA, 19 bp, Homo sapiens
ggtgcttttatagaggcta

SEQ ID NO: 4573362 - DNA, 21 bp, Homo sapiens
ggtggaaaggtgtgagactgg

SEQ ID NO: 4573363 - DNA, 18 bp, Homo sapiens
ggtggaagcagaggccct

SEQ ID NO: 4573364 - DNA, 20 bp, Homo sapiens
ggtggaagcagaggccctgc

SEQ ID NO: 4573365 - DNA, 18 bp, Homo sapiens
ggtggacgctgcagaccc

SEQ ID NO: 4573366 - DNA, 17 bp, Homo sapiens
ggtggaggaagggctgg

SEQ ID NO: 4573367 - DNA, 17 bp, Homo sapiens
ggtggaggaccgaggct

SEQ ID NO: 4573368 - DNA, 23 bp, Homo sapiens
ggtggagggccacatgggaggct

SEQ ID NO: 4573369 - DNA, 15 bp, Homo sapiens
ggtggagtttctctg

SEQ ID NO: 4573370 - DNA, 16 bp, Homo sapiens
ggtggatgtgctggag

SEQ ID NO: 4573371 - DNA, 19 bp, Homo sapiens
ggtggcaattggggcggag

SEQ ID NO: 4573372 - DNA, 12 bp, Homo sapiens
ggtggcacctgc

SEQ ID NO: 4573373 - DNA, 13 bp, Homo sapiens
ggtggcacctgca

SEQ ID NO: 4573374 - DNA, 14 bp, Homo sapiens
ggtggcacctgcag

SEQ ID NO: 4573375 - DNA, 17 bp, Homo sapiens
ggtggcagatgtcttcc

SEQ ID NO: 4573376 - DNA, 13 bp, Homo sapiens
ggtggccacagca

SEQ ID NO: 4573377 - DNA, 23 bp, Homo sapiens
ggtggccatccctgggcccctcc

SEQ ID NO: 4573378 - DNA, 17 bp, Homo sapiens
ggtggcccagagccata

SEQ ID NO: 4573379 - DNA, 20 bp, Homo sapiens
ggtggcctatttcagctgct

SEQ ID NO: 4573380 - DNA, 23 bp, Homo sapiens
ggtggcctatttcagctgctttg

SEQ ID NO: 4573381 - DNA, 15 bp, Homo sapiens
ggtggctgacccagt

SEQ ID NO: 4573382 - DNA, 19 bp, Homo sapiens
ggtggctgacccagtccct

SEQ ID NO: 4573383 - DNA, 21 bp, Homo sapiens
ggtggctgccccggcctcctc

SEQ ID NO: 4573384 - DNA, 21 bp, Homo sapiens
ggtggcttcttttctttgtat

SEQ ID NO: 4573385 - DNA, 14 bp, Homo sapiens
ggtggcttttgcgg

SEQ ID NO: 4573386 - DNA, 22 bp, Homo sapiens
ggtgggaccctgtccggcccag

SEQ ID NO: 4573387 - DNA, 17 bp, Homo sapiens
ggtgggagtaacagggc

SEQ ID NO: 4573388 - DNA, 18 bp, Homo sapiens
ggtgggagtaacagggca

SEQ ID NO: 4573389 - DNA, 16 bp, Homo sapiens
ggtgggatggaggaga

SEQ ID NO: 4573390 - DNA, 20 bp, Homo sapiens
ggtgggcagatcacttgagc

SEQ ID NO: 4573391 - DNA, 15 bp, Homo sapiens
ggtgggcttcctgcc

SEQ ID NO: 4573392 - DNA, 21 bp, Homo sapiens
ggtggggagagacgggccctg

SEQ ID NO: 4573393 - DNA, 18 bp, Homo sapiens
ggtggggctgctcctcca

SEQ ID NO: 4573394 - DNA, 17 bp, Homo sapiens
ggtgggggtgggtcaga

SEQ ID NO: 4573395 - DNA, 20 bp, Homo sapiens
ggtgggtccaggggcccctc

SEQ ID NO: 4573396 - DNA, 17 bp, Homo sapiens
ggtgggtccatgggcag

SEQ ID NO: 4573397 - DNA, 20 bp, Homo sapiens
ggtgggtccatgggcagagc

SEQ ID NO: 4573398 - DNA, 13 bp, Homo sapiens
ggtgggtgctgcc

SEQ ID NO: 4573399 - DNA, 23 bp, Homo sapiens
ggtggtgacgtggtagtcacttg

SEQ ID NO: 4573400 - DNA, 14 bp, Homo sapiens
ggtggtgcccgtgc

SEQ ID NO: 4573401 - DNA, 17 bp, Homo sapiens
ggtggtgcccgtgcccg

SEQ ID NO: 4573402 - DNA, 15 bp, Homo sapiens
ggtggttgagatgga

SEQ ID NO: 4573403 - DNA, 17 bp, Homo sapiens
ggtgtaaagttgttcgc

SEQ ID NO: 4573404 - DNA, 18 bp, Homo sapiens
ggtgtaatcattttaaat

SEQ ID NO: 4573405 - DNA, 22 bp, Homo sapiens
ggtgtatatgtgccacattttc

SEQ ID NO: 4573406 - DNA, 10 bp, Homo sapiens
ggtgtatttt

SEQ ID NO: 4573407 - DNA, 15 bp, Homo sapiens
ggtgtcaagtgcctg

SEQ ID NO: 4573408 - DNA, 12 bp, Homo sapiens
ggtgtcaataaa

SEQ ID NO: 4573409 - DNA, 20 bp, Homo sapiens
ggtgtcaataaagctgtgct

SEQ ID NO: 4573410 - DNA, 13 bp, Homo sapiens
ggtgtcaggctgc

SEQ ID NO: 4573411 - DNA, 18 bp, Homo sapiens
ggtgtcatttcattccat

SEQ ID NO: 4573412 - DNA, 21 bp, Homo sapiens
ggtgtccagcattgctggact

SEQ ID NO: 4573413 - DNA, 23 bp, Homo sapiens
ggtgtccccttcccctgctgacc

SEQ ID NO: 4573414 - DNA, 21 bp, Homo sapiens
ggtgtcctgcaccggggcctg

SEQ ID NO: 4573415 - DNA, 19 bp, Homo sapiens
ggtgtctccaaccccccag

SEQ ID NO: 4573416 - DNA, 15 bp, Homo sapiens
ggtgtcttccctgcc

SEQ ID NO: 4573417 - DNA, 20 bp, Homo sapiens
ggtgtcttccctgcctgtgg

SEQ ID NO: 4573418 - DNA, 16 bp, Homo sapiens
ggtgtgaccactgcag

SEQ ID NO: 4573419 - DNA, 15 bp, Homo sapiens
ggtgtgacctgaggg

SEQ ID NO: 4573420 - DNA, 16 bp, Homo sapiens
ggtgtgcaccagggtt

SEQ ID NO: 4573421 - DNA, 13 bp, Homo sapiens
ggtgtggcctcag

SEQ ID NO: 4573422 - DNA, 18 bp, Homo sapiens
ggtgtggcctcagccctc

SEQ ID NO: 4573423 - DNA, 19 bp, Homo sapiens
ggtgtggcctcagccctca

SEQ ID NO: 4573424 - DNA, 23 bp, Homo sapiens
ggtgtgtccccctctgtccaggc

SEQ ID NO: 4573425 - DNA, 13 bp, Homo sapiens
ggtgtgtttttgg

SEQ ID NO: 4573426 - DNA, 22 bp, Homo sapiens
ggtgttaggcatgtcccaccca

SEQ ID NO: 4573427 - DNA, 19 bp, Homo sapiens
ggtgttccacctggaaact

SEQ ID NO: 4573428 - DNA, 23 bp, Homo sapiens
ggtgttccgtgggaccctcagca

SEQ ID NO: 4573429 - DNA, 17 bp, Homo sapiens
ggtgttcgtttccatca

SEQ ID NO: 4573430 - DNA, 13 bp, Homo sapiens
ggtgttgaatcca

SEQ ID NO: 4573431 - DNA, 22 bp, Homo sapiens
ggtgttgaccactccagagaag

SEQ ID NO: 4573432 - DNA, 15 bp, Homo sapiens
ggtgttgtatgcctt

SEQ ID NO: 4573433 - DNA, 14 bp, Homo sapiens
ggtgtttcaacaga

SEQ ID NO: 4573434 - DNA, 16 bp, Homo sapiens
ggttaaaaaaaaaagt

SEQ ID NO: 4573435 - DNA, 17 bp, Homo sapiens
ggttaaaaaacaaatgt

SEQ ID NO: 4573436 - DNA, 13 bp, Homo sapiens
ggttaaagctaaa

SEQ ID NO: 4573437 - DNA, 13 bp, Homo sapiens
ggttaaattgctt

SEQ ID NO: 4573438 - DNA, 20 bp, Homo sapiens
ggttacactgttagaacact

SEQ ID NO: 4573439 - DNA, 17 bp, Homo sapiens
ggttactcagcagcaga

SEQ ID NO: 4573440 - DNA, 14 bp, Homo sapiens
ggttactttcaaaa

SEQ ID NO: 4573441 - DNA, 20 bp, Homo sapiens
ggttagatatttcgaccctg

SEQ ID NO: 4573442 - DNA, 22 bp, Homo sapiens
ggttagatatttcgaccctggg

SEQ ID NO: 4573443 - DNA, 23 bp, Homo sapiens
ggttagatatttcgaccctgggg

SEQ ID NO: 4573444 - DNA, 17 bp, Homo sapiens
ggttattaaactgaata

SEQ ID NO: 4573445 - DNA, 16 bp, Homo sapiens
ggttcacacagcccag

SEQ ID NO: 4573446 - DNA, 19 bp, Homo sapiens
ggttcacacagcccagttc

SEQ ID NO: 4573447 - DNA, 16 bp, Homo sapiens
ggttcagacccctgcc

SEQ ID NO: 4573448 - DNA, 17 bp, Homo sapiens
ggttcagcccctcctct

SEQ ID NO: 4573449 - DNA, 13 bp, Homo sapiens
ggttcatgatgca

SEQ ID NO: 4573450 - DNA, 15 bp, Homo sapiens
ggttcatgatgcagt

SEQ ID NO: 4573451 - DNA, 21 bp, Homo sapiens
ggttcatgcttaataaacatg

SEQ ID NO: 4573452 - DNA, 12 bp, Homo sapiens
ggttcccttcct

SEQ ID NO: 4573453 - DNA, 15 bp, Homo sapiens
ggttccgcttggagc

SEQ ID NO: 4573454 - DNA, 21 bp, Homo sapiens
ggttccgcttggagcagaggg

SEQ ID NO: 4573455 - DNA, 15 bp, Homo sapiens
ggttcctctgcctgc

SEQ ID NO: 4573456 - DNA, 17 bp, Homo sapiens
ggttcctctgcctgccc

SEQ ID NO: 4573457 - DNA, 17 bp, Homo sapiens
ggttcgatacctggagc

SEQ ID NO: 4573458 - DNA, 16 bp, Homo sapiens
ggttcggctgctttta

SEQ ID NO: 4573459 - DNA, 14 bp, Homo sapiens
ggttctaaaaggtg

SEQ ID NO: 4573460 - DNA, 13 bp, Homo sapiens
ggttctaaggctc

SEQ ID NO: 4573461 - DNA, 11 bp, Homo sapiens
ggttctagacg

SEQ ID NO: 4573462 - DNA, 20 bp, Homo sapiens
ggttctagacgcccctccca

SEQ ID NO: 4573463 - DNA, 21 bp, Homo sapiens
ggttctgctagagcagacagg

SEQ ID NO: 4573464 - DNA, 13 bp, Homo sapiens
ggttctggctgtt

SEQ ID NO: 4573465 - DNA, 17 bp, Homo sapiens
ggttcttaaaaaggaac

SEQ ID NO: 4573466 - DNA, 22 bp, Homo sapiens
ggttgaactctggtggcacagg

SEQ ID NO: 4573467 - DNA, 20 bp, Homo sapiens
ggttgagggcaatggacaag

SEQ ID NO: 4573468 - DNA, 16 bp, Homo sapiens
ggttgcaaggccgctg

SEQ ID NO: 4573469 - DNA, 13 bp, Homo sapiens
ggttgccagaggc

SEQ ID NO: 4573470 - DNA, 23 bp, Homo sapiens
ggttgcctctgcctttgtgatcc

SEQ ID NO: 4573471 - DNA, 15 bp, Homo sapiens
ggttgcttaattcct

SEQ ID NO: 4573472 - DNA, 15 bp, Homo sapiens
ggttggagagctaga

SEQ ID NO: 4573473 - DNA, 19 bp, Homo sapiens
ggttgggaattcttgctgt

SEQ ID NO: 4573474 - DNA, 21 bp, Homo sapiens
ggttgggcagccagaccagca

SEQ ID NO: 4573475 - DNA, 17 bp, Homo sapiens
ggttgggcccagatctg

SEQ ID NO: 4573476 - DNA, 20 bp, Homo sapiens
ggttgggggaatgcacctcc

SEQ ID NO: 4573477 - DNA, 19 bp, Homo sapiens
ggttgttgatattgtttgc

SEQ ID NO: 4573478 - DNA, 12 bp, Homo sapiens
ggttgtttctgt

SEQ ID NO: 4573479 - DNA, 14 bp, Homo sapiens
ggttgtttctgttc

SEQ ID NO: 4573480 - DNA, 19 bp, Homo sapiens
ggttgtttctgttccaaat

SEQ ID NO: 4573481 - DNA, 14 bp, Homo sapiens
ggtttaaaaaaaaa

SEQ ID NO: 4573482 - DNA, 20 bp, Homo sapiens
ggtttaaacttgtttgctgt

SEQ ID NO: 4573483 - DNA, 19 bp, Homo sapiens
ggtttaatgttttggccaa

SEQ ID NO: 4573484 - DNA, 15 bp, Homo sapiens
ggtttacccagtggg

SEQ ID NO: 4573485 - DNA, 14 bp, Homo sapiens
ggtttatgactctt

SEQ ID NO: 4573486 - DNA, 18 bp, Homo sapiens
ggtttcaagaatatggag

SEQ ID NO: 4573487 - DNA, 16 bp, Homo sapiens
ggtttcatgttagtta

SEQ ID NO: 4573488 - DNA, 19 bp, Homo sapiens
ggtttccaaagaatatttt

SEQ ID NO: 4573489 - DNA, 20 bp, Homo sapiens
ggtttctctattaaaatgca

SEQ ID NO: 4573490 - DNA, 13 bp, Homo sapiens
ggtttggacagac

SEQ ID NO: 4573491 - DNA, 15 bp, Homo sapiens
ggtttggagctgatc

SEQ ID NO: 4573492 - DNA, 15 bp, Homo sapiens
ggtttggtttgcttt

SEQ ID NO: 4573493 - DNA, 16 bp, Homo sapiens
ggttttatactgaagg

SEQ ID NO: 4573494 - DNA, 12 bp, Homo sapiens
ggttttcatcta

SEQ ID NO: 4573495 - DNA, 20 bp, Homo sapiens
ggttttgcttccccgtgcat

SEQ ID NO: 4573496 - DNA, 19 bp, Homo sapiens
ggttttgtattctctgagc

SEQ ID NO: 4573497 - DNA, 14 bp, Homo sapiens
ggttttgttcccct

SEQ ID NO: 4573498 - DNA, 19 bp, Homo sapiens
ggttttgttcccctcctcc

SEQ ID NO: 4573499 - DNA, 18 bp, Homo sapiens
ggtttttaaattttgtaa

SEQ ID NO: 4573500 - DNA, 16 bp, Homo sapiens
ggtttttccaaactta

SEQ ID NO: 4573501 - DNA, 13 bp, Homo sapiens
ggtttttgctctc

SEQ ID NO: 4573502 - DNA, 23 bp, Homo sapiens
gtaaaaagactactggcctctgt

SEQ ID NO: 4573503 - DNA, 16 bp, Homo sapiens
gtaaaaatgctgctct

SEQ ID NO: 4573504 - DNA, 14 bp, Homo sapiens
gtaaaacaatacat

SEQ ID NO: 4573505 - DNA, 20 bp, Homo sapiens
gtaaaacacaccaatcagcg

SEQ ID NO: 4573506 - DNA, 14 bp, Homo sapiens
gtaaaaccacagca

SEQ ID NO: 4573507 - DNA, 16 bp, Homo sapiens
gtaaaaccacagcagt

SEQ ID NO: 4573508 - DNA, 18 bp, Homo sapiens
gtaaaaccacagcagttg

SEQ ID NO: 4573509 - DNA, 23 bp, Homo sapiens
gtaaaaccacagcagttgaaaag

SEQ ID NO: 4573510 - DNA, 15 bp, Homo sapiens
gtaaaagactttttt

SEQ ID NO: 4573511 - DNA, 19 bp, Homo sapiens
gtaaaagcaaaaaagaaaa

SEQ ID NO: 4573512 - DNA, 19 bp, Homo sapiens
gtaaaagtctacctgtgtt

SEQ ID NO: 4573513 - DNA, 14 bp, Homo sapiens
gtaaaataaaatgc

SEQ ID NO: 4573514 - DNA, 18 bp, Homo sapiens
gtaaaatgtgaaaaacta

SEQ ID NO: 4573515 - DNA, 11 bp, Homo sapiens
gtaaaattaat

SEQ ID NO: 4573516 - DNA, 13 bp, Homo sapiens
gtaaaatttattt

SEQ ID NO: 4573517 - DNA, 20 bp, Homo sapiens
gtaaacaggtatttttttaa

SEQ ID NO: 4573518 - DNA, 17 bp, Homo sapiens
gtaaacagtgcctgctg

SEQ ID NO: 4573519 - DNA, 22 bp, Homo sapiens
gtaaaccaaaccctataaacct

SEQ ID NO: 4573520 - DNA, 12 bp, Homo sapiens
gtaaaccactga

SEQ ID NO: 4573521 - DNA, 13 bp, Homo sapiens
gtaaaccactgaa

SEQ ID NO: 4573522 - DNA, 14 bp, Homo sapiens
gtaaaccactgaaa

SEQ ID NO: 4573523 - DNA, 22 bp, Homo sapiens
gtaaaccactgaaaaaatatat

SEQ ID NO: 4573524 - DNA, 18 bp, Homo sapiens
gtaaaccagatctgtctc

SEQ ID NO: 4573525 - DNA, 18 bp, Homo sapiens
gtaaacggcccaggccag

SEQ ID NO: 4573526 - DNA, 14 bp, Homo sapiens
gtaaactattctta

SEQ ID NO: 4573527 - DNA, 16 bp, Homo sapiens
gtaaactctcttctct

SEQ ID NO: 4573528 - DNA, 19 bp, Homo sapiens
gtaaactgtactagtctgt

SEQ ID NO: 4573529 - DNA, 15 bp, Homo sapiens
gtaaacttggaatca

SEQ ID NO: 4573530 - DNA, 22 bp, Homo sapiens
gtaaagaagggatattaagaat

SEQ ID NO: 4573531 - DNA, 19 bp, Homo sapiens
gtaaagactggcttttatt

SEQ ID NO: 4573532 - DNA, 18 bp, Homo sapiens
gtaaagactggttttctg

SEQ ID NO: 4573533 - DNA, 15 bp, Homo sapiens
gtaaagagaaacttt

SEQ ID NO: 4573534 - DNA, 20 bp, Homo sapiens
gtaaagagaaactttgtgct

SEQ ID NO: 4573535 - DNA, 17 bp, Homo sapiens
gtaaagagtacactcag

SEQ ID NO: 4573536 - DNA, 21 bp, Homo sapiens
gtaaagagtacactcagccac

SEQ ID NO: 4573537 - DNA, 22 bp, Homo sapiens
gtaaagatatttttatctttat

SEQ ID NO: 4573538 - DNA, 15 bp, Homo sapiens
gtaaagccattaaat

SEQ ID NO: 4573539 - DNA, 15 bp, Homo sapiens
gtaaagctagaaatg

SEQ ID NO: 4573540 - DNA, 15 bp, Homo sapiens
gtaaagggcaaataa

SEQ ID NO: 4573541 - DNA, 18 bp, Homo sapiens
gtaaagggcaaataatga

SEQ ID NO: 4573542 - DNA, 17 bp, Homo sapiens
gtaaagtatgtattatt

SEQ ID NO: 4573543 - DNA, 21 bp, Homo sapiens
gtaaagtggttctctgccttt

SEQ ID NO: 4573544 - DNA, 15 bp, Homo sapiens
gtaaataaaaagaaa

SEQ ID NO: 4573545 - DNA, 15 bp, Homo sapiens
gtaaataaaacatca

SEQ ID NO: 4573546 - DNA, 17 bp, Homo sapiens
gtaaataaactatttat

SEQ ID NO: 4573547 - DNA, 17 bp, Homo sapiens
gtaaataggttcttctt

SEQ ID NO: 4573548 - DNA, 23 bp, Homo sapiens
gtaaataggtttctaaaaagtca

SEQ ID NO: 4573549 - DNA, 19 bp, Homo sapiens
gtaaatatccctcccctct

SEQ ID NO: 4573550 - DNA, 13 bp, Homo sapiens
gtaaatattagtg

SEQ ID NO: 4573551 - DNA, 14 bp, Homo sapiens
gtaaatattttaaa

SEQ ID NO: 4573552 - DNA, 20 bp, Homo sapiens
gtaaatctaacattattact

SEQ ID NO: 4573553 - DNA, 19 bp, Homo sapiens
gtaaatctttttgcttcta

SEQ ID NO: 4573554 - DNA, 10 bp, Homo sapiens
gtaaatgcct

SEQ ID NO: 4573555 - DNA, 18 bp, Homo sapiens
gtaaatgcttaaatttca

SEQ ID NO: 4573556 - DNA, 20 bp, Homo sapiens
gtaaatgtggattttgtaga

SEQ ID NO: 4573557 - DNA, 19 bp, Homo sapiens
gtaaattatatttgtgcta

SEQ ID NO: 4573558 - DNA, 20 bp, Homo sapiens
gtaaattatatttgtgctat

SEQ ID NO: 4573559 - DNA, 21 bp, Homo sapiens
gtaaattattttaaattataa

SEQ ID NO: 4573560 - DNA, 16 bp, Homo sapiens
gtaaattgcagaattc

SEQ ID NO: 4573561 - DNA, 16 bp, Homo sapiens
gtaaatttatgtgatg

SEQ ID NO: 4573562 - DNA, 17 bp, Homo sapiens
gtaacactaatatattt

SEQ ID NO: 4573563 - DNA, 17 bp, Homo sapiens
gtaacagacacacgatg

SEQ ID NO: 4573564 - DNA, 21 bp, Homo sapiens
gtaacatgacttccttatttc

SEQ ID NO: 4573565 - DNA, 11 bp, Homo sapiens
gtaaccagcca

SEQ ID NO: 4573566 - DNA, 17 bp, Homo sapiens
gtaaccaggccccagcc

SEQ ID NO: 4573567 - DNA, 20 bp, Homo sapiens
gtaacctcttcagaggccct

SEQ ID NO: 4573568 - DNA, 19 bp, Homo sapiens
gtaacctttaaaaatgtat

SEQ ID NO: 4573569 - DNA, 22 bp, Homo sapiens
gtaactattcacagattgcttc

SEQ ID NO: 4573570 - DNA, 15 bp, Homo sapiens
gtaactgctttctgt

SEQ ID NO: 4573571 - DNA, 20 bp, Homo sapiens
gtaactgctttctgttccaa

SEQ ID NO: 4573572 - DNA, 20 bp, Homo sapiens
gtaactgtccgtagtatcag

SEQ ID NO: 4573573 - DNA, 13 bp, Homo sapiens
gtaacttatttga

SEQ ID NO: 4573574 - DNA, 14 bp, Homo sapiens
gtaacttttgtgaa

SEQ ID NO: 4573575 - DNA, 12 bp, Homo sapiens
gtaagaaaagct

SEQ ID NO: 4573576 - DNA, 18 bp, Homo sapiens
gtaagaaaagctggtctg

SEQ ID NO: 4573577 - DNA, 18 bp, Homo sapiens
gtaagaacaactacctga

SEQ ID NO: 4573578 - DNA, 12 bp, Homo sapiens
gtaagaagaaag

SEQ ID NO: 4573579 - DNA, 14 bp, Homo sapiens
gtaagaagaaagca

SEQ ID NO: 4573580 - DNA, 11 bp, Homo sapiens
gtaagaaggca

SEQ ID NO: 4573581 - DNA, 22 bp, Homo sapiens
gtaagaagggtgggagtggggc

SEQ ID NO: 4573582 - DNA, 22 bp, Homo sapiens
gtaagaagtttcttaaacattg

SEQ ID NO: 4573583 - DNA, 18 bp, Homo sapiens
gtaagaccaaatgtagtt

SEQ ID NO: 4573584 - DNA, 19 bp, Homo sapiens
gtaagagaaaagagagaaa

SEQ ID NO: 4573585 - DNA, 19 bp, Homo sapiens
gtaagattgcactgttctg

SEQ ID NO: 4573586 - DNA, 21 bp, Homo sapiens
gtaagattgttattaaatgta

SEQ ID NO: 4573587 - DNA, 19 bp, Homo sapiens
gtaagcaacttgcttctaa

SEQ ID NO: 4573588 - DNA, 17 bp, Homo sapiens
gtaagcatctcaatctt

SEQ ID NO: 4573589 - DNA, 16 bp, Homo sapiens
gtaagccagagcctgg

SEQ ID NO: 4573590 - DNA, 19 bp, Homo sapiens
gtaaggatccggaaagaag

SEQ ID NO: 4573591 - DNA, 17 bp, Homo sapiens
gtaagggaaactgccag

SEQ ID NO: 4573592 - DNA, 18 bp, Homo sapiens
gtaagggaaactgccagc

SEQ ID NO: 4573593 - DNA, 12 bp, Homo sapiens
gtaaggtgcctt

SEQ ID NO: 4573594 - DNA, 20 bp, Homo sapiens
gtaaggtgtgtactcagggc

SEQ ID NO: 4573595 - DNA, 20 bp, Homo sapiens
gtaagtatttccatagtcaa

SEQ ID NO: 4573596 - DNA, 19 bp, Homo sapiens
gtaagtctgatttttaaga

SEQ ID NO: 4573597 - DNA, 15 bp, Homo sapiens
gtaagtgaatttatg

SEQ ID NO: 4573598 - DNA, 12 bp, Homo sapiens
gtaagtgccttc

SEQ ID NO: 4573599 - DNA, 13 bp, Homo sapiens
gtaagttttttga

SEQ ID NO: 4573600 - DNA, 21 bp, Homo sapiens
gtaataaaactatttgtataa

SEQ ID NO: 4573601 - DNA, 12 bp, Homo sapiens
gtaataaaactg

SEQ ID NO: 4573602 - DNA, 21 bp, Homo sapiens
gtaataaaagctttgactccc

SEQ ID NO: 4573603 - DNA, 12 bp, Homo sapiens
gtaataaacagg

SEQ ID NO: 4573604 - DNA, 16 bp, Homo sapiens
gtaataaactgtgttt

SEQ ID NO: 4573605 - DNA, 17 bp, Homo sapiens
gtaataaagtgttttca

SEQ ID NO: 4573606 - DNA, 20 bp, Homo sapiens
gtaataaagtgttttcagag

SEQ ID NO: 4573607 - DNA, 19 bp, Homo sapiens
gtaatacgtagctctctta

SEQ ID NO: 4573608 - DNA, 13 bp, Homo sapiens
gtaatagctcaga

SEQ ID NO: 4573609 - DNA, 17 bp, Homo sapiens
gtaataggaccagagcg

SEQ ID NO: 4573610 - DNA, 22 bp, Homo sapiens
gtaatataatgtattttctttt

SEQ ID NO: 4573611 - DNA, 15 bp, Homo sapiens
gtaatatagaaaaaa

SEQ ID NO: 4573612 - DNA, 19 bp, Homo sapiens
gtaatatcaaagcatttta

SEQ ID NO: 4573613 - DNA, 12 bp, Homo sapiens
gtaatatgtata

SEQ ID NO: 4573614 - DNA, 12 bp, Homo sapiens
gtaatatttaca

SEQ ID NO: 4573615 - DNA, 17 bp, Homo sapiens
gtaatattttccataaa

SEQ ID NO: 4573616 - DNA, 21 bp, Homo sapiens
gtaatcatgttttaatgtaga

SEQ ID NO: 4573617 - DNA, 23 bp, Homo sapiens
gtaatcattatctcactttgtaa

SEQ ID NO: 4573618 - DNA, 18 bp, Homo sapiens
gtaatcatttgtttacat

SEQ ID NO: 4573619 - DNA, 14 bp, Homo sapiens
gtaatcattttaat

SEQ ID NO: 4573620 - DNA, 15 bp, Homo sapiens
gtaatccaggggtgt

SEQ ID NO: 4573621 - DNA, 12 bp, Homo sapiens
gtaatcccagca

SEQ ID NO: 4573622 - DNA, 13 bp, Homo sapiens
gtaatcccagcag

SEQ ID NO: 4573623 - DNA, 13 bp, Homo sapiens
gtaatcctaaatt

SEQ ID NO: 4573624 - DNA, 14 bp, Homo sapiens
gtaatctaatagaa

SEQ ID NO: 4573625 - DNA, 18 bp, Homo sapiens
gtaatctacaccaatgaa

SEQ ID NO: 4573626 - DNA, 18 bp, Homo sapiens
gtaatgaccagttgttat

SEQ ID NO: 4573627 - DNA, 16 bp, Homo sapiens
gtaatgattttggaac

SEQ ID NO: 4573628 - DNA, 19 bp, Homo sapiens
gtaatgattttggaactgt

SEQ ID NO: 4573629 - DNA, 23 bp, Homo sapiens
gtaatgtaaataaactatttata

SEQ ID NO: 4573630 - DNA, 20 bp, Homo sapiens
gtaatgtagggttatatttg

SEQ ID NO: 4573631 - DNA, 19 bp, Homo sapiens
gtaatgtcaccaccttccc

SEQ ID NO: 4573632 - DNA, 21 bp, Homo sapiens
gtaatgttttctttgcaaagt

SEQ ID NO: 4573633 - DNA, 19 bp, Homo sapiens
gtaattaaaagcaaatcat

SEQ ID NO: 4573634 - DNA, 20 bp, Homo sapiens
gtaattaaaagcaaatcatt

SEQ ID NO: 4573635 - DNA, 19 bp, Homo sapiens
gtaattaaggtacatcatt

SEQ ID NO: 4573636 - DNA, 21 bp, Homo sapiens
gtaattagtgccacttaatgt

SEQ ID NO: 4573637 - DNA, 21 bp, Homo sapiens
gtaattatgcactaaatatga

SEQ ID NO: 4573638 - DNA, 17 bp, Homo sapiens
gtaattcaggtttttcc

SEQ ID NO: 4573639 - DNA, 21 bp, Homo sapiens
gtaattctgtcattcctaaaa

SEQ ID NO: 4573640 - DNA, 12 bp, Homo sapiens
gtaattgtaatt

SEQ ID NO: 4573641 - DNA, 19 bp, Homo sapiens
gtaatttaaaattgtgatg

SEQ ID NO: 4573642 - DNA, 18 bp, Homo sapiens
gtaatttagaaatcattt

SEQ ID NO: 4573643 - DNA, 20 bp, Homo sapiens
gtaatttagaagatattatt

SEQ ID NO: 4573644 - DNA, 13 bp, Homo sapiens
gtaatttattgtc

SEQ ID NO: 4573645 - DNA, 21 bp, Homo sapiens
gtaatttattgtctgtctaca

SEQ ID NO: 4573646 - DNA, 14 bp, Homo sapiens
gtaatttcatttaa

SEQ ID NO: 4573647 - DNA, 13 bp, Homo sapiens
gtaatttctttaa

SEQ ID NO: 4573648 - DNA, 21 bp, Homo sapiens
gtaatttctttaaatgtgtat

SEQ ID NO: 4573649 - DNA, 14 bp, Homo sapiens
gtaatttgaagatt

SEQ ID NO: 4573650 - DNA, 23 bp, Homo sapiens
gtaattttatttgttctttttct

SEQ ID NO: 4573651 - DNA, 16 bp, Homo sapiens
gtaattttattttaaa

SEQ ID NO: 4573652 - DNA, 23 bp, Homo sapiens
gtaattttcggatgggagagttt

SEQ ID NO: 4573653 - DNA, 23 bp, Homo sapiens
gtaatttttgctccaatatccat

SEQ ID NO: 4573654 - DNA, 15 bp, Homo sapiens
gtacaaacagtattt

SEQ ID NO: 4573655 - DNA, 15 bp, Homo sapiens
gtacaagaagcattt

SEQ ID NO: 4573656 - DNA, 21 bp, Homo sapiens
gtacaagaagcattttgtaag

SEQ ID NO: 4573657 - DNA, 11 bp, Homo sapiens
gtacaataaaa

SEQ ID NO: 4573658 - DNA, 16 bp, Homo sapiens
gtacaataaaagtaaa

SEQ ID NO: 4573659 - DNA, 19 bp, Homo sapiens
gtacaatacaatgtacaat

SEQ ID NO: 4573660 - DNA, 20 bp, Homo sapiens
gtacaatacaatgtacaatt

SEQ ID NO: 4573661 - DNA, 21 bp, Homo sapiens
gtacaatacaatgtacaatta

SEQ ID NO: 4573662 - DNA, 20 bp, Homo sapiens
gtacaatagtatacatttta

SEQ ID NO: 4573663 - DNA, 12 bp, Homo sapiens
gtacacatgtgt

SEQ ID NO: 4573664 - DNA, 14 bp, Homo sapiens
gtacacatgtgtta

SEQ ID NO: 4573665 - DNA, 15 bp, Homo sapiens
gtacacatttcttaa

SEQ ID NO: 4573666 - DNA, 21 bp, Homo sapiens
gtacacatttcttaaaacaca

SEQ ID NO: 4573667 - DNA, 23 bp, Homo sapiens
gtacacatttcttaaaacacatg

SEQ ID NO: 4573668 - DNA, 21 bp, Homo sapiens
gtacactacgcactggacagc

SEQ ID NO: 4573669 - DNA, 15 bp, Homo sapiens
gtacactcagccact

SEQ ID NO: 4573670 - DNA, 18 bp, Homo sapiens
gtacactctgctgtttga

SEQ ID NO: 4573671 - DNA, 15 bp, Homo sapiens
gtacagaatttgaat

SEQ ID NO: 4573672 - DNA, 16 bp, Homo sapiens
gtacagacatatttaa

SEQ ID NO: 4573673 - DNA, 17 bp, Homo sapiens
gtacagacatatttaac

SEQ ID NO: 4573674 - DNA, 21 bp, Homo sapiens
gtacagacatggagatgtaaa

SEQ ID NO: 4573675 - DNA, 12 bp, Homo sapiens
gtacagatcccc

SEQ ID NO: 4573676 - DNA, 16 bp, Homo sapiens
gtacagatccccagcc

SEQ ID NO: 4573677 - DNA, 13 bp, Homo sapiens
gtacagcggctcc

SEQ ID NO: 4573678 - DNA, 20 bp, Homo sapiens
gtacagcggctcccctctgc

SEQ ID NO: 4573679 - DNA, 14 bp, Homo sapiens
gtacagtattgtgg

SEQ ID NO: 4573680 - DNA, 12 bp, Homo sapiens
gtacagtctgtc

SEQ ID NO: 4573681 - DNA, 16 bp, Homo sapiens
gtacagtcttgtatta

SEQ ID NO: 4573682 - DNA, 18 bp, Homo sapiens
gtacataactcctgtccc

SEQ ID NO: 4573683 - DNA, 20 bp, Homo sapiens
gtacataattgcatgaaaat

SEQ ID NO: 4573684 - DNA, 21 bp, Homo sapiens
gtacataggcttctattacct

SEQ ID NO: 4573685 - DNA, 20 bp, Homo sapiens
gtacatagttatttttctct

SEQ ID NO: 4573686 - DNA, 22 bp, Homo sapiens
gtacatagttatttttctcttt

SEQ ID NO: 4573687 - DNA, 22 bp, Homo sapiens
gtacatatcctttggtcctggt

SEQ ID NO: 4573688 - DNA, 14 bp, Homo sapiens
gtacatcattattg

SEQ ID NO: 4573689 - DNA, 20 bp, Homo sapiens
gtacatctattttggattgt

SEQ ID NO: 4573690 - DNA, 13 bp, Homo sapiens
gtacatcttcttt

SEQ ID NO: 4573691 - DNA, 20 bp, Homo sapiens
gtacatcttctttggaaata

SEQ ID NO: 4573692 - DNA, 22 bp, Homo sapiens
gtacatgtagttgaatttcagt

SEQ ID NO: 4573693 - DNA, 19 bp, Homo sapiens
gtacattacagattaaaga

SEQ ID NO: 4573694 - DNA, 20 bp, Homo sapiens
gtacattcttccatcatcac

SEQ ID NO: 4573695 - DNA, 22 bp, Homo sapiens
gtacattcttccatcatcactg

SEQ ID NO: 4573696 - DNA, 19 bp, Homo sapiens
gtacattgcttaaaatata

SEQ ID NO: 4573697 - DNA, 23 bp, Homo sapiens
gtacattttgtaaaatattatgt

SEQ ID NO: 4573698 - DNA, 23 bp, Homo sapiens
gtacatttttcaactttgaataa

SEQ ID NO: 4573699 - DNA, 19 bp, Homo sapiens
gtacatttttcagcagcaa

SEQ ID NO: 4573700 - DNA, 20 bp, Homo sapiens
gtaccaagtgcttcctacaa

SEQ ID NO: 4573701 - DNA, 16 bp, Homo sapiens
gtaccagtgaattttt

SEQ ID NO: 4573702 - DNA, 20 bp, Homo sapiens
gtaccagttaatttttccaa

SEQ ID NO: 4573703 - DNA, 20 bp, Homo sapiens
gtaccatggtttgatatgta

SEQ ID NO: 4573704 - DNA, 17 bp, Homo sapiens
gtacccctaaaatccca

SEQ ID NO: 4573705 - DNA, 22 bp, Homo sapiens
gtacccctaaaatcccaccaga

SEQ ID NO: 4573706 - DNA, 19 bp, Homo sapiens
gtaccgccagcagctgtca

SEQ ID NO: 4573707 - DNA, 21 bp, Homo sapiens
gtacctcagtggatcttcaga

SEQ ID NO: 4573708 - DNA, 15 bp, Homo sapiens
gtacctggggccaaa

SEQ ID NO: 4573709 - DNA, 18 bp, Homo sapiens
gtacctgtcaaaaatttt

SEQ ID NO: 4573710 - DNA, 21 bp, Homo sapiens
gtacctgtcaaaaattttgaa

SEQ ID NO: 4573711 - DNA, 22 bp, Homo sapiens
gtacctgtggctgtgtgtctgc

SEQ ID NO: 4573712 - DNA, 22 bp, Homo sapiens
gtaccttccatacacagaggag

SEQ ID NO: 4573713 - DNA, 22 bp, Homo sapiens
gtacgaatcttatttttcctgt

SEQ ID NO: 4573714 - DNA, 13 bp, Homo sapiens
gtacggatttgtc

SEQ ID NO: 4573715 - DNA, 23 bp, Homo sapiens
gtacggatttgtccaaataaatt

SEQ ID NO: 4573716 - DNA, 16 bp, Homo sapiens
gtacgttatatattgt

SEQ ID NO: 4573717 - DNA, 18 bp, Homo sapiens
gtactacagctatatttg

SEQ ID NO: 4573718 - DNA, 19 bp, Homo sapiens
gtactacagctatatttga

SEQ ID NO: 4573719 - DNA, 21 bp, Homo sapiens
gtactagagatattttgtaaa

SEQ ID NO: 4573720 - DNA, 11 bp, Homo sapiens
gtactcagggc

SEQ ID NO: 4573721 - DNA, 13 bp, Homo sapiens
gtactccagcctg

SEQ ID NO: 4573722 - DNA, 15 bp, Homo sapiens
gtactccagcctggg

SEQ ID NO: 4573723 - DNA, 16 bp, Homo sapiens
gtactctttctctccc

SEQ ID NO: 4573724 - DNA, 16 bp, Homo sapiens
gtactgaattctttat

SEQ ID NO: 4573725 - DNA, 19 bp, Homo sapiens
gtactgaatttttttgtaa

SEQ ID NO: 4573726 - DNA, 16 bp, Homo sapiens
gtactgtaagaataat

SEQ ID NO: 4573727 - DNA, 14 bp, Homo sapiens
gtactgtagcaggg

SEQ ID NO: 4573728 - DNA, 21 bp, Homo sapiens
gtactgtgggcaatttagaaa

SEQ ID NO: 4573729 - DNA, 22 bp, Homo sapiens
gtactgtgggcaatttagaaaa

SEQ ID NO: 4573730 - DNA, 14 bp, Homo sapiens
gtactgtgttttta

SEQ ID NO: 4573731 - DNA, 22 bp, Homo sapiens
gtactgttcggaaggggttcct

SEQ ID NO: 4573732 - DNA, 16 bp, Homo sapiens
gtactgttgctttaat

SEQ ID NO: 4573733 - DNA, 21 bp, Homo sapiens
gtactgttgctttaatatgag

SEQ ID NO: 4573734 - DNA, 15 bp, Homo sapiens
gtacttacattccag

SEQ ID NO: 4573735 - DNA, 14 bp, Homo sapiens
gtacttcctctgtg

SEQ ID NO: 4573736 - DNA, 15 bp, Homo sapiens
gtacttcttctgtaa

SEQ ID NO: 4573737 - DNA, 16 bp, Homo sapiens
gtacttcttctgtaat

SEQ ID NO: 4573738 - DNA, 23 bp, Homo sapiens
gtacttgaaaaatgtttttattt

SEQ ID NO: 4573739 - DNA, 22 bp, Homo sapiens
gtacttgccctgaccatgcatt

SEQ ID NO: 4573740 - DNA, 22 bp, Homo sapiens
gtacttgcttgtattgtaaatg

SEQ ID NO: 4573741 - DNA, 17 bp, Homo sapiens
gtacttgtcatatgtag

SEQ ID NO: 4573742 - DNA, 19 bp, Homo sapiens
gtacttgtcatatgtagcc

SEQ ID NO: 4573743 - DNA, 17 bp, Homo sapiens
gtactttatatcttgtt

SEQ ID NO: 4573744 - DNA, 20 bp, Homo sapiens
gtactttatatcttgtttac

SEQ ID NO: 4573745 - DNA, 22 bp, Homo sapiens
gtactttattgcaactctttta

SEQ ID NO: 4573746 - DNA, 21 bp, Homo sapiens
gtacttttcattctcttttaa

SEQ ID NO: 4573747 - DNA, 13 bp, Homo sapiens
gtagaaaaattat

SEQ ID NO: 4573748 - DNA, 15 bp, Homo sapiens
gtagaaacttaaaca

SEQ ID NO: 4573749 - DNA, 21 bp, Homo sapiens
gtagaaagacatctgcctgta

SEQ ID NO: 4573750 - DNA, 13 bp, Homo sapiens
gtagaaagctaaa

SEQ ID NO: 4573751 - DNA, 16 bp, Homo sapiens
gtagaaagtggaaagg

SEQ ID NO: 4573752 - DNA, 19 bp, Homo sapiens
gtagaataaatgaagaaag

SEQ ID NO: 4573753 - DNA, 15 bp, Homo sapiens
gtagaataggcaggg

SEQ ID NO: 4573754 - DNA, 17 bp, Homo sapiens
gtagaattatctaattt

SEQ ID NO: 4573755 - DNA, 18 bp, Homo sapiens
gtagactctaagatacac

SEQ ID NO: 4573756 - DNA, 17 bp, Homo sapiens
gtagactgtgccagagg

SEQ ID NO: 4573757 - DNA, 15 bp, Homo sapiens
gtagagacccccagg

SEQ ID NO: 4573758 - DNA, 16 bp, Homo sapiens
gtagagacccccaggc

SEQ ID NO: 4573759 - DNA, 15 bp, Homo sapiens
gtagagccagaggtc

SEQ ID NO: 4573760 - DNA, 15 bp, Homo sapiens
gtagaggagaaactg

SEQ ID NO: 4573761 - DNA, 19 bp, Homo sapiens
gtagagtgacctcggacag

SEQ ID NO: 4573762 - DNA, 16 bp, Homo sapiens
gtagatagtatgcact

SEQ ID NO: 4573763 - DNA, 17 bp, Homo sapiens
gtagatcagtggtctcc

SEQ ID NO: 4573764 - DNA, 15 bp, Homo sapiens
gtagatgacaaatat

SEQ ID NO: 4573765 - DNA, 17 bp, Homo sapiens
gtagatgagccgggtcc

SEQ ID NO: 4573766 - DNA, 14 bp, Homo sapiens
gtagattcaggtaa

SEQ ID NO: 4573767 - DNA, 15 bp, Homo sapiens
gtagattgattgtat

SEQ ID NO: 4573768 - DNA, 23 bp, Homo sapiens
gtagattgcagaaaattctgtgc

SEQ ID NO: 4573769 - DNA, 16 bp, Homo sapiens
gtagattttacagaga

SEQ ID NO: 4573770 - DNA, 17 bp, Homo sapiens
gtagcaaatgtttactg

SEQ ID NO: 4573771 - DNA, 18 bp, Homo sapiens
gtagcaaatgtttactgt

SEQ ID NO: 4573772 - DNA, 15 bp, Homo sapiens
gtagcaatggccaga

SEQ ID NO: 4573773 - DNA, 18 bp, Homo sapiens
gtagcaatggccagagcc

SEQ ID NO: 4573774 - DNA, 21 bp, Homo sapiens
gtagcaatggccagagcctct

SEQ ID NO: 4573775 - DNA, 23 bp, Homo sapiens
gtagcacagattttgaatctgtg

SEQ ID NO: 4573776 - DNA, 14 bp, Homo sapiens
gtagcatataaatg

SEQ ID NO: 4573777 - DNA, 21 bp, Homo sapiens
gtagcattcatgtaataaaca

SEQ ID NO: 4573778 - DNA, 17 bp, Homo sapiens
gtagccatcaagcactt

SEQ ID NO: 4573779 - DNA, 15 bp, Homo sapiens
gtagccccctcatct

SEQ ID NO: 4573780 - DNA, 15 bp, Homo sapiens
gtagcccgcctgcca

SEQ ID NO: 4573781 - DNA, 17 bp, Homo sapiens
gtagcccgcctgccagt

SEQ ID NO: 4573782 - DNA, 20 bp, Homo sapiens
gtagcccgcctgccagtcct

SEQ ID NO: 4573783 - DNA, 20 bp, Homo sapiens
gtagcctcctcctgggctcc

SEQ ID NO: 4573784 - DNA, 22 bp, Homo sapiens
gtagcgttttttaaatgtatac

SEQ ID NO: 4573785 - DNA, 21 bp, Homo sapiens
gtagctagtagcaatgtgcct

SEQ ID NO: 4573786 - DNA, 14 bp, Homo sapiens
gtagctcccctggc

SEQ ID NO: 4573787 - DNA, 14 bp, Homo sapiens
gtagctcggcacca

SEQ ID NO: 4573788 - DNA, 14 bp, Homo sapiens
gtagctgaaatgca

SEQ ID NO: 4573789 - DNA, 16 bp, Homo sapiens
gtagctgcaaaaataa

SEQ ID NO: 4573790 - DNA, 17 bp, Homo sapiens
gtagctgggatgacagg

SEQ ID NO: 4573791 - DNA, 15 bp, Homo sapiens
gtagcttatctgccc

SEQ ID NO: 4573792 - DNA, 14 bp, Homo sapiens
gtagctttcctggt

SEQ ID NO: 4573793 - DNA, 21 bp, Homo sapiens
gtagctttttattattttaag

SEQ ID NO: 4573794 - DNA, 21 bp, Homo sapiens
gtaggaatgtacatgaagcaa

SEQ ID NO: 4573795 - DNA, 15 bp, Homo sapiens
gtaggactgtagaaa

SEQ ID NO: 4573796 - DNA, 18 bp, Homo sapiens
gtaggagcccagctctga

SEQ ID NO: 4573797 - DNA, 21 bp, Homo sapiens
gtaggatgacaggctctcctg

SEQ ID NO: 4573798 - DNA, 23 bp, Homo sapiens
gtaggcatcagtatgtcactctg

SEQ ID NO: 4573799 - DNA, 16 bp, Homo sapiens
gtaggctgcaaaatta

SEQ ID NO: 4573800 - DNA, 21 bp, Homo sapiens
gtagggaagaaaactatcctg

SEQ ID NO: 4573801 - DNA, 22 bp, Homo sapiens
gtaggggcttataataaaggac

SEQ ID NO: 4573802 - DNA, 23 bp, Homo sapiens
gtaggggttaacttggtcagagc

SEQ ID NO: 4573803 - DNA, 17 bp, Homo sapiens
gtagggtaaggtgcctt

SEQ ID NO: 4573804 - DNA, 23 bp, Homo sapiens
gtaggtatgatctcttctggtgt

SEQ ID NO: 4573805 - DNA, 23 bp, Homo sapiens
gtaggtggaagctagacacatga

SEQ ID NO: 4573806 - DNA, 20 bp, Homo sapiens
gtaggtgtctgccttcacaa

SEQ ID NO: 4573807 - DNA, 14 bp, Homo sapiens
gtaggttgggagaa

SEQ ID NO: 4573808 - DNA, 18 bp, Homo sapiens
gtagtaaactattcttaa

SEQ ID NO: 4573809 - DNA, 14 bp, Homo sapiens
gtagtaacactaat

SEQ ID NO: 4573810 - DNA, 14 bp, Homo sapiens
gtagtaatttattg

SEQ ID NO: 4573811 - DNA, 15 bp, Homo sapiens
gtagtaccaaaataa

SEQ ID NO: 4573812 - DNA, 19 bp, Homo sapiens
gtagtacttcttctgtaat

SEQ ID NO: 4573813 - DNA, 21 bp, Homo sapiens
gtagtacttcttctgtaatat

SEQ ID NO: 4573814 - DNA, 22 bp, Homo sapiens
gtagtagcgttttttaaatgta

SEQ ID NO: 4573815 - DNA, 23 bp, Homo sapiens
gtagtatggcctgacagctctgt

SEQ ID NO: 4573816 - DNA, 20 bp, Homo sapiens
gtagtattttttgtataatt

SEQ ID NO: 4573817 - DNA, 23 bp, Homo sapiens
gtagtattttttgtataattgga

SEQ ID NO: 4573818 - DNA, 16 bp, Homo sapiens
gtagtcacaaactgat

SEQ ID NO: 4573819 - DNA, 13 bp, Homo sapiens
gtagtccaccttc

SEQ ID NO: 4573820 - DNA, 13 bp, Homo sapiens
gtagtctcagcta

SEQ ID NO: 4573821 - DNA, 16 bp, Homo sapiens
gtagtcttgatgacca

SEQ ID NO: 4573822 - DNA, 16 bp, Homo sapiens
gtagtgattaaatata

SEQ ID NO: 4573823 - DNA, 11 bp, Homo sapiens
gtagtggccac

SEQ ID NO: 4573824 - DNA, 19 bp, Homo sapiens
gtagtgtctggatcagtaa

SEQ ID NO: 4573825 - DNA, 13 bp, Homo sapiens
gtagttaatataa

SEQ ID NO: 4573826 - DNA, 19 bp, Homo sapiens
gtagttaatataaatgttg

SEQ ID NO: 4573827 - DNA, 23 bp, Homo sapiens
gtagttccctgaaaacccagaga

SEQ ID NO: 4573828 - DNA, 20 bp, Homo sapiens
gtagttgttggtctgtagca

SEQ ID NO: 4573829 - DNA, 20 bp, Homo sapiens
gtagttttccctgcactgtg

SEQ ID NO: 4573830 - DNA, 19 bp, Homo sapiens
gtataaactgtattttgaa

SEQ ID NO: 4573831 - DNA, 13 bp, Homo sapiens
gtataaatgtaca

SEQ ID NO: 4573832 - DNA, 22 bp, Homo sapiens
gtataacagccttttccttctg

SEQ ID NO: 4573833 - DNA, 18 bp, Homo sapiens
gtataagttgctgtaaaa

SEQ ID NO: 4573834 - DNA, 13 bp, Homo sapiens
gtataatagagat

SEQ ID NO: 4573835 - DNA, 14 bp, Homo sapiens
gtataatcacagtt

SEQ ID NO: 4573836 - DNA, 19 bp, Homo sapiens
gtataatctcctctgctca

SEQ ID NO: 4573837 - DNA, 21 bp, Homo sapiens
gtataatctcctctgctcatt

SEQ ID NO: 4573838 - DNA, 16 bp, Homo sapiens
gtataatgacttttaa

SEQ ID NO: 4573839 - DNA, 20 bp, Homo sapiens
gtataatgacttttaaaatt

SEQ ID NO: 4573840 - DNA, 13 bp, Homo sapiens
gtataatgtttat

SEQ ID NO: 4573841 - DNA, 18 bp, Homo sapiens
gtataatgtttattaaat

SEQ ID NO: 4573842 - DNA, 14 bp, Homo sapiens
gtataccaatgtgt

SEQ ID NO: 4573843 - DNA, 15 bp, Homo sapiens
gtatacctgattttt

SEQ ID NO: 4573844 - DNA, 16 bp, Homo sapiens
gtatactcctgtcacc

SEQ ID NO: 4573845 - DNA, 12 bp, Homo sapiens
gtatactttaaa

SEQ ID NO: 4573846 - DNA, 23 bp, Homo sapiens
gtatactttaaataatttaacta

SEQ ID NO: 4573847 - DNA, 14 bp, Homo sapiens
gtatagaaatgctg

SEQ ID NO: 4573848 - DNA, 19 bp, Homo sapiens
gtataggaatttgtatttt

SEQ ID NO: 4573849 - DNA, 22 bp, Homo sapiens
gtatagtgttcacaaactgtga

SEQ ID NO: 4573850 - DNA, 19 bp, Homo sapiens
gtatataatttactttgta

SEQ ID NO: 4573851 - DNA, 23 bp, Homo sapiens
gtatatacacccaagatgggcat

SEQ ID NO: 4573852 - DNA, 13 bp, Homo sapiens
gtatatacttttt

SEQ ID NO: 4573853 - DNA, 21 bp, Homo sapiens
gtatatatctattattcaaaa

SEQ ID NO: 4573854 - DNA, 21 bp, Homo sapiens
gtatatatcttataactgttt

SEQ ID NO: 4573855 - DNA, 20 bp, Homo sapiens
gtatatatggatcagaggag

SEQ ID NO: 4573856 - DNA, 19 bp, Homo sapiens
gtatatctaagactcatcc

SEQ ID NO: 4573857 - DNA, 20 bp, Homo sapiens
gtatatctcttggaaaataa

SEQ ID NO: 4573858 - DNA, 17 bp, Homo sapiens
gtatatgcacaaaacta

SEQ ID NO: 4573859 - DNA, 23 bp, Homo sapiens
gtatattaagaagcaataactat

SEQ ID NO: 4573860 - DNA, 18 bp, Homo sapiens
gtatattacaatgatcac

SEQ ID NO: 4573861 - DNA, 13 bp, Homo sapiens
gtatattgctaag

SEQ ID NO: 4573862 - DNA, 12 bp, Homo sapiens
gtatattggaag

SEQ ID NO: 4573863 - DNA, 13 bp, Homo sapiens
gtatattgtgttt

SEQ ID NO: 4573864 - DNA, 18 bp, Homo sapiens
gtatatttgtatgatatt

SEQ ID NO: 4573865 - DNA, 16 bp, Homo sapiens
gtatattttatatcaa

SEQ ID NO: 4573866 - DNA, 20 bp, Homo sapiens
gtatattttatttcaatgta

SEQ ID NO: 4573867 - DNA, 14 bp, Homo sapiens
gtatattttctgta

SEQ ID NO: 4573868 - DNA, 15 bp, Homo sapiens
gtatattttctgtat

SEQ ID NO: 4573869 - DNA, 17 bp, Homo sapiens
gtatattttctgtattt

SEQ ID NO: 4573870 - DNA, 14 bp, Homo sapiens
gtatcaataaaatt

SEQ ID NO: 4573871 - DNA, 19 bp, Homo sapiens
gtatcaataaaattctgta

SEQ ID NO: 4573872 - DNA, 22 bp, Homo sapiens
gtatcaataaaattctgtaatt

SEQ ID NO: 4573873 - DNA, 12 bp, Homo sapiens
gtatcagcacta

SEQ ID NO: 4573874 - DNA, 14 bp, Homo sapiens
gtatcaggacccag

SEQ ID NO: 4573875 - DNA, 17 bp, Homo sapiens
gtatcagtgtcctttcc

SEQ ID NO: 4573876 - DNA, 14 bp, Homo sapiens
gtatcagtgtttat

SEQ ID NO: 4573877 - DNA, 18 bp, Homo sapiens
gtatcatatattaaaaca

SEQ ID NO: 4573878 - DNA, 19 bp, Homo sapiens
gtatcatatattaaaacaa

SEQ ID NO: 4573879 - DNA, 13 bp, Homo sapiens
gtatcatcagtgt

SEQ ID NO: 4573880 - DNA, 14 bp, Homo sapiens
gtatcatctggata

SEQ ID NO: 4573881 - DNA, 16 bp, Homo sapiens
gtatcattcaactctc

SEQ ID NO: 4573882 - DNA, 19 bp, Homo sapiens
gtatccacacaaattcagt

SEQ ID NO: 4573883 - DNA, 20 bp, Homo sapiens
gtatccaggttccctcccag

SEQ ID NO: 4573884 - DNA, 22 bp, Homo sapiens
gtatcctaaactttagacttcc

SEQ ID NO: 4573885 - DNA, 16 bp, Homo sapiens
gtatcgtaaccagcca

SEQ ID NO: 4573886 - DNA, 18 bp, Homo sapiens
gtatctaagaataataaa

SEQ ID NO: 4573887 - DNA, 14 bp, Homo sapiens
gtatctatttgtac

SEQ ID NO: 4573888 - DNA, 15 bp, Homo sapiens
gtatctctggcacca

SEQ ID NO: 4573889 - DNA, 13 bp, Homo sapiens
gtatctgccctcc

SEQ ID NO: 4573890 - DNA, 18 bp, Homo sapiens
gtatctgggtaagaagaa

SEQ ID NO: 4573891 - DNA, 18 bp, Homo sapiens
gtatctgtgcttctaata

SEQ ID NO: 4573892 - DNA, 18 bp, Homo sapiens
gtatcttacctagtgttt

SEQ ID NO: 4573893 - DNA, 16 bp, Homo sapiens
gtatcttgtgcttctt

SEQ ID NO: 4573894 - DNA, 21 bp, Homo sapiens
gtatctttggttatcctgttt

SEQ ID NO: 4573895 - DNA, 21 bp, Homo sapiens
gtatcttttatcctgggagca

SEQ ID NO: 4573896 - DNA, 23 bp, Homo sapiens
gtatcttttttaaactgtaaagt

SEQ ID NO: 4573897 - DNA, 11 bp, Homo sapiens
gtatgaaatat

SEQ ID NO: 4573898 - DNA, 19 bp, Homo sapiens
gtatgaataatgaaaataa

SEQ ID NO: 4573899 - DNA, 12 bp, Homo sapiens
gtatgaatttga

SEQ ID NO: 4573900 - DNA, 15 bp, Homo sapiens
gtatgcagtgtagat

SEQ ID NO: 4573901 - DNA, 16 bp, Homo sapiens
gtatgcattattaaat

SEQ ID NO: 4573902 - DNA, 17 bp, Homo sapiens
gtatgcattattaaatt

SEQ ID NO: 4573903 - DNA, 16 bp, Homo sapiens
gtatgcatttttttag

SEQ ID NO: 4573904 - DNA, 20 bp, Homo sapiens
gtatgccaccaacttacaaa

SEQ ID NO: 4573905 - DNA, 22 bp, Homo sapiens
gtatgcctttaaatctgtgatg

SEQ ID NO: 4573906 - DNA, 14 bp, Homo sapiens
gtatgctggccagc

SEQ ID NO: 4573907 - DNA, 14 bp, Homo sapiens
gtatggtaatcttt

SEQ ID NO: 4573908 - DNA, 23 bp, Homo sapiens
gtatgtatataatcatgctcatg

SEQ ID NO: 4573909 - DNA, 23 bp, Homo sapiens
gtatgtccacgtactagaaaaat

SEQ ID NO: 4573910 - DNA, 17 bp, Homo sapiens
gtatgtggaagtgtggg

SEQ ID NO: 4573911 - DNA, 17 bp, Homo sapiens
gtatgttgaggatctat

SEQ ID NO: 4573912 - DNA, 14 bp, Homo sapiens
gtatgtttttactg

SEQ ID NO: 4573913 - DNA, 23 bp, Homo sapiens
gtatgtttttactgaatgatcta

SEQ ID NO: 4573914 - DNA, 15 bp, Homo sapiens
gtatgttttttatgt

SEQ ID NO: 4573915 - DNA, 17 bp, Homo sapiens
gtattaaaggttaaatt

SEQ ID NO: 4573916 - DNA, 14 bp, Homo sapiens
gtattaaatggttt

SEQ ID NO: 4573917 - DNA, 14 bp, Homo sapiens
gtattaagaaagga

SEQ ID NO: 4573918 - DNA, 19 bp, Homo sapiens
gtattaagcccacagtata

SEQ ID NO: 4573919 - DNA, 18 bp, Homo sapiens
gtattaattttgatataa

SEQ ID NO: 4573920 - DNA, 20 bp, Homo sapiens
gtattaccaccctttcacaa

SEQ ID NO: 4573921 - DNA, 14 bp, Homo sapiens
gtattaccattact

SEQ ID NO: 4573922 - DNA, 13 bp, Homo sapiens
gtattattacaaa

SEQ ID NO: 4573923 - DNA, 20 bp, Homo sapiens
gtattatttctccatcccct

SEQ ID NO: 4573924 - DNA, 18 bp, Homo sapiens
gtattattttttaataaa

SEQ ID NO: 4573925 - DNA, 14 bp, Homo sapiens
gtattcaggcactg

SEQ ID NO: 4573926 - DNA, 15 bp, Homo sapiens
gtattcaggcactga

SEQ ID NO: 4573927 - DNA, 15 bp, Homo sapiens
gtattccaccttaaa

SEQ ID NO: 4573928 - DNA, 22 bp, Homo sapiens
gtattccaccttaaattaaaca

SEQ ID NO: 4573929 - DNA, 17 bp, Homo sapiens
gtattcctttaaaatat

SEQ ID NO: 4573930 - DNA, 13 bp, Homo sapiens
gtattctctgagc

SEQ ID NO: 4573931 - DNA, 17 bp, Homo sapiens
gtattctctgcaatttt

SEQ ID NO: 4573932 - DNA, 19 bp, Homo sapiens
gtattcttaaaatgcaata

SEQ ID NO: 4573933 - DNA, 20 bp, Homo sapiens
gtattcttaaaatgcaatat

SEQ ID NO: 4573934 - DNA, 15 bp, Homo sapiens
gtattcttgtttgaa

SEQ ID NO: 4573935 - DNA, 11 bp, Homo sapiens
gtattcttttt

SEQ ID NO: 4573936 - DNA, 14 bp, Homo sapiens
gtattgccccctct

SEQ ID NO: 4573937 - DNA, 14 bp, Homo sapiens
gtattgctgtgtct

SEQ ID NO: 4573938 - DNA, 14 bp, Homo sapiens
gtattgtaaatgtg

SEQ ID NO: 4573939 - DNA, 13 bp, Homo sapiens
gtattgtaaatta

SEQ ID NO: 4573940 - DNA, 20 bp, Homo sapiens
gtattgtaaattatatttgt

SEQ ID NO: 4573941 - DNA, 22 bp, Homo sapiens
gtattgtcagccatcgtcctgg

SEQ ID NO: 4573942 - DNA, 23 bp, Homo sapiens
gtattgtgttttgctttggaaac

SEQ ID NO: 4573943 - DNA, 16 bp, Homo sapiens
gtattgttagatgttt

SEQ ID NO: 4573944 - DNA, 16 bp, Homo sapiens
gtattgttgaaaaagt

SEQ ID NO: 4573945 - DNA, 15 bp, Homo sapiens
gtattgtttctacaa

SEQ ID NO: 4573946 - DNA, 17 bp, Homo sapiens
gtatttaaaaacatttt

SEQ ID NO: 4573947 - DNA, 20 bp, Homo sapiens
gtatttaacagaaattgtat

SEQ ID NO: 4573948 - DNA, 21 bp, Homo sapiens
gtatttaacagaaattgtata

SEQ ID NO: 4573949 - DNA, 22 bp, Homo sapiens
gtatttaactacatctgcctcg

SEQ ID NO: 4573950 - DNA, 21 bp, Homo sapiens
gtatttaagatgtacatttaa

SEQ ID NO: 4573951 - DNA, 22 bp, Homo sapiens
gtatttaagatgtacatttaat

SEQ ID NO: 4573952 - DNA, 14 bp, Homo sapiens
gtatttaagcttta

SEQ ID NO: 4573953 - DNA, 13 bp, Homo sapiens
gtatttaatcgca

SEQ ID NO: 4573954 - DNA, 18 bp, Homo sapiens
gtatttaattgtaaactg

SEQ ID NO: 4573955 - DNA, 19 bp, Homo sapiens
gtatttacgctttgattca

SEQ ID NO: 4573956 - DNA, 21 bp, Homo sapiens
gtatttactttttaaaaataa

SEQ ID NO: 4573957 - DNA, 17 bp, Homo sapiens
gtatttatttaaaactc

SEQ ID NO: 4573958 - DNA, 13 bp, Homo sapiens
gtatttcaaatat

SEQ ID NO: 4573959 - DNA, 19 bp, Homo sapiens
gtatttcaaatatctaagc

SEQ ID NO: 4573960 - DNA, 19 bp, Homo sapiens
gtatttcagtattttccag

SEQ ID NO: 4573961 - DNA, 17 bp, Homo sapiens
gtatttctcctttgcaa

SEQ ID NO: 4573962 - DNA, 15 bp, Homo sapiens
gtatttcttaagaat

SEQ ID NO: 4573963 - DNA, 18 bp, Homo sapiens
gtatttcttaagaattca

SEQ ID NO: 4573964 - DNA, 14 bp, Homo sapiens
gtatttgatgtaca

SEQ ID NO: 4573965 - DNA, 17 bp, Homo sapiens
gtatttgatgtacatta

SEQ ID NO: 4573966 - DNA, 20 bp, Homo sapiens
gtatttggaaataaagtcag

SEQ ID NO: 4573967 - DNA, 20 bp, Homo sapiens
gtatttgggaagtgaagact

SEQ ID NO: 4573968 - DNA, 22 bp, Homo sapiens
gtatttgtattctctgcaattt

SEQ ID NO: 4573969 - DNA, 17 bp, Homo sapiens
gtatttgttaatttaga

SEQ ID NO: 4573970 - DNA, 23 bp, Homo sapiens
gtatttgttaatttagaaaactt

SEQ ID NO: 4573971 - DNA, 13 bp, Homo sapiens
gtattttaaaata

SEQ ID NO: 4573972 - DNA, 22 bp, Homo sapiens
gtattttaagatccagaaatac

SEQ ID NO: 4573973 - DNA, 20 bp, Homo sapiens
gtattttaagtgatgtcatt

SEQ ID NO: 4573974 - DNA, 12 bp, Homo sapiens
gtattttatctg

SEQ ID NO: 4573975 - DNA, 22 bp, Homo sapiens
gtattttgatataattgtactg

SEQ ID NO: 4573976 - DNA, 13 bp, Homo sapiens
gtatttttaaagg

SEQ ID NO: 4573977 - DNA, 17 bp, Homo sapiens
gtatttttgctgcttct

SEQ ID NO: 4573978 - DNA, 17 bp, Homo sapiens
gtatttttttaaatcaa

SEQ ID NO: 4573979 - DNA, 23 bp, Homo sapiens
gtattttttttttaaataaaagc

SEQ ID NO: 4573980 - DNA, 19 bp, Homo sapiens
gtcaaaaagaaccacttgt

SEQ ID NO: 4573981 - DNA, 16 bp, Homo sapiens
gtcaaaaggtgcctgt

SEQ ID NO: 4573982 - DNA, 23 bp, Homo sapiens
gtcaaacattcgtgagctgggga

SEQ ID NO: 4573983 - DNA, 23 bp, Homo sapiens
gtcaaactccctagtctccacct

SEQ ID NO: 4573984 - DNA, 13 bp, Homo sapiens
gtcaaacttggat

SEQ ID NO: 4573985 - DNA, 12 bp, Homo sapiens
gtcaaagaagct

SEQ ID NO: 4573986 - DNA, 15 bp, Homo sapiens
gtcaaagaagcttcc

SEQ ID NO: 4573987 - DNA, 22 bp, Homo sapiens
gtcaaagaagcttccacaaaat

SEQ ID NO: 4573988 - DNA, 22 bp, Homo sapiens
gtcaaagctttgactctataag

SEQ ID NO: 4573989 - DNA, 12 bp, Homo sapiens
gtcaaataaaca

SEQ ID NO: 4573990 - DNA, 13 bp, Homo sapiens
gtcaaataaacac

SEQ ID NO: 4573991 - DNA, 22 bp, Homo sapiens
gtcaaatgcatacaagtttcat

SEQ ID NO: 4573992 - DNA, 22 bp, Homo sapiens
gtcaacagagaaggcaggaatg

SEQ ID NO: 4573993 - DNA, 19 bp, Homo sapiens
gtcaacggggggctcctgc

SEQ ID NO: 4573994 - DNA, 19 bp, Homo sapiens
gtcaactggctggccagtc

SEQ ID NO: 4573995 - DNA, 22 bp, Homo sapiens
gtcaagattttttttgtaactt

SEQ ID NO: 4573996 - DNA, 15 bp, Homo sapiens
gtcaagtaataaaaa

SEQ ID NO: 4573997 - DNA, 18 bp, Homo sapiens
gtcaagtgttaggtcaat

SEQ ID NO: 4573998 - DNA, 18 bp, Homo sapiens
gtcaattcataaaaacaa

SEQ ID NO: 4573999 - DNA, 14 bp, Homo sapiens
gtcacaaactgatc

SEQ ID NO: 4574000 - DNA, 19 bp, Homo sapiens
gtcacacagtgttggaggt

SEQ ID NO: 4574001 - DNA, 13 bp, Homo sapiens
gtcacaccagcca

SEQ ID NO: 4574002 - DNA, 12 bp, Homo sapiens
gtcacagaggca

SEQ ID NO: 4574003 - DNA, 13 bp, Homo sapiens
gtcacagaggcat

SEQ ID NO: 4574004 - DNA, 23 bp, Homo sapiens
gtcacagcctcctctgtctgccc

SEQ ID NO: 4574005 - DNA, 22 bp, Homo sapiens
gtcacagtaaaaataaaatact

SEQ ID NO: 4574006 - DNA, 21 bp, Homo sapiens
gtcacagtctctactgttatt

SEQ ID NO: 4574007 - DNA, 19 bp, Homo sapiens
gtcacatcacaatattcag

SEQ ID NO: 4574008 - DNA, 22 bp, Homo sapiens
gtcacattgccatcactcttgt

SEQ ID NO: 4574009 - DNA, 17 bp, Homo sapiens
gtcaccaagctcacagt

SEQ ID NO: 4574010 - DNA, 17 bp, Homo sapiens
gtcaccaccttcccagc

SEQ ID NO: 4574011 - DNA, 19 bp, Homo sapiens
gtcaccaccttcccagctc

SEQ ID NO: 4574012 - DNA, 21 bp, Homo sapiens
gtcaccacgactggccagggc

SEQ ID NO: 4574013 - DNA, 13 bp, Homo sapiens
gtcaccagagact

SEQ ID NO: 4574014 - DNA, 23 bp, Homo sapiens
gtcaccagctatctgtcatctct

SEQ ID NO: 4574015 - DNA, 19 bp, Homo sapiens
gtcaccaggctggagtgca

SEQ ID NO: 4574016 - DNA, 20 bp, Homo sapiens
gtcacccaggctggagtgcg

SEQ ID NO: 4574017 - DNA, 20 bp, Homo sapiens
gtcacccccaccccacccct

SEQ ID NO: 4574018 - DNA, 17 bp, Homo sapiens
gtcaccgagactcagcc

SEQ ID NO: 4574019 - DNA, 19 bp, Homo sapiens
gtcaccgagactcagcctc

SEQ ID NO: 4574020 - DNA, 20 bp, Homo sapiens
gtcaccgagactcagcctct

SEQ ID NO: 4574021 - DNA, 21 bp, Homo sapiens
gtcaccgagactcagcctctg

SEQ ID NO: 4574022 - DNA, 22 bp, Homo sapiens
gtcaccgagactcagcctctgc

SEQ ID NO: 4574023 - DNA, 16 bp, Homo sapiens
gtcaccggtcagtgcc

SEQ ID NO: 4574024 - DNA, 18 bp, Homo sapiens
gtcaccggtcagtgcctt

SEQ ID NO: 4574025 - DNA, 14 bp, Homo sapiens
gtcacctctcagct

SEQ ID NO: 4574026 - DNA, 13 bp, Homo sapiens
gtcacctcttcta

SEQ ID NO: 4574027 - DNA, 20 bp, Homo sapiens
gtcacctgccgccctgtggg

SEQ ID NO: 4574028 - DNA, 22 bp, Homo sapiens
gtcaccttttctgtggctggct

SEQ ID NO: 4574029 - DNA, 12 bp, Homo sapiens
gtcactactgca

SEQ ID NO: 4574030 - DNA, 20 bp, Homo sapiens
gtcactcacattgagagtaa

SEQ ID NO: 4574031 - DNA, 12 bp, Homo sapiens
gtcactggaaag

SEQ ID NO: 4574032 - DNA, 18 bp, Homo sapiens
gtcactggaaaggggaga

SEQ ID NO: 4574033 - DNA, 23 bp, Homo sapiens
gtcactggaaaggggagagcctg

SEQ ID NO: 4574034 - DNA, 20 bp, Homo sapiens
gtcactggcccaaccagaac

SEQ ID NO: 4574035 - DNA, 21 bp, Homo sapiens
gtcactggcctctccccagga

SEQ ID NO: 4574036 - DNA, 17 bp, Homo sapiens
gtcacttcatttttatt

SEQ ID NO: 4574037 - DNA, 12 bp, Homo sapiens
gtcacttctgct

SEQ ID NO: 4574038 - DNA, 11 bp, Homo sapiens
gtcacttgcca

SEQ ID NO: 4574039 - DNA, 17 bp, Homo sapiens
gtcacttttttctgcct

SEQ ID NO: 4574040 - DNA, 18 bp, Homo sapiens
gtcacttttttctgcctt

SEQ ID NO: 4574041 - DNA, 19 bp, Homo sapiens
gtcactttttttctttttc

SEQ ID NO: 4574042 - DNA, 19 bp, Homo sapiens
gtcagaagtctagttttat

SEQ ID NO: 4574043 - DNA, 13 bp, Homo sapiens
gtcagaatcagaa

SEQ ID NO: 4574044 - DNA, 23 bp, Homo sapiens
gtcagactttgtgttcatttcat

SEQ ID NO: 4574045 - DNA, 20 bp, Homo sapiens
gtcagagaaaatgagaaagg

SEQ ID NO: 4574046 - DNA, 16 bp, Homo sapiens
gtcagagcccagccca

SEQ ID NO: 4574047 - DNA, 15 bp, Homo sapiens
gtcagaggacctgta

SEQ ID NO: 4574048 - DNA, 16 bp, Homo sapiens
gtcagatgcgtgccca

SEQ ID NO: 4574049 - DNA, 12 bp, Homo sapiens
gtcagatgtttg

SEQ ID NO: 4574050 - DNA, 12 bp, Homo sapiens
gtcagattaaat

SEQ ID NO: 4574051 - DNA, 14 bp, Homo sapiens
gtcagattcctttc

SEQ ID NO: 4574052 - DNA, 22 bp, Homo sapiens
gtcagcagcagctctgagccag

SEQ ID NO: 4574053 - DNA, 11 bp, Homo sapiens
gtcagccaagt

SEQ ID NO: 4574054 - DNA, 21 bp, Homo sapiens
gtcagctcccctcggagaaga

SEQ ID NO: 4574055 - DNA, 19 bp, Homo sapiens
gtcagcttttgttgtttat

SEQ ID NO: 4574056 - DNA, 22 bp, Homo sapiens
gtcaggagttcaagaccagcct

SEQ ID NO: 4574057 - DNA, 19 bp, Homo sapiens
gtcaggagttttactgcct

SEQ ID NO: 4574058 - DNA, 15 bp, Homo sapiens
gtcaggcctggcctc

SEQ ID NO: 4574059 - DNA, 16 bp, Homo sapiens
gtcaggcctggcctca

SEQ ID NO: 4574060 - DNA, 13 bp, Homo sapiens
gtcaggctgctgg

SEQ ID NO: 4574061 - DNA, 16 bp, Homo sapiens
gtcaggctgctggcgc

SEQ ID NO: 4574062 - DNA, 19 bp, Homo sapiens
gtcagggacctgctgctca

SEQ ID NO: 4574063 - DNA, 14 bp, Homo sapiens
gtcaggggcttgga

SEQ ID NO: 4574064 - DNA, 15 bp, Homo sapiens
gtcaggtagggggga

SEQ ID NO: 4574065 - DNA, 18 bp, Homo sapiens
gtcaggtaggggggaaac

SEQ ID NO: 4574066 - DNA, 15 bp, Homo sapiens
gtcaggtgggaaagc

SEQ ID NO: 4574067 - DNA, 22 bp, Homo sapiens
gtcagtaccttcaaactagggc

SEQ ID NO: 4574068 - DNA, 14 bp, Homo sapiens
gtcagtatccaggc

SEQ ID NO: 4574069 - DNA, 14 bp, Homo sapiens
gtcagtatgacatt

SEQ ID NO: 4574070 - DNA, 14 bp, Homo sapiens
gtcagtggccaggt

SEQ ID NO: 4574071 - DNA, 21 bp, Homo sapiens
gtcagttgtaataaatctagg

SEQ ID NO: 4574072 - DNA, 16 bp, Homo sapiens
gtcagttgttatttat

SEQ ID NO: 4574073 - DNA, 17 bp, Homo sapiens
gtcagttgttatttatt

SEQ ID NO: 4574074 - DNA, 16 bp, Homo sapiens
gtcataaatttgaata

SEQ ID NO: 4574075 - DNA, 22 bp, Homo sapiens
gtcataacggttaagaaagcac

SEQ ID NO: 4574076 - DNA, 15 bp, Homo sapiens
gtcataccaatgaaa

SEQ ID NO: 4574077 - DNA, 20 bp, Homo sapiens
gtcatactgtgcaggcctgt

SEQ ID NO: 4574078 - DNA, 17 bp, Homo sapiens
gtcatagtcttgaaatg

SEQ ID NO: 4574079 - DNA, 21 bp, Homo sapiens
gtcatagtcttgaaatgaaag

SEQ ID NO: 4574080 - DNA, 22 bp, Homo sapiens
gtcatagtcttgaaatgaaagg

SEQ ID NO: 4574081 - DNA, 20 bp, Homo sapiens
gtcatcaaaacctgcgcagt

SEQ ID NO: 4574082 - DNA, 23 bp, Homo sapiens
gtcatcaatagtgtcctatgcaa

SEQ ID NO: 4574083 - DNA, 16 bp, Homo sapiens
gtcatcagatatgctt

SEQ ID NO: 4574084 - DNA, 21 bp, Homo sapiens
gtcatcaggtgtgctcagggg

SEQ ID NO: 4574085 - DNA, 16 bp, Homo sapiens
gtcatcagtcatcagg

SEQ ID NO: 4574086 - DNA, 17 bp, Homo sapiens
gtcatctcattccactg

SEQ ID NO: 4574087 - DNA, 14 bp, Homo sapiens
gtcatcttgctacc

SEQ ID NO: 4574088 - DNA, 14 bp, Homo sapiens
gtcatctttttcta

SEQ ID NO: 4574089 - DNA, 20 bp, Homo sapiens
gtcatctttttctagagtta

SEQ ID NO: 4574090 - DNA, 19 bp, Homo sapiens
gtcatgacaagatgggaca

SEQ ID NO: 4574091 - DNA, 14 bp, Homo sapiens
gtcatgatctccct

SEQ ID NO: 4574092 - DNA, 15 bp, Homo sapiens
gtcatgatctccctg

SEQ ID NO: 4574093 - DNA, 17 bp, Homo sapiens
gtcatgatctccctgcc

SEQ ID NO: 4574094 - DNA, 19 bp, Homo sapiens
gtcatgatctccctgccgc

SEQ ID NO: 4574095 - DNA, 19 bp, Homo sapiens
gtcatgatgaatcagtcct

SEQ ID NO: 4574096 - DNA, 14 bp, Homo sapiens
gtcatggcctgaga

SEQ ID NO: 4574097 - DNA, 16 bp, Homo sapiens
gtcatggcctgagatg

SEQ ID NO: 4574098 - DNA, 23 bp, Homo sapiens
gtcatgggccactgcttttccct

SEQ ID NO: 4574099 - DNA, 21 bp, Homo sapiens
gtcatggtcctttctggaagt

SEQ ID NO: 4574100 - DNA, 16 bp, Homo sapiens
gtcatgtgttcccttt

SEQ ID NO: 4574101 - DNA, 18 bp, Homo sapiens
gtcatgtgttccctttgt

SEQ ID NO: 4574102 - DNA, 23 bp, Homo sapiens
gtcatgtgttccctttgtctttc

SEQ ID NO: 4574103 - DNA, 21 bp, Homo sapiens
gtcattaaaacagaagcaaat

SEQ ID NO: 4574104 - DNA, 16 bp, Homo sapiens
gtcattatattctaat

SEQ ID NO: 4574105 - DNA, 17 bp, Homo sapiens
gtcattatgttaatatt

SEQ ID NO: 4574106 - DNA, 19 bp, Homo sapiens
gtcattatgttaatatttc

SEQ ID NO: 4574107 - DNA, 15 bp, Homo sapiens
gtcattgacttcatt

SEQ ID NO: 4574108 - DNA, 13 bp, Homo sapiens
gtcattgtctact

SEQ ID NO: 4574109 - DNA, 11 bp, Homo sapiens
gtcatttaaaa

SEQ ID NO: 4574110 - DNA, 18 bp, Homo sapiens
gtcattttattttgtaat

SEQ ID NO: 4574111 - DNA, 13 bp, Homo sapiens
gtcattttgggtt

SEQ ID NO: 4574112 - DNA, 17 bp, Homo sapiens
gtccaaaagcgccctca

SEQ ID NO: 4574113 - DNA, 20 bp, Homo sapiens
gtccaaaagcgccctcacta

SEQ ID NO: 4574114 - DNA, 19 bp, Homo sapiens
gtccaaagaggctgcccct

SEQ ID NO: 4574115 - DNA, 17 bp, Homo sapiens
gtccaacctaacccctt

SEQ ID NO: 4574116 - DNA, 19 bp, Homo sapiens
gtccaaggacaccctccct

SEQ ID NO: 4574117 - DNA, 13 bp, Homo sapiens
gtccaaggccagt

SEQ ID NO: 4574118 - DNA, 12 bp, Homo sapiens
gtccaatgtggc

SEQ ID NO: 4574119 - DNA, 15 bp, Homo sapiens
gtccacaggggccac

SEQ ID NO: 4574120 - DNA, 13 bp, Homo sapiens
gtccacaggtcca

SEQ ID NO: 4574121 - DNA, 16 bp, Homo sapiens
gtccacaggtccaagg

SEQ ID NO: 4574122 - DNA, 17 bp, Homo sapiens
gtccacaggtccaagga

SEQ ID NO: 4574123 - DNA, 21 bp, Homo sapiens
gtccacgcccaccagccttgc

SEQ ID NO: 4574124 - DNA, 22 bp, Homo sapiens
gtccacgcccaccagccttgct

SEQ ID NO: 4574125 - DNA, 13 bp, Homo sapiens
gtccacgtactta

SEQ ID NO: 4574126 - DNA, 17 bp, Homo sapiens
gtccacgtacttaattt

SEQ ID NO: 4574127 - DNA, 14 bp, Homo sapiens
gtccacttcatttt

SEQ ID NO: 4574128 - DNA, 15 bp, Homo sapiens
gtccagacccaagtc

SEQ ID NO: 4574129 - DNA, 16 bp, Homo sapiens
gtccagaccccccagc

SEQ ID NO: 4574130 - DNA, 19 bp, Homo sapiens
gtccagcattgctggactc

SEQ ID NO: 4574131 - DNA, 13 bp, Homo sapiens
gtccagccacttg

SEQ ID NO: 4574132 - DNA, 18 bp, Homo sapiens
gtccagcccctcctccct

SEQ ID NO: 4574133 - DNA, 19 bp, Homo sapiens
gtccagcccctcctccctc

SEQ ID NO: 4574134 - DNA, 20 bp, Homo sapiens
gtccagcccctcctccctca

SEQ ID NO: 4574135 - DNA, 21 bp, Homo sapiens
gtccagcccctcctccctcag

SEQ ID NO: 4574136 - DNA, 23 bp, Homo sapiens
gtccagcccctcctccctcagac

SEQ ID NO: 4574137 - DNA, 22 bp, Homo sapiens
gtccagctgggaagcccttttt

SEQ ID NO: 4574138 - DNA, 14 bp, Homo sapiens
gtccagctggggcc

SEQ ID NO: 4574139 - DNA, 14 bp, Homo sapiens
gtccagcttgctct

SEQ ID NO: 4574140 - DNA, 12 bp, Homo sapiens
gtccaggagcta

SEQ ID NO: 4574141 - DNA, 14 bp, Homo sapiens
gtccaggcccccaa

SEQ ID NO: 4574142 - DNA, 20 bp, Homo sapiens
gtccaggcccccaacccctc

SEQ ID NO: 4574143 - DNA, 19 bp, Homo sapiens
gtccaggcccccagcccct

SEQ ID NO: 4574144 - DNA, 23 bp, Homo sapiens
gtccaggcccccagcccctcctc

SEQ ID NO: 4574145 - DNA, 19 bp, Homo sapiens
gtccaggcctctctctgct

SEQ ID NO: 4574146 - DNA, 21 bp, Homo sapiens
gtccaggcctctctctgctcc

SEQ ID NO: 4574147 - DNA, 19 bp, Homo sapiens
gtccagggaaacagcctct

SEQ ID NO: 4574148 - DNA, 21 bp, Homo sapiens
gtccagggaggggtccctgca

SEQ ID NO: 4574149 - DNA, 20 bp, Homo sapiens
gtccaggggcccctccagct

SEQ ID NO: 4574150 - DNA, 16 bp, Homo sapiens
gtccagggtttctctg

SEQ ID NO: 4574151 - DNA, 16 bp, Homo sapiens
gtccaggtcccagccc

SEQ ID NO: 4574152 - DNA, 19 bp, Homo sapiens
gtccagtgctctgcctcag

SEQ ID NO: 4574153 - DNA, 17 bp, Homo sapiens
gtccatgctccagggtc

SEQ ID NO: 4574154 - DNA, 14 bp, Homo sapiens
gtccatgcttctca

SEQ ID NO: 4574155 - DNA, 14 bp, Homo sapiens
gtccatgggcagag

SEQ ID NO: 4574156 - DNA, 16 bp, Homo sapiens
gtccatgggcagagcc

SEQ ID NO: 4574157 - DNA, 18 bp, Homo sapiens
gtccatgggcagagccca

SEQ ID NO: 4574158 - DNA, 16 bp, Homo sapiens
gtccattgtccaatcc

SEQ ID NO: 4574159 - DNA, 23 bp, Homo sapiens
gtccatttttacaagttatagta

SEQ ID NO: 4574160 - DNA, 18 bp, Homo sapiens
gtcccaagcctgatactt

SEQ ID NO: 4574161 - DNA, 15 bp, Homo sapiens
gtcccaagctgggcc

SEQ ID NO: 4574162 - DNA, 22 bp, Homo sapiens
gtcccaagctgggccccagccc

SEQ ID NO: 4574163 - DNA, 23 bp, Homo sapiens
gtcccaagctgggccccagccca

SEQ ID NO: 4574164 - DNA, 20 bp, Homo sapiens
gtcccaatggtcctgacttt

SEQ ID NO: 4574165 - DNA, 13 bp, Homo sapiens
gtcccaccctccc

SEQ ID NO: 4574166 - DNA, 16 bp, Homo sapiens
gtcccaccctccctag

SEQ ID NO: 4574167 - DNA, 16 bp, Homo sapiens
gtcccaccctcttccc

SEQ ID NO: 4574168 - DNA, 17 bp, Homo sapiens
gtcccacgccaggccag

SEQ ID NO: 4574169 - DNA, 18 bp, Homo sapiens
gtcccagcatccctggag

SEQ ID NO: 4574170 - DNA, 19 bp, Homo sapiens
gtcccagcatccctggagc

SEQ ID NO: 4574171 - DNA, 14 bp, Homo sapiens
gtcccagccacccc

SEQ ID NO: 4574172 - DNA, 18 bp, Homo sapiens
gtcccagcccctcctccc

SEQ ID NO: 4574173 - DNA, 23 bp, Homo sapiens
gtcccagcccctcctccctcaga

SEQ ID NO: 4574174 - DNA, 11 bp, Homo sapiens
gtcccagctcc

SEQ ID NO: 4574175 - DNA, 12 bp, Homo sapiens
gtcccagctccc

SEQ ID NO: 4574176 - DNA, 23 bp, Homo sapiens
gtcccagtgctcaccagccctgc

SEQ ID NO: 4574177 - DNA, 17 bp, Homo sapiens
gtcccattcagtggcaa

SEQ ID NO: 4574178 - DNA, 13 bp, Homo sapiens
gtcccattctaga

SEQ ID NO: 4574179 - DNA, 14 bp, Homo sapiens
gtcccattctagat

SEQ ID NO: 4574180 - DNA, 15 bp, Homo sapiens
gtcccattctagatc

SEQ ID NO: 4574181 - DNA, 18 bp, Homo sapiens
gtcccattctagatcctg

SEQ ID NO: 4574182 - DNA, 22 bp, Homo sapiens
gtccccaacgtcccctccgccg

SEQ ID NO: 4574183 - DNA, 12 bp, Homo sapiens
gtccccacccct

SEQ ID NO: 4574184 - DNA, 14 bp, Homo sapiens
gtccccacccctgc

SEQ ID NO: 4574185 - DNA, 15 bp, Homo sapiens
gtccccacccctgcc

SEQ ID NO: 4574186 - DNA, 17 bp, Homo sapiens
gtccccacccctgcccc

SEQ ID NO: 4574187 - DNA, 14 bp, Homo sapiens
gtccccagttgccg

SEQ ID NO: 4574188 - DNA, 19 bp, Homo sapiens
gtccccagtttgcagaaaa

SEQ ID NO: 4574189 - DNA, 17 bp, Homo sapiens
gtccccatttctgcctc

SEQ ID NO: 4574190 - DNA, 14 bp, Homo sapiens
gtcccccaggaggc

SEQ ID NO: 4574191 - DNA, 21 bp, Homo sapiens
gtcccccccaggccttgtcct

SEQ ID NO: 4574192 - DNA, 20 bp, Homo sapiens
gtccccctcctcagccagcc

SEQ ID NO: 4574193 - DNA, 16 bp, Homo sapiens
gtccccgaggagctgg

SEQ ID NO: 4574194 - DNA, 17 bp, Homo sapiens
gtcccctcaaactcatt

SEQ ID NO: 4574195 - DNA, 18 bp, Homo sapiens
gtcccctcactctgtcag

SEQ ID NO: 4574196 - DNA, 12 bp, Homo sapiens
gtccccttcccc

SEQ ID NO: 4574197 - DNA, 15 bp, Homo sapiens
gtccccttcccctgc

SEQ ID NO: 4574198 - DNA, 17 bp, Homo sapiens
gtccccttcccctgctg

SEQ ID NO: 4574199 - DNA, 12 bp, Homo sapiens
gtccccttctct

SEQ ID NO: 4574200 - DNA, 18 bp, Homo sapiens
gtccccttctctcatctc

SEQ ID NO: 4574201 - DNA, 20 bp, Homo sapiens
gtcccgctgctgtgctctgg

SEQ ID NO: 4574202 - DNA, 21 bp, Homo sapiens
gtcccggggccagcacttcca

SEQ ID NO: 4574203 - DNA, 16 bp, Homo sapiens
gtccctacctgcttca

SEQ ID NO: 4574204 - DNA, 13 bp, Homo sapiens
gtccctccctgcc

SEQ ID NO: 4574205 - DNA, 19 bp, Homo sapiens
gtccctccctgcctgaggg

SEQ ID NO: 4574206 - DNA, 20 bp, Homo sapiens
gtccctgcaaaactccaggc

SEQ ID NO: 4574207 - DNA, 22 bp, Homo sapiens
gtccctgcaaaactccaggcag

SEQ ID NO: 4574208 - DNA, 18 bp, Homo sapiens
gtccctgccccagcaaga

SEQ ID NO: 4574209 - DNA, 23 bp, Homo sapiens
gtccctgcctggaccagcctctc

SEQ ID NO: 4574210 - DNA, 14 bp, Homo sapiens
gtccctgctgggga

SEQ ID NO: 4574211 - DNA, 15 bp, Homo sapiens
gtccctgtcacctct

SEQ ID NO: 4574212 - DNA, 20 bp, Homo sapiens
gtccctgtccctctagtgcc

SEQ ID NO: 4574213 - DNA, 19 bp, Homo sapiens
gtcccttcccctccctggc

SEQ ID NO: 4574214 - DNA, 17 bp, Homo sapiens
gtcccttgagacctcag

SEQ ID NO: 4574215 - DNA, 21 bp, Homo sapiens
gtcccttgagacctcagccat

SEQ ID NO: 4574216 - DNA, 14 bp, Homo sapiens
gtcccttgcctctg

SEQ ID NO: 4574217 - DNA, 21 bp, Homo sapiens
gtcccttgcctctgccctgga

SEQ ID NO: 4574218 - DNA, 14 bp, Homo sapiens
gtccctttccccta

SEQ ID NO: 4574219 - DNA, 20 bp, Homo sapiens
gtccctttcccctagatcca

SEQ ID NO: 4574220 - DNA, 17 bp, Homo sapiens
gtccggacactcctaga

SEQ ID NO: 4574221 - DNA, 16 bp, Homo sapiens
gtccggcctctccctg

SEQ ID NO: 4574222 - DNA, 17 bp, Homo sapiens
gtccggtgtccttttca

SEQ ID NO: 4574223 - DNA, 24 bp, Homo sapiens
gtccggtgtccttttcactacacc

SEQ ID NO: 4574224 - DNA, 19 bp, Homo sapiens
gtccgtagctcccctggct

SEQ ID NO: 4574225 - DNA, 21 bp, Homo sapiens
gtccgtagctcccctggctgg

SEQ ID NO: 4574226 - DNA, 23 bp, Homo sapiens
gtccgtagctcccctggctggct

SEQ ID NO: 4574227 - DNA, 22 bp, Homo sapiens
gtccgtagtatcagagatgtcc

SEQ ID NO: 4574228 - DNA, 18 bp, Homo sapiens
gtcctaacttcctgtgcc

SEQ ID NO: 4574229 - DNA, 22 bp, Homo sapiens
gtcctaatcatacaccagaaga

SEQ ID NO: 4574230 - DNA, 23 bp, Homo sapiens
gtcctaccatcagctctgccttg

SEQ ID NO: 4574231 - DNA, 16 bp, Homo sapiens
gtcctacgtccaaggt

SEQ ID NO: 4574232 - DNA, 13 bp, Homo sapiens
gtcctagcccagt

SEQ ID NO: 4574233 - DNA, 20 bp, Homo sapiens
gtcctagcccagtgcttctc

SEQ ID NO: 4574234 - DNA, 16 bp, Homo sapiens
gtcctagcccttccct

SEQ ID NO: 4574235 - DNA, 19 bp, Homo sapiens
gtcctagcccttccctgag

SEQ ID NO: 4574236 - DNA, 14 bp, Homo sapiens
gtcctaggcctcaa

SEQ ID NO: 4574237 - DNA, 16 bp, Homo sapiens
gtcctatgcaataaaa

SEQ ID NO: 4574238 - DNA, 19 bp, Homo sapiens
gtcctattatattcattct

SEQ ID NO: 4574239 - DNA, 17 bp, Homo sapiens
gtcctcactcccagtcc

SEQ ID NO: 4574240 - DNA, 18 bp, Homo sapiens
gtcctcactcccagtcca

SEQ ID NO: 4574241 - DNA, 23 bp, Homo sapiens
gtcctcacttctagatctcagcc

SEQ ID NO: 4574242 - DNA, 13 bp, Homo sapiens
gtcctcagggagc

SEQ ID NO: 4574243 - DNA, 22 bp, Homo sapiens
gtcctcagggagcagggaaggc

SEQ ID NO: 4574244 - DNA, 13 bp, Homo sapiens
gtcctccagaagc

SEQ ID NO: 4574245 - DNA, 18 bp, Homo sapiens
gtcctccagaagcctctg

SEQ ID NO: 4574246 - DNA, 22 bp, Homo sapiens
gtcctccagaagcctctggcta

SEQ ID NO: 4574247 - DNA, 21 bp, Homo sapiens
gtcctccccctgccagtgcct

SEQ ID NO: 4574248 - DNA, 17 bp, Homo sapiens
gtcctcccctctcttgt

SEQ ID NO: 4574249 - DNA, 19 bp, Homo sapiens
gtcctccctgatcccaccc

SEQ ID NO: 4574250 - DNA, 22 bp, Homo sapiens
gtcctccctgatcccaccccct

SEQ ID NO: 4574251 - DNA, 13 bp, Homo sapiens
gtcctcctcacct

SEQ ID NO: 4574252 - DNA, 13 bp, Homo sapiens
gtcctcctctgtg

SEQ ID NO: 4574253 - DNA, 16 bp, Homo sapiens
gtcctctccctgccaa

SEQ ID NO: 4574254 - DNA, 16 bp, Homo sapiens
gtcctctcgagcccag

SEQ ID NO: 4574255 - DNA, 11 bp, Homo sapiens
gtcctctcttc

SEQ ID NO: 4574256 - DNA, 19 bp, Homo sapiens
gtcctcttccctctctgca

SEQ ID NO: 4574257 - DNA, 20 bp, Homo sapiens
gtcctcttccctctctgcag

SEQ ID NO: 4574258 - DNA, 19 bp, Homo sapiens
gtcctcttttcctggcagc

SEQ ID NO: 4574259 - DNA, 23 bp, Homo sapiens
gtcctcttttcctggcagctgct

SEQ ID NO: 4574260 - DNA, 15 bp, Homo sapiens
gtcctgatcagagcc

SEQ ID NO: 4574261 - DNA, 15 bp, Homo sapiens
gtcctgcacaccctg

SEQ ID NO: 4574262 - DNA, 17 bp, Homo sapiens
gtcctgcacaccctggg

SEQ ID NO: 4574263 - DNA, 22 bp, Homo sapiens
gtcctgcacaccctgggccacg

SEQ ID NO: 4574264 - DNA, 23 bp, Homo sapiens
gtcctgcacaccctgggccacgc

SEQ ID NO: 4574265 - DNA, 12 bp, Homo sapiens
gtcctgccagct

SEQ ID NO: 4574266 - DNA, 16 bp, Homo sapiens
gtcctgccagctggat

SEQ ID NO: 4574267 - DNA, 17 bp, Homo sapiens
gtcctgccagctggatc

SEQ ID NO: 4574268 - DNA, 18 bp, Homo sapiens
gtcctgccctgtggaatg

SEQ ID NO: 4574269 - DNA, 13 bp, Homo sapiens
gtcctgccggtgg

SEQ ID NO: 4574270 - DNA, 17 bp, Homo sapiens
gtcctgccggtgggacc

SEQ ID NO: 4574271 - DNA, 19 bp, Homo sapiens
gtcctgccggtgggaccct

SEQ ID NO: 4574272 - DNA, 12 bp, Homo sapiens
gtcctgcctgaa

SEQ ID NO: 4574273 - DNA, 14 bp, Homo sapiens
gtcctgcctgaaca

SEQ ID NO: 4574274 - DNA, 19 bp, Homo sapiens
gtcctgcctggccaggcag

SEQ ID NO: 4574275 - DNA, 13 bp, Homo sapiens
gtcctggaggggc

SEQ ID NO: 4574276 - DNA, 19 bp, Homo sapiens
gtcctggctcctgaggggc

SEQ ID NO: 4574277 - DNA, 18 bp, Homo sapiens
gtcctggtgctgccgagg

SEQ ID NO: 4574278 - DNA, 22 bp, Homo sapiens
gtcctggtgctgccgagggctg

SEQ ID NO: 4574279 - DNA, 23 bp, Homo sapiens
gtcctggtgctgccgagggctgg

SEQ ID NO: 4574280 - DNA, 20 bp, Homo sapiens
gtcctgtagttttattttat

SEQ ID NO: 4574281 - DNA, 16 bp, Homo sapiens
gtcctgtgagatgtgt

SEQ ID NO: 4574282 - DNA, 17 bp, Homo sapiens
gtcctgttgatcccagt

SEQ ID NO: 4574283 - DNA, 22 bp, Homo sapiens
gtccttatgttaagccctggca

SEQ ID NO: 4574284 - DNA, 18 bp, Homo sapiens
gtccttatttatttaact

SEQ ID NO: 4574285 - DNA, 22 bp, Homo sapiens
gtccttccctcaaagaggcctt

SEQ ID NO: 4574286 - DNA, 16 bp, Homo sapiens
gtccttcctctcaagc

SEQ ID NO: 4574287 - DNA, 18 bp, Homo sapiens
gtccttgcacctgcatcc

SEQ ID NO: 4574288 - DNA, 21 bp, Homo sapiens
gtccttgcctgaactccagag

SEQ ID NO: 4574289 - DNA, 21 bp, Homo sapiens
gtccttgtctctgggccactt

SEQ ID NO: 4574290 - DNA, 13 bp, Homo sapiens
gtcctttctcaga

SEQ ID NO: 4574291 - DNA, 15 bp, Homo sapiens
gtccttttctaggaa

SEQ ID NO: 4574292 - DNA, 23 bp, Homo sapiens
gtccttttctcccatttcttgct

SEQ ID NO: 4574293 - DNA, 15 bp, Homo sapiens
gtccttttgacactg

SEQ ID NO: 4574294 - DNA, 17 bp, Homo sapiens
gtccttttgacactgct

SEQ ID NO: 4574295 - DNA, 16 bp, Homo sapiens
gtcctttttttccatc

SEQ ID NO: 4574296 - DNA, 14 bp, Homo sapiens
gtcgatagagctgt

SEQ ID NO: 4574297 - DNA, 17 bp, Homo sapiens
gtcgcagaccagagctg

SEQ ID NO: 4574298 - DNA, 13 bp, Homo sapiens
gtcgcccaggctg

SEQ ID NO: 4574299 - DNA, 20 bp, Homo sapiens
gtcgcccaggctggagtgca

SEQ ID NO: 4574300 - DNA, 14 bp, Homo sapiens
gtcgccccaggccc

SEQ ID NO: 4574301 - DNA, 18 bp, Homo sapiens
gtcgccccaggccctccc

SEQ ID NO: 4574302 - DNA, 23 bp, Homo sapiens
gtcgccccaggccctccctgact

SEQ ID NO: 4574303 - DNA, 20 bp, Homo sapiens
gtcgcccctccttttggcct

SEQ ID NO: 4574304 - DNA, 21 bp, Homo sapiens
gtcgcccctccttttggcctg

SEQ ID NO: 4574305 - DNA, 22 bp, Homo sapiens
gtcgcccctccttttggcctgg

SEQ ID NO: 4574306 - DNA, 23 bp, Homo sapiens
gtcgcccctccttttggcctggg

SEQ ID NO: 4574307 - DNA, 21 bp, Homo sapiens
gtcgcctgtaatgccagcgct

SEQ ID NO: 4574308 - DNA, 15 bp, Homo sapiens
gtcgctatgtgactt

SEQ ID NO: 4574309 - DNA, 17 bp, Homo sapiens
gtcggccccaccagtgc

SEQ ID NO: 4574310 - DNA, 20 bp, Homo sapiens
gtcggcctctaaccccaggc

SEQ ID NO: 4574311 - DNA, 22 bp, Homo sapiens
gtcggcctctaaccccaggccc

SEQ ID NO: 4574312 - DNA, 23 bp, Homo sapiens
gtcggcctctaaccccaggcccc

SEQ ID NO: 4574313 - DNA, 13 bp, Homo sapiens
gtcgggacagctg

SEQ ID NO: 4574314 - DNA, 19 bp, Homo sapiens
gtcgggcttccctggcctc

SEQ ID NO: 4574315 - DNA, 20 bp, Homo sapiens
gtcgggcttccctggcctcc

SEQ ID NO: 4574316 - DNA, 17 bp, Homo sapiens
gtcgtcatcagatgctt

SEQ ID NO: 4574317 - DNA, 15 bp, Homo sapiens
gtctaaaaacatttg

SEQ ID NO: 4574318 - DNA, 14 bp, Homo sapiens
gtctacctggcaga

SEQ ID NO: 4574319 - DNA, 17 bp, Homo sapiens
gtctactcctagaagaa

SEQ ID NO: 4574320 - DNA, 19 bp, Homo sapiens
gtctagatgggttcttagc

SEQ ID NO: 4574321 - DNA, 14 bp, Homo sapiens
gtctaggacacagt

SEQ ID NO: 4574322 - DNA, 13 bp, Homo sapiens
gtctaggagctgg

SEQ ID NO: 4574323 - DNA, 16 bp, Homo sapiens
gtctaggcaggcaaga

SEQ ID NO: 4574324 - DNA, 15 bp, Homo sapiens
gtctaggttaaagct

SEQ ID NO: 4574325 - DNA, 14 bp, Homo sapiens
gtctagtctctcct

SEQ ID NO: 4574326 - DNA, 18 bp, Homo sapiens
gtctagtctctcctgtaa

SEQ ID NO: 4574327 - DNA, 12 bp, Homo sapiens
gtctagttttat

SEQ ID NO: 4574328 - DNA, 14 bp, Homo sapiens
gtctatactacagt

SEQ ID NO: 4574329 - DNA, 18 bp, Homo sapiens
gtctattatagtgaaaca

SEQ ID NO: 4574330 - DNA, 19 bp, Homo sapiens
gtctattatagtgaaacat

SEQ ID NO: 4574331 - DNA, 16 bp, Homo sapiens
gtctatttgtctctta

SEQ ID NO: 4574332 - DNA, 22 bp, Homo sapiens
gtctcaaacttgtggcctcaag

SEQ ID NO: 4574333 - DNA, 18 bp, Homo sapiens
gtctcaacgcctccccct

SEQ ID NO: 4574334 - DNA, 19 bp, Homo sapiens
gtctcacctggacttaagc

SEQ ID NO: 4574335 - DNA, 22 bp, Homo sapiens
gtctcactcttctgtcttgtcc

SEQ ID NO: 4574336 - DNA, 18 bp, Homo sapiens
gtctcactttactttcaa

SEQ ID NO: 4574337 - DNA, 13 bp, Homo sapiens
gtctcagaagagg

SEQ ID NO: 4574338 - DNA, 14 bp, Homo sapiens
gtctcagaagaggt

SEQ ID NO: 4574339 - DNA, 23 bp, Homo sapiens
gtctcagtccatgaagatgtaga

SEQ ID NO: 4574340 - DNA, 15 bp, Homo sapiens
gtctcatccatcatc

SEQ ID NO: 4574341 - DNA, 13 bp, Homo sapiens
gtctcatccccag

SEQ ID NO: 4574342 - DNA, 15 bp, Homo sapiens
gtctcatccccaggg

SEQ ID NO: 4574343 - DNA, 15 bp, Homo sapiens
gtctcatcctcccat

SEQ ID NO: 4574344 - DNA, 15 bp, Homo sapiens
gtctcatctcccagg

SEQ ID NO: 4574345 - DNA, 19 bp, Homo sapiens
gtctcatgctccttaatgg

SEQ ID NO: 4574346 - DNA, 16 bp, Homo sapiens
gtctcatgctgttgct

SEQ ID NO: 4574347 - DNA, 15 bp, Homo sapiens
gtctcatttgggcta

SEQ ID NO: 4574348 - DNA, 15 bp, Homo sapiens
gtctcattttaatgt

SEQ ID NO: 4574349 - DNA, 22 bp, Homo sapiens
gtctccaaaaaaaaaaaaaata

SEQ ID NO: 4574350 - DNA, 23 bp, Homo sapiens
gtctccaaaaaaaaaaaaaatac

SEQ ID NO: 4574351 - DNA, 17 bp, Homo sapiens
gtctccaaaacatttct

SEQ ID NO: 4574352 - DNA, 17 bp, Homo sapiens
gtctccaaccccccagc

SEQ ID NO: 4574353 - DNA, 21 bp, Homo sapiens
gtctccaaccccccagcactg

SEQ ID NO: 4574354 - DNA, 22 bp, Homo sapiens
gtctccaagtagtccaccttca

SEQ ID NO: 4574355 - DNA, 17 bp, Homo sapiens
gtctccacactgctgct

SEQ ID NO: 4574356 - DNA, 14 bp, Homo sapiens
gtctccaccccagg

SEQ ID NO: 4574357 - DNA, 16 bp, Homo sapiens
gtctccaccccagggt

SEQ ID NO: 4574358 - DNA, 14 bp, Homo sapiens
gtctccacctgcac

SEQ ID NO: 4574359 - DNA, 15 bp, Homo sapiens
gtctccacctgcaca

SEQ ID NO: 4574360 - DNA, 17 bp, Homo sapiens
gtctccacctgcacatt

SEQ ID NO: 4574361 - DNA, 19 bp, Homo sapiens
gtctccatgtgtgtgccaa

SEQ ID NO: 4574362 - DNA, 19 bp, Homo sapiens
gtctcccatatgcagaaat

SEQ ID NO: 4574363 - DNA, 19 bp, Homo sapiens
gtctccccagttccacagc

SEQ ID NO: 4574364 - DNA, 12 bp, Homo sapiens
gtctccctcctc

SEQ ID NO: 4574365 - DNA, 19 bp, Homo sapiens
gtctccctcctctgcccgg

SEQ ID NO: 4574366 - DNA, 12 bp, Homo sapiens
gtctccctggct

SEQ ID NO: 4574367 - DNA, 21 bp, Homo sapiens
gtctcctcactcccttctacc

SEQ ID NO: 4574368 - DNA, 18 bp, Homo sapiens
gtctcctcactctgtccc

SEQ ID NO: 4574369 - DNA, 21 bp, Homo sapiens
gtctcggatgacaccctggcc

SEQ ID NO: 4574370 - DNA, 21 bp, Homo sapiens
gtctctaccaaaaaaaggaag

SEQ ID NO: 4574371 - DNA, 23 bp, Homo sapiens
gtctctatattgcttagtaagta

SEQ ID NO: 4574372 - DNA, 14 bp, Homo sapiens
gtctctatttaaat

SEQ ID NO: 4574373 - DNA, 20 bp, Homo sapiens
gtctctatttaaattctttt

SEQ ID NO: 4574374 - DNA, 12 bp, Homo sapiens
gtctctcagaat

SEQ ID NO: 4574375 - DNA, 18 bp, Homo sapiens
gtctctctcggcccctgt

SEQ ID NO: 4574376 - DNA, 20 bp, Homo sapiens
gtctctcttcagactctcag

SEQ ID NO: 4574377 - DNA, 14 bp, Homo sapiens
gtctctcttctctc

SEQ ID NO: 4574378 - DNA, 23 bp, Homo sapiens
gtctctcttctctccagctgact

SEQ ID NO: 4574379 - DNA, 13 bp, Homo sapiens
gtctctgggccac

SEQ ID NO: 4574380 - DNA, 19 bp, Homo sapiens
gtctctggggcaggctgct

SEQ ID NO: 4574381 - DNA, 21 bp, Homo sapiens
gtctctggggcaggctgcttc

SEQ ID NO: 4574382 - DNA, 15 bp, Homo sapiens
gtctctgtgagactc

SEQ ID NO: 4574383 - DNA, 13 bp, Homo sapiens
gtctctgtgtgtg

SEQ ID NO: 4574384 - DNA, 20 bp, Homo sapiens
gtctcttagaatttgtttca

SEQ ID NO: 4574385 - DNA, 19 bp, Homo sapiens
gtctcttctgaataaagca

SEQ ID NO: 4574386 - DNA, 20 bp, Homo sapiens
gtctcttctgaataaagcaa

SEQ ID NO: 4574387 - DNA, 22 bp, Homo sapiens
gtctcttctgaataaagcaatt

SEQ ID NO: 4574388 - DNA, 23 bp, Homo sapiens
gtctcttctgaataaagcaatta

SEQ ID NO: 4574389 - DNA, 14 bp, Homo sapiens
gtctcttctgagct

SEQ ID NO: 4574390 - DNA, 15 bp, Homo sapiens
gtctcttgagcatca

SEQ ID NO: 4574391 - DNA, 16 bp, Homo sapiens
gtctcttgagcatcaa

SEQ ID NO: 4574392 - DNA, 21 bp, Homo sapiens
gtctcttgagcatcaatcttg

SEQ ID NO: 4574393 - DNA, 22 bp, Homo sapiens
gtctcttgagcatcaatcttgt

SEQ ID NO: 4574394 - DNA, 15 bp, Homo sapiens
gtctgaaacatttca

SEQ ID NO: 4574395 - DNA, 16 bp, Homo sapiens
gtctgaaacatttcat

SEQ ID NO: 4574396 - DNA, 17 bp, Homo sapiens
gtctgaaacatttcata

SEQ ID NO: 4574397 - DNA, 15 bp, Homo sapiens
gtctgaacatagaaa

SEQ ID NO: 4574398 - DNA, 22 bp, Homo sapiens
gtctgaagctcgcatccagaca

SEQ ID NO: 4574399 - DNA, 19 bp, Homo sapiens
gtctgaagtacaaacatga

SEQ ID NO: 4574400 - DNA, 16 bp, Homo sapiens
gtctgagccacagcag

SEQ ID NO: 4574401 - DNA, 21 bp, Homo sapiens
gtctgagccacagcagcattt

SEQ ID NO: 4574402 - DNA, 15 bp, Homo sapiens
gtctgagccctggtg

SEQ ID NO: 4574403 - DNA, 14 bp, Homo sapiens
gtctgaggcccctg

SEQ ID NO: 4574404 - DNA, 19 bp, Homo sapiens
gtctgagtagtggccactg

SEQ ID NO: 4574405 - DNA, 19 bp, Homo sapiens
gtctgagtcctgtctctgc

SEQ ID NO: 4574406 - DNA, 21 bp, Homo sapiens
gtctgagtcctgtctctgcct

SEQ ID NO: 4574407 - DNA, 17 bp, Homo sapiens
gtctgatctgtgctttc

SEQ ID NO: 4574408 - DNA, 19 bp, Homo sapiens
gtctgatgttctttccatg

SEQ ID NO: 4574409 - DNA, 16 bp, Homo sapiens
gtctgatttgtgatga

SEQ ID NO: 4574410 - DNA, 20 bp, Homo sapiens
gtctgcaccttagaaaaaaa

SEQ ID NO: 4574411 - DNA, 23 bp, Homo sapiens
gtctgcaccttagaaaaaaaaag

SEQ ID NO: 4574412 - DNA, 14 bp, Homo sapiens
gtctgcatttcata

SEQ ID NO: 4574413 - DNA, 19 bp, Homo sapiens
gtctgccaacctaaaactc

SEQ ID NO: 4574414 - DNA, 21 bp, Homo sapiens
gtctgccaacctaaaactctt

SEQ ID NO: 4574415 - DNA, 22 bp, Homo sapiens
gtctgccgattttgtaaatgtt

SEQ ID NO: 4574416 - DNA, 15 bp, Homo sapiens
gtctgcgtgggtcag

SEQ ID NO: 4574417 - DNA, 16 bp, Homo sapiens
gtctgcgtgggtcaga

SEQ ID NO: 4574418 - DNA, 15 bp, Homo sapiens
gtctgctaggcgctg

SEQ ID NO: 4574419 - DNA, 11 bp, Homo sapiens
gtctgctctgc

SEQ ID NO: 4574420 - DNA, 22 bp, Homo sapiens
gtctgctgagttggcctggcca

SEQ ID NO: 4574421 - DNA, 14 bp, Homo sapiens
gtctgctgtagaaa

SEQ ID NO: 4574422 - DNA, 17 bp, Homo sapiens
gtctgcttgcatctgca

SEQ ID NO: 4574423 - DNA, 17 bp, Homo sapiens
gtctggaaaacagaaac

SEQ ID NO: 4574424 - DNA, 15 bp, Homo sapiens
gtctggacctgggga

SEQ ID NO: 4574425 - DNA, 19 bp, Homo sapiens
gtctggagaagcagtgagc

SEQ ID NO: 4574426 - DNA, 16 bp, Homo sapiens
gtctggagaaggtatt

SEQ ID NO: 4574427 - DNA, 18 bp, Homo sapiens
gtctggctttggcactct

SEQ ID NO: 4574428 - DNA, 18 bp, Homo sapiens
gtctgggatatggctgcc

SEQ ID NO: 4574429 - DNA, 22 bp, Homo sapiens
gtctggggacgttgctgagcca

SEQ ID NO: 4574430 - DNA, 17 bp, Homo sapiens
gtctggggttcagcccc

SEQ ID NO: 4574431 - DNA, 20 bp, Homo sapiens
gtctggggttcagcccctcc

SEQ ID NO: 4574432 - DNA, 23 bp, Homo sapiens
gtctggggttcagcccctcctct

SEQ ID NO: 4574433 - DNA, 15 bp, Homo sapiens
gtctggttcctgtgt

SEQ ID NO: 4574434 - DNA, 19 bp, Homo sapiens
gtctgtaaaaaatggagct

SEQ ID NO: 4574435 - DNA, 11 bp, Homo sapiens
gtctgtaattt

SEQ ID NO: 4574436 - DNA, 18 bp, Homo sapiens
gtctgtagagggccctgg

SEQ ID NO: 4574437 - DNA, 20 bp, Homo sapiens
gtctgtatactcctgtcacc

SEQ ID NO: 4574438 - DNA, 22 bp, Homo sapiens
gtctgtatactcctgtcaccta

SEQ ID NO: 4574439 - DNA, 17 bp, Homo sapiens
gtctgtcaggggcttgg

SEQ ID NO: 4574440 - DNA, 16 bp, Homo sapiens
gtctgtctacatttct

SEQ ID NO: 4574441 - DNA, 21 bp, Homo sapiens
gtctgtctgaatgatcttgtg

SEQ ID NO: 4574442 - DNA, 14 bp, Homo sapiens
gtctgtctgctttg

SEQ ID NO: 4574443 - DNA, 14 bp, Homo sapiens
gtctgtgaagagcc

SEQ ID NO: 4574444 - DNA, 18 bp, Homo sapiens
gtctgtgccctccaaaga

SEQ ID NO: 4574445 - DNA, 15 bp, Homo sapiens
gtctgtgtcatttct

SEQ ID NO: 4574446 - DNA, 18 bp, Homo sapiens
gtctgtgtcatttcttca

SEQ ID NO: 4574447 - DNA, 16 bp, Homo sapiens
gtctgtgtgtgtgtat

SEQ ID NO: 4574448 - DNA, 21 bp, Homo sapiens
gtctgtgtgtttatgtgtgtg

SEQ ID NO: 4574449 - DNA, 22 bp, Homo sapiens
gtctgtgtgtttatgtgtgtgt

SEQ ID NO: 4574450 - DNA, 19 bp, Homo sapiens
gtctgttaccttgttaata

SEQ ID NO: 4574451 - DNA, 15 bp, Homo sapiens
gtctgttatttatta

SEQ ID NO: 4574452 - DNA, 17 bp, Homo sapiens
gtctgttcactgcattc

SEQ ID NO: 4574453 - DNA, 17 bp, Homo sapiens
gtctgttcccagcccct

SEQ ID NO: 4574454 - DNA, 18 bp, Homo sapiens
gtctgttcccagcccctg

SEQ ID NO: 4574455 - DNA, 19 bp, Homo sapiens
gtctgttcccagcccctgc

SEQ ID NO: 4574456 - DNA, 13 bp, Homo sapiens
gtctgtttaaagt

SEQ ID NO: 4574457 - DNA, 14 bp, Homo sapiens
gtctgtttaaagtg

SEQ ID NO: 4574458 - DNA, 17 bp, Homo sapiens
gtcttaaaaaatgtgaa

SEQ ID NO: 4574459 - DNA, 14 bp, Homo sapiens
gtcttaaaagatat

SEQ ID NO: 4574460 - DNA, 22 bp, Homo sapiens
gtcttaaactaaatgtgcaata

SEQ ID NO: 4574461 - DNA, 18 bp, Homo sapiens
gtcttaaattttcttcct

SEQ ID NO: 4574462 - DNA, 16 bp, Homo sapiens
gtcttaactgtatttc

SEQ ID NO: 4574463 - DNA, 14 bp, Homo sapiens
gtcttaagggtcac

SEQ ID NO: 4574464 - DNA, 16 bp, Homo sapiens
gtcttaattgtgttta

SEQ ID NO: 4574465 - DNA, 18 bp, Homo sapiens
gtcttacgtttttctggt

SEQ ID NO: 4574466 - DNA, 20 bp, Homo sapiens
gtcttagaagtggaccagga

SEQ ID NO: 4574467 - DNA, 14 bp, Homo sapiens
gtcttagactgcta

SEQ ID NO: 4574468 - DNA, 15 bp, Homo sapiens
gtcttagttgatatt

SEQ ID NO: 4574469 - DNA, 13 bp, Homo sapiens
gtcttcacaacag

SEQ ID NO: 4574470 - DNA, 11 bp, Homo sapiens
gtcttccacaa

SEQ ID NO: 4574471 - DNA, 16 bp, Homo sapiens
gtcttccctacctcag

SEQ ID NO: 4574472 - DNA, 21 bp, Homo sapiens
gtcttccctacctcaggcagg

SEQ ID NO: 4574473 - DNA, 11 bp, Homo sapiens
gtcttccctgg

SEQ ID NO: 4574474 - DNA, 12 bp, Homo sapiens
gtcttccctggg

SEQ ID NO: 4574475 - DNA, 14 bp, Homo sapiens
gtcttcctgacact

SEQ ID NO: 4574476 - DNA, 19 bp, Homo sapiens
gtcttcctgacactttaat

SEQ ID NO: 4574477 - DNA, 13 bp, Homo sapiens
gtcttctgcctgt

SEQ ID NO: 4574478 - DNA, 14 bp, Homo sapiens
gtcttctgcctgtt

SEQ ID NO: 4574479 - DNA, 13 bp, Homo sapiens
gtcttgaaatgaa

SEQ ID NO: 4574480 - DNA, 14 bp, Homo sapiens
gtcttgaaatgaaa

SEQ ID NO: 4574481 - DNA, 16 bp, Homo sapiens
gtcttgaaatgaaagg

SEQ ID NO: 4574482 - DNA, 15 bp, Homo sapiens
gtcttgctgttgaca

SEQ ID NO: 4574483 - DNA, 19 bp, Homo sapiens
gtcttgtcccaattaaaat

SEQ ID NO: 4574484 - DNA, 20 bp, Homo sapiens
gtcttgtcccaattaaaata

SEQ ID NO: 4574485 - DNA, 17 bp, Homo sapiens
gtcttgtccccacccat

SEQ ID NO: 4574486 - DNA, 15 bp, Homo sapiens
gtcttgttcctgtgc

SEQ ID NO: 4574487 - DNA, 16 bp, Homo sapiens
gtcttgttcctgtgca

SEQ ID NO: 4574488 - DNA, 16 bp, Homo sapiens
gtctttagctattact

SEQ ID NO: 4574489 - DNA, 24 bp, Homo sapiens
gtctttattgtccaccatgctctc

SEQ ID NO: 4574490 - DNA, 19 bp, Homo sapiens
gtctttctaagaaatcaag

SEQ ID NO: 4574491 - DNA, 13 bp, Homo sapiens
gtctttctagcca

SEQ ID NO: 4574492 - DNA, 15 bp, Homo sapiens
gtctttcttcttttt

SEQ ID NO: 4574493 - DNA, 18 bp, Homo sapiens
gtctttggagaaatgctt

SEQ ID NO: 4574494 - DNA, 18 bp, Homo sapiens
gtctttgtaatgtcacca

SEQ ID NO: 4574495 - DNA, 19 bp, Homo sapiens
gtctttgtaatgtcaccac

SEQ ID NO: 4574496 - DNA, 15 bp, Homo sapiens
gtcttttaaacatta

SEQ ID NO: 4574497 - DNA, 23 bp, Homo sapiens
gtcttttataggaaaaaaactgg

SEQ ID NO: 4574498 - DNA, 22 bp, Homo sapiens
gtcttttatagtggaaaaacac

SEQ ID NO: 4574499 - DNA, 13 bp, Homo sapiens
gtctttttttatt

SEQ ID NO: 4574500 - DNA, 23 bp, Homo sapiens
gtctttttttttctttttccagt

SEQ ID NO: 4574501 - DNA, 12 bp, Homo sapiens
gtgaaaaaggaa

SEQ ID NO: 4574502 - DNA, 11 bp, Homo sapiens
gtgaaaaatgt

SEQ ID NO: 4574503 - DNA, 14 bp, Homo sapiens
gtgaaaagctccat

SEQ ID NO: 4574504 - DNA, 22 bp, Homo sapiens
gtgaaaatagtgtaagaactgt

SEQ ID NO: 4574505 - DNA, 21 bp, Homo sapiens
gtgaaaatgaatatcatgcaa

SEQ ID NO: 4574506 - DNA, 17 bp, Homo sapiens
gtgaaaatggtccagga

SEQ ID NO: 4574507 - DNA, 17 bp, Homo sapiens
gtgaaacccccatctct

SEQ ID NO: 4574508 - DNA, 17 bp, Homo sapiens
gtgaaacgtaattgtac

SEQ ID NO: 4574509 - DNA, 22 bp, Homo sapiens
gtgaaatcttgtttgttactgt

SEQ ID NO: 4574510 - DNA, 21 bp, Homo sapiens
gtgaacaaatttacagagaca

SEQ ID NO: 4574511 - DNA, 17 bp, Homo sapiens
gtgaacaactgtttgtc

SEQ ID NO: 4574512 - DNA, 17 bp, Homo sapiens
gtgaacagagagaccct

SEQ ID NO: 4574513 - DNA, 13 bp, Homo sapiens
gtgaaccagaggg

SEQ ID NO: 4574514 - DNA, 14 bp, Homo sapiens
gtgaactcctgcca

SEQ ID NO: 4574515 - DNA, 19 bp, Homo sapiens
gtgaactcctgccaggcac

SEQ ID NO: 4574516 - DNA, 13 bp, Homo sapiens
gtgaactctcaaa

SEQ ID NO: 4574517 - DNA, 15 bp, Homo sapiens
gtgaactggaagaaa

SEQ ID NO: 4574518 - DNA, 17 bp, Homo sapiens
gtgaactggaagaaagc

SEQ ID NO: 4574519 - DNA, 21 bp, Homo sapiens
gtgaactgtgtgtgaatctgc

SEQ ID NO: 4574520 - DNA, 17 bp, Homo sapiens
gtgaagcagcactgtga

SEQ ID NO: 4574521 - DNA, 17 bp, Homo sapiens
gtgaaggcttctctctg

SEQ ID NO: 4574522 - DNA, 18 bp, Homo sapiens
gtgaagggaagagacagc

SEQ ID NO: 4574523 - DNA, 19 bp, Homo sapiens
gtgaagtttaattgactta

SEQ ID NO: 4574524 - DNA, 19 bp, Homo sapiens
gtgaagtttaattgtctca

SEQ ID NO: 4574525 - DNA, 22 bp, Homo sapiens
gtgaatacattaacggtgctaa

SEQ ID NO: 4574526 - DNA, 17 bp, Homo sapiens
gtgaataggttatatgc

SEQ ID NO: 4574527 - DNA, 14 bp, Homo sapiens
gtgaatataaatgt

SEQ ID NO: 4574528 - DNA, 16 bp, Homo sapiens
gtgaatcacgtaaagc

SEQ ID NO: 4574529 - DNA, 19 bp, Homo sapiens
gtgaatctgcttttcctct

SEQ ID NO: 4574530 - DNA, 21 bp, Homo sapiens
gtgaatctgcttttcctctgc

SEQ ID NO: 4574531 - DNA, 21 bp, Homo sapiens
gtgaatgccaaagccattctc

SEQ ID NO: 4574532 - DNA, 22 bp, Homo sapiens
gtgaatgccaaagccattctcc

SEQ ID NO: 4574533 - DNA, 15 bp, Homo sapiens
gtgaatggaggcaga

SEQ ID NO: 4574534 - DNA, 16 bp, Homo sapiens
gtgaatggtctctgtc

SEQ ID NO: 4574535 - DNA, 22 bp, Homo sapiens
gtgaattaggctgtaactactt

SEQ ID NO: 4574536 - DNA, 17 bp, Homo sapiens
gtgaatttttaagctgc

SEQ ID NO: 4574537 - DNA, 15 bp, Homo sapiens
gtgaatttttgcaat

SEQ ID NO: 4574538 - DNA, 16 bp, Homo sapiens
gtgaatttttgcaata

SEQ ID NO: 4574539 - DNA, 19 bp, Homo sapiens
gtgacaattctgtttttaa

SEQ ID NO: 4574540 - DNA, 17 bp, Homo sapiens
gtgacacgcttctgagc

SEQ ID NO: 4574541 - DNA, 12 bp, Homo sapiens
gtgacagagtga

SEQ ID NO: 4574542 - DNA, 12 bp, Homo sapiens
gtgacagctttc

SEQ ID NO: 4574543 - DNA, 23 bp, Homo sapiens
gtgacagctttcctcaaaaagca

SEQ ID NO: 4574544 - DNA, 21 bp, Homo sapiens
gtgacagtatcttttttcctt

SEQ ID NO: 4574545 - DNA, 12 bp, Homo sapiens
gtgacagtggct

SEQ ID NO: 4574546 - DNA, 17 bp, Homo sapiens
gtgacagtggctgctct

SEQ ID NO: 4574547 - DNA, 18 bp, Homo sapiens
gtgacagtggctgctctg

SEQ ID NO: 4574548 - DNA, 19 bp, Homo sapiens
gtgacagtggctgctctgg

SEQ ID NO: 4574549 - DNA, 16 bp, Homo sapiens
gtgacatcggaaaaat

SEQ ID NO: 4574550 - DNA, 19 bp, Homo sapiens
gtgacatcggaaaaataat

SEQ ID NO: 4574551 - DNA, 13 bp, Homo sapiens
gtgacattcactg

SEQ ID NO: 4574552 - DNA, 12 bp, Homo sapiens
gtgacatttctc

SEQ ID NO: 4574553 - DNA, 16 bp, Homo sapiens
gtgacatttctcttcc

SEQ ID NO: 4574554 - DNA, 21 bp, Homo sapiens
gtgacattttacattaaattt

SEQ ID NO: 4574555 - DNA, 15 bp, Homo sapiens
gtgaccagtttctta

SEQ ID NO: 4574556 - DNA, 16 bp, Homo sapiens
gtgaccattattcaca

SEQ ID NO: 4574557 - DNA, 15 bp, Homo sapiens
gtgaccctgggcagt

SEQ ID NO: 4574558 - DNA, 15 bp, Homo sapiens
gtgacctccatactg

SEQ ID NO: 4574559 - DNA, 15 bp, Homo sapiens
gtgacctcttgcctc

SEQ ID NO: 4574560 - DNA, 13 bp, Homo sapiens
gtgacctgagggc

SEQ ID NO: 4574561 - DNA, 17 bp, Homo sapiens
gtgacctgtcagaataa

SEQ ID NO: 4574562 - DNA, 16 bp, Homo sapiens
gtgacctttgacctcg

SEQ ID NO: 4574563 - DNA, 15 bp, Homo sapiens
gtgactcacccaagc

SEQ ID NO: 4574564 - DNA, 17 bp, Homo sapiens
gtgactcacttcaatgt

SEQ ID NO: 4574565 - DNA, 21 bp, Homo sapiens
gtgactcacttcaatgtgtca

SEQ ID NO: 4574566 - DNA, 22 bp, Homo sapiens
gtgactcgacaaaggccacagg

SEQ ID NO: 4574567 - DNA, 23 bp, Homo sapiens
gtgactcgacaaaggccacaggc

SEQ ID NO: 4574568 - DNA, 12 bp, Homo sapiens
gtgacttcactg

SEQ ID NO: 4574569 - DNA, 15 bp, Homo sapiens
gtgacttctgctgct

SEQ ID NO: 4574570 - DNA, 21 bp, Homo sapiens
gtgacttgcaatccaggctgt

SEQ ID NO: 4574571 - DNA, 18 bp, Homo sapiens
gtgagaccatgtttcaaa

SEQ ID NO: 4574572 - DNA, 14 bp, Homo sapiens
gtgagacccccaca

SEQ ID NO: 4574573 - DNA, 14 bp, Homo sapiens
gtgagactccatct

SEQ ID NO: 4574574 - DNA, 15 bp, Homo sapiens
gtgagactccatctc

SEQ ID NO: 4574575 - DNA, 17 bp, Homo sapiens
gtgagagacctgctcag

SEQ ID NO: 4574576 - DNA, 19 bp, Homo sapiens
gtgagagacctgctcaggc

SEQ ID NO: 4574577 - DNA, 11 bp, Homo sapiens
gtgagagagga

SEQ ID NO: 4574578 - DNA, 17 bp, Homo sapiens
gtgagagggctgttaac

SEQ ID NO: 4574579 - DNA, 22 bp, Homo sapiens
gtgagatttccttatcacagaa

SEQ ID NO: 4574580 - DNA, 15 bp, Homo sapiens
gtgagcaccaccagg

SEQ ID NO: 4574581 - DNA, 19 bp, Homo sapiens
gtgagcaggggaagcagga

SEQ ID NO: 4574582 - DNA, 21 bp, Homo sapiens
gtgagcagtcgcctgcctgca

SEQ ID NO: 4574583 - DNA, 16 bp, Homo sapiens
gtgagcatgggtgtgc

SEQ ID NO: 4574584 - DNA, 15 bp, Homo sapiens
gtgagcccctcccca

SEQ ID NO: 4574585 - DNA, 16 bp, Homo sapiens
gtgagcccctccccag

SEQ ID NO: 4574586 - DNA, 24 bp, Homo sapiens
gtgagccctgctcttctctcccca

SEQ ID NO: 4574587 - DNA, 13 bp, Homo sapiens
gtgagcctcctgt

SEQ ID NO: 4574588 - DNA, 15 bp, Homo sapiens
gtgagcctcctgtgc

SEQ ID NO: 4574589 - DNA, 19 bp, Homo sapiens
gtgagcctcctgtgcctgg

SEQ ID NO: 4574590 - DNA, 21 bp, Homo sapiens
gtgagcctcctgtgcctggcc

SEQ ID NO: 4574591 - DNA, 22 bp, Homo sapiens
gtgagctctcaggccgagagcc

SEQ ID NO: 4574592 - DNA, 15 bp, Homo sapiens
gtgagctggtagagg

SEQ ID NO: 4574593 - DNA, 22 bp, Homo sapiens
gtgaggactctttccgactgcc

SEQ ID NO: 4574594 - DNA, 14 bp, Homo sapiens
gtgaggagctgctg

SEQ ID NO: 4574595 - DNA, 15 bp, Homo sapiens
gtgaggagctgctgg

SEQ ID NO: 4574596 - DNA, 18 bp, Homo sapiens
gtgagtaattttggattt

SEQ ID NO: 4574597 - DNA, 17 bp, Homo sapiens
gtgagtgtttttatctt

SEQ ID NO: 4574598 - DNA, 15 bp, Homo sapiens
gtgagttgcatgttt

SEQ ID NO: 4574599 - DNA, 15 bp, Homo sapiens
gtgagtttgagctgc

SEQ ID NO: 4574600 - DNA, 14 bp, Homo sapiens
gtgagttttgttca

SEQ ID NO: 4574601 - DNA, 17 bp, Homo sapiens
gtgataaatcagtcaag

SEQ ID NO: 4574602 - DNA, 14 bp, Homo sapiens
gtgatcatatgagg

SEQ ID NO: 4574603 - DNA, 13 bp, Homo sapiens
gtgatctctgctg

SEQ ID NO: 4574604 - DNA, 13 bp, Homo sapiens
gtgatctgggcat

SEQ ID NO: 4574605 - DNA, 22 bp, Homo sapiens
gtgatgaatgtactatgtctga

SEQ ID NO: 4574606 - DNA, 13 bp, Homo sapiens
gtgatgacatatt

SEQ ID NO: 4574607 - DNA, 17 bp, Homo sapiens
gtgatggaaactgccaa

SEQ ID NO: 4574608 - DNA, 15 bp, Homo sapiens
gtgatgtaaaaatgc

SEQ ID NO: 4574609 - DNA, 14 bp, Homo sapiens
gtgatgtattttca

SEQ ID NO: 4574610 - DNA, 16 bp, Homo sapiens
gtgatgtattttcata

SEQ ID NO: 4574611 - DNA, 10 bp, Homo sapiens
gtgatgtgga

SEQ ID NO: 4574612 - DNA, 22 bp, Homo sapiens
gtgatgtggaggaagagccacc

SEQ ID NO: 4574613 - DNA, 10 bp, Homo sapiens
gtgatgtgtc

SEQ ID NO: 4574614 - DNA, 18 bp, Homo sapiens
gtgatgtttggattgata

SEQ ID NO: 4574615 - DNA, 13 bp, Homo sapiens
gtgattaaaattt

SEQ ID NO: 4574616 - DNA, 21 bp, Homo sapiens
gtgattcaatctgtaaactgt

SEQ ID NO: 4574617 - DNA, 21 bp, Homo sapiens
gtgattccctgcacaccagag

SEQ ID NO: 4574618 - DNA, 22 bp, Homo sapiens
gtgatttaagggcccaggtcag

SEQ ID NO: 4574619 - DNA, 17 bp, Homo sapiens
gtgattttcaagcagca

SEQ ID NO: 4574620 - DNA, 22 bp, Homo sapiens
gtgcaaaatgtgtttcagccgt

SEQ ID NO: 4574621 - DNA, 21 bp, Homo sapiens
gtgcaaacatggagaaatcta

SEQ ID NO: 4574622 - DNA, 18 bp, Homo sapiens
gtgcaaattcagaactga

SEQ ID NO: 4574623 - DNA, 22 bp, Homo sapiens
gtgcaacccaaggactgaggga

SEQ ID NO: 4574624 - DNA, 16 bp, Homo sapiens
gtgcaaggtggccttt

SEQ ID NO: 4574625 - DNA, 17 bp, Homo sapiens
gtgcaaggtggcctttg

SEQ ID NO: 4574626 - DNA, 12 bp, Homo sapiens
gtgcaatagaag

SEQ ID NO: 4574627 - DNA, 17 bp, Homo sapiens
gtgcaatgggtaaggga

SEQ ID NO: 4574628 - DNA, 19 bp, Homo sapiens
gtgcaatgggtaagggagg

SEQ ID NO: 4574629 - DNA, 23 bp, Homo sapiens
gtgcaatgggtaagggagggaag

SEQ ID NO: 4574630 - DNA, 16 bp, Homo sapiens
gtgcaattaacatatg

SEQ ID NO: 4574631 - DNA, 14 bp, Homo sapiens
gtgcaatttctgta

SEQ ID NO: 4574632 - DNA, 19 bp, Homo sapiens
gtgcacaataaagggggtt

SEQ ID NO: 4574633 - DNA, 18 bp, Homo sapiens
gtgcacatctgtgtcttg

SEQ ID NO: 4574634 - DNA, 23 bp, Homo sapiens
gtgcacccatgggctctgacaga

SEQ ID NO: 4574635 - DNA, 16 bp, Homo sapiens
gtgcacgtggagagct

SEQ ID NO: 4574636 - DNA, 15 bp, Homo sapiens
gtgcactccagcttc

SEQ ID NO: 4574637 - DNA, 16 bp, Homo sapiens
gtgcagcagggaaggc

SEQ ID NO: 4574638 - DNA, 20 bp, Homo sapiens
gtgcagcttcgaggacagga

SEQ ID NO: 4574639 - DNA, 13 bp, Homo sapiens
gtgcaggctgcag

SEQ ID NO: 4574640 - DNA, 22 bp, Homo sapiens
gtgcaggctgcagtggctcccc

SEQ ID NO: 4574641 - DNA, 18 bp, Homo sapiens
gtgcagggaagtgcagag

SEQ ID NO: 4574642 - DNA, 16 bp, Homo sapiens
gtgcagggctggtctt

SEQ ID NO: 4574643 - DNA, 15 bp, Homo sapiens
gtgcagtactttgtg

SEQ ID NO: 4574644 - DNA, 14 bp, Homo sapiens
gtgcagtcagcttt

SEQ ID NO: 4574645 - DNA, 16 bp, Homo sapiens
gtgcagtcctgatcag

SEQ ID NO: 4574646 - DNA, 16 bp, Homo sapiens
gtgcagttgctgttta

SEQ ID NO: 4574647 - DNA, 19 bp, Homo sapiens
gtgcataatgctttggaaa

SEQ ID NO: 4574648 - DNA, 20 bp, Homo sapiens
gtgcataatgctttggaaaa

SEQ ID NO: 4574649 - DNA, 22 bp, Homo sapiens
gtgcatagttgtagacaaagta

SEQ ID NO: 4574650 - DNA, 18 bp, Homo sapiens
gtgcatcccccctgctca

SEQ ID NO: 4574651 - DNA, 21 bp, Homo sapiens
gtgcatcccccctgctcagca

SEQ ID NO: 4574652 - DNA, 19 bp, Homo sapiens
gtgcatgctctctgcagcc

SEQ ID NO: 4574653 - DNA, 21 bp, Homo sapiens
gtgcatgctctctgcagccag

SEQ ID NO: 4574654 - DNA, 13 bp, Homo sapiens
gtgcatggctcct

SEQ ID NO: 4574655 - DNA, 22 bp, Homo sapiens
gtgcattgatacatttttaaat

SEQ ID NO: 4574656 - DNA, 22 bp, Homo sapiens
gtgcattgtatagatataatga

SEQ ID NO: 4574657 - DNA, 19 bp, Homo sapiens
gtgcatttgagagaagcca

SEQ ID NO: 4574658 - DNA, 22 bp, Homo sapiens
gtgcatttgagagaagccacgc

SEQ ID NO: 4574659 - DNA, 24 bp, Homo sapiens
gtgcatttgagagaagccacgctg

SEQ ID NO: 4574660 - DNA, 16 bp, Homo sapiens
gtgcatttttaaactt

SEQ ID NO: 4574661 - DNA, 17 bp, Homo sapiens
gtgccaagccctggccc

SEQ ID NO: 4574662 - DNA, 14 bp, Homo sapiens
gtgccaatttcaag

SEQ ID NO: 4574663 - DNA, 18 bp, Homo sapiens
gtgccacagaggccccac

SEQ ID NO: 4574664 - DNA, 19 bp, Homo sapiens
gtgccaccacgcccagcta

SEQ ID NO: 4574665 - DNA, 19 bp, Homo sapiens
gtgccacccacctttgcca

SEQ ID NO: 4574666 - DNA, 22 bp, Homo sapiens
gtgccacccacctttgccacaa

SEQ ID NO: 4574667 - DNA, 22 bp, Homo sapiens
gtgccacctatgcctgtggtga

SEQ ID NO: 4574668 - DNA, 13 bp, Homo sapiens
gtgccactgcggg

SEQ ID NO: 4574669 - DNA, 22 bp, Homo sapiens
gtgccactgttcagcggagctg

SEQ ID NO: 4574670 - DNA, 13 bp, Homo sapiens
gtgccaggcccgg

SEQ ID NO: 4574671 - DNA, 17 bp, Homo sapiens
gtgccaggcccggggct

SEQ ID NO: 4574672 - DNA, 16 bp, Homo sapiens
gtgccaggtggctcag

SEQ ID NO: 4574673 - DNA, 24 bp, Homo sapiens
gtgccatcaccacggctcactgca

SEQ ID NO: 4574674 - DNA, 13 bp, Homo sapiens
gtgccatgctggg

SEQ ID NO: 4574675 - DNA, 14 bp, Homo sapiens
gtgccatgctgggc

SEQ ID NO: 4574676 - DNA, 16 bp, Homo sapiens
gtgccccatgcctgtc

SEQ ID NO: 4574677 - DNA, 18 bp, Homo sapiens
gtgccccatgcctgtcca

SEQ ID NO: 4574678 - DNA, 18 bp, Homo sapiens
gtgcccccgcctgccacc

SEQ ID NO: 4574679 - DNA, 19 bp, Homo sapiens
gtgcccccgcctgccaccg

SEQ ID NO: 4574680 - DNA, 17 bp, Homo sapiens
gtgcccgcatgtgtgcc

SEQ ID NO: 4574681 - DNA, 19 bp, Homo sapiens
gtgcccgcatgtgtgcctg

SEQ ID NO: 4574682 - DNA, 20 bp, Homo sapiens
gtgcccgcatgtgtgcctgg

SEQ ID NO: 4574683 - DNA, 20 bp, Homo sapiens
gtgcccggccaagtaaaatg

SEQ ID NO: 4574684 - DNA, 15 bp, Homo sapiens
gtgcccgtaatccca

SEQ ID NO: 4574685 - DNA, 19 bp, Homo sapiens
gtgcccgtaatcccagcta

SEQ ID NO: 4574686 - DNA, 14 bp, Homo sapiens
gtgccctccaaaga

SEQ ID NO: 4574687 - DNA, 13 bp, Homo sapiens
gtgccgcctgccc

SEQ ID NO: 4574688 - DNA, 17 bp, Homo sapiens
gtgcctaatggagaaga

SEQ ID NO: 4574689 - DNA, 16 bp, Homo sapiens
gtgcctagactgttac

SEQ ID NO: 4574690 - DNA, 17 bp, Homo sapiens
gtgcctagactgttact

SEQ ID NO: 4574691 - DNA, 21 bp, Homo sapiens
gtgcctccccccagaccccgc

SEQ ID NO: 4574692 - DNA, 16 bp, Homo sapiens
gtgcctctccctgctg

SEQ ID NO: 4574693 - DNA, 22 bp, Homo sapiens
gtgcctctccctgctgctccta

SEQ ID NO: 4574694 - DNA, 23 bp, Homo sapiens
gtgcctctccctgctgctcctag

SEQ ID NO: 4574695 - DNA, 16 bp, Homo sapiens
gtgcctgagaccaggg

SEQ ID NO: 4574696 - DNA, 15 bp, Homo sapiens
gtgcctgagaggcag

SEQ ID NO: 4574697 - DNA, 16 bp, Homo sapiens
gtgcctgagaggcagg

SEQ ID NO: 4574698 - DNA, 15 bp, Homo sapiens
gtgcctgccactctc

SEQ ID NO: 4574699 - DNA, 14 bp, Homo sapiens
gtgcctggccccag

SEQ ID NO: 4574700 - DNA, 12 bp, Homo sapiens
gtgcctggctcc

SEQ ID NO: 4574701 - DNA, 21 bp, Homo sapiens
gtgcctgggagagtggacctg

SEQ ID NO: 4574702 - DNA, 17 bp, Homo sapiens
gtgcctgggtggggctg

SEQ ID NO: 4574703 - DNA, 18 bp, Homo sapiens
gtgcctgggtggggctgc

SEQ ID NO: 4574704 - DNA, 19 bp, Homo sapiens
gtgcctggttaatattaat

SEQ ID NO: 4574705 - DNA, 16 bp, Homo sapiens
gtgcctgtgaggcagg

SEQ ID NO: 4574706 - DNA, 15 bp, Homo sapiens
gtgccttacctcctg

SEQ ID NO: 4574707 - DNA, 23 bp, Homo sapiens
gtgccttaggaatgacttgggtt

SEQ ID NO: 4574708 - DNA, 18 bp, Homo sapiens
gtgccttattacccagga

SEQ ID NO: 4574709 - DNA, 19 bp, Homo sapiens
gtgccttcactgggccagt

SEQ ID NO: 4574710 - DNA, 23 bp, Homo sapiens
gtgccttccagatcctctctggg

SEQ ID NO: 4574711 - DNA, 11 bp, Homo sapiens
gtgccttctct

SEQ ID NO: 4574712 - DNA, 12 bp, Homo sapiens
gtgccttctggg

SEQ ID NO: 4574713 - DNA, 17 bp, Homo sapiens
gtgccttctgtggggac

SEQ ID NO: 4574714 - DNA, 20 bp, Homo sapiens
gtgccttggggaatttcctc

SEQ ID NO: 4574715 - DNA, 18 bp, Homo sapiens
gtgcctttcaaatttaga

SEQ ID NO: 4574716 - DNA, 18 bp, Homo sapiens
gtgcctttccctcctaaa

SEQ ID NO: 4574717 - DNA, 22 bp, Homo sapiens
gtgcctttcctgttcagcattc

SEQ ID NO: 4574718 - DNA, 14 bp, Homo sapiens
gtgcctttggcctg

SEQ ID NO: 4574719 - DNA, 23 bp, Homo sapiens
gtgcgcgccaccgtgcctggcta

SEQ ID NO: 4574720 - DNA, 19 bp, Homo sapiens
gtgcgggatacagctgagt

SEQ ID NO: 4574721 - DNA, 13 bp, Homo sapiens
gtgcggggtacac

SEQ ID NO: 4574722 - DNA, 19 bp, Homo sapiens
gtgcgtatgcagtgtagat

SEQ ID NO: 4574723 - DNA, 16 bp, Homo sapiens
gtgctaaaaatgaaaa

SEQ ID NO: 4574724 - DNA, 14 bp, Homo sapiens
gtgctaaaccaagt

SEQ ID NO: 4574725 - DNA, 15 bp, Homo sapiens
gtgctacaaaaacac

SEQ ID NO: 4574726 - DNA, 21 bp, Homo sapiens
gtgctacaaaaacacagcaag

SEQ ID NO: 4574727 - DNA, 20 bp, Homo sapiens
gtgctacgtacatgtgaggc

SEQ ID NO: 4574728 - DNA, 20 bp, Homo sapiens
gtgctactccatgcaggggt

SEQ ID NO: 4574729 - DNA, 22 bp, Homo sapiens
gtgctataatctgtttttacgt

SEQ ID NO: 4574730 - DNA, 21 bp, Homo sapiens
gtgctatactgcatacttttt

SEQ ID NO: 4574731 - DNA, 15 bp, Homo sapiens
gtgctatagtatttg

SEQ ID NO: 4574732 - DNA, 13 bp, Homo sapiens
gtgctattaatat

SEQ ID NO: 4574733 - DNA, 18 bp, Homo sapiens
gtgctcaccagccctgca

SEQ ID NO: 4574734 - DNA, 19 bp, Homo sapiens
gtgctcaccatgcttccag

SEQ ID NO: 4574735 - DNA, 13 bp, Homo sapiens
gtgctcctgtgct

SEQ ID NO: 4574736 - DNA, 13 bp, Homo sapiens
gtgctcggacaca

SEQ ID NO: 4574737 - DNA, 14 bp, Homo sapiens
gtgctctgcctcag

SEQ ID NO: 4574738 - DNA, 14 bp, Homo sapiens
gtgctcttttctcc

SEQ ID NO: 4574739 - DNA, 19 bp, Homo sapiens
gtgctgaagcaaagtgccc

SEQ ID NO: 4574740 - DNA, 14 bp, Homo sapiens
gtgctgaccctcct

SEQ ID NO: 4574741 - DNA, 18 bp, Homo sapiens
gtgctgaccctcctgttg

SEQ ID NO: 4574742 - DNA, 18 bp, Homo sapiens
gtgctgcagctccctggc

SEQ ID NO: 4574743 - DNA, 16 bp, Homo sapiens
gtgctgccaacttgat

SEQ ID NO: 4574744 - DNA, 23 bp, Homo sapiens
gtgctgcccagcagcccctgaga

SEQ ID NO: 4574745 - DNA, 11 bp, Homo sapiens
gtgctgccctg

SEQ ID NO: 4574746 - DNA, 17 bp, Homo sapiens
gtgctgccgagggctgg

SEQ ID NO: 4574747 - DNA, 19 bp, Homo sapiens
gtgctgccgagggctggcc

SEQ ID NO: 4574748 - DNA, 12 bp, Homo sapiens
gtgctgcctcta

SEQ ID NO: 4574749 - DNA, 20 bp, Homo sapiens
gtgctgcgcctgcaggcaga

SEQ ID NO: 4574750 - DNA, 15 bp, Homo sapiens
gtgctggaggggtgg

SEQ ID NO: 4574751 - DNA, 21 bp, Homo sapiens
gtgctggaggggtggcccaga

SEQ ID NO: 4574752 - DNA, 22 bp, Homo sapiens
gtgctggaggggtggcccagag

SEQ ID NO: 4574753 - DNA, 19 bp, Homo sapiens
gtgctggagttttgttggt

SEQ ID NO: 4574754 - DNA, 20 bp, Homo sapiens
gtgctggcccacccagtcca

SEQ ID NO: 4574755 - DNA, 22 bp, Homo sapiens
gtgctggcccacccagtccatg

SEQ ID NO: 4574756 - DNA, 14 bp, Homo sapiens
gtgctgggaaggga

SEQ ID NO: 4574757 - DNA, 18 bp, Homo sapiens
gtgctgggaagggagggt

SEQ ID NO: 4574758 - DNA, 15 bp, Homo sapiens
gtgctgggaggaggg

SEQ ID NO: 4574759 - DNA, 19 bp, Homo sapiens
gtgctgggaggagggagag

SEQ ID NO: 4574760 - DNA, 20 bp, Homo sapiens
gtgctgggattacaggcgtg

SEQ ID NO: 4574761 - DNA, 14 bp, Homo sapiens
gtgctgtgagggag

SEQ ID NO: 4574762 - DNA, 16 bp, Homo sapiens
gtgctgtgagggaggg

SEQ ID NO: 4574763 - DNA, 14 bp, Homo sapiens
gtgctgtggaagca

SEQ ID NO: 4574764 - DNA, 22 bp, Homo sapiens
gtgcttcatctgtgggatgctg

SEQ ID NO: 4574765 - DNA, 17 bp, Homo sapiens
gtgcttcgggcccttcc

SEQ ID NO: 4574766 - DNA, 22 bp, Homo sapiens
gtgcttctagttctgccaggag

SEQ ID NO: 4574767 - DNA, 13 bp, Homo sapiens
gtgcttgatctat

SEQ ID NO: 4574768 - DNA, 18 bp, Homo sapiens
gtgcttgatctatctaca

SEQ ID NO: 4574769 - DNA, 14 bp, Homo sapiens
gtgcttgctcccca

SEQ ID NO: 4574770 - DNA, 11 bp, Homo sapiens
gtgcttggatt

SEQ ID NO: 4574771 - DNA, 13 bp, Homo sapiens
gtgcttgggctcc

SEQ ID NO: 4574772 - DNA, 16 bp, Homo sapiens
gtgcttgtatagcttt

SEQ ID NO: 4574773 - DNA, 17 bp, Homo sapiens
gtgcttgttagagagaa

SEQ ID NO: 4574774 - DNA, 19 bp, Homo sapiens
gtgcttgtttacagcacta

SEQ ID NO: 4574775 - DNA, 22 bp, Homo sapiens
gtgctttattgaattagaaaat

SEQ ID NO: 4574776 - DNA, 15 bp, Homo sapiens
gtgctttccagctca

SEQ ID NO: 4574777 - DNA, 18 bp, Homo sapiens
gtgctttccagctcaccc

SEQ ID NO: 4574778 - DNA, 20 bp, Homo sapiens
gtgctttccagctcaccccc

SEQ ID NO: 4574779 - DNA, 19 bp, Homo sapiens
gtgctttttaagaatattt

SEQ ID NO: 4574780 - DNA, 16 bp, Homo sapiens
gtgctttttataaaaa

SEQ ID NO: 4574781 - DNA, 21 bp, Homo sapiens
gtggaaaacttatgctgattt

SEQ ID NO: 4574782 - DNA, 20 bp, Homo sapiens
gtggaaattaagactttatg

SEQ ID NO: 4574783 - DNA, 16 bp, Homo sapiens
gtggaacatctataga

SEQ ID NO: 4574784 - DNA, 16 bp, Homo sapiens
gtggaacgaaaatgaa

SEQ ID NO: 4574785 - DNA, 15 bp, Homo sapiens
gtggaagaagggaga

SEQ ID NO: 4574786 - DNA, 19 bp, Homo sapiens
gtggaagcagaggccctgc

SEQ ID NO: 4574787 - DNA, 14 bp, Homo sapiens
gtggaagccctcct

SEQ ID NO: 4574788 - DNA, 21 bp, Homo sapiens
gtggaagtgtgggtctgtgtg

SEQ ID NO: 4574789 - DNA, 15 bp, Homo sapiens
gtggaatgtcgcaga

SEQ ID NO: 4574790 - DNA, 16 bp, Homo sapiens
gtggaatgttggataa

SEQ ID NO: 4574791 - DNA, 20 bp, Homo sapiens
gtggaatgttggataaggaa

SEQ ID NO: 4574792 - DNA, 20 bp, Homo sapiens
gtggacaggatgaggacaga

SEQ ID NO: 4574793 - DNA, 20 bp, Homo sapiens
gtggaccaattattgatata

SEQ ID NO: 4574794 - DNA, 14 bp, Homo sapiens
gtggacctgtgctg

SEQ ID NO: 4574795 - DNA, 17 bp, Homo sapiens
gtggacgctgcagaccc

SEQ ID NO: 4574796 - DNA, 18 bp, Homo sapiens
gtggactgagtgggaagc

SEQ ID NO: 4574797 - DNA, 14 bp, Homo sapiens
gtggactgcgctgg

SEQ ID NO: 4574798 - DNA, 23 bp, Homo sapiens
gtggagaccctgccacagccaga

SEQ ID NO: 4574799 - DNA, 16 bp, Homo sapiens
gtggaggaagagccac

SEQ ID NO: 4574800 - DNA, 21 bp, Homo sapiens
gtggaggaagagccacctgca

SEQ ID NO: 4574801 - DNA, 16 bp, Homo sapiens
gtggaggaagggctgg

SEQ ID NO: 4574802 - DNA, 17 bp, Homo sapiens
gtggaggaagggctggg

SEQ ID NO: 4574803 - DNA, 19 bp, Homo sapiens
gtggaggaggaaggcaaga

SEQ ID NO: 4574804 - DNA, 13 bp, Homo sapiens
gtggaggcttcct

SEQ ID NO: 4574805 - DNA, 12 bp, Homo sapiens
gtggagggaggg

SEQ ID NO: 4574806 - DNA, 12 bp, Homo sapiens
gtggagggccac

SEQ ID NO: 4574807 - DNA, 18 bp, Homo sapiens
gtggagtctgagtctgag

SEQ ID NO: 4574808 - DNA, 14 bp, Homo sapiens
gtggagtttctctg

SEQ ID NO: 4574809 - DNA, 20 bp, Homo sapiens
gtggataagtggctgtttca

SEQ ID NO: 4574810 - DNA, 17 bp, Homo sapiens
gtggatacgtgtcaatg

SEQ ID NO: 4574811 - DNA, 13 bp, Homo sapiens
gtggatcacagag

SEQ ID NO: 4574812 - DNA, 19 bp, Homo sapiens
gtggatcacctgaggtcag

SEQ ID NO: 4574813 - DNA, 14 bp, Homo sapiens
gtggatcttcagaa

SEQ ID NO: 4574814 - DNA, 12 bp, Homo sapiens
gtggatgaaaaa

SEQ ID NO: 4574815 - DNA, 12 bp, Homo sapiens
gtggatgatcaa

SEQ ID NO: 4574816 - DNA, 18 bp, Homo sapiens
gtggatgtgctggagggg

SEQ ID NO: 4574817 - DNA, 18 bp, Homo sapiens
gtggattctgaggccctg

SEQ ID NO: 4574818 - DNA, 20 bp, Homo sapiens
gtggatttggagaccgaaga

SEQ ID NO: 4574819 - DNA, 20 bp, Homo sapiens
gtggcaccagatgcaacctc

SEQ ID NO: 4574820 - DNA, 13 bp, Homo sapiens
gtggcacctgcag

SEQ ID NO: 4574821 - DNA, 18 bp, Homo sapiens
gtggcacgtattgctgtg

SEQ ID NO: 4574822 - DNA, 17 bp, Homo sapiens
gtggcactggggcaggg

SEQ ID NO: 4574823 - DNA, 20 bp, Homo sapiens
gtggcaggcacacagcagcc

SEQ ID NO: 4574824 - DNA, 22 bp, Homo sapiens
gtggcaggcacacagcagcccc

SEQ ID NO: 4574825 - DNA, 18 bp, Homo sapiens
gtggcagggggccccgcc

SEQ ID NO: 4574826 - DNA, 15 bp, Homo sapiens
gtggcatcacagacc

SEQ ID NO: 4574827 - DNA, 22 bp, Homo sapiens
gtggcatcacagaccccagctg

SEQ ID NO: 4574828 - DNA, 18 bp, Homo sapiens
gtggcatctttgccttgg

SEQ ID NO: 4574829 - DNA, 21 bp, Homo sapiens
gtggcatctttgccttgggct

SEQ ID NO: 4574830 - DNA, 21 bp, Homo sapiens
gtggcattggggggccgggca

SEQ ID NO: 4574831 - DNA, 23 bp, Homo sapiens
gtggccaagaagcagtggcctta

SEQ ID NO: 4574832 - DNA, 21 bp, Homo sapiens
gtggccacacaggcagggcct

SEQ ID NO: 4574833 - DNA, 23 bp, Homo sapiens
gtggccacacctctatcccggct

SEQ ID NO: 4574834 - DNA, 19 bp, Homo sapiens
gtggccacagcaagtacag

SEQ ID NO: 4574835 - DNA, 13 bp, Homo sapiens
gtggccaccagta

SEQ ID NO: 4574836 - DNA, 15 bp, Homo sapiens
gtggccactggggtg

SEQ ID NO: 4574837 - DNA, 18 bp, Homo sapiens
gtggccactggggtgcct

SEQ ID NO: 4574838 - DNA, 22 bp, Homo sapiens
gtggccagaaataaagggacca

SEQ ID NO: 4574839 - DNA, 19 bp, Homo sapiens
gtggccaggggtgctcctg

SEQ ID NO: 4574840 - DNA, 13 bp, Homo sapiens
gtggccaggtgcc

SEQ ID NO: 4574841 - DNA, 21 bp, Homo sapiens
gtggccatatatgctgtattt

SEQ ID NO: 4574842 - DNA, 15 bp, Homo sapiens
gtggccatccctggg

SEQ ID NO: 4574843 - DNA, 17 bp, Homo sapiens
gtggccatccctgggcc

SEQ ID NO: 4574844 - DNA, 22 bp, Homo sapiens
gtggccatccctgggcccctcc

SEQ ID NO: 4574845 - DNA, 13 bp, Homo sapiens
gtggcccagagcc

SEQ ID NO: 4574846 - DNA, 15 bp, Homo sapiens
gtggcccagagccat

SEQ ID NO: 4574847 - DNA, 20 bp, Homo sapiens
gtggcccagcacgagcctgg

SEQ ID NO: 4574848 - DNA, 15 bp, Homo sapiens
gtggccccaagaggg

SEQ ID NO: 4574849 - DNA, 17 bp, Homo sapiens
gtggcccctcccctgca

SEQ ID NO: 4574850 - DNA, 19 bp, Homo sapiens
gtggccctggcctgctggg

SEQ ID NO: 4574851 - DNA, 11 bp, Homo sapiens
gtggcccttgc

SEQ ID NO: 4574852 - DNA, 14 bp, Homo sapiens
gtggccggcctcct

SEQ ID NO: 4574853 - DNA, 15 bp, Homo sapiens
gtggccggcctcctc

SEQ ID NO: 4574854 - DNA, 16 bp, Homo sapiens
gtggccggcctcctcc

SEQ ID NO: 4574855 - DNA, 15 bp, Homo sapiens
gtggccggtgccagc

SEQ ID NO: 4574856 - DNA, 17 bp, Homo sapiens
gtggccggtgccagctg

SEQ ID NO: 4574857 - DNA, 18 bp, Homo sapiens
gtggccggtgccagctgc

SEQ ID NO: 4574858 - DNA, 17 bp, Homo sapiens
gtggcctcagccctcag

SEQ ID NO: 4574859 - DNA, 15 bp, Homo sapiens
gtggcctccctgctg

SEQ ID NO: 4574860 - DNA, 20 bp, Homo sapiens
gtggcctggccaggagctct

SEQ ID NO: 4574861 - DNA, 20 bp, Homo sapiens
gtggcgagccatttgtccca

SEQ ID NO: 4574862 - DNA, 20 bp, Homo sapiens
gtggcgggaatgagctgtgt

SEQ ID NO: 4574863 - DNA, 19 bp, Homo sapiens
gtggctagtcagagagagt

SEQ ID NO: 4574864 - DNA, 19 bp, Homo sapiens
gtggctcagacccctcagc

SEQ ID NO: 4574865 - DNA, 21 bp, Homo sapiens
gtggctcagacccctcagccc

SEQ ID NO: 4574866 - DNA, 17 bp, Homo sapiens
gtggctctgggtgaggt

SEQ ID NO: 4574867 - DNA, 13 bp, Homo sapiens
gtggctgccccgg

SEQ ID NO: 4574868 - DNA, 14 bp, Homo sapiens
gtggctgctctggg

SEQ ID NO: 4574869 - DNA, 15 bp, Homo sapiens
gtggctggctctacc

SEQ ID NO: 4574870 - DNA, 16 bp, Homo sapiens
gtggctgggggcagga

SEQ ID NO: 4574871 - DNA, 17 bp, Homo sapiens
gtggctgggggcaggag

SEQ ID NO: 4574872 - DNA, 20 bp, Homo sapiens
gtggctggtgtccccttccc

SEQ ID NO: 4574873 - DNA, 22 bp, Homo sapiens
gtggcttgagaaatatggacac

SEQ ID NO: 4574874 - DNA, 17 bp, Homo sapiens
gtgggaacgactgggca

SEQ ID NO: 4574875 - DNA, 21 bp, Homo sapiens
gtgggaagcccatcctgacca

SEQ ID NO: 4574876 - DNA, 13 bp, Homo sapiens
gtgggaaggccag

SEQ ID NO: 4574877 - DNA, 13 bp, Homo sapiens
gtgggaagggaga

SEQ ID NO: 4574878 - DNA, 17 bp, Homo sapiens
gtgggacagaggagcaa

SEQ ID NO: 4574879 - DNA, 16 bp, Homo sapiens
gtgggacatggaaaag

SEQ ID NO: 4574880 - DNA, 14 bp, Homo sapiens
gtgggactgtacac

SEQ ID NO: 4574881 - DNA, 22 bp, Homo sapiens
gtgggactgtacacactttatt

SEQ ID NO: 4574882 - DNA, 13 bp, Homo sapiens
gtgggagggagga

SEQ ID NO: 4574883 - DNA, 17 bp, Homo sapiens
gtgggagggaggaggga

SEQ ID NO: 4574884 - DNA, 17 bp, Homo sapiens
gtgggaggtggaagaag

SEQ ID NO: 4574885 - DNA, 13 bp, Homo sapiens
gtgggagtgtgta

SEQ ID NO: 4574886 - DNA, 14 bp, Homo sapiens
gtgggagtgtgtgc

SEQ ID NO: 4574887 - DNA, 19 bp, Homo sapiens
gtgggatccacgctgggcc

SEQ ID NO: 4574888 - DNA, 14 bp, Homo sapiens
gtgggatcctccct

SEQ ID NO: 4574889 - DNA, 12 bp, Homo sapiens
gtgggcactggc

SEQ ID NO: 4574890 - DNA, 14 bp, Homo sapiens
gtgggccaggacag

SEQ ID NO: 4574891 - DNA, 13 bp, Homo sapiens
gtgggcctggccc

SEQ ID NO: 4574892 - DNA, 15 bp, Homo sapiens
gtgggccttgctggg

SEQ ID NO: 4574893 - DNA, 14 bp, Homo sapiens
gtgggctccctgac

SEQ ID NO: 4574894 - DNA, 15 bp, Homo sapiens
gtgggctccctgact

SEQ ID NO: 4574895 - DNA, 18 bp, Homo sapiens
gtgggctctgtgcagtca

SEQ ID NO: 4574896 - DNA, 14 bp, Homo sapiens
gtgggcttcctgcc

SEQ ID NO: 4574897 - DNA, 19 bp, Homo sapiens
gtggggaacggaggaggac

SEQ ID NO: 4574898 - DNA, 21 bp, Homo sapiens
gtggggagagacgggccctgg

SEQ ID NO: 4574899 - DNA, 19 bp, Homo sapiens
gtggggaggcccaaatgat

SEQ ID NO: 4574900 - DNA, 12 bp, Homo sapiens
gtggggcccctc

SEQ ID NO: 4574901 - DNA, 21 bp, Homo sapiens
gtggggcctttgccagcagag

SEQ ID NO: 4574902 - DNA, 12 bp, Homo sapiens
gtggggctgctc

SEQ ID NO: 4574903 - DNA, 16 bp, Homo sapiens
gtggggctgctcctcc

SEQ ID NO: 4574904 - DNA, 18 bp, Homo sapiens
gtgggggcagagggcaga

SEQ ID NO: 4574905 - DNA, 17 bp, Homo sapiens
gtggggggtctgtgtca

SEQ ID NO: 4574906 - DNA, 10 bp, Homo sapiens
gtgggggtgg

SEQ ID NO: 4574907 - DNA, 20 bp, Homo sapiens
gtgggggtggaggcttcctg

SEQ ID NO: 4574908 - DNA, 15 bp, Homo sapiens
gtgggggtgggtcag

SEQ ID NO: 4574909 - DNA, 14 bp, Homo sapiens
gtgggtcagaaccc

SEQ ID NO: 4574910 - DNA, 19 bp, Homo sapiens
gtgggtccaggggcccctc

SEQ ID NO: 4574911 - DNA, 23 bp, Homo sapiens
gtgggtccaggggcccctccagc

SEQ ID NO: 4574912 - DNA, 18 bp, Homo sapiens
gtgggtccatgggcagag

SEQ ID NO: 4574913 - DNA, 20 bp, Homo sapiens
gtgggtccatgggcagagcc

SEQ ID NO: 4574914 - DNA, 19 bp, Homo sapiens
gtgggtctatgttccccag

SEQ ID NO: 4574915 - DNA, 13 bp, Homo sapiens
gtgggtctctgaa

SEQ ID NO: 4574916 - DNA, 16 bp, Homo sapiens
gtgggtctgtgtgtgt

SEQ ID NO: 4574917 - DNA, 22 bp, Homo sapiens
gtgggtgagctctcaggccgag

SEQ ID NO: 4574918 - DNA, 17 bp, Homo sapiens
gtgggtgttctttcctg

SEQ ID NO: 4574919 - DNA, 20 bp, Homo sapiens
gtgggtgttctttcctgccc

SEQ ID NO: 4574920 - DNA, 21 bp, Homo sapiens
gtgggttatcatggaagaaaa

SEQ ID NO: 4574921 - DNA, 16 bp, Homo sapiens
gtgggttttcttccca

SEQ ID NO: 4574922 - DNA, 16 bp, Homo sapiens
gtggtaaatactgtga

SEQ ID NO: 4574923 - DNA, 21 bp, Homo sapiens
gtggtaaatactgtgaaatac

SEQ ID NO: 4574924 - DNA, 23 bp, Homo sapiens
gtggtaaccagccctgcacgacc

SEQ ID NO: 4574925 - DNA, 17 bp, Homo sapiens
gtggtaatctacaccaa

SEQ ID NO: 4574926 - DNA, 16 bp, Homo sapiens
gtggtagctccagcga

SEQ ID NO: 4574927 - DNA, 19 bp, Homo sapiens
gtggtcgtcaactttcctc

SEQ ID NO: 4574928 - DNA, 22 bp, Homo sapiens
gtggtcgtcaactttcctcaaa

SEQ ID NO: 4574929 - DNA, 12 bp, Homo sapiens
gtggtcttcctt

SEQ ID NO: 4574930 - DNA, 18 bp, Homo sapiens
gtggtgaagtgtggctgg

SEQ ID NO: 4574931 - DNA, 20 bp, Homo sapiens
gtggtgaagtgtggctggtg

SEQ ID NO: 4574932 - DNA, 22 bp, Homo sapiens
gtggtgaagtgtggctggtgtc

SEQ ID NO: 4574933 - DNA, 17 bp, Homo sapiens
gtggtgacacctccccc

SEQ ID NO: 4574934 - DNA, 17 bp, Homo sapiens
gtggtgcagccttcccc

SEQ ID NO: 4574935 - DNA, 13 bp, Homo sapiens
gtggtgtgactct

SEQ ID NO: 4574936 - DNA, 14 bp, Homo sapiens
gtggttaggcagca

SEQ ID NO: 4574937 - DNA, 19 bp, Homo sapiens
gtggttcaagcacactgga

SEQ ID NO: 4574938 - DNA, 16 bp, Homo sapiens
gtggttcctctgctca

SEQ ID NO: 4574939 - DNA, 12 bp, Homo sapiens
gtggtttggaat

SEQ ID NO: 4574940 - DNA, 20 bp, Homo sapiens
gtgtaaaattaatgtaataa

SEQ ID NO: 4574941 - DNA, 23 bp, Homo sapiens
gtgtaaaattaatgtaataaagt

SEQ ID NO: 4574942 - DNA, 14 bp, Homo sapiens
gtgtaaagactgag

SEQ ID NO: 4574943 - DNA, 17 bp, Homo sapiens
gtgtaaagatttataca

SEQ ID NO: 4574944 - DNA, 12 bp, Homo sapiens
gtgtaaatttgt

SEQ ID NO: 4574945 - DNA, 21 bp, Homo sapiens
gtgtaacttgcttaaatttct

SEQ ID NO: 4574946 - DNA, 18 bp, Homo sapiens
gtgtaagaactgtacatt

SEQ ID NO: 4574947 - DNA, 14 bp, Homo sapiens
gtgtaataaagtgt

SEQ ID NO: 4574948 - DNA, 15 bp, Homo sapiens
gtgtaataaagtgtt

SEQ ID NO: 4574949 - DNA, 20 bp, Homo sapiens
gtgtaataaagtgttttcag

SEQ ID NO: 4574950 - DNA, 15 bp, Homo sapiens
gtgtaatcattttaa

SEQ ID NO: 4574951 - DNA, 19 bp, Homo sapiens
gtgtaatctaagtatatgt

SEQ ID NO: 4574952 - DNA, 15 bp, Homo sapiens
gtgtaatggatcaaa

SEQ ID NO: 4574953 - DNA, 14 bp, Homo sapiens
gtgtaatttgaaga

SEQ ID NO: 4574954 - DNA, 13 bp, Homo sapiens
gtgtacaactttt

SEQ ID NO: 4574955 - DNA, 19 bp, Homo sapiens
gtgtacacgtctggacccc

SEQ ID NO: 4574956 - DNA, 14 bp, Homo sapiens
gtgtacagactctt

SEQ ID NO: 4574957 - DNA, 21 bp, Homo sapiens
gtgtaccaagtgcttcctaca

SEQ ID NO: 4574958 - DNA, 17 bp, Homo sapiens
gtgtacctcactgtcca

SEQ ID NO: 4574959 - DNA, 13 bp, Homo sapiens
gtgtactcagggc

SEQ ID NO: 4574960 - DNA, 16 bp, Homo sapiens
gtgtagatttctgaca

SEQ ID NO: 4574961 - DNA, 23 bp, Homo sapiens
gtgtagctgcaaaaataatcatg

SEQ ID NO: 4574962 - DNA, 14 bp, Homo sapiens
gtgtataaaacatt

SEQ ID NO: 4574963 - DNA, 14 bp, Homo sapiens
gtgtataggaattt

SEQ ID NO: 4574964 - DNA, 17 bp, Homo sapiens
gtgtatagtgttcacaa

SEQ ID NO: 4574965 - DNA, 16 bp, Homo sapiens
gtgtatatctcttgga

SEQ ID NO: 4574966 - DNA, 19 bp, Homo sapiens
gtgtatcagtgtttatgtg

SEQ ID NO: 4574967 - DNA, 20 bp, Homo sapiens
gtgtattatggttcaccagg

SEQ ID NO: 4574968 - DNA, 19 bp, Homo sapiens
gtgtattctagttttgtca

SEQ ID NO: 4574969 - DNA, 20 bp, Homo sapiens
gtgtatttaattgtaaactg

SEQ ID NO: 4574970 - DNA, 16 bp, Homo sapiens
gtgtatttatttaaaa

SEQ ID NO: 4574971 - DNA, 18 bp, Homo sapiens
gtgtatttatttaaaact

SEQ ID NO: 4574972 - DNA, 10 bp, Homo sapiens
gtgtatttgc

SEQ ID NO: 4574973 - DNA, 14 bp, Homo sapiens
gtgtattttcagtc

SEQ ID NO: 4574974 - DNA, 19 bp, Homo sapiens
gtgtcaaataaacactgtg

SEQ ID NO: 4574975 - DNA, 15 bp, Homo sapiens
gtgtcagagcccagc

SEQ ID NO: 4574976 - DNA, 16 bp, Homo sapiens
gtgtcagagcccagcc

SEQ ID NO: 4574977 - DNA, 21 bp, Homo sapiens
gtgtcagagcccagcccagga

SEQ ID NO: 4574978 - DNA, 17 bp, Homo sapiens
gtgtcagccccacagga

SEQ ID NO: 4574979 - DNA, 23 bp, Homo sapiens
gtgtcataaacagatgaataaac

SEQ ID NO: 4574980 - DNA, 16 bp, Homo sapiens
gtgtcatttcattcca

SEQ ID NO: 4574981 - DNA, 17 bp, Homo sapiens
gtgtcatttcattccat

SEQ ID NO: 4574982 - DNA, 17 bp, Homo sapiens
gtgtcatttcttcactt

SEQ ID NO: 4574983 - DNA, 13 bp, Homo sapiens
gtgtccagagacc

SEQ ID NO: 4574984 - DNA, 21 bp, Homo sapiens
gtgtcccctcactctgtcagc

SEQ ID NO: 4574985 - DNA, 23 bp, Homo sapiens
gtgtccccttcccctgctgacct

SEQ ID NO: 4574986 - DNA, 16 bp, Homo sapiens
gtgtcctaaggcccat

SEQ ID NO: 4574987 - DNA, 16 bp, Homo sapiens
gtgtcctctccctgcc

SEQ ID NO: 4574988 - DNA, 21 bp, Homo sapiens
gtgtcctgcaccggggcctgg

SEQ ID NO: 4574989 - DNA, 18 bp, Homo sapiens
gtgtccttgcacctgcat

SEQ ID NO: 4574990 - DNA, 17 bp, Homo sapiens
gtgtctcagcctctgcc

SEQ ID NO: 4574991 - DNA, 15 bp, Homo sapiens
gtgtctcccaacatg

SEQ ID NO: 4574992 - DNA, 18 bp, Homo sapiens
gtgtctgacttttgttaa

SEQ ID NO: 4574993 - DNA, 16 bp, Homo sapiens
gtgtctggatcagtaa

SEQ ID NO: 4574994 - DNA, 13 bp, Homo sapiens
gtgtctgtattta

SEQ ID NO: 4574995 - DNA, 17 bp, Homo sapiens
gtgtcttccctgcctgt

SEQ ID NO: 4574996 - DNA, 14 bp, Homo sapiens
gtgtcttcctccca

SEQ ID NO: 4574997 - DNA, 14 bp, Homo sapiens
gtgtcttctgcccc

SEQ ID NO: 4574998 - DNA, 21 bp, Homo sapiens
gtgtctttctttggtgccttt

SEQ ID NO: 4574999 - DNA, 18 bp, Homo sapiens
gtgtctttgtttaaaatt

SEQ ID NO: 4575000 - DNA, 20 bp, Homo sapiens
gtgtgaaactttcattcctt

SEQ ID NO: 4575001 - DNA, 19 bp, Homo sapiens
gtgtgaatattcctttatt

SEQ ID NO: 4575002 - DNA, 21 bp, Homo sapiens
gtgtgaccactgcagaagaca

SEQ ID NO: 4575003 - DNA, 19 bp, Homo sapiens
gtgtgactattcatggcta

SEQ ID NO: 4575004 - DNA, 16 bp, Homo sapiens
gtgtgactttcaggct

SEQ ID NO: 4575005 - DNA, 12 bp, Homo sapiens
gtgtgagactgg

SEQ ID NO: 4575006 - DNA, 12 bp, Homo sapiens
gtgtgaggccag

SEQ ID NO: 4575007 - DNA, 19 bp, Homo sapiens
gtgtgagtgagggagacag

SEQ ID NO: 4575008 - DNA, 18 bp, Homo sapiens
gtgtgataaatcagtcaa

SEQ ID NO: 4575009 - DNA, 18 bp, Homo sapiens
gtgtgatccggtttcttt

SEQ ID NO: 4575010 - DNA, 16 bp, Homo sapiens
gtgtgcaccagggttg

SEQ ID NO: 4575011 - DNA, 12 bp, Homo sapiens
gtgtgcataata

SEQ ID NO: 4575012 - DNA, 14 bp, Homo sapiens
gtgtgccaagccct

SEQ ID NO: 4575013 - DNA, 16 bp, Homo sapiens
gtgtgccaagccctgg

SEQ ID NO: 4575014 - DNA, 17 bp, Homo sapiens
gtgtgccaagccctggc

SEQ ID NO: 4575015 - DNA, 11 bp, Homo sapiens
gtgtgccctgg

SEQ ID NO: 4575016 - DNA, 14 bp, Homo sapiens
gtgtgccctggact

SEQ ID NO: 4575017 - DNA, 16 bp, Homo sapiens
gtgtgccctggactgt

SEQ ID NO: 4575018 - DNA, 14 bp, Homo sapiens
gtgtgcccttgggg

SEQ ID NO: 4575019 - DNA, 19 bp, Homo sapiens
gtgtgcctggccgcagggc

SEQ ID NO: 4575020 - DNA, 15 bp, Homo sapiens
gtgtgctcaggggac

SEQ ID NO: 4575021 - DNA, 19 bp, Homo sapiens
gtgtgctctgagccacaga

SEQ ID NO: 4575022 - DNA, 17 bp, Homo sapiens
gtgtgctgtttgaaaat

SEQ ID NO: 4575023 - DNA, 16 bp, Homo sapiens
gtgtgctttttttgtg

SEQ ID NO: 4575024 - DNA, 23 bp, Homo sapiens
gtgtggagaagccacaggcctga

SEQ ID NO: 4575025 - DNA, 16 bp, Homo sapiens
gtgtggagaccctgcc

SEQ ID NO: 4575026 - DNA, 21 bp, Homo sapiens
gtgtggagaccctgccacagc

SEQ ID NO: 4575027 - DNA, 14 bp, Homo sapiens
gtgtggcagtggtt

SEQ ID NO: 4575028 - DNA, 13 bp, Homo sapiens
gtgtggcctcagc

SEQ ID NO: 4575029 - DNA, 21 bp, Homo sapiens
gtgtggcctcagccctcagaa

SEQ ID NO: 4575030 - DNA, 12 bp, Homo sapiens
gtgtggctctgc

SEQ ID NO: 4575031 - DNA, 20 bp, Homo sapiens
gtgtggctgaggaggcctcc

SEQ ID NO: 4575032 - DNA, 13 bp, Homo sapiens
gtgtgggaaggga

SEQ ID NO: 4575033 - DNA, 17 bp, Homo sapiens
gtgtgggggacggcttc

SEQ ID NO: 4575034 - DNA, 13 bp, Homo sapiens
gtgtggggtgggg

SEQ ID NO: 4575035 - DNA, 13 bp, Homo sapiens
gtgtgggtcccgc

SEQ ID NO: 4575036 - DNA, 12 bp, Homo sapiens
gtgtgtaaaatt

SEQ ID NO: 4575037 - DNA, 17 bp, Homo sapiens
gtgtgtacctgtggctg

SEQ ID NO: 4575038 - DNA, 17 bp, Homo sapiens
gtgtgtatatgtattta

SEQ ID NO: 4575039 - DNA, 12 bp, Homo sapiens
gtgtgtatgtgg

SEQ ID NO: 4575040 - DNA, 13 bp, Homo sapiens
gtgtgtatgtggg

SEQ ID NO: 4575041 - DNA, 15 bp, Homo sapiens
gtgtgtatgtggggg

SEQ ID NO: 4575042 - DNA, 20 bp, Homo sapiens
gtgtgtccacgactgtctcc

SEQ ID NO: 4575043 - DNA, 16 bp, Homo sapiens
gtgtgtccccctctgt

SEQ ID NO: 4575044 - DNA, 17 bp, Homo sapiens
gtgtgtccccctctgtc

SEQ ID NO: 4575045 - DNA, 18 bp, Homo sapiens
gtgtgtctttataaagct

SEQ ID NO: 4575046 - DNA, 17 bp, Homo sapiens
gtgtgtgacaattctgt

SEQ ID NO: 4575047 - DNA, 15 bp, Homo sapiens
gtgtgtgccaagagc

SEQ ID NO: 4575048 - DNA, 18 bp, Homo sapiens
gtgtgtgccaagccctgg

SEQ ID NO: 4575049 - DNA, 14 bp, Homo sapiens
gtgtgtggcagggg

SEQ ID NO: 4575050 - DNA, 12 bp, Homo sapiens
gtgtgtggccgg

SEQ ID NO: 4575051 - DNA, 12 bp, Homo sapiens
gtgtgtgtggcc

SEQ ID NO: 4575052 - DNA, 13 bp, Homo sapiens
gtgtgtgtggccg

SEQ ID NO: 4575053 - DNA, 24 bp, Homo sapiens
gtgtgttatttccccagccacagg

SEQ ID NO: 4575054 - DNA, 19 bp, Homo sapiens
gtgtgttgtgctttcaaga

SEQ ID NO: 4575055 - DNA, 22 bp, Homo sapiens
gtgtgtttccagatcgatcctg

SEQ ID NO: 4575056 - DNA, 21 bp, Homo sapiens
gtgtgtttttgggatgtctta

SEQ ID NO: 4575057 - DNA, 20 bp, Homo sapiens
gtgttaaacactacacattt

SEQ ID NO: 4575058 - DNA, 21 bp, Homo sapiens
gtgttaaatgtgatgaatact

SEQ ID NO: 4575059 - DNA, 23 bp, Homo sapiens
gtgttaatacatcacatcttatt

SEQ ID NO: 4575060 - DNA, 20 bp, Homo sapiens
gtgttaatcttaatgtatat

SEQ ID NO: 4575061 - DNA, 15 bp, Homo sapiens
gtgttaatttttgat

SEQ ID NO: 4575062 - DNA, 23 bp, Homo sapiens
gtgttacacagcccaagaggact

SEQ ID NO: 4575063 - DNA, 16 bp, Homo sapiens
gtgttacctgaaaaca

SEQ ID NO: 4575064 - DNA, 12 bp, Homo sapiens
gtgttacctgta

SEQ ID NO: 4575065 - DNA, 22 bp, Homo sapiens
gtgttagggaagggcctgccac

SEQ ID NO: 4575066 - DNA, 14 bp, Homo sapiens
gtgttaggtcaata

SEQ ID NO: 4575067 - DNA, 20 bp, Homo sapiens
gtgttatctacctcaaggta

SEQ ID NO: 4575068 - DNA, 22 bp, Homo sapiens
gtgttatgaacatccaagtctt

SEQ ID NO: 4575069 - DNA, 22 bp, Homo sapiens
gtgttatttccccagccacagg

SEQ ID NO: 4575070 - DNA, 14 bp, Homo sapiens
gtgttcaatatcag

SEQ ID NO: 4575071 - DNA, 14 bp, Homo sapiens
gtgttcaatatttt

SEQ ID NO: 4575072 - DNA, 14 bp, Homo sapiens
gtgttcattgtttc

SEQ ID NO: 4575073 - DNA, 21 bp, Homo sapiens
gtgttccagccaaagcatgcc

SEQ ID NO: 4575074 - DNA, 23 bp, Homo sapiens
gtgttccccttccactgagggca

SEQ ID NO: 4575075 - DNA, 20 bp, Homo sapiens
gtgttccctttgtctttcaa

SEQ ID NO: 4575076 - DNA, 21 bp, Homo sapiens
gtgttccctttgtctttcaaa

SEQ ID NO: 4575077 - DNA, 22 bp, Homo sapiens
gtgttccgtgggaccctcagca

SEQ ID NO: 4575078 - DNA, 16 bp, Homo sapiens
gtgttcctgaagctgc

SEQ ID NO: 4575079 - DNA, 14 bp, Homo sapiens
gtgttcgtttccat

SEQ ID NO: 4575080 - DNA, 20 bp, Homo sapiens
gtgttcgtttccatcatgtc

SEQ ID NO: 4575081 - DNA, 23 bp, Homo sapiens
gtgttcgtttccatcatgtctgt

SEQ ID NO: 4575082 - DNA, 16 bp, Homo sapiens
gtgttctaagactctg

SEQ ID NO: 4575083 - DNA, 23 bp, Homo sapiens
gtgttctatccaaacatgtattt

SEQ ID NO: 4575084 - DNA, 11 bp, Homo sapiens
gtgttctgggc

SEQ ID NO: 4575085 - DNA, 14 bp, Homo sapiens
gtgttctgggctgg

SEQ ID NO: 4575086 - DNA, 17 bp, Homo sapiens
gtgttctgggctggggc

SEQ ID NO: 4575087 - DNA, 12 bp, Homo sapiens
gtgttggaaaaa

SEQ ID NO: 4575088 - DNA, 20 bp, Homo sapiens
gtgttgtccctactttctct

SEQ ID NO: 4575089 - DNA, 18 bp, Homo sapiens
gtgtttatgtgctattaa

SEQ ID NO: 4575090 - DNA, 12 bp, Homo sapiens
gtgtttatgtgt

SEQ ID NO: 4575091 - DNA, 21 bp, Homo sapiens
gtgtttcattacttgaatgta

SEQ ID NO: 4575092 - DNA, 14 bp, Homo sapiens
gtgtttccatctca

SEQ ID NO: 4575093 - DNA, 17 bp, Homo sapiens
gtgtttcctcatctatg

SEQ ID NO: 4575094 - DNA, 16 bp, Homo sapiens
gtgtttctagcactgg

SEQ ID NO: 4575095 - DNA, 13 bp, Homo sapiens
gtgtttctttagt

SEQ ID NO: 4575096 - DNA, 14 bp, Homo sapiens
gtgtttgcttaaaa

SEQ ID NO: 4575097 - DNA, 15 bp, Homo sapiens
gtgtttgcttaaaat

SEQ ID NO: 4575098 - DNA, 16 bp, Homo sapiens
gtgttttaattgtaaa

SEQ ID NO: 4575099 - DNA, 14 bp, Homo sapiens
gtgttttctgtaga

SEQ ID NO: 4575100 - DNA, 23 bp, Homo sapiens
gtgttttctgtagactctaagat

SEQ ID NO: 4575101 - DNA, 20 bp, Homo sapiens
gtgttttgaaagaatagaac

SEQ ID NO: 4575102 - DNA, 16 bp, Homo sapiens
gtgtttttaaattttg

SEQ ID NO: 4575103 - DNA, 17 bp, Homo sapiens
gtgtttttaaattttgt

SEQ ID NO: 4575104 - DNA, 14 bp, Homo sapiens
gtgtttttctccag

SEQ ID NO: 4575105 - DNA, 15 bp, Homo sapiens
gtgtttttgggatgt

SEQ ID NO: 4575106 - DNA, 18 bp, Homo sapiens
gtgtttttgggatgtctt

SEQ ID NO: 4575107 - DNA, 13 bp, Homo sapiens
gtgttttttaaga

SEQ ID NO: 4575108 - DNA, 14 bp, Homo sapiens
gtgttttttaagat

SEQ ID NO: 4575109 - DNA, 14 bp, Homo sapiens
gtgttttttgcaac

SEQ ID NO: 4575110 - DNA, 18 bp, Homo sapiens
gtgtttttttctaaaaag

SEQ ID NO: 4575111 - DNA, 13 bp, Homo sapiens
gttaaaaattaaa

SEQ ID NO: 4575112 - DNA, 14 bp, Homo sapiens
gttaaaaattaaat

SEQ ID NO: 4575113 - DNA, 15 bp, Homo sapiens
gttaaaacatagctt

SEQ ID NO: 4575114 - DNA, 22 bp, Homo sapiens
gttaaaactcatcacataaaga

SEQ ID NO: 4575115 - DNA, 14 bp, Homo sapiens
gttaaaataaagct

SEQ ID NO: 4575116 - DNA, 15 bp, Homo sapiens
gttaaactgattagt

SEQ ID NO: 4575117 - DNA, 14 bp, Homo sapiens
gttaaagctaaact

SEQ ID NO: 4575118 - DNA, 18 bp, Homo sapiens
gttaaataaatagaaaga

SEQ ID NO: 4575119 - DNA, 23 bp, Homo sapiens
gttaaatgtaatataatgtattt

SEQ ID NO: 4575120 - DNA, 19 bp, Homo sapiens
gttaaatgtattcttggct

SEQ ID NO: 4575121 - DNA, 15 bp, Homo sapiens
gttaaattcagtaat

SEQ ID NO: 4575122 - DNA, 15 bp, Homo sapiens
gttaacagtatttct

SEQ ID NO: 4575123 - DNA, 21 bp, Homo sapiens
gttaactgttcttggaaaaaa

SEQ ID NO: 4575124 - DNA, 19 bp, Homo sapiens
gttaacttggtcagagcca

SEQ ID NO: 4575125 - DNA, 15 bp, Homo sapiens
gttaagaaagcactt

SEQ ID NO: 4575126 - DNA, 20 bp, Homo sapiens
gttaagcaaatttcatttca

SEQ ID NO: 4575127 - DNA, 19 bp, Homo sapiens
gttaagctaaagcagtgtt

SEQ ID NO: 4575128 - DNA, 20 bp, Homo sapiens
gttaagctaaagcagtgttt

SEQ ID NO: 4575129 - DNA, 18 bp, Homo sapiens
gttaagtctatctggtat

SEQ ID NO: 4575130 - DNA, 12 bp, Homo sapiens
gttaataaaagt

SEQ ID NO: 4575131 - DNA, 15 bp, Homo sapiens
gttaatatgtctttt

SEQ ID NO: 4575132 - DNA, 22 bp, Homo sapiens
gttaatatttgaattgccttgc

SEQ ID NO: 4575133 - DNA, 21 bp, Homo sapiens
gttaatcagaaagaaaaaatt

SEQ ID NO: 4575134 - DNA, 12 bp, Homo sapiens
gttaatgtggac

SEQ ID NO: 4575135 - DNA, 15 bp, Homo sapiens
gttaatgtggactgg

SEQ ID NO: 4575136 - DNA, 16 bp, Homo sapiens
gttaatttataatgta

SEQ ID NO: 4575137 - DNA, 16 bp, Homo sapiens
gttaatttatttagtt

SEQ ID NO: 4575138 - DNA, 18 bp, Homo sapiens
gttaatttgtgtgttttt

SEQ ID NO: 4575139 - DNA, 17 bp, Homo sapiens
gttaattttgaagtgct

SEQ ID NO: 4575140 - DNA, 16 bp, Homo sapiens
gttacacgtgcctgta

SEQ ID NO: 4575141 - DNA, 20 bp, Homo sapiens
gttacactgttagaacacta

SEQ ID NO: 4575142 - DNA, 15 bp, Homo sapiens
gttacagactgaaag

SEQ ID NO: 4575143 - DNA, 22 bp, Homo sapiens
gttacagtaatgtcataaagtg

SEQ ID NO: 4575144 - DNA, 20 bp, Homo sapiens
gttacatattatatgttcta

SEQ ID NO: 4575145 - DNA, 19 bp, Homo sapiens
gttaccaagtatgaagtat

SEQ ID NO: 4575146 - DNA, 21 bp, Homo sapiens
gttaccattttaacgctgcct

SEQ ID NO: 4575147 - DNA, 15 bp, Homo sapiens
gttacccaggctgga

SEQ ID NO: 4575148 - DNA, 16 bp, Homo sapiens
gttacctactttgact

SEQ ID NO: 4575149 - DNA, 19 bp, Homo sapiens
gttacctcctccatcttac

SEQ ID NO: 4575150 - DNA, 22 bp, Homo sapiens
gttaccttatagttactgtgta

SEQ ID NO: 4575151 - DNA, 13 bp, Homo sapiens
gttactaaaattt

SEQ ID NO: 4575152 - DNA, 20 bp, Homo sapiens
gttactcagcagcagagagc

SEQ ID NO: 4575153 - DNA, 13 bp, Homo sapiens
gttactcagccct

SEQ ID NO: 4575154 - DNA, 15 bp, Homo sapiens
gttactcagccctgg

SEQ ID NO: 4575155 - DNA, 17 bp, Homo sapiens
gttactcagccctgggc

SEQ ID NO: 4575156 - DNA, 14 bp, Homo sapiens
gttactctccaacc

SEQ ID NO: 4575157 - DNA, 14 bp, Homo sapiens
gttactgccttaat

SEQ ID NO: 4575158 - DNA, 21 bp, Homo sapiens
gttactgccttaataaaaaat

SEQ ID NO: 4575159 - DNA, 22 bp, Homo sapiens
gttactgctgattcttgtaaat

SEQ ID NO: 4575160 - DNA, 17 bp, Homo sapiens
gttactgcttctctttg

SEQ ID NO: 4575161 - DNA, 20 bp, Homo sapiens
gttactgcttctctttgtgc

SEQ ID NO: 4575162 - DNA, 13 bp, Homo sapiens
gttactgtaattc

SEQ ID NO: 4575163 - DNA, 18 bp, Homo sapiens
gttactgtatttttcaga

SEQ ID NO: 4575164 - DNA, 14 bp, Homo sapiens
gttacttcttctct

SEQ ID NO: 4575165 - DNA, 16 bp, Homo sapiens
gttacttcttctctta

SEQ ID NO: 4575166 - DNA, 16 bp, Homo sapiens
gttactttcaaaatga

SEQ ID NO: 4575167 - DNA, 22 bp, Homo sapiens
gttagaaaatgacttatttctg

SEQ ID NO: 4575168 - DNA, 20 bp, Homo sapiens
gttagaacactattttcaga

SEQ ID NO: 4575169 - DNA, 22 bp, Homo sapiens
gttagaacactattttcagaat

SEQ ID NO: 4575170 - DNA, 18 bp, Homo sapiens
gttagaacctagattcaa

SEQ ID NO: 4575171 - DNA, 23 bp, Homo sapiens
gttagaagcaaggagaaaatata

SEQ ID NO: 4575172 - DNA, 16 bp, Homo sapiens
gttagacttgctccct

SEQ ID NO: 4575173 - DNA, 17 bp, Homo sapiens
gttagacttgctccctc

SEQ ID NO: 4575174 - DNA, 18 bp, Homo sapiens
gttagacttgctccctct

SEQ ID NO: 4575175 - DNA, 19 bp, Homo sapiens
gttagacttgctccctctc

SEQ ID NO: 4575176 - DNA, 17 bp, Homo sapiens
gttagacttgtgtgcat

SEQ ID NO: 4575177 - DNA, 17 bp, Homo sapiens
gttagagagaaagagaa

SEQ ID NO: 4575178 - DNA, 17 bp, Homo sapiens
gttagaggaaaaatatt

SEQ ID NO: 4575179 - DNA, 22 bp, Homo sapiens
gttagatatttcgaccctgggg

SEQ ID NO: 4575180 - DNA, 12 bp, Homo sapiens
gttagatgtttg

SEQ ID NO: 4575181 - DNA, 18 bp, Homo sapiens
gttagcactgatagtcct

SEQ ID NO: 4575182 - DNA, 19 bp, Homo sapiens
gttagcagggatgttcctt

SEQ ID NO: 4575183 - DNA, 15 bp, Homo sapiens
gttagcatccaggct

SEQ ID NO: 4575184 - DNA, 17 bp, Homo sapiens
gttagcatccaggctgg

SEQ ID NO: 4575185 - DNA, 19 bp, Homo sapiens
gttaggggccaataaaatg

SEQ ID NO: 4575186 - DNA, 13 bp, Homo sapiens
gttagtaatctgt

SEQ ID NO: 4575187 - DNA, 17 bp, Homo sapiens
gttagtaatctgtataa

SEQ ID NO: 4575188 - DNA, 14 bp, Homo sapiens
gttagtatcttttg

SEQ ID NO: 4575189 - DNA, 17 bp, Homo sapiens
gttagtatcttttgata

SEQ ID NO: 4575190 - DNA, 18 bp, Homo sapiens
gttagtatcttttgatat

SEQ ID NO: 4575191 - DNA, 22 bp, Homo sapiens
gttagttaccttatagttactg

SEQ ID NO: 4575192 - DNA, 23 bp, Homo sapiens
gttagttataaaactatgtgttc

SEQ ID NO: 4575193 - DNA, 16 bp, Homo sapiens
gttagtttgtatatat

SEQ ID NO: 4575194 - DNA, 11 bp, Homo sapiens
gttataaaata

SEQ ID NO: 4575195 - DNA, 12 bp, Homo sapiens
gttataattttt

SEQ ID NO: 4575196 - DNA, 20 bp, Homo sapiens
gttatacagttataaaatta

SEQ ID NO: 4575197 - DNA, 19 bp, Homo sapiens
gttatagaacttcatggat

SEQ ID NO: 4575198 - DNA, 17 bp, Homo sapiens
gttatagattgtcttaa

SEQ ID NO: 4575199 - DNA, 22 bp, Homo sapiens
gttatatagtggatgatataca

SEQ ID NO: 4575200 - DNA, 21 bp, Homo sapiens
gttatatagtttagttctaag

SEQ ID NO: 4575201 - DNA, 16 bp, Homo sapiens
gttatatataataaat

SEQ ID NO: 4575202 - DNA, 13 bp, Homo sapiens
gttatatattgta

SEQ ID NO: 4575203 - DNA, 12 bp, Homo sapiens
gttatatttcag

SEQ ID NO: 4575204 - DNA, 11 bp, Homo sapiens
gttatatttgt

SEQ ID NO: 4575205 - DNA, 22 bp, Homo sapiens
gttatcaccgtgggctccctga

SEQ ID NO: 4575206 - DNA, 14 bp, Homo sapiens
gttatcactgtgca

SEQ ID NO: 4575207 - DNA, 16 bp, Homo sapiens
gttatcactgtgcagt

SEQ ID NO: 4575208 - DNA, 19 bp, Homo sapiens
gttatcatgaattttaaag

SEQ ID NO: 4575209 - DNA, 20 bp, Homo sapiens
gttatcatgaattttaaagt

SEQ ID NO: 4575210 - DNA, 19 bp, Homo sapiens
gttatccaactattaagat

SEQ ID NO: 4575211 - DNA, 15 bp, Homo sapiens
gttatctcaggtgag

SEQ ID NO: 4575212 - DNA, 22 bp, Homo sapiens
gttatcttatactgtacaataa

SEQ ID NO: 4575213 - DNA, 14 bp, Homo sapiens
gttatcttctttat

SEQ ID NO: 4575214 - DNA, 21 bp, Homo sapiens
gttatcttctttattattcct

SEQ ID NO: 4575215 - DNA, 19 bp, Homo sapiens
gttatgcctctgacagtcc

SEQ ID NO: 4575216 - DNA, 15 bp, Homo sapiens
gttatgtatttaaag

SEQ ID NO: 4575217 - DNA, 12 bp, Homo sapiens
gttatgtatttc

SEQ ID NO: 4575218 - DNA, 16 bp, Homo sapiens
gttattcaaatttgat

SEQ ID NO: 4575219 - DNA, 13 bp, Homo sapiens
gttattctggagt

SEQ ID NO: 4575220 - DNA, 22 bp, Homo sapiens
gttatttcttccctgctttgca

SEQ ID NO: 4575221 - DNA, 22 bp, Homo sapiens
gttatttgaaaacatgtttatt

SEQ ID NO: 4575222 - DNA, 15 bp, Homo sapiens
gttattttctacagt

SEQ ID NO: 4575223 - DNA, 21 bp, Homo sapiens
gttattttctttatcattgct

SEQ ID NO: 4575224 - DNA, 15 bp, Homo sapiens
gttattttgtacatt

SEQ ID NO: 4575225 - DNA, 16 bp, Homo sapiens
gttattttgtacattt

SEQ ID NO: 4575226 - DNA, 19 bp, Homo sapiens
gttatttttctcttgtacc

SEQ ID NO: 4575227 - DNA, 22 bp, Homo sapiens
gttcaaagaggtgaacattaaa

SEQ ID NO: 4575228 - DNA, 13 bp, Homo sapiens
gttcaaagccagc

SEQ ID NO: 4575229 - DNA, 22 bp, Homo sapiens
gttcaaatgcattttgggggtt

SEQ ID NO: 4575230 - DNA, 16 bp, Homo sapiens
gttcaagaaataagtt

SEQ ID NO: 4575231 - DNA, 16 bp, Homo sapiens
gttcaagaccagcctg

SEQ ID NO: 4575232 - DNA, 14 bp, Homo sapiens
gttcaagcctgtgg

SEQ ID NO: 4575233 - DNA, 20 bp, Homo sapiens
gttcaagcctgtgggagtag

SEQ ID NO: 4575234 - DNA, 12 bp, Homo sapiens
gttcaatatcag

SEQ ID NO: 4575235 - DNA, 21 bp, Homo sapiens
gttcaatatcagctttgataa

SEQ ID NO: 4575236 - DNA, 12 bp, Homo sapiens
gttcaatatttt

SEQ ID NO: 4575237 - DNA, 16 bp, Homo sapiens
gttcaatctgtgaagc

SEQ ID NO: 4575238 - DNA, 15 bp, Homo sapiens
gttcacacagcccag

SEQ ID NO: 4575239 - DNA, 16 bp, Homo sapiens
gttcacccacagggct

SEQ ID NO: 4575240 - DNA, 21 bp, Homo sapiens
gttcacctccaagcatttcat

SEQ ID NO: 4575241 - DNA, 13 bp, Homo sapiens
gttcacctccctg

SEQ ID NO: 4575242 - DNA, 18 bp, Homo sapiens
gttcacctccctgctcag

SEQ ID NO: 4575243 - DNA, 20 bp, Homo sapiens
gttcacttttgacaaaggca

SEQ ID NO: 4575244 - DNA, 17 bp, Homo sapiens
gttcagaaatagctcct

SEQ ID NO: 4575245 - DNA, 17 bp, Homo sapiens
gttcagacccctgcctg

SEQ ID NO: 4575246 - DNA, 20 bp, Homo sapiens
gttcagatcttaatataaat

SEQ ID NO: 4575247 - DNA, 23 bp, Homo sapiens
gttcagatcttaatataaattca

SEQ ID NO: 4575248 - DNA, 16 bp, Homo sapiens
gttcagcaccacccta

SEQ ID NO: 4575249 - DNA, 22 bp, Homo sapiens
gttcagcattcttagcctgtgg

SEQ ID NO: 4575250 - DNA, 16 bp, Homo sapiens
gttcagcccctcctct

SEQ ID NO: 4575251 - DNA, 19 bp, Homo sapiens
gttcagcccctcctctgcc

SEQ ID NO: 4575252 - DNA, 21 bp, Homo sapiens
gttcagcccctcctctgccac

SEQ ID NO: 4575253 - DNA, 15 bp, Homo sapiens
gttcagcggagctga

SEQ ID NO: 4575254 - DNA, 13 bp, Homo sapiens
gttcaggagactt

SEQ ID NO: 4575255 - DNA, 19 bp, Homo sapiens
gttcaggggactcagccct

SEQ ID NO: 4575256 - DNA, 21 bp, Homo sapiens
gttcagtttttttttttccag

SEQ ID NO: 4575257 - DNA, 23 bp, Homo sapiens
gttcataacagtgccattgtctt

SEQ ID NO: 4575258 - DNA, 19 bp, Homo sapiens
gttcattagaaatatttta

SEQ ID NO: 4575259 - DNA, 18 bp, Homo sapiens
gttcattgcaattaaact

SEQ ID NO: 4575260 - DNA, 12 bp, Homo sapiens
gttcattttaag

SEQ ID NO: 4575261 - DNA, 14 bp, Homo sapiens
gttcattttaagta

SEQ ID NO: 4575262 - DNA, 22 bp, Homo sapiens
gttccacttccaggtctgcctg

SEQ ID NO: 4575263 - DNA, 24 bp, Homo sapiens
gttccagaacagccctcggcctcc

SEQ ID NO: 4575264 - DNA, 14 bp, Homo sapiens
gttccagacattct

SEQ ID NO: 4575265 - DNA, 23 bp, Homo sapiens
gttccagaccccctgagccacag

SEQ ID NO: 4575266 - DNA, 14 bp, Homo sapiens
gttccagctctttg

SEQ ID NO: 4575267 - DNA, 17 bp, Homo sapiens
gttccaggccctccagt

SEQ ID NO: 4575268 - DNA, 20 bp, Homo sapiens
gttccatgagttatcatgaa

SEQ ID NO: 4575269 - DNA, 15 bp, Homo sapiens
gttccattatgaaaa

SEQ ID NO: 4575270 - DNA, 21 bp, Homo sapiens
gttcccagatggctggaaggg

SEQ ID NO: 4575271 - DNA, 13 bp, Homo sapiens
gttcccagcccct

SEQ ID NO: 4575272 - DNA, 18 bp, Homo sapiens
gttcccagcccctcctcc

SEQ ID NO: 4575273 - DNA, 14 bp, Homo sapiens
gttcccagcccctg

SEQ ID NO: 4575274 - DNA, 16 bp, Homo sapiens
gttcccatttcagctg

SEQ ID NO: 4575275 - DNA, 14 bp, Homo sapiens
gttccccagttcag

SEQ ID NO: 4575276 - DNA, 12 bp, Homo sapiens
gttcccccagca

SEQ ID NO: 4575277 - DNA, 13 bp, Homo sapiens
gttcccccagcaa

SEQ ID NO: 4575278 - DNA, 17 bp, Homo sapiens
gttccccgctccacaga

SEQ ID NO: 4575279 - DNA, 22 bp, Homo sapiens
gttcccctcctccactctcccc

SEQ ID NO: 4575280 - DNA, 14 bp, Homo sapiens
gttcccgggagctg

SEQ ID NO: 4575281 - DNA, 16 bp, Homo sapiens
gttcccgggagctggg

SEQ ID NO: 4575282 - DNA, 23 bp, Homo sapiens
gttcccgggagctgggccctgcc

SEQ ID NO: 4575283 - DNA, 14 bp, Homo sapiens
gttcccgtgcctgg

SEQ ID NO: 4575284 - DNA, 17 bp, Homo sapiens
gttcccgtgcctgggag

SEQ ID NO: 4575285 - DNA, 22 bp, Homo sapiens
gttccctatttttctctcctgt

SEQ ID NO: 4575286 - DNA, 18 bp, Homo sapiens
gttccctcctagctctcc

SEQ ID NO: 4575287 - DNA, 20 bp, Homo sapiens
gttccctcctagctctccca

SEQ ID NO: 4575288 - DNA, 21 bp, Homo sapiens
gttccctcctagctctcccag

SEQ ID NO: 4575289 - DNA, 21 bp, Homo sapiens
gttccctgaaaacccagagag

SEQ ID NO: 4575290 - DNA, 14 bp, Homo sapiens
gttcccttgaccat

SEQ ID NO: 4575291 - DNA, 23 bp, Homo sapiens
gttcccttgaccattggctgcgc

SEQ ID NO: 4575292 - DNA, 13 bp, Homo sapiens
gttcccttggcct

SEQ ID NO: 4575293 - DNA, 15 bp, Homo sapiens
gttcccttggcctca

SEQ ID NO: 4575294 - DNA, 16 bp, Homo sapiens
gttcccttggcctcag

SEQ ID NO: 4575295 - DNA, 19 bp, Homo sapiens
gttcccttggcctcagaat

SEQ ID NO: 4575296 - DNA, 16 bp, Homo sapiens
gttccctttgtctttc

SEQ ID NO: 4575297 - DNA, 14 bp, Homo sapiens
gttccctttttcat

SEQ ID NO: 4575298 - DNA, 12 bp, Homo sapiens
gttcctagcact

SEQ ID NO: 4575299 - DNA, 13 bp, Homo sapiens
gttcctagcactg

SEQ ID NO: 4575300 - DNA, 14 bp, Homo sapiens
gttcctagcactgc

SEQ ID NO: 4575301 - DNA, 15 bp, Homo sapiens
gttcctcaaattttt

SEQ ID NO: 4575302 - DNA, 13 bp, Homo sapiens
gttcctcgccctg

SEQ ID NO: 4575303 - DNA, 16 bp, Homo sapiens
gttcctctgcctgccc

SEQ ID NO: 4575304 - DNA, 13 bp, Homo sapiens
gttcctctgctca

SEQ ID NO: 4575305 - DNA, 19 bp, Homo sapiens
gttcctctgggtttctaag

SEQ ID NO: 4575306 - DNA, 17 bp, Homo sapiens
gttcctctgtacagcaa

SEQ ID NO: 4575307 - DNA, 14 bp, Homo sapiens
gttcctgaagctgc

SEQ ID NO: 4575308 - DNA, 20 bp, Homo sapiens
gttcctgaagctgctgtgtc

SEQ ID NO: 4575309 - DNA, 22 bp, Homo sapiens
gttcctggacagatcaggctag

SEQ ID NO: 4575310 - DNA, 20 bp, Homo sapiens
gttcctgtgtgaccctgggc

SEQ ID NO: 4575311 - DNA, 15 bp, Homo sapiens
gttccttatccctct

SEQ ID NO: 4575312 - DNA, 20 bp, Homo sapiens
gttccttttttcaatatgca

SEQ ID NO: 4575313 - DNA, 16 bp, Homo sapiens
gttcgagactccatct

SEQ ID NO: 4575314 - DNA, 14 bp, Homo sapiens
gttcgcatggtcac

SEQ ID NO: 4575315 - DNA, 15 bp, Homo sapiens
gttcggttccagaca

SEQ ID NO: 4575316 - DNA, 16 bp, Homo sapiens
gttctaaatattgctt

SEQ ID NO: 4575317 - DNA, 19 bp, Homo sapiens
gttctaaatattgcttcaa

SEQ ID NO: 4575318 - DNA, 22 bp, Homo sapiens
gttctaaatattgcttcaattt

SEQ ID NO: 4575319 - DNA, 19 bp, Homo sapiens
gttctaaatgcaataagat

SEQ ID NO: 4575320 - DNA, 17 bp, Homo sapiens
gttctaagtctttccat

SEQ ID NO: 4575321 - DNA, 15 bp, Homo sapiens
gttctagacttcccc

SEQ ID NO: 4575322 - DNA, 16 bp, Homo sapiens
gttctagacttcccca

SEQ ID NO: 4575323 - DNA, 14 bp, Homo sapiens
gttctagtttttta

SEQ ID NO: 4575324 - DNA, 21 bp, Homo sapiens
gttctatccaaacatgtattt

SEQ ID NO: 4575325 - DNA, 20 bp, Homo sapiens
gttctatccttttgcctgca

SEQ ID NO: 4575326 - DNA, 22 bp, Homo sapiens
gttctatttgctttaatgagaa

SEQ ID NO: 4575327 - DNA, 21 bp, Homo sapiens
gttctcaagaatctagaagat

SEQ ID NO: 4575328 - DNA, 21 bp, Homo sapiens
gttctcacactggtctgctgt

SEQ ID NO: 4575329 - DNA, 18 bp, Homo sapiens
gttctcagcttgcagctg

SEQ ID NO: 4575330 - DNA, 20 bp, Homo sapiens
gttctccagtcattatgtta

SEQ ID NO: 4575331 - DNA, 15 bp, Homo sapiens
gttctcccaaagatt

SEQ ID NO: 4575332 - DNA, 19 bp, Homo sapiens
gttctccgggtgtggcctc

SEQ ID NO: 4575333 - DNA, 22 bp, Homo sapiens
gttctccgggtgtggcctcagc

SEQ ID NO: 4575334 - DNA, 13 bp, Homo sapiens
gttctctgccttt

SEQ ID NO: 4575335 - DNA, 21 bp, Homo sapiens
gttctgatatgtgaatttgtt

SEQ ID NO: 4575336 - DNA, 15 bp, Homo sapiens
gttctgcaaaataca

SEQ ID NO: 4575337 - DNA, 15 bp, Homo sapiens
gttctgcaaatagaa

SEQ ID NO: 4575338 - DNA, 18 bp, Homo sapiens
gttctgcaaatagaaaac

SEQ ID NO: 4575339 - DNA, 13 bp, Homo sapiens
gttctgcaactcc

SEQ ID NO: 4575340 - DNA, 13 bp, Homo sapiens
gttctgcacccta

SEQ ID NO: 4575341 - DNA, 13 bp, Homo sapiens
gttctgcctctcc

SEQ ID NO: 4575342 - DNA, 18 bp, Homo sapiens
gttctgctagagcagaca

SEQ ID NO: 4575343 - DNA, 16 bp, Homo sapiens
gttctgctatatttgt

SEQ ID NO: 4575344 - DNA, 17 bp, Homo sapiens
gttctggactctgcccc

SEQ ID NO: 4575345 - DNA, 18 bp, Homo sapiens
gttctggactctgcccca

SEQ ID NO: 4575346 - DNA, 23 bp, Homo sapiens
gttctgggtgatggaaactgcca

SEQ ID NO: 4575347 - DNA, 18 bp, Homo sapiens
gttctgtgacccatctgt

SEQ ID NO: 4575348 - DNA, 17 bp, Homo sapiens
gttctgtgcctcccccc

SEQ ID NO: 4575349 - DNA, 22 bp, Homo sapiens
gttctgtgcctccccccagacc

SEQ ID NO: 4575350 - DNA, 19 bp, Homo sapiens
gttctgtggtttcatgtta

SEQ ID NO: 4575351 - DNA, 23 bp, Homo sapiens
gttctgtgtatttaattgtaaac

SEQ ID NO: 4575352 - DNA, 18 bp, Homo sapiens
gttctgtgtattttcagt

SEQ ID NO: 4575353 - DNA, 16 bp, Homo sapiens
gttcttaagacgtgat

SEQ ID NO: 4575354 - DNA, 17 bp, Homo sapiens
gttcttatttttataac

SEQ ID NO: 4575355 - DNA, 14 bp, Homo sapiens
gttcttcgaggtgg

SEQ ID NO: 4575356 - DNA, 20 bp, Homo sapiens
gttcttgaaagccaagtgtt

SEQ ID NO: 4575357 - DNA, 15 bp, Homo sapiens
gttcttgaattatat

SEQ ID NO: 4575358 - DNA, 16 bp, Homo sapiens
gttcttgacaatcatc

SEQ ID NO: 4575359 - DNA, 17 bp, Homo sapiens
gttcttggattacttta

SEQ ID NO: 4575360 - DNA, 23 bp, Homo sapiens
gttcttgttttttaaaatccaga

SEQ ID NO: 4575361 - DNA, 19 bp, Homo sapiens
gttctttcctccccctgca

SEQ ID NO: 4575362 - DNA, 11 bp, Homo sapiens
gttctttggaa

SEQ ID NO: 4575363 - DNA, 20 bp, Homo sapiens
gttcttttctcctttaccag

SEQ ID NO: 4575364 - DNA, 12 bp, Homo sapiens
gttgaaaaaatt

SEQ ID NO: 4575365 - DNA, 14 bp, Homo sapiens
gttgaaaaagataa

SEQ ID NO: 4575366 - DNA, 17 bp, Homo sapiens
gttgaaaagactccaaa

SEQ ID NO: 4575367 - DNA, 22 bp, Homo sapiens
gttgaaaagactccaaagaaat

SEQ ID NO: 4575368 - DNA, 22 bp, Homo sapiens
gttgaagagacagagacaagta

SEQ ID NO: 4575369 - DNA, 18 bp, Homo sapiens
gttgaagcaaatcgaatg

SEQ ID NO: 4575370 - DNA, 13 bp, Homo sapiens
gttgaataaaaat

SEQ ID NO: 4575371 - DNA, 19 bp, Homo sapiens
gttgaatgttgcaatgtga

SEQ ID NO: 4575372 - DNA, 17 bp, Homo sapiens
gttgaatttcagtcctt

SEQ ID NO: 4575373 - DNA, 14 bp, Homo sapiens
gttgacatatttaa

SEQ ID NO: 4575374 - DNA, 23 bp, Homo sapiens
gttgacatatttaatgttttaaa

SEQ ID NO: 4575375 - DNA, 15 bp, Homo sapiens
gttgaccccagagga

SEQ ID NO: 4575376 - DNA, 11 bp, Homo sapiens
gttgaccttta

SEQ ID NO: 4575377 - DNA, 19 bp, Homo sapiens
gttgactgtgattagatca

SEQ ID NO: 4575378 - DNA, 22 bp, Homo sapiens
gttgagcgtgcgcactgcatgg

SEQ ID NO: 4575379 - DNA, 21 bp, Homo sapiens
gttgagcttcatataccagca

SEQ ID NO: 4575380 - DNA, 17 bp, Homo sapiens
gttgaggaactgtacag

SEQ ID NO: 4575381 - DNA, 23 bp, Homo sapiens
gttgagggaacagacaggagaaa

SEQ ID NO: 4575382 - DNA, 20 bp, Homo sapiens
gttgaggtggaagccctcct

SEQ ID NO: 4575383 - DNA, 23 bp, Homo sapiens
gttgaggtggaagccctccttcc

SEQ ID NO: 4575384 - DNA, 22 bp, Homo sapiens
gttgataaaccaaaaacatttg

SEQ ID NO: 4575385 - DNA, 22 bp, Homo sapiens
gttgatcatgtactttttagta

SEQ ID NO: 4575386 - DNA, 22 bp, Homo sapiens
gttgatttttttttttttttcc

SEQ ID NO: 4575387 - DNA, 23 bp, Homo sapiens
gttgatttttttttttttttcct

SEQ ID NO: 4575388 - DNA, 14 bp, Homo sapiens
gttgcaaagagaca

SEQ ID NO: 4575389 - DNA, 14 bp, Homo sapiens
gttgcaagatgtga

SEQ ID NO: 4575390 - DNA, 18 bp, Homo sapiens
gttgcaagatgtgaatta

SEQ ID NO: 4575391 - DNA, 17 bp, Homo sapiens
gttgcaaggccgctgtt

SEQ ID NO: 4575392 - DNA, 16 bp, Homo sapiens
gttgcacccagccctg

SEQ ID NO: 4575393 - DNA, 20 bp, Homo sapiens
gttgcacccagccctggtct

SEQ ID NO: 4575394 - DNA, 23 bp, Homo sapiens
gttgcacccagccctggtctcag

SEQ ID NO: 4575395 - DNA, 20 bp, Homo sapiens
gttgccaaaaccaaacccag

SEQ ID NO: 4575396 - DNA, 19 bp, Homo sapiens
gttgccaaagctggtctca

SEQ ID NO: 4575397 - DNA, 13 bp, Homo sapiens
gttgccagaggcc

SEQ ID NO: 4575398 - DNA, 18 bp, Homo sapiens
gttgccagaggccctgga

SEQ ID NO: 4575399 - DNA, 21 bp, Homo sapiens
gttgccagaggccctggaggg

SEQ ID NO: 4575400 - DNA, 15 bp, Homo sapiens
gttgcccaggctgga

SEQ ID NO: 4575401 - DNA, 21 bp, Homo sapiens
gttgccccccatcaccagagt

SEQ ID NO: 4575402 - DNA, 20 bp, Homo sapiens
gttgcccgaaactaagccag

SEQ ID NO: 4575403 - DNA, 21 bp, Homo sapiens
gttgcccgaaactaagccagg

SEQ ID NO: 4575404 - DNA, 18 bp, Homo sapiens
gttgcctaagcattgcct

SEQ ID NO: 4575405 - DNA, 14 bp, Homo sapiens
gttgcctaattgga

SEQ ID NO: 4575406 - DNA, 18 bp, Homo sapiens
gttgctcaaaaaatgagc

SEQ ID NO: 4575407 - DNA, 18 bp, Homo sapiens
gttgctgagccagctgca

SEQ ID NO: 4575408 - DNA, 13 bp, Homo sapiens
gttgctgctgtga

SEQ ID NO: 4575409 - DNA, 18 bp, Homo sapiens
gttgctttaatatgagct

SEQ ID NO: 4575410 - DNA, 17 bp, Homo sapiens
gttgctttgaaaaagcc

SEQ ID NO: 4575411 - DNA, 15 bp, Homo sapiens
gttgcttttattgca

SEQ ID NO: 4575412 - DNA, 15 bp, Homo sapiens
gttggaaatgtgttt

SEQ ID NO: 4575413 - DNA, 22 bp, Homo sapiens
gttggaatggatttttctttaa

SEQ ID NO: 4575414 - DNA, 14 bp, Homo sapiens
gttggactctcagg

SEQ ID NO: 4575415 - DNA, 22 bp, Homo sapiens
gttggagagctagaacctggag

SEQ ID NO: 4575416 - DNA, 16 bp, Homo sapiens
gttggaggcaatgtgg

SEQ ID NO: 4575417 - DNA, 18 bp, Homo sapiens
gttggagtttgggctgga

SEQ ID NO: 4575418 - DNA, 17 bp, Homo sapiens
gttggattccatgctaa

SEQ ID NO: 4575419 - DNA, 15 bp, Homo sapiens
gttggcaggcccact

SEQ ID NO: 4575420 - DNA, 16 bp, Homo sapiens
gttggcaggcccactc

SEQ ID NO: 4575421 - DNA, 12 bp, Homo sapiens
gttggctggggt

SEQ ID NO: 4575422 - DNA, 16 bp, Homo sapiens
gttggctgttccagac

SEQ ID NO: 4575423 - DNA, 16 bp, Homo sapiens
gttggctttcataaat

SEQ ID NO: 4575424 - DNA, 13 bp, Homo sapiens
gttgggcccagat

SEQ ID NO: 4575425 - DNA, 17 bp, Homo sapiens
gttgggcccagatctgg

SEQ ID NO: 4575426 - DNA, 19 bp, Homo sapiens
gttgggtggcaattccaat

SEQ ID NO: 4575427 - DNA, 19 bp, Homo sapiens
gttggtgttctaagactct

SEQ ID NO: 4575428 - DNA, 18 bp, Homo sapiens
gttggttgcactttgtag

SEQ ID NO: 4575429 - DNA, 17 bp, Homo sapiens
gttgtaaaatagaaaaa

SEQ ID NO: 4575430 - DNA, 13 bp, Homo sapiens
gttgtacatgata

SEQ ID NO: 4575431 - DNA, 14 bp, Homo sapiens
gttgtacatgataa

SEQ ID NO: 4575432 - DNA, 18 bp, Homo sapiens
gttgtactttggaattct

SEQ ID NO: 4575433 - DNA, 15 bp, Homo sapiens
gttgtatcatactct

SEQ ID NO: 4575434 - DNA, 13 bp, Homo sapiens
gttgtatgtttgc

SEQ ID NO: 4575435 - DNA, 22 bp, Homo sapiens
gttgtatgtttgctgattattt

SEQ ID NO: 4575436 - DNA, 12 bp, Homo sapiens
gttgtatttcaa

SEQ ID NO: 4575437 - DNA, 13 bp, Homo sapiens
gttgtatttcaaa

SEQ ID NO: 4575438 - DNA, 23 bp, Homo sapiens
gttgtgactgccaggataaagct

SEQ ID NO: 4575439 - DNA, 13 bp, Homo sapiens
gttgtgcttgagc

SEQ ID NO: 4575440 - DNA, 19 bp, Homo sapiens
gttgtgtgtatatgtattt

SEQ ID NO: 4575441 - DNA, 14 bp, Homo sapiens
gttgtgtgtgggag

SEQ ID NO: 4575442 - DNA, 22 bp, Homo sapiens
gttgtgtgtgggagtgtgtaat

SEQ ID NO: 4575443 - DNA, 19 bp, Homo sapiens
gttgttaatactgtattgc

SEQ ID NO: 4575444 - DNA, 10 bp, Homo sapiens
gttgttcttt

SEQ ID NO: 4575445 - DNA, 15 bp, Homo sapiens
gttgttgactgtgat

SEQ ID NO: 4575446 - DNA, 22 bp, Homo sapiens
gttgttgactgtgattagatca

SEQ ID NO: 4575447 - DNA, 23 bp, Homo sapiens
gttgttgatattgtttgctgttg

SEQ ID NO: 4575448 - DNA, 17 bp, Homo sapiens
gttgttgcatgtttgaa

SEQ ID NO: 4575449 - DNA, 14 bp, Homo sapiens
gttgttgtggaagc

SEQ ID NO: 4575450 - DNA, 15 bp, Homo sapiens
gttgttgtttgccaa

SEQ ID NO: 4575451 - DNA, 14 bp, Homo sapiens
gttgtttctgttcc

SEQ ID NO: 4575452 - DNA, 11 bp, Homo sapiens
gtttaaaactt

SEQ ID NO: 4575453 - DNA, 22 bp, Homo sapiens
gtttaaaataaaatgaaaattg

SEQ ID NO: 4575454 - DNA, 18 bp, Homo sapiens
gtttaaacaatctttcat

SEQ ID NO: 4575455 - DNA, 20 bp, Homo sapiens
gtttaaacaatctttcatgt

SEQ ID NO: 4575456 - DNA, 19 bp, Homo sapiens
gtttaaatgccaaaatgta

SEQ ID NO: 4575457 - DNA, 18 bp, Homo sapiens
gtttaacaataataaaaa

SEQ ID NO: 4575458 - DNA, 22 bp, Homo sapiens
gtttaaccaaaaagaccagact

SEQ ID NO: 4575459 - DNA, 18 bp, Homo sapiens
gtttaacttccactgtta

SEQ ID NO: 4575460 - DNA, 21 bp, Homo sapiens
gtttaactttaaggatttgaa

SEQ ID NO: 4575461 - DNA, 20 bp, Homo sapiens
gtttaagccaaaacaatgtt

SEQ ID NO: 4575462 - DNA, 18 bp, Homo sapiens
gtttaagtcattttttac

SEQ ID NO: 4575463 - DNA, 16 bp, Homo sapiens
gtttaatacaggaaat

SEQ ID NO: 4575464 - DNA, 21 bp, Homo sapiens
gtttaatattacctaatgaaa

SEQ ID NO: 4575465 - DNA, 14 bp, Homo sapiens
gtttaatcccagca

SEQ ID NO: 4575466 - DNA, 19 bp, Homo sapiens
gtttaatctataacaaatg

SEQ ID NO: 4575467 - DNA, 13 bp, Homo sapiens
gtttaatgttttg

SEQ ID NO: 4575468 - DNA, 15 bp, Homo sapiens
gtttaattcagcaga

SEQ ID NO: 4575469 - DNA, 20 bp, Homo sapiens
gtttaatttttatttcttcc

SEQ ID NO: 4575470 - DNA, 23 bp, Homo sapiens
gtttacagcactactctgtgcca

SEQ ID NO: 4575471 - DNA, 23 bp, Homo sapiens
gtttacatgagttcaaatacttt

SEQ ID NO: 4575472 - DNA, 21 bp, Homo sapiens
gtttacatttgatgcatgtct

SEQ ID NO: 4575473 - DNA, 16 bp, Homo sapiens
gtttaccatttttcat

SEQ ID NO: 4575474 - DNA, 21 bp, Homo sapiens
gtttacctggcttatttaata

SEQ ID NO: 4575475 - DNA, 17 bp, Homo sapiens
gtttagaaagcttgccc

SEQ ID NO: 4575476 - DNA, 16 bp, Homo sapiens
gtttagaatcagaata

SEQ ID NO: 4575477 - DNA, 22 bp, Homo sapiens
gtttagaatggaggaagaacaa

SEQ ID NO: 4575478 - DNA, 18 bp, Homo sapiens
gtttagatgaatgtcagt

SEQ ID NO: 4575479 - DNA, 18 bp, Homo sapiens
gtttagttttacatttta

SEQ ID NO: 4575480 - DNA, 13 bp, Homo sapiens
gtttataaatctt

SEQ ID NO: 4575481 - DNA, 18 bp, Homo sapiens
gtttatacagttttaaag

SEQ ID NO: 4575482 - DNA, 21 bp, Homo sapiens
gtttatatattgaaagttgct

SEQ ID NO: 4575483 - DNA, 23 bp, Homo sapiens
gtttatatattgaaagttgcttt

SEQ ID NO: 4575484 - DNA, 21 bp, Homo sapiens
gtttatattgtttttatatat

SEQ ID NO: 4575485 - DNA, 15 bp, Homo sapiens
gtttatcatgaagcc

SEQ ID NO: 4575486 - DNA, 14 bp, Homo sapiens
gtttatcattcaag

SEQ ID NO: 4575487 - DNA, 21 bp, Homo sapiens
gtttatgatatttcttgcttt

SEQ ID NO: 4575488 - DNA, 14 bp, Homo sapiens
gtttatggcagaag

SEQ ID NO: 4575489 - DNA, 16 bp, Homo sapiens
gtttatggcagaaggg

SEQ ID NO: 4575490 - DNA, 23 bp, Homo sapiens
gtttatgtgctattaatatttgt

SEQ ID NO: 4575491 - DNA, 18 bp, Homo sapiens
gtttatgtgttatgaaca

SEQ ID NO: 4575492 - DNA, 21 bp, Homo sapiens
gtttattaatcttagtgtatg

SEQ ID NO: 4575493 - DNA, 23 bp, Homo sapiens
gtttattaatcttagtgtatgat

SEQ ID NO: 4575494 - DNA, 21 bp, Homo sapiens
gtttattggatctattgattt

SEQ ID NO: 4575495 - DNA, 16 bp, Homo sapiens
gtttatttctgtgaaa

SEQ ID NO: 4575496 - DNA, 12 bp, Homo sapiens
gtttattttcat

SEQ ID NO: 4575497 - DNA, 18 bp, Homo sapiens
gtttattttcattctgcc

SEQ ID NO: 4575498 - DNA, 21 bp, Homo sapiens
gtttcaaaatagacaagtttt

SEQ ID NO: 4575499 - DNA, 18 bp, Homo sapiens
gtttcaacggaaagtgct

SEQ ID NO: 4575500 - DNA, 13 bp, Homo sapiens
gtttcaagccctc

SEQ ID NO: 4575501 - DNA, 18 bp, Homo sapiens
gtttcaaggtcagaacag

SEQ ID NO: 4575502 - DNA, 19 bp, Homo sapiens
gtttcagagcataaaacct

SEQ ID NO: 4575503 - DNA, 14 bp, Homo sapiens
gtttcagatgaggt

SEQ ID NO: 4575504 - DNA, 22 bp, Homo sapiens
gtttcagtgtcaaataaacact

SEQ ID NO: 4575505 - DNA, 22 bp, Homo sapiens
gtttcatatataagactgctgc

SEQ ID NO: 4575506 - DNA, 17 bp, Homo sapiens
gtttcatctaaatgaaa

SEQ ID NO: 4575507 - DNA, 15 bp, Homo sapiens
gtttccatcatgtct

SEQ ID NO: 4575508 - DNA, 16 bp, Homo sapiens
gtttccatcatgtctg

SEQ ID NO: 4575509 - DNA, 23 bp, Homo sapiens
gtttcccaaaacaatctatttaa

SEQ ID NO: 4575510 - DNA, 17 bp, Homo sapiens
gtttccccaataaagcc

SEQ ID NO: 4575511 - DNA, 21 bp, Homo sapiens
gtttccccactaataaagtgc

SEQ ID NO: 4575512 - DNA, 22 bp, Homo sapiens
gtttccccactaataaagtgcc

SEQ ID NO: 4575513 - DNA, 22 bp, Homo sapiens
gtttcccccacagttttaataa

SEQ ID NO: 4575514 - DNA, 23 bp, Homo sapiens
gtttccctcaaatgcgcgtgtgc

SEQ ID NO: 4575515 - DNA, 19 bp, Homo sapiens
gtttcctatttaatacagc

SEQ ID NO: 4575516 - DNA, 23 bp, Homo sapiens
gtttcctcatctatggttctaaa

SEQ ID NO: 4575517 - DNA, 12 bp, Homo sapiens
gtttcctctaaa

SEQ ID NO: 4575518 - DNA, 24 bp, Homo sapiens
gtttcctgacagatgcctggtgag

SEQ ID NO: 4575519 - DNA, 15 bp, Homo sapiens
gtttcctgacattgt

SEQ ID NO: 4575520 - DNA, 15 bp, Homo sapiens
gtttctatggattca

SEQ ID NO: 4575521 - DNA, 14 bp, Homo sapiens
gtttctcattaaac

SEQ ID NO: 4575522 - DNA, 17 bp, Homo sapiens
gtttctcattaaactct

SEQ ID NO: 4575523 - DNA, 15 bp, Homo sapiens
gtttctcctcagaag

SEQ ID NO: 4575524 - DNA, 14 bp, Homo sapiens
gtttctcctggtag

SEQ ID NO: 4575525 - DNA, 14 bp, Homo sapiens
gtttctccttttcc

SEQ ID NO: 4575526 - DNA, 19 bp, Homo sapiens
gtttctccttttcctatcc

SEQ ID NO: 4575527 - DNA, 20 bp, Homo sapiens
gtttctcttctagatgattt

SEQ ID NO: 4575528 - DNA, 13 bp, Homo sapiens
gtttctgactctg

SEQ ID NO: 4575529 - DNA, 20 bp, Homo sapiens
gtttctgatctgtactttgt

SEQ ID NO: 4575530 - DNA, 22 bp, Homo sapiens
gtttctgatctgtactttgtgt

SEQ ID NO: 4575531 - DNA, 23 bp, Homo sapiens
gtttctgatctgtactttgtgtt

SEQ ID NO: 4575532 - DNA, 13 bp, Homo sapiens
gtttctgtcaagc

SEQ ID NO: 4575533 - DNA, 13 bp, Homo sapiens
gtttctgttccaa

SEQ ID NO: 4575534 - DNA, 17 bp, Homo sapiens
gtttctgtttgattctt

SEQ ID NO: 4575535 - DNA, 18 bp, Homo sapiens
gtttctgtttgattcttt

SEQ ID NO: 4575536 - DNA, 22 bp, Homo sapiens
gtttcttaaataagaaactttt

SEQ ID NO: 4575537 - DNA, 18 bp, Homo sapiens
gtttcttgccttttgtta

SEQ ID NO: 4575538 - DNA, 15 bp, Homo sapiens
gtttcttgtgtagat

SEQ ID NO: 4575539 - DNA, 21 bp, Homo sapiens
gtttcttgtgtagatttgaaa

SEQ ID NO: 4575540 - DNA, 19 bp, Homo sapiens
gtttctttcttcctcttct

SEQ ID NO: 4575541 - DNA, 11 bp, Homo sapiens
gtttgaaaagc

SEQ ID NO: 4575542 - DNA, 21 bp, Homo sapiens
gtttgaaagttgtacatgata

SEQ ID NO: 4575543 - DNA, 22 bp, Homo sapiens
gtttgaaagttgtacatgataa

SEQ ID NO: 4575544 - DNA, 20 bp, Homo sapiens
gtttgaaatgaggtctgttt

SEQ ID NO: 4575545 - DNA, 16 bp, Homo sapiens
gtttgaaattctgaat

SEQ ID NO: 4575546 - DNA, 17 bp, Homo sapiens
gtttgaaattctgaatt

SEQ ID NO: 4575547 - DNA, 19 bp, Homo sapiens
gtttgactagatgatggat

SEQ ID NO: 4575548 - DNA, 15 bp, Homo sapiens
gtttgagattctcaa

SEQ ID NO: 4575549 - DNA, 13 bp, Homo sapiens
gtttgagctgcct

SEQ ID NO: 4575550 - DNA, 19 bp, Homo sapiens
gtttgagtttttcctccca

SEQ ID NO: 4575551 - DNA, 21 bp, Homo sapiens
gtttgattttagctgcagaac

SEQ ID NO: 4575552 - DNA, 15 bp, Homo sapiens
gtttgcttaaaatat

SEQ ID NO: 4575553 - DNA, 19 bp, Homo sapiens
gtttggaaataaactgtgc

SEQ ID NO: 4575554 - DNA, 16 bp, Homo sapiens
gtttggacctgcatat

SEQ ID NO: 4575555 - DNA, 20 bp, Homo sapiens
gtttggatatgtaaaacatt

SEQ ID NO: 4575556 - DNA, 21 bp, Homo sapiens
gtttggatctccaattgcctc

SEQ ID NO: 4575557 - DNA, 18 bp, Homo sapiens
gtttggatgtctgtagca

SEQ ID NO: 4575558 - DNA, 17 bp, Homo sapiens
gtttggctataagtgct

SEQ ID NO: 4575559 - DNA, 12 bp, Homo sapiens
gtttgggctgga

SEQ ID NO: 4575560 - DNA, 22 bp, Homo sapiens
gtttggggaatgcggccgcatt

SEQ ID NO: 4575561 - DNA, 19 bp, Homo sapiens
gtttggtataaattaattt

SEQ ID NO: 4575562 - DNA, 13 bp, Homo sapiens
gtttggtgcttct

SEQ ID NO: 4575563 - DNA, 16 bp, Homo sapiens
gtttgtaatactttac

SEQ ID NO: 4575564 - DNA, 14 bp, Homo sapiens
gtttgtaggtaaaa

SEQ ID NO: 4575565 - DNA, 13 bp, Homo sapiens
gtttgtggcctca

SEQ ID NO: 4575566 - DNA, 15 bp, Homo sapiens
gtttgtggcctcaga

SEQ ID NO: 4575567 - DNA, 13 bp, Homo sapiens
gtttgtgggactg

SEQ ID NO: 4575568 - DNA, 12 bp, Homo sapiens
gtttgttactgt

SEQ ID NO: 4575569 - DNA, 13 bp, Homo sapiens
gtttgttactgtc

SEQ ID NO: 4575570 - DNA, 17 bp, Homo sapiens
gtttgttactgtcattc

SEQ ID NO: 4575571 - DNA, 23 bp, Homo sapiens
gtttgttctccgggtgtggcctc

SEQ ID NO: 4575572 - DNA, 14 bp, Homo sapiens
gtttgttcttcaga

SEQ ID NO: 4575573 - DNA, 22 bp, Homo sapiens
gtttgtttaaacacttatcttc

SEQ ID NO: 4575574 - DNA, 21 bp, Homo sapiens
gtttgtttacataagagaaag

SEQ ID NO: 4575575 - DNA, 14 bp, Homo sapiens
gtttgtttttgcgt

SEQ ID NO: 4575576 - DNA, 12 bp, Homo sapiens
gttttaaaatct

SEQ ID NO: 4575577 - DNA, 16 bp, Homo sapiens
gttttaaactttcaat

SEQ ID NO: 4575578 - DNA, 19 bp, Homo sapiens
gttttaataagaacagatc

SEQ ID NO: 4575579 - DNA, 13 bp, Homo sapiens
gttttacaatagt

SEQ ID NO: 4575580 - DNA, 19 bp, Homo sapiens
gttttacagagaggataca

SEQ ID NO: 4575581 - DNA, 14 bp, Homo sapiens
gttttacagtgttt

SEQ ID NO: 4575582 - DNA, 12 bp, Homo sapiens
gttttagctgta

SEQ ID NO: 4575583 - DNA, 15 bp, Homo sapiens
gttttagctgtagat

SEQ ID NO: 4575584 - DNA, 22 bp, Homo sapiens
gttttaggtgtgtgtgtccaga

SEQ ID NO: 4575585 - DNA, 21 bp, Homo sapiens
gttttataaggtctgacatca

SEQ ID NO: 4575586 - DNA, 15 bp, Homo sapiens
gttttatactgaagg

SEQ ID NO: 4575587 - DNA, 21 bp, Homo sapiens
gttttatactgaaggaaaaac

SEQ ID NO: 4575588 - DNA, 18 bp, Homo sapiens
gttttataggcagctgtc

SEQ ID NO: 4575589 - DNA, 20 bp, Homo sapiens
gttttatatattatgtgaag

SEQ ID NO: 4575590 - DNA, 22 bp, Homo sapiens
gttttatatattatgtgaagaa

SEQ ID NO: 4575591 - DNA, 23 bp, Homo sapiens
gttttattggggaattaaatagt

SEQ ID NO: 4575592 - DNA, 17 bp, Homo sapiens
gttttattttatgttta

SEQ ID NO: 4575593 - DNA, 14 bp, Homo sapiens
gttttcagactcag

SEQ ID NO: 4575594 - DNA, 15 bp, Homo sapiens
gttttcatcatttca

SEQ ID NO: 4575595 - DNA, 18 bp, Homo sapiens
gttttcatcatttcagcc

SEQ ID NO: 4575596 - DNA, 20 bp, Homo sapiens
gttttcattcattggtgaag

SEQ ID NO: 4575597 - DNA, 15 bp, Homo sapiens
gttttcattttactg

SEQ ID NO: 4575598 - DNA, 13 bp, Homo sapiens
gttttccaaagag

SEQ ID NO: 4575599 - DNA, 18 bp, Homo sapiens
gttttccaatattttaat

SEQ ID NO: 4575600 - DNA, 15 bp, Homo sapiens
gttttccactgtgct

SEQ ID NO: 4575601 - DNA, 21 bp, Homo sapiens
gttttccccaaaccataaaac

SEQ ID NO: 4575602 - DNA, 15 bp, Homo sapiens
gttttcctcagctct

SEQ ID NO: 4575603 - DNA, 14 bp, Homo sapiens
gttttctaaattta

SEQ ID NO: 4575604 - DNA, 16 bp, Homo sapiens
gttttctgagaaagac

SEQ ID NO: 4575605 - DNA, 21 bp, Homo sapiens
gttttctgtaaattcatattt

SEQ ID NO: 4575606 - DNA, 20 bp, Homo sapiens
gttttcttcccatcactgga

SEQ ID NO: 4575607 - DNA, 15 bp, Homo sapiens
gttttctttcctcct

SEQ ID NO: 4575608 - DNA, 20 bp, Homo sapiens
gttttctttgcaaagtattg

SEQ ID NO: 4575609 - DNA, 16 bp, Homo sapiens
gttttgaagattctat

SEQ ID NO: 4575610 - DNA, 17 bp, Homo sapiens
gttttgaagattctatg

SEQ ID NO: 4575611 - DNA, 20 bp, Homo sapiens
gttttgaagattctatgtta

SEQ ID NO: 4575612 - DNA, 14 bp, Homo sapiens
gttttgaattgtgt

SEQ ID NO: 4575613 - DNA, 13 bp, Homo sapiens
gttttgagtaaaa

SEQ ID NO: 4575614 - DNA, 20 bp, Homo sapiens
gttttgagtaaaaagacatt

SEQ ID NO: 4575615 - DNA, 22 bp, Homo sapiens
gttttgagtaaaaagacatttt

SEQ ID NO: 4575616 - DNA, 20 bp, Homo sapiens
gttttgatttaatgttttca

SEQ ID NO: 4575617 - DNA, 15 bp, Homo sapiens
gttttggactctctg

SEQ ID NO: 4575618 - DNA, 20 bp, Homo sapiens
gttttggcaaacgctaaaga

SEQ ID NO: 4575619 - DNA, 14 bp, Homo sapiens
gttttggttaagtt

SEQ ID NO: 4575620 - DNA, 20 bp, Homo sapiens
gttttggttaagttggcttc

SEQ ID NO: 4575621 - DNA, 14 bp, Homo sapiens
gttttgtaaaagaa

SEQ ID NO: 4575622 - DNA, 14 bp, Homo sapiens
gttttgtaccagtg

SEQ ID NO: 4575623 - DNA, 22 bp, Homo sapiens
gttttgtatacagagaagaaaa

SEQ ID NO: 4575624 - DNA, 24 bp, Homo sapiens
gttttgtcaaactgtagaaatgat

SEQ ID NO: 4575625 - DNA, 15 bp, Homo sapiens
gttttgtcagacttc

SEQ ID NO: 4575626 - DNA, 23 bp, Homo sapiens
gttttgtggtagtccttttggga

SEQ ID NO: 4575627 - DNA, 17 bp, Homo sapiens
gttttgtggtttggaat

SEQ ID NO: 4575628 - DNA, 17 bp, Homo sapiens
gttttgtgtttgttgta

SEQ ID NO: 4575629 - DNA, 18 bp, Homo sapiens
gttttgtgtttgttgtag

SEQ ID NO: 4575630 - DNA, 14 bp, Homo sapiens
gttttgttaatata

SEQ ID NO: 4575631 - DNA, 16 bp, Homo sapiens
gttttgttcccctcct

SEQ ID NO: 4575632 - DNA, 14 bp, Homo sapiens
gttttgtttcactt

SEQ ID NO: 4575633 - DNA, 15 bp, Homo sapiens
gtttttaaattttgt

SEQ ID NO: 4575634 - DNA, 13 bp, Homo sapiens
gtttttaatagaa

SEQ ID NO: 4575635 - DNA, 13 bp, Homo sapiens
gtttttaatttga

SEQ ID NO: 4575636 - DNA, 20 bp, Homo sapiens
gtttttactgaatgatctat

SEQ ID NO: 4575637 - DNA, 13 bp, Homo sapiens
gtttttactgtat

SEQ ID NO: 4575638 - DNA, 15 bp, Homo sapiens
gtttttatatattat

SEQ ID NO: 4575639 - DNA, 15 bp, Homo sapiens
gtttttatgagaaac

SEQ ID NO: 4575640 - DNA, 18 bp, Homo sapiens
gtttttatggggctgaac

SEQ ID NO: 4575641 - DNA, 16 bp, Homo sapiens
gtttttattccttgtg

SEQ ID NO: 4575642 - DNA, 23 bp, Homo sapiens
gtttttattgctcgcccagacac

SEQ ID NO: 4575643 - DNA, 14 bp, Homo sapiens
gtttttatttcctc

SEQ ID NO: 4575644 - DNA, 15 bp, Homo sapiens
gtttttatttcctct

SEQ ID NO: 4575645 - DNA, 16 bp, Homo sapiens
gtttttatttctttta

SEQ ID NO: 4575646 - DNA, 13 bp, Homo sapiens
gtttttatttttg

SEQ ID NO: 4575647 - DNA, 14 bp, Homo sapiens
gtttttcagttttc

SEQ ID NO: 4575648 - DNA, 22 bp, Homo sapiens
gtttttcatactgtacacattt

SEQ ID NO: 4575649 - DNA, 20 bp, Homo sapiens
gtttttcatcttttgaagag

SEQ ID NO: 4575650 - DNA, 16 bp, Homo sapiens
gtttttcattttaaaa

SEQ ID NO: 4575651 - DNA, 15 bp, Homo sapiens
gtttttccctaatct

SEQ ID NO: 4575652 - DNA, 13 bp, Homo sapiens
gtttttccctccc

SEQ ID NO: 4575653 - DNA, 17 bp, Homo sapiens
gtttttccctccccaga

SEQ ID NO: 4575654 - DNA, 18 bp, Homo sapiens
gtttttccctccccagaa

SEQ ID NO: 4575655 - DNA, 20 bp, Homo sapiens
gtttttcctatcatgttaac

SEQ ID NO: 4575656 - DNA, 13 bp, Homo sapiens
gtttttcctccca

SEQ ID NO: 4575657 - DNA, 18 bp, Homo sapiens
gtttttcctttttttgta

SEQ ID NO: 4575658 - DNA, 14 bp, Homo sapiens
gtttttctgccagg

SEQ ID NO: 4575659 - DNA, 17 bp, Homo sapiens
gtttttctgccagggag

SEQ ID NO: 4575660 - DNA, 15 bp, Homo sapiens
gtttttcttcagcat

SEQ ID NO: 4575661 - DNA, 18 bp, Homo sapiens
gtttttctttttccacaa

SEQ ID NO: 4575662 - DNA, 23 bp, Homo sapiens
gtttttgcatttttgttttgaaa

SEQ ID NO: 4575663 - DNA, 11 bp, Homo sapiens
gtttttgctgt

SEQ ID NO: 4575664 - DNA, 20 bp, Homo sapiens
gtttttggctgttttccctc

SEQ ID NO: 4575665 - DNA, 17 bp, Homo sapiens
gtttttgtttggagagc

SEQ ID NO: 4575666 - DNA, 17 bp, Homo sapiens
gtttttgtttttgcatg

SEQ ID NO: 4575667 - DNA, 14 bp, Homo sapiens
gttttttcaaaata

SEQ ID NO: 4575668 - DNA, 16 bp, Homo sapiens
gttttttttcagccac

SEQ ID NO: 4575669 - DNA, 17 bp, Homo sapiens
gtttttttttttccaga

SEQ ID NO: 4575670 - DNA, 19 bp, Homo sapiens
taaaaaaaaaaaaaagctt

SEQ ID NO: 4575671 - DNA, 22 bp, Homo sapiens
taaaaaaaatccttgtgactta

SEQ ID NO: 4575672 - DNA, 17 bp, Homo sapiens
taaaaaaacaaatgtta

SEQ ID NO: 4575673 - DNA, 20 bp, Homo sapiens
taaaaaaataagaagaatgc

SEQ ID NO: 4575674 - DNA, 12 bp, Homo sapiens
taaaaaagaaaa

SEQ ID NO: 4575675 - DNA, 12 bp, Homo sapiens
taaaaaagcata

SEQ ID NO: 4575676 - DNA, 13 bp, Homo sapiens
taaaaaagcatta

SEQ ID NO: 4575677 - DNA, 17 bp, Homo sapiens
taaaaaagcttaaaact

SEQ ID NO: 4575678 - DNA, 12 bp, Homo sapiens
taaaaaagtctc

SEQ ID NO: 4575679 - DNA, 14 bp, Homo sapiens
taaaaaagtctcta

SEQ ID NO: 4575680 - DNA, 20 bp, Homo sapiens
taaaaaagtctctatttaaa

SEQ ID NO: 4575681 - DNA, 15 bp, Homo sapiens
taaaaaataatacaa

SEQ ID NO: 4575682 - DNA, 13 bp, Homo sapiens
taaaaaatatttt

SEQ ID NO: 4575683 - DNA, 14 bp, Homo sapiens
taaaaaatattttc

SEQ ID NO: 4575684 - DNA, 16 bp, Homo sapiens
taaaaaatattttctc

SEQ ID NO: 4575685 - DNA, 13 bp, Homo sapiens
taaaaaatctgaa

SEQ ID NO: 4575686 - DNA, 14 bp, Homo sapiens
taaaaaatggtcac

SEQ ID NO: 4575687 - DNA, 15 bp, Homo sapiens
taaaaaatgtgtgta

SEQ ID NO: 4575688 - DNA, 22 bp, Homo sapiens
taaaaaattatggaatatcatc

SEQ ID NO: 4575689 - DNA, 20 bp, Homo sapiens
taaaaacacaccttaaaaca

SEQ ID NO: 4575690 - DNA, 19 bp, Homo sapiens
taaaaacattgcctttgaa

SEQ ID NO: 4575691 - DNA, 19 bp, Homo sapiens
taaaaacattttgaagtgt

SEQ ID NO: 4575692 - DNA, 21 bp, Homo sapiens
taaaaagaggatgatttcaga

SEQ ID NO: 4575693 - DNA, 11 bp, Homo sapiens
taaaaagcaac

SEQ ID NO: 4575694 - DNA, 13 bp, Homo sapiens
taaaaaggaacaa

SEQ ID NO: 4575695 - DNA, 21 bp, Homo sapiens
taaaaaggacatcagcaaaca

SEQ ID NO: 4575696 - DNA, 16 bp, Homo sapiens
taaaaaggtcctgtaa

SEQ ID NO: 4575697 - DNA, 19 bp, Homo sapiens
taaaaagtcagatgtttga

SEQ ID NO: 4575698 - DNA, 22 bp, Homo sapiens
taaaaagttgaaccattatact

SEQ ID NO: 4575699 - DNA, 14 bp, Homo sapiens
taaaaataaaggaa

SEQ ID NO: 4575700 - DNA, 19 bp, Homo sapiens
taaaaataaaggaaaacaa

SEQ ID NO: 4575701 - DNA, 17 bp, Homo sapiens
taaaaataaatagaaaa

SEQ ID NO: 4575702 - DNA, 16 bp, Homo sapiens
taaaaataagtcaaca

SEQ ID NO: 4575703 - DNA, 17 bp, Homo sapiens
taaaaatagaaacctga

SEQ ID NO: 4575704 - DNA, 22 bp, Homo sapiens
taaaaatagaaacctgaatgaa

SEQ ID NO: 4575705 - DNA, 17 bp, Homo sapiens
taaaaatataaattgta

SEQ ID NO: 4575706 - DNA, 19 bp, Homo sapiens
taaaaatataaattgtaca

SEQ ID NO: 4575707 - DNA, 20 bp, Homo sapiens
taaaaatataaattgtacat

SEQ ID NO: 4575708 - DNA, 15 bp, Homo sapiens
taaaaatcatagtac

SEQ ID NO: 4575709 - DNA, 16 bp, Homo sapiens
taaaaatccttttgaa

SEQ ID NO: 4575710 - DNA, 22 bp, Homo sapiens
taaaaatctagcacactcttct

SEQ ID NO: 4575711 - DNA, 21 bp, Homo sapiens
taaaaatgaaggaattacatt

SEQ ID NO: 4575712 - DNA, 16 bp, Homo sapiens
taaaaatgagatttct

SEQ ID NO: 4575713 - DNA, 18 bp, Homo sapiens
taaaaatgagatttctta

SEQ ID NO: 4575714 - DNA, 15 bp, Homo sapiens
taaaaatgatctaaa

SEQ ID NO: 4575715 - DNA, 18 bp, Homo sapiens
taaaaatggtttaaatgg

SEQ ID NO: 4575716 - DNA, 15 bp, Homo sapiens
taaaaattaaaacct

SEQ ID NO: 4575717 - DNA, 14 bp, Homo sapiens
taaaaattaaatat

SEQ ID NO: 4575718 - DNA, 22 bp, Homo sapiens
taaaaattgaatgtggctgaag

SEQ ID NO: 4575719 - DNA, 11 bp, Homo sapiens
taaaacaaaac

SEQ ID NO: 4575720 - DNA, 17 bp, Homo sapiens
taaaacaaaatttgact

SEQ ID NO: 4575721 - DNA, 16 bp, Homo sapiens
taaaacaacagctcga

SEQ ID NO: 4575722 - DNA, 18 bp, Homo sapiens
taaaacacaacaagaaac

SEQ ID NO: 4575723 - DNA, 16 bp, Homo sapiens
taaaacagaagcaaat

SEQ ID NO: 4575724 - DNA, 22 bp, Homo sapiens
taaaacaggtagaattatctaa

SEQ ID NO: 4575725 - DNA, 21 bp, Homo sapiens
taaaacaggttataacagtgt

SEQ ID NO: 4575726 - DNA, 12 bp, Homo sapiens
taaaacagtcat

SEQ ID NO: 4575727 - DNA, 21 bp, Homo sapiens
taaaacatcacctatttaatg

SEQ ID NO: 4575728 - DNA, 13 bp, Homo sapiens
taaaacattatat

SEQ ID NO: 4575729 - DNA, 14 bp, Homo sapiens
taaaacattcccct

SEQ ID NO: 4575730 - DNA, 19 bp, Homo sapiens
taaaacatttgtttccccc

SEQ ID NO: 4575731 - DNA, 17 bp, Homo sapiens
taaaaccaaacatgctt

SEQ ID NO: 4575732 - DNA, 11 bp, Homo sapiens
taaaaccaaag

SEQ ID NO: 4575733 - DNA, 14 bp, Homo sapiens
taaaaccacagcag

SEQ ID NO: 4575734 - DNA, 21 bp, Homo sapiens
taaaaccatgtagaaaatttg

SEQ ID NO: 4575735 - DNA, 15 bp, Homo sapiens
taaaaccctatacaa

SEQ ID NO: 4575736 - DNA, 18 bp, Homo sapiens
taaaacctgagctagaag

SEQ ID NO: 4575737 - DNA, 19 bp, Homo sapiens
taaaactaaggcttttatt

SEQ ID NO: 4575738 - DNA, 22 bp, Homo sapiens
taaaactaaggcttttatttct

SEQ ID NO: 4575739 - DNA, 14 bp, Homo sapiens
taaaactataacat

SEQ ID NO: 4575740 - DNA, 23 bp, Homo sapiens
taaaactataacattatataaca

SEQ ID NO: 4575741 - DNA, 21 bp, Homo sapiens
taaaactcactcactgtttat

SEQ ID NO: 4575742 - DNA, 22 bp, Homo sapiens
taaaactcactcactgtttata

SEQ ID NO: 4575743 - DNA, 23 bp, Homo sapiens
taaaactcactcactgtttataa

SEQ ID NO: 4575744 - DNA, 16 bp, Homo sapiens
taaaactcatcacata

SEQ ID NO: 4575745 - DNA, 19 bp, Homo sapiens
taaaactcatcacataaag

SEQ ID NO: 4575746 - DNA, 22 bp, Homo sapiens
taaaactcatcacataaagaaa

SEQ ID NO: 4575747 - DNA, 22 bp, Homo sapiens
taaaactgaacttgaagctaac

SEQ ID NO: 4575748 - DNA, 21 bp, Homo sapiens
taaaactgcgaggacatcaaa

SEQ ID NO: 4575749 - DNA, 22 bp, Homo sapiens
taaaactgcgaggacatcaaag

SEQ ID NO: 4575750 - DNA, 23 bp, Homo sapiens
taaaactgcgaggacatcaaagt

SEQ ID NO: 4575751 - DNA, 22 bp, Homo sapiens
taaaacttcagtttcacagaaa

SEQ ID NO: 4575752 - DNA, 17 bp, Homo sapiens
taaaactttattttata

SEQ ID NO: 4575753 - DNA, 19 bp, Homo sapiens
taaaagaaatatacagttt

SEQ ID NO: 4575754 - DNA, 19 bp, Homo sapiens
taaaagagacaaactgtaa

SEQ ID NO: 4575755 - DNA, 14 bp, Homo sapiens
taaaagatgaaaat

SEQ ID NO: 4575756 - DNA, 17 bp, Homo sapiens
taaaagatgaaagagca

SEQ ID NO: 4575757 - DNA, 22 bp, Homo sapiens
taaaagatgcaattcaaagata

SEQ ID NO: 4575758 - DNA, 18 bp, Homo sapiens
taaaagcaaaaaagaaaa

SEQ ID NO: 4575759 - DNA, 19 bp, Homo sapiens
taaaagcaaaaaagaaaac

SEQ ID NO: 4575760 - DNA, 13 bp, Homo sapiens
taaaagcaaaata

SEQ ID NO: 4575761 - DNA, 20 bp, Homo sapiens
taaaagcaaatcatttgttt

SEQ ID NO: 4575762 - DNA, 21 bp, Homo sapiens
taaaagcaaatcatttgttta

SEQ ID NO: 4575763 - DNA, 20 bp, Homo sapiens
taaaagcacaagtacttttg

SEQ ID NO: 4575764 - DNA, 12 bp, Homo sapiens
taaaagcctgct

SEQ ID NO: 4575765 - DNA, 14 bp, Homo sapiens
taaaagccttccag

SEQ ID NO: 4575766 - DNA, 22 bp, Homo sapiens
taaaagctatcttcatgtaaat

SEQ ID NO: 4575767 - DNA, 18 bp, Homo sapiens
taaaaggatagtattttt

SEQ ID NO: 4575768 - DNA, 16 bp, Homo sapiens
taaaaggcttccaggc

SEQ ID NO: 4575769 - DNA, 23 bp, Homo sapiens
taaaaggcttccaggctgagagc

SEQ ID NO: 4575770 - DNA, 11 bp, Homo sapiens
taaaagtatta

SEQ ID NO: 4575771 - DNA, 19 bp, Homo sapiens
taaaagtgggcttgattct

SEQ ID NO: 4575772 - DNA, 15 bp, Homo sapiens
taaaagtgtacagac

SEQ ID NO: 4575773 - DNA, 14 bp, Homo sapiens
taaaagttgcaaag

SEQ ID NO: 4575774 - DNA, 18 bp, Homo sapiens
taaaagtttgaaaagcaa

SEQ ID NO: 4575775 - DNA, 14 bp, Homo sapiens
taaaataaaatgaa

SEQ ID NO: 4575776 - DNA, 17 bp, Homo sapiens
taaaataaaatgaaaat

SEQ ID NO: 4575777 - DNA, 22 bp, Homo sapiens
taaaataaaatgaaaattgtat

SEQ ID NO: 4575778 - DNA, 15 bp, Homo sapiens
taaaataaagcaaat

SEQ ID NO: 4575779 - DNA, 12 bp, Homo sapiens
taaaataaagct

SEQ ID NO: 4575780 - DNA, 21 bp, Homo sapiens
taaaataacatattttttctt

SEQ ID NO: 4575781 - DNA, 23 bp, Homo sapiens
taaaataagtggattttgtattt

SEQ ID NO: 4575782 - DNA, 14 bp, Homo sapiens
taaaataagttctt

SEQ ID NO: 4575783 - DNA, 16 bp, Homo sapiens
taaaataatgtactga

SEQ ID NO: 4575784 - DNA, 22 bp, Homo sapiens
taaaataatgtactgaattctt

SEQ ID NO: 4575785 - DNA, 23 bp, Homo sapiens
taaaataatgtactgaattcttt

SEQ ID NO: 4575786 - DNA, 21 bp, Homo sapiens
taaaataattcatatctaaat

SEQ ID NO: 4575787 - DNA, 18 bp, Homo sapiens
taaaatactttttatcac

SEQ ID NO: 4575788 - DNA, 19 bp, Homo sapiens
taaaatagaaattttgtaa

SEQ ID NO: 4575789 - DNA, 13 bp, Homo sapiens
taaaatagcaaaa

SEQ ID NO: 4575790 - DNA, 22 bp, Homo sapiens
taaaatagcaaaagaagaagtt

SEQ ID NO: 4575791 - DNA, 20 bp, Homo sapiens
taaaatagcaataactgaaa

SEQ ID NO: 4575792 - DNA, 21 bp, Homo sapiens
taaaatagcaataactgaaaa

SEQ ID NO: 4575793 - DNA, 20 bp, Homo sapiens
taaaatatagagacaggaca

SEQ ID NO: 4575794 - DNA, 20 bp, Homo sapiens
taaaatatataatatactaa

SEQ ID NO: 4575795 - DNA, 17 bp, Homo sapiens
taaaatatctatttgaa

SEQ ID NO: 4575796 - DNA, 18 bp, Homo sapiens
taaaatattgttttccta

SEQ ID NO: 4575797 - DNA, 23 bp, Homo sapiens
taaaatattttgttaacttttgt

SEQ ID NO: 4575798 - DNA, 19 bp, Homo sapiens
taaaatcactaacattata

SEQ ID NO: 4575799 - DNA, 20 bp, Homo sapiens
taaaatcactaacattatat

SEQ ID NO: 4575800 - DNA, 21 bp, Homo sapiens
taaaatcagtgtgcttgcctt

SEQ ID NO: 4575801 - DNA, 14 bp, Homo sapiens
taaaatccatttta

SEQ ID NO: 4575802 - DNA, 12 bp, Homo sapiens
taaaatctaaaa

SEQ ID NO: 4575803 - DNA, 21 bp, Homo sapiens
taaaatctaaaatttcataat

SEQ ID NO: 4575804 - DNA, 17 bp, Homo sapiens
taaaatctcctaaatgc

SEQ ID NO: 4575805 - DNA, 16 bp, Homo sapiens
taaaatgaaaattgta

SEQ ID NO: 4575806 - DNA, 19 bp, Homo sapiens
taaaatgaacctgctactt

SEQ ID NO: 4575807 - DNA, 20 bp, Homo sapiens
taaaatgaggccggacagag

SEQ ID NO: 4575808 - DNA, 18 bp, Homo sapiens
taaaatgcccatttcgaa

SEQ ID NO: 4575809 - DNA, 19 bp, Homo sapiens
taaaatgcccatttcgaag

SEQ ID NO: 4575810 - DNA, 18 bp, Homo sapiens
taaaatgcctcagctatg

SEQ ID NO: 4575811 - DNA, 20 bp, Homo sapiens
taaaatgcctcagctatgta

SEQ ID NO: 4575812 - DNA, 22 bp, Homo sapiens
taaaatgctcctagaagtctta

SEQ ID NO: 4575813 - DNA, 16 bp, Homo sapiens
taaaatggaataacat

SEQ ID NO: 4575814 - DNA, 12 bp, Homo sapiens
taaaatgtatta

SEQ ID NO: 4575815 - DNA, 20 bp, Homo sapiens
taaaatgtctttccaaatta

SEQ ID NO: 4575816 - DNA, 22 bp, Homo sapiens
taaaatgtctttccaaattatt

SEQ ID NO: 4575817 - DNA, 14 bp, Homo sapiens
taaaatgtgaaaaa

SEQ ID NO: 4575818 - DNA, 12 bp, Homo sapiens
taaaatgtgatt

SEQ ID NO: 4575819 - DNA, 22 bp, Homo sapiens
taaaatgtttattccttctgta

SEQ ID NO: 4575820 - DNA, 21 bp, Homo sapiens
taaaatgtttggatggtttgt

SEQ ID NO: 4575821 - DNA, 20 bp, Homo sapiens
taaaatgttttatgacattt

SEQ ID NO: 4575822 - DNA, 16 bp, Homo sapiens
taaaatgttttcattt

SEQ ID NO: 4575823 - DNA, 21 bp, Homo sapiens
taaaatgttttcattttactg

SEQ ID NO: 4575824 - DNA, 23 bp, Homo sapiens
taaaattaaatttgatggttgaa

SEQ ID NO: 4575825 - DNA, 11 bp, Homo sapiens
taaaattaatg

SEQ ID NO: 4575826 - DNA, 19 bp, Homo sapiens
taaaattatactgtgtgtg

SEQ ID NO: 4575827 - DNA, 14 bp, Homo sapiens
taaaattcagtttt

SEQ ID NO: 4575828 - DNA, 17 bp, Homo sapiens
taaaattccaaattcat

SEQ ID NO: 4575829 - DNA, 13 bp, Homo sapiens
taaaattctgtaa

SEQ ID NO: 4575830 - DNA, 14 bp, Homo sapiens
taaaattctgtaat

SEQ ID NO: 4575831 - DNA, 22 bp, Homo sapiens
taaaattgatattatattaaac

SEQ ID NO: 4575832 - DNA, 19 bp, Homo sapiens
taaaattgcagtttcatgt

SEQ ID NO: 4575833 - DNA, 21 bp, Homo sapiens
taaaattgcagtttcatgtat

SEQ ID NO: 4575834 - DNA, 24 bp, Homo sapiens
taaaattgcagtttcatgtatgta

SEQ ID NO: 4575835 - DNA, 22 bp, Homo sapiens
taaaattggtatatttgaaata

SEQ ID NO: 4575836 - DNA, 14 bp, Homo sapiens
taaaattgtgcata

SEQ ID NO: 4575837 - DNA, 17 bp, Homo sapiens
taaaatttattctactt

SEQ ID NO: 4575838 - DNA, 15 bp, Homo sapiens
taaaatttatttcat

SEQ ID NO: 4575839 - DNA, 20 bp, Homo sapiens
taaaatttcataattctgaa

SEQ ID NO: 4575840 - DNA, 17 bp, Homo sapiens
taaaatttgtagaattg

SEQ ID NO: 4575841 - DNA, 16 bp, Homo sapiens
taaaatttgtgtaaat

SEQ ID NO: 4575842 - DNA, 21 bp, Homo sapiens
taaaatttgtgtaaatttgta

SEQ ID NO: 4575843 - DNA, 20 bp, Homo sapiens
taaaattttattttaaattt

SEQ ID NO: 4575844 - DNA, 19 bp, Homo sapiens
taaacaaaatttcacagtt

SEQ ID NO: 4575845 - DNA, 19 bp, Homo sapiens
taaacaaataaaatacttt

SEQ ID NO: 4575846 - DNA, 22 bp, Homo sapiens
taaacaagtatttgttaattta

SEQ ID NO: 4575847 - DNA, 16 bp, Homo sapiens
taaacaatctttcatg

SEQ ID NO: 4575848 - DNA, 21 bp, Homo sapiens
taaacaatctttcatgtcttg

SEQ ID NO: 4575849 - DNA, 24 bp, Homo sapiens
taaacaatttattttattttagca

SEQ ID NO: 4575850 - DNA, 21 bp, Homo sapiens
taaacacaacaataactttta

SEQ ID NO: 4575851 - DNA, 23 bp, Homo sapiens
taaacacaacaataacttttata

SEQ ID NO: 4575852 - DNA, 15 bp, Homo sapiens
taaacacaggctgtc

SEQ ID NO: 4575853 - DNA, 19 bp, Homo sapiens
taaacacaggctgtcctta

SEQ ID NO: 4575854 - DNA, 20 bp, Homo sapiens
taaacacatagattcacctg

SEQ ID NO: 4575855 - DNA, 20 bp, Homo sapiens
taaacactacacatttgaaa

SEQ ID NO: 4575856 - DNA, 16 bp, Homo sapiens
taaacagacaaaaaca

SEQ ID NO: 4575857 - DNA, 19 bp, Homo sapiens
taaacagacaggaatttag

SEQ ID NO: 4575858 - DNA, 21 bp, Homo sapiens
taaacagcaccaccatttaat

SEQ ID NO: 4575859 - DNA, 22 bp, Homo sapiens
taaacagcaccaccatttaatt

SEQ ID NO: 4575860 - DNA, 21 bp, Homo sapiens
taaacaggtatttttttaaat

SEQ ID NO: 4575861 - DNA, 23 bp, Homo sapiens
taaacaggtatttttttaaatca

SEQ ID NO: 4575862 - DNA, 16 bp, Homo sapiens
taaacagttatttctg

SEQ ID NO: 4575863 - DNA, 15 bp, Homo sapiens
taaacatatggcttt

SEQ ID NO: 4575864 - DNA, 18 bp, Homo sapiens
taaacatatggctttagt

SEQ ID NO: 4575865 - DNA, 22 bp, Homo sapiens
taaacatatttatttttacctg

SEQ ID NO: 4575866 - DNA, 21 bp, Homo sapiens
taaacatatttttatacttta

SEQ ID NO: 4575867 - DNA, 22 bp, Homo sapiens
taaacatatttttatactttat

SEQ ID NO: 4575868 - DNA, 17 bp, Homo sapiens
taaacatcattcatttt

SEQ ID NO: 4575869 - DNA, 13 bp, Homo sapiens
taaacatgtttaa

SEQ ID NO: 4575870 - DNA, 18 bp, Homo sapiens
taaacattacggtacaga

SEQ ID NO: 4575871 - DNA, 21 bp, Homo sapiens
taaacattacggtacagacat

SEQ ID NO: 4575872 - DNA, 20 bp, Homo sapiens
taaacattcctccagcctcc

SEQ ID NO: 4575873 - DNA, 20 bp, Homo sapiens
taaaccaaaaattatgtgtt

SEQ ID NO: 4575874 - DNA, 15 bp, Homo sapiens
taaaccaactctaat

SEQ ID NO: 4575875 - DNA, 16 bp, Homo sapiens
taaaccaactctaata

SEQ ID NO: 4575876 - DNA, 20 bp, Homo sapiens
taaaccaactctaatattgc

SEQ ID NO: 4575877 - DNA, 14 bp, Homo sapiens
taaaccacaagcat

SEQ ID NO: 4575878 - DNA, 11 bp, Homo sapiens
taaaccagtgt

SEQ ID NO: 4575879 - DNA, 13 bp, Homo sapiens
taaaccagtgtga

SEQ ID NO: 4575880 - DNA, 15 bp, Homo sapiens
taaaccagtgtgaac

SEQ ID NO: 4575881 - DNA, 16 bp, Homo sapiens
taaaccagtgtgaacc

SEQ ID NO: 4575882 - DNA, 13 bp, Homo sapiens
taaacccatacaa

SEQ ID NO: 4575883 - DNA, 16 bp, Homo sapiens
taaacccatacaatgt

SEQ ID NO: 4575884 - DNA, 13 bp, Homo sapiens
taaaccctcagag

SEQ ID NO: 4575885 - DNA, 16 bp, Homo sapiens
taaaccctcagagcct

SEQ ID NO: 4575886 - DNA, 20 bp, Homo sapiens
taaaccctccttggtgcctc

SEQ ID NO: 4575887 - DNA, 14 bp, Homo sapiens
taaaccctttagtg

SEQ ID NO: 4575888 - DNA, 21 bp, Homo sapiens
taaacctggaacatctcacct

SEQ ID NO: 4575889 - DNA, 12 bp, Homo sapiens
taaaccttaata

SEQ ID NO: 4575890 - DNA, 23 bp, Homo sapiens
taaacctttccattttacgtttt

SEQ ID NO: 4575891 - DNA, 13 bp, Homo sapiens
taaaccttttttg

SEQ ID NO: 4575892 - DNA, 13 bp, Homo sapiens
taaacggcccagg

SEQ ID NO: 4575893 - DNA, 21 bp, Homo sapiens
taaacggcccaggccaggtgc

SEQ ID NO: 4575894 - DNA, 20 bp, Homo sapiens
taaactaaagtatggtacat

SEQ ID NO: 4575895 - DNA, 14 bp, Homo sapiens
taaactaaatgtgc

SEQ ID NO: 4575896 - DNA, 16 bp, Homo sapiens
taaactacagaatatt

SEQ ID NO: 4575897 - DNA, 22 bp, Homo sapiens
taaactacagaatattaaatat

SEQ ID NO: 4575898 - DNA, 18 bp, Homo sapiens
taaactactatttttctt

SEQ ID NO: 4575899 - DNA, 18 bp, Homo sapiens
taaactactctttgattt

SEQ ID NO: 4575900 - DNA, 13 bp, Homo sapiens
taaactagctttg

SEQ ID NO: 4575901 - DNA, 16 bp, Homo sapiens
taaactctcttctctt

SEQ ID NO: 4575902 - DNA, 18 bp, Homo sapiens
taaactctggacactcta

SEQ ID NO: 4575903 - DNA, 18 bp, Homo sapiens
taaactgaatctatggct

SEQ ID NO: 4575904 - DNA, 13 bp, Homo sapiens
taaactgaggccc

SEQ ID NO: 4575905 - DNA, 22 bp, Homo sapiens
taaactgattagtattcaggca

SEQ ID NO: 4575906 - DNA, 14 bp, Homo sapiens
taaactgtgcacca

SEQ ID NO: 4575907 - DNA, 18 bp, Homo sapiens
taaactgtgtacataact

SEQ ID NO: 4575908 - DNA, 14 bp, Homo sapiens
taaactgttaactt

SEQ ID NO: 4575909 - DNA, 14 bp, Homo sapiens
taaacttcagcaac

SEQ ID NO: 4575910 - DNA, 17 bp, Homo sapiens
taaacttcagcaaccct

SEQ ID NO: 4575911 - DNA, 13 bp, Homo sapiens
taaacttgaaata

SEQ ID NO: 4575912 - DNA, 15 bp, Homo sapiens
taaacttgaaatata

SEQ ID NO: 4575913 - DNA, 18 bp, Homo sapiens
taaacttgaaatatataa

SEQ ID NO: 4575914 - DNA, 13 bp, Homo sapiens
taaacttgtgtat

SEQ ID NO: 4575915 - DNA, 20 bp, Homo sapiens
taaacttgtttgctgtgaac

SEQ ID NO: 4575916 - DNA, 14 bp, Homo sapiens
taaactttagactt

SEQ ID NO: 4575917 - DNA, 18 bp, Homo sapiens
taaactttagacttccca

SEQ ID NO: 4575918 - DNA, 12 bp, Homo sapiens
taaactttgtca

SEQ ID NO: 4575919 - DNA, 22 bp, Homo sapiens
taaacttttaccacttgctgca

SEQ ID NO: 4575920 - DNA, 11 bp, Homo sapiens
taaacttttta

SEQ ID NO: 4575921 - DNA, 19 bp, Homo sapiens
taaactttttaaaatactt

SEQ ID NO: 4575922 - DNA, 16 bp, Homo sapiens
taaactttttttctgt

SEQ ID NO: 4575923 - DNA, 20 bp, Homo sapiens
taaactttttttctgtacca

SEQ ID NO: 4575924 - DNA, 17 bp, Homo sapiens
taaagaaaggaaaagaa

SEQ ID NO: 4575925 - DNA, 11 bp, Homo sapiens
taaagaaagtg

SEQ ID NO: 4575926 - DNA, 15 bp, Homo sapiens
taaagaaagtgtatt

SEQ ID NO: 4575927 - DNA, 23 bp, Homo sapiens
taaagaaagtgtatttggaaata

SEQ ID NO: 4575928 - DNA, 24 bp, Homo sapiens
taaagaaagtgtatttggaaataa

SEQ ID NO: 4575929 - DNA, 22 bp, Homo sapiens
taaagaagaaacttgtaaatat

SEQ ID NO: 4575930 - DNA, 17 bp, Homo sapiens
taaagaagctactattt

SEQ ID NO: 4575931 - DNA, 14 bp, Homo sapiens
taaagaatacttga

SEQ ID NO: 4575932 - DNA, 19 bp, Homo sapiens
taaagaatacttgaacttg

SEQ ID NO: 4575933 - DNA, 19 bp, Homo sapiens
taaagaatatgacttttta

SEQ ID NO: 4575934 - DNA, 17 bp, Homo sapiens
taaagaatcattattta

SEQ ID NO: 4575935 - DNA, 15 bp, Homo sapiens
taaagaatgccattt

SEQ ID NO: 4575936 - DNA, 17 bp, Homo sapiens
taaagaattaatgactt

SEQ ID NO: 4575937 - DNA, 15 bp, Homo sapiens
taaagacaaattttg

SEQ ID NO: 4575938 - DNA, 20 bp, Homo sapiens
taaagacaaccatatttagc

SEQ ID NO: 4575939 - DNA, 20 bp, Homo sapiens
taaagacacatcttattgaa

SEQ ID NO: 4575940 - DNA, 13 bp, Homo sapiens
taaagacatgaag

SEQ ID NO: 4575941 - DNA, 21 bp, Homo sapiens
taaagaccaatttatgggaga

SEQ ID NO: 4575942 - DNA, 22 bp, Homo sapiens
taaagaccaatttatgggagaa

SEQ ID NO: 4575943 - DNA, 16 bp, Homo sapiens
taaagaccagaaattc

SEQ ID NO: 4575944 - DNA, 17 bp, Homo sapiens
taaagactagagcaaaa

SEQ ID NO: 4575945 - DNA, 21 bp, Homo sapiens
taaagactagagcaaaataat

SEQ ID NO: 4575946 - DNA, 14 bp, Homo sapiens
taaagactggcttt

SEQ ID NO: 4575947 - DNA, 13 bp, Homo sapiens
taaagactggttt

SEQ ID NO: 4575948 - DNA, 19 bp, Homo sapiens
taaagactggttttctgcc

SEQ ID NO: 4575949 - DNA, 19 bp, Homo sapiens
taaagacttttatgtgaga

SEQ ID NO: 4575950 - DNA, 22 bp, Homo sapiens
taaagacttttatgtgagattt

SEQ ID NO: 4575951 - DNA, 23 bp, Homo sapiens
taaagacttttatgtgagatttc

SEQ ID NO: 4575952 - DNA, 12 bp, Homo sapiens
taaagagaaact

SEQ ID NO: 4575953 - DNA, 15 bp, Homo sapiens
taaagagaaactttg

SEQ ID NO: 4575954 - DNA, 22 bp, Homo sapiens
taaagagacagtgatattggaa

SEQ ID NO: 4575955 - DNA, 21 bp, Homo sapiens
taaagagcaatcctggaagaa

SEQ ID NO: 4575956 - DNA, 17 bp, Homo sapiens
taaagagcccttgcctc

SEQ ID NO: 4575957 - DNA, 21 bp, Homo sapiens
taaagaggcatcttttctaga

SEQ ID NO: 4575958 - DNA, 21 bp, Homo sapiens
taaagagtgtgttataaaata

SEQ ID NO: 4575959 - DNA, 17 bp, Homo sapiens
taaagatacatgattga

SEQ ID NO: 4575960 - DNA, 18 bp, Homo sapiens
taaagatacatgattgaa

SEQ ID NO: 4575961 - DNA, 19 bp, Homo sapiens
taaagatacatgattgaaa

SEQ ID NO: 4575962 - DNA, 17 bp, Homo sapiens
taaagatatggagaatt

SEQ ID NO: 4575963 - DNA, 24 bp, Homo sapiens
taaagatatggagaattgctgaag

SEQ ID NO: 4575964 - DNA, 23 bp, Homo sapiens
taaagatcatttataatactgtt

SEQ ID NO: 4575965 - DNA, 16 bp, Homo sapiens
taaagatggttttgat

SEQ ID NO: 4575966 - DNA, 17 bp, Homo sapiens
taaagatggttttgatt

SEQ ID NO: 4575967 - DNA, 20 bp, Homo sapiens
taaagattagggaaaatgga

SEQ ID NO: 4575968 - DNA, 11 bp, Homo sapiens
taaagattatt

SEQ ID NO: 4575969 - DNA, 20 bp, Homo sapiens
taaagatttatacagttgaa

SEQ ID NO: 4575970 - DNA, 21 bp, Homo sapiens
taaagatttatttagctattt

SEQ ID NO: 4575971 - DNA, 22 bp, Homo sapiens
taaagatttatttagctatttt

SEQ ID NO: 4575972 - DNA, 22 bp, Homo sapiens
taaagatttctagtaggcagca

SEQ ID NO: 4575973 - DNA, 17 bp, Homo sapiens
taaagattttttaataa

SEQ ID NO: 4575974 - DNA, 20 bp, Homo sapiens
taaagattttttaataattt

SEQ ID NO: 4575975 - DNA, 22 bp, Homo sapiens
taaagattttttaataatttag

SEQ ID NO: 4575976 - DNA, 18 bp, Homo sapiens
taaagcaaactatgattt

SEQ ID NO: 4575977 - DNA, 20 bp, Homo sapiens
taaagcaaactatgatttat

SEQ ID NO: 4575978 - DNA, 21 bp, Homo sapiens
taaagcaaactatgatttatt

SEQ ID NO: 4575979 - DNA, 15 bp, Homo sapiens
taaagcaatatgcat

SEQ ID NO: 4575980 - DNA, 15 bp, Homo sapiens
taaagcagaagcccc

SEQ ID NO: 4575981 - DNA, 13 bp, Homo sapiens
taaagcagtattt

SEQ ID NO: 4575982 - DNA, 14 bp, Homo sapiens
taaagcagtatttt

SEQ ID NO: 4575983 - DNA, 18 bp, Homo sapiens
taaagccatgctaaaatt

SEQ ID NO: 4575984 - DNA, 23 bp, Homo sapiens
taaagcctgtgggtttggtcctt

SEQ ID NO: 4575985 - DNA, 18 bp, Homo sapiens
taaagcctttgatgcaca

SEQ ID NO: 4575986 - DNA, 12 bp, Homo sapiens
taaagctaaact

SEQ ID NO: 4575987 - DNA, 13 bp, Homo sapiens
taaagctaaactg

SEQ ID NO: 4575988 - DNA, 14 bp, Homo sapiens
taaagctaaactga

SEQ ID NO: 4575989 - DNA, 14 bp, Homo sapiens
taaagctcaaatga

SEQ ID NO: 4575990 - DNA, 19 bp, Homo sapiens
taaagctgtgcttggggtc

SEQ ID NO: 4575991 - DNA, 17 bp, Homo sapiens
taaagcttacatagttt

SEQ ID NO: 4575992 - DNA, 21 bp, Homo sapiens
taaagcttacatagttttctt

SEQ ID NO: 4575993 - DNA, 18 bp, Homo sapiens
taaagctttatctttgtg

SEQ ID NO: 4575994 - DNA, 17 bp, Homo sapiens
taaaggaaaacaaaaaa

SEQ ID NO: 4575995 - DNA, 15 bp, Homo sapiens
taaaggatccagaga

SEQ ID NO: 4575996 - DNA, 22 bp, Homo sapiens
taaaggatgtgattgtggaatg

SEQ ID NO: 4575997 - DNA, 21 bp, Homo sapiens
taaaggcaaaaccgtgctctt

SEQ ID NO: 4575998 - DNA, 16 bp, Homo sapiens
taaaggcacaaatagg

SEQ ID NO: 4575999 - DNA, 17 bp, Homo sapiens
taaaggcacaaatagga

SEQ ID NO: 4576000 - DNA, 11 bp, Homo sapiens
taaaggcagct

SEQ ID NO: 4576001 - DNA, 12 bp, Homo sapiens
taaaggcagctg

SEQ ID NO: 4576002 - DNA, 18 bp, Homo sapiens
taaaggcagctgcctctg

SEQ ID NO: 4576003 - DNA, 20 bp, Homo sapiens
taaaggcagctgcctctgct

SEQ ID NO: 4576004 - DNA, 21 bp, Homo sapiens
taaaggcagctgcctctgctc

SEQ ID NO: 4576005 - DNA, 19 bp, Homo sapiens
taaaggccgtcatttcatt

SEQ ID NO: 4576006 - DNA, 17 bp, Homo sapiens
taaagggcaaataatga

SEQ ID NO: 4576007 - DNA, 18 bp, Homo sapiens
taaagggcccaatgaatt

SEQ ID NO: 4576008 - DNA, 22 bp, Homo sapiens
taaaggtgacatcggaaaaata

SEQ ID NO: 4576009 - DNA, 21 bp, Homo sapiens
taaaggtggtgaggcaataaa

SEQ ID NO: 4576010 - DNA, 18 bp, Homo sapiens
taaaggttaaattgcttt

SEQ ID NO: 4576011 - DNA, 15 bp, Homo sapiens
taaaggtttattttt

SEQ ID NO: 4576012 - DNA, 16 bp, Homo sapiens
taaagtacagcctgga

SEQ ID NO: 4576013 - DNA, 17 bp, Homo sapiens
taaagtacctttatgtt

SEQ ID NO: 4576014 - DNA, 19 bp, Homo sapiens
taaagtagggaagttttat

SEQ ID NO: 4576015 - DNA, 20 bp, Homo sapiens
taaagtatagagagaagttc

SEQ ID NO: 4576016 - DNA, 23 bp, Homo sapiens
taaagtatgacccacattacttt

SEQ ID NO: 4576017 - DNA, 14 bp, Homo sapiens
taaagtattccacc

SEQ ID NO: 4576018 - DNA, 23 bp, Homo sapiens
taaagtattccaccttaaattaa

SEQ ID NO: 4576019 - DNA, 13 bp, Homo sapiens
taaagtattcttt

SEQ ID NO: 4576020 - DNA, 15 bp, Homo sapiens
taaagtatttataaa

SEQ ID NO: 4576021 - DNA, 20 bp, Homo sapiens
taaagtatttataaaaatat

SEQ ID NO: 4576022 - DNA, 21 bp, Homo sapiens
taaagtatttataaaaatata

SEQ ID NO: 4576023 - DNA, 20 bp, Homo sapiens
taaagtatttgatgtacatt

SEQ ID NO: 4576024 - DNA, 19 bp, Homo sapiens
taaagtcacacatttctat

SEQ ID NO: 4576025 - DNA, 15 bp, Homo sapiens
taaagtcagaagttt

SEQ ID NO: 4576026 - DNA, 13 bp, Homo sapiens
taaagtcagatgg

SEQ ID NO: 4576027 - DNA, 20 bp, Homo sapiens
taaagtcattattaggaagt

SEQ ID NO: 4576028 - DNA, 17 bp, Homo sapiens
taaagtgaactttgttt

SEQ ID NO: 4576029 - DNA, 17 bp, Homo sapiens
taaagtgagaaaactgt

SEQ ID NO: 4576030 - DNA, 18 bp, Homo sapiens
taaagtgagaaaactgtg

SEQ ID NO: 4576031 - DNA, 22 bp, Homo sapiens
taaagtgatcctaaatatgaca

SEQ ID NO: 4576032 - DNA, 22 bp, Homo sapiens
taaagtgccttataggaatttg

SEQ ID NO: 4576033 - DNA, 13 bp, Homo sapiens
taaagtgccttct

SEQ ID NO: 4576034 - DNA, 16 bp, Homo sapiens
taaagtgccttctggg

SEQ ID NO: 4576035 - DNA, 14 bp, Homo sapiens
taaagtggttttgt

SEQ ID NO: 4576036 - DNA, 14 bp, Homo sapiens
taaagtgttttcag

SEQ ID NO: 4576037 - DNA, 13 bp, Homo sapiens
taaagttatattt

SEQ ID NO: 4576038 - DNA, 15 bp, Homo sapiens
taaagttcaacatgt

SEQ ID NO: 4576039 - DNA, 18 bp, Homo sapiens
taaagttcaacatgttat

SEQ ID NO: 4576040 - DNA, 19 bp, Homo sapiens
taaagttctgcaaaataca

SEQ ID NO: 4576041 - DNA, 21 bp, Homo sapiens
taaagttgtatttcaaatatc

SEQ ID NO: 4576042 - DNA, 13 bp, Homo sapiens
taaataaaaacaa

SEQ ID NO: 4576043 - DNA, 21 bp, Homo sapiens
taaataaaaacacaccttaaa

SEQ ID NO: 4576044 - DNA, 17 bp, Homo sapiens
taaataaaaagaaaggc

SEQ ID NO: 4576045 - DNA, 17 bp, Homo sapiens
taaataaaattcatttc

SEQ ID NO: 4576046 - DNA, 15 bp, Homo sapiens
taaataaaccactgt

SEQ ID NO: 4576047 - DNA, 12 bp, Homo sapiens
taaataaatgtt

SEQ ID NO: 4576048 - DNA, 20 bp, Homo sapiens
taaataacacagatattgtt

SEQ ID NO: 4576049 - DNA, 19 bp, Homo sapiens
taaataaccccattctttg

SEQ ID NO: 4576050 - DNA, 21 bp, Homo sapiens
taaataaccccattctttgct

SEQ ID NO: 4576051 - DNA, 21 bp, Homo sapiens
taaataagaaacaactctttg

SEQ ID NO: 4576052 - DNA, 13 bp, Homo sapiens
taaataattggaa

SEQ ID NO: 4576053 - DNA, 16 bp, Homo sapiens
taaataatttaactac

SEQ ID NO: 4576054 - DNA, 17 bp, Homo sapiens
taaataatttatttaat

SEQ ID NO: 4576055 - DNA, 13 bp, Homo sapiens
taaatacaggaaa

SEQ ID NO: 4576056 - DNA, 14 bp, Homo sapiens
taaatacaggaaac

SEQ ID NO: 4576057 - DNA, 15 bp, Homo sapiens
taaatacaggaaaca

SEQ ID NO: 4576058 - DNA, 16 bp, Homo sapiens
taaatacaggaaacag

SEQ ID NO: 4576059 - DNA, 20 bp, Homo sapiens
taaatacagtcttccatttg

SEQ ID NO: 4576060 - DNA, 22 bp, Homo sapiens
taaatacagtcttccatttgca

SEQ ID NO: 4576061 - DNA, 17 bp, Homo sapiens
taaatactgcaaatcag

SEQ ID NO: 4576062 - DNA, 22 bp, Homo sapiens
taaatactgcaaatcaggcttt

SEQ ID NO: 4576063 - DNA, 14 bp, Homo sapiens
taaatagcataaaa

SEQ ID NO: 4576064 - DNA, 16 bp, Homo sapiens
taaatagcataaaatg

SEQ ID NO: 4576065 - DNA, 12 bp, Homo sapiens
taaataggattt

SEQ ID NO: 4576066 - DNA, 19 bp, Homo sapiens
taaatataccactctttac

SEQ ID NO: 4576067 - DNA, 14 bp, Homo sapiens
taaatatatataaa

SEQ ID NO: 4576068 - DNA, 20 bp, Homo sapiens
taaatatatataaagaatat

SEQ ID NO: 4576069 - DNA, 14 bp, Homo sapiens
taaatatatctacc

SEQ ID NO: 4576070 - DNA, 15 bp, Homo sapiens
taaatatatgtatgt

SEQ ID NO: 4576071 - DNA, 16 bp, Homo sapiens
taaatatatgtatgta

SEQ ID NO: 4576072 - DNA, 13 bp, Homo sapiens
taaatatcaccta

SEQ ID NO: 4576073 - DNA, 13 bp, Homo sapiens
taaatatgaaagt

SEQ ID NO: 4576074 - DNA, 18 bp, Homo sapiens
taaatatgaaccctttgt

SEQ ID NO: 4576075 - DNA, 22 bp, Homo sapiens
taaatatgaaccctttgtttct

SEQ ID NO: 4576076 - DNA, 18 bp, Homo sapiens
taaatattagtgcagtta

SEQ ID NO: 4576077 - DNA, 15 bp, Homo sapiens
taaatattttaaaga

SEQ ID NO: 4576078 - DNA, 13 bp, Homo sapiens
taaatattttcta

SEQ ID NO: 4576079 - DNA, 17 bp, Homo sapiens
taaatattttctatttt

SEQ ID NO: 4576080 - DNA, 22 bp, Homo sapiens
taaatcaaccacctatttttga

SEQ ID NO: 4576081 - DNA, 13 bp, Homo sapiens
taaatcaatggtt

SEQ ID NO: 4576082 - DNA, 14 bp, Homo sapiens
taaatcacagaaaa

SEQ ID NO: 4576083 - DNA, 23 bp, Homo sapiens
taaatcacagaaaatttaactta

SEQ ID NO: 4576084 - DNA, 23 bp, Homo sapiens
taaatcagctgcaatccatttat

SEQ ID NO: 4576085 - DNA, 20 bp, Homo sapiens
taaatcatatataataaatt

SEQ ID NO: 4576086 - DNA, 22 bp, Homo sapiens
taaatcatgatgctagccagca

SEQ ID NO: 4576087 - DNA, 22 bp, Homo sapiens
taaatcatgttgttgtgtgtat

SEQ ID NO: 4576088 - DNA, 15 bp, Homo sapiens
taaatcatttggtta

SEQ ID NO: 4576089 - DNA, 17 bp, Homo sapiens
taaatcattttaggaaa

SEQ ID NO: 4576090 - DNA, 20 bp, Homo sapiens
taaatcattttaggaaagga

SEQ ID NO: 4576091 - DNA, 21 bp, Homo sapiens
taaatcattttaggaaaggat

SEQ ID NO: 4576092 - DNA, 23 bp, Homo sapiens
taaatccaggctttatgtacaaa

SEQ ID NO: 4576093 - DNA, 20 bp, Homo sapiens
taaatcccacatcccagttt

SEQ ID NO: 4576094 - DNA, 13 bp, Homo sapiens
taaatctaacatt

SEQ ID NO: 4576095 - DNA, 15 bp, Homo sapiens
taaatctggggaaga

SEQ ID NO: 4576096 - DNA, 14 bp, Homo sapiens
taaatcttttacaa

SEQ ID NO: 4576097 - DNA, 22 bp, Homo sapiens
taaatgaagtacagtagtttcc

SEQ ID NO: 4576098 - DNA, 15 bp, Homo sapiens
taaatgaatattttg

SEQ ID NO: 4576099 - DNA, 18 bp, Homo sapiens
taaatgacagtaatattg

SEQ ID NO: 4576100 - DNA, 18 bp, Homo sapiens
taaatgatatcaaagaag

SEQ ID NO: 4576101 - DNA, 11 bp, Homo sapiens
taaatgcaata

SEQ ID NO: 4576102 - DNA, 16 bp, Homo sapiens
taaatgcaataagatt

SEQ ID NO: 4576103 - DNA, 18 bp, Homo sapiens
taaatgcaatattcttga

SEQ ID NO: 4576104 - DNA, 17 bp, Homo sapiens
taaatgcccagttcact

SEQ ID NO: 4576105 - DNA, 15 bp, Homo sapiens
taaatgcttaaattt

SEQ ID NO: 4576106 - DNA, 18 bp, Homo sapiens
taaatgcttcttaaagtt

SEQ ID NO: 4576107 - DNA, 22 bp, Homo sapiens
taaatgggtcatgacaagatgg

SEQ ID NO: 4576108 - DNA, 15 bp, Homo sapiens
taaatggttaagaca

SEQ ID NO: 4576109 - DNA, 21 bp, Homo sapiens
taaatggtttctcattaaact

SEQ ID NO: 4576110 - DNA, 22 bp, Homo sapiens
taaatggtttggtgctttttat

SEQ ID NO: 4576111 - DNA, 16 bp, Homo sapiens
taaatggtttttaaat

SEQ ID NO: 4576112 - DNA, 13 bp, Homo sapiens
taaatgtaaagat

SEQ ID NO: 4576113 - DNA, 17 bp, Homo sapiens
taaatgtatactatagt

SEQ ID NO: 4576114 - DNA, 20 bp, Homo sapiens
taaatgtatactatagtacc

SEQ ID NO: 4576115 - DNA, 19 bp, Homo sapiens
taaatgtgatgaatactgt

SEQ ID NO: 4576116 - DNA, 15 bp, Homo sapiens
taaatgtgtatttct

SEQ ID NO: 4576117 - DNA, 14 bp, Homo sapiens
taaatgtgttagca

SEQ ID NO: 4576118 - DNA, 16 bp, Homo sapiens
taaatgtgttagcact

SEQ ID NO: 4576119 - DNA, 22 bp, Homo sapiens
taaatgtgttagcactgatagt

SEQ ID NO: 4576120 - DNA, 19 bp, Homo sapiens
taaatgttatgactatgta

SEQ ID NO: 4576121 - DNA, 23 bp, Homo sapiens
taaatgttatgactatgtaaact

SEQ ID NO: 4576122 - DNA, 11 bp, Homo sapiens
taaatgttcaa

SEQ ID NO: 4576123 - DNA, 16 bp, Homo sapiens
taaatgttcaaactgt

SEQ ID NO: 4576124 - DNA, 14 bp, Homo sapiens
taaatgtttaaaga

SEQ ID NO: 4576125 - DNA, 15 bp, Homo sapiens
taaatgtttaaagaa

SEQ ID NO: 4576126 - DNA, 15 bp, Homo sapiens
taaatgtttcaaaat

SEQ ID NO: 4576127 - DNA, 22 bp, Homo sapiens
taaatgtttcaaaatagacaag

SEQ ID NO: 4576128 - DNA, 20 bp, Homo sapiens
taaatgttttgccagccact

SEQ ID NO: 4576129 - DNA, 12 bp, Homo sapiens
taaattaaacaa

SEQ ID NO: 4576130 - DNA, 13 bp, Homo sapiens
taaattaaacaat

SEQ ID NO: 4576131 - DNA, 21 bp, Homo sapiens
taaattaaatatatgtatgta

SEQ ID NO: 4576132 - DNA, 20 bp, Homo sapiens
taaattaagatcctaaactc

SEQ ID NO: 4576133 - DNA, 12 bp, Homo sapiens
taaattaatatc

SEQ ID NO: 4576134 - DNA, 14 bp, Homo sapiens
taaattaatatctt

SEQ ID NO: 4576135 - DNA, 22 bp, Homo sapiens
taaattacaattgatctgtcat

SEQ ID NO: 4576136 - DNA, 16 bp, Homo sapiens
taaattacaattttat

SEQ ID NO: 4576137 - DNA, 23 bp, Homo sapiens
taaattacaattttatctgtttc

SEQ ID NO: 4576138 - DNA, 17 bp, Homo sapiens
taaattacctttacata

SEQ ID NO: 4576139 - DNA, 21 bp, Homo sapiens
taaattacctttacatatata

SEQ ID NO: 4576140 - DNA, 16 bp, Homo sapiens
taaattactatagcaa

SEQ ID NO: 4576141 - DNA, 17 bp, Homo sapiens
taaattactatagcaaa

SEQ ID NO: 4576142 - DNA, 20 bp, Homo sapiens
taaattactatagcaaagta

SEQ ID NO: 4576143 - DNA, 23 bp, Homo sapiens
taaattactatagcaaagtagta

SEQ ID NO: 4576144 - DNA, 12 bp, Homo sapiens
taaattacttaa

SEQ ID NO: 4576145 - DNA, 20 bp, Homo sapiens
taaattagaaaatattctct

SEQ ID NO: 4576146 - DNA, 14 bp, Homo sapiens
taaattagaatgaa

SEQ ID NO: 4576147 - DNA, 19 bp, Homo sapiens
taaattagaatgaatttat

SEQ ID NO: 4576148 - DNA, 22 bp, Homo sapiens
taaattaggaataaataaaaat

SEQ ID NO: 4576149 - DNA, 23 bp, Homo sapiens
taaattagtgtacctattaaaag

SEQ ID NO: 4576150 - DNA, 16 bp, Homo sapiens
taaattataaggactg

SEQ ID NO: 4576151 - DNA, 19 bp, Homo sapiens
taaattataaggactgcat

SEQ ID NO: 4576152 - DNA, 21 bp, Homo sapiens
taaattataaggactgcatgg

SEQ ID NO: 4576153 - DNA, 13 bp, Homo sapiens
taaattatatatt

SEQ ID NO: 4576154 - DNA, 19 bp, Homo sapiens
taaattatatgatatgcat

SEQ ID NO: 4576155 - DNA, 17 bp, Homo sapiens
taaattatatttgtgct

SEQ ID NO: 4576156 - DNA, 20 bp, Homo sapiens
taaattatgaatattaaagg

SEQ ID NO: 4576157 - DNA, 21 bp, Homo sapiens
taaattatgaatattaaaggt

SEQ ID NO: 4576158 - DNA, 18 bp, Homo sapiens
taaattatggcatttcta

SEQ ID NO: 4576159 - DNA, 22 bp, Homo sapiens
taaattatgtgaccataatgta

SEQ ID NO: 4576160 - DNA, 21 bp, Homo sapiens
taaattatgttccttctccaa

SEQ ID NO: 4576161 - DNA, 15 bp, Homo sapiens
taaattattacttta

SEQ ID NO: 4576162 - DNA, 16 bp, Homo sapiens
taaattattttaaatt

SEQ ID NO: 4576163 - DNA, 15 bp, Homo sapiens
taaattcatttctag

SEQ ID NO: 4576164 - DNA, 16 bp, Homo sapiens
taaattcatttctaga

SEQ ID NO: 4576165 - DNA, 17 bp, Homo sapiens
taaattcatttctagac

SEQ ID NO: 4576166 - DNA, 17 bp, Homo sapiens
taaattccactgaaaat

SEQ ID NO: 4576167 - DNA, 22 bp, Homo sapiens
taaattccactgaaaatttaac

SEQ ID NO: 4576168 - DNA, 23 bp, Homo sapiens
taaattccactgaaaatttaaca

SEQ ID NO: 4576169 - DNA, 18 bp, Homo sapiens
taaattccatatgctcca

SEQ ID NO: 4576170 - DNA, 19 bp, Homo sapiens
taaattcgtgattttcaag

SEQ ID NO: 4576171 - DNA, 19 bp, Homo sapiens
taaattctacctccttgtg

SEQ ID NO: 4576172 - DNA, 14 bp, Homo sapiens
taaattctctttca

SEQ ID NO: 4576173 - DNA, 15 bp, Homo sapiens
taaattcttaaaact

SEQ ID NO: 4576174 - DNA, 22 bp, Homo sapiens
taaattcttttttaaattttct

SEQ ID NO: 4576175 - DNA, 17 bp, Homo sapiens
taaattgatagcagata

SEQ ID NO: 4576176 - DNA, 20 bp, Homo sapiens
taaattgcagaattcaaaag

SEQ ID NO: 4576177 - DNA, 17 bp, Homo sapiens
taaattgctttctatat

SEQ ID NO: 4576178 - DNA, 15 bp, Homo sapiens
taaattgtacatttt

SEQ ID NO: 4576179 - DNA, 20 bp, Homo sapiens
taaattgtttagtggaaaat

SEQ ID NO: 4576180 - DNA, 13 bp, Homo sapiens
taaatttaagaaa

SEQ ID NO: 4576181 - DNA, 22 bp, Homo sapiens
taaatttaagtaagttttataa

SEQ ID NO: 4576182 - DNA, 15 bp, Homo sapiens
taaatttattttctt

SEQ ID NO: 4576183 - DNA, 15 bp, Homo sapiens
taaatttcttatgtg

SEQ ID NO: 4576184 - DNA, 16 bp, Homo sapiens
taaatttcttatgtga

SEQ ID NO: 4576185 - DNA, 22 bp, Homo sapiens
taaatttcttatgtgacattaa

SEQ ID NO: 4576186 - DNA, 11 bp, Homo sapiens
taaatttcttt

SEQ ID NO: 4576187 - DNA, 19 bp, Homo sapiens
taaatttcttttattaata

SEQ ID NO: 4576188 - DNA, 16 bp, Homo sapiens
taaatttgaataagca

SEQ ID NO: 4576189 - DNA, 16 bp, Homo sapiens
taaatttgatggttga

SEQ ID NO: 4576190 - DNA, 11 bp, Homo sapiens
taaatttggtg

SEQ ID NO: 4576191 - DNA, 16 bp, Homo sapiens
taaattttaaagccat

SEQ ID NO: 4576192 - DNA, 17 bp, Homo sapiens
taaattttaactaaatt

SEQ ID NO: 4576193 - DNA, 16 bp, Homo sapiens
taaattttaattcaag

SEQ ID NO: 4576194 - DNA, 17 bp, Homo sapiens
taaattttcaaatcctt

SEQ ID NO: 4576195 - DNA, 12 bp, Homo sapiens
taaattttctaa

SEQ ID NO: 4576196 - DNA, 13 bp, Homo sapiens
taaattttgtaat

SEQ ID NO: 4576197 - DNA, 15 bp, Homo sapiens
taaattttgtaatga

SEQ ID NO: 4576198 - DNA, 13 bp, Homo sapiens
taaatttttcata

SEQ ID NO: 4576199 - DNA, 20 bp, Homo sapiens
taacaaaatgtatgtctggt

SEQ ID NO: 4576200 - DNA, 19 bp, Homo sapiens
taacaaacaagaaagctat

SEQ ID NO: 4576201 - DNA, 21 bp, Homo sapiens
taacaaagcaacctttccctt

SEQ ID NO: 4576202 - DNA, 12 bp, Homo sapiens
taacaaattatt

SEQ ID NO: 4576203 - DNA, 20 bp, Homo sapiens
taacaacatataaaactgtt

SEQ ID NO: 4576204 - DNA, 21 bp, Homo sapiens
taacaacatataaaactgttt

SEQ ID NO: 4576205 - DNA, 14 bp, Homo sapiens
taacaacctggaga

SEQ ID NO: 4576206 - DNA, 15 bp, Homo sapiens
taacaagagtatgtg

SEQ ID NO: 4576207 - DNA, 22 bp, Homo sapiens
taacaagatgtttcattttact

SEQ ID NO: 4576208 - DNA, 21 bp, Homo sapiens
taacaagcatgcataaatcaa

SEQ ID NO: 4576209 - DNA, 19 bp, Homo sapiens
taacaagttccattatgaa

SEQ ID NO: 4576210 - DNA, 19 bp, Homo sapiens
taacaatacatgagaaaga

SEQ ID NO: 4576211 - DNA, 21 bp, Homo sapiens
taacaatccattcacaagcct

SEQ ID NO: 4576212 - DNA, 14 bp, Homo sapiens
taacaattcctcta

SEQ ID NO: 4576213 - DNA, 13 bp, Homo sapiens
taacacaaaggaa

SEQ ID NO: 4576214 - DNA, 23 bp, Homo sapiens
taacacaggataaagttattctt

SEQ ID NO: 4576215 - DNA, 14 bp, Homo sapiens
taacactacagagt

SEQ ID NO: 4576216 - DNA, 21 bp, Homo sapiens
taacactcgactctgctgctc

SEQ ID NO: 4576217 - DNA, 14 bp, Homo sapiens
taacactgtatttt

SEQ ID NO: 4576218 - DNA, 20 bp, Homo sapiens
taacactgtgatttatcttt

SEQ ID NO: 4576219 - DNA, 22 bp, Homo sapiens
taacactgtgatttatctttca

SEQ ID NO: 4576220 - DNA, 13 bp, Homo sapiens
taacagaaattgt

SEQ ID NO: 4576221 - DNA, 14 bp, Homo sapiens
taacagaaattgta

SEQ ID NO: 4576222 - DNA, 13 bp, Homo sapiens
taacagatgtgaa

SEQ ID NO: 4576223 - DNA, 18 bp, Homo sapiens
taacagccctcctctgca

SEQ ID NO: 4576224 - DNA, 20 bp, Homo sapiens
taacagccctcctctgcact

SEQ ID NO: 4576225 - DNA, 17 bp, Homo sapiens
taacagccttttccttc

SEQ ID NO: 4576226 - DNA, 20 bp, Homo sapiens
taacagctacaaacttttaa

SEQ ID NO: 4576227 - DNA, 14 bp, Homo sapiens
taacaggcttctgg

SEQ ID NO: 4576228 - DNA, 15 bp, Homo sapiens
taacagggagaagta

SEQ ID NO: 4576229 - DNA, 14 bp, Homo sapiens
taacagtatttctc

SEQ ID NO: 4576230 - DNA, 23 bp, Homo sapiens
taacagtatttctcttttattct

SEQ ID NO: 4576231 - DNA, 21 bp, Homo sapiens
taacagtgcagggcaaaatat

SEQ ID NO: 4576232 - DNA, 20 bp, Homo sapiens
taacagtgccattgtcttta

SEQ ID NO: 4576233 - DNA, 14 bp, Homo sapiens
taacagtgtaaagt

SEQ ID NO: 4576234 - DNA, 19 bp, Homo sapiens
taacagtgtctttctagcc

SEQ ID NO: 4576235 - DNA, 16 bp, Homo sapiens
taacagttgccacatc

SEQ ID NO: 4576236 - DNA, 21 bp, Homo sapiens
taacagttttgagtaattcaa

SEQ ID NO: 4576237 - DNA, 16 bp, Homo sapiens
taacataactgcttct

SEQ ID NO: 4576238 - DNA, 19 bp, Homo sapiens
taacataactgcttcttgg

SEQ ID NO: 4576239 - DNA, 15 bp, Homo sapiens
taacatattttttct

SEQ ID NO: 4576240 - DNA, 17 bp, Homo sapiens
taacatctttattgaaa

SEQ ID NO: 4576241 - DNA, 21 bp, Homo sapiens
taacatctttattgaaattct

SEQ ID NO: 4576242 - DNA, 22 bp, Homo sapiens
taacatgtgttaagtattttca

SEQ ID NO: 4576243 - DNA, 13 bp, Homo sapiens
taacattaagaaa

SEQ ID NO: 4576244 - DNA, 22 bp, Homo sapiens
taacattatctagttcattgaa

SEQ ID NO: 4576245 - DNA, 12 bp, Homo sapiens
taacatttaaat

SEQ ID NO: 4576246 - DNA, 18 bp, Homo sapiens
taacatttaaattccaca

SEQ ID NO: 4576247 - DNA, 14 bp, Homo sapiens
taacattttacagt

SEQ ID NO: 4576248 - DNA, 21 bp, Homo sapiens
taacattttacagtaaatgtt

SEQ ID NO: 4576249 - DNA, 17 bp, Homo sapiens
taaccaaaaagaccaga

SEQ ID NO: 4576250 - DNA, 20 bp, Homo sapiens
taaccaaaaagaccagacta

SEQ ID NO: 4576251 - DNA, 11 bp, Homo sapiens
taaccaagttc

SEQ ID NO: 4576252 - DNA, 17 bp, Homo sapiens
taaccaatgccttttta

SEQ ID NO: 4576253 - DNA, 15 bp, Homo sapiens
taaccaatttgtaat

SEQ ID NO: 4576254 - DNA, 21 bp, Homo sapiens
taaccaattttcagacacatt

SEQ ID NO: 4576255 - DNA, 18 bp, Homo sapiens
taaccacggttatttaag

SEQ ID NO: 4576256 - DNA, 21 bp, Homo sapiens
taaccacggttatttaagcat

SEQ ID NO: 4576257 - DNA, 20 bp, Homo sapiens
taaccagaattatacagtaa

SEQ ID NO: 4576258 - DNA, 23 bp, Homo sapiens
taaccaggccccagcctccaggc

SEQ ID NO: 4576259 - DNA, 18 bp, Homo sapiens
taaccagtacttctaaga

SEQ ID NO: 4576260 - DNA, 15 bp, Homo sapiens
taaccatccccaact

SEQ ID NO: 4576261 - DNA, 15 bp, Homo sapiens
taacccacctctcct

SEQ ID NO: 4576262 - DNA, 16 bp, Homo sapiens
taacccacctctcctg

SEQ ID NO: 4576263 - DNA, 21 bp, Homo sapiens
taacccacctctcctgccctg

SEQ ID NO: 4576264 - DNA, 15 bp, Homo sapiens
taaccccaggccccg

SEQ ID NO: 4576265 - DNA, 19 bp, Homo sapiens
taaccccagggcactgcca

SEQ ID NO: 4576266 - DNA, 20 bp, Homo sapiens
taaccccagggcactgccag

SEQ ID NO: 4576267 - DNA, 15 bp, Homo sapiens
taaccccattctttg

SEQ ID NO: 4576268 - DNA, 17 bp, Homo sapiens
taaccccattctttgct

SEQ ID NO: 4576269 - DNA, 22 bp, Homo sapiens
taacccccagcccacagagcct

SEQ ID NO: 4576270 - DNA, 15 bp, Homo sapiens
taaccccgggcgggt

SEQ ID NO: 4576271 - DNA, 20 bp, Homo sapiens
taacctatgatattttctgt

SEQ ID NO: 4576272 - DNA, 12 bp, Homo sapiens
taacctcaggga

SEQ ID NO: 4576273 - DNA, 14 bp, Homo sapiens
taacctcatcttct

SEQ ID NO: 4576274 - DNA, 18 bp, Homo sapiens
taacctcatcttcttcac

SEQ ID NO: 4576275 - DNA, 23 bp, Homo sapiens
taacctccagcagactcctgctc

SEQ ID NO: 4576276 - DNA, 17 bp, Homo sapiens
taacctctgcttttatc

SEQ ID NO: 4576277 - DNA, 20 bp, Homo sapiens
taacctctgcttttatctca

SEQ ID NO: 4576278 - DNA, 16 bp, Homo sapiens
taacctgtctatacta

SEQ ID NO: 4576279 - DNA, 18 bp, Homo sapiens
taacctgtctcacctgga

SEQ ID NO: 4576280 - DNA, 16 bp, Homo sapiens
taacctgttatttcta

SEQ ID NO: 4576281 - DNA, 17 bp, Homo sapiens
taaccttaaaattgata

SEQ ID NO: 4576282 - DNA, 20 bp, Homo sapiens
taacctttaaaaatgtataa

SEQ ID NO: 4576283 - DNA, 17 bp, Homo sapiens
taacgagaagtgcttta

SEQ ID NO: 4576284 - DNA, 13 bp, Homo sapiens
taacgctgaactg

SEQ ID NO: 4576285 - DNA, 22 bp, Homo sapiens
taacggaaagtttttagaatgt

SEQ ID NO: 4576286 - DNA, 21 bp, Homo sapiens
taacgggacagtaaacactcc

SEQ ID NO: 4576287 - DNA, 20 bp, Homo sapiens
taacggttaagaaagcactt

SEQ ID NO: 4576288 - DNA, 22 bp, Homo sapiens
taacgtgtatctttaagaaaaa

SEQ ID NO: 4576289 - DNA, 22 bp, Homo sapiens
taacgttataaagccttctaaa

SEQ ID NO: 4576290 - DNA, 17 bp, Homo sapiens
taacgtttaagccaaaa

SEQ ID NO: 4576291 - DNA, 20 bp, Homo sapiens
taacgtttaagccaaaacaa

SEQ ID NO: 4576292 - DNA, 14 bp, Homo sapiens
taactaaatgctca

SEQ ID NO: 4576293 - DNA, 18 bp, Homo sapiens
taactaactgcatacact

SEQ ID NO: 4576294 - DNA, 22 bp, Homo sapiens
taactacccttaattacttaaa

SEQ ID NO: 4576295 - DNA, 13 bp, Homo sapiens
taactactttata

SEQ ID NO: 4576296 - DNA, 20 bp, Homo sapiens
taactagaaccaccaaatat

SEQ ID NO: 4576297 - DNA, 15 bp, Homo sapiens
taactataagataca

SEQ ID NO: 4576298 - DNA, 18 bp, Homo sapiens
taactataagatacaata

SEQ ID NO: 4576299 - DNA, 15 bp, Homo sapiens
taactattgcattta

SEQ ID NO: 4576300 - DNA, 14 bp, Homo sapiens
taactatttttcct

SEQ ID NO: 4576301 - DNA, 11 bp, Homo sapiens
taactccacca

SEQ ID NO: 4576302 - DNA, 19 bp, Homo sapiens
taactcctgtcccttttcc

SEQ ID NO: 4576303 - DNA, 13 bp, Homo sapiens
taactctgcatag

SEQ ID NO: 4576304 - DNA, 20 bp, Homo sapiens
taactctgcatagacaaagg

SEQ ID NO: 4576305 - DNA, 12 bp, Homo sapiens
taactctttgaa

SEQ ID NO: 4576306 - DNA, 16 bp, Homo sapiens
taactgaaaatgaaag

SEQ ID NO: 4576307 - DNA, 20 bp, Homo sapiens
taactgaaaatgtgctatac

SEQ ID NO: 4576308 - DNA, 17 bp, Homo sapiens
taactgactctgttatt

SEQ ID NO: 4576309 - DNA, 19 bp, Homo sapiens
taactgactctgttattga

SEQ ID NO: 4576310 - DNA, 14 bp, Homo sapiens
taactgagagaaag

SEQ ID NO: 4576311 - DNA, 17 bp, Homo sapiens
taactgatgagtaaact

SEQ ID NO: 4576312 - DNA, 18 bp, Homo sapiens
taactgatttaacacttt

SEQ ID NO: 4576313 - DNA, 13 bp, Homo sapiens
taactgatttcta

SEQ ID NO: 4576314 - DNA, 15 bp, Homo sapiens
taactgatttctatg

SEQ ID NO: 4576315 - DNA, 20 bp, Homo sapiens
taactgatttctatggcttt

SEQ ID NO: 4576316 - DNA, 23 bp, Homo sapiens
taactgcaaccttgtttattaaa

SEQ ID NO: 4576317 - DNA, 21 bp, Homo sapiens
taactgctttctgttccaaat

SEQ ID NO: 4576318 - DNA, 21 bp, Homo sapiens
taactggcatgtcatttgcac

SEQ ID NO: 4576319 - DNA, 19 bp, Homo sapiens
taactgggtaatgaaacaa

SEQ ID NO: 4576320 - DNA, 13 bp, Homo sapiens
taactgtaaactt

SEQ ID NO: 4576321 - DNA, 18 bp, Homo sapiens
taactgtaaatgtgacat

SEQ ID NO: 4576322 - DNA, 17 bp, Homo sapiens
taactgtatttcagtat

SEQ ID NO: 4576323 - DNA, 18 bp, Homo sapiens
taactgtatttcagtatt

SEQ ID NO: 4576324 - DNA, 14 bp, Homo sapiens
taactgtatttgaa

SEQ ID NO: 4576325 - DNA, 14 bp, Homo sapiens
taactgtcttgttt

SEQ ID NO: 4576326 - DNA, 14 bp, Homo sapiens
taactgtgaaatac

SEQ ID NO: 4576327 - DNA, 17 bp, Homo sapiens
taactgtgaaatgtacg

SEQ ID NO: 4576328 - DNA, 21 bp, Homo sapiens
taactgttacagtaatgtcat

SEQ ID NO: 4576329 - DNA, 22 bp, Homo sapiens
taactgtttatatgtgttgaaa

SEQ ID NO: 4576330 - DNA, 11 bp, Homo sapiens
taactgtttca

SEQ ID NO: 4576331 - DNA, 17 bp, Homo sapiens
taactgtttcaaagcca

SEQ ID NO: 4576332 - DNA, 19 bp, Homo sapiens
taactgttttagaaattgg

SEQ ID NO: 4576333 - DNA, 17 bp, Homo sapiens
taacttaaatagtattt

SEQ ID NO: 4576334 - DNA, 24 bp, Homo sapiens
taacttagaaggatggcatctcca

SEQ ID NO: 4576335 - DNA, 21 bp, Homo sapiens
taacttagactctagtattta

SEQ ID NO: 4576336 - DNA, 13 bp, Homo sapiens
taacttagttttt

SEQ ID NO: 4576337 - DNA, 15 bp, Homo sapiens
taacttagtttttaa

SEQ ID NO: 4576338 - DNA, 16 bp, Homo sapiens
taacttattaaattta

SEQ ID NO: 4576339 - DNA, 14 bp, Homo sapiens
taacttattgctga

SEQ ID NO: 4576340 - DNA, 19 bp, Homo sapiens
taacttattgctgatttta

SEQ ID NO: 4576341 - DNA, 22 bp, Homo sapiens
taacttattgctgattttaatg

SEQ ID NO: 4576342 - DNA, 14 bp, Homo sapiens
taacttcatattaa

SEQ ID NO: 4576343 - DNA, 14 bp, Homo sapiens
taacttccactgtt

SEQ ID NO: 4576344 - DNA, 17 bp, Homo sapiens
taacttccatgttctgg

SEQ ID NO: 4576345 - DNA, 15 bp, Homo sapiens
taacttcttaaagtt

SEQ ID NO: 4576346 - DNA, 15 bp, Homo sapiens
taacttcttgaaaaa

SEQ ID NO: 4576347 - DNA, 12 bp, Homo sapiens
taacttcttgct

SEQ ID NO: 4576348 - DNA, 18 bp, Homo sapiens
taactttaccaaatgaaa

SEQ ID NO: 4576349 - DNA, 21 bp, Homo sapiens
taactttagaaataaacctta

SEQ ID NO: 4576350 - DNA, 18 bp, Homo sapiens
taactttcaaaagcaaac

SEQ ID NO: 4576351 - DNA, 15 bp, Homo sapiens
taactttctctgtga

SEQ ID NO: 4576352 - DNA, 17 bp, Homo sapiens
taactttctctgtgaaa

SEQ ID NO: 4576353 - DNA, 12 bp, Homo sapiens
taactttctgaa

SEQ ID NO: 4576354 - DNA, 16 bp, Homo sapiens
taactttcttaccatt

SEQ ID NO: 4576355 - DNA, 15 bp, Homo sapiens
taactttggttttct

SEQ ID NO: 4576356 - DNA, 13 bp, Homo sapiens
taacttttccaag

SEQ ID NO: 4576357 - DNA, 12 bp, Homo sapiens
taacttttgtga

SEQ ID NO: 4576358 - DNA, 18 bp, Homo sapiens
taacttttttgagtcatt

SEQ ID NO: 4576359 - DNA, 20 bp, Homo sapiens
taacttttttttctctcttt

SEQ ID NO: 4576360 - DNA, 22 bp, Homo sapiens
taagaaaaaaagcacaaagttc

SEQ ID NO: 4576361 - DNA, 17 bp, Homo sapiens
taagaaaactattaaga

SEQ ID NO: 4576362 - DNA, 16 bp, Homo sapiens
taagaaaagtaatgaa

SEQ ID NO: 4576363 - DNA, 21 bp, Homo sapiens
taagaaaatgtaaaggttttt

SEQ ID NO: 4576364 - DNA, 13 bp, Homo sapiens
taagaaaatttac

SEQ ID NO: 4576365 - DNA, 21 bp, Homo sapiens
taagaaacaactctttgagaa

SEQ ID NO: 4576366 - DNA, 20 bp, Homo sapiens
taagaaaccttgctctcctc

SEQ ID NO: 4576367 - DNA, 19 bp, Homo sapiens
taagaaacttttttattta

SEQ ID NO: 4576368 - DNA, 21 bp, Homo sapiens
taagaaacttttttatttaaa

SEQ ID NO: 4576369 - DNA, 18 bp, Homo sapiens
taagaaagcacttaaaca

SEQ ID NO: 4576370 - DNA, 12 bp, Homo sapiens
taagaaaggaag

SEQ ID NO: 4576371 - DNA, 21 bp, Homo sapiens
taagaaaggaagcattgtaaa

SEQ ID NO: 4576372 - DNA, 22 bp, Homo sapiens
taagaaaggaagcattgtaaaa

SEQ ID NO: 4576373 - DNA, 22 bp, Homo sapiens
taagaaccaaactcctatttca

SEQ ID NO: 4576374 - DNA, 23 bp, Homo sapiens
taagaaccaaactcctatttcaa

SEQ ID NO: 4576375 - DNA, 17 bp, Homo sapiens
taagaacccctctgctt

SEQ ID NO: 4576376 - DNA, 17 bp, Homo sapiens
taagaaccttaatgaca

SEQ ID NO: 4576377 - DNA, 18 bp, Homo sapiens
taagaaccttaatgacaa

SEQ ID NO: 4576378 - DNA, 14 bp, Homo sapiens
taagaactgtacat

SEQ ID NO: 4576379 - DNA, 15 bp, Homo sapiens
taagaactgtacatt

SEQ ID NO: 4576380 - DNA, 20 bp, Homo sapiens
taagaagaaagatttaaagt

SEQ ID NO: 4576381 - DNA, 12 bp, Homo sapiens
taagaagacatt

SEQ ID NO: 4576382 - DNA, 17 bp, Homo sapiens
taagaagattctcgccc

SEQ ID NO: 4576383 - DNA, 13 bp, Homo sapiens
taagaaggcaaaa

SEQ ID NO: 4576384 - DNA, 17 bp, Homo sapiens
taagaaggcaatattaa

SEQ ID NO: 4576385 - DNA, 12 bp, Homo sapiens
taagaagggtgg

SEQ ID NO: 4576386 - DNA, 18 bp, Homo sapiens
taagaagggtgggagtgg

SEQ ID NO: 4576387 - DNA, 19 bp, Homo sapiens
taagaagggtgggagtggg

SEQ ID NO: 4576388 - DNA, 13 bp, Homo sapiens
taagaagtgaaaa

SEQ ID NO: 4576389 - DNA, 13 bp, Homo sapiens
taagaataataaa

SEQ ID NO: 4576390 - DNA, 14 bp, Homo sapiens
taagaataataaaa

SEQ ID NO: 4576391 - DNA, 13 bp, Homo sapiens
taagaataattta

SEQ ID NO: 4576392 - DNA, 18 bp, Homo sapiens
taagaatgaaactataaa

SEQ ID NO: 4576393 - DNA, 13 bp, Homo sapiens
taagaatggccaa

SEQ ID NO: 4576394 - DNA, 16 bp, Homo sapiens
taagaattactttgtg

SEQ ID NO: 4576395 - DNA, 17 bp, Homo sapiens
taagaattcaaatttgt

SEQ ID NO: 4576396 - DNA, 15 bp, Homo sapiens
taagaattcagacat

SEQ ID NO: 4576397 - DNA, 18 bp, Homo sapiens
taagacaagagatctaca

SEQ ID NO: 4576398 - DNA, 21 bp, Homo sapiens
taagacaagagatctacacat

SEQ ID NO: 4576399 - DNA, 16 bp, Homo sapiens
taagacaatagtattt

SEQ ID NO: 4576400 - DNA, 19 bp, Homo sapiens
taagacatgatttccttga

SEQ ID NO: 4576401 - DNA, 23 bp, Homo sapiens
taagacatttttcattcatgaat

SEQ ID NO: 4576402 - DNA, 13 bp, Homo sapiens
taagacgtgaatg

SEQ ID NO: 4576403 - DNA, 19 bp, Homo sapiens
taagacgtgaatgtctcag

SEQ ID NO: 4576404 - DNA, 20 bp, Homo sapiens
taagacgtgaatgtctcagc

SEQ ID NO: 4576405 - DNA, 18 bp, Homo sapiens
taagactactaaggcctt

SEQ ID NO: 4576406 - DNA, 13 bp, Homo sapiens
taagactgctggt

SEQ ID NO: 4576407 - DNA, 18 bp, Homo sapiens
taagagaaaagagagaaa

SEQ ID NO: 4576408 - DNA, 14 bp, Homo sapiens
taagagaagtagaa

SEQ ID NO: 4576409 - DNA, 20 bp, Homo sapiens
taagagaagtagaaatcata

SEQ ID NO: 4576410 - DNA, 22 bp, Homo sapiens
taagagccatttaggggccact

SEQ ID NO: 4576411 - DNA, 23 bp, Homo sapiens
taagagggattagggagagaaga

SEQ ID NO: 4576412 - DNA, 15 bp, Homo sapiens
taagagggcagactg

SEQ ID NO: 4576413 - DNA, 23 bp, Homo sapiens
taagagggcagactgtgaacttg

SEQ ID NO: 4576414 - DNA, 21 bp, Homo sapiens
taagagtagaaactgcaggga

SEQ ID NO: 4576415 - DNA, 14 bp, Homo sapiens
taagataaaataaa

SEQ ID NO: 4576416 - DNA, 20 bp, Homo sapiens
taagatagtgtaacttgctt

SEQ ID NO: 4576417 - DNA, 17 bp, Homo sapiens
taagatcctaaactctc

SEQ ID NO: 4576418 - DNA, 19 bp, Homo sapiens
taagatcctaaactctcta

SEQ ID NO: 4576419 - DNA, 17 bp, Homo sapiens
taagatgtgttcttatt

SEQ ID NO: 4576420 - DNA, 17 bp, Homo sapiens
taagattaataagattt

SEQ ID NO: 4576421 - DNA, 19 bp, Homo sapiens
taagattacaaatcagaag

SEQ ID NO: 4576422 - DNA, 22 bp, Homo sapiens
taagattacaaatcagaagtca

SEQ ID NO: 4576423 - DNA, 17 bp, Homo sapiens
taagattccaaaaagca

SEQ ID NO: 4576424 - DNA, 19 bp, Homo sapiens
taagattctctgcccagcc

SEQ ID NO: 4576425 - DNA, 20 bp, Homo sapiens
taagattctctgcccagccg

SEQ ID NO: 4576426 - DNA, 14 bp, Homo sapiens
taagattcttttaa

SEQ ID NO: 4576427 - DNA, 20 bp, Homo sapiens
taagattgttattaaatgta

SEQ ID NO: 4576428 - DNA, 17 bp, Homo sapiens
taagatttttcaaaatc

SEQ ID NO: 4576429 - DNA, 21 bp, Homo sapiens
taagcaaaatgtgatatgtac

SEQ ID NO: 4576430 - DNA, 14 bp, Homo sapiens
taagcaagaaggca

SEQ ID NO: 4576431 - DNA, 16 bp, Homo sapiens
taagcaagaatgcagt

SEQ ID NO: 4576432 - DNA, 23 bp, Homo sapiens
taagcaagaatgcagtacagaat

SEQ ID NO: 4576433 - DNA, 15 bp, Homo sapiens
taagcaatcatttta

SEQ ID NO: 4576434 - DNA, 14 bp, Homo sapiens
taagcacaattaat

SEQ ID NO: 4576435 - DNA, 18 bp, Homo sapiens
taagcacatcagtacttt

SEQ ID NO: 4576436 - DNA, 23 bp, Homo sapiens
taagcacatcagtacttttctct

SEQ ID NO: 4576437 - DNA, 15 bp, Homo sapiens
taagcacttctagaa

SEQ ID NO: 4576438 - DNA, 13 bp, Homo sapiens
taagcagaaacag

SEQ ID NO: 4576439 - DNA, 17 bp, Homo sapiens
taagcagaacactgcag

SEQ ID NO: 4576440 - DNA, 19 bp, Homo sapiens
taagcagaacatactgttc

SEQ ID NO: 4576441 - DNA, 17 bp, Homo sapiens
taagcagaccactgata

SEQ ID NO: 4576442 - DNA, 17 bp, Homo sapiens
taagcagattgctttaa

SEQ ID NO: 4576443 - DNA, 12 bp, Homo sapiens
taagcagcaaca

SEQ ID NO: 4576444 - DNA, 23 bp, Homo sapiens
taagcagttatggtgatgactta

SEQ ID NO: 4576445 - DNA, 23 bp, Homo sapiens
taagcataaaagatgaaagagca

SEQ ID NO: 4576446 - DNA, 20 bp, Homo sapiens
taagcataatctgaaaacat

SEQ ID NO: 4576447 - DNA, 18 bp, Homo sapiens
taagcatctggctctaat

SEQ ID NO: 4576448 - DNA, 21 bp, Homo sapiens
taagcattaccactcaggcat

SEQ ID NO: 4576449 - DNA, 12 bp, Homo sapiens
taagcatttgta

SEQ ID NO: 4576450 - DNA, 16 bp, Homo sapiens
taagccaaagaaatga

SEQ ID NO: 4576451 - DNA, 13 bp, Homo sapiens
taagccagacatc

SEQ ID NO: 4576452 - DNA, 14 bp, Homo sapiens
taagccagagcctg

SEQ ID NO: 4576453 - DNA, 16 bp, Homo sapiens
taagccagagcctggg

SEQ ID NO: 4576454 - DNA, 23 bp, Homo sapiens
taagccccaacatgttcagaaaa

SEQ ID NO: 4576455 - DNA, 16 bp, Homo sapiens
taagcccttaataata

SEQ ID NO: 4576456 - DNA, 15 bp, Homo sapiens
taagcctacctgctc

SEQ ID NO: 4576457 - DNA, 17 bp, Homo sapiens
taagcctacctgctctc

SEQ ID NO: 4576458 - DNA, 12 bp, Homo sapiens
taagcctggaag

SEQ ID NO: 4576459 - DNA, 22 bp, Homo sapiens
taagcgaagtctttgccttctc

SEQ ID NO: 4576460 - DNA, 21 bp, Homo sapiens
taagcggaacatgtgcttcat

SEQ ID NO: 4576461 - DNA, 14 bp, Homo sapiens
taagctactgccat

SEQ ID NO: 4576462 - DNA, 10 bp, Homo sapiens
taagctgcaa

SEQ ID NO: 4576463 - DNA, 22 bp, Homo sapiens
taagctgtgtctgcccaatgaa

SEQ ID NO: 4576464 - DNA, 21 bp, Homo sapiens
taagcttggtgacaaaattca

SEQ ID NO: 4576465 - DNA, 14 bp, Homo sapiens
taagctttaaatga

SEQ ID NO: 4576466 - DNA, 23 bp, Homo sapiens
taagctttaaatgacagtaatat

SEQ ID NO: 4576467 - DNA, 15 bp, Homo sapiens
taagcttttatttct

SEQ ID NO: 4576468 - DNA, 22 bp, Homo sapiens
taagcttttcattttaatatat

SEQ ID NO: 4576469 - DNA, 15 bp, Homo sapiens
taaggaaaaggattt

SEQ ID NO: 4576470 - DNA, 15 bp, Homo sapiens
taaggaaacttttta

SEQ ID NO: 4576471 - DNA, 21 bp, Homo sapiens
taaggaatgatattgctgaag

SEQ ID NO: 4576472 - DNA, 22 bp, Homo sapiens
taaggacctttttaaagagata

SEQ ID NO: 4576473 - DNA, 10 bp, Homo sapiens
taaggactgc

SEQ ID NO: 4576474 - DNA, 21 bp, Homo sapiens
taaggactttttgatggaatt

SEQ ID NO: 4576475 - DNA, 22 bp, Homo sapiens
taaggaggggaaaaaaatgttg

SEQ ID NO: 4576476 - DNA, 18 bp, Homo sapiens
taaggatccggaaagaag

SEQ ID NO: 4576477 - DNA, 12 bp, Homo sapiens
taaggatgactt

SEQ ID NO: 4576478 - DNA, 17 bp, Homo sapiens
taaggattctgaagttt

SEQ ID NO: 4576479 - DNA, 22 bp, Homo sapiens
taaggattttatgagttcttgt

SEQ ID NO: 4576480 - DNA, 19 bp, Homo sapiens
taaggccattattgtactt

SEQ ID NO: 4576481 - DNA, 16 bp, Homo sapiens
taaggccgtgtctctg

SEQ ID NO: 4576482 - DNA, 18 bp, Homo sapiens
taaggccttttatgtaat

SEQ ID NO: 4576483 - DNA, 21 bp, Homo sapiens
taaggccttttatgtaatttc

SEQ ID NO: 4576484 - DNA, 18 bp, Homo sapiens
taaggcgtgagccactgc

SEQ ID NO: 4576485 - DNA, 17 bp, Homo sapiens
taagggaaaaatatata

SEQ ID NO: 4576486 - DNA, 13 bp, Homo sapiens
taagggaagaatt

SEQ ID NO: 4576487 - DNA, 13 bp, Homo sapiens
taagggaataaaa

SEQ ID NO: 4576488 - DNA, 17 bp, Homo sapiens
taagggacatttctata

SEQ ID NO: 4576489 - DNA, 14 bp, Homo sapiens
taagggagggaagg

SEQ ID NO: 4576490 - DNA, 22 bp, Homo sapiens
taagggcaaggagtttattaca

SEQ ID NO: 4576491 - DNA, 17 bp, Homo sapiens
taagggtcactggcctc

SEQ ID NO: 4576492 - DNA, 13 bp, Homo sapiens
taaggtctcatgc

SEQ ID NO: 4576493 - DNA, 21 bp, Homo sapiens
taaggtgctctctttctgtct

SEQ ID NO: 4576494 - DNA, 16 bp, Homo sapiens
taaggtgcttgctccc

SEQ ID NO: 4576495 - DNA, 21 bp, Homo sapiens
taaggtggacagcagacaaga

SEQ ID NO: 4576496 - DNA, 19 bp, Homo sapiens
taaggtgtgcagtgttttt

SEQ ID NO: 4576497 - DNA, 19 bp, Homo sapiens
taaggtgtgtactcagggc

SEQ ID NO: 4576498 - DNA, 19 bp, Homo sapiens
taagtaaaagtctacctgt

SEQ ID NO: 4576499 - DNA, 12 bp, Homo sapiens
taagtaaagtga

SEQ ID NO: 4576500 - DNA, 14 bp, Homo sapiens
taagtaaagtggtt

SEQ ID NO: 4576501 - DNA, 23 bp, Homo sapiens
taagtaacgtgctcactgtgtat

SEQ ID NO: 4576502 - DNA, 16 bp, Homo sapiens
taagtaatttagaaga

SEQ ID NO: 4576503 - DNA, 15 bp, Homo sapiens
taagtagatttcatg

SEQ ID NO: 4576504 - DNA, 16 bp, Homo sapiens
taagtatcttgtgctt

SEQ ID NO: 4576505 - DNA, 14 bp, Homo sapiens
taagtatgttattt

SEQ ID NO: 4576506 - DNA, 21 bp, Homo sapiens
taagtattatgtctcttctga

SEQ ID NO: 4576507 - DNA, 20 bp, Homo sapiens
taagtcatctgatgagaaca

SEQ ID NO: 4576508 - DNA, 18 bp, Homo sapiens
taagtcattcataaacct

SEQ ID NO: 4576509 - DNA, 19 bp, Homo sapiens
taagtcattttttacttga

SEQ ID NO: 4576510 - DNA, 18 bp, Homo sapiens
taagtccagaagcctcct

SEQ ID NO: 4576511 - DNA, 20 bp, Homo sapiens
taagtcccattcagtggcaa

SEQ ID NO: 4576512 - DNA, 21 bp, Homo sapiens
taagtctatctggtattaaat

SEQ ID NO: 4576513 - DNA, 21 bp, Homo sapiens
taagtctgatgttctttccat

SEQ ID NO: 4576514 - DNA, 14 bp, Homo sapiens
taagtctgggcact

SEQ ID NO: 4576515 - DNA, 14 bp, Homo sapiens
taagtgaaggagaa

SEQ ID NO: 4576516 - DNA, 19 bp, Homo sapiens
taagtgatgtgctgaattt

SEQ ID NO: 4576517 - DNA, 22 bp, Homo sapiens
taagtgatgtgctgaattttat

SEQ ID NO: 4576518 - DNA, 22 bp, Homo sapiens
taagtgccaggatggaatgatg

SEQ ID NO: 4576519 - DNA, 13 bp, Homo sapiens
taagtgccttcca

SEQ ID NO: 4576520 - DNA, 23 bp, Homo sapiens
taagtgccttggatgagaagtgt

SEQ ID NO: 4576521 - DNA, 19 bp, Homo sapiens
taagtggactggtgtcata

SEQ ID NO: 4576522 - DNA, 16 bp, Homo sapiens
taagtggctgccttct

SEQ ID NO: 4576523 - DNA, 19 bp, Homo sapiens
taagtgggacattagtaac

SEQ ID NO: 4576524 - DNA, 14 bp, Homo sapiens
taagtgtaaatgaa

SEQ ID NO: 4576525 - DNA, 21 bp, Homo sapiens
taagttcttatgaggagggga

SEQ ID NO: 4576526 - DNA, 15 bp, Homo sapiens
taagttgacctttat

SEQ ID NO: 4576527 - DNA, 17 bp, Homo sapiens
taagttgacctttattt

SEQ ID NO: 4576528 - DNA, 23 bp, Homo sapiens
taagttgacctttatttattaaa

SEQ ID NO: 4576529 - DNA, 23 bp, Homo sapiens
taagttgagcgtgcgcactgcat

SEQ ID NO: 4576530 - DNA, 18 bp, Homo sapiens
taagttgtcaaagaagct

SEQ ID NO: 4576531 - DNA, 16 bp, Homo sapiens
taagtttagaagcgct

SEQ ID NO: 4576532 - DNA, 21 bp, Homo sapiens
taagtttcactcacatagcca

SEQ ID NO: 4576533 - DNA, 16 bp, Homo sapiens
taataaaaagattgaa

SEQ ID NO: 4576534 - DNA, 12 bp, Homo sapiens
taataaaactgt

SEQ ID NO: 4576535 - DNA, 18 bp, Homo sapiens
taataaaactgtttgact

SEQ ID NO: 4576536 - DNA, 22 bp, Homo sapiens
taataaaagctttgactccctg

SEQ ID NO: 4576537 - DNA, 17 bp, Homo sapiens
taataaaagtacatgtt

SEQ ID NO: 4576538 - DNA, 12 bp, Homo sapiens
taataaaatcac

SEQ ID NO: 4576539 - DNA, 15 bp, Homo sapiens
taataaactgtgttt

SEQ ID NO: 4576540 - DNA, 12 bp, Homo sapiens
taataaaggact

SEQ ID NO: 4576541 - DNA, 20 bp, Homo sapiens
taataaaggactgtaatctt

SEQ ID NO: 4576542 - DNA, 15 bp, Homo sapiens
taataaagtattcca

SEQ ID NO: 4576543 - DNA, 18 bp, Homo sapiens
taataaagtgttttcaga

SEQ ID NO: 4576544 - DNA, 15 bp, Homo sapiens
taataaattttctaa

SEQ ID NO: 4576545 - DNA, 13 bp, Homo sapiens
taataactgtgta

SEQ ID NO: 4576546 - DNA, 14 bp, Homo sapiens
taataactttctct

SEQ ID NO: 4576547 - DNA, 14 bp, Homo sapiens
taataagaacagat

SEQ ID NO: 4576548 - DNA, 15 bp, Homo sapiens
taataagaacagatc

SEQ ID NO: 4576549 - DNA, 20 bp, Homo sapiens
taataagatttttcaaaatc

SEQ ID NO: 4576550 - DNA, 19 bp, Homo sapiens
taataagcatggtgtcagt

SEQ ID NO: 4576551 - DNA, 17 bp, Homo sapiens
taataagtgatgtgctg

SEQ ID NO: 4576552 - DNA, 10 bp, Homo sapiens
taataatatt

SEQ ID NO: 4576553 - DNA, 23 bp, Homo sapiens
taataatgagctattaaaactca

SEQ ID NO: 4576554 - DNA, 15 bp, Homo sapiens
taataatgtacagag

SEQ ID NO: 4576555 - DNA, 15 bp, Homo sapiens
taataatgtttaata

SEQ ID NO: 4576556 - DNA, 19 bp, Homo sapiens
taataatttttgctgaatt

SEQ ID NO: 4576557 - DNA, 15 bp, Homo sapiens
taatacaaactatat

SEQ ID NO: 4576558 - DNA, 18 bp, Homo sapiens
taatacagcaacaattta

SEQ ID NO: 4576559 - DNA, 17 bp, Homo sapiens
taatacatactaatgaa

SEQ ID NO: 4576560 - DNA, 19 bp, Homo sapiens
taatacctgattgatcaca

SEQ ID NO: 4576561 - DNA, 20 bp, Homo sapiens
taatacctgattgatcacac

SEQ ID NO: 4576562 - DNA, 14 bp, Homo sapiens
taatactctatttt

SEQ ID NO: 4576563 - DNA, 21 bp, Homo sapiens
taatacttctttgttattata

SEQ ID NO: 4576564 - DNA, 20 bp, Homo sapiens
taatactttgtatacaagta

SEQ ID NO: 4576565 - DNA, 17 bp, Homo sapiens
taatactttttaaatta

SEQ ID NO: 4576566 - DNA, 14 bp, Homo sapiens
taatagaataaagg

SEQ ID NO: 4576567 - DNA, 21 bp, Homo sapiens
taatagatgtttgatagattt

SEQ ID NO: 4576568 - DNA, 22 bp, Homo sapiens
taatagattttttcagacttgt

SEQ ID NO: 4576569 - DNA, 13 bp, Homo sapiens
taatagcaaagaa

SEQ ID NO: 4576570 - DNA, 18 bp, Homo sapiens
taatagccaaagatttca

SEQ ID NO: 4576571 - DNA, 12 bp, Homo sapiens
taatagctcaga

SEQ ID NO: 4576572 - DNA, 15 bp, Homo sapiens
taataggagtatttt

SEQ ID NO: 4576573 - DNA, 14 bp, Homo sapiens
taatagggaatata

SEQ ID NO: 4576574 - DNA, 15 bp, Homo sapiens
taatagggaatatat

SEQ ID NO: 4576575 - DNA, 21 bp, Homo sapiens
taatagtttttcactttgtgt

SEQ ID NO: 4576576 - DNA, 21 bp, Homo sapiens
taatataaaaagcttccatga

SEQ ID NO: 4576577 - DNA, 16 bp, Homo sapiens
taatataaaagatctt

SEQ ID NO: 4576578 - DNA, 14 bp, Homo sapiens
taatataaatgttg

SEQ ID NO: 4576579 - DNA, 20 bp, Homo sapiens
taatataagtttctttagaa

SEQ ID NO: 4576580 - DNA, 16 bp, Homo sapiens
taatataatgtatttt

SEQ ID NO: 4576581 - DNA, 16 bp, Homo sapiens
taatatactaaaccaa

SEQ ID NO: 4576582 - DNA, 12 bp, Homo sapiens
taatatagaaaa

SEQ ID NO: 4576583 - DNA, 17 bp, Homo sapiens
taatatatatctgctgt

SEQ ID NO: 4576584 - DNA, 18 bp, Homo sapiens
taatatatgggggaaaat

SEQ ID NO: 4576585 - DNA, 15 bp, Homo sapiens
taatatattaaaatt

SEQ ID NO: 4576586 - DNA, 16 bp, Homo sapiens
taatatattaaaattc

SEQ ID NO: 4576587 - DNA, 14 bp, Homo sapiens
taatatattgaaca

SEQ ID NO: 4576588 - DNA, 15 bp, Homo sapiens
taatatatttatata

SEQ ID NO: 4576589 - DNA, 21 bp, Homo sapiens
taatatattttctgttttctt

SEQ ID NO: 4576590 - DNA, 15 bp, Homo sapiens
taatatcaaaagaaa

SEQ ID NO: 4576591 - DNA, 22 bp, Homo sapiens
taatatcaaaagaaaattgata

SEQ ID NO: 4576592 - DNA, 18 bp, Homo sapiens
taatatcaaagcatttta

SEQ ID NO: 4576593 - DNA, 14 bp, Homo sapiens
taatatcactcatt

SEQ ID NO: 4576594 - DNA, 18 bp, Homo sapiens
taatatcactcattaatt

SEQ ID NO: 4576595 - DNA, 16 bp, Homo sapiens
taatatctaaagttat

SEQ ID NO: 4576596 - DNA, 21 bp, Homo sapiens
taatatgctgcaacaaaatgt

SEQ ID NO: 4576597 - DNA, 22 bp, Homo sapiens
taatatgctgcaacaaaatgta

SEQ ID NO: 4576598 - DNA, 12 bp, Homo sapiens
taatatgtttag

SEQ ID NO: 4576599 - DNA, 22 bp, Homo sapiens
taatatgtttttttaaacctca

SEQ ID NO: 4576600 - DNA, 23 bp, Homo sapiens
taatattagttggctttcataaa

SEQ ID NO: 4576601 - DNA, 21 bp, Homo sapiens
taatattcagccagcttaaac

SEQ ID NO: 4576602 - DNA, 16 bp, Homo sapiens
taatattggcatagaa

SEQ ID NO: 4576603 - DNA, 15 bp, Homo sapiens
taatattgtttttct

SEQ ID NO: 4576604 - DNA, 23 bp, Homo sapiens
taatattgtttttctttctacaa

SEQ ID NO: 4576605 - DNA, 14 bp, Homo sapiens
taatatttaatgga

SEQ ID NO: 4576606 - DNA, 20 bp, Homo sapiens
taatatttacaatgtattaa

SEQ ID NO: 4576607 - DNA, 12 bp, Homo sapiens
taatatttatgt

SEQ ID NO: 4576608 - DNA, 14 bp, Homo sapiens
taatatttgaattg

SEQ ID NO: 4576609 - DNA, 15 bp, Homo sapiens
taatattttgtaata

SEQ ID NO: 4576610 - DNA, 17 bp, Homo sapiens
taatattttgtaatatt

SEQ ID NO: 4576611 - DNA, 22 bp, Homo sapiens
taatattttgtaatattctgtt

SEQ ID NO: 4576612 - DNA, 17 bp, Homo sapiens
taatcaaaagctattta

SEQ ID NO: 4576613 - DNA, 15 bp, Homo sapiens
taatcaaatgatttc

SEQ ID NO: 4576614 - DNA, 16 bp, Homo sapiens
taatcaaatgatttca

SEQ ID NO: 4576615 - DNA, 17 bp, Homo sapiens
taatcaaatgatttcat

SEQ ID NO: 4576616 - DNA, 23 bp, Homo sapiens
taatcaccctaccaactttactg

SEQ ID NO: 4576617 - DNA, 18 bp, Homo sapiens
taatcacgctttcctgaa

SEQ ID NO: 4576618 - DNA, 22 bp, Homo sapiens
taatcagaatggaagagagaaa

SEQ ID NO: 4576619 - DNA, 15 bp, Homo sapiens
taatcagattgctta

SEQ ID NO: 4576620 - DNA, 14 bp, Homo sapiens
taatcatacaaact

SEQ ID NO: 4576621 - DNA, 18 bp, Homo sapiens
taatcatagattattata

SEQ ID NO: 4576622 - DNA, 15 bp, Homo sapiens
taatcatgaaccaat

SEQ ID NO: 4576623 - DNA, 18 bp, Homo sapiens
taatcattatctcacttt

SEQ ID NO: 4576624 - DNA, 15 bp, Homo sapiens
taatcattatttgag

SEQ ID NO: 4576625 - DNA, 21 bp, Homo sapiens
taatcatttgtttacatttga

SEQ ID NO: 4576626 - DNA, 19 bp, Homo sapiens
taatcattttaataaagtt

SEQ ID NO: 4576627 - DNA, 17 bp, Homo sapiens
taatcattttagaatta

SEQ ID NO: 4576628 - DNA, 23 bp, Homo sapiens
taatcattttagaattaaaattt

SEQ ID NO: 4576629 - DNA, 13 bp, Homo sapiens
taatcattttcat

SEQ ID NO: 4576630 - DNA, 13 bp, Homo sapiens
taatccctgcttt

SEQ ID NO: 4576631 - DNA, 14 bp, Homo sapiens
taatccctgctttt

SEQ ID NO: 4576632 - DNA, 21 bp, Homo sapiens
taatccctgctttttgtgttt

SEQ ID NO: 4576633 - DNA, 16 bp, Homo sapiens
taatcctgcacagatc

SEQ ID NO: 4576634 - DNA, 22 bp, Homo sapiens
taatccttctttgtaatacttt

SEQ ID NO: 4576635 - DNA, 15 bp, Homo sapiens
taatccttttcctta

SEQ ID NO: 4576636 - DNA, 23 bp, Homo sapiens
taatccttttccttatttgcctt

SEQ ID NO: 4576637 - DNA, 13 bp, Homo sapiens
taatcgaagcaaa

SEQ ID NO: 4576638 - DNA, 15 bp, Homo sapiens
taatcggcccacagc

SEQ ID NO: 4576639 - DNA, 19 bp, Homo sapiens
taatctaaaagctctgttc

SEQ ID NO: 4576640 - DNA, 20 bp, Homo sapiens
taatctaagtatatgtgaga

SEQ ID NO: 4576641 - DNA, 13 bp, Homo sapiens
taatctacaccaa

SEQ ID NO: 4576642 - DNA, 17 bp, Homo sapiens
taatctacaccaatgaa

SEQ ID NO: 4576643 - DNA, 19 bp, Homo sapiens
taatctacaccaatgaaaa

SEQ ID NO: 4576644 - DNA, 20 bp, Homo sapiens
taatctacaccaatgaaaac

SEQ ID NO: 4576645 - DNA, 13 bp, Homo sapiens
taatctactgtat

SEQ ID NO: 4576646 - DNA, 16 bp, Homo sapiens
taatctatattaaatg

SEQ ID NO: 4576647 - DNA, 17 bp, Homo sapiens
taatctatattaaatga

SEQ ID NO: 4576648 - DNA, 18 bp, Homo sapiens
taatctatattaaatgag

SEQ ID NO: 4576649 - DNA, 17 bp, Homo sapiens
taatctcctctgctcat

SEQ ID NO: 4576650 - DNA, 16 bp, Homo sapiens
taatctgcctggtttt

SEQ ID NO: 4576651 - DNA, 18 bp, Homo sapiens
taatctgtataatacttt

SEQ ID NO: 4576652 - DNA, 15 bp, Homo sapiens
taatctgtcagtgtt

SEQ ID NO: 4576653 - DNA, 15 bp, Homo sapiens
taatcttagtgtatg

SEQ ID NO: 4576654 - DNA, 18 bp, Homo sapiens
taatcttataattgttct

SEQ ID NO: 4576655 - DNA, 15 bp, Homo sapiens
taatcttatttagga

SEQ ID NO: 4576656 - DNA, 22 bp, Homo sapiens
taatcttcagaggtgctaaatt

SEQ ID NO: 4576657 - DNA, 17 bp, Homo sapiens
taatcttgttgataaaa

SEQ ID NO: 4576658 - DNA, 19 bp, Homo sapiens
taatctttacctgtataca

SEQ ID NO: 4576659 - DNA, 16 bp, Homo sapiens
taatctttcaaaccag

SEQ ID NO: 4576660 - DNA, 14 bp, Homo sapiens
taatcttttattta

SEQ ID NO: 4576661 - DNA, 16 bp, Homo sapiens
taatgaaaataaaaca

SEQ ID NO: 4576662 - DNA, 20 bp, Homo sapiens
taatgaaagggtttgtaata

SEQ ID NO: 4576663 - DNA, 19 bp, Homo sapiens
taatgaaagtgatgacata

SEQ ID NO: 4576664 - DNA, 17 bp, Homo sapiens
taatgaaatgataaaga

SEQ ID NO: 4576665 - DNA, 20 bp, Homo sapiens
taatgaaatgataaagactt

SEQ ID NO: 4576666 - DNA, 16 bp, Homo sapiens
taatgaaatgtttact

SEQ ID NO: 4576667 - DNA, 14 bp, Homo sapiens
taatgaacaaaatt

SEQ ID NO: 4576668 - DNA, 17 bp, Homo sapiens
taatgaacaaaattatt

SEQ ID NO: 4576669 - DNA, 20 bp, Homo sapiens
taatgaaggttttcatttgc

SEQ ID NO: 4576670 - DNA, 16 bp, Homo sapiens
taatgaatttttatga

SEQ ID NO: 4576671 - DNA, 19 bp, Homo sapiens
taatgacttgtacaaacag

SEQ ID NO: 4576672 - DNA, 24 bp, Homo sapiens
taatgacttgtacaaacagtattt

SEQ ID NO: 4576673 - DNA, 17 bp, Homo sapiens
taatgacttttaaaatt

SEQ ID NO: 4576674 - DNA, 17 bp, Homo sapiens
taatgagagtgcactgc

SEQ ID NO: 4576675 - DNA, 18 bp, Homo sapiens
taatgagagtgcactgct

SEQ ID NO: 4576676 - DNA, 21 bp, Homo sapiens
taatgagctattaaaactcag

SEQ ID NO: 4576677 - DNA, 23 bp, Homo sapiens
taatgaggagagaaaatatatgt

SEQ ID NO: 4576678 - DNA, 14 bp, Homo sapiens
taatgatgtaacag

SEQ ID NO: 4576679 - DNA, 16 bp, Homo sapiens
taatgattaagggaca

SEQ ID NO: 4576680 - DNA, 22 bp, Homo sapiens
taatgattaagggacatttcta

SEQ ID NO: 4576681 - DNA, 12 bp, Homo sapiens
taatgattttgg

SEQ ID NO: 4576682 - DNA, 22 bp, Homo sapiens
taatgcactctgggtctggcca

SEQ ID NO: 4576683 - DNA, 12 bp, Homo sapiens
taatgcactttc

SEQ ID NO: 4576684 - DNA, 21 bp, Homo sapiens
taatgcagtatggtacatttt

SEQ ID NO: 4576685 - DNA, 20 bp, Homo sapiens
taatgcagtttttaaaaacc

SEQ ID NO: 4576686 - DNA, 16 bp, Homo sapiens
taatgcattgttgtaa

SEQ ID NO: 4576687 - DNA, 17 bp, Homo sapiens
taatgcattgttgtaaa

SEQ ID NO: 4576688 - DNA, 19 bp, Homo sapiens
taatgcattgttgtaaagt

SEQ ID NO: 4576689 - DNA, 16 bp, Homo sapiens
taatgccaatgaacat

SEQ ID NO: 4576690 - DNA, 15 bp, Homo sapiens
taatgcctttgtaac

SEQ ID NO: 4576691 - DNA, 19 bp, Homo sapiens
taatgctcttcaaaataaa

SEQ ID NO: 4576692 - DNA, 16 bp, Homo sapiens
taatgctgtacagcag

SEQ ID NO: 4576693 - DNA, 17 bp, Homo sapiens
taatgctgttgcctcat

SEQ ID NO: 4576694 - DNA, 21 bp, Homo sapiens
taatgcttacctaatttcatt

SEQ ID NO: 4576695 - DNA, 21 bp, Homo sapiens
taatggaaaatgccatgaatt

SEQ ID NO: 4576696 - DNA, 12 bp, Homo sapiens
taatggagaaga

SEQ ID NO: 4576697 - DNA, 17 bp, Homo sapiens
taatggagcatcaagcc

SEQ ID NO: 4576698 - DNA, 16 bp, Homo sapiens
taatggattgttaatt

SEQ ID NO: 4576699 - DNA, 22 bp, Homo sapiens
taatggctgataattttaaatt

SEQ ID NO: 4576700 - DNA, 23 bp, Homo sapiens
taatgggggcagtctccccttcc

SEQ ID NO: 4576701 - DNA, 16 bp, Homo sapiens
taatggtagttttaca

SEQ ID NO: 4576702 - DNA, 22 bp, Homo sapiens
taatggtgaaaacgtcttcctt

SEQ ID NO: 4576703 - DNA, 22 bp, Homo sapiens
taatggtttttatttctcgggt

SEQ ID NO: 4576704 - DNA, 14 bp, Homo sapiens
taatgtaataaagt

SEQ ID NO: 4576705 - DNA, 15 bp, Homo sapiens
taatgtacagaggaa

SEQ ID NO: 4576706 - DNA, 15 bp, Homo sapiens
taatgtatataaaaa

SEQ ID NO: 4576707 - DNA, 21 bp, Homo sapiens
taatgtatctatttgtacaat

SEQ ID NO: 4576708 - DNA, 14 bp, Homo sapiens
taatgtatttgaaa

SEQ ID NO: 4576709 - DNA, 23 bp, Homo sapiens
taatgtatttgaaaattacatgt

SEQ ID NO: 4576710 - DNA, 17 bp, Homo sapiens
taatgtcataaagtgag

SEQ ID NO: 4576711 - DNA, 20 bp, Homo sapiens
taatgtcataaagtgagaaa

SEQ ID NO: 4576712 - DNA, 13 bp, Homo sapiens
taatgtgaaatgt

SEQ ID NO: 4576713 - DNA, 19 bp, Homo sapiens
taatgtgaaatgtaactgt

SEQ ID NO: 4576714 - DNA, 22 bp, Homo sapiens
taatgtgcagaaaatatttaat

SEQ ID NO: 4576715 - DNA, 22 bp, Homo sapiens
taatgtgcagggatattgcctt

SEQ ID NO: 4576716 - DNA, 14 bp, Homo sapiens
taatgtgctctgta

SEQ ID NO: 4576717 - DNA, 13 bp, Homo sapiens
taatgtggactgg

SEQ ID NO: 4576718 - DNA, 13 bp, Homo sapiens
taatgtgtctgtg

SEQ ID NO: 4576719 - DNA, 13 bp, Homo sapiens
taatgttattcat

SEQ ID NO: 4576720 - DNA, 13 bp, Homo sapiens
taatgttcatttt

SEQ ID NO: 4576721 - DNA, 16 bp, Homo sapiens
taatgttcattttgaa

SEQ ID NO: 4576722 - DNA, 22 bp, Homo sapiens
taatgttcattttgaaaatatg

SEQ ID NO: 4576723 - DNA, 22 bp, Homo sapiens
taatgttgctggatcaggaagc

SEQ ID NO: 4576724 - DNA, 12 bp, Homo sapiens
taatgtttacta

SEQ ID NO: 4576725 - DNA, 16 bp, Homo sapiens
taatgtttattaaatg

SEQ ID NO: 4576726 - DNA, 21 bp, Homo sapiens
taatgtttctgatttctgaag

SEQ ID NO: 4576727 - DNA, 22 bp, Homo sapiens
taatgtttctggatttcatact

SEQ ID NO: 4576728 - DNA, 15 bp, Homo sapiens
taatgttttaaatgt

SEQ ID NO: 4576729 - DNA, 16 bp, Homo sapiens
taatgttttaaatgta

SEQ ID NO: 4576730 - DNA, 20 bp, Homo sapiens
taatgttttaaatgtacaga

SEQ ID NO: 4576731 - DNA, 13 bp, Homo sapiens
taatgttttcttt

SEQ ID NO: 4576732 - DNA, 21 bp, Homo sapiens
taatgttttctttgcaaagta

SEQ ID NO: 4576733 - DNA, 22 bp, Homo sapiens
taatgttttctttgcaaagtat

SEQ ID NO: 4576734 - DNA, 23 bp, Homo sapiens
taatgtttttctctataaagggt

SEQ ID NO: 4576735 - DNA, 12 bp, Homo sapiens
taattaaaaact

SEQ ID NO: 4576736 - DNA, 19 bp, Homo sapiens
taattaaaaactttaaaga

SEQ ID NO: 4576737 - DNA, 14 bp, Homo sapiens
taattaaactgtta

SEQ ID NO: 4576738 - DNA, 18 bp, Homo sapiens
taattaaccttactaatt

SEQ ID NO: 4576739 - DNA, 16 bp, Homo sapiens
taattaagaaaactat

SEQ ID NO: 4576740 - DNA, 22 bp, Homo sapiens
taattaagaaaactattaagat

SEQ ID NO: 4576741 - DNA, 20 bp, Homo sapiens
taattaaggtacatcattat

SEQ ID NO: 4576742 - DNA, 14 bp, Homo sapiens
taattaataacttt

SEQ ID NO: 4576743 - DNA, 20 bp, Homo sapiens
taattaatagccaaagattt

SEQ ID NO: 4576744 - DNA, 22 bp, Homo sapiens
taattaatatattaaaattcca

SEQ ID NO: 4576745 - DNA, 21 bp, Homo sapiens
taattaccatacataaactgt

SEQ ID NO: 4576746 - DNA, 14 bp, Homo sapiens
taattagatccatt

SEQ ID NO: 4576747 - DNA, 21 bp, Homo sapiens
taattagcagtttagaatgga

SEQ ID NO: 4576748 - DNA, 12 bp, Homo sapiens
taattaggaatt

SEQ ID NO: 4576749 - DNA, 15 bp, Homo sapiens
taattataaaaaatt

SEQ ID NO: 4576750 - DNA, 14 bp, Homo sapiens
taattatccaggaa

SEQ ID NO: 4576751 - DNA, 20 bp, Homo sapiens
taattatgttctaagtgcct

SEQ ID NO: 4576752 - DNA, 18 bp, Homo sapiens
taattattataaaaatat

SEQ ID NO: 4576753 - DNA, 19 bp, Homo sapiens
taattattataaaaatatt

SEQ ID NO: 4576754 - DNA, 17 bp, Homo sapiens
taattatttattacata

SEQ ID NO: 4576755 - DNA, 13 bp, Homo sapiens
taattatttctaa

SEQ ID NO: 4576756 - DNA, 22 bp, Homo sapiens
taattatttctaacactagctt

SEQ ID NO: 4576757 - DNA, 16 bp, Homo sapiens
taattcaagaaatgac

SEQ ID NO: 4576758 - DNA, 17 bp, Homo sapiens
taattcaagcctctaaa

SEQ ID NO: 4576759 - DNA, 18 bp, Homo sapiens
taattcaagcctctaaac

SEQ ID NO: 4576760 - DNA, 22 bp, Homo sapiens
taattcaaggaatttcttaact

SEQ ID NO: 4576761 - DNA, 17 bp, Homo sapiens
taattcaaggagaatat

SEQ ID NO: 4576762 - DNA, 20 bp, Homo sapiens
taattcaaggagaatatgat

SEQ ID NO: 4576763 - DNA, 16 bp, Homo sapiens
taattcaattcaaagc

SEQ ID NO: 4576764 - DNA, 14 bp, Homo sapiens
taattcacagtgct

SEQ ID NO: 4576765 - DNA, 16 bp, Homo sapiens
taattcaggtttttcc

SEQ ID NO: 4576766 - DNA, 21 bp, Homo sapiens
taattcaggtttttccttttt

SEQ ID NO: 4576767 - DNA, 15 bp, Homo sapiens
taattccacaccttt

SEQ ID NO: 4576768 - DNA, 19 bp, Homo sapiens
taattcctcaacgtattgt

SEQ ID NO: 4576769 - DNA, 14 bp, Homo sapiens
taattctcattaaa

SEQ ID NO: 4576770 - DNA, 17 bp, Homo sapiens
taattctgggaagggag

SEQ ID NO: 4576771 - DNA, 21 bp, Homo sapiens
taattgcaaaaacatagaaat

SEQ ID NO: 4576772 - DNA, 16 bp, Homo sapiens
taattgcaagtctgcc

SEQ ID NO: 4576773 - DNA, 19 bp, Homo sapiens
taattgcactttttaagtt

SEQ ID NO: 4576774 - DNA, 22 bp, Homo sapiens
taattgcactttttaagtttga

SEQ ID NO: 4576775 - DNA, 16 bp, Homo sapiens
taattgcatgaaaata

SEQ ID NO: 4576776 - DNA, 17 bp, Homo sapiens
taattggatttcctaat

SEQ ID NO: 4576777 - DNA, 23 bp, Homo sapiens
taattggatttcctaatactgtc

SEQ ID NO: 4576778 - DNA, 16 bp, Homo sapiens
taattgtaaactgtac

SEQ ID NO: 4576779 - DNA, 18 bp, Homo sapiens
taattgtaattccaaaat

SEQ ID NO: 4576780 - DNA, 16 bp, Homo sapiens
taattgtactgtgttt

SEQ ID NO: 4576781 - DNA, 15 bp, Homo sapiens
taattgttctgcttt

SEQ ID NO: 4576782 - DNA, 11 bp, Homo sapiens
taatttaactt

SEQ ID NO: 4576783 - DNA, 18 bp, Homo sapiens
taatttaataaaaaggaa

SEQ ID NO: 4576784 - DNA, 13 bp, Homo sapiens
taatttaattgct

SEQ ID NO: 4576785 - DNA, 16 bp, Homo sapiens
taatttacaagatatt

SEQ ID NO: 4576786 - DNA, 22 bp, Homo sapiens
taatttacctaagattacaaat

SEQ ID NO: 4576787 - DNA, 20 bp, Homo sapiens
taatttacttaagtgttcat

SEQ ID NO: 4576788 - DNA, 16 bp, Homo sapiens
taatttagaaaacttt

SEQ ID NO: 4576789 - DNA, 22 bp, Homo sapiens
taatttagaagatattatttgt

SEQ ID NO: 4576790 - DNA, 20 bp, Homo sapiens
taatttagagcgtttggtta

SEQ ID NO: 4576791 - DNA, 17 bp, Homo sapiens
taatttagtaaatgtta

SEQ ID NO: 4576792 - DNA, 16 bp, Homo sapiens
taatttagttgtttct

SEQ ID NO: 4576793 - DNA, 17 bp, Homo sapiens
taatttataatgtattt

SEQ ID NO: 4576794 - DNA, 20 bp, Homo sapiens
taatttataatgtatttgaa

SEQ ID NO: 4576795 - DNA, 12 bp, Homo sapiens
taatttattggg

SEQ ID NO: 4576796 - DNA, 19 bp, Homo sapiens
taatttatttagtttttaa

SEQ ID NO: 4576797 - DNA, 22 bp, Homo sapiens
taatttatttcaataaatcttt

SEQ ID NO: 4576798 - DNA, 20 bp, Homo sapiens
taatttcaaaatgcttttta

SEQ ID NO: 4576799 - DNA, 17 bp, Homo sapiens
taatttcaaatctgtaa

SEQ ID NO: 4576800 - DNA, 23 bp, Homo sapiens
taatttcagtcctgtagttttat

SEQ ID NO: 4576801 - DNA, 16 bp, Homo sapiens
taatttcagtgtaaag

SEQ ID NO: 4576802 - DNA, 13 bp, Homo sapiens
taatttcatgtat

SEQ ID NO: 4576803 - DNA, 14 bp, Homo sapiens
taatttcatgtata

SEQ ID NO: 4576804 - DNA, 15 bp, Homo sapiens
taatttcatgtatat

SEQ ID NO: 4576805 - DNA, 19 bp, Homo sapiens
taatttcatgtatatctaa

SEQ ID NO: 4576806 - DNA, 20 bp, Homo sapiens
taatttcatttcaaggcagt

SEQ ID NO: 4576807 - DNA, 11 bp, Homo sapiens
taatttccttt

SEQ ID NO: 4576808 - DNA, 21 bp, Homo sapiens
taatttcctttttgacactga

SEQ ID NO: 4576809 - DNA, 16 bp, Homo sapiens
taatttcgccttaaac

SEQ ID NO: 4576810 - DNA, 14 bp, Homo sapiens
taatttctcctccc

SEQ ID NO: 4576811 - DNA, 21 bp, Homo sapiens
taatttggagcacaaaattca

SEQ ID NO: 4576812 - DNA, 23 bp, Homo sapiens
taatttggagcacaaaattcaaa

SEQ ID NO: 4576813 - DNA, 20 bp, Homo sapiens
taatttggtagatgacaaat

SEQ ID NO: 4576814 - DNA, 21 bp, Homo sapiens
taatttgtgtaataaagtgtt

SEQ ID NO: 4576815 - DNA, 15 bp, Homo sapiens
taatttgtgtgtttt

SEQ ID NO: 4576816 - DNA, 19 bp, Homo sapiens
taattttaaagagtgtgtt

SEQ ID NO: 4576817 - DNA, 21 bp, Homo sapiens
taattttacatgtttataaat

SEQ ID NO: 4576818 - DNA, 19 bp, Homo sapiens
taattttagtttttcatta

SEQ ID NO: 4576819 - DNA, 23 bp, Homo sapiens
taattttagtttttcattaaata

SEQ ID NO: 4576820 - DNA, 15 bp, Homo sapiens
taattttcaccgagc

SEQ ID NO: 4576821 - DNA, 16 bp, Homo sapiens
taattttcaccgagca

SEQ ID NO: 4576822 - DNA, 17 bp, Homo sapiens
taattttgacactgaaa

SEQ ID NO: 4576823 - DNA, 19 bp, Homo sapiens
taatttttaatgatgacaa

SEQ ID NO: 4576824 - DNA, 13 bp, Homo sapiens
taatttttattta

SEQ ID NO: 4576825 - DNA, 16 bp, Homo sapiens
taatttttatttcttc

SEQ ID NO: 4576826 - DNA, 17 bp, Homo sapiens
taatttttatttcttcc

SEQ ID NO: 4576827 - DNA, 18 bp, Homo sapiens
taatttttccttttgcca

SEQ ID NO: 4576828 - DNA, 22 bp, Homo sapiens
taatttttgctccaatatccat

SEQ ID NO: 4576829 - DNA, 20 bp, Homo sapiens
taatttttgctgaattcctt

SEQ ID NO: 4576830 - DNA, 20 bp, Homo sapiens
taatttttgcttttagaaaa

SEQ ID NO: 4576831 - DNA, 18 bp, Homo sapiens
taatttttgtatttttag

SEQ ID NO: 4576832 - DNA, 17 bp, Homo sapiens
taattttttggtacaaa

SEQ ID NO: 4576833 - DNA, 13 bp, Homo sapiens
tacaaaaacacag

SEQ ID NO: 4576834 - DNA, 16 bp, Homo sapiens
tacaaaaacacagcaa

SEQ ID NO: 4576835 - DNA, 18 bp, Homo sapiens
tacaaaaacacagcaagg

SEQ ID NO: 4576836 - DNA, 23 bp, Homo sapiens
tacaaaaacacttcgttcgcaga

SEQ ID NO: 4576837 - DNA, 20 bp, Homo sapiens
tacaaaaacatacttcaaaa

SEQ ID NO: 4576838 - DNA, 12 bp, Homo sapiens
tacaaaaataaa

SEQ ID NO: 4576839 - DNA, 19 bp, Homo sapiens
tacaaaagagcatggatgc

SEQ ID NO: 4576840 - DNA, 20 bp, Homo sapiens
tacaaaagagcatggatgca

SEQ ID NO: 4576841 - DNA, 22 bp, Homo sapiens
tacaaaatatttaagtgaagga

SEQ ID NO: 4576842 - DNA, 13 bp, Homo sapiens
tacaaaatgattt

SEQ ID NO: 4576843 - DNA, 15 bp, Homo sapiens
tacaaaatttattct

SEQ ID NO: 4576844 - DNA, 16 bp, Homo sapiens
tacaaacaaaatttct

SEQ ID NO: 4576845 - DNA, 14 bp, Homo sapiens
tacaaacaatctct

SEQ ID NO: 4576846 - DNA, 20 bp, Homo sapiens
tacaaacaatctcttaaatt

SEQ ID NO: 4576847 - DNA, 14 bp, Homo sapiens
tacaaacatgttgt

SEQ ID NO: 4576848 - DNA, 11 bp, Homo sapiens
tacaaaccttt

SEQ ID NO: 4576849 - DNA, 22 bp, Homo sapiens
tacaaacgtttgacaaacacaa

SEQ ID NO: 4576850 - DNA, 15 bp, Homo sapiens
tacaaacttttaaga

SEQ ID NO: 4576851 - DNA, 23 bp, Homo sapiens
tacaaacttttaagatttctcta

SEQ ID NO: 4576852 - DNA, 18 bp, Homo sapiens
tacaaagagatgcttgga

SEQ ID NO: 4576853 - DNA, 17 bp, Homo sapiens
tacaaagcccttttata

SEQ ID NO: 4576854 - DNA, 21 bp, Homo sapiens
tacaaaggcatgttttaaaat

SEQ ID NO: 4576855 - DNA, 17 bp, Homo sapiens
tacaaatattgtcatct

SEQ ID NO: 4576856 - DNA, 16 bp, Homo sapiens
tacaaatcaagtattt

SEQ ID NO: 4576857 - DNA, 16 bp, Homo sapiens
tacaaatcagaagtca

SEQ ID NO: 4576858 - DNA, 17 bp, Homo sapiens
tacaaatcagaagtcat

SEQ ID NO: 4576859 - DNA, 19 bp, Homo sapiens
tacaaatcagaagtcatct

SEQ ID NO: 4576860 - DNA, 20 bp, Homo sapiens
tacaaatgtggctgtaaaac

SEQ ID NO: 4576861 - DNA, 18 bp, Homo sapiens
tacaaatttggccttaag

SEQ ID NO: 4576862 - DNA, 20 bp, Homo sapiens
tacaaatttggccttaagaa

SEQ ID NO: 4576863 - DNA, 16 bp, Homo sapiens
tacaaatttgttattt

SEQ ID NO: 4576864 - DNA, 20 bp, Homo sapiens
tacaaattttcttttgaaag

SEQ ID NO: 4576865 - DNA, 23 bp, Homo sapiens
tacaaattttgcacttttttgtt

SEQ ID NO: 4576866 - DNA, 21 bp, Homo sapiens
tacaacaacaacaaaaaatac

SEQ ID NO: 4576867 - DNA, 16 bp, Homo sapiens
tacaacatgcatgttc

SEQ ID NO: 4576868 - DNA, 15 bp, Homo sapiens
tacaacatttatgtg

SEQ ID NO: 4576869 - DNA, 15 bp, Homo sapiens
tacaactaaataaca

SEQ ID NO: 4576870 - DNA, 23 bp, Homo sapiens
tacaactgcctcgaaacacagaa

SEQ ID NO: 4576871 - DNA, 16 bp, Homo sapiens
tacaactttcatttaa

SEQ ID NO: 4576872 - DNA, 14 bp, Homo sapiens
tacaagaagcattt

SEQ ID NO: 4576873 - DNA, 19 bp, Homo sapiens
tacaagagcagcctgtggc

SEQ ID NO: 4576874 - DNA, 18 bp, Homo sapiens
tacaagaggattgtaaaa

SEQ ID NO: 4576875 - DNA, 20 bp, Homo sapiens
tacaagcaagcaaaattatt

SEQ ID NO: 4576876 - DNA, 14 bp, Homo sapiens
tacaagcagttaat

SEQ ID NO: 4576877 - DNA, 17 bp, Homo sapiens
tacaagcttaaagcttg

SEQ ID NO: 4576878 - DNA, 16 bp, Homo sapiens
tacaaggcccagaagc

SEQ ID NO: 4576879 - DNA, 17 bp, Homo sapiens
tacaagggagaagacaa

SEQ ID NO: 4576880 - DNA, 22 bp, Homo sapiens
tacaaggtggggattgcccctg

SEQ ID NO: 4576881 - DNA, 16 bp, Homo sapiens
tacaagtcagtttcta

SEQ ID NO: 4576882 - DNA, 13 bp, Homo sapiens
tacaataaaaaca

SEQ ID NO: 4576883 - DNA, 14 bp, Homo sapiens
tacaatacaatgta

SEQ ID NO: 4576884 - DNA, 14 bp, Homo sapiens
tacaatagtataca

SEQ ID NO: 4576885 - DNA, 18 bp, Homo sapiens
tacaatagtatacatttt

SEQ ID NO: 4576886 - DNA, 15 bp, Homo sapiens
tacaatattctctct

SEQ ID NO: 4576887 - DNA, 16 bp, Homo sapiens
tacaatattctctctt

SEQ ID NO: 4576888 - DNA, 22 bp, Homo sapiens
tacaatcgagactgcaatgtga

SEQ ID NO: 4576889 - DNA, 18 bp, Homo sapiens
tacaatggaataaattat

SEQ ID NO: 4576890 - DNA, 15 bp, Homo sapiens
tacaatgtacaatta

SEQ ID NO: 4576891 - DNA, 19 bp, Homo sapiens
tacaatgtacaattatgtc

SEQ ID NO: 4576892 - DNA, 16 bp, Homo sapiens
tacaatgtatctttat

SEQ ID NO: 4576893 - DNA, 15 bp, Homo sapiens
tacaatgtatgtaca

SEQ ID NO: 4576894 - DNA, 16 bp, Homo sapiens
tacaatgtatgtacaa

SEQ ID NO: 4576895 - DNA, 17 bp, Homo sapiens
tacaatgtgtttttctc

SEQ ID NO: 4576896 - DNA, 15 bp, Homo sapiens
tacaattatgtctct

SEQ ID NO: 4576897 - DNA, 19 bp, Homo sapiens
tacaattatgtctcttgag

SEQ ID NO: 4576898 - DNA, 16 bp, Homo sapiens
tacaattcattgtgtt

SEQ ID NO: 4576899 - DNA, 14 bp, Homo sapiens
tacaatttgcacaa

SEQ ID NO: 4576900 - DNA, 19 bp, Homo sapiens
tacaattttaaagttctta

SEQ ID NO: 4576901 - DNA, 21 bp, Homo sapiens
tacaattttaaagttcttatt

SEQ ID NO: 4576902 - DNA, 22 bp, Homo sapiens
tacaatttttatttcttttact

SEQ ID NO: 4576903 - DNA, 23 bp, Homo sapiens
tacaattttttatcatgcatgtc

SEQ ID NO: 4576904 - DNA, 16 bp, Homo sapiens
tacacaatacagtatt

SEQ ID NO: 4576905 - DNA, 17 bp, Homo sapiens
tacacaatacagtatta

SEQ ID NO: 4576906 - DNA, 17 bp, Homo sapiens
tacacaatggtttttaa

SEQ ID NO: 4576907 - DNA, 20 bp, Homo sapiens
tacacaatggtttttaaatt

SEQ ID NO: 4576908 - DNA, 13 bp, Homo sapiens
tacacacatatat

SEQ ID NO: 4576909 - DNA, 15 bp, Homo sapiens
tacacacccgcctga

SEQ ID NO: 4576910 - DNA, 15 bp, Homo sapiens
tacacactaacatca

SEQ ID NO: 4576911 - DNA, 17 bp, Homo sapiens
tacacactcaaatcaag

SEQ ID NO: 4576912 - DNA, 13 bp, Homo sapiens
tacacactcagcc

SEQ ID NO: 4576913 - DNA, 17 bp, Homo sapiens
tacacactttatttact

SEQ ID NO: 4576914 - DNA, 18 bp, Homo sapiens
tacacagagcaggactgc

SEQ ID NO: 4576915 - DNA, 20 bp, Homo sapiens
tacacagaggagtgcagcct

SEQ ID NO: 4576916 - DNA, 16 bp, Homo sapiens
tacacagcccaagagg

SEQ ID NO: 4576917 - DNA, 16 bp, Homo sapiens
tacacagtgagactgt

SEQ ID NO: 4576918 - DNA, 22 bp, Homo sapiens
tacacagtgagactgtacataa

SEQ ID NO: 4576919 - DNA, 17 bp, Homo sapiens
tacacatagttctgtaa

SEQ ID NO: 4576920 - DNA, 18 bp, Homo sapiens
tacacatagttctgtaat

SEQ ID NO: 4576921 - DNA, 21 bp, Homo sapiens
tacacatagttctgtaataaa

SEQ ID NO: 4576922 - DNA, 17 bp, Homo sapiens
tacacatgtgttatcta

SEQ ID NO: 4576923 - DNA, 18 bp, Homo sapiens
tacacatgtgttatctac

SEQ ID NO: 4576924 - DNA, 22 bp, Homo sapiens
tacacatgtgttatctacctca

SEQ ID NO: 4576925 - DNA, 15 bp, Homo sapiens
tacacatgttgcctt

SEQ ID NO: 4576926 - DNA, 16 bp, Homo sapiens
tacacatgttgccttg

SEQ ID NO: 4576927 - DNA, 20 bp, Homo sapiens
tacacatgttgccttgcatt

SEQ ID NO: 4576928 - DNA, 14 bp, Homo sapiens
tacacatttcactg

SEQ ID NO: 4576929 - DNA, 15 bp, Homo sapiens
tacacatttttcaga

SEQ ID NO: 4576930 - DNA, 15 bp, Homo sapiens
tacacctccccctgc

SEQ ID NO: 4576931 - DNA, 22 bp, Homo sapiens
tacacctggctgaggttcctct

SEQ ID NO: 4576932 - DNA, 21 bp, Homo sapiens
tacacgcatgatggagctgat

SEQ ID NO: 4576933 - DNA, 16 bp, Homo sapiens
tacacgtctggacccc

SEQ ID NO: 4576934 - DNA, 14 bp, Homo sapiens
tacacgtttatctt

SEQ ID NO: 4576935 - DNA, 17 bp, Homo sapiens
tacactaggaaacgtgt

SEQ ID NO: 4576936 - DNA, 14 bp, Homo sapiens
tacactatgaaatt

SEQ ID NO: 4576937 - DNA, 20 bp, Homo sapiens
tacactcagccactgtcaca

SEQ ID NO: 4576938 - DNA, 22 bp, Homo sapiens
tacactcagccactgtcacagg

SEQ ID NO: 4576939 - DNA, 14 bp, Homo sapiens
tacactcattgaaa

SEQ ID NO: 4576940 - DNA, 16 bp, Homo sapiens
tacactcattgaaatg

SEQ ID NO: 4576941 - DNA, 19 bp, Homo sapiens
tacactcattgaaatgtaa

SEQ ID NO: 4576942 - DNA, 20 bp, Homo sapiens
tacactcctctatcatgcaa

SEQ ID NO: 4576943 - DNA, 15 bp, Homo sapiens
tacactctcctgggc

SEQ ID NO: 4576944 - DNA, 14 bp, Homo sapiens
tacactctgctgtt

SEQ ID NO: 4576945 - DNA, 23 bp, Homo sapiens
tacactctgtattgaaaatggct

SEQ ID NO: 4576946 - DNA, 16 bp, Homo sapiens
tacactgagcagggag

SEQ ID NO: 4576947 - DNA, 14 bp, Homo sapiens
tacactgcactttg

SEQ ID NO: 4576948 - DNA, 18 bp, Homo sapiens
tacactgcactttgttta

SEQ ID NO: 4576949 - DNA, 20 bp, Homo sapiens
tacactgtatgttatagaac

SEQ ID NO: 4576950 - DNA, 16 bp, Homo sapiens
tacacttcctgcttaa

SEQ ID NO: 4576951 - DNA, 21 bp, Homo sapiens
tacacttctccttatctttat

SEQ ID NO: 4576952 - DNA, 18 bp, Homo sapiens
tacacttgagatgatttc

SEQ ID NO: 4576953 - DNA, 19 bp, Homo sapiens
tacactttttacagcagca

SEQ ID NO: 4576954 - DNA, 21 bp, Homo sapiens
tacagaaaccaggtaagccct

SEQ ID NO: 4576955 - DNA, 17 bp, Homo sapiens
tacagaactctttcaaa

SEQ ID NO: 4576956 - DNA, 14 bp, Homo sapiens
tacagacatattta

SEQ ID NO: 4576957 - DNA, 14 bp, Homo sapiens
tacagactccatct

SEQ ID NO: 4576958 - DNA, 15 bp, Homo sapiens
tacagactccatctc

SEQ ID NO: 4576959 - DNA, 17 bp, Homo sapiens
tacagactccatctctt

SEQ ID NO: 4576960 - DNA, 13 bp, Homo sapiens
tacagactctgat

SEQ ID NO: 4576961 - DNA, 13 bp, Homo sapiens
tacagactgaaag

SEQ ID NO: 4576962 - DNA, 14 bp, Homo sapiens
tacagagaagaaaa

SEQ ID NO: 4576963 - DNA, 12 bp, Homo sapiens
tacagagaattt

SEQ ID NO: 4576964 - DNA, 20 bp, Homo sapiens
tacagagaatttctaaagta

SEQ ID NO: 4576965 - DNA, 21 bp, Homo sapiens
tacagagaatttctaaagtaa

SEQ ID NO: 4576966 - DNA, 17 bp, Homo sapiens
tacagagaggatacatt

SEQ ID NO: 4576967 - DNA, 20 bp, Homo sapiens
tacagagaggatacatttaa

SEQ ID NO: 4576968 - DNA, 23 bp, Homo sapiens
tacagagaggatacatttaataa

SEQ ID NO: 4576969 - DNA, 19 bp, Homo sapiens
tacagagcacctgtagctg

SEQ ID NO: 4576970 - DNA, 16 bp, Homo sapiens
tacagagcttccctga

SEQ ID NO: 4576971 - DNA, 14 bp, Homo sapiens
tacagaggacagta

SEQ ID NO: 4576972 - DNA, 12 bp, Homo sapiens
tacagaggagat

SEQ ID NO: 4576973 - DNA, 15 bp, Homo sapiens
tacagatccccagcc

SEQ ID NO: 4576974 - DNA, 23 bp, Homo sapiens
tacagatccccagcccctcctcc

SEQ ID NO: 4576975 - DNA, 20 bp, Homo sapiens
tacagatggagcaaatgtcc

SEQ ID NO: 4576976 - DNA, 15 bp, Homo sapiens
tacagattaaagaag

SEQ ID NO: 4576977 - DNA, 16 bp, Homo sapiens
tacagattaaagaaga

SEQ ID NO: 4576978 - DNA, 23 bp, Homo sapiens
tacagattaacctgaaagaacat

SEQ ID NO: 4576979 - DNA, 22 bp, Homo sapiens
tacagcaagatgtttcttgcct

SEQ ID NO: 4576980 - DNA, 14 bp, Homo sapiens
tacagcactactct

SEQ ID NO: 4576981 - DNA, 15 bp, Homo sapiens
tacagcactactctg

SEQ ID NO: 4576982 - DNA, 19 bp, Homo sapiens
tacagcactactctgtgcc

SEQ ID NO: 4576983 - DNA, 17 bp, Homo sapiens
tacagcactactgggtg

SEQ ID NO: 4576984 - DNA, 14 bp, Homo sapiens
tacagcagcaatat

SEQ ID NO: 4576985 - DNA, 18 bp, Homo sapiens
tacagcagcaatattttg

SEQ ID NO: 4576986 - DNA, 23 bp, Homo sapiens
tacagccaagttgtgacagtcac

SEQ ID NO: 4576987 - DNA, 22 bp, Homo sapiens
tacagccctaagtggctgcctt

SEQ ID NO: 4576988 - DNA, 20 bp, Homo sapiens
tacagccttaatattttcct

SEQ ID NO: 4576989 - DNA, 15 bp, Homo sapiens
tacagctatatttga

SEQ ID NO: 4576990 - DNA, 16 bp, Homo sapiens
tacagctatatttgat

SEQ ID NO: 4576991 - DNA, 16 bp, Homo sapiens
tacagctcattaaact

SEQ ID NO: 4576992 - DNA, 14 bp, Homo sapiens
tacagctcctttga

SEQ ID NO: 4576993 - DNA, 10 bp, Homo sapiens
tacagctgag

SEQ ID NO: 4576994 - DNA, 13 bp, Homo sapiens
tacagcttttatg

SEQ ID NO: 4576995 - DNA, 18 bp, Homo sapiens
tacagcttttatggatga

SEQ ID NO: 4576996 - DNA, 15 bp, Homo sapiens
tacaggaaacagttg

SEQ ID NO: 4576997 - DNA, 14 bp, Homo sapiens
tacaggaatgaaga

SEQ ID NO: 4576998 - DNA, 23 bp, Homo sapiens
tacaggggaggggcgcaccccac

SEQ ID NO: 4576999 - DNA, 20 bp, Homo sapiens
tacaggtagtgggctcacaa

SEQ ID NO: 4577000 - DNA, 15 bp, Homo sapiens
tacaggtgcatatta

SEQ ID NO: 4577001 - DNA, 23 bp, Homo sapiens
tacaggtgcatattaattttctt

SEQ ID NO: 4577002 - DNA, 14 bp, Homo sapiens
tacagtaaatgtta

SEQ ID NO: 4577003 - DNA, 17 bp, Homo sapiens
tacagtaatgaaatgtt

SEQ ID NO: 4577004 - DNA, 20 bp, Homo sapiens
tacagtaggagcccagctct

SEQ ID NO: 4577005 - DNA, 22 bp, Homo sapiens
tacagtaggagcccagctctga

SEQ ID NO: 4577006 - DNA, 12 bp, Homo sapiens
tacagtatataa

SEQ ID NO: 4577007 - DNA, 18 bp, Homo sapiens
tacagtattatagacaaa

SEQ ID NO: 4577008 - DNA, 18 bp, Homo sapiens
tacagtcaagatagaaag

SEQ ID NO: 4577009 - DNA, 15 bp, Homo sapiens
tacagtcttccacaa

SEQ ID NO: 4577010 - DNA, 12 bp, Homo sapiens
tacagtcttgta

SEQ ID NO: 4577011 - DNA, 22 bp, Homo sapiens
tacagtgcagagccttctcaga

SEQ ID NO: 4577012 - DNA, 16 bp, Homo sapiens
tacagtgtacagtctt

SEQ ID NO: 4577013 - DNA, 13 bp, Homo sapiens
tacagttataaaa

SEQ ID NO: 4577014 - DNA, 20 bp, Homo sapiens
tacagttctgctctggttgt

SEQ ID NO: 4577015 - DNA, 15 bp, Homo sapiens
tacagttctgtggtt

SEQ ID NO: 4577016 - DNA, 13 bp, Homo sapiens
tacagttgtataa

SEQ ID NO: 4577017 - DNA, 15 bp, Homo sapiens
tacagtttaggagta

SEQ ID NO: 4577018 - DNA, 17 bp, Homo sapiens
tacagttttaactgtgg

SEQ ID NO: 4577019 - DNA, 19 bp, Homo sapiens
tacagttttaactgtggat

SEQ ID NO: 4577020 - DNA, 13 bp, Homo sapiens
tacataactcctg

SEQ ID NO: 4577021 - DNA, 16 bp, Homo sapiens
tacataactcctgtcc

SEQ ID NO: 4577022 - DNA, 18 bp, Homo sapiens
tacataaggatgactttt

SEQ ID NO: 4577023 - DNA, 13 bp, Homo sapiens
tacataattgcat

SEQ ID NO: 4577024 - DNA, 14 bp, Homo sapiens
tacatactaatgaa

SEQ ID NO: 4577025 - DNA, 15 bp, Homo sapiens
tacatactttatcaa

SEQ ID NO: 4577026 - DNA, 22 bp, Homo sapiens
tacatagagatctattttttct

SEQ ID NO: 4577027 - DNA, 17 bp, Homo sapiens
tacatagatgcttagtc

SEQ ID NO: 4577028 - DNA, 16 bp, Homo sapiens
tacatagtctgaagtg

SEQ ID NO: 4577029 - DNA, 12 bp, Homo sapiens
tacatagtcttt

SEQ ID NO: 4577030 - DNA, 22 bp, Homo sapiens
tacatagtgctgctgtgtgctt

SEQ ID NO: 4577031 - DNA, 20 bp, Homo sapiens
tacatagttatttttctctt

SEQ ID NO: 4577032 - DNA, 17 bp, Homo sapiens
tacatatgatctgtctg

SEQ ID NO: 4577033 - DNA, 17 bp, Homo sapiens
tacatatttgagactag

SEQ ID NO: 4577034 - DNA, 15 bp, Homo sapiens
tacatatttttctat

SEQ ID NO: 4577035 - DNA, 19 bp, Homo sapiens
tacatcaaagcttcttcac

SEQ ID NO: 4577036 - DNA, 17 bp, Homo sapiens
tacatcaacaagaagaa

SEQ ID NO: 4577037 - DNA, 19 bp, Homo sapiens
tacatcaacaagaagaaac

SEQ ID NO: 4577038 - DNA, 22 bp, Homo sapiens
tacatcaagtccatctgacaaa

SEQ ID NO: 4577039 - DNA, 16 bp, Homo sapiens
tacatcacatcttatt

SEQ ID NO: 4577040 - DNA, 18 bp, Homo sapiens
tacatcacatcttattta

SEQ ID NO: 4577041 - DNA, 16 bp, Homo sapiens
tacatcacgttaaagt

SEQ ID NO: 4577042 - DNA, 22 bp, Homo sapiens
tacatcagccttcaagaatcag

SEQ ID NO: 4577043 - DNA, 21 bp, Homo sapiens
tacatcagtatagtgttttat

SEQ ID NO: 4577044 - DNA, 23 bp, Homo sapiens
tacatcagtttgttccttttgta

SEQ ID NO: 4577045 - DNA, 18 bp, Homo sapiens
tacatctattttggattg

SEQ ID NO: 4577046 - DNA, 19 bp, Homo sapiens
tacatctattttggattgt

SEQ ID NO: 4577047 - DNA, 16 bp, Homo sapiens
tacatgacatttattt

SEQ ID NO: 4577048 - DNA, 15 bp, Homo sapiens
tacatgagaaagatg

SEQ ID NO: 4577049 - DNA, 17 bp, Homo sapiens
tacatgagaacaaacag

SEQ ID NO: 4577050 - DNA, 16 bp, Homo sapiens
tacatgagaaggaact

SEQ ID NO: 4577051 - DNA, 21 bp, Homo sapiens
tacatgaggtactgagagtga

SEQ ID NO: 4577052 - DNA, 17 bp, Homo sapiens
tacatgataagacattt

SEQ ID NO: 4577053 - DNA, 14 bp, Homo sapiens
tacatgcagcccat

SEQ ID NO: 4577054 - DNA, 16 bp, Homo sapiens
tacatgcataaactaa

SEQ ID NO: 4577055 - DNA, 22 bp, Homo sapiens
tacatgctgaaaaatatagcct

SEQ ID NO: 4577056 - DNA, 20 bp, Homo sapiens
tacatgtatctggtttgtca

SEQ ID NO: 4577057 - DNA, 15 bp, Homo sapiens
tacatgtatgcctgc

SEQ ID NO: 4577058 - DNA, 17 bp, Homo sapiens
tacatgttggaaatgtg

SEQ ID NO: 4577059 - DNA, 15 bp, Homo sapiens
tacatgtttataaat

SEQ ID NO: 4577060 - DNA, 18 bp, Homo sapiens
tacatgttttttcatttg

SEQ ID NO: 4577061 - DNA, 22 bp, Homo sapiens
tacatgttttttcatttgtaaa

SEQ ID NO: 4577062 - DNA, 14 bp, Homo sapiens
tacattaacggtgc

SEQ ID NO: 4577063 - DNA, 18 bp, Homo sapiens
tacattaacggtgctaaa

SEQ ID NO: 4577064 - DNA, 18 bp, Homo sapiens
tacattacagattaaaga

SEQ ID NO: 4577065 - DNA, 20 bp, Homo sapiens
tacattacatctgagtattt

SEQ ID NO: 4577066 - DNA, 15 bp, Homo sapiens
tacattcatttagct

SEQ ID NO: 4577067 - DNA, 16 bp, Homo sapiens
tacattccaaagaaac

SEQ ID NO: 4577068 - DNA, 22 bp, Homo sapiens
tacattccagtagccagtatct

SEQ ID NO: 4577069 - DNA, 22 bp, Homo sapiens
tacattgagtagacacatttaa

SEQ ID NO: 4577070 - DNA, 21 bp, Homo sapiens
tacattgtgagctctggttat

SEQ ID NO: 4577071 - DNA, 14 bp, Homo sapiens
tacatttaaatttt

SEQ ID NO: 4577072 - DNA, 16 bp, Homo sapiens
tacatttaataaaact

SEQ ID NO: 4577073 - DNA, 14 bp, Homo sapiens
tacatttaataata

SEQ ID NO: 4577074 - DNA, 22 bp, Homo sapiens
tacatttatttacactcttgat

SEQ ID NO: 4577075 - DNA, 16 bp, Homo sapiens
tacatttctactatga

SEQ ID NO: 4577076 - DNA, 11 bp, Homo sapiens
tacatttctgc

SEQ ID NO: 4577077 - DNA, 15 bp, Homo sapiens
tacatttctgcagat

SEQ ID NO: 4577078 - DNA, 12 bp, Homo sapiens
tacatttgcaat

SEQ ID NO: 4577079 - DNA, 14 bp, Homo sapiens
tacatttgcaatta

SEQ ID NO: 4577080 - DNA, 19 bp, Homo sapiens
tacatttgggagtttttat

SEQ ID NO: 4577081 - DNA, 16 bp, Homo sapiens
tacattttatatgtga

SEQ ID NO: 4577082 - DNA, 11 bp, Homo sapiens
tacattttatt

SEQ ID NO: 4577083 - DNA, 14 bp, Homo sapiens
tacatttttaaatg

SEQ ID NO: 4577084 - DNA, 15 bp, Homo sapiens
taccaaaaaaaggaa

SEQ ID NO: 4577085 - DNA, 20 bp, Homo sapiens
taccaaaaacaagtctataa

SEQ ID NO: 4577086 - DNA, 15 bp, Homo sapiens
taccaaaaattttgt

SEQ ID NO: 4577087 - DNA, 14 bp, Homo sapiens
taccaaaattttaa

SEQ ID NO: 4577088 - DNA, 12 bp, Homo sapiens
taccaaatctca

SEQ ID NO: 4577089 - DNA, 23 bp, Homo sapiens
taccaaattaaaaaaaaattgta

SEQ ID NO: 4577090 - DNA, 17 bp, Homo sapiens
taccaacctaaatttct

SEQ ID NO: 4577091 - DNA, 12 bp, Homo sapiens
taccaaggattt

SEQ ID NO: 4577092 - DNA, 15 bp, Homo sapiens
taccaagtatgaagt

SEQ ID NO: 4577093 - DNA, 13 bp, Homo sapiens
taccaagtgcttc

SEQ ID NO: 4577094 - DNA, 23 bp, Homo sapiens
taccaagtgcttcctacaaagac

SEQ ID NO: 4577095 - DNA, 19 bp, Homo sapiens
taccacaaacactgtgggg

SEQ ID NO: 4577096 - DNA, 17 bp, Homo sapiens
taccacaagcctgagaa

SEQ ID NO: 4577097 - DNA, 20 bp, Homo sapiens
taccactgtggccccaagag

SEQ ID NO: 4577098 - DNA, 20 bp, Homo sapiens
taccacttgaatttattgat

SEQ ID NO: 4577099 - DNA, 18 bp, Homo sapiens
taccagaaggaaagcact

SEQ ID NO: 4577100 - DNA, 21 bp, Homo sapiens
taccagattctgcctatgtaa

SEQ ID NO: 4577101 - DNA, 18 bp, Homo sapiens
taccagcagcaactgaaa

SEQ ID NO: 4577102 - DNA, 17 bp, Homo sapiens
taccagctaccctgtgt

SEQ ID NO: 4577103 - DNA, 13 bp, Homo sapiens
taccagctgcgct

SEQ ID NO: 4577104 - DNA, 21 bp, Homo sapiens
taccagctgcgcttgcttttc

SEQ ID NO: 4577105 - DNA, 13 bp, Homo sapiens
taccagcttttaa

SEQ ID NO: 4577106 - DNA, 16 bp, Homo sapiens
taccagcttttaacca

SEQ ID NO: 4577107 - DNA, 18 bp, Homo sapiens
taccaggcaccaaaagaa

SEQ ID NO: 4577108 - DNA, 14 bp, Homo sapiens
taccaggcactggt

SEQ ID NO: 4577109 - DNA, 15 bp, Homo sapiens
taccagtatttagaa

SEQ ID NO: 4577110 - DNA, 13 bp, Homo sapiens
taccagtctgatt

SEQ ID NO: 4577111 - DNA, 22 bp, Homo sapiens
taccagtctgattataccatgt

SEQ ID NO: 4577112 - DNA, 20 bp, Homo sapiens
taccagtgaatttttgcaat

SEQ ID NO: 4577113 - DNA, 22 bp, Homo sapiens
taccagtgaatttttgcaataa

SEQ ID NO: 4577114 - DNA, 19 bp, Homo sapiens
taccagttaatttttccaa

SEQ ID NO: 4577115 - DNA, 20 bp, Homo sapiens
taccatagaaaaatgtataa

SEQ ID NO: 4577116 - DNA, 16 bp, Homo sapiens
taccatcagctctgcc

SEQ ID NO: 4577117 - DNA, 13 bp, Homo sapiens
taccatcatctct

SEQ ID NO: 4577118 - DNA, 21 bp, Homo sapiens
taccatgagatgagatgacca

SEQ ID NO: 4577119 - DNA, 23 bp, Homo sapiens
taccatgagatgagatgaccacc

SEQ ID NO: 4577120 - DNA, 18 bp, Homo sapiens
taccatgcttcacaatgt

SEQ ID NO: 4577121 - DNA, 21 bp, Homo sapiens
taccatggttctgcctcctgg

SEQ ID NO: 4577122 - DNA, 17 bp, Homo sapiens
taccattcacaataaaa

SEQ ID NO: 4577123 - DNA, 12 bp, Homo sapiens
taccatttgtgt

SEQ ID NO: 4577124 - DNA, 16 bp, Homo sapiens
taccatttgtgtctct

SEQ ID NO: 4577125 - DNA, 14 bp, Homo sapiens
tacccaaactgctt

SEQ ID NO: 4577126 - DNA, 18 bp, Homo sapiens
tacccacacctctgccag

SEQ ID NO: 4577127 - DNA, 19 bp, Homo sapiens
tacccacacctctgccaga

SEQ ID NO: 4577128 - DNA, 21 bp, Homo sapiens
tacccagagaagccccttccc

SEQ ID NO: 4577129 - DNA, 9 bp, Homo sapiens
tacccagca

SEQ ID NO: 4577130 - DNA, 22 bp, Homo sapiens
tacccagtgccgaggacatgca

SEQ ID NO: 4577131 - DNA, 14 bp, Homo sapiens
taccccaaggccag

SEQ ID NO: 4577132 - DNA, 15 bp, Homo sapiens
taccccaaggccagt

SEQ ID NO: 4577133 - DNA, 22 bp, Homo sapiens
taccccaccacgatgtggccct

SEQ ID NO: 4577134 - DNA, 22 bp, Homo sapiens
taccccagactagatgtagtat

SEQ ID NO: 4577135 - DNA, 14 bp, Homo sapiens
taccccagttccta

SEQ ID NO: 4577136 - DNA, 20 bp, Homo sapiens
taccccatggagctgggcta

SEQ ID NO: 4577137 - DNA, 15 bp, Homo sapiens
taccccctgtgcctt

SEQ ID NO: 4577138 - DNA, 19 bp, Homo sapiens
taccccgggctgggcccct

SEQ ID NO: 4577139 - DNA, 19 bp, Homo sapiens
taccccttacaaatgaaaa

SEQ ID NO: 4577140 - DNA, 12 bp, Homo sapiens
taccctcccacc

SEQ ID NO: 4577141 - DNA, 17 bp, Homo sapiens
taccctcccaccagaac

SEQ ID NO: 4577142 - DNA, 18 bp, Homo sapiens
taccctgagatctgcaca

SEQ ID NO: 4577143 - DNA, 18 bp, Homo sapiens
taccctgggaaggcctct

SEQ ID NO: 4577144 - DNA, 13 bp, Homo sapiens
tacccttttcccc

SEQ ID NO: 4577145 - DNA, 20 bp, Homo sapiens
tacccttttcccccttccca

SEQ ID NO: 4577146 - DNA, 16 bp, Homo sapiens
tacccttttcctttgt

SEQ ID NO: 4577147 - DNA, 18 bp, Homo sapiens
taccggattctctcttta

SEQ ID NO: 4577148 - DNA, 22 bp, Homo sapiens
tacctaagattacaaatcagaa

SEQ ID NO: 4577149 - DNA, 20 bp, Homo sapiens
tacctacatatttgtatgtt

SEQ ID NO: 4577150 - DNA, 21 bp, Homo sapiens
tacctacatatttgtatgttt

SEQ ID NO: 4577151 - DNA, 14 bp, Homo sapiens
tacctaccagtatt

SEQ ID NO: 4577152 - DNA, 13 bp, Homo sapiens
tacctactttgac

SEQ ID NO: 4577153 - DNA, 16 bp, Homo sapiens
tacctatcatcttaag

SEQ ID NO: 4577154 - DNA, 18 bp, Homo sapiens
tacctcaagccccatttc

SEQ ID NO: 4577155 - DNA, 14 bp, Homo sapiens
tacctcaggaaaga

SEQ ID NO: 4577156 - DNA, 19 bp, Homo sapiens
tacctcctcccccctcctc

SEQ ID NO: 4577157 - DNA, 14 bp, Homo sapiens
tacctcctgagaaa

SEQ ID NO: 4577158 - DNA, 13 bp, Homo sapiens
tacctcttggctg

SEQ ID NO: 4577159 - DNA, 17 bp, Homo sapiens
tacctgacactcccttg

SEQ ID NO: 4577160 - DNA, 15 bp, Homo sapiens
tacctgagcattcag

SEQ ID NO: 4577161 - DNA, 22 bp, Homo sapiens
tacctgattgatcacacagtgt

SEQ ID NO: 4577162 - DNA, 18 bp, Homo sapiens
tacctgattttttttcct

SEQ ID NO: 4577163 - DNA, 19 bp, Homo sapiens
tacctgccctaagggactt

SEQ ID NO: 4577164 - DNA, 17 bp, Homo sapiens
tacctgccttttaagtt

SEQ ID NO: 4577165 - DNA, 20 bp, Homo sapiens
tacctgccttttaagtttga

SEQ ID NO: 4577166 - DNA, 14 bp, Homo sapiens
tacctgctctccaa

SEQ ID NO: 4577167 - DNA, 15 bp, Homo sapiens
tacctggagcagagg

SEQ ID NO: 4577168 - DNA, 19 bp, Homo sapiens
tacctggagcagaggaggg

SEQ ID NO: 4577169 - DNA, 19 bp, Homo sapiens
tacctggatgttcttttta

SEQ ID NO: 4577170 - DNA, 14 bp, Homo sapiens
tacctgggaagggg

SEQ ID NO: 4577171 - DNA, 20 bp, Homo sapiens
tacctgtgtttttttctaaa

SEQ ID NO: 4577172 - DNA, 22 bp, Homo sapiens
tacctgtgtttttttctaaaaa

SEQ ID NO: 4577173 - DNA, 20 bp, Homo sapiens
taccttaggttctttctgaa

SEQ ID NO: 4577174 - DNA, 17 bp, Homo sapiens
taccttatagttactgt

SEQ ID NO: 4577175 - DNA, 18 bp, Homo sapiens
taccttatagttactgtg

SEQ ID NO: 4577176 - DNA, 14 bp, Homo sapiens
taccttcctgtccc

SEQ ID NO: 4577177 - DNA, 20 bp, Homo sapiens
taccttcctgtccctgaggt

SEQ ID NO: 4577178 - DNA, 22 bp, Homo sapiens
taccttgaaaataagaatagaa

SEQ ID NO: 4577179 - DNA, 15 bp, Homo sapiens
taccttgaccatcgt

SEQ ID NO: 4577180 - DNA, 18 bp, Homo sapiens
taccttgcttttgcttct

SEQ ID NO: 4577181 - DNA, 22 bp, Homo sapiens
taccttggttcccccactgatc

SEQ ID NO: 4577182 - DNA, 16 bp, Homo sapiens
tacctttacatatata

SEQ ID NO: 4577183 - DNA, 12 bp, Homo sapiens
tacctttcatac

SEQ ID NO: 4577184 - DNA, 17 bp, Homo sapiens
taccttttctcttttct

SEQ ID NO: 4577185 - DNA, 20 bp, Homo sapiens
tacctttttatttgcatgtg

SEQ ID NO: 4577186 - DNA, 19 bp, Homo sapiens
tacgaaaaagtgattgtga

SEQ ID NO: 4577187 - DNA, 22 bp, Homo sapiens
tacgaacctacagttttaactg

SEQ ID NO: 4577188 - DNA, 13 bp, Homo sapiens
tacgaagaggggt

SEQ ID NO: 4577189 - DNA, 15 bp, Homo sapiens
tacgaatcttatttt

SEQ ID NO: 4577190 - DNA, 15 bp, Homo sapiens
tacgacctgtctgtt

SEQ ID NO: 4577191 - DNA, 20 bp, Homo sapiens
tacgagggaggaacacctga

SEQ ID NO: 4577192 - DNA, 20 bp, Homo sapiens
tacgatcaagttgttgactg

SEQ ID NO: 4577193 - DNA, 13 bp, Homo sapiens
tacgatgtaaatt

SEQ ID NO: 4577194 - DNA, 18 bp, Homo sapiens
tacgcactggacagcatc

SEQ ID NO: 4577195 - DNA, 14 bp, Homo sapiens
tacgctgtccagaa

SEQ ID NO: 4577196 - DNA, 19 bp, Homo sapiens
tacggatcatcaacaagat

SEQ ID NO: 4577197 - DNA, 15 bp, Homo sapiens
tacgggggcacttgg

SEQ ID NO: 4577198 - DNA, 21 bp, Homo sapiens
tacgggggcacttggaggacc

SEQ ID NO: 4577199 - DNA, 11 bp, Homo sapiens
tacggtacaga

SEQ ID NO: 4577200 - DNA, 17 bp, Homo sapiens
tacgtataaatatcagt

SEQ ID NO: 4577201 - DNA, 15 bp, Homo sapiens
tacgtcccgctgctg

SEQ ID NO: 4577202 - DNA, 19 bp, Homo sapiens
tacgtcccgctgctgtgct

SEQ ID NO: 4577203 - DNA, 21 bp, Homo sapiens
tacgtgccagatataactgtc

SEQ ID NO: 4577204 - DNA, 14 bp, Homo sapiens
tacgtgtcaatgtg

SEQ ID NO: 4577205 - DNA, 20 bp, Homo sapiens
tacgtttaagcttaacattt

SEQ ID NO: 4577206 - DNA, 21 bp, Homo sapiens
tacgtttccccaataaagcct

SEQ ID NO: 4577207 - DNA, 12 bp, Homo sapiens
tacgtttgaagt

SEQ ID NO: 4577208 - DNA, 14 bp, Homo sapiens
tacgtttttctggt

SEQ ID NO: 4577209 - DNA, 16 bp, Homo sapiens
tactaaaaaaaagatg

SEQ ID NO: 4577210 - DNA, 19 bp, Homo sapiens
tactaaaccaactctaata

SEQ ID NO: 4577211 - DNA, 20 bp, Homo sapiens
tactaaaccaactctaatat

SEQ ID NO: 4577212 - DNA, 23 bp, Homo sapiens
tactaacctcccttaagcagcaa

SEQ ID NO: 4577213 - DNA, 15 bp, Homo sapiens
tactaatgaagtatt

SEQ ID NO: 4577214 - DNA, 20 bp, Homo sapiens
tactacagctatatttgatt

SEQ ID NO: 4577215 - DNA, 15 bp, Homo sapiens
tactacagtcaagat

SEQ ID NO: 4577216 - DNA, 14 bp, Homo sapiens
tactacagttttta

SEQ ID NO: 4577217 - DNA, 14 bp, Homo sapiens
tactaccttgaaaa

SEQ ID NO: 4577218 - DNA, 16 bp, Homo sapiens
tactaccttgaaaata

SEQ ID NO: 4577219 - DNA, 16 bp, Homo sapiens
tactactgaagaaggt

SEQ ID NO: 4577220 - DNA, 22 bp, Homo sapiens
tactactttgttaggattttca

SEQ ID NO: 4577221 - DNA, 23 bp, Homo sapiens
tactactttgttaggattttcac

SEQ ID NO: 4577222 - DNA, 24 bp, Homo sapiens
tactagagatattttgtaaaatgt

SEQ ID NO: 4577223 - DNA, 23 bp, Homo sapiens
tactaggaagaacgttttttcct

SEQ ID NO: 4577224 - DNA, 14 bp, Homo sapiens
tactagtactatta

SEQ ID NO: 4577225 - DNA, 20 bp, Homo sapiens
tactagtcaccagagacttt

SEQ ID NO: 4577226 - DNA, 22 bp, Homo sapiens
tactagtcaccagagactttag

SEQ ID NO: 4577227 - DNA, 15 bp, Homo sapiens
tactagtgtttaagt

SEQ ID NO: 4577228 - DNA, 22 bp, Homo sapiens
tactataatcaaatgatttcat

SEQ ID NO: 4577229 - DNA, 14 bp, Homo sapiens
tactatattgctgt

SEQ ID NO: 4577230 - DNA, 23 bp, Homo sapiens
tactatgatcagaagaacatgat

SEQ ID NO: 4577231 - DNA, 22 bp, Homo sapiens
tactattaggaaaataaacaga

SEQ ID NO: 4577232 - DNA, 13 bp, Homo sapiens
tactatttcacaa

SEQ ID NO: 4577233 - DNA, 18 bp, Homo sapiens
tactatttgccaatgtat

SEQ ID NO: 4577234 - DNA, 13 bp, Homo sapiens
tactcacctctct

SEQ ID NO: 4577235 - DNA, 16 bp, Homo sapiens
tactcagcagccctcc

SEQ ID NO: 4577236 - DNA, 23 bp, Homo sapiens
tactcagcagccctcctcacccc

SEQ ID NO: 4577237 - DNA, 15 bp, Homo sapiens
tactcagccctgggc

SEQ ID NO: 4577238 - DNA, 16 bp, Homo sapiens
tactcagccctgggcc

SEQ ID NO: 4577239 - DNA, 22 bp, Homo sapiens
tactcagccctgggccccacca

SEQ ID NO: 4577240 - DNA, 12 bp, Homo sapiens
tactcaggaggc

SEQ ID NO: 4577241 - DNA, 15 bp, Homo sapiens
tactcaggaggctga

SEQ ID NO: 4577242 - DNA, 11 bp, Homo sapiens
tactcattttt

SEQ ID NO: 4577243 - DNA, 12 bp, Homo sapiens
tactccagcctg

SEQ ID NO: 4577244 - DNA, 13 bp, Homo sapiens
tactccagcctgg

SEQ ID NO: 4577245 - DNA, 14 bp, Homo sapiens
tactcccctgggca

SEQ ID NO: 4577246 - DNA, 21 bp, Homo sapiens
tactcccctgggcatcttctg

SEQ ID NO: 4577247 - DNA, 20 bp, Homo sapiens
tactcccttctcgtgtttgc

SEQ ID NO: 4577248 - DNA, 20 bp, Homo sapiens
tactcctatttttgtaaact

SEQ ID NO: 4577249 - DNA, 21 bp, Homo sapiens
tactcctatttttgtaaactg

SEQ ID NO: 4577250 - DNA, 21 bp, Homo sapiens
tactcctctgcagtgccttgg

SEQ ID NO: 4577251 - DNA, 22 bp, Homo sapiens
tactcctctgcagtgccttggg

SEQ ID NO: 4577252 - DNA, 12 bp, Homo sapiens
tactcctgggct

SEQ ID NO: 4577253 - DNA, 16 bp, Homo sapiens
tactcctggtttgatt

SEQ ID NO: 4577254 - DNA, 17 bp, Homo sapiens
tactcctgtgctctgga

SEQ ID NO: 4577255 - DNA, 21 bp, Homo sapiens
tactctaccatggttctgcct

SEQ ID NO: 4577256 - DNA, 18 bp, Homo sapiens
tactctagatggcaacat

SEQ ID NO: 4577257 - DNA, 15 bp, Homo sapiens
tactctcctgtttgg

SEQ ID NO: 4577258 - DNA, 13 bp, Homo sapiens
tactctcttcatc

SEQ ID NO: 4577259 - DNA, 14 bp, Homo sapiens
tactctcttcttct

SEQ ID NO: 4577260 - DNA, 16 bp, Homo sapiens
tactctcttcttctca

SEQ ID NO: 4577261 - DNA, 14 bp, Homo sapiens
tactctgccctcta

SEQ ID NO: 4577262 - DNA, 20 bp, Homo sapiens
tactcttagagatgattcag

SEQ ID NO: 4577263 - DNA, 13 bp, Homo sapiens
tactcttctaaaa

SEQ ID NO: 4577264 - DNA, 17 bp, Homo sapiens
tactcttcttgaaattt

SEQ ID NO: 4577265 - DNA, 18 bp, Homo sapiens
tactcttcttgaaatttt

SEQ ID NO: 4577266 - DNA, 21 bp, Homo sapiens
tactcttgaattcctctcaaa

SEQ ID NO: 4577267 - DNA, 14 bp, Homo sapiens
tactgaaggaaaaa

SEQ ID NO: 4577268 - DNA, 16 bp, Homo sapiens
tactgaatgatctatt

SEQ ID NO: 4577269 - DNA, 19 bp, Homo sapiens
tactgaatgtcattgaaaa

SEQ ID NO: 4577270 - DNA, 13 bp, Homo sapiens
tactgaattcttt

SEQ ID NO: 4577271 - DNA, 15 bp, Homo sapiens
tactgaattctttat

SEQ ID NO: 4577272 - DNA, 15 bp, Homo sapiens
tactgaattgtatca

SEQ ID NO: 4577273 - DNA, 12 bp, Homo sapiens
tactgaattttt

SEQ ID NO: 4577274 - DNA, 18 bp, Homo sapiens
tactgaatttttttgtaa

SEQ ID NO: 4577275 - DNA, 21 bp, Homo sapiens
tactgacagggagcagccccc

SEQ ID NO: 4577276 - DNA, 20 bp, Homo sapiens
tactgactccaaccattcaa

SEQ ID NO: 4577277 - DNA, 19 bp, Homo sapiens
tactgagtactctttctct

SEQ ID NO: 4577278 - DNA, 16 bp, Homo sapiens
tactgatatattttac

SEQ ID NO: 4577279 - DNA, 22 bp, Homo sapiens
tactgatgtgatattctgttgc

SEQ ID NO: 4577280 - DNA, 23 bp, Homo sapiens
tactgatgttcctagtgaaagag

SEQ ID NO: 4577281 - DNA, 18 bp, Homo sapiens
tactgatttcagtaagtc

SEQ ID NO: 4577282 - DNA, 16 bp, Homo sapiens
tactgcaaaaagaaaa

SEQ ID NO: 4577283 - DNA, 16 bp, Homo sapiens
tactgcactccagcct

SEQ ID NO: 4577284 - DNA, 18 bp, Homo sapiens
tactgcactccagcctgg

SEQ ID NO: 4577285 - DNA, 20 bp, Homo sapiens
tactgcactccagcctgggg

SEQ ID NO: 4577286 - DNA, 13 bp, Homo sapiens
tactgcatacttt

SEQ ID NO: 4577287 - DNA, 16 bp, Homo sapiens
tactgcatcatctgtt

SEQ ID NO: 4577288 - DNA, 18 bp, Homo sapiens
tactgccatcctggccca

SEQ ID NO: 4577289 - DNA, 22 bp, Homo sapiens
tactgccatcctggcccagggc

SEQ ID NO: 4577290 - DNA, 15 bp, Homo sapiens
tactgcctttagaaa

SEQ ID NO: 4577291 - DNA, 18 bp, Homo sapiens
tactgcctttagaaaata

SEQ ID NO: 4577292 - DNA, 14 bp, Homo sapiens
tactggaaatgtag

SEQ ID NO: 4577293 - DNA, 19 bp, Homo sapiens
tactggaaatgtagcactt

SEQ ID NO: 4577294 - DNA, 16 bp, Homo sapiens
tactggataaattgtt

SEQ ID NO: 4577295 - DNA, 17 bp, Homo sapiens
tactggggaggctgagg

SEQ ID NO: 4577296 - DNA, 23 bp, Homo sapiens
tactggggagtaaacggcccagg

SEQ ID NO: 4577297 - DNA, 17 bp, Homo sapiens
tactggtaagattgtta

SEQ ID NO: 4577298 - DNA, 21 bp, Homo sapiens
tactggtaagattgttattaa

SEQ ID NO: 4577299 - DNA, 13 bp, Homo sapiens
tactggtccaaaa

SEQ ID NO: 4577300 - DNA, 19 bp, Homo sapiens
tactggtgcagtcattatg

SEQ ID NO: 4577301 - DNA, 13 bp, Homo sapiens
tactggttcattg

SEQ ID NO: 4577302 - DNA, 18 bp, Homo sapiens
tactgtaactgtcagtgt

SEQ ID NO: 4577303 - DNA, 17 bp, Homo sapiens
tactgtaatacttcttt

SEQ ID NO: 4577304 - DNA, 15 bp, Homo sapiens
tactgtaattcctca

SEQ ID NO: 4577305 - DNA, 14 bp, Homo sapiens
tactgtacaataaa

SEQ ID NO: 4577306 - DNA, 18 bp, Homo sapiens
tactgtacaataaaaaca

SEQ ID NO: 4577307 - DNA, 13 bp, Homo sapiens
tactgtacacatt

SEQ ID NO: 4577308 - DNA, 18 bp, Homo sapiens
tactgtacacatttctta

SEQ ID NO: 4577309 - DNA, 18 bp, Homo sapiens
tactgtatcaatttctaa

SEQ ID NO: 4577310 - DNA, 15 bp, Homo sapiens
tactgtatttttcag

SEQ ID NO: 4577311 - DNA, 18 bp, Homo sapiens
tactgtatttttcagaaa

SEQ ID NO: 4577312 - DNA, 14 bp, Homo sapiens
tactgtcagattaa

SEQ ID NO: 4577313 - DNA, 16 bp, Homo sapiens
tactgtccagttttct

SEQ ID NO: 4577314 - DNA, 20 bp, Homo sapiens
tactgtgaaaaaaaatttgt

SEQ ID NO: 4577315 - DNA, 13 bp, Homo sapiens
tactgtgaaatac

SEQ ID NO: 4577316 - DNA, 23 bp, Homo sapiens
tactgtgcaggcctgtccctggg

SEQ ID NO: 4577317 - DNA, 16 bp, Homo sapiens
tactgtgggcaattta

SEQ ID NO: 4577318 - DNA, 18 bp, Homo sapiens
tactgtgggcaatttaga

SEQ ID NO: 4577319 - DNA, 13 bp, Homo sapiens
tactgtgtaatta

SEQ ID NO: 4577320 - DNA, 14 bp, Homo sapiens
tactgtgtaattag

SEQ ID NO: 4577321 - DNA, 16 bp, Homo sapiens
tactgtgtcataaaca

SEQ ID NO: 4577322 - DNA, 23 bp, Homo sapiens
tactgtgtgtgagtgtgaatata

SEQ ID NO: 4577323 - DNA, 19 bp, Homo sapiens
tactgtgtgtgtgaatgaa

SEQ ID NO: 4577324 - DNA, 12 bp, Homo sapiens
tactgttctcaa

SEQ ID NO: 4577325 - DNA, 10 bp, Homo sapiens
tactgttctt

SEQ ID NO: 4577326 - DNA, 17 bp, Homo sapiens
tactgtttacagtttag

SEQ ID NO: 4577327 - DNA, 23 bp, Homo sapiens
tacttaagtgttcattttaagta

SEQ ID NO: 4577328 - DNA, 14 bp, Homo sapiens
tacttaatgaccat

SEQ ID NO: 4577329 - DNA, 12 bp, Homo sapiens
tacttaatgctt

SEQ ID NO: 4577330 - DNA, 16 bp, Homo sapiens
tacttaatttacttaa

SEQ ID NO: 4577331 - DNA, 21 bp, Homo sapiens
tacttaatttacttaagtgtt

SEQ ID NO: 4577332 - DNA, 19 bp, Homo sapiens
tacttacccaggtgggtcc

SEQ ID NO: 4577333 - DNA, 16 bp, Homo sapiens
tacttagagtttctgt

SEQ ID NO: 4577334 - DNA, 20 bp, Homo sapiens
tacttatctctcaaaacaat

SEQ ID NO: 4577335 - DNA, 18 bp, Homo sapiens
tacttattaaaaaatttg

SEQ ID NO: 4577336 - DNA, 18 bp, Homo sapiens
tacttatttacctataaa

SEQ ID NO: 4577337 - DNA, 19 bp, Homo sapiens
tacttcactgtcatcttca

SEQ ID NO: 4577338 - DNA, 20 bp, Homo sapiens
tacttcactgtcatcttcaa

SEQ ID NO: 4577339 - DNA, 16 bp, Homo sapiens
tacttcagctttgtgt

SEQ ID NO: 4577340 - DNA, 22 bp, Homo sapiens
tacttcaggggaagagaagaca

SEQ ID NO: 4577341 - DNA, 14 bp, Homo sapiens
tacttcctctgtga

SEQ ID NO: 4577342 - DNA, 18 bp, Homo sapiens
tacttctctataaaaaat

SEQ ID NO: 4577343 - DNA, 16 bp, Homo sapiens
tacttctgatacttta

SEQ ID NO: 4577344 - DNA, 14 bp, Homo sapiens
tacttcttctgtaa

SEQ ID NO: 4577345 - DNA, 15 bp, Homo sapiens
tacttcttctgtaat

SEQ ID NO: 4577346 - DNA, 17 bp, Homo sapiens
tacttcttctgtaatat

SEQ ID NO: 4577347 - DNA, 13 bp, Homo sapiens
tacttcttgaata

SEQ ID NO: 4577348 - DNA, 20 bp, Homo sapiens
tacttcttgaatataaaaaa

SEQ ID NO: 4577349 - DNA, 19 bp, Homo sapiens
tacttctttgttattataa

SEQ ID NO: 4577350 - DNA, 20 bp, Homo sapiens
tacttgaataaccatctgaa

SEQ ID NO: 4577351 - DNA, 15 bp, Homo sapiens
tacttgaatagtatt

SEQ ID NO: 4577352 - DNA, 15 bp, Homo sapiens
tacttgactctaata

SEQ ID NO: 4577353 - DNA, 16 bp, Homo sapiens
tacttgactctaatat

SEQ ID NO: 4577354 - DNA, 21 bp, Homo sapiens
tacttgaggaaaacactattt

SEQ ID NO: 4577355 - DNA, 14 bp, Homo sapiens
tacttgcctcattt

SEQ ID NO: 4577356 - DNA, 23 bp, Homo sapiens
tacttgccttattagagtgtctt

SEQ ID NO: 4577357 - DNA, 16 bp, Homo sapiens
tacttgtaaaatgctt

SEQ ID NO: 4577358 - DNA, 21 bp, Homo sapiens
tacttgtaaaatgcttttcac

SEQ ID NO: 4577359 - DNA, 23 bp, Homo sapiens
tacttgtaaaatgcttttcactt

SEQ ID NO: 4577360 - DNA, 21 bp, Homo sapiens
tactttaaattatatgatatg

SEQ ID NO: 4577361 - DNA, 22 bp, Homo sapiens
tactttacaaaccattacctgt

SEQ ID NO: 4577362 - DNA, 19 bp, Homo sapiens
tactttacctctctgtcat

SEQ ID NO: 4577363 - DNA, 16 bp, Homo sapiens
tactttactttttcca

SEQ ID NO: 4577364 - DNA, 19 bp, Homo sapiens
tactttataactaacatgt

SEQ ID NO: 4577365 - DNA, 13 bp, Homo sapiens
tactttatatctg

SEQ ID NO: 4577366 - DNA, 18 bp, Homo sapiens
tactttatatctgtaatg

SEQ ID NO: 4577367 - DNA, 14 bp, Homo sapiens
tactttattataaa

SEQ ID NO: 4577368 - DNA, 13 bp, Homo sapiens
tactttatttctg

SEQ ID NO: 4577369 - DNA, 17 bp, Homo sapiens
tactttcaagtaatatt

SEQ ID NO: 4577370 - DNA, 16 bp, Homo sapiens
tactttcatcttaaac

SEQ ID NO: 4577371 - DNA, 17 bp, Homo sapiens
tactttctatgtgacat

SEQ ID NO: 4577372 - DNA, 19 bp, Homo sapiens
tactttctcccagtatgtt

SEQ ID NO: 4577373 - DNA, 23 bp, Homo sapiens
tactttctcccagtatgttttaa

SEQ ID NO: 4577374 - DNA, 18 bp, Homo sapiens
tactttgaagtcatacca

SEQ ID NO: 4577375 - DNA, 22 bp, Homo sapiens
tactttgagcttattgttttta

SEQ ID NO: 4577376 - DNA, 21 bp, Homo sapiens
tactttgattccattttaagt

SEQ ID NO: 4577377 - DNA, 23 bp, Homo sapiens
tactttgcagctgcttttgcaga

SEQ ID NO: 4577378 - DNA, 16 bp, Homo sapiens
tactttggcaatttcc

SEQ ID NO: 4577379 - DNA, 13 bp, Homo sapiens
tactttgtaaata

SEQ ID NO: 4577380 - DNA, 23 bp, Homo sapiens
tactttgtaaataggatttttag

SEQ ID NO: 4577381 - DNA, 16 bp, Homo sapiens
tactttgtatacaagt

SEQ ID NO: 4577382 - DNA, 21 bp, Homo sapiens
tactttgtggaccaattattg

SEQ ID NO: 4577383 - DNA, 22 bp, Homo sapiens
tactttgtggaccaattattga

SEQ ID NO: 4577384 - DNA, 15 bp, Homo sapiens
tacttttaaactgtg

SEQ ID NO: 4577385 - DNA, 13 bp, Homo sapiens
tacttttattatt

SEQ ID NO: 4577386 - DNA, 15 bp, Homo sapiens
tacttttctgccaaa

SEQ ID NO: 4577387 - DNA, 16 bp, Homo sapiens
tacttttctgccaaaa

SEQ ID NO: 4577388 - DNA, 12 bp, Homo sapiens
tactttttctaa

SEQ ID NO: 4577389 - DNA, 15 bp, Homo sapiens
tactttttttgttat

SEQ ID NO: 4577390 - DNA, 15 bp, Homo sapiens
tagaaaaaaaactga

SEQ ID NO: 4577391 - DNA, 22 bp, Homo sapiens
tagaaaaacatttaaacttttt

SEQ ID NO: 4577392 - DNA, 21 bp, Homo sapiens
tagaaaaagaacatgcagttt

SEQ ID NO: 4577393 - DNA, 18 bp, Homo sapiens
tagaaaaatctcattccc

SEQ ID NO: 4577394 - DNA, 19 bp, Homo sapiens
tagaaaaatgtataaaaat

SEQ ID NO: 4577395 - DNA, 17 bp, Homo sapiens
tagaaaaattattagaa

SEQ ID NO: 4577396 - DNA, 21 bp, Homo sapiens
tagaaaaattattagaacatt

SEQ ID NO: 4577397 - DNA, 15 bp, Homo sapiens
tagaaaacaggaaaa

SEQ ID NO: 4577398 - DNA, 11 bp, Homo sapiens
tagaaaacttt

SEQ ID NO: 4577399 - DNA, 16 bp, Homo sapiens
tagaaaactttaaagc

SEQ ID NO: 4577400 - DNA, 14 bp, Homo sapiens
tagaaaagtgaatt

SEQ ID NO: 4577401 - DNA, 13 bp, Homo sapiens
tagaaaatattct

SEQ ID NO: 4577402 - DNA, 18 bp, Homo sapiens
tagaaaatattctctatt

SEQ ID NO: 4577403 - DNA, 16 bp, Homo sapiens
tagaaaattagactgt

SEQ ID NO: 4577404 - DNA, 16 bp, Homo sapiens
tagaaacaccattcat

SEQ ID NO: 4577405 - DNA, 15 bp, Homo sapiens
tagaaacttaaacac

SEQ ID NO: 4577406 - DNA, 13 bp, Homo sapiens
tagaaagaagcca

SEQ ID NO: 4577407 - DNA, 16 bp, Homo sapiens
tagaaagaagccatat

SEQ ID NO: 4577408 - DNA, 15 bp, Homo sapiens
tagaaagctaaagtg

SEQ ID NO: 4577409 - DNA, 19 bp, Homo sapiens
tagaaaggacaacagttct

SEQ ID NO: 4577410 - DNA, 16 bp, Homo sapiens
tagaaaggggagaatg

SEQ ID NO: 4577411 - DNA, 22 bp, Homo sapiens
tagaaagtatagatggccaaag

SEQ ID NO: 4577412 - DNA, 15 bp, Homo sapiens
tagaaataaacctta

SEQ ID NO: 4577413 - DNA, 14 bp, Homo sapiens
tagaaatagagata

SEQ ID NO: 4577414 - DNA, 18 bp, Homo sapiens
tagaaatagagataaaaa

SEQ ID NO: 4577415 - DNA, 21 bp, Homo sapiens
tagaaatagctccgtggagca

SEQ ID NO: 4577416 - DNA, 15 bp, Homo sapiens
tagaaatattttaaa

SEQ ID NO: 4577417 - DNA, 19 bp, Homo sapiens
tagaaatattttaaaatca

SEQ ID NO: 4577418 - DNA, 20 bp, Homo sapiens
tagaaatattttaaaatcag

SEQ ID NO: 4577419 - DNA, 13 bp, Homo sapiens
tagaaatcatttt

SEQ ID NO: 4577420 - DNA, 17 bp, Homo sapiens
tagaaatggaaattttg

SEQ ID NO: 4577421 - DNA, 21 bp, Homo sapiens
tagaaatggaaattttgctat

SEQ ID NO: 4577422 - DNA, 23 bp, Homo sapiens
tagaaattgaacaaaaatgtttc

SEQ ID NO: 4577423 - DNA, 14 bp, Homo sapiens
tagaaattttgtaa

SEQ ID NO: 4577424 - DNA, 15 bp, Homo sapiens
tagaaattttgtaag

SEQ ID NO: 4577425 - DNA, 12 bp, Homo sapiens
tagaacactatt

SEQ ID NO: 4577426 - DNA, 16 bp, Homo sapiens
tagaacactattttca

SEQ ID NO: 4577427 - DNA, 22 bp, Homo sapiens
tagaacattgatctgttttaca

SEQ ID NO: 4577428 - DNA, 14 bp, Homo sapiens
tagaaccacagcag

SEQ ID NO: 4577429 - DNA, 18 bp, Homo sapiens
tagaaccacagcagacac

SEQ ID NO: 4577430 - DNA, 21 bp, Homo sapiens
tagaaccacagcagacaccat

SEQ ID NO: 4577431 - DNA, 21 bp, Homo sapiens
tagaaccatgttggttgcact

SEQ ID NO: 4577432 - DNA, 22 bp, Homo sapiens
tagaacccggcaggctagaacc

SEQ ID NO: 4577433 - DNA, 15 bp, Homo sapiens
tagaacctaattcaa

SEQ ID NO: 4577434 - DNA, 23 bp, Homo sapiens
tagaacctaattcaattcaaagc

SEQ ID NO: 4577435 - DNA, 17 bp, Homo sapiens
tagaacctagaagggct

SEQ ID NO: 4577436 - DNA, 16 bp, Homo sapiens
tagaacctggaagggc

SEQ ID NO: 4577437 - DNA, 13 bp, Homo sapiens
tagaacctggagg

SEQ ID NO: 4577438 - DNA, 22 bp, Homo sapiens
tagaacctggagggctagaacc

SEQ ID NO: 4577439 - DNA, 14 bp, Homo sapiens
tagaactgaactgt

SEQ ID NO: 4577440 - DNA, 22 bp, Homo sapiens
tagaacttggatgtacctgccc

SEQ ID NO: 4577441 - DNA, 18 bp, Homo sapiens
tagaagaaccaaatacct

SEQ ID NO: 4577442 - DNA, 17 bp, Homo sapiens
tagaagaatattgtatt

SEQ ID NO: 4577443 - DNA, 17 bp, Homo sapiens
tagaagaggcctttgga

SEQ ID NO: 4577444 - DNA, 14 bp, Homo sapiens
tagaagatatggaa

SEQ ID NO: 4577445 - DNA, 18 bp, Homo sapiens
tagaagatggcacttata

SEQ ID NO: 4577446 - DNA, 17 bp, Homo sapiens
tagaagattagaaacta

SEQ ID NO: 4577447 - DNA, 15 bp, Homo sapiens
tagaagcaaggagaa

SEQ ID NO: 4577448 - DNA, 16 bp, Homo sapiens
tagaagccaagggaaa

SEQ ID NO: 4577449 - DNA, 21 bp, Homo sapiens
tagaagccttatgaaaattat

SEQ ID NO: 4577450 - DNA, 16 bp, Homo sapiens
tagaagcgctcatctg

SEQ ID NO: 4577451 - DNA, 17 bp, Homo sapiens
tagaagctgaagatccc

SEQ ID NO: 4577452 - DNA, 16 bp, Homo sapiens
tagaagctgcagtggt

SEQ ID NO: 4577453 - DNA, 14 bp, Homo sapiens
tagaagcttcagca

SEQ ID NO: 4577454 - DNA, 21 bp, Homo sapiens
tagaaggaagtgtgtttgcct

SEQ ID NO: 4577455 - DNA, 21 bp, Homo sapiens
tagaaggcgtccatgtttatt

SEQ ID NO: 4577456 - DNA, 24 bp, Homo sapiens
tagaagggctagaacctggagagc

SEQ ID NO: 4577457 - DNA, 14 bp, Homo sapiens
tagaagtccacaga

SEQ ID NO: 4577458 - DNA, 20 bp, Homo sapiens
tagaagtgggccaggacagg

SEQ ID NO: 4577459 - DNA, 21 bp, Homo sapiens
tagaataaaggcagttttcta

SEQ ID NO: 4577460 - DNA, 17 bp, Homo sapiens
tagaataaatggtttct

SEQ ID NO: 4577461 - DNA, 19 bp, Homo sapiens
tagaataaggattctgaag

SEQ ID NO: 4577462 - DNA, 15 bp, Homo sapiens
tagaataggcagggg

SEQ ID NO: 4577463 - DNA, 22 bp, Homo sapiens
tagaataggcagggggccctgc

SEQ ID NO: 4577464 - DNA, 19 bp, Homo sapiens
tagaatagtggttaacaga

SEQ ID NO: 4577465 - DNA, 23 bp, Homo sapiens
tagaatagtggttaacagagcta

SEQ ID NO: 4577466 - DNA, 22 bp, Homo sapiens
tagaatattcagacaaaatgga

SEQ ID NO: 4577467 - DNA, 14 bp, Homo sapiens
tagaatcaatttaa

SEQ ID NO: 4577468 - DNA, 21 bp, Homo sapiens
tagaatcagaataaagttgta

SEQ ID NO: 4577469 - DNA, 20 bp, Homo sapiens
tagaatctcttcatgcttga

SEQ ID NO: 4577470 - DNA, 12 bp, Homo sapiens
tagaatctggag

SEQ ID NO: 4577471 - DNA, 22 bp, Homo sapiens
tagaatgccggttaaattccat

SEQ ID NO: 4577472 - DNA, 15 bp, Homo sapiens
tagaatgtaaagtta

SEQ ID NO: 4577473 - DNA, 17 bp, Homo sapiens
tagaatgttattgtgta

SEQ ID NO: 4577474 - DNA, 15 bp, Homo sapiens
tagaatgttgaaaag

SEQ ID NO: 4577475 - DNA, 14 bp, Homo sapiens
tagaattaaaaaag

SEQ ID NO: 4577476 - DNA, 16 bp, Homo sapiens
tagaattaacacatga

SEQ ID NO: 4577477 - DNA, 16 bp, Homo sapiens
tagaattaccatttgt

SEQ ID NO: 4577478 - DNA, 17 bp, Homo sapiens
tagaattatattttctt

SEQ ID NO: 4577479 - DNA, 15 bp, Homo sapiens
tagaattatctaatt

SEQ ID NO: 4577480 - DNA, 23 bp, Homo sapiens
tagaattatctaatttataaaaa

SEQ ID NO: 4577481 - DNA, 15 bp, Homo sapiens
tagaattcactgagt

SEQ ID NO: 4577482 - DNA, 19 bp, Homo sapiens
tagaattgagtgtttaaag

SEQ ID NO: 4577483 - DNA, 20 bp, Homo sapiens
tagaatttcctgtaatatat

SEQ ID NO: 4577484 - DNA, 21 bp, Homo sapiens
tagaatttgtttcatctattt

SEQ ID NO: 4577485 - DNA, 22 bp, Homo sapiens
tagaatttgtttcatctatttt

SEQ ID NO: 4577486 - DNA, 20 bp, Homo sapiens
tagacaaaccatctcctcct

SEQ ID NO: 4577487 - DNA, 17 bp, Homo sapiens
tagacaatcattgtttt

SEQ ID NO: 4577488 - DNA, 23 bp, Homo sapiens
tagacaattcctccagagacact

SEQ ID NO: 4577489 - DNA, 13 bp, Homo sapiens
tagacacatgaag

SEQ ID NO: 4577490 - DNA, 19 bp, Homo sapiens
tagacacatgaaggtaaat

SEQ ID NO: 4577491 - DNA, 21 bp, Homo sapiens
tagacacatgaaggtaaataa

SEQ ID NO: 4577492 - DNA, 12 bp, Homo sapiens
tagacagaagaa

SEQ ID NO: 4577493 - DNA, 14 bp, Homo sapiens
tagacagaagaaac

SEQ ID NO: 4577494 - DNA, 15 bp, Homo sapiens
tagacagtgcccttg

SEQ ID NO: 4577495 - DNA, 17 bp, Homo sapiens
tagacagtgcccttggt

SEQ ID NO: 4577496 - DNA, 18 bp, Homo sapiens
tagacagtgcccttggtg

SEQ ID NO: 4577497 - DNA, 20 bp, Homo sapiens
tagacataaagaagaaactt

SEQ ID NO: 4577498 - DNA, 21 bp, Homo sapiens
tagacatcattgtcagccttg

SEQ ID NO: 4577499 - DNA, 20 bp, Homo sapiens
tagacatgcccaaaacttat

SEQ ID NO: 4577500 - DNA, 16 bp, Homo sapiens
tagaccctcgggcccc

SEQ ID NO: 4577501 - DNA, 20 bp, Homo sapiens
tagaccctgggtgggctctg

SEQ ID NO: 4577502 - DNA, 23 bp, Homo sapiens
tagaccgctctcttttctgtact

SEQ ID NO: 4577503 - DNA, 20 bp, Homo sapiens
tagacgcccctcccaagcgt

SEQ ID NO: 4577504 - DNA, 23 bp, Homo sapiens
tagacggagccctggcatgtcaa

SEQ ID NO: 4577505 - DNA, 14 bp, Homo sapiens
tagactagagaaac

SEQ ID NO: 4577506 - DNA, 21 bp, Homo sapiens
tagactagcaatctcttcatt

SEQ ID NO: 4577507 - DNA, 15 bp, Homo sapiens
tagactataaatgtt

SEQ ID NO: 4577508 - DNA, 22 bp, Homo sapiens
tagactataaatgttgctatgt

SEQ ID NO: 4577509 - DNA, 13 bp, Homo sapiens
tagactgtgccag

SEQ ID NO: 4577510 - DNA, 22 bp, Homo sapiens
tagacttatattttataatcag

SEQ ID NO: 4577511 - DNA, 22 bp, Homo sapiens
tagacttcaagcatggctattt

SEQ ID NO: 4577512 - DNA, 16 bp, Homo sapiens
tagacttcagagagaa

SEQ ID NO: 4577513 - DNA, 19 bp, Homo sapiens
tagacttcccactgttctg

SEQ ID NO: 4577514 - DNA, 22 bp, Homo sapiens
tagacttcccactgttctgaaa

SEQ ID NO: 4577515 - DNA, 12 bp, Homo sapiens
tagacttgctcc

SEQ ID NO: 4577516 - DNA, 15 bp, Homo sapiens
tagacttggacccaa

SEQ ID NO: 4577517 - DNA, 14 bp, Homo sapiens
tagacttgtgtgca

SEQ ID NO: 4577518 - DNA, 15 bp, Homo sapiens
tagacttgtgtgcat

SEQ ID NO: 4577519 - DNA, 16 bp, Homo sapiens
tagagaacgcagccct

SEQ ID NO: 4577520 - DNA, 18 bp, Homo sapiens
tagagaagacaggctgga

SEQ ID NO: 4577521 - DNA, 21 bp, Homo sapiens
tagagaatccgtattgaattt

SEQ ID NO: 4577522 - DNA, 22 bp, Homo sapiens
tagagaatgcacagatatactt

SEQ ID NO: 4577523 - DNA, 12 bp, Homo sapiens
tagagaatgttc

SEQ ID NO: 4577524 - DNA, 13 bp, Homo sapiens
tagagagaaagag

SEQ ID NO: 4577525 - DNA, 14 bp, Homo sapiens
tagagagaaagaga

SEQ ID NO: 4577526 - DNA, 16 bp, Homo sapiens
tagagataggaaactg

SEQ ID NO: 4577527 - DNA, 16 bp, Homo sapiens
tagagatattttgtaa

SEQ ID NO: 4577528 - DNA, 15 bp, Homo sapiens
tagagatctattttt

SEQ ID NO: 4577529 - DNA, 13 bp, Homo sapiens
tagagatgagccc

SEQ ID NO: 4577530 - DNA, 14 bp, Homo sapiens
tagagatgagccca

SEQ ID NO: 4577531 - DNA, 18 bp, Homo sapiens
tagagattacctcctgag

SEQ ID NO: 4577532 - DNA, 17 bp, Homo sapiens
tagagcaaaataatgca

SEQ ID NO: 4577533 - DNA, 20 bp, Homo sapiens
tagagcaaagcatcaaagaa

SEQ ID NO: 4577534 - DNA, 20 bp, Homo sapiens
tagagccaagtgtcttttaa

SEQ ID NO: 4577535 - DNA, 16 bp, Homo sapiens
tagagcctgcctggag

SEQ ID NO: 4577536 - DNA, 15 bp, Homo sapiens
tagagcttggacagt

SEQ ID NO: 4577537 - DNA, 19 bp, Homo sapiens
tagagcttggacagtctga

SEQ ID NO: 4577538 - DNA, 22 bp, Homo sapiens
tagaggagaaactggaactctc

SEQ ID NO: 4577539 - DNA, 22 bp, Homo sapiens
tagaggatggtcttacagcagg

SEQ ID NO: 4577540 - DNA, 22 bp, Homo sapiens
tagaggctccagctctggcaca

SEQ ID NO: 4577541 - DNA, 14 bp, Homo sapiens
tagaggcttctccg

SEQ ID NO: 4577542 - DNA, 21 bp, Homo sapiens
tagaggcttctccgccagcct

SEQ ID NO: 4577543 - DNA, 15 bp, Homo sapiens
tagaggtaaaagtac

SEQ ID NO: 4577544 - DNA, 17 bp, Homo sapiens
tagaggtatattggaag

SEQ ID NO: 4577545 - DNA, 22 bp, Homo sapiens
tagagtaacgagaagtgcttta

SEQ ID NO: 4577546 - DNA, 15 bp, Homo sapiens
tagagtaatgatgta

SEQ ID NO: 4577547 - DNA, 21 bp, Homo sapiens
tagagtcaactacacaaagca

SEQ ID NO: 4577548 - DNA, 13 bp, Homo sapiens
tagagtcctcact

SEQ ID NO: 4577549 - DNA, 20 bp, Homo sapiens
tagagtcctcactcccagtc

SEQ ID NO: 4577550 - DNA, 20 bp, Homo sapiens
tagagtcttaaagcatttca

SEQ ID NO: 4577551 - DNA, 22 bp, Homo sapiens
tagagtgacctcggacagagcc

SEQ ID NO: 4577552 - DNA, 15 bp, Homo sapiens
tagagtgtctttcca

SEQ ID NO: 4577553 - DNA, 17 bp, Homo sapiens
tagagttatcttcttta

SEQ ID NO: 4577554 - DNA, 21 bp, Homo sapiens
tagagttttattcctttcctt

SEQ ID NO: 4577555 - DNA, 17 bp, Homo sapiens
tagataaccaattttca

SEQ ID NO: 4577556 - DNA, 18 bp, Homo sapiens
tagataacttcttgaaaa

SEQ ID NO: 4577557 - DNA, 19 bp, Homo sapiens
tagataacttcttgaaaaa

SEQ ID NO: 4577558 - DNA, 13 bp, Homo sapiens
tagatacaataaa

SEQ ID NO: 4577559 - DNA, 14 bp, Homo sapiens
tagatacaataaat

SEQ ID NO: 4577560 - DNA, 16 bp, Homo sapiens
tagatactctcttctt

SEQ ID NO: 4577561 - DNA, 13 bp, Homo sapiens
tagatataatgaa

SEQ ID NO: 4577562 - DNA, 22 bp, Homo sapiens
tagatatcctctccccctcctc

SEQ ID NO: 4577563 - DNA, 15 bp, Homo sapiens
tagatatgaaagctg

SEQ ID NO: 4577564 - DNA, 12 bp, Homo sapiens
tagatattgcta

SEQ ID NO: 4577565 - DNA, 17 bp, Homo sapiens
tagatattgctactata

SEQ ID NO: 4577566 - DNA, 20 bp, Homo sapiens
tagatatttcgaccctgggg

SEQ ID NO: 4577567 - DNA, 21 bp, Homo sapiens
tagatatttcgaccctggggc

SEQ ID NO: 4577568 - DNA, 18 bp, Homo sapiens
tagatcaaatagttgcat

SEQ ID NO: 4577569 - DNA, 20 bp, Homo sapiens
tagatcaaatagttgcatag

SEQ ID NO: 4577570 - DNA, 19 bp, Homo sapiens
tagatcctgcaccccagca

SEQ ID NO: 4577571 - DNA, 22 bp, Homo sapiens
tagatcctgcaccccagcattc

SEQ ID NO: 4577572 - DNA, 19 bp, Homo sapiens
tagatctccaggagaactg

SEQ ID NO: 4577573 - DNA, 16 bp, Homo sapiens
tagatgaagttttaca

SEQ ID NO: 4577574 - DNA, 16 bp, Homo sapiens
tagatgagccgggtcc

SEQ ID NO: 4577575 - DNA, 16 bp, Homo sapiens
tagatgataatttttt

SEQ ID NO: 4577576 - DNA, 19 bp, Homo sapiens
tagatgattttttgaaagt

SEQ ID NO: 4577577 - DNA, 20 bp, Homo sapiens
tagatgcacgtggggcccac

SEQ ID NO: 4577578 - DNA, 17 bp, Homo sapiens
tagatggaccccagcat

SEQ ID NO: 4577579 - DNA, 21 bp, Homo sapiens
tagatgggacgcataatcatt

SEQ ID NO: 4577580 - DNA, 21 bp, Homo sapiens
tagatggttacactgttagaa

SEQ ID NO: 4577581 - DNA, 19 bp, Homo sapiens
tagatggtttgagcctgag

SEQ ID NO: 4577582 - DNA, 15 bp, Homo sapiens
tagatgtatttttga

SEQ ID NO: 4577583 - DNA, 17 bp, Homo sapiens
tagatgtcttttatagt

SEQ ID NO: 4577584 - DNA, 23 bp, Homo sapiens
tagattaatactctatttttaca

SEQ ID NO: 4577585 - DNA, 18 bp, Homo sapiens
tagattattataaactat

SEQ ID NO: 4577586 - DNA, 20 bp, Homo sapiens
tagattcacctgtaaaactt

SEQ ID NO: 4577587 - DNA, 22 bp, Homo sapiens
tagattcacctgtaaaacttta

SEQ ID NO: 4577588 - DNA, 17 bp, Homo sapiens
tagattcatgaaaatgt

SEQ ID NO: 4577589 - DNA, 20 bp, Homo sapiens
tagattgcaaatattggtta

SEQ ID NO: 4577590 - DNA, 20 bp, Homo sapiens
tagatttaaaggcagacagt

SEQ ID NO: 4577591 - DNA, 22 bp, Homo sapiens
tagatttcatagttcagaattt

SEQ ID NO: 4577592 - DNA, 23 bp, Homo sapiens
tagatttctcacactctaactgt

SEQ ID NO: 4577593 - DNA, 16 bp, Homo sapiens
tagatttgaaaattgt

SEQ ID NO: 4577594 - DNA, 21 bp, Homo sapiens
tagattttagaaaaacattta

SEQ ID NO: 4577595 - DNA, 12 bp, Homo sapiens
tagattttttca

SEQ ID NO: 4577596 - DNA, 14 bp, Homo sapiens
tagcaaaaagtggg

SEQ ID NO: 4577597 - DNA, 14 bp, Homo sapiens
tagcaaaagaagaa

SEQ ID NO: 4577598 - DNA, 16 bp, Homo sapiens
tagcaaaagaagaagt

SEQ ID NO: 4577599 - DNA, 21 bp, Homo sapiens
tagcaaaattcttaagtatgt

SEQ ID NO: 4577600 - DNA, 18 bp, Homo sapiens
tagcaaacagatgtttgt

SEQ ID NO: 4577601 - DNA, 15 bp, Homo sapiens
tagcaaagcaaaagg

SEQ ID NO: 4577602 - DNA, 20 bp, Homo sapiens
tagcaaagcaaaaggctgag

SEQ ID NO: 4577603 - DNA, 13 bp, Homo sapiens
tagcaaatgttta

SEQ ID NO: 4577604 - DNA, 14 bp, Homo sapiens
tagcaaatgtttac

SEQ ID NO: 4577605 - DNA, 16 bp, Homo sapiens
tagcaaatgtttactg

SEQ ID NO: 4577606 - DNA, 18 bp, Homo sapiens
tagcaaatgtttactgta

SEQ ID NO: 4577607 - DNA, 17 bp, Homo sapiens
tagcaaatttgtttaat

SEQ ID NO: 4577608 - DNA, 22 bp, Homo sapiens
tagcaaatttgtttaatctaca

SEQ ID NO: 4577609 - DNA, 19 bp, Homo sapiens
tagcaacaacaattggtaa

SEQ ID NO: 4577610 - DNA, 15 bp, Homo sapiens
tagcaacagagcact

SEQ ID NO: 4577611 - DNA, 20 bp, Homo sapiens
tagcaacccagaatgtaaaa

SEQ ID NO: 4577612 - DNA, 17 bp, Homo sapiens
tagcaagactgcaagag

SEQ ID NO: 4577613 - DNA, 18 bp, Homo sapiens
tagcaagactgcaagaga

SEQ ID NO: 4577614 - DNA, 13 bp, Homo sapiens
tagcaataactga

SEQ ID NO: 4577615 - DNA, 15 bp, Homo sapiens
tagcaatacagggag

SEQ ID NO: 4577616 - DNA, 21 bp, Homo sapiens
tagcaataggtttgtaaaatg

SEQ ID NO: 4577617 - DNA, 17 bp, Homo sapiens
tagcaatggccagagcc

SEQ ID NO: 4577618 - DNA, 17 bp, Homo sapiens
tagcaatgtaaaaatgg

SEQ ID NO: 4577619 - DNA, 14 bp, Homo sapiens
tagcaatgtgcctt

SEQ ID NO: 4577620 - DNA, 21 bp, Homo sapiens
tagcaattcatgggctgtgtg

SEQ ID NO: 4577621 - DNA, 17 bp, Homo sapiens
tagcacagaggcctgac

SEQ ID NO: 4577622 - DNA, 17 bp, Homo sapiens
tagcaccttcagggctg

SEQ ID NO: 4577623 - DNA, 16 bp, Homo sapiens
tagcacgtttaaagtt

SEQ ID NO: 4577624 - DNA, 16 bp, Homo sapiens
tagcactaggcaccca

SEQ ID NO: 4577625 - DNA, 20 bp, Homo sapiens
tagcactggtttgtttctca

SEQ ID NO: 4577626 - DNA, 19 bp, Homo sapiens
tagcacttaaattcctcaa

SEQ ID NO: 4577627 - DNA, 15 bp, Homo sapiens
tagcacttacgtaaa

SEQ ID NO: 4577628 - DNA, 20 bp, Homo sapiens
tagcactttcattgccagtg

SEQ ID NO: 4577629 - DNA, 17 bp, Homo sapiens
tagcagatctgttttgt

SEQ ID NO: 4577630 - DNA, 17 bp, Homo sapiens
tagcagcaggctcaggc

SEQ ID NO: 4577631 - DNA, 18 bp, Homo sapiens
tagcaggccaaggtctga

SEQ ID NO: 4577632 - DNA, 20 bp, Homo sapiens
tagcagggcatggctgggaa

SEQ ID NO: 4577633 - DNA, 17 bp, Homo sapiens
tagcaggtaccactgat

SEQ ID NO: 4577634 - DNA, 16 bp, Homo sapiens
tagcagttctgcaaat

SEQ ID NO: 4577635 - DNA, 20 bp, Homo sapiens
tagcagttctgcaaatagaa

SEQ ID NO: 4577636 - DNA, 23 bp, Homo sapiens
tagcatgttcctccttttcttca

SEQ ID NO: 4577637 - DNA, 20 bp, Homo sapiens
tagcattcatgtaataaaca

SEQ ID NO: 4577638 - DNA, 17 bp, Homo sapiens
tagcattctttggagtt

SEQ ID NO: 4577639 - DNA, 20 bp, Homo sapiens
tagcattctttggagttaaa

SEQ ID NO: 4577640 - DNA, 18 bp, Homo sapiens
tagcatttatttctctgg

SEQ ID NO: 4577641 - DNA, 21 bp, Homo sapiens
tagccaaaaatagctaaatac

SEQ ID NO: 4577642 - DNA, 15 bp, Homo sapiens
tagccacagctgctg

SEQ ID NO: 4577643 - DNA, 20 bp, Homo sapiens
tagccacatttggaatactt

SEQ ID NO: 4577644 - DNA, 16 bp, Homo sapiens
tagccactcctgccag

SEQ ID NO: 4577645 - DNA, 20 bp, Homo sapiens
tagccagacacgttctgatt

SEQ ID NO: 4577646 - DNA, 20 bp, Homo sapiens
tagccagagggtgggagcct

SEQ ID NO: 4577647 - DNA, 15 bp, Homo sapiens
tagccagatttgtct

SEQ ID NO: 4577648 - DNA, 16 bp, Homo sapiens
tagccagcgtttattg

SEQ ID NO: 4577649 - DNA, 17 bp, Homo sapiens
tagccagcgtttattgt

SEQ ID NO: 4577650 - DNA, 17 bp, Homo sapiens
tagccatgctttatgtg

SEQ ID NO: 4577651 - DNA, 20 bp, Homo sapiens
tagcccaagaggtctgagcc

SEQ ID NO: 4577652 - DNA, 18 bp, Homo sapiens
tagcccaatgaaatgaat

SEQ ID NO: 4577653 - DNA, 20 bp, Homo sapiens
tagcccacccccctccccaa

SEQ ID NO: 4577654 - DNA, 13 bp, Homo sapiens
tagccccaaatct

SEQ ID NO: 4577655 - DNA, 19 bp, Homo sapiens
tagccccctcatctgcagg

SEQ ID NO: 4577656 - DNA, 21 bp, Homo sapiens
tagccccctggtaatagctgt

SEQ ID NO: 4577657 - DNA, 15 bp, Homo sapiens
tagccccggcccccc

SEQ ID NO: 4577658 - DNA, 14 bp, Homo sapiens
tagcccgcctgcca

SEQ ID NO: 4577659 - DNA, 20 bp, Homo sapiens
tagcccgcctgccagtccta

SEQ ID NO: 4577660 - DNA, 17 bp, Homo sapiens
tagccctgccctcccaa

SEQ ID NO: 4577661 - DNA, 14 bp, Homo sapiens
tagcccttccctga

SEQ ID NO: 4577662 - DNA, 15 bp, Homo sapiens
tagcccttccctgag

SEQ ID NO: 4577663 - DNA, 18 bp, Homo sapiens
tagccgagagcctgctcc

SEQ ID NO: 4577664 - DNA, 21 bp, Homo sapiens
tagccgatatcagaatttgtg

SEQ ID NO: 4577665 - DNA, 20 bp, Homo sapiens
tagcctaaggctcctgtttt

SEQ ID NO: 4577666 - DNA, 22 bp, Homo sapiens
tagcctagatatgaatatatgg

SEQ ID NO: 4577667 - DNA, 20 bp, Homo sapiens
tagcctcagatgatttcccc

SEQ ID NO: 4577668 - DNA, 19 bp, Homo sapiens
tagcctcctcctgggctcc

SEQ ID NO: 4577669 - DNA, 16 bp, Homo sapiens
tagcctctcccacccg

SEQ ID NO: 4577670 - DNA, 17 bp, Homo sapiens
tagcctgaattgctttc

SEQ ID NO: 4577671 - DNA, 20 bp, Homo sapiens
tagcctgaattgctttctgc

SEQ ID NO: 4577672 - DNA, 14 bp, Homo sapiens
tagcctgcactttg

SEQ ID NO: 4577673 - DNA, 12 bp, Homo sapiens
tagcctgctggt

SEQ ID NO: 4577674 - DNA, 17 bp, Homo sapiens
tagcctggccaccagcc

SEQ ID NO: 4577675 - DNA, 20 bp, Homo sapiens
tagcctgggctcactgtgct

SEQ ID NO: 4577676 - DNA, 14 bp, Homo sapiens
tagcctgtggcagt

SEQ ID NO: 4577677 - DNA, 23 bp, Homo sapiens
tagcctgtggcagtaaagagaaa

SEQ ID NO: 4577678 - DNA, 16 bp, Homo sapiens
tagcgatctctcctgg

SEQ ID NO: 4577679 - DNA, 19 bp, Homo sapiens
tagcgatctctcctggcct

SEQ ID NO: 4577680 - DNA, 20 bp, Homo sapiens
tagcgatctctcctggccta

SEQ ID NO: 4577681 - DNA, 21 bp, Homo sapiens
tagcgctgccgcaccccagag

SEQ ID NO: 4577682 - DNA, 15 bp, Homo sapiens
tagcggagcccagcc

SEQ ID NO: 4577683 - DNA, 12 bp, Homo sapiens
tagcggccctgg

SEQ ID NO: 4577684 - DNA, 14 bp, Homo sapiens
tagcgtgtgtagat

SEQ ID NO: 4577685 - DNA, 13 bp, Homo sapiens
tagcgttctggac

SEQ ID NO: 4577686 - DNA, 22 bp, Homo sapiens
tagcgtttaaggtgagcataaa

SEQ ID NO: 4577687 - DNA, 18 bp, Homo sapiens
tagcgttttttaaatgta

SEQ ID NO: 4577688 - DNA, 22 bp, Homo sapiens
tagctaagtacacaataagcaa

SEQ ID NO: 4577689 - DNA, 22 bp, Homo sapiens
tagctacaatttgtttttgcat

SEQ ID NO: 4577690 - DNA, 15 bp, Homo sapiens
tagctacaggaagca

SEQ ID NO: 4577691 - DNA, 23 bp, Homo sapiens
tagctacaggaagcaccccatgc

SEQ ID NO: 4577692 - DNA, 12 bp, Homo sapiens
tagctagtagca

SEQ ID NO: 4577693 - DNA, 16 bp, Homo sapiens
tagctagtagcaatgt

SEQ ID NO: 4577694 - DNA, 14 bp, Homo sapiens
tagctattactgga

SEQ ID NO: 4577695 - DNA, 17 bp, Homo sapiens
tagctcaagaattgtta

SEQ ID NO: 4577696 - DNA, 17 bp, Homo sapiens
tagctcactgcagcctc

SEQ ID NO: 4577697 - DNA, 18 bp, Homo sapiens
tagctcactgcagcctca

SEQ ID NO: 4577698 - DNA, 23 bp, Homo sapiens
tagctccagcgatggtgctgccc

SEQ ID NO: 4577699 - DNA, 11 bp, Homo sapiens
tagctcccctg

SEQ ID NO: 4577700 - DNA, 15 bp, Homo sapiens
tagctcccctggctg

SEQ ID NO: 4577701 - DNA, 16 bp, Homo sapiens
tagctcccctggctgg

SEQ ID NO: 4577702 - DNA, 19 bp, Homo sapiens
tagctcccctggctggctc

SEQ ID NO: 4577703 - DNA, 20 bp, Homo sapiens
tagctcccctggctggctcc

SEQ ID NO: 4577704 - DNA, 18 bp, Homo sapiens
tagctcctcaaagcctca

SEQ ID NO: 4577705 - DNA, 12 bp, Homo sapiens
tagctctgcctc

SEQ ID NO: 4577706 - DNA, 13 bp, Homo sapiens
tagctcttacaca

SEQ ID NO: 4577707 - DNA, 23 bp, Homo sapiens
tagctgcacagggcagctgggcc

SEQ ID NO: 4577708 - DNA, 16 bp, Homo sapiens
tagctggcaagaatgg

SEQ ID NO: 4577709 - DNA, 16 bp, Homo sapiens
tagctgggaaagcata

SEQ ID NO: 4577710 - DNA, 18 bp, Homo sapiens
tagctgggaaagcataaa

SEQ ID NO: 4577711 - DNA, 14 bp, Homo sapiens
tagctgggattaca

SEQ ID NO: 4577712 - DNA, 16 bp, Homo sapiens
tagctgggattacagg

SEQ ID NO: 4577713 - DNA, 21 bp, Homo sapiens
tagctgtcccatctggtcatt

SEQ ID NO: 4577714 - DNA, 18 bp, Homo sapiens
tagctgtggtgaggtggg

SEQ ID NO: 4577715 - DNA, 15 bp, Homo sapiens
tagctgttttggaac

SEQ ID NO: 4577716 - DNA, 21 bp, Homo sapiens
tagcttatctgcccctccccc

SEQ ID NO: 4577717 - DNA, 12 bp, Homo sapiens
tagcttcaggaa

SEQ ID NO: 4577718 - DNA, 19 bp, Homo sapiens
tagcttctcttctttctga

SEQ ID NO: 4577719 - DNA, 13 bp, Homo sapiens
tagcttctgcttt

SEQ ID NO: 4577720 - DNA, 22 bp, Homo sapiens
tagcttctgcttttctgccctg

SEQ ID NO: 4577721 - DNA, 21 bp, Homo sapiens
tagcttgtctgtgatctctgc

SEQ ID NO: 4577722 - DNA, 16 bp, Homo sapiens
tagctttaacttaaat

SEQ ID NO: 4577723 - DNA, 17 bp, Homo sapiens
tagctttagaccctggg

SEQ ID NO: 4577724 - DNA, 18 bp, Homo sapiens
tagctttagaccctgggt

SEQ ID NO: 4577725 - DNA, 18 bp, Homo sapiens
tagctttgctctttagat

SEQ ID NO: 4577726 - DNA, 17 bp, Homo sapiens
tagctttgtatttttgt

SEQ ID NO: 4577727 - DNA, 20 bp, Homo sapiens
tagctttttaattaagcaaa

SEQ ID NO: 4577728 - DNA, 20 bp, Homo sapiens
taggaaaaaaactgggataa

SEQ ID NO: 4577729 - DNA, 16 bp, Homo sapiens
taggaaaatgcttatt

SEQ ID NO: 4577730 - DNA, 20 bp, Homo sapiens
taggaaatctagaagtagtc

SEQ ID NO: 4577731 - DNA, 22 bp, Homo sapiens
taggaaatggctttgtgattca

SEQ ID NO: 4577732 - DNA, 16 bp, Homo sapiens
taggaagtaaattata

SEQ ID NO: 4577733 - DNA, 12 bp, Homo sapiens
taggaataaata

SEQ ID NO: 4577734 - DNA, 17 bp, Homo sapiens
taggaatagaggaagaa

SEQ ID NO: 4577735 - DNA, 22 bp, Homo sapiens
taggaatatacatagtctttgt

SEQ ID NO: 4577736 - DNA, 17 bp, Homo sapiens
taggaattactttatta

SEQ ID NO: 4577737 - DNA, 22 bp, Homo sapiens
taggaattactttattataaaa

SEQ ID NO: 4577738 - DNA, 18 bp, Homo sapiens
taggaatttgtattttgg

SEQ ID NO: 4577739 - DNA, 21 bp, Homo sapiens
taggacaagttttagttaaaa

SEQ ID NO: 4577740 - DNA, 22 bp, Homo sapiens
taggacaagttttagttaaaac

SEQ ID NO: 4577741 - DNA, 19 bp, Homo sapiens
taggacccgtctccagctg

SEQ ID NO: 4577742 - DNA, 20 bp, Homo sapiens
taggagaagtcttctattta

SEQ ID NO: 4577743 - DNA, 20 bp, Homo sapiens
taggagtgctgataagaatg

SEQ ID NO: 4577744 - DNA, 19 bp, Homo sapiens
taggatagctaactgtaaa

SEQ ID NO: 4577745 - DNA, 21 bp, Homo sapiens
taggatccagtgatccttaca

SEQ ID NO: 4577746 - DNA, 16 bp, Homo sapiens
taggatgacaggctct

SEQ ID NO: 4577747 - DNA, 17 bp, Homo sapiens
taggatgacaggctctc

SEQ ID NO: 4577748 - DNA, 20 bp, Homo sapiens
taggatgggaacaaggaagg

SEQ ID NO: 4577749 - DNA, 17 bp, Homo sapiens
taggatggttctgtgac

SEQ ID NO: 4577750 - DNA, 19 bp, Homo sapiens
taggatgtatattttatat

SEQ ID NO: 4577751 - DNA, 14 bp, Homo sapiens
taggatgtgatgat

SEQ ID NO: 4577752 - DNA, 13 bp, Homo sapiens
taggatgttgaaa

SEQ ID NO: 4577753 - DNA, 16 bp, Homo sapiens
taggatttatttaaaa

SEQ ID NO: 4577754 - DNA, 22 bp, Homo sapiens
taggatttatttaaaatagcaa

SEQ ID NO: 4577755 - DNA, 19 bp, Homo sapiens
taggcagggggccctgccc

SEQ ID NO: 4577756 - DNA, 14 bp, Homo sapiens
taggcatgtaaaca

SEQ ID NO: 4577757 - DNA, 18 bp, Homo sapiens
taggcattttaagtaaaa

SEQ ID NO: 4577758 - DNA, 14 bp, Homo sapiens
taggccactcctcc

SEQ ID NO: 4577759 - DNA, 22 bp, Homo sapiens
taggcctcaactcctcccatag

SEQ ID NO: 4577760 - DNA, 21 bp, Homo sapiens
taggcctgtcccttgcctctg

SEQ ID NO: 4577761 - DNA, 21 bp, Homo sapiens
taggctgcaaaattaaatcta

SEQ ID NO: 4577762 - DNA, 19 bp, Homo sapiens
taggctgtaactactttat

SEQ ID NO: 4577763 - DNA, 16 bp, Homo sapiens
taggcttaaacctgga

SEQ ID NO: 4577764 - DNA, 13 bp, Homo sapiens
taggcttctatta

SEQ ID NO: 4577765 - DNA, 15 bp, Homo sapiens
taggcttctattacc

SEQ ID NO: 4577766 - DNA, 17 bp, Homo sapiens
taggcttctattaccta

SEQ ID NO: 4577767 - DNA, 15 bp, Homo sapiens
tagggattcaggctg

SEQ ID NO: 4577768 - DNA, 23 bp, Homo sapiens
tagggccaagcccagcactgctt

SEQ ID NO: 4577769 - DNA, 14 bp, Homo sapiens
tagggctaaatgtt

SEQ ID NO: 4577770 - DNA, 19 bp, Homo sapiens
tagggggatataatacata

SEQ ID NO: 4577771 - DNA, 15 bp, Homo sapiens
tagggggctttctgg

SEQ ID NO: 4577772 - DNA, 16 bp, Homo sapiens
tagggtcttgggggtc

SEQ ID NO: 4577773 - DNA, 18 bp, Homo sapiens
tagggttctaaatgcaat

SEQ ID NO: 4577774 - DNA, 14 bp, Homo sapiens
tagggttctgcctc

SEQ ID NO: 4577775 - DNA, 15 bp, Homo sapiens
tagggttctgcctct

SEQ ID NO: 4577776 - DNA, 13 bp, Homo sapiens
tagggttctgctt

SEQ ID NO: 4577777 - DNA, 19 bp, Homo sapiens
tagggttctgcttttaagt

SEQ ID NO: 4577778 - DNA, 21 bp, Homo sapiens
taggtaaaatgtatttttcta

SEQ ID NO: 4577779 - DNA, 23 bp, Homo sapiens
taggtaaatttttaggcaaagat

SEQ ID NO: 4577780 - DNA, 16 bp, Homo sapiens
taggtaaggttttcaa

SEQ ID NO: 4577781 - DNA, 18 bp, Homo sapiens
taggtaccatttgtgtct

SEQ ID NO: 4577782 - DNA, 18 bp, Homo sapiens
taggtagaaaaagggtca

SEQ ID NO: 4577783 - DNA, 22 bp, Homo sapiens
taggtatgatctcttctggtgt

SEQ ID NO: 4577784 - DNA, 18 bp, Homo sapiens
taggtattacaagtaatg

SEQ ID NO: 4577785 - DNA, 16 bp, Homo sapiens
taggtcaaactcccta

SEQ ID NO: 4577786 - DNA, 22 bp, Homo sapiens
taggtcaataacactgtatttt

SEQ ID NO: 4577787 - DNA, 20 bp, Homo sapiens
taggtcattgcacctatctc

SEQ ID NO: 4577788 - DNA, 19 bp, Homo sapiens
taggtcgttttccaaagag

SEQ ID NO: 4577789 - DNA, 15 bp, Homo sapiens
taggtctttctctca

SEQ ID NO: 4577790 - DNA, 19 bp, Homo sapiens
taggtctttctctcagtga

SEQ ID NO: 4577791 - DNA, 16 bp, Homo sapiens
taggtggatcacctga

SEQ ID NO: 4577792 - DNA, 20 bp, Homo sapiens
taggtggctctgggaatggg

SEQ ID NO: 4577793 - DNA, 13 bp, Homo sapiens
taggtgtccccaa

SEQ ID NO: 4577794 - DNA, 22 bp, Homo sapiens
taggtgtctgccttcacaaatg

SEQ ID NO: 4577795 - DNA, 13 bp, Homo sapiens
taggttaaagcta

SEQ ID NO: 4577796 - DNA, 12 bp, Homo sapiens
taggttcttctt

SEQ ID NO: 4577797 - DNA, 15 bp, Homo sapiens
taggtttgtaaaatg

SEQ ID NO: 4577798 - DNA, 13 bp, Homo sapiens
taggttttacctt

SEQ ID NO: 4577799 - DNA, 22 bp, Homo sapiens
tagtaaactaaagtatggtaca

SEQ ID NO: 4577800 - DNA, 15 bp, Homo sapiens
tagtaaactattctt

SEQ ID NO: 4577801 - DNA, 22 bp, Homo sapiens
tagtaacactaatatatttaaa

SEQ ID NO: 4577802 - DNA, 16 bp, Homo sapiens
tagtaagatttggaga

SEQ ID NO: 4577803 - DNA, 17 bp, Homo sapiens
tagtaagtatttccata

SEQ ID NO: 4577804 - DNA, 16 bp, Homo sapiens
tagtaagttaatgtat

SEQ ID NO: 4577805 - DNA, 17 bp, Homo sapiens
tagtaatctgcattatt

SEQ ID NO: 4577806 - DNA, 14 bp, Homo sapiens
tagtaatctgtata

SEQ ID NO: 4577807 - DNA, 21 bp, Homo sapiens
tagtaatttattgtctgtcta

SEQ ID NO: 4577808 - DNA, 14 bp, Homo sapiens
tagtaatttctttt

SEQ ID NO: 4577809 - DNA, 20 bp, Homo sapiens
tagtaatttctttttttcct

SEQ ID NO: 4577810 - DNA, 15 bp, Homo sapiens
tagtacaatttcaac

SEQ ID NO: 4577811 - DNA, 20 bp, Homo sapiens
tagtactattgctattacta

SEQ ID NO: 4577812 - DNA, 16 bp, Homo sapiens
tagtacttcttctgta

SEQ ID NO: 4577813 - DNA, 18 bp, Homo sapiens
tagtacttcttctgtaat

SEQ ID NO: 4577814 - DNA, 22 bp, Homo sapiens
tagtagaaagacatctgcctgt

SEQ ID NO: 4577815 - DNA, 15 bp, Homo sapiens
tagtagacacactat

SEQ ID NO: 4577816 - DNA, 19 bp, Homo sapiens
tagtagcgttttttaaatg

SEQ ID NO: 4577817 - DNA, 21 bp, Homo sapiens
tagtagcgttttttaaatgta

SEQ ID NO: 4577818 - DNA, 15 bp, Homo sapiens
tagtaggaatgtaca

SEQ ID NO: 4577819 - DNA, 13 bp, Homo sapiens
tagtagttagaaa

SEQ ID NO: 4577820 - DNA, 19 bp, Homo sapiens
tagtataaatgtacatcag

SEQ ID NO: 4577821 - DNA, 16 bp, Homo sapiens
tagtatagtagaaaga

SEQ ID NO: 4577822 - DNA, 23 bp, Homo sapiens
tagtatagtagaaagacatctgc

SEQ ID NO: 4577823 - DNA, 14 bp, Homo sapiens
tagtattaactatt

SEQ ID NO: 4577824 - DNA, 22 bp, Homo sapiens
tagtattaccaccctttcacaa

SEQ ID NO: 4577825 - DNA, 23 bp, Homo sapiens
tagtattatcttgttcaggaaaa

SEQ ID NO: 4577826 - DNA, 19 bp, Homo sapiens
tagtattcaggcactgaga

SEQ ID NO: 4577827 - DNA, 18 bp, Homo sapiens
tagtattcctcattctgc

SEQ ID NO: 4577828 - DNA, 21 bp, Homo sapiens
tagtatttctcctttgcaata

SEQ ID NO: 4577829 - DNA, 20 bp, Homo sapiens
tagtatttgattcaaaatat

SEQ ID NO: 4577830 - DNA, 23 bp, Homo sapiens
tagtatttgattcaaaatattta

SEQ ID NO: 4577831 - DNA, 15 bp, Homo sapiens
tagtatttttatcca

SEQ ID NO: 4577832 - DNA, 15 bp, Homo sapiens
tagtcaccagagact

SEQ ID NO: 4577833 - DNA, 19 bp, Homo sapiens
tagtcagactgacactact

SEQ ID NO: 4577834 - DNA, 18 bp, Homo sapiens
tagtcattaacccatctc

SEQ ID NO: 4577835 - DNA, 21 bp, Homo sapiens
tagtcatttaggatccatgca

SEQ ID NO: 4577836 - DNA, 15 bp, Homo sapiens
tagtcccttcccctc

SEQ ID NO: 4577837 - DNA, 16 bp, Homo sapiens
tagtcccttcccctcc

SEQ ID NO: 4577838 - DNA, 22 bp, Homo sapiens
tagtcccttcccctccctggct

SEQ ID NO: 4577839 - DNA, 22 bp, Homo sapiens
tagtcctttttccaatgtttta

SEQ ID NO: 4577840 - DNA, 14 bp, Homo sapiens
tagtctgaaactgg

SEQ ID NO: 4577841 - DNA, 21 bp, Homo sapiens
tagtctgaagtgaagtacaga

SEQ ID NO: 4577842 - DNA, 18 bp, Homo sapiens
tagtctgtgtgaaggtga

SEQ ID NO: 4577843 - DNA, 21 bp, Homo sapiens
tagtcttgaaatgaaagggaa

SEQ ID NO: 4577844 - DNA, 22 bp, Homo sapiens
tagtcttgaaatgaaagggaaa

SEQ ID NO: 4577845 - DNA, 22 bp, Homo sapiens
tagtcttgtcccaattaaaata

SEQ ID NO: 4577846 - DNA, 18 bp, Homo sapiens
tagtctttagctattact

SEQ ID NO: 4577847 - DNA, 19 bp, Homo sapiens
tagtgaaacatgtactttg

SEQ ID NO: 4577848 - DNA, 18 bp, Homo sapiens
tagtgaaccaaaaataga

SEQ ID NO: 4577849 - DNA, 23 bp, Homo sapiens
tagtgaaccaaaaatagaaatta

SEQ ID NO: 4577850 - DNA, 21 bp, Homo sapiens
tagtgaaggcttctctctgtg

SEQ ID NO: 4577851 - DNA, 21 bp, Homo sapiens
tagtgaatcacgtaaagctag

SEQ ID NO: 4577852 - DNA, 17 bp, Homo sapiens
tagtgacctgtgtttca

SEQ ID NO: 4577853 - DNA, 13 bp, Homo sapiens
tagtgagacactg

SEQ ID NO: 4577854 - DNA, 18 bp, Homo sapiens
tagtgagttgcatgtttt

SEQ ID NO: 4577855 - DNA, 20 bp, Homo sapiens
tagtgatttttatgccacct

SEQ ID NO: 4577856 - DNA, 21 bp, Homo sapiens
tagtgatttttatgccacctg

SEQ ID NO: 4577857 - DNA, 21 bp, Homo sapiens
tagtgcaattccaagaaaata

SEQ ID NO: 4577858 - DNA, 16 bp, Homo sapiens
tagtgccaaataattg

SEQ ID NO: 4577859 - DNA, 23 bp, Homo sapiens
tagtgccaggtggctcagtgcca

SEQ ID NO: 4577860 - DNA, 18 bp, Homo sapiens
tagtgctgcaataaacat

SEQ ID NO: 4577861 - DNA, 18 bp, Homo sapiens
tagtgctggtcagagaga

SEQ ID NO: 4577862 - DNA, 13 bp, Homo sapiens
tagtggccactgg

SEQ ID NO: 4577863 - DNA, 23 bp, Homo sapiens
tagtggccactggggtgccttca

SEQ ID NO: 4577864 - DNA, 20 bp, Homo sapiens
tagtgggccctctctctggg

SEQ ID NO: 4577865 - DNA, 18 bp, Homo sapiens
tagtggttaacagagcta

SEQ ID NO: 4577866 - DNA, 23 bp, Homo sapiens
tagtgtaacttgcttaaatttct

SEQ ID NO: 4577867 - DNA, 23 bp, Homo sapiens
tagtgtaccaagtgcttcctaca

SEQ ID NO: 4577868 - DNA, 20 bp, Homo sapiens
tagtgtacctattaaaagtt

SEQ ID NO: 4577869 - DNA, 18 bp, Homo sapiens
tagtgtattaatcataga

SEQ ID NO: 4577870 - DNA, 20 bp, Homo sapiens
tagtgtcaacttttaacttt

SEQ ID NO: 4577871 - DNA, 14 bp, Homo sapiens
tagtgtcctatgca

SEQ ID NO: 4577872 - DNA, 11 bp, Homo sapiens
tagtgtgaaat

SEQ ID NO: 4577873 - DNA, 19 bp, Homo sapiens
tagtgtgaatattccttta

SEQ ID NO: 4577874 - DNA, 13 bp, Homo sapiens
tagtgtgtaaaat

SEQ ID NO: 4577875 - DNA, 17 bp, Homo sapiens
tagtgtgtaaaattaat

SEQ ID NO: 4577876 - DNA, 18 bp, Homo sapiens
tagtgtgtcctgtgtaaa

SEQ ID NO: 4577877 - DNA, 19 bp, Homo sapiens
tagtgttcaaaacaaaatg

SEQ ID NO: 4577878 - DNA, 13 bp, Homo sapiens
tagtgttcacaaa

SEQ ID NO: 4577879 - DNA, 14 bp, Homo sapiens
tagtgttcacaaac

SEQ ID NO: 4577880 - DNA, 18 bp, Homo sapiens
tagtgttcacaaactgtg

SEQ ID NO: 4577881 - DNA, 19 bp, Homo sapiens
tagtgttcacaaactgtga

SEQ ID NO: 4577882 - DNA, 20 bp, Homo sapiens
tagtgttcacaaactgtgaa

SEQ ID NO: 4577883 - DNA, 13 bp, Homo sapiens
tagtgtttaagtc

SEQ ID NO: 4577884 - DNA, 18 bp, Homo sapiens
tagttaaaaattaaatat

SEQ ID NO: 4577885 - DNA, 19 bp, Homo sapiens
tagttaaaaattaaatatt

SEQ ID NO: 4577886 - DNA, 20 bp, Homo sapiens
tagttaaaactcatcacata

SEQ ID NO: 4577887 - DNA, 22 bp, Homo sapiens
tagttaaaactcatcacataaa

SEQ ID NO: 4577888 - DNA, 17 bp, Homo sapiens
tagttaatataaatgtt

SEQ ID NO: 4577889 - DNA, 19 bp, Homo sapiens
tagttaccttatagttact

SEQ ID NO: 4577890 - DNA, 15 bp, Homo sapiens
tagttacgtataatg

SEQ ID NO: 4577891 - DNA, 22 bp, Homo sapiens
tagttacgtataatgctttctg

SEQ ID NO: 4577892 - DNA, 14 bp, Homo sapiens
tagttactaaaatt

SEQ ID NO: 4577893 - DNA, 17 bp, Homo sapiens
tagttactaaaattatg

SEQ ID NO: 4577894 - DNA, 17 bp, Homo sapiens
tagttactgtgtaatta

SEQ ID NO: 4577895 - DNA, 16 bp, Homo sapiens
tagttagcatccaggc

SEQ ID NO: 4577896 - DNA, 20 bp, Homo sapiens
tagttagccatctaatgctt

SEQ ID NO: 4577897 - DNA, 16 bp, Homo sapiens
tagttataaaaggctt

SEQ ID NO: 4577898 - DNA, 18 bp, Homo sapiens
tagttataaaaggcttta

SEQ ID NO: 4577899 - DNA, 17 bp, Homo sapiens
tagttattaaatgtttc

SEQ ID NO: 4577900 - DNA, 15 bp, Homo sapiens
tagttattttatagg

SEQ ID NO: 4577901 - DNA, 16 bp, Homo sapiens
tagttatttttctctt

SEQ ID NO: 4577902 - DNA, 16 bp, Homo sapiens
tagttcaatttcatgt

SEQ ID NO: 4577903 - DNA, 21 bp, Homo sapiens
tagttccagaaaacctctcct

SEQ ID NO: 4577904 - DNA, 21 bp, Homo sapiens
tagttccccaaatacaaagtt

SEQ ID NO: 4577905 - DNA, 23 bp, Homo sapiens
tagttccctgaaaacccagagag

SEQ ID NO: 4577906 - DNA, 11 bp, Homo sapiens
tagttctagat

SEQ ID NO: 4577907 - DNA, 12 bp, Homo sapiens
tagttctagatg

SEQ ID NO: 4577908 - DNA, 19 bp, Homo sapiens
tagttctgtaataaaactg

SEQ ID NO: 4577909 - DNA, 21 bp, Homo sapiens
tagttctgtaataaaactgtt

SEQ ID NO: 4577910 - DNA, 15 bp, Homo sapiens
tagttctgtgcctcc

SEQ ID NO: 4577911 - DNA, 22 bp, Homo sapiens
tagttctttcctccccctgcaa

SEQ ID NO: 4577912 - DNA, 22 bp, Homo sapiens
tagttgcaaagagacatttcaa

SEQ ID NO: 4577913 - DNA, 20 bp, Homo sapiens
tagttgcatagcagtatatg

SEQ ID NO: 4577914 - DNA, 18 bp, Homo sapiens
tagttggcagaaatacag

SEQ ID NO: 4577915 - DNA, 16 bp, Homo sapiens
tagttgggtagaaaaa

SEQ ID NO: 4577916 - DNA, 21 bp, Homo sapiens
tagttgtaccgcaatgtgact

SEQ ID NO: 4577917 - DNA, 20 bp, Homo sapiens
tagttgttggtctgtagcaa

SEQ ID NO: 4577918 - DNA, 21 bp, Homo sapiens
tagtttatacagttttaaaga

SEQ ID NO: 4577919 - DNA, 12 bp, Homo sapiens
tagtttatttct

SEQ ID NO: 4577920 - DNA, 21 bp, Homo sapiens
tagtttcagtagattgcagaa

SEQ ID NO: 4577921 - DNA, 20 bp, Homo sapiens
tagtttgaaagttgtacatg

SEQ ID NO: 4577922 - DNA, 22 bp, Homo sapiens
tagtttgcctgcagtttcttgt

SEQ ID NO: 4577923 - DNA, 21 bp, Homo sapiens
tagtttgctcatactacattg

SEQ ID NO: 4577924 - DNA, 12 bp, Homo sapiens
tagtttgctttg

SEQ ID NO: 4577925 - DNA, 16 bp, Homo sapiens
tagtttgctttgcttt

SEQ ID NO: 4577926 - DNA, 17 bp, Homo sapiens
tagtttggaaataaaaa

SEQ ID NO: 4577927 - DNA, 21 bp, Homo sapiens
tagtttggctataagtgctca

SEQ ID NO: 4577928 - DNA, 19 bp, Homo sapiens
tagtttgttaaagcctgtt

SEQ ID NO: 4577929 - DNA, 22 bp, Homo sapiens
tagttttacactaggaaacgtg

SEQ ID NO: 4577930 - DNA, 12 bp, Homo sapiens
tagttttacatt

SEQ ID NO: 4577931 - DNA, 14 bp, Homo sapiens
tagttttactttta

SEQ ID NO: 4577932 - DNA, 20 bp, Homo sapiens
tagttttacttttaaactgt

SEQ ID NO: 4577933 - DNA, 22 bp, Homo sapiens
tagttttacttttaaactgtgt

SEQ ID NO: 4577934 - DNA, 21 bp, Homo sapiens
tagttttattttatgtttaga

SEQ ID NO: 4577935 - DNA, 12 bp, Homo sapiens
tagttttcttcc

SEQ ID NO: 4577936 - DNA, 13 bp, Homo sapiens
tagttttgtcaaa

SEQ ID NO: 4577937 - DNA, 22 bp, Homo sapiens
tagtttttaattaaaaacttta

SEQ ID NO: 4577938 - DNA, 19 bp, Homo sapiens
tagtttttggaaaaacctt

SEQ ID NO: 4577939 - DNA, 17 bp, Homo sapiens
tataaaaaatatgtatt

SEQ ID NO: 4577940 - DNA, 13 bp, Homo sapiens
tataaaaaattaa

SEQ ID NO: 4577941 - DNA, 19 bp, Homo sapiens
tataaaaaattaacttagt

SEQ ID NO: 4577942 - DNA, 18 bp, Homo sapiens
tataaaaagcttccatga

SEQ ID NO: 4577943 - DNA, 14 bp, Homo sapiens
tataaaacagtcat

SEQ ID NO: 4577944 - DNA, 17 bp, Homo sapiens
tataaaacttaaaaaca

SEQ ID NO: 4577945 - DNA, 12 bp, Homo sapiens
tataaaataact

SEQ ID NO: 4577946 - DNA, 15 bp, Homo sapiens
tataaacctgacctc

SEQ ID NO: 4577947 - DNA, 18 bp, Homo sapiens
tataaactgtattttgaa

SEQ ID NO: 4577948 - DNA, 17 bp, Homo sapiens
tataaacttaagggcaa

SEQ ID NO: 4577949 - DNA, 21 bp, Homo sapiens
tataaagctgttcttgaaagc

SEQ ID NO: 4577950 - DNA, 12 bp, Homo sapiens
tataaagggtca

SEQ ID NO: 4577951 - DNA, 14 bp, Homo sapiens
tataaagggtcagg

SEQ ID NO: 4577952 - DNA, 18 bp, Homo sapiens
tataaagtatagagagaa

SEQ ID NO: 4577953 - DNA, 14 bp, Homo sapiens
tataaagtattctt

SEQ ID NO: 4577954 - DNA, 20 bp, Homo sapiens
tataaatatatataaagaat

SEQ ID NO: 4577955 - DNA, 15 bp, Homo sapiens
tataaatatcagtat

SEQ ID NO: 4577956 - DNA, 16 bp, Homo sapiens
tataaatatcagtatt

SEQ ID NO: 4577957 - DNA, 23 bp, Homo sapiens
tataaatcaacaccttaatatgc

SEQ ID NO: 4577958 - DNA, 17 bp, Homo sapiens
tataaatgatatcaaag

SEQ ID NO: 4577959 - DNA, 19 bp, Homo sapiens
tataaatgtaaaaatgaag

SEQ ID NO: 4577960 - DNA, 12 bp, Homo sapiens
tataaatgtgtg

SEQ ID NO: 4577961 - DNA, 11 bp, Homo sapiens
tataaattaaa

SEQ ID NO: 4577962 - DNA, 19 bp, Homo sapiens
tataaattaaatatatgta

SEQ ID NO: 4577963 - DNA, 15 bp, Homo sapiens
tataaattaatttgt

SEQ ID NO: 4577964 - DNA, 12 bp, Homo sapiens
tataaattactt

SEQ ID NO: 4577965 - DNA, 13 bp, Homo sapiens
tataaattcactt

SEQ ID NO: 4577966 - DNA, 14 bp, Homo sapiens
tataaattgtacat

SEQ ID NO: 4577967 - DNA, 16 bp, Homo sapiens
tataaatttaagaaaa

SEQ ID NO: 4577968 - DNA, 20 bp, Homo sapiens
tataaatttcgcttcttaga

SEQ ID NO: 4577969 - DNA, 14 bp, Homo sapiens
tataacaactattt

SEQ ID NO: 4577970 - DNA, 18 bp, Homo sapiens
tataacagatgtgaaaat

SEQ ID NO: 4577971 - DNA, 23 bp, Homo sapiens
tataacagttttgagtaattcaa

SEQ ID NO: 4577972 - DNA, 16 bp, Homo sapiens
tataacataaagaata

SEQ ID NO: 4577973 - DNA, 13 bp, Homo sapiens
tataacattatat

SEQ ID NO: 4577974 - DNA, 17 bp, Homo sapiens
tataacctagttaaaga

SEQ ID NO: 4577975 - DNA, 22 bp, Homo sapiens
tataacctagttaaagaaagga

SEQ ID NO: 4577976 - DNA, 14 bp, Homo sapiens
tataactaacatgt

SEQ ID NO: 4577977 - DNA, 15 bp, Homo sapiens
tataactcatttgtt

SEQ ID NO: 4577978 - DNA, 16 bp, Homo sapiens
tataactgaaggagaa

SEQ ID NO: 4577979 - DNA, 13 bp, Homo sapiens
tataactgtattt

SEQ ID NO: 4577980 - DNA, 12 bp, Homo sapiens
tataactgtctt

SEQ ID NO: 4577981 - DNA, 15 bp, Homo sapiens
tataactgtcttgtt

SEQ ID NO: 4577982 - DNA, 13 bp, Homo sapiens
tataactgtttta

SEQ ID NO: 4577983 - DNA, 14 bp, Homo sapiens
tataactgttttag

SEQ ID NO: 4577984 - DNA, 20 bp, Homo sapiens
tataactgttttagaaattg

SEQ ID NO: 4577985 - DNA, 21 bp, Homo sapiens
tataactgttttagaaattgg

SEQ ID NO: 4577986 - DNA, 18 bp, Homo sapiens
tataacttgtaagtctga

SEQ ID NO: 4577987 - DNA, 21 bp, Homo sapiens
tataagaaaagtaatgaagaa

SEQ ID NO: 4577988 - DNA, 16 bp, Homo sapiens
tataagaagcaatctt

SEQ ID NO: 4577989 - DNA, 21 bp, Homo sapiens
tataagaagcaatctttgaaa

SEQ ID NO: 4577990 - DNA, 14 bp, Homo sapiens
tataagactgctgc

SEQ ID NO: 4577991 - DNA, 16 bp, Homo sapiens
tataagactgctgcag

SEQ ID NO: 4577992 - DNA, 19 bp, Homo sapiens
tataagagggctttttaaa

SEQ ID NO: 4577993 - DNA, 19 bp, Homo sapiens
tataagcagattgctttaa

SEQ ID NO: 4577994 - DNA, 21 bp, Homo sapiens
tataagcccttaataataatg

SEQ ID NO: 4577995 - DNA, 15 bp, Homo sapiens
tataagcttaaatag

SEQ ID NO: 4577996 - DNA, 22 bp, Homo sapiens
tataaggaaagcaataaatgaa

SEQ ID NO: 4577997 - DNA, 23 bp, Homo sapiens
tataaggaaagcaataaatgaat

SEQ ID NO: 4577998 - DNA, 16 bp, Homo sapiens
tataaggggaaagata

SEQ ID NO: 4577999 - DNA, 22 bp, Homo sapiens
tataataaatactcagtgatga

SEQ ID NO: 4578000 - DNA, 12 bp, Homo sapiens
tataatactgtt

SEQ ID NO: 4578001 - DNA, 23 bp, Homo sapiens
tataatactgttttaaaatgtga

SEQ ID NO: 4578002 - DNA, 19 bp, Homo sapiens
tataatactttgtatacaa

SEQ ID NO: 4578003 - DNA, 20 bp, Homo sapiens
tataatatctaaagttatat

SEQ ID NO: 4578004 - DNA, 17 bp, Homo sapiens
tataatcaaatgatttc

SEQ ID NO: 4578005 - DNA, 19 bp, Homo sapiens
tataatcaaatgatttcat

SEQ ID NO: 4578006 - DNA, 18 bp, Homo sapiens
tataatcatgctcatgta

SEQ ID NO: 4578007 - DNA, 20 bp, Homo sapiens
tataatcatgctcatgtata

SEQ ID NO: 4578008 - DNA, 23 bp, Homo sapiens
tataatcatgctcatgtatattt

SEQ ID NO: 4578009 - DNA, 22 bp, Homo sapiens
tataatccttgataatatattg

SEQ ID NO: 4578010 - DNA, 18 bp, Homo sapiens
tataatctatttacataa

SEQ ID NO: 4578011 - DNA, 19 bp, Homo sapiens
tataatctcctctgctcat

SEQ ID NO: 4578012 - DNA, 16 bp, Homo sapiens
tataatcttataattg

SEQ ID NO: 4578013 - DNA, 19 bp, Homo sapiens
tataatgacttttaaaatt

SEQ ID NO: 4578014 - DNA, 23 bp, Homo sapiens
tataatgacttttaaaatttgta

SEQ ID NO: 4578015 - DNA, 16 bp, Homo sapiens
tataatgctttctgag

SEQ ID NO: 4578016 - DNA, 22 bp, Homo sapiens
tataatgtatttgaaaattaca

SEQ ID NO: 4578017 - DNA, 18 bp, Homo sapiens
tataatgtttattaaatg

SEQ ID NO: 4578018 - DNA, 15 bp, Homo sapiens
tataattctcattaa

SEQ ID NO: 4578019 - DNA, 23 bp, Homo sapiens
tataattgaattggtttttccca

SEQ ID NO: 4578020 - DNA, 19 bp, Homo sapiens
tataattggatttcctaat

SEQ ID NO: 4578021 - DNA, 22 bp, Homo sapiens
tataattggatttcctaatact

SEQ ID NO: 4578022 - DNA, 15 bp, Homo sapiens
tataatttaatgtaa

SEQ ID NO: 4578023 - DNA, 17 bp, Homo sapiens
tataatttaatgtaaat

SEQ ID NO: 4578024 - DNA, 14 bp, Homo sapiens
tataatttacctaa

SEQ ID NO: 4578025 - DNA, 18 bp, Homo sapiens
tataatttacctaagatt

SEQ ID NO: 4578026 - DNA, 20 bp, Homo sapiens
tataatttactttgtagact

SEQ ID NO: 4578027 - DNA, 19 bp, Homo sapiens
tataatttatttccactaa

SEQ ID NO: 4578028 - DNA, 17 bp, Homo sapiens
tatacaagcaagcaaaa

SEQ ID NO: 4578029 - DNA, 16 bp, Homo sapiens
tatacaagtactggta

SEQ ID NO: 4578030 - DNA, 19 bp, Homo sapiens
tatacaggaggatgtgaat

SEQ ID NO: 4578031 - DNA, 16 bp, Homo sapiens
tatacagttataaaat

SEQ ID NO: 4578032 - DNA, 15 bp, Homo sapiens
tatacagttgtataa

SEQ ID NO: 4578033 - DNA, 11 bp, Homo sapiens
tatacagtttg

SEQ ID NO: 4578034 - DNA, 13 bp, Homo sapiens
tatacatacatgt

SEQ ID NO: 4578035 - DNA, 18 bp, Homo sapiens
tatacatacatgtatctg

SEQ ID NO: 4578036 - DNA, 19 bp, Homo sapiens
tatacatatgagaatatac

SEQ ID NO: 4578037 - DNA, 11 bp, Homo sapiens
tatacatgttg

SEQ ID NO: 4578038 - DNA, 21 bp, Homo sapiens
tatacatttggttatgttgat

SEQ ID NO: 4578039 - DNA, 22 bp, Homo sapiens
tataccaatgtgttttctgtag

SEQ ID NO: 4578040 - DNA, 16 bp, Homo sapiens
tataccccaaattgtg

SEQ ID NO: 4578041 - DNA, 22 bp, Homo sapiens
tataccccaaattgtgtatata

SEQ ID NO: 4578042 - DNA, 20 bp, Homo sapiens
tatacccgggaccaaactca

SEQ ID NO: 4578043 - DNA, 18 bp, Homo sapiens
tatacctgccttttaagt

SEQ ID NO: 4578044 - DNA, 20 bp, Homo sapiens
tatacgcagcgtgctttaaa

SEQ ID NO: 4578045 - DNA, 15 bp, Homo sapiens
tatacgtataaatat

SEQ ID NO: 4578046 - DNA, 22 bp, Homo sapiens
tatacgtatgcatttttttagt

SEQ ID NO: 4578047 - DNA, 19 bp, Homo sapiens
tatactaaaccaactctaa

SEQ ID NO: 4578048 - DNA, 16 bp, Homo sapiens
tatactcattagaatt

SEQ ID NO: 4578049 - DNA, 22 bp, Homo sapiens
tatactcattagaattaccatt

SEQ ID NO: 4578050 - DNA, 18 bp, Homo sapiens
tatactctagatgaagtt

SEQ ID NO: 4578051 - DNA, 23 bp, Homo sapiens
tatactcttgaattcctctcaaa

SEQ ID NO: 4578052 - DNA, 16 bp, Homo sapiens
tatactctttctgtat

SEQ ID NO: 4578053 - DNA, 16 bp, Homo sapiens
tatactgaaccaggcc

SEQ ID NO: 4578054 - DNA, 13 bp, Homo sapiens
tatactgtacaat

SEQ ID NO: 4578055 - DNA, 22 bp, Homo sapiens
tatactgtacaataaaaacatt

SEQ ID NO: 4578056 - DNA, 14 bp, Homo sapiens
tatactgtgtgtga

SEQ ID NO: 4578057 - DNA, 21 bp, Homo sapiens
tatacttaaaaaatcctgccc

SEQ ID NO: 4578058 - DNA, 16 bp, Homo sapiens
tatacttgaatgaaaa

SEQ ID NO: 4578059 - DNA, 15 bp, Homo sapiens
tatacttgactctaa

SEQ ID NO: 4578060 - DNA, 16 bp, Homo sapiens
tatactttaaataatt

SEQ ID NO: 4578061 - DNA, 21 bp, Homo sapiens
tatactttaaataatttaact

SEQ ID NO: 4578062 - DNA, 12 bp, Homo sapiens
tatactttagta

SEQ ID NO: 4578063 - DNA, 12 bp, Homo sapiens
tatactttatat

SEQ ID NO: 4578064 - DNA, 15 bp, Homo sapiens
tatactttatatctg

SEQ ID NO: 4578065 - DNA, 19 bp, Homo sapiens
tatactttatatctgtaat

SEQ ID NO: 4578066 - DNA, 20 bp, Homo sapiens
tatactttatatctgtaatg

SEQ ID NO: 4578067 - DNA, 14 bp, Homo sapiens
tatactttgtggac

SEQ ID NO: 4578068 - DNA, 20 bp, Homo sapiens
tatactttgtggaccaatta

SEQ ID NO: 4578069 - DNA, 13 bp, Homo sapiens
tatactttttcat

SEQ ID NO: 4578070 - DNA, 15 bp, Homo sapiens
tatactttttcatga

SEQ ID NO: 4578071 - DNA, 11 bp, Homo sapiens
tatactttttt

SEQ ID NO: 4578072 - DNA, 20 bp, Homo sapiens
tatactttttttgttataga

SEQ ID NO: 4578073 - DNA, 22 bp, Homo sapiens
tatactttttttgttatagatt

SEQ ID NO: 4578074 - DNA, 23 bp, Homo sapiens
tatagaaaaataaaaatctcttt

SEQ ID NO: 4578075 - DNA, 11 bp, Homo sapiens
tatagaaatgc

SEQ ID NO: 4578076 - DNA, 17 bp, Homo sapiens
tatagaactgaatgaga

SEQ ID NO: 4578077 - DNA, 16 bp, Homo sapiens
tatagaagcttcagca

SEQ ID NO: 4578078 - DNA, 16 bp, Homo sapiens
tatagaatttcctgta

SEQ ID NO: 4578079 - DNA, 21 bp, Homo sapiens
tatagagatatttttgtacgt

SEQ ID NO: 4578080 - DNA, 14 bp, Homo sapiens
tatagattttatta

SEQ ID NO: 4578081 - DNA, 20 bp, Homo sapiens
tatagcaaaaatgttttcca

SEQ ID NO: 4578082 - DNA, 14 bp, Homo sapiens
tatagccatgattt

SEQ ID NO: 4578083 - DNA, 22 bp, Homo sapiens
tatagctgcttccagtgtagac

SEQ ID NO: 4578084 - DNA, 15 bp, Homo sapiens
tatagcttaaaacac

SEQ ID NO: 4578085 - DNA, 17 bp, Homo sapiens
tatagcttccagattac

SEQ ID NO: 4578086 - DNA, 12 bp, Homo sapiens
tataggaaaaaa

SEQ ID NO: 4578087 - DNA, 22 bp, Homo sapiens
tataggaaaaaaactgggataa

SEQ ID NO: 4578088 - DNA, 19 bp, Homo sapiens
tataggaatagaggaagaa

SEQ ID NO: 4578089 - DNA, 21 bp, Homo sapiens
tataggcagctgtcctgtgat

SEQ ID NO: 4578090 - DNA, 21 bp, Homo sapiens
tataggtgctacaaaaacaca

SEQ ID NO: 4578091 - DNA, 13 bp, Homo sapiens
tatagtagaaaga

SEQ ID NO: 4578092 - DNA, 21 bp, Homo sapiens
tatagtagaaagacatctgcc

SEQ ID NO: 4578093 - DNA, 19 bp, Homo sapiens
tatagtatttgattcaaaa

SEQ ID NO: 4578094 - DNA, 17 bp, Homo sapiens
tatagtgaagtgttaat

SEQ ID NO: 4578095 - DNA, 13 bp, Homo sapiens
tatagtgatgtaa

SEQ ID NO: 4578096 - DNA, 16 bp, Homo sapiens
tatagtgtgttgtgct

SEQ ID NO: 4578097 - DNA, 16 bp, Homo sapiens
tatagtgttcacaaac

SEQ ID NO: 4578098 - DNA, 17 bp, Homo sapiens
tatagtgttcacaaact

SEQ ID NO: 4578099 - DNA, 18 bp, Homo sapiens
tatagtgttcacaaactg

SEQ ID NO: 4578100 - DNA, 20 bp, Homo sapiens
tatagtgttcacaaactgtg

SEQ ID NO: 4578101 - DNA, 16 bp, Homo sapiens
tatagttactgtgtaa

SEQ ID NO: 4578102 - DNA, 18 bp, Homo sapiens
tatagttactgtgtaatt

SEQ ID NO: 4578103 - DNA, 20 bp, Homo sapiens
tatagttactgtgtaattag

SEQ ID NO: 4578104 - DNA, 22 bp, Homo sapiens
tatagttactgtgtaattagtg

SEQ ID NO: 4578105 - DNA, 13 bp, Homo sapiens
tatagttgctttt

SEQ ID NO: 4578106 - DNA, 21 bp, Homo sapiens
tatataaaacttaaaaacaag

SEQ ID NO: 4578107 - DNA, 13 bp, Homo sapiens
tatataaaataac

SEQ ID NO: 4578108 - DNA, 16 bp, Homo sapiens
tatataaactgtgcca

SEQ ID NO: 4578109 - DNA, 12 bp, Homo sapiens
tatataaagtat

SEQ ID NO: 4578110 - DNA, 16 bp, Homo sapiens
tatataaagtattctt

SEQ ID NO: 4578111 - DNA, 15 bp, Homo sapiens
tatataaattattac

SEQ ID NO: 4578112 - DNA, 14 bp, Homo sapiens
tatataacaaaaaa

SEQ ID NO: 4578113 - DNA, 17 bp, Homo sapiens
tatataatatctaaagt

SEQ ID NO: 4578114 - DNA, 18 bp, Homo sapiens
tatataatttaatgtaaa

SEQ ID NO: 4578115 - DNA, 19 bp, Homo sapiens
tatataatttaatgtaaat

SEQ ID NO: 4578116 - DNA, 14 bp, Homo sapiens
tatataatttactt

SEQ ID NO: 4578117 - DNA, 17 bp, Homo sapiens
tatataatttactttgt

SEQ ID NO: 4578118 - DNA, 20 bp, Homo sapiens
tatatagatgtcagcaatta

SEQ ID NO: 4578119 - DNA, 19 bp, Homo sapiens
tatatagctggcaagaatg

SEQ ID NO: 4578120 - DNA, 19 bp, Homo sapiens
tatatagtgaaaaatgtca

SEQ ID NO: 4578121 - DNA, 15 bp, Homo sapiens
tatatataataaata

SEQ ID NO: 4578122 - DNA, 23 bp, Homo sapiens
tatatataataaatactcagtga

SEQ ID NO: 4578123 - DNA, 15 bp, Homo sapiens
tatatatatataaag

SEQ ID NO: 4578124 - DNA, 14 bp, Homo sapiens
tatatatatatata

SEQ ID NO: 4578125 - DNA, 13 bp, Homo sapiens
tatatatcttata

SEQ ID NO: 4578126 - DNA, 15 bp, Homo sapiens
tatatatggatcaga

SEQ ID NO: 4578127 - DNA, 19 bp, Homo sapiens
tatatatgtgtgccctgga

SEQ ID NO: 4578128 - DNA, 17 bp, Homo sapiens
tatatattatgtgaaga

SEQ ID NO: 4578129 - DNA, 15 bp, Homo sapiens
tatatattgaaagtt

SEQ ID NO: 4578130 - DNA, 15 bp, Homo sapiens
tatatattgtaaaga

SEQ ID NO: 4578131 - DNA, 16 bp, Homo sapiens
tatatattgtattaag

SEQ ID NO: 4578132 - DNA, 17 bp, Homo sapiens
tatatatttacaaggag

SEQ ID NO: 4578133 - DNA, 14 bp, Homo sapiens
tatatatttacaga

SEQ ID NO: 4578134 - DNA, 17 bp, Homo sapiens
tatatatttacagaaga

SEQ ID NO: 4578135 - DNA, 20 bp, Homo sapiens
tatatatttattttattcta

SEQ ID NO: 4578136 - DNA, 13 bp, Homo sapiens
tatatatttctat

SEQ ID NO: 4578137 - DNA, 17 bp, Homo sapiens
tatatatttctattatt

SEQ ID NO: 4578138 - DNA, 13 bp, Homo sapiens
tatatcagcagac

SEQ ID NO: 4578139 - DNA, 15 bp, Homo sapiens
tatatcatacagttt

SEQ ID NO: 4578140 - DNA, 22 bp, Homo sapiens
tatatcatacagttttcattga

SEQ ID NO: 4578141 - DNA, 20 bp, Homo sapiens
tatatcattatctttgctgt

SEQ ID NO: 4578142 - DNA, 23 bp, Homo sapiens
tatatcctctggaaaaggctttc

SEQ ID NO: 4578143 - DNA, 16 bp, Homo sapiens
tatatcgttatcactg

SEQ ID NO: 4578144 - DNA, 17 bp, Homo sapiens
tatatcgttatcactgt

SEQ ID NO: 4578145 - DNA, 14 bp, Homo sapiens
tatatctatctatt

SEQ ID NO: 4578146 - DNA, 14 bp, Homo sapiens
tatatctgagcaag

SEQ ID NO: 4578147 - DNA, 15 bp, Homo sapiens
tatatctgtctttta

SEQ ID NO: 4578148 - DNA, 14 bp, Homo sapiens
tatatcttaagcag

SEQ ID NO: 4578149 - DNA, 18 bp, Homo sapiens
tatatcttcccatttaac

SEQ ID NO: 4578150 - DNA, 18 bp, Homo sapiens
tatatcttgtttacaata

SEQ ID NO: 4578151 - DNA, 19 bp, Homo sapiens
tatatgaccagaagccttg

SEQ ID NO: 4578152 - DNA, 14 bp, Homo sapiens
tatatgagaagaat

SEQ ID NO: 4578153 - DNA, 17 bp, Homo sapiens
tatatgagaagaatagc

SEQ ID NO: 4578154 - DNA, 14 bp, Homo sapiens
tatatgctgtattt

SEQ ID NO: 4578155 - DNA, 23 bp, Homo sapiens
tatatggaggattctttccccag

SEQ ID NO: 4578156 - DNA, 22 bp, Homo sapiens
tatatgggggaaaattattttg

SEQ ID NO: 4578157 - DNA, 20 bp, Homo sapiens
tatatgggtatatattcatc

SEQ ID NO: 4578158 - DNA, 12 bp, Homo sapiens
tatatgtaaatg

SEQ ID NO: 4578159 - DNA, 15 bp, Homo sapiens
tatatgtaaatgtgt

SEQ ID NO: 4578160 - DNA, 19 bp, Homo sapiens
tatatgtaccgtaggcttt

SEQ ID NO: 4578161 - DNA, 16 bp, Homo sapiens
tatatgtatgtaaaaa

SEQ ID NO: 4578162 - DNA, 12 bp, Homo sapiens
tatatgtattta

SEQ ID NO: 4578163 - DNA, 14 bp, Homo sapiens
tatatgtatttaag

SEQ ID NO: 4578164 - DNA, 12 bp, Homo sapiens
tatatgtatttt

SEQ ID NO: 4578165 - DNA, 17 bp, Homo sapiens
tatatgtatttttatat

SEQ ID NO: 4578166 - DNA, 18 bp, Homo sapiens
tatatgtgaaacattttt

SEQ ID NO: 4578167 - DNA, 16 bp, Homo sapiens
tatatgtgttgaaaac

SEQ ID NO: 4578168 - DNA, 22 bp, Homo sapiens
tatattaaacatacataataca

SEQ ID NO: 4578169 - DNA, 23 bp, Homo sapiens
tatattaatagtaatttgtaaag

SEQ ID NO: 4578170 - DNA, 17 bp, Homo sapiens
tatattacaatgatcac

SEQ ID NO: 4578171 - DNA, 22 bp, Homo sapiens
tatattacactacacactgtgt

SEQ ID NO: 4578172 - DNA, 18 bp, Homo sapiens
tatattagttgctttgtt

SEQ ID NO: 4578173 - DNA, 20 bp, Homo sapiens
tatattataaatatatataa

SEQ ID NO: 4578174 - DNA, 14 bp, Homo sapiens
tatattataagttg

SEQ ID NO: 4578175 - DNA, 18 bp, Homo sapiens
tatattataagttgacct

SEQ ID NO: 4578176 - DNA, 16 bp, Homo sapiens
tatattatgtgaagaa

SEQ ID NO: 4578177 - DNA, 12 bp, Homo sapiens
tatattattata

SEQ ID NO: 4578178 - DNA, 20 bp, Homo sapiens
tatattcatctaataaatca

SEQ ID NO: 4578179 - DNA, 20 bp, Homo sapiens
tatattcattctttttgaaa

SEQ ID NO: 4578180 - DNA, 18 bp, Homo sapiens
tatattccaggtttaagt

SEQ ID NO: 4578181 - DNA, 22 bp, Homo sapiens
tatattccaggtttaagtagat

SEQ ID NO: 4578182 - DNA, 16 bp, Homo sapiens
tatattctaatagttt

SEQ ID NO: 4578183 - DNA, 12 bp, Homo sapiens
tatattctaatt

SEQ ID NO: 4578184 - DNA, 17 bp, Homo sapiens
tatattctaattaaaat

SEQ ID NO: 4578185 - DNA, 17 bp, Homo sapiens
tatattgaaagttgctt

SEQ ID NO: 4578186 - DNA, 13 bp, Homo sapiens
tatattgaacttt

SEQ ID NO: 4578187 - DNA, 23 bp, Homo sapiens
tatattgataaattttaaaattg

SEQ ID NO: 4578188 - DNA, 17 bp, Homo sapiens
tatattgcttagtaagt

SEQ ID NO: 4578189 - DNA, 14 bp, Homo sapiens
tatattgcttcctg

SEQ ID NO: 4578190 - DNA, 19 bp, Homo sapiens
tatattgggtgtagatttc

SEQ ID NO: 4578191 - DNA, 22 bp, Homo sapiens
tatattgtcctcccctatttta

SEQ ID NO: 4578192 - DNA, 18 bp, Homo sapiens
tatattgtgtttgtgtat

SEQ ID NO: 4578193 - DNA, 15 bp, Homo sapiens
tatattgttgaagag

SEQ ID NO: 4578194 - DNA, 19 bp, Homo sapiens
tatatttaaaaaattaaaa

SEQ ID NO: 4578195 - DNA, 21 bp, Homo sapiens
tatatttaaaaaattatggaa

SEQ ID NO: 4578196 - DNA, 16 bp, Homo sapiens
tatatttagttacgta

SEQ ID NO: 4578197 - DNA, 16 bp, Homo sapiens
tatatttatatacttt

SEQ ID NO: 4578198 - DNA, 20 bp, Homo sapiens
tatatttatatactttttca

SEQ ID NO: 4578199 - DNA, 12 bp, Homo sapiens
tatatttattgt

SEQ ID NO: 4578200 - DNA, 11 bp, Homo sapiens
tatatttcctt

SEQ ID NO: 4578201 - DNA, 14 bp, Homo sapiens
tatatttcctttat

SEQ ID NO: 4578202 - DNA, 18 bp, Homo sapiens
tatatttcctttatgtga

SEQ ID NO: 4578203 - DNA, 21 bp, Homo sapiens
tatatttgaaatagtatacat

SEQ ID NO: 4578204 - DNA, 16 bp, Homo sapiens
tatatttgattatgta

SEQ ID NO: 4578205 - DNA, 18 bp, Homo sapiens
tatatttgggagtgactg

SEQ ID NO: 4578206 - DNA, 20 bp, Homo sapiens
tatatttgtgctatagtatt

SEQ ID NO: 4578207 - DNA, 13 bp, Homo sapiens
tatatttgtttca

SEQ ID NO: 4578208 - DNA, 17 bp, Homo sapiens
tatattttaaattagtt

SEQ ID NO: 4578209 - DNA, 14 bp, Homo sapiens
tatattttatgaac

SEQ ID NO: 4578210 - DNA, 17 bp, Homo sapiens
tatattttatgaacatt

SEQ ID NO: 4578211 - DNA, 20 bp, Homo sapiens
tatattttatgaacattgta

SEQ ID NO: 4578212 - DNA, 14 bp, Homo sapiens
tatattttctgtat

SEQ ID NO: 4578213 - DNA, 14 bp, Homo sapiens
tatattttctgttt

SEQ ID NO: 4578214 - DNA, 20 bp, Homo sapiens
tatcaaaaagctaatgtgca

SEQ ID NO: 4578215 - DNA, 21 bp, Homo sapiens
tatcaaaaagctaatgtgcag

SEQ ID NO: 4578216 - DNA, 22 bp, Homo sapiens
tatcaaaaagctaatgtgcagg

SEQ ID NO: 4578217 - DNA, 19 bp, Homo sapiens
tatcaaacaccaacataaa

SEQ ID NO: 4578218 - DNA, 23 bp, Homo sapiens
tatcaaacaccaacataaaaatg

SEQ ID NO: 4578219 - DNA, 19 bp, Homo sapiens
tatcaaatgcagtatattt

SEQ ID NO: 4578220 - DNA, 21 bp, Homo sapiens
tatcaaatgcagtatatttct

SEQ ID NO: 4578221 - DNA, 19 bp, Homo sapiens
tatcaaattcaataatctt

SEQ ID NO: 4578222 - DNA, 14 bp, Homo sapiens
tatcaagcaacatt

SEQ ID NO: 4578223 - DNA, 14 bp, Homo sapiens
tatcaataaaattc

SEQ ID NO: 4578224 - DNA, 13 bp, Homo sapiens
tatcaatttctaa

SEQ ID NO: 4578225 - DNA, 22 bp, Homo sapiens
tatcaattttaaggaaactttt

SEQ ID NO: 4578226 - DNA, 16 bp, Homo sapiens
tatcacaaatcttaac

SEQ ID NO: 4578227 - DNA, 12 bp, Homo sapiens
tatcacacaata

SEQ ID NO: 4578228 - DNA, 13 bp, Homo sapiens
tatcacacttctg

SEQ ID NO: 4578229 - DNA, 13 bp, Homo sapiens
tatcacactttgt

SEQ ID NO: 4578230 - DNA, 12 bp, Homo sapiens
tatcacatgttt

SEQ ID NO: 4578231 - DNA, 13 bp, Homo sapiens
tatcacattgaat

SEQ ID NO: 4578232 - DNA, 20 bp, Homo sapiens
tatcacattggagtcactgc

SEQ ID NO: 4578233 - DNA, 23 bp, Homo sapiens
tatcaccgtgggctccctgactg

SEQ ID NO: 4578234 - DNA, 23 bp, Homo sapiens
tatcacctaagcacttctagaat

SEQ ID NO: 4578235 - DNA, 16 bp, Homo sapiens
tatcactaaataaaca

SEQ ID NO: 4578236 - DNA, 23 bp, Homo sapiens
tatcactgcagtcacctcttcta

SEQ ID NO: 4578237 - DNA, 14 bp, Homo sapiens
tatcagcaaaaaag

SEQ ID NO: 4578238 - DNA, 15 bp, Homo sapiens
tatcagcacgtgtgg

SEQ ID NO: 4578239 - DNA, 11 bp, Homo sapiens
tatcagcacta

SEQ ID NO: 4578240 - DNA, 13 bp, Homo sapiens
tatcagcatctga

SEQ ID NO: 4578241 - DNA, 13 bp, Homo sapiens
tatcagtattctg

SEQ ID NO: 4578242 - DNA, 16 bp, Homo sapiens
tatcagtattctgaca

SEQ ID NO: 4578243 - DNA, 13 bp, Homo sapiens
tatcagtgtcctt

SEQ ID NO: 4578244 - DNA, 17 bp, Homo sapiens
tatcagttgatttttct

SEQ ID NO: 4578245 - DNA, 17 bp, Homo sapiens
tatcatactcttctaaa

SEQ ID NO: 4578246 - DNA, 20 bp, Homo sapiens
tatcatactcttctaaaact

SEQ ID NO: 4578247 - DNA, 16 bp, Homo sapiens
tatcatatatactgta

SEQ ID NO: 4578248 - DNA, 15 bp, Homo sapiens
tatcatatattaaaa

SEQ ID NO: 4578249 - DNA, 17 bp, Homo sapiens
tatcatccacacatgaa

SEQ ID NO: 4578250 - DNA, 14 bp, Homo sapiens
tatcatctgtcatt

SEQ ID NO: 4578251 - DNA, 15 bp, Homo sapiens
tatcatctgtcatta

SEQ ID NO: 4578252 - DNA, 18 bp, Homo sapiens
tatcatctgtcattatat

SEQ ID NO: 4578253 - DNA, 14 bp, Homo sapiens
tatcatctttgcca

SEQ ID NO: 4578254 - DNA, 12 bp, Homo sapiens
tatcatgaattt

SEQ ID NO: 4578255 - DNA, 15 bp, Homo sapiens
tatcatgaattttaa

SEQ ID NO: 4578256 - DNA, 18 bp, Homo sapiens
tatcatgaattttaaagt

SEQ ID NO: 4578257 - DNA, 19 bp, Homo sapiens
tatcatgaattttaaagta

SEQ ID NO: 4578258 - DNA, 15 bp, Homo sapiens
tatcatggaagaaaa

SEQ ID NO: 4578259 - DNA, 18 bp, Homo sapiens
tatcatggaagaaaagga

SEQ ID NO: 4578260 - DNA, 12 bp, Homo sapiens
tatcattaaaca

SEQ ID NO: 4578261 - DNA, 16 bp, Homo sapiens
tatcattaaacaaata

SEQ ID NO: 4578262 - DNA, 15 bp, Homo sapiens
tatcatttcttaacc

SEQ ID NO: 4578263 - DNA, 18 bp, Homo sapiens
tatccaaaataatgagga

SEQ ID NO: 4578264 - DNA, 20 bp, Homo sapiens
tatccacagaacctttgtca

SEQ ID NO: 4578265 - DNA, 12 bp, Homo sapiens
tatccacccagc

SEQ ID NO: 4578266 - DNA, 13 bp, Homo sapiens
tatccacccagcc

SEQ ID NO: 4578267 - DNA, 14 bp, Homo sapiens
tatccacccagccc

SEQ ID NO: 4578268 - DNA, 20 bp, Homo sapiens
tatccacccagcccattctc

SEQ ID NO: 4578269 - DNA, 18 bp, Homo sapiens
tatccaggcaccaggact

SEQ ID NO: 4578270 - DNA, 21 bp, Homo sapiens
tatccaggtaatccaagatat

SEQ ID NO: 4578271 - DNA, 22 bp, Homo sapiens
tatccatgacaggcctgaagat

SEQ ID NO: 4578272 - DNA, 17 bp, Homo sapiens
tatccatttatcttttg

SEQ ID NO: 4578273 - DNA, 17 bp, Homo sapiens
tatccccatctccctgc

SEQ ID NO: 4578274 - DNA, 19 bp, Homo sapiens
tatccctattttgctgatg

SEQ ID NO: 4578275 - DNA, 23 bp, Homo sapiens
tatccctctcttccccttccctt

SEQ ID NO: 4578276 - DNA, 16 bp, Homo sapiens
tatcctaaacatcatt

SEQ ID NO: 4578277 - DNA, 14 bp, Homo sapiens
tatcctctgttgat

SEQ ID NO: 4578278 - DNA, 19 bp, Homo sapiens
tatcctgaaaggcaacata

SEQ ID NO: 4578279 - DNA, 15 bp, Homo sapiens
tatcctgcattgtta

SEQ ID NO: 4578280 - DNA, 17 bp, Homo sapiens
tatcctgcgaccttgca

SEQ ID NO: 4578281 - DNA, 21 bp, Homo sapiens
tatcctgctgaaagtcctgct

SEQ ID NO: 4578282 - DNA, 18 bp, Homo sapiens
tatcctggccttgtactt

SEQ ID NO: 4578283 - DNA, 22 bp, Homo sapiens
tatcctggccttgtacttgctt

SEQ ID NO: 4578284 - DNA, 22 bp, Homo sapiens
tatcctgtttgaggaaagcaag

SEQ ID NO: 4578285 - DNA, 17 bp, Homo sapiens
tatcctttggtcctggt

SEQ ID NO: 4578286 - DNA, 20 bp, Homo sapiens
tatcgcattgctgtccttgg

SEQ ID NO: 4578287 - DNA, 21 bp, Homo sapiens
tatcgtaaccagccagatcct

SEQ ID NO: 4578288 - DNA, 15 bp, Homo sapiens
tatcgttatcactgt

SEQ ID NO: 4578289 - DNA, 23 bp, Homo sapiens
tatctaaactagattagatccaa

SEQ ID NO: 4578290 - DNA, 14 bp, Homo sapiens
tatctaaagttata

SEQ ID NO: 4578291 - DNA, 20 bp, Homo sapiens
tatctaaagttatatttcag

SEQ ID NO: 4578292 - DNA, 13 bp, Homo sapiens
tatctaactttgt

SEQ ID NO: 4578293 - DNA, 14 bp, Homo sapiens
tatctaatgacatg

SEQ ID NO: 4578294 - DNA, 13 bp, Homo sapiens
tatctaatttata

SEQ ID NO: 4578295 - DNA, 12 bp, Homo sapiens
tatctacaaaga

SEQ ID NO: 4578296 - DNA, 15 bp, Homo sapiens
tatctacctcaaggt

SEQ ID NO: 4578297 - DNA, 16 bp, Homo sapiens
tatctacctcaaggta

SEQ ID NO: 4578298 - DNA, 20 bp, Homo sapiens
tatctacctcaaggtaacaa

SEQ ID NO: 4578299 - DNA, 21 bp, Homo sapiens
tatctagaactatcattttta

SEQ ID NO: 4578300 - DNA, 18 bp, Homo sapiens
tatctaggcatttcatta

SEQ ID NO: 4578301 - DNA, 23 bp, Homo sapiens
tatctaggcatttcattatgctt

SEQ ID NO: 4578302 - DNA, 13 bp, Homo sapiens
tatctataattta

SEQ ID NO: 4578303 - DNA, 14 bp, Homo sapiens
tatctataatttac

SEQ ID NO: 4578304 - DNA, 23 bp, Homo sapiens
tatctatacctgccttttaagtt

SEQ ID NO: 4578305 - DNA, 16 bp, Homo sapiens
tatctatagcaactca

SEQ ID NO: 4578306 - DNA, 13 bp, Homo sapiens
tatctatagctaa

SEQ ID NO: 4578307 - DNA, 12 bp, Homo sapiens
tatctattagca

SEQ ID NO: 4578308 - DNA, 17 bp, Homo sapiens
tatctatttgaataaat

SEQ ID NO: 4578309 - DNA, 16 bp, Homo sapiens
tatctatttgtacaat

SEQ ID NO: 4578310 - DNA, 16 bp, Homo sapiens
tatctcagatgttaaa

SEQ ID NO: 4578311 - DNA, 13 bp, Homo sapiens
tatctcagccata

SEQ ID NO: 4578312 - DNA, 21 bp, Homo sapiens
tatctcagtctaaggtctcat

SEQ ID NO: 4578313 - DNA, 21 bp, Homo sapiens
tatctcatgccagtgccttat

SEQ ID NO: 4578314 - DNA, 22 bp, Homo sapiens
tatctccatgatgatagttgaa

SEQ ID NO: 4578315 - DNA, 16 bp, Homo sapiens
tatctccgttccatct

SEQ ID NO: 4578316 - DNA, 23 bp, Homo sapiens
tatctccttcccctacacctccc

SEQ ID NO: 4578317 - DNA, 20 bp, Homo sapiens
tatctctactgaatgtcatt

SEQ ID NO: 4578318 - DNA, 13 bp, Homo sapiens
tatctcttggaaa

SEQ ID NO: 4578319 - DNA, 22 bp, Homo sapiens
tatctctttgatctacttgcct

SEQ ID NO: 4578320 - DNA, 17 bp, Homo sapiens
tatctgaacatttacta

SEQ ID NO: 4578321 - DNA, 19 bp, Homo sapiens
tatctgaatttttaaacaa

SEQ ID NO: 4578322 - DNA, 23 bp, Homo sapiens
tatctgacccactttgtaatttt

SEQ ID NO: 4578323 - DNA, 16 bp, Homo sapiens
tatctgcccctccccc

SEQ ID NO: 4578324 - DNA, 22 bp, Homo sapiens
tatctgctgtccagacagcctg

SEQ ID NO: 4578325 - DNA, 16 bp, Homo sapiens
tatctggattcaaatt

SEQ ID NO: 4578326 - DNA, 23 bp, Homo sapiens
tatctgggattatggttttgtga

SEQ ID NO: 4578327 - DNA, 19 bp, Homo sapiens
tatctggtattaaatgcca

SEQ ID NO: 4578328 - DNA, 14 bp, Homo sapiens
tatctggtgcctcc

SEQ ID NO: 4578329 - DNA, 15 bp, Homo sapiens
tatctgtcatctctc

SEQ ID NO: 4578330 - DNA, 17 bp, Homo sapiens
tatctgtgaaatatcat

SEQ ID NO: 4578331 - DNA, 16 bp, Homo sapiens
tatctgtgcttctaat

SEQ ID NO: 4578332 - DNA, 16 bp, Homo sapiens
tatctgtttgttactg

SEQ ID NO: 4578333 - DNA, 17 bp, Homo sapiens
tatcttacctagtgttt

SEQ ID NO: 4578334 - DNA, 14 bp, Homo sapiens
tatcttactttcct

SEQ ID NO: 4578335 - DNA, 15 bp, Homo sapiens
tatcttataactgtt

SEQ ID NO: 4578336 - DNA, 18 bp, Homo sapiens
tatcttatactgtacaat

SEQ ID NO: 4578337 - DNA, 19 bp, Homo sapiens
tatcttcaccctcatcctt

SEQ ID NO: 4578338 - DNA, 18 bp, Homo sapiens
tatcttcatgtaaattga

SEQ ID NO: 4578339 - DNA, 15 bp, Homo sapiens
tatcttctggactat

SEQ ID NO: 4578340 - DNA, 14 bp, Homo sapiens
tatcttgaatttca

SEQ ID NO: 4578341 - DNA, 17 bp, Homo sapiens
tatcttgcactgataaa

SEQ ID NO: 4578342 - DNA, 16 bp, Homo sapiens
tatctttcacctttct

SEQ ID NO: 4578343 - DNA, 14 bp, Homo sapiens
tatctttgagacca

SEQ ID NO: 4578344 - DNA, 22 bp, Homo sapiens
tatctttgattctccttcagcc

SEQ ID NO: 4578345 - DNA, 14 bp, Homo sapiens
tatctttgctgtta

SEQ ID NO: 4578346 - DNA, 22 bp, Homo sapiens
tatctttggttatcctgtttga

SEQ ID NO: 4578347 - DNA, 15 bp, Homo sapiens
tatgaaaaagaagaa

SEQ ID NO: 4578348 - DNA, 23 bp, Homo sapiens
tatgaaaagcacaaggggccaag

SEQ ID NO: 4578349 - DNA, 14 bp, Homo sapiens
tatgaaaagctaga

SEQ ID NO: 4578350 - DNA, 15 bp, Homo sapiens
tatgaaaatgagccc

SEQ ID NO: 4578351 - DNA, 16 bp, Homo sapiens
tatgaaaatgagccct

SEQ ID NO: 4578352 - DNA, 13 bp, Homo sapiens
tatgaaagtagat

SEQ ID NO: 4578353 - DNA, 16 bp, Homo sapiens
tatgaaataagtaaat

SEQ ID NO: 4578354 - DNA, 10 bp, Homo sapiens
tatgaacaga

SEQ ID NO: 4578355 - DNA, 23 bp, Homo sapiens
tatgaacagaaactacatttcta

SEQ ID NO: 4578356 - DNA, 14 bp, Homo sapiens
tatgaacatattgt

SEQ ID NO: 4578357 - DNA, 19 bp, Homo sapiens
tatgaacatattgttgaaa

SEQ ID NO: 4578358 - DNA, 14 bp, Homo sapiens
tatgaacattgtac

SEQ ID NO: 4578359 - DNA, 18 bp, Homo sapiens
tatgaaccctttgtttct

SEQ ID NO: 4578360 - DNA, 19 bp, Homo sapiens
tatgaaccctttgtttctt

SEQ ID NO: 4578361 - DNA, 14 bp, Homo sapiens
tatgaagtataaat

SEQ ID NO: 4578362 - DNA, 13 bp, Homo sapiens
tatgaatcaaata

SEQ ID NO: 4578363 - DNA, 21 bp, Homo sapiens
tatgaattcaagaaaggaaat

SEQ ID NO: 4578364 - DNA, 14 bp, Homo sapiens
tatgacacttgtaa

SEQ ID NO: 4578365 - DNA, 16 bp, Homo sapiens
tatgacagctgtccct

SEQ ID NO: 4578366 - DNA, 22 bp, Homo sapiens
tatgacataagcaatcatttta

SEQ ID NO: 4578367 - DNA, 13 bp, Homo sapiens
tatgaccagaagc

SEQ ID NO: 4578368 - DNA, 16 bp, Homo sapiens
tatgactatgtaaact

SEQ ID NO: 4578369 - DNA, 13 bp, Homo sapiens
tatgactttttat

SEQ ID NO: 4578370 - DNA, 19 bp, Homo sapiens
tatgactttttataaaatg

SEQ ID NO: 4578371 - DNA, 22 bp, Homo sapiens
tatgactttttataaaatggct

SEQ ID NO: 4578372 - DNA, 19 bp, Homo sapiens
tatgagaatataccttatt

SEQ ID NO: 4578373 - DNA, 23 bp, Homo sapiens
tatgagacagggtcttgctctgt

SEQ ID NO: 4578374 - DNA, 18 bp, Homo sapiens
tatgagagtttggaatta

SEQ ID NO: 4578375 - DNA, 18 bp, Homo sapiens
tatgagctatcctttcaa

SEQ ID NO: 4578376 - DNA, 19 bp, Homo sapiens
tatgagctatcctttcaaa

SEQ ID NO: 4578377 - DNA, 13 bp, Homo sapiens
tatgagcttcaat

SEQ ID NO: 4578378 - DNA, 15 bp, Homo sapiens
tatgaggagcctctg

SEQ ID NO: 4578379 - DNA, 13 bp, Homo sapiens
tatgaggagggga

SEQ ID NO: 4578380 - DNA, 20 bp, Homo sapiens
tatgaggggcagtggacagt

SEQ ID NO: 4578381 - DNA, 18 bp, Homo sapiens
tatgagggtgtttcctct

SEQ ID NO: 4578382 - DNA, 16 bp, Homo sapiens
tatgagttggacttca

SEQ ID NO: 4578383 - DNA, 15 bp, Homo sapiens
tatgataaaacactg

SEQ ID NO: 4578384 - DNA, 15 bp, Homo sapiens
tatgatatgcatgta

SEQ ID NO: 4578385 - DNA, 17 bp, Homo sapiens
tatgatcagaagaacat

SEQ ID NO: 4578386 - DNA, 20 bp, Homo sapiens
tatgatcagaagaacatgat

SEQ ID NO: 4578387 - DNA, 18 bp, Homo sapiens
tatgatcaggtaactttc

SEQ ID NO: 4578388 - DNA, 19 bp, Homo sapiens
tatgatggagcaactgaaa

SEQ ID NO: 4578389 - DNA, 16 bp, Homo sapiens
tatgatggttttaaac

SEQ ID NO: 4578390 - DNA, 18 bp, Homo sapiens
tatgatgttaaaaaaata

SEQ ID NO: 4578391 - DNA, 22 bp, Homo sapiens
tatgattagagggatgagacag

SEQ ID NO: 4578392 - DNA, 12 bp, Homo sapiens
tatgattattaa

SEQ ID NO: 4578393 - DNA, 16 bp, Homo sapiens
tatgattttcataact

SEQ ID NO: 4578394 - DNA, 12 bp, Homo sapiens
tatgcaagcagc

SEQ ID NO: 4578395 - DNA, 18 bp, Homo sapiens
tatgcaaggcggtacact

SEQ ID NO: 4578396 - DNA, 12 bp, Homo sapiens
tatgcaataaaa

SEQ ID NO: 4578397 - DNA, 21 bp, Homo sapiens
tatgcaataaaattatttgca

SEQ ID NO: 4578398 - DNA, 16 bp, Homo sapiens
tatgcactgaagagct

SEQ ID NO: 4578399 - DNA, 19 bp, Homo sapiens
tatgcactgaagagctctt

SEQ ID NO: 4578400 - DNA, 23 bp, Homo sapiens
tatgcactgaagagctcttggcc

SEQ ID NO: 4578401 - DNA, 20 bp, Homo sapiens
tatgcacttataattttcct

SEQ ID NO: 4578402 - DNA, 14 bp, Homo sapiens
tatgcacttggcct

SEQ ID NO: 4578403 - DNA, 22 bp, Homo sapiens
tatgcagaaatagacaaaaagt

SEQ ID NO: 4578404 - DNA, 16 bp, Homo sapiens
tatgcagtatctctta

SEQ ID NO: 4578405 - DNA, 22 bp, Homo sapiens
tatgcatggtgtagatgccctg

SEQ ID NO: 4578406 - DNA, 12 bp, Homo sapiens
tatgcattcaca

SEQ ID NO: 4578407 - DNA, 12 bp, Homo sapiens
tatgcattcttt

SEQ ID NO: 4578408 - DNA, 17 bp, Homo sapiens
tatgcatttttttagtt

SEQ ID NO: 4578409 - DNA, 19 bp, Homo sapiens
tatgccattggggtagttg

SEQ ID NO: 4578410 - DNA, 19 bp, Homo sapiens
tatgcccggcgccgggcac

SEQ ID NO: 4578411 - DNA, 20 bp, Homo sapiens
tatgcctgtactaaggagca

SEQ ID NO: 4578412 - DNA, 22 bp, Homo sapiens
tatgcctttaaatctgtgatga

SEQ ID NO: 4578413 - DNA, 17 bp, Homo sapiens
tatgctattgacaataa

SEQ ID NO: 4578414 - DNA, 13 bp, Homo sapiens
tatgctatttctg

SEQ ID NO: 4578415 - DNA, 14 bp, Homo sapiens
tatgctgaattgaa

SEQ ID NO: 4578416 - DNA, 15 bp, Homo sapiens
tatgctgatttattt

SEQ ID NO: 4578417 - DNA, 18 bp, Homo sapiens
tatgctggccagcaccct

SEQ ID NO: 4578418 - DNA, 22 bp, Homo sapiens
tatgctggccagcaccctctcc

SEQ ID NO: 4578419 - DNA, 13 bp, Homo sapiens
tatgctgtcatgg

SEQ ID NO: 4578420 - DNA, 22 bp, Homo sapiens
tatgcttactaaatcttcagca

SEQ ID NO: 4578421 - DNA, 21 bp, Homo sapiens
tatgctttccttctttgggat

SEQ ID NO: 4578422 - DNA, 14 bp, Homo sapiens
tatggaaatattaa

SEQ ID NO: 4578423 - DNA, 23 bp, Homo sapiens
tatggaagaacgaggtttatatt

SEQ ID NO: 4578424 - DNA, 19 bp, Homo sapiens
tatggaatatcatctgtca

SEQ ID NO: 4578425 - DNA, 18 bp, Homo sapiens
tatggaattgatttgcat

SEQ ID NO: 4578426 - DNA, 18 bp, Homo sapiens
tatggactgttttgatag

SEQ ID NO: 4578427 - DNA, 17 bp, Homo sapiens
tatggagactttgctgt

SEQ ID NO: 4578428 - DNA, 21 bp, Homo sapiens
tatggagactttgctgttact

SEQ ID NO: 4578429 - DNA, 16 bp, Homo sapiens
tatggagtcttgtgaa

SEQ ID NO: 4578430 - DNA, 15 bp, Homo sapiens
tatggagtcttgtgc

SEQ ID NO: 4578431 - DNA, 15 bp, Homo sapiens
tatggatgattaaat

SEQ ID NO: 4578432 - DNA, 13 bp, Homo sapiens
tatggattcactt

SEQ ID NO: 4578433 - DNA, 20 bp, Homo sapiens
tatggattcacttctattta

SEQ ID NO: 4578434 - DNA, 14 bp, Homo sapiens
tatggattctaaaa

SEQ ID NO: 4578435 - DNA, 18 bp, Homo sapiens
tatggcacctatttcttt

SEQ ID NO: 4578436 - DNA, 14 bp, Homo sapiens
tatggcagcgaaag

SEQ ID NO: 4578437 - DNA, 13 bp, Homo sapiens
tatggcatttgca

SEQ ID NO: 4578438 - DNA, 17 bp, Homo sapiens
tatggctataggtgcta

SEQ ID NO: 4578439 - DNA, 13 bp, Homo sapiens
tatggctgcccag

SEQ ID NO: 4578440 - DNA, 14 bp, Homo sapiens
tatggctgcccagg

SEQ ID NO: 4578441 - DNA, 21 bp, Homo sapiens
tatgggaactatgaggagcct

SEQ ID NO: 4578442 - DNA, 22 bp, Homo sapiens
tatgggagaagggggagtaatg

SEQ ID NO: 4578443 - DNA, 14 bp, Homo sapiens
tatgggaggaacaa

SEQ ID NO: 4578444 - DNA, 18 bp, Homo sapiens
tatgggaggaacaaagac

SEQ ID NO: 4578445 - DNA, 18 bp, Homo sapiens
tatggggatagatgtgtg

SEQ ID NO: 4578446 - DNA, 20 bp, Homo sapiens
tatggggatagatgtgtgga

SEQ ID NO: 4578447 - DNA, 20 bp, Homo sapiens
tatgggggcatctcttcccc

SEQ ID NO: 4578448 - DNA, 14 bp, Homo sapiens
tatgggtctaggac

SEQ ID NO: 4578449 - DNA, 20 bp, Homo sapiens
tatgggtgggattttgcaaa

SEQ ID NO: 4578450 - DNA, 15 bp, Homo sapiens
tatgggtttattttc

SEQ ID NO: 4578451 - DNA, 16 bp, Homo sapiens
tatggtatgctggcca

SEQ ID NO: 4578452 - DNA, 14 bp, Homo sapiens
tatggtgatgactt

SEQ ID NO: 4578453 - DNA, 15 bp, Homo sapiens
tatggtgatgactta

SEQ ID NO: 4578454 - DNA, 22 bp, Homo sapiens
tatggttacttcttctcttaga

SEQ ID NO: 4578455 - DNA, 21 bp, Homo sapiens
tatggttagctgtcacataca

SEQ ID NO: 4578456 - DNA, 14 bp, Homo sapiens
tatggttcaccagg

SEQ ID NO: 4578457 - DNA, 10 bp, Homo sapiens
tatgtaaaaa

SEQ ID NO: 4578458 - DNA, 21 bp, Homo sapiens
tatgtaacacaggataaagtt

SEQ ID NO: 4578459 - DNA, 23 bp, Homo sapiens
tatgtaatgaagtaaagccatta

SEQ ID NO: 4578460 - DNA, 14 bp, Homo sapiens
tatgtaatttcttt

SEQ ID NO: 4578461 - DNA, 21 bp, Homo sapiens
tatgtacaatacaatgtacaa

SEQ ID NO: 4578462 - DNA, 15 bp, Homo sapiens
tatgtacatgagaag

SEQ ID NO: 4578463 - DNA, 23 bp, Homo sapiens
tatgtagccttcacacagataga

SEQ ID NO: 4578464 - DNA, 14 bp, Homo sapiens
tatgtagtaattga

SEQ ID NO: 4578465 - DNA, 18 bp, Homo sapiens
tatgtatataatcatgct

SEQ ID NO: 4578466 - DNA, 20 bp, Homo sapiens
tatgtatcagtgtcctttcc

SEQ ID NO: 4578467 - DNA, 21 bp, Homo sapiens
tatgtatggatatatttgaaa

SEQ ID NO: 4578468 - DNA, 22 bp, Homo sapiens
tatgtatggatatatttgaaat

SEQ ID NO: 4578469 - DNA, 13 bp, Homo sapiens
tatgtatgttaat

SEQ ID NO: 4578470 - DNA, 14 bp, Homo sapiens
tatgtatttaaagt

SEQ ID NO: 4578471 - DNA, 22 bp, Homo sapiens
tatgtatttaccaaaaattttg

SEQ ID NO: 4578472 - DNA, 11 bp, Homo sapiens
tatgtcactca

SEQ ID NO: 4578473 - DNA, 16 bp, Homo sapiens
tatgtcagtcactaaa

SEQ ID NO: 4578474 - DNA, 21 bp, Homo sapiens
tatgtcagtgtaaatccttgt

SEQ ID NO: 4578475 - DNA, 17 bp, Homo sapiens
tatgtcatcagtaaagt

SEQ ID NO: 4578476 - DNA, 18 bp, Homo sapiens
tatgtcctgtgagatgtg

SEQ ID NO: 4578477 - DNA, 15 bp, Homo sapiens
tatgtctatatttaa

SEQ ID NO: 4578478 - DNA, 13 bp, Homo sapiens
tatgtctcttgag

SEQ ID NO: 4578479 - DNA, 22 bp, Homo sapiens
tatgtctgctgagttggcctgg

SEQ ID NO: 4578480 - DNA, 22 bp, Homo sapiens
tatgtcttgtatttaaaaacat

SEQ ID NO: 4578481 - DNA, 14 bp, Homo sapiens
tatgtgaaaggata

SEQ ID NO: 4578482 - DNA, 14 bp, Homo sapiens
tatgtgaagttttc

SEQ ID NO: 4578483 - DNA, 12 bp, Homo sapiens
tatgtgaatttt

SEQ ID NO: 4578484 - DNA, 18 bp, Homo sapiens
tatgtgacattttacatt

SEQ ID NO: 4578485 - DNA, 19 bp, Homo sapiens
tatgtgacattttacatta

SEQ ID NO: 4578486 - DNA, 17 bp, Homo sapiens
tatgtgacttgcaataa

SEQ ID NO: 4578487 - DNA, 20 bp, Homo sapiens
tatgtgagaaatcagaattg

SEQ ID NO: 4578488 - DNA, 14 bp, Homo sapiens
tatgtgagatttcc

SEQ ID NO: 4578489 - DNA, 17 bp, Homo sapiens
tatgtgagcgagcaagc

SEQ ID NO: 4578490 - DNA, 20 bp, Homo sapiens
tatgtgcacatctgttttgt

SEQ ID NO: 4578491 - DNA, 23 bp, Homo sapiens
tatgtgcattattcataaaaaat

SEQ ID NO: 4578492 - DNA, 16 bp, Homo sapiens
tatgtggaagtgtggg

SEQ ID NO: 4578493 - DNA, 14 bp, Homo sapiens
tatgtggaataata

SEQ ID NO: 4578494 - DNA, 15 bp, Homo sapiens
tatgtggaataatac

SEQ ID NO: 4578495 - DNA, 16 bp, Homo sapiens
tatgtggaataataca

SEQ ID NO: 4578496 - DNA, 19 bp, Homo sapiens
tatgtggattttgcatgta

SEQ ID NO: 4578497 - DNA, 16 bp, Homo sapiens
tatgtggcaaaacata

SEQ ID NO: 4578498 - DNA, 23 bp, Homo sapiens
tatgtgggcagattttcagcaaa

SEQ ID NO: 4578499 - DNA, 18 bp, Homo sapiens
tatgtgggggtctgtgtg

SEQ ID NO: 4578500 - DNA, 20 bp, Homo sapiens
tatgtgggggtctgtgtgtt

SEQ ID NO: 4578501 - DNA, 12 bp, Homo sapiens
tatgtgtaaaga

SEQ ID NO: 4578502 - DNA, 11 bp, Homo sapiens
tatgtgtgtgt

SEQ ID NO: 4578503 - DNA, 14 bp, Homo sapiens
tatgtgtgtgtgtt

SEQ ID NO: 4578504 - DNA, 13 bp, Homo sapiens
tatgtgttacatt

SEQ ID NO: 4578505 - DNA, 15 bp, Homo sapiens
tatgtgttatgaaca

SEQ ID NO: 4578506 - DNA, 14 bp, Homo sapiens
tatgtgtttttctc

SEQ ID NO: 4578507 - DNA, 16 bp, Homo sapiens
tatgttaatatttctg

SEQ ID NO: 4578508 - DNA, 14 bp, Homo sapiens
tatgttaatatttt

SEQ ID NO: 4578509 - DNA, 20 bp, Homo sapiens
tatgttatacaaccttcatt

SEQ ID NO: 4578510 - DNA, 21 bp, Homo sapiens
tatgttatagaacttcatgga

SEQ ID NO: 4578511 - DNA, 17 bp, Homo sapiens
tatgttctaagaagtga

SEQ ID NO: 4578512 - DNA, 13 bp, Homo sapiens
tatgttcttggct

SEQ ID NO: 4578513 - DNA, 16 bp, Homo sapiens
tatgttgaaaaaattt

SEQ ID NO: 4578514 - DNA, 18 bp, Homo sapiens
tatgttgaatacttttta

SEQ ID NO: 4578515 - DNA, 17 bp, Homo sapiens
tatgtttatttcatgtg

SEQ ID NO: 4578516 - DNA, 12 bp, Homo sapiens
tatgtttccaag

SEQ ID NO: 4578517 - DNA, 19 bp, Homo sapiens
tatgtttgctgattattta

SEQ ID NO: 4578518 - DNA, 17 bp, Homo sapiens
tatgttttccacataaa

SEQ ID NO: 4578519 - DNA, 21 bp, Homo sapiens
tatgttttccacataaatttt

SEQ ID NO: 4578520 - DNA, 13 bp, Homo sapiens
tatgtttttaatg

SEQ ID NO: 4578521 - DNA, 14 bp, Homo sapiens
tatgtttttactga

SEQ ID NO: 4578522 - DNA, 16 bp, Homo sapiens
tatgtttttataaaaa

SEQ ID NO: 4578523 - DNA, 17 bp, Homo sapiens
tatgtttttatttatga

SEQ ID NO: 4578524 - DNA, 13 bp, Homo sapiens
tatgtttttctgt

SEQ ID NO: 4578525 - DNA, 23 bp, Homo sapiens
tatgtttttctgtataacagcct

SEQ ID NO: 4578526 - DNA, 15 bp, Homo sapiens
tatgtttttgttcaa

SEQ ID NO: 4578527 - DNA, 16 bp, Homo sapiens
tatgtttttgttcaaa

SEQ ID NO: 4578528 - DNA, 18 bp, Homo sapiens
tattaaaaaaactggcct

SEQ ID NO: 4578529 - DNA, 22 bp, Homo sapiens
tattaaaactcagcctgggaca

SEQ ID NO: 4578530 - DNA, 14 bp, Homo sapiens
tattaaaattccaa

SEQ ID NO: 4578531 - DNA, 17 bp, Homo sapiens
tattaaacagtgaactt

SEQ ID NO: 4578532 - DNA, 19 bp, Homo sapiens
tattaaacagtgaacttgt

SEQ ID NO: 4578533 - DNA, 15 bp, Homo sapiens
tattaaacttcagca

SEQ ID NO: 4578534 - DNA, 20 bp, Homo sapiens
tattaaagcgcaaatgaatt

SEQ ID NO: 4578535 - DNA, 20 bp, Homo sapiens
tattaaataataaagtatga

SEQ ID NO: 4578536 - DNA, 11 bp, Homo sapiens
tattaaatgtt

SEQ ID NO: 4578537 - DNA, 14 bp, Homo sapiens
tattaacaattaat

SEQ ID NO: 4578538 - DNA, 20 bp, Homo sapiens
tattaacaattaattgtctt

SEQ ID NO: 4578539 - DNA, 22 bp, Homo sapiens
tattaacactaataatagtact

SEQ ID NO: 4578540 - DNA, 12 bp, Homo sapiens
tattaacatgca

SEQ ID NO: 4578541 - DNA, 14 bp, Homo sapiens
tattaacatgcaat

SEQ ID NO: 4578542 - DNA, 15 bp, Homo sapiens
tattaacatgcaata

SEQ ID NO: 4578543 - DNA, 19 bp, Homo sapiens
tattaacatgcaataacaa

SEQ ID NO: 4578544 - DNA, 18 bp, Homo sapiens
tattaactctgcatagac

SEQ ID NO: 4578545 - DNA, 21 bp, Homo sapiens
tattaagaaaggaagcattgt

SEQ ID NO: 4578546 - DNA, 21 bp, Homo sapiens
tattaagaatcttagataact

SEQ ID NO: 4578547 - DNA, 21 bp, Homo sapiens
tattaagacaatagcacttaa

SEQ ID NO: 4578548 - DNA, 16 bp, Homo sapiens
tattaagagctatttt

SEQ ID NO: 4578549 - DNA, 16 bp, Homo sapiens
tattaagctttttgga

SEQ ID NO: 4578550 - DNA, 15 bp, Homo sapiens
tattaagggcatttt

SEQ ID NO: 4578551 - DNA, 15 bp, Homo sapiens
tattaagttgttaat

SEQ ID NO: 4578552 - DNA, 14 bp, Homo sapiens
tattaataatattt

SEQ ID NO: 4578553 - DNA, 20 bp, Homo sapiens
tattaatcatacaaactctc

SEQ ID NO: 4578554 - DNA, 19 bp, Homo sapiens
tattaatcatagattatta

SEQ ID NO: 4578555 - DNA, 15 bp, Homo sapiens
tattaatctactgta

SEQ ID NO: 4578556 - DNA, 18 bp, Homo sapiens
tattaatctactgtatca

SEQ ID NO: 4578557 - DNA, 14 bp, Homo sapiens
tattaatctctgtg

SEQ ID NO: 4578558 - DNA, 17 bp, Homo sapiens
tattacaagtaatgtaa

SEQ ID NO: 4578559 - DNA, 15 bp, Homo sapiens
tattacaatgatcac

SEQ ID NO: 4578560 - DNA, 15 bp, Homo sapiens
tattacaatgtatct

SEQ ID NO: 4578561 - DNA, 18 bp, Homo sapiens
tattacatgtaatttgat

SEQ ID NO: 4578562 - DNA, 19 bp, Homo sapiens
tattaccaccctttcacaa

SEQ ID NO: 4578563 - DNA, 22 bp, Homo sapiens
tattaccagtggcgttgttgca

SEQ ID NO: 4578564 - DNA, 17 bp, Homo sapiens
tattacctaatgaaagt

SEQ ID NO: 4578565 - DNA, 21 bp, Homo sapiens
tattacctattaggtggaaat

SEQ ID NO: 4578566 - DNA, 13 bp, Homo sapiens
tattactagtact

SEQ ID NO: 4578567 - DNA, 16 bp, Homo sapiens
tattactagtgtttaa

SEQ ID NO: 4578568 - DNA, 21 bp, Homo sapiens
tattactagtgtttaagtcat

SEQ ID NO: 4578569 - DNA, 22 bp, Homo sapiens
tattactagtgtttaagtcatt

SEQ ID NO: 4578570 - DNA, 18 bp, Homo sapiens
tattactgatgtgtgcaa

SEQ ID NO: 4578571 - DNA, 12 bp, Homo sapiens
tattacttgaac

SEQ ID NO: 4578572 - DNA, 14 bp, Homo sapiens
tattacttgaactt

SEQ ID NO: 4578573 - DNA, 19 bp, Homo sapiens
tattagaaagtgctgaatt

SEQ ID NO: 4578574 - DNA, 22 bp, Homo sapiens
tattagatcaaatagttgcata

SEQ ID NO: 4578575 - DNA, 16 bp, Homo sapiens
tattagccctgcattt

SEQ ID NO: 4578576 - DNA, 17 bp, Homo sapiens
tattagccctgcatttt

SEQ ID NO: 4578577 - DNA, 22 bp, Homo sapiens
tattagccctgcattttcatag

SEQ ID NO: 4578578 - DNA, 21 bp, Homo sapiens
tattaggaaaataaacagaca

SEQ ID NO: 4578579 - DNA, 18 bp, Homo sapiens
tattaggccagttgaagt

SEQ ID NO: 4578580 - DNA, 15 bp, Homo sapiens
tattaggtggaaatt

SEQ ID NO: 4578581 - DNA, 13 bp, Homo sapiens
tattagttgcttt

SEQ ID NO: 4578582 - DNA, 14 bp, Homo sapiens
tattagttttgatt

SEQ ID NO: 4578583 - DNA, 17 bp, Homo sapiens
tattataaaaatattaa

SEQ ID NO: 4578584 - DNA, 13 bp, Homo sapiens
tattataaactat

SEQ ID NO: 4578585 - DNA, 21 bp, Homo sapiens
tattataaagccaattatctg

SEQ ID NO: 4578586 - DNA, 23 bp, Homo sapiens
tattataaatatatataaagaat

SEQ ID NO: 4578587 - DNA, 15 bp, Homo sapiens
tattataacataaaa

SEQ ID NO: 4578588 - DNA, 12 bp, Homo sapiens
tattatagaaaa

SEQ ID NO: 4578589 - DNA, 14 bp, Homo sapiens
tattatagaaaatt

SEQ ID NO: 4578590 - DNA, 20 bp, Homo sapiens
tattatagacaaaagaataa

SEQ ID NO: 4578591 - DNA, 20 bp, Homo sapiens
tattatatatttacagaaga

SEQ ID NO: 4578592 - DNA, 13 bp, Homo sapiens
tattatattcatt

SEQ ID NO: 4578593 - DNA, 17 bp, Homo sapiens
tattatattcattcttt

SEQ ID NO: 4578594 - DNA, 23 bp, Homo sapiens
tattatattcattctttttgaaa

SEQ ID NO: 4578595 - DNA, 14 bp, Homo sapiens
tattatctgtcagc

SEQ ID NO: 4578596 - DNA, 20 bp, Homo sapiens
tattatcttgttcaggaaaa

SEQ ID NO: 4578597 - DNA, 19 bp, Homo sapiens
tattatgcattatatcaaa

SEQ ID NO: 4578598 - DNA, 20 bp, Homo sapiens
tattatggaaaactgtgttg

SEQ ID NO: 4578599 - DNA, 17 bp, Homo sapiens
tattatgtctcttctga

SEQ ID NO: 4578600 - DNA, 20 bp, Homo sapiens
tattatgtgaagaatttaga

SEQ ID NO: 4578601 - DNA, 17 bp, Homo sapiens
tattattaatataataa

SEQ ID NO: 4578602 - DNA, 17 bp, Homo sapiens
tattattactgttctta

SEQ ID NO: 4578603 - DNA, 19 bp, Homo sapiens
tattattagttttgattta

SEQ ID NO: 4578604 - DNA, 15 bp, Homo sapiens
tattattataatctt

SEQ ID NO: 4578605 - DNA, 17 bp, Homo sapiens
tattattcccgacgaca

SEQ ID NO: 4578606 - DNA, 22 bp, Homo sapiens
tattattcctagtctttccagt

SEQ ID NO: 4578607 - DNA, 15 bp, Homo sapiens
tattattgcttcatg

SEQ ID NO: 4578608 - DNA, 13 bp, Homo sapiens
tattcaaatgaag

SEQ ID NO: 4578609 - DNA, 15 bp, Homo sapiens
tattcaaatttgatg

SEQ ID NO: 4578610 - DNA, 20 bp, Homo sapiens
tattcaactaatacatggtt

SEQ ID NO: 4578611 - DNA, 16 bp, Homo sapiens
tattcaaggaagtttt

SEQ ID NO: 4578612 - DNA, 18 bp, Homo sapiens
tattcacaggtggacaaa

SEQ ID NO: 4578613 - DNA, 15 bp, Homo sapiens
tattcagaatattca

SEQ ID NO: 4578614 - DNA, 17 bp, Homo sapiens
tattcagacaaaatgga

SEQ ID NO: 4578615 - DNA, 16 bp, Homo sapiens
tattcagccagcttaa

SEQ ID NO: 4578616 - DNA, 20 bp, Homo sapiens
tattcagctagaatttctgg

SEQ ID NO: 4578617 - DNA, 20 bp, Homo sapiens
tattcaggacttgaaagaaa

SEQ ID NO: 4578618 - DNA, 18 bp, Homo sapiens
tattcaggcactgagaat

SEQ ID NO: 4578619 - DNA, 18 bp, Homo sapiens
tattcagtggtgaaatct

SEQ ID NO: 4578620 - DNA, 20 bp, Homo sapiens
tattcataaaaaataatggt

SEQ ID NO: 4578621 - DNA, 17 bp, Homo sapiens
tattcatggatggctca

SEQ ID NO: 4578622 - DNA, 13 bp, Homo sapiens
tattcatggctac

SEQ ID NO: 4578623 - DNA, 15 bp, Homo sapiens
tattcatggctacct

SEQ ID NO: 4578624 - DNA, 18 bp, Homo sapiens
tattcattctttttgaaa

SEQ ID NO: 4578625 - DNA, 19 bp, Homo sapiens
tattccaagacatgtctgt

SEQ ID NO: 4578626 - DNA, 17 bp, Homo sapiens
tattccagaatgctgta

SEQ ID NO: 4578627 - DNA, 16 bp, Homo sapiens
tattcccccaaacttt

SEQ ID NO: 4578628 - DNA, 23 bp, Homo sapiens
tattcccccaaactttttgttca

SEQ ID NO: 4578629 - DNA, 14 bp, Homo sapiens
tattcctattgtgc

SEQ ID NO: 4578630 - DNA, 18 bp, Homo sapiens
tattcctcctgctcatat

SEQ ID NO: 4578631 - DNA, 12 bp, Homo sapiens
tattcctttgaa

SEQ ID NO: 4578632 - DNA, 17 bp, Homo sapiens
tattcctttgaatattt

SEQ ID NO: 4578633 - DNA, 21 bp, Homo sapiens
tattcctttttattcctttta

SEQ ID NO: 4578634 - DNA, 17 bp, Homo sapiens
tattcgaatgaaaagac

SEQ ID NO: 4578635 - DNA, 14 bp, Homo sapiens
tattctaacttatt

SEQ ID NO: 4578636 - DNA, 14 bp, Homo sapiens
tattctaatagttt

SEQ ID NO: 4578637 - DNA, 13 bp, Homo sapiens
tattctaattaaa

SEQ ID NO: 4578638 - DNA, 15 bp, Homo sapiens
tattctatctgtttt

SEQ ID NO: 4578639 - DNA, 13 bp, Homo sapiens
tattctcactcca

SEQ ID NO: 4578640 - DNA, 16 bp, Homo sapiens
tattctcactccacca

SEQ ID NO: 4578641 - DNA, 20 bp, Homo sapiens
tattctcaggtaatcatttt

SEQ ID NO: 4578642 - DNA, 20 bp, Homo sapiens
tattctcctcggactgtgtg

SEQ ID NO: 4578643 - DNA, 15 bp, Homo sapiens
tattctctatttgaa

SEQ ID NO: 4578644 - DNA, 23 bp, Homo sapiens
tattctctcttattgttctttca

SEQ ID NO: 4578645 - DNA, 12 bp, Homo sapiens
tattctctgagc

SEQ ID NO: 4578646 - DNA, 19 bp, Homo sapiens
tattctctgagctgtgcag

SEQ ID NO: 4578647 - DNA, 17 bp, Homo sapiens
tattctctgcaatttta

SEQ ID NO: 4578648 - DNA, 20 bp, Homo sapiens
tattctgaatcaccaattaa

SEQ ID NO: 4578649 - DNA, 20 bp, Homo sapiens
tattctgggcaccacaaaat

SEQ ID NO: 4578650 - DNA, 12 bp, Homo sapiens
tattctgtttgc

SEQ ID NO: 4578651 - DNA, 18 bp, Homo sapiens
tattcttaaaatgcaata

SEQ ID NO: 4578652 - DNA, 20 bp, Homo sapiens
tattcttaataaaactcact

SEQ ID NO: 4578653 - DNA, 12 bp, Homo sapiens
tattcttcatga

SEQ ID NO: 4578654 - DNA, 13 bp, Homo sapiens
tattcttcatgaa

SEQ ID NO: 4578655 - DNA, 15 bp, Homo sapiens
tattcttcatgaaat

SEQ ID NO: 4578656 - DNA, 20 bp, Homo sapiens
tattcttcatgaaatgtgtt

SEQ ID NO: 4578657 - DNA, 22 bp, Homo sapiens
tattcttctcttccttttatca

SEQ ID NO: 4578658 - DNA, 18 bp, Homo sapiens
tattcttggaccatgcca

SEQ ID NO: 4578659 - DNA, 15 bp, Homo sapiens
tattctttttttcct

SEQ ID NO: 4578660 - DNA, 21 bp, Homo sapiens
tattgaaaggggacacctgta

SEQ ID NO: 4578661 - DNA, 21 bp, Homo sapiens
tattgaagttgtttatcaact

SEQ ID NO: 4578662 - DNA, 14 bp, Homo sapiens
tattgaattagaaa

SEQ ID NO: 4578663 - DNA, 15 bp, Homo sapiens
tattgaatttttcct

SEQ ID NO: 4578664 - DNA, 17 bp, Homo sapiens
tattgacaacagtttta

SEQ ID NO: 4578665 - DNA, 11 bp, Homo sapiens
tattgacactg

SEQ ID NO: 4578666 - DNA, 23 bp, Homo sapiens
tattgacaggtcttttcaaataa

SEQ ID NO: 4578667 - DNA, 17 bp, Homo sapiens
tattgagcagaattcat

SEQ ID NO: 4578668 - DNA, 18 bp, Homo sapiens
tattgagcagaattcatt

SEQ ID NO: 4578669 - DNA, 19 bp, Homo sapiens
tattgagggataattggtt

SEQ ID NO: 4578670 - DNA, 19 bp, Homo sapiens
tattgagttccagttgaag

SEQ ID NO: 4578671 - DNA, 13 bp, Homo sapiens
tattgatatatat

SEQ ID NO: 4578672 - DNA, 21 bp, Homo sapiens
tattgatgcagtgtgtcttta

SEQ ID NO: 4578673 - DNA, 13 bp, Homo sapiens
tattgatgttttc

SEQ ID NO: 4578674 - DNA, 16 bp, Homo sapiens
tattgattaaaaatgt

SEQ ID NO: 4578675 - DNA, 17 bp, Homo sapiens
tattgattaaaaatgtg

SEQ ID NO: 4578676 - DNA, 20 bp, Homo sapiens
tattgcaactcttttaagtg

SEQ ID NO: 4578677 - DNA, 14 bp, Homo sapiens
tattgcaataaagt

SEQ ID NO: 4578678 - DNA, 16 bp, Homo sapiens
tattgcaataaagtat

SEQ ID NO: 4578679 - DNA, 18 bp, Homo sapiens
tattgcaataaagtataa

SEQ ID NO: 4578680 - DNA, 17 bp, Homo sapiens
tattgcaatgaaggaaa

SEQ ID NO: 4578681 - DNA, 14 bp, Homo sapiens
tattgcagaatgtg

SEQ ID NO: 4578682 - DNA, 13 bp, Homo sapiens
tattgcagtttat

SEQ ID NO: 4578683 - DNA, 13 bp, Homo sapiens
tattgcatttata

SEQ ID NO: 4578684 - DNA, 17 bp, Homo sapiens
tattgcatttatatgta

SEQ ID NO: 4578685 - DNA, 21 bp, Homo sapiens
tattgcccatgatataacttt

SEQ ID NO: 4578686 - DNA, 17 bp, Homo sapiens
tattgccttatttgtct

SEQ ID NO: 4578687 - DNA, 16 bp, Homo sapiens
tattgccttctcacca

SEQ ID NO: 4578688 - DNA, 21 bp, Homo sapiens
tattgccttctcaccagctgc

SEQ ID NO: 4578689 - DNA, 17 bp, Homo sapiens
tattgccttttaatttt

SEQ ID NO: 4578690 - DNA, 21 bp, Homo sapiens
tattgccttttaatttttaat

SEQ ID NO: 4578691 - DNA, 13 bp, Homo sapiens
tattgctactata

SEQ ID NO: 4578692 - DNA, 19 bp, Homo sapiens
tattgctgtccttgaatgc

SEQ ID NO: 4578693 - DNA, 18 bp, Homo sapiens
tattgcttagtaagtatt

SEQ ID NO: 4578694 - DNA, 23 bp, Homo sapiens
tattgcttcctgtgtaacatctg

SEQ ID NO: 4578695 - DNA, 18 bp, Homo sapiens
tattggaaatggatgcaa

SEQ ID NO: 4578696 - DNA, 19 bp, Homo sapiens
tattggaaatggatgcaaa

SEQ ID NO: 4578697 - DNA, 23 bp, Homo sapiens
tattggatctattgatttgaaaa

SEQ ID NO: 4578698 - DNA, 13 bp, Homo sapiens
tattggcaaagtt

SEQ ID NO: 4578699 - DNA, 20 bp, Homo sapiens
tattggcttgataaacataa

SEQ ID NO: 4578700 - DNA, 20 bp, Homo sapiens
tattgggcacagcctagggt

SEQ ID NO: 4578701 - DNA, 18 bp, Homo sapiens
tattggggaattaaatag

SEQ ID NO: 4578702 - DNA, 21 bp, Homo sapiens
tattggggaattaaatagtgt

SEQ ID NO: 4578703 - DNA, 19 bp, Homo sapiens
tattgggtgtagatttctg

SEQ ID NO: 4578704 - DNA, 14 bp, Homo sapiens
tattggtttgcaca

SEQ ID NO: 4578705 - DNA, 20 bp, Homo sapiens
tattggttttaaaaaagcat

SEQ ID NO: 4578706 - DNA, 17 bp, Homo sapiens
tattgtaaattttagaa

SEQ ID NO: 4578707 - DNA, 11 bp, Homo sapiens
tattgtaatat

SEQ ID NO: 4578708 - DNA, 23 bp, Homo sapiens
tattgtaatatagaaaaaaacat

SEQ ID NO: 4578709 - DNA, 21 bp, Homo sapiens
tattgtaatgagtgaattgaa

SEQ ID NO: 4578710 - DNA, 13 bp, Homo sapiens
tattgtacagttt

SEQ ID NO: 4578711 - DNA, 13 bp, Homo sapiens
tattgtagtttga

SEQ ID NO: 4578712 - DNA, 12 bp, Homo sapiens
tattgtattaag

SEQ ID NO: 4578713 - DNA, 17 bp, Homo sapiens
tattgtattgttagatg

SEQ ID NO: 4578714 - DNA, 18 bp, Homo sapiens
tattgtattgttagatgt

SEQ ID NO: 4578715 - DNA, 14 bp, Homo sapiens
tattgtcagccatc

SEQ ID NO: 4578716 - DNA, 14 bp, Homo sapiens
tattgtccaccatg

SEQ ID NO: 4578717 - DNA, 17 bp, Homo sapiens
tattgtccattgtccaa

SEQ ID NO: 4578718 - DNA, 20 bp, Homo sapiens
tattgtcctcccctatttta

SEQ ID NO: 4578719 - DNA, 15 bp, Homo sapiens
tattgtctgtctaca

SEQ ID NO: 4578720 - DNA, 15 bp, Homo sapiens
tattgtgactcttct

SEQ ID NO: 4578721 - DNA, 16 bp, Homo sapiens
tattgtgtttgtgtat

SEQ ID NO: 4578722 - DNA, 22 bp, Homo sapiens
tattgttacgtagcctaaggct

SEQ ID NO: 4578723 - DNA, 15 bp, Homo sapiens
tattgttagaaaatg

SEQ ID NO: 4578724 - DNA, 14 bp, Homo sapiens
tattgttagatgtt

SEQ ID NO: 4578725 - DNA, 16 bp, Homo sapiens
tattgttctttcatat

SEQ ID NO: 4578726 - DNA, 16 bp, Homo sapiens
tattgtttaaaatcat

SEQ ID NO: 4578727 - DNA, 14 bp, Homo sapiens
tattgtttctacaa

SEQ ID NO: 4578728 - DNA, 18 bp, Homo sapiens
tattgtttgatgttttta

SEQ ID NO: 4578729 - DNA, 13 bp, Homo sapiens
tattgtttgctgt

SEQ ID NO: 4578730 - DNA, 20 bp, Homo sapiens
tattgttttacaatagttct

SEQ ID NO: 4578731 - DNA, 23 bp, Homo sapiens
tattgtttttggatggcttaagc

SEQ ID NO: 4578732 - DNA, 20 bp, Homo sapiens
tatttaaaaaactaaaaact

SEQ ID NO: 4578733 - DNA, 16 bp, Homo sapiens
tatttaaaaaattaaa

SEQ ID NO: 4578734 - DNA, 17 bp, Homo sapiens
tatttaaaaaattaaaa

SEQ ID NO: 4578735 - DNA, 23 bp, Homo sapiens
tatttaaaaataagtcaacagta

SEQ ID NO: 4578736 - DNA, 13 bp, Homo sapiens
tatttaaaaatgt

SEQ ID NO: 4578737 - DNA, 15 bp, Homo sapiens
tatttaaaaatgtct

SEQ ID NO: 4578738 - DNA, 17 bp, Homo sapiens
tatttaaaaatgtcttg

SEQ ID NO: 4578739 - DNA, 18 bp, Homo sapiens
tatttaaaaatgtcttgc

SEQ ID NO: 4578740 - DNA, 23 bp, Homo sapiens
tatttaaaactctggtgataaaa

SEQ ID NO: 4578741 - DNA, 15 bp, Homo sapiens
tatttaaaatagcaa

SEQ ID NO: 4578742 - DNA, 23 bp, Homo sapiens
tatttaaaatgctcaatttcagc

SEQ ID NO: 4578743 - DNA, 21 bp, Homo sapiens
tatttaaaccgctaaaagaaa

SEQ ID NO: 4578744 - DNA, 16 bp, Homo sapiens
tatttaaactttcaat

SEQ ID NO: 4578745 - DNA, 21 bp, Homo sapiens
tatttaaactttcaatatttt

SEQ ID NO: 4578746 - DNA, 13 bp, Homo sapiens
tatttaaagttgt

SEQ ID NO: 4578747 - DNA, 15 bp, Homo sapiens
tatttaaattctttt

SEQ ID NO: 4578748 - DNA, 18 bp, Homo sapiens
tatttaacaaaaaatgta

SEQ ID NO: 4578749 - DNA, 15 bp, Homo sapiens
tatttaacaagatgt

SEQ ID NO: 4578750 - DNA, 17 bp, Homo sapiens
tatttaacaagatgttt

SEQ ID NO: 4578751 - DNA, 14 bp, Homo sapiens
tatttaacagaaat

SEQ ID NO: 4578752 - DNA, 19 bp, Homo sapiens
tatttaacagaaattgtat

SEQ ID NO: 4578753 - DNA, 12 bp, Homo sapiens
tatttaacattt

SEQ ID NO: 4578754 - DNA, 13 bp, Homo sapiens
tatttaactacat

SEQ ID NO: 4578755 - DNA, 16 bp, Homo sapiens
tatttaactgattaaa

SEQ ID NO: 4578756 - DNA, 21 bp, Homo sapiens
tatttaagatatatacatgga

SEQ ID NO: 4578757 - DNA, 23 bp, Homo sapiens
tatttaagatgtacatttaataa

SEQ ID NO: 4578758 - DNA, 13 bp, Homo sapiens
tatttaagcaaat

SEQ ID NO: 4578759 - DNA, 14 bp, Homo sapiens
tatttaagcataat

SEQ ID NO: 4578760 - DNA, 22 bp, Homo sapiens
tatttaagctttaaatgacagt

SEQ ID NO: 4578761 - DNA, 22 bp, Homo sapiens
tatttaagtagtgggcatttca

SEQ ID NO: 4578762 - DNA, 18 bp, Homo sapiens
tatttaagtgaaggagaa

SEQ ID NO: 4578763 - DNA, 22 bp, Homo sapiens
tatttaagtttgttgctgtcaa

SEQ ID NO: 4578764 - DNA, 22 bp, Homo sapiens
tatttaatagcaaagaattgac

SEQ ID NO: 4578765 - DNA, 15 bp, Homo sapiens
tatttaatatgctta

SEQ ID NO: 4578766 - DNA, 22 bp, Homo sapiens
tatttaatgacacaccttggat

SEQ ID NO: 4578767 - DNA, 21 bp, Homo sapiens
tatttaatgccgatatactct

SEQ ID NO: 4578768 - DNA, 12 bp, Homo sapiens
tatttaatgttt

SEQ ID NO: 4578769 - DNA, 15 bp, Homo sapiens
tatttaatgttttaa

SEQ ID NO: 4578770 - DNA, 17 bp, Homo sapiens
tatttaatgttttaaat

SEQ ID NO: 4578771 - DNA, 13 bp, Homo sapiens
tatttaattgtaa

SEQ ID NO: 4578772 - DNA, 14 bp, Homo sapiens
tatttaattgtaaa

SEQ ID NO: 4578773 - DNA, 16 bp, Homo sapiens
tatttaattgtaaact

SEQ ID NO: 4578774 - DNA, 16 bp, Homo sapiens
tatttaatttgaaggt

SEQ ID NO: 4578775 - DNA, 15 bp, Homo sapiens
tatttacaatgtatt

SEQ ID NO: 4578776 - DNA, 16 bp, Homo sapiens
tatttacaatgtatta

SEQ ID NO: 4578777 - DNA, 18 bp, Homo sapiens
tatttaccaaaaattttg

SEQ ID NO: 4578778 - DNA, 19 bp, Homo sapiens
tatttacgctttgattcat

SEQ ID NO: 4578779 - DNA, 19 bp, Homo sapiens
tatttacttcgttttggtt

SEQ ID NO: 4578780 - DNA, 13 bp, Homo sapiens
tatttacttttta

SEQ ID NO: 4578781 - DNA, 15 bp, Homo sapiens
tatttagaactttgt

SEQ ID NO: 4578782 - DNA, 19 bp, Homo sapiens
tatttagacaagagatggg

SEQ ID NO: 4578783 - DNA, 16 bp, Homo sapiens
tatttaggaaaatgct

SEQ ID NO: 4578784 - DNA, 19 bp, Homo sapiens
tatttagttacgtataatg

SEQ ID NO: 4578785 - DNA, 13 bp, Homo sapiens
tatttataaaaat

SEQ ID NO: 4578786 - DNA, 23 bp, Homo sapiens
tatttatgtgaacaactgtttgt

SEQ ID NO: 4578787 - DNA, 21 bp, Homo sapiens
tatttattaaacttcagcaac

SEQ ID NO: 4578788 - DNA, 20 bp, Homo sapiens
tatttattacataatttagt

SEQ ID NO: 4578789 - DNA, 20 bp, Homo sapiens
tatttattgaaatgatttca

SEQ ID NO: 4578790 - DNA, 14 bp, Homo sapiens
tatttattgagcat

SEQ ID NO: 4578791 - DNA, 16 bp, Homo sapiens
tatttattgagcatct

SEQ ID NO: 4578792 - DNA, 14 bp, Homo sapiens
tatttattgattaa

SEQ ID NO: 4578793 - DNA, 13 bp, Homo sapiens
tatttattgcatt

SEQ ID NO: 4578794 - DNA, 15 bp, Homo sapiens
tatttattgttagaa

SEQ ID NO: 4578795 - DNA, 15 bp, Homo sapiens
tatttatttaaaact

SEQ ID NO: 4578796 - DNA, 16 bp, Homo sapiens
tatttatttaaaactc

SEQ ID NO: 4578797 - DNA, 17 bp, Homo sapiens
tatttatttaaaactct

SEQ ID NO: 4578798 - DNA, 14 bp, Homo sapiens
tatttatttctagt

SEQ ID NO: 4578799 - DNA, 16 bp, Homo sapiens
tatttattttagcaaa

SEQ ID NO: 4578800 - DNA, 20 bp, Homo sapiens
tatttatttttacctgcttt

SEQ ID NO: 4578801 - DNA, 22 bp, Homo sapiens
tatttatttttacctgcttttt

SEQ ID NO: 4578802 - DNA, 15 bp, Homo sapiens
tatttatttttcttg

SEQ ID NO: 4578803 - DNA, 13 bp, Homo sapiens
tatttcaaaatga

SEQ ID NO: 4578804 - DNA, 11 bp, Homo sapiens
tatttcaagtg

SEQ ID NO: 4578805 - DNA, 12 bp, Homo sapiens
tatttcaagtgc

SEQ ID NO: 4578806 - DNA, 22 bp, Homo sapiens
tatttcaagtgcctagactgtt

SEQ ID NO: 4578807 - DNA, 22 bp, Homo sapiens
tatttcaataaatctttcaaaa

SEQ ID NO: 4578808 - DNA, 15 bp, Homo sapiens
tatttcaatgtaatt

SEQ ID NO: 4578809 - DNA, 19 bp, Homo sapiens
tatttcaatgtaattaaac

SEQ ID NO: 4578810 - DNA, 11 bp, Homo sapiens
tatttcactta

SEQ ID NO: 4578811 - DNA, 19 bp, Homo sapiens
tatttcacttaaactttgt

SEQ ID NO: 4578812 - DNA, 19 bp, Homo sapiens
tatttcagatgtaatgttt

SEQ ID NO: 4578813 - DNA, 21 bp, Homo sapiens
tatttcagatgtaatgttttc

SEQ ID NO: 4578814 - DNA, 16 bp, Homo sapiens
tatttcagattttgat

SEQ ID NO: 4578815 - DNA, 23 bp, Homo sapiens
tatttcagcccccatcacccaag

SEQ ID NO: 4578816 - DNA, 16 bp, Homo sapiens
tatttcagctgctttg

SEQ ID NO: 4578817 - DNA, 21 bp, Homo sapiens
tatttcagtgatttttagtaa

SEQ ID NO: 4578818 - DNA, 22 bp, Homo sapiens
tatttcatgtggtgaatatgca

SEQ ID NO: 4578819 - DNA, 23 bp, Homo sapiens
tatttcatgtggtgaatatgcaa

SEQ ID NO: 4578820 - DNA, 13 bp, Homo sapiens
tatttcatttctt

SEQ ID NO: 4578821 - DNA, 20 bp, Homo sapiens
tatttcatttgctgttcatc

SEQ ID NO: 4578822 - DNA, 16 bp, Homo sapiens
tatttccaaaagcaca

SEQ ID NO: 4578823 - DNA, 18 bp, Homo sapiens
tatttccaaacctggttc

SEQ ID NO: 4578824 - DNA, 16 bp, Homo sapiens
tatttcgaccctgggg

SEQ ID NO: 4578825 - DNA, 23 bp, Homo sapiens
tatttctccatcccctccctgcc

SEQ ID NO: 4578826 - DNA, 16 bp, Homo sapiens
tatttctcctttgcaa

SEQ ID NO: 4578827 - DNA, 19 bp, Homo sapiens
tatttctcctttgcaatag

SEQ ID NO: 4578828 - DNA, 22 bp, Homo sapiens
tatttctcctttgcaatagcag

SEQ ID NO: 4578829 - DNA, 19 bp, Homo sapiens
tatttctcgggtgcatttg

SEQ ID NO: 4578830 - DNA, 16 bp, Homo sapiens
tatttctctggcaaac

SEQ ID NO: 4578831 - DNA, 16 bp, Homo sapiens
tatttctgatttcata

SEQ ID NO: 4578832 - DNA, 21 bp, Homo sapiens
tatttctgatttcataattca

SEQ ID NO: 4578833 - DNA, 22 bp, Homo sapiens
tatttctgatttcataattcag

SEQ ID NO: 4578834 - DNA, 15 bp, Homo sapiens
tatttctgctttctt

SEQ ID NO: 4578835 - DNA, 18 bp, Homo sapiens
tatttctggtgtatattt

SEQ ID NO: 4578836 - DNA, 20 bp, Homo sapiens
tatttctgtgaaagaagtat

SEQ ID NO: 4578837 - DNA, 15 bp, Homo sapiens
tatttctgttatttt

SEQ ID NO: 4578838 - DNA, 20 bp, Homo sapiens
tatttcttaagaattcaaat

SEQ ID NO: 4578839 - DNA, 18 bp, Homo sapiens
tatttcttaattattata

SEQ ID NO: 4578840 - DNA, 14 bp, Homo sapiens
tatttcttcaaata

SEQ ID NO: 4578841 - DNA, 23 bp, Homo sapiens
tatttcttcaaatatctctattt

SEQ ID NO: 4578842 - DNA, 13 bp, Homo sapiens
tatttcttccctg

SEQ ID NO: 4578843 - DNA, 23 bp, Homo sapiens
tatttcttcttctaagaagacat

SEQ ID NO: 4578844 - DNA, 23 bp, Homo sapiens
tatttcttgaagaataaattcta

SEQ ID NO: 4578845 - DNA, 14 bp, Homo sapiens
tatttcttgctttc

SEQ ID NO: 4578846 - DNA, 20 bp, Homo sapiens
tatttgaaaacatgtttatt

SEQ ID NO: 4578847 - DNA, 15 bp, Homo sapiens
tatttgaaatagtat

SEQ ID NO: 4578848 - DNA, 22 bp, Homo sapiens
tatttgaaatagtatacattgt

SEQ ID NO: 4578849 - DNA, 17 bp, Homo sapiens
tatttgaattatttctg

SEQ ID NO: 4578850 - DNA, 16 bp, Homo sapiens
tatttgagactagttt

SEQ ID NO: 4578851 - DNA, 14 bp, Homo sapiens
tatttgatgtacat

SEQ ID NO: 4578852 - DNA, 15 bp, Homo sapiens
tatttgattcaaaat

SEQ ID NO: 4578853 - DNA, 15 bp, Homo sapiens
tatttgccaatgtat

SEQ ID NO: 4578854 - DNA, 18 bp, Homo sapiens
tatttgctgacaaccatt

SEQ ID NO: 4578855 - DNA, 17 bp, Homo sapiens
tatttggaaataaagtc

SEQ ID NO: 4578856 - DNA, 18 bp, Homo sapiens
tatttggatttagagcag

SEQ ID NO: 4578857 - DNA, 22 bp, Homo sapiens
tatttgggagggaaaagggaag

SEQ ID NO: 4578858 - DNA, 23 bp, Homo sapiens
tatttgggagggaaaagggaagt

SEQ ID NO: 4578859 - DNA, 22 bp, Homo sapiens
tatttgtaaatttatgtgatgg

SEQ ID NO: 4578860 - DNA, 17 bp, Homo sapiens
tatttgtaagatatttg

SEQ ID NO: 4578861 - DNA, 15 bp, Homo sapiens
tatttgtaatagatg

SEQ ID NO: 4578862 - DNA, 14 bp, Homo sapiens
tatttgtagtgtta

SEQ ID NO: 4578863 - DNA, 20 bp, Homo sapiens
tatttgtatgtttttctgta

SEQ ID NO: 4578864 - DNA, 15 bp, Homo sapiens
tatttgtctgtaaaa

SEQ ID NO: 4578865 - DNA, 19 bp, Homo sapiens
tatttgtcttaaaaaatgt

SEQ ID NO: 4578866 - DNA, 22 bp, Homo sapiens
tatttgttacttttagttctat

SEQ ID NO: 4578867 - DNA, 19 bp, Homo sapiens
tatttgttatatataataa

SEQ ID NO: 4578868 - DNA, 21 bp, Homo sapiens
tatttgttatatataataaat

SEQ ID NO: 4578869 - DNA, 21 bp, Homo sapiens
tatttgtttagttcagcaaaa

SEQ ID NO: 4578870 - DNA, 13 bp, Homo sapiens
tattttaaaatat

SEQ ID NO: 4578871 - DNA, 14 bp, Homo sapiens
tattttaaaatttg

SEQ ID NO: 4578872 - DNA, 14 bp, Homo sapiens
tattttaaagaatt

SEQ ID NO: 4578873 - DNA, 13 bp, Homo sapiens
tattttaaatatc

SEQ ID NO: 4578874 - DNA, 20 bp, Homo sapiens
tattttaaattataaggact

SEQ ID NO: 4578875 - DNA, 14 bp, Homo sapiens
tattttaaattctc

SEQ ID NO: 4578876 - DNA, 13 bp, Homo sapiens
tattttaactttt

SEQ ID NO: 4578877 - DNA, 14 bp, Homo sapiens
tattttaacttttt

SEQ ID NO: 4578878 - DNA, 18 bp, Homo sapiens
tattttaagactgatttt

SEQ ID NO: 4578879 - DNA, 15 bp, Homo sapiens
tattttaataaagta

SEQ ID NO: 4578880 - DNA, 13 bp, Homo sapiens
tattttaatgtac

SEQ ID NO: 4578881 - DNA, 13 bp, Homo sapiens
tattttaatttta

SEQ ID NO: 4578882 - DNA, 14 bp, Homo sapiens
tattttacaatttt

SEQ ID NO: 4578883 - DNA, 18 bp, Homo sapiens
tattttacagctcattaa

SEQ ID NO: 4578884 - DNA, 21 bp, Homo sapiens
tattttacagctcattaaact

SEQ ID NO: 4578885 - DNA, 21 bp, Homo sapiens
tattttacttttctgccaaaa

SEQ ID NO: 4578886 - DNA, 18 bp, Homo sapiens
tattttagaaagctaaat

SEQ ID NO: 4578887 - DNA, 13 bp, Homo sapiens
tattttagattac

SEQ ID NO: 4578888 - DNA, 20 bp, Homo sapiens
tattttagcagttctgcaaa

SEQ ID NO: 4578889 - DNA, 21 bp, Homo sapiens
tattttagcagttctgcaaat

SEQ ID NO: 4578890 - DNA, 21 bp, Homo sapiens
tattttagggttctaaatgca

SEQ ID NO: 4578891 - DNA, 23 bp, Homo sapiens
tattttagggttctaaatgcaat

SEQ ID NO: 4578892 - DNA, 13 bp, Homo sapiens
tattttagtatac

SEQ ID NO: 4578893 - DNA, 21 bp, Homo sapiens
tattttagtatacgtataaat

SEQ ID NO: 4578894 - DNA, 20 bp, Homo sapiens
tattttagtgtgtaaaatta

SEQ ID NO: 4578895 - DNA, 19 bp, Homo sapiens
tattttataggggatactt

SEQ ID NO: 4578896 - DNA, 15 bp, Homo sapiens
tattttatataataa

SEQ ID NO: 4578897 - DNA, 16 bp, Homo sapiens
tattttatatcataca

SEQ ID NO: 4578898 - DNA, 19 bp, Homo sapiens
tattttatatcatacagtt

SEQ ID NO: 4578899 - DNA, 14 bp, Homo sapiens
tattttatcctgta

SEQ ID NO: 4578900 - DNA, 17 bp, Homo sapiens
tattttatgaacattgt

SEQ ID NO: 4578901 - DNA, 18 bp, Homo sapiens
tattttatgaacattgta

SEQ ID NO: 4578902 - DNA, 16 bp, Homo sapiens
tattttattttattga

SEQ ID NO: 4578903 - DNA, 14 bp, Homo sapiens
tattttcaccattt

SEQ ID NO: 4578904 - DNA, 12 bp, Homo sapiens
tattttcagaat

SEQ ID NO: 4578905 - DNA, 20 bp, Homo sapiens
tattttcagaatctgaatgt

SEQ ID NO: 4578906 - DNA, 20 bp, Homo sapiens
tattttcagggttttaaaca

SEQ ID NO: 4578907 - DNA, 14 bp, Homo sapiens
tattttcattgtga

SEQ ID NO: 4578908 - DNA, 18 bp, Homo sapiens
tattttccagccttatgt

SEQ ID NO: 4578909 - DNA, 12 bp, Homo sapiens
tattttctgcaa

SEQ ID NO: 4578910 - DNA, 15 bp, Homo sapiens
tattttcttctaagt

SEQ ID NO: 4578911 - DNA, 13 bp, Homo sapiens
tattttcttggat

SEQ ID NO: 4578912 - DNA, 19 bp, Homo sapiens
tattttgacagaagctatt

SEQ ID NO: 4578913 - DNA, 12 bp, Homo sapiens
tattttgcaaac

SEQ ID NO: 4578914 - DNA, 14 bp, Homo sapiens
tattttgctggaat

SEQ ID NO: 4578915 - DNA, 16 bp, Homo sapiens
tattttggaggtgctt

SEQ ID NO: 4578916 - DNA, 23 bp, Homo sapiens
tattttggaggtgcttgatctat

SEQ ID NO: 4578917 - DNA, 20 bp, Homo sapiens
tattttggattgtatattgt

SEQ ID NO: 4578918 - DNA, 18 bp, Homo sapiens
tattttgtaaaatgtatt

SEQ ID NO: 4578919 - DNA, 22 bp, Homo sapiens
tattttgtaaaatgtattatgt

SEQ ID NO: 4578920 - DNA, 21 bp, Homo sapiens
tattttgtaatattctgtttt

SEQ ID NO: 4578921 - DNA, 16 bp, Homo sapiens
tattttgtaatattga

SEQ ID NO: 4578922 - DNA, 18 bp, Homo sapiens
tattttgttaacttttgt

SEQ ID NO: 4578923 - DNA, 17 bp, Homo sapiens
tattttgttgctttctt

SEQ ID NO: 4578924 - DNA, 15 bp, Homo sapiens
tatttttaaaggcat

SEQ ID NO: 4578925 - DNA, 24 bp, Homo sapiens
tatttttacagctactttaaccta

SEQ ID NO: 4578926 - DNA, 13 bp, Homo sapiens
tatttttagatgg

SEQ ID NO: 4578927 - DNA, 22 bp, Homo sapiens
tatttttagatggttacactgt

SEQ ID NO: 4578928 - DNA, 18 bp, Homo sapiens
tatttttatataatatct

SEQ ID NO: 4578929 - DNA, 19 bp, Homo sapiens
tatttttatatcatgcaaa

SEQ ID NO: 4578930 - DNA, 17 bp, Homo sapiens
tatttttatatttcctt

SEQ ID NO: 4578931 - DNA, 12 bp, Homo sapiens
tatttttatcca

SEQ ID NO: 4578932 - DNA, 14 bp, Homo sapiens
tatttttcagaaat

SEQ ID NO: 4578933 - DNA, 12 bp, Homo sapiens
tatttttcctgt

SEQ ID NO: 4578934 - DNA, 22 bp, Homo sapiens
tatttttcctgtcctgcccgtg

SEQ ID NO: 4578935 - DNA, 13 bp, Homo sapiens
tatttttctcttg

SEQ ID NO: 4578936 - DNA, 17 bp, Homo sapiens
tatttttctcttgtacc

SEQ ID NO: 4578937 - DNA, 19 bp, Homo sapiens
tatttttctcttgtaccat

SEQ ID NO: 4578938 - DNA, 15 bp, Homo sapiens
tatttttcttttaaa

SEQ ID NO: 4578939 - DNA, 18 bp, Homo sapiens
tatttttgactgtagcca

SEQ ID NO: 4578940 - DNA, 14 bp, Homo sapiens
tatttttgatgtat

SEQ ID NO: 4578941 - DNA, 12 bp, Homo sapiens
tatttttgtaaa

SEQ ID NO: 4578942 - DNA, 13 bp, Homo sapiens
tatttttgtaaac

SEQ ID NO: 4578943 - DNA, 13 bp, Homo sapiens
tatttttgtgtag

SEQ ID NO: 4578944 - DNA, 22 bp, Homo sapiens
tatttttgttgttgttgtttgt

SEQ ID NO: 4578945 - DNA, 11 bp, Homo sapiens
tattttttcaa

SEQ ID NO: 4578946 - DNA, 13 bp, Homo sapiens
tattttttgaaaa

SEQ ID NO: 4578947 - DNA, 21 bp, Homo sapiens
tattttttgaaggtttcagat

SEQ ID NO: 4578948 - DNA, 20 bp, Homo sapiens
tattttttttttttgaaaaa

SEQ ID NO: 4578949 - DNA, 19 bp, Homo sapiens
tcaaaaaaaaaaagattct

SEQ ID NO: 4578950 - DNA, 23 bp, Homo sapiens
tcaaaaaaaaacaaaaaaaatca

SEQ ID NO: 4578951 - DNA, 18 bp, Homo sapiens
tcaaaaaactctctccca

SEQ ID NO: 4578952 - DNA, 19 bp, Homo sapiens
tcaaaaaactctctcccag

SEQ ID NO: 4578953 - DNA, 21 bp, Homo sapiens
tcaaaaaactctctcccagga

SEQ ID NO: 4578954 - DNA, 18 bp, Homo sapiens
tcaaaaaatcatgtttat

SEQ ID NO: 4578955 - DNA, 16 bp, Homo sapiens
tcaaaaagcagaagga

SEQ ID NO: 4578956 - DNA, 19 bp, Homo sapiens
tcaaaaagctaatgtgcag

SEQ ID NO: 4578957 - DNA, 20 bp, Homo sapiens
tcaaaaataaaaaatctgaa

SEQ ID NO: 4578958 - DNA, 21 bp, Homo sapiens
tcaaaaatgattttattacct

SEQ ID NO: 4578959 - DNA, 15 bp, Homo sapiens
tcaaaaattaaatat

SEQ ID NO: 4578960 - DNA, 14 bp, Homo sapiens
tcaaaacctggaga

SEQ ID NO: 4578961 - DNA, 24 bp, Homo sapiens
tcaaaactggagtcccaaatgtca

SEQ ID NO: 4578962 - DNA, 20 bp, Homo sapiens
tcaaaacttggacccttgga

SEQ ID NO: 4578963 - DNA, 22 bp, Homo sapiens
tcaaaacttggacccttggaaa

SEQ ID NO: 4578964 - DNA, 18 bp, Homo sapiens
tcaaaagaaagaaaatca

SEQ ID NO: 4578965 - DNA, 21 bp, Homo sapiens
tcaaaagaatctattagattt

SEQ ID NO: 4578966 - DNA, 19 bp, Homo sapiens
tcaaaagatccttcatttt

SEQ ID NO: 4578967 - DNA, 13 bp, Homo sapiens
tcaaaaggtgcct

SEQ ID NO: 4578968 - DNA, 23 bp, Homo sapiens
tcaaaaggtgcctgtgaggcagg

SEQ ID NO: 4578969 - DNA, 20 bp, Homo sapiens
tcaaaataaagattctcaca

SEQ ID NO: 4578970 - DNA, 21 bp, Homo sapiens
tcaaaataccatgccatttaa

SEQ ID NO: 4578971 - DNA, 23 bp, Homo sapiens
tcaaaataccatgccatttaaag

SEQ ID NO: 4578972 - DNA, 12 bp, Homo sapiens
tcaaaatacttc

SEQ ID NO: 4578973 - DNA, 18 bp, Homo sapiens
tcaaaatagacaagtttt

SEQ ID NO: 4578974 - DNA, 22 bp, Homo sapiens
tcaaaatattgagcagaattca

SEQ ID NO: 4578975 - DNA, 12 bp, Homo sapiens
tcaaaatattta

SEQ ID NO: 4578976 - DNA, 21 bp, Homo sapiens
tcaaaatatttaaaaatgtct

SEQ ID NO: 4578977 - DNA, 19 bp, Homo sapiens
tcaaaatctagaagagtct

SEQ ID NO: 4578978 - DNA, 14 bp, Homo sapiens
tcaaaatgaatttt

SEQ ID NO: 4578979 - DNA, 12 bp, Homo sapiens
tcaaaatgcttt

SEQ ID NO: 4578980 - DNA, 15 bp, Homo sapiens
tcaaacaacactggt

SEQ ID NO: 4578981 - DNA, 13 bp, Homo sapiens
tcaaacagtctca

SEQ ID NO: 4578982 - DNA, 21 bp, Homo sapiens
tcaaacagtctcaggaaatca

SEQ ID NO: 4578983 - DNA, 20 bp, Homo sapiens
tcaaacattcgtgagctggg

SEQ ID NO: 4578984 - DNA, 22 bp, Homo sapiens
tcaaacattcgtgagctgggga

SEQ ID NO: 4578985 - DNA, 20 bp, Homo sapiens
tcaaaccatattttttatga

SEQ ID NO: 4578986 - DNA, 17 bp, Homo sapiens
tcaaactcattgcagca

SEQ ID NO: 4578987 - DNA, 20 bp, Homo sapiens
tcaaactcattgcagcagat

SEQ ID NO: 4578988 - DNA, 17 bp, Homo sapiens
tcaaactgtagaaatga

SEQ ID NO: 4578989 - DNA, 20 bp, Homo sapiens
tcaaactgtagaaatgatga

SEQ ID NO: 4578990 - DNA, 19 bp, Homo sapiens
tcaaacttgtggcctcaag

SEQ ID NO: 4578991 - DNA, 14 bp, Homo sapiens
tcaaacttttgaaa

SEQ ID NO: 4578992 - DNA, 15 bp, Homo sapiens
tcaaagaaagtgtat

SEQ ID NO: 4578993 - DNA, 14 bp, Homo sapiens
tcaaagaaggcatt

SEQ ID NO: 4578994 - DNA, 20 bp, Homo sapiens
tcaaagaagtactttattgc

SEQ ID NO: 4578995 - DNA, 17 bp, Homo sapiens
tcaaagagaagatgcct

SEQ ID NO: 4578996 - DNA, 18 bp, Homo sapiens
tcaaagagaagatgcctg

SEQ ID NO: 4578997 - DNA, 19 bp, Homo sapiens
tcaaagagaagatgcctgt

SEQ ID NO: 4578998 - DNA, 23 bp, Homo sapiens
tcaaagagaagatgcctgttaat

SEQ ID NO: 4578999 - DNA, 19 bp, Homo sapiens
tcaaagaggtgaacattaa

SEQ ID NO: 4579000 - DNA, 23 bp, Homo sapiens
tcaaagaggtgaacattaaaata

SEQ ID NO: 4579001 - DNA, 15 bp, Homo sapiens
tcaaagatgataatt

SEQ ID NO: 4579002 - DNA, 15 bp, Homo sapiens
tcaaagcaagcattc

SEQ ID NO: 4579003 - DNA, 19 bp, Homo sapiens
tcaaagcaagcattcagaa

SEQ ID NO: 4579004 - DNA, 21 bp, Homo sapiens
tcaaagcaagcattcagaaga

SEQ ID NO: 4579005 - DNA, 22 bp, Homo sapiens
tcaaagcaagcattcagaagaa

SEQ ID NO: 4579006 - DNA, 15 bp, Homo sapiens
tcaaagcaaggaaac

SEQ ID NO: 4579007 - DNA, 15 bp, Homo sapiens
tcaaaggaatataag

SEQ ID NO: 4579008 - DNA, 19 bp, Homo sapiens
tcaaaggaatataagaaaa

SEQ ID NO: 4579009 - DNA, 23 bp, Homo sapiens
tcaaaggaatataagaaaagtaa

SEQ ID NO: 4579010 - DNA, 22 bp, Homo sapiens
tcaaaggtcgggacagctgtgc

SEQ ID NO: 4579011 - DNA, 16 bp, Homo sapiens
tcaaagtaaggctggt

SEQ ID NO: 4579012 - DNA, 21 bp, Homo sapiens
tcaaagtggtaaatactgtga

SEQ ID NO: 4579013 - DNA, 13 bp, Homo sapiens
tcaaagtttaata

SEQ ID NO: 4579014 - DNA, 19 bp, Homo sapiens
tcaaataaaaattctagat

SEQ ID NO: 4579015 - DNA, 15 bp, Homo sapiens
tcaaatacatgcaca

SEQ ID NO: 4579016 - DNA, 16 bp, Homo sapiens
tcaaatacatgcacag

SEQ ID NO: 4579017 - DNA, 20 bp, Homo sapiens
tcaaatacatgcacagtcat

SEQ ID NO: 4579018 - DNA, 23 bp, Homo sapiens
tcaaataggctattaaaaaagtc

SEQ ID NO: 4579019 - DNA, 14 bp, Homo sapiens
tcaaatatgcaaag

SEQ ID NO: 4579020 - DNA, 20 bp, Homo sapiens
tcaaatcaagaaacttaagg

SEQ ID NO: 4579021 - DNA, 17 bp, Homo sapiens
tcaaatcagtgataatt

SEQ ID NO: 4579022 - DNA, 15 bp, Homo sapiens
tcaaatcctcttttg

SEQ ID NO: 4579023 - DNA, 18 bp, Homo sapiens
tcaaatcctcttttgtat

SEQ ID NO: 4579024 - DNA, 13 bp, Homo sapiens
tcaaatctgtaat

SEQ ID NO: 4579025 - DNA, 15 bp, Homo sapiens
tcaaatgaaatgtat

SEQ ID NO: 4579026 - DNA, 21 bp, Homo sapiens
tcaaatgaataatgcctttgt

SEQ ID NO: 4579027 - DNA, 13 bp, Homo sapiens
tcaaatgatttca

SEQ ID NO: 4579028 - DNA, 14 bp, Homo sapiens
tcaaatgatttcat

SEQ ID NO: 4579029 - DNA, 19 bp, Homo sapiens
tcaaatgatttcatattga

SEQ ID NO: 4579030 - DNA, 20 bp, Homo sapiens
tcaaatgcagtatatttctt

SEQ ID NO: 4579031 - DNA, 23 bp, Homo sapiens
tcaaatgcgcgtgtgcacgtgtg

SEQ ID NO: 4579032 - DNA, 18 bp, Homo sapiens
tcaaatgtgcaatttgta

SEQ ID NO: 4579033 - DNA, 22 bp, Homo sapiens
tcaaatgtgcaatttgtaaata

SEQ ID NO: 4579034 - DNA, 18 bp, Homo sapiens
tcaaatgttagatattgc

SEQ ID NO: 4579035 - DNA, 22 bp, Homo sapiens
tcaaattaagattctctgccca

SEQ ID NO: 4579036 - DNA, 12 bp, Homo sapiens
tcaaattactaa

SEQ ID NO: 4579037 - DNA, 15 bp, Homo sapiens
tcaaattactaatga

SEQ ID NO: 4579038 - DNA, 23 bp, Homo sapiens
tcaaattattaatctgaaaatag

SEQ ID NO: 4579039 - DNA, 15 bp, Homo sapiens
tcaaattcagctctg

SEQ ID NO: 4579040 - DNA, 14 bp, Homo sapiens
tcaaattcttctga

SEQ ID NO: 4579041 - DNA, 21 bp, Homo sapiens
tcaaattcttctgaactcaaa

SEQ ID NO: 4579042 - DNA, 12 bp, Homo sapiens
tcaaattgctgc

SEQ ID NO: 4579043 - DNA, 23 bp, Homo sapiens
tcaaatttagaaactaattgact

SEQ ID NO: 4579044 - DNA, 14 bp, Homo sapiens
tcaaatttgtaata

SEQ ID NO: 4579045 - DNA, 15 bp, Homo sapiens
tcaaatttgtaataa

SEQ ID NO: 4579046 - DNA, 21 bp, Homo sapiens
tcaaatttgtaataaaactat

SEQ ID NO: 4579047 - DNA, 14 bp, Homo sapiens
tcaaattttttgac

SEQ ID NO: 4579048 - DNA, 14 bp, Homo sapiens
tcaacaaagaaaca

SEQ ID NO: 4579049 - DNA, 17 bp, Homo sapiens
tcaacaagaagaatttg

SEQ ID NO: 4579050 - DNA, 22 bp, Homo sapiens
tcaacaccttaatatgctgcaa

SEQ ID NO: 4579051 - DNA, 14 bp, Homo sapiens
tcaacagacaatta

SEQ ID NO: 4579052 - DNA, 17 bp, Homo sapiens
tcaacagagaaggcagg

SEQ ID NO: 4579053 - DNA, 19 bp, Homo sapiens
tcaacaggagggcagcccg

SEQ ID NO: 4579054 - DNA, 18 bp, Homo sapiens
tcaacagtaaaccactga

SEQ ID NO: 4579055 - DNA, 14 bp, Homo sapiens
tcaacagtgttttc

SEQ ID NO: 4579056 - DNA, 22 bp, Homo sapiens
tcaacatacattggttttgaaa

SEQ ID NO: 4579057 - DNA, 20 bp, Homo sapiens
tcaacatagtgagacactgt

SEQ ID NO: 4579058 - DNA, 16 bp, Homo sapiens
tcaacattccagggat

SEQ ID NO: 4579059 - DNA, 22 bp, Homo sapiens
tcaacatttttttttctccata

SEQ ID NO: 4579060 - DNA, 15 bp, Homo sapiens
tcaaccaatgtagaa

SEQ ID NO: 4579061 - DNA, 14 bp, Homo sapiens
tcaacccccctccc

SEQ ID NO: 4579062 - DNA, 16 bp, Homo sapiens
tcaacccccctcccag

SEQ ID NO: 4579063 - DNA, 20 bp, Homo sapiens
tcaacccccctcccagacag

SEQ ID NO: 4579064 - DNA, 17 bp, Homo sapiens
tcaacctggtggcacca

SEQ ID NO: 4579065 - DNA, 21 bp, Homo sapiens
tcaacctggtggcaccagatg

SEQ ID NO: 4579066 - DNA, 13 bp, Homo sapiens
tcaacctgtaaat

SEQ ID NO: 4579067 - DNA, 19 bp, Homo sapiens
tcaaccttcaagtatccaa

SEQ ID NO: 4579068 - DNA, 16 bp, Homo sapiens
tcaacggggggctcct

SEQ ID NO: 4579069 - DNA, 18 bp, Homo sapiens
tcaacggggggctcctgc

SEQ ID NO: 4579070 - DNA, 20 bp, Homo sapiens
tcaacggggggctcctgccc

SEQ ID NO: 4579071 - DNA, 22 bp, Homo sapiens
tcaacggggggctcctgcccag

SEQ ID NO: 4579072 - DNA, 23 bp, Homo sapiens
tcaacggggggctcctgcccagg

SEQ ID NO: 4579073 - DNA, 15 bp, Homo sapiens
tcaacgtattgtttc

SEQ ID NO: 4579074 - DNA, 12 bp, Homo sapiens
tcaactgcccag

SEQ ID NO: 4579075 - DNA, 15 bp, Homo sapiens
tcaactgcccagcaa

SEQ ID NO: 4579076 - DNA, 18 bp, Homo sapiens
tcaactggggggcaattt

SEQ ID NO: 4579077 - DNA, 20 bp, Homo sapiens
tcaacttcagttgaaaagag

SEQ ID NO: 4579078 - DNA, 12 bp, Homo sapiens
tcaactttgaat

SEQ ID NO: 4579079 - DNA, 14 bp, Homo sapiens
tcaactttgaataa

SEQ ID NO: 4579080 - DNA, 16 bp, Homo sapiens
tcaactttgaataaag

SEQ ID NO: 4579081 - DNA, 18 bp, Homo sapiens
tcaactttgaataaagaa

SEQ ID NO: 4579082 - DNA, 14 bp, Homo sapiens
tcaacttttaactt

SEQ ID NO: 4579083 - DNA, 21 bp, Homo sapiens
tcaactttttattgccttctc

SEQ ID NO: 4579084 - DNA, 14 bp, Homo sapiens
tcaagaaaagaatt

SEQ ID NO: 4579085 - DNA, 17 bp, Homo sapiens
tcaagaaataagttttt

SEQ ID NO: 4579086 - DNA, 11 bp, Homo sapiens
tcaagaaatga

SEQ ID NO: 4579087 - DNA, 18 bp, Homo sapiens
tcaagaatctagaagatg

SEQ ID NO: 4579088 - DNA, 19 bp, Homo sapiens
tcaagaatctagaagatgt

SEQ ID NO: 4579089 - DNA, 20 bp, Homo sapiens
tcaagaatctagaagatgtg

SEQ ID NO: 4579090 - DNA, 23 bp, Homo sapiens
tcaagaatctagaagatgtgtaa

SEQ ID NO: 4579091 - DNA, 19 bp, Homo sapiens
tcaagacagatgagcagga

SEQ ID NO: 4579092 - DNA, 14 bp, Homo sapiens
tcaagaccagcctg

SEQ ID NO: 4579093 - DNA, 23 bp, Homo sapiens
tcaagacccccatttgtcccaga

SEQ ID NO: 4579094 - DNA, 18 bp, Homo sapiens
tcaagactatctacaaaa

SEQ ID NO: 4579095 - DNA, 17 bp, Homo sapiens
tcaagagcatgcacatg

SEQ ID NO: 4579096 - DNA, 13 bp, Homo sapiens
tcaagagctgccc

SEQ ID NO: 4579097 - DNA, 15 bp, Homo sapiens
tcaagaggaatctgt

SEQ ID NO: 4579098 - DNA, 22 bp, Homo sapiens
tcaagaggaatctgtttctctg

SEQ ID NO: 4579099 - DNA, 23 bp, Homo sapiens
tcaagaggaatctgtttctctgc

SEQ ID NO: 4579100 - DNA, 15 bp, Homo sapiens
tcaagataaggagaa

SEQ ID NO: 4579101 - DNA, 21 bp, Homo sapiens
tcaagatatatgtgtatacat

SEQ ID NO: 4579102 - DNA, 18 bp, Homo sapiens
tcaagattttttttgtaa

SEQ ID NO: 4579103 - DNA, 19 bp, Homo sapiens
tcaagattttttttgtaac

SEQ ID NO: 4579104 - DNA, 23 bp, Homo sapiens
tcaagcaagatgagctgtgcgct

SEQ ID NO: 4579105 - DNA, 22 bp, Homo sapiens
tcaagcaatccacctgccttgg

SEQ ID NO: 4579106 - DNA, 18 bp, Homo sapiens
tcaagcaatcctcctgcc

SEQ ID NO: 4579107 - DNA, 23 bp, Homo sapiens
tcaagcactaaaaagttgaacca

SEQ ID NO: 4579108 - DNA, 17 bp, Homo sapiens
tcaagcacttcccagga

SEQ ID NO: 4579109 - DNA, 18 bp, Homo sapiens
tcaagcatgtttaaaaca

SEQ ID NO: 4579110 - DNA, 20 bp, Homo sapiens
tcaagccctcctccccagag

SEQ ID NO: 4579111 - DNA, 17 bp, Homo sapiens
tcaagcctctaaacaga

SEQ ID NO: 4579112 - DNA, 15 bp, Homo sapiens
tcaagcctgtgcaaa

SEQ ID NO: 4579113 - DNA, 20 bp, Homo sapiens
tcaagcctgtgggagtagaa

SEQ ID NO: 4579114 - DNA, 15 bp, Homo sapiens
tcaagcgattctcct

SEQ ID NO: 4579115 - DNA, 19 bp, Homo sapiens
tcaagcgctatccacagaa

SEQ ID NO: 4579116 - DNA, 23 bp, Homo sapiens
tcaagctgttatttcttccctgc

SEQ ID NO: 4579117 - DNA, 19 bp, Homo sapiens
tcaagctgttgaagtctca

SEQ ID NO: 4579118 - DNA, 17 bp, Homo sapiens
tcaaggaaaagttcttt

SEQ ID NO: 4579119 - DNA, 14 bp, Homo sapiens
tcaaggaatcggct

SEQ ID NO: 4579120 - DNA, 19 bp, Homo sapiens
tcaaggaatttcttaactt

SEQ ID NO: 4579121 - DNA, 16 bp, Homo sapiens
tcaaggacaggagcct

SEQ ID NO: 4579122 - DNA, 20 bp, Homo sapiens
tcaaggagaggcaaagaaag

SEQ ID NO: 4579123 - DNA, 20 bp, Homo sapiens
tcaagggcactgtgatacag

SEQ ID NO: 4579124 - DNA, 14 bp, Homo sapiens
tcaaggtaagctca

SEQ ID NO: 4579125 - DNA, 17 bp, Homo sapiens
tcaagtaataaaaagag

SEQ ID NO: 4579126 - DNA, 19 bp, Homo sapiens
tcaagtaccaccaagggat

SEQ ID NO: 4579127 - DNA, 15 bp, Homo sapiens
tcaagtgagacccaa

SEQ ID NO: 4579128 - DNA, 16 bp, Homo sapiens
tcaagtgagacccaaa

SEQ ID NO: 4579129 - DNA, 15 bp, Homo sapiens
tcaagtgattctctt

SEQ ID NO: 4579130 - DNA, 19 bp, Homo sapiens
tcaagtgcatgctctctgc

SEQ ID NO: 4579131 - DNA, 14 bp, Homo sapiens
tcaagttcctttgg

SEQ ID NO: 4579132 - DNA, 18 bp, Homo sapiens
tcaagttgttgactgtga

SEQ ID NO: 4579133 - DNA, 15 bp, Homo sapiens
tcaagttttaaagtt

SEQ ID NO: 4579134 - DNA, 17 bp, Homo sapiens
tcaagttttaaagttca

SEQ ID NO: 4579135 - DNA, 14 bp, Homo sapiens
tcaagtttttcata

SEQ ID NO: 4579136 - DNA, 17 bp, Homo sapiens
tcaagtttttcatactg

SEQ ID NO: 4579137 - DNA, 20 bp, Homo sapiens
tcaataaaccacaagcatct

SEQ ID NO: 4579138 - DNA, 23 bp, Homo sapiens
tcaataacagatggtgctgctaa

SEQ ID NO: 4579139 - DNA, 18 bp, Homo sapiens
tcaataatatattttctg

SEQ ID NO: 4579140 - DNA, 20 bp, Homo sapiens
tcaataatatattttctgtt

SEQ ID NO: 4579141 - DNA, 16 bp, Homo sapiens
tcaatacacagtactt

SEQ ID NO: 4579142 - DNA, 23 bp, Homo sapiens
tcaatagtggcataccaaatggc

SEQ ID NO: 4579143 - DNA, 20 bp, Homo sapiens
tcaatagtgtcctatgcaat

SEQ ID NO: 4579144 - DNA, 21 bp, Homo sapiens
tcaatagtgtcctatgcaata

SEQ ID NO: 4579145 - DNA, 12 bp, Homo sapiens
tcaatagttgaa

SEQ ID NO: 4579146 - DNA, 15 bp, Homo sapiens
tcaatataagaagca

SEQ ID NO: 4579147 - DNA, 20 bp, Homo sapiens
tcaatataagaagcaatctt

SEQ ID NO: 4579148 - DNA, 12 bp, Homo sapiens
tcaatattgaat

SEQ ID NO: 4579149 - DNA, 19 bp, Homo sapiens
tcaatcagtctcagaatgt

SEQ ID NO: 4579150 - DNA, 21 bp, Homo sapiens
tcaatcagtctcagaatgtca

SEQ ID NO: 4579151 - DNA, 22 bp, Homo sapiens
tcaatcagtctcagaatgtcat

SEQ ID NO: 4579152 - DNA, 16 bp, Homo sapiens
tcaatcatttattcat

SEQ ID NO: 4579153 - DNA, 14 bp, Homo sapiens
tcaatccaccttca

SEQ ID NO: 4579154 - DNA, 15 bp, Homo sapiens
tcaatccaccttcag

SEQ ID NO: 4579155 - DNA, 13 bp, Homo sapiens
tcaatctgtaaac

SEQ ID NO: 4579156 - DNA, 15 bp, Homo sapiens
tcaatcttctacttt

SEQ ID NO: 4579157 - DNA, 19 bp, Homo sapiens
tcaatcttggtttgtcagt

SEQ ID NO: 4579158 - DNA, 14 bp, Homo sapiens
tcaatcttgttact

SEQ ID NO: 4579159 - DNA, 19 bp, Homo sapiens
tcaatcttgttactgctga

SEQ ID NO: 4579160 - DNA, 13 bp, Homo sapiens
tcaatgcagcccc

SEQ ID NO: 4579161 - DNA, 21 bp, Homo sapiens
tcaatgccaatgagtctgtaa

SEQ ID NO: 4579162 - DNA, 22 bp, Homo sapiens
tcaatgccaatgagtctgtaat

SEQ ID NO: 4579163 - DNA, 14 bp, Homo sapiens
tcaatggaagaaat

SEQ ID NO: 4579164 - DNA, 20 bp, Homo sapiens
tcaatgtctaaaaacatttg

SEQ ID NO: 4579165 - DNA, 22 bp, Homo sapiens
tcaatgtgtataaattgtcttt

SEQ ID NO: 4579166 - DNA, 13 bp, Homo sapiens
tcaattactggtc

SEQ ID NO: 4579167 - DNA, 19 bp, Homo sapiens
tcaattatattatgtttaa

SEQ ID NO: 4579168 - DNA, 22 bp, Homo sapiens
tcaattcaaagctgtgtgtttg

SEQ ID NO: 4579169 - DNA, 22 bp, Homo sapiens
tcaattgcatctcccagataat

SEQ ID NO: 4579170 - DNA, 21 bp, Homo sapiens
tcaatttatacctagcacttt

SEQ ID NO: 4579171 - DNA, 12 bp, Homo sapiens
tcaatttcatgt

SEQ ID NO: 4579172 - DNA, 20 bp, Homo sapiens
tcaatttctaatgtttacta

SEQ ID NO: 4579173 - DNA, 20 bp, Homo sapiens
tcaatttggagcattaacta

SEQ ID NO: 4579174 - DNA, 12 bp, Homo sapiens
tcaatttttgtt

SEQ ID NO: 4579175 - DNA, 18 bp, Homo sapiens
tcacaaaaaggcaaatat

SEQ ID NO: 4579176 - DNA, 19 bp, Homo sapiens
tcacaaaatgcacttctat

SEQ ID NO: 4579177 - DNA, 12 bp, Homo sapiens
tcacaaactgtg

SEQ ID NO: 4579178 - DNA, 23 bp, Homo sapiens
tcacaaactgtgaaaatagtgta

SEQ ID NO: 4579179 - DNA, 20 bp, Homo sapiens
tcacaaataagtaatatctt

SEQ ID NO: 4579180 - DNA, 14 bp, Homo sapiens
tcacaaatgtcatt

SEQ ID NO: 4579181 - DNA, 21 bp, Homo sapiens
tcacaaatgtcattgtctact

SEQ ID NO: 4579182 - DNA, 23 bp, Homo sapiens
tcacaacaactcatttttacaga

SEQ ID NO: 4579183 - DNA, 19 bp, Homo sapiens
tcacaacaattaaatatac

SEQ ID NO: 4579184 - DNA, 17 bp, Homo sapiens
tcacaacagtcacctca

SEQ ID NO: 4579185 - DNA, 16 bp, Homo sapiens
tcacaacattctgggc

SEQ ID NO: 4579186 - DNA, 22 bp, Homo sapiens
tcacaagacccaaaaggcagaa

SEQ ID NO: 4579187 - DNA, 21 bp, Homo sapiens
tcacaagttctatttcttgaa

SEQ ID NO: 4579188 - DNA, 21 bp, Homo sapiens
tcacaatgttccttttttgta

SEQ ID NO: 4579189 - DNA, 17 bp, Homo sapiens
tcacaattttcctgtgg

SEQ ID NO: 4579190 - DNA, 19 bp, Homo sapiens
tcacaattttcctgtggaa

SEQ ID NO: 4579191 - DNA, 15 bp, Homo sapiens
tcacaatttttaatg

SEQ ID NO: 4579192 - DNA, 18 bp, Homo sapiens
tcacacaaactgatgatg

SEQ ID NO: 4579193 - DNA, 12 bp, Homo sapiens
tcacacactgat

SEQ ID NO: 4579194 - DNA, 21 bp, Homo sapiens
tcacacatcctgtcagtgtca

SEQ ID NO: 4579195 - DNA, 15 bp, Homo sapiens
tcacacatgaataaa

SEQ ID NO: 4579196 - DNA, 11 bp, Homo sapiens
tcacaccagcc

SEQ ID NO: 4579197 - DNA, 16 bp, Homo sapiens
tcacacctgccctaaa

SEQ ID NO: 4579198 - DNA, 19 bp, Homo sapiens
tcacacgactgtcatctaa

SEQ ID NO: 4579199 - DNA, 21 bp, Homo sapiens
tcacacgtttaatcccagcac

SEQ ID NO: 4579200 - DNA, 21 bp, Homo sapiens
tcacactcaaggacaggagcc

SEQ ID NO: 4579201 - DNA, 12 bp, Homo sapiens
tcacactgagaa

SEQ ID NO: 4579202 - DNA, 21 bp, Homo sapiens
tcacactgcaagagccttggt

SEQ ID NO: 4579203 - DNA, 21 bp, Homo sapiens
tcacactgggtggtggcctgg

SEQ ID NO: 4579204 - DNA, 22 bp, Homo sapiens
tcacactgggtggtggcctggt

SEQ ID NO: 4579205 - DNA, 22 bp, Homo sapiens
tcacacttctgtgagaccccca

SEQ ID NO: 4579206 - DNA, 23 bp, Homo sapiens
tcacacttctgtgagacccccac

SEQ ID NO: 4579207 - DNA, 20 bp, Homo sapiens
tcacagaaaggcaggtttca

SEQ ID NO: 4579208 - DNA, 23 bp, Homo sapiens
tcacagaagtgttaacttttcta

SEQ ID NO: 4579209 - DNA, 18 bp, Homo sapiens
tcacagaccacaggaaga

SEQ ID NO: 4579210 - DNA, 16 bp, Homo sapiens
tcacagaccccagctg

SEQ ID NO: 4579211 - DNA, 18 bp, Homo sapiens
tcacagaccccagctggg

SEQ ID NO: 4579212 - DNA, 12 bp, Homo sapiens
tcacagagcagc

SEQ ID NO: 4579213 - DNA, 13 bp, Homo sapiens
tcacagagcagca

SEQ ID NO: 4579214 - DNA, 13 bp, Homo sapiens
tcacagaggcata

SEQ ID NO: 4579215 - DNA, 12 bp, Homo sapiens
tcacagaggctt

SEQ ID NO: 4579216 - DNA, 23 bp, Homo sapiens
tcacagagtgagactccatctca

SEQ ID NO: 4579217 - DNA, 13 bp, Homo sapiens
tcacagattttta

SEQ ID NO: 4579218 - DNA, 23 bp, Homo sapiens
tcacagcaagtcactggccagtg

SEQ ID NO: 4579219 - DNA, 21 bp, Homo sapiens
tcacagccacacctggactga

SEQ ID NO: 4579220 - DNA, 20 bp, Homo sapiens
tcacagcctcctctgtctgc

SEQ ID NO: 4579221 - DNA, 22 bp, Homo sapiens
tcacagcctcctctgtctgccc

SEQ ID NO: 4579222 - DNA, 14 bp, Homo sapiens
tcacaggctgagaa

SEQ ID NO: 4579223 - DNA, 15 bp, Homo sapiens
tcacaggctgagaac

SEQ ID NO: 4579224 - DNA, 20 bp, Homo sapiens
tcacagggaggattgaaaaa

SEQ ID NO: 4579225 - DNA, 16 bp, Homo sapiens
tcacagggttgggccc

SEQ ID NO: 4579226 - DNA, 18 bp, Homo sapiens
tcacagtaaagagtacac

SEQ ID NO: 4579227 - DNA, 16 bp, Homo sapiens
tcacagtcacattcca

SEQ ID NO: 4579228 - DNA, 22 bp, Homo sapiens
tcacagtcttgtgaactttgaa

SEQ ID NO: 4579229 - DNA, 18 bp, Homo sapiens
tcacagtgctcttttctc

SEQ ID NO: 4579230 - DNA, 16 bp, Homo sapiens
tcacagttcctcgccc

SEQ ID NO: 4579231 - DNA, 21 bp, Homo sapiens
tcacagttcctcgccctgggt

SEQ ID NO: 4579232 - DNA, 22 bp, Homo sapiens
tcacagttcctcgccctgggtc

SEQ ID NO: 4579233 - DNA, 15 bp, Homo sapiens
tcacagttctgtaat

SEQ ID NO: 4579234 - DNA, 16 bp, Homo sapiens
tcacataaaagtctgt

SEQ ID NO: 4579235 - DNA, 13 bp, Homo sapiens
tcacataaagaaa

SEQ ID NO: 4579236 - DNA, 22 bp, Homo sapiens
tcacatattttaaaatttgttc

SEQ ID NO: 4579237 - DNA, 18 bp, Homo sapiens
tcacatcacaatattcag

SEQ ID NO: 4579238 - DNA, 16 bp, Homo sapiens
tcacatctaaagcttt

SEQ ID NO: 4579239 - DNA, 20 bp, Homo sapiens
tcacatctaaagctttatct

SEQ ID NO: 4579240 - DNA, 22 bp, Homo sapiens
tcacatctaaagctttatcttt

SEQ ID NO: 4579241 - DNA, 17 bp, Homo sapiens
tcacatcttaaattcat

SEQ ID NO: 4579242 - DNA, 19 bp, Homo sapiens
tcacatgtcctattactga

SEQ ID NO: 4579243 - DNA, 21 bp, Homo sapiens
tcacattcttggcttaatcat

SEQ ID NO: 4579244 - DNA, 13 bp, Homo sapiens
tcacatttctact

SEQ ID NO: 4579245 - DNA, 17 bp, Homo sapiens
tcacatttgcatcatag

SEQ ID NO: 4579246 - DNA, 13 bp, Homo sapiens
tcacattttgtat

SEQ ID NO: 4579247 - DNA, 13 bp, Homo sapiens
tcacatttttgta

SEQ ID NO: 4579248 - DNA, 17 bp, Homo sapiens
tcacatttttttctacc

SEQ ID NO: 4579249 - DNA, 16 bp, Homo sapiens
tcaccaaaatttctac

SEQ ID NO: 4579250 - DNA, 17 bp, Homo sapiens
tcaccaaatagtgtgaa

SEQ ID NO: 4579251 - DNA, 21 bp, Homo sapiens
tcaccaactgaattaaactta

SEQ ID NO: 4579252 - DNA, 12 bp, Homo sapiens
tcaccaagctca

SEQ ID NO: 4579253 - DNA, 22 bp, Homo sapiens
tcaccaaggatcggactctgcc

SEQ ID NO: 4579254 - DNA, 11 bp, Homo sapiens
tcaccaccccc

SEQ ID NO: 4579255 - DNA, 21 bp, Homo sapiens
tcaccaccccctgtcccattc

SEQ ID NO: 4579256 - DNA, 20 bp, Homo sapiens
tcaccactaccagccagcct

SEQ ID NO: 4579257 - DNA, 17 bp, Homo sapiens
tcaccagaaatgatagc

SEQ ID NO: 4579258 - DNA, 19 bp, Homo sapiens
tcaccagagactttagggg

SEQ ID NO: 4579259 - DNA, 11 bp, Homo sapiens
tcaccagccct

SEQ ID NO: 4579260 - DNA, 17 bp, Homo sapiens
tcaccagctatctgtca

SEQ ID NO: 4579261 - DNA, 22 bp, Homo sapiens
tcaccaggaatgttaaagtcag

SEQ ID NO: 4579262 - DNA, 16 bp, Homo sapiens
tcaccatgcttccagc

SEQ ID NO: 4579263 - DNA, 21 bp, Homo sapiens
tcaccatgtaagcactctgga

SEQ ID NO: 4579264 - DNA, 14 bp, Homo sapiens
tcaccatttcttgg

SEQ ID NO: 4579265 - DNA, 22 bp, Homo sapiens
tcaccatttgattatgtagcaa

SEQ ID NO: 4579266 - DNA, 23 bp, Homo sapiens
tcaccatttggcaatgccatcat

SEQ ID NO: 4579267 - DNA, 16 bp, Homo sapiens
tcacccaagccacaag

SEQ ID NO: 4579268 - DNA, 12 bp, Homo sapiens
tcacccacaggg

SEQ ID NO: 4579269 - DNA, 18 bp, Homo sapiens
tcacccaccatggaccag

SEQ ID NO: 4579270 - DNA, 13 bp, Homo sapiens
tcacccacccctg

SEQ ID NO: 4579271 - DNA, 13 bp, Homo sapiens
tcacccagtcctg

SEQ ID NO: 4579272 - DNA, 22 bp, Homo sapiens
tcacccccaacttcaccacccc

SEQ ID NO: 4579273 - DNA, 14 bp, Homo sapiens
tcacccccatccct

SEQ ID NO: 4579274 - DNA, 22 bp, Homo sapiens
tcacccccatggccccaggccc

SEQ ID NO: 4579275 - DNA, 15 bp, Homo sapiens
tcaccccccaatctc

SEQ ID NO: 4579276 - DNA, 17 bp, Homo sapiens
tcaccccctcccacccc

SEQ ID NO: 4579277 - DNA, 23 bp, Homo sapiens
tcaccccctcccacccccagccc

SEQ ID NO: 4579278 - DNA, 13 bp, Homo sapiens
tcaccccctcggg

SEQ ID NO: 4579279 - DNA, 19 bp, Homo sapiens
tcaccccctcgggtctcct

SEQ ID NO: 4579280 - DNA, 16 bp, Homo sapiens
tcacccccttctccat

SEQ ID NO: 4579281 - DNA, 11 bp, Homo sapiens
tcacccctctg

SEQ ID NO: 4579282 - DNA, 17 bp, Homo sapiens
tcacccctctgcccctg

SEQ ID NO: 4579283 - DNA, 15 bp, Homo sapiens
tcacccctggttctc

SEQ ID NO: 4579284 - DNA, 18 bp, Homo sapiens
tcacccctggttctcatc

SEQ ID NO: 4579285 - DNA, 19 bp, Homo sapiens
tcacccctggttctcatct

SEQ ID NO: 4579286 - DNA, 19 bp, Homo sapiens
tcacccgagttcctctggg

SEQ ID NO: 4579287 - DNA, 19 bp, Homo sapiens
tcaccctaccaactttact

SEQ ID NO: 4579288 - DNA, 15 bp, Homo sapiens
tcaccctcatgaaaa

SEQ ID NO: 4579289 - DNA, 13 bp, Homo sapiens
tcaccgagactca

SEQ ID NO: 4579290 - DNA, 19 bp, Homo sapiens
tcaccgagactcagcctct

SEQ ID NO: 4579291 - DNA, 22 bp, Homo sapiens
tcaccgagcgggtgcaagcact

SEQ ID NO: 4579292 - DNA, 15 bp, Homo sapiens
tcaccgcccatcagg

SEQ ID NO: 4579293 - DNA, 20 bp, Homo sapiens
tcaccgcccatcagggttct

SEQ ID NO: 4579294 - DNA, 15 bp, Homo sapiens
tcaccgtgggctccc

SEQ ID NO: 4579295 - DNA, 12 bp, Homo sapiens
tcacctcagcac

SEQ ID NO: 4579296 - DNA, 20 bp, Homo sapiens
tcacctcatgcccaccccct

SEQ ID NO: 4579297 - DNA, 17 bp, Homo sapiens
tcacctccctgctcagt

SEQ ID NO: 4579298 - DNA, 20 bp, Homo sapiens
tcacctccctgctcagtgct

SEQ ID NO: 4579299 - DNA, 19 bp, Homo sapiens
tcacctcctctgtgatttc

SEQ ID NO: 4579300 - DNA, 24 bp, Homo sapiens
tcacctcgagaagtaattatcagt

SEQ ID NO: 4579301 - DNA, 13 bp, Homo sapiens
tcacctctctcta

SEQ ID NO: 4579302 - DNA, 23 bp, Homo sapiens
tcacctctctctaagtttagaag

SEQ ID NO: 4579303 - DNA, 13 bp, Homo sapiens
tcacctctgcctc

SEQ ID NO: 4579304 - DNA, 18 bp, Homo sapiens
tcacctctggactggcta

SEQ ID NO: 4579305 - DNA, 17 bp, Homo sapiens
tcacctgaaccccagag

SEQ ID NO: 4579306 - DNA, 20 bp, Homo sapiens
tcacctgaaccccagaggca

SEQ ID NO: 4579307 - DNA, 12 bp, Homo sapiens
tcacctgaggtc

SEQ ID NO: 4579308 - DNA, 23 bp, Homo sapiens
tcacctgaggtcaggagttcaag

SEQ ID NO: 4579309 - DNA, 18 bp, Homo sapiens
tcacctgccgccctgtgg

SEQ ID NO: 4579310 - DNA, 12 bp, Homo sapiens
tcacctgctccc

SEQ ID NO: 4579311 - DNA, 16 bp, Homo sapiens
tcacctgctcccagtc

SEQ ID NO: 4579312 - DNA, 17 bp, Homo sapiens
tcacctgctcccagtcc

SEQ ID NO: 4579313 - DNA, 22 bp, Homo sapiens
tcacctgctcccagtcctgcct

SEQ ID NO: 4579314 - DNA, 18 bp, Homo sapiens
tcacctgtaaaactttat

SEQ ID NO: 4579315 - DNA, 16 bp, Homo sapiens
tcacctgtaaacctga

SEQ ID NO: 4579316 - DNA, 16 bp, Homo sapiens
tcacctgtatatttct

SEQ ID NO: 4579317 - DNA, 20 bp, Homo sapiens
tcacctgtatatttctttta

SEQ ID NO: 4579318 - DNA, 21 bp, Homo sapiens
tcacctgtgcttcgggccctt

SEQ ID NO: 4579319 - DNA, 14 bp, Homo sapiens
tcaccttcctgtgg

SEQ ID NO: 4579320 - DNA, 14 bp, Homo sapiens
tcacctttcccacc

SEQ ID NO: 4579321 - DNA, 15 bp, Homo sapiens
tcaccttttcaggaa

SEQ ID NO: 4579322 - DNA, 18 bp, Homo sapiens
tcacgacacatttgcctt

SEQ ID NO: 4579323 - DNA, 13 bp, Homo sapiens
tcacgagcccatt

SEQ ID NO: 4579324 - DNA, 20 bp, Homo sapiens
tcacgagcccattctcatgt

SEQ ID NO: 4579325 - DNA, 21 bp, Homo sapiens
tcacgccattctcctgcctca

SEQ ID NO: 4579326 - DNA, 22 bp, Homo sapiens
tcacgccattctcctgcctcag

SEQ ID NO: 4579327 - DNA, 21 bp, Homo sapiens
tcacgccattgtactccagcc

SEQ ID NO: 4579328 - DNA, 16 bp, Homo sapiens
tcacgctttcctgaat

SEQ ID NO: 4579329 - DNA, 23 bp, Homo sapiens
tcacggaccactcgaggcctgca

SEQ ID NO: 4579330 - DNA, 21 bp, Homo sapiens
tcacggatggtgcatgggctc

SEQ ID NO: 4579331 - DNA, 20 bp, Homo sapiens
tcacggggttccctcctagc

SEQ ID NO: 4579332 - DNA, 22 bp, Homo sapiens
tcacggggttggctgttccaga

SEQ ID NO: 4579333 - DNA, 17 bp, Homo sapiens
tcacgtcatttgtttca

SEQ ID NO: 4579334 - DNA, 21 bp, Homo sapiens
tcactaaaagtctccaaaaca

SEQ ID NO: 4579335 - DNA, 23 bp, Homo sapiens
tcactaaaagtctccaaaacatt

SEQ ID NO: 4579336 - DNA, 12 bp, Homo sapiens
tcactaacatta

SEQ ID NO: 4579337 - DNA, 21 bp, Homo sapiens
tcactaacattatattgcaat

SEQ ID NO: 4579338 - DNA, 22 bp, Homo sapiens
tcactaacattatattgcaatg

SEQ ID NO: 4579339 - DNA, 23 bp, Homo sapiens
tcactactgcatttataggacct

SEQ ID NO: 4579340 - DNA, 14 bp, Homo sapiens
tcactatcaatttt

SEQ ID NO: 4579341 - DNA, 13 bp, Homo sapiens
tcactatggtatg

SEQ ID NO: 4579342 - DNA, 23 bp, Homo sapiens
tcactatggtatgctggccagca

SEQ ID NO: 4579343 - DNA, 16 bp, Homo sapiens
tcactattacttgaac

SEQ ID NO: 4579344 - DNA, 21 bp, Homo sapiens
tcactattcttggaccatgcc

SEQ ID NO: 4579345 - DNA, 22 bp, Homo sapiens
tcactattcttggaccatgcca

SEQ ID NO: 4579346 - DNA, 17 bp, Homo sapiens
tcactcaagaagcacac

SEQ ID NO: 4579347 - DNA, 15 bp, Homo sapiens
tcactcacattgaga

SEQ ID NO: 4579348 - DNA, 15 bp, Homo sapiens
tcactcactgtttat

SEQ ID NO: 4579349 - DNA, 11 bp, Homo sapiens
tcactcagaaa

SEQ ID NO: 4579350 - DNA, 13 bp, Homo sapiens
tcactccaccacc

SEQ ID NO: 4579351 - DNA, 15 bp, Homo sapiens
tcactccaccatccc

SEQ ID NO: 4579352 - DNA, 16 bp, Homo sapiens
tcactcccctctcctc

SEQ ID NO: 4579353 - DNA, 23 bp, Homo sapiens
tcactcccctctcctccccttcc

SEQ ID NO: 4579354 - DNA, 20 bp, Homo sapiens
tcactcccttctacctgcca

SEQ ID NO: 4579355 - DNA, 21 bp, Homo sapiens
tcactcccttctacctgccac

SEQ ID NO: 4579356 - DNA, 22 bp, Homo sapiens
tcactcctgagacccctggcct

SEQ ID NO: 4579357 - DNA, 17 bp, Homo sapiens
tcactctgtcagccagc

SEQ ID NO: 4579358 - DNA, 18 bp, Homo sapiens
tcactctgtcagccagcc

SEQ ID NO: 4579359 - DNA, 23 bp, Homo sapiens
tcactctgtcagccagccgccct

SEQ ID NO: 4579360 - DNA, 21 bp, Homo sapiens
tcactctgtccctgtccttcc

SEQ ID NO: 4579361 - DNA, 22 bp, Homo sapiens
tcactcttcctgcgtagaagat

SEQ ID NO: 4579362 - DNA, 15 bp, Homo sapiens
tcactcttctgtctt

SEQ ID NO: 4579363 - DNA, 21 bp, Homo sapiens
tcactctttatagtgcacaaa

SEQ ID NO: 4579364 - DNA, 20 bp, Homo sapiens
tcactgagttttgtttcact

SEQ ID NO: 4579365 - DNA, 16 bp, Homo sapiens
tcactgatgggaaaac

SEQ ID NO: 4579366 - DNA, 14 bp, Homo sapiens
tcactgatgggaat

SEQ ID NO: 4579367 - DNA, 15 bp, Homo sapiens
tcactgatgggaata

SEQ ID NO: 4579368 - DNA, 17 bp, Homo sapiens
tcactgatgggaataaa

SEQ ID NO: 4579369 - DNA, 15 bp, Homo sapiens
tcactgccaggccag

SEQ ID NO: 4579370 - DNA, 16 bp, Homo sapiens
tcactgccaggccagc

SEQ ID NO: 4579371 - DNA, 18 bp, Homo sapiens
tcactgccaggccagcct

SEQ ID NO: 4579372 - DNA, 20 bp, Homo sapiens
tcactgccaggccagcctcc

SEQ ID NO: 4579373 - DNA, 18 bp, Homo sapiens
tcactgcctaaaatttta

SEQ ID NO: 4579374 - DNA, 18 bp, Homo sapiens
tcactgcgaagaccctct

SEQ ID NO: 4579375 - DNA, 12 bp, Homo sapiens
tcactgctccag

SEQ ID NO: 4579376 - DNA, 13 bp, Homo sapiens
tcactgctccagg

SEQ ID NO: 4579377 - DNA, 14 bp, Homo sapiens
tcactgctccaggc

SEQ ID NO: 4579378 - DNA, 18 bp, Homo sapiens
tcactggaaaggggagag

SEQ ID NO: 4579379 - DNA, 21 bp, Homo sapiens
tcactggaaaggggagagcct

SEQ ID NO: 4579380 - DNA, 20 bp, Homo sapiens
tcactggcatactgagaata

SEQ ID NO: 4579381 - DNA, 18 bp, Homo sapiens
tcactggcccaaccagaa

SEQ ID NO: 4579382 - DNA, 14 bp, Homo sapiens
tcactggcctctcc

SEQ ID NO: 4579383 - DNA, 18 bp, Homo sapiens
tcactggcctctccccag

SEQ ID NO: 4579384 - DNA, 11 bp, Homo sapiens
tcactgggcca

SEQ ID NO: 4579385 - DNA, 20 bp, Homo sapiens
tcactgggccaattcaatac

SEQ ID NO: 4579386 - DNA, 19 bp, Homo sapiens
tcactggtccaggtcttca

SEQ ID NO: 4579387 - DNA, 17 bp, Homo sapiens
tcactggtgagacaatg

SEQ ID NO: 4579388 - DNA, 20 bp, Homo sapiens
tcactgtaaagacaaataaa

SEQ ID NO: 4579389 - DNA, 12 bp, Homo sapiens
tcactgtatata

SEQ ID NO: 4579390 - DNA, 15 bp, Homo sapiens
tcactgtatataaac

SEQ ID NO: 4579391 - DNA, 12 bp, Homo sapiens
tcactgtccaat

SEQ ID NO: 4579392 - DNA, 22 bp, Homo sapiens
tcactgtgaaccaacccccatc

SEQ ID NO: 4579393 - DNA, 18 bp, Homo sapiens
tcactgtgggaaggccag

SEQ ID NO: 4579394 - DNA, 22 bp, Homo sapiens
tcactgtgtataggaatttgta

SEQ ID NO: 4579395 - DNA, 16 bp, Homo sapiens
tcactgttgctttgaa

SEQ ID NO: 4579396 - DNA, 14 bp, Homo sapiens
tcactgtttataaa

SEQ ID NO: 4579397 - DNA, 17 bp, Homo sapiens
tcacttaaactttgtca

SEQ ID NO: 4579398 - DNA, 18 bp, Homo sapiens
tcacttaaaggcacaaat

SEQ ID NO: 4579399 - DNA, 14 bp, Homo sapiens
tcacttaatgtttc

SEQ ID NO: 4579400 - DNA, 17 bp, Homo sapiens
tcacttaattttcccaa

SEQ ID NO: 4579401 - DNA, 13 bp, Homo sapiens
tcacttacaagaa

SEQ ID NO: 4579402 - DNA, 12 bp, Homo sapiens
tcacttagtcct

SEQ ID NO: 4579403 - DNA, 18 bp, Homo sapiens
tcacttcaagctgttatt

SEQ ID NO: 4579404 - DNA, 12 bp, Homo sapiens
tcacttctaaat

SEQ ID NO: 4579405 - DNA, 13 bp, Homo sapiens
tcacttctaaatt

SEQ ID NO: 4579406 - DNA, 12 bp, Homo sapiens
tcacttctccca

SEQ ID NO: 4579407 - DNA, 14 bp, Homo sapiens
tcacttctgctgta

SEQ ID NO: 4579408 - DNA, 22 bp, Homo sapiens
tcacttgaggaggagctggcct

SEQ ID NO: 4579409 - DNA, 11 bp, Homo sapiens
tcacttgccac

SEQ ID NO: 4579410 - DNA, 13 bp, Homo sapiens
tcacttgccacat

SEQ ID NO: 4579411 - DNA, 14 bp, Homo sapiens
tcactttcattttt

SEQ ID NO: 4579412 - DNA, 14 bp, Homo sapiens
tcactttctcagtt

SEQ ID NO: 4579413 - DNA, 14 bp, Homo sapiens
tcactttctgtcta

SEQ ID NO: 4579414 - DNA, 20 bp, Homo sapiens
tcactttgccattatgcaaa

SEQ ID NO: 4579415 - DNA, 15 bp, Homo sapiens
tcactttgtaaataa

SEQ ID NO: 4579416 - DNA, 20 bp, Homo sapiens
tcactttgtaaataaaaaca

SEQ ID NO: 4579417 - DNA, 21 bp, Homo sapiens
tcactttgtaaataaaaacac

SEQ ID NO: 4579418 - DNA, 23 bp, Homo sapiens
tcactttgtgtattaaatggttt

SEQ ID NO: 4579419 - DNA, 18 bp, Homo sapiens
tcacttttgacaaaggca

SEQ ID NO: 4579420 - DNA, 22 bp, Homo sapiens
tcactttttatgctatttctgt

SEQ ID NO: 4579421 - DNA, 17 bp, Homo sapiens
tcactttttctgataaa

SEQ ID NO: 4579422 - DNA, 15 bp, Homo sapiens
tcacttttttataaa

SEQ ID NO: 4579423 - DNA, 13 bp, Homo sapiens
tcactttttttct

SEQ ID NO: 4579424 - DNA, 16 bp, Homo sapiens
tcagaaaaccaaaggg

SEQ ID NO: 4579425 - DNA, 14 bp, Homo sapiens
tcagaaatagctcc

SEQ ID NO: 4579426 - DNA, 20 bp, Homo sapiens
tcagaaatcctctgttaatg

SEQ ID NO: 4579427 - DNA, 16 bp, Homo sapiens
tcagaacaatccgatt

SEQ ID NO: 4579428 - DNA, 16 bp, Homo sapiens
tcagaaccctgccatg

SEQ ID NO: 4579429 - DNA, 15 bp, Homo sapiens
tcagaactagaattt

SEQ ID NO: 4579430 - DNA, 16 bp, Homo sapiens
tcagaactgcccttgc

SEQ ID NO: 4579431 - DNA, 23 bp, Homo sapiens
tcagaagaaaggccaaggtgctg

SEQ ID NO: 4579432 - DNA, 23 bp, Homo sapiens
tcagaagaacatgattttacaag

SEQ ID NO: 4579433 - DNA, 20 bp, Homo sapiens
tcagaagatagtcttggaag

SEQ ID NO: 4579434 - DNA, 14 bp, Homo sapiens
tcagaagcaagcca

SEQ ID NO: 4579435 - DNA, 18 bp, Homo sapiens
tcagaagcacagaatatt

SEQ ID NO: 4579436 - DNA, 14 bp, Homo sapiens
tcagaagcctttgg

SEQ ID NO: 4579437 - DNA, 13 bp, Homo sapiens
tcagaaggacggc

SEQ ID NO: 4579438 - DNA, 13 bp, Homo sapiens
tcagaaggagaag

SEQ ID NO: 4579439 - DNA, 18 bp, Homo sapiens
tcagaaggagaaggaagg

SEQ ID NO: 4579440 - DNA, 19 bp, Homo sapiens
tcagaaggagaaggaagga

SEQ ID NO: 4579441 - DNA, 17 bp, Homo sapiens
tcagaagttagtttgta

SEQ ID NO: 4579442 - DNA, 19 bp, Homo sapiens
tcagaataaagttgtattt

SEQ ID NO: 4579443 - DNA, 23 bp, Homo sapiens
tcagaataaagttgtatttcaaa

SEQ ID NO: 4579444 - DNA, 21 bp, Homo sapiens
tcagaatagccacatttggaa

SEQ ID NO: 4579445 - DNA, 22 bp, Homo sapiens
tcagaatagccacatttggaat

SEQ ID NO: 4579446 - DNA, 23 bp, Homo sapiens
tcagaatagccacatttggaata

SEQ ID NO: 4579447 - DNA, 17 bp, Homo sapiens
tcagaatctgaatgtaa

SEQ ID NO: 4579448 - DNA, 22 bp, Homo sapiens
tcagaatctgaatgtaatttgt

SEQ ID NO: 4579449 - DNA, 16 bp, Homo sapiens
tcagaattaagcagaa

SEQ ID NO: 4579450 - DNA, 21 bp, Homo sapiens
tcagaattcggtgtgctgcca

SEQ ID NO: 4579451 - DNA, 19 bp, Homo sapiens
tcagaattggcataatttg

SEQ ID NO: 4579452 - DNA, 14 bp, Homo sapiens
tcagacaaaatgga

SEQ ID NO: 4579453 - DNA, 21 bp, Homo sapiens
tcagacaaaatggatacataa

SEQ ID NO: 4579454 - DNA, 13 bp, Homo sapiens
tcagacaaattac

SEQ ID NO: 4579455 - DNA, 19 bp, Homo sapiens
tcagacatagaattaacac

SEQ ID NO: 4579456 - DNA, 14 bp, Homo sapiens
tcagacatttatat

SEQ ID NO: 4579457 - DNA, 18 bp, Homo sapiens
tcagacccagcggtccaa

SEQ ID NO: 4579458 - DNA, 11 bp, Homo sapiens
tcagacccagg

SEQ ID NO: 4579459 - DNA, 20 bp, Homo sapiens
tcagacccaggagtccagcc

SEQ ID NO: 4579460 - DNA, 23 bp, Homo sapiens
tcagacccaggggtccaggcccc

SEQ ID NO: 4579461 - DNA, 12 bp, Homo sapiens
tcagaccccagc

SEQ ID NO: 4579462 - DNA, 18 bp, Homo sapiens
tcagacccccactctcat

SEQ ID NO: 4579463 - DNA, 13 bp, Homo sapiens
tcagacccctgcc

SEQ ID NO: 4579464 - DNA, 15 bp, Homo sapiens
tcagaccctgcttag

SEQ ID NO: 4579465 - DNA, 19 bp, Homo sapiens
tcagacgtgtgacctccat

SEQ ID NO: 4579466 - DNA, 22 bp, Homo sapiens
tcagacgtgtgacctccatact

SEQ ID NO: 4579467 - DNA, 20 bp, Homo sapiens
tcagactagccactcctgcc

SEQ ID NO: 4579468 - DNA, 15 bp, Homo sapiens
tcagactcagaggtc

SEQ ID NO: 4579469 - DNA, 18 bp, Homo sapiens
tcagactcagaggtccag

SEQ ID NO: 4579470 - DNA, 22 bp, Homo sapiens
tcagactcagaggtccaggccc

SEQ ID NO: 4579471 - DNA, 14 bp, Homo sapiens
tcagactctagaaa

SEQ ID NO: 4579472 - DNA, 13 bp, Homo sapiens
tcagactgcagag

SEQ ID NO: 4579473 - DNA, 18 bp, Homo sapiens
tcagactgcctgtctgct

SEQ ID NO: 4579474 - DNA, 21 bp, Homo sapiens
tcagactgggcactggggcct

SEQ ID NO: 4579475 - DNA, 14 bp, Homo sapiens
tcagactgtttagt

SEQ ID NO: 4579476 - DNA, 13 bp, Homo sapiens
tcagacttgtcaa

SEQ ID NO: 4579477 - DNA, 19 bp, Homo sapiens
tcagagaaaatgagaaagg

SEQ ID NO: 4579478 - DNA, 23 bp, Homo sapiens
tcagagaaaatgagaaaggacag

SEQ ID NO: 4579479 - DNA, 14 bp, Homo sapiens
tcagagaaggaaca

SEQ ID NO: 4579480 - DNA, 17 bp, Homo sapiens
tcagagatgtgcaccca

SEQ ID NO: 4579481 - DNA, 12 bp, Homo sapiens
tcagagccactc

SEQ ID NO: 4579482 - DNA, 18 bp, Homo sapiens
tcagagccactctatgag

SEQ ID NO: 4579483 - DNA, 15 bp, Homo sapiens
tcagagccagcctgg

SEQ ID NO: 4579484 - DNA, 18 bp, Homo sapiens
tcagagcccagcccagga

SEQ ID NO: 4579485 - DNA, 16 bp, Homo sapiens
tcagagccgtggtcct

SEQ ID NO: 4579486 - DNA, 14 bp, Homo sapiens
tcagaggacctgta

SEQ ID NO: 4579487 - DNA, 17 bp, Homo sapiens
tcagaggacctgtattt

SEQ ID NO: 4579488 - DNA, 22 bp, Homo sapiens
tcagaggacctgtatttaagca

SEQ ID NO: 4579489 - DNA, 23 bp, Homo sapiens
tcagaggacctgtatttaagcaa

SEQ ID NO: 4579490 - DNA, 13 bp, Homo sapiens
tcagaggagaaga

SEQ ID NO: 4579491 - DNA, 14 bp, Homo sapiens
tcagaggagtaaat

SEQ ID NO: 4579492 - DNA, 21 bp, Homo sapiens
tcagaggccctcgctgccagc

SEQ ID NO: 4579493 - DNA, 16 bp, Homo sapiens
tcagagggctgatgga

SEQ ID NO: 4579494 - DNA, 19 bp, Homo sapiens
tcagagggtgtcctgcacc

SEQ ID NO: 4579495 - DNA, 16 bp, Homo sapiens
tcagagtccactgtgg

SEQ ID NO: 4579496 - DNA, 19 bp, Homo sapiens
tcagagtccactgtggcac

SEQ ID NO: 4579497 - DNA, 13 bp, Homo sapiens
tcagagtccagtg

SEQ ID NO: 4579498 - DNA, 22 bp, Homo sapiens
tcagagtccagtgctctgcctc

SEQ ID NO: 4579499 - DNA, 20 bp, Homo sapiens
tcagagtgactacacacagt

SEQ ID NO: 4579500 - DNA, 12 bp, Homo sapiens
tcagagtgccac

SEQ ID NO: 4579501 - DNA, 21 bp, Homo sapiens
tcagataatgccaccaaagga

SEQ ID NO: 4579502 - DNA, 17 bp, Homo sapiens
tcagataggattttctc

SEQ ID NO: 4579503 - DNA, 20 bp, Homo sapiens
tcagatataaaagactgacc

SEQ ID NO: 4579504 - DNA, 22 bp, Homo sapiens
tcagatatcttggacaaatcac

SEQ ID NO: 4579505 - DNA, 16 bp, Homo sapiens
tcagatcctgttactt

SEQ ID NO: 4579506 - DNA, 13 bp, Homo sapiens
tcagatctgtctg

SEQ ID NO: 4579507 - DNA, 16 bp, Homo sapiens
tcagatctttctcctt

SEQ ID NO: 4579508 - DNA, 10 bp, Homo sapiens
tcagatgagg

SEQ ID NO: 4579509 - DNA, 15 bp, Homo sapiens
tcagatgaggacaga

SEQ ID NO: 4579510 - DNA, 18 bp, Homo sapiens
tcagatgatttcccccct

SEQ ID NO: 4579511 - DNA, 16 bp, Homo sapiens
tcagatgctgaattga

SEQ ID NO: 4579512 - DNA, 17 bp, Homo sapiens
tcagatgttaaaataaa

SEQ ID NO: 4579513 - DNA, 19 bp, Homo sapiens
tcagattcctttcccttta

SEQ ID NO: 4579514 - DNA, 18 bp, Homo sapiens
tcagattgtggaatgttg

SEQ ID NO: 4579515 - DNA, 16 bp, Homo sapiens
tcagatttctgaggaa

SEQ ID NO: 4579516 - DNA, 21 bp, Homo sapiens
tcagattttgataactgttta

SEQ ID NO: 4579517 - DNA, 22 bp, Homo sapiens
tcagcaaaaatctcccagtgac

SEQ ID NO: 4579518 - DNA, 15 bp, Homo sapiens
tcagcaaacaggatc

SEQ ID NO: 4579519 - DNA, 21 bp, Homo sapiens
tcagcaaccctacagtatata

SEQ ID NO: 4579520 - DNA, 16 bp, Homo sapiens
tcagcaactcgcttta

SEQ ID NO: 4579521 - DNA, 19 bp, Homo sapiens
tcagcaactgttagctggg

SEQ ID NO: 4579522 - DNA, 14 bp, Homo sapiens
tcagcaagctgccc

SEQ ID NO: 4579523 - DNA, 18 bp, Homo sapiens
tcagcaagctgcccagcc

SEQ ID NO: 4579524 - DNA, 22 bp, Homo sapiens
tcagcaagctgcccagccctgg

SEQ ID NO: 4579525 - DNA, 19 bp, Homo sapiens
tcagcaagttagaactagc

SEQ ID NO: 4579526 - DNA, 21 bp, Homo sapiens
tcagcaagttagaactagcca

SEQ ID NO: 4579527 - DNA, 16 bp, Homo sapiens
tcagcacatatgggaa

SEQ ID NO: 4579528 - DNA, 18 bp, Homo sapiens
tcagcacatatttgcatg

SEQ ID NO: 4579529 - DNA, 14 bp, Homo sapiens
tcagcaccacccta

SEQ ID NO: 4579530 - DNA, 22 bp, Homo sapiens
tcagcacccccaccaaacttta

SEQ ID NO: 4579531 - DNA, 22 bp, Homo sapiens
tcagcacctacagtgtacagtc

SEQ ID NO: 4579532 - DNA, 18 bp, Homo sapiens
tcagcactgtggacacct

SEQ ID NO: 4579533 - DNA, 18 bp, Homo sapiens
tcagcacttgtctcattt

SEQ ID NO: 4579534 - DNA, 17 bp, Homo sapiens
tcagcagacatttatct

SEQ ID NO: 4579535 - DNA, 21 bp, Homo sapiens
tcagcagagaaggtaaggtgt

SEQ ID NO: 4579536 - DNA, 17 bp, Homo sapiens
tcagcagcagagagccc

SEQ ID NO: 4579537 - DNA, 22 bp, Homo sapiens
tcagcagcagctctgagccaga

SEQ ID NO: 4579538 - DNA, 12 bp, Homo sapiens
tcagcagcccta

SEQ ID NO: 4579539 - DNA, 14 bp, Homo sapiens
tcagcagccctcct

SEQ ID NO: 4579540 - DNA, 16 bp, Homo sapiens
tcagcagccctcctca

SEQ ID NO: 4579541 - DNA, 20 bp, Homo sapiens
tcagcagcgaccacccctgc

SEQ ID NO: 4579542 - DNA, 22 bp, Homo sapiens
tcagcagcgaccacccctgcct

SEQ ID NO: 4579543 - DNA, 23 bp, Homo sapiens
tcagcagcgaccacccctgcctc

SEQ ID NO: 4579544 - DNA, 21 bp, Homo sapiens
tcagcagctctggctctgcct

SEQ ID NO: 4579545 - DNA, 13 bp, Homo sapiens
tcagcatcactga

SEQ ID NO: 4579546 - DNA, 14 bp, Homo sapiens
tcagcatcactgat

SEQ ID NO: 4579547 - DNA, 16 bp, Homo sapiens
tcagcatcactgatgg

SEQ ID NO: 4579548 - DNA, 21 bp, Homo sapiens
tcagcatgtctattcagcttc

SEQ ID NO: 4579549 - DNA, 19 bp, Homo sapiens
tcagcatttccacaccaag

SEQ ID NO: 4579550 - DNA, 19 bp, Homo sapiens
tcagcatttccttgtcccg

SEQ ID NO: 4579551 - DNA, 21 bp, Homo sapiens
tcagccacaaagccccccagc

SEQ ID NO: 4579552 - DNA, 17 bp, Homo sapiens
tcagccacatgccccag

SEQ ID NO: 4579553 - DNA, 21 bp, Homo sapiens
tcagccactaagaacccctct

SEQ ID NO: 4579554 - DNA, 16 bp, Homo sapiens
tcagccactgtcacag

SEQ ID NO: 4579555 - DNA, 19 bp, Homo sapiens
tcagccactgtcacaggca

SEQ ID NO: 4579556 - DNA, 22 bp, Homo sapiens
tcagccagcccatggcccccaa

SEQ ID NO: 4579557 - DNA, 14 bp, Homo sapiens
tcagccagcctcct

SEQ ID NO: 4579558 - DNA, 20 bp, Homo sapiens
tcagccatcgtcctgggact

SEQ ID NO: 4579559 - DNA, 24 bp, Homo sapiens
tcagcccagaagaaaattctcctg

SEQ ID NO: 4579560 - DNA, 15 bp, Homo sapiens
tcagccccagcccag

SEQ ID NO: 4579561 - DNA, 17 bp, Homo sapiens
tcagccccaggccagct

SEQ ID NO: 4579562 - DNA, 18 bp, Homo sapiens
tcagccccaggccagctg

SEQ ID NO: 4579563 - DNA, 19 bp, Homo sapiens
tcagcccccatcacccaag

SEQ ID NO: 4579564 - DNA, 23 bp, Homo sapiens
tcagcccccatcacccaagccac

SEQ ID NO: 4579565 - DNA, 16 bp, Homo sapiens
tcagccccgcctgtca

SEQ ID NO: 4579566 - DNA, 22 bp, Homo sapiens
tcagccccgcctgtcacaataa

SEQ ID NO: 4579567 - DNA, 23 bp, Homo sapiens
tcagccccgcctgtcacaataaa

SEQ ID NO: 4579568 - DNA, 12 bp, Homo sapiens
tcagcccctcct

SEQ ID NO: 4579569 - DNA, 18 bp, Homo sapiens
tcagcccctcctctgcca

SEQ ID NO: 4579570 - DNA, 19 bp, Homo sapiens
tcagcccctcctctgccac

SEQ ID NO: 4579571 - DNA, 20 bp, Homo sapiens
tcagcccctcctctgccacc

SEQ ID NO: 4579572 - DNA, 23 bp, Homo sapiens
tcagccccttaatctattttcag

SEQ ID NO: 4579573 - DNA, 23 bp, Homo sapiens
tcagccctagggtggagagccac

SEQ ID NO: 4579574 - DNA, 13 bp, Homo sapiens
tcagccctcagtt

SEQ ID NO: 4579575 - DNA, 18 bp, Homo sapiens
tcagccctgaaaataaca

SEQ ID NO: 4579576 - DNA, 14 bp, Homo sapiens
tcagccctgctccc

SEQ ID NO: 4579577 - DNA, 15 bp, Homo sapiens
tcagccctgctccct

SEQ ID NO: 4579578 - DNA, 18 bp, Homo sapiens
tcagccctgctccctgcc

SEQ ID NO: 4579579 - DNA, 20 bp, Homo sapiens
tcagccctgctccctgcctc

SEQ ID NO: 4579580 - DNA, 21 bp, Homo sapiens
tcagccctgggccccaccacc

SEQ ID NO: 4579581 - DNA, 17 bp, Homo sapiens
tcagccgagaaattggg

SEQ ID NO: 4579582 - DNA, 22 bp, Homo sapiens
tcagcctcccgagtagctggca

SEQ ID NO: 4579583 - DNA, 16 bp, Homo sapiens
tcagcctctctcccag

SEQ ID NO: 4579584 - DNA, 13 bp, Homo sapiens
tcagcctctgctg

SEQ ID NO: 4579585 - DNA, 17 bp, Homo sapiens
tcagcctgctttcctgc

SEQ ID NO: 4579586 - DNA, 19 bp, Homo sapiens
tcagcctgggacagtttat

SEQ ID NO: 4579587 - DNA, 18 bp, Homo sapiens
tcagccttcaagaatcag

SEQ ID NO: 4579588 - DNA, 15 bp, Homo sapiens
tcagccttcctcctc

SEQ ID NO: 4579589 - DNA, 16 bp, Homo sapiens
tcagcgggagccagtg

SEQ ID NO: 4579590 - DNA, 14 bp, Homo sapiens
tcagcgtcccctgc

SEQ ID NO: 4579591 - DNA, 16 bp, Homo sapiens
tcagcgttaatgtaaa

SEQ ID NO: 4579592 - DNA, 22 bp, Homo sapiens
tcagctaatgtcacaacatggt

SEQ ID NO: 4579593 - DNA, 21 bp, Homo sapiens
tcagctagttaataattcttt

SEQ ID NO: 4579594 - DNA, 15 bp, Homo sapiens
tcagctcatccatgc

SEQ ID NO: 4579595 - DNA, 21 bp, Homo sapiens
tcagctcccctcggagaagag

SEQ ID NO: 4579596 - DNA, 19 bp, Homo sapiens
tcagctctaggctgttctg

SEQ ID NO: 4579597 - DNA, 21 bp, Homo sapiens
tcagctctaggctgttctgta

SEQ ID NO: 4579598 - DNA, 23 bp, Homo sapiens
tcagctctaggctgttctgtagc

SEQ ID NO: 4579599 - DNA, 15 bp, Homo sapiens
tcagctctcctgctg

SEQ ID NO: 4579600 - DNA, 18 bp, Homo sapiens
tcagctctcctgctgcag

SEQ ID NO: 4579601 - DNA, 22 bp, Homo sapiens
tcagctctctgggacctcctta

SEQ ID NO: 4579602 - DNA, 21 bp, Homo sapiens
tcagctctgccttgcactgtg

SEQ ID NO: 4579603 - DNA, 21 bp, Homo sapiens
tcagctgcaaggtactctggt

SEQ ID NO: 4579604 - DNA, 22 bp, Homo sapiens
tcagctgcaatccatttatttc

SEQ ID NO: 4579605 - DNA, 15 bp, Homo sapiens
tcagctgcctcactt

SEQ ID NO: 4579606 - DNA, 23 bp, Homo sapiens
tcagcttatcctaaggctgtcca

SEQ ID NO: 4579607 - DNA, 17 bp, Homo sapiens
tcagcttgcttagatgt

SEQ ID NO: 4579608 - DNA, 14 bp, Homo sapiens
tcagcttttctgat

SEQ ID NO: 4579609 - DNA, 16 bp, Homo sapiens
tcagcttttgttctag

SEQ ID NO: 4579610 - DNA, 21 bp, Homo sapiens
tcaggaaaatgtattgattca

SEQ ID NO: 4579611 - DNA, 12 bp, Homo sapiens
tcaggaaaattg

SEQ ID NO: 4579612 - DNA, 23 bp, Homo sapiens
tcaggaaagaatagaaagaaagt

SEQ ID NO: 4579613 - DNA, 15 bp, Homo sapiens
tcaggaaagagagca

SEQ ID NO: 4579614 - DNA, 15 bp, Homo sapiens
tcaggaaaggaatca

SEQ ID NO: 4579615 - DNA, 20 bp, Homo sapiens
tcaggaaatcaaatatgcaa

SEQ ID NO: 4579616 - DNA, 21 bp, Homo sapiens
tcaggaaatcaaatatgcaaa

SEQ ID NO: 4579617 - DNA, 23 bp, Homo sapiens
tcaggaaatcaaatatgcaaagc

SEQ ID NO: 4579618 - DNA, 18 bp, Homo sapiens
tcaggaacagctatggga

SEQ ID NO: 4579619 - DNA, 18 bp, Homo sapiens
tcaggaattctaaataaa

SEQ ID NO: 4579620 - DNA, 18 bp, Homo sapiens
tcaggaattcttggagaa

SEQ ID NO: 4579621 - DNA, 21 bp, Homo sapiens
tcaggacagcatcccttccca

SEQ ID NO: 4579622 - DNA, 16 bp, Homo sapiens
tcaggacccagaggaa

SEQ ID NO: 4579623 - DNA, 18 bp, Homo sapiens
tcaggacggctcctcaga

SEQ ID NO: 4579624 - DNA, 19 bp, Homo sapiens
tcaggacggctcctcagag

SEQ ID NO: 4579625 - DNA, 22 bp, Homo sapiens
tcaggactctgcgggaggctgg

SEQ ID NO: 4579626 - DNA, 23 bp, Homo sapiens
tcaggagactttacaaacctttg

SEQ ID NO: 4579627 - DNA, 16 bp, Homo sapiens
tcaggagagcaaggtc

SEQ ID NO: 4579628 - DNA, 22 bp, Homo sapiens
tcaggagatcgagaccatcctg

SEQ ID NO: 4579629 - DNA, 18 bp, Homo sapiens
tcaggagatggagggctt

SEQ ID NO: 4579630 - DNA, 23 bp, Homo sapiens
tcaggagcttgggcagtgcccca

SEQ ID NO: 4579631 - DNA, 23 bp, Homo sapiens
tcaggaggcgaataaatgttcaa

SEQ ID NO: 4579632 - DNA, 12 bp, Homo sapiens
tcaggaggctga

SEQ ID NO: 4579633 - DNA, 22 bp, Homo sapiens
tcaggaggctgagacaggagaa

SEQ ID NO: 4579634 - DNA, 22 bp, Homo sapiens
tcaggaggctgaggcagaagaa

SEQ ID NO: 4579635 - DNA, 22 bp, Homo sapiens
tcaggagttcaagaccagcctg

SEQ ID NO: 4579636 - DNA, 16 bp, Homo sapiens
tcaggagttcaagact

SEQ ID NO: 4579637 - DNA, 19 bp, Homo sapiens
tcaggagttttactgcctg

SEQ ID NO: 4579638 - DNA, 20 bp, Homo sapiens
tcaggagttttactgcctgt

SEQ ID NO: 4579639 - DNA, 22 bp, Homo sapiens
tcaggcaattcctacctcttca

SEQ ID NO: 4579640 - DNA, 13 bp, Homo sapiens
tcaggcacacagc

SEQ ID NO: 4579641 - DNA, 15 bp, Homo sapiens
tcaggcactgagaat

SEQ ID NO: 4579642 - DNA, 14 bp, Homo sapiens
tcaggcagcactga

SEQ ID NO: 4579643 - DNA, 13 bp, Homo sapiens
tcaggcaggaagg

SEQ ID NO: 4579644 - DNA, 13 bp, Homo sapiens
tcaggccagccca

SEQ ID NO: 4579645 - DNA, 15 bp, Homo sapiens
tcaggccagcccagc

SEQ ID NO: 4579646 - DNA, 17 bp, Homo sapiens
tcaggccagcccagcca

SEQ ID NO: 4579647 - DNA, 21 bp, Homo sapiens
tcaggccatattatcaatgtt

SEQ ID NO: 4579648 - DNA, 18 bp, Homo sapiens
tcaggccctgactcctct

SEQ ID NO: 4579649 - DNA, 13 bp, Homo sapiens
tcaggccgagagc

SEQ ID NO: 4579650 - DNA, 22 bp, Homo sapiens
tcaggctactataggtccagaa

SEQ ID NO: 4579651 - DNA, 19 bp, Homo sapiens
tcaggctactgttcttgac

SEQ ID NO: 4579652 - DNA, 21 bp, Homo sapiens
tcaggctactgttcttgacaa

SEQ ID NO: 4579653 - DNA, 13 bp, Homo sapiens
tcaggctagccct

SEQ ID NO: 4579654 - DNA, 20 bp, Homo sapiens
tcaggctagccctgccctcc

SEQ ID NO: 4579655 - DNA, 22 bp, Homo sapiens
tcaggctatatgcagtccttta

SEQ ID NO: 4579656 - DNA, 23 bp, Homo sapiens
tcaggctcaaccttccaacttcc

SEQ ID NO: 4579657 - DNA, 22 bp, Homo sapiens
tcaggctccgggcaccaggggc

SEQ ID NO: 4579658 - DNA, 14 bp, Homo sapiens
tcaggctgctggcg

SEQ ID NO: 4579659 - DNA, 19 bp, Homo sapiens
tcagggaaactaagattct

SEQ ID NO: 4579660 - DNA, 16 bp, Homo sapiens
tcagggacctgctgct

SEQ ID NO: 4579661 - DNA, 17 bp, Homo sapiens
tcagggacctgctgctc

SEQ ID NO: 4579662 - DNA, 21 bp, Homo sapiens
tcagggagcagggaaggcctg

SEQ ID NO: 4579663 - DNA, 18 bp, Homo sapiens
tcagggagcctccccatc

SEQ ID NO: 4579664 - DNA, 17 bp, Homo sapiens
tcagggaggggcaacca

SEQ ID NO: 4579665 - DNA, 14 bp, Homo sapiens
tcagggcacagtct

SEQ ID NO: 4579666 - DNA, 15 bp, Homo sapiens
tcagggcacagtctc

SEQ ID NO: 4579667 - DNA, 13 bp, Homo sapiens
tcagggcctcagg

SEQ ID NO: 4579668 - DNA, 16 bp, Homo sapiens
tcagggcggcctccca

SEQ ID NO: 4579669 - DNA, 16 bp, Homo sapiens
tcagggctgtcccagc

SEQ ID NO: 4579670 - DNA, 20 bp, Homo sapiens
tcaggggaagagaagacaaa

SEQ ID NO: 4579671 - DNA, 18 bp, Homo sapiens
tcaggggactcagccctg

SEQ ID NO: 4579672 - DNA, 21 bp, Homo sapiens
tcaggggatcaaaaggacgga

SEQ ID NO: 4579673 - DNA, 15 bp, Homo sapiens
tcaggggcctctctc

SEQ ID NO: 4579674 - DNA, 22 bp, Homo sapiens
tcaggggctccatgctgggtct

SEQ ID NO: 4579675 - DNA, 20 bp, Homo sapiens
tcaggggctctagggactgc

SEQ ID NO: 4579676 - DNA, 12 bp, Homo sapiens
tcaggggcttgg

SEQ ID NO: 4579677 - DNA, 22 bp, Homo sapiens
tcaggggcttggatttcgtgtg

SEQ ID NO: 4579678 - DNA, 13 bp, Homo sapiens
tcaggggggagaa

SEQ ID NO: 4579679 - DNA, 15 bp, Homo sapiens
tcagggtgggaagaa

SEQ ID NO: 4579680 - DNA, 15 bp, Homo sapiens
tcaggtaacactaca

SEQ ID NO: 4579681 - DNA, 21 bp, Homo sapiens
tcaggtctttactgaatgtta

SEQ ID NO: 4579682 - DNA, 23 bp, Homo sapiens
tcaggtgtagtagttctgtgttg

SEQ ID NO: 4579683 - DNA, 14 bp, Homo sapiens
tcaggttgcattgg

SEQ ID NO: 4579684 - DNA, 18 bp, Homo sapiens
tcagtaaaattatactgt

SEQ ID NO: 4579685 - DNA, 21 bp, Homo sapiens
tcagtaaaattatactgtgtg

SEQ ID NO: 4579686 - DNA, 19 bp, Homo sapiens
tcagtaacataactgcttc

SEQ ID NO: 4579687 - DNA, 21 bp, Homo sapiens
tcagtaacataactgcttctt

SEQ ID NO: 4579688 - DNA, 13 bp, Homo sapiens
tcagtaatgttat

SEQ ID NO: 4579689 - DNA, 20 bp, Homo sapiens
tcagtaatttagaaatcatt

SEQ ID NO: 4579690 - DNA, 21 bp, Homo sapiens
tcagtagaaagctaaagtgat

SEQ ID NO: 4579691 - DNA, 17 bp, Homo sapiens
tcagtaggcatcagtat

SEQ ID NO: 4579692 - DNA, 19 bp, Homo sapiens
tcagtatattttctgtatt

SEQ ID NO: 4579693 - DNA, 17 bp, Homo sapiens
tcagtatccaggctttg

SEQ ID NO: 4579694 - DNA, 12 bp, Homo sapiens
tcagtatgtgga

SEQ ID NO: 4579695 - DNA, 14 bp, Homo sapiens
tcagtatgtggaag

SEQ ID NO: 4579696 - DNA, 16 bp, Homo sapiens
tcagtatgtggaagtg

SEQ ID NO: 4579697 - DNA, 17 bp, Homo sapiens
tcagtattctgacatgt

SEQ ID NO: 4579698 - DNA, 14 bp, Homo sapiens
tcagtattttcaca

SEQ ID NO: 4579699 - DNA, 15 bp, Homo sapiens
tcagtattttcacac

SEQ ID NO: 4579700 - DNA, 14 bp, Homo sapiens
tcagtattttccag

SEQ ID NO: 4579701 - DNA, 15 bp, Homo sapiens
tcagtcaaaacttta

SEQ ID NO: 4579702 - DNA, 16 bp, Homo sapiens
tcagtcaaaactttaa

SEQ ID NO: 4579703 - DNA, 21 bp, Homo sapiens
tcagtcattagactcctcctc

SEQ ID NO: 4579704 - DNA, 16 bp, Homo sapiens
tcagtccctactgagt

SEQ ID NO: 4579705 - DNA, 18 bp, Homo sapiens
tcagtcctgtagttttat

SEQ ID NO: 4579706 - DNA, 19 bp, Homo sapiens
tcagtctcagaatgtcatt

SEQ ID NO: 4579707 - DNA, 12 bp, Homo sapiens
tcagtctgttca

SEQ ID NO: 4579708 - DNA, 22 bp, Homo sapiens
tcagtctttaatctgagaggcc

SEQ ID NO: 4579709 - DNA, 19 bp, Homo sapiens
tcagtgaagtctagaatca

SEQ ID NO: 4579710 - DNA, 22 bp, Homo sapiens
tcagtgagcccctccccagcca

SEQ ID NO: 4579711 - DNA, 22 bp, Homo sapiens
tcagtgagcctcctgtgcctgg

SEQ ID NO: 4579712 - DNA, 13 bp, Homo sapiens
tcagtgcagtttc

SEQ ID NO: 4579713 - DNA, 14 bp, Homo sapiens
tcagtgcagtttct

SEQ ID NO: 4579714 - DNA, 20 bp, Homo sapiens
tcagtgccacctatgcctgt

SEQ ID NO: 4579715 - DNA, 23 bp, Homo sapiens
tcagtgccacctatgcctgtggt

SEQ ID NO: 4579716 - DNA, 14 bp, Homo sapiens
tcagtgctcctgga

SEQ ID NO: 4579717 - DNA, 17 bp, Homo sapiens
tcagtgcttgggctcca

SEQ ID NO: 4579718 - DNA, 20 bp, Homo sapiens
tcagtggcttcatctgtcaa

SEQ ID NO: 4579719 - DNA, 23 bp, Homo sapiens
tcagtgggaacgtgactgcccca

SEQ ID NO: 4579720 - DNA, 19 bp, Homo sapiens
tcagtgtcaaataaacact

SEQ ID NO: 4579721 - DNA, 22 bp, Homo sapiens
tcagtgtcaaataaacactgtg

SEQ ID NO: 4579722 - DNA, 16 bp, Homo sapiens
tcagtgtgagtcagaa

SEQ ID NO: 4579723 - DNA, 12 bp, Homo sapiens
tcagtgttccca

SEQ ID NO: 4579724 - DNA, 14 bp, Homo sapiens
tcagtgtttatgtg

SEQ ID NO: 4579725 - DNA, 20 bp, Homo sapiens
tcagttaactattgcattta

SEQ ID NO: 4579726 - DNA, 16 bp, Homo sapiens
tcagttaggctagaga

SEQ ID NO: 4579727 - DNA, 20 bp, Homo sapiens
tcagttaggctagagacaga

SEQ ID NO: 4579728 - DNA, 21 bp, Homo sapiens
tcagttatacagttataaaat

SEQ ID NO: 4579729 - DNA, 17 bp, Homo sapiens
tcagttcaacctggtgg

SEQ ID NO: 4579730 - DNA, 16 bp, Homo sapiens
tcagttcccttggcct

SEQ ID NO: 4579731 - DNA, 23 bp, Homo sapiens
tcagttgagcttcatataccagc

SEQ ID NO: 4579732 - DNA, 18 bp, Homo sapiens
tcagttgctcaaaaagaa

SEQ ID NO: 4579733 - DNA, 20 bp, Homo sapiens
tcagttggtgtgtttttggg

SEQ ID NO: 4579734 - DNA, 13 bp, Homo sapiens
tcagttgtgtttt

SEQ ID NO: 4579735 - DNA, 16 bp, Homo sapiens
tcagttgtttgcttct

SEQ ID NO: 4579736 - DNA, 19 bp, Homo sapiens
tcagtttcacagaaaataa

SEQ ID NO: 4579737 - DNA, 21 bp, Homo sapiens
tcagtttccgaatctctttcc

SEQ ID NO: 4579738 - DNA, 20 bp, Homo sapiens
tcagtttgaaaatattttgt

SEQ ID NO: 4579739 - DNA, 21 bp, Homo sapiens
tcagtttgaaaatattttgtt

SEQ ID NO: 4579740 - DNA, 20 bp, Homo sapiens
tcagtttgttccttttgtac

SEQ ID NO: 4579741 - DNA, 13 bp, Homo sapiens
tcagttttcattt

SEQ ID NO: 4579742 - DNA, 18 bp, Homo sapiens
tcagtttttattaatcta

SEQ ID NO: 4579743 - DNA, 18 bp, Homo sapiens
tcagtttttttttttcca

SEQ ID NO: 4579744 - DNA, 19 bp, Homo sapiens
tcagtttttttttttccag

SEQ ID NO: 4579745 - DNA, 10 bp, Homo sapiens
tcataaacac

SEQ ID NO: 4579746 - DNA, 13 bp, Homo sapiens
tcataaagtgaga

SEQ ID NO: 4579747 - DNA, 22 bp, Homo sapiens
tcataaagtgagaaaactgtga

SEQ ID NO: 4579748 - DNA, 21 bp, Homo sapiens
tcataaatttgaataagcaga

SEQ ID NO: 4579749 - DNA, 20 bp, Homo sapiens
tcataacagtgccattgtct

SEQ ID NO: 4579750 - DNA, 22 bp, Homo sapiens
tcataacagtgccattgtcttt

SEQ ID NO: 4579751 - DNA, 15 bp, Homo sapiens
tcataacttattgct

SEQ ID NO: 4579752 - DNA, 20 bp, Homo sapiens
tcataacttattgctgattt

SEQ ID NO: 4579753 - DNA, 20 bp, Homo sapiens
tcataagtattatgtctctt

SEQ ID NO: 4579754 - DNA, 20 bp, Homo sapiens
tcataagtatttcaaattgg

SEQ ID NO: 4579755 - DNA, 14 bp, Homo sapiens
tcataataaatttt

SEQ ID NO: 4579756 - DNA, 12 bp, Homo sapiens
tcataattcaga

SEQ ID NO: 4579757 - DNA, 18 bp, Homo sapiens
tcataattcctacagcac

SEQ ID NO: 4579758 - DNA, 13 bp, Homo sapiens
tcataattctgaa

SEQ ID NO: 4579759 - DNA, 14 bp, Homo sapiens
tcataattctgaaa

SEQ ID NO: 4579760 - DNA, 15 bp, Homo sapiens
tcataattctgaaac

SEQ ID NO: 4579761 - DNA, 19 bp, Homo sapiens
tcataatttgtttccagca

SEQ ID NO: 4579762 - DNA, 16 bp, Homo sapiens
tcatacaaactctcac

SEQ ID NO: 4579763 - DNA, 23 bp, Homo sapiens
tcatacaagtcatggtcacagta

SEQ ID NO: 4579764 - DNA, 16 bp, Homo sapiens
tcatacaccagaagac

SEQ ID NO: 4579765 - DNA, 13 bp, Homo sapiens
tcatacagaaggc

SEQ ID NO: 4579766 - DNA, 16 bp, Homo sapiens
tcatacagttttcatt

SEQ ID NO: 4579767 - DNA, 18 bp, Homo sapiens
tcatacctatcatcttaa

SEQ ID NO: 4579768 - DNA, 13 bp, Homo sapiens
tcatactgtacac

SEQ ID NO: 4579769 - DNA, 14 bp, Homo sapiens
tcatactgtacaca

SEQ ID NO: 4579770 - DNA, 16 bp, Homo sapiens
tcatactgtacacatt

SEQ ID NO: 4579771 - DNA, 18 bp, Homo sapiens
tcatactgtacacatttc

SEQ ID NO: 4579772 - DNA, 19 bp, Homo sapiens
tcatactgtacacatttct

SEQ ID NO: 4579773 - DNA, 20 bp, Homo sapiens
tcatactgtacacatttctt

SEQ ID NO: 4579774 - DNA, 19 bp, Homo sapiens
tcatacttaaaaatttatt

SEQ ID NO: 4579775 - DNA, 17 bp, Homo sapiens
tcatagaaaattgaaac

SEQ ID NO: 4579776 - DNA, 14 bp, Homo sapiens
tcatagaacattga

SEQ ID NO: 4579777 - DNA, 21 bp, Homo sapiens
tcatagaacattgatctgttt

SEQ ID NO: 4579778 - DNA, 14 bp, Homo sapiens
tcatagaagtgttg

SEQ ID NO: 4579779 - DNA, 16 bp, Homo sapiens
tcatagattattataa

SEQ ID NO: 4579780 - DNA, 22 bp, Homo sapiens
tcatagattattataaactata

SEQ ID NO: 4579781 - DNA, 15 bp, Homo sapiens
tcatagattgcaaat

SEQ ID NO: 4579782 - DNA, 15 bp, Homo sapiens
tcatagcactgcaga

SEQ ID NO: 4579783 - DNA, 18 bp, Homo sapiens
tcatagcaggaaatgtag

SEQ ID NO: 4579784 - DNA, 17 bp, Homo sapiens
tcatagccataaatgat

SEQ ID NO: 4579785 - DNA, 22 bp, Homo sapiens
tcatagccctcagacatttata

SEQ ID NO: 4579786 - DNA, 18 bp, Homo sapiens
tcatagctcactgcagcc

SEQ ID NO: 4579787 - DNA, 15 bp, Homo sapiens
tcatagcttcacaat

SEQ ID NO: 4579788 - DNA, 21 bp, Homo sapiens
tcataggttaaaaaaaaaagt

SEQ ID NO: 4579789 - DNA, 15 bp, Homo sapiens
tcatagtaacttctt

SEQ ID NO: 4579790 - DNA, 16 bp, Homo sapiens
tcatagtaacttctta

SEQ ID NO: 4579791 - DNA, 20 bp, Homo sapiens
tcatagtactctttgtagca

SEQ ID NO: 4579792 - DNA, 22 bp, Homo sapiens
tcatagtactctttgtagcaaa

SEQ ID NO: 4579793 - DNA, 14 bp, Homo sapiens
tcatagttaacata

SEQ ID NO: 4579794 - DNA, 18 bp, Homo sapiens
tcatataaagtatcatca

SEQ ID NO: 4579795 - DNA, 13 bp, Homo sapiens
tcatatacaaaca

SEQ ID NO: 4579796 - DNA, 20 bp, Homo sapiens
tcatatacaaacatgtatgt

SEQ ID NO: 4579797 - DNA, 19 bp, Homo sapiens
tcatatatactgtatcctg

SEQ ID NO: 4579798 - DNA, 12 bp, Homo sapiens
tcatatattaaa

SEQ ID NO: 4579799 - DNA, 16 bp, Homo sapiens
tcatatattgctttat

SEQ ID NO: 4579800 - DNA, 17 bp, Homo sapiens
tcatatcactaaataaa

SEQ ID NO: 4579801 - DNA, 14 bp, Homo sapiens
tcatatccttttga

SEQ ID NO: 4579802 - DNA, 13 bp, Homo sapiens
tcatatctaaata

SEQ ID NO: 4579803 - DNA, 22 bp, Homo sapiens
tcatattaatataagtttcttt

SEQ ID NO: 4579804 - DNA, 21 bp, Homo sapiens
tcatattattttagtgtgtaa

SEQ ID NO: 4579805 - DNA, 21 bp, Homo sapiens
tcatattgtgattctgccttt

SEQ ID NO: 4579806 - DNA, 15 bp, Homo sapiens
tcatattttgttgtg

SEQ ID NO: 4579807 - DNA, 19 bp, Homo sapiens
tcatcaaaacctgcgcagt

SEQ ID NO: 4579808 - DNA, 13 bp, Homo sapiens
tcatcaactgaat

SEQ ID NO: 4579809 - DNA, 15 bp, Homo sapiens
tcatcaactgaatga

SEQ ID NO: 4579810 - DNA, 21 bp, Homo sapiens
tcatcaagagtttattattgt

SEQ ID NO: 4579811 - DNA, 14 bp, Homo sapiens
tcatcaccatttcc

SEQ ID NO: 4579812 - DNA, 16 bp, Homo sapiens
tcatcacctgctagaa

SEQ ID NO: 4579813 - DNA, 13 bp, Homo sapiens
tcatcactgtaaa

SEQ ID NO: 4579814 - DNA, 14 bp, Homo sapiens
tcatcactgtaaag

SEQ ID NO: 4579815 - DNA, 16 bp, Homo sapiens
tcatcagaaaggaaaa

SEQ ID NO: 4579816 - DNA, 15 bp, Homo sapiens
tcatcagagcctttc

SEQ ID NO: 4579817 - DNA, 22 bp, Homo sapiens
tcatcagatgcttgcggcaaaa

SEQ ID NO: 4579818 - DNA, 20 bp, Homo sapiens
tcatcagtaagcagcctttg

SEQ ID NO: 4579819 - DNA, 18 bp, Homo sapiens
tcatcagtcatcaggtgt

SEQ ID NO: 4579820 - DNA, 19 bp, Homo sapiens
tcatcatgcagctcaactt

SEQ ID NO: 4579821 - DNA, 16 bp, Homo sapiens
tcatcatgtctattgt

SEQ ID NO: 4579822 - DNA, 13 bp, Homo sapiens
tcatcattctctg

SEQ ID NO: 4579823 - DNA, 20 bp, Homo sapiens
tcatcattctctgtctcatc

SEQ ID NO: 4579824 - DNA, 12 bp, Homo sapiens
tcatcatttcag

SEQ ID NO: 4579825 - DNA, 18 bp, Homo sapiens
tcatcatttcagccaaag

SEQ ID NO: 4579826 - DNA, 19 bp, Homo sapiens
tcatccacataagcactcc

SEQ ID NO: 4579827 - DNA, 21 bp, Homo sapiens
tcatccagtttgttctccggg

SEQ ID NO: 4579828 - DNA, 16 bp, Homo sapiens
tcatccatagacacag

SEQ ID NO: 4579829 - DNA, 11 bp, Homo sapiens
tcatccatcat

SEQ ID NO: 4579830 - DNA, 16 bp, Homo sapiens
tcatccatcatcatgt

SEQ ID NO: 4579831 - DNA, 22 bp, Homo sapiens
tcatccgttgtgactctaggct

SEQ ID NO: 4579832 - DNA, 12 bp, Homo sapiens
tcatcctaacaa

SEQ ID NO: 4579833 - DNA, 23 bp, Homo sapiens
tcatcctcaaagaaagtgtattg

SEQ ID NO: 4579834 - DNA, 16 bp, Homo sapiens
tcatcctcccattgcc

SEQ ID NO: 4579835 - DNA, 20 bp, Homo sapiens
tcatcctccctgaccctgct

SEQ ID NO: 4579836 - DNA, 16 bp, Homo sapiens
tcatcctgactctgcc

SEQ ID NO: 4579837 - DNA, 20 bp, Homo sapiens
tcatcctgtagggcacccaa

SEQ ID NO: 4579838 - DNA, 22 bp, Homo sapiens
tcatccttcttccactgtctca

SEQ ID NO: 4579839 - DNA, 21 bp, Homo sapiens
tcatcgaatctactaattcca

SEQ ID NO: 4579840 - DNA, 15 bp, Homo sapiens
tcatcgaatgctaaa

SEQ ID NO: 4579841 - DNA, 19 bp, Homo sapiens
tcatcggaggctgggcccc

SEQ ID NO: 4579842 - DNA, 18 bp, Homo sapiens
tcatctaataaatcagtg

SEQ ID NO: 4579843 - DNA, 16 bp, Homo sapiens
tcatctaccttttctg

SEQ ID NO: 4579844 - DNA, 13 bp, Homo sapiens
tcatctacttttt

SEQ ID NO: 4579845 - DNA, 18 bp, Homo sapiens
tcatctagcgcaattgaa

SEQ ID NO: 4579846 - DNA, 22 bp, Homo sapiens
tcatctatgagggtgtttcctc

SEQ ID NO: 4579847 - DNA, 17 bp, Homo sapiens
tcatctatggttctaaa

SEQ ID NO: 4579848 - DNA, 18 bp, Homo sapiens
tcatctatggttctaaat

SEQ ID NO: 4579849 - DNA, 13 bp, Homo sapiens
tcatctattttga

SEQ ID NO: 4579850 - DNA, 14 bp, Homo sapiens
tcatctattttgat

SEQ ID NO: 4579851 - DNA, 20 bp, Homo sapiens
tcatctattttgatgcagca

SEQ ID NO: 4579852 - DNA, 14 bp, Homo sapiens
tcatctcagaccct

SEQ ID NO: 4579853 - DNA, 14 bp, Homo sapiens
tcatctcccacgaa

SEQ ID NO: 4579854 - DNA, 13 bp, Homo sapiens
tcatctcccaggc

SEQ ID NO: 4579855 - DNA, 15 bp, Homo sapiens
tcatctcctgccttc

SEQ ID NO: 4579856 - DNA, 21 bp, Homo sapiens
tcatctcctgccttcctcctg

SEQ ID NO: 4579857 - DNA, 15 bp, Homo sapiens
tcatctctctggggc

SEQ ID NO: 4579858 - DNA, 20 bp, Homo sapiens
tcatctctctggggccctgg

SEQ ID NO: 4579859 - DNA, 22 bp, Homo sapiens
tcatctctctggggccctgggc

SEQ ID NO: 4579860 - DNA, 13 bp, Homo sapiens
tcatctcttagct

SEQ ID NO: 4579861 - DNA, 21 bp, Homo sapiens
tcatctcttagctcccctcca

SEQ ID NO: 4579862 - DNA, 17 bp, Homo sapiens
tcatctgatgagaacaa

SEQ ID NO: 4579863 - DNA, 23 bp, Homo sapiens
tcatctggcaacatctttatccg

SEQ ID NO: 4579864 - DNA, 15 bp, Homo sapiens
tcatctgggacaaaa

SEQ ID NO: 4579865 - DNA, 18 bp, Homo sapiens
tcatctggggacctggtt

SEQ ID NO: 4579866 - DNA, 20 bp, Homo sapiens
tcatctggttgaactctggt

SEQ ID NO: 4579867 - DNA, 17 bp, Homo sapiens
tcatctgtcattatatt

SEQ ID NO: 4579868 - DNA, 21 bp, Homo sapiens
tcatctgtcattatattctaa

SEQ ID NO: 4579869 - DNA, 16 bp, Homo sapiens
tcatctgtttgtaatc

SEQ ID NO: 4579870 - DNA, 16 bp, Homo sapiens
tcatcttcttcaccat

SEQ ID NO: 4579871 - DNA, 11 bp, Homo sapiens
tcatcttgcta

SEQ ID NO: 4579872 - DNA, 21 bp, Homo sapiens
tcatcttgctaccagtattta

SEQ ID NO: 4579873 - DNA, 22 bp, Homo sapiens
tcatcttgctaccagtatttag

SEQ ID NO: 4579874 - DNA, 17 bp, Homo sapiens
tcatctttcttccaaac

SEQ ID NO: 4579875 - DNA, 15 bp, Homo sapiens
tcatcttttgaagag

SEQ ID NO: 4579876 - DNA, 14 bp, Homo sapiens
tcatctttttctag

SEQ ID NO: 4579877 - DNA, 21 bp, Homo sapiens
tcatgaaaaagctgcttctta

SEQ ID NO: 4579878 - DNA, 19 bp, Homo sapiens
tcatgaaaatgtattcctt

SEQ ID NO: 4579879 - DNA, 23 bp, Homo sapiens
tcatgaacatgttcctgaattct

SEQ ID NO: 4579880 - DNA, 11 bp, Homo sapiens
tcatgaagcct

SEQ ID NO: 4579881 - DNA, 13 bp, Homo sapiens
tcatgaatgcttt

SEQ ID NO: 4579882 - DNA, 15 bp, Homo sapiens
tcatgaatgctttta

SEQ ID NO: 4579883 - DNA, 16 bp, Homo sapiens
tcatgaattttaaagt

SEQ ID NO: 4579884 - DNA, 22 bp, Homo sapiens
tcatgacaagatgggacagcaa

SEQ ID NO: 4579885 - DNA, 14 bp, Homo sapiens
tcatgagcccacca

SEQ ID NO: 4579886 - DNA, 13 bp, Homo sapiens
tcatgatccaact

SEQ ID NO: 4579887 - DNA, 16 bp, Homo sapiens
tcatgatccaactaat

SEQ ID NO: 4579888 - DNA, 16 bp, Homo sapiens
tcatgatctccctgcc

SEQ ID NO: 4579889 - DNA, 17 bp, Homo sapiens
tcatgatgcagtctcct

SEQ ID NO: 4579890 - DNA, 21 bp, Homo sapiens
tcatgatgcagtctcctcttt

SEQ ID NO: 4579891 - DNA, 23 bp, Homo sapiens
tcatgatgcagtctcctctttaa

SEQ ID NO: 4579892 - DNA, 15 bp, Homo sapiens
tcatgatgctagcca

SEQ ID NO: 4579893 - DNA, 23 bp, Homo sapiens
tcatgattagaaattacctgtgg

SEQ ID NO: 4579894 - DNA, 13 bp, Homo sapiens
tcatgcaaaatat

SEQ ID NO: 4579895 - DNA, 18 bp, Homo sapiens
tcatgcaaactgctttat

SEQ ID NO: 4579896 - DNA, 17 bp, Homo sapiens
tcatgcacagtatttgt

SEQ ID NO: 4579897 - DNA, 18 bp, Homo sapiens
tcatgcccaccccctgcc

SEQ ID NO: 4579898 - DNA, 22 bp, Homo sapiens
tcatgcccaccccctgccctgc

SEQ ID NO: 4579899 - DNA, 23 bp, Homo sapiens
tcatgcccaccccctgccctgca

SEQ ID NO: 4579900 - DNA, 15 bp, Homo sapiens
tcatgccccctttca

SEQ ID NO: 4579901 - DNA, 18 bp, Homo sapiens
tcatgccccctttcagat

SEQ ID NO: 4579902 - DNA, 17 bp, Homo sapiens
tcatgcctcctgaggct

SEQ ID NO: 4579903 - DNA, 20 bp, Homo sapiens
tcatgcctcctgaggctgtt

SEQ ID NO: 4579904 - DNA, 16 bp, Homo sapiens
tcatgcgtacgtccca

SEQ ID NO: 4579905 - DNA, 14 bp, Homo sapiens
tcatggaagaaaag

SEQ ID NO: 4579906 - DNA, 21 bp, Homo sapiens
tcatggatatgttatactgaa

SEQ ID NO: 4579907 - DNA, 13 bp, Homo sapiens
tcatggattactt

SEQ ID NO: 4579908 - DNA, 17 bp, Homo sapiens
tcatgggggtaagaaaa

SEQ ID NO: 4579909 - DNA, 14 bp, Homo sapiens
tcatgggtcctagc

SEQ ID NO: 4579910 - DNA, 17 bp, Homo sapiens
tcatggtactaccccag

SEQ ID NO: 4579911 - DNA, 18 bp, Homo sapiens
tcatggtactaccccagc

SEQ ID NO: 4579912 - DNA, 20 bp, Homo sapiens
tcatggtacttcctctgtga

SEQ ID NO: 4579913 - DNA, 18 bp, Homo sapiens
tcatggtcctttctggaa

SEQ ID NO: 4579914 - DNA, 13 bp, Homo sapiens
tcatgtaaactgt

SEQ ID NO: 4579915 - DNA, 17 bp, Homo sapiens
tcatgtaaactgtgcac

SEQ ID NO: 4579916 - DNA, 17 bp, Homo sapiens
tcatgtacaagatgaag

SEQ ID NO: 4579917 - DNA, 22 bp, Homo sapiens
tcatgtactttttagtaatttc

SEQ ID NO: 4579918 - DNA, 20 bp, Homo sapiens
tcatgtatcatctggatagg

SEQ ID NO: 4579919 - DNA, 21 bp, Homo sapiens
tcatgtatgtatataatcatg

SEQ ID NO: 4579920 - DNA, 13 bp, Homo sapiens
tcatgtctattgt

SEQ ID NO: 4579921 - DNA, 20 bp, Homo sapiens
tcatgtctattgtccaaagt

SEQ ID NO: 4579922 - DNA, 14 bp, Homo sapiens
tcatgtcttgtcat

SEQ ID NO: 4579923 - DNA, 20 bp, Homo sapiens
tcatgtggtgaatatgcaag

SEQ ID NO: 4579924 - DNA, 16 bp, Homo sapiens
tcatgtgtgtccacga

SEQ ID NO: 4579925 - DNA, 14 bp, Homo sapiens
tcatgtgttccctt

SEQ ID NO: 4579926 - DNA, 15 bp, Homo sapiens
tcatgttaacctctg

SEQ ID NO: 4579927 - DNA, 21 bp, Homo sapiens
tcatgttaacctctgctttta

SEQ ID NO: 4579928 - DNA, 15 bp, Homo sapiens
tcatgttagttacct

SEQ ID NO: 4579929 - DNA, 19 bp, Homo sapiens
tcatgttgttgtgtgtata

SEQ ID NO: 4579930 - DNA, 15 bp, Homo sapiens
tcatgttttaatgta

SEQ ID NO: 4579931 - DNA, 15 bp, Homo sapiens
tcattaaacaaataa

SEQ ID NO: 4579932 - DNA, 16 bp, Homo sapiens
tcattaaactttttta

SEQ ID NO: 4579933 - DNA, 13 bp, Homo sapiens
tcattaaattact

SEQ ID NO: 4579934 - DNA, 22 bp, Homo sapiens
tcattaatagctgccttcaagg

SEQ ID NO: 4579935 - DNA, 13 bp, Homo sapiens
tcattaattctat

SEQ ID NO: 4579936 - DNA, 13 bp, Homo sapiens
tcattagactcct

SEQ ID NO: 4579937 - DNA, 16 bp, Homo sapiens
tcattaggatggctag

SEQ ID NO: 4579938 - DNA, 23 bp, Homo sapiens
tcattagttttgaagattctatg

SEQ ID NO: 4579939 - DNA, 20 bp, Homo sapiens
tcattatattctaattaaaa

SEQ ID NO: 4579940 - DNA, 14 bp, Homo sapiens
tcattatgctttga

SEQ ID NO: 4579941 - DNA, 16 bp, Homo sapiens
tcattatgctttgaac

SEQ ID NO: 4579942 - DNA, 19 bp, Homo sapiens
tcattatgctttgaacttt

SEQ ID NO: 4579943 - DNA, 21 bp, Homo sapiens
tcattatgctttgaactttag

SEQ ID NO: 4579944 - DNA, 13 bp, Homo sapiens
tcattatgtcaac

SEQ ID NO: 4579945 - DNA, 18 bp, Homo sapiens
tcattatttattaaattt

SEQ ID NO: 4579946 - DNA, 16 bp, Homo sapiens
tcattatttcaaaatg

SEQ ID NO: 4579947 - DNA, 13 bp, Homo sapiens
tcattatttctgg

SEQ ID NO: 4579948 - DNA, 15 bp, Homo sapiens
tcattatttgtcaaa

SEQ ID NO: 4579949 - DNA, 19 bp, Homo sapiens
tcattatttgtcaaattgt

SEQ ID NO: 4579950 - DNA, 22 bp, Homo sapiens
tcattatttttgttagcaaaga

SEQ ID NO: 4579951 - DNA, 13 bp, Homo sapiens
tcattcaggaaaa

SEQ ID NO: 4579952 - DNA, 13 bp, Homo sapiens
tcattcagtattt

SEQ ID NO: 4579953 - DNA, 23 bp, Homo sapiens
tcattcatgaatattttcaagtt

SEQ ID NO: 4579954 - DNA, 14 bp, Homo sapiens
tcattcatttttgt

SEQ ID NO: 4579955 - DNA, 13 bp, Homo sapiens
tcattccattgcc

SEQ ID NO: 4579956 - DNA, 14 bp, Homo sapiens
tcattccattgcct

SEQ ID NO: 4579957 - DNA, 13 bp, Homo sapiens
tcattcccagagt

SEQ ID NO: 4579958 - DNA, 18 bp, Homo sapiens
tcattcctcacaatgagg

SEQ ID NO: 4579959 - DNA, 15 bp, Homo sapiens
tcattcggtgtgaac

SEQ ID NO: 4579960 - DNA, 21 bp, Homo sapiens
tcattcggtgtgaacttttct

SEQ ID NO: 4579961 - DNA, 16 bp, Homo sapiens
tcattctcgtgagtca

SEQ ID NO: 4579962 - DNA, 14 bp, Homo sapiens
tcattctctgtctc

SEQ ID NO: 4579963 - DNA, 19 bp, Homo sapiens
tcattctctgtctcatcca

SEQ ID NO: 4579964 - DNA, 22 bp, Homo sapiens
tcattctgccaaagtaaaacaa

SEQ ID NO: 4579965 - DNA, 14 bp, Homo sapiens
tcattctttgcagg

SEQ ID NO: 4579966 - DNA, 20 bp, Homo sapiens
tcattgaaagcttcaaagtt

SEQ ID NO: 4579967 - DNA, 12 bp, Homo sapiens
tcattgacttca

SEQ ID NO: 4579968 - DNA, 14 bp, Homo sapiens
tcattgacttcatt

SEQ ID NO: 4579969 - DNA, 21 bp, Homo sapiens
tcattgacttcattttatatt

SEQ ID NO: 4579970 - DNA, 20 bp, Homo sapiens
tcattgcacctatctcagcc

SEQ ID NO: 4579971 - DNA, 19 bp, Homo sapiens
tcattgccaagggcccaaa

SEQ ID NO: 4579972 - DNA, 15 bp, Homo sapiens
tcattgccagtgtct

SEQ ID NO: 4579973 - DNA, 16 bp, Homo sapiens
tcattgccagtgtctt

SEQ ID NO: 4579974 - DNA, 18 bp, Homo sapiens
tcattgccagtgtctttc

SEQ ID NO: 4579975 - DNA, 17 bp, Homo sapiens
tcattgctaaactgatg

SEQ ID NO: 4579976 - DNA, 18 bp, Homo sapiens
tcattggcccaacaagaa

SEQ ID NO: 4579977 - DNA, 20 bp, Homo sapiens
tcattgggtttttcctctgt

SEQ ID NO: 4579978 - DNA, 22 bp, Homo sapiens
tcattgggtttttcctctgtta

SEQ ID NO: 4579979 - DNA, 22 bp, Homo sapiens
tcattgtctactcctagaagaa

SEQ ID NO: 4579980 - DNA, 14 bp, Homo sapiens
tcattgtgttacat

SEQ ID NO: 4579981 - DNA, 17 bp, Homo sapiens
tcattgttttgaatatt

SEQ ID NO: 4579982 - DNA, 22 bp, Homo sapiens
tcatttaaaaaggtttaaaact

SEQ ID NO: 4579983 - DNA, 13 bp, Homo sapiens
tcatttaaatatc

SEQ ID NO: 4579984 - DNA, 15 bp, Homo sapiens
tcatttaagggaaaa

SEQ ID NO: 4579985 - DNA, 16 bp, Homo sapiens
tcatttacaaaagatt

SEQ ID NO: 4579986 - DNA, 12 bp, Homo sapiens
tcatttagatgc

SEQ ID NO: 4579987 - DNA, 17 bp, Homo sapiens
tcatttagatgcacttt

SEQ ID NO: 4579988 - DNA, 21 bp, Homo sapiens
tcatttagtaaggattttatg

SEQ ID NO: 4579989 - DNA, 23 bp, Homo sapiens
tcatttataaagggacactttta

SEQ ID NO: 4579990 - DNA, 18 bp, Homo sapiens
tcatttataatactgttt

SEQ ID NO: 4579991 - DNA, 20 bp, Homo sapiens
tcatttataatactgtttta

SEQ ID NO: 4579992 - DNA, 21 bp, Homo sapiens
tcatttatctataatttacct

SEQ ID NO: 4579993 - DNA, 14 bp, Homo sapiens
tcatttcacccctc

SEQ ID NO: 4579994 - DNA, 16 bp, Homo sapiens
tcatttcacccctccc

SEQ ID NO: 4579995 - DNA, 15 bp, Homo sapiens
tcatttcatgctctg

SEQ ID NO: 4579996 - DNA, 13 bp, Homo sapiens
tcatttctatttc

SEQ ID NO: 4579997 - DNA, 22 bp, Homo sapiens
tcatttctgcatcagctgctga

SEQ ID NO: 4579998 - DNA, 16 bp, Homo sapiens
tcatttgctgttcatc

SEQ ID NO: 4579999 - DNA, 17 bp, Homo sapiens
tcatttggttggcacta

SEQ ID NO: 4580000 - DNA, 12 bp, Homo sapiens
tcatttgtttac

SEQ ID NO: 4580001 - DNA, 18 bp, Homo sapiens
tcatttgtttacatttga

SEQ ID NO: 4580002 - DNA, 16 bp, Homo sapiens
tcattttaaattccac

SEQ ID NO: 4580003 - DNA, 22 bp, Homo sapiens
tcattttaactggcatgtcatt

SEQ ID NO: 4580004 - DNA, 12 bp, Homo sapiens
tcattttaatat

SEQ ID NO: 4580005 - DNA, 13 bp, Homo sapiens
tcattttaatgta

SEQ ID NO: 4580006 - DNA, 17 bp, Homo sapiens
tcattttaatgtaaaga

SEQ ID NO: 4580007 - DNA, 19 bp, Homo sapiens
tcattttaatgtaaagatt

SEQ ID NO: 4580008 - DNA, 15 bp, Homo sapiens
tcattttaggaaagg

SEQ ID NO: 4580009 - DNA, 19 bp, Homo sapiens
tcattttccccccactctc

SEQ ID NO: 4580010 - DNA, 14 bp, Homo sapiens
tcattttctagata

SEQ ID NO: 4580011 - DNA, 18 bp, Homo sapiens
tcattttgaccatataga

SEQ ID NO: 4580012 - DNA, 14 bp, Homo sapiens
tcatttttatagca

SEQ ID NO: 4580013 - DNA, 16 bp, Homo sapiens
tcatttttgagcaact

SEQ ID NO: 4580014 - DNA, 14 bp, Homo sapiens
tcatttttgtattt

SEQ ID NO: 4580015 - DNA, 13 bp, Homo sapiens
tcatttttttcca

SEQ ID NO: 4580016 - DNA, 18 bp, Homo sapiens
tcatttttttccaggctg

SEQ ID NO: 4580017 - DNA, 18 bp, Homo sapiens
tccaaaaaaaaaaaaaat

SEQ ID NO: 4580018 - DNA, 21 bp, Homo sapiens
tccaaaaaaaaaaaaaataca

SEQ ID NO: 4580019 - DNA, 23 bp, Homo sapiens
tccaaaaaaaaaaaaaatacaat

SEQ ID NO: 4580020 - DNA, 17 bp, Homo sapiens
tccaaaaagctctgaaa

SEQ ID NO: 4580021 - DNA, 19 bp, Homo sapiens
tccaaaaagctctgaaaac

SEQ ID NO: 4580022 - DNA, 22 bp, Homo sapiens
tccaaaaagctctgaaaacaag

SEQ ID NO: 4580023 - DNA, 15 bp, Homo sapiens
tccaaaaatctgcct

SEQ ID NO: 4580024 - DNA, 21 bp, Homo sapiens
tccaaaaatgtgtaagaacaa

SEQ ID NO: 4580025 - DNA, 19 bp, Homo sapiens
tccaaaagattgctgaaat

SEQ ID NO: 4580026 - DNA, 21 bp, Homo sapiens
tccaaaataatctatattaaa

SEQ ID NO: 4580027 - DNA, 13 bp, Homo sapiens
tccaaaatgcttg

SEQ ID NO: 4580028 - DNA, 20 bp, Homo sapiens
tccaaacatgtatttatgta

SEQ ID NO: 4580029 - DNA, 22 bp, Homo sapiens
tccaaacctggttcatatttat

SEQ ID NO: 4580030 - DNA, 14 bp, Homo sapiens
tccaaagactccct

SEQ ID NO: 4580031 - DNA, 13 bp, Homo sapiens
tccaaagagaaaa

SEQ ID NO: 4580032 - DNA, 14 bp, Homo sapiens
tccaaagaggctgc

SEQ ID NO: 4580033 - DNA, 16 bp, Homo sapiens
tccaaagaggctgccc

SEQ ID NO: 4580034 - DNA, 18 bp, Homo sapiens
tccaaagaggctgcccct

SEQ ID NO: 4580035 - DNA, 20 bp, Homo sapiens
tccaaagagtagaattgcat

SEQ ID NO: 4580036 - DNA, 13 bp, Homo sapiens
tccaaagctttat

SEQ ID NO: 4580037 - DNA, 14 bp, Homo sapiens
tccaaaggccccct

SEQ ID NO: 4580038 - DNA, 22 bp, Homo sapiens
tccaaatgtcctccagaagcct

SEQ ID NO: 4580039 - DNA, 18 bp, Homo sapiens
tccaaatgtcctttctca

SEQ ID NO: 4580040 - DNA, 19 bp, Homo sapiens
tccaaatgtcctttctcag

SEQ ID NO: 4580041 - DNA, 20 bp, Homo sapiens
tccaaatgtcctttctcaga

SEQ ID NO: 4580042 - DNA, 17 bp, Homo sapiens
tccaaattatttcttaa

SEQ ID NO: 4580043 - DNA, 16 bp, Homo sapiens
tccaaattcagtttca

SEQ ID NO: 4580044 - DNA, 20 bp, Homo sapiens
tccaaccccccagcactgag

SEQ ID NO: 4580045 - DNA, 23 bp, Homo sapiens
tccaaccccccagcactgaggaa

SEQ ID NO: 4580046 - DNA, 18 bp, Homo sapiens
tccaacctaacccctttc

SEQ ID NO: 4580047 - DNA, 20 bp, Homo sapiens
tccaacctaacccctttcct

SEQ ID NO: 4580048 - DNA, 17 bp, Homo sapiens
tccaacctggacaacaa

SEQ ID NO: 4580049 - DNA, 15 bp, Homo sapiens
tccaactaatgcctt

SEQ ID NO: 4580050 - DNA, 18 bp, Homo sapiens
tccaacttaaaaaggcaa

SEQ ID NO: 4580051 - DNA, 19 bp, Homo sapiens
tccaacttcctgtggcctg

SEQ ID NO: 4580052 - DNA, 15 bp, Homo sapiens
tccaagacagcagca

SEQ ID NO: 4580053 - DNA, 17 bp, Homo sapiens
tccaagacatgtctgtt

SEQ ID NO: 4580054 - DNA, 17 bp, Homo sapiens
tccaagactcagatgat

SEQ ID NO: 4580055 - DNA, 18 bp, Homo sapiens
tccaagatattttaaaat

SEQ ID NO: 4580056 - DNA, 16 bp, Homo sapiens
tccaagcacagagcct

SEQ ID NO: 4580057 - DNA, 17 bp, Homo sapiens
tccaagcacagagcctg

SEQ ID NO: 4580058 - DNA, 22 bp, Homo sapiens
tccaagcacagagcctggcccc

SEQ ID NO: 4580059 - DNA, 14 bp, Homo sapiens
tccaagcatttcat

SEQ ID NO: 4580060 - DNA, 20 bp, Homo sapiens
tccaagccaagttttctcaa

SEQ ID NO: 4580061 - DNA, 13 bp, Homo sapiens
tccaagcctgcct

SEQ ID NO: 4580062 - DNA, 22 bp, Homo sapiens
tccaagcttccatagctgctgc

SEQ ID NO: 4580063 - DNA, 16 bp, Homo sapiens
tccaagctttgggttg

SEQ ID NO: 4580064 - DNA, 16 bp, Homo sapiens
tccaaggccagtcccc

SEQ ID NO: 4580065 - DNA, 19 bp, Homo sapiens
tccaagggttgagagccag

SEQ ID NO: 4580066 - DNA, 14 bp, Homo sapiens
tccaaggtggcaga

SEQ ID NO: 4580067 - DNA, 13 bp, Homo sapiens
tccaagttcaaaa

SEQ ID NO: 4580068 - DNA, 23 bp, Homo sapiens
tccaataaaaacattttgaagtg

SEQ ID NO: 4580069 - DNA, 16 bp, Homo sapiens
tccaataaagtgcctt

SEQ ID NO: 4580070 - DNA, 23 bp, Homo sapiens
tccaataaagtgccttctgggct

SEQ ID NO: 4580071 - DNA, 11 bp, Homo sapiens
tccaatatttt

SEQ ID NO: 4580072 - DNA, 15 bp, Homo sapiens
tccaatattttaata

SEQ ID NO: 4580073 - DNA, 16 bp, Homo sapiens
tccaatattttaataa

SEQ ID NO: 4580074 - DNA, 16 bp, Homo sapiens
tccaatattttgcctt

SEQ ID NO: 4580075 - DNA, 17 bp, Homo sapiens
tccaatctgtcacataa

SEQ ID NO: 4580076 - DNA, 21 bp, Homo sapiens
tccaatgactgagcagcatcc

SEQ ID NO: 4580077 - DNA, 16 bp, Homo sapiens
tccaatgcactgatgt

SEQ ID NO: 4580078 - DNA, 22 bp, Homo sapiens
tccaatgccacatacttgcagc

SEQ ID NO: 4580079 - DNA, 15 bp, Homo sapiens
tccaatggaaagctt

SEQ ID NO: 4580080 - DNA, 22 bp, Homo sapiens
tccaatggaaagcttttcagtg

SEQ ID NO: 4580081 - DNA, 19 bp, Homo sapiens
tccaattccttgcacatag

SEQ ID NO: 4580082 - DNA, 11 bp, Homo sapiens
tccaattctat

SEQ ID NO: 4580083 - DNA, 20 bp, Homo sapiens
tccaattctgaaatactttt

SEQ ID NO: 4580084 - DNA, 17 bp, Homo sapiens
tccaattttttcttaaa

SEQ ID NO: 4580085 - DNA, 20 bp, Homo sapiens
tccacaaaataaccaatcct

SEQ ID NO: 4580086 - DNA, 16 bp, Homo sapiens
tccacaagattcccag

SEQ ID NO: 4580087 - DNA, 21 bp, Homo sapiens
tccacaagattcccagagaca

SEQ ID NO: 4580088 - DNA, 17 bp, Homo sapiens
tccacacatgaatctgc

SEQ ID NO: 4580089 - DNA, 21 bp, Homo sapiens
tccacaccttttattgacaca

SEQ ID NO: 4580090 - DNA, 19 bp, Homo sapiens
tccacagaacctttgtcaa

SEQ ID NO: 4580091 - DNA, 22 bp, Homo sapiens
tccacagctggcctggtttcct

SEQ ID NO: 4580092 - DNA, 18 bp, Homo sapiens
tccacaggggccaccacc

SEQ ID NO: 4580093 - DNA, 16 bp, Homo sapiens
tccacaggtccaagga

SEQ ID NO: 4580094 - DNA, 21 bp, Homo sapiens
tccacagtggcgggcccactc

SEQ ID NO: 4580095 - DNA, 13 bp, Homo sapiens
tccacataaattt

SEQ ID NO: 4580096 - DNA, 18 bp, Homo sapiens
tccacataaattttaatt

SEQ ID NO: 4580097 - DNA, 18 bp, Homo sapiens
tccacatcccatgttgaa

SEQ ID NO: 4580098 - DNA, 12 bp, Homo sapiens
tccacatcctcc

SEQ ID NO: 4580099 - DNA, 13 bp, Homo sapiens
tccacatcctcca

SEQ ID NO: 4580100 - DNA, 19 bp, Homo sapiens
tccaccaaatgtgctttga

SEQ ID NO: 4580101 - DNA, 18 bp, Homo sapiens
tccaccaacccatcagaa

SEQ ID NO: 4580102 - DNA, 13 bp, Homo sapiens
tccaccagcagca

SEQ ID NO: 4580103 - DNA, 14 bp, Homo sapiens
tccaccagcagcat

SEQ ID NO: 4580104 - DNA, 19 bp, Homo sapiens
tccaccaggccgtgccttg

SEQ ID NO: 4580105 - DNA, 19 bp, Homo sapiens
tccaccatccccaccccac

SEQ ID NO: 4580106 - DNA, 14 bp, Homo sapiens
tccacccagcccat

SEQ ID NO: 4580107 - DNA, 15 bp, Homo sapiens
tccacccagcccatt

SEQ ID NO: 4580108 - DNA, 17 bp, Homo sapiens
tccacccagcccattct

SEQ ID NO: 4580109 - DNA, 12 bp, Homo sapiens
tccaccccagga

SEQ ID NO: 4580110 - DNA, 19 bp, Homo sapiens
tccaccccaggacgccact

SEQ ID NO: 4580111 - DNA, 18 bp, Homo sapiens
tccacccgggggagccca

SEQ ID NO: 4580112 - DNA, 20 bp, Homo sapiens
tccacccgggggagcccagt

SEQ ID NO: 4580113 - DNA, 19 bp, Homo sapiens
tccaccctgagctcgggga

SEQ ID NO: 4580114 - DNA, 13 bp, Homo sapiens
tccacctcagcct

SEQ ID NO: 4580115 - DNA, 13 bp, Homo sapiens
tccacctgccaca

SEQ ID NO: 4580116 - DNA, 23 bp, Homo sapiens
tccacctgccacaaaccaccagg

SEQ ID NO: 4580117 - DNA, 13 bp, Homo sapiens
tccacctgccttg

SEQ ID NO: 4580118 - DNA, 20 bp, Homo sapiens
tccacctgccttggcctccc

SEQ ID NO: 4580119 - DNA, 21 bp, Homo sapiens
tccacctgccttggcctccca

SEQ ID NO: 4580120 - DNA, 13 bp, Homo sapiens
tccacctggcccc

SEQ ID NO: 4580121 - DNA, 17 bp, Homo sapiens
tccacctggccccatgt

SEQ ID NO: 4580122 - DNA, 15 bp, Homo sapiens
tccaccttcatattg

SEQ ID NO: 4580123 - DNA, 18 bp, Homo sapiens
tccacgactgtctccatg

SEQ ID NO: 4580124 - DNA, 14 bp, Homo sapiens
tccacgctgggcct

SEQ ID NO: 4580125 - DNA, 22 bp, Homo sapiens
tccacggagccactcctctgac

SEQ ID NO: 4580126 - DNA, 19 bp, Homo sapiens
tccactaaccccgggcggg

SEQ ID NO: 4580127 - DNA, 16 bp, Homo sapiens
tccactacacctggct

SEQ ID NO: 4580128 - DNA, 18 bp, Homo sapiens
tccactacacctggctga

SEQ ID NO: 4580129 - DNA, 19 bp, Homo sapiens
tccactatgacatctaagt

SEQ ID NO: 4580130 - DNA, 14 bp, Homo sapiens
tccactcatgtgac

SEQ ID NO: 4580131 - DNA, 18 bp, Homo sapiens
tccactccttccatctct

SEQ ID NO: 4580132 - DNA, 22 bp, Homo sapiens
tccactccttccatctcttcct

SEQ ID NO: 4580133 - DNA, 21 bp, Homo sapiens
tccactctaccctcccacccc

SEQ ID NO: 4580134 - DNA, 23 bp, Homo sapiens
tccactctaccctcccaccccct

SEQ ID NO: 4580135 - DNA, 19 bp, Homo sapiens
tccactctagttctagatg

SEQ ID NO: 4580136 - DNA, 14 bp, Homo sapiens
tccactctccccca

SEQ ID NO: 4580137 - DNA, 15 bp, Homo sapiens
tccactgagggcagt

SEQ ID NO: 4580138 - DNA, 23 bp, Homo sapiens
tccactggcttttgcctgtaaga

SEQ ID NO: 4580139 - DNA, 22 bp, Homo sapiens
tccactggggaatgctcccagc

SEQ ID NO: 4580140 - DNA, 13 bp, Homo sapiens
tccactgtggcac

SEQ ID NO: 4580141 - DNA, 18 bp, Homo sapiens
tccactgttaaaataaag

SEQ ID NO: 4580142 - DNA, 19 bp, Homo sapiens
tccacttccaggtctgcct

SEQ ID NO: 4580143 - DNA, 21 bp, Homo sapiens
tccacttccaggtctgcctgg

SEQ ID NO: 4580144 - DNA, 11 bp, Homo sapiens
tccacttgtat

SEQ ID NO: 4580145 - DNA, 22 bp, Homo sapiens
tccacttgtatatatggatcag

SEQ ID NO: 4580146 - DNA, 21 bp, Homo sapiens
tccagaaaacctctcctgacc

SEQ ID NO: 4580147 - DNA, 11 bp, Homo sapiens
tccagaaatgg

SEQ ID NO: 4580148 - DNA, 13 bp, Homo sapiens
tccagaacactct

SEQ ID NO: 4580149 - DNA, 22 bp, Homo sapiens
tccagaacagccctcggcctcc

SEQ ID NO: 4580150 - DNA, 14 bp, Homo sapiens
tccagaagagccca

SEQ ID NO: 4580151 - DNA, 16 bp, Homo sapiens
tccagaagcctctggc

SEQ ID NO: 4580152 - DNA, 14 bp, Homo sapiens
tccagaagtgtgac

SEQ ID NO: 4580153 - DNA, 19 bp, Homo sapiens
tccagaagtgtgactggct

SEQ ID NO: 4580154 - DNA, 20 bp, Homo sapiens
tccagaagtgtgactggcta

SEQ ID NO: 4580155 - DNA, 15 bp, Homo sapiens
tccagacagcctgta

SEQ ID NO: 4580156 - DNA, 12 bp, Homo sapiens
tccagacagtcg

SEQ ID NO: 4580157 - DNA, 21 bp, Homo sapiens
tccagacagtcgctcagtctg

SEQ ID NO: 4580158 - DNA, 13 bp, Homo sapiens
tccagacctgagc

SEQ ID NO: 4580159 - DNA, 14 bp, Homo sapiens
tccagacctggctc

SEQ ID NO: 4580160 - DNA, 21 bp, Homo sapiens
tccagacctggctccactctt

SEQ ID NO: 4580161 - DNA, 22 bp, Homo sapiens
tccagacgcactgatctttgca

SEQ ID NO: 4580162 - DNA, 18 bp, Homo sapiens
tccagactttctttttct

SEQ ID NO: 4580163 - DNA, 15 bp, Homo sapiens
tccagagacactgag

SEQ ID NO: 4580164 - DNA, 15 bp, Homo sapiens
tccagagaccacacc

SEQ ID NO: 4580165 - DNA, 12 bp, Homo sapiens
tccagagagcag

SEQ ID NO: 4580166 - DNA, 14 bp, Homo sapiens
tccagagagcagct

SEQ ID NO: 4580167 - DNA, 18 bp, Homo sapiens
tccagagagcagctccct

SEQ ID NO: 4580168 - DNA, 16 bp, Homo sapiens
tccagagattcatttt

SEQ ID NO: 4580169 - DNA, 18 bp, Homo sapiens
tccagagattcattttct

SEQ ID NO: 4580170 - DNA, 20 bp, Homo sapiens
tccagagattcattttctag

SEQ ID NO: 4580171 - DNA, 20 bp, Homo sapiens
tccagagcaaccagaaggag

SEQ ID NO: 4580172 - DNA, 14 bp, Homo sapiens
tccagagcagagcc

SEQ ID NO: 4580173 - DNA, 20 bp, Homo sapiens
tccagagcagagcctacaga

SEQ ID NO: 4580174 - DNA, 14 bp, Homo sapiens
tccagagcccaagg

SEQ ID NO: 4580175 - DNA, 19 bp, Homo sapiens
tccagatcccaggcccctg

SEQ ID NO: 4580176 - DNA, 16 bp, Homo sapiens
tccagatgcccgagca

SEQ ID NO: 4580177 - DNA, 21 bp, Homo sapiens
tccagcaaataaagcagtcat

SEQ ID NO: 4580178 - DNA, 18 bp, Homo sapiens
tccagcaattctcctgcc

SEQ ID NO: 4580179 - DNA, 19 bp, Homo sapiens
tccagcaccttctttctgg

SEQ ID NO: 4580180 - DNA, 12 bp, Homo sapiens
tccagcactggt

SEQ ID NO: 4580181 - DNA, 18 bp, Homo sapiens
tccagcagactcctgctc

SEQ ID NO: 4580182 - DNA, 22 bp, Homo sapiens
tccagcagatttccagccttct

SEQ ID NO: 4580183 - DNA, 17 bp, Homo sapiens
tccagcattgctggact

SEQ ID NO: 4580184 - DNA, 17 bp, Homo sapiens
tccagcatttttataaa

SEQ ID NO: 4580185 - DNA, 16 bp, Homo sapiens
tccagccaaagcatgc

SEQ ID NO: 4580186 - DNA, 12 bp, Homo sapiens
tccagccagcgc

SEQ ID NO: 4580187 - DNA, 22 bp, Homo sapiens
tccagccagcgcctccctccac

SEQ ID NO: 4580188 - DNA, 17 bp, Homo sapiens
tccagcccctcctccct

SEQ ID NO: 4580189 - DNA, 19 bp, Homo sapiens
tccagccgccattgccacc

SEQ ID NO: 4580190 - DNA, 20 bp, Homo sapiens
tccagccgccattgccacca

SEQ ID NO: 4580191 - DNA, 21 bp, Homo sapiens
tccagccgccattgccaccag

SEQ ID NO: 4580192 - DNA, 22 bp, Homo sapiens
tccagccgccattgccaccagg

SEQ ID NO: 4580193 - DNA, 20 bp, Homo sapiens
tccagccggcatggctggga

SEQ ID NO: 4580194 - DNA, 20 bp, Homo sapiens
tccagcctcccctcccctgg

SEQ ID NO: 4580195 - DNA, 15 bp, Homo sapiens
tccagcctctgccgc

SEQ ID NO: 4580196 - DNA, 16 bp, Homo sapiens
tccagcctctgccgct

SEQ ID NO: 4580197 - DNA, 16 bp, Homo sapiens
tccagcctgagtgaca

SEQ ID NO: 4580198 - DNA, 17 bp, Homo sapiens
tccagcctgagtgacag

SEQ ID NO: 4580199 - DNA, 20 bp, Homo sapiens
tccagcctgagtgacagagc

SEQ ID NO: 4580200 - DNA, 19 bp, Homo sapiens
tccagcctgcctggcaggc

SEQ ID NO: 4580201 - DNA, 20 bp, Homo sapiens
tccagcctgggtcacagagt

SEQ ID NO: 4580202 - DNA, 23 bp, Homo sapiens
tccagcctgggtcacagagtgag

SEQ ID NO: 4580203 - DNA, 15 bp, Homo sapiens
tccagccttctctca

SEQ ID NO: 4580204 - DNA, 14 bp, Homo sapiens
tccagctctgcccc

SEQ ID NO: 4580205 - DNA, 14 bp, Homo sapiens
tccagctctggcac

SEQ ID NO: 4580206 - DNA, 14 bp, Homo sapiens
tccagctgactaaa

SEQ ID NO: 4580207 - DNA, 12 bp, Homo sapiens
tccagctgcccc

SEQ ID NO: 4580208 - DNA, 14 bp, Homo sapiens
tccagctgctgaga

SEQ ID NO: 4580209 - DNA, 22 bp, Homo sapiens
tccagctgctgagatcctggac

SEQ ID NO: 4580210 - DNA, 17 bp, Homo sapiens
tccagctgggaagccct

SEQ ID NO: 4580211 - DNA, 17 bp, Homo sapiens
tccagctggggccagag

SEQ ID NO: 4580212 - DNA, 20 bp, Homo sapiens
tccagctggggccagaggct

SEQ ID NO: 4580213 - DNA, 14 bp, Homo sapiens
tccagcttcccgag

SEQ ID NO: 4580214 - DNA, 17 bp, Homo sapiens
tccagcttgctcttcag

SEQ ID NO: 4580215 - DNA, 16 bp, Homo sapiens
tccagcttgtggagcc

SEQ ID NO: 4580216 - DNA, 19 bp, Homo sapiens
tccagcttgtggagcccca

SEQ ID NO: 4580217 - DNA, 23 bp, Homo sapiens
tccagcttgtggagccccacact

SEQ ID NO: 4580218 - DNA, 20 bp, Homo sapiens
tccaggagaaggccaattcc

SEQ ID NO: 4580219 - DNA, 23 bp, Homo sapiens
tccaggagattggatttgctgtg

SEQ ID NO: 4580220 - DNA, 18 bp, Homo sapiens
tccaggagcctcatccag

SEQ ID NO: 4580221 - DNA, 19 bp, Homo sapiens
tccaggatctttgactgaa

SEQ ID NO: 4580222 - DNA, 21 bp, Homo sapiens
tccaggatctttgactgaaaa

SEQ ID NO: 4580223 - DNA, 19 bp, Homo sapiens
tccaggattttaatttcag

SEQ ID NO: 4580224 - DNA, 20 bp, Homo sapiens
tccaggcaatcgttctgctg

SEQ ID NO: 4580225 - DNA, 17 bp, Homo sapiens
tccaggcaccctcaggg

SEQ ID NO: 4580226 - DNA, 15 bp, Homo sapiens
tccaggcccaaggct

SEQ ID NO: 4580227 - DNA, 17 bp, Homo sapiens
tccaggcccaaggctcc

SEQ ID NO: 4580228 - DNA, 13 bp, Homo sapiens
tccaggcccccaa

SEQ ID NO: 4580229 - DNA, 19 bp, Homo sapiens
tccaggcccccaacccctc

SEQ ID NO: 4580230 - DNA, 21 bp, Homo sapiens
tccaggcccccagcccctcct

SEQ ID NO: 4580231 - DNA, 23 bp, Homo sapiens
tccaggcccccagcccctcctcc

SEQ ID NO: 4580232 - DNA, 13 bp, Homo sapiens
tccaggccctcca

SEQ ID NO: 4580233 - DNA, 18 bp, Homo sapiens
tccaggcctctctctgct

SEQ ID NO: 4580234 - DNA, 17 bp, Homo sapiens
tccaggcctgcctccca

SEQ ID NO: 4580235 - DNA, 19 bp, Homo sapiens
tccaggcctgcctcccact

SEQ ID NO: 4580236 - DNA, 23 bp, Homo sapiens
tccagggaaacagcctctctctt

SEQ ID NO: 4580237 - DNA, 20 bp, Homo sapiens
tccagggaaggtggccacag

SEQ ID NO: 4580238 - DNA, 22 bp, Homo sapiens
tccagggaccactgggtgagag

SEQ ID NO: 4580239 - DNA, 17 bp, Homo sapiens
tccagggccacgtgcca

SEQ ID NO: 4580240 - DNA, 23 bp, Homo sapiens
tccagggccacgtgccaggcccg

SEQ ID NO: 4580241 - DNA, 19 bp, Homo sapiens
tccagggctggactgaggc

SEQ ID NO: 4580242 - DNA, 21 bp, Homo sapiens
tccagggctggactgaggcct

SEQ ID NO: 4580243 - DNA, 14 bp, Homo sapiens
tccaggggaacctg

SEQ ID NO: 4580244 - DNA, 13 bp, Homo sapiens
tccaggggcccct

SEQ ID NO: 4580245 - DNA, 15 bp, Homo sapiens
tccagggtttctctg

SEQ ID NO: 4580246 - DNA, 18 bp, Homo sapiens
tccagggtttctctgcag

SEQ ID NO: 4580247 - DNA, 23 bp, Homo sapiens
tccaggtagctcggcaccaacta

SEQ ID NO: 4580248 - DNA, 14 bp, Homo sapiens
tccaggtcccagcc

SEQ ID NO: 4580249 - DNA, 15 bp, Homo sapiens
tccaggtcccagccc

SEQ ID NO: 4580250 - DNA, 21 bp, Homo sapiens
tccaggtcccagcccctcctc

SEQ ID NO: 4580251 - DNA, 20 bp, Homo sapiens
tccaggtggaacaaacagaa

SEQ ID NO: 4580252 - DNA, 16 bp, Homo sapiens
tccaggtgtagctaac

SEQ ID NO: 4580253 - DNA, 17 bp, Homo sapiens
tccaggttccctcccag

SEQ ID NO: 4580254 - DNA, 18 bp, Homo sapiens
tccaggttccctcccaga

SEQ ID NO: 4580255 - DNA, 18 bp, Homo sapiens
tccagtaaggaatgatat

SEQ ID NO: 4580256 - DNA, 18 bp, Homo sapiens
tccagtacgtcccgctgc

SEQ ID NO: 4580257 - DNA, 15 bp, Homo sapiens
tccagtcattatgtt

SEQ ID NO: 4580258 - DNA, 22 bp, Homo sapiens
tccagtcattttattttgtaat

SEQ ID NO: 4580259 - DNA, 13 bp, Homo sapiens
tccagtctattca

SEQ ID NO: 4580260 - DNA, 21 bp, Homo sapiens
tccagtcttcctgacacttta

SEQ ID NO: 4580261 - DNA, 18 bp, Homo sapiens
tccagtgagacagctctg

SEQ ID NO: 4580262 - DNA, 15 bp, Homo sapiens
tccagtgaggccaag

SEQ ID NO: 4580263 - DNA, 23 bp, Homo sapiens
tccagtgaggccaagattgaaat

SEQ ID NO: 4580264 - DNA, 11 bp, Homo sapiens
tccagtgcagt

SEQ ID NO: 4580265 - DNA, 15 bp, Homo sapiens
tccagtgctggattt

SEQ ID NO: 4580266 - DNA, 17 bp, Homo sapiens
tccagtggatcataaga

SEQ ID NO: 4580267 - DNA, 13 bp, Homo sapiens
tccagtgtcattt

SEQ ID NO: 4580268 - DNA, 20 bp, Homo sapiens
tccagttcatcgattttcta

SEQ ID NO: 4580269 - DNA, 21 bp, Homo sapiens
tccagttgaagttagtggaaa

SEQ ID NO: 4580270 - DNA, 14 bp, Homo sapiens
tccagtttgttctc

SEQ ID NO: 4580271 - DNA, 19 bp, Homo sapiens
tccagtttgttctccgggt

SEQ ID NO: 4580272 - DNA, 19 bp, Homo sapiens
tccataaaaaaaaatagat

SEQ ID NO: 4580273 - DNA, 18 bp, Homo sapiens
tccataatataaacactt

SEQ ID NO: 4580274 - DNA, 15 bp, Homo sapiens
tccatacacagagga

SEQ ID NO: 4580275 - DNA, 22 bp, Homo sapiens
tccatacactttgttgcaagat

SEQ ID NO: 4580276 - DNA, 13 bp, Homo sapiens
tccataccttttc

SEQ ID NO: 4580277 - DNA, 14 bp, Homo sapiens
tccataccttttct

SEQ ID NO: 4580278 - DNA, 22 bp, Homo sapiens
tccataccttttctcttttctt

SEQ ID NO: 4580279 - DNA, 18 bp, Homo sapiens
tccatactgggctaagga

SEQ ID NO: 4580280 - DNA, 14 bp, Homo sapiens
tccatagacacagt

SEQ ID NO: 4580281 - DNA, 17 bp, Homo sapiens
tccatagacacagtatt

SEQ ID NO: 4580282 - DNA, 21 bp, Homo sapiens
tccatagagatgagcccaccc

SEQ ID NO: 4580283 - DNA, 21 bp, Homo sapiens
tccatagcgacaccctttctg

SEQ ID NO: 4580284 - DNA, 17 bp, Homo sapiens
tccatcaactaaaacat

SEQ ID NO: 4580285 - DNA, 12 bp, Homo sapiens
tccatcacagac

SEQ ID NO: 4580286 - DNA, 19 bp, Homo sapiens
tccatcacgttagctgtcc

SEQ ID NO: 4580287 - DNA, 21 bp, Homo sapiens
tccatcagaaaaccaaagggt

SEQ ID NO: 4580288 - DNA, 15 bp, Homo sapiens
tccatcatcactgta

SEQ ID NO: 4580289 - DNA, 13 bp, Homo sapiens
tccatcatcatgt

SEQ ID NO: 4580290 - DNA, 22 bp, Homo sapiens
tccatcatgtctgtatactcct

SEQ ID NO: 4580291 - DNA, 15 bp, Homo sapiens
tccatccacatggga

SEQ ID NO: 4580292 - DNA, 18 bp, Homo sapiens
tccatccacctttcccaa

SEQ ID NO: 4580293 - DNA, 13 bp, Homo sapiens
tccatcccctccc

SEQ ID NO: 4580294 - DNA, 23 bp, Homo sapiens
tccatcccctccctgcctgctcc

SEQ ID NO: 4580295 - DNA, 15 bp, Homo sapiens
tccatccccttcccc

SEQ ID NO: 4580296 - DNA, 16 bp, Homo sapiens
tccatcctaccccctg

SEQ ID NO: 4580297 - DNA, 20 bp, Homo sapiens
tccatcctaccccctgtgcc

SEQ ID NO: 4580298 - DNA, 19 bp, Homo sapiens
tccatctctttaaaaacaa

SEQ ID NO: 4580299 - DNA, 13 bp, Homo sapiens
tccatctgacaaa

SEQ ID NO: 4580300 - DNA, 21 bp, Homo sapiens
tccatcttggtagttctgtgc

SEQ ID NO: 4580301 - DNA, 13 bp, Homo sapiens
tccatgaagatgt

SEQ ID NO: 4580302 - DNA, 14 bp, Homo sapiens
tccatgacatcaag

SEQ ID NO: 4580303 - DNA, 20 bp, Homo sapiens
tccatgaccttaaggcagta

SEQ ID NO: 4580304 - DNA, 23 bp, Homo sapiens
tccatgaccttaaggcagtagtt

SEQ ID NO: 4580305 - DNA, 17 bp, Homo sapiens
tccatgcatgacagcct

SEQ ID NO: 4580306 - DNA, 23 bp, Homo sapiens
tccatgcctgtagctttcctggt

SEQ ID NO: 4580307 - DNA, 20 bp, Homo sapiens
tccatgcgtgtttctgactc

SEQ ID NO: 4580308 - DNA, 22 bp, Homo sapiens
tccatgcgtgtttctgactctg

SEQ ID NO: 4580309 - DNA, 21 bp, Homo sapiens
tccatgctcctcacctgtcta

SEQ ID NO: 4580310 - DNA, 16 bp, Homo sapiens
tccatgctgggtctga

SEQ ID NO: 4580311 - DNA, 16 bp, Homo sapiens
tccatggaatttctag

SEQ ID NO: 4580312 - DNA, 16 bp, Homo sapiens
tccatggccctgtccc

SEQ ID NO: 4580313 - DNA, 18 bp, Homo sapiens
tccatgggagaaaataga

SEQ ID NO: 4580314 - DNA, 15 bp, Homo sapiens
tccatgggcagagcc

SEQ ID NO: 4580315 - DNA, 22 bp, Homo sapiens
tccatgggcagagcccaaggga

SEQ ID NO: 4580316 - DNA, 15 bp, Homo sapiens
tccatgtcggcctct

SEQ ID NO: 4580317 - DNA, 20 bp, Homo sapiens
tccatgtgcctttctttgcc

SEQ ID NO: 4580318 - DNA, 21 bp, Homo sapiens
tccatgtgcctttctttgcct

SEQ ID NO: 4580319 - DNA, 22 bp, Homo sapiens
tccatgtgtgtgccaagccctg

SEQ ID NO: 4580320 - DNA, 15 bp, Homo sapiens
tccatgttctatttt

SEQ ID NO: 4580321 - DNA, 15 bp, Homo sapiens
tccatgttctcccaa

SEQ ID NO: 4580322 - DNA, 18 bp, Homo sapiens
tccatgttctgggtgatg

SEQ ID NO: 4580323 - DNA, 17 bp, Homo sapiens
tccattaatttaaatga

SEQ ID NO: 4580324 - DNA, 19 bp, Homo sapiens
tccattaatttaaatgatt

SEQ ID NO: 4580325 - DNA, 15 bp, Homo sapiens
tccattcacaagcct

SEQ ID NO: 4580326 - DNA, 21 bp, Homo sapiens
tccattctgcactcagaaaat

SEQ ID NO: 4580327 - DNA, 16 bp, Homo sapiens
tccattggatctcatt

SEQ ID NO: 4580328 - DNA, 16 bp, Homo sapiens
tccattgttgtgtctg

SEQ ID NO: 4580329 - DNA, 17 bp, Homo sapiens
tccattttaacaaacaa

SEQ ID NO: 4580330 - DNA, 23 bp, Homo sapiens
tccattttaggtgataaaatttt

SEQ ID NO: 4580331 - DNA, 21 bp, Homo sapiens
tccatttttctcccaagaaac

SEQ ID NO: 4580332 - DNA, 23 bp, Homo sapiens
tcccaaaacattttaaatgaaag

SEQ ID NO: 4580333 - DNA, 21 bp, Homo sapiens
tcccaaacacataatttctgt

SEQ ID NO: 4580334 - DNA, 14 bp, Homo sapiens
tcccaaagggcaca

SEQ ID NO: 4580335 - DNA, 21 bp, Homo sapiens
tcccaaagtgaactctcaaat

SEQ ID NO: 4580336 - DNA, 12 bp, Homo sapiens
tcccaaagtgtt

SEQ ID NO: 4580337 - DNA, 19 bp, Homo sapiens
tcccaaatttgattgattt

SEQ ID NO: 4580338 - DNA, 14 bp, Homo sapiens
tcccaacactgcca

SEQ ID NO: 4580339 - DNA, 15 bp, Homo sapiens
tcccaacactgccag

SEQ ID NO: 4580340 - DNA, 17 bp, Homo sapiens
tcccaacagagctgggc

SEQ ID NO: 4580341 - DNA, 14 bp, Homo sapiens
tcccaacatgggag

SEQ ID NO: 4580342 - DNA, 14 bp, Homo sapiens
tcccaacgtactcc

SEQ ID NO: 4580343 - DNA, 19 bp, Homo sapiens
tcccaagattttttcattt

SEQ ID NO: 4580344 - DNA, 18 bp, Homo sapiens
tcccaagcgttcctggcc

SEQ ID NO: 4580345 - DNA, 14 bp, Homo sapiens
tcccaagctgggcc

SEQ ID NO: 4580346 - DNA, 17 bp, Homo sapiens
tcccaagctgggcccca

SEQ ID NO: 4580347 - DNA, 19 bp, Homo sapiens
tcccaagctgggccccagc

SEQ ID NO: 4580348 - DNA, 18 bp, Homo sapiens
tcccaaggagaacaaata

SEQ ID NO: 4580349 - DNA, 21 bp, Homo sapiens
tcccaaggcaagcatgaataa

SEQ ID NO: 4580350 - DNA, 17 bp, Homo sapiens
tcccaaggtcctctcag

SEQ ID NO: 4580351 - DNA, 21 bp, Homo sapiens
tcccaagtagctgggattaca

SEQ ID NO: 4580352 - DNA, 16 bp, Homo sapiens
tcccaagtcccaccct

SEQ ID NO: 4580353 - DNA, 13 bp, Homo sapiens
tcccaagtgccaa

SEQ ID NO: 4580354 - DNA, 23 bp, Homo sapiens
tcccaagtgccaaagaagcagac

SEQ ID NO: 4580355 - DNA, 18 bp, Homo sapiens
tcccaatacaaagatgac

SEQ ID NO: 4580356 - DNA, 18 bp, Homo sapiens
tcccaatagcactttcat

SEQ ID NO: 4580357 - DNA, 20 bp, Homo sapiens
tcccaatagcactttcattg

SEQ ID NO: 4580358 - DNA, 22 bp, Homo sapiens
tcccaatcagcttttgttctag

SEQ ID NO: 4580359 - DNA, 15 bp, Homo sapiens
tcccaattcacatct

SEQ ID NO: 4580360 - DNA, 20 bp, Homo sapiens
tcccacactcctatggtcac

SEQ ID NO: 4580361 - DNA, 15 bp, Homo sapiens
tcccacagagtgctg

SEQ ID NO: 4580362 - DNA, 21 bp, Homo sapiens
tcccacagagtgctggactgt

SEQ ID NO: 4580363 - DNA, 22 bp, Homo sapiens
tcccacagcagccccaggagaa

SEQ ID NO: 4580364 - DNA, 16 bp, Homo sapiens
tcccacagcttcctga

SEQ ID NO: 4580365 - DNA, 13 bp, Homo sapiens
tcccacaggaggg

SEQ ID NO: 4580366 - DNA, 16 bp, Homo sapiens
tcccacaggagggcca

SEQ ID NO: 4580367 - DNA, 13 bp, Homo sapiens
tcccacatgaggc

SEQ ID NO: 4580368 - DNA, 22 bp, Homo sapiens
tcccacatgcctgcgcctgctg

SEQ ID NO: 4580369 - DNA, 11 bp, Homo sapiens
tcccacccacc

SEQ ID NO: 4580370 - DNA, 14 bp, Homo sapiens
tcccacccacccgc

SEQ ID NO: 4580371 - DNA, 14 bp, Homo sapiens
tcccaccccctcct

SEQ ID NO: 4580372 - DNA, 15 bp, Homo sapiens
tcccaccccctcctc

SEQ ID NO: 4580373 - DNA, 14 bp, Homo sapiens
tcccacccggccac

SEQ ID NO: 4580374 - DNA, 16 bp, Homo sapiens
tcccacccggccacag

SEQ ID NO: 4580375 - DNA, 14 bp, Homo sapiens
tcccaccctcccta

SEQ ID NO: 4580376 - DNA, 21 bp, Homo sapiens
tcccaccgggagcctccccct

SEQ ID NO: 4580377 - DNA, 19 bp, Homo sapiens
tcccacctcagcctcctga

SEQ ID NO: 4580378 - DNA, 13 bp, Homo sapiens
tcccacctgacac

SEQ ID NO: 4580379 - DNA, 23 bp, Homo sapiens
tcccacctgacacaccaggcgct

SEQ ID NO: 4580380 - DNA, 14 bp, Homo sapiens
tcccacctggctct

SEQ ID NO: 4580381 - DNA, 15 bp, Homo sapiens
tcccacctggctctg

SEQ ID NO: 4580382 - DNA, 13 bp, Homo sapiens
tcccaccttccca

SEQ ID NO: 4580383 - DNA, 24 bp, Homo sapiens
tcccacgactgttgtacaagctca

SEQ ID NO: 4580384 - DNA, 14 bp, Homo sapiens
tcccacgccaggcc

SEQ ID NO: 4580385 - DNA, 21 bp, Homo sapiens
tcccacgcctcaccagccccc

SEQ ID NO: 4580386 - DNA, 16 bp, Homo sapiens
tcccactacatctggg

SEQ ID NO: 4580387 - DNA, 23 bp, Homo sapiens
tcccactcaccccggcagacgcc

SEQ ID NO: 4580388 - DNA, 18 bp, Homo sapiens
tcccactgcactccagcc

SEQ ID NO: 4580389 - DNA, 19 bp, Homo sapiens
tcccactgcactccagcct

SEQ ID NO: 4580390 - DNA, 19 bp, Homo sapiens
tcccagaattttctggcct

SEQ ID NO: 4580391 - DNA, 21 bp, Homo sapiens
tcccagaccagccaagggtcc

SEQ ID NO: 4580392 - DNA, 23 bp, Homo sapiens
tcccagactaaaggatccagaga

SEQ ID NO: 4580393 - DNA, 23 bp, Homo sapiens
tcccagaggagccaccagttctc

SEQ ID NO: 4580394 - DNA, 22 bp, Homo sapiens
tcccagaggtgggatcctccct

SEQ ID NO: 4580395 - DNA, 17 bp, Homo sapiens
tcccagagtcagaggag

SEQ ID NO: 4580396 - DNA, 19 bp, Homo sapiens
tcccagagtcagaggagaa

SEQ ID NO: 4580397 - DNA, 20 bp, Homo sapiens
tcccagattggctcacactg

SEQ ID NO: 4580398 - DNA, 21 bp, Homo sapiens
tcccagattggctcacactga

SEQ ID NO: 4580399 - DNA, 22 bp, Homo sapiens
tcccagattggctcacactgag

SEQ ID NO: 4580400 - DNA, 19 bp, Homo sapiens
tcccagcacctattgaatt

SEQ ID NO: 4580401 - DNA, 23 bp, Homo sapiens
tcccagcactttgagaggctgag

SEQ ID NO: 4580402 - DNA, 22 bp, Homo sapiens
tcccagcactttgggaggcagg

SEQ ID NO: 4580403 - DNA, 23 bp, Homo sapiens
tcccagcactttgggaggcaggg

SEQ ID NO: 4580404 - DNA, 22 bp, Homo sapiens
tcccagcactttgggagtccaa

SEQ ID NO: 4580405 - DNA, 17 bp, Homo sapiens
tcccagcatccctggag

SEQ ID NO: 4580406 - DNA, 12 bp, Homo sapiens
tcccagccaccc

SEQ ID NO: 4580407 - DNA, 13 bp, Homo sapiens
tcccagccacccc

SEQ ID NO: 4580408 - DNA, 20 bp, Homo sapiens
tcccagccaccccgggctct

SEQ ID NO: 4580409 - DNA, 24 bp, Homo sapiens
tcccagccaccccgggctctctgc

SEQ ID NO: 4580410 - DNA, 23 bp, Homo sapiens
tcccagccccggcaagccacagg

SEQ ID NO: 4580411 - DNA, 17 bp, Homo sapiens
tcccagcccctcctccc

SEQ ID NO: 4580412 - DNA, 22 bp, Homo sapiens
tcccagcccctcctccctcagg

SEQ ID NO: 4580413 - DNA, 14 bp, Homo sapiens
tcccagcccctgca

SEQ ID NO: 4580414 - DNA, 15 bp, Homo sapiens
tcccagcccctgcag

SEQ ID NO: 4580415 - DNA, 15 bp, Homo sapiens
tcccagctactcagg

SEQ ID NO: 4580416 - DNA, 18 bp, Homo sapiens
tcccagctacttgggagg

SEQ ID NO: 4580417 - DNA, 16 bp, Homo sapiens
tcccagctaggaagag

SEQ ID NO: 4580418 - DNA, 13 bp, Homo sapiens
tcccagctcccct

SEQ ID NO: 4580419 - DNA, 21 bp, Homo sapiens
tcccagctcccctcttttgta

SEQ ID NO: 4580420 - DNA, 14 bp, Homo sapiens
tcccagctctccct

SEQ ID NO: 4580421 - DNA, 18 bp, Homo sapiens
tcccagctctccctctgg

SEQ ID NO: 4580422 - DNA, 14 bp, Homo sapiens
tcccagctgtgctg

SEQ ID NO: 4580423 - DNA, 16 bp, Homo sapiens
tcccagctgtgctgtg

SEQ ID NO: 4580424 - DNA, 17 bp, Homo sapiens
tcccagctgtgctgtgg

SEQ ID NO: 4580425 - DNA, 18 bp, Homo sapiens
tcccaggagatgggtcca

SEQ ID NO: 4580426 - DNA, 15 bp, Homo sapiens
tcccaggccccaggg

SEQ ID NO: 4580427 - DNA, 20 bp, Homo sapiens
tcccaggccccaggggagaa

SEQ ID NO: 4580428 - DNA, 17 bp, Homo sapiens
tcccaggcccctggagg

SEQ ID NO: 4580429 - DNA, 19 bp, Homo sapiens
tcccaggcccctggaggct

SEQ ID NO: 4580430 - DNA, 16 bp, Homo sapiens
tcccagggaccttgga

SEQ ID NO: 4580431 - DNA, 18 bp, Homo sapiens
tcccagggcacccaggca

SEQ ID NO: 4580432 - DNA, 16 bp, Homo sapiens
tcccaggggcagccac

SEQ ID NO: 4580433 - DNA, 17 bp, Homo sapiens
tcccaggggcagccaca

SEQ ID NO: 4580434 - DNA, 21 bp, Homo sapiens
tcccaggggcccaaggcggcc

SEQ ID NO: 4580435 - DNA, 16 bp, Homo sapiens
tcccagggtagcccgc

SEQ ID NO: 4580436 - DNA, 19 bp, Homo sapiens
tcccaggtaccagctgcgc

SEQ ID NO: 4580437 - DNA, 15 bp, Homo sapiens
tcccaggttccagca

SEQ ID NO: 4580438 - DNA, 20 bp, Homo sapiens
tcccaggttcccccagcaag

SEQ ID NO: 4580439 - DNA, 13 bp, Homo sapiens
tcccagtcctgcc

SEQ ID NO: 4580440 - DNA, 15 bp, Homo sapiens
tcccagtctacccag

SEQ ID NO: 4580441 - DNA, 18 bp, Homo sapiens
tcccagtgaactcctgcc

SEQ ID NO: 4580442 - DNA, 19 bp, Homo sapiens
tcccagtgaactcctgcca

SEQ ID NO: 4580443 - DNA, 20 bp, Homo sapiens
tcccagtgaactcctgccag

SEQ ID NO: 4580444 - DNA, 14 bp, Homo sapiens
tcccagtgacaaca

SEQ ID NO: 4580445 - DNA, 19 bp, Homo sapiens
tcccagtgagactgcccca

SEQ ID NO: 4580446 - DNA, 22 bp, Homo sapiens
tcccagtgctcaccagccctgc

SEQ ID NO: 4580447 - DNA, 15 bp, Homo sapiens
tcccagttaaagatt

SEQ ID NO: 4580448 - DNA, 23 bp, Homo sapiens
tcccataagggtagccccctcat

SEQ ID NO: 4580449 - DNA, 18 bp, Homo sapiens
tcccatagatactctctt

SEQ ID NO: 4580450 - DNA, 19 bp, Homo sapiens
tcccatagatactctcttc

SEQ ID NO: 4580451 - DNA, 14 bp, Homo sapiens
tcccatcagggaag

SEQ ID NO: 4580452 - DNA, 14 bp, Homo sapiens
tcccatctctacaa

SEQ ID NO: 4580453 - DNA, 17 bp, Homo sapiens
tcccatctggtcatttg

SEQ ID NO: 4580454 - DNA, 14 bp, Homo sapiens
tcccatgaagcctt

SEQ ID NO: 4580455 - DNA, 23 bp, Homo sapiens
tcccatgagctccttaaggctct

SEQ ID NO: 4580456 - DNA, 19 bp, Homo sapiens
tcccatgagggagatgcca

SEQ ID NO: 4580457 - DNA, 21 bp, Homo sapiens
tcccatgccggtacacagcca

SEQ ID NO: 4580458 - DNA, 23 bp, Homo sapiens
tcccatgccggtacacagccagt

SEQ ID NO: 4580459 - DNA, 16 bp, Homo sapiens
tcccatggagccccag

SEQ ID NO: 4580460 - DNA, 18 bp, Homo sapiens
tcccatggagccccagcc

SEQ ID NO: 4580461 - DNA, 19 bp, Homo sapiens
tcccatggagccccagccc

SEQ ID NO: 4580462 - DNA, 14 bp, Homo sapiens
tcccatgtatttgt

SEQ ID NO: 4580463 - DNA, 20 bp, Homo sapiens
tcccatgtcccgtgtctcct

SEQ ID NO: 4580464 - DNA, 14 bp, Homo sapiens
tcccattcagtggc

SEQ ID NO: 4580465 - DNA, 23 bp, Homo sapiens
tcccattccttttcgtttagaat

SEQ ID NO: 4580466 - DNA, 17 bp, Homo sapiens
tcccattctagatcctg

SEQ ID NO: 4580467 - DNA, 20 bp, Homo sapiens
tcccattctagatcctgcac

SEQ ID NO: 4580468 - DNA, 21 bp, Homo sapiens
tcccattctagatcctgcacc

SEQ ID NO: 4580469 - DNA, 13 bp, Homo sapiens
tcccattctatgt

SEQ ID NO: 4580470 - DNA, 15 bp, Homo sapiens
tcccattctatgtgt

SEQ ID NO: 4580471 - DNA, 13 bp, Homo sapiens
tcccattctgcac

SEQ ID NO: 4580472 - DNA, 16 bp, Homo sapiens
tcccattctgcaccac

SEQ ID NO: 4580473 - DNA, 21 bp, Homo sapiens
tcccattgcccagtgagccct

SEQ ID NO: 4580474 - DNA, 14 bp, Homo sapiens
tcccattgccctgg

SEQ ID NO: 4580475 - DNA, 15 bp, Homo sapiens
tcccatttagtgtga

SEQ ID NO: 4580476 - DNA, 16 bp, Homo sapiens
tcccatttagtgtgaa

SEQ ID NO: 4580477 - DNA, 20 bp, Homo sapiens
tcccatttagtgtgaatatt

SEQ ID NO: 4580478 - DNA, 16 bp, Homo sapiens
tcccatttatcgcaga

SEQ ID NO: 4580479 - DNA, 14 bp, Homo sapiens
tcccatttcttccc

SEQ ID NO: 4580480 - DNA, 15 bp, Homo sapiens
tcccatttcttccca

SEQ ID NO: 4580481 - DNA, 20 bp, Homo sapiens
tcccatttgcaggatctgtc

SEQ ID NO: 4580482 - DNA, 14 bp, Homo sapiens
tcccattttattaa

SEQ ID NO: 4580483 - DNA, 16 bp, Homo sapiens
tccccaaaggtccgca

SEQ ID NO: 4580484 - DNA, 23 bp, Homo sapiens
tccccaaatcaatacactagttg

SEQ ID NO: 4580485 - DNA, 16 bp, Homo sapiens
tccccaacacctgcct

SEQ ID NO: 4580486 - DNA, 14 bp, Homo sapiens
tccccaactccatg

SEQ ID NO: 4580487 - DNA, 21 bp, Homo sapiens
tccccaactccctctctgtgc

SEQ ID NO: 4580488 - DNA, 12 bp, Homo sapiens
tccccaactgct

SEQ ID NO: 4580489 - DNA, 21 bp, Homo sapiens
tccccaactgctccagcctct

SEQ ID NO: 4580490 - DNA, 22 bp, Homo sapiens
tccccaactgctccagcctctg

SEQ ID NO: 4580491 - DNA, 14 bp, Homo sapiens
tccccaataaagcc

SEQ ID NO: 4580492 - DNA, 16 bp, Homo sapiens
tccccaatccatgctt

SEQ ID NO: 4580493 - DNA, 19 bp, Homo sapiens
tccccaatccatgcttcac

SEQ ID NO: 4580494 - DNA, 18 bp, Homo sapiens
tccccacagcgtccctgg

SEQ ID NO: 4580495 - DNA, 19 bp, Homo sapiens
tccccacagcgtccctggc

SEQ ID NO: 4580496 - DNA, 20 bp, Homo sapiens
tccccacagcgtccctggcg

SEQ ID NO: 4580497 - DNA, 18 bp, Homo sapiens
tccccaccactgatatca

SEQ ID NO: 4580498 - DNA, 22 bp, Homo sapiens
tccccacccatgcgccttcgtg

SEQ ID NO: 4580499 - DNA, 12 bp, Homo sapiens
tccccacccctc

SEQ ID NO: 4580500 - DNA, 14 bp, Homo sapiens
tccccacccctgcc

SEQ ID NO: 4580501 - DNA, 15 bp, Homo sapiens
tccccacccctgccc

SEQ ID NO: 4580502 - DNA, 20 bp, Homo sapiens
tccccaccctcctcttggaa

SEQ ID NO: 4580503 - DNA, 11 bp, Homo sapiens
tccccactgcc

SEQ ID NO: 4580504 - DNA, 14 bp, Homo sapiens
tccccactgcccca

SEQ ID NO: 4580505 - DNA, 17 bp, Homo sapiens
tccccactgccccacgt

SEQ ID NO: 4580506 - DNA, 19 bp, Homo sapiens
tccccagagaggcactcag

SEQ ID NO: 4580507 - DNA, 15 bp, Homo sapiens
tccccagagctcccc

SEQ ID NO: 4580508 - DNA, 17 bp, Homo sapiens
tccccagagctcccccg

SEQ ID NO: 4580509 - DNA, 22 bp, Homo sapiens
tccccagagctggcgctcagca

SEQ ID NO: 4580510 - DNA, 23 bp, Homo sapiens
tccccagagctggcgctcagcag

SEQ ID NO: 4580511 - DNA, 15 bp, Homo sapiens
tccccagcaactctg

SEQ ID NO: 4580512 - DNA, 12 bp, Homo sapiens
tccccagccaca

SEQ ID NO: 4580513 - DNA, 20 bp, Homo sapiens
tccccagccccagccccttc

SEQ ID NO: 4580514 - DNA, 17 bp, Homo sapiens
tccccagcccctcctcc

SEQ ID NO: 4580515 - DNA, 20 bp, Homo sapiens
tccccagcccctcctccctc

SEQ ID NO: 4580516 - DNA, 21 bp, Homo sapiens
tccccagcccctcctccctca

SEQ ID NO: 4580517 - DNA, 19 bp, Homo sapiens
tccccaggctggagacccc

SEQ ID NO: 4580518 - DNA, 14 bp, Homo sapiens
tccccaggggagag

SEQ ID NO: 4580519 - DNA, 15 bp, Homo sapiens
tccccaggtggctga

SEQ ID NO: 4580520 - DNA, 20 bp, Homo sapiens
tccccaggtggctgacccag

SEQ ID NO: 4580521 - DNA, 16 bp, Homo sapiens
tccccagtgcctgcca

SEQ ID NO: 4580522 - DNA, 21 bp, Homo sapiens
tccccagtgcctgccactctc

SEQ ID NO: 4580523 - DNA, 16 bp, Homo sapiens
tccccagttccacagc

SEQ ID NO: 4580524 - DNA, 17 bp, Homo sapiens
tccccagttccacagca

SEQ ID NO: 4580525 - DNA, 16 bp, Homo sapiens
tccccagttgccgtct

SEQ ID NO: 4580526 - DNA, 17 bp, Homo sapiens
tccccagtttgcagaaa

SEQ ID NO: 4580527 - DNA, 19 bp, Homo sapiens
tccccatatataaattatt

SEQ ID NO: 4580528 - DNA, 22 bp, Homo sapiens
tccccatatataaattattact

SEQ ID NO: 4580529 - DNA, 15 bp, Homo sapiens
tccccatctccctgc

SEQ ID NO: 4580530 - DNA, 16 bp, Homo sapiens
tccccatctccctgcc

SEQ ID NO: 4580531 - DNA, 15 bp, Homo sapiens
tccccatctgtccag

SEQ ID NO: 4580532 - DNA, 14 bp, Homo sapiens
tccccatcttctaa

SEQ ID NO: 4580533 - DNA, 16 bp, Homo sapiens
tccccatttcccatct

SEQ ID NO: 4580534 - DNA, 18 bp, Homo sapiens
tccccatttcccatctgc

SEQ ID NO: 4580535 - DNA, 20 bp, Homo sapiens
tccccatttcccatctgcac

SEQ ID NO: 4580536 - DNA, 15 bp, Homo sapiens
tccccatttctgcct

SEQ ID NO: 4580537 - DNA, 16 bp, Homo sapiens
tccccatttctgcctc

SEQ ID NO: 4580538 - DNA, 19 bp, Homo sapiens
tccccatttctgcctcgct

SEQ ID NO: 4580539 - DNA, 19 bp, Homo sapiens
tcccccaacccccacccca

SEQ ID NO: 4580540 - DNA, 21 bp, Homo sapiens
tcccccaacccccaccccaca

SEQ ID NO: 4580541 - DNA, 22 bp, Homo sapiens
tcccccaacccccaccccacac

SEQ ID NO: 4580542 - DNA, 14 bp, Homo sapiens
tcccccaactcagg

SEQ ID NO: 4580543 - DNA, 15 bp, Homo sapiens
tcccccaactcagga

SEQ ID NO: 4580544 - DNA, 11 bp, Homo sapiens
tcccccagagc

SEQ ID NO: 4580545 - DNA, 15 bp, Homo sapiens
tcccccagagcatct

SEQ ID NO: 4580546 - DNA, 23 bp, Homo sapiens
tcccccagagcatctgccccagg

SEQ ID NO: 4580547 - DNA, 11 bp, Homo sapiens
tcccccagcaa

SEQ ID NO: 4580548 - DNA, 12 bp, Homo sapiens
tcccccaggagg

SEQ ID NO: 4580549 - DNA, 17 bp, Homo sapiens
tcccccaggaggcagct

SEQ ID NO: 4580550 - DNA, 14 bp, Homo sapiens
tcccccaggctgga

SEQ ID NO: 4580551 - DNA, 16 bp, Homo sapiens
tcccccatcatgtggc

SEQ ID NO: 4580552 - DNA, 23 bp, Homo sapiens
tcccccatcatgtggcccaactc

SEQ ID NO: 4580553 - DNA, 18 bp, Homo sapiens
tcccccattccctccatt

SEQ ID NO: 4580554 - DNA, 12 bp, Homo sapiens
tccccccactct

SEQ ID NO: 4580555 - DNA, 13 bp, Homo sapiens
tccccccactgca

SEQ ID NO: 4580556 - DNA, 18 bp, Homo sapiens
tcccccctcctctgaaac

SEQ ID NO: 4580557 - DNA, 17 bp, Homo sapiens
tcccccgtggtgcctgc

SEQ ID NO: 4580558 - DNA, 18 bp, Homo sapiens
tcccccgtggtgcctgca

SEQ ID NO: 4580559 - DNA, 16 bp, Homo sapiens
tcccccgtttctcctt

SEQ ID NO: 4580560 - DNA, 16 bp, Homo sapiens
tccccctccccaggct

SEQ ID NO: 4580561 - DNA, 20 bp, Homo sapiens
tccccctcctccagggaagg

SEQ ID NO: 4580562 - DNA, 12 bp, Homo sapiens
tccccctctgtc

SEQ ID NO: 4580563 - DNA, 11 bp, Homo sapiens
tccccctgcaa

SEQ ID NO: 4580564 - DNA, 12 bp, Homo sapiens
tccccctgcaac

SEQ ID NO: 4580565 - DNA, 16 bp, Homo sapiens
tccccctgccagtgcc

SEQ ID NO: 4580566 - DNA, 18 bp, Homo sapiens
tccccctgccagtgcctt

SEQ ID NO: 4580567 - DNA, 13 bp, Homo sapiens
tccccctgcctcc

SEQ ID NO: 4580568 - DNA, 19 bp, Homo sapiens
tccccctgcctcccattct

SEQ ID NO: 4580569 - DNA, 12 bp, Homo sapiens
tccccctgcgcc

SEQ ID NO: 4580570 - DNA, 17 bp, Homo sapiens
tccccctgcgccccgca

SEQ ID NO: 4580571 - DNA, 18 bp, Homo sapiens
tcccccttcccatttctt

SEQ ID NO: 4580572 - DNA, 21 bp, Homo sapiens
tcccccttcccatttcttccc

SEQ ID NO: 4580573 - DNA, 23 bp, Homo sapiens
tcccccttgccaccccaccctcc

SEQ ID NO: 4580574 - DNA, 17 bp, Homo sapiens
tccccgaggagctgggc

SEQ ID NO: 4580575 - DNA, 19 bp, Homo sapiens
tccccgaggagctgggccc

SEQ ID NO: 4580576 - DNA, 18 bp, Homo sapiens
tccccgcagcccgcctgc

SEQ ID NO: 4580577 - DNA, 20 bp, Homo sapiens
tccccgcagcccgcctgccg

SEQ ID NO: 4580578 - DNA, 13 bp, Homo sapiens
tccccgcctccac

SEQ ID NO: 4580579 - DNA, 13 bp, Homo sapiens
tccccgctccaca

SEQ ID NO: 4580580 - DNA, 22 bp, Homo sapiens
tccccggtcccttgagacctca

SEQ ID NO: 4580581 - DNA, 22 bp, Homo sapiens
tccccgtgtcctctccctgcca

SEQ ID NO: 4580582 - DNA, 15 bp, Homo sapiens
tcccctatccaccca

SEQ ID NO: 4580583 - DNA, 16 bp, Homo sapiens
tcccctatccacccag

SEQ ID NO: 4580584 - DNA, 17 bp, Homo sapiens
tcccctcactctgtcag

SEQ ID NO: 4580585 - DNA, 18 bp, Homo sapiens
tcccctcactctgtcagc

SEQ ID NO: 4580586 - DNA, 22 bp, Homo sapiens
tcccctcactctgtcagccagc

SEQ ID NO: 4580587 - DNA, 13 bp, Homo sapiens
tcccctccctgcc

SEQ ID NO: 4580588 - DNA, 16 bp, Homo sapiens
tcccctccctgcctgc

SEQ ID NO: 4580589 - DNA, 18 bp, Homo sapiens
tcccctccctgcctgctc

SEQ ID NO: 4580590 - DNA, 19 bp, Homo sapiens
tcccctccctgcctgctcc

SEQ ID NO: 4580591 - DNA, 19 bp, Homo sapiens
tcccctccctggctcccat

SEQ ID NO: 4580592 - DNA, 21 bp, Homo sapiens
tcccctccctggctcccatga

SEQ ID NO: 4580593 - DNA, 14 bp, Homo sapiens
tcccctcctccact

SEQ ID NO: 4580594 - DNA, 16 bp, Homo sapiens
tcccctcctccactct

SEQ ID NO: 4580595 - DNA, 14 bp, Homo sapiens
tcccctcctcttcc

SEQ ID NO: 4580596 - DNA, 19 bp, Homo sapiens
tcccctcctcttcccttag

SEQ ID NO: 4580597 - DNA, 17 bp, Homo sapiens
tcccctcggagaagagc

SEQ ID NO: 4580598 - DNA, 21 bp, Homo sapiens
tcccctctcctccccttcctg

SEQ ID NO: 4580599 - DNA, 19 bp, Homo sapiens
tcccctctcgccccatccc

SEQ ID NO: 4580600 - DNA, 21 bp, Homo sapiens
tcccctctcttgtcagatgcc

SEQ ID NO: 4580601 - DNA, 22 bp, Homo sapiens
tcccctcttaaatgagaaagca

SEQ ID NO: 4580602 - DNA, 14 bp, Homo sapiens
tcccctgccagggc

SEQ ID NO: 4580603 - DNA, 15 bp, Homo sapiens
tcccctgccagggca

SEQ ID NO: 4580604 - DNA, 18 bp, Homo sapiens
tcccctgcccagcctgct

SEQ ID NO: 4580605 - DNA, 13 bp, Homo sapiens
tcccctgccctgg

SEQ ID NO: 4580606 - DNA, 15 bp, Homo sapiens
tcccctgccctggtc

SEQ ID NO: 4580607 - DNA, 20 bp, Homo sapiens
tcccctgctactcctgtgct

SEQ ID NO: 4580608 - DNA, 15 bp, Homo sapiens
tcccctgctgacctt

SEQ ID NO: 4580609 - DNA, 23 bp, Homo sapiens
tcccctgctgaccttggaggaat

SEQ ID NO: 4580610 - DNA, 13 bp, Homo sapiens
tccccttccccca

SEQ ID NO: 4580611 - DNA, 15 bp, Homo sapiens
tccccttcccctgct

SEQ ID NO: 4580612 - DNA, 13 bp, Homo sapiens
tccccttccctta

SEQ ID NO: 4580613 - DNA, 18 bp, Homo sapiens
tccccttctctcatctct

SEQ ID NO: 4580614 - DNA, 21 bp, Homo sapiens
tccccttttttttctgattct

SEQ ID NO: 4580615 - DNA, 22 bp, Homo sapiens
tccccttttttttctgattctt

SEQ ID NO: 4580616 - DNA, 22 bp, Homo sapiens
tcccgagcacctccacatcctc

SEQ ID NO: 4580617 - DNA, 16 bp, Homo sapiens
tcccgcactctgcccc

SEQ ID NO: 4580618 - DNA, 19 bp, Homo sapiens
tcccgccactcgccttctt

SEQ ID NO: 4580619 - DNA, 17 bp, Homo sapiens
tcccgccccgcccctcc

SEQ ID NO: 4580620 - DNA, 15 bp, Homo sapiens
tcccgcgttcaagac

SEQ ID NO: 4580621 - DNA, 16 bp, Homo sapiens
tcccgctgctgtgctc

SEQ ID NO: 4580622 - DNA, 22 bp, Homo sapiens
tcccgctgctgtgctctgggga

SEQ ID NO: 4580623 - DNA, 21 bp, Homo sapiens
tcccgggacacctaggctagg

SEQ ID NO: 4580624 - DNA, 14 bp, Homo sapiens
tcccgggagctggg

SEQ ID NO: 4580625 - DNA, 16 bp, Homo sapiens
tcccgggagctgggcc

SEQ ID NO: 4580626 - DNA, 18 bp, Homo sapiens
tcccgggagctgggccct

SEQ ID NO: 4580627 - DNA, 19 bp, Homo sapiens
tcccgggagctgggccctg

SEQ ID NO: 4580628 - DNA, 21 bp, Homo sapiens
tcccggggccagcacttccat

SEQ ID NO: 4580629 - DNA, 22 bp, Homo sapiens
tcccggtggtgggatccacgct

SEQ ID NO: 4580630 - DNA, 15 bp, Homo sapiens
tcccgtatcacagtg

SEQ ID NO: 4580631 - DNA, 17 bp, Homo sapiens
tcccgtatcacagtgtt

SEQ ID NO: 4580632 - DNA, 17 bp, Homo sapiens
tcccgtctggacctggg

SEQ ID NO: 4580633 - DNA, 20 bp, Homo sapiens
tcccgtgcatcccccctgct

SEQ ID NO: 4580634 - DNA, 13 bp, Homo sapiens
tcccgtgcctggg

SEQ ID NO: 4580635 - DNA, 19 bp, Homo sapiens
tccctaaactttggccttt

SEQ ID NO: 4580636 - DNA, 15 bp, Homo sapiens
tccctaatgtgtttc

SEQ ID NO: 4580637 - DNA, 22 bp, Homo sapiens
tccctacctcaacctgtaaatt

SEQ ID NO: 4580638 - DNA, 15 bp, Homo sapiens
tccctacctcaggca

SEQ ID NO: 4580639 - DNA, 14 bp, Homo sapiens
tccctacctgcttc

SEQ ID NO: 4580640 - DNA, 16 bp, Homo sapiens
tccctactttctctct

SEQ ID NO: 4580641 - DNA, 17 bp, Homo sapiens
tccctagttagcatcca

SEQ ID NO: 4580642 - DNA, 16 bp, Homo sapiens
tccctatcaagcacta

SEQ ID NO: 4580643 - DNA, 18 bp, Homo sapiens
tccctatttttctctcct

SEQ ID NO: 4580644 - DNA, 21 bp, Homo sapiens
tccctatttttctctcctgtc

SEQ ID NO: 4580645 - DNA, 22 bp, Homo sapiens
tccctatttttctctcctgtcc

SEQ ID NO: 4580646 - DNA, 17 bp, Homo sapiens
tccctcaaagaggcctt

SEQ ID NO: 4580647 - DNA, 20 bp, Homo sapiens
tccctcaaatgcgcgtgtgc

SEQ ID NO: 4580648 - DNA, 23 bp, Homo sapiens
tccctcaccccctcccaccccca

SEQ ID NO: 4580649 - DNA, 9 bp, Homo sapiens
tccctcaga

SEQ ID NO: 4580650 - DNA, 12 bp, Homo sapiens
tccctcagaccc

SEQ ID NO: 4580651 - DNA, 18 bp, Homo sapiens
tccctcagacccaggagt

SEQ ID NO: 4580652 - DNA, 19 bp, Homo sapiens
tccctcagacccaggagtc

SEQ ID NO: 4580653 - DNA, 21 bp, Homo sapiens
tccctcagacccaggagtcca

SEQ ID NO: 4580654 - DNA, 12 bp, Homo sapiens
tccctcagactc

SEQ ID NO: 4580655 - DNA, 13 bp, Homo sapiens
tccctcagactca

SEQ ID NO: 4580656 - DNA, 23 bp, Homo sapiens
tccctcagactcagaggtccagg

SEQ ID NO: 4580657 - DNA, 11 bp, Homo sapiens
tccctcagcct

SEQ ID NO: 4580658 - DNA, 19 bp, Homo sapiens
tccctcagcctaagaaaca

SEQ ID NO: 4580659 - DNA, 17 bp, Homo sapiens
tccctcagctctctggg

SEQ ID NO: 4580660 - DNA, 14 bp, Homo sapiens
tccctcaggcccag

SEQ ID NO: 4580661 - DNA, 17 bp, Homo sapiens
tccctcaggcccaggag

SEQ ID NO: 4580662 - DNA, 19 bp, Homo sapiens
tccctcaggcccaggagtc

SEQ ID NO: 4580663 - DNA, 13 bp, Homo sapiens
tccctccacccca

SEQ ID NO: 4580664 - DNA, 14 bp, Homo sapiens
tccctccaccccac

SEQ ID NO: 4580665 - DNA, 15 bp, Homo sapiens
tccctccaccccagg

SEQ ID NO: 4580666 - DNA, 17 bp, Homo sapiens
tccctccaccccaggac

SEQ ID NO: 4580667 - DNA, 13 bp, Homo sapiens
tccctccagggtc

SEQ ID NO: 4580668 - DNA, 23 bp, Homo sapiens
tccctccagggtcctctcttcca

SEQ ID NO: 4580669 - DNA, 21 bp, Homo sapiens
tccctccagtattgccccctc

SEQ ID NO: 4580670 - DNA, 21 bp, Homo sapiens
tccctcccaacagagctgggc

SEQ ID NO: 4580671 - DNA, 23 bp, Homo sapiens
tccctcccagaggagccaccagt

SEQ ID NO: 4580672 - DNA, 14 bp, Homo sapiens
tccctccccctcct

SEQ ID NO: 4580673 - DNA, 17 bp, Homo sapiens
tccctccccctccttgt

SEQ ID NO: 4580674 - DNA, 15 bp, Homo sapiens
tccctcccctgccct

SEQ ID NO: 4580675 - DNA, 16 bp, Homo sapiens
tccctcccctgccctg

SEQ ID NO: 4580676 - DNA, 17 bp, Homo sapiens
tccctcccctgccctgg

SEQ ID NO: 4580677 - DNA, 15 bp, Homo sapiens
tccctccgccttctc

SEQ ID NO: 4580678 - DNA, 12 bp, Homo sapiens
tccctcctcacc

SEQ ID NO: 4580679 - DNA, 14 bp, Homo sapiens
tccctcctcacctc

SEQ ID NO: 4580680 - DNA, 17 bp, Homo sapiens
tccctcctccaggcctg

SEQ ID NO: 4580681 - DNA, 16 bp, Homo sapiens
tccctcctctgcccgg

SEQ ID NO: 4580682 - DNA, 16 bp, Homo sapiens
tccctctaacccagtg

SEQ ID NO: 4580683 - DNA, 17 bp, Homo sapiens
tccctctaacccagtgg

SEQ ID NO: 4580684 - DNA, 13 bp, Homo sapiens
tccctctagtgcc

SEQ ID NO: 4580685 - DNA, 16 bp, Homo sapiens
tccctctccaagacag

SEQ ID NO: 4580686 - DNA, 19 bp, Homo sapiens
tccctctccaagacagcag

SEQ ID NO: 4580687 - DNA, 22 bp, Homo sapiens
tccctctccaagacagcagcag

SEQ ID NO: 4580688 - DNA, 16 bp, Homo sapiens
tccctctcctgcctac

SEQ ID NO: 4580689 - DNA, 16 bp, Homo sapiens
tccctctctccctgcc

SEQ ID NO: 4580690 - DNA, 19 bp, Homo sapiens
tccctctctgatgtcccag

SEQ ID NO: 4580691 - DNA, 13 bp, Homo sapiens
tccctctgctgct

SEQ ID NO: 4580692 - DNA, 15 bp, Homo sapiens
tccctctgctgcttt

SEQ ID NO: 4580693 - DNA, 16 bp, Homo sapiens
tccctctgctgctttt

SEQ ID NO: 4580694 - DNA, 17 bp, Homo sapiens
tccctctggccctgcct

SEQ ID NO: 4580695 - DNA, 18 bp, Homo sapiens
tccctctggccctgcctt

SEQ ID NO: 4580696 - DNA, 17 bp, Homo sapiens
tccctctgggcacgcct

SEQ ID NO: 4580697 - DNA, 17 bp, Homo sapiens
tccctgaaaatgttttt

SEQ ID NO: 4580698 - DNA, 20 bp, Homo sapiens
tccctgaccttagcgttctg

SEQ ID NO: 4580699 - DNA, 19 bp, Homo sapiens
tccctgactcattctgaag

SEQ ID NO: 4580700 - DNA, 17 bp, Homo sapiens
tccctgactccctgtgg

SEQ ID NO: 4580701 - DNA, 16 bp, Homo sapiens
tccctgacttgcttta

SEQ ID NO: 4580702 - DNA, 16 bp, Homo sapiens
tccctgacttttctgt

SEQ ID NO: 4580703 - DNA, 17 bp, Homo sapiens
tccctgagtcaccagga

SEQ ID NO: 4580704 - DNA, 21 bp, Homo sapiens
tccctgagtcaccaggaatgt

SEQ ID NO: 4580705 - DNA, 21 bp, Homo sapiens
tccctgagtgcgggctgaggc

SEQ ID NO: 4580706 - DNA, 17 bp, Homo sapiens
tccctgatcccaccccc

SEQ ID NO: 4580707 - DNA, 19 bp, Homo sapiens
tccctgcaaaactccaggc

SEQ ID NO: 4580708 - DNA, 21 bp, Homo sapiens
tccctgcaagctccgcctccc

SEQ ID NO: 4580709 - DNA, 18 bp, Homo sapiens
tccctgcctcaggccaag

SEQ ID NO: 4580710 - DNA, 14 bp, Homo sapiens
tccctgcctgaggg

SEQ ID NO: 4580711 - DNA, 15 bp, Homo sapiens
tccctgcctgctcct

SEQ ID NO: 4580712 - DNA, 21 bp, Homo sapiens
tccctgcctgctccttggcac

SEQ ID NO: 4580713 - DNA, 13 bp, Homo sapiens
tccctgcctggac

SEQ ID NO: 4580714 - DNA, 15 bp, Homo sapiens
tccctgcctgtggcc

SEQ ID NO: 4580715 - DNA, 19 bp, Homo sapiens
tccctgcgagacgcacaca

SEQ ID NO: 4580716 - DNA, 16 bp, Homo sapiens
tccctgctcagtgctt

SEQ ID NO: 4580717 - DNA, 14 bp, Homo sapiens
tccctgctggggaa

SEQ ID NO: 4580718 - DNA, 14 bp, Homo sapiens
tccctgctgtgcca

SEQ ID NO: 4580719 - DNA, 14 bp, Homo sapiens
tccctgcttccagg

SEQ ID NO: 4580720 - DNA, 16 bp, Homo sapiens
tccctgcttgcccgct

SEQ ID NO: 4580721 - DNA, 19 bp, Homo sapiens
tccctgcttgcccgctccc

SEQ ID NO: 4580722 - DNA, 17 bp, Homo sapiens
tccctgctttgcatctt

SEQ ID NO: 4580723 - DNA, 23 bp, Homo sapiens
tccctggaaaccttccacccagt

SEQ ID NO: 4580724 - DNA, 16 bp, Homo sapiens
tccctggagcaggagc

SEQ ID NO: 4580725 - DNA, 17 bp, Homo sapiens
tccctggagcaggagcc

SEQ ID NO: 4580726 - DNA, 18 bp, Homo sapiens
tccctggagcaggagccc

SEQ ID NO: 4580727 - DNA, 11 bp, Homo sapiens
tccctggagtg

SEQ ID NO: 4580728 - DNA, 21 bp, Homo sapiens
tccctggcgcaggtgggctgg

SEQ ID NO: 4580729 - DNA, 11 bp, Homo sapiens
tccctggcttg

SEQ ID NO: 4580730 - DNA, 18 bp, Homo sapiens
tccctggcttgtaactcc

SEQ ID NO: 4580731 - DNA, 19 bp, Homo sapiens
tccctggcttgtaactcca

SEQ ID NO: 4580732 - DNA, 20 bp, Homo sapiens
tccctgggacacagacccag

SEQ ID NO: 4580733 - DNA, 23 bp, Homo sapiens
tccctgggacacagacccaggac

SEQ ID NO: 4580734 - DNA, 18 bp, Homo sapiens
tccctgggcccctccacg

SEQ ID NO: 4580735 - DNA, 20 bp, Homo sapiens
tccctgggcccctccacgcc

SEQ ID NO: 4580736 - DNA, 20 bp, Homo sapiens
tccctggggaaaacttgcag

SEQ ID NO: 4580737 - DNA, 18 bp, Homo sapiens
tccctgggggaagccctg

SEQ ID NO: 4580738 - DNA, 21 bp, Homo sapiens
tccctgggggccttgggtgag

SEQ ID NO: 4580739 - DNA, 23 bp, Homo sapiens
tccctgtaacctcttcagaggcc

SEQ ID NO: 4580740 - DNA, 14 bp, Homo sapiens
tccctgtcaccaag

SEQ ID NO: 4580741 - DNA, 13 bp, Homo sapiens
tccctgtcacctc

SEQ ID NO: 4580742 - DNA, 17 bp, Homo sapiens
tccctgtcacctcttcc

SEQ ID NO: 4580743 - DNA, 13 bp, Homo sapiens
tccctgtcccagt

SEQ ID NO: 4580744 - DNA, 15 bp, Homo sapiens
tccctgtcctcctcg

SEQ ID NO: 4580745 - DNA, 21 bp, Homo sapiens
tccctgtccttccctgttctc

SEQ ID NO: 4580746 - DNA, 13 bp, Homo sapiens
tccctgtctccag

SEQ ID NO: 4580747 - DNA, 12 bp, Homo sapiens
tccctgtgaggg

SEQ ID NO: 4580748 - DNA, 21 bp, Homo sapiens
tccctgtggcactcagggagc

SEQ ID NO: 4580749 - DNA, 20 bp, Homo sapiens
tccctgtgggggtggccatc

SEQ ID NO: 4580750 - DNA, 22 bp, Homo sapiens
tccctgtgggggtggccatccc

SEQ ID NO: 4580751 - DNA, 17 bp, Homo sapiens
tcccttaacagttgtat

SEQ ID NO: 4580752 - DNA, 22 bp, Homo sapiens
tcccttaacagttgtatttaac

SEQ ID NO: 4580753 - DNA, 13 bp, Homo sapiens
tcccttaataaaa

SEQ ID NO: 4580754 - DNA, 17 bp, Homo sapiens
tcccttaatatcctaaa

SEQ ID NO: 4580755 - DNA, 21 bp, Homo sapiens
tcccttaatatcctaaacatc

SEQ ID NO: 4580756 - DNA, 15 bp, Homo sapiens
tcccttagcctctcc

SEQ ID NO: 4580757 - DNA, 18 bp, Homo sapiens
tcccttagcctctcccac

SEQ ID NO: 4580758 - DNA, 17 bp, Homo sapiens
tcccttccttttccctg

SEQ ID NO: 4580759 - DNA, 19 bp, Homo sapiens
tcccttccttttccctgct

SEQ ID NO: 4580760 - DNA, 20 bp, Homo sapiens
tcccttccttttccctgctt

SEQ ID NO: 4580761 - DNA, 20 bp, Homo sapiens
tcccttctcgtgtttgctta

SEQ ID NO: 4580762 - DNA, 19 bp, Homo sapiens
tcccttctgtagtttttaa

SEQ ID NO: 4580763 - DNA, 22 bp, Homo sapiens
tcccttgaccattggctgcgct

SEQ ID NO: 4580764 - DNA, 13 bp, Homo sapiens
tcccttgagacct

SEQ ID NO: 4580765 - DNA, 18 bp, Homo sapiens
tcccttgagacctcagcc

SEQ ID NO: 4580766 - DNA, 19 bp, Homo sapiens
tcccttgagacctcagcca

SEQ ID NO: 4580767 - DNA, 15 bp, Homo sapiens
tcccttgcaggggtc

SEQ ID NO: 4580768 - DNA, 12 bp, Homo sapiens
tcccttgcctct

SEQ ID NO: 4580769 - DNA, 14 bp, Homo sapiens
tcccttgcctctgc

SEQ ID NO: 4580770 - DNA, 16 bp, Homo sapiens
tcccttgcctctgccc

SEQ ID NO: 4580771 - DNA, 15 bp, Homo sapiens
tcccttggacatttt

SEQ ID NO: 4580772 - DNA, 14 bp, Homo sapiens
tcccttggcctcag

SEQ ID NO: 4580773 - DNA, 12 bp, Homo sapiens
tcccttgggctc

SEQ ID NO: 4580774 - DNA, 16 bp, Homo sapiens
tcccttgtggccctct

SEQ ID NO: 4580775 - DNA, 18 bp, Homo sapiens
tcccttgtttataaatag

SEQ ID NO: 4580776 - DNA, 16 bp, Homo sapiens
tccctttaaagagcaa

SEQ ID NO: 4580777 - DNA, 19 bp, Homo sapiens
tccctttctctctcctctc

SEQ ID NO: 4580778 - DNA, 17 bp, Homo sapiens
tccctttctcttcttcc

SEQ ID NO: 4580779 - DNA, 14 bp, Homo sapiens
tccctttgtctttc

SEQ ID NO: 4580780 - DNA, 18 bp, Homo sapiens
tcccttttatctattaga

SEQ ID NO: 4580781 - DNA, 14 bp, Homo sapiens
tcccttttctcctc

SEQ ID NO: 4580782 - DNA, 14 bp, Homo sapiens
tcccttttctgttc

SEQ ID NO: 4580783 - DNA, 16 bp, Homo sapiens
tcccttttctgttcta

SEQ ID NO: 4580784 - DNA, 17 bp, Homo sapiens
tcccttttgcattgcca

SEQ ID NO: 4580785 - DNA, 15 bp, Homo sapiens
tccgaagaaaagaat

SEQ ID NO: 4580786 - DNA, 20 bp, Homo sapiens
tccgacatcccagaccagcc

SEQ ID NO: 4580787 - DNA, 17 bp, Homo sapiens
tccgactgcccagaaag

SEQ ID NO: 4580788 - DNA, 13 bp, Homo sapiens
tccgagagggaga

SEQ ID NO: 4580789 - DNA, 14 bp, Homo sapiens
tccgagagggagag

SEQ ID NO: 4580790 - DNA, 14 bp, Homo sapiens
tccgaggctccccg

SEQ ID NO: 4580791 - DNA, 16 bp, Homo sapiens
tccgaggctccccgcc

SEQ ID NO: 4580792 - DNA, 15 bp, Homo sapiens
tccgcaccctgtcct

SEQ ID NO: 4580793 - DNA, 16 bp, Homo sapiens
tccgcaggtgctggtc

SEQ ID NO: 4580794 - DNA, 18 bp, Homo sapiens
tccgcaggtgctggtccc

SEQ ID NO: 4580795 - DNA, 13 bp, Homo sapiens
tccgccagcctcc

SEQ ID NO: 4580796 - DNA, 17 bp, Homo sapiens
tccgccagcctcctctg

SEQ ID NO: 4580797 - DNA, 18 bp, Homo sapiens
tccgcccactcctgggac

SEQ ID NO: 4580798 - DNA, 13 bp, Homo sapiens
tccgcccagcctc

SEQ ID NO: 4580799 - DNA, 19 bp, Homo sapiens
tccgcccagcctctccccg

SEQ ID NO: 4580800 - DNA, 12 bp, Homo sapiens
tccgcctccaca

SEQ ID NO: 4580801 - DNA, 15 bp, Homo sapiens
tccgcctccacactg

SEQ ID NO: 4580802 - DNA, 19 bp, Homo sapiens
tccgctgaggggtctcgga

SEQ ID NO: 4580803 - DNA, 14 bp, Homo sapiens
tccgctgccagcct

SEQ ID NO: 4580804 - DNA, 16 bp, Homo sapiens
tccgctgccagccttg

SEQ ID NO: 4580805 - DNA, 19 bp, Homo sapiens
tccgctgccagccttgagc

SEQ ID NO: 4580806 - DNA, 18 bp, Homo sapiens
tccgctgtcgccccaggc

SEQ ID NO: 4580807 - DNA, 21 bp, Homo sapiens
tccgctgtcgccccaggccct

SEQ ID NO: 4580808 - DNA, 23 bp, Homo sapiens
tccgcttctctcttttaaagtat

SEQ ID NO: 4580809 - DNA, 12 bp, Homo sapiens
tccggaaagaag

SEQ ID NO: 4580810 - DNA, 15 bp, Homo sapiens
tccggacactcctag

SEQ ID NO: 4580811 - DNA, 16 bp, Homo sapiens
tccggaggactgagcc

SEQ ID NO: 4580812 - DNA, 18 bp, Homo sapiens
tccggaggactgagcccc

SEQ ID NO: 4580813 - DNA, 20 bp, Homo sapiens
tccggcccagtgccactgcc

SEQ ID NO: 4580814 - DNA, 22 bp, Homo sapiens
tccggcccagtgccactgcccc

SEQ ID NO: 4580815 - DNA, 14 bp, Homo sapiens
tccggccctccaga

SEQ ID NO: 4580816 - DNA, 14 bp, Homo sapiens
tccggcctctccct

SEQ ID NO: 4580817 - DNA, 15 bp, Homo sapiens
tccggcctctccctg

SEQ ID NO: 4580818 - DNA, 17 bp, Homo sapiens
tccggcctctccctgcc

SEQ ID NO: 4580819 - DNA, 18 bp, Homo sapiens
tccggcctctccctgcct

SEQ ID NO: 4580820 - DNA, 21 bp, Homo sapiens
tccggcctgggtgacagagtg

SEQ ID NO: 4580821 - DNA, 23 bp, Homo sapiens
tccggcctgggtgacagagtgag

SEQ ID NO: 4580822 - DNA, 16 bp, Homo sapiens
tccggcgtcagcctcc

SEQ ID NO: 4580823 - DNA, 22 bp, Homo sapiens
tccggcgtcagcctccagcctc

SEQ ID NO: 4580824 - DNA, 14 bp, Homo sapiens
tccgggggtacagc

SEQ ID NO: 4580825 - DNA, 19 bp, Homo sapiens
tccgggtgtggcctcagcc

SEQ ID NO: 4580826 - DNA, 13 bp, Homo sapiens
tccgtagctcccc

SEQ ID NO: 4580827 - DNA, 17 bp, Homo sapiens
tccgtagctcccctggc

SEQ ID NO: 4580828 - DNA, 22 bp, Homo sapiens
tccgtagctcccctggctggct

SEQ ID NO: 4580829 - DNA, 18 bp, Homo sapiens
tccgtaggacaagtttta

SEQ ID NO: 4580830 - DNA, 17 bp, Homo sapiens
tccgtcaagctggttgt

SEQ ID NO: 4580831 - DNA, 17 bp, Homo sapiens
tccgtcagcttctccca

SEQ ID NO: 4580832 - DNA, 19 bp, Homo sapiens
tccgtcccacatcagggcg

SEQ ID NO: 4580833 - DNA, 17 bp, Homo sapiens
tccgtgaactctggtgc

SEQ ID NO: 4580834 - DNA, 17 bp, Homo sapiens
tccgtgggaccctcagc

SEQ ID NO: 4580835 - DNA, 14 bp, Homo sapiens
tccgtggtcagagt

SEQ ID NO: 4580836 - DNA, 18 bp, Homo sapiens
tccgtggtcagagtgcca

SEQ ID NO: 4580837 - DNA, 14 bp, Homo sapiens
tccgtggtttctca

SEQ ID NO: 4580838 - DNA, 21 bp, Homo sapiens
tccgtgtggagcacgtggaga

SEQ ID NO: 4580839 - DNA, 15 bp, Homo sapiens
tccgtttattaaaga

SEQ ID NO: 4580840 - DNA, 17 bp, Homo sapiens
tccgtttccttacacat

SEQ ID NO: 4580841 - DNA, 14 bp, Homo sapiens
tcctaaaacaccct

SEQ ID NO: 4580842 - DNA, 23 bp, Homo sapiens
tcctaaaagcaaaataaaaacta

SEQ ID NO: 4580843 - DNA, 23 bp, Homo sapiens
tcctaaaaggtgttgtaatggtg

SEQ ID NO: 4580844 - DNA, 13 bp, Homo sapiens
tcctaaaagttca

SEQ ID NO: 4580845 - DNA, 15 bp, Homo sapiens
tcctaaagtctctgc

SEQ ID NO: 4580846 - DNA, 12 bp, Homo sapiens
tcctaactttct

SEQ ID NO: 4580847 - DNA, 18 bp, Homo sapiens
tcctaagacatttttcat

SEQ ID NO: 4580848 - DNA, 18 bp, Homo sapiens
tcctaataaagttctgta

SEQ ID NO: 4580849 - DNA, 15 bp, Homo sapiens
tcctaatactgtcat

SEQ ID NO: 4580850 - DNA, 14 bp, Homo sapiens
tcctaatatcaaat

SEQ ID NO: 4580851 - DNA, 19 bp, Homo sapiens
tcctaatcatataccagag

SEQ ID NO: 4580852 - DNA, 13 bp, Homo sapiens
tcctaatcgctaa

SEQ ID NO: 4580853 - DNA, 23 bp, Homo sapiens
tcctacaagagcagcctgtggca

SEQ ID NO: 4580854 - DNA, 14 bp, Homo sapiens
tcctaccactctaa

SEQ ID NO: 4580855 - DNA, 14 bp, Homo sapiens
tcctaccatcagct

SEQ ID NO: 4580856 - DNA, 23 bp, Homo sapiens
tcctaccccggctgcttggcagt

SEQ ID NO: 4580857 - DNA, 15 bp, Homo sapiens
tcctacctcaaaatt

SEQ ID NO: 4580858 - DNA, 14 bp, Homo sapiens
tcctaccttgcttt

SEQ ID NO: 4580859 - DNA, 23 bp, Homo sapiens
tcctagaagaaccaaatacctca

SEQ ID NO: 4580860 - DNA, 15 bp, Homo sapiens
tcctagaagtcttaa

SEQ ID NO: 4580861 - DNA, 22 bp, Homo sapiens
tcctagaagtcttaattgtgtt

SEQ ID NO: 4580862 - DNA, 18 bp, Homo sapiens
tcctagagaagacaggct

SEQ ID NO: 4580863 - DNA, 19 bp, Homo sapiens
tcctagattacatctgcct

SEQ ID NO: 4580864 - DNA, 22 bp, Homo sapiens
tcctagattacatctgccttaa

SEQ ID NO: 4580865 - DNA, 18 bp, Homo sapiens
tcctagcaccctggagag

SEQ ID NO: 4580866 - DNA, 19 bp, Homo sapiens
tcctagcccagtgcttctc

SEQ ID NO: 4580867 - DNA, 12 bp, Homo sapiens
tcctagcccttc

SEQ ID NO: 4580868 - DNA, 15 bp, Homo sapiens
tcctagcccttccct

SEQ ID NO: 4580869 - DNA, 16 bp, Homo sapiens
tcctagcccttccctg

SEQ ID NO: 4580870 - DNA, 18 bp, Homo sapiens
tcctagcccttccctgag

SEQ ID NO: 4580871 - DNA, 19 bp, Homo sapiens
tcctagcccttccctgagt

SEQ ID NO: 4580872 - DNA, 20 bp, Homo sapiens
tcctagcccttccctgagtg

SEQ ID NO: 4580873 - DNA, 16 bp, Homo sapiens
tcctagctgcacaggg

SEQ ID NO: 4580874 - DNA, 20 bp, Homo sapiens
tcctagctgtgttattcctg

SEQ ID NO: 4580875 - DNA, 11 bp, Homo sapiens
tcctaggactt

SEQ ID NO: 4580876 - DNA, 13 bp, Homo sapiens
tcctaggacttaa

SEQ ID NO: 4580877 - DNA, 23 bp, Homo sapiens
tcctaggcctcaactcctcccat

SEQ ID NO: 4580878 - DNA, 13 bp, Homo sapiens
tcctaggggaaga

SEQ ID NO: 4580879 - DNA, 23 bp, Homo sapiens
tcctagtgaaagaggcagcttga

SEQ ID NO: 4580880 - DNA, 18 bp, Homo sapiens
tcctatacgcagcgtgct

SEQ ID NO: 4580881 - DNA, 20 bp, Homo sapiens
tcctatatatttctattatt

SEQ ID NO: 4580882 - DNA, 13 bp, Homo sapiens
tcctatccttata

SEQ ID NO: 4580883 - DNA, 15 bp, Homo sapiens
tcctatctagcattt

SEQ ID NO: 4580884 - DNA, 13 bp, Homo sapiens
tcctatctgcagg

SEQ ID NO: 4580885 - DNA, 14 bp, Homo sapiens
tcctatctgtgttt

SEQ ID NO: 4580886 - DNA, 12 bp, Homo sapiens
tcctatgcaata

SEQ ID NO: 4580887 - DNA, 19 bp, Homo sapiens
tcctatgtttttgttcaaa

SEQ ID NO: 4580888 - DNA, 19 bp, Homo sapiens
tcctattactgatgtgtgc

SEQ ID NO: 4580889 - DNA, 12 bp, Homo sapiens
tcctattatatt

SEQ ID NO: 4580890 - DNA, 14 bp, Homo sapiens
tcctatttttgtaa

SEQ ID NO: 4580891 - DNA, 14 bp, Homo sapiens
tcctatttttttaa

SEQ ID NO: 4580892 - DNA, 19 bp, Homo sapiens
tcctcaaagaaagtgtatt

SEQ ID NO: 4580893 - DNA, 17 bp, Homo sapiens
tcctcaaatacatgcac

SEQ ID NO: 4580894 - DNA, 24 bp, Homo sapiens
tcctcaaatcaaaaacaggcaggt

SEQ ID NO: 4580895 - DNA, 21 bp, Homo sapiens
tcctcaaatcagtgataattg

SEQ ID NO: 4580896 - DNA, 17 bp, Homo sapiens
tcctcaacacccaactg

SEQ ID NO: 4580897 - DNA, 22 bp, Homo sapiens
tcctcacacttttggaaccatg

SEQ ID NO: 4580898 - DNA, 20 bp, Homo sapiens
tcctcaccccgtctggggtt

SEQ ID NO: 4580899 - DNA, 14 bp, Homo sapiens
tcctcacccttccc

SEQ ID NO: 4580900 - DNA, 19 bp, Homo sapiens
tcctcacccttcccggccc

SEQ ID NO: 4580901 - DNA, 21 bp, Homo sapiens
tcctcacctcatgcccacccc

SEQ ID NO: 4580902 - DNA, 15 bp, Homo sapiens
tcctcacctctggac

SEQ ID NO: 4580903 - DNA, 16 bp, Homo sapiens
tcctcacctctggact

SEQ ID NO: 4580904 - DNA, 22 bp, Homo sapiens
tcctcacctctggactggctag

SEQ ID NO: 4580905 - DNA, 12 bp, Homo sapiens
tcctcacctggt

SEQ ID NO: 4580906 - DNA, 17 bp, Homo sapiens
tcctcacctgtctaggt

SEQ ID NO: 4580907 - DNA, 16 bp, Homo sapiens
tcctcactcccttcta

SEQ ID NO: 4580908 - DNA, 15 bp, Homo sapiens
tcctcactctgtccc

SEQ ID NO: 4580909 - DNA, 19 bp, Homo sapiens
tcctcactctgtccctgtc

SEQ ID NO: 4580910 - DNA, 22 bp, Homo sapiens
tcctcactctgtccctgtcctt

SEQ ID NO: 4580911 - DNA, 20 bp, Homo sapiens
tcctcagagcgccaggaagc

SEQ ID NO: 4580912 - DNA, 22 bp, Homo sapiens
tcctcagagcgccaggaagcca

SEQ ID NO: 4580913 - DNA, 18 bp, Homo sapiens
tcctcagccgagaaattg

SEQ ID NO: 4580914 - DNA, 20 bp, Homo sapiens
tcctcagccgagaaattggg

SEQ ID NO: 4580915 - DNA, 15 bp, Homo sapiens
tcctcagctgcctcc

SEQ ID NO: 4580916 - DNA, 21 bp, Homo sapiens
tcctcagctgcctcctgcgcc

SEQ ID NO: 4580917 - DNA, 17 bp, Homo sapiens
tcctcaggcacacagct

SEQ ID NO: 4580918 - DNA, 22 bp, Homo sapiens
tcctcaggcacacagctactct

SEQ ID NO: 4580919 - DNA, 16 bp, Homo sapiens
tcctcagggacagaga

SEQ ID NO: 4580920 - DNA, 24 bp, Homo sapiens
tcctcagggacagagacacctgca

SEQ ID NO: 4580921 - DNA, 19 bp, Homo sapiens
tcctcagtgcatttgtgct

SEQ ID NO: 4580922 - DNA, 21 bp, Homo sapiens
tcctcatatggcccagtgtca

SEQ ID NO: 4580923 - DNA, 14 bp, Homo sapiens
tcctcatccctgac

SEQ ID NO: 4580924 - DNA, 18 bp, Homo sapiens
tcctcatctatggttcta

SEQ ID NO: 4580925 - DNA, 20 bp, Homo sapiens
tcctcatctatggttctaaa

SEQ ID NO: 4580926 - DNA, 21 bp, Homo sapiens
tcctcatctatggttctaaat

SEQ ID NO: 4580927 - DNA, 22 bp, Homo sapiens
tcctcattaatagctgccttca

SEQ ID NO: 4580928 - DNA, 23 bp, Homo sapiens
tcctccaaaggaagtctaggagc

SEQ ID NO: 4580929 - DNA, 13 bp, Homo sapiens
tcctccacagaga

SEQ ID NO: 4580930 - DNA, 21 bp, Homo sapiens
tcctccacgttctgctcatca

SEQ ID NO: 4580931 - DNA, 23 bp, Homo sapiens
tcctccacgttctgctcatcatt

SEQ ID NO: 4580932 - DNA, 16 bp, Homo sapiens
tcctccactcgaccca

SEQ ID NO: 4580933 - DNA, 16 bp, Homo sapiens
tcctccagaagcctct

SEQ ID NO: 4580934 - DNA, 18 bp, Homo sapiens
tcctccagaagcctctgg

SEQ ID NO: 4580935 - DNA, 19 bp, Homo sapiens
tcctccaggcctgcctccc

SEQ ID NO: 4580936 - DNA, 21 bp, Homo sapiens
tcctccagggaaggtggccac

SEQ ID NO: 4580937 - DNA, 22 bp, Homo sapiens
tcctccagggaaggtggccaca

SEQ ID NO: 4580938 - DNA, 19 bp, Homo sapiens
tcctccagggccacgtgcc

SEQ ID NO: 4580939 - DNA, 20 bp, Homo sapiens
tcctccagggccacgtgcca

SEQ ID NO: 4580940 - DNA, 23 bp, Homo sapiens
tcctccagggccacgtgccaggc

SEQ ID NO: 4580941 - DNA, 12 bp, Homo sapiens
tcctccatggga

SEQ ID NO: 4580942 - DNA, 14 bp, Homo sapiens
tcctcccagtgaga

SEQ ID NO: 4580943 - DNA, 22 bp, Homo sapiens
tcctcccagtgagactgcccca

SEQ ID NO: 4580944 - DNA, 17 bp, Homo sapiens
tcctcccattgcccagt

SEQ ID NO: 4580945 - DNA, 22 bp, Homo sapiens
tcctcccattgcccagtgagcc

SEQ ID NO: 4580946 - DNA, 15 bp, Homo sapiens
tcctccccagagctg

SEQ ID NO: 4580947 - DNA, 16 bp, Homo sapiens
tcctccccagagctgg

SEQ ID NO: 4580948 - DNA, 15 bp, Homo sapiens
tcctccccctgccag

SEQ ID NO: 4580949 - DNA, 17 bp, Homo sapiens
tcctccccctgccagtg

SEQ ID NO: 4580950 - DNA, 12 bp, Homo sapiens
tcctccccttcc

SEQ ID NO: 4580951 - DNA, 15 bp, Homo sapiens
tcctccccttcctgt

SEQ ID NO: 4580952 - DNA, 16 bp, Homo sapiens
tcctcccgccccgccc

SEQ ID NO: 4580953 - DNA, 19 bp, Homo sapiens
tcctcccgcccttccatgt

SEQ ID NO: 4580954 - DNA, 15 bp, Homo sapiens
tcctccctcagaccc

SEQ ID NO: 4580955 - DNA, 18 bp, Homo sapiens
tcctccctcagacccagg

SEQ ID NO: 4580956 - DNA, 14 bp, Homo sapiens
tcctccctcagact

SEQ ID NO: 4580957 - DNA, 15 bp, Homo sapiens
tcctccctcagactc

SEQ ID NO: 4580958 - DNA, 18 bp, Homo sapiens
tcctccctcagactcaga

SEQ ID NO: 4580959 - DNA, 20 bp, Homo sapiens
tcctccctcagactcagagg

SEQ ID NO: 4580960 - DNA, 14 bp, Homo sapiens
tcctccctcaggcc

SEQ ID NO: 4580961 - DNA, 19 bp, Homo sapiens
tcctccctcatggctctgg

SEQ ID NO: 4580962 - DNA, 17 bp, Homo sapiens
tcctccctccagctgcg

SEQ ID NO: 4580963 - DNA, 17 bp, Homo sapiens
tcctccctgaccctgct

SEQ ID NO: 4580964 - DNA, 20 bp, Homo sapiens
tcctccctgaccctgctcct

SEQ ID NO: 4580965 - DNA, 21 bp, Homo sapiens
tcctccctgaccctgctccta

SEQ ID NO: 4580966 - DNA, 21 bp, Homo sapiens
tcctcccttccttttccctgc

SEQ ID NO: 4580967 - DNA, 18 bp, Homo sapiens
tcctccgtccagccgcca

SEQ ID NO: 4580968 - DNA, 17 bp, Homo sapiens
tcctcctcacccttccc

SEQ ID NO: 4580969 - DNA, 13 bp, Homo sapiens
tcctcctcccctc

SEQ ID NO: 4580970 - DNA, 11 bp, Homo sapiens
tcctcctctgc

SEQ ID NO: 4580971 - DNA, 12 bp, Homo sapiens
tcctcctgcaga

SEQ ID NO: 4580972 - DNA, 14 bp, Homo sapiens
tcctcctgcagaca

SEQ ID NO: 4580973 - DNA, 22 bp, Homo sapiens
tcctcctgcagacacctggact

SEQ ID NO: 4580974 - DNA, 14 bp, Homo sapiens
tcctcctgcctcag

SEQ ID NO: 4580975 - DNA, 17 bp, Homo sapiens
tcctcctgcctcagcct

SEQ ID NO: 4580976 - DNA, 16 bp, Homo sapiens
tcctcctgggccctct

SEQ ID NO: 4580977 - DNA, 18 bp, Homo sapiens
tcctcctgggctccagag

SEQ ID NO: 4580978 - DNA, 15 bp, Homo sapiens
tcctccttcactgtt

SEQ ID NO: 4580979 - DNA, 16 bp, Homo sapiens
tcctccttcactgttt

SEQ ID NO: 4580980 - DNA, 23 bp, Homo sapiens
tcctccttgcccagactacaggg

SEQ ID NO: 4580981 - DNA, 22 bp, Homo sapiens
tcctccttttcttcaccctccc

SEQ ID NO: 4580982 - DNA, 13 bp, Homo sapiens
tcctcgccctggg

SEQ ID NO: 4580983 - DNA, 14 bp, Homo sapiens
tcctcgccctgggt

SEQ ID NO: 4580984 - DNA, 21 bp, Homo sapiens
tcctcggagagcagcagcacc

SEQ ID NO: 4580985 - DNA, 19 bp, Homo sapiens
tcctcggatcaccgagagt

SEQ ID NO: 4580986 - DNA, 16 bp, Homo sapiens
tcctctagaagccaag

SEQ ID NO: 4580987 - DNA, 17 bp, Homo sapiens
tcctctagaagccaagg

SEQ ID NO: 4580988 - DNA, 22 bp, Homo sapiens
tcctctccccctcctccaggga

SEQ ID NO: 4580989 - DNA, 13 bp, Homo sapiens
tcctctccctgcc

SEQ ID NO: 4580990 - DNA, 14 bp, Homo sapiens
tcctctccctgcca

SEQ ID NO: 4580991 - DNA, 14 bp, Homo sapiens
tcctctcctggagg

SEQ ID NO: 4580992 - DNA, 15 bp, Homo sapiens
tcctctcctggagga

SEQ ID NO: 4580993 - DNA, 17 bp, Homo sapiens
tcctctcctttgaaacc

SEQ ID NO: 4580994 - DNA, 17 bp, Homo sapiens
tcctctcgagcccagat

SEQ ID NO: 4580995 - DNA, 22 bp, Homo sapiens
tcctctctctcttcctctttct

SEQ ID NO: 4580996 - DNA, 11 bp, Homo sapiens
tcctctctgct

SEQ ID NO: 4580997 - DNA, 19 bp, Homo sapiens
tcctctctggggctgtgtt

SEQ ID NO: 4580998 - DNA, 23 bp, Homo sapiens
tcctctctggggctgtgttttga

SEQ ID NO: 4580999 - DNA, 15 bp, Homo sapiens
tcctctcttccacag

SEQ ID NO: 4581000 - DNA, 14 bp, Homo sapiens
tcctctgaaacagc

SEQ ID NO: 4581001 - DNA, 17 bp, Homo sapiens
tcctctgactcagggct

SEQ ID NO: 4581002 - DNA, 21 bp, Homo sapiens
tcctctgaggatgatgtactt

SEQ ID NO: 4581003 - DNA, 13 bp, Homo sapiens
tcctctgcagtgc

SEQ ID NO: 4581004 - DNA, 14 bp, Homo sapiens
tcctctgccacctc

SEQ ID NO: 4581005 - DNA, 18 bp, Homo sapiens
tcctctgccacctcccct

SEQ ID NO: 4581006 - DNA, 16 bp, Homo sapiens
tcctctgcccgggagc

SEQ ID NO: 4581007 - DNA, 13 bp, Homo sapiens
tcctctgcctgcc

SEQ ID NO: 4581008 - DNA, 14 bp, Homo sapiens
tcctctgcctgccc

SEQ ID NO: 4581009 - DNA, 20 bp, Homo sapiens
tcctctggacggcaggctca

SEQ ID NO: 4581010 - DNA, 16 bp, Homo sapiens
tcctctggccgcagag

SEQ ID NO: 4581011 - DNA, 19 bp, Homo sapiens
tcctctggccgcagaggtg

SEQ ID NO: 4581012 - DNA, 14 bp, Homo sapiens
tcctctggctttcc

SEQ ID NO: 4581013 - DNA, 21 bp, Homo sapiens
tcctctgggccctgtcgcccc

SEQ ID NO: 4581014 - DNA, 20 bp, Homo sapiens
tcctctgggtttctaagcag

SEQ ID NO: 4581015 - DNA, 13 bp, Homo sapiens
tcctctgtacagc

SEQ ID NO: 4581016 - DNA, 14 bp, Homo sapiens
tcctctgtgaactg

SEQ ID NO: 4581017 - DNA, 11 bp, Homo sapiens
tcctcttccct

SEQ ID NO: 4581018 - DNA, 14 bp, Homo sapiens
tcctcttccctctc

SEQ ID NO: 4581019 - DNA, 23 bp, Homo sapiens
tcctcttctaaaatagcaataac

SEQ ID NO: 4581020 - DNA, 12 bp, Homo sapiens
tcctcttctgct

SEQ ID NO: 4581021 - DNA, 21 bp, Homo sapiens
tcctcttctgctcttttcctg

SEQ ID NO: 4581022 - DNA, 13 bp, Homo sapiens
tcctcttctgggc

SEQ ID NO: 4581023 - DNA, 21 bp, Homo sapiens
tcctcttggtgtcgtttccct

SEQ ID NO: 4581024 - DNA, 18 bp, Homo sapiens
tcctcttttcctggcagc

SEQ ID NO: 4581025 - DNA, 19 bp, Homo sapiens
tcctcttttcctggcagct

SEQ ID NO: 4581026 - DNA, 21 bp, Homo sapiens
tcctcttttcctggcagctgc

SEQ ID NO: 4581027 - DNA, 18 bp, Homo sapiens
tcctgaaagcattatttt

SEQ ID NO: 4581028 - DNA, 19 bp, Homo sapiens
tcctgaacaatattttctc

SEQ ID NO: 4581029 - DNA, 22 bp, Homo sapiens
tcctgaaccatgtggataactt

SEQ ID NO: 4581030 - DNA, 17 bp, Homo sapiens
tcctgaactttctccct

SEQ ID NO: 4581031 - DNA, 21 bp, Homo sapiens
tcctgaactttctccctcatc

SEQ ID NO: 4581032 - DNA, 15 bp, Homo sapiens
tcctgaagctgctgt

SEQ ID NO: 4581033 - DNA, 16 bp, Homo sapiens
tcctgaagctgctgtg

SEQ ID NO: 4581034 - DNA, 19 bp, Homo sapiens
tcctgaagctgctgtgtcc

SEQ ID NO: 4581035 - DNA, 16 bp, Homo sapiens
tcctgaagttgctgct

SEQ ID NO: 4581036 - DNA, 12 bp, Homo sapiens
tcctgaatattt

SEQ ID NO: 4581037 - DNA, 16 bp, Homo sapiens
tcctgaatattttttg

SEQ ID NO: 4581038 - DNA, 14 bp, Homo sapiens
tcctgaatctgtgc

SEQ ID NO: 4581039 - DNA, 15 bp, Homo sapiens
tcctgaattctattt

SEQ ID NO: 4581040 - DNA, 19 bp, Homo sapiens
tcctgacactcaataaaca

SEQ ID NO: 4581041 - DNA, 21 bp, Homo sapiens
tcctgacactcaataaacagt

SEQ ID NO: 4581042 - DNA, 22 bp, Homo sapiens
tcctgacactcaataaacagtc

SEQ ID NO: 4581043 - DNA, 13 bp, Homo sapiens
tcctgacacttta

SEQ ID NO: 4581044 - DNA, 23 bp, Homo sapiens
tcctgacagatgcctggtgagca

SEQ ID NO: 4581045 - DNA, 18 bp, Homo sapiens
tcctgacccccatgtaaa

SEQ ID NO: 4581046 - DNA, 15 bp, Homo sapiens
tcctgacccctgcct

SEQ ID NO: 4581047 - DNA, 16 bp, Homo sapiens
tcctgactctgccccc

SEQ ID NO: 4581048 - DNA, 24 bp, Homo sapiens
tcctgagaaaaaaggttccgcttg

SEQ ID NO: 4581049 - DNA, 16 bp, Homo sapiens
tcctgagacccctggc

SEQ ID NO: 4581050 - DNA, 19 bp, Homo sapiens
tcctgagacccctggcctc

SEQ ID NO: 4581051 - DNA, 16 bp, Homo sapiens
tcctgaggcctccaag

SEQ ID NO: 4581052 - DNA, 17 bp, Homo sapiens
tcctgaggctttggatt

SEQ ID NO: 4581053 - DNA, 20 bp, Homo sapiens
tcctgaggggcatctgcccc

SEQ ID NO: 4581054 - DNA, 21 bp, Homo sapiens
tcctgataaaacaacagctcg

SEQ ID NO: 4581055 - DNA, 20 bp, Homo sapiens
tcctgcaaaaggaggtgaaa

SEQ ID NO: 4581056 - DNA, 14 bp, Homo sapiens
tcctgcaaatttag

SEQ ID NO: 4581057 - DNA, 22 bp, Homo sapiens
tcctgcaaatttagtttgttaa

SEQ ID NO: 4581058 - DNA, 15 bp, Homo sapiens
tcctgcaccccagca

SEQ ID NO: 4581059 - DNA, 20 bp, Homo sapiens
tcctgcagggagccttctgc

SEQ ID NO: 4581060 - DNA, 21 bp, Homo sapiens
tcctgcagggagccttctgcc

SEQ ID NO: 4581061 - DNA, 19 bp, Homo sapiens
tcctgcagggcttctcctc

SEQ ID NO: 4581062 - DNA, 14 bp, Homo sapiens
tcctgcatctctgt

SEQ ID NO: 4581063 - DNA, 16 bp, Homo sapiens
tcctgcatctctgtga

SEQ ID NO: 4581064 - DNA, 22 bp, Homo sapiens
tcctgccagctggatcgctgca

SEQ ID NO: 4581065 - DNA, 13 bp, Homo sapiens
tcctgccaggcac

SEQ ID NO: 4581066 - DNA, 13 bp, Homo sapiens
tcctgccaggccg

SEQ ID NO: 4581067 - DNA, 23 bp, Homo sapiens
tcctgcccaaacagctgtattta

SEQ ID NO: 4581068 - DNA, 12 bp, Homo sapiens
tcctgcccagga

SEQ ID NO: 4581069 - DNA, 16 bp, Homo sapiens
tcctgcccaggagagc

SEQ ID NO: 4581070 - DNA, 23 bp, Homo sapiens
tcctgcccaggagagccagccct

SEQ ID NO: 4581071 - DNA, 13 bp, Homo sapiens
tcctgcccaggcc

SEQ ID NO: 4581072 - DNA, 14 bp, Homo sapiens
tcctgcccaggcca

SEQ ID NO: 4581073 - DNA, 19 bp, Homo sapiens
tcctgcccaggccacagag

SEQ ID NO: 4581074 - DNA, 17 bp, Homo sapiens
tcctgcccatgtgtccc

SEQ ID NO: 4581075 - DNA, 19 bp, Homo sapiens
tcctgcccatgtgtcccct

SEQ ID NO: 4581076 - DNA, 18 bp, Homo sapiens
tcctgcccctgagcccat

SEQ ID NO: 4581077 - DNA, 16 bp, Homo sapiens
tcctgccctggaggaa

SEQ ID NO: 4581078 - DNA, 23 bp, Homo sapiens
tcctgccctgtcaagcttctctg

SEQ ID NO: 4581079 - DNA, 15 bp, Homo sapiens
tcctgcccttccctc

SEQ ID NO: 4581080 - DNA, 22 bp, Homo sapiens
tcctgcccttccctctgggcac

SEQ ID NO: 4581081 - DNA, 17 bp, Homo sapiens
tcctgcctcagcctccc

SEQ ID NO: 4581082 - DNA, 18 bp, Homo sapiens
tcctgcctcagtctgctt

SEQ ID NO: 4581083 - DNA, 14 bp, Homo sapiens
tcctgcctggccag

SEQ ID NO: 4581084 - DNA, 23 bp, Homo sapiens
tcctgccttcctcctgggccctc

SEQ ID NO: 4581085 - DNA, 23 bp, Homo sapiens
tcctgcgggcttttccccggtcc

SEQ ID NO: 4581086 - DNA, 21 bp, Homo sapiens
tcctgcgggttttaatttatt

SEQ ID NO: 4581087 - DNA, 21 bp, Homo sapiens
tcctgcgtcccagcctgcacc

SEQ ID NO: 4581088 - DNA, 16 bp, Homo sapiens
tcctgcgtcctcctca

SEQ ID NO: 4581089 - DNA, 21 bp, Homo sapiens
tcctgcgtcctcctcacctca

SEQ ID NO: 4581090 - DNA, 15 bp, Homo sapiens
tcctgctcatattgt

SEQ ID NO: 4581091 - DNA, 14 bp, Homo sapiens
tcctgctcttttgt

SEQ ID NO: 4581092 - DNA, 17 bp, Homo sapiens
tcctgctcttttgtgat

SEQ ID NO: 4581093 - DNA, 22 bp, Homo sapiens
tcctgctgaaagtcctgctttc

SEQ ID NO: 4581094 - DNA, 11 bp, Homo sapiens
tcctgctgcct

SEQ ID NO: 4581095 - DNA, 12 bp, Homo sapiens
tcctgctgctgc

SEQ ID NO: 4581096 - DNA, 17 bp, Homo sapiens
tcctgctgctgctactg

SEQ ID NO: 4581097 - DNA, 19 bp, Homo sapiens
tcctgctgctttgggctgg

SEQ ID NO: 4581098 - DNA, 19 bp, Homo sapiens
tcctgcttaaacttgaccc

SEQ ID NO: 4581099 - DNA, 21 bp, Homo sapiens
tcctggaagctgtgtccttgc

SEQ ID NO: 4581100 - DNA, 15 bp, Homo sapiens
tcctggaaggacaca

SEQ ID NO: 4581101 - DNA, 15 bp, Homo sapiens
tcctggacatcacca

SEQ ID NO: 4581102 - DNA, 14 bp, Homo sapiens
tcctggaccaggcc

SEQ ID NO: 4581103 - DNA, 20 bp, Homo sapiens
tcctggactgagggggcctg

SEQ ID NO: 4581104 - DNA, 22 bp, Homo sapiens
tcctggcacattgcccctctgc

SEQ ID NO: 4581105 - DNA, 15 bp, Homo sapiens
tcctggcagctgctg

SEQ ID NO: 4581106 - DNA, 16 bp, Homo sapiens
tcctggcagctgctgt

SEQ ID NO: 4581107 - DNA, 22 bp, Homo sapiens
tcctggcccagggcatctggga

SEQ ID NO: 4581108 - DNA, 16 bp, Homo sapiens
tcctggccctccactc

SEQ ID NO: 4581109 - DNA, 18 bp, Homo sapiens
tcctggcctcatacagaa

SEQ ID NO: 4581110 - DNA, 15 bp, Homo sapiens
tcctggccttctgaa

SEQ ID NO: 4581111 - DNA, 16 bp, Homo sapiens
tcctggctcctgaggg

SEQ ID NO: 4581112 - DNA, 22 bp, Homo sapiens
tcctggctgtcctaccatcagc

SEQ ID NO: 4581113 - DNA, 21 bp, Homo sapiens
tcctggctgtgaatgccaaag

SEQ ID NO: 4581114 - DNA, 20 bp, Homo sapiens
tcctgggaaatattccctag

SEQ ID NO: 4581115 - DNA, 21 bp, Homo sapiens
tcctgggaaatattccctaga

SEQ ID NO: 4581116 - DNA, 19 bp, Homo sapiens
tcctgggaggacaggcagg

SEQ ID NO: 4581117 - DNA, 20 bp, Homo sapiens
tcctgggaggacaggcaggc

SEQ ID NO: 4581118 - DNA, 23 bp, Homo sapiens
tcctgggcacccttaatcttcag

SEQ ID NO: 4581119 - DNA, 14 bp, Homo sapiens
tcctgggcccctcc

SEQ ID NO: 4581120 - DNA, 17 bp, Homo sapiens
tcctgggcccctcccta

SEQ ID NO: 4581121 - DNA, 23 bp, Homo sapiens
tcctgggccctctctgctctgcg

SEQ ID NO: 4581122 - DNA, 12 bp, Homo sapiens
tcctgggccctg

SEQ ID NO: 4581123 - DNA, 15 bp, Homo sapiens
tcctgggccctgggc

SEQ ID NO: 4581124 - DNA, 19 bp, Homo sapiens
tcctgggccctgggctggc

SEQ ID NO: 4581125 - DNA, 13 bp, Homo sapiens
tcctgggcctttg

SEQ ID NO: 4581126 - DNA, 17 bp, Homo sapiens
tcctggggagctcctgg

SEQ ID NO: 4581127 - DNA, 18 bp, Homo sapiens
tcctgggggtggcaggca

SEQ ID NO: 4581128 - DNA, 23 bp, Homo sapiens
tcctgggttttgtattctctgag

SEQ ID NO: 4581129 - DNA, 13 bp, Homo sapiens
tcctggtgctgcc

SEQ ID NO: 4581130 - DNA, 16 bp, Homo sapiens
tcctggtgctgccgag

SEQ ID NO: 4581131 - DNA, 22 bp, Homo sapiens
tcctggtgctgccgagggctgg

SEQ ID NO: 4581132 - DNA, 19 bp, Homo sapiens
tcctggtgggtccaggggc

SEQ ID NO: 4581133 - DNA, 19 bp, Homo sapiens
tcctgtaactgttacagta

SEQ ID NO: 4581134 - DNA, 24 bp, Homo sapiens
tcctgtaagaagcggcatagcacc

SEQ ID NO: 4581135 - DNA, 12 bp, Homo sapiens
tcctgtaatata

SEQ ID NO: 4581136 - DNA, 17 bp, Homo sapiens
tcctgtacctcagtgga

SEQ ID NO: 4581137 - DNA, 20 bp, Homo sapiens
tcctgtacctcagtggatct

SEQ ID NO: 4581138 - DNA, 16 bp, Homo sapiens
tcctgtagctctccct

SEQ ID NO: 4581139 - DNA, 14 bp, Homo sapiens
tcctgtcagtgagg

SEQ ID NO: 4581140 - DNA, 20 bp, Homo sapiens
tcctgtcagtgtcaccttgg

SEQ ID NO: 4581141 - DNA, 19 bp, Homo sapiens
tcctgtccacacccagctc

SEQ ID NO: 4581142 - DNA, 22 bp, Homo sapiens
tcctgtccacacccagctcagc

SEQ ID NO: 4581143 - DNA, 14 bp, Homo sapiens
tcctgtccctgagg

SEQ ID NO: 4581144 - DNA, 10 bp, Homo sapiens
tcctgtcctc

SEQ ID NO: 4581145 - DNA, 17 bp, Homo sapiens
tcctgtcctccctcacc

SEQ ID NO: 4581146 - DNA, 23 bp, Homo sapiens
tcctgtctccctcctctgcccgg

SEQ ID NO: 4581147 - DNA, 14 bp, Homo sapiens
tcctgtctctgcct

SEQ ID NO: 4581148 - DNA, 24 bp, Homo sapiens
tcctgtgccctagatgcacgtggg

SEQ ID NO: 4581149 - DNA, 16 bp, Homo sapiens
tcctgtgcctggcccc

SEQ ID NO: 4581150 - DNA, 15 bp, Homo sapiens
tcctgtgcctttcct

SEQ ID NO: 4581151 - DNA, 13 bp, Homo sapiens
tcctgtgctctgg

SEQ ID NO: 4581152 - DNA, 19 bp, Homo sapiens
tcctgtgctctggaggctg

SEQ ID NO: 4581153 - DNA, 22 bp, Homo sapiens
tcctgtggaaggcagagaaatc

SEQ ID NO: 4581154 - DNA, 19 bp, Homo sapiens
tcctgtggcctgctcatca

SEQ ID NO: 4581155 - DNA, 23 bp, Homo sapiens
tcctgtgggtgttctttcctgcc

SEQ ID NO: 4581156 - DNA, 18 bp, Homo sapiens
tcctgtgtaacatctgcc

SEQ ID NO: 4581157 - DNA, 13 bp, Homo sapiens
tcctgtgtactgt

SEQ ID NO: 4581158 - DNA, 17 bp, Homo sapiens
tcctgtgtactgtgtca

SEQ ID NO: 4581159 - DNA, 23 bp, Homo sapiens
tcctgtgtattaaacctttccat

SEQ ID NO: 4581160 - DNA, 19 bp, Homo sapiens
tcctgtgtgaccctgggca

SEQ ID NO: 4581161 - DNA, 16 bp, Homo sapiens
tcctgttacttgcttc

SEQ ID NO: 4581162 - DNA, 17 bp, Homo sapiens
tcctgttacttgcttca

SEQ ID NO: 4581163 - DNA, 13 bp, Homo sapiens
tcctgttgcaccc

SEQ ID NO: 4581164 - DNA, 16 bp, Homo sapiens
tcctgttgcacccagc

SEQ ID NO: 4581165 - DNA, 21 bp, Homo sapiens
tcctgttgcacccagccctgg

SEQ ID NO: 4581166 - DNA, 15 bp, Homo sapiens
tcctgttggtttcat

SEQ ID NO: 4581167 - DNA, 18 bp, Homo sapiens
tcctgttttacagctgcc

SEQ ID NO: 4581168 - DNA, 14 bp, Homo sapiens
tcctgttttatata

SEQ ID NO: 4581169 - DNA, 17 bp, Homo sapiens
tcctgttttgcacagcc

SEQ ID NO: 4581170 - DNA, 21 bp, Homo sapiens
tcctgttttgcacagccaaat

SEQ ID NO: 4581171 - DNA, 18 bp, Homo sapiens
tccttaatttaattgctt

SEQ ID NO: 4581172 - DNA, 15 bp, Homo sapiens
tccttacctttttat

SEQ ID NO: 4581173 - DNA, 20 bp, Homo sapiens
tccttacctttttatttgca

SEQ ID NO: 4581174 - DNA, 11 bp, Homo sapiens
tccttactgtg

SEQ ID NO: 4581175 - DNA, 12 bp, Homo sapiens
tccttactgtgc

SEQ ID NO: 4581176 - DNA, 13 bp, Homo sapiens
tccttagacactt

SEQ ID NO: 4581177 - DNA, 22 bp, Homo sapiens
tccttagacactttggaatcta

SEQ ID NO: 4581178 - DNA, 18 bp, Homo sapiens
tccttagactcttttcct

SEQ ID NO: 4581179 - DNA, 18 bp, Homo sapiens
tccttatagacacttgct

SEQ ID NO: 4581180 - DNA, 18 bp, Homo sapiens
tccttatccctctcttcc

SEQ ID NO: 4581181 - DNA, 21 bp, Homo sapiens
tccttatgtatcagtgtcctt

SEQ ID NO: 4581182 - DNA, 16 bp, Homo sapiens
tccttatgtcctgtca

SEQ ID NO: 4581183 - DNA, 13 bp, Homo sapiens
tccttattgttca

SEQ ID NO: 4581184 - DNA, 16 bp, Homo sapiens
tccttatttgccttct

SEQ ID NO: 4581185 - DNA, 18 bp, Homo sapiens
tccttcaacaattctaaa

SEQ ID NO: 4581186 - DNA, 12 bp, Homo sapiens
tccttcactgtt

SEQ ID NO: 4581187 - DNA, 13 bp, Homo sapiens
tccttcagccctc

SEQ ID NO: 4581188 - DNA, 20 bp, Homo sapiens
tccttcagctgactccagta

SEQ ID NO: 4581189 - DNA, 20 bp, Homo sapiens
tccttcaggactctgcggga

SEQ ID NO: 4581190 - DNA, 20 bp, Homo sapiens
tccttcagtgagcccctccc

SEQ ID NO: 4581191 - DNA, 21 bp, Homo sapiens
tccttcagtgagcccctcccc

SEQ ID NO: 4581192 - DNA, 23 bp, Homo sapiens
tccttcagtgagcccctccccag

SEQ ID NO: 4581193 - DNA, 18 bp, Homo sapiens
tccttcatcgaatgctaa

SEQ ID NO: 4581194 - DNA, 18 bp, Homo sapiens
tccttcatttccaccagg

SEQ ID NO: 4581195 - DNA, 21 bp, Homo sapiens
tccttcatttccaccaggccg

SEQ ID NO: 4581196 - DNA, 19 bp, Homo sapiens
tccttccagggctcttcca

SEQ ID NO: 4581197 - DNA, 13 bp, Homo sapiens
tccttccagtggc

SEQ ID NO: 4581198 - DNA, 16 bp, Homo sapiens
tccttccatccctacc

SEQ ID NO: 4581199 - DNA, 14 bp, Homo sapiens
tccttccatctctt

SEQ ID NO: 4581200 - DNA, 20 bp, Homo sapiens
tccttccatctcttccttca

SEQ ID NO: 4581201 - DNA, 12 bp, Homo sapiens
tccttccccaga

SEQ ID NO: 4581202 - DNA, 18 bp, Homo sapiens
tccttccccagacccaga

SEQ ID NO: 4581203 - DNA, 17 bp, Homo sapiens
tccttccctctctgatg

SEQ ID NO: 4581204 - DNA, 19 bp, Homo sapiens
tccttccctctctgatgtc

SEQ ID NO: 4581205 - DNA, 12 bp, Homo sapiens
tccttccctggc

SEQ ID NO: 4581206 - DNA, 15 bp, Homo sapiens
tccttccctggcttg

SEQ ID NO: 4581207 - DNA, 21 bp, Homo sapiens
tccttccctgttctccctttc

SEQ ID NO: 4581208 - DNA, 16 bp, Homo sapiens
tccttcccttttctgt

SEQ ID NO: 4581209 - DNA, 16 bp, Homo sapiens
tccttcctgtgccctg

SEQ ID NO: 4581210 - DNA, 16 bp, Homo sapiens
tccttccttcaggact

SEQ ID NO: 4581211 - DNA, 17 bp, Homo sapiens
tccttccttcaggactc

SEQ ID NO: 4581212 - DNA, 14 bp, Homo sapiens
tccttccttccctg

SEQ ID NO: 4581213 - DNA, 16 bp, Homo sapiens
tccttcctttttattc

SEQ ID NO: 4581214 - DNA, 20 bp, Homo sapiens
tccttcgtccccagttgccg

SEQ ID NO: 4581215 - DNA, 13 bp, Homo sapiens
tccttctggttct

SEQ ID NO: 4581216 - DNA, 16 bp, Homo sapiens
tccttctgtagtgtat

SEQ ID NO: 4581217 - DNA, 21 bp, Homo sapiens
tccttctttattgccccttct

SEQ ID NO: 4581218 - DNA, 15 bp, Homo sapiens
tccttctttgggata

SEQ ID NO: 4581219 - DNA, 22 bp, Homo sapiens
tccttgaacaagatgtgggcct

SEQ ID NO: 4581220 - DNA, 23 bp, Homo sapiens
tccttgcacgcgccctttctacc

SEQ ID NO: 4581221 - DNA, 15 bp, Homo sapiens
tccttgcatcaattt

SEQ ID NO: 4581222 - DNA, 17 bp, Homo sapiens
tccttgcatcaattttt

SEQ ID NO: 4581223 - DNA, 17 bp, Homo sapiens
tccttgcgcctcagccc

SEQ ID NO: 4581224 - DNA, 19 bp, Homo sapiens
tccttgcgcctcagccctc

SEQ ID NO: 4581225 - DNA, 15 bp, Homo sapiens
tccttggaaggtctt

SEQ ID NO: 4581226 - DNA, 16 bp, Homo sapiens
tccttggaaggtcttt

SEQ ID NO: 4581227 - DNA, 16 bp, Homo sapiens
tccttggagtcccagg

SEQ ID NO: 4581228 - DNA, 19 bp, Homo sapiens
tccttggagtcccaggggc

SEQ ID NO: 4581229 - DNA, 22 bp, Homo sapiens
tccttggatcctgaatctgtgc

SEQ ID NO: 4581230 - DNA, 17 bp, Homo sapiens
tccttggcacccccatg

SEQ ID NO: 4581231 - DNA, 14 bp, Homo sapiens
tccttggcagccgg

SEQ ID NO: 4581232 - DNA, 22 bp, Homo sapiens
tccttggctttcagagccagcc

SEQ ID NO: 4581233 - DNA, 16 bp, Homo sapiens
tccttggtgcctctgg

SEQ ID NO: 4581234 - DNA, 12 bp, Homo sapiens
tccttgtaatac

SEQ ID NO: 4581235 - DNA, 16 bp, Homo sapiens
tccttgtaatacctga

SEQ ID NO: 4581236 - DNA, 21 bp, Homo sapiens
tccttgtcaacaaagtgcttt

SEQ ID NO: 4581237 - DNA, 15 bp, Homo sapiens
tccttgtccacccac

SEQ ID NO: 4581238 - DNA, 19 bp, Homo sapiens
tccttgtgagagtggcttt

SEQ ID NO: 4581239 - DNA, 13 bp, Homo sapiens
tcctttaattgta

SEQ ID NO: 4581240 - DNA, 19 bp, Homo sapiens
tcctttagggttctgcctc

SEQ ID NO: 4581241 - DNA, 18 bp, Homo sapiens
tcctttatacagttgtat

SEQ ID NO: 4581242 - DNA, 14 bp, Homo sapiens
tcctttatgtgaat

SEQ ID NO: 4581243 - DNA, 15 bp, Homo sapiens
tcctttatgtgaatt

SEQ ID NO: 4581244 - DNA, 23 bp, Homo sapiens
tcctttcagccacatgccccagg

SEQ ID NO: 4581245 - DNA, 19 bp, Homo sapiens
tcctttccaatagaaagaa

SEQ ID NO: 4581246 - DNA, 21 bp, Homo sapiens
tcctttccaatagaaagaaac

SEQ ID NO: 4581247 - DNA, 23 bp, Homo sapiens
tcctttccaatagaaagaaacta

SEQ ID NO: 4581248 - DNA, 18 bp, Homo sapiens
tcctttccaggggccaat

SEQ ID NO: 4581249 - DNA, 12 bp, Homo sapiens
tcctttctcaga

SEQ ID NO: 4581250 - DNA, 15 bp, Homo sapiens
tcctttctcctgtga

SEQ ID NO: 4581251 - DNA, 19 bp, Homo sapiens
tcctttctggaagtttctg

SEQ ID NO: 4581252 - DNA, 19 bp, Homo sapiens
tcctttgcaatagcagtta

SEQ ID NO: 4581253 - DNA, 17 bp, Homo sapiens
tcctttgtgcttagtta

SEQ ID NO: 4581254 - DNA, 14 bp, Homo sapiens
tccttttcctatcc

SEQ ID NO: 4581255 - DNA, 19 bp, Homo sapiens
tccttttccttatttgcct

SEQ ID NO: 4581256 - DNA, 12 bp, Homo sapiens
tccttttctccc

SEQ ID NO: 4581257 - DNA, 13 bp, Homo sapiens
tccttttctccca

SEQ ID NO: 4581258 - DNA, 20 bp, Homo sapiens
tccttttgacactgctctaa

SEQ ID NO: 4581259 - DNA, 13 bp, Homo sapiens
tccttttggcctg

SEQ ID NO: 4581260 - DNA, 14 bp, Homo sapiens
tccttttggcctgg

SEQ ID NO: 4581261 - DNA, 17 bp, Homo sapiens
tccttttggcctggggg

SEQ ID NO: 4581262 - DNA, 21 bp, Homo sapiens
tcctttttccaatgttttatt

SEQ ID NO: 4581263 - DNA, 18 bp, Homo sapiens
tcctttttctttttttaa

SEQ ID NO: 4581264 - DNA, 14 bp, Homo sapiens
tcctttttgacact

SEQ ID NO: 4581265 - DNA, 16 bp, Homo sapiens
tcctttttgacactga

SEQ ID NO: 4581266 - DNA, 18 bp, Homo sapiens
tccttttttcaatatgca

SEQ ID NO: 4581267 - DNA, 19 bp, Homo sapiens
tccttttttcaatatgcaa

SEQ ID NO: 4581268 - DNA, 13 bp, Homo sapiens
tcgaaacacagaa

SEQ ID NO: 4581269 - DNA, 21 bp, Homo sapiens
tcgaaatagatatcctctccc

SEQ ID NO: 4581270 - DNA, 19 bp, Homo sapiens
tcgaaatttgttgtttgtt

SEQ ID NO: 4581271 - DNA, 15 bp, Homo sapiens
tcgaaccgttttgaa

SEQ ID NO: 4581272 - DNA, 18 bp, Homo sapiens
tcgaaccgttttgaagct

SEQ ID NO: 4581273 - DNA, 21 bp, Homo sapiens
tcgaactcttctttgctgcat

SEQ ID NO: 4581274 - DNA, 12 bp, Homo sapiens
tcgaatctctgc

SEQ ID NO: 4581275 - DNA, 15 bp, Homo sapiens
tcgacagggcctgga

SEQ ID NO: 4581276 - DNA, 14 bp, Homo sapiens
tcgacccagaatgg

SEQ ID NO: 4581277 - DNA, 19 bp, Homo sapiens
tcgacccagaatggagcct

SEQ ID NO: 4581278 - DNA, 21 bp, Homo sapiens
tcgagaaagaggcaccaggaa

SEQ ID NO: 4581279 - DNA, 14 bp, Homo sapiens
tcgagaactttcat

SEQ ID NO: 4581280 - DNA, 15 bp, Homo sapiens
tcgagaactttcatt

SEQ ID NO: 4581281 - DNA, 16 bp, Homo sapiens
tcgagaactttcattt

SEQ ID NO: 4581282 - DNA, 22 bp, Homo sapiens
tcgagaactttcatttttttcc

SEQ ID NO: 4581283 - DNA, 15 bp, Homo sapiens
tcgaggacaggaaag

SEQ ID NO: 4581284 - DNA, 21 bp, Homo sapiens
tcgaggacaggaaaggcccca

SEQ ID NO: 4581285 - DNA, 23 bp, Homo sapiens
tcgaggcctgcaaaccttcctgg

SEQ ID NO: 4581286 - DNA, 14 bp, Homo sapiens
tcgagtactgtggg

SEQ ID NO: 4581287 - DNA, 17 bp, Homo sapiens
tcgagtactgtgggcaa

SEQ ID NO: 4581288 - DNA, 23 bp, Homo sapiens
tcgagtactgtgggcaatttaga

SEQ ID NO: 4581289 - DNA, 23 bp, Homo sapiens
tcgatacctggagcagaggaggg

SEQ ID NO: 4581290 - DNA, 14 bp, Homo sapiens
tcgatggacctcag

SEQ ID NO: 4581291 - DNA, 17 bp, Homo sapiens
tcgatggacctcagcaa

SEQ ID NO: 4581292 - DNA, 23 bp, Homo sapiens
tcgatggacctcagcaagctgcc

SEQ ID NO: 4581293 - DNA, 14 bp, Homo sapiens
tcgcacacacccat

SEQ ID NO: 4581294 - DNA, 21 bp, Homo sapiens
tcgcaccactgcactccagcc

SEQ ID NO: 4581295 - DNA, 14 bp, Homo sapiens
tcgcagaccagagc

SEQ ID NO: 4581296 - DNA, 21 bp, Homo sapiens
tcgcagaccagagctgtctga

SEQ ID NO: 4581297 - DNA, 20 bp, Homo sapiens
tcgcatggtcacacactgat

SEQ ID NO: 4581298 - DNA, 18 bp, Homo sapiens
tcgccacctttcaccctc

SEQ ID NO: 4581299 - DNA, 19 bp, Homo sapiens
tcgccacctttcaccctca

SEQ ID NO: 4581300 - DNA, 23 bp, Homo sapiens
tcgcccacaagccttactcacct

SEQ ID NO: 4581301 - DNA, 13 bp, Homo sapiens
tcgcccagcagga

SEQ ID NO: 4581302 - DNA, 19 bp, Homo sapiens
tcgcccaggctggagtgca

SEQ ID NO: 4581303 - DNA, 13 bp, Homo sapiens
tcgccccatccct

SEQ ID NO: 4581304 - DNA, 23 bp, Homo sapiens
tcgcccctccttttggcctgggg

SEQ ID NO: 4581305 - DNA, 22 bp, Homo sapiens
tcgccccttccctctctccctg

SEQ ID NO: 4581306 - DNA, 16 bp, Homo sapiens
tcgccggatctgaggg

SEQ ID NO: 4581307 - DNA, 16 bp, Homo sapiens
tcgccgtgtctcagcc

SEQ ID NO: 4581308 - DNA, 23 bp, Homo sapiens
tcgccgtgtctcagcctctgcca

SEQ ID NO: 4581309 - DNA, 13 bp, Homo sapiens
tcgcctgcctgca

SEQ ID NO: 4581310 - DNA, 16 bp, Homo sapiens
tcgcctgcctgcagca

SEQ ID NO: 4581311 - DNA, 12 bp, Homo sapiens
tcgcctgtaatc

SEQ ID NO: 4581312 - DNA, 18 bp, Homo sapiens
tcgcctgtaatgccagcg

SEQ ID NO: 4581313 - DNA, 19 bp, Homo sapiens
tcgcggcaggttctctttg

SEQ ID NO: 4581314 - DNA, 24 bp, Homo sapiens
tcgctaagggcttgtttttcttca

SEQ ID NO: 4581315 - DNA, 13 bp, Homo sapiens
tcgctcagtctgt

SEQ ID NO: 4581316 - DNA, 18 bp, Homo sapiens
tcgctcagtctgttcact

SEQ ID NO: 4581317 - DNA, 16 bp, Homo sapiens
tcgctccctgtagctc

SEQ ID NO: 4581318 - DNA, 19 bp, Homo sapiens
tcgctccctgtagctctgc

SEQ ID NO: 4581319 - DNA, 23 bp, Homo sapiens
tcgctccctgtagctctgcctcc

SEQ ID NO: 4581320 - DNA, 13 bp, Homo sapiens
tcgctctgtcacc

SEQ ID NO: 4581321 - DNA, 18 bp, Homo sapiens
tcgctgcacatggcctga

SEQ ID NO: 4581322 - DNA, 20 bp, Homo sapiens
tcgctgcacatggcctgagc

SEQ ID NO: 4581323 - DNA, 20 bp, Homo sapiens
tcgctgccagctctgtatca

SEQ ID NO: 4581324 - DNA, 16 bp, Homo sapiens
tcgctgcgcagcctcc

SEQ ID NO: 4581325 - DNA, 17 bp, Homo sapiens
tcgctgcgcagcctcca

SEQ ID NO: 4581326 - DNA, 15 bp, Homo sapiens
tcgctggactattgt

SEQ ID NO: 4581327 - DNA, 20 bp, Homo sapiens
tcgctggactctcagtctct

SEQ ID NO: 4581328 - DNA, 20 bp, Homo sapiens
tcgctgtgattttaagacaa

SEQ ID NO: 4581329 - DNA, 23 bp, Homo sapiens
tcgcttatttagcccgagatctg

SEQ ID NO: 4581330 - DNA, 18 bp, Homo sapiens
tcgcttgctggaacacag

SEQ ID NO: 4581331 - DNA, 19 bp, Homo sapiens
tcgcttgctggaacacagg

SEQ ID NO: 4581332 - DNA, 13 bp, Homo sapiens
tcgcttgcttctg

SEQ ID NO: 4581333 - DNA, 16 bp, Homo sapiens
tcgcttgcttctgcag

SEQ ID NO: 4581334 - DNA, 19 bp, Homo sapiens
tcgcttgcttctgcagcaa

SEQ ID NO: 4581335 - DNA, 19 bp, Homo sapiens
tcggaaaaataatcaaaag

SEQ ID NO: 4581336 - DNA, 21 bp, Homo sapiens
tcggacaagacccccagcact

SEQ ID NO: 4581337 - DNA, 11 bp, Homo sapiens
tcggacacagt

SEQ ID NO: 4581338 - DNA, 17 bp, Homo sapiens
tcggacagagcccccct

SEQ ID NO: 4581339 - DNA, 17 bp, Homo sapiens
tcggacccaccccaact

SEQ ID NO: 4581340 - DNA, 19 bp, Homo sapiens
tcggactaagcctacctgc

SEQ ID NO: 4581341 - DNA, 14 bp, Homo sapiens
tcggactgccaaat

SEQ ID NO: 4581342 - DNA, 20 bp, Homo sapiens
tcggactgcccccagaaagc

SEQ ID NO: 4581343 - DNA, 13 bp, Homo sapiens
tcggagagcagca

SEQ ID NO: 4581344 - DNA, 14 bp, Homo sapiens
tcggagagcagcag

SEQ ID NO: 4581345 - DNA, 22 bp, Homo sapiens
tcggaggctacccgctgtggcc

SEQ ID NO: 4581346 - DNA, 14 bp, Homo sapiens
tcggaggctgggcc

SEQ ID NO: 4581347 - DNA, 18 bp, Homo sapiens
tcggaggctgggcccctg

SEQ ID NO: 4581348 - DNA, 17 bp, Homo sapiens
tcggaggtgctgtcccc

SEQ ID NO: 4581349 - DNA, 14 bp, Homo sapiens
tcggagtgaatgtg

SEQ ID NO: 4581350 - DNA, 18 bp, Homo sapiens
tcggatctcacaggctga

SEQ ID NO: 4581351 - DNA, 19 bp, Homo sapiens
tcggatgacaccctggcct

SEQ ID NO: 4581352 - DNA, 17 bp, Homo sapiens
tcggattttttccaaaa

SEQ ID NO: 4581353 - DNA, 21 bp, Homo sapiens
tcggcaccttcccctgaggac

SEQ ID NO: 4581354 - DNA, 18 bp, Homo sapiens
tcggcatagtccccagag

SEQ ID NO: 4581355 - DNA, 19 bp, Homo sapiens
tcggcatagtccccagagc

SEQ ID NO: 4581356 - DNA, 23 bp, Homo sapiens
tcggcatagtccccagagctccc

SEQ ID NO: 4581357 - DNA, 13 bp, Homo sapiens
tcggccacaggca

SEQ ID NO: 4581358 - DNA, 15 bp, Homo sapiens
tcggccacaggcagg

SEQ ID NO: 4581359 - DNA, 19 bp, Homo sapiens
tcggccaggcattggctca

SEQ ID NO: 4581360 - DNA, 19 bp, Homo sapiens
tcggcccacagctcccacc

SEQ ID NO: 4581361 - DNA, 15 bp, Homo sapiens
tcggcccctgtctgt

SEQ ID NO: 4581362 - DNA, 19 bp, Homo sapiens
tcggcctcccaaagtgctg

SEQ ID NO: 4581363 - DNA, 22 bp, Homo sapiens
tcggcctctaaccccaggcccc

SEQ ID NO: 4581364 - DNA, 23 bp, Homo sapiens
tcggcctctaaccccaggccccg

SEQ ID NO: 4581365 - DNA, 14 bp, Homo sapiens
tcggctcacaaatt

SEQ ID NO: 4581366 - DNA, 17 bp, Homo sapiens
tcggctgttcctcccct

SEQ ID NO: 4581367 - DNA, 21 bp, Homo sapiens
tcgggaaaaggtagaggagtc

SEQ ID NO: 4581368 - DNA, 14 bp, Homo sapiens
tcgggaattttccc

SEQ ID NO: 4581369 - DNA, 16 bp, Homo sapiens
tcgggaccaatatata

SEQ ID NO: 4581370 - DNA, 13 bp, Homo sapiens
tcgggagcaccca

SEQ ID NO: 4581371 - DNA, 15 bp, Homo sapiens
tcgggcagccagcag

SEQ ID NO: 4581372 - DNA, 17 bp, Homo sapiens
tcgggcagccagcagag

SEQ ID NO: 4581373 - DNA, 12 bp, Homo sapiens
tcgggcccagcc

SEQ ID NO: 4581374 - DNA, 17 bp, Homo sapiens
tcgggcttccctggcct

SEQ ID NO: 4581375 - DNA, 19 bp, Homo sapiens
tcgggcttccctggcctcc

SEQ ID NO: 4581376 - DNA, 16 bp, Homo sapiens
tcggggaactcctgga

SEQ ID NO: 4581377 - DNA, 21 bp, Homo sapiens
tcggggacaggtgacagtggc

SEQ ID NO: 4581378 - DNA, 18 bp, Homo sapiens
tcggggcttctgcggggc

SEQ ID NO: 4581379 - DNA, 13 bp, Homo sapiens
tcggggtccctgg

SEQ ID NO: 4581380 - DNA, 18 bp, Homo sapiens
tcggggtggcccactgag

SEQ ID NO: 4581381 - DNA, 13 bp, Homo sapiens
tcgggtccagaga

SEQ ID NO: 4581382 - DNA, 20 bp, Homo sapiens
tcggtcgccccgtgtttgcg

SEQ ID NO: 4581383 - DNA, 13 bp, Homo sapiens
tcggtgctccatc

SEQ ID NO: 4581384 - DNA, 14 bp, Homo sapiens
tcggtgctccatct

SEQ ID NO: 4581385 - DNA, 13 bp, Homo sapiens
tcgtaaagatttg

SEQ ID NO: 4581386 - DNA, 15 bp, Homo sapiens
tcgtaacttcatatt

SEQ ID NO: 4581387 - DNA, 18 bp, Homo sapiens
tcgtcaccccagccctcg

SEQ ID NO: 4581388 - DNA, 13 bp, Homo sapiens
tcgtcctccccct

SEQ ID NO: 4581389 - DNA, 18 bp, Homo sapiens
tcgtcctccccctgccag

SEQ ID NO: 4581390 - DNA, 14 bp, Homo sapiens
tcgtccttcctctc

SEQ ID NO: 4581391 - DNA, 13 bp, Homo sapiens
tcgtgagctgggg

SEQ ID NO: 4581392 - DNA, 18 bp, Homo sapiens
tcgtgagctggggactca

SEQ ID NO: 4581393 - DNA, 23 bp, Homo sapiens
tcgtgatgtggaggaagagccac

SEQ ID NO: 4581394 - DNA, 20 bp, Homo sapiens
tcgtgattttcaagcagcat

SEQ ID NO: 4581395 - DNA, 12 bp, Homo sapiens
tcgtgcctgaga

SEQ ID NO: 4581396 - DNA, 15 bp, Homo sapiens
tcgtgcctgagacca

SEQ ID NO: 4581397 - DNA, 18 bp, Homo sapiens
tcgtggacacacacagac

SEQ ID NO: 4581398 - DNA, 20 bp, Homo sapiens
tcgtggactgagtgggaagc

SEQ ID NO: 4581399 - DNA, 14 bp, Homo sapiens
tcgtggtaggactg

SEQ ID NO: 4581400 - DNA, 15 bp, Homo sapiens
tcgtgtattccatat

SEQ ID NO: 4581401 - DNA, 14 bp, Homo sapiens
tcgtgtctggcaca

SEQ ID NO: 4581402 - DNA, 21 bp, Homo sapiens
tcgtgtctggcacagcctggc

SEQ ID NO: 4581403 - DNA, 21 bp, Homo sapiens
tcgtgtgtgttatttccccag

SEQ ID NO: 4581404 - DNA, 23 bp, Homo sapiens
tcgttagaccgctctcttttctg

SEQ ID NO: 4581405 - DNA, 22 bp, Homo sapiens
tcgttcgcagagcttttcagat

SEQ ID NO: 4581406 - DNA, 17 bp, Homo sapiens
tcgttcttcatgggggt

SEQ ID NO: 4581407 - DNA, 14 bp, Homo sapiens
tcgttctttttaag

SEQ ID NO: 4581408 - DNA, 15 bp, Homo sapiens
tcgtttactccatgt

SEQ ID NO: 4581409 - DNA, 17 bp, Homo sapiens
tcgtttagaatcagaat

SEQ ID NO: 4581410 - DNA, 20 bp, Homo sapiens
tcgtttgtttgtttgtttaa

SEQ ID NO: 4581411 - DNA, 15 bp, Homo sapiens
tcgttttacaagaaa

SEQ ID NO: 4581412 - DNA, 14 bp, Homo sapiens
tctaaaaagtcaga

SEQ ID NO: 4581413 - DNA, 15 bp, Homo sapiens
tctaaaaagtcagat

SEQ ID NO: 4581414 - DNA, 17 bp, Homo sapiens
tctaaaaatgaagatga

SEQ ID NO: 4581415 - DNA, 20 bp, Homo sapiens
tctaaaacacaacaagaaac

SEQ ID NO: 4581416 - DNA, 16 bp, Homo sapiens
tctaaaacattcccct

SEQ ID NO: 4581417 - DNA, 22 bp, Homo sapiens
tctaaaacattcccctccccac

SEQ ID NO: 4581418 - DNA, 22 bp, Homo sapiens
tctaaaatagcaataactgaaa

SEQ ID NO: 4581419 - DNA, 19 bp, Homo sapiens
tctaaaatctaaaatttca

SEQ ID NO: 4581420 - DNA, 17 bp, Homo sapiens
tctaaaatgttttatga

SEQ ID NO: 4581421 - DNA, 21 bp, Homo sapiens
tctaaaatgttttatgacatt

SEQ ID NO: 4581422 - DNA, 14 bp, Homo sapiens
tctaaacagttatt

SEQ ID NO: 4581423 - DNA, 19 bp, Homo sapiens
tctaaacagttatttctgt

SEQ ID NO: 4581424 - DNA, 16 bp, Homo sapiens
tctaaacccaatccaa

SEQ ID NO: 4581425 - DNA, 17 bp, Homo sapiens
tctaaacttccccatct

SEQ ID NO: 4581426 - DNA, 23 bp, Homo sapiens
tctaaagcactggtttcaagaat

SEQ ID NO: 4581427 - DNA, 21 bp, Homo sapiens
tctaaagctttatctttgtgt

SEQ ID NO: 4581428 - DNA, 17 bp, Homo sapiens
tctaaagtaaaattgaa

SEQ ID NO: 4581429 - DNA, 14 bp, Homo sapiens
tctaaatgcaataa

SEQ ID NO: 4581430 - DNA, 19 bp, Homo sapiens
tctaaatgcaataagattt

SEQ ID NO: 4581431 - DNA, 13 bp, Homo sapiens
tctaaatgcccag

SEQ ID NO: 4581432 - DNA, 14 bp, Homo sapiens
tctaaatgcccagt

SEQ ID NO: 4581433 - DNA, 15 bp, Homo sapiens
tctaaattaagtccc

SEQ ID NO: 4581434 - DNA, 14 bp, Homo sapiens
tctaacaataatat

SEQ ID NO: 4581435 - DNA, 19 bp, Homo sapiens
tctaacaataatatttcaa

SEQ ID NO: 4581436 - DNA, 21 bp, Homo sapiens
tctaacaataatatttcaagt

SEQ ID NO: 4581437 - DNA, 21 bp, Homo sapiens
tctaacagccctcctctgcac

SEQ ID NO: 4581438 - DNA, 20 bp, Homo sapiens
tctaaccacggttatttaag

SEQ ID NO: 4581439 - DNA, 16 bp, Homo sapiens
tctaaccccaggcccc

SEQ ID NO: 4581440 - DNA, 17 bp, Homo sapiens
tctaaccccaggccccg

SEQ ID NO: 4581441 - DNA, 14 bp, Homo sapiens
tctaaccctcccat

SEQ ID NO: 4581442 - DNA, 20 bp, Homo sapiens
tctaaccctcccatggcacc

SEQ ID NO: 4581443 - DNA, 22 bp, Homo sapiens
tctaaccttcacgattaactgt

SEQ ID NO: 4581444 - DNA, 15 bp, Homo sapiens
tctaacgctgaactg

SEQ ID NO: 4581445 - DNA, 22 bp, Homo sapiens
tctaacgctgaactgacaatga

SEQ ID NO: 4581446 - DNA, 17 bp, Homo sapiens
tctaactgtatatttgt

SEQ ID NO: 4581447 - DNA, 12 bp, Homo sapiens
tctaactttgta

SEQ ID NO: 4581448 - DNA, 15 bp, Homo sapiens
tctaagaagacattt

SEQ ID NO: 4581449 - DNA, 18 bp, Homo sapiens
tctaagactctgtgtggc

SEQ ID NO: 4581450 - DNA, 20 bp, Homo sapiens
tctaagactctgtgtggctg

SEQ ID NO: 4581451 - DNA, 12 bp, Homo sapiens
tctaagagaagt

SEQ ID NO: 4581452 - DNA, 13 bp, Homo sapiens
tctaagatacact

SEQ ID NO: 4581453 - DNA, 14 bp, Homo sapiens
tctaagatacactg

SEQ ID NO: 4581454 - DNA, 20 bp, Homo sapiens
tctaagatacactgcacttt

SEQ ID NO: 4581455 - DNA, 23 bp, Homo sapiens
tctaagcaagtgaactcatccct

SEQ ID NO: 4581456 - DNA, 18 bp, Homo sapiens
tctaaggtctcatgctgt

SEQ ID NO: 4581457 - DNA, 20 bp, Homo sapiens
tctaagtaaaaccacagcag

SEQ ID NO: 4581458 - DNA, 21 bp, Homo sapiens
tctaagtttagaagcgctcat

SEQ ID NO: 4581459 - DNA, 16 bp, Homo sapiens
tctaatataatgactt

SEQ ID NO: 4581460 - DNA, 13 bp, Homo sapiens
tctaatattagtt

SEQ ID NO: 4581461 - DNA, 13 bp, Homo sapiens
tctaatattgctt

SEQ ID NO: 4581462 - DNA, 18 bp, Homo sapiens
tctaatccttttccttat

SEQ ID NO: 4581463 - DNA, 22 bp, Homo sapiens
tctaatccttttccttatttgc

SEQ ID NO: 4581464 - DNA, 24 bp, Homo sapiens
tctaatgaggagagaaaatatatg

SEQ ID NO: 4581465 - DNA, 20 bp, Homo sapiens
tctaatgcttgtttatgata

SEQ ID NO: 4581466 - DNA, 23 bp, Homo sapiens
tctaatgggggcagtctcccctt

SEQ ID NO: 4581467 - DNA, 14 bp, Homo sapiens
tctaatgttgtatc

SEQ ID NO: 4581468 - DNA, 16 bp, Homo sapiens
tctaatgtttactata

SEQ ID NO: 4581469 - DNA, 17 bp, Homo sapiens
tctaatgtttactatat

SEQ ID NO: 4581470 - DNA, 16 bp, Homo sapiens
tctaattaaaattgtg

SEQ ID NO: 4581471 - DNA, 23 bp, Homo sapiens
tctaattaaccttactaattata

SEQ ID NO: 4581472 - DNA, 21 bp, Homo sapiens
tctaattaagaaaactattaa

SEQ ID NO: 4581473 - DNA, 22 bp, Homo sapiens
tctaattaatagccaaagattt

SEQ ID NO: 4581474 - DNA, 16 bp, Homo sapiens
tctaattcacagtgct

SEQ ID NO: 4581475 - DNA, 13 bp, Homo sapiens
tctaatttataaa

SEQ ID NO: 4581476 - DNA, 22 bp, Homo sapiens
tctaatttctttagttttctat

SEQ ID NO: 4581477 - DNA, 23 bp, Homo sapiens
tctacaaagcactagagaatgca

SEQ ID NO: 4581478 - DNA, 16 bp, Homo sapiens
tctacacaatttaatt

SEQ ID NO: 4581479 - DNA, 17 bp, Homo sapiens
tctacacatgttgcctt

SEQ ID NO: 4581480 - DNA, 15 bp, Homo sapiens
tctacactctcctgg

SEQ ID NO: 4581481 - DNA, 17 bp, Homo sapiens
tctacactctcctgggc

SEQ ID NO: 4581482 - DNA, 16 bp, Homo sapiens
tctacagagcttccct

SEQ ID NO: 4581483 - DNA, 19 bp, Homo sapiens
tctacagagcttccctgac

SEQ ID NO: 4581484 - DNA, 18 bp, Homo sapiens
tctacagatgagtcacac

SEQ ID NO: 4581485 - DNA, 22 bp, Homo sapiens
tctacagtgatagagcaaagca

SEQ ID NO: 4581486 - DNA, 13 bp, Homo sapiens
tctacagtggttt

SEQ ID NO: 4581487 - DNA, 19 bp, Homo sapiens
tctacataaaatacaaaaa

SEQ ID NO: 4581488 - DNA, 16 bp, Homo sapiens
tctacatactatggaa

SEQ ID NO: 4581489 - DNA, 14 bp, Homo sapiens
tctacatgccatgc

SEQ ID NO: 4581490 - DNA, 15 bp, Homo sapiens
tctacatgccatgcc

SEQ ID NO: 4581491 - DNA, 23 bp, Homo sapiens
tctacatgccatgcctatgggcc

SEQ ID NO: 4581492 - DNA, 20 bp, Homo sapiens
tctacatgtgagatagtttt

SEQ ID NO: 4581493 - DNA, 14 bp, Homo sapiens
tctacattattgct

SEQ ID NO: 4581494 - DNA, 15 bp, Homo sapiens
tctacattattgctt

SEQ ID NO: 4581495 - DNA, 21 bp, Homo sapiens
tctacattcttggttgttaat

SEQ ID NO: 4581496 - DNA, 13 bp, Homo sapiens
tctacatttcaca

SEQ ID NO: 4581497 - DNA, 17 bp, Homo sapiens
tctaccaaaaaaaggaa

SEQ ID NO: 4581498 - DNA, 16 bp, Homo sapiens
tctaccacacacagcc

SEQ ID NO: 4581499 - DNA, 20 bp, Homo sapiens
tctaccacacacagcctgtc

SEQ ID NO: 4581500 - DNA, 21 bp, Homo sapiens
tctaccatggttctgcctcct

SEQ ID NO: 4581501 - DNA, 22 bp, Homo sapiens
tctacccagagaagccccttcc

SEQ ID NO: 4581502 - DNA, 16 bp, Homo sapiens
tctaccccagactaga

SEQ ID NO: 4581503 - DNA, 12 bp, Homo sapiens
tctacccctgct

SEQ ID NO: 4581504 - DNA, 15 bp, Homo sapiens
tctaccctcccaccc

SEQ ID NO: 4581505 - DNA, 18 bp, Homo sapiens
tctaccctcccaccccct

SEQ ID NO: 4581506 - DNA, 15 bp, Homo sapiens
tctacctcttggctg

SEQ ID NO: 4581507 - DNA, 20 bp, Homo sapiens
tctacctgagcattcaggca

SEQ ID NO: 4581508 - DNA, 12 bp, Homo sapiens
tctacctgccac

SEQ ID NO: 4581509 - DNA, 16 bp, Homo sapiens
tctacctgcttggtct

SEQ ID NO: 4581510 - DNA, 22 bp, Homo sapiens
tctacctgtgtttttttctaaa

SEQ ID NO: 4581511 - DNA, 22 bp, Homo sapiens
tctaccttcctgtccctgaggt

SEQ ID NO: 4581512 - DNA, 15 bp, Homo sapiens
tctaccttttaaaat

SEQ ID NO: 4581513 - DNA, 13 bp, Homo sapiens
tctaccttttctg

SEQ ID NO: 4581514 - DNA, 14 bp, Homo sapiens
tctaccttttctgg

SEQ ID NO: 4581515 - DNA, 19 bp, Homo sapiens
tctacgcaattgacaaacc

SEQ ID NO: 4581516 - DNA, 22 bp, Homo sapiens
tctacgccaatgttatgccagc

SEQ ID NO: 4581517 - DNA, 18 bp, Homo sapiens
tctacggatcatcaacaa

SEQ ID NO: 4581518 - DNA, 12 bp, Homo sapiens
tctactaaaaat

SEQ ID NO: 4581519 - DNA, 16 bp, Homo sapiens
tctactcctagaagaa

SEQ ID NO: 4581520 - DNA, 12 bp, Homo sapiens
tctactcctgcc

SEQ ID NO: 4581521 - DNA, 22 bp, Homo sapiens
tctactggaaaaaaatacaaaa

SEQ ID NO: 4581522 - DNA, 23 bp, Homo sapiens
tctactgtgtaatataaaagatc

SEQ ID NO: 4581523 - DNA, 17 bp, Homo sapiens
tctactgttattatgca

SEQ ID NO: 4581524 - DNA, 14 bp, Homo sapiens
tctacttacagttg

SEQ ID NO: 4581525 - DNA, 18 bp, Homo sapiens
tctacttgtcatatcact

SEQ ID NO: 4581526 - DNA, 17 bp, Homo sapiens
tctacttgttcatttgg

SEQ ID NO: 4581527 - DNA, 17 bp, Homo sapiens
tctacttgtttaacatt

SEQ ID NO: 4581528 - DNA, 14 bp, Homo sapiens
tctacttttaaata

SEQ ID NO: 4581529 - DNA, 20 bp, Homo sapiens
tctagaagagtctattgtct

SEQ ID NO: 4581530 - DNA, 21 bp, Homo sapiens
tctagaagagtctattgtctc

SEQ ID NO: 4581531 - DNA, 16 bp, Homo sapiens
tctagaagatgtgtaa

SEQ ID NO: 4581532 - DNA, 23 bp, Homo sapiens
tctagaagatgtgtaaacaggta

SEQ ID NO: 4581533 - DNA, 21 bp, Homo sapiens
tctagaagccaagggaaaggg

SEQ ID NO: 4581534 - DNA, 12 bp, Homo sapiens
tctagaagctcc

SEQ ID NO: 4581535 - DNA, 22 bp, Homo sapiens
tctagaatgtctgaagtacaaa

SEQ ID NO: 4581536 - DNA, 21 bp, Homo sapiens
tctagaatgttattgtgtata

SEQ ID NO: 4581537 - DNA, 15 bp, Homo sapiens
tctagaattcactga

SEQ ID NO: 4581538 - DNA, 15 bp, Homo sapiens
tctagaatttagtga

SEQ ID NO: 4581539 - DNA, 19 bp, Homo sapiens
tctagaatttatcacactt

SEQ ID NO: 4581540 - DNA, 17 bp, Homo sapiens
tctagacattcttttaa

SEQ ID NO: 4581541 - DNA, 15 bp, Homo sapiens
tctagacgcccctcc

SEQ ID NO: 4581542 - DNA, 15 bp, Homo sapiens
tctagacttccccat

SEQ ID NO: 4581543 - DNA, 18 bp, Homo sapiens
tctagacttccccatccc

SEQ ID NO: 4581544 - DNA, 19 bp, Homo sapiens
tctagacttccccatcccg

SEQ ID NO: 4581545 - DNA, 14 bp, Homo sapiens
tctagagacacatt

SEQ ID NO: 4581546 - DNA, 18 bp, Homo sapiens
tctagagttatcttcttt

SEQ ID NO: 4581547 - DNA, 19 bp, Homo sapiens
tctagagttatcttcttta

SEQ ID NO: 4581548 - DNA, 22 bp, Homo sapiens
tctagagttatcttctttatta

SEQ ID NO: 4581549 - DNA, 23 bp, Homo sapiens
tctagataaccttgtttattagc

SEQ ID NO: 4581550 - DNA, 16 bp, Homo sapiens
tctagatacaataaat

SEQ ID NO: 4581551 - DNA, 15 bp, Homo sapiens
tctagatcctgcacc

SEQ ID NO: 4581552 - DNA, 15 bp, Homo sapiens
tctagatctcagcca

SEQ ID NO: 4581553 - DNA, 22 bp, Homo sapiens
tctagatgaagttttacattgt

SEQ ID NO: 4581554 - DNA, 19 bp, Homo sapiens
tctagatggaccccagcat

SEQ ID NO: 4581555 - DNA, 16 bp, Homo sapiens
tctagatggcaacatt

SEQ ID NO: 4581556 - DNA, 19 bp, Homo sapiens
tctagatgggttcttagct

SEQ ID NO: 4581557 - DNA, 20 bp, Homo sapiens
tctagattaatactctattt

SEQ ID NO: 4581558 - DNA, 17 bp, Homo sapiens
tctagattaccatgaag

SEQ ID NO: 4581559 - DNA, 16 bp, Homo sapiens
tctagcaaacagatgt

SEQ ID NO: 4581560 - DNA, 14 bp, Homo sapiens
tctagcacactctt

SEQ ID NO: 4581561 - DNA, 15 bp, Homo sapiens
tctagcactggcctg

SEQ ID NO: 4581562 - DNA, 16 bp, Homo sapiens
tctagcatttatttct

SEQ ID NO: 4581563 - DNA, 19 bp, Homo sapiens
tctagcatttatttctctg

SEQ ID NO: 4581564 - DNA, 16 bp, Homo sapiens
tctagcctgcactttg

SEQ ID NO: 4581565 - DNA, 15 bp, Homo sapiens
tctagctatgctgta

SEQ ID NO: 4581566 - DNA, 21 bp, Homo sapiens
tctagcttaagtgtaaatgaa

SEQ ID NO: 4581567 - DNA, 23 bp, Homo sapiens
tctaggaggagctagtaggaatg

SEQ ID NO: 4581568 - DNA, 16 bp, Homo sapiens
tctaggatgtgatgat

SEQ ID NO: 4581569 - DNA, 21 bp, Homo sapiens
tctaggcatttcattatgctt

SEQ ID NO: 4581570 - DNA, 22 bp, Homo sapiens
tctagggacccctcgccccagc

SEQ ID NO: 4581571 - DNA, 14 bp, Homo sapiens
tctaggtctcctca

SEQ ID NO: 4581572 - DNA, 17 bp, Homo sapiens
tctaggttaaagctaaa

SEQ ID NO: 4581573 - DNA, 16 bp, Homo sapiens
tctagtaacaatacat

SEQ ID NO: 4581574 - DNA, 15 bp, Homo sapiens
tctagtattttatct

SEQ ID NO: 4581575 - DNA, 21 bp, Homo sapiens
tctagtattttatctggaaca

SEQ ID NO: 4581576 - DNA, 19 bp, Homo sapiens
tctagtcacaaagactcct

SEQ ID NO: 4581577 - DNA, 14 bp, Homo sapiens
tctagttcattgaa

SEQ ID NO: 4581578 - DNA, 14 bp, Homo sapiens
tctagttctagatg

SEQ ID NO: 4581579 - DNA, 14 bp, Homo sapiens
tctagttctgccag

SEQ ID NO: 4581580 - DNA, 13 bp, Homo sapiens
tctagtttattct

SEQ ID NO: 4581581 - DNA, 15 bp, Homo sapiens
tctagtttgtttagt

SEQ ID NO: 4581582 - DNA, 15 bp, Homo sapiens
tctataaatgaatgt

SEQ ID NO: 4581583 - DNA, 16 bp, Homo sapiens
tctataaatgaatgtg

SEQ ID NO: 4581584 - DNA, 19 bp, Homo sapiens
tctataaatttaagaaaac

SEQ ID NO: 4581585 - DNA, 15 bp, Homo sapiens
tctataacatgcatt

SEQ ID NO: 4581586 - DNA, 21 bp, Homo sapiens
tctataagcaaattgcttttt

SEQ ID NO: 4581587 - DNA, 16 bp, Homo sapiens
tctatacccacccaga

SEQ ID NO: 4581588 - DNA, 16 bp, Homo sapiens
tctatactaatgctta

SEQ ID NO: 4581589 - DNA, 15 bp, Homo sapiens
tctatagatgcctct

SEQ ID NO: 4581590 - DNA, 18 bp, Homo sapiens
tctataggtgtcttcaga

SEQ ID NO: 4581591 - DNA, 23 bp, Homo sapiens
tctatataaaataactaaaatgt

SEQ ID NO: 4581592 - DNA, 21 bp, Homo sapiens
tctatatgtagtgcattttta

SEQ ID NO: 4581593 - DNA, 15 bp, Homo sapiens
tctatattaaatgag

SEQ ID NO: 4581594 - DNA, 23 bp, Homo sapiens
tctatcagcatctgacaggtgaa

SEQ ID NO: 4581595 - DNA, 15 bp, Homo sapiens
tctatccaaacatgt

SEQ ID NO: 4581596 - DNA, 12 bp, Homo sapiens
tctatctaatga

SEQ ID NO: 4581597 - DNA, 20 bp, Homo sapiens
tctatctacaaagaaaaatt

SEQ ID NO: 4581598 - DNA, 18 bp, Homo sapiens
tctatgaaataatgtgaa

SEQ ID NO: 4581599 - DNA, 13 bp, Homo sapiens
tctatggaaggag

SEQ ID NO: 4581600 - DNA, 17 bp, Homo sapiens
tctatggagactttgct

SEQ ID NO: 4581601 - DNA, 18 bp, Homo sapiens
tctatggagactttgctg

SEQ ID NO: 4581602 - DNA, 16 bp, Homo sapiens
tctatggattcacttc

SEQ ID NO: 4581603 - DNA, 18 bp, Homo sapiens
tctatggctttaaataaa

SEQ ID NO: 4581604 - DNA, 14 bp, Homo sapiens
tctatggctttcaa

SEQ ID NO: 4581605 - DNA, 17 bp, Homo sapiens
tctatggctttcaaagc

SEQ ID NO: 4581606 - DNA, 15 bp, Homo sapiens
tctatgggtttagtt

SEQ ID NO: 4581607 - DNA, 18 bp, Homo sapiens
tctatgtcatttttaatg

SEQ ID NO: 4581608 - DNA, 16 bp, Homo sapiens
tctatgtgaatatttg

SEQ ID NO: 4581609 - DNA, 16 bp, Homo sapiens
tctatgttaatatttt

SEQ ID NO: 4581610 - DNA, 20 bp, Homo sapiens
tctattatggaaaactgtgt

SEQ ID NO: 4581611 - DNA, 17 bp, Homo sapiens
tctattatttagaaatg

SEQ ID NO: 4581612 - DNA, 18 bp, Homo sapiens
tctattctgtcagtgtta

SEQ ID NO: 4581613 - DNA, 20 bp, Homo sapiens
tctattgatgtacagtctgt

SEQ ID NO: 4581614 - DNA, 14 bp, Homo sapiens
tctattgatttgaa

SEQ ID NO: 4581615 - DNA, 16 bp, Homo sapiens
tctatttaaaaaactg

SEQ ID NO: 4581616 - DNA, 13 bp, Homo sapiens
tctatttaaattc

SEQ ID NO: 4581617 - DNA, 13 bp, Homo sapiens
tctatttatatgt

SEQ ID NO: 4581618 - DNA, 15 bp, Homo sapiens
tctatttctcctcca

SEQ ID NO: 4581619 - DNA, 18 bp, Homo sapiens
tctatttgaattatttct

SEQ ID NO: 4581620 - DNA, 20 bp, Homo sapiens
tctatttgctttaatgagaa

SEQ ID NO: 4581621 - DNA, 18 bp, Homo sapiens
tctatttgtctcttacat

SEQ ID NO: 4581622 - DNA, 16 bp, Homo sapiens
tctatttttacattta

SEQ ID NO: 4581623 - DNA, 17 bp, Homo sapiens
tctatttttacatttaa

SEQ ID NO: 4581624 - DNA, 17 bp, Homo sapiens
tctcaaaactgcactgt

SEQ ID NO: 4581625 - DNA, 21 bp, Homo sapiens
tctcaaaatatttttttaaga

SEQ ID NO: 4581626 - DNA, 18 bp, Homo sapiens
tctcaaacttgtggcctc

SEQ ID NO: 4581627 - DNA, 20 bp, Homo sapiens
tctcaaataggctattaaaa

SEQ ID NO: 4581628 - DNA, 14 bp, Homo sapiens
tctcaacatactgt

SEQ ID NO: 4581629 - DNA, 15 bp, Homo sapiens
tctcaacatactgta

SEQ ID NO: 4581630 - DNA, 21 bp, Homo sapiens
tctcaaggagaggcaaagaaa

SEQ ID NO: 4581631 - DNA, 13 bp, Homo sapiens
tctcaatgaaata

SEQ ID NO: 4581632 - DNA, 19 bp, Homo sapiens
tctcaatgtgcaataactt

SEQ ID NO: 4581633 - DNA, 11 bp, Homo sapiens
tctcacaaaaa

SEQ ID NO: 4581634 - DNA, 13 bp, Homo sapiens
tctcacaggctga

SEQ ID NO: 4581635 - DNA, 13 bp, Homo sapiens
tctcaccagctgc

SEQ ID NO: 4581636 - DNA, 16 bp, Homo sapiens
tctcaccagctgcaaa

SEQ ID NO: 4581637 - DNA, 15 bp, Homo sapiens
tctcacccaggcaat

SEQ ID NO: 4581638 - DNA, 14 bp, Homo sapiens
tctcacctgctccc

SEQ ID NO: 4581639 - DNA, 23 bp, Homo sapiens
tctcaccttgagcccacccccac

SEQ ID NO: 4581640 - DNA, 13 bp, Homo sapiens
tctcacgctttgt

SEQ ID NO: 4581641 - DNA, 15 bp, Homo sapiens
tctcacgctttgttt

SEQ ID NO: 4581642 - DNA, 20 bp, Homo sapiens
tctcactatatatatttcta

SEQ ID NO: 4581643 - DNA, 12 bp, Homo sapiens
tctcactcacca

SEQ ID NO: 4581644 - DNA, 24 bp, Homo sapiens
tctcactcaccactaccagccagc

SEQ ID NO: 4581645 - DNA, 12 bp, Homo sapiens
tctcactccacc

SEQ ID NO: 4581646 - DNA, 13 bp, Homo sapiens
tctcactcccctc

SEQ ID NO: 4581647 - DNA, 15 bp, Homo sapiens
tctcactcttctgtc

SEQ ID NO: 4581648 - DNA, 14 bp, Homo sapiens
tctcactgcttgaa

SEQ ID NO: 4581649 - DNA, 18 bp, Homo sapiens
tctcactgcttgaactag

SEQ ID NO: 4581650 - DNA, 17 bp, Homo sapiens
tctcactttactttcaa

SEQ ID NO: 4581651 - DNA, 18 bp, Homo sapiens
tctcagaaccatttcacc

SEQ ID NO: 4581652 - DNA, 14 bp, Homo sapiens
tctcagaattcggt

SEQ ID NO: 4581653 - DNA, 15 bp, Homo sapiens
tctcagaggcctgct

SEQ ID NO: 4581654 - DNA, 21 bp, Homo sapiens
tctcagaggcctgctgccagt

SEQ ID NO: 4581655 - DNA, 19 bp, Homo sapiens
tctcagagtccactgtggc

SEQ ID NO: 4581656 - DNA, 18 bp, Homo sapiens
tctcagatgttaaaataa

SEQ ID NO: 4581657 - DNA, 19 bp, Homo sapiens
tctcagatgttaaaataaa

SEQ ID NO: 4581658 - DNA, 17 bp, Homo sapiens
tctcagatttctgagga

SEQ ID NO: 4581659 - DNA, 23 bp, Homo sapiens
tctcagcagcgaccacccctgcc

SEQ ID NO: 4581660 - DNA, 20 bp, Homo sapiens
tctcagccataggtgcagtt

SEQ ID NO: 4581661 - DNA, 21 bp, Homo sapiens
tctcagccataggtgcagttt

SEQ ID NO: 4581662 - DNA, 14 bp, Homo sapiens
tctcagcccagaag

SEQ ID NO: 4581663 - DNA, 22 bp, Homo sapiens
tctcagcccagaagaaaattct

SEQ ID NO: 4581664 - DNA, 15 bp, Homo sapiens
tctcagcctctgcca

SEQ ID NO: 4581665 - DNA, 22 bp, Homo sapiens
tctcagctgctggatgacttga

SEQ ID NO: 4581666 - DNA, 22 bp, Homo sapiens
tctcaggacagcatcccttccc

SEQ ID NO: 4581667 - DNA, 12 bp, Homo sapiens
tctcaggagctt

SEQ ID NO: 4581668 - DNA, 18 bp, Homo sapiens
tctcaggccgagagcctt

SEQ ID NO: 4581669 - DNA, 23 bp, Homo sapiens
tctcaggctcaagtttttatagt

SEQ ID NO: 4581670 - DNA, 15 bp, Homo sapiens
tctcaggtgagctgg

SEQ ID NO: 4581671 - DNA, 20 bp, Homo sapiens
tctcagtaccccatggagct

SEQ ID NO: 4581672 - DNA, 23 bp, Homo sapiens
tctcagtccatgaagatgtagag

SEQ ID NO: 4581673 - DNA, 13 bp, Homo sapiens
tctcagtctctga

SEQ ID NO: 4581674 - DNA, 16 bp, Homo sapiens
tctcagtgaagaatac

SEQ ID NO: 4581675 - DNA, 13 bp, Homo sapiens
tctcagtgctttc

SEQ ID NO: 4581676 - DNA, 16 bp, Homo sapiens
tctcagttttcataag

SEQ ID NO: 4581677 - DNA, 16 bp, Homo sapiens
tctcataattttgcaa

SEQ ID NO: 4581678 - DNA, 17 bp, Homo sapiens
tctcataattttgcaaa

SEQ ID NO: 4581679 - DNA, 22 bp, Homo sapiens
tctcatagaggaaattcaaatc

SEQ ID NO: 4581680 - DNA, 17 bp, Homo sapiens
tctcatcaactgaatga

SEQ ID NO: 4581681 - DNA, 13 bp, Homo sapiens
tctcatccatcat

SEQ ID NO: 4581682 - DNA, 14 bp, Homo sapiens
tctcatccatcatc

SEQ ID NO: 4581683 - DNA, 14 bp, Homo sapiens
tctcatccccaggg

SEQ ID NO: 4581684 - DNA, 14 bp, Homo sapiens
tctcatcctcccat

SEQ ID NO: 4581685 - DNA, 15 bp, Homo sapiens
tctcatcctcccatt

SEQ ID NO: 4581686 - DNA, 22 bp, Homo sapiens
tctcatcctcccattgcccagt

SEQ ID NO: 4581687 - DNA, 24 bp, Homo sapiens
tctcatcctcccattgcccagtga

SEQ ID NO: 4581688 - DNA, 20 bp, Homo sapiens
tctcatctcttagctcccct

SEQ ID NO: 4581689 - DNA, 18 bp, Homo sapiens
tctcatgccagtgcctta

SEQ ID NO: 4581690 - DNA, 22 bp, Homo sapiens
tctcatgcctcctgaggctgtt

SEQ ID NO: 4581691 - DNA, 19 bp, Homo sapiens
tctcatggtacttcctctg

SEQ ID NO: 4581692 - DNA, 15 bp, Homo sapiens
tctcattaaaagaat

SEQ ID NO: 4581693 - DNA, 16 bp, Homo sapiens
tctcattaaaagaata

SEQ ID NO: 4581694 - DNA, 20 bp, Homo sapiens
tctcattaaaagaatatctg

SEQ ID NO: 4581695 - DNA, 15 bp, Homo sapiens
tctcattatttcaaa

SEQ ID NO: 4581696 - DNA, 21 bp, Homo sapiens
tctcattcccagagtcagagg

SEQ ID NO: 4581697 - DNA, 14 bp, Homo sapiens
tctcattccccagg

SEQ ID NO: 4581698 - DNA, 19 bp, Homo sapiens
tctcattggacccttccat

SEQ ID NO: 4581699 - DNA, 15 bp, Homo sapiens
tctcatttaagggaa

SEQ ID NO: 4581700 - DNA, 17 bp, Homo sapiens
tctcatttaagggaaaa

SEQ ID NO: 4581701 - DNA, 16 bp, Homo sapiens
tctcattttaatgtaa

SEQ ID NO: 4581702 - DNA, 20 bp, Homo sapiens
tctcattttttaaaaaagct

SEQ ID NO: 4581703 - DNA, 23 bp, Homo sapiens
tctccaaaaaaaaaaaaaataca

SEQ ID NO: 4581704 - DNA, 22 bp, Homo sapiens
tctccaaaaatctgcctgggtt

SEQ ID NO: 4581705 - DNA, 16 bp, Homo sapiens
tctccaaaacatttct

SEQ ID NO: 4581706 - DNA, 20 bp, Homo sapiens
tctccaaccccccagcactg

SEQ ID NO: 4581707 - DNA, 21 bp, Homo sapiens
tctccaaccccccagcactga

SEQ ID NO: 4581708 - DNA, 16 bp, Homo sapiens
tctccaagacagcagc

SEQ ID NO: 4581709 - DNA, 19 bp, Homo sapiens
tctccacactgctgctagg

SEQ ID NO: 4581710 - DNA, 11 bp, Homo sapiens
tctccacctca

SEQ ID NO: 4581711 - DNA, 21 bp, Homo sapiens
tctccacctgagaccctggga

SEQ ID NO: 4581712 - DNA, 14 bp, Homo sapiens
tctccacctgcaca

SEQ ID NO: 4581713 - DNA, 14 bp, Homo sapiens
tctccagctgacta

SEQ ID NO: 4581714 - DNA, 15 bp, Homo sapiens
tctccagctgactaa

SEQ ID NO: 4581715 - DNA, 21 bp, Homo sapiens
tctccaggattttaatttcag

SEQ ID NO: 4581716 - DNA, 13 bp, Homo sapiens
tctccaggcattt

SEQ ID NO: 4581717 - DNA, 15 bp, Homo sapiens
tctccatatctcctt

SEQ ID NO: 4581718 - DNA, 16 bp, Homo sapiens
tctccatatctccttc

SEQ ID NO: 4581719 - DNA, 19 bp, Homo sapiens
tctccatccacatgggagc

SEQ ID NO: 4581720 - DNA, 12 bp, Homo sapiens
tctccatcccct

SEQ ID NO: 4581721 - DNA, 23 bp, Homo sapiens
tctccatcccctccctgcctgct

SEQ ID NO: 4581722 - DNA, 15 bp, Homo sapiens
tctccatggccctgc

SEQ ID NO: 4581723 - DNA, 20 bp, Homo sapiens
tctccatggccctgtcccag

SEQ ID NO: 4581724 - DNA, 22 bp, Homo sapiens
tctccatgtagaataaatgaag

SEQ ID NO: 4581725 - DNA, 20 bp, Homo sapiens
tctccatgtgtgtgccaagc

SEQ ID NO: 4581726 - DNA, 13 bp, Homo sapiens
tctcccaacatgg

SEQ ID NO: 4581727 - DNA, 17 bp, Homo sapiens
tctcccacatgaggcca

SEQ ID NO: 4581728 - DNA, 20 bp, Homo sapiens
tctcccacccggccacagct

SEQ ID NO: 4581729 - DNA, 18 bp, Homo sapiens
tctcccagataatgtgaa

SEQ ID NO: 4581730 - DNA, 21 bp, Homo sapiens
tctcccagataatgtgaaaat

SEQ ID NO: 4581731 - DNA, 15 bp, Homo sapiens
tctcccagtcattta

SEQ ID NO: 4581732 - DNA, 19 bp, Homo sapiens
tctcccagtctacccagag

SEQ ID NO: 4581733 - DNA, 22 bp, Homo sapiens
tctcccagtgaactcctgccag

SEQ ID NO: 4581734 - DNA, 19 bp, Homo sapiens
tctcccatctcttccttga

SEQ ID NO: 4581735 - DNA, 13 bp, Homo sapiens
tctccccacacta

SEQ ID NO: 4581736 - DNA, 22 bp, Homo sapiens
tctccccacactaacctgggtt

SEQ ID NO: 4581737 - DNA, 11 bp, Homo sapiens
tctccccagcc

SEQ ID NO: 4581738 - DNA, 20 bp, Homo sapiens
tctccccagccccctcccac

SEQ ID NO: 4581739 - DNA, 12 bp, Homo sapiens
tctccccaggaa

SEQ ID NO: 4581740 - DNA, 10 bp, Homo sapiens
tctccccagt

SEQ ID NO: 4581741 - DNA, 11 bp, Homo sapiens
tctccccagtg

SEQ ID NO: 4581742 - DNA, 20 bp, Homo sapiens
tctccccagtgcctgccact

SEQ ID NO: 4581743 - DNA, 13 bp, Homo sapiens
tctccccatatat

SEQ ID NO: 4581744 - DNA, 18 bp, Homo sapiens
tctccccatatataaatt

SEQ ID NO: 4581745 - DNA, 20 bp, Homo sapiens
tctccccctcctccagggaa

SEQ ID NO: 4581746 - DNA, 20 bp, Homo sapiens
tctccccgcagcccgcctgc

SEQ ID NO: 4581747 - DNA, 22 bp, Homo sapiens
tctccccgcagcccgcctgccg

SEQ ID NO: 4581748 - DNA, 22 bp, Homo sapiens
tctccccgctctggatcctgca

SEQ ID NO: 4581749 - DNA, 21 bp, Homo sapiens
tctcccctgcccccaggactg

SEQ ID NO: 4581750 - DNA, 22 bp, Homo sapiens
tctcccctgcccccaggactgg

SEQ ID NO: 4581751 - DNA, 12 bp, Homo sapiens
tctccctctggc

SEQ ID NO: 4581752 - DNA, 15 bp, Homo sapiens
tctccctgccgcctc

SEQ ID NO: 4581753 - DNA, 15 bp, Homo sapiens
tctccctgcctcact

SEQ ID NO: 4581754 - DNA, 21 bp, Homo sapiens
tctccctgcctcactcctccg

SEQ ID NO: 4581755 - DNA, 16 bp, Homo sapiens
tctccctgcctggccc

SEQ ID NO: 4581756 - DNA, 13 bp, Homo sapiens
tctccctggctcc

SEQ ID NO: 4581757 - DNA, 20 bp, Homo sapiens
tctccctggctccctcctcc

SEQ ID NO: 4581758 - DNA, 20 bp, Homo sapiens
tctcccttctcatctcccca

SEQ ID NO: 4581759 - DNA, 12 bp, Homo sapiens
tctcccttggcc

SEQ ID NO: 4581760 - DNA, 18 bp, Homo sapiens
tctcccttggcccagaga

SEQ ID NO: 4581761 - DNA, 15 bp, Homo sapiens
tctccctttctctct

SEQ ID NO: 4581762 - DNA, 14 bp, Homo sapiens
tctccgccagcctc

SEQ ID NO: 4581763 - DNA, 21 bp, Homo sapiens
tctccgccagcctcctctgga

SEQ ID NO: 4581764 - DNA, 19 bp, Homo sapiens
tctccgggactgccctctc

SEQ ID NO: 4581765 - DNA, 15 bp, Homo sapiens
tctccgggtgtggcc

SEQ ID NO: 4581766 - DNA, 17 bp, Homo sapiens
tctccgggtgtggcctc

SEQ ID NO: 4581767 - DNA, 22 bp, Homo sapiens
tctcctatatatttctattatt

SEQ ID NO: 4581768 - DNA, 13 bp, Homo sapiens
tctcctatttttt

SEQ ID NO: 4581769 - DNA, 20 bp, Homo sapiens
tctcctatttttttaaaatc

SEQ ID NO: 4581770 - DNA, 13 bp, Homo sapiens
tctcctcactccc

SEQ ID NO: 4581771 - DNA, 23 bp, Homo sapiens
tctcctcactcccttctacctgc

SEQ ID NO: 4581772 - DNA, 17 bp, Homo sapiens
tctcctcactctgtccc

SEQ ID NO: 4581773 - DNA, 12 bp, Homo sapiens
tctcctcagggt

SEQ ID NO: 4581774 - DNA, 13 bp, Homo sapiens
tctcctcagtggc

SEQ ID NO: 4581775 - DNA, 14 bp, Homo sapiens
tctcctcagtggct

SEQ ID NO: 4581776 - DNA, 17 bp, Homo sapiens
tctcctcagtggcttct

SEQ ID NO: 4581777 - DNA, 16 bp, Homo sapiens
tctcctccatgggaga

SEQ ID NO: 4581778 - DNA, 14 bp, Homo sapiens
tctcctcctcccct

SEQ ID NO: 4581779 - DNA, 18 bp, Homo sapiens
tctcctcggactgtgtgc

SEQ ID NO: 4581780 - DNA, 14 bp, Homo sapiens
tctcctctgctcat

SEQ ID NO: 4581781 - DNA, 17 bp, Homo sapiens
tctcctctttaaaacaa

SEQ ID NO: 4581782 - DNA, 20 bp, Homo sapiens
tctcctctttaaaacaaaac

SEQ ID NO: 4581783 - DNA, 18 bp, Homo sapiens
tctcctgaacaatatttt

SEQ ID NO: 4581784 - DNA, 14 bp, Homo sapiens
tctcctgaatattt

SEQ ID NO: 4581785 - DNA, 13 bp, Homo sapiens
tctcctgcaaatt

SEQ ID NO: 4581786 - DNA, 23 bp, Homo sapiens
tctcctgcaaatttagtttgtta

SEQ ID NO: 4581787 - DNA, 13 bp, Homo sapiens
tctcctgccctgt

SEQ ID NO: 4581788 - DNA, 12 bp, Homo sapiens
tctcctgcctac

SEQ ID NO: 4581789 - DNA, 13 bp, Homo sapiens
tctcctgcctcag

SEQ ID NO: 4581790 - DNA, 17 bp, Homo sapiens
tctcctgccttcctcct

SEQ ID NO: 4581791 - DNA, 13 bp, Homo sapiens
tctcctggaggat

SEQ ID NO: 4581792 - DNA, 21 bp, Homo sapiens
tctcctggcctatccgctgcc

SEQ ID NO: 4581793 - DNA, 20 bp, Homo sapiens
tctcctggcctggccatctc

SEQ ID NO: 4581794 - DNA, 13 bp, Homo sapiens
tctcctggctgtc

SEQ ID NO: 4581795 - DNA, 13 bp, Homo sapiens
tctcctgggcccc

SEQ ID NO: 4581796 - DNA, 19 bp, Homo sapiens
tctcctgggcccctcccta

SEQ ID NO: 4581797 - DNA, 20 bp, Homo sapiens
tctcctgggcccctccctac

SEQ ID NO: 4581798 - DNA, 22 bp, Homo sapiens
tctcctgggggtggcaggcaca

SEQ ID NO: 4581799 - DNA, 23 bp, Homo sapiens
tctcctgtaagccaaagaaatga

SEQ ID NO: 4581800 - DNA, 18 bp, Homo sapiens
tctcctgttttatatatt

SEQ ID NO: 4581801 - DNA, 19 bp, Homo sapiens
tctccttcagccctcaccc

SEQ ID NO: 4581802 - DNA, 16 bp, Homo sapiens
tctccttggccacaga

SEQ ID NO: 4581803 - DNA, 17 bp, Homo sapiens
tctccttggttatattt

SEQ ID NO: 4581804 - DNA, 12 bp, Homo sapiens
tctcctttacca

SEQ ID NO: 4581805 - DNA, 16 bp, Homo sapiens
tctcctttcctacagt

SEQ ID NO: 4581806 - DNA, 13 bp, Homo sapiens
tctcctttgcaat

SEQ ID NO: 4581807 - DNA, 17 bp, Homo sapiens
tctcctttgcaatagca

SEQ ID NO: 4581808 - DNA, 19 bp, Homo sapiens
tctcctttgcaatagcagt

SEQ ID NO: 4581809 - DNA, 13 bp, Homo sapiens
tctccttttccta

SEQ ID NO: 4581810 - DNA, 18 bp, Homo sapiens
tctcgagcccagatggaa

SEQ ID NO: 4581811 - DNA, 13 bp, Homo sapiens
tctcgatctcctg

SEQ ID NO: 4581812 - DNA, 21 bp, Homo sapiens
tctcgctaaagttatatttgt

SEQ ID NO: 4581813 - DNA, 22 bp, Homo sapiens
tctcggatgacaccctggcctg

SEQ ID NO: 4581814 - DNA, 14 bp, Homo sapiens
tctcgggtgcattt

SEQ ID NO: 4581815 - DNA, 15 bp, Homo sapiens
tctcgtgagtcattt

SEQ ID NO: 4581816 - DNA, 21 bp, Homo sapiens
tctcgtggtaggactgtagaa

SEQ ID NO: 4581817 - DNA, 15 bp, Homo sapiens
tctcgtgtttgctta

SEQ ID NO: 4581818 - DNA, 16 bp, Homo sapiens
tctcgttgtcacaccc

SEQ ID NO: 4581819 - DNA, 22 bp, Homo sapiens
tctctaagtttagaagcgctca

SEQ ID NO: 4581820 - DNA, 22 bp, Homo sapiens
tctctacaggcctcttcctgtt

SEQ ID NO: 4581821 - DNA, 21 bp, Homo sapiens
tctctacaggtccgtttcctt

SEQ ID NO: 4581822 - DNA, 15 bp, Homo sapiens
tctctacatgcataa

SEQ ID NO: 4581823 - DNA, 21 bp, Homo sapiens
tctctaccttttaaaattgaa

SEQ ID NO: 4581824 - DNA, 21 bp, Homo sapiens
tctctataaagggtcaggccc

SEQ ID NO: 4581825 - DNA, 22 bp, Homo sapiens
tctctataaagggtcaggcccg

SEQ ID NO: 4581826 - DNA, 15 bp, Homo sapiens
tctctattccctcag

SEQ ID NO: 4581827 - DNA, 18 bp, Homo sapiens
tctctattccctcagcct

SEQ ID NO: 4581828 - DNA, 18 bp, Homo sapiens
tctctatttaaattcttt

SEQ ID NO: 4581829 - DNA, 13 bp, Homo sapiens
tctctattttact

SEQ ID NO: 4581830 - DNA, 19 bp, Homo sapiens
tctctattttacttttctg

SEQ ID NO: 4581831 - DNA, 21 bp, Homo sapiens
tctctcaaaagagaaaaacaa

SEQ ID NO: 4581832 - DNA, 18 bp, Homo sapiens
tctctcactcccctctcc

SEQ ID NO: 4581833 - DNA, 19 bp, Homo sapiens
tctctcactcccctctcct

SEQ ID NO: 4581834 - DNA, 12 bp, Homo sapiens
tctctcagtgaa

SEQ ID NO: 4581835 - DNA, 17 bp, Homo sapiens
tctctcatctaactgat

SEQ ID NO: 4581836 - DNA, 22 bp, Homo sapiens
tctctcatctcttagctcccct

SEQ ID NO: 4581837 - DNA, 14 bp, Homo sapiens
tctctcatgcctcc

SEQ ID NO: 4581838 - DNA, 23 bp, Homo sapiens
tctctcccagtctacccagagaa

SEQ ID NO: 4581839 - DNA, 13 bp, Homo sapiens
tctctcccatgga

SEQ ID NO: 4581840 - DNA, 15 bp, Homo sapiens
tctctcccatggagc

SEQ ID NO: 4581841 - DNA, 17 bp, Homo sapiens
tctctcccatggagccc

SEQ ID NO: 4581842 - DNA, 21 bp, Homo sapiens
tctctcccatggagccccagc

SEQ ID NO: 4581843 - DNA, 23 bp, Homo sapiens
tctctcccatggagccccagccc

SEQ ID NO: 4581844 - DNA, 21 bp, Homo sapiens
tctctccccagccccctccca

SEQ ID NO: 4581845 - DNA, 22 bp, Homo sapiens
tctctccccagccccctcccac

SEQ ID NO: 4581846 - DNA, 19 bp, Homo sapiens
tctctccccatatataaat

SEQ ID NO: 4581847 - DNA, 20 bp, Homo sapiens
tctctccccatatataaatt

SEQ ID NO: 4581848 - DNA, 23 bp, Homo sapiens
tctctccccatatataaattatt

SEQ ID NO: 4581849 - DNA, 11 bp, Homo sapiens
tctctccctgc

SEQ ID NO: 4581850 - DNA, 20 bp, Homo sapiens
tctctcccttcctctctcct

SEQ ID NO: 4581851 - DNA, 14 bp, Homo sapiens
tctctcctctctgc

SEQ ID NO: 4581852 - DNA, 11 bp, Homo sapiens
tctctcctggc

SEQ ID NO: 4581853 - DNA, 13 bp, Homo sapiens
tctctcctgtcca

SEQ ID NO: 4581854 - DNA, 14 bp, Homo sapiens
tctctcctgtccaa

SEQ ID NO: 4581855 - DNA, 14 bp, Homo sapiens
tctctccttggcca

SEQ ID NO: 4581856 - DNA, 18 bp, Homo sapiens
tctctcggcccctgtctg

SEQ ID NO: 4581857 - DNA, 20 bp, Homo sapiens
tctctcggcccctgtctgtt

SEQ ID NO: 4581858 - DNA, 23 bp, Homo sapiens
tctctctcatgcctcctgaggct

SEQ ID NO: 4581859 - DNA, 13 bp, Homo sapiens
tctctctcctgtc

SEQ ID NO: 4581860 - DNA, 16 bp, Homo sapiens
tctctctcggcccctg

SEQ ID NO: 4581861 - DNA, 15 bp, Homo sapiens
tctctctcttagcat

SEQ ID NO: 4581862 - DNA, 11 bp, Homo sapiens
tctctctgctc

SEQ ID NO: 4581863 - DNA, 13 bp, Homo sapiens
tctctctgctcca

SEQ ID NO: 4581864 - DNA, 19 bp, Homo sapiens
tctctctggggccctgggc

SEQ ID NO: 4581865 - DNA, 14 bp, Homo sapiens
tctctctgttacac

SEQ ID NO: 4581866 - DNA, 14 bp, Homo sapiens
tctctcttctgctc

SEQ ID NO: 4581867 - DNA, 16 bp, Homo sapiens
tctctcttctgctcca

SEQ ID NO: 4581868 - DNA, 18 bp, Homo sapiens
tctctcttgtcctcttct

SEQ ID NO: 4581869 - DNA, 15 bp, Homo sapiens
tctctctttccatct

SEQ ID NO: 4581870 - DNA, 11 bp, Homo sapiens
tctctcttttg

SEQ ID NO: 4581871 - DNA, 11 bp, Homo sapiens
tctctgaaggg

SEQ ID NO: 4581872 - DNA, 16 bp, Homo sapiens
tctctgagctctgcat

SEQ ID NO: 4581873 - DNA, 16 bp, Homo sapiens
tctctgagctgtgcag

SEQ ID NO: 4581874 - DNA, 16 bp, Homo sapiens
tctctgatgtcccagt

SEQ ID NO: 4581875 - DNA, 17 bp, Homo sapiens
tctctgatgtcccagtg

SEQ ID NO: 4581876 - DNA, 20 bp, Homo sapiens
tctctgcacccagtgaacac

SEQ ID NO: 4581877 - DNA, 11 bp, Homo sapiens
tctctgcagcc

SEQ ID NO: 4581878 - DNA, 19 bp, Homo sapiens
tctctgcagccagcccagc

SEQ ID NO: 4581879 - DNA, 20 bp, Homo sapiens
tctctgcagccagcccagcc

SEQ ID NO: 4581880 - DNA, 13 bp, Homo sapiens
tctctgcagtaaa

SEQ ID NO: 4581881 - DNA, 19 bp, Homo sapiens
tctctgcagtaaaacacat

SEQ ID NO: 4581882 - DNA, 21 bp, Homo sapiens
tctctgcagtaaaacacattt

SEQ ID NO: 4581883 - DNA, 13 bp, Homo sapiens
tctctgcccagcc

SEQ ID NO: 4581884 - DNA, 18 bp, Homo sapiens
tctctgcccagccgggca

SEQ ID NO: 4581885 - DNA, 11 bp, Homo sapiens
tctctgctcca

SEQ ID NO: 4581886 - DNA, 13 bp, Homo sapiens
tctctgctccacc

SEQ ID NO: 4581887 - DNA, 18 bp, Homo sapiens
tctctgctctgcgtgtca

SEQ ID NO: 4581888 - DNA, 21 bp, Homo sapiens
tctctgctctgcgtgtcacct

SEQ ID NO: 4581889 - DNA, 23 bp, Homo sapiens
tctctgctctgcgtgtcacctgt

SEQ ID NO: 4581890 - DNA, 15 bp, Homo sapiens
tctctggcaaacttt

SEQ ID NO: 4581891 - DNA, 15 bp, Homo sapiens
tctctggcactttga

SEQ ID NO: 4581892 - DNA, 17 bp, Homo sapiens
tctctggcagctggcct

SEQ ID NO: 4581893 - DNA, 14 bp, Homo sapiens
tctctgggactctc

SEQ ID NO: 4581894 - DNA, 16 bp, Homo sapiens
tctctgggactctcct

SEQ ID NO: 4581895 - DNA, 16 bp, Homo sapiens
tctctggggcaggctg

SEQ ID NO: 4581896 - DNA, 14 bp, Homo sapiens
tctctggggccctg

SEQ ID NO: 4581897 - DNA, 18 bp, Homo sapiens
tctctggggccctgggcc

SEQ ID NO: 4581898 - DNA, 22 bp, Homo sapiens
tctctggggccctgggcctcag

SEQ ID NO: 4581899 - DNA, 13 bp, Homo sapiens
tctctggtccgga

SEQ ID NO: 4581900 - DNA, 16 bp, Homo sapiens
tctctgtataatctat

SEQ ID NO: 4581901 - DNA, 12 bp, Homo sapiens
tctctgtgaaag

SEQ ID NO: 4581902 - DNA, 21 bp, Homo sapiens
tctctgtgaaagctttggaaa

SEQ ID NO: 4581903 - DNA, 19 bp, Homo sapiens
tctctgtgagactcgagaa

SEQ ID NO: 4581904 - DNA, 15 bp, Homo sapiens
tctctgtgctgtgga

SEQ ID NO: 4581905 - DNA, 22 bp, Homo sapiens
tctctgttacacactaacatca

SEQ ID NO: 4581906 - DNA, 18 bp, Homo sapiens
tctctgttgtcgtaaaga

SEQ ID NO: 4581907 - DNA, 18 bp, Homo sapiens
tctcttaaacttgtgaat

SEQ ID NO: 4581908 - DNA, 20 bp, Homo sapiens
tctcttagaatttgtttcat

SEQ ID NO: 4581909 - DNA, 22 bp, Homo sapiens
tctcttattgttctttcatatg

SEQ ID NO: 4581910 - DNA, 12 bp, Homo sapiens
tctcttccacag

SEQ ID NO: 4581911 - DNA, 13 bp, Homo sapiens
tctcttccacagt

SEQ ID NO: 4581912 - DNA, 15 bp, Homo sapiens
tctcttccacagtgg

SEQ ID NO: 4581913 - DNA, 13 bp, Homo sapiens
tctcttcctcttt

SEQ ID NO: 4581914 - DNA, 21 bp, Homo sapiens
tctcttccttgacctgcattg

SEQ ID NO: 4581915 - DNA, 20 bp, Homo sapiens
tctcttccttttatcagtag

SEQ ID NO: 4581916 - DNA, 15 bp, Homo sapiens
tctcttctctccagc

SEQ ID NO: 4581917 - DNA, 23 bp, Homo sapiens
tctcttctctccagctgactaaa

SEQ ID NO: 4581918 - DNA, 19 bp, Homo sapiens
tctcttctgaataaagcaa

SEQ ID NO: 4581919 - DNA, 21 bp, Homo sapiens
tctcttctgagctatttcatc

SEQ ID NO: 4581920 - DNA, 14 bp, Homo sapiens
tctcttctgctcca

SEQ ID NO: 4581921 - DNA, 16 bp, Homo sapiens
tctcttggacccacct

SEQ ID NO: 4581922 - DNA, 16 bp, Homo sapiens
tctctttaaccctccc

SEQ ID NO: 4581923 - DNA, 12 bp, Homo sapiens
tctctttccatg

SEQ ID NO: 4581924 - DNA, 12 bp, Homo sapiens
tctctttctctg

SEQ ID NO: 4581925 - DNA, 16 bp, Homo sapiens
tctctttgagtcaata

SEQ ID NO: 4581926 - DNA, 15 bp, Homo sapiens
tctctttgtgcagtg

SEQ ID NO: 4581927 - DNA, 22 bp, Homo sapiens
tctcttttccactccattgtcg

SEQ ID NO: 4581928 - DNA, 18 bp, Homo sapiens
tctctttttgctttcgaa

SEQ ID NO: 4581929 - DNA, 14 bp, Homo sapiens
tctgaaaacaaggt

SEQ ID NO: 4581930 - DNA, 19 bp, Homo sapiens
tctgaaaacccaaggccag

SEQ ID NO: 4581931 - DNA, 12 bp, Homo sapiens
tctgaaacagct

SEQ ID NO: 4581932 - DNA, 14 bp, Homo sapiens
tctgaaacagctgc

SEQ ID NO: 4581933 - DNA, 12 bp, Homo sapiens
tctgaaactggc

SEQ ID NO: 4581934 - DNA, 17 bp, Homo sapiens
tctgaactccatacagc

SEQ ID NO: 4581935 - DNA, 21 bp, Homo sapiens
tctgaactccatacagcctct

SEQ ID NO: 4581936 - DNA, 19 bp, Homo sapiens
tctgaactggtagaaaaac

SEQ ID NO: 4581937 - DNA, 22 bp, Homo sapiens
tctgaacttgagtataagataa

SEQ ID NO: 4581938 - DNA, 23 bp, Homo sapiens
tctgaagaaggaaggcctgagcc

SEQ ID NO: 4581939 - DNA, 10 bp, Homo sapiens
tctgaagagg

SEQ ID NO: 4581940 - DNA, 20 bp, Homo sapiens
tctgaagaggcttctcctgt

SEQ ID NO: 4581941 - DNA, 17 bp, Homo sapiens
tctgaagatcaatttct

SEQ ID NO: 4581942 - DNA, 23 bp, Homo sapiens
tctgaagctcgcatccagacagt

SEQ ID NO: 4581943 - DNA, 16 bp, Homo sapiens
tctgaagtacaaacat

SEQ ID NO: 4581944 - DNA, 14 bp, Homo sapiens
tctgaatacacagt

SEQ ID NO: 4581945 - DNA, 15 bp, Homo sapiens
tctgaatacacagta

SEQ ID NO: 4581946 - DNA, 21 bp, Homo sapiens
tctgaatcaccaattaaaaac

SEQ ID NO: 4581947 - DNA, 15 bp, Homo sapiens
tctgaattattttta

SEQ ID NO: 4581948 - DNA, 22 bp, Homo sapiens
tctgaattggctaaaagacatg

SEQ ID NO: 4581949 - DNA, 18 bp, Homo sapiens
tctgaatttaattctttc

SEQ ID NO: 4581950 - DNA, 16 bp, Homo sapiens
tctgaatttgcaaagt

SEQ ID NO: 4581951 - DNA, 20 bp, Homo sapiens
tctgaatttgcaaagtactg

SEQ ID NO: 4581952 - DNA, 22 bp, Homo sapiens
tctgaatttgcaaagtactgta

SEQ ID NO: 4581953 - DNA, 13 bp, Homo sapiens
tctgaattttcag

SEQ ID NO: 4581954 - DNA, 21 bp, Homo sapiens
tctgaattttggggattttca

SEQ ID NO: 4581955 - DNA, 22 bp, Homo sapiens
tctgaattttggggattttcaa

SEQ ID NO: 4581956 - DNA, 16 bp, Homo sapiens
tctgaatttttaaaca

SEQ ID NO: 4581957 - DNA, 22 bp, Homo sapiens
tctgacaattaacatacatcat

SEQ ID NO: 4581958 - DNA, 16 bp, Homo sapiens
tctgacagaaagcaga

SEQ ID NO: 4581959 - DNA, 13 bp, Homo sapiens
tctgacaggtgaa

SEQ ID NO: 4581960 - DNA, 20 bp, Homo sapiens
tctgaccgattcctttatat

SEQ ID NO: 4581961 - DNA, 14 bp, Homo sapiens
tctgacctcctctg

SEQ ID NO: 4581962 - DNA, 20 bp, Homo sapiens
tctgactcagggctcctggg

SEQ ID NO: 4581963 - DNA, 12 bp, Homo sapiens
tctgactgcccc

SEQ ID NO: 4581964 - DNA, 21 bp, Homo sapiens
tctgactgtccaggagctaat

SEQ ID NO: 4581965 - DNA, 14 bp, Homo sapiens
tctgacttggggac

SEQ ID NO: 4581966 - DNA, 21 bp, Homo sapiens
tctgagaaagactattcaaac

SEQ ID NO: 4581967 - DNA, 18 bp, Homo sapiens
tctgagcaaaggccctgg

SEQ ID NO: 4581968 - DNA, 19 bp, Homo sapiens
tctgagcaaaggccctggg

SEQ ID NO: 4581969 - DNA, 22 bp, Homo sapiens
tctgagcacatttgactccact

SEQ ID NO: 4581970 - DNA, 22 bp, Homo sapiens
tctgagcaggggcccctgggga

SEQ ID NO: 4581971 - DNA, 22 bp, Homo sapiens
tctgagcagtcagggtgggaag

SEQ ID NO: 4581972 - DNA, 21 bp, Homo sapiens
tctgagccacagcagcatttt

SEQ ID NO: 4581973 - DNA, 11 bp, Homo sapiens
tctgagccctg

SEQ ID NO: 4581974 - DNA, 17 bp, Homo sapiens
tctgaggcccctgcctc

SEQ ID NO: 4581975 - DNA, 15 bp, Homo sapiens
tctgaggttttattt

SEQ ID NO: 4581976 - DNA, 14 bp, Homo sapiens
tctgagtagtggcc

SEQ ID NO: 4581977 - DNA, 15 bp, Homo sapiens
tctgagtagtggcca

SEQ ID NO: 4581978 - DNA, 14 bp, Homo sapiens
tctgagtcctgtct

SEQ ID NO: 4581979 - DNA, 22 bp, Homo sapiens
tctgagtcctgtctctgcctgc

SEQ ID NO: 4581980 - DNA, 16 bp, Homo sapiens
tctgagtgccttctgt

SEQ ID NO: 4581981 - DNA, 19 bp, Homo sapiens
tctgagtgccttctgtggg

SEQ ID NO: 4581982 - DNA, 20 bp, Homo sapiens
tctgagttttgtgtttgttg

SEQ ID NO: 4581983 - DNA, 18 bp, Homo sapiens
tctgatagctgtttcaaa

SEQ ID NO: 4581984 - DNA, 22 bp, Homo sapiens
tctgatagctgtttcaaatgtg

SEQ ID NO: 4581985 - DNA, 20 bp, Homo sapiens
tctgatatgtgaatttgttt

SEQ ID NO: 4581986 - DNA, 21 bp, Homo sapiens
tctgatccctctacagagctt

SEQ ID NO: 4581987 - DNA, 17 bp, Homo sapiens
tctgatctgaggctaag

SEQ ID NO: 4581988 - DNA, 17 bp, Homo sapiens
tctgatctgtactttgt

SEQ ID NO: 4581989 - DNA, 18 bp, Homo sapiens
tctgatctgtactttgtg

SEQ ID NO: 4581990 - DNA, 15 bp, Homo sapiens
tctgatctgtgcttt

SEQ ID NO: 4581991 - DNA, 21 bp, Homo sapiens
tctgatctgtgctttccagct

SEQ ID NO: 4581992 - DNA, 20 bp, Homo sapiens
tctgatcttggaaaaacagc

SEQ ID NO: 4581993 - DNA, 13 bp, Homo sapiens
tctgatggcctta

SEQ ID NO: 4581994 - DNA, 20 bp, Homo sapiens
tctgatggccttaatttcct

SEQ ID NO: 4581995 - DNA, 21 bp, Homo sapiens
tctgattataccatgtgtgct

SEQ ID NO: 4581996 - DNA, 13 bp, Homo sapiens
tctgattatgtaa

SEQ ID NO: 4581997 - DNA, 16 bp, Homo sapiens
tctgatttattttgta

SEQ ID NO: 4581998 - DNA, 22 bp, Homo sapiens
tctgatttattttgtatgaaat

SEQ ID NO: 4581999 - DNA, 21 bp, Homo sapiens
tctgatttctgcccttgttcc

SEQ ID NO: 4582000 - DNA, 21 bp, Homo sapiens
tctgatttgtaatgagcacct

SEQ ID NO: 4582001 - DNA, 14 bp, Homo sapiens
tctgattttggcat

SEQ ID NO: 4582002 - DNA, 14 bp, Homo sapiens
tctgcaaatagaaa

SEQ ID NO: 4582003 - DNA, 16 bp, Homo sapiens
tctgcaaatagaaaac

SEQ ID NO: 4582004 - DNA, 21 bp, Homo sapiens
tctgcaaatagaaaacaggaa

SEQ ID NO: 4582005 - DNA, 19 bp, Homo sapiens
tctgcaactccatcctcct

SEQ ID NO: 4582006 - DNA, 17 bp, Homo sapiens
tctgcaagcctcatgcc

SEQ ID NO: 4582007 - DNA, 23 bp, Homo sapiens
tctgcaagggcagaacactaacc

SEQ ID NO: 4582008 - DNA, 21 bp, Homo sapiens
tctgcaattttactgtgaaaa

SEQ ID NO: 4582009 - DNA, 17 bp, Homo sapiens
tctgcacagattctttt

SEQ ID NO: 4582010 - DNA, 18 bp, Homo sapiens
tctgcaccccttctctcc

SEQ ID NO: 4582011 - DNA, 15 bp, Homo sapiens
tctgcacccgcctcg

SEQ ID NO: 4582012 - DNA, 19 bp, Homo sapiens
tctgcaccttagaaaaaaa

SEQ ID NO: 4582013 - DNA, 12 bp, Homo sapiens
tctgcactactc

SEQ ID NO: 4582014 - DNA, 18 bp, Homo sapiens
tctgcactactcctctgc

SEQ ID NO: 4582015 - DNA, 22 bp, Homo sapiens
tctgcactcctttatctgtaat

SEQ ID NO: 4582016 - DNA, 16 bp, Homo sapiens
tctgcagacttcccag

SEQ ID NO: 4582017 - DNA, 22 bp, Homo sapiens
tctgcagatcttccgtggtcag

SEQ ID NO: 4582018 - DNA, 19 bp, Homo sapiens
tctgcagcaactcccacga

SEQ ID NO: 4582019 - DNA, 17 bp, Homo sapiens
tctgcagtaaaacacat

SEQ ID NO: 4582020 - DNA, 18 bp, Homo sapiens
tctgcagtaaaacacatt

SEQ ID NO: 4582021 - DNA, 14 bp, Homo sapiens
tctgcagtctcatt

SEQ ID NO: 4582022 - DNA, 16 bp, Homo sapiens
tctgcagtctcatttc

SEQ ID NO: 4582023 - DNA, 17 bp, Homo sapiens
tctgcagtctcatttct

SEQ ID NO: 4582024 - DNA, 18 bp, Homo sapiens
tctgcagtctcatttctc

SEQ ID NO: 4582025 - DNA, 15 bp, Homo sapiens
tctgcatatgttgaa

SEQ ID NO: 4582026 - DNA, 21 bp, Homo sapiens
tctgcatatgttgaatacttt

SEQ ID NO: 4582027 - DNA, 23 bp, Homo sapiens
tctgcatatgttttccacataaa

SEQ ID NO: 4582028 - DNA, 21 bp, Homo sapiens
tctgcatcagctgctgaaaca

SEQ ID NO: 4582029 - DNA, 14 bp, Homo sapiens
tctgcatgcggccc

SEQ ID NO: 4582030 - DNA, 16 bp, Homo sapiens
tctgcatgcggcccag

SEQ ID NO: 4582031 - DNA, 22 bp, Homo sapiens
tctgcatgcggcccagcccggc

SEQ ID NO: 4582032 - DNA, 23 bp, Homo sapiens
tctgcattactattaactctgca

SEQ ID NO: 4582033 - DNA, 21 bp, Homo sapiens
tctgcattcatttttatagca

SEQ ID NO: 4582034 - DNA, 19 bp, Homo sapiens
tctgcatttaccactgtat

SEQ ID NO: 4582035 - DNA, 17 bp, Homo sapiens
tctgcatttcatattat

SEQ ID NO: 4582036 - DNA, 14 bp, Homo sapiens
tctgcatttgtcta

SEQ ID NO: 4582037 - DNA, 15 bp, Homo sapiens
tctgccaaaatgcaa

SEQ ID NO: 4582038 - DNA, 18 bp, Homo sapiens
tctgccaacctaaaactc

SEQ ID NO: 4582039 - DNA, 17 bp, Homo sapiens
tctgccaagtcagttct

SEQ ID NO: 4582040 - DNA, 20 bp, Homo sapiens
tctgccacctcccctatcca

SEQ ID NO: 4582041 - DNA, 23 bp, Homo sapiens
tctgccacctcccctatccaccc

SEQ ID NO: 4582042 - DNA, 19 bp, Homo sapiens
tctgccagggagcttgaaa

SEQ ID NO: 4582043 - DNA, 16 bp, Homo sapiens
tctgccattctgtgca

SEQ ID NO: 4582044 - DNA, 17 bp, Homo sapiens
tctgccattgggaccct

SEQ ID NO: 4582045 - DNA, 13 bp, Homo sapiens
tctgcccagccgg

SEQ ID NO: 4582046 - DNA, 21 bp, Homo sapiens
tctgccccaatcgggtccaga

SEQ ID NO: 4582047 - DNA, 22 bp, Homo sapiens
tctgcccccgcgggttctagac

SEQ ID NO: 4582048 - DNA, 19 bp, Homo sapiens
tctgcccctgcagctggaa

SEQ ID NO: 4582049 - DNA, 19 bp, Homo sapiens
tctgccctctagagccttc

SEQ ID NO: 4582050 - DNA, 14 bp, Homo sapiens
tctgccctggctgc

SEQ ID NO: 4582051 - DNA, 21 bp, Homo sapiens
tctgcccttgttccagctttg

SEQ ID NO: 4582052 - DNA, 13 bp, Homo sapiens
tctgccgctgcca

SEQ ID NO: 4582053 - DNA, 19 bp, Homo sapiens
tctgccgctgccatgcttt

SEQ ID NO: 4582054 - DNA, 19 bp, Homo sapiens
tctgccggtcgggcagcca

SEQ ID NO: 4582055 - DNA, 21 bp, Homo sapiens
tctgcctatgcactgaagagc

SEQ ID NO: 4582056 - DNA, 22 bp, Homo sapiens
tctgcctatgcactgaagagct

SEQ ID NO: 4582057 - DNA, 21 bp, Homo sapiens
tctgcctcaatgtgaatcaga

SEQ ID NO: 4582058 - DNA, 20 bp, Homo sapiens
tctgcctcagacgttgcctg

SEQ ID NO: 4582059 - DNA, 23 bp, Homo sapiens
tctgcctcagacgttgcctgaga

SEQ ID NO: 4582060 - DNA, 13 bp, Homo sapiens
tctgcctccctct

SEQ ID NO: 4582061 - DNA, 12 bp, Homo sapiens
tctgcctcctgg

SEQ ID NO: 4582062 - DNA, 13 bp, Homo sapiens
tctgcctcctggc

SEQ ID NO: 4582063 - DNA, 13 bp, Homo sapiens
tctgcctcgctca

SEQ ID NO: 4582064 - DNA, 13 bp, Homo sapiens
tctgcctctccag

SEQ ID NO: 4582065 - DNA, 18 bp, Homo sapiens
tctgcctctccaggcatt

SEQ ID NO: 4582066 - DNA, 14 bp, Homo sapiens
tctgcctcttctgg

SEQ ID NO: 4582067 - DNA, 18 bp, Homo sapiens
tctgcctcttctgggagg

SEQ ID NO: 4582068 - DNA, 14 bp, Homo sapiens
tctgcctgccccgc

SEQ ID NO: 4582069 - DNA, 15 bp, Homo sapiens
tctgcctgcggccca

SEQ ID NO: 4582070 - DNA, 23 bp, Homo sapiens
tctgcctggagacaaggtgctaa

SEQ ID NO: 4582071 - DNA, 21 bp, Homo sapiens
tctgcctgggttttgttccct

SEQ ID NO: 4582072 - DNA, 19 bp, Homo sapiens
tctgcctggttccctcccc

SEQ ID NO: 4582073 - DNA, 22 bp, Homo sapiens
tctgcctggttccctccccaag

SEQ ID NO: 4582074 - DNA, 21 bp, Homo sapiens
tctgcctggttttatttatat

SEQ ID NO: 4582075 - DNA, 15 bp, Homo sapiens
tctgcctgttataac

SEQ ID NO: 4582076 - DNA, 20 bp, Homo sapiens
tctgccttaaaaccaaagag

SEQ ID NO: 4582077 - DNA, 15 bp, Homo sapiens
tctgccttcacaaat

SEQ ID NO: 4582078 - DNA, 16 bp, Homo sapiens
tctgccttgcactgtg

SEQ ID NO: 4582079 - DNA, 23 bp, Homo sapiens
tctgccttgccctcctgggccct

SEQ ID NO: 4582080 - DNA, 22 bp, Homo sapiens
tctgcggagcacactggctcac

SEQ ID NO: 4582081 - DNA, 18 bp, Homo sapiens
tctgcgggaggctggggc

SEQ ID NO: 4582082 - DNA, 17 bp, Homo sapiens
tctgcgtgggtcagaag

SEQ ID NO: 4582083 - DNA, 19 bp, Homo sapiens
tctgcgtgtcacctgtgct

SEQ ID NO: 4582084 - DNA, 18 bp, Homo sapiens
tctgctaaatatcaccta

SEQ ID NO: 4582085 - DNA, 20 bp, Homo sapiens
tctgctaaccatttatataa

SEQ ID NO: 4582086 - DNA, 16 bp, Homo sapiens
tctgctactttgctgc

SEQ ID NO: 4582087 - DNA, 17 bp, Homo sapiens
tctgctagagcagacag

SEQ ID NO: 4582088 - DNA, 22 bp, Homo sapiens
tctgctagagcagacaggcctg

SEQ ID NO: 4582089 - DNA, 16 bp, Homo sapiens
tctgctatatataaaa

SEQ ID NO: 4582090 - DNA, 20 bp, Homo sapiens
tctgctcaccgcccatcagg

SEQ ID NO: 4582091 - DNA, 16 bp, Homo sapiens
tctgctcattaaactg

SEQ ID NO: 4582092 - DNA, 20 bp, Homo sapiens
tctgctccaccacatcctcc

SEQ ID NO: 4582093 - DNA, 12 bp, Homo sapiens
tctgctccaccc

SEQ ID NO: 4582094 - DNA, 14 bp, Homo sapiens
tctgctccaccctt

SEQ ID NO: 4582095 - DNA, 18 bp, Homo sapiens
tctgctccacccttggcc

SEQ ID NO: 4582096 - DNA, 16 bp, Homo sapiens
tctgctccataccttt

SEQ ID NO: 4582097 - DNA, 17 bp, Homo sapiens
tctgctccctgcaagct

SEQ ID NO: 4582098 - DNA, 21 bp, Homo sapiens
tctgctctgcgtgtcacctgt

SEQ ID NO: 4582099 - DNA, 14 bp, Homo sapiens
tctgctctgctgct

SEQ ID NO: 4582100 - DNA, 18 bp, Homo sapiens
tctgctctggttgtttct

SEQ ID NO: 4582101 - DNA, 14 bp, Homo sapiens
tctgctctttacat

SEQ ID NO: 4582102 - DNA, 19 bp, Homo sapiens
tctgctgagaggcaccagt

SEQ ID NO: 4582103 - DNA, 17 bp, Homo sapiens
tctgctgagttggcctg

SEQ ID NO: 4582104 - DNA, 12 bp, Homo sapiens
tctgctgcatcg

SEQ ID NO: 4582105 - DNA, 15 bp, Homo sapiens
tctgctgcatcgctg

SEQ ID NO: 4582106 - DNA, 11 bp, Homo sapiens
tctgctgcttt

SEQ ID NO: 4582107 - DNA, 12 bp, Homo sapiens
tctgctgctttt

SEQ ID NO: 4582108 - DNA, 22 bp, Homo sapiens
tctgctggagaaagccacgccc

SEQ ID NO: 4582109 - DNA, 13 bp, Homo sapiens
tctgctggagttt

SEQ ID NO: 4582110 - DNA, 23 bp, Homo sapiens
tctgctggagtttcatgtacaag

SEQ ID NO: 4582111 - DNA, 17 bp, Homo sapiens
tctgctgggctctgcct

SEQ ID NO: 4582112 - DNA, 14 bp, Homo sapiens
tctgctgtccagac

SEQ ID NO: 4582113 - DNA, 15 bp, Homo sapiens
tctgctgtccagaca

SEQ ID NO: 4582114 - DNA, 18 bp, Homo sapiens
tctgctgtccagacagcc

SEQ ID NO: 4582115 - DNA, 19 bp, Homo sapiens
tctgctgttacgtttgaag

SEQ ID NO: 4582116 - DNA, 20 bp, Homo sapiens
tctgctgttacgtttgaagt

SEQ ID NO: 4582117 - DNA, 15 bp, Homo sapiens
tctgctgttccagtg

SEQ ID NO: 4582118 - DNA, 18 bp, Homo sapiens
tctgcttgatttttgcct

SEQ ID NO: 4582119 - DNA, 19 bp, Homo sapiens
tctgcttgcatctgcacat

SEQ ID NO: 4582120 - DNA, 17 bp, Homo sapiens
tctgctttctcctttaa

SEQ ID NO: 4582121 - DNA, 16 bp, Homo sapiens
tctgcttttaagtttt

SEQ ID NO: 4582122 - DNA, 21 bp, Homo sapiens
tctgcttttttggctgctctt

SEQ ID NO: 4582123 - DNA, 20 bp, Homo sapiens
tctggaaagttttctccact

SEQ ID NO: 4582124 - DNA, 17 bp, Homo sapiens
tctggaagacgtggctc

SEQ ID NO: 4582125 - DNA, 18 bp, Homo sapiens
tctggaagacgtggctct

SEQ ID NO: 4582126 - DNA, 13 bp, Homo sapiens
tctggaagactgc

SEQ ID NO: 4582127 - DNA, 18 bp, Homo sapiens
tctggaagactgctcccg

SEQ ID NO: 4582128 - DNA, 12 bp, Homo sapiens
tctggaagcaaa

SEQ ID NO: 4582129 - DNA, 18 bp, Homo sapiens
tctggaagtttctggtgc

SEQ ID NO: 4582130 - DNA, 18 bp, Homo sapiens
tctggaatgcttgctgta

SEQ ID NO: 4582131 - DNA, 21 bp, Homo sapiens
tctggaatgtttttccctccc

SEQ ID NO: 4582132 - DNA, 16 bp, Homo sapiens
tctggacagcagaagc

SEQ ID NO: 4582133 - DNA, 20 bp, Homo sapiens
tctggacagcagaagcctcc

SEQ ID NO: 4582134 - DNA, 21 bp, Homo sapiens
tctggaccccgtttcattttt

SEQ ID NO: 4582135 - DNA, 14 bp, Homo sapiens
tctggacggcaggc

SEQ ID NO: 4582136 - DNA, 21 bp, Homo sapiens
tctggacggcaggctcactgc

SEQ ID NO: 4582137 - DNA, 14 bp, Homo sapiens
tctggactctgccc

SEQ ID NO: 4582138 - DNA, 15 bp, Homo sapiens
tctggactggctaga

SEQ ID NO: 4582139 - DNA, 14 bp, Homo sapiens
tctggagagaacag

SEQ ID NO: 4582140 - DNA, 13 bp, Homo sapiens
tctggagagctag

SEQ ID NO: 4582141 - DNA, 23 bp, Homo sapiens
tctggagagctagaacctggagg

SEQ ID NO: 4582142 - DNA, 15 bp, Homo sapiens
tctggagcatttctc

SEQ ID NO: 4582143 - DNA, 20 bp, Homo sapiens
tctggagctgggagacaaag

SEQ ID NO: 4582144 - DNA, 17 bp, Homo sapiens
tctggaggctgcagagc

SEQ ID NO: 4582145 - DNA, 24 bp, Homo sapiens
tctggaggctgcagagctgaccca

SEQ ID NO: 4582146 - DNA, 17 bp, Homo sapiens
tctggagtattctataa

SEQ ID NO: 4582147 - DNA, 18 bp, Homo sapiens
tctggatggtgtgccttc

SEQ ID NO: 4582148 - DNA, 22 bp, Homo sapiens
tctggcaaaaaggagccttttg

SEQ ID NO: 4582149 - DNA, 21 bp, Homo sapiens
tctggcactattataagtgct

SEQ ID NO: 4582150 - DNA, 11 bp, Homo sapiens
tctggccaggc

SEQ ID NO: 4582151 - DNA, 21 bp, Homo sapiens
tctggccctggggatcttccc

SEQ ID NO: 4582152 - DNA, 21 bp, Homo sapiens
tctggccgtccttgtctctgg

SEQ ID NO: 4582153 - DNA, 22 bp, Homo sapiens
tctggcctaggacccctcgcct

SEQ ID NO: 4582154 - DNA, 20 bp, Homo sapiens
tctggcgttctcaagaatct

SEQ ID NO: 4582155 - DNA, 14 bp, Homo sapiens
tctggctacctgtt

SEQ ID NO: 4582156 - DNA, 23 bp, Homo sapiens
tctggctcggacccaccccaact

SEQ ID NO: 4582157 - DNA, 13 bp, Homo sapiens
tctggctctgcct

SEQ ID NO: 4582158 - DNA, 21 bp, Homo sapiens
tctggctggctaactggaagc

SEQ ID NO: 4582159 - DNA, 19 bp, Homo sapiens
tctggctgtgatcttaaaa

SEQ ID NO: 4582160 - DNA, 16 bp, Homo sapiens
tctggcttagtgccac

SEQ ID NO: 4582161 - DNA, 22 bp, Homo sapiens
tctggcttagtgccacccacct

SEQ ID NO: 4582162 - DNA, 15 bp, Homo sapiens
tctggctttcccagg

SEQ ID NO: 4582163 - DNA, 16 bp, Homo sapiens
tctggctttcccagga

SEQ ID NO: 4582164 - DNA, 22 bp, Homo sapiens
tctgggaaatgagaaggcagcc

SEQ ID NO: 4582165 - DNA, 22 bp, Homo sapiens
tctgggaacttgcgagtccaag

SEQ ID NO: 4582166 - DNA, 15 bp, Homo sapiens
tctgggaccctttcc

SEQ ID NO: 4582167 - DNA, 21 bp, Homo sapiens
tctgggacctgccaggcaggg

SEQ ID NO: 4582168 - DNA, 18 bp, Homo sapiens
tctgggactgtgcctggc

SEQ ID NO: 4582169 - DNA, 13 bp, Homo sapiens
tctgggagggcag

SEQ ID NO: 4582170 - DNA, 19 bp, Homo sapiens
tctgggagggcagcagggc

SEQ ID NO: 4582171 - DNA, 21 bp, Homo sapiens
tctgggatatggctgcccagg

SEQ ID NO: 4582172 - DNA, 23 bp, Homo sapiens
tctgggatatggctgcccaggag

SEQ ID NO: 4582173 - DNA, 20 bp, Homo sapiens
tctgggcaccacaaaatata

SEQ ID NO: 4582174 - DNA, 18 bp, Homo sapiens
tctgggcattttcctcct

SEQ ID NO: 4582175 - DNA, 17 bp, Homo sapiens
tctgggctaggtagaaa

SEQ ID NO: 4582176 - DNA, 20 bp, Homo sapiens
tctgggctaggtagaaaaag

SEQ ID NO: 4582177 - DNA, 19 bp, Homo sapiens
tctgggctggggccacctt

SEQ ID NO: 4582178 - DNA, 20 bp, Homo sapiens
tctggggaagaggttttatt

SEQ ID NO: 4582179 - DNA, 21 bp, Homo sapiens
tctggggaagaggttttattt

SEQ ID NO: 4582180 - DNA, 20 bp, Homo sapiens
tctggggacgttgctgagcc

SEQ ID NO: 4582181 - DNA, 16 bp, Homo sapiens
tctggggatttctggg

SEQ ID NO: 4582182 - DNA, 17 bp, Homo sapiens
tctggggcaggctgggc

SEQ ID NO: 4582183 - DNA, 18 bp, Homo sapiens
tctggggcaggctgggcc

SEQ ID NO: 4582184 - DNA, 15 bp, Homo sapiens
tctggggccctgggc

SEQ ID NO: 4582185 - DNA, 19 bp, Homo sapiens
tctggggccctgggcctca

SEQ ID NO: 4582186 - DNA, 20 bp, Homo sapiens
tctggggccctgggcctcag

SEQ ID NO: 4582187 - DNA, 15 bp, Homo sapiens
tctggggctgtgtta

SEQ ID NO: 4582188 - DNA, 16 bp, Homo sapiens
tctggggttcagcccc

SEQ ID NO: 4582189 - DNA, 17 bp, Homo sapiens
tctggggttcagcccct

SEQ ID NO: 4582190 - DNA, 19 bp, Homo sapiens
tctggggttcagcccctcc

SEQ ID NO: 4582191 - DNA, 17 bp, Homo sapiens
tctgggtaagaagaaag

SEQ ID NO: 4582192 - DNA, 15 bp, Homo sapiens
tctgggtccagggag

SEQ ID NO: 4582193 - DNA, 18 bp, Homo sapiens
tctgggtttctaagcagt

SEQ ID NO: 4582194 - DNA, 21 bp, Homo sapiens
tctggtaaacattcctccagc

SEQ ID NO: 4582195 - DNA, 19 bp, Homo sapiens
tctggtatgcattctttat

SEQ ID NO: 4582196 - DNA, 20 bp, Homo sapiens
tctggtatgcattctttata

SEQ ID NO: 4582197 - DNA, 14 bp, Homo sapiens
tctggtattaaatg

SEQ ID NO: 4582198 - DNA, 20 bp, Homo sapiens
tctggttctaactgctgtta

SEQ ID NO: 4582199 - DNA, 13 bp, Homo sapiens
tctggttgcctcc

SEQ ID NO: 4582200 - DNA, 14 bp, Homo sapiens
tctggttgcctccc

SEQ ID NO: 4582201 - DNA, 15 bp, Homo sapiens
tctggttgtttctgt

SEQ ID NO: 4582202 - DNA, 20 bp, Homo sapiens
tctggttgtttctgttccaa

SEQ ID NO: 4582203 - DNA, 22 bp, Homo sapiens
tctggttgtttctgttccaaat

SEQ ID NO: 4582204 - DNA, 19 bp, Homo sapiens
tctggtttcttccagccac

SEQ ID NO: 4582205 - DNA, 14 bp, Homo sapiens
tctgtaaaacacac

SEQ ID NO: 4582206 - DNA, 12 bp, Homo sapiens
tctgtaaactgt

SEQ ID NO: 4582207 - DNA, 14 bp, Homo sapiens
tctgtaaactgtgt

SEQ ID NO: 4582208 - DNA, 17 bp, Homo sapiens
tctgtaataaaactgtt

SEQ ID NO: 4582209 - DNA, 19 bp, Homo sapiens
tctgtaatatttacaatgt

SEQ ID NO: 4582210 - DNA, 23 bp, Homo sapiens
tctgtaatatttacaatgtatta

SEQ ID NO: 4582211 - DNA, 13 bp, Homo sapiens
tctgtaatgatac

SEQ ID NO: 4582212 - DNA, 17 bp, Homo sapiens
tctgtaatgtaaataaa

SEQ ID NO: 4582213 - DNA, 19 bp, Homo sapiens
tctgtaattgtaattccaa

SEQ ID NO: 4582214 - DNA, 14 bp, Homo sapiens
tctgtaattttacg

SEQ ID NO: 4582215 - DNA, 21 bp, Homo sapiens
tctgtacagcaagatgtttct

SEQ ID NO: 4582216 - DNA, 15 bp, Homo sapiens
tctgtacatttgcaa

SEQ ID NO: 4582217 - DNA, 22 bp, Homo sapiens
tctgtaccagttaatttttcca

SEQ ID NO: 4582218 - DNA, 20 bp, Homo sapiens
tctgtacttttcattctctt

SEQ ID NO: 4582219 - DNA, 22 bp, Homo sapiens
tctgtagagagcagcattccca

SEQ ID NO: 4582220 - DNA, 16 bp, Homo sapiens
tctgtagagggccctg

SEQ ID NO: 4582221 - DNA, 17 bp, Homo sapiens
tctgtagagggccctgg

SEQ ID NO: 4582222 - DNA, 18 bp, Homo sapiens
tctgtagagggccctggt

SEQ ID NO: 4582223 - DNA, 20 bp, Homo sapiens
tctgtagcaaatttgtttaa

SEQ ID NO: 4582224 - DNA, 23 bp, Homo sapiens
tctgtagcaaatttgtttaatct

SEQ ID NO: 4582225 - DNA, 20 bp, Homo sapiens
tctgtagcttatctgcccct

SEQ ID NO: 4582226 - DNA, 20 bp, Homo sapiens
tctgtagggtaattagtaac

SEQ ID NO: 4582227 - DNA, 15 bp, Homo sapiens
tctgtagtaatttat

SEQ ID NO: 4582228 - DNA, 23 bp, Homo sapiens
tctgtagtaatttattgtctgtc

SEQ ID NO: 4582229 - DNA, 20 bp, Homo sapiens
tctgtagttcaatttcatgt

SEQ ID NO: 4582230 - DNA, 16 bp, Homo sapiens
tctgtataatactttg

SEQ ID NO: 4582231 - DNA, 15 bp, Homo sapiens
tctgtataatagaga

SEQ ID NO: 4582232 - DNA, 22 bp, Homo sapiens
tctgtattgtctattatttaga

SEQ ID NO: 4582233 - DNA, 23 bp, Homo sapiens
tctgtatttatgtgtgaggagct

SEQ ID NO: 4582234 - DNA, 15 bp, Homo sapiens
tctgtcacaccagcc

SEQ ID NO: 4582235 - DNA, 19 bp, Homo sapiens
tctgtcacagtaaaaataa

SEQ ID NO: 4582236 - DNA, 13 bp, Homo sapiens
tctgtcagccagc

SEQ ID NO: 4582237 - DNA, 17 bp, Homo sapiens
tctgtcagccagccgcc

SEQ ID NO: 4582238 - DNA, 20 bp, Homo sapiens
tctgtcagccagccgccctg

SEQ ID NO: 4582239 - DNA, 14 bp, Homo sapiens
tctgtcagctgcaa

SEQ ID NO: 4582240 - DNA, 17 bp, Homo sapiens
tctgtcatctctctggg

SEQ ID NO: 4582241 - DNA, 18 bp, Homo sapiens
tctgtcatctctctgggg

SEQ ID NO: 4582242 - DNA, 23 bp, Homo sapiens
tctgtccaaaggaggctggcagg

SEQ ID NO: 4582243 - DNA, 15 bp, Homo sapiens
tctgtccctgtcctt

SEQ ID NO: 4582244 - DNA, 19 bp, Homo sapiens
tctgtccctgtccttccct

SEQ ID NO: 4582245 - DNA, 14 bp, Homo sapiens
tctgtcgcccaggc

SEQ ID NO: 4582246 - DNA, 15 bp, Homo sapiens
tctgtctacatttct

SEQ ID NO: 4582247 - DNA, 18 bp, Homo sapiens
tctgtctaggttaaagct

SEQ ID NO: 4582248 - DNA, 17 bp, Homo sapiens
tctgtctcatccatcat

SEQ ID NO: 4582249 - DNA, 15 bp, Homo sapiens
tctgtctccagcttc

SEQ ID NO: 4582250 - DNA, 17 bp, Homo sapiens
tctgtctccagcttccc

SEQ ID NO: 4582251 - DNA, 21 bp, Homo sapiens
tctgtctgccaacctaaaact

SEQ ID NO: 4582252 - DNA, 15 bp, Homo sapiens
tctgtcttttttctc

SEQ ID NO: 4582253 - DNA, 16 bp, Homo sapiens
tctgtgaaatatcatc

SEQ ID NO: 4582254 - DNA, 20 bp, Homo sapiens
tctgtgaagcctttatctat

SEQ ID NO: 4582255 - DNA, 16 bp, Homo sapiens
tctgtgaccaatgtct

SEQ ID NO: 4582256 - DNA, 16 bp, Homo sapiens
tctgtgacccatctgt

SEQ ID NO: 4582257 - DNA, 20 bp, Homo sapiens
tctgtgacccatctgtagta

SEQ ID NO: 4582258 - DNA, 19 bp, Homo sapiens
tctgtgacctgtcagaata

SEQ ID NO: 4582259 - DNA, 20 bp, Homo sapiens
tctgtgacctgtcagaataa

SEQ ID NO: 4582260 - DNA, 21 bp, Homo sapiens
tctgtgagactcgagaacttt

SEQ ID NO: 4582261 - DNA, 15 bp, Homo sapiens
tctgtgatctctgct

SEQ ID NO: 4582262 - DNA, 17 bp, Homo sapiens
tctgtgatctctgctgg

SEQ ID NO: 4582263 - DNA, 16 bp, Homo sapiens
tctgtgatgatcctca

SEQ ID NO: 4582264 - DNA, 12 bp, Homo sapiens
tctgtgcaaaca

SEQ ID NO: 4582265 - DNA, 17 bp, Homo sapiens
tctgtgcacatgcctct

SEQ ID NO: 4582266 - DNA, 18 bp, Homo sapiens
tctgtgcacatgcctctg

SEQ ID NO: 4582267 - DNA, 17 bp, Homo sapiens
tctgtgccccatgcctg

SEQ ID NO: 4582268 - DNA, 14 bp, Homo sapiens
tctgtgcctccccc

SEQ ID NO: 4582269 - DNA, 17 bp, Homo sapiens
tctgtgcctccccccag

SEQ ID NO: 4582270 - DNA, 15 bp, Homo sapiens
tctgtgcctgaatat

SEQ ID NO: 4582271 - DNA, 14 bp, Homo sapiens
tctgtgcttctaat

SEQ ID NO: 4582272 - DNA, 12 bp, Homo sapiens
tctgtgcttgga

SEQ ID NO: 4582273 - DNA, 14 bp, Homo sapiens
tctgtgctttccag

SEQ ID NO: 4582274 - DNA, 17 bp, Homo sapiens
tctgtgctttccagctc

SEQ ID NO: 4582275 - DNA, 22 bp, Homo sapiens
tctgtggctttttgttcagaat

SEQ ID NO: 4582276 - DNA, 23 bp, Homo sapiens
tctgtgggatgctgaaggagatg

SEQ ID NO: 4582277 - DNA, 23 bp, Homo sapiens
tctgtgggatgggatggtggagg

SEQ ID NO: 4582278 - DNA, 22 bp, Homo sapiens
tctgtgggtgatggggaggggc

SEQ ID NO: 4582279 - DNA, 18 bp, Homo sapiens
tctgtggttcctctgctc

SEQ ID NO: 4582280 - DNA, 19 bp, Homo sapiens
tctgtggttcctctgctca

SEQ ID NO: 4582281 - DNA, 20 bp, Homo sapiens
tctgtggttcctctgctcac

SEQ ID NO: 4582282 - DNA, 13 bp, Homo sapiens
tctgtgtatatct

SEQ ID NO: 4582283 - DNA, 18 bp, Homo sapiens
tctgtgtatatctcttgg

SEQ ID NO: 4582284 - DNA, 20 bp, Homo sapiens
tctgtgtatttaattgtaaa

SEQ ID NO: 4582285 - DNA, 22 bp, Homo sapiens
tctgtgtatttaattgtaaact

SEQ ID NO: 4582286 - DNA, 21 bp, Homo sapiens
tctgtgtcagagcccagccca

SEQ ID NO: 4582287 - DNA, 14 bp, Homo sapiens
tctgtgtcagcatt

SEQ ID NO: 4582288 - DNA, 12 bp, Homo sapiens
tctgtgtcttgt

SEQ ID NO: 4582289 - DNA, 15 bp, Homo sapiens
tctgtgtgcatattt

SEQ ID NO: 4582290 - DNA, 17 bp, Homo sapiens
tctgtgtgcatatttgt

SEQ ID NO: 4582291 - DNA, 16 bp, Homo sapiens
tctgtgtggctgtgca

SEQ ID NO: 4582292 - DNA, 15 bp, Homo sapiens
tctgtgtgtgtgtat

SEQ ID NO: 4582293 - DNA, 21 bp, Homo sapiens
tctgtgtgtgtgtatgtgggg

SEQ ID NO: 4582294 - DNA, 22 bp, Homo sapiens
tctgtgtgtgtgtatgtggggg

SEQ ID NO: 4582295 - DNA, 12 bp, Homo sapiens
tctgtgttgctt

SEQ ID NO: 4582296 - DNA, 13 bp, Homo sapiens
tctgttaatgtgg

SEQ ID NO: 4582297 - DNA, 15 bp, Homo sapiens
tctgttacccaggct

SEQ ID NO: 4582298 - DNA, 23 bp, Homo sapiens
tctgttatttattattaatttat

SEQ ID NO: 4582299 - DNA, 19 bp, Homo sapiens
tctgttatttttaagcttt

SEQ ID NO: 4582300 - DNA, 13 bp, Homo sapiens
tctgttccaaatg

SEQ ID NO: 4582301 - DNA, 19 bp, Homo sapiens
tctgttccaaattcagttt

SEQ ID NO: 4582302 - DNA, 17 bp, Homo sapiens
tctgttccatgcaactg

SEQ ID NO: 4582303 - DNA, 13 bp, Homo sapiens
tctgttcccagcc

SEQ ID NO: 4582304 - DNA, 16 bp, Homo sapiens
tctgttcccagcccct

SEQ ID NO: 4582305 - DNA, 21 bp, Homo sapiens
tctgttcccagcccctcctcc

SEQ ID NO: 4582306 - DNA, 22 bp, Homo sapiens
tctgttcccagcccctgcagat

SEQ ID NO: 4582307 - DNA, 20 bp, Homo sapiens
tctgttctagttttttactt

SEQ ID NO: 4582308 - DNA, 18 bp, Homo sapiens
tctgttggagttccctca

SEQ ID NO: 4582309 - DNA, 17 bp, Homo sapiens
tctgtttagaggaggca

SEQ ID NO: 4582310 - DNA, 20 bp, Homo sapiens
tctgtttcagagcataaaac

SEQ ID NO: 4582311 - DNA, 18 bp, Homo sapiens
tctgtttcctatttaata

SEQ ID NO: 4582312 - DNA, 12 bp, Homo sapiens
tctgtttctagt

SEQ ID NO: 4582313 - DNA, 16 bp, Homo sapiens
tctgtttctctgctgt

SEQ ID NO: 4582314 - DNA, 16 bp, Homo sapiens
tctgtttgattctttt

SEQ ID NO: 4582315 - DNA, 16 bp, Homo sapiens
tctgtttgcgtacttg

SEQ ID NO: 4582316 - DNA, 12 bp, Homo sapiens
tctgttttctct

SEQ ID NO: 4582317 - DNA, 20 bp, Homo sapiens
tctgttttgtggtttggaat

SEQ ID NO: 4582318 - DNA, 15 bp, Homo sapiens
tctgttttgttaata

SEQ ID NO: 4582319 - DNA, 16 bp, Homo sapiens
tctgttttgttaatat

SEQ ID NO: 4582320 - DNA, 16 bp, Homo sapiens
tcttaaaaaatgtgaa

SEQ ID NO: 4582321 - DNA, 17 bp, Homo sapiens
tcttaaaaaatgtgaaa

SEQ ID NO: 4582322 - DNA, 18 bp, Homo sapiens
tcttaaaacacatgatac

SEQ ID NO: 4582323 - DNA, 18 bp, Homo sapiens
tcttaaaactataacatt

SEQ ID NO: 4582324 - DNA, 23 bp, Homo sapiens
tcttaaaactataacattatata

SEQ ID NO: 4582325 - DNA, 22 bp, Homo sapiens
tcttaaaataattcatatctaa

SEQ ID NO: 4582326 - DNA, 18 bp, Homo sapiens
tcttaaactgaaagcttt

SEQ ID NO: 4582327 - DNA, 14 bp, Homo sapiens
tcttaaacttgtga

SEQ ID NO: 4582328 - DNA, 18 bp, Homo sapiens
tcttaaagtattcttctc

SEQ ID NO: 4582329 - DNA, 18 bp, Homo sapiens
tcttaaataagaaacttt

SEQ ID NO: 4582330 - DNA, 13 bp, Homo sapiens
tcttaaatcattt

SEQ ID NO: 4582331 - DNA, 19 bp, Homo sapiens
tcttaaattatatatttat

SEQ ID NO: 4582332 - DNA, 12 bp, Homo sapiens
tcttaaattatt

SEQ ID NO: 4582333 - DNA, 20 bp, Homo sapiens
tcttaacctttgctatgtaa

SEQ ID NO: 4582334 - DNA, 14 bp, Homo sapiens
tcttaactgtattt

SEQ ID NO: 4582335 - DNA, 15 bp, Homo sapiens
tcttaactgtatttc

SEQ ID NO: 4582336 - DNA, 17 bp, Homo sapiens
tcttaactgtatttcag

SEQ ID NO: 4582337 - DNA, 17 bp, Homo sapiens
tcttaagaattcaaatt

SEQ ID NO: 4582338 - DNA, 16 bp, Homo sapiens
tcttaagacagcatgt

SEQ ID NO: 4582339 - DNA, 16 bp, Homo sapiens
tcttaagattaatttt

SEQ ID NO: 4582340 - DNA, 18 bp, Homo sapiens
tcttaagtcagattttta

SEQ ID NO: 4582341 - DNA, 14 bp, Homo sapiens
tcttaatataaatt

SEQ ID NO: 4582342 - DNA, 15 bp, Homo sapiens
tcttaatatatttga

SEQ ID NO: 4582343 - DNA, 14 bp, Homo sapiens
tcttaattaaaaga

SEQ ID NO: 4582344 - DNA, 21 bp, Homo sapiens
tcttaattaaaagaatatttt

SEQ ID NO: 4582345 - DNA, 22 bp, Homo sapiens
tcttaattattataaaaatatt

SEQ ID NO: 4582346 - DNA, 19 bp, Homo sapiens
tcttaattgcaagtctgcc

SEQ ID NO: 4582347 - DNA, 18 bp, Homo sapiens
tcttaattgtgtttattt

SEQ ID NO: 4582348 - DNA, 22 bp, Homo sapiens
tcttaattgtgtttatttttta

SEQ ID NO: 4582349 - DNA, 14 bp, Homo sapiens
tcttacaagcttaa

SEQ ID NO: 4582350 - DNA, 17 bp, Homo sapiens
tcttacctactattggc

SEQ ID NO: 4582351 - DNA, 17 bp, Homo sapiens
tcttagaagaatattgt

SEQ ID NO: 4582352 - DNA, 20 bp, Homo sapiens
tcttagaagaatattgtatt

SEQ ID NO: 4582353 - DNA, 21 bp, Homo sapiens
tcttagaagtggaccaggaca

SEQ ID NO: 4582354 - DNA, 18 bp, Homo sapiens
tcttagaatttgtttcat

SEQ ID NO: 4582355 - DNA, 21 bp, Homo sapiens
tcttagagccaagtgtctttt

SEQ ID NO: 4582356 - DNA, 23 bp, Homo sapiens
tcttagaggggtattcttcttga

SEQ ID NO: 4582357 - DNA, 13 bp, Homo sapiens
tcttagctcccct

SEQ ID NO: 4582358 - DNA, 16 bp, Homo sapiens
tcttagctcccctcca

SEQ ID NO: 4582359 - DNA, 17 bp, Homo sapiens
tcttaggggattatctt

SEQ ID NO: 4582360 - DNA, 21 bp, Homo sapiens
tcttataattgttctcagaat

SEQ ID NO: 4582361 - DNA, 19 bp, Homo sapiens
tcttatattggtttgcaca

SEQ ID NO: 4582362 - DNA, 22 bp, Homo sapiens
tcttatattggtttgcacaagt

SEQ ID NO: 4582363 - DNA, 14 bp, Homo sapiens
tcttatgccttttc

SEQ ID NO: 4582364 - DNA, 21 bp, Homo sapiens
tcttatgctctcactgtttgt

SEQ ID NO: 4582365 - DNA, 14 bp, Homo sapiens
tcttatggaattga

SEQ ID NO: 4582366 - DNA, 15 bp, Homo sapiens
tcttatggaattgat

SEQ ID NO: 4582367 - DNA, 17 bp, Homo sapiens
tcttatggaattgattt

SEQ ID NO: 4582368 - DNA, 22 bp, Homo sapiens
tcttatggaattgatttgcatt

SEQ ID NO: 4582369 - DNA, 12 bp, Homo sapiens
tcttatgtgaca

SEQ ID NO: 4582370 - DNA, 16 bp, Homo sapiens
tcttatgtgacattaa

SEQ ID NO: 4582371 - DNA, 20 bp, Homo sapiens
tcttattaatcatacaaact

SEQ ID NO: 4582372 - DNA, 22 bp, Homo sapiens
tcttattaatcatacaaactct

SEQ ID NO: 4582373 - DNA, 17 bp, Homo sapiens
tcttattcaaagatgat

SEQ ID NO: 4582374 - DNA, 17 bp, Homo sapiens
tcttattgaataaagag

SEQ ID NO: 4582375 - DNA, 23 bp, Homo sapiens
tcttatttacagataacttcttt

SEQ ID NO: 4582376 - DNA, 17 bp, Homo sapiens
tcttatttacccttttc

SEQ ID NO: 4582377 - DNA, 13 bp, Homo sapiens
tcttatttatttt

SEQ ID NO: 4582378 - DNA, 20 bp, Homo sapiens
tcttatttattttagcaaat

SEQ ID NO: 4582379 - DNA, 16 bp, Homo sapiens
tcttatttctttcctt

SEQ ID NO: 4582380 - DNA, 12 bp, Homo sapiens
tcttatttttcc

SEQ ID NO: 4582381 - DNA, 16 bp, Homo sapiens
tcttatttttcctgtc

SEQ ID NO: 4582382 - DNA, 15 bp, Homo sapiens
tcttcaaatatctct

SEQ ID NO: 4582383 - DNA, 16 bp, Homo sapiens
tcttcaataaaccaca

SEQ ID NO: 4582384 - DNA, 19 bp, Homo sapiens
tcttcaccaagtgcaatag

SEQ ID NO: 4582385 - DNA, 17 bp, Homo sapiens
tcttcaccatttggcaa

SEQ ID NO: 4582386 - DNA, 16 bp, Homo sapiens
tcttcagaactgccct

SEQ ID NO: 4582387 - DNA, 19 bp, Homo sapiens
tcttcagaactgcccttgc

SEQ ID NO: 4582388 - DNA, 20 bp, Homo sapiens
tcttcagaactgcccttgct

SEQ ID NO: 4582389 - DNA, 22 bp, Homo sapiens
tcttcagactctcagcccagaa

SEQ ID NO: 4582390 - DNA, 15 bp, Homo sapiens
tcttcagaggccctc

SEQ ID NO: 4582391 - DNA, 21 bp, Homo sapiens
tcttcagaggtgctaaattgt

SEQ ID NO: 4582392 - DNA, 11 bp, Homo sapiens
tcttcagcttt

SEQ ID NO: 4582393 - DNA, 15 bp, Homo sapiens
tcttcaggcctccct

SEQ ID NO: 4582394 - DNA, 23 bp, Homo sapiens
tcttcaggtggaaaaacatctga

SEQ ID NO: 4582395 - DNA, 19 bp, Homo sapiens
tcttcagtgggagaaaaca

SEQ ID NO: 4582396 - DNA, 19 bp, Homo sapiens
tcttcatccatagacacag

SEQ ID NO: 4582397 - DNA, 19 bp, Homo sapiens
tcttcattgtaatctgcaa

SEQ ID NO: 4582398 - DNA, 16 bp, Homo sapiens
tcttcattttttaatg

SEQ ID NO: 4582399 - DNA, 17 bp, Homo sapiens
tcttcattttttaatgt

SEQ ID NO: 4582400 - DNA, 20 bp, Homo sapiens
tcttccatcatcactgtaaa

SEQ ID NO: 4582401 - DNA, 13 bp, Homo sapiens
tcttccatttgca

SEQ ID NO: 4582402 - DNA, 14 bp, Homo sapiens
tcttccatttgcaa

SEQ ID NO: 4582403 - DNA, 14 bp, Homo sapiens
tcttcccagggtag

SEQ ID NO: 4582404 - DNA, 21 bp, Homo sapiens
tcttcccagggtagcccgcct

SEQ ID NO: 4582405 - DNA, 16 bp, Homo sapiens
tcttcccatcactgga

SEQ ID NO: 4582406 - DNA, 17 bp, Homo sapiens
tcttcccatcactggag

SEQ ID NO: 4582407 - DNA, 21 bp, Homo sapiens
tcttcccatttaacattgttt

SEQ ID NO: 4582408 - DNA, 14 bp, Homo sapiens
tcttccccagagag

SEQ ID NO: 4582409 - DNA, 14 bp, Homo sapiens
tcttcccgtaaaaa

SEQ ID NO: 4582410 - DNA, 14 bp, Homo sapiens
tcttccctacctca

SEQ ID NO: 4582411 - DNA, 10 bp, Homo sapiens
tcttccctcc

SEQ ID NO: 4582412 - DNA, 16 bp, Homo sapiens
tcttccctctctgcag

SEQ ID NO: 4582413 - DNA, 13 bp, Homo sapiens
tcttccctgcctg

SEQ ID NO: 4582414 - DNA, 21 bp, Homo sapiens
tcttccctggaaaccttccac

SEQ ID NO: 4582415 - DNA, 16 bp, Homo sapiens
tcttccctttgtgtat

SEQ ID NO: 4582416 - DNA, 17 bp, Homo sapiens
tcttccctttgtgtatc

SEQ ID NO: 4582417 - DNA, 15 bp, Homo sapiens
tcttccgactctttc

SEQ ID NO: 4582418 - DNA, 21 bp, Homo sapiens
tcttccgtggtcagagtgcca

SEQ ID NO: 4582419 - DNA, 22 bp, Homo sapiens
tcttcctcccaagtggtgccta

SEQ ID NO: 4582420 - DNA, 18 bp, Homo sapiens
tcttcctccgaggccagt

SEQ ID NO: 4582421 - DNA, 14 bp, Homo sapiens
tcttcctcttcttt

SEQ ID NO: 4582422 - DNA, 16 bp, Homo sapiens
tcttcctgacacttta

SEQ ID NO: 4582423 - DNA, 18 bp, Homo sapiens
tcttcctgcgtagaagat

SEQ ID NO: 4582424 - DNA, 13 bp, Homo sapiens
tcttcctgtaatc

SEQ ID NO: 4582425 - DNA, 15 bp, Homo sapiens
tcttcctgtaatctt

SEQ ID NO: 4582426 - DNA, 23 bp, Homo sapiens
tcttcctgttgtgactgccagga

SEQ ID NO: 4582427 - DNA, 15 bp, Homo sapiens
tcttccttccctcct

SEQ ID NO: 4582428 - DNA, 22 bp, Homo sapiens
tcttccttctaccccaaggcca

SEQ ID NO: 4582429 - DNA, 20 bp, Homo sapiens
tcttccttttttaaaataaa

SEQ ID NO: 4582430 - DNA, 14 bp, Homo sapiens
tcttcgctggacta

SEQ ID NO: 4582431 - DNA, 19 bp, Homo sapiens
tcttcgctggactattgtg

SEQ ID NO: 4582432 - DNA, 20 bp, Homo sapiens
tcttcgctggactattgtgc

SEQ ID NO: 4582433 - DNA, 21 bp, Homo sapiens
tcttcgctggactattgtgcc

SEQ ID NO: 4582434 - DNA, 19 bp, Homo sapiens
tcttcggggaactcctgga

SEQ ID NO: 4582435 - DNA, 19 bp, Homo sapiens
tcttctacttgtttaacat

SEQ ID NO: 4582436 - DNA, 13 bp, Homo sapiens
tcttctactttta

SEQ ID NO: 4582437 - DNA, 19 bp, Homo sapiens
tcttctattaatcaagaga

SEQ ID NO: 4582438 - DNA, 23 bp, Homo sapiens
tcttctcatttcacccctccctt

SEQ ID NO: 4582439 - DNA, 20 bp, Homo sapiens
tcttctccaattctgaaata

SEQ ID NO: 4582440 - DNA, 14 bp, Homo sapiens
tcttctccatctgg

SEQ ID NO: 4582441 - DNA, 13 bp, Homo sapiens
tcttctctaacaa

SEQ ID NO: 4582442 - DNA, 18 bp, Homo sapiens
tcttctctccagctgact

SEQ ID NO: 4582443 - DNA, 14 bp, Homo sapiens
tcttctctccccag

SEQ ID NO: 4582444 - DNA, 24 bp, Homo sapiens
tcttctgaactcaaactgaggaat

SEQ ID NO: 4582445 - DNA, 16 bp, Homo sapiens
tcttctgaagattctt

SEQ ID NO: 4582446 - DNA, 17 bp, Homo sapiens
tcttctgaataaagcaa

SEQ ID NO: 4582447 - DNA, 15 bp, Homo sapiens
tcttctgcctgttat

SEQ ID NO: 4582448 - DNA, 16 bp, Homo sapiens
tcttctgcctgttata

SEQ ID NO: 4582449 - DNA, 20 bp, Homo sapiens
tcttctgctccacccttggc

SEQ ID NO: 4582450 - DNA, 22 bp, Homo sapiens
tcttctgctccacccttggcct

SEQ ID NO: 4582451 - DNA, 15 bp, Homo sapiens
tcttctgctcttttc

SEQ ID NO: 4582452 - DNA, 17 bp, Homo sapiens
tcttctgggagggcagc

SEQ ID NO: 4582453 - DNA, 20 bp, Homo sapiens
tcttctgggagggcagcagg

SEQ ID NO: 4582454 - DNA, 22 bp, Homo sapiens
tcttctgggagggcagcagggc

SEQ ID NO: 4582455 - DNA, 16 bp, Homo sapiens
tcttctgggtgtgctt

SEQ ID NO: 4582456 - DNA, 23 bp, Homo sapiens
tcttctgggtgtgctttttggga

SEQ ID NO: 4582457 - DNA, 15 bp, Homo sapiens
tcttctgtaatattt

SEQ ID NO: 4582458 - DNA, 14 bp, Homo sapiens
tcttctgtcttgtc

SEQ ID NO: 4582459 - DNA, 18 bp, Homo sapiens
tcttcttaacagtttagt

SEQ ID NO: 4582460 - DNA, 22 bp, Homo sapiens
tcttcttatacagataaaacat

SEQ ID NO: 4582461 - DNA, 13 bp, Homo sapiens
tcttcttcaccat

SEQ ID NO: 4582462 - DNA, 14 bp, Homo sapiens
tcttcttcaccatt

SEQ ID NO: 4582463 - DNA, 17 bp, Homo sapiens
tcttcttgaaattttaa

SEQ ID NO: 4582464 - DNA, 13 bp, Homo sapiens
tcttcttgggccc

SEQ ID NO: 4582465 - DNA, 22 bp, Homo sapiens
tcttcttgggcccggtccacag

SEQ ID NO: 4582466 - DNA, 23 bp, Homo sapiens
tcttcttgggcccggtccacagg

SEQ ID NO: 4582467 - DNA, 12 bp, Homo sapiens
tcttctttggaa

SEQ ID NO: 4582468 - DNA, 14 bp, Homo sapiens
tcttctttgtgcct

SEQ ID NO: 4582469 - DNA, 20 bp, Homo sapiens
tcttctttgtgcctttggcc

SEQ ID NO: 4582470 - DNA, 18 bp, Homo sapiens
tcttgaaaaagatggctt

SEQ ID NO: 4582471 - DNA, 16 bp, Homo sapiens
tcttgaaatattcaga

SEQ ID NO: 4582472 - DNA, 20 bp, Homo sapiens
tcttgaaatattcagaaatt

SEQ ID NO: 4582473 - DNA, 16 bp, Homo sapiens
tcttgaaatgaaaggg

SEQ ID NO: 4582474 - DNA, 14 bp, Homo sapiens
tcttgaatataaaa

SEQ ID NO: 4582475 - DNA, 21 bp, Homo sapiens
tcttgaatttaataatctgta

SEQ ID NO: 4582476 - DNA, 17 bp, Homo sapiens
tcttgactttttaaaaa

SEQ ID NO: 4582477 - DNA, 17 bp, Homo sapiens
tcttgagcatcaatctt

SEQ ID NO: 4582478 - DNA, 20 bp, Homo sapiens
tcttgatcggaaagctcttc

SEQ ID NO: 4582479 - DNA, 13 bp, Homo sapiens
tcttgatctttga

SEQ ID NO: 4582480 - DNA, 13 bp, Homo sapiens
tcttgatgcatgc

SEQ ID NO: 4582481 - DNA, 21 bp, Homo sapiens
tcttgatgcatgcactgttcc

SEQ ID NO: 4582482 - DNA, 21 bp, Homo sapiens
tcttgatgttttttctgtaat

SEQ ID NO: 4582483 - DNA, 16 bp, Homo sapiens
tcttgattctctccct

SEQ ID NO: 4582484 - DNA, 18 bp, Homo sapiens
tcttgatttatttgcttc

SEQ ID NO: 4582485 - DNA, 20 bp, Homo sapiens
tcttgcatggtttggagctg

SEQ ID NO: 4582486 - DNA, 14 bp, Homo sapiens
tcttgcccatcctg

SEQ ID NO: 4582487 - DNA, 18 bp, Homo sapiens
tcttgcccatcctgactg

SEQ ID NO: 4582488 - DNA, 23 bp, Homo sapiens
tcttgcctcgaggggcccaggga

SEQ ID NO: 4582489 - DNA, 16 bp, Homo sapiens
tcttgcctctgtcccc

SEQ ID NO: 4582490 - DNA, 21 bp, Homo sapiens
tcttgcctctgtccccttctc

SEQ ID NO: 4582491 - DNA, 14 bp, Homo sapiens
tcttgccttttgtt

SEQ ID NO: 4582492 - DNA, 15 bp, Homo sapiens
tcttgccttttgtta

SEQ ID NO: 4582493 - DNA, 16 bp, Homo sapiens
tcttgccttttgttaa

SEQ ID NO: 4582494 - DNA, 14 bp, Homo sapiens
tcttgctctgtccc

SEQ ID NO: 4582495 - DNA, 15 bp, Homo sapiens
tcttgctgttgacat

SEQ ID NO: 4582496 - DNA, 19 bp, Homo sapiens
tcttgctgttgacatattt

SEQ ID NO: 4582497 - DNA, 21 bp, Homo sapiens
tcttgctgttgacatatttaa

SEQ ID NO: 4582498 - DNA, 12 bp, Homo sapiens
tcttgctttctc

SEQ ID NO: 4582499 - DNA, 20 bp, Homo sapiens
tcttggaaaaaataaaaaca

SEQ ID NO: 4582500 - DNA, 19 bp, Homo sapiens
tcttggaactgtcccagct

SEQ ID NO: 4582501 - DNA, 14 bp, Homo sapiens
tcttggacccacct

SEQ ID NO: 4582502 - DNA, 17 bp, Homo sapiens
tcttggagaccttaccc

SEQ ID NO: 4582503 - DNA, 16 bp, Homo sapiens
tcttggcttaatcatt

SEQ ID NO: 4582504 - DNA, 18 bp, Homo sapiens
tcttggcttaatcatttt

SEQ ID NO: 4582505 - DNA, 13 bp, Homo sapiens
tcttgggaactga

SEQ ID NO: 4582506 - DNA, 20 bp, Homo sapiens
tcttgggcccggtccacagg

SEQ ID NO: 4582507 - DNA, 24 bp, Homo sapiens
tcttgggggacagggctggcccag

SEQ ID NO: 4582508 - DNA, 15 bp, Homo sapiens
tcttggtaaaacatt

SEQ ID NO: 4582509 - DNA, 18 bp, Homo sapiens
tcttggtagttctgtgcc

SEQ ID NO: 4582510 - DNA, 16 bp, Homo sapiens
tcttggtgactgtccc

SEQ ID NO: 4582511 - DNA, 20 bp, Homo sapiens
tcttggtgtttgactgtaat

SEQ ID NO: 4582512 - DNA, 19 bp, Homo sapiens
tcttgtaatccgaatctct

SEQ ID NO: 4582513 - DNA, 14 bp, Homo sapiens
tcttgtacaaactt

SEQ ID NO: 4582514 - DNA, 16 bp, Homo sapiens
tcttgtacaaactttg

SEQ ID NO: 4582515 - DNA, 21 bp, Homo sapiens
tcttgtaccatagaaaaatgt

SEQ ID NO: 4582516 - DNA, 18 bp, Homo sapiens
tcttgtattaagttgtta

SEQ ID NO: 4582517 - DNA, 13 bp, Homo sapiens
tcttgtatttaaa

SEQ ID NO: 4582518 - DNA, 18 bp, Homo sapiens
tcttgtatttaaaaacat

SEQ ID NO: 4582519 - DNA, 21 bp, Homo sapiens
tcttgtcatacaaatttataa

SEQ ID NO: 4582520 - DNA, 19 bp, Homo sapiens
tcttgtcccaattaaaata

SEQ ID NO: 4582521 - DNA, 21 bp, Homo sapiens
tcttgtcctcttctgctcttt

SEQ ID NO: 4582522 - DNA, 17 bp, Homo sapiens
tcttgtgaactttgaat

SEQ ID NO: 4582523 - DNA, 13 bp, Homo sapiens
tcttgtgcttctt

SEQ ID NO: 4582524 - DNA, 18 bp, Homo sapiens
tcttgtgtagatttgaaa

SEQ ID NO: 4582525 - DNA, 18 bp, Homo sapiens
tcttgttattaatgtttc

SEQ ID NO: 4582526 - DNA, 14 bp, Homo sapiens
tcttgttctgttcc

SEQ ID NO: 4582527 - DNA, 15 bp, Homo sapiens
tcttgtttacaataa

SEQ ID NO: 4582528 - DNA, 13 bp, Homo sapiens
tcttgtttatagc

SEQ ID NO: 4582529 - DNA, 14 bp, Homo sapiens
tcttgtttatagca

SEQ ID NO: 4582530 - DNA, 16 bp, Homo sapiens
tcttgtttctcatgaa

SEQ ID NO: 4582531 - DNA, 12 bp, Homo sapiens
tctttaaaacaa

SEQ ID NO: 4582532 - DNA, 14 bp, Homo sapiens
tctttaaaacaaaa

SEQ ID NO: 4582533 - DNA, 21 bp, Homo sapiens
tctttaaagggatggcaagat

SEQ ID NO: 4582534 - DNA, 14 bp, Homo sapiens
tctttaaataataa

SEQ ID NO: 4582535 - DNA, 18 bp, Homo sapiens
tctttacatttcttttaa

SEQ ID NO: 4582536 - DNA, 21 bp, Homo sapiens
tctttacatttcttttaaaat

SEQ ID NO: 4582537 - DNA, 18 bp, Homo sapiens
tctttaccaaaaaccatg

SEQ ID NO: 4582538 - DNA, 13 bp, Homo sapiens
tctttacttatct

SEQ ID NO: 4582539 - DNA, 21 bp, Homo sapiens
tctttagaaaacccaagtttt

SEQ ID NO: 4582540 - DNA, 23 bp, Homo sapiens
tctttaggggaagtaaaacagtc

SEQ ID NO: 4582541 - DNA, 15 bp, Homo sapiens
tctttagtttttgtg

SEQ ID NO: 4582542 - DNA, 22 bp, Homo sapiens
tctttataaagctgttcttgaa

SEQ ID NO: 4582543 - DNA, 23 bp, Homo sapiens
tctttataaagctgttcttgaaa

SEQ ID NO: 4582544 - DNA, 13 bp, Homo sapiens
tctttatagtgaa

SEQ ID NO: 4582545 - DNA, 11 bp, Homo sapiens
tctttatatga

SEQ ID NO: 4582546 - DNA, 15 bp, Homo sapiens
tctttatatgaacat

SEQ ID NO: 4582547 - DNA, 15 bp, Homo sapiens
tctttatatgaagaa

SEQ ID NO: 4582548 - DNA, 14 bp, Homo sapiens
tctttatattgtca

SEQ ID NO: 4582549 - DNA, 12 bp, Homo sapiens
tctttattaaaa

SEQ ID NO: 4582550 - DNA, 14 bp, Homo sapiens
tctttattaaaaca

SEQ ID NO: 4582551 - DNA, 12 bp, Homo sapiens
tctttattataa

SEQ ID NO: 4582552 - DNA, 23 bp, Homo sapiens
tctttcaacttgcaatttgcaag

SEQ ID NO: 4582553 - DNA, 14 bp, Homo sapiens
tctttcacacaatg

SEQ ID NO: 4582554 - DNA, 21 bp, Homo sapiens
tctttcagtacttttttaaat

SEQ ID NO: 4582555 - DNA, 19 bp, Homo sapiens
tctttccaaccggctttgt

SEQ ID NO: 4582556 - DNA, 22 bp, Homo sapiens
tctttccacggagccactcctc

SEQ ID NO: 4582557 - DNA, 23 bp, Homo sapiens
tctttccacggagccactcctct

SEQ ID NO: 4582558 - DNA, 17 bp, Homo sapiens
tctttccagaaaccaaa

SEQ ID NO: 4582559 - DNA, 21 bp, Homo sapiens
tctttccagtggatcataaga

SEQ ID NO: 4582560 - DNA, 20 bp, Homo sapiens
tctttccattggatctcatt

SEQ ID NO: 4582561 - DNA, 17 bp, Homo sapiens
tctttcccatgtatttg

SEQ ID NO: 4582562 - DNA, 11 bp, Homo sapiens
tctttccccag

SEQ ID NO: 4582563 - DNA, 14 bp, Homo sapiens
tctttccccagcag

SEQ ID NO: 4582564 - DNA, 22 bp, Homo sapiens
tctttccccagcagtttctgtc

SEQ ID NO: 4582565 - DNA, 24 bp, Homo sapiens
tctttccccagcagtttctgtcct

SEQ ID NO: 4582566 - DNA, 17 bp, Homo sapiens
tctttccgactgcccag

SEQ ID NO: 4582567 - DNA, 15 bp, Homo sapiens
tctttcctcacattt

SEQ ID NO: 4582568 - DNA, 13 bp, Homo sapiens
tctttcctttaaa

SEQ ID NO: 4582569 - DNA, 15 bp, Homo sapiens
tctttcctttaaaaa

SEQ ID NO: 4582570 - DNA, 17 bp, Homo sapiens
tctttcctttaaaaata

SEQ ID NO: 4582571 - DNA, 23 bp, Homo sapiens
tctttctacaaagcactagagaa

SEQ ID NO: 4582572 - DNA, 15 bp, Homo sapiens
tctttctagtttgtt

SEQ ID NO: 4582573 - DNA, 18 bp, Homo sapiens
tctttctcactaaatctt

SEQ ID NO: 4582574 - DNA, 17 bp, Homo sapiens
tctttctctcccctcct

SEQ ID NO: 4582575 - DNA, 14 bp, Homo sapiens
tctttctctggtgg

SEQ ID NO: 4582576 - DNA, 13 bp, Homo sapiens
tctttctggactg

SEQ ID NO: 4582577 - DNA, 20 bp, Homo sapiens
tctttctgtcttgttaatgc

SEQ ID NO: 4582578 - DNA, 12 bp, Homo sapiens
tctttctgtttt

SEQ ID NO: 4582579 - DNA, 19 bp, Homo sapiens
tctttcttcttttttaagt

SEQ ID NO: 4582580 - DNA, 13 bp, Homo sapiens
tctttctttctct

SEQ ID NO: 4582581 - DNA, 18 bp, Homo sapiens
tctttctttgtttctttc

SEQ ID NO: 4582582 - DNA, 23 bp, Homo sapiens
tctttctttgtttctttcttcct

SEQ ID NO: 4582583 - DNA, 12 bp, Homo sapiens
tctttgaaataa

SEQ ID NO: 4582584 - DNA, 21 bp, Homo sapiens
tctttgagaccatccattctc

SEQ ID NO: 4582585 - DNA, 21 bp, Homo sapiens
tctttgagcccattcttctgg

SEQ ID NO: 4582586 - DNA, 22 bp, Homo sapiens
tctttgagtcaatagcttgtct

SEQ ID NO: 4582587 - DNA, 17 bp, Homo sapiens
tctttgatccagaggtg

SEQ ID NO: 4582588 - DNA, 23 bp, Homo sapiens
tctttgattctccttcagccctc

SEQ ID NO: 4582589 - DNA, 23 bp, Homo sapiens
tctttgcaaagtattgtaaatta

SEQ ID NO: 4582590 - DNA, 18 bp, Homo sapiens
tctttgcaacagcagtgt

SEQ ID NO: 4582591 - DNA, 21 bp, Homo sapiens
tctttgcaacagcagtgttct

SEQ ID NO: 4582592 - DNA, 17 bp, Homo sapiens
tctttgctgcccctgtc

SEQ ID NO: 4582593 - DNA, 18 bp, Homo sapiens
tctttgctgcccctgtct

SEQ ID NO: 4582594 - DNA, 12 bp, Homo sapiens
tctttgctgtta

SEQ ID NO: 4582595 - DNA, 16 bp, Homo sapiens
tctttgcttgaacaca

SEQ ID NO: 4582596 - DNA, 17 bp, Homo sapiens
tctttgcttgaacacag

SEQ ID NO: 4582597 - DNA, 19 bp, Homo sapiens
tctttgcttgaacacagta

SEQ ID NO: 4582598 - DNA, 15 bp, Homo sapiens
tctttgctttgtagt

SEQ ID NO: 4582599 - DNA, 20 bp, Homo sapiens
tctttgctttgtagtttgct

SEQ ID NO: 4582600 - DNA, 20 bp, Homo sapiens
tctttggaaataaaagataa

SEQ ID NO: 4582601 - DNA, 23 bp, Homo sapiens
tctttggtgcctttcctgttcag

SEQ ID NO: 4582602 - DNA, 14 bp, Homo sapiens
tctttgtaccaaaa

SEQ ID NO: 4582603 - DNA, 19 bp, Homo sapiens
tctttgtagaataaatggt

SEQ ID NO: 4582604 - DNA, 20 bp, Homo sapiens
tctttgtagaataaatggtt

SEQ ID NO: 4582605 - DNA, 17 bp, Homo sapiens
tctttgtatcattcatc

SEQ ID NO: 4582606 - DNA, 21 bp, Homo sapiens
tctttgtattcttcatgaaat

SEQ ID NO: 4582607 - DNA, 23 bp, Homo sapiens
tctttgtattcttcatgaaatgt

SEQ ID NO: 4582608 - DNA, 23 bp, Homo sapiens
tctttgtgacaggaaagccctcc

SEQ ID NO: 4582609 - DNA, 14 bp, Homo sapiens
tctttgtgcctttg

SEQ ID NO: 4582610 - DNA, 14 bp, Homo sapiens
tctttgtggtttct

SEQ ID NO: 4582611 - DNA, 13 bp, Homo sapiens
tctttgtgtaatc

SEQ ID NO: 4582612 - DNA, 16 bp, Homo sapiens
tctttgttacttcctt

SEQ ID NO: 4582613 - DNA, 15 bp, Homo sapiens
tctttgtttaaatgc

SEQ ID NO: 4582614 - DNA, 17 bp, Homo sapiens
tctttgtttacatgagt

SEQ ID NO: 4582615 - DNA, 18 bp, Homo sapiens
tctttgtttatgcacttt

SEQ ID NO: 4582616 - DNA, 16 bp, Homo sapiens
tctttgtttctttctt

SEQ ID NO: 4582617 - DNA, 17 bp, Homo sapiens
tcttttaaaagccccag

SEQ ID NO: 4582618 - DNA, 17 bp, Homo sapiens
tcttttaaattagaaaa

SEQ ID NO: 4582619 - DNA, 20 bp, Homo sapiens
tcttttaaattagaaaatat

SEQ ID NO: 4582620 - DNA, 12 bp, Homo sapiens
tcttttacaact

SEQ ID NO: 4582621 - DNA, 20 bp, Homo sapiens
tcttttacctgctgcttctc

SEQ ID NO: 4582622 - DNA, 23 bp, Homo sapiens
tcttttactttttttagtaagtt

SEQ ID NO: 4582623 - DNA, 13 bp, Homo sapiens
tcttttagaaaag

SEQ ID NO: 4582624 - DNA, 12 bp, Homo sapiens
tcttttagagag

SEQ ID NO: 4582625 - DNA, 15 bp, Homo sapiens
tcttttagagagggg

SEQ ID NO: 4582626 - DNA, 13 bp, Homo sapiens
tcttttattaata

SEQ ID NO: 4582627 - DNA, 17 bp, Homo sapiens
tcttttattaatacttt

SEQ ID NO: 4582628 - DNA, 13 bp, Homo sapiens
tcttttattctgt

SEQ ID NO: 4582629 - DNA, 12 bp, Homo sapiens
tcttttattctt

SEQ ID NO: 4582630 - DNA, 15 bp, Homo sapiens
tcttttatttaacaa

SEQ ID NO: 4582631 - DNA, 14 bp, Homo sapiens
tcttttcagaagca

SEQ ID NO: 4582632 - DNA, 19 bp, Homo sapiens
tcttttcagaagcaagcca

SEQ ID NO: 4582633 - DNA, 21 bp, Homo sapiens
tcttttcagaagcaagccaga

SEQ ID NO: 4582634 - DNA, 19 bp, Homo sapiens
tcttttcccatcaccagaa

SEQ ID NO: 4582635 - DNA, 12 bp, Homo sapiens
tcttttcttatt

SEQ ID NO: 4582636 - DNA, 14 bp, Homo sapiens
tcttttctttgtat

SEQ ID NO: 4582637 - DNA, 18 bp, Homo sapiens
tcttttgaattgttacat

SEQ ID NO: 4582638 - DNA, 16 bp, Homo sapiens
tcttttgacaccttag

SEQ ID NO: 4582639 - DNA, 14 bp, Homo sapiens
tcttttgtatatct

SEQ ID NO: 4582640 - DNA, 17 bp, Homo sapiens
tcttttgtattgtttct

SEQ ID NO: 4582641 - DNA, 14 bp, Homo sapiens
tcttttgtttcctt

SEQ ID NO: 4582642 - DNA, 18 bp, Homo sapiens
tctttttaaagtactgta

SEQ ID NO: 4582643 - DNA, 19 bp, Homo sapiens
tctttttacctttcataca

SEQ ID NO: 4582644 - DNA, 12 bp, Homo sapiens
tctttttccagt

SEQ ID NO: 4582645 - DNA, 12 bp, Homo sapiens
tctttttcctcc

SEQ ID NO: 4582646 - DNA, 20 bp, Homo sapiens
tctttttctacatgtgagat

SEQ ID NO: 4582647 - DNA, 20 bp, Homo sapiens
tctttttctgaactccattt

SEQ ID NO: 4582648 - DNA, 15 bp, Homo sapiens
tctttttcttcttcc

SEQ ID NO: 4582649 - DNA, 21 bp, Homo sapiens
tctttttgccagttttccctg

SEQ ID NO: 4582650 - DNA, 22 bp, Homo sapiens
tcttttttaaattttcttcagt

SEQ ID NO: 4582651 - DNA, 16 bp, Homo sapiens
tcttttttctctctta

SEQ ID NO: 4582652 - DNA, 16 bp, Homo sapiens
tcttttttgctttctt

SEQ ID NO: 4582653 - DNA, 22 bp, Homo sapiens
tcttttttgtttgtttctttgt

SEQ ID NO: 4582654 - DNA, 17 bp, Homo sapiens
tctttttttccttcctt

SEQ ID NO: 4582655 - DNA, 17 bp, Homo sapiens
tcttttttttaatgttt

SEQ ID NO: 4582656 - DNA, 18 bp, Homo sapiens
tcttttttttttattatg

SEQ ID NO: 4582657 - DNA, 20 bp, Homo sapiens
tctttttttttttttttgtg

SEQ ID NO: 4582658 - DNA, 19 bp, Homo sapiens
tgaaaaaaaaaaagaagaa

SEQ ID NO: 4582659 - DNA, 15 bp, Homo sapiens
tgaaaaaaaagtttt

SEQ ID NO: 4582660 - DNA, 21 bp, Homo sapiens
tgaaaaaaaatttgttttcaa

SEQ ID NO: 4582661 - DNA, 11 bp, Homo sapiens
tgaaaaaagct

SEQ ID NO: 4582662 - DNA, 12 bp, Homo sapiens
tgaaaaaagctc

SEQ ID NO: 4582663 - DNA, 14 bp, Homo sapiens
tgaaaaaagctcat

SEQ ID NO: 4582664 - DNA, 20 bp, Homo sapiens
tgaaaaaagctcatttcatg

SEQ ID NO: 4582665 - DNA, 14 bp, Homo sapiens
tgaaaaacaatttt

SEQ ID NO: 4582666 - DNA, 16 bp, Homo sapiens
tgaaaaactaatgtgt

SEQ ID NO: 4582667 - DNA, 13 bp, Homo sapiens
tgaaaaagcgaaa

SEQ ID NO: 4582668 - DNA, 16 bp, Homo sapiens
tgaaaaagctgcttct

SEQ ID NO: 4582669 - DNA, 22 bp, Homo sapiens
tgaaaaagctgcttcttattaa

SEQ ID NO: 4582670 - DNA, 20 bp, Homo sapiens
tgaaaaagctggattttctt

SEQ ID NO: 4582671 - DNA, 12 bp, Homo sapiens
tgaaaaatatag

SEQ ID NO: 4582672 - DNA, 22 bp, Homo sapiens
tgaaaaatctcattatttctgg

SEQ ID NO: 4582673 - DNA, 21 bp, Homo sapiens
tgaaaaatgtcactatatctt

SEQ ID NO: 4582674 - DNA, 15 bp, Homo sapiens
tgaaaaatttctaac

SEQ ID NO: 4582675 - DNA, 21 bp, Homo sapiens
tgaaaacaaataaaagttgaa

SEQ ID NO: 4582676 - DNA, 16 bp, Homo sapiens
tgaaaacactgtgcac

SEQ ID NO: 4582677 - DNA, 18 bp, Homo sapiens
tgaaaacactgtgcacat

SEQ ID NO: 4582678 - DNA, 13 bp, Homo sapiens
tgaaaacatgtac

SEQ ID NO: 4582679 - DNA, 22 bp, Homo sapiens
tgaaaacatgtactacagctat

SEQ ID NO: 4582680 - DNA, 21 bp, Homo sapiens
tgaaaaccaaaatgacatctt

SEQ ID NO: 4582681 - DNA, 15 bp, Homo sapiens
tgaaaacccagagag

SEQ ID NO: 4582682 - DNA, 23 bp, Homo sapiens
tgaaaacccagagaggaatcaga

SEQ ID NO: 4582683 - DNA, 16 bp, Homo sapiens
tgaaaagacaagaaaa

SEQ ID NO: 4582684 - DNA, 21 bp, Homo sapiens
tgaaaaggaaaaaatgcaaac

SEQ ID NO: 4582685 - DNA, 12 bp, Homo sapiens
tgaaaaggaatc

SEQ ID NO: 4582686 - DNA, 20 bp, Homo sapiens
tgaaaagggtgttgggaggg

SEQ ID NO: 4582687 - DNA, 14 bp, Homo sapiens
tgaaaagtaattga

SEQ ID NO: 4582688 - DNA, 18 bp, Homo sapiens
tgaaaagtaattgaaaaa

SEQ ID NO: 4582689 - DNA, 18 bp, Homo sapiens
tgaaaataactgaatttg

SEQ ID NO: 4582690 - DNA, 15 bp, Homo sapiens
tgaaaatagctattt

SEQ ID NO: 4582691 - DNA, 13 bp, Homo sapiens
tgaaaatagtgta

SEQ ID NO: 4582692 - DNA, 22 bp, Homo sapiens
tgaaaatagtgtaagaactgta

SEQ ID NO: 4582693 - DNA, 19 bp, Homo sapiens
tgaaaatatacttgactct

SEQ ID NO: 4582694 - DNA, 22 bp, Homo sapiens
tgaaaatatacttgactctaat

SEQ ID NO: 4582695 - DNA, 23 bp, Homo sapiens
tgaaaatatagacattctcacat

SEQ ID NO: 4582696 - DNA, 12 bp, Homo sapiens
tgaaaatatcag

SEQ ID NO: 4582697 - DNA, 16 bp, Homo sapiens
tgaaaatattgtttta

SEQ ID NO: 4582698 - DNA, 17 bp, Homo sapiens
tgaaaatatttgtatca

SEQ ID NO: 4582699 - DNA, 15 bp, Homo sapiens
tgaaaatgaaagtgt

SEQ ID NO: 4582700 - DNA, 12 bp, Homo sapiens
tgaaaatgaata

SEQ ID NO: 4582701 - DNA, 13 bp, Homo sapiens
tgaaaatgaatgc

SEQ ID NO: 4582702 - DNA, 14 bp, Homo sapiens
tgaaaatgagccct

SEQ ID NO: 4582703 - DNA, 15 bp, Homo sapiens
tgaaaatgagccctg

SEQ ID NO: 4582704 - DNA, 21 bp, Homo sapiens
tgaaaatgcatttttatcatg

SEQ ID NO: 4582705 - DNA, 19 bp, Homo sapiens
tgaaaatgggatgtgctgt

SEQ ID NO: 4582706 - DNA, 16 bp, Homo sapiens
tgaaaatgtccaggaa

SEQ ID NO: 4582707 - DNA, 17 bp, Homo sapiens
tgaaaattacatgtttt

SEQ ID NO: 4582708 - DNA, 19 bp, Homo sapiens
tgaaaattacgttcttaca

SEQ ID NO: 4582709 - DNA, 20 bp, Homo sapiens
tgaaaattcgcccgagctgt

SEQ ID NO: 4582710 - DNA, 13 bp, Homo sapiens
tgaaaattgaaaa

SEQ ID NO: 4582711 - DNA, 13 bp, Homo sapiens
tgaaaattgtata

SEQ ID NO: 4582712 - DNA, 22 bp, Homo sapiens
tgaaaattgtataccaatgtgt

SEQ ID NO: 4582713 - DNA, 12 bp, Homo sapiens
tgaaaattttaa

SEQ ID NO: 4582714 - DNA, 14 bp, Homo sapiens
tgaaaattttaaga

SEQ ID NO: 4582715 - DNA, 19 bp, Homo sapiens
tgaaacaaaaaaaaaatga

SEQ ID NO: 4582716 - DNA, 14 bp, Homo sapiens
tgaaacaacaaaac

SEQ ID NO: 4582717 - DNA, 10 bp, Homo sapiens
tgaaacagct

SEQ ID NO: 4582718 - DNA, 14 bp, Homo sapiens
tgaaacagctgcct

SEQ ID NO: 4582719 - DNA, 15 bp, Homo sapiens
tgaaacagctgcctt

SEQ ID NO: 4582720 - DNA, 16 bp, Homo sapiens
tgaaacagctgcctta

SEQ ID NO: 4582721 - DNA, 22 bp, Homo sapiens
tgaaacagggaaaatgaagctg

SEQ ID NO: 4582722 - DNA, 14 bp, Homo sapiens
tgaaacatcttctc

SEQ ID NO: 4582723 - DNA, 19 bp, Homo sapiens
tgaaacattttttcttctg

SEQ ID NO: 4582724 - DNA, 16 bp, Homo sapiens
tgaaacccagtaattc

SEQ ID NO: 4582725 - DNA, 16 bp, Homo sapiens
tgaaacccccatctct

SEQ ID NO: 4582726 - DNA, 18 bp, Homo sapiens
tgaaaccctgtctctact

SEQ ID NO: 4582727 - DNA, 18 bp, Homo sapiens
tgaaacctagtactgccc

SEQ ID NO: 4582728 - DNA, 16 bp, Homo sapiens
tgaaacctcagggctg

SEQ ID NO: 4582729 - DNA, 18 bp, Homo sapiens
tgaaactcatagacactg

SEQ ID NO: 4582730 - DNA, 22 bp, Homo sapiens
tgaaactgcccactctgcaaga

SEQ ID NO: 4582731 - DNA, 23 bp, Homo sapiens
tgaaactttcattccttcagatt

SEQ ID NO: 4582732 - DNA, 22 bp, Homo sapiens
tgaaagagcaaacctaacagga

SEQ ID NO: 4582733 - DNA, 19 bp, Homo sapiens
tgaaagcagggacttgaac

SEQ ID NO: 4582734 - DNA, 16 bp, Homo sapiens
tgaaagccaagtgttt

SEQ ID NO: 4582735 - DNA, 17 bp, Homo sapiens
tgaaagctgacattaag

SEQ ID NO: 4582736 - DNA, 19 bp, Homo sapiens
tgaaagcttcaaagtttat

SEQ ID NO: 4582737 - DNA, 16 bp, Homo sapiens
tgaaaggcaacataat

SEQ ID NO: 4582738 - DNA, 21 bp, Homo sapiens
tgaaaggctatcctgctgaaa

SEQ ID NO: 4582739 - DNA, 16 bp, Homo sapiens
tgaaagggaaactggg

SEQ ID NO: 4582740 - DNA, 20 bp, Homo sapiens
tgaaagggaaactgggaaac

SEQ ID NO: 4582741 - DNA, 17 bp, Homo sapiens
tgaaagggatcatcatg

SEQ ID NO: 4582742 - DNA, 20 bp, Homo sapiens
tgaaaggggacacctgtaca

SEQ ID NO: 4582743 - DNA, 18 bp, Homo sapiens
tgaaagtagattcatgaa

SEQ ID NO: 4582744 - DNA, 20 bp, Homo sapiens
tgaaagtgatgacatatttt

SEQ ID NO: 4582745 - DNA, 14 bp, Homo sapiens
tgaaagtgttaatt

SEQ ID NO: 4582746 - DNA, 20 bp, Homo sapiens
tgaaagtgttaattttacct

SEQ ID NO: 4582747 - DNA, 16 bp, Homo sapiens
tgaaagttgcttttat

SEQ ID NO: 4582748 - DNA, 20 bp, Homo sapiens
tgaaagttgtacatgataag

SEQ ID NO: 4582749 - DNA, 13 bp, Homo sapiens
tgaaagttttgta

SEQ ID NO: 4582750 - DNA, 16 bp, Homo sapiens
tgaaagttttgtaaaa

SEQ ID NO: 4582751 - DNA, 20 bp, Homo sapiens
tgaaagttttgtaaaagaaa

SEQ ID NO: 4582752 - DNA, 20 bp, Homo sapiens
tgaaataactggaacaaatt

SEQ ID NO: 4582753 - DNA, 15 bp, Homo sapiens
tgaaataagaattca

SEQ ID NO: 4582754 - DNA, 14 bp, Homo sapiens
tgaaataagccaga

SEQ ID NO: 4582755 - DNA, 20 bp, Homo sapiens
tgaaataagccagacatcaa

SEQ ID NO: 4582756 - DNA, 13 bp, Homo sapiens
tgaaataatatat

SEQ ID NO: 4582757 - DNA, 18 bp, Homo sapiens
tgaaatagtcctgaagtt

SEQ ID NO: 4582758 - DNA, 17 bp, Homo sapiens
tgaaatagtctgtgtga

SEQ ID NO: 4582759 - DNA, 19 bp, Homo sapiens
tgaaatatatattgtaaag

SEQ ID NO: 4582760 - DNA, 16 bp, Homo sapiens
tgaaatatgatgttaa

SEQ ID NO: 4582761 - DNA, 17 bp, Homo sapiens
tgaaatcatattatttt

SEQ ID NO: 4582762 - DNA, 18 bp, Homo sapiens
tgaaatcccatctctaca

SEQ ID NO: 4582763 - DNA, 21 bp, Homo sapiens
tgaaatctgtcaagagtagtt

SEQ ID NO: 4582764 - DNA, 14 bp, Homo sapiens
tgaaatcttgtttg

SEQ ID NO: 4582765 - DNA, 19 bp, Homo sapiens
tgaaatcttgtttgttact

SEQ ID NO: 4582766 - DNA, 13 bp, Homo sapiens
tgaaatgaaaggg

SEQ ID NO: 4582767 - DNA, 18 bp, Homo sapiens
tgaaatgacatttcacta

SEQ ID NO: 4582768 - DNA, 17 bp, Homo sapiens
tgaaatgaggtctgttt

SEQ ID NO: 4582769 - DNA, 15 bp, Homo sapiens
tgaaatgataaagac

SEQ ID NO: 4582770 - DNA, 13 bp, Homo sapiens
tgaaatgccaaag

SEQ ID NO: 4582771 - DNA, 14 bp, Homo sapiens
tgaaatgccaaagg

SEQ ID NO: 4582772 - DNA, 15 bp, Homo sapiens
tgaaatgcttttata

SEQ ID NO: 4582773 - DNA, 19 bp, Homo sapiens
tgaaatgcttttatattct

SEQ ID NO: 4582774 - DNA, 21 bp, Homo sapiens
tgaaatgcttttatattctaa

SEQ ID NO: 4582775 - DNA, 14 bp, Homo sapiens
tgaaatggcattta

SEQ ID NO: 4582776 - DNA, 19 bp, Homo sapiens
tgaaatgtaatttcagttc

SEQ ID NO: 4582777 - DNA, 22 bp, Homo sapiens
tgaaatgtcccctcaaactcat

SEQ ID NO: 4582778 - DNA, 20 bp, Homo sapiens
tgaaattatgtgacatttta

SEQ ID NO: 4582779 - DNA, 13 bp, Homo sapiens
tgaaattctgaat

SEQ ID NO: 4582780 - DNA, 14 bp, Homo sapiens
tgaaattctgaatt

SEQ ID NO: 4582781 - DNA, 19 bp, Homo sapiens
tgaaattgactgatgattt

SEQ ID NO: 4582782 - DNA, 16 bp, Homo sapiens
tgaaattttagaaata

SEQ ID NO: 4582783 - DNA, 16 bp, Homo sapiens
tgaaattttatatgct

SEQ ID NO: 4582784 - DNA, 18 bp, Homo sapiens
tgaacaaaaatgtttcca

SEQ ID NO: 4582785 - DNA, 21 bp, Homo sapiens
tgaacaaaaatgtttccactg

SEQ ID NO: 4582786 - DNA, 18 bp, Homo sapiens
tgaacaaatttacagaga

SEQ ID NO: 4582787 - DNA, 20 bp, Homo sapiens
tgaacaaatttacagagaca

SEQ ID NO: 4582788 - DNA, 17 bp, Homo sapiens
tgaacaaattttctggt

SEQ ID NO: 4582789 - DNA, 18 bp, Homo sapiens
tgaacaaattttctggtg

SEQ ID NO: 4582790 - DNA, 12 bp, Homo sapiens
tgaacaaggtaa

SEQ ID NO: 4582791 - DNA, 18 bp, Homo sapiens
tgaacaatgtatacaatg

SEQ ID NO: 4582792 - DNA, 22 bp, Homo sapiens
tgaacaatgtatacaatgcact

SEQ ID NO: 4582793 - DNA, 11 bp, Homo sapiens
tgaacacagta

SEQ ID NO: 4582794 - DNA, 19 bp, Homo sapiens
tgaacacagtattttccca

SEQ ID NO: 4582795 - DNA, 14 bp, Homo sapiens
tgaacacatcagct

SEQ ID NO: 4582796 - DNA, 17 bp, Homo sapiens
tgaacaccattgaaggc

SEQ ID NO: 4582797 - DNA, 22 bp, Homo sapiens
tgaacagatgaaaaggagcctg

SEQ ID NO: 4582798 - DNA, 21 bp, Homo sapiens
tgaacagcttgccagggatgg

SEQ ID NO: 4582799 - DNA, 22 bp, Homo sapiens
tgaacaggaaactcctgtgacc

SEQ ID NO: 4582800 - DNA, 23 bp, Homo sapiens
tgaacagtactggttactttcaa

SEQ ID NO: 4582801 - DNA, 15 bp, Homo sapiens
tgaacatattcatga

SEQ ID NO: 4582802 - DNA, 16 bp, Homo sapiens
tgaacatattcatgaa

SEQ ID NO: 4582803 - DNA, 17 bp, Homo sapiens
tgaacatattgttgaaa

SEQ ID NO: 4582804 - DNA, 12 bp, Homo sapiens
tgaacattccaa

SEQ ID NO: 4582805 - DNA, 13 bp, Homo sapiens
tgaacattccaga

SEQ ID NO: 4582806 - DNA, 12 bp, Homo sapiens
tgaacattgtac

SEQ ID NO: 4582807 - DNA, 19 bp, Homo sapiens
tgaacattgtactgttgct

SEQ ID NO: 4582808 - DNA, 23 bp, Homo sapiens
tgaacattgtactgttgctttaa

SEQ ID NO: 4582809 - DNA, 19 bp, Homo sapiens
tgaaccaacccccatctcc

SEQ ID NO: 4582810 - DNA, 19 bp, Homo sapiens
tgaacccaggaggtggagg

SEQ ID NO: 4582811 - DNA, 13 bp, Homo sapiens
tgaaccccagagg

SEQ ID NO: 4582812 - DNA, 20 bp, Homo sapiens
tgaaccccagaggcagaggt

SEQ ID NO: 4582813 - DNA, 19 bp, Homo sapiens
tgaacccgggggacagagg

SEQ ID NO: 4582814 - DNA, 20 bp, Homo sapiens
tgaacccgggggacagaggt

SEQ ID NO: 4582815 - DNA, 17 bp, Homo sapiens
tgaaccctttgtttctt

SEQ ID NO: 4582816 - DNA, 19 bp, Homo sapiens
tgaacgactgtatattgct

SEQ ID NO: 4582817 - DNA, 23 bp, Homo sapiens
tgaacgttttaataatttttgct

SEQ ID NO: 4582818 - DNA, 19 bp, Homo sapiens
tgaactacagcttgagaac

SEQ ID NO: 4582819 - DNA, 20 bp, Homo sapiens
tgaactagctaccatataag

SEQ ID NO: 4582820 - DNA, 11 bp, Homo sapiens
tgaactccaga

SEQ ID NO: 4582821 - DNA, 13 bp, Homo sapiens
tgaactcctgcca

SEQ ID NO: 4582822 - DNA, 15 bp, Homo sapiens
tgaactcctgccagg

SEQ ID NO: 4582823 - DNA, 18 bp, Homo sapiens
tgaactctcaaatccaaa

SEQ ID NO: 4582824 - DNA, 13 bp, Homo sapiens
tgaactctggtgc

SEQ ID NO: 4582825 - DNA, 17 bp, Homo sapiens
tgaactctgttccccca

SEQ ID NO: 4582826 - DNA, 12 bp, Homo sapiens
tgaactggaaga

SEQ ID NO: 4582827 - DNA, 14 bp, Homo sapiens
tgaactggaataat

SEQ ID NO: 4582828 - DNA, 17 bp, Homo sapiens
tgaactggtagaaaaac

SEQ ID NO: 4582829 - DNA, 16 bp, Homo sapiens
tgaactggtcttcctt

SEQ ID NO: 4582830 - DNA, 18 bp, Homo sapiens
tgaactggtcttcctttt

SEQ ID NO: 4582831 - DNA, 13 bp, Homo sapiens
tgaactgttacaa

SEQ ID NO: 4582832 - DNA, 18 bp, Homo sapiens
tgaacttaataactgtgt

SEQ ID NO: 4582833 - DNA, 22 bp, Homo sapiens
tgaacttaataactgtgtactg

SEQ ID NO: 4582834 - DNA, 23 bp, Homo sapiens
tgaacttaataactgtgtactgt

SEQ ID NO: 4582835 - DNA, 20 bp, Homo sapiens
tgaacttgcctcttttacct

SEQ ID NO: 4582836 - DNA, 12 bp, Homo sapiens
tgaactttaaaa

SEQ ID NO: 4582837 - DNA, 16 bp, Homo sapiens
tgaactttctccctca

SEQ ID NO: 4582838 - DNA, 14 bp, Homo sapiens
tgaacttttgtact

SEQ ID NO: 4582839 - DNA, 19 bp, Homo sapiens
tgaagaaaaaggacaaata

SEQ ID NO: 4582840 - DNA, 20 bp, Homo sapiens
tgaagaaaaaggacaaataa

SEQ ID NO: 4582841 - DNA, 21 bp, Homo sapiens
tgaagaaagcctgttgtttaa

SEQ ID NO: 4582842 - DNA, 19 bp, Homo sapiens
tgaagaaagggaggcccag

SEQ ID NO: 4582843 - DNA, 13 bp, Homo sapiens
tgaagaacatgtg

SEQ ID NO: 4582844 - DNA, 13 bp, Homo sapiens
tgaagaactgagg

SEQ ID NO: 4582845 - DNA, 20 bp, Homo sapiens
tgaagaagcacttctgctgc

SEQ ID NO: 4582846 - DNA, 19 bp, Homo sapiens
tgaagaatacttctcattt

SEQ ID NO: 4582847 - DNA, 13 bp, Homo sapiens
tgaagaatttaga

SEQ ID NO: 4582848 - DNA, 17 bp, Homo sapiens
tgaagactggaagctaa

SEQ ID NO: 4582849 - DNA, 22 bp, Homo sapiens
tgaagagaagggcagggctgag

SEQ ID NO: 4582850 - DNA, 12 bp, Homo sapiens
tgaagagacaga

SEQ ID NO: 4582851 - DNA, 21 bp, Homo sapiens
tgaagagacagagacaagtaa

SEQ ID NO: 4582852 - DNA, 23 bp, Homo sapiens
tgaagagcacggtcccccaggag

SEQ ID NO: 4582853 - DNA, 11 bp, Homo sapiens
tgaagagctct

SEQ ID NO: 4582854 - DNA, 14 bp, Homo sapiens
tgaagagctcttgg

SEQ ID NO: 4582855 - DNA, 16 bp, Homo sapiens
tgaagagctcttggcc

SEQ ID NO: 4582856 - DNA, 17 bp, Homo sapiens
tgaagaggaccagagga

SEQ ID NO: 4582857 - DNA, 20 bp, Homo sapiens
tgaagaggaccagaggagca

SEQ ID NO: 4582858 - DNA, 17 bp, Homo sapiens
tgaagaggcttctcctg

SEQ ID NO: 4582859 - DNA, 20 bp, Homo sapiens
tgaagagtcagaactaactt

SEQ ID NO: 4582860 - DNA, 13 bp, Homo sapiens
tgaagatccccaa

SEQ ID NO: 4582861 - DNA, 19 bp, Homo sapiens
tgaagatccccaactgctc

SEQ ID NO: 4582862 - DNA, 15 bp, Homo sapiens
tgaagatgcagctca

SEQ ID NO: 4582863 - DNA, 17 bp, Homo sapiens
tgaagatggagggggct

SEQ ID NO: 4582864 - DNA, 20 bp, Homo sapiens
tgaagatggagggggctggg

SEQ ID NO: 4582865 - DNA, 13 bp, Homo sapiens
tgaagatggcttt

SEQ ID NO: 4582866 - DNA, 17 bp, Homo sapiens
tgaagatgtagaggaga

SEQ ID NO: 4582867 - DNA, 19 bp, Homo sapiens
tgaagattcttaaaaattg

SEQ ID NO: 4582868 - DNA, 22 bp, Homo sapiens
tgaagcaaactctaaaattata

SEQ ID NO: 4582869 - DNA, 13 bp, Homo sapiens
tgaagcaaagaag

SEQ ID NO: 4582870 - DNA, 21 bp, Homo sapiens
tgaagcacagagggctaggga

SEQ ID NO: 4582871 - DNA, 14 bp, Homo sapiens
tgaagctactgtgt

SEQ ID NO: 4582872 - DNA, 22 bp, Homo sapiens
tgaagctactgtgtgtgtgaat

SEQ ID NO: 4582873 - DNA, 18 bp, Homo sapiens
tgaagctgacaatttatg

SEQ ID NO: 4582874 - DNA, 16 bp, Homo sapiens
tgaagctgctgtgtcc

SEQ ID NO: 4582875 - DNA, 15 bp, Homo sapiens
tgaagctgttgtgtg

SEQ ID NO: 4582876 - DNA, 19 bp, Homo sapiens
tgaagctgttgtgtgaggt

SEQ ID NO: 4582877 - DNA, 23 bp, Homo sapiens
tgaaggaaataaaaaagtctcta

SEQ ID NO: 4582878 - DNA, 20 bp, Homo sapiens
tgaaggaacttgtctcttca

SEQ ID NO: 4582879 - DNA, 20 bp, Homo sapiens
tgaaggatttttatttgcat

SEQ ID NO: 4582880 - DNA, 16 bp, Homo sapiens
tgaaggcaaaattgca

SEQ ID NO: 4582881 - DNA, 18 bp, Homo sapiens
tgaaggcacagctaacca

SEQ ID NO: 4582882 - DNA, 18 bp, Homo sapiens
tgaaggctggaaggcagc

SEQ ID NO: 4582883 - DNA, 23 bp, Homo sapiens
tgaaggctggaaggcagcaggca

SEQ ID NO: 4582884 - DNA, 13 bp, Homo sapiens
tgaaggcttctct

SEQ ID NO: 4582885 - DNA, 15 bp, Homo sapiens
tgaaggcttctctct

SEQ ID NO: 4582886 - DNA, 13 bp, Homo sapiens
tgaagggaaagat

SEQ ID NO: 4582887 - DNA, 14 bp, Homo sapiens
tgaagggtaaggga

SEQ ID NO: 4582888 - DNA, 14 bp, Homo sapiens
tgaagggtcctgcc

SEQ ID NO: 4582889 - DNA, 13 bp, Homo sapiens
tgaagggtggatg

SEQ ID NO: 4582890 - DNA, 18 bp, Homo sapiens
tgaaggtaaataaaaaga

SEQ ID NO: 4582891 - DNA, 20 bp, Homo sapiens
tgaaggtaaataaaaagaaa

SEQ ID NO: 4582892 - DNA, 18 bp, Homo sapiens
tgaaggtagaatgttttc

SEQ ID NO: 4582893 - DNA, 23 bp, Homo sapiens
tgaaggtagcattctttggagtt

SEQ ID NO: 4582894 - DNA, 22 bp, Homo sapiens
tgaaggtgatttaagggcccag

SEQ ID NO: 4582895 - DNA, 19 bp, Homo sapiens
tgaaggtgttgggtcagtg

SEQ ID NO: 4582896 - DNA, 19 bp, Homo sapiens
tgaagtaaagccattaaat

SEQ ID NO: 4582897 - DNA, 14 bp, Homo sapiens
tgaagtaaattgaa

SEQ ID NO: 4582898 - DNA, 19 bp, Homo sapiens
tgaagtaattcttctgcct

SEQ ID NO: 4582899 - DNA, 14 bp, Homo sapiens
tgaagtacaaacat

SEQ ID NO: 4582900 - DNA, 15 bp, Homo sapiens
tgaagtacaaacatg

SEQ ID NO: 4582901 - DNA, 16 bp, Homo sapiens
tgaagtacaaacatga

SEQ ID NO: 4582902 - DNA, 21 bp, Homo sapiens
tgaagtattacatgatttaaa

SEQ ID NO: 4582903 - DNA, 22 bp, Homo sapiens
tgaagtcacccctttctgtccc

SEQ ID NO: 4582904 - DNA, 19 bp, Homo sapiens
tgaagtcaccgggatgaac

SEQ ID NO: 4582905 - DNA, 14 bp, Homo sapiens
tgaagtctgacaat

SEQ ID NO: 4582906 - DNA, 18 bp, Homo sapiens
tgaagtgctgtttattaa

SEQ ID NO: 4582907 - DNA, 21 bp, Homo sapiens
tgaagtgtggctggtgtcccc

SEQ ID NO: 4582908 - DNA, 18 bp, Homo sapiens
tgaagtgttaatacatca

SEQ ID NO: 4582909 - DNA, 19 bp, Homo sapiens
tgaagtgttaatacatcac

SEQ ID NO: 4582910 - DNA, 21 bp, Homo sapiens
tgaagtgttccctttttcata

SEQ ID NO: 4582911 - DNA, 22 bp, Homo sapiens
tgaagtgttccctttttcataa

SEQ ID NO: 4582912 - DNA, 23 bp, Homo sapiens
tgaagttagctttaacttaaata

SEQ ID NO: 4582913 - DNA, 13 bp, Homo sapiens
tgaagttgaacat

SEQ ID NO: 4582914 - DNA, 20 bp, Homo sapiens
tgaagttgtttatcaacttc

SEQ ID NO: 4582915 - DNA, 14 bp, Homo sapiens
tgaagttttacatt

SEQ ID NO: 4582916 - DNA, 16 bp, Homo sapiens
tgaagttttacattgt

SEQ ID NO: 4582917 - DNA, 13 bp, Homo sapiens
tgaataaaattag

SEQ ID NO: 4582918 - DNA, 19 bp, Homo sapiens
tgaataaagaatacttgaa

SEQ ID NO: 4582919 - DNA, 23 bp, Homo sapiens
tgaataaagaatgccatttctca

SEQ ID NO: 4582920 - DNA, 14 bp, Homo sapiens
tgaataaagcaatt

SEQ ID NO: 4582921 - DNA, 13 bp, Homo sapiens
tgaataaagcctt

SEQ ID NO: 4582922 - DNA, 21 bp, Homo sapiens
tgaataaagcctttgtatctt

SEQ ID NO: 4582923 - DNA, 13 bp, Homo sapiens
tgaataagcagaa

SEQ ID NO: 4582924 - DNA, 16 bp, Homo sapiens
tgaataagcagaacat

SEQ ID NO: 4582925 - DNA, 17 bp, Homo sapiens
tgaataagcagaacata

SEQ ID NO: 4582926 - DNA, 23 bp, Homo sapiens
tgaataagcagaacatactgttc

SEQ ID NO: 4582927 - DNA, 14 bp, Homo sapiens
tgaataatggaaaa

SEQ ID NO: 4582928 - DNA, 15 bp, Homo sapiens
tgaatacacagtatt

SEQ ID NO: 4582929 - DNA, 20 bp, Homo sapiens
tgaatacattaacggtgcta

SEQ ID NO: 4582930 - DNA, 22 bp, Homo sapiens
tgaatactctgccctctagagc

SEQ ID NO: 4582931 - DNA, 17 bp, Homo sapiens
tgaatactgtctgtatc

SEQ ID NO: 4582932 - DNA, 16 bp, Homo sapiens
tgaatactttttacaa

SEQ ID NO: 4582933 - DNA, 14 bp, Homo sapiens
tgaatagcctggcc

SEQ ID NO: 4582934 - DNA, 14 bp, Homo sapiens
tgaatagttaaaaa

SEQ ID NO: 4582935 - DNA, 18 bp, Homo sapiens
tgaatagttaaaaattaa

SEQ ID NO: 4582936 - DNA, 16 bp, Homo sapiens
tgaatagtttatttct

SEQ ID NO: 4582937 - DNA, 17 bp, Homo sapiens
tgaatataaatgtgtgt

SEQ ID NO: 4582938 - DNA, 18 bp, Homo sapiens
tgaatataaatgtgtgta

SEQ ID NO: 4582939 - DNA, 21 bp, Homo sapiens
tgaatataaatgtgtgtatgt

SEQ ID NO: 4582940 - DNA, 19 bp, Homo sapiens
tgaatatactcattagaat

SEQ ID NO: 4582941 - DNA, 16 bp, Homo sapiens
tgaatatatggcattt

SEQ ID NO: 4582942 - DNA, 21 bp, Homo sapiens
tgaatatatggcatttgcaga

SEQ ID NO: 4582943 - DNA, 13 bp, Homo sapiens
tgaatatatttta

SEQ ID NO: 4582944 - DNA, 13 bp, Homo sapiens
tgaatattatata

SEQ ID NO: 4582945 - DNA, 14 bp, Homo sapiens
tgaatattatatat

SEQ ID NO: 4582946 - DNA, 15 bp, Homo sapiens
tgaatatttgtaaaa

SEQ ID NO: 4582947 - DNA, 20 bp, Homo sapiens
tgaatatttgtaaaaataat

SEQ ID NO: 4582948 - DNA, 21 bp, Homo sapiens
tgaatatttgttatgtagata

SEQ ID NO: 4582949 - DNA, 17 bp, Homo sapiens
tgaatattttcaagttt

SEQ ID NO: 4582950 - DNA, 19 bp, Homo sapiens
tgaatattttttgaaggtt

SEQ ID NO: 4582951 - DNA, 19 bp, Homo sapiens
tgaatcaataatatatttt

SEQ ID NO: 4582952 - DNA, 20 bp, Homo sapiens
tgaatcaataatatattttc

SEQ ID NO: 4582953 - DNA, 18 bp, Homo sapiens
tgaatcaatctggcttct

SEQ ID NO: 4582954 - DNA, 22 bp, Homo sapiens
tgaatcaatctggcttctgcat

SEQ ID NO: 4582955 - DNA, 21 bp, Homo sapiens
tgaatcagaccctaccccacc

SEQ ID NO: 4582956 - DNA, 18 bp, Homo sapiens
tgaatcattgtatgtggt

SEQ ID NO: 4582957 - DNA, 21 bp, Homo sapiens
tgaatcattgtatgtggtcat

SEQ ID NO: 4582958 - DNA, 22 bp, Homo sapiens
tgaatccatcttgctttttccc

SEQ ID NO: 4582959 - DNA, 17 bp, Homo sapiens
tgaatctagagaacagt

SEQ ID NO: 4582960 - DNA, 13 bp, Homo sapiens
tgaatctgctttt

SEQ ID NO: 4582961 - DNA, 19 bp, Homo sapiens
tgaatctgcttttcctctg

SEQ ID NO: 4582962 - DNA, 13 bp, Homo sapiens
tgaatctgggact

SEQ ID NO: 4582963 - DNA, 20 bp, Homo sapiens
tgaatctgggactgtgcctg

SEQ ID NO: 4582964 - DNA, 23 bp, Homo sapiens
tgaatctgtgtgcatatttgtta

SEQ ID NO: 4582965 - DNA, 23 bp, Homo sapiens
tgaatctttttatcccatttagt

SEQ ID NO: 4582966 - DNA, 11 bp, Homo sapiens
tgaatgaacac

SEQ ID NO: 4582967 - DNA, 12 bp, Homo sapiens
tgaatgatctat

SEQ ID NO: 4582968 - DNA, 16 bp, Homo sapiens
tgaatgattaaattat

SEQ ID NO: 4582969 - DNA, 22 bp, Homo sapiens
tgaatgccgaatttggtacaca

SEQ ID NO: 4582970 - DNA, 12 bp, Homo sapiens
tgaatgctgctt

SEQ ID NO: 4582971 - DNA, 19 bp, Homo sapiens
tgaatggactcatcttagt

SEQ ID NO: 4582972 - DNA, 19 bp, Homo sapiens
tgaatggactttgcacact

SEQ ID NO: 4582973 - DNA, 21 bp, Homo sapiens
tgaatggctatgtttttaatg

SEQ ID NO: 4582974 - DNA, 15 bp, Homo sapiens
tgaatgtaatttgtg

SEQ ID NO: 4582975 - DNA, 20 bp, Homo sapiens
tgaatgtaatttgtgtaata

SEQ ID NO: 4582976 - DNA, 21 bp, Homo sapiens
tgaatgtacaccacatgctat

SEQ ID NO: 4582977 - DNA, 18 bp, Homo sapiens
tgaatgtctcagcgaggt

SEQ ID NO: 4582978 - DNA, 20 bp, Homo sapiens
tgaatgtcttgttcctgtgc

SEQ ID NO: 4582979 - DNA, 18 bp, Homo sapiens
tgaatgtgctgaagcaaa

SEQ ID NO: 4582980 - DNA, 15 bp, Homo sapiens
tgaatgtggcagttt

SEQ ID NO: 4582981 - DNA, 18 bp, Homo sapiens
tgaatgtggcagtttaaa

SEQ ID NO: 4582982 - DNA, 16 bp, Homo sapiens
tgaatgttaatttttt

SEQ ID NO: 4582983 - DNA, 15 bp, Homo sapiens
tgaattaaataaata

SEQ ID NO: 4582984 - DNA, 13 bp, Homo sapiens
tgaattagaaaat

SEQ ID NO: 4582985 - DNA, 22 bp, Homo sapiens
tgaattaggctgtaactacttt

SEQ ID NO: 4582986 - DNA, 15 bp, Homo sapiens
tgaattagtgagtat

SEQ ID NO: 4582987 - DNA, 18 bp, Homo sapiens
tgaattagtgagtatagt

SEQ ID NO: 4582988 - DNA, 23 bp, Homo sapiens
tgaattataaatgtgtttatagc

SEQ ID NO: 4582989 - DNA, 14 bp, Homo sapiens
tgaattattgacac

SEQ ID NO: 4582990 - DNA, 16 bp, Homo sapiens
tgaattattgacactg

SEQ ID NO: 4582991 - DNA, 15 bp, Homo sapiens
tgaattcctcctcta

SEQ ID NO: 4582992 - DNA, 16 bp, Homo sapiens
tgaattcctctcaaat

SEQ ID NO: 4582993 - DNA, 23 bp, Homo sapiens
tgaattctttatcccattttatc

SEQ ID NO: 4582994 - DNA, 12 bp, Homo sapiens
tgaattgaaaaa

SEQ ID NO: 4582995 - DNA, 15 bp, Homo sapiens
tgaattgaaaaacaa

SEQ ID NO: 4582996 - DNA, 12 bp, Homo sapiens
tgaattgaagtt

SEQ ID NO: 4582997 - DNA, 16 bp, Homo sapiens
tgaattgaagtttcaa

SEQ ID NO: 4582998 - DNA, 19 bp, Homo sapiens
tgaattgaagtttcaagtt

SEQ ID NO: 4582999 - DNA, 21 bp, Homo sapiens
tgaattggctaaaagacatgc

SEQ ID NO: 4583000 - DNA, 17 bp, Homo sapiens
tgaattggtttttccca

SEQ ID NO: 4583001 - DNA, 18 bp, Homo sapiens
tgaattgtaactgttctt

SEQ ID NO: 4583002 - DNA, 19 bp, Homo sapiens
tgaattgtaactgttcttg

SEQ ID NO: 4583003 - DNA, 15 bp, Homo sapiens
tgaattgtccccagt

SEQ ID NO: 4583004 - DNA, 11 bp, Homo sapiens
tgaattgtgtc

SEQ ID NO: 4583005 - DNA, 18 bp, Homo sapiens
tgaatttaattctttcaa

SEQ ID NO: 4583006 - DNA, 19 bp, Homo sapiens
tgaatttatctttaccaaa

SEQ ID NO: 4583007 - DNA, 13 bp, Homo sapiens
tgaatttctcctt

SEQ ID NO: 4583008 - DNA, 14 bp, Homo sapiens
tgaatttgcaaagt

SEQ ID NO: 4583009 - DNA, 15 bp, Homo sapiens
tgaatttgcaaagta

SEQ ID NO: 4583010 - DNA, 17 bp, Homo sapiens
tgaatttgcaaagtact

SEQ ID NO: 4583011 - DNA, 18 bp, Homo sapiens
tgaatttgcaaagtactg

SEQ ID NO: 4583012 - DNA, 11 bp, Homo sapiens
tgaatttggag

SEQ ID NO: 4583013 - DNA, 22 bp, Homo sapiens
tgaatttgtaagcaacttgctt

SEQ ID NO: 4583014 - DNA, 13 bp, Homo sapiens
tgaatttgtagtt

SEQ ID NO: 4583015 - DNA, 13 bp, Homo sapiens
tgaattttaaagt

SEQ ID NO: 4583016 - DNA, 14 bp, Homo sapiens
tgaattttaaagta

SEQ ID NO: 4583017 - DNA, 22 bp, Homo sapiens
tgaattttaaagtatgcattat

SEQ ID NO: 4583018 - DNA, 22 bp, Homo sapiens
tgaattttctaaaagctttcat

SEQ ID NO: 4583019 - DNA, 20 bp, Homo sapiens
tgaattttggggattttcaa

SEQ ID NO: 4583020 - DNA, 22 bp, Homo sapiens
tgaattttggggattttcaaaa

SEQ ID NO: 4583021 - DNA, 21 bp, Homo sapiens
tgaatttttaaacaagtattt

SEQ ID NO: 4583022 - DNA, 23 bp, Homo sapiens
tgaatttttaaacaagtatttgt

SEQ ID NO: 4583023 - DNA, 13 bp, Homo sapiens
tgaatttttaagc

SEQ ID NO: 4583024 - DNA, 13 bp, Homo sapiens
tgaatttttgcaa

SEQ ID NO: 4583025 - DNA, 14 bp, Homo sapiens
tgaatttttgcaat

SEQ ID NO: 4583026 - DNA, 16 bp, Homo sapiens
tgaatttttgcaataa

SEQ ID NO: 4583027 - DNA, 23 bp, Homo sapiens
tgaatttttgcaataatgcagta

SEQ ID NO: 4583028 - DNA, 18 bp, Homo sapiens
tgaatttttttgtaataa

SEQ ID NO: 4583029 - DNA, 22 bp, Homo sapiens
tgaatttttttgtaataagcaa

SEQ ID NO: 4583030 - DNA, 21 bp, Homo sapiens
tgacaaaatggggcagaagag

SEQ ID NO: 4583031 - DNA, 16 bp, Homo sapiens
tgacaaaattcatttg

SEQ ID NO: 4583032 - DNA, 12 bp, Homo sapiens
tgacaaacacaa

SEQ ID NO: 4583033 - DNA, 19 bp, Homo sapiens
tgacaacacttaatagcaa

SEQ ID NO: 4583034 - DNA, 21 bp, Homo sapiens
tgacaaccattaaagtcagaa

SEQ ID NO: 4583035 - DNA, 13 bp, Homo sapiens
tgacaacctccat

SEQ ID NO: 4583036 - DNA, 21 bp, Homo sapiens
tgacaacctccattctatttt

SEQ ID NO: 4583037 - DNA, 19 bp, Homo sapiens
tgacaactgtttaattgaa

SEQ ID NO: 4583038 - DNA, 13 bp, Homo sapiens
tgacaagatggga

SEQ ID NO: 4583039 - DNA, 21 bp, Homo sapiens
tgacaagatgggacagcaaca

SEQ ID NO: 4583040 - DNA, 14 bp, Homo sapiens
tgacaagggcacaa

SEQ ID NO: 4583041 - DNA, 16 bp, Homo sapiens
tgacaagggcacaagc

SEQ ID NO: 4583042 - DNA, 21 bp, Homo sapiens
tgacaatagggctaaatgttt

SEQ ID NO: 4583043 - DNA, 16 bp, Homo sapiens
tgacaatatgacactt

SEQ ID NO: 4583044 - DNA, 14 bp, Homo sapiens
tgacaatcatctcc

SEQ ID NO: 4583045 - DNA, 22 bp, Homo sapiens
tgacaatcatctccaatggaaa

SEQ ID NO: 4583046 - DNA, 17 bp, Homo sapiens
tgacaattctgttttta

SEQ ID NO: 4583047 - DNA, 16 bp, Homo sapiens
tgacaattttgtacaa

SEQ ID NO: 4583048 - DNA, 19 bp, Homo sapiens
tgacacaggaaatgggaaa

SEQ ID NO: 4583049 - DNA, 17 bp, Homo sapiens
tgacaccatcttttatt

SEQ ID NO: 4583050 - DNA, 13 bp, Homo sapiens
tgacacccaggcc

SEQ ID NO: 4583051 - DNA, 14 bp, Homo sapiens
tgacaccctggcct

SEQ ID NO: 4583052 - DNA, 16 bp, Homo sapiens
tgacaccctggcctga

SEQ ID NO: 4583053 - DNA, 18 bp, Homo sapiens
tgacactagcccaatgaa

SEQ ID NO: 4583054 - DNA, 18 bp, Homo sapiens
tgacactcaataaacagt

SEQ ID NO: 4583055 - DNA, 19 bp, Homo sapiens
tgacactcaataaacagtc

SEQ ID NO: 4583056 - DNA, 13 bp, Homo sapiens
tgacactgctcta

SEQ ID NO: 4583057 - DNA, 22 bp, Homo sapiens
tgacactgctctaacagccctc

SEQ ID NO: 4583058 - DNA, 20 bp, Homo sapiens
tgacacttttcatatcattt

SEQ ID NO: 4583059 - DNA, 13 bp, Homo sapiens
tgacagaaagcag

SEQ ID NO: 4583060 - DNA, 23 bp, Homo sapiens
tgacagagcgagactccatctct

SEQ ID NO: 4583061 - DNA, 16 bp, Homo sapiens
tgacagaggctgcacc

SEQ ID NO: 4583062 - DNA, 20 bp, Homo sapiens
tgacagaggctgcacccctg

SEQ ID NO: 4583063 - DNA, 14 bp, Homo sapiens
tgacagatgcctgg

SEQ ID NO: 4583064 - DNA, 22 bp, Homo sapiens
tgacagcactaaacttggtgct

SEQ ID NO: 4583065 - DNA, 12 bp, Homo sapiens
tgacagctgtcc

SEQ ID NO: 4583066 - DNA, 18 bp, Homo sapiens
tgacagctgtccctgtca

SEQ ID NO: 4583067 - DNA, 20 bp, Homo sapiens
tgacagctgtccctgtcacc

SEQ ID NO: 4583068 - DNA, 19 bp, Homo sapiens
tgacaggaaagccctcccc

SEQ ID NO: 4583069 - DNA, 18 bp, Homo sapiens
tgacaggcctgaagatat

SEQ ID NO: 4583070 - DNA, 19 bp, Homo sapiens
tgacaggctctcctggctg

SEQ ID NO: 4583071 - DNA, 21 bp, Homo sapiens
tgacagtacccgactgtttat

SEQ ID NO: 4583072 - DNA, 19 bp, Homo sapiens
tgacagtatcttttttcct

SEQ ID NO: 4583073 - DNA, 23 bp, Homo sapiens
tgacagtattaacatcaaagact

SEQ ID NO: 4583074 - DNA, 12 bp, Homo sapiens
tgacagtgcctt

SEQ ID NO: 4583075 - DNA, 16 bp, Homo sapiens
tgacagtgccttctct

SEQ ID NO: 4583076 - DNA, 19 bp, Homo sapiens
tgacagtggctgctctggg

SEQ ID NO: 4583077 - DNA, 14 bp, Homo sapiens
tgacataaagttga

SEQ ID NO: 4583078 - DNA, 21 bp, Homo sapiens
tgacataaccaatttgtaatg

SEQ ID NO: 4583079 - DNA, 20 bp, Homo sapiens
tgacataattgtccagttat

SEQ ID NO: 4583080 - DNA, 11 bp, Homo sapiens
tgacatattta

SEQ ID NO: 4583081 - DNA, 20 bp, Homo sapiens
tgacatatttaatgttttaa

SEQ ID NO: 4583082 - DNA, 17 bp, Homo sapiens
tgacatctttttaaagc

SEQ ID NO: 4583083 - DNA, 22 bp, Homo sapiens
tgacatgacgtggtaaaatgtg

SEQ ID NO: 4583084 - DNA, 23 bp, Homo sapiens
tgacatgacgtggtaaaatgtga

SEQ ID NO: 4583085 - DNA, 15 bp, Homo sapiens
tgacatggaaatgaa

SEQ ID NO: 4583086 - DNA, 15 bp, Homo sapiens
tgacatggtgcctga

SEQ ID NO: 4583087 - DNA, 21 bp, Homo sapiens
tgacatggtgcctgagaggca

SEQ ID NO: 4583088 - DNA, 21 bp, Homo sapiens
tgacatgtaagaaaatgttac

SEQ ID NO: 4583089 - DNA, 19 bp, Homo sapiens
tgacattaacaaataaaaa

SEQ ID NO: 4583090 - DNA, 13 bp, Homo sapiens
tgacattcactgg

SEQ ID NO: 4583091 - DNA, 14 bp, Homo sapiens
tgacattcttagct

SEQ ID NO: 4583092 - DNA, 18 bp, Homo sapiens
tgacattcttagctgtaa

SEQ ID NO: 4583093 - DNA, 14 bp, Homo sapiens
tgacattgccaaaa

SEQ ID NO: 4583094 - DNA, 18 bp, Homo sapiens
tgacattgccaaaaagga

SEQ ID NO: 4583095 - DNA, 16 bp, Homo sapiens
tgacatttgtttattt

SEQ ID NO: 4583096 - DNA, 12 bp, Homo sapiens
tgacattttaca

SEQ ID NO: 4583097 - DNA, 15 bp, Homo sapiens
tgacattttacatta

SEQ ID NO: 4583098 - DNA, 14 bp, Homo sapiens
tgacattttactat

SEQ ID NO: 4583099 - DNA, 16 bp, Homo sapiens
tgaccaaagtcctttt

SEQ ID NO: 4583100 - DNA, 18 bp, Homo sapiens
tgaccaacatggagaaac

SEQ ID NO: 4583101 - DNA, 23 bp, Homo sapiens
tgaccaacatggagaaaccctgt

SEQ ID NO: 4583102 - DNA, 17 bp, Homo sapiens
tgaccaatattgtacag

SEQ ID NO: 4583103 - DNA, 18 bp, Homo sapiens
tgaccaatattgtacagt

SEQ ID NO: 4583104 - DNA, 21 bp, Homo sapiens
tgaccaatattgtacagtttt

SEQ ID NO: 4583105 - DNA, 13 bp, Homo sapiens
tgaccaatgtctt

SEQ ID NO: 4583106 - DNA, 15 bp, Homo sapiens
tgaccactccagaga

SEQ ID NO: 4583107 - DNA, 23 bp, Homo sapiens
tgaccactcttctttaagccata

SEQ ID NO: 4583108 - DNA, 13 bp, Homo sapiens
tgaccagaagcct

SEQ ID NO: 4583109 - DNA, 16 bp, Homo sapiens
tgaccagaagccttgg

SEQ ID NO: 4583110 - DNA, 17 bp, Homo sapiens
tgaccagaagccttgga

SEQ ID NO: 4583111 - DNA, 16 bp, Homo sapiens
tgaccaggctgcctcc

SEQ ID NO: 4583112 - DNA, 18 bp, Homo sapiens
tgaccagggatgctgggc

SEQ ID NO: 4583113 - DNA, 21 bp, Homo sapiens
tgaccagggatgctgggctgg

SEQ ID NO: 4583114 - DNA, 17 bp, Homo sapiens
tgaccagtgcctgtgag

SEQ ID NO: 4583115 - DNA, 18 bp, Homo sapiens
tgaccagtgcctgtgagc

SEQ ID NO: 4583116 - DNA, 14 bp, Homo sapiens
tgaccatactcaga

SEQ ID NO: 4583117 - DNA, 16 bp, Homo sapiens
tgaccatactgaggga

SEQ ID NO: 4583118 - DNA, 23 bp, Homo sapiens
tgaccatccactctaccctccca

SEQ ID NO: 4583119 - DNA, 18 bp, Homo sapiens
tgaccatgttatattgct

SEQ ID NO: 4583120 - DNA, 23 bp, Homo sapiens
tgaccattggctgcgctaacccc

SEQ ID NO: 4583121 - DNA, 19 bp, Homo sapiens
tgacccaaaaatgttccct

SEQ ID NO: 4583122 - DNA, 22 bp, Homo sapiens
tgacccagaggggacgctgagg

SEQ ID NO: 4583123 - DNA, 15 bp, Homo sapiens
tgacccagtccctgg

SEQ ID NO: 4583124 - DNA, 14 bp, Homo sapiens
tgacccatctgtag

SEQ ID NO: 4583125 - DNA, 15 bp, Homo sapiens
tgacccatctgtagt

SEQ ID NO: 4583126 - DNA, 16 bp, Homo sapiens
tgacccccatgtaaat

SEQ ID NO: 4583127 - DNA, 19 bp, Homo sapiens
tgacccccatgtaaatatt

SEQ ID NO: 4583128 - DNA, 13 bp, Homo sapiens
tgacccctgctca

SEQ ID NO: 4583129 - DNA, 21 bp, Homo sapiens
tgaccctatgggtctaggaca

SEQ ID NO: 4583130 - DNA, 13 bp, Homo sapiens
tgaccctcctgtt

SEQ ID NO: 4583131 - DNA, 16 bp, Homo sapiens
tgaccctcctgttgca

SEQ ID NO: 4583132 - DNA, 17 bp, Homo sapiens
tgaccctgctcctagca

SEQ ID NO: 4583133 - DNA, 11 bp, Homo sapiens
tgaccctgggc

SEQ ID NO: 4583134 - DNA, 16 bp, Homo sapiens
tgaccgtgggcggggc

SEQ ID NO: 4583135 - DNA, 22 bp, Homo sapiens
tgacctagttttccatgcgtgt

SEQ ID NO: 4583136 - DNA, 18 bp, Homo sapiens
tgacctccatactgggct

SEQ ID NO: 4583137 - DNA, 22 bp, Homo sapiens
tgacctcctctgggccctgtcg

SEQ ID NO: 4583138 - DNA, 19 bp, Homo sapiens
tgacctcggacagagcccc

SEQ ID NO: 4583139 - DNA, 19 bp, Homo sapiens
tgacctgaaataatatatt

SEQ ID NO: 4583140 - DNA, 12 bp, Homo sapiens
tgacctgcattg

SEQ ID NO: 4583141 - DNA, 15 bp, Homo sapiens
tgacctgtcagaata

SEQ ID NO: 4583142 - DNA, 15 bp, Homo sapiens
tgaccttagcgttct

SEQ ID NO: 4583143 - DNA, 15 bp, Homo sapiens
tgaccttgaatcttt

SEQ ID NO: 4583144 - DNA, 15 bp, Homo sapiens
tgacctttaggtatt

SEQ ID NO: 4583145 - DNA, 17 bp, Homo sapiens
tgaccttttatgtagta

SEQ ID NO: 4583146 - DNA, 18 bp, Homo sapiens
tgaccttttatgtagtaa

SEQ ID NO: 4583147 - DNA, 20 bp, Homo sapiens
tgacgacaaagctgctaaat

SEQ ID NO: 4583148 - DNA, 22 bp, Homo sapiens
tgacgctcagccccaggccagc

SEQ ID NO: 4583149 - DNA, 19 bp, Homo sapiens
tgacgggactcaggcggga

SEQ ID NO: 4583150 - DNA, 13 bp, Homo sapiens
tgacgtattatct

SEQ ID NO: 4583151 - DNA, 23 bp, Homo sapiens
tgacgtcactttttggccatgta

SEQ ID NO: 4583152 - DNA, 19 bp, Homo sapiens
tgactaaactacattataa

SEQ ID NO: 4583153 - DNA, 12 bp, Homo sapiens
tgactaaacttt

SEQ ID NO: 4583154 - DNA, 15 bp, Homo sapiens
tgactaaattcgtga

SEQ ID NO: 4583155 - DNA, 17 bp, Homo sapiens
tgactaacaggccaaag

SEQ ID NO: 4583156 - DNA, 24 bp, Homo sapiens
tgactacgtcttaagtcagatttt

SEQ ID NO: 4583157 - DNA, 18 bp, Homo sapiens
tgactagggattcaggct

SEQ ID NO: 4583158 - DNA, 12 bp, Homo sapiens
tgactatgtaaa

SEQ ID NO: 4583159 - DNA, 13 bp, Homo sapiens
tgactatgtaaac

SEQ ID NO: 4583160 - DNA, 22 bp, Homo sapiens
tgactattacttttctgtttag

SEQ ID NO: 4583161 - DNA, 20 bp, Homo sapiens
tgactattctgtatctttca

SEQ ID NO: 4583162 - DNA, 11 bp, Homo sapiens
tgactcaccca

SEQ ID NO: 4583163 - DNA, 19 bp, Homo sapiens
tgactcagctaatgtcaca

SEQ ID NO: 4583164 - DNA, 14 bp, Homo sapiens
tgactcagggctcc

SEQ ID NO: 4583165 - DNA, 15 bp, Homo sapiens
tgactcagggctcct

SEQ ID NO: 4583166 - DNA, 18 bp, Homo sapiens
tgactcagggctcctggg

SEQ ID NO: 4583167 - DNA, 22 bp, Homo sapiens
tgactcagtgtctgcctttaaa

SEQ ID NO: 4583168 - DNA, 16 bp, Homo sapiens
tgactccaaccattca

SEQ ID NO: 4583169 - DNA, 16 bp, Homo sapiens
tgactccctgtggggg

SEQ ID NO: 4583170 - DNA, 23 bp, Homo sapiens
tgactccctgtgggggtggccat

SEQ ID NO: 4583171 - DNA, 13 bp, Homo sapiens
tgactcctgaaac

SEQ ID NO: 4583172 - DNA, 14 bp, Homo sapiens
tgactcctggactc

SEQ ID NO: 4583173 - DNA, 20 bp, Homo sapiens
tgactctaatatgattatac

SEQ ID NO: 4583174 - DNA, 22 bp, Homo sapiens
tgactctaatatgattatacaa

SEQ ID NO: 4583175 - DNA, 21 bp, Homo sapiens
tgactctataagcaaattgct

SEQ ID NO: 4583176 - DNA, 13 bp, Homo sapiens
tgactctgccccc

SEQ ID NO: 4583177 - DNA, 17 bp, Homo sapiens
tgactctttattgtctg

SEQ ID NO: 4583178 - DNA, 20 bp, Homo sapiens
tgactctttattgtctgtaa

SEQ ID NO: 4583179 - DNA, 21 bp, Homo sapiens
tgactctttattgtctgtaaa

SEQ ID NO: 4583180 - DNA, 11 bp, Homo sapiens
tgactgagctt

SEQ ID NO: 4583181 - DNA, 17 bp, Homo sapiens
tgactgatgttcatgat

SEQ ID NO: 4583182 - DNA, 21 bp, Homo sapiens
tgactgcaagcatttttccat

SEQ ID NO: 4583183 - DNA, 19 bp, Homo sapiens
tgactgcattgccgctgta

SEQ ID NO: 4583184 - DNA, 12 bp, Homo sapiens
tgactggctcct

SEQ ID NO: 4583185 - DNA, 17 bp, Homo sapiens
tgactgggtcagccttc

SEQ ID NO: 4583186 - DNA, 23 bp, Homo sapiens
tgactggtgttatcaccgtgggc

SEQ ID NO: 4583187 - DNA, 19 bp, Homo sapiens
tgactgtagccacagctgc

SEQ ID NO: 4583188 - DNA, 12 bp, Homo sapiens
tgactgtatcta

SEQ ID NO: 4583189 - DNA, 21 bp, Homo sapiens
tgactgtatctaggcatttca

SEQ ID NO: 4583190 - DNA, 16 bp, Homo sapiens
tgacttaactgcattt

SEQ ID NO: 4583191 - DNA, 13 bp, Homo sapiens
tgacttagaaact

SEQ ID NO: 4583192 - DNA, 19 bp, Homo sapiens
tgacttagcctcctcccaa

SEQ ID NO: 4583193 - DNA, 19 bp, Homo sapiens
tgacttatagtacatgata

SEQ ID NO: 4583194 - DNA, 17 bp, Homo sapiens
tgacttatttatataaa

SEQ ID NO: 4583195 - DNA, 13 bp, Homo sapiens
tgacttatttctg

SEQ ID NO: 4583196 - DNA, 21 bp, Homo sapiens
tgacttcaggtggagagcact

SEQ ID NO: 4583197 - DNA, 15 bp, Homo sapiens
tgacttcattttata

SEQ ID NO: 4583198 - DNA, 17 bp, Homo sapiens
tgacttcattttatatt

SEQ ID NO: 4583199 - DNA, 17 bp, Homo sapiens
tgacttccttatttctg

SEQ ID NO: 4583200 - DNA, 13 bp, Homo sapiens
tgacttctgctgc

SEQ ID NO: 4583201 - DNA, 15 bp, Homo sapiens
tgacttctgctgctg

SEQ ID NO: 4583202 - DNA, 21 bp, Homo sapiens
tgacttctgctggcatcaaga

SEQ ID NO: 4583203 - DNA, 13 bp, Homo sapiens
tgacttgagccac

SEQ ID NO: 4583204 - DNA, 12 bp, Homo sapiens
tgacttgcttta

SEQ ID NO: 4583205 - DNA, 16 bp, Homo sapiens
tgactttcaggctact

SEQ ID NO: 4583206 - DNA, 15 bp, Homo sapiens
tgacttttaaaattt

SEQ ID NO: 4583207 - DNA, 20 bp, Homo sapiens
tgacttttaaggctaaaact

SEQ ID NO: 4583208 - DNA, 14 bp, Homo sapiens
tgacttttctgtgg

SEQ ID NO: 4583209 - DNA, 23 bp, Homo sapiens
tgactttttgcatttaaaacaga

SEQ ID NO: 4583210 - DNA, 14 bp, Homo sapiens
tgactttttggaat

SEQ ID NO: 4583211 - DNA, 22 bp, Homo sapiens
tgactttttggaattcagcagt

SEQ ID NO: 4583212 - DNA, 17 bp, Homo sapiens
tgactttttttgtatgt

SEQ ID NO: 4583213 - DNA, 19 bp, Homo sapiens
tgactttttttgtatgtgt

SEQ ID NO: 4583214 - DNA, 24 bp, Homo sapiens
tgagaaaacctgacttaaggggct

SEQ ID NO: 4583215 - DNA, 22 bp, Homo sapiens
tgagaaaactgtgaccaagtat

SEQ ID NO: 4583216 - DNA, 19 bp, Homo sapiens
tgagaaacttaaatgttat

SEQ ID NO: 4583217 - DNA, 15 bp, Homo sapiens
tgagaaagactattc

SEQ ID NO: 4583218 - DNA, 20 bp, Homo sapiens
tgagaaagcttttattcctt

SEQ ID NO: 4583219 - DNA, 21 bp, Homo sapiens
tgagaaagcttttattccttt

SEQ ID NO: 4583220 - DNA, 14 bp, Homo sapiens
tgagaaaggacaga

SEQ ID NO: 4583221 - DNA, 20 bp, Homo sapiens
tgagaaaggacagagccagc

SEQ ID NO: 4583222 - DNA, 23 bp, Homo sapiens
tgagaaaggacagagccagcggc

SEQ ID NO: 4583223 - DNA, 20 bp, Homo sapiens
tgagaaatcagaattggcat

SEQ ID NO: 4583224 - DNA, 15 bp, Homo sapiens
tgagaaatttaaact

SEQ ID NO: 4583225 - DNA, 17 bp, Homo sapiens
tgagaaatttaaactat

SEQ ID NO: 4583226 - DNA, 23 bp, Homo sapiens
tgagaactcgttcacctccaagc

SEQ ID NO: 4583227 - DNA, 13 bp, Homo sapiens
tgagaaggaacag

SEQ ID NO: 4583228 - DNA, 14 bp, Homo sapiens
tgagaaggcagcca

SEQ ID NO: 4583229 - DNA, 12 bp, Homo sapiens
tgagaatagaaa

SEQ ID NO: 4583230 - DNA, 24 bp, Homo sapiens
tgagaatagaaacgtaaactatga

SEQ ID NO: 4583231 - DNA, 19 bp, Homo sapiens
tgagaatataccttattta

SEQ ID NO: 4583232 - DNA, 22 bp, Homo sapiens
tgagaatcccaaatttgattga

SEQ ID NO: 4583233 - DNA, 15 bp, Homo sapiens
tgagaatggaggctc

SEQ ID NO: 4583234 - DNA, 14 bp, Homo sapiens
tgagacagctctgc

SEQ ID NO: 4583235 - DNA, 12 bp, Homo sapiens
tgagacaggctg

SEQ ID NO: 4583236 - DNA, 22 bp, Homo sapiens
tgagacagggtcttgctctgtc

SEQ ID NO: 4583237 - DNA, 15 bp, Homo sapiens
tgagacagtcttgct

SEQ ID NO: 4583238 - DNA, 13 bp, Homo sapiens
tgagacatccagc

SEQ ID NO: 4583239 - DNA, 19 bp, Homo sapiens
tgagaccatccattctcct

SEQ ID NO: 4583240 - DNA, 22 bp, Homo sapiens
tgagaccatccattctcctcag

SEQ ID NO: 4583241 - DNA, 15 bp, Homo sapiens
tgagacccccacacc

SEQ ID NO: 4583242 - DNA, 15 bp, Homo sapiens
tgagaccctgggaga

SEQ ID NO: 4583243 - DNA, 16 bp, Homo sapiens
tgagaccctgggagag

SEQ ID NO: 4583244 - DNA, 15 bp, Homo sapiens
tgagaccctgtctca

SEQ ID NO: 4583245 - DNA, 14 bp, Homo sapiens
tgagacctcagcca

SEQ ID NO: 4583246 - DNA, 17 bp, Homo sapiens
tgagacctcagccatga

SEQ ID NO: 4583247 - DNA, 21 bp, Homo sapiens
tgagacgccggcttcctcctt

SEQ ID NO: 4583248 - DNA, 15 bp, Homo sapiens
tgagactcgagaact

SEQ ID NO: 4583249 - DNA, 20 bp, Homo sapiens
tgagactctgtctcagtcca

SEQ ID NO: 4583250 - DNA, 13 bp, Homo sapiens
tgagactgtacat

SEQ ID NO: 4583251 - DNA, 22 bp, Homo sapiens
tgagactttcttctagtgcttt

SEQ ID NO: 4583252 - DNA, 14 bp, Homo sapiens
tgagactttctttc

SEQ ID NO: 4583253 - DNA, 14 bp, Homo sapiens
tgagactttttggt

SEQ ID NO: 4583254 - DNA, 17 bp, Homo sapiens
tgagagacctgctcagg

SEQ ID NO: 4583255 - DNA, 18 bp, Homo sapiens
tgagagacctgctcaggc

SEQ ID NO: 4583256 - DNA, 19 bp, Homo sapiens
tgagagacctgctcaggcg

SEQ ID NO: 4583257 - DNA, 21 bp, Homo sapiens
tgagagacgccactccctggg

SEQ ID NO: 4583258 - DNA, 20 bp, Homo sapiens
tgagagagacaggcagctcg

SEQ ID NO: 4583259 - DNA, 15 bp, Homo sapiens
tgagagagagagtgt

SEQ ID NO: 4583260 - DNA, 23 bp, Homo sapiens
tgagagagatgggagctcctctc

SEQ ID NO: 4583261 - DNA, 19 bp, Homo sapiens
tgagagccggccgtggaag

SEQ ID NO: 4583262 - DNA, 12 bp, Homo sapiens
tgagaggcaggc

SEQ ID NO: 4583263 - DNA, 13 bp, Homo sapiens
tgagaggcaggca

SEQ ID NO: 4583264 - DNA, 22 bp, Homo sapiens
tgagagtacaggtgcatattaa

SEQ ID NO: 4583265 - DNA, 16 bp, Homo sapiens
tgagagtcaaagctga

SEQ ID NO: 4583266 - DNA, 17 bp, Homo sapiens
tgagagtcattcaggtg

SEQ ID NO: 4583267 - DNA, 20 bp, Homo sapiens
tgagagtcattcaggtgacc

SEQ ID NO: 4583268 - DNA, 21 bp, Homo sapiens
tgagatacaaggcccagaagc

SEQ ID NO: 4583269 - DNA, 13 bp, Homo sapiens
tgagatacactga

SEQ ID NO: 4583270 - DNA, 20 bp, Homo sapiens
tgagataccagcgaggaggc

SEQ ID NO: 4583271 - DNA, 18 bp, Homo sapiens
tgagatactttgcattgt

SEQ ID NO: 4583272 - DNA, 14 bp, Homo sapiens
tgagatagttttca

SEQ ID NO: 4583273 - DNA, 16 bp, Homo sapiens
tgagatagttttcatt

SEQ ID NO: 4583274 - DNA, 14 bp, Homo sapiens
tgagatattatttt

SEQ ID NO: 4583275 - DNA, 17 bp, Homo sapiens
tgagatcttcctgctga

SEQ ID NO: 4583276 - DNA, 21 bp, Homo sapiens
tgagatcttcctgctgagtcc

SEQ ID NO: 4583277 - DNA, 15 bp, Homo sapiens
tgagatgaaaactag

SEQ ID NO: 4583278 - DNA, 17 bp, Homo sapiens
tgagatgagatgaccac

SEQ ID NO: 4583279 - DNA, 16 bp, Homo sapiens
tgagatgatttccaag

SEQ ID NO: 4583280 - DNA, 21 bp, Homo sapiens
tgagatgatttccaagcctct

SEQ ID NO: 4583281 - DNA, 24 bp, Homo sapiens
tgagatgtgaacacatcagcttgc

SEQ ID NO: 4583282 - DNA, 15 bp, Homo sapiens
tgagatgtgtatcag

SEQ ID NO: 4583283 - DNA, 18 bp, Homo sapiens
tgagatgtgtatcagtgt

SEQ ID NO: 4583284 - DNA, 19 bp, Homo sapiens
tgagatgtgtatcagtgtt

SEQ ID NO: 4583285 - DNA, 17 bp, Homo sapiens
tgagattcaatattgaa

SEQ ID NO: 4583286 - DNA, 23 bp, Homo sapiens
tgagattcaatattgaatttttc

SEQ ID NO: 4583287 - DNA, 19 bp, Homo sapiens
tgagattgccccaggtctg

SEQ ID NO: 4583288 - DNA, 18 bp, Homo sapiens
tgagatttcatctgctct

SEQ ID NO: 4583289 - DNA, 19 bp, Homo sapiens
tgagatttcatctgctctc

SEQ ID NO: 4583290 - DNA, 14 bp, Homo sapiens
tgagatttccttat

SEQ ID NO: 4583291 - DNA, 15 bp, Homo sapiens
tgagatttcttattt

SEQ ID NO: 4583292 - DNA, 17 bp, Homo sapiens
tgagattttgcttgagc

SEQ ID NO: 4583293 - DNA, 22 bp, Homo sapiens
tgagatttttaaaaaatatttt

SEQ ID NO: 4583294 - DNA, 17 bp, Homo sapiens
tgagcaaaggccctggg

SEQ ID NO: 4583295 - DNA, 19 bp, Homo sapiens
tgagcaaccacatttagaa

SEQ ID NO: 4583296 - DNA, 18 bp, Homo sapiens
tgagcaactcttgattat

SEQ ID NO: 4583297 - DNA, 13 bp, Homo sapiens
tgagcacatctct

SEQ ID NO: 4583298 - DNA, 22 bp, Homo sapiens
tgagcacatctctctgccctct

SEQ ID NO: 4583299 - DNA, 14 bp, Homo sapiens
tgagcactcctggt

SEQ ID NO: 4583300 - DNA, 16 bp, Homo sapiens
tgagcactcctggtgc

SEQ ID NO: 4583301 - DNA, 15 bp, Homo sapiens
tgagcacttagcagg

SEQ ID NO: 4583302 - DNA, 14 bp, Homo sapiens
tgagcaggagcttg

SEQ ID NO: 4583303 - DNA, 16 bp, Homo sapiens
tgagcaggagcttggg

SEQ ID NO: 4583304 - DNA, 23 bp, Homo sapiens
tgagcaggagcttgggtctctct

SEQ ID NO: 4583305 - DNA, 15 bp, Homo sapiens
tgagcaggattttaa

SEQ ID NO: 4583306 - DNA, 15 bp, Homo sapiens
tgagcaggggaagca

SEQ ID NO: 4583307 - DNA, 18 bp, Homo sapiens
tgagcaggggaagcagga

SEQ ID NO: 4583308 - DNA, 20 bp, Homo sapiens
tgagcaggggcccctgggga

SEQ ID NO: 4583309 - DNA, 16 bp, Homo sapiens
tgagcagtcgcctgcc

SEQ ID NO: 4583310 - DNA, 18 bp, Homo sapiens
tgagcagtcgcctgcctg

SEQ ID NO: 4583311 - DNA, 19 bp, Homo sapiens
tgagcagtcgcctgcctgc

SEQ ID NO: 4583312 - DNA, 20 bp, Homo sapiens
tgagcatcaatcttgttact

SEQ ID NO: 4583313 - DNA, 22 bp, Homo sapiens
tgagcatcagagggctgatgga

SEQ ID NO: 4583314 - DNA, 15 bp, Homo sapiens
tgagcatccagacct

SEQ ID NO: 4583315 - DNA, 16 bp, Homo sapiens
tgagcatccagacctg

SEQ ID NO: 4583316 - DNA, 18 bp, Homo sapiens
tgagcatgcacactgaga

SEQ ID NO: 4583317 - DNA, 14 bp, Homo sapiens
tgagcatggagctg

SEQ ID NO: 4583318 - DNA, 15 bp, Homo sapiens
tgagcatggggccag

SEQ ID NO: 4583319 - DNA, 18 bp, Homo sapiens
tgagcatgggtgtgccct

SEQ ID NO: 4583320 - DNA, 22 bp, Homo sapiens
tgagcattagaatggaggaaat

SEQ ID NO: 4583321 - DNA, 23 bp, Homo sapiens
tgagccaagatcgcaccactgca

SEQ ID NO: 4583322 - DNA, 14 bp, Homo sapiens
tgagccaaggaggc

SEQ ID NO: 4583323 - DNA, 17 bp, Homo sapiens
tgagccaaggaggcctg

SEQ ID NO: 4583324 - DNA, 16 bp, Homo sapiens
tgagccacagcagcat

SEQ ID NO: 4583325 - DNA, 20 bp, Homo sapiens
tgagccacagcagcattttt

SEQ ID NO: 4583326 - DNA, 16 bp, Homo sapiens
tgagccaccgtgcctg

SEQ ID NO: 4583327 - DNA, 18 bp, Homo sapiens
tgagccaccgtgcctggc

SEQ ID NO: 4583328 - DNA, 23 bp, Homo sapiens
tgagccaccgtgcctggccagat

SEQ ID NO: 4583329 - DNA, 19 bp, Homo sapiens
tgagccacctgcccttttt

SEQ ID NO: 4583330 - DNA, 14 bp, Homo sapiens
tgagccagctgcag

SEQ ID NO: 4583331 - DNA, 18 bp, Homo sapiens
tgagccatgctacagtta

SEQ ID NO: 4583332 - DNA, 15 bp, Homo sapiens
tgagcccattcttct

SEQ ID NO: 4583333 - DNA, 13 bp, Homo sapiens
tgagccccaaaag

SEQ ID NO: 4583334 - DNA, 17 bp, Homo sapiens
tgagccccagcgggctg

SEQ ID NO: 4583335 - DNA, 21 bp, Homo sapiens
tgagccccagcgggctggcgg

SEQ ID NO: 4583336 - DNA, 19 bp, Homo sapiens
tgagccccggaggtcgagg

SEQ ID NO: 4583337 - DNA, 14 bp, Homo sapiens
tgagcccctcccca

SEQ ID NO: 4583338 - DNA, 18 bp, Homo sapiens
tgagcccctccccagcca

SEQ ID NO: 4583339 - DNA, 12 bp, Homo sapiens
tgagccctgctc

SEQ ID NO: 4583340 - DNA, 17 bp, Homo sapiens
tgagccctgctcttctc

SEQ ID NO: 4583341 - DNA, 13 bp, Homo sapiens
tgagccctggctc

SEQ ID NO: 4583342 - DNA, 14 bp, Homo sapiens
tgagccctggctcc

SEQ ID NO: 4583343 - DNA, 19 bp, Homo sapiens
tgagccctggctcccacct

SEQ ID NO: 4583344 - DNA, 14 bp, Homo sapiens
tgagccgcccaagg

SEQ ID NO: 4583345 - DNA, 15 bp, Homo sapiens
tgagccgcccaaggc

SEQ ID NO: 4583346 - DNA, 18 bp, Homo sapiens
tgagccgcccaaggcctt

SEQ ID NO: 4583347 - DNA, 22 bp, Homo sapiens
tgagccgcggggaagctggctt

SEQ ID NO: 4583348 - DNA, 17 bp, Homo sapiens
tgagccgggcccctggg

SEQ ID NO: 4583349 - DNA, 16 bp, Homo sapiens
tgagcctggtcctggc

SEQ ID NO: 4583350 - DNA, 20 bp, Homo sapiens
tgagcgacagtgagactctg

SEQ ID NO: 4583351 - DNA, 22 bp, Homo sapiens
tgagcgacatctctgactttct

SEQ ID NO: 4583352 - DNA, 23 bp, Homo sapiens
tgagcgaggagatgctccttggg

SEQ ID NO: 4583353 - DNA, 19 bp, Homo sapiens
tgagcgcccccgagccctg

SEQ ID NO: 4583354 - DNA, 18 bp, Homo sapiens
tgagcgctcctgccgcag

SEQ ID NO: 4583355 - DNA, 22 bp, Homo sapiens
tgagcgctcctgccgcagagct

SEQ ID NO: 4583356 - DNA, 17 bp, Homo sapiens
tgagcgtgcgcactgca

SEQ ID NO: 4583357 - DNA, 20 bp, Homo sapiens
tgagcgtgcgcactgcatgg

SEQ ID NO: 4583358 - DNA, 15 bp, Homo sapiens
tgagctattaaaact

SEQ ID NO: 4583359 - DNA, 16 bp, Homo sapiens
tgagctattgctgttc

SEQ ID NO: 4583360 - DNA, 15 bp, Homo sapiens
tgagctatttcatct

SEQ ID NO: 4583361 - DNA, 17 bp, Homo sapiens
tgagctattttcctctg

SEQ ID NO: 4583362 - DNA, 18 bp, Homo sapiens
tgagctcacatgggactg

SEQ ID NO: 4583363 - DNA, 11 bp, Homo sapiens
tgagctcaggt

SEQ ID NO: 4583364 - DNA, 16 bp, Homo sapiens
tgagctcggggacagg

SEQ ID NO: 4583365 - DNA, 18 bp, Homo sapiens
tgagctcggggacaggtg

SEQ ID NO: 4583366 - DNA, 15 bp, Homo sapiens
tgagctctcaggccg

SEQ ID NO: 4583367 - DNA, 12 bp, Homo sapiens
tgagctctctgt

SEQ ID NO: 4583368 - DNA, 14 bp, Homo sapiens
tgagctcttccctt

SEQ ID NO: 4583369 - DNA, 14 bp, Homo sapiens
tgagctgcagcccc

SEQ ID NO: 4583370 - DNA, 11 bp, Homo sapiens
tgagctgcctt

SEQ ID NO: 4583371 - DNA, 15 bp, Homo sapiens
tgagctgccttccct

SEQ ID NO: 4583372 - DNA, 16 bp, Homo sapiens
tgagctgccttcccta

SEQ ID NO: 4583373 - DNA, 17 bp, Homo sapiens
tgagctggggactcagg

SEQ ID NO: 4583374 - DNA, 19 bp, Homo sapiens
tgagctggggactcaggga

SEQ ID NO: 4583375 - DNA, 21 bp, Homo sapiens
tgagctggggactcagggacc

SEQ ID NO: 4583376 - DNA, 20 bp, Homo sapiens
tgagctggggatgtctctca

SEQ ID NO: 4583377 - DNA, 14 bp, Homo sapiens
tgagcttcaatata

SEQ ID NO: 4583378 - DNA, 18 bp, Homo sapiens
tgagcttcaatataagaa

SEQ ID NO: 4583379 - DNA, 21 bp, Homo sapiens
tgaggaaactgagtcactcac

SEQ ID NO: 4583380 - DNA, 18 bp, Homo sapiens
tgaggaaagcaagaatca

SEQ ID NO: 4583381 - DNA, 15 bp, Homo sapiens
tgaggaactgtacag

SEQ ID NO: 4583382 - DNA, 19 bp, Homo sapiens
tgaggaactgtacagaaaa

SEQ ID NO: 4583383 - DNA, 22 bp, Homo sapiens
tgaggaatttcacctgtaaacc

SEQ ID NO: 4583384 - DNA, 14 bp, Homo sapiens
tgaggacagagggc

SEQ ID NO: 4583385 - DNA, 14 bp, Homo sapiens
tgaggacctttctg

SEQ ID NO: 4583386 - DNA, 24 bp, Homo sapiens
tgaggactctttccgactgcccag

SEQ ID NO: 4583387 - DNA, 21 bp, Homo sapiens
tgaggagagaaaatatatgta

SEQ ID NO: 4583388 - DNA, 16 bp, Homo sapiens
tgaggagatgaccagg

SEQ ID NO: 4583389 - DNA, 21 bp, Homo sapiens
tgaggagatgaccagggatgc

SEQ ID NO: 4583390 - DNA, 15 bp, Homo sapiens
tgaggagctgctggc

SEQ ID NO: 4583391 - DNA, 16 bp, Homo sapiens
tgaggagctgctggct

SEQ ID NO: 4583392 - DNA, 17 bp, Homo sapiens
tgaggagctgctggctt

SEQ ID NO: 4583393 - DNA, 18 bp, Homo sapiens
tgaggaggagctggcctg

SEQ ID NO: 4583394 - DNA, 19 bp, Homo sapiens
tgaggaggagctggcctgc

SEQ ID NO: 4583395 - DNA, 17 bp, Homo sapiens
tgaggatataatgtgtg

SEQ ID NO: 4583396 - DNA, 21 bp, Homo sapiens
tgaggatataatgtgtgcttt

SEQ ID NO: 4583397 - DNA, 13 bp, Homo sapiens
tgaggcagaagaa

SEQ ID NO: 4583398 - DNA, 14 bp, Homo sapiens
tgaggccagggcag

SEQ ID NO: 4583399 - DNA, 20 bp, Homo sapiens
tgaggccatctcaggagatg

SEQ ID NO: 4583400 - DNA, 22 bp, Homo sapiens
tgaggccatctcaggagatgga

SEQ ID NO: 4583401 - DNA, 15 bp, Homo sapiens
tgaggcccctgcctc

SEQ ID NO: 4583402 - DNA, 16 bp, Homo sapiens
tgaggccctgggctgg

SEQ ID NO: 4583403 - DNA, 16 bp, Homo sapiens
tgaggcctagactctg

SEQ ID NO: 4583404 - DNA, 15 bp, Homo sapiens
tgaggcggaggctgt

SEQ ID NO: 4583405 - DNA, 22 bp, Homo sapiens
tgaggctacaaggggtgtgtaa

SEQ ID NO: 4583406 - DNA, 19 bp, Homo sapiens
tgaggctgtttttggctgt

SEQ ID NO: 4583407 - DNA, 17 bp, Homo sapiens
tgagggaacagacagga

SEQ ID NO: 4583408 - DNA, 22 bp, Homo sapiens
tgagggaacagacaggagaaat

SEQ ID NO: 4583409 - DNA, 16 bp, Homo sapiens
tgagggagatgccatg

SEQ ID NO: 4583410 - DNA, 15 bp, Homo sapiens
tgagggaggagggct

SEQ ID NO: 4583411 - DNA, 12 bp, Homo sapiens
tgagggcaaatc

SEQ ID NO: 4583412 - DNA, 17 bp, Homo sapiens
tgaggggcatctgcccc

SEQ ID NO: 4583413 - DNA, 22 bp, Homo sapiens
tgaggggcatctgcccctcccc

SEQ ID NO: 4583414 - DNA, 22 bp, Homo sapiens
tgaggggccagggaggaaggag

SEQ ID NO: 4583415 - DNA, 18 bp, Homo sapiens
tgaggggccctggccagg

SEQ ID NO: 4583416 - DNA, 17 bp, Homo sapiens
tgaggggcttcctgggt

SEQ ID NO: 4583417 - DNA, 15 bp, Homo sapiens
tgaggggtctcggat

SEQ ID NO: 4583418 - DNA, 16 bp, Homo sapiens
tgaggggtctcggatg

SEQ ID NO: 4583419 - DNA, 14 bp, Homo sapiens
tgagggtgtttcct

SEQ ID NO: 4583420 - DNA, 15 bp, Homo sapiens
tgagggtgtttcctc

SEQ ID NO: 4583421 - DNA, 20 bp, Homo sapiens
tgagggtgtttcctctaaac

SEQ ID NO: 4583422 - DNA, 21 bp, Homo sapiens
tgagggtttctgatctgtact

SEQ ID NO: 4583423 - DNA, 22 bp, Homo sapiens
tgaggtactgagagtgaacaaa

SEQ ID NO: 4583424 - DNA, 13 bp, Homo sapiens
tgaggtccttatg

SEQ ID NO: 4583425 - DNA, 14 bp, Homo sapiens
tgaggtctgttcct

SEQ ID NO: 4583426 - DNA, 16 bp, Homo sapiens
tgaggtctgttccttt

SEQ ID NO: 4583427 - DNA, 15 bp, Homo sapiens
tgaggtgaaagggag

SEQ ID NO: 4583428 - DNA, 16 bp, Homo sapiens
tgaggtgaaagggagc

SEQ ID NO: 4583429 - DNA, 15 bp, Homo sapiens
tgaggtggaagccct

SEQ ID NO: 4583430 - DNA, 21 bp, Homo sapiens
tgaggtgggaggtggaagaag

SEQ ID NO: 4583431 - DNA, 22 bp, Homo sapiens
tgaggttaaacggtgcccatcc

SEQ ID NO: 4583432 - DNA, 17 bp, Homo sapiens
tgaggttcctctgcctg

SEQ ID NO: 4583433 - DNA, 18 bp, Homo sapiens
tgaggttcctctgcctgc

SEQ ID NO: 4583434 - DNA, 22 bp, Homo sapiens
tgaggttttatttcatttttca

SEQ ID NO: 4583435 - DNA, 23 bp, Homo sapiens
tgagtaagtgaaggtctcctaaa

SEQ ID NO: 4583436 - DNA, 19 bp, Homo sapiens
tgagtagacacatttaagg

SEQ ID NO: 4583437 - DNA, 16 bp, Homo sapiens
tgagtagtggccactg

SEQ ID NO: 4583438 - DNA, 21 bp, Homo sapiens
tgagtagtggccactggggtg

SEQ ID NO: 4583439 - DNA, 15 bp, Homo sapiens
tgagtagttactaaa

SEQ ID NO: 4583440 - DNA, 19 bp, Homo sapiens
tgagtagttgttggtctgt

SEQ ID NO: 4583441 - DNA, 22 bp, Homo sapiens
tgagtagttgttggtctgtagc

SEQ ID NO: 4583442 - DNA, 13 bp, Homo sapiens
tgagtcagaatgt

SEQ ID NO: 4583443 - DNA, 14 bp, Homo sapiens
tgagtcattgactt

SEQ ID NO: 4583444 - DNA, 15 bp, Homo sapiens
tgagtcattgacttc

SEQ ID NO: 4583445 - DNA, 17 bp, Homo sapiens
tgagtcattgacttcat

SEQ ID NO: 4583446 - DNA, 18 bp, Homo sapiens
tgagtcatttgtttaaac

SEQ ID NO: 4583447 - DNA, 13 bp, Homo sapiens
tgagtccagctcc

SEQ ID NO: 4583448 - DNA, 22 bp, Homo sapiens
tgagtccattctcccaggtacc

SEQ ID NO: 4583449 - DNA, 19 bp, Homo sapiens
tgagtcctgtctctgcctg

SEQ ID NO: 4583450 - DNA, 13 bp, Homo sapiens
tgagtcctttcca

SEQ ID NO: 4583451 - DNA, 20 bp, Homo sapiens
tgagtcgagattgcactgct

SEQ ID NO: 4583452 - DNA, 17 bp, Homo sapiens
tgagtcgtacagaaagc

SEQ ID NO: 4583453 - DNA, 19 bp, Homo sapiens
tgagtcgtacagaaagctg

SEQ ID NO: 4583454 - DNA, 14 bp, Homo sapiens
tgagtctctggggc

SEQ ID NO: 4583455 - DNA, 22 bp, Homo sapiens
tgagtctctggggcaggctgct

SEQ ID NO: 4583456 - DNA, 12 bp, Homo sapiens
tgagtctgtaat

SEQ ID NO: 4583457 - DNA, 15 bp, Homo sapiens
tgagtctgtaatttt

SEQ ID NO: 4583458 - DNA, 21 bp, Homo sapiens
tgagtcttaactgtatttcag

SEQ ID NO: 4583459 - DNA, 15 bp, Homo sapiens
tgagtgcagtcctga

SEQ ID NO: 4583460 - DNA, 15 bp, Homo sapiens
tgagtgccatgcttt

SEQ ID NO: 4583461 - DNA, 16 bp, Homo sapiens
tgagtgccatgctttt

SEQ ID NO: 4583462 - DNA, 21 bp, Homo sapiens
tgagtgccttctgtggggact

SEQ ID NO: 4583463 - DNA, 22 bp, Homo sapiens
tgagtgcgggctgaggccagag

SEQ ID NO: 4583464 - DNA, 22 bp, Homo sapiens
tgagtgcttgttagagagaaag

SEQ ID NO: 4583465 - DNA, 13 bp, Homo sapiens
tgagtgggaagcc

SEQ ID NO: 4583466 - DNA, 14 bp, Homo sapiens
tgagtgggaagccc

SEQ ID NO: 4583467 - DNA, 15 bp, Homo sapiens
tgagtggtgtgactc

SEQ ID NO: 4583468 - DNA, 22 bp, Homo sapiens
tgagttacttagaatgccataa

SEQ ID NO: 4583469 - DNA, 17 bp, Homo sapiens
tgagttattccacaaac

SEQ ID NO: 4583470 - DNA, 17 bp, Homo sapiens
tgagttccagaaagtaa

SEQ ID NO: 4583471 - DNA, 18 bp, Homo sapiens
tgagttccagaaagtaaa

SEQ ID NO: 4583472 - DNA, 16 bp, Homo sapiens
tgagttccagttgaag

SEQ ID NO: 4583473 - DNA, 20 bp, Homo sapiens
tgagttcccgggagctgggc

SEQ ID NO: 4583474 - DNA, 19 bp, Homo sapiens
tgagttggacttcagtctt

SEQ ID NO: 4583475 - DNA, 22 bp, Homo sapiens
tgagttgggggtgtggctctgc

SEQ ID NO: 4583476 - DNA, 19 bp, Homo sapiens
tgagtttaaaaatcaactt

SEQ ID NO: 4583477 - DNA, 17 bp, Homo sapiens
tgagtttgagctgcctt

SEQ ID NO: 4583478 - DNA, 18 bp, Homo sapiens
tgagtttgtaggtaaaat

SEQ ID NO: 4583479 - DNA, 19 bp, Homo sapiens
tgagttttactcttaaatc

SEQ ID NO: 4583480 - DNA, 13 bp, Homo sapiens
tgagttttttcct

SEQ ID NO: 4583481 - DNA, 19 bp, Homo sapiens
tgataaaccaaaaacattt

SEQ ID NO: 4583482 - DNA, 14 bp, Homo sapiens
tgataaactgacga

SEQ ID NO: 4583483 - DNA, 15 bp, Homo sapiens
tgataaagagacagt

SEQ ID NO: 4583484 - DNA, 16 bp, Homo sapiens
tgataaagaggcatct

SEQ ID NO: 4583485 - DNA, 19 bp, Homo sapiens
tgataaagattttttaata

SEQ ID NO: 4583486 - DNA, 23 bp, Homo sapiens
tgataacaagcaaggatatcaga

SEQ ID NO: 4583487 - DNA, 21 bp, Homo sapiens
tgataactgtttatatgtgtt

SEQ ID NO: 4583488 - DNA, 15 bp, Homo sapiens
tgataagacattttg

SEQ ID NO: 4583489 - DNA, 18 bp, Homo sapiens
tgataagagaatcaacat

SEQ ID NO: 4583490 - DNA, 18 bp, Homo sapiens
tgataatgaacagaacat

SEQ ID NO: 4583491 - DNA, 20 bp, Homo sapiens
tgataatgaacagaacatag

SEQ ID NO: 4583492 - DNA, 13 bp, Homo sapiens
tgatacagttttg

SEQ ID NO: 4583493 - DNA, 14 bp, Homo sapiens
tgatacatttttgt

SEQ ID NO: 4583494 - DNA, 21 bp, Homo sapiens
tgataccagcagcaactgaaa

SEQ ID NO: 4583495 - DNA, 14 bp, Homo sapiens
tgataccagctgga

SEQ ID NO: 4583496 - DNA, 15 bp, Homo sapiens
tgatacccaacagtt

SEQ ID NO: 4583497 - DNA, 21 bp, Homo sapiens
tgataccccgtctctactaaa

SEQ ID NO: 4583498 - DNA, 14 bp, Homo sapiens
tgatactaagcatt

SEQ ID NO: 4583499 - DNA, 16 bp, Homo sapiens
tgatactaagcattga

SEQ ID NO: 4583500 - DNA, 19 bp, Homo sapiens
tgatactttagccatcata

SEQ ID NO: 4583501 - DNA, 13 bp, Homo sapiens
tgatagaaagaat

SEQ ID NO: 4583502 - DNA, 21 bp, Homo sapiens
tgatagaaagaataaaatgtt

SEQ ID NO: 4583503 - DNA, 21 bp, Homo sapiens
tgatagaaggctatggggata

SEQ ID NO: 4583504 - DNA, 14 bp, Homo sapiens
tgatagctgtttca

SEQ ID NO: 4583505 - DNA, 14 bp, Homo sapiens
tgatagcttcgcat

SEQ ID NO: 4583506 - DNA, 24 bp, Homo sapiens
tgatagttgtaccgcaatgtgact

SEQ ID NO: 4583507 - DNA, 17 bp, Homo sapiens
tgatataactttagaaa

SEQ ID NO: 4583508 - DNA, 16 bp, Homo sapiens
tgatataatctttcaa

SEQ ID NO: 4583509 - DNA, 20 bp, Homo sapiens
tgatatacacagtggcaaaa

SEQ ID NO: 4583510 - DNA, 13 bp, Homo sapiens
tgatatattttac

SEQ ID NO: 4583511 - DNA, 18 bp, Homo sapiens
tgatatctatagtagaca

SEQ ID NO: 4583512 - DNA, 21 bp, Homo sapiens
tgatattaaagcgcaaatgaa

SEQ ID NO: 4583513 - DNA, 15 bp, Homo sapiens
tgatattatattaaa

SEQ ID NO: 4583514 - DNA, 20 bp, Homo sapiens
tgatattatattaaacatac

SEQ ID NO: 4583515 - DNA, 16 bp, Homo sapiens
tgatattcaaggcttt

SEQ ID NO: 4583516 - DNA, 22 bp, Homo sapiens
tgatattcaaggctttaaaagt

SEQ ID NO: 4583517 - DNA, 21 bp, Homo sapiens
tgatattccccccacttaaga

SEQ ID NO: 4583518 - DNA, 18 bp, Homo sapiens
tgatattctgttgcttta

SEQ ID NO: 4583519 - DNA, 16 bp, Homo sapiens
tgatattgctgaagaa

SEQ ID NO: 4583520 - DNA, 14 bp, Homo sapiens
tgatattgtttgct

SEQ ID NO: 4583521 - DNA, 23 bp, Homo sapiens
tgatattgtttgctgttgggttt

SEQ ID NO: 4583522 - DNA, 15 bp, Homo sapiens
tgatatttcttgctt

SEQ ID NO: 4583523 - DNA, 13 bp, Homo sapiens
tgatattttaaaa

SEQ ID NO: 4583524 - DNA, 17 bp, Homo sapiens
tgatattttctgtgcct

SEQ ID NO: 4583525 - DNA, 20 bp, Homo sapiens
tgatattttctgtgcctgaa

SEQ ID NO: 4583526 - DNA, 17 bp, Homo sapiens
tgatattttttatcata

SEQ ID NO: 4583527 - DNA, 18 bp, Homo sapiens
tgatcacatctaaagctt

SEQ ID NO: 4583528 - DNA, 19 bp, Homo sapiens
tgatcacatctaaagcttt

SEQ ID NO: 4583529 - DNA, 16 bp, Homo sapiens
tgatcaccatgaaaga

SEQ ID NO: 4583530 - DNA, 22 bp, Homo sapiens
tgatcagaagaacatgatttta

SEQ ID NO: 4583531 - DNA, 16 bp, Homo sapiens
tgatcagatgctgaat

SEQ ID NO: 4583532 - DNA, 16 bp, Homo sapiens
tgatcaggtaactttc

SEQ ID NO: 4583533 - DNA, 14 bp, Homo sapiens
tgatcatgtacttt

SEQ ID NO: 4583534 - DNA, 20 bp, Homo sapiens
tgatcattttccccccactc

SEQ ID NO: 4583535 - DNA, 13 bp, Homo sapiens
tgatccaactaat

SEQ ID NO: 4583536 - DNA, 22 bp, Homo sapiens
tgatccaggcaatcgttctgct

SEQ ID NO: 4583537 - DNA, 23 bp, Homo sapiens
tgatccagtcattttattttgta

SEQ ID NO: 4583538 - DNA, 15 bp, Homo sapiens
tgatccctaatgtgt

SEQ ID NO: 4583539 - DNA, 18 bp, Homo sapiens
tgatcccttctcctgccc

SEQ ID NO: 4583540 - DNA, 15 bp, Homo sapiens
tgatcctaagaattt

SEQ ID NO: 4583541 - DNA, 15 bp, Homo sapiens
tgatccttacaagtt

SEQ ID NO: 4583542 - DNA, 17 bp, Homo sapiens
tgatcgaaaaaataatt

SEQ ID NO: 4583543 - DNA, 21 bp, Homo sapiens
tgatctacttctgtaattgtg

SEQ ID NO: 4583544 - DNA, 13 bp, Homo sapiens
tgatctccctgcc

SEQ ID NO: 4583545 - DNA, 16 bp, Homo sapiens
tgatctccctgccgcc

SEQ ID NO: 4583546 - DNA, 17 bp, Homo sapiens
tgatctccctgccgcct

SEQ ID NO: 4583547 - DNA, 12 bp, Homo sapiens
tgatctctccac

SEQ ID NO: 4583548 - DNA, 16 bp, Homo sapiens
tgatctctcttgtcct

SEQ ID NO: 4583549 - DNA, 21 bp, Homo sapiens
tgatctcttctggtgttgact

SEQ ID NO: 4583550 - DNA, 18 bp, Homo sapiens
tgatctgcttttcagaat

SEQ ID NO: 4583551 - DNA, 17 bp, Homo sapiens
tgatctgtactttgtgt

SEQ ID NO: 4583552 - DNA, 23 bp, Homo sapiens
tgatctgtatttaatggttttta

SEQ ID NO: 4583553 - DNA, 14 bp, Homo sapiens
tgatctgtctgtgg

SEQ ID NO: 4583554 - DNA, 11 bp, Homo sapiens
tgatctgtgct

SEQ ID NO: 4583555 - DNA, 17 bp, Homo sapiens
tgatctgttttacagga

SEQ ID NO: 4583556 - DNA, 20 bp, Homo sapiens
tgatctgttttacaggaaac

SEQ ID NO: 4583557 - DNA, 13 bp, Homo sapiens
tgatcttcactgt

SEQ ID NO: 4583558 - DNA, 15 bp, Homo sapiens
tgatcttcactgtat

SEQ ID NO: 4583559 - DNA, 18 bp, Homo sapiens
tgatcttggaaaaacagc

SEQ ID NO: 4583560 - DNA, 15 bp, Homo sapiens
tgatctttgagccca

SEQ ID NO: 4583561 - DNA, 17 bp, Homo sapiens
tgatctttgtttaaatg

SEQ ID NO: 4583562 - DNA, 19 bp, Homo sapiens
tgatctttgtttaaatgcc

SEQ ID NO: 4583563 - DNA, 18 bp, Homo sapiens
tgatctttttatcatgat

SEQ ID NO: 4583564 - DNA, 19 bp, Homo sapiens
tgatgaaaactaaggattt

SEQ ID NO: 4583565 - DNA, 20 bp, Homo sapiens
tgatgaaaactaaggatttt

SEQ ID NO: 4583566 - DNA, 14 bp, Homo sapiens
tgatgaatactgta

SEQ ID NO: 4583567 - DNA, 20 bp, Homo sapiens
tgatgaatcactgttgcttt

SEQ ID NO: 4583568 - DNA, 17 bp, Homo sapiens
tgatgaatgtactatgt

SEQ ID NO: 4583569 - DNA, 18 bp, Homo sapiens
tgatgacaaaaaatgttt

SEQ ID NO: 4583570 - DNA, 22 bp, Homo sapiens
tgatgagaattgtatgtcatgt

SEQ ID NO: 4583571 - DNA, 16 bp, Homo sapiens
tgatgagagataacct

SEQ ID NO: 4583572 - DNA, 12 bp, Homo sapiens
tgatgagcacat

SEQ ID NO: 4583573 - DNA, 16 bp, Homo sapiens
tgatgaggtatttttt

SEQ ID NO: 4583574 - DNA, 17 bp, Homo sapiens
tgatgagttaactgtga

SEQ ID NO: 4583575 - DNA, 18 bp, Homo sapiens
tgatgagttaactgtgaa

SEQ ID NO: 4583576 - DNA, 15 bp, Homo sapiens
tgatgatgaaaacta

SEQ ID NO: 4583577 - DNA, 16 bp, Homo sapiens
tgatgatgatgaaaac

SEQ ID NO: 4583578 - DNA, 13 bp, Homo sapiens
tgatgatgttaaa

SEQ ID NO: 4583579 - DNA, 18 bp, Homo sapiens
tgatgattgaactggaat

SEQ ID NO: 4583580 - DNA, 22 bp, Homo sapiens
tgatgattgaactggaataata

SEQ ID NO: 4583581 - DNA, 16 bp, Homo sapiens
tgatgattttcctttt

SEQ ID NO: 4583582 - DNA, 18 bp, Homo sapiens
tgatgattttcctttttc

SEQ ID NO: 4583583 - DNA, 21 bp, Homo sapiens
tgatgcaggcacttattgtaa

SEQ ID NO: 4583584 - DNA, 14 bp, Homo sapiens
tgatgcagtctcct

SEQ ID NO: 4583585 - DNA, 17 bp, Homo sapiens
tgatgcatgcactgttc

SEQ ID NO: 4583586 - DNA, 22 bp, Homo sapiens
tgatgcatgctattcacaatta

SEQ ID NO: 4583587 - DNA, 16 bp, Homo sapiens
tgatgcatgtctttta

SEQ ID NO: 4583588 - DNA, 21 bp, Homo sapiens
tgatgccaaaaaaaaatacat

SEQ ID NO: 4583589 - DNA, 14 bp, Homo sapiens
tgatgccagctgtc

SEQ ID NO: 4583590 - DNA, 21 bp, Homo sapiens
tgatgccagctgtctcccacg

SEQ ID NO: 4583591 - DNA, 15 bp, Homo sapiens
tgatgccaggtgcaa

SEQ ID NO: 4583592 - DNA, 18 bp, Homo sapiens
tgatgccctgctccaggg

SEQ ID NO: 4583593 - DNA, 20 bp, Homo sapiens
tgatgccctgctccagggag

SEQ ID NO: 4583594 - DNA, 15 bp, Homo sapiens
tgatgctccctcccc

SEQ ID NO: 4583595 - DNA, 22 bp, Homo sapiens
tgatgctccctcccctgccctg

SEQ ID NO: 4583596 - DNA, 12 bp, Homo sapiens
tgatggagagga

SEQ ID NO: 4583597 - DNA, 15 bp, Homo sapiens
tgatggagtgtgagc

SEQ ID NO: 4583598 - DNA, 16 bp, Homo sapiens
tgatggagtttctcta

SEQ ID NO: 4583599 - DNA, 20 bp, Homo sapiens
tgatggcagccatagtgcat

SEQ ID NO: 4583600 - DNA, 14 bp, Homo sapiens
tgatggccagcccc

SEQ ID NO: 4583601 - DNA, 18 bp, Homo sapiens
tgatggccagcccctggg

SEQ ID NO: 4583602 - DNA, 22 bp, Homo sapiens
tgatggccggctggttgtgggc

SEQ ID NO: 4583603 - DNA, 16 bp, Homo sapiens
tgatggccttaatttc

SEQ ID NO: 4583604 - DNA, 19 bp, Homo sapiens
tgatggccttaatttcctt

SEQ ID NO: 4583605 - DNA, 14 bp, Homo sapiens
tgatggcctttgga

SEQ ID NO: 4583606 - DNA, 13 bp, Homo sapiens
tgatgggaataaa

SEQ ID NO: 4583607 - DNA, 17 bp, Homo sapiens
tgatgtaaaaatgcttc

SEQ ID NO: 4583608 - DNA, 22 bp, Homo sapiens
tgatgtaatcttgaattgtaac

SEQ ID NO: 4583609 - DNA, 17 bp, Homo sapiens
tgatgtacagtctgtca

SEQ ID NO: 4583610 - DNA, 19 bp, Homo sapiens
tgatgtacagtctgtcatg

SEQ ID NO: 4583611 - DNA, 22 bp, Homo sapiens
tgatgtacataactcctgtccc

SEQ ID NO: 4583612 - DNA, 15 bp, Homo sapiens
tgatgtacattacag

SEQ ID NO: 4583613 - DNA, 20 bp, Homo sapiens
tgatgtagggtaaggtgcct

SEQ ID NO: 4583614 - DNA, 18 bp, Homo sapiens
tgatgtattttcatagtg

SEQ ID NO: 4583615 - DNA, 15 bp, Homo sapiens
tgatgtcactatttg

SEQ ID NO: 4583616 - DNA, 18 bp, Homo sapiens
tgatgtcactatttgttg

SEQ ID NO: 4583617 - DNA, 14 bp, Homo sapiens
tgatgtcatgtgtt

SEQ ID NO: 4583618 - DNA, 13 bp, Homo sapiens
tgatgtcatttga

SEQ ID NO: 4583619 - DNA, 18 bp, Homo sapiens
tgatgtgaagagtttcac

SEQ ID NO: 4583620 - DNA, 20 bp, Homo sapiens
tgatgtgaagagtttcacaa

SEQ ID NO: 4583621 - DNA, 13 bp, Homo sapiens
tgatgttaaaaaa

SEQ ID NO: 4583622 - DNA, 14 bp, Homo sapiens
tgatgttaaaaaaa

SEQ ID NO: 4583623 - DNA, 22 bp, Homo sapiens
tgatgttcatgatagaaagaat

SEQ ID NO: 4583624 - DNA, 19 bp, Homo sapiens
tgatgtttgtggcctcaga

SEQ ID NO: 4583625 - DNA, 19 bp, Homo sapiens
tgattaaaaataccttcta

SEQ ID NO: 4583626 - DNA, 20 bp, Homo sapiens
tgattaaaaataccttctat

SEQ ID NO: 4583627 - DNA, 16 bp, Homo sapiens
tgattaaaatgtttga

SEQ ID NO: 4583628 - DNA, 12 bp, Homo sapiens
tgattaaaccaa

SEQ ID NO: 4583629 - DNA, 19 bp, Homo sapiens
tgattaaaggcagcatttg

SEQ ID NO: 4583630 - DNA, 23 bp, Homo sapiens
tgattaaaggcagcatttgatga

SEQ ID NO: 4583631 - DNA, 16 bp, Homo sapiens
tgattaagaaaggaag

SEQ ID NO: 4583632 - DNA, 18 bp, Homo sapiens
tgattaagggacatttct

SEQ ID NO: 4583633 - DNA, 21 bp, Homo sapiens
tgattaatttctgccatttca

SEQ ID NO: 4583634 - DNA, 22 bp, Homo sapiens
tgattaatttctgccatttcat

SEQ ID NO: 4583635 - DNA, 19 bp, Homo sapiens
tgattaccagtctgattat

SEQ ID NO: 4583636 - DNA, 22 bp, Homo sapiens
tgattactctttgctttgtagt

SEQ ID NO: 4583637 - DNA, 22 bp, Homo sapiens
tgattatagttaagcaaatttc

SEQ ID NO: 4583638 - DNA, 14 bp, Homo sapiens
tgattatattcaca

SEQ ID NO: 4583639 - DNA, 16 bp, Homo sapiens
tgattatgtatggata

SEQ ID NO: 4583640 - DNA, 23 bp, Homo sapiens
tgattcaaggctcagaaggaatg

SEQ ID NO: 4583641 - DNA, 19 bp, Homo sapiens
tgattcagaaaatgttctg

SEQ ID NO: 4583642 - DNA, 21 bp, Homo sapiens
tgattcagaaaatgttctgtt

SEQ ID NO: 4583643 - DNA, 19 bp, Homo sapiens
tgattcatagtaacttctt

SEQ ID NO: 4583644 - DNA, 19 bp, Homo sapiens
tgattccactacacctggc

SEQ ID NO: 4583645 - DNA, 20 bp, Homo sapiens
tgattccactacacctggct

SEQ ID NO: 4583646 - DNA, 23 bp, Homo sapiens
tgattccactacacctggctgag

SEQ ID NO: 4583647 - DNA, 16 bp, Homo sapiens
tgattccatccacctt

SEQ ID NO: 4583648 - DNA, 18 bp, Homo sapiens
tgattccatccacctttc

SEQ ID NO: 4583649 - DNA, 20 bp, Homo sapiens
tgattcccaactcctttctg

SEQ ID NO: 4583650 - DNA, 23 bp, Homo sapiens
tgattccttgagtttcatatata

SEQ ID NO: 4583651 - DNA, 15 bp, Homo sapiens
tgattctacagtgat

SEQ ID NO: 4583652 - DNA, 19 bp, Homo sapiens
tgattctccttcagccctc

SEQ ID NO: 4583653 - DNA, 21 bp, Homo sapiens
tgattctccttcagccctcac

SEQ ID NO: 4583654 - DNA, 19 bp, Homo sapiens
tgattctccttttatgtgt

SEQ ID NO: 4583655 - DNA, 22 bp, Homo sapiens
tgattctgcagtaaatctttta

SEQ ID NO: 4583656 - DNA, 15 bp, Homo sapiens
tgattcttttcccat

SEQ ID NO: 4583657 - DNA, 23 bp, Homo sapiens
tgattgaaaccaagttgaaaaat

SEQ ID NO: 4583658 - DNA, 14 bp, Homo sapiens
tgattgaattctaa

SEQ ID NO: 4583659 - DNA, 18 bp, Homo sapiens
tgattgatcacacagtgt

SEQ ID NO: 4583660 - DNA, 12 bp, Homo sapiens
tgattgatttga

SEQ ID NO: 4583661 - DNA, 23 bp, Homo sapiens
tgattggatattctcctcggact

SEQ ID NO: 4583662 - DNA, 15 bp, Homo sapiens
tgattggttcagttt

SEQ ID NO: 4583663 - DNA, 15 bp, Homo sapiens
tgattgtgaggcttc

SEQ ID NO: 4583664 - DNA, 22 bp, Homo sapiens
tgattgtttcttcttcatgctt

SEQ ID NO: 4583665 - DNA, 15 bp, Homo sapiens
tgatttactcttaga

SEQ ID NO: 4583666 - DNA, 17 bp, Homo sapiens
tgatttagattgagtaa

SEQ ID NO: 4583667 - DNA, 18 bp, Homo sapiens
tgatttattttgtatgaa

SEQ ID NO: 4583668 - DNA, 21 bp, Homo sapiens
tgatttcagactgcagagggg

SEQ ID NO: 4583669 - DNA, 14 bp, Homo sapiens
tgatttcagtaagt

SEQ ID NO: 4583670 - DNA, 15 bp, Homo sapiens
tgatttcataattca

SEQ ID NO: 4583671 - DNA, 20 bp, Homo sapiens
tgatttcataattcagaact

SEQ ID NO: 4583672 - DNA, 15 bp, Homo sapiens
tgatttcccactgca

SEQ ID NO: 4583673 - DNA, 22 bp, Homo sapiens
tgatttccgtgaactctggtgc

SEQ ID NO: 4583674 - DNA, 14 bp, Homo sapiens
tgatttccttgaat

SEQ ID NO: 4583675 - DNA, 19 bp, Homo sapiens
tgatttccttgaatgtggc

SEQ ID NO: 4583676 - DNA, 15 bp, Homo sapiens
tgatttctatggctt

SEQ ID NO: 4583677 - DNA, 20 bp, Homo sapiens
tgatttctatggctttcaaa

SEQ ID NO: 4583678 - DNA, 18 bp, Homo sapiens
tgatttgaaaagaatttg

SEQ ID NO: 4583679 - DNA, 21 bp, Homo sapiens
tgatttgaaaagaatttgtta

SEQ ID NO: 4583680 - DNA, 19 bp, Homo sapiens
tgatttgaagaacatgtga

SEQ ID NO: 4583681 - DNA, 12 bp, Homo sapiens
tgatttgcattg

SEQ ID NO: 4583682 - DNA, 21 bp, Homo sapiens
tgattttaatggattgttaat

SEQ ID NO: 4583683 - DNA, 19 bp, Homo sapiens
tgattttcaagcagcatct

SEQ ID NO: 4583684 - DNA, 15 bp, Homo sapiens
tgattttcataactt

SEQ ID NO: 4583685 - DNA, 15 bp, Homo sapiens
tgattttcctttttc

SEQ ID NO: 4583686 - DNA, 14 bp, Homo sapiens
tgattttgctgtag

SEQ ID NO: 4583687 - DNA, 16 bp, Homo sapiens
tgattttgctgtagaa

SEQ ID NO: 4583688 - DNA, 17 bp, Homo sapiens
tgattttggaactgtgt

SEQ ID NO: 4583689 - DNA, 18 bp, Homo sapiens
tgatttttatgccacctg

SEQ ID NO: 4583690 - DNA, 21 bp, Homo sapiens
tgatttttgcctcttccagtc

SEQ ID NO: 4583691 - DNA, 22 bp, Homo sapiens
tgatttttgcctcttccagtct

SEQ ID NO: 4583692 - DNA, 18 bp, Homo sapiens
tgatttttttttcataca

SEQ ID NO: 4583693 - DNA, 20 bp, Homo sapiens
tgatttttttttttttttcc

SEQ ID NO: 4583694 - DNA, 22 bp, Homo sapiens
tgcaaaaaatactttttctaat

SEQ ID NO: 4583695 - DNA, 16 bp, Homo sapiens
tgcaaaaatgacccaa

SEQ ID NO: 4583696 - DNA, 19 bp, Homo sapiens
tgcaaaaggactctcagga

SEQ ID NO: 4583697 - DNA, 13 bp, Homo sapiens
tgcaaaagtgggg

SEQ ID NO: 4583698 - DNA, 22 bp, Homo sapiens
tgcaaaagtggggctaaatgaa

SEQ ID NO: 4583699 - DNA, 23 bp, Homo sapiens
tgcaaaagtggggctaaatgaag

SEQ ID NO: 4583700 - DNA, 15 bp, Homo sapiens
tgcaaaatgtagaaa

SEQ ID NO: 4583701 - DNA, 22 bp, Homo sapiens
tgcaaaattgtctaaaatgtca

SEQ ID NO: 4583702 - DNA, 22 bp, Homo sapiens
tgcaaacactgtgattactctt

SEQ ID NO: 4583703 - DNA, 17 bp, Homo sapiens
tgcaaacatggagaaat

SEQ ID NO: 4583704 - DNA, 18 bp, Homo sapiens
tgcaaaccttcctgggag

SEQ ID NO: 4583705 - DNA, 15 bp, Homo sapiens
tgcaaactgctttat

SEQ ID NO: 4583706 - DNA, 19 bp, Homo sapiens
tgcaaagagacatttcaaa

SEQ ID NO: 4583707 - DNA, 18 bp, Homo sapiens
tgcaaagcactgacttct

SEQ ID NO: 4583708 - DNA, 20 bp, Homo sapiens
tgcaaagcactgacttctaa

SEQ ID NO: 4583709 - DNA, 18 bp, Homo sapiens
tgcaaagtacaatgtgtt

SEQ ID NO: 4583710 - DNA, 17 bp, Homo sapiens
tgcaaagtattgtaaat

SEQ ID NO: 4583711 - DNA, 18 bp, Homo sapiens
tgcaaagtattgtaaatt

SEQ ID NO: 4583712 - DNA, 21 bp, Homo sapiens
tgcaaagtgttttgtaccagt

SEQ ID NO: 4583713 - DNA, 22 bp, Homo sapiens
tgcaaagtgttttgtaccagtg

SEQ ID NO: 4583714 - DNA, 17 bp, Homo sapiens
tgcaaatagaaaacagg

SEQ ID NO: 4583715 - DNA, 20 bp, Homo sapiens
tgcaaatcaggcttttgttt

SEQ ID NO: 4583716 - DNA, 18 bp, Homo sapiens
tgcaaatggagataaaag

SEQ ID NO: 4583717 - DNA, 13 bp, Homo sapiens
tgcaaattgtgaa

SEQ ID NO: 4583718 - DNA, 20 bp, Homo sapiens
tgcaaatttagtttgttaaa

SEQ ID NO: 4583719 - DNA, 18 bp, Homo sapiens
tgcaaatttctataaatt

SEQ ID NO: 4583720 - DNA, 15 bp, Homo sapiens
tgcaaattttaactg

SEQ ID NO: 4583721 - DNA, 20 bp, Homo sapiens
tgcaacaaaatgtagaatat

SEQ ID NO: 4583722 - DNA, 21 bp, Homo sapiens
tgcaacaaagacttgctttaa

SEQ ID NO: 4583723 - DNA, 12 bp, Homo sapiens
tgcaacactggt

SEQ ID NO: 4583724 - DNA, 16 bp, Homo sapiens
tgcaacagacttgaat

SEQ ID NO: 4583725 - DNA, 13 bp, Homo sapiens
tgcaacagcagtg

SEQ ID NO: 4583726 - DNA, 14 bp, Homo sapiens
tgcaacagcagtgt

SEQ ID NO: 4583727 - DNA, 15 bp, Homo sapiens
tgcaacagcagtgtt

SEQ ID NO: 4583728 - DNA, 16 bp, Homo sapiens
tgcaacaggaggcttt

SEQ ID NO: 4583729 - DNA, 22 bp, Homo sapiens
tgcaacatacgggaagtttatt

SEQ ID NO: 4583730 - DNA, 13 bp, Homo sapiens
tgcaacatttatt

SEQ ID NO: 4583731 - DNA, 12 bp, Homo sapiens
tgcaaccaggaa

SEQ ID NO: 4583732 - DNA, 20 bp, Homo sapiens
tgcaaccaggaacagcaaat

SEQ ID NO: 4583733 - DNA, 19 bp, Homo sapiens
tgcaacctcacctcccggg

SEQ ID NO: 4583734 - DNA, 20 bp, Homo sapiens
tgcaacctcacctcccgggt

SEQ ID NO: 4583735 - DNA, 21 bp, Homo sapiens
tgcaacctcaccttcctgtgg

SEQ ID NO: 4583736 - DNA, 23 bp, Homo sapiens
tgcaacctcaccttcctgtgggt

SEQ ID NO: 4583737 - DNA, 19 bp, Homo sapiens
tgcaaccttgtttattaaa

SEQ ID NO: 4583738 - DNA, 15 bp, Homo sapiens
tgcaaccttttatgt

SEQ ID NO: 4583739 - DNA, 20 bp, Homo sapiens
tgcaactaactgactctgtt

SEQ ID NO: 4583740 - DNA, 14 bp, Homo sapiens
tgcaactcagcccc

SEQ ID NO: 4583741 - DNA, 20 bp, Homo sapiens
tgcaactccatcctcctgtg

SEQ ID NO: 4583742 - DNA, 18 bp, Homo sapiens
tgcaacttccgctgaggg

SEQ ID NO: 4583743 - DNA, 22 bp, Homo sapiens
tgcaagaccccaagaggaagtt

SEQ ID NO: 4583744 - DNA, 21 bp, Homo sapiens
tgcaagaccgtttgtccactt

SEQ ID NO: 4583745 - DNA, 20 bp, Homo sapiens
tgcaagagatggaaaaaaag

SEQ ID NO: 4583746 - DNA, 13 bp, Homo sapiens
tgcaagatgtgaa

SEQ ID NO: 4583747 - DNA, 14 bp, Homo sapiens
tgcaagatgtgaat

SEQ ID NO: 4583748 - DNA, 21 bp, Homo sapiens
tgcaagattttttttttaagt

SEQ ID NO: 4583749 - DNA, 22 bp, Homo sapiens
tgcaagattttttttttaagtg

SEQ ID NO: 4583750 - DNA, 15 bp, Homo sapiens
tgcaagcacagccct

SEQ ID NO: 4583751 - DNA, 16 bp, Homo sapiens
tgcaagcacagccctt

SEQ ID NO: 4583752 - DNA, 22 bp, Homo sapiens
tgcaagcactcggggtccctgg

SEQ ID NO: 4583753 - DNA, 23 bp, Homo sapiens
tgcaagcatttttccatctgtgt

SEQ ID NO: 4583754 - DNA, 13 bp, Homo sapiens
tgcaagctccgcc

SEQ ID NO: 4583755 - DNA, 20 bp, Homo sapiens
tgcaagctccgcctcccggg

SEQ ID NO: 4583756 - DNA, 17 bp, Homo sapiens
tgcaaggaccaggactc

SEQ ID NO: 4583757 - DNA, 18 bp, Homo sapiens
tgcaaggcggtacactac

SEQ ID NO: 4583758 - DNA, 23 bp, Homo sapiens
tgcaagggaagagcctttataca

SEQ ID NO: 4583759 - DNA, 22 bp, Homo sapiens
tgcaagggcagaacactaacct

SEQ ID NO: 4583760 - DNA, 16 bp, Homo sapiens
tgcaaggtactctggt

SEQ ID NO: 4583761 - DNA, 18 bp, Homo sapiens
tgcaaggtactctggtga

SEQ ID NO: 4583762 - DNA, 14 bp, Homo sapiens
tgcaaggtggcctt

SEQ ID NO: 4583763 - DNA, 15 bp, Homo sapiens
tgcaagtactgctgt

SEQ ID NO: 4583764 - DNA, 19 bp, Homo sapiens
tgcaagtactgctgtaaat

SEQ ID NO: 4583765 - DNA, 17 bp, Homo sapiens
tgcaagtcaggaatcat

SEQ ID NO: 4583766 - DNA, 21 bp, Homo sapiens
tgcaagtctgccgattttgta

SEQ ID NO: 4583767 - DNA, 15 bp, Homo sapiens
tgcaagttgctctga

SEQ ID NO: 4583768 - DNA, 20 bp, Homo sapiens
tgcaataaaattatttgcag

SEQ ID NO: 4583769 - DNA, 22 bp, Homo sapiens
tgcaataaaattatttgcaggt

SEQ ID NO: 4583770 - DNA, 16 bp, Homo sapiens
tgcaataaagtataat

SEQ ID NO: 4583771 - DNA, 17 bp, Homo sapiens
tgcaataactctgggag

SEQ ID NO: 4583772 - DNA, 23 bp, Homo sapiens
tgcaataacttgtgtattagata

SEQ ID NO: 4583773 - DNA, 20 bp, Homo sapiens
tgcaataatgatcaaagttt

SEQ ID NO: 4583774 - DNA, 22 bp, Homo sapiens
tgcaataatgatcaaagttttg

SEQ ID NO: 4583775 - DNA, 15 bp, Homo sapiens
tgcaataatgcagta

SEQ ID NO: 4583776 - DNA, 23 bp, Homo sapiens
tgcaatagcagttataacagatg

SEQ ID NO: 4583777 - DNA, 21 bp, Homo sapiens
tgcaatatagagactgtgttc

SEQ ID NO: 4583778 - DNA, 13 bp, Homo sapiens
tgcaatatcttcg

SEQ ID NO: 4583779 - DNA, 20 bp, Homo sapiens
tgcaatccaggctgttctca

SEQ ID NO: 4583780 - DNA, 20 bp, Homo sapiens
tgcaatccatttatttcatt

SEQ ID NO: 4583781 - DNA, 15 bp, Homo sapiens
tgcaatcccttaata

SEQ ID NO: 4583782 - DNA, 15 bp, Homo sapiens
tgcaatctaatctga

SEQ ID NO: 4583783 - DNA, 17 bp, Homo sapiens
tgcaatctaatctgaac

SEQ ID NO: 4583784 - DNA, 15 bp, Homo sapiens
tgcaatctactggaa

SEQ ID NO: 4583785 - DNA, 15 bp, Homo sapiens
tgcaatgtgaaaaat

SEQ ID NO: 4583786 - DNA, 17 bp, Homo sapiens
tgcaatgtgaaaaatct

SEQ ID NO: 4583787 - DNA, 23 bp, Homo sapiens
tgcaatgtggtgacacctccccc

SEQ ID NO: 4583788 - DNA, 14 bp, Homo sapiens
tgcaattgctccca

SEQ ID NO: 4583789 - DNA, 13 bp, Homo sapiens
tgcaatttctgta

SEQ ID NO: 4583790 - DNA, 15 bp, Homo sapiens
tgcaatttctgtaca

SEQ ID NO: 4583791 - DNA, 13 bp, Homo sapiens
tgcaatttgcaag

SEQ ID NO: 4583792 - DNA, 23 bp, Homo sapiens
tgcacaaaactacttttctaaaa

SEQ ID NO: 4583793 - DNA, 18 bp, Homo sapiens
tgcacaaacttgtgagca

SEQ ID NO: 4583794 - DNA, 23 bp, Homo sapiens
tgcacaaacttgtgagcatcaga

SEQ ID NO: 4583795 - DNA, 12 bp, Homo sapiens
tgcacaaggatt

SEQ ID NO: 4583796 - DNA, 15 bp, Homo sapiens
tgcacaaggattgaa

SEQ ID NO: 4583797 - DNA, 19 bp, Homo sapiens
tgcacaaggattgaaaatt

SEQ ID NO: 4583798 - DNA, 21 bp, Homo sapiens
tgcacaagttccctggagaaa

SEQ ID NO: 4583799 - DNA, 22 bp, Homo sapiens
tgcacaagttccctggagaaaa

SEQ ID NO: 4583800 - DNA, 14 bp, Homo sapiens
tgcacaatatttct

SEQ ID NO: 4583801 - DNA, 15 bp, Homo sapiens
tgcacacaaaaataa

SEQ ID NO: 4583802 - DNA, 18 bp, Homo sapiens
tgcacacaaatattattt

SEQ ID NO: 4583803 - DNA, 15 bp, Homo sapiens
tgcacacaattagat

SEQ ID NO: 4583804 - DNA, 17 bp, Homo sapiens
tgcacacaattagattt

SEQ ID NO: 4583805 - DNA, 15 bp, Homo sapiens
tgcacacagagtgag

SEQ ID NO: 4583806 - DNA, 16 bp, Homo sapiens
tgcacaccctgggcca

SEQ ID NO: 4583807 - DNA, 15 bp, Homo sapiens
tgcacactgagaatg

SEQ ID NO: 4583808 - DNA, 14 bp, Homo sapiens
tgcacactgtccta

SEQ ID NO: 4583809 - DNA, 22 bp, Homo sapiens
tgcacactttgccatattttca

SEQ ID NO: 4583810 - DNA, 18 bp, Homo sapiens
tgcacactttggcccagg

SEQ ID NO: 4583811 - DNA, 18 bp, Homo sapiens
tgcacagatatactttgt

SEQ ID NO: 4583812 - DNA, 21 bp, Homo sapiens
tgcacagattctttttttctg

SEQ ID NO: 4583813 - DNA, 22 bp, Homo sapiens
tgcacagcaggctgccagtgcc

SEQ ID NO: 4583814 - DNA, 23 bp, Homo sapiens
tgcacagcaggctgccagtgcct

SEQ ID NO: 4583815 - DNA, 20 bp, Homo sapiens
tgcacagccaacgagacaca

SEQ ID NO: 4583816 - DNA, 18 bp, Homo sapiens
tgcacaggcacacagggc

SEQ ID NO: 4583817 - DNA, 18 bp, Homo sapiens
tgcacagggattctcaca

SEQ ID NO: 4583818 - DNA, 16 bp, Homo sapiens
tgcacagggcagctgg

SEQ ID NO: 4583819 - DNA, 17 bp, Homo sapiens
tgcacagggcagctggg

SEQ ID NO: 4583820 - DNA, 18 bp, Homo sapiens
tgcacagggcagctgggc

SEQ ID NO: 4583821 - DNA, 19 bp, Homo sapiens
tgcacagtatttgtaatta

SEQ ID NO: 4583822 - DNA, 18 bp, Homo sapiens
tgcacagtcagaaggacg

SEQ ID NO: 4583823 - DNA, 20 bp, Homo sapiens
tgcacagtcagaaggacggc

SEQ ID NO: 4583824 - DNA, 15 bp, Homo sapiens
tgcacagtcatacaa

SEQ ID NO: 4583825 - DNA, 19 bp, Homo sapiens
tgcacagtgttggtttcct

SEQ ID NO: 4583826 - DNA, 19 bp, Homo sapiens
tgcacatctacatgccatg

SEQ ID NO: 4583827 - DNA, 21 bp, Homo sapiens
tgcacatctacatgccatgcc

SEQ ID NO: 4583828 - DNA, 17 bp, Homo sapiens
tgcacatggattcagtt

SEQ ID NO: 4583829 - DNA, 13 bp, Homo sapiens
tgcacatggcctg

SEQ ID NO: 4583830 - DNA, 14 bp, Homo sapiens
tgcacatggcctga

SEQ ID NO: 4583831 - DNA, 15 bp, Homo sapiens
tgcacatggcctgag

SEQ ID NO: 4583832 - DNA, 12 bp, Homo sapiens
tgcaccaaagac

SEQ ID NO: 4583833 - DNA, 14 bp, Homo sapiens
tgcaccaaagacat

SEQ ID NO: 4583834 - DNA, 20 bp, Homo sapiens
tgcaccacacctggcatggt

SEQ ID NO: 4583835 - DNA, 14 bp, Homo sapiens
tgcaccatctgctt

SEQ ID NO: 4583836 - DNA, 15 bp, Homo sapiens
tgcaccatctgcttg

SEQ ID NO: 4583837 - DNA, 15 bp, Homo sapiens
tgcaccatggagacg

SEQ ID NO: 4583838 - DNA, 14 bp, Homo sapiens
tgcaccattttcaa

SEQ ID NO: 4583839 - DNA, 17 bp, Homo sapiens
tgcacccagaacagtgg

SEQ ID NO: 4583840 - DNA, 22 bp, Homo sapiens
tgcacccatgggctctgacaga

SEQ ID NO: 4583841 - DNA, 15 bp, Homo sapiens
tgcaccccagcattc

SEQ ID NO: 4583842 - DNA, 19 bp, Homo sapiens
tgcaccccagcattccagc

SEQ ID NO: 4583843 - DNA, 18 bp, Homo sapiens
tgcacccctccggccccg

SEQ ID NO: 4583844 - DNA, 18 bp, Homo sapiens
tgcacccctgagccagca

SEQ ID NO: 4583845 - DNA, 16 bp, Homo sapiens
tgcacccctgggccag

SEQ ID NO: 4583846 - DNA, 14 bp, Homo sapiens
tgcacctaaagaaa

SEQ ID NO: 4583847 - DNA, 14 bp, Homo sapiens
tgcacctatctcag

SEQ ID NO: 4583848 - DNA, 17 bp, Homo sapiens
tgcacctcctaccctcc

SEQ ID NO: 4583849 - DNA, 12 bp, Homo sapiens
tgcacctgcccc

SEQ ID NO: 4583850 - DNA, 15 bp, Homo sapiens
tgcacgaccttggga

SEQ ID NO: 4583851 - DNA, 20 bp, Homo sapiens
tgcacgcgccctttctacca

SEQ ID NO: 4583852 - DNA, 12 bp, Homo sapiens
tgcacgtggaga

SEQ ID NO: 4583853 - DNA, 17 bp, Homo sapiens
tgcacgtggggcccact

SEQ ID NO: 4583854 - DNA, 17 bp, Homo sapiens
tgcactaacagagtggc

SEQ ID NO: 4583855 - DNA, 15 bp, Homo sapiens
tgcactaagacaaga

SEQ ID NO: 4583856 - DNA, 19 bp, Homo sapiens
tgcactaagacaagaacat

SEQ ID NO: 4583857 - DNA, 16 bp, Homo sapiens
tgcactactcctctgc

SEQ ID NO: 4583858 - DNA, 18 bp, Homo sapiens
tgcactactcctctgcag

SEQ ID NO: 4583859 - DNA, 14 bp, Homo sapiens
tgcactagtgcaat

SEQ ID NO: 4583860 - DNA, 21 bp, Homo sapiens
tgcactagtgcaattccaaga

SEQ ID NO: 4583861 - DNA, 14 bp, Homo sapiens
tgcactcagaaaat

SEQ ID NO: 4583862 - DNA, 13 bp, Homo sapiens
tgcactccagcct

SEQ ID NO: 4583863 - DNA, 14 bp, Homo sapiens
tgcactccagcctg

SEQ ID NO: 4583864 - DNA, 15 bp, Homo sapiens
tgcactccagcctgg

SEQ ID NO: 4583865 - DNA, 18 bp, Homo sapiens
tgcactccagcctggggg

SEQ ID NO: 4583866 - DNA, 15 bp, Homo sapiens
tgcactccggcctgg

SEQ ID NO: 4583867 - DNA, 22 bp, Homo sapiens
tgcactccggcctgggtgacag

SEQ ID NO: 4583868 - DNA, 16 bp, Homo sapiens
tgcactcctactgagt

SEQ ID NO: 4583869 - DNA, 19 bp, Homo sapiens
tgcactcctttatctgtaa

SEQ ID NO: 4583870 - DNA, 19 bp, Homo sapiens
tgcactctgggtctggcca

SEQ ID NO: 4583871 - DNA, 17 bp, Homo sapiens
tgcactcttaaacagca

SEQ ID NO: 4583872 - DNA, 16 bp, Homo sapiens
tgcactgaagagctct

SEQ ID NO: 4583873 - DNA, 22 bp, Homo sapiens
tgcactgaagagctcttggccc

SEQ ID NO: 4583874 - DNA, 15 bp, Homo sapiens
tgcactgatgttgtg

SEQ ID NO: 4583875 - DNA, 21 bp, Homo sapiens
tgcactgatgttgtgttttta

SEQ ID NO: 4583876 - DNA, 16 bp, Homo sapiens
tgcactggccttctga

SEQ ID NO: 4583877 - DNA, 12 bp, Homo sapiens
tgcactgtgaac

SEQ ID NO: 4583878 - DNA, 20 bp, Homo sapiens
tgcactgttccccctgtgca

SEQ ID NO: 4583879 - DNA, 15 bp, Homo sapiens
tgcacttatttgtca

SEQ ID NO: 4583880 - DNA, 13 bp, Homo sapiens
tgcacttctattt

SEQ ID NO: 4583881 - DNA, 19 bp, Homo sapiens
tgcactttccaatgccaca

SEQ ID NO: 4583882 - DNA, 23 bp, Homo sapiens
tgcactttccaatgccacagaca

SEQ ID NO: 4583883 - DNA, 18 bp, Homo sapiens
tgcactttgtagtgtttg

SEQ ID NO: 4583884 - DNA, 14 bp, Homo sapiens
tgcactttgtttag

SEQ ID NO: 4583885 - DNA, 16 bp, Homo sapiens
tgcactttgtttagaa

SEQ ID NO: 4583886 - DNA, 22 bp, Homo sapiens
tgcactttttaagtttgaagag

SEQ ID NO: 4583887 - DNA, 18 bp, Homo sapiens
tgcactttttccttactg

SEQ ID NO: 4583888 - DNA, 18 bp, Homo sapiens
tgcactttttttctatat

SEQ ID NO: 4583889 - DNA, 19 bp, Homo sapiens
tgcagaaaagcacctgccg

SEQ ID NO: 4583890 - DNA, 15 bp, Homo sapiens
tgcagaaaatattta

SEQ ID NO: 4583891 - DNA, 16 bp, Homo sapiens
tgcagaaatagacaaa

SEQ ID NO: 4583892 - DNA, 18 bp, Homo sapiens
tgcagaaatcacaatttt

SEQ ID NO: 4583893 - DNA, 16 bp, Homo sapiens
tgcagaagaaggcatc

SEQ ID NO: 4583894 - DNA, 14 bp, Homo sapiens
tgcagaagacagta

SEQ ID NO: 4583895 - DNA, 19 bp, Homo sapiens
tgcagacaacaccttcctc

SEQ ID NO: 4583896 - DNA, 22 bp, Homo sapiens
tgcagacaacaccttcctcctg

SEQ ID NO: 4583897 - DNA, 15 bp, Homo sapiens
tgcagacacctaacc

SEQ ID NO: 4583898 - DNA, 20 bp, Homo sapiens
tgcagacacctaaccccagg

SEQ ID NO: 4583899 - DNA, 15 bp, Homo sapiens
tgcagaccccaggtt

SEQ ID NO: 4583900 - DNA, 15 bp, Homo sapiens
tgcagacctgtcctc

SEQ ID NO: 4583901 - DNA, 20 bp, Homo sapiens
tgcagacctgtcctcctggt

SEQ ID NO: 4583902 - DNA, 19 bp, Homo sapiens
tgcagagccttttacccct

SEQ ID NO: 4583903 - DNA, 16 bp, Homo sapiens
tgcagaggaggtaaga

SEQ ID NO: 4583904 - DNA, 16 bp, Homo sapiens
tgcagaggggaaagac

SEQ ID NO: 4583905 - DNA, 19 bp, Homo sapiens
tgcagagggtactttaaga

SEQ ID NO: 4583906 - DNA, 18 bp, Homo sapiens
tgcagatggtgagagata

SEQ ID NO: 4583907 - DNA, 13 bp, Homo sapiens
tgcagatgtctta

SEQ ID NO: 4583908 - DNA, 17 bp, Homo sapiens
tgcagattacactgatc

SEQ ID NO: 4583909 - DNA, 13 bp, Homo sapiens
tgcagcaactccc

SEQ ID NO: 4583910 - DNA, 14 bp, Homo sapiens
tgcagcaactccca

SEQ ID NO: 4583911 - DNA, 17 bp, Homo sapiens
tgcagcaactcccacga

SEQ ID NO: 4583912 - DNA, 19 bp, Homo sapiens
tgcagcaatcacaaaggct

SEQ ID NO: 4583913 - DNA, 14 bp, Homo sapiens
tgcagcagataact

SEQ ID NO: 4583914 - DNA, 22 bp, Homo sapiens
tgcagcaggaaggaacaaagac

SEQ ID NO: 4583915 - DNA, 19 bp, Homo sapiens
tgcagcagggaaggcccaa

SEQ ID NO: 4583916 - DNA, 18 bp, Homo sapiens
tgcagcagtcgcccaagc

SEQ ID NO: 4583917 - DNA, 21 bp, Homo sapiens
tgcagccaagtagcctctcct

SEQ ID NO: 4583918 - DNA, 16 bp, Homo sapiens
tgcagccaccacatcc

SEQ ID NO: 4583919 - DNA, 12 bp, Homo sapiens
tgcagccagccc

SEQ ID NO: 4583920 - DNA, 15 bp, Homo sapiens
tgcagccagcccagc

SEQ ID NO: 4583921 - DNA, 22 bp, Homo sapiens
tgcagccagcccagcccagctg

SEQ ID NO: 4583922 - DNA, 20 bp, Homo sapiens
tgcagccagggctggggttg

SEQ ID NO: 4583923 - DNA, 10 bp, Homo sapiens
tgcagcccac

SEQ ID NO: 4583924 - DNA, 19 bp, Homo sapiens
tgcagcccatgcccacctg

SEQ ID NO: 4583925 - DNA, 21 bp, Homo sapiens
tgcagcctcatactcctgggc

SEQ ID NO: 4583926 - DNA, 22 bp, Homo sapiens
tgcagcctcatactcctgggct

SEQ ID NO: 4583927 - DNA, 13 bp, Homo sapiens
tgcagccttcccc

SEQ ID NO: 4583928 - DNA, 17 bp, Homo sapiens
tgcagccttcccctccc

SEQ ID NO: 4583929 - DNA, 19 bp, Homo sapiens
tgcagccttcccctccctg

SEQ ID NO: 4583930 - DNA, 20 bp, Homo sapiens
tgcagccttcccctccctgt

SEQ ID NO: 4583931 - DNA, 15 bp, Homo sapiens
tgcagccttctccat

SEQ ID NO: 4583932 - DNA, 14 bp, Homo sapiens
tgcagcggctcctg

SEQ ID NO: 4583933 - DNA, 16 bp, Homo sapiens
tgcagcggctcctgca

SEQ ID NO: 4583934 - DNA, 16 bp, Homo sapiens
tgcagctactggaatg

SEQ ID NO: 4583935 - DNA, 18 bp, Homo sapiens
tgcagctccctggcttct

SEQ ID NO: 4583936 - DNA, 19 bp, Homo sapiens
tgcagctccctggcttctg

SEQ ID NO: 4583937 - DNA, 20 bp, Homo sapiens
tgcagcttcaacttttctct

SEQ ID NO: 4583938 - DNA, 19 bp, Homo sapiens
tgcagcttcacccaccagg

SEQ ID NO: 4583939 - DNA, 17 bp, Homo sapiens
tgcagcttcgaggacag

SEQ ID NO: 4583940 - DNA, 16 bp, Homo sapiens
tgcagcttttggttaa

SEQ ID NO: 4583941 - DNA, 17 bp, Homo sapiens
tgcaggaatcacccctc

SEQ ID NO: 4583942 - DNA, 20 bp, Homo sapiens
tgcaggaatcacccctctgc

SEQ ID NO: 4583943 - DNA, 21 bp, Homo sapiens
tgcaggaatcacccctctgcc

SEQ ID NO: 4583944 - DNA, 22 bp, Homo sapiens
tgcaggaatcacccctctgccc

SEQ ID NO: 4583945 - DNA, 22 bp, Homo sapiens
tgcaggacagagggaagccagt

SEQ ID NO: 4583946 - DNA, 16 bp, Homo sapiens
tgcaggagagagcagc

SEQ ID NO: 4583947 - DNA, 13 bp, Homo sapiens
tgcaggagcttct

SEQ ID NO: 4583948 - DNA, 19 bp, Homo sapiens
tgcaggatctgtctgtgca

SEQ ID NO: 4583949 - DNA, 15 bp, Homo sapiens
tgcaggcagagctgg

SEQ ID NO: 4583950 - DNA, 16 bp, Homo sapiens
tgcaggcagagctgga

SEQ ID NO: 4583951 - DNA, 22 bp, Homo sapiens
tgcaggcagagctggagccccc

SEQ ID NO: 4583952 - DNA, 14 bp, Homo sapiens
tgcaggcaggaaca

SEQ ID NO: 4583953 - DNA, 16 bp, Homo sapiens
tgcaggcctgctcagg

SEQ ID NO: 4583954 - DNA, 18 bp, Homo sapiens
tgcaggcctgtccctggg

SEQ ID NO: 4583955 - DNA, 15 bp, Homo sapiens
tgcaggctggggagg

SEQ ID NO: 4583956 - DNA, 15 bp, Homo sapiens
tgcagggaaaattat

SEQ ID NO: 4583957 - DNA, 20 bp, Homo sapiens
tgcagggaaaattatttgca

SEQ ID NO: 4583958 - DNA, 12 bp, Homo sapiens
tgcagggaagtg

SEQ ID NO: 4583959 - DNA, 23 bp, Homo sapiens
tgcagggagcatggctgtgagga

SEQ ID NO: 4583960 - DNA, 21 bp, Homo sapiens
tgcagggatattgccttattt

SEQ ID NO: 4583961 - DNA, 19 bp, Homo sapiens
tgcagggccactggaagga

SEQ ID NO: 4583962 - DNA, 18 bp, Homo sapiens
tgcaggggtcccccctca

SEQ ID NO: 4583963 - DNA, 19 bp, Homo sapiens
tgcagggtgggtgagctct

SEQ ID NO: 4583964 - DNA, 22 bp, Homo sapiens
tgcagggtgggtgagctctcag

SEQ ID NO: 4583965 - DNA, 15 bp, Homo sapiens
tgcaggttcatggat

SEQ ID NO: 4583966 - DNA, 13 bp, Homo sapiens
tgcagtaaatctt

SEQ ID NO: 4583967 - DNA, 14 bp, Homo sapiens
tgcagtaaatcttt

SEQ ID NO: 4583968 - DNA, 17 bp, Homo sapiens
tgcagtactttgtgcat

SEQ ID NO: 4583969 - DNA, 22 bp, Homo sapiens
tgcagtatggtacatttttcaa

SEQ ID NO: 4583970 - DNA, 17 bp, Homo sapiens
tgcagtattgagcactg

SEQ ID NO: 4583971 - DNA, 14 bp, Homo sapiens
tgcagtcactggag

SEQ ID NO: 4583972 - DNA, 15 bp, Homo sapiens
tgcagtcactggagg

SEQ ID NO: 4583973 - DNA, 17 bp, Homo sapiens
tgcagtcactggaggtt

SEQ ID NO: 4583974 - DNA, 22 bp, Homo sapiens
tgcagtcctgatcagagccgtg

SEQ ID NO: 4583975 - DNA, 14 bp, Homo sapiens
tgcagtgagccgag

SEQ ID NO: 4583976 - DNA, 19 bp, Homo sapiens
tgcagtgagccgagattgt

SEQ ID NO: 4583977 - DNA, 15 bp, Homo sapiens
tgcagtgagctgaga

SEQ ID NO: 4583978 - DNA, 12 bp, Homo sapiens
tgcagtgccttg

SEQ ID NO: 4583979 - DNA, 13 bp, Homo sapiens
tgcagtggctccc

SEQ ID NO: 4583980 - DNA, 15 bp, Homo sapiens
tgcagtgtagatttt

SEQ ID NO: 4583981 - DNA, 16 bp, Homo sapiens
tgcagtgtgtctttat

SEQ ID NO: 4583982 - DNA, 16 bp, Homo sapiens
tgcagttaagctaaag

SEQ ID NO: 4583983 - DNA, 15 bp, Homo sapiens
tgcagttcagcacca

SEQ ID NO: 4583984 - DNA, 19 bp, Homo sapiens
tgcagttcagcaccaccct

SEQ ID NO: 4583985 - DNA, 19 bp, Homo sapiens
tgcagttggactctcaggg

SEQ ID NO: 4583986 - DNA, 20 bp, Homo sapiens
tgcagttggactctcaggga

SEQ ID NO: 4583987 - DNA, 14 bp, Homo sapiens
tgcagtttcatgta

SEQ ID NO: 4583988 - DNA, 15 bp, Homo sapiens
tgcagtttcatgtat

SEQ ID NO: 4583989 - DNA, 18 bp, Homo sapiens
tgcagtttcatgtatgta

SEQ ID NO: 4583990 - DNA, 16 bp, Homo sapiens
tgcagtttcttgtgta

SEQ ID NO: 4583991 - DNA, 22 bp, Homo sapiens
tgcagtttcttgtgtagatttg

SEQ ID NO: 4583992 - DNA, 14 bp, Homo sapiens
tgcagtttcttttc

SEQ ID NO: 4583993 - DNA, 12 bp, Homo sapiens
tgcagtttgaaa

SEQ ID NO: 4583994 - DNA, 13 bp, Homo sapiens
tgcagtttgaaat

SEQ ID NO: 4583995 - DNA, 14 bp, Homo sapiens
tgcagtttgaaatt

SEQ ID NO: 4583996 - DNA, 15 bp, Homo sapiens
tgcagtttgaaattc

SEQ ID NO: 4583997 - DNA, 16 bp, Homo sapiens
tgcagtttgaaattct

SEQ ID NO: 4583998 - DNA, 21 bp, Homo sapiens
tgcagtttgaaattctgaatt

SEQ ID NO: 4583999 - DNA, 15 bp, Homo sapiens
tgcagtttttcattt

SEQ ID NO: 4584000 - DNA, 17 bp, Homo sapiens
tgcataaatgcataatt

SEQ ID NO: 4584001 - DNA, 13 bp, Homo sapiens
tgcataatgcttt

SEQ ID NO: 4584002 - DNA, 17 bp, Homo sapiens
tgcataatgctttggaa

SEQ ID NO: 4584003 - DNA, 19 bp, Homo sapiens
tgcataatgctttggaaaa

SEQ ID NO: 4584004 - DNA, 16 bp, Homo sapiens
tgcatacaggggaggg

SEQ ID NO: 4584005 - DNA, 16 bp, Homo sapiens
tgcataccacaagaca

SEQ ID NO: 4584006 - DNA, 19 bp, Homo sapiens
tgcatactcattaggatgg

SEQ ID NO: 4584007 - DNA, 19 bp, Homo sapiens
tgcatactttttaaatgta

SEQ ID NO: 4584008 - DNA, 15 bp, Homo sapiens
tgcatagcagtatat

SEQ ID NO: 4584009 - DNA, 18 bp, Homo sapiens
tgcataggcaaagaagga

SEQ ID NO: 4584010 - DNA, 15 bp, Homo sapiens
tgcatatgttgaata

SEQ ID NO: 4584011 - DNA, 17 bp, Homo sapiens
tgcatatgttgaatact

SEQ ID NO: 4584012 - DNA, 19 bp, Homo sapiens
tgcatatgttgaatacttt

SEQ ID NO: 4584013 - DNA, 17 bp, Homo sapiens
tgcatattaaataataa

SEQ ID NO: 4584014 - DNA, 16 bp, Homo sapiens
tgcatattttgagaaa

SEQ ID NO: 4584015 - DNA, 19 bp, Homo sapiens
tgcatattttgagaaactg

SEQ ID NO: 4584016 - DNA, 13 bp, Homo sapiens
tgcatcacactca

SEQ ID NO: 4584017 - DNA, 13 bp, Homo sapiens
tgcatcagctgct

SEQ ID NO: 4584018 - DNA, 17 bp, Homo sapiens
tgcatcatctgtttgta

SEQ ID NO: 4584019 - DNA, 18 bp, Homo sapiens
tgcatcatctgtttgtaa

SEQ ID NO: 4584020 - DNA, 14 bp, Homo sapiens
tgcatccagcagca

SEQ ID NO: 4584021 - DNA, 14 bp, Homo sapiens
tgcatccattcctc

SEQ ID NO: 4584022 - DNA, 16 bp, Homo sapiens
tgcatccattcctcag

SEQ ID NO: 4584023 - DNA, 17 bp, Homo sapiens
tgcatccattcctcagg

SEQ ID NO: 4584024 - DNA, 19 bp, Homo sapiens
tgcatccattcctcaggga

SEQ ID NO: 4584025 - DNA, 20 bp, Homo sapiens
tgcatccattcctcagggac

SEQ ID NO: 4584026 - DNA, 18 bp, Homo sapiens
tgcatcccacgttctgtt

SEQ ID NO: 4584027 - DNA, 19 bp, Homo sapiens
tgcatccgcctgaaagtgt

SEQ ID NO: 4584028 - DNA, 20 bp, Homo sapiens
tgcatccgtagttccctgaa

SEQ ID NO: 4584029 - DNA, 10 bp, Homo sapiens
tgcatcctgg

SEQ ID NO: 4584030 - DNA, 20 bp, Homo sapiens
tgcatccttgtaatacctga

SEQ ID NO: 4584031 - DNA, 13 bp, Homo sapiens
tgcatctcctccc

SEQ ID NO: 4584032 - DNA, 19 bp, Homo sapiens
tgcatctcctcccgccctt

SEQ ID NO: 4584033 - DNA, 18 bp, Homo sapiens
tgcatctgcacataggca

SEQ ID NO: 4584034 - DNA, 16 bp, Homo sapiens
tgcatctttgttactt

SEQ ID NO: 4584035 - DNA, 20 bp, Homo sapiens
tgcatctttgttacttcctt

SEQ ID NO: 4584036 - DNA, 19 bp, Homo sapiens
tgcatgcactgttccccct

SEQ ID NO: 4584037 - DNA, 22 bp, Homo sapiens
tgcatgcactgttccccctgtg

SEQ ID NO: 4584038 - DNA, 21 bp, Homo sapiens
tgcatgccaaggggttaatga

SEQ ID NO: 4584039 - DNA, 21 bp, Homo sapiens
tgcatgcggcccagcccggct

SEQ ID NO: 4584040 - DNA, 19 bp, Homo sapiens
tgcatgctctctgcagcca

SEQ ID NO: 4584041 - DNA, 19 bp, Homo sapiens
tgcatggaagtaattaagg

SEQ ID NO: 4584042 - DNA, 21 bp, Homo sapiens
tgcatgggaaatagcggccct

SEQ ID NO: 4584043 - DNA, 23 bp, Homo sapiens
tgcatggggtggggtagggctga

SEQ ID NO: 4584044 - DNA, 17 bp, Homo sapiens
tgcatgtactgtatatt

SEQ ID NO: 4584045 - DNA, 16 bp, Homo sapiens
tgcatgtagcatataa

SEQ ID NO: 4584046 - DNA, 12 bp, Homo sapiens
tgcatgtctgcc

SEQ ID NO: 4584047 - DNA, 21 bp, Homo sapiens
tgcatgtctgccaaaatgcaa

SEQ ID NO: 4584048 - DNA, 12 bp, Homo sapiens
tgcatgtgcatg

SEQ ID NO: 4584049 - DNA, 14 bp, Homo sapiens
tgcatgtgcatgca

SEQ ID NO: 4584050 - DNA, 16 bp, Homo sapiens
tgcatgttccactaac

SEQ ID NO: 4584051 - DNA, 16 bp, Homo sapiens
tgcatgttctcctcta

SEQ ID NO: 4584052 - DNA, 19 bp, Homo sapiens
tgcattaaattcacaaact

SEQ ID NO: 4584053 - DNA, 22 bp, Homo sapiens
tgcattactattaactctgcat

SEQ ID NO: 4584054 - DNA, 22 bp, Homo sapiens
tgcattatatcaaatctaccac

SEQ ID NO: 4584055 - DNA, 23 bp, Homo sapiens
tgcattcacatttagaaaagtga

SEQ ID NO: 4584056 - DNA, 19 bp, Homo sapiens
tgcattcaccttagtgcaa

SEQ ID NO: 4584057 - DNA, 15 bp, Homo sapiens
tgcattcatttttat

SEQ ID NO: 4584058 - DNA, 18 bp, Homo sapiens
tgcattcgttgtgttttt

SEQ ID NO: 4584059 - DNA, 19 bp, Homo sapiens
tgcattctagataaccttg

SEQ ID NO: 4584060 - DNA, 13 bp, Homo sapiens
tgcattctttata

SEQ ID NO: 4584061 - DNA, 12 bp, Homo sapiens
tgcattgaaaaa

SEQ ID NO: 4584062 - DNA, 13 bp, Homo sapiens
tgcattgaacaca

SEQ ID NO: 4584063 - DNA, 17 bp, Homo sapiens
tgcattgaacacaaact

SEQ ID NO: 4584064 - DNA, 18 bp, Homo sapiens
tgcattgccgctgtataa

SEQ ID NO: 4584065 - DNA, 20 bp, Homo sapiens
tgcattggggttcctctgta

SEQ ID NO: 4584066 - DNA, 18 bp, Homo sapiens
tgcattggttttccatga

SEQ ID NO: 4584067 - DNA, 17 bp, Homo sapiens
tgcattgtctgtctgca

SEQ ID NO: 4584068 - DNA, 17 bp, Homo sapiens
tgcatttaaaacagaca

SEQ ID NO: 4584069 - DNA, 19 bp, Homo sapiens
tgcatttaaaacagacact

SEQ ID NO: 4584070 - DNA, 19 bp, Homo sapiens
tgcatttaaacatgtttaa

SEQ ID NO: 4584071 - DNA, 16 bp, Homo sapiens
tgcatttaaatacagt

SEQ ID NO: 4584072 - DNA, 17 bp, Homo sapiens
tgcatttaccactgtat

SEQ ID NO: 4584073 - DNA, 14 bp, Homo sapiens
tgcatttatatgta

SEQ ID NO: 4584074 - DNA, 15 bp, Homo sapiens
tgcatttcaaatgtt

SEQ ID NO: 4584075 - DNA, 18 bp, Homo sapiens
tgcatttgagagaagcca

SEQ ID NO: 4584076 - DNA, 16 bp, Homo sapiens
tgcatttgcctgcttc

SEQ ID NO: 4584077 - DNA, 17 bp, Homo sapiens
tgcatttgcctgcttct

SEQ ID NO: 4584078 - DNA, 22 bp, Homo sapiens
tgcatttgcctgcttctttcca

SEQ ID NO: 4584079 - DNA, 22 bp, Homo sapiens
tgcatttgtgcgtatgcagtgt

SEQ ID NO: 4584080 - DNA, 17 bp, Homo sapiens
tgcattttggaaggctg

SEQ ID NO: 4584081 - DNA, 20 bp, Homo sapiens
tgcatttttggatcattttt

SEQ ID NO: 4584082 - DNA, 17 bp, Homo sapiens
tgcatttttgttttgaa

SEQ ID NO: 4584083 - DNA, 19 bp, Homo sapiens
tgcatttttgttttgaaag

SEQ ID NO: 4584084 - DNA, 22 bp, Homo sapiens
tgcatttttgttttgaaagttt

SEQ ID NO: 4584085 - DNA, 16 bp, Homo sapiens
tgcatttttttagttt

SEQ ID NO: 4584086 - DNA, 20 bp, Homo sapiens
tgcatttttttagtttgttt

SEQ ID NO: 4584087 - DNA, 19 bp, Homo sapiens
tgccaaaaaggatacataa

SEQ ID NO: 4584088 - DNA, 21 bp, Homo sapiens
tgccaaaaaggatacataatg

SEQ ID NO: 4584089 - DNA, 19 bp, Homo sapiens
tgccaaaataccagagcct

SEQ ID NO: 4584090 - DNA, 21 bp, Homo sapiens
tgccaaaataccagagccttc

SEQ ID NO: 4584091 - DNA, 17 bp, Homo sapiens
tgccaaacctcctgtca

SEQ ID NO: 4584092 - DNA, 11 bp, Homo sapiens
tgccaaagtac

SEQ ID NO: 4584093 - DNA, 19 bp, Homo sapiens
tgccaaattctccggtttg

SEQ ID NO: 4584094 - DNA, 23 bp, Homo sapiens
tgccaactgttgtaactaggctc

SEQ ID NO: 4584095 - DNA, 23 bp, Homo sapiens
tgccaacttgatgttccacctgc

SEQ ID NO: 4584096 - DNA, 21 bp, Homo sapiens
tgccaagagctactcccacag

SEQ ID NO: 4584097 - DNA, 22 bp, Homo sapiens
tgccaagagctactcccacagc

SEQ ID NO: 4584098 - DNA, 23 bp, Homo sapiens
tgccaagagctactcccacagca

SEQ ID NO: 4584099 - DNA, 23 bp, Homo sapiens
tgccaagatttaaaattaaattt

SEQ ID NO: 4584100 - DNA, 21 bp, Homo sapiens
tgccaaggccagagtggcctg

SEQ ID NO: 4584101 - DNA, 13 bp, Homo sapiens
tgccaaggctctc

SEQ ID NO: 4584102 - DNA, 18 bp, Homo sapiens
tgccaatgagtctgtaat

SEQ ID NO: 4584103 - DNA, 15 bp, Homo sapiens
tgccaattgctaccg

SEQ ID NO: 4584104 - DNA, 23 bp, Homo sapiens
tgccaattgctaccgagaaggtt

SEQ ID NO: 4584105 - DNA, 19 bp, Homo sapiens
tgccacacggaagcaagca

SEQ ID NO: 4584106 - DNA, 13 bp, Homo sapiens
tgccacagaggcc

SEQ ID NO: 4584107 - DNA, 14 bp, Homo sapiens
tgccacagaggccc

SEQ ID NO: 4584108 - DNA, 20 bp, Homo sapiens
tgccacagaggccccacctg

SEQ ID NO: 4584109 - DNA, 21 bp, Homo sapiens
tgccacagaggccccacctga

SEQ ID NO: 4584110 - DNA, 23 bp, Homo sapiens
tgccacagaggccccacctgaag

SEQ ID NO: 4584111 - DNA, 17 bp, Homo sapiens
tgccacagcctcccctg

SEQ ID NO: 4584112 - DNA, 17 bp, Homo sapiens
tgccacagtagaactgt

SEQ ID NO: 4584113 - DNA, 12 bp, Homo sapiens
tgccacatccct

SEQ ID NO: 4584114 - DNA, 15 bp, Homo sapiens
tgccacatggagccc

SEQ ID NO: 4584115 - DNA, 19 bp, Homo sapiens
tgccacatggtgtctccca

SEQ ID NO: 4584116 - DNA, 14 bp, Homo sapiens
tgccacattttctt

SEQ ID NO: 4584117 - DNA, 21 bp, Homo sapiens
tgccaccaaaggagacatatc

SEQ ID NO: 4584118 - DNA, 22 bp, Homo sapiens
tgccaccagcccccgccccaga

SEQ ID NO: 4584119 - DNA, 14 bp, Homo sapiens
tgccaccagcccct

SEQ ID NO: 4584120 - DNA, 14 bp, Homo sapiens
tgccaccaggagaa

SEQ ID NO: 4584121 - DNA, 16 bp, Homo sapiens
tgccaccccaccctcc

SEQ ID NO: 4584122 - DNA, 17 bp, Homo sapiens
tgccaccccaccctccc

SEQ ID NO: 4584123 - DNA, 20 bp, Homo sapiens
tgccacccctaaactccagg

SEQ ID NO: 4584124 - DNA, 13 bp, Homo sapiens
tgccacctagact

SEQ ID NO: 4584125 - DNA, 18 bp, Homo sapiens
tgccacctcccctatcca

SEQ ID NO: 4584126 - DNA, 16 bp, Homo sapiens
tgccactcacacagcc

SEQ ID NO: 4584127 - DNA, 23 bp, Homo sapiens
tgccactcacacagccaggtgcc

SEQ ID NO: 4584128 - DNA, 18 bp, Homo sapiens
tgccactctctgggactc

SEQ ID NO: 4584129 - DNA, 19 bp, Homo sapiens
tgccactctctgggactct

SEQ ID NO: 4584130 - DNA, 23 bp, Homo sapiens
tgccactgccccccgaggctgct

SEQ ID NO: 4584131 - DNA, 22 bp, Homo sapiens
tgccactgttcagcggagctga

SEQ ID NO: 4584132 - DNA, 17 bp, Homo sapiens
tgccacttgtcaaagaa

SEQ ID NO: 4584133 - DNA, 20 bp, Homo sapiens
tgccagaagatcccctcagg

SEQ ID NO: 4584134 - DNA, 21 bp, Homo sapiens
tgccagaagatcccctcagga

SEQ ID NO: 4584135 - DNA, 15 bp, Homo sapiens
tgccagaggccctgg

SEQ ID NO: 4584136 - DNA, 23 bp, Homo sapiens
tgccagatataactgtcttgttt

SEQ ID NO: 4584137 - DNA, 16 bp, Homo sapiens
tgccagattctgcctc

SEQ ID NO: 4584138 - DNA, 21 bp, Homo sapiens
tgccagattctgcctctctgg

SEQ ID NO: 4584139 - DNA, 17 bp, Homo sapiens
tgccagcagagccaggg

SEQ ID NO: 4584140 - DNA, 23 bp, Homo sapiens
tgccagcagagccagggcagggc

SEQ ID NO: 4584141 - DNA, 17 bp, Homo sapiens
tgccagcattccagact

SEQ ID NO: 4584142 - DNA, 20 bp, Homo sapiens
tgccagcattccagacttca

SEQ ID NO: 4584143 - DNA, 21 bp, Homo sapiens
tgccagccttgagccctggct

SEQ ID NO: 4584144 - DNA, 22 bp, Homo sapiens
tgccagctctgtatcaggaccc

SEQ ID NO: 4584145 - DNA, 13 bp, Homo sapiens
tgccagctgccct

SEQ ID NO: 4584146 - DNA, 14 bp, Homo sapiens
tgccagctgccctt

SEQ ID NO: 4584147 - DNA, 22 bp, Homo sapiens
tgccaggaacctgtcctaagga

SEQ ID NO: 4584148 - DNA, 11 bp, Homo sapiens
tgccaggagga

SEQ ID NO: 4584149 - DNA, 15 bp, Homo sapiens
tgccaggcaggggtg

SEQ ID NO: 4584150 - DNA, 16 bp, Homo sapiens
tgccaggccagcctcc

SEQ ID NO: 4584151 - DNA, 17 bp, Homo sapiens
tgccaggccagcctccg

SEQ ID NO: 4584152 - DNA, 18 bp, Homo sapiens
tgccaggccagcctccga

SEQ ID NO: 4584153 - DNA, 14 bp, Homo sapiens
tgccaggcccgggg

SEQ ID NO: 4584154 - DNA, 16 bp, Homo sapiens
tgccaggctaattttt

SEQ ID NO: 4584155 - DNA, 21 bp, Homo sapiens
tgccaggctgcctcctgccct

SEQ ID NO: 4584156 - DNA, 16 bp, Homo sapiens
tgccaggctgtttcag

SEQ ID NO: 4584157 - DNA, 11 bp, Homo sapiens
tgccagggcag

SEQ ID NO: 4584158 - DNA, 18 bp, Homo sapiens
tgccaggttaggaaggca

SEQ ID NO: 4584159 - DNA, 18 bp, Homo sapiens
tgccagtatttttaaagg

SEQ ID NO: 4584160 - DNA, 16 bp, Homo sapiens
tgccagtgaagtcctt

SEQ ID NO: 4584161 - DNA, 15 bp, Homo sapiens
tgccagtgcctgggt

SEQ ID NO: 4584162 - DNA, 13 bp, Homo sapiens
tgccagtgcctta

SEQ ID NO: 4584163 - DNA, 21 bp, Homo sapiens
tgccagtgccttacctcctgc

SEQ ID NO: 4584164 - DNA, 22 bp, Homo sapiens
tgccagtgccttacctcctgcc

SEQ ID NO: 4584165 - DNA, 14 bp, Homo sapiens
tgccagtgtctttc

SEQ ID NO: 4584166 - DNA, 20 bp, Homo sapiens
tgccagtgtctttctttggt

SEQ ID NO: 4584167 - DNA, 18 bp, Homo sapiens
tgccagttttccctggaa

SEQ ID NO: 4584168 - DNA, 17 bp, Homo sapiens
tgccataaaattgcagt

SEQ ID NO: 4584169 - DNA, 19 bp, Homo sapiens
tgccataaccatgagcact

SEQ ID NO: 4584170 - DNA, 20 bp, Homo sapiens
tgccataaccatgagcacta

SEQ ID NO: 4584171 - DNA, 24 bp, Homo sapiens
tgccatagtcaaagagagttttta

SEQ ID NO: 4584172 - DNA, 14 bp, Homo sapiens
tgccatattttcac

SEQ ID NO: 4584173 - DNA, 13 bp, Homo sapiens
tgccatcaaatga

SEQ ID NO: 4584174 - DNA, 15 bp, Homo sapiens
tgccatcatctcctg

SEQ ID NO: 4584175 - DNA, 23 bp, Homo sapiens
tgccatcatctcctgccttcctc

SEQ ID NO: 4584176 - DNA, 15 bp, Homo sapiens
tgccatcatgcctga

SEQ ID NO: 4584177 - DNA, 21 bp, Homo sapiens
tgccatccagatgtgtgcaat

SEQ ID NO: 4584178 - DNA, 16 bp, Homo sapiens
tgccatcctggcccag

SEQ ID NO: 4584179 - DNA, 21 bp, Homo sapiens
tgccatgagccgcccaaggcc

SEQ ID NO: 4584180 - DNA, 15 bp, Homo sapiens
tgccatgatctgtat

SEQ ID NO: 4584181 - DNA, 23 bp, Homo sapiens
tgccatgctgggccactggggac

SEQ ID NO: 4584182 - DNA, 14 bp, Homo sapiens
tgccatggaagagg

SEQ ID NO: 4584183 - DNA, 23 bp, Homo sapiens
tgccatggaagaggctacagggc

SEQ ID NO: 4584184 - DNA, 13 bp, Homo sapiens
tgccatggatgat

SEQ ID NO: 4584185 - DNA, 21 bp, Homo sapiens
tgccatggatgattcttttcc

SEQ ID NO: 4584186 - DNA, 17 bp, Homo sapiens
tgccattacagaaccaa

SEQ ID NO: 4584187 - DNA, 14 bp, Homo sapiens
tgccattacccagt

SEQ ID NO: 4584188 - DNA, 16 bp, Homo sapiens
tgccattatccctgaa

SEQ ID NO: 4584189 - DNA, 21 bp, Homo sapiens
tgccattatgcaaatggagat

SEQ ID NO: 4584190 - DNA, 16 bp, Homo sapiens
tgccattcacttcata

SEQ ID NO: 4584191 - DNA, 18 bp, Homo sapiens
tgccattcttctggtgct

SEQ ID NO: 4584192 - DNA, 21 bp, Homo sapiens
tgccattgggaccctccagtg

SEQ ID NO: 4584193 - DNA, 14 bp, Homo sapiens
tgccattgtcttta

SEQ ID NO: 4584194 - DNA, 16 bp, Homo sapiens
tgccattgtctttata

SEQ ID NO: 4584195 - DNA, 17 bp, Homo sapiens
tgccatttctgaactgt

SEQ ID NO: 4584196 - DNA, 14 bp, Homo sapiens
tgcccaaaatgtga

SEQ ID NO: 4584197 - DNA, 16 bp, Homo sapiens
tgcccaaaatgtgaag

SEQ ID NO: 4584198 - DNA, 18 bp, Homo sapiens
tgcccaaacccttaactg

SEQ ID NO: 4584199 - DNA, 21 bp, Homo sapiens
tgcccaaacccttaactgaca

SEQ ID NO: 4584200 - DNA, 22 bp, Homo sapiens
tgcccaaggcctaccccagttc

SEQ ID NO: 4584201 - DNA, 20 bp, Homo sapiens
tgcccaatgaataatggaaa

SEQ ID NO: 4584202 - DNA, 20 bp, Homo sapiens
tgcccaatgagactctaggg

SEQ ID NO: 4584203 - DNA, 16 bp, Homo sapiens
tgcccaattggaggaa

SEQ ID NO: 4584204 - DNA, 11 bp, Homo sapiens
tgcccaccccc

SEQ ID NO: 4584205 - DNA, 19 bp, Homo sapiens
tgcccagaataagttattg

SEQ ID NO: 4584206 - DNA, 21 bp, Homo sapiens
tgcccagaataagttattgca

SEQ ID NO: 4584207 - DNA, 13 bp, Homo sapiens
tgcccagactgat

SEQ ID NO: 4584208 - DNA, 11 bp, Homo sapiens
tgcccagagat

SEQ ID NO: 4584209 - DNA, 12 bp, Homo sapiens
tgcccagagatg

SEQ ID NO: 4584210 - DNA, 16 bp, Homo sapiens
tgcccagagatgcctc

SEQ ID NO: 4584211 - DNA, 22 bp, Homo sapiens
tgcccagagatgcctccaccgc

SEQ ID NO: 4584212 - DNA, 19 bp, Homo sapiens
tgcccagcagcccctgaga

SEQ ID NO: 4584213 - DNA, 22 bp, Homo sapiens
tgcccagccctggcccaggtgc

SEQ ID NO: 4584214 - DNA, 14 bp, Homo sapiens
tgcccagcctggat

SEQ ID NO: 4584215 - DNA, 15 bp, Homo sapiens
tgcccaggccacaga

SEQ ID NO: 4584216 - DNA, 17 bp, Homo sapiens
tgcccaggccacagaga

SEQ ID NO: 4584217 - DNA, 21 bp, Homo sapiens
tgcccaggccacagagaacct

SEQ ID NO: 4584218 - DNA, 22 bp, Homo sapiens
tgcccaggccacagagaacctg

SEQ ID NO: 4584219 - DNA, 14 bp, Homo sapiens
tgcccagggaataa

SEQ ID NO: 4584220 - DNA, 12 bp, Homo sapiens
tgcccagtgagc

SEQ ID NO: 4584221 - DNA, 18 bp, Homo sapiens
tgcccagtgagccctgct

SEQ ID NO: 4584222 - DNA, 16 bp, Homo sapiens
tgcccatgagcaagcc

SEQ ID NO: 4584223 - DNA, 22 bp, Homo sapiens
tgcccatgtgtcccctcactct

SEQ ID NO: 4584224 - DNA, 13 bp, Homo sapiens
tgcccatgtttca

SEQ ID NO: 4584225 - DNA, 14 bp, Homo sapiens
tgcccattcctgcc

SEQ ID NO: 4584226 - DNA, 16 bp, Homo sapiens
tgcccattcctgcctg

SEQ ID NO: 4584227 - DNA, 23 bp, Homo sapiens
tgcccatttcgaagatatacaaa

SEQ ID NO: 4584228 - DNA, 13 bp, Homo sapiens
tgccccaactcct

SEQ ID NO: 4584229 - DNA, 21 bp, Homo sapiens
tgccccaatcgggtccagaga

SEQ ID NO: 4584230 - DNA, 22 bp, Homo sapiens
tgccccaatcgggtccagagac

SEQ ID NO: 4584231 - DNA, 22 bp, Homo sapiens
tgccccacatgcatgtctgcct

SEQ ID NO: 4584232 - DNA, 21 bp, Homo sapiens
tgccccaccccatccagccag

SEQ ID NO: 4584233 - DNA, 14 bp, Homo sapiens
tgccccagagctgt

SEQ ID NO: 4584234 - DNA, 12 bp, Homo sapiens
tgccccaggctc

SEQ ID NO: 4584235 - DNA, 19 bp, Homo sapiens
tgccccagggagtccaggg

SEQ ID NO: 4584236 - DNA, 21 bp, Homo sapiens
tgccccagggagtccagggtt

SEQ ID NO: 4584237 - DNA, 17 bp, Homo sapiens
tgccccaggtacacctc

SEQ ID NO: 4584238 - DNA, 22 bp, Homo sapiens
tgccccattccttgcgcctcag

SEQ ID NO: 4584239 - DNA, 16 bp, Homo sapiens
tgccccattgagatct

SEQ ID NO: 4584240 - DNA, 23 bp, Homo sapiens
tgcccccaccccggggaccctgt

SEQ ID NO: 4584241 - DNA, 22 bp, Homo sapiens
tgcccccaccccttcctgtctc

SEQ ID NO: 4584242 - DNA, 24 bp, Homo sapiens
tgcccccaccccttcctgtctcac

SEQ ID NO: 4584243 - DNA, 18 bp, Homo sapiens
tgcccccagaaagcctcc

SEQ ID NO: 4584244 - DNA, 13 bp, Homo sapiens
tgcccccaggact

SEQ ID NO: 4584245 - DNA, 19 bp, Homo sapiens
tgcccccaggactgggcca

SEQ ID NO: 4584246 - DNA, 12 bp, Homo sapiens
tgcccccaggtg

SEQ ID NO: 4584247 - DNA, 19 bp, Homo sapiens
tgccccccgaggctgctag

SEQ ID NO: 4584248 - DNA, 17 bp, Homo sapiens
tgcccccctcctccagt

SEQ ID NO: 4584249 - DNA, 18 bp, Homo sapiens
tgcccccctcctccagta

SEQ ID NO: 4584250 - DNA, 14 bp, Homo sapiens
tgcccccgcctgcc

SEQ ID NO: 4584251 - DNA, 20 bp, Homo sapiens
tgcccccgcgggttctagac

SEQ ID NO: 4584252 - DNA, 12 bp, Homo sapiens
tgccccctgcca

SEQ ID NO: 4584253 - DNA, 14 bp, Homo sapiens
tgccccctgccagt

SEQ ID NO: 4584254 - DNA, 22 bp, Homo sapiens
tgccccctgctggctcttctgc

SEQ ID NO: 4584255 - DNA, 22 bp, Homo sapiens
tgccccctttcagatgtcttct

SEQ ID NO: 4584256 - DNA, 15 bp, Homo sapiens
tgccccgactgtggg

SEQ ID NO: 4584257 - DNA, 22 bp, Homo sapiens
tgccccgcccccagtccccacc

SEQ ID NO: 4584258 - DNA, 15 bp, Homo sapiens
tgccccggcctcctc

SEQ ID NO: 4584259 - DNA, 17 bp, Homo sapiens
tgcccctcccccaaccc

SEQ ID NO: 4584260 - DNA, 15 bp, Homo sapiens
tgcccctctgccttg

SEQ ID NO: 4584261 - DNA, 15 bp, Homo sapiens
tgcccctgcagctgg

SEQ ID NO: 4584262 - DNA, 18 bp, Homo sapiens
tgcccctgctcactgggc

SEQ ID NO: 4584263 - DNA, 23 bp, Homo sapiens
tgcccctgctcactgggcccgag

SEQ ID NO: 4584264 - DNA, 14 bp, Homo sapiens
tgcccctggctttg

SEQ ID NO: 4584265 - DNA, 17 bp, Homo sapiens
tgcccctggctttgcct

SEQ ID NO: 4584266 - DNA, 18 bp, Homo sapiens
tgcccctggctttgcctc

SEQ ID NO: 4584267 - DNA, 20 bp, Homo sapiens
tgcccctggctttgcctctt

SEQ ID NO: 4584268 - DNA, 17 bp, Homo sapiens
tgcccctgtctggaaga

SEQ ID NO: 4584269 - DNA, 18 bp, Homo sapiens
tgccccttctacactctc

SEQ ID NO: 4584270 - DNA, 20 bp, Homo sapiens
tgccccttctacactctcct

SEQ ID NO: 4584271 - DNA, 22 bp, Homo sapiens
tgccccttctacactctcctgg

SEQ ID NO: 4584272 - DNA, 15 bp, Homo sapiens
tgccccttggtcctg

SEQ ID NO: 4584273 - DNA, 18 bp, Homo sapiens
tgcccgaaactaagccag

SEQ ID NO: 4584274 - DNA, 16 bp, Homo sapiens
tgcccgactgactgga

SEQ ID NO: 4584275 - DNA, 23 bp, Homo sapiens
tgcccgataccgggacacagaat

SEQ ID NO: 4584276 - DNA, 15 bp, Homo sapiens
tgcccgcatgtgtgc

SEQ ID NO: 4584277 - DNA, 18 bp, Homo sapiens
tgcccgcatgtgtgcctg

SEQ ID NO: 4584278 - DNA, 22 bp, Homo sapiens
tgcccggcacagatgctccagg

SEQ ID NO: 4584279 - DNA, 17 bp, Homo sapiens
tgcccggcgccgggcac

SEQ ID NO: 4584280 - DNA, 18 bp, Homo sapiens
tgcccgggagctcaggaa

SEQ ID NO: 4584281 - DNA, 20 bp, Homo sapiens
tgcccgggcgcggccagccc

SEQ ID NO: 4584282 - DNA, 18 bp, Homo sapiens
tgcccgtaatcccagcta

SEQ ID NO: 4584283 - DNA, 20 bp, Homo sapiens
tgcccgtaatcccagctact

SEQ ID NO: 4584284 - DNA, 20 bp, Homo sapiens
tgcccgtctctctcccatgg

SEQ ID NO: 4584285 - DNA, 17 bp, Homo sapiens
tgcccgtgcccgcagga

SEQ ID NO: 4584286 - DNA, 16 bp, Homo sapiens
tgccctaccttctgtt

SEQ ID NO: 4584287 - DNA, 22 bp, Homo sapiens
tgccctagttttctttcctcct

SEQ ID NO: 4584288 - DNA, 14 bp, Homo sapiens
tgccctccaaagag

SEQ ID NO: 4584289 - DNA, 11 bp, Homo sapiens
tgccctcctgg

SEQ ID NO: 4584290 - DNA, 21 bp, Homo sapiens
tgccctgagcactcctggtgc

SEQ ID NO: 4584291 - DNA, 23 bp, Homo sapiens
tgccctgagcactcctggtgcag

SEQ ID NO: 4584292 - DNA, 14 bp, Homo sapiens
tgccctggctccag

SEQ ID NO: 4584293 - DNA, 11 bp, Homo sapiens
tgccctggctg

SEQ ID NO: 4584294 - DNA, 21 bp, Homo sapiens
tgccctggtccagggaagctg

SEQ ID NO: 4584295 - DNA, 13 bp, Homo sapiens
tgcccttaggcca

SEQ ID NO: 4584296 - DNA, 14 bp, Homo sapiens
tgcccttcacccca

SEQ ID NO: 4584297 - DNA, 15 bp, Homo sapiens
tgcccttcaccccag

SEQ ID NO: 4584298 - DNA, 11 bp, Homo sapiens
tgcccttccct

SEQ ID NO: 4584299 - DNA, 16 bp, Homo sapiens
tgcccttccctctggg

SEQ ID NO: 4584300 - DNA, 21 bp, Homo sapiens
tgcccttgcagggtgggtgag

SEQ ID NO: 4584301 - DNA, 13 bp, Homo sapiens
tgcccttgctgcc

SEQ ID NO: 4584302 - DNA, 18 bp, Homo sapiens
tgcccttttttctgcctc

SEQ ID NO: 4584303 - DNA, 18 bp, Homo sapiens
tgccgaatttggtacaca

SEQ ID NO: 4584304 - DNA, 21 bp, Homo sapiens
tgccgaatttggtacacatgt

SEQ ID NO: 4584305 - DNA, 23 bp, Homo sapiens
tgccgaatttggtacacatgtgt

SEQ ID NO: 4584306 - DNA, 13 bp, Homo sapiens
tgccgagggctgg

SEQ ID NO: 4584307 - DNA, 14 bp, Homo sapiens
tgccgagggctggc

SEQ ID NO: 4584308 - DNA, 18 bp, Homo sapiens
tgccgatatcttcagaaa

SEQ ID NO: 4584309 - DNA, 13 bp, Homo sapiens
tgccgatgttgaa

SEQ ID NO: 4584310 - DNA, 16 bp, Homo sapiens
tgccgatgttgaactt

SEQ ID NO: 4584311 - DNA, 13 bp, Homo sapiens
tgccgatttctgt

SEQ ID NO: 4584312 - DNA, 20 bp, Homo sapiens
tgccgatttctgtaaactct

SEQ ID NO: 4584313 - DNA, 15 bp, Homo sapiens
tgccgcaaattgtac

SEQ ID NO: 4584314 - DNA, 22 bp, Homo sapiens
tgccgcaatggccatgtgggga

SEQ ID NO: 4584315 - DNA, 18 bp, Homo sapiens
tgccgcaccccagagtgt

SEQ ID NO: 4584316 - DNA, 15 bp, Homo sapiens
tgccgcagagctggc

SEQ ID NO: 4584317 - DNA, 14 bp, Homo sapiens
tgccgccctgtggg

SEQ ID NO: 4584318 - DNA, 10 bp, Homo sapiens
tgccgcctgc

SEQ ID NO: 4584319 - DNA, 12 bp, Homo sapiens
tgccgcctgccc

SEQ ID NO: 4584320 - DNA, 12 bp, Homo sapiens
tgccgctgcacc

SEQ ID NO: 4584321 - DNA, 15 bp, Homo sapiens
tgccgctgcaccacg

SEQ ID NO: 4584322 - DNA, 21 bp, Homo sapiens
tgccgctgccacccgcccacc

SEQ ID NO: 4584323 - DNA, 13 bp, Homo sapiens
tgccgctgccatg

SEQ ID NO: 4584324 - DNA, 18 bp, Homo sapiens
tgccgctgccgctgcacc

SEQ ID NO: 4584325 - DNA, 16 bp, Homo sapiens
tgccgctgtataaagc

SEQ ID NO: 4584326 - DNA, 19 bp, Homo sapiens
tgccgctgtataaagcatg

SEQ ID NO: 4584327 - DNA, 17 bp, Homo sapiens
tgccggcggcagcccca

SEQ ID NO: 4584328 - DNA, 19 bp, Homo sapiens
tgccggcggcagccccact

SEQ ID NO: 4584329 - DNA, 16 bp, Homo sapiens
tgccggtcgggcagcc

SEQ ID NO: 4584330 - DNA, 18 bp, Homo sapiens
tgccggtcgggcagccag

SEQ ID NO: 4584331 - DNA, 19 bp, Homo sapiens
tgccggtgggaccctgtcc

SEQ ID NO: 4584332 - DNA, 14 bp, Homo sapiens
tgccgtgagcatgc

SEQ ID NO: 4584333 - DNA, 15 bp, Homo sapiens
tgccgtgagcatgca

SEQ ID NO: 4584334 - DNA, 16 bp, Homo sapiens
tgccgttactctccaa

SEQ ID NO: 4584335 - DNA, 15 bp, Homo sapiens
tgccgttctgcaccc

SEQ ID NO: 4584336 - DNA, 16 bp, Homo sapiens
tgcctaaaattttaga

SEQ ID NO: 4584337 - DNA, 16 bp, Homo sapiens
tgcctaatggagaaga

SEQ ID NO: 4584338 - DNA, 14 bp, Homo sapiens
tgcctaattggaaa

SEQ ID NO: 4584339 - DNA, 20 bp, Homo sapiens
tgcctacctagctgcatcta

SEQ ID NO: 4584340 - DNA, 15 bp, Homo sapiens
tgcctagtaaatgtt

SEQ ID NO: 4584341 - DNA, 16 bp, Homo sapiens
tgcctatagtcccact

SEQ ID NO: 4584342 - DNA, 20 bp, Homo sapiens
tgcctatgcactgaagagct

SEQ ID NO: 4584343 - DNA, 22 bp, Homo sapiens
tgcctatgcactgaagagctct

SEQ ID NO: 4584344 - DNA, 23 bp, Homo sapiens
tgcctatgcactgaagagctctt

SEQ ID NO: 4584345 - DNA, 15 bp, Homo sapiens
tgcctatgggccaga

SEQ ID NO: 4584346 - DNA, 15 bp, Homo sapiens
tgcctatgtctcctc

SEQ ID NO: 4584347 - DNA, 21 bp, Homo sapiens
tgcctattatctgtcagctgc

SEQ ID NO: 4584348 - DNA, 23 bp, Homo sapiens
tgcctcaatgtgaatcagaccct

SEQ ID NO: 4584349 - DNA, 24 bp, Homo sapiens
tgcctcaatgtgaatcagacccta

SEQ ID NO: 4584350 - DNA, 19 bp, Homo sapiens
tgcctcacatttttttcta

SEQ ID NO: 4584351 - DNA, 18 bp, Homo sapiens
tgcctcactaatttttgt

SEQ ID NO: 4584352 - DNA, 14 bp, Homo sapiens
tgcctcagccaggc

SEQ ID NO: 4584353 - DNA, 11 bp, Homo sapiens
tgcctcagcct

SEQ ID NO: 4584354 - DNA, 18 bp, Homo sapiens
tgcctcagcctcccgagt

SEQ ID NO: 4584355 - DNA, 23 bp, Homo sapiens
tgcctcagcctcccgagtagctg

SEQ ID NO: 4584356 - DNA, 15 bp, Homo sapiens
tgcctcagtctgctt

SEQ ID NO: 4584357 - DNA, 22 bp, Homo sapiens
tgcctccaagaggaacctctga

SEQ ID NO: 4584358 - DNA, 12 bp, Homo sapiens
tgcctccaccct

SEQ ID NO: 4584359 - DNA, 19 bp, Homo sapiens
tgcctcccaaggtcctctc

SEQ ID NO: 4584360 - DNA, 16 bp, Homo sapiens
tgcctcccacttcact

SEQ ID NO: 4584361 - DNA, 17 bp, Homo sapiens
tgcctcccacttcactg

SEQ ID NO: 4584362 - DNA, 18 bp, Homo sapiens
tgcctcccattctgcacc

SEQ ID NO: 4584363 - DNA, 19 bp, Homo sapiens
tgcctcccattctgcacca

SEQ ID NO: 4584364 - DNA, 17 bp, Homo sapiens
tgcctccccatttccca

SEQ ID NO: 4584365 - DNA, 14 bp, Homo sapiens
tgcctccccccaga

SEQ ID NO: 4584366 - DNA, 15 bp, Homo sapiens
tgcctccccccagac

SEQ ID NO: 4584367 - DNA, 21 bp, Homo sapiens
tgcctcccccgcctccagtca

SEQ ID NO: 4584368 - DNA, 20 bp, Homo sapiens
tgcctcctcaaacccagtct

SEQ ID NO: 4584369 - DNA, 14 bp, Homo sapiens
tgcctcctgaggct

SEQ ID NO: 4584370 - DNA, 18 bp, Homo sapiens
tgcctcctgaggctgttt

SEQ ID NO: 4584371 - DNA, 14 bp, Homo sapiens
tgcctcctgcgccc

SEQ ID NO: 4584372 - DNA, 14 bp, Homo sapiens
tgcctcctgtgtac

SEQ ID NO: 4584373 - DNA, 21 bp, Homo sapiens
tgcctcctgtgtactgtgtca

SEQ ID NO: 4584374 - DNA, 21 bp, Homo sapiens
tgcctcgaaacacagaaacct

SEQ ID NO: 4584375 - DNA, 23 bp, Homo sapiens
tgcctcgaaacacagaaaccttt

SEQ ID NO: 4584376 - DNA, 20 bp, Homo sapiens
tgcctcggcctcccaaagtg

SEQ ID NO: 4584377 - DNA, 18 bp, Homo sapiens
tgcctcgtagagtgacct

SEQ ID NO: 4584378 - DNA, 22 bp, Homo sapiens
tgcctcgtagagtgacctcgga

SEQ ID NO: 4584379 - DNA, 15 bp, Homo sapiens
tgcctctacctgaca

SEQ ID NO: 4584380 - DNA, 21 bp, Homo sapiens
tgcctctcatcaactgaatga

SEQ ID NO: 4584381 - DNA, 13 bp, Homo sapiens
tgcctctccaggc

SEQ ID NO: 4584382 - DNA, 14 bp, Homo sapiens
tgcctctccaggca

SEQ ID NO: 4584383 - DNA, 21 bp, Homo sapiens
tgcctctctggaaagaggctc

SEQ ID NO: 4584384 - DNA, 20 bp, Homo sapiens
tgcctctgacagtccacagg

SEQ ID NO: 4584385 - DNA, 21 bp, Homo sapiens
tgcctctgacagtccacaggg

SEQ ID NO: 4584386 - DNA, 17 bp, Homo sapiens
tgcctctgctccctctg

SEQ ID NO: 4584387 - DNA, 13 bp, Homo sapiens
tgcctctgtcccc

SEQ ID NO: 4584388 - DNA, 20 bp, Homo sapiens
tgcctctgtccccttctctc

SEQ ID NO: 4584389 - DNA, 23 bp, Homo sapiens
tgcctcttccagtcttcctgaca

SEQ ID NO: 4584390 - DNA, 23 bp, Homo sapiens
tgcctcttctcttgacagtctga

SEQ ID NO: 4584391 - DNA, 15 bp, Homo sapiens
tgcctcttctgggag

SEQ ID NO: 4584392 - DNA, 19 bp, Homo sapiens
tgcctcttctgggagggca

SEQ ID NO: 4584393 - DNA, 13 bp, Homo sapiens
tgcctcttctttg

SEQ ID NO: 4584394 - DNA, 20 bp, Homo sapiens
tgcctcttctttgtgccttt

SEQ ID NO: 4584395 - DNA, 20 bp, Homo sapiens
tgcctcttttacctgctgct

SEQ ID NO: 4584396 - DNA, 22 bp, Homo sapiens
tgcctcttttacctgctgcttc

SEQ ID NO: 4584397 - DNA, 16 bp, Homo sapiens
tgcctgaacagccctc

SEQ ID NO: 4584398 - DNA, 17 bp, Homo sapiens
tgcctgaacagccctct

SEQ ID NO: 4584399 - DNA, 21 bp, Homo sapiens
tgcctgaagcttcggccgcgc

SEQ ID NO: 4584400 - DNA, 15 bp, Homo sapiens
tgcctgaatatttgt

SEQ ID NO: 4584401 - DNA, 20 bp, Homo sapiens
tgcctgactaatttttgtat

SEQ ID NO: 4584402 - DNA, 21 bp, Homo sapiens
tgcctgagaagaagtggctgc

SEQ ID NO: 4584403 - DNA, 15 bp, Homo sapiens
tgcctgagaccaggg

SEQ ID NO: 4584404 - DNA, 21 bp, Homo sapiens
tgcctgagaccagggtggcca

SEQ ID NO: 4584405 - DNA, 16 bp, Homo sapiens
tgcctgagaggcaggc

SEQ ID NO: 4584406 - DNA, 14 bp, Homo sapiens
tgcctgcacacaga

SEQ ID NO: 4584407 - DNA, 17 bp, Homo sapiens
tgcctgcagcaggcagc

SEQ ID NO: 4584408 - DNA, 14 bp, Homo sapiens
tgcctgcagccagg

SEQ ID NO: 4584409 - DNA, 15 bp, Homo sapiens
tgcctgcagccaggg

SEQ ID NO: 4584410 - DNA, 17 bp, Homo sapiens
tgcctgcagccagggct

SEQ ID NO: 4584411 - DNA, 18 bp, Homo sapiens
tgcctgcagccagggctg

SEQ ID NO: 4584412 - DNA, 21 bp, Homo sapiens
tgcctgcaggtcagttgtaat

SEQ ID NO: 4584413 - DNA, 22 bp, Homo sapiens
tgcctgcaggtcagttgtaata

SEQ ID NO: 4584414 - DNA, 23 bp, Homo sapiens
tgcctgcaggtcagttgtaataa

SEQ ID NO: 4584415 - DNA, 12 bp, Homo sapiens
tgcctgcagttt

SEQ ID NO: 4584416 - DNA, 14 bp, Homo sapiens
tgcctgcagtttct

SEQ ID NO: 4584417 - DNA, 14 bp, Homo sapiens
tgcctgccaccgcg

SEQ ID NO: 4584418 - DNA, 14 bp, Homo sapiens
tgcctgccactctc

SEQ ID NO: 4584419 - DNA, 20 bp, Homo sapiens
tgcctgccactctctgggac

SEQ ID NO: 4584420 - DNA, 13 bp, Homo sapiens
tgcctgccctgcc

SEQ ID NO: 4584421 - DNA, 18 bp, Homo sapiens
tgcctgcgcctgctgcct

SEQ ID NO: 4584422 - DNA, 17 bp, Homo sapiens
tgcctgctttttggaaa

SEQ ID NO: 4584423 - DNA, 21 bp, Homo sapiens
tgcctgctttttggaaagtca

SEQ ID NO: 4584424 - DNA, 20 bp, Homo sapiens
tgcctggagacaaggtgcta

SEQ ID NO: 4584425 - DNA, 15 bp, Homo sapiens
tgcctggcaggctgt

SEQ ID NO: 4584426 - DNA, 17 bp, Homo sapiens
tgcctggccagattttt

SEQ ID NO: 4584427 - DNA, 11 bp, Homo sapiens
tgcctggcccc

SEQ ID NO: 4584428 - DNA, 14 bp, Homo sapiens
tgcctggccccagc

SEQ ID NO: 4584429 - DNA, 16 bp, Homo sapiens
tgcctggccccagcct

SEQ ID NO: 4584430 - DNA, 21 bp, Homo sapiens
tgcctggccccagcctgggcc

SEQ ID NO: 4584431 - DNA, 12 bp, Homo sapiens
tgcctggccccc

SEQ ID NO: 4584432 - DNA, 16 bp, Homo sapiens
tgcctggccctcccca

SEQ ID NO: 4584433 - DNA, 18 bp, Homo sapiens
tgcctggccctccccaca

SEQ ID NO: 4584434 - DNA, 15 bp, Homo sapiens
tgcctggctaacttt

SEQ ID NO: 4584435 - DNA, 16 bp, Homo sapiens
tgcctgggtggggctg

SEQ ID NO: 4584436 - DNA, 21 bp, Homo sapiens
tgcctgggtggggctgctcct

SEQ ID NO: 4584437 - DNA, 24 bp, Homo sapiens
tgcctgggtggggctgctcctcca

SEQ ID NO: 4584438 - DNA, 18 bp, Homo sapiens
tgcctggttaatattaat

SEQ ID NO: 4584439 - DNA, 15 bp, Homo sapiens
tgcctggttttattt

SEQ ID NO: 4584440 - DNA, 15 bp, Homo sapiens
tgcctgtaacttgag

SEQ ID NO: 4584441 - DNA, 18 bp, Homo sapiens
tgcctgtaatcacagcta

SEQ ID NO: 4584442 - DNA, 22 bp, Homo sapiens
tgcctgtaattaaactagttta

SEQ ID NO: 4584443 - DNA, 22 bp, Homo sapiens
tgcctgtagcaatggccagagc

SEQ ID NO: 4584444 - DNA, 20 bp, Homo sapiens
tgcctgtagctttcctggtc

SEQ ID NO: 4584445 - DNA, 20 bp, Homo sapiens
tgcctgtagtctcagctagt

SEQ ID NO: 4584446 - DNA, 15 bp, Homo sapiens
tgcctgtccagcctg

SEQ ID NO: 4584447 - DNA, 18 bp, Homo sapiens
tgcctgtccagcctgggc

SEQ ID NO: 4584448 - DNA, 19 bp, Homo sapiens
tgcctgtccagcctgggca

SEQ ID NO: 4584449 - DNA, 23 bp, Homo sapiens
tgcctgtccccaaacaggacagc

SEQ ID NO: 4584450 - DNA, 21 bp, Homo sapiens
tgcctgtgagcatggggccag

SEQ ID NO: 4584451 - DNA, 14 bp, Homo sapiens
tgcctgtgaggcag

SEQ ID NO: 4584452 - DNA, 19 bp, Homo sapiens
tgcctgtgctacaattcat

SEQ ID NO: 4584453 - DNA, 18 bp, Homo sapiens
tgcctgtggcccctcccc

SEQ ID NO: 4584454 - DNA, 18 bp, Homo sapiens
tgcctgttataactctgc

SEQ ID NO: 4584455 - DNA, 19 bp, Homo sapiens
tgcctgttataactctgca

SEQ ID NO: 4584456 - DNA, 15 bp, Homo sapiens
tgccttacctcctgc

SEQ ID NO: 4584457 - DNA, 21 bp, Homo sapiens
tgccttacctcctgcccagga

SEQ ID NO: 4584458 - DNA, 15 bp, Homo sapiens
tgccttactcttctt

SEQ ID NO: 4584459 - DNA, 19 bp, Homo sapiens
tgccttagagccaggcaca

SEQ ID NO: 4584460 - DNA, 23 bp, Homo sapiens
tgccttagagccaggcacacact

SEQ ID NO: 4584461 - DNA, 13 bp, Homo sapiens
tgccttagcttca

SEQ ID NO: 4584462 - DNA, 16 bp, Homo sapiens
tgccttagcttcagga

SEQ ID NO: 4584463 - DNA, 17 bp, Homo sapiens
tgccttatttgtctgta

SEQ ID NO: 4584464 - DNA, 20 bp, Homo sapiens
tgccttatttgtctgtaaaa

SEQ ID NO: 4584465 - DNA, 23 bp, Homo sapiens
tgccttatttgtctgtaaaaaat

SEQ ID NO: 4584466 - DNA, 16 bp, Homo sapiens
tgccttcacaaatgtc

SEQ ID NO: 4584467 - DNA, 18 bp, Homo sapiens
tgccttcagtcttggtaa

SEQ ID NO: 4584468 - DNA, 16 bp, Homo sapiens
tgccttccctagcttt

SEQ ID NO: 4584469 - DNA, 13 bp, Homo sapiens
tgccttctcacca

SEQ ID NO: 4584470 - DNA, 17 bp, Homo sapiens
tgccttctcaccagctg

SEQ ID NO: 4584471 - DNA, 18 bp, Homo sapiens
tgccttctcaccagctgc

SEQ ID NO: 4584472 - DNA, 21 bp, Homo sapiens
tgccttctcaccagctgcaaa

SEQ ID NO: 4584473 - DNA, 22 bp, Homo sapiens
tgccttctcaccagctgcaaag

SEQ ID NO: 4584474 - DNA, 23 bp, Homo sapiens
tgccttctcaccagctgcaaagt

SEQ ID NO: 4584475 - DNA, 14 bp, Homo sapiens
tgccttctgtgggg

SEQ ID NO: 4584476 - DNA, 13 bp, Homo sapiens
tgccttctttcca

SEQ ID NO: 4584477 - DNA, 14 bp, Homo sapiens
tgccttctttccat

SEQ ID NO: 4584478 - DNA, 18 bp, Homo sapiens
tgccttgaaatttacaca

SEQ ID NO: 4584479 - DNA, 21 bp, Homo sapiens
tgccttgaaatttacacagtg

SEQ ID NO: 4584480 - DNA, 22 bp, Homo sapiens
tgccttgaaatttacacagtga

SEQ ID NO: 4584481 - DNA, 12 bp, Homo sapiens
tgccttgaataa

SEQ ID NO: 4584482 - DNA, 13 bp, Homo sapiens
tgccttggagagg

SEQ ID NO: 4584483 - DNA, 19 bp, Homo sapiens
tgccttggagagggcccag

SEQ ID NO: 4584484 - DNA, 20 bp, Homo sapiens
tgccttggaggaaatgtgct

SEQ ID NO: 4584485 - DNA, 19 bp, Homo sapiens
tgccttggagggtcccaag

SEQ ID NO: 4584486 - DNA, 17 bp, Homo sapiens
tgccttggatgagaagt

SEQ ID NO: 4584487 - DNA, 12 bp, Homo sapiens
tgccttggcctc

SEQ ID NO: 4584488 - DNA, 19 bp, Homo sapiens
tgccttggcctcccaaagt

SEQ ID NO: 4584489 - DNA, 11 bp, Homo sapiens
tgccttgggct

SEQ ID NO: 4584490 - DNA, 17 bp, Homo sapiens
tgccttgggctgctcct

SEQ ID NO: 4584491 - DNA, 19 bp, Homo sapiens
tgccttgggctgctcctca

SEQ ID NO: 4584492 - DNA, 16 bp, Homo sapiens
tgccttgtataatatt

SEQ ID NO: 4584493 - DNA, 23 bp, Homo sapiens
tgccttgtttgagtttttcctcc

SEQ ID NO: 4584494 - DNA, 20 bp, Homo sapiens
tgccttgttttttgtttgtt

SEQ ID NO: 4584495 - DNA, 15 bp, Homo sapiens
tgcctttaaatctgt

SEQ ID NO: 4584496 - DNA, 18 bp, Homo sapiens
tgcctttaaatctgtgat

SEQ ID NO: 4584497 - DNA, 11 bp, Homo sapiens
tgcctttagaa

SEQ ID NO: 4584498 - DNA, 15 bp, Homo sapiens
tgcctttagaaaata

SEQ ID NO: 4584499 - DNA, 16 bp, Homo sapiens
tgcctttagaaaatat

SEQ ID NO: 4584500 - DNA, 13 bp, Homo sapiens
tgcctttcaaatt

SEQ ID NO: 4584501 - DNA, 17 bp, Homo sapiens
tgcctttcaaatttaga

SEQ ID NO: 4584502 - DNA, 15 bp, Homo sapiens
tgcctttcctatcac

SEQ ID NO: 4584503 - DNA, 23 bp, Homo sapiens
tgcctttcctatcacctcgagaa

SEQ ID NO: 4584504 - DNA, 13 bp, Homo sapiens
tgcctttcgtgat

SEQ ID NO: 4584505 - DNA, 17 bp, Homo sapiens
tgcctttcgtgatctta

SEQ ID NO: 4584506 - DNA, 15 bp, Homo sapiens
tgcctttctttgcct

SEQ ID NO: 4584507 - DNA, 18 bp, Homo sapiens
tgcctttctttgcctctg

SEQ ID NO: 4584508 - DNA, 22 bp, Homo sapiens
tgcctttctttgcctctgcagt

SEQ ID NO: 4584509 - DNA, 13 bp, Homo sapiens
tgcctttgatgtg

SEQ ID NO: 4584510 - DNA, 12 bp, Homo sapiens
tgcctttgtaac

SEQ ID NO: 4584511 - DNA, 17 bp, Homo sapiens
tgccttttaagtttgaa

SEQ ID NO: 4584512 - DNA, 17 bp, Homo sapiens
tgccttttgttaatgca

SEQ ID NO: 4584513 - DNA, 21 bp, Homo sapiens
tgccttttttctatatcaaaa

SEQ ID NO: 4584514 - DNA, 15 bp, Homo sapiens
tgcgagggaagcaat

SEQ ID NO: 4584515 - DNA, 21 bp, Homo sapiens
tgcgcattctaacctggaggt

SEQ ID NO: 4584516 - DNA, 12 bp, Homo sapiens
tgcgcctcagcc

SEQ ID NO: 4584517 - DNA, 15 bp, Homo sapiens
tgcgcctcagccctc

SEQ ID NO: 4584518 - DNA, 16 bp, Homo sapiens
tgcgcctcagccctca

SEQ ID NO: 4584519 - DNA, 12 bp, Homo sapiens
tgcgcctgcagg

SEQ ID NO: 4584520 - DNA, 15 bp, Homo sapiens
tgcgcctgcaggcag

SEQ ID NO: 4584521 - DNA, 16 bp, Homo sapiens
tgcgcctgctgcctgc

SEQ ID NO: 4584522 - DNA, 11 bp, Homo sapiens
tgcgctcaggg

SEQ ID NO: 4584523 - DNA, 20 bp, Homo sapiens
tgcgctcaggggctccatgc

SEQ ID NO: 4584524 - DNA, 23 bp, Homo sapiens
tgcggccccctctcggccaggca

SEQ ID NO: 4584525 - DNA, 18 bp, Homo sapiens
tgcggccgcattccctga

SEQ ID NO: 4584526 - DNA, 21 bp, Homo sapiens
tgcgggaccggtacagaaagg

SEQ ID NO: 4584527 - DNA, 14 bp, Homo sapiens
tgcgggagccagac

SEQ ID NO: 4584528 - DNA, 21 bp, Homo sapiens
tgcgggagccagactgtccag

SEQ ID NO: 4584529 - DNA, 22 bp, Homo sapiens
tgcgggagccagactgtccagg

SEQ ID NO: 4584530 - DNA, 17 bp, Homo sapiens
tgcgggagctctgtatg

SEQ ID NO: 4584531 - DNA, 12 bp, Homo sapiens
tgcgggaggctg

SEQ ID NO: 4584532 - DNA, 17 bp, Homo sapiens
tgcgggatacagctgag

SEQ ID NO: 4584533 - DNA, 18 bp, Homo sapiens
tgcgggctgaggccagag

SEQ ID NO: 4584534 - DNA, 23 bp, Homo sapiens
tgcggggggtgtcttccctgcct

SEQ ID NO: 4584535 - DNA, 22 bp, Homo sapiens
tgcgtggcttccctgtcccagt

SEQ ID NO: 4584536 - DNA, 18 bp, Homo sapiens
tgcgtgggagtgtgtgcc

SEQ ID NO: 4584537 - DNA, 13 bp, Homo sapiens
tgcgtgggtcaga

SEQ ID NO: 4584538 - DNA, 14 bp, Homo sapiens
tgcgtgggtgtgtg

SEQ ID NO: 4584539 - DNA, 16 bp, Homo sapiens
tgcgttctgcaagcat

SEQ ID NO: 4584540 - DNA, 17 bp, Homo sapiens
tgctaaaagcatgtata

SEQ ID NO: 4584541 - DNA, 17 bp, Homo sapiens
tgctaaaggagcatcta

SEQ ID NO: 4584542 - DNA, 17 bp, Homo sapiens
tgctaaataaaatttgt

SEQ ID NO: 4584543 - DNA, 21 bp, Homo sapiens
tgctaaataaaatttgttgca

SEQ ID NO: 4584544 - DNA, 22 bp, Homo sapiens
tgctaaataaaatttgttgcat

SEQ ID NO: 4584545 - DNA, 12 bp, Homo sapiens
tgctaaatctcc

SEQ ID NO: 4584546 - DNA, 17 bp, Homo sapiens
tgctaaatctcctattt

SEQ ID NO: 4584547 - DNA, 19 bp, Homo sapiens
tgctaagagggcccaaaga

SEQ ID NO: 4584548 - DNA, 20 bp, Homo sapiens
tgctaagcaagctaacctta

SEQ ID NO: 4584549 - DNA, 13 bp, Homo sapiens
tgctaaggcagct

SEQ ID NO: 4584550 - DNA, 19 bp, Homo sapiens
tgctaaggctcctccttgc

SEQ ID NO: 4584551 - DNA, 16 bp, Homo sapiens
tgctaagtaatttaga

SEQ ID NO: 4584552 - DNA, 17 bp, Homo sapiens
tgctaagtaatttagaa

SEQ ID NO: 4584553 - DNA, 22 bp, Homo sapiens
tgctaagtaatttagaagatat

SEQ ID NO: 4584554 - DNA, 21 bp, Homo sapiens
tgctaatataagtttctttgc

SEQ ID NO: 4584555 - DNA, 13 bp, Homo sapiens
tgctaatgtataa

SEQ ID NO: 4584556 - DNA, 14 bp, Homo sapiens
tgctacaaaaacac

SEQ ID NO: 4584557 - DNA, 15 bp, Homo sapiens
tgctacaaaaacaca

SEQ ID NO: 4584558 - DNA, 17 bp, Homo sapiens
tgctacaaaaacacagc

SEQ ID NO: 4584559 - DNA, 16 bp, Homo sapiens
tgctacagttagtctt

SEQ ID NO: 4584560 - DNA, 15 bp, Homo sapiens
tgctacatcagactc

SEQ ID NO: 4584561 - DNA, 23 bp, Homo sapiens
tgctacatgacgacaaagctgct

SEQ ID NO: 4584562 - DNA, 21 bp, Homo sapiens
tgctacctcagtgctcctgga

SEQ ID NO: 4584563 - DNA, 14 bp, Homo sapiens
tgctacctctgaga

SEQ ID NO: 4584564 - DNA, 16 bp, Homo sapiens
tgctacctctgagaag

SEQ ID NO: 4584565 - DNA, 17 bp, Homo sapiens
tgctacctctgagaaga

SEQ ID NO: 4584566 - DNA, 18 bp, Homo sapiens
tgctacctctgagaagac

SEQ ID NO: 4584567 - DNA, 18 bp, Homo sapiens
tgctactgcactccagcc

SEQ ID NO: 4584568 - DNA, 17 bp, Homo sapiens
tgctactgctcagcttc

SEQ ID NO: 4584569 - DNA, 13 bp, Homo sapiens
tgctactgtacat

SEQ ID NO: 4584570 - DNA, 19 bp, Homo sapiens
tgctacttcactgtcatct

SEQ ID NO: 4584571 - DNA, 21 bp, Homo sapiens
tgctacttgaaggtacacccc

SEQ ID NO: 4584572 - DNA, 15 bp, Homo sapiens
tgctagagcagacag

SEQ ID NO: 4584573 - DNA, 20 bp, Homo sapiens
tgctagagcagacaggcctg

SEQ ID NO: 4584574 - DNA, 18 bp, Homo sapiens
tgctagcacagaggcctg

SEQ ID NO: 4584575 - DNA, 19 bp, Homo sapiens
tgctagcacagaggcctga

SEQ ID NO: 4584576 - DNA, 19 bp, Homo sapiens
tgctaggcgctggggagac

SEQ ID NO: 4584577 - DNA, 19 bp, Homo sapiens
tgctaggggatgaggggct

SEQ ID NO: 4584578 - DNA, 21 bp, Homo sapiens
tgctagggttaggaggtcctt

SEQ ID NO: 4584579 - DNA, 14 bp, Homo sapiens
tgctaggtctcgga

SEQ ID NO: 4584580 - DNA, 22 bp, Homo sapiens
tgctaggtctcggactaagcct

SEQ ID NO: 4584581 - DNA, 11 bp, Homo sapiens
tgctagtgtga

SEQ ID NO: 4584582 - DNA, 18 bp, Homo sapiens
tgctataatctgttttta

SEQ ID NO: 4584583 - DNA, 13 bp, Homo sapiens
tgctatacatgtt

SEQ ID NO: 4584584 - DNA, 22 bp, Homo sapiens
tgctatagtatttgattcaaaa

SEQ ID NO: 4584585 - DNA, 19 bp, Homo sapiens
tgctatccccatctccctg

SEQ ID NO: 4584586 - DNA, 19 bp, Homo sapiens
tgctatgagctggggatgt

SEQ ID NO: 4584587 - DNA, 16 bp, Homo sapiens
tgctattaatatttgt

SEQ ID NO: 4584588 - DNA, 13 bp, Homo sapiens
tgctattgacaat

SEQ ID NO: 4584589 - DNA, 17 bp, Homo sapiens
tgctattgacaataaaa

SEQ ID NO: 4584590 - DNA, 20 bp, Homo sapiens
tgctattgacaataaaatat

SEQ ID NO: 4584591 - DNA, 21 bp, Homo sapiens
tgctattgacaataaaatatt

SEQ ID NO: 4584592 - DNA, 13 bp, Homo sapiens
tgctattgtctga

SEQ ID NO: 4584593 - DNA, 18 bp, Homo sapiens
tgctatttcaataacaga

SEQ ID NO: 4584594 - DNA, 17 bp, Homo sapiens
tgctatttgaacaagtg

SEQ ID NO: 4584595 - DNA, 20 bp, Homo sapiens
tgctatttgaacaagtgggc

SEQ ID NO: 4584596 - DNA, 15 bp, Homo sapiens
tgctcaaaaaatgag

SEQ ID NO: 4584597 - DNA, 15 bp, Homo sapiens
tgctcaaaaagaaat

SEQ ID NO: 4584598 - DNA, 23 bp, Homo sapiens
tgctcaacaatttatccattcaa

SEQ ID NO: 4584599 - DNA, 19 bp, Homo sapiens
tgctcaacagacaattaga

SEQ ID NO: 4584600 - DNA, 13 bp, Homo sapiens
tgctcaacccccc

SEQ ID NO: 4584601 - DNA, 22 bp, Homo sapiens
tgctcaacccccctcccagaca

SEQ ID NO: 4584602 - DNA, 15 bp, Homo sapiens
tgctcaatttcagca

SEQ ID NO: 4584603 - DNA, 16 bp, Homo sapiens
tgctcaccagccctgc

SEQ ID NO: 4584604 - DNA, 17 bp, Homo sapiens
tgctcaccagccctgca

SEQ ID NO: 4584605 - DNA, 18 bp, Homo sapiens
tgctcaccctctcttggt

SEQ ID NO: 4584606 - DNA, 17 bp, Homo sapiens
tgctcacgtcaaatgca

SEQ ID NO: 4584607 - DNA, 22 bp, Homo sapiens
tgctcacgttaccttgacacat

SEQ ID NO: 4584608 - DNA, 15 bp, Homo sapiens
tgctcactgggcccg

SEQ ID NO: 4584609 - DNA, 12 bp, Homo sapiens
tgctcactgtgt

SEQ ID NO: 4584610 - DNA, 14 bp, Homo sapiens
tgctcagagaagga

SEQ ID NO: 4584611 - DNA, 17 bp, Homo sapiens
tgctcagccaaatttcc

SEQ ID NO: 4584612 - DNA, 18 bp, Homo sapiens
tgctcagccaaatttcct

SEQ ID NO: 4584613 - DNA, 23 bp, Homo sapiens
tgctcagtgcttgggctccacgg

SEQ ID NO: 4584614 - DNA, 22 bp, Homo sapiens
tgctcatacacagttaaataaa

SEQ ID NO: 4584615 - DNA, 21 bp, Homo sapiens
tgctcatattgtgattctgcc

SEQ ID NO: 4584616 - DNA, 17 bp, Homo sapiens
tgctcatcattctctgt

SEQ ID NO: 4584617 - DNA, 20 bp, Homo sapiens
tgctcatcattctctgtctc

SEQ ID NO: 4584618 - DNA, 15 bp, Homo sapiens
tgctcatgggaagaa

SEQ ID NO: 4584619 - DNA, 23 bp, Homo sapiens
tgctcattaaactgattccagga

SEQ ID NO: 4584620 - DNA, 14 bp, Homo sapiens
tgctccaatctgtc

SEQ ID NO: 4584621 - DNA, 20 bp, Homo sapiens
tgctccaatctgtcacataa

SEQ ID NO: 4584622 - DNA, 18 bp, Homo sapiens
tgctccaatgactgagca

SEQ ID NO: 4584623 - DNA, 15 bp, Homo sapiens
tgctccaccacatcc

SEQ ID NO: 4584624 - DNA, 16 bp, Homo sapiens
tgctccaccagcagca

SEQ ID NO: 4584625 - DNA, 16 bp, Homo sapiens
tgctccacccttggcc

SEQ ID NO: 4584626 - DNA, 18 bp, Homo sapiens
tgctccacccttggcctg

SEQ ID NO: 4584627 - DNA, 14 bp, Homo sapiens
tgctccagcctctg

SEQ ID NO: 4584628 - DNA, 16 bp, Homo sapiens
tgctccagcctctgcc

SEQ ID NO: 4584629 - DNA, 15 bp, Homo sapiens
tgctccagggtcagg

SEQ ID NO: 4584630 - DNA, 20 bp, Homo sapiens
tgctccataccttttctctt

SEQ ID NO: 4584631 - DNA, 16 bp, Homo sapiens
tgctcccacctggctc

SEQ ID NO: 4584632 - DNA, 17 bp, Homo sapiens
tgctcccacctggctct

SEQ ID NO: 4584633 - DNA, 16 bp, Homo sapiens
tgctcccagctgtgct

SEQ ID NO: 4584634 - DNA, 17 bp, Homo sapiens
tgctccccaacacctgc

SEQ ID NO: 4584635 - DNA, 18 bp, Homo sapiens
tgctccccaacacctgcc

SEQ ID NO: 4584636 - DNA, 21 bp, Homo sapiens
tgctccccacagcgtccctgg

SEQ ID NO: 4584637 - DNA, 17 bp, Homo sapiens
tgctcccggcccgcctg

SEQ ID NO: 4584638 - DNA, 13 bp, Homo sapiens
tgctccctcccct

SEQ ID NO: 4584639 - DNA, 14 bp, Homo sapiens
tgctccctcccctg

SEQ ID NO: 4584640 - DNA, 15 bp, Homo sapiens
tgctccctcccctgc

SEQ ID NO: 4584641 - DNA, 23 bp, Homo sapiens
tgctccctctccaagacagcagc

SEQ ID NO: 4584642 - DNA, 12 bp, Homo sapiens
tgctccctgcct

SEQ ID NO: 4584643 - DNA, 13 bp, Homo sapiens
tgctccctgcctc

SEQ ID NO: 4584644 - DNA, 15 bp, Homo sapiens
tgctccgccatggtg

SEQ ID NO: 4584645 - DNA, 20 bp, Homo sapiens
tgctccgccatggtgtcccg

SEQ ID NO: 4584646 - DNA, 19 bp, Homo sapiens
tgctcctagaagtcttaat

SEQ ID NO: 4584647 - DNA, 13 bp, Homo sapiens
tgctcctccaggg

SEQ ID NO: 4584648 - DNA, 21 bp, Homo sapiens
tgctcctccagggccacgtgc

SEQ ID NO: 4584649 - DNA, 13 bp, Homo sapiens
tgctcctgtgctc

SEQ ID NO: 4584650 - DNA, 14 bp, Homo sapiens
tgctcctgtgctca

SEQ ID NO: 4584651 - DNA, 21 bp, Homo sapiens
tgctcctgttcacaccagaga

SEQ ID NO: 4584652 - DNA, 23 bp, Homo sapiens
tgctccttggcacccccatgctg

SEQ ID NO: 4584653 - DNA, 19 bp, Homo sapiens
tgctccttgggccctttga

SEQ ID NO: 4584654 - DNA, 22 bp, Homo sapiens
tgctcgcttgctggaacacagg

SEQ ID NO: 4584655 - DNA, 23 bp, Homo sapiens
tgctcgcttgctggaacacaggg

SEQ ID NO: 4584656 - DNA, 14 bp, Homo sapiens
tgctcggacacagt

SEQ ID NO: 4584657 - DNA, 16 bp, Homo sapiens
tgctcgtggactgtgc

SEQ ID NO: 4584658 - DNA, 21 bp, Homo sapiens
tgctctaatgagcatttcctt

SEQ ID NO: 4584659 - DNA, 13 bp, Homo sapiens
tgctctagaaagt

SEQ ID NO: 4584660 - DNA, 14 bp, Homo sapiens
tgctctatatgtaa

SEQ ID NO: 4584661 - DNA, 17 bp, Homo sapiens
tgctctatgtctgcctt

SEQ ID NO: 4584662 - DNA, 22 bp, Homo sapiens
tgctctcactgtttgtttttat

SEQ ID NO: 4584663 - DNA, 16 bp, Homo sapiens
tgctctcagcctccca

SEQ ID NO: 4584664 - DNA, 17 bp, Homo sapiens
tgctctcagcctcccac

SEQ ID NO: 4584665 - DNA, 19 bp, Homo sapiens
tgctctcagcctcccacaa

SEQ ID NO: 4584666 - DNA, 19 bp, Homo sapiens
tgctctccaagtctcagtg

SEQ ID NO: 4584667 - DNA, 20 bp, Homo sapiens
tgctctccaagtctcagtgg

SEQ ID NO: 4584668 - DNA, 22 bp, Homo sapiens
tgctctccctaaccccttgtcc

SEQ ID NO: 4584669 - DNA, 12 bp, Homo sapiens
tgctctccttcc

SEQ ID NO: 4584670 - DNA, 21 bp, Homo sapiens
tgctctctgcagccagcccag

SEQ ID NO: 4584671 - DNA, 16 bp, Homo sapiens
tgctctcttcaataaa

SEQ ID NO: 4584672 - DNA, 15 bp, Homo sapiens
tgctctgacctcctc

SEQ ID NO: 4584673 - DNA, 18 bp, Homo sapiens
tgctctgacctcctctgg

SEQ ID NO: 4584674 - DNA, 21 bp, Homo sapiens
tgctctgacctcctctgggcc

SEQ ID NO: 4584675 - DNA, 22 bp, Homo sapiens
tgctctgacctcctctgggccc

SEQ ID NO: 4584676 - DNA, 20 bp, Homo sapiens
tgctctgaccttccagagcc

SEQ ID NO: 4584677 - DNA, 21 bp, Homo sapiens
tgctctgaccttccagagccc

SEQ ID NO: 4584678 - DNA, 16 bp, Homo sapiens
tgctctgagccacaga

SEQ ID NO: 4584679 - DNA, 13 bp, Homo sapiens
tgctctgatccct

SEQ ID NO: 4584680 - DNA, 19 bp, Homo sapiens
tgctctgatccctctacag

SEQ ID NO: 4584681 - DNA, 19 bp, Homo sapiens
tgctctgcaggctggggag

SEQ ID NO: 4584682 - DNA, 23 bp, Homo sapiens
tgctctgcaggctggggaggtgc

SEQ ID NO: 4584683 - DNA, 12 bp, Homo sapiens
tgctctgcctca

SEQ ID NO: 4584684 - DNA, 13 bp, Homo sapiens
tgctctgcctcag

SEQ ID NO: 4584685 - DNA, 22 bp, Homo sapiens
tgctctgcgtgtcacctgtgct

SEQ ID NO: 4584686 - DNA, 15 bp, Homo sapiens
tgctctggaggctgc

SEQ ID NO: 4584687 - DNA, 17 bp, Homo sapiens
tgctctgggaaggggct

SEQ ID NO: 4584688 - DNA, 21 bp, Homo sapiens
tgctctggttgtttctgttcc

SEQ ID NO: 4584689 - DNA, 11 bp, Homo sapiens
tgctctgtccc

SEQ ID NO: 4584690 - DNA, 22 bp, Homo sapiens
tgctctgtgtatatctcttgga

SEQ ID NO: 4584691 - DNA, 17 bp, Homo sapiens
tgctctgttacccaggc

SEQ ID NO: 4584692 - DNA, 16 bp, Homo sapiens
tgctctgtttgtgggg

SEQ ID NO: 4584693 - DNA, 21 bp, Homo sapiens
tgctcttctctccccagcccc

SEQ ID NO: 4584694 - DNA, 22 bp, Homo sapiens
tgctcttctctccccagccccc

SEQ ID NO: 4584695 - DNA, 20 bp, Homo sapiens
tgctcttgaaatattcagaa

SEQ ID NO: 4584696 - DNA, 20 bp, Homo sapiens
tgctcttgaccttgtagaga

SEQ ID NO: 4584697 - DNA, 16 bp, Homo sapiens
tgctctttaaataata

SEQ ID NO: 4584698 - DNA, 20 bp, Homo sapiens
tgctcttttcctggtgctct

SEQ ID NO: 4584699 - DNA, 13 bp, Homo sapiens
tgctcttttctcc

SEQ ID NO: 4584700 - DNA, 15 bp, Homo sapiens
tgctcttttctcctc

SEQ ID NO: 4584701 - DNA, 21 bp, Homo sapiens
tgctcttttctcctcactgta

SEQ ID NO: 4584702 - DNA, 23 bp, Homo sapiens
tgctcttttctcctcactgtatc

SEQ ID NO: 4584703 - DNA, 15 bp, Homo sapiens
tgctcttttgtgatg

SEQ ID NO: 4584704 - DNA, 17 bp, Homo sapiens
tgctcttttgtgatgaa

SEQ ID NO: 4584705 - DNA, 17 bp, Homo sapiens
tgctgaaacaacaaata

SEQ ID NO: 4584706 - DNA, 13 bp, Homo sapiens
tgctgaaactgcc

SEQ ID NO: 4584707 - DNA, 18 bp, Homo sapiens
tgctgaaagtcctgcttt

SEQ ID NO: 4584708 - DNA, 17 bp, Homo sapiens
tgctgaactcagcacat

SEQ ID NO: 4584709 - DNA, 13 bp, Homo sapiens
tgctgaagggcat

SEQ ID NO: 4584710 - DNA, 18 bp, Homo sapiens
tgctgaagggcattcttt

SEQ ID NO: 4584711 - DNA, 21 bp, Homo sapiens
tgctgaagggcattctttccc

SEQ ID NO: 4584712 - DNA, 23 bp, Homo sapiens
tgctgaatgccgcgatgggtcag

SEQ ID NO: 4584713 - DNA, 18 bp, Homo sapiens
tgctgaattcctttacaa

SEQ ID NO: 4584714 - DNA, 19 bp, Homo sapiens
tgctgaatttgtagttgtt

SEQ ID NO: 4584715 - DNA, 17 bp, Homo sapiens
tgctgacttagcctcct

SEQ ID NO: 4584716 - DNA, 18 bp, Homo sapiens
tgctgagagacccaagga

SEQ ID NO: 4584717 - DNA, 21 bp, Homo sapiens
tgctgagagacccaaggagga

SEQ ID NO: 4584718 - DNA, 22 bp, Homo sapiens
tgctgagagacccaaggaggaa

SEQ ID NO: 4584719 - DNA, 19 bp, Homo sapiens
tgctgagattgcagatgtg

SEQ ID NO: 4584720 - DNA, 15 bp, Homo sapiens
tgctgagtgacagct

SEQ ID NO: 4584721 - DNA, 15 bp, Homo sapiens
tgctgagttggcctg

SEQ ID NO: 4584722 - DNA, 14 bp, Homo sapiens
tgctgatccttgca

SEQ ID NO: 4584723 - DNA, 14 bp, Homo sapiens
tgctgatgtcaaag

SEQ ID NO: 4584724 - DNA, 12 bp, Homo sapiens
tgctgattattt

SEQ ID NO: 4584725 - DNA, 13 bp, Homo sapiens
tgctgattattta

SEQ ID NO: 4584726 - DNA, 14 bp, Homo sapiens
tgctgattatttat

SEQ ID NO: 4584727 - DNA, 16 bp, Homo sapiens
tgctgattatttatga

SEQ ID NO: 4584728 - DNA, 21 bp, Homo sapiens
tgctgattatttatgacctga

SEQ ID NO: 4584729 - DNA, 14 bp, Homo sapiens
tgctgattttaatg

SEQ ID NO: 4584730 - DNA, 20 bp, Homo sapiens
tgctgcaaacctgacccctg

SEQ ID NO: 4584731 - DNA, 15 bp, Homo sapiens
tgctgcaacaagctc

SEQ ID NO: 4584732 - DNA, 13 bp, Homo sapiens
tgctgcagagatc

SEQ ID NO: 4584733 - DNA, 15 bp, Homo sapiens
tgctgcagctccctg

SEQ ID NO: 4584734 - DNA, 21 bp, Homo sapiens
tgctgcagctccctggcttct

SEQ ID NO: 4584735 - DNA, 16 bp, Homo sapiens
tgctgcaggtggcaga

SEQ ID NO: 4584736 - DNA, 21 bp, Homo sapiens
tgctgcagtcacatcacaata

SEQ ID NO: 4584737 - DNA, 13 bp, Homo sapiens
tgctgcattcctt

SEQ ID NO: 4584738 - DNA, 21 bp, Homo sapiens
tgctgccatgacagaggctgc

SEQ ID NO: 4584739 - DNA, 16 bp, Homo sapiens
tgctgcccatgtttca

SEQ ID NO: 4584740 - DNA, 21 bp, Homo sapiens
tgctgcccctgcacagcaggc

SEQ ID NO: 4584741 - DNA, 14 bp, Homo sapiens
tgctgcccctgtct

SEQ ID NO: 4584742 - DNA, 18 bp, Homo sapiens
tgctgcccctgtctggaa

SEQ ID NO: 4584743 - DNA, 14 bp, Homo sapiens
tgctgccttcaggg

SEQ ID NO: 4584744 - DNA, 18 bp, Homo sapiens
tgctgcgcctgcaggcag

SEQ ID NO: 4584745 - DNA, 19 bp, Homo sapiens
tgctgcgcctgcaggcaga

SEQ ID NO: 4584746 - DNA, 16 bp, Homo sapiens
tgctgctactgctgct

SEQ ID NO: 4584747 - DNA, 14 bp, Homo sapiens
tgctgctactgtct

SEQ ID NO: 4584748 - DNA, 23 bp, Homo sapiens
tgctgctcagtaagaagattctc

SEQ ID NO: 4584749 - DNA, 18 bp, Homo sapiens
tgctgctctcccaagggt

SEQ ID NO: 4584750 - DNA, 13 bp, Homo sapiens
tgctgctgctgcc

SEQ ID NO: 4584751 - DNA, 16 bp, Homo sapiens
tgctgctttgggctgg

SEQ ID NO: 4584752 - DNA, 18 bp, Homo sapiens
tgctggaacacaggggcc

SEQ ID NO: 4584753 - DNA, 21 bp, Homo sapiens
tgctggaacacaggggccttt

SEQ ID NO: 4584754 - DNA, 22 bp, Homo sapiens
tgctggactgttccaggccctc

SEQ ID NO: 4584755 - DNA, 18 bp, Homo sapiens
tgctggagaaagccacgc

SEQ ID NO: 4584756 - DNA, 20 bp, Homo sapiens
tgctggagaaagccacgccc

SEQ ID NO: 4584757 - DNA, 14 bp, Homo sapiens
tgctggagctctgc

SEQ ID NO: 4584758 - DNA, 11 bp, Homo sapiens
tgctggagggg

SEQ ID NO: 4584759 - DNA, 15 bp, Homo sapiens
tgctggaggggtggc

SEQ ID NO: 4584760 - DNA, 22 bp, Homo sapiens
tgctggaggggtggcccagagc

SEQ ID NO: 4584761 - DNA, 17 bp, Homo sapiens
tgctggatgacttgaga

SEQ ID NO: 4584762 - DNA, 13 bp, Homo sapiens
tgctggatttgat

SEQ ID NO: 4584763 - DNA, 22 bp, Homo sapiens
tgctggccagcaccctctcctg

SEQ ID NO: 4584764 - DNA, 14 bp, Homo sapiens
tgctggcccaccca

SEQ ID NO: 4584765 - DNA, 16 bp, Homo sapiens
tgctggcgcctctgca

SEQ ID NO: 4584766 - DNA, 12 bp, Homo sapiens
tgctggctcagg

SEQ ID NO: 4584767 - DNA, 13 bp, Homo sapiens
tgctggctcagga

SEQ ID NO: 4584768 - DNA, 13 bp, Homo sapiens
tgctggctcttct

SEQ ID NO: 4584769 - DNA, 23 bp, Homo sapiens
tgctggctgaagaggaccagagg

SEQ ID NO: 4584770 - DNA, 17 bp, Homo sapiens
tgctgggaggagggaga

SEQ ID NO: 4584771 - DNA, 18 bp, Homo sapiens
tgctgggaggagggagag

SEQ ID NO: 4584772 - DNA, 14 bp, Homo sapiens
tgctgggccactgg

SEQ ID NO: 4584773 - DNA, 16 bp, Homo sapiens
tgctgggctctccacc

SEQ ID NO: 4584774 - DNA, 13 bp, Homo sapiens
tgctgggctctgc

SEQ ID NO: 4584775 - DNA, 12 bp, Homo sapiens
tgctgggctggg

SEQ ID NO: 4584776 - DNA, 13 bp, Homo sapiens
tgctgggctgggc

SEQ ID NO: 4584777 - DNA, 20 bp, Homo sapiens
tgctggggacacacattctg

SEQ ID NO: 4584778 - DNA, 22 bp, Homo sapiens
tgctggggacacacattctgcc

SEQ ID NO: 4584779 - DNA, 23 bp, Homo sapiens
tgctggggacacacattctgcct

SEQ ID NO: 4584780 - DNA, 22 bp, Homo sapiens
tgctggggacggggggccccag

SEQ ID NO: 4584781 - DNA, 18 bp, Homo sapiens
tgctgggggtgagctgta

SEQ ID NO: 4584782 - DNA, 22 bp, Homo sapiens
tgctgggtccatatcacacaca

SEQ ID NO: 4584783 - DNA, 19 bp, Homo sapiens
tgctggtagagacccccag

SEQ ID NO: 4584784 - DNA, 16 bp, Homo sapiens
tgctggtcacagcctc

SEQ ID NO: 4584785 - DNA, 20 bp, Homo sapiens
tgctggtcacagcctcctct

SEQ ID NO: 4584786 - DNA, 20 bp, Homo sapiens
tgctggtcagagagacctca

SEQ ID NO: 4584787 - DNA, 19 bp, Homo sapiens
tgctggtggaggaagggct

SEQ ID NO: 4584788 - DNA, 20 bp, Homo sapiens
tgctggtggaggaagggctg

SEQ ID NO: 4584789 - DNA, 21 bp, Homo sapiens
tgctggtggaggaagggctgg

SEQ ID NO: 4584790 - DNA, 22 bp, Homo sapiens
tgctggtggaggaagggctggg

SEQ ID NO: 4584791 - DNA, 23 bp, Homo sapiens
tgctggtggaggaagggctgggc

SEQ ID NO: 4584792 - DNA, 12 bp, Homo sapiens
tgctggtttttc

SEQ ID NO: 4584793 - DNA, 21 bp, Homo sapiens
tgctgtaaaatttgtgtaaat

SEQ ID NO: 4584794 - DNA, 22 bp, Homo sapiens
tgctgtaaaatttgtgtaaatt

SEQ ID NO: 4584795 - DNA, 16 bp, Homo sapiens
tgctgtagacatctgt

SEQ ID NO: 4584796 - DNA, 17 bp, Homo sapiens
tgctgtagcctattttt

SEQ ID NO: 4584797 - DNA, 13 bp, Homo sapiens
tgctgtatttctt

SEQ ID NO: 4584798 - DNA, 15 bp, Homo sapiens
tgctgtattttgata

SEQ ID NO: 4584799 - DNA, 22 bp, Homo sapiens
tgctgtatttttacagctactt

SEQ ID NO: 4584800 - DNA, 15 bp, Homo sapiens
tgctgtcatggtcct

SEQ ID NO: 4584801 - DNA, 23 bp, Homo sapiens
tgctgtcatggtcctttctggaa

SEQ ID NO: 4584802 - DNA, 19 bp, Homo sapiens
tgctgtccagacagcctgt

SEQ ID NO: 4584803 - DNA, 21 bp, Homo sapiens
tgctgtcctgtttctgtcaag

SEQ ID NO: 4584804 - DNA, 14 bp, Homo sapiens
tgctgtccttgaat

SEQ ID NO: 4584805 - DNA, 23 bp, Homo sapiens
tgctgtctgagtagtggccactg

SEQ ID NO: 4584806 - DNA, 16 bp, Homo sapiens
tgctgtctggccctgg

SEQ ID NO: 4584807 - DNA, 17 bp, Homo sapiens
tgctgtctggccctggg

SEQ ID NO: 4584808 - DNA, 21 bp, Homo sapiens
tgctgtcttaaactaaatgtg

SEQ ID NO: 4584809 - DNA, 16 bp, Homo sapiens
tgctgtgaatctgaaa

SEQ ID NO: 4584810 - DNA, 18 bp, Homo sapiens
tgctgtgagggaggggaa

SEQ ID NO: 4584811 - DNA, 23 bp, Homo sapiens
tgctgtgccatgctgggccactg

SEQ ID NO: 4584812 - DNA, 23 bp, Homo sapiens
tgctgtgctctggggatttctgg

SEQ ID NO: 4584813 - DNA, 14 bp, Homo sapiens
tgctgtgggagagc

SEQ ID NO: 4584814 - DNA, 14 bp, Homo sapiens
tgctgtgggcagca

SEQ ID NO: 4584815 - DNA, 19 bp, Homo sapiens
tgctgtgggcagcaccctc

SEQ ID NO: 4584816 - DNA, 21 bp, Homo sapiens
tgctgtgggtgatatggacag

SEQ ID NO: 4584817 - DNA, 16 bp, Homo sapiens
tgctgtggtgtgtccc

SEQ ID NO: 4584818 - DNA, 23 bp, Homo sapiens
tgctgtggtgtgtccccctctgt

SEQ ID NO: 4584819 - DNA, 21 bp, Homo sapiens
tgctgtgtgctttttttgtgt

SEQ ID NO: 4584820 - DNA, 23 bp, Homo sapiens
tgctgttaaaattaatatatcat

SEQ ID NO: 4584821 - DNA, 21 bp, Homo sapiens
tgctgttatgttttttcatgg

SEQ ID NO: 4584822 - DNA, 13 bp, Homo sapiens
tgctgttctcagg

SEQ ID NO: 4584823 - DNA, 19 bp, Homo sapiens
tgctgttgggtttttgctg

SEQ ID NO: 4584824 - DNA, 20 bp, Homo sapiens
tgctgttgggtttttgctgt

SEQ ID NO: 4584825 - DNA, 22 bp, Homo sapiens
tgctgttgggtttttgctgttt

SEQ ID NO: 4584826 - DNA, 15 bp, Homo sapiens
tgctgtttatacttg

SEQ ID NO: 4584827 - DNA, 16 bp, Homo sapiens
tgctgtttatacttga

SEQ ID NO: 4584828 - DNA, 23 bp, Homo sapiens
tgctgtttattaatcttagtgta

SEQ ID NO: 4584829 - DNA, 17 bp, Homo sapiens
tgctgttttctgtaaat

SEQ ID NO: 4584830 - DNA, 15 bp, Homo sapiens
tgcttaaatttcaga

SEQ ID NO: 4584831 - DNA, 13 bp, Homo sapiens
tgcttaaatttct

SEQ ID NO: 4584832 - DNA, 16 bp, Homo sapiens
tgcttaaatttcttat

SEQ ID NO: 4584833 - DNA, 14 bp, Homo sapiens
tgcttaataaacat

SEQ ID NO: 4584834 - DNA, 16 bp, Homo sapiens
tgcttacctaatttca

SEQ ID NO: 4584835 - DNA, 22 bp, Homo sapiens
tgcttactgatatattttacaa

SEQ ID NO: 4584836 - DNA, 13 bp, Homo sapiens
tgcttagcaaaaa

SEQ ID NO: 4584837 - DNA, 14 bp, Homo sapiens
tgcttagtaaaatt

SEQ ID NO: 4584838 - DNA, 13 bp, Homo sapiens
tgcttataacatt

SEQ ID NO: 4584839 - DNA, 20 bp, Homo sapiens
tgcttattcttaacttatta

SEQ ID NO: 4584840 - DNA, 21 bp, Homo sapiens
tgcttattgatgaggtttatt

SEQ ID NO: 4584841 - DNA, 21 bp, Homo sapiens
tgcttattgcttagtaaaatt

SEQ ID NO: 4584842 - DNA, 15 bp, Homo sapiens
tgcttcaatcccagc

SEQ ID NO: 4584843 - DNA, 14 bp, Homo sapiens
tgcttcaatttcaa

SEQ ID NO: 4584844 - DNA, 19 bp, Homo sapiens
tgcttcaatttcaaacttt

SEQ ID NO: 4584845 - DNA, 15 bp, Homo sapiens
tgcttcacaaaatgc

SEQ ID NO: 4584846 - DNA, 14 bp, Homo sapiens
tgcttcacaatgtt

SEQ ID NO: 4584847 - DNA, 20 bp, Homo sapiens
tgcttcatatattgctttat

SEQ ID NO: 4584848 - DNA, 14 bp, Homo sapiens
tgcttcattgaaag

SEQ ID NO: 4584849 - DNA, 16 bp, Homo sapiens
tgcttcattgaaagct

SEQ ID NO: 4584850 - DNA, 15 bp, Homo sapiens
tgcttcattgacctc

SEQ ID NO: 4584851 - DNA, 16 bp, Homo sapiens
tgcttccaggaaactc

SEQ ID NO: 4584852 - DNA, 23 bp, Homo sapiens
tgcttccccgtgcatgatttact

SEQ ID NO: 4584853 - DNA, 18 bp, Homo sapiens
tgcttcctcctcaggccc

SEQ ID NO: 4584854 - DNA, 23 bp, Homo sapiens
tgcttcctgattaccagtctgat

SEQ ID NO: 4584855 - DNA, 19 bp, Homo sapiens
tgcttcctgtgtaacatct

SEQ ID NO: 4584856 - DNA, 23 bp, Homo sapiens
tgcttcctgtgtaacatctgcca

SEQ ID NO: 4584857 - DNA, 23 bp, Homo sapiens
tgcttctaaatgcccagttcact

SEQ ID NO: 4584858 - DNA, 23 bp, Homo sapiens
tgcttctactttcatcttaaact

SEQ ID NO: 4584859 - DNA, 15 bp, Homo sapiens
tgcttctcacttttt

SEQ ID NO: 4584860 - DNA, 15 bp, Homo sapiens
tgcttctcaggctat

SEQ ID NO: 4584861 - DNA, 17 bp, Homo sapiens
tgcttctcatcttgtga

SEQ ID NO: 4584862 - DNA, 18 bp, Homo sapiens
tgcttctcatcttgtgaa

SEQ ID NO: 4584863 - DNA, 24 bp, Homo sapiens
tgcttctccaaaaatctgcctggg

SEQ ID NO: 4584864 - DNA, 13 bp, Homo sapiens
tgcttctccaaca

SEQ ID NO: 4584865 - DNA, 17 bp, Homo sapiens
tgcttctccaacactga

SEQ ID NO: 4584866 - DNA, 14 bp, Homo sapiens
tgcttctctccttg

SEQ ID NO: 4584867 - DNA, 15 bp, Homo sapiens
tgcttctctccttgc

SEQ ID NO: 4584868 - DNA, 18 bp, Homo sapiens
tgcttctgcagcaactcc

SEQ ID NO: 4584869 - DNA, 17 bp, Homo sapiens
tgcttgaacacagtatt

SEQ ID NO: 4584870 - DNA, 20 bp, Homo sapiens
tgcttgacatacctaccagt

SEQ ID NO: 4584871 - DNA, 15 bp, Homo sapiens
tgcttgagctcagga

SEQ ID NO: 4584872 - DNA, 13 bp, Homo sapiens
tgcttgaggaaaa

SEQ ID NO: 4584873 - DNA, 19 bp, Homo sapiens
tgcttgatctatctacaaa

SEQ ID NO: 4584874 - DNA, 22 bp, Homo sapiens
tgcttgcaatctaatctgaact

SEQ ID NO: 4584875 - DNA, 15 bp, Homo sapiens
tgcttgcccgctccc

SEQ ID NO: 4584876 - DNA, 18 bp, Homo sapiens
tgcttgggaccagaagtg

SEQ ID NO: 4584877 - DNA, 16 bp, Homo sapiens
tgcttgtcctgggcct

SEQ ID NO: 4584878 - DNA, 20 bp, Homo sapiens
tgctttaatgagaatagaaa

SEQ ID NO: 4584879 - DNA, 20 bp, Homo sapiens
tgctttatcctcctgtcagc

SEQ ID NO: 4584880 - DNA, 15 bp, Homo sapiens
tgctttattccagaa

SEQ ID NO: 4584881 - DNA, 14 bp, Homo sapiens
tgctttccagctca

SEQ ID NO: 4584882 - DNA, 21 bp, Homo sapiens
tgctttcctaaagtctctgct

SEQ ID NO: 4584883 - DNA, 15 bp, Homo sapiens
tgctttccttcatct

SEQ ID NO: 4584884 - DNA, 21 bp, Homo sapiens
tgctttctatgctgtttgtag

SEQ ID NO: 4584885 - DNA, 12 bp, Homo sapiens
tgctttctattg

SEQ ID NO: 4584886 - DNA, 15 bp, Homo sapiens
tgctttctcctttaa

SEQ ID NO: 4584887 - DNA, 16 bp, Homo sapiens
tgctttctgttccaaa

SEQ ID NO: 4584888 - DNA, 22 bp, Homo sapiens
tgctttctgttccaaattcagt

SEQ ID NO: 4584889 - DNA, 11 bp, Homo sapiens
tgctttcttac

SEQ ID NO: 4584890 - DNA, 14 bp, Homo sapiens
tgctttcttaccta

SEQ ID NO: 4584891 - DNA, 13 bp, Homo sapiens
tgctttcttgtct

SEQ ID NO: 4584892 - DNA, 18 bp, Homo sapiens
tgctttgaaaaagcctct

SEQ ID NO: 4584893 - DNA, 12 bp, Homo sapiens
tgctttgaaaat

SEQ ID NO: 4584894 - DNA, 18 bp, Homo sapiens
tgctttgaactttagttt

SEQ ID NO: 4584895 - DNA, 18 bp, Homo sapiens
tgctttgagtccacgccc

SEQ ID NO: 4584896 - DNA, 20 bp, Homo sapiens
tgctttgccaaaataccaga

SEQ ID NO: 4584897 - DNA, 17 bp, Homo sapiens
tgctttgcccacatgcc

SEQ ID NO: 4584898 - DNA, 21 bp, Homo sapiens
tgctttgtagtttgctttgct

SEQ ID NO: 4584899 - DNA, 20 bp, Homo sapiens
tgcttttaaaagtgcacatt

SEQ ID NO: 4584900 - DNA, 16 bp, Homo sapiens
tgcttttaactctaga

SEQ ID NO: 4584901 - DNA, 14 bp, Homo sapiens
tgcttttatattct

SEQ ID NO: 4584902 - DNA, 21 bp, Homo sapiens
tgcttttccctttgtgagtca

SEQ ID NO: 4584903 - DNA, 15 bp, Homo sapiens
tgcttttctgccctg

SEQ ID NO: 4584904 - DNA, 15 bp, Homo sapiens
tgctttttatttctg

SEQ ID NO: 4584905 - DNA, 14 bp, Homo sapiens
tgctttttccaact

SEQ ID NO: 4584906 - DNA, 14 bp, Homo sapiens
tgctttttggaaag

SEQ ID NO: 4584907 - DNA, 17 bp, Homo sapiens
tgctttttttgtgtgta

SEQ ID NO: 4584908 - DNA, 17 bp, Homo sapiens
tggaaaaaaatacaaaa

SEQ ID NO: 4584909 - DNA, 19 bp, Homo sapiens
tggaaaaaaatacaaaaag

SEQ ID NO: 4584910 - DNA, 15 bp, Homo sapiens
tggaaaaaatatttt

SEQ ID NO: 4584911 - DNA, 16 bp, Homo sapiens
tggaaaaaatatttta

SEQ ID NO: 4584912 - DNA, 23 bp, Homo sapiens
tggaaaaacatctgaaagccacg

SEQ ID NO: 4584913 - DNA, 12 bp, Homo sapiens
tggaaaaataaa

SEQ ID NO: 4584914 - DNA, 17 bp, Homo sapiens
tggaaaaataacaacta

SEQ ID NO: 4584915 - DNA, 15 bp, Homo sapiens
tggaaaaatatttca

SEQ ID NO: 4584916 - DNA, 13 bp, Homo sapiens
tggaaaaatcaca

SEQ ID NO: 4584917 - DNA, 15 bp, Homo sapiens
tggaaaaatgcccat

SEQ ID NO: 4584918 - DNA, 21 bp, Homo sapiens
tggaaactatgtgtttttctc

SEQ ID NO: 4584919 - DNA, 23 bp, Homo sapiens
tggaaactcaaggaaaagttctt

SEQ ID NO: 4584920 - DNA, 15 bp, Homo sapiens
tggaaactgctcaga

SEQ ID NO: 4584921 - DNA, 17 bp, Homo sapiens
tggaaagaggctctgga

SEQ ID NO: 4584922 - DNA, 23 bp, Homo sapiens
tggaaagagtgccagtcagcagt

SEQ ID NO: 4584923 - DNA, 12 bp, Homo sapiens
tggaaagcaggt

SEQ ID NO: 4584924 - DNA, 21 bp, Homo sapiens
tggaaagcttttcagtgttcc

SEQ ID NO: 4584925 - DNA, 14 bp, Homo sapiens
tggaaagggagaca

SEQ ID NO: 4584926 - DNA, 19 bp, Homo sapiens
tggaaaggggagagcctgc

SEQ ID NO: 4584927 - DNA, 22 bp, Homo sapiens
tggaaaggtgtgagactgggaa

SEQ ID NO: 4584928 - DNA, 19 bp, Homo sapiens
tggaaagtacactctgctg

SEQ ID NO: 4584929 - DNA, 12 bp, Homo sapiens
tggaaagtcaga

SEQ ID NO: 4584930 - DNA, 21 bp, Homo sapiens
tggaaatattaagaacatttt

SEQ ID NO: 4584931 - DNA, 18 bp, Homo sapiens
tggaaatcagtagaaagc

SEQ ID NO: 4584932 - DNA, 20 bp, Homo sapiens
tggaaatcagtagaaagcta

SEQ ID NO: 4584933 - DNA, 17 bp, Homo sapiens
tggaaatcctgccctgg

SEQ ID NO: 4584934 - DNA, 11 bp, Homo sapiens
tggaaatgtag

SEQ ID NO: 4584935 - DNA, 21 bp, Homo sapiens
tggaaattttatatgtaaatg

SEQ ID NO: 4584936 - DNA, 20 bp, Homo sapiens
tggaacaaagtgaaggacat

SEQ ID NO: 4584937 - DNA, 14 bp, Homo sapiens
tggaacacaggggc

SEQ ID NO: 4584938 - DNA, 12 bp, Homo sapiens
tggaacagattt

SEQ ID NO: 4584939 - DNA, 20 bp, Homo sapiens
tggaacataaaaaggacatc

SEQ ID NO: 4584940 - DNA, 15 bp, Homo sapiens
tggaacataaagttg

SEQ ID NO: 4584941 - DNA, 15 bp, Homo sapiens
tggaaccagccccat

SEQ ID NO: 4584942 - DNA, 23 bp, Homo sapiens
tggaaccagccccatcagaacct

SEQ ID NO: 4584943 - DNA, 19 bp, Homo sapiens
tggaacctgcaaaaaatac

SEQ ID NO: 4584944 - DNA, 13 bp, Homo sapiens
tggaaccttccct

SEQ ID NO: 4584945 - DNA, 14 bp, Homo sapiens
tggaaccttccctc

SEQ ID NO: 4584946 - DNA, 14 bp, Homo sapiens
tggaaccttctaga

SEQ ID NO: 4584947 - DNA, 23 bp, Homo sapiens
tggaaccttctagaacacctgcc

SEQ ID NO: 4584948 - DNA, 21 bp, Homo sapiens
tggaacgtttttcctgttctt

SEQ ID NO: 4584949 - DNA, 20 bp, Homo sapiens
tggaactatacccgggacca

SEQ ID NO: 4584950 - DNA, 14 bp, Homo sapiens
tggaactctcgagc

SEQ ID NO: 4584951 - DNA, 21 bp, Homo sapiens
tggaactgcgttatgaagagc

SEQ ID NO: 4584952 - DNA, 16 bp, Homo sapiens
tggaactgtcccagct

SEQ ID NO: 4584953 - DNA, 14 bp, Homo sapiens
tggaactgtgtatt

SEQ ID NO: 4584954 - DNA, 15 bp, Homo sapiens
tggaactgtgtttca

SEQ ID NO: 4584955 - DNA, 16 bp, Homo sapiens
tggaactgtgtttcaa

SEQ ID NO: 4584956 - DNA, 13 bp, Homo sapiens
tggaactgtttcc

SEQ ID NO: 4584957 - DNA, 15 bp, Homo sapiens
tggaactgtttcctt

SEQ ID NO: 4584958 - DNA, 21 bp, Homo sapiens
tggaactttttagattattcc

SEQ ID NO: 4584959 - DNA, 13 bp, Homo sapiens
tggaagaaagtaa

SEQ ID NO: 4584960 - DNA, 22 bp, Homo sapiens
tggaagaaatggctatgaacag

SEQ ID NO: 4584961 - DNA, 13 bp, Homo sapiens
tggaagaagggag

SEQ ID NO: 4584962 - DNA, 17 bp, Homo sapiens
tggaagaagggagaaga

SEQ ID NO: 4584963 - DNA, 21 bp, Homo sapiens
tggaagaagggagaagaaagg

SEQ ID NO: 4584964 - DNA, 22 bp, Homo sapiens
tggaagaataaaattgcctctc

SEQ ID NO: 4584965 - DNA, 12 bp, Homo sapiens
tggaagacgtgg

SEQ ID NO: 4584966 - DNA, 14 bp, Homo sapiens
tggaagagagaaag

SEQ ID NO: 4584967 - DNA, 16 bp, Homo sapiens
tggaagagagaaagca

SEQ ID NO: 4584968 - DNA, 19 bp, Homo sapiens
tggaagagagaaagcatat

SEQ ID NO: 4584969 - DNA, 23 bp, Homo sapiens
tggaagagagaaagcatattgac

SEQ ID NO: 4584970 - DNA, 17 bp, Homo sapiens
tggaagcagaggccctg

SEQ ID NO: 4584971 - DNA, 18 bp, Homo sapiens
tggaagcagaggccctgc

SEQ ID NO: 4584972 - DNA, 22 bp, Homo sapiens
tggaagcatgtaggagaatcca

SEQ ID NO: 4584973 - DNA, 23 bp, Homo sapiens
tggaagcatgtttattctgttcc

SEQ ID NO: 4584974 - DNA, 15 bp, Homo sapiens
tggaagccagctttc

SEQ ID NO: 4584975 - DNA, 16 bp, Homo sapiens
tggaagccagctttcc

SEQ ID NO: 4584976 - DNA, 20 bp, Homo sapiens
tggaagcccctgggcccagt

SEQ ID NO: 4584977 - DNA, 12 bp, Homo sapiens
tggaagccctcc

SEQ ID NO: 4584978 - DNA, 13 bp, Homo sapiens
tggaagccctcct

SEQ ID NO: 4584979 - DNA, 18 bp, Homo sapiens
tggaagctaatttgcatt

SEQ ID NO: 4584980 - DNA, 20 bp, Homo sapiens
tggaagctagacacatgaag

SEQ ID NO: 4584981 - DNA, 18 bp, Homo sapiens
tggaagctgctgaggccc

SEQ ID NO: 4584982 - DNA, 17 bp, Homo sapiens
tggaagctgtttggaaa

SEQ ID NO: 4584983 - DNA, 19 bp, Homo sapiens
tggaagctgtttggaaaag

SEQ ID NO: 4584984 - DNA, 23 bp, Homo sapiens
tggaaggaacatggagctgtcat

SEQ ID NO: 4584985 - DNA, 17 bp, Homo sapiens
tggaaggacacagtgat

SEQ ID NO: 4584986 - DNA, 16 bp, Homo sapiens
tggaaggcagagaaat

SEQ ID NO: 4584987 - DNA, 20 bp, Homo sapiens
tggaaggcagagaaatctaa

SEQ ID NO: 4584988 - DNA, 16 bp, Homo sapiens
tggaaggctgaggcag

SEQ ID NO: 4584989 - DNA, 15 bp, Homo sapiens
tggaagggtttgtgg

SEQ ID NO: 4584990 - DNA, 20 bp, Homo sapiens
tggaaggtggaagttgcagt

SEQ ID NO: 4584991 - DNA, 20 bp, Homo sapiens
tggaagtaattaaggtacat

SEQ ID NO: 4584992 - DNA, 22 bp, Homo sapiens
tggaagtaattaaggtacatca

SEQ ID NO: 4584993 - DNA, 22 bp, Homo sapiens
tggaagtgtatttattttacag

SEQ ID NO: 4584994 - DNA, 23 bp, Homo sapiens
tggaagtgtgggtctgtgtgtgt

SEQ ID NO: 4584995 - DNA, 19 bp, Homo sapiens
tggaagtgtgtgccaagag

SEQ ID NO: 4584996 - DNA, 18 bp, Homo sapiens
tggaatactttttgttat

SEQ ID NO: 4584997 - DNA, 14 bp, Homo sapiens
tggaatataattgt

SEQ ID NO: 4584998 - DNA, 15 bp, Homo sapiens
tggaatatcatctgt

SEQ ID NO: 4584999 - DNA, 15 bp, Homo sapiens
tggaatattgtccat

SEQ ID NO: 4585000 - DNA, 20 bp, Homo sapiens
tggaatattgtccattgtcc

SEQ ID NO: 4585001 - DNA, 12 bp, Homo sapiens
tggaatctggag

SEQ ID NO: 4585002 - DNA, 20 bp, Homo sapiens
tggaatgatgggtcagttgt

SEQ ID NO: 4585003 - DNA, 15 bp, Homo sapiens
tggaatgtgagtgtg

SEQ ID NO: 4585004 - DNA, 15 bp, Homo sapiens
tggaatgttggataa

SEQ ID NO: 4585005 - DNA, 17 bp, Homo sapiens
tggaatgtttttccctc

SEQ ID NO: 4585006 - DNA, 23 bp, Homo sapiens
tggaatgtttttccctccccaga

SEQ ID NO: 4585007 - DNA, 21 bp, Homo sapiens
tggaattaaaaggatagtatt

SEQ ID NO: 4585008 - DNA, 12 bp, Homo sapiens
tggaattgattt

SEQ ID NO: 4585009 - DNA, 18 bp, Homo sapiens
tggaattgatttgcattg

SEQ ID NO: 4585010 - DNA, 20 bp, Homo sapiens
tggaattgatttgcattgaa

SEQ ID NO: 4585011 - DNA, 23 bp, Homo sapiens
tggaattgatttgcattgaacac

SEQ ID NO: 4585012 - DNA, 16 bp, Homo sapiens
tggaatttgcctgctg

SEQ ID NO: 4585013 - DNA, 22 bp, Homo sapiens
tggaattttgcaaagatttaat

SEQ ID NO: 4585014 - DNA, 23 bp, Homo sapiens
tggacaaagaattccaaagcaaa

SEQ ID NO: 4585015 - DNA, 15 bp, Homo sapiens
tggacaaatcacata

SEQ ID NO: 4585016 - DNA, 22 bp, Homo sapiens
tggacaaatcacatattttaaa

SEQ ID NO: 4585017 - DNA, 23 bp, Homo sapiens
tggacaaatcacatattttaaaa

SEQ ID NO: 4585018 - DNA, 22 bp, Homo sapiens
tggacaaggagctgtgttcacc

SEQ ID NO: 4585019 - DNA, 23 bp, Homo sapiens
tggacacaataggtctttctctc

SEQ ID NO: 4585020 - DNA, 16 bp, Homo sapiens
tggacacacacagact

SEQ ID NO: 4585021 - DNA, 20 bp, Homo sapiens
tggacacacacagactattt

SEQ ID NO: 4585022 - DNA, 20 bp, Homo sapiens
tggacacattggaatgcctt

SEQ ID NO: 4585023 - DNA, 21 bp, Homo sapiens
tggacacattggaatgccttg

SEQ ID NO: 4585024 - DNA, 14 bp, Homo sapiens
tggacacgagccac

SEQ ID NO: 4585025 - DNA, 17 bp, Homo sapiens
tggacacgagccacaag

SEQ ID NO: 4585026 - DNA, 24 bp, Homo sapiens
tggacagacagatgttgggaggat

SEQ ID NO: 4585027 - DNA, 14 bp, Homo sapiens
tggacagcagaagc

SEQ ID NO: 4585028 - DNA, 15 bp, Homo sapiens
tggacagcagaagcc

SEQ ID NO: 4585029 - DNA, 12 bp, Homo sapiens
tggacagcatca

SEQ ID NO: 4585030 - DNA, 18 bp, Homo sapiens
tggacagcatcagaaatc

SEQ ID NO: 4585031 - DNA, 20 bp, Homo sapiens
tggacagcatcagaaatcct

SEQ ID NO: 4585032 - DNA, 14 bp, Homo sapiens
tggacagccagtga

SEQ ID NO: 4585033 - DNA, 18 bp, Homo sapiens
tggacagccagtgacctt

SEQ ID NO: 4585034 - DNA, 20 bp, Homo sapiens
tggacagctgataaatttaa

SEQ ID NO: 4585035 - DNA, 23 bp, Homo sapiens
tggacaggatgaggacagagggc

SEQ ID NO: 4585036 - DNA, 18 bp, Homo sapiens
tggacaggcgggctcgga

SEQ ID NO: 4585037 - DNA, 14 bp, Homo sapiens
tggacagtctgagc

SEQ ID NO: 4585038 - DNA, 20 bp, Homo sapiens
tggacatcaccagtcctagc

SEQ ID NO: 4585039 - DNA, 18 bp, Homo sapiens
tggacatgaagattcttt

SEQ ID NO: 4585040 - DNA, 23 bp, Homo sapiens
tggaccaccgttcagtcattttg

SEQ ID NO: 4585041 - DNA, 14 bp, Homo sapiens
tggaccaggacagg

SEQ ID NO: 4585042 - DNA, 15 bp, Homo sapiens
tggaccaggcccata

SEQ ID NO: 4585043 - DNA, 22 bp, Homo sapiens
tggaccatgccagattctgcct

SEQ ID NO: 4585044 - DNA, 15 bp, Homo sapiens
tggacccagggcctg

SEQ ID NO: 4585045 - DNA, 18 bp, Homo sapiens
tggacccagggcctgact

SEQ ID NO: 4585046 - DNA, 19 bp, Homo sapiens
tggacccagggcctgactt

SEQ ID NO: 4585047 - DNA, 18 bp, Homo sapiens
tggaccgcaggagggcag

SEQ ID NO: 4585048 - DNA, 14 bp, Homo sapiens
tggacctaatccaa

SEQ ID NO: 4585049 - DNA, 22 bp, Homo sapiens
tggacctaatccaagcatccct

SEQ ID NO: 4585050 - DNA, 22 bp, Homo sapiens
tggacctgcatatttagctgtt

SEQ ID NO: 4585051 - DNA, 16 bp, Homo sapiens
tggacctggggagtgg

SEQ ID NO: 4585052 - DNA, 18 bp, Homo sapiens
tggacctggtgcccctgc

SEQ ID NO: 4585053 - DNA, 23 bp, Homo sapiens
tggacgcattttggtttttcctc

SEQ ID NO: 4585054 - DNA, 12 bp, Homo sapiens
tggacgctgcag

SEQ ID NO: 4585055 - DNA, 16 bp, Homo sapiens
tggacgctgcagaccc

SEQ ID NO: 4585056 - DNA, 21 bp, Homo sapiens
tggacggattccttggcagcc

SEQ ID NO: 4585057 - DNA, 13 bp, Homo sapiens
tggacggcaggct

SEQ ID NO: 4585058 - DNA, 20 bp, Homo sapiens
tggacggcaggctcactgcc

SEQ ID NO: 4585059 - DNA, 13 bp, Homo sapiens
tggactacacaat

SEQ ID NO: 4585060 - DNA, 19 bp, Homo sapiens
tggactacacaatacagta

SEQ ID NO: 4585061 - DNA, 12 bp, Homo sapiens
tggactcagaaa

SEQ ID NO: 4585062 - DNA, 15 bp, Homo sapiens
tggactctcagtctc

SEQ ID NO: 4585063 - DNA, 14 bp, Homo sapiens
tggactctctgtgg

SEQ ID NO: 4585064 - DNA, 16 bp, Homo sapiens
tggactctctgtggtc

SEQ ID NO: 4585065 - DNA, 18 bp, Homo sapiens
tggactctctgtggtccc

SEQ ID NO: 4585066 - DNA, 16 bp, Homo sapiens
tggactgaccctgcag

SEQ ID NO: 4585067 - DNA, 23 bp, Homo sapiens
tggactgagccaaggaggcctgg

SEQ ID NO: 4585068 - DNA, 11 bp, Homo sapiens
tggactgaggc

SEQ ID NO: 4585069 - DNA, 15 bp, Homo sapiens
tggactgaggcctga

SEQ ID NO: 4585070 - DNA, 20 bp, Homo sapiens
tggactgagggggcctggat

SEQ ID NO: 4585071 - DNA, 16 bp, Homo sapiens
tggactgcgctggacg

SEQ ID NO: 4585072 - DNA, 22 bp, Homo sapiens
tggactggctagagtcctcact

SEQ ID NO: 4585073 - DNA, 21 bp, Homo sapiens
tggactgtcacggggttccct

SEQ ID NO: 4585074 - DNA, 15 bp, Homo sapiens
tggacttctgggaga

SEQ ID NO: 4585075 - DNA, 18 bp, Homo sapiens
tggagaaagccacgccct

SEQ ID NO: 4585076 - DNA, 20 bp, Homo sapiens
tggagaaagccacgccctcc

SEQ ID NO: 4585077 - DNA, 15 bp, Homo sapiens
tggagaaagctcatg

SEQ ID NO: 4585078 - DNA, 23 bp, Homo sapiens
tggagaaccagggctcttctcag

SEQ ID NO: 4585079 - DNA, 22 bp, Homo sapiens
tggagaattgctgaagggcatt

SEQ ID NO: 4585080 - DNA, 14 bp, Homo sapiens
tggagacaaggtgc

SEQ ID NO: 4585081 - DNA, 17 bp, Homo sapiens
tggagacaaggtgctaa

SEQ ID NO: 4585082 - DNA, 18 bp, Homo sapiens
tggagacaaggtgctaac

SEQ ID NO: 4585083 - DNA, 23 bp, Homo sapiens
tggagacactcctataaggagag

SEQ ID NO: 4585084 - DNA, 23 bp, Homo sapiens
tggagaccctgccacagccagag

SEQ ID NO: 4585085 - DNA, 19 bp, Homo sapiens
tggagacctctccttccta

SEQ ID NO: 4585086 - DNA, 17 bp, Homo sapiens
tggagagaatgtgtgtg

SEQ ID NO: 4585087 - DNA, 19 bp, Homo sapiens
tggagagccagaacctgga

SEQ ID NO: 4585088 - DNA, 20 bp, Homo sapiens
tggagagccagaacctggag

SEQ ID NO: 4585089 - DNA, 14 bp, Homo sapiens
tggagagctggtgc

SEQ ID NO: 4585090 - DNA, 19 bp, Homo sapiens
tggagagctggtgcccgga

SEQ ID NO: 4585091 - DNA, 18 bp, Homo sapiens
tggagaggacagagcagg

SEQ ID NO: 4585092 - DNA, 13 bp, Homo sapiens
tggagaggcggcc

SEQ ID NO: 4585093 - DNA, 14 bp, Homo sapiens
tggagagggcccag

SEQ ID NO: 4585094 - DNA, 13 bp, Homo sapiens
tggagagtgcaca

SEQ ID NO: 4585095 - DNA, 20 bp, Homo sapiens
tggagatagtgccaggtggc

SEQ ID NO: 4585096 - DNA, 23 bp, Homo sapiens
tggagatatttatggggggagaa

SEQ ID NO: 4585097 - DNA, 22 bp, Homo sapiens
tggagatgcatcgggaaagaag

SEQ ID NO: 4585098 - DNA, 16 bp, Homo sapiens
tggagattctgattca

SEQ ID NO: 4585099 - DNA, 15 bp, Homo sapiens
tggagcagaatcagt

SEQ ID NO: 4585100 - DNA, 17 bp, Homo sapiens
tggagcagaggggctga

SEQ ID NO: 4585101 - DNA, 18 bp, Homo sapiens
tggagcaggagccccgcc

SEQ ID NO: 4585102 - DNA, 17 bp, Homo sapiens
tggagcatcaagccact

SEQ ID NO: 4585103 - DNA, 20 bp, Homo sapiens
tggagcccagaggagggcag

SEQ ID NO: 4585104 - DNA, 19 bp, Homo sapiens
tggagcccagcgtcagaag

SEQ ID NO: 4585105 - DNA, 21 bp, Homo sapiens
tggagcccagcgtcagaagtc

SEQ ID NO: 4585106 - DNA, 14 bp, Homo sapiens
tggagccccacact

SEQ ID NO: 4585107 - DNA, 22 bp, Homo sapiens
tggagccccagccccctttggg

SEQ ID NO: 4585108 - DNA, 21 bp, Homo sapiens
tggagcccccagcagaggcag

SEQ ID NO: 4585109 - DNA, 23 bp, Homo sapiens
tggagctcctccctccagctgcg

SEQ ID NO: 4585110 - DNA, 16 bp, Homo sapiens
tggagctgactgttct

SEQ ID NO: 4585111 - DNA, 18 bp, Homo sapiens
tggagctgggagacaaag

SEQ ID NO: 4585112 - DNA, 16 bp, Homo sapiens
tggagctgtcacctct

SEQ ID NO: 4585113 - DNA, 20 bp, Homo sapiens
tggagctgtcacctctcagc

SEQ ID NO: 4585114 - DNA, 23 bp, Homo sapiens
tggagctgtcacctctcagctgc

SEQ ID NO: 4585115 - DNA, 12 bp, Homo sapiens
tggagctgtcat

SEQ ID NO: 4585116 - DNA, 21 bp, Homo sapiens
tggagctgtcatcactcaaca

SEQ ID NO: 4585117 - DNA, 21 bp, Homo sapiens
tggagcttcatggcagaaggc

SEQ ID NO: 4585118 - DNA, 13 bp, Homo sapiens
tggaggaaagcaa

SEQ ID NO: 4585119 - DNA, 22 bp, Homo sapiens
tggaggaagaacaacaaagaca

SEQ ID NO: 4585120 - DNA, 13 bp, Homo sapiens
tggaggaagagcc

SEQ ID NO: 4585121 - DNA, 16 bp, Homo sapiens
tggaggaagagccacc

SEQ ID NO: 4585122 - DNA, 19 bp, Homo sapiens
tggaggaagatagcgcata

SEQ ID NO: 4585123 - DNA, 20 bp, Homo sapiens
tggaggactagaacctggag

SEQ ID NO: 4585124 - DNA, 21 bp, Homo sapiens
tggaggagaagaattttcaga

SEQ ID NO: 4585125 - DNA, 13 bp, Homo sapiens
tggaggaggaagg

SEQ ID NO: 4585126 - DNA, 12 bp, Homo sapiens
tggaggaggcct

SEQ ID NO: 4585127 - DNA, 18 bp, Homo sapiens
tggaggaggcctgtccca

SEQ ID NO: 4585128 - DNA, 19 bp, Homo sapiens
tggaggaggcctgtcccaa

SEQ ID NO: 4585129 - DNA, 18 bp, Homo sapiens
tggaggatggtgtcctga

SEQ ID NO: 4585130 - DNA, 21 bp, Homo sapiens
tggaggatggtgtcctgaggc

SEQ ID NO: 4585131 - DNA, 19 bp, Homo sapiens
tggaggattctttccccag

SEQ ID NO: 4585132 - DNA, 22 bp, Homo sapiens
tggaggattctttccccagagg

SEQ ID NO: 4585133 - DNA, 22 bp, Homo sapiens
tggaggcagggccttgcccaga

SEQ ID NO: 4585134 - DNA, 22 bp, Homo sapiens
tggaggccattgtgtgagccta

SEQ ID NO: 4585135 - DNA, 21 bp, Homo sapiens
tggaggctgccccattgagat

SEQ ID NO: 4585136 - DNA, 16 bp, Homo sapiens
tggaggctgcctccca

SEQ ID NO: 4585137 - DNA, 17 bp, Homo sapiens
tggaggctgcctcccaa

SEQ ID NO: 4585138 - DNA, 20 bp, Homo sapiens
tggaggctgcctcccaacag

SEQ ID NO: 4585139 - DNA, 13 bp, Homo sapiens
tggaggcttcctg

SEQ ID NO: 4585140 - DNA, 15 bp, Homo sapiens
tggaggcttcctgcg

SEQ ID NO: 4585141 - DNA, 22 bp, Homo sapiens
tggaggcttcctgcgtcctcct

SEQ ID NO: 4585142 - DNA, 20 bp, Homo sapiens
tggagggaaggacagtccct

SEQ ID NO: 4585143 - DNA, 19 bp, Homo sapiens
tggagggaatgaacctgga

SEQ ID NO: 4585144 - DNA, 20 bp, Homo sapiens
tggagggaatgaacctggag

SEQ ID NO: 4585145 - DNA, 17 bp, Homo sapiens
tggagggagggaagggt

SEQ ID NO: 4585146 - DNA, 19 bp, Homo sapiens
tggagggatcagttgcccc

SEQ ID NO: 4585147 - DNA, 21 bp, Homo sapiens
tggagggctagaacctggagg

SEQ ID NO: 4585148 - DNA, 21 bp, Homo sapiens
tggagggctggaatctggaga

SEQ ID NO: 4585149 - DNA, 15 bp, Homo sapiens
tggagggcttggccc

SEQ ID NO: 4585150 - DNA, 18 bp, Homo sapiens
tggaggggcttgggcctg

SEQ ID NO: 4585151 - DNA, 17 bp, Homo sapiens
tggagggggctggggtc

SEQ ID NO: 4585152 - DNA, 13 bp, Homo sapiens
tggaggggtggcc

SEQ ID NO: 4585153 - DNA, 14 bp, Homo sapiens
tggaggggtggccc

SEQ ID NO: 4585154 - DNA, 17 bp, Homo sapiens
tggaggggtggcccaga

SEQ ID NO: 4585155 - DNA, 19 bp, Homo sapiens
tggaggggtggcccagagc

SEQ ID NO: 4585156 - DNA, 21 bp, Homo sapiens
tggaggggtggcccagagcca

SEQ ID NO: 4585157 - DNA, 19 bp, Homo sapiens
tggaggggtgtggcagtgg

SEQ ID NO: 4585158 - DNA, 22 bp, Homo sapiens
tggaggtagttgggtagaaaaa

SEQ ID NO: 4585159 - DNA, 20 bp, Homo sapiens
tggaggtcagcatttgatct

SEQ ID NO: 4585160 - DNA, 13 bp, Homo sapiens
tggaggtgggcaa

SEQ ID NO: 4585161 - DNA, 17 bp, Homo sapiens
tggaggtggggaaggct

SEQ ID NO: 4585162 - DNA, 18 bp, Homo sapiens
tggaggtgtcaggctgct

SEQ ID NO: 4585163 - DNA, 22 bp, Homo sapiens
tggaggtgtcaggctgctggcg

SEQ ID NO: 4585164 - DNA, 17 bp, Homo sapiens
tggaggttgaagccaag

SEQ ID NO: 4585165 - DNA, 15 bp, Homo sapiens
tggagtcttgtgaaa

SEQ ID NO: 4585166 - DNA, 16 bp, Homo sapiens
tggagtcttgtgccaa

SEQ ID NO: 4585167 - DNA, 15 bp, Homo sapiens
tggagtgtgagccac

SEQ ID NO: 4585168 - DNA, 18 bp, Homo sapiens
tggagtgttatgtatttc

SEQ ID NO: 4585169 - DNA, 21 bp, Homo sapiens
tggagtttcatgtacaagatg

SEQ ID NO: 4585170 - DNA, 19 bp, Homo sapiens
tggagtttctctagaagct

SEQ ID NO: 4585171 - DNA, 13 bp, Homo sapiens
tggagtttctctg

SEQ ID NO: 4585172 - DNA, 15 bp, Homo sapiens
tggagtttgggctgg

SEQ ID NO: 4585173 - DNA, 18 bp, Homo sapiens
tggagtttgggctggagc

SEQ ID NO: 4585174 - DNA, 24 bp, Homo sapiens
tggagtttgggctggagctcctcc

SEQ ID NO: 4585175 - DNA, 16 bp, Homo sapiens
tggatacataaagact

SEQ ID NO: 4585176 - DNA, 17 bp, Homo sapiens
tggatacataaagacta

SEQ ID NO: 4585177 - DNA, 17 bp, Homo sapiens
tggatacgtgtcaatgt

SEQ ID NO: 4585178 - DNA, 21 bp, Homo sapiens
tggatacgtgtcaatgtgtgc

SEQ ID NO: 4585179 - DNA, 15 bp, Homo sapiens
tggatacttggattt

SEQ ID NO: 4585180 - DNA, 16 bp, Homo sapiens
tggataggagcctgct

SEQ ID NO: 4585181 - DNA, 13 bp, Homo sapiens
tggatatatttga

SEQ ID NO: 4585182 - DNA, 11 bp, Homo sapiens
tggatatttgt

SEQ ID NO: 4585183 - DNA, 14 bp, Homo sapiens
tggatccagcactg

SEQ ID NO: 4585184 - DNA, 14 bp, Homo sapiens
tggatcctgctgct

SEQ ID NO: 4585185 - DNA, 19 bp, Homo sapiens
tggatctattgatttgaaa

SEQ ID NO: 4585186 - DNA, 20 bp, Homo sapiens
tggatctattgatttgaaaa

SEQ ID NO: 4585187 - DNA, 20 bp, Homo sapiens
tggatctgggaccctttcct

SEQ ID NO: 4585188 - DNA, 15 bp, Homo sapiens
tggatctgtgagggg

SEQ ID NO: 4585189 - DNA, 22 bp, Homo sapiens
tggatcttcagaactgcccttg

SEQ ID NO: 4585190 - DNA, 23 bp, Homo sapiens
tggatcttcagaactgcccttgc

SEQ ID NO: 4585191 - DNA, 18 bp, Homo sapiens
tggatgattaaattttag

SEQ ID NO: 4585192 - DNA, 13 bp, Homo sapiens
tggatgattcttt

SEQ ID NO: 4585193 - DNA, 20 bp, Homo sapiens
tggatgcaaagtacaatgtg

SEQ ID NO: 4585194 - DNA, 18 bp, Homo sapiens
tggatgcatttcaaatgt

SEQ ID NO: 4585195 - DNA, 20 bp, Homo sapiens
tggatgcatttcaaatgtta

SEQ ID NO: 4585196 - DNA, 20 bp, Homo sapiens
tggatgccaatattaaatct

SEQ ID NO: 4585197 - DNA, 15 bp, Homo sapiens
tggatgtgctggagg

SEQ ID NO: 4585198 - DNA, 18 bp, Homo sapiens
tggattaaacctttttat

SEQ ID NO: 4585199 - DNA, 20 bp, Homo sapiens
tggattaaacctttttataa

SEQ ID NO: 4585200 - DNA, 12 bp, Homo sapiens
tggattcacttc

SEQ ID NO: 4585201 - DNA, 13 bp, Homo sapiens
tggattcacttct

SEQ ID NO: 4585202 - DNA, 23 bp, Homo sapiens
tggattcattctcataattccta

SEQ ID NO: 4585203 - DNA, 13 bp, Homo sapiens
tggattctaaaat

SEQ ID NO: 4585204 - DNA, 23 bp, Homo sapiens
tggattgtgcctaatgtgtttga

SEQ ID NO: 4585205 - DNA, 15 bp, Homo sapiens
tggatttagtttcag

SEQ ID NO: 4585206 - DNA, 14 bp, Homo sapiens
tggatttcagaaag

SEQ ID NO: 4585207 - DNA, 15 bp, Homo sapiens
tggatttccactgct

SEQ ID NO: 4585208 - DNA, 21 bp, Homo sapiens
tggatttccagtttttcttta

SEQ ID NO: 4585209 - DNA, 15 bp, Homo sapiens
tggatttcctaatac

SEQ ID NO: 4585210 - DNA, 20 bp, Homo sapiens
tggatttccttctaacatgt

SEQ ID NO: 4585211 - DNA, 13 bp, Homo sapiens
tggatttctgtga

SEQ ID NO: 4585212 - DNA, 21 bp, Homo sapiens
tggatttctgtgaagttgaat

SEQ ID NO: 4585213 - DNA, 13 bp, Homo sapiens
tggatttgacatt

SEQ ID NO: 4585214 - DNA, 14 bp, Homo sapiens
tggatttgacattg

SEQ ID NO: 4585215 - DNA, 24 bp, Homo sapiens
tggatttgatgagttaactgtgaa

SEQ ID NO: 4585216 - DNA, 12 bp, Homo sapiens
tggatttgctgt

SEQ ID NO: 4585217 - DNA, 17 bp, Homo sapiens
tggattttgtagatgtt

SEQ ID NO: 4585218 - DNA, 14 bp, Homo sapiens
tggattttgtattt

SEQ ID NO: 4585219 - DNA, 19 bp, Homo sapiens
tggattttttatgtacaac

SEQ ID NO: 4585220 - DNA, 18 bp, Homo sapiens
tggcaaaaaggagccttt

SEQ ID NO: 4585221 - DNA, 22 bp, Homo sapiens
tggcaaaaccagtagcttccca

SEQ ID NO: 4585222 - DNA, 14 bp, Homo sapiens
tggcaaaactcagg

SEQ ID NO: 4585223 - DNA, 14 bp, Homo sapiens
tggcaaaattgcca

SEQ ID NO: 4585224 - DNA, 22 bp, Homo sapiens
tggcaaaggacccttgagtaag

SEQ ID NO: 4585225 - DNA, 15 bp, Homo sapiens
tggcaatttcctggc

SEQ ID NO: 4585226 - DNA, 22 bp, Homo sapiens
tggcaatttcctggccctccac

SEQ ID NO: 4585227 - DNA, 15 bp, Homo sapiens
tggcacagcccctgg

SEQ ID NO: 4585228 - DNA, 16 bp, Homo sapiens
tggcacagcccctgga

SEQ ID NO: 4585229 - DNA, 23 bp, Homo sapiens
tggcacagccgcgggccaggagg

SEQ ID NO: 4585230 - DNA, 22 bp, Homo sapiens
tggcacagcctggctgtggcct

SEQ ID NO: 4585231 - DNA, 19 bp, Homo sapiens
tggcacagttttctgagaa

SEQ ID NO: 4585232 - DNA, 20 bp, Homo sapiens
tggcacagttttctgagaaa

SEQ ID NO: 4585233 - DNA, 22 bp, Homo sapiens
tggcacagttttctgagaaaga

SEQ ID NO: 4585234 - DNA, 19 bp, Homo sapiens
tggcaccagatgcaacctc

SEQ ID NO: 4585235 - DNA, 14 bp, Homo sapiens
tggcacccccatgc

SEQ ID NO: 4585236 - DNA, 16 bp, Homo sapiens
tggcacccccatgctg

SEQ ID NO: 4585237 - DNA, 19 bp, Homo sapiens
tggcacccccatgctgcct

SEQ ID NO: 4585238 - DNA, 12 bp, Homo sapiens
tggcacctgcag

SEQ ID NO: 4585239 - DNA, 20 bp, Homo sapiens
tggcacctgcagcggctgcc

SEQ ID NO: 4585240 - DNA, 14 bp, Homo sapiens
tggcacgaaggccc

SEQ ID NO: 4585241 - DNA, 17 bp, Homo sapiens
tggcacgtattgctgtg

SEQ ID NO: 4585242 - DNA, 19 bp, Homo sapiens
tggcactattataagtgct

SEQ ID NO: 4585243 - DNA, 21 bp, Homo sapiens
tggcactctctaacgtccact

SEQ ID NO: 4585244 - DNA, 13 bp, Homo sapiens
tggcactctctgc

SEQ ID NO: 4585245 - DNA, 14 bp, Homo sapiens
tggcactgtaaggt

SEQ ID NO: 4585246 - DNA, 20 bp, Homo sapiens
tggcactgtaaggtgcttgc

SEQ ID NO: 4585247 - DNA, 23 bp, Homo sapiens
tggcactgtaaggtgcttgctcc

SEQ ID NO: 4585248 - DNA, 18 bp, Homo sapiens
tggcacttagcccaagag

SEQ ID NO: 4585249 - DNA, 20 bp, Homo sapiens
tggcacttagcccaagaggt

SEQ ID NO: 4585250 - DNA, 23 bp, Homo sapiens
tggcacttagcccaagaggtctg

SEQ ID NO: 4585251 - DNA, 15 bp, Homo sapiens
tggcagaagggaatt

SEQ ID NO: 4585252 - DNA, 20 bp, Homo sapiens
tggcagagaggtaaagggtg

SEQ ID NO: 4585253 - DNA, 17 bp, Homo sapiens
tggcagagttacagttc

SEQ ID NO: 4585254 - DNA, 20 bp, Homo sapiens
tggcagagttacagttctgt

SEQ ID NO: 4585255 - DNA, 20 bp, Homo sapiens
tggcagcaacggcacagcta

SEQ ID NO: 4585256 - DNA, 16 bp, Homo sapiens
tggcagctgagagccc

SEQ ID NO: 4585257 - DNA, 23 bp, Homo sapiens
tggcagctgagagccctgctgtg

SEQ ID NO: 4585258 - DNA, 11 bp, Homo sapiens
tggcagctgct

SEQ ID NO: 4585259 - DNA, 13 bp, Homo sapiens
tggcagctgctgt

SEQ ID NO: 4585260 - DNA, 14 bp, Homo sapiens
tggcagctgctgtg

SEQ ID NO: 4585261 - DNA, 23 bp, Homo sapiens
tggcaggaggttgggaattcttg

SEQ ID NO: 4585262 - DNA, 19 bp, Homo sapiens
tggcaggcacacagcagcc

SEQ ID NO: 4585263 - DNA, 18 bp, Homo sapiens
tggcaggcccactcccca

SEQ ID NO: 4585264 - DNA, 22 bp, Homo sapiens
tggcaggcccactccccagccc

SEQ ID NO: 4585265 - DNA, 13 bp, Homo sapiens
tggcagggccagg

SEQ ID NO: 4585266 - DNA, 16 bp, Homo sapiens
tggcagggccaggcct

SEQ ID NO: 4585267 - DNA, 22 bp, Homo sapiens
tggcagggccaggcctctgctg

SEQ ID NO: 4585268 - DNA, 18 bp, Homo sapiens
tggcagggcgtgaggaac

SEQ ID NO: 4585269 - DNA, 23 bp, Homo sapiens
tggcagggggccccgccagggct

SEQ ID NO: 4585270 - DNA, 17 bp, Homo sapiens
tggcagtaaagagaaac

SEQ ID NO: 4585271 - DNA, 19 bp, Homo sapiens
tggcagtaaagagaaactt

SEQ ID NO: 4585272 - DNA, 22 bp, Homo sapiens
tggcagtctgaatttttaaaac

SEQ ID NO: 4585273 - DNA, 20 bp, Homo sapiens
tggcagtttatatttaactc

SEQ ID NO: 4585274 - DNA, 21 bp, Homo sapiens
tggcatacaaaatatttaagt

SEQ ID NO: 4585275 - DNA, 14 bp, Homo sapiens
tggcatagacatgg

SEQ ID NO: 4585276 - DNA, 16 bp, Homo sapiens
tggcatcacagacccc

SEQ ID NO: 4585277 - DNA, 19 bp, Homo sapiens
tggcatcgcagcttcctgt

SEQ ID NO: 4585278 - DNA, 22 bp, Homo sapiens
tggcatcgcagtctcttagaat

SEQ ID NO: 4585279 - DNA, 19 bp, Homo sapiens
tggcatcgtgtattccata

SEQ ID NO: 4585280 - DNA, 23 bp, Homo sapiens
tggcatctctccccatatataaa

SEQ ID NO: 4585281 - DNA, 21 bp, Homo sapiens
tggcatctttgccttgggctg

SEQ ID NO: 4585282 - DNA, 15 bp, Homo sapiens
tggcatgggacagac

SEQ ID NO: 4585283 - DNA, 19 bp, Homo sapiens
tggcatggtagtatacaaa

SEQ ID NO: 4585284 - DNA, 15 bp, Homo sapiens
tggcatgtcatttgc

SEQ ID NO: 4585285 - DNA, 17 bp, Homo sapiens
tggcatgtcatttgcac

SEQ ID NO: 4585286 - DNA, 13 bp, Homo sapiens
tggcatgtggaga

SEQ ID NO: 4585287 - DNA, 19 bp, Homo sapiens
tggcattatctctttctct

SEQ ID NO: 4585288 - DNA, 12 bp, Homo sapiens
tggcatttctat

SEQ ID NO: 4585289 - DNA, 17 bp, Homo sapiens
tggcatttgcagatttt

SEQ ID NO: 4585290 - DNA, 19 bp, Homo sapiens
tggcatttgcagattttta

SEQ ID NO: 4585291 - DNA, 14 bp, Homo sapiens
tggccaacatggtg

SEQ ID NO: 4585292 - DNA, 19 bp, Homo sapiens
tggccaactcaactttcat

SEQ ID NO: 4585293 - DNA, 16 bp, Homo sapiens
tggccaagaagcagtg

SEQ ID NO: 4585294 - DNA, 22 bp, Homo sapiens
tggccaagaagcagtggcctta

SEQ ID NO: 4585295 - DNA, 17 bp, Homo sapiens
tggccaagcaggctggt

SEQ ID NO: 4585296 - DNA, 14 bp, Homo sapiens
tggccaagcctatc

SEQ ID NO: 4585297 - DNA, 19 bp, Homo sapiens
tggccaaggctctctctgt

SEQ ID NO: 4585298 - DNA, 20 bp, Homo sapiens
tggccaaggctctctctgtc

SEQ ID NO: 4585299 - DNA, 23 bp, Homo sapiens
tggccacacactgagttgcacat

SEQ ID NO: 4585300 - DNA, 13 bp, Homo sapiens
tggccacacaggc

SEQ ID NO: 4585301 - DNA, 15 bp, Homo sapiens
tggccacacaggcag

SEQ ID NO: 4585302 - DNA, 18 bp, Homo sapiens
tggccacacaggcagggc

SEQ ID NO: 4585303 - DNA, 16 bp, Homo sapiens
tggccacccctcccca

SEQ ID NO: 4585304 - DNA, 12 bp, Homo sapiens
tggccactcagc

SEQ ID NO: 4585305 - DNA, 22 bp, Homo sapiens
tggccactcagcttcctaccca

SEQ ID NO: 4585306 - DNA, 15 bp, Homo sapiens
tggccagacgctgcc

SEQ ID NO: 4585307 - DNA, 13 bp, Homo sapiens
tggccagcaaata

SEQ ID NO: 4585308 - DNA, 12 bp, Homo sapiens
tggccagcaccc

SEQ ID NO: 4585309 - DNA, 15 bp, Homo sapiens
tggccagcaccctct

SEQ ID NO: 4585310 - DNA, 21 bp, Homo sapiens
tggccagcaccctctcctggg

SEQ ID NO: 4585311 - DNA, 17 bp, Homo sapiens
tggccagcccctggggc

SEQ ID NO: 4585312 - DNA, 14 bp, Homo sapiens
tggccaggagctct

SEQ ID NO: 4585313 - DNA, 20 bp, Homo sapiens
tggccaggagctcttcaggc

SEQ ID NO: 4585314 - DNA, 16 bp, Homo sapiens
tggccaggcagatctg

SEQ ID NO: 4585315 - DNA, 19 bp, Homo sapiens
tggccaggcagatctgtgc

SEQ ID NO: 4585316 - DNA, 15 bp, Homo sapiens
tggccagtggctgga

SEQ ID NO: 4585317 - DNA, 19 bp, Homo sapiens
tggccagtgtttaaaactt

SEQ ID NO: 4585318 - DNA, 17 bp, Homo sapiens
tggccatatatgctgta

SEQ ID NO: 4585319 - DNA, 20 bp, Homo sapiens
tggccatatatgctgtattt

SEQ ID NO: 4585320 - DNA, 16 bp, Homo sapiens
tggccatccctgggcc

SEQ ID NO: 4585321 - DNA, 17 bp, Homo sapiens
tggccatctccctcccc

SEQ ID NO: 4585322 - DNA, 20 bp, Homo sapiens
tggccatctccctccccaga

SEQ ID NO: 4585323 - DNA, 12 bp, Homo sapiens
tggccatgctca

SEQ ID NO: 4585324 - DNA, 21 bp, Homo sapiens
tggcccacccagtccatgctc

SEQ ID NO: 4585325 - DNA, 14 bp, Homo sapiens
tggcccaccgtggc

SEQ ID NO: 4585326 - DNA, 16 bp, Homo sapiens
tggcccaccgtggcac

SEQ ID NO: 4585327 - DNA, 20 bp, Homo sapiens
tggcccaccgtggcactaga

SEQ ID NO: 4585328 - DNA, 13 bp, Homo sapiens
tggcccagagcca

SEQ ID NO: 4585329 - DNA, 22 bp, Homo sapiens
tggcccagagccatactgcgtc

SEQ ID NO: 4585330 - DNA, 15 bp, Homo sapiens
tggcccagcacgagc

SEQ ID NO: 4585331 - DNA, 18 bp, Homo sapiens
tggcccagcacgagcctg

SEQ ID NO: 4585332 - DNA, 15 bp, Homo sapiens
tggcccagccctgct

SEQ ID NO: 4585333 - DNA, 13 bp, Homo sapiens
tggcccagtgtca

SEQ ID NO: 4585334 - DNA, 13 bp, Homo sapiens
tggccccagcctg

SEQ ID NO: 4585335 - DNA, 17 bp, Homo sapiens
tggccccagcctgggcc

SEQ ID NO: 4585336 - DNA, 15 bp, Homo sapiens
tggcccccaataaag

SEQ ID NO: 4585337 - DNA, 16 bp, Homo sapiens
tggcccccaataaagg

SEQ ID NO: 4585338 - DNA, 19 bp, Homo sapiens
tggcccccaataaaggcag

SEQ ID NO: 4585339 - DNA, 23 bp, Homo sapiens
tggcccccaataaaggcagctgc

SEQ ID NO: 4585340 - DNA, 14 bp, Homo sapiens
tggcccccacagcg

SEQ ID NO: 4585341 - DNA, 17 bp, Homo sapiens
tggcccccacagcgctc

SEQ ID NO: 4585342 - DNA, 21 bp, Homo sapiens
tggcccccatcagccctgcta

SEQ ID NO: 4585343 - DNA, 11 bp, Homo sapiens
tggccctccac

SEQ ID NO: 4585344 - DNA, 15 bp, Homo sapiens
tggccctccactcct

SEQ ID NO: 4585345 - DNA, 14 bp, Homo sapiens
tggccctccccaca

SEQ ID NO: 4585346 - DNA, 11 bp, Homo sapiens
tggccctgcct

SEQ ID NO: 4585347 - DNA, 13 bp, Homo sapiens
tggccctgctttc

SEQ ID NO: 4585348 - DNA, 14 bp, Homo sapiens
tggccctggcctgc

SEQ ID NO: 4585349 - DNA, 15 bp, Homo sapiens
tggccctggcctgct

SEQ ID NO: 4585350 - DNA, 15 bp, Homo sapiens
tggccctgtcccagg

SEQ ID NO: 4585351 - DNA, 22 bp, Homo sapiens
tggcccttgcagttcagcacca

SEQ ID NO: 4585352 - DNA, 23 bp, Homo sapiens
tggcccttgcagttcagcaccac

SEQ ID NO: 4585353 - DNA, 18 bp, Homo sapiens
tggccctttccttccaga

SEQ ID NO: 4585354 - DNA, 13 bp, Homo sapiens
tggccgagctcct

SEQ ID NO: 4585355 - DNA, 22 bp, Homo sapiens
tggccgagctcctggggagctc

SEQ ID NO: 4585356 - DNA, 14 bp, Homo sapiens
tggccgcagaggtg

SEQ ID NO: 4585357 - DNA, 22 bp, Homo sapiens
tggccgcgccaaataatgtctc

SEQ ID NO: 4585358 - DNA, 19 bp, Homo sapiens
tggccgctgagcgcccccg

SEQ ID NO: 4585359 - DNA, 14 bp, Homo sapiens
tggccggcctcctc

SEQ ID NO: 4585360 - DNA, 20 bp, Homo sapiens
tggccggcggctactctgga

SEQ ID NO: 4585361 - DNA, 16 bp, Homo sapiens
tggccgggactgctgc

SEQ ID NO: 4585362 - DNA, 17 bp, Homo sapiens
tggccgggctctcatgg

SEQ ID NO: 4585363 - DNA, 18 bp, Homo sapiens
tggccggtgccagctgcc

SEQ ID NO: 4585364 - DNA, 14 bp, Homo sapiens
tggccgtctcctcc

SEQ ID NO: 4585365 - DNA, 15 bp, Homo sapiens
tggccgtctcctccc

SEQ ID NO: 4585366 - DNA, 21 bp, Homo sapiens
tggcctatccgctgccagcct

SEQ ID NO: 4585367 - DNA, 16 bp, Homo sapiens
tggcctatgtggtcta

SEQ ID NO: 4585368 - DNA, 20 bp, Homo sapiens
tggcctatttcagctgcttt

SEQ ID NO: 4585369 - DNA, 15 bp, Homo sapiens
tggcctcaaagcaag

SEQ ID NO: 4585370 - DNA, 17 bp, Homo sapiens
tggcctcagccctcaga

SEQ ID NO: 4585371 - DNA, 15 bp, Homo sapiens
tggcctcagccctgc

SEQ ID NO: 4585372 - DNA, 16 bp, Homo sapiens
tggcctcagccctgct

SEQ ID NO: 4585373 - DNA, 17 bp, Homo sapiens
tggcctcagccctgctc

SEQ ID NO: 4585374 - DNA, 19 bp, Homo sapiens
tggcctcagccctgctccc

SEQ ID NO: 4585375 - DNA, 16 bp, Homo sapiens
tggcctcagctgcctc

SEQ ID NO: 4585376 - DNA, 13 bp, Homo sapiens
tggcctcatctca

SEQ ID NO: 4585377 - DNA, 20 bp, Homo sapiens
tggcctcatctcagaccctg

SEQ ID NO: 4585378 - DNA, 14 bp, Homo sapiens
tggcctccctgctg

SEQ ID NO: 4585379 - DNA, 19 bp, Homo sapiens
tggcctccctgctgtgcca

SEQ ID NO: 4585380 - DNA, 19 bp, Homo sapiens
tggcctccggcgtcagcct

SEQ ID NO: 4585381 - DNA, 22 bp, Homo sapiens
tggcctcttcaggcctgctagt

SEQ ID NO: 4585382 - DNA, 15 bp, Homo sapiens
tggcctgacagctct

SEQ ID NO: 4585383 - DNA, 18 bp, Homo sapiens
tggcctgagatgcaggtg

SEQ ID NO: 4585384 - DNA, 20 bp, Homo sapiens
tggcctgagcatccagacct

SEQ ID NO: 4585385 - DNA, 23 bp, Homo sapiens
tggcctgcacggtgggccttgct

SEQ ID NO: 4585386 - DNA, 24 bp, Homo sapiens
tggcctgcacggtgggccttgctg

SEQ ID NO: 4585387 - DNA, 17 bp, Homo sapiens
tggcctgccagtctgcc

SEQ ID NO: 4585388 - DNA, 22 bp, Homo sapiens
tggcctgctgggctctccacct

SEQ ID NO: 4585389 - DNA, 12 bp, Homo sapiens
tggcctgctgtg

SEQ ID NO: 4585390 - DNA, 16 bp, Homo sapiens
tggcctggccaggagc

SEQ ID NO: 4585391 - DNA, 21 bp, Homo sapiens
tggcctggccaggagctcttc

SEQ ID NO: 4585392 - DNA, 11 bp, Homo sapiens
tggcctggggg

SEQ ID NO: 4585393 - DNA, 23 bp, Homo sapiens
tggcctggggtgcatctcctccc

SEQ ID NO: 4585394 - DNA, 18 bp, Homo sapiens
tggcctgtctcatcccca

SEQ ID NO: 4585395 - DNA, 15 bp, Homo sapiens
tggccttaatttcct

SEQ ID NO: 4585396 - DNA, 16 bp, Homo sapiens
tggccttaatttcctt

SEQ ID NO: 4585397 - DNA, 18 bp, Homo sapiens
tggccttgtaagaccctt

SEQ ID NO: 4585398 - DNA, 23 bp, Homo sapiens
tggccttgtaagacccttattgc

SEQ ID NO: 4585399 - DNA, 14 bp, Homo sapiens
tggccttgtacttg

SEQ ID NO: 4585400 - DNA, 11 bp, Homo sapiens
tggcctttcct

SEQ ID NO: 4585401 - DNA, 17 bp, Homo sapiens
tggcctttccttccctc

SEQ ID NO: 4585402 - DNA, 13 bp, Homo sapiens
tggccttttgata

SEQ ID NO: 4585403 - DNA, 20 bp, Homo sapiens
tggcctttttcatttatcta

SEQ ID NO: 4585404 - DNA, 14 bp, Homo sapiens
tggcgcaggtgggc

SEQ ID NO: 4585405 - DNA, 21 bp, Homo sapiens
tggcgcaggtgggctggactt

SEQ ID NO: 4585406 - DNA, 16 bp, Homo sapiens
tggcggctactcagca

SEQ ID NO: 4585407 - DNA, 17 bp, Homo sapiens
tggcggctactcagcag

SEQ ID NO: 4585408 - DNA, 13 bp, Homo sapiens
tggcggtgcctgg

SEQ ID NO: 4585409 - DNA, 14 bp, Homo sapiens
tggcggtggctgcc

SEQ ID NO: 4585410 - DNA, 16 bp, Homo sapiens
tggcggtggctgcccc

SEQ ID NO: 4585411 - DNA, 22 bp, Homo sapiens
tggcgttcacctccctgctcag

SEQ ID NO: 4585412 - DNA, 19 bp, Homo sapiens
tggcgttctcaagaatcta

SEQ ID NO: 4585413 - DNA, 15 bp, Homo sapiens
tggctaaaagacatg

SEQ ID NO: 4585414 - DNA, 19 bp, Homo sapiens
tggctagaggccagcccca

SEQ ID NO: 4585415 - DNA, 23 bp, Homo sapiens
tggctataggtgctacaaaaaca

SEQ ID NO: 4585416 - DNA, 18 bp, Homo sapiens
tggctatgaaaatgagcc

SEQ ID NO: 4585417 - DNA, 20 bp, Homo sapiens
tggctatgaaaatgagccct

SEQ ID NO: 4585418 - DNA, 15 bp, Homo sapiens
tggctcacactgaga

SEQ ID NO: 4585419 - DNA, 13 bp, Homo sapiens
tggctcagacccc

SEQ ID NO: 4585420 - DNA, 17 bp, Homo sapiens
tggctcagacccctcag

SEQ ID NO: 4585421 - DNA, 23 bp, Homo sapiens
tggctcagacccctcagccccag

SEQ ID NO: 4585422 - DNA, 12 bp, Homo sapiens
tggctcaggagg

SEQ ID NO: 4585423 - DNA, 20 bp, Homo sapiens
tggctcagtgccacctatgc

SEQ ID NO: 4585424 - DNA, 13 bp, Homo sapiens
tggctccactctt

SEQ ID NO: 4585425 - DNA, 18 bp, Homo sapiens
tggctccactcttgatct

SEQ ID NO: 4585426 - DNA, 22 bp, Homo sapiens
tggctccactcttgatctctct

SEQ ID NO: 4585427 - DNA, 22 bp, Homo sapiens
tggctccagtctcatcctccca

SEQ ID NO: 4585428 - DNA, 16 bp, Homo sapiens
tggctccccctcccca

SEQ ID NO: 4585429 - DNA, 20 bp, Homo sapiens
tggctccccctccccaggct

SEQ ID NO: 4585430 - DNA, 16 bp, Homo sapiens
tggctcccttacttta

SEQ ID NO: 4585431 - DNA, 16 bp, Homo sapiens
tggctcctatctgtgt

SEQ ID NO: 4585432 - DNA, 18 bp, Homo sapiens
tggctcctatctgtgttt

SEQ ID NO: 4585433 - DNA, 14 bp, Homo sapiens
tggctcctcccagc

SEQ ID NO: 4585434 - DNA, 14 bp, Homo sapiens
tggctcctgagggg

SEQ ID NO: 4585435 - DNA, 17 bp, Homo sapiens
tggctcggacccacccc

SEQ ID NO: 4585436 - DNA, 20 bp, Homo sapiens
tggctcggacccaccccaac

SEQ ID NO: 4585437 - DNA, 17 bp, Homo sapiens
tggctctaccttcctgt

SEQ ID NO: 4585438 - DNA, 19 bp, Homo sapiens
tggctctaccttcctgtcc

SEQ ID NO: 4585439 - DNA, 21 bp, Homo sapiens
tggctctaccttcctgtccct

SEQ ID NO: 4585440 - DNA, 17 bp, Homo sapiens
tggctctgccccctccc

SEQ ID NO: 4585441 - DNA, 14 bp, Homo sapiens
tggctctgccccgc

SEQ ID NO: 4585442 - DNA, 15 bp, Homo sapiens
tggctctgccccgca

SEQ ID NO: 4585443 - DNA, 18 bp, Homo sapiens
tggctgacatgaagctgt

SEQ ID NO: 4585444 - DNA, 16 bp, Homo sapiens
tggctgacccagtccc

SEQ ID NO: 4585445 - DNA, 17 bp, Homo sapiens
tggctgacccagtccct

SEQ ID NO: 4585446 - DNA, 22 bp, Homo sapiens
tggctgaggttcctctgcctgc

SEQ ID NO: 4585447 - DNA, 23 bp, Homo sapiens
tggctgaggttcctctgcctgcc

SEQ ID NO: 4585448 - DNA, 13 bp, Homo sapiens
tggctgccacacc

SEQ ID NO: 4585449 - DNA, 18 bp, Homo sapiens
tggctgccccggcctcct

SEQ ID NO: 4585450 - DNA, 22 bp, Homo sapiens
tggctgccttgtgaaggaatta

SEQ ID NO: 4585451 - DNA, 12 bp, Homo sapiens
tggctgctcttt

SEQ ID NO: 4585452 - DNA, 12 bp, Homo sapiens
tggctgctgccc

SEQ ID NO: 4585453 - DNA, 16 bp, Homo sapiens
tggctgctgcccccac

SEQ ID NO: 4585454 - DNA, 13 bp, Homo sapiens
tggctggaagggg

SEQ ID NO: 4585455 - DNA, 18 bp, Homo sapiens
tggctggaaggggtccag

SEQ ID NO: 4585456 - DNA, 22 bp, Homo sapiens
tggctggcagctgagagccctg

SEQ ID NO: 4585457 - DNA, 23 bp, Homo sapiens
tggctggcagctgagagccctgc

SEQ ID NO: 4585458 - DNA, 15 bp, Homo sapiens
tggctggctcctagg

SEQ ID NO: 4585459 - DNA, 21 bp, Homo sapiens
tggctggctcctaggggaaga

SEQ ID NO: 4585460 - DNA, 17 bp, Homo sapiens
tggctgggaactgcaga

SEQ ID NO: 4585461 - DNA, 21 bp, Homo sapiens
tggctgggaactgcagacctg

SEQ ID NO: 4585462 - DNA, 17 bp, Homo sapiens
tggctgggggcaggagg

SEQ ID NO: 4585463 - DNA, 18 bp, Homo sapiens
tggctggtagcagcaggc

SEQ ID NO: 4585464 - DNA, 21 bp, Homo sapiens
tggctggtagcagcaggctca

SEQ ID NO: 4585465 - DNA, 14 bp, Homo sapiens
tggctggtgggccc

SEQ ID NO: 4585466 - DNA, 12 bp, Homo sapiens
tggctggtgtcc

SEQ ID NO: 4585467 - DNA, 21 bp, Homo sapiens
tggctggtgtccccttcccct

SEQ ID NO: 4585468 - DNA, 13 bp, Homo sapiens
tggctgtaatcat

SEQ ID NO: 4585469 - DNA, 22 bp, Homo sapiens
tggctgtaatcatttgtttaca

SEQ ID NO: 4585470 - DNA, 22 bp, Homo sapiens
tggctgtgcaatttctgtacat

SEQ ID NO: 4585471 - DNA, 23 bp, Homo sapiens
tggctgtgcaatttctgtacatt

SEQ ID NO: 4585472 - DNA, 14 bp, Homo sapiens
tggctgtttgagat

SEQ ID NO: 4585473 - DNA, 11 bp, Homo sapiens
tggctgtttgg

SEQ ID NO: 4585474 - DNA, 16 bp, Homo sapiens
tggctgtttggacttt

SEQ ID NO: 4585475 - DNA, 18 bp, Homo sapiens
tggctgttttccctctgc

SEQ ID NO: 4585476 - DNA, 14 bp, Homo sapiens
tggcttagtgccac

SEQ ID NO: 4585477 - DNA, 21 bp, Homo sapiens
tggcttcatactctttctttg

SEQ ID NO: 4585478 - DNA, 15 bp, Homo sapiens
tggcttctccaggga

SEQ ID NO: 4585479 - DNA, 13 bp, Homo sapiens
tggcttgctgttt

SEQ ID NO: 4585480 - DNA, 17 bp, Homo sapiens
tggcttgtaactccacc

SEQ ID NO: 4585481 - DNA, 19 bp, Homo sapiens
tggctttcaaagctaaaat

SEQ ID NO: 4585482 - DNA, 21 bp, Homo sapiens
tggctttcagagccagcctgg

SEQ ID NO: 4585483 - DNA, 22 bp, Homo sapiens
tggctttcagagccagcctggc

SEQ ID NO: 4585484 - DNA, 22 bp, Homo sapiens
tggctttccaggcaccctcagg

SEQ ID NO: 4585485 - DNA, 23 bp, Homo sapiens
tggctttctaccacacacagcct

SEQ ID NO: 4585486 - DNA, 15 bp, Homo sapiens
tggctttgcagctgc

SEQ ID NO: 4585487 - DNA, 16 bp, Homo sapiens
tggctttgcagctgct

SEQ ID NO: 4585488 - DNA, 17 bp, Homo sapiens
tggctttgcagctgctg

SEQ ID NO: 4585489 - DNA, 20 bp, Homo sapiens
tggctttgcagctgctgtct

SEQ ID NO: 4585490 - DNA, 13 bp, Homo sapiens
tggctttgtactt

SEQ ID NO: 4585491 - DNA, 20 bp, Homo sapiens
tggctttgtgattcaatctg

SEQ ID NO: 4585492 - DNA, 20 bp, Homo sapiens
tggcttttattaatgcactt

SEQ ID NO: 4585493 - DNA, 21 bp, Homo sapiens
tggcttttattaatgcacttt

SEQ ID NO: 4585494 - DNA, 21 bp, Homo sapiens
tggcttttcgcttgcttctgc

SEQ ID NO: 4585495 - DNA, 17 bp, Homo sapiens
tggcttttgcctgtaag

SEQ ID NO: 4585496 - DNA, 17 bp, Homo sapiens
tgggaaagcattgtaaa

SEQ ID NO: 4585497 - DNA, 18 bp, Homo sapiens
tgggaaatagcggccctg

SEQ ID NO: 4585498 - DNA, 23 bp, Homo sapiens
tgggaaatagcggccctggagga

SEQ ID NO: 4585499 - DNA, 20 bp, Homo sapiens
tgggaaatgagaaggcagcc

SEQ ID NO: 4585500 - DNA, 22 bp, Homo sapiens
tgggaaattaaatccaataaaa

SEQ ID NO: 4585501 - DNA, 16 bp, Homo sapiens
tgggaactgcagacct

SEQ ID NO: 4585502 - DNA, 18 bp, Homo sapiens
tgggaactgcagacctgt

SEQ ID NO: 4585503 - DNA, 16 bp, Homo sapiens
tgggaagaattggaag

SEQ ID NO: 4585504 - DNA, 21 bp, Homo sapiens
tgggaagactcaggagtctgc

SEQ ID NO: 4585505 - DNA, 17 bp, Homo sapiens
tgggaagatggtttgaa

SEQ ID NO: 4585506 - DNA, 20 bp, Homo sapiens
tgggaagctgagggcaaatc

SEQ ID NO: 4585507 - DNA, 17 bp, Homo sapiens
tgggaaggcttgggatt

SEQ ID NO: 4585508 - DNA, 21 bp, Homo sapiens
tgggaagggagagcggggcag

SEQ ID NO: 4585509 - DNA, 22 bp, Homo sapiens
tgggaagggagagttctttgct

SEQ ID NO: 4585510 - DNA, 18 bp, Homo sapiens
tgggaagtccggccccag

SEQ ID NO: 4585511 - DNA, 18 bp, Homo sapiens
tgggaagtcgaggctgca

SEQ ID NO: 4585512 - DNA, 11 bp, Homo sapiens
tgggaataaaa

SEQ ID NO: 4585513 - DNA, 17 bp, Homo sapiens
tgggaataaaagtatta

SEQ ID NO: 4585514 - DNA, 19 bp, Homo sapiens
tgggaatgaaattaacaca

SEQ ID NO: 4585515 - DNA, 14 bp, Homo sapiens
tgggaatgaggtgg

SEQ ID NO: 4585516 - DNA, 15 bp, Homo sapiens
tgggaattgcgctca

SEQ ID NO: 4585517 - DNA, 19 bp, Homo sapiens
tgggaattgcgctcagggg

SEQ ID NO: 4585518 - DNA, 18 bp, Homo sapiens
tgggacacagacccagga

SEQ ID NO: 4585519 - DNA, 15 bp, Homo sapiens
tgggacatggaaaag

SEQ ID NO: 4585520 - DNA, 23 bp, Homo sapiens
tgggaccctgtccggcccagtgc

SEQ ID NO: 4585521 - DNA, 13 bp, Homo sapiens
tgggacccttggc

SEQ ID NO: 4585522 - DNA, 17 bp, Homo sapiens
tgggaccctttccttcc

SEQ ID NO: 4585523 - DNA, 23 bp, Homo sapiens
tgggacctgccaggcaggggtgg

SEQ ID NO: 4585524 - DNA, 23 bp, Homo sapiens
tgggacgggatggttctggctgt

SEQ ID NO: 4585525 - DNA, 22 bp, Homo sapiens
tgggactagaggctcagtggtg

SEQ ID NO: 4585526 - DNA, 20 bp, Homo sapiens
tgggactccatgctccttga

SEQ ID NO: 4585527 - DNA, 18 bp, Homo sapiens
tgggactcggagactatg

SEQ ID NO: 4585528 - DNA, 15 bp, Homo sapiens
tgggactgctgaaga

SEQ ID NO: 4585529 - DNA, 21 bp, Homo sapiens
tgggactgtacacactttatt

SEQ ID NO: 4585530 - DNA, 17 bp, Homo sapiens
tgggactgtgcctggct

SEQ ID NO: 4585531 - DNA, 22 bp, Homo sapiens
tgggactgtgcctggctccctg

SEQ ID NO: 4585532 - DNA, 14 bp, Homo sapiens
tgggacttctaccc

SEQ ID NO: 4585533 - DNA, 16 bp, Homo sapiens
tgggacttgaacaaag

SEQ ID NO: 4585534 - DNA, 20 bp, Homo sapiens
tgggacttgaacaaagacat

SEQ ID NO: 4585535 - DNA, 21 bp, Homo sapiens
tgggagaaaacgccagtgtgt

SEQ ID NO: 4585536 - DNA, 22 bp, Homo sapiens
tgggagaaaacgccagtgtgtt

SEQ ID NO: 4585537 - DNA, 19 bp, Homo sapiens
tgggagaatgtcagtatgt

SEQ ID NO: 4585538 - DNA, 22 bp, Homo sapiens
tgggagaatgtcagtatgtgga

SEQ ID NO: 4585539 - DNA, 17 bp, Homo sapiens
tgggagaattgcttgag

SEQ ID NO: 4585540 - DNA, 20 bp, Homo sapiens
tgggagccacttctccccag

SEQ ID NO: 4585541 - DNA, 19 bp, Homo sapiens
tgggagccagtcctccact

SEQ ID NO: 4585542 - DNA, 23 bp, Homo sapiens
tgggagccccagggtcttcccta

SEQ ID NO: 4585543 - DNA, 18 bp, Homo sapiens
tgggagccgcagagcctg

SEQ ID NO: 4585544 - DNA, 13 bp, Homo sapiens
tgggagcctagct

SEQ ID NO: 4585545 - DNA, 22 bp, Homo sapiens
tgggagctcctctcctggagga

SEQ ID NO: 4585546 - DNA, 14 bp, Homo sapiens
tgggagctgagcag

SEQ ID NO: 4585547 - DNA, 19 bp, Homo sapiens
tgggagctgagcagcctct

SEQ ID NO: 4585548 - DNA, 16 bp, Homo sapiens
tgggagctgccaagag

SEQ ID NO: 4585549 - DNA, 12 bp, Homo sapiens
tgggaggaaaag

SEQ ID NO: 4585550 - DNA, 20 bp, Homo sapiens
tgggaggaaaagaaaagagg

SEQ ID NO: 4585551 - DNA, 12 bp, Homo sapiens
tgggaggacagg

SEQ ID NO: 4585552 - DNA, 17 bp, Homo sapiens
tgggaggacaggcaggc

SEQ ID NO: 4585553 - DNA, 20 bp, Homo sapiens
tgggaggacggtgcaaccca

SEQ ID NO: 4585554 - DNA, 13 bp, Homo sapiens
tgggaggagggag

SEQ ID NO: 4585555 - DNA, 15 bp, Homo sapiens
tgggaggagggagag

SEQ ID NO: 4585556 - DNA, 18 bp, Homo sapiens
tgggaggagggagaggga

SEQ ID NO: 4585557 - DNA, 22 bp, Homo sapiens
tgggaggcgtgcccccctcctc

SEQ ID NO: 4585558 - DNA, 14 bp, Homo sapiens
tgggagggaaaagg

SEQ ID NO: 4585559 - DNA, 18 bp, Homo sapiens
tgggagggatcagccccg

SEQ ID NO: 4585560 - DNA, 14 bp, Homo sapiens
tgggagggcagcag

SEQ ID NO: 4585561 - DNA, 17 bp, Homo sapiens
tgggagggcagcagggc

SEQ ID NO: 4585562 - DNA, 18 bp, Homo sapiens
tgggagggcagcagggct

SEQ ID NO: 4585563 - DNA, 19 bp, Homo sapiens
tgggagggcagcagggcta

SEQ ID NO: 4585564 - DNA, 15 bp, Homo sapiens
tgggaggtaaggaaa

SEQ ID NO: 4585565 - DNA, 18 bp, Homo sapiens
tgggaggtggaagaaggg

SEQ ID NO: 4585566 - DNA, 22 bp, Homo sapiens
tgggaggtggaagaagggagaa

SEQ ID NO: 4585567 - DNA, 18 bp, Homo sapiens
tgggaggtggaagcagag

SEQ ID NO: 4585568 - DNA, 20 bp, Homo sapiens
tgggaggtggaagcagaggc

SEQ ID NO: 4585569 - DNA, 19 bp, Homo sapiens
tgggagtaacagggcagaa

SEQ ID NO: 4585570 - DNA, 15 bp, Homo sapiens
tgggagtggggcctt

SEQ ID NO: 4585571 - DNA, 22 bp, Homo sapiens
tgggagtggggcctttgccagc

SEQ ID NO: 4585572 - DNA, 13 bp, Homo sapiens
tgggagtgtgtaa

SEQ ID NO: 4585573 - DNA, 20 bp, Homo sapiens
tgggagtgttcccgtgcctg

SEQ ID NO: 4585574 - DNA, 21 bp, Homo sapiens
tgggagtgttcccgtgcctgg

SEQ ID NO: 4585575 - DNA, 17 bp, Homo sapiens
tgggataactgatttct

SEQ ID NO: 4585576 - DNA, 17 bp, Homo sapiens
tgggatagagaatgttc

SEQ ID NO: 4585577 - DNA, 19 bp, Homo sapiens
tgggatccacgctgggcct

SEQ ID NO: 4585578 - DNA, 21 bp, Homo sapiens
tgggatcctgactaagccttt

SEQ ID NO: 4585579 - DNA, 14 bp, Homo sapiens
tgggatggaggaga

SEQ ID NO: 4585580 - DNA, 16 bp, Homo sapiens
tgggatggaggagaag

SEQ ID NO: 4585581 - DNA, 19 bp, Homo sapiens
tgggatggtcggatctcac

SEQ ID NO: 4585582 - DNA, 21 bp, Homo sapiens
tgggatggtcggatctcacag

SEQ ID NO: 4585583 - DNA, 17 bp, Homo sapiens
tgggatggtggagggcc

SEQ ID NO: 4585584 - DNA, 22 bp, Homo sapiens
tgggattaagaaaccttgctct

SEQ ID NO: 4585585 - DNA, 24 bp, Homo sapiens
tgggattaaggcgtgagccactgc

SEQ ID NO: 4585586 - DNA, 15 bp, Homo sapiens
tgggattttgcaaaa

SEQ ID NO: 4585587 - DNA, 22 bp, Homo sapiens
tgggcaacacatgcagaataat

SEQ ID NO: 4585588 - DNA, 14 bp, Homo sapiens
tgggcaaggaaaaa

SEQ ID NO: 4585589 - DNA, 16 bp, Homo sapiens
tgggcaatttagaaaa

SEQ ID NO: 4585590 - DNA, 16 bp, Homo sapiens
tgggcaccacaaaata

SEQ ID NO: 4585591 - DNA, 16 bp, Homo sapiens
tgggcacgcctgctgg

SEQ ID NO: 4585592 - DNA, 20 bp, Homo sapiens
tgggcactggtgggtcggcc

SEQ ID NO: 4585593 - DNA, 14 bp, Homo sapiens
tgggcactgtgcca

SEQ ID NO: 4585594 - DNA, 12 bp, Homo sapiens
tgggcagcaatt

SEQ ID NO: 4585595 - DNA, 15 bp, Homo sapiens
tgggcagcaccctcc

SEQ ID NO: 4585596 - DNA, 16 bp, Homo sapiens
tgggcagcaccctccc

SEQ ID NO: 4585597 - DNA, 22 bp, Homo sapiens
tgggcagcaccctcccccgcag

SEQ ID NO: 4585598 - DNA, 12 bp, Homo sapiens
tgggcagccaga

SEQ ID NO: 4585599 - DNA, 21 bp, Homo sapiens
tgggcagccagaccagcaggc

SEQ ID NO: 4585600 - DNA, 13 bp, Homo sapiens
tgggcagccagga

SEQ ID NO: 4585601 - DNA, 23 bp, Homo sapiens
tgggcagccaggagtgcccccgg

SEQ ID NO: 4585602 - DNA, 23 bp, Homo sapiens
tgggcagtgccccagggagtcca

SEQ ID NO: 4585603 - DNA, 24 bp, Homo sapiens
tgggcagtgccccagggagtccag

SEQ ID NO: 4585604 - DNA, 15 bp, Homo sapiens
tgggcatcttttgta

SEQ ID NO: 4585605 - DNA, 22 bp, Homo sapiens
tgggcatggcagggccaggcct

SEQ ID NO: 4585606 - DNA, 16 bp, Homo sapiens
tgggcatttggtgaga

SEQ ID NO: 4585607 - DNA, 22 bp, Homo sapiens
tgggcattttcctcctctgcct

SEQ ID NO: 4585608 - DNA, 20 bp, Homo sapiens
tgggccacacccaggaaggg

SEQ ID NO: 4585609 - DNA, 22 bp, Homo sapiens
tgggccacacccaggaagggaa

SEQ ID NO: 4585610 - DNA, 15 bp, Homo sapiens
tgggccaccagggat

SEQ ID NO: 4585611 - DNA, 23 bp, Homo sapiens
tgggccaccgccttgcccagcct

SEQ ID NO: 4585612 - DNA, 15 bp, Homo sapiens
tgggccactggggac

SEQ ID NO: 4585613 - DNA, 18 bp, Homo sapiens
tgggccaggacaggcccg

SEQ ID NO: 4585614 - DNA, 10 bp, Homo sapiens
tgggccaggg

SEQ ID NO: 4585615 - DNA, 22 bp, Homo sapiens
tgggccagtcaacggggggctc

SEQ ID NO: 4585616 - DNA, 18 bp, Homo sapiens
tgggccagtccccgagga

SEQ ID NO: 4585617 - DNA, 23 bp, Homo sapiens
tgggccataatgttgcttctcag

SEQ ID NO: 4585618 - DNA, 14 bp, Homo sapiens
tgggccatgtccaa

SEQ ID NO: 4585619 - DNA, 23 bp, Homo sapiens
tgggccatgtccaaagaggctgc

SEQ ID NO: 4585620 - DNA, 16 bp, Homo sapiens
tgggcccaaccctgtc

SEQ ID NO: 4585621 - DNA, 23 bp, Homo sapiens
tgggcccaagacagatgccccag

SEQ ID NO: 4585622 - DNA, 13 bp, Homo sapiens
tgggcccagatct

SEQ ID NO: 4585623 - DNA, 14 bp, Homo sapiens
tgggcccagatctg

SEQ ID NO: 4585624 - DNA, 22 bp, Homo sapiens
tgggcccagggacaccagccag

SEQ ID NO: 4585625 - DNA, 13 bp, Homo sapiens
tgggccccagccc

SEQ ID NO: 4585626 - DNA, 14 bp, Homo sapiens
tgggccccagccca

SEQ ID NO: 4585627 - DNA, 13 bp, Homo sapiens
tgggcccctgcac

SEQ ID NO: 4585628 - DNA, 13 bp, Homo sapiens
tgggcccctggga

SEQ ID NO: 4585629 - DNA, 19 bp, Homo sapiens
tgggcccggtccacaggtc

SEQ ID NO: 4585630 - DNA, 20 bp, Homo sapiens
tgggcccggtccacaggtcc

SEQ ID NO: 4585631 - DNA, 13 bp, Homo sapiens
tgggccctctctc

SEQ ID NO: 4585632 - DNA, 18 bp, Homo sapiens
tgggccctctctctgggc

SEQ ID NO: 4585633 - DNA, 19 bp, Homo sapiens
tgggccctctttccctgcg

SEQ ID NO: 4585634 - DNA, 23 bp, Homo sapiens
tgggccctctttccctgcgagac

SEQ ID NO: 4585635 - DNA, 14 bp, Homo sapiens
tgggccctgcctgc

SEQ ID NO: 4585636 - DNA, 18 bp, Homo sapiens
tgggccctgcctgcagcc

SEQ ID NO: 4585637 - DNA, 20 bp, Homo sapiens
tgggccctgcctgcagccag

SEQ ID NO: 4585638 - DNA, 15 bp, Homo sapiens
tgggccctgggctgg

SEQ ID NO: 4585639 - DNA, 12 bp, Homo sapiens
tgggccttgctg

SEQ ID NO: 4585640 - DNA, 14 bp, Homo sapiens
tgggccttgctggg

SEQ ID NO: 4585641 - DNA, 16 bp, Homo sapiens
tgggcgctcggtctcc

SEQ ID NO: 4585642 - DNA, 16 bp, Homo sapiens
tgggcgttgggagcct

SEQ ID NO: 4585643 - DNA, 19 bp, Homo sapiens
tgggcgttgggagcctagc

SEQ ID NO: 4585644 - DNA, 17 bp, Homo sapiens
tgggctattgctgctgc

SEQ ID NO: 4585645 - DNA, 21 bp, Homo sapiens
tgggctattgctgctgcccct

SEQ ID NO: 4585646 - DNA, 16 bp, Homo sapiens
tgggctcactgtgctg

SEQ ID NO: 4585647 - DNA, 19 bp, Homo sapiens
tgggctccacgggcagggg

SEQ ID NO: 4585648 - DNA, 21 bp, Homo sapiens
tgggctcgccgtgtctcagcc

SEQ ID NO: 4585649 - DNA, 16 bp, Homo sapiens
tgggctctccacctca

SEQ ID NO: 4585650 - DNA, 17 bp, Homo sapiens
tgggctctccacctcag

SEQ ID NO: 4585651 - DNA, 19 bp, Homo sapiens
tgggctctccacctcagcc

SEQ ID NO: 4585652 - DNA, 17 bp, Homo sapiens
tgggctctgtgcagtca

SEQ ID NO: 4585653 - DNA, 12 bp, Homo sapiens
tgggctgaggga

SEQ ID NO: 4585654 - DNA, 15 bp, Homo sapiens
tgggctgctcctcat

SEQ ID NO: 4585655 - DNA, 16 bp, Homo sapiens
tgggctgctcctcatg

SEQ ID NO: 4585656 - DNA, 12 bp, Homo sapiens
tgggctggactt

SEQ ID NO: 4585657 - DNA, 15 bp, Homo sapiens
tgggctggagctcct

SEQ ID NO: 4585658 - DNA, 15 bp, Homo sapiens
tgggctggcacagcc

SEQ ID NO: 4585659 - DNA, 16 bp, Homo sapiens
tgggctgggccctctt

SEQ ID NO: 4585660 - DNA, 17 bp, Homo sapiens
tgggctggggccacctt

SEQ ID NO: 4585661 - DNA, 16 bp, Homo sapiens
tgggctgggtgctggg

SEQ ID NO: 4585662 - DNA, 16 bp, Homo sapiens
tgggctgtctgtcacc

SEQ ID NO: 4585663 - DNA, 22 bp, Homo sapiens
tgggctgtgtcctaaggcccat

SEQ ID NO: 4585664 - DNA, 15 bp, Homo sapiens
tgggcttcctgccct

SEQ ID NO: 4585665 - DNA, 20 bp, Homo sapiens
tgggcttcggagtgaatgtg

SEQ ID NO: 4585666 - DNA, 22 bp, Homo sapiens
tgggcttcggagtgaatgtggc

SEQ ID NO: 4585667 - DNA, 23 bp, Homo sapiens
tgggcttcggagtgaatgtggca

SEQ ID NO: 4585668 - DNA, 14 bp, Homo sapiens
tgggcttggcctgc

SEQ ID NO: 4585669 - DNA, 22 bp, Homo sapiens
tgggctttttttttctctttct

SEQ ID NO: 4585670 - DNA, 22 bp, Homo sapiens
tggggaaaactacaaacgtttg

SEQ ID NO: 4585671 - DNA, 23 bp, Homo sapiens
tggggaacaggtcccacgccagg

SEQ ID NO: 4585672 - DNA, 19 bp, Homo sapiens
tggggaagaacagccccgg

SEQ ID NO: 4585673 - DNA, 11 bp, Homo sapiens
tggggaagagt

SEQ ID NO: 4585674 - DNA, 16 bp, Homo sapiens
tggggaagggcctgcc

SEQ ID NO: 4585675 - DNA, 16 bp, Homo sapiens
tggggaatgctcccag

SEQ ID NO: 4585676 - DNA, 14 bp, Homo sapiens
tggggaatttcctc

SEQ ID NO: 4585677 - DNA, 14 bp, Homo sapiens
tggggacctgaact

SEQ ID NO: 4585678 - DNA, 17 bp, Homo sapiens
tggggacgccaaggagg

SEQ ID NO: 4585679 - DNA, 21 bp, Homo sapiens
tggggacgccaaggaggtggg

SEQ ID NO: 4585680 - DNA, 22 bp, Homo sapiens
tggggacggggggccccagtca

SEQ ID NO: 4585681 - DNA, 14 bp, Homo sapiens
tggggactgctacc

SEQ ID NO: 4585682 - DNA, 23 bp, Homo sapiens
tggggacttcaactgcccagcaa

SEQ ID NO: 4585683 - DNA, 21 bp, Homo sapiens
tggggactttatttatttcta

SEQ ID NO: 4585684 - DNA, 17 bp, Homo sapiens
tggggagactgggctga

SEQ ID NO: 4585685 - DNA, 20 bp, Homo sapiens
tggggagagggatttccctg

SEQ ID NO: 4585686 - DNA, 21 bp, Homo sapiens
tggggagagggatttccctgc

SEQ ID NO: 4585687 - DNA, 12 bp, Homo sapiens
tggggagctaag

SEQ ID NO: 4585688 - DNA, 14 bp, Homo sapiens
tggggagctcctgg

SEQ ID NO: 4585689 - DNA, 19 bp, Homo sapiens
tggggaggaatcctggacc

SEQ ID NO: 4585690 - DNA, 17 bp, Homo sapiens
tggggaggcccaaatga

SEQ ID NO: 4585691 - DNA, 12 bp, Homo sapiens
tggggaggccct

SEQ ID NO: 4585692 - DNA, 20 bp, Homo sapiens
tggggaggctgaggcaggag

SEQ ID NO: 4585693 - DNA, 14 bp, Homo sapiens
tggggagggatttg

SEQ ID NO: 4585694 - DNA, 22 bp, Homo sapiens
tggggagggatttggggctcag

SEQ ID NO: 4585695 - DNA, 20 bp, Homo sapiens
tggggagtaaacggcccagg

SEQ ID NO: 4585696 - DNA, 17 bp, Homo sapiens
tggggatatcagggcac

SEQ ID NO: 4585697 - DNA, 21 bp, Homo sapiens
tggggatcttcccacaggagg

SEQ ID NO: 4585698 - DNA, 14 bp, Homo sapiens
tggggcaggctggg

SEQ ID NO: 4585699 - DNA, 15 bp, Homo sapiens
tggggcaggctgggc

SEQ ID NO: 4585700 - DNA, 20 bp, Homo sapiens
tggggcaggctgggccatgt

SEQ ID NO: 4585701 - DNA, 18 bp, Homo sapiens
tggggcaggggccggggg

SEQ ID NO: 4585702 - DNA, 12 bp, Homo sapiens
tggggccctggg

SEQ ID NO: 4585703 - DNA, 23 bp, Homo sapiens
tggggccggttttcctcagctct

SEQ ID NO: 4585704 - DNA, 13 bp, Homo sapiens
tggggcctcagcc

SEQ ID NO: 4585705 - DNA, 16 bp, Homo sapiens
tggggcctcaggctcc

SEQ ID NO: 4585706 - DNA, 17 bp, Homo sapiens
tggggcctttgccagca

SEQ ID NO: 4585707 - DNA, 21 bp, Homo sapiens
tggggcctttgccagcagagc

SEQ ID NO: 4585708 - DNA, 16 bp, Homo sapiens
tggggcgcccacccgg

SEQ ID NO: 4585709 - DNA, 16 bp, Homo sapiens
tggggcgtgcagcagg

SEQ ID NO: 4585710 - DNA, 21 bp, Homo sapiens
tggggctcccagccaggccct

SEQ ID NO: 4585711 - DNA, 12 bp, Homo sapiens
tggggctcctgg

SEQ ID NO: 4585712 - DNA, 20 bp, Homo sapiens
tggggctgacacccaggccc

SEQ ID NO: 4585713 - DNA, 15 bp, Homo sapiens
tggggctgagccctc

SEQ ID NO: 4585714 - DNA, 23 bp, Homo sapiens
tggggctgagccctcctgagggc

SEQ ID NO: 4585715 - DNA, 14 bp, Homo sapiens
tgggggaagccctg

SEQ ID NO: 4585716 - DNA, 21 bp, Homo sapiens
tgggggacaggatttggccac

SEQ ID NO: 4585717 - DNA, 18 bp, Homo sapiens
tgggggaggccaccccaa

SEQ ID NO: 4585718 - DNA, 11 bp, Homo sapiens
tgggggagggc

SEQ ID NO: 4585719 - DNA, 23 bp, Homo sapiens
tgggggcagtctccccttcctgg

SEQ ID NO: 4585720 - DNA, 17 bp, Homo sapiens
tggggggccgggcaggt

SEQ ID NO: 4585721 - DNA, 18 bp, Homo sapiens
tgggggtctgtgtgttta

SEQ ID NO: 4585722 - DNA, 16 bp, Homo sapiens
tgggggtggaggaccg

SEQ ID NO: 4585723 - DNA, 18 bp, Homo sapiens
tgggggtggaggcttcct

SEQ ID NO: 4585724 - DNA, 16 bp, Homo sapiens
tgggggtggcaggcac

SEQ ID NO: 4585725 - DNA, 23 bp, Homo sapiens
tgggggtggggaggcccaaatga

SEQ ID NO: 4585726 - DNA, 17 bp, Homo sapiens
tgggggtgtggctctgc

SEQ ID NO: 4585727 - DNA, 13 bp, Homo sapiens
tggggtagggctg

SEQ ID NO: 4585728 - DNA, 20 bp, Homo sapiens
tggggtatggattctaaaat

SEQ ID NO: 4585729 - DNA, 14 bp, Homo sapiens
tggggtcacagagg

SEQ ID NO: 4585730 - DNA, 19 bp, Homo sapiens
tggggtccatccccttccc

SEQ ID NO: 4585731 - DNA, 19 bp, Homo sapiens
tggggtctccctctcctgc

SEQ ID NO: 4585732 - DNA, 16 bp, Homo sapiens
tggggtgcatctcctc

SEQ ID NO: 4585733 - DNA, 15 bp, Homo sapiens
tggggtgccttcact

SEQ ID NO: 4585734 - DNA, 21 bp, Homo sapiens
tggggtgccttcactgggcca

SEQ ID NO: 4585735 - DNA, 21 bp, Homo sapiens
tggggtgcgggatacagctga

SEQ ID NO: 4585736 - DNA, 12 bp, Homo sapiens
tggggtgggagt

SEQ ID NO: 4585737 - DNA, 23 bp, Homo sapiens
tggggtgggagtaacagggcaga

SEQ ID NO: 4585738 - DNA, 14 bp, Homo sapiens
tggggttcagcccc

SEQ ID NO: 4585739 - DNA, 17 bp, Homo sapiens
tggggttcagcccctcc

SEQ ID NO: 4585740 - DNA, 21 bp, Homo sapiens
tggggttgccagaggccctgg

SEQ ID NO: 4585741 - DNA, 13 bp, Homo sapiens
tgggtaagaaagc

SEQ ID NO: 4585742 - DNA, 16 bp, Homo sapiens
tgggtaagaagaaagc

SEQ ID NO: 4585743 - DNA, 18 bp, Homo sapiens
tgggtaatgaaacaaaga

SEQ ID NO: 4585744 - DNA, 14 bp, Homo sapiens
tgggtagaaaaatt

SEQ ID NO: 4585745 - DNA, 22 bp, Homo sapiens
tgggtatccttaatagaggagc

SEQ ID NO: 4585746 - DNA, 17 bp, Homo sapiens
tgggtcaaaaaaaagaa

SEQ ID NO: 4585747 - DNA, 18 bp, Homo sapiens
tgggtcagaaccctgcca

SEQ ID NO: 4585748 - DNA, 16 bp, Homo sapiens
tgggtcatgggcctgt

SEQ ID NO: 4585749 - DNA, 17 bp, Homo sapiens
tgggtcatgggcctgtg

SEQ ID NO: 4585750 - DNA, 20 bp, Homo sapiens
tgggtcatgggcctgtgggg

SEQ ID NO: 4585751 - DNA, 18 bp, Homo sapiens
tgggtccaggggcccctc

SEQ ID NO: 4585752 - DNA, 19 bp, Homo sapiens
tgggtccaggggcccctcc

SEQ ID NO: 4585753 - DNA, 17 bp, Homo sapiens
tgggtccatgggcagag

SEQ ID NO: 4585754 - DNA, 15 bp, Homo sapiens
tgggtcctagccctt

SEQ ID NO: 4585755 - DNA, 19 bp, Homo sapiens
tgggtcctagcccttccct

SEQ ID NO: 4585756 - DNA, 20 bp, Homo sapiens
tgggtcctagcccttccctg

SEQ ID NO: 4585757 - DNA, 21 bp, Homo sapiens
tgggtcctagcccttccctga

SEQ ID NO: 4585758 - DNA, 12 bp, Homo sapiens
tgggtcctgcca

SEQ ID NO: 4585759 - DNA, 17 bp, Homo sapiens
tgggtctctctcggccc

SEQ ID NO: 4585760 - DNA, 23 bp, Homo sapiens
tgggtctctgaagggaccccccc

SEQ ID NO: 4585761 - DNA, 15 bp, Homo sapiens
tgggtctctgtgtgt

SEQ ID NO: 4585762 - DNA, 17 bp, Homo sapiens
tgggtctgaggcccctg

SEQ ID NO: 4585763 - DNA, 23 bp, Homo sapiens
tgggtctgggatatggctgccca

SEQ ID NO: 4585764 - DNA, 15 bp, Homo sapiens
tgggtctgtgtgtgt

SEQ ID NO: 4585765 - DNA, 15 bp, Homo sapiens
tgggtgacagagtga

SEQ ID NO: 4585766 - DNA, 14 bp, Homo sapiens
tgggtgagagagac

SEQ ID NO: 4585767 - DNA, 17 bp, Homo sapiens
tgggtgataattttgaa

SEQ ID NO: 4585768 - DNA, 23 bp, Homo sapiens
tgggtggaagtgtgtgccaagag

SEQ ID NO: 4585769 - DNA, 16 bp, Homo sapiens
tgggtgggattttgca

SEQ ID NO: 4585770 - DNA, 16 bp, Homo sapiens
tgggtgggcctggccc

SEQ ID NO: 4585771 - DNA, 14 bp, Homo sapiens
tgggtgtcatttca

SEQ ID NO: 4585772 - DNA, 21 bp, Homo sapiens
tgggtgtgctttttgggacca

SEQ ID NO: 4585773 - DNA, 14 bp, Homo sapiens
tgggtgttaatttt

SEQ ID NO: 4585774 - DNA, 16 bp, Homo sapiens
tgggtgttgaccactc

SEQ ID NO: 4585775 - DNA, 22 bp, Homo sapiens
tgggtgttgaccactccagaga

SEQ ID NO: 4585776 - DNA, 15 bp, Homo sapiens
tgggtgtttcagttt

SEQ ID NO: 4585777 - DNA, 17 bp, Homo sapiens
tgggttaattcatttgg

SEQ ID NO: 4585778 - DNA, 17 bp, Homo sapiens
tgggttattctggagtt

SEQ ID NO: 4585779 - DNA, 24 bp, Homo sapiens
tgggttcaggggactcagccctga

SEQ ID NO: 4585780 - DNA, 17 bp, Homo sapiens
tgggttcatgatgcagt

SEQ ID NO: 4585781 - DNA, 14 bp, Homo sapiens
tgggttcttagctt

SEQ ID NO: 4585782 - DNA, 23 bp, Homo sapiens
tgggttgttaatactatattgct

SEQ ID NO: 4585783 - DNA, 15 bp, Homo sapiens
tgggtttctaagcag

SEQ ID NO: 4585784 - DNA, 24 bp, Homo sapiens
tgggttttcttcccatcactggag

SEQ ID NO: 4585785 - DNA, 21 bp, Homo sapiens
tgggttttgtattctctgagc

SEQ ID NO: 4585786 - DNA, 17 bp, Homo sapiens
tgggtttttttccttta

SEQ ID NO: 4585787 - DNA, 12 bp, Homo sapiens
tggtaaaaatgc

SEQ ID NO: 4585788 - DNA, 16 bp, Homo sapiens
tggtaaaaatgctgct

SEQ ID NO: 4585789 - DNA, 19 bp, Homo sapiens
tggtaaaaatgctgctctc

SEQ ID NO: 4585790 - DNA, 15 bp, Homo sapiens
tggtaaaacattact

SEQ ID NO: 4585791 - DNA, 22 bp, Homo sapiens
tggtaaacggtttttattaaag

SEQ ID NO: 4585792 - DNA, 14 bp, Homo sapiens
tggtaagagaaaag

SEQ ID NO: 4585793 - DNA, 16 bp, Homo sapiens
tggtaagcagaggctt

SEQ ID NO: 4585794 - DNA, 21 bp, Homo sapiens
tggtaatctacaccaatgaaa

SEQ ID NO: 4585795 - DNA, 17 bp, Homo sapiens
tggtaatctttacctgt

SEQ ID NO: 4585796 - DNA, 15 bp, Homo sapiens
tggtacacatgtgtt

SEQ ID NO: 4585797 - DNA, 16 bp, Homo sapiens
tggtacacatgtgtta

SEQ ID NO: 4585798 - DNA, 24 bp, Homo sapiens
tggtacttagagtttctgtttgat

SEQ ID NO: 4585799 - DNA, 21 bp, Homo sapiens
tggtagaaaaacatctgaaga

SEQ ID NO: 4585800 - DNA, 19 bp, Homo sapiens
tggtagagacccccaggcc

SEQ ID NO: 4585801 - DNA, 12 bp, Homo sapiens
tggtagagagag

SEQ ID NO: 4585802 - DNA, 14 bp, Homo sapiens
tggtagatgacaaa

SEQ ID NO: 4585803 - DNA, 17 bp, Homo sapiens
tggtagatgacaaatat

SEQ ID NO: 4585804 - DNA, 14 bp, Homo sapiens
tggtagcaaagtaa

SEQ ID NO: 4585805 - DNA, 14 bp, Homo sapiens
tggtagcagcaggc

SEQ ID NO: 4585806 - DNA, 18 bp, Homo sapiens
tggtagccatcaagcact

SEQ ID NO: 4585807 - DNA, 14 bp, Homo sapiens
tggtagctccagcg

SEQ ID NO: 4585808 - DNA, 15 bp, Homo sapiens
tggtagctccagcga

SEQ ID NO: 4585809 - DNA, 18 bp, Homo sapiens
tggtagctccagcgatgg

SEQ ID NO: 4585810 - DNA, 20 bp, Homo sapiens
tggtagctgggaaagcataa

SEQ ID NO: 4585811 - DNA, 22 bp, Homo sapiens
tggtagggtataatgtgtctgt

SEQ ID NO: 4585812 - DNA, 13 bp, Homo sapiens
tggtagtcacttg

SEQ ID NO: 4585813 - DNA, 18 bp, Homo sapiens
tggtagttctgtgcctcc

SEQ ID NO: 4585814 - DNA, 17 bp, Homo sapiens
tggtataaacaggagac

SEQ ID NO: 4585815 - DNA, 13 bp, Homo sapiens
tggtatagaaatg

SEQ ID NO: 4585816 - DNA, 21 bp, Homo sapiens
tggtatattattgcttcatgt

SEQ ID NO: 4585817 - DNA, 18 bp, Homo sapiens
tggtatatttgaaataaa

SEQ ID NO: 4585818 - DNA, 18 bp, Homo sapiens
tggtatcaaaattacata

SEQ ID NO: 4585819 - DNA, 16 bp, Homo sapiens
tggtatgctggccagc

SEQ ID NO: 4585820 - DNA, 17 bp, Homo sapiens
tggtatgctggccagca

SEQ ID NO: 4585821 - DNA, 20 bp, Homo sapiens
tggtatgtgggtgaccctgg

SEQ ID NO: 4585822 - DNA, 13 bp, Homo sapiens
tggtcacagcctc

SEQ ID NO: 4585823 - DNA, 14 bp, Homo sapiens
tggtcacagcctcc

SEQ ID NO: 4585824 - DNA, 15 bp, Homo sapiens
tggtcacagcctcct

SEQ ID NO: 4585825 - DNA, 23 bp, Homo sapiens
tggtcaccgagactcagcctctg

SEQ ID NO: 4585826 - DNA, 19 bp, Homo sapiens
tggtcacgtttggtgcttc

SEQ ID NO: 4585827 - DNA, 15 bp, Homo sapiens
tggtcagcttttgtt

SEQ ID NO: 4585828 - DNA, 22 bp, Homo sapiens
tggtcatggtagatttttttca

SEQ ID NO: 4585829 - DNA, 23 bp, Homo sapiens
tggtccaaaagattgctgaaatt

SEQ ID NO: 4585830 - DNA, 22 bp, Homo sapiens
tggtccagcttgctcttcagtg

SEQ ID NO: 4585831 - DNA, 17 bp, Homo sapiens
tggtccagggaagctgg

SEQ ID NO: 4585832 - DNA, 14 bp, Homo sapiens
tggtcccaagcctg

SEQ ID NO: 4585833 - DNA, 12 bp, Homo sapiens
tggtccctgggg

SEQ ID NO: 4585834 - DNA, 22 bp, Homo sapiens
tggtccctgttttcccacgagg

SEQ ID NO: 4585835 - DNA, 18 bp, Homo sapiens
tggtcccttccaatgctg

SEQ ID NO: 4585836 - DNA, 15 bp, Homo sapiens
tggtccctttaaaga

SEQ ID NO: 4585837 - DNA, 19 bp, Homo sapiens
tggtccggacactcctaga

SEQ ID NO: 4585838 - DNA, 22 bp, Homo sapiens
tggtcctaaaagcaaaataaaa

SEQ ID NO: 4585839 - DNA, 15 bp, Homo sapiens
tggtcctggcagggc

SEQ ID NO: 4585840 - DNA, 14 bp, Homo sapiens
tggtcctggtgctg

SEQ ID NO: 4585841 - DNA, 20 bp, Homo sapiens
tggtcggatctcacaggctg

SEQ ID NO: 4585842 - DNA, 20 bp, Homo sapiens
tggtcgtcaactttcctcaa

SEQ ID NO: 4585843 - DNA, 22 bp, Homo sapiens
tggtctcaaaatggtgtgctat

SEQ ID NO: 4585844 - DNA, 15 bp, Homo sapiens
tggtctcccttctct

SEQ ID NO: 4585845 - DNA, 18 bp, Homo sapiens
tggtctggagttgctgaa

SEQ ID NO: 4585846 - DNA, 18 bp, Homo sapiens
tggtctggttcctgtgtg

SEQ ID NO: 4585847 - DNA, 22 bp, Homo sapiens
tggtcttccttctaccccaagg

SEQ ID NO: 4585848 - DNA, 22 bp, Homo sapiens
tggtgaaatcccatctctacaa

SEQ ID NO: 4585849 - DNA, 11 bp, Homo sapiens
tggtgaaatct

SEQ ID NO: 4585850 - DNA, 18 bp, Homo sapiens
tggtgaaatcttgtttgt

SEQ ID NO: 4585851 - DNA, 20 bp, Homo sapiens
tggtgaagtaaattaggcag

SEQ ID NO: 4585852 - DNA, 23 bp, Homo sapiens
tggtgaagtaaattaggcagtgc

SEQ ID NO: 4585853 - DNA, 13 bp, Homo sapiens
tggtgaagtgtgg

SEQ ID NO: 4585854 - DNA, 15 bp, Homo sapiens
tggtgaagtgtggct

SEQ ID NO: 4585855 - DNA, 18 bp, Homo sapiens
tggtgaagtgtggctggt

SEQ ID NO: 4585856 - DNA, 20 bp, Homo sapiens
tggtgacaaaattcatttgc

SEQ ID NO: 4585857 - DNA, 17 bp, Homo sapiens
tggtgacacctccccct

SEQ ID NO: 4585858 - DNA, 19 bp, Homo sapiens
tggtgaccagtttcttaaa

SEQ ID NO: 4585859 - DNA, 22 bp, Homo sapiens
tggtgaccagtttcttaaactg

SEQ ID NO: 4585860 - DNA, 21 bp, Homo sapiens
tggtgactcacttcaatgtgt

SEQ ID NO: 4585861 - DNA, 13 bp, Homo sapiens
tggtgactcctga

SEQ ID NO: 4585862 - DNA, 13 bp, Homo sapiens
tggtgactgtccc

SEQ ID NO: 4585863 - DNA, 14 bp, Homo sapiens
tggtgactgtccca

SEQ ID NO: 4585864 - DNA, 15 bp, Homo sapiens
tggtgactgtcccac

SEQ ID NO: 4585865 - DNA, 19 bp, Homo sapiens
tggtgactgtcccaccggg

SEQ ID NO: 4585866 - DNA, 13 bp, Homo sapiens
tggtgacttctgc

SEQ ID NO: 4585867 - DNA, 19 bp, Homo sapiens
tggtgagagtcaaagctga

SEQ ID NO: 4585868 - DNA, 17 bp, Homo sapiens
tggtgcaaattcagaac

SEQ ID NO: 4585869 - DNA, 19 bp, Homo sapiens
tggtgcactttgtaaattc

SEQ ID NO: 4585870 - DNA, 20 bp, Homo sapiens
tggtgccatttctgaactgt

SEQ ID NO: 4585871 - DNA, 15 bp, Homo sapiens
tggtgcccctgctca

SEQ ID NO: 4585872 - DNA, 15 bp, Homo sapiens
tggtgcctgagaggc

SEQ ID NO: 4585873 - DNA, 17 bp, Homo sapiens
tggtgcctgagaggcag

SEQ ID NO: 4585874 - DNA, 18 bp, Homo sapiens
tggtgcctgagaggcagg

SEQ ID NO: 4585875 - DNA, 19 bp, Homo sapiens
tggtgcctgagaggcaggc

SEQ ID NO: 4585876 - DNA, 20 bp, Homo sapiens
tggtgcctgagaggcaggca

SEQ ID NO: 4585877 - DNA, 19 bp, Homo sapiens
tggtgcctttcctgttcag

SEQ ID NO: 4585878 - DNA, 15 bp, Homo sapiens
tggtgctaaaggagg

SEQ ID NO: 4585879 - DNA, 16 bp, Homo sapiens
tggtgctatttaacat

SEQ ID NO: 4585880 - DNA, 15 bp, Homo sapiens
tggtgctgcccaggc

SEQ ID NO: 4585881 - DNA, 16 bp, Homo sapiens
tggtgctgccgagggc

SEQ ID NO: 4585882 - DNA, 18 bp, Homo sapiens
tggtgctgccgagggctg

SEQ ID NO: 4585883 - DNA, 13 bp, Homo sapiens
tggtgctgtttaa

SEQ ID NO: 4585884 - DNA, 18 bp, Homo sapiens
tggtgcttattcttaact

SEQ ID NO: 4585885 - DNA, 11 bp, Homo sapiens
tggtgctttcc

SEQ ID NO: 4585886 - DNA, 15 bp, Homo sapiens
tggtgctttccttca

SEQ ID NO: 4585887 - DNA, 22 bp, Homo sapiens
tggtggaggaagggctgggcca

SEQ ID NO: 4585888 - DNA, 14 bp, Homo sapiens
tggtggatgtaaat

SEQ ID NO: 4585889 - DNA, 16 bp, Homo sapiens
tggtggcaccagatgc

SEQ ID NO: 4585890 - DNA, 11 bp, Homo sapiens
tggtggcctat

SEQ ID NO: 4585891 - DNA, 16 bp, Homo sapiens
tggtggcctggtccct

SEQ ID NO: 4585892 - DNA, 16 bp, Homo sapiens
tggtgggtccatgggc

SEQ ID NO: 4585893 - DNA, 11 bp, Homo sapiens
tggtggtgcta

SEQ ID NO: 4585894 - DNA, 14 bp, Homo sapiens
tggtgtcatttagt

SEQ ID NO: 4585895 - DNA, 14 bp, Homo sapiens
tggtgtcattttct

SEQ ID NO: 4585896 - DNA, 16 bp, Homo sapiens
tggtgtccccttcccc

SEQ ID NO: 4585897 - DNA, 11 bp, Homo sapiens
tggtgtctccc

SEQ ID NO: 4585898 - DNA, 16 bp, Homo sapiens
tggtgtgatcgtctga

SEQ ID NO: 4585899 - DNA, 11 bp, Homo sapiens
tggtgtgtttc

SEQ ID NO: 4585900 - DNA, 18 bp, Homo sapiens
tggtgttcgtttccatca

SEQ ID NO: 4585901 - DNA, 21 bp, Homo sapiens
tggtgttctaagactctgtgt

SEQ ID NO: 4585902 - DNA, 21 bp, Homo sapiens
tggtgtttctagcactggcct

SEQ ID NO: 4585903 - DNA, 16 bp, Homo sapiens
tggtgtttgactgtaa

SEQ ID NO: 4585904 - DNA, 18 bp, Homo sapiens
tggtgtttgactgtaatg

SEQ ID NO: 4585905 - DNA, 16 bp, Homo sapiens
tggtgtttgtctgtgt

SEQ ID NO: 4585906 - DNA, 17 bp, Homo sapiens
tggtgttttgtcagact

SEQ ID NO: 4585907 - DNA, 18 bp, Homo sapiens
tggttaaaacatagcttt

SEQ ID NO: 4585908 - DNA, 14 bp, Homo sapiens
tggttaaaatgtga

SEQ ID NO: 4585909 - DNA, 18 bp, Homo sapiens
tggttaagagaatgaatt

SEQ ID NO: 4585910 - DNA, 17 bp, Homo sapiens
tggttaagggctcccta

SEQ ID NO: 4585911 - DNA, 22 bp, Homo sapiens
tggttacactgttagaacacta

SEQ ID NO: 4585912 - DNA, 14 bp, Homo sapiens
tggttactttcaaa

SEQ ID NO: 4585913 - DNA, 17 bp, Homo sapiens
tggttactttcaaaatg

SEQ ID NO: 4585914 - DNA, 14 bp, Homo sapiens
tggttatggagtct

SEQ ID NO: 4585915 - DNA, 17 bp, Homo sapiens
tggttatgttgataaac

SEQ ID NO: 4585916 - DNA, 16 bp, Homo sapiens
tggttccccagtagag

SEQ ID NO: 4585917 - DNA, 14 bp, Homo sapiens
tggttctaaatatt

SEQ ID NO: 4585918 - DNA, 17 bp, Homo sapiens
tggttctaactgctgtt

SEQ ID NO: 4585919 - DNA, 18 bp, Homo sapiens
tggttctgtgacccatct

SEQ ID NO: 4585920 - DNA, 15 bp, Homo sapiens
tggttctttcagctg

SEQ ID NO: 4585921 - DNA, 16 bp, Homo sapiens
tggttgaaaataaaaa

SEQ ID NO: 4585922 - DNA, 15 bp, Homo sapiens
tggttgaggtggaag

SEQ ID NO: 4585923 - DNA, 16 bp, Homo sapiens
tggttgcactttgtag

SEQ ID NO: 4585924 - DNA, 12 bp, Homo sapiens
tggttgcctccc

SEQ ID NO: 4585925 - DNA, 15 bp, Homo sapiens
tggttgggggaatgc

SEQ ID NO: 4585926 - DNA, 17 bp, Homo sapiens
tggttgggttgattgta

SEQ ID NO: 4585927 - DNA, 15 bp, Homo sapiens
tggtttaaaagaaaa

SEQ ID NO: 4585928 - DNA, 17 bp, Homo sapiens
tggtttaaagaaagtgt

SEQ ID NO: 4585929 - DNA, 19 bp, Homo sapiens
tggtttaaagaaagtgtat

SEQ ID NO: 4585930 - DNA, 20 bp, Homo sapiens
tggtttagttataaaaggct

SEQ ID NO: 4585931 - DNA, 14 bp, Homo sapiens
tggtttcctcgaga

SEQ ID NO: 4585932 - DNA, 16 bp, Homo sapiens
tggtttcttattcaaa

SEQ ID NO: 4585933 - DNA, 18 bp, Homo sapiens
tggtttcttattcaaaga

SEQ ID NO: 4585934 - DNA, 14 bp, Homo sapiens
tggtttgcaagaat

SEQ ID NO: 4585935 - DNA, 12 bp, Homo sapiens
tggtttgcacaa

SEQ ID NO: 4585936 - DNA, 11 bp, Homo sapiens
tggtttggaat

SEQ ID NO: 4585937 - DNA, 16 bp, Homo sapiens
tggtttgtacatatca

SEQ ID NO: 4585938 - DNA, 23 bp, Homo sapiens
tggttttatactgaaggaaaaac

SEQ ID NO: 4585939 - DNA, 12 bp, Homo sapiens
tggttttccatg

SEQ ID NO: 4585940 - DNA, 16 bp, Homo sapiens
tggtttttcagttttc

SEQ ID NO: 4585941 - DNA, 14 bp, Homo sapiens
tggtttttgctctc

SEQ ID NO: 4585942 - DNA, 16 bp, Homo sapiens
tgtaaaaaatggagct

SEQ ID NO: 4585943 - DNA, 18 bp, Homo sapiens
tgtaaaaatccttttgaa

SEQ ID NO: 4585944 - DNA, 17 bp, Homo sapiens
tgtaaaaatgaaggaat

SEQ ID NO: 4585945 - DNA, 13 bp, Homo sapiens
tgtaaaacaggta

SEQ ID NO: 4585946 - DNA, 14 bp, Homo sapiens
tgtaaaactttatt

SEQ ID NO: 4585947 - DNA, 13 bp, Homo sapiens
tgtaaaagaaatc

SEQ ID NO: 4585948 - DNA, 12 bp, Homo sapiens
tgtaaaataatt

SEQ ID NO: 4585949 - DNA, 20 bp, Homo sapiens
tgtaaaatattttgaatcaa

SEQ ID NO: 4585950 - DNA, 17 bp, Homo sapiens
tgtaaaatgaattgaaa

SEQ ID NO: 4585951 - DNA, 21 bp, Homo sapiens
tgtaaaatgaattgaaaaaca

SEQ ID NO: 4585952 - DNA, 13 bp, Homo sapiens
tgtaaaatgagtt

SEQ ID NO: 4585953 - DNA, 14 bp, Homo sapiens
tgtaaaatgagttt

SEQ ID NO: 4585954 - DNA, 13 bp, Homo sapiens
tgtaaaatgcttt

SEQ ID NO: 4585955 - DNA, 22 bp, Homo sapiens
tgtaaaatgcttttcactttct

SEQ ID NO: 4585956 - DNA, 23 bp, Homo sapiens
tgtaaaatgcttttcactttctg

SEQ ID NO: 4585957 - DNA, 11 bp, Homo sapiens
tgtaaaatggt

SEQ ID NO: 4585958 - DNA, 15 bp, Homo sapiens
tgtaaaatgtattat

SEQ ID NO: 4585959 - DNA, 13 bp, Homo sapiens
tgtaaaattaatg

SEQ ID NO: 4585960 - DNA, 22 bp, Homo sapiens
tgtaaaattaatgtaataaagt

SEQ ID NO: 4585961 - DNA, 22 bp, Homo sapiens
tgtaaaatttgtgtaaatttgt

SEQ ID NO: 4585962 - DNA, 18 bp, Homo sapiens
tgtaaacagcctcttttt

SEQ ID NO: 4585963 - DNA, 12 bp, Homo sapiens
tgtaaacagtgc

SEQ ID NO: 4585964 - DNA, 17 bp, Homo sapiens
tgtaaacagtgcctgct

SEQ ID NO: 4585965 - DNA, 19 bp, Homo sapiens
tgtaaacagtgcctgctga

SEQ ID NO: 4585966 - DNA, 22 bp, Homo sapiens
tgtaaactctcttctctttctc

SEQ ID NO: 4585967 - DNA, 14 bp, Homo sapiens
tgtaaactgtgcac

SEQ ID NO: 4585968 - DNA, 13 bp, Homo sapiens
tgtaaactgtgta

SEQ ID NO: 4585969 - DNA, 19 bp, Homo sapiens
tgtaaactgtgtattccaa

SEQ ID NO: 4585970 - DNA, 13 bp, Homo sapiens
tgtaaactttttg

SEQ ID NO: 4585971 - DNA, 18 bp, Homo sapiens
tgtaaagatatttttatc

SEQ ID NO: 4585972 - DNA, 21 bp, Homo sapiens
tgtaaaggagtcaaaactaca

SEQ ID NO: 4585973 - DNA, 19 bp, Homo sapiens
tgtaaagtatttgatgtac

SEQ ID NO: 4585974 - DNA, 21 bp, Homo sapiens
tgtaaagttatgtatttaaag

SEQ ID NO: 4585975 - DNA, 14 bp, Homo sapiens
tgtaaataaaaaga

SEQ ID NO: 4585976 - DNA, 12 bp, Homo sapiens
tgtaaataaact

SEQ ID NO: 4585977 - DNA, 14 bp, Homo sapiens
tgtaaataaactat

SEQ ID NO: 4585978 - DNA, 19 bp, Homo sapiens
tgtaaataaccccattctt

SEQ ID NO: 4585979 - DNA, 15 bp, Homo sapiens
tgtaaataatttatt

SEQ ID NO: 4585980 - DNA, 18 bp, Homo sapiens
tgtaaataggttcttctt

SEQ ID NO: 4585981 - DNA, 14 bp, Homo sapiens
tgtaaatattttaa

SEQ ID NO: 4585982 - DNA, 17 bp, Homo sapiens
tgtaaatcctgtgtttc

SEQ ID NO: 4585983 - DNA, 16 bp, Homo sapiens
tgtaaatctaacatta

SEQ ID NO: 4585984 - DNA, 11 bp, Homo sapiens
tgtaaatgcct

SEQ ID NO: 4585985 - DNA, 20 bp, Homo sapiens
tgtaaatgcttaaatttcag

SEQ ID NO: 4585986 - DNA, 12 bp, Homo sapiens
tgtaaatgtgtt

SEQ ID NO: 4585987 - DNA, 12 bp, Homo sapiens
tgtaaattattt

SEQ ID NO: 4585988 - DNA, 14 bp, Homo sapiens
tgtaacatctgcca

SEQ ID NO: 4585989 - DNA, 18 bp, Homo sapiens
tgtaaccacaactttcac

SEQ ID NO: 4585990 - DNA, 12 bp, Homo sapiens
tgtaactgttac

SEQ ID NO: 4585991 - DNA, 22 bp, Homo sapiens
tgtaacttgcttaaatttctta

SEQ ID NO: 4585992 - DNA, 18 bp, Homo sapiens
tgtaagaactacaaacaa

SEQ ID NO: 4585993 - DNA, 12 bp, Homo sapiens
tgtaagaactgt

SEQ ID NO: 4585994 - DNA, 15 bp, Homo sapiens
tgtaagaactgtaca

SEQ ID NO: 4585995 - DNA, 21 bp, Homo sapiens
tgtaagaactgtacattgtga

SEQ ID NO: 4585996 - DNA, 20 bp, Homo sapiens
tgtaagaagcggcatagcac

SEQ ID NO: 4585997 - DNA, 22 bp, Homo sapiens
tgtaagaagcggcatagcaccc

SEQ ID NO: 4585998 - DNA, 12 bp, Homo sapiens
tgtaagaataat

SEQ ID NO: 4585999 - DNA, 18 bp, Homo sapiens
tgtaagacccttattgct

SEQ ID NO: 4586000 - DNA, 22 bp, Homo sapiens
tgtaagacccttattgctgtcc

SEQ ID NO: 4586001 - DNA, 18 bp, Homo sapiens
tgtaagcactctggatga

SEQ ID NO: 4586002 - DNA, 20 bp, Homo sapiens
tgtaagcatactttgtaaat

SEQ ID NO: 4586003 - DNA, 20 bp, Homo sapiens
tgtaagcatttgtacatctt

SEQ ID NO: 4586004 - DNA, 15 bp, Homo sapiens
tgtaagccaaagaaa

SEQ ID NO: 4586005 - DNA, 21 bp, Homo sapiens
tgtaagccaaagaaatgaaca

SEQ ID NO: 4586006 - DNA, 19 bp, Homo sapiens
tgtaaggatccggaaagaa

SEQ ID NO: 4586007 - DNA, 19 bp, Homo sapiens
tgtaagggaaactgccagc

SEQ ID NO: 4586008 - DNA, 22 bp, Homo sapiens
tgtaaggggaagagggaaatgt

SEQ ID NO: 4586009 - DNA, 20 bp, Homo sapiens
tgtaaggtgcttgctcccca

SEQ ID NO: 4586010 - DNA, 15 bp, Homo sapiens
tgtaagtatgtgaaa

SEQ ID NO: 4586011 - DNA, 12 bp, Homo sapiens
tgtaataaagtg

SEQ ID NO: 4586012 - DNA, 20 bp, Homo sapiens
tgtaataaagtgaactttgt

SEQ ID NO: 4586013 - DNA, 18 bp, Homo sapiens
tgtaataaagtgttttca

SEQ ID NO: 4586014 - DNA, 20 bp, Homo sapiens
tgtaataaagtgttttcaga

SEQ ID NO: 4586015 - DNA, 18 bp, Homo sapiens
tgtaataactttcttacc

SEQ ID NO: 4586016 - DNA, 14 bp, Homo sapiens
tgtaataatcattt

SEQ ID NO: 4586017 - DNA, 16 bp, Homo sapiens
tgtaataatgtacaga

SEQ ID NO: 4586018 - DNA, 19 bp, Homo sapiens
tgtaatacttctttgttat

SEQ ID NO: 4586019 - DNA, 15 bp, Homo sapiens
tgtaatataatgtat

SEQ ID NO: 4586020 - DNA, 16 bp, Homo sapiens
tgtaatataatgtatt

SEQ ID NO: 4586021 - DNA, 23 bp, Homo sapiens
tgtaatatagaaaaaaacattct

SEQ ID NO: 4586022 - DNA, 18 bp, Homo sapiens
tgtaatatatttatatac

SEQ ID NO: 4586023 - DNA, 14 bp, Homo sapiens
tgtaatattctgtt

SEQ ID NO: 4586024 - DNA, 16 bp, Homo sapiens
tgtaatattctgtttt

SEQ ID NO: 4586025 - DNA, 13 bp, Homo sapiens
tgtaatatttaca

SEQ ID NO: 4586026 - DNA, 14 bp, Homo sapiens
tgtaatatttacaa

SEQ ID NO: 4586027 - DNA, 20 bp, Homo sapiens
tgtaatcattttaaattcca

SEQ ID NO: 4586028 - DNA, 13 bp, Homo sapiens
tgtaatcccagaa

SEQ ID NO: 4586029 - DNA, 14 bp, Homo sapiens
tgtaatcccagcac

SEQ ID NO: 4586030 - DNA, 21 bp, Homo sapiens
tgtaatcccagcactttggga

SEQ ID NO: 4586031 - DNA, 18 bp, Homo sapiens
tgtaatctaagtatatgt

SEQ ID NO: 4586032 - DNA, 22 bp, Homo sapiens
tgtaatctgcaaaatgtagaaa

SEQ ID NO: 4586033 - DNA, 21 bp, Homo sapiens
tgtaatcttgaattgtaactg

SEQ ID NO: 4586034 - DNA, 17 bp, Homo sapiens
tgtaatcttttatttaa

SEQ ID NO: 4586035 - DNA, 15 bp, Homo sapiens
tgtaatgaagtaaag

SEQ ID NO: 4586036 - DNA, 20 bp, Homo sapiens
tgtaatggagcatcaagcca

SEQ ID NO: 4586037 - DNA, 12 bp, Homo sapiens
tgtaatgtaaat

SEQ ID NO: 4586038 - DNA, 13 bp, Homo sapiens
tgtaatgtaaata

SEQ ID NO: 4586039 - DNA, 20 bp, Homo sapiens
tgtaatgtaggcacttttat

SEQ ID NO: 4586040 - DNA, 23 bp, Homo sapiens
tgtaatgtcaccaccttcccagc

SEQ ID NO: 4586041 - DNA, 14 bp, Homo sapiens
tgtaattaactgta

SEQ ID NO: 4586042 - DNA, 20 bp, Homo sapiens
tgtaattaataactttctct

SEQ ID NO: 4586043 - DNA, 22 bp, Homo sapiens
tgtaattaataactttctctgt

SEQ ID NO: 4586044 - DNA, 24 bp, Homo sapiens
tgtaattaataactttctctgtga

SEQ ID NO: 4586045 - DNA, 21 bp, Homo sapiens
tgtaattatgttctaagtgcc

SEQ ID NO: 4586046 - DNA, 23 bp, Homo sapiens
tgtaattgcactttttaagtttg

SEQ ID NO: 4586047 - DNA, 16 bp, Homo sapiens
tgtaattgtaattcca

SEQ ID NO: 4586048 - DNA, 21 bp, Homo sapiens
tgtaatttaaaattgtgatgt

SEQ ID NO: 4586049 - DNA, 17 bp, Homo sapiens
tgtaatttcgccttaaa

SEQ ID NO: 4586050 - DNA, 19 bp, Homo sapiens
tgtaatttctttaaatgtg

SEQ ID NO: 4586051 - DNA, 12 bp, Homo sapiens
tgtaatttgaat

SEQ ID NO: 4586052 - DNA, 13 bp, Homo sapiens
tgtaatttgtgta

SEQ ID NO: 4586053 - DNA, 20 bp, Homo sapiens
tgtaattttattttaaaatt

SEQ ID NO: 4586054 - DNA, 23 bp, Homo sapiens
tgtaattttattttaaaatttca

SEQ ID NO: 4586055 - DNA, 15 bp, Homo sapiens
tgtacaaacagtatt

SEQ ID NO: 4586056 - DNA, 13 bp, Homo sapiens
tgtacaaccctga

SEQ ID NO: 4586057 - DNA, 16 bp, Homo sapiens
tgtacaatacaatgta

SEQ ID NO: 4586058 - DNA, 21 bp, Homo sapiens
tgtacaattttaaagttctta

SEQ ID NO: 4586059 - DNA, 22 bp, Homo sapiens
tgtacacactggtacttagagt

SEQ ID NO: 4586060 - DNA, 13 bp, Homo sapiens
tgtacacacttta

SEQ ID NO: 4586061 - DNA, 12 bp, Homo sapiens
tgtacacagtca

SEQ ID NO: 4586062 - DNA, 17 bp, Homo sapiens
tgtacacatttcttaaa

SEQ ID NO: 4586063 - DNA, 21 bp, Homo sapiens
tgtacacatttcttaaaacac

SEQ ID NO: 4586064 - DNA, 16 bp, Homo sapiens
tgtacaccacatgcta

SEQ ID NO: 4586065 - DNA, 21 bp, Homo sapiens
tgtacactttttacagcagca

SEQ ID NO: 4586066 - DNA, 21 bp, Homo sapiens
tgtacagaaaagggcggcttc

SEQ ID NO: 4586067 - DNA, 17 bp, Homo sapiens
tgtacagacatatttaa

SEQ ID NO: 4586068 - DNA, 20 bp, Homo sapiens
tgtacagacatatttaactg

SEQ ID NO: 4586069 - DNA, 12 bp, Homo sapiens
tgtacagactct

SEQ ID NO: 4586070 - DNA, 18 bp, Homo sapiens
tgtacagaggtcagcaca

SEQ ID NO: 4586071 - DNA, 20 bp, Homo sapiens
tgtacagcaagatgtttctt

SEQ ID NO: 4586072 - DNA, 16 bp, Homo sapiens
tgtacagtctgtcatg

SEQ ID NO: 4586073 - DNA, 23 bp, Homo sapiens
tgtacagtctgtcatgaacatgt

SEQ ID NO: 4586074 - DNA, 17 bp, Homo sapiens
tgtacagtcttgtatta

SEQ ID NO: 4586075 - DNA, 16 bp, Homo sapiens
tgtacagttgagctca

SEQ ID NO: 4586076 - DNA, 17 bp, Homo sapiens
tgtacataactcctgtc

SEQ ID NO: 4586077 - DNA, 19 bp, Homo sapiens
tgtacataactgaaaatgt

SEQ ID NO: 4586078 - DNA, 14 bp, Homo sapiens
tgtacataattgca

SEQ ID NO: 4586079 - DNA, 14 bp, Homo sapiens
tgtacatacaaatt

SEQ ID NO: 4586080 - DNA, 19 bp, Homo sapiens
tgtacatctattttggatt

SEQ ID NO: 4586081 - DNA, 17 bp, Homo sapiens
tgtacattacagattaa

SEQ ID NO: 4586082 - DNA, 16 bp, Homo sapiens
tgtacatttgggagtt

SEQ ID NO: 4586083 - DNA, 14 bp, Homo sapiens
tgtacattttgtaa

SEQ ID NO: 4586084 - DNA, 15 bp, Homo sapiens
tgtaccaagtgcttc

SEQ ID NO: 4586085 - DNA, 18 bp, Homo sapiens
tgtaccaagtgcttccta

SEQ ID NO: 4586086 - DNA, 20 bp, Homo sapiens
tgtaccagtgaatttttgca

SEQ ID NO: 4586087 - DNA, 12 bp, Homo sapiens
tgtaccagttaa

SEQ ID NO: 4586088 - DNA, 21 bp, Homo sapiens
tgtaccagttaatttttccaa

SEQ ID NO: 4586089 - DNA, 17 bp, Homo sapiens
tgtaccatggtttgata

SEQ ID NO: 4586090 - DNA, 20 bp, Homo sapiens
tgtaccatggtttgatatgt

SEQ ID NO: 4586091 - DNA, 22 bp, Homo sapiens
tgtaccgtaggctttgtattca

SEQ ID NO: 4586092 - DNA, 16 bp, Homo sapiens
tgtacctgtggctgtg

SEQ ID NO: 4586093 - DNA, 18 bp, Homo sapiens
tgtacggattttcagtta

SEQ ID NO: 4586094 - DNA, 21 bp, Homo sapiens
tgtacggattttcagttactt

SEQ ID NO: 4586095 - DNA, 15 bp, Homo sapiens
tgtacgttatatatt

SEQ ID NO: 4586096 - DNA, 12 bp, Homo sapiens
tgtactacagct

SEQ ID NO: 4586097 - DNA, 21 bp, Homo sapiens
tgtactacagctatatttgat

SEQ ID NO: 4586098 - DNA, 15 bp, Homo sapiens
tgtactagtctgtgt

SEQ ID NO: 4586099 - DNA, 19 bp, Homo sapiens
tgtactagtctgtgtggga

SEQ ID NO: 4586100 - DNA, 18 bp, Homo sapiens
tgtactatcctgtaaata

SEQ ID NO: 4586101 - DNA, 19 bp, Homo sapiens
tgtactccagcctgggcaa

SEQ ID NO: 4586102 - DNA, 12 bp, Homo sapiens
tgtactgaattc

SEQ ID NO: 4586103 - DNA, 15 bp, Homo sapiens
tgtactgaattcttt

SEQ ID NO: 4586104 - DNA, 16 bp, Homo sapiens
tgtactggttcattgt

SEQ ID NO: 4586105 - DNA, 19 bp, Homo sapiens
tgtactgtgtcataaacag

SEQ ID NO: 4586106 - DNA, 18 bp, Homo sapiens
tgtactgtgtttttaaat

SEQ ID NO: 4586107 - DNA, 19 bp, Homo sapiens
tgtactgttgctttaatat

SEQ ID NO: 4586108 - DNA, 19 bp, Homo sapiens
tgtacttaaatgagttact

SEQ ID NO: 4586109 - DNA, 22 bp, Homo sapiens
tgtacttaaatgagttacttag

SEQ ID NO: 4586110 - DNA, 17 bp, Homo sapiens
tgtacttcctgagtggc

SEQ ID NO: 4586111 - DNA, 23 bp, Homo sapiens
tgtacttgccctgaccatgcatt

SEQ ID NO: 4586112 - DNA, 22 bp, Homo sapiens
tgtacttgcttgtattgtaaat

SEQ ID NO: 4586113 - DNA, 20 bp, Homo sapiens
tgtactttatatcttgttta

SEQ ID NO: 4586114 - DNA, 20 bp, Homo sapiens
tgtactttatcatgaatgct

SEQ ID NO: 4586115 - DNA, 15 bp, Homo sapiens
tgtactttttagtaa

SEQ ID NO: 4586116 - DNA, 19 bp, Homo sapiens
tgtagaaaagggaactgaa

SEQ ID NO: 4586117 - DNA, 23 bp, Homo sapiens
tgtagaaaagggaactgaacatt

SEQ ID NO: 4586118 - DNA, 18 bp, Homo sapiens
tgtagaaacttaaacaca

SEQ ID NO: 4586119 - DNA, 19 bp, Homo sapiens
tgtagaaggagtagctgcc

SEQ ID NO: 4586120 - DNA, 15 bp, Homo sapiens
tgtagaataaatgaa

SEQ ID NO: 4586121 - DNA, 21 bp, Homo sapiens
tgtagaataaatggtttctca

SEQ ID NO: 4586122 - DNA, 16 bp, Homo sapiens
tgtagacataaagaag

SEQ ID NO: 4586123 - DNA, 21 bp, Homo sapiens
tgtagactctaagatacactg

SEQ ID NO: 4586124 - DNA, 14 bp, Homo sapiens
tgtagactgtttca

SEQ ID NO: 4586125 - DNA, 14 bp, Homo sapiens
tgtagagggccctg

SEQ ID NO: 4586126 - DNA, 22 bp, Homo sapiens
tgtagattgattgtattgttga

SEQ ID NO: 4586127 - DNA, 13 bp, Homo sapiens
tgtagatttctga

SEQ ID NO: 4586128 - DNA, 12 bp, Homo sapiens
tgtagatttgaa

SEQ ID NO: 4586129 - DNA, 13 bp, Homo sapiens
tgtagatttgaaa

SEQ ID NO: 4586130 - DNA, 22 bp, Homo sapiens
tgtagcaaaattcttaagtatg

SEQ ID NO: 4586131 - DNA, 20 bp, Homo sapiens
tgtagcaactacagtctaaa

SEQ ID NO: 4586132 - DNA, 14 bp, Homo sapiens
tgtagcaagctgag

SEQ ID NO: 4586133 - DNA, 22 bp, Homo sapiens
tgtagcaggggaattccctccc

SEQ ID NO: 4586134 - DNA, 14 bp, Homo sapiens
tgtagcatataaat

SEQ ID NO: 4586135 - DNA, 13 bp, Homo sapiens
tgtagccacagct

SEQ ID NO: 4586136 - DNA, 18 bp, Homo sapiens
tgtagccacagctgctgt

SEQ ID NO: 4586137 - DNA, 23 bp, Homo sapiens
tgtagccacagctgctgttctca

SEQ ID NO: 4586138 - DNA, 20 bp, Homo sapiens
tgtagccactagtaagtaat

SEQ ID NO: 4586139 - DNA, 15 bp, Homo sapiens
tgtagccagctgtgc

SEQ ID NO: 4586140 - DNA, 19 bp, Homo sapiens
tgtagctgaaaataaaatg

SEQ ID NO: 4586141 - DNA, 15 bp, Homo sapiens
tgtagctgaggaggc

SEQ ID NO: 4586142 - DNA, 19 bp, Homo sapiens
tgtagcttcagtcattaaa

SEQ ID NO: 4586143 - DNA, 15 bp, Homo sapiens
tgtagctttcctggt

SEQ ID NO: 4586144 - DNA, 20 bp, Homo sapiens
tgtagctttcctggtccctc

SEQ ID NO: 4586145 - DNA, 11 bp, Homo sapiens
tgtaggagaat

SEQ ID NO: 4586146 - DNA, 24 bp, Homo sapiens
tgtagggcacccaaaactcaagca

SEQ ID NO: 4586147 - DNA, 18 bp, Homo sapiens
tgtagggtaaggtgcctt

SEQ ID NO: 4586148 - DNA, 18 bp, Homo sapiens
tgtagggtttggacagac

SEQ ID NO: 4586149 - DNA, 15 bp, Homo sapiens
tgtaggtaaaatgta

SEQ ID NO: 4586150 - DNA, 12 bp, Homo sapiens
tgtaggtgactt

SEQ ID NO: 4586151 - DNA, 18 bp, Homo sapiens
tgtaggtgtctgccttca

SEQ ID NO: 4586152 - DNA, 14 bp, Homo sapiens
tgtagtaagatttg

SEQ ID NO: 4586153 - DNA, 23 bp, Homo sapiens
tgtagtagcgttttttaaatgta

SEQ ID NO: 4586154 - DNA, 14 bp, Homo sapiens
tgtagtatctcata

SEQ ID NO: 4586155 - DNA, 15 bp, Homo sapiens
tgtagtcaataaaac

SEQ ID NO: 4586156 - DNA, 19 bp, Homo sapiens
tgtagtgatggagttcctt

SEQ ID NO: 4586157 - DNA, 17 bp, Homo sapiens
tgtagtgattaaatata

SEQ ID NO: 4586158 - DNA, 20 bp, Homo sapiens
tgtagtgatttttatgccac

SEQ ID NO: 4586159 - DNA, 18 bp, Homo sapiens
tgtagttcaatttcatgt

SEQ ID NO: 4586160 - DNA, 19 bp, Homo sapiens
tgtagtttttatatgttgt

SEQ ID NO: 4586161 - DNA, 17 bp, Homo sapiens
tgtataaaaattatcaa

SEQ ID NO: 4586162 - DNA, 19 bp, Homo sapiens
tgtataaaaattatcaaaa

SEQ ID NO: 4586163 - DNA, 20 bp, Homo sapiens
tgtataaaacattaattgct

SEQ ID NO: 4586164 - DNA, 16 bp, Homo sapiens
tgtataaactgtattt

SEQ ID NO: 4586165 - DNA, 19 bp, Homo sapiens
tgtataacagccttttcct

SEQ ID NO: 4586166 - DNA, 19 bp, Homo sapiens
tgtataagccacttgtctt

SEQ ID NO: 4586167 - DNA, 18 bp, Homo sapiens
tgtataagctactcactt

SEQ ID NO: 4586168 - DNA, 22 bp, Homo sapiens
tgtataaggagattctgtgtat

SEQ ID NO: 4586169 - DNA, 18 bp, Homo sapiens
tgtataatagagataagt

SEQ ID NO: 4586170 - DNA, 20 bp, Homo sapiens
tgtataatattgaaaattga

SEQ ID NO: 4586171 - DNA, 22 bp, Homo sapiens
tgtataatcacagttgtgttcc

SEQ ID NO: 4586172 - DNA, 20 bp, Homo sapiens
tgtataatcccacccacctc

SEQ ID NO: 4586173 - DNA, 14 bp, Homo sapiens
tgtataatctattt

SEQ ID NO: 4586174 - DNA, 15 bp, Homo sapiens
tgtataatgactttt

SEQ ID NO: 4586175 - DNA, 16 bp, Homo sapiens
tgtatacagtgcagag

SEQ ID NO: 4586176 - DNA, 22 bp, Homo sapiens
tgtatacagtgcagagccttct

SEQ ID NO: 4586177 - DNA, 23 bp, Homo sapiens
tgtatacagtgcagagccttctc

SEQ ID NO: 4586178 - DNA, 13 bp, Homo sapiens
tgtatactttaaa

SEQ ID NO: 4586179 - DNA, 16 bp, Homo sapiens
tgtatagtgttcacaa

SEQ ID NO: 4586180 - DNA, 20 bp, Homo sapiens
tgtatagtgttcacaaactg

SEQ ID NO: 4586181 - DNA, 14 bp, Homo sapiens
tgtatagttgcttt

SEQ ID NO: 4586182 - DNA, 15 bp, Homo sapiens
tgtatagttgctttt

SEQ ID NO: 4586183 - DNA, 17 bp, Homo sapiens
tgtatagttgcttttga

SEQ ID NO: 4586184 - DNA, 14 bp, Homo sapiens
tgtatataaaaatg

SEQ ID NO: 4586185 - DNA, 21 bp, Homo sapiens
tgtatataagtactgaccact

SEQ ID NO: 4586186 - DNA, 23 bp, Homo sapiens
tgtatataatcatgctcatgtat

SEQ ID NO: 4586187 - DNA, 16 bp, Homo sapiens
tgtatatatctattat

SEQ ID NO: 4586188 - DNA, 15 bp, Homo sapiens
tgtatatatcttata

SEQ ID NO: 4586189 - DNA, 22 bp, Homo sapiens
tgtatatatcttataactgttt

SEQ ID NO: 4586190 - DNA, 20 bp, Homo sapiens
tgtatatatgtgtgccctgg

SEQ ID NO: 4586191 - DNA, 13 bp, Homo sapiens
tgtatatgtattt

SEQ ID NO: 4586192 - DNA, 14 bp, Homo sapiens
tgtatattacaatg

SEQ ID NO: 4586193 - DNA, 16 bp, Homo sapiens
tgtatattatgtttat

SEQ ID NO: 4586194 - DNA, 14 bp, Homo sapiens
tgtatattgtaatt

SEQ ID NO: 4586195 - DNA, 12 bp, Homo sapiens
tgtatatttgta

SEQ ID NO: 4586196 - DNA, 16 bp, Homo sapiens
tgtatatttgtatgat

SEQ ID NO: 4586197 - DNA, 17 bp, Homo sapiens
tgtatatttgtatgata

SEQ ID NO: 4586198 - DNA, 18 bp, Homo sapiens
tgtatatttgtatgatat

SEQ ID NO: 4586199 - DNA, 16 bp, Homo sapiens
tgtatattttaatgtt

SEQ ID NO: 4586200 - DNA, 12 bp, Homo sapiens
tgtatattttat

SEQ ID NO: 4586201 - DNA, 15 bp, Homo sapiens
tgtatcaataaaatt

SEQ ID NO: 4586202 - DNA, 24 bp, Homo sapiens
tgtatcaataaaattctgtaattt

SEQ ID NO: 4586203 - DNA, 15 bp, Homo sapiens
tgtatcaatttctaa

SEQ ID NO: 4586204 - DNA, 16 bp, Homo sapiens
tgtatcagtgtccttt

SEQ ID NO: 4586205 - DNA, 18 bp, Homo sapiens
tgtatcagtgtcctttcc

SEQ ID NO: 4586206 - DNA, 18 bp, Homo sapiens
tgtatcagtgtttatgtg

SEQ ID NO: 4586207 - DNA, 21 bp, Homo sapiens
tgtatcatctggataggagcc

SEQ ID NO: 4586208 - DNA, 20 bp, Homo sapiens
tgtatccacacaaattcagt

SEQ ID NO: 4586209 - DNA, 15 bp, Homo sapiens
tgtatctaagaataa

SEQ ID NO: 4586210 - DNA, 19 bp, Homo sapiens
tgtatctaagaataataaa

SEQ ID NO: 4586211 - DNA, 19 bp, Homo sapiens
tgtatctacagtaatgaaa

SEQ ID NO: 4586212 - DNA, 19 bp, Homo sapiens
tgtatctaggcatttcatt

SEQ ID NO: 4586213 - DNA, 15 bp, Homo sapiens
tgtatctatttgtac

SEQ ID NO: 4586214 - DNA, 19 bp, Homo sapiens
tgtatctatttgtacaatt

SEQ ID NO: 4586215 - DNA, 22 bp, Homo sapiens
tgtatcttgggggacagggctg

SEQ ID NO: 4586216 - DNA, 15 bp, Homo sapiens
tgtatctttattaaa

SEQ ID NO: 4586217 - DNA, 16 bp, Homo sapiens
tgtatctttattaaaa

SEQ ID NO: 4586218 - DNA, 21 bp, Homo sapiens
tgtatgaaaaattggggagga

SEQ ID NO: 4586219 - DNA, 22 bp, Homo sapiens
tgtatgacagtgaagcagcact

SEQ ID NO: 4586220 - DNA, 19 bp, Homo sapiens
tgtatgcatggaaacatgg

SEQ ID NO: 4586221 - DNA, 20 bp, Homo sapiens
tgtatgccaagtgagaagat

SEQ ID NO: 4586222 - DNA, 21 bp, Homo sapiens
tgtatgcctttaaatctgtga

SEQ ID NO: 4586223 - DNA, 22 bp, Homo sapiens
tgtatgcctttaaatctgtgat

SEQ ID NO: 4586224 - DNA, 23 bp, Homo sapiens
tgtatgcctttaaatctgtgatg

SEQ ID NO: 4586225 - DNA, 22 bp, Homo sapiens
tgtatgcttttataggcctgtg

SEQ ID NO: 4586226 - DNA, 14 bp, Homo sapiens
tgtatggatatatt

SEQ ID NO: 4586227 - DNA, 16 bp, Homo sapiens
tgtatggatatatttg

SEQ ID NO: 4586228 - DNA, 18 bp, Homo sapiens
tgtatggatatatttgaa

SEQ ID NO: 4586229 - DNA, 22 bp, Homo sapiens
tgtatgtaatacatatagcagc

SEQ ID NO: 4586230 - DNA, 12 bp, Homo sapiens
tgtatgtacaat

SEQ ID NO: 4586231 - DNA, 17 bp, Homo sapiens
tgtatgtacaatacaat

SEQ ID NO: 4586232 - DNA, 19 bp, Homo sapiens
tgtatgtacaatacaatgt

SEQ ID NO: 4586233 - DNA, 23 bp, Homo sapiens
tgtatgtacaatacaatgtacaa

SEQ ID NO: 4586234 - DNA, 18 bp, Homo sapiens
tgtatgtctcgtggtagg

SEQ ID NO: 4586235 - DNA, 20 bp, Homo sapiens
tgtatgtgtgtttctgtcct

SEQ ID NO: 4586236 - DNA, 12 bp, Homo sapiens
tgtatgtttgct

SEQ ID NO: 4586237 - DNA, 22 bp, Homo sapiens
tgtattaaacctttccatttta

SEQ ID NO: 4586238 - DNA, 17 bp, Homo sapiens
tgtattaagggcatttt

SEQ ID NO: 4586239 - DNA, 21 bp, Homo sapiens
tgtattaagttgttaataaaa

SEQ ID NO: 4586240 - DNA, 18 bp, Homo sapiens
tgtattaatcatagatta

SEQ ID NO: 4586241 - DNA, 18 bp, Homo sapiens
tgtattaatctctgtgtg

SEQ ID NO: 4586242 - DNA, 16 bp, Homo sapiens
tgtattaccattactt

SEQ ID NO: 4586243 - DNA, 14 bp, Homo sapiens
tgtattattacaaa

SEQ ID NO: 4586244 - DNA, 18 bp, Homo sapiens
tgtattatttacatttaa

SEQ ID NO: 4586245 - DNA, 18 bp, Homo sapiens
tgtattctcagacactga

SEQ ID NO: 4586246 - DNA, 13 bp, Homo sapiens
tgtattctctgag

SEQ ID NO: 4586247 - DNA, 19 bp, Homo sapiens
tgtattctctgagctgtgc

SEQ ID NO: 4586248 - DNA, 14 bp, Homo sapiens
tgtattcttaaaat

SEQ ID NO: 4586249 - DNA, 22 bp, Homo sapiens
tgtattcttaaaatgcaatatt

SEQ ID NO: 4586250 - DNA, 19 bp, Homo sapiens
tgtattcttcatgaaatgt

SEQ ID NO: 4586251 - DNA, 21 bp, Homo sapiens
tgtattcttcatgaaatgtgt

SEQ ID NO: 4586252 - DNA, 16 bp, Homo sapiens
tgtattcttgtttgaa

SEQ ID NO: 4586253 - DNA, 20 bp, Homo sapiens
tgtattctttataattgaat

SEQ ID NO: 4586254 - DNA, 12 bp, Homo sapiens
tgtattgattca

SEQ ID NO: 4586255 - DNA, 18 bp, Homo sapiens
tgtattgattcaacaggg

SEQ ID NO: 4586256 - DNA, 15 bp, Homo sapiens
tgtattgcatgcaat

SEQ ID NO: 4586257 - DNA, 12 bp, Homo sapiens
tgtattgctgtc

SEQ ID NO: 4586258 - DNA, 14 bp, Homo sapiens
tgtattgctgtcct

SEQ ID NO: 4586259 - DNA, 16 bp, Homo sapiens
tgtattgtatattaca

SEQ ID NO: 4586260 - DNA, 17 bp, Homo sapiens
tgtattgttagatgttt

SEQ ID NO: 4586261 - DNA, 22 bp, Homo sapiens
tgtattgttgaaaaagtttgtt

SEQ ID NO: 4586262 - DNA, 15 bp, Homo sapiens
tgtatttaacagaaa

SEQ ID NO: 4586263 - DNA, 16 bp, Homo sapiens
tgtatttaacagaaat

SEQ ID NO: 4586264 - DNA, 12 bp, Homo sapiens
tgtatttaagca

SEQ ID NO: 4586265 - DNA, 14 bp, Homo sapiens
tgtatttaagcaaa

SEQ ID NO: 4586266 - DNA, 16 bp, Homo sapiens
tgtatttaagcaaata

SEQ ID NO: 4586267 - DNA, 16 bp, Homo sapiens
tgtatttaattataaa

SEQ ID NO: 4586268 - DNA, 13 bp, Homo sapiens
tgtatttaattgt

SEQ ID NO: 4586269 - DNA, 21 bp, Homo sapiens
tgtatttacgctttgattcat

SEQ ID NO: 4586270 - DNA, 23 bp, Homo sapiens
tgtatttacgctttgattcatag

SEQ ID NO: 4586271 - DNA, 14 bp, Homo sapiens
tgtatttcaaatat

SEQ ID NO: 4586272 - DNA, 13 bp, Homo sapiens
tgtatttcagtat

SEQ ID NO: 4586273 - DNA, 15 bp, Homo sapiens
tgtatttcagtattt

SEQ ID NO: 4586274 - DNA, 19 bp, Homo sapiens
tgtatttcagtattttcca

SEQ ID NO: 4586275 - DNA, 19 bp, Homo sapiens
tgtatttcttaagaattca

SEQ ID NO: 4586276 - DNA, 14 bp, Homo sapiens
tgtatttctttgta

SEQ ID NO: 4586277 - DNA, 17 bp, Homo sapiens
tgtatttgaaataagaa

SEQ ID NO: 4586278 - DNA, 13 bp, Homo sapiens
tgtatttggaaat

SEQ ID NO: 4586279 - DNA, 14 bp, Homo sapiens
tgtatttgtagtgt

SEQ ID NO: 4586280 - DNA, 18 bp, Homo sapiens
tgtattttatttagacaa

SEQ ID NO: 4586281 - DNA, 14 bp, Homo sapiens
tgtattttgtattg

SEQ ID NO: 4586282 - DNA, 18 bp, Homo sapiens
tgtattttgtcacttttt

SEQ ID NO: 4586283 - DNA, 23 bp, Homo sapiens
tgtatttttatataatatctaaa

SEQ ID NO: 4586284 - DNA, 22 bp, Homo sapiens
tgtatttttctacattattgct

SEQ ID NO: 4586285 - DNA, 18 bp, Homo sapiens
tgtcaaaaattttgaatg

SEQ ID NO: 4586286 - DNA, 19 bp, Homo sapiens
tgtcaaaaattttgaatgt

SEQ ID NO: 4586287 - DNA, 22 bp, Homo sapiens
tgtcaaaaattttgaatgtaca

SEQ ID NO: 4586288 - DNA, 23 bp, Homo sapiens
tgtcaaagaagcttccacaaaat

SEQ ID NO: 4586289 - DNA, 13 bp, Homo sapiens
tgtcaaagctttg

SEQ ID NO: 4586290 - DNA, 14 bp, Homo sapiens
tgtcaacttcagtt

SEQ ID NO: 4586291 - DNA, 17 bp, Homo sapiens
tgtcaagagtagttata

SEQ ID NO: 4586292 - DNA, 18 bp, Homo sapiens
tgtcaagcctgtgcaaaa

SEQ ID NO: 4586293 - DNA, 23 bp, Homo sapiens
tgtcaaggaagacttttggtaga

SEQ ID NO: 4586294 - DNA, 12 bp, Homo sapiens
tgtcaagtgcct

SEQ ID NO: 4586295 - DNA, 14 bp, Homo sapiens
tgtcaagtgcctgc

SEQ ID NO: 4586296 - DNA, 15 bp, Homo sapiens
tgtcaagtgcctgca

SEQ ID NO: 4586297 - DNA, 19 bp, Homo sapiens
tgtcaagtgggatctgtca

SEQ ID NO: 4586298 - DNA, 16 bp, Homo sapiens
tgtcaagttgtgcttg

SEQ ID NO: 4586299 - DNA, 23 bp, Homo sapiens
tgtcaataaagctgtgcttgggg

SEQ ID NO: 4586300 - DNA, 15 bp, Homo sapiens
tgtcaatctgtccgt

SEQ ID NO: 4586301 - DNA, 12 bp, Homo sapiens
tgtcaatgtgtg

SEQ ID NO: 4586302 - DNA, 13 bp, Homo sapiens
tgtcaatgtgtgc

SEQ ID NO: 4586303 - DNA, 16 bp, Homo sapiens
tgtcacaataaagttt

SEQ ID NO: 4586304 - DNA, 21 bp, Homo sapiens
tgtcacaatgagattgaattt

SEQ ID NO: 4586305 - DNA, 17 bp, Homo sapiens
tgtcacacccatggcct

SEQ ID NO: 4586306 - DNA, 22 bp, Homo sapiens
tgtcacacccatggcctcagcc

SEQ ID NO: 4586307 - DNA, 18 bp, Homo sapiens
tgtcaccaccttcccagc

SEQ ID NO: 4586308 - DNA, 14 bp, Homo sapiens
tgtcaccagctatc

SEQ ID NO: 4586309 - DNA, 17 bp, Homo sapiens
tgtcaccggtcagtgcc

SEQ ID NO: 4586310 - DNA, 18 bp, Homo sapiens
tgtcacctagaacgtgca

SEQ ID NO: 4586311 - DNA, 17 bp, Homo sapiens
tgtcacctctcagctgc

SEQ ID NO: 4586312 - DNA, 19 bp, Homo sapiens
tgtcacctctcagctgctg

SEQ ID NO: 4586313 - DNA, 14 bp, Homo sapiens
tgtcacgagcccat

SEQ ID NO: 4586314 - DNA, 14 bp, Homo sapiens
tgtcacgccagact

SEQ ID NO: 4586315 - DNA, 16 bp, Homo sapiens
tgtcactttttatgct

SEQ ID NO: 4586316 - DNA, 23 bp, Homo sapiens
tgtcacttttttataaaagttta

SEQ ID NO: 4586317 - DNA, 16 bp, Homo sapiens
tgtcagacttccaaat

SEQ ID NO: 4586318 - DNA, 16 bp, Homo sapiens
tgtcagattaaattac

SEQ ID NO: 4586319 - DNA, 14 bp, Homo sapiens
tgtcagattccttt

SEQ ID NO: 4586320 - DNA, 15 bp, Homo sapiens
tgtcagattcctttc

SEQ ID NO: 4586321 - DNA, 15 bp, Homo sapiens
tgtcagccagccgcc

SEQ ID NO: 4586322 - DNA, 16 bp, Homo sapiens
tgtcagccagccgccc

SEQ ID NO: 4586323 - DNA, 17 bp, Homo sapiens
tgtcagccagccgccct

SEQ ID NO: 4586324 - DNA, 19 bp, Homo sapiens
tgtcagccagccgccctgg

SEQ ID NO: 4586325 - DNA, 22 bp, Homo sapiens
tgtcagccatcgtcctgggact

SEQ ID NO: 4586326 - DNA, 23 bp, Homo sapiens
tgtcagctcccctcggagaagag

SEQ ID NO: 4586327 - DNA, 14 bp, Homo sapiens
tgtcagtatccagg

SEQ ID NO: 4586328 - DNA, 18 bp, Homo sapiens
tgtcagtatgtggaagtg

SEQ ID NO: 4586329 - DNA, 19 bp, Homo sapiens
tgtcagtatgtggaagtgt

SEQ ID NO: 4586330 - DNA, 22 bp, Homo sapiens
tgtcagtgttaaagattttgtt

SEQ ID NO: 4586331 - DNA, 18 bp, Homo sapiens
tgtcagtgtttgtatttg

SEQ ID NO: 4586332 - DNA, 18 bp, Homo sapiens
tgtcataaacagatgaat

SEQ ID NO: 4586333 - DNA, 16 bp, Homo sapiens
tgtcataaactttctc

SEQ ID NO: 4586334 - DNA, 16 bp, Homo sapiens
tgtcataaggttttta

SEQ ID NO: 4586335 - DNA, 14 bp, Homo sapiens
tgtcatactgtgca

SEQ ID NO: 4586336 - DNA, 22 bp, Homo sapiens
tgtcatactgtgcaggcctgtc

SEQ ID NO: 4586337 - DNA, 16 bp, Homo sapiens
tgtcatagtcttgaaa

SEQ ID NO: 4586338 - DNA, 21 bp, Homo sapiens
tgtcatagtcttgaaatgaaa

SEQ ID NO: 4586339 - DNA, 23 bp, Homo sapiens
tgtcatagtcttgaaatgaaagg

SEQ ID NO: 4586340 - DNA, 20 bp, Homo sapiens
tgtcatatgtagccttcaca

SEQ ID NO: 4586341 - DNA, 23 bp, Homo sapiens
tgtcatcaatagtgtcctatgca

SEQ ID NO: 4586342 - DNA, 13 bp, Homo sapiens
tgtcatcttttca

SEQ ID NO: 4586343 - DNA, 16 bp, Homo sapiens
tgtcatgaacatgttc

SEQ ID NO: 4586344 - DNA, 18 bp, Homo sapiens
tgtcatgtgttccctttg

SEQ ID NO: 4586345 - DNA, 14 bp, Homo sapiens
tgtcattggaagcc

SEQ ID NO: 4586346 - DNA, 16 bp, Homo sapiens
tgtcatttcagaagtt

SEQ ID NO: 4586347 - DNA, 20 bp, Homo sapiens
tgtcatttcattccattgcc

SEQ ID NO: 4586348 - DNA, 22 bp, Homo sapiens
tgtcatttcttcacttcaagct

SEQ ID NO: 4586349 - DNA, 23 bp, Homo sapiens
tgtcatttgctggagctctgccc

SEQ ID NO: 4586350 - DNA, 15 bp, Homo sapiens
tgtcatttttaatgt

SEQ ID NO: 4586351 - DNA, 21 bp, Homo sapiens
tgtccaaagaggctgcccctc

SEQ ID NO: 4586352 - DNA, 20 bp, Homo sapiens
tgtccaaataaattcaataa

SEQ ID NO: 4586353 - DNA, 23 bp, Homo sapiens
tgtccaacatggtgaaaccccca

SEQ ID NO: 4586354 - DNA, 19 bp, Homo sapiens
tgtccaactggccctattt

SEQ ID NO: 4586355 - DNA, 14 bp, Homo sapiens
tgtccaatatgaaa

SEQ ID NO: 4586356 - DNA, 12 bp, Homo sapiens
tgtccaccatgc

SEQ ID NO: 4586357 - DNA, 16 bp, Homo sapiens
tgtccaccatgctctc

SEQ ID NO: 4586358 - DNA, 17 bp, Homo sapiens
tgtccaccatgctctct

SEQ ID NO: 4586359 - DNA, 23 bp, Homo sapiens
tgtccaccatgctctctcacctg

SEQ ID NO: 4586360 - DNA, 16 bp, Homo sapiens
tgtccacgactgtctc

SEQ ID NO: 4586361 - DNA, 15 bp, Homo sapiens
tgtccacgtacttaa

SEQ ID NO: 4586362 - DNA, 21 bp, Homo sapiens
tgtccacgtacttaatttact

SEQ ID NO: 4586363 - DNA, 12 bp, Homo sapiens
tgtccagacagc

SEQ ID NO: 4586364 - DNA, 13 bp, Homo sapiens
tgtccagacagcc

SEQ ID NO: 4586365 - DNA, 16 bp, Homo sapiens
tgtccagacagcctgt

SEQ ID NO: 4586366 - DNA, 17 bp, Homo sapiens
tgtccagagtgagcaag

SEQ ID NO: 4586367 - DNA, 21 bp, Homo sapiens
tgtccagattgggagaagtgg

SEQ ID NO: 4586368 - DNA, 22 bp, Homo sapiens
tgtccagcctgggcagccaggc

SEQ ID NO: 4586369 - DNA, 22 bp, Homo sapiens
tgtccagggaaacagcctctct

SEQ ID NO: 4586370 - DNA, 15 bp, Homo sapiens
tgtccagtggagggc

SEQ ID NO: 4586371 - DNA, 17 bp, Homo sapiens
tgtccatgcttctcatc

SEQ ID NO: 4586372 - DNA, 17 bp, Homo sapiens
tgtccattgtccaatcc

SEQ ID NO: 4586373 - DNA, 16 bp, Homo sapiens
tgtccatttttacaag

SEQ ID NO: 4586374 - DNA, 15 bp, Homo sapiens
tgtcccaagtgccaa

SEQ ID NO: 4586375 - DNA, 16 bp, Homo sapiens
tgtcccaattaaaata

SEQ ID NO: 4586376 - DNA, 18 bp, Homo sapiens
tgtcccactacatctggg

SEQ ID NO: 4586377 - DNA, 17 bp, Homo sapiens
tgtccccacccatgcgc

SEQ ID NO: 4586378 - DNA, 19 bp, Homo sapiens
tgtccccacccatgcgcct

SEQ ID NO: 4586379 - DNA, 20 bp, Homo sapiens
tgtccccacccatgcgcctt

SEQ ID NO: 4586380 - DNA, 13 bp, Homo sapiens
tgtcccccaggct

SEQ ID NO: 4586381 - DNA, 18 bp, Homo sapiens
tgtccccctctgtccagg

SEQ ID NO: 4586382 - DNA, 22 bp, Homo sapiens
tgtcccctcaaactcattgcag

SEQ ID NO: 4586383 - DNA, 14 bp, Homo sapiens
tgtcccctgcgggc

SEQ ID NO: 4586384 - DNA, 15 bp, Homo sapiens
tgtccccttcccctg

SEQ ID NO: 4586385 - DNA, 17 bp, Homo sapiens
tgtccccttcccctgct

SEQ ID NO: 4586386 - DNA, 11 bp, Homo sapiens
tgtccccttct

SEQ ID NO: 4586387 - DNA, 16 bp, Homo sapiens
tgtccccttctctcat

SEQ ID NO: 4586388 - DNA, 20 bp, Homo sapiens
tgtccccttctctcatctct

SEQ ID NO: 4586389 - DNA, 12 bp, Homo sapiens
tgtccctccggg

SEQ ID NO: 4586390 - DNA, 16 bp, Homo sapiens
tgtccctctagtgcct

SEQ ID NO: 4586391 - DNA, 23 bp, Homo sapiens
tgtccctgggggagtaattctgt

SEQ ID NO: 4586392 - DNA, 16 bp, Homo sapiens
tgtccctgtcaccaag

SEQ ID NO: 4586393 - DNA, 21 bp, Homo sapiens
tgtccctgtcaccaagctcac

SEQ ID NO: 4586394 - DNA, 13 bp, Homo sapiens
tgtcccttgcctc

SEQ ID NO: 4586395 - DNA, 23 bp, Homo sapiens
tgtccctttcccctagatccaga

SEQ ID NO: 4586396 - DNA, 15 bp, Homo sapiens
tgtccggcccagtgc

SEQ ID NO: 4586397 - DNA, 16 bp, Homo sapiens
tgtccgtagtatcaga

SEQ ID NO: 4586398 - DNA, 15 bp, Homo sapiens
tgtcctaaggcccat

SEQ ID NO: 4586399 - DNA, 14 bp, Homo sapiens
tgtcctacacttga

SEQ ID NO: 4586400 - DNA, 16 bp, Homo sapiens
tgtcctaccatcagct

SEQ ID NO: 4586401 - DNA, 18 bp, Homo sapiens
tgtcctaccatcagctct

SEQ ID NO: 4586402 - DNA, 21 bp, Homo sapiens
tgtcctaccatcagctctgcc

SEQ ID NO: 4586403 - DNA, 15 bp, Homo sapiens
tgtcctatgcaataa

SEQ ID NO: 4586404 - DNA, 13 bp, Homo sapiens
tgtcctcagcccc

SEQ ID NO: 4586405 - DNA, 14 bp, Homo sapiens
tgtcctcagggagc

SEQ ID NO: 4586406 - DNA, 23 bp, Homo sapiens
tgtcctcagggagcagggaaggc

SEQ ID NO: 4586407 - DNA, 18 bp, Homo sapiens
tgtcctccagaagcctct

SEQ ID NO: 4586408 - DNA, 22 bp, Homo sapiens
tgtcctccagaagcctctggct

SEQ ID NO: 4586409 - DNA, 23 bp, Homo sapiens
tgtcctccagaagcctctggcta

SEQ ID NO: 4586410 - DNA, 10 bp, Homo sapiens
tgtcctcctc

SEQ ID NO: 4586411 - DNA, 11 bp, Homo sapiens
tgtcctcctcg

SEQ ID NO: 4586412 - DNA, 14 bp, Homo sapiens
tgtcctctccctgc

SEQ ID NO: 4586413 - DNA, 17 bp, Homo sapiens
tgtcctctccctgccaa

SEQ ID NO: 4586414 - DNA, 18 bp, Homo sapiens
tgtcctctccctgccaag

SEQ ID NO: 4586415 - DNA, 20 bp, Homo sapiens
tgtcctctcgagcccagatg

SEQ ID NO: 4586416 - DNA, 20 bp, Homo sapiens
tgtcctcttctgctcttttc

SEQ ID NO: 4586417 - DNA, 22 bp, Homo sapiens
tgtcctcttctgctcttttcct

SEQ ID NO: 4586418 - DNA, 17 bp, Homo sapiens
tgtcctgcacaccctgg

SEQ ID NO: 4586419 - DNA, 15 bp, Homo sapiens
tgtcctgtgagatgt

SEQ ID NO: 4586420 - DNA, 18 bp, Homo sapiens
tgtcctgtgagatgtgta

SEQ ID NO: 4586421 - DNA, 15 bp, Homo sapiens
tgtcctgttgattaa

SEQ ID NO: 4586422 - DNA, 15 bp, Homo sapiens
tgtccttgcacctgc

SEQ ID NO: 4586423 - DNA, 15 bp, Homo sapiens
tgtccttttgctctt

SEQ ID NO: 4586424 - DNA, 16 bp, Homo sapiens
tgtccttttgctcttc

SEQ ID NO: 4586425 - DNA, 12 bp, Homo sapiens
tgtcgcagactc

SEQ ID NO: 4586426 - DNA, 14 bp, Homo sapiens
tgtcgcccaggctg

SEQ ID NO: 4586427 - DNA, 16 bp, Homo sapiens
tgtcgctatgtgactt

SEQ ID NO: 4586428 - DNA, 22 bp, Homo sapiens
tgtcgctatgtgacttgcgctt

SEQ ID NO: 4586429 - DNA, 15 bp, Homo sapiens
tgtctacctggcaga

SEQ ID NO: 4586430 - DNA, 14 bp, Homo sapiens
tgtctactggacaa

SEQ ID NO: 4586431 - DNA, 17 bp, Homo sapiens
tgtctaggcaggacctg

SEQ ID NO: 4586432 - DNA, 20 bp, Homo sapiens
tgtctatatttaaatcattt

SEQ ID NO: 4586433 - DNA, 13 bp, Homo sapiens
tgtctattcagct

SEQ ID NO: 4586434 - DNA, 16 bp, Homo sapiens
tgtctatttaagtgca

SEQ ID NO: 4586435 - DNA, 16 bp, Homo sapiens
tgtctcaacgcctccc

SEQ ID NO: 4586436 - DNA, 17 bp, Homo sapiens
tgtctcactcttctgtc

SEQ ID NO: 4586437 - DNA, 21 bp, Homo sapiens
tgtctcactttactttcaagt

SEQ ID NO: 4586438 - DNA, 17 bp, Homo sapiens
tgtctcagcctctgcca

SEQ ID NO: 4586439 - DNA, 22 bp, Homo sapiens
tgtctcagtccatgaagatgta

SEQ ID NO: 4586440 - DNA, 19 bp, Homo sapiens
tgtctcatccacataagca

SEQ ID NO: 4586441 - DNA, 23 bp, Homo sapiens
tgtctcatccccaggggtcccag

SEQ ID NO: 4586442 - DNA, 14 bp, Homo sapiens
tgtctcattttaat

SEQ ID NO: 4586443 - DNA, 23 bp, Homo sapiens
tgtctcattttaatgtaaagatt

SEQ ID NO: 4586444 - DNA, 11 bp, Homo sapiens
tgtctccaacc

SEQ ID NO: 4586445 - DNA, 16 bp, Homo sapiens
tgtctccaacccccca

SEQ ID NO: 4586446 - DNA, 20 bp, Homo sapiens
tgtctccaaccccccagcac

SEQ ID NO: 4586447 - DNA, 22 bp, Homo sapiens
tgtctccaaccccccagcactg

SEQ ID NO: 4586448 - DNA, 15 bp, Homo sapiens
tgtctccaagtagtc

SEQ ID NO: 4586449 - DNA, 19 bp, Homo sapiens
tgtctccacttgtatatat

SEQ ID NO: 4586450 - DNA, 15 bp, Homo sapiens
tgtctccagcttccc

SEQ ID NO: 4586451 - DNA, 16 bp, Homo sapiens
tgtctcccaacatggg

SEQ ID NO: 4586452 - DNA, 20 bp, Homo sapiens
tgtctcccaacatgggaggg

SEQ ID NO: 4586453 - DNA, 19 bp, Homo sapiens
tgtctccccagttccacag

SEQ ID NO: 4586454 - DNA, 14 bp, Homo sapiens
tgtctcctctcaga

SEQ ID NO: 4586455 - DNA, 17 bp, Homo sapiens
tgtctccttggttatat

SEQ ID NO: 4586456 - DNA, 18 bp, Homo sapiens
tgtctcgtggtaggactg

SEQ ID NO: 4586457 - DNA, 14 bp, Homo sapiens
tgtctctaaaaaga

SEQ ID NO: 4586458 - DNA, 16 bp, Homo sapiens
tgtctctgggccactt

SEQ ID NO: 4586459 - DNA, 13 bp, Homo sapiens
tgtctctgtgaga

SEQ ID NO: 4586460 - DNA, 18 bp, Homo sapiens
tgtctcttacatctcctt

SEQ ID NO: 4586461 - DNA, 13 bp, Homo sapiens
tgtctcttctgag

SEQ ID NO: 4586462 - DNA, 13 bp, Homo sapiens
tgtctcttgagca

SEQ ID NO: 4586463 - DNA, 17 bp, Homo sapiens
tgtctcttgagcatcaa

SEQ ID NO: 4586464 - DNA, 20 bp, Homo sapiens
tgtctcttgagcatcaatct

SEQ ID NO: 4586465 - DNA, 21 bp, Homo sapiens
tgtctcttgagcatcaatctt

SEQ ID NO: 4586466 - DNA, 22 bp, Homo sapiens
tgtctctttattataagtgaga

SEQ ID NO: 4586467 - DNA, 15 bp, Homo sapiens
tgtctgaacatagaa

SEQ ID NO: 4586468 - DNA, 15 bp, Homo sapiens
tgtctgaagtacaaa

SEQ ID NO: 4586469 - DNA, 17 bp, Homo sapiens
tgtctgaagtacaaaca

SEQ ID NO: 4586470 - DNA, 19 bp, Homo sapiens
tgtctgaagtacaaacatg

SEQ ID NO: 4586471 - DNA, 20 bp, Homo sapiens
tgtctgaagtacaaacatga

SEQ ID NO: 4586472 - DNA, 16 bp, Homo sapiens
tgtctgatctgtgctt

SEQ ID NO: 4586473 - DNA, 23 bp, Homo sapiens
tgtctgatctgtgctttccagct

SEQ ID NO: 4586474 - DNA, 21 bp, Homo sapiens
tgtctgcaccttagaaaaaaa

SEQ ID NO: 4586475 - DNA, 17 bp, Homo sapiens
tgtctgccaaaatgcaa

SEQ ID NO: 4586476 - DNA, 15 bp, Homo sapiens
tgtctgccaacctaa

SEQ ID NO: 4586477 - DNA, 15 bp, Homo sapiens
tgtctgcctatgcac

SEQ ID NO: 4586478 - DNA, 13 bp, Homo sapiens
tgtctgccttcac

SEQ ID NO: 4586479 - DNA, 18 bp, Homo sapiens
tgtctgccttcacaaatg

SEQ ID NO: 4586480 - DNA, 17 bp, Homo sapiens
tgtctgcgtgggtcaga

SEQ ID NO: 4586481 - DNA, 19 bp, Homo sapiens
tgtctgctgagttggcctg

SEQ ID NO: 4586482 - DNA, 16 bp, Homo sapiens
tgtctgcttgcatctg

SEQ ID NO: 4586483 - DNA, 18 bp, Homo sapiens
tgtctggcaaaagaaaaa

SEQ ID NO: 4586484 - DNA, 20 bp, Homo sapiens
tgtctggcaaggactttgta

SEQ ID NO: 4586485 - DNA, 20 bp, Homo sapiens
tgtctggctcggacccaccc

SEQ ID NO: 4586486 - DNA, 18 bp, Homo sapiens
tgtctggctttggcactc

SEQ ID NO: 4586487 - DNA, 23 bp, Homo sapiens
tgtctgtaaaaaatggagctcag

SEQ ID NO: 4586488 - DNA, 21 bp, Homo sapiens
tgtctgtcaccagctatctgt

SEQ ID NO: 4586489 - DNA, 24 bp, Homo sapiens
tgtctgtcaccagctatctgtcat

SEQ ID NO: 4586490 - DNA, 12 bp, Homo sapiens
tgtctgtctaca

SEQ ID NO: 4586491 - DNA, 17 bp, Homo sapiens
tgtctgtgatctctgct

SEQ ID NO: 4586492 - DNA, 20 bp, Homo sapiens
tgtctgtgatctctgctggg

SEQ ID NO: 4586493 - DNA, 14 bp, Homo sapiens
tgtctgtgcacatg

SEQ ID NO: 4586494 - DNA, 21 bp, Homo sapiens
tgtctgtgcacatgcctctgt

SEQ ID NO: 4586495 - DNA, 20 bp, Homo sapiens
tgtctgtgccctccaaagag

SEQ ID NO: 4586496 - DNA, 20 bp, Homo sapiens
tgtctgtgttgcttcaaatt

SEQ ID NO: 4586497 - DNA, 16 bp, Homo sapiens
tgtctgttcccagccc

SEQ ID NO: 4586498 - DNA, 20 bp, Homo sapiens
tgtctgttcccagcccctgc

SEQ ID NO: 4586499 - DNA, 21 bp, Homo sapiens
tgtctgttctacatagatgct

SEQ ID NO: 4586500 - DNA, 22 bp, Homo sapiens
tgtctgtttatatattgaaagt

SEQ ID NO: 4586501 - DNA, 15 bp, Homo sapiens
tgtcttaaaaaatgt

SEQ ID NO: 4586502 - DNA, 12 bp, Homo sapiens
tgtcttaattaa

SEQ ID NO: 4586503 - DNA, 20 bp, Homo sapiens
tgtcttacgtttttctggtg

SEQ ID NO: 4586504 - DNA, 14 bp, Homo sapiens
tgtcttatttttag

SEQ ID NO: 4586505 - DNA, 15 bp, Homo sapiens
tgtcttatttttaga

SEQ ID NO: 4586506 - DNA, 23 bp, Homo sapiens
tgtcttatttttagatggttaca

SEQ ID NO: 4586507 - DNA, 14 bp, Homo sapiens
tgtcttcacaacag

SEQ ID NO: 4586508 - DNA, 20 bp, Homo sapiens
tgtcttcattttttaatgtg

SEQ ID NO: 4586509 - DNA, 16 bp, Homo sapiens
tgtcttcccagggtag

SEQ ID NO: 4586510 - DNA, 22 bp, Homo sapiens
tgtcttcccagggtagcccgcc

SEQ ID NO: 4586511 - DNA, 16 bp, Homo sapiens
tgtcttccctgcctgt

SEQ ID NO: 4586512 - DNA, 16 bp, Homo sapiens
tgtcttcctcccaagt

SEQ ID NO: 4586513 - DNA, 14 bp, Homo sapiens
tgtcttctgcctgt

SEQ ID NO: 4586514 - DNA, 14 bp, Homo sapiens
tgtcttgatgtttt

SEQ ID NO: 4586515 - DNA, 22 bp, Homo sapiens
tgtcttgatgttttttctgtaa

SEQ ID NO: 4586516 - DNA, 19 bp, Homo sapiens
tgtcttgcactggccttct

SEQ ID NO: 4586517 - DNA, 19 bp, Homo sapiens
tgtcttgctgttgacatat

SEQ ID NO: 4586518 - DNA, 20 bp, Homo sapiens
tgtcttgctgttgacatatt

SEQ ID NO: 4586519 - DNA, 19 bp, Homo sapiens
tgtcttgtatttaaaaaca

SEQ ID NO: 4586520 - DNA, 15 bp, Homo sapiens
tgtcttgtgtttctt

SEQ ID NO: 4586521 - DNA, 16 bp, Homo sapiens
tgtctttataaagctg

SEQ ID NO: 4586522 - DNA, 12 bp, Homo sapiens
tgtctttatatg

SEQ ID NO: 4586523 - DNA, 13 bp, Homo sapiens
tgtctttcctgaa

SEQ ID NO: 4586524 - DNA, 16 bp, Homo sapiens
tgtctttctaagaaat

SEQ ID NO: 4586525 - DNA, 14 bp, Homo sapiens
tgtctttctagcca

SEQ ID NO: 4586526 - DNA, 23 bp, Homo sapiens
tgtctttctagccataataaaat

SEQ ID NO: 4586527 - DNA, 22 bp, Homo sapiens
tgtctttctttggtgcctttcc

SEQ ID NO: 4586528 - DNA, 20 bp, Homo sapiens
tgtcttttaaaatgcaatgt

SEQ ID NO: 4586529 - DNA, 20 bp, Homo sapiens
tgtcttttatagtggaaaaa

SEQ ID NO: 4586530 - DNA, 16 bp, Homo sapiens
tgtcttttcagaagca

SEQ ID NO: 4586531 - DNA, 23 bp, Homo sapiens
tgtctttttttttctttttccag

SEQ ID NO: 4586532 - DNA, 13 bp, Homo sapiens
tgtgaaaaatctg

SEQ ID NO: 4586533 - DNA, 11 bp, Homo sapiens
tgtgaaaatat

SEQ ID NO: 4586534 - DNA, 17 bp, Homo sapiens
tgtgaaaatatacttga

SEQ ID NO: 4586535 - DNA, 22 bp, Homo sapiens
tgtgaaaatggtccaggagaag

SEQ ID NO: 4586536 - DNA, 15 bp, Homo sapiens
tgtgaaacatcttct

SEQ ID NO: 4586537 - DNA, 13 bp, Homo sapiens
tgtgaaataccac

SEQ ID NO: 4586538 - DNA, 14 bp, Homo sapiens
tgtgaaccaatgca

SEQ ID NO: 4586539 - DNA, 19 bp, Homo sapiens
tgtgaacctacctgccttg

SEQ ID NO: 4586540 - DNA, 15 bp, Homo sapiens
tgtgaagaatttaga

SEQ ID NO: 4586541 - DNA, 22 bp, Homo sapiens
tgtgaagaatttagatcttata

SEQ ID NO: 4586542 - DNA, 16 bp, Homo sapiens
tgtgaagcctttatct

SEQ ID NO: 4586543 - DNA, 23 bp, Homo sapiens
tgtgaaggcaggggaatgtatgt

SEQ ID NO: 4586544 - DNA, 23 bp, Homo sapiens
tgtgaaggtgatttaagggccca

SEQ ID NO: 4586545 - DNA, 22 bp, Homo sapiens
tgtgaatagaactctgaaatga

SEQ ID NO: 4586546 - DNA, 21 bp, Homo sapiens
tgtgaatctgcttttcctctg

SEQ ID NO: 4586547 - DNA, 15 bp, Homo sapiens
tgtgaatgcttctca

SEQ ID NO: 4586548 - DNA, 17 bp, Homo sapiens
tgtgaatgcttctcact

SEQ ID NO: 4586549 - DNA, 13 bp, Homo sapiens
tgtgaatggaggc

SEQ ID NO: 4586550 - DNA, 22 bp, Homo sapiens
tgtgaatggaggcagagacctc

SEQ ID NO: 4586551 - DNA, 19 bp, Homo sapiens
tgtgaattaggctgtaact

SEQ ID NO: 4586552 - DNA, 20 bp, Homo sapiens
tgtgaattattgacactgaa

SEQ ID NO: 4586553 - DNA, 22 bp, Homo sapiens
tgtgaattttctaaaagctttc

SEQ ID NO: 4586554 - DNA, 16 bp, Homo sapiens
tgtgaatttttaagct

SEQ ID NO: 4586555 - DNA, 15 bp, Homo sapiens
tgtgacaactaaaca

SEQ ID NO: 4586556 - DNA, 21 bp, Homo sapiens
tgtgacaattctgtttttaat

SEQ ID NO: 4586557 - DNA, 19 bp, Homo sapiens
tgtgacaattttgtacaaa

SEQ ID NO: 4586558 - DNA, 22 bp, Homo sapiens
tgtgacaggaaagccctccccc

SEQ ID NO: 4586559 - DNA, 20 bp, Homo sapiens
tgtgacatggtgcctgagag

SEQ ID NO: 4586560 - DNA, 11 bp, Homo sapiens
tgtgacattcc

SEQ ID NO: 4586561 - DNA, 17 bp, Homo sapiens
tgtgacattttacatta

SEQ ID NO: 4586562 - DNA, 18 bp, Homo sapiens
tgtgacattttacattaa

SEQ ID NO: 4586563 - DNA, 15 bp, Homo sapiens
tgtgaccaagtataa

SEQ ID NO: 4586564 - DNA, 15 bp, Homo sapiens
tgtgaccaatgtctt

SEQ ID NO: 4586565 - DNA, 22 bp, Homo sapiens
tgtgaccactgcagaagacagt

SEQ ID NO: 4586566 - DNA, 22 bp, Homo sapiens
tgtgaccagaaagcttcatcca

SEQ ID NO: 4586567 - DNA, 13 bp, Homo sapiens
tgtgaccctgggc

SEQ ID NO: 4586568 - DNA, 15 bp, Homo sapiens
tgtgaccctgggcag

SEQ ID NO: 4586569 - DNA, 18 bp, Homo sapiens
tgtgactattcatggcta

SEQ ID NO: 4586570 - DNA, 19 bp, Homo sapiens
tgtgactcagcatcaccca

SEQ ID NO: 4586571 - DNA, 12 bp, Homo sapiens
tgtgactctttc

SEQ ID NO: 4586572 - DNA, 15 bp, Homo sapiens
tgtgactctttccaa

SEQ ID NO: 4586573 - DNA, 17 bp, Homo sapiens
tgtgactctttccaacc

SEQ ID NO: 4586574 - DNA, 20 bp, Homo sapiens
tgtgactggctaaagctcga

SEQ ID NO: 4586575 - DNA, 13 bp, Homo sapiens
tgtgagagaaagt

SEQ ID NO: 4586576 - DNA, 18 bp, Homo sapiens
tgtgagatagttttcatt

SEQ ID NO: 4586577 - DNA, 13 bp, Homo sapiens
tgtgagatgtgta

SEQ ID NO: 4586578 - DNA, 12 bp, Homo sapiens
tgtgagcagtgg

SEQ ID NO: 4586579 - DNA, 21 bp, Homo sapiens
tgtgagccaccgtgcctggcc

SEQ ID NO: 4586580 - DNA, 14 bp, Homo sapiens
tgtgaggagctgct

SEQ ID NO: 4586581 - DNA, 18 bp, Homo sapiens
tgtgaggagctgctggct

SEQ ID NO: 4586582 - DNA, 16 bp, Homo sapiens
tgtgaggccagggcag

SEQ ID NO: 4586583 - DNA, 17 bp, Homo sapiens
tgtgaggcttctaataa

SEQ ID NO: 4586584 - DNA, 19 bp, Homo sapiens
tgtgagtgagggagacagg

SEQ ID NO: 4586585 - DNA, 17 bp, Homo sapiens
tgtgagtgtttttatct

SEQ ID NO: 4586586 - DNA, 20 bp, Homo sapiens
tgtgatacagttttgagtaa

SEQ ID NO: 4586587 - DNA, 14 bp, Homo sapiens
tgtgatcctgagtc

SEQ ID NO: 4586588 - DNA, 22 bp, Homo sapiens
tgtgatctgggcattttcctcc

SEQ ID NO: 4586589 - DNA, 13 bp, Homo sapiens
tgtgatcttaaaa

SEQ ID NO: 4586590 - DNA, 20 bp, Homo sapiens
tgtgatgaacatattcatga

SEQ ID NO: 4586591 - DNA, 16 bp, Homo sapiens
tgtgatgaggcagagg

SEQ ID NO: 4586592 - DNA, 22 bp, Homo sapiens
tgtgatgtttggattgatatcg

SEQ ID NO: 4586593 - DNA, 15 bp, Homo sapiens
tgtgatttctttctt

SEQ ID NO: 4586594 - DNA, 14 bp, Homo sapiens
tgtgcaaaatgtgt

SEQ ID NO: 4586595 - DNA, 18 bp, Homo sapiens
tgtgcaaggtggcctttg

SEQ ID NO: 4586596 - DNA, 21 bp, Homo sapiens
tgtgcaaggtggcctttgtgc

SEQ ID NO: 4586597 - DNA, 14 bp, Homo sapiens
tgtgcaccagggtt

SEQ ID NO: 4586598 - DNA, 23 bp, Homo sapiens
tgtgcacgcagattagcaggcca

SEQ ID NO: 4586599 - DNA, 24 bp, Homo sapiens
tgtgcactgtataccaagttctta

SEQ ID NO: 4586600 - DNA, 15 bp, Homo sapiens
tgtgcagcttcgagg

SEQ ID NO: 4586601 - DNA, 18 bp, Homo sapiens
tgtgcagcttcgaggaca

SEQ ID NO: 4586602 - DNA, 19 bp, Homo sapiens
tgtgcaggcctgtccctgg

SEQ ID NO: 4586603 - DNA, 22 bp, Homo sapiens
tgtgcaggcctgtccctgggag

SEQ ID NO: 4586604 - DNA, 13 bp, Homo sapiens
tgtgcaggctgca

SEQ ID NO: 4586605 - DNA, 18 bp, Homo sapiens
tgtgcaggtgctattgtt

SEQ ID NO: 4586606 - DNA, 14 bp, Homo sapiens
tgtgcaggttccca

SEQ ID NO: 4586607 - DNA, 21 bp, Homo sapiens
tgtgcagtcagcttttttcct

SEQ ID NO: 4586608 - DNA, 15 bp, Homo sapiens
tgtgcataatgcttt

SEQ ID NO: 4586609 - DNA, 20 bp, Homo sapiens
tgtgcataatgctttggaaa

SEQ ID NO: 4586610 - DNA, 21 bp, Homo sapiens
tgtgcataatgctttggaaaa

SEQ ID NO: 4586611 - DNA, 22 bp, Homo sapiens
tgtgcataatgctttggaaaaa

SEQ ID NO: 4586612 - DNA, 20 bp, Homo sapiens
tgtgcatatttagcatccct

SEQ ID NO: 4586613 - DNA, 17 bp, Homo sapiens
tgtgcatgaaagagaaa

SEQ ID NO: 4586614 - DNA, 15 bp, Homo sapiens
tgtgcatgcatacca

SEQ ID NO: 4586615 - DNA, 14 bp, Homo sapiens
tgtgccaagagcta

SEQ ID NO: 4586616 - DNA, 12 bp, Homo sapiens
tgtgccaagccc

SEQ ID NO: 4586617 - DNA, 22 bp, Homo sapiens
tgtgccaatacagacaaagcat

SEQ ID NO: 4586618 - DNA, 23 bp, Homo sapiens
tgtgccacagaggccccacctga

SEQ ID NO: 4586619 - DNA, 15 bp, Homo sapiens
tgtgccactgttcag

SEQ ID NO: 4586620 - DNA, 14 bp, Homo sapiens
tgtgccatgctggg

SEQ ID NO: 4586621 - DNA, 15 bp, Homo sapiens
tgtgccccatgcctg

SEQ ID NO: 4586622 - DNA, 23 bp, Homo sapiens
tgtgccccatgcctgtccagcct

SEQ ID NO: 4586623 - DNA, 19 bp, Homo sapiens
tgtgcccgcatgtgtgcct

SEQ ID NO: 4586624 - DNA, 19 bp, Homo sapiens
tgtgccctagatgcacgtg

SEQ ID NO: 4586625 - DNA, 18 bp, Homo sapiens
tgtgcctaatgtgtttga

SEQ ID NO: 4586626 - DNA, 14 bp, Homo sapiens
tgtgcctcccccca

SEQ ID NO: 4586627 - DNA, 17 bp, Homo sapiens
tgtgcctcccttttctc

SEQ ID NO: 4586628 - DNA, 21 bp, Homo sapiens
tgtgcctcccttttctcctct

SEQ ID NO: 4586629 - DNA, 13 bp, Homo sapiens
tgtgcctggcccc

SEQ ID NO: 4586630 - DNA, 22 bp, Homo sapiens
tgtgcctggccccagcctgggc

SEQ ID NO: 4586631 - DNA, 12 bp, Homo sapiens
tgtgcctggctc

SEQ ID NO: 4586632 - DNA, 15 bp, Homo sapiens
tgtgcctggctccct

SEQ ID NO: 4586633 - DNA, 15 bp, Homo sapiens
tgtgccttctttgta

SEQ ID NO: 4586634 - DNA, 17 bp, Homo sapiens
tgtgccttggtgtgctg

SEQ ID NO: 4586635 - DNA, 13 bp, Homo sapiens
tgtgccttgtttt

SEQ ID NO: 4586636 - DNA, 13 bp, Homo sapiens
tgtgcctttcttt

SEQ ID NO: 4586637 - DNA, 19 bp, Homo sapiens
tgtgcctttctttgcctct

SEQ ID NO: 4586638 - DNA, 22 bp, Homo sapiens
tgtgcctttctttgcctctgca

SEQ ID NO: 4586639 - DNA, 13 bp, Homo sapiens
tgtgcctttggcc

SEQ ID NO: 4586640 - DNA, 15 bp, Homo sapiens
tgtgcctttggcctg

SEQ ID NO: 4586641 - DNA, 13 bp, Homo sapiens
tgtgcgctgctct

SEQ ID NO: 4586642 - DNA, 21 bp, Homo sapiens
tgtgcggagcgggaggcggtg

SEQ ID NO: 4586643 - DNA, 17 bp, Homo sapiens
tgtgctacatgacgaca

SEQ ID NO: 4586644 - DNA, 13 bp, Homo sapiens
tgtgctatactgc

SEQ ID NO: 4586645 - DNA, 22 bp, Homo sapiens
tgtgctatataaatatgtcaga

SEQ ID NO: 4586646 - DNA, 13 bp, Homo sapiens
tgtgctcaccctc

SEQ ID NO: 4586647 - DNA, 15 bp, Homo sapiens
tgtgctcggacacag

SEQ ID NO: 4586648 - DNA, 16 bp, Homo sapiens
tgtgctcggacacagt

SEQ ID NO: 4586649 - DNA, 16 bp, Homo sapiens
tgtgctctggaggctg

SEQ ID NO: 4586650 - DNA, 17 bp, Homo sapiens
tgtgctgaccctcctgt

SEQ ID NO: 4586651 - DNA, 22 bp, Homo sapiens
tgtgctgcgcctgcaggcagag

SEQ ID NO: 4586652 - DNA, 22 bp, Homo sapiens
tgtgctggaggggtggcccaga

SEQ ID NO: 4586653 - DNA, 16 bp, Homo sapiens
tgtgctgtattttgat

SEQ ID NO: 4586654 - DNA, 14 bp, Homo sapiens
tgtgctgtggaagc

SEQ ID NO: 4586655 - DNA, 13 bp, Homo sapiens
tgtgctgtggaga

SEQ ID NO: 4586656 - DNA, 15 bp, Homo sapiens
tgtgctgtggagaga

SEQ ID NO: 4586657 - DNA, 16 bp, Homo sapiens
tgtgctgtgggcagca

SEQ ID NO: 4586658 - DNA, 19 bp, Homo sapiens
tgtgctgtgggcagcaccc

SEQ ID NO: 4586659 - DNA, 14 bp, Homo sapiens
tgtgctgtttgaaa

SEQ ID NO: 4586660 - DNA, 23 bp, Homo sapiens
tgtgctgtttgcttgtagttgaa

SEQ ID NO: 4586661 - DNA, 15 bp, Homo sapiens
tgtgctgttttctgt

SEQ ID NO: 4586662 - DNA, 17 bp, Homo sapiens
tgtgctgttttctgtaa

SEQ ID NO: 4586663 - DNA, 14 bp, Homo sapiens
tgtgcttcatctgt

SEQ ID NO: 4586664 - DNA, 19 bp, Homo sapiens
tgtgctttattgaattaga

SEQ ID NO: 4586665 - DNA, 21 bp, Homo sapiens
tgtgctttattgaattagaaa

SEQ ID NO: 4586666 - DNA, 22 bp, Homo sapiens
tgtgctttattgaattagaaaa

SEQ ID NO: 4586667 - DNA, 14 bp, Homo sapiens
tgtgctttcaagat

SEQ ID NO: 4586668 - DNA, 11 bp, Homo sapiens
tgtgctttcta

SEQ ID NO: 4586669 - DNA, 14 bp, Homo sapiens
tgtgctttgagaag

SEQ ID NO: 4586670 - DNA, 15 bp, Homo sapiens
tgtgctttttaagaa

SEQ ID NO: 4586671 - DNA, 17 bp, Homo sapiens
tgtgctttttttgtgtg

SEQ ID NO: 4586672 - DNA, 13 bp, Homo sapiens
tgtggaataatac

SEQ ID NO: 4586673 - DNA, 19 bp, Homo sapiens
tgtggaataatacatacta

SEQ ID NO: 4586674 - DNA, 19 bp, Homo sapiens
tgtggaatgtcgcagactc

SEQ ID NO: 4586675 - DNA, 14 bp, Homo sapiens
tgtggacaggatga

SEQ ID NO: 4586676 - DNA, 18 bp, Homo sapiens
tgtggactggaacatggt

SEQ ID NO: 4586677 - DNA, 21 bp, Homo sapiens
tgtggagaccctgccacagcc

SEQ ID NO: 4586678 - DNA, 16 bp, Homo sapiens
tgtggaggaagagcca

SEQ ID NO: 4586679 - DNA, 19 bp, Homo sapiens
tgtggatcaaccatcgctt

SEQ ID NO: 4586680 - DNA, 14 bp, Homo sapiens
tgtggatgaaaaaa

SEQ ID NO: 4586681 - DNA, 16 bp, Homo sapiens
tgtggatgaaaaaaag

SEQ ID NO: 4586682 - DNA, 17 bp, Homo sapiens
tgtggattctgaggccc

SEQ ID NO: 4586683 - DNA, 14 bp, Homo sapiens
tgtggattctttaa

SEQ ID NO: 4586684 - DNA, 13 bp, Homo sapiens
tgtggattttgta

SEQ ID NO: 4586685 - DNA, 15 bp, Homo sapiens
tgtggcagagttaca

SEQ ID NO: 4586686 - DNA, 21 bp, Homo sapiens
tgtggcagagttacagttctg

SEQ ID NO: 4586687 - DNA, 16 bp, Homo sapiens
tgtggcatccagagtc

SEQ ID NO: 4586688 - DNA, 21 bp, Homo sapiens
tgtggcatctttgccttgggc

SEQ ID NO: 4586689 - DNA, 12 bp, Homo sapiens
tgtggcccagca

SEQ ID NO: 4586690 - DNA, 21 bp, Homo sapiens
tgtggcccagcacgagcctgg

SEQ ID NO: 4586691 - DNA, 17 bp, Homo sapiens
tgtggccccaagagggg

SEQ ID NO: 4586692 - DNA, 16 bp, Homo sapiens
tgtggcccctcccctg

SEQ ID NO: 4586693 - DNA, 12 bp, Homo sapiens
tgtggccctggc

SEQ ID NO: 4586694 - DNA, 17 bp, Homo sapiens
tgtggccggcctcctcc

SEQ ID NO: 4586695 - DNA, 23 bp, Homo sapiens
tgtggccggcctcctcctcaccc

SEQ ID NO: 4586696 - DNA, 18 bp, Homo sapiens
tgtggccggtgccagctg

SEQ ID NO: 4586697 - DNA, 19 bp, Homo sapiens
tgtggccggtgccagctgc

SEQ ID NO: 4586698 - DNA, 21 bp, Homo sapiens
tgtggccggtgccagctgccc

SEQ ID NO: 4586699 - DNA, 17 bp, Homo sapiens
tgtggccgtctcctccc

SEQ ID NO: 4586700 - DNA, 15 bp, Homo sapiens
tgtggcctaacctgc

SEQ ID NO: 4586701 - DNA, 13 bp, Homo sapiens
tgtggcctcagaa

SEQ ID NO: 4586702 - DNA, 15 bp, Homo sapiens
tgtggcctcagccct

SEQ ID NO: 4586703 - DNA, 10 bp, Homo sapiens
tgtggcctga

SEQ ID NO: 4586704 - DNA, 22 bp, Homo sapiens
tgtggcgagccatttgtcccaa

SEQ ID NO: 4586705 - DNA, 17 bp, Homo sapiens
tgtggctaaaaaagctg

SEQ ID NO: 4586706 - DNA, 17 bp, Homo sapiens
tgtggctcctatctgtg

SEQ ID NO: 4586707 - DNA, 19 bp, Homo sapiens
tgtggctcctatctgtgtt

SEQ ID NO: 4586708 - DNA, 13 bp, Homo sapiens
tgtggctctgccc

SEQ ID NO: 4586709 - DNA, 17 bp, Homo sapiens
tgtggctctgccctgga

SEQ ID NO: 4586710 - DNA, 16 bp, Homo sapiens
tgtggctgaggaggcc

SEQ ID NO: 4586711 - DNA, 21 bp, Homo sapiens
tgtggctgaggaggcctccat

SEQ ID NO: 4586712 - DNA, 22 bp, Homo sapiens
tgtggctgaggaggcctccatc

SEQ ID NO: 4586713 - DNA, 13 bp, Homo sapiens
tgtggctggctct

SEQ ID NO: 4586714 - DNA, 18 bp, Homo sapiens
tgtggctgggggcaggag

SEQ ID NO: 4586715 - DNA, 21 bp, Homo sapiens
tgtggctgggggcaggagggc

SEQ ID NO: 4586716 - DNA, 15 bp, Homo sapiens
tgtggctggtgtccc

SEQ ID NO: 4586717 - DNA, 23 bp, Homo sapiens
tgtggctggtgtccccttcccct

SEQ ID NO: 4586718 - DNA, 13 bp, Homo sapiens
tgtggctgtgcaa

SEQ ID NO: 4586719 - DNA, 21 bp, Homo sapiens
tgtggctgtgtgtctgcttgt

SEQ ID NO: 4586720 - DNA, 13 bp, Homo sapiens
tgtggctttccag

SEQ ID NO: 4586721 - DNA, 15 bp, Homo sapiens
tgtgggaaggccagc

SEQ ID NO: 4586722 - DNA, 15 bp, Homo sapiens
tgtgggactgtacac

SEQ ID NO: 4586723 - DNA, 14 bp, Homo sapiens
tgtgggagccgcag

SEQ ID NO: 4586724 - DNA, 15 bp, Homo sapiens
tgtgggagtgtgtaa

SEQ ID NO: 4586725 - DNA, 13 bp, Homo sapiens
tgtgggatgctga

SEQ ID NO: 4586726 - DNA, 17 bp, Homo sapiens
tgtggggaggggaaggg

SEQ ID NO: 4586727 - DNA, 22 bp, Homo sapiens
tgtggggagggtgtctggggac

SEQ ID NO: 4586728 - DNA, 17 bp, Homo sapiens
tgtggggggacagacag

SEQ ID NO: 4586729 - DNA, 20 bp, Homo sapiens
tgtgggggtggccatccctg

SEQ ID NO: 4586730 - DNA, 13 bp, Homo sapiens
tgtggggtggggt

SEQ ID NO: 4586731 - DNA, 14 bp, Homo sapiens
tgtgggtctgtgtg

SEQ ID NO: 4586732 - DNA, 17 bp, Homo sapiens
tgtgggtgatggggagg

SEQ ID NO: 4586733 - DNA, 13 bp, Homo sapiens
tgtgggtggggcc

SEQ ID NO: 4586734 - DNA, 21 bp, Homo sapiens
tgtgggtgttctttcctgccc

SEQ ID NO: 4586735 - DNA, 22 bp, Homo sapiens
tgtgggtgttctttcctgccct

SEQ ID NO: 4586736 - DNA, 22 bp, Homo sapiens
tgtggtaggtgataaagaggca

SEQ ID NO: 4586737 - DNA, 23 bp, Homo sapiens
tgtggtcacagctgtatagctgc

SEQ ID NO: 4586738 - DNA, 17 bp, Homo sapiens
tgtggtgaagtgtggct

SEQ ID NO: 4586739 - DNA, 17 bp, Homo sapiens
tgtggttcctctgctca

SEQ ID NO: 4586740 - DNA, 17 bp, Homo sapiens
tgtggtttcatgttagt

SEQ ID NO: 4586741 - DNA, 10 bp, Homo sapiens
tgtggtttta

SEQ ID NO: 4586742 - DNA, 13 bp, Homo sapiens
tgtgtaaaattaa

SEQ ID NO: 4586743 - DNA, 14 bp, Homo sapiens
tgtgtaaatttgta

SEQ ID NO: 4586744 - DNA, 13 bp, Homo sapiens
tgtgtaacatctg

SEQ ID NO: 4586745 - DNA, 16 bp, Homo sapiens
tgtgtaacatctgcca

SEQ ID NO: 4586746 - DNA, 23 bp, Homo sapiens
tgtgtaataaagtgttttcagag

SEQ ID NO: 4586747 - DNA, 22 bp, Homo sapiens
tgtgtaatttaaaattgtgatg

SEQ ID NO: 4586748 - DNA, 17 bp, Homo sapiens
tgtgtacataactgaaa

SEQ ID NO: 4586749 - DNA, 14 bp, Homo sapiens
tgtgtactcagggc

SEQ ID NO: 4586750 - DNA, 15 bp, Homo sapiens
tgtgtagatagtatg

SEQ ID NO: 4586751 - DNA, 15 bp, Homo sapiens
tgtgtagatttgaaa

SEQ ID NO: 4586752 - DNA, 18 bp, Homo sapiens
tgtgtagctgcaaaaata

SEQ ID NO: 4586753 - DNA, 14 bp, Homo sapiens
tgtgtagttccagc

SEQ ID NO: 4586754 - DNA, 16 bp, Homo sapiens
tgtgtatacagccctg

SEQ ID NO: 4586755 - DNA, 12 bp, Homo sapiens
tgtgtatacata

SEQ ID NO: 4586756 - DNA, 14 bp, Homo sapiens
tgtgtatagctgtg

SEQ ID NO: 4586757 - DNA, 17 bp, Homo sapiens
tgtgtatatatcttata

SEQ ID NO: 4586758 - DNA, 17 bp, Homo sapiens
tgtgtatattacaccaa

SEQ ID NO: 4586759 - DNA, 20 bp, Homo sapiens
tgtgtattcttaaaatgcaa

SEQ ID NO: 4586760 - DNA, 23 bp, Homo sapiens
tgtgtattcttaaaatgcaatat

SEQ ID NO: 4586761 - DNA, 17 bp, Homo sapiens
tgtgtatttaattgtaa

SEQ ID NO: 4586762 - DNA, 19 bp, Homo sapiens
tgtgtatttaattgtaaac

SEQ ID NO: 4586763 - DNA, 20 bp, Homo sapiens
tgtgtatttatttaaaactc

SEQ ID NO: 4586764 - DNA, 14 bp, Homo sapiens
tgtgtatttcttaa

SEQ ID NO: 4586765 - DNA, 11 bp, Homo sapiens
tgtgtatttgc

SEQ ID NO: 4586766 - DNA, 17 bp, Homo sapiens
tgtgtcagagcccagcc

SEQ ID NO: 4586767 - DNA, 22 bp, Homo sapiens
tgtgtcagagcccagcccagga

SEQ ID NO: 4586768 - DNA, 21 bp, Homo sapiens
tgtgtcatactgtgcaggcct

SEQ ID NO: 4586769 - DNA, 13 bp, Homo sapiens
tgtgtcatttctt

SEQ ID NO: 4586770 - DNA, 17 bp, Homo sapiens
tgtgtcatttcttcact

SEQ ID NO: 4586771 - DNA, 16 bp, Homo sapiens
tgtgtccccctctgtc

SEQ ID NO: 4586772 - DNA, 13 bp, Homo sapiens
tgtgtcccctcac

SEQ ID NO: 4586773 - DNA, 22 bp, Homo sapiens
tgtgtcccctcactctgtcagc

SEQ ID NO: 4586774 - DNA, 17 bp, Homo sapiens
tgtgtccctggaacctt

SEQ ID NO: 4586775 - DNA, 20 bp, Homo sapiens
tgtgtccctggaaccttcta

SEQ ID NO: 4586776 - DNA, 17 bp, Homo sapiens
tgtgtcctaaggcccat

SEQ ID NO: 4586777 - DNA, 14 bp, Homo sapiens
tgtgtcctcaggga

SEQ ID NO: 4586778 - DNA, 14 bp, Homo sapiens
tgtgtccttgcacc

SEQ ID NO: 4586779 - DNA, 19 bp, Homo sapiens
tgtgtccttgcacctgcat

SEQ ID NO: 4586780 - DNA, 19 bp, Homo sapiens
tgtgtctaggcaggacctg

SEQ ID NO: 4586781 - DNA, 19 bp, Homo sapiens
tgtgtgaagtgagaactcc

SEQ ID NO: 4586782 - DNA, 17 bp, Homo sapiens
tgtgtgaatgaacactc

SEQ ID NO: 4586783 - DNA, 15 bp, Homo sapiens
tgtgtgacaattctg

SEQ ID NO: 4586784 - DNA, 20 bp, Homo sapiens
tgtgtgacaattctgttttt

SEQ ID NO: 4586785 - DNA, 17 bp, Homo sapiens
tgtgtgagtgtgaatat

SEQ ID NO: 4586786 - DNA, 12 bp, Homo sapiens
tgtgtgataaat

SEQ ID NO: 4586787 - DNA, 15 bp, Homo sapiens
tgtgtgattaaaagg

SEQ ID NO: 4586788 - DNA, 17 bp, Homo sapiens
tgtgtgcatatttgtta

SEQ ID NO: 4586789 - DNA, 20 bp, Homo sapiens
tgtgtgcatggaagtaatta

SEQ ID NO: 4586790 - DNA, 16 bp, Homo sapiens
tgtgtgccaagccctg

SEQ ID NO: 4586791 - DNA, 17 bp, Homo sapiens
tgtgtgccaagccctgg

SEQ ID NO: 4586792 - DNA, 20 bp, Homo sapiens
tgtgtgctcacaatgttctg

SEQ ID NO: 4586793 - DNA, 14 bp, Homo sapiens
tgtgtggattcttt

SEQ ID NO: 4586794 - DNA, 19 bp, Homo sapiens
tgtgtggcagggggccccg

SEQ ID NO: 4586795 - DNA, 16 bp, Homo sapiens
tgtgtggccggcctcc

SEQ ID NO: 4586796 - DNA, 14 bp, Homo sapiens
tgtgtggctgtgca

SEQ ID NO: 4586797 - DNA, 16 bp, Homo sapiens
tgtgtgggagtgtgta

SEQ ID NO: 4586798 - DNA, 14 bp, Homo sapiens
tgtgtggtactttg

SEQ ID NO: 4586799 - DNA, 20 bp, Homo sapiens
tgtgtggtactttgcagctg

SEQ ID NO: 4586800 - DNA, 21 bp, Homo sapiens
tgtgtggtactttgcagctgc

SEQ ID NO: 4586801 - DNA, 17 bp, Homo sapiens
tgtgtgtatatgtattt

SEQ ID NO: 4586802 - DNA, 13 bp, Homo sapiens
tgtgtgtatttgc

SEQ ID NO: 4586803 - DNA, 16 bp, Homo sapiens
tgtgtgtgacaattct

SEQ ID NO: 4586804 - DNA, 13 bp, Homo sapiens
tgtgtgtggcagg

SEQ ID NO: 4586805 - DNA, 13 bp, Homo sapiens
tgtgtgtgtgtat

SEQ ID NO: 4586806 - DNA, 10 bp, Homo sapiens
tgtgtgtttg

SEQ ID NO: 4586807 - DNA, 13 bp, Homo sapiens
tgtgttcaatctg

SEQ ID NO: 4586808 - DNA, 20 bp, Homo sapiens
tgtgttcaatgaaataaaag

SEQ ID NO: 4586809 - DNA, 12 bp, Homo sapiens
tgtgttcatttc

SEQ ID NO: 4586810 - DNA, 14 bp, Homo sapiens
tgtgttcatttcat

SEQ ID NO: 4586811 - DNA, 16 bp, Homo sapiens
tgtgttcccatttcag

SEQ ID NO: 4586812 - DNA, 19 bp, Homo sapiens
tgtgttcccatttcagctg

SEQ ID NO: 4586813 - DNA, 19 bp, Homo sapiens
tgtgttcctttttgcagca

SEQ ID NO: 4586814 - DNA, 12 bp, Homo sapiens
tgtgttctgggc

SEQ ID NO: 4586815 - DNA, 13 bp, Homo sapiens
tgtgttctgggct

SEQ ID NO: 4586816 - DNA, 18 bp, Homo sapiens
tgtgttctgggctggggc

SEQ ID NO: 4586817 - DNA, 14 bp, Homo sapiens
tgtgttgaaaacca

SEQ ID NO: 4586818 - DNA, 16 bp, Homo sapiens
tgtgttgaaaaccaaa

SEQ ID NO: 4586819 - DNA, 16 bp, Homo sapiens
tgtgttgcactgaaca

SEQ ID NO: 4586820 - DNA, 13 bp, Homo sapiens
tgtgttgcttcaa

SEQ ID NO: 4586821 - DNA, 23 bp, Homo sapiens
tgtgttgtgtgtgggagtgtgta

SEQ ID NO: 4586822 - DNA, 13 bp, Homo sapiens
tgtgtttatgtgt

SEQ ID NO: 4586823 - DNA, 17 bp, Homo sapiens
tgtgtttcattacttga

SEQ ID NO: 4586824 - DNA, 21 bp, Homo sapiens
tgtgtttcattacttgaatgt

SEQ ID NO: 4586825 - DNA, 22 bp, Homo sapiens
tgtgtttcattacttgaatgta

SEQ ID NO: 4586826 - DNA, 20 bp, Homo sapiens
tgtgtttctatgtgacaatt

SEQ ID NO: 4586827 - DNA, 21 bp, Homo sapiens
tgtgtttctgtcctgtaactg

SEQ ID NO: 4586828 - DNA, 15 bp, Homo sapiens
tgtgtttgtgtattt

SEQ ID NO: 4586829 - DNA, 20 bp, Homo sapiens
tgtgttttcatcatttcagc

SEQ ID NO: 4586830 - DNA, 15 bp, Homo sapiens
tgtgttttctttggt

SEQ ID NO: 4586831 - DNA, 16 bp, Homo sapiens
tgtgttttgaaagaat

SEQ ID NO: 4586832 - DNA, 13 bp, Homo sapiens
tgtgtttttctca

SEQ ID NO: 4586833 - DNA, 14 bp, Homo sapiens
tgtgtttttctcca

SEQ ID NO: 4586834 - DNA, 18 bp, Homo sapiens
tgtgtttttctccagtgc

SEQ ID NO: 4586835 - DNA, 20 bp, Homo sapiens
tgtgtttttctccagtgctg

SEQ ID NO: 4586836 - DNA, 18 bp, Homo sapiens
tgtgtttttgggatgtct

SEQ ID NO: 4586837 - DNA, 14 bp, Homo sapiens
tgtgttttttaaga

SEQ ID NO: 4586838 - DNA, 16 bp, Homo sapiens
tgtgtttttttctaaa

SEQ ID NO: 4586839 - DNA, 20 bp, Homo sapiens
tgttaaaaaaataagaagaa

SEQ ID NO: 4586840 - DNA, 22 bp, Homo sapiens
tgttaaaaaaataagaagaatg

SEQ ID NO: 4586841 - DNA, 21 bp, Homo sapiens
tgttaaaagaaaataaattac

SEQ ID NO: 4586842 - DNA, 16 bp, Homo sapiens
tgttaaatacaggaaa

SEQ ID NO: 4586843 - DNA, 14 bp, Homo sapiens
tgttaacaatgcct

SEQ ID NO: 4586844 - DNA, 19 bp, Homo sapiens
tgttaacaatgcctattgt

SEQ ID NO: 4586845 - DNA, 23 bp, Homo sapiens
tgttaacagcaacgaaccctaga

SEQ ID NO: 4586846 - DNA, 15 bp, Homo sapiens
tgttaacagtatttc

SEQ ID NO: 4586847 - DNA, 17 bp, Homo sapiens
tgttaacttattcaaag

SEQ ID NO: 4586848 - DNA, 18 bp, Homo sapiens
tgttaacttattcaaaga

SEQ ID NO: 4586849 - DNA, 23 bp, Homo sapiens
tgttaacttattcaaagagaaaa

SEQ ID NO: 4586850 - DNA, 20 bp, Homo sapiens
tgttaagcgtgtctgtattt

SEQ ID NO: 4586851 - DNA, 20 bp, Homo sapiens
tgttaagggaagaattccag

SEQ ID NO: 4586852 - DNA, 18 bp, Homo sapiens
tgttaagtcctccctgac

SEQ ID NO: 4586853 - DNA, 19 bp, Homo sapiens
tgttaataaaagtacatgt

SEQ ID NO: 4586854 - DNA, 14 bp, Homo sapiens
tgttaatacatcac

SEQ ID NO: 4586855 - DNA, 12 bp, Homo sapiens
tgttaatatcac

SEQ ID NO: 4586856 - DNA, 19 bp, Homo sapiens
tgttaatcttaatgtatat

SEQ ID NO: 4586857 - DNA, 22 bp, Homo sapiens
tgttaatttagaaaactttaaa

SEQ ID NO: 4586858 - DNA, 22 bp, Homo sapiens
tgttaatttataatgtatttga

SEQ ID NO: 4586859 - DNA, 23 bp, Homo sapiens
tgttaatttataatgtatttgaa

SEQ ID NO: 4586860 - DNA, 15 bp, Homo sapiens
tgttaatttatttag

SEQ ID NO: 4586861 - DNA, 15 bp, Homo sapiens
tgttaatttttgata

SEQ ID NO: 4586862 - DNA, 21 bp, Homo sapiens
tgttaattttttggtacaaaa

SEQ ID NO: 4586863 - DNA, 22 bp, Homo sapiens
tgttaattttttggtacaaaaa

SEQ ID NO: 4586864 - DNA, 18 bp, Homo sapiens
tgttacaaaatgttcagt

SEQ ID NO: 4586865 - DNA, 20 bp, Homo sapiens
tgttacaacttgtatttcca

SEQ ID NO: 4586866 - DNA, 16 bp, Homo sapiens
tgttacacaatggttt

SEQ ID NO: 4586867 - DNA, 17 bp, Homo sapiens
tgttacacagcccaaga

SEQ ID NO: 4586868 - DNA, 20 bp, Homo sapiens
tgttacacgtgcctgtagtc

SEQ ID NO: 4586869 - DNA, 21 bp, Homo sapiens
tgttacacgtgcctgtagtcc

SEQ ID NO: 4586870 - DNA, 14 bp, Homo sapiens
tgttacattattcc

SEQ ID NO: 4586871 - DNA, 14 bp, Homo sapiens
tgttaccattcaca

SEQ ID NO: 4586872 - DNA, 15 bp, Homo sapiens
tgttaccattcacaa

SEQ ID NO: 4586873 - DNA, 15 bp, Homo sapiens
tgttacctgaaaaca

SEQ ID NO: 4586874 - DNA, 22 bp, Homo sapiens
tgttacctgaaaacactgtgca

SEQ ID NO: 4586875 - DNA, 15 bp, Homo sapiens
tgttaccttcacatg

SEQ ID NO: 4586876 - DNA, 21 bp, Homo sapiens
tgttacggcatcacacttata

SEQ ID NO: 4586877 - DNA, 16 bp, Homo sapiens
tgttacgtagcctaag

SEQ ID NO: 4586878 - DNA, 14 bp, Homo sapiens
tgttactcttacga

SEQ ID NO: 4586879 - DNA, 19 bp, Homo sapiens
tgttactgcatcatctgtt

SEQ ID NO: 4586880 - DNA, 19 bp, Homo sapiens
tgttactgcttctctttgt

SEQ ID NO: 4586881 - DNA, 14 bp, Homo sapiens
tgttactgtaattc

SEQ ID NO: 4586882 - DNA, 15 bp, Homo sapiens
tgttactgtaattcc

SEQ ID NO: 4586883 - DNA, 14 bp, Homo sapiens
tgttacttctgata

SEQ ID NO: 4586884 - DNA, 18 bp, Homo sapiens
tgttagaaaatgacttat

SEQ ID NO: 4586885 - DNA, 23 bp, Homo sapiens
tgttagaaaatgacttatttctg

SEQ ID NO: 4586886 - DNA, 13 bp, Homo sapiens
tgttagaacacta

SEQ ID NO: 4586887 - DNA, 20 bp, Homo sapiens
tgttagaacactattttcag

SEQ ID NO: 4586888 - DNA, 15 bp, Homo sapiens
tgttagactcatggt

SEQ ID NO: 4586889 - DNA, 23 bp, Homo sapiens
tgttagatgcttagtgtgaagtt

SEQ ID NO: 4586890 - DNA, 12 bp, Homo sapiens
tgttagatgttt

SEQ ID NO: 4586891 - DNA, 13 bp, Homo sapiens
tgttagcaaagat

SEQ ID NO: 4586892 - DNA, 15 bp, Homo sapiens
tgttagcaaagatta

SEQ ID NO: 4586893 - DNA, 22 bp, Homo sapiens
tgttagcactgatagtcctttt

SEQ ID NO: 4586894 - DNA, 14 bp, Homo sapiens
tgttagctgggaag

SEQ ID NO: 4586895 - DNA, 21 bp, Homo sapiens
tgttaggattttcacattctt

SEQ ID NO: 4586896 - DNA, 20 bp, Homo sapiens
tgttaggcatgtcccaccca

SEQ ID NO: 4586897 - DNA, 14 bp, Homo sapiens
tgttagtgctggtc

SEQ ID NO: 4586898 - DNA, 21 bp, Homo sapiens
tgttatactgaaccaggccag

SEQ ID NO: 4586899 - DNA, 19 bp, Homo sapiens
tgttatagaacttcatgga

SEQ ID NO: 4586900 - DNA, 20 bp, Homo sapiens
tgttatagaacttcatggat

SEQ ID NO: 4586901 - DNA, 16 bp, Homo sapiens
tgttatagattgtctt

SEQ ID NO: 4586902 - DNA, 17 bp, Homo sapiens
tgttatagattgtctta

SEQ ID NO: 4586903 - DNA, 18 bp, Homo sapiens
tgttatagattgtcttaa

SEQ ID NO: 4586904 - DNA, 18 bp, Homo sapiens
tgttatattgcttcctgt

SEQ ID NO: 4586905 - DNA, 22 bp, Homo sapiens
tgttatcaaacaccaacataaa

SEQ ID NO: 4586906 - DNA, 17 bp, Homo sapiens
tgttatcaaactgctgt

SEQ ID NO: 4586907 - DNA, 17 bp, Homo sapiens
tgttatctcaggtgagc

SEQ ID NO: 4586908 - DNA, 15 bp, Homo sapiens
tgttatgctgtgaca

SEQ ID NO: 4586909 - DNA, 15 bp, Homo sapiens
tgttatggtagaaaa

SEQ ID NO: 4586910 - DNA, 16 bp, Homo sapiens
tgttatggtagaaaaa

SEQ ID NO: 4586911 - DNA, 17 bp, Homo sapiens
tgttatggtagaaaaat

SEQ ID NO: 4586912 - DNA, 23 bp, Homo sapiens
tgttatgtttctacacattgcta

SEQ ID NO: 4586913 - DNA, 14 bp, Homo sapiens
tgttattaaacaaa

SEQ ID NO: 4586914 - DNA, 13 bp, Homo sapiens
tgttattaaatgt

SEQ ID NO: 4586915 - DNA, 14 bp, Homo sapiens
tgttattaaatgta

SEQ ID NO: 4586916 - DNA, 17 bp, Homo sapiens
tgttattaatgtttctt

SEQ ID NO: 4586917 - DNA, 23 bp, Homo sapiens
tgttattagagattacctcctga

SEQ ID NO: 4586918 - DNA, 16 bp, Homo sapiens
tgttattatctgggct

SEQ ID NO: 4586919 - DNA, 23 bp, Homo sapiens
tgttattatctgggcttatatct

SEQ ID NO: 4586920 - DNA, 17 bp, Homo sapiens
tgttatttctatgaaaa

SEQ ID NO: 4586921 - DNA, 18 bp, Homo sapiens
tgttatttctatgaaaat

SEQ ID NO: 4586922 - DNA, 20 bp, Homo sapiens
tgttatttttaagcttttat

SEQ ID NO: 4586923 - DNA, 21 bp, Homo sapiens
tgttcaaagccagcgtcctcc

SEQ ID NO: 4586924 - DNA, 16 bp, Homo sapiens
tgttcaaatgcatttt

SEQ ID NO: 4586925 - DNA, 19 bp, Homo sapiens
tgttcaagaccagcctggt

SEQ ID NO: 4586926 - DNA, 15 bp, Homo sapiens
tgttcaatctgtgaa

SEQ ID NO: 4586927 - DNA, 15 bp, Homo sapiens
tgttcacaaactgtg

SEQ ID NO: 4586928 - DNA, 16 bp, Homo sapiens
tgttcacaaactgtga

SEQ ID NO: 4586929 - DNA, 19 bp, Homo sapiens
tgttcagaattaagcagaa

SEQ ID NO: 4586930 - DNA, 21 bp, Homo sapiens
tgttcatcttgtacaaacttt

SEQ ID NO: 4586931 - DNA, 14 bp, Homo sapiens
tgttcattttgaaa

SEQ ID NO: 4586932 - DNA, 15 bp, Homo sapiens
tgttcattttgaaaa

SEQ ID NO: 4586933 - DNA, 16 bp, Homo sapiens
tgttccacattctctc

SEQ ID NO: 4586934 - DNA, 22 bp, Homo sapiens
tgttccagactcaggttccaga

SEQ ID NO: 4586935 - DNA, 21 bp, Homo sapiens
tgttccagccaaagcatgccg

SEQ ID NO: 4586936 - DNA, 14 bp, Homo sapiens
tgttccagctcttt

SEQ ID NO: 4586937 - DNA, 19 bp, Homo sapiens
tgttccaggccctccagtg

SEQ ID NO: 4586938 - DNA, 18 bp, Homo sapiens
tgttccagtaatctaata

SEQ ID NO: 4586939 - DNA, 13 bp, Homo sapiens
tgttcccagcccc

SEQ ID NO: 4586940 - DNA, 15 bp, Homo sapiens
tgttcccagcccctc

SEQ ID NO: 4586941 - DNA, 21 bp, Homo sapiens
tgttcccagcccctcctccct

SEQ ID NO: 4586942 - DNA, 22 bp, Homo sapiens
tgttcccagcccctcctccctc

SEQ ID NO: 4586943 - DNA, 16 bp, Homo sapiens
tgttcccagcccctgc

SEQ ID NO: 4586944 - DNA, 18 bp, Homo sapiens
tgttcccagcccctgcag

SEQ ID NO: 4586945 - DNA, 15 bp, Homo sapiens
tgttccccctgtgca

SEQ ID NO: 4586946 - DNA, 12 bp, Homo sapiens
tgttcccctcct

SEQ ID NO: 4586947 - DNA, 17 bp, Homo sapiens
tgttcccctcctccact

SEQ ID NO: 4586948 - DNA, 19 bp, Homo sapiens
tgttcccctcctccactct

SEQ ID NO: 4586949 - DNA, 15 bp, Homo sapiens
tgttcccgtgcctgg

SEQ ID NO: 4586950 - DNA, 16 bp, Homo sapiens
tgttcccgtgcctggg

SEQ ID NO: 4586951 - DNA, 13 bp, Homo sapiens
tgttccctacccc

SEQ ID NO: 4586952 - DNA, 22 bp, Homo sapiens
tgttccctatttttctctcctg

SEQ ID NO: 4586953 - DNA, 15 bp, Homo sapiens
tgttcccttgaccat

SEQ ID NO: 4586954 - DNA, 21 bp, Homo sapiens
tgttccgcttctctcttttaa

SEQ ID NO: 4586955 - DNA, 22 bp, Homo sapiens
tgttccgtgggaccctcagcag

SEQ ID NO: 4586956 - DNA, 18 bp, Homo sapiens
tgttcctagtgaaagagg

SEQ ID NO: 4586957 - DNA, 16 bp, Homo sapiens
tgttcctgaagctgct

SEQ ID NO: 4586958 - DNA, 19 bp, Homo sapiens
tgttcctgaagctgctgtg

SEQ ID NO: 4586959 - DNA, 21 bp, Homo sapiens
tgttcctgaagctgctgtgtc

SEQ ID NO: 4586960 - DNA, 14 bp, Homo sapiens
tgttcctttttctg

SEQ ID NO: 4586961 - DNA, 22 bp, Homo sapiens
tgttccttttttcaatatgcaa

SEQ ID NO: 4586962 - DNA, 20 bp, Homo sapiens
tgttcggaaggggttcctca

SEQ ID NO: 4586963 - DNA, 22 bp, Homo sapiens
tgttcgtttccatcatgtctgt

SEQ ID NO: 4586964 - DNA, 22 bp, Homo sapiens
tgttctaaatatcccttggaca

SEQ ID NO: 4586965 - DNA, 15 bp, Homo sapiens
tgttctaagaagtga

SEQ ID NO: 4586966 - DNA, 19 bp, Homo sapiens
tgttctaagactctgtgtg

SEQ ID NO: 4586967 - DNA, 22 bp, Homo sapiens
tgttctagacttccccatcccg

SEQ ID NO: 4586968 - DNA, 14 bp, Homo sapiens
tgttctagtttttt

SEQ ID NO: 4586969 - DNA, 22 bp, Homo sapiens
tgttctattaatcacctctctg

SEQ ID NO: 4586970 - DNA, 23 bp, Homo sapiens
tgttctcacactggtctgctgtc

SEQ ID NO: 4586971 - DNA, 20 bp, Homo sapiens
tgttctccctttctctctcc

SEQ ID NO: 4586972 - DNA, 19 bp, Homo sapiens
tgttctctgaattttcaga

SEQ ID NO: 4586973 - DNA, 18 bp, Homo sapiens
tgttctgaaaggagacat

SEQ ID NO: 4586974 - DNA, 15 bp, Homo sapiens
tgttctgattatgta

SEQ ID NO: 4586975 - DNA, 12 bp, Homo sapiens
tgttctgggctg

SEQ ID NO: 4586976 - DNA, 17 bp, Homo sapiens
tgttctgggctggggcc

SEQ ID NO: 4586977 - DNA, 23 bp, Homo sapiens
tgttctggtatgcattctttata

SEQ ID NO: 4586978 - DNA, 19 bp, Homo sapiens
tgttctgtggttcctctgc

SEQ ID NO: 4586979 - DNA, 16 bp, Homo sapiens
tgttctttcctgccct

SEQ ID NO: 4586980 - DNA, 22 bp, Homo sapiens
tgttctttcctgccctgtccaa

SEQ ID NO: 4586981 - DNA, 18 bp, Homo sapiens
tgttctttggaaagtaca

SEQ ID NO: 4586982 - DNA, 22 bp, Homo sapiens
tgttctttggaaagtacactct

SEQ ID NO: 4586983 - DNA, 13 bp, Homo sapiens
tgttcttttctcc

SEQ ID NO: 4586984 - DNA, 13 bp, Homo sapiens
tgttctttttaga

SEQ ID NO: 4586985 - DNA, 15 bp, Homo sapiens
tgttgaaaaaattta

SEQ ID NO: 4586986 - DNA, 16 bp, Homo sapiens
tgttgaaactttaaga

SEQ ID NO: 4586987 - DNA, 23 bp, Homo sapiens
tgttgaactaatatatgaaataa

SEQ ID NO: 4586988 - DNA, 12 bp, Homo sapiens
tgttgaactttt

SEQ ID NO: 4586989 - DNA, 14 bp, Homo sapiens
tgttgaaggaactt

SEQ ID NO: 4586990 - DNA, 22 bp, Homo sapiens
tgttgacaaatgacagatcttt

SEQ ID NO: 4586991 - DNA, 14 bp, Homo sapiens
tgttgacagcttgg

SEQ ID NO: 4586992 - DNA, 15 bp, Homo sapiens
tgttgacatatttaa

SEQ ID NO: 4586993 - DNA, 20 bp, Homo sapiens
tgttgacatatttaatgttt

SEQ ID NO: 4586994 - DNA, 19 bp, Homo sapiens
tgttgaccactccagagaa

SEQ ID NO: 4586995 - DNA, 13 bp, Homo sapiens
tgttgactgtgat

SEQ ID NO: 4586996 - DNA, 21 bp, Homo sapiens
tgttgagccatgctacagtta

SEQ ID NO: 4586997 - DNA, 21 bp, Homo sapiens
tgttgagctggtaacatcgtt

SEQ ID NO: 4586998 - DNA, 15 bp, Homo sapiens
tgttgatctttcact

SEQ ID NO: 4586999 - DNA, 15 bp, Homo sapiens
tgttgattaggaaca

SEQ ID NO: 4587000 - DNA, 16 bp, Homo sapiens
tgttgcaagcccctct

SEQ ID NO: 4587001 - DNA, 19 bp, Homo sapiens
tgttgcaccatctgcttgg

SEQ ID NO: 4587002 - DNA, 15 bp, Homo sapiens
tgttgcacccagccc

SEQ ID NO: 4587003 - DNA, 16 bp, Homo sapiens
tgttgcacccagccct

SEQ ID NO: 4587004 - DNA, 17 bp, Homo sapiens
tgttgcacccagccctg

SEQ ID NO: 4587005 - DNA, 15 bp, Homo sapiens
tgttgcactgtttgc

SEQ ID NO: 4587006 - DNA, 16 bp, Homo sapiens
tgttgcactgtttgca

SEQ ID NO: 4587007 - DNA, 15 bp, Homo sapiens
tgttgccttatttct

SEQ ID NO: 4587008 - DNA, 18 bp, Homo sapiens
tgttgccttatttctcat

SEQ ID NO: 4587009 - DNA, 16 bp, Homo sapiens
tgttgccttcatcttc

SEQ ID NO: 4587010 - DNA, 13 bp, Homo sapiens
tgttgctgaattt

SEQ ID NO: 4587011 - DNA, 15 bp, Homo sapiens
tgttgctgaatttgt

SEQ ID NO: 4587012 - DNA, 14 bp, Homo sapiens
tgttgcttctcagg

SEQ ID NO: 4587013 - DNA, 19 bp, Homo sapiens
tgttggaaagagtctccag

SEQ ID NO: 4587014 - DNA, 13 bp, Homo sapiens
tgttggaaatgtg

SEQ ID NO: 4587015 - DNA, 11 bp, Homo sapiens
tgttggataag

SEQ ID NO: 4587016 - DNA, 14 bp, Homo sapiens
tgttggccaggctg

SEQ ID NO: 4587017 - DNA, 19 bp, Homo sapiens
tgttgggactgctaaataa

SEQ ID NO: 4587018 - DNA, 16 bp, Homo sapiens
tgttgggcctttttcc

SEQ ID NO: 4587019 - DNA, 17 bp, Homo sapiens
tgttggtcaggctggtc

SEQ ID NO: 4587020 - DNA, 14 bp, Homo sapiens
tgttggtttcattt

SEQ ID NO: 4587021 - DNA, 23 bp, Homo sapiens
tgttgtaaaacaaaatttgacta

SEQ ID NO: 4587022 - DNA, 23 bp, Homo sapiens
tgttgtacatacagaggtaacta

SEQ ID NO: 4587023 - DNA, 15 bp, Homo sapiens
tgttgtatgccttta

SEQ ID NO: 4587024 - DNA, 16 bp, Homo sapiens
tgttgtattcctgcct

SEQ ID NO: 4587025 - DNA, 12 bp, Homo sapiens
tgttgtcaagga

SEQ ID NO: 4587026 - DNA, 20 bp, Homo sapiens
tgttgtccctactttctctc

SEQ ID NO: 4587027 - DNA, 19 bp, Homo sapiens
tgttgtgcactagtgcaat

SEQ ID NO: 4587028 - DNA, 18 bp, Homo sapiens
tgttgtgtgtatatgtat

SEQ ID NO: 4587029 - DNA, 19 bp, Homo sapiens
tgttgtgtgtatatgtatt

SEQ ID NO: 4587030 - DNA, 14 bp, Homo sapiens
tgttgtgtgtggga

SEQ ID NO: 4587031 - DNA, 22 bp, Homo sapiens
tgttgttgtgtgtatatgtatt

SEQ ID NO: 4587032 - DNA, 21 bp, Homo sapiens
tgttgtttcctaatatcaaat

SEQ ID NO: 4587033 - DNA, 15 bp, Homo sapiens
tgttgtttttggatg

SEQ ID NO: 4587034 - DNA, 18 bp, Homo sapiens
tgtttaaaataaaatgaa

SEQ ID NO: 4587035 - DNA, 17 bp, Homo sapiens
tgtttaaaatcatttct

SEQ ID NO: 4587036 - DNA, 18 bp, Homo sapiens
tgtttaaaatcatttctg

SEQ ID NO: 4587037 - DNA, 24 bp, Homo sapiens
tgtttaaacacttatcttctggat

SEQ ID NO: 4587038 - DNA, 21 bp, Homo sapiens
tgtttaaagtcacatccctgt

SEQ ID NO: 4587039 - DNA, 13 bp, Homo sapiens
tgtttaaatgcca

SEQ ID NO: 4587040 - DNA, 16 bp, Homo sapiens
tgtttaaatgccaaaa

SEQ ID NO: 4587041 - DNA, 17 bp, Homo sapiens
tgtttaaatgccaaaat

SEQ ID NO: 4587042 - DNA, 14 bp, Homo sapiens
tgtttaagtcattt

SEQ ID NO: 4587043 - DNA, 24 bp, Homo sapiens
tgtttaagtcattttttacttgaa

SEQ ID NO: 4587044 - DNA, 15 bp, Homo sapiens
tgtttaatctacatt

SEQ ID NO: 4587045 - DNA, 18 bp, Homo sapiens
tgtttaatttttatttct

SEQ ID NO: 4587046 - DNA, 19 bp, Homo sapiens
tgtttacaaaatcaggtaa

SEQ ID NO: 4587047 - DNA, 14 bp, Homo sapiens
tgtttacagaggac

SEQ ID NO: 4587048 - DNA, 22 bp, Homo sapiens
tgtttacagcactactctgtgc

SEQ ID NO: 4587049 - DNA, 22 bp, Homo sapiens
tgtttacatttgatgcatgtct

SEQ ID NO: 4587050 - DNA, 20 bp, Homo sapiens
tgtttactcattgaagcaga

SEQ ID NO: 4587051 - DNA, 21 bp, Homo sapiens
tgtttactcccttctgtagtt

SEQ ID NO: 4587052 - DNA, 20 bp, Homo sapiens
tgtttactctcttcatccgt

SEQ ID NO: 4587053 - DNA, 17 bp, Homo sapiens
tgtttactgtatcaatt

SEQ ID NO: 4587054 - DNA, 24 bp, Homo sapiens
tgtttactgtatcaatttctaatg

SEQ ID NO: 4587055 - DNA, 15 bp, Homo sapiens
tgtttacttgaatag

SEQ ID NO: 4587056 - DNA, 23 bp, Homo sapiens
tgtttagtctcgctaaagttata

SEQ ID NO: 4587057 - DNA, 16 bp, Homo sapiens
tgtttagttcagcaaa

SEQ ID NO: 4587058 - DNA, 14 bp, Homo sapiens
tgtttagttttaca

SEQ ID NO: 4587059 - DNA, 19 bp, Homo sapiens
tgtttagttttacatttta

SEQ ID NO: 4587060 - DNA, 17 bp, Homo sapiens
tgtttataaatagcatt

SEQ ID NO: 4587061 - DNA, 13 bp, Homo sapiens
tgtttataaatgt

SEQ ID NO: 4587062 - DNA, 17 bp, Homo sapiens
tgtttatatggaagaaa

SEQ ID NO: 4587063 - DNA, 21 bp, Homo sapiens
tgtttatattgtttttatata

SEQ ID NO: 4587064 - DNA, 22 bp, Homo sapiens
tgtttatattgtttttatatat

SEQ ID NO: 4587065 - DNA, 18 bp, Homo sapiens
tgtttatgaattataaat

SEQ ID NO: 4587066 - DNA, 18 bp, Homo sapiens
tgtttatggaaatattaa

SEQ ID NO: 4587067 - DNA, 13 bp, Homo sapiens
tgtttatggcctc

SEQ ID NO: 4587068 - DNA, 23 bp, Homo sapiens
tgtttatggcctcagctgcctca

SEQ ID NO: 4587069 - DNA, 16 bp, Homo sapiens
tgtttatgtgtgtgtg

SEQ ID NO: 4587070 - DNA, 19 bp, Homo sapiens
tgtttattaaaattctgaa

SEQ ID NO: 4587071 - DNA, 15 bp, Homo sapiens
tgtttattaaatgct

SEQ ID NO: 4587072 - DNA, 16 bp, Homo sapiens
tgtttattaaatgctt

SEQ ID NO: 4587073 - DNA, 15 bp, Homo sapiens
tgtttattaatctta

SEQ ID NO: 4587074 - DNA, 17 bp, Homo sapiens
tgtttattaatcttagt

SEQ ID NO: 4587075 - DNA, 13 bp, Homo sapiens
tgtttattagcat

SEQ ID NO: 4587076 - DNA, 22 bp, Homo sapiens
tgtttattgacaggtcttttca

SEQ ID NO: 4587077 - DNA, 13 bp, Homo sapiens
tgtttcaaatgga

SEQ ID NO: 4587078 - DNA, 15 bp, Homo sapiens
tgtttcaacagaggg

SEQ ID NO: 4587079 - DNA, 15 bp, Homo sapiens
tgtttcaactttctt

SEQ ID NO: 4587080 - DNA, 20 bp, Homo sapiens
tgtttcagattttttaaaat

SEQ ID NO: 4587081 - DNA, 14 bp, Homo sapiens
tgtttcatctaagt

SEQ ID NO: 4587082 - DNA, 15 bp, Homo sapiens
tgtttcattttactg

SEQ ID NO: 4587083 - DNA, 20 bp, Homo sapiens
tgtttcctaactgtgatttg

SEQ ID NO: 4587084 - DNA, 17 bp, Homo sapiens
tgtttcctaatatcaaa

SEQ ID NO: 4587085 - DNA, 18 bp, Homo sapiens
tgtttcctatttaataca

SEQ ID NO: 4587086 - DNA, 15 bp, Homo sapiens
tgtttcctcatctat

SEQ ID NO: 4587087 - DNA, 21 bp, Homo sapiens
tgtttcctcatctatggttct

SEQ ID NO: 4587088 - DNA, 14 bp, Homo sapiens
tgtttcctgacaga

SEQ ID NO: 4587089 - DNA, 21 bp, Homo sapiens
tgtttcctgacattgtctcct

SEQ ID NO: 4587090 - DNA, 16 bp, Homo sapiens
tgtttctacaataatt

SEQ ID NO: 4587091 - DNA, 22 bp, Homo sapiens
tgtttctagttgaggagtttcc

SEQ ID NO: 4587092 - DNA, 16 bp, Homo sapiens
tgtttctatcctgttt

SEQ ID NO: 4587093 - DNA, 16 bp, Homo sapiens
tgtttctctgctgtca

SEQ ID NO: 4587094 - DNA, 17 bp, Homo sapiens
tgtttctctgctgtcaa

SEQ ID NO: 4587095 - DNA, 12 bp, Homo sapiens
tgtttctgactc

SEQ ID NO: 4587096 - DNA, 17 bp, Homo sapiens
tgtttctggatttcata

SEQ ID NO: 4587097 - DNA, 22 bp, Homo sapiens
tgtttctgtcaagctggtgcta

SEQ ID NO: 4587098 - DNA, 20 bp, Homo sapiens
tgtttctgtcctgtaactgt

SEQ ID NO: 4587099 - DNA, 15 bp, Homo sapiens
tgtttctgttccaaa

SEQ ID NO: 4587100 - DNA, 22 bp, Homo sapiens
tgtttcttagagccaagtgtct

SEQ ID NO: 4587101 - DNA, 12 bp, Homo sapiens
tgtttcttctcc

SEQ ID NO: 4587102 - DNA, 22 bp, Homo sapiens
tgtttcttctccaattctgaaa

SEQ ID NO: 4587103 - DNA, 19 bp, Homo sapiens
tgtttcttgccttttgtta

SEQ ID NO: 4587104 - DNA, 14 bp, Homo sapiens
tgtttcttgtttat

SEQ ID NO: 4587105 - DNA, 20 bp, Homo sapiens
tgtttctttcttcctcttct

SEQ ID NO: 4587106 - DNA, 14 bp, Homo sapiens
tgtttgaaatatca

SEQ ID NO: 4587107 - DNA, 17 bp, Homo sapiens
tgtttgaaatatcatgt

SEQ ID NO: 4587108 - DNA, 12 bp, Homo sapiens
tgtttgaatatt

SEQ ID NO: 4587109 - DNA, 22 bp, Homo sapiens
tgtttgaattcctcctctattt

SEQ ID NO: 4587110 - DNA, 18 bp, Homo sapiens
tgtttgactgtaatgtaa

SEQ ID NO: 4587111 - DNA, 13 bp, Homo sapiens
tgtttgagctcag

SEQ ID NO: 4587112 - DNA, 14 bp, Homo sapiens
tgtttgagctcaga

SEQ ID NO: 4587113 - DNA, 23 bp, Homo sapiens
tgtttgagctcagacccccactc

SEQ ID NO: 4587114 - DNA, 15 bp, Homo sapiens
tgtttgaggaaagca

SEQ ID NO: 4587115 - DNA, 19 bp, Homo sapiens
tgtttgagtttttcctccc

SEQ ID NO: 4587116 - DNA, 13 bp, Homo sapiens
tgtttgcatgcgc

SEQ ID NO: 4587117 - DNA, 19 bp, Homo sapiens
tgtttgcgtacttgtaata

SEQ ID NO: 4587118 - DNA, 18 bp, Homo sapiens
tgtttgctccaccttcat

SEQ ID NO: 4587119 - DNA, 19 bp, Homo sapiens
tgtttgctgattatttatg

SEQ ID NO: 4587120 - DNA, 19 bp, Homo sapiens
tgtttgcttcttgccatca

SEQ ID NO: 4587121 - DNA, 14 bp, Homo sapiens
tgtttggaaacatt

SEQ ID NO: 4587122 - DNA, 13 bp, Homo sapiens
tgtttggacagct

SEQ ID NO: 4587123 - DNA, 15 bp, Homo sapiens
tgtttggtataaatt

SEQ ID NO: 4587124 - DNA, 18 bp, Homo sapiens
tgtttggtgctcatttaa

SEQ ID NO: 4587125 - DNA, 15 bp, Homo sapiens
tgtttgtaaatgcct

SEQ ID NO: 4587126 - DNA, 19 bp, Homo sapiens
tgtttgtactggttcattg

SEQ ID NO: 4587127 - DNA, 14 bp, Homo sapiens
tgtttgtggcctca

SEQ ID NO: 4587128 - DNA, 15 bp, Homo sapiens
tgtttgtggcctcag

SEQ ID NO: 4587129 - DNA, 14 bp, Homo sapiens
tgtttgtgtgcatg

SEQ ID NO: 4587130 - DNA, 18 bp, Homo sapiens
tgtttgttactgtcattc

SEQ ID NO: 4587131 - DNA, 14 bp, Homo sapiens
tgtttgttttcaaa

SEQ ID NO: 4587132 - DNA, 19 bp, Homo sapiens
tgttttaaagaatatgact

SEQ ID NO: 4587133 - DNA, 14 bp, Homo sapiens
tgttttaaatgtac

SEQ ID NO: 4587134 - DNA, 15 bp, Homo sapiens
tgttttaacaaaaaa

SEQ ID NO: 4587135 - DNA, 21 bp, Homo sapiens
tgttttaaccagtacttctaa

SEQ ID NO: 4587136 - DNA, 14 bp, Homo sapiens
tgttttaatgtaga

SEQ ID NO: 4587137 - DNA, 13 bp, Homo sapiens
tgttttacaatag

SEQ ID NO: 4587138 - DNA, 17 bp, Homo sapiens
tgttttacaatagttct

SEQ ID NO: 4587139 - DNA, 17 bp, Homo sapiens
tgttttacagctgcctt

SEQ ID NO: 4587140 - DNA, 14 bp, Homo sapiens
tgttttcaagatgg

SEQ ID NO: 4587141 - DNA, 19 bp, Homo sapiens
tgttttccacataaatttt

SEQ ID NO: 4587142 - DNA, 16 bp, Homo sapiens
tgttttcccacgagga

SEQ ID NO: 4587143 - DNA, 12 bp, Homo sapiens
tgttttgaaagt

SEQ ID NO: 4587144 - DNA, 17 bp, Homo sapiens
tgttttgatagatgata

SEQ ID NO: 4587145 - DNA, 17 bp, Homo sapiens
tgttttggactctctgt

SEQ ID NO: 4587146 - DNA, 22 bp, Homo sapiens
tgttttggtgtattgtcagcca

SEQ ID NO: 4587147 - DNA, 13 bp, Homo sapiens
tgttttgtaccag

SEQ ID NO: 4587148 - DNA, 15 bp, Homo sapiens
tgtttttaaattttg

SEQ ID NO: 4587149 - DNA, 12 bp, Homo sapiens
tgtttttactga

SEQ ID NO: 4587150 - DNA, 13 bp, Homo sapiens
tgtttttactgta

SEQ ID NO: 4587151 - DNA, 15 bp, Homo sapiens
tgtttttataaaaat

SEQ ID NO: 4587152 - DNA, 12 bp, Homo sapiens
tgtttttatata

SEQ ID NO: 4587153 - DNA, 14 bp, Homo sapiens
tgtttttatttcct

SEQ ID NO: 4587154 - DNA, 13 bp, Homo sapiens
tgtttttccctaa

SEQ ID NO: 4587155 - DNA, 18 bp, Homo sapiens
tgtttttcctgtgtatta

SEQ ID NO: 4587156 - DNA, 14 bp, Homo sapiens
tgtttttctccagt

SEQ ID NO: 4587157 - DNA, 15 bp, Homo sapiens
tgtttttcttcagca

SEQ ID NO: 4587158 - DNA, 13 bp, Homo sapiens
tgtttttgcatga

SEQ ID NO: 4587159 - DNA, 14 bp, Homo sapiens
tgtttttgggaaga

SEQ ID NO: 4587160 - DNA, 16 bp, Homo sapiens
tgtttttggtctttta

SEQ ID NO: 4587161 - DNA, 13 bp, Homo sapiens
tgttttttatgtt

SEQ ID NO: 4587162 - DNA, 13 bp, Homo sapiens
tgttttttcaaaa

SEQ ID NO: 4587163 - DNA, 23 bp, Homo sapiens
tgttttttcaaaatagaaaagtt

SEQ ID NO: 4587164 - DNA, 13 bp, Homo sapiens
tgttttttctgta

SEQ ID NO: 4587165 - DNA, 11 bp, Homo sapiens
tgttttttgta

SEQ ID NO: 4587166 - DNA, 11 bp, Homo sapiens
tgttttttgtt

SEQ ID NO: 4587167 - DNA, 13 bp, Homo sapiens
tgttttttgttct

SEQ ID NO: 4587168 - DNA, 14 bp, Homo sapiens
tgttttttgttctt

SEQ ID NO: 4587169 - DNA, 20 bp, Homo sapiens
tgtttttttctcctgcaaat

SEQ ID NO: 4587170 - DNA, 21 bp, Homo sapiens
tgtttttttctcctgcaaatt

SEQ ID NO: 4587171 - DNA, 15 bp, Homo sapiens
tgttttttttttaaa

SEQ ID NO: 4587172 - DNA, 19 bp, Homo sapiens
ttaaaaaaaaaaaaaagct

SEQ ID NO: 4587173 - DNA, 15 bp, Homo sapiens
ttaaaaaaaaaaaat

SEQ ID NO: 4587174 - DNA, 21 bp, Homo sapiens
ttaaaaaaaaaagtcaccaaa

SEQ ID NO: 4587175 - DNA, 19 bp, Homo sapiens
ttaaaaaaaaattgtatct

SEQ ID NO: 4587176 - DNA, 16 bp, Homo sapiens
ttaaaaaaacaaatgt

SEQ ID NO: 4587177 - DNA, 20 bp, Homo sapiens
ttaaaaaacttcatgtaatt

SEQ ID NO: 4587178 - DNA, 18 bp, Homo sapiens
ttaaaaaagacatttaaa

SEQ ID NO: 4587179 - DNA, 15 bp, Homo sapiens
ttaaaaaataataca

SEQ ID NO: 4587180 - DNA, 14 bp, Homo sapiens
ttaaaaaatatttt

SEQ ID NO: 4587181 - DNA, 14 bp, Homo sapiens
ttaaaaaattaaaa

SEQ ID NO: 4587182 - DNA, 23 bp, Homo sapiens
ttaaaaaattatggaatatcatc

SEQ ID NO: 4587183 - DNA, 13 bp, Homo sapiens
ttaaaaaatttgt

SEQ ID NO: 4587184 - DNA, 21 bp, Homo sapiens
ttaaaaacattttttatacat

SEQ ID NO: 4587185 - DNA, 15 bp, Homo sapiens
ttaaaaacctttttg

SEQ ID NO: 4587186 - DNA, 19 bp, Homo sapiens
ttaaaaactgacttaatgc

SEQ ID NO: 4587187 - DNA, 12 bp, Homo sapiens
ttaaaaacttta

SEQ ID NO: 4587188 - DNA, 15 bp, Homo sapiens
ttaaaaagagtaatt

SEQ ID NO: 4587189 - DNA, 20 bp, Homo sapiens
ttaaaaaggcagtttgcaaa

SEQ ID NO: 4587190 - DNA, 23 bp, Homo sapiens
ttaaaaagtccataccttatata

SEQ ID NO: 4587191 - DNA, 12 bp, Homo sapiens
ttaaaaagtgtt

SEQ ID NO: 4587192 - DNA, 13 bp, Homo sapiens
ttaaaaagtgttt

SEQ ID NO: 4587193 - DNA, 18 bp, Homo sapiens
ttaaaaatacatagcatt

SEQ ID NO: 4587194 - DNA, 22 bp, Homo sapiens
ttaaaaataccttctatgtatt

SEQ ID NO: 4587195 - DNA, 12 bp, Homo sapiens
ttaaaaatcaac

SEQ ID NO: 4587196 - DNA, 15 bp, Homo sapiens
ttaaaaatcaacttt

SEQ ID NO: 4587197 - DNA, 14 bp, Homo sapiens
ttaaaaatgaaaat

SEQ ID NO: 4587198 - DNA, 23 bp, Homo sapiens
ttaaaaatgcacacctcatgagt

SEQ ID NO: 4587199 - DNA, 20 bp, Homo sapiens
ttaaaaatggtatcaaaatt

SEQ ID NO: 4587200 - DNA, 22 bp, Homo sapiens
ttaaaaatggtatcaaaattac

SEQ ID NO: 4587201 - DNA, 15 bp, Homo sapiens
ttaaaaattaaatat

SEQ ID NO: 4587202 - DNA, 16 bp, Homo sapiens
ttaaaaattaaatatt

SEQ ID NO: 4587203 - DNA, 13 bp, Homo sapiens
ttaaaacaaaaga

SEQ ID NO: 4587204 - DNA, 22 bp, Homo sapiens
ttaaaacaaaagggtgtatagt

SEQ ID NO: 4587205 - DNA, 22 bp, Homo sapiens
ttaaaacaataatgcaattaga

SEQ ID NO: 4587206 - DNA, 22 bp, Homo sapiens
ttaaaactagttagattcactt

SEQ ID NO: 4587207 - DNA, 19 bp, Homo sapiens
ttaaaactataacattata

SEQ ID NO: 4587208 - DNA, 19 bp, Homo sapiens
ttaaaactcatcacataaa

SEQ ID NO: 4587209 - DNA, 23 bp, Homo sapiens
ttaaaactgaacttgaagctaac

SEQ ID NO: 4587210 - DNA, 20 bp, Homo sapiens
ttaaaagaaatatacagttt

SEQ ID NO: 4587211 - DNA, 21 bp, Homo sapiens
ttaaaagaatattttaacttc

SEQ ID NO: 4587212 - DNA, 15 bp, Homo sapiens
ttaaaagatgaaaat

SEQ ID NO: 4587213 - DNA, 18 bp, Homo sapiens
ttaaaagatgaaaatatt

SEQ ID NO: 4587214 - DNA, 14 bp, Homo sapiens
ttaaaagcaaatca

SEQ ID NO: 4587215 - DNA, 21 bp, Homo sapiens
ttaaaagcaaatcatttgttt

SEQ ID NO: 4587216 - DNA, 12 bp, Homo sapiens
ttaaaagcattt

SEQ ID NO: 4587217 - DNA, 16 bp, Homo sapiens
ttaaaagctatcttca

SEQ ID NO: 4587218 - DNA, 20 bp, Homo sapiens
ttaaaataaaatgaaaattg

SEQ ID NO: 4587219 - DNA, 16 bp, Homo sapiens
ttaaaataattcatat

SEQ ID NO: 4587220 - DNA, 14 bp, Homo sapiens
ttaaaatacttatt

SEQ ID NO: 4587221 - DNA, 16 bp, Homo sapiens
ttaaaatatagagaca

SEQ ID NO: 4587222 - DNA, 17 bp, Homo sapiens
ttaaaatatagagacag

SEQ ID NO: 4587223 - DNA, 21 bp, Homo sapiens
ttaaaatatatagtgaaaaat

SEQ ID NO: 4587224 - DNA, 14 bp, Homo sapiens
ttaaaatatatgaa

SEQ ID NO: 4587225 - DNA, 17 bp, Homo sapiens
ttaaaatatgtgaagtt

SEQ ID NO: 4587226 - DNA, 18 bp, Homo sapiens
ttaaaatatgtgaagttt

SEQ ID NO: 4587227 - DNA, 23 bp, Homo sapiens
ttaaaatcactaacattatattg

SEQ ID NO: 4587228 - DNA, 16 bp, Homo sapiens
ttaaaatcagctattt

SEQ ID NO: 4587229 - DNA, 12 bp, Homo sapiens
ttaaaatcctca

SEQ ID NO: 4587230 - DNA, 13 bp, Homo sapiens
ttaaaatcctcaa

SEQ ID NO: 4587231 - DNA, 21 bp, Homo sapiens
ttaaaatgaacctgctactta

SEQ ID NO: 4587232 - DNA, 13 bp, Homo sapiens
ttaaaatgcaata

SEQ ID NO: 4587233 - DNA, 19 bp, Homo sapiens
ttaaaatggtatgccaact

SEQ ID NO: 4587234 - DNA, 15 bp, Homo sapiens
ttaaaatgtgatttt

SEQ ID NO: 4587235 - DNA, 17 bp, Homo sapiens
ttaaaatgtttgagcac

SEQ ID NO: 4587236 - DNA, 17 bp, Homo sapiens
ttaaaatgtttggatgg

SEQ ID NO: 4587237 - DNA, 18 bp, Homo sapiens
ttaaaattggtatatttg

SEQ ID NO: 4587238 - DNA, 20 bp, Homo sapiens
ttaaaattggtatatttgaa

SEQ ID NO: 4587239 - DNA, 16 bp, Homo sapiens
ttaaaattgtgcataa

SEQ ID NO: 4587240 - DNA, 19 bp, Homo sapiens
ttaaacaaaatttcacagt

SEQ ID NO: 4587241 - DNA, 13 bp, Homo sapiens
ttaaacaaataaa

SEQ ID NO: 4587242 - DNA, 17 bp, Homo sapiens
ttaaacaatctttcatg

SEQ ID NO: 4587243 - DNA, 21 bp, Homo sapiens
ttaaacaatctttcatgtctt

SEQ ID NO: 4587244 - DNA, 16 bp, Homo sapiens
ttaaacaatttatttt

SEQ ID NO: 4587245 - DNA, 16 bp, Homo sapiens
ttaaacacaggctgtc

SEQ ID NO: 4587246 - DNA, 21 bp, Homo sapiens
ttaaacactacacatttgaaa

SEQ ID NO: 4587247 - DNA, 15 bp, Homo sapiens
ttaaacatgcagaag

SEQ ID NO: 4587248 - DNA, 15 bp, Homo sapiens
ttaaacccatacaat

SEQ ID NO: 4587249 - DNA, 23 bp, Homo sapiens
ttaaacctggaatctacaagcca

SEQ ID NO: 4587250 - DNA, 14 bp, Homo sapiens
ttaaaccttttatt

SEQ ID NO: 4587251 - DNA, 18 bp, Homo sapiens
ttaaactactatttttct

SEQ ID NO: 4587252 - DNA, 13 bp, Homo sapiens
ttaaactggtatt

SEQ ID NO: 4587253 - DNA, 12 bp, Homo sapiens
ttaaactgtgta

SEQ ID NO: 4587254 - DNA, 17 bp, Homo sapiens
ttaaacttccaaagaaa

SEQ ID NO: 4587255 - DNA, 14 bp, Homo sapiens
ttaaacttgaaata

SEQ ID NO: 4587256 - DNA, 21 bp, Homo sapiens
ttaaactttgtcacttctgct

SEQ ID NO: 4587257 - DNA, 13 bp, Homo sapiens
ttaaactttttaa

SEQ ID NO: 4587258 - DNA, 17 bp, Homo sapiens
ttaaagaatcattattt

SEQ ID NO: 4587259 - DNA, 17 bp, Homo sapiens
ttaaagagtgtgttata

SEQ ID NO: 4587260 - DNA, 16 bp, Homo sapiens
ttaaagatttgtttgt

SEQ ID NO: 4587261 - DNA, 21 bp, Homo sapiens
ttaaagatttgtttgtgttta

SEQ ID NO: 4587262 - DNA, 22 bp, Homo sapiens
ttaaagcaaactatgatttatt

SEQ ID NO: 4587263 - DNA, 14 bp, Homo sapiens
ttaaagccttaagc

SEQ ID NO: 4587264 - DNA, 20 bp, Homo sapiens
ttaaagcttattaaaactca

SEQ ID NO: 4587265 - DNA, 19 bp, Homo sapiens
ttaaagcttgatttgatct

SEQ ID NO: 4587266 - DNA, 17 bp, Homo sapiens
ttaaaggtgtcttcctc

SEQ ID NO: 4587267 - DNA, 18 bp, Homo sapiens
ttaaaggttaaattgctt

SEQ ID NO: 4587268 - DNA, 19 bp, Homo sapiens
ttaaaggtttttgaaatcc

SEQ ID NO: 4587269 - DNA, 12 bp, Homo sapiens
ttaaagtaaatt

SEQ ID NO: 4587270 - DNA, 15 bp, Homo sapiens
ttaaagtaaattatt

SEQ ID NO: 4587271 - DNA, 20 bp, Homo sapiens
ttaaagtatgcattattaaa

SEQ ID NO: 4587272 - DNA, 23 bp, Homo sapiens
ttaaagtatttataaaaatataa

SEQ ID NO: 4587273 - DNA, 18 bp, Homo sapiens
ttaaagtattttaatttt

SEQ ID NO: 4587274 - DNA, 20 bp, Homo sapiens
ttaaagtattttaattttaa

SEQ ID NO: 4587275 - DNA, 19 bp, Homo sapiens
ttaaagtcacatccctgta

SEQ ID NO: 4587276 - DNA, 19 bp, Homo sapiens
ttaaagtgtacttataaac

SEQ ID NO: 4587277 - DNA, 20 bp, Homo sapiens
ttaaagttagtatcttttga

SEQ ID NO: 4587278 - DNA, 23 bp, Homo sapiens
ttaaagttagtatcttttgatat

SEQ ID NO: 4587279 - DNA, 13 bp, Homo sapiens
ttaaagttctgtg

SEQ ID NO: 4587280 - DNA, 21 bp, Homo sapiens
ttaaagttggtattaataaaa

SEQ ID NO: 4587281 - DNA, 16 bp, Homo sapiens
ttaaagttgtttccca

SEQ ID NO: 4587282 - DNA, 21 bp, Homo sapiens
ttaaataaatccaaaaaaaat

SEQ ID NO: 4587283 - DNA, 22 bp, Homo sapiens
ttaaataaatttgacttttctg

SEQ ID NO: 4587284 - DNA, 17 bp, Homo sapiens
ttaaataataaagtatg

SEQ ID NO: 4587285 - DNA, 15 bp, Homo sapiens
ttaaataatttaact

SEQ ID NO: 4587286 - DNA, 19 bp, Homo sapiens
ttaaatacaggaaacagtt

SEQ ID NO: 4587287 - DNA, 12 bp, Homo sapiens
ttaaatagtgtg

SEQ ID NO: 4587288 - DNA, 16 bp, Homo sapiens
ttaaatatatctagaa

SEQ ID NO: 4587289 - DNA, 17 bp, Homo sapiens
ttaaatatatgtatgta

SEQ ID NO: 4587290 - DNA, 22 bp, Homo sapiens
ttaaatatatgtatgtaaaaat

SEQ ID NO: 4587291 - DNA, 17 bp, Homo sapiens
ttaaatatctgaacatt

SEQ ID NO: 4587292 - DNA, 13 bp, Homo sapiens
ttaaatattttct

SEQ ID NO: 4587293 - DNA, 22 bp, Homo sapiens
ttaaatattttctattttaaga

SEQ ID NO: 4587294 - DNA, 12 bp, Homo sapiens
ttaaatcatttg

SEQ ID NO: 4587295 - DNA, 19 bp, Homo sapiens
ttaaatcatttggttaaat

SEQ ID NO: 4587296 - DNA, 22 bp, Homo sapiens
ttaaatcatttggttaaatcat

SEQ ID NO: 4587297 - DNA, 18 bp, Homo sapiens
ttaaatcattttaggaaa

SEQ ID NO: 4587298 - DNA, 15 bp, Homo sapiens
ttaaatctagacatt

SEQ ID NO: 4587299 - DNA, 19 bp, Homo sapiens
ttaaatctagacattcttt

SEQ ID NO: 4587300 - DNA, 16 bp, Homo sapiens
ttaaatctgtgatgat

SEQ ID NO: 4587301 - DNA, 11 bp, Homo sapiens
ttaaatgaaag

SEQ ID NO: 4587302 - DNA, 16 bp, Homo sapiens
ttaaatgaacttatgt

SEQ ID NO: 4587303 - DNA, 21 bp, Homo sapiens
ttaaatgaatattttgataat

SEQ ID NO: 4587304 - DNA, 13 bp, Homo sapiens
ttaaatgacagta

SEQ ID NO: 4587305 - DNA, 16 bp, Homo sapiens
ttaaatgacagtaata

SEQ ID NO: 4587306 - DNA, 21 bp, Homo sapiens
ttaaatgagggtttctgatct

SEQ ID NO: 4587307 - DNA, 12 bp, Homo sapiens
ttaaatgccaaa

SEQ ID NO: 4587308 - DNA, 13 bp, Homo sapiens
ttaaatgccaaaa

SEQ ID NO: 4587309 - DNA, 18 bp, Homo sapiens
ttaaatgccaaaatgtac

SEQ ID NO: 4587310 - DNA, 16 bp, Homo sapiens
ttaaatgcttcatttg

SEQ ID NO: 4587311 - DNA, 22 bp, Homo sapiens
ttaaatggaataattagcttgt

SEQ ID NO: 4587312 - DNA, 17 bp, Homo sapiens
ttaaatgtaagttgaga

SEQ ID NO: 4587313 - DNA, 15 bp, Homo sapiens
ttaaatgtaatataa

SEQ ID NO: 4587314 - DNA, 21 bp, Homo sapiens
ttaaatgtacagacatattta

SEQ ID NO: 4587315 - DNA, 16 bp, Homo sapiens
ttaaatgtattttaca

SEQ ID NO: 4587316 - DNA, 15 bp, Homo sapiens
ttaaatgtgagcaaa

SEQ ID NO: 4587317 - DNA, 17 bp, Homo sapiens
ttaaatgtgtacaatgt

SEQ ID NO: 4587318 - DNA, 20 bp, Homo sapiens
ttaaatgtgtacatgtagtt

SEQ ID NO: 4587319 - DNA, 12 bp, Homo sapiens
ttaaatgtgtat

SEQ ID NO: 4587320 - DNA, 16 bp, Homo sapiens
ttaaatgttatgacta

SEQ ID NO: 4587321 - DNA, 14 bp, Homo sapiens
ttaaattaaacaat

SEQ ID NO: 4587322 - DNA, 16 bp, Homo sapiens
ttaaattaatatcttt

SEQ ID NO: 4587323 - DNA, 22 bp, Homo sapiens
ttaaattaatatctttctgcac

SEQ ID NO: 4587324 - DNA, 15 bp, Homo sapiens
ttaaattacaatttt

SEQ ID NO: 4587325 - DNA, 18 bp, Homo sapiens
ttaaattacctttacata

SEQ ID NO: 4587326 - DNA, 13 bp, Homo sapiens
ttaaattataagg

SEQ ID NO: 4587327 - DNA, 15 bp, Homo sapiens
ttaaattataaggac

SEQ ID NO: 4587328 - DNA, 18 bp, Homo sapiens
ttaaattatatatttatt

SEQ ID NO: 4587329 - DNA, 12 bp, Homo sapiens
ttaaattatatg

SEQ ID NO: 4587330 - DNA, 14 bp, Homo sapiens
ttaaattatatgat

SEQ ID NO: 4587331 - DNA, 16 bp, Homo sapiens
ttaaattccactgaaa

SEQ ID NO: 4587332 - DNA, 21 bp, Homo sapiens
ttaaattccactgaaaattta

SEQ ID NO: 4587333 - DNA, 23 bp, Homo sapiens
ttaaattctctctcttgcaggaa

SEQ ID NO: 4587334 - DNA, 20 bp, Homo sapiens
ttaaattcttttttaaattt

SEQ ID NO: 4587335 - DNA, 17 bp, Homo sapiens
ttaaattggaaagcagg

SEQ ID NO: 4587336 - DNA, 15 bp, Homo sapiens
ttaaattgtgtttta

SEQ ID NO: 4587337 - DNA, 12 bp, Homo sapiens
ttaaatttcaga

SEQ ID NO: 4587338 - DNA, 17 bp, Homo sapiens
ttaaatttcttatgtga

SEQ ID NO: 4587339 - DNA, 22 bp, Homo sapiens
ttaaatttcttatgtgacatta

SEQ ID NO: 4587340 - DNA, 16 bp, Homo sapiens
ttaaatttcttttatt

SEQ ID NO: 4587341 - DNA, 16 bp, Homo sapiens
ttaaattttagtacat

SEQ ID NO: 4587342 - DNA, 19 bp, Homo sapiens
ttaaattttagtacatttt

SEQ ID NO: 4587343 - DNA, 15 bp, Homo sapiens
ttaaattttcttcag

SEQ ID NO: 4587344 - DNA, 14 bp, Homo sapiens
ttaaattttgtaat

SEQ ID NO: 4587345 - DNA, 19 bp, Homo sapiens
ttaaattttgtatgccaat

SEQ ID NO: 4587346 - DNA, 13 bp, Homo sapiens
ttaacaagatgtt

SEQ ID NO: 4587347 - DNA, 17 bp, Homo sapiens
ttaacaagatgtttcat

SEQ ID NO: 4587348 - DNA, 12 bp, Homo sapiens
ttaacaataata

SEQ ID NO: 4587349 - DNA, 22 bp, Homo sapiens
ttaacagtatttctcttttatt

SEQ ID NO: 4587350 - DNA, 23 bp, Homo sapiens
ttaacatagtaagttcagcactt

SEQ ID NO: 4587351 - DNA, 15 bp, Homo sapiens
ttaacatcaaagact

SEQ ID NO: 4587352 - DNA, 13 bp, Homo sapiens
ttaacatgcaata

SEQ ID NO: 4587353 - DNA, 14 bp, Homo sapiens
ttaacatgcaataa

SEQ ID NO: 4587354 - DNA, 16 bp, Homo sapiens
ttaacatgcaataaca

SEQ ID NO: 4587355 - DNA, 18 bp, Homo sapiens
ttaacatgcaataacaag

SEQ ID NO: 4587356 - DNA, 15 bp, Homo sapiens
ttaacattcatagag

SEQ ID NO: 4587357 - DNA, 15 bp, Homo sapiens
ttaacattttacagt

SEQ ID NO: 4587358 - DNA, 18 bp, Homo sapiens
ttaaccccataattagat

SEQ ID NO: 4587359 - DNA, 14 bp, Homo sapiens
ttaacccctccact

SEQ ID NO: 4587360 - DNA, 14 bp, Homo sapiens
ttaaccctcccctt

SEQ ID NO: 4587361 - DNA, 21 bp, Homo sapiens
ttaacctatgatattttctgt

SEQ ID NO: 4587362 - DNA, 17 bp, Homo sapiens
ttaacctgttatttcta

SEQ ID NO: 4587363 - DNA, 15 bp, Homo sapiens
ttaaccttaaaatta

SEQ ID NO: 4587364 - DNA, 21 bp, Homo sapiens
ttaaccttaaaattgatatta

SEQ ID NO: 4587365 - DNA, 21 bp, Homo sapiens
ttaaccttagagcttggacag

SEQ ID NO: 4587366 - DNA, 17 bp, Homo sapiens
ttaacctttccgctgtc

SEQ ID NO: 4587367 - DNA, 19 bp, Homo sapiens
ttaacctttccgctgtcgc

SEQ ID NO: 4587368 - DNA, 14 bp, Homo sapiens
ttaacgatgtccaa

SEQ ID NO: 4587369 - DNA, 13 bp, Homo sapiens
ttaacggtgctaa

SEQ ID NO: 4587370 - DNA, 15 bp, Homo sapiens
ttaacggtgctaaaa

SEQ ID NO: 4587371 - DNA, 20 bp, Homo sapiens
ttaactacccttaattactt

SEQ ID NO: 4587372 - DNA, 21 bp, Homo sapiens
ttaactatatgtgaaacattt

SEQ ID NO: 4587373 - DNA, 23 bp, Homo sapiens
ttaactatgtaataatgtacaga

SEQ ID NO: 4587374 - DNA, 13 bp, Homo sapiens
ttaactctactgt

SEQ ID NO: 4587375 - DNA, 17 bp, Homo sapiens
ttaactctactgtgtaa

SEQ ID NO: 4587376 - DNA, 17 bp, Homo sapiens
ttaactctctttatgtc

SEQ ID NO: 4587377 - DNA, 19 bp, Homo sapiens
ttaactctctttatgtctg

SEQ ID NO: 4587378 - DNA, 20 bp, Homo sapiens
ttaactctttgaaactgtat

SEQ ID NO: 4587379 - DNA, 19 bp, Homo sapiens
ttaactgatttaacacttt

SEQ ID NO: 4587380 - DNA, 21 bp, Homo sapiens
ttaactgatttaacacttttt

SEQ ID NO: 4587381 - DNA, 18 bp, Homo sapiens
ttaactggcatgtcattt

SEQ ID NO: 4587382 - DNA, 20 bp, Homo sapiens
ttaactggcatgtcatttgc

SEQ ID NO: 4587383 - DNA, 17 bp, Homo sapiens
ttaactgggtaatgaaa

SEQ ID NO: 4587384 - DNA, 22 bp, Homo sapiens
ttaactggtgcactttgtaaat

SEQ ID NO: 4587385 - DNA, 15 bp, Homo sapiens
ttaactgtaaacttg

SEQ ID NO: 4587386 - DNA, 16 bp, Homo sapiens
ttaactgtgaaatacc

SEQ ID NO: 4587387 - DNA, 13 bp, Homo sapiens
ttaactgtggata

SEQ ID NO: 4587388 - DNA, 15 bp, Homo sapiens
ttaactgtggatatt

SEQ ID NO: 4587389 - DNA, 14 bp, Homo sapiens
ttaacttagttttt

SEQ ID NO: 4587390 - DNA, 16 bp, Homo sapiens
ttaacttccactgtta

SEQ ID NO: 4587391 - DNA, 13 bp, Homo sapiens
ttaacttggaaat

SEQ ID NO: 4587392 - DNA, 18 bp, Homo sapiens
ttaacttggtcagagcca

SEQ ID NO: 4587393 - DNA, 19 bp, Homo sapiens
ttaacttggtcagagccac

SEQ ID NO: 4587394 - DNA, 19 bp, Homo sapiens
ttaacttgtttggtagtta

SEQ ID NO: 4587395 - DNA, 13 bp, Homo sapiens
ttaactttaccat

SEQ ID NO: 4587396 - DNA, 19 bp, Homo sapiens
ttaactttcaaaagcaaac

SEQ ID NO: 4587397 - DNA, 23 bp, Homo sapiens
ttaactttttgtttttatttctt

SEQ ID NO: 4587398 - DNA, 17 bp, Homo sapiens
ttaagaaaaacaataaa

SEQ ID NO: 4587399 - DNA, 22 bp, Homo sapiens
ttaagaaaacaagtatataatt

SEQ ID NO: 4587400 - DNA, 19 bp, Homo sapiens
ttaagaaaatttacaaaat

SEQ ID NO: 4587401 - DNA, 15 bp, Homo sapiens
ttaagaaagcactta

SEQ ID NO: 4587402 - DNA, 15 bp, Homo sapiens
ttaagaaatagaatt

SEQ ID NO: 4587403 - DNA, 13 bp, Homo sapiens
ttaagaacatttt

SEQ ID NO: 4587404 - DNA, 18 bp, Homo sapiens
ttaagaaccaaactccta

SEQ ID NO: 4587405 - DNA, 20 bp, Homo sapiens
ttaagaactaaaatgttcta

SEQ ID NO: 4587406 - DNA, 16 bp, Homo sapiens
ttaagaactgtgtctg

SEQ ID NO: 4587407 - DNA, 12 bp, Homo sapiens
ttaagaaggcaa

SEQ ID NO: 4587408 - DNA, 20 bp, Homo sapiens
ttaagaatcttagataactt

SEQ ID NO: 4587409 - DNA, 18 bp, Homo sapiens
ttaagaattcaaatttgt

SEQ ID NO: 4587410 - DNA, 16 bp, Homo sapiens
ttaagaatttgtttaa

SEQ ID NO: 4587411 - DNA, 16 bp, Homo sapiens
ttaagacatgatttcc

SEQ ID NO: 4587412 - DNA, 19 bp, Homo sapiens
ttaagacgtgaatgtctca

SEQ ID NO: 4587413 - DNA, 20 bp, Homo sapiens
ttaagacgtgaatgtctcag

SEQ ID NO: 4587414 - DNA, 21 bp, Homo sapiens
ttaagagctattttagaaagc

SEQ ID NO: 4587415 - DNA, 12 bp, Homo sapiens
ttaagaggcttt

SEQ ID NO: 4587416 - DNA, 15 bp, Homo sapiens
ttaagatccagaaat

SEQ ID NO: 4587417 - DNA, 16 bp, Homo sapiens
ttaagatcctaaactc

SEQ ID NO: 4587418 - DNA, 19 bp, Homo sapiens
ttaagatcctaaactctct

SEQ ID NO: 4587419 - DNA, 22 bp, Homo sapiens
ttaagatgagcaaccacattta

SEQ ID NO: 4587420 - DNA, 13 bp, Homo sapiens
ttaagatggcaat

SEQ ID NO: 4587421 - DNA, 21 bp, Homo sapiens
ttaagatggcaattactttgg

SEQ ID NO: 4587422 - DNA, 15 bp, Homo sapiens
ttaagatgtacattt

SEQ ID NO: 4587423 - DNA, 15 bp, Homo sapiens
ttaagcaaatactta

SEQ ID NO: 4587424 - DNA, 16 bp, Homo sapiens
ttaagcaaatttcatt

SEQ ID NO: 4587425 - DNA, 15 bp, Homo sapiens
ttaagcagtaatctg

SEQ ID NO: 4587426 - DNA, 22 bp, Homo sapiens
ttaagcatctggctctaattca

SEQ ID NO: 4587427 - DNA, 19 bp, Homo sapiens
ttaagcccacagtatattt

SEQ ID NO: 4587428 - DNA, 19 bp, Homo sapiens
ttaagctgcaaatctgatg

SEQ ID NO: 4587429 - DNA, 14 bp, Homo sapiens
ttaagcttttattt

SEQ ID NO: 4587430 - DNA, 13 bp, Homo sapiens
ttaagctttttgg

SEQ ID NO: 4587431 - DNA, 15 bp, Homo sapiens
ttaaggaaacttttt

SEQ ID NO: 4587432 - DNA, 19 bp, Homo sapiens
ttaaggaaactttttaatt

SEQ ID NO: 4587433 - DNA, 11 bp, Homo sapiens
ttaaggattct

SEQ ID NO: 4587434 - DNA, 13 bp, Homo sapiens
ttaagggaaaaat

SEQ ID NO: 4587435 - DNA, 18 bp, Homo sapiens
ttaagggaagaattccag

SEQ ID NO: 4587436 - DNA, 15 bp, Homo sapiens
ttaagggacatttct

SEQ ID NO: 4587437 - DNA, 19 bp, Homo sapiens
ttaagggtggaaaaatgcc

SEQ ID NO: 4587438 - DNA, 21 bp, Homo sapiens
ttaaggtacatcattattgta

SEQ ID NO: 4587439 - DNA, 14 bp, Homo sapiens
ttaaggtctccaaa

SEQ ID NO: 4587440 - DNA, 16 bp, Homo sapiens
ttaaggtctttcagta

SEQ ID NO: 4587441 - DNA, 14 bp, Homo sapiens
ttaagtaacgtgct

SEQ ID NO: 4587442 - DNA, 16 bp, Homo sapiens
ttaagtaacgtgctca

SEQ ID NO: 4587443 - DNA, 13 bp, Homo sapiens
ttaagtagatttc

SEQ ID NO: 4587444 - DNA, 19 bp, Homo sapiens
ttaagtatcttgtgcttct

SEQ ID NO: 4587445 - DNA, 17 bp, Homo sapiens
ttaagtcagatttttat

SEQ ID NO: 4587446 - DNA, 22 bp, Homo sapiens
ttaagtcattttttacttgaat

SEQ ID NO: 4587447 - DNA, 14 bp, Homo sapiens
ttaagtccagcttg

SEQ ID NO: 4587448 - DNA, 17 bp, Homo sapiens
ttaagtcccattcagtg

SEQ ID NO: 4587449 - DNA, 20 bp, Homo sapiens
ttaagtccctgtcacctctt

SEQ ID NO: 4587450 - DNA, 16 bp, Homo sapiens
ttaagtgatgtcattt

SEQ ID NO: 4587451 - DNA, 19 bp, Homo sapiens
ttaagtgtaaatgaagtac

SEQ ID NO: 4587452 - DNA, 19 bp, Homo sapiens
ttaagtgtgtataaaacat

SEQ ID NO: 4587453 - DNA, 18 bp, Homo sapiens
ttaagtgttggaaaaaat

SEQ ID NO: 4587454 - DNA, 14 bp, Homo sapiens
ttaagttatgtgtg

SEQ ID NO: 4587455 - DNA, 20 bp, Homo sapiens
ttaagttattttacctgttt

SEQ ID NO: 4587456 - DNA, 18 bp, Homo sapiens
ttaagttggcttctgttt

SEQ ID NO: 4587457 - DNA, 21 bp, Homo sapiens
ttaagttggcttctgtttcta

SEQ ID NO: 4587458 - DNA, 20 bp, Homo sapiens
ttaagtttttctctttttca

SEQ ID NO: 4587459 - DNA, 14 bp, Homo sapiens
ttaataaaaaggaa

SEQ ID NO: 4587460 - DNA, 14 bp, Homo sapiens
ttaataaaacctgt

SEQ ID NO: 4587461 - DNA, 12 bp, Homo sapiens
ttaataaaactg

SEQ ID NO: 4587462 - DNA, 21 bp, Homo sapiens
ttaataaaactgcgaggacat

SEQ ID NO: 4587463 - DNA, 16 bp, Homo sapiens
ttaataaaagtacatg

SEQ ID NO: 4587464 - DNA, 17 bp, Homo sapiens
ttaataaacatgtcaca

SEQ ID NO: 4587465 - DNA, 14 bp, Homo sapiens
ttaataaactactc

SEQ ID NO: 4587466 - DNA, 18 bp, Homo sapiens
ttaataaattggtaatat

SEQ ID NO: 4587467 - DNA, 17 bp, Homo sapiens
ttaataagaacagatca

SEQ ID NO: 4587468 - DNA, 21 bp, Homo sapiens
ttaataagatttttcaaaatc

SEQ ID NO: 4587469 - DNA, 17 bp, Homo sapiens
ttaatacagctcagtaa

SEQ ID NO: 4587470 - DNA, 14 bp, Homo sapiens
ttaatacatcacat

SEQ ID NO: 4587471 - DNA, 21 bp, Homo sapiens
ttaatacatgcaacagaagtg

SEQ ID NO: 4587472 - DNA, 15 bp, Homo sapiens
ttaatactaccttga

SEQ ID NO: 4587473 - DNA, 17 bp, Homo sapiens
ttaatactattaagcaa

SEQ ID NO: 4587474 - DNA, 21 bp, Homo sapiens
ttaatagaggagctgcttgtt

SEQ ID NO: 4587475 - DNA, 13 bp, Homo sapiens
ttaatagcaacag

SEQ ID NO: 4587476 - DNA, 17 bp, Homo sapiens
ttaatagggaatatatc

SEQ ID NO: 4587477 - DNA, 16 bp, Homo sapiens
ttaataggtaaaccaa

SEQ ID NO: 4587478 - DNA, 18 bp, Homo sapiens
ttaatagtactattaaca

SEQ ID NO: 4587479 - DNA, 20 bp, Homo sapiens
ttaatagtctagaatgttat

SEQ ID NO: 4587480 - DNA, 14 bp, Homo sapiens
ttaatataaatgtt

SEQ ID NO: 4587481 - DNA, 17 bp, Homo sapiens
ttaatataagtttcttt

SEQ ID NO: 4587482 - DNA, 19 bp, Homo sapiens
ttaatataagtttctttag

SEQ ID NO: 4587483 - DNA, 22 bp, Homo sapiens
ttaatataccccaaattgtgta

SEQ ID NO: 4587484 - DNA, 15 bp, Homo sapiens
ttaatatataattta

SEQ ID NO: 4587485 - DNA, 23 bp, Homo sapiens
ttaatatataatttaatgtaaat

SEQ ID NO: 4587486 - DNA, 18 bp, Homo sapiens
ttaatatattaaaattcc

SEQ ID NO: 4587487 - DNA, 22 bp, Homo sapiens
ttaatatcaaaagaaaattgat

SEQ ID NO: 4587488 - DNA, 21 bp, Homo sapiens
ttaatatgagcttcaatataa

SEQ ID NO: 4587489 - DNA, 19 bp, Homo sapiens
ttaatatgctgcaacaaaa

SEQ ID NO: 4587490 - DNA, 18 bp, Homo sapiens
ttaatattcccattttat

SEQ ID NO: 4587491 - DNA, 12 bp, Homo sapiens
ttaatatttgtt

SEQ ID NO: 4587492 - DNA, 15 bp, Homo sapiens
ttaatattttgtaat

SEQ ID NO: 4587493 - DNA, 20 bp, Homo sapiens
ttaatattttgtaatattct

SEQ ID NO: 4587494 - DNA, 22 bp, Homo sapiens
ttaatcagttcattagaaatat

SEQ ID NO: 4587495 - DNA, 21 bp, Homo sapiens
ttaatcatacaaactctcacc

SEQ ID NO: 4587496 - DNA, 15 bp, Homo sapiens
ttaatcattttcatt

SEQ ID NO: 4587497 - DNA, 15 bp, Homo sapiens
ttaatccaatatttt

SEQ ID NO: 4587498 - DNA, 18 bp, Homo sapiens
ttaatccagtctatcatt

SEQ ID NO: 4587499 - DNA, 15 bp, Homo sapiens
ttaatcccagcactt

SEQ ID NO: 4587500 - DNA, 16 bp, Homo sapiens
ttaatcccagcacttt

SEQ ID NO: 4587501 - DNA, 14 bp, Homo sapiens
ttaatcgtttttgt

SEQ ID NO: 4587502 - DNA, 16 bp, Homo sapiens
ttaatcttaatgtata

SEQ ID NO: 4587503 - DNA, 17 bp, Homo sapiens
ttaatcttaatgtatat

SEQ ID NO: 4587504 - DNA, 17 bp, Homo sapiens
ttaatcttccattcctt

SEQ ID NO: 4587505 - DNA, 21 bp, Homo sapiens
ttaatgaaatgataaagactt

SEQ ID NO: 4587506 - DNA, 23 bp, Homo sapiens
ttaatgaaatgataaagactttt

SEQ ID NO: 4587507 - DNA, 23 bp, Homo sapiens
ttaatgaagaaagtggaaaacaa

SEQ ID NO: 4587508 - DNA, 20 bp, Homo sapiens
ttaatgacaacacttaatag

SEQ ID NO: 4587509 - DNA, 22 bp, Homo sapiens
ttaatgacaacacttaatagca

SEQ ID NO: 4587510 - DNA, 14 bp, Homo sapiens
ttaatgaccatgtt

SEQ ID NO: 4587511 - DNA, 19 bp, Homo sapiens
ttaatgactctttctgaag

SEQ ID NO: 4587512 - DNA, 15 bp, Homo sapiens
ttaatgagaatagaa

SEQ ID NO: 4587513 - DNA, 12 bp, Homo sapiens
ttaatgcacttt

SEQ ID NO: 4587514 - DNA, 14 bp, Homo sapiens
ttaatgcattgttg

SEQ ID NO: 4587515 - DNA, 18 bp, Homo sapiens
ttaatgcattgttgtaaa

SEQ ID NO: 4587516 - DNA, 21 bp, Homo sapiens
ttaatgcctgctttttggaaa

SEQ ID NO: 4587517 - DNA, 20 bp, Homo sapiens
ttaatggaagtgtatttatt

SEQ ID NO: 4587518 - DNA, 12 bp, Homo sapiens
ttaatgtaaata

SEQ ID NO: 4587519 - DNA, 16 bp, Homo sapiens
ttaatgtaaataaaac

SEQ ID NO: 4587520 - DNA, 11 bp, Homo sapiens
ttaatgtagta

SEQ ID NO: 4587521 - DNA, 21 bp, Homo sapiens
ttaatgtatataaaaatggct

SEQ ID NO: 4587522 - DNA, 15 bp, Homo sapiens
ttaatgtatctattt

SEQ ID NO: 4587523 - DNA, 22 bp, Homo sapiens
ttaatgttgattttaatcctgt

SEQ ID NO: 4587524 - DNA, 10 bp, Homo sapiens
ttaatgtttt

SEQ ID NO: 4587525 - DNA, 23 bp, Homo sapiens
ttaatgttttaaatgtacagaca

SEQ ID NO: 4587526 - DNA, 23 bp, Homo sapiens
ttaattaaaaactttaaagataa

SEQ ID NO: 4587527 - DNA, 22 bp, Homo sapiens
ttaattaaagccttaagcacaa

SEQ ID NO: 4587528 - DNA, 22 bp, Homo sapiens
ttaattaaccccataattagat

SEQ ID NO: 4587529 - DNA, 20 bp, Homo sapiens
ttaattaatttggagcacaa

SEQ ID NO: 4587530 - DNA, 14 bp, Homo sapiens
ttaattacttaaaa

SEQ ID NO: 4587531 - DNA, 11 bp, Homo sapiens
ttaattcaaga

SEQ ID NO: 4587532 - DNA, 22 bp, Homo sapiens
ttaattcttaaaactataacat

SEQ ID NO: 4587533 - DNA, 13 bp, Homo sapiens
ttaattgaaaaga

SEQ ID NO: 4587534 - DNA, 23 bp, Homo sapiens
ttaattgaaaagaagtagtgtct

SEQ ID NO: 4587535 - DNA, 21 bp, Homo sapiens
ttaattgacttatttatataa

SEQ ID NO: 4587536 - DNA, 19 bp, Homo sapiens
ttaattgcaagtctgccga

SEQ ID NO: 4587537 - DNA, 16 bp, Homo sapiens
ttaattgctttgaagc

SEQ ID NO: 4587538 - DNA, 15 bp, Homo sapiens
ttaattgtaaactgt

SEQ ID NO: 4587539 - DNA, 14 bp, Homo sapiens
ttaattgtaaagta

SEQ ID NO: 4587540 - DNA, 15 bp, Homo sapiens
ttaattgtgtttatt

SEQ ID NO: 4587541 - DNA, 14 bp, Homo sapiens
ttaatttaaatgat

SEQ ID NO: 4587542 - DNA, 17 bp, Homo sapiens
ttaatttagtaaatgtt

SEQ ID NO: 4587543 - DNA, 18 bp, Homo sapiens
ttaatttagtaaatgtta

SEQ ID NO: 4587544 - DNA, 18 bp, Homo sapiens
ttaatttataatgtattt

SEQ ID NO: 4587545 - DNA, 21 bp, Homo sapiens
ttaatttataatgtatttgaa

SEQ ID NO: 4587546 - DNA, 13 bp, Homo sapiens
ttaatttattggg

SEQ ID NO: 4587547 - DNA, 14 bp, Homo sapiens
ttaatttatttcat

SEQ ID NO: 4587548 - DNA, 13 bp, Homo sapiens
ttaatttcaggaa

SEQ ID NO: 4587549 - DNA, 19 bp, Homo sapiens
ttaatttcaggaaaatgta

SEQ ID NO: 4587550 - DNA, 23 bp, Homo sapiens
ttaatttcagtcctgtagtttta

SEQ ID NO: 4587551 - DNA, 19 bp, Homo sapiens
ttaatttcctttttgacac

SEQ ID NO: 4587552 - DNA, 22 bp, Homo sapiens
ttaatttcctttttgacactga

SEQ ID NO: 4587553 - DNA, 13 bp, Homo sapiens
ttaatttctgcca

SEQ ID NO: 4587554 - DNA, 22 bp, Homo sapiens
ttaatttggagcacaaaattca

SEQ ID NO: 4587555 - DNA, 23 bp, Homo sapiens
ttaatttggtagatgacaaatat

SEQ ID NO: 4587556 - DNA, 20 bp, Homo sapiens
ttaattttgaagtgctgttt

SEQ ID NO: 4587557 - DNA, 17 bp, Homo sapiens
ttaatttttaatgatga

SEQ ID NO: 4587558 - DNA, 18 bp, Homo sapiens
ttaatttttatttcttcc

SEQ ID NO: 4587559 - DNA, 15 bp, Homo sapiens
ttaatttttccaact

SEQ ID NO: 4587560 - DNA, 22 bp, Homo sapiens
ttaatttttgcttttagaaaag

SEQ ID NO: 4587561 - DNA, 18 bp, Homo sapiens
ttaattttttggtacaaa

SEQ ID NO: 4587562 - DNA, 17 bp, Homo sapiens
ttacaaatcagaagtca

SEQ ID NO: 4587563 - DNA, 17 bp, Homo sapiens
ttacaaatgcaaatttc

SEQ ID NO: 4587564 - DNA, 15 bp, Homo sapiens
ttacaacattcaact

SEQ ID NO: 4587565 - DNA, 20 bp, Homo sapiens
ttacaacgccgagtgcactg

SEQ ID NO: 4587566 - DNA, 19 bp, Homo sapiens
ttacaactgaccaagtttc

SEQ ID NO: 4587567 - DNA, 13 bp, Homo sapiens
ttacaagaagaac

SEQ ID NO: 4587568 - DNA, 22 bp, Homo sapiens
ttacaagatattattaattttt

SEQ ID NO: 4587569 - DNA, 20 bp, Homo sapiens
ttacaataaaccctccttgg

SEQ ID NO: 4587570 - DNA, 11 bp, Homo sapiens
ttacaatttgc

SEQ ID NO: 4587571 - DNA, 14 bp, Homo sapiens
ttacaatttgcaca

SEQ ID NO: 4587572 - DNA, 18 bp, Homo sapiens
ttacaattttatctgttt

SEQ ID NO: 4587573 - DNA, 17 bp, Homo sapiens
ttacaattttttatcat

SEQ ID NO: 4587574 - DNA, 17 bp, Homo sapiens
ttacaattttttgctct

SEQ ID NO: 4587575 - DNA, 17 bp, Homo sapiens
ttacacactaacatcaa

SEQ ID NO: 4587576 - DNA, 17 bp, Homo sapiens
ttacacagcccaagagg

SEQ ID NO: 4587577 - DNA, 22 bp, Homo sapiens
ttacacagtgagactgtacata

SEQ ID NO: 4587578 - DNA, 19 bp, Homo sapiens
ttacacatcttaaaagtgt

SEQ ID NO: 4587579 - DNA, 18 bp, Homo sapiens
ttacacatttcactgtga

SEQ ID NO: 4587580 - DNA, 17 bp, Homo sapiens
ttacacatttttcagat

SEQ ID NO: 4587581 - DNA, 14 bp, Homo sapiens
ttacactattgtga

SEQ ID NO: 4587582 - DNA, 22 bp, Homo sapiens
ttacactctgtattgaaaatgg

SEQ ID NO: 4587583 - DNA, 19 bp, Homo sapiens
ttacactgttagaacacta

SEQ ID NO: 4587584 - DNA, 14 bp, Homo sapiens
ttacacttttgaga

SEQ ID NO: 4587585 - DNA, 22 bp, Homo sapiens
ttacagaaaataccacctcgag

SEQ ID NO: 4587586 - DNA, 15 bp, Homo sapiens
ttacagaaatggact

SEQ ID NO: 4587587 - DNA, 19 bp, Homo sapiens
ttacagaaatggactggag

SEQ ID NO: 4587588 - DNA, 20 bp, Homo sapiens
ttacagacctcagttttatg

SEQ ID NO: 4587589 - DNA, 14 bp, Homo sapiens
ttacagactctgat

SEQ ID NO: 4587590 - DNA, 18 bp, Homo sapiens
ttacagatatttgtcatg

SEQ ID NO: 4587591 - DNA, 14 bp, Homo sapiens
ttacagcagcaata

SEQ ID NO: 4587592 - DNA, 11 bp, Homo sapiens
ttacaggaaac

SEQ ID NO: 4587593 - DNA, 18 bp, Homo sapiens
ttacaggaatgaagaact

SEQ ID NO: 4587594 - DNA, 16 bp, Homo sapiens
ttacaggcactaaagt

SEQ ID NO: 4587595 - DNA, 15 bp, Homo sapiens
ttacagggaagtggt

SEQ ID NO: 4587596 - DNA, 19 bp, Homo sapiens
ttacaggtcctgctgaaac

SEQ ID NO: 4587597 - DNA, 12 bp, Homo sapiens
ttacagttctgt

SEQ ID NO: 4587598 - DNA, 22 bp, Homo sapiens
ttacataatttagttgtttcta

SEQ ID NO: 4587599 - DNA, 13 bp, Homo sapiens
ttacatagtctga

SEQ ID NO: 4587600 - DNA, 23 bp, Homo sapiens
ttacatcagtagcatttttctaa

SEQ ID NO: 4587601 - DNA, 13 bp, Homo sapiens
ttacatctaagaa

SEQ ID NO: 4587602 - DNA, 13 bp, Homo sapiens
ttacatctgcctt

SEQ ID NO: 4587603 - DNA, 12 bp, Homo sapiens
ttacatgaagct

SEQ ID NO: 4587604 - DNA, 19 bp, Homo sapiens
ttacatgagttcaaatact

SEQ ID NO: 4587605 - DNA, 20 bp, Homo sapiens
ttacatgagttcaaatactt

SEQ ID NO: 4587606 - DNA, 15 bp, Homo sapiens
ttacatgatttaaag

SEQ ID NO: 4587607 - DNA, 15 bp, Homo sapiens
ttacatgtaatttga

SEQ ID NO: 4587608 - DNA, 19 bp, Homo sapiens
ttacattattccaatgata

SEQ ID NO: 4587609 - DNA, 20 bp, Homo sapiens
ttacattttattaagctttt

SEQ ID NO: 4587610 - DNA, 12 bp, Homo sapiens
ttacattttcag

SEQ ID NO: 4587611 - DNA, 21 bp, Homo sapiens
ttacattttttgggcagcaat

SEQ ID NO: 4587612 - DNA, 17 bp, Homo sapiens
ttaccaaaaaccatgtt

SEQ ID NO: 4587613 - DNA, 10 bp, Homo sapiens
ttaccaaagc

SEQ ID NO: 4587614 - DNA, 15 bp, Homo sapiens
ttaccaaatgaaatg

SEQ ID NO: 4587615 - DNA, 13 bp, Homo sapiens
ttaccaacctgtt

SEQ ID NO: 4587616 - DNA, 20 bp, Homo sapiens
ttaccaacctgttacctact

SEQ ID NO: 4587617 - DNA, 20 bp, Homo sapiens
ttaccaataggcaaattaat

SEQ ID NO: 4587618 - DNA, 17 bp, Homo sapiens
ttaccaccctttcacaa

SEQ ID NO: 4587619 - DNA, 19 bp, Homo sapiens
ttaccagggactatctttg

SEQ ID NO: 4587620 - DNA, 21 bp, Homo sapiens
ttaccagggactatctttgct

SEQ ID NO: 4587621 - DNA, 14 bp, Homo sapiens
ttaccagtctgatt

SEQ ID NO: 4587622 - DNA, 15 bp, Homo sapiens
ttaccagtctgatta

SEQ ID NO: 4587623 - DNA, 15 bp, Homo sapiens
ttaccatcatctctg

SEQ ID NO: 4587624 - DNA, 14 bp, Homo sapiens
ttaccatttacatg

SEQ ID NO: 4587625 - DNA, 19 bp, Homo sapiens
ttaccatttgttaatatca

SEQ ID NO: 4587626 - DNA, 16 bp, Homo sapiens
ttacccagaatgtcag

SEQ ID NO: 4587627 - DNA, 21 bp, Homo sapiens
ttacccagtgggacagaggag

SEQ ID NO: 4587628 - DNA, 17 bp, Homo sapiens
ttacccctgcacagttt

SEQ ID NO: 4587629 - DNA, 17 bp, Homo sapiens
ttacccctggctgtttg

SEQ ID NO: 4587630 - DNA, 14 bp, Homo sapiens
ttaccccttagcct

SEQ ID NO: 4587631 - DNA, 16 bp, Homo sapiens
ttaccccttagcctcc

SEQ ID NO: 4587632 - DNA, 21 bp, Homo sapiens
ttaccctgttcccaagcaaag

SEQ ID NO: 4587633 - DNA, 23 bp, Homo sapiens
ttacctactttgactttttgcat

SEQ ID NO: 4587634 - DNA, 19 bp, Homo sapiens
ttacctattaggtggaaat

SEQ ID NO: 4587635 - DNA, 15 bp, Homo sapiens
ttacctctctgtcat

SEQ ID NO: 4587636 - DNA, 17 bp, Homo sapiens
ttacctctctgtcatgt

SEQ ID NO: 4587637 - DNA, 12 bp, Homo sapiens
ttacctgccaat

SEQ ID NO: 4587638 - DNA, 15 bp, Homo sapiens
ttacctgctgcttct

SEQ ID NO: 4587639 - DNA, 19 bp, Homo sapiens
ttacctgtgaagtgttact

SEQ ID NO: 4587640 - DNA, 12 bp, Homo sapiens
ttacctgtggat

SEQ ID NO: 4587641 - DNA, 18 bp, Homo sapiens
ttaccttatagttactgt

SEQ ID NO: 4587642 - DNA, 20 bp, Homo sapiens
ttaccttttaccagctttta

SEQ ID NO: 4587643 - DNA, 20 bp, Homo sapiens
ttacctttttatttgcatgt

SEQ ID NO: 4587644 - DNA, 16 bp, Homo sapiens
ttacgaatattttcag

SEQ ID NO: 4587645 - DNA, 22 bp, Homo sapiens
ttacgcctataatcccagcatt

SEQ ID NO: 4587646 - DNA, 16 bp, Homo sapiens
ttacgtataatgcttt

SEQ ID NO: 4587647 - DNA, 21 bp, Homo sapiens
ttacgtttaagcttaacattt

SEQ ID NO: 4587648 - DNA, 17 bp, Homo sapiens
ttactaaaaaaaagatg

SEQ ID NO: 4587649 - DNA, 21 bp, Homo sapiens
ttactaaaatttacacatctt

SEQ ID NO: 4587650 - DNA, 22 bp, Homo sapiens
ttactagaaggcgtccatgttt

SEQ ID NO: 4587651 - DNA, 12 bp, Homo sapiens
ttactagtgttt

SEQ ID NO: 4587652 - DNA, 15 bp, Homo sapiens
ttactatagcaaagt

SEQ ID NO: 4587653 - DNA, 20 bp, Homo sapiens
ttactatatagaatttcctg

SEQ ID NO: 4587654 - DNA, 17 bp, Homo sapiens
ttactatcacacatgaa

SEQ ID NO: 4587655 - DNA, 12 bp, Homo sapiens
ttactattaact

SEQ ID NO: 4587656 - DNA, 21 bp, Homo sapiens
ttactattaggaaaataaaca

SEQ ID NO: 4587657 - DNA, 22 bp, Homo sapiens
ttactatttgccaatgtatatt

SEQ ID NO: 4587658 - DNA, 15 bp, Homo sapiens
ttactcagcagcaga

SEQ ID NO: 4587659 - DNA, 13 bp, Homo sapiens
ttactcagccctg

SEQ ID NO: 4587660 - DNA, 19 bp, Homo sapiens
ttactcccttctcgtgttt

SEQ ID NO: 4587661 - DNA, 21 bp, Homo sapiens
ttactcccttctgtagttttt

SEQ ID NO: 4587662 - DNA, 15 bp, Homo sapiens
ttactgaatgatcta

SEQ ID NO: 4587663 - DNA, 22 bp, Homo sapiens
ttactgaattgtatcaatttgt

SEQ ID NO: 4587664 - DNA, 12 bp, Homo sapiens
ttactgacttgg

SEQ ID NO: 4587665 - DNA, 23 bp, Homo sapiens
ttactgatatattttacaatttt

SEQ ID NO: 4587666 - DNA, 15 bp, Homo sapiens
ttactgatgtgtgca

SEQ ID NO: 4587667 - DNA, 17 bp, Homo sapiens
ttactgctgattcttgt

SEQ ID NO: 4587668 - DNA, 20 bp, Homo sapiens
ttactgctgattcttgtaaa

SEQ ID NO: 4587669 - DNA, 18 bp, Homo sapiens
ttactgcttctctttgtg

SEQ ID NO: 4587670 - DNA, 16 bp, Homo sapiens
ttactggataaattgt

SEQ ID NO: 4587671 - DNA, 14 bp, Homo sapiens
ttactggtccaaaa

SEQ ID NO: 4587672 - DNA, 17 bp, Homo sapiens
ttactggtccaaaagat

SEQ ID NO: 4587673 - DNA, 15 bp, Homo sapiens
ttactgtaattcctc

SEQ ID NO: 4587674 - DNA, 19 bp, Homo sapiens
ttactgtatcaatttctaa

SEQ ID NO: 4587675 - DNA, 20 bp, Homo sapiens
ttactgtatttttcagaaat

SEQ ID NO: 4587676 - DNA, 16 bp, Homo sapiens
ttactgtcagattaaa

SEQ ID NO: 4587677 - DNA, 17 bp, Homo sapiens
ttactgtcagattaaat

SEQ ID NO: 4587678 - DNA, 19 bp, Homo sapiens
ttactgtcagattaaatta

SEQ ID NO: 4587679 - DNA, 14 bp, Homo sapiens
ttactgtcattccc

SEQ ID NO: 4587680 - DNA, 12 bp, Homo sapiens
ttactgtgaaaa

SEQ ID NO: 4587681 - DNA, 19 bp, Homo sapiens
ttactgtgaaaaaaaattt

SEQ ID NO: 4587682 - DNA, 16 bp, Homo sapiens
ttactgtgtaattagt

SEQ ID NO: 4587683 - DNA, 20 bp, Homo sapiens
ttactgtgtaattagtgcca

SEQ ID NO: 4587684 - DNA, 13 bp, Homo sapiens
ttacttaaggcag

SEQ ID NO: 4587685 - DNA, 13 bp, Homo sapiens
ttacttaagtgtt

SEQ ID NO: 4587686 - DNA, 19 bp, Homo sapiens
ttacttaagtgttcatttt

SEQ ID NO: 4587687 - DNA, 20 bp, Homo sapiens
ttacttaagtgttcatttta

SEQ ID NO: 4587688 - DNA, 14 bp, Homo sapiens
ttacttagaatgcc

SEQ ID NO: 4587689 - DNA, 16 bp, Homo sapiens
ttacttatcttatgcc

SEQ ID NO: 4587690 - DNA, 18 bp, Homo sapiens
ttacttctctataaaaaa

SEQ ID NO: 4587691 - DNA, 24 bp, Homo sapiens
ttacttctctataaaaaatatgta

SEQ ID NO: 4587692 - DNA, 12 bp, Homo sapiens
ttacttgaagta

SEQ ID NO: 4587693 - DNA, 15 bp, Homo sapiens
ttactttaaattata

SEQ ID NO: 4587694 - DNA, 12 bp, Homo sapiens
ttactttcaaaa

SEQ ID NO: 4587695 - DNA, 13 bp, Homo sapiens
ttactttcaaaat

SEQ ID NO: 4587696 - DNA, 14 bp, Homo sapiens
ttactttcaagtaa

SEQ ID NO: 4587697 - DNA, 19 bp, Homo sapiens
ttactttcttcaccaagtg

SEQ ID NO: 4587698 - DNA, 11 bp, Homo sapiens
ttactttgtgt

SEQ ID NO: 4587699 - DNA, 14 bp, Homo sapiens
ttacttttattatt

SEQ ID NO: 4587700 - DNA, 15 bp, Homo sapiens
ttacttttctgccaa

SEQ ID NO: 4587701 - DNA, 17 bp, Homo sapiens
ttacttttctgccaaaa

SEQ ID NO: 4587702 - DNA, 16 bp, Homo sapiens
ttactttttaaaaata

SEQ ID NO: 4587703 - DNA, 15 bp, Homo sapiens
ttactttttgctgtt

SEQ ID NO: 4587704 - DNA, 14 bp, Homo sapiens
ttagaaaaagaaca

SEQ ID NO: 4587705 - DNA, 21 bp, Homo sapiens
ttagaaaacataatcttctgc

SEQ ID NO: 4587706 - DNA, 16 bp, Homo sapiens
ttagaaaactttaaag

SEQ ID NO: 4587707 - DNA, 20 bp, Homo sapiens
ttagaaaagcaaagggtgct

SEQ ID NO: 4587708 - DNA, 13 bp, Homo sapiens
ttagaaaagtgaa

SEQ ID NO: 4587709 - DNA, 21 bp, Homo sapiens
ttagaaaatgacttatttctg

SEQ ID NO: 4587710 - DNA, 16 bp, Homo sapiens
ttagaaacaccattca

SEQ ID NO: 4587711 - DNA, 10 bp, Homo sapiens
ttagaaactg

SEQ ID NO: 4587712 - DNA, 15 bp, Homo sapiens
ttagaaatattaaag

SEQ ID NO: 4587713 - DNA, 22 bp, Homo sapiens
ttagaaatattttaaaatcagc

SEQ ID NO: 4587714 - DNA, 17 bp, Homo sapiens
ttagaacactattttca

SEQ ID NO: 4587715 - DNA, 21 bp, Homo sapiens
ttagaacactattttcagaat

SEQ ID NO: 4587716 - DNA, 14 bp, Homo sapiens
ttagaaccacagca

SEQ ID NO: 4587717 - DNA, 20 bp, Homo sapiens
ttagaaccagccgtatttta

SEQ ID NO: 4587718 - DNA, 12 bp, Homo sapiens
ttagaagaaaga

SEQ ID NO: 4587719 - DNA, 15 bp, Homo sapiens
ttagaagaagtgtgt

SEQ ID NO: 4587720 - DNA, 22 bp, Homo sapiens
ttagaagctgaagatccccaac

SEQ ID NO: 4587721 - DNA, 13 bp, Homo sapiens
ttagaatcagaat

SEQ ID NO: 4587722 - DNA, 14 bp, Homo sapiens
ttagaatcagaata

SEQ ID NO: 4587723 - DNA, 20 bp, Homo sapiens
ttagaatcattaccttttac

SEQ ID NO: 4587724 - DNA, 19 bp, Homo sapiens
ttagaatgaatttatcttt

SEQ ID NO: 4587725 - DNA, 17 bp, Homo sapiens
ttagaatgccataaaat

SEQ ID NO: 4587726 - DNA, 23 bp, Homo sapiens
ttagaatgccggttaaattccat

SEQ ID NO: 4587727 - DNA, 15 bp, Homo sapiens
ttagaatggaggaag

SEQ ID NO: 4587728 - DNA, 13 bp, Homo sapiens
ttagaattaaaaa

SEQ ID NO: 4587729 - DNA, 15 bp, Homo sapiens
ttagaccgctctctt

SEQ ID NO: 4587730 - DNA, 15 bp, Homo sapiens
ttagacctttatcca

SEQ ID NO: 4587731 - DNA, 21 bp, Homo sapiens
ttagactcatggtgtgttaca

SEQ ID NO: 4587732 - DNA, 17 bp, Homo sapiens
ttagactcttttccttc

SEQ ID NO: 4587733 - DNA, 18 bp, Homo sapiens
ttagactgtgattcagaa

SEQ ID NO: 4587734 - DNA, 22 bp, Homo sapiens
ttagactgtggccatatatgct

SEQ ID NO: 4587735 - DNA, 15 bp, Homo sapiens
ttagacttgctccct

SEQ ID NO: 4587736 - DNA, 12 bp, Homo sapiens
ttagagaatccg

SEQ ID NO: 4587737 - DNA, 15 bp, Homo sapiens
ttagagcttggacag

SEQ ID NO: 4587738 - DNA, 19 bp, Homo sapiens
ttagaggagtctgtggctt

SEQ ID NO: 4587739 - DNA, 18 bp, Homo sapiens
ttagagtttctgtttgat

SEQ ID NO: 4587740 - DNA, 18 bp, Homo sapiens
ttagagttttattccttt

SEQ ID NO: 4587741 - DNA, 19 bp, Homo sapiens
ttagagttttattcctttc

SEQ ID NO: 4587742 - DNA, 21 bp, Homo sapiens
ttagataaagatttctagtag

SEQ ID NO: 4587743 - DNA, 16 bp, Homo sapiens
ttagataacttcttga

SEQ ID NO: 4587744 - DNA, 18 bp, Homo sapiens
ttagataacttcttgaaa

SEQ ID NO: 4587745 - DNA, 21 bp, Homo sapiens
ttagataacttcttgaaaaag

SEQ ID NO: 4587746 - DNA, 23 bp, Homo sapiens
ttagataatcaagggcactgtga

SEQ ID NO: 4587747 - DNA, 12 bp, Homo sapiens
ttagatattgct

SEQ ID NO: 4587748 - DNA, 21 bp, Homo sapiens
ttagatattgctactataatc

SEQ ID NO: 4587749 - DNA, 14 bp, Homo sapiens
ttagatccattaat

SEQ ID NO: 4587750 - DNA, 20 bp, Homo sapiens
ttagatgttctaagtctttc

SEQ ID NO: 4587751 - DNA, 20 bp, Homo sapiens
ttagattcttaattcatgag

SEQ ID NO: 4587752 - DNA, 13 bp, Homo sapiens
ttagattgagaaa

SEQ ID NO: 4587753 - DNA, 15 bp, Homo sapiens
ttagattgagaaatg

SEQ ID NO: 4587754 - DNA, 14 bp, Homo sapiens
ttagatttcatagt

SEQ ID NO: 4587755 - DNA, 20 bp, Homo sapiens
ttagatttcatagttcagaa

SEQ ID NO: 4587756 - DNA, 20 bp, Homo sapiens
ttagcactgaactgctttta

SEQ ID NO: 4587757 - DNA, 19 bp, Homo sapiens
ttagcagagacaaagagtt

SEQ ID NO: 4587758 - DNA, 23 bp, Homo sapiens
ttagcaggccaaggtctgagcca

SEQ ID NO: 4587759 - DNA, 12 bp, Homo sapiens
ttagcagttctg

SEQ ID NO: 4587760 - DNA, 18 bp, Homo sapiens
ttagcagttctgcaaata

SEQ ID NO: 4587761 - DNA, 17 bp, Homo sapiens
ttagccagatttgtctt

SEQ ID NO: 4587762 - DNA, 20 bp, Homo sapiens
ttagccatctaatgcttgtt

SEQ ID NO: 4587763 - DNA, 19 bp, Homo sapiens
ttagcccaagaggtctgag

SEQ ID NO: 4587764 - DNA, 15 bp, Homo sapiens
ttagcctccctgaaa

SEQ ID NO: 4587765 - DNA, 16 bp, Homo sapiens
ttagcgtcaagacatt

SEQ ID NO: 4587766 - DNA, 18 bp, Homo sapiens
ttagcgtcaagacatttg

SEQ ID NO: 4587767 - DNA, 14 bp, Homo sapiens
ttagcgttctggac

SEQ ID NO: 4587768 - DNA, 16 bp, Homo sapiens
ttagcgttctggactc

SEQ ID NO: 4587769 - DNA, 21 bp, Homo sapiens
ttagcgttctggactctgccc

SEQ ID NO: 4587770 - DNA, 23 bp, Homo sapiens
ttagcgttctggactctgcccca

SEQ ID NO: 4587771 - DNA, 13 bp, Homo sapiens
ttagctcccctcc

SEQ ID NO: 4587772 - DNA, 14 bp, Homo sapiens
ttagctcccctcca

SEQ ID NO: 4587773 - DNA, 22 bp, Homo sapiens
ttagctgggaagaatgtattcg

SEQ ID NO: 4587774 - DNA, 17 bp, Homo sapiens
ttagcttttgatgtctc

SEQ ID NO: 4587775 - DNA, 16 bp, Homo sapiens
ttagctttttctcaga

SEQ ID NO: 4587776 - DNA, 18 bp, Homo sapiens
ttaggaaaggatgatcaa

SEQ ID NO: 4587777 - DNA, 13 bp, Homo sapiens
ttaggactagaag

SEQ ID NO: 4587778 - DNA, 23 bp, Homo sapiens
ttaggagtgctgataagaatgaa

SEQ ID NO: 4587779 - DNA, 19 bp, Homo sapiens
ttaggcatgtcccacccac

SEQ ID NO: 4587780 - DNA, 16 bp, Homo sapiens
ttaggccacatgggag

SEQ ID NO: 4587781 - DNA, 14 bp, Homo sapiens
ttaggctgtaacta

SEQ ID NO: 4587782 - DNA, 20 bp, Homo sapiens
ttaggctgtaactactttat

SEQ ID NO: 4587783 - DNA, 14 bp, Homo sapiens
ttagggaagggcct

SEQ ID NO: 4587784 - DNA, 15 bp, Homo sapiens
ttagggagagaagat

SEQ ID NO: 4587785 - DNA, 14 bp, Homo sapiens
ttagggtataagtt

SEQ ID NO: 4587786 - DNA, 17 bp, Homo sapiens
ttaggtaatttttttca

SEQ ID NO: 4587787 - DNA, 14 bp, Homo sapiens
ttaggttgttacca

SEQ ID NO: 4587788 - DNA, 18 bp, Homo sapiens
ttagtaacctttaaaaat

SEQ ID NO: 4587789 - DNA, 20 bp, Homo sapiens
ttagtaacctttaaaaatgt

SEQ ID NO: 4587790 - DNA, 14 bp, Homo sapiens
ttagtacaatagta

SEQ ID NO: 4587791 - DNA, 22 bp, Homo sapiens
ttagtagttactaaaattatgt

SEQ ID NO: 4587792 - DNA, 20 bp, Homo sapiens
ttagtattcaggcactgaga

SEQ ID NO: 4587793 - DNA, 14 bp, Homo sapiens
ttagtattcttgag

SEQ ID NO: 4587794 - DNA, 21 bp, Homo sapiens
ttagtctcgctaaagttatat

SEQ ID NO: 4587795 - DNA, 15 bp, Homo sapiens
ttagtcttaaaataa

SEQ ID NO: 4587796 - DNA, 17 bp, Homo sapiens
ttagtcttttgtaatat

SEQ ID NO: 4587797 - DNA, 19 bp, Homo sapiens
ttagtgatactggctcaga

SEQ ID NO: 4587798 - DNA, 20 bp, Homo sapiens
ttagtggctcaacattgtgt

SEQ ID NO: 4587799 - DNA, 23 bp, Homo sapiens
ttagtggctcaacattgtgttcc

SEQ ID NO: 4587800 - DNA, 13 bp, Homo sapiens
ttagtgtatccat

SEQ ID NO: 4587801 - DNA, 16 bp, Homo sapiens
ttagtgtgtaaaatta

SEQ ID NO: 4587802 - DNA, 23 bp, Homo sapiens
ttagttaaaactcatcacataaa

SEQ ID NO: 4587803 - DNA, 18 bp, Homo sapiens
ttagttaccttatagtta

SEQ ID NO: 4587804 - DNA, 13 bp, Homo sapiens
ttagttataaaac

SEQ ID NO: 4587805 - DNA, 13 bp, Homo sapiens
ttagttctgtata

SEQ ID NO: 4587806 - DNA, 19 bp, Homo sapiens
ttagttctttttgccagtt

SEQ ID NO: 4587807 - DNA, 22 bp, Homo sapiens
ttagttgcctaagcattgcctg

SEQ ID NO: 4587808 - DNA, 19 bp, Homo sapiens
ttagttggctttcataaat

SEQ ID NO: 4587809 - DNA, 15 bp, Homo sapiens
ttagtttgtatatat

SEQ ID NO: 4587810 - DNA, 13 bp, Homo sapiens
ttagtttgttaaa

SEQ ID NO: 4587811 - DNA, 14 bp, Homo sapiens
ttagtttgttcttc

SEQ ID NO: 4587812 - DNA, 18 bp, Homo sapiens
ttagttttgtgaaggtga

SEQ ID NO: 4587813 - DNA, 21 bp, Homo sapiens
ttagtttttgtgaagtttaat

SEQ ID NO: 4587814 - DNA, 14 bp, Homo sapiens
ttataaaaaattaa

SEQ ID NO: 4587815 - DNA, 22 bp, Homo sapiens
ttataaaaaattaacttagttt

SEQ ID NO: 4587816 - DNA, 14 bp, Homo sapiens
ttataaaaagataa

SEQ ID NO: 4587817 - DNA, 17 bp, Homo sapiens
ttataaaaataaataga

SEQ ID NO: 4587818 - DNA, 12 bp, Homo sapiens
ttataaaagtgt

SEQ ID NO: 4587819 - DNA, 10 bp, Homo sapiens
ttataaaata

SEQ ID NO: 4587820 - DNA, 14 bp, Homo sapiens
ttataaaataatgt

SEQ ID NO: 4587821 - DNA, 22 bp, Homo sapiens
ttataaaataatgtactgaatt

SEQ ID NO: 4587822 - DNA, 14 bp, Homo sapiens
ttataaaattaaaa

SEQ ID NO: 4587823 - DNA, 15 bp, Homo sapiens
ttataaactataaac

SEQ ID NO: 4587824 - DNA, 11 bp, Homo sapiens
ttataaataaa

SEQ ID NO: 4587825 - DNA, 19 bp, Homo sapiens
ttataaatactgcaaatca

SEQ ID NO: 4587826 - DNA, 19 bp, Homo sapiens
ttataaatatatataaaga

SEQ ID NO: 4587827 - DNA, 23 bp, Homo sapiens
ttataaatgtgtttatagctcat

SEQ ID NO: 4587828 - DNA, 19 bp, Homo sapiens
ttataaatgttctggtatg

SEQ ID NO: 4587829 - DNA, 18 bp, Homo sapiens
ttataaattaaatatatg

SEQ ID NO: 4587830 - DNA, 15 bp, Homo sapiens
ttataacagatgtga

SEQ ID NO: 4587831 - DNA, 19 bp, Homo sapiens
ttataactaacatgtcctg

SEQ ID NO: 4587832 - DNA, 16 bp, Homo sapiens
ttataactctgcacta

SEQ ID NO: 4587833 - DNA, 17 bp, Homo sapiens
ttataactctgtataat

SEQ ID NO: 4587834 - DNA, 17 bp, Homo sapiens
ttataactgtaaagatg

SEQ ID NO: 4587835 - DNA, 13 bp, Homo sapiens
ttataactgtttt

SEQ ID NO: 4587836 - DNA, 14 bp, Homo sapiens
ttataactgtttta

SEQ ID NO: 4587837 - DNA, 19 bp, Homo sapiens
ttataactgttttagaaat

SEQ ID NO: 4587838 - DNA, 20 bp, Homo sapiens
ttataatacttttcttcccc

SEQ ID NO: 4587839 - DNA, 18 bp, Homo sapiens
ttataatgtatttgaaaa

SEQ ID NO: 4587840 - DNA, 18 bp, Homo sapiens
ttataattttactcactc

SEQ ID NO: 4587841 - DNA, 16 bp, Homo sapiens
ttatacaaccttcatt

SEQ ID NO: 4587842 - DNA, 19 bp, Homo sapiens
ttatacaaccttcatttaa

SEQ ID NO: 4587843 - DNA, 17 bp, Homo sapiens
ttatacagttataaaat

SEQ ID NO: 4587844 - DNA, 16 bp, Homo sapiens
ttatacagttttaaag

SEQ ID NO: 4587845 - DNA, 18 bp, Homo sapiens
ttatacagttttaaagaa

SEQ ID NO: 4587846 - DNA, 19 bp, Homo sapiens
ttatacagttttaaagaat

SEQ ID NO: 4587847 - DNA, 21 bp, Homo sapiens
ttatacagttttaaagaatca

SEQ ID NO: 4587848 - DNA, 13 bp, Homo sapiens
ttataccagctta

SEQ ID NO: 4587849 - DNA, 13 bp, Homo sapiens
ttatactgtacaa

SEQ ID NO: 4587850 - DNA, 12 bp, Homo sapiens
ttatagaaaatt

SEQ ID NO: 4587851 - DNA, 19 bp, Homo sapiens
ttatagacaaaagaataag

SEQ ID NO: 4587852 - DNA, 18 bp, Homo sapiens
ttatagcaaaaatgtttt

SEQ ID NO: 4587853 - DNA, 15 bp, Homo sapiens
ttatagctcatttgt

SEQ ID NO: 4587854 - DNA, 18 bp, Homo sapiens
ttataggatttatttaaa

SEQ ID NO: 4587855 - DNA, 23 bp, Homo sapiens
ttataggcctgtcccttgcctct

SEQ ID NO: 4587856 - DNA, 13 bp, Homo sapiens
ttatagtacatga

SEQ ID NO: 4587857 - DNA, 20 bp, Homo sapiens
ttatagtctatgtgattctg

SEQ ID NO: 4587858 - DNA, 21 bp, Homo sapiens
ttatagtgatgtaatcttgaa

SEQ ID NO: 4587859 - DNA, 16 bp, Homo sapiens
ttatagtggaaaaaca

SEQ ID NO: 4587860 - DNA, 17 bp, Homo sapiens
ttatagtgtttggacag

SEQ ID NO: 4587861 - DNA, 14 bp, Homo sapiens
ttatagttactgtg

SEQ ID NO: 4587862 - DNA, 16 bp, Homo sapiens
ttatagttattaaatg

SEQ ID NO: 4587863 - DNA, 22 bp, Homo sapiens
ttatataaagtattctttttct

SEQ ID NO: 4587864 - DNA, 19 bp, Homo sapiens
ttatataaataaagttttt

SEQ ID NO: 4587865 - DNA, 12 bp, Homo sapiens
ttatataactgt

SEQ ID NO: 4587866 - DNA, 19 bp, Homo sapiens
ttatataagcccttaataa

SEQ ID NO: 4587867 - DNA, 18 bp, Homo sapiens
ttatataatatctaaagt

SEQ ID NO: 4587868 - DNA, 12 bp, Homo sapiens
ttatataattgt

SEQ ID NO: 4587869 - DNA, 16 bp, Homo sapiens
ttatataattgttgaa

SEQ ID NO: 4587870 - DNA, 19 bp, Homo sapiens
ttatatactttttcatgaa

SEQ ID NO: 4587871 - DNA, 22 bp, Homo sapiens
ttatatactttttcatgaaaat

SEQ ID NO: 4587872 - DNA, 19 bp, Homo sapiens
ttatatagatgtcagcaat

SEQ ID NO: 4587873 - DNA, 18 bp, Homo sapiens
ttatatataataaatact

SEQ ID NO: 4587874 - DNA, 16 bp, Homo sapiens
ttatatattataagtt

SEQ ID NO: 4587875 - DNA, 17 bp, Homo sapiens
ttatatattatgtgaag

SEQ ID NO: 4587876 - DNA, 15 bp, Homo sapiens
ttatatattgaaagt

SEQ ID NO: 4587877 - DNA, 18 bp, Homo sapiens
ttatatattgtattaagg

SEQ ID NO: 4587878 - DNA, 14 bp, Homo sapiens
ttatatatttacag

SEQ ID NO: 4587879 - DNA, 19 bp, Homo sapiens
ttatatatttacagaagaa

SEQ ID NO: 4587880 - DNA, 13 bp, Homo sapiens
ttatatcagcttt

SEQ ID NO: 4587881 - DNA, 14 bp, Homo sapiens
ttatatcatacagt

SEQ ID NO: 4587882 - DNA, 18 bp, Homo sapiens
ttatatcatacagttttc

SEQ ID NO: 4587883 - DNA, 23 bp, Homo sapiens
ttatatcatacagttttcattga

SEQ ID NO: 4587884 - DNA, 14 bp, Homo sapiens
ttatatcatgcaaa

SEQ ID NO: 4587885 - DNA, 22 bp, Homo sapiens
ttatatctgtaatgatactgat

SEQ ID NO: 4587886 - DNA, 15 bp, Homo sapiens
ttatatcttgtttac

SEQ ID NO: 4587887 - DNA, 15 bp, Homo sapiens
ttatatgaagaaaat

SEQ ID NO: 4587888 - DNA, 19 bp, Homo sapiens
ttatatgggtatatattca

SEQ ID NO: 4587889 - DNA, 14 bp, Homo sapiens
ttatatgtaccgta

SEQ ID NO: 4587890 - DNA, 14 bp, Homo sapiens
ttatatgtgttgaa

SEQ ID NO: 4587891 - DNA, 20 bp, Homo sapiens
ttatattagttgctttgtta

SEQ ID NO: 4587892 - DNA, 13 bp, Homo sapiens
ttatattctaata

SEQ ID NO: 4587893 - DNA, 17 bp, Homo sapiens
ttatattctaattaaaa

SEQ ID NO: 4587894 - DNA, 21 bp, Homo sapiens
ttatattctaattaaaattgt

SEQ ID NO: 4587895 - DNA, 19 bp, Homo sapiens
ttatattgcttcctgtgta

SEQ ID NO: 4587896 - DNA, 23 bp, Homo sapiens
ttatattgtttttatatattata

SEQ ID NO: 4587897 - DNA, 15 bp, Homo sapiens
ttatatttcagatgt

SEQ ID NO: 4587898 - DNA, 13 bp, Homo sapiens
ttatatttccttt

SEQ ID NO: 4587899 - DNA, 16 bp, Homo sapiens
ttatatttcctttatg

SEQ ID NO: 4587900 - DNA, 21 bp, Homo sapiens
ttatatttcctttatgtgaat

SEQ ID NO: 4587901 - DNA, 15 bp, Homo sapiens
ttatattttatgaac

SEQ ID NO: 4587902 - DNA, 21 bp, Homo sapiens
ttatattttatgaacattgta

SEQ ID NO: 4587903 - DNA, 11 bp, Homo sapiens
ttatattttca

SEQ ID NO: 4587904 - DNA, 22 bp, Homo sapiens
ttatcaaaaagctaatgtgcag

SEQ ID NO: 4587905 - DNA, 18 bp, Homo sapiens
ttatcacataagagagat

SEQ ID NO: 4587906 - DNA, 22 bp, Homo sapiens
ttatcacctaagcacttctaga

SEQ ID NO: 4587907 - DNA, 17 bp, Homo sapiens
ttatcacctctgatggc

SEQ ID NO: 4587908 - DNA, 15 bp, Homo sapiens
ttatcagagtcatga

SEQ ID NO: 4587909 - DNA, 14 bp, Homo sapiens
ttatcagcaaaaaa

SEQ ID NO: 4587910 - DNA, 14 bp, Homo sapiens
ttatcagcaaagaa

SEQ ID NO: 4587911 - DNA, 19 bp, Homo sapiens
ttatcatcctttcagtttt

SEQ ID NO: 4587912 - DNA, 18 bp, Homo sapiens
ttatcatgaattttaaag

SEQ ID NO: 4587913 - DNA, 18 bp, Homo sapiens
ttatcattcaagtgtaaa

SEQ ID NO: 4587914 - DNA, 18 bp, Homo sapiens
ttatccctctcttcccct

SEQ ID NO: 4587915 - DNA, 14 bp, Homo sapiens
ttatcctgtattct

SEQ ID NO: 4587916 - DNA, 11 bp, Homo sapiens
ttatctaattt

SEQ ID NO: 4587917 - DNA, 18 bp, Homo sapiens
ttatctacctcaaggtaa

SEQ ID NO: 4587918 - DNA, 14 bp, Homo sapiens
ttatctataattta

SEQ ID NO: 4587919 - DNA, 22 bp, Homo sapiens
ttatctataatttacctaagat

SEQ ID NO: 4587920 - DNA, 17 bp, Homo sapiens
ttatctcagatgttaaa

SEQ ID NO: 4587921 - DNA, 20 bp, Homo sapiens
ttatctgcccctcccccact

SEQ ID NO: 4587922 - DNA, 12 bp, Homo sapiens
ttatctgggctt

SEQ ID NO: 4587923 - DNA, 12 bp, Homo sapiens
ttatcttacatt

SEQ ID NO: 4587924 - DNA, 17 bp, Homo sapiens
ttatcttatgccacggg

SEQ ID NO: 4587925 - DNA, 19 bp, Homo sapiens
ttatcttctttattattcc

SEQ ID NO: 4587926 - DNA, 17 bp, Homo sapiens
ttatcttggttgaaaat

SEQ ID NO: 4587927 - DNA, 23 bp, Homo sapiens
ttatctttaccaaaaaccatgtt

SEQ ID NO: 4587928 - DNA, 14 bp, Homo sapiens
ttatgaaaaagaag

SEQ ID NO: 4587929 - DNA, 14 bp, Homo sapiens
ttatgaaaagtact

SEQ ID NO: 4587930 - DNA, 16 bp, Homo sapiens
ttatgaaaattatact

SEQ ID NO: 4587931 - DNA, 16 bp, Homo sapiens
ttatgaatattaaagg

SEQ ID NO: 4587932 - DNA, 18 bp, Homo sapiens
ttatgaattataaatgtg

SEQ ID NO: 4587933 - DNA, 16 bp, Homo sapiens
ttatgactatgtaaac

SEQ ID NO: 4587934 - DNA, 16 bp, Homo sapiens
ttatgagtctttgaga

SEQ ID NO: 4587935 - DNA, 20 bp, Homo sapiens
ttatgatgatacagtgttaa

SEQ ID NO: 4587936 - DNA, 20 bp, Homo sapiens
ttatgatggagcaactgaaa

SEQ ID NO: 4587937 - DNA, 18 bp, Homo sapiens
ttatgattttcataactt

SEQ ID NO: 4587938 - DNA, 16 bp, Homo sapiens
ttatgcaaaacttttt

SEQ ID NO: 4587939 - DNA, 18 bp, Homo sapiens
ttatgcagcaaatatatg

SEQ ID NO: 4587940 - DNA, 13 bp, Homo sapiens
ttatgccacctga

SEQ ID NO: 4587941 - DNA, 18 bp, Homo sapiens
ttatgcctcgcttattta

SEQ ID NO: 4587942 - DNA, 19 bp, Homo sapiens
ttatgcggttaattttgaa

SEQ ID NO: 4587943 - DNA, 15 bp, Homo sapiens
ttatgctgatttatt

SEQ ID NO: 4587944 - DNA, 17 bp, Homo sapiens
ttatgctgtgacacatg

SEQ ID NO: 4587945 - DNA, 12 bp, Homo sapiens
ttatgctttgaa

SEQ ID NO: 4587946 - DNA, 14 bp, Homo sapiens
ttatgctttgaact

SEQ ID NO: 4587947 - DNA, 17 bp, Homo sapiens
ttatgctttgaacttta

SEQ ID NO: 4587948 - DNA, 19 bp, Homo sapiens
ttatggagacctctccttc

SEQ ID NO: 4587949 - DNA, 21 bp, Homo sapiens
ttatggagtcttgtgccaaac

SEQ ID NO: 4587950 - DNA, 14 bp, Homo sapiens
ttatggcaaaagta

SEQ ID NO: 4587951 - DNA, 14 bp, Homo sapiens
ttatggcatttcta

SEQ ID NO: 4587952 - DNA, 11 bp, Homo sapiens
ttatggcctca

SEQ ID NO: 4587953 - DNA, 18 bp, Homo sapiens
ttatggctataggtgcta

SEQ ID NO: 4587954 - DNA, 21 bp, Homo sapiens
ttatggtaactgctttctgtt

SEQ ID NO: 4587955 - DNA, 14 bp, Homo sapiens
ttatggttacttct

SEQ ID NO: 4587956 - DNA, 22 bp, Homo sapiens
ttatggttatgttcatctaaac

SEQ ID NO: 4587957 - DNA, 11 bp, Homo sapiens
ttatggttttg

SEQ ID NO: 4587958 - DNA, 16 bp, Homo sapiens
ttatgtaagcatttgt

SEQ ID NO: 4587959 - DNA, 17 bp, Homo sapiens
ttatgtaatttctttaa

SEQ ID NO: 4587960 - DNA, 14 bp, Homo sapiens
ttatgtacaaacat

SEQ ID NO: 4587961 - DNA, 11 bp, Homo sapiens
ttatgtacaac

SEQ ID NO: 4587962 - DNA, 14 bp, Homo sapiens
ttatgtacaaccct

SEQ ID NO: 4587963 - DNA, 15 bp, Homo sapiens
ttatgtagtaattga

SEQ ID NO: 4587964 - DNA, 11 bp, Homo sapiens
ttatgtagttt

SEQ ID NO: 4587965 - DNA, 19 bp, Homo sapiens
ttatgtatcagtgtccttt

SEQ ID NO: 4587966 - DNA, 20 bp, Homo sapiens
ttatgtatttaaagttgtat

SEQ ID NO: 4587967 - DNA, 20 bp, Homo sapiens
ttatgtatttcctggatgtt

SEQ ID NO: 4587968 - DNA, 21 bp, Homo sapiens
ttatgtcagcacacacttaca

SEQ ID NO: 4587969 - DNA, 16 bp, Homo sapiens
ttatgtcatcagtaaa

SEQ ID NO: 4587970 - DNA, 18 bp, Homo sapiens
ttatgtcatcagtaaagt

SEQ ID NO: 4587971 - DNA, 22 bp, Homo sapiens
ttatgtcctgtgagatgtgtat

SEQ ID NO: 4587972 - DNA, 21 bp, Homo sapiens
ttatgtgaaatgctttctgta

SEQ ID NO: 4587973 - DNA, 17 bp, Homo sapiens
ttatgtgaacaactgtt

SEQ ID NO: 4587974 - DNA, 21 bp, Homo sapiens
ttatgtgaacaactgtttgtc

SEQ ID NO: 4587975 - DNA, 19 bp, Homo sapiens
ttatgtgaagaatttagat

SEQ ID NO: 4587976 - DNA, 20 bp, Homo sapiens
ttatgtgaatttttaagctg

SEQ ID NO: 4587977 - DNA, 15 bp, Homo sapiens
ttatgtgacattaac

SEQ ID NO: 4587978 - DNA, 13 bp, Homo sapiens
ttatgtgttacat

SEQ ID NO: 4587979 - DNA, 20 bp, Homo sapiens
ttatgtgttacattattcca

SEQ ID NO: 4587980 - DNA, 17 bp, Homo sapiens
ttatgtgttatgaacat

SEQ ID NO: 4587981 - DNA, 17 bp, Homo sapiens
ttatgttaaatcaataa

SEQ ID NO: 4587982 - DNA, 20 bp, Homo sapiens
ttatgttactgtatttttca

SEQ ID NO: 4587983 - DNA, 13 bp, Homo sapiens
ttatgttagttta

SEQ ID NO: 4587984 - DNA, 11 bp, Homo sapiens
ttatgttcctt

SEQ ID NO: 4587985 - DNA, 21 bp, Homo sapiens
ttatgtttctacacattgcta

SEQ ID NO: 4587986 - DNA, 18 bp, Homo sapiens
ttatgttttctttctcac

SEQ ID NO: 4587987 - DNA, 15 bp, Homo sapiens
ttattaaaaaatttg

SEQ ID NO: 4587988 - DNA, 15 bp, Homo sapiens
ttattaaaattctga

SEQ ID NO: 4587989 - DNA, 16 bp, Homo sapiens
ttattaaaattctgaa

SEQ ID NO: 4587990 - DNA, 17 bp, Homo sapiens
ttattaaacttcagcaa

SEQ ID NO: 4587991 - DNA, 18 bp, Homo sapiens
ttattaacataggtgaaa

SEQ ID NO: 4587992 - DNA, 20 bp, Homo sapiens
ttattaagcagactggaaaa

SEQ ID NO: 4587993 - DNA, 13 bp, Homo sapiens
ttattaatataat

SEQ ID NO: 4587994 - DNA, 20 bp, Homo sapiens
ttattaatctactgtatcaa

SEQ ID NO: 4587995 - DNA, 13 bp, Homo sapiens
ttattaatgcact

SEQ ID NO: 4587996 - DNA, 14 bp, Homo sapiens
ttattaatgtttct

SEQ ID NO: 4587997 - DNA, 17 bp, Homo sapiens
ttattacaaatgcaaat

SEQ ID NO: 4587998 - DNA, 17 bp, Homo sapiens
ttattacaatgtatctt

SEQ ID NO: 4587999 - DNA, 16 bp, Homo sapiens
ttattactttaaatta

SEQ ID NO: 4588000 - DNA, 18 bp, Homo sapiens
ttattactttaaattata

SEQ ID NO: 4588001 - DNA, 21 bp, Homo sapiens
ttattactttaaattatatga

SEQ ID NO: 4588002 - DNA, 19 bp, Homo sapiens
ttattagaaaaatattata

SEQ ID NO: 4588003 - DNA, 21 bp, Homo sapiens
ttattagagattacctcctga

SEQ ID NO: 4588004 - DNA, 18 bp, Homo sapiens
ttattagccctgcatttt

SEQ ID NO: 4588005 - DNA, 22 bp, Homo sapiens
ttattagttccccaaatacaaa

SEQ ID NO: 4588006 - DNA, 12 bp, Homo sapiens
ttattataaaat

SEQ ID NO: 4588007 - DNA, 14 bp, Homo sapiens
ttattataaactat

SEQ ID NO: 4588008 - DNA, 23 bp, Homo sapiens
ttattataaactataaacttaag

SEQ ID NO: 4588009 - DNA, 18 bp, Homo sapiens
ttattatctagctaagcg

SEQ ID NO: 4588010 - DNA, 14 bp, Homo sapiens
ttattatgcattat

SEQ ID NO: 4588011 - DNA, 13 bp, Homo sapiens
ttattattcctag

SEQ ID NO: 4588012 - DNA, 14 bp, Homo sapiens
ttattattcctagt

SEQ ID NO: 4588013 - DNA, 18 bp, Homo sapiens
ttattattttaaaatata

SEQ ID NO: 4588014 - DNA, 14 bp, Homo sapiens
ttattattttgcaa

SEQ ID NO: 4588015 - DNA, 15 bp, Homo sapiens
ttattcaaaaaatca

SEQ ID NO: 4588016 - DNA, 20 bp, Homo sapiens
ttattcaaaaaatcatgttt

SEQ ID NO: 4588017 - DNA, 13 bp, Homo sapiens
ttattcaaagaga

SEQ ID NO: 4588018 - DNA, 15 bp, Homo sapiens
ttattcaaagagaaa

SEQ ID NO: 4588019 - DNA, 20 bp, Homo sapiens
ttattcaaagagaaaacatc

SEQ ID NO: 4588020 - DNA, 13 bp, Homo sapiens
ttattcaaatgaa

SEQ ID NO: 4588021 - DNA, 14 bp, Homo sapiens
ttattcaaatgaag

SEQ ID NO: 4588022 - DNA, 14 bp, Homo sapiens
ttattcagtgtcac

SEQ ID NO: 4588023 - DNA, 21 bp, Homo sapiens
ttattcataaaaaataatggt

SEQ ID NO: 4588024 - DNA, 20 bp, Homo sapiens
ttattccaaaccaaatttta

SEQ ID NO: 4588025 - DNA, 18 bp, Homo sapiens
ttattcccccaaactttt

SEQ ID NO: 4588026 - DNA, 21 bp, Homo sapiens
ttattccctgcccaaaccctt

SEQ ID NO: 4588027 - DNA, 14 bp, Homo sapiens
ttattcctagtctt

SEQ ID NO: 4588028 - DNA, 16 bp, Homo sapiens
ttattcctcctgctca

SEQ ID NO: 4588029 - DNA, 14 bp, Homo sapiens
ttattcctttcctt

SEQ ID NO: 4588030 - DNA, 17 bp, Homo sapiens
ttattcctttgaatatt

SEQ ID NO: 4588031 - DNA, 14 bp, Homo sapiens
ttattccttttaaa

SEQ ID NO: 4588032 - DNA, 15 bp, Homo sapiens
ttattctatctgttt

SEQ ID NO: 4588033 - DNA, 17 bp, Homo sapiens
ttattctcactccacca

SEQ ID NO: 4588034 - DNA, 17 bp, Homo sapiens
ttattctgtattaaata

SEQ ID NO: 4588035 - DNA, 21 bp, Homo sapiens
ttattgaatactgtctgtatc

SEQ ID NO: 4588036 - DNA, 17 bp, Homo sapiens
ttattgaattagaaaat

SEQ ID NO: 4588037 - DNA, 23 bp, Homo sapiens
ttattgacacagaaaatgttgag

SEQ ID NO: 4588038 - DNA, 13 bp, Homo sapiens
ttattgacactga

SEQ ID NO: 4588039 - DNA, 15 bp, Homo sapiens
ttattgacactgaac

SEQ ID NO: 4588040 - DNA, 17 bp, Homo sapiens
ttattgatattctaaga

SEQ ID NO: 4588041 - DNA, 21 bp, Homo sapiens
ttattgatattctaagaaata

SEQ ID NO: 4588042 - DNA, 22 bp, Homo sapiens
ttattgccttctcaccagctgc

SEQ ID NO: 4588043 - DNA, 21 bp, Homo sapiens
ttattgctcgcccagacacca

SEQ ID NO: 4588044 - DNA, 13 bp, Homo sapiens
ttattgctgattt

SEQ ID NO: 4588045 - DNA, 17 bp, Homo sapiens
ttattgctgattttaat

SEQ ID NO: 4588046 - DNA, 18 bp, Homo sapiens
ttattgctgattttaatg

SEQ ID NO: 4588047 - DNA, 12 bp, Homo sapiens
ttattgctgttg

SEQ ID NO: 4588048 - DNA, 17 bp, Homo sapiens
ttattgcttattgctta

SEQ ID NO: 4588049 - DNA, 13 bp, Homo sapiens
ttattgcttcatg

SEQ ID NO: 4588050 - DNA, 14 bp, Homo sapiens
ttattggcaaagtt

SEQ ID NO: 4588051 - DNA, 23 bp, Homo sapiens
ttattggcaaagtttaaatgtat

SEQ ID NO: 4588052 - DNA, 14 bp, Homo sapiens
ttattggctgagat

SEQ ID NO: 4588053 - DNA, 15 bp, Homo sapiens
ttattggctgagata

SEQ ID NO: 4588054 - DNA, 15 bp, Homo sapiens
ttattggcttgataa

SEQ ID NO: 4588055 - DNA, 22 bp, Homo sapiens
ttattggggaattaaatagtgt

SEQ ID NO: 4588056 - DNA, 12 bp, Homo sapiens
ttattgtaaatt

SEQ ID NO: 4588057 - DNA, 22 bp, Homo sapiens
ttattgtaagcatctcaatctt

SEQ ID NO: 4588058 - DNA, 18 bp, Homo sapiens
ttattgtagtttgaaagt

SEQ ID NO: 4588059 - DNA, 22 bp, Homo sapiens
ttattgtctgtctacatttctg

SEQ ID NO: 4588060 - DNA, 18 bp, Homo sapiens
ttattgtgacttcactgt

SEQ ID NO: 4588061 - DNA, 20 bp, Homo sapiens
ttattgtgacttcactgtat

SEQ ID NO: 4588062 - DNA, 17 bp, Homo sapiens
ttattgtttaaaatcat

SEQ ID NO: 4588063 - DNA, 14 bp, Homo sapiens
ttatttaaaactct

SEQ ID NO: 4588064 - DNA, 18 bp, Homo sapiens
ttatttaaaactctggtg

SEQ ID NO: 4588065 - DNA, 22 bp, Homo sapiens
ttatttaaaatagcaaaagaag

SEQ ID NO: 4588066 - DNA, 16 bp, Homo sapiens
ttatttaacaaaaaat

SEQ ID NO: 4588067 - DNA, 13 bp, Homo sapiens
ttatttaagaaat

SEQ ID NO: 4588068 - DNA, 12 bp, Homo sapiens
ttatttaagcat

SEQ ID NO: 4588069 - DNA, 19 bp, Homo sapiens
ttatttaagcataatctga

SEQ ID NO: 4588070 - DNA, 11 bp, Homo sapiens
ttatttacaag

SEQ ID NO: 4588071 - DNA, 18 bp, Homo sapiens
ttatttagacaagagatg

SEQ ID NO: 4588072 - DNA, 16 bp, Homo sapiens
ttatttatatcttgtt

SEQ ID NO: 4588073 - DNA, 16 bp, Homo sapiens
ttatttattaaacttc

SEQ ID NO: 4588074 - DNA, 15 bp, Homo sapiens
ttatttattattaat

SEQ ID NO: 4588075 - DNA, 15 bp, Homo sapiens
ttatttattttagca

SEQ ID NO: 4588076 - DNA, 16 bp, Homo sapiens
ttatttattttagcaa

SEQ ID NO: 4588077 - DNA, 23 bp, Homo sapiens
ttatttcaaaatatacattcaaa

SEQ ID NO: 4588078 - DNA, 16 bp, Homo sapiens
ttatttcaataaatct

SEQ ID NO: 4588079 - DNA, 15 bp, Homo sapiens
ttatttcaatgtaat

SEQ ID NO: 4588080 - DNA, 19 bp, Homo sapiens
ttatttcagattttgataa

SEQ ID NO: 4588081 - DNA, 14 bp, Homo sapiens
ttatttcatccagt

SEQ ID NO: 4588082 - DNA, 21 bp, Homo sapiens
ttatttcatcttttattcaag

SEQ ID NO: 4588083 - DNA, 14 bp, Homo sapiens
ttatttccccagcc

SEQ ID NO: 4588084 - DNA, 22 bp, Homo sapiens
ttatttctaatccttttcctta

SEQ ID NO: 4588085 - DNA, 16 bp, Homo sapiens
ttatttctccatcccc

SEQ ID NO: 4588086 - DNA, 19 bp, Homo sapiens
ttatttctgatttcataat

SEQ ID NO: 4588087 - DNA, 13 bp, Homo sapiens
ttatttctgcata

SEQ ID NO: 4588088 - DNA, 15 bp, Homo sapiens
ttatttctgcatatg

SEQ ID NO: 4588089 - DNA, 20 bp, Homo sapiens
ttatttctgcatatgttgaa

SEQ ID NO: 4588090 - DNA, 13 bp, Homo sapiens
ttatttctgtgaa

SEQ ID NO: 4588091 - DNA, 19 bp, Homo sapiens
ttatttctgtgaaagaagt

SEQ ID NO: 4588092 - DNA, 14 bp, Homo sapiens
ttatttcttccctg

SEQ ID NO: 4588093 - DNA, 19 bp, Homo sapiens
ttatttgactatgaatgtt

SEQ ID NO: 4588094 - DNA, 18 bp, Homo sapiens
ttatttggttcccttcct

SEQ ID NO: 4588095 - DNA, 12 bp, Homo sapiens
ttatttgtcaaa

SEQ ID NO: 4588096 - DNA, 15 bp, Homo sapiens
ttatttgtctgtaaa

SEQ ID NO: 4588097 - DNA, 16 bp, Homo sapiens
ttatttgtcttaaaaa

SEQ ID NO: 4588098 - DNA, 19 bp, Homo sapiens
ttatttgttctttttctga

SEQ ID NO: 4588099 - DNA, 14 bp, Homo sapiens
ttatttgtttgtct

SEQ ID NO: 4588100 - DNA, 21 bp, Homo sapiens
ttattttaaattataaggact

SEQ ID NO: 4588101 - DNA, 23 bp, Homo sapiens
ttattttagcaaatcagtatatt

SEQ ID NO: 4588102 - DNA, 12 bp, Homo sapiens
ttattttagcag

SEQ ID NO: 4588103 - DNA, 14 bp, Homo sapiens
ttattttagtgtgt

SEQ ID NO: 4588104 - DNA, 20 bp, Homo sapiens
ttattttataggggatactt

SEQ ID NO: 4588105 - DNA, 20 bp, Homo sapiens
ttattttatatcatacagtt

SEQ ID NO: 4588106 - DNA, 18 bp, Homo sapiens
ttattttattgaatactg

SEQ ID NO: 4588107 - DNA, 13 bp, Homo sapiens
ttattttcaagaa

SEQ ID NO: 4588108 - DNA, 13 bp, Homo sapiens
ttattttcattgt

SEQ ID NO: 4588109 - DNA, 23 bp, Homo sapiens
ttattttgagtcctaggacttaa

SEQ ID NO: 4588110 - DNA, 14 bp, Homo sapiens
ttatttttcctgtc

SEQ ID NO: 4588111 - DNA, 20 bp, Homo sapiens
ttatttttctcttgtaccat

SEQ ID NO: 4588112 - DNA, 21 bp, Homo sapiens
ttatttttctcttgtaccata

SEQ ID NO: 4588113 - DNA, 15 bp, Homo sapiens
ttatttttctgttac

SEQ ID NO: 4588114 - DNA, 14 bp, Homo sapiens
ttatttttcttgtc

SEQ ID NO: 4588115 - DNA, 21 bp, Homo sapiens
ttatttttgttagcaaagatt

SEQ ID NO: 4588116 - DNA, 14 bp, Homo sapiens
ttcaaaagtgatta

SEQ ID NO: 4588117 - DNA, 15 bp, Homo sapiens
ttcaaaataaaaagt

SEQ ID NO: 4588118 - DNA, 15 bp, Homo sapiens
ttcaaaataaaacat

SEQ ID NO: 4588119 - DNA, 13 bp, Homo sapiens
ttcaaaatagaca

SEQ ID NO: 4588120 - DNA, 14 bp, Homo sapiens
ttcaaaatattgag

SEQ ID NO: 4588121 - DNA, 22 bp, Homo sapiens
ttcaaaatatttaaaaatgtct

SEQ ID NO: 4588122 - DNA, 18 bp, Homo sapiens
ttcaaaatgatagacata

SEQ ID NO: 4588123 - DNA, 12 bp, Homo sapiens
ttcaaaatgctc

SEQ ID NO: 4588124 - DNA, 21 bp, Homo sapiens
ttcaaaccttggtatctgttg

SEQ ID NO: 4588125 - DNA, 22 bp, Homo sapiens
ttcaaactccaaggttcccttg

SEQ ID NO: 4588126 - DNA, 16 bp, Homo sapiens
ttcaaacttttgaaag

SEQ ID NO: 4588127 - DNA, 17 bp, Homo sapiens
ttcaaacttttgaaaga

SEQ ID NO: 4588128 - DNA, 23 bp, Homo sapiens
ttcaaagagaaaacatctcatca

SEQ ID NO: 4588129 - DNA, 21 bp, Homo sapiens
ttcaaagatgataatttagtg

SEQ ID NO: 4588130 - DNA, 23 bp, Homo sapiens
ttcaaagcatggacatttagaag

SEQ ID NO: 4588131 - DNA, 21 bp, Homo sapiens
ttcaaagccaagacctcacac

SEQ ID NO: 4588132 - DNA, 15 bp, Homo sapiens
ttcaaatacttttgg

SEQ ID NO: 4588133 - DNA, 13 bp, Homo sapiens
ttcaaatatttgt

SEQ ID NO: 4588134 - DNA, 18 bp, Homo sapiens
ttcaaatgaactttaaaa

SEQ ID NO: 4588135 - DNA, 18 bp, Homo sapiens
ttcaaatgtgcaatttgt

SEQ ID NO: 4588136 - DNA, 22 bp, Homo sapiens
ttcaaatgttagatattgctac

SEQ ID NO: 4588137 - DNA, 15 bp, Homo sapiens
ttcaaatgttttaaa

SEQ ID NO: 4588138 - DNA, 16 bp, Homo sapiens
ttcaaattcttctgaa

SEQ ID NO: 4588139 - DNA, 19 bp, Homo sapiens
ttcaaattcttctgaactc

SEQ ID NO: 4588140 - DNA, 15 bp, Homo sapiens
ttcaaattgctgctt

SEQ ID NO: 4588141 - DNA, 17 bp, Homo sapiens
ttcaaattgctgcttgg

SEQ ID NO: 4588142 - DNA, 21 bp, Homo sapiens
ttcaaattggtctgaaaggct

SEQ ID NO: 4588143 - DNA, 18 bp, Homo sapiens
ttcaacaattctaaaatg

SEQ ID NO: 4588144 - DNA, 19 bp, Homo sapiens
ttcaacaattctaaaatga

SEQ ID NO: 4588145 - DNA, 23 bp, Homo sapiens
ttcaacaattggtgtcattttct

SEQ ID NO: 4588146 - DNA, 15 bp, Homo sapiens
ttcaacagggaagaa

SEQ ID NO: 4588147 - DNA, 17 bp, Homo sapiens
ttcaacatgttatttgt

SEQ ID NO: 4588148 - DNA, 22 bp, Homo sapiens
ttcaacctggtggcaccagatg

SEQ ID NO: 4588149 - DNA, 13 bp, Homo sapiens
ttcaactttgaat

SEQ ID NO: 4588150 - DNA, 16 bp, Homo sapiens
ttcaactttgaataaa

SEQ ID NO: 4588151 - DNA, 19 bp, Homo sapiens
ttcaagaagtaatcagtat

SEQ ID NO: 4588152 - DNA, 16 bp, Homo sapiens
ttcaagcacactggaa

SEQ ID NO: 4588153 - DNA, 12 bp, Homo sapiens
ttcaagccctcc

SEQ ID NO: 4588154 - DNA, 23 bp, Homo sapiens
ttcaagccctcctccccagagct

SEQ ID NO: 4588155 - DNA, 15 bp, Homo sapiens
ttcaagcctctaaac

SEQ ID NO: 4588156 - DNA, 17 bp, Homo sapiens
ttcaagcctctaaacag

SEQ ID NO: 4588157 - DNA, 15 bp, Homo sapiens
ttcaagcctgtggga

SEQ ID NO: 4588158 - DNA, 23 bp, Homo sapiens
ttcaagctgttatttcttccctg

SEQ ID NO: 4588159 - DNA, 17 bp, Homo sapiens
ttcaaggaatttcttaa

SEQ ID NO: 4588160 - DNA, 19 bp, Homo sapiens
ttcaaggaatttcttaact

SEQ ID NO: 4588161 - DNA, 16 bp, Homo sapiens
ttcaaggactgtttca

SEQ ID NO: 4588162 - DNA, 22 bp, Homo sapiens
ttcaaggactgtttcagtgtga

SEQ ID NO: 4588163 - DNA, 23 bp, Homo sapiens
ttcaaggaggcccactgtgtcta

SEQ ID NO: 4588164 - DNA, 11 bp, Homo sapiens
ttcaagtgcct

SEQ ID NO: 4588165 - DNA, 12 bp, Homo sapiens
ttcaagtgccta

SEQ ID NO: 4588166 - DNA, 14 bp, Homo sapiens
ttcaagtgcctaga

SEQ ID NO: 4588167 - DNA, 18 bp, Homo sapiens
ttcaagtgcctagactgt

SEQ ID NO: 4588168 - DNA, 23 bp, Homo sapiens
ttcaagttccaagttgctaatac

SEQ ID NO: 4588169 - DNA, 22 bp, Homo sapiens
ttcaagttgtaaataatttatt

SEQ ID NO: 4588170 - DNA, 15 bp, Homo sapiens
ttcaagttttaaagt

SEQ ID NO: 4588171 - DNA, 18 bp, Homo sapiens
ttcaagttttaaagttca

SEQ ID NO: 4588172 - DNA, 16 bp, Homo sapiens
ttcaagtttttcatac

SEQ ID NO: 4588173 - DNA, 21 bp, Homo sapiens
ttcaataaaccacaagcatct

SEQ ID NO: 4588174 - DNA, 16 bp, Homo sapiens
ttcaatacacagtact

SEQ ID NO: 4588175 - DNA, 22 bp, Homo sapiens
ttcaatataagaagcaatcttt

SEQ ID NO: 4588176 - DNA, 11 bp, Homo sapiens
ttcaatatcag

SEQ ID NO: 4588177 - DNA, 12 bp, Homo sapiens
ttcaatatgcaa

SEQ ID NO: 4588178 - DNA, 11 bp, Homo sapiens
ttcaatatttt

SEQ ID NO: 4588179 - DNA, 16 bp, Homo sapiens
ttcaatattttctttt

SEQ ID NO: 4588180 - DNA, 16 bp, Homo sapiens
ttcaatcatttattca

SEQ ID NO: 4588181 - DNA, 15 bp, Homo sapiens
ttcaatctgtgaagc

SEQ ID NO: 4588182 - DNA, 18 bp, Homo sapiens
ttcaatcttctactttta

SEQ ID NO: 4588183 - DNA, 16 bp, Homo sapiens
ttcaatgtgactgaaa

SEQ ID NO: 4588184 - DNA, 21 bp, Homo sapiens
ttcaattacaaagcagttact

SEQ ID NO: 4588185 - DNA, 12 bp, Homo sapiens
ttcaattgtgaa

SEQ ID NO: 4588186 - DNA, 22 bp, Homo sapiens
ttcaatttggagcattaactaa

SEQ ID NO: 4588187 - DNA, 16 bp, Homo sapiens
ttcacaaaaaaatgtt

SEQ ID NO: 4588188 - DNA, 20 bp, Homo sapiens
ttcacaaaaaaatgttcatt

SEQ ID NO: 4588189 - DNA, 15 bp, Homo sapiens
ttcacaaacttttat

SEQ ID NO: 4588190 - DNA, 18 bp, Homo sapiens
ttcacaaatgtcattgtc

SEQ ID NO: 4588191 - DNA, 19 bp, Homo sapiens
ttcacaaatgtcattgtct

SEQ ID NO: 4588192 - DNA, 14 bp, Homo sapiens
ttcacaagcctcct

SEQ ID NO: 4588193 - DNA, 13 bp, Homo sapiens
ttcacaataaaag

SEQ ID NO: 4588194 - DNA, 14 bp, Homo sapiens
ttcacacagcccag

SEQ ID NO: 4588195 - DNA, 14 bp, Homo sapiens
ttcacagactgatt

SEQ ID NO: 4588196 - DNA, 23 bp, Homo sapiens
ttcacagtacccaaactgctttt

SEQ ID NO: 4588197 - DNA, 19 bp, Homo sapiens
ttcacatctaacctcatct

SEQ ID NO: 4588198 - DNA, 16 bp, Homo sapiens
ttcacattaggctgtt

SEQ ID NO: 4588199 - DNA, 18 bp, Homo sapiens
ttcacattaggctgttgg

SEQ ID NO: 4588200 - DNA, 15 bp, Homo sapiens
ttcacattcttggct

SEQ ID NO: 4588201 - DNA, 19 bp, Homo sapiens
ttcacattttccttttcaa

SEQ ID NO: 4588202 - DNA, 24 bp, Homo sapiens
ttcaccatttggcaatgccatcat

SEQ ID NO: 4588203 - DNA, 22 bp, Homo sapiens
ttcacccaccaggccagctcag

SEQ ID NO: 4588204 - DNA, 20 bp, Homo sapiens
ttcaccccatccctccttaa

SEQ ID NO: 4588205 - DNA, 20 bp, Homo sapiens
ttcacccctccctttctccc

SEQ ID NO: 4588206 - DNA, 16 bp, Homo sapiens
ttcaccctcatgaaaa

SEQ ID NO: 4588207 - DNA, 15 bp, Homo sapiens
ttcaccctgggcagt

SEQ ID NO: 4588208 - DNA, 11 bp, Homo sapiens
ttcacctgtaa

SEQ ID NO: 4588209 - DNA, 13 bp, Homo sapiens
ttcacctgtaaac

SEQ ID NO: 4588210 - DNA, 17 bp, Homo sapiens
ttcacctgtatatttct

SEQ ID NO: 4588211 - DNA, 20 bp, Homo sapiens
ttcactaaaagtctccaaaa

SEQ ID NO: 4588212 - DNA, 23 bp, Homo sapiens
ttcactagaagccgtgggaagaa

SEQ ID NO: 4588213 - DNA, 21 bp, Homo sapiens
ttcactatacaggctgggaag

SEQ ID NO: 4588214 - DNA, 21 bp, Homo sapiens
ttcactcatgcaaactgcttt

SEQ ID NO: 4588215 - DNA, 15 bp, Homo sapiens
ttcactgcaattttg

SEQ ID NO: 4588216 - DNA, 13 bp, Homo sapiens
ttcactgggccaa

SEQ ID NO: 4588217 - DNA, 17 bp, Homo sapiens
ttcactggttttacaca

SEQ ID NO: 4588218 - DNA, 11 bp, Homo sapiens
ttcactgtata

SEQ ID NO: 4588219 - DNA, 22 bp, Homo sapiens
ttcactgtatataaacatattt

SEQ ID NO: 4588220 - DNA, 17 bp, Homo sapiens
ttcacttctttgcagag

SEQ ID NO: 4588221 - DNA, 19 bp, Homo sapiens
ttcactttcttcaaagcca

SEQ ID NO: 4588222 - DNA, 20 bp, Homo sapiens
ttcacttttgacaaaggcaa

SEQ ID NO: 4588223 - DNA, 13 bp, Homo sapiens
ttcagaaaaccta

SEQ ID NO: 4588224 - DNA, 19 bp, Homo sapiens
ttcagaaaatgttctgttt

SEQ ID NO: 4588225 - DNA, 16 bp, Homo sapiens
ttcagaaatagctcct

SEQ ID NO: 4588226 - DNA, 13 bp, Homo sapiens
ttcagaacagagg

SEQ ID NO: 4588227 - DNA, 13 bp, Homo sapiens
ttcagaaggagaa

SEQ ID NO: 4588228 - DNA, 15 bp, Homo sapiens
ttcagaagttagttt

SEQ ID NO: 4588229 - DNA, 13 bp, Homo sapiens
ttcagaatattca

SEQ ID NO: 4588230 - DNA, 13 bp, Homo sapiens
ttcagaatctgaa

SEQ ID NO: 4588231 - DNA, 23 bp, Homo sapiens
ttcagaatctgaatgtaatttgt

SEQ ID NO: 4588232 - DNA, 13 bp, Homo sapiens
ttcagacacattt

SEQ ID NO: 4588233 - DNA, 15 bp, Homo sapiens
ttcagacacattttt

SEQ ID NO: 4588234 - DNA, 15 bp, Homo sapiens
ttcagacccctgcct

SEQ ID NO: 4588235 - DNA, 19 bp, Homo sapiens
ttcagactgcctgtctgct

SEQ ID NO: 4588236 - DNA, 23 bp, Homo sapiens
ttcagactgcctgtctgcttgca

SEQ ID NO: 4588237 - DNA, 14 bp, Homo sapiens
ttcagacttgtcaa

SEQ ID NO: 4588238 - DNA, 17 bp, Homo sapiens
ttcagagccagcctggc

SEQ ID NO: 4588239 - DNA, 12 bp, Homo sapiens
ttcagatataaa

SEQ ID NO: 4588240 - DNA, 22 bp, Homo sapiens
ttcagatataaaagactgacca

SEQ ID NO: 4588241 - DNA, 13 bp, Homo sapiens
ttcagatcttaat

SEQ ID NO: 4588242 - DNA, 19 bp, Homo sapiens
ttcagatcttaatataaat

SEQ ID NO: 4588243 - DNA, 14 bp, Homo sapiens
ttcagatgtaatgt

SEQ ID NO: 4588244 - DNA, 16 bp, Homo sapiens
ttcagatgtaatgttt

SEQ ID NO: 4588245 - DNA, 20 bp, Homo sapiens
ttcagatgtcttctgcctgt

SEQ ID NO: 4588246 - DNA, 12 bp, Homo sapiens
ttcagatttggc

SEQ ID NO: 4588247 - DNA, 22 bp, Homo sapiens
ttcagattttgataactgttta

SEQ ID NO: 4588248 - DNA, 21 bp, Homo sapiens
ttcagcaaccctacagtatat

SEQ ID NO: 4588249 - DNA, 19 bp, Homo sapiens
ttcagcaagttagaactag

SEQ ID NO: 4588250 - DNA, 22 bp, Homo sapiens
ttcagcacctacagtgtacagt

SEQ ID NO: 4588251 - DNA, 19 bp, Homo sapiens
ttcagcacttgtctcattt

SEQ ID NO: 4588252 - DNA, 23 bp, Homo sapiens
ttcagcagcaaaaccaaactggg

SEQ ID NO: 4588253 - DNA, 20 bp, Homo sapiens
ttcagcagcaaattttcagc

SEQ ID NO: 4588254 - DNA, 23 bp, Homo sapiens
ttcagcatccgcaggtgctggtc

SEQ ID NO: 4588255 - DNA, 16 bp, Homo sapiens
ttcagccaaagtccta

SEQ ID NO: 4588256 - DNA, 11 bp, Homo sapiens
ttcagccacat

SEQ ID NO: 4588257 - DNA, 17 bp, Homo sapiens
ttcagccacatgcccca

SEQ ID NO: 4588258 - DNA, 16 bp, Homo sapiens
ttcagccactaagaac

SEQ ID NO: 4588259 - DNA, 15 bp, Homo sapiens
ttcagccagcttaaa

SEQ ID NO: 4588260 - DNA, 21 bp, Homo sapiens
ttcagcccccatcacccaagc

SEQ ID NO: 4588261 - DNA, 16 bp, Homo sapiens
ttcagcccctcctctg

SEQ ID NO: 4588262 - DNA, 18 bp, Homo sapiens
ttcagcccctcctctgcc

SEQ ID NO: 4588263 - DNA, 19 bp, Homo sapiens
ttcagcccctcctctgcca

SEQ ID NO: 4588264 - DNA, 23 bp, Homo sapiens
ttcagcccctcctctgccacctc

SEQ ID NO: 4588265 - DNA, 12 bp, Homo sapiens
ttcagccctcac

SEQ ID NO: 4588266 - DNA, 16 bp, Homo sapiens
ttcagccctcacccct

SEQ ID NO: 4588267 - DNA, 12 bp, Homo sapiens
ttcagccttaat

SEQ ID NO: 4588268 - DNA, 14 bp, Homo sapiens
ttcagctagaattt

SEQ ID NO: 4588269 - DNA, 14 bp, Homo sapiens
ttcagctttgtgta

SEQ ID NO: 4588270 - DNA, 18 bp, Homo sapiens
ttcaggaaaattgaatgc

SEQ ID NO: 4588271 - DNA, 20 bp, Homo sapiens
ttcaggaacctcgagtactg

SEQ ID NO: 4588272 - DNA, 20 bp, Homo sapiens
ttcaggggactcagccctga

SEQ ID NO: 4588273 - DNA, 16 bp, Homo sapiens
ttcaggtaacactaca

SEQ ID NO: 4588274 - DNA, 21 bp, Homo sapiens
ttcaggtgtagtagttctgtg

SEQ ID NO: 4588275 - DNA, 23 bp, Homo sapiens
ttcagtaaagtggttctctgcct

SEQ ID NO: 4588276 - DNA, 14 bp, Homo sapiens
ttcagtactttttt

SEQ ID NO: 4588277 - DNA, 21 bp, Homo sapiens
ttcagtacttttttaaatatt

SEQ ID NO: 4588278 - DNA, 19 bp, Homo sapiens
ttcagtatttattgagcat

SEQ ID NO: 4588279 - DNA, 15 bp, Homo sapiens
ttcagtcattaaatt

SEQ ID NO: 4588280 - DNA, 20 bp, Homo sapiens
ttcagtcttggtaaaacatt

SEQ ID NO: 4588281 - DNA, 16 bp, Homo sapiens
ttcagtgagcccctcc

SEQ ID NO: 4588282 - DNA, 21 bp, Homo sapiens
ttcagtgagcccctccccagc

SEQ ID NO: 4588283 - DNA, 19 bp, Homo sapiens
ttcagtgatcttcactgta

SEQ ID NO: 4588284 - DNA, 14 bp, Homo sapiens
ttcagtgcccacca

SEQ ID NO: 4588285 - DNA, 22 bp, Homo sapiens
ttcagtgtcaaataaacactgt

SEQ ID NO: 4588286 - DNA, 21 bp, Homo sapiens
ttcagtgtcgggaattttccc

SEQ ID NO: 4588287 - DNA, 23 bp, Homo sapiens
ttcagtgtcgggaattttccccg

SEQ ID NO: 4588288 - DNA, 17 bp, Homo sapiens
ttcagtgtgagtcagaa

SEQ ID NO: 4588289 - DNA, 22 bp, Homo sapiens
ttcagtgttaaatgtgatgaat

SEQ ID NO: 4588290 - DNA, 12 bp, Homo sapiens
ttcagtgttccc

SEQ ID NO: 4588291 - DNA, 18 bp, Homo sapiens
ttcagtttctaaaattga

SEQ ID NO: 4588292 - DNA, 19 bp, Homo sapiens
ttcagtttctaaaattgag

SEQ ID NO: 4588293 - DNA, 19 bp, Homo sapiens
ttcagtttctatcaacctt

SEQ ID NO: 4588294 - DNA, 20 bp, Homo sapiens
ttcagtttctatcaaccttc

SEQ ID NO: 4588295 - DNA, 21 bp, Homo sapiens
ttcagttttcatttggttcat

SEQ ID NO: 4588296 - DNA, 19 bp, Homo sapiens
ttcagtttttattaatcta

SEQ ID NO: 4588297 - DNA, 19 bp, Homo sapiens
ttcataacttattgctgat

SEQ ID NO: 4588298 - DNA, 22 bp, Homo sapiens
ttcataataaattttctaaaag

SEQ ID NO: 4588299 - DNA, 13 bp, Homo sapiens
ttcataattcaga

SEQ ID NO: 4588300 - DNA, 18 bp, Homo sapiens
ttcataattctgaaacaa

SEQ ID NO: 4588301 - DNA, 22 bp, Homo sapiens
ttcatactgtaacattcaggaa

SEQ ID NO: 4588302 - DNA, 17 bp, Homo sapiens
ttcatactgtacacatt

SEQ ID NO: 4588303 - DNA, 18 bp, Homo sapiens
ttcatactgtacacattt

SEQ ID NO: 4588304 - DNA, 23 bp, Homo sapiens
ttcatactgtacacatttcttaa

SEQ ID NO: 4588305 - DNA, 18 bp, Homo sapiens
ttcatacttaaaaattta

SEQ ID NO: 4588306 - DNA, 21 bp, Homo sapiens
ttcatagtgacctgtgtttca

SEQ ID NO: 4588307 - DNA, 16 bp, Homo sapiens
ttcatagttcagaatt

SEQ ID NO: 4588308 - DNA, 19 bp, Homo sapiens
ttcatagttcagaatttag

SEQ ID NO: 4588309 - DNA, 17 bp, Homo sapiens
ttcatatacaaacatgt

SEQ ID NO: 4588310 - DNA, 15 bp, Homo sapiens
ttcatatcatccaca

SEQ ID NO: 4588311 - DNA, 22 bp, Homo sapiens
ttcatatgatacaccattatgt

SEQ ID NO: 4588312 - DNA, 19 bp, Homo sapiens
ttcatattaatataagttt

SEQ ID NO: 4588313 - DNA, 11 bp, Homo sapiens
ttcatattgat

SEQ ID NO: 4588314 - DNA, 14 bp, Homo sapiens
ttcatattggaaaa

SEQ ID NO: 4588315 - DNA, 18 bp, Homo sapiens
ttcatatttatactttgc

SEQ ID NO: 4588316 - DNA, 13 bp, Homo sapiens
ttcatatttctac

SEQ ID NO: 4588317 - DNA, 17 bp, Homo sapiens
ttcatcaagagtttatt

SEQ ID NO: 4588318 - DNA, 18 bp, Homo sapiens
ttcatcaagagtttatta

SEQ ID NO: 4588319 - DNA, 15 bp, Homo sapiens
ttcatcaatgaatga

SEQ ID NO: 4588320 - DNA, 15 bp, Homo sapiens
ttcatcagtaagcag

SEQ ID NO: 4588321 - DNA, 16 bp, Homo sapiens
ttcatcatttcagcca

SEQ ID NO: 4588322 - DNA, 15 bp, Homo sapiens
ttcatcatttgcaca

SEQ ID NO: 4588323 - DNA, 19 bp, Homo sapiens
ttcatcccgtatcacagtg

SEQ ID NO: 4588324 - DNA, 14 bp, Homo sapiens
ttcatctaaatgaa

SEQ ID NO: 4588325 - DNA, 16 bp, Homo sapiens
ttcatctaaatgaaag

SEQ ID NO: 4588326 - DNA, 16 bp, Homo sapiens
ttcatctaccttttct

SEQ ID NO: 4588327 - DNA, 19 bp, Homo sapiens
ttcatctaccttttctggc

SEQ ID NO: 4588328 - DNA, 12 bp, Homo sapiens
ttcatctcaagg

SEQ ID NO: 4588329 - DNA, 19 bp, Homo sapiens
ttcatctgctctccttcct

SEQ ID NO: 4588330 - DNA, 11 bp, Homo sapiens
ttcatctgtgg

SEQ ID NO: 4588331 - DNA, 16 bp, Homo sapiens
ttcatctgtgggatgc

SEQ ID NO: 4588332 - DNA, 13 bp, Homo sapiens
ttcatcttaaact

SEQ ID NO: 4588333 - DNA, 22 bp, Homo sapiens
ttcatgaaaaagctgcttctta

SEQ ID NO: 4588334 - DNA, 14 bp, Homo sapiens
ttcatgaaaatgta

SEQ ID NO: 4588335 - DNA, 15 bp, Homo sapiens
ttcatgacagcctcc

SEQ ID NO: 4588336 - DNA, 16 bp, Homo sapiens
ttcatgacagcctcca

SEQ ID NO: 4588337 - DNA, 15 bp, Homo sapiens
ttcatgataatgaac

SEQ ID NO: 4588338 - DNA, 23 bp, Homo sapiens
ttcatgatagaaagaataaaatg

SEQ ID NO: 4588339 - DNA, 14 bp, Homo sapiens
ttcatgatgcagtc

SEQ ID NO: 4588340 - DNA, 14 bp, Homo sapiens
ttcatgctctgcaa

SEQ ID NO: 4588341 - DNA, 17 bp, Homo sapiens
ttcatgctgaggtgatt

SEQ ID NO: 4588342 - DNA, 16 bp, Homo sapiens
ttcatgcttgacatac

SEQ ID NO: 4588343 - DNA, 22 bp, Homo sapiens
ttcatggcaatgaaaattttaa

SEQ ID NO: 4588344 - DNA, 21 bp, Homo sapiens
ttcatggcatgcttaaatttt

SEQ ID NO: 4588345 - DNA, 22 bp, Homo sapiens
ttcatggtttgcatttaaacat

SEQ ID NO: 4588346 - DNA, 17 bp, Homo sapiens
ttcatgtaaactgtgca

SEQ ID NO: 4588347 - DNA, 15 bp, Homo sapiens
ttcatgtacagaggt

SEQ ID NO: 4588348 - DNA, 16 bp, Homo sapiens
ttcatgtcttgtcata

SEQ ID NO: 4588349 - DNA, 18 bp, Homo sapiens
ttcatgttagttacctta

SEQ ID NO: 4588350 - DNA, 16 bp, Homo sapiens
ttcattacttgaatgt

SEQ ID NO: 4588351 - DNA, 14 bp, Homo sapiens
ttcattatctcaaa

SEQ ID NO: 4588352 - DNA, 13 bp, Homo sapiens
ttcattattctct

SEQ ID NO: 4588353 - DNA, 15 bp, Homo sapiens
ttcattatttgtcaa

SEQ ID NO: 4588354 - DNA, 9 bp, Homo sapiens
ttcattcag

SEQ ID NO: 4588355 - DNA, 16 bp, Homo sapiens
ttcattcatacttaaa

SEQ ID NO: 4588356 - DNA, 21 bp, Homo sapiens
ttcattccttcagatttggct

SEQ ID NO: 4588357 - DNA, 22 bp, Homo sapiens
ttcattcggtgtgaacttttct

SEQ ID NO: 4588358 - DNA, 23 bp, Homo sapiens
ttcattctcataattcctacagc

SEQ ID NO: 4588359 - DNA, 14 bp, Homo sapiens
ttcattctctttta

SEQ ID NO: 4588360 - DNA, 13 bp, Homo sapiens
ttcattctgccaa

SEQ ID NO: 4588361 - DNA, 15 bp, Homo sapiens
ttcattctgccaaag

SEQ ID NO: 4588362 - DNA, 17 bp, Homo sapiens
ttcattctgccaaagta

SEQ ID NO: 4588363 - DNA, 19 bp, Homo sapiens
ttcattctgctacttcact

SEQ ID NO: 4588364 - DNA, 19 bp, Homo sapiens
ttcattgtagattttgtta

SEQ ID NO: 4588365 - DNA, 18 bp, Homo sapiens
ttcatttatctataattt

SEQ ID NO: 4588366 - DNA, 13 bp, Homo sapiens
ttcatttcttatc

SEQ ID NO: 4588367 - DNA, 16 bp, Homo sapiens
ttcattttaactggca

SEQ ID NO: 4588368 - DNA, 14 bp, Homo sapiens
ttcattttctagat

SEQ ID NO: 4588369 - DNA, 18 bp, Homo sapiens
ttcatttttttccaggct

SEQ ID NO: 4588370 - DNA, 19 bp, Homo sapiens
ttccaaaataatctatatt

SEQ ID NO: 4588371 - DNA, 16 bp, Homo sapiens
ttccaaaatctcccat

SEQ ID NO: 4588372 - DNA, 22 bp, Homo sapiens
ttccaaagagtagaattgcatt

SEQ ID NO: 4588373 - DNA, 22 bp, Homo sapiens
ttccaaagctttattaccagtg

SEQ ID NO: 4588374 - DNA, 19 bp, Homo sapiens
ttccaaattatttcttaat

SEQ ID NO: 4588375 - DNA, 14 bp, Homo sapiens
ttccaaattcagtt

SEQ ID NO: 4588376 - DNA, 15 bp, Homo sapiens
ttccaaattcagttt

SEQ ID NO: 4588377 - DNA, 13 bp, Homo sapiens
ttccaaattcatg

SEQ ID NO: 4588378 - DNA, 18 bp, Homo sapiens
ttccaactactaatagaa

SEQ ID NO: 4588379 - DNA, 21 bp, Homo sapiens
ttccaagacatgtctgttcta

SEQ ID NO: 4588380 - DNA, 15 bp, Homo sapiens
ttccaagctccaaat

SEQ ID NO: 4588381 - DNA, 19 bp, Homo sapiens
ttccaagctccaaatccaa

SEQ ID NO: 4588382 - DNA, 13 bp, Homo sapiens
ttccaatatttct

SEQ ID NO: 4588383 - DNA, 21 bp, Homo sapiens
ttccaattctatcttttgttt

SEQ ID NO: 4588384 - DNA, 11 bp, Homo sapiens
ttccacaaacc

SEQ ID NO: 4588385 - DNA, 16 bp, Homo sapiens
ttccacaaagaaaatt

SEQ ID NO: 4588386 - DNA, 22 bp, Homo sapiens
ttccacaagtgccgcaaattgt

SEQ ID NO: 4588387 - DNA, 18 bp, Homo sapiens
ttccacaccaagcagcaa

SEQ ID NO: 4588388 - DNA, 19 bp, Homo sapiens
ttccacactccttgtcaac

SEQ ID NO: 4588389 - DNA, 21 bp, Homo sapiens
ttccacagatttttttgtaag

SEQ ID NO: 4588390 - DNA, 15 bp, Homo sapiens
ttccacagcagtgtc

SEQ ID NO: 4588391 - DNA, 13 bp, Homo sapiens
ttccacagctggc

SEQ ID NO: 4588392 - DNA, 16 bp, Homo sapiens
ttccacagctggcctg

SEQ ID NO: 4588393 - DNA, 13 bp, Homo sapiens
ttccacataaatt

SEQ ID NO: 4588394 - DNA, 17 bp, Homo sapiens
ttccaccaaatgtgctt

SEQ ID NO: 4588395 - DNA, 14 bp, Homo sapiens
ttccaccaggccgt

SEQ ID NO: 4588396 - DNA, 15 bp, Homo sapiens
ttccaccaggccgtg

SEQ ID NO: 4588397 - DNA, 13 bp, Homo sapiens
ttccacccgtctc

SEQ ID NO: 4588398 - DNA, 14 bp, Homo sapiens
ttccacctgccaca

SEQ ID NO: 4588399 - DNA, 21 bp, Homo sapiens
ttccacctggaaactgctcag

SEQ ID NO: 4588400 - DNA, 15 bp, Homo sapiens
ttccacggagccact

SEQ ID NO: 4588401 - DNA, 24 bp, Homo sapiens
ttccacggagccactcctctgact

SEQ ID NO: 4588402 - DNA, 14 bp, Homo sapiens
ttccactaaaaata

SEQ ID NO: 4588403 - DNA, 12 bp, Homo sapiens
ttccactaaccc

SEQ ID NO: 4588404 - DNA, 16 bp, Homo sapiens
ttccactacacctggc

SEQ ID NO: 4588405 - DNA, 16 bp, Homo sapiens
ttccactccattgtcg

SEQ ID NO: 4588406 - DNA, 16 bp, Homo sapiens
ttccactccttccaga

SEQ ID NO: 4588407 - DNA, 15 bp, Homo sapiens
ttccactgagggcag

SEQ ID NO: 4588408 - DNA, 16 bp, Homo sapiens
ttccactgagggcagt

SEQ ID NO: 4588409 - DNA, 23 bp, Homo sapiens
ttccactggcttttgcctgtaag

SEQ ID NO: 4588410 - DNA, 14 bp, Homo sapiens
ttccagaacagccc

SEQ ID NO: 4588411 - DNA, 22 bp, Homo sapiens
ttccagaacagccctcggcctc

SEQ ID NO: 4588412 - DNA, 20 bp, Homo sapiens
ttccagaagtgtgactggct

SEQ ID NO: 4588413 - DNA, 14 bp, Homo sapiens
ttccagaatgctgt

SEQ ID NO: 4588414 - DNA, 15 bp, Homo sapiens
ttccagaatgctgta

SEQ ID NO: 4588415 - DNA, 16 bp, Homo sapiens
ttccagaatgctgtac

SEQ ID NO: 4588416 - DNA, 19 bp, Homo sapiens
ttccagaatgctgtacatc

SEQ ID NO: 4588417 - DNA, 18 bp, Homo sapiens
ttccagactcaggttcca

SEQ ID NO: 4588418 - DNA, 15 bp, Homo sapiens
ttccagacttcaaaa

SEQ ID NO: 4588419 - DNA, 16 bp, Homo sapiens
ttccagatcctctctg

SEQ ID NO: 4588420 - DNA, 17 bp, Homo sapiens
ttccagatgcccgagca

SEQ ID NO: 4588421 - DNA, 20 bp, Homo sapiens
ttccagattttaaattttat

SEQ ID NO: 4588422 - DNA, 22 bp, Homo sapiens
ttccagattttaaattttatgt

SEQ ID NO: 4588423 - DNA, 15 bp, Homo sapiens
ttccagccaaagcat

SEQ ID NO: 4588424 - DNA, 18 bp, Homo sapiens
ttccagccttatgtgtta

SEQ ID NO: 4588425 - DNA, 20 bp, Homo sapiens
ttccagctcaccccccacac

SEQ ID NO: 4588426 - DNA, 24 bp, Homo sapiens
ttccaggaaactccacatctgcct

SEQ ID NO: 4588427 - DNA, 15 bp, Homo sapiens
ttccaggctgagagc

SEQ ID NO: 4588428 - DNA, 19 bp, Homo sapiens
ttccaggcttccctgactt

SEQ ID NO: 4588429 - DNA, 17 bp, Homo sapiens
ttccaggtctgcctggt

SEQ ID NO: 4588430 - DNA, 15 bp, Homo sapiens
ttccaggtttaagta

SEQ ID NO: 4588431 - DNA, 21 bp, Homo sapiens
ttccagtaaggaatgatattg

SEQ ID NO: 4588432 - DNA, 18 bp, Homo sapiens
ttccagtcctaactttct

SEQ ID NO: 4588433 - DNA, 17 bp, Homo sapiens
ttccagtcttcctgaca

SEQ ID NO: 4588434 - DNA, 18 bp, Homo sapiens
ttccagtggatcataaga

SEQ ID NO: 4588435 - DNA, 15 bp, Homo sapiens
ttccatagtcaatga

SEQ ID NO: 4588436 - DNA, 16 bp, Homo sapiens
ttccatatgctccagg

SEQ ID NO: 4588437 - DNA, 20 bp, Homo sapiens
ttccatcataattctaatct

SEQ ID NO: 4588438 - DNA, 15 bp, Homo sapiens
ttccatcatcactgt

SEQ ID NO: 4588439 - DNA, 16 bp, Homo sapiens
ttccatcatcactgta

SEQ ID NO: 4588440 - DNA, 17 bp, Homo sapiens
ttccatcatcactgtaa

SEQ ID NO: 4588441 - DNA, 19 bp, Homo sapiens
ttccatcatcactgtaaag

SEQ ID NO: 4588442 - DNA, 21 bp, Homo sapiens
ttccatcatcactgtaaagac

SEQ ID NO: 4588443 - DNA, 15 bp, Homo sapiens
ttccatccctacccc

SEQ ID NO: 4588444 - DNA, 15 bp, Homo sapiens
ttccatctcttcctt

SEQ ID NO: 4588445 - DNA, 16 bp, Homo sapiens
ttccatgaaggcagag

SEQ ID NO: 4588446 - DNA, 21 bp, Homo sapiens
ttccatgcgtgtttctgactc

SEQ ID NO: 4588447 - DNA, 17 bp, Homo sapiens
ttccatgtgcctttctt

SEQ ID NO: 4588448 - DNA, 20 bp, Homo sapiens
ttccatgtgcctttctttgc

SEQ ID NO: 4588449 - DNA, 22 bp, Homo sapiens
ttccatgtgcctttctttgcct

SEQ ID NO: 4588450 - DNA, 13 bp, Homo sapiens
ttccattatgaaa

SEQ ID NO: 4588451 - DNA, 23 bp, Homo sapiens
ttcccaaaacaatctatttaaaa

SEQ ID NO: 4588452 - DNA, 22 bp, Homo sapiens
ttcccaaaatgttgaaatatga

SEQ ID NO: 4588453 - DNA, 21 bp, Homo sapiens
ttcccaagaaaggaaaccttt

SEQ ID NO: 4588454 - DNA, 21 bp, Homo sapiens
ttcccaatagcactttcattg

SEQ ID NO: 4588455 - DNA, 21 bp, Homo sapiens
ttcccacaggagggccagcgc

SEQ ID NO: 4588456 - DNA, 15 bp, Homo sapiens
ttcccactgtttaag

SEQ ID NO: 4588457 - DNA, 22 bp, Homo sapiens
ttcccagagtcagaggagaaga

SEQ ID NO: 4588458 - DNA, 22 bp, Homo sapiens
ttcccagcactatgctttcctt

SEQ ID NO: 4588459 - DNA, 18 bp, Homo sapiens
ttcccagctctccctctg

SEQ ID NO: 4588460 - DNA, 19 bp, Homo sapiens
ttcccagctctccctctgg

SEQ ID NO: 4588461 - DNA, 13 bp, Homo sapiens
ttcccagggacct

SEQ ID NO: 4588462 - DNA, 17 bp, Homo sapiens
ttcccagggaccttgga

SEQ ID NO: 4588463 - DNA, 23 bp, Homo sapiens
ttcccagggtagcccgcctgcca

SEQ ID NO: 4588464 - DNA, 20 bp, Homo sapiens
ttcccaggtaatttaaattg

SEQ ID NO: 4588465 - DNA, 12 bp, Homo sapiens
ttcccaggtgct

SEQ ID NO: 4588466 - DNA, 19 bp, Homo sapiens
ttcccagtaaccctaagga

SEQ ID NO: 4588467 - DNA, 15 bp, Homo sapiens
ttcccagtctgtcga

SEQ ID NO: 4588468 - DNA, 14 bp, Homo sapiens
ttcccatcaccaga

SEQ ID NO: 4588469 - DNA, 12 bp, Homo sapiens
ttcccatctgca

SEQ ID NO: 4588470 - DNA, 16 bp, Homo sapiens
ttccccaaaccataaa

SEQ ID NO: 4588471 - DNA, 17 bp, Homo sapiens
ttccccaataaagcctt

SEQ ID NO: 4588472 - DNA, 23 bp, Homo sapiens
ttccccacccccctctctttctc

SEQ ID NO: 4588473 - DNA, 12 bp, Homo sapiens
ttccccagagag

SEQ ID NO: 4588474 - DNA, 18 bp, Homo sapiens
ttccccatcttctaaacc

SEQ ID NO: 4588475 - DNA, 23 bp, Homo sapiens
ttcccccaaactttttgttcatg

SEQ ID NO: 4588476 - DNA, 14 bp, Homo sapiens
ttcccccatcccta

SEQ ID NO: 4588477 - DNA, 15 bp, Homo sapiens
ttcccccatccctac

SEQ ID NO: 4588478 - DNA, 17 bp, Homo sapiens
ttcccccatccctacca

SEQ ID NO: 4588479 - DNA, 18 bp, Homo sapiens
ttcccccatccctaccac

SEQ ID NO: 4588480 - DNA, 12 bp, Homo sapiens
ttccccccactc

SEQ ID NO: 4588481 - DNA, 21 bp, Homo sapiens
ttccccccactctccccacac

SEQ ID NO: 4588482 - DNA, 19 bp, Homo sapiens
ttccccgatgtcccctgcg

SEQ ID NO: 4588483 - DNA, 22 bp, Homo sapiens
ttccccgtgcatgatttactct

SEQ ID NO: 4588484 - DNA, 13 bp, Homo sapiens
ttcccctccacca

SEQ ID NO: 4588485 - DNA, 18 bp, Homo sapiens
ttcccctcttaaatgaga

SEQ ID NO: 4588486 - DNA, 17 bp, Homo sapiens
ttcccctcttttgtctt

SEQ ID NO: 4588487 - DNA, 12 bp, Homo sapiens
ttcccctgctga

SEQ ID NO: 4588488 - DNA, 13 bp, Homo sapiens
ttccccttccctt

SEQ ID NO: 4588489 - DNA, 19 bp, Homo sapiens
ttccccttctgtgtcacag

SEQ ID NO: 4588490 - DNA, 19 bp, Homo sapiens
ttcccggcccccggccaag

SEQ ID NO: 4588491 - DNA, 17 bp, Homo sapiens
ttcccgggagctgggcc

SEQ ID NO: 4588492 - DNA, 18 bp, Homo sapiens
ttcccgggagctgggccc

SEQ ID NO: 4588493 - DNA, 22 bp, Homo sapiens
ttcccgggagctgggccctgcc

SEQ ID NO: 4588494 - DNA, 14 bp, Homo sapiens
ttcccgtgcctggg

SEQ ID NO: 4588495 - DNA, 12 bp, Homo sapiens
ttccctcacccc

SEQ ID NO: 4588496 - DNA, 20 bp, Homo sapiens
ttccctccatttttctccca

SEQ ID NO: 4588497 - DNA, 19 bp, Homo sapiens
ttccctcctagctctccca

SEQ ID NO: 4588498 - DNA, 21 bp, Homo sapiens
ttccctcctagctctcccagt

SEQ ID NO: 4588499 - DNA, 17 bp, Homo sapiens
ttccctctctccctgcc

SEQ ID NO: 4588500 - DNA, 20 bp, Homo sapiens
ttccctctctccctgcctca

SEQ ID NO: 4588501 - DNA, 20 bp, Homo sapiens
ttccctctgggcacgcctgc

SEQ ID NO: 4588502 - DNA, 16 bp, Homo sapiens
ttccctgactcattct

SEQ ID NO: 4588503 - DNA, 17 bp, Homo sapiens
ttccctgacttgcttta

SEQ ID NO: 4588504 - DNA, 18 bp, Homo sapiens
ttccctgagtcaccagga

SEQ ID NO: 4588505 - DNA, 11 bp, Homo sapiens
ttccctgcaca

SEQ ID NO: 4588506 - DNA, 13 bp, Homo sapiens
ttccctgcacaca

SEQ ID NO: 4588507 - DNA, 23 bp, Homo sapiens
ttccctgcagacctcaagccatc

SEQ ID NO: 4588508 - DNA, 17 bp, Homo sapiens
ttccctgcccaaaccct

SEQ ID NO: 4588509 - DNA, 14 bp, Homo sapiens
ttccctgcttccag

SEQ ID NO: 4588510 - DNA, 16 bp, Homo sapiens
ttccctgcttccagga

SEQ ID NO: 4588511 - DNA, 18 bp, Homo sapiens
ttccctgctttgcatctt

SEQ ID NO: 4588512 - DNA, 21 bp, Homo sapiens
ttccctgctttgcatctttgt

SEQ ID NO: 4588513 - DNA, 15 bp, Homo sapiens
ttccctggagaaaaa

SEQ ID NO: 4588514 - DNA, 23 bp, Homo sapiens
ttccctgggctgccaccagcccc

SEQ ID NO: 4588515 - DNA, 15 bp, Homo sapiens
ttcccttagcctctc

SEQ ID NO: 4588516 - DNA, 18 bp, Homo sapiens
ttcccttagcctctccca

SEQ ID NO: 4588517 - DNA, 15 bp, Homo sapiens
ttcccttattcctaa

SEQ ID NO: 4588518 - DNA, 15 bp, Homo sapiens
ttcccttgaaattta

SEQ ID NO: 4588519 - DNA, 20 bp, Homo sapiens
ttcccttgaccattggctgc

SEQ ID NO: 4588520 - DNA, 11 bp, Homo sapiens
ttcccttggcc

SEQ ID NO: 4588521 - DNA, 17 bp, Homo sapiens
ttcccttgggctggaga

SEQ ID NO: 4588522 - DNA, 14 bp, Homo sapiens
ttccgaatctcttt

SEQ ID NO: 4588523 - DNA, 16 bp, Homo sapiens
ttccgggaactggagt

SEQ ID NO: 4588524 - DNA, 15 bp, Homo sapiens
ttccgtgagacacaa

SEQ ID NO: 4588525 - DNA, 20 bp, Homo sapiens
ttccgtggtcagagtgccac

SEQ ID NO: 4588526 - DNA, 13 bp, Homo sapiens
ttcctaaaatgct

SEQ ID NO: 4588527 - DNA, 13 bp, Homo sapiens
ttcctaagacatt

SEQ ID NO: 4588528 - DNA, 20 bp, Homo sapiens
ttcctaagacatttttcatt

SEQ ID NO: 4588529 - DNA, 15 bp, Homo sapiens
ttcctacagcactac

SEQ ID NO: 4588530 - DNA, 13 bp, Homo sapiens
ttcctacaggcag

SEQ ID NO: 4588531 - DNA, 21 bp, Homo sapiens
ttcctacaggcctatttaaca

SEQ ID NO: 4588532 - DNA, 20 bp, Homo sapiens
ttcctacccacacctctgcc

SEQ ID NO: 4588533 - DNA, 21 bp, Homo sapiens
ttcctacccacacctctgcca

SEQ ID NO: 4588534 - DNA, 19 bp, Homo sapiens
ttcctagagaagacaggct

SEQ ID NO: 4588535 - DNA, 19 bp, Homo sapiens
ttcctagattacatctgcc

SEQ ID NO: 4588536 - DNA, 13 bp, Homo sapiens
ttcctagcactgc

SEQ ID NO: 4588537 - DNA, 19 bp, Homo sapiens
ttcctagctgttctaatta

SEQ ID NO: 4588538 - DNA, 12 bp, Homo sapiens
ttcctagtgaaa

SEQ ID NO: 4588539 - DNA, 13 bp, Homo sapiens
ttcctatcacctc

SEQ ID NO: 4588540 - DNA, 15 bp, Homo sapiens
ttcctatgactaatt

SEQ ID NO: 4588541 - DNA, 19 bp, Homo sapiens
ttcctcaaaaagcagaagg

SEQ ID NO: 4588542 - DNA, 21 bp, Homo sapiens
ttcctcaaaataaagaagtat

SEQ ID NO: 4588543 - DNA, 20 bp, Homo sapiens
ttcctcaaatcagtgataat

SEQ ID NO: 4588544 - DNA, 14 bp, Homo sapiens
ttcctcaaattttt

SEQ ID NO: 4588545 - DNA, 21 bp, Homo sapiens
ttcctcaacagtgttttcaga

SEQ ID NO: 4588546 - DNA, 22 bp, Homo sapiens
ttcctcaacagtgttttcagaa

SEQ ID NO: 4588547 - DNA, 10 bp, Homo sapiens
ttcctcacca

SEQ ID NO: 4588548 - DNA, 23 bp, Homo sapiens
ttcctcaccagtcccatgctggc

SEQ ID NO: 4588549 - DNA, 21 bp, Homo sapiens
ttcctcagctctaggctgttc

SEQ ID NO: 4588550 - DNA, 15 bp, Homo sapiens
ttcctcagctgcctc

SEQ ID NO: 4588551 - DNA, 21 bp, Homo sapiens
ttcctcagctgtacaaatcct

SEQ ID NO: 4588552 - DNA, 21 bp, Homo sapiens
ttcctcatctatggttctaaa

SEQ ID NO: 4588553 - DNA, 23 bp, Homo sapiens
ttcctcatctatggttctaaata

SEQ ID NO: 4588554 - DNA, 20 bp, Homo sapiens
ttcctcattaatagctgcct

SEQ ID NO: 4588555 - DNA, 18 bp, Homo sapiens
ttcctcattgatgttaag

SEQ ID NO: 4588556 - DNA, 13 bp, Homo sapiens
ttcctcctcaggc

SEQ ID NO: 4588557 - DNA, 14 bp, Homo sapiens
ttcctcctgcagac

SEQ ID NO: 4588558 - DNA, 13 bp, Homo sapiens
ttcctcctgctca

SEQ ID NO: 4588559 - DNA, 15 bp, Homo sapiens
ttcctcctgctcata

SEQ ID NO: 4588560 - DNA, 15 bp, Homo sapiens
ttcctcgagaggcac

SEQ ID NO: 4588561 - DNA, 21 bp, Homo sapiens
ttcctctaggggctgtacagt

SEQ ID NO: 4588562 - DNA, 17 bp, Homo sapiens
ttcctctattgatgtac

SEQ ID NO: 4588563 - DNA, 23 bp, Homo sapiens
ttcctctattgatgtacagtctg

SEQ ID NO: 4588564 - DNA, 21 bp, Homo sapiens
ttcctctcaaattcagctctg

SEQ ID NO: 4588565 - DNA, 22 bp, Homo sapiens
ttcctctcaaattcagctctga

SEQ ID NO: 4588566 - DNA, 18 bp, Homo sapiens
ttcctctcaagctagcca

SEQ ID NO: 4588567 - DNA, 20 bp, Homo sapiens
ttcctctgcccttcctgcag

SEQ ID NO: 4588568 - DNA, 13 bp, Homo sapiens
ttcctctgcctgc

SEQ ID NO: 4588569 - DNA, 17 bp, Homo sapiens
ttcctctgtacagcaag

SEQ ID NO: 4588570 - DNA, 21 bp, Homo sapiens
ttcctctgtacagcaagatgt

SEQ ID NO: 4588571 - DNA, 13 bp, Homo sapiens
ttcctgaagctgc

SEQ ID NO: 4588572 - DNA, 18 bp, Homo sapiens
ttcctgaagctgctgtgt

SEQ ID NO: 4588573 - DNA, 13 bp, Homo sapiens
ttcctgaatccaa

SEQ ID NO: 4588574 - DNA, 20 bp, Homo sapiens
ttcctgaattctatttgctg

SEQ ID NO: 4588575 - DNA, 23 bp, Homo sapiens
ttcctgacactcaataaacagtc

SEQ ID NO: 4588576 - DNA, 22 bp, Homo sapiens
ttcctgacactttaattaccaa

SEQ ID NO: 4588577 - DNA, 23 bp, Homo sapiens
ttcctgacagatgcctggtgagc

SEQ ID NO: 4588578 - DNA, 23 bp, Homo sapiens
ttcctgattaccagtctgattat

SEQ ID NO: 4588579 - DNA, 21 bp, Homo sapiens
ttcctgcaggcaggaacaaac

SEQ ID NO: 4588580 - DNA, 15 bp, Homo sapiens
ttcctgccctgtcca

SEQ ID NO: 4588581 - DNA, 16 bp, Homo sapiens
ttcctgccctgtccaa

SEQ ID NO: 4588582 - DNA, 15 bp, Homo sapiens
ttcctgcgtcctcct

SEQ ID NO: 4588583 - DNA, 16 bp, Homo sapiens
ttcctgcgtcctcctc

SEQ ID NO: 4588584 - DNA, 17 bp, Homo sapiens
ttcctgctgctgctact

SEQ ID NO: 4588585 - DNA, 18 bp, Homo sapiens
ttcctgctgctgctactg

SEQ ID NO: 4588586 - DNA, 21 bp, Homo sapiens
ttcctggacatcaccagtcct

SEQ ID NO: 4588587 - DNA, 20 bp, Homo sapiens
ttcctggcacattgcccctc

SEQ ID NO: 4588588 - DNA, 23 bp, Homo sapiens
ttcctggcacattgcccctctgc

SEQ ID NO: 4588589 - DNA, 13 bp, Homo sapiens
ttcctggcagctg

SEQ ID NO: 4588590 - DNA, 15 bp, Homo sapiens
ttcctggcagctgct

SEQ ID NO: 4588591 - DNA, 15 bp, Homo sapiens
ttcctggccctccac

SEQ ID NO: 4588592 - DNA, 16 bp, Homo sapiens
ttcctggccctccact

SEQ ID NO: 4588593 - DNA, 21 bp, Homo sapiens
ttcctgggaaatattccctag

SEQ ID NO: 4588594 - DNA, 22 bp, Homo sapiens
ttcctgggaggacaggcaggcc

SEQ ID NO: 4588595 - DNA, 17 bp, Homo sapiens
ttcctgggcctttgcaa

SEQ ID NO: 4588596 - DNA, 19 bp, Homo sapiens
ttcctggtgccaatttcaa

SEQ ID NO: 4588597 - DNA, 15 bp, Homo sapiens
ttcctggtgctcttt

SEQ ID NO: 4588598 - DNA, 22 bp, Homo sapiens
ttcctgtaatatatttatatac

SEQ ID NO: 4588599 - DNA, 20 bp, Homo sapiens
ttcctgtctagtctctcctg

SEQ ID NO: 4588600 - DNA, 24 bp, Homo sapiens
ttcctgtgaagtttaattgtctca

SEQ ID NO: 4588601 - DNA, 19 bp, Homo sapiens
ttcctgtgtaaaaacaaca

SEQ ID NO: 4588602 - DNA, 16 bp, Homo sapiens
ttcctgtgtaacatct

SEQ ID NO: 4588603 - DNA, 20 bp, Homo sapiens
ttcctgtgtaacatctgcca

SEQ ID NO: 4588604 - DNA, 21 bp, Homo sapiens
ttcctgtgtgaccctgggcag

SEQ ID NO: 4588605 - DNA, 15 bp, Homo sapiens
ttcctgttcagcatt

SEQ ID NO: 4588606 - DNA, 13 bp, Homo sapiens
ttcctgtttgaaa

SEQ ID NO: 4588607 - DNA, 21 bp, Homo sapiens
ttcctgtttgaaatatcatgt

SEQ ID NO: 4588608 - DNA, 17 bp, Homo sapiens
ttccttatccctctctt

SEQ ID NO: 4588609 - DNA, 20 bp, Homo sapiens
ttccttccaggtgattctgt

SEQ ID NO: 4588610 - DNA, 11 bp, Homo sapiens
ttccttccctc

SEQ ID NO: 4588611 - DNA, 14 bp, Homo sapiens
ttccttccctcctt

SEQ ID NO: 4588612 - DNA, 13 bp, Homo sapiens
ttccttccctctc

SEQ ID NO: 4588613 - DNA, 19 bp, Homo sapiens
ttccttcccttttctgttc

SEQ ID NO: 4588614 - DNA, 18 bp, Homo sapiens
ttccttctaacatgttat

SEQ ID NO: 4588615 - DNA, 22 bp, Homo sapiens
ttccttgacctgcattgtaaat

SEQ ID NO: 4588616 - DNA, 15 bp, Homo sapiens
ttccttgaggacaga

SEQ ID NO: 4588617 - DNA, 16 bp, Homo sapiens
ttccttgctatttcaa

SEQ ID NO: 4588618 - DNA, 13 bp, Homo sapiens
ttccttgtgcaaa

SEQ ID NO: 4588619 - DNA, 15 bp, Homo sapiens
ttcctttatgtgaat

SEQ ID NO: 4588620 - DNA, 20 bp, Homo sapiens
ttcctttgtggttttatgga

SEQ ID NO: 4588621 - DNA, 12 bp, Homo sapiens
ttccttttatca

SEQ ID NO: 4588622 - DNA, 14 bp, Homo sapiens
ttccttttccctgc

SEQ ID NO: 4588623 - DNA, 15 bp, Homo sapiens
ttccttttccctgct

SEQ ID NO: 4588624 - DNA, 16 bp, Homo sapiens
ttccttttccctgctt

SEQ ID NO: 4588625 - DNA, 20 bp, Homo sapiens
ttccttttgtccacttgtaa

SEQ ID NO: 4588626 - DNA, 14 bp, Homo sapiens
ttcctttttcttcg

SEQ ID NO: 4588627 - DNA, 19 bp, Homo sapiens
ttccttttttaaaataaaa

SEQ ID NO: 4588628 - DNA, 20 bp, Homo sapiens
ttccttttttaaaataaaat

SEQ ID NO: 4588629 - DNA, 16 bp, Homo sapiens
ttccttttttgagatt

SEQ ID NO: 4588630 - DNA, 14 bp, Homo sapiens
ttcctttttttgta

SEQ ID NO: 4588631 - DNA, 16 bp, Homo sapiens
ttcgaatctctgcccc

SEQ ID NO: 4588632 - DNA, 20 bp, Homo sapiens
ttcgaatctctgcccctcac

SEQ ID NO: 4588633 - DNA, 18 bp, Homo sapiens
ttcgagaccaacctgacc

SEQ ID NO: 4588634 - DNA, 16 bp, Homo sapiens
ttcgcatggtcacaca

SEQ ID NO: 4588635 - DNA, 20 bp, Homo sapiens
ttcgcatggtcacacactga

SEQ ID NO: 4588636 - DNA, 21 bp, Homo sapiens
ttcgcatggtcacacactgat

SEQ ID NO: 4588637 - DNA, 13 bp, Homo sapiens
ttcgccttaaact

SEQ ID NO: 4588638 - DNA, 15 bp, Homo sapiens
ttcgcttgcttctgc

SEQ ID NO: 4588639 - DNA, 17 bp, Homo sapiens
ttcgcttgcttctgcag

SEQ ID NO: 4588640 - DNA, 18 bp, Homo sapiens
ttcgcttgcttctgcagc

SEQ ID NO: 4588641 - DNA, 17 bp, Homo sapiens
ttcggccccatgtatct

SEQ ID NO: 4588642 - DNA, 17 bp, Homo sapiens
ttcgggaccaatatata

SEQ ID NO: 4588643 - DNA, 17 bp, Homo sapiens
ttcggggaactcctgga

SEQ ID NO: 4588644 - DNA, 21 bp, Homo sapiens
ttcgtaacttcatattaatat

SEQ ID NO: 4588645 - DNA, 12 bp, Homo sapiens
ttcgtctgttgt

SEQ ID NO: 4588646 - DNA, 14 bp, Homo sapiens
ttcgtcttccctgc

SEQ ID NO: 4588647 - DNA, 15 bp, Homo sapiens
ttcgtgtgccgctgc

SEQ ID NO: 4588648 - DNA, 17 bp, Homo sapiens
ttcgttggtgaccagtt

SEQ ID NO: 4588649 - DNA, 20 bp, Homo sapiens
ttcgttggtgaccagtttct

SEQ ID NO: 4588650 - DNA, 20 bp, Homo sapiens
ttcgttgtgttttttaagat

SEQ ID NO: 4588651 - DNA, 13 bp, Homo sapiens
ttcgtttagaatc

SEQ ID NO: 4588652 - DNA, 21 bp, Homo sapiens
ttcgtttagaatcagaataaa

SEQ ID NO: 4588653 - DNA, 15 bp, Homo sapiens
ttcgtttattttcaa

SEQ ID NO: 4588654 - DNA, 22 bp, Homo sapiens
ttcgttttggttaagttggctt

SEQ ID NO: 4588655 - DNA, 18 bp, Homo sapiens
ttctaaaaagatgtaata

SEQ ID NO: 4588656 - DNA, 14 bp, Homo sapiens
ttctaaaaagtcag

SEQ ID NO: 4588657 - DNA, 15 bp, Homo sapiens
ttctaaaaggtgtga

SEQ ID NO: 4588658 - DNA, 15 bp, Homo sapiens
ttctaaaatctaaaa

SEQ ID NO: 4588659 - DNA, 23 bp, Homo sapiens
ttctaaacagaaattattttcta

SEQ ID NO: 4588660 - DNA, 23 bp, Homo sapiens
ttctaaacccaatccaaatggcg

SEQ ID NO: 4588661 - DNA, 22 bp, Homo sapiens
ttctaaagcactggtttcaaga

SEQ ID NO: 4588662 - DNA, 12 bp, Homo sapiens
ttctaaagtaaa

SEQ ID NO: 4588663 - DNA, 15 bp, Homo sapiens
ttctaaagtaaaatt

SEQ ID NO: 4588664 - DNA, 18 bp, Homo sapiens
ttctaaatgcaataagat

SEQ ID NO: 4588665 - DNA, 17 bp, Homo sapiens
ttctaaccttcacgatt

SEQ ID NO: 4588666 - DNA, 12 bp, Homo sapiens
ttctaagaagac

SEQ ID NO: 4588667 - DNA, 13 bp, Homo sapiens
ttctaagaagaca

SEQ ID NO: 4588668 - DNA, 13 bp, Homo sapiens
ttctaagaagtga

SEQ ID NO: 4588669 - DNA, 16 bp, Homo sapiens
ttctaagactctgtgt

SEQ ID NO: 4588670 - DNA, 17 bp, Homo sapiens
ttctaagactctgtgtg

SEQ ID NO: 4588671 - DNA, 13 bp, Homo sapiens
ttctaagagaagt

SEQ ID NO: 4588672 - DNA, 18 bp, Homo sapiens
ttctaagagaagttattt

SEQ ID NO: 4588673 - DNA, 16 bp, Homo sapiens
ttctaagagcatagaa

SEQ ID NO: 4588674 - DNA, 21 bp, Homo sapiens
ttctaagtaaaaccacagcag

SEQ ID NO: 4588675 - DNA, 18 bp, Homo sapiens
ttctaagtcattcataaa

SEQ ID NO: 4588676 - DNA, 12 bp, Homo sapiens
ttctaagtcttt

SEQ ID NO: 4588677 - DNA, 15 bp, Homo sapiens
ttctaagtctttcca

SEQ ID NO: 4588678 - DNA, 17 bp, Homo sapiens
ttctaagtctttccatt

SEQ ID NO: 4588679 - DNA, 12 bp, Homo sapiens
ttctaatgttta

SEQ ID NO: 4588680 - DNA, 14 bp, Homo sapiens
ttctaatgtttact

SEQ ID NO: 4588681 - DNA, 15 bp, Homo sapiens
ttctaatgtttacta

SEQ ID NO: 4588682 - DNA, 18 bp, Homo sapiens
ttctaatgtttactatat

SEQ ID NO: 4588683 - DNA, 16 bp, Homo sapiens
ttctaattaaaattgt

SEQ ID NO: 4588684 - DNA, 17 bp, Homo sapiens
ttctaattaaaattgtg

SEQ ID NO: 4588685 - DNA, 13 bp, Homo sapiens
ttctaattaagaa

SEQ ID NO: 4588686 - DNA, 13 bp, Homo sapiens
ttctaattaatag

SEQ ID NO: 4588687 - DNA, 17 bp, Homo sapiens
ttctacactctcctggg

SEQ ID NO: 4588688 - DNA, 21 bp, Homo sapiens
ttctacagtggttttatactg

SEQ ID NO: 4588689 - DNA, 23 bp, Homo sapiens
ttctacatgtgagatagttttca

SEQ ID NO: 4588690 - DNA, 18 bp, Homo sapiens
ttctaccacacacagcct

SEQ ID NO: 4588691 - DNA, 21 bp, Homo sapiens
ttctaccacacacagcctgtc

SEQ ID NO: 4588692 - DNA, 19 bp, Homo sapiens
ttctaccccaaggccagta

SEQ ID NO: 4588693 - DNA, 23 bp, Homo sapiens
ttctaccggagagagaatgtatt

SEQ ID NO: 4588694 - DNA, 23 bp, Homo sapiens
ttctacctataacactctaggat

SEQ ID NO: 4588695 - DNA, 11 bp, Homo sapiens
ttctacctgcc

SEQ ID NO: 4588696 - DNA, 19 bp, Homo sapiens
ttctacggatcatcaacaa

SEQ ID NO: 4588697 - DNA, 20 bp, Homo sapiens
ttctacggatcatcaacaag

SEQ ID NO: 4588698 - DNA, 13 bp, Homo sapiens
ttctactcccctt

SEQ ID NO: 4588699 - DNA, 20 bp, Homo sapiens
ttctactgctctcctccacc

SEQ ID NO: 4588700 - DNA, 17 bp, Homo sapiens
ttctactttcatcttaa

SEQ ID NO: 4588701 - DNA, 14 bp, Homo sapiens
ttctacttttaaat

SEQ ID NO: 4588702 - DNA, 16 bp, Homo sapiens
ttctacttttaaataa

SEQ ID NO: 4588703 - DNA, 15 bp, Homo sapiens
ttctagacgcccctc

SEQ ID NO: 4588704 - DNA, 21 bp, Homo sapiens
ttctagacgcccctcccaagc

SEQ ID NO: 4588705 - DNA, 14 bp, Homo sapiens
ttctagactataaa

SEQ ID NO: 4588706 - DNA, 14 bp, Homo sapiens
ttctagacttcccc

SEQ ID NO: 4588707 - DNA, 11 bp, Homo sapiens
ttctagagaca

SEQ ID NO: 4588708 - DNA, 22 bp, Homo sapiens
ttctagagttatcttctttatt

SEQ ID NO: 4588709 - DNA, 18 bp, Homo sapiens
ttctagataaccttgttt

SEQ ID NO: 4588710 - DNA, 21 bp, Homo sapiens
ttctagataaccttgtttatt

SEQ ID NO: 4588711 - DNA, 16 bp, Homo sapiens
ttctagatacaataaa

SEQ ID NO: 4588712 - DNA, 20 bp, Homo sapiens
ttctagatacaataaattgc

SEQ ID NO: 4588713 - DNA, 14 bp, Homo sapiens
ttctagatcctgca

SEQ ID NO: 4588714 - DNA, 16 bp, Homo sapiens
ttctagatcctgcacc

SEQ ID NO: 4588715 - DNA, 22 bp, Homo sapiens
ttctagatcctgcaccccagca

SEQ ID NO: 4588716 - DNA, 12 bp, Homo sapiens
ttctagcactgg

SEQ ID NO: 4588717 - DNA, 13 bp, Homo sapiens
ttctagccataat

SEQ ID NO: 4588718 - DNA, 17 bp, Homo sapiens
ttctagccatacctcag

SEQ ID NO: 4588719 - DNA, 12 bp, Homo sapiens
ttctagcctgca

SEQ ID NO: 4588720 - DNA, 16 bp, Homo sapiens
ttctagttctgccagg

SEQ ID NO: 4588721 - DNA, 17 bp, Homo sapiens
ttctagttgaggagttt

SEQ ID NO: 4588722 - DNA, 11 bp, Homo sapiens
ttctataaaaa

SEQ ID NO: 4588723 - DNA, 16 bp, Homo sapiens
ttctataaatgaatgt

SEQ ID NO: 4588724 - DNA, 14 bp, Homo sapiens
ttctataaggccat

SEQ ID NO: 4588725 - DNA, 23 bp, Homo sapiens
ttctataaggccataaaacaggt

SEQ ID NO: 4588726 - DNA, 15 bp, Homo sapiens
ttctatagccaaaaa

SEQ ID NO: 4588727 - DNA, 21 bp, Homo sapiens
ttctatagccaaaaatagcta

SEQ ID NO: 4588728 - DNA, 22 bp, Homo sapiens
ttctataggtttttaaatggaa

SEQ ID NO: 4588729 - DNA, 15 bp, Homo sapiens
ttctatcctctgtaa

SEQ ID NO: 4588730 - DNA, 18 bp, Homo sapiens
ttctatccttttgcctgc

SEQ ID NO: 4588731 - DNA, 17 bp, Homo sapiens
ttctatctactgatttg

SEQ ID NO: 4588732 - DNA, 15 bp, Homo sapiens
ttctatggagacttt

SEQ ID NO: 4588733 - DNA, 17 bp, Homo sapiens
ttctatggattcacttc

SEQ ID NO: 4588734 - DNA, 17 bp, Homo sapiens
ttctatgtatgttaatt

SEQ ID NO: 4588735 - DNA, 12 bp, Homo sapiens
ttctatgtatta

SEQ ID NO: 4588736 - DNA, 21 bp, Homo sapiens
ttctatgtcatttttaatgta

SEQ ID NO: 4588737 - DNA, 14 bp, Homo sapiens
ttctattgtacaga

SEQ ID NO: 4588738 - DNA, 15 bp, Homo sapiens
ttctattgtacagaa

SEQ ID NO: 4588739 - DNA, 17 bp, Homo sapiens
ttctatttctcctccat

SEQ ID NO: 4588740 - DNA, 19 bp, Homo sapiens
ttctatttctcctccatgg

SEQ ID NO: 4588741 - DNA, 17 bp, Homo sapiens
ttctatttgcctccagt

SEQ ID NO: 4588742 - DNA, 16 bp, Homo sapiens
ttctatttgctgggct

SEQ ID NO: 4588743 - DNA, 22 bp, Homo sapiens
ttctattttaagactgatttta

SEQ ID NO: 4588744 - DNA, 18 bp, Homo sapiens
ttctcaaagatctgaatt

SEQ ID NO: 4588745 - DNA, 18 bp, Homo sapiens
ttctcaacatactgtaat

SEQ ID NO: 4588746 - DNA, 22 bp, Homo sapiens
ttctcaacatactgtaatcaaa

SEQ ID NO: 4588747 - DNA, 11 bp, Homo sapiens
ttctcaagaat

SEQ ID NO: 4588748 - DNA, 16 bp, Homo sapiens
ttctcaagaatctaga

SEQ ID NO: 4588749 - DNA, 21 bp, Homo sapiens
ttctcaagcgctatccacaga

SEQ ID NO: 4588750 - DNA, 22 bp, Homo sapiens
ttctcaagcgctatccacagaa

SEQ ID NO: 4588751 - DNA, 14 bp, Homo sapiens
ttctcaagtaacat

SEQ ID NO: 4588752 - DNA, 20 bp, Homo sapiens
ttctcacactctaactgtat

SEQ ID NO: 4588753 - DNA, 21 bp, Homo sapiens
ttctcacactctaactgtata

SEQ ID NO: 4588754 - DNA, 21 bp, Homo sapiens
ttctcacactggtctgctgtc

SEQ ID NO: 4588755 - DNA, 13 bp, Homo sapiens
ttctcaccagctg

SEQ ID NO: 4588756 - DNA, 14 bp, Homo sapiens
ttctcaccagctgc

SEQ ID NO: 4588757 - DNA, 17 bp, Homo sapiens
ttctcaccagctgcaaa

SEQ ID NO: 4588758 - DNA, 23 bp, Homo sapiens
ttctcacctttcccacctctctc

SEQ ID NO: 4588759 - DNA, 23 bp, Homo sapiens
ttctcacgaaagtatttactttt

SEQ ID NO: 4588760 - DNA, 17 bp, Homo sapiens
ttctcacgctttgttta

SEQ ID NO: 4588761 - DNA, 15 bp, Homo sapiens
ttctcactaaatctt

SEQ ID NO: 4588762 - DNA, 15 bp, Homo sapiens
ttctcactaatttgt

SEQ ID NO: 4588763 - DNA, 16 bp, Homo sapiens
ttctcagacactgagt

SEQ ID NO: 4588764 - DNA, 16 bp, Homo sapiens
ttctcagatttctgag

SEQ ID NO: 4588765 - DNA, 23 bp, Homo sapiens
ttctcaggacagcatcccttccc

SEQ ID NO: 4588766 - DNA, 15 bp, Homo sapiens
ttctcagttttcata

SEQ ID NO: 4588767 - DNA, 17 bp, Homo sapiens
ttctcataattcctaca

SEQ ID NO: 4588768 - DNA, 16 bp, Homo sapiens
ttctcataattttgca

SEQ ID NO: 4588769 - DNA, 20 bp, Homo sapiens
ttctcatagaggaaattcaa

SEQ ID NO: 4588770 - DNA, 12 bp, Homo sapiens
ttctcatatttg

SEQ ID NO: 4588771 - DNA, 13 bp, Homo sapiens
ttctcattaaact

SEQ ID NO: 4588772 - DNA, 21 bp, Homo sapiens
ttctcattaaagttgtttccc

SEQ ID NO: 4588773 - DNA, 16 bp, Homo sapiens
ttctcatttcacccct

SEQ ID NO: 4588774 - DNA, 18 bp, Homo sapiens
ttctccaaaaatctgcct

SEQ ID NO: 4588775 - DNA, 21 bp, Homo sapiens
ttctccatcccctccctgcct

SEQ ID NO: 4588776 - DNA, 17 bp, Homo sapiens
ttctcccaagaaacctg

SEQ ID NO: 4588777 - DNA, 19 bp, Homo sapiens
ttctcccaggtaccagctg

SEQ ID NO: 4588778 - DNA, 20 bp, Homo sapiens
ttctcccaggtaccagctgc

SEQ ID NO: 4588779 - DNA, 17 bp, Homo sapiens
ttctcccagtatgtttt

SEQ ID NO: 4588780 - DNA, 23 bp, Homo sapiens
ttctccccgcagcccgcctgccg

SEQ ID NO: 4588781 - DNA, 13 bp, Homo sapiens
ttctcccctccct

SEQ ID NO: 4588782 - DNA, 15 bp, Homo sapiens
ttctcccctgccccc

SEQ ID NO: 4588783 - DNA, 13 bp, Homo sapiens
ttctccgccagcc

SEQ ID NO: 4588784 - DNA, 21 bp, Homo sapiens
ttctccgccagcctcctctgg

SEQ ID NO: 4588785 - DNA, 17 bp, Homo sapiens
ttctccgggtgtggcct

SEQ ID NO: 4588786 - DNA, 21 bp, Homo sapiens
ttctccgggtgtggcctcagc

SEQ ID NO: 4588787 - DNA, 18 bp, Homo sapiens
ttctcctcactgtatcca

SEQ ID NO: 4588788 - DNA, 13 bp, Homo sapiens
ttctcctcagtgg

SEQ ID NO: 4588789 - DNA, 23 bp, Homo sapiens
ttctcctccatgggagaaaatag

SEQ ID NO: 4588790 - DNA, 16 bp, Homo sapiens
ttctcctgcaaattta

SEQ ID NO: 4588791 - DNA, 22 bp, Homo sapiens
ttctcctgcaaatttagtttgt

SEQ ID NO: 4588792 - DNA, 23 bp, Homo sapiens
ttctcctgcaaatttagtttgtt

SEQ ID NO: 4588793 - DNA, 11 bp, Homo sapiens
ttctcctgccc

SEQ ID NO: 4588794 - DNA, 12 bp, Homo sapiens
ttctcctgcctc

SEQ ID NO: 4588795 - DNA, 14 bp, Homo sapiens
ttctcctgcctcag

SEQ ID NO: 4588796 - DNA, 15 bp, Homo sapiens
ttctcctgcctcagc

SEQ ID NO: 4588797 - DNA, 16 bp, Homo sapiens
ttctcctgcctcagcc

SEQ ID NO: 4588798 - DNA, 16 bp, Homo sapiens
ttctcctttcctacag

SEQ ID NO: 4588799 - DNA, 14 bp, Homo sapiens
ttctcctttgcaat

SEQ ID NO: 4588800 - DNA, 18 bp, Homo sapiens
ttctcgccccttccctct

SEQ ID NO: 4588801 - DNA, 23 bp, Homo sapiens
ttctcgccccttccctctctccc

SEQ ID NO: 4588802 - DNA, 14 bp, Homo sapiens
ttctcgtgtttgct

SEQ ID NO: 4588803 - DNA, 20 bp, Homo sapiens
ttctctactgtctggattaa

SEQ ID NO: 4588804 - DNA, 21 bp, Homo sapiens
ttctctataaaaaatatgtat

SEQ ID NO: 4588805 - DNA, 16 bp, Homo sapiens
ttctctataaagggtc

SEQ ID NO: 4588806 - DNA, 19 bp, Homo sapiens
ttctctataaagggtcagg

SEQ ID NO: 4588807 - DNA, 19 bp, Homo sapiens
ttctctcaaggagaggcaa

SEQ ID NO: 4588808 - DNA, 12 bp, Homo sapiens
ttctctcagtga

SEQ ID NO: 4588809 - DNA, 13 bp, Homo sapiens
ttctctcatctct

SEQ ID NO: 4588810 - DNA, 13 bp, Homo sapiens
ttctctccccagc

SEQ ID NO: 4588811 - DNA, 22 bp, Homo sapiens
ttctctccccagccccctccca

SEQ ID NO: 4588812 - DNA, 15 bp, Homo sapiens
ttctctcctccccaa

SEQ ID NO: 4588813 - DNA, 17 bp, Homo sapiens
ttctctcctgtcctccc

SEQ ID NO: 4588814 - DNA, 10 bp, Homo sapiens
ttctctctcc

SEQ ID NO: 4588815 - DNA, 18 bp, Homo sapiens
ttctctctcctctctgct

SEQ ID NO: 4588816 - DNA, 11 bp, Homo sapiens
ttctctctgtt

SEQ ID NO: 4588817 - DNA, 10 bp, Homo sapiens
ttctctcttt

SEQ ID NO: 4588818 - DNA, 19 bp, Homo sapiens
ttctctcttttaaagtatt

SEQ ID NO: 4588819 - DNA, 17 bp, Homo sapiens
ttctctgagctgtgcag

SEQ ID NO: 4588820 - DNA, 20 bp, Homo sapiens
ttctctgatttgtaatgagc

SEQ ID NO: 4588821 - DNA, 19 bp, Homo sapiens
ttctctgcccagccgggca

SEQ ID NO: 4588822 - DNA, 11 bp, Homo sapiens
ttctctgctcc

SEQ ID NO: 4588823 - DNA, 18 bp, Homo sapiens
ttctctggtggtcttcct

SEQ ID NO: 4588824 - DNA, 18 bp, Homo sapiens
ttctcttaaacttgtgaa

SEQ ID NO: 4588825 - DNA, 21 bp, Homo sapiens
ttctcttaggtggctctggga

SEQ ID NO: 4588826 - DNA, 22 bp, Homo sapiens
ttctcttaggtggctctgggaa

SEQ ID NO: 4588827 - DNA, 21 bp, Homo sapiens
ttctcttccccttagaaacac

SEQ ID NO: 4588828 - DNA, 21 bp, Homo sapiens
ttctcttgagcagttagcaga

SEQ ID NO: 4588829 - DNA, 16 bp, Homo sapiens
ttctctttccatgaca

SEQ ID NO: 4588830 - DNA, 14 bp, Homo sapiens
ttctctttctctcc

SEQ ID NO: 4588831 - DNA, 16 bp, Homo sapiens
ttctctttctctcctt

SEQ ID NO: 4588832 - DNA, 19 bp, Homo sapiens
ttctctttgtggtttcttg

SEQ ID NO: 4588833 - DNA, 16 bp, Homo sapiens
ttctcttttattctgt

SEQ ID NO: 4588834 - DNA, 23 bp, Homo sapiens
ttctgaaaaggaggtatctagca

SEQ ID NO: 4588835 - DNA, 23 bp, Homo sapiens
ttctgaaaggagacattgctcta

SEQ ID NO: 4588836 - DNA, 22 bp, Homo sapiens
ttctgaactaaagtgctgcact

SEQ ID NO: 4588837 - DNA, 16 bp, Homo sapiens
ttctgaactcaaactg

SEQ ID NO: 4588838 - DNA, 13 bp, Homo sapiens
ttctgaactccat

SEQ ID NO: 4588839 - DNA, 15 bp, Homo sapiens
ttctgaactccattt

SEQ ID NO: 4588840 - DNA, 15 bp, Homo sapiens
ttctgaactgttaca

SEQ ID NO: 4588841 - DNA, 21 bp, Homo sapiens
ttctgaagatcaatttctccc

SEQ ID NO: 4588842 - DNA, 14 bp, Homo sapiens
ttctgaataaagca

SEQ ID NO: 4588843 - DNA, 15 bp, Homo sapiens
ttctgaataaagcaa

SEQ ID NO: 4588844 - DNA, 17 bp, Homo sapiens
ttctgaataaagcaatt

SEQ ID NO: 4588845 - DNA, 20 bp, Homo sapiens
ttctgaatctagagaacagt

SEQ ID NO: 4588846 - DNA, 22 bp, Homo sapiens
ttctgaatgtgaaaatatttaa

SEQ ID NO: 4588847 - DNA, 16 bp, Homo sapiens
ttctgaatttgcaaag

SEQ ID NO: 4588848 - DNA, 18 bp, Homo sapiens
ttctgaatttgcaaagta

SEQ ID NO: 4588849 - DNA, 22 bp, Homo sapiens
ttctgaatttgcaaagtactgt

SEQ ID NO: 4588850 - DNA, 12 bp, Homo sapiens
ttctgacatgta

SEQ ID NO: 4588851 - DNA, 23 bp, Homo sapiens
ttctgaccgttaaaaaattcttg

SEQ ID NO: 4588852 - DNA, 15 bp, Homo sapiens
ttctgactctgagct

SEQ ID NO: 4588853 - DNA, 11 bp, Homo sapiens
ttctgactgtc

SEQ ID NO: 4588854 - DNA, 16 bp, Homo sapiens
ttctgacttttacaga

SEQ ID NO: 4588855 - DNA, 21 bp, Homo sapiens
ttctgagcaccgaatattgag

SEQ ID NO: 4588856 - DNA, 16 bp, Homo sapiens
ttctgagtgccttctg

SEQ ID NO: 4588857 - DNA, 18 bp, Homo sapiens
ttctgagtgccttctgtg

SEQ ID NO: 4588858 - DNA, 21 bp, Homo sapiens
ttctgagttttgtgtttgttg

SEQ ID NO: 4588859 - DNA, 18 bp, Homo sapiens
ttctgataaaagatggcc

SEQ ID NO: 4588860 - DNA, 14 bp, Homo sapiens
ttctgatctgtact

SEQ ID NO: 4588861 - DNA, 20 bp, Homo sapiens
ttctgattcccctccaccaa

SEQ ID NO: 4588862 - DNA, 18 bp, Homo sapiens
ttctgatttcataattca

SEQ ID NO: 4588863 - DNA, 15 bp, Homo sapiens
ttctgatttctgaag

SEQ ID NO: 4588864 - DNA, 14 bp, Homo sapiens
ttctgcaaaataca

SEQ ID NO: 4588865 - DNA, 18 bp, Homo sapiens
ttctgcaagcctcatgcc

SEQ ID NO: 4588866 - DNA, 17 bp, Homo sapiens
ttctgcagcaactccca

SEQ ID NO: 4588867 - DNA, 21 bp, Homo sapiens
ttctgcagcaactcccacgac

SEQ ID NO: 4588868 - DNA, 17 bp, Homo sapiens
ttctgcatatgttgaat

SEQ ID NO: 4588869 - DNA, 23 bp, Homo sapiens
ttctgcatcagctgctgaaacaa

SEQ ID NO: 4588870 - DNA, 21 bp, Homo sapiens
ttctgcattactattaactct

SEQ ID NO: 4588871 - DNA, 23 bp, Homo sapiens
ttctgcattactattaactctgc

SEQ ID NO: 4588872 - DNA, 15 bp, Homo sapiens
ttctgccaaaataaa

SEQ ID NO: 4588873 - DNA, 18 bp, Homo sapiens
ttctgccaaaataaacct

SEQ ID NO: 4588874 - DNA, 17 bp, Homo sapiens
ttctgccaccagcccct

SEQ ID NO: 4588875 - DNA, 13 bp, Homo sapiens
ttctgccaggaga

SEQ ID NO: 4588876 - DNA, 15 bp, Homo sapiens
ttctgccagggagct

SEQ ID NO: 4588877 - DNA, 19 bp, Homo sapiens
ttctgcccaattggaggaa

SEQ ID NO: 4588878 - DNA, 20 bp, Homo sapiens
ttctgcccggctacatcagc

SEQ ID NO: 4588879 - DNA, 18 bp, Homo sapiens
ttctgccctggctgctgc

SEQ ID NO: 4588880 - DNA, 19 bp, Homo sapiens
ttctgccctggctgctgcc

SEQ ID NO: 4588881 - DNA, 20 bp, Homo sapiens
ttctgccctggctgctgccc

SEQ ID NO: 4588882 - DNA, 14 bp, Homo sapiens
ttctgcctgttata

SEQ ID NO: 4588883 - DNA, 20 bp, Homo sapiens
ttctgccttggattcctaga

SEQ ID NO: 4588884 - DNA, 23 bp, Homo sapiens
ttctgctagagcagacaggcctg

SEQ ID NO: 4588885 - DNA, 20 bp, Homo sapiens
ttctgctcatcattctctgt

SEQ ID NO: 4588886 - DNA, 20 bp, Homo sapiens
ttctgctccacccttggcct

SEQ ID NO: 4588887 - DNA, 20 bp, Homo sapiens
ttctgctccataccttttct

SEQ ID NO: 4588888 - DNA, 17 bp, Homo sapiens
ttctgctctggaataaa

SEQ ID NO: 4588889 - DNA, 23 bp, Homo sapiens
ttctgctctggttgtttctgttc

SEQ ID NO: 4588890 - DNA, 18 bp, Homo sapiens
ttctgctgtctgggactc

SEQ ID NO: 4588891 - DNA, 15 bp, Homo sapiens
ttctgctttctttga

SEQ ID NO: 4588892 - DNA, 14 bp, Homo sapiens
ttctgctttgctct

SEQ ID NO: 4588893 - DNA, 14 bp, Homo sapiens
ttctgcttttaagt

SEQ ID NO: 4588894 - DNA, 17 bp, Homo sapiens
ttctgcttttaagtttt

SEQ ID NO: 4588895 - DNA, 13 bp, Homo sapiens
ttctgcttttctg

SEQ ID NO: 4588896 - DNA, 18 bp, Homo sapiens
ttctgcttttctgccctg

SEQ ID NO: 4588897 - DNA, 20 bp, Homo sapiens
ttctggactatagctgttct

SEQ ID NO: 4588898 - DNA, 17 bp, Homo sapiens
ttctggactctgcccca

SEQ ID NO: 4588899 - DNA, 11 bp, Homo sapiens
ttctggactgg

SEQ ID NO: 4588900 - DNA, 18 bp, Homo sapiens
ttctggatggtgtgcctt

SEQ ID NO: 4588901 - DNA, 16 bp, Homo sapiens
ttctggcataattttt

SEQ ID NO: 4588902 - DNA, 21 bp, Homo sapiens
ttctggccagtgtttaaaact

SEQ ID NO: 4588903 - DNA, 22 bp, Homo sapiens
ttctggccagtgtttaaaactt

SEQ ID NO: 4588904 - DNA, 17 bp, Homo sapiens
ttctggcgcccctgcct

SEQ ID NO: 4588905 - DNA, 20 bp, Homo sapiens
ttctggctgtgatcttaaaa

SEQ ID NO: 4588906 - DNA, 22 bp, Homo sapiens
ttctggctgtgatcttaaaata

SEQ ID NO: 4588907 - DNA, 14 bp, Homo sapiens
ttctgggagggcag

SEQ ID NO: 4588908 - DNA, 22 bp, Homo sapiens
ttctgggcatggcagggccagg

SEQ ID NO: 4588909 - DNA, 23 bp, Homo sapiens
ttctgggcatggcagggccaggc

SEQ ID NO: 4588910 - DNA, 15 bp, Homo sapiens
ttctgggctggggcc

SEQ ID NO: 4588911 - DNA, 17 bp, Homo sapiens
ttctggggcaggctggg

SEQ ID NO: 4588912 - DNA, 18 bp, Homo sapiens
ttctggggcaggctgggc

SEQ ID NO: 4588913 - DNA, 21 bp, Homo sapiens
ttctggggcaggctgggccat

SEQ ID NO: 4588914 - DNA, 19 bp, Homo sapiens
ttctgggtggggcagtggg

SEQ ID NO: 4588915 - DNA, 16 bp, Homo sapiens
ttctgggtgttgacca

SEQ ID NO: 4588916 - DNA, 20 bp, Homo sapiens
ttctggtatgcattctttat

SEQ ID NO: 4588917 - DNA, 14 bp, Homo sapiens
ttctggtgggttga

SEQ ID NO: 4588918 - DNA, 20 bp, Homo sapiens
ttctggtggttctgctgtta

SEQ ID NO: 4588919 - DNA, 17 bp, Homo sapiens
ttctggtttaaacttgt

SEQ ID NO: 4588920 - DNA, 14 bp, Homo sapiens
ttctgtaatgtaaa

SEQ ID NO: 4588921 - DNA, 11 bp, Homo sapiens
ttctgtaattc

SEQ ID NO: 4588922 - DNA, 16 bp, Homo sapiens
ttctgtaattcaggtt

SEQ ID NO: 4588923 - DNA, 22 bp, Homo sapiens
ttctgtaattcaggtttttcct

SEQ ID NO: 4588924 - DNA, 22 bp, Homo sapiens
ttctgtacatgcattgagctct

SEQ ID NO: 4588925 - DNA, 17 bp, Homo sapiens
ttctgtaccaaagtgtt

SEQ ID NO: 4588926 - DNA, 18 bp, Homo sapiens
ttctgtactcaaatgtag

SEQ ID NO: 4588927 - DNA, 20 bp, Homo sapiens
ttctgtagcttatctgcccc

SEQ ID NO: 4588928 - DNA, 21 bp, Homo sapiens
ttctgtagcttatctgcccct

SEQ ID NO: 4588929 - DNA, 16 bp, Homo sapiens
ttctgtatatactttt

SEQ ID NO: 4588930 - DNA, 12 bp, Homo sapiens
ttctgtatttaa

SEQ ID NO: 4588931 - DNA, 16 bp, Homo sapiens
ttctgtcagtaaaact

SEQ ID NO: 4588932 - DNA, 16 bp, Homo sapiens
ttctgtcagtgttaaa

SEQ ID NO: 4588933 - DNA, 15 bp, Homo sapiens
ttctgtcctgtaact

SEQ ID NO: 4588934 - DNA, 22 bp, Homo sapiens
ttctgtctaggttaaagctaaa

SEQ ID NO: 4588935 - DNA, 17 bp, Homo sapiens
ttctgtcttctacagat

SEQ ID NO: 4588936 - DNA, 17 bp, Homo sapiens
ttctgtgacccatctgt

SEQ ID NO: 4588937 - DNA, 18 bp, Homo sapiens
ttctgtgacccatctgta

SEQ ID NO: 4588938 - DNA, 19 bp, Homo sapiens
ttctgtgacccatctgtag

SEQ ID NO: 4588939 - DNA, 16 bp, Homo sapiens
ttctgtgcctcccccc

SEQ ID NO: 4588940 - DNA, 15 bp, Homo sapiens
ttctgtgcctgaata

SEQ ID NO: 4588941 - DNA, 23 bp, Homo sapiens
ttctgtggctggctctaccttcc

SEQ ID NO: 4588942 - DNA, 18 bp, Homo sapiens
ttctgtggggactccggc

SEQ ID NO: 4588943 - DNA, 16 bp, Homo sapiens
ttctgtggggcccctc

SEQ ID NO: 4588944 - DNA, 19 bp, Homo sapiens
ttctgtggggcccctcacc

SEQ ID NO: 4588945 - DNA, 18 bp, Homo sapiens
ttctgtggtttcatgtta

SEQ ID NO: 4588946 - DNA, 12 bp, Homo sapiens
ttctgtgtattt

SEQ ID NO: 4588947 - DNA, 13 bp, Homo sapiens
ttctgtgtattta

SEQ ID NO: 4588948 - DNA, 17 bp, Homo sapiens
ttctgtgtatttaattg

SEQ ID NO: 4588949 - DNA, 20 bp, Homo sapiens
ttctgtgtatttaattgtaa

SEQ ID NO: 4588950 - DNA, 21 bp, Homo sapiens
ttctgtgtatttaattgtaaa

SEQ ID NO: 4588951 - DNA, 17 bp, Homo sapiens
ttctgtgttttcagact

SEQ ID NO: 4588952 - DNA, 23 bp, Homo sapiens
ttctgtgttttcagactgcctgt

SEQ ID NO: 4588953 - DNA, 21 bp, Homo sapiens
ttctgttaggggccaataaaa

SEQ ID NO: 4588954 - DNA, 21 bp, Homo sapiens
ttctgttatttttaagctttt

SEQ ID NO: 4588955 - DNA, 16 bp, Homo sapiens
ttctgttcatttccta

SEQ ID NO: 4588956 - DNA, 14 bp, Homo sapiens
ttctgttctagttt

SEQ ID NO: 4588957 - DNA, 21 bp, Homo sapiens
ttctgttggcctaagtgcctc

SEQ ID NO: 4588958 - DNA, 19 bp, Homo sapiens
ttctgtttagttttacact

SEQ ID NO: 4588959 - DNA, 23 bp, Homo sapiens
ttctgtttcctatttaatacagc

SEQ ID NO: 4588960 - DNA, 15 bp, Homo sapiens
ttctgtttgattctt

SEQ ID NO: 4588961 - DNA, 14 bp, Homo sapiens
ttctgttttgttaa

SEQ ID NO: 4588962 - DNA, 21 bp, Homo sapiens
ttctgttttgttaatataccc

SEQ ID NO: 4588963 - DNA, 15 bp, Homo sapiens
ttcttaaaacacatg

SEQ ID NO: 4588964 - DNA, 16 bp, Homo sapiens
ttcttaaaacacatga

SEQ ID NO: 4588965 - DNA, 18 bp, Homo sapiens
ttcttaaaatgcaatatt

SEQ ID NO: 4588966 - DNA, 15 bp, Homo sapiens
ttcttaaattatttt

SEQ ID NO: 4588967 - DNA, 19 bp, Homo sapiens
ttcttaacctttgctatgt

SEQ ID NO: 4588968 - DNA, 17 bp, Homo sapiens
ttcttaacttcttgctt

SEQ ID NO: 4588969 - DNA, 18 bp, Homo sapiens
ttcttaagaattcaaatt

SEQ ID NO: 4588970 - DNA, 23 bp, Homo sapiens
ttcttaataaaactcactcactg

SEQ ID NO: 4588971 - DNA, 16 bp, Homo sapiens
ttcttacaagcttaaa

SEQ ID NO: 4588972 - DNA, 21 bp, Homo sapiens
ttcttacaataaaccctcctt

SEQ ID NO: 4588973 - DNA, 15 bp, Homo sapiens
ttcttagaacagtgg

SEQ ID NO: 4588974 - DNA, 22 bp, Homo sapiens
ttcttagaacagtggaaactat

SEQ ID NO: 4588975 - DNA, 23 bp, Homo sapiens
ttcttagagccttagcagccctg

SEQ ID NO: 4588976 - DNA, 23 bp, Homo sapiens
ttcttagagttttattcctttcc

SEQ ID NO: 4588977 - DNA, 23 bp, Homo sapiens
ttcttagcctgtggcagtaaaga

SEQ ID NO: 4588978 - DNA, 19 bp, Homo sapiens
ttcttagctgtaacttaac

SEQ ID NO: 4588979 - DNA, 15 bp, Homo sapiens
ttcttagttgctgta

SEQ ID NO: 4588980 - DNA, 16 bp, Homo sapiens
ttcttataacttgtaa

SEQ ID NO: 4588981 - DNA, 17 bp, Homo sapiens
ttcttatacagataaaa

SEQ ID NO: 4588982 - DNA, 22 bp, Homo sapiens
ttcttatcacataagagagatg

SEQ ID NO: 4588983 - DNA, 23 bp, Homo sapiens
ttcttatcacataagagagatga

SEQ ID NO: 4588984 - DNA, 17 bp, Homo sapiens
ttcttatggaattgatt

SEQ ID NO: 4588985 - DNA, 18 bp, Homo sapiens
ttcttatggaattgattt

SEQ ID NO: 4588986 - DNA, 13 bp, Homo sapiens
ttcttatgtgaca

SEQ ID NO: 4588987 - DNA, 16 bp, Homo sapiens
ttcttatgtgacatta

SEQ ID NO: 4588988 - DNA, 21 bp, Homo sapiens
ttcttatgtgacattaacaaa

SEQ ID NO: 4588989 - DNA, 14 bp, Homo sapiens
ttcttattcaaaga

SEQ ID NO: 4588990 - DNA, 18 bp, Homo sapiens
ttcttatttaatcttttc

SEQ ID NO: 4588991 - DNA, 15 bp, Homo sapiens
ttcttcacaggcact

SEQ ID NO: 4588992 - DNA, 16 bp, Homo sapiens
ttcttcaccaaatctt

SEQ ID NO: 4588993 - DNA, 11 bp, Homo sapiens
ttcttcagttg

SEQ ID NO: 4588994 - DNA, 20 bp, Homo sapiens
ttcttcatccatagacacag

SEQ ID NO: 4588995 - DNA, 12 bp, Homo sapiens
ttcttcatgaaa

SEQ ID NO: 4588996 - DNA, 15 bp, Homo sapiens
ttcttcatttctctg

SEQ ID NO: 4588997 - DNA, 18 bp, Homo sapiens
ttcttccatcatcactgt

SEQ ID NO: 4588998 - DNA, 17 bp, Homo sapiens
ttcttcccactttcatc

SEQ ID NO: 4588999 - DNA, 21 bp, Homo sapiens
ttcttccccaggtccttcctt

SEQ ID NO: 4589000 - DNA, 23 bp, Homo sapiens
ttcttctaaagcactggtttcaa

SEQ ID NO: 4589001 - DNA, 12 bp, Homo sapiens
ttcttctaagaa

SEQ ID NO: 4589002 - DNA, 19 bp, Homo sapiens
ttcttctcttagattctta

SEQ ID NO: 4589003 - DNA, 19 bp, Homo sapiens
ttcttctgaagattcttaa

SEQ ID NO: 4589004 - DNA, 12 bp, Homo sapiens
ttcttctgcctc

SEQ ID NO: 4589005 - DNA, 16 bp, Homo sapiens
ttcttctggtgctact

SEQ ID NO: 4589006 - DNA, 14 bp, Homo sapiens
ttcttctgtaatat

SEQ ID NO: 4589007 - DNA, 15 bp, Homo sapiens
ttcttctgtaatatt

SEQ ID NO: 4589008 - DNA, 13 bp, Homo sapiens
ttcttcttccctc

SEQ ID NO: 4589009 - DNA, 14 bp, Homo sapiens
ttcttcttctaaga

SEQ ID NO: 4589010 - DNA, 15 bp, Homo sapiens
ttcttcttgaaaata

SEQ ID NO: 4589011 - DNA, 14 bp, Homo sapiens
ttcttgaaaaagat

SEQ ID NO: 4589012 - DNA, 16 bp, Homo sapiens
ttcttgaatataaaaa

SEQ ID NO: 4589013 - DNA, 18 bp, Homo sapiens
ttcttgcctctgtcccct

SEQ ID NO: 4589014 - DNA, 17 bp, Homo sapiens
ttcttgcttctttctag

SEQ ID NO: 4589015 - DNA, 12 bp, Homo sapiens
ttcttgctttca

SEQ ID NO: 4589016 - DNA, 18 bp, Homo sapiens
ttcttggagctttggaat

SEQ ID NO: 4589017 - DNA, 16 bp, Homo sapiens
ttcttggattacttta

SEQ ID NO: 4589018 - DNA, 17 bp, Homo sapiens
ttcttgggaattgaaaa

SEQ ID NO: 4589019 - DNA, 22 bp, Homo sapiens
ttcttgggcccggtccacaggt

SEQ ID NO: 4589020 - DNA, 23 bp, Homo sapiens
ttcttgggcccggtccacaggtc

SEQ ID NO: 4589021 - DNA, 21 bp, Homo sapiens
ttcttggtgtttgactgtaat

SEQ ID NO: 4589022 - DNA, 16 bp, Homo sapiens
ttcttggttgaggaaa

SEQ ID NO: 4589023 - DNA, 22 bp, Homo sapiens
ttcttggttgaggaaacaaaca

SEQ ID NO: 4589024 - DNA, 12 bp, Homo sapiens
ttcttgtattta

SEQ ID NO: 4589025 - DNA, 22 bp, Homo sapiens
ttcttgtgttttactgtcagat

SEQ ID NO: 4589026 - DNA, 15 bp, Homo sapiens
ttcttgtttattgag

SEQ ID NO: 4589027 - DNA, 13 bp, Homo sapiens
ttctttaaaagaa

SEQ ID NO: 4589028 - DNA, 19 bp, Homo sapiens
ttctttaaaagaatgacta

SEQ ID NO: 4589029 - DNA, 22 bp, Homo sapiens
ttctttaaatgtgtatttctta

SEQ ID NO: 4589030 - DNA, 12 bp, Homo sapiens
ttctttaactgc

SEQ ID NO: 4589031 - DNA, 12 bp, Homo sapiens
ttctttagaaaa

SEQ ID NO: 4589032 - DNA, 13 bp, Homo sapiens
ttctttagaaaac

SEQ ID NO: 4589033 - DNA, 12 bp, Homo sapiens
ttctttccatga

SEQ ID NO: 4589034 - DNA, 13 bp, Homo sapiens
ttctttccatgaa

SEQ ID NO: 4589035 - DNA, 14 bp, Homo sapiens
ttctttcccatgta

SEQ ID NO: 4589036 - DNA, 19 bp, Homo sapiens
ttctttcccatgtatttgt

SEQ ID NO: 4589037 - DNA, 13 bp, Homo sapiens
ttctttccccaga

SEQ ID NO: 4589038 - DNA, 22 bp, Homo sapiens
ttctttccccagaggctcccaa

SEQ ID NO: 4589039 - DNA, 24 bp, Homo sapiens
ttctttccccagaggctcccaatc

SEQ ID NO: 4589040 - DNA, 11 bp, Homo sapiens
ttctttcctcc

SEQ ID NO: 4589041 - DNA, 13 bp, Homo sapiens
ttctttctagaaa

SEQ ID NO: 4589042 - DNA, 14 bp, Homo sapiens
ttctttcttcctct

SEQ ID NO: 4589043 - DNA, 16 bp, Homo sapiens
ttctttgcaaagtatt

SEQ ID NO: 4589044 - DNA, 16 bp, Homo sapiens
ttctttgcaccaaaga

SEQ ID NO: 4589045 - DNA, 12 bp, Homo sapiens
ttctttgcctct

SEQ ID NO: 4589046 - DNA, 23 bp, Homo sapiens
ttctttgctgcagtcatctactt

SEQ ID NO: 4589047 - DNA, 17 bp, Homo sapiens
ttctttgcttgaacaca

SEQ ID NO: 4589048 - DNA, 16 bp, Homo sapiens
ttctttggaaagtaca

SEQ ID NO: 4589049 - DNA, 16 bp, Homo sapiens
ttctttggagttaaaa

SEQ ID NO: 4589050 - DNA, 21 bp, Homo sapiens
ttctttggtgcctttcctgtt

SEQ ID NO: 4589051 - DNA, 22 bp, Homo sapiens
ttctttggtgcctttcctgttc

SEQ ID NO: 4589052 - DNA, 13 bp, Homo sapiens
ttctttgtgcctt

SEQ ID NO: 4589053 - DNA, 16 bp, Homo sapiens
ttctttgtgcctttgg

SEQ ID NO: 4589054 - DNA, 11 bp, Homo sapiens
ttctttgtgtt

SEQ ID NO: 4589055 - DNA, 20 bp, Homo sapiens
ttctttgtttctttcttcct

SEQ ID NO: 4589056 - DNA, 14 bp, Homo sapiens
ttcttttaaagatt

SEQ ID NO: 4589057 - DNA, 15 bp, Homo sapiens
ttcttttagaaaagg

SEQ ID NO: 4589058 - DNA, 19 bp, Homo sapiens
ttcttttatggcaaaagta

SEQ ID NO: 4589059 - DNA, 14 bp, Homo sapiens
ttcttttattaata

SEQ ID NO: 4589060 - DNA, 13 bp, Homo sapiens
ttcttttcacatt

SEQ ID NO: 4589061 - DNA, 13 bp, Homo sapiens
ttcttttccccct

SEQ ID NO: 4589062 - DNA, 13 bp, Homo sapiens
ttcttttctaact

SEQ ID NO: 4589063 - DNA, 12 bp, Homo sapiens
ttcttttctcct

SEQ ID NO: 4589064 - DNA, 15 bp, Homo sapiens
ttcttttctttgtat

SEQ ID NO: 4589065 - DNA, 18 bp, Homo sapiens
ttcttttgccacatccct

SEQ ID NO: 4589066 - DNA, 13 bp, Homo sapiens
ttcttttggtaaa

SEQ ID NO: 4589067 - DNA, 13 bp, Homo sapiens
ttctttttctaca

SEQ ID NO: 4589068 - DNA, 14 bp, Homo sapiens
ttcttttttaaagt

SEQ ID NO: 4589069 - DNA, 19 bp, Homo sapiens
ttcttttttaaagtaaact

SEQ ID NO: 4589070 - DNA, 18 bp, Homo sapiens
ttctttttttccttttta

SEQ ID NO: 4589071 - DNA, 17 bp, Homo sapiens
ttctttttttctgtcag

SEQ ID NO: 4589072 - DNA, 17 bp, Homo sapiens
ttcttttttttaatgtt

SEQ ID NO: 4589073 - DNA, 21 bp, Homo sapiens
ttctttttttttaagttctta

SEQ ID NO: 4589074 - DNA, 21 bp, Homo sapiens
ttcttttttttttttttgaga

SEQ ID NO: 4589075 - DNA, 19 bp, Homo sapiens
ttgaaaaaatagacttaaa

SEQ ID NO: 4589076 - DNA, 15 bp, Homo sapiens
ttgaaaaagtttgtt

SEQ ID NO: 4589077 - DNA, 20 bp, Homo sapiens
ttgaaaaatagcatatgcct

SEQ ID NO: 4589078 - DNA, 16 bp, Homo sapiens
ttgaaaaccaaaatga

SEQ ID NO: 4589079 - DNA, 17 bp, Homo sapiens
ttgaaaaccaaaatgac

SEQ ID NO: 4589080 - DNA, 19 bp, Homo sapiens
ttgaaaaccaaaatgacat

SEQ ID NO: 4589081 - DNA, 22 bp, Homo sapiens
ttgaaaaccaaaatgacatctt

SEQ ID NO: 4589082 - DNA, 19 bp, Homo sapiens
ttgaaaactgtgcaacttt

SEQ ID NO: 4589083 - DNA, 16 bp, Homo sapiens
ttgaaaagactccaaa

SEQ ID NO: 4589084 - DNA, 22 bp, Homo sapiens
ttgaaaagactccaaagaaatg

SEQ ID NO: 4589085 - DNA, 16 bp, Homo sapiens
ttgaaaagcacagagg

SEQ ID NO: 4589086 - DNA, 23 bp, Homo sapiens
ttgaaaataaatcttagtgttca

SEQ ID NO: 4589087 - DNA, 22 bp, Homo sapiens
ttgaaaataacctaattaatat

SEQ ID NO: 4589088 - DNA, 15 bp, Homo sapiens
ttgaaaatatgtact

SEQ ID NO: 4589089 - DNA, 12 bp, Homo sapiens
ttgaaaattgta

SEQ ID NO: 4589090 - DNA, 19 bp, Homo sapiens
ttgaaaccaagttgaaaaa

SEQ ID NO: 4589091 - DNA, 22 bp, Homo sapiens
ttgaaactcgcgagtgtaactt

SEQ ID NO: 4589092 - DNA, 23 bp, Homo sapiens
ttgaaactgagatgtgaacacat

SEQ ID NO: 4589093 - DNA, 18 bp, Homo sapiens
ttgaaactgcatttgtgc

SEQ ID NO: 4589094 - DNA, 22 bp, Homo sapiens
ttgaaagactgtgctgtccttt

SEQ ID NO: 4589095 - DNA, 19 bp, Homo sapiens
ttgaaagcttcaaagttta

SEQ ID NO: 4589096 - DNA, 21 bp, Homo sapiens
ttgaaaggggacacctgtaca

SEQ ID NO: 4589097 - DNA, 22 bp, Homo sapiens
ttgaaaggggacacctgtacat

SEQ ID NO: 4589098 - DNA, 23 bp, Homo sapiens
ttgaaaggggacacctgtacatt

SEQ ID NO: 4589099 - DNA, 21 bp, Homo sapiens
ttgaaaggttttttttcagtt

SEQ ID NO: 4589100 - DNA, 19 bp, Homo sapiens
ttgaaagtgggcaaaagct

SEQ ID NO: 4589101 - DNA, 16 bp, Homo sapiens
ttgaaataactggaac

SEQ ID NO: 4589102 - DNA, 18 bp, Homo sapiens
ttgaaatattcagaaatt

SEQ ID NO: 4589103 - DNA, 18 bp, Homo sapiens
ttgaaatgaggtctgttt

SEQ ID NO: 4589104 - DNA, 19 bp, Homo sapiens
ttgaaatgaggtctgttta

SEQ ID NO: 4589105 - DNA, 20 bp, Homo sapiens
ttgaaatgaggtctgtttaa

SEQ ID NO: 4589106 - DNA, 18 bp, Homo sapiens
ttgaaatgcattgctctg

SEQ ID NO: 4589107 - DNA, 11 bp, Homo sapiens
ttgaaatgtaa

SEQ ID NO: 4589108 - DNA, 20 bp, Homo sapiens
ttgaaattatgtgacatttt

SEQ ID NO: 4589109 - DNA, 21 bp, Homo sapiens
ttgaaattctatttataatac

SEQ ID NO: 4589110 - DNA, 17 bp, Homo sapiens
ttgaaattctgaatttg

SEQ ID NO: 4589111 - DNA, 20 bp, Homo sapiens
ttgaacaaaaatgtttccac

SEQ ID NO: 4589112 - DNA, 23 bp, Homo sapiens
ttgaacaaaaatgtttccactgg

SEQ ID NO: 4589113 - DNA, 13 bp, Homo sapiens
ttgaacaaagaca

SEQ ID NO: 4589114 - DNA, 20 bp, Homo sapiens
ttgaacacaaactgtaaata

SEQ ID NO: 4589115 - DNA, 20 bp, Homo sapiens
ttgaacacagtattttccca

SEQ ID NO: 4589116 - DNA, 22 bp, Homo sapiens
ttgaacattaatccacatgttt

SEQ ID NO: 4589117 - DNA, 16 bp, Homo sapiens
ttgaaccattatactt

SEQ ID NO: 4589118 - DNA, 19 bp, Homo sapiens
ttgaaccattatactttat

SEQ ID NO: 4589119 - DNA, 13 bp, Homo sapiens
ttgaacccaggag

SEQ ID NO: 4589120 - DNA, 23 bp, Homo sapiens
ttgaacgactgtatattgctaag

SEQ ID NO: 4589121 - DNA, 20 bp, Homo sapiens
ttgaactcagatctgtctga

SEQ ID NO: 4589122 - DNA, 15 bp, Homo sapiens
ttgaactttccaaaa

SEQ ID NO: 4589123 - DNA, 19 bp, Homo sapiens
ttgaacttttgtactgaat

SEQ ID NO: 4589124 - DNA, 16 bp, Homo sapiens
ttgaagacttcaaaat

SEQ ID NO: 4589125 - DNA, 20 bp, Homo sapiens
ttgaagacttcaaaatattg

SEQ ID NO: 4589126 - DNA, 20 bp, Homo sapiens
ttgaagagacagagacaagt

SEQ ID NO: 4589127 - DNA, 22 bp, Homo sapiens
ttgaagattctatgttaatatt

SEQ ID NO: 4589128 - DNA, 23 bp, Homo sapiens
ttgaagattctatgttaatattt

SEQ ID NO: 4589129 - DNA, 20 bp, Homo sapiens
ttgaagccaagtggggtgct

SEQ ID NO: 4589130 - DNA, 19 bp, Homo sapiens
ttgaagcctaaatttgtgc

SEQ ID NO: 4589131 - DNA, 17 bp, Homo sapiens
ttgaaggcaaaattgca

SEQ ID NO: 4589132 - DNA, 15 bp, Homo sapiens
ttgaaggtacacccc

SEQ ID NO: 4589133 - DNA, 15 bp, Homo sapiens
ttgaaggtagaatgt

SEQ ID NO: 4589134 - DNA, 16 bp, Homo sapiens
ttgaagtaatgaattt

SEQ ID NO: 4589135 - DNA, 20 bp, Homo sapiens
ttgaagtaattcttctgcct

SEQ ID NO: 4589136 - DNA, 22 bp, Homo sapiens
ttgaagttagtggaaatctgaa

SEQ ID NO: 4589137 - DNA, 21 bp, Homo sapiens
ttgaagttgtttatcaacttc

SEQ ID NO: 4589138 - DNA, 12 bp, Homo sapiens
ttgaataaacat

SEQ ID NO: 4589139 - DNA, 12 bp, Homo sapiens
ttgaataaagaa

SEQ ID NO: 4589140 - DNA, 23 bp, Homo sapiens
ttgaataagcagaacatactgtt

SEQ ID NO: 4589141 - DNA, 20 bp, Homo sapiens
ttgaataataagcaggatgt

SEQ ID NO: 4589142 - DNA, 20 bp, Homo sapiens
ttgaatactgtctgtatctt

SEQ ID NO: 4589143 - DNA, 12 bp, Homo sapiens
ttgaatactttt

SEQ ID NO: 4589144 - DNA, 13 bp, Homo sapiens
ttgaatacttttt

SEQ ID NO: 4589145 - DNA, 21 bp, Homo sapiens
ttgaatagtttatttctgtga

SEQ ID NO: 4589146 - DNA, 13 bp, Homo sapiens
ttgaatataaaaa

SEQ ID NO: 4589147 - DNA, 21 bp, Homo sapiens
ttgaatattactcctattttt

SEQ ID NO: 4589148 - DNA, 23 bp, Homo sapiens
ttgaatattactcctatttttgt

SEQ ID NO: 4589149 - DNA, 12 bp, Homo sapiens
ttgaatattata

SEQ ID NO: 4589150 - DNA, 15 bp, Homo sapiens
ttgaatattatatat

SEQ ID NO: 4589151 - DNA, 18 bp, Homo sapiens
ttgaatattttttgaagg

SEQ ID NO: 4589152 - DNA, 14 bp, Homo sapiens
ttgaatcaataata

SEQ ID NO: 4589153 - DNA, 17 bp, Homo sapiens
ttgaatgaaattccact

SEQ ID NO: 4589154 - DNA, 22 bp, Homo sapiens
ttgaatggagattctgattcag

SEQ ID NO: 4589155 - DNA, 16 bp, Homo sapiens
ttgaatggtgttgtat

SEQ ID NO: 4589156 - DNA, 20 bp, Homo sapiens
ttgaatggtgttgtatgcct

SEQ ID NO: 4589157 - DNA, 22 bp, Homo sapiens
ttgaatgtggcttgagaaatat

SEQ ID NO: 4589158 - DNA, 17 bp, Homo sapiens
ttgaattaaattaggaa

SEQ ID NO: 4589159 - DNA, 22 bp, Homo sapiens
ttgaattaaattaggaataaat

SEQ ID NO: 4589160 - DNA, 12 bp, Homo sapiens
ttgaattagaaa

SEQ ID NO: 4589161 - DNA, 12 bp, Homo sapiens
ttgaattatcag

SEQ ID NO: 4589162 - DNA, 20 bp, Homo sapiens
ttgaattatcagcaaagaaa

SEQ ID NO: 4589163 - DNA, 13 bp, Homo sapiens
ttgaattatcttg

SEQ ID NO: 4589164 - DNA, 18 bp, Homo sapiens
ttgaattatcttggttga

SEQ ID NO: 4589165 - DNA, 16 bp, Homo sapiens
ttgaattgatacctgt

SEQ ID NO: 4589166 - DNA, 18 bp, Homo sapiens
ttgaattgtaactgttct

SEQ ID NO: 4589167 - DNA, 18 bp, Homo sapiens
ttgacaaacacaattcta

SEQ ID NO: 4589168 - DNA, 20 bp, Homo sapiens
ttgacaaatgacagatcttt

SEQ ID NO: 4589169 - DNA, 22 bp, Homo sapiens
ttgacaaatgacagatcttttt

SEQ ID NO: 4589170 - DNA, 14 bp, Homo sapiens
ttgacaataaaata

SEQ ID NO: 4589171 - DNA, 16 bp, Homo sapiens
ttgacaataaaatatt

SEQ ID NO: 4589172 - DNA, 16 bp, Homo sapiens
ttgacacagaaaatgt

SEQ ID NO: 4589173 - DNA, 21 bp, Homo sapiens
ttgacaccacttagatttaaa

SEQ ID NO: 4589174 - DNA, 23 bp, Homo sapiens
ttgacactagcccaatgaaatga

SEQ ID NO: 4589175 - DNA, 21 bp, Homo sapiens
ttgacactgaaagttttgtaa

SEQ ID NO: 4589176 - DNA, 15 bp, Homo sapiens
ttgacactgaactta

SEQ ID NO: 4589177 - DNA, 14 bp, Homo sapiens
ttgacactgctcta

SEQ ID NO: 4589178 - DNA, 15 bp, Homo sapiens
ttgacactgctctaa

SEQ ID NO: 4589179 - DNA, 23 bp, Homo sapiens
ttgacactgctctaacagccctc

SEQ ID NO: 4589180 - DNA, 17 bp, Homo sapiens
ttgacacttaaaaatgg

SEQ ID NO: 4589181 - DNA, 19 bp, Homo sapiens
ttgacacttaaaaatggtt

SEQ ID NO: 4589182 - DNA, 18 bp, Homo sapiens
ttgacacttttcatatca

SEQ ID NO: 4589183 - DNA, 14 bp, Homo sapiens
ttgacagtgttttt

SEQ ID NO: 4589184 - DNA, 14 bp, Homo sapiens
ttgacattgcgttt

SEQ ID NO: 4589185 - DNA, 13 bp, Homo sapiens
ttgaccactccag

SEQ ID NO: 4589186 - DNA, 16 bp, Homo sapiens
ttgacccttgctgtga

SEQ ID NO: 4589187 - DNA, 21 bp, Homo sapiens
ttgaccttttatgtagtaatt

SEQ ID NO: 4589188 - DNA, 13 bp, Homo sapiens
ttgactctaatat

SEQ ID NO: 4589189 - DNA, 22 bp, Homo sapiens
ttgactctaatatgattataca

SEQ ID NO: 4589190 - DNA, 20 bp, Homo sapiens
ttgactgaagatgcagctca

SEQ ID NO: 4589191 - DNA, 12 bp, Homo sapiens
ttgactgtaatg

SEQ ID NO: 4589192 - DNA, 16 bp, Homo sapiens
ttgactgtagccacag

SEQ ID NO: 4589193 - DNA, 17 bp, Homo sapiens
ttgactgtgattagatc

SEQ ID NO: 4589194 - DNA, 18 bp, Homo sapiens
ttgacttatagtacatga

SEQ ID NO: 4589195 - DNA, 18 bp, Homo sapiens
ttgacttcattttatatt

SEQ ID NO: 4589196 - DNA, 13 bp, Homo sapiens
ttgactttataaa

SEQ ID NO: 4589197 - DNA, 14 bp, Homo sapiens
ttgactttgctcct

SEQ ID NO: 4589198 - DNA, 19 bp, Homo sapiens
ttgacttttctgtaattca

SEQ ID NO: 4589199 - DNA, 22 bp, Homo sapiens
ttgagaaaaatagagcaaaatc

SEQ ID NO: 4589200 - DNA, 19 bp, Homo sapiens
ttgagaaataattactaat

SEQ ID NO: 4589201 - DNA, 17 bp, Homo sapiens
ttgagaaccagtctcct

SEQ ID NO: 4589202 - DNA, 19 bp, Homo sapiens
ttgagaataagaatttgag

SEQ ID NO: 4589203 - DNA, 19 bp, Homo sapiens
ttgagaattcaaatcctct

SEQ ID NO: 4589204 - DNA, 15 bp, Homo sapiens
ttgagaccaggctgg

SEQ ID NO: 4589205 - DNA, 17 bp, Homo sapiens
ttgagacctcagccatg

SEQ ID NO: 4589206 - DNA, 16 bp, Homo sapiens
ttgagactgtcctgtg

SEQ ID NO: 4589207 - DNA, 21 bp, Homo sapiens
ttgagattcaaacccaggctg

SEQ ID NO: 4589208 - DNA, 15 bp, Homo sapiens
ttgagattgccccag

SEQ ID NO: 4589209 - DNA, 22 bp, Homo sapiens
ttgagattttccattaactatt

SEQ ID NO: 4589210 - DNA, 23 bp, Homo sapiens
ttgagattttccattaactattt

SEQ ID NO: 4589211 - DNA, 16 bp, Homo sapiens
ttgagattttttttcc

SEQ ID NO: 4589212 - DNA, 19 bp, Homo sapiens
ttgagcatattttcttact

SEQ ID NO: 4589213 - DNA, 19 bp, Homo sapiens
ttgagcatcaatcttgtta

SEQ ID NO: 4589214 - DNA, 12 bp, Homo sapiens
ttgagccacagt

SEQ ID NO: 4589215 - DNA, 19 bp, Homo sapiens
ttgagccatgctacagtta

SEQ ID NO: 4589216 - DNA, 19 bp, Homo sapiens
ttgagccgggcccctgggc

SEQ ID NO: 4589217 - DNA, 19 bp, Homo sapiens
ttgagctactggattctta

SEQ ID NO: 4589218 - DNA, 18 bp, Homo sapiens
ttgagctctctcattgtc

SEQ ID NO: 4589219 - DNA, 14 bp, Homo sapiens
ttgagctgccttcc

SEQ ID NO: 4589220 - DNA, 19 bp, Homo sapiens
ttgagctgccttccctagc

SEQ ID NO: 4589221 - DNA, 16 bp, Homo sapiens
ttgagcttaatctttg

SEQ ID NO: 4589222 - DNA, 13 bp, Homo sapiens
ttgaggaaaacaa

SEQ ID NO: 4589223 - DNA, 15 bp, Homo sapiens
ttgaggaaagaaata

SEQ ID NO: 4589224 - DNA, 15 bp, Homo sapiens
ttgaggaaagcaaga

SEQ ID NO: 4589225 - DNA, 15 bp, Homo sapiens
ttgaggaactgtaca

SEQ ID NO: 4589226 - DNA, 16 bp, Homo sapiens
ttgaggtaaagatatg

SEQ ID NO: 4589227 - DNA, 22 bp, Homo sapiens
ttgaggtggaagccctccttcc

SEQ ID NO: 4589228 - DNA, 23 bp, Homo sapiens
ttgagtcattgacttcattttat

SEQ ID NO: 4589229 - DNA, 16 bp, Homo sapiens
ttgagtccacgcccac

SEQ ID NO: 4589230 - DNA, 17 bp, Homo sapiens
ttgagtcctaggactta

SEQ ID NO: 4589231 - DNA, 22 bp, Homo sapiens
ttgagtctgtttttttatagtt

SEQ ID NO: 4589232 - DNA, 14 bp, Homo sapiens
ttgagtgagaagag

SEQ ID NO: 4589233 - DNA, 16 bp, Homo sapiens
ttgagtggctgtctta

SEQ ID NO: 4589234 - DNA, 13 bp, Homo sapiens
ttgagtgtttaaa

SEQ ID NO: 4589235 - DNA, 14 bp, Homo sapiens
ttgagttttcagtg

SEQ ID NO: 4589236 - DNA, 20 bp, Homo sapiens
ttgataaaccaaaaacattt

SEQ ID NO: 4589237 - DNA, 22 bp, Homo sapiens
ttgataaagattttttaataat

SEQ ID NO: 4589238 - DNA, 13 bp, Homo sapiens
ttgatagaaccat

SEQ ID NO: 4589239 - DNA, 23 bp, Homo sapiens
ttgataggccgttggttgtctga

SEQ ID NO: 4589240 - DNA, 19 bp, Homo sapiens
ttgatagtcctgacctcat

SEQ ID NO: 4589241 - DNA, 17 bp, Homo sapiens
ttgatagttctataaga

SEQ ID NO: 4589242 - DNA, 18 bp, Homo sapiens
ttgatataattgtactgt

SEQ ID NO: 4589243 - DNA, 16 bp, Homo sapiens
ttgatattgtttgctg

SEQ ID NO: 4589244 - DNA, 16 bp, Homo sapiens
ttgatcacacagtgtt

SEQ ID NO: 4589245 - DNA, 17 bp, Homo sapiens
ttgatcacatgcttgaa

SEQ ID NO: 4589246 - DNA, 12 bp, Homo sapiens
ttgatcaccatg

SEQ ID NO: 4589247 - DNA, 19 bp, Homo sapiens
ttgatccagaagagcccat

SEQ ID NO: 4589248 - DNA, 21 bp, Homo sapiens
ttgatcccttctcctgccctt

SEQ ID NO: 4589249 - DNA, 19 bp, Homo sapiens
ttgatctatctacaaagaa

SEQ ID NO: 4589250 - DNA, 12 bp, Homo sapiens
ttgatctctctt

SEQ ID NO: 4589251 - DNA, 17 bp, Homo sapiens
ttgatctctcttgtcct

SEQ ID NO: 4589252 - DNA, 18 bp, Homo sapiens
ttgatctttgtttaaatg

SEQ ID NO: 4589253 - DNA, 19 bp, Homo sapiens
ttgatctttgtttaaatgc

SEQ ID NO: 4589254 - DNA, 16 bp, Homo sapiens
ttgatctttttatcat

SEQ ID NO: 4589255 - DNA, 18 bp, Homo sapiens
ttgatctttttatcatga

SEQ ID NO: 4589256 - DNA, 20 bp, Homo sapiens
ttgatgaccaaagtcctttt

SEQ ID NO: 4589257 - DNA, 20 bp, Homo sapiens
ttgatgagttaactgtgaaa

SEQ ID NO: 4589258 - DNA, 18 bp, Homo sapiens
ttgatgcagataaaatat

SEQ ID NO: 4589259 - DNA, 14 bp, Homo sapiens
ttgatgcagcattt

SEQ ID NO: 4589260 - DNA, 18 bp, Homo sapiens
ttgatgcagcatttgata

SEQ ID NO: 4589261 - DNA, 14 bp, Homo sapiens
ttgatgccaaaaaa

SEQ ID NO: 4589262 - DNA, 21 bp, Homo sapiens
ttgatggagtgtgagccacct

SEQ ID NO: 4589263 - DNA, 19 bp, Homo sapiens
ttgatgtacagtctgtcat

SEQ ID NO: 4589264 - DNA, 23 bp, Homo sapiens
ttgatgtctccaagtagtccacc

SEQ ID NO: 4589265 - DNA, 16 bp, Homo sapiens
ttgatgtgtgtctagg

SEQ ID NO: 4589266 - DNA, 13 bp, Homo sapiens
ttgatgtttgtgg

SEQ ID NO: 4589267 - DNA, 15 bp, Homo sapiens
ttgatgtttgtggcc

SEQ ID NO: 4589268 - DNA, 19 bp, Homo sapiens
ttgatgtttgtggcctcag

SEQ ID NO: 4589269 - DNA, 11 bp, Homo sapiens
ttgatgttttt

SEQ ID NO: 4589270 - DNA, 13 bp, Homo sapiens
ttgattaaattgc

SEQ ID NO: 4589271 - DNA, 14 bp, Homo sapiens
ttgattaagtaaat

SEQ ID NO: 4589272 - DNA, 21 bp, Homo sapiens
ttgattatgtatggatatatt

SEQ ID NO: 4589273 - DNA, 12 bp, Homo sapiens
ttgattcaaaat

SEQ ID NO: 4589274 - DNA, 17 bp, Homo sapiens
ttgattcaaggctcaga

SEQ ID NO: 4589275 - DNA, 14 bp, Homo sapiens
ttgattcagcaaaa

SEQ ID NO: 4589276 - DNA, 19 bp, Homo sapiens
ttgattcatagtaacttct

SEQ ID NO: 4589277 - DNA, 20 bp, Homo sapiens
ttgattctccttcagccctc

SEQ ID NO: 4589278 - DNA, 13 bp, Homo sapiens
ttgattgatttga

SEQ ID NO: 4589279 - DNA, 14 bp, Homo sapiens
ttgattgatttgaa

SEQ ID NO: 4589280 - DNA, 20 bp, Homo sapiens
ttgatttgatctttgtttaa

SEQ ID NO: 4589281 - DNA, 14 bp, Homo sapiens
ttgatttgcattga

SEQ ID NO: 4589282 - DNA, 20 bp, Homo sapiens
ttgatttttgcctcttccag

SEQ ID NO: 4589283 - DNA, 19 bp, Homo sapiens
ttgcaaaaaatgtttttgg

SEQ ID NO: 4589284 - DNA, 23 bp, Homo sapiens
ttgcaaacctgcagtttttaatt

SEQ ID NO: 4589285 - DNA, 13 bp, Homo sapiens
ttgcaaagtactg

SEQ ID NO: 4589286 - DNA, 18 bp, Homo sapiens
ttgcaaagtattgtaaat

SEQ ID NO: 4589287 - DNA, 17 bp, Homo sapiens
ttgcaaatcttgaaatt

SEQ ID NO: 4589288 - DNA, 18 bp, Homo sapiens
ttgcaaatgagggaagaa

SEQ ID NO: 4589289 - DNA, 14 bp, Homo sapiens
ttgcaacagcagtg

SEQ ID NO: 4589290 - DNA, 14 bp, Homo sapiens
ttgcaaccgtctgt

SEQ ID NO: 4589291 - DNA, 19 bp, Homo sapiens
ttgcaacctcaccttcctg

SEQ ID NO: 4589292 - DNA, 20 bp, Homo sapiens
ttgcaacctcaccttcctgt

SEQ ID NO: 4589293 - DNA, 15 bp, Homo sapiens
ttgcaagatgtgaat

SEQ ID NO: 4589294 - DNA, 16 bp, Homo sapiens
ttgcaagatgtgaatt

SEQ ID NO: 4589295 - DNA, 19 bp, Homo sapiens
ttgcaagatgtgaattatt

SEQ ID NO: 4589296 - DNA, 17 bp, Homo sapiens
ttgcaaggccgctgttc

SEQ ID NO: 4589297 - DNA, 19 bp, Homo sapiens
ttgcaagggaaaagtctct

SEQ ID NO: 4589298 - DNA, 22 bp, Homo sapiens
ttgcaagggaaaagtctcttgt

SEQ ID NO: 4589299 - DNA, 13 bp, Homo sapiens
ttgcaataatgca

SEQ ID NO: 4589300 - DNA, 21 bp, Homo sapiens
ttgcaataatgcagtatggta

SEQ ID NO: 4589301 - DNA, 17 bp, Homo sapiens
ttgcaatagcagttata

SEQ ID NO: 4589302 - DNA, 15 bp, Homo sapiens
ttgcaatccaggctg

SEQ ID NO: 4589303 - DNA, 23 bp, Homo sapiens
ttgcaatccaggctgttctcagc

SEQ ID NO: 4589304 - DNA, 18 bp, Homo sapiens
ttgcaatcccttaatatc

SEQ ID NO: 4589305 - DNA, 18 bp, Homo sapiens
ttgcaatctaatctgaac

SEQ ID NO: 4589306 - DNA, 22 bp, Homo sapiens
ttgcaattagaaatattaaaga

SEQ ID NO: 4589307 - DNA, 12 bp, Homo sapiens
ttgcacaatatt

SEQ ID NO: 4589308 - DNA, 16 bp, Homo sapiens
ttgcacaatatttctt

SEQ ID NO: 4589309 - DNA, 21 bp, Homo sapiens
ttgcacaatatttcttttgtt

SEQ ID NO: 4589310 - DNA, 22 bp, Homo sapiens
ttgcacacaaaaataaagacta

SEQ ID NO: 4589311 - DNA, 13 bp, Homo sapiens
ttgcacagggatt

SEQ ID NO: 4589312 - DNA, 14 bp, Homo sapiens
ttgcaccattttca

SEQ ID NO: 4589313 - DNA, 13 bp, Homo sapiens
ttgcacccagccc

SEQ ID NO: 4589314 - DNA, 16 bp, Homo sapiens
ttgcacccagccctgg

SEQ ID NO: 4589315 - DNA, 14 bp, Homo sapiens
ttgcactgaacagg

SEQ ID NO: 4589316 - DNA, 22 bp, Homo sapiens
ttgcactgttctgattatgtaa

SEQ ID NO: 4589317 - DNA, 14 bp, Homo sapiens
ttgcactgtttgca

SEQ ID NO: 4589318 - DNA, 21 bp, Homo sapiens
ttgcagaaaagcacctgccga

SEQ ID NO: 4589319 - DNA, 17 bp, Homo sapiens
ttgcagggtcctcttct

SEQ ID NO: 4589320 - DNA, 21 bp, Homo sapiens
ttgcagggtgggtgagctctc

SEQ ID NO: 4589321 - DNA, 16 bp, Homo sapiens
ttgcagttcagcacca

SEQ ID NO: 4589322 - DNA, 23 bp, Homo sapiens
ttgcatattgaaaagcacagagg

SEQ ID NO: 4589323 - DNA, 15 bp, Homo sapiens
ttgcatattttgaga

SEQ ID NO: 4589324 - DNA, 18 bp, Homo sapiens
ttgcatattttgagaaac

SEQ ID NO: 4589325 - DNA, 15 bp, Homo sapiens
ttgcatccattgttg

SEQ ID NO: 4589326 - DNA, 19 bp, Homo sapiens
ttgcatgttccactaaccc

SEQ ID NO: 4589327 - DNA, 16 bp, Homo sapiens
ttgcatgtttttgaaa

SEQ ID NO: 4589328 - DNA, 20 bp, Homo sapiens
ttgcattaaattcacaaact

SEQ ID NO: 4589329 - DNA, 15 bp, Homo sapiens
ttgcattgaacacaa

SEQ ID NO: 4589330 - DNA, 18 bp, Homo sapiens
ttgcattgaacacaaact

SEQ ID NO: 4589331 - DNA, 23 bp, Homo sapiens
ttgcattgaacacaaactgtaaa

SEQ ID NO: 4589332 - DNA, 15 bp, Homo sapiens
ttgcatttaaaacag

SEQ ID NO: 4589333 - DNA, 19 bp, Homo sapiens
ttgcatttaaacatgttta

SEQ ID NO: 4589334 - DNA, 22 bp, Homo sapiens
ttgccaaaataccagagccttc

SEQ ID NO: 4589335 - DNA, 23 bp, Homo sapiens
ttgccaaaataccagagccttca

SEQ ID NO: 4589336 - DNA, 19 bp, Homo sapiens
ttgccaaaatcctgaactt

SEQ ID NO: 4589337 - DNA, 19 bp, Homo sapiens
ttgccaagctaatctgcct

SEQ ID NO: 4589338 - DNA, 18 bp, Homo sapiens
ttgccaatagtgtcatcc

SEQ ID NO: 4589339 - DNA, 21 bp, Homo sapiens
ttgccacatggtgtctcccaa

SEQ ID NO: 4589340 - DNA, 23 bp, Homo sapiens
ttgccacatggtgtctcccaaca

SEQ ID NO: 4589341 - DNA, 13 bp, Homo sapiens
ttgccaccaggag

SEQ ID NO: 4589342 - DNA, 17 bp, Homo sapiens
ttgccaccccaccctcc

SEQ ID NO: 4589343 - DNA, 22 bp, Homo sapiens
ttgccaccccaccctccctgga

SEQ ID NO: 4589344 - DNA, 13 bp, Homo sapiens
ttgccagaggccc

SEQ ID NO: 4589345 - DNA, 14 bp, Homo sapiens
ttgccagaggccct

SEQ ID NO: 4589346 - DNA, 15 bp, Homo sapiens
ttgccagaggccctg

SEQ ID NO: 4589347 - DNA, 14 bp, Homo sapiens
ttgccagcagagcc

SEQ ID NO: 4589348 - DNA, 21 bp, Homo sapiens
ttgccagggatgggcagccca

SEQ ID NO: 4589349 - DNA, 13 bp, Homo sapiens
ttgccagtgtctt

SEQ ID NO: 4589350 - DNA, 18 bp, Homo sapiens
ttgccagttttccctgga

SEQ ID NO: 4589351 - DNA, 19 bp, Homo sapiens
ttgccatattttcaccatt

SEQ ID NO: 4589352 - DNA, 13 bp, Homo sapiens
ttgccatcactgg

SEQ ID NO: 4589353 - DNA, 13 bp, Homo sapiens
ttgccatttagcg

SEQ ID NO: 4589354 - DNA, 17 bp, Homo sapiens
ttgcccagagatgcctc

SEQ ID NO: 4589355 - DNA, 10 bp, Homo sapiens
ttgcccagct

SEQ ID NO: 4589356 - DNA, 13 bp, Homo sapiens
ttgcccagtgagc

SEQ ID NO: 4589357 - DNA, 15 bp, Homo sapiens
ttgcccatgatataa

SEQ ID NO: 4589358 - DNA, 21 bp, Homo sapiens
ttgccccatccagacctggct

SEQ ID NO: 4589359 - DNA, 15 bp, Homo sapiens
ttgccccctctcact

SEQ ID NO: 4589360 - DNA, 13 bp, Homo sapiens
ttgcccctctgcc

SEQ ID NO: 4589361 - DNA, 15 bp, Homo sapiens
ttgcccctctgcctt

SEQ ID NO: 4589362 - DNA, 13 bp, Homo sapiens
ttgcccctggctt

SEQ ID NO: 4589363 - DNA, 18 bp, Homo sapiens
ttgcccctggctttgcct

SEQ ID NO: 4589364 - DNA, 19 bp, Homo sapiens
ttgcccctggctttgcctc

SEQ ID NO: 4589365 - DNA, 20 bp, Homo sapiens
ttgcccgaaactaagccagg

SEQ ID NO: 4589366 - DNA, 21 bp, Homo sapiens
ttgcccgctcccacagcttcc

SEQ ID NO: 4589367 - DNA, 13 bp, Homo sapiens
ttgccctcctggg

SEQ ID NO: 4589368 - DNA, 21 bp, Homo sapiens
ttgccctcctgggccctgggc

SEQ ID NO: 4589369 - DNA, 22 bp, Homo sapiens
ttgcctccccatttcccatctg

SEQ ID NO: 4589370 - DNA, 19 bp, Homo sapiens
ttgcctcctgtgtactgtg

SEQ ID NO: 4589371 - DNA, 21 bp, Homo sapiens
ttgcctcctgtgtactgtgtc

SEQ ID NO: 4589372 - DNA, 13 bp, Homo sapiens
ttgcctctctctt

SEQ ID NO: 4589373 - DNA, 14 bp, Homo sapiens
ttgcctctgccctg

SEQ ID NO: 4589374 - DNA, 17 bp, Homo sapiens
ttgcctctgccctggat

SEQ ID NO: 4589375 - DNA, 19 bp, Homo sapiens
ttgcctctgccctggattg

SEQ ID NO: 4589376 - DNA, 17 bp, Homo sapiens
ttgcctctgtccccttc

SEQ ID NO: 4589377 - DNA, 18 bp, Homo sapiens
ttgcctctgtccccttct

SEQ ID NO: 4589378 - DNA, 17 bp, Homo sapiens
ttgcctctttctccagc

SEQ ID NO: 4589379 - DNA, 20 bp, Homo sapiens
ttgcctcttttacctgctgc

SEQ ID NO: 4589380 - DNA, 15 bp, Homo sapiens
ttgcctgaggctgta

SEQ ID NO: 4589381 - DNA, 12 bp, Homo sapiens
ttgcctgcagtt

SEQ ID NO: 4589382 - DNA, 15 bp, Homo sapiens
ttgccttatttgtct

SEQ ID NO: 4589383 - DNA, 17 bp, Homo sapiens
ttgccttatttgtctgt

SEQ ID NO: 4589384 - DNA, 19 bp, Homo sapiens
ttgccttatttgtctgtaa

SEQ ID NO: 4589385 - DNA, 15 bp, Homo sapiens
ttgccttctactccc

SEQ ID NO: 4589386 - DNA, 18 bp, Homo sapiens
ttgccttctactcccctt

SEQ ID NO: 4589387 - DNA, 14 bp, Homo sapiens
ttgccttctcacca

SEQ ID NO: 4589388 - DNA, 20 bp, Homo sapiens
ttgccttctcaccagctgca

SEQ ID NO: 4589389 - DNA, 21 bp, Homo sapiens
ttgccttctggagctgggaga

SEQ ID NO: 4589390 - DNA, 22 bp, Homo sapiens
ttgccttgaaatttacacagtg

SEQ ID NO: 4589391 - DNA, 15 bp, Homo sapiens
ttgcctttaatattt

SEQ ID NO: 4589392 - DNA, 16 bp, Homo sapiens
ttgcctttgaatgtta

SEQ ID NO: 4589393 - DNA, 17 bp, Homo sapiens
ttgcctttgaatgttaa

SEQ ID NO: 4589394 - DNA, 18 bp, Homo sapiens
ttgccttttgttaatgca

SEQ ID NO: 4589395 - DNA, 22 bp, Homo sapiens
ttgccttttgttaatgcattgt

SEQ ID NO: 4589396 - DNA, 14 bp, Homo sapiens
ttgcgagtccaagg

SEQ ID NO: 4589397 - DNA, 23 bp, Homo sapiens
ttgcgctcaggggctccatgctg

SEQ ID NO: 4589398 - DNA, 16 bp, Homo sapiens
ttgcggcaaaaggaaa

SEQ ID NO: 4589399 - DNA, 21 bp, Homo sapiens
ttgctaaaagcatgtatagtt

SEQ ID NO: 4589400 - DNA, 15 bp, Homo sapiens
ttgctaatgtataat

SEQ ID NO: 4589401 - DNA, 16 bp, Homo sapiens
ttgctacataattatc

SEQ ID NO: 4589402 - DNA, 12 bp, Homo sapiens
ttgctaccagta

SEQ ID NO: 4589403 - DNA, 15 bp, Homo sapiens
ttgctaccagtattt

SEQ ID NO: 4589404 - DNA, 16 bp, Homo sapiens
ttgctaccagtattta

SEQ ID NO: 4589405 - DNA, 18 bp, Homo sapiens
ttgctacctcagtgctcc

SEQ ID NO: 4589406 - DNA, 18 bp, Homo sapiens
ttgctactataatcaaat

SEQ ID NO: 4589407 - DNA, 21 bp, Homo sapiens
ttgctatgtgccttatgttga

SEQ ID NO: 4589408 - DNA, 18 bp, Homo sapiens
ttgctcaaaaaatgagct

SEQ ID NO: 4589409 - DNA, 12 bp, Homo sapiens
ttgctcaaaatc

SEQ ID NO: 4589410 - DNA, 17 bp, Homo sapiens
ttgctcagagaaggaaa

SEQ ID NO: 4589411 - DNA, 19 bp, Homo sapiens
ttgctcaggtgcaagtgcc

SEQ ID NO: 4589412 - DNA, 14 bp, Homo sapiens
ttgctcccaaccca

SEQ ID NO: 4589413 - DNA, 15 bp, Homo sapiens
ttgctccctctccaa

SEQ ID NO: 4589414 - DNA, 19 bp, Homo sapiens
ttgctcgcccagacaccat

SEQ ID NO: 4589415 - DNA, 21 bp, Homo sapiens
ttgctcgcccagacaccatgt

SEQ ID NO: 4589416 - DNA, 23 bp, Homo sapiens
ttgctctatatgtaatatatcct

SEQ ID NO: 4589417 - DNA, 15 bp, Homo sapiens
ttgctctatgtctgc

SEQ ID NO: 4589418 - DNA, 16 bp, Homo sapiens
ttgctctatgtctgcc

SEQ ID NO: 4589419 - DNA, 12 bp, Homo sapiens
ttgctctcctca

SEQ ID NO: 4589420 - DNA, 13 bp, Homo sapiens
ttgctctctgtga

SEQ ID NO: 4589421 - DNA, 17 bp, Homo sapiens
ttgctctctgtgaccct

SEQ ID NO: 4589422 - DNA, 16 bp, Homo sapiens
ttgctctgacctcctc

SEQ ID NO: 4589423 - DNA, 22 bp, Homo sapiens
ttgctctgtcccccaggctgga

SEQ ID NO: 4589424 - DNA, 16 bp, Homo sapiens
ttgctctgtgtatatc

SEQ ID NO: 4589425 - DNA, 18 bp, Homo sapiens
ttgctctgtgtatatctc

SEQ ID NO: 4589426 - DNA, 23 bp, Homo sapiens
ttgctctgtgtatatctcttgga

SEQ ID NO: 4589427 - DNA, 11 bp, Homo sapiens
ttgctgaaatt

SEQ ID NO: 4589428 - DNA, 11 bp, Homo sapiens
ttgctgaactc

SEQ ID NO: 4589429 - DNA, 19 bp, Homo sapiens
ttgctgaattcctttacaa

SEQ ID NO: 4589430 - DNA, 14 bp, Homo sapiens
ttgctgagccagct

SEQ ID NO: 4589431 - DNA, 19 bp, Homo sapiens
ttgctgatgggttcttaga

SEQ ID NO: 4589432 - DNA, 13 bp, Homo sapiens
ttgctgcaaacct

SEQ ID NO: 4589433 - DNA, 15 bp, Homo sapiens
ttgctgcaaacctga

SEQ ID NO: 4589434 - DNA, 17 bp, Homo sapiens
ttgctgcactcttgcac

SEQ ID NO: 4589435 - DNA, 15 bp, Homo sapiens
ttgctgcttgatgat

SEQ ID NO: 4589436 - DNA, 14 bp, Homo sapiens
ttgctggaacacag

SEQ ID NO: 4589437 - DNA, 12 bp, Homo sapiens
ttgctgggcttt

SEQ ID NO: 4589438 - DNA, 16 bp, Homo sapiens
ttgctgtgactagata

SEQ ID NO: 4589439 - DNA, 15 bp, Homo sapiens
ttgctgttaaaaata

SEQ ID NO: 4589440 - DNA, 14 bp, Homo sapiens
ttgctgttactgct

SEQ ID NO: 4589441 - DNA, 14 bp, Homo sapiens
ttgctgtttactcc

SEQ ID NO: 4589442 - DNA, 15 bp, Homo sapiens
ttgcttaaaagcatt

SEQ ID NO: 4589443 - DNA, 14 bp, Homo sapiens
ttgcttaaaatata

SEQ ID NO: 4589444 - DNA, 18 bp, Homo sapiens
ttgcttaaaatatgtgaa

SEQ ID NO: 4589445 - DNA, 23 bp, Homo sapiens
ttgcttaaatttcttatgtgaca

SEQ ID NO: 4589446 - DNA, 23 bp, Homo sapiens
ttgcttaacttccatgttctggg

SEQ ID NO: 4589447 - DNA, 13 bp, Homo sapiens
ttgcttacatcct

SEQ ID NO: 4589448 - DNA, 20 bp, Homo sapiens
ttgcttcaatttcaaacttt

SEQ ID NO: 4589449 - DNA, 13 bp, Homo sapiens
ttgcttcagtgga

SEQ ID NO: 4589450 - DNA, 15 bp, Homo sapiens
ttgcttcctgtgtaa

SEQ ID NO: 4589451 - DNA, 16 bp, Homo sapiens
ttgcttctaaatgccc

SEQ ID NO: 4589452 - DNA, 13 bp, Homo sapiens
ttgcttctgcagc

SEQ ID NO: 4589453 - DNA, 17 bp, Homo sapiens
ttgcttcttgtgtttta

SEQ ID NO: 4589454 - DNA, 12 bp, Homo sapiens
ttgcttctttct

SEQ ID NO: 4589455 - DNA, 17 bp, Homo sapiens
ttgcttctttctagaaa

SEQ ID NO: 4589456 - DNA, 20 bp, Homo sapiens
ttgcttctttctagaaagag

SEQ ID NO: 4589457 - DNA, 18 bp, Homo sapiens
ttgcttgaacacagtatt

SEQ ID NO: 4589458 - DNA, 19 bp, Homo sapiens
ttgcttgaacacagtattt

SEQ ID NO: 4589459 - DNA, 16 bp, Homo sapiens
ttgcttgagcaggatt

SEQ ID NO: 4589460 - DNA, 13 bp, Homo sapiens
ttgcttgatccag

SEQ ID NO: 4589461 - DNA, 17 bp, Homo sapiens
ttgcttgatccagaaga

SEQ ID NO: 4589462 - DNA, 23 bp, Homo sapiens
ttgcttgcaatctaatctgaact

SEQ ID NO: 4589463 - DNA, 16 bp, Homo sapiens
ttgcttgccaaagtac

SEQ ID NO: 4589464 - DNA, 13 bp, Homo sapiens
ttgcttgcttttt

SEQ ID NO: 4589465 - DNA, 15 bp, Homo sapiens
ttgcttgtattgtaa

SEQ ID NO: 4589466 - DNA, 18 bp, Homo sapiens
ttgcttgtattgtaaatg

SEQ ID NO: 4589467 - DNA, 21 bp, Homo sapiens
ttgcttgtattgtaaatgtgg

SEQ ID NO: 4589468 - DNA, 14 bp, Homo sapiens
ttgctttaatgaga

SEQ ID NO: 4589469 - DNA, 15 bp, Homo sapiens
ttgctttattccaga

SEQ ID NO: 4589470 - DNA, 16 bp, Homo sapiens
ttgctttcctgggcct

SEQ ID NO: 4589471 - DNA, 12 bp, Homo sapiens
ttgctttgcttt

SEQ ID NO: 4589472 - DNA, 15 bp, Homo sapiens
ttgctttggaaacac

SEQ ID NO: 4589473 - DNA, 18 bp, Homo sapiens
ttgctttgtagtttgctt

SEQ ID NO: 4589474 - DNA, 20 bp, Homo sapiens
ttgctttgtattgtatatta

SEQ ID NO: 4589475 - DNA, 23 bp, Homo sapiens
ttgctttgttaaaaaaaaaaaga

SEQ ID NO: 4589476 - DNA, 13 bp, Homo sapiens
ttgcttttgcttc

SEQ ID NO: 4589477 - DNA, 21 bp, Homo sapiens
ttggaaaaatgggtcttttat

SEQ ID NO: 4589478 - DNA, 16 bp, Homo sapiens
ttggaaaatgacattt

SEQ ID NO: 4589479 - DNA, 11 bp, Homo sapiens
ttggaaagagt

SEQ ID NO: 4589480 - DNA, 21 bp, Homo sapiens
ttggaaagtacactctgctgt

SEQ ID NO: 4589481 - DNA, 12 bp, Homo sapiens
ttggaaagtcag

SEQ ID NO: 4589482 - DNA, 21 bp, Homo sapiens
ttggaaagtgccagcattcca

SEQ ID NO: 4589483 - DNA, 17 bp, Homo sapiens
ttggaaataaaaatgtt

SEQ ID NO: 4589484 - DNA, 17 bp, Homo sapiens
ttggaaccatgccttcc

SEQ ID NO: 4589485 - DNA, 17 bp, Homo sapiens
ttggaactagtcattaa

SEQ ID NO: 4589486 - DNA, 15 bp, Homo sapiens
ttggaactgtgtttc

SEQ ID NO: 4589487 - DNA, 22 bp, Homo sapiens
ttggaagatggcataacctgtc

SEQ ID NO: 4589488 - DNA, 12 bp, Homo sapiens
ttggaagctgct

SEQ ID NO: 4589489 - DNA, 13 bp, Homo sapiens
ttggaatactttt

SEQ ID NO: 4589490 - DNA, 23 bp, Homo sapiens
ttggaatattgtccattgtccaa

SEQ ID NO: 4589491 - DNA, 18 bp, Homo sapiens
ttggaatattttatcctg

SEQ ID NO: 4589492 - DNA, 22 bp, Homo sapiens
ttggaatattttatcctgtatt

SEQ ID NO: 4589493 - DNA, 14 bp, Homo sapiens
ttggaatcaaggta

SEQ ID NO: 4589494 - DNA, 17 bp, Homo sapiens
ttggaattggaattact

SEQ ID NO: 4589495 - DNA, 19 bp, Homo sapiens
ttggacaaatcacatattt

SEQ ID NO: 4589496 - DNA, 18 bp, Homo sapiens
ttggacagaaaatgcaat

SEQ ID NO: 4589497 - DNA, 22 bp, Homo sapiens
ttggacagacccacccccagcc

SEQ ID NO: 4589498 - DNA, 15 bp, Homo sapiens
ttggacattttatgt

SEQ ID NO: 4589499 - DNA, 19 bp, Homo sapiens
ttggacccagggcctgact

SEQ ID NO: 4589500 - DNA, 21 bp, Homo sapiens
ttggacccagggcctgacttg

SEQ ID NO: 4589501 - DNA, 17 bp, Homo sapiens
ttggacctaatccaagc

SEQ ID NO: 4589502 - DNA, 21 bp, Homo sapiens
ttggacggcctgatgctccct

SEQ ID NO: 4589503 - DNA, 13 bp, Homo sapiens
ttggactacacaa

SEQ ID NO: 4589504 - DNA, 15 bp, Homo sapiens
ttggactacacaata

SEQ ID NO: 4589505 - DNA, 15 bp, Homo sapiens
ttggactctcaggga

SEQ ID NO: 4589506 - DNA, 21 bp, Homo sapiens
ttggagaaggagattttaagg

SEQ ID NO: 4589507 - DNA, 15 bp, Homo sapiens
ttggagaccttaccc

SEQ ID NO: 4589508 - DNA, 21 bp, Homo sapiens
ttggagcacaaaattcaaagc

SEQ ID NO: 4589509 - DNA, 17 bp, Homo sapiens
ttggagcattaactaaa

SEQ ID NO: 4589510 - DNA, 12 bp, Homo sapiens
ttggagggatgg

SEQ ID NO: 4589511 - DNA, 22 bp, Homo sapiens
ttggagggtcccaagctgggcc

SEQ ID NO: 4589512 - DNA, 15 bp, Homo sapiens
ttggagtcactgcca

SEQ ID NO: 4589513 - DNA, 20 bp, Homo sapiens
ttggagtttgggctggagct

SEQ ID NO: 4589514 - DNA, 19 bp, Homo sapiens
ttggatatgtaaaacattt

SEQ ID NO: 4589515 - DNA, 13 bp, Homo sapiens
ttggatccaagga

SEQ ID NO: 4589516 - DNA, 22 bp, Homo sapiens
ttggatggtgttacatattata

SEQ ID NO: 4589517 - DNA, 19 bp, Homo sapiens
ttggatttaaaagcctgct

SEQ ID NO: 4589518 - DNA, 14 bp, Homo sapiens
ttggatttcgtgtg

SEQ ID NO: 4589519 - DNA, 20 bp, Homo sapiens
ttggatttcgtgtgccgctg

SEQ ID NO: 4589520 - DNA, 16 bp, Homo sapiens
ttggatttctgtgaag

SEQ ID NO: 4589521 - DNA, 14 bp, Homo sapiens
ttggatttgacatt

SEQ ID NO: 4589522 - DNA, 14 bp, Homo sapiens
ttggatttgctgtg

SEQ ID NO: 4589523 - DNA, 18 bp, Homo sapiens
ttggatttgctgtgacta

SEQ ID NO: 4589524 - DNA, 20 bp, Homo sapiens
ttggattttgcaaggtgcat

SEQ ID NO: 4589525 - DNA, 16 bp, Homo sapiens
ttggcaaactaaagga

SEQ ID NO: 4589526 - DNA, 12 bp, Homo sapiens
ttggcaaagttt

SEQ ID NO: 4589527 - DNA, 22 bp, Homo sapiens
ttggcaaagtttaaatgtattt

SEQ ID NO: 4589528 - DNA, 19 bp, Homo sapiens
ttggcaatttcctggccct

SEQ ID NO: 4589529 - DNA, 20 bp, Homo sapiens
ttggcaatttcctggccctc

SEQ ID NO: 4589530 - DNA, 20 bp, Homo sapiens
ttggcacatgccacctggca

SEQ ID NO: 4589531 - DNA, 12 bp, Homo sapiens
ttggcaccccca

SEQ ID NO: 4589532 - DNA, 20 bp, Homo sapiens
ttggcacccccatgctgcct

SEQ ID NO: 4589533 - DNA, 15 bp, Homo sapiens
ttggcactctctgcc

SEQ ID NO: 4589534 - DNA, 14 bp, Homo sapiens
ttggcactgtaagg

SEQ ID NO: 4589535 - DNA, 19 bp, Homo sapiens
ttggcacttgccattccaa

SEQ ID NO: 4589536 - DNA, 17 bp, Homo sapiens
ttggcataatttgtctt

SEQ ID NO: 4589537 - DNA, 22 bp, Homo sapiens
ttggccaatgcacctaaagaaa

SEQ ID NO: 4589538 - DNA, 17 bp, Homo sapiens
ttggcccagagacggag

SEQ ID NO: 4589539 - DNA, 14 bp, Homo sapiens
ttggccgagctcct

SEQ ID NO: 4589540 - DNA, 17 bp, Homo sapiens
ttggccgagctcctggg

SEQ ID NO: 4589541 - DNA, 19 bp, Homo sapiens
ttggccgagctcctgggga

SEQ ID NO: 4589542 - DNA, 12 bp, Homo sapiens
ttggcctgctgt

SEQ ID NO: 4589543 - DNA, 18 bp, Homo sapiens
ttggcctggggtgcatct

SEQ ID NO: 4589544 - DNA, 16 bp, Homo sapiens
ttggcctgtctcatcc

SEQ ID NO: 4589545 - DNA, 22 bp, Homo sapiens
ttggcctgtctcatccccaggg

SEQ ID NO: 4589546 - DNA, 11 bp, Homo sapiens
ttggccttaag

SEQ ID NO: 4589547 - DNA, 17 bp, Homo sapiens
ttggctataagtgctca

SEQ ID NO: 4589548 - DNA, 23 bp, Homo sapiens
ttggctgagatatgaacatattg

SEQ ID NO: 4589549 - DNA, 17 bp, Homo sapiens
ttggctgccgtctggcc

SEQ ID NO: 4589550 - DNA, 19 bp, Homo sapiens
ttggctgcgctaaccccca

SEQ ID NO: 4589551 - DNA, 14 bp, Homo sapiens
ttggctgttccaga

SEQ ID NO: 4589552 - DNA, 22 bp, Homo sapiens
ttggctgttttccctctgctgc

SEQ ID NO: 4589553 - DNA, 21 bp, Homo sapiens
ttggcttccagattttaaatt

SEQ ID NO: 4589554 - DNA, 16 bp, Homo sapiens
ttggcttctgtttcta

SEQ ID NO: 4589555 - DNA, 23 bp, Homo sapiens
ttggctttcagagccagcctggc

SEQ ID NO: 4589556 - DNA, 15 bp, Homo sapiens
ttggctttcataaat

SEQ ID NO: 4589557 - DNA, 22 bp, Homo sapiens
ttgggaaattaaatccaataaa

SEQ ID NO: 4589558 - DNA, 18 bp, Homo sapiens
ttgggaccagaagtgttt

SEQ ID NO: 4589559 - DNA, 13 bp, Homo sapiens
ttgggagcctgtg

SEQ ID NO: 4589560 - DNA, 20 bp, Homo sapiens
ttgggagcctgtggccagca

SEQ ID NO: 4589561 - DNA, 22 bp, Homo sapiens
ttgggatcgcattgcatacctt

SEQ ID NO: 4589562 - DNA, 18 bp, Homo sapiens
ttgggatgtcttattttt

SEQ ID NO: 4589563 - DNA, 18 bp, Homo sapiens
ttgggcagcaatttaaat

SEQ ID NO: 4589564 - DNA, 19 bp, Homo sapiens
ttgggcagcaatttaaatg

SEQ ID NO: 4589565 - DNA, 23 bp, Homo sapiens
ttgggcagccagaccagcaggct

SEQ ID NO: 4589566 - DNA, 12 bp, Homo sapiens
ttgggcaggagg

SEQ ID NO: 4589567 - DNA, 14 bp, Homo sapiens
ttgggccataatta

SEQ ID NO: 4589568 - DNA, 21 bp, Homo sapiens
ttgggccataattatgaaaac

SEQ ID NO: 4589569 - DNA, 13 bp, Homo sapiens
ttgggcccaggga

SEQ ID NO: 4589570 - DNA, 21 bp, Homo sapiens
ttgggcctcccataattgctt

SEQ ID NO: 4589571 - DNA, 17 bp, Homo sapiens
ttgggctgaatgtatgt

SEQ ID NO: 4589572 - DNA, 20 bp, Homo sapiens
ttgggctggagctcctccct

SEQ ID NO: 4589573 - DNA, 18 bp, Homo sapiens
ttggggaagggcctgccc

SEQ ID NO: 4589574 - DNA, 20 bp, Homo sapiens
ttggggaattaaatagtgtg

SEQ ID NO: 4589575 - DNA, 22 bp, Homo sapiens
ttggggctcccagccaggccct

SEQ ID NO: 4589576 - DNA, 13 bp, Homo sapiens
ttgggggaatgca

SEQ ID NO: 4589577 - DNA, 23 bp, Homo sapiens
ttggggggagggggtgtctgcac

SEQ ID NO: 4589578 - DNA, 13 bp, Homo sapiens
ttggggggccggg

SEQ ID NO: 4589579 - DNA, 18 bp, Homo sapiens
ttgggggtgtggctctgc

SEQ ID NO: 4589580 - DNA, 17 bp, Homo sapiens
ttgggggttcaggcccg

SEQ ID NO: 4589581 - DNA, 15 bp, Homo sapiens
ttgggggtttttaat

SEQ ID NO: 4589582 - DNA, 20 bp, Homo sapiens
ttggggtccctccaccccac

SEQ ID NO: 4589583 - DNA, 14 bp, Homo sapiens
ttgggtagaaaaat

SEQ ID NO: 4589584 - DNA, 18 bp, Homo sapiens
ttgggtcagtggccaggt

SEQ ID NO: 4589585 - DNA, 21 bp, Homo sapiens
ttgggtggggctcctgggagg

SEQ ID NO: 4589586 - DNA, 19 bp, Homo sapiens
ttggtaaaactcactgtga

SEQ ID NO: 4589587 - DNA, 20 bp, Homo sapiens
ttggtaactgattacctgcc

SEQ ID NO: 4589588 - DNA, 12 bp, Homo sapiens
ttggtaactttt

SEQ ID NO: 4589589 - DNA, 14 bp, Homo sapiens
ttggtaacttttgt

SEQ ID NO: 4589590 - DNA, 13 bp, Homo sapiens
ttggtacacatgt

SEQ ID NO: 4589591 - DNA, 16 bp, Homo sapiens
ttggtacacatgtgtt

SEQ ID NO: 4589592 - DNA, 21 bp, Homo sapiens
ttggtagagaaggagcagaaa

SEQ ID NO: 4589593 - DNA, 21 bp, Homo sapiens
ttggtagtgtccccagcctac

SEQ ID NO: 4589594 - DNA, 22 bp, Homo sapiens
ttggtagttctgtgcctccccc

SEQ ID NO: 4589595 - DNA, 12 bp, Homo sapiens
ttggtcagcttt

SEQ ID NO: 4589596 - DNA, 15 bp, Homo sapiens
ttggtcagcttttgt

SEQ ID NO: 4589597 - DNA, 19 bp, Homo sapiens
ttggtcatggtagattttt

SEQ ID NO: 4589598 - DNA, 21 bp, Homo sapiens
ttggtctcccatatgcagaaa

SEQ ID NO: 4589599 - DNA, 14 bp, Homo sapiens
ttggtctttcattg

SEQ ID NO: 4589600 - DNA, 14 bp, Homo sapiens
ttggtgactgtccc

SEQ ID NO: 4589601 - DNA, 12 bp, Homo sapiens
ttggtgcctctg

SEQ ID NO: 4589602 - DNA, 14 bp, Homo sapiens
ttggtgcctttcct

SEQ ID NO: 4589603 - DNA, 16 bp, Homo sapiens
ttggtgcctttcctgt

SEQ ID NO: 4589604 - DNA, 18 bp, Homo sapiens
ttggtgcctttcctgttc

SEQ ID NO: 4589605 - DNA, 16 bp, Homo sapiens
ttggtgcggggtacac

SEQ ID NO: 4589606 - DNA, 21 bp, Homo sapiens
ttggtgctttttataaaaaga

SEQ ID NO: 4589607 - DNA, 15 bp, Homo sapiens
ttggtggatgtaaat

SEQ ID NO: 4589608 - DNA, 14 bp, Homo sapiens
ttggtggccacata

SEQ ID NO: 4589609 - DNA, 21 bp, Homo sapiens
ttggtgggtctatgttcccca

SEQ ID NO: 4589610 - DNA, 12 bp, Homo sapiens
ttggtggttttt

SEQ ID NO: 4589611 - DNA, 17 bp, Homo sapiens
ttggtgtaatttgaaga

SEQ ID NO: 4589612 - DNA, 16 bp, Homo sapiens
ttggtgtgttttgctc

SEQ ID NO: 4589613 - DNA, 23 bp, Homo sapiens
ttggtgtgtttttgggatgtctt

SEQ ID NO: 4589614 - DNA, 19 bp, Homo sapiens
ttggtgttctaagactctg

SEQ ID NO: 4589615 - DNA, 17 bp, Homo sapiens
ttggtgtttgtctgtgt

SEQ ID NO: 4589616 - DNA, 15 bp, Homo sapiens
ttggttcagtttttt

SEQ ID NO: 4589617 - DNA, 22 bp, Homo sapiens
ttggtttaaagaaagtgtattt

SEQ ID NO: 4589618 - DNA, 12 bp, Homo sapiens
ttggtttaatat

SEQ ID NO: 4589619 - DNA, 13 bp, Homo sapiens
ttggttttgaaat

SEQ ID NO: 4589620 - DNA, 14 bp, Homo sapiens
ttggttttgaaatg

SEQ ID NO: 4589621 - DNA, 17 bp, Homo sapiens
ttggttttgacttcaga

SEQ ID NO: 4589622 - DNA, 18 bp, Homo sapiens
ttggttttgttcccctcc

SEQ ID NO: 4589623 - DNA, 18 bp, Homo sapiens
ttgtaaaacaaaatttga

SEQ ID NO: 4589624 - DNA, 13 bp, Homo sapiens
ttgtaaaacaggt

SEQ ID NO: 4589625 - DNA, 15 bp, Homo sapiens
ttgtaaaacaggtag

SEQ ID NO: 4589626 - DNA, 20 bp, Homo sapiens
ttgtaaaatggtgtgaccac

SEQ ID NO: 4589627 - DNA, 18 bp, Homo sapiens
ttgtaaaatgtattatgt

SEQ ID NO: 4589628 - DNA, 12 bp, Homo sapiens
ttgtaaagaagg

SEQ ID NO: 4589629 - DNA, 17 bp, Homo sapiens
ttgtaaagtatgtatta

SEQ ID NO: 4589630 - DNA, 23 bp, Homo sapiens
ttgtaaagtatttgatgtacatt

SEQ ID NO: 4589631 - DNA, 12 bp, Homo sapiens
ttgtaaatcttt

SEQ ID NO: 4589632 - DNA, 14 bp, Homo sapiens
ttgtaaatgtgctt

SEQ ID NO: 4589633 - DNA, 16 bp, Homo sapiens
ttgtaaattatatttg

SEQ ID NO: 4589634 - DNA, 17 bp, Homo sapiens
ttgtaaattatatttgt

SEQ ID NO: 4589635 - DNA, 20 bp, Homo sapiens
ttgtaactaggctcagagat

SEQ ID NO: 4589636 - DNA, 13 bp, Homo sapiens
ttgtaagaaggca

SEQ ID NO: 4589637 - DNA, 20 bp, Homo sapiens
ttgtaagaaggcaatattaa

SEQ ID NO: 4589638 - DNA, 14 bp, Homo sapiens
ttgtaataagcaat

SEQ ID NO: 4589639 - DNA, 21 bp, Homo sapiens
ttgtaatatagaaaaaaacat

SEQ ID NO: 4589640 - DNA, 17 bp, Homo sapiens
ttgtaatattctgtttt

SEQ ID NO: 4589641 - DNA, 22 bp, Homo sapiens
ttgtaatgattttggaactgtg

SEQ ID NO: 4589642 - DNA, 15 bp, Homo sapiens
ttgtaatgctgtaca

SEQ ID NO: 4589643 - DNA, 14 bp, Homo sapiens
ttgtacaattttaa

SEQ ID NO: 4589644 - DNA, 19 bp, Homo sapiens
ttgtacatatcctttggtc

SEQ ID NO: 4589645 - DNA, 20 bp, Homo sapiens
ttgtacatttgggagttttt

SEQ ID NO: 4589646 - DNA, 21 bp, Homo sapiens
ttgtaccatagaaaaatgtat

SEQ ID NO: 4589647 - DNA, 15 bp, Homo sapiens
ttgtacgttatatat

SEQ ID NO: 4589648 - DNA, 15 bp, Homo sapiens
ttgtactccagcctg

SEQ ID NO: 4589649 - DNA, 21 bp, Homo sapiens
ttgtactgaatttttttgtaa

SEQ ID NO: 4589650 - DNA, 18 bp, Homo sapiens
ttgtactgtgtttttaaa

SEQ ID NO: 4589651 - DNA, 15 bp, Homo sapiens
ttgtactttatcatg

SEQ ID NO: 4589652 - DNA, 18 bp, Homo sapiens
ttgtactttgtggagaga

SEQ ID NO: 4589653 - DNA, 22 bp, Homo sapiens
ttgtagatgttagggtataagt

SEQ ID NO: 4589654 - DNA, 22 bp, Homo sapiens
ttgtagattttgttatgttcaa

SEQ ID NO: 4589655 - DNA, 15 bp, Homo sapiens
ttgtaggtaaaatgt

SEQ ID NO: 4589656 - DNA, 22 bp, Homo sapiens
ttgtagtagcgttttttaaatg

SEQ ID NO: 4589657 - DNA, 21 bp, Homo sapiens
ttgtagtttgaaagttgtaca

SEQ ID NO: 4589658 - DNA, 15 bp, Homo sapiens
ttgtataatattgaa

SEQ ID NO: 4589659 - DNA, 16 bp, Homo sapiens
ttgtataatattgaaa

SEQ ID NO: 4589660 - DNA, 11 bp, Homo sapiens
ttgtataattg

SEQ ID NO: 4589661 - DNA, 20 bp, Homo sapiens
ttgtataattggatttccta

SEQ ID NO: 4589662 - DNA, 13 bp, Homo sapiens
ttgtatacaagta

SEQ ID NO: 4589663 - DNA, 16 bp, Homo sapiens
ttgtatacaagtactg

SEQ ID NO: 4589664 - DNA, 21 bp, Homo sapiens
ttgtatactttaaataattta

SEQ ID NO: 4589665 - DNA, 18 bp, Homo sapiens
ttgtataggctaaatgtt

SEQ ID NO: 4589666 - DNA, 15 bp, Homo sapiens
ttgtatattacaatg

SEQ ID NO: 4589667 - DNA, 19 bp, Homo sapiens
ttgtatattatgtttattt

SEQ ID NO: 4589668 - DNA, 20 bp, Homo sapiens
ttgtatattatgtttatttc

SEQ ID NO: 4589669 - DNA, 19 bp, Homo sapiens
ttgtatattgggtgtagat

SEQ ID NO: 4589670 - DNA, 13 bp, Homo sapiens
ttgtatattgtgt

SEQ ID NO: 4589671 - DNA, 19 bp, Homo sapiens
ttgtatcacaaatcttaac

SEQ ID NO: 4589672 - DNA, 22 bp, Homo sapiens
ttgtatgccaatcttaaagaca

SEQ ID NO: 4589673 - DNA, 23 bp, Homo sapiens
ttgtatgcctttaaatctgtgat

SEQ ID NO: 4589674 - DNA, 20 bp, Homo sapiens
ttgtatggggaggcaagtgt

SEQ ID NO: 4589675 - DNA, 14 bp, Homo sapiens
ttgtatgttgagga

SEQ ID NO: 4589676 - DNA, 17 bp, Homo sapiens
ttgtattatttttgtag

SEQ ID NO: 4589677 - DNA, 15 bp, Homo sapiens
ttgtattcctgcctt

SEQ ID NO: 4589678 - DNA, 22 bp, Homo sapiens
ttgtattctctgagctgtgcag

SEQ ID NO: 4589679 - DNA, 21 bp, Homo sapiens
ttgtattgcatgcaatttgaa

SEQ ID NO: 4589680 - DNA, 12 bp, Homo sapiens
ttgtattgcttc

SEQ ID NO: 4589681 - DNA, 13 bp, Homo sapiens
ttgtattgttgaa

SEQ ID NO: 4589682 - DNA, 17 bp, Homo sapiens
ttgtattgtttctacaa

SEQ ID NO: 4589683 - DNA, 17 bp, Homo sapiens
ttgtatttaaaaacatt

SEQ ID NO: 4589684 - DNA, 18 bp, Homo sapiens
ttgtatttaacagaaatt

SEQ ID NO: 4589685 - DNA, 15 bp, Homo sapiens
ttgtatttaaggatt

SEQ ID NO: 4589686 - DNA, 23 bp, Homo sapiens
ttgtcaaaataaagattctcaca

SEQ ID NO: 4589687 - DNA, 22 bp, Homo sapiens
ttgtcaaactgtagaaatgatg

SEQ ID NO: 4589688 - DNA, 16 bp, Homo sapiens
ttgtcaacttcagttg

SEQ ID NO: 4589689 - DNA, 19 bp, Homo sapiens
ttgtcacagtctctactgt

SEQ ID NO: 4589690 - DNA, 20 bp, Homo sapiens
ttgtcacgccagacttccca

SEQ ID NO: 4589691 - DNA, 21 bp, Homo sapiens
ttgtcacttctgctgtacaga

SEQ ID NO: 4589692 - DNA, 14 bp, Homo sapiens
ttgtcacttgccac

SEQ ID NO: 4589693 - DNA, 15 bp, Homo sapiens
ttgtcacttgccaca

SEQ ID NO: 4589694 - DNA, 17 bp, Homo sapiens
ttgtcacttgccacatg

SEQ ID NO: 4589695 - DNA, 14 bp, Homo sapiens
ttgtcactttttat

SEQ ID NO: 4589696 - DNA, 21 bp, Homo sapiens
ttgtcactttttatgctattt

SEQ ID NO: 4589697 - DNA, 19 bp, Homo sapiens
ttgtcagccatcgtcctgg

SEQ ID NO: 4589698 - DNA, 20 bp, Homo sapiens
ttgtcagccatcgtcctggg

SEQ ID NO: 4589699 - DNA, 21 bp, Homo sapiens
ttgtcatatgtagccttcaca

SEQ ID NO: 4589700 - DNA, 16 bp, Homo sapiens
ttgtccaaataaattc

SEQ ID NO: 4589701 - DNA, 16 bp, Homo sapiens
ttgtccaccatgctct

SEQ ID NO: 4589702 - DNA, 19 bp, Homo sapiens
ttgtcctcccctattttaa

SEQ ID NO: 4589703 - DNA, 23 bp, Homo sapiens
ttgtcgaaaagagtcttccaatt

SEQ ID NO: 4589704 - DNA, 15 bp, Homo sapiens
ttgtctaaaatgtca

SEQ ID NO: 4589705 - DNA, 18 bp, Homo sapiens
ttgtctatttgtctctta

SEQ ID NO: 4589706 - DNA, 15 bp, Homo sapiens
ttgtctgaaacattt

SEQ ID NO: 4589707 - DNA, 13 bp, Homo sapiens
ttgtctgtaaatc

SEQ ID NO: 4589708 - DNA, 18 bp, Homo sapiens
ttgtctgtctacatttct

SEQ ID NO: 4589709 - DNA, 19 bp, Homo sapiens
ttgtctgtgatctctgctg

SEQ ID NO: 4589710 - DNA, 23 bp, Homo sapiens
ttgtcttaagatggaaatacagt

SEQ ID NO: 4589711 - DNA, 12 bp, Homo sapiens
ttgtcttaatat

SEQ ID NO: 4589712 - DNA, 16 bp, Homo sapiens
ttgtcttgaaaactgt

SEQ ID NO: 4589713 - DNA, 16 bp, Homo sapiens
ttgtcttgatgttttt

SEQ ID NO: 4589714 - DNA, 12 bp, Homo sapiens
ttgtctttattt

SEQ ID NO: 4589715 - DNA, 23 bp, Homo sapiens
ttgtctttgtaatgtcaccacct

SEQ ID NO: 4589716 - DNA, 22 bp, Homo sapiens
ttgtcttttcaatcttctactt

SEQ ID NO: 4589717 - DNA, 23 bp, Homo sapiens
ttgtgaaatggccaggatcctct

SEQ ID NO: 4589718 - DNA, 12 bp, Homo sapiens
ttgtgaactgga

SEQ ID NO: 4589719 - DNA, 18 bp, Homo sapiens
ttgtgaaggattatggaa

SEQ ID NO: 4589720 - DNA, 21 bp, Homo sapiens
ttgtgaaggattatggaaaaa

SEQ ID NO: 4589721 - DNA, 13 bp, Homo sapiens
ttgtgaaggattt

SEQ ID NO: 4589722 - DNA, 15 bp, Homo sapiens
ttgtgaatgcttctc

SEQ ID NO: 4589723 - DNA, 23 bp, Homo sapiens
ttgtgacaggaaagccctccccc

SEQ ID NO: 4589724 - DNA, 16 bp, Homo sapiens
ttgtgacattccttct

SEQ ID NO: 4589725 - DNA, 22 bp, Homo sapiens
ttgtgactctaggcttcaggtt

SEQ ID NO: 4589726 - DNA, 14 bp, Homo sapiens
ttgtgacttcactg

SEQ ID NO: 4589727 - DNA, 19 bp, Homo sapiens
ttgtgattcaatctgtaaa

SEQ ID NO: 4589728 - DNA, 22 bp, Homo sapiens
ttgtgcaaacatggagaaatct

SEQ ID NO: 4589729 - DNA, 22 bp, Homo sapiens
ttgtgcaatgtaaatattttaa

SEQ ID NO: 4589730 - DNA, 16 bp, Homo sapiens
ttgtgcacatttattt

SEQ ID NO: 4589731 - DNA, 18 bp, Homo sapiens
ttgtgcagtgttagtatt

SEQ ID NO: 4589732 - DNA, 21 bp, Homo sapiens
ttgtgcataatgctttggaaa

SEQ ID NO: 4589733 - DNA, 14 bp, Homo sapiens
ttgtgcattctgga

SEQ ID NO: 4589734 - DNA, 23 bp, Homo sapiens
ttgtgccaaacctactaggccat

SEQ ID NO: 4589735 - DNA, 23 bp, Homo sapiens
ttgtgctacatgacgacaaagct

SEQ ID NO: 4589736 - DNA, 18 bp, Homo sapiens
ttgtgctagaaattttca

SEQ ID NO: 4589737 - DNA, 19 bp, Homo sapiens
ttgtgctatagtatttgat

SEQ ID NO: 4589738 - DNA, 13 bp, Homo sapiens
ttgtgctgcttct

SEQ ID NO: 4589739 - DNA, 14 bp, Homo sapiens
ttgtgctgtgggca

SEQ ID NO: 4589740 - DNA, 15 bp, Homo sapiens
ttgtgctgtgggcag

SEQ ID NO: 4589741 - DNA, 19 bp, Homo sapiens
ttgtgctgtgggcagcacc

SEQ ID NO: 4589742 - DNA, 22 bp, Homo sapiens
ttgtgctgtgggcagcaccctc

SEQ ID NO: 4589743 - DNA, 16 bp, Homo sapiens
ttgtgcttctccccag

SEQ ID NO: 4589744 - DNA, 19 bp, Homo sapiens
ttgtgcttctccccagaat

SEQ ID NO: 4589745 - DNA, 17 bp, Homo sapiens
ttgtgctttttctcccc

SEQ ID NO: 4589746 - DNA, 22 bp, Homo sapiens
ttgtggaatggagattcagttt

SEQ ID NO: 4589747 - DNA, 19 bp, Homo sapiens
ttgtggggcctcaggctcc

SEQ ID NO: 4589748 - DNA, 18 bp, Homo sapiens
ttgtggtcacatgcttta

SEQ ID NO: 4589749 - DNA, 16 bp, Homo sapiens
ttgtgtaaatttgtat

SEQ ID NO: 4589750 - DNA, 17 bp, Homo sapiens
ttgtgtaataaagtgtt

SEQ ID NO: 4589751 - DNA, 19 bp, Homo sapiens
ttgtgtaataaagtgtttt

SEQ ID NO: 4589752 - DNA, 13 bp, Homo sapiens
ttgtgtagatttg

SEQ ID NO: 4589753 - DNA, 16 bp, Homo sapiens
ttgtgtatatatctta

SEQ ID NO: 4589754 - DNA, 16 bp, Homo sapiens
ttgtgtatatattata

SEQ ID NO: 4589755 - DNA, 22 bp, Homo sapiens
ttgtgtatcttcgtaacttcat

SEQ ID NO: 4589756 - DNA, 16 bp, Homo sapiens
ttgtgtattagatatc

SEQ ID NO: 4589757 - DNA, 22 bp, Homo sapiens
ttgtgtattgagtcttaactgt

SEQ ID NO: 4589758 - DNA, 19 bp, Homo sapiens
ttgtgtctggcagtttata

SEQ ID NO: 4589759 - DNA, 22 bp, Homo sapiens
ttgtgtctgtgccctccaaaga

SEQ ID NO: 4589760 - DNA, 15 bp, Homo sapiens
ttgtgtcttaatctc

SEQ ID NO: 4589761 - DNA, 15 bp, Homo sapiens
ttgtgtgcatggaag

SEQ ID NO: 4589762 - DNA, 21 bp, Homo sapiens
ttgtgtggcccagcacgagcc

SEQ ID NO: 4589763 - DNA, 19 bp, Homo sapiens
ttgtgtggtctggttcctg

SEQ ID NO: 4589764 - DNA, 19 bp, Homo sapiens
ttgtgtgtaaggagtatac

SEQ ID NO: 4589765 - DNA, 14 bp, Homo sapiens
ttgtgtgtatttgc

SEQ ID NO: 4589766 - DNA, 16 bp, Homo sapiens
ttgtgtgtgggagtgt

SEQ ID NO: 4589767 - DNA, 14 bp, Homo sapiens
ttgtgttcaatctg

SEQ ID NO: 4589768 - DNA, 16 bp, Homo sapiens
ttgtgttcatttcatt

SEQ ID NO: 4589769 - DNA, 13 bp, Homo sapiens
ttgtgttctgctc

SEQ ID NO: 4589770 - DNA, 23 bp, Homo sapiens
ttgtgtttagctacctttttata

SEQ ID NO: 4589771 - DNA, 17 bp, Homo sapiens
ttgtgtttgtgtattta

SEQ ID NO: 4589772 - DNA, 15 bp, Homo sapiens
ttgtgttttttaaga

SEQ ID NO: 4589773 - DNA, 16 bp, Homo sapiens
ttgtgttttttaagat

SEQ ID NO: 4589774 - DNA, 22 bp, Homo sapiens
ttgttaaaaaaaaaaagattgt

SEQ ID NO: 4589775 - DNA, 15 bp, Homo sapiens
ttgttaaagcctgtt

SEQ ID NO: 4589776 - DNA, 13 bp, Homo sapiens
ttgttaacagcaa

SEQ ID NO: 4589777 - DNA, 16 bp, Homo sapiens
ttgttaacctttctaa

SEQ ID NO: 4589778 - DNA, 20 bp, Homo sapiens
ttgttaatatcactcattaa

SEQ ID NO: 4589779 - DNA, 23 bp, Homo sapiens
ttgttaatgcattgttgtaaagt

SEQ ID NO: 4589780 - DNA, 19 bp, Homo sapiens
ttgttactcttacgaatat

SEQ ID NO: 4589781 - DNA, 17 bp, Homo sapiens
ttgttactgctgattct

SEQ ID NO: 4589782 - DNA, 12 bp, Homo sapiens
ttgttataaata

SEQ ID NO: 4589783 - DNA, 20 bp, Homo sapiens
ttgttatatataataaatac

SEQ ID NO: 4589784 - DNA, 14 bp, Homo sapiens
ttgttattaatgtt

SEQ ID NO: 4589785 - DNA, 22 bp, Homo sapiens
ttgttattttgcaacctcgctg

SEQ ID NO: 4589786 - DNA, 15 bp, Homo sapiens
ttgttcaaatgcatt

SEQ ID NO: 4589787 - DNA, 14 bp, Homo sapiens
ttgttcaactccct

SEQ ID NO: 4589788 - DNA, 19 bp, Homo sapiens
ttgttcacttctaaaccaa

SEQ ID NO: 4589789 - DNA, 23 bp, Homo sapiens
ttgttcaggaaaaggttgaataa

SEQ ID NO: 4589790 - DNA, 14 bp, Homo sapiens
ttgttccacattct

SEQ ID NO: 4589791 - DNA, 12 bp, Homo sapiens
ttgttccagctc

SEQ ID NO: 4589792 - DNA, 14 bp, Homo sapiens
ttgttcccctcctc

SEQ ID NO: 4589793 - DNA, 19 bp, Homo sapiens
ttgttcccctcctccactc

SEQ ID NO: 4589794 - DNA, 23 bp, Homo sapiens
ttgttcccctcctccactctccc

SEQ ID NO: 4589795 - DNA, 14 bp, Homo sapiens
ttgttcctttttct

SEQ ID NO: 4589796 - DNA, 23 bp, Homo sapiens
ttgttctccgggtgtggcctcag

SEQ ID NO: 4589797 - DNA, 16 bp, Homo sapiens
ttgttctgcctggaga

SEQ ID NO: 4589798 - DNA, 15 bp, Homo sapiens
ttgttgactgtgatt

SEQ ID NO: 4589799 - DNA, 18 bp, Homo sapiens
ttgttgatattgtttgct

SEQ ID NO: 4589800 - DNA, 20 bp, Homo sapiens
ttgttgtagattgattgtat

SEQ ID NO: 4589801 - DNA, 14 bp, Homo sapiens
ttgttgtattcctg

SEQ ID NO: 4589802 - DNA, 17 bp, Homo sapiens
ttgttgtattcctgcct

SEQ ID NO: 4589803 - DNA, 20 bp, Homo sapiens
ttgttgtctatttgtctctt

SEQ ID NO: 4589804 - DNA, 19 bp, Homo sapiens
ttgttgtctccacttgtat

SEQ ID NO: 4589805 - DNA, 13 bp, Homo sapiens
ttgttgtgtgtat

SEQ ID NO: 4589806 - DNA, 17 bp, Homo sapiens
ttgtttaaaatcatttc

SEQ ID NO: 4589807 - DNA, 16 bp, Homo sapiens
ttgtttaaatgccaaa

SEQ ID NO: 4589808 - DNA, 20 bp, Homo sapiens
ttgtttacatgagttcaaat

SEQ ID NO: 4589809 - DNA, 21 bp, Homo sapiens
ttgtttactctcttcatccgt

SEQ ID NO: 4589810 - DNA, 21 bp, Homo sapiens
ttgtttagaaagaatattcat

SEQ ID NO: 4589811 - DNA, 15 bp, Homo sapiens
ttgtttagaagaagt

SEQ ID NO: 4589812 - DNA, 14 bp, Homo sapiens
ttgtttatcaactt

SEQ ID NO: 4589813 - DNA, 20 bp, Homo sapiens
ttgtttatgtgttatgaaca

SEQ ID NO: 4589814 - DNA, 23 bp, Homo sapiens
ttgtttcaatgaggtgtccaact

SEQ ID NO: 4589815 - DNA, 16 bp, Homo sapiens
ttgtttcatctatttt

SEQ ID NO: 4589816 - DNA, 12 bp, Homo sapiens
ttgtttgtttct

SEQ ID NO: 4589817 - DNA, 22 bp, Homo sapiens
ttgttttaaggaaaaaagattt

SEQ ID NO: 4589818 - DNA, 14 bp, Homo sapiens
ttgttttgaaaata

SEQ ID NO: 4589819 - DNA, 14 bp, Homo sapiens
ttgttttgaaagtt

SEQ ID NO: 4589820 - DNA, 23 bp, Homo sapiens
ttgttttgatgtttgtggcctca

SEQ ID NO: 4589821 - DNA, 20 bp, Homo sapiens
ttgttttgcacactttgcca

SEQ ID NO: 4589822 - DNA, 16 bp, Homo sapiens
ttgttttggtctcaaa

SEQ ID NO: 4589823 - DNA, 14 bp, Homo sapiens
ttgtttttactgta

SEQ ID NO: 4589824 - DNA, 15 bp, Homo sapiens
ttgtttttactgtat

SEQ ID NO: 4589825 - DNA, 14 bp, Homo sapiens
ttgtttttcttcag

SEQ ID NO: 4589826 - DNA, 15 bp, Homo sapiens
ttgtttttctttcta

SEQ ID NO: 4589827 - DNA, 16 bp, Homo sapiens
ttgtttttgcatgaaa

SEQ ID NO: 4589828 - DNA, 17 bp, Homo sapiens
ttgtttttgcatgaaat

SEQ ID NO: 4589829 - DNA, 15 bp, Homo sapiens
ttgttttttaaatga

SEQ ID NO: 4589830 - DNA, 17 bp, Homo sapiens
ttgttttttcaaaatag

SEQ ID NO: 4589831 - DNA, 21 bp, Homo sapiens
ttgttttttcaaaatagaaaa

SEQ ID NO: 4589832 - DNA, 21 bp, Homo sapiens
tttaaaaaactaaaaactaga

SEQ ID NO: 4589833 - DNA, 13 bp, Homo sapiens
tttaaaaaagctt

SEQ ID NO: 4589834 - DNA, 14 bp, Homo sapiens
tttaaaaaagctta

SEQ ID NO: 4589835 - DNA, 22 bp, Homo sapiens
tttaaaaaattaaaaatgaaaa

SEQ ID NO: 4589836 - DNA, 14 bp, Homo sapiens
tttaaaaacaaaca

SEQ ID NO: 4589837 - DNA, 13 bp, Homo sapiens
tttaaaaacattt

SEQ ID NO: 4589838 - DNA, 14 bp, Homo sapiens
tttaaaaagtgttt

SEQ ID NO: 4589839 - DNA, 12 bp, Homo sapiens
tttaaaaataca

SEQ ID NO: 4589840 - DNA, 17 bp, Homo sapiens
tttaaaaatacatagca

SEQ ID NO: 4589841 - DNA, 15 bp, Homo sapiens
tttaaaaatatatat

SEQ ID NO: 4589842 - DNA, 13 bp, Homo sapiens
tttaaaaatcaac

SEQ ID NO: 4589843 - DNA, 15 bp, Homo sapiens
tttaaaaatcaactt

SEQ ID NO: 4589844 - DNA, 11 bp, Homo sapiens
tttaaaaatgt

SEQ ID NO: 4589845 - DNA, 13 bp, Homo sapiens
tttaaaaatgtat

SEQ ID NO: 4589846 - DNA, 12 bp, Homo sapiens
tttaaaaatgtc

SEQ ID NO: 4589847 - DNA, 12 bp, Homo sapiens
tttaaaacaaaa

SEQ ID NO: 4589848 - DNA, 18 bp, Homo sapiens
tttaaaactagcaactct

SEQ ID NO: 4589849 - DNA, 20 bp, Homo sapiens
tttaaaactagttagattca

SEQ ID NO: 4589850 - DNA, 10 bp, Homo sapiens
tttaaaactc

SEQ ID NO: 4589851 - DNA, 15 bp, Homo sapiens
tttaaaactgttgga

SEQ ID NO: 4589852 - DNA, 13 bp, Homo sapiens
tttaaaagcacga

SEQ ID NO: 4589853 - DNA, 23 bp, Homo sapiens
tttaaaagtaaaatgtctttcca

SEQ ID NO: 4589854 - DNA, 18 bp, Homo sapiens
tttaaaagtcattattcc

SEQ ID NO: 4589855 - DNA, 16 bp, Homo sapiens
tttaaaagtgcacatt

SEQ ID NO: 4589856 - DNA, 21 bp, Homo sapiens
tttaaaagttttgaaggaaac

SEQ ID NO: 4589857 - DNA, 22 bp, Homo sapiens
tttaaaagttttgaaggaaacc

SEQ ID NO: 4589858 - DNA, 12 bp, Homo sapiens
tttaaaatagca

SEQ ID NO: 4589859 - DNA, 12 bp, Homo sapiens
tttaaaatatat

SEQ ID NO: 4589860 - DNA, 13 bp, Homo sapiens
tttaaaatatatg

SEQ ID NO: 4589861 - DNA, 16 bp, Homo sapiens
tttaaaatatctacat

SEQ ID NO: 4589862 - DNA, 18 bp, Homo sapiens
tttaaaatcagctatttt

SEQ ID NO: 4589863 - DNA, 16 bp, Homo sapiens
tttaaaatcatttctg

SEQ ID NO: 4589864 - DNA, 17 bp, Homo sapiens
tttaaaatccattttag

SEQ ID NO: 4589865 - DNA, 18 bp, Homo sapiens
tttaaaatctcctaaatg

SEQ ID NO: 4589866 - DNA, 15 bp, Homo sapiens
tttaaaatctgtcac

SEQ ID NO: 4589867 - DNA, 21 bp, Homo sapiens
tttaaaatgctcaatttcagc

SEQ ID NO: 4589868 - DNA, 21 bp, Homo sapiens
tttaaaatgtagaaacttaaa

SEQ ID NO: 4589869 - DNA, 19 bp, Homo sapiens
tttaaaatgtgaggcaata

SEQ ID NO: 4589870 - DNA, 20 bp, Homo sapiens
tttaaaatgtgaggcaataa

SEQ ID NO: 4589871 - DNA, 16 bp, Homo sapiens
tttaaaatttgttctt

SEQ ID NO: 4589872 - DNA, 16 bp, Homo sapiens
tttaaaattttggaat

SEQ ID NO: 4589873 - DNA, 16 bp, Homo sapiens
tttaaacaaaatttca

SEQ ID NO: 4589874 - DNA, 20 bp, Homo sapiens
tttaaacaaaatttcacagt

SEQ ID NO: 4589875 - DNA, 14 bp, Homo sapiens
tttaaacaatcttt

SEQ ID NO: 4589876 - DNA, 17 bp, Homo sapiens
tttaaacaatctttcat

SEQ ID NO: 4589877 - DNA, 23 bp, Homo sapiens
tttaaacaatctttcatgtcttg

SEQ ID NO: 4589878 - DNA, 23 bp, Homo sapiens
tttaaacccaaaatatatacaca

SEQ ID NO: 4589879 - DNA, 17 bp, Homo sapiens
tttaaacccaagtgctg

SEQ ID NO: 4589880 - DNA, 20 bp, Homo sapiens
tttaaaccgctaaaagaaac

SEQ ID NO: 4589881 - DNA, 22 bp, Homo sapiens
tttaaaccgctaaaagaaactt

SEQ ID NO: 4589882 - DNA, 20 bp, Homo sapiens
tttaaactactatttttctt

SEQ ID NO: 4589883 - DNA, 15 bp, Homo sapiens
tttaaactataagca

SEQ ID NO: 4589884 - DNA, 14 bp, Homo sapiens
tttaaactgtgtac

SEQ ID NO: 4589885 - DNA, 20 bp, Homo sapiens
tttaaacttgaaatatataa

SEQ ID NO: 4589886 - DNA, 17 bp, Homo sapiens
tttaaactttttaaaat

SEQ ID NO: 4589887 - DNA, 13 bp, Homo sapiens
tttaaagaaagtg

SEQ ID NO: 4589888 - DNA, 14 bp, Homo sapiens
tttaaagaaagtgt

SEQ ID NO: 4589889 - DNA, 13 bp, Homo sapiens
tttaaagaaattt

SEQ ID NO: 4589890 - DNA, 17 bp, Homo sapiens
tttaaagaatcattatt

SEQ ID NO: 4589891 - DNA, 18 bp, Homo sapiens
tttaaagaatcattattt

SEQ ID NO: 4589892 - DNA, 23 bp, Homo sapiens
tttaaagaatcattatttattaa

SEQ ID NO: 4589893 - DNA, 22 bp, Homo sapiens
tttaaagacaaagacattattt

SEQ ID NO: 4589894 - DNA, 18 bp, Homo sapiens
tttaaagactacaataaa

SEQ ID NO: 4589895 - DNA, 24 bp, Homo sapiens
tttaaagcttattaaaactcattt

SEQ ID NO: 4589896 - DNA, 18 bp, Homo sapiens
tttaaaggcattagagtc

SEQ ID NO: 4589897 - DNA, 14 bp, Homo sapiens
tttaaagtaaactt

SEQ ID NO: 4589898 - DNA, 16 bp, Homo sapiens
tttaaagtaaacttgt

SEQ ID NO: 4589899 - DNA, 18 bp, Homo sapiens
tttaaagtaaacttgtgt

SEQ ID NO: 4589900 - DNA, 20 bp, Homo sapiens
tttaaagtatttataaaaat

SEQ ID NO: 4589901 - DNA, 18 bp, Homo sapiens
tttaaagtcacatccctg

SEQ ID NO: 4589902 - DNA, 21 bp, Homo sapiens
tttaaagttctgtgtatttaa

SEQ ID NO: 4589903 - DNA, 17 bp, Homo sapiens
tttaaagttcttatttt

SEQ ID NO: 4589904 - DNA, 16 bp, Homo sapiens
tttaaataaaagcaca

SEQ ID NO: 4589905 - DNA, 19 bp, Homo sapiens
tttaaataaaagcacaagt

SEQ ID NO: 4589906 - DNA, 16 bp, Homo sapiens
tttaaataatttaact

SEQ ID NO: 4589907 - DNA, 21 bp, Homo sapiens
tttaaataatttaactaccct

SEQ ID NO: 4589908 - DNA, 16 bp, Homo sapiens
tttaaatatatatttt

SEQ ID NO: 4589909 - DNA, 14 bp, Homo sapiens
tttaaatattttct

SEQ ID NO: 4589910 - DNA, 19 bp, Homo sapiens
tttaaatattttctatttt

SEQ ID NO: 4589911 - DNA, 14 bp, Homo sapiens
tttaaatcaaggaa

SEQ ID NO: 4589912 - DNA, 18 bp, Homo sapiens
tttaaatcaaggaaaggc

SEQ ID NO: 4589913 - DNA, 14 bp, Homo sapiens
tttaaatctgtgat

SEQ ID NO: 4589914 - DNA, 12 bp, Homo sapiens
tttaaatgaaag

SEQ ID NO: 4589915 - DNA, 16 bp, Homo sapiens
tttaaatggaataatt

SEQ ID NO: 4589916 - DNA, 11 bp, Homo sapiens
tttaaatgtac

SEQ ID NO: 4589917 - DNA, 14 bp, Homo sapiens
tttaaatgtatact

SEQ ID NO: 4589918 - DNA, 18 bp, Homo sapiens
tttaaatgtgtacaatgt

SEQ ID NO: 4589919 - DNA, 13 bp, Homo sapiens
tttaaatgtgtat

SEQ ID NO: 4589920 - DNA, 14 bp, Homo sapiens
tttaaattagaaaa

SEQ ID NO: 4589921 - DNA, 20 bp, Homo sapiens
tttaaattataaggactgca

SEQ ID NO: 4589922 - DNA, 16 bp, Homo sapiens
tttaaattatatgata

SEQ ID NO: 4589923 - DNA, 15 bp, Homo sapiens
tttaaattattatct

SEQ ID NO: 4589924 - DNA, 17 bp, Homo sapiens
tttaaatttcttttatt

SEQ ID NO: 4589925 - DNA, 21 bp, Homo sapiens
tttaaatttcttttattaata

SEQ ID NO: 4589926 - DNA, 16 bp, Homo sapiens
tttaaattttattatt

SEQ ID NO: 4589927 - DNA, 22 bp, Homo sapiens
tttaaattttcttcagttggtg

SEQ ID NO: 4589928 - DNA, 15 bp, Homo sapiens
tttaaattttgtaat

SEQ ID NO: 4589929 - DNA, 18 bp, Homo sapiens
tttaacaaaaagtgcttc

SEQ ID NO: 4589930 - DNA, 14 bp, Homo sapiens
tttaacaagatgtt

SEQ ID NO: 4589931 - DNA, 13 bp, Homo sapiens
tttaacagaaatt

SEQ ID NO: 4589932 - DNA, 19 bp, Homo sapiens
tttaacagaaattgtatat

SEQ ID NO: 4589933 - DNA, 17 bp, Homo sapiens
tttaaccagtacttcta

SEQ ID NO: 4589934 - DNA, 18 bp, Homo sapiens
tttaacctatgataatta

SEQ ID NO: 4589935 - DNA, 16 bp, Homo sapiens
tttaacctatgatatt

SEQ ID NO: 4589936 - DNA, 21 bp, Homo sapiens
tttaacctgcaagttgctctg

SEQ ID NO: 4589937 - DNA, 14 bp, Homo sapiens
tttaactaaatttt

SEQ ID NO: 4589938 - DNA, 14 bp, Homo sapiens
tttaactaccctta

SEQ ID NO: 4589939 - DNA, 16 bp, Homo sapiens
tttaactatgaactga

SEQ ID NO: 4589940 - DNA, 20 bp, Homo sapiens
tttaactatgaactgaaggc

SEQ ID NO: 4589941 - DNA, 18 bp, Homo sapiens
tttaactatgtaataatg

SEQ ID NO: 4589942 - DNA, 21 bp, Homo sapiens
tttaactctttgaaactgtat

SEQ ID NO: 4589943 - DNA, 19 bp, Homo sapiens
tttaactgacaagccatct

SEQ ID NO: 4589944 - DNA, 21 bp, Homo sapiens
tttaactgattcttatgatta

SEQ ID NO: 4589945 - DNA, 12 bp, Homo sapiens
tttaactgccgt

SEQ ID NO: 4589946 - DNA, 18 bp, Homo sapiens
tttaactggcatgtcatt

SEQ ID NO: 4589947 - DNA, 13 bp, Homo sapiens
tttaactggtgca

SEQ ID NO: 4589948 - DNA, 18 bp, Homo sapiens
tttaactgtggatattgt

SEQ ID NO: 4589949 - DNA, 17 bp, Homo sapiens
tttaacttccactgtta

SEQ ID NO: 4589950 - DNA, 14 bp, Homo sapiens
tttaactttctaga

SEQ ID NO: 4589951 - DNA, 23 bp, Homo sapiens
tttaactttttgtttttatttct

SEQ ID NO: 4589952 - DNA, 21 bp, Homo sapiens
tttaagacgtgaatgtctcag

SEQ ID NO: 4589953 - DNA, 19 bp, Homo sapiens
tttaagatatatacatgga

SEQ ID NO: 4589954 - DNA, 17 bp, Homo sapiens
tttaagatccagaaata

SEQ ID NO: 4589955 - DNA, 15 bp, Homo sapiens
tttaagatttgtgtt

SEQ ID NO: 4589956 - DNA, 16 bp, Homo sapiens
tttaagcaagttaagt

SEQ ID NO: 4589957 - DNA, 18 bp, Homo sapiens
tttaagccaaaacaatgt

SEQ ID NO: 4589958 - DNA, 20 bp, Homo sapiens
tttaagccaaaacaatgttt

SEQ ID NO: 4589959 - DNA, 11 bp, Homo sapiens
tttaagccata

SEQ ID NO: 4589960 - DNA, 14 bp, Homo sapiens
tttaagctcaaaat

SEQ ID NO: 4589961 - DNA, 16 bp, Homo sapiens
tttaagcttaacattt

SEQ ID NO: 4589962 - DNA, 18 bp, Homo sapiens
tttaagcttaacatttca

SEQ ID NO: 4589963 - DNA, 20 bp, Homo sapiens
tttaagctttaaatgacagt

SEQ ID NO: 4589964 - DNA, 23 bp, Homo sapiens
tttaaggaaaaaagatttttaaa

SEQ ID NO: 4589965 - DNA, 14 bp, Homo sapiens
tttaagtagatttc

SEQ ID NO: 4589966 - DNA, 16 bp, Homo sapiens
tttaagtcatttttta

SEQ ID NO: 4589967 - DNA, 15 bp, Homo sapiens
tttaagtccctgtca

SEQ ID NO: 4589968 - DNA, 16 bp, Homo sapiens
tttaagtccctgtcac

SEQ ID NO: 4589969 - DNA, 15 bp, Homo sapiens
tttaagtgcaattaa

SEQ ID NO: 4589970 - DNA, 14 bp, Homo sapiens
tttaagtgtgctgg

SEQ ID NO: 4589971 - DNA, 17 bp, Homo sapiens
tttaagttaatagattt

SEQ ID NO: 4589972 - DNA, 18 bp, Homo sapiens
tttaagttacacattttt

SEQ ID NO: 4589973 - DNA, 14 bp, Homo sapiens
tttaagttgtcaaa

SEQ ID NO: 4589974 - DNA, 18 bp, Homo sapiens
tttaagttgtcaaagaag

SEQ ID NO: 4589975 - DNA, 13 bp, Homo sapiens
tttaagtttgaaa

SEQ ID NO: 4589976 - DNA, 11 bp, Homo sapiens
tttaataaaac

SEQ ID NO: 4589977 - DNA, 12 bp, Homo sapiens
tttaataaactg

SEQ ID NO: 4589978 - DNA, 11 bp, Homo sapiens
tttaataattt

SEQ ID NO: 4589979 - DNA, 15 bp, Homo sapiens
tttaatacaggaaat

SEQ ID NO: 4589980 - DNA, 17 bp, Homo sapiens
tttaatagcaaagaatt

SEQ ID NO: 4589981 - DNA, 13 bp, Homo sapiens
tttaatagcacta

SEQ ID NO: 4589982 - DNA, 19 bp, Homo sapiens
tttaatagtggcaaatgaa

SEQ ID NO: 4589983 - DNA, 21 bp, Homo sapiens
tttaatatagtgaaatggcca

SEQ ID NO: 4589984 - DNA, 18 bp, Homo sapiens
tttaatatataatttaat

SEQ ID NO: 4589985 - DNA, 18 bp, Homo sapiens
tttaatatgagcttcaat

SEQ ID NO: 4589986 - DNA, 24 bp, Homo sapiens
tttaatattacctaatgaaagtga

SEQ ID NO: 4589987 - DNA, 15 bp, Homo sapiens
tttaatattgagaaa

SEQ ID NO: 4589988 - DNA, 15 bp, Homo sapiens
tttaatcgtttttgt

SEQ ID NO: 4589989 - DNA, 23 bp, Homo sapiens
tttaatgccgatatactctagat

SEQ ID NO: 4589990 - DNA, 21 bp, Homo sapiens
tttaatggattgttaatttca

SEQ ID NO: 4589991 - DNA, 21 bp, Homo sapiens
tttaatggtatgtacaagttg

SEQ ID NO: 4589992 - DNA, 14 bp, Homo sapiens
tttaatgtaaagat

SEQ ID NO: 4589993 - DNA, 13 bp, Homo sapiens
tttaatgtagaac

SEQ ID NO: 4589994 - DNA, 14 bp, Homo sapiens
tttaatgtttctga

SEQ ID NO: 4589995 - DNA, 18 bp, Homo sapiens
tttaatgttttaaatgta

SEQ ID NO: 4589996 - DNA, 19 bp, Homo sapiens
tttaatgttttaaatgtac

SEQ ID NO: 4589997 - DNA, 14 bp, Homo sapiens
tttaattaagcaaa

SEQ ID NO: 4589998 - DNA, 19 bp, Homo sapiens
tttaattaagcagaaacag

SEQ ID NO: 4589999 - DNA, 21 bp, Homo sapiens
tttaattatgaaaactagcat

SEQ ID NO: 4590000 - DNA, 22 bp, Homo sapiens
tttaattatgaaaactagcatt

SEQ ID NO: 4590001 - DNA, 12 bp, Homo sapiens
tttaattgcttt

SEQ ID NO: 4590002 - DNA, 18 bp, Homo sapiens
tttaattgctttgaagca

SEQ ID NO: 4590003 - DNA, 19 bp, Homo sapiens
tttaattgctttgaagcat

SEQ ID NO: 4590004 - DNA, 15 bp, Homo sapiens
tttaattgtaaactg

SEQ ID NO: 4590005 - DNA, 17 bp, Homo sapiens
tttaattgtaaactgta

SEQ ID NO: 4590006 - DNA, 19 bp, Homo sapiens
tttaattgtaaactgtact

SEQ ID NO: 4590007 - DNA, 15 bp, Homo sapiens
tttaattgtaaagta

SEQ ID NO: 4590008 - DNA, 21 bp, Homo sapiens
tttaattgtaaagtaaaagct

SEQ ID NO: 4590009 - DNA, 18 bp, Homo sapiens
tttaatttagtaaatgtt

SEQ ID NO: 4590010 - DNA, 14 bp, Homo sapiens
tttaatttatttca

SEQ ID NO: 4590011 - DNA, 13 bp, Homo sapiens
tttaatttcagga

SEQ ID NO: 4590012 - DNA, 17 bp, Homo sapiens
tttaatttcatgtatat

SEQ ID NO: 4590013 - DNA, 22 bp, Homo sapiens
tttaatttctgaagaagttaat

SEQ ID NO: 4590014 - DNA, 22 bp, Homo sapiens
tttaatttgaaggtagaatgtt

SEQ ID NO: 4590015 - DNA, 11 bp, Homo sapiens
tttaatttgat

SEQ ID NO: 4590016 - DNA, 19 bp, Homo sapiens
tttaatttggtagatgaca

SEQ ID NO: 4590017 - DNA, 21 bp, Homo sapiens
tttaatttggtagatgacaaa

SEQ ID NO: 4590018 - DNA, 21 bp, Homo sapiens
tttaattttttactttcagtt

SEQ ID NO: 4590019 - DNA, 19 bp, Homo sapiens
tttacaaaactacatgaga

SEQ ID NO: 4590020 - DNA, 17 bp, Homo sapiens
tttacaaaccattacct

SEQ ID NO: 4590021 - DNA, 19 bp, Homo sapiens
tttacaaaccattacctgt

SEQ ID NO: 4590022 - DNA, 17 bp, Homo sapiens
tttacaaacctttgttt

SEQ ID NO: 4590023 - DNA, 12 bp, Homo sapiens
tttacaactaaa

SEQ ID NO: 4590024 - DNA, 16 bp, Homo sapiens
tttacaactaaataac

SEQ ID NO: 4590025 - DNA, 17 bp, Homo sapiens
tttacaagggagaagac

SEQ ID NO: 4590026 - DNA, 13 bp, Homo sapiens
tttacaatgtatt

SEQ ID NO: 4590027 - DNA, 14 bp, Homo sapiens
tttacaatgtatta

SEQ ID NO: 4590028 - DNA, 15 bp, Homo sapiens
tttacacagagaaat

SEQ ID NO: 4590029 - DNA, 18 bp, Homo sapiens
tttacacagagaaataca

SEQ ID NO: 4590030 - DNA, 14 bp, Homo sapiens
tttacacagtgaga

SEQ ID NO: 4590031 - DNA, 14 bp, Homo sapiens
tttacacatcttaa

SEQ ID NO: 4590032 - DNA, 17 bp, Homo sapiens
tttacacatcttaaaag

SEQ ID NO: 4590033 - DNA, 23 bp, Homo sapiens
tttacagagaggatacatttaat

SEQ ID NO: 4590034 - DNA, 15 bp, Homo sapiens
tttacagatttctca

SEQ ID NO: 4590035 - DNA, 15 bp, Homo sapiens
tttacagcactactc

SEQ ID NO: 4590036 - DNA, 16 bp, Homo sapiens
tttacagcactactct

SEQ ID NO: 4590037 - DNA, 18 bp, Homo sapiens
tttacagcagcaatattt

SEQ ID NO: 4590038 - DNA, 18 bp, Homo sapiens
tttacagtagttaacctt

SEQ ID NO: 4590039 - DNA, 16 bp, Homo sapiens
tttacagtatccaaaa

SEQ ID NO: 4590040 - DNA, 17 bp, Homo sapiens
tttacagtgtttctggc

SEQ ID NO: 4590041 - DNA, 19 bp, Homo sapiens
tttacagtgtttctggctt

SEQ ID NO: 4590042 - DNA, 20 bp, Homo sapiens
tttacataacggaaagtttt

SEQ ID NO: 4590043 - DNA, 21 bp, Homo sapiens
tttacataagttcctatacct

SEQ ID NO: 4590044 - DNA, 21 bp, Homo sapiens
tttacatacactgtatgttat

SEQ ID NO: 4590045 - DNA, 13 bp, Homo sapiens
tttacatagtctg

SEQ ID NO: 4590046 - DNA, 23 bp, Homo sapiens
tttacatagtctgaagtgaagta

SEQ ID NO: 4590047 - DNA, 16 bp, Homo sapiens
tttacattgttgagct

SEQ ID NO: 4590048 - DNA, 10 bp, Homo sapiens
tttacatttc

SEQ ID NO: 4590049 - DNA, 15 bp, Homo sapiens
tttacattttagggt

SEQ ID NO: 4590050 - DNA, 18 bp, Homo sapiens
tttaccaaaaaccatgtt

SEQ ID NO: 4590051 - DNA, 11 bp, Homo sapiens
tttaccaaagc

SEQ ID NO: 4590052 - DNA, 17 bp, Homo sapiens
tttaccaaatgaaatgc

SEQ ID NO: 4590053 - DNA, 21 bp, Homo sapiens
tttaccatgctcaatgaaaag

SEQ ID NO: 4590054 - DNA, 18 bp, Homo sapiens
tttacccctgcacagttt

SEQ ID NO: 4590055 - DNA, 21 bp, Homo sapiens
tttacctggcttatttaatat

SEQ ID NO: 4590056 - DNA, 13 bp, Homo sapiens
tttacctttatct

SEQ ID NO: 4590057 - DNA, 17 bp, Homo sapiens
tttacctttcagtgcag

SEQ ID NO: 4590058 - DNA, 17 bp, Homo sapiens
tttacgttcatcacctg

SEQ ID NO: 4590059 - DNA, 15 bp, Homo sapiens
tttacgttttagaaa

SEQ ID NO: 4590060 - DNA, 10 bp, Homo sapiens
tttactattt

SEQ ID NO: 4590061 - DNA, 14 bp, Homo sapiens
tttactatttgcca

SEQ ID NO: 4590062 - DNA, 22 bp, Homo sapiens
tttactccaggttattgcaata

SEQ ID NO: 4590063 - DNA, 13 bp, Homo sapiens
tttactcttaaat

SEQ ID NO: 4590064 - DNA, 14 bp, Homo sapiens
tttactctttgaaa

SEQ ID NO: 4590065 - DNA, 17 bp, Homo sapiens
tttactgaatgatctat

SEQ ID NO: 4590066 - DNA, 18 bp, Homo sapiens
tttactgaatgatctatt

SEQ ID NO: 4590067 - DNA, 21 bp, Homo sapiens
tttactgctctagaaagtata

SEQ ID NO: 4590068 - DNA, 20 bp, Homo sapiens
tttactgtatcaatttctaa

SEQ ID NO: 4590069 - DNA, 20 bp, Homo sapiens
tttactgtatgtttttactg

SEQ ID NO: 4590070 - DNA, 17 bp, Homo sapiens
tttactgtcagattaaa

SEQ ID NO: 4590071 - DNA, 15 bp, Homo sapiens
tttacttaactgttt

SEQ ID NO: 4590072 - DNA, 16 bp, Homo sapiens
tttacttaagtgttca

SEQ ID NO: 4590073 - DNA, 17 bp, Homo sapiens
tttacttaagtgttcat

SEQ ID NO: 4590074 - DNA, 22 bp, Homo sapiens
tttacttatctctcaaaacaat

SEQ ID NO: 4590075 - DNA, 13 bp, Homo sapiens
tttacttttgttt

SEQ ID NO: 4590076 - DNA, 20 bp, Homo sapiens
tttactttttccatttggca

SEQ ID NO: 4590077 - DNA, 23 bp, Homo sapiens
tttactttttttagtaagttaat

SEQ ID NO: 4590078 - DNA, 19 bp, Homo sapiens
tttacttttttttttttct

SEQ ID NO: 4590079 - DNA, 21 bp, Homo sapiens
tttagaaaaaaaactgaagat

SEQ ID NO: 4590080 - DNA, 16 bp, Homo sapiens
tttagaaaaacattta

SEQ ID NO: 4590081 - DNA, 19 bp, Homo sapiens
tttagaaaaagaacatgca

SEQ ID NO: 4590082 - DNA, 20 bp, Homo sapiens
tttagaaaaagaacatgcag

SEQ ID NO: 4590083 - DNA, 16 bp, Homo sapiens
tttagaaaactttaaa

SEQ ID NO: 4590084 - DNA, 22 bp, Homo sapiens
tttagaaaagggagtttaaaaa

SEQ ID NO: 4590085 - DNA, 13 bp, Homo sapiens
tttagaaaatata

SEQ ID NO: 4590086 - DNA, 16 bp, Homo sapiens
tttagaaaattttatg

SEQ ID NO: 4590087 - DNA, 22 bp, Homo sapiens
tttagaaacagtgcaacactgg

SEQ ID NO: 4590088 - DNA, 17 bp, Homo sapiens
tttagaaataaacctta

SEQ ID NO: 4590089 - DNA, 13 bp, Homo sapiens
tttagaaatcatt

SEQ ID NO: 4590090 - DNA, 13 bp, Homo sapiens
tttagaacagagg

SEQ ID NO: 4590091 - DNA, 16 bp, Homo sapiens
tttagacagtctcact

SEQ ID NO: 4590092 - DNA, 20 bp, Homo sapiens
tttagacagtctcactttgt

SEQ ID NO: 4590093 - DNA, 23 bp, Homo sapiens
tttagactgtggccatatatgct

SEQ ID NO: 4590094 - DNA, 15 bp, Homo sapiens
tttagacttcaagca

SEQ ID NO: 4590095 - DNA, 19 bp, Homo sapiens
tttagagataggaaactga

SEQ ID NO: 4590096 - DNA, 22 bp, Homo sapiens
tttagatgaatgtcagttgtta

SEQ ID NO: 4590097 - DNA, 20 bp, Homo sapiens
tttagatgcaagtggctgag

SEQ ID NO: 4590098 - DNA, 21 bp, Homo sapiens
tttagatgtagatatttgaaa

SEQ ID NO: 4590099 - DNA, 19 bp, Homo sapiens
tttagattttcttttgcct

SEQ ID NO: 4590100 - DNA, 22 bp, Homo sapiens
tttagcacgtttaaagttctgt

SEQ ID NO: 4590101 - DNA, 15 bp, Homo sapiens
tttagcagttctgca

SEQ ID NO: 4590102 - DNA, 18 bp, Homo sapiens
tttagcagttctgcaaat

SEQ ID NO: 4590103 - DNA, 14 bp, Homo sapiens
tttagggtgggtaa

SEQ ID NO: 4590104 - DNA, 15 bp, Homo sapiens
tttagggttctaaat

SEQ ID NO: 4590105 - DNA, 12 bp, Homo sapiens
tttagtaaatgt

SEQ ID NO: 4590106 - DNA, 14 bp, Homo sapiens
tttagtaagtatgt

SEQ ID NO: 4590107 - DNA, 23 bp, Homo sapiens
tttagtaagtatgttttttatgt

SEQ ID NO: 4590108 - DNA, 16 bp, Homo sapiens
tttagtacaatttcaa

SEQ ID NO: 4590109 - DNA, 17 bp, Homo sapiens
tttagtacaatttcaac

SEQ ID NO: 4590110 - DNA, 22 bp, Homo sapiens
tttagtagcagtgattgtctta

SEQ ID NO: 4590111 - DNA, 17 bp, Homo sapiens
tttagtagctcaaaaat

SEQ ID NO: 4590112 - DNA, 18 bp, Homo sapiens
tttagtataaatgtacat

SEQ ID NO: 4590113 - DNA, 17 bp, Homo sapiens
tttagtctttagctatt

SEQ ID NO: 4590114 - DNA, 13 bp, Homo sapiens
tttagtggaaaat

SEQ ID NO: 4590115 - DNA, 19 bp, Homo sapiens
tttagtgtgtaaaattaat

SEQ ID NO: 4590116 - DNA, 21 bp, Homo sapiens
tttagttacgtataatgcttt

SEQ ID NO: 4590117 - DNA, 22 bp, Homo sapiens
tttagttacgtataatgctttc

SEQ ID NO: 4590118 - DNA, 16 bp, Homo sapiens
tttagttgccaacagt

SEQ ID NO: 4590119 - DNA, 17 bp, Homo sapiens
tttagttgccaacagtt

SEQ ID NO: 4590120 - DNA, 13 bp, Homo sapiens
tttagtttgttaa

SEQ ID NO: 4590121 - DNA, 15 bp, Homo sapiens
tttagttttacacta

SEQ ID NO: 4590122 - DNA, 14 bp, Homo sapiens
tttataaaaagata

SEQ ID NO: 4590123 - DNA, 22 bp, Homo sapiens
tttataaaaataaatagaaaag

SEQ ID NO: 4590124 - DNA, 14 bp, Homo sapiens
tttataaaaatata

SEQ ID NO: 4590125 - DNA, 19 bp, Homo sapiens
tttataaaaatataaattg

SEQ ID NO: 4590126 - DNA, 13 bp, Homo sapiens
tttataaattaaa

SEQ ID NO: 4590127 - DNA, 17 bp, Homo sapiens
tttataaattaaatata

SEQ ID NO: 4590128 - DNA, 14 bp, Homo sapiens
tttataactaacat

SEQ ID NO: 4590129 - DNA, 21 bp, Homo sapiens
tttataagcatttgtattatt

SEQ ID NO: 4590130 - DNA, 19 bp, Homo sapiens
tttataatgatgaacttat

SEQ ID NO: 4590131 - DNA, 20 bp, Homo sapiens
tttataatgatgaacttata

SEQ ID NO: 4590132 - DNA, 12 bp, Homo sapiens
tttataatgtat

SEQ ID NO: 4590133 - DNA, 15 bp, Homo sapiens
tttataatgtatttg

SEQ ID NO: 4590134 - DNA, 17 bp, Homo sapiens
tttataattctcattaa

SEQ ID NO: 4590135 - DNA, 20 bp, Homo sapiens
tttatacaatggaataaatt

SEQ ID NO: 4590136 - DNA, 22 bp, Homo sapiens
tttataccagcttaatagctgt

SEQ ID NO: 4590137 - DNA, 16 bp, Homo sapiens
tttatactgaaggaaa

SEQ ID NO: 4590138 - DNA, 17 bp, Homo sapiens
tttatacttaaaaaatc

SEQ ID NO: 4590139 - DNA, 17 bp, Homo sapiens
tttatactttattgaaa

SEQ ID NO: 4590140 - DNA, 18 bp, Homo sapiens
tttatagcaacaacaatt

SEQ ID NO: 4590141 - DNA, 14 bp, Homo sapiens
tttataggaaaaaa

SEQ ID NO: 4590142 - DNA, 22 bp, Homo sapiens
tttataggaaaaaaactgggat

SEQ ID NO: 4590143 - DNA, 21 bp, Homo sapiens
tttataggaatagaggaagaa

SEQ ID NO: 4590144 - DNA, 20 bp, Homo sapiens
tttataggcagctgtcctgt

SEQ ID NO: 4590145 - DNA, 19 bp, Homo sapiens
tttataggggatacttgaa

SEQ ID NO: 4590146 - DNA, 22 bp, Homo sapiens
tttatagttattaaatgtttca

SEQ ID NO: 4590147 - DNA, 17 bp, Homo sapiens
tttatataaagtattct

SEQ ID NO: 4590148 - DNA, 22 bp, Homo sapiens
tttatataagcccttaataata

SEQ ID NO: 4590149 - DNA, 14 bp, Homo sapiens
tttatataagtctg

SEQ ID NO: 4590150 - DNA, 12 bp, Homo sapiens
tttatatacttt

SEQ ID NO: 4590151 - DNA, 19 bp, Homo sapiens
tttatatactttttcatga

SEQ ID NO: 4590152 - DNA, 16 bp, Homo sapiens
tttatatattatgtga

SEQ ID NO: 4590153 - DNA, 18 bp, Homo sapiens
tttatatattatgtgaag

SEQ ID NO: 4590154 - DNA, 14 bp, Homo sapiens
tttatatattgaaa

SEQ ID NO: 4590155 - DNA, 14 bp, Homo sapiens
tttatatcactgtc

SEQ ID NO: 4590156 - DNA, 15 bp, Homo sapiens
tttatatcactgtct

SEQ ID NO: 4590157 - DNA, 17 bp, Homo sapiens
tttatatcatacagttt

SEQ ID NO: 4590158 - DNA, 14 bp, Homo sapiens
tttatatgaagaaa

SEQ ID NO: 4590159 - DNA, 16 bp, Homo sapiens
tttatatgtaaatgtg

SEQ ID NO: 4590160 - DNA, 19 bp, Homo sapiens
tttatatgtaaatgtgtta

SEQ ID NO: 4590161 - DNA, 16 bp, Homo sapiens
tttatattacactaca

SEQ ID NO: 4590162 - DNA, 16 bp, Homo sapiens
tttatattagttgctt

SEQ ID NO: 4590163 - DNA, 20 bp, Homo sapiens
tttatattagttgctttgtt

SEQ ID NO: 4590164 - DNA, 21 bp, Homo sapiens
tttatattctaatagtttttc

SEQ ID NO: 4590165 - DNA, 17 bp, Homo sapiens
tttatattgtttttata

SEQ ID NO: 4590166 - DNA, 18 bp, Homo sapiens
tttatattgtttttatat

SEQ ID NO: 4590167 - DNA, 12 bp, Homo sapiens
tttatatttaaa

SEQ ID NO: 4590168 - DNA, 18 bp, Homo sapiens
tttatatttcctttatgt

SEQ ID NO: 4590169 - DNA, 15 bp, Homo sapiens
tttatcaactttggt

SEQ ID NO: 4590170 - DNA, 23 bp, Homo sapiens
tttatcaattatattatgtttaa

SEQ ID NO: 4590171 - DNA, 20 bp, Homo sapiens
tttatcagggaaactaagat

SEQ ID NO: 4590172 - DNA, 19 bp, Homo sapiens
tttatcatcctttcagttt

SEQ ID NO: 4590173 - DNA, 23 bp, Homo sapiens
tttatcatgcatgtcctgtaaag

SEQ ID NO: 4590174 - DNA, 14 bp, Homo sapiens
tttatcattcaagt

SEQ ID NO: 4590175 - DNA, 20 bp, Homo sapiens
tttatccccgtttcttgcaa

SEQ ID NO: 4590176 - DNA, 20 bp, Homo sapiens
tttatcctggccttgtactt

SEQ ID NO: 4590177 - DNA, 14 bp, Homo sapiens
tttatctataattt

SEQ ID NO: 4590178 - DNA, 22 bp, Homo sapiens
tttatctgtaattgtaattcca

SEQ ID NO: 4590179 - DNA, 13 bp, Homo sapiens
tttatctgtcttg

SEQ ID NO: 4590180 - DNA, 16 bp, Homo sapiens
tttatctttgtattct

SEQ ID NO: 4590181 - DNA, 15 bp, Homo sapiens
tttatctttgtgtaa

SEQ ID NO: 4590182 - DNA, 14 bp, Homo sapiens
tttatgagaaactt

SEQ ID NO: 4590183 - DNA, 13 bp, Homo sapiens
tttatgagttctt

SEQ ID NO: 4590184 - DNA, 17 bp, Homo sapiens
tttatgagttcttgttt

SEQ ID NO: 4590185 - DNA, 14 bp, Homo sapiens
tttatgcacttttt

SEQ ID NO: 4590186 - DNA, 13 bp, Homo sapiens
tttatgccatgtt

SEQ ID NO: 4590187 - DNA, 20 bp, Homo sapiens
tttatggcacctatttcttt

SEQ ID NO: 4590188 - DNA, 13 bp, Homo sapiens
tttatgggagaat

SEQ ID NO: 4590189 - DNA, 23 bp, Homo sapiens
tttatggtaactgctttctgttc

SEQ ID NO: 4590190 - DNA, 18 bp, Homo sapiens
tttatggtcctaaaagca

SEQ ID NO: 4590191 - DNA, 23 bp, Homo sapiens
tttatggtcctaaaagcaaaata

SEQ ID NO: 4590192 - DNA, 15 bp, Homo sapiens
tttatggttttcatt

SEQ ID NO: 4590193 - DNA, 19 bp, Homo sapiens
tttatgtaatgaagtaaag

SEQ ID NO: 4590194 - DNA, 19 bp, Homo sapiens
tttatgtctgtggattttt

SEQ ID NO: 4590195 - DNA, 21 bp, Homo sapiens
tttatgtgaaatgctttctgt

SEQ ID NO: 4590196 - DNA, 16 bp, Homo sapiens
tttatgtgagatttcc

SEQ ID NO: 4590197 - DNA, 17 bp, Homo sapiens
tttatgtgttatgaaca

SEQ ID NO: 4590198 - DNA, 18 bp, Homo sapiens
tttatgtgttatgaacat

SEQ ID NO: 4590199 - DNA, 12 bp, Homo sapiens
tttatgtgttct

SEQ ID NO: 4590200 - DNA, 20 bp, Homo sapiens
tttatgttaagggaagaatt

SEQ ID NO: 4590201 - DNA, 17 bp, Homo sapiens
tttattaatctactgta

SEQ ID NO: 4590202 - DNA, 13 bp, Homo sapiens
tttattaatctta

SEQ ID NO: 4590203 - DNA, 18 bp, Homo sapiens
tttattacaatgtatctt

SEQ ID NO: 4590204 - DNA, 14 bp, Homo sapiens
tttattaccagtgg

SEQ ID NO: 4590205 - DNA, 13 bp, Homo sapiens
tttattatacacc

SEQ ID NO: 4590206 - DNA, 17 bp, Homo sapiens
tttattattattactgt

SEQ ID NO: 4590207 - DNA, 14 bp, Homo sapiens
tttattattcctag

SEQ ID NO: 4590208 - DNA, 18 bp, Homo sapiens
tttattcagctagaattt

SEQ ID NO: 4590209 - DNA, 23 bp, Homo sapiens
tttattcagctagaatttctggt

SEQ ID NO: 4590210 - DNA, 23 bp, Homo sapiens
tttattccagaatgctgtacatc

SEQ ID NO: 4590211 - DNA, 18 bp, Homo sapiens
tttattccttctgtagtg

SEQ ID NO: 4590212 - DNA, 23 bp, Homo sapiens
tttattctcaggtaatcatttta

SEQ ID NO: 4590213 - DNA, 12 bp, Homo sapiens
tttattctgtat

SEQ ID NO: 4590214 - DNA, 14 bp, Homo sapiens
tttattctgtccat

SEQ ID NO: 4590215 - DNA, 12 bp, Homo sapiens
tttattctgtta

SEQ ID NO: 4590216 - DNA, 14 bp, Homo sapiens
tttattctgttata

SEQ ID NO: 4590217 - DNA, 17 bp, Homo sapiens
tttattgaatactgtct

SEQ ID NO: 4590218 - DNA, 15 bp, Homo sapiens
tttattgacacagaa

SEQ ID NO: 4590219 - DNA, 14 bp, Homo sapiens
tttattgcagaatg

SEQ ID NO: 4590220 - DNA, 16 bp, Homo sapiens
tttattgcagaatgtg

SEQ ID NO: 4590221 - DNA, 12 bp, Homo sapiens
tttattgcattg

SEQ ID NO: 4590222 - DNA, 13 bp, Homo sapiens
tttattgcttgtt

SEQ ID NO: 4590223 - DNA, 23 bp, Homo sapiens
tttattggggaattaaatagtgt

SEQ ID NO: 4590224 - DNA, 23 bp, Homo sapiens
tttattggttttgcagaagaagg

SEQ ID NO: 4590225 - DNA, 12 bp, Homo sapiens
tttattgtaaaa

SEQ ID NO: 4590226 - DNA, 22 bp, Homo sapiens
tttattgtctgtctacatttct

SEQ ID NO: 4590227 - DNA, 14 bp, Homo sapiens
tttatttaaaactc

SEQ ID NO: 4590228 - DNA, 19 bp, Homo sapiens
tttatttaaaactctggtg

SEQ ID NO: 4590229 - DNA, 14 bp, Homo sapiens
tttatttcaatgta

SEQ ID NO: 4590230 - DNA, 20 bp, Homo sapiens
tttatttcatttttcaatag

SEQ ID NO: 4590231 - DNA, 13 bp, Homo sapiens
tttatttcctccc

SEQ ID NO: 4590232 - DNA, 15 bp, Homo sapiens
tttatttctgtgaaa

SEQ ID NO: 4590233 - DNA, 22 bp, Homo sapiens
tttatttctgtgaaagaagtat

SEQ ID NO: 4590234 - DNA, 23 bp, Homo sapiens
tttatttgcaaatatactttact

SEQ ID NO: 4590235 - DNA, 13 bp, Homo sapiens
tttatttggttcc

SEQ ID NO: 4590236 - DNA, 22 bp, Homo sapiens
tttattttaaaaaacactgata

SEQ ID NO: 4590237 - DNA, 20 bp, Homo sapiens
tttattttaaaatttcatag

SEQ ID NO: 4590238 - DNA, 15 bp, Homo sapiens
tttattttagcagtt

SEQ ID NO: 4590239 - DNA, 19 bp, Homo sapiens
tttattttagcagttctgc

SEQ ID NO: 4590240 - DNA, 11 bp, Homo sapiens
tttattttctt

SEQ ID NO: 4590241 - DNA, 14 bp, Homo sapiens
tttattttgacata

SEQ ID NO: 4590242 - DNA, 17 bp, Homo sapiens
tttatttttcttgtctt

SEQ ID NO: 4590243 - DNA, 19 bp, Homo sapiens
tttatttttgtgtaggtgt

SEQ ID NO: 4590244 - DNA, 21 bp, Homo sapiens
tttattttttaaaaagtgttt

SEQ ID NO: 4590245 - DNA, 18 bp, Homo sapiens
tttcaaacttttgaaaga

SEQ ID NO: 4590246 - DNA, 12 bp, Homo sapiens
tttcaaagcaat

SEQ ID NO: 4590247 - DNA, 14 bp, Homo sapiens
tttcaaagcaattg

SEQ ID NO: 4590248 - DNA, 21 bp, Homo sapiens
tttcaaagcaattgaaatgca

SEQ ID NO: 4590249 - DNA, 22 bp, Homo sapiens
tttcaaagcaattgaaatgcat

SEQ ID NO: 4590250 - DNA, 16 bp, Homo sapiens
tttcaaataatgcttt

SEQ ID NO: 4590251 - DNA, 10 bp, Homo sapiens
tttcaaatgt

SEQ ID NO: 4590252 - DNA, 13 bp, Homo sapiens
tttcaaatgttag

SEQ ID NO: 4590253 - DNA, 14 bp, Homo sapiens
tttcaaatgttctc

SEQ ID NO: 4590254 - DNA, 23 bp, Homo sapiens
tttcaaatttagaaactaattga

SEQ ID NO: 4590255 - DNA, 20 bp, Homo sapiens
tttcaacaattggtgtcatt

SEQ ID NO: 4590256 - DNA, 23 bp, Homo sapiens
tttcaagacagatgagcaggagc

SEQ ID NO: 4590257 - DNA, 21 bp, Homo sapiens
tttcaagagtctaatagtctt

SEQ ID NO: 4590258 - DNA, 22 bp, Homo sapiens
tttcaatatattgaacttttgt

SEQ ID NO: 4590259 - DNA, 21 bp, Homo sapiens
tttcaatatgcaagcagcttt

SEQ ID NO: 4590260 - DNA, 16 bp, Homo sapiens
tttcaatattttaact

SEQ ID NO: 4590261 - DNA, 13 bp, Homo sapiens
tttcaatcttcta

SEQ ID NO: 4590262 - DNA, 17 bp, Homo sapiens
tttcaatgtgattcttc

SEQ ID NO: 4590263 - DNA, 20 bp, Homo sapiens
tttcacaaatccttcaaaat

SEQ ID NO: 4590264 - DNA, 13 bp, Homo sapiens
tttcacaagcaac

SEQ ID NO: 4590265 - DNA, 17 bp, Homo sapiens
tttcacagctatgaaga

SEQ ID NO: 4590266 - DNA, 15 bp, Homo sapiens
tttcacatttctact

SEQ ID NO: 4590267 - DNA, 16 bp, Homo sapiens
tttcacatttttgtaa

SEQ ID NO: 4590268 - DNA, 19 bp, Homo sapiens
tttcacatttttgtaatgc

SEQ ID NO: 4590269 - DNA, 20 bp, Homo sapiens
tttcaccaaaatttctacac

SEQ ID NO: 4590270 - DNA, 21 bp, Homo sapiens
tttcaccccatccctccttaa

SEQ ID NO: 4590271 - DNA, 13 bp, Homo sapiens
tttcacccctccc

SEQ ID NO: 4590272 - DNA, 14 bp, Homo sapiens
tttcacccctccct

SEQ ID NO: 4590273 - DNA, 18 bp, Homo sapiens
tttcacccctccctttct

SEQ ID NO: 4590274 - DNA, 17 bp, Homo sapiens
tttcaccctcatgaaaa

SEQ ID NO: 4590275 - DNA, 18 bp, Homo sapiens
tttcacctgtaaacctga

SEQ ID NO: 4590276 - DNA, 16 bp, Homo sapiens
tttcaccttttcagga

SEQ ID NO: 4590277 - DNA, 16 bp, Homo sapiens
tttcactataatgtga

SEQ ID NO: 4590278 - DNA, 20 bp, Homo sapiens
tttcactataatgtgaaatg

SEQ ID NO: 4590279 - DNA, 17 bp, Homo sapiens
tttcactttctgtctag

SEQ ID NO: 4590280 - DNA, 20 bp, Homo sapiens
tttcactttgtgtattaaat

SEQ ID NO: 4590281 - DNA, 20 bp, Homo sapiens
tttcagaagttagtttgtat

SEQ ID NO: 4590282 - DNA, 14 bp, Homo sapiens
tttcagaccccagc

SEQ ID NO: 4590283 - DNA, 18 bp, Homo sapiens
tttcagactgcctgtctg

SEQ ID NO: 4590284 - DNA, 23 bp, Homo sapiens
tttcagactgcctgtctgcttgc

SEQ ID NO: 4590285 - DNA, 24 bp, Homo sapiens
tttcagactgcctgtctgcttgca

SEQ ID NO: 4590286 - DNA, 15 bp, Homo sapiens
tttcagacttgtcaa

SEQ ID NO: 4590287 - DNA, 16 bp, Homo sapiens
tttcagagaaaggact

SEQ ID NO: 4590288 - DNA, 22 bp, Homo sapiens
tttcagagccagcctggctctg

SEQ ID NO: 4590289 - DNA, 19 bp, Homo sapiens
tttcagagggtaagtaaac

SEQ ID NO: 4590290 - DNA, 20 bp, Homo sapiens
tttcagagggtaagtaaaca

SEQ ID NO: 4590291 - DNA, 22 bp, Homo sapiens
tttcagagtgactacacacagt

SEQ ID NO: 4590292 - DNA, 16 bp, Homo sapiens
tttcagatataaaaga

SEQ ID NO: 4590293 - DNA, 18 bp, Homo sapiens
tttcagatataaaagact

SEQ ID NO: 4590294 - DNA, 23 bp, Homo sapiens
tttcagatatcttggacaaatca

SEQ ID NO: 4590295 - DNA, 16 bp, Homo sapiens
tttcagatgtaatgtt

SEQ ID NO: 4590296 - DNA, 15 bp, Homo sapiens
tttcagatgtcttct

SEQ ID NO: 4590297 - DNA, 20 bp, Homo sapiens
tttcagatgtcttctgcctg

SEQ ID NO: 4590298 - DNA, 21 bp, Homo sapiens
tttcagatgtcttctgcctgt

SEQ ID NO: 4590299 - DNA, 16 bp, Homo sapiens
tttcagattgtggaat

SEQ ID NO: 4590300 - DNA, 15 bp, Homo sapiens
tttcagattttgata

SEQ ID NO: 4590301 - DNA, 16 bp, Homo sapiens
tttcagccaaagtcct

SEQ ID NO: 4590302 - DNA, 22 bp, Homo sapiens
tttcagccacatgccccaggct

SEQ ID NO: 4590303 - DNA, 12 bp, Homo sapiens
tttcaggaaaat

SEQ ID NO: 4590304 - DNA, 19 bp, Homo sapiens
tttcaggccagtgtggtgt

SEQ ID NO: 4590305 - DNA, 20 bp, Homo sapiens
tttcagggtcttggctgcct

SEQ ID NO: 4590306 - DNA, 13 bp, Homo sapiens
tttcagtaaagtg

SEQ ID NO: 4590307 - DNA, 16 bp, Homo sapiens
tttcagtgatcttcac

SEQ ID NO: 4590308 - DNA, 17 bp, Homo sapiens
tttcagtgatcttcact

SEQ ID NO: 4590309 - DNA, 18 bp, Homo sapiens
tttcagtgatttttagta

SEQ ID NO: 4590310 - DNA, 21 bp, Homo sapiens
tttcagtggggcagtcattat

SEQ ID NO: 4590311 - DNA, 24 bp, Homo sapiens
tttcagtttttattaatctactgt

SEQ ID NO: 4590312 - DNA, 18 bp, Homo sapiens
tttcataacttattgctg

SEQ ID NO: 4590313 - DNA, 16 bp, Homo sapiens
tttcataattctgaaa

SEQ ID NO: 4590314 - DNA, 19 bp, Homo sapiens
tttcataattctgaaacaa

SEQ ID NO: 4590315 - DNA, 16 bp, Homo sapiens
tttcataccacttgaa

SEQ ID NO: 4590316 - DNA, 16 bp, Homo sapiens
tttcatactgtacaca

SEQ ID NO: 4590317 - DNA, 20 bp, Homo sapiens
tttcatactgtacacatttc

SEQ ID NO: 4590318 - DNA, 21 bp, Homo sapiens
tttcatactgtacacatttct

SEQ ID NO: 4590319 - DNA, 19 bp, Homo sapiens
tttcatcatttcagccaaa

SEQ ID NO: 4590320 - DNA, 21 bp, Homo sapiens
tttcatccagtttgttctccg

SEQ ID NO: 4590321 - DNA, 19 bp, Homo sapiens
tttcatcccgtatcacagt

SEQ ID NO: 4590322 - DNA, 22 bp, Homo sapiens
tttcatcccgtatcacagtgtt

SEQ ID NO: 4590323 - DNA, 14 bp, Homo sapiens
tttcatctaccttt

SEQ ID NO: 4590324 - DNA, 18 bp, Homo sapiens
tttcatctaccttttctg

SEQ ID NO: 4590325 - DNA, 19 bp, Homo sapiens
tttcatctaccttttctgg

SEQ ID NO: 4590326 - DNA, 12 bp, Homo sapiens
tttcatctcatt

SEQ ID NO: 4590327 - DNA, 23 bp, Homo sapiens
tttcatctcatttaagggaaaaa

SEQ ID NO: 4590328 - DNA, 11 bp, Homo sapiens
tttcatctgct

SEQ ID NO: 4590329 - DNA, 17 bp, Homo sapiens
tttcatctgctctcctt

SEQ ID NO: 4590330 - DNA, 22 bp, Homo sapiens
tttcatctgctctccttcctgg

SEQ ID NO: 4590331 - DNA, 15 bp, Homo sapiens
tttcatgaaaaagct

SEQ ID NO: 4590332 - DNA, 17 bp, Homo sapiens
tttcatgaaaatggagt

SEQ ID NO: 4590333 - DNA, 19 bp, Homo sapiens
tttcatgataatgaacaga

SEQ ID NO: 4590334 - DNA, 21 bp, Homo sapiens
tttcatgattagcaagttaca

SEQ ID NO: 4590335 - DNA, 19 bp, Homo sapiens
tttcatgctctgcaaaagg

SEQ ID NO: 4590336 - DNA, 19 bp, Homo sapiens
tttcatggcaatgaaaatt

SEQ ID NO: 4590337 - DNA, 20 bp, Homo sapiens
tttcatggcaatgaaaattt

SEQ ID NO: 4590338 - DNA, 19 bp, Homo sapiens
tttcatgttagttacctta

SEQ ID NO: 4590339 - DNA, 15 bp, Homo sapiens
tttcattaaataaat

SEQ ID NO: 4590340 - DNA, 17 bp, Homo sapiens
tttcattaaataaattt

SEQ ID NO: 4590341 - DNA, 17 bp, Homo sapiens
tttcattatgctttgaa

SEQ ID NO: 4590342 - DNA, 15 bp, Homo sapiens
tttcattcaacacat

SEQ ID NO: 4590343 - DNA, 16 bp, Homo sapiens
tttcattcaacacatt

SEQ ID NO: 4590344 - DNA, 15 bp, Homo sapiens
tttcattcatgaata

SEQ ID NO: 4590345 - DNA, 15 bp, Homo sapiens
tttcattcattttaa

SEQ ID NO: 4590346 - DNA, 14 bp, Homo sapiens
tttcattctgccaa

SEQ ID NO: 4590347 - DNA, 14 bp, Homo sapiens
tttcattcttgtat

SEQ ID NO: 4590348 - DNA, 19 bp, Homo sapiens
tttcattgtacaagtatta

SEQ ID NO: 4590349 - DNA, 14 bp, Homo sapiens
tttcatttatctat

SEQ ID NO: 4590350 - DNA, 17 bp, Homo sapiens
tttcatttatctataat

SEQ ID NO: 4590351 - DNA, 12 bp, Homo sapiens
tttcatttcaca

SEQ ID NO: 4590352 - DNA, 16 bp, Homo sapiens
tttcattttaaaaagt

SEQ ID NO: 4590353 - DNA, 17 bp, Homo sapiens
tttcattttaaaaagtc

SEQ ID NO: 4590354 - DNA, 17 bp, Homo sapiens
tttcattttaactggca

SEQ ID NO: 4590355 - DNA, 18 bp, Homo sapiens
tttcattttaatatataa

SEQ ID NO: 4590356 - DNA, 20 bp, Homo sapiens
tttcattttaatatataatt

SEQ ID NO: 4590357 - DNA, 15 bp, Homo sapiens
tttccaaaacaaaaa

SEQ ID NO: 4590358 - DNA, 13 bp, Homo sapiens
tttccaaattatt

SEQ ID NO: 4590359 - DNA, 16 bp, Homo sapiens
tttccaagcaaaatct

SEQ ID NO: 4590360 - DNA, 19 bp, Homo sapiens
tttccaagcaaaatctaaa

SEQ ID NO: 4590361 - DNA, 18 bp, Homo sapiens
tttccaatattttaataa

SEQ ID NO: 4590362 - DNA, 19 bp, Homo sapiens
tttccaccaggccgtgcct

SEQ ID NO: 4590363 - DNA, 23 bp, Homo sapiens
tttccacggagccactcctctga

SEQ ID NO: 4590364 - DNA, 15 bp, Homo sapiens
tttccagaaaccaaa

SEQ ID NO: 4590365 - DNA, 18 bp, Homo sapiens
tttccagagttgttgttt

SEQ ID NO: 4590366 - DNA, 13 bp, Homo sapiens
tttccagcctatc

SEQ ID NO: 4590367 - DNA, 16 bp, Homo sapiens
tttccatcatgtctgt

SEQ ID NO: 4590368 - DNA, 20 bp, Homo sapiens
tttccatttttttctttact

SEQ ID NO: 4590369 - DNA, 18 bp, Homo sapiens
tttccccaataaagcctt

SEQ ID NO: 4590370 - DNA, 15 bp, Homo sapiens
tttccccagccacag

SEQ ID NO: 4590371 - DNA, 20 bp, Homo sapiens
tttcccccacagttttaata

SEQ ID NO: 4590372 - DNA, 12 bp, Homo sapiens
tttccccccact

SEQ ID NO: 4590373 - DNA, 22 bp, Homo sapiens
tttcccccttcccatttcttcc

SEQ ID NO: 4590374 - DNA, 15 bp, Homo sapiens
tttccctcaccccct

SEQ ID NO: 4590375 - DNA, 19 bp, Homo sapiens
tttccctcaccccctccca

SEQ ID NO: 4590376 - DNA, 16 bp, Homo sapiens
tttccctgcagacctc

SEQ ID NO: 4590377 - DNA, 19 bp, Homo sapiens
tttcccttacaaggtgggg

SEQ ID NO: 4590378 - DNA, 14 bp, Homo sapiens
tttccgactgccca

SEQ ID NO: 4590379 - DNA, 15 bp, Homo sapiens
tttccgactgcccag

SEQ ID NO: 4590380 - DNA, 16 bp, Homo sapiens
tttcctaagacatttt

SEQ ID NO: 4590381 - DNA, 19 bp, Homo sapiens
tttcctaagacatttttca

SEQ ID NO: 4590382 - DNA, 20 bp, Homo sapiens
tttcctaagacatttttcat

SEQ ID NO: 4590383 - DNA, 24 bp, Homo sapiens
tttcctaataaagttctgtactca

SEQ ID NO: 4590384 - DNA, 15 bp, Homo sapiens
tttcctaatatcaaa

SEQ ID NO: 4590385 - DNA, 22 bp, Homo sapiens
tttcctcaaaacttcagacata

SEQ ID NO: 4590386 - DNA, 22 bp, Homo sapiens
tttcctcatctatggttctaaa

SEQ ID NO: 4590387 - DNA, 15 bp, Homo sapiens
tttcctccccctgca

SEQ ID NO: 4590388 - DNA, 12 bp, Homo sapiens
tttcctcctctg

SEQ ID NO: 4590389 - DNA, 14 bp, Homo sapiens
tttcctcctctgcc

SEQ ID NO: 4590390 - DNA, 15 bp, Homo sapiens
tttcctcctctgcct

SEQ ID NO: 4590391 - DNA, 22 bp, Homo sapiens
tttcctcctgaggctttggatt

SEQ ID NO: 4590392 - DNA, 11 bp, Homo sapiens
tttcctctaaa

SEQ ID NO: 4590393 - DNA, 20 bp, Homo sapiens
tttcctctattgatgtacag

SEQ ID NO: 4590394 - DNA, 19 bp, Homo sapiens
tttcctctgttaaaaacct

SEQ ID NO: 4590395 - DNA, 12 bp, Homo sapiens
tttcctcttgaa

SEQ ID NO: 4590396 - DNA, 18 bp, Homo sapiens
tttcctggcagctgctgt

SEQ ID NO: 4590397 - DNA, 16 bp, Homo sapiens
tttcctggccctccac

SEQ ID NO: 4590398 - DNA, 13 bp, Homo sapiens
tttcctgtaatat

SEQ ID NO: 4590399 - DNA, 21 bp, Homo sapiens
tttcctgtaatatatttatat

SEQ ID NO: 4590400 - DNA, 22 bp, Homo sapiens
tttcctgtggttttattacaaa

SEQ ID NO: 4590401 - DNA, 18 bp, Homo sapiens
tttcctgttcagcattct

SEQ ID NO: 4590402 - DNA, 18 bp, Homo sapiens
tttccttatttgccttct

SEQ ID NO: 4590403 - DNA, 15 bp, Homo sapiens
tttccttccatccct

SEQ ID NO: 4590404 - DNA, 18 bp, Homo sapiens
tttccttcccttttctgt

SEQ ID NO: 4590405 - DNA, 15 bp, Homo sapiens
tttcctttttcttcg

SEQ ID NO: 4590406 - DNA, 16 bp, Homo sapiens
tttcctttttcttcgc

SEQ ID NO: 4590407 - DNA, 16 bp, Homo sapiens
tttcctttttgacact

SEQ ID NO: 4590408 - DNA, 22 bp, Homo sapiens
tttccttttttcccataagaca

SEQ ID NO: 4590409 - DNA, 15 bp, Homo sapiens
tttccttttttgaga

SEQ ID NO: 4590410 - DNA, 13 bp, Homo sapiens
tttcgataaacaa

SEQ ID NO: 4590411 - DNA, 20 bp, Homo sapiens
tttcgataaacaacaaggtg

SEQ ID NO: 4590412 - DNA, 12 bp, Homo sapiens
tttcgcttgctt

SEQ ID NO: 4590413 - DNA, 16 bp, Homo sapiens
tttcgtaatagctcag

SEQ ID NO: 4590414 - DNA, 17 bp, Homo sapiens
tttcgtaatagctcaga

SEQ ID NO: 4590415 - DNA, 15 bp, Homo sapiens
tttctaaagtaaaat

SEQ ID NO: 4590416 - DNA, 22 bp, Homo sapiens
tttctaaagtaaaattgaagca

SEQ ID NO: 4590417 - DNA, 22 bp, Homo sapiens
tttctaaccttcacgattaact

SEQ ID NO: 4590418 - DNA, 21 bp, Homo sapiens
tttctaagttattttgtacat

SEQ ID NO: 4590419 - DNA, 18 bp, Homo sapiens
tttctaatccttttcctt

SEQ ID NO: 4590420 - DNA, 19 bp, Homo sapiens
tttctaatccttttcctta

SEQ ID NO: 4590421 - DNA, 19 bp, Homo sapiens
tttctaatgaggagagaaa

SEQ ID NO: 4590422 - DNA, 16 bp, Homo sapiens
tttctaatgtttacta

SEQ ID NO: 4590423 - DNA, 15 bp, Homo sapiens
tttctaattaacctt

SEQ ID NO: 4590424 - DNA, 19 bp, Homo sapiens
tttctacacattgctacct

SEQ ID NO: 4590425 - DNA, 19 bp, Homo sapiens
tttctaccacacacagcct

SEQ ID NO: 4590426 - DNA, 21 bp, Homo sapiens
tttctagaatttatcacactt

SEQ ID NO: 4590427 - DNA, 21 bp, Homo sapiens
tttctagactataaatgttgc

SEQ ID NO: 4590428 - DNA, 13 bp, Homo sapiens
tttctagactcaa

SEQ ID NO: 4590429 - DNA, 15 bp, Homo sapiens
tttctagagacacat

SEQ ID NO: 4590430 - DNA, 16 bp, Homo sapiens
tttctagagacacatt

SEQ ID NO: 4590431 - DNA, 21 bp, Homo sapiens
tttctagagttatcttcttta

SEQ ID NO: 4590432 - DNA, 16 bp, Homo sapiens
tttctagatacaataa

SEQ ID NO: 4590433 - DNA, 18 bp, Homo sapiens
tttctagatacaataaat

SEQ ID NO: 4590434 - DNA, 20 bp, Homo sapiens
tttctagatacaataaattg

SEQ ID NO: 4590435 - DNA, 14 bp, Homo sapiens
tttctagttgagga

SEQ ID NO: 4590436 - DNA, 18 bp, Homo sapiens
tttctagtttgtttagtt

SEQ ID NO: 4590437 - DNA, 23 bp, Homo sapiens
tttctataaatttaagaaaacaa

SEQ ID NO: 4590438 - DNA, 13 bp, Homo sapiens
tttctatatcaaa

SEQ ID NO: 4590439 - DNA, 20 bp, Homo sapiens
tttctatcaaccttcaagta

SEQ ID NO: 4590440 - DNA, 14 bp, Homo sapiens
tttctatgcaggca

SEQ ID NO: 4590441 - DNA, 17 bp, Homo sapiens
tttctatggattcactt

SEQ ID NO: 4590442 - DNA, 18 bp, Homo sapiens
tttctatggattcacttc

SEQ ID NO: 4590443 - DNA, 17 bp, Homo sapiens
tttctatgtcattttta

SEQ ID NO: 4590444 - DNA, 13 bp, Homo sapiens
tttctattttgca

SEQ ID NO: 4590445 - DNA, 21 bp, Homo sapiens
tttctcactatatatatttct

SEQ ID NO: 4590446 - DNA, 13 bp, Homo sapiens
tttctcaggagct

SEQ ID NO: 4590447 - DNA, 18 bp, Homo sapiens
tttctcaggagcttcaat

SEQ ID NO: 4590448 - DNA, 17 bp, Homo sapiens
tttctcataattttgca

SEQ ID NO: 4590449 - DNA, 13 bp, Homo sapiens
tttctcatgttga

SEQ ID NO: 4590450 - DNA, 19 bp, Homo sapiens
tttctccatcccctccctg

SEQ ID NO: 4590451 - DNA, 22 bp, Homo sapiens
tttctccatcccctccctgcct

SEQ ID NO: 4590452 - DNA, 23 bp, Homo sapiens
tttctccatcccctccctgcctg

SEQ ID NO: 4590453 - DNA, 13 bp, Homo sapiens
tttctcccaagaa

SEQ ID NO: 4590454 - DNA, 15 bp, Homo sapiens
tttctcccaaggcca

SEQ ID NO: 4590455 - DNA, 18 bp, Homo sapiens
tttctcccagtatgtttt

SEQ ID NO: 4590456 - DNA, 15 bp, Homo sapiens
tttctcctcagaagt

SEQ ID NO: 4590457 - DNA, 16 bp, Homo sapiens
tttctcctcagaagtg

SEQ ID NO: 4590458 - DNA, 14 bp, Homo sapiens
tttctcctccatgg

SEQ ID NO: 4590459 - DNA, 15 bp, Homo sapiens
tttctcctcccttcc

SEQ ID NO: 4590460 - DNA, 18 bp, Homo sapiens
tttctcctttaattgtaa

SEQ ID NO: 4590461 - DNA, 15 bp, Homo sapiens
tttctcctttgcaat

SEQ ID NO: 4590462 - DNA, 16 bp, Homo sapiens
tttctccttttcctat

SEQ ID NO: 4590463 - DNA, 23 bp, Homo sapiens
tttctcgggtgcatttgagagaa

SEQ ID NO: 4590464 - DNA, 18 bp, Homo sapiens
tttctctataaagggtca

SEQ ID NO: 4590465 - DNA, 15 bp, Homo sapiens
tttctctcctgtcct

SEQ ID NO: 4590466 - DNA, 15 bp, Homo sapiens
tttctctctcatgcc

SEQ ID NO: 4590467 - DNA, 17 bp, Homo sapiens
tttctctctctctacct

SEQ ID NO: 4590468 - DNA, 21 bp, Homo sapiens
tttctctctctctacctttta

SEQ ID NO: 4590469 - DNA, 12 bp, Homo sapiens
tttctctgagca

SEQ ID NO: 4590470 - DNA, 20 bp, Homo sapiens
tttctctggtggtcttcctt

SEQ ID NO: 4590471 - DNA, 13 bp, Homo sapiens
tttctcttttctt

SEQ ID NO: 4590472 - DNA, 14 bp, Homo sapiens
tttctgaactgtta

SEQ ID NO: 4590473 - DNA, 22 bp, Homo sapiens
tttctgaagaagttaattctta

SEQ ID NO: 4590474 - DNA, 23 bp, Homo sapiens
tttctgaagaagttaattcttaa

SEQ ID NO: 4590475 - DNA, 14 bp, Homo sapiens
tttctgaagtgctt

SEQ ID NO: 4590476 - DNA, 22 bp, Homo sapiens
tttctgaatctagagaacagta

SEQ ID NO: 4590477 - DNA, 19 bp, Homo sapiens
tttctgacatcaaaacttg

SEQ ID NO: 4590478 - DNA, 15 bp, Homo sapiens
tttctgcctccttta

SEQ ID NO: 4590479 - DNA, 11 bp, Homo sapiens
tttctgcctcg

SEQ ID NO: 4590480 - DNA, 22 bp, Homo sapiens
tttctgctttctttgattctcc

SEQ ID NO: 4590481 - DNA, 11 bp, Homo sapiens
tttctggactg

SEQ ID NO: 4590482 - DNA, 20 bp, Homo sapiens
tttctggctgtgatcttaaa

SEQ ID NO: 4590483 - DNA, 15 bp, Homo sapiens
tttctggtgtatatt

SEQ ID NO: 4590484 - DNA, 15 bp, Homo sapiens
tttctgtaccagtta

SEQ ID NO: 4590485 - DNA, 16 bp, Homo sapiens
tttctgtagactctaa

SEQ ID NO: 4590486 - DNA, 17 bp, Homo sapiens
tttctgtatatactttt

SEQ ID NO: 4590487 - DNA, 13 bp, Homo sapiens
tttctgtatttaa

SEQ ID NO: 4590488 - DNA, 15 bp, Homo sapiens
tttctgtatttttta

SEQ ID NO: 4590489 - DNA, 14 bp, Homo sapiens
tttctgtgaaagaa

SEQ ID NO: 4590490 - DNA, 14 bp, Homo sapiens
tttctgtgcttgga

SEQ ID NO: 4590491 - DNA, 14 bp, Homo sapiens
tttctgttggataa

SEQ ID NO: 4590492 - DNA, 15 bp, Homo sapiens
tttctgttggattcc

SEQ ID NO: 4590493 - DNA, 16 bp, Homo sapiens
tttcttaaaacacatg

SEQ ID NO: 4590494 - DNA, 17 bp, Homo sapiens
tttcttaaaacacatga

SEQ ID NO: 4590495 - DNA, 18 bp, Homo sapiens
tttcttaaaacacatgat

SEQ ID NO: 4590496 - DNA, 22 bp, Homo sapiens
tttcttaaaacacatgatacca

SEQ ID NO: 4590497 - DNA, 18 bp, Homo sapiens
tttcttaaaccttcagtt

SEQ ID NO: 4590498 - DNA, 13 bp, Homo sapiens
tttcttaaataag

SEQ ID NO: 4590499 - DNA, 15 bp, Homo sapiens
tttcttaaattattt

SEQ ID NO: 4590500 - DNA, 18 bp, Homo sapiens
tttcttaacttcttgctt

SEQ ID NO: 4590501 - DNA, 19 bp, Homo sapiens
tttcttaagaattcaaatt

SEQ ID NO: 4590502 - DNA, 21 bp, Homo sapiens
tttcttaattttcaccgagca

SEQ ID NO: 4590503 - DNA, 17 bp, Homo sapiens
tttcttatgtgacatta

SEQ ID NO: 4590504 - DNA, 19 bp, Homo sapiens
tttcttcaccaagtgcaat

SEQ ID NO: 4590505 - DNA, 20 bp, Homo sapiens
tttcttcacttacaagaaag

SEQ ID NO: 4590506 - DNA, 23 bp, Homo sapiens
tttcttcacttcaagctgttatt

SEQ ID NO: 4590507 - DNA, 17 bp, Homo sapiens
tttcttcaggtaacact

SEQ ID NO: 4590508 - DNA, 12 bp, Homo sapiens
tttcttcattgt

SEQ ID NO: 4590509 - DNA, 15 bp, Homo sapiens
tttcttccctgcttt

SEQ ID NO: 4590510 - DNA, 14 bp, Homo sapiens
tttcttcctcttct

SEQ ID NO: 4590511 - DNA, 23 bp, Homo sapiens
tttcttctgtatttttttttcta

SEQ ID NO: 4590512 - DNA, 13 bp, Homo sapiens
tttcttcttcatg

SEQ ID NO: 4590513 - DNA, 13 bp, Homo sapiens
tttcttcttccct

SEQ ID NO: 4590514 - DNA, 16 bp, Homo sapiens
tttcttcttctaagaa

SEQ ID NO: 4590515 - DNA, 17 bp, Homo sapiens
tttcttcttctaagaag

SEQ ID NO: 4590516 - DNA, 18 bp, Homo sapiens
tttcttcttctaagaaga

SEQ ID NO: 4590517 - DNA, 19 bp, Homo sapiens
tttcttcttctaagaagac

SEQ ID NO: 4590518 - DNA, 20 bp, Homo sapiens
tttcttcttctaagaagaca

SEQ ID NO: 4590519 - DNA, 17 bp, Homo sapiens
tttcttcttttttaagt

SEQ ID NO: 4590520 - DNA, 18 bp, Homo sapiens
tttcttgatttgagttga

SEQ ID NO: 4590521 - DNA, 20 bp, Homo sapiens
tttcttggaactgtcccagc

SEQ ID NO: 4590522 - DNA, 23 bp, Homo sapiens
tttcttgggaattgaaaaaaatt

SEQ ID NO: 4590523 - DNA, 17 bp, Homo sapiens
tttcttgtgtagatttg

SEQ ID NO: 4590524 - DNA, 13 bp, Homo sapiens
tttcttgtttatt

SEQ ID NO: 4590525 - DNA, 20 bp, Homo sapiens
tttctttccaaaacatttct

SEQ ID NO: 4590526 - DNA, 15 bp, Homo sapiens
tttctttgcaaagta

SEQ ID NO: 4590527 - DNA, 18 bp, Homo sapiens
tttctttgcaccaaagac

SEQ ID NO: 4590528 - DNA, 11 bp, Homo sapiens
tttctttgcct

SEQ ID NO: 4590529 - DNA, 21 bp, Homo sapiens
tttctttggtgcctttcctgt

SEQ ID NO: 4590530 - DNA, 17 bp, Homo sapiens
tttctttgtatcattca

SEQ ID NO: 4590531 - DNA, 16 bp, Homo sapiens
tttcttttctctttaa

SEQ ID NO: 4590532 - DNA, 23 bp, Homo sapiens
tttcttttggtaaagactggctt

SEQ ID NO: 4590533 - DNA, 14 bp, Homo sapiens
tttcttttgttgta

SEQ ID NO: 4590534 - DNA, 18 bp, Homo sapiens
tttcttttttaaagtaaa

SEQ ID NO: 4590535 - DNA, 21 bp, Homo sapiens
tttcttttttaaagtaaactt

SEQ ID NO: 4590536 - DNA, 21 bp, Homo sapiens
tttcttttttttaatgtttct

SEQ ID NO: 4590537 - DNA, 21 bp, Homo sapiens
tttgaaaaaaaagtttttaat

SEQ ID NO: 4590538 - DNA, 16 bp, Homo sapiens
tttgaaaaaaacttca

SEQ ID NO: 4590539 - DNA, 24 bp, Homo sapiens
tttgaaaaacttttaggttgttac

SEQ ID NO: 4590540 - DNA, 14 bp, Homo sapiens
tttgaaaaatctca

SEQ ID NO: 4590541 - DNA, 22 bp, Homo sapiens
tttgaaaactctgtgtttggaa

SEQ ID NO: 4590542 - DNA, 16 bp, Homo sapiens
tttgaaaagcagacat

SEQ ID NO: 4590543 - DNA, 22 bp, Homo sapiens
tttgaaaattacatgttttttc

SEQ ID NO: 4590544 - DNA, 20 bp, Homo sapiens
tttgaaaattgtataccaat

SEQ ID NO: 4590545 - DNA, 20 bp, Homo sapiens
tttgaaagacagagtcttca

SEQ ID NO: 4590546 - DNA, 12 bp, Homo sapiens
tttgaaagcttt

SEQ ID NO: 4590547 - DNA, 19 bp, Homo sapiens
tttgaaagttgtacatgat

SEQ ID NO: 4590548 - DNA, 17 bp, Homo sapiens
tttgaaagtttaacaaa

SEQ ID NO: 4590549 - DNA, 18 bp, Homo sapiens
tttgaaagtttaacaaat

SEQ ID NO: 4590550 - DNA, 18 bp, Homo sapiens
tttgaaattaacctctca

SEQ ID NO: 4590551 - DNA, 22 bp, Homo sapiens
tttgaaattatgtgacatttta

SEQ ID NO: 4590552 - DNA, 20 bp, Homo sapiens
tttgaacaaattttctggtg

SEQ ID NO: 4590553 - DNA, 17 bp, Homo sapiens
tttgaagacttcaaaat

SEQ ID NO: 4590554 - DNA, 23 bp, Homo sapiens
tttgaagacttcaaaatattgag

SEQ ID NO: 4590555 - DNA, 20 bp, Homo sapiens
tttgaagcagtcttgctctg

SEQ ID NO: 4590556 - DNA, 18 bp, Homo sapiens
tttgaagctactgtgtgt

SEQ ID NO: 4590557 - DNA, 12 bp, Homo sapiens
tttgaaggcaaa

SEQ ID NO: 4590558 - DNA, 18 bp, Homo sapiens
tttgaaggtttcagatga

SEQ ID NO: 4590559 - DNA, 20 bp, Homo sapiens
tttgaaggtttcagatgagg

SEQ ID NO: 4590560 - DNA, 17 bp, Homo sapiens
tttgaagtaacttattt

SEQ ID NO: 4590561 - DNA, 20 bp, Homo sapiens
tttgaagtaacttatttgac

SEQ ID NO: 4590562 - DNA, 16 bp, Homo sapiens
tttgaagtctgacaat

SEQ ID NO: 4590563 - DNA, 10 bp, Homo sapiens
tttgaagtgt

SEQ ID NO: 4590564 - DNA, 16 bp, Homo sapiens
tttgaagttagcttta

SEQ ID NO: 4590565 - DNA, 17 bp, Homo sapiens
tttgaagttagctttaa

SEQ ID NO: 4590566 - DNA, 14 bp, Homo sapiens
tttgaataaagaat

SEQ ID NO: 4590567 - DNA, 21 bp, Homo sapiens
tttgaataaagaatacttgaa

SEQ ID NO: 4590568 - DNA, 14 bp, Homo sapiens
tttgaatcaatctg

SEQ ID NO: 4590569 - DNA, 12 bp, Homo sapiens
tttgaatgttaa

SEQ ID NO: 4590570 - DNA, 13 bp, Homo sapiens
tttgaatgttaat

SEQ ID NO: 4590571 - DNA, 20 bp, Homo sapiens
tttgaatgttagatgcttag

SEQ ID NO: 4590572 - DNA, 15 bp, Homo sapiens
tttgaatgttttgtg

SEQ ID NO: 4590573 - DNA, 16 bp, Homo sapiens
tttgaattgtgtctta

SEQ ID NO: 4590574 - DNA, 18 bp, Homo sapiens
tttgaattgtgtcttaat

SEQ ID NO: 4590575 - DNA, 14 bp, Homo sapiens
tttgaattgttaca

SEQ ID NO: 4590576 - DNA, 15 bp, Homo sapiens
tttgaattgttacat

SEQ ID NO: 4590577 - DNA, 20 bp, Homo sapiens
tttgacaaaatgactggctc

SEQ ID NO: 4590578 - DNA, 22 bp, Homo sapiens
tttgacaaaatgactggctcct

SEQ ID NO: 4590579 - DNA, 20 bp, Homo sapiens
tttgacacctcttttttcgt

SEQ ID NO: 4590580 - DNA, 17 bp, Homo sapiens
tttgacactgaaagttt

SEQ ID NO: 4590581 - DNA, 19 bp, Homo sapiens
tttgacactgaaagttttg

SEQ ID NO: 4590582 - DNA, 22 bp, Homo sapiens
tttgacactgaaagttttgtaa

SEQ ID NO: 4590583 - DNA, 18 bp, Homo sapiens
tttgacagactatttgct

SEQ ID NO: 4590584 - DNA, 14 bp, Homo sapiens
tttgactaatttta

SEQ ID NO: 4590585 - DNA, 16 bp, Homo sapiens
tttgactaattttaca

SEQ ID NO: 4590586 - DNA, 15 bp, Homo sapiens
tttgactatgaatgt

SEQ ID NO: 4590587 - DNA, 19 bp, Homo sapiens
tttgactgaagatgcagct

SEQ ID NO: 4590588 - DNA, 12 bp, Homo sapiens
tttgactgtaat

SEQ ID NO: 4590589 - DNA, 12 bp, Homo sapiens
tttgacttttct

SEQ ID NO: 4590590 - DNA, 14 bp, Homo sapiens
tttgacttttctgt

SEQ ID NO: 4590591 - DNA, 13 bp, Homo sapiens
tttgagaaactgc

SEQ ID NO: 4590592 - DNA, 20 bp, Homo sapiens
tttgagattgccccaggtct

SEQ ID NO: 4590593 - DNA, 19 bp, Homo sapiens
tttgagcccattcttctgg

SEQ ID NO: 4590594 - DNA, 21 bp, Homo sapiens
tttgagcccattcttctgggt

SEQ ID NO: 4590595 - DNA, 17 bp, Homo sapiens
tttgagctgccttccct

SEQ ID NO: 4590596 - DNA, 22 bp, Homo sapiens
tttgaggaagtggctgtccctg

SEQ ID NO: 4590597 - DNA, 15 bp, Homo sapiens
tttgaggtctacatt

SEQ ID NO: 4590598 - DNA, 19 bp, Homo sapiens
tttgagtcattgacttcat

SEQ ID NO: 4590599 - DNA, 13 bp, Homo sapiens
tttgagtgctctg

SEQ ID NO: 4590600 - DNA, 14 bp, Homo sapiens
tttgagtgctctga

SEQ ID NO: 4590601 - DNA, 19 bp, Homo sapiens
tttgagttgattgagaaga

SEQ ID NO: 4590602 - DNA, 19 bp, Homo sapiens
tttgagtttttcctcccag

SEQ ID NO: 4590603 - DNA, 14 bp, Homo sapiens
tttgataactgttt

SEQ ID NO: 4590604 - DNA, 16 bp, Homo sapiens
tttgatactaagcatt

SEQ ID NO: 4590605 - DNA, 17 bp, Homo sapiens
tttgatagatgataatt

SEQ ID NO: 4590606 - DNA, 18 bp, Homo sapiens
tttgatataattgtactg

SEQ ID NO: 4590607 - DNA, 16 bp, Homo sapiens
tttgatataccaaatt

SEQ ID NO: 4590608 - DNA, 21 bp, Homo sapiens
tttgatataccaaattaaaaa

SEQ ID NO: 4590609 - DNA, 17 bp, Homo sapiens
tttgattaataaaatat

SEQ ID NO: 4590610 - DNA, 18 bp, Homo sapiens
tttgcaaaaaatgttttt

SEQ ID NO: 4590611 - DNA, 11 bp, Homo sapiens
tttgcaaagta

SEQ ID NO: 4590612 - DNA, 14 bp, Homo sapiens
tttgcaaagtactg

SEQ ID NO: 4590613 - DNA, 15 bp, Homo sapiens
tttgcaaagtactgt

SEQ ID NO: 4590614 - DNA, 19 bp, Homo sapiens
tttgcaaagtattgtaaat

SEQ ID NO: 4590615 - DNA, 22 bp, Homo sapiens
tttgcaaagtattgtaaattat

SEQ ID NO: 4590616 - DNA, 22 bp, Homo sapiens
tttgcaaatatactttactttt

SEQ ID NO: 4590617 - DNA, 15 bp, Homo sapiens
tttgcaaccaggaac

SEQ ID NO: 4590618 - DNA, 14 bp, Homo sapiens
tttgcaacctcgct

SEQ ID NO: 4590619 - DNA, 15 bp, Homo sapiens
tttgcaataatgcag

SEQ ID NO: 4590620 - DNA, 18 bp, Homo sapiens
tttgcaatagcagttata

SEQ ID NO: 4590621 - DNA, 14 bp, Homo sapiens
tttgcacaatattt

SEQ ID NO: 4590622 - DNA, 12 bp, Homo sapiens
tttgcaggaaaa

SEQ ID NO: 4590623 - DNA, 22 bp, Homo sapiens
tttgcaggatctgtctgtgcac

SEQ ID NO: 4590624 - DNA, 22 bp, Homo sapiens
tttgcagggtcctcttctgggc

SEQ ID NO: 4590625 - DNA, 16 bp, Homo sapiens
tttgcataacaattcc

SEQ ID NO: 4590626 - DNA, 20 bp, Homo sapiens
tttgcataacaattcctcta

SEQ ID NO: 4590627 - DNA, 21 bp, Homo sapiens
tttgcatagattccctgagca

SEQ ID NO: 4590628 - DNA, 22 bp, Homo sapiens
tttgcatattttgagaaactgc

SEQ ID NO: 4590629 - DNA, 24 bp, Homo sapiens
tttgcatattttgagaaactgctg

SEQ ID NO: 4590630 - DNA, 13 bp, Homo sapiens
tttgcatccagca

SEQ ID NO: 4590631 - DNA, 12 bp, Homo sapiens
tttgcatgaaat

SEQ ID NO: 4590632 - DNA, 13 bp, Homo sapiens
tttgcattgtctg

SEQ ID NO: 4590633 - DNA, 14 bp, Homo sapiens
tttgcattgtctgt

SEQ ID NO: 4590634 - DNA, 21 bp, Homo sapiens
tttgcatttaaaacagacact

SEQ ID NO: 4590635 - DNA, 13 bp, Homo sapiens
tttgcatttaaga

SEQ ID NO: 4590636 - DNA, 21 bp, Homo sapiens
tttgcatttaagaattgccag

SEQ ID NO: 4590637 - DNA, 23 bp, Homo sapiens
tttgccaaaattcatttctaatt

SEQ ID NO: 4590638 - DNA, 12 bp, Homo sapiens
tttgccagcaga

SEQ ID NO: 4590639 - DNA, 20 bp, Homo sapiens
tttgccagttttccctggaa

SEQ ID NO: 4590640 - DNA, 19 bp, Homo sapiens
tttgcccatttacactttt

SEQ ID NO: 4590641 - DNA, 15 bp, Homo sapiens
tttgcctcttctttg

SEQ ID NO: 4590642 - DNA, 15 bp, Homo sapiens
tttgcctgtaagaaa

SEQ ID NO: 4590643 - DNA, 21 bp, Homo sapiens
tttgccttgggctgctcctca

SEQ ID NO: 4590644 - DNA, 15 bp, Homo sapiens
tttgctaaagacatg

SEQ ID NO: 4590645 - DNA, 14 bp, Homo sapiens
tttgctaattttta

SEQ ID NO: 4590646 - DNA, 24 bp, Homo sapiens
tttgctactgtacataaacaatga

SEQ ID NO: 4590647 - DNA, 19 bp, Homo sapiens
tttgctatgagctggggat

SEQ ID NO: 4590648 - DNA, 13 bp, Homo sapiens
tttgctattcaaa

SEQ ID NO: 4590649 - DNA, 18 bp, Homo sapiens
tttgctcttcaagaaatc

SEQ ID NO: 4590650 - DNA, 23 bp, Homo sapiens
tttgctgacaaccattaaagtca

SEQ ID NO: 4590651 - DNA, 14 bp, Homo sapiens
tttgctgtgaacaa

SEQ ID NO: 4590652 - DNA, 13 bp, Homo sapiens
tttgctgttactg

SEQ ID NO: 4590653 - DNA, 18 bp, Homo sapiens
tttgcttaaaatatgtga

SEQ ID NO: 4590654 - DNA, 16 bp, Homo sapiens
tttgcttgatccagaa

SEQ ID NO: 4590655 - DNA, 15 bp, Homo sapiens
tttggaaaaaccttg

SEQ ID NO: 4590656 - DNA, 20 bp, Homo sapiens
tttggaaagtacactctgct

SEQ ID NO: 4590657 - DNA, 18 bp, Homo sapiens
tttggaactgtgtttcaa

SEQ ID NO: 4590658 - DNA, 15 bp, Homo sapiens
tttggaagctcttct

SEQ ID NO: 4590659 - DNA, 15 bp, Homo sapiens
tttggaatacttttt

SEQ ID NO: 4590660 - DNA, 15 bp, Homo sapiens
tttggaatattaaaa

SEQ ID NO: 4590661 - DNA, 15 bp, Homo sapiens
tttggaatattttat

SEQ ID NO: 4590662 - DNA, 13 bp, Homo sapiens
tttggaatctaac

SEQ ID NO: 4590663 - DNA, 16 bp, Homo sapiens
tttggacctaatccaa

SEQ ID NO: 4590664 - DNA, 20 bp, Homo sapiens
tttggacctgcatatttagc

SEQ ID NO: 4590665 - DNA, 16 bp, Homo sapiens
tttggactctctgtgg

SEQ ID NO: 4590666 - DNA, 22 bp, Homo sapiens
tttggagcattaactaaatgct

SEQ ID NO: 4590667 - DNA, 22 bp, Homo sapiens
tttggagtgttatgtatttcct

SEQ ID NO: 4590668 - DNA, 17 bp, Homo sapiens
tttggatgtctgtagca

SEQ ID NO: 4590669 - DNA, 14 bp, Homo sapiens
tttggattttatgg

SEQ ID NO: 4590670 - DNA, 19 bp, Homo sapiens
tttggcaatttcctggccc

SEQ ID NO: 4590671 - DNA, 14 bp, Homo sapiens
tttggcactctctg

SEQ ID NO: 4590672 - DNA, 12 bp, Homo sapiens
tttggcagagtc

SEQ ID NO: 4590673 - DNA, 21 bp, Homo sapiens
tttggctgttttccctctgct

SEQ ID NO: 4590674 - DNA, 22 bp, Homo sapiens
tttggctttatgtgcaaaatct

SEQ ID NO: 4590675 - DNA, 16 bp, Homo sapiens
tttgggaactgtgttt

SEQ ID NO: 4590676 - DNA, 12 bp, Homo sapiens
tttgggaagaat

SEQ ID NO: 4590677 - DNA, 16 bp, Homo sapiens
tttgggagggaaaagg

SEQ ID NO: 4590678 - DNA, 23 bp, Homo sapiens
tttgggagtttttatgagaaact

SEQ ID NO: 4590679 - DNA, 17 bp, Homo sapiens
tttgggatgtcttattt

SEQ ID NO: 4590680 - DNA, 21 bp, Homo sapiens
tttgggcagcaatttaaatgt

SEQ ID NO: 4590681 - DNA, 15 bp, Homo sapiens
tttgggcccagggac

SEQ ID NO: 4590682 - DNA, 20 bp, Homo sapiens
tttggggggttttcttgcct

SEQ ID NO: 4590683 - DNA, 22 bp, Homo sapiens
tttgggttggttccaagtcttt

SEQ ID NO: 4590684 - DNA, 14 bp, Homo sapiens
tttggtaaaaatgc

SEQ ID NO: 4590685 - DNA, 15 bp, Homo sapiens
tttggtacacatgtg

SEQ ID NO: 4590686 - DNA, 18 bp, Homo sapiens
tttggtacacatgtgtta

SEQ ID NO: 4590687 - DNA, 14 bp, Homo sapiens
tttggtataaatta

SEQ ID NO: 4590688 - DNA, 20 bp, Homo sapiens
tttggtgccgatgttgaact

SEQ ID NO: 4590689 - DNA, 12 bp, Homo sapiens
tttggtgccttt

SEQ ID NO: 4590690 - DNA, 20 bp, Homo sapiens
tttggtgctcatttaaatat

SEQ ID NO: 4590691 - DNA, 20 bp, Homo sapiens
tttggtgctttttataaaaa

SEQ ID NO: 4590692 - DNA, 12 bp, Homo sapiens
tttggttaatat

SEQ ID NO: 4590693 - DNA, 21 bp, Homo sapiens
tttggttatttcagcccccat

SEQ ID NO: 4590694 - DNA, 21 bp, Homo sapiens
tttggtttcccaagagctacg

SEQ ID NO: 4590695 - DNA, 14 bp, Homo sapiens
tttggttttgttcc

SEQ ID NO: 4590696 - DNA, 16 bp, Homo sapiens
tttggttttgttcccc

SEQ ID NO: 4590697 - DNA, 20 bp, Homo sapiens
tttgtaaaatattatgtttg

SEQ ID NO: 4590698 - DNA, 16 bp, Homo sapiens
tttgtaaactggaatt

SEQ ID NO: 4590699 - DNA, 19 bp, Homo sapiens
tttgtaaatgcctcttaaa

SEQ ID NO: 4590700 - DNA, 17 bp, Homo sapiens
tttgtaaggcttgttcc

SEQ ID NO: 4590701 - DNA, 18 bp, Homo sapiens
tttgtaaggtttttgtag

SEQ ID NO: 4590702 - DNA, 16 bp, Homo sapiens
tttgtaagttgaagca

SEQ ID NO: 4590703 - DNA, 22 bp, Homo sapiens
tttgtaataaaactatttgtat

SEQ ID NO: 4590704 - DNA, 11 bp, Homo sapiens
tttgtaatcat

SEQ ID NO: 4590705 - DNA, 14 bp, Homo sapiens
tttgtaatgaattc

SEQ ID NO: 4590706 - DNA, 15 bp, Homo sapiens
tttgtaatttttgct

SEQ ID NO: 4590707 - DNA, 19 bp, Homo sapiens
tttgtacaattttaaagtt

SEQ ID NO: 4590708 - DNA, 14 bp, Homo sapiens
tttgtacagagtgc

SEQ ID NO: 4590709 - DNA, 17 bp, Homo sapiens
tttgtacatatcaaata

SEQ ID NO: 4590710 - DNA, 20 bp, Homo sapiens
tttgtacatatcaaatagat

SEQ ID NO: 4590711 - DNA, 12 bp, Homo sapiens
tttgtaccagtg

SEQ ID NO: 4590712 - DNA, 18 bp, Homo sapiens
tttgtacgttatatattg

SEQ ID NO: 4590713 - DNA, 15 bp, Homo sapiens
tttgtactgaatttt

SEQ ID NO: 4590714 - DNA, 16 bp, Homo sapiens
tttgtagaataaatgg

SEQ ID NO: 4590715 - DNA, 17 bp, Homo sapiens
tttgtagaataaatggt

SEQ ID NO: 4590716 - DNA, 14 bp, Homo sapiens
tttgtagactgttt

SEQ ID NO: 4590717 - DNA, 12 bp, Homo sapiens
tttgtagatgtt

SEQ ID NO: 4590718 - DNA, 18 bp, Homo sapiens
tttgtagtgaaataatag

SEQ ID NO: 4590719 - DNA, 14 bp, Homo sapiens
tttgtatacaagta

SEQ ID NO: 4590720 - DNA, 22 bp, Homo sapiens
tttgtatactttaaataattta

SEQ ID NO: 4590721 - DNA, 14 bp, Homo sapiens
tttgtatctttctt

SEQ ID NO: 4590722 - DNA, 21 bp, Homo sapiens
tttgtatcttttatcctggga

SEQ ID NO: 4590723 - DNA, 22 bp, Homo sapiens
tttgtatgccaagtgagaagat

SEQ ID NO: 4590724 - DNA, 14 bp, Homo sapiens
tttgtatggagtta

SEQ ID NO: 4590725 - DNA, 12 bp, Homo sapiens
tttgtatgtgtg

SEQ ID NO: 4590726 - DNA, 17 bp, Homo sapiens
tttgtatgtttttctgt

SEQ ID NO: 4590727 - DNA, 16 bp, Homo sapiens
tttgtattaagaaagg

SEQ ID NO: 4590728 - DNA, 14 bp, Homo sapiens
tttgtattctctga

SEQ ID NO: 4590729 - DNA, 19 bp, Homo sapiens
tttgtatttaaggattctg

SEQ ID NO: 4590730 - DNA, 16 bp, Homo sapiens
tttgtatttttagtag

SEQ ID NO: 4590731 - DNA, 17 bp, Homo sapiens
tttgtcaaactgtagaa

SEQ ID NO: 4590732 - DNA, 17 bp, Homo sapiens
tttgtcaacttcagttg

SEQ ID NO: 4590733 - DNA, 12 bp, Homo sapiens
tttgtcacttct

SEQ ID NO: 4590734 - DNA, 13 bp, Homo sapiens
tttgtcacttctg

SEQ ID NO: 4590735 - DNA, 14 bp, Homo sapiens
tttgtcactttttc

SEQ ID NO: 4590736 - DNA, 10 bp, Homo sapiens
tttgtcccag

SEQ ID NO: 4590737 - DNA, 13 bp, Homo sapiens
tttgtctttttgt

SEQ ID NO: 4590738 - DNA, 18 bp, Homo sapiens
tttgtgaatagaactctg

SEQ ID NO: 4590739 - DNA, 16 bp, Homo sapiens
tttgtgaatccatctt

SEQ ID NO: 4590740 - DNA, 15 bp, Homo sapiens
tttgtgaattaggct

SEQ ID NO: 4590741 - DNA, 22 bp, Homo sapiens
tttgtgaattaggctgtaacta

SEQ ID NO: 4590742 - DNA, 18 bp, Homo sapiens
tttgtgagtcaatacata

SEQ ID NO: 4590743 - DNA, 12 bp, Homo sapiens
tttgtgcctttg

SEQ ID NO: 4590744 - DNA, 13 bp, Homo sapiens
tttgtgctgtggg

SEQ ID NO: 4590745 - DNA, 14 bp, Homo sapiens
tttgtggcctcaga

SEQ ID NO: 4590746 - DNA, 11 bp, Homo sapiens
tttgtggggag

SEQ ID NO: 4590747 - DNA, 14 bp, Homo sapiens
tttgtggtcacagc

SEQ ID NO: 4590748 - DNA, 16 bp, Homo sapiens
tttgtggtttggaata

SEQ ID NO: 4590749 - DNA, 18 bp, Homo sapiens
tttgtgtaaatttctcaa

SEQ ID NO: 4590750 - DNA, 15 bp, Homo sapiens
tttgtgtaataaagt

SEQ ID NO: 4590751 - DNA, 12 bp, Homo sapiens
tttgtgtttatg

SEQ ID NO: 4590752 - DNA, 15 bp, Homo sapiens
tttgtgtttatgaaa

SEQ ID NO: 4590753 - DNA, 18 bp, Homo sapiens
tttgttaacagtatttct

SEQ ID NO: 4590754 - DNA, 16 bp, Homo sapiens
tttgttaatgcattgt

SEQ ID NO: 4590755 - DNA, 20 bp, Homo sapiens
tttgttaattaaatatttct

SEQ ID NO: 4590756 - DNA, 12 bp, Homo sapiens
tttgttaattta

SEQ ID NO: 4590757 - DNA, 23 bp, Homo sapiens
tttgttaatttagaaaactttaa

SEQ ID NO: 4590758 - DNA, 22 bp, Homo sapiens
tttgttacataaggatgacttt

SEQ ID NO: 4590759 - DNA, 14 bp, Homo sapiens
tttgttagcaaaga

SEQ ID NO: 4590760 - DNA, 22 bp, Homo sapiens
tttgttaggattttcacattct

SEQ ID NO: 4590761 - DNA, 13 bp, Homo sapiens
tttgttatagatt

SEQ ID NO: 4590762 - DNA, 20 bp, Homo sapiens
tttgttatagattgtcttaa

SEQ ID NO: 4590763 - DNA, 20 bp, Homo sapiens
tttgttatatataataaata

SEQ ID NO: 4590764 - DNA, 21 bp, Homo sapiens
tttgttatatataataaatac

SEQ ID NO: 4590765 - DNA, 14 bp, Homo sapiens
tttgttccttttgt

SEQ ID NO: 4590766 - DNA, 13 bp, Homo sapiens
tttgttctagact

SEQ ID NO: 4590767 - DNA, 21 bp, Homo sapiens
tttgttctccgggtgtggcct

SEQ ID NO: 4590768 - DNA, 21 bp, Homo sapiens
tttgttctctgaattttcaga

SEQ ID NO: 4590769 - DNA, 14 bp, Homo sapiens
tttgttcttcagat

SEQ ID NO: 4590770 - DNA, 15 bp, Homo sapiens
tttgttcttcagatt

SEQ ID NO: 4590771 - DNA, 23 bp, Homo sapiens
tttgttgagctggtaacatcgtt

SEQ ID NO: 4590772 - DNA, 21 bp, Homo sapiens
tttgttgcctacctagctgca

SEQ ID NO: 4590773 - DNA, 14 bp, Homo sapiens
tttgttgctgtcaa

SEQ ID NO: 4590774 - DNA, 15 bp, Homo sapiens
tttgttgctgtcaag

SEQ ID NO: 4590775 - DNA, 12 bp, Homo sapiens
tttgttggcttt

SEQ ID NO: 4590776 - DNA, 22 bp, Homo sapiens
tttgtttcaatgaggtgtccaa

SEQ ID NO: 4590777 - DNA, 13 bp, Homo sapiens
tttgtttcatatt

SEQ ID NO: 4590778 - DNA, 15 bp, Homo sapiens
tttgtttgtgtttat

SEQ ID NO: 4590779 - DNA, 15 bp, Homo sapiens
tttgttttagaacca

SEQ ID NO: 4590780 - DNA, 12 bp, Homo sapiens
tttgttttgaaa

SEQ ID NO: 4590781 - DNA, 12 bp, Homo sapiens
tttgtttttact

SEQ ID NO: 4590782 - DNA, 15 bp, Homo sapiens
tttgtttttactgta

SEQ ID NO: 4590783 - DNA, 18 bp, Homo sapiens
tttgtttttatttaaatt

SEQ ID NO: 4590784 - DNA, 13 bp, Homo sapiens
tttgtttttgcat

SEQ ID NO: 4590785 - DNA, 19 bp, Homo sapiens
ttttaaaaaaacaaatgtt

SEQ ID NO: 4590786 - DNA, 21 bp, Homo sapiens
ttttaaaaagagtaatttcat

SEQ ID NO: 4590787 - DNA, 22 bp, Homo sapiens
ttttaaaaataaaggaaaacaa

SEQ ID NO: 4590788 - DNA, 22 bp, Homo sapiens
ttttaaaagagacaaactgtaa

SEQ ID NO: 4590789 - DNA, 16 bp, Homo sapiens
ttttaaaagtgcacat

SEQ ID NO: 4590790 - DNA, 20 bp, Homo sapiens
ttttaaaatcactaacatta

SEQ ID NO: 4590791 - DNA, 19 bp, Homo sapiens
ttttaaaatccagactttc

SEQ ID NO: 4590792 - DNA, 20 bp, Homo sapiens
ttttaaaatgtgaggcaata

SEQ ID NO: 4590793 - DNA, 22 bp, Homo sapiens
ttttaaaatgtgaggcaataag

SEQ ID NO: 4590794 - DNA, 11 bp, Homo sapiens
ttttaaaattg

SEQ ID NO: 4590795 - DNA, 19 bp, Homo sapiens
ttttaaaatttatttgcaa

SEQ ID NO: 4590796 - DNA, 20 bp, Homo sapiens
ttttaaaatttatttgcaaa

SEQ ID NO: 4590797 - DNA, 21 bp, Homo sapiens
ttttaaacaaaatttcacagt

SEQ ID NO: 4590798 - DNA, 17 bp, Homo sapiens
ttttaaacccaaaatat

SEQ ID NO: 4590799 - DNA, 14 bp, Homo sapiens
ttttaaacttgaaa

SEQ ID NO: 4590800 - DNA, 17 bp, Homo sapiens
ttttaaacttgaaatat

SEQ ID NO: 4590801 - DNA, 19 bp, Homo sapiens
ttttaaagaaattttagta

SEQ ID NO: 4590802 - DNA, 23 bp, Homo sapiens
ttttaaagaatatgactttttat

SEQ ID NO: 4590803 - DNA, 13 bp, Homo sapiens
ttttaaagaattg

SEQ ID NO: 4590804 - DNA, 19 bp, Homo sapiens
ttttaaaggccgttggctg

SEQ ID NO: 4590805 - DNA, 19 bp, Homo sapiens
ttttaaagtaaacttgtgt

SEQ ID NO: 4590806 - DNA, 13 bp, Homo sapiens
ttttaaagtattt

SEQ ID NO: 4590807 - DNA, 17 bp, Homo sapiens
ttttaaagttagtatct

SEQ ID NO: 4590808 - DNA, 12 bp, Homo sapiens
ttttaaagttca

SEQ ID NO: 4590809 - DNA, 17 bp, Homo sapiens
ttttaaataaaagcaca

SEQ ID NO: 4590810 - DNA, 14 bp, Homo sapiens
ttttaaataaagca

SEQ ID NO: 4590811 - DNA, 17 bp, Homo sapiens
ttttaaatattttctat

SEQ ID NO: 4590812 - DNA, 13 bp, Homo sapiens
ttttaaatcaagg

SEQ ID NO: 4590813 - DNA, 22 bp, Homo sapiens
ttttaaatgtacagacatattt

SEQ ID NO: 4590814 - DNA, 18 bp, Homo sapiens
ttttaaattagaaaatat

SEQ ID NO: 4590815 - DNA, 19 bp, Homo sapiens
ttttaaattataaggactg

SEQ ID NO: 4590816 - DNA, 23 bp, Homo sapiens
ttttaaattataaggactgcatg

SEQ ID NO: 4590817 - DNA, 20 bp, Homo sapiens
ttttaaattttgtatgccaa

SEQ ID NO: 4590818 - DNA, 22 bp, Homo sapiens
ttttaacctgtatactcttgaa

SEQ ID NO: 4590819 - DNA, 20 bp, Homo sapiens
ttttaactaaattttaaagc

SEQ ID NO: 4590820 - DNA, 20 bp, Homo sapiens
ttttaactggcatgtcattt

SEQ ID NO: 4590821 - DNA, 12 bp, Homo sapiens
ttttaactgttt

SEQ ID NO: 4590822 - DNA, 14 bp, Homo sapiens
ttttaacttctata

SEQ ID NO: 4590823 - DNA, 13 bp, Homo sapiens
ttttaactttaat

SEQ ID NO: 4590824 - DNA, 19 bp, Homo sapiens
ttttaactttttgttttta

SEQ ID NO: 4590825 - DNA, 22 bp, Homo sapiens
ttttaagacgtgaatgtctcag

SEQ ID NO: 4590826 - DNA, 20 bp, Homo sapiens
ttttaagaggctttggccca

SEQ ID NO: 4590827 - DNA, 13 bp, Homo sapiens
ttttaagatagtg

SEQ ID NO: 4590828 - DNA, 23 bp, Homo sapiens
ttttaagatagtgtaacttgctt

SEQ ID NO: 4590829 - DNA, 18 bp, Homo sapiens
ttttaagatccagaaata

SEQ ID NO: 4590830 - DNA, 21 bp, Homo sapiens
ttttaagctgcaaatctgatg

SEQ ID NO: 4590831 - DNA, 18 bp, Homo sapiens
ttttaaggaaacttttta

SEQ ID NO: 4590832 - DNA, 22 bp, Homo sapiens
ttttaaggaaactttttaattg

SEQ ID NO: 4590833 - DNA, 13 bp, Homo sapiens
ttttaaggtcttt

SEQ ID NO: 4590834 - DNA, 18 bp, Homo sapiens
ttttaaggtctttcagta

SEQ ID NO: 4590835 - DNA, 22 bp, Homo sapiens
ttttaagtgacataattgtcca

SEQ ID NO: 4590836 - DNA, 13 bp, Homo sapiens
ttttaagttctta

SEQ ID NO: 4590837 - DNA, 15 bp, Homo sapiens
ttttaagttcttatg

SEQ ID NO: 4590838 - DNA, 12 bp, Homo sapiens
ttttaataaact

SEQ ID NO: 4590839 - DNA, 15 bp, Homo sapiens
ttttaataaactact

SEQ ID NO: 4590840 - DNA, 21 bp, Homo sapiens
ttttaataaactactctttga

SEQ ID NO: 4590841 - DNA, 15 bp, Homo sapiens
ttttaatagcactaa

SEQ ID NO: 4590842 - DNA, 17 bp, Homo sapiens
ttttaatatataattta

SEQ ID NO: 4590843 - DNA, 15 bp, Homo sapiens
ttttaatgatgacaa

SEQ ID NO: 4590844 - DNA, 18 bp, Homo sapiens
ttttaatggattgttaat

SEQ ID NO: 4590845 - DNA, 22 bp, Homo sapiens
ttttaatggcagcagaaaactt

SEQ ID NO: 4590846 - DNA, 21 bp, Homo sapiens
ttttaatgtatctatttgtac

SEQ ID NO: 4590847 - DNA, 20 bp, Homo sapiens
ttttaatgtgctctgtacct

SEQ ID NO: 4590848 - DNA, 14 bp, Homo sapiens
ttttaattaaaaaa

SEQ ID NO: 4590849 - DNA, 17 bp, Homo sapiens
ttttaattaaaaacttt

SEQ ID NO: 4590850 - DNA, 14 bp, Homo sapiens
ttttaattgaaaag

SEQ ID NO: 4590851 - DNA, 19 bp, Homo sapiens
ttttaattgaaaagaagta

SEQ ID NO: 4590852 - DNA, 14 bp, Homo sapiens
ttttaatttagtaa

SEQ ID NO: 4590853 - DNA, 18 bp, Homo sapiens
ttttaatttagtaaatgt

SEQ ID NO: 4590854 - DNA, 22 bp, Homo sapiens
ttttaatttggtagatgacaaa

SEQ ID NO: 4590855 - DNA, 12 bp, Homo sapiens
ttttaattttta

SEQ ID NO: 4590856 - DNA, 15 bp, Homo sapiens
ttttacacagagaaa

SEQ ID NO: 4590857 - DNA, 17 bp, Homo sapiens
ttttacagcagcaatat

SEQ ID NO: 4590858 - DNA, 12 bp, Homo sapiens
ttttacaggaaa

SEQ ID NO: 4590859 - DNA, 15 bp, Homo sapiens
ttttaccagctttta

SEQ ID NO: 4590860 - DNA, 23 bp, Homo sapiens
ttttaccctgttcccaagcaaag

SEQ ID NO: 4590861 - DNA, 14 bp, Homo sapiens
ttttacctgctgct

SEQ ID NO: 4590862 - DNA, 17 bp, Homo sapiens
ttttactattgttacat

SEQ ID NO: 4590863 - DNA, 22 bp, Homo sapiens
ttttactccaggttattgcaat

SEQ ID NO: 4590864 - DNA, 15 bp, Homo sapiens
ttttactctttgaaa

SEQ ID NO: 4590865 - DNA, 14 bp, Homo sapiens
ttttactgaatgat

SEQ ID NO: 4590866 - DNA, 12 bp, Homo sapiens
ttttactgcctg

SEQ ID NO: 4590867 - DNA, 15 bp, Homo sapiens
ttttactgtcagatt

SEQ ID NO: 4590868 - DNA, 20 bp, Homo sapiens
ttttactgtcagattaaatt

SEQ ID NO: 4590869 - DNA, 14 bp, Homo sapiens
ttttacttgaatca

SEQ ID NO: 4590870 - DNA, 15 bp, Homo sapiens
ttttactttggttta

SEQ ID NO: 4590871 - DNA, 17 bp, Homo sapiens
ttttacttttctgccaa

SEQ ID NO: 4590872 - DNA, 12 bp, Homo sapiens
ttttacttttgt

SEQ ID NO: 4590873 - DNA, 17 bp, Homo sapiens
ttttagaaaaacattta

SEQ ID NO: 4590874 - DNA, 20 bp, Homo sapiens
ttttagaaaattttatgtat

SEQ ID NO: 4590875 - DNA, 15 bp, Homo sapiens
ttttagaaagctaaa

SEQ ID NO: 4590876 - DNA, 17 bp, Homo sapiens
ttttagaaatattcaca

SEQ ID NO: 4590877 - DNA, 13 bp, Homo sapiens
ttttagatgtatt

SEQ ID NO: 4590878 - DNA, 18 bp, Homo sapiens
ttttagcaaatcagtata

SEQ ID NO: 4590879 - DNA, 23 bp, Homo sapiens
ttttagggttctaaatgcaataa

SEQ ID NO: 4590880 - DNA, 17 bp, Homo sapiens
ttttagtaacctttaaa

SEQ ID NO: 4590881 - DNA, 19 bp, Homo sapiens
ttttagtgtattaatcata

SEQ ID NO: 4590882 - DNA, 18 bp, Homo sapiens
ttttagtgtgtaaaatta

SEQ ID NO: 4590883 - DNA, 23 bp, Homo sapiens
ttttagtgtgtaaaattaatgta

SEQ ID NO: 4590884 - DNA, 18 bp, Homo sapiens
ttttagtttttcattaaa

SEQ ID NO: 4590885 - DNA, 22 bp, Homo sapiens
ttttagtttttcattaaataaa

SEQ ID NO: 4590886 - DNA, 22 bp, Homo sapiens
ttttataaaatggctgtaatca

SEQ ID NO: 4590887 - DNA, 22 bp, Homo sapiens
ttttataaatactgcaaatcag

SEQ ID NO: 4590888 - DNA, 19 bp, Homo sapiens
ttttataaatgatatcaaa

SEQ ID NO: 4590889 - DNA, 13 bp, Homo sapiens
ttttataaattaa

SEQ ID NO: 4590890 - DNA, 16 bp, Homo sapiens
ttttataaattaaata

SEQ ID NO: 4590891 - DNA, 21 bp, Homo sapiens
ttttataatgttattcatttg

SEQ ID NO: 4590892 - DNA, 16 bp, Homo sapiens
ttttatacaagtaatt

SEQ ID NO: 4590893 - DNA, 18 bp, Homo sapiens
ttttataggaaaaaaact

SEQ ID NO: 4590894 - DNA, 21 bp, Homo sapiens
ttttatatctggaatgagcct

SEQ ID NO: 4590895 - DNA, 19 bp, Homo sapiens
ttttatatgtgagcgagca

SEQ ID NO: 4590896 - DNA, 20 bp, Homo sapiens
ttttatcaaaagacttttat

SEQ ID NO: 4590897 - DNA, 20 bp, Homo sapiens
ttttatcaattatattatgt

SEQ ID NO: 4590898 - DNA, 12 bp, Homo sapiens
ttttatcagtag

SEQ ID NO: 4590899 - DNA, 16 bp, Homo sapiens
ttttatcgcagatttt

SEQ ID NO: 4590900 - DNA, 15 bp, Homo sapiens
ttttatctgtttcct

SEQ ID NO: 4590901 - DNA, 13 bp, Homo sapiens
ttttatgccccat

SEQ ID NO: 4590902 - DNA, 23 bp, Homo sapiens
ttttatggaggctttgcatagat

SEQ ID NO: 4590903 - DNA, 19 bp, Homo sapiens
ttttatggcacctatttct

SEQ ID NO: 4590904 - DNA, 17 bp, Homo sapiens
ttttatggttacttctt

SEQ ID NO: 4590905 - DNA, 20 bp, Homo sapiens
ttttatgtacaaccctgacc

SEQ ID NO: 4590906 - DNA, 18 bp, Homo sapiens
ttttatgtgagagaaagt

SEQ ID NO: 4590907 - DNA, 17 bp, Homo sapiens
ttttatgttttctttct

SEQ ID NO: 4590908 - DNA, 22 bp, Homo sapiens
ttttattaagctttttggaatc

SEQ ID NO: 4590909 - DNA, 16 bp, Homo sapiens
ttttattaataatatt

SEQ ID NO: 4590910 - DNA, 13 bp, Homo sapiens
ttttattaatata

SEQ ID NO: 4590911 - DNA, 11 bp, Homo sapiens
ttttattaatg

SEQ ID NO: 4590912 - DNA, 17 bp, Homo sapiens
ttttattacaaatgcaa

SEQ ID NO: 4590913 - DNA, 20 bp, Homo sapiens
ttttattcagctagaatttc

SEQ ID NO: 4590914 - DNA, 13 bp, Homo sapiens
ttttattcttttt

SEQ ID NO: 4590915 - DNA, 20 bp, Homo sapiens
ttttattgaatactgtctgt

SEQ ID NO: 4590916 - DNA, 23 bp, Homo sapiens
ttttattgaatactgtctgtatc

SEQ ID NO: 4590917 - DNA, 18 bp, Homo sapiens
ttttattgacacagaaaa

SEQ ID NO: 4590918 - DNA, 13 bp, Homo sapiens
ttttatttaaaaa

SEQ ID NO: 4590919 - DNA, 11 bp, Homo sapiens
ttttatttaca

SEQ ID NO: 4590920 - DNA, 13 bp, Homo sapiens
ttttatttacatt

SEQ ID NO: 4590921 - DNA, 14 bp, Homo sapiens
ttttatttcaatgt

SEQ ID NO: 4590922 - DNA, 23 bp, Homo sapiens
ttttatttcagattttgataact

SEQ ID NO: 4590923 - DNA, 21 bp, Homo sapiens
ttttatttctcgggtgcattt

SEQ ID NO: 4590924 - DNA, 20 bp, Homo sapiens
ttttatttctgatttcataa

SEQ ID NO: 4590925 - DNA, 12 bp, Homo sapiens
ttttatttgcat

SEQ ID NO: 4590926 - DNA, 14 bp, Homo sapiens
ttttattttatgtt

SEQ ID NO: 4590927 - DNA, 21 bp, Homo sapiens
ttttatttttctcatgatgag

SEQ ID NO: 4590928 - DNA, 15 bp, Homo sapiens
ttttcaaaagataat

SEQ ID NO: 4590929 - DNA, 19 bp, Homo sapiens
ttttcaaaatagaaaagtt

SEQ ID NO: 4590930 - DNA, 17 bp, Homo sapiens
ttttcaaataatgcttt

SEQ ID NO: 4590931 - DNA, 13 bp, Homo sapiens
ttttcaaatcctt

SEQ ID NO: 4590932 - DNA, 22 bp, Homo sapiens
ttttcaaatgtgcaatttgtaa

SEQ ID NO: 4590933 - DNA, 15 bp, Homo sapiens
ttttcaaatgttctc

SEQ ID NO: 4590934 - DNA, 17 bp, Homo sapiens
ttttcaagtttttcata

SEQ ID NO: 4590935 - DNA, 20 bp, Homo sapiens
ttttcaagtttttcatactg

SEQ ID NO: 4590936 - DNA, 21 bp, Homo sapiens
ttttcaagtttttcatactgt

SEQ ID NO: 4590937 - DNA, 16 bp, Homo sapiens
ttttcaataaatcagc

SEQ ID NO: 4590938 - DNA, 14 bp, Homo sapiens
ttttcaataacaaa

SEQ ID NO: 4590939 - DNA, 16 bp, Homo sapiens
ttttcaataagatgta

SEQ ID NO: 4590940 - DNA, 14 bp, Homo sapiens
ttttcaatatattg

SEQ ID NO: 4590941 - DNA, 15 bp, Homo sapiens
ttttcaatatattga

SEQ ID NO: 4590942 - DNA, 13 bp, Homo sapiens
ttttcaatatgca

SEQ ID NO: 4590943 - DNA, 19 bp, Homo sapiens
ttttcaatatgcaagcagc

SEQ ID NO: 4590944 - DNA, 20 bp, Homo sapiens
ttttcaatcttctactttta

SEQ ID NO: 4590945 - DNA, 16 bp, Homo sapiens
ttttcagactcagact

SEQ ID NO: 4590946 - DNA, 21 bp, Homo sapiens
ttttcagactgcctgtctgct

SEQ ID NO: 4590947 - DNA, 15 bp, Homo sapiens
ttttcagatataaaa

SEQ ID NO: 4590948 - DNA, 19 bp, Homo sapiens
ttttcagatataaaagact

SEQ ID NO: 4590949 - DNA, 19 bp, Homo sapiens
ttttcagcaaactcttttc

SEQ ID NO: 4590950 - DNA, 22 bp, Homo sapiens
ttttcagtgatcttcactgtat

SEQ ID NO: 4590951 - DNA, 12 bp, Homo sapiens
ttttcagttgtt

SEQ ID NO: 4590952 - DNA, 13 bp, Homo sapiens
ttttcataactta

SEQ ID NO: 4590953 - DNA, 15 bp, Homo sapiens
ttttcatactgtaca

SEQ ID NO: 4590954 - DNA, 17 bp, Homo sapiens
ttttcatactgtacaca

SEQ ID NO: 4590955 - DNA, 14 bp, Homo sapiens
ttttcatagatttg

SEQ ID NO: 4590956 - DNA, 22 bp, Homo sapiens
ttttcatagatttgaaaaactt

SEQ ID NO: 4590957 - DNA, 19 bp, Homo sapiens
ttttcatcatttcagccaa

SEQ ID NO: 4590958 - DNA, 22 bp, Homo sapiens
ttttcatctttaagaatgctta

SEQ ID NO: 4590959 - DNA, 22 bp, Homo sapiens
ttttcattaaataaatttgact

SEQ ID NO: 4590960 - DNA, 22 bp, Homo sapiens
ttttcattttaatatataattt

SEQ ID NO: 4590961 - DNA, 19 bp, Homo sapiens
ttttccaaaacaaaaagat

SEQ ID NO: 4590962 - DNA, 13 bp, Homo sapiens
ttttccaaactga

SEQ ID NO: 4590963 - DNA, 18 bp, Homo sapiens
ttttccaactactaatag

SEQ ID NO: 4590964 - DNA, 16 bp, Homo sapiens
ttttccaatattttaa

SEQ ID NO: 4590965 - DNA, 17 bp, Homo sapiens
ttttccaatattttaat

SEQ ID NO: 4590966 - DNA, 22 bp, Homo sapiens
ttttccacaagattcccagaga

SEQ ID NO: 4590967 - DNA, 14 bp, Homo sapiens
ttttccacataaat

SEQ ID NO: 4590968 - DNA, 13 bp, Homo sapiens
ttttccaggctgg

SEQ ID NO: 4590969 - DNA, 17 bp, Homo sapiens
ttttccatctgtgtgca

SEQ ID NO: 4590970 - DNA, 14 bp, Homo sapiens
ttttccatttggca

SEQ ID NO: 4590971 - DNA, 16 bp, Homo sapiens
ttttcccataagacaa

SEQ ID NO: 4590972 - DNA, 17 bp, Homo sapiens
ttttccccctatcagtt

SEQ ID NO: 4590973 - DNA, 12 bp, Homo sapiens
ttttcccccttc

SEQ ID NO: 4590974 - DNA, 15 bp, Homo sapiens
ttttcccccttccca

SEQ ID NO: 4590975 - DNA, 14 bp, Homo sapiens
ttttccctctgctg

SEQ ID NO: 4590976 - DNA, 16 bp, Homo sapiens
ttttccctctgctgct

SEQ ID NO: 4590977 - DNA, 17 bp, Homo sapiens
ttttcctaagacatttt

SEQ ID NO: 4590978 - DNA, 23 bp, Homo sapiens
ttttcctaagacatttttcattc

SEQ ID NO: 4590979 - DNA, 15 bp, Homo sapiens
ttttcctatgctatt

SEQ ID NO: 4590980 - DNA, 20 bp, Homo sapiens
ttttcctatgctattgacaa

SEQ ID NO: 4590981 - DNA, 12 bp, Homo sapiens
ttttcctcccag

SEQ ID NO: 4590982 - DNA, 14 bp, Homo sapiens
ttttcctcctctgc

SEQ ID NO: 4590983 - DNA, 19 bp, Homo sapiens
ttttccttcctttttattc

SEQ ID NO: 4590984 - DNA, 16 bp, Homo sapiens
ttttccttctggttct

SEQ ID NO: 4590985 - DNA, 14 bp, Homo sapiens
ttttccttgcctgt

SEQ ID NO: 4590986 - DNA, 13 bp, Homo sapiens
ttttcctttgtgc

SEQ ID NO: 4590987 - DNA, 21 bp, Homo sapiens
ttttcgcttgcttctgcagca

SEQ ID NO: 4590988 - DNA, 14 bp, Homo sapiens
ttttcgtcttccct

SEQ ID NO: 4590989 - DNA, 20 bp, Homo sapiens
ttttctaaaacattcccctc

SEQ ID NO: 4590990 - DNA, 13 bp, Homo sapiens
ttttctaaaagct

SEQ ID NO: 4590991 - DNA, 13 bp, Homo sapiens
ttttctaactttt

SEQ ID NO: 4590992 - DNA, 17 bp, Homo sapiens
ttttctagtttgctcat

SEQ ID NO: 4590993 - DNA, 14 bp, Homo sapiens
ttttctcacaaaaa

SEQ ID NO: 4590994 - DNA, 14 bp, Homo sapiens
ttttctcccaagaa

SEQ ID NO: 4590995 - DNA, 21 bp, Homo sapiens
ttttctcctcactgtatccag

SEQ ID NO: 4590996 - DNA, 18 bp, Homo sapiens
ttttctcctgcaaattta

SEQ ID NO: 4590997 - DNA, 16 bp, Homo sapiens
ttttctctcctgtcct

SEQ ID NO: 4590998 - DNA, 12 bp, Homo sapiens
ttttctctcttt

SEQ ID NO: 4590999 - DNA, 14 bp, Homo sapiens
ttttctctttgtgg

SEQ ID NO: 4591000 - DNA, 17 bp, Homo sapiens
ttttctgaactccattt

SEQ ID NO: 4591001 - DNA, 12 bp, Homo sapiens
ttttctgccaaa

SEQ ID NO: 4591002 - DNA, 17 bp, Homo sapiens
ttttctgtaaattcata

SEQ ID NO: 4591003 - DNA, 19 bp, Homo sapiens
ttttctgtaatgtaaataa

SEQ ID NO: 4591004 - DNA, 17 bp, Homo sapiens
ttttctgtagttcaatt

SEQ ID NO: 4591005 - DNA, 18 bp, Homo sapiens
ttttctgtgcctgaatat

SEQ ID NO: 4591006 - DNA, 9 bp, Homo sapiens
ttttcttaa

SEQ ID NO: 4591007 - DNA, 20 bp, Homo sapiens
ttttcttgactttgtatctt

SEQ ID NO: 4591008 - DNA, 17 bp, Homo sapiens
ttttcttggttctttca

SEQ ID NO: 4591009 - DNA, 12 bp, Homo sapiens
ttttctttactt

SEQ ID NO: 4591010 - DNA, 14 bp, Homo sapiens
ttttctttcctcct

SEQ ID NO: 4591011 - DNA, 17 bp, Homo sapiens
ttttctttctagtttgt

SEQ ID NO: 4591012 - DNA, 12 bp, Homo sapiens
ttttctttgcaa

SEQ ID NO: 4591013 - DNA, 12 bp, Homo sapiens
ttttctttgtat

SEQ ID NO: 4591014 - DNA, 18 bp, Homo sapiens
ttttctttgtatcattca

SEQ ID NO: 4591015 - DNA, 20 bp, Homo sapiens
ttttctttgtatcattcatc

SEQ ID NO: 4591016 - DNA, 22 bp, Homo sapiens
ttttctttgttaaaaccaaact

SEQ ID NO: 4591017 - DNA, 17 bp, Homo sapiens
ttttctttttaacttta

SEQ ID NO: 4591018 - DNA, 22 bp, Homo sapiens
ttttcttttttaaagtaaactt

SEQ ID NO: 4591019 - DNA, 23 bp, Homo sapiens
ttttcttttttaaattaatatct

SEQ ID NO: 4591020 - DNA, 18 bp, Homo sapiens
ttttgaaaaaaaagtttt

SEQ ID NO: 4591021 - DNA, 22 bp, Homo sapiens
ttttgaaaatatgtactgtata

SEQ ID NO: 4591022 - DNA, 17 bp, Homo sapiens
ttttgaaagatgtatgg

SEQ ID NO: 4591023 - DNA, 21 bp, Homo sapiens
ttttgaagcagtcttgctctg

SEQ ID NO: 4591024 - DNA, 13 bp, Homo sapiens
ttttgaatcaata

SEQ ID NO: 4591025 - DNA, 18 bp, Homo sapiens
ttttgacactgaaagttt

SEQ ID NO: 4591026 - DNA, 21 bp, Homo sapiens
ttttgacactgaaataaccgt

SEQ ID NO: 4591027 - DNA, 17 bp, Homo sapiens
ttttgaccatatagatt

SEQ ID NO: 4591028 - DNA, 19 bp, Homo sapiens
ttttgaccatatagatttt

SEQ ID NO: 4591029 - DNA, 22 bp, Homo sapiens
ttttgactagggattcaggctg

SEQ ID NO: 4591030 - DNA, 21 bp, Homo sapiens
ttttgagtaaaaagacatttt

SEQ ID NO: 4591031 - DNA, 18 bp, Homo sapiens
ttttgatactaagcattg

SEQ ID NO: 4591032 - DNA, 22 bp, Homo sapiens
ttttgatataattgtactgtgt

SEQ ID NO: 4591033 - DNA, 15 bp, Homo sapiens
ttttgatatatgaaa

SEQ ID NO: 4591034 - DNA, 19 bp, Homo sapiens
ttttgatatgcatatttgt

SEQ ID NO: 4591035 - DNA, 20 bp, Homo sapiens
ttttgatctgcttttcagaa

SEQ ID NO: 4591036 - DNA, 20 bp, Homo sapiens
ttttgatgtttgtggcctca

SEQ ID NO: 4591037 - DNA, 20 bp, Homo sapiens
ttttgatttaatgttttcag

SEQ ID NO: 4591038 - DNA, 15 bp, Homo sapiens
ttttgctgaattcct

SEQ ID NO: 4591039 - DNA, 16 bp, Homo sapiens
ttttgctgaattcctt

SEQ ID NO: 4591040 - DNA, 14 bp, Homo sapiens
ttttgctgcttctg

SEQ ID NO: 4591041 - DNA, 18 bp, Homo sapiens
ttttgcttccccgtgcat

SEQ ID NO: 4591042 - DNA, 16 bp, Homo sapiens
ttttgcttgcaatgta

SEQ ID NO: 4591043 - DNA, 20 bp, Homo sapiens
ttttggaggtgcttgatcta

SEQ ID NO: 4591044 - DNA, 16 bp, Homo sapiens
ttttggagtgttatgt

SEQ ID NO: 4591045 - DNA, 16 bp, Homo sapiens
ttttggattgtatatt

SEQ ID NO: 4591046 - DNA, 19 bp, Homo sapiens
ttttggcaaacgctaaaga

SEQ ID NO: 4591047 - DNA, 22 bp, Homo sapiens
ttttggcacttgccattccaaa

SEQ ID NO: 4591048 - DNA, 17 bp, Homo sapiens
ttttggcgaatctcaaa

SEQ ID NO: 4591049 - DNA, 11 bp, Homo sapiens
ttttgggactt

SEQ ID NO: 4591050 - DNA, 12 bp, Homo sapiens
ttttgggatgtc

SEQ ID NO: 4591051 - DNA, 14 bp, Homo sapiens
ttttgggatgtctt

SEQ ID NO: 4591052 - DNA, 16 bp, Homo sapiens
ttttggggttcaagaa

SEQ ID NO: 4591053 - DNA, 17 bp, Homo sapiens
ttttggtggatgtaaat

SEQ ID NO: 4591054 - DNA, 12 bp, Homo sapiens
ttttggtgtatt

SEQ ID NO: 4591055 - DNA, 13 bp, Homo sapiens
ttttggtttctta

SEQ ID NO: 4591056 - DNA, 21 bp, Homo sapiens
ttttggtttcttattcaaaga

SEQ ID NO: 4591057 - DNA, 14 bp, Homo sapiens
ttttggttttgttc

SEQ ID NO: 4591058 - DNA, 20 bp, Homo sapiens
ttttggttttgttcccctcc

SEQ ID NO: 4591059 - DNA, 15 bp, Homo sapiens
ttttgtaaaagaaat

SEQ ID NO: 4591060 - DNA, 21 bp, Homo sapiens
ttttgtaaactggaattaaaa

SEQ ID NO: 4591061 - DNA, 24 bp, Homo sapiens
ttttgtataattggatttcctaat

SEQ ID NO: 4591062 - DNA, 18 bp, Homo sapiens
ttttgtcactttttctga

SEQ ID NO: 4591063 - DNA, 17 bp, Homo sapiens
ttttgtcagacttccaa

SEQ ID NO: 4591064 - DNA, 15 bp, Homo sapiens
ttttgtgatgaacat

SEQ ID NO: 4591065 - DNA, 15 bp, Homo sapiens
ttttgtggaggggag

SEQ ID NO: 4591066 - DNA, 18 bp, Homo sapiens
ttttgtggattaaacctt

SEQ ID NO: 4591067 - DNA, 16 bp, Homo sapiens
ttttgtggtttggaat

SEQ ID NO: 4591068 - DNA, 16 bp, Homo sapiens
ttttgttagcaaagat

SEQ ID NO: 4591069 - DNA, 15 bp, Homo sapiens
ttttgttattaaaca

SEQ ID NO: 4591070 - DNA, 13 bp, Homo sapiens
ttttgttcagaat

SEQ ID NO: 4591071 - DNA, 21 bp, Homo sapiens
ttttgttgtgcactagtgcaa

SEQ ID NO: 4591072 - DNA, 16 bp, Homo sapiens
ttttgtttaccagaga

SEQ ID NO: 4591073 - DNA, 22 bp, Homo sapiens
ttttgtttccttttttcccata

SEQ ID NO: 4591074 - DNA, 21 bp, Homo sapiens
ttttgtttggttatatcgaaa

SEQ ID NO: 4591075 - DNA, 14 bp, Homo sapiens
ttttgtttgtttct

SEQ ID NO: 4591076 - DNA, 13 bp, Homo sapiens
ttttgttttgaaa

SEQ ID NO: 4591077 - DNA, 18 bp, Homo sapiens
tttttaaaaaagacattt

SEQ ID NO: 4591078 - DNA, 17 bp, Homo sapiens
tttttaaaaaagcttaa

SEQ ID NO: 4591079 - DNA, 16 bp, Homo sapiens
tttttaaaacaaaaga

SEQ ID NO: 4591080 - DNA, 15 bp, Homo sapiens
tttttaaaagagaca

SEQ ID NO: 4591081 - DNA, 14 bp, Homo sapiens
tttttaaaataaaa

SEQ ID NO: 4591082 - DNA, 15 bp, Homo sapiens
tttttaaaataaaat

SEQ ID NO: 4591083 - DNA, 14 bp, Homo sapiens
tttttaaaatactt

SEQ ID NO: 4591084 - DNA, 14 bp, Homo sapiens
tttttaaaatagaa

SEQ ID NO: 4591085 - DNA, 23 bp, Homo sapiens
tttttaaaatagaaattttgtaa

SEQ ID NO: 4591086 - DNA, 14 bp, Homo sapiens
tttttaaaatccag

SEQ ID NO: 4591087 - DNA, 14 bp, Homo sapiens
tttttaaaattttg

SEQ ID NO: 4591088 - DNA, 18 bp, Homo sapiens
tttttaaacttgaaatat

SEQ ID NO: 4591089 - DNA, 13 bp, Homo sapiens
tttttaaagctta

SEQ ID NO: 4591090 - DNA, 16 bp, Homo sapiens
tttttaaagtaaactt

SEQ ID NO: 4591091 - DNA, 16 bp, Homo sapiens
tttttaaataaaagca

SEQ ID NO: 4591092 - DNA, 17 bp, Homo sapiens
tttttaaataaaagcac

SEQ ID NO: 4591093 - DNA, 13 bp, Homo sapiens
tttttaaatgtaa

SEQ ID NO: 4591094 - DNA, 20 bp, Homo sapiens
tttttaaatgtaaagatatt

SEQ ID NO: 4591095 - DNA, 22 bp, Homo sapiens
tttttaactctactgtgtaata

SEQ ID NO: 4591096 - DNA, 18 bp, Homo sapiens
tttttaagttacacattt

SEQ ID NO: 4591097 - DNA, 19 bp, Homo sapiens
tttttaagttgtcaaagaa

SEQ ID NO: 4591098 - DNA, 12 bp, Homo sapiens
tttttaataaac

SEQ ID NO: 4591099 - DNA, 13 bp, Homo sapiens
tttttaatagaac

SEQ ID NO: 4591100 - DNA, 14 bp, Homo sapiens
tttttaatgtatct

SEQ ID NO: 4591101 - DNA, 11 bp, Homo sapiens
tttttaatttg

SEQ ID NO: 4591102 - DNA, 15 bp, Homo sapiens
tttttacaaagccct

SEQ ID NO: 4591103 - DNA, 11 bp, Homo sapiens
tttttacattt

SEQ ID NO: 4591104 - DNA, 17 bp, Homo sapiens
tttttagatggttacac

SEQ ID NO: 4591105 - DNA, 22 bp, Homo sapiens
tttttagtaagttaatgtatat

SEQ ID NO: 4591106 - DNA, 12 bp, Homo sapiens
tttttatacttt

SEQ ID NO: 4591107 - DNA, 15 bp, Homo sapiens
tttttatactttatt

SEQ ID NO: 4591108 - DNA, 22 bp, Homo sapiens
tttttatatttcctttatgtga

SEQ ID NO: 4591109 - DNA, 18 bp, Homo sapiens
tttttatctatataaaat

SEQ ID NO: 4591110 - DNA, 13 bp, Homo sapiens
tttttatgtacaa

SEQ ID NO: 4591111 - DNA, 23 bp, Homo sapiens
tttttattaattttagtttttca

SEQ ID NO: 4591112 - DNA, 13 bp, Homo sapiens
tttttattgcctt

SEQ ID NO: 4591113 - DNA, 12 bp, Homo sapiens
tttttatttcct

SEQ ID NO: 4591114 - DNA, 12 bp, Homo sapiens
tttttatttctg

SEQ ID NO: 4591115 - DNA, 19 bp, Homo sapiens
tttttcaagttgtaaataa

SEQ ID NO: 4591116 - DNA, 19 bp, Homo sapiens
tttttcaatatattgaact

SEQ ID NO: 4591117 - DNA, 13 bp, Homo sapiens
tttttcacaatca

SEQ ID NO: 4591118 - DNA, 21 bp, Homo sapiens
tttttcagtgatcttcactgt

SEQ ID NO: 4591119 - DNA, 16 bp, Homo sapiens
tttttcagttgttctt

SEQ ID NO: 4591120 - DNA, 23 bp, Homo sapiens
tttttcatactgtacacatttct

SEQ ID NO: 4591121 - DNA, 10 bp, Homo sapiens
tttttcatcc

SEQ ID NO: 4591122 - DNA, 22 bp, Homo sapiens
tttttcattaaataaatttgac

SEQ ID NO: 4591123 - DNA, 18 bp, Homo sapiens
tttttcattttaaaaagt

SEQ ID NO: 4591124 - DNA, 21 bp, Homo sapiens
tttttccacaaggaataaatg

SEQ ID NO: 4591125 - DNA, 21 bp, Homo sapiens
tttttccatcataattctaat

SEQ ID NO: 4591126 - DNA, 18 bp, Homo sapiens
tttttccccctatcagtt

SEQ ID NO: 4591127 - DNA, 15 bp, Homo sapiens
tttttccctccccag

SEQ ID NO: 4591128 - DNA, 18 bp, Homo sapiens
tttttcctaagacatttt

SEQ ID NO: 4591129 - DNA, 17 bp, Homo sapiens
tttttcctatgctattg

SEQ ID NO: 4591130 - DNA, 11 bp, Homo sapiens
tttttcctcct

SEQ ID NO: 4591131 - DNA, 16 bp, Homo sapiens
tttttccttactgtgc

SEQ ID NO: 4591132 - DNA, 22 bp, Homo sapiens
tttttccttcaaagtttaataa

SEQ ID NO: 4591133 - DNA, 15 bp, Homo sapiens
tttttctccagtgct

SEQ ID NO: 4591134 - DNA, 11 bp, Homo sapiens
tttttcttctg

SEQ ID NO: 4591135 - DNA, 16 bp, Homo sapiens
tttttcttctgtattt

SEQ ID NO: 4591136 - DNA, 23 bp, Homo sapiens
tttttctttttccagtgttctat

SEQ ID NO: 4591137 - DNA, 23 bp, Homo sapiens
tttttgaaaaagcgaaaaaatca

SEQ ID NO: 4591138 - DNA, 20 bp, Homo sapiens
tttttgaacctccaaatgga

SEQ ID NO: 4591139 - DNA, 13 bp, Homo sapiens
tttttgacactga

SEQ ID NO: 4591140 - DNA, 18 bp, Homo sapiens
tttttgaccagtttcttt

SEQ ID NO: 4591141 - DNA, 20 bp, Homo sapiens
tttttgactttttttgtatg

SEQ ID NO: 4591142 - DNA, 18 bp, Homo sapiens
tttttgaggtatcactgc

SEQ ID NO: 4591143 - DNA, 14 bp, Homo sapiens
tttttgagtactgt

SEQ ID NO: 4591144 - DNA, 15 bp, Homo sapiens
tttttgagtcattga

SEQ ID NO: 4591145 - DNA, 14 bp, Homo sapiens
tttttgatggaatt

SEQ ID NO: 4591146 - DNA, 11 bp, Homo sapiens
tttttgcaata

SEQ ID NO: 4591147 - DNA, 17 bp, Homo sapiens
tttttgcatttaaaaca

SEQ ID NO: 4591148 - DNA, 12 bp, Homo sapiens
tttttgcatttt

SEQ ID NO: 4591149 - DNA, 20 bp, Homo sapiens
tttttggagtgttatgtatt

SEQ ID NO: 4591150 - DNA, 19 bp, Homo sapiens
tttttggctgttttccctc

SEQ ID NO: 4591151 - DNA, 13 bp, Homo sapiens
tttttggtacaaa

SEQ ID NO: 4591152 - DNA, 14 bp, Homo sapiens
tttttggtacaaaa

SEQ ID NO: 4591153 - DNA, 20 bp, Homo sapiens
tttttggtttcttattcaaa

SEQ ID NO: 4591154 - DNA, 14 bp, Homo sapiens
tttttgtaacttca

SEQ ID NO: 4591155 - DNA, 23 bp, Homo sapiens
tttttgtacgttatatattgtat

SEQ ID NO: 4591156 - DNA, 18 bp, Homo sapiens
tttttgtgtgtatttgct

SEQ ID NO: 4591157 - DNA, 15 bp, Homo sapiens
tttttgttttgaaag

SEQ ID NO: 4591158 - DNA, 17 bp, Homo sapiens
ttttttaaaacaaaaga

SEQ ID NO: 4591159 - DNA, 23 bp, Homo sapiens
ttttttaaacaaaatttcacagt

SEQ ID NO: 4591160 - DNA, 12 bp, Homo sapiens
ttttttaaagaa

SEQ ID NO: 4591161 - DNA, 12 bp, Homo sapiens
ttttttaatttc

SEQ ID NO: 4591162 - DNA, 17 bp, Homo sapiens
ttttttactctttgaaa

SEQ ID NO: 4591163 - DNA, 18 bp, Homo sapiens
ttttttacttgaatcaga

SEQ ID NO: 4591164 - DNA, 13 bp, Homo sapiens
ttttttatactgc

SEQ ID NO: 4591165 - DNA, 12 bp, Homo sapiens
ttttttcagttg

SEQ ID NO: 4591166 - DNA, 14 bp, Homo sapiens
ttttttccaaaatc

SEQ ID NO: 4591167 - DNA, 15 bp, Homo sapiens
ttttttctacctata

SEQ ID NO: 4591168 - DNA, 20 bp, Homo sapiens
ttttttctttcccatgtatt

SEQ ID NO: 4591169 - DNA, 13 bp, Homo sapiens
ttttttggtacaa

SEQ ID NO: 4591170 - DNA, 16 bp, Homo sapiens
ttttttggtacaaaaa

SEQ ID NO: 4591171 - DNA, 11 bp, Homo sapiens
ttttttgtaac

SEQ ID NO: 4591172 - DNA, 11 bp, Homo sapiens
tttttttcaaa

SEQ ID NO: 4591173 - DNA, 13 bp, Homo sapiens
tttttttcaaatg

SEQ ID NO: 4591174 - DNA, 13 bp, Homo sapiens
tttttttccaatt

SEQ ID NO: 4591175 - DNA, 10 bp, Homo sapiens
tttttttcct

SEQ ID NO: 4591176 - DNA, 12 bp, Homo sapiens
tttttttcctga

SEQ ID NO: 4591177 - DNA, 13 bp, Homo sapiens
tttttttctgatt

SEQ ID NO: 4591178 - DNA, 12 bp, Homo sapiens
tttttttgtgtg

SEQ ID NO: 4591179 - DNA, 13 bp, Homo sapiens
ttttttttccgtg

SEQ ID NO: 4591180 - DNA, 17 bp, Homo sapiens
aagtgggtggggacaga

SEQ ID NO: 4591181 - DNA, 23 bp, Homo sapiens
aagtgggtggggacagaccagcc

SEQ ID NO: 4591182 - DNA, 21 bp, Homo sapiens
aagtgtatttttttactaata

SEQ ID NO: 4591183 - DNA, 19 bp, Homo sapiens
aagttccaagttgctaata

SEQ ID NO: 4591184 - DNA, 17 bp, Homo sapiens
aataaaaagatcacttt

SEQ ID NO: 4591185 - DNA, 15 bp, Homo sapiens
aataaaaatgtttaa

SEQ ID NO: 4591186 - DNA, 12 bp, Homo sapiens
aataaaactttt

SEQ ID NO: 4591187 - DNA, 23 bp, Homo sapiens
aataaacatccttcaagaactct

SEQ ID NO: 4591188 - DNA, 14 bp, Homo sapiens
aataaagcagcgtt

SEQ ID NO: 4591189 - DNA, 20 bp, Homo sapiens
aataaatctgacccagtgcc

SEQ ID NO: 4591190 - DNA, 20 bp, Homo sapiens
aataatcacgctttcctgaa

SEQ ID NO: 4591191 - DNA, 14 bp, Homo sapiens
aataattttgtaat

SEQ ID NO: 4591192 - DNA, 15 bp, Homo sapiens
aataattttgtaatg

SEQ ID NO: 4591193 - DNA, 20 bp, Homo sapiens
aatacaccactacattctgt

SEQ ID NO: 4591194 - DNA, 23 bp, Homo sapiens
aatacatttaaaacattaaaata

SEQ ID NO: 4591195 - DNA, 19 bp, Homo sapiens
aataccagccagtaaatgg

SEQ ID NO: 4591196 - DNA, 16 bp, Homo sapiens
aatagacagcatgaga

SEQ ID NO: 4591197 - DNA, 16 bp, Homo sapiens
aatagctttaatgata

SEQ ID NO: 4591198 - DNA, 21 bp, Homo sapiens
aatagggctgagctctctgtg

SEQ ID NO: 4591199 - DNA, 18 bp, Homo sapiens
aatataggaacttaaata

SEQ ID NO: 4591200 - DNA, 21 bp, Homo sapiens
aatataggaacttaaataatg

SEQ ID NO: 4591201 - DNA, 19 bp, Homo sapiens
aatatcttttttttaataa

SEQ ID NO: 4591202 - DNA, 15 bp, Homo sapiens
aatatgcacacattt

SEQ ID NO: 4591203 - DNA, 17 bp, Homo sapiens
aatatgcacacattttt

SEQ ID NO: 4591204 - DNA, 21 bp, Homo sapiens
aatattttaggtgtaaaataa

SEQ ID NO: 4591205 - DNA, 20 bp, Homo sapiens
aatcaattactggtccaaaa

SEQ ID NO: 4591206 - DNA, 16 bp, Homo sapiens
aatcacttaggaaatg

SEQ ID NO: 4591207 - DNA, 11 bp, Homo sapiens
aatcagaactc

SEQ ID NO: 4591208 - DNA, 15 bp, Homo sapiens
aatcattaggtgtga

SEQ ID NO: 4591209 - DNA, 17 bp, Homo sapiens
aatcattaggtgtgact

SEQ ID NO: 4591210 - DNA, 18 bp, Homo sapiens
aatccaggcagatccagg

SEQ ID NO: 4591211 - DNA, 15 bp, Homo sapiens
aatctaaatggaacc

SEQ ID NO: 4591212 - DNA, 18 bp, Homo sapiens
aatctaaatggaaccact

SEQ ID NO: 4591213 - DNA, 14 bp, Homo sapiens
aatctcaaatttct

SEQ ID NO: 4591214 - DNA, 14 bp, Homo sapiens
aatctccaaaataa

SEQ ID NO: 4591215 - DNA, 18 bp, Homo sapiens
aatctccaaaataaaact

SEQ ID NO: 4591216 - DNA, 15 bp, Homo sapiens
aatctgacccagtgc

SEQ ID NO: 4591217 - DNA, 21 bp, Homo sapiens
aatctgtaaactgtgtattcc

SEQ ID NO: 4591218 - DNA, 19 bp, Homo sapiens
aatgaagttgattcatatt

SEQ ID NO: 4591219 - DNA, 15 bp, Homo sapiens
aatgaatgaatgaat

SEQ ID NO: 4591220 - DNA, 22 bp, Homo sapiens
aatgaatggctaagcaaaatgt

SEQ ID NO: 4591221 - DNA, 13 bp, Homo sapiens
aatgcaaccattt

SEQ ID NO: 4591222 - DNA, 19 bp, Homo sapiens
aatgcgtgcataccacttt

SEQ ID NO: 4591223 - DNA, 16 bp, Homo sapiens
aatgctccagcactca

SEQ ID NO: 4591224 - DNA, 13 bp, Homo sapiens
aatgctgtgccct

SEQ ID NO: 4591225 - DNA, 21 bp, Homo sapiens
aatgctgtgccctaaagtgta

SEQ ID NO: 4591226 - DNA, 22 bp, Homo sapiens
aatggggccagatccagcctgg

SEQ ID NO: 4591227 - DNA, 15 bp, Homo sapiens
aatggtcgcccagga

SEQ ID NO: 4591228 - DNA, 23 bp, Homo sapiens
aatgtacagcaaggagatttaca

SEQ ID NO: 4591229 - DNA, 20 bp, Homo sapiens
aatgtcagttgttatttatt

SEQ ID NO: 4591230 - DNA, 22 bp, Homo sapiens
aatgtcagttgttatttattga

SEQ ID NO: 4591231 - DNA, 22 bp, Homo sapiens
aatgtgaaactggattaaactt

SEQ ID NO: 4591232 - DNA, 11 bp, Homo sapiens
aatgtgatatg

SEQ ID NO: 4591233 - DNA, 21 bp, Homo sapiens
aatgtttatgcaaggaaggaa

SEQ ID NO: 4591234 - DNA, 11 bp, Homo sapiens
aattaactttt

SEQ ID NO: 4591235 - DNA, 15 bp, Homo sapiens
aattaacttttataa

SEQ ID NO: 4591236 - DNA, 20 bp, Homo sapiens
aattaacttttataaacttt

SEQ ID NO: 4591237 - DNA, 18 bp, Homo sapiens
aattagaaattggctgga

SEQ ID NO: 4591238 - DNA, 15 bp, Homo sapiens
aattctctagtttga

SEQ ID NO: 4591239 - DNA, 20 bp, Homo sapiens
aattctgctctaaataaaga

SEQ ID NO: 4591240 - DNA, 23 bp, Homo sapiens
aattcttctgaactcaaactgag

SEQ ID NO: 4591241 - DNA, 14 bp, Homo sapiens
aattcttgcaaagt

SEQ ID NO: 4591242 - DNA, 19 bp, Homo sapiens
aattgtcactttttatgct

SEQ ID NO: 4591243 - DNA, 17 bp, Homo sapiens
aatttacagagacagaa

SEQ ID NO: 4591244 - DNA, 16 bp, Homo sapiens
aatttcacctgtaaac

SEQ ID NO: 4591245 - DNA, 15 bp, Homo sapiens
aatttcccaggaccc

SEQ ID NO: 4591246 - DNA, 17 bp, Homo sapiens
aatttcccaggaccctg

SEQ ID NO: 4591247 - DNA, 21 bp, Homo sapiens
aatttcccaggaccctgaagg

SEQ ID NO: 4591248 - DNA, 21 bp, Homo sapiens
aatttcgccgttgaagaggaa

SEQ ID NO: 4591249 - DNA, 21 bp, Homo sapiens
aatttctaaatctccaaaata

SEQ ID NO: 4591250 - DNA, 18 bp, Homo sapiens
aatttggcctgcactaat

SEQ ID NO: 4591251 - DNA, 18 bp, Homo sapiens
aatttgtgatacaatgct

SEQ ID NO: 4591252 - DNA, 18 bp, Homo sapiens
aattttgtaatgtatcaa

SEQ ID NO: 4591253 - DNA, 15 bp, Homo sapiens
aattttgtgtaagaa

SEQ ID NO: 4591254 - DNA, 11 bp, Homo sapiens
acaaaagcatg

SEQ ID NO: 4591255 - DNA, 17 bp, Homo sapiens
acaaaggggcttaatta

SEQ ID NO: 4591256 - DNA, 17 bp, Homo sapiens
acaaatttacagagaca

SEQ ID NO: 4591257 - DNA, 18 bp, Homo sapiens
acaaatttacagagacag

SEQ ID NO: 4591258 - DNA, 19 bp, Homo sapiens
acaaatttacagagacaga

SEQ ID NO: 4591259 - DNA, 14 bp, Homo sapiens
acaacacacacact

SEQ ID NO: 4591260 - DNA, 18 bp, Homo sapiens
acaagaccacgtttctaa

SEQ ID NO: 4591261 - DNA, 20 bp, Homo sapiens
acaagacccaaaaggcagaa

SEQ ID NO: 4591262 - DNA, 18 bp, Homo sapiens
acaaggatagatgctggc

SEQ ID NO: 4591263 - DNA, 16 bp, Homo sapiens
acaattttttatcatg

SEQ ID NO: 4591264 - DNA, 13 bp, Homo sapiens
acacaggccctcc

SEQ ID NO: 4591265 - DNA, 19 bp, Homo sapiens
acacagtaccatttaatgg

SEQ ID NO: 4591266 - DNA, 15 bp, Homo sapiens
acacataccctcttc

SEQ ID NO: 4591267 - DNA, 18 bp, Homo sapiens
acacatgcaaggtcattt

SEQ ID NO: 4591268 - DNA, 21 bp, Homo sapiens
acacatgcaaggtcatttttt

SEQ ID NO: 4591269 - DNA, 22 bp, Homo sapiens
acacattttattttattatgca

SEQ ID NO: 4591270 - DNA, 22 bp, Homo sapiens
acacattttttaaatgcacctg

SEQ ID NO: 4591271 - DNA, 14 bp, Homo sapiens
acactccagtgaga

SEQ ID NO: 4591272 - DNA, 19 bp, Homo sapiens
acactgagaaagaggcagg

SEQ ID NO: 4591273 - DNA, 15 bp, Homo sapiens
acactgtttcaaact

SEQ ID NO: 4591274 - DNA, 20 bp, Homo sapiens
acactgtttcaaactttact

SEQ ID NO: 4591275 - DNA, 20 bp, Homo sapiens
acacttattggaactctgct

SEQ ID NO: 4591276 - DNA, 12 bp, Homo sapiens
acacttctgggc

SEQ ID NO: 4591277 - DNA, 22 bp, Homo sapiens
acactttaattaccaacctgtt

SEQ ID NO: 4591278 - DNA, 13 bp, Homo sapiens
acagaaatgtaca

SEQ ID NO: 4591279 - DNA, 19 bp, Homo sapiens
acagacatactaaccagca

SEQ ID NO: 4591280 - DNA, 15 bp, Homo sapiens
acagaccagcccttc

SEQ ID NO: 4591281 - DNA, 15 bp, Homo sapiens
acagaggccccagcc

SEQ ID NO: 4591282 - DNA, 15 bp, Homo sapiens
acagagttgttacat

SEQ ID NO: 4591283 - DNA, 16 bp, Homo sapiens
acagagttgttacatt

SEQ ID NO: 4591284 - DNA, 17 bp, Homo sapiens
acagagttgttacattt

SEQ ID NO: 4591285 - DNA, 20 bp, Homo sapiens
acagagttgttacattttta

SEQ ID NO: 4591286 - DNA, 21 bp, Homo sapiens
acagagttgttacatttttaa

SEQ ID NO: 4591287 - DNA, 22 bp, Homo sapiens
acagagttgttacatttttaag

SEQ ID NO: 4591288 - DNA, 12 bp, Homo sapiens
acagatctggaa

SEQ ID NO: 4591289 - DNA, 21 bp, Homo sapiens
acagatctggaacctcagcct

SEQ ID NO: 4591290 - DNA, 17 bp, Homo sapiens
acagcaacaatttatga

SEQ ID NO: 4591291 - DNA, 21 bp, Homo sapiens
acagcaaggagatttacaact

SEQ ID NO: 4591292 - DNA, 12 bp, Homo sapiens
acagcatcctct

SEQ ID NO: 4591293 - DNA, 13 bp, Homo sapiens
acagcatcctctc

SEQ ID NO: 4591294 - DNA, 14 bp, Homo sapiens
acagccccaccctg

SEQ ID NO: 4591295 - DNA, 17 bp, Homo sapiens
acagctcattaaacttt

SEQ ID NO: 4591296 - DNA, 20 bp, Homo sapiens
acagctctgcatactcatta

SEQ ID NO: 4591297 - DNA, 21 bp, Homo sapiens
acaggccctccctgttcccca

SEQ ID NO: 4591298 - DNA, 16 bp, Homo sapiens
acaggtggacacacaa

SEQ ID NO: 4591299 - DNA, 22 bp, Homo sapiens
acagtgtgtggtcaacatttct

SEQ ID NO: 4591300 - DNA, 18 bp, Homo sapiens
acagttctttgggccaga

SEQ ID NO: 4591301 - DNA, 21 bp, Homo sapiens
acagttctttgggccagacat

SEQ ID NO: 4591302 - DNA, 16 bp, Homo sapiens
acagtttgttagtatg

SEQ ID NO: 4591303 - DNA, 12 bp, Homo sapiens
acataactgaaa

SEQ ID NO: 4591304 - DNA, 21 bp, Homo sapiens
acataatgcgtgcataccact

SEQ ID NO: 4591305 - DNA, 23 bp, Homo sapiens
acataatgcgtgcataccacttt

SEQ ID NO: 4591306 - DNA, 21 bp, Homo sapiens
acatacttgaagggccagagc

SEQ ID NO: 4591307 - DNA, 23 bp, Homo sapiens
acatattgatttccgttaaaata

SEQ ID NO: 4591308 - DNA, 13 bp, Homo sapiens
acatcacaggaca

SEQ ID NO: 4591309 - DNA, 17 bp, Homo sapiens
acatcagcacgatttct

SEQ ID NO: 4591310 - DNA, 20 bp, Homo sapiens
acatcagcacgatttctgtt

SEQ ID NO: 4591311 - DNA, 13 bp, Homo sapiens
acatctttatccg

SEQ ID NO: 4591312 - DNA, 18 bp, Homo sapiens
acatgaaaacacattttt

SEQ ID NO: 4591313 - DNA, 18 bp, Homo sapiens
aaaaacagatttggaaag

SEQ ID NO: 4591314 - DNA, 13 bp, Homo sapiens
aaaaactatttaa

SEQ ID NO: 4591315 - DNA, 21 bp, Homo sapiens
aaaaagggatccgtacattca

SEQ ID NO: 4591316 - DNA, 12 bp, Homo sapiens
aaaacacatttt

SEQ ID NO: 4591317 - DNA, 17 bp, Homo sapiens
aaaacagacactggcat

SEQ ID NO: 4591318 - DNA, 24 bp, Homo sapiens
aaaacataatcttctgccttctca

SEQ ID NO: 4591319 - DNA, 15 bp, Homo sapiens
aaaacatgctacaca

SEQ ID NO: 4591320 - DNA, 15 bp, Homo sapiens
aaaacttcagacata

SEQ ID NO: 4591321 - DNA, 21 bp, Homo sapiens
aaaagattgaagtattttgct

SEQ ID NO: 4591322 - DNA, 14 bp, Homo sapiens
aaaagcattttgta

SEQ ID NO: 4591323 - DNA, 23 bp, Homo sapiens
aaaagccaggttccacagaggac

SEQ ID NO: 4591324 - DNA, 14 bp, Homo sapiens
aaaagctttttatt

SEQ ID NO: 4591325 - DNA, 19 bp, Homo sapiens
aaaaggatgcacagagttg

SEQ ID NO: 4591326 - DNA, 20 bp, Homo sapiens
aaaataaaaagatcactttc

SEQ ID NO: 4591327 - DNA, 16 bp, Homo sapiens
aaaataaaacttttta

SEQ ID NO: 4591328 - DNA, 17 bp, Homo sapiens
aaaataaaactttttaa

SEQ ID NO: 4591329 - DNA, 15 bp, Homo sapiens
aaaataccagccagt

SEQ ID NO: 4591330 - DNA, 21 bp, Homo sapiens
aaaatctacactccagtgaga

SEQ ID NO: 4591331 - DNA, 15 bp, Homo sapiens
aaaatctcaaatttc

SEQ ID NO: 4591332 - DNA, 16 bp, Homo sapiens
aaaatctcaaatttct

SEQ ID NO: 4591333 - DNA, 22 bp, Homo sapiens
aaaatctcaaatttctaaatct

SEQ ID NO: 4591334 - DNA, 16 bp, Homo sapiens
aaaatggtttaaatgg

SEQ ID NO: 4591335 - DNA, 20 bp, Homo sapiens
aaacaaaggcctaattctat

SEQ ID NO: 4591336 - DNA, 20 bp, Homo sapiens
aaacaagaccacgtttctaa

SEQ ID NO: 4591337 - DNA, 11 bp, Homo sapiens
aaacacatttt

SEQ ID NO: 4591338 - DNA, 12 bp, Homo sapiens
aaacacattttt

SEQ ID NO: 4591339 - DNA, 14 bp, Homo sapiens
aaacagtagtgata

SEQ ID NO: 4591340 - DNA, 18 bp, Homo sapiens
aaacatccttcaagaact

SEQ ID NO: 4591341 - DNA, 22 bp, Homo sapiens
aaacatgctacacactgcatgt

SEQ ID NO: 4591342 - DNA, 18 bp, Homo sapiens
aaacccctgtaggcctca

SEQ ID NO: 4591343 - DNA, 14 bp, Homo sapiens
aaactaccacctca

SEQ ID NO: 4591344 - DNA, 17 bp, Homo sapiens
aaactaccacctcaggt

SEQ ID NO: 4591345 - DNA, 15 bp, Homo sapiens
aaactccagatgcca

SEQ ID NO: 4591346 - DNA, 16 bp, Homo sapiens
aaactggattaaactt

SEQ ID NO: 4591347 - DNA, 10 bp, Homo sapiens
aaactgtgta

SEQ ID NO: 4591348 - DNA, 20 bp, Homo sapiens
aaactgtgtacataactgaa

SEQ ID NO: 4591349 - DNA, 18 bp, Homo sapiens
aaactgtgtattccaaga

SEQ ID NO: 4591350 - DNA, 14 bp, Homo sapiens
aaactttacctttt

SEQ ID NO: 4591351 - DNA, 14 bp, Homo sapiens
aaagaaagaaggaa

SEQ ID NO: 4591352 - DNA, 20 bp, Homo sapiens
aaagaacgctgatttaaaga

SEQ ID NO: 4591353 - DNA, 12 bp, Homo sapiens
aaagaaggaagt

SEQ ID NO: 4591354 - DNA, 12 bp, Homo sapiens
aaagaggcaggg

SEQ ID NO: 4591355 - DNA, 12 bp, Homo sapiens
aaagatattttg

SEQ ID NO: 4591356 - DNA, 16 bp, Homo sapiens
aaagatattttgcttt

SEQ ID NO: 4591357 - DNA, 17 bp, Homo sapiens
aaagatattttgctttg

SEQ ID NO: 4591358 - DNA, 16 bp, Homo sapiens
aaagatatttttatct

SEQ ID NO: 4591359 - DNA, 20 bp, Homo sapiens
aaagatctgtcctcagcctt

SEQ ID NO: 4591360 - DNA, 21 bp, Homo sapiens
aaagattgctgaaattttata

SEQ ID NO: 4591361 - DNA, 15 bp, Homo sapiens
aaagcagcgtttcta

SEQ ID NO: 4591362 - DNA, 18 bp, Homo sapiens
aaagcagcgtttctatga

SEQ ID NO: 4591363 - DNA, 13 bp, Homo sapiens
aaagcatgaatgg

SEQ ID NO: 4591364 - DNA, 15 bp, Homo sapiens
aaagcattttgtaat

SEQ ID NO: 4591365 - DNA, 11 bp, Homo sapiens
aaagccagcct

SEQ ID NO: 4591366 - DNA, 19 bp, Homo sapiens
aaagtataaaattatattt

SEQ ID NO: 4591367 - DNA, 18 bp, Homo sapiens
aaagtatccctactgtaa

SEQ ID NO: 4591368 - DNA, 22 bp, Homo sapiens
aaagttaccagtgccttaaact

SEQ ID NO: 4591369 - DNA, 19 bp, Homo sapiens
aaataaaactttttaaaat

SEQ ID NO: 4591370 - DNA, 16 bp, Homo sapiens
aaataaagacgactac

SEQ ID NO: 4591371 - DNA, 12 bp, Homo sapiens
aaataatgtgaa

SEQ ID NO: 4591372 - DNA, 14 bp, Homo sapiens
aaataatgtgaaac

SEQ ID NO: 4591373 - DNA, 13 bp, Homo sapiens
aaataattttgta

SEQ ID NO: 4591374 - DNA, 18 bp, Homo sapiens
aaataccagccagtaaat

SEQ ID NO: 4591375 - DNA, 19 bp, Homo sapiens
aaataccagccagtaaatg

SEQ ID NO: 4591376 - DNA, 19 bp, Homo sapiens
aaatcaattactggtccaa

SEQ ID NO: 4591377 - DNA, 19 bp, Homo sapiens
aaatctacactccagtgag

SEQ ID NO: 4591378 - DNA, 16 bp, Homo sapiens
aaatctcaaatttcta

SEQ ID NO: 4591379 - DNA, 22 bp, Homo sapiens
aaatctccaaaataaaactttt

SEQ ID NO: 4591380 - DNA, 13 bp, Homo sapiens
aaatgctccagca

SEQ ID NO: 4591381 - DNA, 17 bp, Homo sapiens
aaatgggggtgcatttg

SEQ ID NO: 4591382 - DNA, 19 bp, Homo sapiens
aaatgggggtgcatttgag

SEQ ID NO: 4591383 - DNA, 22 bp, Homo sapiens
aaatgtaaagatatttttatct

SEQ ID NO: 4591384 - DNA, 19 bp, Homo sapiens
aaatgttggtcattttatg

SEQ ID NO: 4591385 - DNA, 23 bp, Homo sapiens
aaattaacttttataaactttac

SEQ ID NO: 4591386 - DNA, 15 bp, Homo sapiens
aaatttctaaatctc

SEQ ID NO: 4591387 - DNA, 18 bp, Homo sapiens
aaattttgatgttttaag

SEQ ID NO: 4591388 - DNA, 23 bp, Homo sapiens
aaattttgatgttttaaggatgc

SEQ ID NO: 4591389 - DNA, 18 bp, Homo sapiens
aacaaatttacagagaca

SEQ ID NO: 4591390 - DNA, 20 bp, Homo sapiens
aacaagaccacgtttctaaa

SEQ ID NO: 4591391 - DNA, 12 bp, Homo sapiens
aacaagctattt

SEQ ID NO: 4591392 - DNA, 15 bp, Homo sapiens
aacactgagaaagag

SEQ ID NO: 4591393 - DNA, 19 bp, Homo sapiens
aacactgagaaagaggcag

SEQ ID NO: 4591394 - DNA, 15 bp, Homo sapiens
aacagaaatgtacag

SEQ ID NO: 4591395 - DNA, 18 bp, Homo sapiens
aacagacaacagaagtca

SEQ ID NO: 4591396 - DNA, 17 bp, Homo sapiens
aacagaggccatggcag

SEQ ID NO: 4591397 - DNA, 21 bp, Homo sapiens
aacagaggccatggcagaata

SEQ ID NO: 4591398 - DNA, 16 bp, Homo sapiens
aacagataaatagttt

SEQ ID NO: 4591399 - DNA, 14 bp, Homo sapiens
aacagatttggaaa

SEQ ID NO: 4591400 - DNA, 22 bp, Homo sapiens
aacagtgattaccagggactga

SEQ ID NO: 4591401 - DNA, 20 bp, Homo sapiens
aacataatcttctgccttct

SEQ ID NO: 4591402 - DNA, 14 bp, Homo sapiens
aacatattgttgaa

SEQ ID NO: 4591403 - DNA, 22 bp, Homo sapiens
aacattcttttgtttatattgt

SEQ ID NO: 4591404 - DNA, 21 bp, Homo sapiens
aaccaaaagaacaagaatttc

SEQ ID NO: 4591405 - DNA, 18 bp, Homo sapiens
aacccaaatgttcatcaa

SEQ ID NO: 4591406 - DNA, 15 bp, Homo sapiens
aacccagactcagac

SEQ ID NO: 4591407 - DNA, 20 bp, Homo sapiens
aacccatatttgtacaccaa

SEQ ID NO: 4591408 - DNA, 16 bp, Homo sapiens
aaccccaagttagttc

SEQ ID NO: 4591409 - DNA, 18 bp, Homo sapiens
aaccgtctgttatgctgt

SEQ ID NO: 4591410 - DNA, 22 bp, Homo sapiens
aaccgtctgttatgctgtgaca

SEQ ID NO: 4591411 - DNA, 17 bp, Homo sapiens
aacctcaactgcctact

SEQ ID NO: 4591412 - DNA, 21 bp, Homo sapiens
aacctgttacctactttgact

SEQ ID NO: 4591413 - DNA, 23 bp, Homo sapiens
aaccttgtctctatgccagctca

SEQ ID NO: 4591414 - DNA, 17 bp, Homo sapiens
aacgtaaccacggaaaa

SEQ ID NO: 4591415 - DNA, 15 bp, Homo sapiens
aactaccacctcagg

SEQ ID NO: 4591416 - DNA, 22 bp, Homo sapiens
aactcaaatggggccagatcca

SEQ ID NO: 4591417 - DNA, 13 bp, Homo sapiens
aactcagatccag

SEQ ID NO: 4591418 - DNA, 12 bp, Homo sapiens
aactctctccac

SEQ ID NO: 4591419 - DNA, 21 bp, Homo sapiens
aactctgggctgctacccaga

SEQ ID NO: 4591420 - DNA, 19 bp, Homo sapiens
aactctgttgcaagtgcaa

SEQ ID NO: 4591421 - DNA, 22 bp, Homo sapiens
aactctgttgcaagtgcaataa

SEQ ID NO: 4591422 - DNA, 18 bp, Homo sapiens
aactgaggaatttcacct

SEQ ID NO: 4591423 - DNA, 16 bp, Homo sapiens
aactggattaaactta

SEQ ID NO: 4591424 - DNA, 21 bp, Homo sapiens
aactgtgtacataactgaaaa

SEQ ID NO: 4591425 - DNA, 19 bp, Homo sapiens
aacttaaataatgtgaaac

SEQ ID NO: 4591426 - DNA, 15 bp, Homo sapiens
aacttaatctaaatg

SEQ ID NO: 4591427 - DNA, 23 bp, Homo sapiens
aacttggggagttaagacctggc

SEQ ID NO: 4591428 - DNA, 20 bp, Homo sapiens
aactttatgctaagtgaaat

SEQ ID NO: 4591429 - DNA, 15 bp, Homo sapiens
aactttcaattgtca

SEQ ID NO: 4591430 - DNA, 14 bp, Homo sapiens
aactttgacctctg

SEQ ID NO: 4591431 - DNA, 12 bp, Homo sapiens
aacttttataaa

SEQ ID NO: 4591432 - DNA, 16 bp, Homo sapiens
aacttttataaacttt

SEQ ID NO: 4591433 - DNA, 18 bp, Homo sapiens
aagaaaaaggatgcacag

SEQ ID NO: 4591434 - DNA, 20 bp, Homo sapiens
aagaaaaaggatgcacagag

SEQ ID NO: 4591435 - DNA, 22 bp, Homo sapiens
aagaaaaaggatgcacagagtt

SEQ ID NO: 4591436 - DNA, 13 bp, Homo sapiens
aagaaaatcactt

SEQ ID NO: 4591437 - DNA, 15 bp, Homo sapiens
aagaaagaaggaagt

SEQ ID NO: 4591438 - DNA, 17 bp, Homo sapiens
aagaaccagtcccccca

SEQ ID NO: 4591439 - DNA, 14 bp, Homo sapiens
aagaacctggaact

SEQ ID NO: 4591440 - DNA, 23 bp, Homo sapiens
aagaatagcattgtaaaagcatt

SEQ ID NO: 4591441 - DNA, 17 bp, Homo sapiens
aagaatagctttaatga

SEQ ID NO: 4591442 - DNA, 23 bp, Homo sapiens
aagaatttcttggtaagaagccg

SEQ ID NO: 4591443 - DNA, 16 bp, Homo sapiens
aagacatgtctgttct

SEQ ID NO: 4591444 - DNA, 17 bp, Homo sapiens
aagacatgtctgttcta

SEQ ID NO: 4591445 - DNA, 15 bp, Homo sapiens
aagaccacgtttcta

SEQ ID NO: 4591446 - DNA, 17 bp, Homo sapiens
aagaccacgtttctaaa

SEQ ID NO: 4591447 - DNA, 17 bp, Homo sapiens
aagacctggcagctctg

SEQ ID NO: 4591448 - DNA, 21 bp, Homo sapiens
aagactgagtacgttgtgcat

SEQ ID NO: 4591449 - DNA, 22 bp, Homo sapiens
aagactgagtacgttgtgcatt

SEQ ID NO: 4591450 - DNA, 23 bp, Homo sapiens
aagaggaatgaagtactcataca

SEQ ID NO: 4591451 - DNA, 15 bp, Homo sapiens
aagatcactttctca

SEQ ID NO: 4591452 - DNA, 21 bp, Homo sapiens
aagatcctgtctttaaggaaa

SEQ ID NO: 4591453 - DNA, 17 bp, Homo sapiens
aagatctgtcctcagcc

SEQ ID NO: 4591454 - DNA, 19 bp, Homo sapiens
aagatgtagaggagaaact

SEQ ID NO: 4591455 - DNA, 22 bp, Homo sapiens
aagatgtagaggagaaactgga

SEQ ID NO: 4591456 - DNA, 17 bp, Homo sapiens
aagcagcgtttctatga

SEQ ID NO: 4591457 - DNA, 15 bp, Homo sapiens
aagcagggacttgaa

SEQ ID NO: 4591458 - DNA, 13 bp, Homo sapiens
aagccagcctggg

SEQ ID NO: 4591459 - DNA, 12 bp, Homo sapiens
aagccagctttc

SEQ ID NO: 4591460 - DNA, 21 bp, Homo sapiens
aagcctgcacaataaaaatgt

SEQ ID NO: 4591461 - DNA, 23 bp, Homo sapiens
aagctcacttctgggcttcatct

SEQ ID NO: 4591462 - DNA, 19 bp, Homo sapiens
aagctcctctccccagccc

SEQ ID NO: 4591463 - DNA, 23 bp, Homo sapiens
aagctcctctccccagcccagag

SEQ ID NO: 4591464 - DNA, 12 bp, Homo sapiens
aagctctgaagt

SEQ ID NO: 4591465 - DNA, 15 bp, Homo sapiens
aagctgcctggtata

SEQ ID NO: 4591466 - DNA, 20 bp, Homo sapiens
aagctgcctggtatatccaa

SEQ ID NO: 4591467 - DNA, 21 bp, Homo sapiens
aaggacttcctgtccagctcc

SEQ ID NO: 4591468 - DNA, 23 bp, Homo sapiens
aaggacttcctgtccagctccaa

SEQ ID NO: 4591469 - DNA, 17 bp, Homo sapiens
aaggagatttacaactg

SEQ ID NO: 4591470 - DNA, 21 bp, Homo sapiens
aaggatacaaaagcatgtgag

SEQ ID NO: 4591471 - DNA, 17 bp, Homo sapiens
aaggatgcttgtacata

SEQ ID NO: 4591472 - DNA, 16 bp, Homo sapiens
aaggcaaccaataaaa

SEQ ID NO: 4591473 - DNA, 22 bp, Homo sapiens
aaggcctaattctatgcctgtc

SEQ ID NO: 4591474 - DNA, 19 bp, Homo sapiens
aaggctacctttgtattct

SEQ ID NO: 4591475 - DNA, 20 bp, Homo sapiens
aagggactacctctgtgcct

SEQ ID NO: 4591476 - DNA, 19 bp, Homo sapiens
aaggtactttcatatttta

SEQ ID NO: 4591477 - DNA, 19 bp, Homo sapiens
aaggtcattttttttaaga

SEQ ID NO: 4591478 - DNA, 12 bp, Homo sapiens
aagtaatatgca

SEQ ID NO: 4591479 - DNA, 15 bp, Homo sapiens
aagtaatatgcacac

SEQ ID NO: 4591480 - DNA, 18 bp, Homo sapiens
aagtaatatgcacacatt

SEQ ID NO: 4591481 - DNA, 23 bp, Homo sapiens
aagtacactgtttcaaactttac

SEQ ID NO: 4591482 - DNA, 17 bp, Homo sapiens
aagtatccctactgtaa

SEQ ID NO: 4591483 - DNA, 17 bp, Homo sapiens
aagtcacatcacaggac

SEQ ID NO: 4591484 - DNA, 17 bp, Homo sapiens
aagtcttctatttattt

SEQ ID NO: 4591485 - DNA, 12 bp, Homo sapiens
aagtgaaaatat

SEQ ID NO: 4591486 - DNA, 17 bp, Homo sapiens
aagtgaagacaatgact

SEQ ID NO: 4591487 - DNA, 17 bp, Homo sapiens
acatgcaaggtcatttt

SEQ ID NO: 4591488 - DNA, 21 bp, Homo sapiens
acatgcagctatttcaaagtg

SEQ ID NO: 4591489 - DNA, 21 bp, Homo sapiens
acatgctacacactgcatgtt

SEQ ID NO: 4591490 - DNA, 22 bp, Homo sapiens
acatgctacacactgcatgttt

SEQ ID NO: 4591491 - DNA, 21 bp, Homo sapiens
acatggcccctccccctgcca

SEQ ID NO: 4591492 - DNA, 15 bp, Homo sapiens
acattctgttaatca

SEQ ID NO: 4591493 - DNA, 21 bp, Homo sapiens
acattggcacctaatccaggc

SEQ ID NO: 4591494 - DNA, 14 bp, Homo sapiens
acatttaaaacatt

SEQ ID NO: 4591495 - DNA, 22 bp, Homo sapiens
acatttaaaacattaaaatata

SEQ ID NO: 4591496 - DNA, 17 bp, Homo sapiens
acatttctcatgttgaa

SEQ ID NO: 4591497 - DNA, 14 bp, Homo sapiens
acattttattttat

SEQ ID NO: 4591498 - DNA, 12 bp, Homo sapiens
acattttccttt

SEQ ID NO: 4591499 - DNA, 18 bp, Homo sapiens
acatttttaagtgctgca

SEQ ID NO: 4591500 - DNA, 13 bp, Homo sapiens
acatttttcttag

SEQ ID NO: 4591501 - DNA, 17 bp, Homo sapiens
acattttttaaatgcac

SEQ ID NO: 4591502 - DNA, 20 bp, Homo sapiens
accaaggctgattaaaccaa

SEQ ID NO: 4591503 - DNA, 23 bp, Homo sapiens
accaatagggctgagctctctgt

SEQ ID NO: 4591504 - DNA, 21 bp, Homo sapiens
accacagacatactaaccagc

SEQ ID NO: 4591505 - DNA, 17 bp, Homo sapiens
accacctcaggtgactt

SEQ ID NO: 4591506 - DNA, 20 bp, Homo sapiens
accacctcaggtgacttttt

SEQ ID NO: 4591507 - DNA, 13 bp, Homo sapiens
accacgtttctaa

SEQ ID NO: 4591508 - DNA, 15 bp, Homo sapiens
accacgtttctaaag

SEQ ID NO: 4591509 - DNA, 14 bp, Homo sapiens
accactacattctg

SEQ ID NO: 4591510 - DNA, 20 bp, Homo sapiens
accactctatcaagtattat

SEQ ID NO: 4591511 - DNA, 23 bp, Homo sapiens
accactggcctacccctttctcc

SEQ ID NO: 4591512 - DNA, 21 bp, Homo sapiens
accacttttgttcttggtttg

SEQ ID NO: 4591513 - DNA, 17 bp, Homo sapiens
accagacacccaggact

SEQ ID NO: 4591514 - DNA, 16 bp, Homo sapiens
accagctcaggacaga

SEQ ID NO: 4591515 - DNA, 23 bp, Homo sapiens
accagctcaggacagatgccaca

SEQ ID NO: 4591516 - DNA, 14 bp, Homo sapiens
accagggactgagg

SEQ ID NO: 4591517 - DNA, 15 bp, Homo sapiens
accagtccccccacc

SEQ ID NO: 4591518 - DNA, 12 bp, Homo sapiens
accagtgcctta

SEQ ID NO: 4591519 - DNA, 15 bp, Homo sapiens
accatcgctttattg

SEQ ID NO: 4591520 - DNA, 22 bp, Homo sapiens
accatggtcggaaaacatgcta

SEQ ID NO: 4591521 - DNA, 15 bp, Homo sapiens
acccaaaaggcagaa

SEQ ID NO: 4591522 - DNA, 18 bp, Homo sapiens
acccaaaaggcagaagca

SEQ ID NO: 4591523 - DNA, 21 bp, Homo sapiens
acccacaagaaatgaaagcag

SEQ ID NO: 4591524 - DNA, 16 bp, Homo sapiens
acccagaagaaaatag

SEQ ID NO: 4591525 - DNA, 16 bp, Homo sapiens
acccagctctactcca

SEQ ID NO: 4591526 - DNA, 23 bp, Homo sapiens
acccaggacttatttaaactctg

SEQ ID NO: 4591527 - DNA, 15 bp, Homo sapiens
acccagtgcccccac

SEQ ID NO: 4591528 - DNA, 20 bp, Homo sapiens
acccatgaggcaatgtcagg

SEQ ID NO: 4591529 - DNA, 23 bp, Homo sapiens
accccagctccctaggagaccaa

SEQ ID NO: 4591530 - DNA, 18 bp, Homo sapiens
acccccttctactgagcc

SEQ ID NO: 4591531 - DNA, 18 bp, Homo sapiens
acccctttctccagccct

SEQ ID NO: 4591532 - DNA, 15 bp, Homo sapiens
acccgggaggcagag

SEQ ID NO: 4591533 - DNA, 17 bp, Homo sapiens
acccgggaggcagaggt

SEQ ID NO: 4591534 - DNA, 20 bp, Homo sapiens
acctaatccaggcagatcca

SEQ ID NO: 4591535 - DNA, 21 bp, Homo sapiens
acctaatccaggcagatccag

SEQ ID NO: 4591536 - DNA, 22 bp, Homo sapiens
acctaatccaggcagatccagg

SEQ ID NO: 4591537 - DNA, 14 bp, Homo sapiens
acctagttttccat

SEQ ID NO: 4591538 - DNA, 17 bp, Homo sapiens
acctcagcctggccaga

SEQ ID NO: 4591539 - DNA, 20 bp, Homo sapiens
acctctgcagcaataaagca

SEQ ID NO: 4591540 - DNA, 16 bp, Homo sapiens
acctgattttttttcc

SEQ ID NO: 4591541 - DNA, 18 bp, Homo sapiens
acctggaacttggggagt

SEQ ID NO: 4591542 - DNA, 22 bp, Homo sapiens
acctggattgtgcctaatgtgt

SEQ ID NO: 4591543 - DNA, 20 bp, Homo sapiens
acctgtaatgacaggcctgt

SEQ ID NO: 4591544 - DNA, 18 bp, Homo sapiens
acctgttacctactttga

SEQ ID NO: 4591545 - DNA, 17 bp, Homo sapiens
accttggcaccagacac

SEQ ID NO: 4591546 - DNA, 22 bp, Homo sapiens
accttggcaccagacacccagg

SEQ ID NO: 4591547 - DNA, 19 bp, Homo sapiens
acctttttatttgcatgtg

SEQ ID NO: 4591548 - DNA, 13 bp, Homo sapiens
accttttttatac

SEQ ID NO: 4591549 - DNA, 14 bp, Homo sapiens
accttttttataca

SEQ ID NO: 4591550 - DNA, 18 bp, Homo sapiens
accttttttatacataaa

SEQ ID NO: 4591551 - DNA, 21 bp, Homo sapiens
acgaaggtaaaaagtattttt

SEQ ID NO: 4591552 - DNA, 11 bp, Homo sapiens
acgactacaga

SEQ ID NO: 4591553 - DNA, 12 bp, Homo sapiens
acgatttctgtt

SEQ ID NO: 4591554 - DNA, 17 bp, Homo sapiens
acgatttctgtttagat

SEQ ID NO: 4591555 - DNA, 19 bp, Homo sapiens
acgatttctgtttagataa

SEQ ID NO: 4591556 - DNA, 20 bp, Homo sapiens
acgatttctgtttagataat

SEQ ID NO: 4591557 - DNA, 19 bp, Homo sapiens
acggacgaaccttgaaaac

SEQ ID NO: 4591558 - DNA, 14 bp, Homo sapiens
acgttgtgcatttg

SEQ ID NO: 4591559 - DNA, 15 bp, Homo sapiens
acgttgtgcatttgg

SEQ ID NO: 4591560 - DNA, 15 bp, Homo sapiens
acgtttctaaaggct

SEQ ID NO: 4591561 - DNA, 20 bp, Homo sapiens
actaaaataattttgtaatg

SEQ ID NO: 4591562 - DNA, 17 bp, Homo sapiens
actaaactaccacctca

SEQ ID NO: 4591563 - DNA, 15 bp, Homo sapiens
actaactatgcatgg

SEQ ID NO: 4591564 - DNA, 19 bp, Homo sapiens
actaatgccttactcttct

SEQ ID NO: 4591565 - DNA, 22 bp, Homo sapiens
actaattttccataagctattt

SEQ ID NO: 4591566 - DNA, 14 bp, Homo sapiens
actacagtttgtta

SEQ ID NO: 4591567 - DNA, 13 bp, Homo sapiens
actacattctgtt

SEQ ID NO: 4591568 - DNA, 20 bp, Homo sapiens
actaccacctcaggtgactt

SEQ ID NO: 4591569 - DNA, 14 bp, Homo sapiens
actacctctgtgcc

SEQ ID NO: 4591570 - DNA, 15 bp, Homo sapiens
actagcccaatgaaa

SEQ ID NO: 4591571 - DNA, 12 bp, Homo sapiens
actatctcccct

SEQ ID NO: 4591572 - DNA, 22 bp, Homo sapiens
actatgcatggtgccccaggac

SEQ ID NO: 4591573 - DNA, 24 bp, Homo sapiens
actatgcatggtgccccaggacca

SEQ ID NO: 4591574 - DNA, 21 bp, Homo sapiens
actcaaactgaggaatttcac

SEQ ID NO: 4591575 - DNA, 17 bp, Homo sapiens
actcaaatggggccaga

SEQ ID NO: 4591576 - DNA, 22 bp, Homo sapiens
actcagaattctctagtttgat

SEQ ID NO: 4591577 - DNA, 18 bp, Homo sapiens
actcagacattggcacct

SEQ ID NO: 4591578 - DNA, 19 bp, Homo sapiens
actcagatccagggacaga

SEQ ID NO: 4591579 - DNA, 13 bp, Homo sapiens
actccaaaatgtt

SEQ ID NO: 4591580 - DNA, 14 bp, Homo sapiens
actccagcctgggc

SEQ ID NO: 4591581 - DNA, 18 bp, Homo sapiens
actccaggcttccacact

SEQ ID NO: 4591582 - DNA, 22 bp, Homo sapiens
actccaggcttccacacttctg

SEQ ID NO: 4591583 - DNA, 23 bp, Homo sapiens
actccaggcttccacacttctgg

SEQ ID NO: 4591584 - DNA, 16 bp, Homo sapiens
actcccattcctgaag

SEQ ID NO: 4591585 - DNA, 20 bp, Homo sapiens
actcccattcctgaagaacc

SEQ ID NO: 4591586 - DNA, 16 bp, Homo sapiens
actctatcaagtatta

SEQ ID NO: 4591587 - DNA, 21 bp, Homo sapiens
actctatcaagtattatacct

SEQ ID NO: 4591588 - DNA, 17 bp, Homo sapiens
actctatgttctaagaa

SEQ ID NO: 4591589 - DNA, 15 bp, Homo sapiens
actctgcttgatttt

SEQ ID NO: 4591590 - DNA, 18 bp, Homo sapiens
actctgcttgatttttgc

SEQ ID NO: 4591591 - DNA, 17 bp, Homo sapiens
actctgggctgctaccc

SEQ ID NO: 4591592 - DNA, 17 bp, Homo sapiens
actctgtctcagtccat

SEQ ID NO: 4591593 - DNA, 20 bp, Homo sapiens
actctgttgcaagtgcaata

SEQ ID NO: 4591594 - DNA, 16 bp, Homo sapiens
actcttcttgaaattt

SEQ ID NO: 4591595 - DNA, 19 bp, Homo sapiens
actgaccactggcctaccc

SEQ ID NO: 4591596 - DNA, 19 bp, Homo sapiens
actgaggaatttcacctgt

SEQ ID NO: 4591597 - DNA, 19 bp, Homo sapiens
actgagtacgttgtgcatt

SEQ ID NO: 4591598 - DNA, 22 bp, Homo sapiens
actgagtacgttgtgcatttgg

SEQ ID NO: 4591599 - DNA, 21 bp, Homo sapiens
actgataaagatgagtgagca

SEQ ID NO: 4591600 - DNA, 14 bp, Homo sapiens
actgatgctgcccc

SEQ ID NO: 4591601 - DNA, 16 bp, Homo sapiens
actgcatactttttaa

SEQ ID NO: 4591602 - DNA, 20 bp, Homo sapiens
actgcttaacttcacatatt

SEQ ID NO: 4591603 - DNA, 12 bp, Homo sapiens
actggaactctc

SEQ ID NO: 4591604 - DNA, 15 bp, Homo sapiens
actggattaaactta

SEQ ID NO: 4591605 - DNA, 21 bp, Homo sapiens
actggcatggatatagtttta

SEQ ID NO: 4591606 - DNA, 18 bp, Homo sapiens
actggttccatggcctct

SEQ ID NO: 4591607 - DNA, 19 bp, Homo sapiens
actgtacatgaaaacacat

SEQ ID NO: 4591608 - DNA, 17 bp, Homo sapiens
actgtgtacataactga

SEQ ID NO: 4591609 - DNA, 18 bp, Homo sapiens
actgtgtacataactgaa

SEQ ID NO: 4591610 - DNA, 21 bp, Homo sapiens
actgtgtattccaagacatgt

SEQ ID NO: 4591611 - DNA, 14 bp, Homo sapiens
acttaaaaatggtt

SEQ ID NO: 4591612 - DNA, 16 bp, Homo sapiens
acttaaataatgtgaa

SEQ ID NO: 4591613 - DNA, 15 bp, Homo sapiens
acttaatctaaatgg

SEQ ID NO: 4591614 - DNA, 22 bp, Homo sapiens
acttaatctaaatggaaccact

SEQ ID NO: 4591615 - DNA, 13 bp, Homo sapiens
acttactgtacat

SEQ ID NO: 4591616 - DNA, 14 bp, Homo sapiens
acttactgtacatg

SEQ ID NO: 4591617 - DNA, 16 bp, Homo sapiens
acttactgtacatgaa

SEQ ID NO: 4591618 - DNA, 21 bp, Homo sapiens
acttattggaactctgcttga

SEQ ID NO: 4591619 - DNA, 22 bp, Homo sapiens
acttcccagttcaggagtccca

SEQ ID NO: 4591620 - DNA, 15 bp, Homo sapiens
agcctggggtctgga

SEQ ID NO: 4591621 - DNA, 16 bp, Homo sapiens
agccttgaactttgac

SEQ ID NO: 4591622 - DNA, 15 bp, Homo sapiens
agccttgccagagat

SEQ ID NO: 4591623 - DNA, 17 bp, Homo sapiens
agccttgccagagatcc

SEQ ID NO: 4591624 - DNA, 15 bp, Homo sapiens
agcgacagtgagact

SEQ ID NO: 4591625 - DNA, 16 bp, Homo sapiens
agctaagaacctggaa

SEQ ID NO: 4591626 - DNA, 17 bp, Homo sapiens
agctaagaacctggaac

SEQ ID NO: 4591627 - DNA, 19 bp, Homo sapiens
agctaaggtttagataaat

SEQ ID NO: 4591628 - DNA, 21 bp, Homo sapiens
agctatttcatctatttttgg

SEQ ID NO: 4591629 - DNA, 17 bp, Homo sapiens
agctcaggacagatgcc

SEQ ID NO: 4591630 - DNA, 12 bp, Homo sapiens
agctcatccctc

SEQ ID NO: 4591631 - DNA, 19 bp, Homo sapiens
agctcatccctctcaccca

SEQ ID NO: 4591632 - DNA, 18 bp, Homo sapiens
agctcattaaactttttt

SEQ ID NO: 4591633 - DNA, 21 bp, Homo sapiens
agctcattaaacttttttaac

SEQ ID NO: 4591634 - DNA, 14 bp, Homo sapiens
agctccaacctgca

SEQ ID NO: 4591635 - DNA, 15 bp, Homo sapiens
agctccaacctgcaa

SEQ ID NO: 4591636 - DNA, 16 bp, Homo sapiens
agctccaacctgcaaa

SEQ ID NO: 4591637 - DNA, 18 bp, Homo sapiens
agctccaacctgcaaaga

SEQ ID NO: 4591638 - DNA, 15 bp, Homo sapiens
agctccctaggagac

SEQ ID NO: 4591639 - DNA, 20 bp, Homo sapiens
agctcctctccccagcccag

SEQ ID NO: 4591640 - DNA, 23 bp, Homo sapiens
agctcctctccccagcccagaga

SEQ ID NO: 4591641 - DNA, 20 bp, Homo sapiens
agctgcactgatgctgcccc

SEQ ID NO: 4591642 - DNA, 16 bp, Homo sapiens
agctgtcaaggctcag

SEQ ID NO: 4591643 - DNA, 22 bp, Homo sapiens
agctttttattcctcctgctca

SEQ ID NO: 4591644 - DNA, 14 bp, Homo sapiens
aggaacagaaggat

SEQ ID NO: 4591645 - DNA, 21 bp, Homo sapiens
aggaacttaaataatgtgaaa

SEQ ID NO: 4591646 - DNA, 18 bp, Homo sapiens
aggaatttcacctgtaaa

SEQ ID NO: 4591647 - DNA, 22 bp, Homo sapiens
aggaatttcacctgtaaacctg

SEQ ID NO: 4591648 - DNA, 18 bp, Homo sapiens
aggaatttcccaggaccc

SEQ ID NO: 4591649 - DNA, 20 bp, Homo sapiens
aggaatttcccaggaccctg

SEQ ID NO: 4591650 - DNA, 15 bp, Homo sapiens
aggaccctgaagggg

SEQ ID NO: 4591651 - DNA, 21 bp, Homo sapiens
aggacttcctgtccagctcca

SEQ ID NO: 4591652 - DNA, 11 bp, Homo sapiens
aggagaagcca

SEQ ID NO: 4591653 - DNA, 13 bp, Homo sapiens
aggagaagccagg

SEQ ID NO: 4591654 - DNA, 15 bp, Homo sapiens
aggagaagccaggaa

SEQ ID NO: 4591655 - DNA, 17 bp, Homo sapiens
aggagaccaaggcggga

SEQ ID NO: 4591656 - DNA, 20 bp, Homo sapiens
aggagctggggatccctccc

SEQ ID NO: 4591657 - DNA, 20 bp, Homo sapiens
aggaggattgcttgagccca

SEQ ID NO: 4591658 - DNA, 16 bp, Homo sapiens
aggaggccaggccacc

SEQ ID NO: 4591659 - DNA, 17 bp, Homo sapiens
aggaggctgaggcagga

SEQ ID NO: 4591660 - DNA, 19 bp, Homo sapiens
aggaggctgaggcaggagg

SEQ ID NO: 4591661 - DNA, 16 bp, Homo sapiens
aggaggggctgtaaaa

SEQ ID NO: 4591662 - DNA, 23 bp, Homo sapiens
aggatagaagtatacctgatttt

SEQ ID NO: 4591663 - DNA, 15 bp, Homo sapiens
aggatagatgctggc

SEQ ID NO: 4591664 - DNA, 18 bp, Homo sapiens
aggatagatgctggccca

SEQ ID NO: 4591665 - DNA, 19 bp, Homo sapiens
aggatagatgctggcccag

SEQ ID NO: 4591666 - DNA, 21 bp, Homo sapiens
aggatatcggcatttgtttct

SEQ ID NO: 4591667 - DNA, 18 bp, Homo sapiens
aggatcctggagaagtgg

SEQ ID NO: 4591668 - DNA, 17 bp, Homo sapiens
aggatgttgaaaaagtt

SEQ ID NO: 4591669 - DNA, 20 bp, Homo sapiens
aggattgcttgagcccagga

SEQ ID NO: 4591670 - DNA, 16 bp, Homo sapiens
aggcaaccaataaaag

SEQ ID NO: 4591671 - DNA, 20 bp, Homo sapiens
aggcaaccaataaaagccag

SEQ ID NO: 4591672 - DNA, 19 bp, Homo sapiens
aggcaatgtcaggaacaga

SEQ ID NO: 4591673 - DNA, 22 bp, Homo sapiens
aggcaatgtcaggaacagaagg

SEQ ID NO: 4591674 - DNA, 17 bp, Homo sapiens
aggcagatccaggacta

SEQ ID NO: 4591675 - DNA, 15 bp, Homo sapiens
aggccaccctgcctc

SEQ ID NO: 4591676 - DNA, 15 bp, Homo sapiens
aggccatggcagaat

SEQ ID NO: 4591677 - DNA, 13 bp, Homo sapiens
aggccccagcctc

SEQ ID NO: 4591678 - DNA, 14 bp, Homo sapiens
aggccccagcctcc

SEQ ID NO: 4591679 - DNA, 13 bp, Homo sapiens
aggctacctttgt

SEQ ID NO: 4591680 - DNA, 17 bp, Homo sapiens
aggctgaggcaggagga

SEQ ID NO: 4591681 - DNA, 23 bp, Homo sapiens
aggctgagggtcgtgggaaaggg

SEQ ID NO: 4591682 - DNA, 13 bp, Homo sapiens
agggaaagccagc

SEQ ID NO: 4591683 - DNA, 14 bp, Homo sapiens
agggaaagccagcc

SEQ ID NO: 4591684 - DNA, 15 bp, Homo sapiens
agggaaagccagcct

SEQ ID NO: 4591685 - DNA, 13 bp, Homo sapiens
agggagaagctcc

SEQ ID NO: 4591686 - DNA, 18 bp, Homo sapiens
agggagaagggatggagg

SEQ ID NO: 4591687 - DNA, 13 bp, Homo sapiens
agggcccagagcc

SEQ ID NO: 4591688 - DNA, 15 bp, Homo sapiens
agggcccagagccca

SEQ ID NO: 4591689 - DNA, 16 bp, Homo sapiens
agggcccagagcccag

SEQ ID NO: 4591690 - DNA, 20 bp, Homo sapiens
agggcccagagcccagctcc

SEQ ID NO: 4591691 - DNA, 17 bp, Homo sapiens
aggggagcccactgtcc

SEQ ID NO: 4591692 - DNA, 21 bp, Homo sapiens
aggggagcccactgtcctggg

SEQ ID NO: 4591693 - DNA, 24 bp, Homo sapiens
aggggagcccactgtcctgggcct

SEQ ID NO: 4591694 - DNA, 21 bp, Homo sapiens
aggggagtaggtgggggaaca

SEQ ID NO: 4591695 - DNA, 23 bp, Homo sapiens
aggggctggggccaaataaagtc

SEQ ID NO: 4591696 - DNA, 16 bp, Homo sapiens
agggggccttgctgga

SEQ ID NO: 4591697 - DNA, 15 bp, Homo sapiens
agggtcgtgggaaag

SEQ ID NO: 4591698 - DNA, 16 bp, Homo sapiens
aggtcagcatgtctat

SEQ ID NO: 4591699 - DNA, 23 bp, Homo sapiens
aggtcattttttttaagaaaaag

SEQ ID NO: 4591700 - DNA, 12 bp, Homo sapiens
aggtcccaggca

SEQ ID NO: 4591701 - DNA, 14 bp, Homo sapiens
aggtcccaggcaga

SEQ ID NO: 4591702 - DNA, 15 bp, Homo sapiens
aggtctgttctttcc

SEQ ID NO: 4591703 - DNA, 16 bp, Homo sapiens
aggtgctgacggccag

SEQ ID NO: 4591704 - DNA, 20 bp, Homo sapiens
aggtgctgacggccagggag

SEQ ID NO: 4591705 - DNA, 23 bp, Homo sapiens
aggtgggggaacactgagaaaga

SEQ ID NO: 4591706 - DNA, 14 bp, Homo sapiens
aggttgcagtgagc

SEQ ID NO: 4591707 - DNA, 19 bp, Homo sapiens
aggtttcacttgcacatca

SEQ ID NO: 4591708 - DNA, 20 bp, Homo sapiens
agtaaatgggggtgcatttg

SEQ ID NO: 4591709 - DNA, 17 bp, Homo sapiens
agtaatatgcacacatt

SEQ ID NO: 4591710 - DNA, 23 bp, Homo sapiens
agtaccatttaatggggaggaca

SEQ ID NO: 4591711 - DNA, 17 bp, Homo sapiens
agtatgaggcatttgtt

SEQ ID NO: 4591712 - DNA, 21 bp, Homo sapiens
agtattttcctgttgtcaaga

SEQ ID NO: 4591713 - DNA, 14 bp, Homo sapiens
agtattttttcaag

SEQ ID NO: 4591714 - DNA, 14 bp, Homo sapiens
agtcatgaagccca

SEQ ID NO: 4591715 - DNA, 17 bp, Homo sapiens
agtcatggtggccacgg

SEQ ID NO: 4591716 - DNA, 12 bp, Homo sapiens
agtcattatgtt

SEQ ID NO: 4591717 - DNA, 17 bp, Homo sapiens
agtcctagccactcagg

SEQ ID NO: 4591718 - DNA, 14 bp, Homo sapiens
agtcctggaagcca

SEQ ID NO: 4591719 - DNA, 23 bp, Homo sapiens
agtcctggaagccagctttccct

SEQ ID NO: 4591720 - DNA, 14 bp, Homo sapiens
agtctgaattctgc

SEQ ID NO: 4591721 - DNA, 16 bp, Homo sapiens
agtctgaatttttaaa

SEQ ID NO: 4591722 - DNA, 16 bp, Homo sapiens
agtctgttgattaaag

SEQ ID NO: 4591723 - DNA, 16 bp, Homo sapiens
agtcttcctgacactt

SEQ ID NO: 4591724 - DNA, 18 bp, Homo sapiens
agtcttcctgacacttta

SEQ ID NO: 4591725 - DNA, 19 bp, Homo sapiens
agtcttcctgacactttaa

SEQ ID NO: 4591726 - DNA, 14 bp, Homo sapiens
agtgaaaatatagc

SEQ ID NO: 4591727 - DNA, 21 bp, Homo sapiens
agtgaacaaatttacagagac

SEQ ID NO: 4591728 - DNA, 22 bp, Homo sapiens
agtgaacaaatttacagagaca

SEQ ID NO: 4591729 - DNA, 13 bp, Homo sapiens
agtgattaccagg

SEQ ID NO: 4591730 - DNA, 15 bp, Homo sapiens
agtgattaccaggga

SEQ ID NO: 4591731 - DNA, 17 bp, Homo sapiens
agtgctgcatttaaaag

SEQ ID NO: 4591732 - DNA, 23 bp, Homo sapiens
agtggccaagatcacagtggcca

SEQ ID NO: 4591733 - DNA, 14 bp, Homo sapiens
agtggctcaacatt

SEQ ID NO: 4591734 - DNA, 16 bp, Homo sapiens
agtgggctttgcaagc

SEQ ID NO: 4591735 - DNA, 15 bp, Homo sapiens
agtgggtggggacag

SEQ ID NO: 4591736 - DNA, 17 bp, Homo sapiens
agtgggtggggacagac

SEQ ID NO: 4591737 - DNA, 17 bp, Homo sapiens
agtgtatttttttacta

SEQ ID NO: 4591738 - DNA, 19 bp, Homo sapiens
agtgtgtggtcaacatttc

SEQ ID NO: 4591739 - DNA, 20 bp, Homo sapiens
agttaaactgtattttatgt

SEQ ID NO: 4591740 - DNA, 16 bp, Homo sapiens
agttaagacctggcag

SEQ ID NO: 4591741 - DNA, 20 bp, Homo sapiens
agttagtggattactgccat

SEQ ID NO: 4591742 - DNA, 17 bp, Homo sapiens
agttagttccactgaga

SEQ ID NO: 4591743 - DNA, 18 bp, Homo sapiens
agttcaaattcttctgaa

SEQ ID NO: 4591744 - DNA, 24 bp, Homo sapiens
agttcaatctggattcatatttaa

SEQ ID NO: 4591745 - DNA, 19 bp, Homo sapiens
agttcaggagtcccaagga

SEQ ID NO: 4591746 - DNA, 21 bp, Homo sapiens
agttctgcagataaacagtag

SEQ ID NO: 4591747 - DNA, 15 bp, Homo sapiens
agttgatctggaacc

SEQ ID NO: 4591748 - DNA, 20 bp, Homo sapiens
agttgatctggaacccagac

SEQ ID NO: 4591749 - DNA, 21 bp, Homo sapiens
agttgatctggaacccagact

SEQ ID NO: 4591750 - DNA, 18 bp, Homo sapiens
agttggagggaaagccag

SEQ ID NO: 4591751 - DNA, 22 bp, Homo sapiens
agttggagggaaagccagcctg

SEQ ID NO: 4591752 - DNA, 15 bp, Homo sapiens
agttgttacattttt

SEQ ID NO: 4591753 - DNA, 19 bp, Homo sapiens
agttgttacatttttaagt

SEQ ID NO: 4591754 - DNA, 22 bp, Homo sapiens
agttgttacatttttaagtgct

SEQ ID NO: 4591755 - DNA, 12 bp, Homo sapiens
agtttcctgaaa

SEQ ID NO: 4591756 - DNA, 20 bp, Homo sapiens
agtttctgtcgttaaaaaca

SEQ ID NO: 4591757 - DNA, 22 bp, Homo sapiens
agtttctgtcgttaaaaacaga

SEQ ID NO: 4591758 - DNA, 23 bp, Homo sapiens
agtttgattaaattcttgcaaag

SEQ ID NO: 4591759 - DNA, 19 bp, Homo sapiens
agtttgctttgtttaagca

SEQ ID NO: 4591760 - DNA, 19 bp, Homo sapiens
agttttacttttaaactgt

SEQ ID NO: 4591761 - DNA, 12 bp, Homo sapiens
ataaaaatgttt

SEQ ID NO: 4591762 - DNA, 14 bp, Homo sapiens
ataaaatgtcttct

SEQ ID NO: 4591763 - DNA, 22 bp, Homo sapiens
ataaacaagaccacgtttctaa

SEQ ID NO: 4591764 - DNA, 13 bp, Homo sapiens
ataaactttacct

SEQ ID NO: 4591765 - DNA, 15 bp, Homo sapiens
ataaactttaccttt

SEQ ID NO: 4591766 - DNA, 16 bp, Homo sapiens
ataaactttacctttt

SEQ ID NO: 4591767 - DNA, 14 bp, Homo sapiens
ataaagcagcgttt

SEQ ID NO: 4591768 - DNA, 20 bp, Homo sapiens
ataaagcagcgtttctatga

SEQ ID NO: 4591769 - DNA, 15 bp, Homo sapiens
ataaatagtttatga

SEQ ID NO: 4591770 - DNA, 19 bp, Homo sapiens
ataaatctgacccagtgcc

SEQ ID NO: 4591771 - DNA, 20 bp, Homo sapiens
ataaccagtgttgtggattt

SEQ ID NO: 4591772 - DNA, 13 bp, Homo sapiens
ataactgaaaatg

SEQ ID NO: 4591773 - DNA, 19 bp, Homo sapiens
ataagaaaaatattaataa

SEQ ID NO: 4591774 - DNA, 21 bp, Homo sapiens
ataagccagacatcaacagat

SEQ ID NO: 4591775 - DNA, 12 bp, Homo sapiens
ataagctatttt

SEQ ID NO: 4591776 - DNA, 14 bp, Homo sapiens
ataataaagaatag

SEQ ID NO: 4591777 - DNA, 14 bp, Homo sapiens
ataatcttctgcct

SEQ ID NO: 4591778 - DNA, 13 bp, Homo sapiens
ataatctttgggt

SEQ ID NO: 4591779 - DNA, 13 bp, Homo sapiens
ataattttgtaat

SEQ ID NO: 4591780 - DNA, 22 bp, Homo sapiens
atacaaaaaaaaaaaaaaatta

SEQ ID NO: 4591781 - DNA, 15 bp, Homo sapiens
atacaaaagcatgtg

SEQ ID NO: 4591782 - DNA, 20 bp, Homo sapiens
atacataaacaagaccacgt

SEQ ID NO: 4591783 - DNA, 16 bp, Homo sapiens
atacatttaaaacatt

SEQ ID NO: 4591784 - DNA, 17 bp, Homo sapiens
ataccagccagtaaatg

SEQ ID NO: 4591785 - DNA, 20 bp, Homo sapiens
atacctgattttttttcctt

SEQ ID NO: 4591786 - DNA, 13 bp, Homo sapiens
atactaaccagca

SEQ ID NO: 4591787 - DNA, 22 bp, Homo sapiens
atactaattttccataagctat

SEQ ID NO: 4591788 - DNA, 20 bp, Homo sapiens
atactgccttgtttaatggt

SEQ ID NO: 4591789 - DNA, 17 bp, Homo sapiens
atacttgaagggccaga

SEQ ID NO: 4591790 - DNA, 19 bp, Homo sapiens
atacttgaagggccagagc

SEQ ID NO: 4591791 - DNA, 16 bp, Homo sapiens
atagacaatttattat

SEQ ID NO: 4591792 - DNA, 22 bp, Homo sapiens
ataggaattgacccacaagaaa

SEQ ID NO: 4591793 - DNA, 22 bp, Homo sapiens
atagttttacttttaaactgtg

SEQ ID NO: 4591794 - DNA, 18 bp, Homo sapiens
atatagttttacttttaa

SEQ ID NO: 4591795 - DNA, 23 bp, Homo sapiens
atatagttttacttttaaactgt

SEQ ID NO: 4591796 - DNA, 13 bp, Homo sapiens
atatataaccagt

SEQ ID NO: 4591797 - DNA, 21 bp, Homo sapiens
atatccatgacctagttttcc

SEQ ID NO: 4591798 - DNA, 20 bp, Homo sapiens
atatcccttggacattttat

SEQ ID NO: 4591799 - DNA, 22 bp, Homo sapiens
atatcccttggacattttatgt

SEQ ID NO: 4591800 - DNA, 20 bp, Homo sapiens
atatgaacatattgttgaaa

SEQ ID NO: 4591801 - DNA, 13 bp, Homo sapiens
atatgcacacatt

SEQ ID NO: 4591802 - DNA, 22 bp, Homo sapiens
atatgtaaatggtatgtcattc

SEQ ID NO: 4591803 - DNA, 19 bp, Homo sapiens
atattaccacagacatact

SEQ ID NO: 4591804 - DNA, 17 bp, Homo sapiens
atattcattctttttga

SEQ ID NO: 4591805 - DNA, 20 bp, Homo sapiens
atattgcatcatagtttgct

SEQ ID NO: 4591806 - DNA, 17 bp, Homo sapiens
atattgtgattctgcct

SEQ ID NO: 4591807 - DNA, 19 bp, Homo sapiens
atattgtgattctgccttt

SEQ ID NO: 4591808 - DNA, 20 bp, Homo sapiens
atatttagatgtaattttgt

SEQ ID NO: 4591809 - DNA, 22 bp, Homo sapiens
atatttagatgtaattttgtgt

SEQ ID NO: 4591810 - DNA, 15 bp, Homo sapiens
atatttttatcttta

SEQ ID NO: 4591811 - DNA, 22 bp, Homo sapiens
atatttttatctttatatgaag

SEQ ID NO: 4591812 - DNA, 18 bp, Homo sapiens
atattttttgttaaatga

SEQ ID NO: 4591813 - DNA, 13 bp, Homo sapiens
atcaactgaatga

SEQ ID NO: 4591814 - DNA, 23 bp, Homo sapiens
atcagaactcaaatggggccaga

SEQ ID NO: 4591815 - DNA, 13 bp, Homo sapiens
atcagcacgattt

SEQ ID NO: 4591816 - DNA, 15 bp, Homo sapiens
atcagcacgatttct

SEQ ID NO: 4591817 - DNA, 18 bp, Homo sapiens
atcagcacgatttctgtt

SEQ ID NO: 4591818 - DNA, 23 bp, Homo sapiens
atcagcacgatttctgtttagat

SEQ ID NO: 4591819 - DNA, 16 bp, Homo sapiens
atcattaggtgtgact

SEQ ID NO: 4591820 - DNA, 22 bp, Homo sapiens
atccaaaagaagcccccagcta

SEQ ID NO: 4591821 - DNA, 20 bp, Homo sapiens
atccaactaatgccttactc

SEQ ID NO: 4591822 - DNA, 22 bp, Homo sapiens
atccaggcagatccaggactat

SEQ ID NO: 4591823 - DNA, 19 bp, Homo sapiens
atccagggacagaggcccc

SEQ ID NO: 4591824 - DNA, 21 bp, Homo sapiens
atccatgacctagttttccat

SEQ ID NO: 4591825 - DNA, 15 bp, Homo sapiens
atccctactgtaatt

SEQ ID NO: 4591826 - DNA, 13 bp, Homo sapiens
atcctgcccctga

SEQ ID NO: 4591827 - DNA, 14 bp, Homo sapiens
atcctggaggccca

SEQ ID NO: 4591828 - DNA, 15 bp, Homo sapiens
atcctggaggcccag

SEQ ID NO: 4591829 - DNA, 20 bp, Homo sapiens
atcctggaggcccagttcac

SEQ ID NO: 4591830 - DNA, 21 bp, Homo sapiens
atcctgtctttaaggaaaaaa

SEQ ID NO: 4591831 - DNA, 13 bp, Homo sapiens
atctaaatggaac

SEQ ID NO: 4591832 - DNA, 17 bp, Homo sapiens
atctaaatggaaccact

SEQ ID NO: 4591833 - DNA, 18 bp, Homo sapiens
atctacactccagtgaga

SEQ ID NO: 4591834 - DNA, 13 bp, Homo sapiens
atctccaaaataa

SEQ ID NO: 4591835 - DNA, 17 bp, Homo sapiens
atctccaaaataaaact

SEQ ID NO: 4591836 - DNA, 21 bp, Homo sapiens
atctccaaaataaaacttttt

SEQ ID NO: 4591837 - DNA, 21 bp, Homo sapiens
atctcccttttccatgactgt

SEQ ID NO: 4591838 - DNA, 14 bp, Homo sapiens
atctctctgcccaa

SEQ ID NO: 4591839 - DNA, 12 bp, Homo sapiens
atctgacccagt

SEQ ID NO: 4591840 - DNA, 14 bp, Homo sapiens
atctggaacccaga

SEQ ID NO: 4591841 - DNA, 15 bp, Homo sapiens
atctggaacccagac

SEQ ID NO: 4591842 - DNA, 17 bp, Homo sapiens
atctggaacccagactc

SEQ ID NO: 4591843 - DNA, 17 bp, Homo sapiens
atctgtaaactgtgtat

SEQ ID NO: 4591844 - DNA, 22 bp, Homo sapiens
atctgtaaactgtgtattccaa

SEQ ID NO: 4591845 - DNA, 16 bp, Homo sapiens
atctgtcctcagcctt

SEQ ID NO: 4591846 - DNA, 16 bp, Homo sapiens
atcttattttcatgta

SEQ ID NO: 4591847 - DNA, 16 bp, Homo sapiens
atcttctgccttctca

SEQ ID NO: 4591848 - DNA, 15 bp, Homo sapiens
atgaaaacacatttt

SEQ ID NO: 4591849 - DNA, 21 bp, Homo sapiens
atgaacatattgttgaaaggt

SEQ ID NO: 4591850 - DNA, 15 bp, Homo sapiens
atgaagcccaagtga

SEQ ID NO: 4591851 - DNA, 16 bp, Homo sapiens
atgaagttgattcata

SEQ ID NO: 4591852 - DNA, 21 bp, Homo sapiens
atgaagttgattcatattgca

SEQ ID NO: 4591853 - DNA, 23 bp, Homo sapiens
atgaagttgattcatattgcatc

SEQ ID NO: 4591854 - DNA, 19 bp, Homo sapiens
atgaatgaggtcccaggca

SEQ ID NO: 4591855 - DNA, 20 bp, Homo sapiens
atgaatgaggtcccaggcag

SEQ ID NO: 4591856 - DNA, 14 bp, Homo sapiens
atgaattaaagtgg

SEQ ID NO: 4591857 - DNA, 22 bp, Homo sapiens
atgacacatgcaaggtcatttt

SEQ ID NO: 4591858 - DNA, 16 bp, Homo sapiens
atgacttactgtacat

SEQ ID NO: 4591859 - DNA, 21 bp, Homo sapiens
atgagctttgtctacttcaaa

SEQ ID NO: 4591860 - DNA, 13 bp, Homo sapiens
atgaggcatttgt

SEQ ID NO: 4591861 - DNA, 16 bp, Homo sapiens
atgaggtcccaggcag

SEQ ID NO: 4591862 - DNA, 18 bp, Homo sapiens
atgaggtcccaggcagag

SEQ ID NO: 4591863 - DNA, 17 bp, Homo sapiens
atgatatgcttgtaact

SEQ ID NO: 4591864 - DNA, 17 bp, Homo sapiens
atgatggttttaaactt

SEQ ID NO: 4591865 - DNA, 17 bp, Homo sapiens
atgatttaatttgaaat

SEQ ID NO: 4591866 - DNA, 18 bp, Homo sapiens
atgcaaggaaggaaagaa

SEQ ID NO: 4591867 - DNA, 14 bp, Homo sapiens
atgcaaggtcattt

SEQ ID NO: 4591868 - DNA, 16 bp, Homo sapiens
atgcaaggtcattttt

SEQ ID NO: 4591869 - DNA, 22 bp, Homo sapiens
atgcaaggtcattttttttaag

SEQ ID NO: 4591870 - DNA, 13 bp, Homo sapiens
atgcacacatttt

SEQ ID NO: 4591871 - DNA, 16 bp, Homo sapiens
atgcacagagttgtta

SEQ ID NO: 4591872 - DNA, 18 bp, Homo sapiens
atgcacagagttgttaca

SEQ ID NO: 4591873 - DNA, 21 bp, Homo sapiens
atgcacagagttgttacattt

SEQ ID NO: 4591874 - DNA, 16 bp, Homo sapiens
atgcatgaagtaatat

SEQ ID NO: 4591875 - DNA, 20 bp, Homo sapiens
atgcatgaagtaatatgcac

SEQ ID NO: 4591876 - DNA, 18 bp, Homo sapiens
atgcatggtgccccagga

SEQ ID NO: 4591877 - DNA, 16 bp, Homo sapiens
atgcatgtcctgtaaa

SEQ ID NO: 4591878 - DNA, 17 bp, Homo sapiens
atgcatgtcctgtaaag

SEQ ID NO: 4591879 - DNA, 10 bp, Homo sapiens
atgcatttga

SEQ ID NO: 4591880 - DNA, 17 bp, Homo sapiens
atgccactaaattgaca

SEQ ID NO: 4591881 - DNA, 18 bp, Homo sapiens
atgccttactcttcttga

SEQ ID NO: 4591882 - DNA, 16 bp, Homo sapiens
atgcgtgtttctgact

SEQ ID NO: 4591883 - DNA, 12 bp, Homo sapiens
atgctatttctg

SEQ ID NO: 4591884 - DNA, 13 bp, Homo sapiens
atgctccagcact

SEQ ID NO: 4591885 - DNA, 15 bp, Homo sapiens
atgctccagcactca

SEQ ID NO: 4591886 - DNA, 20 bp, Homo sapiens
atgctggcccagggcccaga

SEQ ID NO: 4591887 - DNA, 21 bp, Homo sapiens
atgctggcccagggcccagag

SEQ ID NO: 4591888 - DNA, 22 bp, Homo sapiens
atgctgtgccctaaagtgtatt

SEQ ID NO: 4591889 - DNA, 13 bp, Homo sapiens
atgcttactgata

SEQ ID NO: 4591890 - DNA, 23 bp, Homo sapiens
atgcttagtccctcatgcaaatc

SEQ ID NO: 4591891 - DNA, 14 bp, Homo sapiens
atgcttgtacataa

SEQ ID NO: 4591892 - DNA, 16 bp, Homo sapiens
atgcttgtacataatg

SEQ ID NO: 4591893 - DNA, 15 bp, Homo sapiens
atggaattggacata

SEQ ID NO: 4591894 - DNA, 19 bp, Homo sapiens
atggatgggggaactcaga

SEQ ID NO: 4591895 - DNA, 14 bp, Homo sapiens
atggcaacagatct

SEQ ID NO: 4591896 - DNA, 16 bp, Homo sapiens
atggcaacagatctgg

SEQ ID NO: 4591897 - DNA, 17 bp, Homo sapiens
atggcacatcagcacga

SEQ ID NO: 4591898 - DNA, 22 bp, Homo sapiens
atggccatggagtgtacaagta

SEQ ID NO: 4591899 - DNA, 17 bp, Homo sapiens
atggcttttgtgcatta

SEQ ID NO: 4591900 - DNA, 18 bp, Homo sapiens
atggcttttgtgcattat

SEQ ID NO: 4591901 - DNA, 15 bp, Homo sapiens
atggtagttttacag

SEQ ID NO: 4591902 - DNA, 22 bp, Homo sapiens
atggtagttttacagtgtttct

SEQ ID NO: 4591903 - DNA, 16 bp, Homo sapiens
atggtcgcccaggaga

SEQ ID NO: 4591904 - DNA, 15 bp, Homo sapiens
atggtcggaaaacat

SEQ ID NO: 4591905 - DNA, 18 bp, Homo sapiens
atggtgccccaggaccag

SEQ ID NO: 4591906 - DNA, 19 bp, Homo sapiens
atggtgccccaggaccagc

SEQ ID NO: 4591907 - DNA, 20 bp, Homo sapiens
atggtgccccaggaccagct

SEQ ID NO: 4591908 - DNA, 21 bp, Homo sapiens
atggtgccccaggaccagctc

SEQ ID NO: 4591909 - DNA, 23 bp, Homo sapiens
atgtaattttgtgtaagaaatac

SEQ ID NO: 4591910 - DNA, 12 bp, Homo sapiens
atgtagaggaga

SEQ ID NO: 4591911 - DNA, 17 bp, Homo sapiens
atgtagaggagaaactg

SEQ ID NO: 4591912 - DNA, 19 bp, Homo sapiens
atgtagaggagaaactgga

SEQ ID NO: 4591913 - DNA, 16 bp, Homo sapiens
atgtagtataaagaaa

SEQ ID NO: 4591914 - DNA, 19 bp, Homo sapiens
atgtagtataaagaaaagt

SEQ ID NO: 4591915 - DNA, 15 bp, Homo sapiens
atgtcaggaacagaa

SEQ ID NO: 4591916 - DNA, 17 bp, Homo sapiens
atgtcagttgttattta

SEQ ID NO: 4591917 - DNA, 13 bp, Homo sapiens
atgtcctgtaaag

SEQ ID NO: 4591918 - DNA, 15 bp, Homo sapiens
atgtctattcagctt

SEQ ID NO: 4591919 - DNA, 22 bp, Homo sapiens
atgtgaaactggattaaactta

SEQ ID NO: 4591920 - DNA, 14 bp, Homo sapiens
atgtgagactggtt

SEQ ID NO: 4591921 - DNA, 18 bp, Homo sapiens
atgtgctatactgcatac

SEQ ID NO: 4591922 - DNA, 22 bp, Homo sapiens
atgttaatattttaggtgtaaa

SEQ ID NO: 4591923 - DNA, 20 bp, Homo sapiens
atgttctccagtcattatgt

SEQ ID NO: 4591924 - DNA, 14 bp, Homo sapiens
atgttcttaattct

SEQ ID NO: 4591925 - DNA, 15 bp, Homo sapiens
atgttcttaattctt

SEQ ID NO: 4591926 - DNA, 22 bp, Homo sapiens
atgtttacaggtggacacacaa

SEQ ID NO: 4591927 - DNA, 18 bp, Homo sapiens
atgtttatgcaaggaagg

SEQ ID NO: 4591928 - DNA, 15 bp, Homo sapiens
attaaaaatctcaaa

SEQ ID NO: 4591929 - DNA, 20 bp, Homo sapiens
attaaaaatctcaaatttct

SEQ ID NO: 4591930 - DNA, 13 bp, Homo sapiens
attaaaatataat

SEQ ID NO: 4591931 - DNA, 12 bp, Homo sapiens
attaaacttttt

SEQ ID NO: 4591932 - DNA, 13 bp, Homo sapiens
attaaattcttgc

SEQ ID NO: 4591933 - DNA, 14 bp, Homo sapiens
attaaattcttgca

SEQ ID NO: 4591934 - DNA, 20 bp, Homo sapiens
attaaattcttgcaaagtat

SEQ ID NO: 4591935 - DNA, 19 bp, Homo sapiens
attaccacagacatactaa

SEQ ID NO: 4591936 - DNA, 13 bp, Homo sapiens
attactgccattc

SEQ ID NO: 4591937 - DNA, 15 bp, Homo sapiens
attactggtccaaaa

SEQ ID NO: 4591938 - DNA, 16 bp, Homo sapiens
attaggtgtgactgaa

SEQ ID NO: 4591939 - DNA, 16 bp, Homo sapiens
attatattcattcttt

SEQ ID NO: 4591940 - DNA, 13 bp, Homo sapiens
attatgttaatat

SEQ ID NO: 4591941 - DNA, 17 bp, Homo sapiens
attattgatgttttcat

SEQ ID NO: 4591942 - DNA, 14 bp, Homo sapiens
attcaatctgtaaa

SEQ ID NO: 4591943 - DNA, 18 bp, Homo sapiens
attcaatctgtaaactgt

SEQ ID NO: 4591944 - DNA, 19 bp, Homo sapiens
attcacaagacccaaaagg

SEQ ID NO: 4591945 - DNA, 22 bp, Homo sapiens
attcatagcagcttattcacaa

SEQ ID NO: 4591946 - DNA, 16 bp, Homo sapiens
attcatattgcatcat

SEQ ID NO: 4591947 - DNA, 14 bp, Homo sapiens
attcattagttttg

SEQ ID NO: 4591948 - DNA, 15 bp, Homo sapiens
attcattctttttga

SEQ ID NO: 4591949 - DNA, 16 bp, Homo sapiens
attcctcctgctcata

SEQ ID NO: 4591950 - DNA, 20 bp, Homo sapiens
attcctcctgctcatattgt

SEQ ID NO: 4591951 - DNA, 15 bp, Homo sapiens
attctatgttaatat

SEQ ID NO: 4591952 - DNA, 17 bp, Homo sapiens
attctctagtttgatta

SEQ ID NO: 4591953 - DNA, 18 bp, Homo sapiens
attctctagtttgattaa

SEQ ID NO: 4591954 - DNA, 20 bp, Homo sapiens
attctctagtttgattaaat

SEQ ID NO: 4591955 - DNA, 19 bp, Homo sapiens
attctctcctgtacctctt

SEQ ID NO: 4591956 - DNA, 19 bp, Homo sapiens
attctgctctaaataaaga

SEQ ID NO: 4591957 - DNA, 16 bp, Homo sapiens
attcttgcaaagtatc

SEQ ID NO: 4591958 - DNA, 16 bp, Homo sapiens
attctttttgaaatgt

SEQ ID NO: 4591959 - DNA, 13 bp, Homo sapiens
attgaattatctt

SEQ ID NO: 4591960 - DNA, 18 bp, Homo sapiens
attgacacagtaccattt

SEQ ID NO: 4591961 - DNA, 20 bp, Homo sapiens
attgacacttaaaaatggtt

SEQ ID NO: 4591962 - DNA, 13 bp, Homo sapiens
attgctgaaattt

SEQ ID NO: 4591963 - DNA, 22 bp, Homo sapiens
attggctagaggttcaaagata

SEQ ID NO: 4591964 - DNA, 19 bp, Homo sapiens
attggtgtaaggtactttc

SEQ ID NO: 4591965 - DNA, 19 bp, Homo sapiens
attgtaaaagcattttgta

SEQ ID NO: 4591966 - DNA, 23 bp, Homo sapiens
attgtaaaagcattttgtaataa

SEQ ID NO: 4591967 - DNA, 13 bp, Homo sapiens
attgtgcccctgc

SEQ ID NO: 4591968 - DNA, 19 bp, Homo sapiens
atttaaaacattaaaatat

SEQ ID NO: 4591969 - DNA, 16 bp, Homo sapiens
atttaaaagatacagt

SEQ ID NO: 4591970 - DNA, 12 bp, Homo sapiens
atttaacagaaa

SEQ ID NO: 4591971 - DNA, 14 bp, Homo sapiens
atttaacagaaatg

SEQ ID NO: 4591972 - DNA, 16 bp, Homo sapiens
atttaacagaaatgta

SEQ ID NO: 4591973 - DNA, 19 bp, Homo sapiens
atttaatactaattttcca

SEQ ID NO: 4591974 - DNA, 23 bp, Homo sapiens
atttatagctgtaggttttctgt

SEQ ID NO: 4591975 - DNA, 13 bp, Homo sapiens
atttattatggca

SEQ ID NO: 4591976 - DNA, 14 bp, Homo sapiens
atttcacctgtaaa

SEQ ID NO: 4591977 - DNA, 12 bp, Homo sapiens
atttcagactcc

SEQ ID NO: 4591978 - DNA, 18 bp, Homo sapiens
atttcccaacacaaagat

SEQ ID NO: 4591979 - DNA, 19 bp, Homo sapiens
atttcccaacacaaagatt

SEQ ID NO: 4591980 - DNA, 16 bp, Homo sapiens
atttcccaggaccctg

SEQ ID NO: 4591981 - DNA, 21 bp, Homo sapiens
atttcgccgttgaagaggaag

SEQ ID NO: 4591982 - DNA, 13 bp, Homo sapiens
atttctgtatata

SEQ ID NO: 4591983 - DNA, 20 bp, Homo sapiens
atttctgtttagataataca

SEQ ID NO: 4591984 - DNA, 21 bp, Homo sapiens
atttctgtttagataatacac

SEQ ID NO: 4591985 - DNA, 23 bp, Homo sapiens
atttgaaggtagaatgttttcaa

SEQ ID NO: 4591986 - DNA, 17 bp, Homo sapiens
atttgagagaaatatga

SEQ ID NO: 4591987 - DNA, 21 bp, Homo sapiens
atttgaggtctgttctttcca

SEQ ID NO: 4591988 - DNA, 19 bp, Homo sapiens
atttgggcctgctccagac

SEQ ID NO: 4591989 - DNA, 17 bp, Homo sapiens
atttggtggtttcagaa

SEQ ID NO: 4591990 - DNA, 20 bp, Homo sapiens
atttggtggtttcagaaatg

SEQ ID NO: 4591991 - DNA, 21 bp, Homo sapiens
atttggtggtttcagaaatgt

SEQ ID NO: 4591992 - DNA, 17 bp, Homo sapiens
atttgtgatacaatgct

SEQ ID NO: 4591993 - DNA, 18 bp, Homo sapiens
atttgtttctttctctga

SEQ ID NO: 4591994 - DNA, 14 bp, Homo sapiens
atttgtttgaactg

SEQ ID NO: 4591995 - DNA, 16 bp, Homo sapiens
atttgtttgaactgat

SEQ ID NO: 4591996 - DNA, 23 bp, Homo sapiens
attttacagctcattaaactttt

SEQ ID NO: 4591997 - DNA, 23 bp, Homo sapiens
attttatatgcttactgatatat

SEQ ID NO: 4591998 - DNA, 22 bp, Homo sapiens
attttatgttaagggaagaatt

SEQ ID NO: 4591999 - DNA, 16 bp, Homo sapiens
attttatgttatttat

SEQ ID NO: 4592000 - DNA, 14 bp, Homo sapiens
attttattatgcat

SEQ ID NO: 4592001 - DNA, 18 bp, Homo sapiens
attttattttattatgca

SEQ ID NO: 4592002 - DNA, 19 bp, Homo sapiens
attttcagcaaactctttt

SEQ ID NO: 4592003 - DNA, 22 bp, Homo sapiens
attttcctggtgccaatttcaa

SEQ ID NO: 4592004 - DNA, 16 bp, Homo sapiens
attttctgtgcctgaa

SEQ ID NO: 4592005 - DNA, 15 bp, Homo sapiens
attttgatgttttaa

SEQ ID NO: 4592006 - DNA, 17 bp, Homo sapiens
attttgatgttttaagg

SEQ ID NO: 4592007 - DNA, 12 bp, Homo sapiens
attttgctttgt

SEQ ID NO: 4592008 - DNA, 23 bp, Homo sapiens
attttgtaatgtatcaaatacat

SEQ ID NO: 4592009 - DNA, 20 bp, Homo sapiens
attttgtgtaagaaatacag

SEQ ID NO: 4592010 - DNA, 17 bp, Homo sapiens
atttttaaaacccattt

SEQ ID NO: 4592011 - DNA, 19 bp, Homo sapiens
atttttggcagtctgaatt

SEQ ID NO: 4592012 - DNA, 21 bp, Homo sapiens
attttttatcatgcatgtcct

SEQ ID NO: 4592013 - DNA, 19 bp, Homo sapiens
atttttttttcatacactt

SEQ ID NO: 4592014 - DNA, 21 bp, Homo sapiens
atttttttttcatacacttat

SEQ ID NO: 4592015 - DNA, 22 bp, Homo sapiens
caaaacaaaggcctaattctat

SEQ ID NO: 4592016 - DNA, 23 bp, Homo sapiens
caaaacttcagacatagaattaa

SEQ ID NO: 4592017 - DNA, 19 bp, Homo sapiens
caaaagaacaagaatttct

SEQ ID NO: 4592018 - DNA, 16 bp, Homo sapiens
caaaagaagcccccag

SEQ ID NO: 4592019 - DNA, 19 bp, Homo sapiens
caaaagaagcccccagcta

SEQ ID NO: 4592020 - DNA, 22 bp, Homo sapiens
caaaagattgctgaaattttat

SEQ ID NO: 4592021 - DNA, 18 bp, Homo sapiens
caaaagtttgtttgctta

SEQ ID NO: 4592022 - DNA, 17 bp, Homo sapiens
caaaatgttggtcattt

SEQ ID NO: 4592023 - DNA, 21 bp, Homo sapiens
caaaatgttggtcattttatg

SEQ ID NO: 4592024 - DNA, 19 bp, Homo sapiens
caaacctgacccctgctca

SEQ ID NO: 4592025 - DNA, 20 bp, Homo sapiens
caaacctgacccctgctcag

SEQ ID NO: 4592026 - DNA, 14 bp, Homo sapiens
caaagatattttgc

SEQ ID NO: 4592027 - DNA, 23 bp, Homo sapiens
caaagatattttgctttgtgatt

SEQ ID NO: 4592028 - DNA, 16 bp, Homo sapiens
caaagtacactgtttc

SEQ ID NO: 4592029 - DNA, 15 bp, Homo sapiens
caaataaagtctctt

SEQ ID NO: 4592030 - DNA, 16 bp, Homo sapiens
caaatggggccagatc

SEQ ID NO: 4592031 - DNA, 19 bp, Homo sapiens
caaatggggccagatccag

SEQ ID NO: 4592032 - DNA, 21 bp, Homo sapiens
caaatgttcatcaatgaatga

SEQ ID NO: 4592033 - DNA, 17 bp, Homo sapiens
caaatttacagagacag

SEQ ID NO: 4592034 - DNA, 23 bp, Homo sapiens
caaatttacagagacagaaagca

SEQ ID NO: 4592035 - DNA, 18 bp, Homo sapiens
caacaacctcaactgcct

SEQ ID NO: 4592036 - DNA, 13 bp, Homo sapiens
caacaagctattt

SEQ ID NO: 4592037 - DNA, 14 bp, Homo sapiens
caacaatttatgaa

SEQ ID NO: 4592038 - DNA, 16 bp, Homo sapiens
caacaatttatgaatt

SEQ ID NO: 4592039 - DNA, 18 bp, Homo sapiens
caacaatttatgaattga

SEQ ID NO: 4592040 - DNA, 14 bp, Homo sapiens
caacacacacactc

SEQ ID NO: 4592041 - DNA, 23 bp, Homo sapiens
caacatgccagccactgtgatag

SEQ ID NO: 4592042 - DNA, 11 bp, Homo sapiens
caaccaataaa

SEQ ID NO: 4592043 - DNA, 12 bp, Homo sapiens
caaccaataaaa

SEQ ID NO: 4592044 - DNA, 18 bp, Homo sapiens
caaccaataaaagccaga

SEQ ID NO: 4592045 - DNA, 23 bp, Homo sapiens
caaccagggccccggggcctgtt

SEQ ID NO: 4592046 - DNA, 18 bp, Homo sapiens
caacctcaactgcctact

SEQ ID NO: 4592047 - DNA, 18 bp, Homo sapiens
caactgaatgaggtcagc

SEQ ID NO: 4592048 - DNA, 19 bp, Homo sapiens
caactggacattgtctgcg

SEQ ID NO: 4592049 - DNA, 21 bp, Homo sapiens
caagaataatcacgctttcct

SEQ ID NO: 4592050 - DNA, 19 bp, Homo sapiens
caagaatagcattgtaaaa

SEQ ID NO: 4592051 - DNA, 23 bp, Homo sapiens
caagaatttcttggtaagaagcc

SEQ ID NO: 4592052 - DNA, 14 bp, Homo sapiens
caagacatgtctgt

SEQ ID NO: 4592053 - DNA, 14 bp, Homo sapiens
caagaccacgtttc

SEQ ID NO: 4592054 - DNA, 22 bp, Homo sapiens
caagcctggcccccgacccagc

SEQ ID NO: 4592055 - DNA, 17 bp, Homo sapiens
caaggaaagccccagca

SEQ ID NO: 4592056 - DNA, 12 bp, Homo sapiens
caaggaaggaaa

SEQ ID NO: 4592057 - DNA, 13 bp, Homo sapiens
caaggaaggaaag

SEQ ID NO: 4592058 - DNA, 19 bp, Homo sapiens
caaggacttcctgtccagc

SEQ ID NO: 4592059 - DNA, 23 bp, Homo sapiens
caaggacttcctgtccagctcca

SEQ ID NO: 4592060 - DNA, 20 bp, Homo sapiens
caaggatagatgctggccca

SEQ ID NO: 4592061 - DNA, 23 bp, Homo sapiens
caaggatagatgctggcccaggg

SEQ ID NO: 4592062 - DNA, 18 bp, Homo sapiens
caaggggaatcagaactc

SEQ ID NO: 4592063 - DNA, 13 bp, Homo sapiens
caaggtcattttt

SEQ ID NO: 4592064 - DNA, 13 bp, Homo sapiens
caagtattatacc

SEQ ID NO: 4592065 - DNA, 20 bp, Homo sapiens
caagtcatagccataaatga

SEQ ID NO: 4592066 - DNA, 16 bp, Homo sapiens
caagttagaaaacata

SEQ ID NO: 4592067 - DNA, 18 bp, Homo sapiens
caagttccaagttgctaa

SEQ ID NO: 4592068 - DNA, 15 bp, Homo sapiens
caagttgctaataca

SEQ ID NO: 4592069 - DNA, 12 bp, Homo sapiens
caagttgtaaat

SEQ ID NO: 4592070 - DNA, 15 bp, Homo sapiens
caagttgtaaataat

SEQ ID NO: 4592071 - DNA, 20 bp, Homo sapiens
caataaaaatgtttaacggt

SEQ ID NO: 4592072 - DNA, 21 bp, Homo sapiens
caataaaagccagatgctaga

SEQ ID NO: 4592073 - DNA, 21 bp, Homo sapiens
caatatcttttttttaataaa

SEQ ID NO: 4592074 - DNA, 23 bp, Homo sapiens
caatgaaatgaattaaagtggac

SEQ ID NO: 4592075 - DNA, 18 bp, Homo sapiens
caatgacttactgtacat

SEQ ID NO: 4592076 - DNA, 16 bp, Homo sapiens
caattgtcacttttta

SEQ ID NO: 4592077 - DNA, 14 bp, Homo sapiens
caatttatgaattg

SEQ ID NO: 4592078 - DNA, 14 bp, Homo sapiens
caatttcagactcc

SEQ ID NO: 4592079 - DNA, 16 bp, Homo sapiens
cacaacacacacactc

SEQ ID NO: 4592080 - DNA, 23 bp, Homo sapiens
cacaagacccaaaaggcagaagc

SEQ ID NO: 4592081 - DNA, 12 bp, Homo sapiens
cacaaggacttc

SEQ ID NO: 4592082 - DNA, 18 bp, Homo sapiens
cacaaggatagatgctgg

SEQ ID NO: 4592083 - DNA, 13 bp, Homo sapiens
cacacacactcta

SEQ ID NO: 4592084 - DNA, 10 bp, Homo sapiens
cacacatttt

SEQ ID NO: 4592085 - DNA, 19 bp, Homo sapiens
cacacattttttaaatgca

SEQ ID NO: 4592086 - DNA, 20 bp, Homo sapiens
cacacattttttaaatgcac

SEQ ID NO: 4592087 - DNA, 19 bp, Homo sapiens
cacaccggtaccctcctcc

SEQ ID NO: 4592088 - DNA, 22 bp, Homo sapiens
cacagagttgttacatttttaa

SEQ ID NO: 4592089 - DNA, 13 bp, Homo sapiens
cacaggccctccc

SEQ ID NO: 4592090 - DNA, 21 bp, Homo sapiens
cacagttctttgggccagaca

SEQ ID NO: 4592091 - DNA, 23 bp, Homo sapiens
cacagttctttgggccagacatg

SEQ ID NO: 4592092 - DNA, 19 bp, Homo sapiens
cacataccctcttcatgga

SEQ ID NO: 4592093 - DNA, 20 bp, Homo sapiens
cacatattgatttccgttaa

SEQ ID NO: 4592094 - DNA, 20 bp, Homo sapiens
cacatcagcacgatttctgt

SEQ ID NO: 4592095 - DNA, 21 bp, Homo sapiens
cacatcagcacgatttctgtt

SEQ ID NO: 4592096 - DNA, 17 bp, Homo sapiens
cacatgcaaggtcattt

SEQ ID NO: 4592097 - DNA, 23 bp, Homo sapiens
cacatggcccctccccctgccag

SEQ ID NO: 4592098 - DNA, 19 bp, Homo sapiens
cacattttattttattatg

SEQ ID NO: 4592099 - DNA, 21 bp, Homo sapiens
cacattttttaaatgcacctg

SEQ ID NO: 4592100 - DNA, 20 bp, Homo sapiens
caccactacattctgttaat

SEQ ID NO: 4592101 - DNA, 18 bp, Homo sapiens
caccagacacccaggact

SEQ ID NO: 4592102 - DNA, 19 bp, Homo sapiens
caccagacacccaggactt

SEQ ID NO: 4592103 - DNA, 22 bp, Homo sapiens
caccctgcctctacccaaccag

SEQ ID NO: 4592104 - DNA, 20 bp, Homo sapiens
cacctaatccaggcagatcc

SEQ ID NO: 4592105 - DNA, 22 bp, Homo sapiens
cacctaatccaggcagatccag

SEQ ID NO: 4592106 - DNA, 15 bp, Homo sapiens
cacctcaggtgactt

SEQ ID NO: 4592107 - DNA, 21 bp, Homo sapiens
cacgaaggtaaaaagtatttt

SEQ ID NO: 4592108 - DNA, 14 bp, Homo sapiens
cacgatttctgttt

SEQ ID NO: 4592109 - DNA, 13 bp, Homo sapiens
cacggccacagtc

SEQ ID NO: 4592110 - DNA, 12 bp, Homo sapiens
cacgtttctaaa

SEQ ID NO: 4592111 - DNA, 23 bp, Homo sapiens
cacgtttctaaaggctacctttg

SEQ ID NO: 4592112 - DNA, 17 bp, Homo sapiens
cactaatttgatgttta

SEQ ID NO: 4592113 - DNA, 14 bp, Homo sapiens
cactacattctgtt

SEQ ID NO: 4592114 - DNA, 15 bp, Homo sapiens
cactacattctgtta

SEQ ID NO: 4592115 - DNA, 21 bp, Homo sapiens
cactacattctgttaatcatt

SEQ ID NO: 4592116 - DNA, 15 bp, Homo sapiens
cactagaactctcca

SEQ ID NO: 4592117 - DNA, 17 bp, Homo sapiens
cactagaactctccatc

SEQ ID NO: 4592118 - DNA, 21 bp, Homo sapiens
cactcaggaggctgaggcagg

SEQ ID NO: 4592119 - DNA, 12 bp, Homo sapiens
cactccagcctg

SEQ ID NO: 4592120 - DNA, 14 bp, Homo sapiens
cactgaccagaact

SEQ ID NO: 4592121 - DNA, 23 bp, Homo sapiens
cactgagaccccaggctgttagg

SEQ ID NO: 4592122 - DNA, 17 bp, Homo sapiens
cactgatgctgcccctc

SEQ ID NO: 4592123 - DNA, 21 bp, Homo sapiens
cactgcagaagacagtatggc

SEQ ID NO: 4592124 - DNA, 16 bp, Homo sapiens
cactggcctacccctt

SEQ ID NO: 4592125 - DNA, 15 bp, Homo sapiens
cactgtcctgggcct

SEQ ID NO: 4592126 - DNA, 11 bp, Homo sapiens
cactgtttaag

SEQ ID NO: 4592127 - DNA, 19 bp, Homo sapiens
cactgtttcaaactttact

SEQ ID NO: 4592128 - DNA, 14 bp, Homo sapiens
cacttcataatcca

SEQ ID NO: 4592129 - DNA, 20 bp, Homo sapiens
cacttctgggcttcatctgg

SEQ ID NO: 4592130 - DNA, 20 bp, Homo sapiens
cacttgaacccgggaggcag

SEQ ID NO: 4592131 - DNA, 23 bp, Homo sapiens
cacttgaacccgggaggcagagg

SEQ ID NO: 4592132 - DNA, 14 bp, Homo sapiens
cacttttgttcttg

SEQ ID NO: 4592133 - DNA, 22 bp, Homo sapiens
cacttttgttcttggtttgtaa

SEQ ID NO: 4592134 - DNA, 14 bp, Homo sapiens
cagaaagctgcctg

SEQ ID NO: 4592135 - DNA, 11 bp, Homo sapiens
cagaacagtga

SEQ ID NO: 4592136 - DNA, 18 bp, Homo sapiens
cagaacagtgattaccag

SEQ ID NO: 4592137 - DNA, 20 bp, Homo sapiens
cagaactcaaatggggccag

SEQ ID NO: 4592138 - DNA, 21 bp, Homo sapiens
cagaactcaaatggggccaga

SEQ ID NO: 4592139 - DNA, 20 bp, Homo sapiens
cagaagcaacccaaatgttc

SEQ ID NO: 4592140 - DNA, 16 bp, Homo sapiens
cagaagtcatgaagcc

SEQ ID NO: 4592141 - DNA, 17 bp, Homo sapiens
cagaagtcatgaagccc

SEQ ID NO: 4592142 - DNA, 17 bp, Homo sapiens
cagaataatctttgggt

SEQ ID NO: 4592143 - DNA, 18 bp, Homo sapiens
cagaattctctagtttga

SEQ ID NO: 4592144 - DNA, 18 bp, Homo sapiens
cagacacaggccctccct

SEQ ID NO: 4592145 - DNA, 17 bp, Homo sapiens
cagacacccaggactta

SEQ ID NO: 4592146 - DNA, 17 bp, Homo sapiens
cagacatagaattaaca

SEQ ID NO: 4592147 - DNA, 13 bp, Homo sapiens
cagacctgatcct

SEQ ID NO: 4592148 - DNA, 18 bp, Homo sapiens
cagactcccattcctgaa

SEQ ID NO: 4592149 - DNA, 20 bp, Homo sapiens
cagactcccattcctgaaga

SEQ ID NO: 4592150 - DNA, 19 bp, Homo sapiens
cagagacatacttgaaggg

SEQ ID NO: 4592151 - DNA, 21 bp, Homo sapiens
cagagacatacttgaagggcc

SEQ ID NO: 4592152 - DNA, 21 bp, Homo sapiens
cagagatccaaaagaagcccc

SEQ ID NO: 4592153 - DNA, 18 bp, Homo sapiens
cagagcaagatcctgtct

SEQ ID NO: 4592154 - DNA, 23 bp, Homo sapiens
gaaaaaggatgcacagagttgtt

SEQ ID NO: 4592155 - DNA, 19 bp, Homo sapiens
gaaaacacatttttcttag

SEQ ID NO: 4592156 - DNA, 19 bp, Homo sapiens
gaaaacatgctacacactg

SEQ ID NO: 4592157 - DNA, 19 bp, Homo sapiens
gaaacccctgtaggcctca

SEQ ID NO: 4592158 - DNA, 15 bp, Homo sapiens
gaaactccagatgcc

SEQ ID NO: 4592159 - DNA, 18 bp, Homo sapiens
gaaagaaaatcaggctgg

SEQ ID NO: 4592160 - DNA, 11 bp, Homo sapiens
gaaagaaggaa

SEQ ID NO: 4592161 - DNA, 14 bp, Homo sapiens
gaaagcagaacagt

SEQ ID NO: 4592162 - DNA, 12 bp, Homo sapiens
gaaagccagcct

SEQ ID NO: 4592163 - DNA, 13 bp, Homo sapiens
gaaagccagcctg

SEQ ID NO: 4592164 - DNA, 23 bp, Homo sapiens
gaaagccagcctgggggctggga

SEQ ID NO: 4592165 - DNA, 14 bp, Homo sapiens
gaaagccccagcac

SEQ ID NO: 4592166 - DNA, 15 bp, Homo sapiens
gaaaggggagtaggt

SEQ ID NO: 4592167 - DNA, 21 bp, Homo sapiens
gaaaggggagtaggtggggga

SEQ ID NO: 4592168 - DNA, 16 bp, Homo sapiens
gaaatggctttgtgat

SEQ ID NO: 4592169 - DNA, 15 bp, Homo sapiens
gaaattggctggatg

SEQ ID NO: 4592170 - DNA, 15 bp, Homo sapiens
gaacactgagaaaga

SEQ ID NO: 4592171 - DNA, 12 bp, Homo sapiens
gaacagaaggat

SEQ ID NO: 4592172 - DNA, 14 bp, Homo sapiens
gaacagaaggatga

SEQ ID NO: 4592173 - DNA, 19 bp, Homo sapiens
gaacagaaggatgaatgag

SEQ ID NO: 4592174 - DNA, 17 bp, Homo sapiens
gaacagacaacagaagt

SEQ ID NO: 4592175 - DNA, 22 bp, Homo sapiens
gaaccatggtcggaaaacatgc

SEQ ID NO: 4592176 - DNA, 22 bp, Homo sapiens
gaactcaaatggggccagatcc

SEQ ID NO: 4592177 - DNA, 13 bp, Homo sapiens
gaactcagatcca

SEQ ID NO: 4592178 - DNA, 14 bp, Homo sapiens
gaactcagatccag

SEQ ID NO: 4592179 - DNA, 12 bp, Homo sapiens
gaagaattccag

SEQ ID NO: 4592180 - DNA, 18 bp, Homo sapiens
gaagatgtagaggagaaa

SEQ ID NO: 4592181 - DNA, 23 bp, Homo sapiens
gaagattctatgttaatatttta

SEQ ID NO: 4592182 - DNA, 22 bp, Homo sapiens
gaagccagctttccctgcctct

SEQ ID NO: 4592183 - DNA, 19 bp, Homo sapiens
gaagccaggaatttcccag

SEQ ID NO: 4592184 - DNA, 21 bp, Homo sapiens
gaagccaggaatttcccagga

SEQ ID NO: 4592185 - DNA, 14 bp, Homo sapiens
gaagcccccagcta

SEQ ID NO: 4592186 - DNA, 17 bp, Homo sapiens
gaagcccccagctaaga

SEQ ID NO: 4592187 - DNA, 22 bp, Homo sapiens
gaagcccccagctaagaacctg

SEQ ID NO: 4592188 - DNA, 16 bp, Homo sapiens
gaagccgggaacagac

SEQ ID NO: 4592189 - DNA, 22 bp, Homo sapiens
gaagctcctctccccagcccag

SEQ ID NO: 4592190 - DNA, 16 bp, Homo sapiens
gaagctctgaagtcac

SEQ ID NO: 4592191 - DNA, 20 bp, Homo sapiens
gaagctctgaagtcacatca

SEQ ID NO: 4592192 - DNA, 16 bp, Homo sapiens
gaaggaagtgaagagg

SEQ ID NO: 4592193 - DNA, 16 bp, Homo sapiens
gaagggccagagccag

SEQ ID NO: 4592194 - DNA, 17 bp, Homo sapiens
gaagggccagagccagg

SEQ ID NO: 4592195 - DNA, 20 bp, Homo sapiens
gaaggtagaatgttttcaaa

SEQ ID NO: 4592196 - DNA, 21 bp, Homo sapiens
gaagtaatatgcacacatttt

SEQ ID NO: 4592197 - DNA, 16 bp, Homo sapiens
gaagtatccttcagcc

SEQ ID NO: 4592198 - DNA, 17 bp, Homo sapiens
gaagtcttctatttatt

SEQ ID NO: 4592199 - DNA, 16 bp, Homo sapiens
gaagttgattcatatt

SEQ ID NO: 4592200 - DNA, 17 bp, Homo sapiens
gaataagattatatgga

SEQ ID NO: 4592201 - DNA, 18 bp, Homo sapiens
gaataatcacgctttcct

SEQ ID NO: 4592202 - DNA, 20 bp, Homo sapiens
gaataatcacgctttcctga

SEQ ID NO: 4592203 - DNA, 15 bp, Homo sapiens
gaataatctttgggt

SEQ ID NO: 4592204 - DNA, 24 bp, Homo sapiens
gaatactttgcagcacagctgaga

SEQ ID NO: 4592205 - DNA, 20 bp, Homo sapiens
gaatgaatggctaagcaaaa

SEQ ID NO: 4592206 - DNA, 18 bp, Homo sapiens
gaatgaggtcccaggcag

SEQ ID NO: 4592207 - DNA, 17 bp, Homo sapiens
gaatttctaaaaaacag

SEQ ID NO: 4592208 - DNA, 17 bp, Homo sapiens
gacaacagaagtcatga

SEQ ID NO: 4592209 - DNA, 17 bp, Homo sapiens
gacaatgacttactgta

SEQ ID NO: 4592210 - DNA, 19 bp, Homo sapiens
gacaatttattatggcaca

SEQ ID NO: 4592211 - DNA, 13 bp, Homo sapiens
gacacaggccctc

SEQ ID NO: 4592212 - DNA, 14 bp, Homo sapiens
gacacccaggactt

SEQ ID NO: 4592213 - DNA, 12 bp, Homo sapiens
gacactggcatg

SEQ ID NO: 4592214 - DNA, 23 bp, Homo sapiens
gacactttaattaccaacctgtt

SEQ ID NO: 4592215 - DNA, 21 bp, Homo sapiens
gacagaaagcagaacagtgat

SEQ ID NO: 4592216 - DNA, 19 bp, Homo sapiens
gacagaggccccagcctcc

SEQ ID NO: 4592217 - DNA, 15 bp, Homo sapiens
gacagccccaccctg

SEQ ID NO: 4592218 - DNA, 20 bp, Homo sapiens
gacagttggagggaaagcca

SEQ ID NO: 4592219 - DNA, 22 bp, Homo sapiens
gacagttggagggaaagccagc

SEQ ID NO: 4592220 - DNA, 23 bp, Homo sapiens
gacagttggagggaaagccagcc

SEQ ID NO: 4592221 - DNA, 14 bp, Homo sapiens
gacatacttgaagg

SEQ ID NO: 4592222 - DNA, 18 bp, Homo sapiens
gacatacttgaagggcca

SEQ ID NO: 4592223 - DNA, 16 bp, Homo sapiens
gacatccgttgtgctt

SEQ ID NO: 4592224 - DNA, 23 bp, Homo sapiens
gacattggcacctaatccaggca

SEQ ID NO: 4592225 - DNA, 14 bp, Homo sapiens
gaccagctcaggac

SEQ ID NO: 4592226 - DNA, 19 bp, Homo sapiens
gacccaaaaggcagaagca

SEQ ID NO: 4592227 - DNA, 15 bp, Homo sapiens
gacccagtgccccca

SEQ ID NO: 4592228 - DNA, 14 bp, Homo sapiens
gacctctgcagcaa

SEQ ID NO: 4592229 - DNA, 18 bp, Homo sapiens
gacctctgcagcaataaa

SEQ ID NO: 4592230 - DNA, 22 bp, Homo sapiens
gacctctgcagcaataaagcag

SEQ ID NO: 4592231 - DNA, 15 bp, Homo sapiens
gacctgatcctggag

SEQ ID NO: 4592232 - DNA, 16 bp, Homo sapiens
gactaaactaccacct

SEQ ID NO: 4592233 - DNA, 23 bp, Homo sapiens
gactgagtacgttgtgcatttgg

SEQ ID NO: 4592234 - DNA, 17 bp, Homo sapiens
gactggatgtaccacca

SEQ ID NO: 4592235 - DNA, 15 bp, Homo sapiens
gacttactgtacatg

SEQ ID NO: 4592236 - DNA, 18 bp, Homo sapiens
gacttactgtacatgaaa

SEQ ID NO: 4592237 - DNA, 19 bp, Homo sapiens
gacttcctgtccagctcca

SEQ ID NO: 4592238 - DNA, 20 bp, Homo sapiens
gacttcctgtccagctccaa

SEQ ID NO: 4592239 - DNA, 21 bp, Homo sapiens
gactttttaaaaaatgctggg

SEQ ID NO: 4592240 - DNA, 16 bp, Homo sapiens
gactttttgcatttaa

SEQ ID NO: 4592241 - DNA, 17 bp, Homo sapiens
gagaaaggggagcccac

SEQ ID NO: 4592242 - DNA, 22 bp, Homo sapiens
gagaagctcctctccccagccc

SEQ ID NO: 4592243 - DNA, 21 bp, Homo sapiens
gagaagtcttctatttattta

SEQ ID NO: 4592244 - DNA, 18 bp, Homo sapiens
gagaagtgggtggggaca

SEQ ID NO: 4592245 - DNA, 15 bp, Homo sapiens
gagaatcacttgaac

SEQ ID NO: 4592246 - DNA, 15 bp, Homo sapiens
gagacagactagaag

SEQ ID NO: 4592247 - DNA, 18 bp, Homo sapiens
gagacatacttgaagggc

SEQ ID NO: 4592248 - DNA, 21 bp, Homo sapiens
gagacatacttgaagggccag

SEQ ID NO: 4592249 - DNA, 16 bp, Homo sapiens
gagaccagcctgggca

SEQ ID NO: 4592250 - DNA, 19 bp, Homo sapiens
gagagtgaacaaatttaca

SEQ ID NO: 4592251 - DNA, 21 bp, Homo sapiens
gagattgtgcccctgcactcc

SEQ ID NO: 4592252 - DNA, 20 bp, Homo sapiens
gagcatctcttgaggccagg

SEQ ID NO: 4592253 - DNA, 22 bp, Homo sapiens
gagcatctcttgaggccaggag

SEQ ID NO: 4592254 - DNA, 23 bp, Homo sapiens
gagcatctcttgaggccaggagt

SEQ ID NO: 4592255 - DNA, 11 bp, Homo sapiens
gagcccactgt

SEQ ID NO: 4592256 - DNA, 12 bp, Homo sapiens
gagcccagctcc

SEQ ID NO: 4592257 - DNA, 16 bp, Homo sapiens
gagcgagcgctaccca

SEQ ID NO: 4592258 - DNA, 16 bp, Homo sapiens
gagcgcatcaggcctg

SEQ ID NO: 4592259 - DNA, 15 bp, Homo sapiens
gagcgctacccactt

SEQ ID NO: 4592260 - DNA, 21 bp, Homo sapiens
gagctcatccctctcacccag

SEQ ID NO: 4592261 - DNA, 14 bp, Homo sapiens
gaggagggggcagg

SEQ ID NO: 4592262 - DNA, 22 bp, Homo sapiens
gaggcagggacctaaagggact

SEQ ID NO: 4592263 - DNA, 22 bp, Homo sapiens
gaggccaggagtttgagaccag

SEQ ID NO: 4592264 - DNA, 18 bp, Homo sapiens
gaggcccagttcaccctg

SEQ ID NO: 4592265 - DNA, 23 bp, Homo sapiens
gaggccccagcctccctgaagcc

SEQ ID NO: 4592266 - DNA, 21 bp, Homo sapiens
gagggtgaagtgaagacaatg

SEQ ID NO: 4592267 - DNA, 12 bp, Homo sapiens
gaggtcccaggc

SEQ ID NO: 4592268 - DNA, 14 bp, Homo sapiens
gaggtcccaggcag

SEQ ID NO: 4592269 - DNA, 17 bp, Homo sapiens
gagtacgttgtgcattt

SEQ ID NO: 4592270 - DNA, 18 bp, Homo sapiens
gagtacgttgtgcatttg

SEQ ID NO: 4592271 - DNA, 23 bp, Homo sapiens
gagtctggtgaagctcacttctg

SEQ ID NO: 4592272 - DNA, 17 bp, Homo sapiens
gagttaagacctggcag

SEQ ID NO: 4592273 - DNA, 22 bp, Homo sapiens
gagttgatactacagtttgtta

SEQ ID NO: 4592274 - DNA, 14 bp, Homo sapiens
gagttgatctggaa

SEQ ID NO: 4592275 - DNA, 17 bp, Homo sapiens
gagttgatctggaaccc

SEQ ID NO: 4592276 - DNA, 20 bp, Homo sapiens
gagttgttacatttttaagt

SEQ ID NO: 4592277 - DNA, 21 bp, Homo sapiens
gataaatattgagcagatcta

SEQ ID NO: 4592278 - DNA, 14 bp, Homo sapiens
gataatacaccact

SEQ ID NO: 4592279 - DNA, 22 bp, Homo sapiens
gataatacaccactacattctg

SEQ ID NO: 4592280 - DNA, 13 bp, Homo sapiens
gatacaatgctgt

SEQ ID NO: 4592281 - DNA, 17 bp, Homo sapiens
gatagatgctggcccag

SEQ ID NO: 4592282 - DNA, 20 bp, Homo sapiens
gatagatgctggcccagggc

SEQ ID NO: 4592283 - DNA, 19 bp, Homo sapiens
gatatagttttacttttaa

SEQ ID NO: 4592284 - DNA, 14 bp, Homo sapiens
gatatattttacaa

SEQ ID NO: 4592285 - DNA, 21 bp, Homo sapiens
gatattttctgtgcctgaata

SEQ ID NO: 4592286 - DNA, 16 bp, Homo sapiens
gatattttgctttgtg

SEQ ID NO: 4592287 - DNA, 14 bp, Homo sapiens
ctatgcatttgaaa

SEQ ID NO: 4592288 - DNA, 13 bp, Homo sapiens
ctatgttaatatt

SEQ ID NO: 4592289 - DNA, 14 bp, Homo sapiens
ctatgttaatattt

SEQ ID NO: 4592290 - DNA, 18 bp, Homo sapiens
ctatgttctaagaagtga

SEQ ID NO: 4592291 - DNA, 12 bp, Homo sapiens
ctatttatttat

SEQ ID NO: 4592292 - DNA, 22 bp, Homo sapiens
ctatttttggcagtctgaattt

SEQ ID NO: 4592293 - DNA, 13 bp, Homo sapiens
ctcaaaacaaagg

SEQ ID NO: 4592294 - DNA, 14 bp, Homo sapiens
ctcaaaacaaaggc

SEQ ID NO: 4592295 - DNA, 22 bp, Homo sapiens
ctcaaactgaggaatttcacct

SEQ ID NO: 4592296 - DNA, 16 bp, Homo sapiens
ctcaaatggggccaga

SEQ ID NO: 4592297 - DNA, 15 bp, Homo sapiens
ctcaaatttctaaat

SEQ ID NO: 4592298 - DNA, 15 bp, Homo sapiens
ctcaactgcctactc

SEQ ID NO: 4592299 - DNA, 16 bp, Homo sapiens
ctcaccttggcaccag

SEQ ID NO: 4592300 - DNA, 17 bp, Homo sapiens
ctcaccttggcaccaga

SEQ ID NO: 4592301 - DNA, 19 bp, Homo sapiens
ctcaccttggcaccagaca

SEQ ID NO: 4592302 - DNA, 17 bp, Homo sapiens
ctcagacattggcacct

SEQ ID NO: 4592303 - DNA, 13 bp, Homo sapiens
ctcagatccaggg

SEQ ID NO: 4592304 - DNA, 14 bp, Homo sapiens
ctcagatccaggga

SEQ ID NO: 4592305 - DNA, 19 bp, Homo sapiens
ctcagcctggccagacaca

SEQ ID NO: 4592306 - DNA, 20 bp, Homo sapiens
ctcagcctggccagacacag

SEQ ID NO: 4592307 - DNA, 16 bp, Homo sapiens
ctcagccttgccagag

SEQ ID NO: 4592308 - DNA, 14 bp, Homo sapiens
ctcaggacagatgc

SEQ ID NO: 4592309 - DNA, 13 bp, Homo sapiens
ctcagttttcata

SEQ ID NO: 4592310 - DNA, 16 bp, Homo sapiens
ctcatcaactgaatga

SEQ ID NO: 4592311 - DNA, 13 bp, Homo sapiens
ctcatccctctca

SEQ ID NO: 4592312 - DNA, 12 bp, Homo sapiens
ctcatgttctta

SEQ ID NO: 4592313 - DNA, 18 bp, Homo sapiens
ctcattaggatggctagt

SEQ ID NO: 4592314 - DNA, 16 bp, Homo sapiens
ctccaaaataaaactt

SEQ ID NO: 4592315 - DNA, 21 bp, Homo sapiens
ctccaacctgcaaagatctgt

SEQ ID NO: 4592316 - DNA, 20 bp, Homo sapiens
ctccaaggaggggctgtaaa

SEQ ID NO: 4592317 - DNA, 21 bp, Homo sapiens
ctccaaggaggggctgtaaaa

SEQ ID NO: 4592318 - DNA, 22 bp, Homo sapiens
ctccaaggaggggctgtaaaat

SEQ ID NO: 4592319 - DNA, 20 bp, Homo sapiens
ctccaaggggaatcagaact

SEQ ID NO: 4592320 - DNA, 15 bp, Homo sapiens
ctccaattttttaag

SEQ ID NO: 4592321 - DNA, 11 bp, Homo sapiens
ctccagacctg

SEQ ID NO: 4592322 - DNA, 14 bp, Homo sapiens
ctccagacctgatc

SEQ ID NO: 4592323 - DNA, 13 bp, Homo sapiens
ctccagccctgac

SEQ ID NO: 4592324 - DNA, 15 bp, Homo sapiens
ctccaggcttccaca

SEQ ID NO: 4592325 - DNA, 17 bp, Homo sapiens
ctccaggcttccacact

SEQ ID NO: 4592326 - DNA, 21 bp, Homo sapiens
ctccagtgagacagctctgca

SEQ ID NO: 4592327 - DNA, 17 bp, Homo sapiens
ctcccattcctgaagaa

SEQ ID NO: 4592328 - DNA, 13 bp, Homo sapiens
ctccccagcccag

SEQ ID NO: 4592329 - DNA, 18 bp, Homo sapiens
ctccccagcccagagaca

SEQ ID NO: 4592330 - DNA, 18 bp, Homo sapiens
ctcccccccatgcactgt

SEQ ID NO: 4592331 - DNA, 20 bp, Homo sapiens
ctcccccccatgcactgtga

SEQ ID NO: 4592332 - DNA, 11 bp, Homo sapiens
ctccccctgcc

SEQ ID NO: 4592333 - DNA, 16 bp, Homo sapiens
ctcccctaaagcctca

SEQ ID NO: 4592334 - DNA, 23 bp, Homo sapiens
ctcccctaaagcctcaaaacaaa

SEQ ID NO: 4592335 - DNA, 16 bp, Homo sapiens
ctccctgttccccaga

SEQ ID NO: 4592336 - DNA, 17 bp, Homo sapiens
ctccctgttccccagag

SEQ ID NO: 4592337 - DNA, 18 bp, Homo sapiens
ctccctgttccccagaga

SEQ ID NO: 4592338 - DNA, 19 bp, Homo sapiens
ctccctgttccccagagaa

SEQ ID NO: 4592339 - DNA, 15 bp, Homo sapiens
ctcctctccccagcc

SEQ ID NO: 4592340 - DNA, 19 bp, Homo sapiens
ctcctctccccagcccaga

SEQ ID NO: 4592341 - DNA, 13 bp, Homo sapiens
ctctaaataaaga

SEQ ID NO: 4592342 - DNA, 14 bp, Homo sapiens
ctctaaataaagac

SEQ ID NO: 4592343 - DNA, 15 bp, Homo sapiens
ctctaaataaagacg

SEQ ID NO: 4592344 - DNA, 19 bp, Homo sapiens
ctctaacagtggacaaagt

SEQ ID NO: 4592345 - DNA, 17 bp, Homo sapiens
ctctatgccagctcagt

SEQ ID NO: 4592346 - DNA, 23 bp, Homo sapiens
ctctcacccagaatccctctaac

SEQ ID NO: 4592347 - DNA, 16 bp, Homo sapiens
ctctcatcaactgaat

SEQ ID NO: 4592348 - DNA, 16 bp, Homo sapiens
ctctccccagcccaga

SEQ ID NO: 4592349 - DNA, 20 bp, Homo sapiens
ctctccccagcccagagaca

SEQ ID NO: 4592350 - DNA, 15 bp, Homo sapiens
ctctcctgtacctct

SEQ ID NO: 4592351 - DNA, 18 bp, Homo sapiens
ctctcctgtacctcttga

SEQ ID NO: 4592352 - DNA, 22 bp, Homo sapiens
ctctcctgtacctcttgagcct

SEQ ID NO: 4592353 - DNA, 18 bp, Homo sapiens
ctctgcagcaataaagca

SEQ ID NO: 4592354 - DNA, 23 bp, Homo sapiens
ctctgcagcaataaagcagcgtt

SEQ ID NO: 4592355 - DNA, 14 bp, Homo sapiens
ctctgcccaaccct

SEQ ID NO: 4592356 - DNA, 17 bp, Homo sapiens
ctctgcctgacagcatc

SEQ ID NO: 4592357 - DNA, 23 bp, Homo sapiens
ctctgtgccttgccacattaaat

SEQ ID NO: 4592358 - DNA, 19 bp, Homo sapiens
ctcttccagtcttcctgac

SEQ ID NO: 4592359 - DNA, 21 bp, Homo sapiens
ctcttctgagctatttcatct

SEQ ID NO: 4592360 - DNA, 15 bp, Homo sapiens
ctcttcttgaaattt

SEQ ID NO: 4592361 - DNA, 22 bp, Homo sapiens
ctcttgaaatataggaacttaa

SEQ ID NO: 4592362 - DNA, 16 bp, Homo sapiens
ctcttgagccttgaac

SEQ ID NO: 4592363 - DNA, 16 bp, Homo sapiens
ctcttgaggccaggag

SEQ ID NO: 4592364 - DNA, 17 bp, Homo sapiens
ctcttgaggccaggagt

SEQ ID NO: 4592365 - DNA, 22 bp, Homo sapiens
ctctttccagtggatcataaga

SEQ ID NO: 4592366 - DNA, 19 bp, Homo sapiens
ctgaaattttatatgctta

SEQ ID NO: 4592367 - DNA, 22 bp, Homo sapiens
ctgaaattttatatgcttactg

SEQ ID NO: 4592368 - DNA, 19 bp, Homo sapiens
ctgaaggggccatgatggc

SEQ ID NO: 4592369 - DNA, 19 bp, Homo sapiens
ctgaagtcacatcacagga

SEQ ID NO: 4592370 - DNA, 20 bp, Homo sapiens
ctgaatccaaactaatccat

SEQ ID NO: 4592371 - DNA, 21 bp, Homo sapiens
ctgaattctgctctaaataaa

SEQ ID NO: 4592372 - DNA, 21 bp, Homo sapiens
ctgaatttggcctgcactaat

SEQ ID NO: 4592373 - DNA, 15 bp, Homo sapiens
ctgaccactggccta

SEQ ID NO: 4592374 - DNA, 13 bp, Homo sapiens
ctgaccagaacta

SEQ ID NO: 4592375 - DNA, 21 bp, Homo sapiens
ctgacccagtgcccccactga

SEQ ID NO: 4592376 - DNA, 23 bp, Homo sapiens
ctgacccagtgcccccactgacc

SEQ ID NO: 4592377 - DNA, 19 bp, Homo sapiens
ctgaccttaaatgcaacca

SEQ ID NO: 4592378 - DNA, 19 bp, Homo sapiens
ctgacggccagggagaagc

SEQ ID NO: 4592379 - DNA, 20 bp, Homo sapiens
ctgacggccagggagaagct

SEQ ID NO: 4592380 - DNA, 21 bp, Homo sapiens
ctgacggccagggagaagctc

SEQ ID NO: 4592381 - DNA, 18 bp, Homo sapiens
ctgactaaactaccacct

SEQ ID NO: 4592382 - DNA, 19 bp, Homo sapiens
ctgactaaactaccacctc

SEQ ID NO: 4592383 - DNA, 22 bp, Homo sapiens
ctgactaaactaccacctcagg

SEQ ID NO: 4592384 - DNA, 21 bp, Homo sapiens
ctgagatatgaacatattgtt

SEQ ID NO: 4592385 - DNA, 23 bp, Homo sapiens
ctgagatatgaacatattgttga

SEQ ID NO: 4592386 - DNA, 13 bp, Homo sapiens
ctgagctatttca

SEQ ID NO: 4592387 - DNA, 16 bp, Homo sapiens
ctgagctatttcatct

SEQ ID NO: 4592388 - DNA, 21 bp, Homo sapiens
ctgagctatttcatctatttt

SEQ ID NO: 4592389 - DNA, 18 bp, Homo sapiens
ctgagtacgttgtgcatt

SEQ ID NO: 4592390 - DNA, 20 bp, Homo sapiens
ctgagtacgttgtgcatttg

SEQ ID NO: 4592391 - DNA, 21 bp, Homo sapiens
ctgagtacgttgtgcatttgg

SEQ ID NO: 4592392 - DNA, 12 bp, Homo sapiens
ctgagtctgaat

SEQ ID NO: 4592393 - DNA, 17 bp, Homo sapiens
ctgatcctggaggccca

SEQ ID NO: 4592394 - DNA, 18 bp, Homo sapiens
ctgatcctggaggcccag

SEQ ID NO: 4592395 - DNA, 19 bp, Homo sapiens
ctgatcctggaggcccagt

SEQ ID NO: 4592396 - DNA, 15 bp, Homo sapiens
ctgattttttttcct

SEQ ID NO: 4592397 - DNA, 20 bp, Homo sapiens
ctgattttttttccttttaa

SEQ ID NO: 4592398 - DNA, 22 bp, Homo sapiens
ctgcaaagatctgtcctcagcc

SEQ ID NO: 4592399 - DNA, 23 bp, Homo sapiens
ctgcaaagatctgtcctcagcct

SEQ ID NO: 4592400 - DNA, 22 bp, Homo sapiens
ctgcacaataaaaatgtttaac

SEQ ID NO: 4592401 - DNA, 16 bp, Homo sapiens
ctgcactaatttgatg

SEQ ID NO: 4592402 - DNA, 20 bp, Homo sapiens
ctgcactccagcctgagcga

SEQ ID NO: 4592403 - DNA, 23 bp, Homo sapiens
ctgcagaagacagtatggcagct

SEQ ID NO: 4592404 - DNA, 16 bp, Homo sapiens
ctgcagcaataaagca

SEQ ID NO: 4592405 - DNA, 14 bp, Homo sapiens
ctgcatacttttta

SEQ ID NO: 4592406 - DNA, 11 bp, Homo sapiens
ctgccagctgc

SEQ ID NO: 4592407 - DNA, 17 bp, Homo sapiens
ctgccagctgcactgat

SEQ ID NO: 4592408 - DNA, 15 bp, Homo sapiens
ctgccaggagctttg

SEQ ID NO: 4592409 - DNA, 17 bp, Homo sapiens
ctgcccaacccttccct

SEQ ID NO: 4592410 - DNA, 15 bp, Homo sapiens
ctgcctaagtgcagc

SEQ ID NO: 4592411 - DNA, 20 bp, Homo sapiens
ctgcctggtatatccaaaag

SEQ ID NO: 4592412 - DNA, 18 bp, Homo sapiens
ctgcgaatctagaggagg

SEQ ID NO: 4592413 - DNA, 20 bp, Homo sapiens
ctgcgttttggaagctctga

SEQ ID NO: 4592414 - DNA, 19 bp, Homo sapiens
ctgctcagtaaagcacttg

SEQ ID NO: 4592415 - DNA, 13 bp, Homo sapiens
ctgctccagacct

SEQ ID NO: 4592416 - DNA, 15 bp, Homo sapiens
ctgctccagacctga

SEQ ID NO: 4592417 - DNA, 19 bp, Homo sapiens
ctgctcccctaaagcctca

SEQ ID NO: 4592418 - DNA, 16 bp, Homo sapiens
ctgctgtacaacttct

SEQ ID NO: 4592419 - DNA, 15 bp, Homo sapiens
ctgcttaacttcaca

SEQ ID NO: 4592420 - DNA, 13 bp, Homo sapiens
ctgcttgattttt

SEQ ID NO: 4592421 - DNA, 16 bp, Homo sapiens
acttctgggcctctct

SEQ ID NO: 4592422 - DNA, 17 bp, Homo sapiens
acttctgggcttcatct

SEQ ID NO: 4592423 - DNA, 16 bp, Homo sapiens
acttcttgaaggtgct

SEQ ID NO: 4592424 - DNA, 23 bp, Homo sapiens
acttgaacccgggaggcagaggt

SEQ ID NO: 4592425 - DNA, 15 bp, Homo sapiens
acttgaagggccaga

SEQ ID NO: 4592426 - DNA, 19 bp, Homo sapiens
acttgaagggccagagcca

SEQ ID NO: 4592427 - DNA, 20 bp, Homo sapiens
acttgaagggccagagccag

SEQ ID NO: 4592428 - DNA, 21 bp, Homo sapiens
acttgaagggccagagccagg

SEQ ID NO: 4592429 - DNA, 22 bp, Homo sapiens
acttgaagggccagagccaggg

SEQ ID NO: 4592430 - DNA, 14 bp, Homo sapiens
actttgacctctgc

SEQ ID NO: 4592431 - DNA, 15 bp, Homo sapiens
actttgactttttgc

SEQ ID NO: 4592432 - DNA, 20 bp, Homo sapiens
actttgactttttgcattta

SEQ ID NO: 4592433 - DNA, 22 bp, Homo sapiens
actttgcagcacagctgagagg

SEQ ID NO: 4592434 - DNA, 22 bp, Homo sapiens
actttggacaggagttaattaa

SEQ ID NO: 4592435 - DNA, 20 bp, Homo sapiens
acttttaaactgtgtacata

SEQ ID NO: 4592436 - DNA, 13 bp, Homo sapiens
acttttataaact

SEQ ID NO: 4592437 - DNA, 15 bp, Homo sapiens
acttttataaacttt

SEQ ID NO: 4592438 - DNA, 16 bp, Homo sapiens
acttttcttaaacctt

SEQ ID NO: 4592439 - DNA, 15 bp, Homo sapiens
acttttgttcttggt

SEQ ID NO: 4592440 - DNA, 21 bp, Homo sapiens
actttttaaaaaatgctgggt

SEQ ID NO: 4592441 - DNA, 19 bp, Homo sapiens
agaaaatagtggtgtgatt

SEQ ID NO: 4592442 - DNA, 12 bp, Homo sapiens
agaaagaaggaa

SEQ ID NO: 4592443 - DNA, 13 bp, Homo sapiens
agaaagaaggaag

SEQ ID NO: 4592444 - DNA, 15 bp, Homo sapiens
agaaaggggagccca

SEQ ID NO: 4592445 - DNA, 15 bp, Homo sapiens
agaaatgtacagcaa

SEQ ID NO: 4592446 - DNA, 16 bp, Homo sapiens
agaaatgtacagcaag

SEQ ID NO: 4592447 - DNA, 17 bp, Homo sapiens
agaaatgtacagcaagg

SEQ ID NO: 4592448 - DNA, 20 bp, Homo sapiens
agaacaaaggggcttaatta

SEQ ID NO: 4592449 - DNA, 19 bp, Homo sapiens
agaaccagtccccccaccc

SEQ ID NO: 4592450 - DNA, 13 bp, Homo sapiens
agaacctggaact

SEQ ID NO: 4592451 - DNA, 21 bp, Homo sapiens
agaacctggaacttggggagt

SEQ ID NO: 4592452 - DNA, 16 bp, Homo sapiens
agaacgctgatttaaa

SEQ ID NO: 4592453 - DNA, 20 bp, Homo sapiens
agaactcaaatggggccaga

SEQ ID NO: 4592454 - DNA, 12 bp, Homo sapiens
agaagccaggaa

SEQ ID NO: 4592455 - DNA, 12 bp, Homo sapiens
agaagcccccag

SEQ ID NO: 4592456 - DNA, 24 bp, Homo sapiens
agaagcccccagctaagaacctgg

SEQ ID NO: 4592457 - DNA, 18 bp, Homo sapiens
agaagccgggaacagaca

SEQ ID NO: 4592458 - DNA, 14 bp, Homo sapiens
agaagctcctctcc

SEQ ID NO: 4592459 - DNA, 14 bp, Homo sapiens
agaaggatgaatga

SEQ ID NO: 4592460 - DNA, 21 bp, Homo sapiens
agaaggatgaatgaggtccca

SEQ ID NO: 4592461 - DNA, 17 bp, Homo sapiens
agaagtcatgaagccca

SEQ ID NO: 4592462 - DNA, 21 bp, Homo sapiens
agaagtgaaaatctacactcc

SEQ ID NO: 4592463 - DNA, 15 bp, Homo sapiens
agaagtgggtgggga

SEQ ID NO: 4592464 - DNA, 16 bp, Homo sapiens
agaagtgggtggggac

SEQ ID NO: 4592465 - DNA, 21 bp, Homo sapiens
agaataatcacgctttcctga

SEQ ID NO: 4592466 - DNA, 14 bp, Homo sapiens
agaatcatacttag

SEQ ID NO: 4592467 - DNA, 15 bp, Homo sapiens
agaatgttttcaaat

SEQ ID NO: 4592468 - DNA, 21 bp, Homo sapiens
agaatgttttcaaatgttctc

SEQ ID NO: 4592469 - DNA, 23 bp, Homo sapiens
agaattaacacatgatcctgcaa

SEQ ID NO: 4592470 - DNA, 19 bp, Homo sapiens
agaattctctagtttgatt

SEQ ID NO: 4592471 - DNA, 14 bp, Homo sapiens
agacaacagaagtc

SEQ ID NO: 4592472 - DNA, 17 bp, Homo sapiens
agacaatgacttactgt

SEQ ID NO: 4592473 - DNA, 19 bp, Homo sapiens
agacaatgacttactgtac

SEQ ID NO: 4592474 - DNA, 18 bp, Homo sapiens
agacaatggacccttttt

SEQ ID NO: 4592475 - DNA, 14 bp, Homo sapiens
agacaatttattat

SEQ ID NO: 4592476 - DNA, 12 bp, Homo sapiens
agacacaggccc

SEQ ID NO: 4592477 - DNA, 14 bp, Homo sapiens
agacacccaggact

SEQ ID NO: 4592478 - DNA, 17 bp, Homo sapiens
agacatacttgaagggc

SEQ ID NO: 4592479 - DNA, 21 bp, Homo sapiens
agacatacttgaagggccaga

SEQ ID NO: 4592480 - DNA, 23 bp, Homo sapiens
agacatacttgaagggccagagc

SEQ ID NO: 4592481 - DNA, 12 bp, Homo sapiens
agaccagccctt

SEQ ID NO: 4592482 - DNA, 17 bp, Homo sapiens
agacccaaaaggcagaa

SEQ ID NO: 4592483 - DNA, 19 bp, Homo sapiens
agacccaaaaggcagaagc

SEQ ID NO: 4592484 - DNA, 16 bp, Homo sapiens
agacctgatcctggag

SEQ ID NO: 4592485 - DNA, 23 bp, Homo sapiens
agacctgatcctggaggcccagt

SEQ ID NO: 4592486 - DNA, 17 bp, Homo sapiens
agacctggcagctctgg

SEQ ID NO: 4592487 - DNA, 20 bp, Homo sapiens
agactggttccatggcctct

SEQ ID NO: 4592488 - DNA, 15 bp, Homo sapiens
agagaatcatactta

SEQ ID NO: 4592489 - DNA, 15 bp, Homo sapiens
agagacagaaagcag

SEQ ID NO: 4592490 - DNA, 24 bp, Homo sapiens
agagacagaaagcagaacagtgat

SEQ ID NO: 4592491 - DNA, 18 bp, Homo sapiens
agagatccaaaagaagcc

SEQ ID NO: 4592492 - DNA, 23 bp, Homo sapiens
agagcaagatcctgtctttaagg

SEQ ID NO: 4592493 - DNA, 15 bp, Homo sapiens
agagcccagctccaa

SEQ ID NO: 4592494 - DNA, 16 bp, Homo sapiens
agaggcagggacctaa

SEQ ID NO: 4592495 - DNA, 16 bp, Homo sapiens
agaggccatggcagaa

SEQ ID NO: 4592496 - DNA, 13 bp, Homo sapiens
agaggccccagcc

SEQ ID NO: 4592497 - DNA, 15 bp, Homo sapiens
agaggccccagcctc

SEQ ID NO: 4592498 - DNA, 14 bp, Homo sapiens
agaggctgtctgtt

SEQ ID NO: 4592499 - DNA, 15 bp, Homo sapiens
agaggttgcagtgag

SEQ ID NO: 4592500 - DNA, 23 bp, Homo sapiens
agagtctggtgaagctcacttct

SEQ ID NO: 4592501 - DNA, 22 bp, Homo sapiens
agagttgatactacagtttgtt

SEQ ID NO: 4592502 - DNA, 21 bp, Homo sapiens
agagttgttacatttttaagt

SEQ ID NO: 4592503 - DNA, 13 bp, Homo sapiens
agagtttcctgaa

SEQ ID NO: 4592504 - DNA, 18 bp, Homo sapiens
agatatgaacatattgtt

SEQ ID NO: 4592505 - DNA, 21 bp, Homo sapiens
agatattttgctttgtgattt

SEQ ID NO: 4592506 - DNA, 17 bp, Homo sapiens
agatatttttatcttta

SEQ ID NO: 4592507 - DNA, 21 bp, Homo sapiens
agatatttttatctttatatg

SEQ ID NO: 4592508 - DNA, 19 bp, Homo sapiens
agatcactttctcagtttt

SEQ ID NO: 4592509 - DNA, 22 bp, Homo sapiens
agatccagggacagaggcccca

SEQ ID NO: 4592510 - DNA, 19 bp, Homo sapiens
agatctgtcctcagccttg

SEQ ID NO: 4592511 - DNA, 11 bp, Homo sapiens
agatgaatgtc

SEQ ID NO: 4592512 - DNA, 13 bp, Homo sapiens
agatgtaattttg

SEQ ID NO: 4592513 - DNA, 16 bp, Homo sapiens
agatgtagaggagaaa

SEQ ID NO: 4592514 - DNA, 18 bp, Homo sapiens
agattctatgttaatatt

SEQ ID NO: 4592515 - DNA, 20 bp, Homo sapiens
agattgaacctgaatattgc

SEQ ID NO: 4592516 - DNA, 16 bp, Homo sapiens
agattgtgcccctgca

SEQ ID NO: 4592517 - DNA, 21 bp, Homo sapiens
agattgtgcccctgcactcca

SEQ ID NO: 4592518 - DNA, 21 bp, Homo sapiens
agcaacaatttatgaattgaa

SEQ ID NO: 4592519 - DNA, 21 bp, Homo sapiens
agcaagatcctgtctttaagg

SEQ ID NO: 4592520 - DNA, 19 bp, Homo sapiens
agcaaggagatttacaact

SEQ ID NO: 4592521 - DNA, 14 bp, Homo sapiens
agcacgatttctgt

SEQ ID NO: 4592522 - DNA, 19 bp, Homo sapiens
agcacgatttctgtttaga

SEQ ID NO: 4592523 - DNA, 13 bp, Homo sapiens
agcagaaatgcct

SEQ ID NO: 4592524 - DNA, 14 bp, Homo sapiens
agcagaacagtgat

SEQ ID NO: 4592525 - DNA, 19 bp, Homo sapiens
agcagcgtttctatgacac

SEQ ID NO: 4592526 - DNA, 20 bp, Homo sapiens
agcatgagagggatgaggca

SEQ ID NO: 4592527 - DNA, 19 bp, Homo sapiens
agcatgtctattcagcttc

SEQ ID NO: 4592528 - DNA, 17 bp, Homo sapiens
agcattgtaaaagcatt

SEQ ID NO: 4592529 - DNA, 14 bp, Homo sapiens
agccagatgctaga

SEQ ID NO: 4592530 - DNA, 23 bp, Homo sapiens
agccagatgctagagcctctgcc

SEQ ID NO: 4592531 - DNA, 14 bp, Homo sapiens
agccagcatcggaa

SEQ ID NO: 4592532 - DNA, 18 bp, Homo sapiens
agccagcctgggggctgg

SEQ ID NO: 4592533 - DNA, 13 bp, Homo sapiens
agccagctttccc

SEQ ID NO: 4592534 - DNA, 19 bp, Homo sapiens
agccaggaatttcccagga

SEQ ID NO: 4592535 - DNA, 21 bp, Homo sapiens
agccaggaatttcccaggacc

SEQ ID NO: 4592536 - DNA, 22 bp, Homo sapiens
agccaggaatttcccaggaccc

SEQ ID NO: 4592537 - DNA, 18 bp, Homo sapiens
agccaggttccacagagg

SEQ ID NO: 4592538 - DNA, 13 bp, Homo sapiens
agccagtaaatgg

SEQ ID NO: 4592539 - DNA, 16 bp, Homo sapiens
agcccaatgaaatgaa

SEQ ID NO: 4592540 - DNA, 14 bp, Homo sapiens
agcccactgtcctg

SEQ ID NO: 4592541 - DNA, 15 bp, Homo sapiens
agcccactgtcctgg

SEQ ID NO: 4592542 - DNA, 18 bp, Homo sapiens
agcccactgtcctgggcc

SEQ ID NO: 4592543 - DNA, 12 bp, Homo sapiens
agccccagcact

SEQ ID NO: 4592544 - DNA, 23 bp, Homo sapiens
agccctgactaaactaccacctc

SEQ ID NO: 4592545 - DNA, 21 bp, Homo sapiens
agccgggcgtggtggtgagtg

SEQ ID NO: 4592546 - DNA, 21 bp, Homo sapiens
agcctcagaggccttgggagc

SEQ ID NO: 4592547 - DNA, 15 bp, Homo sapiens
agcctcatgtccact

SEQ ID NO: 4592548 - DNA, 22 bp, Homo sapiens
agcctctgcctgacagcatcct

SEQ ID NO: 4592549 - DNA, 19 bp, Homo sapiens
agcctgagcgacagtgaga

SEQ ID NO: 4592550 - DNA, 15 bp, Homo sapiens
agcctggccagacac

SEQ ID NO: 4592551 - DNA, 15 bp, Homo sapiens
agcctgggcaacaga

SEQ ID NO: 4592552 - DNA, 17 bp, Homo sapiens
agcctgggcagcatagc

SEQ ID NO: 4592553 - DNA, 20 bp, Homo sapiens
agcctgggcagcatagcaag

SEQ ID NO: 4592554 - DNA, 15 bp, Homo sapiens
agcctgggggctggg

SEQ ID NO: 4592555 - DNA, 20 bp, Homo sapiens
cagagcaagatcctgtcttt

SEQ ID NO: 4592556 - DNA, 11 bp, Homo sapiens
cagagcccagc

SEQ ID NO: 4592557 - DNA, 14 bp, Homo sapiens
cagagcccagctcc

SEQ ID NO: 4592558 - DNA, 17 bp, Homo sapiens
cagaggacacagagaag

SEQ ID NO: 4592559 - DNA, 13 bp, Homo sapiens
cagaggccccagc

SEQ ID NO: 4592560 - DNA, 21 bp, Homo sapiens
cagaggctcagattgtaatat

SEQ ID NO: 4592561 - DNA, 18 bp, Homo sapiens
cagagttgttacattttt

SEQ ID NO: 4592562 - DNA, 14 bp, Homo sapiens
cagatccagcctgg

SEQ ID NO: 4592563 - DNA, 15 bp, Homo sapiens
cagatccagcctggg

SEQ ID NO: 4592564 - DNA, 17 bp, Homo sapiens
cagatccagcctggggt

SEQ ID NO: 4592565 - DNA, 13 bp, Homo sapiens
cagatccagggac

SEQ ID NO: 4592566 - DNA, 20 bp, Homo sapiens
cagatctctaacttcaccat

SEQ ID NO: 4592567 - DNA, 13 bp, Homo sapiens
cagattttcagca

SEQ ID NO: 4592568 - DNA, 22 bp, Homo sapiens
cagattttcagcaaactctttt

SEQ ID NO: 4592569 - DNA, 13 bp, Homo sapiens
cagcaagcctggc

SEQ ID NO: 4592570 - DNA, 17 bp, Homo sapiens
cagcaaggagatttaca

SEQ ID NO: 4592571 - DNA, 15 bp, Homo sapiens
cagcactcaataaag

SEQ ID NO: 4592572 - DNA, 15 bp, Homo sapiens
cagcagaaatgcctt

SEQ ID NO: 4592573 - DNA, 13 bp, Homo sapiens
cagcatcctctct

SEQ ID NO: 4592574 - DNA, 19 bp, Homo sapiens
cagccaaacccatgaggca

SEQ ID NO: 4592575 - DNA, 16 bp, Homo sapiens
cagcctccctgaagcc

SEQ ID NO: 4592576 - DNA, 17 bp, Homo sapiens
cagcctccctgaagcct

SEQ ID NO: 4592577 - DNA, 18 bp, Homo sapiens
cagcctgagcgacagtga

SEQ ID NO: 4592578 - DNA, 15 bp, Homo sapiens
cagcctggccagaca

SEQ ID NO: 4592579 - DNA, 20 bp, Homo sapiens
cagcctggccagacacaggc

SEQ ID NO: 4592580 - DNA, 14 bp, Homo sapiens
cagcgtttctatga

SEQ ID NO: 4592581 - DNA, 16 bp, Homo sapiens
cagctaagaacctgga

SEQ ID NO: 4592582 - DNA, 19 bp, Homo sapiens
cagctcaggacagatgcca

SEQ ID NO: 4592583 - DNA, 23 bp, Homo sapiens
cagctccaacctgcaaagatctg

SEQ ID NO: 4592584 - DNA, 20 bp, Homo sapiens
cagctctgcatactcattag

SEQ ID NO: 4592585 - DNA, 17 bp, Homo sapiens
cagctctggacagcccc

SEQ ID NO: 4592586 - DNA, 14 bp, Homo sapiens
cagctgagaggctg

SEQ ID NO: 4592587 - DNA, 16 bp, Homo sapiens
cagctgtcaaggctca

SEQ ID NO: 4592588 - DNA, 23 bp, Homo sapiens
cagctttcctcaaaacttcagac

SEQ ID NO: 4592589 - DNA, 17 bp, Homo sapiens
caggaatttcccaggac

SEQ ID NO: 4592590 - DNA, 21 bp, Homo sapiens
caggaatttcccaggaccctg

SEQ ID NO: 4592591 - DNA, 14 bp, Homo sapiens
caggacagatgcca

SEQ ID NO: 4592592 - DNA, 12 bp, Homo sapiens
caggaccagctc

SEQ ID NO: 4592593 - DNA, 15 bp, Homo sapiens
caggaccagctcagg

SEQ ID NO: 4592594 - DNA, 18 bp, Homo sapiens
caggaccctgaaggggcc

SEQ ID NO: 4592595 - DNA, 20 bp, Homo sapiens
caggactatatttgggcctg

SEQ ID NO: 4592596 - DNA, 12 bp, Homo sapiens
caggagacatcc

SEQ ID NO: 4592597 - DNA, 21 bp, Homo sapiens
caggaggctgaggcaggagga

SEQ ID NO: 4592598 - DNA, 16 bp, Homo sapiens
caggagtcccaaggaa

SEQ ID NO: 4592599 - DNA, 18 bp, Homo sapiens
caggagttcgaggctgca

SEQ ID NO: 4592600 - DNA, 19 bp, Homo sapiens
caggagttcgaggctgcag

SEQ ID NO: 4592601 - DNA, 14 bp, Homo sapiens
caggcagagaatca

SEQ ID NO: 4592602 - DNA, 15 bp, Homo sapiens
caggcagagaatcat

SEQ ID NO: 4592603 - DNA, 15 bp, Homo sapiens
caggcagatccagga

SEQ ID NO: 4592604 - DNA, 16 bp, Homo sapiens
caggccgtcaccctgg

SEQ ID NO: 4592605 - DNA, 19 bp, Homo sapiens
caggccgtcaccctgggag

SEQ ID NO: 4592606 - DNA, 22 bp, Homo sapiens
caggctgagggtcgtgggaaag

SEQ ID NO: 4592607 - DNA, 14 bp, Homo sapiens
cagggacagaggcc

SEQ ID NO: 4592608 - DNA, 16 bp, Homo sapiens
cagggacagaggcccc

SEQ ID NO: 4592609 - DNA, 23 bp, Homo sapiens
cagggacagaggccccagcctcc

SEQ ID NO: 4592610 - DNA, 15 bp, Homo sapiens
cagggacctaaaggg

SEQ ID NO: 4592611 - DNA, 12 bp, Homo sapiens
cagggagaagct

SEQ ID NO: 4592612 - DNA, 13 bp, Homo sapiens
cagggagaagctc

SEQ ID NO: 4592613 - DNA, 15 bp, Homo sapiens
cagggcccagagccc

SEQ ID NO: 4592614 - DNA, 18 bp, Homo sapiens
caggggggtgaggagctg

SEQ ID NO: 4592615 - DNA, 19 bp, Homo sapiens
caggggggtgaggagctgg

SEQ ID NO: 4592616 - DNA, 15 bp, Homo sapiens
caggttccacagagg

SEQ ID NO: 4592617 - DNA, 19 bp, Homo sapiens
caggttccacagaggacac

SEQ ID NO: 4592618 - DNA, 18 bp, Homo sapiens
cagtaaatgggggtgcat

SEQ ID NO: 4592619 - DNA, 19 bp, Homo sapiens
cagtaaatgggggtgcatt

SEQ ID NO: 4592620 - DNA, 16 bp, Homo sapiens
cagtacatgggtgact

SEQ ID NO: 4592621 - DNA, 15 bp, Homo sapiens
cagtcacattccaag

SEQ ID NO: 4592622 - DNA, 20 bp, Homo sapiens
cagtcatggtggccacggcc

SEQ ID NO: 4592623 - DNA, 19 bp, Homo sapiens
cagtcattatgttaatatt

SEQ ID NO: 4592624 - DNA, 17 bp, Homo sapiens
cagtcctggaagccagc

SEQ ID NO: 4592625 - DNA, 19 bp, Homo sapiens
cagtcggcacagtgcagca

SEQ ID NO: 4592626 - DNA, 13 bp, Homo sapiens
cagtcttcctgac

SEQ ID NO: 4592627 - DNA, 16 bp, Homo sapiens
cagtcttcctgacact

SEQ ID NO: 4592628 - DNA, 15 bp, Homo sapiens
cagtgagacagctct

SEQ ID NO: 4592629 - DNA, 23 bp, Homo sapiens
cagtgagggtaagtattttcctg

SEQ ID NO: 4592630 - DNA, 18 bp, Homo sapiens
cagtgattaccagggact

SEQ ID NO: 4592631 - DNA, 17 bp, Homo sapiens
cagtgtgtggtcaacat

SEQ ID NO: 4592632 - DNA, 19 bp, Homo sapiens
cagtgttgtggatttaaca

SEQ ID NO: 4592633 - DNA, 22 bp, Homo sapiens
cagttatgatttttttttcata

SEQ ID NO: 4592634 - DNA, 17 bp, Homo sapiens
cagttcaggagtcccaa

SEQ ID NO: 4592635 - DNA, 20 bp, Homo sapiens
cagttggagggaaagccagc

SEQ ID NO: 4592636 - DNA, 14 bp, Homo sapiens
cagttgttatttat

SEQ ID NO: 4592637 - DNA, 21 bp, Homo sapiens
cagtttgttagtatgaggcat

SEQ ID NO: 4592638 - DNA, 12 bp, Homo sapiens
cataagctattt

SEQ ID NO: 4592639 - DNA, 19 bp, Homo sapiens
cataagtattatgtctctt

SEQ ID NO: 4592640 - DNA, 22 bp, Homo sapiens
cataatcttctgccttctcatg

SEQ ID NO: 4592641 - DNA, 21 bp, Homo sapiens
cataatgcgtgcataccactt

SEQ ID NO: 4592642 - DNA, 23 bp, Homo sapiens
cataatgcgtgcataccactttt

SEQ ID NO: 4592643 - DNA, 15 bp, Homo sapiens
cataccacttttgtt

SEQ ID NO: 4592644 - DNA, 18 bp, Homo sapiens
cataccacttttgttctt

SEQ ID NO: 4592645 - DNA, 19 bp, Homo sapiens
cataccacttttgttcttg

SEQ ID NO: 4592646 - DNA, 18 bp, Homo sapiens
catacttgaagggccaga

SEQ ID NO: 4592647 - DNA, 14 bp, Homo sapiens
catagcaagacaca

SEQ ID NO: 4592648 - DNA, 20 bp, Homo sapiens
catagcagcttattcacaag

SEQ ID NO: 4592649 - DNA, 13 bp, Homo sapiens
catattgttgaaa

SEQ ID NO: 4592650 - DNA, 12 bp, Homo sapiens
catcaactgaat

SEQ ID NO: 4592651 - DNA, 21 bp, Homo sapiens
catcagcacgatttctgttta

SEQ ID NO: 4592652 - DNA, 21 bp, Homo sapiens
catccttcaagaactctgggc

SEQ ID NO: 4592653 - DNA, 23 bp, Homo sapiens
catccttcaagaactctgggctg

SEQ ID NO: 4592654 - DNA, 20 bp, Homo sapiens
catcttattttcatgtatat

SEQ ID NO: 4592655 - DNA, 19 bp, Homo sapiens
catgaagatgtagaggaga

SEQ ID NO: 4592656 - DNA, 22 bp, Homo sapiens
catgaagcccaagtgaaatcaa

SEQ ID NO: 4592657 - DNA, 18 bp, Homo sapiens
catgacctagttttccat

SEQ ID NO: 4592658 - DNA, 22 bp, Homo sapiens
catgaggcaatgtcaggaacag

SEQ ID NO: 4592659 - DNA, 16 bp, Homo sapiens
catgaggtactgagag

SEQ ID NO: 4592660 - DNA, 19 bp, Homo sapiens
catgaggtactgagagtga

SEQ ID NO: 4592661 - DNA, 19 bp, Homo sapiens
catgatggcaacagatctg

SEQ ID NO: 4592662 - DNA, 14 bp, Homo sapiens
catgcactgtgaag

SEQ ID NO: 4592663 - DNA, 23 bp, Homo sapiens
catgccacaccggtaccctcctc

SEQ ID NO: 4592664 - DNA, 16 bp, Homo sapiens
catgcgtgtttctgac

SEQ ID NO: 4592665 - DNA, 22 bp, Homo sapiens
catggcagaataatctttgggt

SEQ ID NO: 4592666 - DNA, 22 bp, Homo sapiens
catggcctcttcagatctctaa

SEQ ID NO: 4592667 - DNA, 12 bp, Homo sapiens
catgggtgacta

SEQ ID NO: 4592668 - DNA, 19 bp, Homo sapiens
catggtcggaaaacatgct

SEQ ID NO: 4592669 - DNA, 23 bp, Homo sapiens
catggtcggaaaacatgctacac

SEQ ID NO: 4592670 - DNA, 15 bp, Homo sapiens
catggtgccccagga

SEQ ID NO: 4592671 - DNA, 22 bp, Homo sapiens
catggtgccccaggaccagctc

SEQ ID NO: 4592672 - DNA, 17 bp, Homo sapiens
catgtctattcagcttc

SEQ ID NO: 4592673 - DNA, 11 bp, Homo sapiens
cattaaaatat

SEQ ID NO: 4592674 - DNA, 14 bp, Homo sapiens
cattaaaatataat

SEQ ID NO: 4592675 - DNA, 13 bp, Homo sapiens
cattaaacttttt

SEQ ID NO: 4592676 - DNA, 13 bp, Homo sapiens
cattaaattgata

SEQ ID NO: 4592677 - DNA, 22 bp, Homo sapiens
cattaggtgtgactgaatttct

SEQ ID NO: 4592678 - DNA, 13 bp, Homo sapiens
cattagttttgaa

SEQ ID NO: 4592679 - DNA, 14 bp, Homo sapiens
cattagttttgaag

SEQ ID NO: 4592680 - DNA, 16 bp, Homo sapiens
cattagttttgaagat

SEQ ID NO: 4592681 - DNA, 16 bp, Homo sapiens
cattatgttaatattt

SEQ ID NO: 4592682 - DNA, 23 bp, Homo sapiens
cattcacagttctttgggccaga

SEQ ID NO: 4592683 - DNA, 14 bp, Homo sapiens
cattcacttcataa

SEQ ID NO: 4592684 - DNA, 20 bp, Homo sapiens
cattcctgaagaaccagtcc

SEQ ID NO: 4592685 - DNA, 15 bp, Homo sapiens
cattctactgaaaag

SEQ ID NO: 4592686 - DNA, 15 bp, Homo sapiens
cattgtaaaagcatt

SEQ ID NO: 4592687 - DNA, 17 bp, Homo sapiens
catttaaaacagacact

SEQ ID NO: 4592688 - DNA, 18 bp, Homo sapiens
catttaaaacagacactg

SEQ ID NO: 4592689 - DNA, 23 bp, Homo sapiens
catttaaaacagacactggcatg

SEQ ID NO: 4592690 - DNA, 12 bp, Homo sapiens
catttaaaagat

SEQ ID NO: 4592691 - DNA, 18 bp, Homo sapiens
catttcccaacacaaaga

SEQ ID NO: 4592692 - DNA, 17 bp, Homo sapiens
catttctcatgttgaaa

SEQ ID NO: 4592693 - DNA, 19 bp, Homo sapiens
catttgaaaattttgatgt

SEQ ID NO: 4592694 - DNA, 19 bp, Homo sapiens
catttgaaacccctgtagg

SEQ ID NO: 4592695 - DNA, 19 bp, Homo sapiens
catttgaggtctgttcttt

SEQ ID NO: 4592696 - DNA, 22 bp, Homo sapiens
catttggtggtttcagaaatgt

SEQ ID NO: 4592697 - DNA, 23 bp, Homo sapiens
catttggtggtttcagaaatgtg

SEQ ID NO: 4592698 - DNA, 20 bp, Homo sapiens
catttgtttgaactgataaa

SEQ ID NO: 4592699 - DNA, 23 bp, Homo sapiens
cattttttttaagaaaaaggatg

SEQ ID NO: 4592700 - DNA, 22 bp, Homo sapiens
ccaaaagaagcccccagctaag

SEQ ID NO: 4592701 - DNA, 19 bp, Homo sapiens
ccaaaagattgctgaaatt

SEQ ID NO: 4592702 - DNA, 18 bp, Homo sapiens
ccaaaataaaacttttta

SEQ ID NO: 4592703 - DNA, 16 bp, Homo sapiens
ccaaacccatgaggca

SEQ ID NO: 4592704 - DNA, 18 bp, Homo sapiens
ccaaagtacactgtttca

SEQ ID NO: 4592705 - DNA, 18 bp, Homo sapiens
ccaaatcatactttttct

SEQ ID NO: 4592706 - DNA, 18 bp, Homo sapiens
ccaaatgttcatcaatga

SEQ ID NO: 4592707 - DNA, 17 bp, Homo sapiens
ccaacctgcaaagatct

SEQ ID NO: 4592708 - DNA, 18 bp, Homo sapiens
ccaacctgcaaagatctg

SEQ ID NO: 4592709 - DNA, 20 bp, Homo sapiens
ccaactaatgccttactctt

SEQ ID NO: 4592710 - DNA, 13 bp, Homo sapiens
ccaacttcccagt

SEQ ID NO: 4592711 - DNA, 21 bp, Homo sapiens
ccaagacatgtctgttctaca

SEQ ID NO: 4592712 - DNA, 18 bp, Homo sapiens
ccaatagggctgagctct

SEQ ID NO: 4592713 - DNA, 22 bp, Homo sapiens
ccaatagggctgagctctctgt

SEQ ID NO: 4592714 - DNA, 19 bp, Homo sapiens
ccaatttcaagttccaagt

SEQ ID NO: 4592715 - DNA, 20 bp, Homo sapiens
ccacacaaggatagatgctg

SEQ ID NO: 4592716 - DNA, 12 bp, Homo sapiens
ccacacttctgg

SEQ ID NO: 4592717 - DNA, 14 bp, Homo sapiens
ccacctcaggtgac

SEQ ID NO: 4592718 - DNA, 13 bp, Homo sapiens
ccacgtttctaaa

SEQ ID NO: 4592719 - DNA, 17 bp, Homo sapiens
ccactacattctgttaa

SEQ ID NO: 4592720 - DNA, 21 bp, Homo sapiens
ccactagaactctccatctta

SEQ ID NO: 4592721 - DNA, 16 bp, Homo sapiens
ccactggcctacccct

SEQ ID NO: 4592722 - DNA, 19 bp, Homo sapiens
ccactgtcctgggcctgca

SEQ ID NO: 4592723 - DNA, 16 bp, Homo sapiens
ccagaaatcattttac

SEQ ID NO: 4592724 - DNA, 13 bp, Homo sapiens
ccagacacccagg

SEQ ID NO: 4592725 - DNA, 14 bp, Homo sapiens
ccagacatgccaca

SEQ ID NO: 4592726 - DNA, 15 bp, Homo sapiens
ccagacctgatcctg

SEQ ID NO: 4592727 - DNA, 17 bp, Homo sapiens
ccagacctgatcctgga

SEQ ID NO: 4592728 - DNA, 24 bp, Homo sapiens
ccagacctgatcctggaggcccag

SEQ ID NO: 4592729 - DNA, 16 bp, Homo sapiens
ccagagaaaggggagc

SEQ ID NO: 4592730 - DNA, 19 bp, Homo sapiens
ccagagaaaggggagccca

SEQ ID NO: 4592731 - DNA, 13 bp, Homo sapiens
ccagagatccaaa

SEQ ID NO: 4592732 - DNA, 20 bp, Homo sapiens
ccagagatccaaaagaagcc

SEQ ID NO: 4592733 - DNA, 11 bp, Homo sapiens
ccagagccagg

SEQ ID NO: 4592734 - DNA, 23 bp, Homo sapiens
ccagagccaggggggtgaggagc

SEQ ID NO: 4592735 - DNA, 21 bp, Homo sapiens
ccagatgctagagcctctgcc

SEQ ID NO: 4592736 - DNA, 15 bp, Homo sapiens
ccagcactcaataaa

SEQ ID NO: 4592737 - DNA, 14 bp, Homo sapiens
ccagcccagagaca

SEQ ID NO: 4592738 - DNA, 13 bp, Homo sapiens
ccagcctccctga

SEQ ID NO: 4592739 - DNA, 19 bp, Homo sapiens
ccagcctgggcaacagagc

SEQ ID NO: 4592740 - DNA, 14 bp, Homo sapiens
ccagctaagaacct

SEQ ID NO: 4592741 - DNA, 15 bp, Homo sapiens
ccagctcagtcccat

SEQ ID NO: 4592742 - DNA, 19 bp, Homo sapiens
ccagctgagtctgaattct

SEQ ID NO: 4592743 - DNA, 20 bp, Homo sapiens
ccagctgagtctgaattctg

SEQ ID NO: 4592744 - DNA, 20 bp, Homo sapiens
ccaggaatttcccaggaccc

SEQ ID NO: 4592745 - DNA, 13 bp, Homo sapiens
ccaggaccagctc

SEQ ID NO: 4592746 - DNA, 14 bp, Homo sapiens
ccaggaccagctca

SEQ ID NO: 4592747 - DNA, 15 bp, Homo sapiens
ccaggaccagctcag

SEQ ID NO: 4592748 - DNA, 17 bp, Homo sapiens
ccaggaccagctcagga

SEQ ID NO: 4592749 - DNA, 13 bp, Homo sapiens
ccaggcagatcca

SEQ ID NO: 4592750 - DNA, 20 bp, Homo sapiens
ccaggcttccacacttctgg

SEQ ID NO: 4592751 - DNA, 22 bp, Homo sapiens
ccagggacagaggccccagcct

SEQ ID NO: 4592752 - DNA, 23 bp, Homo sapiens
ccagggacagaggccccagcctc

SEQ ID NO: 4592753 - DNA, 13 bp, Homo sapiens
ccagggagaagct

SEQ ID NO: 4592754 - DNA, 17 bp, Homo sapiens
ccagggcccagagccca

SEQ ID NO: 4592755 - DNA, 19 bp, Homo sapiens
ccagggcccagagcccagc

SEQ ID NO: 4592756 - DNA, 16 bp, Homo sapiens
ccagggccccggggcc

SEQ ID NO: 4592757 - DNA, 19 bp, Homo sapiens
ccaggggggtgaggagctg

SEQ ID NO: 4592758 - DNA, 18 bp, Homo sapiens
ccagttcaggagtcccaa

SEQ ID NO: 4592759 - DNA, 21 bp, Homo sapiens
ccagttgttagattaagaaat

SEQ ID NO: 4592760 - DNA, 13 bp, Homo sapiens
ccataagctattt

SEQ ID NO: 4592761 - DNA, 14 bp, Homo sapiens
ccatgatggcaaca

SEQ ID NO: 4592762 - DNA, 13 bp, Homo sapiens
ccatgcactgtga

SEQ ID NO: 4592763 - DNA, 17 bp, Homo sapiens
ccatgcactgtgaagga

SEQ ID NO: 4592764 - DNA, 20 bp, Homo sapiens
ccatgcactgtgaaggaccc

SEQ ID NO: 4592765 - DNA, 20 bp, Homo sapiens
ccatgcgtgtttctgactct

SEQ ID NO: 4592766 - DNA, 23 bp, Homo sapiens
ccatggcactctatgttctaaga

SEQ ID NO: 4592767 - DNA, 22 bp, Homo sapiens
ccattgtggtcacaggaagtag

SEQ ID NO: 4592768 - DNA, 19 bp, Homo sapiens
ccatttaaatttttttcct

SEQ ID NO: 4592769 - DNA, 20 bp, Homo sapiens
ccatttaatggggaggacaa

SEQ ID NO: 4592770 - DNA, 18 bp, Homo sapiens
cccaaaaggcagaagcaa

SEQ ID NO: 4592771 - DNA, 13 bp, Homo sapiens
cccaacacaaaga

SEQ ID NO: 4592772 - DNA, 16 bp, Homo sapiens
cccaaccagggccccg

SEQ ID NO: 4592773 - DNA, 22 bp, Homo sapiens
cccaaggaaagccccagcacta

SEQ ID NO: 4592774 - DNA, 18 bp, Homo sapiens
cccaccctggtgggccaa

SEQ ID NO: 4592775 - DNA, 22 bp, Homo sapiens
cccactgtcctgggcctgcaga

SEQ ID NO: 4592776 - DNA, 13 bp, Homo sapiens
cccagactcagac

SEQ ID NO: 4592777 - DNA, 16 bp, Homo sapiens
cccagactcagacatt

SEQ ID NO: 4592778 - DNA, 20 bp, Homo sapiens
cccagactcagacattggca

SEQ ID NO: 4592779 - DNA, 17 bp, Homo sapiens
cccagctaagaacctgg

SEQ ID NO: 4592780 - DNA, 22 bp, Homo sapiens
cccaggaccagctcaggacaga

SEQ ID NO: 4592781 - DNA, 12 bp, Homo sapiens
cccaggaccctg

SEQ ID NO: 4592782 - DNA, 13 bp, Homo sapiens
cccaggaccctga

SEQ ID NO: 4592783 - DNA, 24 bp, Homo sapiens
cccaggagttcgaggctgcagtca

SEQ ID NO: 4592784 - DNA, 13 bp, Homo sapiens
cccagggcccaga

SEQ ID NO: 4592785 - DNA, 19 bp, Homo sapiens
cccagggcccagagcccag

SEQ ID NO: 4592786 - DNA, 22 bp, Homo sapiens
cccagttcaggagtcccaagga

SEQ ID NO: 4592787 - DNA, 20 bp, Homo sapiens
cccatatttgtacaccaata

SEQ ID NO: 4592788 - DNA, 16 bp, Homo sapiens
cccatgcactgtgaag

SEQ ID NO: 4592789 - DNA, 19 bp, Homo sapiens
cccatgcactgtgaaggac

SEQ ID NO: 4592790 - DNA, 20 bp, Homo sapiens
cccatgcactgtgaaggacc

SEQ ID NO: 4592791 - DNA, 22 bp, Homo sapiens
cccattgtggtcacaggaagta

SEQ ID NO: 4592792 - DNA, 12 bp, Homo sapiens
ccccagcccaga

SEQ ID NO: 4592793 - DNA, 13 bp, Homo sapiens
ccccagcccagag

SEQ ID NO: 4592794 - DNA, 21 bp, Homo sapiens
ccccaggaccagctcaggaca

SEQ ID NO: 4592795 - DNA, 23 bp, Homo sapiens
ccccatcctggggttgccctggg

SEQ ID NO: 4592796 - DNA, 13 bp, Homo sapiens
cccccagctaaga

SEQ ID NO: 4592797 - DNA, 13 bp, Homo sapiens
ccccggggcctgt

SEQ ID NO: 4592798 - DNA, 18 bp, Homo sapiens
cccctgttggaggtgagt

SEQ ID NO: 4592799 - DNA, 17 bp, Homo sapiens
cccctttctccagccct

SEQ ID NO: 4592800 - DNA, 13 bp, Homo sapiens
cccggggcctgtt

SEQ ID NO: 4592801 - DNA, 22 bp, Homo sapiens
ccctaaagtgtatttttttact

SEQ ID NO: 4592802 - DNA, 14 bp, Homo sapiens
ccctaggagaccaa

SEQ ID NO: 4592803 - DNA, 23 bp, Homo sapiens
ccctatatgtagtataaagaaaa

SEQ ID NO: 4592804 - DNA, 18 bp, Homo sapiens
ccctcccccccatgcact

SEQ ID NO: 4592805 - DNA, 20 bp, Homo sapiens
ccctcccccccatgcactgt

SEQ ID NO: 4592806 - DNA, 18 bp, Homo sapiens
ccctgactaaactaccac

SEQ ID NO: 4592807 - DNA, 15 bp, Homo sapiens
ccctgcctctaccca

SEQ ID NO: 4592808 - DNA, 22 bp, Homo sapiens
ccctgcctctcatcaactgaat

SEQ ID NO: 4592809 - DNA, 16 bp, Homo sapiens
ccctgctcagtaaagc

SEQ ID NO: 4592810 - DNA, 15 bp, Homo sapiens
ccctgtaggcctcag

SEQ ID NO: 4592811 - DNA, 14 bp, Homo sapiens
ccctgttccccaga

SEQ ID NO: 4592812 - DNA, 18 bp, Homo sapiens
ccctgttggaggtgagtg

SEQ ID NO: 4592813 - DNA, 17 bp, Homo sapiens
cccttccccatcctggg

SEQ ID NO: 4592814 - DNA, 15 bp, Homo sapiens
cccttggacatttta

SEQ ID NO: 4592815 - DNA, 14 bp, Homo sapiens
ccgactgaccactg

SEQ ID NO: 4592816 - DNA, 12 bp, Homo sapiens
ccgttattaaaa

SEQ ID NO: 4592817 - DNA, 20 bp, Homo sapiens
cctaacgaagtatccttcag

SEQ ID NO: 4592818 - DNA, 18 bp, Homo sapiens
cctaataaacatccttca

SEQ ID NO: 4592819 - DNA, 18 bp, Homo sapiens
cctaatccaggcagatcc

SEQ ID NO: 4592820 - DNA, 15 bp, Homo sapiens
cctacccctttctcc

SEQ ID NO: 4592821 - DNA, 16 bp, Homo sapiens
cctacccctttctcca

SEQ ID NO: 4592822 - DNA, 23 bp, Homo sapiens
cctactgtttaaattcccattcc

SEQ ID NO: 4592823 - DNA, 21 bp, Homo sapiens
cctagcatacgtacacatttt

SEQ ID NO: 4592824 - DNA, 12 bp, Homo sapiens
cctaggagacca

SEQ ID NO: 4592825 - DNA, 14 bp, Homo sapiens
cctcaactgcctac

SEQ ID NO: 4592826 - DNA, 21 bp, Homo sapiens
cctcaccttggcaccagacac

SEQ ID NO: 4592827 - DNA, 17 bp, Homo sapiens
cctcagaggccttggga

SEQ ID NO: 4592828 - DNA, 15 bp, Homo sapiens
cctcagcctggccag

SEQ ID NO: 4592829 - DNA, 17 bp, Homo sapiens
cctcagcctggccagac

SEQ ID NO: 4592830 - DNA, 18 bp, Homo sapiens
cctcagccttgccagaga

SEQ ID NO: 4592831 - DNA, 13 bp, Homo sapiens
cctcaggtgactt

SEQ ID NO: 4592832 - DNA, 20 bp, Homo sapiens
cctcatgtccactggttctt

SEQ ID NO: 4592833 - DNA, 21 bp, Homo sapiens
cctccaaggaggggctgtaaa

SEQ ID NO: 4592834 - DNA, 19 bp, Homo sapiens
cctcccaatttcagactcc

SEQ ID NO: 4592835 - DNA, 16 bp, Homo sapiens
cctcccccccatgcac

SEQ ID NO: 4592836 - DNA, 19 bp, Homo sapiens
cctccctgaagcctttgca

SEQ ID NO: 4592837 - DNA, 18 bp, Homo sapiens
cctccctgttccccagag

SEQ ID NO: 4592838 - DNA, 19 bp, Homo sapiens
cctccctgttccccagaga

SEQ ID NO: 4592839 - DNA, 20 bp, Homo sapiens
cctcctcccgactgaccact

SEQ ID NO: 4592840 - DNA, 13 bp, Homo sapiens
cctctcacccaga

SEQ ID NO: 4592841 - DNA, 16 bp, Homo sapiens
cctctccccagcccag

SEQ ID NO: 4592842 - DNA, 21 bp, Homo sapiens
cctctccccagcccagagaca

SEQ ID NO: 4592843 - DNA, 17 bp, Homo sapiens
cctctcttggaccctgg

SEQ ID NO: 4592844 - DNA, 18 bp, Homo sapiens
cctctgcctgacagcatc

SEQ ID NO: 4592845 - DNA, 21 bp, Homo sapiens
cctctgcctgacagcatcctc

SEQ ID NO: 4592846 - DNA, 22 bp, Homo sapiens
cctctgcctgacagcatcctct

SEQ ID NO: 4592847 - DNA, 12 bp, Homo sapiens
cctcttccagtc

SEQ ID NO: 4592848 - DNA, 17 bp, Homo sapiens
cctgaagaaccagtccc

SEQ ID NO: 4592849 - DNA, 13 bp, Homo sapiens
cctgacactttaa

SEQ ID NO: 4592850 - DNA, 16 bp, Homo sapiens
cctgacccctgctcag

SEQ ID NO: 4592851 - DNA, 18 bp, Homo sapiens
cctgactaaactaccacc

SEQ ID NO: 4592852 - DNA, 11 bp, Homo sapiens
cctgagcccca

SEQ ID NO: 4592853 - DNA, 21 bp, Homo sapiens
cctgagtcgtacagaaagctg

SEQ ID NO: 4592854 - DNA, 22 bp, Homo sapiens
cctgagtcgtacagaaagctgc

SEQ ID NO: 4592855 - DNA, 23 bp, Homo sapiens
cctgcctctcatcaactgaatga

SEQ ID NO: 4592856 - DNA, 11 bp, Homo sapiens
cctgctccaga

SEQ ID NO: 4592857 - DNA, 13 bp, Homo sapiens
cctggaacttggg

SEQ ID NO: 4592858 - DNA, 16 bp, Homo sapiens
cctggaacttggggag

SEQ ID NO: 4592859 - DNA, 13 bp, Homo sapiens
cctggaggcccag

SEQ ID NO: 4592860 - DNA, 21 bp, Homo sapiens
cctggcagctctggacagccc

SEQ ID NO: 4592861 - DNA, 13 bp, Homo sapiens
cctggccagacac

SEQ ID NO: 4592862 - DNA, 14 bp, Homo sapiens
cctggccagacaca

SEQ ID NO: 4592863 - DNA, 15 bp, Homo sapiens
cctggccagacacag

SEQ ID NO: 4592864 - DNA, 22 bp, Homo sapiens
cctggcccccgacccagctcta

SEQ ID NO: 4592865 - DNA, 21 bp, Homo sapiens
cctgggggctgggaggatcct

SEQ ID NO: 4592866 - DNA, 14 bp, Homo sapiens
cctggggtctggag

SEQ ID NO: 4592867 - DNA, 18 bp, Homo sapiens
cctggtatatccaaaagc

SEQ ID NO: 4592868 - DNA, 23 bp, Homo sapiens
cctggtgggccaacaaagaacac

SEQ ID NO: 4592869 - DNA, 13 bp, Homo sapiens
cctgtagtcctag

SEQ ID NO: 4592870 - DNA, 13 bp, Homo sapiens
cctgtccagctcc

SEQ ID NO: 4592871 - DNA, 15 bp, Homo sapiens
cctgtccagctccaa

SEQ ID NO: 4592872 - DNA, 17 bp, Homo sapiens
cctgtctctactaaaaa

SEQ ID NO: 4592873 - DNA, 13 bp, Homo sapiens
cctgttccccaga

SEQ ID NO: 4592874 - DNA, 17 bp, Homo sapiens
ccttactcttcttgaaa

SEQ ID NO: 4592875 - DNA, 19 bp, Homo sapiens
ccttcaagaactctgggct

SEQ ID NO: 4592876 - DNA, 21 bp, Homo sapiens
ccttcagtcttgaatttctaa

SEQ ID NO: 4592877 - DNA, 14 bp, Homo sapiens
ccttccccatcctg

SEQ ID NO: 4592878 - DNA, 17 bp, Homo sapiens
ccttctcttcacagtca

SEQ ID NO: 4592879 - DNA, 20 bp, Homo sapiens
ccttgaaaactttatgctaa

SEQ ID NO: 4592880 - DNA, 17 bp, Homo sapiens
ccttgccacattaaatt

SEQ ID NO: 4592881 - DNA, 13 bp, Homo sapiens
ccttgccagagat

SEQ ID NO: 4592882 - DNA, 18 bp, Homo sapiens
ccttggacattttatgtc

SEQ ID NO: 4592883 - DNA, 21 bp, Homo sapiens
ccttggacattttatgtcttt

SEQ ID NO: 4592884 - DNA, 22 bp, Homo sapiens
ccttggcaccagacacccagga

SEQ ID NO: 4592885 - DNA, 18 bp, Homo sapiens
ccttggctcaatcctcta

SEQ ID NO: 4592886 - DNA, 13 bp, Homo sapiens
ccttgtttaatgg

SEQ ID NO: 4592887 - DNA, 20 bp, Homo sapiens
cctttgtattctctcctgta

SEQ ID NO: 4592888 - DNA, 22 bp, Homo sapiens
cctttgtattctctcctgtacc

SEQ ID NO: 4592889 - DNA, 18 bp, Homo sapiens
ccttttttatacataaac

SEQ ID NO: 4592890 - DNA, 16 bp, Homo sapiens
cgacagtgagactctg

SEQ ID NO: 4592891 - DNA, 20 bp, Homo sapiens
cgatttctgtttagataata

SEQ ID NO: 4592892 - DNA, 11 bp, Homo sapiens
cgcaatgtgac

SEQ ID NO: 4592893 - DNA, 17 bp, Homo sapiens
cgcctgtagtcctagcc

SEQ ID NO: 4592894 - DNA, 20 bp, Homo sapiens
cgcctgtagtcctagccact

SEQ ID NO: 4592895 - DNA, 21 bp, Homo sapiens
cgcgctgtgtaaatgctccag

SEQ ID NO: 4592896 - DNA, 20 bp, Homo sapiens
cgctactatgatttaatttg

SEQ ID NO: 4592897 - DNA, 14 bp, Homo sapiens
cgctttcctgaatc

SEQ ID NO: 4592898 - DNA, 20 bp, Homo sapiens
cggaaaacatgctacacact

SEQ ID NO: 4592899 - DNA, 15 bp, Homo sapiens
cgggaacagacaaca

SEQ ID NO: 4592900 - DNA, 14 bp, Homo sapiens
cgggagcatctctt

SEQ ID NO: 4592901 - DNA, 15 bp, Homo sapiens
cgtcaccctgggagc

SEQ ID NO: 4592902 - DNA, 20 bp, Homo sapiens
cgtgggaaaggggagtaggt

SEQ ID NO: 4592903 - DNA, 14 bp, Homo sapiens
cgtgtttctgactc

SEQ ID NO: 4592904 - DNA, 15 bp, Homo sapiens
cgtgtttctgactct

SEQ ID NO: 4592905 - DNA, 21 bp, Homo sapiens
cgtttctaaaggctacctttg

SEQ ID NO: 4592906 - DNA, 15 bp, Homo sapiens
cgttttggaagctct

SEQ ID NO: 4592907 - DNA, 15 bp, Homo sapiens
ctaaactaccacctc

SEQ ID NO: 4592908 - DNA, 19 bp, Homo sapiens
ctaaactaccacctcaggt

SEQ ID NO: 4592909 - DNA, 16 bp, Homo sapiens
ctaaaggctacctttg

SEQ ID NO: 4592910 - DNA, 22 bp, Homo sapiens
ctaaagggactacctctgtgcc

SEQ ID NO: 4592911 - DNA, 23 bp, Homo sapiens
ctaaagggactacctctgtgcct

SEQ ID NO: 4592912 - DNA, 19 bp, Homo sapiens
ctaaagtgtatttttttac

SEQ ID NO: 4592913 - DNA, 12 bp, Homo sapiens
ctaaataaagac

SEQ ID NO: 4592914 - DNA, 16 bp, Homo sapiens
ctaaatggaaccactc

SEQ ID NO: 4592915 - DNA, 18 bp, Homo sapiens
ctaaatggaaccactcta

SEQ ID NO: 4592916 - DNA, 18 bp, Homo sapiens
ctaaatggtcgcccagga

SEQ ID NO: 4592917 - DNA, 17 bp, Homo sapiens
ctaaccagcagaaatgc

SEQ ID NO: 4592918 - DNA, 20 bp, Homo sapiens
ctaacgaagtatccttcagc

SEQ ID NO: 4592919 - DNA, 15 bp, Homo sapiens
ctaacttcaccatat

SEQ ID NO: 4592920 - DNA, 16 bp, Homo sapiens
ctaagaacctggaact

SEQ ID NO: 4592921 - DNA, 15 bp, Homo sapiens
ctaagcaaaatgtga

SEQ ID NO: 4592922 - DNA, 18 bp, Homo sapiens
ctaagcaaaatgtgatat

SEQ ID NO: 4592923 - DNA, 23 bp, Homo sapiens
ctaagtgaaataagccagacatc

SEQ ID NO: 4592924 - DNA, 23 bp, Homo sapiens
ctaatacagcaacaatttatgaa

SEQ ID NO: 4592925 - DNA, 17 bp, Homo sapiens
ctaatccaggcagatcc

SEQ ID NO: 4592926 - DNA, 18 bp, Homo sapiens
ctaatccaggcagatcca

SEQ ID NO: 4592927 - DNA, 19 bp, Homo sapiens
ctaatccaggcagatccag

SEQ ID NO: 4592928 - DNA, 20 bp, Homo sapiens
ctaatccaggcagatccagg

SEQ ID NO: 4592929 - DNA, 21 bp, Homo sapiens
ctaattttccataagctattt

SEQ ID NO: 4592930 - DNA, 13 bp, Homo sapiens
ctaccacctcagg

SEQ ID NO: 4592931 - DNA, 18 bp, Homo sapiens
ctaccacctcaggtgact

SEQ ID NO: 4592932 - DNA, 19 bp, Homo sapiens
ctaccacctcaggtgactt

SEQ ID NO: 4592933 - DNA, 16 bp, Homo sapiens
ctacccaaccagggcc

SEQ ID NO: 4592934 - DNA, 14 bp, Homo sapiens
ctacccacttctaa

SEQ ID NO: 4592935 - DNA, 16 bp, Homo sapiens
ctacccacttctaaat

SEQ ID NO: 4592936 - DNA, 22 bp, Homo sapiens
ctacccacttctaaatagcaat

SEQ ID NO: 4592937 - DNA, 17 bp, Homo sapiens
ctactgtaatttgtgat

SEQ ID NO: 4592938 - DNA, 18 bp, Homo sapiens
ctacttgggaggctgaga

SEQ ID NO: 4592939 - DNA, 14 bp, Homo sapiens
ctagagcctctgcc

SEQ ID NO: 4592940 - DNA, 22 bp, Homo sapiens
ctagaggagggggcaggctgag

SEQ ID NO: 4592941 - DNA, 15 bp, Homo sapiens
ctagaggttcaaaga

SEQ ID NO: 4592942 - DNA, 13 bp, Homo sapiens
ctagatactgtat

SEQ ID NO: 4592943 - DNA, 24 bp, Homo sapiens
ctagatactgtatcatgacaaaga

SEQ ID NO: 4592944 - DNA, 18 bp, Homo sapiens
ctagcatacgtacacatt

SEQ ID NO: 4592945 - DNA, 19 bp, Homo sapiens
ctagcatacgtacacattt

SEQ ID NO: 4592946 - DNA, 20 bp, Homo sapiens
ctagcatacgtacacatttt

SEQ ID NO: 4592947 - DNA, 21 bp, Homo sapiens
ctagcatacgtacacatttta

SEQ ID NO: 4592948 - DNA, 19 bp, Homo sapiens
ctagcatttcccaacacaa

SEQ ID NO: 4592949 - DNA, 16 bp, Homo sapiens
ctaggagaccaaggcg

SEQ ID NO: 4592950 - DNA, 20 bp, Homo sapiens
ctaggagaccaaggcgggag

SEQ ID NO: 4592951 - DNA, 15 bp, Homo sapiens
ctagtatcaaaagaa

SEQ ID NO: 4592952 - DNA, 17 bp, Homo sapiens
ctagtatcaaaagaaag

SEQ ID NO: 4592953 - DNA, 12 bp, Homo sapiens
ctatatttgggc

SEQ ID NO: 4592954 - DNA, 22 bp, Homo sapiens
ctatatttgggcctgctccaga

SEQ ID NO: 4592955 - DNA, 20 bp, Homo sapiens
ctatattttttgttaaatga

SEQ ID NO: 4592956 - DNA, 22 bp, Homo sapiens
ctggaacccagactcagacatt

SEQ ID NO: 4592957 - DNA, 16 bp, Homo sapiens
ctggaacctcagcctg

SEQ ID NO: 4592958 - DNA, 17 bp, Homo sapiens
ctggaacctcagcctgg

SEQ ID NO: 4592959 - DNA, 22 bp, Homo sapiens
ctggaacctcagcctggccaga

SEQ ID NO: 4592960 - DNA, 14 bp, Homo sapiens
ctggacagccccac

SEQ ID NO: 4592961 - DNA, 16 bp, Homo sapiens
ctggacagccccaccc

SEQ ID NO: 4592962 - DNA, 18 bp, Homo sapiens
ctggacagccccaccctg

SEQ ID NO: 4592963 - DNA, 14 bp, Homo sapiens
ctggaggcccagtt

SEQ ID NO: 4592964 - DNA, 18 bp, Homo sapiens
ctggagttgatctggaac

SEQ ID NO: 4592965 - DNA, 17 bp, Homo sapiens
ctggcaacatctttatc

SEQ ID NO: 4592966 - DNA, 21 bp, Homo sapiens
ctggcacggtggctcaggcct

SEQ ID NO: 4592967 - DNA, 12 bp, Homo sapiens
ctggcagctctg

SEQ ID NO: 4592968 - DNA, 18 bp, Homo sapiens
ctggcagctctggacagc

SEQ ID NO: 4592969 - DNA, 20 bp, Homo sapiens
ctggcagctctggacagccc

SEQ ID NO: 4592970 - DNA, 15 bp, Homo sapiens
ctggccagacacagg

SEQ ID NO: 4592971 - DNA, 18 bp, Homo sapiens
ctggccagacacaggccc

SEQ ID NO: 4592972 - DNA, 17 bp, Homo sapiens
ctggcctagcatacgta

SEQ ID NO: 4592973 - DNA, 23 bp, Homo sapiens
ctggcctagcatacgtacacatt

SEQ ID NO: 4592974 - DNA, 16 bp, Homo sapiens
ctggctatgcatttga

SEQ ID NO: 4592975 - DNA, 18 bp, Homo sapiens
ctgggaggatcctggaga

SEQ ID NO: 4592976 - DNA, 15 bp, Homo sapiens
ctggggccaaataaa

SEQ ID NO: 4592977 - DNA, 16 bp, Homo sapiens
ctggggccaaataaag

SEQ ID NO: 4592978 - DNA, 22 bp, Homo sapiens
ctgggggggattgtaaaatggt

SEQ ID NO: 4592979 - DNA, 14 bp, Homo sapiens
ctggggttgccctg

SEQ ID NO: 4592980 - DNA, 18 bp, Homo sapiens
ctggtatatccaaaagct

SEQ ID NO: 4592981 - DNA, 20 bp, Homo sapiens
ctggtatatccaaaagcttt

SEQ ID NO: 4592982 - DNA, 15 bp, Homo sapiens
ctggtccaaaagatt

SEQ ID NO: 4592983 - DNA, 15 bp, Homo sapiens
ctggtgaagctcact

SEQ ID NO: 4592984 - DNA, 20 bp, Homo sapiens
ctggtgaagctcacttctgg

SEQ ID NO: 4592985 - DNA, 21 bp, Homo sapiens
ctgtaatttgtgatacaatgc

SEQ ID NO: 4592986 - DNA, 22 bp, Homo sapiens
ctgtacatgaaaacacattttt

SEQ ID NO: 4592987 - DNA, 23 bp, Homo sapiens
ctgtacatgaaaacacatttttc

SEQ ID NO: 4592988 - DNA, 22 bp, Homo sapiens
ctgtaggcctcaggtgaaactc

SEQ ID NO: 4592989 - DNA, 15 bp, Homo sapiens
ctgtatataaaggtg

SEQ ID NO: 4592990 - DNA, 12 bp, Homo sapiens
ctgtccagctcc

SEQ ID NO: 4592991 - DNA, 21 bp, Homo sapiens
ctgtcctattatattcattct

SEQ ID NO: 4592992 - DNA, 14 bp, Homo sapiens
ctgtcctcagcctt

SEQ ID NO: 4592993 - DNA, 22 bp, Homo sapiens
ctgtcctcagccttgccagaga

SEQ ID NO: 4592994 - DNA, 14 bp, Homo sapiens
ctgtcttaattttc

SEQ ID NO: 4592995 - DNA, 14 bp, Homo sapiens
ctgtcttggctgtg

SEQ ID NO: 4592996 - DNA, 15 bp, Homo sapiens
ctgtgcctgaatatt

SEQ ID NO: 4592997 - DNA, 17 bp, Homo sapiens
ctgtgcgttactaattg

SEQ ID NO: 4592998 - DNA, 18 bp, Homo sapiens
ctgtgtaaatgctccagc

SEQ ID NO: 4592999 - DNA, 19 bp, Homo sapiens
ctgtgtaaatgctccagca

SEQ ID NO: 4593000 - DNA, 22 bp, Homo sapiens
ctgtgtaaatgctccagcactc

SEQ ID NO: 4593001 - DNA, 17 bp, Homo sapiens
ctgtgtacataactgaa

SEQ ID NO: 4593002 - DNA, 19 bp, Homo sapiens
ctgtgtttagctatttaat

SEQ ID NO: 4593003 - DNA, 13 bp, Homo sapiens
ctgttccccagag

SEQ ID NO: 4593004 - DNA, 20 bp, Homo sapiens
ctgttctacatagatgctta

SEQ ID NO: 4593005 - DNA, 19 bp, Homo sapiens
ctgttctttccaaagtaca

SEQ ID NO: 4593006 - DNA, 21 bp, Homo sapiens
ctgttctttctggctatgcat

SEQ ID NO: 4593007 - DNA, 22 bp, Homo sapiens
ctgttggaggtgagtggcctgt

SEQ ID NO: 4593008 - DNA, 12 bp, Homo sapiens
ctgtttttcaca

SEQ ID NO: 4593009 - DNA, 15 bp, Homo sapiens
cttaaaccttcagtt

SEQ ID NO: 4593010 - DNA, 23 bp, Homo sapiens
cttaaaccttcagttatgatttt

SEQ ID NO: 4593011 - DNA, 14 bp, Homo sapiens
cttaaataatgtga

SEQ ID NO: 4593012 - DNA, 19 bp, Homo sapiens
cttaaataatgtgaaactg

SEQ ID NO: 4593013 - DNA, 14 bp, Homo sapiens
cttaacttcacata

SEQ ID NO: 4593014 - DNA, 22 bp, Homo sapiens
cttaacttcacatattgatttc

SEQ ID NO: 4593015 - DNA, 19 bp, Homo sapiens
cttaagttagttccactga

SEQ ID NO: 4593016 - DNA, 13 bp, Homo sapiens
cttacctttttat

SEQ ID NO: 4593017 - DNA, 20 bp, Homo sapiens
cttacctttttatttgcatg

SEQ ID NO: 4593018 - DNA, 15 bp, Homo sapiens
cttactcttcttgaa

SEQ ID NO: 4593019 - DNA, 19 bp, Homo sapiens
cttactgatatattttaca

SEQ ID NO: 4593020 - DNA, 23 bp, Homo sapiens
cttagctcattctccttgtgtta

SEQ ID NO: 4593021 - DNA, 18 bp, Homo sapiens
cttattggaactctgctt

SEQ ID NO: 4593022 - DNA, 16 bp, Homo sapiens
cttattttcatgtata

SEQ ID NO: 4593023 - DNA, 23 bp, Homo sapiens
cttcacatattgatttccgttaa

SEQ ID NO: 4593024 - DNA, 15 bp, Homo sapiens
cttcagcctgaaaga

SEQ ID NO: 4593025 - DNA, 12 bp, Homo sapiens
cttcataatcca

SEQ ID NO: 4593026 - DNA, 23 bp, Homo sapiens
cttcatggatgggggaactcaga

SEQ ID NO: 4593027 - DNA, 15 bp, Homo sapiens
cttccacacttctgg

SEQ ID NO: 4593028 - DNA, 17 bp, Homo sapiens
cttccacacttctgggc

SEQ ID NO: 4593029 - DNA, 22 bp, Homo sapiens
cttcccagttcaggagtcccaa

SEQ ID NO: 4593030 - DNA, 15 bp, Homo sapiens
cttcctgacacttta

SEQ ID NO: 4593031 - DNA, 18 bp, Homo sapiens
cttcctgacactttaatt

SEQ ID NO: 4593032 - DNA, 18 bp, Homo sapiens
cttcctgtttttcacatt

SEQ ID NO: 4593033 - DNA, 16 bp, Homo sapiens
cttcgtttattttcaa

SEQ ID NO: 4593034 - DNA, 17 bp, Homo sapiens
cttctgaactcaaactg

SEQ ID NO: 4593035 - DNA, 13 bp, Homo sapiens
cttctgactgctg

SEQ ID NO: 4593036 - DNA, 21 bp, Homo sapiens
cttctgactgctgattctccc

SEQ ID NO: 4593037 - DNA, 20 bp, Homo sapiens
cttctgagctatttcatcta

SEQ ID NO: 4593038 - DNA, 14 bp, Homo sapiens
cttctgccttctca

SEQ ID NO: 4593039 - DNA, 17 bp, Homo sapiens
cttgaaattttaaccta

SEQ ID NO: 4593040 - DNA, 21 bp, Homo sapiens
cttgaactttgacctctgcag

SEQ ID NO: 4593041 - DNA, 15 bp, Homo sapiens
cttgaagggccagag

SEQ ID NO: 4593042 - DNA, 20 bp, Homo sapiens
cttgaagggccagagccagg

SEQ ID NO: 4593043 - DNA, 15 bp, Homo sapiens
cttgagcccaggagt

SEQ ID NO: 4593044 - DNA, 17 bp, Homo sapiens
cttgagccttgaacttt

SEQ ID NO: 4593045 - DNA, 20 bp, Homo sapiens
cttgcaagcaacaagctatt

SEQ ID NO: 4593046 - DNA, 19 bp, Homo sapiens
cttgccacattaaattgat

SEQ ID NO: 4593047 - DNA, 12 bp, Homo sapiens
cttgccagagat

SEQ ID NO: 4593048 - DNA, 18 bp, Homo sapiens
cttgccctggtgcctcac

SEQ ID NO: 4593049 - DNA, 16 bp, Homo sapiens
cttggacattttatgt

SEQ ID NO: 4593050 - DNA, 17 bp, Homo sapiens
cttggctgtggggctag

SEQ ID NO: 4593051 - DNA, 13 bp, Homo sapiens
cttgggaatttta

SEQ ID NO: 4593052 - DNA, 21 bp, Homo sapiens
cttggggagttaagacctggc

SEQ ID NO: 4593053 - DNA, 21 bp, Homo sapiens
cttgggtgcggtttgctcagc

SEQ ID NO: 4593054 - DNA, 16 bp, Homo sapiens
cttgtaactaaaataa

SEQ ID NO: 4593055 - DNA, 15 bp, Homo sapiens
cttgtacataatgcg

SEQ ID NO: 4593056 - DNA, 12 bp, Homo sapiens
ctttaaggaaaa

SEQ ID NO: 4593057 - DNA, 18 bp, Homo sapiens
ctttaattaccaacctgt

SEQ ID NO: 4593058 - DNA, 22 bp, Homo sapiens
ctttaccttttttatacataaa

SEQ ID NO: 4593059 - DNA, 13 bp, Homo sapiens
ctttactatggcc

SEQ ID NO: 4593060 - DNA, 19 bp, Homo sapiens
ctttcaattgtcacttttt

SEQ ID NO: 4593061 - DNA, 16 bp, Homo sapiens
ctttcatattttaaac

SEQ ID NO: 4593062 - DNA, 23 bp, Homo sapiens
ctttcatattttaaacagaggat

SEQ ID NO: 4593063 - DNA, 14 bp, Homo sapiens
ctttcatttgcttt

SEQ ID NO: 4593064 - DNA, 18 bp, Homo sapiens
ctttcatttgctttggaa

SEQ ID NO: 4593065 - DNA, 19 bp, Homo sapiens
ctttcctcaaaacttcaga

SEQ ID NO: 4593066 - DNA, 22 bp, Homo sapiens
ctttcctgaatccaaactaatc

SEQ ID NO: 4593067 - DNA, 21 bp, Homo sapiens
ctttctcagccgcttctgact

SEQ ID NO: 4593068 - DNA, 20 bp, Homo sapiens
ctttctcagttttcataagt

SEQ ID NO: 4593069 - DNA, 19 bp, Homo sapiens
ctttctggctatgcatttg

SEQ ID NO: 4593070 - DNA, 17 bp, Homo sapiens
ctttgacctctgcagca

SEQ ID NO: 4593071 - DNA, 20 bp, Homo sapiens
ctttgacctctgcagcaata

SEQ ID NO: 4593072 - DNA, 14 bp, Homo sapiens
ctttgactttttgc

SEQ ID NO: 4593073 - DNA, 15 bp, Homo sapiens
ctttgactttttgca

SEQ ID NO: 4593074 - DNA, 15 bp, Homo sapiens
ctttgcccagaaaga

SEQ ID NO: 4593075 - DNA, 21 bp, Homo sapiens
ctttgggccagacatgccaca

SEQ ID NO: 4593076 - DNA, 17 bp, Homo sapiens
ctttgtattctctcctg

SEQ ID NO: 4593077 - DNA, 12 bp, Homo sapiens
ctttgtgatttt

SEQ ID NO: 4593078 - DNA, 14 bp, Homo sapiens
ctttgtgatttttg

SEQ ID NO: 4593079 - DNA, 19 bp, Homo sapiens
ctttgtgatttttgtaatt

SEQ ID NO: 4593080 - DNA, 13 bp, Homo sapiens
cttttataaactt

SEQ ID NO: 4593081 - DNA, 16 bp, Homo sapiens
cttttataaactttac

SEQ ID NO: 4593082 - DNA, 15 bp, Homo sapiens
cttttcttaaacctt

SEQ ID NO: 4593083 - DNA, 12 bp, Homo sapiens
cttttgtgcatt

SEQ ID NO: 4593084 - DNA, 13 bp, Homo sapiens
cttttgtgcatta

SEQ ID NO: 4593085 - DNA, 14 bp, Homo sapiens
cttttgtgcattat

SEQ ID NO: 4593086 - DNA, 13 bp, Homo sapiens
ctttttatttgca

SEQ ID NO: 4593087 - DNA, 14 bp, Homo sapiens
ctttttgaaatgtc

SEQ ID NO: 4593088 - DNA, 17 bp, Homo sapiens
cttttttatacataaac

SEQ ID NO: 4593089 - DNA, 15 bp, Homo sapiens
cttttttttttcatt

SEQ ID NO: 4593090 - DNA, 17 bp, Homo sapiens
gatatttttatctttat

SEQ ID NO: 4593091 - DNA, 19 bp, Homo sapiens
gatcacagtggccacggcc

SEQ ID NO: 4593092 - DNA, 13 bp, Homo sapiens
gatccagggacag

SEQ ID NO: 4593093 - DNA, 19 bp, Homo sapiens
gatccctcccccccatgca

SEQ ID NO: 4593094 - DNA, 23 bp, Homo sapiens
gatccctcccccccatgcactgt

SEQ ID NO: 4593095 - DNA, 19 bp, Homo sapiens
gatcctgtctttaaggaaa

SEQ ID NO: 4593096 - DNA, 15 bp, Homo sapiens
gatctctaacttcac

SEQ ID NO: 4593097 - DNA, 15 bp, Homo sapiens
gatctggaacccaga

SEQ ID NO: 4593098 - DNA, 16 bp, Homo sapiens
gatctggaacccagac

SEQ ID NO: 4593099 - DNA, 18 bp, Homo sapiens
gatctggaacccagactc

SEQ ID NO: 4593100 - DNA, 16 bp, Homo sapiens
gatctggaacctcagc

SEQ ID NO: 4593101 - DNA, 18 bp, Homo sapiens
gatctggaacctcagcct

SEQ ID NO: 4593102 - DNA, 22 bp, Homo sapiens
gatgaatgtcagttgttattta

SEQ ID NO: 4593103 - DNA, 12 bp, Homo sapiens
gatgctgcccct

SEQ ID NO: 4593104 - DNA, 14 bp, Homo sapiens
gatgctggcccagg

SEQ ID NO: 4593105 - DNA, 15 bp, Homo sapiens
gatgctggcccaggg

SEQ ID NO: 4593106 - DNA, 22 bp, Homo sapiens
gatggcaacagatctggaacct

SEQ ID NO: 4593107 - DNA, 13 bp, Homo sapiens
gatgtaattttgt

SEQ ID NO: 4593108 - DNA, 15 bp, Homo sapiens
gattaaacttaatct

SEQ ID NO: 4593109 - DNA, 14 bp, Homo sapiens
gattaccagggact

SEQ ID NO: 4593110 - DNA, 18 bp, Homo sapiens
gattcaatctgtaaactg

SEQ ID NO: 4593111 - DNA, 19 bp, Homo sapiens
gattcaatctgtaaactgt

SEQ ID NO: 4593112 - DNA, 20 bp, Homo sapiens
gattcaatctgtaaactgtg

SEQ ID NO: 4593113 - DNA, 18 bp, Homo sapiens
gattcatattgcatcata

SEQ ID NO: 4593114 - DNA, 17 bp, Homo sapiens
gattctatgttaatatt

SEQ ID NO: 4593115 - DNA, 23 bp, Homo sapiens
gattctgaccttaaatgcaacca

SEQ ID NO: 4593116 - DNA, 23 bp, Homo sapiens
gattgacgggactgttggtattg

SEQ ID NO: 4593117 - DNA, 16 bp, Homo sapiens
gattgcttgagcccag

SEQ ID NO: 4593118 - DNA, 16 bp, Homo sapiens
gatttaatttgaaata

SEQ ID NO: 4593119 - DNA, 22 bp, Homo sapiens
gatttctgtttagataatacac

SEQ ID NO: 4593120 - DNA, 15 bp, Homo sapiens
gatttttttttcata

SEQ ID NO: 4593121 - DNA, 21 bp, Homo sapiens
gcaaaaccactagaactctcc

SEQ ID NO: 4593122 - DNA, 21 bp, Homo sapiens
gcaaagatctgtcctcagcct

SEQ ID NO: 4593123 - DNA, 16 bp, Homo sapiens
gcaacagatctggaac

SEQ ID NO: 4593124 - DNA, 17 bp, Homo sapiens
gcaacagatctggaacc

SEQ ID NO: 4593125 - DNA, 19 bp, Homo sapiens
gcaaccaataaaagccaga

SEQ ID NO: 4593126 - DNA, 15 bp, Homo sapiens
gcaaggaaggaaaga

SEQ ID NO: 4593127 - DNA, 14 bp, Homo sapiens
gcaaggtcattttt

SEQ ID NO: 4593128 - DNA, 21 bp, Homo sapiens
gcaataaatctgacccagtgc

SEQ ID NO: 4593129 - DNA, 12 bp, Homo sapiens
gcacacattttt

SEQ ID NO: 4593130 - DNA, 14 bp, Homo sapiens
gcacacatttttta

SEQ ID NO: 4593131 - DNA, 22 bp, Homo sapiens
gcacagagttgttacattttta

SEQ ID NO: 4593132 - DNA, 19 bp, Homo sapiens
gcacagtgcagcaagcctg

SEQ ID NO: 4593133 - DNA, 19 bp, Homo sapiens
gcacatcagcacgatttct

SEQ ID NO: 4593134 - DNA, 20 bp, Homo sapiens
gcacatcagcacgatttctg

SEQ ID NO: 4593135 - DNA, 23 bp, Homo sapiens
gcacatcagcacgatttctgttt

SEQ ID NO: 4593136 - DNA, 15 bp, Homo sapiens
gcaccagacacccag

SEQ ID NO: 4593137 - DNA, 16 bp, Homo sapiens
gcaccagacacccagg

SEQ ID NO: 4593138 - DNA, 19 bp, Homo sapiens
gcaccagacacccaggact

SEQ ID NO: 4593139 - DNA, 20 bp, Homo sapiens
gcaccagacacccaggactt

SEQ ID NO: 4593140 - DNA, 15 bp, Homo sapiens
gcacctaatccaggc

SEQ ID NO: 4593141 - DNA, 17 bp, Homo sapiens
gcacctaatccaggcag

SEQ ID NO: 4593142 - DNA, 18 bp, Homo sapiens
gcacctaatccaggcaga

SEQ ID NO: 4593143 - DNA, 18 bp, Homo sapiens
gcacctggaatatataac

SEQ ID NO: 4593144 - DNA, 21 bp, Homo sapiens
gcacctggaatatataaccag

SEQ ID NO: 4593145 - DNA, 15 bp, Homo sapiens
gcacgatttctgttt

SEQ ID NO: 4593146 - DNA, 16 bp, Homo sapiens
gcacgatttctgttta

SEQ ID NO: 4593147 - DNA, 19 bp, Homo sapiens
gcactaatttgatgtttac

SEQ ID NO: 4593148 - DNA, 13 bp, Homo sapiens
gcactcaataaag

SEQ ID NO: 4593149 - DNA, 17 bp, Homo sapiens
gcactccagcctgggca

SEQ ID NO: 4593150 - DNA, 13 bp, Homo sapiens
gcactgatgctgc

SEQ ID NO: 4593151 - DNA, 18 bp, Homo sapiens
gcactgatgctgcccctc

SEQ ID NO: 4593152 - DNA, 17 bp, Homo sapiens
gcactgtgaaggaccct

SEQ ID NO: 4593153 - DNA, 22 bp, Homo sapiens
gcagaacagtgattaccaggga

SEQ ID NO: 4593154 - DNA, 14 bp, Homo sapiens
gcagaagacagtat

SEQ ID NO: 4593155 - DNA, 18 bp, Homo sapiens
gcagaataatctttgggt

SEQ ID NO: 4593156 - DNA, 18 bp, Homo sapiens
gcagataaacagtagtga

SEQ ID NO: 4593157 - DNA, 17 bp, Homo sapiens
gcagcaagcctggcccc

SEQ ID NO: 4593158 - DNA, 16 bp, Homo sapiens
gcagcaataaagcagc

SEQ ID NO: 4593159 - DNA, 23 bp, Homo sapiens
gcagcaataaagcagcgtttcta

SEQ ID NO: 4593160 - DNA, 15 bp, Homo sapiens
gcagcacagctgaga

SEQ ID NO: 4593161 - DNA, 20 bp, Homo sapiens
gcagctctggacagccccac

SEQ ID NO: 4593162 - DNA, 19 bp, Homo sapiens
gcagggacttgaacccata

SEQ ID NO: 4593163 - DNA, 13 bp, Homo sapiens
gcagtaataaaaa

SEQ ID NO: 4593164 - DNA, 23 bp, Homo sapiens
gcagtacatgggtgactatctcc

SEQ ID NO: 4593165 - DNA, 18 bp, Homo sapiens
gcagtcctggaagccagc

SEQ ID NO: 4593166 - DNA, 20 bp, Homo sapiens
gcagtcctggaagccagctt

SEQ ID NO: 4593167 - DNA, 21 bp, Homo sapiens
gcagtggtggttttctgttct

SEQ ID NO: 4593168 - DNA, 22 bp, Homo sapiens
gcagtggtggttttctgttctt

SEQ ID NO: 4593169 - DNA, 14 bp, Homo sapiens
gcatacgtacacat

SEQ ID NO: 4593170 - DNA, 16 bp, Homo sapiens
gcatacgtacacattt

SEQ ID NO: 4593171 - DNA, 14 bp, Homo sapiens
gcatctcttgaggc

SEQ ID NO: 4593172 - DNA, 16 bp, Homo sapiens
gcatctcttgaggcca

SEQ ID NO: 4593173 - DNA, 20 bp, Homo sapiens
gcatctcttgaggccaggag

SEQ ID NO: 4593174 - DNA, 21 bp, Homo sapiens
gcatctcttgaggccaggagt

SEQ ID NO: 4593175 - DNA, 18 bp, Homo sapiens
gcatgaagtaatatgcac

SEQ ID NO: 4593176 - DNA, 20 bp, Homo sapiens
gcatgaagtaatatgcacac

SEQ ID NO: 4593177 - DNA, 17 bp, Homo sapiens
gcatggtgccccaggac

SEQ ID NO: 4593178 - DNA, 19 bp, Homo sapiens
gcatggtgccccaggacca

SEQ ID NO: 4593179 - DNA, 20 bp, Homo sapiens
gcatggtgccccaggaccag

SEQ ID NO: 4593180 - DNA, 17 bp, Homo sapiens
gcatgtttgtgattgac

SEQ ID NO: 4593181 - DNA, 19 bp, Homo sapiens
gcattatctagatactgta

SEQ ID NO: 4593182 - DNA, 22 bp, Homo sapiens
gcattatctagatactgtatca

SEQ ID NO: 4593183 - DNA, 20 bp, Homo sapiens
gcattgtaaaagcattttgt

SEQ ID NO: 4593184 - DNA, 20 bp, Homo sapiens
gcatttgaggtctgttcttt

SEQ ID NO: 4593185 - DNA, 21 bp, Homo sapiens
gccaagatcacagtggccacg

SEQ ID NO: 4593186 - DNA, 20 bp, Homo sapiens
gccactcaggaggctgaggc

SEQ ID NO: 4593187 - DNA, 17 bp, Homo sapiens
gccagacacaggccctc

SEQ ID NO: 4593188 - DNA, 13 bp, Homo sapiens
gccagagatccaa

SEQ ID NO: 4593189 - DNA, 23 bp, Homo sapiens
gccagagatccaaaagaagcccc

SEQ ID NO: 4593190 - DNA, 11 bp, Homo sapiens
gccagatccag

SEQ ID NO: 4593191 - DNA, 14 bp, Homo sapiens
gccagctgcactga

SEQ ID NO: 4593192 - DNA, 20 bp, Homo sapiens
gccagctgcactgatgctgc

SEQ ID NO: 4593193 - DNA, 17 bp, Homo sapiens
gccaggaatttcccagg

SEQ ID NO: 4593194 - DNA, 18 bp, Homo sapiens
gccaggaatttcccagga

SEQ ID NO: 4593195 - DNA, 15 bp, Homo sapiens
gccagggagaagctc

SEQ ID NO: 4593196 - DNA, 16 bp, Homo sapiens
gccagggagaagctcc

SEQ ID NO: 4593197 - DNA, 20 bp, Homo sapiens
gccaggggggtgaggagctg

SEQ ID NO: 4593198 - DNA, 22 bp, Homo sapiens
gccaggggggtgaggagctggg

SEQ ID NO: 4593199 - DNA, 14 bp, Homo sapiens
gccatattccgcac

SEQ ID NO: 4593200 - DNA, 19 bp, Homo sapiens
gccatgatggcaacagatc

SEQ ID NO: 4593201 - DNA, 14 bp, Homo sapiens
gcccaatgaaatga

SEQ ID NO: 4593202 - DNA, 15 bp, Homo sapiens
gcccactgtcctggg

SEQ ID NO: 4593203 - DNA, 18 bp, Homo sapiens
gcccactgtcctgggcct

SEQ ID NO: 4593204 - DNA, 20 bp, Homo sapiens
gcccagagacatacttgaag

SEQ ID NO: 4593205 - DNA, 23 bp, Homo sapiens
gcccagagacatacttgaagggc

SEQ ID NO: 4593206 - DNA, 16 bp, Homo sapiens
gcccagagcccagctc

SEQ ID NO: 4593207 - DNA, 20 bp, Homo sapiens
gcccagggcccagagcccag

SEQ ID NO: 4593208 - DNA, 21 bp, Homo sapiens
gcccagggcccagagcccagc

SEQ ID NO: 4593209 - DNA, 23 bp, Homo sapiens
gcccagggcccagagcccagctc

SEQ ID NO: 4593210 - DNA, 19 bp, Homo sapiens
gcccagttcaccctgattt

SEQ ID NO: 4593211 - DNA, 11 bp, Homo sapiens
gccccaggacc

SEQ ID NO: 4593212 - DNA, 14 bp, Homo sapiens
gccccaggaccagc

SEQ ID NO: 4593213 - DNA, 17 bp, Homo sapiens
gcccccactgaccagaa

SEQ ID NO: 4593214 - DNA, 21 bp, Homo sapiens
gcccccagctaagaacctgga

SEQ ID NO: 4593215 - DNA, 23 bp, Homo sapiens
gcccccagctaagaacctggaac

SEQ ID NO: 4593216 - DNA, 21 bp, Homo sapiens
gcccctcatctctctgcccaa

SEQ ID NO: 4593217 - DNA, 20 bp, Homo sapiens
gccctccctgttccccagag

SEQ ID NO: 4593218 - DNA, 19 bp, Homo sapiens
gccctgactaaactaccac

SEQ ID NO: 4593219 - DNA, 21 bp, Homo sapiens
gccctgggggataccagctga

SEQ ID NO: 4593220 - DNA, 16 bp, Homo sapiens
gcccttccccatcctg

SEQ ID NO: 4593221 - DNA, 17 bp, Homo sapiens
gccgtcaccctgggagc

SEQ ID NO: 4593222 - DNA, 22 bp, Homo sapiens
gcctagcatacgtacacatttt

SEQ ID NO: 4593223 - DNA, 23 bp, Homo sapiens
gcctagcatacgtacacatttta

SEQ ID NO: 4593224 - DNA, 22 bp, Homo sapiens
gcctcatgtccactggttcttc

SEQ ID NO: 4593225 - DNA, 23 bp, Homo sapiens
gcctccaaggaggggctgtaaaa

SEQ ID NO: 4593226 - DNA, 21 bp, Homo sapiens
gcctctacccaaccagggccc

SEQ ID NO: 4593227 - DNA, 16 bp, Homo sapiens
gcctctcatcaactga

SEQ ID NO: 4593228 - DNA, 22 bp, Homo sapiens
gcctctcttggaccctgggagt

SEQ ID NO: 4593229 - DNA, 20 bp, Homo sapiens
gcctgagcgacagtgagact

SEQ ID NO: 4593230 - DNA, 17 bp, Homo sapiens
gcctggccagacacagg

SEQ ID NO: 4593231 - DNA, 13 bp, Homo sapiens
gcctgggcagcat

SEQ ID NO: 4593232 - DNA, 19 bp, Homo sapiens
gcctgggcagcatagcaag

SEQ ID NO: 4593233 - DNA, 16 bp, Homo sapiens
gcctgtcttaattttc

SEQ ID NO: 4593234 - DNA, 14 bp, Homo sapiens
gccttgaactttga

SEQ ID NO: 4593235 - DNA, 23 bp, Homo sapiens
gccttgaactttgacctctgcag

SEQ ID NO: 4593236 - DNA, 19 bp, Homo sapiens
gccttgctggatgctgctg

SEQ ID NO: 4593237 - DNA, 13 bp, Homo sapiens
gcgctacccactt

SEQ ID NO: 4593238 - DNA, 16 bp, Homo sapiens
gcgctacccacttcta

SEQ ID NO: 4593239 - DNA, 15 bp, Homo sapiens
gcgtggttcctttct

SEQ ID NO: 4593240 - DNA, 23 bp, Homo sapiens
gctaaatggtcgcccaggagaca

SEQ ID NO: 4593241 - DNA, 21 bp, Homo sapiens
gctaacccccttctactgagc

SEQ ID NO: 4593242 - DNA, 22 bp, Homo sapiens
gctaacccccttctactgagcc

SEQ ID NO: 4593243 - DNA, 17 bp, Homo sapiens
gctaagaacctggaact

SEQ ID NO: 4593244 - DNA, 13 bp, Homo sapiens
gctacacactgca

SEQ ID NO: 4593245 - DNA, 20 bp, Homo sapiens
gctacacactgcatgtttgt

SEQ ID NO: 4593246 - DNA, 16 bp, Homo sapiens
gctacctttgtattct

SEQ ID NO: 4593247 - DNA, 14 bp, Homo sapiens
gctagagcctctgc

SEQ ID NO: 4593248 - DNA, 15 bp, Homo sapiens
gctagagcctctgcc

SEQ ID NO: 4593249 - DNA, 22 bp, Homo sapiens
gctagagcctctgcctgacagc

SEQ ID NO: 4593250 - DNA, 12 bp, Homo sapiens
gctaggggctgg

SEQ ID NO: 4593251 - DNA, 15 bp, Homo sapiens
gctaggggctggggc

SEQ ID NO: 4593252 - DNA, 16 bp, Homo sapiens
gctatttaatactaat

SEQ ID NO: 4593253 - DNA, 14 bp, Homo sapiens
gctatttcatctat

SEQ ID NO: 4593254 - DNA, 15 bp, Homo sapiens
gctatttcatctatt

SEQ ID NO: 4593255 - DNA, 20 bp, Homo sapiens
gctcagccccagcttatctc

SEQ ID NO: 4593256 - DNA, 22 bp, Homo sapiens
gctcagccccagcttatctcct

SEQ ID NO: 4593257 - DNA, 20 bp, Homo sapiens
gctcaggcctataaccccag

SEQ ID NO: 4593258 - DNA, 12 bp, Homo sapiens
gctcagtcccat

SEQ ID NO: 4593259 - DNA, 17 bp, Homo sapiens
gctcattaaactttttt

SEQ ID NO: 4593260 - DNA, 15 bp, Homo sapiens
gctccaacctgcaaa

SEQ ID NO: 4593261 - DNA, 21 bp, Homo sapiens
gctccagacctgatcctggag

SEQ ID NO: 4593262 - DNA, 19 bp, Homo sapiens
gctcctctccccagcccag

SEQ ID NO: 4593263 - DNA, 20 bp, Homo sapiens
gctctctgtgggctggcagt

SEQ ID NO: 4593264 - DNA, 22 bp, Homo sapiens
gctctgctcccctaaagcctca

SEQ ID NO: 4593265 - DNA, 22 bp, Homo sapiens
gctctggacagccccaccctgg

SEQ ID NO: 4593266 - DNA, 11 bp, Homo sapiens
gctgagggtcg

SEQ ID NO: 4593267 - DNA, 16 bp, Homo sapiens
gctgagggtcgtggga

SEQ ID NO: 4593268 - DNA, 19 bp, Homo sapiens
gctgcatttaaaagataca

SEQ ID NO: 4593269 - DNA, 19 bp, Homo sapiens
gctgcgaatctagaggagg

SEQ ID NO: 4593270 - DNA, 23 bp, Homo sapiens
gctgcgaatctagaggagggggc

SEQ ID NO: 4593271 - DNA, 16 bp, Homo sapiens
gctggcccagggccca

SEQ ID NO: 4593272 - DNA, 20 bp, Homo sapiens
gctggcccagggcccagagc

SEQ ID NO: 4593273 - DNA, 21 bp, Homo sapiens
gctggcccagggcccagagcc

SEQ ID NO: 4593274 - DNA, 18 bp, Homo sapiens
gctgtacaacttctgggc

SEQ ID NO: 4593275 - DNA, 17 bp, Homo sapiens
gcttaacttcacatatt

SEQ ID NO: 4593276 - DNA, 22 bp, Homo sapiens
gcttaattattgatgttttcat

SEQ ID NO: 4593277 - DNA, 17 bp, Homo sapiens
gcttactgatatatttt

SEQ ID NO: 4593278 - DNA, 16 bp, Homo sapiens
gcttatctcctcctcc

SEQ ID NO: 4593279 - DNA, 14 bp, Homo sapiens
gcttcatctggcaa

SEQ ID NO: 4593280 - DNA, 18 bp, Homo sapiens
gcttccacacttctgggc

SEQ ID NO: 4593281 - DNA, 17 bp, Homo sapiens
gcttgtaactaaaataa

SEQ ID NO: 4593282 - DNA, 23 bp, Homo sapiens
gcttgtaactaaaataattttgt

SEQ ID NO: 4593283 - DNA, 19 bp, Homo sapiens
gcttgtacataatgcgtgc

SEQ ID NO: 4593284 - DNA, 11 bp, Homo sapiens
gctttcctgaa

SEQ ID NO: 4593285 - DNA, 19 bp, Homo sapiens
gcttttgtgcattatctag

SEQ ID NO: 4593286 - DNA, 12 bp, Homo sapiens
ggaaagccagcc

SEQ ID NO: 4593287 - DNA, 19 bp, Homo sapiens
ggaaagccagcctgggggc

SEQ ID NO: 4593288 - DNA, 20 bp, Homo sapiens
ggaaagccagcctgggggct

SEQ ID NO: 4593289 - DNA, 15 bp, Homo sapiens
ggaacactgagaaag

SEQ ID NO: 4593290 - DNA, 11 bp, Homo sapiens
ggaacagaagg

SEQ ID NO: 4593291 - DNA, 18 bp, Homo sapiens
ggaacagacaacagaagt

SEQ ID NO: 4593292 - DNA, 19 bp, Homo sapiens
ggaacctcagcctggccag

SEQ ID NO: 4593293 - DNA, 20 bp, Homo sapiens
ggaacctcagcctggccaga

SEQ ID NO: 4593294 - DNA, 21 bp, Homo sapiens
ggaacctcagcctggccagac

SEQ ID NO: 4593295 - DNA, 22 bp, Homo sapiens
ggaacctcagcctggccagaca

SEQ ID NO: 4593296 - DNA, 19 bp, Homo sapiens
ggaaggaaagaaagaagga

SEQ ID NO: 4593297 - DNA, 14 bp, Homo sapiens
ggaatttcccagga

SEQ ID NO: 4593298 - DNA, 18 bp, Homo sapiens
ggaatttcccaggaccct

SEQ ID NO: 4593299 - DNA, 19 bp, Homo sapiens
ggaatttcccaggaccctg

SEQ ID NO: 4593300 - DNA, 13 bp, Homo sapiens
ggacagaccagcc

SEQ ID NO: 4593301 - DNA, 14 bp, Homo sapiens
ggacagaccagccc

SEQ ID NO: 4593302 - DNA, 16 bp, Homo sapiens
ggacagaccagccctt

SEQ ID NO: 4593303 - DNA, 14 bp, Homo sapiens
ggacagaggcccca

SEQ ID NO: 4593304 - DNA, 23 bp, Homo sapiens
ggacagaggccccagcctccctg

SEQ ID NO: 4593305 - DNA, 15 bp, Homo sapiens
ggacattttatgtct

SEQ ID NO: 4593306 - DNA, 13 bp, Homo sapiens
ggaccagctcagg

SEQ ID NO: 4593307 - DNA, 19 bp, Homo sapiens
ggaccagctcaggacagat

SEQ ID NO: 4593308 - DNA, 13 bp, Homo sapiens
ggaccctgggagt

SEQ ID NO: 4593309 - DNA, 23 bp, Homo sapiens
ggactatatttgggcctgctcca

SEQ ID NO: 4593310 - DNA, 20 bp, Homo sapiens
ggacttcctgtccagctcca

SEQ ID NO: 4593311 - DNA, 23 bp, Homo sapiens
ggacttcctgtccagctccaacc

SEQ ID NO: 4593312 - DNA, 13 bp, Homo sapiens
ggagaaactggaa

SEQ ID NO: 4593313 - DNA, 19 bp, Homo sapiens
ggagaagctcctctcccca

SEQ ID NO: 4593314 - DNA, 17 bp, Homo sapiens
ggagaccaaggcgggag

SEQ ID NO: 4593315 - DNA, 20 bp, Homo sapiens
ggagcccactgtcctgggcc

SEQ ID NO: 4593316 - DNA, 22 bp, Homo sapiens
ggaggattgcttgagcccagga

SEQ ID NO: 4593317 - DNA, 13 bp, Homo sapiens
ggaggcccagttc

SEQ ID NO: 4593318 - DNA, 19 bp, Homo sapiens
ggaggctgagatgggagaa

SEQ ID NO: 4593319 - DNA, 19 bp, Homo sapiens
ggaggctgaggcaggagga

SEQ ID NO: 4593320 - DNA, 16 bp, Homo sapiens
ggagggaaagccagcc

SEQ ID NO: 4593321 - DNA, 18 bp, Homo sapiens
ggagggggcaggctgagg

SEQ ID NO: 4593322 - DNA, 15 bp, Homo sapiens
ggagtgagggtgggt

SEQ ID NO: 4593323 - DNA, 18 bp, Homo sapiens
ggagttaagacctggcag

SEQ ID NO: 4593324 - DNA, 14 bp, Homo sapiens
ggagttgatctgga

SEQ ID NO: 4593325 - DNA, 18 bp, Homo sapiens
ggatacaaaagcatgtga

SEQ ID NO: 4593326 - DNA, 20 bp, Homo sapiens
ggatagatgctggcccaggg

SEQ ID NO: 4593327 - DNA, 15 bp, Homo sapiens
ggatgcttgtacata

SEQ ID NO: 4593328 - DNA, 15 bp, Homo sapiens
ggatgggggaactca

SEQ ID NO: 4593329 - DNA, 17 bp, Homo sapiens
ggatgggggaactcaga

SEQ ID NO: 4593330 - DNA, 21 bp, Homo sapiens
ggatgggggaactcagatcca

SEQ ID NO: 4593331 - DNA, 23 bp, Homo sapiens
ggattaaacttaatctaaatgga

SEQ ID NO: 4593332 - DNA, 22 bp, Homo sapiens
ggatttaacagaaatgtacagc

SEQ ID NO: 4593333 - DNA, 15 bp, Homo sapiens
ggcaacagatctgga

SEQ ID NO: 4593334 - DNA, 14 bp, Homo sapiens
ggcaacatctttat

SEQ ID NO: 4593335 - DNA, 15 bp, Homo sapiens
ggcaaccttgtctct

SEQ ID NO: 4593336 - DNA, 19 bp, Homo sapiens
ggcacaggccgtcaccctg

SEQ ID NO: 4593337 - DNA, 18 bp, Homo sapiens
ggcacatcagcacgattt

SEQ ID NO: 4593338 - DNA, 20 bp, Homo sapiens
ggcaccagacacccaggact

SEQ ID NO: 4593339 - DNA, 19 bp, Homo sapiens
ggcagaataatctttgggt

SEQ ID NO: 4593340 - DNA, 16 bp, Homo sapiens
ggcagccaaacccatg

SEQ ID NO: 4593341 - DNA, 18 bp, Homo sapiens
ggcagccaaacccatgag

SEQ ID NO: 4593342 - DNA, 19 bp, Homo sapiens
ggcagccaaacccatgagg

SEQ ID NO: 4593343 - DNA, 20 bp, Homo sapiens
ggcagctctggacagcccca

SEQ ID NO: 4593344 - DNA, 18 bp, Homo sapiens
ggcagggacctaaaggga

SEQ ID NO: 4593345 - DNA, 20 bp, Homo sapiens
ggcagggacctaaagggact

SEQ ID NO: 4593346 - DNA, 19 bp, Homo sapiens
ggcagtctgaatttttaaa

SEQ ID NO: 4593347 - DNA, 21 bp, Homo sapiens
ggcagtggtggttttctgttc

SEQ ID NO: 4593348 - DNA, 21 bp, Homo sapiens
ggcatacgcctgtagtcctag

SEQ ID NO: 4593349 - DNA, 17 bp, Homo sapiens
ggcatttgtttctttct

SEQ ID NO: 4593350 - DNA, 14 bp, Homo sapiens
ggccaaataaagtc

SEQ ID NO: 4593351 - DNA, 18 bp, Homo sapiens
ggccagacacaggccctc

SEQ ID NO: 4593352 - DNA, 15 bp, Homo sapiens
ggccagacatgccac

SEQ ID NO: 4593353 - DNA, 12 bp, Homo sapiens
ggccagagccag

SEQ ID NO: 4593354 - DNA, 14 bp, Homo sapiens
ggccagagccaggg

SEQ ID NO: 4593355 - DNA, 12 bp, Homo sapiens
ggccagatccag

SEQ ID NO: 4593356 - DNA, 18 bp, Homo sapiens
ggccagatccagcctggg

SEQ ID NO: 4593357 - DNA, 15 bp, Homo sapiens
ggccagggagaagct

SEQ ID NO: 4593358 - DNA, 18 bp, Homo sapiens
ggccagggagaagctcct

SEQ ID NO: 4593359 - DNA, 15 bp, Homo sapiens
ggccatgatggcaac

SEQ ID NO: 4593360 - DNA, 18 bp, Homo sapiens
ggccatgatggcaacaga

SEQ ID NO: 4593361 - DNA, 12 bp, Homo sapiens
ggcccagagccc

SEQ ID NO: 4593362 - DNA, 18 bp, Homo sapiens
ggcccagagcccagctcc

SEQ ID NO: 4593363 - DNA, 14 bp, Homo sapiens
ggcccagggcccag

SEQ ID NO: 4593364 - DNA, 19 bp, Homo sapiens
ggcccagggcccagagccc

SEQ ID NO: 4593365 - DNA, 13 bp, Homo sapiens
ggccccagcctcc

SEQ ID NO: 4593366 - DNA, 22 bp, Homo sapiens
ggccctccctgttccccagaga

SEQ ID NO: 4593367 - DNA, 20 bp, Homo sapiens
ggcctacccctttctccagc

SEQ ID NO: 4593368 - DNA, 20 bp, Homo sapiens
ggcctagcatacgtacacat

SEQ ID NO: 4593369 - DNA, 22 bp, Homo sapiens
ggcctctcttggaccctgggag

SEQ ID NO: 4593370 - DNA, 13 bp, Homo sapiens
ggcctgcactaat

SEQ ID NO: 4593371 - DNA, 13 bp, Homo sapiens
ggcctgctccaga

SEQ ID NO: 4593372 - DNA, 14 bp, Homo sapiens
ggcctgctccagac

SEQ ID NO: 4593373 - DNA, 15 bp, Homo sapiens
ggcctgctccagacc

SEQ ID NO: 4593374 - DNA, 16 bp, Homo sapiens
ggcctgctccagacct

SEQ ID NO: 4593375 - DNA, 13 bp, Homo sapiens
ggctacctttgta

SEQ ID NO: 4593376 - DNA, 16 bp, Homo sapiens
ggctagaggttcaaag

SEQ ID NO: 4593377 - DNA, 17 bp, Homo sapiens
ggctagaggttcaaaga

SEQ ID NO: 4593378 - DNA, 22 bp, Homo sapiens
ggctagaggttcaaagatattt

SEQ ID NO: 4593379 - DNA, 13 bp, Homo sapiens
ggctatgcatttg

SEQ ID NO: 4593380 - DNA, 15 bp, Homo sapiens
ggctgctacccagaa

SEQ ID NO: 4593381 - DNA, 16 bp, Homo sapiens
gggaaggatacaaaag

SEQ ID NO: 4593382 - DNA, 21 bp, Homo sapiens
gggaaggatacaaaagcatgt

SEQ ID NO: 4593383 - DNA, 14 bp, Homo sapiens
gggacagaccagcc

SEQ ID NO: 4593384 - DNA, 16 bp, Homo sapiens
gggacagaccagccct

SEQ ID NO: 4593385 - DNA, 18 bp, Homo sapiens
gggacagaccagcccttc

SEQ ID NO: 4593386 - DNA, 21 bp, Homo sapiens
gggacagaccagcccttcccc

SEQ ID NO: 4593387 - DNA, 17 bp, Homo sapiens
gggacagaggccccagc

SEQ ID NO: 4593388 - DNA, 12 bp, Homo sapiens
gggagaagctcc

SEQ ID NO: 4593389 - DNA, 20 bp, Homo sapiens
gggaggcagaggttgcagtg

SEQ ID NO: 4593390 - DNA, 17 bp, Homo sapiens
gggagttaagacctggc

SEQ ID NO: 4593391 - DNA, 20 bp, Homo sapiens
gggagttaagacctggcagc

SEQ ID NO: 4593392 - DNA, 14 bp, Homo sapiens
gggataccagctga

SEQ ID NO: 4593393 - DNA, 17 bp, Homo sapiens
gggattgtaaaatggtg

SEQ ID NO: 4593394 - DNA, 16 bp, Homo sapiens
gggcagattttcagca

SEQ ID NO: 4593395 - DNA, 12 bp, Homo sapiens
gggcaggctgag

SEQ ID NO: 4593396 - DNA, 14 bp, Homo sapiens
gggccagatccagc

SEQ ID NO: 4593397 - DNA, 17 bp, Homo sapiens
gggccatattccgcact

SEQ ID NO: 4593398 - DNA, 20 bp, Homo sapiens
gggcctctcttggaccctgg

SEQ ID NO: 4593399 - DNA, 18 bp, Homo sapiens
ggggacagaccagccctt

SEQ ID NO: 4593400 - DNA, 11 bp, Homo sapiens
ggggagcccac

SEQ ID NO: 4593401 - DNA, 17 bp, Homo sapiens
ggggagttaagacctgg

SEQ ID NO: 4593402 - DNA, 14 bp, Homo sapiens
ggggataccagctg

SEQ ID NO: 4593403 - DNA, 23 bp, Homo sapiens
ggggatccctcccccccatgcac

SEQ ID NO: 4593404 - DNA, 21 bp, Homo sapiens
ggggcagccaaacccatgagg

SEQ ID NO: 4593405 - DNA, 14 bp, Homo sapiens
gggggataccagct

SEQ ID NO: 4593406 - DNA, 20 bp, Homo sapiens
ggggtctggagttgatctgg

SEQ ID NO: 4593407 - DNA, 21 bp, Homo sapiens
ggggtctggagttgatctgga

SEQ ID NO: 4593408 - DNA, 17 bp, Homo sapiens
gggtgaagtgaagacaa

SEQ ID NO: 4593409 - DNA, 15 bp, Homo sapiens
gggtgaggagctggg

SEQ ID NO: 4593410 - DNA, 13 bp, Homo sapiens
gggtggggacaga

SEQ ID NO: 4593411 - DNA, 19 bp, Homo sapiens
gggtggggacagaccagcc

SEQ ID NO: 4593412 - DNA, 16 bp, Homo sapiens
ggtacttcttgaaggt

SEQ ID NO: 4593413 - DNA, 23 bp, Homo sapiens
ggtattggctagaggttcaaaga

SEQ ID NO: 4593414 - DNA, 21 bp, Homo sapiens
ggtcagcatgtctattcagct

SEQ ID NO: 4593415 - DNA, 14 bp, Homo sapiens
ggtcgcccaggaga

SEQ ID NO: 4593416 - DNA, 17 bp, Homo sapiens
ggtctgttctttccaaa

SEQ ID NO: 4593417 - DNA, 19 bp, Homo sapiens
ggtctgttctttccaaagt

SEQ ID NO: 4593418 - DNA, 21 bp, Homo sapiens
ggtgcatttgaggtctgttct

SEQ ID NO: 4593419 - DNA, 22 bp, Homo sapiens
ggtgccccaggaccagctcagg

SEQ ID NO: 4593420 - DNA, 15 bp, Homo sapiens
ggtgctgacggccag

SEQ ID NO: 4593421 - DNA, 21 bp, Homo sapiens
ggtggaagcctcagaggcctt

SEQ ID NO: 4593422 - DNA, 16 bp, Homo sapiens
ggtgtgaccactgcag

SEQ ID NO: 4593423 - DNA, 23 bp, Homo sapiens
ggttattttgatgtaaagatgtt

SEQ ID NO: 4593424 - DNA, 13 bp, Homo sapiens
ggttcaaagatat

SEQ ID NO: 4593425 - DNA, 21 bp, Homo sapiens
ggttcaaagatattttgcttt

SEQ ID NO: 4593426 - DNA, 20 bp, Homo sapiens
ggttctgcctgccagctgca

SEQ ID NO: 4593427 - DNA, 20 bp, Homo sapiens
ggtttgtaaattaactttta

SEQ ID NO: 4593428 - DNA, 12 bp, Homo sapiens
ggttttctgttc

SEQ ID NO: 4593429 - DNA, 17 bp, Homo sapiens
gtaaattaacttttata

SEQ ID NO: 4593430 - DNA, 20 bp, Homo sapiens
gtaactaaaataattttgta

SEQ ID NO: 4593431 - DNA, 22 bp, Homo sapiens
gtaactgtttagatgaatgtca

SEQ ID NO: 4593432 - DNA, 11 bp, Homo sapiens
gtaagaagccg

SEQ ID NO: 4593433 - DNA, 12 bp, Homo sapiens
gtaataataaag

SEQ ID NO: 4593434 - DNA, 16 bp, Homo sapiens
gtaataataaagaata

SEQ ID NO: 4593435 - DNA, 19 bp, Homo sapiens
gtaatgtatcaaatacatt

SEQ ID NO: 4593436 - DNA, 21 bp, Homo sapiens
gtaatttttttatcgtcactg

SEQ ID NO: 4593437 - DNA, 18 bp, Homo sapiens
gtacaacttctgggcctc

SEQ ID NO: 4593438 - DNA, 20 bp, Homo sapiens
gtacactgtttcaaacttta

SEQ ID NO: 4593439 - DNA, 15 bp, Homo sapiens
gtacatgaaaacaca

SEQ ID NO: 4593440 - DNA, 20 bp, Homo sapiens
gtacatgaaaacacattttt

SEQ ID NO: 4593441 - DNA, 23 bp, Homo sapiens
gtaccatttaatggggaggacaa

SEQ ID NO: 4593442 - DNA, 22 bp, Homo sapiens
gtacctcttgagccttgaactt

SEQ ID NO: 4593443 - DNA, 15 bp, Homo sapiens
gtacgttgtgcattt

SEQ ID NO: 4593444 - DNA, 18 bp, Homo sapiens
gtagaacgtaaccacgga

SEQ ID NO: 4593445 - DNA, 19 bp, Homo sapiens
gtagaacgtaaccacggaa

SEQ ID NO: 4593446 - DNA, 16 bp, Homo sapiens
gtagtataaagaaaag

SEQ ID NO: 4593447 - DNA, 15 bp, Homo sapiens
gtatacctgattttt

SEQ ID NO: 4593448 - DNA, 13 bp, Homo sapiens
gtatcaaatacat

SEQ ID NO: 4593449 - DNA, 13 bp, Homo sapiens
gtatgaggcattt

SEQ ID NO: 4593450 - DNA, 20 bp, Homo sapiens
gtatgaggcatttgtttgaa

SEQ ID NO: 4593451 - DNA, 24 bp, Homo sapiens
gtatgataggttattttgatgtaa

SEQ ID NO: 4593452 - DNA, 15 bp, Homo sapiens
gtatggttgacacta

SEQ ID NO: 4593453 - DNA, 16 bp, Homo sapiens
gtattatgtctcttct

SEQ ID NO: 4593454 - DNA, 21 bp, Homo sapiens
gtattttttcaagttgtaaat

SEQ ID NO: 4593455 - DNA, 17 bp, Homo sapiens
gtcaacatttctcatgt

SEQ ID NO: 4593456 - DNA, 15 bp, Homo sapiens
gtcaatgcagccccc

SEQ ID NO: 4593457 - DNA, 15 bp, Homo sapiens
gtcaccctgggagca

SEQ ID NO: 4593458 - DNA, 18 bp, Homo sapiens
gtcagttgttatttattg

SEQ ID NO: 4593459 - DNA, 21 bp, Homo sapiens
gtcagttgttatttattgaaa

SEQ ID NO: 4593460 - DNA, 15 bp, Homo sapiens
gtcatgatggcacca

SEQ ID NO: 4593461 - DNA, 21 bp, Homo sapiens
gtcattttttttaagaaaaag

SEQ ID NO: 4593462 - DNA, 12 bp, Homo sapiens
gtcccaggcaga

SEQ ID NO: 4593463 - DNA, 12 bp, Homo sapiens
gtccccccaccc

SEQ ID NO: 4593464 - DNA, 18 bp, Homo sapiens
gtcctagccactcaggag

SEQ ID NO: 4593465 - DNA, 12 bp, Homo sapiens
gtcctcagcctt

SEQ ID NO: 4593466 - DNA, 17 bp, Homo sapiens
gtcctgggcctgcagaa

SEQ ID NO: 4593467 - DNA, 21 bp, Homo sapiens
gtcggaaaacatgctacacac

SEQ ID NO: 4593468 - DNA, 13 bp, Homo sapiens
gtctattcagctt

SEQ ID NO: 4593469 - DNA, 16 bp, Homo sapiens
gtctgttatgctgtga

SEQ ID NO: 4593470 - DNA, 19 bp, Homo sapiens
gtctgttgattaaagatga

SEQ ID NO: 4593471 - DNA, 14 bp, Homo sapiens
gtcttctatttatt

SEQ ID NO: 4593472 - DNA, 12 bp, Homo sapiens
gtgagacagact

SEQ ID NO: 4593473 - DNA, 13 bp, Homo sapiens
gtgaggagctggg

SEQ ID NO: 4593474 - DNA, 11 bp, Homo sapiens
gtgattaccag

SEQ ID NO: 4593475 - DNA, 23 bp, Homo sapiens
gtgattcaatctgtaaactgtgt

SEQ ID NO: 4593476 - DNA, 13 bp, Homo sapiens
gtgattctgcctt

SEQ ID NO: 4593477 - DNA, 22 bp, Homo sapiens
gtgcaataaatctgacccagtg

SEQ ID NO: 4593478 - DNA, 13 bp, Homo sapiens
gtgcataccactt

SEQ ID NO: 4593479 - DNA, 14 bp, Homo sapiens
gtgcataccacttt

SEQ ID NO: 4593480 - DNA, 19 bp, Homo sapiens
gtgcattatctagatactg

SEQ ID NO: 4593481 - DNA, 19 bp, Homo sapiens
gtgcatttgaggtctgttc

SEQ ID NO: 4593482 - DNA, 18 bp, Homo sapiens
gtgcccccactgaccaga

SEQ ID NO: 4593483 - DNA, 15 bp, Homo sapiens
gtgcctaatgtgttt

SEQ ID NO: 4593484 - DNA, 16 bp, Homo sapiens
gtgctgacggccaggg

SEQ ID NO: 4593485 - DNA, 23 bp, Homo sapiens
gtgctgacggccagggagaagct

SEQ ID NO: 4593486 - DNA, 12 bp, Homo sapiens
gtgctgcattta

SEQ ID NO: 4593487 - DNA, 20 bp, Homo sapiens
gtggaagcctcagaggcctt

SEQ ID NO: 4593488 - DNA, 21 bp, Homo sapiens
gtggatttaacagaaatgtac

SEQ ID NO: 4593489 - DNA, 14 bp, Homo sapiens
gtggccacggccac

SEQ ID NO: 4593490 - DNA, 17 bp, Homo sapiens
gtggggacagaccagcc

SEQ ID NO: 4593491 - DNA, 19 bp, Homo sapiens
gtggggacagaccagccct

SEQ ID NO: 4593492 - DNA, 20 bp, Homo sapiens
gtggggctaggggctggggc

SEQ ID NO: 4593493 - DNA, 21 bp, Homo sapiens
gtggggctaggggctggggcc

SEQ ID NO: 4593494 - DNA, 14 bp, Homo sapiens
gtggtggttttctg

SEQ ID NO: 4593495 - DNA, 20 bp, Homo sapiens
gtggtggttttctgttcttt

SEQ ID NO: 4593496 - DNA, 16 bp, Homo sapiens
gtggtttcagaaatgt

SEQ ID NO: 4593497 - DNA, 18 bp, Homo sapiens
gtgtaagaaatacagact

SEQ ID NO: 4593498 - DNA, 19 bp, Homo sapiens
gtgtatttattttacagct

SEQ ID NO: 4593499 - DNA, 23 bp, Homo sapiens
gtgtatttttttactaatagaca

SEQ ID NO: 4593500 - DNA, 20 bp, Homo sapiens
gtgtcctcctggggttcttt

SEQ ID NO: 4593501 - DNA, 18 bp, Homo sapiens
gttaaaggtgaacattgg

SEQ ID NO: 4593502 - DNA, 22 bp, Homo sapiens
gttacactttttggaagtgaaa

SEQ ID NO: 4593503 - DNA, 13 bp, Homo sapiens
gttacctactttg

SEQ ID NO: 4593504 - DNA, 16 bp, Homo sapiens
gttagattaagaaata

SEQ ID NO: 4593505 - DNA, 14 bp, Homo sapiens
gttccacagaggac

SEQ ID NO: 4593506 - DNA, 12 bp, Homo sapiens
gttccactgaga

SEQ ID NO: 4593507 - DNA, 14 bp, Homo sapiens
gttccactgagacc

SEQ ID NO: 4593508 - DNA, 20 bp, Homo sapiens
gttccatggcctcttcagat

SEQ ID NO: 4593509 - DNA, 14 bp, Homo sapiens
gttccccagagaaa

SEQ ID NO: 4593510 - DNA, 18 bp, Homo sapiens
gttccccctgtttcagag

SEQ ID NO: 4593511 - DNA, 18 bp, Homo sapiens
gttctccagtcattatgt

SEQ ID NO: 4593512 - DNA, 14 bp, Homo sapiens
gttcttggtttgta

SEQ ID NO: 4593513 - DNA, 20 bp, Homo sapiens
gttctttccaaagtacactg

SEQ ID NO: 4593514 - DNA, 17 bp, Homo sapiens
gttctttgggccagaca

SEQ ID NO: 4593515 - DNA, 22 bp, Homo sapiens
gttgatctggaacccagactca

SEQ ID NO: 4593516 - DNA, 20 bp, Homo sapiens
gttgattcatattgcatcat

SEQ ID NO: 4593517 - DNA, 23 bp, Homo sapiens
gttgccctgggggataccagctg

SEQ ID NO: 4593518 - DNA, 19 bp, Homo sapiens
gttggagggaaagccagcc

SEQ ID NO: 4593519 - DNA, 20 bp, Homo sapiens
gttggagggaaagccagcct

SEQ ID NO: 4593520 - DNA, 23 bp, Homo sapiens
gttggaggtttcacttgcacatc

SEQ ID NO: 4593521 - DNA, 18 bp, Homo sapiens
gttgtaccgcaatgtgac

SEQ ID NO: 4593522 - DNA, 20 bp, Homo sapiens
gtttaatggtagttttacag

SEQ ID NO: 4593523 - DNA, 14 bp, Homo sapiens
gtttagataataca

SEQ ID NO: 4593524 - DNA, 13 bp, Homo sapiens
gtttagctattta

SEQ ID NO: 4593525 - DNA, 18 bp, Homo sapiens
gtttagtggctcaacatt

SEQ ID NO: 4593526 - DNA, 13 bp, Homo sapiens
gtttcaaacttta

SEQ ID NO: 4593527 - DNA, 14 bp, Homo sapiens
gtttcagaaatgtg

SEQ ID NO: 4593528 - DNA, 23 bp, Homo sapiens
gtttctaaaggctacctttgtat

SEQ ID NO: 4593529 - DNA, 13 bp, Homo sapiens
gtttctgactctg

SEQ ID NO: 4593530 - DNA, 17 bp, Homo sapiens
gtttctgtcgttaaaaa

SEQ ID NO: 4593531 - DNA, 22 bp, Homo sapiens
gtttctgtcgttaaaaacagat

SEQ ID NO: 4593532 - DNA, 22 bp, Homo sapiens
gttttaaggatgcttgtacata

SEQ ID NO: 4593533 - DNA, 13 bp, Homo sapiens
gttttacttttaa

SEQ ID NO: 4593534 - DNA, 18 bp, Homo sapiens
gttttacttttaaactgt

SEQ ID NO: 4593535 - DNA, 15 bp, Homo sapiens
gttttctgttctttc

SEQ ID NO: 4593536 - DNA, 23 bp, Homo sapiens
gtttttatggcttttgtgcatta

SEQ ID NO: 4593537 - DNA, 16 bp, Homo sapiens
gtttttcacattttcc

SEQ ID NO: 4593538 - DNA, 21 bp, Homo sapiens
taaaaaaaaacctgagcccca

SEQ ID NO: 4593539 - DNA, 20 bp, Homo sapiens
taaaaacagatttggaaaga

SEQ ID NO: 4593540 - DNA, 14 bp, Homo sapiens
taaaaagtattttt

SEQ ID NO: 4593541 - DNA, 20 bp, Homo sapiens
taaaaatctcaaatttctaa

SEQ ID NO: 4593542 - DNA, 19 bp, Homo sapiens
taaaaatggtttaaatggt

SEQ ID NO: 4593543 - DNA, 15 bp, Homo sapiens
taaaacagacactgg

SEQ ID NO: 4593544 - DNA, 18 bp, Homo sapiens
taaaacagacactggcat

SEQ ID NO: 4593545 - DNA, 19 bp, Homo sapiens
taaaacagacactggcatg

SEQ ID NO: 4593546 - DNA, 12 bp, Homo sapiens
taaaacattaaa

SEQ ID NO: 4593547 - DNA, 19 bp, Homo sapiens
taaaacccatttaaatttt

SEQ ID NO: 4593548 - DNA, 17 bp, Homo sapiens
taaaagatacagttact

SEQ ID NO: 4593549 - DNA, 20 bp, Homo sapiens
taaaagatacagttactcag

SEQ ID NO: 4593550 - DNA, 21 bp, Homo sapiens
taaaagatacagttactcaga

SEQ ID NO: 4593551 - DNA, 14 bp, Homo sapiens
taaaagcattttgt

SEQ ID NO: 4593552 - DNA, 16 bp, Homo sapiens
taaaagcattttgtaa

SEQ ID NO: 4593553 - DNA, 18 bp, Homo sapiens
taaaagcattttgtaata

SEQ ID NO: 4593554 - DNA, 16 bp, Homo sapiens
taaaagccagatgcta

SEQ ID NO: 4593555 - DNA, 15 bp, Homo sapiens
taaaataattttgta

SEQ ID NO: 4593556 - DNA, 9 bp, Homo sapiens
taaaatggt

SEQ ID NO: 4593557 - DNA, 16 bp, Homo sapiens
taaactaccacctcag

SEQ ID NO: 4593558 - DNA, 15 bp, Homo sapiens
taaactgtgtacata

SEQ ID NO: 4593559 - DNA, 17 bp, Homo sapiens
taaactgtgtattccaa

SEQ ID NO: 4593560 - DNA, 13 bp, Homo sapiens
taaacttaatcta

SEQ ID NO: 4593561 - DNA, 14 bp, Homo sapiens
taaacttaatctaa

SEQ ID NO: 4593562 - DNA, 19 bp, Homo sapiens
taaacttaatctaaatgga

SEQ ID NO: 4593563 - DNA, 22 bp, Homo sapiens
taaactttaccttttttataca

SEQ ID NO: 4593564 - DNA, 11 bp, Homo sapiens
taaagcctcaa

SEQ ID NO: 4593565 - DNA, 17 bp, Homo sapiens
taaaggctacctttgta

SEQ ID NO: 4593566 - DNA, 19 bp, Homo sapiens
taaaggctacctttgtatt

SEQ ID NO: 4593567 - DNA, 20 bp, Homo sapiens
taaagggactacctctgtgc

SEQ ID NO: 4593568 - DNA, 21 bp, Homo sapiens
taaagggactacctctgtgcc

SEQ ID NO: 4593569 - DNA, 22 bp, Homo sapiens
taaagggactacctctgtgcct

SEQ ID NO: 4593570 - DNA, 21 bp, Homo sapiens
taaagtctgttgattaaagat

SEQ ID NO: 4593571 - DNA, 22 bp, Homo sapiens
taaagtctgttgattaaagatg

SEQ ID NO: 4593572 - DNA, 15 bp, Homo sapiens
taaagtgtatttttt

SEQ ID NO: 4593573 - DNA, 19 bp, Homo sapiens
taaataatgtgaaactgga

SEQ ID NO: 4593574 - DNA, 18 bp, Homo sapiens
taaatctccaaaataaaa

SEQ ID NO: 4593575 - DNA, 14 bp, Homo sapiens
taaatctgacccag

SEQ ID NO: 4593576 - DNA, 16 bp, Homo sapiens
taaatctgacccagtg

SEQ ID NO: 4593577 - DNA, 17 bp, Homo sapiens
taaatgatttcattcaa

SEQ ID NO: 4593578 - DNA, 19 bp, Homo sapiens
taaatgcaaccatttgaaa

SEQ ID NO: 4593579 - DNA, 14 bp, Homo sapiens
taaatgctccagca

SEQ ID NO: 4593580 - DNA, 18 bp, Homo sapiens
taaatgggggtgcatttg

SEQ ID NO: 4593581 - DNA, 16 bp, Homo sapiens
taaatgtaaagatatt

SEQ ID NO: 4593582 - DNA, 12 bp, Homo sapiens
taaattaacttt

SEQ ID NO: 4593583 - DNA, 15 bp, Homo sapiens
taaattaacttttat

SEQ ID NO: 4593584 - DNA, 16 bp, Homo sapiens
taaattaacttttata

SEQ ID NO: 4593585 - DNA, 19 bp, Homo sapiens
taaattaacttttataaac

SEQ ID NO: 4593586 - DNA, 20 bp, Homo sapiens
taaattaacttttataaact

SEQ ID NO: 4593587 - DNA, 16 bp, Homo sapiens
taaatttttttcctta

SEQ ID NO: 4593588 - DNA, 12 bp, Homo sapiens
taacagaaatgt

SEQ ID NO: 4593589 - DNA, 17 bp, Homo sapiens
taacagtggacaaagtt

SEQ ID NO: 4593590 - DNA, 19 bp, Homo sapiens
taacatgtgaaaagaatag

SEQ ID NO: 4593591 - DNA, 14 bp, Homo sapiens
taaccagcagaaat

SEQ ID NO: 4593592 - DNA, 19 bp, Homo sapiens
taaccagcagaaatgcctt

SEQ ID NO: 4593593 - DNA, 23 bp, Homo sapiens
taaccagtgttgtggatttaaca

SEQ ID NO: 4593594 - DNA, 19 bp, Homo sapiens
taactaaaataattttgta

SEQ ID NO: 4593595 - DNA, 21 bp, Homo sapiens
taactgaaaatgtgctatact

SEQ ID NO: 4593596 - DNA, 20 bp, Homo sapiens
taacttttataaactttacc

SEQ ID NO: 4593597 - DNA, 22 bp, Homo sapiens
taacttttataaactttacctt

SEQ ID NO: 4593598 - DNA, 22 bp, Homo sapiens
taagacaatggaccctttttgt

SEQ ID NO: 4593599 - DNA, 13 bp, Homo sapiens
taagacctggcag

SEQ ID NO: 4593600 - DNA, 21 bp, Homo sapiens
taagccagacatcaacagata

SEQ ID NO: 4593601 - DNA, 17 bp, Homo sapiens
taaggaaaaaaagacaa

SEQ ID NO: 4593602 - DNA, 20 bp, Homo sapiens
taaggatgcttgtacataat

SEQ ID NO: 4593603 - DNA, 21 bp, Homo sapiens
taagtattatgtctcttctga

SEQ ID NO: 4593604 - DNA, 21 bp, Homo sapiens
taagtattttcctgttgtcaa

SEQ ID NO: 4593605 - DNA, 20 bp, Homo sapiens
taagttcaaattcttctgaa

SEQ ID NO: 4593606 - DNA, 20 bp, Homo sapiens
taagtttttatggcttttgt

SEQ ID NO: 4593607 - DNA, 23 bp, Homo sapiens
taatacaccactacattctgtta

SEQ ID NO: 4593608 - DNA, 23 bp, Homo sapiens
taatactaattttccataagcta

SEQ ID NO: 4593609 - DNA, 16 bp, Homo sapiens
taatagacaatttatt

SEQ ID NO: 4593610 - DNA, 22 bp, Homo sapiens
taatagacaatttattatggca

SEQ ID NO: 4593611 - DNA, 15 bp, Homo sapiens
taatatgcacacatt

SEQ ID NO: 4593612 - DNA, 16 bp, Homo sapiens
taatatgcacacattt

SEQ ID NO: 4593613 - DNA, 19 bp, Homo sapiens
taatatgcacacatttttt

SEQ ID NO: 4593614 - DNA, 12 bp, Homo sapiens
taatctaaatgg

SEQ ID NO: 4593615 - DNA, 12 bp, Homo sapiens
taatctttgggt

SEQ ID NO: 4593616 - DNA, 16 bp, Homo sapiens
taatgatatgcttgta

SEQ ID NO: 4593617 - DNA, 21 bp, Homo sapiens
taatgccttactcttcttgaa

SEQ ID NO: 4593618 - DNA, 23 bp, Homo sapiens
taatggaagtgtatttattttac

SEQ ID NO: 4593619 - DNA, 16 bp, Homo sapiens
taatggtagttttaca

SEQ ID NO: 4593620 - DNA, 22 bp, Homo sapiens
taatgtgaaactggattaaact

SEQ ID NO: 4593621 - DNA, 17 bp, Homo sapiens
taattaccaacctgtta

SEQ ID NO: 4593622 - DNA, 16 bp, Homo sapiens
taattattgatgtttt

SEQ ID NO: 4593623 - DNA, 15 bp, Homo sapiens
taattctatgcctgt

SEQ ID NO: 4593624 - DNA, 18 bp, Homo sapiens
taattcttagctcattct

SEQ ID NO: 4593625 - DNA, 15 bp, Homo sapiens
taatttgagagaaat

SEQ ID NO: 4593626 - DNA, 14 bp, Homo sapiens
taatttgtgataca

SEQ ID NO: 4593627 - DNA, 22 bp, Homo sapiens
taatttgtgatacaatgctgtg

SEQ ID NO: 4593628 - DNA, 20 bp, Homo sapiens
taattttgtgtaagaaatac

SEQ ID NO: 4593629 - DNA, 15 bp, Homo sapiens
tacaaaagcatgtga

SEQ ID NO: 4593630 - DNA, 14 bp, Homo sapiens
tacaatgctgtgcc

SEQ ID NO: 4593631 - DNA, 17 bp, Homo sapiens
tacacactgcatgtttg

SEQ ID NO: 4593632 - DNA, 19 bp, Homo sapiens
tacacattttattttatta

SEQ ID NO: 4593633 - DNA, 15 bp, Homo sapiens
tacaccactacattc

SEQ ID NO: 4593634 - DNA, 16 bp, Homo sapiens
tacaccactacattct

SEQ ID NO: 4593635 - DNA, 18 bp, Homo sapiens
tacaccactacattctgt

SEQ ID NO: 4593636 - DNA, 19 bp, Homo sapiens
tacactgtttcaaacttta

SEQ ID NO: 4593637 - DNA, 20 bp, Homo sapiens
tacactgtttcaaactttac

SEQ ID NO: 4593638 - DNA, 13 bp, Homo sapiens
tacagaaagctgc

SEQ ID NO: 4593639 - DNA, 22 bp, Homo sapiens
tacagcaacaatttatgaattg

SEQ ID NO: 4593640 - DNA, 22 bp, Homo sapiens
tacagcaaggagatttacaact

SEQ ID NO: 4593641 - DNA, 21 bp, Homo sapiens
tacagctcattaaactttttt

SEQ ID NO: 4593642 - DNA, 23 bp, Homo sapiens
tacagttactcagaattctctag

SEQ ID NO: 4593643 - DNA, 18 bp, Homo sapiens
tacagtttgttagtatga

SEQ ID NO: 4593644 - DNA, 19 bp, Homo sapiens
tacagtttgttagtatgag

SEQ ID NO: 4593645 - DNA, 14 bp, Homo sapiens
tacatagatgctta

SEQ ID NO: 4593646 - DNA, 19 bp, Homo sapiens
tacatgaaaacacattttt

SEQ ID NO: 4593647 - DNA, 21 bp, Homo sapiens
tacatgaggtactgagagtga

SEQ ID NO: 4593648 - DNA, 22 bp, Homo sapiens
tacatgaggtactgagagtgaa

SEQ ID NO: 4593649 - DNA, 18 bp, Homo sapiens
tacatgcagctatttcaa

SEQ ID NO: 4593650 - DNA, 16 bp, Homo sapiens
tacatttaaaacatta

SEQ ID NO: 4593651 - DNA, 18 bp, Homo sapiens
taccagccagtaaatggg

SEQ ID NO: 4593652 - DNA, 22 bp, Homo sapiens
taccctcctcccgactgaccac

SEQ ID NO: 4593653 - DNA, 22 bp, Homo sapiens
tacctaacgaagtatccttcag

SEQ ID NO: 4593654 - DNA, 21 bp, Homo sapiens
tacctactttgactttttgca

SEQ ID NO: 4593655 - DNA, 15 bp, Homo sapiens
tacgtacacatttta

SEQ ID NO: 4593656 - DNA, 17 bp, Homo sapiens
tactaaccagcagaaat

SEQ ID NO: 4593657 - DNA, 22 bp, Homo sapiens
tactaattttccataagctatt

SEQ ID NO: 4593658 - DNA, 20 bp, Homo sapiens
tactacagtttgttagtatg

SEQ ID NO: 4593659 - DNA, 14 bp, Homo sapiens
tactacctgtaatg

SEQ ID NO: 4593660 - DNA, 23 bp, Homo sapiens
tactatggccctggcctagcata

SEQ ID NO: 4593661 - DNA, 16 bp, Homo sapiens
tactcagaattctcta

SEQ ID NO: 4593662 - DNA, 22 bp, Homo sapiens
tactcagaattctctagtttga

SEQ ID NO: 4593663 - DNA, 17 bp, Homo sapiens
tactgagagtgaacaaa

SEQ ID NO: 4593664 - DNA, 14 bp, Homo sapiens
tactgatatatttt

SEQ ID NO: 4593665 - DNA, 15 bp, Homo sapiens
tactgcatacttttt

SEQ ID NO: 4593666 - DNA, 21 bp, Homo sapiens
tactgcatactttttaaatgt

SEQ ID NO: 4593667 - DNA, 23 bp, Homo sapiens
tactgtaatttgtgatacaatgc

SEQ ID NO: 4593668 - DNA, 18 bp, Homo sapiens
tactgtacatgaaaacac

SEQ ID NO: 4593669 - DNA, 22 bp, Homo sapiens
tacttcaaaagtttgtttgctt

SEQ ID NO: 4593670 - DNA, 11 bp, Homo sapiens
tacttgaaggg

SEQ ID NO: 4593671 - DNA, 15 bp, Homo sapiens
tacttgaagggccag

SEQ ID NO: 4593672 - DNA, 17 bp, Homo sapiens
tacttgaagggccagag

SEQ ID NO: 4593673 - DNA, 22 bp, Homo sapiens
tacttgaagggccagagccagg

SEQ ID NO: 4593674 - DNA, 14 bp, Homo sapiens
tactttgacttttt

SEQ ID NO: 4593675 - DNA, 15 bp, Homo sapiens
tacttttaaactgtg

SEQ ID NO: 4593676 - DNA, 21 bp, Homo sapiens
tagagcctctgcctgacagca

SEQ ID NO: 4593677 - DNA, 19 bp, Homo sapiens
tagaggagaaactggaact

SEQ ID NO: 4593678 - DNA, 14 bp, Homo sapiens
tagaggttcaaaga

SEQ ID NO: 4593679 - DNA, 19 bp, Homo sapiens
tagaggttcaaagatattt

SEQ ID NO: 4593680 - DNA, 14 bp, Homo sapiens
tagagttgatacta

SEQ ID NO: 4593681 - DNA, 20 bp, Homo sapiens
tagatgaatgtcagttgtta

SEQ ID NO: 4593682 - DNA, 18 bp, Homo sapiens
tagatgctggcccagggc

SEQ ID NO: 4593683 - DNA, 18 bp, Homo sapiens
tagcaagacacatcccta

SEQ ID NO: 4593684 - DNA, 19 bp, Homo sapiens
tagcattgtaaaagcattt

SEQ ID NO: 4593685 - DNA, 14 bp, Homo sapiens
tagccactcaggag

SEQ ID NO: 4593686 - DNA, 18 bp, Homo sapiens
tagcccaatgaaatgaat

SEQ ID NO: 4593687 - DNA, 16 bp, Homo sapiens
tagctatttaatacta

SEQ ID NO: 4593688 - DNA, 20 bp, Homo sapiens
tagctatttaatactaattt

SEQ ID NO: 4593689 - DNA, 23 bp, Homo sapiens
tagctttaatgatatgcttgtaa

SEQ ID NO: 4593690 - DNA, 22 bp, Homo sapiens
taggaaatggctttgtgattca

SEQ ID NO: 4593691 - DNA, 15 bp, Homo sapiens
taggagaagccagga

SEQ ID NO: 4593692 - DNA, 20 bp, Homo sapiens
taggagaagtcttctattta

SEQ ID NO: 4593693 - DNA, 13 bp, Homo sapiens
taggatgttgaaa

SEQ ID NO: 4593694 - DNA, 21 bp, Homo sapiens
taggggctggggccaaataaa

SEQ ID NO: 4593695 - DNA, 23 bp, Homo sapiens
taggtgtgactgaatttcttttg

SEQ ID NO: 4593696 - DNA, 16 bp, Homo sapiens
tagtataaagaaaagt

SEQ ID NO: 4593697 - DNA, 17 bp, Homo sapiens
tagtatgaggcatttgt

SEQ ID NO: 4593698 - DNA, 17 bp, Homo sapiens
tagtgcttatctaattt

SEQ ID NO: 4593699 - DNA, 23 bp, Homo sapiens
tagtggattactgccattcactt

SEQ ID NO: 4593700 - DNA, 14 bp, Homo sapiens
tagtttctttggga

SEQ ID NO: 4593701 - DNA, 16 bp, Homo sapiens
tagtttgattaaattc

SEQ ID NO: 4593702 - DNA, 13 bp, Homo sapiens
tataaactttacc

SEQ ID NO: 4593703 - DNA, 14 bp, Homo sapiens
tataaactttacct

SEQ ID NO: 4593704 - DNA, 15 bp, Homo sapiens
tataaactttacctt

SEQ ID NO: 4593705 - DNA, 15 bp, Homo sapiens
tataaccccagctcc

SEQ ID NO: 4593706 - DNA, 13 bp, Homo sapiens
tatacataaacaa

SEQ ID NO: 4593707 - DNA, 14 bp, Homo sapiens
tatacataaacaag

SEQ ID NO: 4593708 - DNA, 23 bp, Homo sapiens
tataggaacttaaataatgtgaa

SEQ ID NO: 4593709 - DNA, 12 bp, Homo sapiens
tataggaattga

SEQ ID NO: 4593710 - DNA, 20 bp, Homo sapiens
tatatccaaaagctttttat

SEQ ID NO: 4593711 - DNA, 18 bp, Homo sapiens
tatatgaagaaaatcact

SEQ ID NO: 4593712 - DNA, 19 bp, Homo sapiens
tatatgaagaaaatcactt

SEQ ID NO: 4593713 - DNA, 14 bp, Homo sapiens
tatatgcttactga

SEQ ID NO: 4593714 - DNA, 20 bp, Homo sapiens
tatattcattctttttgaaa

SEQ ID NO: 4593715 - DNA, 22 bp, Homo sapiens
tatatttgggcctgctccagac

SEQ ID NO: 4593716 - DNA, 20 bp, Homo sapiens
tatcacattggagtcactgc

SEQ ID NO: 4593717 - DNA, 19 bp, Homo sapiens
tatcacccagaagaaaata

SEQ ID NO: 4593718 - DNA, 17 bp, Homo sapiens
tatcccttggacatttt

SEQ ID NO: 4593719 - DNA, 19 bp, Homo sapiens
tatgaacatattgttgaaa

SEQ ID NO: 4593720 - DNA, 17 bp, Homo sapiens
tatgaagaactgaggag

SEQ ID NO: 4593721 - DNA, 13 bp, Homo sapiens
tatgaatactttg

SEQ ID NO: 4593722 - DNA, 18 bp, Homo sapiens
tatgaattgaattatctt

SEQ ID NO: 4593723 - DNA, 12 bp, Homo sapiens
tatgacacatgc

SEQ ID NO: 4593724 - DNA, 15 bp, Homo sapiens
tatgaggcatttgtt

SEQ ID NO: 4593725 - DNA, 15 bp, Homo sapiens
tatgatattttctgt

SEQ ID NO: 4593726 - DNA, 22 bp, Homo sapiens
tatgatattttctgtgcctgaa

SEQ ID NO: 4593727 - DNA, 16 bp, Homo sapiens
tatgatggttttaaac

SEQ ID NO: 4593728 - DNA, 17 bp, Homo sapiens
tatgatttaatttgaaa

SEQ ID NO: 4593729 - DNA, 18 bp, Homo sapiens
tatgatttaatttgaaat

SEQ ID NO: 4593730 - DNA, 14 bp, Homo sapiens
tatgcacacatttt

SEQ ID NO: 4593731 - DNA, 20 bp, Homo sapiens
tatgcatggtgccccaggac

SEQ ID NO: 4593732 - DNA, 21 bp, Homo sapiens
tatgcatggtgccccaggacc

SEQ ID NO: 4593733 - DNA, 11 bp, Homo sapiens
tatgcatttga

SEQ ID NO: 4593734 - DNA, 23 bp, Homo sapiens
tatgcatttgaaaattttgatgt

SEQ ID NO: 4593735 - DNA, 18 bp, Homo sapiens
tatgcttgtaactaaaat

SEQ ID NO: 4593736 - DNA, 21 bp, Homo sapiens
tatggccctggcctagcatac

SEQ ID NO: 4593737 - DNA, 22 bp, Homo sapiens
tatggccctggcctagcatacg

SEQ ID NO: 4593738 - DNA, 14 bp, Homo sapiens
tatgtagataacaa

SEQ ID NO: 4593739 - DNA, 20 bp, Homo sapiens
tatgtgcacatctgttttgt

SEQ ID NO: 4593740 - DNA, 17 bp, Homo sapiens
tatgtgggcagattttc

SEQ ID NO: 4593741 - DNA, 16 bp, Homo sapiens
tatgttatttatagct

SEQ ID NO: 4593742 - DNA, 13 bp, Homo sapiens
tattatacctttt

SEQ ID NO: 4593743 - DNA, 17 bp, Homo sapiens
tattatgtctcttctga

SEQ ID NO: 4593744 - DNA, 18 bp, Homo sapiens
tattcattgtggtcatag

SEQ ID NO: 4593745 - DNA, 18 bp, Homo sapiens
tattcctcctgctcatat

SEQ ID NO: 4593746 - DNA, 18 bp, Homo sapiens
tattctctcctgtacctc

SEQ ID NO: 4593747 - DNA, 24 bp, Homo sapiens
tattctctcctgtacctcttgagc

SEQ ID NO: 4593748 - DNA, 16 bp, Homo sapiens
tattgaaatgatttca

SEQ ID NO: 4593749 - DNA, 14 bp, Homo sapiens
tattgatgttttca

SEQ ID NO: 4593750 - DNA, 17 bp, Homo sapiens
tattggtgtaaggtact

SEQ ID NO: 4593751 - DNA, 14 bp, Homo sapiens
tatttatttattta

SEQ ID NO: 4593752 - DNA, 23 bp, Homo sapiens
tatttctgaggagcctgcaacat

SEQ ID NO: 4593753 - DNA, 14 bp, Homo sapiens
tattttacaatttt

SEQ ID NO: 4593754 - DNA, 18 bp, Homo sapiens
tattttacagctcattaa

SEQ ID NO: 4593755 - DNA, 15 bp, Homo sapiens
tattttatgttattt

SEQ ID NO: 4593756 - DNA, 14 bp, Homo sapiens
tattttattatgca

SEQ ID NO: 4593757 - DNA, 21 bp, Homo sapiens
tattttctgtgcctgaatatt

SEQ ID NO: 4593758 - DNA, 17 bp, Homo sapiens
tattttgatgtaaagat

SEQ ID NO: 4593759 - DNA, 20 bp, Homo sapiens
tatttttggcagtctgaatt

SEQ ID NO: 4593760 - DNA, 18 bp, Homo sapiens
tcaaaagaaagaaaatca

SEQ ID NO: 4593761 - DNA, 13 bp, Homo sapiens
tcaaaagtttgtt

SEQ ID NO: 4593762 - DNA, 14 bp, Homo sapiens
tcaaaagtttgttt

SEQ ID NO: 4593763 - DNA, 19 bp, Homo sapiens
tcaaactgaggaatttcac

SEQ ID NO: 4593764 - DNA, 15 bp, Homo sapiens
tcaaactttactatg

SEQ ID NO: 4593765 - DNA, 21 bp, Homo sapiens
tcaaatacatttaaaacatta

SEQ ID NO: 4593766 - DNA, 19 bp, Homo sapiens
tcaaatggggccagatcca

SEQ ID NO: 4593767 - DNA, 20 bp, Homo sapiens
tcaaatggggccagatccag

SEQ ID NO: 4593768 - DNA, 14 bp, Homo sapiens
tcaaattcttctga

SEQ ID NO: 4593769 - DNA, 13 bp, Homo sapiens
tcaaatttctaaa

SEQ ID NO: 4593770 - DNA, 14 bp, Homo sapiens
tcaaatttctaaat

SEQ ID NO: 4593771 - DNA, 15 bp, Homo sapiens
tcaaatttctaaatc

SEQ ID NO: 4593772 - DNA, 16 bp, Homo sapiens
tcaaatttctaaatct

SEQ ID NO: 4593773 - DNA, 17 bp, Homo sapiens
tcaaatttctaaatctc

SEQ ID NO: 4593774 - DNA, 11 bp, Homo sapiens
tcaaggctcag

SEQ ID NO: 4593775 - DNA, 21 bp, Homo sapiens
tcaagtattatacctttttta

SEQ ID NO: 4593776 - DNA, 23 bp, Homo sapiens
tcaagtattataccttttttaga

SEQ ID NO: 4593777 - DNA, 16 bp, Homo sapiens
tcaagttgtaaataat

SEQ ID NO: 4593778 - DNA, 22 bp, Homo sapiens
tcaatatcttttttttaataaa

SEQ ID NO: 4593779 - DNA, 13 bp, Homo sapiens
tcaatgcagcccc

SEQ ID NO: 4593780 - DNA, 20 bp, Homo sapiens
tcaattactggtccaaaaga

SEQ ID NO: 4593781 - DNA, 13 bp, Homo sapiens
tcacaagacccaa

SEQ ID NO: 4593782 - DNA, 17 bp, Homo sapiens
tcacaagacccaaaagg

SEQ ID NO: 4593783 - DNA, 18 bp, Homo sapiens
tcacaagacccaaaaggc

SEQ ID NO: 4593784 - DNA, 16 bp, Homo sapiens
tcacagtcacattcca

SEQ ID NO: 4593785 - DNA, 20 bp, Homo sapiens
tcacagttctttgggccaga

SEQ ID NO: 4593786 - DNA, 22 bp, Homo sapiens
tcacagttctttgggccagaca

SEQ ID NO: 4593787 - DNA, 20 bp, Homo sapiens
tcacattggagtcactgcca

SEQ ID NO: 4593788 - DNA, 16 bp, Homo sapiens
tcacattttccttttc

SEQ ID NO: 4593789 - DNA, 12 bp, Homo sapiens
tcacccagaatc

SEQ ID NO: 4593790 - DNA, 23 bp, Homo sapiens
tcaccctgatttaggagaagcca

SEQ ID NO: 4593791 - DNA, 17 bp, Homo sapiens
tcacctgtaaacctgag

SEQ ID NO: 4593792 - DNA, 18 bp, Homo sapiens
tcactgcttaacttcaca

SEQ ID NO: 4593793 - DNA, 22 bp, Homo sapiens
tcacttaagttagttccactga

SEQ ID NO: 4593794 - DNA, 21 bp, Homo sapiens
tcacttaggaaatggctttgt

SEQ ID NO: 4593795 - DNA, 23 bp, Homo sapiens
tcagaattctctagtttgattaa

SEQ ID NO: 4593796 - DNA, 22 bp, Homo sapiens
tcagacatagaattaacacatg

SEQ ID NO: 4593797 - DNA, 21 bp, Homo sapiens
tcagagttgctgcaaacctga

SEQ ID NO: 4593798 - DNA, 16 bp, Homo sapiens
tcagatccagggacag

SEQ ID NO: 4593799 - DNA, 16 bp, Homo sapiens
tcagatctctaacttc

SEQ ID NO: 4593800 - DNA, 15 bp, Homo sapiens
tcagcacgatttctg

SEQ ID NO: 4593801 - DNA, 16 bp, Homo sapiens
tcagcacgatttctgt

SEQ ID NO: 4593802 - DNA, 16 bp, Homo sapiens
tcagcatgtctattca

SEQ ID NO: 4593803 - DNA, 17 bp, Homo sapiens
tcagcctggccagacac

SEQ ID NO: 4593804 - DNA, 20 bp, Homo sapiens
tcagcctggccagacacagg

SEQ ID NO: 4593805 - DNA, 14 bp, Homo sapiens
tcagccttgccaga

SEQ ID NO: 4593806 - DNA, 21 bp, Homo sapiens
tcagcttcgtttattttcaag

SEQ ID NO: 4593807 - DNA, 14 bp, Homo sapiens
tcaggaacagaagg

SEQ ID NO: 4593808 - DNA, 16 bp, Homo sapiens
tcaggaacagaaggat

SEQ ID NO: 4593809 - DNA, 20 bp, Homo sapiens
tcaggagtcccaaggaaagc

SEQ ID NO: 4593810 - DNA, 18 bp, Homo sapiens
tcagtccatgaagatgta

SEQ ID NO: 4593811 - DNA, 11 bp, Homo sapiens
tcatagcagct

SEQ ID NO: 4593812 - DNA, 12 bp, Homo sapiens
tcatagcagctt

SEQ ID NO: 4593813 - DNA, 20 bp, Homo sapiens
tcatagtttgctttgtttaa

SEQ ID NO: 4593814 - DNA, 15 bp, Homo sapiens
tcatattgcatcata

SEQ ID NO: 4593815 - DNA, 22 bp, Homo sapiens
tcatcaactgaatgaggtcagc

SEQ ID NO: 4593816 - DNA, 17 bp, Homo sapiens
tcatcaatgaatgaatg

SEQ ID NO: 4593817 - DNA, 16 bp, Homo sapiens
tcatctctctgcccaa

SEQ ID NO: 4593818 - DNA, 23 bp, Homo sapiens
tcatctggcaacatctttatccg

SEQ ID NO: 4593819 - DNA, 19 bp, Homo sapiens
tcatgacaaagactgagta

SEQ ID NO: 4593820 - DNA, 21 bp, Homo sapiens
tcatggagggtttagtgctta

SEQ ID NO: 4593821 - DNA, 17 bp, Homo sapiens
tcatgttcttaattctt

SEQ ID NO: 4593822 - DNA, 16 bp, Homo sapiens
tcattaaactttttta

SEQ ID NO: 4593823 - DNA, 21 bp, Homo sapiens
tcattccaacttcccagttca

SEQ ID NO: 4593824 - DNA, 21 bp, Homo sapiens
tcattctttttgaaatgtcaa

SEQ ID NO: 4593825 - DNA, 14 bp, Homo sapiens
tcatttgctttgga

SEQ ID NO: 4593826 - DNA, 15 bp, Homo sapiens
tcatttgctttggaa

SEQ ID NO: 4593827 - DNA, 17 bp, Homo sapiens
tcattttttttaagaaa

SEQ ID NO: 4593828 - DNA, 14 bp, Homo sapiens
tccaaaagaagccc

SEQ ID NO: 4593829 - DNA, 19 bp, Homo sapiens
tccaaaagattgctgaaat

SEQ ID NO: 4593830 - DNA, 20 bp, Homo sapiens
tccaaaataaaactttttaa

SEQ ID NO: 4593831 - DNA, 21 bp, Homo sapiens
tccaacctgcaaagatctgtc

SEQ ID NO: 4593832 - DNA, 15 bp, Homo sapiens
tccaactaatgcctt

SEQ ID NO: 4593833 - DNA, 20 bp, Homo sapiens
tccaagacatgtctgttcta

SEQ ID NO: 4593834 - DNA, 19 bp, Homo sapiens
tccaattaatgaagttgat

SEQ ID NO: 4593835 - DNA, 19 bp, Homo sapiens
tccacagaggacacagaga

SEQ ID NO: 4593836 - DNA, 22 bp, Homo sapiens
tccactggttcttcttggtctc

SEQ ID NO: 4593837 - DNA, 11 bp, Homo sapiens
tccagacctga

SEQ ID NO: 4593838 - DNA, 13 bp, Homo sapiens
tccagacctgatc

SEQ ID NO: 4593839 - DNA, 22 bp, Homo sapiens
tccagacctgatcctggaggcc

SEQ ID NO: 4593840 - DNA, 15 bp, Homo sapiens
tccagccctgactaa

SEQ ID NO: 4593841 - DNA, 23 bp, Homo sapiens
tccagccctgactaaactaccac

SEQ ID NO: 4593842 - DNA, 13 bp, Homo sapiens
tccagcctgggca

SEQ ID NO: 4593843 - DNA, 20 bp, Homo sapiens
tccagcctgggcaacagagc

SEQ ID NO: 4593844 - DNA, 17 bp, Homo sapiens
tccagcctggggtctgg

SEQ ID NO: 4593845 - DNA, 18 bp, Homo sapiens
tccagctccaacctgcaa

SEQ ID NO: 4593846 - DNA, 19 bp, Homo sapiens
tccagctccaacctgcaaa

SEQ ID NO: 4593847 - DNA, 23 bp, Homo sapiens
tccagtcttcctgacactttaat

SEQ ID NO: 4593848 - DNA, 18 bp, Homo sapiens
tccagtgagacagctctg

SEQ ID NO: 4593849 - DNA, 22 bp, Homo sapiens
tccatgaagatgtagaggagaa

SEQ ID NO: 4593850 - DNA, 18 bp, Homo sapiens
tccatgcgtgtttctgac

SEQ ID NO: 4593851 - DNA, 13 bp, Homo sapiens
tcccaaggaaagc

SEQ ID NO: 4593852 - DNA, 13 bp, Homo sapiens
tcccaggaccctg

SEQ ID NO: 4593853 - DNA, 14 bp, Homo sapiens
tcccaggaccctga

SEQ ID NO: 4593854 - DNA, 19 bp, Homo sapiens
tcccaggaccctgaagggg

SEQ ID NO: 4593855 - DNA, 23 bp, Homo sapiens
tcccagttcaggagtcccaagga

SEQ ID NO: 4593856 - DNA, 10 bp, Homo sapiens
tccccagaga

SEQ ID NO: 4593857 - DNA, 13 bp, Homo sapiens
tccccagcccaga

SEQ ID NO: 4593858 - DNA, 15 bp, Homo sapiens
tccccagcccagaga

SEQ ID NO: 4593859 - DNA, 18 bp, Homo sapiens
tcccccccatgcactgtg

SEQ ID NO: 4593860 - DNA, 20 bp, Homo sapiens
tccctcaccttggcaccaga

SEQ ID NO: 4593861 - DNA, 16 bp, Homo sapiens
tccctcccccccatgc

SEQ ID NO: 4593862 - DNA, 20 bp, Homo sapiens
tccctctaaccccttgggtg

SEQ ID NO: 4593863 - DNA, 15 bp, Homo sapiens
tcccttggacatttt

SEQ ID NO: 4593864 - DNA, 18 bp, Homo sapiens
tcccttggacattttatg

SEQ ID NO: 4593865 - DNA, 21 bp, Homo sapiens
tcccttggacattttatgtct

SEQ ID NO: 4593866 - DNA, 12 bp, Homo sapiens
tccctttggtta

SEQ ID NO: 4593867 - DNA, 14 bp, Homo sapiens
tcccttttccatga

SEQ ID NO: 4593868 - DNA, 20 bp, Homo sapiens
tcctcagccttgccagagat

SEQ ID NO: 4593869 - DNA, 20 bp, Homo sapiens
tcctcccaatttcagactcc

SEQ ID NO: 4593870 - DNA, 12 bp, Homo sapiens
tcctcctgctca

SEQ ID NO: 4593871 - DNA, 14 bp, Homo sapiens
tcctctccccagcc

SEQ ID NO: 4593872 - DNA, 16 bp, Homo sapiens
tcctctccccagccca

SEQ ID NO: 4593873 - DNA, 18 bp, Homo sapiens
tcctgaagaaccagtccc

SEQ ID NO: 4593874 - DNA, 20 bp, Homo sapiens
tcctggagaagtgggtgggg

SEQ ID NO: 4593875 - DNA, 13 bp, Homo sapiens
tcctgggcctgca

SEQ ID NO: 4593876 - DNA, 15 bp, Homo sapiens
tcctgggcctgcaga

SEQ ID NO: 4593877 - DNA, 16 bp, Homo sapiens
tcctggggttgccctg

SEQ ID NO: 4593878 - DNA, 19 bp, Homo sapiens
tcctgtaaaggttacaagc

SEQ ID NO: 4593879 - DNA, 17 bp, Homo sapiens
tcctgtccagctccaac

SEQ ID NO: 4593880 - DNA, 19 bp, Homo sapiens
tcctgtctttaaggaaaaa

SEQ ID NO: 4593881 - DNA, 20 bp, Homo sapiens
tccttcaagaactctgggct

SEQ ID NO: 4593882 - DNA, 14 bp, Homo sapiens
tccttgtgttacta

SEQ ID NO: 4593883 - DNA, 23 bp, Homo sapiens
tccttgtgttactaagtttttat

SEQ ID NO: 4593884 - DNA, 16 bp, Homo sapiens
tcgaggctgcagtcag

SEQ ID NO: 4593885 - DNA, 11 bp, Homo sapiens
tcgcccaggag

SEQ ID NO: 4593886 - DNA, 15 bp, Homo sapiens
tcggaaaacatgcta

SEQ ID NO: 4593887 - DNA, 23 bp, Homo sapiens
tcgtcactgcttaacttcacata

SEQ ID NO: 4593888 - DNA, 19 bp, Homo sapiens
tcgtttattttcaagaata

SEQ ID NO: 4593889 - DNA, 13 bp, Homo sapiens
tctaaaggctacc

SEQ ID NO: 4593890 - DNA, 18 bp, Homo sapiens
tctaaaggctacctttgt

SEQ ID NO: 4593891 - DNA, 12 bp, Homo sapiens
tctactaaaaat

SEQ ID NO: 4593892 - DNA, 13 bp, Homo sapiens
tctagatactgta

SEQ ID NO: 4593893 - DNA, 24 bp, Homo sapiens
tctagatactgtatcatgacaaag

SEQ ID NO: 4593894 - DNA, 13 bp, Homo sapiens
tctatgcctgtct

SEQ ID NO: 4593895 - DNA, 14 bp, Homo sapiens
tctatgttaatatt

SEQ ID NO: 4593896 - DNA, 13 bp, Homo sapiens
tctcaaatttcta

SEQ ID NO: 4593897 - DNA, 16 bp, Homo sapiens
tctcaaatttctaaat

SEQ ID NO: 4593898 - DNA, 14 bp, Homo sapiens
tctcagccctgcct

SEQ ID NO: 4593899 - DNA, 22 bp, Homo sapiens
tctccaaaataaaactttttaa

SEQ ID NO: 4593900 - DNA, 17 bp, Homo sapiens
tctccagccctgactaa

SEQ ID NO: 4593901 - DNA, 15 bp, Homo sapiens
tctcctaaattgttg

SEQ ID NO: 4593902 - DNA, 21 bp, Homo sapiens
tctcctcctccgcgctgtgta

SEQ ID NO: 4593903 - DNA, 13 bp, Homo sapiens
tctcctgtacctc

SEQ ID NO: 4593904 - DNA, 15 bp, Homo sapiens
tctcctgtacctctt

SEQ ID NO: 4593905 - DNA, 17 bp, Homo sapiens
tctcctgtacctcttga

SEQ ID NO: 4593906 - DNA, 19 bp, Homo sapiens
tctcctgtacctcttgagc

SEQ ID NO: 4593907 - DNA, 20 bp, Homo sapiens
tctctaacagtggacaaagt

SEQ ID NO: 4593908 - DNA, 15 bp, Homo sapiens
tctctagtttgatta

SEQ ID NO: 4593909 - DNA, 18 bp, Homo sapiens
tctctagtttgattaaat

SEQ ID NO: 4593910 - DNA, 16 bp, Homo sapiens
tctctctgcccaaccc

SEQ ID NO: 4593911 - DNA, 18 bp, Homo sapiens
tctcttgaggccaggagt

SEQ ID NO: 4593912 - DNA, 17 bp, Homo sapiens
tctgaactcaaactgag

SEQ ID NO: 4593913 - DNA, 22 bp, Homo sapiens
tctgaagtcacatcacaggaca

SEQ ID NO: 4593914 - DNA, 22 bp, Homo sapiens
tctgaattctgctctaaataaa

SEQ ID NO: 4593915 - DNA, 19 bp, Homo sapiens
tctgacccagtgcccccac

SEQ ID NO: 4593916 - DNA, 22 bp, Homo sapiens
tctgacccagtgcccccactga

SEQ ID NO: 4593917 - DNA, 22 bp, Homo sapiens
tctgagctatttcatctatttt

SEQ ID NO: 4593918 - DNA, 18 bp, Homo sapiens
tctgaggacaagagaaaa

SEQ ID NO: 4593919 - DNA, 15 bp, Homo sapiens
tctgcagataaacag

SEQ ID NO: 4593920 - DNA, 12 bp, Homo sapiens
tctgcccaaccc

SEQ ID NO: 4593921 - DNA, 18 bp, Homo sapiens
tctgcctgccagctgcac

SEQ ID NO: 4593922 - DNA, 21 bp, Homo sapiens
tctgcctgccagctgcactga

SEQ ID NO: 4593923 - DNA, 22 bp, Homo sapiens
tctgcctgccagctgcactgat

SEQ ID NO: 4593924 - DNA, 22 bp, Homo sapiens
tctgcgtggttcctttctcagc

SEQ ID NO: 4593925 - DNA, 15 bp, Homo sapiens
tctgctctaaataaa

SEQ ID NO: 4593926 - DNA, 17 bp, Homo sapiens
tctgctctaaataaaga

SEQ ID NO: 4593927 - DNA, 15 bp, Homo sapiens
tctggaacccagact

SEQ ID NO: 4593928 - DNA, 20 bp, Homo sapiens
tctggaacctcagcctggcc

SEQ ID NO: 4593929 - DNA, 23 bp, Homo sapiens
tctggaacctcagcctggccaga

SEQ ID NO: 4593930 - DNA, 18 bp, Homo sapiens
tctggacagccccaccct

SEQ ID NO: 4593931 - DNA, 15 bp, Homo sapiens
tctggcaacatcttt

SEQ ID NO: 4593932 - DNA, 16 bp, Homo sapiens
tctggcaacatcttta

SEQ ID NO: 4593933 - DNA, 22 bp, Homo sapiens
tctggctatgcatttgaaaatt

SEQ ID NO: 4593934 - DNA, 17 bp, Homo sapiens
tctgggctgctacccag

SEQ ID NO: 4593935 - DNA, 17 bp, Homo sapiens
tctggtgaagctcactt

SEQ ID NO: 4593936 - DNA, 13 bp, Homo sapiens
tctgtaaactgtg

SEQ ID NO: 4593937 - DNA, 13 bp, Homo sapiens
tctgtcctcagcc

SEQ ID NO: 4593938 - DNA, 14 bp, Homo sapiens
tctgtctcagtcca

SEQ ID NO: 4593939 - DNA, 15 bp, Homo sapiens
tctgtgcctgaatat

SEQ ID NO: 4593940 - DNA, 12 bp, Homo sapiens
tctgtgtttagc

SEQ ID NO: 4593941 - DNA, 17 bp, Homo sapiens
tctgttatgctgtgaca

SEQ ID NO: 4593942 - DNA, 19 bp, Homo sapiens
tctgtttagataatacacc

SEQ ID NO: 4593943 - DNA, 23 bp, Homo sapiens
tctgtttagataatacaccacta

SEQ ID NO: 4593944 - DNA, 15 bp, Homo sapiens
tcttcctgacacttt

SEQ ID NO: 4593945 - DNA, 19 bp, Homo sapiens
tcttctgaactcaaactga

SEQ ID NO: 4593946 - DNA, 16 bp, Homo sapiens
tcttgagccttgaact

SEQ ID NO: 4593947 - DNA, 18 bp, Homo sapiens
tcttgagccttgaacttt

SEQ ID NO: 4593948 - DNA, 20 bp, Homo sapiens
tcttgagccttgaactttga

SEQ ID NO: 4593949 - DNA, 16 bp, Homo sapiens
tcttggaccctgggag

SEQ ID NO: 4593950 - DNA, 11 bp, Homo sapiens
tctttatatga

SEQ ID NO: 4593951 - DNA, 21 bp, Homo sapiens
tctttcatttgctttggaagt

SEQ ID NO: 4593952 - DNA, 14 bp, Homo sapiens
tctttccaaagtac

SEQ ID NO: 4593953 - DNA, 17 bp, Homo sapiens
tctttccaaagtacact

SEQ ID NO: 4593954 - DNA, 23 bp, Homo sapiens
tctttccaaagtacactgtttca

SEQ ID NO: 4593955 - DNA, 13 bp, Homo sapiens
tctttctctgagg

SEQ ID NO: 4593956 - DNA, 21 bp, Homo sapiens
tctttctggctatgcatttga

SEQ ID NO: 4593957 - DNA, 19 bp, Homo sapiens
tcttttcccactgtttaag

SEQ ID NO: 4593958 - DNA, 13 bp, Homo sapiens
tgaaaacacattt

SEQ ID NO: 4593959 - DNA, 17 bp, Homo sapiens
tgaaaacacatttttct

SEQ ID NO: 4593960 - DNA, 12 bp, Homo sapiens
tgaaaattttga

SEQ ID NO: 4593961 - DNA, 15 bp, Homo sapiens
tgaaacaacttggaa

SEQ ID NO: 4593962 - DNA, 16 bp, Homo sapiens
tgaaacaacttggaaa

SEQ ID NO: 4593963 - DNA, 18 bp, Homo sapiens
tgaaaccctgtctctact

SEQ ID NO: 4593964 - DNA, 17 bp, Homo sapiens
tgaaactccagatgcca

SEQ ID NO: 4593965 - DNA, 18 bp, Homo sapiens
tgaaactccagatgccac

SEQ ID NO: 4593966 - DNA, 14 bp, Homo sapiens
tgaaataagccaga

SEQ ID NO: 4593967 - DNA, 17 bp, Homo sapiens
tgaaataagccagacat

SEQ ID NO: 4593968 - DNA, 20 bp, Homo sapiens
tgaaataagccagacatcaa

SEQ ID NO: 4593969 - DNA, 14 bp, Homo sapiens
tgaaattttaacct

SEQ ID NO: 4593970 - DNA, 22 bp, Homo sapiens
tgaaattttaacctatgatatt

SEQ ID NO: 4593971 - DNA, 16 bp, Homo sapiens
tgaaattttatatgct

SEQ ID NO: 4593972 - DNA, 22 bp, Homo sapiens
tgaaattttatatgcttactga

SEQ ID NO: 4593973 - DNA, 13 bp, Homo sapiens
tgaacaaatttac

SEQ ID NO: 4593974 - DNA, 18 bp, Homo sapiens
tgaactcaaactgaggaa

SEQ ID NO: 4593975 - DNA, 13 bp, Homo sapiens
tgaactgataaag

SEQ ID NO: 4593976 - DNA, 16 bp, Homo sapiens
tgaactttgacctctg

SEQ ID NO: 4593977 - DNA, 22 bp, Homo sapiens
tgaactttgacctctgcagcaa

SEQ ID NO: 4593978 - DNA, 21 bp, Homo sapiens
tgaagaaaatcacttaggaaa

SEQ ID NO: 4593979 - DNA, 13 bp, Homo sapiens
tgaagaactgagg

SEQ ID NO: 4593980 - DNA, 11 bp, Homo sapiens
tgaagacaatg

SEQ ID NO: 4593981 - DNA, 22 bp, Homo sapiens
tgaagacaatgacttactgtac

SEQ ID NO: 4593982 - DNA, 23 bp, Homo sapiens
tgaagacaatgacttactgtaca

SEQ ID NO: 4593983 - DNA, 21 bp, Homo sapiens
tgaagattctatgttaatatt

SEQ ID NO: 4593984 - DNA, 12 bp, Homo sapiens
tgaaggaccctt

SEQ ID NO: 4593985 - DNA, 18 bp, Homo sapiens
tgaagggccagagccagg

SEQ ID NO: 4593986 - DNA, 19 bp, Homo sapiens
tgaagggccagagccaggg

SEQ ID NO: 4593987 - DNA, 15 bp, Homo sapiens
tgaaggtgctgacgg

SEQ ID NO: 4593988 - DNA, 22 bp, Homo sapiens
tgaagtaatatgcacacatttt

SEQ ID NO: 4593989 - DNA, 16 bp, Homo sapiens
tgaatccaaactaatc

SEQ ID NO: 4593990 - DNA, 17 bp, Homo sapiens
tgaatgaggtcccaggc

SEQ ID NO: 4593991 - DNA, 19 bp, Homo sapiens
tgaatgaggtcccaggcag

SEQ ID NO: 4593992 - DNA, 15 bp, Homo sapiens
tgaatgtcagttgtt

SEQ ID NO: 4593993 - DNA, 20 bp, Homo sapiens
tgaattctgctctaaataaa

SEQ ID NO: 4593994 - DNA, 23 bp, Homo sapiens
tgaatttcttttgccgttattaa

SEQ ID NO: 4593995 - DNA, 19 bp, Homo sapiens
tgacaaagactgagtacgt

SEQ ID NO: 4593996 - DNA, 16 bp, Homo sapiens
tgacacatggcccctc

SEQ ID NO: 4593997 - DNA, 22 bp, Homo sapiens
tgacacatggcccctccccctg

SEQ ID NO: 4593998 - DNA, 21 bp, Homo sapiens
tgacactagcccaatgaaatg

SEQ ID NO: 4593999 - DNA, 22 bp, Homo sapiens
tgacactagcccaatgaaatga

SEQ ID NO: 4594000 - DNA, 15 bp, Homo sapiens
tgacacttaaaaatg

SEQ ID NO: 4594001 - DNA, 16 bp, Homo sapiens
tgacagcatcctctct

SEQ ID NO: 4594002 - DNA, 20 bp, Homo sapiens
tgaccactgcagaagacagt

SEQ ID NO: 4594003 - DNA, 23 bp, Homo sapiens
tgacctctgcagcaataaagcag

SEQ ID NO: 4594004 - DNA, 19 bp, Homo sapiens
tgactaaactaccacctca

SEQ ID NO: 4594005 - DNA, 21 bp, Homo sapiens
tgactaaactaccacctcagg

SEQ ID NO: 4594006 - DNA, 13 bp, Homo sapiens
tgactgaatttct

SEQ ID NO: 4594007 - DNA, 13 bp, Homo sapiens
tgacttactgtac

SEQ ID NO: 4594008 - DNA, 15 bp, Homo sapiens
tgacttactgtacat

SEQ ID NO: 4594009 - DNA, 19 bp, Homo sapiens
tgacttactgtacatgaaa

SEQ ID NO: 4594010 - DNA, 23 bp, Homo sapiens
tgactttttaaaaaatgctgggt

SEQ ID NO: 4594011 - DNA, 17 bp, Homo sapiens
tgagaaagaggcaggga

SEQ ID NO: 4594012 - DNA, 19 bp, Homo sapiens
tgagaggctgtctgttgta

SEQ ID NO: 4594013 - DNA, 13 bp, Homo sapiens
tgagccccaaaag

SEQ ID NO: 4594014 - DNA, 14 bp, Homo sapiens
tgagccttcagtct

SEQ ID NO: 4594015 - DNA, 13 bp, Homo sapiens
tgagcgacagtga

SEQ ID NO: 4594016 - DNA, 20 bp, Homo sapiens
tgagcgacagtgagactctg

SEQ ID NO: 4594017 - DNA, 21 bp, Homo sapiens
tgaggaatttcacctgtaaac

SEQ ID NO: 4594018 - DNA, 22 bp, Homo sapiens
tgaggaatttcacctgtaaacc

SEQ ID NO: 4594019 - DNA, 22 bp, Homo sapiens
tgaggacaagagaaaaaagcca

SEQ ID NO: 4594020 - DNA, 13 bp, Homo sapiens
tgaggagctgggg

SEQ ID NO: 4594021 - DNA, 20 bp, Homo sapiens
tgaggagctggggatccctc

SEQ ID NO: 4594022 - DNA, 17 bp, Homo sapiens
tgaggcaatgtcaggaa

SEQ ID NO: 4594023 - DNA, 19 bp, Homo sapiens
tgaggcatttgtttgaact

SEQ ID NO: 4594024 - DNA, 14 bp, Homo sapiens
tgagggtaagtatt

SEQ ID NO: 4594025 - DNA, 14 bp, Homo sapiens
tgagggtcgtggga

SEQ ID NO: 4594026 - DNA, 22 bp, Homo sapiens
tgagggtcgtgggaaaggggag

SEQ ID NO: 4594027 - DNA, 22 bp, Homo sapiens
tgaggtactgagagtgaacaaa

SEQ ID NO: 4594028 - DNA, 17 bp, Homo sapiens
tgaggtcccaggcagag

SEQ ID NO: 4594029 - DNA, 17 bp, Homo sapiens
tgagtacgttgtgcatt

SEQ ID NO: 4594030 - DNA, 18 bp, Homo sapiens
tgagtacgttgtgcattt

SEQ ID NO: 4594031 - DNA, 16 bp, Homo sapiens
tgataacatggaaatg

SEQ ID NO: 4594032 - DNA, 18 bp, Homo sapiens
tgatacaatgctgtgccc

SEQ ID NO: 4594033 - DNA, 20 bp, Homo sapiens
tgatacaatgctgtgcccta

SEQ ID NO: 4594034 - DNA, 21 bp, Homo sapiens
tgatacaatgctgtgccctaa

SEQ ID NO: 4594035 - DNA, 17 bp, Homo sapiens
tgatattttctgtgcct

SEQ ID NO: 4594036 - DNA, 13 bp, Homo sapiens
tgatccaactaat

SEQ ID NO: 4594037 - DNA, 15 bp, Homo sapiens
tgatccttacaagtt

SEQ ID NO: 4594038 - DNA, 16 bp, Homo sapiens
tgatggcaacagatct

SEQ ID NO: 4594039 - DNA, 23 bp, Homo sapiens
tgatggcaacagatctggaacct

SEQ ID NO: 4594040 - DNA, 13 bp, Homo sapiens
tgattaaattctt

SEQ ID NO: 4594041 - DNA, 16 bp, Homo sapiens
tgattaaattcttgca

SEQ ID NO: 4594042 - DNA, 17 bp, Homo sapiens
tgattaaattcttgcaa

SEQ ID NO: 4594043 - DNA, 21 bp, Homo sapiens
tgattcaatctgtaaactgtg

SEQ ID NO: 4594044 - DNA, 13 bp, Homo sapiens
tgattctgccttt

SEQ ID NO: 4594045 - DNA, 21 bp, Homo sapiens
tgatttaggagaagccaggaa

SEQ ID NO: 4594046 - DNA, 17 bp, Homo sapiens
tgatttggggatatttt

SEQ ID NO: 4594047 - DNA, 12 bp, Homo sapiens
tgcaaagatctg

SEQ ID NO: 4594048 - DNA, 18 bp, Homo sapiens
tgcaagcaacaagctatt

SEQ ID NO: 4594049 - DNA, 19 bp, Homo sapiens
tgcaagcaacaagctattt

SEQ ID NO: 4594050 - DNA, 15 bp, Homo sapiens
tgcaaggaaggaaag

SEQ ID NO: 4594051 - DNA, 19 bp, Homo sapiens
tgcaataaatctgacccag

SEQ ID NO: 4594052 - DNA, 20 bp, Homo sapiens
tgcacaataaaaatgtttaa

SEQ ID NO: 4594053 - DNA, 15 bp, Homo sapiens
tgcacacatttttta

SEQ ID NO: 4594054 - DNA, 17 bp, Homo sapiens
tgcacagagttgttaca

SEQ ID NO: 4594055 - DNA, 22 bp, Homo sapiens
tgcacctggaatatataaccag

SEQ ID NO: 4594056 - DNA, 17 bp, Homo sapiens
tgcactccagcctgagc

SEQ ID NO: 4594057 - DNA, 20 bp, Homo sapiens
tgcactccagcctgggcaac

SEQ ID NO: 4594058 - DNA, 14 bp, Homo sapiens
tgcactgatgctgc

SEQ ID NO: 4594059 - DNA, 16 bp, Homo sapiens
tgcactgatgctgccc

SEQ ID NO: 4594060 - DNA, 22 bp, Homo sapiens
tgcactgatgctgcccctcatc

SEQ ID NO: 4594061 - DNA, 18 bp, Homo sapiens
tgcactgtgaaggaccct

SEQ ID NO: 4594062 - DNA, 16 bp, Homo sapiens
tgcagcaataaagcag

SEQ ID NO: 4594063 - DNA, 20 bp, Homo sapiens
tgcagcaataaagcagcgtt

SEQ ID NO: 4594064 - DNA, 23 bp, Homo sapiens
tgcagcaataaagcagcgtttct

SEQ ID NO: 4594065 - DNA, 20 bp, Homo sapiens
tgcagtacatgggtgactat

SEQ ID NO: 4594066 - DNA, 21 bp, Homo sapiens
tgcagtcagtcatgatggcac

SEQ ID NO: 4594067 - DNA, 14 bp, Homo sapiens
tgcagtgagccgag

SEQ ID NO: 4594068 - DNA, 22 bp, Homo sapiens
tgcataccacttttgttcttgg

SEQ ID NO: 4594069 - DNA, 18 bp, Homo sapiens
tgcatactttttaaatgt

SEQ ID NO: 4594070 - DNA, 19 bp, Homo sapiens
tgcatactttttaaatgta

SEQ ID NO: 4594071 - DNA, 18 bp, Homo sapiens
tgcatggtgccccaggac

SEQ ID NO: 4594072 - DNA, 19 bp, Homo sapiens
tgcatggtgccccaggacc

SEQ ID NO: 4594073 - DNA, 20 bp, Homo sapiens
tgcatggtgccccaggacca

SEQ ID NO: 4594074 - DNA, 17 bp, Homo sapiens
tgcattatctagatact

SEQ ID NO: 4594075 - DNA, 19 bp, Homo sapiens
tgcatttgaaaattttgat

SEQ ID NO: 4594076 - DNA, 20 bp, Homo sapiens
tgcatttgaggtctgttctt

SEQ ID NO: 4594077 - DNA, 23 bp, Homo sapiens
tgccaagtcatagccataaatga

SEQ ID NO: 4594078 - DNA, 13 bp, Homo sapiens
tgccaatttcaag

SEQ ID NO: 4594079 - DNA, 21 bp, Homo sapiens
tgccacaccggtaccctcctc

SEQ ID NO: 4594080 - DNA, 22 bp, Homo sapiens
tgccacattaaattgataacat

SEQ ID NO: 4594081 - DNA, 16 bp, Homo sapiens
tgccactaaattgaca

SEQ ID NO: 4594082 - DNA, 17 bp, Homo sapiens
tgcccccactgaccaga

SEQ ID NO: 4594083 - DNA, 17 bp, Homo sapiens
tgccctaaagtgtattt

SEQ ID NO: 4594084 - DNA, 19 bp, Homo sapiens
tgccctaaagtgtattttt

SEQ ID NO: 4594085 - DNA, 22 bp, Homo sapiens
tgccctgggggataccagctga

SEQ ID NO: 4594086 - DNA, 18 bp, Homo sapiens
tgcctaataaacatcctt

SEQ ID NO: 4594087 - DNA, 21 bp, Homo sapiens
tgcctaataaacatccttcaa

SEQ ID NO: 4594088 - DNA, 21 bp, Homo sapiens
tgcctctcatcaactgaatga

SEQ ID NO: 4594089 - DNA, 18 bp, Homo sapiens
tgcctgacagcatcctct

SEQ ID NO: 4594090 - DNA, 15 bp, Homo sapiens
tgcctgccagctgca

SEQ ID NO: 4594091 - DNA, 19 bp, Homo sapiens
tgcctgccagctgcactga

SEQ ID NO: 4594092 - DNA, 18 bp, Homo sapiens
tgcctgtaatcacagcta

SEQ ID NO: 4594093 - DNA, 19 bp, Homo sapiens
tgccttactcttcttgaaa

SEQ ID NO: 4594094 - DNA, 15 bp, Homo sapiens
tgccttcctgttttt

SEQ ID NO: 4594095 - DNA, 19 bp, Homo sapiens
tgccttcctgtttttcaca

SEQ ID NO: 4594096 - DNA, 19 bp, Homo sapiens
tgcgaatctagaggagggg

SEQ ID NO: 4594097 - DNA, 13 bp, Homo sapiens
tgcgttttggaag

SEQ ID NO: 4594098 - DNA, 21 bp, Homo sapiens
tgctaaatggtcgcccaggag

SEQ ID NO: 4594099 - DNA, 22 bp, Homo sapiens
tgctaaatggtcgcccaggaga

SEQ ID NO: 4594100 - DNA, 20 bp, Homo sapiens
tgctcagctgtcaaggctca

SEQ ID NO: 4594101 - DNA, 22 bp, Homo sapiens
tgctcatattgtgattctgcct

SEQ ID NO: 4594102 - DNA, 23 bp, Homo sapiens
tgctcatattgtgattctgcctt

SEQ ID NO: 4594103 - DNA, 12 bp, Homo sapiens
tgctccagacct

SEQ ID NO: 4594104 - DNA, 21 bp, Homo sapiens
tgctccagacctgatcctgga

SEQ ID NO: 4594105 - DNA, 16 bp, Homo sapiens
tgctctaaataaagac

SEQ ID NO: 4594106 - DNA, 17 bp, Homo sapiens
tgctctaaataaagacg

SEQ ID NO: 4594107 - DNA, 17 bp, Homo sapiens
tgctgaaattttatatg

SEQ ID NO: 4594108 - DNA, 14 bp, Homo sapiens
tgctgcaaacctga

SEQ ID NO: 4594109 - DNA, 20 bp, Homo sapiens
tgctgcaaacctgacccctg

SEQ ID NO: 4594110 - DNA, 19 bp, Homo sapiens
tgctgcatttaaaagatac

SEQ ID NO: 4594111 - DNA, 13 bp, Homo sapiens
tgctggagctctg

SEQ ID NO: 4594112 - DNA, 22 bp, Homo sapiens
tgctggcccagggcccagagcc

SEQ ID NO: 4594113 - DNA, 17 bp, Homo sapiens
tgcttaacttcacatat

SEQ ID NO: 4594114 - DNA, 19 bp, Homo sapiens
tgcttaacttcacatattg

SEQ ID NO: 4594115 - DNA, 16 bp, Homo sapiens
tgcttgagcccaggag

SEQ ID NO: 4594116 - DNA, 14 bp, Homo sapiens
tgcttgtacataat

SEQ ID NO: 4594117 - DNA, 12 bp, Homo sapiens
tgctttgtgatt

SEQ ID NO: 4594118 - DNA, 16 bp, Homo sapiens
tgctttgtgatttttg

SEQ ID NO: 4594119 - DNA, 18 bp, Homo sapiens
tggaaagataactaggaa

SEQ ID NO: 4594120 - DNA, 17 bp, Homo sapiens
tggaacccagactcaga

SEQ ID NO: 4594121 - DNA, 17 bp, Homo sapiens
tggaacctcagcctggc

SEQ ID NO: 4594122 - DNA, 19 bp, Homo sapiens
tggaacctcagcctggcca

SEQ ID NO: 4594123 - DNA, 23 bp, Homo sapiens
tggaacctcagcctggccagaca

SEQ ID NO: 4594124 - DNA, 15 bp, Homo sapiens
tggaagccagctttc

SEQ ID NO: 4594125 - DNA, 12 bp, Homo sapiens
tggaagcctcag

SEQ ID NO: 4594126 - DNA, 13 bp, Homo sapiens
tggaagcctcaga

SEQ ID NO: 4594127 - DNA, 18 bp, Homo sapiens
tggaagtgaaaactttgt

SEQ ID NO: 4594128 - DNA, 19 bp, Homo sapiens
tggaagtgaaaactttgta

SEQ ID NO: 4594129 - DNA, 16 bp, Homo sapiens
tggaagtgtatttatt

SEQ ID NO: 4594130 - DNA, 15 bp, Homo sapiens
tggaataagttcaaa

SEQ ID NO: 4594131 - DNA, 15 bp, Homo sapiens
tggaatatataacca

SEQ ID NO: 4594132 - DNA, 16 bp, Homo sapiens
tggaatatataaccag

SEQ ID NO: 4594133 - DNA, 17 bp, Homo sapiens
tggacacacaaggtgca

SEQ ID NO: 4594134 - DNA, 20 bp, Homo sapiens
tggaccaatagggctgagct

SEQ ID NO: 4594135 - DNA, 13 bp, Homo sapiens
tggaccctgggag

SEQ ID NO: 4594136 - DNA, 22 bp, Homo sapiens
tggacctaatccaagcatccct

SEQ ID NO: 4594137 - DNA, 19 bp, Homo sapiens
tggacttgtccaattaatg

SEQ ID NO: 4594138 - DNA, 22 bp, Homo sapiens
tggagaagtgggtggggacaga

SEQ ID NO: 4594139 - DNA, 12 bp, Homo sapiens
tggaggcccagt

SEQ ID NO: 4594140 - DNA, 13 bp, Homo sapiens
tggataccattat

SEQ ID NO: 4594141 - DNA, 17 bp, Homo sapiens
tggatatagttttactt

SEQ ID NO: 4594142 - DNA, 19 bp, Homo sapiens
tggatcataagacaatgga

SEQ ID NO: 4594143 - DNA, 18 bp, Homo sapiens
tggatgggggaactcaga

SEQ ID NO: 4594144 - DNA, 22 bp, Homo sapiens
tggatgggggaactcagatcca

SEQ ID NO: 4594145 - DNA, 20 bp, Homo sapiens
tggattactgccattcactt

SEQ ID NO: 4594146 - DNA, 23 bp, Homo sapiens
tggattgtgcctaatgtgtttga

SEQ ID NO: 4594147 - DNA, 21 bp, Homo sapiens
tggcaccactgcactccagcc

SEQ ID NO: 4594148 - DNA, 20 bp, Homo sapiens
tggcacggtggctcaggcct

SEQ ID NO: 4594149 - DNA, 22 bp, Homo sapiens
tggcatacgcctgtagtcctag

SEQ ID NO: 4594150 - DNA, 14 bp, Homo sapiens
tggccacggccaca

SEQ ID NO: 4594151 - DNA, 17 bp, Homo sapiens
tggcccagggcccagag

SEQ ID NO: 4594152 - DNA, 15 bp, Homo sapiens
tggcccccgacccag

SEQ ID NO: 4594153 - DNA, 17 bp, Homo sapiens
tggcccccgacccagct

SEQ ID NO: 4594154 - DNA, 19 bp, Homo sapiens
tggcccccgacccagctct

SEQ ID NO: 4594155 - DNA, 19 bp, Homo sapiens
tggcccctccccctgccag

SEQ ID NO: 4594156 - DNA, 13 bp, Homo sapiens
tggcctcttcaga

SEQ ID NO: 4594157 - DNA, 22 bp, Homo sapiens
tggctagaggttcaaagatatt

SEQ ID NO: 4594158 - DNA, 12 bp, Homo sapiens
aaaaaaactatt

SEQ ID NO: 4594159 - DNA, 15 bp, Homo sapiens
aaaaaacagaggcca

SEQ ID NO: 4594160 - DNA, 22 bp, Homo sapiens
aaaaaattagaaattggctgga

SEQ ID NO: 4594161 - DNA, 14 bp, Homo sapiens
aaaaacagaggcca

SEQ ID NO: 4594162 - DNA, 14 bp, Homo sapiens
aaaaatctcaaatt

SEQ ID NO: 4594163 - DNA, 17 bp, Homo sapiens
aaaaatctcaaatttct

SEQ ID NO: 4594164 - DNA, 19 bp, Homo sapiens
aaaaatctcaaatttctaa

SEQ ID NO: 4594165 - DNA, 20 bp, Homo sapiens
aaaaatctcaaatttctaaa

SEQ ID NO: 4594166 - DNA, 17 bp, Homo sapiens
aaaacacatttttctta

SEQ ID NO: 4594167 - DNA, 18 bp, Homo sapiens
aaaacataatcttctgcc

SEQ ID NO: 4594168 - DNA, 21 bp, Homo sapiens
aaaactttatgctaagtgaaa

SEQ ID NO: 4594169 - DNA, 17 bp, Homo sapiens
aaaagaaagaaaatcag

SEQ ID NO: 4594170 - DNA, 19 bp, Homo sapiens
aaaagtattttttcaagtt

SEQ ID NO: 4594171 - DNA, 14 bp, Homo sapiens
aaaataccagccag

SEQ ID NO: 4594172 - DNA, 18 bp, Homo sapiens
aaaatctcaaatttctaa

SEQ ID NO: 4594173 - DNA, 19 bp, Homo sapiens
aaaatctcaaatttctaaa

SEQ ID NO: 4594174 - DNA, 11 bp, Homo sapiens
aaaatgctggg

SEQ ID NO: 4594175 - DNA, 19 bp, Homo sapiens
aaaatgtgctatactgcat

SEQ ID NO: 4594176 - DNA, 20 bp, Homo sapiens
aaaatgtgctatactgcata

SEQ ID NO: 4594177 - DNA, 20 bp, Homo sapiens
aaaattttgatgttttaagg

SEQ ID NO: 4594178 - DNA, 16 bp, Homo sapiens
aaacacatttttctta

SEQ ID NO: 4594179 - DNA, 14 bp, Homo sapiens
aaacattaaaatat

SEQ ID NO: 4594180 - DNA, 13 bp, Homo sapiens
aaactatttaaca

SEQ ID NO: 4594181 - DNA, 18 bp, Homo sapiens
aaactctgttacactttt

SEQ ID NO: 4594182 - DNA, 13 bp, Homo sapiens
aaactcttttccc

SEQ ID NO: 4594183 - DNA, 19 bp, Homo sapiens
aaactgaggaatttcacct

SEQ ID NO: 4594184 - DNA, 19 bp, Homo sapiens
aaactgtgtattccaagac

SEQ ID NO: 4594185 - DNA, 14 bp, Homo sapiens
aaacttaatctaaa

SEQ ID NO: 4594186 - DNA, 19 bp, Homo sapiens
aaacttcagacatagaatt

SEQ ID NO: 4594187 - DNA, 12 bp, Homo sapiens
aaactttatgct

SEQ ID NO: 4594188 - DNA, 19 bp, Homo sapiens
aaactttatgctaagtgaa

SEQ ID NO: 4594189 - DNA, 12 bp, Homo sapiens
aaactttgtagt

SEQ ID NO: 4594190 - DNA, 15 bp, Homo sapiens
aaagaacgctgattt

SEQ ID NO: 4594191 - DNA, 18 bp, Homo sapiens
aaagaacgctgatttaaa

SEQ ID NO: 4594192 - DNA, 15 bp, Homo sapiens
aaagatacagttact

SEQ ID NO: 4594193 - DNA, 20 bp, Homo sapiens
aaagatattttgctttgtga

SEQ ID NO: 4594194 - DNA, 21 bp, Homo sapiens
aaagatctgtcctcagccttg

SEQ ID NO: 4594195 - DNA, 15 bp, Homo sapiens
aaagatgagtgagca

SEQ ID NO: 4594196 - DNA, 19 bp, Homo sapiens
aaagctttttattcctcct

SEQ ID NO: 4594197 - DNA, 14 bp, Homo sapiens
aaaggatgcacaga

SEQ ID NO: 4594198 - DNA, 19 bp, Homo sapiens
aaaggcagaagcaacccaa

SEQ ID NO: 4594199 - DNA, 21 bp, Homo sapiens
aaaggcctaattctatgcctg

SEQ ID NO: 4594200 - DNA, 14 bp, Homo sapiens
aaaggctacctttg

SEQ ID NO: 4594201 - DNA, 18 bp, Homo sapiens
aaagtacactgtttcaaa

SEQ ID NO: 4594202 - DNA, 19 bp, Homo sapiens
aaagtacactgtttcaaac

SEQ ID NO: 4594203 - DNA, 16 bp, Homo sapiens
aaagttaccagtgcct

SEQ ID NO: 4594204 - DNA, 14 bp, Homo sapiens
aaagtttgtttgct

SEQ ID NO: 4594205 - DNA, 13 bp, Homo sapiens
aaataaagtctct

SEQ ID NO: 4594206 - DNA, 15 bp, Homo sapiens
aaataagaaaaatat

SEQ ID NO: 4594207 - DNA, 22 bp, Homo sapiens
aaataatgtgaaactggattaa

SEQ ID NO: 4594208 - DNA, 15 bp, Homo sapiens
aaatacagactggat

SEQ ID NO: 4594209 - DNA, 17 bp, Homo sapiens
aaatacatttaaaacat

SEQ ID NO: 4594210 - DNA, 17 bp, Homo sapiens
aaatagacagcatgaga

SEQ ID NO: 4594211 - DNA, 16 bp, Homo sapiens
aaatagggtctaactc

SEQ ID NO: 4594212 - DNA, 15 bp, Homo sapiens
aaatctcaaatttct

SEQ ID NO: 4594213 - DNA, 17 bp, Homo sapiens
aaatctcaaatttctaa

SEQ ID NO: 4594214 - DNA, 19 bp, Homo sapiens
aaatctccaaaataaaact

SEQ ID NO: 4594215 - DNA, 21 bp, Homo sapiens
aaatgaaagcagggacttgaa

SEQ ID NO: 4594216 - DNA, 22 bp, Homo sapiens
aaatgaaagcagggacttgaac

SEQ ID NO: 4594217 - DNA, 18 bp, Homo sapiens
aaatgcacctggaatata

SEQ ID NO: 4594218 - DNA, 11 bp, Homo sapiens
aaatgctgggt

SEQ ID NO: 4594219 - DNA, 13 bp, Homo sapiens
aaatggggccaga

SEQ ID NO: 4594220 - DNA, 16 bp, Homo sapiens
aaatggggccagatcc

SEQ ID NO: 4594221 - DNA, 17 bp, Homo sapiens
aaatggggccagatcca

SEQ ID NO: 4594222 - DNA, 15 bp, Homo sapiens
aaatgggggtgcatt

SEQ ID NO: 4594223 - DNA, 17 bp, Homo sapiens
aaatggtcgcccaggag

SEQ ID NO: 4594224 - DNA, 17 bp, Homo sapiens
aaatgttcatcaatgaa

SEQ ID NO: 4594225 - DNA, 17 bp, Homo sapiens
aaatgttggtcatttta

SEQ ID NO: 4594226 - DNA, 12 bp, Homo sapiens
aaattaactttt

SEQ ID NO: 4594227 - DNA, 13 bp, Homo sapiens
aaattaactttta

SEQ ID NO: 4594228 - DNA, 23 bp, Homo sapiens
aaattcttctgaactcaaactga

SEQ ID NO: 4594229 - DNA, 18 bp, Homo sapiens
aaattcttgcaaagtatc

SEQ ID NO: 4594230 - DNA, 21 bp, Homo sapiens
aaattcttgcaaagtatccct

SEQ ID NO: 4594231 - DNA, 14 bp, Homo sapiens
aacaacctcaactg

SEQ ID NO: 4594232 - DNA, 18 bp, Homo sapiens
aacaacctcaactgccta

SEQ ID NO: 4594233 - DNA, 13 bp, Homo sapiens
aacaatttatgaa

SEQ ID NO: 4594234 - DNA, 14 bp, Homo sapiens
aacactgagaaaga

SEQ ID NO: 4594235 - DNA, 21 bp, Homo sapiens
aacagaaatgtacagcaagga

SEQ ID NO: 4594236 - DNA, 22 bp, Homo sapiens
aacagtagtgatagttgtaccg

SEQ ID NO: 4594237 - DNA, 15 bp, Homo sapiens
aacagtgattaccag

SEQ ID NO: 4594238 - DNA, 17 bp, Homo sapiens
aacatgtgaaaagaata

SEQ ID NO: 4594239 - DNA, 13 bp, Homo sapiens
aacattaaaatat

SEQ ID NO: 4594240 - DNA, 18 bp, Homo sapiens
aaccagtccccccaccct

SEQ ID NO: 4594241 - DNA, 17 bp, Homo sapiens
aaccagtgttgtggatt

SEQ ID NO: 4594242 - DNA, 19 bp, Homo sapiens
aaccatttgaaacccctgt

SEQ ID NO: 4594243 - DNA, 12 bp, Homo sapiens
aacccagactca

SEQ ID NO: 4594244 - DNA, 16 bp, Homo sapiens
aacccgggaggcagag

SEQ ID NO: 4594245 - DNA, 16 bp, Homo sapiens
aaccgtctgttatgct

SEQ ID NO: 4594246 - DNA, 16 bp, Homo sapiens
aacctcaactgcctac

SEQ ID NO: 4594247 - DNA, 13 bp, Homo sapiens
aacctcagcctgg

SEQ ID NO: 4594248 - DNA, 16 bp, Homo sapiens
aacctcagcctggcca

SEQ ID NO: 4594249 - DNA, 20 bp, Homo sapiens
aacctcagcctggccagaca

SEQ ID NO: 4594250 - DNA, 20 bp, Homo sapiens
aacctgagccccaaaaggta

SEQ ID NO: 4594251 - DNA, 20 bp, Homo sapiens
aacctgagtcgtacagaaag

SEQ ID NO: 4594252 - DNA, 18 bp, Homo sapiens
aaccttgaaaactttatg

SEQ ID NO: 4594253 - DNA, 19 bp, Homo sapiens
aaccttgtctctatgccag

SEQ ID NO: 4594254 - DNA, 13 bp, Homo sapiens
aactaccacctca

SEQ ID NO: 4594255 - DNA, 22 bp, Homo sapiens
aactcaaactgaggaatttcac

SEQ ID NO: 4594256 - DNA, 15 bp, Homo sapiens
aactcagatccaggg

SEQ ID NO: 4594257 - DNA, 22 bp, Homo sapiens
aactcagatccagggacagagg

SEQ ID NO: 4594258 - DNA, 22 bp, Homo sapiens
aactctctccaccctatatgta

SEQ ID NO: 4594259 - DNA, 16 bp, Homo sapiens
aactctgcttgatttt

SEQ ID NO: 4594260 - DNA, 16 bp, Homo sapiens
aactctgttacacttt

SEQ ID NO: 4594261 - DNA, 22 bp, Homo sapiens
aactctgttacactttttggaa

SEQ ID NO: 4594262 - DNA, 23 bp, Homo sapiens
aactgtgtacataactgaaaatg

SEQ ID NO: 4594263 - DNA, 13 bp, Homo sapiens
aacttcacatatt

SEQ ID NO: 4594264 - DNA, 22 bp, Homo sapiens
aacttcaccatattaccacaga

SEQ ID NO: 4594265 - DNA, 17 bp, Homo sapiens
aacttctgggcctctct

SEQ ID NO: 4594266 - DNA, 22 bp, Homo sapiens
aacttggggagttaagacctgg

SEQ ID NO: 4594267 - DNA, 13 bp, Homo sapiens
aactttacctttt

SEQ ID NO: 4594268 - DNA, 13 bp, Homo sapiens
aactttgacctct

SEQ ID NO: 4594269 - DNA, 17 bp, Homo sapiens
aactttgacctctgcag

SEQ ID NO: 4594270 - DNA, 19 bp, Homo sapiens
aacttttataaactttacc

SEQ ID NO: 4594271 - DNA, 15 bp, Homo sapiens
aagaaaaaggatgca

SEQ ID NO: 4594272 - DNA, 15 bp, Homo sapiens
aagaaaatagtggtg

SEQ ID NO: 4594273 - DNA, 21 bp, Homo sapiens
aagaaaatagtggtgtgattt

SEQ ID NO: 4594274 - DNA, 22 bp, Homo sapiens
aagaaaatagtggtgtgatttg

SEQ ID NO: 4594275 - DNA, 14 bp, Homo sapiens
aagaaagaaaatca

SEQ ID NO: 4594276 - DNA, 12 bp, Homo sapiens
aagacatgtctg

SEQ ID NO: 4594277 - DNA, 14 bp, Homo sapiens
aagacgactacaga

SEQ ID NO: 4594278 - DNA, 23 bp, Homo sapiens
aagatacagttactcagaattct

SEQ ID NO: 4594279 - DNA, 15 bp, Homo sapiens
aagatattttgcttt

SEQ ID NO: 4594280 - DNA, 17 bp, Homo sapiens
aagatattttgctttgt

SEQ ID NO: 4594281 - DNA, 15 bp, Homo sapiens
aagatgttctggata

SEQ ID NO: 4594282 - DNA, 20 bp, Homo sapiens
aagatgttctggataccatt

SEQ ID NO: 4594283 - DNA, 13 bp, Homo sapiens
aagcaaaatgtga

SEQ ID NO: 4594284 - DNA, 14 bp, Homo sapiens
aagcagcgtttcta

SEQ ID NO: 4594285 - DNA, 20 bp, Homo sapiens
aagcagcgtttctatgacac

SEQ ID NO: 4594286 - DNA, 22 bp, Homo sapiens
aagcagcgtttctatgacacat

SEQ ID NO: 4594287 - DNA, 13 bp, Homo sapiens
aagcattttgtaa

SEQ ID NO: 4594288 - DNA, 14 bp, Homo sapiens
aagcattttgtaat

SEQ ID NO: 4594289 - DNA, 11 bp, Homo sapiens
aagccagcctg

SEQ ID NO: 4594290 - DNA, 12 bp, Homo sapiens
aagccagcctgg

SEQ ID NO: 4594291 - DNA, 15 bp, Homo sapiens
aagccagctttccct

SEQ ID NO: 4594292 - DNA, 20 bp, Homo sapiens
aagccaggaatttcccagga

SEQ ID NO: 4594293 - DNA, 21 bp, Homo sapiens
aagccaggaatttcccaggac

SEQ ID NO: 4594294 - DNA, 21 bp, Homo sapiens
aagccaggttccacagaggac

SEQ ID NO: 4594295 - DNA, 16 bp, Homo sapiens
aagcccccagctaaga

SEQ ID NO: 4594296 - DNA, 21 bp, Homo sapiens
aagcccccagctaagaacctg

SEQ ID NO: 4594297 - DNA, 23 bp, Homo sapiens
aagcccccagctaagaacctgga

SEQ ID NO: 4594298 - DNA, 15 bp, Homo sapiens
aagcctcaaaacaaa

SEQ ID NO: 4594299 - DNA, 16 bp, Homo sapiens
aagcctcaaaacaaag

SEQ ID NO: 4594300 - DNA, 16 bp, Homo sapiens
aagctcctctccccag

SEQ ID NO: 4594301 - DNA, 16 bp, Homo sapiens
aagctctgaagtcaca

SEQ ID NO: 4594302 - DNA, 22 bp, Homo sapiens
aagctctgaagtcacatcacag

SEQ ID NO: 4594303 - DNA, 12 bp, Homo sapiens
aaggaaggaaag

SEQ ID NO: 4594304 - DNA, 16 bp, Homo sapiens
aaggaaggaaagaaag

SEQ ID NO: 4594305 - DNA, 14 bp, Homo sapiens
aaggaagtgaagag

SEQ ID NO: 4594306 - DNA, 17 bp, Homo sapiens
aaggacttcctgtccag

SEQ ID NO: 4594307 - DNA, 22 bp, Homo sapiens
aaggacttcctgtccagctcca

SEQ ID NO: 4594308 - DNA, 14 bp, Homo sapiens
aaggagatttacaa

SEQ ID NO: 4594309 - DNA, 17 bp, Homo sapiens
aaggaggggctgtaaaa

SEQ ID NO: 4594310 - DNA, 20 bp, Homo sapiens
aaggatagatgctggcccag

SEQ ID NO: 4594311 - DNA, 23 bp, Homo sapiens
aaggatgaatgaggtcccaggca

SEQ ID NO: 4594312 - DNA, 24 bp, Homo sapiens
aaggatgcacagagttgttacatt

SEQ ID NO: 4594313 - DNA, 15 bp, Homo sapiens
aaggatgcttgtaca

SEQ ID NO: 4594314 - DNA, 22 bp, Homo sapiens
aaggcaaccaataaaagccaga

SEQ ID NO: 4594315 - DNA, 18 bp, Homo sapiens
aaggcaggggaatgtatg

SEQ ID NO: 4594316 - DNA, 20 bp, Homo sapiens
aaggcaggggaatgtatgtg

SEQ ID NO: 4594317 - DNA, 15 bp, Homo sapiens
aagggactacctctg

SEQ ID NO: 4594318 - DNA, 11 bp, Homo sapiens
aagggccagag

SEQ ID NO: 4594319 - DNA, 12 bp, Homo sapiens
aagggccagagc

SEQ ID NO: 4594320 - DNA, 16 bp, Homo sapiens
aagggccagagccagg

SEQ ID NO: 4594321 - DNA, 17 bp, Homo sapiens
aagggccagagccaggg

SEQ ID NO: 4594322 - DNA, 16 bp, Homo sapiens
aaggggagcccactgt

SEQ ID NO: 4594323 - DNA, 14 bp, Homo sapiens
aaggggcagtggtg

SEQ ID NO: 4594324 - DNA, 18 bp, Homo sapiens
aaggtactttcatatttt

SEQ ID NO: 4594325 - DNA, 22 bp, Homo sapiens
aaggtactttcatattttaaac

SEQ ID NO: 4594326 - DNA, 12 bp, Homo sapiens
aaggtcattttt

SEQ ID NO: 4594327 - DNA, 16 bp, Homo sapiens
aagtaatatgcacaca

SEQ ID NO: 4594328 - DNA, 17 bp, Homo sapiens
aagtaatatgcacacat

SEQ ID NO: 4594329 - DNA, 21 bp, Homo sapiens
aagtaatatgcacacattttt

SEQ ID NO: 4594330 - DNA, 12 bp, Homo sapiens
aagtagaggagg

SEQ ID NO: 4594331 - DNA, 16 bp, Homo sapiens
aagtattatacctttt

SEQ ID NO: 4594332 - DNA, 15 bp, Homo sapiens
aagtattttcctgtt

SEQ ID NO: 4594333 - DNA, 16 bp, Homo sapiens
aagtgaaatcaaaggt

SEQ ID NO: 4594334 - DNA, 19 bp, Homo sapiens
aagtgaagacaatgactta

SEQ ID NO: 4594335 - DNA, 22 bp, Homo sapiens
aagtgggtggggacagaccagc

SEQ ID NO: 4594336 - DNA, 18 bp, Homo sapiens
aagtgtatttttttacta

SEQ ID NO: 4594337 - DNA, 23 bp, Homo sapiens
aagtgtatttttttactaataga

SEQ ID NO: 4594338 - DNA, 14 bp, Homo sapiens
aagttgattcatat

SEQ ID NO: 4594339 - DNA, 23 bp, Homo sapiens
aataaaaagatcactttctcagt

SEQ ID NO: 4594340 - DNA, 16 bp, Homo sapiens
aataaatctgacccag

SEQ ID NO: 4594341 - DNA, 14 bp, Homo sapiens
aataagattatatg

SEQ ID NO: 4594342 - DNA, 12 bp, Homo sapiens
aataataaagaa

SEQ ID NO: 4594343 - DNA, 20 bp, Homo sapiens
aataataaagaatagcttta

SEQ ID NO: 4594344 - DNA, 21 bp, Homo sapiens
aataatcacgctttcctgaat

SEQ ID NO: 4594345 - DNA, 16 bp, Homo sapiens
aataatgtgaaactgg

SEQ ID NO: 4594346 - DNA, 17 bp, Homo sapiens
aataatgtgaaactgga

SEQ ID NO: 4594347 - DNA, 22 bp, Homo sapiens
aataatgtgaaactggattaaa

SEQ ID NO: 4594348 - DNA, 13 bp, Homo sapiens
aataattttgtaa

SEQ ID NO: 4594349 - DNA, 15 bp, Homo sapiens
aatacagactggatg

SEQ ID NO: 4594350 - DNA, 18 bp, Homo sapiens
aatacagcaacaatttat

SEQ ID NO: 4594351 - DNA, 23 bp, Homo sapiens
aatactttgcagcacagctgaga

SEQ ID NO: 4594352 - DNA, 13 bp, Homo sapiens
aatagacaattta

SEQ ID NO: 4594353 - DNA, 16 bp, Homo sapiens
aatataggaacttaaa

SEQ ID NO: 4594354 - DNA, 20 bp, Homo sapiens
aatataggaacttaaataat

SEQ ID NO: 4594355 - DNA, 22 bp, Homo sapiens
aatatcccttggacattttatg

SEQ ID NO: 4594356 - DNA, 21 bp, Homo sapiens
aatccaggcagatccaggact

SEQ ID NO: 4594357 - DNA, 15 bp, Homo sapiens
aatctagaggagggg

SEQ ID NO: 4594358 - DNA, 12 bp, Homo sapiens
aatctcaaattt

SEQ ID NO: 4594359 - DNA, 17 bp, Homo sapiens
aatctcaaatttctaaa

SEQ ID NO: 4594360 - DNA, 12 bp, Homo sapiens
aatctgacccag

SEQ ID NO: 4594361 - DNA, 14 bp, Homo sapiens
aatctgacccagtg

SEQ ID NO: 4594362 - DNA, 16 bp, Homo sapiens
aatctggattcatatt

SEQ ID NO: 4594363 - DNA, 18 bp, Homo sapiens
aatctggattcatattta

SEQ ID NO: 4594364 - DNA, 14 bp, Homo sapiens
aatctgtaaactgt

SEQ ID NO: 4594365 - DNA, 15 bp, Homo sapiens
aatgacaggcctgtc

SEQ ID NO: 4594366 - DNA, 17 bp, Homo sapiens
aatgacttactgtacat

SEQ ID NO: 4594367 - DNA, 15 bp, Homo sapiens
aatgatatgcttgta

SEQ ID NO: 4594368 - DNA, 17 bp, Homo sapiens
aatgatatgcttgtaac

SEQ ID NO: 4594369 - DNA, 18 bp, Homo sapiens
aatgatatgcttgtaact

SEQ ID NO: 4594370 - DNA, 19 bp, Homo sapiens
aatgatatgcttgtaacta

SEQ ID NO: 4594371 - DNA, 16 bp, Homo sapiens
aatgatttcattcaat

SEQ ID NO: 4594372 - DNA, 18 bp, Homo sapiens
aatgcaaccatttgaaac

SEQ ID NO: 4594373 - DNA, 13 bp, Homo sapiens
aatgcacctggaa

SEQ ID NO: 4594374 - DNA, 23 bp, Homo sapiens
aatgcgtgcataccacttttgtt

SEQ ID NO: 4594375 - DNA, 14 bp, Homo sapiens
aatggaaccactct

SEQ ID NO: 4594376 - DNA, 17 bp, Homo sapiens
aatggggccagatccag

SEQ ID NO: 4594377 - DNA, 15 bp, Homo sapiens
aatgggggtgcattt

SEQ ID NO: 4594378 - DNA, 16 bp, Homo sapiens
aatggtatggaactct

SEQ ID NO: 4594379 - DNA, 20 bp, Homo sapiens
aatgtcaggaacagaaggat

SEQ ID NO: 4594380 - DNA, 14 bp, Homo sapiens
aatgtgaaactgga

SEQ ID NO: 4594381 - DNA, 13 bp, Homo sapiens
aatgttcatcaat

SEQ ID NO: 4594382 - DNA, 22 bp, Homo sapiens
aatgtttatgcaaggaaggaaa

SEQ ID NO: 4594383 - DNA, 12 bp, Homo sapiens
aattaactttta

SEQ ID NO: 4594384 - DNA, 13 bp, Homo sapiens
aattaacttttat

SEQ ID NO: 4594385 - DNA, 16 bp, Homo sapiens
aattaacttttataaa

SEQ ID NO: 4594386 - DNA, 15 bp, Homo sapiens
aattctatgcctgtc

SEQ ID NO: 4594387 - DNA, 17 bp, Homo sapiens
aattctctagtttgatt

SEQ ID NO: 4594388 - DNA, 22 bp, Homo sapiens
aattctgctctaaataaagacg

SEQ ID NO: 4594389 - DNA, 18 bp, Homo sapiens
aattcttctgaactcaaa

SEQ ID NO: 4594390 - DNA, 19 bp, Homo sapiens
aattgacccacaagaaatg

SEQ ID NO: 4594391 - DNA, 17 bp, Homo sapiens
aatttattatggcacat

SEQ ID NO: 4594392 - DNA, 19 bp, Homo sapiens
aatttcacctgtaaacctg

SEQ ID NO: 4594393 - DNA, 13 bp, Homo sapiens
aatttcagactcc

SEQ ID NO: 4594394 - DNA, 14 bp, Homo sapiens
aatttcccaggacc

SEQ ID NO: 4594395 - DNA, 18 bp, Homo sapiens
aatttcgccgttgaagag

SEQ ID NO: 4594396 - DNA, 13 bp, Homo sapiens
aatttctaaatct

SEQ ID NO: 4594397 - DNA, 18 bp, Homo sapiens
aatttgagagaaatatga

SEQ ID NO: 4594398 - DNA, 20 bp, Homo sapiens
aatttgagagaaatatgaag

SEQ ID NO: 4594399 - DNA, 19 bp, Homo sapiens
aattttaacctatgatatt

SEQ ID NO: 4594400 - DNA, 22 bp, Homo sapiens
aattttgtgtaagaaatacaga

SEQ ID NO: 4594401 - DNA, 21 bp, Homo sapiens
aattttttaagtgaaaatata

SEQ ID NO: 4594402 - DNA, 22 bp, Homo sapiens
aatttttttatcgtcactgctt

SEQ ID NO: 4594403 - DNA, 22 bp, Homo sapiens
acaaaagcatgtgagactggtt

SEQ ID NO: 4594404 - DNA, 11 bp, Homo sapiens
acaacagaagt

SEQ ID NO: 4594405 - DNA, 15 bp, Homo sapiens
acaacctcaactgcc

SEQ ID NO: 4594406 - DNA, 15 bp, Homo sapiens
acaagaaatgaaagc

SEQ ID NO: 4594407 - DNA, 22 bp, Homo sapiens
acaagaaatgaaagcagggact

SEQ ID NO: 4594408 - DNA, 15 bp, Homo sapiens
acaaggacttcctgt

SEQ ID NO: 4594409 - DNA, 21 bp, Homo sapiens
acaaggatagatgctggccca

SEQ ID NO: 4594410 - DNA, 14 bp, Homo sapiens
acaataaaaatgtt

SEQ ID NO: 4594411 - DNA, 22 bp, Homo sapiens
acaatgacttactgtacatgaa

SEQ ID NO: 4594412 - DNA, 21 bp, Homo sapiens
acaatgctgtgccctaaagtg

SEQ ID NO: 4594413 - DNA, 22 bp, Homo sapiens
acaatgctgtgccctaaagtgt

SEQ ID NO: 4594414 - DNA, 13 bp, Homo sapiens
acacaacacacac

SEQ ID NO: 4594415 - DNA, 23 bp, Homo sapiens
acacaaggatagatgctggccca

SEQ ID NO: 4594416 - DNA, 18 bp, Homo sapiens
acacatgatcctgcaatt

SEQ ID NO: 4594417 - DNA, 20 bp, Homo sapiens
acacatgcaaggtcattttt

SEQ ID NO: 4594418 - DNA, 13 bp, Homo sapiens
acacattttattt

SEQ ID NO: 4594419 - DNA, 14 bp, Homo sapiens
acacattttttaaa

SEQ ID NO: 4594420 - DNA, 20 bp, Homo sapiens
acacattttttaaatgcacc

SEQ ID NO: 4594421 - DNA, 14 bp, Homo sapiens
acaccactacattc

SEQ ID NO: 4594422 - DNA, 21 bp, Homo sapiens
acaccactacattctgttaat

SEQ ID NO: 4594423 - DNA, 14 bp, Homo sapiens
acactgcatgtttg

SEQ ID NO: 4594424 - DNA, 15 bp, Homo sapiens
acactgcatgtttgt

SEQ ID NO: 4594425 - DNA, 18 bp, Homo sapiens
acactgtcctattatatt

SEQ ID NO: 4594426 - DNA, 16 bp, Homo sapiens
acactgtttcaaactt

SEQ ID NO: 4594427 - DNA, 17 bp, Homo sapiens
acactgtttcaaacttt

SEQ ID NO: 4594428 - DNA, 19 bp, Homo sapiens
acagaaagcagaacagtga

SEQ ID NO: 4594429 - DNA, 16 bp, Homo sapiens
acagaaatgtacagca

SEQ ID NO: 4594430 - DNA, 17 bp, Homo sapiens
acagaaatgtacagcaa

SEQ ID NO: 4594431 - DNA, 17 bp, Homo sapiens
acagaagtcatgaagcc

SEQ ID NO: 4594432 - DNA, 14 bp, Homo sapiens
acagacactggcat

SEQ ID NO: 4594433 - DNA, 18 bp, Homo sapiens
acagacatactaaccagc

SEQ ID NO: 4594434 - DNA, 20 bp, Homo sapiens
acagactggatgtaccacca

SEQ ID NO: 4594435 - DNA, 17 bp, Homo sapiens
acagaggccatggcaga

SEQ ID NO: 4594436 - DNA, 22 bp, Homo sapiens
acagaggccccagcctccctga

SEQ ID NO: 4594437 - DNA, 14 bp, Homo sapiens
acagatctggaacc

SEQ ID NO: 4594438 - DNA, 16 bp, Homo sapiens
acagatctggaacctc

SEQ ID NO: 4594439 - DNA, 17 bp, Homo sapiens
acagcaaggagatttac

SEQ ID NO: 4594440 - DNA, 16 bp, Homo sapiens
acagctcattaaactt

SEQ ID NO: 4594441 - DNA, 19 bp, Homo sapiens
acagctcattaaacttttt

SEQ ID NO: 4594442 - DNA, 22 bp, Homo sapiens
acaggccctccctgttccccag

SEQ ID NO: 4594443 - DNA, 18 bp, Homo sapiens
acaggtggacacacaagg

SEQ ID NO: 4594444 - DNA, 21 bp, Homo sapiens
acagtatggcagctttcctca

SEQ ID NO: 4594445 - DNA, 21 bp, Homo sapiens
acagtgattaccagggactga

SEQ ID NO: 4594446 - DNA, 13 bp, Homo sapiens
acagttactcaga

SEQ ID NO: 4594447 - DNA, 20 bp, Homo sapiens
acagttactcagaattctct

SEQ ID NO: 4594448 - DNA, 17 bp, Homo sapiens
acagttctttgggccag

SEQ ID NO: 4594449 - DNA, 19 bp, Homo sapiens
acagttctttgggccagac

SEQ ID NO: 4594450 - DNA, 20 bp, Homo sapiens
acagttctttgggccagaca

SEQ ID NO: 4594451 - DNA, 20 bp, Homo sapiens
acagttggagggaaagccag

SEQ ID NO: 4594452 - DNA, 20 bp, Homo sapiens
acagtttgttagtatgaggc

SEQ ID NO: 4594453 - DNA, 23 bp, Homo sapiens
acataatcttctgccttctcatg

SEQ ID NO: 4594454 - DNA, 22 bp, Homo sapiens
acatactaaccagcagaaatgc

SEQ ID NO: 4594455 - DNA, 16 bp, Homo sapiens
acatacttgaagggcc

SEQ ID NO: 4594456 - DNA, 17 bp, Homo sapiens
acatacttgaagggcca

SEQ ID NO: 4594457 - DNA, 19 bp, Homo sapiens
acatacttgaagggccaga

SEQ ID NO: 4594458 - DNA, 18 bp, Homo sapiens
acatagaattaacacatg

SEQ ID NO: 4594459 - DNA, 16 bp, Homo sapiens
acatagcccaagaaca

SEQ ID NO: 4594460 - DNA, 19 bp, Homo sapiens
acatagcccaagaacagaa

SEQ ID NO: 4594461 - DNA, 14 bp, Homo sapiens
acatattgatttcc

SEQ ID NO: 4594462 - DNA, 15 bp, Homo sapiens
acatcagcacgattt

SEQ ID NO: 4594463 - DNA, 18 bp, Homo sapiens
acatcagcacgatttctg

SEQ ID NO: 4594464 - DNA, 22 bp, Homo sapiens
acatcagcacgatttctgttta

SEQ ID NO: 4594465 - DNA, 23 bp, Homo sapiens
acatctcccttttccatgactgt

SEQ ID NO: 4594466 - DNA, 17 bp, Homo sapiens
acatgaaaacacatttt

SEQ ID NO: 4594467 - DNA, 16 bp, Homo sapiens
acatgaggtactgaga

SEQ ID NO: 4594468 - DNA, 15 bp, Homo sapiens
acatgctacacactg

SEQ ID NO: 4594469 - DNA, 22 bp, Homo sapiens
acatggcccctccccctgccag

SEQ ID NO: 4594470 - DNA, 13 bp, Homo sapiens
acatgggtgacta

SEQ ID NO: 4594471 - DNA, 18 bp, Homo sapiens
acatgggtgactatctcc

SEQ ID NO: 4594472 - DNA, 17 bp, Homo sapiens
acatgtctgttctacat

SEQ ID NO: 4594473 - DNA, 18 bp, Homo sapiens
acatgtctgttctacata

SEQ ID NO: 4594474 - DNA, 18 bp, Homo sapiens
acatgtgaaaagaataga

SEQ ID NO: 4594475 - DNA, 13 bp, Homo sapiens
acatgttacaaca

SEQ ID NO: 4594476 - DNA, 13 bp, Homo sapiens
acattaaattgat

SEQ ID NO: 4594477 - DNA, 21 bp, Homo sapiens
acattaaattgataacatgga

SEQ ID NO: 4594478 - DNA, 22 bp, Homo sapiens
acattggcacctaatccaggca

SEQ ID NO: 4594479 - DNA, 22 bp, Homo sapiens
acattggttctttcatttgctt

SEQ ID NO: 4594480 - DNA, 12 bp, Homo sapiens
acattgtctgcg

SEQ ID NO: 4594481 - DNA, 20 bp, Homo sapiens
acattttattttattatgca

SEQ ID NO: 4594482 - DNA, 19 bp, Homo sapiens
acattttccttttcaaata

SEQ ID NO: 4594483 - DNA, 19 bp, Homo sapiens
acatttttaagtgctgcat

SEQ ID NO: 4594484 - DNA, 21 bp, Homo sapiens
acatttttaagtgctgcattt

SEQ ID NO: 4594485 - DNA, 22 bp, Homo sapiens
acatttttaagtgctgcattta

SEQ ID NO: 4594486 - DNA, 23 bp, Homo sapiens
acatttttaagtgctgcatttaa

SEQ ID NO: 4594487 - DNA, 16 bp, Homo sapiens
acattttttaaatgca

SEQ ID NO: 4594488 - DNA, 19 bp, Homo sapiens
accaaggctgattaaacca

SEQ ID NO: 4594489 - DNA, 16 bp, Homo sapiens
accaataaaagccaga

SEQ ID NO: 4594490 - DNA, 21 bp, Homo sapiens
accaataaaagccagatgcta

SEQ ID NO: 4594491 - DNA, 18 bp, Homo sapiens
accaccccttacaattcc

SEQ ID NO: 4594492 - DNA, 14 bp, Homo sapiens
accacggaaaagag

SEQ ID NO: 4594493 - DNA, 18 bp, Homo sapiens
accacggaaaagagcgca

SEQ ID NO: 4594494 - DNA, 15 bp, Homo sapiens
accactacattctgt

SEQ ID NO: 4594495 - DNA, 20 bp, Homo sapiens
accactagaactctccatct

SEQ ID NO: 4594496 - DNA, 13 bp, Homo sapiens
accactgcagaag

SEQ ID NO: 4594497 - DNA, 19 bp, Homo sapiens
accactgcagaagacagta

SEQ ID NO: 4594498 - DNA, 14 bp, Homo sapiens
accagacacccagg

SEQ ID NO: 4594499 - DNA, 14 bp, Homo sapiens
accagcagaaatgc

SEQ ID NO: 4594500 - DNA, 17 bp, Homo sapiens
accagccagtaaatggg

SEQ ID NO: 4594501 - DNA, 13 bp, Homo sapiens
accagcctgggca

SEQ ID NO: 4594502 - DNA, 14 bp, Homo sapiens
accagctcaggaca

SEQ ID NO: 4594503 - DNA, 17 bp, Homo sapiens
accagtccccccaccct

SEQ ID NO: 4594504 - DNA, 14 bp, Homo sapiens
accatattaccaca

SEQ ID NO: 4594505 - DNA, 16 bp, Homo sapiens
accatattaccacaga

SEQ ID NO: 4594506 - DNA, 20 bp, Homo sapiens
accatattaccacagacata

SEQ ID NO: 4594507 - DNA, 13 bp, Homo sapiens
acccaaaaggcag

SEQ ID NO: 4594508 - DNA, 15 bp, Homo sapiens
acccacaagaaatga

SEQ ID NO: 4594509 - DNA, 17 bp, Homo sapiens
acccagctctactccag

SEQ ID NO: 4594510 - DNA, 13 bp, Homo sapiens
acccatgaggcaa

SEQ ID NO: 4594511 - DNA, 20 bp, Homo sapiens
acccatttaaatttttttcc

SEQ ID NO: 4594512 - DNA, 23 bp, Homo sapiens
acccatttaaatttttttcctta

SEQ ID NO: 4594513 - DNA, 19 bp, Homo sapiens
acccccttctactgagcct

SEQ ID NO: 4594514 - DNA, 16 bp, Homo sapiens
acccctgtaggcctca

SEQ ID NO: 4594515 - DNA, 17 bp, Homo sapiens
acccctgtaggcctcag

SEQ ID NO: 4594516 - DNA, 15 bp, Homo sapiens
accctcatgttctta

SEQ ID NO: 4594517 - DNA, 17 bp, Homo sapiens
accctcattctactgaa

SEQ ID NO: 4594518 - DNA, 22 bp, Homo sapiens
accctcctcccgactgaccact

SEQ ID NO: 4594519 - DNA, 21 bp, Homo sapiens
accctgaatttggcctgcact

SEQ ID NO: 4594520 - DNA, 15 bp, Homo sapiens
accctggtgggccaa

SEQ ID NO: 4594521 - DNA, 17 bp, Homo sapiens
acccttggctcaatcct

SEQ ID NO: 4594522 - DNA, 16 bp, Homo sapiens
accggtaccctcctcc

SEQ ID NO: 4594523 - DNA, 20 bp, Homo sapiens
acctactttgactttttgca

SEQ ID NO: 4594524 - DNA, 21 bp, Homo sapiens
acctactttgactttttgcat

SEQ ID NO: 4594525 - DNA, 19 bp, Homo sapiens
acctatgatattttctgtg

SEQ ID NO: 4594526 - DNA, 11 bp, Homo sapiens
acctcagcctg

SEQ ID NO: 4594527 - DNA, 14 bp, Homo sapiens
acctcagcctggcc

SEQ ID NO: 4594528 - DNA, 15 bp, Homo sapiens
acctcagcctggcca

SEQ ID NO: 4594529 - DNA, 16 bp, Homo sapiens
acctcagcctggccag

SEQ ID NO: 4594530 - DNA, 19 bp, Homo sapiens
acctcagcctggccagaca

SEQ ID NO: 4594531 - DNA, 21 bp, Homo sapiens
acctcagcctggccagacaca

SEQ ID NO: 4594532 - DNA, 15 bp, Homo sapiens
acctctgcagcaata

SEQ ID NO: 4594533 - DNA, 11 bp, Homo sapiens
acctctgtgcc

SEQ ID NO: 4594534 - DNA, 16 bp, Homo sapiens
acctgacccctgctca

SEQ ID NO: 4594535 - DNA, 20 bp, Homo sapiens
acctgatcctggaggcccag

SEQ ID NO: 4594536 - DNA, 20 bp, Homo sapiens
acctgattttttttcctttt

SEQ ID NO: 4594537 - DNA, 16 bp, Homo sapiens
acctgcaaagatctgt

SEQ ID NO: 4594538 - DNA, 15 bp, Homo sapiens
acctgtaatgacagg

SEQ ID NO: 4594539 - DNA, 19 bp, Homo sapiens
accttcagttatgattttt

SEQ ID NO: 4594540 - DNA, 19 bp, Homo sapiens
accttttttatacataaac

SEQ ID NO: 4594541 - DNA, 14 bp, Homo sapiens
acgatttctgttta

SEQ ID NO: 4594542 - DNA, 18 bp, Homo sapiens
acgctttcctgaatccaa

SEQ ID NO: 4594543 - DNA, 17 bp, Homo sapiens
acggccacggccacagt

SEQ ID NO: 4594544 - DNA, 17 bp, Homo sapiens
acggccagggagaagct

SEQ ID NO: 4594545 - DNA, 18 bp, Homo sapiens
acgtaaccacggaaaaga

SEQ ID NO: 4594546 - DNA, 14 bp, Homo sapiens
acgtacacatttta

SEQ ID NO: 4594547 - DNA, 13 bp, Homo sapiens
acgttgtgcattt

SEQ ID NO: 4594548 - DNA, 15 bp, Homo sapiens
acgtttcctgagaag

SEQ ID NO: 4594549 - DNA, 16 bp, Homo sapiens
actaaaataattttgt

SEQ ID NO: 4594550 - DNA, 23 bp, Homo sapiens
actaactatgcatggtgccccag

SEQ ID NO: 4594551 - DNA, 15 bp, Homo sapiens
actaagtttttatgg

SEQ ID NO: 4594552 - DNA, 15 bp, Homo sapiens
actaatagacaattt

SEQ ID NO: 4594553 - DNA, 23 bp, Homo sapiens
actaatgccttactcttcttgaa

SEQ ID NO: 4594554 - DNA, 17 bp, Homo sapiens
actaatttgatgtttac

SEQ ID NO: 4594555 - DNA, 15 bp, Homo sapiens
actacattctgttaa

SEQ ID NO: 4594556 - DNA, 17 bp, Homo sapiens
actaccacctcaggtga

SEQ ID NO: 4594557 - DNA, 21 bp, Homo sapiens
actaccacctcaggtgacttt

SEQ ID NO: 4594558 - DNA, 15 bp, Homo sapiens
actacctctgtgcct

SEQ ID NO: 4594559 - DNA, 15 bp, Homo sapiens
actagaactctccat

SEQ ID NO: 4594560 - DNA, 22 bp, Homo sapiens
actatatttgggcctgctccag

SEQ ID NO: 4594561 - DNA, 22 bp, Homo sapiens
actatggccctggcctagcata

SEQ ID NO: 4594562 - DNA, 10 bp, Homo sapiens
actatttaac

SEQ ID NO: 4594563 - DNA, 21 bp, Homo sapiens
actcagaattctctagtttga

SEQ ID NO: 4594564 - DNA, 11 bp, Homo sapiens
actcagatcca

SEQ ID NO: 4594565 - DNA, 12 bp, Homo sapiens
actcagatccag

SEQ ID NO: 4594566 - DNA, 17 bp, Homo sapiens
actcagatccagggaca

SEQ ID NO: 4594567 - DNA, 16 bp, Homo sapiens
actccaggcttccaca

SEQ ID NO: 4594568 - DNA, 13 bp, Homo sapiens
actcccattcctg

SEQ ID NO: 4594569 - DNA, 14 bp, Homo sapiens
actctaaagtctgt

SEQ ID NO: 4594570 - DNA, 16 bp, Homo sapiens
actctacctgcacact

SEQ ID NO: 4594571 - DNA, 14 bp, Homo sapiens
actctatcaagtat

SEQ ID NO: 4594572 - DNA, 13 bp, Homo sapiens
actctccatctta

SEQ ID NO: 4594573 - DNA, 20 bp, Homo sapiens
actgaaaaggaggggtctgg

SEQ ID NO: 4594574 - DNA, 15 bp, Homo sapiens
actgaaaatgtgcta

SEQ ID NO: 4594575 - DNA, 23 bp, Homo sapiens
actgaatttcttttgccgttatt

SEQ ID NO: 4594576 - DNA, 16 bp, Homo sapiens
actgaccactggccta

SEQ ID NO: 4594577 - DNA, 14 bp, Homo sapiens
actgaccagaacta

SEQ ID NO: 4594578 - DNA, 19 bp, Homo sapiens
actgagaaagaggcaggga

SEQ ID NO: 4594579 - DNA, 17 bp, Homo sapiens
actgaggaatttcacct

SEQ ID NO: 4594580 - DNA, 23 bp, Homo sapiens
actgagtacgttgtgcatttggt

SEQ ID NO: 4594581 - DNA, 19 bp, Homo sapiens
actgatgctgcccctcatc

SEQ ID NO: 4594582 - DNA, 20 bp, Homo sapiens
actgatgctgcccctcatct

SEQ ID NO: 4594583 - DNA, 17 bp, Homo sapiens
actgcactccagcctgg

SEQ ID NO: 4594584 - DNA, 13 bp, Homo sapiens
actgcatactttt

SEQ ID NO: 4594585 - DNA, 17 bp, Homo sapiens
actgcatactttttaaa

SEQ ID NO: 4594586 - DNA, 15 bp, Homo sapiens
actgcatgtttgtga

SEQ ID NO: 4594587 - DNA, 13 bp, Homo sapiens
actgtacatgaaa

SEQ ID NO: 4594588 - DNA, 16 bp, Homo sapiens
actgtacatgaaaaca

SEQ ID NO: 4594589 - DNA, 20 bp, Homo sapiens
actgtacatgaaaacacatt

SEQ ID NO: 4594590 - DNA, 14 bp, Homo sapiens
actgtatcatgaca

SEQ ID NO: 4594591 - DNA, 16 bp, Homo sapiens
actgtatcatgacaaa

SEQ ID NO: 4594592 - DNA, 14 bp, Homo sapiens
actgtcctgggcct

SEQ ID NO: 4594593 - DNA, 12 bp, Homo sapiens
actgtgtacata

SEQ ID NO: 4594594 - DNA, 15 bp, Homo sapiens
actgtgtattccaag

SEQ ID NO: 4594595 - DNA, 15 bp, Homo sapiens
actgtttcaaacttt

SEQ ID NO: 4594596 - DNA, 19 bp, Homo sapiens
actgtttcaaactttacta

SEQ ID NO: 4594597 - DNA, 17 bp, Homo sapiens
acttaaataatgtgaaa

SEQ ID NO: 4594598 - DNA, 15 bp, Homo sapiens
acttcaaaagtttgt

SEQ ID NO: 4594599 - DNA, 23 bp, Homo sapiens
acttcacatattgatttccgtta

SEQ ID NO: 4594600 - DNA, 12 bp, Homo sapiens
acttcagacata

SEQ ID NO: 4594601 - DNA, 21 bp, Homo sapiens
acttcagacatagaattaaca

SEQ ID NO: 4594602 - DNA, 24 bp, Homo sapiens
acttcccagttcaggagtcccaag

SEQ ID NO: 4594603 - DNA, 19 bp, Homo sapiens
acttctgggcttcatctgg

SEQ ID NO: 4594604 - DNA, 13 bp, Homo sapiens
acttcttgaaggt

SEQ ID NO: 4594605 - DNA, 21 bp, Homo sapiens
acttgaacccgggaggcagag

SEQ ID NO: 4594606 - DNA, 22 bp, Homo sapiens
acttgggaggctgagatgggag

SEQ ID NO: 4594607 - DNA, 23 bp, Homo sapiens
acttggggagttaagacctggca

SEQ ID NO: 4594608 - DNA, 22 bp, Homo sapiens
actttaattaccaacctgttac

SEQ ID NO: 4594609 - DNA, 12 bp, Homo sapiens
actttacctttt

SEQ ID NO: 4594610 - DNA, 23 bp, Homo sapiens
actttaccttttttatacataaa

SEQ ID NO: 4594611 - DNA, 20 bp, Homo sapiens
actttcaattgtcacttttt

SEQ ID NO: 4594612 - DNA, 22 bp, Homo sapiens
actttcatattttaaacagagg

SEQ ID NO: 4594613 - DNA, 14 bp, Homo sapiens
actttctcagtttt

SEQ ID NO: 4594614 - DNA, 13 bp, Homo sapiens
actttgacctctg

SEQ ID NO: 4594615 - DNA, 18 bp, Homo sapiens
actttgacctctgcagca

SEQ ID NO: 4594616 - DNA, 19 bp, Homo sapiens
actttgacctctgcagcaa

SEQ ID NO: 4594617 - DNA, 23 bp, Homo sapiens
actttgacctctgcagcaataaa

SEQ ID NO: 4594618 - DNA, 19 bp, Homo sapiens
acttttataaactttacct

SEQ ID NO: 4594619 - DNA, 12 bp, Homo sapiens
acttttgttctt

SEQ ID NO: 4594620 - DNA, 13 bp, Homo sapiens
acttttgttcttg

SEQ ID NO: 4594621 - DNA, 23 bp, Homo sapiens
acttttgttcttggtttgtaaat

SEQ ID NO: 4594622 - DNA, 18 bp, Homo sapiens
agaaaaaggatgcacaga

SEQ ID NO: 4594623 - DNA, 13 bp, Homo sapiens
agaaactggaact

SEQ ID NO: 4594624 - DNA, 14 bp, Homo sapiens
agaaagaggcaggg

SEQ ID NO: 4594625 - DNA, 20 bp, Homo sapiens
agaaagcagaacagtgatta

SEQ ID NO: 4594626 - DNA, 13 bp, Homo sapiens
agaaagctgcctg

SEQ ID NO: 4594627 - DNA, 14 bp, Homo sapiens
agaaatgaaagcag

SEQ ID NO: 4594628 - DNA, 14 bp, Homo sapiens
agaaatgtacagca

SEQ ID NO: 4594629 - DNA, 11 bp, Homo sapiens
agaaatgtgtt

SEQ ID NO: 4594630 - DNA, 14 bp, Homo sapiens
agaaattggctgga

SEQ ID NO: 4594631 - DNA, 22 bp, Homo sapiens
agaacagtgattaccagggact

SEQ ID NO: 4594632 - DNA, 20 bp, Homo sapiens
agaaccagtccccccaccct

SEQ ID NO: 4594633 - DNA, 23 bp, Homo sapiens
agaactctccatcttattttcat

SEQ ID NO: 4594634 - DNA, 20 bp, Homo sapiens
agaactctgggctgctaccc

SEQ ID NO: 4594635 - DNA, 23 bp, Homo sapiens
agaagcccccagctaagaacctg

SEQ ID NO: 4594636 - DNA, 18 bp, Homo sapiens
agaagctaaggtttagat

SEQ ID NO: 4594637 - DNA, 20 bp, Homo sapiens
agaagctcctctccccagcc

SEQ ID NO: 4594638 - DNA, 23 bp, Homo sapiens
agaagctcctctccccagcccag

SEQ ID NO: 4594639 - DNA, 17 bp, Homo sapiens
agaaggaagtgaagagg

SEQ ID NO: 4594640 - DNA, 13 bp, Homo sapiens
agaagtttctgtc

SEQ ID NO: 4594641 - DNA, 12 bp, Homo sapiens
agaatgttttca

SEQ ID NO: 4594642 - DNA, 15 bp, Homo sapiens
agaattaacacatga

SEQ ID NO: 4594643 - DNA, 14 bp, Homo sapiens
agaattctctagtt

SEQ ID NO: 4594644 - DNA, 15 bp, Homo sapiens
agacaacagaagtca

SEQ ID NO: 4594645 - DNA, 23 bp, Homo sapiens
agacaatgacttactgtacatga

SEQ ID NO: 4594646 - DNA, 16 bp, Homo sapiens
agacacccaggactta

SEQ ID NO: 4594647 - DNA, 23 bp, Homo sapiens
agacatactaaccagcagaaatg

SEQ ID NO: 4594648 - DNA, 19 bp, Homo sapiens
agacatacttgaagggcca

SEQ ID NO: 4594649 - DNA, 14 bp, Homo sapiens
agacatagaattaa

SEQ ID NO: 4594650 - DNA, 21 bp, Homo sapiens
agacatagaattaacacatga

SEQ ID NO: 4594651 - DNA, 17 bp, Homo sapiens
agacatcaacagataaa

SEQ ID NO: 4594652 - DNA, 15 bp, Homo sapiens
agacattggcaccta

SEQ ID NO: 4594653 - DNA, 14 bp, Homo sapiens
agaccacgtttcta

SEQ ID NO: 4594654 - DNA, 21 bp, Homo sapiens
agaccagcccttccccatcct

SEQ ID NO: 4594655 - DNA, 18 bp, Homo sapiens
agacctcagtgccttcct

SEQ ID NO: 4594656 - DNA, 14 bp, Homo sapiens
agacctgatcctgg

SEQ ID NO: 4594657 - DNA, 18 bp, Homo sapiens
agacctggcagctctgga

SEQ ID NO: 4594658 - DNA, 23 bp, Homo sapiens
agactcccattcctgaagaacca

SEQ ID NO: 4594659 - DNA, 18 bp, Homo sapiens
agactctgtctcagtcca

SEQ ID NO: 4594660 - DNA, 20 bp, Homo sapiens
agactgagtacgttgtgcat

SEQ ID NO: 4594661 - DNA, 22 bp, Homo sapiens
agactgagtacgttgtgcattt

SEQ ID NO: 4594662 - DNA, 21 bp, Homo sapiens
agagaaaggggagcccactgt

SEQ ID NO: 4594663 - DNA, 23 bp, Homo sapiens
agagaaaggggagcccactgtcc

SEQ ID NO: 4594664 - DNA, 22 bp, Homo sapiens
agagacatacttgaagggccag

SEQ ID NO: 4594665 - DNA, 13 bp, Homo sapiens
agagcccagctcc

SEQ ID NO: 4594666 - DNA, 14 bp, Homo sapiens
agagcccagctcca

SEQ ID NO: 4594667 - DNA, 16 bp, Homo sapiens
agaggagggggcaggc

SEQ ID NO: 4594668 - DNA, 19 bp, Homo sapiens
agaggagggggcaggctga

SEQ ID NO: 4594669 - DNA, 23 bp, Homo sapiens
agaggagggggcaggctgagggt

SEQ ID NO: 4594670 - DNA, 14 bp, Homo sapiens
agaggccatggcag

SEQ ID NO: 4594671 - DNA, 20 bp, Homo sapiens
agaggccatggcagaataat

SEQ ID NO: 4594672 - DNA, 23 bp, Homo sapiens
agaggccccagcctccctgaagc

SEQ ID NO: 4594673 - DNA, 18 bp, Homo sapiens
agaggctcagattgtaat

SEQ ID NO: 4594674 - DNA, 19 bp, Homo sapiens
agaggttcaaagatatttt

SEQ ID NO: 4594675 - DNA, 14 bp, Homo sapiens
agagtgaacaaatt

SEQ ID NO: 4594676 - DNA, 12 bp, Homo sapiens
agagttgttaca

SEQ ID NO: 4594677 - DNA, 20 bp, Homo sapiens
agagttgttacatttttaag

SEQ ID NO: 4594678 - DNA, 13 bp, Homo sapiens
agatacagttact

SEQ ID NO: 4594679 - DNA, 11 bp, Homo sapiens
agatactgtat

SEQ ID NO: 4594680 - DNA, 15 bp, Homo sapiens
agatactgtatcatg

SEQ ID NO: 4594681 - DNA, 20 bp, Homo sapiens
agatattttgctttgtgatt

SEQ ID NO: 4594682 - DNA, 22 bp, Homo sapiens
agatattttgctttgtgatttt

SEQ ID NO: 4594683 - DNA, 18 bp, Homo sapiens
agatcactttctcagttt

SEQ ID NO: 4594684 - DNA, 23 bp, Homo sapiens
agatcactttctcagttttcata

SEQ ID NO: 4594685 - DNA, 12 bp, Homo sapiens
agatccaggact

SEQ ID NO: 4594686 - DNA, 15 bp, Homo sapiens
agatctggaacctca

SEQ ID NO: 4594687 - DNA, 19 bp, Homo sapiens
agatctggaacctcagcct

SEQ ID NO: 4594688 - DNA, 14 bp, Homo sapiens
agatctgtcctcag

SEQ ID NO: 4594689 - DNA, 18 bp, Homo sapiens
agatctgtcctcagcctt

SEQ ID NO: 4594690 - DNA, 17 bp, Homo sapiens
agatgctagagcctctg

SEQ ID NO: 4594691 - DNA, 21 bp, Homo sapiens
agatgctggcccagggcccag

SEQ ID NO: 4594692 - DNA, 21 bp, Homo sapiens
agatgggagaatcacttgaac

SEQ ID NO: 4594693 - DNA, 14 bp, Homo sapiens
agatgtaattttgt

SEQ ID NO: 4594694 - DNA, 19 bp, Homo sapiens
agatgtaattttgtgtaag

SEQ ID NO: 4594695 - DNA, 14 bp, Homo sapiens
agatgtagaggaga

SEQ ID NO: 4594696 - DNA, 15 bp, Homo sapiens
agattaagaaataga

SEQ ID NO: 4594697 - DNA, 21 bp, Homo sapiens
agattctatgttaatatttta

SEQ ID NO: 4594698 - DNA, 13 bp, Homo sapiens
agattgctgaaat

SEQ ID NO: 4594699 - DNA, 14 bp, Homo sapiens
agattgctgaaatt

SEQ ID NO: 4594700 - DNA, 19 bp, Homo sapiens
agattttcagcaaactctt

SEQ ID NO: 4594701 - DNA, 13 bp, Homo sapiens
agcaaactctttt

SEQ ID NO: 4594702 - DNA, 15 bp, Homo sapiens
agcaaatggcctcat

SEQ ID NO: 4594703 - DNA, 13 bp, Homo sapiens
agcaacaagctat

SEQ ID NO: 4594704 - DNA, 14 bp, Homo sapiens
agcaacaagctatt

SEQ ID NO: 4594705 - DNA, 21 bp, Homo sapiens
agcaatttcgccgttgaagag

SEQ ID NO: 4594706 - DNA, 13 bp, Homo sapiens
agcacgatttctg

SEQ ID NO: 4594707 - DNA, 17 bp, Homo sapiens
agcacgatttctgttta

SEQ ID NO: 4594708 - DNA, 17 bp, Homo sapiens
agcactcaataaagtgg

SEQ ID NO: 4594709 - DNA, 22 bp, Homo sapiens
agcactcaataaagtgggcttt

SEQ ID NO: 4594710 - DNA, 22 bp, Homo sapiens
agcacttgcaaccgtctgttat

SEQ ID NO: 4594711 - DNA, 15 bp, Homo sapiens
agcatacgtacacat

SEQ ID NO: 4594712 - DNA, 17 bp, Homo sapiens
agcatacgtacacattt

SEQ ID NO: 4594713 - DNA, 13 bp, Homo sapiens
agcattttgtaat

SEQ ID NO: 4594714 - DNA, 18 bp, Homo sapiens
agccaaacccatgaggca

SEQ ID NO: 4594715 - DNA, 19 bp, Homo sapiens
agccaaacccatgaggcaa

SEQ ID NO: 4594716 - DNA, 22 bp, Homo sapiens
agccactcaggaggctgaggca

SEQ ID NO: 4594717 - DNA, 12 bp, Homo sapiens
agccagatgcta

SEQ ID NO: 4594718 - DNA, 14 bp, Homo sapiens
agccagctttccct

SEQ ID NO: 4594719 - DNA, 22 bp, Homo sapiens
agccagctttccctgcctctca

SEQ ID NO: 4594720 - DNA, 17 bp, Homo sapiens
agccaggaatttcccag

SEQ ID NO: 4594721 - DNA, 20 bp, Homo sapiens
agccaggaatttcccaggac

SEQ ID NO: 4594722 - DNA, 13 bp, Homo sapiens
agccataaatgat

SEQ ID NO: 4594723 - DNA, 20 bp, Homo sapiens
agcccactgtcctgggcctg

SEQ ID NO: 4594724 - DNA, 11 bp, Homo sapiens
agcccagagac

SEQ ID NO: 4594725 - DNA, 22 bp, Homo sapiens
agcccagagacatacttgaagg

SEQ ID NO: 4594726 - DNA, 12 bp, Homo sapiens
agccccagctta

SEQ ID NO: 4594727 - DNA, 23 bp, Homo sapiens
agccccagcttatctcctcctcc

SEQ ID NO: 4594728 - DNA, 19 bp, Homo sapiens
agcccccagctaagaacct

SEQ ID NO: 4594729 - DNA, 20 bp, Homo sapiens
agccctgactaaactaccac

SEQ ID NO: 4594730 - DNA, 20 bp, Homo sapiens
agcctcaaaacaaaggccta

SEQ ID NO: 4594731 - DNA, 13 bp, Homo sapiens
agcctccctgaag

SEQ ID NO: 4594732 - DNA, 14 bp, Homo sapiens
agcctggccagaca

SEQ ID NO: 4594733 - DNA, 16 bp, Homo sapiens
agcctggccagacaca

SEQ ID NO: 4594734 - DNA, 21 bp, Homo sapiens
agcctggccagacacaggccc

SEQ ID NO: 4594735 - DNA, 20 bp, Homo sapiens
agcctggcccccgacccagc

SEQ ID NO: 4594736 - DNA, 20 bp, Homo sapiens
agcctgggcaacagagcaag

SEQ ID NO: 4594737 - DNA, 16 bp, Homo sapiens
agcctgggggctggga

SEQ ID NO: 4594738 - DNA, 23 bp, Homo sapiens
agccttcagtcttgaatttctaa

SEQ ID NO: 4594739 - DNA, 22 bp, Homo sapiens
agccttgaactttgacctctgc

SEQ ID NO: 4594740 - DNA, 13 bp, Homo sapiens
agccttgccagag

SEQ ID NO: 4594741 - DNA, 23 bp, Homo sapiens
agctaacccccttctactgagcc

SEQ ID NO: 4594742 - DNA, 12 bp, Homo sapiens
agctaagaacct

SEQ ID NO: 4594743 - DNA, 14 bp, Homo sapiens
agctaagaacctgg

SEQ ID NO: 4594744 - DNA, 18 bp, Homo sapiens
agctaataacatgtgaaa

SEQ ID NO: 4594745 - DNA, 13 bp, Homo sapiens
agctatttcatct

SEQ ID NO: 4594746 - DNA, 14 bp, Homo sapiens
agctatttcatcta

SEQ ID NO: 4594747 - DNA, 13 bp, Homo sapiens
agctcacttctgg

SEQ ID NO: 4594748 - DNA, 13 bp, Homo sapiens
agctccaacctgc

SEQ ID NO: 4594749 - DNA, 22 bp, Homo sapiens
agctccaacctgcaaagatctg

SEQ ID NO: 4594750 - DNA, 18 bp, Homo sapiens
agctcctctccccagccc

SEQ ID NO: 4594751 - DNA, 19 bp, Homo sapiens
agctcctctccccagccca

SEQ ID NO: 4594752 - DNA, 22 bp, Homo sapiens
agctcctctccccagcccagag

SEQ ID NO: 4594753 - DNA, 13 bp, Homo sapiens
agctctactccag

SEQ ID NO: 4594754 - DNA, 23 bp, Homo sapiens
agctctgcccatcctgcccctga

SEQ ID NO: 4594755 - DNA, 17 bp, Homo sapiens
agctctggacagcccca

SEQ ID NO: 4594756 - DNA, 11 bp, Homo sapiens
agctgcactga

SEQ ID NO: 4594757 - DNA, 22 bp, Homo sapiens
agctgcactgatgctgcccctc

SEQ ID NO: 4594758 - DNA, 15 bp, Homo sapiens
agctgcctggtatat

SEQ ID NO: 4594759 - DNA, 13 bp, Homo sapiens
agcttatctcctc

SEQ ID NO: 4594760 - DNA, 20 bp, Homo sapiens
agcttgccctggtgcctcac

SEQ ID NO: 4594761 - DNA, 12 bp, Homo sapiens
agctttccctgc

SEQ ID NO: 4594762 - DNA, 18 bp, Homo sapiens
agctttggacctaatcca

SEQ ID NO: 4594763 - DNA, 19 bp, Homo sapiens
agctttggacctaatccaa

SEQ ID NO: 4594764 - DNA, 17 bp, Homo sapiens
aggaaagaaagaaggaa

SEQ ID NO: 4594765 - DNA, 21 bp, Homo sapiens
aggaacagaaggatgaatgag

SEQ ID NO: 4594766 - DNA, 12 bp, Homo sapiens
aggaaggaaaga

SEQ ID NO: 4594767 - DNA, 12 bp, Homo sapiens
aggaagggcaaa

SEQ ID NO: 4594768 - DNA, 19 bp, Homo sapiens
aggaattgacccacaagaa

SEQ ID NO: 4594769 - DNA, 23 bp, Homo sapiens
aggaattgacccacaagaaatga

SEQ ID NO: 4594770 - DNA, 17 bp, Homo sapiens
aggaatttcccaggacc

SEQ ID NO: 4594771 - DNA, 21 bp, Homo sapiens
aggaatttcccaggaccctga

SEQ ID NO: 4594772 - DNA, 12 bp, Homo sapiens
aggaccagctca

SEQ ID NO: 4594773 - DNA, 13 bp, Homo sapiens
aggaccagctcag

SEQ ID NO: 4594774 - DNA, 15 bp, Homo sapiens
aggaccagctcagga

SEQ ID NO: 4594775 - DNA, 19 bp, Homo sapiens
aggaccctgaaggggccat

SEQ ID NO: 4594776 - DNA, 11 bp, Homo sapiens
aggagaaactg

SEQ ID NO: 4594777 - DNA, 17 bp, Homo sapiens
aggagaaactggaactc

SEQ ID NO: 4594778 - DNA, 19 bp, Homo sapiens
aggagaaactggaactctc

SEQ ID NO: 4594779 - DNA, 12 bp, Homo sapiens
aggagaagccag

SEQ ID NO: 4594780 - DNA, 14 bp, Homo sapiens
aggagaccaaggcg

SEQ ID NO: 4594781 - DNA, 12 bp, Homo sapiens
aggagctgggga

SEQ ID NO: 4594782 - DNA, 21 bp, Homo sapiens
aggagctggggatccctcccc

SEQ ID NO: 4594783 - DNA, 18 bp, Homo sapiens
aggagggggcaggctgag

SEQ ID NO: 4594784 - DNA, 19 bp, Homo sapiens
aggagggggcaggctgagg

SEQ ID NO: 4594785 - DNA, 19 bp, Homo sapiens
aggagtttgagaccagcct

SEQ ID NO: 4594786 - DNA, 18 bp, Homo sapiens
aggatcatccctttggtt

SEQ ID NO: 4594787 - DNA, 21 bp, Homo sapiens
aggatgaatgaggtcccaggc

SEQ ID NO: 4594788 - DNA, 15 bp, Homo sapiens
aggatgcttgtacat

SEQ ID NO: 4594789 - DNA, 16 bp, Homo sapiens
aggatgcttgtacata

SEQ ID NO: 4594790 - DNA, 18 bp, Homo sapiens
aggatgcttgtacataat

SEQ ID NO: 4594791 - DNA, 17 bp, Homo sapiens
aggattgcttgagccca

SEQ ID NO: 4594792 - DNA, 19 bp, Homo sapiens
aggattgcttgagcccagg

SEQ ID NO: 4594793 - DNA, 21 bp, Homo sapiens
aggattgcttgagcccaggag

SEQ ID NO: 4594794 - DNA, 14 bp, Homo sapiens
aggcaggggaatgt

SEQ ID NO: 4594795 - DNA, 16 bp, Homo sapiens
aggcaggggaatgtat

SEQ ID NO: 4594796 - DNA, 19 bp, Homo sapiens
aggcaggggaatgtatgtg

SEQ ID NO: 4594797 - DNA, 19 bp, Homo sapiens
aggcagtaataaaaagatt

SEQ ID NO: 4594798 - DNA, 21 bp, Homo sapiens
aggccaggagtttgagaccag

SEQ ID NO: 4594799 - DNA, 17 bp, Homo sapiens
aggcccagttcaccctg

SEQ ID NO: 4594800 - DNA, 12 bp, Homo sapiens
aggccccagcct

SEQ ID NO: 4594801 - DNA, 22 bp, Homo sapiens
aggccctccctgttccccagag

SEQ ID NO: 4594802 - DNA, 16 bp, Homo sapiens
aggcctataaccccag

SEQ ID NO: 4594803 - DNA, 15 bp, Homo sapiens
aggctacctttgtat

SEQ ID NO: 4594804 - DNA, 14 bp, Homo sapiens
aggctgaggcagga

SEQ ID NO: 4594805 - DNA, 16 bp, Homo sapiens
aggctgagggtcgtgg

SEQ ID NO: 4594806 - DNA, 16 bp, Homo sapiens
aggctgtctgttgtat

SEQ ID NO: 4594807 - DNA, 13 bp, Homo sapiens
aggcttccacact

SEQ ID NO: 4594808 - DNA, 16 bp, Homo sapiens
agggaaagccagcctg

SEQ ID NO: 4594809 - DNA, 22 bp, Homo sapiens
agggacagaggccccagcctcc

SEQ ID NO: 4594810 - DNA, 12 bp, Homo sapiens
agggccagagcc

SEQ ID NO: 4594811 - DNA, 13 bp, Homo sapiens
agggccagagcca

SEQ ID NO: 4594812 - DNA, 12 bp, Homo sapiens
agggcccagagc

SEQ ID NO: 4594813 - DNA, 16 bp, Homo sapiens
aggggaatcagaactc

SEQ ID NO: 4594814 - DNA, 12 bp, Homo sapiens
aggggagcccac

SEQ ID NO: 4594815 - DNA, 21 bp, Homo sapiens
aggggcttaattattgatgtt

SEQ ID NO: 4594816 - DNA, 15 bp, Homo sapiens
agggggcaggctgag

SEQ ID NO: 4594817 - DNA, 20 bp, Homo sapiens
agggtcgtgggaaaggggag

SEQ ID NO: 4594818 - DNA, 23 bp, Homo sapiens
aggtactttcatattttaaacag

SEQ ID NO: 4594819 - DNA, 11 bp, Homo sapiens
aggtcccaggc

SEQ ID NO: 4594820 - DNA, 20 bp, Homo sapiens
aggtcgcttgggaattttat

SEQ ID NO: 4594821 - DNA, 13 bp, Homo sapiens
aggtctgttcttt

SEQ ID NO: 4594822 - DNA, 20 bp, Homo sapiens
aggtgaaactccagatgcca

SEQ ID NO: 4594823 - DNA, 15 bp, Homo sapiens
aggtgagtggcctgt

SEQ ID NO: 4594824 - DNA, 21 bp, Homo sapiens
aggttacaagcctgcacaata

SEQ ID NO: 4594825 - DNA, 20 bp, Homo sapiens
aggttttctgtgtttagcta

SEQ ID NO: 4594826 - DNA, 23 bp, Homo sapiens
aggttttctgtgtttagctattt

SEQ ID NO: 4594827 - DNA, 18 bp, Homo sapiens
agtaaatgggggtgcatt

SEQ ID NO: 4594828 - DNA, 19 bp, Homo sapiens
agtaatatgcacacatttt

SEQ ID NO: 4594829 - DNA, 16 bp, Homo sapiens
agtacactgtttcaaa

SEQ ID NO: 4594830 - DNA, 20 bp, Homo sapiens
agtacactgtttcaaacttt

SEQ ID NO: 4594831 - DNA, 16 bp, Homo sapiens
agtacatgggtgacta

SEQ ID NO: 4594832 - DNA, 12 bp, Homo sapiens
agtaccatttaa

SEQ ID NO: 4594833 - DNA, 17 bp, Homo sapiens
agtacgttgtgcatttg

SEQ ID NO: 4594834 - DNA, 18 bp, Homo sapiens
agtacgttgtgcatttgg

SEQ ID NO: 4594835 - DNA, 15 bp, Homo sapiens
agtatgaggcatttg

SEQ ID NO: 4594836 - DNA, 23 bp, Homo sapiens
agtatgtgggcagattttcagca

SEQ ID NO: 4594837 - DNA, 14 bp, Homo sapiens
agtattataccttt

SEQ ID NO: 4594838 - DNA, 15 bp, Homo sapiens
agtattatacctttt

SEQ ID NO: 4594839 - DNA, 14 bp, Homo sapiens
agtcacatcacagg

SEQ ID NO: 4594840 - DNA, 13 bp, Homo sapiens
agtcatgaagccc

SEQ ID NO: 4594841 - DNA, 14 bp, Homo sapiens
agtcccaaggaaag

SEQ ID NO: 4594842 - DNA, 17 bp, Homo sapiens
agtcccaaggaaagccc

SEQ ID NO: 4594843 - DNA, 20 bp, Homo sapiens
agtcccaaggaaagccccag

SEQ ID NO: 4594844 - DNA, 21 bp, Homo sapiens
agtcccaaggaaagccccagc

SEQ ID NO: 4594845 - DNA, 18 bp, Homo sapiens
agtcggcacagtgcagca

SEQ ID NO: 4594846 - DNA, 15 bp, Homo sapiens
agtctggtgaagctc

SEQ ID NO: 4594847 - DNA, 12 bp, Homo sapiens
agtcttcctgac

SEQ ID NO: 4594848 - DNA, 17 bp, Homo sapiens
agtcttcctgacacttt

SEQ ID NO: 4594849 - DNA, 14 bp, Homo sapiens
agtcttctatttat

SEQ ID NO: 4594850 - DNA, 16 bp, Homo sapiens
agtgaacaaatttaca

SEQ ID NO: 4594851 - DNA, 14 bp, Homo sapiens
agtgaagacaatga

SEQ ID NO: 4594852 - DNA, 13 bp, Homo sapiens
agtgagacagact

SEQ ID NO: 4594853 - DNA, 21 bp, Homo sapiens
agtgcaataaatctgacccag

SEQ ID NO: 4594854 - DNA, 18 bp, Homo sapiens
agtgcagcaagcctggcc

SEQ ID NO: 4594855 - DNA, 14 bp, Homo sapiens
agtgcccccactga

SEQ ID NO: 4594856 - DNA, 16 bp, Homo sapiens
agtgcccccactgacc

SEQ ID NO: 4594857 - DNA, 18 bp, Homo sapiens
agtgcccccactgaccag

SEQ ID NO: 4594858 - DNA, 12 bp, Homo sapiens
agtgctgcattt

SEQ ID NO: 4594859 - DNA, 20 bp, Homo sapiens
agtgctgcatttaaaagata

SEQ ID NO: 4594860 - DNA, 22 bp, Homo sapiens
agtgctgcatttaaaagataca

SEQ ID NO: 4594861 - DNA, 18 bp, Homo sapiens
agtggccaagatcacagt

SEQ ID NO: 4594862 - DNA, 22 bp, Homo sapiens
agtgggtggggacagaccagcc

SEQ ID NO: 4594863 - DNA, 18 bp, Homo sapiens
agtggtggttttctgttc

SEQ ID NO: 4594864 - DNA, 23 bp, Homo sapiens
agtggtggttttctgttctttct

SEQ ID NO: 4594865 - DNA, 19 bp, Homo sapiens
agtgtcaatgcagccccca

SEQ ID NO: 4594866 - DNA, 16 bp, Homo sapiens
agtgttgtggatttaa

SEQ ID NO: 4594867 - DNA, 19 bp, Homo sapiens
agtgttgtggatttaacag

SEQ ID NO: 4594868 - DNA, 20 bp, Homo sapiens
agtgttgtggatttaacaga

SEQ ID NO: 4594869 - DNA, 17 bp, Homo sapiens
agttaagacctggcagc

SEQ ID NO: 4594870 - DNA, 15 bp, Homo sapiens
agttaccagtgcctt

SEQ ID NO: 4594871 - DNA, 16 bp, Homo sapiens
agttaccagtgcctta

SEQ ID NO: 4594872 - DNA, 13 bp, Homo sapiens
agttactcagaat

SEQ ID NO: 4594873 - DNA, 15 bp, Homo sapiens
agttagttccactga

SEQ ID NO: 4594874 - DNA, 19 bp, Homo sapiens
agttagttccactgagacc

SEQ ID NO: 4594875 - DNA, 16 bp, Homo sapiens
agttagtttctttggg

SEQ ID NO: 4594876 - DNA, 20 bp, Homo sapiens
agttatgatttttttttcat

SEQ ID NO: 4594877 - DNA, 21 bp, Homo sapiens
agttcaggagtcccaaggaaa

SEQ ID NO: 4594878 - DNA, 16 bp, Homo sapiens
agttctgcagataaac

SEQ ID NO: 4594879 - DNA, 18 bp, Homo sapiens
agttctttgggccagaca

SEQ ID NO: 4594880 - DNA, 16 bp, Homo sapiens
agttgatactacagtt

SEQ ID NO: 4594881 - DNA, 13 bp, Homo sapiens
agttgatctggaa

SEQ ID NO: 4594882 - DNA, 17 bp, Homo sapiens
agttgatctggaaccca

SEQ ID NO: 4594883 - DNA, 23 bp, Homo sapiens
agttgatctggaacccagactca

SEQ ID NO: 4594884 - DNA, 16 bp, Homo sapiens
agttgctgcaaacctg

SEQ ID NO: 4594885 - DNA, 20 bp, Homo sapiens
agttggagggaaagccagcc

SEQ ID NO: 4594886 - DNA, 19 bp, Homo sapiens
agttgtaccgcaatgtgac

SEQ ID NO: 4594887 - DNA, 20 bp, Homo sapiens
agttgttagattaagaaata

SEQ ID NO: 4594888 - DNA, 13 bp, Homo sapiens
agtttctttggga

SEQ ID NO: 4594889 - DNA, 14 bp, Homo sapiens
agtttgattaaatt

SEQ ID NO: 4594890 - DNA, 16 bp, Homo sapiens
agtttgattaaattct

SEQ ID NO: 4594891 - DNA, 17 bp, Homo sapiens
agtttgattaaattctt

SEQ ID NO: 4594892 - DNA, 22 bp, Homo sapiens
agtttgttagtatgaggcattt

SEQ ID NO: 4594893 - DNA, 15 bp, Homo sapiens
agttttacagtgttt

SEQ ID NO: 4594894 - DNA, 17 bp, Homo sapiens
agttttgaagattctat

SEQ ID NO: 4594895 - DNA, 18 bp, Homo sapiens
agttttgaagattctatg

SEQ ID NO: 4594896 - DNA, 11 bp, Homo sapiens
ataaaactttt

SEQ ID NO: 4594897 - DNA, 15 bp, Homo sapiens
ataaacaagaccacg

SEQ ID NO: 4594898 - DNA, 21 bp, Homo sapiens
ataaacatccttcaagaactc

SEQ ID NO: 4594899 - DNA, 21 bp, Homo sapiens
ataaactttaccttttttata

SEQ ID NO: 4594900 - DNA, 24 bp, Homo sapiens
ataaactttaccttttttatacat

SEQ ID NO: 4594901 - DNA, 21 bp, Homo sapiens
ataaagatgagtgagcatgcc

SEQ ID NO: 4594902 - DNA, 16 bp, Homo sapiens
ataaatctgacccagt

SEQ ID NO: 4594903 - DNA, 19 bp, Homo sapiens
ataacatgtgaaaagaata

SEQ ID NO: 4594904 - DNA, 14 bp, Homo sapiens
ataagccagacatc

SEQ ID NO: 4594905 - DNA, 18 bp, Homo sapiens
ataagttcaaattcttct

SEQ ID NO: 4594906 - DNA, 21 bp, Homo sapiens
ataagttcaaattcttctgaa

SEQ ID NO: 4594907 - DNA, 13 bp, Homo sapiens
ataataaagaata

SEQ ID NO: 4594908 - DNA, 23 bp, Homo sapiens
ataataaagaatagctttaatga

SEQ ID NO: 4594909 - DNA, 18 bp, Homo sapiens
ataatacaccactacatt

SEQ ID NO: 4594910 - DNA, 20 bp, Homo sapiens
ataatacaccactacattct

SEQ ID NO: 4594911 - DNA, 23 bp, Homo sapiens
ataatacaccactacattctgtt

SEQ ID NO: 4594912 - DNA, 20 bp, Homo sapiens
ataatgcgtgcataccactt

SEQ ID NO: 4594913 - DNA, 18 bp, Homo sapiens
atacaccactacattctg

SEQ ID NO: 4594914 - DNA, 19 bp, Homo sapiens
atacaccactacattctgt

SEQ ID NO: 4594915 - DNA, 22 bp, Homo sapiens
atacacttattggaactctgct

SEQ ID NO: 4594916 - DNA, 18 bp, Homo sapiens
atacagttactcagaatt

SEQ ID NO: 4594917 - DNA, 21 bp, Homo sapiens
atacatttaaaacattaaaat

SEQ ID NO: 4594918 - DNA, 18 bp, Homo sapiens
ataccacttttgttcttg

SEQ ID NO: 4594919 - DNA, 17 bp, Homo sapiens
ataccagctgagtctga

SEQ ID NO: 4594920 - DNA, 14 bp, Homo sapiens
atacgtacacattt

SEQ ID NO: 4594921 - DNA, 15 bp, Homo sapiens
atacgtacacatttt

SEQ ID NO: 4594922 - DNA, 16 bp, Homo sapiens
atacgtacacatttta

SEQ ID NO: 4594923 - DNA, 16 bp, Homo sapiens
atactacagtttgtta

SEQ ID NO: 4594924 - DNA, 21 bp, Homo sapiens
atactgcatactttttaaatg

SEQ ID NO: 4594925 - DNA, 18 bp, Homo sapiens
atactgccttgtttaatg

SEQ ID NO: 4594926 - DNA, 22 bp, Homo sapiens
atacttagcaaagttttacctg

SEQ ID NO: 4594927 - DNA, 16 bp, Homo sapiens
atacttgaagggccag

SEQ ID NO: 4594928 - DNA, 18 bp, Homo sapiens
atacttgaagggccagag

SEQ ID NO: 4594929 - DNA, 19 bp, Homo sapiens
atactttttaaatgtaaag

SEQ ID NO: 4594930 - DNA, 22 bp, Homo sapiens
atagacaatttattatggcaca

SEQ ID NO: 4594931 - DNA, 15 bp, Homo sapiens
atagatgctggccca

SEQ ID NO: 4594932 - DNA, 17 bp, Homo sapiens
atagatgctggcccagg

SEQ ID NO: 4594933 - DNA, 23 bp, Homo sapiens
atagatgctggcccagggcccag

SEQ ID NO: 4594934 - DNA, 19 bp, Homo sapiens
atagcaagacacatcccta

SEQ ID NO: 4594935 - DNA, 19 bp, Homo sapiens
ataggaacttaaataatgt

SEQ ID NO: 4594936 - DNA, 14 bp, Homo sapiens
atagggtctaactc

SEQ ID NO: 4594937 - DNA, 21 bp, Homo sapiens
atagtttgctttgtttaagca

SEQ ID NO: 4594938 - DNA, 12 bp, Homo sapiens
atatagttttac

SEQ ID NO: 4594939 - DNA, 13 bp, Homo sapiens
atatagttttact

SEQ ID NO: 4594940 - DNA, 15 bp, Homo sapiens
atatcaatttaaaaa

SEQ ID NO: 4594941 - DNA, 12 bp, Homo sapiens
atatccaaaagc

SEQ ID NO: 4594942 - DNA, 15 bp, Homo sapiens
atatgaacatattgt

SEQ ID NO: 4594943 - DNA, 19 bp, Homo sapiens
atatgaacatattgttgaa

SEQ ID NO: 4594944 - DNA, 22 bp, Homo sapiens
atatgcacacattttttaaatg

SEQ ID NO: 4594945 - DNA, 14 bp, Homo sapiens
atatgcttactgat

SEQ ID NO: 4594946 - DNA, 23 bp, Homo sapiens
atatgtacctaacgaagtatcct

SEQ ID NO: 4594947 - DNA, 17 bp, Homo sapiens
atattaccacagacata

SEQ ID NO: 4594948 - DNA, 22 bp, Homo sapiens
atattaccacagacatactaac

SEQ ID NO: 4594949 - DNA, 21 bp, Homo sapiens
atattgatttccgttaaaata

SEQ ID NO: 4594950 - DNA, 9 bp, Homo sapiens
atatttaat

SEQ ID NO: 4594951 - DNA, 23 bp, Homo sapiens
atatttctgaggagcctgcaaca

SEQ ID NO: 4594952 - DNA, 20 bp, Homo sapiens
atatttttatctttatatga

SEQ ID NO: 4594953 - DNA, 20 bp, Homo sapiens
atattttttgttaaatgatt

SEQ ID NO: 4594954 - DNA, 13 bp, Homo sapiens
atcaaatacattt

SEQ ID NO: 4594955 - DNA, 11 bp, Homo sapiens
atcaactgaat

SEQ ID NO: 4594956 - DNA, 14 bp, Homo sapiens
atcaactgaatgag

SEQ ID NO: 4594957 - DNA, 13 bp, Homo sapiens
atcaatttaaaaa

SEQ ID NO: 4594958 - DNA, 13 bp, Homo sapiens
atcacgctttcct

SEQ ID NO: 4594959 - DNA, 18 bp, Homo sapiens
atcacgctttcctgaatc

SEQ ID NO: 4594960 - DNA, 20 bp, Homo sapiens
atcacttaggaaatggcttt

SEQ ID NO: 4594961 - DNA, 23 bp, Homo sapiens
atcacttgaacccgggaggcaga

SEQ ID NO: 4594962 - DNA, 21 bp, Homo sapiens
atcactttctcagttttcata

SEQ ID NO: 4594963 - DNA, 22 bp, Homo sapiens
atcagaactcaaatggggccag

SEQ ID NO: 4594964 - DNA, 20 bp, Homo sapiens
atcagcacgatttctgttta

SEQ ID NO: 4594965 - DNA, 21 bp, Homo sapiens
atcatgcatgtcctgtaaagg

SEQ ID NO: 4594966 - DNA, 18 bp, Homo sapiens
atccaaaagaagccccca

SEQ ID NO: 4594967 - DNA, 13 bp, Homo sapiens
atccaaaagcttt

SEQ ID NO: 4594968 - DNA, 16 bp, Homo sapiens
atccaactaatgcctt

SEQ ID NO: 4594969 - DNA, 18 bp, Homo sapiens
atccaactaatgccttac

SEQ ID NO: 4594970 - DNA, 23 bp, Homo sapiens
atccaggactatatttgggcctg

SEQ ID NO: 4594971 - DNA, 16 bp, Homo sapiens
atccagtgatccttac

SEQ ID NO: 4594972 - DNA, 20 bp, Homo sapiens
atccatgacctagttttcca

SEQ ID NO: 4594973 - DNA, 18 bp, Homo sapiens
atccctcccccccatgca

SEQ ID NO: 4594974 - DNA, 19 bp, Homo sapiens
atcccttggacattttatg

SEQ ID NO: 4594975 - DNA, 21 bp, Homo sapiens
atcccttggacattttatgtc

SEQ ID NO: 4594976 - DNA, 19 bp, Homo sapiens
atcctgtctttaaggaaaa

SEQ ID NO: 4594977 - DNA, 23 bp, Homo sapiens
atcctgtctttaaggaaaaaaag

SEQ ID NO: 4594978 - DNA, 13 bp, Homo sapiens
atccttacaagtt

SEQ ID NO: 4594979 - DNA, 20 bp, Homo sapiens
atccttcaagaactctgggc

SEQ ID NO: 4594980 - DNA, 15 bp, Homo sapiens
atcggcatttgtttc

SEQ ID NO: 4594981 - DNA, 14 bp, Homo sapiens
atcgtcactgctta

SEQ ID NO: 4594982 - DNA, 18 bp, Homo sapiens
atctaaatggaaccactc

SEQ ID NO: 4594983 - DNA, 19 bp, Homo sapiens
atctaaatggaaccactct

SEQ ID NO: 4594984 - DNA, 19 bp, Homo sapiens
atctacactccagtgagac

SEQ ID NO: 4594985 - DNA, 18 bp, Homo sapiens
atctagatactgtatcat

SEQ ID NO: 4594986 - DNA, 19 bp, Homo sapiens
atctagatactgtatcatg

SEQ ID NO: 4594987 - DNA, 19 bp, Homo sapiens
atctatttttggcagtctg

SEQ ID NO: 4594988 - DNA, 16 bp, Homo sapiens
atctcaaatttctaaa

SEQ ID NO: 4594989 - DNA, 14 bp, Homo sapiens
atctccaaaataaa

SEQ ID NO: 4594990 - DNA, 15 bp, Homo sapiens
atctcttgaggccag

SEQ ID NO: 4594991 - DNA, 14 bp, Homo sapiens
atctgacccagtgc

SEQ ID NO: 4594992 - DNA, 20 bp, Homo sapiens
atctggaacctcagcctggc

SEQ ID NO: 4594993 - DNA, 21 bp, Homo sapiens
atctggaacctcagcctggcc

SEQ ID NO: 4594994 - DNA, 22 bp, Homo sapiens
atctggaacctcagcctggcca

SEQ ID NO: 4594995 - DNA, 23 bp, Homo sapiens
atcttattttcatgtatatgtgt

SEQ ID NO: 4594996 - DNA, 14 bp, Homo sapiens
atctttatcataaa

SEQ ID NO: 4594997 - DNA, 14 bp, Homo sapiens
atgaaaacacattt

SEQ ID NO: 4594998 - DNA, 16 bp, Homo sapiens
atgaaaacacattttt

SEQ ID NO: 4594999 - DNA, 15 bp, Homo sapiens
atgaaagcagggact

SEQ ID NO: 4595000 - DNA, 18 bp, Homo sapiens
atgaagatgtagaggaga

SEQ ID NO: 4595001 - DNA, 12 bp, Homo sapiens
atgaagcccaag

SEQ ID NO: 4595002 - DNA, 14 bp, Homo sapiens
atgaagtaatatgc

SEQ ID NO: 4595003 - DNA, 22 bp, Homo sapiens
atgaagttgattcatattgcat

SEQ ID NO: 4595004 - DNA, 12 bp, Homo sapiens
atgaatactttg

SEQ ID NO: 4595005 - DNA, 14 bp, Homo sapiens
atgacacatgcaag

SEQ ID NO: 4595006 - DNA, 18 bp, Homo sapiens
atgacctagttttccatg

SEQ ID NO: 4595007 - DNA, 14 bp, Homo sapiens
atgacttactgtac

SEQ ID NO: 4595008 - DNA, 17 bp, Homo sapiens
atgacttactgtacatg

SEQ ID NO: 4595009 - DNA, 19 bp, Homo sapiens
atgaggtcccaggcagaga

SEQ ID NO: 4595010 - DNA, 20 bp, Homo sapiens
atgaggtcccaggcagagaa

SEQ ID NO: 4595011 - DNA, 15 bp, Homo sapiens
atgcaaccatttgaa

SEQ ID NO: 4595012 - DNA, 13 bp, Homo sapiens
atgcaaggaagga

SEQ ID NO: 4595013 - DNA, 14 bp, Homo sapiens
atgcaaggaaggaa

SEQ ID NO: 4595014 - DNA, 16 bp, Homo sapiens
atgcaaggaaggaaag

SEQ ID NO: 4595015 - DNA, 22 bp, Homo sapiens
atgcacacattttttaaatgca

SEQ ID NO: 4595016 - DNA, 23 bp, Homo sapiens
atgcacagagttgttacattttt

SEQ ID NO: 4595017 - DNA, 19 bp, Homo sapiens
atgcacctggaatatataa

SEQ ID NO: 4595018 - DNA, 13 bp, Homo sapiens
atgcactgtgaag

SEQ ID NO: 4595019 - DNA, 19 bp, Homo sapiens
atgcatggtgccccaggac

SEQ ID NO: 4595020 - DNA, 19 bp, Homo sapiens
atgccacaaggacttcctg

SEQ ID NO: 4595021 - DNA, 18 bp, Homo sapiens
atgccagctcagtcccat

SEQ ID NO: 4595022 - DNA, 19 bp, Homo sapiens
atgcctgtcttaattttct

SEQ ID NO: 4595023 - DNA, 16 bp, Homo sapiens
atgccttactcttctt

SEQ ID NO: 4595024 - DNA, 21 bp, Homo sapiens
atgcgtacgtttcctgagaag

SEQ ID NO: 4595025 - DNA, 20 bp, Homo sapiens
atgcgtgcataccacttttg

SEQ ID NO: 4595026 - DNA, 13 bp, Homo sapiens
atgctaagtgaaa

SEQ ID NO: 4595027 - DNA, 17 bp, Homo sapiens
atgctacacactgcatg

SEQ ID NO: 4595028 - DNA, 15 bp, Homo sapiens
atgctagagcctctg

SEQ ID NO: 4595029 - DNA, 17 bp, Homo sapiens
atgctagagcctctgcc

SEQ ID NO: 4595030 - DNA, 19 bp, Homo sapiens
atgctagagcctctgcctg

SEQ ID NO: 4595031 - DNA, 12 bp, Homo sapiens
atgctgcccctc

SEQ ID NO: 4595032 - DNA, 12 bp, Homo sapiens
atgctggcccag

SEQ ID NO: 4595033 - DNA, 15 bp, Homo sapiens
atgctggcccagggc

SEQ ID NO: 4595034 - DNA, 19 bp, Homo sapiens
atgctggcccagggcccag

SEQ ID NO: 4595035 - DNA, 22 bp, Homo sapiens
atgctggcccagggcccagagc

SEQ ID NO: 4595036 - DNA, 23 bp, Homo sapiens
atgctgtgacacatggcccctcc

SEQ ID NO: 4595037 - DNA, 22 bp, Homo sapiens
atgcttactgatatattttaca

SEQ ID NO: 4595038 - DNA, 15 bp, Homo sapiens
atgcttagtccctca

SEQ ID NO: 4595039 - DNA, 15 bp, Homo sapiens
atgcttgtacataat

SEQ ID NO: 4595040 - DNA, 14 bp, Homo sapiens
atggagggtttagt

SEQ ID NO: 4595041 - DNA, 16 bp, Homo sapiens
atggagtgtacaagta

SEQ ID NO: 4595042 - DNA, 24 bp, Homo sapiens
atggcaacagatctggaacctcag

SEQ ID NO: 4595043 - DNA, 19 bp, Homo sapiens
atggctaagcaaaatgtga

SEQ ID NO: 4595044 - DNA, 20 bp, Homo sapiens
atggctagtatcaaaagaaa

SEQ ID NO: 4595045 - DNA, 17 bp, Homo sapiens
atggctttgtgattcaa

SEQ ID NO: 4595046 - DNA, 16 bp, Homo sapiens
atggcttttgtgcatt

SEQ ID NO: 4595047 - DNA, 13 bp, Homo sapiens
atggggaggacaa

SEQ ID NO: 4595048 - DNA, 14 bp, Homo sapiens
atggggccagatcc

SEQ ID NO: 4595049 - DNA, 19 bp, Homo sapiens
atgggggaactcagatcca

SEQ ID NO: 4595050 - DNA, 14 bp, Homo sapiens
atgggggtgcattt

SEQ ID NO: 4595051 - DNA, 15 bp, Homo sapiens
atgggggtgcatttg

SEQ ID NO: 4595052 - DNA, 14 bp, Homo sapiens
atggtcgcccagga

SEQ ID NO: 4595053 - DNA, 14 bp, Homo sapiens
atggtgccccagga

SEQ ID NO: 4595054 - DNA, 16 bp, Homo sapiens
atggtgccccaggacc

SEQ ID NO: 4595055 - DNA, 15 bp, Homo sapiens
atgtaattttgtgta

SEQ ID NO: 4595056 - DNA, 17 bp, Homo sapiens
atgtaattttgtgtaag

SEQ ID NO: 4595057 - DNA, 16 bp, Homo sapiens
atgtatatgtgttcat

SEQ ID NO: 4595058 - DNA, 19 bp, Homo sapiens
atgtatattttatatcaat

SEQ ID NO: 4595059 - DNA, 17 bp, Homo sapiens
atgtatcaaatacattt

SEQ ID NO: 4595060 - DNA, 20 bp, Homo sapiens
atgtcaggaacagaaggatg

SEQ ID NO: 4595061 - DNA, 16 bp, Homo sapiens
atgtccactggttctt

SEQ ID NO: 4595062 - DNA, 16 bp, Homo sapiens
atgtctattcagcttc

SEQ ID NO: 4595063 - DNA, 13 bp, Homo sapiens
atgtctcttctga

SEQ ID NO: 4595064 - DNA, 19 bp, Homo sapiens
atgtgcacatctgttttgt

SEQ ID NO: 4595065 - DNA, 19 bp, Homo sapiens
atgtgctatactgcatact

SEQ ID NO: 4595066 - DNA, 13 bp, Homo sapiens
atgttaatatttc

SEQ ID NO: 4595067 - DNA, 12 bp, Homo sapiens
atgttttcaaat

SEQ ID NO: 4595068 - DNA, 18 bp, Homo sapiens
atgttttcaaatgttctc

SEQ ID NO: 4595069 - DNA, 18 bp, Homo sapiens
attaaattcttgcaaagt

SEQ ID NO: 4595070 - DNA, 12 bp, Homo sapiens
attaacttttat

SEQ ID NO: 4595071 - DNA, 16 bp, Homo sapiens
attaacttttataaac

SEQ ID NO: 4595072 - DNA, 20 bp, Homo sapiens
attaacttttataaacttta

SEQ ID NO: 4595073 - DNA, 17 bp, Homo sapiens
attagaaattggctgga

SEQ ID NO: 4595074 - DNA, 21 bp, Homo sapiens
attagttttgaagattctatg

SEQ ID NO: 4595075 - DNA, 16 bp, Homo sapiens
attatgttaatatttc

SEQ ID NO: 4595076 - DNA, 15 bp, Homo sapiens
attcaatctgtaaac

SEQ ID NO: 4595077 - DNA, 22 bp, Homo sapiens
attcaatgtttatgcaaggaag

SEQ ID NO: 4595078 - DNA, 23 bp, Homo sapiens
attcaatgtttatgcaaggaagg

SEQ ID NO: 4595079 - DNA, 21 bp, Homo sapiens
attcattctttttgaaatgtc

SEQ ID NO: 4595080 - DNA, 13 bp, Homo sapiens
attcctcctgctc

SEQ ID NO: 4595081 - DNA, 19 bp, Homo sapiens
attcctgaagaaccagtcc

SEQ ID NO: 4595082 - DNA, 15 bp, Homo sapiens
attcttgcaaagtat

SEQ ID NO: 4595083 - DNA, 19 bp, Homo sapiens
attgaagtattttgctgga

SEQ ID NO: 4595084 - DNA, 17 bp, Homo sapiens
attgacacttaaaaatg

SEQ ID NO: 4595085 - DNA, 19 bp, Homo sapiens
attgacacttaaaaatggt

SEQ ID NO: 4595086 - DNA, 18 bp, Homo sapiens
attgacccacaagaaatg

SEQ ID NO: 4595087 - DNA, 13 bp, Homo sapiens
attgatgttttca

SEQ ID NO: 4595088 - DNA, 17 bp, Homo sapiens
attgatgttttcataga

SEQ ID NO: 4595089 - DNA, 17 bp, Homo sapiens
attgcttgagcccagga

SEQ ID NO: 4595090 - DNA, 20 bp, Homo sapiens
attggcacctaatccaggca

SEQ ID NO: 4595091 - DNA, 14 bp, Homo sapiens
attgtaaaatggtg

SEQ ID NO: 4595092 - DNA, 13 bp, Homo sapiens
attgtcacttttt

SEQ ID NO: 4595093 - DNA, 17 bp, Homo sapiens
atttaaaaaaaaacctg

SEQ ID NO: 4595094 - DNA, 14 bp, Homo sapiens
atttaaaacagaca

SEQ ID NO: 4595095 - DNA, 18 bp, Homo sapiens
atttaaaacagacactgg

SEQ ID NO: 4595096 - DNA, 23 bp, Homo sapiens
atttaaaacagacactggcatgg

SEQ ID NO: 4595097 - DNA, 20 bp, Homo sapiens
atttaaaacattaaaatata

SEQ ID NO: 4595098 - DNA, 17 bp, Homo sapiens
atttaaaagatacagtt

SEQ ID NO: 4595099 - DNA, 15 bp, Homo sapiens
atttaacagaaatgt

SEQ ID NO: 4595100 - DNA, 17 bp, Homo sapiens
atttaacagaaatgtac

SEQ ID NO: 4595101 - DNA, 23 bp, Homo sapiens
atttaatggaagtgtatttattt

SEQ ID NO: 4595102 - DNA, 18 bp, Homo sapiens
atttaatttgaaatatgg

SEQ ID NO: 4595103 - DNA, 16 bp, Homo sapiens
atttattatggcacat

SEQ ID NO: 4595104 - DNA, 15 bp, Homo sapiens
atttattgaaatgat

SEQ ID NO: 4595105 - DNA, 18 bp, Homo sapiens
atttatttaatatttaat

SEQ ID NO: 4595106 - DNA, 11 bp, Homo sapiens
atttcaagttc

SEQ ID NO: 4595107 - DNA, 22 bp, Homo sapiens
atttcaagttccaagttgctaa

SEQ ID NO: 4595108 - DNA, 18 bp, Homo sapiens
atttcacctgtaaacctg

SEQ ID NO: 4595109 - DNA, 18 bp, Homo sapiens
atttcagactcccattcc

SEQ ID NO: 4595110 - DNA, 12 bp, Homo sapiens
atttcccaggac

SEQ ID NO: 4595111 - DNA, 19 bp, Homo sapiens
atttcccaggaccctgaag

SEQ ID NO: 4595112 - DNA, 16 bp, Homo sapiens
atttccgttaaaatac

SEQ ID NO: 4595113 - DNA, 20 bp, Homo sapiens
atttctaaaaaacagaggcc

SEQ ID NO: 4595114 - DNA, 13 bp, Homo sapiens
atttctaaatctc

SEQ ID NO: 4595115 - DNA, 15 bp, Homo sapiens
atttctcatgttgaa

SEQ ID NO: 4595116 - DNA, 12 bp, Homo sapiens
atttctgtttag

SEQ ID NO: 4595117 - DNA, 16 bp, Homo sapiens
atttctgtttagataa

SEQ ID NO: 4595118 - DNA, 20 bp, Homo sapiens
atttcttggtaagaagccgg

SEQ ID NO: 4595119 - DNA, 23 bp, Homo sapiens
atttcttttgccgttattaaaaa

SEQ ID NO: 4595120 - DNA, 16 bp, Homo sapiens
atttgaaaattttgat

SEQ ID NO: 4595121 - DNA, 22 bp, Homo sapiens
atttgggcctgctccagacctg

SEQ ID NO: 4595122 - DNA, 18 bp, Homo sapiens
atttggtggtttcagaaa

SEQ ID NO: 4595123 - DNA, 13 bp, Homo sapiens
atttgtttgaact

SEQ ID NO: 4595124 - DNA, 23 bp, Homo sapiens
atttgtttgaactgataaagatg

SEQ ID NO: 4595125 - DNA, 18 bp, Homo sapiens
attttacagctcattaaa

SEQ ID NO: 4595126 - DNA, 18 bp, Homo sapiens
attttatatgcttactga

SEQ ID NO: 4595127 - DNA, 13 bp, Homo sapiens
attttatgtcttt

SEQ ID NO: 4595128 - DNA, 18 bp, Homo sapiens
attttatgttatttatag

SEQ ID NO: 4595129 - DNA, 15 bp, Homo sapiens
attttattatgcatg

SEQ ID NO: 4595130 - DNA, 15 bp, Homo sapiens
attttccataagcta

SEQ ID NO: 4595131 - DNA, 17 bp, Homo sapiens
attttccataagctatt

SEQ ID NO: 4595132 - DNA, 18 bp, Homo sapiens
attttctgtgcctgaata

SEQ ID NO: 4595133 - DNA, 20 bp, Homo sapiens
attttggagagtttcctgaa

SEQ ID NO: 4595134 - DNA, 22 bp, Homo sapiens
attttgtaataataaagaatag

SEQ ID NO: 4595135 - DNA, 20 bp, Homo sapiens
attttgtaatgtatcaaata

SEQ ID NO: 4595136 - DNA, 18 bp, Homo sapiens
attttgtgtaagaaatac

SEQ ID NO: 4595137 - DNA, 16 bp, Homo sapiens
atttttaaaacccatt

SEQ ID NO: 4595138 - DNA, 16 bp, Homo sapiens
atttttaagtgctgca

SEQ ID NO: 4595139 - DNA, 19 bp, Homo sapiens
atttttaagtgctgcattt

SEQ ID NO: 4595140 - DNA, 21 bp, Homo sapiens
atttttcttagggaaggatac

SEQ ID NO: 4595141 - DNA, 21 bp, Homo sapiens
attttttaaaaaaaactattt

SEQ ID NO: 4595142 - DNA, 13 bp, Homo sapiens
attttttaaatgc

SEQ ID NO: 4595143 - DNA, 16 bp, Homo sapiens
attttttatcatgcat

SEQ ID NO: 4595144 - DNA, 18 bp, Homo sapiens
attttttgttaaatgatt

SEQ ID NO: 4595145 - DNA, 16 bp, Homo sapiens
caaaacaaaggcctaa

SEQ ID NO: 4595146 - DNA, 13 bp, Homo sapiens
caaaacggggcag

SEQ ID NO: 4595147 - DNA, 13 bp, Homo sapiens
caaaagaagcccc

SEQ ID NO: 4595148 - DNA, 13 bp, Homo sapiens
caaaagcatgtga

SEQ ID NO: 4595149 - DNA, 13 bp, Homo sapiens
caaaagcttttta

SEQ ID NO: 4595150 - DNA, 16 bp, Homo sapiens
caaaataaaacttttt

SEQ ID NO: 4595151 - DNA, 20 bp, Homo sapiens
caaaataaaactttttaaaa

SEQ ID NO: 4595152 - DNA, 13 bp, Homo sapiens
caaacccatgagg

SEQ ID NO: 4595153 - DNA, 17 bp, Homo sapiens
caaactgaggaatttca

SEQ ID NO: 4595154 - DNA, 18 bp, Homo sapiens
caaagatattttgctttg

SEQ ID NO: 4595155 - DNA, 20 bp, Homo sapiens
caaagatattttgctttgtg

SEQ ID NO: 4595156 - DNA, 23 bp, Homo sapiens
caaaggcctaattctatgcctgt

SEQ ID NO: 4595157 - DNA, 19 bp, Homo sapiens
caaatacatttaaaacatt

SEQ ID NO: 4595158 - DNA, 22 bp, Homo sapiens
caaatatttagatgtaattttg

SEQ ID NO: 4595159 - DNA, 16 bp, Homo sapiens
caaatcaattactggt

SEQ ID NO: 4595160 - DNA, 14 bp, Homo sapiens
caaatggggccaga

SEQ ID NO: 4595161 - DNA, 18 bp, Homo sapiens
caaatggggccagatcca

SEQ ID NO: 4595162 - DNA, 20 bp, Homo sapiens
caaatggggccagatccagc

SEQ ID NO: 4595163 - DNA, 14 bp, Homo sapiens
caaattcttctgaa

SEQ ID NO: 4595164 - DNA, 16 bp, Homo sapiens
caaatttacagagaca

SEQ ID NO: 4595165 - DNA, 14 bp, Homo sapiens
caaatttctaaatc

SEQ ID NO: 4595166 - DNA, 15 bp, Homo sapiens
caaatttctaaatct

SEQ ID NO: 4595167 - DNA, 22 bp, Homo sapiens
caaatttctaaatctccaaaat

SEQ ID NO: 4595168 - DNA, 14 bp, Homo sapiens
caacaaagaacact

SEQ ID NO: 4595169 - DNA, 14 bp, Homo sapiens
caacaagctatttt

SEQ ID NO: 4595170 - DNA, 20 bp, Homo sapiens
caacagaagtcatgaagccc

SEQ ID NO: 4595171 - DNA, 13 bp, Homo sapiens
caacagatctgga

SEQ ID NO: 4595172 - DNA, 23 bp, Homo sapiens
caacagatctggaacctcagcct

SEQ ID NO: 4595173 - DNA, 16 bp, Homo sapiens
caacattgtagcctca

SEQ ID NO: 4595174 - DNA, 22 bp, Homo sapiens
caacatttctcatgttgaaact

SEQ ID NO: 4595175 - DNA, 13 bp, Homo sapiens
caaccaataaaag

SEQ ID NO: 4595176 - DNA, 14 bp, Homo sapiens
caaccatttgaaac

SEQ ID NO: 4595177 - DNA, 17 bp, Homo sapiens
caacccttccctcacct

SEQ ID NO: 4595178 - DNA, 17 bp, Homo sapiens
caacctgcaaagatctg

SEQ ID NO: 4595179 - DNA, 22 bp, Homo sapiens
caacctgttacctactttgact

SEQ ID NO: 4595180 - DNA, 19 bp, Homo sapiens
caactactacctgtaatga

SEQ ID NO: 4595181 - DNA, 14 bp, Homo sapiens
caactcgctttagg

SEQ ID NO: 4595182 - DNA, 18 bp, Homo sapiens
caactgcctactccaaaa

SEQ ID NO: 4595183 - DNA, 17 bp, Homo sapiens
caagaaatgaaagcagg

SEQ ID NO: 4595184 - DNA, 19 bp, Homo sapiens
caagaaatgaaagcaggga

SEQ ID NO: 4595185 - DNA, 17 bp, Homo sapiens
caagaataatcacgctt

SEQ ID NO: 4595186 - DNA, 20 bp, Homo sapiens
caagaataatcacgctttcc

SEQ ID NO: 4595187 - DNA, 22 bp, Homo sapiens
caagaataatcacgctttcctg

SEQ ID NO: 4595188 - DNA, 23 bp, Homo sapiens
caagaataatcacgctttcctga

SEQ ID NO: 4595189 - DNA, 17 bp, Homo sapiens
caagacatgtctgttct

SEQ ID NO: 4595190 - DNA, 17 bp, Homo sapiens
caagacctcagtgcctt

SEQ ID NO: 4595191 - DNA, 17 bp, Homo sapiens
caagcaacaagctattt

SEQ ID NO: 4595192 - DNA, 16 bp, Homo sapiens
caaggaaggaaagaaa

SEQ ID NO: 4595193 - DNA, 14 bp, Homo sapiens
caaggacttcctgt

SEQ ID NO: 4595194 - DNA, 22 bp, Homo sapiens
caaggacttcctgtccagctcc

SEQ ID NO: 4595195 - DNA, 16 bp, Homo sapiens
caaggagatttacaac

SEQ ID NO: 4595196 - DNA, 21 bp, Homo sapiens
caaggatagatgctggcccag

SEQ ID NO: 4595197 - DNA, 19 bp, Homo sapiens
caaggcgggagcatctctt

SEQ ID NO: 4595198 - DNA, 22 bp, Homo sapiens
caagtatgtgggcagattttca

SEQ ID NO: 4595199 - DNA, 18 bp, Homo sapiens
caagtcatagccataaat

SEQ ID NO: 4595200 - DNA, 16 bp, Homo sapiens
caagttagttcaatct

SEQ ID NO: 4595201 - DNA, 14 bp, Homo sapiens
caataaaagccaga

SEQ ID NO: 4595202 - DNA, 19 bp, Homo sapiens
caataaagcagcgtttcta

SEQ ID NO: 4595203 - DNA, 20 bp, Homo sapiens
caatctggattcatatttaa

SEQ ID NO: 4595204 - DNA, 12 bp, Homo sapiens
caatctgtaaac

SEQ ID NO: 4595205 - DNA, 15 bp, Homo sapiens
caatctgtaaactgt

SEQ ID NO: 4595206 - DNA, 13 bp, Homo sapiens
caatgaaatgaat

SEQ ID NO: 4595207 - DNA, 21 bp, Homo sapiens
caatgaaatgaattaaagtgg

SEQ ID NO: 4595208 - DNA, 19 bp, Homo sapiens
caatgagatcattgtgaag

SEQ ID NO: 4595209 - DNA, 21 bp, Homo sapiens
caatgtcaggaacagaaggat

SEQ ID NO: 4595210 - DNA, 22 bp, Homo sapiens
caatgtgacttaatgccactaa

SEQ ID NO: 4595211 - DNA, 15 bp, Homo sapiens
caattgtcacttttt

SEQ ID NO: 4595212 - DNA, 17 bp, Homo sapiens
caattgtcactttttat

SEQ ID NO: 4595213 - DNA, 11 bp, Homo sapiens
caatttcaagt

SEQ ID NO: 4595214 - DNA, 13 bp, Homo sapiens
cacaagaaatgaa

SEQ ID NO: 4595215 - DNA, 15 bp, Homo sapiens
cacaagaaatgaaag

SEQ ID NO: 4595216 - DNA, 18 bp, Homo sapiens
cacaagaaatgaaagcag

SEQ ID NO: 4595217 - DNA, 14 bp, Homo sapiens
cacaaggacttcct

SEQ ID NO: 4595218 - DNA, 22 bp, Homo sapiens
cacaaggacttcctgtccagct

SEQ ID NO: 4595219 - DNA, 17 bp, Homo sapiens
cacaaggatagatgctg

SEQ ID NO: 4595220 - DNA, 16 bp, Homo sapiens
cacacattttttaaat

SEQ ID NO: 4595221 - DNA, 19 bp, Homo sapiens
cacagaggacacagagaag

SEQ ID NO: 4595222 - DNA, 17 bp, Homo sapiens
cacagagttgttacatt

SEQ ID NO: 4595223 - DNA, 20 bp, Homo sapiens
cacagagttgttacattttt

SEQ ID NO: 4595224 - DNA, 22 bp, Homo sapiens
cacaggccgtcaccctgggagc

SEQ ID NO: 4595225 - DNA, 19 bp, Homo sapiens
cacagtgcagcaagcctgg

SEQ ID NO: 4595226 - DNA, 18 bp, Homo sapiens
cacatcagcacgatttct

SEQ ID NO: 4595227 - DNA, 22 bp, Homo sapiens
cacatcagcacgatttctgttt

SEQ ID NO: 4595228 - DNA, 19 bp, Homo sapiens
cacatgcaaggtcattttt

SEQ ID NO: 4595229 - DNA, 13 bp, Homo sapiens
cacattaaagtta

SEQ ID NO: 4595230 - DNA, 15 bp, Homo sapiens
cacattttattttat

SEQ ID NO: 4595231 - DNA, 14 bp, Homo sapiens
cacatttttcttag

SEQ ID NO: 4595232 - DNA, 16 bp, Homo sapiens
caccactacattctgt

SEQ ID NO: 4595233 - DNA, 18 bp, Homo sapiens
caccactacattctgtta

SEQ ID NO: 4595234 - DNA, 18 bp, Homo sapiens
caccactgcactccagcc

SEQ ID NO: 4595235 - DNA, 17 bp, Homo sapiens
caccagacacccaggac

SEQ ID NO: 4595236 - DNA, 20 bp, Homo sapiens
caccagacacccaggactta

SEQ ID NO: 4595237 - DNA, 21 bp, Homo sapiens
caccatattaccacagacata

SEQ ID NO: 4595238 - DNA, 20 bp, Homo sapiens
caccctgcctctacccaacc

SEQ ID NO: 4595239 - DNA, 16 bp, Homo sapiens
caccctggtgggccaa

SEQ ID NO: 4595240 - DNA, 18 bp, Homo sapiens
caccggtaccctcctccc

SEQ ID NO: 4595241 - DNA, 21 bp, Homo sapiens
cacctaatccaggcagatcca

SEQ ID NO: 4595242 - DNA, 21 bp, Homo sapiens
cacctacatgaggtactgaga

SEQ ID NO: 4595243 - DNA, 20 bp, Homo sapiens
cacctggaatatataaccag

SEQ ID NO: 4595244 - DNA, 17 bp, Homo sapiens
caccttggcaccagaca

SEQ ID NO: 4595245 - DNA, 16 bp, Homo sapiens
cacgatttctgtttag

SEQ ID NO: 4595246 - DNA, 14 bp, Homo sapiens
cacgctttcctgaa

SEQ ID NO: 4595247 - DNA, 14 bp, Homo sapiens
cacgtttctaaagg

SEQ ID NO: 4595248 - DNA, 21 bp, Homo sapiens
cactaaattgacacttaaaaa

SEQ ID NO: 4595249 - DNA, 16 bp, Homo sapiens
cactacattctgttaa

SEQ ID NO: 4595250 - DNA, 19 bp, Homo sapiens
cactagcccaatgaaatga

SEQ ID NO: 4595251 - DNA, 19 bp, Homo sapiens
cactcaggaggctgaggca

SEQ ID NO: 4595252 - DNA, 13 bp, Homo sapiens
cactccagcctga

SEQ ID NO: 4595253 - DNA, 23 bp, Homo sapiens
cactccagcctgagcgacagtga

SEQ ID NO: 4595254 - DNA, 16 bp, Homo sapiens
cactccagtgagacag

SEQ ID NO: 4595255 - DNA, 17 bp, Homo sapiens
cactctaccctatacaa

SEQ ID NO: 4595256 - DNA, 12 bp, Homo sapiens
cactgagaaaga

SEQ ID NO: 4595257 - DNA, 13 bp, Homo sapiens
cactgcttaactt

SEQ ID NO: 4595258 - DNA, 22 bp, Homo sapiens
cactggttcttcttggtctcag

SEQ ID NO: 4595259 - DNA, 18 bp, Homo sapiens
cactgtcctgggcctgca

SEQ ID NO: 4595260 - DNA, 15 bp, Homo sapiens
cacttaaaaatggtt

SEQ ID NO: 4595261 - DNA, 22 bp, Homo sapiens
cacttattggaactctgcttga

SEQ ID NO: 4595262 - DNA, 15 bp, Homo sapiens
cacttcataatccag

SEQ ID NO: 4595263 - DNA, 17 bp, Homo sapiens
cacttctaaatagcaat

SEQ ID NO: 4595264 - DNA, 16 bp, Homo sapiens
cacttctgggccctag

SEQ ID NO: 4595265 - DNA, 18 bp, Homo sapiens
cacttctgggcttcatct

SEQ ID NO: 4595266 - DNA, 20 bp, Homo sapiens
cactttaattaccaacctgt

SEQ ID NO: 4595267 - DNA, 14 bp, Homo sapiens
cactttttatgcta

SEQ ID NO: 4595268 - DNA, 18 bp, Homo sapiens
cagaaagcagaacagtga

SEQ ID NO: 4595269 - DNA, 15 bp, Homo sapiens
cagaaagctgcctgg

SEQ ID NO: 4595270 - DNA, 23 bp, Homo sapiens
cagaacagtgattaccagggact

SEQ ID NO: 4595271 - DNA, 22 bp, Homo sapiens
cagaactcaaatggggccagat

SEQ ID NO: 4595272 - DNA, 17 bp, Homo sapiens
cagaaggatgaatgagg

SEQ ID NO: 4595273 - DNA, 18 bp, Homo sapiens
cagaagtcatgaagccca

SEQ ID NO: 4595274 - DNA, 14 bp, Homo sapiens
cagacaacagaagt

SEQ ID NO: 4595275 - DNA, 16 bp, Homo sapiens
cagacaacagaagtca

SEQ ID NO: 4595276 - DNA, 14 bp, Homo sapiens
cagacacaggccct

SEQ ID NO: 4595277 - DNA, 15 bp, Homo sapiens
cagacacccaggact

SEQ ID NO: 4595278 - DNA, 16 bp, Homo sapiens
cagaccagcccttccc

SEQ ID NO: 4595279 - DNA, 17 bp, Homo sapiens
cagacctgatcctggag

SEQ ID NO: 4595280 - DNA, 14 bp, Homo sapiens
cagactcagacatt

SEQ ID NO: 4595281 - DNA, 14 bp, Homo sapiens
cagactcccattcc

SEQ ID NO: 4595282 - DNA, 17 bp, Homo sapiens
cagactcccattcctga

SEQ ID NO: 4595283 - DNA, 19 bp, Homo sapiens
cagactcccattcctgaag

SEQ ID NO: 4595284 - DNA, 19 bp, Homo sapiens
cagagaaaggggagcccac

SEQ ID NO: 4595285 - DNA, 14 bp, Homo sapiens
cagaggccatggca

SEQ ID NO: 4595286 - DNA, 14 bp, Homo sapiens
cagaggccccagcc

SEQ ID NO: 4595287 - DNA, 20 bp, Homo sapiens
cagagtctggtgaagctcac

SEQ ID NO: 4595288 - DNA, 15 bp, Homo sapiens
cagagttgttacatt

SEQ ID NO: 4595289 - DNA, 14 bp, Homo sapiens
cagataaacagtag

SEQ ID NO: 4595290 - DNA, 12 bp, Homo sapiens
cagatccagcct

SEQ ID NO: 4595291 - DNA, 13 bp, Homo sapiens
cagatccagcctg

SEQ ID NO: 4595292 - DNA, 18 bp, Homo sapiens
cagatccagcctggggtc

SEQ ID NO: 4595293 - DNA, 13 bp, Homo sapiens
cagatccaggact

SEQ ID NO: 4595294 - DNA, 18 bp, Homo sapiens
cagatctggaacctcagc

SEQ ID NO: 4595295 - DNA, 18 bp, Homo sapiens
cagatgctagagcctctg

SEQ ID NO: 4595296 - DNA, 20 bp, Homo sapiens
cagatgctagagcctctgcc

SEQ ID NO: 4595297 - DNA, 19 bp, Homo sapiens
cagattttcagcaaactct

SEQ ID NO: 4595298 - DNA, 20 bp, Homo sapiens
cagcaaactcttttcccact

SEQ ID NO: 4595299 - DNA, 13 bp, Homo sapiens
cagcaataaagca

SEQ ID NO: 4595300 - DNA, 21 bp, Homo sapiens
cagcaataaagcagcgtttct

SEQ ID NO: 4595301 - DNA, 14 bp, Homo sapiens
cagcacgatttctg

SEQ ID NO: 4595302 - DNA, 15 bp, Homo sapiens
cagcacgatttctgt

SEQ ID NO: 4595303 - DNA, 18 bp, Homo sapiens
cagcacgatttctgttta

SEQ ID NO: 4595304 - DNA, 16 bp, Homo sapiens
cagccaaacccatgag

SEQ ID NO: 4595305 - DNA, 13 bp, Homo sapiens
cagccagtaaatg

SEQ ID NO: 4595306 - DNA, 11 bp, Homo sapiens
cagcccagaga

SEQ ID NO: 4595307 - DNA, 21 bp, Homo sapiens
cagcccagagacatacttgaa

SEQ ID NO: 4595308 - DNA, 22 bp, Homo sapiens
cagcccagagacatacttgaag

SEQ ID NO: 4595309 - DNA, 19 bp, Homo sapiens
cagccccgtggggttcctc

SEQ ID NO: 4595310 - DNA, 18 bp, Homo sapiens
cagcccttccccatcctg

SEQ ID NO: 4595311 - DNA, 14 bp, Homo sapiens
cagccgcttctgac

SEQ ID NO: 4595312 - DNA, 14 bp, Homo sapiens
cagcctccctgaag

SEQ ID NO: 4595313 - DNA, 18 bp, Homo sapiens
cagcctggccagacacag

SEQ ID NO: 4595314 - DNA, 19 bp, Homo sapiens
cagcctgggcaacagagca

SEQ ID NO: 4595315 - DNA, 23 bp, Homo sapiens
cagcctgggggctgggaggatcc

SEQ ID NO: 4595316 - DNA, 15 bp, Homo sapiens
cagcctggggtctgg

SEQ ID NO: 4595317 - DNA, 14 bp, Homo sapiens
cagccttgccagag

SEQ ID NO: 4595318 - DNA, 13 bp, Homo sapiens
cagctaagaacct

SEQ ID NO: 4595319 - DNA, 18 bp, Homo sapiens
cagctaagaacctggaac

SEQ ID NO: 4595320 - DNA, 23 bp, Homo sapiens
cagctaagaacctggaacttggg

SEQ ID NO: 4595321 - DNA, 19 bp, Homo sapiens
cagctacttgggaggctga

SEQ ID NO: 4595322 - DNA, 13 bp, Homo sapiens
cagctcaggacag

SEQ ID NO: 4595323 - DNA, 16 bp, Homo sapiens
cagctcaggacagatg

SEQ ID NO: 4595324 - DNA, 18 bp, Homo sapiens
cagctcaggacagatgcc

SEQ ID NO: 4595325 - DNA, 22 bp, Homo sapiens
cagctcaggacagatgccacac

SEQ ID NO: 4595326 - DNA, 18 bp, Homo sapiens
cagctcagtcccatcaga

SEQ ID NO: 4595327 - DNA, 14 bp, Homo sapiens
cagctccaacctgc

SEQ ID NO: 4595328 - DNA, 19 bp, Homo sapiens
cagctccctaggagaccaa

SEQ ID NO: 4595329 - DNA, 18 bp, Homo sapiens
cagctctggacagcccca

SEQ ID NO: 4595330 - DNA, 22 bp, Homo sapiens
cagcttcgtttattttcaagaa

SEQ ID NO: 4595331 - DNA, 17 bp, Homo sapiens
cagctttccctgcctct

SEQ ID NO: 4595332 - DNA, 19 bp, Homo sapiens
cagctttccctgcctctca

SEQ ID NO: 4595333 - DNA, 20 bp, Homo sapiens
caggaatttcccaggaccct

SEQ ID NO: 4595334 - DNA, 13 bp, Homo sapiens
caggaccagctca

SEQ ID NO: 4595335 - DNA, 16 bp, Homo sapiens
caggaccagctcagga

SEQ ID NO: 4595336 - DNA, 17 bp, Homo sapiens
caggaccagctcaggac

SEQ ID NO: 4595337 - DNA, 18 bp, Homo sapiens
caggaggctgaggcagga

SEQ ID NO: 4595338 - DNA, 23 bp, Homo sapiens
caggatatcacattggagtcact

SEQ ID NO: 4595339 - DNA, 14 bp, Homo sapiens
caggcagatccagg

SEQ ID NO: 4595340 - DNA, 17 bp, Homo sapiens
caggcagatccaggact

SEQ ID NO: 4595341 - DNA, 18 bp, Homo sapiens
caggcagatccaggacta

SEQ ID NO: 4595342 - DNA, 21 bp, Homo sapiens
caggctgagggtcgtgggaaa

SEQ ID NO: 4595343 - DNA, 14 bp, Homo sapiens
caggcttccacact

SEQ ID NO: 4595344 - DNA, 19 bp, Homo sapiens
caggcttccacacttctgg

SEQ ID NO: 4595345 - DNA, 21 bp, Homo sapiens
caggcttccacacttctgggc

SEQ ID NO: 4595346 - DNA, 18 bp, Homo sapiens
cagggacagaggccccag

SEQ ID NO: 4595347 - DNA, 21 bp, Homo sapiens
cagggacagaggccccagcct

SEQ ID NO: 4595348 - DNA, 20 bp, Homo sapiens
cagggacctaaagggactac

SEQ ID NO: 4595349 - DNA, 13 bp, Homo sapiens
cagggcccagagc

SEQ ID NO: 4595350 - DNA, 15 bp, Homo sapiens
cagtaaagcacttgc

SEQ ID NO: 4595351 - DNA, 21 bp, Homo sapiens
cagtaaatgggggtgcatttg

SEQ ID NO: 4595352 - DNA, 12 bp, Homo sapiens
cagtagtgatag

SEQ ID NO: 4595353 - DNA, 19 bp, Homo sapiens
cagtcccatcagagagcga

SEQ ID NO: 4595354 - DNA, 20 bp, Homo sapiens
cagtccccccaccctcattc

SEQ ID NO: 4595355 - DNA, 17 bp, Homo sapiens
cagtcttcctgacactt

SEQ ID NO: 4595356 - DNA, 21 bp, Homo sapiens
cagtcttcctgacactttaat

SEQ ID NO: 4595357 - DNA, 15 bp, Homo sapiens
cagtcttgaatttct

SEQ ID NO: 4595358 - DNA, 19 bp, Homo sapiens
cagtgcagcaagcctggcc

SEQ ID NO: 4595359 - DNA, 12 bp, Homo sapiens
cagtgcccccac

SEQ ID NO: 4595360 - DNA, 15 bp, Homo sapiens
cagtgcccccactga

SEQ ID NO: 4595361 - DNA, 22 bp, Homo sapiens
cagtgcccccactgaccagaac

SEQ ID NO: 4595362 - DNA, 22 bp, Homo sapiens
cagtgccttcctgtttttcaca

SEQ ID NO: 4595363 - DNA, 22 bp, Homo sapiens
cagtggccaagatcacagtggc

SEQ ID NO: 4595364 - DNA, 23 bp, Homo sapiens
cagtggccaagatcacagtggcc

SEQ ID NO: 4595365 - DNA, 20 bp, Homo sapiens
cagtggtggttttctgttct

SEQ ID NO: 4595366 - DNA, 14 bp, Homo sapiens
cagtgtcaatgcag

SEQ ID NO: 4595367 - DNA, 20 bp, Homo sapiens
cagttcaggagtcccaagga

SEQ ID NO: 4595368 - DNA, 16 bp, Homo sapiens
cagttctttgggccag

SEQ ID NO: 4595369 - DNA, 17 bp, Homo sapiens
cagttctttgggccaga

SEQ ID NO: 4595370 - DNA, 18 bp, Homo sapiens
cagttctttgggccagac

SEQ ID NO: 4595371 - DNA, 20 bp, Homo sapiens
cagttctttgggccagacat

SEQ ID NO: 4595372 - DNA, 21 bp, Homo sapiens
cagttctttgggccagacatg

SEQ ID NO: 4595373 - DNA, 21 bp, Homo sapiens
cagttggagggaaagccagcc

SEQ ID NO: 4595374 - DNA, 19 bp, Homo sapiens
cagttgttatttattgaaa

SEQ ID NO: 4595375 - DNA, 11 bp, Homo sapiens
cataactgaaa

SEQ ID NO: 4595376 - DNA, 14 bp, Homo sapiens
cataactgaaaatg

SEQ ID NO: 4595377 - DNA, 13 bp, Homo sapiens
cataatcttctgc

SEQ ID NO: 4595378 - DNA, 13 bp, Homo sapiens
cataccacttttg

SEQ ID NO: 4595379 - DNA, 18 bp, Homo sapiens
catacgtacacattttat

SEQ ID NO: 4595380 - DNA, 14 bp, Homo sapiens
catactaaccagca

SEQ ID NO: 4595381 - DNA, 14 bp, Homo sapiens
catacttgaagggc

SEQ ID NO: 4595382 - DNA, 22 bp, Homo sapiens
catacttgaagggccagagcca

SEQ ID NO: 4595383 - DNA, 16 bp, Homo sapiens
catactttttaaatgt

SEQ ID NO: 4595384 - DNA, 22 bp, Homo sapiens
catactttttaaatgtaaagat

SEQ ID NO: 4595385 - DNA, 13 bp, Homo sapiens
catagccataaat

SEQ ID NO: 4595386 - DNA, 17 bp, Homo sapiens
catagccataaatgatg

SEQ ID NO: 4595387 - DNA, 18 bp, Homo sapiens
catattgtgattctgcct

SEQ ID NO: 4595388 - DNA, 16 bp, Homo sapiens
catattgttgaaaggt

SEQ ID NO: 4595389 - DNA, 18 bp, Homo sapiens
catcaatgaatgaatgaa

SEQ ID NO: 4595390 - DNA, 17 bp, Homo sapiens
catcagcacgatttctg

SEQ ID NO: 4595391 - DNA, 19 bp, Homo sapiens
catcatagtttgctttgtt

SEQ ID NO: 4595392 - DNA, 15 bp, Homo sapiens
catcatgccacaccg

SEQ ID NO: 4595393 - DNA, 12 bp, Homo sapiens
catccctttggt

SEQ ID NO: 4595394 - DNA, 13 bp, Homo sapiens
catccctttggtt

SEQ ID NO: 4595395 - DNA, 16 bp, Homo sapiens
catctctctgcccaac

SEQ ID NO: 4595396 - DNA, 20 bp, Homo sapiens
catctggcaacatctttatc

SEQ ID NO: 4595397 - DNA, 18 bp, Homo sapiens
catgaagatgtagaggag

SEQ ID NO: 4595398 - DNA, 22 bp, Homo sapiens
catgacccccacccctctgcca

SEQ ID NO: 4595399 - DNA, 15 bp, Homo sapiens
catgcaaggtcattt

SEQ ID NO: 4595400 - DNA, 17 bp, Homo sapiens
catgcaaggtcattttt

SEQ ID NO: 4595401 - DNA, 13 bp, Homo sapiens
catgcactgtgaa

SEQ ID NO: 4595402 - DNA, 17 bp, Homo sapiens
catgcatgtcctgtaaa

SEQ ID NO: 4595403 - DNA, 17 bp, Homo sapiens
catgccacaaggacttc

SEQ ID NO: 4595404 - DNA, 21 bp, Homo sapiens
catgccacaaggacttcctgt

SEQ ID NO: 4595405 - DNA, 23 bp, Homo sapiens
catgctacacactgcatgtttgt

SEQ ID NO: 4595406 - DNA, 20 bp, Homo sapiens
catggtgccccaggaccagc

SEQ ID NO: 4595407 - DNA, 14 bp, Homo sapiens
cattaaactttttt

SEQ ID NO: 4595408 - DNA, 15 bp, Homo sapiens
cattaggatggctag

SEQ ID NO: 4595409 - DNA, 12 bp, Homo sapiens
cattatctagat

SEQ ID NO: 4595410 - DNA, 14 bp, Homo sapiens
cattatgttaatat

SEQ ID NO: 4595411 - DNA, 13 bp, Homo sapiens
cattcaatgttta

SEQ ID NO: 4595412 - DNA, 13 bp, Homo sapiens
cattcatctcatt

SEQ ID NO: 4595413 - DNA, 20 bp, Homo sapiens
cattctccttgtgttactaa

SEQ ID NO: 4595414 - DNA, 17 bp, Homo sapiens
cattctgttaatcatta

SEQ ID NO: 4595415 - DNA, 13 bp, Homo sapiens
cattctttttgaa

SEQ ID NO: 4595416 - DNA, 16 bp, Homo sapiens
cattctttttgaaatg

SEQ ID NO: 4595417 - DNA, 13 bp, Homo sapiens
catttaaaacaga

SEQ ID NO: 4595418 - DNA, 16 bp, Homo sapiens
catttctcatgttgaa

SEQ ID NO: 4595419 - DNA, 17 bp, Homo sapiens
catttgaggtctgttct

SEQ ID NO: 4595420 - DNA, 22 bp, Homo sapiens
catttgaggtctgttctttcca

SEQ ID NO: 4595421 - DNA, 21 bp, Homo sapiens
catttggtggtttcagaaatg

SEQ ID NO: 4595422 - DNA, 22 bp, Homo sapiens
cattttattttattatgcatga

SEQ ID NO: 4595423 - DNA, 23 bp, Homo sapiens
cattttattttattatgcatgaa

SEQ ID NO: 4595424 - DNA, 20 bp, Homo sapiens
cattttggagagtttcctga

SEQ ID NO: 4595425 - DNA, 12 bp, Homo sapiens
cattttgtaata

SEQ ID NO: 4595426 - DNA, 13 bp, Homo sapiens
cattttgtaataa

SEQ ID NO: 4595427 - DNA, 15 bp, Homo sapiens
catttttaagtgctg

SEQ ID NO: 4595428 - DNA, 15 bp, Homo sapiens
cattttttaaatgca

SEQ ID NO: 4595429 - DNA, 19 bp, Homo sapiens
cattttttaaatgcacctg

SEQ ID NO: 4595430 - DNA, 22 bp, Homo sapiens
cattttttttaagaaaaaggat

SEQ ID NO: 4595431 - DNA, 23 bp, Homo sapiens
ccaaaagattgctgaaattttat

SEQ ID NO: 4595432 - DNA, 15 bp, Homo sapiens
ccaaaagctttttat

SEQ ID NO: 4595433 - DNA, 20 bp, Homo sapiens
ccaaaatgttggtcatttta

SEQ ID NO: 4595434 - DNA, 21 bp, Homo sapiens
ccaaaatgttggtcattttat

SEQ ID NO: 4595435 - DNA, 19 bp, Homo sapiens
ccaacctgcaaagatctgt

SEQ ID NO: 4595436 - DNA, 19 bp, Homo sapiens
ccaaggctgattaaaccaa

SEQ ID NO: 4595437 - DNA, 19 bp, Homo sapiens
ccaaggggaatcagaactc

SEQ ID NO: 4595438 - DNA, 15 bp, Homo sapiens
ccaataaaagccaga

SEQ ID NO: 4595439 - DNA, 16 bp, Homo sapiens
ccaatattcatagcag

SEQ ID NO: 4595440 - DNA, 18 bp, Homo sapiens
ccaattaatgaagttgat

SEQ ID NO: 4595441 - DNA, 23 bp, Homo sapiens
ccaattttttaagtgaaaatata

SEQ ID NO: 4595442 - DNA, 16 bp, Homo sapiens
ccacaagaaatgaaag

SEQ ID NO: 4595443 - DNA, 16 bp, Homo sapiens
ccacaccggtaccctc

SEQ ID NO: 4595444 - DNA, 14 bp, Homo sapiens
ccacacttctgggc

SEQ ID NO: 4595445 - DNA, 13 bp, Homo sapiens
ccacagaggacac

SEQ ID NO: 4595446 - DNA, 15 bp, Homo sapiens
ccactacattctgtt

SEQ ID NO: 4595447 - DNA, 13 bp, Homo sapiens
ccactgcagaaga

SEQ ID NO: 4595448 - DNA, 15 bp, Homo sapiens
ccactggttcttctt

SEQ ID NO: 4595449 - DNA, 21 bp, Homo sapiens
ccactgtcctgggcctgcaga

SEQ ID NO: 4595450 - DNA, 15 bp, Homo sapiens
ccacttttgttcttg

SEQ ID NO: 4595451 - DNA, 14 bp, Homo sapiens
ccagacacaggccc

SEQ ID NO: 4595452 - DNA, 19 bp, Homo sapiens
ccagacacaggccctccct

SEQ ID NO: 4595453 - DNA, 14 bp, Homo sapiens
ccagacacccagga

SEQ ID NO: 4595454 - DNA, 15 bp, Homo sapiens
ccagacacccaggac

SEQ ID NO: 4595455 - DNA, 16 bp, Homo sapiens
ccagacacccaggact

SEQ ID NO: 4595456 - DNA, 20 bp, Homo sapiens
ccagacatgccacaaggact

SEQ ID NO: 4595457 - DNA, 20 bp, Homo sapiens
ccagacctgatcctggaggc

SEQ ID NO: 4595458 - DNA, 18 bp, Homo sapiens
ccagagacatacttgaag

SEQ ID NO: 4595459 - DNA, 11 bp, Homo sapiens
ccagagcccag

SEQ ID NO: 4595460 - DNA, 13 bp, Homo sapiens
ccagagcccagct

SEQ ID NO: 4595461 - DNA, 17 bp, Homo sapiens
ccagagcccagctccaa

SEQ ID NO: 4595462 - DNA, 13 bp, Homo sapiens
ccagatccagcct

SEQ ID NO: 4595463 - DNA, 17 bp, Homo sapiens
ccagatgctagagcctc

SEQ ID NO: 4595464 - DNA, 12 bp, Homo sapiens
ccagcactaacg

SEQ ID NO: 4595465 - DNA, 22 bp, Homo sapiens
ccagcagaaatgccttaccctc

SEQ ID NO: 4595466 - DNA, 11 bp, Homo sapiens
ccagcccagag

SEQ ID NO: 4595467 - DNA, 22 bp, Homo sapiens
ccagcccagagacatacttgaa

SEQ ID NO: 4595468 - DNA, 17 bp, Homo sapiens
ccagcctgggggctggg

SEQ ID NO: 4595469 - DNA, 15 bp, Homo sapiens
ccagctaagaacctg

SEQ ID NO: 4595470 - DNA, 18 bp, Homo sapiens
ccagctaagaacctggaa

SEQ ID NO: 4595471 - DNA, 20 bp, Homo sapiens
ccagctcaggacagatgcca

SEQ ID NO: 4595472 - DNA, 23 bp, Homo sapiens
ccagctcaggacagatgccacac

SEQ ID NO: 4595473 - DNA, 22 bp, Homo sapiens
ccagctcagtcccatcagagag

SEQ ID NO: 4595474 - DNA, 14 bp, Homo sapiens
ccagctccctagga

SEQ ID NO: 4595475 - DNA, 16 bp, Homo sapiens
ccagcttatctcctcc

SEQ ID NO: 4595476 - DNA, 14 bp, Homo sapiens
ccagctttccctgc

SEQ ID NO: 4595477 - DNA, 18 bp, Homo sapiens
ccagctttccctgcctct

SEQ ID NO: 4595478 - DNA, 17 bp, Homo sapiens
ccaggaatttcccagga

SEQ ID NO: 4595479 - DNA, 19 bp, Homo sapiens
ccaggaatttcccaggacc

SEQ ID NO: 4595480 - DNA, 21 bp, Homo sapiens
ccaggaatttcccaggaccct

SEQ ID NO: 4595481 - DNA, 22 bp, Homo sapiens
ccaggaatttcccaggaccctg

SEQ ID NO: 4595482 - DNA, 19 bp, Homo sapiens
ccaggaccctgaaggggcc

SEQ ID NO: 4595483 - DNA, 20 bp, Homo sapiens
ccaggactatatttgggcct

SEQ ID NO: 4595484 - DNA, 21 bp, Homo sapiens
ccaggacttatttaaactctg

SEQ ID NO: 4595485 - DNA, 18 bp, Homo sapiens
ccaggcagatccaggact

SEQ ID NO: 4595486 - DNA, 22 bp, Homo sapiens
ccaggcttccacacttctgggc

SEQ ID NO: 4595487 - DNA, 20 bp, Homo sapiens
ccagggacagaggccccagc

SEQ ID NO: 4595488 - DNA, 14 bp, Homo sapiens
ccagggagaagctc

SEQ ID NO: 4595489 - DNA, 14 bp, Homo sapiens
ccagggcccagagc

SEQ ID NO: 4595490 - DNA, 21 bp, Homo sapiens
ccagggcccagagcccagctc

SEQ ID NO: 4595491 - DNA, 15 bp, Homo sapiens
ccaggttccacagag

SEQ ID NO: 4595492 - DNA, 18 bp, Homo sapiens
ccaggttccacagaggac

SEQ ID NO: 4595493 - DNA, 22 bp, Homo sapiens
ccagtaaatgggggtgcatttg

SEQ ID NO: 4595494 - DNA, 21 bp, Homo sapiens
ccagtcattatgttaatattt

SEQ ID NO: 4595495 - DNA, 22 bp, Homo sapiens
ccagtcattatgttaatatttc

SEQ ID NO: 4595496 - DNA, 17 bp, Homo sapiens
ccagtcttcctgacact

SEQ ID NO: 4595497 - DNA, 22 bp, Homo sapiens
ccagtcttcctgacactttaat

SEQ ID NO: 4595498 - DNA, 16 bp, Homo sapiens
ccagtgcccccactga

SEQ ID NO: 4595499 - DNA, 18 bp, Homo sapiens
ccagtgcccccactgacc

SEQ ID NO: 4595500 - DNA, 14 bp, Homo sapiens
ccagttcaggagtc

SEQ ID NO: 4595501 - DNA, 19 bp, Homo sapiens
ccatattaccacagacata

SEQ ID NO: 4595502 - DNA, 16 bp, Homo sapiens
ccatcatgccacaccg

SEQ ID NO: 4595503 - DNA, 21 bp, Homo sapiens
ccatgatggcaacagatctgg

SEQ ID NO: 4595504 - DNA, 20 bp, Homo sapiens
ccatggtcggaaaacatgct

SEQ ID NO: 4595505 - DNA, 15 bp, Homo sapiens
cccaatttcagactc

SEQ ID NO: 4595506 - DNA, 13 bp, Homo sapiens
cccacaagaaatg

SEQ ID NO: 4595507 - DNA, 20 bp, Homo sapiens
cccacaagaaatgaaagcag

SEQ ID NO: 4595508 - DNA, 14 bp, Homo sapiens
cccactgaccagaa

SEQ ID NO: 4595509 - DNA, 15 bp, Homo sapiens
cccactgtcctgggc

SEQ ID NO: 4595510 - DNA, 16 bp, Homo sapiens
cccactgtcctgggcc

SEQ ID NO: 4595511 - DNA, 12 bp, Homo sapiens
cccagactcaga

SEQ ID NO: 4595512 - DNA, 21 bp, Homo sapiens
cccagagacatacttgaaggg

SEQ ID NO: 4595513 - DNA, 22 bp, Homo sapiens
cccagagacatacttgaagggc

SEQ ID NO: 4595514 - DNA, 13 bp, Homo sapiens
cccagagcccagc

SEQ ID NO: 4595515 - DNA, 17 bp, Homo sapiens
cccagagcccagctcca

SEQ ID NO: 4595516 - DNA, 11 bp, Homo sapiens
cccagcccaga

SEQ ID NO: 4595517 - DNA, 15 bp, Homo sapiens
cccagcccagagaca

SEQ ID NO: 4595518 - DNA, 16 bp, Homo sapiens
cccagcctccctgaag

SEQ ID NO: 4595519 - DNA, 16 bp, Homo sapiens
cccagctaagaacctg

SEQ ID NO: 4595520 - DNA, 20 bp, Homo sapiens
cccagctaagaacctggaac

SEQ ID NO: 4595521 - DNA, 15 bp, Homo sapiens
cccagctctactcca

SEQ ID NO: 4595522 - DNA, 20 bp, Homo sapiens
cccaggaccagctcaggaca

SEQ ID NO: 4595523 - DNA, 21 bp, Homo sapiens
cccaggaccagctcaggacag

SEQ ID NO: 4595524 - DNA, 23 bp, Homo sapiens
cccaggaccctgaaggggccatg

SEQ ID NO: 4595525 - DNA, 15 bp, Homo sapiens
cccagggcccagagc

SEQ ID NO: 4595526 - DNA, 16 bp, Homo sapiens
cccagggcccagagcc

SEQ ID NO: 4595527 - DNA, 17 bp, Homo sapiens
cccagggcccagagccc

SEQ ID NO: 4595528 - DNA, 22 bp, Homo sapiens
cccagggcccagagcccagctc

SEQ ID NO: 4595529 - DNA, 22 bp, Homo sapiens
cccagtgcccccactgaccaga

SEQ ID NO: 4595530 - DNA, 14 bp, Homo sapiens
cccagttcaccctg

SEQ ID NO: 4595531 - DNA, 14 bp, Homo sapiens
cccatgcactgtga

SEQ ID NO: 4595532 - DNA, 22 bp, Homo sapiens
cccatgcactgtgaaggaccct

SEQ ID NO: 4595533 - DNA, 12 bp, Homo sapiens
cccattcctgaa

SEQ ID NO: 4595534 - DNA, 18 bp, Homo sapiens
cccattcctgaagaacca

SEQ ID NO: 4595535 - DNA, 14 bp, Homo sapiens
ccccactgaccaga

SEQ ID NO: 4595536 - DNA, 15 bp, Homo sapiens
ccccagcccagagac

SEQ ID NO: 4595537 - DNA, 16 bp, Homo sapiens
ccccagcccagagaca

SEQ ID NO: 4595538 - DNA, 13 bp, Homo sapiens
ccccagcctccct

SEQ ID NO: 4595539 - DNA, 15 bp, Homo sapiens
ccccagcctccctga

SEQ ID NO: 4595540 - DNA, 19 bp, Homo sapiens
ccccagctaagaacctgga

SEQ ID NO: 4595541 - DNA, 21 bp, Homo sapiens
ccccagctaagaacctggaac

SEQ ID NO: 4595542 - DNA, 15 bp, Homo sapiens
ccccaggaccagctc

SEQ ID NO: 4595543 - DNA, 23 bp, Homo sapiens
ccccatgcactgtgaaggaccct

SEQ ID NO: 4595544 - DNA, 21 bp, Homo sapiens
cccccagctaagaacctggaa

SEQ ID NO: 4595545 - DNA, 18 bp, Homo sapiens
cccccatgcactgtgaag

SEQ ID NO: 4595546 - DNA, 14 bp, Homo sapiens
ccccccatgcactg

SEQ ID NO: 4595547 - DNA, 15 bp, Homo sapiens
cccctgtaggcctca

SEQ ID NO: 4595548 - DNA, 16 bp, Homo sapiens
cccgactgaccactgg

SEQ ID NO: 4595549 - DNA, 15 bp, Homo sapiens
cccgtggggttcctc

SEQ ID NO: 4595550 - DNA, 13 bp, Homo sapiens
ccctaaagcctca

SEQ ID NO: 4595551 - DNA, 17 bp, Homo sapiens
ccctaaagtgtattttt

SEQ ID NO: 4595552 - DNA, 20 bp, Homo sapiens
ccctcaccttggcaccagac

SEQ ID NO: 4595553 - DNA, 14 bp, Homo sapiens
ccctccccctgcca

SEQ ID NO: 4595554 - DNA, 19 bp, Homo sapiens
ccctccctgttccccagag

SEQ ID NO: 4595555 - DNA, 13 bp, Homo sapiens
ccctctcacccag

SEQ ID NO: 4595556 - DNA, 23 bp, Homo sapiens
ccctgactaaactaccacctcag

SEQ ID NO: 4595557 - DNA, 12 bp, Homo sapiens
ccctgcctctca

SEQ ID NO: 4595558 - DNA, 23 bp, Homo sapiens
ccctggtgggccaacaaagaaca

SEQ ID NO: 4595559 - DNA, 16 bp, Homo sapiens
ccctgttccccagaga

SEQ ID NO: 4595560 - DNA, 16 bp, Homo sapiens
cccttccccatcctgg

SEQ ID NO: 4595561 - DNA, 14 bp, Homo sapiens
cccttggacatttt

SEQ ID NO: 4595562 - DNA, 17 bp, Homo sapiens
ccctttgcccagaaaga

SEQ ID NO: 4595563 - DNA, 13 bp, Homo sapiens
ccgacccagctct

SEQ ID NO: 4595564 - DNA, 23 bp, Homo sapiens
ccgcgctgtgtaaatgctccagc

SEQ ID NO: 4595565 - DNA, 22 bp, Homo sapiens
ccgggaggcagaggttgcagtg

SEQ ID NO: 4595566 - DNA, 13 bp, Homo sapiens
cctaaagcctcaa

SEQ ID NO: 4595567 - DNA, 19 bp, Homo sapiens
cctaaagcctcaaaacaaa

SEQ ID NO: 4595568 - DNA, 13 bp, Homo sapiens
cctaatccaggca

SEQ ID NO: 4595569 - DNA, 15 bp, Homo sapiens
cctaatccaggcaga

SEQ ID NO: 4595570 - DNA, 20 bp, Homo sapiens
cctaatccaggcagatccag

SEQ ID NO: 4595571 - DNA, 12 bp, Homo sapiens
cctaatgtgttt

SEQ ID NO: 4595572 - DNA, 18 bp, Homo sapiens
cctacccctttctccagc

SEQ ID NO: 4595573 - DNA, 19 bp, Homo sapiens
cctacccctttctccagcc

SEQ ID NO: 4595574 - DNA, 16 bp, Homo sapiens
cctactccaaaatgtt

SEQ ID NO: 4595575 - DNA, 19 bp, Homo sapiens
cctactgtaatttgtgata

SEQ ID NO: 4595576 - DNA, 14 bp, Homo sapiens
cctactttgacttt

SEQ ID NO: 4595577 - DNA, 21 bp, Homo sapiens
cctactttgactttttgcatt

SEQ ID NO: 4595578 - DNA, 12 bp, Homo sapiens
cctagttttcca

SEQ ID NO: 4595579 - DNA, 14 bp, Homo sapiens
cctatatgtagtat

SEQ ID NO: 4595580 - DNA, 20 bp, Homo sapiens
cctatcagagttgctgcaaa

SEQ ID NO: 4595581 - DNA, 17 bp, Homo sapiens
cctatgatattttctgt

SEQ ID NO: 4595582 - DNA, 15 bp, Homo sapiens
cctcaccttggcacc

SEQ ID NO: 4595583 - DNA, 14 bp, Homo sapiens
cctcagcctggcca

SEQ ID NO: 4595584 - DNA, 16 bp, Homo sapiens
cctcagcctggccaga

SEQ ID NO: 4595585 - DNA, 20 bp, Homo sapiens
cctcagcctggccagacaca

SEQ ID NO: 4595586 - DNA, 21 bp, Homo sapiens
cctcagcctggccagacacag

SEQ ID NO: 4595587 - DNA, 22 bp, Homo sapiens
cctcagcctggccagacacagg

SEQ ID NO: 4595588 - DNA, 17 bp, Homo sapiens
cctcagccttgccagag

SEQ ID NO: 4595589 - DNA, 19 bp, Homo sapiens
cctcatctctctgcccaac

SEQ ID NO: 4595590 - DNA, 20 bp, Homo sapiens
cctccaaggaggggctgtaa

SEQ ID NO: 4595591 - DNA, 20 bp, Homo sapiens
cctcccaatttcagactccc

SEQ ID NO: 4595592 - DNA, 17 bp, Homo sapiens
cctcccccccatgcact

SEQ ID NO: 4595593 - DNA, 13 bp, Homo sapiens
cctccccctgcca

SEQ ID NO: 4595594 - DNA, 16 bp, Homo sapiens
cctcccgactgaccac

SEQ ID NO: 4595595 - DNA, 20 bp, Homo sapiens
cctccctgttccccagagaa

SEQ ID NO: 4595596 - DNA, 15 bp, Homo sapiens
cctccgcgctgtgta

SEQ ID NO: 4595597 - DNA, 20 bp, Homo sapiens
cctcctccgcgctgtgtaaa

SEQ ID NO: 4595598 - DNA, 12 bp, Homo sapiens
cctctcacccag

SEQ ID NO: 4595599 - DNA, 16 bp, Homo sapiens
cctctcacccagaatc

SEQ ID NO: 4595600 - DNA, 14 bp, Homo sapiens
cctctccccagccc

SEQ ID NO: 4595601 - DNA, 19 bp, Homo sapiens
cctctgcctgacagcatcc

SEQ ID NO: 4595602 - DNA, 13 bp, Homo sapiens
cctcttgagcctt

SEQ ID NO: 4595603 - DNA, 12 bp, Homo sapiens
cctctttaagag

SEQ ID NO: 4595604 - DNA, 15 bp, Homo sapiens
cctgaaacaacttgg

SEQ ID NO: 4595605 - DNA, 18 bp, Homo sapiens
cctgaaagaggaatgaag

SEQ ID NO: 4595606 - DNA, 23 bp, Homo sapiens
cctgaaagaggaatgaagtactc

SEQ ID NO: 4595607 - DNA, 16 bp, Homo sapiens
cctgaagaaccagtcc

SEQ ID NO: 4595608 - DNA, 15 bp, Homo sapiens
cctgacactttaatt

SEQ ID NO: 4595609 - DNA, 15 bp, Homo sapiens
cctgacccctgctca

SEQ ID NO: 4595610 - DNA, 16 bp, Homo sapiens
cctgactaaactacca

SEQ ID NO: 4595611 - DNA, 19 bp, Homo sapiens
cctgactaaactaccacct

SEQ ID NO: 4595612 - DNA, 13 bp, Homo sapiens
cctgatcctggag

SEQ ID NO: 4595613 - DNA, 18 bp, Homo sapiens
cctgatcctggaggccca

SEQ ID NO: 4595614 - DNA, 18 bp, Homo sapiens
cctgatttaggagaagcc

SEQ ID NO: 4595615 - DNA, 21 bp, Homo sapiens
cctgcactaatttgatgttta

SEQ ID NO: 4595616 - DNA, 12 bp, Homo sapiens
cctgccagctgc

SEQ ID NO: 4595617 - DNA, 14 bp, Homo sapiens
cctgccagctgcac

SEQ ID NO: 4595618 - DNA, 16 bp, Homo sapiens
cctgccagctgcactg

SEQ ID NO: 4595619 - DNA, 17 bp, Homo sapiens
cctgccagctgcactga

SEQ ID NO: 4595620 - DNA, 18 bp, Homo sapiens
cctgccagctgcactgat

SEQ ID NO: 4595621 - DNA, 21 bp, Homo sapiens
cctgccaggagctttggacct

SEQ ID NO: 4595622 - DNA, 14 bp, Homo sapiens
cctgcctctaccca

SEQ ID NO: 4595623 - DNA, 15 bp, Homo sapiens
cctgcctctacccaa

SEQ ID NO: 4595624 - DNA, 13 bp, Homo sapiens
cctgctccagacc

SEQ ID NO: 4595625 - DNA, 17 bp, Homo sapiens
cctggaagccagctttc

SEQ ID NO: 4595626 - DNA, 12 bp, Homo sapiens
cctggaggccca

SEQ ID NO: 4595627 - DNA, 13 bp, Homo sapiens
cctggcagctctg

SEQ ID NO: 4595628 - DNA, 17 bp, Homo sapiens
cctggcagctctggaca

SEQ ID NO: 4595629 - DNA, 20 bp, Homo sapiens
cctggcagctctggacagcc

SEQ ID NO: 4595630 - DNA, 18 bp, Homo sapiens
cctggccagacacaggcc

SEQ ID NO: 4595631 - DNA, 23 bp, Homo sapiens
cctggccagacacaggccctccc

SEQ ID NO: 4595632 - DNA, 22 bp, Homo sapiens
cctggcctagcatacgtacaca

SEQ ID NO: 4595633 - DNA, 20 bp, Homo sapiens
cctgggagtgagggtgggtg

SEQ ID NO: 4595634 - DNA, 12 bp, Homo sapiens
cctgggcctgca

SEQ ID NO: 4595635 - DNA, 20 bp, Homo sapiens
cctgggggataccagctgag

SEQ ID NO: 4595636 - DNA, 20 bp, Homo sapiens
cctggtatatccaaaagctt

SEQ ID NO: 4595637 - DNA, 14 bp, Homo sapiens
cctggtgggccaac

SEQ ID NO: 4595638 - DNA, 15 bp, Homo sapiens
cctgtaatcacagct

SEQ ID NO: 4595639 - DNA, 17 bp, Homo sapiens
cctgtctttaaggaaaa

SEQ ID NO: 4595640 - DNA, 15 bp, Homo sapiens
cctgttccccagaga

SEQ ID NO: 4595641 - DNA, 16 bp, Homo sapiens
cctgttccccagagaa

SEQ ID NO: 4595642 - DNA, 23 bp, Homo sapiens
cctgttccccagagaaaggggag

SEQ ID NO: 4595643 - DNA, 13 bp, Homo sapiens
cctgtttttcaca

SEQ ID NO: 4595644 - DNA, 16 bp, Homo sapiens
cctgtttttcacattt

SEQ ID NO: 4595645 - DNA, 20 bp, Homo sapiens
cctgtttttcacattttcct

SEQ ID NO: 4595646 - DNA, 15 bp, Homo sapiens
ccttaccctcatgtt

SEQ ID NO: 4595647 - DNA, 22 bp, Homo sapiens
ccttactcttcttgaaatttta

SEQ ID NO: 4595648 - DNA, 23 bp, Homo sapiens
ccttccctcaccttggcaccaga

SEQ ID NO: 4595649 - DNA, 17 bp, Homo sapiens
ccttcctgtttttcaca

SEQ ID NO: 4595650 - DNA, 19 bp, Homo sapiens
ccttcctgtttttcacatt

SEQ ID NO: 4595651 - DNA, 15 bp, Homo sapiens
ccttctactgagcct

SEQ ID NO: 4595652 - DNA, 12 bp, Homo sapiens
ccttgccagaga

SEQ ID NO: 4595653 - DNA, 16 bp, Homo sapiens
ccttgccagagatcca

SEQ ID NO: 4595654 - DNA, 20 bp, Homo sapiens
ccttggcaccagacacccag

SEQ ID NO: 4595655 - DNA, 19 bp, Homo sapiens
ccttgtttacacataccct

SEQ ID NO: 4595656 - DNA, 13 bp, Homo sapiens
cctttctccagcc

SEQ ID NO: 4595657 - DNA, 18 bp, Homo sapiens
cctttgtattctctcctg

SEQ ID NO: 4595658 - DNA, 17 bp, Homo sapiens
cctttttatttgcatgt

SEQ ID NO: 4595659 - DNA, 17 bp, Homo sapiens
ccttttttatacataaa

SEQ ID NO: 4595660 - DNA, 16 bp, Homo sapiens
cgaatctagaggaggg

SEQ ID NO: 4595661 - DNA, 17 bp, Homo sapiens
cgaatctagaggagggg

SEQ ID NO: 4595662 - DNA, 13 bp, Homo sapiens
cgacccagctcta

SEQ ID NO: 4595663 - DNA, 13 bp, Homo sapiens
cgactgaccactg

SEQ ID NO: 4595664 - DNA, 17 bp, Homo sapiens
cgactgaccactggcct

SEQ ID NO: 4595665 - DNA, 12 bp, Homo sapiens
cgatttctgttt

SEQ ID NO: 4595666 - DNA, 11 bp, Homo sapiens
cgctacccact

SEQ ID NO: 4595667 - DNA, 13 bp, Homo sapiens
cggcatttgtttc

SEQ ID NO: 4595668 - DNA, 17 bp, Homo sapiens
cggccagggagaagctc

SEQ ID NO: 4595669 - DNA, 22 bp, Homo sapiens
cgggagcatctcttgaggccag

SEQ ID NO: 4595670 - DNA, 20 bp, Homo sapiens
cggtggctcaggcctataac

SEQ ID NO: 4595671 - DNA, 16 bp, Homo sapiens
cgtacacattttattt

SEQ ID NO: 4595672 - DNA, 16 bp, Homo sapiens
cgtgggaaaggggagt

SEQ ID NO: 4595673 - DNA, 20 bp, Homo sapiens
cgtgtttctgactctgagct

SEQ ID NO: 4595674 - DNA, 13 bp, Homo sapiens
cgttaaaatacca

SEQ ID NO: 4595675 - DNA, 14 bp, Homo sapiens
cgtttattttcaag

SEQ ID NO: 4595676 - DNA, 11 bp, Homo sapiens
ctaaaaaacag

SEQ ID NO: 4595677 - DNA, 15 bp, Homo sapiens
ctaaaataattttgt

SEQ ID NO: 4595678 - DNA, 13 bp, Homo sapiens
ctaaactaccacc

SEQ ID NO: 4595679 - DNA, 17 bp, Homo sapiens
ctaaactaccacctcag

SEQ ID NO: 4595680 - DNA, 18 bp, Homo sapiens
ctaaactaccacctcagg

SEQ ID NO: 4595681 - DNA, 15 bp, Homo sapiens
ctaaaggctaccttt

SEQ ID NO: 4595682 - DNA, 19 bp, Homo sapiens
ctaaagggactacctctgt

SEQ ID NO: 4595683 - DNA, 21 bp, Homo sapiens
ctaaagggactacctctgtgc

SEQ ID NO: 4595684 - DNA, 15 bp, Homo sapiens
ctaaatggaaccact

SEQ ID NO: 4595685 - DNA, 20 bp, Homo sapiens
ctaaatggtcgcccaggaga

SEQ ID NO: 4595686 - DNA, 16 bp, Homo sapiens
ctaaccagcagaaatg

SEQ ID NO: 4595687 - DNA, 15 bp, Homo sapiens
ctaacgtaaatacac

SEQ ID NO: 4595688 - DNA, 15 bp, Homo sapiens
ctaagaacctggaac

SEQ ID NO: 4595689 - DNA, 14 bp, Homo sapiens
ctaagcaaaatgtg

SEQ ID NO: 4595690 - DNA, 15 bp, Homo sapiens
ctaagctaaccccct

SEQ ID NO: 4595691 - DNA, 20 bp, Homo sapiens
ctaagtgaaataagccagac

SEQ ID NO: 4595692 - DNA, 14 bp, Homo sapiens
ctaagtttttatgg

SEQ ID NO: 4595693 - DNA, 23 bp, Homo sapiens
ctaagtttttatggcttttgtgc

SEQ ID NO: 4595694 - DNA, 17 bp, Homo sapiens
ctaataacatgtgaaaa

SEQ ID NO: 4595695 - DNA, 19 bp, Homo sapiens
ctaatagacaatttattat

SEQ ID NO: 4595696 - DNA, 15 bp, Homo sapiens
ctaattctatgcctg

SEQ ID NO: 4595697 - DNA, 16 bp, Homo sapiens
ctaatttgatgtttac

SEQ ID NO: 4595698 - DNA, 19 bp, Homo sapiens
ctaattttccataagctat

SEQ ID NO: 4595699 - DNA, 17 bp, Homo sapiens
ctacactccagtgagac

SEQ ID NO: 4595700 - DNA, 15 bp, Homo sapiens
ctacatgaggtactg

SEQ ID NO: 4595701 - DNA, 18 bp, Homo sapiens
ctacatgaggtactgaga

SEQ ID NO: 4595702 - DNA, 20 bp, Homo sapiens
ctacatgaggtactgagagt

SEQ ID NO: 4595703 - DNA, 14 bp, Homo sapiens
ctacattctgttaa

SEQ ID NO: 4595704 - DNA, 20 bp, Homo sapiens
ctacccctttctccagccct

SEQ ID NO: 4595705 - DNA, 12 bp, Homo sapiens
ctacctctgtgc

SEQ ID NO: 4595706 - DNA, 13 bp, Homo sapiens
ctacctctgtgcc

SEQ ID NO: 4595707 - DNA, 17 bp, Homo sapiens
ctacctctgtgccttgc

SEQ ID NO: 4595708 - DNA, 17 bp, Homo sapiens
ctactacctgtaatgac

SEQ ID NO: 4595709 - DNA, 19 bp, Homo sapiens
ctacttgggaggctgagat

SEQ ID NO: 4595710 - DNA, 18 bp, Homo sapiens
ctactttgactttttgca

SEQ ID NO: 4595711 - DNA, 13 bp, Homo sapiens
ctagaggaggggg

SEQ ID NO: 4595712 - DNA, 16 bp, Homo sapiens
ctagaggagggggcag

SEQ ID NO: 4595713 - DNA, 20 bp, Homo sapiens
ctagaggagggggcaggctg

SEQ ID NO: 4595714 - DNA, 17 bp, Homo sapiens
ctagaggttcaaagata

SEQ ID NO: 4595715 - DNA, 16 bp, Homo sapiens
ctagatactgtatcat

SEQ ID NO: 4595716 - DNA, 16 bp, Homo sapiens
ctagcatacgtacaca

SEQ ID NO: 4595717 - DNA, 18 bp, Homo sapiens
ctagcccaatgaaatgaa

SEQ ID NO: 4595718 - DNA, 11 bp, Homo sapiens
ctaggggctgg

SEQ ID NO: 4595719 - DNA, 15 bp, Homo sapiens
ctaggggctggggcc

SEQ ID NO: 4595720 - DNA, 22 bp, Homo sapiens
ctagtttgattaaattcttgca

SEQ ID NO: 4595721 - DNA, 20 bp, Homo sapiens
ctatcaagtattataccttt

SEQ ID NO: 4595722 - DNA, 23 bp, Homo sapiens
ctatgatattttctgtgcctgaa

SEQ ID NO: 4595723 - DNA, 20 bp, Homo sapiens
ctatgatttaatttgaaata

SEQ ID NO: 4595724 - DNA, 20 bp, Homo sapiens
ctatgcatggtgccccagga

SEQ ID NO: 4595725 - DNA, 21 bp, Homo sapiens
ctatgcatttgaaaattttga

SEQ ID NO: 4595726 - DNA, 20 bp, Homo sapiens
ctatgccagctcagtcccat

SEQ ID NO: 4595727 - DNA, 17 bp, Homo sapiens
ctatgttaatattttag

SEQ ID NO: 4595728 - DNA, 23 bp, Homo sapiens
ctattcagcttcgtttattttca

SEQ ID NO: 4595729 - DNA, 19 bp, Homo sapiens
ctatttatttatttattca

SEQ ID NO: 4595730 - DNA, 21 bp, Homo sapiens
ctatttttggcagtctgaatt

SEQ ID NO: 4595731 - DNA, 15 bp, Homo sapiens
ctcaaatggggccag

SEQ ID NO: 4595732 - DNA, 19 bp, Homo sapiens
ctcaaatggggccagatcc

SEQ ID NO: 4595733 - DNA, 20 bp, Homo sapiens
ctcaaatggggccagatcca

SEQ ID NO: 4595734 - DNA, 14 bp, Homo sapiens
ctcaataaagtggg

SEQ ID NO: 4595735 - DNA, 18 bp, Homo sapiens
ctcacccagaatccctct

SEQ ID NO: 4595736 - DNA, 13 bp, Homo sapiens
ctcagaggccttg

SEQ ID NO: 4595737 - DNA, 18 bp, Homo sapiens
ctcagatccagggacaga

SEQ ID NO: 4595738 - DNA, 16 bp, Homo sapiens
ctcagcctggccagac

SEQ ID NO: 4595739 - DNA, 15 bp, Homo sapiens
ctcagccttgccaga

SEQ ID NO: 4595740 - DNA, 17 bp, Homo sapiens
ctcagccttgccagaga

SEQ ID NO: 4595741 - DNA, 19 bp, Homo sapiens
ctcagccttgccagagatc

SEQ ID NO: 4595742 - DNA, 19 bp, Homo sapiens
ctcagctgtcaaggctcag

SEQ ID NO: 4595743 - DNA, 16 bp, Homo sapiens
ctcaggacagatgcca

SEQ ID NO: 4595744 - DNA, 17 bp, Homo sapiens
ctcaggaggctgaggca

SEQ ID NO: 4595745 - DNA, 22 bp, Homo sapiens
ctcaggaggctgaggcaggagg

SEQ ID NO: 4595746 - DNA, 23 bp, Homo sapiens
ctcaggcctataaccccagctcc

SEQ ID NO: 4595747 - DNA, 16 bp, Homo sapiens
ctcagttcaatgagca

SEQ ID NO: 4595748 - DNA, 14 bp, Homo sapiens
ctcatgttcttaat

SEQ ID NO: 4595749 - DNA, 18 bp, Homo sapiens
ctcatgttcttaattctt

SEQ ID NO: 4595750 - DNA, 19 bp, Homo sapiens
ctcatgttcttaattctta

SEQ ID NO: 4595751 - DNA, 22 bp, Homo sapiens
ctcattctccttgtgttactaa

SEQ ID NO: 4595752 - DNA, 15 bp, Homo sapiens
ctccaaaataaaact

SEQ ID NO: 4595753 - DNA, 13 bp, Homo sapiens
ctccaacctgcaa

SEQ ID NO: 4595754 - DNA, 23 bp, Homo sapiens
ctccaattttttaagtgaaaata

SEQ ID NO: 4595755 - DNA, 20 bp, Homo sapiens
ctccacatatttcagtgagg

SEQ ID NO: 4595756 - DNA, 11 bp, Homo sapiens
ctccagcactc

SEQ ID NO: 4595757 - DNA, 20 bp, Homo sapiens
ctccatactgtttctttctt

SEQ ID NO: 4595758 - DNA, 16 bp, Homo sapiens
ctcccattcctgaaga

SEQ ID NO: 4595759 - DNA, 17 bp, Homo sapiens
ctccccagcccagagac

SEQ ID NO: 4595760 - DNA, 21 bp, Homo sapiens
ctcccccccatgcactgtgaa

SEQ ID NO: 4595761 - DNA, 15 bp, Homo sapiens
ctcccgactgaccac

SEQ ID NO: 4595762 - DNA, 16 bp, Homo sapiens
ctcccttctcttcaca

SEQ ID NO: 4595763 - DNA, 23 bp, Homo sapiens
ctccgcgctgtgtaaatgctcca

SEQ ID NO: 4595764 - DNA, 17 bp, Homo sapiens
ctcctcccgactgacca

SEQ ID NO: 4595765 - DNA, 17 bp, Homo sapiens
ctcctctccccagccca

SEQ ID NO: 4595766 - DNA, 20 bp, Homo sapiens
ctcctctccccagcccagag

SEQ ID NO: 4595767 - DNA, 23 bp, Homo sapiens
ctcctctccccagcccagagaca

SEQ ID NO: 4595768 - DNA, 16 bp, Homo sapiens
ctcctgtacctcttga

SEQ ID NO: 4595769 - DNA, 22 bp, Homo sapiens
ctctaaagtctgttgattaaag

SEQ ID NO: 4595770 - DNA, 19 bp, Homo sapiens
ctctaaataaagacgacta

SEQ ID NO: 4595771 - DNA, 19 bp, Homo sapiens
ctctactccaggcttccac

SEQ ID NO: 4595772 - DNA, 21 bp, Homo sapiens
ctctagtttgattaaattctt

SEQ ID NO: 4595773 - DNA, 21 bp, Homo sapiens
ctctatgggccatattccgca

SEQ ID NO: 4595774 - DNA, 23 bp, Homo sapiens
ctctatgggccatattccgcact

SEQ ID NO: 4595775 - DNA, 13 bp, Homo sapiens
ctctccccagccc

SEQ ID NO: 4595776 - DNA, 17 bp, Homo sapiens
ctctccccagcccagag

SEQ ID NO: 4595777 - DNA, 18 bp, Homo sapiens
ctctccccagcccagaga

SEQ ID NO: 4595778 - DNA, 19 bp, Homo sapiens
ctctccccagcccagagac

SEQ ID NO: 4595779 - DNA, 13 bp, Homo sapiens
ctctcctgtacct

SEQ ID NO: 4595780 - DNA, 14 bp, Homo sapiens
ctctcctgtacctc

SEQ ID NO: 4595781 - DNA, 13 bp, Homo sapiens
ctctgaagtcaca

SEQ ID NO: 4595782 - DNA, 19 bp, Homo sapiens
ctctgcctgacagcatcct

SEQ ID NO: 4595783 - DNA, 15 bp, Homo sapiens
ctctggacagcccca

SEQ ID NO: 4595784 - DNA, 17 bp, Homo sapiens
ctctgtgggctggcagt

SEQ ID NO: 4595785 - DNA, 20 bp, Homo sapiens
ctctgttgcaagtgcaataa

SEQ ID NO: 4595786 - DNA, 18 bp, Homo sapiens
ctcttcagatctctaact

SEQ ID NO: 4595787 - DNA, 15 bp, Homo sapiens
ctcttctgagctatt

SEQ ID NO: 4595788 - DNA, 17 bp, Homo sapiens
ctcttggaccctgggag

SEQ ID NO: 4595789 - DNA, 13 bp, Homo sapiens
ctgaaaatgtgct

SEQ ID NO: 4595790 - DNA, 15 bp, Homo sapiens
ctgaaacaacttgga

SEQ ID NO: 4595791 - DNA, 13 bp, Homo sapiens
ctgaaattttata

SEQ ID NO: 4595792 - DNA, 14 bp, Homo sapiens
ctgaagaaccagtc

SEQ ID NO: 4595793 - DNA, 15 bp, Homo sapiens
ctgaagaaccagtcc

SEQ ID NO: 4595794 - DNA, 23 bp, Homo sapiens
ctgaagcctttgcattttggaga

SEQ ID NO: 4595795 - DNA, 21 bp, Homo sapiens
ctgaagtcacatcacaggaca

SEQ ID NO: 4595796 - DNA, 22 bp, Homo sapiens
ctgaagtcacatcacaggacac

SEQ ID NO: 4595797 - DNA, 19 bp, Homo sapiens
ctgaatccaaactaatcca

SEQ ID NO: 4595798 - DNA, 20 bp, Homo sapiens
ctgaatgaggtcagcatgtc

SEQ ID NO: 4595799 - DNA, 12 bp, Homo sapiens
ctgaatttcttt

SEQ ID NO: 4595800 - DNA, 14 bp, Homo sapiens
ctgacccctgctca

SEQ ID NO: 4595801 - DNA, 16 bp, Homo sapiens
ctgacccctgctcagt

SEQ ID NO: 4595802 - DNA, 15 bp, Homo sapiens
ctgacggccagggag

SEQ ID NO: 4595803 - DNA, 15 bp, Homo sapiens
ctgactaaactacca

SEQ ID NO: 4595804 - DNA, 16 bp, Homo sapiens
ctgactaaactaccac

SEQ ID NO: 4595805 - DNA, 11 bp, Homo sapiens
ctgagaaagag

SEQ ID NO: 4595806 - DNA, 15 bp, Homo sapiens
ctgagaaagaggcag

SEQ ID NO: 4595807 - DNA, 14 bp, Homo sapiens
ctgagaggctgtct

SEQ ID NO: 4595808 - DNA, 16 bp, Homo sapiens
ctgaggaatttcacct

SEQ ID NO: 4595809 - DNA, 23 bp, Homo sapiens
ctgaggacaagagaaaaaagcca

SEQ ID NO: 4595810 - DNA, 16 bp, Homo sapiens
ctgagggtcgtgggaa

SEQ ID NO: 4595811 - DNA, 17 bp, Homo sapiens
ctgagggtcgtgggaaa

SEQ ID NO: 4595812 - DNA, 18 bp, Homo sapiens
ctgagggtcgtgggaaag

SEQ ID NO: 4595813 - DNA, 20 bp, Homo sapiens
ctgagtcgtacagaaagctg

SEQ ID NO: 4595814 - DNA, 21 bp, Homo sapiens
ctgagtcgtacagaaagctgc

SEQ ID NO: 4595815 - DNA, 21 bp, Homo sapiens
ctgataaagatgagtgagcat

SEQ ID NO: 4595816 - DNA, 16 bp, Homo sapiens
ctgatatattttacaa

SEQ ID NO: 4595817 - DNA, 18 bp, Homo sapiens
ctgatatattttacaatt

SEQ ID NO: 4595818 - DNA, 12 bp, Homo sapiens
ctgatcctggag

SEQ ID NO: 4595819 - DNA, 21 bp, Homo sapiens
ctgatcctggaggcccagttc

SEQ ID NO: 4595820 - DNA, 14 bp, Homo sapiens
ctgatgctgcccct

SEQ ID NO: 4595821 - DNA, 19 bp, Homo sapiens
ctgattttttttcctttta

SEQ ID NO: 4595822 - DNA, 18 bp, Homo sapiens
ctgcacaataaaaatgtt

SEQ ID NO: 4595823 - DNA, 16 bp, Homo sapiens
ctgcactccagcctga

SEQ ID NO: 4595824 - DNA, 17 bp, Homo sapiens
ctgcactccagcctgag

SEQ ID NO: 4595825 - DNA, 19 bp, Homo sapiens
ctgcactgatgctgcccct

SEQ ID NO: 4595826 - DNA, 13 bp, Homo sapiens
ctgcagaagacag

SEQ ID NO: 4595827 - DNA, 22 bp, Homo sapiens
ctgcagaatttgggttctgcct

SEQ ID NO: 4595828 - DNA, 21 bp, Homo sapiens
ctgcagtcagtcatgatggca

SEQ ID NO: 4595829 - DNA, 15 bp, Homo sapiens
ctgcatgtttgtgat

SEQ ID NO: 4595830 - DNA, 22 bp, Homo sapiens
ctgcatttaaaagatacagtta

SEQ ID NO: 4595831 - DNA, 13 bp, Homo sapiens
ctgccagctgcac

SEQ ID NO: 4595832 - DNA, 17 bp, Homo sapiens
ctgccattcacttcata

SEQ ID NO: 4595833 - DNA, 20 bp, Homo sapiens
ctgcccaacccttccctcac

SEQ ID NO: 4595834 - DNA, 13 bp, Homo sapiens
ctgcctgacagca

SEQ ID NO: 4595835 - DNA, 17 bp, Homo sapiens
ctgcctgacagcatcct

SEQ ID NO: 4595836 - DNA, 15 bp, Homo sapiens
ctgcctgccagctgc

SEQ ID NO: 4595837 - DNA, 20 bp, Homo sapiens
ctgcgaatctagaggagggg

SEQ ID NO: 4595838 - DNA, 21 bp, Homo sapiens
ctgcgaatctagaggaggggg

SEQ ID NO: 4595839 - DNA, 17 bp, Homo sapiens
ctgctacccagaaatca

SEQ ID NO: 4595840 - DNA, 15 bp, Homo sapiens
ctgctcatattgtga

SEQ ID NO: 4595841 - DNA, 14 bp, Homo sapiens
ctgctccagacctg

SEQ ID NO: 4595842 - DNA, 21 bp, Homo sapiens
ctgctccagacctgatcctgg

SEQ ID NO: 4595843 - DNA, 22 bp, Homo sapiens
ctgctccagacctgatcctgga

SEQ ID NO: 4595844 - DNA, 20 bp, Homo sapiens
ctgctctaaataaagacgac

SEQ ID NO: 4595845 - DNA, 20 bp, Homo sapiens
ctgctgtacaacttctgggc

SEQ ID NO: 4595846 - DNA, 13 bp, Homo sapiens
ctgcttaacttca

SEQ ID NO: 4595847 - DNA, 20 bp, Homo sapiens
ctgcttgatttttgcctctt

SEQ ID NO: 4595848 - DNA, 13 bp, Homo sapiens
ctggaacccagac

SEQ ID NO: 4595849 - DNA, 14 bp, Homo sapiens
ctggaacccagact

SEQ ID NO: 4595850 - DNA, 19 bp, Homo sapiens
ctggaacccagactcagac

SEQ ID NO: 4595851 - DNA, 18 bp, Homo sapiens
ctggaatatataaccagt

SEQ ID NO: 4595852 - DNA, 15 bp, Homo sapiens
ctggacagccccacc

SEQ ID NO: 4595853 - DNA, 23 bp, Homo sapiens
ctggactctaaagtctgttgatt

SEQ ID NO: 4595854 - DNA, 17 bp, Homo sapiens
ctggagaagtgggtggg

SEQ ID NO: 4595855 - DNA, 12 bp, Homo sapiens
ctggaggcccag

SEQ ID NO: 4595856 - DNA, 16 bp, Homo sapiens
ctggagttgatctgga

SEQ ID NO: 4595857 - DNA, 20 bp, Homo sapiens
ctggagttgatctggaaccc

SEQ ID NO: 4595858 - DNA, 13 bp, Homo sapiens
ctggattaaactt

SEQ ID NO: 4595859 - DNA, 14 bp, Homo sapiens
ctggcaacatcttt

SEQ ID NO: 4595860 - DNA, 16 bp, Homo sapiens
ctggccaacggggtga

SEQ ID NO: 4595861 - DNA, 19 bp, Homo sapiens
ctggccagacacaggccct

SEQ ID NO: 4595862 - DNA, 21 bp, Homo sapiens
ctggccagacacaggccctcc

SEQ ID NO: 4595863 - DNA, 14 bp, Homo sapiens
ctggcccagggccc

SEQ ID NO: 4595864 - DNA, 16 bp, Homo sapiens
ctggcccagggcccag

SEQ ID NO: 4595865 - DNA, 17 bp, Homo sapiens
ctggcccagggcccaga

SEQ ID NO: 4595866 - DNA, 18 bp, Homo sapiens
ctggcccagggcccagag

SEQ ID NO: 4595867 - DNA, 23 bp, Homo sapiens
ctggcccagggcccagagcccag

SEQ ID NO: 4595868 - DNA, 13 bp, Homo sapiens
ctggctatgcatt

SEQ ID NO: 4595869 - DNA, 17 bp, Homo sapiens
ctgggcagcatagcaag

SEQ ID NO: 4595870 - DNA, 12 bp, Homo sapiens
ctgggcctctct

SEQ ID NO: 4595871 - DNA, 15 bp, Homo sapiens
ctgggcttcatctgg

SEQ ID NO: 4595872 - DNA, 16 bp, Homo sapiens
ctgggggataccagct

SEQ ID NO: 4595873 - DNA, 13 bp, Homo sapiens
ctggggtctggag

SEQ ID NO: 4595874 - DNA, 17 bp, Homo sapiens
ctgggtacttcttgaag

SEQ ID NO: 4595875 - DNA, 15 bp, Homo sapiens
ctggtgccaatttca

SEQ ID NO: 4595876 - DNA, 21 bp, Homo sapiens
ctggtgcctcaccccttgcca

SEQ ID NO: 4595877 - DNA, 13 bp, Homo sapiens
ctggtgggccaac

SEQ ID NO: 4595878 - DNA, 12 bp, Homo sapiens
ctgtaaactgtg

SEQ ID NO: 4595879 - DNA, 13 bp, Homo sapiens
ctgtaaactgtgt

SEQ ID NO: 4595880 - DNA, 18 bp, Homo sapiens
ctgtaatttgtgatacaa

SEQ ID NO: 4595881 - DNA, 17 bp, Homo sapiens
ctgtacatgaaaacaca

SEQ ID NO: 4595882 - DNA, 12 bp, Homo sapiens
ctgtaggcctca

SEQ ID NO: 4595883 - DNA, 13 bp, Homo sapiens
ctgtaggcctcag

SEQ ID NO: 4595884 - DNA, 23 bp, Homo sapiens
ctgtagtcctagccactcaggag

SEQ ID NO: 4595885 - DNA, 14 bp, Homo sapiens
ctgtcaaggctcag

SEQ ID NO: 4595886 - DNA, 13 bp, Homo sapiens
ctgtccagctcca

SEQ ID NO: 4595887 - DNA, 18 bp, Homo sapiens
ctgtccagctccaacctg

SEQ ID NO: 4595888 - DNA, 18 bp, Homo sapiens
ctgtcctcagccttgcca

SEQ ID NO: 4595889 - DNA, 20 bp, Homo sapiens
ctgtcctcagccttgccaga

SEQ ID NO: 4595890 - DNA, 21 bp, Homo sapiens
ctgtcctcagccttgccagag

SEQ ID NO: 4595891 - DNA, 13 bp, Homo sapiens
ctgtcctgggcct

SEQ ID NO: 4595892 - DNA, 18 bp, Homo sapiens
ctgtctgttgtattcatt

SEQ ID NO: 4595893 - DNA, 14 bp, Homo sapiens
ctgtgaaggaccct

SEQ ID NO: 4595894 - DNA, 19 bp, Homo sapiens
ctgtgccctaaagtgtatt

SEQ ID NO: 4595895 - DNA, 19 bp, Homo sapiens
ctgtgcgagggggccttgc

SEQ ID NO: 4595896 - DNA, 15 bp, Homo sapiens
ctgtgggctggcagt

SEQ ID NO: 4595897 - DNA, 20 bp, Homo sapiens
ctgtgtaaatgctccagcac

SEQ ID NO: 4595898 - DNA, 14 bp, Homo sapiens
ctgttccccagaga

SEQ ID NO: 4595899 - DNA, 15 bp, Homo sapiens
ctgttccccagagaa

SEQ ID NO: 4595900 - DNA, 16 bp, Homo sapiens
ctgttccccagagaaa

SEQ ID NO: 4595901 - DNA, 19 bp, Homo sapiens
ctgttctacatagatgctt

SEQ ID NO: 4595902 - DNA, 12 bp, Homo sapiens
ctgtttagataa

SEQ ID NO: 4595903 - DNA, 14 bp, Homo sapiens
ctgtttagataata

SEQ ID NO: 4595904 - DNA, 17 bp, Homo sapiens
ctgtttagataatacac

SEQ ID NO: 4595905 - DNA, 16 bp, Homo sapiens
ctgtttcagaggctca

SEQ ID NO: 4595906 - DNA, 15 bp, Homo sapiens
ctgtttttcacattt

SEQ ID NO: 4595907 - DNA, 20 bp, Homo sapiens
cttaaaaatggtttaaatgg

SEQ ID NO: 4595908 - DNA, 13 bp, Homo sapiens
cttaaataatgtg

SEQ ID NO: 4595909 - DNA, 12 bp, Homo sapiens
cttaacttcaca

SEQ ID NO: 4595910 - DNA, 17 bp, Homo sapiens
cttaacttcacatattg

SEQ ID NO: 4595911 - DNA, 10 bp, Homo sapiens
cttaattatt

SEQ ID NO: 4595912 - DNA, 16 bp, Homo sapiens
cttaattattgatgtt

SEQ ID NO: 4595913 - DNA, 17 bp, Homo sapiens
cttaccctcatgttctt

SEQ ID NO: 4595914 - DNA, 21 bp, Homo sapiens
cttactgatatattttacaat

SEQ ID NO: 4595915 - DNA, 13 bp, Homo sapiens
cttactgtacatg

SEQ ID NO: 4595916 - DNA, 15 bp, Homo sapiens
cttattggaactctg

SEQ ID NO: 4595917 - DNA, 18 bp, Homo sapiens
cttcaagaactctgggct

SEQ ID NO: 4595918 - DNA, 13 bp, Homo sapiens
cttcatctggcaa

SEQ ID NO: 4595919 - DNA, 14 bp, Homo sapiens
cttcatctggcaac

SEQ ID NO: 4595920 - DNA, 19 bp, Homo sapiens
cttcatctggcaacatctt

SEQ ID NO: 4595921 - DNA, 20 bp, Homo sapiens
cttccagtcttcctgacact

SEQ ID NO: 4595922 - DNA, 22 bp, Homo sapiens
cttccagtcttcctgacacttt

SEQ ID NO: 4595923 - DNA, 18 bp, Homo sapiens
cttctactgagccttcag

SEQ ID NO: 4595924 - DNA, 16 bp, Homo sapiens
cttctatttatttatt

SEQ ID NO: 4595925 - DNA, 18 bp, Homo sapiens
cttctgaactcaaactga

SEQ ID NO: 4595926 - DNA, 17 bp, Homo sapiens
cttctgagctatttcat

SEQ ID NO: 4595927 - DNA, 16 bp, Homo sapiens
cttctgccttctcatg

SEQ ID NO: 4595928 - DNA, 21 bp, Homo sapiens
cttctgggcttcatctggcaa

SEQ ID NO: 4595929 - DNA, 22 bp, Homo sapiens
cttcttgaaattttaacctatg

SEQ ID NO: 4595930 - DNA, 19 bp, Homo sapiens
cttgaaatataggaactta

SEQ ID NO: 4595931 - DNA, 14 bp, Homo sapiens
cttgaaattttaac

SEQ ID NO: 4595932 - DNA, 15 bp, Homo sapiens
cttgaaattttaacc

SEQ ID NO: 4595933 - DNA, 16 bp, Homo sapiens
cttgaaattttaacct

SEQ ID NO: 4595934 - DNA, 16 bp, Homo sapiens
cttgaagggccagagc

SEQ ID NO: 4595935 - DNA, 17 bp, Homo sapiens
cttgaagggccagagcc

SEQ ID NO: 4595936 - DNA, 19 bp, Homo sapiens
cttgaagggccagagccag

SEQ ID NO: 4595937 - DNA, 22 bp, Homo sapiens
cttgaaggtgctgacggccagg

SEQ ID NO: 4595938 - DNA, 20 bp, Homo sapiens
cttgaatttctaaaaaacag

SEQ ID NO: 4595939 - DNA, 12 bp, Homo sapiens
cttgagcccagg

SEQ ID NO: 4595940 - DNA, 18 bp, Homo sapiens
cttgagccttgaactttg

SEQ ID NO: 4595941 - DNA, 19 bp, Homo sapiens
cttgagccttgaactttga

SEQ ID NO: 4595942 - DNA, 20 bp, Homo sapiens
cttgagccttgaactttgac

SEQ ID NO: 4595943 - DNA, 14 bp, Homo sapiens
cttgaggccaggag

SEQ ID NO: 4595944 - DNA, 17 bp, Homo sapiens
cttggacattttatgtc

SEQ ID NO: 4595945 - DNA, 19 bp, Homo sapiens
cttggacattttatgtctt

SEQ ID NO: 4595946 - DNA, 16 bp, Homo sapiens
cttggcaccagacacc

SEQ ID NO: 4595947 - DNA, 21 bp, Homo sapiens
cttggcaccagacacccagga

SEQ ID NO: 4595948 - DNA, 16 bp, Homo sapiens
cttgggagctcatccc

SEQ ID NO: 4595949 - DNA, 15 bp, Homo sapiens
cttggtttgtaaatt

SEQ ID NO: 4595950 - DNA, 14 bp, Homo sapiens
cttgtaactaaaat

SEQ ID NO: 4595951 - DNA, 12 bp, Homo sapiens
cttgtacataat

SEQ ID NO: 4595952 - DNA, 19 bp, Homo sapiens
cttgtacataatgcgtgca

SEQ ID NO: 4595953 - DNA, 21 bp, Homo sapiens
cttgtccaattaatgaagttg

SEQ ID NO: 4595954 - DNA, 23 bp, Homo sapiens
cttgtccaattaatgaagttgat

SEQ ID NO: 4595955 - DNA, 16 bp, Homo sapiens
ctttaatgatatgctt

SEQ ID NO: 4595956 - DNA, 17 bp, Homo sapiens
ctttaccttttttatac

SEQ ID NO: 4595957 - DNA, 22 bp, Homo sapiens
ctttccaaagtacactgtttca

SEQ ID NO: 4595958 - DNA, 13 bp, Homo sapiens
ctttccctgcctc

SEQ ID NO: 4595959 - DNA, 15 bp, Homo sapiens
ctttcctgaatccaa

SEQ ID NO: 4595960 - DNA, 15 bp, Homo sapiens
ctttctcagttttca

SEQ ID NO: 4595961 - DNA, 14 bp, Homo sapiens
ctttctccagccct

SEQ ID NO: 4595962 - DNA, 12 bp, Homo sapiens
ctttctctgagg

SEQ ID NO: 4595963 - DNA, 14 bp, Homo sapiens
ctttctctgaggac

SEQ ID NO: 4595964 - DNA, 15 bp, Homo sapiens
ctttctctgaggaca

SEQ ID NO: 4595965 - DNA, 15 bp, Homo sapiens
ctttgacctctgcag

SEQ ID NO: 4595966 - DNA, 18 bp, Homo sapiens
ctttgacctctgcagcaa

SEQ ID NO: 4595967 - DNA, 14 bp, Homo sapiens
ctttgcattttgga

SEQ ID NO: 4595968 - DNA, 17 bp, Homo sapiens
ctttggacctaatccaa

SEQ ID NO: 4595969 - DNA, 23 bp, Homo sapiens
ctttgtctacttcaaaagtttgt

SEQ ID NO: 4595970 - DNA, 13 bp, Homo sapiens
ctttgtttaagca

SEQ ID NO: 4595971 - DNA, 12 bp, Homo sapiens
cttttaaactgt

SEQ ID NO: 4595972 - DNA, 14 bp, Homo sapiens
cttttaattttcct

SEQ ID NO: 4595973 - DNA, 18 bp, Homo sapiens
cttttataaactttacct

SEQ ID NO: 4595974 - DNA, 19 bp, Homo sapiens
cttttataaactttacctt

SEQ ID NO: 4595975 - DNA, 20 bp, Homo sapiens
cttttataaactttaccttt

SEQ ID NO: 4595976 - DNA, 22 bp, Homo sapiens
cttttcaaatagggtctaactc

SEQ ID NO: 4595977 - DNA, 18 bp, Homo sapiens
cttttcccactgtttaag

SEQ ID NO: 4595978 - DNA, 13 bp, Homo sapiens
cttttcttttctt

SEQ ID NO: 4595979 - DNA, 21 bp, Homo sapiens
ctttttaaatgtaaagatatt

SEQ ID NO: 4595980 - DNA, 23 bp, Homo sapiens
ctttttatgctatttctgtatat

SEQ ID NO: 4595981 - DNA, 16 bp, Homo sapiens
cttttttagagttgat

SEQ ID NO: 4595982 - DNA, 15 bp, Homo sapiens
cttttttatacataa

SEQ ID NO: 4595983 - DNA, 17 bp, Homo sapiens
gaaaaaggatgcacaga

SEQ ID NO: 4595984 - DNA, 22 bp, Homo sapiens
gaaaatctacactccagtgaga

SEQ ID NO: 4595985 - DNA, 17 bp, Homo sapiens
gaaactggattaaactt

SEQ ID NO: 4595986 - DNA, 20 bp, Homo sapiens
gaaagaacgctgatttaaag

SEQ ID NO: 4595987 - DNA, 13 bp, Homo sapiens
gaaagcagaacag

SEQ ID NO: 4595988 - DNA, 22 bp, Homo sapiens
gaaagcagaacagtgattacca

SEQ ID NO: 4595989 - DNA, 18 bp, Homo sapiens
gaaagccccagcactaac

SEQ ID NO: 4595990 - DNA, 17 bp, Homo sapiens
gaaagctgcctggtata

SEQ ID NO: 4595991 - DNA, 17 bp, Homo sapiens
gaaaggcaaccaataaa

SEQ ID NO: 4595992 - DNA, 18 bp, Homo sapiens
gaaaggcaaccaataaaa

SEQ ID NO: 4595993 - DNA, 15 bp, Homo sapiens
gaaaggggagcccac

SEQ ID NO: 4595994 - DNA, 16 bp, Homo sapiens
gaaaggggagcccact

SEQ ID NO: 4595995 - DNA, 18 bp, Homo sapiens
gaaatagacagcatgaga

SEQ ID NO: 4595996 - DNA, 15 bp, Homo sapiens
gaaatgaattaaagt

SEQ ID NO: 4595997 - DNA, 14 bp, Homo sapiens
gaaattggctggat

SEQ ID NO: 4595998 - DNA, 15 bp, Homo sapiens
gaaattttatatgct

SEQ ID NO: 4595999 - DNA, 19 bp, Homo sapiens
gaaattttatatgcttact

SEQ ID NO: 4596000 - DNA, 17 bp, Homo sapiens
gaacaaatttacagaga

SEQ ID NO: 4596001 - DNA, 14 bp, Homo sapiens
gaacactgagaaag

SEQ ID NO: 4596002 - DNA, 20 bp, Homo sapiens
gaacagtgattaccagggac

SEQ ID NO: 4596003 - DNA, 12 bp, Homo sapiens
gaacatattgtt

SEQ ID NO: 4596004 - DNA, 17 bp, Homo sapiens
gaacccagactcagaca

SEQ ID NO: 4596005 - DNA, 19 bp, Homo sapiens
gaacccgggaggcagaggt

SEQ ID NO: 4596006 - DNA, 12 bp, Homo sapiens
gaacctcagcct

SEQ ID NO: 4596007 - DNA, 13 bp, Homo sapiens
gaacctcagcctg

SEQ ID NO: 4596008 - DNA, 15 bp, Homo sapiens
gaacctcagcctggc

SEQ ID NO: 4596009 - DNA, 17 bp, Homo sapiens
gaacctcagcctggcca

SEQ ID NO: 4596010 - DNA, 18 bp, Homo sapiens
gaacctcagcctggccag

SEQ ID NO: 4596011 - DNA, 21 bp, Homo sapiens
gaacctcagcctggccagaca

SEQ ID NO: 4596012 - DNA, 19 bp, Homo sapiens
gaactcaaatggggccaga

SEQ ID NO: 4596013 - DNA, 19 bp, Homo sapiens
gaactcagatccagggaca

SEQ ID NO: 4596014 - DNA, 21 bp, Homo sapiens
gaactcagatccagggacaga

SEQ ID NO: 4596015 - DNA, 16 bp, Homo sapiens
gaactttgacctctgc

SEQ ID NO: 4596016 - DNA, 23 bp, Homo sapiens
gaactttgacctctgcagcaata

SEQ ID NO: 4596017 - DNA, 17 bp, Homo sapiens
gaagatgtagaggagaa

SEQ ID NO: 4596018 - DNA, 24 bp, Homo sapiens
gaagccaggaatttcccaggaccc

SEQ ID NO: 4596019 - DNA, 20 bp, Homo sapiens
gaagctcctctccccagccc

SEQ ID NO: 4596020 - DNA, 21 bp, Homo sapiens
gaagctcctctccccagccca

SEQ ID NO: 4596021 - DNA, 15 bp, Homo sapiens
gaagctctgaagtca

SEQ ID NO: 4596022 - DNA, 21 bp, Homo sapiens
gaaggatacaaaagcatgtga

SEQ ID NO: 4596023 - DNA, 18 bp, Homo sapiens
gaagggccagagccaggg

SEQ ID NO: 4596024 - DNA, 15 bp, Homo sapiens
gaaggtagaatgttt

SEQ ID NO: 4596025 - DNA, 16 bp, Homo sapiens
gaaggtagaatgtttt

SEQ ID NO: 4596026 - DNA, 19 bp, Homo sapiens
gaaggtgctgacggccagg

SEQ ID NO: 4596027 - DNA, 19 bp, Homo sapiens
gaagtaatatgcacacatt

SEQ ID NO: 4596028 - DNA, 22 bp, Homo sapiens
gaagtaatatgcacacattttt

SEQ ID NO: 4596029 - DNA, 14 bp, Homo sapiens
gaagtatacctgat

SEQ ID NO: 4596030 - DNA, 14 bp, Homo sapiens
gaagtatccttcag

SEQ ID NO: 4596031 - DNA, 19 bp, Homo sapiens
gaagtcatgaagcccaagt

SEQ ID NO: 4596032 - DNA, 13 bp, Homo sapiens
gaagtcttctatt

SEQ ID NO: 4596033 - DNA, 13 bp, Homo sapiens
gaagtgggtgggg

SEQ ID NO: 4596034 - DNA, 15 bp, Homo sapiens
gaagtgggtggggac

SEQ ID NO: 4596035 - DNA, 24 bp, Homo sapiens
gaagtgggtggggacagaccagcc

SEQ ID NO: 4596036 - DNA, 19 bp, Homo sapiens
gaagttgattcatattgca

SEQ ID NO: 4596037 - DNA, 17 bp, Homo sapiens
gaatagaagctaaggtt

SEQ ID NO: 4596038 - DNA, 18 bp, Homo sapiens
gaatagaagctaaggttt

SEQ ID NO: 4596039 - DNA, 16 bp, Homo sapiens
gaatatccatgaccta

SEQ ID NO: 4596040 - DNA, 22 bp, Homo sapiens
gaatatttgttatgtagataac

SEQ ID NO: 4596041 - DNA, 13 bp, Homo sapiens
gaatcagaactca

SEQ ID NO: 4596042 - DNA, 14 bp, Homo sapiens
gaatgaatggctaa

SEQ ID NO: 4596043 - DNA, 15 bp, Homo sapiens
gaatgaatggctaag

SEQ ID NO: 4596044 - DNA, 14 bp, Homo sapiens
gaatgaggtcccag

SEQ ID NO: 4596045 - DNA, 19 bp, Homo sapiens
gaatgaggtcccaggcaga

SEQ ID NO: 4596046 - DNA, 16 bp, Homo sapiens
gaattgacccacaaga

SEQ ID NO: 4596047 - DNA, 15 bp, Homo sapiens
gaatttcccaggacc

SEQ ID NO: 4596048 - DNA, 17 bp, Homo sapiens
gaatttcccaggaccct

SEQ ID NO: 4596049 - DNA, 21 bp, Homo sapiens
gaatttcttggtaagaagccg

SEQ ID NO: 4596050 - DNA, 19 bp, Homo sapiens
gaatttggcctgcactaat

SEQ ID NO: 4596051 - DNA, 20 bp, Homo sapiens
gacaatgacttactgtacat

SEQ ID NO: 4596052 - DNA, 12 bp, Homo sapiens
gacaatttatta

SEQ ID NO: 4596053 - DNA, 15 bp, Homo sapiens
gacacggggcagtgg

SEQ ID NO: 4596054 - DNA, 18 bp, Homo sapiens
gacactagcccaatgaaa

SEQ ID NO: 4596055 - DNA, 20 bp, Homo sapiens
gacagaaagcagaacagtga

SEQ ID NO: 4596056 - DNA, 12 bp, Homo sapiens
gacagaccagcc

SEQ ID NO: 4596057 - DNA, 15 bp, Homo sapiens
gacagaccagccctt

SEQ ID NO: 4596058 - DNA, 18 bp, Homo sapiens
gacagaggccccagcctc

SEQ ID NO: 4596059 - DNA, 20 bp, Homo sapiens
gacagtatggcagctttcct

SEQ ID NO: 4596060 - DNA, 20 bp, Homo sapiens
gacatacttgaagggccaga

SEQ ID NO: 4596061 - DNA, 20 bp, Homo sapiens
gacatagaattaacacatga

SEQ ID NO: 4596062 - DNA, 17 bp, Homo sapiens
gacatgtctgttctaca

SEQ ID NO: 4596063 - DNA, 20 bp, Homo sapiens
gacattttatgtctttcttg

SEQ ID NO: 4596064 - DNA, 16 bp, Homo sapiens
gaccactgcagaagac

SEQ ID NO: 4596065 - DNA, 21 bp, Homo sapiens
gaccactgcagaagacagtat

SEQ ID NO: 4596066 - DNA, 18 bp, Homo sapiens
gaccactggcctacccct

SEQ ID NO: 4596067 - DNA, 19 bp, Homo sapiens
gaccactggcctacccctt

SEQ ID NO: 4596068 - DNA, 17 bp, Homo sapiens
gaccagcctgggcagca

SEQ ID NO: 4596069 - DNA, 15 bp, Homo sapiens
gacccacaagaaatg

SEQ ID NO: 4596070 - DNA, 18 bp, Homo sapiens
gacccagctctactccag

SEQ ID NO: 4596071 - DNA, 23 bp, Homo sapiens
gacccctgctcagtaaagcactt

SEQ ID NO: 4596072 - DNA, 10 bp, Homo sapiens
gacctggcag

SEQ ID NO: 4596073 - DNA, 16 bp, Homo sapiens
gacctggcagctctgg

SEQ ID NO: 4596074 - DNA, 14 bp, Homo sapiens
gaccttaaatgcaa

SEQ ID NO: 4596075 - DNA, 18 bp, Homo sapiens
gactaaactaccacctca

SEQ ID NO: 4596076 - DNA, 19 bp, Homo sapiens
gactaaactaccacctcag

SEQ ID NO: 4596077 - DNA, 14 bp, Homo sapiens
gactacctctgtgc

SEQ ID NO: 4596078 - DNA, 19 bp, Homo sapiens
gactatatttgggcctgct

SEQ ID NO: 4596079 - DNA, 18 bp, Homo sapiens
gactcagacattggcacc

SEQ ID NO: 4596080 - DNA, 15 bp, Homo sapiens
gactctaaagtctgt

SEQ ID NO: 4596081 - DNA, 16 bp, Homo sapiens
gactgaatttcttttg

SEQ ID NO: 4596082 - DNA, 16 bp, Homo sapiens
gacttactgtacatga

SEQ ID NO: 4596083 - DNA, 23 bp, Homo sapiens
gacttactgtacatgaaaacaca

SEQ ID NO: 4596084 - DNA, 22 bp, Homo sapiens
gagaagccaggaatttcccagg

SEQ ID NO: 4596085 - DNA, 20 bp, Homo sapiens
gagaagtcttctatttattt

SEQ ID NO: 4596086 - DNA, 15 bp, Homo sapiens
gagaagtgggtgggg

SEQ ID NO: 4596087 - DNA, 15 bp, Homo sapiens
gagacagctctgcat

SEQ ID NO: 4596088 - DNA, 18 bp, Homo sapiens
gagacagctctgcatact

SEQ ID NO: 4596089 - DNA, 15 bp, Homo sapiens
gagacatacttgaag

SEQ ID NO: 4596090 - DNA, 20 bp, Homo sapiens
gagacatacttgaagggcca

SEQ ID NO: 4596091 - DNA, 19 bp, Homo sapiens
gagaccagcctgggcagca

SEQ ID NO: 4596092 - DNA, 15 bp, Homo sapiens
gagagtgaacaaatt

SEQ ID NO: 4596093 - DNA, 14 bp, Homo sapiens
gagagtttcctgaa

SEQ ID NO: 4596094 - DNA, 22 bp, Homo sapiens
gagatccaaaagaagcccccag

SEQ ID NO: 4596095 - DNA, 18 bp, Homo sapiens
gagcatctcttgaggcca

SEQ ID NO: 4596096 - DNA, 13 bp, Homo sapiens
gagcccagctcca

SEQ ID NO: 4596097 - DNA, 14 bp, Homo sapiens
gagcccagctccaa

SEQ ID NO: 4596098 - DNA, 11 bp, Homo sapiens
gagcccaggag

SEQ ID NO: 4596099 - DNA, 12 bp, Homo sapiens
gagcctctgcct

SEQ ID NO: 4596100 - DNA, 13 bp, Homo sapiens
gagccttgaactt

SEQ ID NO: 4596101 - DNA, 15 bp, Homo sapiens
gagcgacagtgagac

SEQ ID NO: 4596102 - DNA, 20 bp, Homo sapiens
gagctcatccctctcaccca

SEQ ID NO: 4596103 - DNA, 20 bp, Homo sapiens
gaggatcctggagaagtggg

SEQ ID NO: 4596104 - DNA, 19 bp, Homo sapiens
gaggcaatgtcaggaacag

SEQ ID NO: 4596105 - DNA, 19 bp, Homo sapiens
gaggcagaggttgcagtga

SEQ ID NO: 4596106 - DNA, 12 bp, Homo sapiens
gaggcagggacc

SEQ ID NO: 4596107 - DNA, 18 bp, Homo sapiens
gaggcagggacctaaagg

SEQ ID NO: 4596108 - DNA, 19 bp, Homo sapiens
gaggcatttgtttgaactg

SEQ ID NO: 4596109 - DNA, 20 bp, Homo sapiens
gaggcccagttcaccctgat

SEQ ID NO: 4596110 - DNA, 22 bp, Homo sapiens
gaggccttgggagctcatccct

SEQ ID NO: 4596111 - DNA, 14 bp, Homo sapiens
gaggctcagattgt

SEQ ID NO: 4596112 - DNA, 14 bp, Homo sapiens
gaggctgcagtcag

SEQ ID NO: 4596113 - DNA, 14 bp, Homo sapiens
gagggaaagccagc

SEQ ID NO: 4596114 - DNA, 17 bp, Homo sapiens
gagggaaagccagcctg

SEQ ID NO: 4596115 - DNA, 16 bp, Homo sapiens
gagggtcgtgggaaag

SEQ ID NO: 4596116 - DNA, 17 bp, Homo sapiens
gagggtcgtgggaaagg

SEQ ID NO: 4596117 - DNA, 18 bp, Homo sapiens
gagggtcgtgggaaaggg

SEQ ID NO: 4596118 - DNA, 23 bp, Homo sapiens
gaggtcagcatgtctattcagct

SEQ ID NO: 4596119 - DNA, 19 bp, Homo sapiens
gaggtttcacttgcacatc

SEQ ID NO: 4596120 - DNA, 20 bp, Homo sapiens
gagtacgttgtgcatttggt

SEQ ID NO: 4596121 - DNA, 14 bp, Homo sapiens
gagtcccaaggaaa

SEQ ID NO: 4596122 - DNA, 16 bp, Homo sapiens
gagttgatctggaacc

SEQ ID NO: 4596123 - DNA, 18 bp, Homo sapiens
gagttgctgcaaacctga

SEQ ID NO: 4596124 - DNA, 22 bp, Homo sapiens
gagttgttacatttttaagtgc

SEQ ID NO: 4596125 - DNA, 22 bp, Homo sapiens
gataaatagtttatgattccac

SEQ ID NO: 4596126 - DNA, 12 bp, Homo sapiens
gataatacacca

SEQ ID NO: 4596127 - DNA, 23 bp, Homo sapiens
gataatacaccactacattctgt

SEQ ID NO: 4596128 - DNA, 18 bp, Homo sapiens
gatacaatgctgtgccct

SEQ ID NO: 4596129 - DNA, 16 bp, Homo sapiens
gatacagttactcaga

SEQ ID NO: 4596130 - DNA, 19 bp, Homo sapiens
gatacagttactcagaatt

SEQ ID NO: 4596131 - DNA, 17 bp, Homo sapiens
gatactgtatcatgaca

SEQ ID NO: 4596132 - DNA, 21 bp, Homo sapiens
gatactgtatcatgacaaaga

SEQ ID NO: 4596133 - DNA, 21 bp, Homo sapiens
gatagatgctggcccagggcc

SEQ ID NO: 4596134 - DNA, 12 bp, Homo sapiens
gatatgcttgta

SEQ ID NO: 4596135 - DNA, 22 bp, Homo sapiens
gatatgcttgtaactaaaataa

SEQ ID NO: 4596136 - DNA, 15 bp, Homo sapiens
gatattttgctttgt

SEQ ID NO: 4596137 - DNA, 23 bp, Homo sapiens
gatcagtgggcctccaaggaggg

SEQ ID NO: 4596138 - DNA, 16 bp, Homo sapiens
gatccaaaagaagccc

SEQ ID NO: 4596139 - DNA, 19 bp, Homo sapiens
gatccaaaagaagccccca

SEQ ID NO: 4596140 - DNA, 22 bp, Homo sapiens
gatccaaaagaagcccccagct

SEQ ID NO: 4596141 - DNA, 19 bp, Homo sapiens
gatccaactaatgccttac

SEQ ID NO: 4596142 - DNA, 20 bp, Homo sapiens
gatccaactaatgccttact

SEQ ID NO: 4596143 - DNA, 12 bp, Homo sapiens
gatccagcctgg

SEQ ID NO: 4596144 - DNA, 12 bp, Homo sapiens
gatccaggacta

SEQ ID NO: 4596145 - DNA, 14 bp, Homo sapiens
gatccagggacaga

SEQ ID NO: 4596146 - DNA, 15 bp, Homo sapiens
gatccagggacagag

SEQ ID NO: 4596147 - DNA, 15 bp, Homo sapiens
gatcctggaggccca

SEQ ID NO: 4596148 - DNA, 16 bp, Homo sapiens
gatcctgtctttaagg

SEQ ID NO: 4596149 - DNA, 12 bp, Homo sapiens
gatctggaaccc

SEQ ID NO: 4596150 - DNA, 17 bp, Homo sapiens
gatctggaacccagact

SEQ ID NO: 4596151 - DNA, 17 bp, Homo sapiens
gatctggaacctcagcc

SEQ ID NO: 4596152 - DNA, 14 bp, Homo sapiens
gatctgtcctcagc

SEQ ID NO: 4596153 - DNA, 18 bp, Homo sapiens
gatctgtcctcagccttg

SEQ ID NO: 4596154 - DNA, 15 bp, Homo sapiens
gatgctagagcctct

SEQ ID NO: 4596155 - DNA, 13 bp, Homo sapiens
gatgctggcccag

SEQ ID NO: 4596156 - DNA, 17 bp, Homo sapiens
gatgctggcccagggcc

SEQ ID NO: 4596157 - DNA, 21 bp, Homo sapiens
gatgctggcccagggcccaga

SEQ ID NO: 4596158 - DNA, 16 bp, Homo sapiens
gatggcaacagatctg

SEQ ID NO: 4596159 - DNA, 16 bp, Homo sapiens
gatgggggaactcaga

SEQ ID NO: 4596160 - DNA, 17 bp, Homo sapiens
gatgtagaggagaaact

SEQ ID NO: 4596161 - DNA, 23 bp, Homo sapiens
gatgtttacaggtggacacacaa

SEQ ID NO: 4596162 - DNA, 19 bp, Homo sapiens
gattaaattcttgcaaagt

SEQ ID NO: 4596163 - DNA, 16 bp, Homo sapiens
gattcaatctgtaaac

SEQ ID NO: 4596164 - DNA, 21 bp, Homo sapiens
gattcaatctgtaaactgtgt

SEQ ID NO: 4596165 - DNA, 22 bp, Homo sapiens
gattcaatctgtaaactgtgta

SEQ ID NO: 4596166 - DNA, 20 bp, Homo sapiens
gattctgaccttaaatgcaa

SEQ ID NO: 4596167 - DNA, 13 bp, Homo sapiens
gattgtgcccctg

SEQ ID NO: 4596168 - DNA, 15 bp, Homo sapiens
gatttaacagaaatg

SEQ ID NO: 4596169 - DNA, 16 bp, Homo sapiens
gatttaacagaaatgt

SEQ ID NO: 4596170 - DNA, 18 bp, Homo sapiens
gatttaacagaaatgtac

SEQ ID NO: 4596171 - DNA, 20 bp, Homo sapiens
gatttaacagaaatgtacag

SEQ ID NO: 4596172 - DNA, 23 bp, Homo sapiens
gatttaacagaaatgtacagcaa

SEQ ID NO: 4596173 - DNA, 15 bp, Homo sapiens
gatttccgttaaaat

SEQ ID NO: 4596174 - DNA, 22 bp, Homo sapiens
gatttccgttaaaataccagcc

SEQ ID NO: 4596175 - DNA, 19 bp, Homo sapiens
gcaaagatctgtcctcagc

SEQ ID NO: 4596176 - DNA, 16 bp, Homo sapiens
gcaaagtatccctact

SEQ ID NO: 4596177 - DNA, 12 bp, Homo sapiens
gcaaatcaatgc

SEQ ID NO: 4596178 - DNA, 15 bp, Homo sapiens
gcaacaagctatttt

SEQ ID NO: 4596179 - DNA, 20 bp, Homo sapiens
gcaacagatctggaacctca

SEQ ID NO: 4596180 - DNA, 13 bp, Homo sapiens
gcaaccaataaaa

SEQ ID NO: 4596181 - DNA, 18 bp, Homo sapiens
gcaaccaataaaagccag

SEQ ID NO: 4596182 - DNA, 14 bp, Homo sapiens
gcaaccatttgaaa

SEQ ID NO: 4596183 - DNA, 14 bp, Homo sapiens
gcaaggaaggaaag

SEQ ID NO: 4596184 - DNA, 18 bp, Homo sapiens
gcaaggagatttacaact

SEQ ID NO: 4596185 - DNA, 16 bp, Homo sapiens
gcacagagttgttaca

SEQ ID NO: 4596186 - DNA, 19 bp, Homo sapiens
gcacaggccgtcaccctgg

SEQ ID NO: 4596187 - DNA, 17 bp, Homo sapiens
gcacagtgcagcaagcc

SEQ ID NO: 4596188 - DNA, 18 bp, Homo sapiens
gcacagtgcagcaagcct

SEQ ID NO: 4596189 - DNA, 20 bp, Homo sapiens
gcacagtgcagcaagcctgg

SEQ ID NO: 4596190 - DNA, 17 bp, Homo sapiens
gcaccagacacccagga

SEQ ID NO: 4596191 - DNA, 12 bp, Homo sapiens
gcacgatttctg

SEQ ID NO: 4596192 - DNA, 21 bp, Homo sapiens
gcactcaataaagtgggcttt

SEQ ID NO: 4596193 - DNA, 12 bp, Homo sapiens
gcactccagcct

SEQ ID NO: 4596194 - DNA, 16 bp, Homo sapiens
gcactgggcacaggcc

SEQ ID NO: 4596195 - DNA, 14 bp, Homo sapiens
gcactgtgaaggac

SEQ ID NO: 4596196 - DNA, 16 bp, Homo sapiens
gcactgtgaaggaccc

SEQ ID NO: 4596197 - DNA, 13 bp, Homo sapiens
gcagaacagtgat

SEQ ID NO: 4596198 - DNA, 15 bp, Homo sapiens
gcagatccaggacta

SEQ ID NO: 4596199 - DNA, 14 bp, Homo sapiens
gcagcaagcctggc

SEQ ID NO: 4596200 - DNA, 12 bp, Homo sapiens
gcagcaataaag

SEQ ID NO: 4596201 - DNA, 21 bp, Homo sapiens
gcagccaaacccatgaggcaa

SEQ ID NO: 4596202 - DNA, 20 bp, Homo sapiens
gcagccccgtggggttcctc

SEQ ID NO: 4596203 - DNA, 15 bp, Homo sapiens
gcagcttattcacaa

SEQ ID NO: 4596204 - DNA, 14 bp, Homo sapiens
gcaggaggattgct

SEQ ID NO: 4596205 - DNA, 23 bp, Homo sapiens
gcaggaggattgcttgagcccag

SEQ ID NO: 4596206 - DNA, 20 bp, Homo sapiens
gcagggacctaaagggacta

SEQ ID NO: 4596207 - DNA, 23 bp, Homo sapiens
gcagtggtggttttctgttcttt

SEQ ID NO: 4596208 - DNA, 20 bp, Homo sapiens
gcataccacttttgttcttg

SEQ ID NO: 4596209 - DNA, 22 bp, Homo sapiens
gcatactgccttgtttaatggt

SEQ ID NO: 4596210 - DNA, 13 bp, Homo sapiens
gcatactttttaa

SEQ ID NO: 4596211 - DNA, 18 bp, Homo sapiens
gcatctcttgaggccagg

SEQ ID NO: 4596212 - DNA, 22 bp, Homo sapiens
gcatgaagtaatatgcacacat

SEQ ID NO: 4596213 - DNA, 18 bp, Homo sapiens
gcatggtgccccaggacc

SEQ ID NO: 4596214 - DNA, 24 bp, Homo sapiens
gcattatctagatactgtatcatg

SEQ ID NO: 4596215 - DNA, 16 bp, Homo sapiens
gcatttaaaagataca

SEQ ID NO: 4596216 - DNA, 17 bp, Homo sapiens
gcatttaaaagatacag

SEQ ID NO: 4596217 - DNA, 18 bp, Homo sapiens
gcatttaaaagatacagt

SEQ ID NO: 4596218 - DNA, 14 bp, Homo sapiens
gcatttgaaaattt

SEQ ID NO: 4596219 - DNA, 18 bp, Homo sapiens
gcatttgtttgaactgat

SEQ ID NO: 4596220 - DNA, 23 bp, Homo sapiens
gcattttggagagtttcctgaaa

SEQ ID NO: 4596221 - DNA, 12 bp, Homo sapiens
gcattttgtaat

SEQ ID NO: 4596222 - DNA, 22 bp, Homo sapiens
gccaaacccatgaggcaatgtc

SEQ ID NO: 4596223 - DNA, 22 bp, Homo sapiens
gccacgttcttactagtttccc

SEQ ID NO: 4596224 - DNA, 22 bp, Homo sapiens
gccagacatcaacagataaata

SEQ ID NO: 4596225 - DNA, 16 bp, Homo sapiens
gccagagatccaaaag

SEQ ID NO: 4596226 - DNA, 16 bp, Homo sapiens
gccagatccagcctgg

SEQ ID NO: 4596227 - DNA, 16 bp, Homo sapiens
gccagatgctagagcc

SEQ ID NO: 4596228 - DNA, 17 bp, Homo sapiens
gccagatgctagagcct

SEQ ID NO: 4596229 - DNA, 11 bp, Homo sapiens
gccagcctggg

SEQ ID NO: 4596230 - DNA, 22 bp, Homo sapiens
gccagcctgggggctgggagga

SEQ ID NO: 4596231 - DNA, 15 bp, Homo sapiens
gccagctttccctgc

SEQ ID NO: 4596232 - DNA, 20 bp, Homo sapiens
gccaggaatttcccaggacc

SEQ ID NO: 4596233 - DNA, 21 bp, Homo sapiens
gccaggaatttcccaggaccc

SEQ ID NO: 4596234 - DNA, 14 bp, Homo sapiens
gccagggagaagct

SEQ ID NO: 4596235 - DNA, 20 bp, Homo sapiens
gccagggagaagctcctctc

SEQ ID NO: 4596236 - DNA, 19 bp, Homo sapiens
gccaggggggtgaggagct

SEQ ID NO: 4596237 - DNA, 17 bp, Homo sapiens
gccatgatggcaacaga

SEQ ID NO: 4596238 - DNA, 21 bp, Homo sapiens
gccattcacttcataatccag

SEQ ID NO: 4596239 - DNA, 22 bp, Homo sapiens
gccattcacttcataatccagt

SEQ ID NO: 4596240 - DNA, 15 bp, Homo sapiens
gcccagagcccagct

SEQ ID NO: 4596241 - DNA, 17 bp, Homo sapiens
gcccagagcccagctcc

SEQ ID NO: 4596242 - DNA, 12 bp, Homo sapiens
gcccagctccaa

SEQ ID NO: 4596243 - DNA, 11 bp, Homo sapiens
gcccaggagac

SEQ ID NO: 4596244 - DNA, 19 bp, Homo sapiens
gccccagcactaacgtaaa

SEQ ID NO: 4596245 - DNA, 18 bp, Homo sapiens
gccccagcctccctgaag

SEQ ID NO: 4596246 - DNA, 21 bp, Homo sapiens
gccccagcctccctgaagcct

SEQ ID NO: 4596247 - DNA, 17 bp, Homo sapiens
gccccaggaccagctca

SEQ ID NO: 4596248 - DNA, 15 bp, Homo sapiens
gccccggggcctgtt

SEQ ID NO: 4596249 - DNA, 17 bp, Homo sapiens
gccccgtggggttcctc

SEQ ID NO: 4596250 - DNA, 20 bp, Homo sapiens
gccctgactaaactaccacc

SEQ ID NO: 4596251 - DNA, 21 bp, Homo sapiens
gccctgactaaactaccacct

SEQ ID NO: 4596252 - DNA, 22 bp, Homo sapiens
gccctgggggataccagctgag

SEQ ID NO: 4596253 - DNA, 20 bp, Homo sapiens
gccgggaacagacaacagaa

SEQ ID NO: 4596254 - DNA, 14 bp, Homo sapiens
gccgtcaccctggg

SEQ ID NO: 4596255 - DNA, 18 bp, Homo sapiens
gccgttgaagaggaaggg

SEQ ID NO: 4596256 - DNA, 19 bp, Homo sapiens
gcctagcatacgtacacat

SEQ ID NO: 4596257 - DNA, 19 bp, Homo sapiens
gcctcagaggccttgggag

SEQ ID NO: 4596258 - DNA, 18 bp, Homo sapiens
gcctccctgaagcctttg

SEQ ID NO: 4596259 - DNA, 18 bp, Homo sapiens
gcctctcatcaactgaat

SEQ ID NO: 4596260 - DNA, 19 bp, Homo sapiens
gcctctcatcaactgaatg

SEQ ID NO: 4596261 - DNA, 15 bp, Homo sapiens
gcctctgcctgacag

SEQ ID NO: 4596262 - DNA, 21 bp, Homo sapiens
gcctctgcctgacagcatcct

SEQ ID NO: 4596263 - DNA, 21 bp, Homo sapiens
gcctcttccagtcttcctgac

SEQ ID NO: 4596264 - DNA, 17 bp, Homo sapiens
gcctgacagcatcctct

SEQ ID NO: 4596265 - DNA, 16 bp, Homo sapiens
gcctgcacaataaaaa

SEQ ID NO: 4596266 - DNA, 16 bp, Homo sapiens
gcctgcagaatttggg

SEQ ID NO: 4596267 - DNA, 18 bp, Homo sapiens
gcctgccagctgcactga

SEQ ID NO: 4596268 - DNA, 20 bp, Homo sapiens
gcctgcgttttggaagctct

SEQ ID NO: 4596269 - DNA, 16 bp, Homo sapiens
gcctgctccagacctg

SEQ ID NO: 4596270 - DNA, 13 bp, Homo sapiens
gcctggccagaca

SEQ ID NO: 4596271 - DNA, 14 bp, Homo sapiens
gcctggccagacac

SEQ ID NO: 4596272 - DNA, 21 bp, Homo sapiens
gcctggccagacacaggccct

SEQ ID NO: 4596273 - DNA, 22 bp, Homo sapiens
gcctggcccccgacccagctct

SEQ ID NO: 4596274 - DNA, 19 bp, Homo sapiens
gcctgggcaacagagcaag

SEQ ID NO: 4596275 - DNA, 14 bp, Homo sapiens
gcctggggtctgga

SEQ ID NO: 4596276 - DNA, 20 bp, Homo sapiens
gcctggtatatccaaaagct

SEQ ID NO: 4596277 - DNA, 18 bp, Homo sapiens
gcctgtaatcacagctac

SEQ ID NO: 4596278 - DNA, 17 bp, Homo sapiens
gcctgtcttaattttct

SEQ ID NO: 4596279 - DNA, 19 bp, Homo sapiens
gccttaccctcatgttctt

SEQ ID NO: 4596280 - DNA, 19 bp, Homo sapiens
gccttgggagctcatccct

SEQ ID NO: 4596281 - DNA, 16 bp, Homo sapiens
gcgaatctagaggagg

SEQ ID NO: 4596282 - DNA, 21 bp, Homo sapiens
gcgaatctagaggagggggca

SEQ ID NO: 4596283 - DNA, 12 bp, Homo sapiens
gcgacagtgaga

SEQ ID NO: 4596284 - DNA, 22 bp, Homo sapiens
gcgacagtgagactctgtctca

SEQ ID NO: 4596285 - DNA, 22 bp, Homo sapiens
gcgctgtgtaaatgctccagca

SEQ ID NO: 4596286 - DNA, 17 bp, Homo sapiens
gcgtttctatgacacat

SEQ ID NO: 4596287 - DNA, 17 bp, Homo sapiens
gctacccacttctaaat

SEQ ID NO: 4596288 - DNA, 20 bp, Homo sapiens
gctacctttgtattctctcc

SEQ ID NO: 4596289 - DNA, 20 bp, Homo sapiens
gctactatgatttaatttga

SEQ ID NO: 4596290 - DNA, 22 bp, Homo sapiens
gctactatgatttaatttgaaa

SEQ ID NO: 4596291 - DNA, 21 bp, Homo sapiens
gctagaggttcaaagatattt

SEQ ID NO: 4596292 - DNA, 21 bp, Homo sapiens
gctatactgcatactttttaa

SEQ ID NO: 4596293 - DNA, 13 bp, Homo sapiens
gctatgcatttga

SEQ ID NO: 4596294 - DNA, 19 bp, Homo sapiens
gctcagctgtcaaggctca

SEQ ID NO: 4596295 - DNA, 14 bp, Homo sapiens
gctcattaaacttt

SEQ ID NO: 4596296 - DNA, 13 bp, Homo sapiens
gctccagacctga

SEQ ID NO: 4596297 - DNA, 20 bp, Homo sapiens
gctccagacctgatcctgga

SEQ ID NO: 4596298 - DNA, 16 bp, Homo sapiens
gctcctctccccagcc

SEQ ID NO: 4596299 - DNA, 18 bp, Homo sapiens
gctcctctccccagccca

SEQ ID NO: 4596300 - DNA, 23 bp, Homo sapiens
gctcctctccccagcccagagac

SEQ ID NO: 4596301 - DNA, 19 bp, Homo sapiens
gctctaaataaagacgact

SEQ ID NO: 4596302 - DNA, 19 bp, Homo sapiens
gctctctgtgggctggcag

SEQ ID NO: 4596303 - DNA, 22 bp, Homo sapiens
gctctgaagtcacatcacagga

SEQ ID NO: 4596304 - DNA, 14 bp, Homo sapiens
gctgagctctctgt

SEQ ID NO: 4596305 - DNA, 14 bp, Homo sapiens
gctgagggtcgtgg

SEQ ID NO: 4596306 - DNA, 12 bp, Homo sapiens
gctgagtctgaa

SEQ ID NO: 4596307 - DNA, 22 bp, Homo sapiens
gctgcccctcatctctctgccc

SEQ ID NO: 4596308 - DNA, 14 bp, Homo sapiens
gctgctacccagaa

SEQ ID NO: 4596309 - DNA, 17 bp, Homo sapiens
gctggcagtcctggaag

SEQ ID NO: 4596310 - DNA, 13 bp, Homo sapiens
gctggcccagggc

SEQ ID NO: 4596311 - DNA, 17 bp, Homo sapiens
gctggcccagggcccag

SEQ ID NO: 4596312 - DNA, 18 bp, Homo sapiens
gctggcccagggcccaga

SEQ ID NO: 4596313 - DNA, 23 bp, Homo sapiens
gctgtctgttgtattcattgtgg

SEQ ID NO: 4596314 - DNA, 23 bp, Homo sapiens
gctgttaggggttattggtgtaa

SEQ ID NO: 4596315 - DNA, 21 bp, Homo sapiens
gcttactgatatattttacaa

SEQ ID NO: 4596316 - DNA, 21 bp, Homo sapiens
gcttaggagaagtcttctatt

SEQ ID NO: 4596317 - DNA, 14 bp, Homo sapiens
gcttcgtttatttt

SEQ ID NO: 4596318 - DNA, 16 bp, Homo sapiens
gcttcgtttattttca

SEQ ID NO: 4596319 - DNA, 14 bp, Homo sapiens
gcttgagcccagga

SEQ ID NO: 4596320 - DNA, 14 bp, Homo sapiens
gcttgatttttgcc

SEQ ID NO: 4596321 - DNA, 15 bp, Homo sapiens
gcttgggaattttat

SEQ ID NO: 4596322 - DNA, 12 bp, Homo sapiens
gcttgtacataa

SEQ ID NO: 4596323 - DNA, 22 bp, Homo sapiens
gctttcctgaatccaaactaat

SEQ ID NO: 4596324 - DNA, 14 bp, Homo sapiens
gctttggaagtttt

SEQ ID NO: 4596325 - DNA, 17 bp, Homo sapiens
gctttggacctaatcca

SEQ ID NO: 4596326 - DNA, 22 bp, Homo sapiens
ggaaaagagcgcatcaggcctg

SEQ ID NO: 4596327 - DNA, 16 bp, Homo sapiens
ggaaagaaagaaggaa

SEQ ID NO: 4596328 - DNA, 14 bp, Homo sapiens
ggaaagccagcctg

SEQ ID NO: 4596329 - DNA, 22 bp, Homo sapiens
ggaaagccagcctgggggctgg

SEQ ID NO: 4596330 - DNA, 13 bp, Homo sapiens
ggaacagaaggat

SEQ ID NO: 4596331 - DNA, 11 bp, Homo sapiens
ggaacccagac

SEQ ID NO: 4596332 - DNA, 15 bp, Homo sapiens
ggaacccagactcag

SEQ ID NO: 4596333 - DNA, 12 bp, Homo sapiens
ggaacctcagcc

SEQ ID NO: 4596334 - DNA, 14 bp, Homo sapiens
ggaacctcagcctg

SEQ ID NO: 4596335 - DNA, 15 bp, Homo sapiens
ggaacctcagcctgg

SEQ ID NO: 4596336 - DNA, 13 bp, Homo sapiens
ggaactcagatcc

SEQ ID NO: 4596337 - DNA, 19 bp, Homo sapiens
ggaactcagatccagggac

SEQ ID NO: 4596338 - DNA, 20 bp, Homo sapiens
ggaactcagatccagggaca

SEQ ID NO: 4596339 - DNA, 17 bp, Homo sapiens
ggaagcctcagaggcct

SEQ ID NO: 4596340 - DNA, 14 bp, Homo sapiens
ggaagggcaaaacc

SEQ ID NO: 4596341 - DNA, 20 bp, Homo sapiens
ggaagtgacggtttaatggg

SEQ ID NO: 4596342 - DNA, 16 bp, Homo sapiens
ggaatatataaccagt

SEQ ID NO: 4596343 - DNA, 17 bp, Homo sapiens
ggaatttcccaggaccc

SEQ ID NO: 4596344 - DNA, 22 bp, Homo sapiens
ggacacggggcagtggcaacct

SEQ ID NO: 4596345 - DNA, 15 bp, Homo sapiens
ggacagaccagccct

SEQ ID NO: 4596346 - DNA, 16 bp, Homo sapiens
ggacagaggccccagc

SEQ ID NO: 4596347 - DNA, 18 bp, Homo sapiens
ggacagaggccccagcct

SEQ ID NO: 4596348 - DNA, 20 bp, Homo sapiens
ggacagaggccccagcctcc

SEQ ID NO: 4596349 - DNA, 14 bp, Homo sapiens
ggacagccccaccc

SEQ ID NO: 4596350 - DNA, 20 bp, Homo sapiens
ggactatatttgggcctgct

SEQ ID NO: 4596351 - DNA, 13 bp, Homo sapiens
ggactctaaagtc

SEQ ID NO: 4596352 - DNA, 21 bp, Homo sapiens
ggacttcctgtccagctccaa

SEQ ID NO: 4596353 - DNA, 15 bp, Homo sapiens
ggagaagccaggaat

SEQ ID NO: 4596354 - DNA, 20 bp, Homo sapiens
ggagaagtcttctatttatt

SEQ ID NO: 4596355 - DNA, 18 bp, Homo sapiens
ggagagtttcctgaaaca

SEQ ID NO: 4596356 - DNA, 20 bp, Homo sapiens
ggagatttacaactggggga

SEQ ID NO: 4596357 - DNA, 12 bp, Homo sapiens
ggagcccactgt

SEQ ID NO: 4596358 - DNA, 14 bp, Homo sapiens
ggagcccactgtcc

SEQ ID NO: 4596359 - DNA, 18 bp, Homo sapiens
ggagcccactgtcctggg

SEQ ID NO: 4596360 - DNA, 23 bp, Homo sapiens
ggagcccactgtcctgggcctgc

SEQ ID NO: 4596361 - DNA, 19 bp, Homo sapiens
ggaggcccagttcaccctg

SEQ ID NO: 4596362 - DNA, 14 bp, Homo sapiens
ggaggctgaggcag

SEQ ID NO: 4596363 - DNA, 13 bp, Homo sapiens
ggagggaaagcca

SEQ ID NO: 4596364 - DNA, 15 bp, Homo sapiens
ggagggaaagccagc

SEQ ID NO: 4596365 - DNA, 17 bp, Homo sapiens
ggagggaaagccagcct

SEQ ID NO: 4596366 - DNA, 16 bp, Homo sapiens
ggagtcccaaggaaag

SEQ ID NO: 4596367 - DNA, 15 bp, Homo sapiens
ggagttaagacctgg

SEQ ID NO: 4596368 - DNA, 16 bp, Homo sapiens
ggagttaagacctggc

SEQ ID NO: 4596369 - DNA, 15 bp, Homo sapiens
ggagttcgaggctgc

SEQ ID NO: 4596370 - DNA, 20 bp, Homo sapiens
ggagttcgaggctgcagtca

SEQ ID NO: 4596371 - DNA, 21 bp, Homo sapiens
ggagttcgaggctgcagtcag

SEQ ID NO: 4596372 - DNA, 17 bp, Homo sapiens
ggagttgatctggaacc

SEQ ID NO: 4596373 - DNA, 20 bp, Homo sapiens
ggataccagctgagtctgaa

SEQ ID NO: 4596374 - DNA, 13 bp, Homo sapiens
ggatagatgctgg

SEQ ID NO: 4596375 - DNA, 18 bp, Homo sapiens
ggatagatgctggcccag

SEQ ID NO: 4596376 - DNA, 20 bp, Homo sapiens
ggatatagttttacttttaa

SEQ ID NO: 4596377 - DNA, 18 bp, Homo sapiens
ggatgaatgaggtcccag

SEQ ID NO: 4596378 - DNA, 22 bp, Homo sapiens
ggatgaatgaggtcccaggcag

SEQ ID NO: 4596379 - DNA, 22 bp, Homo sapiens
ggatgggggaactcagatccag

SEQ ID NO: 4596380 - DNA, 22 bp, Homo sapiens
ggatgttgaaaaagttctgcag

SEQ ID NO: 4596381 - DNA, 17 bp, Homo sapiens
ggattgcttgagcccag

SEQ ID NO: 4596382 - DNA, 15 bp, Homo sapiens
ggattgtaaaatggt

SEQ ID NO: 4596383 - DNA, 23 bp, Homo sapiens
ggattgtgcctaatgtgtttgag

SEQ ID NO: 4596384 - DNA, 17 bp, Homo sapiens
ggatttaacagaaatgt

SEQ ID NO: 4596385 - DNA, 12 bp, Homo sapiens
ggcaacagagca

SEQ ID NO: 4596386 - DNA, 19 bp, Homo sapiens
ggcaacagagcaagatcct

SEQ ID NO: 4596387 - DNA, 20 bp, Homo sapiens
ggcaaccaataaaagccaga

SEQ ID NO: 4596388 - DNA, 19 bp, Homo sapiens
ggcaaccttgtctctatgc

SEQ ID NO: 4596389 - DNA, 20 bp, Homo sapiens
ggcacaggccgtcaccctgg

SEQ ID NO: 4596390 - DNA, 22 bp, Homo sapiens
ggcaccactgcactccagcctg

SEQ ID NO: 4596391 - DNA, 13 bp, Homo sapiens
ggcaccagacacc

SEQ ID NO: 4596392 - DNA, 18 bp, Homo sapiens
ggcaccagacacccagga

SEQ ID NO: 4596393 - DNA, 19 bp, Homo sapiens
ggcacctaatccaggcaga

SEQ ID NO: 4596394 - DNA, 14 bp, Homo sapiens
ggcagagaatcata

SEQ ID NO: 4596395 - DNA, 21 bp, Homo sapiens
ggcagaggttgcagtgagccg

SEQ ID NO: 4596396 - DNA, 17 bp, Homo sapiens
ggcagcatagcaagaca

SEQ ID NO: 4596397 - DNA, 20 bp, Homo sapiens
ggcagccaaacccatgaggc

SEQ ID NO: 4596398 - DNA, 15 bp, Homo sapiens
ggcagctctggacag

SEQ ID NO: 4596399 - DNA, 12 bp, Homo sapiens
ggcaggctgagg

SEQ ID NO: 4596400 - DNA, 14 bp, Homo sapiens
ggcagggacctaaa

SEQ ID NO: 4596401 - DNA, 23 bp, Homo sapiens
ggcatttgtttctttctctgagg

SEQ ID NO: 4596402 - DNA, 21 bp, Homo sapiens
ggccacagccactaatcagga

SEQ ID NO: 4596403 - DNA, 16 bp, Homo sapiens
ggccagacacaggccc

SEQ ID NO: 4596404 - DNA, 17 bp, Homo sapiens
ggccagatccagcctgg

SEQ ID NO: 4596405 - DNA, 22 bp, Homo sapiens
ggccatgatggcaacagatctg

SEQ ID NO: 4596406 - DNA, 13 bp, Homo sapiens
ggccatggcagaa

SEQ ID NO: 4596407 - DNA, 13 bp, Homo sapiens
ggcccagagccca

SEQ ID NO: 4596408 - DNA, 14 bp, Homo sapiens
ggcccagagcccag

SEQ ID NO: 4596409 - DNA, 15 bp, Homo sapiens
ggcccagagcccagc

SEQ ID NO: 4596410 - DNA, 15 bp, Homo sapiens
ggcccagggcccaga

SEQ ID NO: 4596411 - DNA, 21 bp, Homo sapiens
ggcccagggcccagagcccag

SEQ ID NO: 4596412 - DNA, 22 bp, Homo sapiens
ggcccagggcccagagcccagc

SEQ ID NO: 4596413 - DNA, 20 bp, Homo sapiens
ggccctccctgttccccaga

SEQ ID NO: 4596414 - DNA, 22 bp, Homo sapiens
ggcctagcatacgtacacattt

SEQ ID NO: 4596415 - DNA, 23 bp, Homo sapiens
ggcctagcatacgtacacatttt

SEQ ID NO: 4596416 - DNA, 17 bp, Homo sapiens
ggcctgctccagacctg

SEQ ID NO: 4596417 - DNA, 14 bp, Homo sapiens
ggctacctttgtat

SEQ ID NO: 4596418 - DNA, 14 bp, Homo sapiens
ggctaggggctggg

SEQ ID NO: 4596419 - DNA, 20 bp, Homo sapiens
ggctagtatcaaaagaaaga

SEQ ID NO: 4596420 - DNA, 12 bp, Homo sapiens
ggctatgcattt

SEQ ID NO: 4596421 - DNA, 14 bp, Homo sapiens
ggctatgcatttga

SEQ ID NO: 4596422 - DNA, 19 bp, Homo sapiens
ggctggatgtggtggcata

SEQ ID NO: 4596423 - DNA, 10 bp, Homo sapiens
ggcttttgtg

SEQ ID NO: 4596424 - DNA, 14 bp, Homo sapiens
ggcttttgtgcatt

SEQ ID NO: 4596425 - DNA, 13 bp, Homo sapiens
gggaaagccagcc

SEQ ID NO: 4596426 - DNA, 15 bp, Homo sapiens
gggaaagccagcctg

SEQ ID NO: 4596427 - DNA, 16 bp, Homo sapiens
gggaaagccagcctgg

SEQ ID NO: 4596428 - DNA, 21 bp, Homo sapiens
gggaaagccagcctgggggct

SEQ ID NO: 4596429 - DNA, 16 bp, Homo sapiens
gggaacactgagaaag

SEQ ID NO: 4596430 - DNA, 21 bp, Homo sapiens
gggaacactgagaaagaggca

SEQ ID NO: 4596431 - DNA, 19 bp, Homo sapiens
gggaacagacaacagaagt

SEQ ID NO: 4596432 - DNA, 16 bp, Homo sapiens
gggaactcagatccag

SEQ ID NO: 4596433 - DNA, 23 bp, Homo sapiens
gggaaggatacaaaagcatgtga

SEQ ID NO: 4596434 - DNA, 19 bp, Homo sapiens
gggacagaggccccagcct

SEQ ID NO: 4596435 - DNA, 18 bp, Homo sapiens
gggactacctctgtgcct

SEQ ID NO: 4596436 - DNA, 19 bp, Homo sapiens
gggagcccactgtcctggg

SEQ ID NO: 4596437 - DNA, 21 bp, Homo sapiens
gggagcccactgtcctgggcc

SEQ ID NO: 4596438 - DNA, 13 bp, Homo sapiens
gggaggatcctgg

SEQ ID NO: 4596439 - DNA, 11 bp, Homo sapiens
gggaggcagag

SEQ ID NO: 4596440 - DNA, 15 bp, Homo sapiens
gggagttaagacctg

SEQ ID NO: 4596441 - DNA, 20 bp, Homo sapiens
gggatccctcccccccatgc

SEQ ID NO: 4596442 - DNA, 21 bp, Homo sapiens
gggcaggctgagggtcgtggg

SEQ ID NO: 4596443 - DNA, 14 bp, Homo sapiens
gggccagagccagg

SEQ ID NO: 4596444 - DNA, 16 bp, Homo sapiens
gggccagatccagcct

SEQ ID NO: 4596445 - DNA, 17 bp, Homo sapiens
gggccagatccagcctg

SEQ ID NO: 4596446 - DNA, 18 bp, Homo sapiens
gggccagatccagcctgg

SEQ ID NO: 4596447 - DNA, 20 bp, Homo sapiens
gggcccagagcccagctcca

SEQ ID NO: 4596448 - DNA, 13 bp, Homo sapiens
gggcctgctccag

SEQ ID NO: 4596449 - DNA, 14 bp, Homo sapiens
gggctaggggctgg

SEQ ID NO: 4596450 - DNA, 17 bp, Homo sapiens
ggggaacactgagaaag

SEQ ID NO: 4596451 - DNA, 15 bp, Homo sapiens
ggggacagaccagcc

SEQ ID NO: 4596452 - DNA, 22 bp, Homo sapiens
ggggacagaccagcccttcccc

SEQ ID NO: 4596453 - DNA, 13 bp, Homo sapiens
ggggccagatcca

SEQ ID NO: 4596454 - DNA, 17 bp, Homo sapiens
ggggccagatccagcct

SEQ ID NO: 4596455 - DNA, 14 bp, Homo sapiens
ggggccttgctgga

SEQ ID NO: 4596456 - DNA, 19 bp, Homo sapiens
gggggaacactgagaaaga

SEQ ID NO: 4596457 - DNA, 22 bp, Homo sapiens
gggggaacactgagaaagaggc

SEQ ID NO: 4596458 - DNA, 17 bp, Homo sapiens
gggggaactcagatcca

SEQ ID NO: 4596459 - DNA, 14 bp, Homo sapiens
ggggtgaggagctg

SEQ ID NO: 4596460 - DNA, 15 bp, Homo sapiens
ggggtgaggagctgg

SEQ ID NO: 4596461 - DNA, 19 bp, Homo sapiens
gggtcgtgggaaaggggag

SEQ ID NO: 4596462 - DNA, 20 bp, Homo sapiens
gggtctggagttgatctgga

SEQ ID NO: 4596463 - DNA, 15 bp, Homo sapiens
gggtggggacagacc

SEQ ID NO: 4596464 - DNA, 21 bp, Homo sapiens
gggttctgcctgccagctgca

SEQ ID NO: 4596465 - DNA, 23 bp, Homo sapiens
ggtaagaagccgggaacagacaa

SEQ ID NO: 4596466 - DNA, 15 bp, Homo sapiens
ggtatggaactctct

SEQ ID NO: 4596467 - DNA, 18 bp, Homo sapiens
ggtcgcttgggaatttta

SEQ ID NO: 4596468 - DNA, 14 bp, Homo sapiens
ggtcggaaaacatg

SEQ ID NO: 4596469 - DNA, 16 bp, Homo sapiens
ggtcgtgggaaagggg

SEQ ID NO: 4596470 - DNA, 23 bp, Homo sapiens
ggtgccaatttcaagttccaagt

SEQ ID NO: 4596471 - DNA, 16 bp, Homo sapiens
ggtgccccaggaccag

SEQ ID NO: 4596472 - DNA, 20 bp, Homo sapiens
ggtgccccaggaccagctca

SEQ ID NO: 4596473 - DNA, 21 bp, Homo sapiens
ggtgccccaggaccagctcag

SEQ ID NO: 4596474 - DNA, 23 bp, Homo sapiens
ggtgccccaggaccagctcagga

SEQ ID NO: 4596475 - DNA, 22 bp, Homo sapiens
ggtgctaaatggtcgcccagga

SEQ ID NO: 4596476 - DNA, 23 bp, Homo sapiens
ggtgctaaatggtcgcccaggag

SEQ ID NO: 4596477 - DNA, 20 bp, Homo sapiens
ggtgctgacggccagggaga

SEQ ID NO: 4596478 - DNA, 13 bp, Homo sapiens
ggtggacacacaa

SEQ ID NO: 4596479 - DNA, 18 bp, Homo sapiens
ggtggtttcagaaatgtg

SEQ ID NO: 4596480 - DNA, 22 bp, Homo sapiens
ggtttacattcatctcattcca

SEQ ID NO: 4596481 - DNA, 16 bp, Homo sapiens
ggtttagaaagcttgc

SEQ ID NO: 4596482 - DNA, 12 bp, Homo sapiens
ggtttcagaaat

SEQ ID NO: 4596483 - DNA, 13 bp, Homo sapiens
ggtttcagaaatg

SEQ ID NO: 4596484 - DNA, 15 bp, Homo sapiens
ggtttcagaaatgtg

SEQ ID NO: 4596485 - DNA, 13 bp, Homo sapiens
ggttttaaacttt

SEQ ID NO: 4596486 - DNA, 13 bp, Homo sapiens
ggttttctgttct

SEQ ID NO: 4596487 - DNA, 16 bp, Homo sapiens
gtaaaagcattttgta

SEQ ID NO: 4596488 - DNA, 20 bp, Homo sapiens
gtaaactgtgtattccaaga

SEQ ID NO: 4596489 - DNA, 14 bp, Homo sapiens
gtaaatgctccagc

SEQ ID NO: 4596490 - DNA, 20 bp, Homo sapiens
gtaaatgggggtgcatttga

SEQ ID NO: 4596491 - DNA, 16 bp, Homo sapiens
gtaaatggtatgtcat

SEQ ID NO: 4596492 - DNA, 15 bp, Homo sapiens
gtaaattaactttta

SEQ ID NO: 4596493 - DNA, 16 bp, Homo sapiens
gtaaattaacttttat

SEQ ID NO: 4596494 - DNA, 21 bp, Homo sapiens
gtaaattaacttttataaact

SEQ ID NO: 4596495 - DNA, 13 bp, Homo sapiens
gtaactaaaataa

SEQ ID NO: 4596496 - DNA, 22 bp, Homo sapiens
gtaactaaaataattttgtaat

SEQ ID NO: 4596497 - DNA, 16 bp, Homo sapiens
gtaagaaatacagact

SEQ ID NO: 4596498 - DNA, 16 bp, Homo sapiens
gtaatatgcacacatt

SEQ ID NO: 4596499 - DNA, 23 bp, Homo sapiens
gtaatttgagagaaatatgaaga

SEQ ID NO: 4596500 - DNA, 17 bp, Homo sapiens
gtaatttgtgatacaat

SEQ ID NO: 4596501 - DNA, 20 bp, Homo sapiens
gtaatttgtgatacaatgct

SEQ ID NO: 4596502 - DNA, 14 bp, Homo sapiens
gtaattttgtgtaa

SEQ ID NO: 4596503 - DNA, 20 bp, Homo sapiens
gtaattttgtgtaagaaata

SEQ ID NO: 4596504 - DNA, 13 bp, Homo sapiens
gtacaacttctgg

SEQ ID NO: 4596505 - DNA, 19 bp, Homo sapiens
gtacactgtttcaaacttt

SEQ ID NO: 4596506 - DNA, 21 bp, Homo sapiens
gtacactgtttcaaactttac

SEQ ID NO: 4596507 - DNA, 14 bp, Homo sapiens
gtacataactgaaa

SEQ ID NO: 4596508 - DNA, 20 bp, Homo sapiens
gtacataatgcgtgcatacc

SEQ ID NO: 4596509 - DNA, 14 bp, Homo sapiens
gtacatgaaaacac

SEQ ID NO: 4596510 - DNA, 17 bp, Homo sapiens
gtacatgaaaacacatt

SEQ ID NO: 4596511 - DNA, 18 bp, Homo sapiens
gtacatgaaaacacattt

SEQ ID NO: 4596512 - DNA, 19 bp, Homo sapiens
gtacatgaaaacacatttt

SEQ ID NO: 4596513 - DNA, 21 bp, Homo sapiens
gtacctcttgagccttgaact

SEQ ID NO: 4596514 - DNA, 14 bp, Homo sapiens
gtacgttgtgcatt

SEQ ID NO: 4596515 - DNA, 16 bp, Homo sapiens
gtacgttgtgcatttg

SEQ ID NO: 4596516 - DNA, 17 bp, Homo sapiens
gtacgttgtgcatttgg

SEQ ID NO: 4596517 - DNA, 22 bp, Homo sapiens
gtactttcatattttaaacaga

SEQ ID NO: 4596518 - DNA, 15 bp, Homo sapiens
gtagaggagaaactg

SEQ ID NO: 4596519 - DNA, 14 bp, Homo sapiens
gtataaagaaaagt

SEQ ID NO: 4596520 - DNA, 14 bp, Homo sapiens
gtatcaaatacatt

SEQ ID NO: 4596521 - DNA, 15 bp, Homo sapiens
gtatccctactgtaa

SEQ ID NO: 4596522 - DNA, 15 bp, Homo sapiens
gtatgaggcatttgt

SEQ ID NO: 4596523 - DNA, 21 bp, Homo sapiens
gtcaagaatagcattgtaaaa

SEQ ID NO: 4596524 - DNA, 15 bp, Homo sapiens
gtcacatcacaggac

SEQ ID NO: 4596525 - DNA, 15 bp, Homo sapiens
gtcaggaacagaagg

SEQ ID NO: 4596526 - DNA, 22 bp, Homo sapiens
gtcagtcatgatggcaccactg

SEQ ID NO: 4596527 - DNA, 16 bp, Homo sapiens
gtcagttgttatttat

SEQ ID NO: 4596528 - DNA, 19 bp, Homo sapiens
gtcattatgttaatatttc

SEQ ID NO: 4596529 - DNA, 16 bp, Homo sapiens
gtcccaaggaaagccc

SEQ ID NO: 4596530 - DNA, 23 bp, Homo sapiens
gtcccaaggaaagccccagcact

SEQ ID NO: 4596531 - DNA, 11 bp, Homo sapiens
gtccccccacc

SEQ ID NO: 4596532 - DNA, 13 bp, Homo sapiens
gtccccccaccct

SEQ ID NO: 4596533 - DNA, 14 bp, Homo sapiens
gtcctcagccttgc

SEQ ID NO: 4596534 - DNA, 13 bp, Homo sapiens
gtcctgggcctgc

SEQ ID NO: 4596535 - DNA, 12 bp, Homo sapiens
gtcgcccaggag

SEQ ID NO: 4596536 - DNA, 15 bp, Homo sapiens
gtcgtgggaaagggg

SEQ ID NO: 4596537 - DNA, 12 bp, Homo sapiens
gtctaaaaacac

SEQ ID NO: 4596538 - DNA, 17 bp, Homo sapiens
gtctctatgccagctca

SEQ ID NO: 4596539 - DNA, 23 bp, Homo sapiens
gtctctatgccagctcagtccca

SEQ ID NO: 4596540 - DNA, 13 bp, Homo sapiens
gtctgttgattaa

SEQ ID NO: 4596541 - DNA, 18 bp, Homo sapiens
gtcttcctgacactttaa

SEQ ID NO: 4596542 - DNA, 12 bp, Homo sapiens
gtcttctattta

SEQ ID NO: 4596543 - DNA, 17 bp, Homo sapiens
gtcttctatttatttat

SEQ ID NO: 4596544 - DNA, 17 bp, Homo sapiens
gtgaaatcaaaggtgct

SEQ ID NO: 4596545 - DNA, 23 bp, Homo sapiens
gtgaagacaatgacttactgtac

SEQ ID NO: 4596546 - DNA, 12 bp, Homo sapiens
gtgaaggaccct

SEQ ID NO: 4596547 - DNA, 14 bp, Homo sapiens
gtgaagtgaagaca

SEQ ID NO: 4596548 - DNA, 15 bp, Homo sapiens
gtgactgaatttctt

SEQ ID NO: 4596549 - DNA, 15 bp, Homo sapiens
gtgatacaatgctgt

SEQ ID NO: 4596550 - DNA, 23 bp, Homo sapiens
gtgcaataaatctgacccagtgc

SEQ ID NO: 4596551 - DNA, 22 bp, Homo sapiens
gtgcataccacttttgttcttg

SEQ ID NO: 4596552 - DNA, 15 bp, Homo sapiens
gtgcattatctagat

SEQ ID NO: 4596553 - DNA, 21 bp, Homo sapiens
gtgcatttgaggtctgttctt

SEQ ID NO: 4596554 - DNA, 15 bp, Homo sapiens
gtgcatttggtggtt

SEQ ID NO: 4596555 - DNA, 21 bp, Homo sapiens
gtgcatttggtggtttcagaa

SEQ ID NO: 4596556 - DNA, 14 bp, Homo sapiens
gtgccaatttcaag

SEQ ID NO: 4596557 - DNA, 21 bp, Homo sapiens
gtgccaatttcaagttccaag

SEQ ID NO: 4596558 - DNA, 12 bp, Homo sapiens
gtgccccaggac

SEQ ID NO: 4596559 - DNA, 14 bp, Homo sapiens
gtgccccaggacca

SEQ ID NO: 4596560 - DNA, 19 bp, Homo sapiens
gtgccccaggaccagctca

SEQ ID NO: 4596561 - DNA, 21 bp, Homo sapiens
gtgccccaggaccagctcagg

SEQ ID NO: 4596562 - DNA, 13 bp, Homo sapiens
gtgcccccactga

SEQ ID NO: 4596563 - DNA, 15 bp, Homo sapiens
gtgcccccactgacc

SEQ ID NO: 4596564 - DNA, 21 bp, Homo sapiens
gtgctatactgcatacttttt

SEQ ID NO: 4596565 - DNA, 15 bp, Homo sapiens
gtgctgacggccagg

SEQ ID NO: 4596566 - DNA, 18 bp, Homo sapiens
gtgctgacggccagggag

SEQ ID NO: 4596567 - DNA, 19 bp, Homo sapiens
gtggatttaacagaaatgt

SEQ ID NO: 4596568 - DNA, 23 bp, Homo sapiens
gtggcttttctggaatggaattg

SEQ ID NO: 4596569 - DNA, 16 bp, Homo sapiens
gtgggaaaggggagta

SEQ ID NO: 4596570 - DNA, 23 bp, Homo sapiens
gtggtggcatacgcctgtagtcc

SEQ ID NO: 4596571 - DNA, 13 bp, Homo sapiens
gtgtattccaaga

SEQ ID NO: 4596572 - DNA, 20 bp, Homo sapiens
gtgtattccaagacatgtct

SEQ ID NO: 4596573 - DNA, 12 bp, Homo sapiens
gtgtatttattt

SEQ ID NO: 4596574 - DNA, 21 bp, Homo sapiens
gtgtgaccactgcagaagaca

SEQ ID NO: 4596575 - DNA, 12 bp, Homo sapiens
gtgttactaagt

SEQ ID NO: 4596576 - DNA, 18 bp, Homo sapiens
gttaatcattaggtgtga

SEQ ID NO: 4596577 - DNA, 22 bp, Homo sapiens
gttactaagtttttatggcttt

SEQ ID NO: 4596578 - DNA, 16 bp, Homo sapiens
gttagtttctttggga

SEQ ID NO: 4596579 - DNA, 13 bp, Homo sapiens
gttatgctgtgac

SEQ ID NO: 4596580 - DNA, 16 bp, Homo sapiens
gttcaattatctttat

SEQ ID NO: 4596581 - DNA, 20 bp, Homo sapiens
gttcaggagtcccaaggaaa

SEQ ID NO: 4596582 - DNA, 12 bp, Homo sapiens
gttccccagaga

SEQ ID NO: 4596583 - DNA, 20 bp, Homo sapiens
gttctccagtcattatgtta

SEQ ID NO: 4596584 - DNA, 13 bp, Homo sapiens
gttctgcctgcca

SEQ ID NO: 4596585 - DNA, 15 bp, Homo sapiens
gttctgcctgccagc

SEQ ID NO: 4596586 - DNA, 19 bp, Homo sapiens
gttctgcctgccagctgca

SEQ ID NO: 4596587 - DNA, 23 bp, Homo sapiens
gttctgcctgccagctgcactga

SEQ ID NO: 4596588 - DNA, 14 bp, Homo sapiens
gttcttaattctta

SEQ ID NO: 4596589 - DNA, 15 bp, Homo sapiens
gttcttggtttgtaa

SEQ ID NO: 4596590 - DNA, 13 bp, Homo sapiens
gttctttccaaag

SEQ ID NO: 4596591 - DNA, 18 bp, Homo sapiens
gttctttccaaagtacac

SEQ ID NO: 4596592 - DNA, 15 bp, Homo sapiens
gttctttgggccaga

SEQ ID NO: 4596593 - DNA, 22 bp, Homo sapiens
gttctttgggccagacatgcca

SEQ ID NO: 4596594 - DNA, 19 bp, Homo sapiens
gttgatctggaacccagac

SEQ ID NO: 4596595 - DNA, 16 bp, Homo sapiens
gttgcctaataaacat

SEQ ID NO: 4596596 - DNA, 18 bp, Homo sapiens
gttggagggaaagccagc

SEQ ID NO: 4596597 - DNA, 21 bp, Homo sapiens
gttggagggaaagccagcctg

SEQ ID NO: 4596598 - DNA, 22 bp, Homo sapiens
gttggaggtttcacttgcacat

SEQ ID NO: 4596599 - DNA, 14 bp, Homo sapiens
gttgtaattgcatt

SEQ ID NO: 4596600 - DNA, 18 bp, Homo sapiens
gttgtcaagaatagcatt

SEQ ID NO: 4596601 - DNA, 17 bp, Homo sapiens
gtttaatggtagtttta

SEQ ID NO: 4596602 - DNA, 17 bp, Homo sapiens
gtttacaggtggacaca

SEQ ID NO: 4596603 - DNA, 20 bp, Homo sapiens
gtttaggatgttgaaaaagt

SEQ ID NO: 4596604 - DNA, 19 bp, Homo sapiens
gtttattttcaagaataat

SEQ ID NO: 4596605 - DNA, 16 bp, Homo sapiens
gtttcaaactttacta

SEQ ID NO: 4596606 - DNA, 11 bp, Homo sapiens
gtttcagaaat

SEQ ID NO: 4596607 - DNA, 12 bp, Homo sapiens
gtttctgactct

SEQ ID NO: 4596608 - DNA, 17 bp, Homo sapiens
gtttctgactctgagct

SEQ ID NO: 4596609 - DNA, 22 bp, Homo sapiens
gtttgattaaattcttgcaaag

SEQ ID NO: 4596610 - DNA, 17 bp, Homo sapiens
gtttgtaaattaacttt

SEQ ID NO: 4596611 - DNA, 14 bp, Homo sapiens
gttttctgttcttt

SEQ ID NO: 4596612 - DNA, 17 bp, Homo sapiens
gttttgaagattctatg

SEQ ID NO: 4596613 - DNA, 22 bp, Homo sapiens
gtttttatggcttttgtgcatt

SEQ ID NO: 4596614 - DNA, 12 bp, Homo sapiens
gtttttcacatt

SEQ ID NO: 4596615 - DNA, 22 bp, Homo sapiens
taaaaacagatttggaaagact

SEQ ID NO: 4596616 - DNA, 14 bp, Homo sapiens
taaaaagatcactt

SEQ ID NO: 4596617 - DNA, 18 bp, Homo sapiens
taaaaagattgaagtatt

SEQ ID NO: 4596618 - DNA, 21 bp, Homo sapiens
taaaaatctcaaatttctaaa

SEQ ID NO: 4596619 - DNA, 15 bp, Homo sapiens
taaaaatggtttaaa

SEQ ID NO: 4596620 - DNA, 15 bp, Homo sapiens
taaaacattaaaata

SEQ ID NO: 4596621 - DNA, 14 bp, Homo sapiens
taaaataattttgt

SEQ ID NO: 4596622 - DNA, 16 bp, Homo sapiens
taaaataattttgtaa

SEQ ID NO: 4596623 - DNA, 21 bp, Homo sapiens
taaaataattttgtaatgtat

SEQ ID NO: 4596624 - DNA, 22 bp, Homo sapiens
taaaataccagccagtaaatgg

SEQ ID NO: 4596625 - DNA, 18 bp, Homo sapiens
taaacaagaccacgtttc

SEQ ID NO: 4596626 - DNA, 23 bp, Homo sapiens
taaacaagaccacgtttctaaag

SEQ ID NO: 4596627 - DNA, 19 bp, Homo sapiens
taaaccaaggctagaacca

SEQ ID NO: 4596628 - DNA, 15 bp, Homo sapiens
taaactaccacctca

SEQ ID NO: 4596629 - DNA, 16 bp, Homo sapiens
taaactttaccttttt

SEQ ID NO: 4596630 - DNA, 19 bp, Homo sapiens
taaagatgagctttgtcta

SEQ ID NO: 4596631 - DNA, 17 bp, Homo sapiens
taaagcagcgtttctat

SEQ ID NO: 4596632 - DNA, 19 bp, Homo sapiens
taaagcagcgtttctatga

SEQ ID NO: 4596633 - DNA, 18 bp, Homo sapiens
taaagggactacctctgt

SEQ ID NO: 4596634 - DNA, 22 bp, Homo sapiens
taaaggttacaagcctgcacaa

SEQ ID NO: 4596635 - DNA, 20 bp, Homo sapiens
taaagtgtatttttttacta

SEQ ID NO: 4596636 - DNA, 21 bp, Homo sapiens
taaagtgtatttttttactaa

SEQ ID NO: 4596637 - DNA, 23 bp, Homo sapiens
taaagtgtatttttttactaata

SEQ ID NO: 4596638 - DNA, 14 bp, Homo sapiens
taaataatttattt

SEQ ID NO: 4596639 - DNA, 22 bp, Homo sapiens
taaatatcccttggacatttta

SEQ ID NO: 4596640 - DNA, 19 bp, Homo sapiens
taaatctccaaaataaaac

SEQ ID NO: 4596641 - DNA, 17 bp, Homo sapiens
taaatgctccagcactc

SEQ ID NO: 4596642 - DNA, 16 bp, Homo sapiens
taaatggaaccactct

SEQ ID NO: 4596643 - DNA, 17 bp, Homo sapiens
taaatggtcgcccagga

SEQ ID NO: 4596644 - DNA, 14 bp, Homo sapiens
taaattaactttta

SEQ ID NO: 4596645 - DNA, 18 bp, Homo sapiens
taaattaacttttataaa

SEQ ID NO: 4596646 - DNA, 17 bp, Homo sapiens
taaattcttgcaaagta

SEQ ID NO: 4596647 - DNA, 22 bp, Homo sapiens
taaattcttgcaaagtatccct

SEQ ID NO: 4596648 - DNA, 21 bp, Homo sapiens
taaattgataacatggaaatg

SEQ ID NO: 4596649 - DNA, 13 bp, Homo sapiens
taaattgttgtaa

SEQ ID NO: 4596650 - DNA, 11 bp, Homo sapiens
taacagaaatg

SEQ ID NO: 4596651 - DNA, 15 bp, Homo sapiens
taacattcttttgtt

SEQ ID NO: 4596652 - DNA, 16 bp, Homo sapiens
taaccagcagaaatgc

SEQ ID NO: 4596653 - DNA, 13 bp, Homo sapiens
taaccccagctcc

SEQ ID NO: 4596654 - DNA, 19 bp, Homo sapiens
taaccccagctccctagga

SEQ ID NO: 4596655 - DNA, 15 bp, Homo sapiens
taacgtaaatacaca

SEQ ID NO: 4596656 - DNA, 13 bp, Homo sapiens
taacttcacatat

SEQ ID NO: 4596657 - DNA, 21 bp, Homo sapiens
taacttttataaactttacct

SEQ ID NO: 4596658 - DNA, 14 bp, Homo sapiens
taagaacctggaac

SEQ ID NO: 4596659 - DNA, 17 bp, Homo sapiens
taagacctggcagctct

SEQ ID NO: 4596660 - DNA, 18 bp, Homo sapiens
taagacctggcagctctg

SEQ ID NO: 4596661 - DNA, 14 bp, Homo sapiens
taagcaaaatgtga

SEQ ID NO: 4596662 - DNA, 21 bp, Homo sapiens
taagcaaaatgtgatatgtac

SEQ ID NO: 4596663 - DNA, 15 bp, Homo sapiens
taagtgaaaatatag

SEQ ID NO: 4596664 - DNA, 13 bp, Homo sapiens
taagtgaaataag

SEQ ID NO: 4596665 - DNA, 22 bp, Homo sapiens
taagtgctgcatttaaaagata

SEQ ID NO: 4596666 - DNA, 14 bp, Homo sapiens
taatacaccactac

SEQ ID NO: 4596667 - DNA, 21 bp, Homo sapiens
taatacaccactacattctgt

SEQ ID NO: 4596668 - DNA, 18 bp, Homo sapiens
taatacagcaacaattta

SEQ ID NO: 4596669 - DNA, 18 bp, Homo sapiens
taatatgcacacattttt

SEQ ID NO: 4596670 - DNA, 14 bp, Homo sapiens
taatatttaatgga

SEQ ID NO: 4596671 - DNA, 18 bp, Homo sapiens
taatcacgctttcctgaa

SEQ ID NO: 4596672 - DNA, 22 bp, Homo sapiens
taatccaggcagatccaggact

SEQ ID NO: 4596673 - DNA, 14 bp, Homo sapiens
taatcttctgcctt

SEQ ID NO: 4596674 - DNA, 15 bp, Homo sapiens
taatcttctgccttc

SEQ ID NO: 4596675 - DNA, 22 bp, Homo sapiens
taatctttgggtaacttcaaaa

SEQ ID NO: 4596676 - DNA, 18 bp, Homo sapiens
taatggtagttttacagt

SEQ ID NO: 4596677 - DNA, 12 bp, Homo sapiens
taatgtgaaact

SEQ ID NO: 4596678 - DNA, 16 bp, Homo sapiens
taattaccaacctgtt

SEQ ID NO: 4596679 - DNA, 21 bp, Homo sapiens
taattaccaacctgttaccta

SEQ ID NO: 4596680 - DNA, 14 bp, Homo sapiens
taatttgatgttta

SEQ ID NO: 4596681 - DNA, 19 bp, Homo sapiens
taatttgtgatacaatgct

SEQ ID NO: 4596682 - DNA, 13 bp, Homo sapiens
taattttgtgtaa

SEQ ID NO: 4596683 - DNA, 21 bp, Homo sapiens
tacaaaaaaaaaaaaaaatta

SEQ ID NO: 4596684 - DNA, 13 bp, Homo sapiens
tacaagttagaaa

SEQ ID NO: 4596685 - DNA, 21 bp, Homo sapiens
tacacattttattttattatg

SEQ ID NO: 4596686 - DNA, 22 bp, Homo sapiens
tacacattttattttattatgc

SEQ ID NO: 4596687 - DNA, 17 bp, Homo sapiens
tacaccactacattctg

SEQ ID NO: 4596688 - DNA, 20 bp, Homo sapiens
tacaccactacattctgtta

SEQ ID NO: 4596689 - DNA, 14 bp, Homo sapiens
tacactccagtgag

SEQ ID NO: 4596690 - DNA, 17 bp, Homo sapiens
tacactgtttcaaactt

SEQ ID NO: 4596691 - DNA, 18 bp, Homo sapiens
tacactgtttcaaacttt

SEQ ID NO: 4596692 - DNA, 14 bp, Homo sapiens
tacagaaagctgcc

SEQ ID NO: 4596693 - DNA, 19 bp, Homo sapiens
tacagcaacaatttatgaa

SEQ ID NO: 4596694 - DNA, 24 bp, Homo sapiens
tacagcaaggagatttacaactgg

SEQ ID NO: 4596695 - DNA, 18 bp, Homo sapiens
tacagctcattaaacttt

SEQ ID NO: 4596696 - DNA, 17 bp, Homo sapiens
tacataactgaaaatgt

SEQ ID NO: 4596697 - DNA, 21 bp, Homo sapiens
tacataactgaaaatgtgcta

SEQ ID NO: 4596698 - DNA, 21 bp, Homo sapiens
tacataatgcgtgcataccac

SEQ ID NO: 4596699 - DNA, 18 bp, Homo sapiens
tacatgaaaacacatttt

SEQ ID NO: 4596700 - DNA, 14 bp, Homo sapiens
tacatgggtgacta

SEQ ID NO: 4596701 - DNA, 19 bp, Homo sapiens
tacatttaaaacattaaaa

SEQ ID NO: 4596702 - DNA, 14 bp, Homo sapiens
tacatttttaagtg

SEQ ID NO: 4596703 - DNA, 22 bp, Homo sapiens
tacatttttaagtgctgcattt

SEQ ID NO: 4596704 - DNA, 18 bp, Homo sapiens
taccacctcaggtgactt

SEQ ID NO: 4596705 - DNA, 17 bp, Homo sapiens
taccacttttgttcttg

SEQ ID NO: 4596706 - DNA, 16 bp, Homo sapiens
taccctcatgttctta

SEQ ID NO: 4596707 - DNA, 13 bp, Homo sapiens
tacctactttgac

SEQ ID NO: 4596708 - DNA, 12 bp, Homo sapiens
tacctctgtgcc

SEQ ID NO: 4596709 - DNA, 20 bp, Homo sapiens
tacctgtgcgttactaattg

SEQ ID NO: 4596710 - DNA, 20 bp, Homo sapiens
tacctttgtattctctcctg

SEQ ID NO: 4596711 - DNA, 20 bp, Homo sapiens
tacctttttatttgcatgtg

SEQ ID NO: 4596712 - DNA, 19 bp, Homo sapiens
taccttttttagagttgat

SEQ ID NO: 4596713 - DNA, 17 bp, Homo sapiens
taccttttttatacata

SEQ ID NO: 4596714 - DNA, 18 bp, Homo sapiens
taccttttttatacataa

SEQ ID NO: 4596715 - DNA, 19 bp, Homo sapiens
taccttttttatacataaa

SEQ ID NO: 4596716 - DNA, 12 bp, Homo sapiens
tacgtacacatt

SEQ ID NO: 4596717 - DNA, 14 bp, Homo sapiens
tacgttgtgcattt

SEQ ID NO: 4596718 - DNA, 15 bp, Homo sapiens
tacgttgtgcatttg

SEQ ID NO: 4596719 - DNA, 16 bp, Homo sapiens
tacgttgtgcatttgg

SEQ ID NO: 4596720 - DNA, 14 bp, Homo sapiens
tactaaaaatacaa

SEQ ID NO: 4596721 - DNA, 21 bp, Homo sapiens
tactaatagacaatttattat

SEQ ID NO: 4596722 - DNA, 18 bp, Homo sapiens
tactccaggcttccacac

SEQ ID NO: 4596723 - DNA, 22 bp, Homo sapiens
tactccaggcttccacacttct

SEQ ID NO: 4596724 - DNA, 13 bp, Homo sapiens
tactggtccaaaa

SEQ ID NO: 4596725 - DNA, 23 bp, Homo sapiens
tactggtccaaaagattgctgaa

SEQ ID NO: 4596726 - DNA, 20 bp, Homo sapiens
tactgtaatttgtgatacaa

SEQ ID NO: 4596727 - DNA, 21 bp, Homo sapiens
tactgtatcatgacaaagact

SEQ ID NO: 4596728 - DNA, 14 bp, Homo sapiens
tacttgaagggcca

SEQ ID NO: 4596729 - DNA, 19 bp, Homo sapiens
tacttgaagggccagagcc

SEQ ID NO: 4596730 - DNA, 20 bp, Homo sapiens
tacttgaagggccagagcca

SEQ ID NO: 4596731 - DNA, 21 bp, Homo sapiens
tacttgaagggccagagccag

SEQ ID NO: 4596732 - DNA, 21 bp, Homo sapiens
tacttttaaactgtgtacata

SEQ ID NO: 4596733 - DNA, 18 bp, Homo sapiens
tagaatgttttcaaatgt

SEQ ID NO: 4596734 - DNA, 15 bp, Homo sapiens
tagaattaacacatg

SEQ ID NO: 4596735 - DNA, 18 bp, Homo sapiens
tagaattaacacatgatc

SEQ ID NO: 4596736 - DNA, 16 bp, Homo sapiens
tagacaatttattatg

SEQ ID NO: 4596737 - DNA, 14 bp, Homo sapiens
tagagcctctgcct

SEQ ID NO: 4596738 - DNA, 16 bp, Homo sapiens
tagaggagggggcagg

SEQ ID NO: 4596739 - DNA, 23 bp, Homo sapiens
tagataacaagacctcagtgcct

SEQ ID NO: 4596740 - DNA, 18 bp, Homo sapiens
tagataatacaccactac

SEQ ID NO: 4596741 - DNA, 14 bp, Homo sapiens
tagatgctggccca

SEQ ID NO: 4596742 - DNA, 17 bp, Homo sapiens
tagcatacgtacacatt

SEQ ID NO: 4596743 - DNA, 11 bp, Homo sapiens
tagctatttaa

SEQ ID NO: 4596744 - DNA, 12 bp, Homo sapiens
tagctcattctc

SEQ ID NO: 4596745 - DNA, 19 bp, Homo sapiens
taggttttctgtgtttagc

SEQ ID NO: 4596746 - DNA, 18 bp, Homo sapiens
tagtccctcatgcaaatc

SEQ ID NO: 4596747 - DNA, 17 bp, Homo sapiens
tagtggattactgccat

SEQ ID NO: 4596748 - DNA, 23 bp, Homo sapiens
tagttcaatctggattcatattt

SEQ ID NO: 4596749 - DNA, 15 bp, Homo sapiens
tagttccactgagac

SEQ ID NO: 4596750 - DNA, 21 bp, Homo sapiens
tagtttgattaaattcttgca

SEQ ID NO: 4596751 - DNA, 23 bp, Homo sapiens
tagtttgattaaattcttgcaaa

SEQ ID NO: 4596752 - DNA, 14 bp, Homo sapiens
tagttttactttta

SEQ ID NO: 4596753 - DNA, 22 bp, Homo sapiens
tagttttacttttaaactgtgt

SEQ ID NO: 4596754 - DNA, 16 bp, Homo sapiens
tataaactttaccttt

SEQ ID NO: 4596755 - DNA, 12 bp, Homo sapiens
tatacctgattt

SEQ ID NO: 4596756 - DNA, 20 bp, Homo sapiens
tatacctgattttttttcct

SEQ ID NO: 4596757 - DNA, 16 bp, Homo sapiens
tatactgcatactttt

SEQ ID NO: 4596758 - DNA, 13 bp, Homo sapiens
tataggaattgac

SEQ ID NO: 4596759 - DNA, 14 bp, Homo sapiens
tataggaattgacc

SEQ ID NO: 4596760 - DNA, 16 bp, Homo sapiens
tatagttttactttta

SEQ ID NO: 4596761 - DNA, 23 bp, Homo sapiens
tatagttttacttttaaactgtg

SEQ ID NO: 4596762 - DNA, 16 bp, Homo sapiens
tatatgcttactgata

SEQ ID NO: 4596763 - DNA, 17 bp, Homo sapiens
tatatgcttactgatat

SEQ ID NO: 4596764 - DNA, 21 bp, Homo sapiens
tatatgcttactgatatattt

SEQ ID NO: 4596765 - DNA, 16 bp, Homo sapiens
tatattttacaatttt

SEQ ID NO: 4596766 - DNA, 22 bp, Homo sapiens
tatcacccagaagaaaatagtg

SEQ ID NO: 4596767 - DNA, 22 bp, Homo sapiens
tatcataaacattttacatgca

SEQ ID NO: 4596768 - DNA, 17 bp, Homo sapiens
tatcatgacaaagactg

SEQ ID NO: 4596769 - DNA, 20 bp, Homo sapiens
tatccctactgtaatttgtg

SEQ ID NO: 4596770 - DNA, 14 bp, Homo sapiens
tatccttcagcctg

SEQ ID NO: 4596771 - DNA, 15 bp, Homo sapiens
tatccttcagcctga

SEQ ID NO: 4596772 - DNA, 15 bp, Homo sapiens
tatctagatactgta

SEQ ID NO: 4596773 - DNA, 16 bp, Homo sapiens
tatctagatactgtat

SEQ ID NO: 4596774 - DNA, 15 bp, Homo sapiens
tatgaatactttgca

SEQ ID NO: 4596775 - DNA, 13 bp, Homo sapiens
tatgaggcatttg

SEQ ID NO: 4596776 - DNA, 14 bp, Homo sapiens
tatgaggcatttgt

SEQ ID NO: 4596777 - DNA, 21 bp, Homo sapiens
tatgaggcatttgtttgaact

SEQ ID NO: 4596778 - DNA, 17 bp, Homo sapiens
tatgcaaggaaggaaag

SEQ ID NO: 4596779 - DNA, 13 bp, Homo sapiens
tatgcacacattt

SEQ ID NO: 4596780 - DNA, 13 bp, Homo sapiens
tatgcatgaagta

SEQ ID NO: 4596781 - DNA, 18 bp, Homo sapiens
tatgcatgaagtaatatg

SEQ ID NO: 4596782 - DNA, 22 bp, Homo sapiens
tatgcatgaagtaatatgcaca

SEQ ID NO: 4596783 - DNA, 14 bp, Homo sapiens
tatgctatttctgt

SEQ ID NO: 4596784 - DNA, 15 bp, Homo sapiens
tatgcttactgatat

SEQ ID NO: 4596785 - DNA, 17 bp, Homo sapiens
tatggcttttgtgcatt

SEQ ID NO: 4596786 - DNA, 18 bp, Homo sapiens
tatggcttttgtgcatta

SEQ ID NO: 4596787 - DNA, 21 bp, Homo sapiens
tatggcttttgtgcattatct

SEQ ID NO: 4596788 - DNA, 14 bp, Homo sapiens
tatgtctcttctga

SEQ ID NO: 4596789 - DNA, 19 bp, Homo sapiens
tatgtctcttctgagctat

SEQ ID NO: 4596790 - DNA, 17 bp, Homo sapiens
tatgttctaagaagtga

SEQ ID NO: 4596791 - DNA, 20 bp, Homo sapiens
tattaaaaatctcaaatttc

SEQ ID NO: 4596792 - DNA, 16 bp, Homo sapiens
tattaccacagacata

SEQ ID NO: 4596793 - DNA, 23 bp, Homo sapiens
tattatattcattctttttgaaa

SEQ ID NO: 4596794 - DNA, 23 bp, Homo sapiens
tattcattctttttgaaatgtca

SEQ ID NO: 4596795 - DNA, 20 bp, Homo sapiens
tattctctcctgtacctctt

SEQ ID NO: 4596796 - DNA, 22 bp, Homo sapiens
tattgttttgtctcctaaattg

SEQ ID NO: 4596797 - DNA, 17 bp, Homo sapiens
tatttaatggaagtgta

SEQ ID NO: 4596798 - DNA, 13 bp, Homo sapiens
tatttaatttgaa

SEQ ID NO: 4596799 - DNA, 16 bp, Homo sapiens
tatttaatttgaaggt

SEQ ID NO: 4596800 - DNA, 23 bp, Homo sapiens
tatttgggcctgctccagacctg

SEQ ID NO: 4596801 - DNA, 22 bp, Homo sapiens
tattttaggtgtaaaataatta

SEQ ID NO: 4596802 - DNA, 20 bp, Homo sapiens
tattttgctttgtgattttt

SEQ ID NO: 4596803 - DNA, 12 bp, Homo sapiens
tatttttatctt

SEQ ID NO: 4596804 - DNA, 19 bp, Homo sapiens
tatttttggcagtctgaat

SEQ ID NO: 4596805 - DNA, 17 bp, Homo sapiens
tatttttttcttttctt

SEQ ID NO: 4596806 - DNA, 18 bp, Homo sapiens
tcaaactgtcttggctgt

SEQ ID NO: 4596807 - DNA, 16 bp, Homo sapiens
tcaaattcttctgaac

SEQ ID NO: 4596808 - DNA, 16 bp, Homo sapiens
tcaaccatcgctttat

SEQ ID NO: 4596809 - DNA, 16 bp, Homo sapiens
tcaagtattatacctt

SEQ ID NO: 4596810 - DNA, 16 bp, Homo sapiens
tcaatctgtaaactgt

SEQ ID NO: 4596811 - DNA, 23 bp, Homo sapiens
tcaatgaatgaatgaatggctaa

SEQ ID NO: 4596812 - DNA, 23 bp, Homo sapiens
tcaatgtttatgcaaggaaggaa

SEQ ID NO: 4596813 - DNA, 13 bp, Homo sapiens
tcaattactggtc

SEQ ID NO: 4596814 - DNA, 16 bp, Homo sapiens
tcacatattgatttcc

SEQ ID NO: 4596815 - DNA, 18 bp, Homo sapiens
tcacatattgatttccgt

SEQ ID NO: 4596816 - DNA, 20 bp, Homo sapiens
tcacatattgatttccgtta

SEQ ID NO: 4596817 - DNA, 18 bp, Homo sapiens
tcacattttccttttcaa

SEQ ID NO: 4596818 - DNA, 16 bp, Homo sapiens
tcacctgtaaacctga

SEQ ID NO: 4596819 - DNA, 18 bp, Homo sapiens
tcaccttggcaccagaca

SEQ ID NO: 4596820 - DNA, 15 bp, Homo sapiens
tcacgctttcctgaa

SEQ ID NO: 4596821 - DNA, 17 bp, Homo sapiens
tcacgctttcctgaatc

SEQ ID NO: 4596822 - DNA, 14 bp, Homo sapiens
tcactgcttaactt

SEQ ID NO: 4596823 - DNA, 17 bp, Homo sapiens
tcactgcttaacttcac

SEQ ID NO: 4596824 - DNA, 23 bp, Homo sapiens
tcacttgaacccgggaggcagag

SEQ ID NO: 4596825 - DNA, 21 bp, Homo sapiens
tcactttttatgctatttctg

SEQ ID NO: 4596826 - DNA, 22 bp, Homo sapiens
tcactttttatgctatttctgt

SEQ ID NO: 4596827 - DNA, 21 bp, Homo sapiens
tcagaactcaaatggggccag

SEQ ID NO: 4596828 - DNA, 22 bp, Homo sapiens
tcagaactcaaatggggccaga

SEQ ID NO: 4596829 - DNA, 19 bp, Homo sapiens
tcagacatagaattaacac

SEQ ID NO: 4596830 - DNA, 19 bp, Homo sapiens
tcagactcccattcctgaa

SEQ ID NO: 4596831 - DNA, 22 bp, Homo sapiens
tcagagagcgagcgctacccac

SEQ ID NO: 4596832 - DNA, 15 bp, Homo sapiens
tcagatctctaactt

SEQ ID NO: 4596833 - DNA, 12 bp, Homo sapiens
tcagcatgtcta

SEQ ID NO: 4596834 - DNA, 20 bp, Homo sapiens
tcagccccagcttatctcct

SEQ ID NO: 4596835 - DNA, 15 bp, Homo sapiens
tcagcctggccagac

SEQ ID NO: 4596836 - DNA, 16 bp, Homo sapiens
tcagcctggccagaca

SEQ ID NO: 4596837 - DNA, 19 bp, Homo sapiens
tcagcctggccagacacag

SEQ ID NO: 4596838 - DNA, 15 bp, Homo sapiens
tcaggacagatgcca

SEQ ID NO: 4596839 - DNA, 12 bp, Homo sapiens
tcaggaggctga

SEQ ID NO: 4596840 - DNA, 21 bp, Homo sapiens
tcaggtgaaactccagatgcc

SEQ ID NO: 4596841 - DNA, 12 bp, Homo sapiens
tcaggtgacttt

SEQ ID NO: 4596842 - DNA, 13 bp, Homo sapiens
tcatcaactgaat

SEQ ID NO: 4596843 - DNA, 13 bp, Homo sapiens
tcatcactttgga

SEQ ID NO: 4596844 - DNA, 19 bp, Homo sapiens
tcatccctctcacccagaa

SEQ ID NO: 4596845 - DNA, 14 bp, Homo sapiens
tcatccctttggtt

SEQ ID NO: 4596846 - DNA, 19 bp, Homo sapiens
tcatctggcaacatcttta

SEQ ID NO: 4596847 - DNA, 12 bp, Homo sapiens
tcatgaagccca

SEQ ID NO: 4596848 - DNA, 13 bp, Homo sapiens
tcatgatccaact

SEQ ID NO: 4596849 - DNA, 18 bp, Homo sapiens
tcatgcatgtcctgtaaa

SEQ ID NO: 4596850 - DNA, 23 bp, Homo sapiens
tcatggatgggggaactcagatc

SEQ ID NO: 4596851 - DNA, 18 bp, Homo sapiens
tcatggtggccacggcca

SEQ ID NO: 4596852 - DNA, 23 bp, Homo sapiens
tcatgtcaaatatttagatgtaa

SEQ ID NO: 4596853 - DNA, 17 bp, Homo sapiens
tcattaaacttttttaa

SEQ ID NO: 4596854 - DNA, 16 bp, Homo sapiens
tcattaggatggctag

SEQ ID NO: 4596855 - DNA, 18 bp, Homo sapiens
tcattaggtgtgactgaa

SEQ ID NO: 4596856 - DNA, 21 bp, Homo sapiens
tccaaaagaagcccccagcta

SEQ ID NO: 4596857 - DNA, 16 bp, Homo sapiens
tccaaaagattgctga

SEQ ID NO: 4596858 - DNA, 13 bp, Homo sapiens
tccaaaagctttt

SEQ ID NO: 4596859 - DNA, 16 bp, Homo sapiens
tccaaaagctttttat

SEQ ID NO: 4596860 - DNA, 18 bp, Homo sapiens
tccaaaataaaacttttt

SEQ ID NO: 4596861 - DNA, 13 bp, Homo sapiens
tccaaagtacact

SEQ ID NO: 4596862 - DNA, 14 bp, Homo sapiens
tccaaagtacactg

SEQ ID NO: 4596863 - DNA, 16 bp, Homo sapiens
tccaaagtacactgtt

SEQ ID NO: 4596864 - DNA, 22 bp, Homo sapiens
tccaactaatgccttactcttc

SEQ ID NO: 4596865 - DNA, 17 bp, Homo sapiens
tccaagacatgtctgtt

SEQ ID NO: 4596866 - DNA, 20 bp, Homo sapiens
tccaaggaggggctgtaaaa

SEQ ID NO: 4596867 - DNA, 18 bp, Homo sapiens
tccaattaatgaagttga

SEQ ID NO: 4596868 - DNA, 22 bp, Homo sapiens
tccaattaatgaagttgattca

SEQ ID NO: 4596869 - DNA, 15 bp, Homo sapiens
tccacacttctgggc

SEQ ID NO: 4596870 - DNA, 18 bp, Homo sapiens
tccagacctgatcctgga

SEQ ID NO: 4596871 - DNA, 19 bp, Homo sapiens
tccagacctgatcctggag

SEQ ID NO: 4596872 - DNA, 16 bp, Homo sapiens
tccagcactcaataaa

SEQ ID NO: 4596873 - DNA, 11 bp, Homo sapiens
tccagcctggg

SEQ ID NO: 4596874 - DNA, 12 bp, Homo sapiens
tccagctccaac

SEQ ID NO: 4596875 - DNA, 15 bp, Homo sapiens
tccaggcagatccag

SEQ ID NO: 4596876 - DNA, 20 bp, Homo sapiens
tccaggcagatccaggacta

SEQ ID NO: 4596877 - DNA, 21 bp, Homo sapiens
tccaggcagatccaggactat

SEQ ID NO: 4596878 - DNA, 16 bp, Homo sapiens
tccaggcttccacact

SEQ ID NO: 4596879 - DNA, 19 bp, Homo sapiens
tccaggcttccacacttct

SEQ ID NO: 4596880 - DNA, 14 bp, Homo sapiens
tccagggacagagg

SEQ ID NO: 4596881 - DNA, 15 bp, Homo sapiens
tccagtcttcctgac

SEQ ID NO: 4596882 - DNA, 19 bp, Homo sapiens
tccagtcttcctgacactt

SEQ ID NO: 4596883 - DNA, 21 bp, Homo sapiens
tccagtcttcctgacacttta

SEQ ID NO: 4596884 - DNA, 22 bp, Homo sapiens
tccagtcttcctgacactttaa

SEQ ID NO: 4596885 - DNA, 21 bp, Homo sapiens
tccatgaagatgtagaggaga

SEQ ID NO: 4596886 - DNA, 20 bp, Homo sapiens
tccatgacctagttttccat

SEQ ID NO: 4596887 - DNA, 21 bp, Homo sapiens
tccatgcgtgtttctgactct

SEQ ID NO: 4596888 - DNA, 12 bp, Homo sapiens
tcccaaggaaag

SEQ ID NO: 4596889 - DNA, 22 bp, Homo sapiens
tcccaaggaaagccccagcact

SEQ ID NO: 4596890 - DNA, 18 bp, Homo sapiens
tcccaatttcagactccc

SEQ ID NO: 4596891 - DNA, 11 bp, Homo sapiens
tcccaggaccc

SEQ ID NO: 4596892 - DNA, 13 bp, Homo sapiens
tcccatttcagct

SEQ ID NO: 4596893 - DNA, 17 bp, Homo sapiens
tccccagcccagagaca

SEQ ID NO: 4596894 - DNA, 21 bp, Homo sapiens
tccccctgtttcagaggctca

SEQ ID NO: 4596895 - DNA, 15 bp, Homo sapiens
tccctactgtaattt

SEQ ID NO: 4596896 - DNA, 15 bp, Homo sapiens
tccctaggagaccaa

SEQ ID NO: 4596897 - DNA, 15 bp, Homo sapiens
tccctctaacccctt

SEQ ID NO: 4596898 - DNA, 17 bp, Homo sapiens
tccctgttccccagaga

SEQ ID NO: 4596899 - DNA, 18 bp, Homo sapiens
tccctgtttttgcagtac

SEQ ID NO: 4596900 - DNA, 13 bp, Homo sapiens
tcctagccactca

SEQ ID NO: 4596901 - DNA, 12 bp, Homo sapiens
tcctattatatt

SEQ ID NO: 4596902 - DNA, 11 bp, Homo sapiens
tcctcagcctt

SEQ ID NO: 4596903 - DNA, 17 bp, Homo sapiens
tcctcccgactgaccac

SEQ ID NO: 4596904 - DNA, 21 bp, Homo sapiens
tcctctccccagcccagagac

SEQ ID NO: 4596905 - DNA, 23 bp, Homo sapiens
tcctctccccagcccagagacat

SEQ ID NO: 4596906 - DNA, 17 bp, Homo sapiens
tcctgaaacaacttgga

SEQ ID NO: 4596907 - DNA, 16 bp, Homo sapiens
tcctgaagaaccagtc

SEQ ID NO: 4596908 - DNA, 22 bp, Homo sapiens
tcctgaatccaaactaatccat

SEQ ID NO: 4596909 - DNA, 17 bp, Homo sapiens
tcctgcccctgagccca

SEQ ID NO: 4596910 - DNA, 15 bp, Homo sapiens
tcctgctcatattgt

SEQ ID NO: 4596911 - DNA, 14 bp, Homo sapiens
tcctggaagccagc

SEQ ID NO: 4596912 - DNA, 13 bp, Homo sapiens
tcctggaggccca

SEQ ID NO: 4596913 - DNA, 15 bp, Homo sapiens
tcctggaggcccagt

SEQ ID NO: 4596914 - DNA, 12 bp, Homo sapiens
tcctgggcctgc

SEQ ID NO: 4596915 - DNA, 20 bp, Homo sapiens
tcctggtgccaatttcaagt

SEQ ID NO: 4596916 - DNA, 18 bp, Homo sapiens
tcctgtctttaaggaaaa

SEQ ID NO: 4596917 - DNA, 14 bp, Homo sapiens
tcctgtttttcaca

SEQ ID NO: 4596918 - DNA, 22 bp, Homo sapiens
tccttacaagttagaaaacata

SEQ ID NO: 4596919 - DNA, 15 bp, Homo sapiens
tccttacctttttat

SEQ ID NO: 4596920 - DNA, 20 bp, Homo sapiens
tcgaggctgcagtcagtcat

SEQ ID NO: 4596921 - DNA, 12 bp, Homo sapiens
tcgcccaggaga

SEQ ID NO: 4596922 - DNA, 19 bp, Homo sapiens
tcgctttattggctgagat

SEQ ID NO: 4596923 - DNA, 15 bp, Homo sapiens
tcgtacagaaagctg

SEQ ID NO: 4596924 - DNA, 12 bp, Homo sapiens
tctaaataaaga

SEQ ID NO: 4596925 - DNA, 13 bp, Homo sapiens
tctaactcagcaa

SEQ ID NO: 4596926 - DNA, 15 bp, Homo sapiens
tctactccaggcttc

SEQ ID NO: 4596927 - DNA, 20 bp, Homo sapiens
tctactccaggcttccacac

SEQ ID NO: 4596928 - DNA, 22 bp, Homo sapiens
tctagaggagggggcaggctga

SEQ ID NO: 4596929 - DNA, 22 bp, Homo sapiens
tctatcaagtattatacctttt

SEQ ID NO: 4596930 - DNA, 14 bp, Homo sapiens
tctatgacacatgc

SEQ ID NO: 4596931 - DNA, 21 bp, Homo sapiens
tctatgggccatattccgcac

SEQ ID NO: 4596932 - DNA, 13 bp, Homo sapiens
tctatttatttat

SEQ ID NO: 4596933 - DNA, 21 bp, Homo sapiens
tctcagtgtcaatgcagcccc

SEQ ID NO: 4596934 - DNA, 15 bp, Homo sapiens
tctcagttttcataa

SEQ ID NO: 4596935 - DNA, 16 bp, Homo sapiens
tctcagttttcataag

SEQ ID NO: 4596936 - DNA, 14 bp, Homo sapiens
tctccccagcccag

SEQ ID NO: 4596937 - DNA, 17 bp, Homo sapiens
tctccccagcccagaga

SEQ ID NO: 4596938 - DNA, 20 bp, Homo sapiens
tctcccctgttggaggtgag

SEQ ID NO: 4596939 - DNA, 21 bp, Homo sapiens
tctccttgtgttactaagttt

SEQ ID NO: 4596940 - DNA, 14 bp, Homo sapiens
tctctaacagtgga

SEQ ID NO: 4596941 - DNA, 14 bp, Homo sapiens
tctctcctgtacct

SEQ ID NO: 4596942 - DNA, 20 bp, Homo sapiens
tctctcctgtacctcttgag

SEQ ID NO: 4596943 - DNA, 13 bp, Homo sapiens
tctctgcccaacc

SEQ ID NO: 4596944 - DNA, 18 bp, Homo sapiens
tctcttggaccctgggag

SEQ ID NO: 4596945 - DNA, 16 bp, Homo sapiens
tctgaactcaaactga

SEQ ID NO: 4596946 - DNA, 20 bp, Homo sapiens
tctgaagtcacatcacagga

SEQ ID NO: 4596947 - DNA, 23 bp, Homo sapiens
tctgaagtcacatcacaggacac

SEQ ID NO: 4596948 - DNA, 11 bp, Homo sapiens
tctgacccagt

SEQ ID NO: 4596949 - DNA, 15 bp, Homo sapiens
tctgacccagtgccc

SEQ ID NO: 4596950 - DNA, 14 bp, Homo sapiens
tctgaccttaaatg

SEQ ID NO: 4596951 - DNA, 17 bp, Homo sapiens
tctgagctatttcatct

SEQ ID NO: 4596952 - DNA, 18 bp, Homo sapiens
tctgcagataaacagtag

SEQ ID NO: 4596953 - DNA, 16 bp, Homo sapiens
tctgcctgacagcatc

SEQ ID NO: 4596954 - DNA, 18 bp, Homo sapiens
tctgcttgatttttgcct

SEQ ID NO: 4596955 - DNA, 18 bp, Homo sapiens
tctggaacccagactcag

SEQ ID NO: 4596956 - DNA, 18 bp, Homo sapiens
tctggaacctcagcctgg

SEQ ID NO: 4596957 - DNA, 19 bp, Homo sapiens
tctggaacctcagcctggc

SEQ ID NO: 4596958 - DNA, 21 bp, Homo sapiens
tctggaacctcagcctggcca

SEQ ID NO: 4596959 - DNA, 19 bp, Homo sapiens
tctggacagccccaccctg

SEQ ID NO: 4596960 - DNA, 16 bp, Homo sapiens
tctggagttgatctgg

SEQ ID NO: 4596961 - DNA, 21 bp, Homo sapiens
tctggagttgatctggaaccc

SEQ ID NO: 4596962 - DNA, 15 bp, Homo sapiens
tctggattcatattt

SEQ ID NO: 4596963 - DNA, 19 bp, Homo sapiens
tctggattcatatttaatt

SEQ ID NO: 4596964 - DNA, 14 bp, Homo sapiens
tctggctatgcatt

SEQ ID NO: 4596965 - DNA, 17 bp, Homo sapiens
tctggctatgcatttga

SEQ ID NO: 4596966 - DNA, 15 bp, Homo sapiens
tctgtaaactgtgta

SEQ ID NO: 4596967 - DNA, 19 bp, Homo sapiens
tctgtaaactgtgtattcc

SEQ ID NO: 4596968 - DNA, 22 bp, Homo sapiens
tctgtaaactgtgtattccaag

SEQ ID NO: 4596969 - DNA, 17 bp, Homo sapiens
tctgtgtttagctattt

SEQ ID NO: 4596970 - DNA, 19 bp, Homo sapiens
tctgttacactttttggaa

SEQ ID NO: 4596971 - DNA, 20 bp, Homo sapiens
tctgttctacatagatgctt

SEQ ID NO: 4596972 - DNA, 16 bp, Homo sapiens
tctgttgcaagtgcaa

SEQ ID NO: 4596973 - DNA, 13 bp, Homo sapiens
tctgtttagataa

SEQ ID NO: 4596974 - DNA, 16 bp, Homo sapiens
tctgtttagataatac

SEQ ID NO: 4596975 - DNA, 16 bp, Homo sapiens
tcttaaaccttcagtt

SEQ ID NO: 4596976 - DNA, 15 bp, Homo sapiens
tcttcagatctctaa

SEQ ID NO: 4596977 - DNA, 23 bp, Homo sapiens
tcttcagatctctaacttcacca

SEQ ID NO: 4596978 - DNA, 24 bp, Homo sapiens
tcttctgaactcaaactgaggaat

SEQ ID NO: 4596979 - DNA, 19 bp, Homo sapiens
tcttctgagctatttcatc

SEQ ID NO: 4596980 - DNA, 13 bp, Homo sapiens
tcttcttgaaatt

SEQ ID NO: 4596981 - DNA, 21 bp, Homo sapiens
tcttgaaatataggaacttaa

SEQ ID NO: 4596982 - DNA, 19 bp, Homo sapiens
tcttgagccttgaactttg

SEQ ID NO: 4596983 - DNA, 16 bp, Homo sapiens
tcttgaggccaggagt

SEQ ID NO: 4596984 - DNA, 16 bp, Homo sapiens
tcttgcaagcaacaag

SEQ ID NO: 4596985 - DNA, 17 bp, Homo sapiens
tcttggaccctgggagt

SEQ ID NO: 4596986 - DNA, 14 bp, Homo sapiens
tcttggtaagaagc

SEQ ID NO: 4596987 - DNA, 19 bp, Homo sapiens
tcttggttgaaaataaaaa

SEQ ID NO: 4596988 - DNA, 23 bp, Homo sapiens
tcttggttgaaaataaaaagatc

SEQ ID NO: 4596989 - DNA, 14 bp, Homo sapiens
tcttggtttgtaaa

SEQ ID NO: 4596990 - DNA, 19 bp, Homo sapiens
tcttttgccgttattaaaa

SEQ ID NO: 4596991 - DNA, 20 bp, Homo sapiens
tcttttggttatgaatactt

SEQ ID NO: 4596992 - DNA, 22 bp, Homo sapiens
tgaaaaagttctgcagataaac

SEQ ID NO: 4596993 - DNA, 14 bp, Homo sapiens
tgaaaacacatttt

SEQ ID NO: 4596994 - DNA, 21 bp, Homo sapiens
tgaaaacacatttttcttagg

SEQ ID NO: 4596995 - DNA, 17 bp, Homo sapiens
tgaaaatgtgctatact

SEQ ID NO: 4596996 - DNA, 21 bp, Homo sapiens
tgaaaattttgatgttttaag

SEQ ID NO: 4596997 - DNA, 17 bp, Homo sapiens
tgaaactggattaaact

SEQ ID NO: 4596998 - DNA, 18 bp, Homo sapiens
tgaaactggattaaactt

SEQ ID NO: 4596999 - DNA, 18 bp, Homo sapiens
tgaacaaatttacagaga

SEQ ID NO: 4597000 - DNA, 19 bp, Homo sapiens
tgaacaaatttacagagac

SEQ ID NO: 4597001 - DNA, 20 bp, Homo sapiens
tgaacaaatttacagagaca

SEQ ID NO: 4597002 - DNA, 20 bp, Homo sapiens
tgaacattggttctttcatt

SEQ ID NO: 4597003 - DNA, 14 bp, Homo sapiens
tgaactcaaactga

SEQ ID NO: 4597004 - DNA, 17 bp, Homo sapiens
tgaactttgacctctgc

SEQ ID NO: 4597005 - DNA, 20 bp, Homo sapiens
tgaactttgacctctgcagc

SEQ ID NO: 4597006 - DNA, 15 bp, Homo sapiens
tgaagaaaatcactt

SEQ ID NO: 4597007 - DNA, 19 bp, Homo sapiens
tgaagaaccagtcccccca

SEQ ID NO: 4597008 - DNA, 20 bp, Homo sapiens
tgaagaaccagtccccccac

SEQ ID NO: 4597009 - DNA, 17 bp, Homo sapiens
tgaagacaatgacttac

SEQ ID NO: 4597010 - DNA, 17 bp, Homo sapiens
tgaagatgtagaggaga

SEQ ID NO: 4597011 - DNA, 18 bp, Homo sapiens
tgaagatgtagaggagaa

SEQ ID NO: 4597012 - DNA, 15 bp, Homo sapiens
tgaagggccagagcc

SEQ ID NO: 4597013 - DNA, 16 bp, Homo sapiens
tgaagggccagagcca

SEQ ID NO: 4597014 - DNA, 20 bp, Homo sapiens
tgaaggtgctgacggccagg

SEQ ID NO: 4597015 - DNA, 20 bp, Homo sapiens
tgaagtaatatgcacacatt

SEQ ID NO: 4597016 - DNA, 20 bp, Homo sapiens
tgaagtattttgctggaata

SEQ ID NO: 4597017 - DNA, 16 bp, Homo sapiens
tgaatattgccattat

SEQ ID NO: 4597018 - DNA, 21 bp, Homo sapiens
tgaatatttgttatgtagata

SEQ ID NO: 4597019 - DNA, 22 bp, Homo sapiens
tgaatgaggtcagcatgtctat

SEQ ID NO: 4597020 - DNA, 13 bp, Homo sapiens
tgaatggtatgga

SEQ ID NO: 4597021 - DNA, 20 bp, Homo sapiens
tgaatggtatggaactctct

SEQ ID NO: 4597022 - DNA, 21 bp, Homo sapiens
tgaattatcttggttgaaaat

SEQ ID NO: 4597023 - DNA, 12 bp, Homo sapiens
tgacacatgcaa

SEQ ID NO: 4597024 - DNA, 18 bp, Homo sapiens
tgacactagcccaatgaa

SEQ ID NO: 4597025 - DNA, 19 bp, Homo sapiens
tgacactagcccaatgaaa

SEQ ID NO: 4597026 - DNA, 23 bp, Homo sapiens
tgacactagcccaatgaaatgaa

SEQ ID NO: 4597027 - DNA, 22 bp, Homo sapiens
tgacactttaattaccaacctg

SEQ ID NO: 4597028 - DNA, 14 bp, Homo sapiens
tgacagcatcctct

SEQ ID NO: 4597029 - DNA, 14 bp, Homo sapiens
tgacaggcctgtcc

SEQ ID NO: 4597030 - DNA, 16 bp, Homo sapiens
tgaccactgcagaaga

SEQ ID NO: 4597031 - DNA, 17 bp, Homo sapiens
tgaccactgcagaagac

SEQ ID NO: 4597032 - DNA, 18 bp, Homo sapiens
tgaccactgcagaagaca

SEQ ID NO: 4597033 - DNA, 17 bp, Homo sapiens
tgacccacaagaaatga

SEQ ID NO: 4597034 - DNA, 16 bp, Homo sapiens
tgacccagtgccccca

SEQ ID NO: 4597035 - DNA, 18 bp, Homo sapiens
tgacctctgcagcaataa

SEQ ID NO: 4597036 - DNA, 15 bp, Homo sapiens
tgactaaactaccac

SEQ ID NO: 4597037 - DNA, 18 bp, Homo sapiens
tgactaaactaccacctc

SEQ ID NO: 4597038 - DNA, 20 bp, Homo sapiens
tgactaaactaccacctcag

SEQ ID NO: 4597039 - DNA, 12 bp, Homo sapiens
tgactatctccc

SEQ ID NO: 4597040 - DNA, 14 bp, Homo sapiens
tgactgaatttctt

SEQ ID NO: 4597041 - DNA, 16 bp, Homo sapiens
tgacttactgtacatg

SEQ ID NO: 4597042 - DNA, 14 bp, Homo sapiens
tgactttttgcatt

SEQ ID NO: 4597043 - DNA, 17 bp, Homo sapiens
tgactttttgcatttaa

SEQ ID NO: 4597044 - DNA, 12 bp, Homo sapiens
tgagacagctct

SEQ ID NO: 4597045 - DNA, 16 bp, Homo sapiens
tgagagtgaacaaatt

SEQ ID NO: 4597046 - DNA, 13 bp, Homo sapiens
tgagccttcagtc

SEQ ID NO: 4597047 - DNA, 14 bp, Homo sapiens
tgagccttgaactt

SEQ ID NO: 4597048 - DNA, 14 bp, Homo sapiens
tgagcgacagtgag

SEQ ID NO: 4597049 - DNA, 15 bp, Homo sapiens
tgaggaatttcacct

SEQ ID NO: 4597050 - DNA, 13 bp, Homo sapiens
tgaggacaagaga

SEQ ID NO: 4597051 - DNA, 12 bp, Homo sapiens
tgaggagctggg

SEQ ID NO: 4597052 - DNA, 12 bp, Homo sapiens
tgaggcatttgt

SEQ ID NO: 4597053 - DNA, 12 bp, Homo sapiens
tgaggccaggag

SEQ ID NO: 4597054 - DNA, 13 bp, Homo sapiens
tgaggtcccaggc

SEQ ID NO: 4597055 - DNA, 19 bp, Homo sapiens
tgaggtcccaggcagagaa

SEQ ID NO: 4597056 - DNA, 15 bp, Homo sapiens
tgaggtctgttcttt

SEQ ID NO: 4597057 - DNA, 20 bp, Homo sapiens
tgaggtctgttctttccaaa

SEQ ID NO: 4597058 - DNA, 20 bp, Homo sapiens
tgagtacgttgtgcatttgg

SEQ ID NO: 4597059 - DNA, 16 bp, Homo sapiens
tgagtctgaattctgc

SEQ ID NO: 4597060 - DNA, 21 bp, Homo sapiens
tgagtctgaattctgctctaa

SEQ ID NO: 4597061 - DNA, 14 bp, Homo sapiens
tgatacaatgctgt

SEQ ID NO: 4597062 - DNA, 17 bp, Homo sapiens
tgatactacagtttgtt

SEQ ID NO: 4597063 - DNA, 20 bp, Homo sapiens
tgatattttctgtgcctgaa

SEQ ID NO: 4597064 - DNA, 14 bp, Homo sapiens
tgatcctggaggcc

SEQ ID NO: 4597065 - DNA, 18 bp, Homo sapiens
tgatcctggaggcccagt

SEQ ID NO: 4597066 - DNA, 14 bp, Homo sapiens
tgatctggaaccca

SEQ ID NO: 4597067 - DNA, 15 bp, Homo sapiens
tgatctggaacccag

SEQ ID NO: 4597068 - DNA, 18 bp, Homo sapiens
tgatctggaacccagact

SEQ ID NO: 4597069 - DNA, 15 bp, Homo sapiens
tgatgctgcccctca

SEQ ID NO: 4597070 - DNA, 19 bp, Homo sapiens
tgatggcaacagatctgga

SEQ ID NO: 4597071 - DNA, 17 bp, Homo sapiens
tgatggcttatgatagc

SEQ ID NO: 4597072 - DNA, 21 bp, Homo sapiens
tgatgttttaaggatgcttgt

SEQ ID NO: 4597073 - DNA, 15 bp, Homo sapiens
tgattaaagatgagc

SEQ ID NO: 4597074 - DNA, 22 bp, Homo sapiens
tgatttaggagaagccaggaat

SEQ ID NO: 4597075 - DNA, 18 bp, Homo sapiens
tgatttccgttaaaatac

SEQ ID NO: 4597076 - DNA, 22 bp, Homo sapiens
tgatttccgttaaaataccagc

SEQ ID NO: 4597077 - DNA, 16 bp, Homo sapiens
tgattttttttccttt

SEQ ID NO: 4597078 - DNA, 23 bp, Homo sapiens
tgcaaacctgacccctgctcagt

SEQ ID NO: 4597079 - DNA, 20 bp, Homo sapiens
tgcaaagtatccctactgta

SEQ ID NO: 4597080 - DNA, 19 bp, Homo sapiens
tgcaaggaaggaaagaaag

SEQ ID NO: 4597081 - DNA, 23 bp, Homo sapiens
tgcaataaatctgacccagtgcc

SEQ ID NO: 4597082 - DNA, 15 bp, Homo sapiens
tgcacaataaaaatg

SEQ ID NO: 4597083 - DNA, 21 bp, Homo sapiens
tgcacagagttgttacatttt

SEQ ID NO: 4597084 - DNA, 13 bp, Homo sapiens
tgcacatctgttt

SEQ ID NO: 4597085 - DNA, 17 bp, Homo sapiens
tgcacctggaatatata

SEQ ID NO: 4597086 - DNA, 20 bp, Homo sapiens
tgcacctggaatatataacc

SEQ ID NO: 4597087 - DNA, 15 bp, Homo sapiens
tgcactccagcctga

SEQ ID NO: 4597088 - DNA, 22 bp, Homo sapiens
tgcagaagacagtatggcagct

SEQ ID NO: 4597089 - DNA, 17 bp, Homo sapiens
tgcagataaacagtagt

SEQ ID NO: 4597090 - DNA, 19 bp, Homo sapiens
tgcagtgagccgagattgt

SEQ ID NO: 4597091 - DNA, 12 bp, Homo sapiens
tgcataccactt

SEQ ID NO: 4597092 - DNA, 14 bp, Homo sapiens
tgcataccactttt

SEQ ID NO: 4597093 - DNA, 20 bp, Homo sapiens
tgcataccacttttgttctt

SEQ ID NO: 4597094 - DNA, 21 bp, Homo sapiens
tgcataccacttttgttcttg

SEQ ID NO: 4597095 - DNA, 13 bp, Homo sapiens
tgcatactcatta

SEQ ID NO: 4597096 - DNA, 19 bp, Homo sapiens
tgcatactcattaggatgg

SEQ ID NO: 4597097 - DNA, 17 bp, Homo sapiens
tgcatggtttagaaagc

SEQ ID NO: 4597098 - DNA, 16 bp, Homo sapiens
tgcatgtcctgtaaag

SEQ ID NO: 4597099 - DNA, 18 bp, Homo sapiens
tgcattatctagatactg

SEQ ID NO: 4597100 - DNA, 22 bp, Homo sapiens
tgcattatctagatactgtatc

SEQ ID NO: 4597101 - DNA, 15 bp, Homo sapiens
tgcatttaaaacaga

SEQ ID NO: 4597102 - DNA, 19 bp, Homo sapiens
tgcatttaaaacagacact

SEQ ID NO: 4597103 - DNA, 20 bp, Homo sapiens
tgcatttaaaacagacactg

SEQ ID NO: 4597104 - DNA, 16 bp, Homo sapiens
tgcatttaaaagatac

SEQ ID NO: 4597105 - DNA, 20 bp, Homo sapiens
tgcatttaaaagatacagtt

SEQ ID NO: 4597106 - DNA, 23 bp, Homo sapiens
tgcatttgaaaattttgatgttt

SEQ ID NO: 4597107 - DNA, 19 bp, Homo sapiens
tgcatttgaggtctgttct

SEQ ID NO: 4597108 - DNA, 21 bp, Homo sapiens
tgcatttggtggtttcagaaa

SEQ ID NO: 4597109 - DNA, 23 bp, Homo sapiens
tgcattttggagagtttcctgaa

SEQ ID NO: 4597110 - DNA, 15 bp, Homo sapiens
tgccacaaggacttc

SEQ ID NO: 4597111 - DNA, 22 bp, Homo sapiens
tgccacacaaggatagatgctg

SEQ ID NO: 4597112 - DNA, 22 bp, Homo sapiens
tgccacaccggtaccctcctcc

SEQ ID NO: 4597113 - DNA, 14 bp, Homo sapiens
tgccagagatccaa

SEQ ID NO: 4597114 - DNA, 17 bp, Homo sapiens
tgccagctcagtcccat

SEQ ID NO: 4597115 - DNA, 20 bp, Homo sapiens
tgcccaacccttccctcacc

SEQ ID NO: 4597116 - DNA, 18 bp, Homo sapiens
tgccccaggaccagctca

SEQ ID NO: 4597117 - DNA, 20 bp, Homo sapiens
tgccctaaagtgtatttttt

SEQ ID NO: 4597118 - DNA, 21 bp, Homo sapiens
tgccctgggggataccagctg

SEQ ID NO: 4597119 - DNA, 15 bp, Homo sapiens
tgcctcaccccttgc

SEQ ID NO: 4597120 - DNA, 16 bp, Homo sapiens
tgcctctacccaacca

SEQ ID NO: 4597121 - DNA, 23 bp, Homo sapiens
tgcctcttccagtcttcctgaca

SEQ ID NO: 4597122 - DNA, 15 bp, Homo sapiens
tgcctgaatatttgt

SEQ ID NO: 4597123 - DNA, 20 bp, Homo sapiens
tgcctggtatatccaaaagc

SEQ ID NO: 4597124 - DNA, 23 bp, Homo sapiens
tgcctggtatatccaaaagcttt

SEQ ID NO: 4597125 - DNA, 15 bp, Homo sapiens
tgccttactcttctt

SEQ ID NO: 4597126 - DNA, 18 bp, Homo sapiens
tgccttactcttcttgaa

SEQ ID NO: 4597127 - DNA, 15 bp, Homo sapiens
tgcgtacgtttcctg

SEQ ID NO: 4597128 - DNA, 15 bp, Homo sapiens
tgcgtgcataccact

SEQ ID NO: 4597129 - DNA, 13 bp, Homo sapiens
tgctagagcctct

SEQ ID NO: 4597130 - DNA, 16 bp, Homo sapiens
tgctagagcctctgcc

SEQ ID NO: 4597131 - DNA, 18 bp, Homo sapiens
tgctcagccccagcttat

SEQ ID NO: 4597132 - DNA, 11 bp, Homo sapiens
tgctccagcac

SEQ ID NO: 4597133 - DNA, 20 bp, Homo sapiens
tgctccagcactcaataaag

SEQ ID NO: 4597134 - DNA, 15 bp, Homo sapiens
tgctgacggccaggg

SEQ ID NO: 4597135 - DNA, 17 bp, Homo sapiens
tgctgacggccagggag

SEQ ID NO: 4597136 - DNA, 22 bp, Homo sapiens
tgctgacggccagggagaagct

SEQ ID NO: 4597137 - DNA, 14 bp, Homo sapiens
tgctggagctctgc

SEQ ID NO: 4597138 - DNA, 14 bp, Homo sapiens
tgctggcccagggc

SEQ ID NO: 4597139 - DNA, 16 bp, Homo sapiens
tgctggcccagggccc

SEQ ID NO: 4597140 - DNA, 21 bp, Homo sapiens
tgctggcccagggcccagagc

SEQ ID NO: 4597141 - DNA, 20 bp, Homo sapiens
tgctgggggggattgtaaaa

SEQ ID NO: 4597142 - DNA, 14 bp, Homo sapiens
tgcttactgatata

SEQ ID NO: 4597143 - DNA, 22 bp, Homo sapiens
tgcttactgatatattttacaa

SEQ ID NO: 4597144 - DNA, 15 bp, Homo sapiens
tgcttgtaactaaaa

SEQ ID NO: 4597145 - DNA, 12 bp, Homo sapiens
tgcttgtacata

SEQ ID NO: 4597146 - DNA, 13 bp, Homo sapiens
tgcttgtacataa

SEQ ID NO: 4597147 - DNA, 16 bp, Homo sapiens
tgcttgtacataatgc

SEQ ID NO: 4597148 - DNA, 22 bp, Homo sapiens
tgcttgtacataatgcgtgcat

SEQ ID NO: 4597149 - DNA, 14 bp, Homo sapiens
tgctttgtgatttt

SEQ ID NO: 4597150 - DNA, 17 bp, Homo sapiens
tgctttgtgatttttgt

SEQ ID NO: 4597151 - DNA, 22 bp, Homo sapiens
tgctttgtgatttttgtaattt

SEQ ID NO: 4597152 - DNA, 18 bp, Homo sapiens
tggaacctcagcctggcc

SEQ ID NO: 4597153 - DNA, 14 bp, Homo sapiens
tggaactctcgagc

SEQ ID NO: 4597154 - DNA, 16 bp, Homo sapiens
tggaagccagctttcc

SEQ ID NO: 4597155 - DNA, 14 bp, Homo sapiens
tggacagccccacc

SEQ ID NO: 4597156 - DNA, 11 bp, Homo sapiens
tggacatttta

SEQ ID NO: 4597157 - DNA, 13 bp, Homo sapiens
tggacattttatg

SEQ ID NO: 4597158 - DNA, 14 bp, Homo sapiens
tggacctaatccaa

SEQ ID NO: 4597159 - DNA, 14 bp, Homo sapiens
tggactctaaagtc

SEQ ID NO: 4597160 - DNA, 21 bp, Homo sapiens
tggagaagtgggtggggacag

SEQ ID NO: 4597161 - DNA, 22 bp, Homo sapiens
tggaggccattgtgtgagccta

SEQ ID NO: 4597162 - DNA, 18 bp, Homo sapiens
tggagggaaagccagcct

SEQ ID NO: 4597163 - DNA, 20 bp, Homo sapiens
tggagggaaagccagcctgg

SEQ ID NO: 4597164 - DNA, 19 bp, Homo sapiens
tggaggtttcacttgcaca

SEQ ID NO: 4597165 - DNA, 21 bp, Homo sapiens
tggaggtttcacttgcacatc

SEQ ID NO: 4597166 - DNA, 22 bp, Homo sapiens
tggagttgatctggaacccaga

SEQ ID NO: 4597167 - DNA, 22 bp, Homo sapiens
tggattaaacttaatctaaatg

SEQ ID NO: 4597168 - DNA, 17 bp, Homo sapiens
tggatttaacagaaatg

SEQ ID NO: 4597169 - DNA, 17 bp, Homo sapiens
tggcaacagatctggaa

SEQ ID NO: 4597170 - DNA, 18 bp, Homo sapiens
tggcaacagatctggaac

SEQ ID NO: 4597171 - DNA, 20 bp, Homo sapiens
tggcaacagatctggaacct

SEQ ID NO: 4597172 - DNA, 20 bp, Homo sapiens
tggcacatcagcacgatttc

SEQ ID NO: 4597173 - DNA, 21 bp, Homo sapiens
tggcacatcagcacgatttct

SEQ ID NO: 4597174 - DNA, 20 bp, Homo sapiens
tggcaccagacacccaggac

SEQ ID NO: 4597175 - DNA, 20 bp, Homo sapiens
tggcacctaatccaggcaga

SEQ ID NO: 4597176 - DNA, 21 bp, Homo sapiens
tggcagctctggacagcccca

SEQ ID NO: 4597177 - DNA, 22 bp, Homo sapiens
tggcagctctggacagccccac

SEQ ID NO: 4597178 - DNA, 16 bp, Homo sapiens
tggcagtctgaatttt

SEQ ID NO: 4597179 - DNA, 20 bp, Homo sapiens
tggccacggccacggccaca

SEQ ID NO: 4597180 - DNA, 13 bp, Homo sapiens
tggccagacacag

SEQ ID NO: 4597181 - DNA, 15 bp, Homo sapiens
tggcccagggcccag

SEQ ID NO: 4597182 - DNA, 23 bp, Homo sapiens
tggcccagggcccagagcccagc

SEQ ID NO: 4597183 - DNA, 23 bp, Homo sapiens
tggcctagcatacgtacacattt

SEQ ID NO: 4597184 - DNA, 18 bp, Homo sapiens
tggctaagcaaaatgtga

SEQ ID NO: 4597185 - DNA, 14 bp, Homo sapiens
tggcttttgtgcat

SEQ ID NO: 4597186 - DNA, 14 bp, Homo sapiens
tgggcaacagagca

SEQ ID NO: 4597187 - DNA, 16 bp, Homo sapiens
tgggcaacagagcaag

SEQ ID NO: 4597188 - DNA, 15 bp, Homo sapiens
tgggcagattttcag

SEQ ID NO: 4597189 - DNA, 18 bp, Homo sapiens
tgggccatattccgcact

SEQ ID NO: 4597190 - DNA, 14 bp, Homo sapiens
tgggcctgctccag

SEQ ID NO: 4597191 - DNA, 15 bp, Homo sapiens
tggggacagaccagc

SEQ ID NO: 4597192 - DNA, 18 bp, Homo sapiens
tggggacagaccagccct

SEQ ID NO: 4597193 - DNA, 12 bp, Homo sapiens
tggggaggacaa

SEQ ID NO: 4597194 - DNA, 17 bp, Homo sapiens
tggggagttaagacctg

SEQ ID NO: 4597195 - DNA, 18 bp, Homo sapiens
tggggagttaagacctgg

SEQ ID NO: 4597196 - DNA, 20 bp, Homo sapiens
tggggagttaagacctggca

SEQ ID NO: 4597197 - DNA, 20 bp, Homo sapiens
tggggctaggggctggggcc

SEQ ID NO: 4597198 - DNA, 22 bp, Homo sapiens
tgggggaacactgagaaagagg

SEQ ID NO: 4597199 - DNA, 16 bp, Homo sapiens
tgggttctgcctgcca

SEQ ID NO: 4597200 - DNA, 15 bp, Homo sapiens
tggtagttttacagt

SEQ ID NO: 4597201 - DNA, 22 bp, Homo sapiens
tggtatatccaaaagcttttta

SEQ ID NO: 4597202 - DNA, 14 bp, Homo sapiens
tggtcggaaaacat

SEQ ID NO: 4597203 - DNA, 16 bp, Homo sapiens
tggtgccccaggacca

SEQ ID NO: 4597204 - DNA, 17 bp, Homo sapiens
tggtgccccaggaccag

SEQ ID NO: 4597205 - DNA, 20 bp, Homo sapiens
tggtgggccaacaaagaaca

SEQ ID NO: 4597206 - DNA, 18 bp, Homo sapiens
tggtggtttcagaaatgt

SEQ ID NO: 4597207 - DNA, 19 bp, Homo sapiens
tggtggttttctgttcttt

SEQ ID NO: 4597208 - DNA, 15 bp, Homo sapiens
tggtttcagaaatgt

SEQ ID NO: 4597209 - DNA, 13 bp, Homo sapiens
tggttttctgttc

SEQ ID NO: 4597210 - DNA, 17 bp, Homo sapiens
tgtaaaagcattttgta

SEQ ID NO: 4597211 - DNA, 18 bp, Homo sapiens
tgtaaaagcattttgtaa

SEQ ID NO: 4597212 - DNA, 19 bp, Homo sapiens
tgtaaacctgagtcgtaca

SEQ ID NO: 4597213 - DNA, 18 bp, Homo sapiens
tgtaaactgtgtattcca

SEQ ID NO: 4597214 - DNA, 16 bp, Homo sapiens
tgtaaatgctccagca

SEQ ID NO: 4597215 - DNA, 15 bp, Homo sapiens
tgtaagaaatacaga

SEQ ID NO: 4597216 - DNA, 19 bp, Homo sapiens
tgtaataataaagaatagc

SEQ ID NO: 4597217 - DNA, 14 bp, Homo sapiens
tgtaatcacagcta

SEQ ID NO: 4597218 - DNA, 15 bp, Homo sapiens
tgtaatcacagctac

SEQ ID NO: 4597219 - DNA, 15 bp, Homo sapiens
tgtaattttgtgtaa

SEQ ID NO: 4597220 - DNA, 14 bp, Homo sapiens
tgtacataactgaa

SEQ ID NO: 4597221 - DNA, 19 bp, Homo sapiens
tgtacataactgaaaatgt

SEQ ID NO: 4597222 - DNA, 20 bp, Homo sapiens
tgtacataatgcgtgcatac

SEQ ID NO: 4597223 - DNA, 17 bp, Homo sapiens
tgtacatgaaaacacat

SEQ ID NO: 4597224 - DNA, 23 bp, Homo sapiens
tgtacctcttgagccttgaactt

SEQ ID NO: 4597225 - DNA, 18 bp, Homo sapiens
tgtagaggagaaactgga

SEQ ID NO: 4597226 - DNA, 15 bp, Homo sapiens
tgtagtataaagaaa

SEQ ID NO: 4597227 - DNA, 21 bp, Homo sapiens
tgtatcaaatacatttaaaac

SEQ ID NO: 4597228 - DNA, 19 bp, Homo sapiens
tgtcaaatatttagatgta

SEQ ID NO: 4597229 - DNA, 13 bp, Homo sapiens
tgtccaattaatg

SEQ ID NO: 4597230 - DNA, 11 bp, Homo sapiens
tgtccagctcc

SEQ ID NO: 4597231 - DNA, 23 bp, Homo sapiens
tgtccagctccaacctgcaaaga

SEQ ID NO: 4597232 - DNA, 13 bp, Homo sapiens
tgtcctcagcctt

SEQ ID NO: 4597233 - DNA, 20 bp, Homo sapiens
tgtcctcagccttgccagag

SEQ ID NO: 4597234 - DNA, 21 bp, Homo sapiens
tgtcctcagccttgccagaga

SEQ ID NO: 4597235 - DNA, 22 bp, Homo sapiens
tgtcctcagccttgccagagat

SEQ ID NO: 4597236 - DNA, 17 bp, Homo sapiens
tgtcgttaaaaacagat

SEQ ID NO: 4597237 - DNA, 13 bp, Homo sapiens
tgtctattcagct

SEQ ID NO: 4597238 - DNA, 21 bp, Homo sapiens
tgtctgcgtggttcctttctc

SEQ ID NO: 4597239 - DNA, 15 bp, Homo sapiens
tgtctgttctacata

SEQ ID NO: 4597240 - DNA, 21 bp, Homo sapiens
tgtctgttctacatagatgct

SEQ ID NO: 4597241 - DNA, 16 bp, Homo sapiens
tgtctgttgtattcat

SEQ ID NO: 4597242 - DNA, 17 bp, Homo sapiens
tgtcttggctgtggggc

SEQ ID NO: 4597243 - DNA, 13 bp, Homo sapiens
tgtgaaggaccct

SEQ ID NO: 4597244 - DNA, 16 bp, Homo sapiens
tgtgattcaatctgta

SEQ ID NO: 4597245 - DNA, 20 bp, Homo sapiens
tgtgattcaatctgtaaact

SEQ ID NO: 4597246 - DNA, 22 bp, Homo sapiens
tgtgattcaatctgtaaactgt

SEQ ID NO: 4597247 - DNA, 20 bp, Homo sapiens
tgtgcattatctagatactg

SEQ ID NO: 4597248 - DNA, 15 bp, Homo sapiens
tgtgcctaatgtgtt

SEQ ID NO: 4597249 - DNA, 18 bp, Homo sapiens
tgtgcctaatgtgtttga

SEQ ID NO: 4597250 - DNA, 19 bp, Homo sapiens
tgtggatttaacagaaatg

SEQ ID NO: 4597251 - DNA, 22 bp, Homo sapiens
tgtggatttaacagaaatgtac

SEQ ID NO: 4597252 - DNA, 20 bp, Homo sapiens
tgtggtcacaggaagtagag

SEQ ID NO: 4597253 - DNA, 17 bp, Homo sapiens
tgtgtaagaaatacaga

SEQ ID NO: 4597254 - DNA, 15 bp, Homo sapiens
tgtgtacataactga

SEQ ID NO: 4597255 - DNA, 16 bp, Homo sapiens
tgtgttcccatttcag

SEQ ID NO: 4597256 - DNA, 17 bp, Homo sapiens
tgtgttcccatttcagc

SEQ ID NO: 4597257 - DNA, 19 bp, Homo sapiens
tgtgttcccatttcagctg

SEQ ID NO: 4597258 - DNA, 13 bp, Homo sapiens
tgttacattttta

SEQ ID NO: 4597259 - DNA, 22 bp, Homo sapiens
tgttacatttttaagtgctgca

SEQ ID NO: 4597260 - DNA, 14 bp, Homo sapiens
tgttactaagtttt

SEQ ID NO: 4597261 - DNA, 17 bp, Homo sapiens
tgttagattaagaaata

SEQ ID NO: 4597262 - DNA, 17 bp, Homo sapiens
tgttcccatttcagctg

SEQ ID NO: 4597263 - DNA, 13 bp, Homo sapiens
tgttccccagaga

SEQ ID NO: 4597264 - DNA, 21 bp, Homo sapiens
tgttctccagtcattatgtta

SEQ ID NO: 4597265 - DNA, 14 bp, Homo sapiens
tgttcttaattctt

SEQ ID NO: 4597266 - DNA, 17 bp, Homo sapiens
tgttcttggtttgtaaa

SEQ ID NO: 4597267 - DNA, 20 bp, Homo sapiens
tgttcttggtttgtaaatta

SEQ ID NO: 4597268 - DNA, 18 bp, Homo sapiens
tgttctttccaaagtaca

SEQ ID NO: 4597269 - DNA, 20 bp, Homo sapiens
tgttctttctggctatgcat

SEQ ID NO: 4597270 - DNA, 23 bp, Homo sapiens
tgttctttctggctatgcatttg

SEQ ID NO: 4597271 - DNA, 16 bp, Homo sapiens
tgttgaaactttaaga

SEQ ID NO: 4597272 - DNA, 16 bp, Homo sapiens
tgttgtcaagaatagc

SEQ ID NO: 4597273 - DNA, 15 bp, Homo sapiens
tgtttagctatttaa

SEQ ID NO: 4597274 - DNA, 15 bp, Homo sapiens
tgtttcaaactttac

SEQ ID NO: 4597275 - DNA, 21 bp, Homo sapiens
tgtttcagaggctcagattgt

SEQ ID NO: 4597276 - DNA, 19 bp, Homo sapiens
tgtttctgactctgagcta

SEQ ID NO: 4597277 - DNA, 22 bp, Homo sapiens
tgtttgagcatcgcttaggaga

SEQ ID NO: 4597278 - DNA, 13 bp, Homo sapiens
tgtttttcacatt

SEQ ID NO: 4597279 - DNA, 16 bp, Homo sapiens
ttaaaaaatgctgggt

SEQ ID NO: 4597280 - DNA, 17 bp, Homo sapiens
ttaaaaaatgctgggtt

SEQ ID NO: 4597281 - DNA, 17 bp, Homo sapiens
ttaaaaatctcaaattt

SEQ ID NO: 4597282 - DNA, 19 bp, Homo sapiens
ttaaaaatctcaaatttct

SEQ ID NO: 4597283 - DNA, 20 bp, Homo sapiens
ttaaaaatggtttaaatggt

SEQ ID NO: 4597284 - DNA, 12 bp, Homo sapiens
ttaaaatataat

SEQ ID NO: 4597285 - DNA, 16 bp, Homo sapiens
ttaaactgtattttat

SEQ ID NO: 4597286 - DNA, 12 bp, Homo sapiens
ttaaactgtgta

SEQ ID NO: 4597287 - DNA, 19 bp, Homo sapiens
ttaaactgtgtacataact

SEQ ID NO: 4597288 - DNA, 22 bp, Homo sapiens
ttaaacttaatctaaatggaac

SEQ ID NO: 4597289 - DNA, 16 bp, Homo sapiens
ttaaataatgtgaaac

SEQ ID NO: 4597290 - DNA, 21 bp, Homo sapiens
ttaaataatgtgaaactggat

SEQ ID NO: 4597291 - DNA, 20 bp, Homo sapiens
ttaaatgcaaccatttgaaa

SEQ ID NO: 4597292 - DNA, 16 bp, Homo sapiens
ttaaatgcacctggaa

SEQ ID NO: 4597293 - DNA, 13 bp, Homo sapiens
ttaaattcttgca

SEQ ID NO: 4597294 - DNA, 20 bp, Homo sapiens
ttaacagaaatgtacagcaa

SEQ ID NO: 4597295 - DNA, 21 bp, Homo sapiens
ttaacctatgatattttctgt

SEQ ID NO: 4597296 - DNA, 13 bp, Homo sapiens
ttaacttttataa

SEQ ID NO: 4597297 - DNA, 22 bp, Homo sapiens
ttaacttttataaactttacct

SEQ ID NO: 4597298 - DNA, 19 bp, Homo sapiens
ttaagaaaaaggatgcaca

SEQ ID NO: 4597299 - DNA, 19 bp, Homo sapiens
ttaagaactaaaatgttct

SEQ ID NO: 4597300 - DNA, 18 bp, Homo sapiens
ttaagacctggcagctct

SEQ ID NO: 4597301 - DNA, 17 bp, Homo sapiens
ttaaggatgcttgtaca

SEQ ID NO: 4597302 - DNA, 15 bp, Homo sapiens
ttaagtgctgcattt

SEQ ID NO: 4597303 - DNA, 16 bp, Homo sapiens
ttaagtgctgcattta

SEQ ID NO: 4597304 - DNA, 23 bp, Homo sapiens
ttaatcattaggtgtgactgaat

SEQ ID NO: 4597305 - DNA, 18 bp, Homo sapiens
ttaatctctaacagtgga

SEQ ID NO: 4597306 - DNA, 20 bp, Homo sapiens
ttaatggaagtgtatttatt

SEQ ID NO: 4597307 - DNA, 22 bp, Homo sapiens
ttacatttttaagtgctgcatt

SEQ ID NO: 4597308 - DNA, 12 bp, Homo sapiens
ttaccaacctgt

SEQ ID NO: 4597309 - DNA, 17 bp, Homo sapiens
ttaccacagacatacta

SEQ ID NO: 4597310 - DNA, 19 bp, Homo sapiens
ttaccctcatgttcttaat

SEQ ID NO: 4597311 - DNA, 18 bp, Homo sapiens
ttacctttttatttgcat

SEQ ID NO: 4597312 - DNA, 20 bp, Homo sapiens
ttaccttttttatacataaa

SEQ ID NO: 4597313 - DNA, 13 bp, Homo sapiens
ttactaagttttt

SEQ ID NO: 4597314 - DNA, 19 bp, Homo sapiens
ttactatggccctggccta

SEQ ID NO: 4597315 - DNA, 23 bp, Homo sapiens
ttactgatatattttacaatttt

SEQ ID NO: 4597316 - DNA, 16 bp, Homo sapiens
ttacttttaaactgtg

SEQ ID NO: 4597317 - DNA, 19 bp, Homo sapiens
ttacttttaaactgtgtac

SEQ ID NO: 4597318 - DNA, 14 bp, Homo sapiens
ttagagttgatact

SEQ ID NO: 4597319 - DNA, 15 bp, Homo sapiens
ttagattaagaaata

SEQ ID NO: 4597320 - DNA, 19 bp, Homo sapiens
ttagattaagaaatagaca

SEQ ID NO: 4597321 - DNA, 11 bp, Homo sapiens
ttagctattta

SEQ ID NO: 4597322 - DNA, 19 bp, Homo sapiens
ttagctatttaatactaat

SEQ ID NO: 4597323 - DNA, 12 bp, Homo sapiens
ttaggagaagcc

SEQ ID NO: 4597324 - DNA, 20 bp, Homo sapiens
ttaggagaagtcttctattt

SEQ ID NO: 4597325 - DNA, 18 bp, Homo sapiens
ttaggatgttgaaaaagt

SEQ ID NO: 4597326 - DNA, 20 bp, Homo sapiens
ttagggaaggatacaaaagc

SEQ ID NO: 4597327 - DNA, 16 bp, Homo sapiens
ttaggtgtgactgaat

SEQ ID NO: 4597328 - DNA, 16 bp, Homo sapiens
ttagtatgaggcattt

SEQ ID NO: 4597329 - DNA, 15 bp, Homo sapiens
ttagttccactgaga

SEQ ID NO: 4597330 - DNA, 13 bp, Homo sapiens
ttataaactttac

SEQ ID NO: 4597331 - DNA, 17 bp, Homo sapiens
ttataaactttaccttt

SEQ ID NO: 4597332 - DNA, 18 bp, Homo sapiens
ttataaactttacctttt

SEQ ID NO: 4597333 - DNA, 19 bp, Homo sapiens
ttatatgaagaaaatcact

SEQ ID NO: 4597334 - DNA, 16 bp, Homo sapiens
ttatctagatactgta

SEQ ID NO: 4597335 - DNA, 18 bp, Homo sapiens
ttatgcaaggaaggaaag

SEQ ID NO: 4597336 - DNA, 18 bp, Homo sapiens
ttatggcttttgtgcatt

SEQ ID NO: 4597337 - DNA, 22 bp, Homo sapiens
ttatgttaagggaagaattcca

SEQ ID NO: 4597338 - DNA, 13 bp, Homo sapiens
ttatgttatttat

SEQ ID NO: 4597339 - DNA, 12 bp, Homo sapiens
ttattatgcatg

SEQ ID NO: 4597340 - DNA, 13 bp, Homo sapiens
ttattatgcatga

SEQ ID NO: 4597341 - DNA, 21 bp, Homo sapiens
ttattcattagttttgaagat

SEQ ID NO: 4597342 - DNA, 22 bp, Homo sapiens
ttattggctgagatatgaacat

SEQ ID NO: 4597343 - DNA, 11 bp, Homo sapiens
ttatttattga

SEQ ID NO: 4597344 - DNA, 16 bp, Homo sapiens
ttattttgatgtaaag

SEQ ID NO: 4597345 - DNA, 23 bp, Homo sapiens
ttcaagaataatcacgctttcct

SEQ ID NO: 4597346 - DNA, 19 bp, Homo sapiens
ttcaatctggattcatatt

SEQ ID NO: 4597347 - DNA, 14 bp, Homo sapiens
ttcaatctgtaaac

SEQ ID NO: 4597348 - DNA, 15 bp, Homo sapiens
ttcaatctgtaaact

SEQ ID NO: 4597349 - DNA, 16 bp, Homo sapiens
ttcaatctgtaaactg

SEQ ID NO: 4597350 - DNA, 14 bp, Homo sapiens
ttcaattgtcactt

SEQ ID NO: 4597351 - DNA, 22 bp, Homo sapiens
ttcacaagacccaaaaggcaga

SEQ ID NO: 4597352 - DNA, 23 bp, Homo sapiens
ttcacaagacccaaaaggcagaa

SEQ ID NO: 4597353 - DNA, 20 bp, Homo sapiens
ttcacagttctttgggccag

SEQ ID NO: 4597354 - DNA, 17 bp, Homo sapiens
ttcacatattgatttcc

SEQ ID NO: 4597355 - DNA, 16 bp, Homo sapiens
ttcacctgtaaacctg

SEQ ID NO: 4597356 - DNA, 11 bp, Homo sapiens
ttcagaaatgt

SEQ ID NO: 4597357 - DNA, 12 bp, Homo sapiens
ttcagaggctca

SEQ ID NO: 4597358 - DNA, 17 bp, Homo sapiens
ttcagatctctaacttc

SEQ ID NO: 4597359 - DNA, 20 bp, Homo sapiens
ttcagcaaactcttttccca

SEQ ID NO: 4597360 - DNA, 19 bp, Homo sapiens
ttcataagtattatgtctc

SEQ ID NO: 4597361 - DNA, 18 bp, Homo sapiens
ttcatagagaatataaaa

SEQ ID NO: 4597362 - DNA, 15 bp, Homo sapiens
ttcatattgcatcat

SEQ ID NO: 4597363 - DNA, 17 bp, Homo sapiens
ttcatattgcatcatag

SEQ ID NO: 4597364 - DNA, 13 bp, Homo sapiens
ttcatatttaatt

SEQ ID NO: 4597365 - DNA, 19 bp, Homo sapiens
ttcattagttttgaagatt

SEQ ID NO: 4597366 - DNA, 12 bp, Homo sapiens
ttcatttgcttt

SEQ ID NO: 4597367 - DNA, 16 bp, Homo sapiens
ttcatttgctttggaa

SEQ ID NO: 4597368 - DNA, 16 bp, Homo sapiens
ttccaaagtacactgt

SEQ ID NO: 4597369 - DNA, 16 bp, Homo sapiens
ttccaagacatgtctg

SEQ ID NO: 4597370 - DNA, 21 bp, Homo sapiens
ttccaagacatgtctgttcta

SEQ ID NO: 4597371 - DNA, 13 bp, Homo sapiens
ttccacagaggac

SEQ ID NO: 4597372 - DNA, 22 bp, Homo sapiens
ttccacagaggacacagagaag

SEQ ID NO: 4597373 - DNA, 19 bp, Homo sapiens
ttccacttataggaattga

SEQ ID NO: 4597374 - DNA, 17 bp, Homo sapiens
ttccagtcttcctgaca

SEQ ID NO: 4597375 - DNA, 21 bp, Homo sapiens
ttccatgcgtgtttctgactc

SEQ ID NO: 4597376 - DNA, 12 bp, Homo sapiens
ttccatggcctc

SEQ ID NO: 4597377 - DNA, 11 bp, Homo sapiens
ttcccaggacc

SEQ ID NO: 4597378 - DNA, 19 bp, Homo sapiens
ttcccaggaccctgaaggg

SEQ ID NO: 4597379 - DNA, 20 bp, Homo sapiens
ttcccaggaccctgaagggg

SEQ ID NO: 4597380 - DNA, 14 bp, Homo sapiens
ttcccatttcagct

SEQ ID NO: 4597381 - DNA, 15 bp, Homo sapiens
ttcccatttcagctg

SEQ ID NO: 4597382 - DNA, 12 bp, Homo sapiens
ttccccagagaa

SEQ ID NO: 4597383 - DNA, 16 bp, Homo sapiens
ttccgttaaaatacca

SEQ ID NO: 4597384 - DNA, 15 bp, Homo sapiens
ttcctcctgctcata

SEQ ID NO: 4597385 - DNA, 15 bp, Homo sapiens
ttcctgaagaaccag

SEQ ID NO: 4597386 - DNA, 13 bp, Homo sapiens
ttcctgacacttt

SEQ ID NO: 4597387 - DNA, 19 bp, Homo sapiens
ttcctggtgccaatttcaa

SEQ ID NO: 4597388 - DNA, 17 bp, Homo sapiens
ttcctgttgtcaagaat

SEQ ID NO: 4597389 - DNA, 18 bp, Homo sapiens
ttctaaaggctacctttg

SEQ ID NO: 4597390 - DNA, 21 bp, Homo sapiens
ttctaaatctccaaaataaaa

SEQ ID NO: 4597391 - DNA, 15 bp, Homo sapiens
ttctcagttttcata

SEQ ID NO: 4597392 - DNA, 14 bp, Homo sapiens
ttctcatgatccaa

SEQ ID NO: 4597393 - DNA, 15 bp, Homo sapiens
ttctctagtttgatt

SEQ ID NO: 4597394 - DNA, 20 bp, Homo sapiens
ttctctagtttgattaaatt

SEQ ID NO: 4597395 - DNA, 21 bp, Homo sapiens
ttctctagtttgattaaattc

SEQ ID NO: 4597396 - DNA, 20 bp, Homo sapiens
ttctctgaggacaagagaaa

SEQ ID NO: 4597397 - DNA, 23 bp, Homo sapiens
ttctgagctatttcatctatttt

SEQ ID NO: 4597398 - DNA, 22 bp, Homo sapiens
ttctgcctgccagctgcactga

SEQ ID NO: 4597399 - DNA, 15 bp, Homo sapiens
ttctggaatggaatt

SEQ ID NO: 4597400 - DNA, 18 bp, Homo sapiens
ttctggctatgcatttga

SEQ ID NO: 4597401 - DNA, 17 bp, Homo sapiens
ttctgtgcctgaatatt

SEQ ID NO: 4597402 - DNA, 18 bp, Homo sapiens
ttctgtgtttagctattt

SEQ ID NO: 4597403 - DNA, 20 bp, Homo sapiens
ttctgtgtttagctatttaa

SEQ ID NO: 4597404 - DNA, 17 bp, Homo sapiens
ttcttagggaaggatac

SEQ ID NO: 4597405 - DNA, 20 bp, Homo sapiens
ttcttctgaactcaaactga

SEQ ID NO: 4597406 - DNA, 21 bp, Homo sapiens
ttcttgcaagcaacaagctat

SEQ ID NO: 4597407 - DNA, 13 bp, Homo sapiens
ttcttggtttgta

SEQ ID NO: 4597408 - DNA, 14 bp, Homo sapiens
ttctttccaaagta

SEQ ID NO: 4597409 - DNA, 17 bp, Homo sapiens
ttctttctggctatgca

SEQ ID NO: 4597410 - DNA, 20 bp, Homo sapiens
ttcttttgccgttattaaaa

SEQ ID NO: 4597411 - DNA, 14 bp, Homo sapiens
ttctttttgaaatg

SEQ ID NO: 4597412 - DNA, 15 bp, Homo sapiens
ttctttttgaaatgt

SEQ ID NO: 4597413 - DNA, 18 bp, Homo sapiens
ttgaacccgggaggcaga

SEQ ID NO: 4597414 - DNA, 17 bp, Homo sapiens
ttgaactttgacctctg

SEQ ID NO: 4597415 - DNA, 17 bp, Homo sapiens
ttgaagggccagagcca

SEQ ID NO: 4597416 - DNA, 20 bp, Homo sapiens
ttgaagggccagagccaggg

SEQ ID NO: 4597417 - DNA, 16 bp, Homo sapiens
ttgaaggtagaatgtt

SEQ ID NO: 4597418 - DNA, 17 bp, Homo sapiens
ttgacccacaagaaatg

SEQ ID NO: 4597419 - DNA, 16 bp, Homo sapiens
ttgacctctgcagcaa

SEQ ID NO: 4597420 - DNA, 13 bp, Homo sapiens
ttgagcccaggag

SEQ ID NO: 4597421 - DNA, 14 bp, Homo sapiens
ttgagccttgaact

SEQ ID NO: 4597422 - DNA, 13 bp, Homo sapiens
ttgaggccaggag

SEQ ID NO: 4597423 - DNA, 15 bp, Homo sapiens
ttgaggtctgttctt

SEQ ID NO: 4597424 - DNA, 16 bp, Homo sapiens
ttgaggtctgttcttt

SEQ ID NO: 4597425 - DNA, 19 bp, Homo sapiens
ttgatctggaacccagact

SEQ ID NO: 4597426 - DNA, 23 bp, Homo sapiens
ttgatgtaaagatgttctggata

SEQ ID NO: 4597427 - DNA, 23 bp, Homo sapiens
ttgatgttttaaggatgcttgta

SEQ ID NO: 4597428 - DNA, 13 bp, Homo sapiens
ttgattaaagatg

SEQ ID NO: 4597429 - DNA, 12 bp, Homo sapiens
ttgattcatatt

SEQ ID NO: 4597430 - DNA, 14 bp, Homo sapiens
ttgcaaccgtctgt

SEQ ID NO: 4597431 - DNA, 21 bp, Homo sapiens
ttgcaagcaacaagctatttt

SEQ ID NO: 4597432 - DNA, 20 bp, Homo sapiens
ttgcatttaaaacagacact

SEQ ID NO: 4597433 - DNA, 22 bp, Homo sapiens
ttgcatttaaaacagacactgg

SEQ ID NO: 4597434 - DNA, 18 bp, Homo sapiens
ttgccacattaaattgat

SEQ ID NO: 4597435 - DNA, 17 bp, Homo sapiens
ttgcctcttccagtctt

SEQ ID NO: 4597436 - DNA, 19 bp, Homo sapiens
ttgcctcttccagtcttcc

SEQ ID NO: 4597437 - DNA, 22 bp, Homo sapiens
ttgcctgcgttttggaagctct

SEQ ID NO: 4597438 - DNA, 19 bp, Homo sapiens
ttgctgaaattttatatgc

SEQ ID NO: 4597439 - DNA, 16 bp, Homo sapiens
ttgcttgagcccagga

SEQ ID NO: 4597440 - DNA, 17 bp, Homo sapiens
ttgctttggaagtttta

SEQ ID NO: 4597441 - DNA, 14 bp, Homo sapiens
ttgctttgtttaag

SEQ ID NO: 4597442 - DNA, 16 bp, Homo sapiens
ttggaactctgcttga

SEQ ID NO: 4597443 - DNA, 13 bp, Homo sapiens
ttggacaggagtt

SEQ ID NO: 4597444 - DNA, 20 bp, Homo sapiens
ttggacattttatgtctttc

SEQ ID NO: 4597445 - DNA, 19 bp, Homo sapiens
ttggagggaaagccagcct

SEQ ID NO: 4597446 - DNA, 13 bp, Homo sapiens
ttggcaccagaca

SEQ ID NO: 4597447 - DNA, 17 bp, Homo sapiens
ttggcaccagacaccca

SEQ ID NO: 4597448 - DNA, 23 bp, Homo sapiens
ttggcaccagacacccaggactt

SEQ ID NO: 4597449 - DNA, 19 bp, Homo sapiens
ttggcacctaatccaggca

SEQ ID NO: 4597450 - DNA, 21 bp, Homo sapiens
ttggctagaggttcaaagata

SEQ ID NO: 4597451 - DNA, 13 bp, Homo sapiens
ttggctcaatcct

SEQ ID NO: 4597452 - DNA, 14 bp, Homo sapiens
ttggctcaatcctc

SEQ ID NO: 4597453 - DNA, 17 bp, Homo sapiens
ttgggccagacatgcca

SEQ ID NO: 4597454 - DNA, 16 bp, Homo sapiens
ttgggcctgctccaga

SEQ ID NO: 4597455 - DNA, 19 bp, Homo sapiens
ttgggcctgctccagacct

SEQ ID NO: 4597456 - DNA, 19 bp, Homo sapiens
ttggggagttaagacctgg

SEQ ID NO: 4597457 - DNA, 20 bp, Homo sapiens
ttggttgaaaataaaaagat

SEQ ID NO: 4597458 - DNA, 13 bp, Homo sapiens
ttgtaaaatggtg

SEQ ID NO: 4597459 - DNA, 17 bp, Homo sapiens
ttgtaactaaaataatt

SEQ ID NO: 4597460 - DNA, 22 bp, Homo sapiens
ttgtaactaaaataattttgta

SEQ ID NO: 4597461 - DNA, 23 bp, Homo sapiens
ttgtaactaaaataattttgtaa

SEQ ID NO: 4597462 - DNA, 14 bp, Homo sapiens
ttgtacataatgcg

SEQ ID NO: 4597463 - DNA, 16 bp, Homo sapiens
ttgtattctctcctgt

SEQ ID NO: 4597464 - DNA, 19 bp, Homo sapiens
ttgtgatacaatgctgtgc

SEQ ID NO: 4597465 - DNA, 23 bp, Homo sapiens
ttgtgattcaatctgtaaactgt

SEQ ID NO: 4597466 - DNA, 22 bp, Homo sapiens
ttgtgcattatctagatactgt

SEQ ID NO: 4597467 - DNA, 20 bp, Homo sapiens
ttgtggatttaacagaaatg

SEQ ID NO: 4597468 - DNA, 15 bp, Homo sapiens
ttgtgttactaagtt

SEQ ID NO: 4597469 - DNA, 20 bp, Homo sapiens
ttgtgttactaagtttttat

SEQ ID NO: 4597470 - DNA, 20 bp, Homo sapiens
ttgtgttcccatttcagctg

SEQ ID NO: 4597471 - DNA, 14 bp, Homo sapiens
ttgttacattttta

SEQ ID NO: 4597472 - DNA, 20 bp, Homo sapiens
ttgttcttggtttgtaaatt

SEQ ID NO: 4597473 - DNA, 13 bp, Homo sapiens
ttgttgtaattgc

SEQ ID NO: 4597474 - DNA, 12 bp, Homo sapiens
ttgtttaatggt

SEQ ID NO: 4597475 - DNA, 16 bp, Homo sapiens
ttgtttctttctctga

SEQ ID NO: 4597476 - DNA, 18 bp, Homo sapiens
tttaaaaaatgctgggtt

SEQ ID NO: 4597477 - DNA, 13 bp, Homo sapiens
tttaaaagataca

SEQ ID NO: 4597478 - DNA, 15 bp, Homo sapiens
tttaaactgtgtaca

SEQ ID NO: 4597479 - DNA, 19 bp, Homo sapiens
tttaaactgtgtacataac

SEQ ID NO: 4597480 - DNA, 22 bp, Homo sapiens
tttaaactgtgtacataactga

SEQ ID NO: 4597481 - DNA, 15 bp, Homo sapiens
tttaacagaaatgta

SEQ ID NO: 4597482 - DNA, 18 bp, Homo sapiens
tttaagaaaaaggatgca

SEQ ID NO: 4597483 - DNA, 22 bp, Homo sapiens
tttaaggatgcttgtacataat

SEQ ID NO: 4597484 - DNA, 17 bp, Homo sapiens
tttaagtgctgcattta

SEQ ID NO: 4597485 - DNA, 19 bp, Homo sapiens
tttacagtgtttctggctt

SEQ ID NO: 4597486 - DNA, 21 bp, Homo sapiens
tttaccttttttatacataaa

SEQ ID NO: 4597487 - DNA, 15 bp, Homo sapiens
tttagataatacacc

SEQ ID NO: 4597488 - DNA, 14 bp, Homo sapiens
tttagctatttaat

SEQ ID NO: 4597489 - DNA, 14 bp, Homo sapiens
tttataaactttac

SEQ ID NO: 4597490 - DNA, 21 bp, Homo sapiens
tttatatgaagaaaatcactt

SEQ ID NO: 4597491 - DNA, 16 bp, Homo sapiens
tttatcatgcatgtcc

SEQ ID NO: 4597492 - DNA, 16 bp, Homo sapiens
tttatcgtcactgctt

SEQ ID NO: 4597493 - DNA, 17 bp, Homo sapiens
tttatgcaaggaaggaa

SEQ ID NO: 4597494 - DNA, 16 bp, Homo sapiens
tttatggcttttgtgc

SEQ ID NO: 4597495 - DNA, 24 bp, Homo sapiens
tttatggcttttgtgcattatcta

SEQ ID NO: 4597496 - DNA, 20 bp, Homo sapiens
tttatgttaagggaagaatt

SEQ ID NO: 4597497 - DNA, 23 bp, Homo sapiens
tttcaagaataatcacgctttcc

SEQ ID NO: 4597498 - DNA, 13 bp, Homo sapiens
tttcacattttcc

SEQ ID NO: 4597499 - DNA, 17 bp, Homo sapiens
tttcacctgtaaacctg

SEQ ID NO: 4597500 - DNA, 11 bp, Homo sapiens
tttcagtgagg

SEQ ID NO: 4597501 - DNA, 16 bp, Homo sapiens
tttccataagctattt

SEQ ID NO: 4597502 - DNA, 21 bp, Homo sapiens
tttcccactgtttaaggagtt

SEQ ID NO: 4597503 - DNA, 14 bp, Homo sapiens
tttcccaggaccct

SEQ ID NO: 4597504 - DNA, 17 bp, Homo sapiens
tttccgttaaaatacca

SEQ ID NO: 4597505 - DNA, 19 bp, Homo sapiens
tttcgccgttgaagaggaa

SEQ ID NO: 4597506 - DNA, 20 bp, Homo sapiens
tttctaaaggctacctttgt

SEQ ID NO: 4597507 - DNA, 23 bp, Homo sapiens
tttctcagccgcttctgactgct

SEQ ID NO: 4597508 - DNA, 16 bp, Homo sapiens
tttctcagttttcata

SEQ ID NO: 4597509 - DNA, 13 bp, Homo sapiens
tttctcatgttga

SEQ ID NO: 4597510 - DNA, 15 bp, Homo sapiens
tttctggctatgcat

SEQ ID NO: 4597511 - DNA, 16 bp, Homo sapiens
tttctggctatgcatt

SEQ ID NO: 4597512 - DNA, 17 bp, Homo sapiens
tttctgtgcctgaatat

SEQ ID NO: 4597513 - DNA, 19 bp, Homo sapiens
tttctgtgtttagctattt

SEQ ID NO: 4597514 - DNA, 20 bp, Homo sapiens
tttctgttctttctggctat

SEQ ID NO: 4597515 - DNA, 18 bp, Homo sapiens
tttcttaaaccttcagtt

SEQ ID NO: 4597516 - DNA, 17 bp, Homo sapiens
tttgaactgataaagat

SEQ ID NO: 4597517 - DNA, 19 bp, Homo sapiens
tttgacctctgcagcaata

SEQ ID NO: 4597518 - DNA, 16 bp, Homo sapiens
tttgagaccagcctgg

SEQ ID NO: 4597519 - DNA, 19 bp, Homo sapiens
tttgagaccagcctgggca

SEQ ID NO: 4597520 - DNA, 22 bp, Homo sapiens
tttgaggtctgttctttccaaa

SEQ ID NO: 4597521 - DNA, 13 bp, Homo sapiens
tttgattaaattc

SEQ ID NO: 4597522 - DNA, 21 bp, Homo sapiens
tttgattaaattcttgcaaag

SEQ ID NO: 4597523 - DNA, 16 bp, Homo sapiens
tttgcatttaaaacag

SEQ ID NO: 4597524 - DNA, 16 bp, Homo sapiens
tttgctttgtgatttt

SEQ ID NO: 4597525 - DNA, 17 bp, Homo sapiens
tttggcctgcactaatt

SEQ ID NO: 4597526 - DNA, 14 bp, Homo sapiens
tttggggatatttt

SEQ ID NO: 4597527 - DNA, 15 bp, Homo sapiens
tttgggttctgcctg

SEQ ID NO: 4597528 - DNA, 15 bp, Homo sapiens
tttgtaaattaactt

SEQ ID NO: 4597529 - DNA, 17 bp, Homo sapiens
tttgtaaattaactttt

SEQ ID NO: 4597530 - DNA, 22 bp, Homo sapiens
tttgtaactgtttagatgaatg

SEQ ID NO: 4597531 - DNA, 23 bp, Homo sapiens
tttgtaactgtttagatgaatgt

SEQ ID NO: 4597532 - DNA, 19 bp, Homo sapiens
tttgtaataataaagaata

SEQ ID NO: 4597533 - DNA, 16 bp, Homo sapiens
tttgtaatttttttat

SEQ ID NO: 4597534 - DNA, 16 bp, Homo sapiens
tttgtgatacaatgct

SEQ ID NO: 4597535 - DNA, 19 bp, Homo sapiens
tttgtgcattatctagata

SEQ ID NO: 4597536 - DNA, 18 bp, Homo sapiens
tttgtttgaactgataaa

SEQ ID NO: 4597537 - DNA, 20 bp, Homo sapiens
ttttaaaaaaaactatttaa

SEQ ID NO: 4597538 - DNA, 13 bp, Homo sapiens
ttttaaactgtgt

SEQ ID NO: 4597539 - DNA, 23 bp, Homo sapiens
ttttaaactgtgtacataactga

SEQ ID NO: 4597540 - DNA, 12 bp, Homo sapiens
ttttaaatgcac

SEQ ID NO: 4597541 - DNA, 20 bp, Homo sapiens
ttttacttttaaactgtgta

SEQ ID NO: 4597542 - DNA, 21 bp, Homo sapiens
ttttatacataaacaagacca

SEQ ID NO: 4597543 - DNA, 16 bp, Homo sapiens
ttttcaagaataatca

SEQ ID NO: 4597544 - DNA, 17 bp, Homo sapiens
ttttctgtgcctgaata

SEQ ID NO: 4597545 - DNA, 18 bp, Homo sapiens
ttttctgtgcctgaatat

SEQ ID NO: 4597546 - DNA, 13 bp, Homo sapiens
ttttctgtgttta

SEQ ID NO: 4597547 - DNA, 13 bp, Homo sapiens
ttttgctggaata

SEQ ID NO: 4597548 - DNA, 19 bp, Homo sapiens
ttttgtaataataaagaat

SEQ ID NO: 4597549 - DNA, 20 bp, Homo sapiens
ttttgtgcattatctagata

SEQ ID NO: 4597550 - DNA, 23 bp, Homo sapiens
ttttgtgcattatctagatactg

SEQ ID NO: 4597551 - DNA, 21 bp, Homo sapiens
tttttaaaaaaaactatttaa

SEQ ID NO: 4597552 - DNA, 20 bp, Homo sapiens
tttttaaatgtaaagatatt

SEQ ID NO: 4597553 - DNA, 19 bp, Homo sapiens
tttttaagtgctgcattta

SEQ ID NO: 4597554 - DNA, 23 bp, Homo sapiens
tttttaagtgctgcatttaaaag

SEQ ID NO: 4597555 - DNA, 11 bp, Homo sapiens
tttttactaat

SEQ ID NO: 4597556 - DNA, 23 bp, Homo sapiens
tttttatacataaacaagaccac

SEQ ID NO: 4597557 - DNA, 16 bp, Homo sapiens
tttttatgctatttct

SEQ ID NO: 4597558 - DNA, 12 bp, Homo sapiens
tttttatggctt

SEQ ID NO: 4597559 - DNA, 12 bp, Homo sapiens
ttgtaaaatggt

SEQ ID NO: 4597560 - DNA, 15 bp, Homo sapiens
ttgtaaattaacttt

SEQ ID NO: 4597561 - DNA, 18 bp, Homo sapiens
ttgtaactaaaataattt

SEQ ID NO: 4597562 - DNA, 21 bp, Homo sapiens
ttgtaactaaaataattttgt

SEQ ID NO: 4597563 - DNA, 14 bp, Homo sapiens
ttgtaatatgtaaa

SEQ ID NO: 4597564 - DNA, 19 bp, Homo sapiens
ttgtattctctcctgtacc

SEQ ID NO: 4597565 - DNA, 19 bp, Homo sapiens
ttgtctctatgccagctca

SEQ ID NO: 4597566 - DNA, 12 bp, Homo sapiens
ttgtgatttttg

SEQ ID NO: 4597567 - DNA, 17 bp, Homo sapiens
ttgtgcattatctagat

SEQ ID NO: 4597568 - DNA, 12 bp, Homo sapiens
ttgtgcccctgc

SEQ ID NO: 4597569 - DNA, 19 bp, Homo sapiens
ttgtgcctcactggacttg

SEQ ID NO: 4597570 - DNA, 22 bp, Homo sapiens
ttgttagtatgaggcatttgtt

SEQ ID NO: 4597571 - DNA, 19 bp, Homo sapiens
ttgtttaagcatcacatta

SEQ ID NO: 4597572 - DNA, 19 bp, Homo sapiens
ttgtttctttctctgagga

SEQ ID NO: 4597573 - DNA, 19 bp, Homo sapiens
tttaaaaaaaactatttaa

SEQ ID NO: 4597574 - DNA, 17 bp, Homo sapiens
tttaaaaaatgctgggt

SEQ ID NO: 4597575 - DNA, 21 bp, Homo sapiens
tttaaaacccatttaaatttt

SEQ ID NO: 4597576 - DNA, 14 bp, Homo sapiens
tttaaactgtgtac

SEQ ID NO: 4597577 - DNA, 18 bp, Homo sapiens
tttaaatttttttcctta

SEQ ID NO: 4597578 - DNA, 23 bp, Homo sapiens
tttaacattcttttgtttatatt

SEQ ID NO: 4597579 - DNA, 16 bp, Homo sapiens
tttaacctatgatatt

SEQ ID NO: 4597580 - DNA, 17 bp, Homo sapiens
tttaagaactaaaatgt

SEQ ID NO: 4597581 - DNA, 19 bp, Homo sapiens
tttaaggatgcttgtacat

SEQ ID NO: 4597582 - DNA, 15 bp, Homo sapiens
tttaagtgctgcatt

SEQ ID NO: 4597583 - DNA, 19 bp, Homo sapiens
tttaagtgctgcatttaaa

SEQ ID NO: 4597584 - DNA, 13 bp, Homo sapiens
tttaataaaccat

SEQ ID NO: 4597585 - DNA, 16 bp, Homo sapiens
tttaatttgaaatatg

SEQ ID NO: 4597586 - DNA, 17 bp, Homo sapiens
tttacagtgtttctggc

SEQ ID NO: 4597587 - DNA, 19 bp, Homo sapiens
tttaccttttttatacata

SEQ ID NO: 4597588 - DNA, 15 bp, Homo sapiens
tttacttttaaactg

SEQ ID NO: 4597589 - DNA, 16 bp, Homo sapiens
tttacttttaaactgt

SEQ ID NO: 4597590 - DNA, 18 bp, Homo sapiens
tttagagttgatactaca

SEQ ID NO: 4597591 - DNA, 17 bp, Homo sapiens
tttagatgtaattttgt

SEQ ID NO: 4597592 - DNA, 13 bp, Homo sapiens
tttagctatttaa

SEQ ID NO: 4597593 - DNA, 21 bp, Homo sapiens
tttagctatttaatactaatt

SEQ ID NO: 4597594 - DNA, 22 bp, Homo sapiens
tttagtgcaaagtataaaatta

SEQ ID NO: 4597595 - DNA, 18 bp, Homo sapiens
tttataaactttaccttt

SEQ ID NO: 4597596 - DNA, 12 bp, Homo sapiens
tttatacataaa

SEQ ID NO: 4597597 - DNA, 14 bp, Homo sapiens
tttatatgaagaaa

SEQ ID NO: 4597598 - DNA, 22 bp, Homo sapiens
tttatcataaacattttacatg

SEQ ID NO: 4597599 - DNA, 12 bp, Homo sapiens
tttatctttata

SEQ ID NO: 4597600 - DNA, 15 bp, Homo sapiens
tttatgcaaggaagg

SEQ ID NO: 4597601 - DNA, 14 bp, Homo sapiens
tttatgttatttat

SEQ ID NO: 4597602 - DNA, 13 bp, Homo sapiens
tttattatgcatg

SEQ ID NO: 4597603 - DNA, 16 bp, Homo sapiens
tttcaaactttactat

SEQ ID NO: 4597604 - DNA, 22 bp, Homo sapiens
tttcaaactttactatggccct

SEQ ID NO: 4597605 - DNA, 22 bp, Homo sapiens
tttcaagttccaagttgctaat

SEQ ID NO: 4597606 - DNA, 16 bp, Homo sapiens
tttcaagttgtaaata

SEQ ID NO: 4597607 - DNA, 11 bp, Homo sapiens
tttcagaaatg

SEQ ID NO: 4597608 - DNA, 21 bp, Homo sapiens
tttcagactcccattcctgaa

SEQ ID NO: 4597609 - DNA, 12 bp, Homo sapiens
tttccaaagtac

SEQ ID NO: 4597610 - DNA, 16 bp, Homo sapiens
tttcccaggaccctga

SEQ ID NO: 4597611 - DNA, 15 bp, Homo sapiens
tttccgttaaaatac

SEQ ID NO: 4597612 - DNA, 21 bp, Homo sapiens
tttcctgaaacaacttggaaa

SEQ ID NO: 4597613 - DNA, 14 bp, Homo sapiens
tttcctggtgccaa

SEQ ID NO: 4597614 - DNA, 16 bp, Homo sapiens
tttcctggtgccaatt

SEQ ID NO: 4597615 - DNA, 21 bp, Homo sapiens
tttctaaaggctacctttgta

SEQ ID NO: 4597616 - DNA, 19 bp, Homo sapiens
tttctaaatctccaaaata

SEQ ID NO: 4597617 - DNA, 15 bp, Homo sapiens
tttctatgacacatg

SEQ ID NO: 4597618 - DNA, 18 bp, Homo sapiens
tttcttagggaaggatac

SEQ ID NO: 4597619 - DNA, 22 bp, Homo sapiens
tttcttgcaagcaacaagctat

SEQ ID NO: 4597620 - DNA, 16 bp, Homo sapiens
tttgaaatatggtctt

SEQ ID NO: 4597621 - DNA, 15 bp, Homo sapiens
tttgaactgataaag

SEQ ID NO: 4597622 - DNA, 21 bp, Homo sapiens
tttgaaggtagaatgttttca

SEQ ID NO: 4597623 - DNA, 19 bp, Homo sapiens
tttgcatttaaaacagaca

SEQ ID NO: 4597624 - DNA, 21 bp, Homo sapiens
tttgcatttaaaacagacact

SEQ ID NO: 4597625 - DNA, 23 bp, Homo sapiens
tttgcatttaaaacagacactgg

SEQ ID NO: 4597626 - DNA, 18 bp, Homo sapiens
tttgcccagaaagaagat

SEQ ID NO: 4597627 - DNA, 14 bp, Homo sapiens
tttgctttgtttaa

SEQ ID NO: 4597628 - DNA, 16 bp, Homo sapiens
tttggacctaatccaa

SEQ ID NO: 4597629 - DNA, 22 bp, Homo sapiens
tttgtaaattaacttttataaa

SEQ ID NO: 4597630 - DNA, 21 bp, Homo sapiens
tttgtaataataaagaatagc

SEQ ID NO: 4597631 - DNA, 22 bp, Homo sapiens
tttgtgatacaatgctgtgccc

SEQ ID NO: 4597632 - DNA, 15 bp, Homo sapiens
tttgtgattcaatct

SEQ ID NO: 4597633 - DNA, 22 bp, Homo sapiens
tttgtgcattatctagatactg

SEQ ID NO: 4597634 - DNA, 11 bp, Homo sapiens
ttttaaatgca

SEQ ID NO: 4597635 - DNA, 16 bp, Homo sapiens
ttttaagtgctgcatt

SEQ ID NO: 4597636 - DNA, 21 bp, Homo sapiens
ttttaatctctaacagtggac

SEQ ID NO: 4597637 - DNA, 15 bp, Homo sapiens
ttttactaatagaca

SEQ ID NO: 4597638 - DNA, 17 bp, Homo sapiens
ttttagagttgatacta

SEQ ID NO: 4597639 - DNA, 23 bp, Homo sapiens
ttttagagttgatactacagttt

SEQ ID NO: 4597640 - DNA, 17 bp, Homo sapiens
ttttataaactttacct

SEQ ID NO: 4597641 - DNA, 18 bp, Homo sapiens
ttttatcgtcactgctta

SEQ ID NO: 4597642 - DNA, 18 bp, Homo sapiens
ttttatggcttttgtgca

SEQ ID NO: 4597643 - DNA, 16 bp, Homo sapiens
ttttatgttatttata

SEQ ID NO: 4597644 - DNA, 18 bp, Homo sapiens
ttttcagcaaactctttt

SEQ ID NO: 4597645 - DNA, 13 bp, Homo sapiens
ttttctgttcttt

SEQ ID NO: 4597646 - DNA, 18 bp, Homo sapiens
ttttgatgtaaagatgtt

SEQ ID NO: 4597647 - DNA, 11 bp, Homo sapiens
tttttaaatgc

SEQ ID NO: 4597648 - DNA, 12 bp, Homo sapiens
tttttaagaaaa

SEQ ID NO: 4597649 - DNA, 23 bp, Homo sapiens
tttttaagaaaaaggatgcacag

SEQ ID NO: 4597650 - DNA, 20 bp, Homo sapiens
tttttaagtgaaaatatagc

SEQ ID NO: 4597651 - DNA, 16 bp, Homo sapiens
tttttaagtgctgcat

SEQ ID NO: 4597652 - DNA, 20 bp, Homo sapiens
tttttatcgtcactgcttaa

SEQ ID NO: 4597653 - DNA, 21 bp, Homo sapiens
tttttatggcttttgtgcatt

SEQ ID NO: 4597654 - DNA, 22 bp, Homo sapiens
tttttatggcttttgtgcatta

SEQ ID NO: 4597655 - DNA, 19 bp, Homo sapiens
tttttggaagtgaaaactt

SEQ ID NO: 4597656 - DNA, 12 bp, Homo sapiens
ttttttactaat

SEQ ID NO: 4597657 - DNA, 14 bp, Homo sapiens
tggctatgcatttg

SEQ ID NO: 4597658 - DNA, 20 bp, Homo sapiens
tggctttgtgattcaatctg

SEQ ID NO: 4597659 - DNA, 21 bp, Homo sapiens
tggcttttgtgcattatctag

SEQ ID NO: 4597660 - DNA, 20 bp, Homo sapiens
tgggaaaggggagtaggtgg

SEQ ID NO: 4597661 - DNA, 10 bp, Homo sapiens
tgggattgct

SEQ ID NO: 4597662 - DNA, 19 bp, Homo sapiens
tgggccagacatgccacaa

SEQ ID NO: 4597663 - DNA, 17 bp, Homo sapiens
tgggccatattccgcac

SEQ ID NO: 4597664 - DNA, 13 bp, Homo sapiens
tgggcctgcagaa

SEQ ID NO: 4597665 - DNA, 15 bp, Homo sapiens
tgggcctgctccaga

SEQ ID NO: 4597666 - DNA, 13 bp, Homo sapiens
tgggcttcatctg

SEQ ID NO: 4597667 - DNA, 17 bp, Homo sapiens
tggggacagaccagccc

SEQ ID NO: 4597668 - DNA, 16 bp, Homo sapiens
tggggagttaagacct

SEQ ID NO: 4597669 - DNA, 19 bp, Homo sapiens
tggggagttaagacctggc

SEQ ID NO: 4597670 - DNA, 13 bp, Homo sapiens
tggggccagatcc

SEQ ID NO: 4597671 - DNA, 15 bp, Homo sapiens
tggggccagatccag

SEQ ID NO: 4597672 - DNA, 18 bp, Homo sapiens
tggggccagatccagcct

SEQ ID NO: 4597673 - DNA, 17 bp, Homo sapiens
tggggctaggggctggg

SEQ ID NO: 4597674 - DNA, 18 bp, Homo sapiens
tggggctaggggctgggg

SEQ ID NO: 4597675 - DNA, 18 bp, Homo sapiens
tgggggaacactgagaaa

SEQ ID NO: 4597676 - DNA, 20 bp, Homo sapiens
tgggggaactcagatccagg

SEQ ID NO: 4597677 - DNA, 12 bp, Homo sapiens
tgggggtgcatt

SEQ ID NO: 4597678 - DNA, 21 bp, Homo sapiens
tggggtctggagttgatctgg

SEQ ID NO: 4597679 - DNA, 19 bp, Homo sapiens
tggggttgccctgggggat

SEQ ID NO: 4597680 - DNA, 19 bp, Homo sapiens
tgggtacttcttgaaggtg

SEQ ID NO: 4597681 - DNA, 19 bp, Homo sapiens
tggtatggaactctctcca

SEQ ID NO: 4597682 - DNA, 17 bp, Homo sapiens
tggtcacaggaagtaga

SEQ ID NO: 4597683 - DNA, 22 bp, Homo sapiens
tggtcacaggaagtagaggagg

SEQ ID NO: 4597684 - DNA, 21 bp, Homo sapiens
tggtccaaaagattgctgaaa

SEQ ID NO: 4597685 - DNA, 23 bp, Homo sapiens
tggtccaaaagattgctgaaatt

SEQ ID NO: 4597686 - DNA, 19 bp, Homo sapiens
tggtgccccaggaccagct

SEQ ID NO: 4597687 - DNA, 20 bp, Homo sapiens
tggtgccccaggaccagctc

SEQ ID NO: 4597688 - DNA, 17 bp, Homo sapiens
tggtggtttcagaaatg

SEQ ID NO: 4597689 - DNA, 18 bp, Homo sapiens
tggtgtaaggtactttca

SEQ ID NO: 4597690 - DNA, 17 bp, Homo sapiens
tggttcctttctcagcc

SEQ ID NO: 4597691 - DNA, 14 bp, Homo sapiens
tggtttcagaaatg

SEQ ID NO: 4597692 - DNA, 16 bp, Homo sapiens
tggttttctgttcttt

SEQ ID NO: 4597693 - DNA, 19 bp, Homo sapiens
tgtaaaagcattttgtaat

SEQ ID NO: 4597694 - DNA, 12 bp, Homo sapiens
tgtaaaatggtg

SEQ ID NO: 4597695 - DNA, 18 bp, Homo sapiens
tgtaaagatatttttatc

SEQ ID NO: 4597696 - DNA, 14 bp, Homo sapiens
tgtaaattaacttt

SEQ ID NO: 4597697 - DNA, 15 bp, Homo sapiens
tgtaaattaactttt

SEQ ID NO: 4597698 - DNA, 14 bp, Homo sapiens
tgtaactaaaataa

SEQ ID NO: 4597699 - DNA, 23 bp, Homo sapiens
tgtaatgtatcaaatacatttaa

SEQ ID NO: 4597700 - DNA, 21 bp, Homo sapiens
tgtaatttgtgatacaatgct

SEQ ID NO: 4597701 - DNA, 16 bp, Homo sapiens
tgtaattttgtgtaag

SEQ ID NO: 4597702 - DNA, 20 bp, Homo sapiens
tgtaattttgtgtaagaaat

SEQ ID NO: 4597703 - DNA, 20 bp, Homo sapiens
tgtaatttttttatcgtcac

SEQ ID NO: 4597704 - DNA, 22 bp, Homo sapiens
tgtacagcaaggagatttacaa

SEQ ID NO: 4597705 - DNA, 23 bp, Homo sapiens
tgtacagcaaggagatttacaac

SEQ ID NO: 4597706 - DNA, 13 bp, Homo sapiens
tgtacataactga

SEQ ID NO: 4597707 - DNA, 17 bp, Homo sapiens
tgtacataactgaaaat

SEQ ID NO: 4597708 - DNA, 18 bp, Homo sapiens
tgtacataactgaaaatg

SEQ ID NO: 4597709 - DNA, 18 bp, Homo sapiens
tgtacatgaaaacacatt

SEQ ID NO: 4597710 - DNA, 14 bp, Homo sapiens
tgtacctcttgagc

SEQ ID NO: 4597711 - DNA, 16 bp, Homo sapiens
tgtagaggagaaactg

SEQ ID NO: 4597712 - DNA, 23 bp, Homo sapiens
tgtagtcctagccactcaggagg

SEQ ID NO: 4597713 - DNA, 15 bp, Homo sapiens
tgtattttatgttat

SEQ ID NO: 4597714 - DNA, 14 bp, Homo sapiens
tgtatttttttact

SEQ ID NO: 4597715 - DNA, 16 bp, Homo sapiens
tgtatttttttactaa

SEQ ID NO: 4597716 - DNA, 20 bp, Homo sapiens
tgtcaaccccaagttagttc

SEQ ID NO: 4597717 - DNA, 16 bp, Homo sapiens
tgtcaggaacagaagg

SEQ ID NO: 4597718 - DNA, 17 bp, Homo sapiens
tgtcaggaacagaagga

SEQ ID NO: 4597719 - DNA, 18 bp, Homo sapiens
tgtcagttgttatttatt

SEQ ID NO: 4597720 - DNA, 12 bp, Homo sapiens
tgtccagctcca

SEQ ID NO: 4597721 - DNA, 17 bp, Homo sapiens
tgtcctcagccttgcca

SEQ ID NO: 4597722 - DNA, 15 bp, Homo sapiens
tgtcctgggcctgca

SEQ ID NO: 4597723 - DNA, 13 bp, Homo sapiens
tgtctaaaaacac

SEQ ID NO: 4597724 - DNA, 22 bp, Homo sapiens
tgtctcagtccatgaagatgta

SEQ ID NO: 4597725 - DNA, 13 bp, Homo sapiens
tgtctgttctaca

SEQ ID NO: 4597726 - DNA, 14 bp, Homo sapiens
tgtgaaggaccctt

SEQ ID NO: 4597727 - DNA, 23 bp, Homo sapiens
tgtgaaggcaggggaatgtatgt

SEQ ID NO: 4597728 - DNA, 15 bp, Homo sapiens
tgtgactgaatttct

SEQ ID NO: 4597729 - DNA, 16 bp, Homo sapiens
tgtgactgaatttctt

SEQ ID NO: 4597730 - DNA, 14 bp, Homo sapiens
tgtgattcaatctg

SEQ ID NO: 4597731 - DNA, 15 bp, Homo sapiens
tgtgattcaatctgt

SEQ ID NO: 4597732 - DNA, 15 bp, Homo sapiens
tgtgcacatctgttt

SEQ ID NO: 4597733 - DNA, 21 bp, Homo sapiens
tgtgcattatctagatactgt

SEQ ID NO: 4597734 - DNA, 21 bp, Homo sapiens
tgtgccctaaagtgtattttt

SEQ ID NO: 4597735 - DNA, 14 bp, Homo sapiens
tgtgcctaatgtgt

SEQ ID NO: 4597736 - DNA, 17 bp, Homo sapiens
tgtgcgagggggccttg

SEQ ID NO: 4597737 - DNA, 13 bp, Homo sapiens
tgtgctatactgc

SEQ ID NO: 4597738 - DNA, 19 bp, Homo sapiens
tgtggatcaaccatcgctt

SEQ ID NO: 4597739 - DNA, 20 bp, Homo sapiens
tgtggatcaaccatcgcttt

SEQ ID NO: 4597740 - DNA, 14 bp, Homo sapiens
tgtgtggtcaacat

SEQ ID NO: 4597741 - DNA, 15 bp, Homo sapiens
tgtgtttagctattt

SEQ ID NO: 4597742 - DNA, 20 bp, Homo sapiens
tgttaagggaagaattccag

SEQ ID NO: 4597743 - DNA, 20 bp, Homo sapiens
tgttagattaagaaatagac

SEQ ID NO: 4597744 - DNA, 19 bp, Homo sapiens
tgttagtatgaggcatttg

SEQ ID NO: 4597745 - DNA, 15 bp, Homo sapiens
tgttatgctgtgaca

SEQ ID NO: 4597746 - DNA, 22 bp, Homo sapiens
tgttatgtcaaactgtcttggc

SEQ ID NO: 4597747 - DNA, 18 bp, Homo sapiens
tgttatttattgaaatga

SEQ ID NO: 4597748 - DNA, 19 bp, Homo sapiens
tgttatttattgaaatgat

SEQ ID NO: 4597749 - DNA, 22 bp, Homo sapiens
tgttcattaaagcatgaatggt

SEQ ID NO: 4597750 - DNA, 15 bp, Homo sapiens
tgttctaagaagtga

SEQ ID NO: 4597751 - DNA, 18 bp, Homo sapiens
tgttcttggtttgtaaat

SEQ ID NO: 4597752 - DNA, 19 bp, Homo sapiens
tgttcttggtttgtaaatt

SEQ ID NO: 4597753 - DNA, 14 bp, Homo sapiens
tgttctttccaaag

SEQ ID NO: 4597754 - DNA, 14 bp, Homo sapiens
tgttctttctggct

SEQ ID NO: 4597755 - DNA, 22 bp, Homo sapiens
tgttctttctggctatgcattt

SEQ ID NO: 4597756 - DNA, 16 bp, Homo sapiens
tgttgattaaagatga

SEQ ID NO: 4597757 - DNA, 11 bp, Homo sapiens
tgttgtcaaga

SEQ ID NO: 4597758 - DNA, 18 bp, Homo sapiens
tgtttaagcatcacatta

SEQ ID NO: 4597759 - DNA, 16 bp, Homo sapiens
tgtttagataatacac

SEQ ID NO: 4597760 - DNA, 13 bp, Homo sapiens
tgtttagctattt

SEQ ID NO: 4597761 - DNA, 16 bp, Homo sapiens
tgtttagctatttaat

SEQ ID NO: 4597762 - DNA, 12 bp, Homo sapiens
tgtttctgactc

SEQ ID NO: 4597763 - DNA, 18 bp, Homo sapiens
tgtttctggcttagaaca

SEQ ID NO: 4597764 - DNA, 18 bp, Homo sapiens
tgttttaaggatgcttgt

SEQ ID NO: 4597765 - DNA, 15 bp, Homo sapiens
ttaaaaatctcaaat

SEQ ID NO: 4597766 - DNA, 16 bp, Homo sapiens
ttaaaaatctcaaatt

SEQ ID NO: 4597767 - DNA, 14 bp, Homo sapiens
ttaaaagatacagt

SEQ ID NO: 4597768 - DNA, 13 bp, Homo sapiens
ttaaacagaggat

SEQ ID NO: 4597769 - DNA, 13 bp, Homo sapiens
ttaaactgtattt

SEQ ID NO: 4597770 - DNA, 22 bp, Homo sapiens
ttaaataatgtgaaactggatt

SEQ ID NO: 4597771 - DNA, 17 bp, Homo sapiens
ttaaatgcacctggaat

SEQ ID NO: 4597772 - DNA, 18 bp, Homo sapiens
ttaaatgcacctggaata

SEQ ID NO: 4597773 - DNA, 16 bp, Homo sapiens
ttaaattcttgcaaag

SEQ ID NO: 4597774 - DNA, 13 bp, Homo sapiens
ttaacagaaatgt

SEQ ID NO: 4597775 - DNA, 14 bp, Homo sapiens
ttaacagaaatgta

SEQ ID NO: 4597776 - DNA, 16 bp, Homo sapiens
ttaacagaaatgtaca

SEQ ID NO: 4597777 - DNA, 14 bp, Homo sapiens
ttaacttttataaa

SEQ ID NO: 4597778 - DNA, 15 bp, Homo sapiens
ttaacttttataaac

SEQ ID NO: 4597779 - DNA, 17 bp, Homo sapiens
ttaacttttataaactt

SEQ ID NO: 4597780 - DNA, 20 bp, Homo sapiens
ttaagaaaaaggatgcacag

SEQ ID NO: 4597781 - DNA, 14 bp, Homo sapiens
ttaagacctggcag

SEQ ID NO: 4597782 - DNA, 15 bp, Homo sapiens
ttaatactaattttc

SEQ ID NO: 4597783 - DNA, 22 bp, Homo sapiens
ttaatcattaggtgtgactgaa

SEQ ID NO: 4597784 - DNA, 15 bp, Homo sapiens
ttaatctaaatggaa

SEQ ID NO: 4597785 - DNA, 13 bp, Homo sapiens
ttaatgaagttga

SEQ ID NO: 4597786 - DNA, 16 bp, Homo sapiens
ttaattaccaacctgt

SEQ ID NO: 4597787 - DNA, 13 bp, Homo sapiens
ttaatttgaaata

SEQ ID NO: 4597788 - DNA, 13 bp, Homo sapiens
ttaattttcctgg

SEQ ID NO: 4597789 - DNA, 20 bp, Homo sapiens
ttacaattttttatcatgca

SEQ ID NO: 4597790 - DNA, 20 bp, Homo sapiens
ttacagagacagaaagcaga

SEQ ID NO: 4597791 - DNA, 21 bp, Homo sapiens
ttacatttttaagtgctgcat

SEQ ID NO: 4597792 - DNA, 18 bp, Homo sapiens
ttaccagtgccttaaact

SEQ ID NO: 4597793 - DNA, 23 bp, Homo sapiens
ttacctactttgactttttgcat

SEQ ID NO: 4597794 - DNA, 19 bp, Homo sapiens
ttaccttttttatacataa

SEQ ID NO: 4597795 - DNA, 14 bp, Homo sapiens
ttactaagttttta

SEQ ID NO: 4597796 - DNA, 16 bp, Homo sapiens
ttactaatagacaatt

SEQ ID NO: 4597797 - DNA, 17 bp, Homo sapiens
ttactagtttcccttgc

SEQ ID NO: 4597798 - DNA, 18 bp, Homo sapiens
ttactcagaattctctag

SEQ ID NO: 4597799 - DNA, 14 bp, Homo sapiens
ttactggtccaaaa

SEQ ID NO: 4597800 - DNA, 17 bp, Homo sapiens
ttactggtccaaaagat

SEQ ID NO: 4597801 - DNA, 18 bp, Homo sapiens
ttactggtccaaaagatt

SEQ ID NO: 4597802 - DNA, 14 bp, Homo sapiens
ttactgtacatgaa

SEQ ID NO: 4597803 - DNA, 14 bp, Homo sapiens
ttacttttaaactg

SEQ ID NO: 4597804 - DNA, 13 bp, Homo sapiens
ttagctatttaat

SEQ ID NO: 4597805 - DNA, 16 bp, Homo sapiens
ttaggagaagccagga

SEQ ID NO: 4597806 - DNA, 18 bp, Homo sapiens
ttagtatgaggcatttgt

SEQ ID NO: 4597807 - DNA, 13 bp, Homo sapiens
ttatacataaaca

SEQ ID NO: 4597808 - DNA, 13 bp, Homo sapiens
ttatatgcttact

SEQ ID NO: 4597809 - DNA, 19 bp, Homo sapiens
ttatatgcttactgatata

SEQ ID NO: 4597810 - DNA, 19 bp, Homo sapiens
ttatattgttttgtctcct

SEQ ID NO: 4597811 - DNA, 17 bp, Homo sapiens
ttatcacccagaagaaa

SEQ ID NO: 4597812 - DNA, 19 bp, Homo sapiens
ttatcacccagaagaaaat

SEQ ID NO: 4597813 - DNA, 17 bp, Homo sapiens
ttatctagatactgtat

SEQ ID NO: 4597814 - DNA, 14 bp, Homo sapiens
ttatctcctcctcc

SEQ ID NO: 4597815 - DNA, 12 bp, Homo sapiens
ttatctttatat

SEQ ID NO: 4597816 - DNA, 18 bp, Homo sapiens
ttatgatttttttttcat

SEQ ID NO: 4597817 - DNA, 19 bp, Homo sapiens
ttatgatttttttttcata

SEQ ID NO: 4597818 - DNA, 22 bp, Homo sapiens
ttatgcatgaagtaatatgcac

SEQ ID NO: 4597819 - DNA, 14 bp, Homo sapiens
ttatggcacatcag

SEQ ID NO: 4597820 - DNA, 16 bp, Homo sapiens
ttatggcttttgtgca

SEQ ID NO: 4597821 - DNA, 17 bp, Homo sapiens
ttatggcttttgtgcat

SEQ ID NO: 4597822 - DNA, 19 bp, Homo sapiens
ttatggcttttgtgcatta

SEQ ID NO: 4597823 - DNA, 22 bp, Homo sapiens
ttatgtcaaactgtcttggctg

SEQ ID NO: 4597824 - DNA, 18 bp, Homo sapiens
ttattcattagttttgaa

SEQ ID NO: 4597825 - DNA, 14 bp, Homo sapiens
ttattggctgagat

SEQ ID NO: 4597826 - DNA, 16 bp, Homo sapiens
ttattggctgagatat

SEQ ID NO: 4597827 - DNA, 20 bp, Homo sapiens
ttatttaaactctgttgcaa

SEQ ID NO: 4597828 - DNA, 13 bp, Homo sapiens
ttatttgcatgtg

SEQ ID NO: 4597829 - DNA, 19 bp, Homo sapiens
ttcaaatagggtctaactc

SEQ ID NO: 4597830 - DNA, 19 bp, Homo sapiens
ttcaaattcttctgaactc

SEQ ID NO: 4597831 - DNA, 23 bp, Homo sapiens
ttcaatctggattcatatttaat

SEQ ID NO: 4597832 - DNA, 21 bp, Homo sapiens
ttcacagttctttgggccaga

SEQ ID NO: 4597833 - DNA, 13 bp, Homo sapiens
ttcacctgtaaac

SEQ ID NO: 4597834 - DNA, 18 bp, Homo sapiens
ttcacctgtaaacctgag

SEQ ID NO: 4597835 - DNA, 22 bp, Homo sapiens
ttcacttaagttagttccactg

SEQ ID NO: 4597836 - DNA, 13 bp, Homo sapiens
ttcacttgcacat

SEQ ID NO: 4597837 - DNA, 16 bp, Homo sapiens
ttcagaaatgtgttat

SEQ ID NO: 4597838 - DNA, 21 bp, Homo sapiens
ttcagactcccattcctgaag

SEQ ID NO: 4597839 - DNA, 12 bp, Homo sapiens
ttcataagtatt

SEQ ID NO: 4597840 - DNA, 23 bp, Homo sapiens
ttcatattgcatcatagtttgct

SEQ ID NO: 4597841 - DNA, 22 bp, Homo sapiens
ttcatattttaaacagaggata

SEQ ID NO: 4597842 - DNA, 19 bp, Homo sapiens
ttcatctggcaacatcttt

SEQ ID NO: 4597843 - DNA, 19 bp, Homo sapiens
ttcattctttttgaaatgt

SEQ ID NO: 4597844 - DNA, 13 bp, Homo sapiens
ttcccaacacaaa

SEQ ID NO: 4597845 - DNA, 15 bp, Homo sapiens
ttcccaacacaaaga

SEQ ID NO: 4597846 - DNA, 15 bp, Homo sapiens
ttcccactgtttaag

SEQ ID NO: 4597847 - DNA, 12 bp, Homo sapiens
ttcccaggaccc

SEQ ID NO: 4597848 - DNA, 11 bp, Homo sapiens
ttccccagaga

SEQ ID NO: 4597849 - DNA, 22 bp, Homo sapiens
ttccccctgtttcagaggctca

SEQ ID NO: 4597850 - DNA, 13 bp, Homo sapiens
ttcctcctgctca

SEQ ID NO: 4597851 - DNA, 18 bp, Homo sapiens
ttcctgaaacaacttgga

SEQ ID NO: 4597852 - DNA, 18 bp, Homo sapiens
ttcctgaatccaaactaa

SEQ ID NO: 4597853 - DNA, 20 bp, Homo sapiens
ttcctggtgccaatttcaag

SEQ ID NO: 4597854 - DNA, 15 bp, Homo sapiens
ttcctgtccagctcc

SEQ ID NO: 4597855 - DNA, 16 bp, Homo sapiens
ttcctgtccagctcca

SEQ ID NO: 4597856 - DNA, 19 bp, Homo sapiens
ttcctgtttttcacatttt

SEQ ID NO: 4597857 - DNA, 13 bp, Homo sapiens
ttccttacctttt

SEQ ID NO: 4597858 - DNA, 16 bp, Homo sapiens
ttctaaaggctacctt

SEQ ID NO: 4597859 - DNA, 17 bp, Homo sapiens
ttctaaaggctaccttt

SEQ ID NO: 4597860 - DNA, 20 bp, Homo sapiens
ttctaaaggctacctttgta

SEQ ID NO: 4597861 - DNA, 13 bp, Homo sapiens
ttctaaatagcaa

SEQ ID NO: 4597862 - DNA, 23 bp, Homo sapiens
ttctaagaagtgaaaatctacac

SEQ ID NO: 4597863 - DNA, 22 bp, Homo sapiens
ttctcatgttgaaactttaaga

SEQ ID NO: 4597864 - DNA, 18 bp, Homo sapiens
ttctccagccctgactaa

SEQ ID NO: 4597865 - DNA, 17 bp, Homo sapiens
ttctccagtcattatgt

SEQ ID NO: 4597866 - DNA, 19 bp, Homo sapiens
ttctctcctgtacctcttg

SEQ ID NO: 4597867 - DNA, 22 bp, Homo sapiens
ttctctcctgtacctcttgagc

SEQ ID NO: 4597868 - DNA, 16 bp, Homo sapiens
ttctctgaggacaaga

SEQ ID NO: 4597869 - DNA, 17 bp, Homo sapiens
ttctgaactcaaactga

SEQ ID NO: 4597870 - DNA, 22 bp, Homo sapiens
ttctgaactcaaactgaggaat

SEQ ID NO: 4597871 - DNA, 15 bp, Homo sapiens
ttctgactctgagct

SEQ ID NO: 4597872 - DNA, 17 bp, Homo sapiens
ttctgcctgccagctgc

SEQ ID NO: 4597873 - DNA, 19 bp, Homo sapiens
ttctgcctgccagctgcac

SEQ ID NO: 4597874 - DNA, 16 bp, Homo sapiens
ttctggaatggaattg

SEQ ID NO: 4597875 - DNA, 16 bp, Homo sapiens
ttctggctatgcattt

SEQ ID NO: 4597876 - DNA, 15 bp, Homo sapiens
ttctgtgcctgaata

SEQ ID NO: 4597877 - DNA, 14 bp, Homo sapiens
ttctgtgtttagct

SEQ ID NO: 4597878 - DNA, 11 bp, Homo sapiens
ttctgttcttt

SEQ ID NO: 4597879 - DNA, 13 bp, Homo sapiens
ttctgtttagata

SEQ ID NO: 4597880 - DNA, 13 bp, Homo sapiens
ttcttctgaactc

SEQ ID NO: 4597881 - DNA, 16 bp, Homo sapiens
ttcttggtttgtaaat

SEQ ID NO: 4597882 - DNA, 21 bp, Homo sapiens
ttctttccaaagtacactgtt

SEQ ID NO: 4597883 - DNA, 22 bp, Homo sapiens
ttctttctggctatgcatttga

SEQ ID NO: 4597884 - DNA, 14 bp, Homo sapiens
ttgaaatgatttca

SEQ ID NO: 4597885 - DNA, 19 bp, Homo sapiens
ttgaacccgggaggcagag

SEQ ID NO: 4597886 - DNA, 16 bp, Homo sapiens
ttgaactgataaagat

SEQ ID NO: 4597887 - DNA, 13 bp, Homo sapiens
ttgaactttgacc

SEQ ID NO: 4597888 - DNA, 18 bp, Homo sapiens
ttgaactttgacctctgc

SEQ ID NO: 4597889 - DNA, 20 bp, Homo sapiens
ttgaactttgacctctgcag

SEQ ID NO: 4597890 - DNA, 22 bp, Homo sapiens
ttgaagattctatgttaatatt

SEQ ID NO: 4597891 - DNA, 23 bp, Homo sapiens
ttgaagattctatgttaatattt

SEQ ID NO: 4597892 - DNA, 18 bp, Homo sapiens
ttgaagtattttgctgga

SEQ ID NO: 4597893 - DNA, 20 bp, Homo sapiens
ttgaattatcttggttgaaa

SEQ ID NO: 4597894 - DNA, 17 bp, Homo sapiens
ttgacacttaaaaatgg

SEQ ID NO: 4597895 - DNA, 19 bp, Homo sapiens
ttgacacttaaaaatggtt

SEQ ID NO: 4597896 - DNA, 14 bp, Homo sapiens
ttgacctctgcagc

SEQ ID NO: 4597897 - DNA, 16 bp, Homo sapiens
ttgactttttgcattt

SEQ ID NO: 4597898 - DNA, 17 bp, Homo sapiens
ttgactttttgcattta

SEQ ID NO: 4597899 - DNA, 15 bp, Homo sapiens
ttgagaccagcctgg

SEQ ID NO: 4597900 - DNA, 23 bp, Homo sapiens
ttgagagaaatatgaagaactga

SEQ ID NO: 4597901 - DNA, 15 bp, Homo sapiens
ttgatctggaaccca

SEQ ID NO: 4597902 - DNA, 17 bp, Homo sapiens
ttgatctggaacccaga

SEQ ID NO: 4597903 - DNA, 13 bp, Homo sapiens
ttgattaaattct

SEQ ID NO: 4597904 - DNA, 14 bp, Homo sapiens
ttgattaaattctt

SEQ ID NO: 4597905 - DNA, 16 bp, Homo sapiens
ttgattaaattcttgc

SEQ ID NO: 4597906 - DNA, 21 bp, Homo sapiens
ttgattaaattcttgcaaagt

SEQ ID NO: 4597907 - DNA, 18 bp, Homo sapiens
ttgatttccgttaaaata

SEQ ID NO: 4597908 - DNA, 17 bp, Homo sapiens
ttgcaagcaacaagcta

SEQ ID NO: 4597909 - DNA, 19 bp, Homo sapiens
ttgccagagatccaaaaga

SEQ ID NO: 4597910 - DNA, 14 bp, Homo sapiens
ttgctcagccccag

SEQ ID NO: 4597911 - DNA, 17 bp, Homo sapiens
ttgctcagccccagctt

SEQ ID NO: 4597912 - DNA, 11 bp, Homo sapiens
ttgctgaaatt

SEQ ID NO: 4597913 - DNA, 16 bp, Homo sapiens
ttgctgaaattttata

SEQ ID NO: 4597914 - DNA, 14 bp, Homo sapiens
ttgcttgagcccag

SEQ ID NO: 4597915 - DNA, 22 bp, Homo sapiens
ttggagggaaagccagcctggg

SEQ ID NO: 4597916 - DNA, 15 bp, Homo sapiens
ttggagtcactgcca

SEQ ID NO: 4597917 - DNA, 21 bp, Homo sapiens
ttggcaccagacacccaggac

SEQ ID NO: 4597918 - DNA, 14 bp, Homo sapiens
ttggcagtctgaat

SEQ ID NO: 4597919 - DNA, 22 bp, Homo sapiens
ttggctagaggttcaaagatat

SEQ ID NO: 4597920 - DNA, 12 bp, Homo sapiens
ttgggaggctga

SEQ ID NO: 4597921 - DNA, 13 bp, Homo sapiens
ttgggccagacat

SEQ ID NO: 4597922 - DNA, 17 bp, Homo sapiens
ttgggcctgctccagac

SEQ ID NO: 4597923 - DNA, 20 bp, Homo sapiens
ttggggagttaagacctggc

SEQ ID NO: 4597924 - DNA, 21 bp, Homo sapiens
ttggggagttaagacctggca

SEQ ID NO: 4597925 - DNA, 14 bp, Homo sapiens
ttggggatattttt

SEQ ID NO: 4597926 - DNA, 18 bp, Homo sapiens
ttggtggtttcagaaatg

SEQ ID NO: 4597927 - DNA, 19 bp, Homo sapiens
ccttttttatacataaaca

SEQ ID NO: 4597928 - DNA, 15 bp, Homo sapiens
cgcccaggagacatc

SEQ ID NO: 4597929 - DNA, 21 bp, Homo sapiens
cgctgtgtaaatgctccagca

SEQ ID NO: 4597930 - DNA, 22 bp, Homo sapiens
cgctgtgtaaatgctccagcac

SEQ ID NO: 4597931 - DNA, 12 bp, Homo sapiens
cgcttctgactg

SEQ ID NO: 4597932 - DNA, 15 bp, Homo sapiens
cgtaaccacggaaaa

SEQ ID NO: 4597933 - DNA, 22 bp, Homo sapiens
cgtacacattttattttattat

SEQ ID NO: 4597934 - DNA, 13 bp, Homo sapiens
cgtgggaaagggg

SEQ ID NO: 4597935 - DNA, 15 bp, Homo sapiens
cgtgggaaaggggag

SEQ ID NO: 4597936 - DNA, 18 bp, Homo sapiens
cgttgaagaggaagggca

SEQ ID NO: 4597937 - DNA, 20 bp, Homo sapiens
cgtttcctgagaagtgtcta

SEQ ID NO: 4597938 - DNA, 17 bp, Homo sapiens
ctaaaaaacagaggcca

SEQ ID NO: 4597939 - DNA, 17 bp, Homo sapiens
ctaaaataattttgtaa

SEQ ID NO: 4597940 - DNA, 18 bp, Homo sapiens
ctaaaataattttgtaat

SEQ ID NO: 4597941 - DNA, 13 bp, Homo sapiens
ctaaaatgttcta

SEQ ID NO: 4597942 - DNA, 16 bp, Homo sapiens
ctaaagcctcaaaaca

SEQ ID NO: 4597943 - DNA, 17 bp, Homo sapiens
ctaaaggctacctttgt

SEQ ID NO: 4597944 - DNA, 19 bp, Homo sapiens
ctaaaggctacctttgtat

SEQ ID NO: 4597945 - DNA, 20 bp, Homo sapiens
ctaaatctccaaaataaaac

SEQ ID NO: 4597946 - DNA, 17 bp, Homo sapiens
ctaaatggaaccactct

SEQ ID NO: 4597947 - DNA, 21 bp, Homo sapiens
ctaaatggtcgcccaggagac

SEQ ID NO: 4597948 - DNA, 19 bp, Homo sapiens
ctaaattgacacttaaaaa

SEQ ID NO: 4597949 - DNA, 23 bp, Homo sapiens
ctaaattgacacttaaaaatggt

SEQ ID NO: 4597950 - DNA, 16 bp, Homo sapiens
ctaacttcaccatatt

SEQ ID NO: 4597951 - DNA, 19 bp, Homo sapiens
ctaatacagcaacaattta

SEQ ID NO: 4597952 - DNA, 17 bp, Homo sapiens
ctaatagacaatttatt

SEQ ID NO: 4597953 - DNA, 23 bp, Homo sapiens
ctaatagacaatttattatggca

SEQ ID NO: 4597954 - DNA, 15 bp, Homo sapiens
ctaatttgatgttta

SEQ ID NO: 4597955 - DNA, 23 bp, Homo sapiens
ctacaaaaaattagaaattggct

SEQ ID NO: 4597956 - DNA, 21 bp, Homo sapiens
ctacacactgcatgtttgtga

SEQ ID NO: 4597957 - DNA, 16 bp, Homo sapiens
ctacactccagtgaga

SEQ ID NO: 4597958 - DNA, 14 bp, Homo sapiens
ctaccacctcaggt

SEQ ID NO: 4597959 - DNA, 21 bp, Homo sapiens
ctacccctttctccagccctg

SEQ ID NO: 4597960 - DNA, 20 bp, Homo sapiens
ctactccaggcttccacact

SEQ ID NO: 4597961 - DNA, 16 bp, Homo sapiens
ctactgtaatttgtga

SEQ ID NO: 4597962 - DNA, 20 bp, Homo sapiens
ctactttgactttttgcatt

SEQ ID NO: 4597963 - DNA, 18 bp, Homo sapiens
ctagaactctccatctta

SEQ ID NO: 4597964 - DNA, 22 bp, Homo sapiens
ctagagcctctgcctgacagca

SEQ ID NO: 4597965 - DNA, 15 bp, Homo sapiens
ctagaggagggggca

SEQ ID NO: 4597966 - DNA, 18 bp, Homo sapiens
ctagaggagggggcaggc

SEQ ID NO: 4597967 - DNA, 18 bp, Homo sapiens
ctagaggttcaaagatat

SEQ ID NO: 4597968 - DNA, 21 bp, Homo sapiens
ctagaggttcaaagatatttt

SEQ ID NO: 4597969 - DNA, 23 bp, Homo sapiens
ctagcatacgtacacattttatt

SEQ ID NO: 4597970 - DNA, 12 bp, Homo sapiens
ctaggggctggg

SEQ ID NO: 4597971 - DNA, 13 bp, Homo sapiens
ctagtttgattaa

SEQ ID NO: 4597972 - DNA, 15 bp, Homo sapiens
ctagtttgattaaat

SEQ ID NO: 4597973 - DNA, 17 bp, Homo sapiens
ctagtttgattaaattc

SEQ ID NO: 4597974 - DNA, 20 bp, Homo sapiens
ctagtttgattaaattcttg

SEQ ID NO: 4597975 - DNA, 19 bp, Homo sapiens
ctatactgcatacttttta

SEQ ID NO: 4597976 - DNA, 21 bp, Homo sapiens
ctatatgtagtataaagaaaa

SEQ ID NO: 4597977 - DNA, 22 bp, Homo sapiens
ctatattttttgttaaatgatt

SEQ ID NO: 4597978 - DNA, 19 bp, Homo sapiens
ctatcagagttgctgcaaa

SEQ ID NO: 4597979 - DNA, 14 bp, Homo sapiens
ctatgacacatgca

SEQ ID NO: 4597980 - DNA, 19 bp, Homo sapiens
ctatgatttaatttgaaat

SEQ ID NO: 4597981 - DNA, 13 bp, Homo sapiens
ctatgcatggtgc

SEQ ID NO: 4597982 - DNA, 22 bp, Homo sapiens
ctatgcatggtgccccaggacc

SEQ ID NO: 4597983 - DNA, 23 bp, Homo sapiens
ctatgcatggtgccccaggacca

SEQ ID NO: 4597984 - DNA, 21 bp, Homo sapiens
ctatgttaatattttaggtgt

SEQ ID NO: 4597985 - DNA, 18 bp, Homo sapiens
ctatttttggcagtctga

SEQ ID NO: 4597986 - DNA, 21 bp, Homo sapiens
ctcaaatggggccagatccag

SEQ ID NO: 4597987 - DNA, 14 bp, Homo sapiens
ctcaaatttctaaa

SEQ ID NO: 4597988 - DNA, 23 bp, Homo sapiens
ctcaactgcctactccaaaatgt

SEQ ID NO: 4597989 - DNA, 14 bp, Homo sapiens
ctcaatcctctaag

SEQ ID NO: 4597990 - DNA, 17 bp, Homo sapiens
ctcaccccttgccataa

SEQ ID NO: 4597991 - DNA, 20 bp, Homo sapiens
ctcacttctgggcttcatct

SEQ ID NO: 4597992 - DNA, 13 bp, Homo sapiens
ctcagacattggc

SEQ ID NO: 4597993 - DNA, 15 bp, Homo sapiens
ctcagatccagggac

SEQ ID NO: 4597994 - DNA, 16 bp, Homo sapiens
ctcagatccagggaca

SEQ ID NO: 4597995 - DNA, 15 bp, Homo sapiens
ctcagattgtaatat

SEQ ID NO: 4597996 - DNA, 23 bp, Homo sapiens
ctcagccccagcttatctcctcc

SEQ ID NO: 4597997 - DNA, 18 bp, Homo sapiens
ctcagctgtcaaggctca

SEQ ID NO: 4597998 - DNA, 18 bp, Homo sapiens
ctcaggacagatgccaca

SEQ ID NO: 4597999 - DNA, 18 bp, Homo sapiens
ctcaggaggctgaggcag

SEQ ID NO: 4598000 - DNA, 20 bp, Homo sapiens
ctcaggaggctgaggcagga

SEQ ID NO: 4598001 - DNA, 23 bp, Homo sapiens
ctcaggaggctgaggcaggagga

SEQ ID NO: 4598002 - DNA, 16 bp, Homo sapiens
ctcagtaaagcacttg

SEQ ID NO: 4598003 - DNA, 14 bp, Homo sapiens
ctcagttttcataa

SEQ ID NO: 4598004 - DNA, 13 bp, Homo sapiens
ctcatattgtgat

SEQ ID NO: 4598005 - DNA, 21 bp, Homo sapiens
ctcatattgtgattctgcctt

SEQ ID NO: 4598006 - DNA, 18 bp, Homo sapiens
ctcatccctctcacccag

SEQ ID NO: 4598007 - DNA, 17 bp, Homo sapiens
ctcattaggatggctag

SEQ ID NO: 4598008 - DNA, 19 bp, Homo sapiens
ctccaaggaggggctgtaa

SEQ ID NO: 4598009 - DNA, 12 bp, Homo sapiens
ctccagacctga

SEQ ID NO: 4598010 - DNA, 19 bp, Homo sapiens
ctccagacctgatcctgga

SEQ ID NO: 4598011 - DNA, 14 bp, Homo sapiens
ctccagcctgggca

SEQ ID NO: 4598012 - DNA, 22 bp, Homo sapiens
ctccagtcattatgttaatatt

SEQ ID NO: 4598013 - DNA, 14 bp, Homo sapiens
ctcccattcctgaa

SEQ ID NO: 4598014 - DNA, 15 bp, Homo sapiens
ctcccattcctgaag

SEQ ID NO: 4598015 - DNA, 19 bp, Homo sapiens
ctcccattcctgaagaacc

SEQ ID NO: 4598016 - DNA, 14 bp, Homo sapiens
ctccccagcccaga

SEQ ID NO: 4598017 - DNA, 13 bp, Homo sapiens
ctcccccccatgc

SEQ ID NO: 4598018 - DNA, 16 bp, Homo sapiens
ctcccgactgaccact

SEQ ID NO: 4598019 - DNA, 18 bp, Homo sapiens
ctccctgaagcctttgca

SEQ ID NO: 4598020 - DNA, 18 bp, Homo sapiens
ctcctctccccagcccag

SEQ ID NO: 4598021 - DNA, 21 bp, Homo sapiens
ctcctctccccagcccagaga

SEQ ID NO: 4598022 - DNA, 13 bp, Homo sapiens
ctctactccaggc

SEQ ID NO: 4598023 - DNA, 19 bp, Homo sapiens
ctctagtttgattaaattc

SEQ ID NO: 4598024 - DNA, 20 bp, Homo sapiens
ctctagtttgattaaattct

SEQ ID NO: 4598025 - DNA, 19 bp, Homo sapiens
ctctatgttctaagaagtg

SEQ ID NO: 4598026 - DNA, 11 bp, Homo sapiens
ctctccccagc

SEQ ID NO: 4598027 - DNA, 17 bp, Homo sapiens
ctctcctgtacctcttg

SEQ ID NO: 4598028 - DNA, 19 bp, Homo sapiens
ctctctgtgggctggcagt

SEQ ID NO: 4598029 - DNA, 20 bp, Homo sapiens
ctctcttggaccctgggagt

SEQ ID NO: 4598030 - DNA, 21 bp, Homo sapiens
ctctcttggaccctgggagtg

SEQ ID NO: 4598031 - DNA, 23 bp, Homo sapiens
ctctgaagtcacatcacaggaca

SEQ ID NO: 4598032 - DNA, 12 bp, Homo sapiens
ctctgaggacaa

SEQ ID NO: 4598033 - DNA, 23 bp, Homo sapiens
ctctgcatactcattaggatggc

SEQ ID NO: 4598034 - DNA, 20 bp, Homo sapiens
ctctgcccaacccttccctc

SEQ ID NO: 4598035 - DNA, 14 bp, Homo sapiens
ctctgcctgacagc

SEQ ID NO: 4598036 - DNA, 18 bp, Homo sapiens
ctctggacagccccaccc

SEQ ID NO: 4598037 - DNA, 22 bp, Homo sapiens
ctctgttacactttttggaagt

SEQ ID NO: 4598038 - DNA, 19 bp, Homo sapiens
ctcttcagatctctaactt

SEQ ID NO: 4598039 - DNA, 23 bp, Homo sapiens
ctcttccagtcttcctgacactt

SEQ ID NO: 4598040 - DNA, 12 bp, Homo sapiens
ctcttctgagct

SEQ ID NO: 4598041 - DNA, 18 bp, Homo sapiens
ctcttctgagctatttca

SEQ ID NO: 4598042 - DNA, 23 bp, Homo sapiens
ctcttctgagctatttcatctat

SEQ ID NO: 4598043 - DNA, 20 bp, Homo sapiens
ctcttcttgaaattttaacc

SEQ ID NO: 4598044 - DNA, 23 bp, Homo sapiens
ctcttgagccttgaactttgacc

SEQ ID NO: 4598045 - DNA, 21 bp, Homo sapiens
ctctttaagagttagtttctt

SEQ ID NO: 4598046 - DNA, 12 bp, Homo sapiens
ctgaaaatgtgc

SEQ ID NO: 4598047 - DNA, 13 bp, Homo sapiens
ctgaaagaggaat

SEQ ID NO: 4598048 - DNA, 15 bp, Homo sapiens
ctgaactcaaactga

SEQ ID NO: 4598049 - DNA, 21 bp, Homo sapiens
ctgaatattgccattatgctt

SEQ ID NO: 4598050 - DNA, 13 bp, Homo sapiens
ctgacagcatcct

SEQ ID NO: 4598051 - DNA, 13 bp, Homo sapiens
ctgacccagtgcc

SEQ ID NO: 4598052 - DNA, 20 bp, Homo sapiens
ctgacccagtgcccccactg

SEQ ID NO: 4598053 - DNA, 13 bp, Homo sapiens
ctgacccctgctc

SEQ ID NO: 4598054 - DNA, 15 bp, Homo sapiens
ctgaccttaaatgca

SEQ ID NO: 4598055 - DNA, 17 bp, Homo sapiens
ctgactaaactaccacc

SEQ ID NO: 4598056 - DNA, 20 bp, Homo sapiens
ctgactaaactaccacctca

SEQ ID NO: 4598057 - DNA, 17 bp, Homo sapiens
ctgagaaagaggcaggg

SEQ ID NO: 4598058 - DNA, 16 bp, Homo sapiens
ctgagatatgaacata

SEQ ID NO: 4598059 - DNA, 12 bp, Homo sapiens
ctgagccttcag

SEQ ID NO: 4598060 - DNA, 16 bp, Homo sapiens
ctgagcgacagtgaga

SEQ ID NO: 4598061 - DNA, 20 bp, Homo sapiens
ctgagcgacagtgagactct

SEQ ID NO: 4598062 - DNA, 21 bp, Homo sapiens
ctgagggtcgtgggaaagggg

SEQ ID NO: 4598063 - DNA, 19 bp, Homo sapiens
ctgagtacgttgtgcattt

SEQ ID NO: 4598064 - DNA, 17 bp, Homo sapiens
ctgagtcgtacagaaag

SEQ ID NO: 4598065 - DNA, 23 bp, Homo sapiens
ctgagtcgtacagaaagctgcct

SEQ ID NO: 4598066 - DNA, 15 bp, Homo sapiens
ctgatcctggaggcc

SEQ ID NO: 4598067 - DNA, 18 bp, Homo sapiens
ctgatttaggagaagcca

SEQ ID NO: 4598068 - DNA, 20 bp, Homo sapiens
ctgcaaacctgacccctgct

SEQ ID NO: 4598069 - DNA, 15 bp, Homo sapiens
ctgcacaataaaaat

SEQ ID NO: 4598070 - DNA, 17 bp, Homo sapiens
ctgcactgatgctgccc

SEQ ID NO: 4598071 - DNA, 17 bp, Homo sapiens
ctgcagcaataaagcag

SEQ ID NO: 4598072 - DNA, 20 bp, Homo sapiens
ctgcatactttttaaatgta

SEQ ID NO: 4598073 - DNA, 16 bp, Homo sapiens
ctgccagctgcactga

SEQ ID NO: 4598074 - DNA, 22 bp, Homo sapiens
ctgcctctcatcaactgaatga

SEQ ID NO: 4598075 - DNA, 16 bp, Homo sapiens
ctgcctgacagcatcc

SEQ ID NO: 4598076 - DNA, 19 bp, Homo sapiens
ctgcctgacagcatcctct

SEQ ID NO: 4598077 - DNA, 21 bp, Homo sapiens
ctgcctgccagctgcactgat

SEQ ID NO: 4598078 - DNA, 14 bp, Homo sapiens
ctgctctaaataaa

SEQ ID NO: 4598079 - DNA, 16 bp, Homo sapiens
ctgctctaaataaaga

SEQ ID NO: 4598080 - DNA, 17 bp, Homo sapiens
ctgcttaacttcacata

SEQ ID NO: 4598081 - DNA, 16 bp, Homo sapiens
ctggaacccagactca

SEQ ID NO: 4598082 - DNA, 18 bp, Homo sapiens
ctggaacccagactcaga

SEQ ID NO: 4598083 - DNA, 18 bp, Homo sapiens
ctggaacctcagcctggc

SEQ ID NO: 4598084 - DNA, 15 bp, Homo sapiens
ctggaagccagcttt

SEQ ID NO: 4598085 - DNA, 17 bp, Homo sapiens
ctggaagccagctttcc

SEQ ID NO: 4598086 - DNA, 13 bp, Homo sapiens
ctggacagcccca

SEQ ID NO: 4598087 - DNA, 22 bp, Homo sapiens
ctggagaagtgggtggggacag

SEQ ID NO: 4598088 - DNA, 12 bp, Homo sapiens
ctggagctctgc

SEQ ID NO: 4598089 - DNA, 13 bp, Homo sapiens
gaaactggattaa

SEQ ID NO: 4598090 - DNA, 22 bp, Homo sapiens
gaaagaggcagggacctaaagg

SEQ ID NO: 4598091 - DNA, 14 bp, Homo sapiens
gaaagataactagg

SEQ ID NO: 4598092 - DNA, 17 bp, Homo sapiens
gaaagcagaacagtgat

SEQ ID NO: 4598093 - DNA, 20 bp, Homo sapiens
gaaagccagcctgggggctg

SEQ ID NO: 4598094 - DNA, 21 bp, Homo sapiens
gaaagcttgccctggtgcctc

SEQ ID NO: 4598095 - DNA, 23 bp, Homo sapiens
gaaaggcaaccaataaaagccag

SEQ ID NO: 4598096 - DNA, 19 bp, Homo sapiens
gaaaggggagtaggtgggg

SEQ ID NO: 4598097 - DNA, 20 bp, Homo sapiens
gaaaggggagtaggtggggg

SEQ ID NO: 4598098 - DNA, 14 bp, Homo sapiens
gaaatccattcaca

SEQ ID NO: 4598099 - DNA, 18 bp, Homo sapiens
gaaatgaaagcagggact

SEQ ID NO: 4598100 - DNA, 17 bp, Homo sapiens
gaaatgtacagcaagga

SEQ ID NO: 4598101 - DNA, 23 bp, Homo sapiens
gaacaaatttacagagacagaaa

SEQ ID NO: 4598102 - DNA, 22 bp, Homo sapiens
gaacactgagaaagaggcaggg

SEQ ID NO: 4598103 - DNA, 24 bp, Homo sapiens
gaaccaacaacctcaactgcctac

SEQ ID NO: 4598104 - DNA, 13 bp, Homo sapiens
gaacccagactca

SEQ ID NO: 4598105 - DNA, 16 bp, Homo sapiens
gaacccagactcagac

SEQ ID NO: 4598106 - DNA, 19 bp, Homo sapiens
gaacctcagcctggccaga

SEQ ID NO: 4598107 - DNA, 16 bp, Homo sapiens
gaactcaaatggggcc

SEQ ID NO: 4598108 - DNA, 18 bp, Homo sapiens
gaactcagatccagggac

SEQ ID NO: 4598109 - DNA, 22 bp, Homo sapiens
gaacttggggagttaagacctg

SEQ ID NO: 4598110 - DNA, 22 bp, Homo sapiens
gaactttgacctctgcagcaat

SEQ ID NO: 4598111 - DNA, 13 bp, Homo sapiens
gaagaaccagtcc

SEQ ID NO: 4598112 - DNA, 17 bp, Homo sapiens
gaagattctatgttaat

SEQ ID NO: 4598113 - DNA, 20 bp, Homo sapiens
gaagattctatgttaatatt

SEQ ID NO: 4598114 - DNA, 16 bp, Homo sapiens
gaagcccaagtgaaat

SEQ ID NO: 4598115 - DNA, 12 bp, Homo sapiens
gaagcctcagag

SEQ ID NO: 4598116 - DNA, 17 bp, Homo sapiens
gaagctcctctccccag

SEQ ID NO: 4598117 - DNA, 19 bp, Homo sapiens
gaaggaaagaaagaaggaa

SEQ ID NO: 4598118 - DNA, 13 bp, Homo sapiens
gaagggccagagc

SEQ ID NO: 4598119 - DNA, 15 bp, Homo sapiens
gaagggccagagcca

SEQ ID NO: 4598120 - DNA, 20 bp, Homo sapiens
gaagtaatatgcacacattt

SEQ ID NO: 4598121 - DNA, 16 bp, Homo sapiens
gaagtgggtggggaca

SEQ ID NO: 4598122 - DNA, 15 bp, Homo sapiens
gaagtgtatttattt

SEQ ID NO: 4598123 - DNA, 19 bp, Homo sapiens
gaataatcacgctttcctg

SEQ ID NO: 4598124 - DNA, 22 bp, Homo sapiens
gaatagctttaatgatatgctt

SEQ ID NO: 4598125 - DNA, 19 bp, Homo sapiens
gaatattgccattatgctt

SEQ ID NO: 4598126 - DNA, 19 bp, Homo sapiens
gaatcatacttagcaaagt

SEQ ID NO: 4598127 - DNA, 15 bp, Homo sapiens
gaatgaggtcccagg

SEQ ID NO: 4598128 - DNA, 22 bp, Homo sapiens
gaatgaggtcccaggcagagaa

SEQ ID NO: 4598129 - DNA, 22 bp, Homo sapiens
gaatgtcagttgttatttattg

SEQ ID NO: 4598130 - DNA, 22 bp, Homo sapiens
gaattaaagtggaccaataggg

SEQ ID NO: 4598131 - DNA, 14 bp, Homo sapiens
gaattaacacatga

SEQ ID NO: 4598132 - DNA, 20 bp, Homo sapiens
gaattatcttggttgaaaat

SEQ ID NO: 4598133 - DNA, 21 bp, Homo sapiens
gaattctgctctaaataaaga

SEQ ID NO: 4598134 - DNA, 21 bp, Homo sapiens
gaattgacccacaagaaatga

SEQ ID NO: 4598135 - DNA, 14 bp, Homo sapiens
gaatttcccaggac

SEQ ID NO: 4598136 - DNA, 16 bp, Homo sapiens
gaatttcccaggaccc

SEQ ID NO: 4598137 - DNA, 22 bp, Homo sapiens
gaatttcccaggaccctgaagg

SEQ ID NO: 4598138 - DNA, 12 bp, Homo sapiens
gaatttcttggt

SEQ ID NO: 4598139 - DNA, 22 bp, Homo sapiens
gacaacagaagtcatgaagccc

SEQ ID NO: 4598140 - DNA, 20 bp, Homo sapiens
gacaatggaccctttttgtt

SEQ ID NO: 4598141 - DNA, 13 bp, Homo sapiens
gacaatttattat

SEQ ID NO: 4598142 - DNA, 17 bp, Homo sapiens
gacacaggccctccctg

SEQ ID NO: 4598143 - DNA, 14 bp, Homo sapiens
gacacatgcaaggt

SEQ ID NO: 4598144 - DNA, 13 bp, Homo sapiens
gacacccaggact

SEQ ID NO: 4598145 - DNA, 12 bp, Homo sapiens
gacagcatgaga

SEQ ID NO: 4598146 - DNA, 14 bp, Homo sapiens
gacagccccaccct

SEQ ID NO: 4598147 - DNA, 21 bp, Homo sapiens
gacagtgagactctgtctcag

SEQ ID NO: 4598148 - DNA, 16 bp, Homo sapiens
gacatactaaccagca

SEQ ID NO: 4598149 - DNA, 23 bp, Homo sapiens
gacatactaaccagcagaaatgc

SEQ ID NO: 4598150 - DNA, 15 bp, Homo sapiens
gacatacttgaaggg

SEQ ID NO: 4598151 - DNA, 17 bp, Homo sapiens
gacatacttgaagggcc

SEQ ID NO: 4598152 - DNA, 19 bp, Homo sapiens
gacatacttgaagggccag

SEQ ID NO: 4598153 - DNA, 23 bp, Homo sapiens
gacatacttgaagggccagagcc

SEQ ID NO: 4598154 - DNA, 14 bp, Homo sapiens
gacatcaacagata

SEQ ID NO: 4598155 - DNA, 15 bp, Homo sapiens
gacatgtctgttcta

SEQ ID NO: 4598156 - DNA, 16 bp, Homo sapiens
gacattttatgtcttt

SEQ ID NO: 4598157 - DNA, 14 bp, Homo sapiens
gaccacgtttctaa

SEQ ID NO: 4598158 - DNA, 16 bp, Homo sapiens
gaccacgtttctaaag

SEQ ID NO: 4598159 - DNA, 12 bp, Homo sapiens
gaccagcccttc

SEQ ID NO: 4598160 - DNA, 12 bp, Homo sapiens
gaccagctcagg

SEQ ID NO: 4598161 - DNA, 16 bp, Homo sapiens
gacccaaaaggcagaa

SEQ ID NO: 4598162 - DNA, 18 bp, Homo sapiens
gacccaaaaggcagaagc

SEQ ID NO: 4598163 - DNA, 20 bp, Homo sapiens
gacccagctctactccaggc

SEQ ID NO: 4598164 - DNA, 16 bp, Homo sapiens
gacccagtgcccccac

SEQ ID NO: 4598165 - DNA, 12 bp, Homo sapiens
gaccctgggagt

SEQ ID NO: 4598166 - DNA, 18 bp, Homo sapiens
gacctaaagggactacct

SEQ ID NO: 4598167 - DNA, 18 bp, Homo sapiens
gacctgatcctggaggcc

SEQ ID NO: 4598168 - DNA, 21 bp, Homo sapiens
gacctgatcctggaggcccag

SEQ ID NO: 4598169 - DNA, 15 bp, Homo sapiens
gacctggcagctctg

SEQ ID NO: 4598170 - DNA, 21 bp, Homo sapiens
gactatatttgggcctgctcc

SEQ ID NO: 4598171 - DNA, 22 bp, Homo sapiens
gactatatttgggcctgctcca

SEQ ID NO: 4598172 - DNA, 13 bp, Homo sapiens
gactcccattcct

SEQ ID NO: 4598173 - DNA, 17 bp, Homo sapiens
gactgaccactggccta

SEQ ID NO: 4598174 - DNA, 18 bp, Homo sapiens
gactgagtacgttgtgca

SEQ ID NO: 4598175 - DNA, 21 bp, Homo sapiens
gactgagtacgttgtgcattt

SEQ ID NO: 4598176 - DNA, 22 bp, Homo sapiens
gactgagtacgttgtgcatttg

SEQ ID NO: 4598177 - DNA, 12 bp, Homo sapiens
gacttactgtac

SEQ ID NO: 4598178 - DNA, 18 bp, Homo sapiens
gacttcctgtccagctcc

SEQ ID NO: 4598179 - DNA, 20 bp, Homo sapiens
gactttttaaaaaatgctgg

SEQ ID NO: 4598180 - DNA, 18 bp, Homo sapiens
gagaaaggggagcccact

SEQ ID NO: 4598181 - DNA, 23 bp, Homo sapiens
gagaagccaggaatttcccagga

SEQ ID NO: 4598182 - DNA, 15 bp, Homo sapiens
gagaagggatggagg

SEQ ID NO: 4598183 - DNA, 14 bp, Homo sapiens
gagaagtgggtggg

SEQ ID NO: 4598184 - DNA, 24 bp, Homo sapiens
gagaagtgggtggggacagaccag

SEQ ID NO: 4598185 - DNA, 14 bp, Homo sapiens
gagaatcacttgaa

SEQ ID NO: 4598186 - DNA, 20 bp, Homo sapiens
gagacagctctgcatactca

SEQ ID NO: 4598187 - DNA, 13 bp, Homo sapiens
gagatttacaact

SEQ ID NO: 4598188 - DNA, 19 bp, Homo sapiens
gagcatctcttgaggccag

SEQ ID NO: 4598189 - DNA, 19 bp, Homo sapiens
gagcccactgtcctgggcc

SEQ ID NO: 4598190 - DNA, 24 bp, Homo sapiens
gagcccactgtcctgggcctgcag

SEQ ID NO: 4598191 - DNA, 12 bp, Homo sapiens
gagcccaggagt

SEQ ID NO: 4598192 - DNA, 23 bp, Homo sapiens
gagcccaggagttcgaggctgca

SEQ ID NO: 4598193 - DNA, 19 bp, Homo sapiens
gagccttgaactttgacct

SEQ ID NO: 4598194 - DNA, 13 bp, Homo sapiens
gagcgacagtgag

SEQ ID NO: 4598195 - DNA, 16 bp, Homo sapiens
gagctcatccctctca

SEQ ID NO: 4598196 - DNA, 23 bp, Homo sapiens
gagctttgtctacttcaaaagtt

SEQ ID NO: 4598197 - DNA, 16 bp, Homo sapiens
cagaaatgtacagcaa

SEQ ID NO: 4598198 - DNA, 12 bp, Homo sapiens
cagaacagtgat

SEQ ID NO: 4598199 - DNA, 19 bp, Homo sapiens
cagaatttgggttctgcct

SEQ ID NO: 4598200 - DNA, 13 bp, Homo sapiens
cagacaacagaag

SEQ ID NO: 4598201 - DNA, 12 bp, Homo sapiens
cagacacccagg

SEQ ID NO: 4598202 - DNA, 19 bp, Homo sapiens
cagacatagaattaacaca

SEQ ID NO: 4598203 - DNA, 14 bp, Homo sapiens
cagacattggcacc

SEQ ID NO: 4598204 - DNA, 20 bp, Homo sapiens
cagacctgatcctggaggcc

SEQ ID NO: 4598205 - DNA, 22 bp, Homo sapiens
cagacctgatcctggaggccca

SEQ ID NO: 4598206 - DNA, 23 bp, Homo sapiens
cagacctgatcctggaggcccag

SEQ ID NO: 4598207 - DNA, 18 bp, Homo sapiens
cagagaaaggggagccca

SEQ ID NO: 4598208 - DNA, 15 bp, Homo sapiens
cagagacatacttga

SEQ ID NO: 4598209 - DNA, 16 bp, Homo sapiens
cagagacatacttgaa

SEQ ID NO: 4598210 - DNA, 23 bp, Homo sapiens
cagagacatacttgaagggccag

SEQ ID NO: 4598211 - DNA, 23 bp, Homo sapiens
cagagccaggggggtgaggagct

SEQ ID NO: 4598212 - DNA, 13 bp, Homo sapiens
cagagcccagctc

SEQ ID NO: 4598213 - DNA, 17 bp, Homo sapiens
cagaggccccagcctcc

SEQ ID NO: 4598214 - DNA, 17 bp, Homo sapiens
cagaggttgcagtgagc

SEQ ID NO: 4598215 - DNA, 20 bp, Homo sapiens
cagagttgctgcaaacctga

SEQ ID NO: 4598216 - DNA, 19 bp, Homo sapiens
cagagttgttacattttta

SEQ ID NO: 4598217 - DNA, 12 bp, Homo sapiens
cagatccaggac

SEQ ID NO: 4598218 - DNA, 23 bp, Homo sapiens
cagatccagggacagaggcccca

SEQ ID NO: 4598219 - DNA, 14 bp, Homo sapiens
cagatctggaacct

SEQ ID NO: 4598220 - DNA, 19 bp, Homo sapiens
cagatctggaacctcagcc

SEQ ID NO: 4598221 - DNA, 20 bp, Homo sapiens
cagatctggaacctcagcct

SEQ ID NO: 4598222 - DNA, 13 bp, Homo sapiens
cagatttggaaag

SEQ ID NO: 4598223 - DNA, 15 bp, Homo sapiens
cagattttcagcaaa

SEQ ID NO: 4598224 - DNA, 22 bp, Homo sapiens
cagcaataaagcagcgtttcta

SEQ ID NO: 4598225 - DNA, 16 bp, Homo sapiens
cagcacgatttctgtt

SEQ ID NO: 4598226 - DNA, 20 bp, Homo sapiens
cagcacgatttctgtttaga

SEQ ID NO: 4598227 - DNA, 17 bp, Homo sapiens
cagcagaaatgccttac

SEQ ID NO: 4598228 - DNA, 22 bp, Homo sapiens
cagcagaaatgccttaccctca

SEQ ID NO: 4598229 - DNA, 19 bp, Homo sapiens
cagcatagcaagacacatc

SEQ ID NO: 4598230 - DNA, 17 bp, Homo sapiens
cagccaaacccatgagg

SEQ ID NO: 4598231 - DNA, 12 bp, Homo sapiens
cagcccagagac

SEQ ID NO: 4598232 - DNA, 18 bp, Homo sapiens
cagccgcttctgactgct

SEQ ID NO: 4598233 - DNA, 12 bp, Homo sapiens
cagcctccctga

SEQ ID NO: 4598234 - DNA, 18 bp, Homo sapiens
cagcctccctgaagcctt

SEQ ID NO: 4598235 - DNA, 23 bp, Homo sapiens
cagcctgagcgacagtgagactc

SEQ ID NO: 4598236 - DNA, 20 bp, Homo sapiens
cagcctgggcagcatagcaa

SEQ ID NO: 4598237 - DNA, 13 bp, Homo sapiens
cagcctgggggct

SEQ ID NO: 4598238 - DNA, 20 bp, Homo sapiens
cagcctgggggctgggagga

SEQ ID NO: 4598239 - DNA, 13 bp, Homo sapiens
cagccttgccaga

SEQ ID NO: 4598240 - DNA, 15 bp, Homo sapiens
cagccttgccagaga

SEQ ID NO: 4598241 - DNA, 16 bp, Homo sapiens
cattcctgaagaacca

SEQ ID NO: 4598242 - DNA, 17 bp, Homo sapiens
cattcctgaagaaccag

SEQ ID NO: 4598243 - DNA, 22 bp, Homo sapiens
cattcgctactatgatttaatt

SEQ ID NO: 4598244 - DNA, 16 bp, Homo sapiens
cattctccttgtgtta

SEQ ID NO: 4598245 - DNA, 20 bp, Homo sapiens
cattggcacctaatccaggc

SEQ ID NO: 4598246 - DNA, 21 bp, Homo sapiens
cattggcacctaatccaggca

SEQ ID NO: 4598247 - DNA, 22 bp, Homo sapiens
cattgtaaaagcattttgtaat

SEQ ID NO: 4598248 - DNA, 19 bp, Homo sapiens
catttaaaacattaaaata

SEQ ID NO: 4598249 - DNA, 20 bp, Homo sapiens
catttaaaacattaaaatat

SEQ ID NO: 4598250 - DNA, 16 bp, Homo sapiens
catttaaaagatacag

SEQ ID NO: 4598251 - DNA, 22 bp, Homo sapiens
catttaatggggaggacaaaat

SEQ ID NO: 4598252 - DNA, 20 bp, Homo sapiens
catttgaaaattttgatgtt

SEQ ID NO: 4598253 - DNA, 22 bp, Homo sapiens
catttgaaaattttgatgtttt

SEQ ID NO: 4598254 - DNA, 21 bp, Homo sapiens
catttgaaacccctgtaggcc

SEQ ID NO: 4598255 - DNA, 18 bp, Homo sapiens
catttgaggtctgttctt

SEQ ID NO: 4598256 - DNA, 23 bp, Homo sapiens
catttgtttctttctctgaggac

SEQ ID NO: 4598257 - DNA, 17 bp, Homo sapiens
catttgtttgaactgat

SEQ ID NO: 4598258 - DNA, 22 bp, Homo sapiens
catttgtttgaactgataaaga

SEQ ID NO: 4598259 - DNA, 19 bp, Homo sapiens
cattttattttattatgca

SEQ ID NO: 4598260 - DNA, 21 bp, Homo sapiens
cattttattttattatgcatg

SEQ ID NO: 4598261 - DNA, 22 bp, Homo sapiens
cattttggagagtttcctgaaa

SEQ ID NO: 4598262 - DNA, 20 bp, Homo sapiens
catttttaagtgctgcattt

SEQ ID NO: 4598263 - DNA, 21 bp, Homo sapiens
catttttaagtgctgcattta

SEQ ID NO: 4598264 - DNA, 16 bp, Homo sapiens
ccaaaagattgctgaa

SEQ ID NO: 4598265 - DNA, 14 bp, Homo sapiens
ccaaaaggcagaag

SEQ ID NO: 4598266 - DNA, 15 bp, Homo sapiens
ccaaagtacactgtt

SEQ ID NO: 4598267 - DNA, 20 bp, Homo sapiens
ccaaagtacactgtttcaaa

SEQ ID NO: 4598268 - DNA, 22 bp, Homo sapiens
ccaaagtacactgtttcaaact

SEQ ID NO: 4598269 - DNA, 14 bp, Homo sapiens
ccaaataaagtctc

SEQ ID NO: 4598270 - DNA, 19 bp, Homo sapiens
ccaacaaagaacactaact

SEQ ID NO: 4598271 - DNA, 18 bp, Homo sapiens
ccaaggctagaaccacct

SEQ ID NO: 4598272 - DNA, 12 bp, Homo sapiens
ccaatgaaatga

SEQ ID NO: 4598273 - DNA, 16 bp, Homo sapiens
ccaatttcagactccc

SEQ ID NO: 4598274 - DNA, 17 bp, Homo sapiens
ccacaaggacttcctgt

SEQ ID NO: 4598275 - DNA, 21 bp, Homo sapiens
ccacaaggacttcctgtccag

SEQ ID NO: 4598276 - DNA, 22 bp, Homo sapiens
ccacacaaggatagatgctggc

SEQ ID NO: 4598277 - DNA, 20 bp, Homo sapiens
ccacaccggtaccctcctcc

SEQ ID NO: 4598278 - DNA, 14 bp, Homo sapiens
ccacggccacagtc

SEQ ID NO: 4598279 - DNA, 13 bp, Homo sapiens
ccactcaggaggc

SEQ ID NO: 4598280 - DNA, 20 bp, Homo sapiens
ccactcaggaggctgaggca

SEQ ID NO: 4598281 - DNA, 17 bp, Homo sapiens
ccactggcctacccctt

SEQ ID NO: 4598282 - DNA, 20 bp, Homo sapiens
ccactgtcctgggcctgcag

SEQ ID NO: 4598283 - DNA, 22 bp, Homo sapiens
ccagaagaaaatagtggtgtga

SEQ ID NO: 4598284 - DNA, 15 bp, Homo sapiens
ccagacacaggccct

SEQ ID NO: 4598285 - DNA, 16 bp, Homo sapiens
ccagacctgatcctgg

SEQ ID NO: 4598286 - DNA, 19 bp, Homo sapiens
ccagacctgatcctggagg

SEQ ID NO: 4598287 - DNA, 23 bp, Homo sapiens
ccagacctgatcctggaggccca

SEQ ID NO: 4598288 - DNA, 23 bp, Homo sapiens
ccagagaaaggggagcccactgt

SEQ ID NO: 4598289 - DNA, 23 bp, Homo sapiens
ccagagacatacttgaagggcca

SEQ ID NO: 4598290 - DNA, 14 bp, Homo sapiens
ccagagcccagctc

SEQ ID NO: 4598291 - DNA, 15 bp, Homo sapiens
ccagagcccagctcc

SEQ ID NO: 4598292 - DNA, 16 bp, Homo sapiens
ccagagcccagctcca

SEQ ID NO: 4598293 - DNA, 18 bp, Homo sapiens
ccagagcccagctccaag

SEQ ID NO: 4598294 - DNA, 12 bp, Homo sapiens
ccagcagaaatg

SEQ ID NO: 4598295 - DNA, 17 bp, Homo sapiens
ccagcagaaatgcctta

SEQ ID NO: 4598296 - DNA, 12 bp, Homo sapiens
ccagcccagaga

SEQ ID NO: 4598297 - DNA, 13 bp, Homo sapiens
ccagcccagagac

SEQ ID NO: 4598298 - DNA, 14 bp, Homo sapiens
ccagcccttcccca

SEQ ID NO: 4598299 - DNA, 17 bp, Homo sapiens
ccagcctccctgaagcc

SEQ ID NO: 4598300 - DNA, 19 bp, Homo sapiens
ccagcctgagcgacagtga

SEQ ID NO: 4598301 - DNA, 13 bp, Homo sapiens
ccagcctgggggc

SEQ ID NO: 4598302 - DNA, 13 bp, Homo sapiens
ccagctaagaacc

SEQ ID NO: 4598303 - DNA, 17 bp, Homo sapiens
ccagctaagaacctgga

SEQ ID NO: 4598304 - DNA, 13 bp, Homo sapiens
ccagctcaggaca

SEQ ID NO: 4598305 - DNA, 14 bp, Homo sapiens
ccagctccaacctg

SEQ ID NO: 4598306 - DNA, 20 bp, Homo sapiens
ccagctccaacctgcaaaga

SEQ ID NO: 4598307 - DNA, 13 bp, Homo sapiens
ccagctgcactga

SEQ ID NO: 4598308 - DNA, 14 bp, Homo sapiens
ccagctgcactgat

SEQ ID NO: 4598309 - DNA, 19 bp, Homo sapiens
ccagctgcactgatgctgc

SEQ ID NO: 4598310 - DNA, 14 bp, Homo sapiens
ccagcttatctcct

SEQ ID NO: 4598311 - DNA, 18 bp, Homo sapiens
ccaggaatttcccaggac

SEQ ID NO: 4598312 - DNA, 14 bp, Homo sapiens
ccaggaccctgaag

SEQ ID NO: 4598313 - DNA, 16 bp, Homo sapiens
ccaggaccctgaaggg

SEQ ID NO: 4598314 - DNA, 21 bp, Homo sapiens
ccaggactatatttgggcctg

SEQ ID NO: 4598315 - DNA, 20 bp, Homo sapiens
ccaggagttcgaggctgcag

SEQ ID NO: 4598316 - DNA, 18 bp, Homo sapiens
ccaggagtttgagaccag

SEQ ID NO: 4598317 - DNA, 15 bp, Homo sapiens
ccaggcagatccagg

SEQ ID NO: 4598318 - DNA, 16 bp, Homo sapiens
ccaggcagatccagga

SEQ ID NO: 4598319 - DNA, 13 bp, Homo sapiens
ccagggacagagg

SEQ ID NO: 4598320 - DNA, 18 bp, Homo sapiens
ccagggacagaggcccca

SEQ ID NO: 4598321 - DNA, 21 bp, Homo sapiens
ccagggacagaggccccagcc

SEQ ID NO: 4598322 - DNA, 13 bp, Homo sapiens
ccagggcccagag

SEQ ID NO: 4598323 - DNA, 18 bp, Homo sapiens
ccagggcccagagcccag

SEQ ID NO: 4598324 - DNA, 23 bp, Homo sapiens
ccagggcccagagcccagctcca

SEQ ID NO: 4598325 - DNA, 20 bp, Homo sapiens
ccagtaaatgggggtgcatt

SEQ ID NO: 4598326 - DNA, 21 bp, Homo sapiens
ccagtaaatgggggtgcattt

SEQ ID NO: 4598327 - DNA, 23 bp, Homo sapiens
ccagtaaatgggggtgcatttga

SEQ ID NO: 4598328 - DNA, 17 bp, Homo sapiens
ccagtccccccaccctc

SEQ ID NO: 4598329 - DNA, 12 bp, Homo sapiens
ccataagctatt

SEQ ID NO: 4598330 - DNA, 14 bp, Homo sapiens
ccatattccgcact

SEQ ID NO: 4598331 - DNA, 20 bp, Homo sapiens
ccatcctggggttgccctgg

SEQ ID NO: 4598332 - DNA, 14 bp, Homo sapiens
ccatgaagatgtag

SEQ ID NO: 4598333 - DNA, 15 bp, Homo sapiens
ccatgatggcaacag

SEQ ID NO: 4598334 - DNA, 16 bp, Homo sapiens
ccatgatggcaacaga

SEQ ID NO: 4598335 - DNA, 19 bp, Homo sapiens
ccatgatggcaacagatct

SEQ ID NO: 4598336 - DNA, 16 bp, Homo sapiens
ccatgcactgtgaagg

SEQ ID NO: 4598337 - DNA, 21 bp, Homo sapiens
ccatgcactgtgaaggaccct

SEQ ID NO: 4598338 - DNA, 20 bp, Homo sapiens
ccattcacttcataatccag

SEQ ID NO: 4598339 - DNA, 13 bp, Homo sapiens
ccattcctgaaga

SEQ ID NO: 4598340 - DNA, 16 bp, Homo sapiens
ccattcctgaagaacc

SEQ ID NO: 4598341 - DNA, 12 bp, Homo sapiens
cccagagcccag

SEQ ID NO: 4598342 - DNA, 15 bp, Homo sapiens
cccagagcccagctc

SEQ ID NO: 4598343 - DNA, 16 bp, Homo sapiens
cccagagcccagctcc

SEQ ID NO: 4598344 - DNA, 12 bp, Homo sapiens
cccagcccagag

SEQ ID NO: 4598345 - DNA, 13 bp, Homo sapiens
cccagcccagaga

SEQ ID NO: 4598346 - DNA, 16 bp, Homo sapiens
cccagcccagagacat

SEQ ID NO: 4598347 - DNA, 17 bp, Homo sapiens
cccagcctccctgaagc

SEQ ID NO: 4598348 - DNA, 18 bp, Homo sapiens
cccagctaagaacctgga

SEQ ID NO: 4598349 - DNA, 22 bp, Homo sapiens
cccagctaagaacctggaactt

SEQ ID NO: 4598350 - DNA, 17 bp, Homo sapiens
cccagcttatctcctcc

SEQ ID NO: 4598351 - DNA, 12 bp, Homo sapiens
cccaggaccagc

SEQ ID NO: 4598352 - DNA, 14 bp, Homo sapiens
cccaggaccagctc

SEQ ID NO: 4598353 - DNA, 15 bp, Homo sapiens
cccaggaccagctca

SEQ ID NO: 4598354 - DNA, 17 bp, Homo sapiens
cccaggaccagctcagg

SEQ ID NO: 4598355 - DNA, 11 bp, Homo sapiens
cccaggaccct

SEQ ID NO: 4598356 - DNA, 14 bp, Homo sapiens
cccagggcccagag

SEQ ID NO: 4598357 - DNA, 20 bp, Homo sapiens
cccagggcccagagcccagc

SEQ ID NO: 4598358 - DNA, 14 bp, Homo sapiens
cccagtgcccccac

SEQ ID NO: 4598359 - DNA, 19 bp, Homo sapiens
cccagtgcccccactgacc

SEQ ID NO: 4598360 - DNA, 18 bp, Homo sapiens
cccatgcactgtgaagga

SEQ ID NO: 4598361 - DNA, 23 bp, Homo sapiens
cccattgtggtcacaggaagtag

SEQ ID NO: 4598362 - DNA, 20 bp, Homo sapiens
cccatttaaatttttttcct

SEQ ID NO: 4598363 - DNA, 13 bp, Homo sapiens
cccatttcagctg

SEQ ID NO: 4598364 - DNA, 15 bp, Homo sapiens
ccccactgaccagaa

SEQ ID NO: 4598365 - DNA, 11 bp, Homo sapiens
ccccagcacta

SEQ ID NO: 4598366 - DNA, 17 bp, Homo sapiens
ccccagctaagaacctg

SEQ ID NO: 4598367 - DNA, 13 bp, Homo sapiens
ccccaggaccagc

SEQ ID NO: 4598368 - DNA, 16 bp, Homo sapiens
ccccaggaccagctca

SEQ ID NO: 4598369 - DNA, 18 bp, Homo sapiens
ccccaggaccagctcagg

SEQ ID NO: 4598370 - DNA, 19 bp, Homo sapiens
ccccaggaccagctcagga

SEQ ID NO: 4598371 - DNA, 15 bp, Homo sapiens
ccccattgtggtcac

SEQ ID NO: 4598372 - DNA, 14 bp, Homo sapiens
cccccatgcactgt

SEQ ID NO: 4598373 - DNA, 19 bp, Homo sapiens
cccccgacccagctctact

SEQ ID NO: 4598374 - DNA, 15 bp, Homo sapiens
ccccgacccagctct

SEQ ID NO: 4598375 - DNA, 20 bp, Homo sapiens
cccctcatctctctgcccaa

SEQ ID NO: 4598376 - DNA, 18 bp, Homo sapiens
cccctgcactccagcctg

SEQ ID NO: 4598377 - DNA, 15 bp, Homo sapiens
cccgacccagctcta

SEQ ID NO: 4598378 - DNA, 13 bp, Homo sapiens
cccgactgaccac

SEQ ID NO: 4598379 - DNA, 21 bp, Homo sapiens
ccctcaccttggcaccagaca

SEQ ID NO: 4598380 - DNA, 23 bp, Homo sapiens
ccctcaccttggcaccagacacc

SEQ ID NO: 4598381 - DNA, 15 bp, Homo sapiens
ccctcccccccatgc

SEQ ID NO: 4598382 - DNA, 20 bp, Homo sapiens
ccctgactaaactaccacct

SEQ ID NO: 4598383 - DNA, 21 bp, Homo sapiens
ccctgatttaggagaagccag

SEQ ID NO: 4598384 - DNA, 23 bp, Homo sapiens
ccctgatttaggagaagccagga

SEQ ID NO: 4598385 - DNA, 16 bp, Homo sapiens
ccctggtgggccaaca

SEQ ID NO: 4598386 - DNA, 14 bp, Homo sapiens
ccctgtaggcctca

SEQ ID NO: 4598387 - DNA, 16 bp, Homo sapiens
ccctgtttcagaggct

SEQ ID NO: 4598388 - DNA, 15 bp, Homo sapiens
cccttccccatcctg

SEQ ID NO: 4598389 - DNA, 16 bp, Homo sapiens
ccgggcgtggtggtga

SEQ ID NO: 4598390 - DNA, 14 bp, Homo sapiens
cctaaagtgtattt

SEQ ID NO: 4598391 - DNA, 22 bp, Homo sapiens
cctaacaacattgtagcctcaa

SEQ ID NO: 4598392 - DNA, 15 bp, Homo sapiens
cctaacgaagtatcc

SEQ ID NO: 4598393 - DNA, 19 bp, Homo sapiens
cctaatccaggcagatcca

SEQ ID NO: 4598394 - DNA, 21 bp, Homo sapiens
cctaatccaggcagatccagg

SEQ ID NO: 4598395 - DNA, 17 bp, Homo sapiens
cctaattctatgcctgt

SEQ ID NO: 4598396 - DNA, 15 bp, Homo sapiens
cctactttgactttt

SEQ ID NO: 4598397 - DNA, 19 bp, Homo sapiens
cctcagaggccttgggagc

SEQ ID NO: 4598398 - DNA, 13 bp, Homo sapiens
cctcagcctggcc

SEQ ID NO: 4598399 - DNA, 18 bp, Homo sapiens
cctcagcctggccagaca

SEQ ID NO: 4598400 - DNA, 19 bp, Homo sapiens
cctcagcctggccagacac

SEQ ID NO: 4598401 - DNA, 19 bp, Homo sapiens
cctcagccttgccagagat

SEQ ID NO: 4598402 - DNA, 20 bp, Homo sapiens
cctcagccttgccagagatc

SEQ ID NO: 4598403 - DNA, 21 bp, Homo sapiens
cctcagccttgccagagatcc

SEQ ID NO: 4598404 - DNA, 15 bp, Homo sapiens
cctcaggtgactttt

SEQ ID NO: 4598405 - DNA, 17 bp, Homo sapiens
cctcatctctctgccca

SEQ ID NO: 4598406 - DNA, 15 bp, Homo sapiens
cctcatgtccactgg

SEQ ID NO: 4598407 - DNA, 13 bp, Homo sapiens
cctcatgttctta

SEQ ID NO: 4598408 - DNA, 19 bp, Homo sapiens
cctcatgttcttaattctt

SEQ ID NO: 4598409 - DNA, 15 bp, Homo sapiens
cctcccgactgacca

SEQ ID NO: 4598410 - DNA, 19 bp, Homo sapiens
cctcccgactgaccactgg

SEQ ID NO: 4598411 - DNA, 16 bp, Homo sapiens
cctcccttctcttcac

SEQ ID NO: 4598412 - DNA, 13 bp, Homo sapiens
cctcctcccgact

SEQ ID NO: 4598413 - DNA, 11 bp, Homo sapiens
cctcctgctca

SEQ ID NO: 4598414 - DNA, 19 bp, Homo sapiens
cctctccccagcccagaga

SEQ ID NO: 4598415 - DNA, 20 bp, Homo sapiens
cctctccccagcccagagac

SEQ ID NO: 4598416 - DNA, 21 bp, Homo sapiens
cctctcttggaccctgggagt

SEQ ID NO: 4598417 - DNA, 14 bp, Homo sapiens
cctctgcagcaata

SEQ ID NO: 4598418 - DNA, 19 bp, Homo sapiens
cctctgcagcaataaagca

SEQ ID NO: 4598419 - DNA, 20 bp, Homo sapiens
cctctgcctgacagcatcct

SEQ ID NO: 4598420 - DNA, 14 bp, Homo sapiens
cctcttccagtctt

SEQ ID NO: 4598421 - DNA, 19 bp, Homo sapiens
cctcttgagccttgaactt

SEQ ID NO: 4598422 - DNA, 13 bp, Homo sapiens
cctgaaagaggaa

SEQ ID NO: 4598423 - DNA, 20 bp, Homo sapiens
cctgaaggggccatgatggc

SEQ ID NO: 4598424 - DNA, 15 bp, Homo sapiens
cctgacagcatcctc

SEQ ID NO: 4598425 - DNA, 14 bp, Homo sapiens
cctgacccctgctc

SEQ ID NO: 4598426 - DNA, 17 bp, Homo sapiens
cctgactaaactaccac

SEQ ID NO: 4598427 - DNA, 21 bp, Homo sapiens
cctgactaaactaccacctca

SEQ ID NO: 4598428 - DNA, 22 bp, Homo sapiens
cctgactaaactaccacctcag

SEQ ID NO: 4598429 - DNA, 20 bp, Homo sapiens
cctgatcctggaggcccagt

SEQ ID NO: 4598430 - DNA, 20 bp, Homo sapiens
cctgatttaggagaagccag

SEQ ID NO: 4598431 - DNA, 21 bp, Homo sapiens
cctgatttaggagaagccagg

SEQ ID NO: 4598432 - DNA, 22 bp, Homo sapiens
cctgattttttttccttttaat

SEQ ID NO: 4598433 - DNA, 19 bp, Homo sapiens
cctgcacaataaaaatgtt

SEQ ID NO: 4598434 - DNA, 16 bp, Homo sapiens
cctgcagaatttgggt

SEQ ID NO: 4598435 - DNA, 13 bp, Homo sapiens
cctgccagctgca

SEQ ID NO: 4598436 - DNA, 23 bp, Homo sapiens
cctgccagctgcactgatgctgc

SEQ ID NO: 4598437 - DNA, 12 bp, Homo sapiens
cctgctccagac

SEQ ID NO: 4598438 - DNA, 14 bp, Homo sapiens
cctgctccagacct

SEQ ID NO: 4598439 - DNA, 15 bp, Homo sapiens
cctgctcctctgcct

SEQ ID NO: 4598440 - DNA, 15 bp, Homo sapiens
cctggaagccagctt

SEQ ID NO: 4598441 - DNA, 18 bp, Homo sapiens
cctggaatatataaccag

SEQ ID NO: 4598442 - DNA, 12 bp, Homo sapiens
cctggagaagtg

SEQ ID NO: 4598443 - DNA, 14 bp, Homo sapiens
cctggagaagtggg

SEQ ID NO: 4598444 - DNA, 19 bp, Homo sapiens
cctggagaagtgggtgggg

SEQ ID NO: 4598445 - DNA, 16 bp, Homo sapiens
cctggaggcccagttc

SEQ ID NO: 4598446 - DNA, 18 bp, Homo sapiens
cctggcacggtggctcag

SEQ ID NO: 4598447 - DNA, 12 bp, Homo sapiens
cctggcagctct

SEQ ID NO: 4598448 - DNA, 14 bp, Homo sapiens
cctggcagctctgg

SEQ ID NO: 4598449 - DNA, 15 bp, Homo sapiens
cctggcagctctgga

SEQ ID NO: 4598450 - DNA, 12 bp, Homo sapiens
cctggccagaca

SEQ ID NO: 4598451 - DNA, 19 bp, Homo sapiens
cctgggggataccagctga

SEQ ID NO: 4598452 - DNA, 16 bp, Homo sapiens
cctggggttgccctgg

SEQ ID NO: 4598453 - DNA, 12 bp, Homo sapiens
cctgtaaacctg

SEQ ID NO: 4598454 - DNA, 10 bp, Homo sapiens
cctgtacctc

SEQ ID NO: 4598455 - DNA, 14 bp, Homo sapiens
cctgtctttaagga

SEQ ID NO: 4598456 - DNA, 19 bp, Homo sapiens
cctgttacctactttgact

SEQ ID NO: 4598457 - DNA, 19 bp, Homo sapiens
ccttaccctcatgttctta

SEQ ID NO: 4598458 - DNA, 14 bp, Homo sapiens
ccttacctttttat

SEQ ID NO: 4598459 - DNA, 24 bp, Homo sapiens
ccttccctcaccttggcaccagac

SEQ ID NO: 4598460 - DNA, 22 bp, Homo sapiens
ccttcctgtttttcacattttc

SEQ ID NO: 4598461 - DNA, 14 bp, Homo sapiens
ccttctactgagcc

SEQ ID NO: 4598462 - DNA, 19 bp, Homo sapiens
ccttgaactttgacctctg

SEQ ID NO: 4598463 - DNA, 14 bp, Homo sapiens
cctttctccagccc

SEQ ID NO: 4598464 - DNA, 16 bp, Homo sapiens
cctttctccagccctg

SEQ ID NO: 4598465 - DNA, 23 bp, Homo sapiens
cctttgtattctctcctgtacct

SEQ ID NO: 4598466 - DNA, 18 bp, Homo sapiens
cctttttatttgcatgtg

SEQ ID NO: 4598467 - DNA, 21 bp, Homo sapiens
ccttttttagagttgatacta

SEQ ID NO: 4598468 - DNA, 23 bp, Homo sapiens
ataccattatatgttccccctgt

SEQ ID NO: 4598469 - DNA, 21 bp, Homo sapiens
atacgcctgtagtcctagcca

SEQ ID NO: 4598470 - DNA, 13 bp, Homo sapiens
atacgtacacatt

SEQ ID NO: 4598471 - DNA, 19 bp, Homo sapiens
atactaaccagcagaaatg

SEQ ID NO: 4598472 - DNA, 20 bp, Homo sapiens
atactaaccagcagaaatgc

SEQ ID NO: 4598473 - DNA, 21 bp, Homo sapiens
atactaaccagcagaaatgcc

SEQ ID NO: 4598474 - DNA, 15 bp, Homo sapiens
atactacagtttgtt

SEQ ID NO: 4598475 - DNA, 15 bp, Homo sapiens
atactgcatactttt

SEQ ID NO: 4598476 - DNA, 23 bp, Homo sapiens
atacttgaagggccagagccagg

SEQ ID NO: 4598477 - DNA, 22 bp, Homo sapiens
atactttgcagcacagctgaga

SEQ ID NO: 4598478 - DNA, 23 bp, Homo sapiens
atagacaatttattatggcacat

SEQ ID NO: 4598479 - DNA, 15 bp, Homo sapiens
atagacagcatgaga

SEQ ID NO: 4598480 - DNA, 20 bp, Homo sapiens
atagatgctggcccagggcc

SEQ ID NO: 4598481 - DNA, 15 bp, Homo sapiens
atagcattgtaaaag

SEQ ID NO: 4598482 - DNA, 14 bp, Homo sapiens
atagggctgagctc

SEQ ID NO: 4598483 - DNA, 20 bp, Homo sapiens
atagttgtaccgcaatgtga

SEQ ID NO: 4598484 - DNA, 21 bp, Homo sapiens
atagttttacttttaaactgt

SEQ ID NO: 4598485 - DNA, 16 bp, Homo sapiens
atatagttttactttt

SEQ ID NO: 4598486 - DNA, 12 bp, Homo sapiens
atatataaccag

SEQ ID NO: 4598487 - DNA, 16 bp, Homo sapiens
atatattttacaattt

SEQ ID NO: 4598488 - DNA, 18 bp, Homo sapiens
atatattttacaattttt

SEQ ID NO: 4598489 - DNA, 19 bp, Homo sapiens
atatccaaaagctttttat

SEQ ID NO: 4598490 - DNA, 19 bp, Homo sapiens
atatcccttggacatttta

SEQ ID NO: 4598491 - DNA, 15 bp, Homo sapiens
atatgcacacatttt

SEQ ID NO: 4598492 - DNA, 19 bp, Homo sapiens
atatgcttgtaactaaaat

SEQ ID NO: 4598493 - DNA, 19 bp, Homo sapiens
atatgtagtataaagaaaa

SEQ ID NO: 4598494 - DNA, 19 bp, Homo sapiens
atattgatttccgttaaaa

SEQ ID NO: 4598495 - DNA, 17 bp, Homo sapiens
atattgccattatgctt

SEQ ID NO: 4598496 - DNA, 15 bp, Homo sapiens
atatttgttatgtag

SEQ ID NO: 4598497 - DNA, 14 bp, Homo sapiens
atattttaaacaga

SEQ ID NO: 4598498 - DNA, 14 bp, Homo sapiens
atatttttatcttt

SEQ ID NO: 4598499 - DNA, 14 bp, Homo sapiens
atcaaaagaaagaa

SEQ ID NO: 4598500 - DNA, 14 bp, Homo sapiens
atcaagtattatac

SEQ ID NO: 4598501 - DNA, 18 bp, Homo sapiens
atcaagtattataccttt

SEQ ID NO: 4598502 - DNA, 16 bp, Homo sapiens
atcacattaaagttaa

SEQ ID NO: 4598503 - DNA, 14 bp, Homo sapiens
atcacgctttcctg

SEQ ID NO: 4598504 - DNA, 18 bp, Homo sapiens
atcactttctcagttttc

SEQ ID NO: 4598505 - DNA, 20 bp, Homo sapiens
atcatgacaaagactgagta

SEQ ID NO: 4598506 - DNA, 13 bp, Homo sapiens
atccaaaagaagc

SEQ ID NO: 4598507 - DNA, 19 bp, Homo sapiens
atccaaaagaagcccccag

SEQ ID NO: 4598508 - DNA, 17 bp, Homo sapiens
atccagcctggggtctg

SEQ ID NO: 4598509 - DNA, 14 bp, Homo sapiens
atccaggcagatcc

SEQ ID NO: 4598510 - DNA, 15 bp, Homo sapiens
atccaggcagatcca

SEQ ID NO: 4598511 - DNA, 12 bp, Homo sapiens
atccagggacag

SEQ ID NO: 4598512 - DNA, 13 bp, Homo sapiens
atccagggacaga

SEQ ID NO: 4598513 - DNA, 14 bp, Homo sapiens
atccagggacagag

SEQ ID NO: 4598514 - DNA, 16 bp, Homo sapiens
atccagggacagaggc

SEQ ID NO: 4598515 - DNA, 20 bp, Homo sapiens
atccagggacagaggcccca

SEQ ID NO: 4598516 - DNA, 21 bp, Homo sapiens
atccagggacagaggccccag

SEQ ID NO: 4598517 - DNA, 16 bp, Homo sapiens
atccagtaggatccag

SEQ ID NO: 4598518 - DNA, 21 bp, Homo sapiens
atccagtgatccttacaagtt

SEQ ID NO: 4598519 - DNA, 18 bp, Homo sapiens
atccatgacctagttttc

SEQ ID NO: 4598520 - DNA, 22 bp, Homo sapiens
atccatgacctagttttccatg

SEQ ID NO: 4598521 - DNA, 17 bp, Homo sapiens
atcccttggacatttta

SEQ ID NO: 4598522 - DNA, 20 bp, Homo sapiens
atcccttggacattttatgt

SEQ ID NO: 4598523 - DNA, 17 bp, Homo sapiens
atcctggaggcccagtt

SEQ ID NO: 4598524 - DNA, 19 bp, Homo sapiens
atcctggaggcccagttca

SEQ ID NO: 4598525 - DNA, 17 bp, Homo sapiens
atcctggggttgccctg

SEQ ID NO: 4598526 - DNA, 18 bp, Homo sapiens
atcgtcactgcttaactt

SEQ ID NO: 4598527 - DNA, 21 bp, Homo sapiens
atctataggaagattgaacct

SEQ ID NO: 4598528 - DNA, 14 bp, Homo sapiens
atctcaaatttcta

SEQ ID NO: 4598529 - DNA, 17 bp, Homo sapiens
atctcaaatttctaaat

SEQ ID NO: 4598530 - DNA, 18 bp, Homo sapiens
atctgacccagtgccccc

SEQ ID NO: 4598531 - DNA, 20 bp, Homo sapiens
atctgacccagtgcccccac

SEQ ID NO: 4598532 - DNA, 21 bp, Homo sapiens
atctgacccagtgcccccact

SEQ ID NO: 4598533 - DNA, 11 bp, Homo sapiens
atctggaaccc

SEQ ID NO: 4598534 - DNA, 16 bp, Homo sapiens
atctggaacccagact

SEQ ID NO: 4598535 - DNA, 19 bp, Homo sapiens
atctggaacccagactcag

SEQ ID NO: 4598536 - DNA, 16 bp, Homo sapiens
atctggaacctcagcc

SEQ ID NO: 4598537 - DNA, 18 bp, Homo sapiens
atctggaacctcagcctg

SEQ ID NO: 4598538 - DNA, 19 bp, Homo sapiens
atctggaacctcagcctgg

SEQ ID NO: 4598539 - DNA, 16 bp, Homo sapiens
atctggcaacatcttt

SEQ ID NO: 4598540 - DNA, 15 bp, Homo sapiens
atctgtcctcagcct

SEQ ID NO: 4598541 - DNA, 17 bp, Homo sapiens
atctgtcctcagccttg

SEQ ID NO: 4598542 - DNA, 18 bp, Homo sapiens
atctgtcctcagccttgc

SEQ ID NO: 4598543 - DNA, 21 bp, Homo sapiens
atctgtcctcagccttgccag

SEQ ID NO: 4598544 - DNA, 14 bp, Homo sapiens
atcttctgccttct

SEQ ID NO: 4598545 - DNA, 19 bp, Homo sapiens
atgaagaaaatcacttagg

SEQ ID NO: 4598546 - DNA, 14 bp, Homo sapiens
atgaagaactgagg

SEQ ID NO: 4598547 - DNA, 17 bp, Homo sapiens
atgaagcccaagtgaaa

SEQ ID NO: 4598548 - DNA, 21 bp, Homo sapiens
atgaagtaatatgcacacatt

SEQ ID NO: 4598549 - DNA, 23 bp, Homo sapiens
atgaagtaatatgcacacatttt

SEQ ID NO: 4598550 - DNA, 13 bp, Homo sapiens
atgaagtactcat

SEQ ID NO: 4598551 - DNA, 21 bp, Homo sapiens
atgaagtactcatacatgtta

SEQ ID NO: 4598552 - DNA, 23 bp, Homo sapiens
atgaatggctaagcaaaatgtga

SEQ ID NO: 4598553 - DNA, 21 bp, Homo sapiens
atgaatggtatggaactctct

SEQ ID NO: 4598554 - DNA, 18 bp, Homo sapiens
atgaggcaatgtcaggaa

SEQ ID NO: 4598555 - DNA, 21 bp, Homo sapiens
atgaggcaatgtcaggaacag

SEQ ID NO: 4598556 - DNA, 17 bp, Homo sapiens
atgaggtactgagagtg

SEQ ID NO: 4598557 - DNA, 14 bp, Homo sapiens
atgaggtcccaggc

SEQ ID NO: 4598558 - DNA, 15 bp, Homo sapiens
atgaggtcccaggca

SEQ ID NO: 4598559 - DNA, 22 bp, Homo sapiens
atgataccctgaatttggcctg

SEQ ID NO: 4598560 - DNA, 23 bp, Homo sapiens
atgatatgcttgtaactaaaata

SEQ ID NO: 4598561 - DNA, 21 bp, Homo sapiens
atgatccaactaatgccttac

SEQ ID NO: 4598562 - DNA, 13 bp, Homo sapiens
atgatttcattca

SEQ ID NO: 4598563 - DNA, 17 bp, Homo sapiens
atgatttttttttcata

SEQ ID NO: 4598564 - DNA, 18 bp, Homo sapiens
atgcaaatcaattactgg

SEQ ID NO: 4598565 - DNA, 15 bp, Homo sapiens
atgcaaggaaggaaa

SEQ ID NO: 4598566 - DNA, 20 bp, Homo sapiens
atgcaaggaaggaaagaaag

SEQ ID NO: 4598567 - DNA, 17 bp, Homo sapiens
atgcacacattttttaa

SEQ ID NO: 4598568 - DNA, 19 bp, Homo sapiens
atgcacacattttttaaat

SEQ ID NO: 4598569 - DNA, 17 bp, Homo sapiens
atgcacagagttgttac

SEQ ID NO: 4598570 - DNA, 19 bp, Homo sapiens
atgcactgtgaaggaccct

SEQ ID NO: 4598571 - DNA, 20 bp, Homo sapiens
atgcactgtgaaggaccctt

SEQ ID NO: 4598572 - DNA, 23 bp, Homo sapiens
atgcatgaagtaatatgcacaca

SEQ ID NO: 4598573 - DNA, 17 bp, Homo sapiens
atgcatggtgccccagg

SEQ ID NO: 4598574 - DNA, 20 bp, Homo sapiens
atgcatggtgccccaggacc

SEQ ID NO: 4598575 - DNA, 12 bp, Homo sapiens
atgcatttgaaa

SEQ ID NO: 4598576 - DNA, 18 bp, Homo sapiens
atgcatttgaaaattttg

SEQ ID NO: 4598577 - DNA, 23 bp, Homo sapiens
atgccacaccggtaccctcctcc

SEQ ID NO: 4598578 - DNA, 22 bp, Homo sapiens
atgcgtgcataccacttttgtt

SEQ ID NO: 4598579 - DNA, 20 bp, Homo sapiens
atgctccagcactcaataaa

SEQ ID NO: 4598580 - DNA, 13 bp, Homo sapiens
atgctggcccagg

SEQ ID NO: 4598581 - DNA, 16 bp, Homo sapiens
atgctggcccagggcc

SEQ ID NO: 4598582 - DNA, 18 bp, Homo sapiens
atgctggcccagggccca

SEQ ID NO: 4598583 - DNA, 23 bp, Homo sapiens
atgcttactgatatattttacaa

SEQ ID NO: 4598584 - DNA, 21 bp, Homo sapiens
atgcttagtccctcatgcaaa

SEQ ID NO: 4598585 - DNA, 12 bp, Homo sapiens
atgcttgtacat

SEQ ID NO: 4598586 - DNA, 16 bp, Homo sapiens
atggagggtttagtgc

SEQ ID NO: 4598587 - DNA, 17 bp, Homo sapiens
atggcaacagatctgga

SEQ ID NO: 4598588 - DNA, 13 bp, Homo sapiens
atggggccagatc

SEQ ID NO: 4598589 - DNA, 15 bp, Homo sapiens
atggggccagatcca

SEQ ID NO: 4598590 - DNA, 18 bp, Homo sapiens
atgggggaactcagatcc

SEQ ID NO: 4598591 - DNA, 21 bp, Homo sapiens
atgggggaactcagatccagg

SEQ ID NO: 4598592 - DNA, 15 bp, Homo sapiens
atggtgccccaggac

SEQ ID NO: 4598593 - DNA, 17 bp, Homo sapiens
atggtgccccaggacca

SEQ ID NO: 4598594 - DNA, 15 bp, Homo sapiens
atggttttaaacttt

SEQ ID NO: 4598595 - DNA, 12 bp, Homo sapiens
atgtaattttgt

SEQ ID NO: 4598596 - DNA, 13 bp, Homo sapiens
atgtagaggagaa

SEQ ID NO: 4598597 - DNA, 17 bp, Homo sapiens
atgtagtataaagaaaa

SEQ ID NO: 4598598 - DNA, 17 bp, Homo sapiens
gagtcgtacagaaagct

SEQ ID NO: 4598599 - DNA, 22 bp, Homo sapiens
gagtcgtacagaaagctgcctg

SEQ ID NO: 4598600 - DNA, 13 bp, Homo sapiens
gagtgtacaagta

SEQ ID NO: 4598601 - DNA, 12 bp, Homo sapiens
gagttaagacct

SEQ ID NO: 4598602 - DNA, 13 bp, Homo sapiens
gagttaagacctg

SEQ ID NO: 4598603 - DNA, 18 bp, Homo sapiens
gagttagtttctttggga

SEQ ID NO: 4598604 - DNA, 19 bp, Homo sapiens
gagttcgaggctgcagtca

SEQ ID NO: 4598605 - DNA, 19 bp, Homo sapiens
gagttgatctggaacccag

SEQ ID NO: 4598606 - DNA, 18 bp, Homo sapiens
gataatacaccactacat

SEQ ID NO: 4598607 - DNA, 16 bp, Homo sapiens
gatacaaaagcatgtg

SEQ ID NO: 4598608 - DNA, 11 bp, Homo sapiens
gatactacagt

SEQ ID NO: 4598609 - DNA, 12 bp, Homo sapiens
gatagatgctgg

SEQ ID NO: 4598610 - DNA, 21 bp, Homo sapiens
gatatagttttacttttaaac

SEQ ID NO: 4598611 - DNA, 24 bp, Homo sapiens
gatatagttttacttttaaactgt

SEQ ID NO: 4598612 - DNA, 23 bp, Homo sapiens
gatatattttacaattttttatc

SEQ ID NO: 4598613 - DNA, 20 bp, Homo sapiens
gatatgtacctaacgaagta

SEQ ID NO: 4598614 - DNA, 15 bp, Homo sapiens
gatattttctgtgcc

SEQ ID NO: 4598615 - DNA, 15 bp, Homo sapiens
gatatttttttcttt

SEQ ID NO: 4598616 - DNA, 17 bp, Homo sapiens
gatatttttttcttttc

SEQ ID NO: 4598617 - DNA, 13 bp, Homo sapiens
gatcacagtggcc

SEQ ID NO: 4598618 - DNA, 22 bp, Homo sapiens
gatcactttctcagttttcata

SEQ ID NO: 4598619 - DNA, 13 bp, Homo sapiens
gatccaaaagaag

SEQ ID NO: 4598620 - DNA, 20 bp, Homo sapiens
gatccaaaagaagcccccag

SEQ ID NO: 4598621 - DNA, 13 bp, Homo sapiens
gatccagcctggg

SEQ ID NO: 4598622 - DNA, 12 bp, Homo sapiens
gatccagggaca

SEQ ID NO: 4598623 - DNA, 18 bp, Homo sapiens
gatccagggacagaggcc

SEQ ID NO: 4598624 - DNA, 12 bp, Homo sapiens
gatcctggaggc

SEQ ID NO: 4598625 - DNA, 16 bp, Homo sapiens
gatcctggaggcccag

SEQ ID NO: 4598626 - DNA, 20 bp, Homo sapiens
gatcctgtctttaaggaaaa

SEQ ID NO: 4598627 - DNA, 12 bp, Homo sapiens
gatctggaacct

SEQ ID NO: 4598628 - DNA, 19 bp, Homo sapiens
gatctggaacctcagcctg

SEQ ID NO: 4598629 - DNA, 20 bp, Homo sapiens
gatctggaacctcagcctgg

SEQ ID NO: 4598630 - DNA, 23 bp, Homo sapiens
gatctggaacctcagcctggcca

SEQ ID NO: 4598631 - DNA, 19 bp, Homo sapiens
gatgaatgaggtcccaggc

SEQ ID NO: 4598632 - DNA, 21 bp, Homo sapiens
gatgcacagagttgttacatt

SEQ ID NO: 4598633 - DNA, 22 bp, Homo sapiens
gatgcacagagttgttacattt

SEQ ID NO: 4598634 - DNA, 15 bp, Homo sapiens
gatgccacacaagga

SEQ ID NO: 4598635 - DNA, 12 bp, Homo sapiens
gatgctggccca

SEQ ID NO: 4598636 - DNA, 19 bp, Homo sapiens
gatgctggcccagggccca

SEQ ID NO: 4598637 - DNA, 23 bp, Homo sapiens
gatgctggcccagggcccagagc

SEQ ID NO: 4598638 - DNA, 14 bp, Homo sapiens
gatgcttgtacata

SEQ ID NO: 4598639 - DNA, 15 bp, Homo sapiens
gatggcaacagatct

SEQ ID NO: 4598640 - DNA, 17 bp, Homo sapiens
gatggcaacagatctgg

SEQ ID NO: 4598641 - DNA, 21 bp, Homo sapiens
gatggctagtatcaaaagaaa

SEQ ID NO: 4598642 - DNA, 19 bp, Homo sapiens
gatgggggaactcagatcc

SEQ ID NO: 4598643 - DNA, 16 bp, Homo sapiens
gatggttttaaacttt

SEQ ID NO: 4598644 - DNA, 12 bp, Homo sapiens
gatgtaaagatg

SEQ ID NO: 4598645 - DNA, 19 bp, Homo sapiens
gatgtaattttgtgtaaga

SEQ ID NO: 4598646 - DNA, 18 bp, Homo sapiens
gatgtagaggagaaactg

SEQ ID NO: 4598647 - DNA, 21 bp, Homo sapiens
gatgttttaaggatgcttgta

SEQ ID NO: 4598648 - DNA, 20 bp, Homo sapiens
gattaaagatgagctttgtc

SEQ ID NO: 4598649 - DNA, 12 bp, Homo sapiens
gattaaattctt

SEQ ID NO: 4598650 - DNA, 20 bp, Homo sapiens
gattctatgttaatatttta

SEQ ID NO: 4598651 - DNA, 21 bp, Homo sapiens
gattgaagtattttgctggaa

SEQ ID NO: 4598652 - DNA, 15 bp, Homo sapiens
gattgctatgaatga

SEQ ID NO: 4598653 - DNA, 19 bp, Homo sapiens
gattgcttgagcccaggag

SEQ ID NO: 4598654 - DNA, 18 bp, Homo sapiens
gattgtgcctaatgtgtt

SEQ ID NO: 4598655 - DNA, 14 bp, Homo sapiens
gatttaacagaaat

SEQ ID NO: 4598656 - DNA, 19 bp, Homo sapiens
gatttaacagaaatgtaca

SEQ ID NO: 4598657 - DNA, 20 bp, Homo sapiens
gatttaggagaagccaggaa

SEQ ID NO: 4598658 - DNA, 18 bp, Homo sapiens
gatttccgttaaaatacc

SEQ ID NO: 4598659 - DNA, 11 bp, Homo sapiens
gatttctgttt

SEQ ID NO: 4598660 - DNA, 13 bp, Homo sapiens
gatttttgcctct

SEQ ID NO: 4598661 - DNA, 19 bp, Homo sapiens
gcaaacctgacccctgctc

SEQ ID NO: 4598662 - DNA, 20 bp, Homo sapiens
gcaaagatctgtcctcagcc

SEQ ID NO: 4598663 - DNA, 22 bp, Homo sapiens
gcaaagatctgtcctcagcctt

SEQ ID NO: 4598664 - DNA, 14 bp, Homo sapiens
gcaaatggcctcat

SEQ ID NO: 4598665 - DNA, 14 bp, Homo sapiens
gcaacaagctattt

SEQ ID NO: 4598666 - DNA, 14 bp, Homo sapiens
gcaacagatctgga

SEQ ID NO: 4598667 - DNA, 22 bp, Homo sapiens
gcaacagatctggaacctcagc

SEQ ID NO: 4598668 - DNA, 16 bp, Homo sapiens
gcaaccaataaaagcc

SEQ ID NO: 4598669 - DNA, 18 bp, Homo sapiens
gcaagcaacaagctattt

SEQ ID NO: 4598670 - DNA, 16 bp, Homo sapiens
gcaataaatctgaccc

SEQ ID NO: 4598671 - DNA, 18 bp, Homo sapiens
gcaataaatctgacccag

SEQ ID NO: 4598672 - DNA, 22 bp, Homo sapiens
gcaatgtcaggaacagaaggat

SEQ ID NO: 4598673 - DNA, 16 bp, Homo sapiens
gcacaataaaaatgtt

SEQ ID NO: 4598674 - DNA, 17 bp, Homo sapiens
gcacaataaaaatgttt

SEQ ID NO: 4598675 - DNA, 18 bp, Homo sapiens
gcacagagttgttacatt

SEQ ID NO: 4598676 - DNA, 19 bp, Homo sapiens
gcacagagttgttacattt

SEQ ID NO: 4598677 - DNA, 21 bp, Homo sapiens
gcacagagttgttacattttt

SEQ ID NO: 4598678 - DNA, 22 bp, Homo sapiens
gcacaggccgtcaccctgggag

SEQ ID NO: 4598679 - DNA, 16 bp, Homo sapiens
gcacctaatccaggca

SEQ ID NO: 4598680 - DNA, 22 bp, Homo sapiens
gcacctaatccaggcagatcca

SEQ ID NO: 4598681 - DNA, 23 bp, Homo sapiens
gcacctaatccaggcagatccag

SEQ ID NO: 4598682 - DNA, 22 bp, Homo sapiens
gcacctggaatatataaccagt

SEQ ID NO: 4598683 - DNA, 22 bp, Homo sapiens
gcactgatgctgcccctcatct

SEQ ID NO: 4598684 - DNA, 17 bp, Homo sapiens
gcactgggcacaggccg

SEQ ID NO: 4598685 - DNA, 18 bp, Homo sapiens
gcactgtgaaggaccctt

SEQ ID NO: 4598686 - DNA, 12 bp, Homo sapiens
gcagaacagtga

SEQ ID NO: 4598687 - DNA, 23 bp, Homo sapiens
gcagaggttgcagtgagccgaga

SEQ ID NO: 4598688 - DNA, 22 bp, Homo sapiens
gcaggctgagggtcgtgggaaa

SEQ ID NO: 4598689 - DNA, 19 bp, Homo sapiens
gcagtggtggttttctgtt

SEQ ID NO: 4598690 - DNA, 20 bp, Homo sapiens
gcagtggtggttttctgttc

SEQ ID NO: 4598691 - DNA, 19 bp, Homo sapiens
gcatacgtacacattttat

SEQ ID NO: 4598692 - DNA, 21 bp, Homo sapiens
gcatgaagtaatatgcacaca

SEQ ID NO: 4598693 - DNA, 15 bp, Homo sapiens
gcatggtgccccagg

SEQ ID NO: 4598694 - DNA, 16 bp, Homo sapiens
gcatggtgccccagga

SEQ ID NO: 4598695 - DNA, 21 bp, Homo sapiens
gcatggtgccccaggaccagc

SEQ ID NO: 4598696 - DNA, 15 bp, Homo sapiens
gcatttaaaagatac

SEQ ID NO: 4598697 - DNA, 19 bp, Homo sapiens
gcatttgaggtctgttctt

SEQ ID NO: 4598698 - DNA, 21 bp, Homo sapiens
gcatttgaggtctgttctttc

SEQ ID NO: 4598699 - DNA, 21 bp, Homo sapiens
gcatttggtggtttcagaaat

SEQ ID NO: 4598700 - DNA, 22 bp, Homo sapiens
gcatttggtggtttcagaaatg

SEQ ID NO: 4598701 - DNA, 16 bp, Homo sapiens
gcatttgtttgaactg

SEQ ID NO: 4598702 - DNA, 12 bp, Homo sapiens
gccaaataaagt

SEQ ID NO: 4598703 - DNA, 14 bp, Homo sapiens
gccaaataaagtct

SEQ ID NO: 4598704 - DNA, 21 bp, Homo sapiens
gccaactttccccacgttaaa

SEQ ID NO: 4598705 - DNA, 15 bp, Homo sapiens
gccaagatcacagtg

SEQ ID NO: 4598706 - DNA, 18 bp, Homo sapiens
gccacaaggacttcctgt

SEQ ID NO: 4598707 - DNA, 19 bp, Homo sapiens
gccacaaggacttcctgtc

SEQ ID NO: 4598708 - DNA, 14 bp, Homo sapiens
gccacagtcatggt

SEQ ID NO: 4598709 - DNA, 19 bp, Homo sapiens
gccaccctgcctctaccca

SEQ ID NO: 4598710 - DNA, 15 bp, Homo sapiens
gccacggccacagtc

SEQ ID NO: 4598711 - DNA, 22 bp, Homo sapiens
gccagagatccaaaagaagccc

SEQ ID NO: 4598712 - DNA, 12 bp, Homo sapiens
gccagagccagg

SEQ ID NO: 4598713 - DNA, 14 bp, Homo sapiens
gccagagccagggg

SEQ ID NO: 4598714 - DNA, 14 bp, Homo sapiens
gccagatccagcct

SEQ ID NO: 4598715 - DNA, 22 bp, Homo sapiens
gccagatgctagagcctctgcc

SEQ ID NO: 4598716 - DNA, 19 bp, Homo sapiens
gccaggaatttcccaggac

SEQ ID NO: 4598717 - DNA, 22 bp, Homo sapiens
gccaggaatttcccaggaccct

SEQ ID NO: 4598718 - DNA, 23 bp, Homo sapiens
gccaggaatttcccaggaccctg

SEQ ID NO: 4598719 - DNA, 19 bp, Homo sapiens
gccaggagtttgagaccag

SEQ ID NO: 4598720 - DNA, 21 bp, Homo sapiens
gccaggggggtgaggagctgg

SEQ ID NO: 4598721 - DNA, 20 bp, Homo sapiens
gccatattccgcactgggca

SEQ ID NO: 4598722 - DNA, 23 bp, Homo sapiens
gccatgatggcaacagatctgga

SEQ ID NO: 4598723 - DNA, 17 bp, Homo sapiens
gcccactgtcctgggcc

SEQ ID NO: 4598724 - DNA, 21 bp, Homo sapiens
gcccactgtcctgggcctgca

SEQ ID NO: 4598725 - DNA, 23 bp, Homo sapiens
gcccactgtcctgggcctgcaga

SEQ ID NO: 4598726 - DNA, 24 bp, Homo sapiens
gcccactgtcctgggcctgcagaa

SEQ ID NO: 4598727 - DNA, 16 bp, Homo sapiens
aacctgacccctgctc

SEQ ID NO: 4598728 - DNA, 17 bp, Homo sapiens
aacctgacccctgctca

SEQ ID NO: 4598729 - DNA, 19 bp, Homo sapiens
aacctgacccctgctcagt

SEQ ID NO: 4598730 - DNA, 24 bp, Homo sapiens
aacctgttacctactttgactttt

SEQ ID NO: 4598731 - DNA, 15 bp, Homo sapiens
aacgctgatttaaag

SEQ ID NO: 4598732 - DNA, 17 bp, Homo sapiens
aactaaaataattttgt

SEQ ID NO: 4598733 - DNA, 15 bp, Homo sapiens
aactaaaatgttcta

SEQ ID NO: 4598734 - DNA, 15 bp, Homo sapiens
aactaatgccttact

SEQ ID NO: 4598735 - DNA, 20 bp, Homo sapiens
aactactacctgtaatgaca

SEQ ID NO: 4598736 - DNA, 22 bp, Homo sapiens
aactatgcatggtgccccagga

SEQ ID NO: 4598737 - DNA, 23 bp, Homo sapiens
aactatgcatggtgccccaggac

SEQ ID NO: 4598738 - DNA, 12 bp, Homo sapiens
aactatttaaca

SEQ ID NO: 4598739 - DNA, 21 bp, Homo sapiens
aactcaaatggggccagatcc

SEQ ID NO: 4598740 - DNA, 23 bp, Homo sapiens
aactctgttacactttttggaag

SEQ ID NO: 4598741 - DNA, 12 bp, Homo sapiens
aactgaaaatgt

SEQ ID NO: 4598742 - DNA, 14 bp, Homo sapiens
aactgataaagatg

SEQ ID NO: 4598743 - DNA, 16 bp, Homo sapiens
aactgcctactccaaa

SEQ ID NO: 4598744 - DNA, 15 bp, Homo sapiens
aactggattaaactt

SEQ ID NO: 4598745 - DNA, 13 bp, Homo sapiens
aactgtttagatg

SEQ ID NO: 4598746 - DNA, 16 bp, Homo sapiens
aacttaatctaaatgg

SEQ ID NO: 4598747 - DNA, 19 bp, Homo sapiens
aactttgacctctgcagca

SEQ ID NO: 4598748 - DNA, 15 bp, Homo sapiens
aacttttataaactt

SEQ ID NO: 4598749 - DNA, 17 bp, Homo sapiens
aagaaaaaggatgcaca

SEQ ID NO: 4598750 - DNA, 19 bp, Homo sapiens
aagaaaaaggatgcacaga

SEQ ID NO: 4598751 - DNA, 22 bp, Homo sapiens
aagaaaagtaggtttacattca

SEQ ID NO: 4598752 - DNA, 13 bp, Homo sapiens
aagaaagaaaatc

SEQ ID NO: 4598753 - DNA, 16 bp, Homo sapiens
aagaaagaaaatcagg

SEQ ID NO: 4598754 - DNA, 13 bp, Homo sapiens
aagaaagaaggaa

SEQ ID NO: 4598755 - DNA, 14 bp, Homo sapiens
aagaaagaaggaag

SEQ ID NO: 4598756 - DNA, 20 bp, Homo sapiens
aagaaaggcaaccaataaaa

SEQ ID NO: 4598757 - DNA, 14 bp, Homo sapiens
aagaacaagaattt

SEQ ID NO: 4598758 - DNA, 15 bp, Homo sapiens
aagaagcccccagct

SEQ ID NO: 4598759 - DNA, 16 bp, Homo sapiens
aagaagcccccagcta

SEQ ID NO: 4598760 - DNA, 17 bp, Homo sapiens
aagaagccgggaacaga

SEQ ID NO: 4598761 - DNA, 22 bp, Homo sapiens
aagaagtgaaaatctacactcc

SEQ ID NO: 4598762 - DNA, 23 bp, Homo sapiens
aagaataatcacgctttcctgaa

SEQ ID NO: 4598763 - DNA, 18 bp, Homo sapiens
aagaatagcattgtaaaa

SEQ ID NO: 4598764 - DNA, 20 bp, Homo sapiens
aagaatttcttggtaagaag

SEQ ID NO: 4598765 - DNA, 22 bp, Homo sapiens
aagaatttcttggtaagaagcc

SEQ ID NO: 4598766 - DNA, 19 bp, Homo sapiens
aagacatgtctgttctaca

SEQ ID NO: 4598767 - DNA, 17 bp, Homo sapiens
aagactgagtacgttgt

SEQ ID NO: 4598768 - DNA, 19 bp, Homo sapiens
aagaggcagggacctaaag

SEQ ID NO: 4598769 - DNA, 17 bp, Homo sapiens
aagatacagttactcag

SEQ ID NO: 4598770 - DNA, 22 bp, Homo sapiens
aagatattttgctttgtgattt

SEQ ID NO: 4598771 - DNA, 19 bp, Homo sapiens
aagatatttttatctttat

SEQ ID NO: 4598772 - DNA, 23 bp, Homo sapiens
aagatcactttctcagttttcat

SEQ ID NO: 4598773 - DNA, 18 bp, Homo sapiens
aagatctgtcctcagcct

SEQ ID NO: 4598774 - DNA, 20 bp, Homo sapiens
aagatctgtcctcagccttg

SEQ ID NO: 4598775 - DNA, 11 bp, Homo sapiens
aagattctatg

SEQ ID NO: 4598776 - DNA, 19 bp, Homo sapiens
aagattctatgttaatatt

SEQ ID NO: 4598777 - DNA, 21 bp, Homo sapiens
aagattctatgttaatatttt

SEQ ID NO: 4598778 - DNA, 16 bp, Homo sapiens
aagcaacaagctattt

SEQ ID NO: 4598779 - DNA, 17 bp, Homo sapiens
aagcaacccaaatgttc

SEQ ID NO: 4598780 - DNA, 21 bp, Homo sapiens
aagcagcgtttctatgacaca

SEQ ID NO: 4598781 - DNA, 12 bp, Homo sapiens
aagcatgtgaga

SEQ ID NO: 4598782 - DNA, 17 bp, Homo sapiens
aagcattttgtaataat

SEQ ID NO: 4598783 - DNA, 23 bp, Homo sapiens
aagccagctttccctgcctctca

SEQ ID NO: 4598784 - DNA, 24 bp, Homo sapiens
aagccaggaatttcccaggaccct

SEQ ID NO: 4598785 - DNA, 23 bp, Homo sapiens
aagccaggttccacagaggacac

SEQ ID NO: 4598786 - DNA, 18 bp, Homo sapiens
aagcctcaaaacaaaggc

SEQ ID NO: 4598787 - DNA, 15 bp, Homo sapiens
aagcctcagaggcct

SEQ ID NO: 4598788 - DNA, 17 bp, Homo sapiens
aagctaaggtttagata

SEQ ID NO: 4598789 - DNA, 14 bp, Homo sapiens
aagctcacttctgg

SEQ ID NO: 4598790 - DNA, 22 bp, Homo sapiens
aagctcctctccccagcccaga

SEQ ID NO: 4598791 - DNA, 11 bp, Homo sapiens
aaggaaggaaa

SEQ ID NO: 4598792 - DNA, 20 bp, Homo sapiens
aaggacttcctgtccagctc

SEQ ID NO: 4598793 - DNA, 18 bp, Homo sapiens
aaggagatttacaactgg

SEQ ID NO: 4598794 - DNA, 13 bp, Homo sapiens
aaggatacaaaag

SEQ ID NO: 4598795 - DNA, 15 bp, Homo sapiens
aaggatagatgctgg

SEQ ID NO: 4598796 - DNA, 19 bp, Homo sapiens
aaggatgcttgtacataat

SEQ ID NO: 4598797 - DNA, 15 bp, Homo sapiens
aaggcaaccaataaa

SEQ ID NO: 4598798 - DNA, 20 bp, Homo sapiens
aaggcaaccaataaaagcca

SEQ ID NO: 4598799 - DNA, 18 bp, Homo sapiens
aaggcgggagcatctctt

SEQ ID NO: 4598800 - DNA, 18 bp, Homo sapiens
aagggactacctctgtgc

SEQ ID NO: 4598801 - DNA, 19 bp, Homo sapiens
aagggactacctctgtgcc

SEQ ID NO: 4598802 - DNA, 24 bp, Homo sapiens
aagggatggaggtcacactggtag

SEQ ID NO: 4598803 - DNA, 15 bp, Homo sapiens
aagggccagagccag

SEQ ID NO: 4598804 - DNA, 13 bp, Homo sapiens
aaggggagcccac

SEQ ID NO: 4598805 - DNA, 17 bp, Homo sapiens
aaggggcagtggtggtt

SEQ ID NO: 4598806 - DNA, 13 bp, Homo sapiens
aaggtagaatgtt

SEQ ID NO: 4598807 - DNA, 18 bp, Homo sapiens
aaggtcattttttttaag

SEQ ID NO: 4598808 - DNA, 13 bp, Homo sapiens
aagtacactgttt

SEQ ID NO: 4598809 - DNA, 18 bp, Homo sapiens
aagtacactgtttcaaac

SEQ ID NO: 4598810 - DNA, 20 bp, Homo sapiens
aagtacactgtttcaaactt

SEQ ID NO: 4598811 - DNA, 16 bp, Homo sapiens
aagtatccctactgta

SEQ ID NO: 4598812 - DNA, 18 bp, Homo sapiens
aagtatccctactgtaat

SEQ ID NO: 4598813 - DNA, 23 bp, Homo sapiens
aagtatccctactgtaatttgtg

SEQ ID NO: 4598814 - DNA, 19 bp, Homo sapiens
aagtattatacctttttta

SEQ ID NO: 4598815 - DNA, 19 bp, Homo sapiens
aagtcacatcacaggacac

SEQ ID NO: 4598816 - DNA, 17 bp, Homo sapiens
aagtcatgaagcccaag

SEQ ID NO: 4598817 - DNA, 20 bp, Homo sapiens
aagtctgttgattaaagatg

SEQ ID NO: 4598818 - DNA, 22 bp, Homo sapiens
aagtgcaataaatctgacccag

SEQ ID NO: 4598819 - DNA, 13 bp, Homo sapiens
aagtgctgcattt

SEQ ID NO: 4598820 - DNA, 22 bp, Homo sapiens
aagtgctgcatttaaaagatac

SEQ ID NO: 4598821 - DNA, 18 bp, Homo sapiens
aagttagttccactgaga

SEQ ID NO: 4598822 - DNA, 19 bp, Homo sapiens
aagttagttccactgagac

SEQ ID NO: 4598823 - DNA, 21 bp, Homo sapiens
aagttgattcatattgcatca

SEQ ID NO: 4598824 - DNA, 20 bp, Homo sapiens
aagtttttatggcttttgtg

SEQ ID NO: 4598825 - DNA, 19 bp, Homo sapiens
aataaaaagatcactttct

SEQ ID NO: 4598826 - DNA, 14 bp, Homo sapiens
aataaaaatgttta

SEQ ID NO: 4598827 - DNA, 13 bp, Homo sapiens
aataaaagccaga

SEQ ID NO: 4598828 - DNA, 13 bp, Homo sapiens
aataaacatcctt

SEQ ID NO: 4598829 - DNA, 10 bp, Homo sapiens
aataaaccat

SEQ ID NO: 4598830 - DNA, 15 bp, Homo sapiens
aataaatctgaccca

SEQ ID NO: 4598831 - DNA, 22 bp, Homo sapiens
aataagttcaaattcttctgaa

SEQ ID NO: 4598832 - DNA, 15 bp, Homo sapiens
aatacaccactacat

SEQ ID NO: 4598833 - DNA, 18 bp, Homo sapiens
aatacaccactacattct

SEQ ID NO: 4598834 - DNA, 21 bp, Homo sapiens
aatacaccactacattctgtt

SEQ ID NO: 4598835 - DNA, 14 bp, Homo sapiens
aatacatttaaaac

SEQ ID NO: 4598836 - DNA, 17 bp, Homo sapiens
aatacatttaaaacatt

SEQ ID NO: 4598837 - DNA, 22 bp, Homo sapiens
aatacatttaaaacattaaaat

SEQ ID NO: 4598838 - DNA, 17 bp, Homo sapiens
aataccagccagtaaat

SEQ ID NO: 4598839 - DNA, 20 bp, Homo sapiens
aatatcccttggacatttta

SEQ ID NO: 4598840 - DNA, 21 bp, Homo sapiens
aatatcccttggacattttat

SEQ ID NO: 4598841 - DNA, 22 bp, Homo sapiens
aatatgcacacattttttaaat

SEQ ID NO: 4598842 - DNA, 16 bp, Homo sapiens
aatcacgctttcctga

SEQ ID NO: 4598843 - DNA, 23 bp, Homo sapiens
aatcagaactcaaatggggccag

SEQ ID NO: 4598844 - DNA, 20 bp, Homo sapiens
aatcattttacccttggctc

SEQ ID NO: 4598845 - DNA, 22 bp, Homo sapiens
aatccaggcagatccaggacta

SEQ ID NO: 4598846 - DNA, 12 bp, Homo sapiens
aatctaaatgga

SEQ ID NO: 4598847 - DNA, 13 bp, Homo sapiens
aatctaaatggaa

SEQ ID NO: 4598848 - DNA, 19 bp, Homo sapiens
aatctacactccagtgaga

SEQ ID NO: 4598849 - DNA, 15 bp, Homo sapiens
aatctcaaatttcta

SEQ ID NO: 4598850 - DNA, 17 bp, Homo sapiens
aatctgacccagtgccc

SEQ ID NO: 4598851 - DNA, 17 bp, Homo sapiens
aatctggattcatattt

SEQ ID NO: 4598852 - DNA, 19 bp, Homo sapiens
aatctggattcatatttaa

SEQ ID NO: 4598853 - DNA, 12 bp, Homo sapiens
aatctgtaaact

SEQ ID NO: 4598854 - DNA, 15 bp, Homo sapiens
aatctgtaaactgtg

SEQ ID NO: 4598855 - DNA, 23 bp, Homo sapiens
aatctgtaaactgtgtattccaa

SEQ ID NO: 4598856 - DNA, 18 bp, Homo sapiens
agtcgtacagaaagctgc

SEQ ID NO: 4598857 - DNA, 16 bp, Homo sapiens
agtgaaaactttgtag

SEQ ID NO: 4598858 - DNA, 16 bp, Homo sapiens
agtgagccgagattgt

SEQ ID NO: 4598859 - DNA, 17 bp, Homo sapiens
agtgcaaagtataaaat

SEQ ID NO: 4598860 - DNA, 22 bp, Homo sapiens
agtgcaataaatctgacccagt

SEQ ID NO: 4598861 - DNA, 16 bp, Homo sapiens
agtgcagcaagcctgg

SEQ ID NO: 4598862 - DNA, 21 bp, Homo sapiens
agtgcctgtaatcacagctac

SEQ ID NO: 4598863 - DNA, 19 bp, Homo sapiens
agtgccttcctgtttttca

SEQ ID NO: 4598864 - DNA, 20 bp, Homo sapiens
agtggcctgtaagtccaagc

SEQ ID NO: 4598865 - DNA, 19 bp, Homo sapiens
agtggtggttttctgttct

SEQ ID NO: 4598866 - DNA, 12 bp, Homo sapiens
agtgtatttatt

SEQ ID NO: 4598867 - DNA, 13 bp, Homo sapiens
agttaagacctgg

SEQ ID NO: 4598868 - DNA, 17 bp, Homo sapiens
agttagtggattactgc

SEQ ID NO: 4598869 - DNA, 17 bp, Homo sapiens
agttagtttctttggga

SEQ ID NO: 4598870 - DNA, 16 bp, Homo sapiens
agttcaggagtcccaa

SEQ ID NO: 4598871 - DNA, 20 bp, Homo sapiens
agttcaggagtcccaaggaa

SEQ ID NO: 4598872 - DNA, 15 bp, Homo sapiens
agttccactgagacc

SEQ ID NO: 4598873 - DNA, 16 bp, Homo sapiens
agttctttgggccaga

SEQ ID NO: 4598874 - DNA, 21 bp, Homo sapiens
agttctttgggccagacatgc

SEQ ID NO: 4598875 - DNA, 19 bp, Homo sapiens
agttgatctggaacccaga

SEQ ID NO: 4598876 - DNA, 22 bp, Homo sapiens
agttgattcatattgcatcata

SEQ ID NO: 4598877 - DNA, 21 bp, Homo sapiens
agttggagggaaagccagcct

SEQ ID NO: 4598878 - DNA, 23 bp, Homo sapiens
agttggagggaaagccagcctgg

SEQ ID NO: 4598879 - DNA, 22 bp, Homo sapiens
agttgtaaataatttatttaat

SEQ ID NO: 4598880 - DNA, 18 bp, Homo sapiens
agttgtaccgcaatgtga

SEQ ID NO: 4598881 - DNA, 13 bp, Homo sapiens
agttgttacattt

SEQ ID NO: 4598882 - DNA, 16 bp, Homo sapiens
agttgttacattttta

SEQ ID NO: 4598883 - DNA, 20 bp, Homo sapiens
agttgttacatttttaagtg

SEQ ID NO: 4598884 - DNA, 15 bp, Homo sapiens
agttgttagattaag

SEQ ID NO: 4598885 - DNA, 23 bp, Homo sapiens
agtttctgtcgttaaaaacagat

SEQ ID NO: 4598886 - DNA, 20 bp, Homo sapiens
agtttgattaaattcttgca

SEQ ID NO: 4598887 - DNA, 22 bp, Homo sapiens
agtttgattaaattcttgcaaa

SEQ ID NO: 4598888 - DNA, 23 bp, Homo sapiens
agtttttatggcttttgtgcatt

SEQ ID NO: 4598889 - DNA, 14 bp, Homo sapiens
ataaaaagatcact

SEQ ID NO: 4598890 - DNA, 15 bp, Homo sapiens
ataaaactttttaaa

SEQ ID NO: 4598891 - DNA, 12 bp, Homo sapiens
ataaaataagaa

SEQ ID NO: 4598892 - DNA, 18 bp, Homo sapiens
ataaagcagcgtttctat

SEQ ID NO: 4598893 - DNA, 20 bp, Homo sapiens
ataaccccagctccctagga

SEQ ID NO: 4598894 - DNA, 18 bp, Homo sapiens
ataagaaaaatattaata

SEQ ID NO: 4598895 - DNA, 14 bp, Homo sapiens
ataagattatatgg

SEQ ID NO: 4598896 - DNA, 18 bp, Homo sapiens
ataagattatatggactt

SEQ ID NO: 4598897 - DNA, 22 bp, Homo sapiens
ataagccagacatcaacagata

SEQ ID NO: 4598898 - DNA, 14 bp, Homo sapiens
ataagctattttgg

SEQ ID NO: 4598899 - DNA, 16 bp, Homo sapiens
ataatcacgctttcct

SEQ ID NO: 4598900 - DNA, 18 bp, Homo sapiens
ataatcacgctttcctga

SEQ ID NO: 4598901 - DNA, 17 bp, Homo sapiens
ataatcttctgccttct

SEQ ID NO: 4598902 - DNA, 20 bp, Homo sapiens
ataatcttctgccttctcat

SEQ ID NO: 4598903 - DNA, 15 bp, Homo sapiens
ataatgcgtgcatac

SEQ ID NO: 4598904 - DNA, 12 bp, Homo sapiens
ataattttgtaa

SEQ ID NO: 4598905 - DNA, 13 bp, Homo sapiens
atacaaaagcatg

SEQ ID NO: 4598906 - DNA, 17 bp, Homo sapiens
atacaatgctgtgccct

SEQ ID NO: 4598907 - DNA, 23 bp, Homo sapiens
atacaatgctgtgccctaaagtg

SEQ ID NO: 4598908 - DNA, 15 bp, Homo sapiens
atacacaacacacac

SEQ ID NO: 4598909 - DNA, 16 bp, Homo sapiens
atacagcaacaattta

SEQ ID NO: 4598910 - DNA, 20 bp, Homo sapiens
atacagttactcagaattct

SEQ ID NO: 4598911 - DNA, 17 bp, Homo sapiens
ataccacttttgttctt

SEQ ID NO: 4598912 - DNA, 19 bp, Homo sapiens
ataccagccagtaaatggg

SEQ ID NO: 4598913 - DNA, 21 bp, Homo sapiens
caaccaataaaagccagatgc

SEQ ID NO: 4598914 - DNA, 13 bp, Homo sapiens
caaccatcgcttt

SEQ ID NO: 4598915 - DNA, 18 bp, Homo sapiens
caacccttccctcacctt

SEQ ID NO: 4598916 - DNA, 13 bp, Homo sapiens
caagaaatgaaag

SEQ ID NO: 4598917 - DNA, 15 bp, Homo sapiens
caagaaatgaaagca

SEQ ID NO: 4598918 - DNA, 18 bp, Homo sapiens
caagaataatcacgcttt

SEQ ID NO: 4598919 - DNA, 22 bp, Homo sapiens
caagaatttcttggtaagaagc

SEQ ID NO: 4598920 - DNA, 15 bp, Homo sapiens
caagacacatcccta

SEQ ID NO: 4598921 - DNA, 16 bp, Homo sapiens
caagaccacgtttcta

SEQ ID NO: 4598922 - DNA, 17 bp, Homo sapiens
caagaccacgtttctaa

SEQ ID NO: 4598923 - DNA, 18 bp, Homo sapiens
caagaccacgtttctaaa

SEQ ID NO: 4598924 - DNA, 19 bp, Homo sapiens
caagacccaaaaggcagaa

SEQ ID NO: 4598925 - DNA, 22 bp, Homo sapiens
caagatcctgtctttaaggaaa

SEQ ID NO: 4598926 - DNA, 18 bp, Homo sapiens
caagcaacaagctatttt

SEQ ID NO: 4598927 - DNA, 20 bp, Homo sapiens
caaggaaagccccagcacta

SEQ ID NO: 4598928 - DNA, 17 bp, Homo sapiens
caaggaaggaaagaaag

SEQ ID NO: 4598929 - DNA, 18 bp, Homo sapiens
caaggaaggaaagaaaga

SEQ ID NO: 4598930 - DNA, 23 bp, Homo sapiens
caaggaaggaaagaaagaaggaa

SEQ ID NO: 4598931 - DNA, 21 bp, Homo sapiens
caaggacttcctgtccagctc

SEQ ID NO: 4598932 - DNA, 15 bp, Homo sapiens
caaggatagatgctg

SEQ ID NO: 4598933 - DNA, 16 bp, Homo sapiens
caaggatagatgctgg

SEQ ID NO: 4598934 - DNA, 22 bp, Homo sapiens
caaggatagatgctggcccagg

SEQ ID NO: 4598935 - DNA, 17 bp, Homo sapiens
caaggctgattaaacca

SEQ ID NO: 4598936 - DNA, 20 bp, Homo sapiens
caaggtcattttttttaaga

SEQ ID NO: 4598937 - DNA, 15 bp, Homo sapiens
caaggtgcaaatcaa

SEQ ID NO: 4598938 - DNA, 17 bp, Homo sapiens
caagtattatacctttt

SEQ ID NO: 4598939 - DNA, 17 bp, Homo sapiens
caataaaaatgtttaac

SEQ ID NO: 4598940 - DNA, 13 bp, Homo sapiens
caatcctctaagc

SEQ ID NO: 4598941 - DNA, 16 bp, Homo sapiens
caatctgtaaactgtg

SEQ ID NO: 4598942 - DNA, 17 bp, Homo sapiens
caatctgtaaactgtgt

SEQ ID NO: 4598943 - DNA, 18 bp, Homo sapiens
caatctgtaaactgtgta

SEQ ID NO: 4598944 - DNA, 19 bp, Homo sapiens
caatgaaatgaattaaagt

SEQ ID NO: 4598945 - DNA, 22 bp, Homo sapiens
caatgaatgaatgaatggctaa

SEQ ID NO: 4598946 - DNA, 15 bp, Homo sapiens
caatgacttactgta

SEQ ID NO: 4598947 - DNA, 17 bp, Homo sapiens
caatgacttactgtaca

SEQ ID NO: 4598948 - DNA, 20 bp, Homo sapiens
caatgtttatgcaaggaagg

SEQ ID NO: 4598949 - DNA, 23 bp, Homo sapiens
caatgtttatgcaaggaaggaaa

SEQ ID NO: 4598950 - DNA, 12 bp, Homo sapiens
caatttaaaaaa

SEQ ID NO: 4598951 - DNA, 13 bp, Homo sapiens
caatttattatgg

SEQ ID NO: 4598952 - DNA, 23 bp, Homo sapiens
cacaagaaatgaaagcagggact

SEQ ID NO: 4598953 - DNA, 21 bp, Homo sapiens
cacaaggatagatgctggccc

SEQ ID NO: 4598954 - DNA, 18 bp, Homo sapiens
cacaataaaaatgtttaa

SEQ ID NO: 4598955 - DNA, 12 bp, Homo sapiens
cacacatttttt

SEQ ID NO: 4598956 - DNA, 20 bp, Homo sapiens
cacaccggtaccctcctccc

SEQ ID NO: 4598957 - DNA, 19 bp, Homo sapiens
cacagacatactaaccagc

SEQ ID NO: 4598958 - DNA, 21 bp, Homo sapiens
cacagacatactaaccagcag

SEQ ID NO: 4598959 - DNA, 21 bp, Homo sapiens
cacagagttgttacattttta

SEQ ID NO: 4598960 - DNA, 21 bp, Homo sapiens
cacagtgcagcaagcctggcc

SEQ ID NO: 4598961 - DNA, 23 bp, Homo sapiens
cacagtgtgtggtcaacatttct

SEQ ID NO: 4598962 - DNA, 19 bp, Homo sapiens
cacagttctttgggccaga

SEQ ID NO: 4598963 - DNA, 13 bp, Homo sapiens
cacatattgattt

SEQ ID NO: 4598964 - DNA, 17 bp, Homo sapiens
cacatatttcagtgagg

SEQ ID NO: 4598965 - DNA, 19 bp, Homo sapiens
cacatcagcacgatttctg

SEQ ID NO: 4598966 - DNA, 15 bp, Homo sapiens
cacatctgttttgta

SEQ ID NO: 4598967 - DNA, 20 bp, Homo sapiens
cacatgcaaggtcatttttt

SEQ ID NO: 4598968 - DNA, 13 bp, Homo sapiens
cacattaaattga

SEQ ID NO: 4598969 - DNA, 21 bp, Homo sapiens
cacattttattttattatgca

SEQ ID NO: 4598970 - DNA, 18 bp, Homo sapiens
cacattttccttttcaaa

SEQ ID NO: 4598971 - DNA, 17 bp, Homo sapiens
cacattttttaaatgca

SEQ ID NO: 4598972 - DNA, 14 bp, Homo sapiens
caccagacacccag

SEQ ID NO: 4598973 - DNA, 15 bp, Homo sapiens
caccagacacccagg

SEQ ID NO: 4598974 - DNA, 16 bp, Homo sapiens
caccagacacccagga

SEQ ID NO: 4598975 - DNA, 17 bp, Homo sapiens
cacccagaatccctcta

SEQ ID NO: 4598976 - DNA, 22 bp, Homo sapiens
caccctgatttaggagaagcca

SEQ ID NO: 4598977 - DNA, 21 bp, Homo sapiens
caccctgcctctacccaacca

SEQ ID NO: 4598978 - DNA, 17 bp, Homo sapiens
caccggtaccctcctcc

SEQ ID NO: 4598979 - DNA, 17 bp, Homo sapiens
cacctaatccaggcaga

SEQ ID NO: 4598980 - DNA, 15 bp, Homo sapiens
cacctgtaaacctga

SEQ ID NO: 4598981 - DNA, 12 bp, Homo sapiens
cacgatttctgt

SEQ ID NO: 4598982 - DNA, 22 bp, Homo sapiens
cacgttcttactagtttccctt

SEQ ID NO: 4598983 - DNA, 23 bp, Homo sapiens
cactagcccaatgaaatgaatta

SEQ ID NO: 4598984 - DNA, 13 bp, Homo sapiens
cactgagaaagag

SEQ ID NO: 4598985 - DNA, 17 bp, Homo sapiens
cactgagaaagaggcag

SEQ ID NO: 4598986 - DNA, 19 bp, Homo sapiens
cactgagaaagaggcaggg

SEQ ID NO: 4598987 - DNA, 19 bp, Homo sapiens
cactgatgctgcccctcat

SEQ ID NO: 4598988 - DNA, 22 bp, Homo sapiens
cactgggctggggtccctgcct

SEQ ID NO: 4598989 - DNA, 16 bp, Homo sapiens
cactgtcctattatat

SEQ ID NO: 4598990 - DNA, 14 bp, Homo sapiens
cactgtgaaggacc

SEQ ID NO: 4598991 - DNA, 17 bp, Homo sapiens
cactgtgaaggaccctt

SEQ ID NO: 4598992 - DNA, 20 bp, Homo sapiens
cacttaagttagttccactg

SEQ ID NO: 4598993 - DNA, 22 bp, Homo sapiens
cacttaagttagttccactgag

SEQ ID NO: 4598994 - DNA, 21 bp, Homo sapiens
cacttgaacccgggaggcaga

SEQ ID NO: 4598995 - DNA, 19 bp, Homo sapiens
cactttctcagttttcata

SEQ ID NO: 4598996 - DNA, 19 bp, Homo sapiens
cagaaagcagaacagtgat

SEQ ID NO: 4598997 - DNA, 15 bp, Homo sapiens
acacttaaaaatggt

SEQ ID NO: 4598998 - DNA, 16 bp, Homo sapiens
acagaagtcatgaagc

SEQ ID NO: 4598999 - DNA, 18 bp, Homo sapiens
acagaagtcatgaagccc

SEQ ID NO: 4599000 - DNA, 16 bp, Homo sapiens
acagaggccccagcct

SEQ ID NO: 4599001 - DNA, 18 bp, Homo sapiens
acagaggccccagcctcc

SEQ ID NO: 4599002 - DNA, 18 bp, Homo sapiens
acagagttgttacatttt

SEQ ID NO: 4599003 - DNA, 20 bp, Homo sapiens
acagatctggaacctcagcc

SEQ ID NO: 4599004 - DNA, 22 bp, Homo sapiens
acagatctggaacctcagcctg

SEQ ID NO: 4599005 - DNA, 15 bp, Homo sapiens
acagatttggaaaga

SEQ ID NO: 4599006 - DNA, 20 bp, Homo sapiens
acagcaacaatttatgaatt

SEQ ID NO: 4599007 - DNA, 12 bp, Homo sapiens
acagccccaccc

SEQ ID NO: 4599008 - DNA, 15 bp, Homo sapiens
acagccccaccctgg

SEQ ID NO: 4599009 - DNA, 17 bp, Homo sapiens
acaggaagtagaggagg

SEQ ID NO: 4599010 - DNA, 18 bp, Homo sapiens
acaggccgtcaccctggg

SEQ ID NO: 4599011 - DNA, 20 bp, Homo sapiens
acaggccgtcaccctgggag

SEQ ID NO: 4599012 - DNA, 14 bp, Homo sapiens
acagtgagactctg

SEQ ID NO: 4599013 - DNA, 19 bp, Homo sapiens
acagtgattaccagggact

SEQ ID NO: 4599014 - DNA, 20 bp, Homo sapiens
acagtgattaccagggactg

SEQ ID NO: 4599015 - DNA, 21 bp, Homo sapiens
acagtggccaagatcacagtg

SEQ ID NO: 4599016 - DNA, 13 bp, Homo sapiens
acagtggccacgg

SEQ ID NO: 4599017 - DNA, 22 bp, Homo sapiens
acagttctttgggccagacatg

SEQ ID NO: 4599018 - DNA, 21 bp, Homo sapiens
acagttggagggaaagccagc

SEQ ID NO: 4599019 - DNA, 23 bp, Homo sapiens
acagttggagggaaagccagcct

SEQ ID NO: 4599020 - DNA, 23 bp, Homo sapiens
acataaacaagaccacgtttcta

SEQ ID NO: 4599021 - DNA, 21 bp, Homo sapiens
acatactaaccagcagaaatg

SEQ ID NO: 4599022 - DNA, 15 bp, Homo sapiens
acatacttgaagggc

SEQ ID NO: 4599023 - DNA, 18 bp, Homo sapiens
acatacttgaagggccag

SEQ ID NO: 4599024 - DNA, 16 bp, Homo sapiens
acatattgatttccgt

SEQ ID NO: 4599025 - DNA, 18 bp, Homo sapiens
acatattgatttccgtta

SEQ ID NO: 4599026 - DNA, 22 bp, Homo sapiens
acatattgatttccgttaaaat

SEQ ID NO: 4599027 - DNA, 13 bp, Homo sapiens
acatcaacagata

SEQ ID NO: 4599028 - DNA, 16 bp, Homo sapiens
acatgaaaacacattt

SEQ ID NO: 4599029 - DNA, 19 bp, Homo sapiens
acatgaaaacacatttttc

SEQ ID NO: 4599030 - DNA, 22 bp, Homo sapiens
acatgaaaacacatttttctta

SEQ ID NO: 4599031 - DNA, 23 bp, Homo sapiens
acatgaggtactgagagtgaaca

SEQ ID NO: 4599032 - DNA, 19 bp, Homo sapiens
acatgatcctgcaattcca

SEQ ID NO: 4599033 - DNA, 16 bp, Homo sapiens
acatgcaaggtcattt

SEQ ID NO: 4599034 - DNA, 14 bp, Homo sapiens
acatgtgaaaagaa

SEQ ID NO: 4599035 - DNA, 17 bp, Homo sapiens
acatgtgaaaagaatag

SEQ ID NO: 4599036 - DNA, 12 bp, Homo sapiens
acattcaatgtt

SEQ ID NO: 4599037 - DNA, 18 bp, Homo sapiens
acatttaaaacattaaaa

SEQ ID NO: 4599038 - DNA, 15 bp, Homo sapiens
acattttatgtcttt

SEQ ID NO: 4599039 - DNA, 18 bp, Homo sapiens
acattttattttattatg

SEQ ID NO: 4599040 - DNA, 19 bp, Homo sapiens
acattttattttattatgc

SEQ ID NO: 4599041 - DNA, 23 bp, Homo sapiens
acatttttcttagggaaggatac

SEQ ID NO: 4599042 - DNA, 14 bp, Homo sapiens
acattttttaaatg

SEQ ID NO: 4599043 - DNA, 21 bp, Homo sapiens
acattttttaaatgcacctgg

SEQ ID NO: 4599044 - DNA, 15 bp, Homo sapiens
accaaaagaacaaga

SEQ ID NO: 4599045 - DNA, 12 bp, Homo sapiens
accaataaaagc

SEQ ID NO: 4599046 - DNA, 15 bp, Homo sapiens
accaataaaagccag

SEQ ID NO: 4599047 - DNA, 22 bp, Homo sapiens
accacagacatactaaccagca

SEQ ID NO: 4599048 - DNA, 11 bp, Homo sapiens
accacctcagg

SEQ ID NO: 4599049 - DNA, 14 bp, Homo sapiens
accacgtttctaaa

SEQ ID NO: 4599050 - DNA, 19 bp, Homo sapiens
accacgtttctaaaggcta

SEQ ID NO: 4599051 - DNA, 16 bp, Homo sapiens
accactacattctgtt

SEQ ID NO: 4599052 - DNA, 12 bp, Homo sapiens
accacttttgtt

SEQ ID NO: 4599053 - DNA, 15 bp, Homo sapiens
accagacacccagga

SEQ ID NO: 4599054 - DNA, 13 bp, Homo sapiens
accagctcaggac

SEQ ID NO: 4599055 - DNA, 17 bp, Homo sapiens
accagggccccggggcc

SEQ ID NO: 4599056 - DNA, 18 bp, Homo sapiens
accagtgttgtggattta

SEQ ID NO: 4599057 - DNA, 20 bp, Homo sapiens
acccaaatgttcatcaatga

SEQ ID NO: 4599058 - DNA, 17 bp, Homo sapiens
acccacaagaaatgaaa

SEQ ID NO: 4599059 - DNA, 14 bp, Homo sapiens
accccagctcccta

SEQ ID NO: 4599060 - DNA, 17 bp, Homo sapiens
accccagctccctagga

SEQ ID NO: 4599061 - DNA, 15 bp, Homo sapiens
acccctgtaggcctc

SEQ ID NO: 4599062 - DNA, 16 bp, Homo sapiens
acccctttctccagcc

SEQ ID NO: 4599063 - DNA, 19 bp, Homo sapiens
acccctttctccagccctg

SEQ ID NO: 4599064 - DNA, 17 bp, Homo sapiens
accctatatgtagtata

SEQ ID NO: 4599065 - DNA, 17 bp, Homo sapiens
accctcatgttcttaat

SEQ ID NO: 4599066 - DNA, 13 bp, Homo sapiens
accctcttcatgg

SEQ ID NO: 4599067 - DNA, 18 bp, Homo sapiens
agaattctctagtttgat

SEQ ID NO: 4599068 - DNA, 13 bp, Homo sapiens
agaatttcttggt

SEQ ID NO: 4599069 - DNA, 13 bp, Homo sapiens
agacaacagaagt

SEQ ID NO: 4599070 - DNA, 20 bp, Homo sapiens
agacaatgacttactgtaca

SEQ ID NO: 4599071 - DNA, 22 bp, Homo sapiens
agacaatgacttactgtacatg

SEQ ID NO: 4599072 - DNA, 15 bp, Homo sapiens
agacaatttattatg

SEQ ID NO: 4599073 - DNA, 12 bp, Homo sapiens
agacacccagga

SEQ ID NO: 4599074 - DNA, 14 bp, Homo sapiens
agacagactagaag

SEQ ID NO: 4599075 - DNA, 20 bp, Homo sapiens
agacatgtctgttctacata

SEQ ID NO: 4599076 - DNA, 15 bp, Homo sapiens
agaccacgtttctaa

SEQ ID NO: 4599077 - DNA, 15 bp, Homo sapiens
agacctgatcctgga

SEQ ID NO: 4599078 - DNA, 18 bp, Homo sapiens
agacctgatcctggaggc

SEQ ID NO: 4599079 - DNA, 16 bp, Homo sapiens
agacctggcagctctg

SEQ ID NO: 4599080 - DNA, 23 bp, Homo sapiens
agacctggcagctctggacagcc

SEQ ID NO: 4599081 - DNA, 17 bp, Homo sapiens
agactcccattcctgaa

SEQ ID NO: 4599082 - DNA, 23 bp, Homo sapiens
agactgagtacgttgtgcatttg

SEQ ID NO: 4599083 - DNA, 14 bp, Homo sapiens
agagaaaaaagcca

SEQ ID NO: 4599084 - DNA, 18 bp, Homo sapiens
agagaaaggggagcccac

SEQ ID NO: 4599085 - DNA, 14 bp, Homo sapiens
agagacagaaagca

SEQ ID NO: 4599086 - DNA, 17 bp, Homo sapiens
agagacatacttgaagg

SEQ ID NO: 4599087 - DNA, 23 bp, Homo sapiens
agagacatacttgaagggccaga

SEQ ID NO: 4599088 - DNA, 18 bp, Homo sapiens
agagagcgagcgctaccc

SEQ ID NO: 4599089 - DNA, 22 bp, Homo sapiens
agagccaggggggtgaggagct

SEQ ID NO: 4599090 - DNA, 23 bp, Homo sapiens
agagccaggggggtgaggagctg

SEQ ID NO: 4599091 - DNA, 12 bp, Homo sapiens
agagcccagctc

SEQ ID NO: 4599092 - DNA, 20 bp, Homo sapiens
agaggagggggcaggctgag

SEQ ID NO: 4599093 - DNA, 15 bp, Homo sapiens
agaggccatggcaga

SEQ ID NO: 4599094 - DNA, 12 bp, Homo sapiens
agaggccccagc

SEQ ID NO: 4599095 - DNA, 14 bp, Homo sapiens
agaggccccagcct

SEQ ID NO: 4599096 - DNA, 16 bp, Homo sapiens
agaggttcaaagatat

SEQ ID NO: 4599097 - DNA, 20 bp, Homo sapiens
agaggttcaaagatattttg

SEQ ID NO: 4599098 - DNA, 18 bp, Homo sapiens
agagtctggtgaagctca

SEQ ID NO: 4599099 - DNA, 17 bp, Homo sapiens
agagttgatactacagt

SEQ ID NO: 4599100 - DNA, 20 bp, Homo sapiens
agagttgatactacagtttg

SEQ ID NO: 4599101 - DNA, 17 bp, Homo sapiens
agagttgttacattttt

SEQ ID NO: 4599102 - DNA, 18 bp, Homo sapiens
agataatacaccactaca

SEQ ID NO: 4599103 - DNA, 22 bp, Homo sapiens
agatacagttactcagaattct

SEQ ID NO: 4599104 - DNA, 16 bp, Homo sapiens
agatactgtatcatga

SEQ ID NO: 4599105 - DNA, 19 bp, Homo sapiens
agatatttttatctttata

SEQ ID NO: 4599106 - DNA, 15 bp, Homo sapiens
agatcacagtggcca

SEQ ID NO: 4599107 - DNA, 11 bp, Homo sapiens
agatcactttc

SEQ ID NO: 4599108 - DNA, 18 bp, Homo sapiens
agatccaaaagaagcccc

SEQ ID NO: 4599109 - DNA, 21 bp, Homo sapiens
agatccaaaagaagcccccag

SEQ ID NO: 4599110 - DNA, 13 bp, Homo sapiens
agatccagcctgg

SEQ ID NO: 4599111 - DNA, 14 bp, Homo sapiens
agatccagcctggg

SEQ ID NO: 4599112 - DNA, 13 bp, Homo sapiens
agatccaggacta

SEQ ID NO: 4599113 - DNA, 21 bp, Homo sapiens
agatcctgtctttaaggaaaa

SEQ ID NO: 4599114 - DNA, 18 bp, Homo sapiens
agatctctaacttcacca

SEQ ID NO: 4599115 - DNA, 13 bp, Homo sapiens
agatctggaacct

SEQ ID NO: 4599116 - DNA, 17 bp, Homo sapiens
agatctgtcctcagcct

SEQ ID NO: 4599117 - DNA, 15 bp, Homo sapiens
agatgaatgtcagtt

SEQ ID NO: 4599118 - DNA, 16 bp, Homo sapiens
agatgctagagcctct

SEQ ID NO: 4599119 - DNA, 15 bp, Homo sapiens
agatgctggcccagg

SEQ ID NO: 4599120 - DNA, 17 bp, Homo sapiens
agatgctggcccagggc

SEQ ID NO: 4599121 - DNA, 18 bp, Homo sapiens
agatgctggcccagggcc

SEQ ID NO: 4599122 - DNA, 22 bp, Homo sapiens
agatgctggcccagggcccaga

SEQ ID NO: 4599123 - DNA, 15 bp, Homo sapiens
agatgtaattttgtg

SEQ ID NO: 4599124 - DNA, 19 bp, Homo sapiens
agatgtagaggagaaactg

SEQ ID NO: 4599125 - DNA, 14 bp, Homo sapiens
agattaagaaatag

SEQ ID NO: 4599126 - DNA, 17 bp, Homo sapiens
agcaaactcttttccca

SEQ ID NO: 4599127 - DNA, 15 bp, Homo sapiens
agcaacaagctattt

SEQ ID NO: 4599128 - DNA, 16 bp, Homo sapiens
agcaacaagctatttt

SEQ ID NO: 4599129 - DNA, 15 bp, Homo sapiens
agcaacaatttatga

SEQ ID NO: 4599130 - DNA, 14 bp, Homo sapiens
agcaaggagattta

SEQ ID NO: 4599131 - DNA, 21 bp, Homo sapiens
agcacccatcatgccacaccg

SEQ ID NO: 4599132 - DNA, 15 bp, Homo sapiens
agcacgatttctgtt

SEQ ID NO: 4599133 - DNA, 16 bp, Homo sapiens
agcacgatttctgttt

SEQ ID NO: 4599134 - DNA, 16 bp, Homo sapiens
agcactaacgtaaata

SEQ ID NO: 4599135 - DNA, 15 bp, Homo sapiens
agcactcaataaagt

SEQ ID NO: 4599136 - DNA, 13 bp, Homo sapiens
agcagcgtttcta

SEQ ID NO: 4599137 - DNA, 16 bp, Homo sapiens
agcatacgtacacatt

SEQ ID NO: 4599138 - DNA, 19 bp, Homo sapiens
agcatcgcttaggagaagt

SEQ ID NO: 4599139 - DNA, 19 bp, Homo sapiens
agcatctcttgaggccagg

SEQ ID NO: 4599140 - DNA, 22 bp, Homo sapiens
agcatctcttgaggccaggagt

SEQ ID NO: 4599141 - DNA, 22 bp, Homo sapiens
agcatgaatggtatggaactct

SEQ ID NO: 4599142 - DNA, 22 bp, Homo sapiens
agccagatgctagagcctctgc

SEQ ID NO: 4599143 - DNA, 12 bp, Homo sapiens
agccagcctggg

SEQ ID NO: 4599144 - DNA, 22 bp, Homo sapiens
agccagtaaatgggggtgcatt

SEQ ID NO: 4599145 - DNA, 19 bp, Homo sapiens
agcccactgtcctgggcct

SEQ ID NO: 4599146 - DNA, 22 bp, Homo sapiens
agcccactgtcctgggcctgca

SEQ ID NO: 4599147 - DNA, 11 bp, Homo sapiens
agcccaggagt

SEQ ID NO: 4599148 - DNA, 15 bp, Homo sapiens
agccccagcactaac

SEQ ID NO: 4599149 - DNA, 20 bp, Homo sapiens
agcccccagctaagaacctg

SEQ ID NO: 4599150 - DNA, 18 bp, Homo sapiens
agccccgtggggttcctc

SEQ ID NO: 4599151 - DNA, 21 bp, Homo sapiens
agccctgactaaactaccacc

SEQ ID NO: 4599152 - DNA, 23 bp, Homo sapiens
agccgggaacagacaacagaagt

SEQ ID NO: 4599153 - DNA, 14 bp, Homo sapiens
agcctccaattttt

SEQ ID NO: 4599154 - DNA, 17 bp, Homo sapiens
agcctccctgaagacca

SEQ ID NO: 4599155 - DNA, 14 bp, Homo sapiens
agcctccctgaagc

SEQ ID NO: 4599156 - DNA, 18 bp, Homo sapiens
agcctctgcctgacagca

SEQ ID NO: 4599157 - DNA, 22 bp, Homo sapiens
agcctgaaagaggaatgaagta

SEQ ID NO: 4599158 - DNA, 18 bp, Homo sapiens
agcctgagcgacagtgag

SEQ ID NO: 4599159 - DNA, 12 bp, Homo sapiens
agcctggccaga

SEQ ID NO: 4599160 - DNA, 13 bp, Homo sapiens
agcctggccagac

SEQ ID NO: 4599161 - DNA, 23 bp, Homo sapiens
agcctggcccccgacccagctct

SEQ ID NO: 4599162 - DNA, 17 bp, Homo sapiens
agcctgggcaacagagc

SEQ ID NO: 4599163 - DNA, 15 bp, Homo sapiens
agccttgaactttga

SEQ ID NO: 4599164 - DNA, 14 bp, Homo sapiens
agccttgccagaga

SEQ ID NO: 4599165 - DNA, 13 bp, Homo sapiens
agcgacagtgaga

SEQ ID NO: 4599166 - DNA, 17 bp, Homo sapiens
agctacttgggaggctg

SEQ ID NO: 4599167 - DNA, 18 bp, Homo sapiens
agctacttgggaggctga

SEQ ID NO: 4599168 - DNA, 17 bp, Homo sapiens
agctatttcatctattt

SEQ ID NO: 4599169 - DNA, 17 bp, Homo sapiens
agctattttggtttagt

SEQ ID NO: 4599170 - DNA, 23 bp, Homo sapiens
agctattttttaaaaaaaactat

SEQ ID NO: 4599171 - DNA, 13 bp, Homo sapiens
agctcaggacaga

SEQ ID NO: 4599172 - DNA, 18 bp, Homo sapiens
agctcaggacagatgcca

SEQ ID NO: 4599173 - DNA, 21 bp, Homo sapiens
agctcagtcccatcagagagc

SEQ ID NO: 4599174 - DNA, 20 bp, Homo sapiens
agctcatccctctcacccag

SEQ ID NO: 4599175 - DNA, 21 bp, Homo sapiens
agctcattctccttgtgttac

SEQ ID NO: 4599176 - DNA, 17 bp, Homo sapiens
agctccctaggagacca

SEQ ID NO: 4599177 - DNA, 16 bp, Homo sapiens
agctcctctccccagc

SEQ ID NO: 4599178 - DNA, 21 bp, Homo sapiens
agctcctctccccagcccaga

SEQ ID NO: 4599179 - DNA, 24 bp, Homo sapiens
agctcctctccccagcccagagac

SEQ ID NO: 4599180 - DNA, 21 bp, Homo sapiens
agctctgaagtcacatcacag

SEQ ID NO: 4599181 - DNA, 12 bp, Homo sapiens
agctgagtctga

SEQ ID NO: 4599182 - DNA, 19 bp, Homo sapiens
agctgagtctgaattctgc

SEQ ID NO: 4599183 - DNA, 15 bp, Homo sapiens
agctggggatccctc

SEQ ID NO: 4599184 - DNA, 22 bp, Homo sapiens
agctggggatccctccccccca

SEQ ID NO: 4599185 - DNA, 12 bp, Homo sapiens
agcttatctcct

SEQ ID NO: 4599186 - DNA, 16 bp, Homo sapiens
agcttatctcctcctc

SEQ ID NO: 4599187 - DNA, 20 bp, Homo sapiens
agcttcgtttattttcaaga

SEQ ID NO: 4599188 - DNA, 21 bp, Homo sapiens
agctttaatgatatgcttgta

SEQ ID NO: 4599189 - DNA, 19 bp, Homo sapiens
aggaaagccccagcactaa

SEQ ID NO: 4599190 - DNA, 20 bp, Homo sapiens
aggaaagccccagcactaac

SEQ ID NO: 4599191 - DNA, 23 bp, Homo sapiens
aggaacttaaataatgtgaaact

SEQ ID NO: 4599192 - DNA, 15 bp, Homo sapiens
aggaatttcccagga

SEQ ID NO: 4599193 - DNA, 19 bp, Homo sapiens
aggaatttcccaggaccct

SEQ ID NO: 4599194 - DNA, 24 bp, Homo sapiens
aggaccagctcaggacagatgcca

SEQ ID NO: 4599195 - DNA, 20 bp, Homo sapiens
aggactatatttgggcctgc

SEQ ID NO: 4599196 - DNA, 19 bp, Homo sapiens
aggacttatttaaactctg

SEQ ID NO: 4599197 - DNA, 21 bp, Homo sapiens
tgtttctttctctgaggacaa

SEQ ID NO: 4599198 - DNA, 19 bp, Homo sapiens
tgttttaaggatgcttgta

SEQ ID NO: 4599199 - DNA, 22 bp, Homo sapiens
tgttttaaggatgcttgtacat

SEQ ID NO: 4599200 - DNA, 14 bp, Homo sapiens
tgttttcaaatgtt

SEQ ID NO: 4599201 - DNA, 19 bp, Homo sapiens
tgttttgtctcctaaattg

SEQ ID NO: 4599202 - DNA, 22 bp, Homo sapiens
ttaaaaaaaaacctgagcccca

SEQ ID NO: 4599203 - DNA, 14 bp, Homo sapiens
ttaaaaatctcaaa

SEQ ID NO: 4599204 - DNA, 21 bp, Homo sapiens
ttaaaacagacactggcatgg

SEQ ID NO: 4599205 - DNA, 15 bp, Homo sapiens
ttaaaacattaaaat

SEQ ID NO: 4599206 - DNA, 21 bp, Homo sapiens
ttaaaataccagccagtaaat

SEQ ID NO: 4599207 - DNA, 22 bp, Homo sapiens
ttaaactctgttgcaagtgcaa

SEQ ID NO: 4599208 - DNA, 16 bp, Homo sapiens
ttaaacttaatctaaa

SEQ ID NO: 4599209 - DNA, 13 bp, Homo sapiens
ttaaataatgtga

SEQ ID NO: 4599210 - DNA, 15 bp, Homo sapiens
ttaaataatgtgaaa

SEQ ID NO: 4599211 - DNA, 18 bp, Homo sapiens
ttaaataatgtgaaactg

SEQ ID NO: 4599212 - DNA, 20 bp, Homo sapiens
ttaaataatgtgaaactgga

SEQ ID NO: 4599213 - DNA, 13 bp, Homo sapiens
ttaaatgtaaaga

SEQ ID NO: 4599214 - DNA, 17 bp, Homo sapiens
ttaaatgtaaagatatt

SEQ ID NO: 4599215 - DNA, 20 bp, Homo sapiens
ttaaattcttgcaaagtatc

SEQ ID NO: 4599216 - DNA, 18 bp, Homo sapiens
ttaacattcttttgttta

SEQ ID NO: 4599217 - DNA, 20 bp, Homo sapiens
ttaacctatgatattttctg

SEQ ID NO: 4599218 - DNA, 16 bp, Homo sapiens
ttaacttttataaact

SEQ ID NO: 4599219 - DNA, 18 bp, Homo sapiens
ttaacttttataaacttt

SEQ ID NO: 4599220 - DNA, 23 bp, Homo sapiens
ttaacttttataaactttacctt

SEQ ID NO: 4599221 - DNA, 22 bp, Homo sapiens
ttaagaaatagacagcatgaga

SEQ ID NO: 4599222 - DNA, 20 bp, Homo sapiens
ttaagaactaaaatgttcta

SEQ ID NO: 4599223 - DNA, 11 bp, Homo sapiens
ttaagcatcac

SEQ ID NO: 4599224 - DNA, 15 bp, Homo sapiens
ttaagcatcacatta

SEQ ID NO: 4599225 - DNA, 18 bp, Homo sapiens
ttaaggatgcttgtacat

SEQ ID NO: 4599226 - DNA, 18 bp, Homo sapiens
ttaagggaagaattccag

SEQ ID NO: 4599227 - DNA, 17 bp, Homo sapiens
ttaagtgaaaatatagc

SEQ ID NO: 4599228 - DNA, 14 bp, Homo sapiens
ttaagtgctgcatt

SEQ ID NO: 4599229 - DNA, 19 bp, Homo sapiens
ttaagtgctgcatttaaaa

SEQ ID NO: 4599230 - DNA, 20 bp, Homo sapiens
ttaagttagttccactgaga

SEQ ID NO: 4599231 - DNA, 19 bp, Homo sapiens
ttaatggtagttttacagt

SEQ ID NO: 4599232 - DNA, 15 bp, Homo sapiens
ttaattcttagctca

SEQ ID NO: 4599233 - DNA, 23 bp, Homo sapiens
ttacatttttaagtgctgcattt

SEQ ID NO: 4599234 - DNA, 13 bp, Homo sapiens
ttaccaacctgtt

SEQ ID NO: 4599235 - DNA, 20 bp, Homo sapiens
ttaccaacctgttacctact

SEQ ID NO: 4599236 - DNA, 14 bp, Homo sapiens
ttaccacagacata

SEQ ID NO: 4599237 - DNA, 15 bp, Homo sapiens
ttacctttttatttg

SEQ ID NO: 4599238 - DNA, 20 bp, Homo sapiens
ttacctttttatttgcatgt

SEQ ID NO: 4599239 - DNA, 22 bp, Homo sapiens
ttaccttttttatacataaaca

SEQ ID NO: 4599240 - DNA, 15 bp, Homo sapiens
ttactggtccaaaag

SEQ ID NO: 4599241 - DNA, 15 bp, Homo sapiens
ttagataaatattga

SEQ ID NO: 4599242 - DNA, 22 bp, Homo sapiens
ttagataatacaccactacatt

SEQ ID NO: 4599243 - DNA, 13 bp, Homo sapiens
ttaggagaagcca

SEQ ID NO: 4599244 - DNA, 17 bp, Homo sapiens
ttaggagaagccaggaa

SEQ ID NO: 4599245 - DNA, 17 bp, Homo sapiens
ttagtccctcatgcaaa

SEQ ID NO: 4599246 - DNA, 14 bp, Homo sapiens
ttagtttctttggg

SEQ ID NO: 4599247 - DNA, 11 bp, Homo sapiens
ttatacataaa

SEQ ID NO: 4599248 - DNA, 21 bp, Homo sapiens
ttatcacccagaagaaaatag

SEQ ID NO: 4599249 - DNA, 14 bp, Homo sapiens
ttatctagatactg

SEQ ID NO: 4599250 - DNA, 16 bp, Homo sapiens
ttatgcatgaagtaat

SEQ ID NO: 4599251 - DNA, 15 bp, Homo sapiens
ttatgtctcttctga

SEQ ID NO: 4599252 - DNA, 23 bp, Homo sapiens
ttattaaaaatctcaaatttcta

SEQ ID NO: 4599253 - DNA, 15 bp, Homo sapiens
ttattgatgttttca

SEQ ID NO: 4599254 - DNA, 20 bp, Homo sapiens
ttattttacagctcattaaa

SEQ ID NO: 4599255 - DNA, 18 bp, Homo sapiens
ttattttattatgcatga

SEQ ID NO: 4599256 - DNA, 13 bp, Homo sapiens
ttattttcaagaa

SEQ ID NO: 4599257 - DNA, 13 bp, Homo sapiens
ttattttgatgta

SEQ ID NO: 4599258 - DNA, 20 bp, Homo sapiens
ttcaaaagtttgtttgctta

SEQ ID NO: 4599259 - DNA, 13 bp, Homo sapiens
ttcaaagatattt

SEQ ID NO: 4599260 - DNA, 18 bp, Homo sapiens
ttcaaatagggtctaact

SEQ ID NO: 4599261 - DNA, 23 bp, Homo sapiens
ttcaagttccaagttgctaatac

SEQ ID NO: 4599262 - DNA, 22 bp, Homo sapiens
ttcaagttgtaaataatttatt

SEQ ID NO: 4599263 - DNA, 20 bp, Homo sapiens
ttcaatctggattcatattt

SEQ ID NO: 4599264 - DNA, 20 bp, Homo sapiens
ttcaatctgtaaactgtgta

SEQ ID NO: 4599265 - DNA, 13 bp, Homo sapiens
ttcagaaatgtgt

SEQ ID NO: 4599266 - DNA, 16 bp, Homo sapiens
ttcagacatagaatta

SEQ ID NO: 4599267 - DNA, 20 bp, Homo sapiens
ttcagactcccattcctgaa

SEQ ID NO: 4599268 - DNA, 22 bp, Homo sapiens
ttcagcttcgtttattttcaag

SEQ ID NO: 4599269 - DNA, 17 bp, Homo sapiens
ttcaggagtcccaagga

SEQ ID NO: 4599270 - DNA, 20 bp, Homo sapiens
ttcataagtattatgtctct

SEQ ID NO: 4599271 - DNA, 11 bp, Homo sapiens
ttcatagagaa

SEQ ID NO: 4599272 - DNA, 19 bp, Homo sapiens
ttcatattgcatcatagtt

SEQ ID NO: 4599273 - DNA, 20 bp, Homo sapiens
ttcatatttaatttgaaggt

SEQ ID NO: 4599274 - DNA, 17 bp, Homo sapiens
ttcatattttaaacaga

SEQ ID NO: 4599275 - DNA, 15 bp, Homo sapiens
ttcatcaatgaatga

SEQ ID NO: 4599276 - DNA, 23 bp, Homo sapiens
ttcatctatttttggcagtctga

SEQ ID NO: 4599277 - DNA, 13 bp, Homo sapiens
ttcattaaagcat

SEQ ID NO: 4599278 - DNA, 13 bp, Homo sapiens
ttccaaagtacac

SEQ ID NO: 4599279 - DNA, 16 bp, Homo sapiens
ttccacacttctgggc

SEQ ID NO: 4599280 - DNA, 13 bp, Homo sapiens
ttccactgagacc

SEQ ID NO: 4599281 - DNA, 18 bp, Homo sapiens
ttccatcatcactttgga

SEQ ID NO: 4599282 - DNA, 18 bp, Homo sapiens
ttccatgcgtgtttctga

SEQ ID NO: 4599283 - DNA, 16 bp, Homo sapiens
ttccatggcctcttca

SEQ ID NO: 4599284 - DNA, 13 bp, Homo sapiens
ttcccaggaccct

SEQ ID NO: 4599285 - DNA, 21 bp, Homo sapiens
ttccctcaccttggcaccaga

SEQ ID NO: 4599286 - DNA, 14 bp, Homo sapiens
ttccgttaaaatac

SEQ ID NO: 4599287 - DNA, 16 bp, Homo sapiens
ttcctgaagaaccagt

SEQ ID NO: 4599288 - DNA, 13 bp, Homo sapiens
ttcctgaatccaa

SEQ ID NO: 4599289 - DNA, 22 bp, Homo sapiens
ttcctgacactttaattaccaa

SEQ ID NO: 4599290 - DNA, 17 bp, Homo sapiens
ttcctgtccagctccaa

SEQ ID NO: 4599291 - DNA, 23 bp, Homo sapiens
ttcctgtttttcacattttcctt

SEQ ID NO: 4599292 - DNA, 12 bp, Homo sapiens
ttcctttctcag

SEQ ID NO: 4599293 - DNA, 13 bp, Homo sapiens
ttctaaaaaacag

SEQ ID NO: 4599294 - DNA, 19 bp, Homo sapiens
ttctaaaggctacctttgt

SEQ ID NO: 4599295 - DNA, 21 bp, Homo sapiens
ttctaaaggctacctttgtat

SEQ ID NO: 4599296 - DNA, 13 bp, Homo sapiens
ttctaagaagtga

SEQ ID NO: 4599297 - DNA, 15 bp, Homo sapiens
ttctacatagatgct

SEQ ID NO: 4599298 - DNA, 14 bp, Homo sapiens
ttctagctctgact

SEQ ID NO: 4599299 - DNA, 14 bp, Homo sapiens
ttctcagttttcat

SEQ ID NO: 4599300 - DNA, 19 bp, Homo sapiens
ttctccagtcattatgtta

SEQ ID NO: 4599301 - DNA, 21 bp, Homo sapiens
ttctcccgttcacgttgccta

SEQ ID NO: 4599302 - DNA, 18 bp, Homo sapiens
ttctctcctgtacctctt

SEQ ID NO: 4599303 - DNA, 16 bp, Homo sapiens
ttctgaactcaaactg

SEQ ID NO: 4599304 - DNA, 18 bp, Homo sapiens
ttctgaactcaaactgag

SEQ ID NO: 4599305 - DNA, 13 bp, Homo sapiens
ttctgactgctga

SEQ ID NO: 4599306 - DNA, 16 bp, Homo sapiens
ttctgagctatttcat

SEQ ID NO: 4599307 - DNA, 12 bp, Homo sapiens
ttctgcctgcca

SEQ ID NO: 4599308 - DNA, 18 bp, Homo sapiens
ttctgcctgccagctgca

SEQ ID NO: 4599309 - DNA, 14 bp, Homo sapiens
ttctgccttctcat

SEQ ID NO: 4599310 - DNA, 16 bp, Homo sapiens
ttctgccttctcatga

SEQ ID NO: 4599311 - DNA, 22 bp, Homo sapiens
ttctgcctttggggacttttct

SEQ ID NO: 4599312 - DNA, 20 bp, Homo sapiens
ttctggctatgcatttgaaa

SEQ ID NO: 4599313 - DNA, 16 bp, Homo sapiens
ttctgggcttcatctg

SEQ ID NO: 4599314 - DNA, 13 bp, Homo sapiens
ttctgtgcctgaa

SEQ ID NO: 4599315 - DNA, 13 bp, Homo sapiens
ttctgtgtttagc

SEQ ID NO: 4599316 - DNA, 17 bp, Homo sapiens
ttctgtgtttagctatt

SEQ ID NO: 4599317 - DNA, 21 bp, Homo sapiens
ttctgtgtttagctatttaat

SEQ ID NO: 4599318 - DNA, 18 bp, Homo sapiens
ttctgttctttctggcta

SEQ ID NO: 4599319 - DNA, 18 bp, Homo sapiens
ttctgtttagataataca

SEQ ID NO: 4599320 - DNA, 13 bp, Homo sapiens
ttcttaattctta

SEQ ID NO: 4599321 - DNA, 13 bp, Homo sapiens
ttcttgcaaagta

SEQ ID NO: 4599322 - DNA, 22 bp, Homo sapiens
ttcttgcaagcaacaagctatt

SEQ ID NO: 4599323 - DNA, 17 bp, Homo sapiens
ttcttggtttgtaaatt

SEQ ID NO: 4599324 - DNA, 18 bp, Homo sapiens
ttcttggtttgtaaatta

SEQ ID NO: 4599325 - DNA, 14 bp, Homo sapiens
ttgaaactttaaga

SEQ ID NO: 4599326 - DNA, 15 bp, Homo sapiens
ttgaactttgacctc

SEQ ID NO: 4599327 - DNA, 22 bp, Homo sapiens
ttgaactttgacctctgcagca

SEQ ID NO: 4599328 - DNA, 15 bp, Homo sapiens
ttgaaggtagaatgt

SEQ ID NO: 4599329 - DNA, 19 bp, Homo sapiens
ttgaaggtagaatgttttc

SEQ ID NO: 4599330 - DNA, 23 bp, Homo sapiens
ttgaaggtgctgacggccaggga

SEQ ID NO: 4599331 - DNA, 15 bp, Homo sapiens
ttgagccttgaactt

SEQ ID NO: 4599332 - DNA, 19 bp, Homo sapiens
ttgagccttgaactttgac

SEQ ID NO: 4599333 - DNA, 17 bp, Homo sapiens
ttgatactacagtttgt

SEQ ID NO: 4599334 - DNA, 14 bp, Homo sapiens
ttgatctggaaccc

SEQ ID NO: 4599335 - DNA, 16 bp, Homo sapiens
ttgatctggaacccag

SEQ ID NO: 4599336 - DNA, 20 bp, Homo sapiens
ttgattaaattcttgcaaag

SEQ ID NO: 4599337 - DNA, 20 bp, Homo sapiens
ttgatttttgcctcttccag

SEQ ID NO: 4599338 - DNA, 20 bp, Homo sapiens
ttgcaagcaacaagctattt

SEQ ID NO: 4599339 - DNA, 17 bp, Homo sapiens
ttgcagcacagctgaga

SEQ ID NO: 4599340 - DNA, 15 bp, Homo sapiens
ttgcatgtggatcaa

SEQ ID NO: 4599341 - DNA, 15 bp, Homo sapiens
ttgcatttaaaacag

SEQ ID NO: 4599342 - DNA, 21 bp, Homo sapiens
ttgcatttaaaacagacactg

SEQ ID NO: 4599343 - DNA, 14 bp, Homo sapiens
ttgccacattaaat

SEQ ID NO: 4599344 - DNA, 14 bp, Homo sapiens
ttgccgttattaaa

SEQ ID NO: 4599345 - DNA, 19 bp, Homo sapiens
ttgcctaataaacatcctt

SEQ ID NO: 4599346 - DNA, 15 bp, Homo sapiens
ttgctgcaaacctga

SEQ ID NO: 4599347 - DNA, 15 bp, Homo sapiens
ttgctggatgctgct

SEQ ID NO: 4599348 - DNA, 17 bp, Homo sapiens
ttgcttgagcccaggag

SEQ ID NO: 4599349 - DNA, 15 bp, Homo sapiens
ttgctttgtgatttt

SEQ ID NO: 4599350 - DNA, 17 bp, Homo sapiens
ttggaagctctgaagtc

SEQ ID NO: 4599351 - DNA, 20 bp, Homo sapiens
ttggaagtgaaaactttgta

SEQ ID NO: 4599352 - DNA, 17 bp, Homo sapiens
ttggacattttatgtct

SEQ ID NO: 4599353 - DNA, 18 bp, Homo sapiens
ttggacattttatgtctt

SEQ ID NO: 4599354 - DNA, 14 bp, Homo sapiens
ttggaccctgggag

SEQ ID NO: 4599355 - DNA, 17 bp, Homo sapiens
ttggacctaatccaagc

SEQ ID NO: 4599356 - DNA, 16 bp, Homo sapiens
ttggagagtttcctga

SEQ ID NO: 4599357 - DNA, 18 bp, Homo sapiens
ttggagagtttcctgaaa

SEQ ID NO: 4599358 - DNA, 17 bp, Homo sapiens
ttggagggaaagccagc

SEQ ID NO: 4599359 - DNA, 20 bp, Homo sapiens
ttggagggaaagccagcctg

SEQ ID NO: 4599360 - DNA, 21 bp, Homo sapiens
ttggagggaaagccagcctgg

SEQ ID NO: 4599361 - DNA, 22 bp, Homo sapiens
ttgggtgcggtttgctcagccc

SEQ ID NO: 4599362 - DNA, 19 bp, Homo sapiens
ttggtggtttcagaaatgt

SEQ ID NO: 4599363 - DNA, 17 bp, Homo sapiens
ttgtaaaagcattttgt

SEQ ID NO: 4599364 - DNA, 20 bp, Homo sapiens
ttgtaaaagcattttgtaat

SEQ ID NO: 4599365 - DNA, 18 bp, Homo sapiens
ttgtaaattaacttttat

SEQ ID NO: 4599366 - DNA, 23 bp, Homo sapiens
ttgtaaattaacttttataaact

SEQ ID NO: 4599367 - DNA, 22 bp, Homo sapiens
ttgtaactgtttagatgaatgt

SEQ ID NO: 4599368 - DNA, 15 bp, Homo sapiens
ttgtaataataaaga

SEQ ID NO: 4599369 - DNA, 18 bp, Homo sapiens
ttgtacataatgcgtgca

SEQ ID NO: 4599370 - DNA, 15 bp, Homo sapiens
ttgtattctctcctg

SEQ ID NO: 4599371 - DNA, 21 bp, Homo sapiens
ttgtattctctcctgtacctc

SEQ ID NO: 4599372 - DNA, 14 bp, Homo sapiens
ttgtcactttttat

SEQ ID NO: 4599373 - DNA, 22 bp, Homo sapiens
ttgtctcctaaattgttgtaat

SEQ ID NO: 4599374 - DNA, 18 bp, Homo sapiens
ttgtgatacaatgctgtg

SEQ ID NO: 4599375 - DNA, 16 bp, Homo sapiens
ttgtgatttttgtaat

SEQ ID NO: 4599376 - DNA, 17 bp, Homo sapiens
ttgtgatttttgtaatt

SEQ ID NO: 4599377 - DNA, 12 bp, Homo sapiens
ttgtgcatttgg

SEQ ID NO: 4599378 - DNA, 21 bp, Homo sapiens
ttgtggatttaacagaaatgt

SEQ ID NO: 4599379 - DNA, 22 bp, Homo sapiens
ttgtggatttaacagaaatgta

SEQ ID NO: 4599380 - DNA, 14 bp, Homo sapiens
ttgtgtaagaaata

SEQ ID NO: 4599381 - DNA, 13 bp, Homo sapiens
ttgtgttactaag

SEQ ID NO: 4599382 - DNA, 19 bp, Homo sapiens
ttgttagtatgaggcattt

SEQ ID NO: 4599383 - DNA, 18 bp, Homo sapiens
ttgttatgtagataacaa

SEQ ID NO: 4599384 - DNA, 20 bp, Homo sapiens
ttgttatttattgaaatgat

SEQ ID NO: 4599385 - DNA, 17 bp, Homo sapiens
ttgttcttggtttgtaa

SEQ ID NO: 4599386 - DNA, 15 bp, Homo sapiens
tttaaaacagacact

SEQ ID NO: 4599387 - DNA, 14 bp, Homo sapiens
tttaaaacccattt

SEQ ID NO: 4599388 - DNA, 21 bp, Homo sapiens
tttaaactgtgtacataactg

SEQ ID NO: 4599389 - DNA, 18 bp, Homo sapiens
tttaaatgtaaagatatt

SEQ ID NO: 4599390 - DNA, 14 bp, Homo sapiens
tttaacagaaatgt

SEQ ID NO: 4599391 - DNA, 18 bp, Homo sapiens
tttaacagaaatgtacag

SEQ ID NO: 4599392 - DNA, 23 bp, Homo sapiens
tttaagaaaggcaaccaataaaa

SEQ ID NO: 4599393 - DNA, 21 bp, Homo sapiens
tttaagcatcacattaaagtt

SEQ ID NO: 4599394 - DNA, 20 bp, Homo sapiens
tttaaggatgcttgtacata

SEQ ID NO: 4599395 - DNA, 16 bp, Homo sapiens
tttaagtgctgcattt

SEQ ID NO: 4599396 - DNA, 22 bp, Homo sapiens
tttaatttgaaggtagaatgtt

SEQ ID NO: 4599397 - DNA, 13 bp, Homo sapiens
tttacagagacag

SEQ ID NO: 4599398 - DNA, 21 bp, Homo sapiens
tttacagctcattaaactttt

SEQ ID NO: 4599399 - DNA, 21 bp, Homo sapiens
tttacctgtgcgttactaatt

SEQ ID NO: 4599400 - DNA, 14 bp, Homo sapiens
tttaccttttttat

SEQ ID NO: 4599401 - DNA, 14 bp, Homo sapiens
tttactaatagaca

SEQ ID NO: 4599402 - DNA, 17 bp, Homo sapiens
tttactaatagacaatt

SEQ ID NO: 4599403 - DNA, 17 bp, Homo sapiens
tttagatgaatgtcagt

SEQ ID NO: 4599404 - DNA, 18 bp, Homo sapiens
tttagatgaatgtcagtt

SEQ ID NO: 4599405 - DNA, 22 bp, Homo sapiens
tttagatgaatgtcagttgtta

SEQ ID NO: 4599406 - DNA, 16 bp, Homo sapiens
tttataaactttacct

SEQ ID NO: 4599407 - DNA, 20 bp, Homo sapiens
tttatacataaacaagacca

SEQ ID NO: 4599408 - DNA, 20 bp, Homo sapiens
tttatatgcttactgatata

SEQ ID NO: 4599409 - DNA, 22 bp, Homo sapiens
tttatcatgcatgtcctgtaaa

SEQ ID NO: 4599410 - DNA, 18 bp, Homo sapiens
tttatctttatatgaaga

SEQ ID NO: 4599411 - DNA, 18 bp, Homo sapiens
tttatgcaaggaaggaaa

SEQ ID NO: 4599412 - DNA, 14 bp, Homo sapiens
tttatggcttttgt

SEQ ID NO: 4599413 - DNA, 13 bp, Homo sapiens
tttattatggcac

SEQ ID NO: 4599414 - DNA, 16 bp, Homo sapiens
tttattggctgagata

SEQ ID NO: 4599415 - DNA, 16 bp, Homo sapiens
tttatttatttattca

SEQ ID NO: 4599416 - DNA, 15 bp, Homo sapiens
tttcaaactttacta

SEQ ID NO: 4599417 - DNA, 20 bp, Homo sapiens
tttcaaatagggtctaactc

SEQ ID NO: 4599418 - DNA, 14 bp, Homo sapiens
tttcaaatgttctc

SEQ ID NO: 4599419 - DNA, 22 bp, Homo sapiens
tttcacagtgtgtggtcaacat

SEQ ID NO: 4599420 - DNA, 14 bp, Homo sapiens
tttcacattttcct

SEQ ID NO: 4599421 - DNA, 14 bp, Homo sapiens
tttcacctgtaaac

SEQ ID NO: 4599422 - DNA, 18 bp, Homo sapiens
tttcacctgtaaacctga

SEQ ID NO: 4599423 - DNA, 13 bp, Homo sapiens
tttcagaaatgtg

SEQ ID NO: 4599424 - DNA, 17 bp, Homo sapiens
tttcatattttaaacag

SEQ ID NO: 4599425 - DNA, 15 bp, Homo sapiens
tttccaaagtacact

SEQ ID NO: 4599426 - DNA, 22 bp, Homo sapiens
tttcctcaaaacttcagacata

SEQ ID NO: 4599427 - DNA, 19 bp, Homo sapiens
tttcctggtgccaatttca

SEQ ID NO: 4599428 - DNA, 22 bp, Homo sapiens
tttcctggtgccaatttcaagt

SEQ ID NO: 4599429 - DNA, 14 bp, Homo sapiens
tttctaaaaaacag

SEQ ID NO: 4599430 - DNA, 14 bp, Homo sapiens
tttctaaaggctac

SEQ ID NO: 4599431 - DNA, 18 bp, Homo sapiens
tttctaaaggctaccttt

SEQ ID NO: 4599432 - DNA, 15 bp, Homo sapiens
tttctcatgttgaaa

SEQ ID NO: 4599433 - DNA, 13 bp, Homo sapiens
tttctccagccct

SEQ ID NO: 4599434 - DNA, 17 bp, Homo sapiens
tttctggaatggaattg

SEQ ID NO: 4599435 - DNA, 18 bp, Homo sapiens
tttctggctatgcatttg

SEQ ID NO: 4599436 - DNA, 23 bp, Homo sapiens
tttcttagggaaggatacaaaag

SEQ ID NO: 4599437 - DNA, 19 bp, Homo sapiens
tttgaactgataaagatga

SEQ ID NO: 4599438 - DNA, 14 bp, Homo sapiens
tttgacaaggggca

SEQ ID NO: 4599439 - DNA, 18 bp, Homo sapiens
tttgacctctgcagcaat

SEQ ID NO: 4599440 - DNA, 21 bp, Homo sapiens
tttgacctctgcagcaataaa

SEQ ID NO: 4599441 - DNA, 18 bp, Homo sapiens
tttgattaaattcttgca

SEQ ID NO: 4599442 - DNA, 23 bp, Homo sapiens
tttgattaaattcttgcaaagta

SEQ ID NO: 4599443 - DNA, 15 bp, Homo sapiens
tttgccgttattaaa

SEQ ID NO: 4599444 - DNA, 17 bp, Homo sapiens
tttgcctcttccagtct

SEQ ID NO: 4599445 - DNA, 15 bp, Homo sapiens
tttgctggaataagt

SEQ ID NO: 4599446 - DNA, 15 bp, Homo sapiens
tttgctttgtgattt

SEQ ID NO: 4599447 - DNA, 14 bp, Homo sapiens
tttggactctgcct

SEQ ID NO: 4599448 - DNA, 16 bp, Homo sapiens
tttgggttctgcctgc

SEQ ID NO: 4599449 - DNA, 19 bp, Homo sapiens
tttggtggtttcagaaatg

SEQ ID NO: 4599450 - DNA, 16 bp, Homo sapiens
tttgtaaattaacttt

SEQ ID NO: 4599451 - DNA, 15 bp, Homo sapiens
tttgtattctctcct

SEQ ID NO: 4599452 - DNA, 20 bp, Homo sapiens
tttgtgattcaatctgtaaa

SEQ ID NO: 4599453 - DNA, 22 bp, Homo sapiens
tttgttagtatgaggcatttgt

SEQ ID NO: 4599454 - DNA, 13 bp, Homo sapiens
tttgtttgaactg

SEQ ID NO: 4599455 - DNA, 15 bp, Homo sapiens
ttttaagtgctgcat

SEQ ID NO: 4599456 - DNA, 21 bp, Homo sapiens
ttttaagtgctgcatttaaaa

SEQ ID NO: 4599457 - DNA, 12 bp, Homo sapiens
ttttataaactt

SEQ ID NO: 4599458 - DNA, 13 bp, Homo sapiens
ttttataaacttt

SEQ ID NO: 4599459 - DNA, 19 bp, Homo sapiens
ttttataaactttaccttt

SEQ ID NO: 4599460 - DNA, 13 bp, Homo sapiens
ttttatacataaa

SEQ ID NO: 4599461 - DNA, 20 bp, Homo sapiens
ttttatatcaatttaaaaaa

SEQ ID NO: 4599462 - DNA, 16 bp, Homo sapiens
ttttatcatgcatgtc

SEQ ID NO: 4599463 - DNA, 19 bp, Homo sapiens
ttttatggcttttgtgcat

SEQ ID NO: 4599464 - DNA, 21 bp, Homo sapiens
ttttatggcttttgtgcatta

SEQ ID NO: 4599465 - DNA, 15 bp, Homo sapiens
ttttcaaatgttctc

SEQ ID NO: 4599466 - DNA, 13 bp, Homo sapiens
ttttcaagttgta

SEQ ID NO: 4599467 - DNA, 12 bp, Homo sapiens
ttttcacatttt

SEQ ID NO: 4599468 - DNA, 18 bp, Homo sapiens
ttttctggaatggaattg

SEQ ID NO: 4599469 - DNA, 23 bp, Homo sapiens
ttttctgtgtttagctatttaat

SEQ ID NO: 4599470 - DNA, 21 bp, Homo sapiens
ttttgaagattctatgttaat

SEQ ID NO: 4599471 - DNA, 20 bp, Homo sapiens
ttttgacaaggggcagtggt

SEQ ID NO: 4599472 - DNA, 16 bp, Homo sapiens
ttttgatgtaaagatg

SEQ ID NO: 4599473 - DNA, 17 bp, Homo sapiens
ttttgtgcattatctag

SEQ ID NO: 4599474 - DNA, 13 bp, Homo sapiens
tttttaagtgaaa

SEQ ID NO: 4599475 - DNA, 17 bp, Homo sapiens
tttttaagtgctgcatt

SEQ ID NO: 4599476 - DNA, 22 bp, Homo sapiens
tttttaagtgctgcatttaaaa

SEQ ID NO: 4599477 - DNA, 17 bp, Homo sapiens
tttttatcatgcatgtc

SEQ ID NO: 4599478 - DNA, 14 bp, Homo sapiens
tttttatctttata

SEQ ID NO: 4599479 - DNA, 17 bp, Homo sapiens
tttttcaagttgtaaat

SEQ ID NO: 4599480 - DNA, 21 bp, Homo sapiens
tttttcaagttgtaaataatt

SEQ ID NO: 4599481 - DNA, 13 bp, Homo sapiens
tttttcacatttt

SEQ ID NO: 4599482 - DNA, 12 bp, Homo sapiens
ttttttttaaga

SEQ ID NO: 4599483 - DNA, 17 bp, Homo sapiens
tcccccccatgcactgt

SEQ ID NO: 4599484 - DNA, 22 bp, Homo sapiens
tcccctaaagcctcaaaacaaa

SEQ ID NO: 4599485 - DNA, 14 bp, Homo sapiens
tcccgactgaccac

SEQ ID NO: 4599486 - DNA, 15 bp, Homo sapiens
tccctcaccttggca

SEQ ID NO: 4599487 - DNA, 21 bp, Homo sapiens
tccctcaccttggcaccagac

SEQ ID NO: 4599488 - DNA, 14 bp, Homo sapiens
tccctcccccccat

SEQ ID NO: 4599489 - DNA, 14 bp, Homo sapiens
tccctctcacccag

SEQ ID NO: 4599490 - DNA, 17 bp, Homo sapiens
tccctgcctctcatcaa

SEQ ID NO: 4599491 - DNA, 18 bp, Homo sapiens
tccctgttccccagagaa

SEQ ID NO: 4599492 - DNA, 16 bp, Homo sapiens
tcccttggacatttta

SEQ ID NO: 4599493 - DNA, 19 bp, Homo sapiens
tcccttggacattttatgt

SEQ ID NO: 4599494 - DNA, 14 bp, Homo sapiens
tccgcactgggcac

SEQ ID NO: 4599495 - DNA, 13 bp, Homo sapiens
tccgttaaaatac

SEQ ID NO: 4599496 - DNA, 15 bp, Homo sapiens
tccgttaaaatacca

SEQ ID NO: 4599497 - DNA, 20 bp, Homo sapiens
tcctcaaaacttcagacata

SEQ ID NO: 4599498 - DNA, 21 bp, Homo sapiens
tcctcccaatttcagactccc

SEQ ID NO: 4599499 - DNA, 17 bp, Homo sapiens
tcctctccccagcccag

SEQ ID NO: 4599500 - DNA, 19 bp, Homo sapiens
tcctctccccagcccagag

SEQ ID NO: 4599501 - DNA, 20 bp, Homo sapiens
tcctctccccagcccagaga

SEQ ID NO: 4599502 - DNA, 13 bp, Homo sapiens
tcctgaagaacca

SEQ ID NO: 4599503 - DNA, 20 bp, Homo sapiens
tcctgcctaagtgcagcccc

SEQ ID NO: 4599504 - DNA, 16 bp, Homo sapiens
tcctgctcatattgtg

SEQ ID NO: 4599505 - DNA, 18 bp, Homo sapiens
tcctggaggcccagttca

SEQ ID NO: 4599506 - DNA, 16 bp, Homo sapiens
tcctgggcctgcagaa

SEQ ID NO: 4599507 - DNA, 13 bp, Homo sapiens
tcctgtccagctc

SEQ ID NO: 4599508 - DNA, 15 bp, Homo sapiens
tcctgtccagctcca

SEQ ID NO: 4599509 - DNA, 16 bp, Homo sapiens
tcctgtccagctccaa

SEQ ID NO: 4599510 - DNA, 17 bp, Homo sapiens
tcctgttgtcaagaata

SEQ ID NO: 4599511 - DNA, 21 bp, Homo sapiens
tccttacaagttagaaaacat

SEQ ID NO: 4599512 - DNA, 20 bp, Homo sapiens
tccttacctttttatttgca

SEQ ID NO: 4599513 - DNA, 19 bp, Homo sapiens
tccttcaagaactctgggc

SEQ ID NO: 4599514 - DNA, 23 bp, Homo sapiens
tccttcaagaactctgggctgct

SEQ ID NO: 4599515 - DNA, 23 bp, Homo sapiens
tcctttctcagccgcttctgact

SEQ ID NO: 4599516 - DNA, 23 bp, Homo sapiens
tcgagtgagacagactagaagtt

SEQ ID NO: 4599517 - DNA, 17 bp, Homo sapiens
tcgccgttgaagaggaa

SEQ ID NO: 4599518 - DNA, 23 bp, Homo sapiens
tcgctagcatttcccaacacaaa

SEQ ID NO: 4599519 - DNA, 16 bp, Homo sapiens
tcgtacagaaagctgc

SEQ ID NO: 4599520 - DNA, 13 bp, Homo sapiens
tcgtgggaaaggg

SEQ ID NO: 4599521 - DNA, 15 bp, Homo sapiens
tcgtgggaaagggga

SEQ ID NO: 4599522 - DNA, 18 bp, Homo sapiens
tctaaaaaacagaggcca

SEQ ID NO: 4599523 - DNA, 14 bp, Homo sapiens
tctaaaaacaccaa

SEQ ID NO: 4599524 - DNA, 20 bp, Homo sapiens
tctaaaggctacctttgtat

SEQ ID NO: 4599525 - DNA, 14 bp, Homo sapiens
tctaaataaagacg

SEQ ID NO: 4599526 - DNA, 21 bp, Homo sapiens
tctaaatctccaaaataaaac

SEQ ID NO: 4599527 - DNA, 22 bp, Homo sapiens
tctaaatctccaaaataaaact

SEQ ID NO: 4599528 - DNA, 15 bp, Homo sapiens
tctaacttcaccata

SEQ ID NO: 4599529 - DNA, 16 bp, Homo sapiens
tctaacttcaccatat

SEQ ID NO: 4599530 - DNA, 22 bp, Homo sapiens
tctaacttcaccatattaccac

SEQ ID NO: 4599531 - DNA, 17 bp, Homo sapiens
tctacactccagtgaga

SEQ ID NO: 4599532 - DNA, 15 bp, Homo sapiens
tctactaaaaataca

SEQ ID NO: 4599533 - DNA, 13 bp, Homo sapiens
tctagaggagggg

SEQ ID NO: 4599534 - DNA, 23 bp, Homo sapiens
tctagaggagggggcaggctgag

SEQ ID NO: 4599535 - DNA, 21 bp, Homo sapiens
tctagtttgattaaattcttg

SEQ ID NO: 4599536 - DNA, 22 bp, Homo sapiens
tctagtttgattaaattcttgc

SEQ ID NO: 4599537 - DNA, 23 bp, Homo sapiens
tctagtttgattaaattcttgca

SEQ ID NO: 4599538 - DNA, 15 bp, Homo sapiens
tctatcaagtattat

SEQ ID NO: 4599539 - DNA, 17 bp, Homo sapiens
tctatgacacatgcaag

SEQ ID NO: 4599540 - DNA, 14 bp, Homo sapiens
tctatgccagctca

SEQ ID NO: 4599541 - DNA, 16 bp, Homo sapiens
tctatgttaatatttt

SEQ ID NO: 4599542 - DNA, 14 bp, Homo sapiens
tctatttatttatt

SEQ ID NO: 4599543 - DNA, 14 bp, Homo sapiens
tctcaaatttctaa

SEQ ID NO: 4599544 - DNA, 21 bp, Homo sapiens
tctcagccgcttctgactgct

SEQ ID NO: 4599545 - DNA, 15 bp, Homo sapiens
tctcatcaactgaat

SEQ ID NO: 4599546 - DNA, 13 bp, Homo sapiens
tctccaaaataaa

SEQ ID NO: 4599547 - DNA, 17 bp, Homo sapiens
tctccaaaataaaactt

SEQ ID NO: 4599548 - DNA, 15 bp, Homo sapiens
tctccagccctgact

SEQ ID NO: 4599549 - DNA, 16 bp, Homo sapiens
tctccccagcccagag

SEQ ID NO: 4599550 - DNA, 16 bp, Homo sapiens
tctctagtttgattaa

SEQ ID NO: 4599551 - DNA, 16 bp, Homo sapiens
tctctcctgtacctct

SEQ ID NO: 4599552 - DNA, 17 bp, Homo sapiens
tctctcctgtacctctt

SEQ ID NO: 4599553 - DNA, 14 bp, Homo sapiens
tctctctgcccaac

SEQ ID NO: 4599554 - DNA, 12 bp, Homo sapiens
tctctgcccaac

SEQ ID NO: 4599555 - DNA, 18 bp, Homo sapiens
tctcttcacagtcacatt

SEQ ID NO: 4599556 - DNA, 12 bp, Homo sapiens
tctgaactcaaa

SEQ ID NO: 4599557 - DNA, 21 bp, Homo sapiens
tctgaactcaaactgaggaat

SEQ ID NO: 4599558 - DNA, 17 bp, Homo sapiens
tctgaagtcacatcaca

SEQ ID NO: 4599559 - DNA, 13 bp, Homo sapiens
tctgacccagtgc

SEQ ID NO: 4599560 - DNA, 14 bp, Homo sapiens
tctgactctgagct

SEQ ID NO: 4599561 - DNA, 20 bp, Homo sapiens
tctgagctatttcatctatt

SEQ ID NO: 4599562 - DNA, 17 bp, Homo sapiens
tctgaggacaagagaaa

SEQ ID NO: 4599563 - DNA, 17 bp, Homo sapiens
tctgcagcaataaagca

SEQ ID NO: 4599564 - DNA, 18 bp, Homo sapiens
tctgcagcaataaagcag

SEQ ID NO: 4599565 - DNA, 16 bp, Homo sapiens
tctgcctgccagctgc

SEQ ID NO: 4599566 - DNA, 17 bp, Homo sapiens
tctgcctgccagctgca

SEQ ID NO: 4599567 - DNA, 20 bp, Homo sapiens
tctgccttctcatgatccaa

SEQ ID NO: 4599568 - DNA, 22 bp, Homo sapiens
tctgctcccctaaagcctcaaa

SEQ ID NO: 4599569 - DNA, 13 bp, Homo sapiens
tctggaacccaga

SEQ ID NO: 4599570 - DNA, 14 bp, Homo sapiens
tctggaacccagac

SEQ ID NO: 4599571 - DNA, 16 bp, Homo sapiens
tctggaacccagactc

SEQ ID NO: 4599572 - DNA, 17 bp, Homo sapiens
tctggaacccagactca

SEQ ID NO: 4599573 - DNA, 22 bp, Homo sapiens
tctggaacccagactcagacat

SEQ ID NO: 4599574 - DNA, 16 bp, Homo sapiens
tctggaacctcagcct

SEQ ID NO: 4599575 - DNA, 16 bp, Homo sapiens
tctggattcatattta

SEQ ID NO: 4599576 - DNA, 14 bp, Homo sapiens
tctgtcctcagcct

SEQ ID NO: 4599577 - DNA, 15 bp, Homo sapiens
tctgtcctcagcctt

SEQ ID NO: 4599578 - DNA, 19 bp, Homo sapiens
tctgtcctcagccttgcca

SEQ ID NO: 4599579 - DNA, 23 bp, Homo sapiens
tctgtcctcagccttgccagaga

SEQ ID NO: 4599580 - DNA, 17 bp, Homo sapiens
tctgtgcctgaatattt

SEQ ID NO: 4599581 - DNA, 22 bp, Homo sapiens
tctgttctttccaaagtacact

SEQ ID NO: 4599582 - DNA, 16 bp, Homo sapiens
tctgttgtattcattg

SEQ ID NO: 4599583 - DNA, 18 bp, Homo sapiens
tcttcagatctctaactt

SEQ ID NO: 4599584 - DNA, 18 bp, Homo sapiens
tcttccagtcttcctgac

SEQ ID NO: 4599585 - DNA, 16 bp, Homo sapiens
tcttcctgacacttta

SEQ ID NO: 4599586 - DNA, 12 bp, Homo sapiens
tcttctatttat

SEQ ID NO: 4599587 - DNA, 22 bp, Homo sapiens
tcttctatttatttatttattc

SEQ ID NO: 4599588 - DNA, 17 bp, Homo sapiens
tcttcttgaaattttaa

SEQ ID NO: 4599589 - DNA, 16 bp, Homo sapiens
tcttggtttgtaaatt

SEQ ID NO: 4599590 - DNA, 13 bp, Homo sapiens
tctttccaaagta

SEQ ID NO: 4599591 - DNA, 21 bp, Homo sapiens
tctttccagtggatcataaga

SEQ ID NO: 4599592 - DNA, 20 bp, Homo sapiens
tctttctggctatgcatttg

SEQ ID NO: 4599593 - DNA, 15 bp, Homo sapiens
tctttgggccagaca

SEQ ID NO: 4599594 - DNA, 16 bp, Homo sapiens
tctttgggccagacat

SEQ ID NO: 4599595 - DNA, 17 bp, Homo sapiens
tcttttgccgttattaa

SEQ ID NO: 4599596 - DNA, 14 bp, Homo sapiens
tctttttgaaatgt

SEQ ID NO: 4599597 - DNA, 12 bp, Homo sapiens
tgaaaacacatt

SEQ ID NO: 4599598 - DNA, 20 bp, Homo sapiens
tgaaaacacatttttcttag

SEQ ID NO: 4599599 - DNA, 20 bp, Homo sapiens
tgaaaataaaaagatcactt

SEQ ID NO: 4599600 - DNA, 21 bp, Homo sapiens
tgaaaatgtgctatactgcat

SEQ ID NO: 4599601 - DNA, 22 bp, Homo sapiens
tgaaaatgtgctatactgcata

SEQ ID NO: 4599602 - DNA, 13 bp, Homo sapiens
tgaaaattttgat

SEQ ID NO: 4599603 - DNA, 19 bp, Homo sapiens
tgaaaattttgatgtttta

SEQ ID NO: 4599604 - DNA, 20 bp, Homo sapiens
tgaaacccctgtaggcctca

SEQ ID NO: 4599605 - DNA, 17 bp, Homo sapiens
tgaaagaggaatgaagt

SEQ ID NO: 4599606 - DNA, 18 bp, Homo sapiens
tgaaagaggaatgaagta

SEQ ID NO: 4599607 - DNA, 23 bp, Homo sapiens
tgaaagcagggacttgaacccat

SEQ ID NO: 4599608 - DNA, 16 bp, Homo sapiens
tgaaaggtaatttgag

SEQ ID NO: 4599609 - DNA, 23 bp, Homo sapiens
tgaaataagccagacatcaacag

SEQ ID NO: 4599610 - DNA, 13 bp, Homo sapiens
tgaaatgtcaacc

SEQ ID NO: 4599611 - DNA, 17 bp, Homo sapiens
tgaacatattgttgaaa

SEQ ID NO: 4599612 - DNA, 12 bp, Homo sapiens
tgaacctgaata

SEQ ID NO: 4599613 - DNA, 18 bp, Homo sapiens
tgcttaacttcacatatt

SEQ ID NO: 4599614 - DNA, 14 bp, Homo sapiens
tgcttgagcccagg

SEQ ID NO: 4599615 - DNA, 12 bp, Homo sapiens
tgcttgattttt

SEQ ID NO: 4599616 - DNA, 23 bp, Homo sapiens
tggaaagataactaggaaatcca

SEQ ID NO: 4599617 - DNA, 15 bp, Homo sapiens
tggaacccagactca

SEQ ID NO: 4599618 - DNA, 16 bp, Homo sapiens
tggaacccagactcag

SEQ ID NO: 4599619 - DNA, 22 bp, Homo sapiens
tggaacccagactcagacattg

SEQ ID NO: 4599620 - DNA, 15 bp, Homo sapiens
tggacattgtctgcg

SEQ ID NO: 4599621 - DNA, 16 bp, Homo sapiens
tggacattttatgtct

SEQ ID NO: 4599622 - DNA, 17 bp, Homo sapiens
tggacattttatgtctt

SEQ ID NO: 4599623 - DNA, 15 bp, Homo sapiens
tggactttcttgcaa

SEQ ID NO: 4599624 - DNA, 18 bp, Homo sapiens
tggagaagtgggtgggga

SEQ ID NO: 4599625 - DNA, 15 bp, Homo sapiens
tggagagtttcctga

SEQ ID NO: 4599626 - DNA, 16 bp, Homo sapiens
tggagagtttcctgaa

SEQ ID NO: 4599627 - DNA, 17 bp, Homo sapiens
tggagagtttcctgaaa

SEQ ID NO: 4599628 - DNA, 14 bp, Homo sapiens
cagctaagaacctg

SEQ ID NO: 4599629 - DNA, 19 bp, Homo sapiens
cagctaagaacctggaact

SEQ ID NO: 4599630 - DNA, 12 bp, Homo sapiens
cagctcaggaca

SEQ ID NO: 4599631 - DNA, 12 bp, Homo sapiens
cagctcagtccc

SEQ ID NO: 4599632 - DNA, 16 bp, Homo sapiens
cagctcattaaacttt

SEQ ID NO: 4599633 - DNA, 20 bp, Homo sapiens
cagctccaacctgcaaagat

SEQ ID NO: 4599634 - DNA, 20 bp, Homo sapiens
cagctccctaggagaccaag

SEQ ID NO: 4599635 - DNA, 16 bp, Homo sapiens
cagctctactccaggc

SEQ ID NO: 4599636 - DNA, 23 bp, Homo sapiens
cagctctggacagccccaccctg

SEQ ID NO: 4599637 - DNA, 12 bp, Homo sapiens
cagctgcactga

SEQ ID NO: 4599638 - DNA, 16 bp, Homo sapiens
cagcttattcacaaga

SEQ ID NO: 4599639 - DNA, 17 bp, Homo sapiens
cagcttattcacaagac

SEQ ID NO: 4599640 - DNA, 20 bp, Homo sapiens
cagcttcgtttattttcaag

SEQ ID NO: 4599641 - DNA, 13 bp, Homo sapiens
caggaacagaagg

SEQ ID NO: 4599642 - DNA, 14 bp, Homo sapiens
caggaacagaagga

SEQ ID NO: 4599643 - DNA, 15 bp, Homo sapiens
caggaagtagaggag

SEQ ID NO: 4599644 - DNA, 16 bp, Homo sapiens
caggaatttcccagga

SEQ ID NO: 4599645 - DNA, 19 bp, Homo sapiens
caggaccagctcaggacag

SEQ ID NO: 4599646 - DNA, 15 bp, Homo sapiens
caggaccctgaaggg

SEQ ID NO: 4599647 - DNA, 22 bp, Homo sapiens
caggaggattgcttgagcccag

SEQ ID NO: 4599648 - DNA, 23 bp, Homo sapiens
caggaggattgcttgagcccagg

SEQ ID NO: 4599649 - DNA, 16 bp, Homo sapiens
caggaggctgaggcag

SEQ ID NO: 4599650 - DNA, 15 bp, Homo sapiens
caggagtcccaagga

SEQ ID NO: 4599651 - DNA, 19 bp, Homo sapiens
caggagtcccaaggaaagc

SEQ ID NO: 4599652 - DNA, 21 bp, Homo sapiens
caggagtcccaaggaaagccc

SEQ ID NO: 4599653 - DNA, 24 bp, Homo sapiens
caggagtcccaaggaaagccccag

SEQ ID NO: 4599654 - DNA, 13 bp, Homo sapiens
caggcagatccag

SEQ ID NO: 4599655 - DNA, 17 bp, Homo sapiens
caggccaccctgcctct

SEQ ID NO: 4599656 - DNA, 22 bp, Homo sapiens
caggccctccctgttccccaga

SEQ ID NO: 4599657 - DNA, 17 bp, Homo sapiens
caggcttccacacttct

SEQ ID NO: 4599658 - DNA, 19 bp, Homo sapiens
cagggacagaggccccagc

SEQ ID NO: 4599659 - DNA, 18 bp, Homo sapiens
cagggacctaaagggact

SEQ ID NO: 4599660 - DNA, 16 bp, Homo sapiens
cagggcccagagccca

SEQ ID NO: 4599661 - DNA, 18 bp, Homo sapiens
cagggcccagagcccagc

SEQ ID NO: 4599662 - DNA, 21 bp, Homo sapiens
cagggcccagagcccagctcc

SEQ ID NO: 4599663 - DNA, 15 bp, Homo sapiens
caggggggtgaggag

SEQ ID NO: 4599664 - DNA, 17 bp, Homo sapiens
cagtacatgggtgacta

SEQ ID NO: 4599665 - DNA, 23 bp, Homo sapiens
cagtaccatttaatggggaggac

SEQ ID NO: 4599666 - DNA, 14 bp, Homo sapiens
cagtccccccaccc

SEQ ID NO: 4599667 - DNA, 22 bp, Homo sapiens
cagtcctggaagccagctttcc

SEQ ID NO: 4599668 - DNA, 22 bp, Homo sapiens
cagtcttgaatttctaaaaaac

SEQ ID NO: 4599669 - DNA, 23 bp, Homo sapiens
cagtcttgaatttctaaaaaaca

SEQ ID NO: 4599670 - DNA, 22 bp, Homo sapiens
cagtgattaccagggactgagg

SEQ ID NO: 4599671 - DNA, 20 bp, Homo sapiens
cagtgcccccactgaccaga

SEQ ID NO: 4599672 - DNA, 21 bp, Homo sapiens
cagtgcccccactgaccagaa

SEQ ID NO: 4599673 - DNA, 18 bp, Homo sapiens
cagtggtggttttctgtt

SEQ ID NO: 4599674 - DNA, 19 bp, Homo sapiens
cagtggtggttttctgttc

SEQ ID NO: 4599675 - DNA, 22 bp, Homo sapiens
cagtggtggttttctgttcttt

SEQ ID NO: 4599676 - DNA, 21 bp, Homo sapiens
cagtgtgtggtcaacatttct

SEQ ID NO: 4599677 - DNA, 22 bp, Homo sapiens
cagtgttgtggatttaacagaa

SEQ ID NO: 4599678 - DNA, 20 bp, Homo sapiens
cagttactcagaattctcta

SEQ ID NO: 4599679 - DNA, 13 bp, Homo sapiens
cagttcaccctga

SEQ ID NO: 4599680 - DNA, 23 bp, Homo sapiens
cagttcaggagtcccaaggaaag

SEQ ID NO: 4599681 - DNA, 19 bp, Homo sapiens
cagttctttgggccagaca

SEQ ID NO: 4599682 - DNA, 18 bp, Homo sapiens
cagttggagggaaagcca

SEQ ID NO: 4599683 - DNA, 23 bp, Homo sapiens
cagtttgttagtatgaggcattt

SEQ ID NO: 4599684 - DNA, 12 bp, Homo sapiens
cagttttcataa

SEQ ID NO: 4599685 - DNA, 21 bp, Homo sapiens
cataaacaagaccacgtttct

SEQ ID NO: 4599686 - DNA, 15 bp, Homo sapiens
cataatcttctgcct

SEQ ID NO: 4599687 - DNA, 21 bp, Homo sapiens
cataatcttctgccttctcat

SEQ ID NO: 4599688 - DNA, 17 bp, Homo sapiens
cataatgcgtgcatacc

SEQ ID NO: 4599689 - DNA, 23 bp, Homo sapiens
catacacttattggaactctgct

SEQ ID NO: 4599690 - DNA, 14 bp, Homo sapiens
cataccacttttgt

SEQ ID NO: 4599691 - DNA, 15 bp, Homo sapiens
catacgtacacattt

SEQ ID NO: 4599692 - DNA, 17 bp, Homo sapiens
catacgtacacatttta

SEQ ID NO: 4599693 - DNA, 21 bp, Homo sapiens
catactaaccagcagaaatgc

SEQ ID NO: 4599694 - DNA, 13 bp, Homo sapiens
catacttgaaggg

SEQ ID NO: 4599695 - DNA, 20 bp, Homo sapiens
catacttgaagggccagagc

SEQ ID NO: 4599696 - DNA, 21 bp, Homo sapiens
catacttgaagggccagagcc

SEQ ID NO: 4599697 - DNA, 23 bp, Homo sapiens
catacttgaagggccagagccag

SEQ ID NO: 4599698 - DNA, 20 bp, Homo sapiens
catactttttaaatgtaaag

SEQ ID NO: 4599699 - DNA, 15 bp, Homo sapiens
catagcaagacacat

SEQ ID NO: 4599700 - DNA, 20 bp, Homo sapiens
catagcaagacacatcccta

SEQ ID NO: 4599701 - DNA, 22 bp, Homo sapiens
catagcacctaacaacattgta

SEQ ID NO: 4599702 - DNA, 19 bp, Homo sapiens
catagcagcttattcacaa

SEQ ID NO: 4599703 - DNA, 16 bp, Homo sapiens
catattaccacagaca

SEQ ID NO: 4599704 - DNA, 20 bp, Homo sapiens
catattaccacagacatact

SEQ ID NO: 4599705 - DNA, 22 bp, Homo sapiens
catattaccacagacatactaa

SEQ ID NO: 4599706 - DNA, 16 bp, Homo sapiens
catattttaaacagag

SEQ ID NO: 4599707 - DNA, 17 bp, Homo sapiens
catattttaaacagagg

SEQ ID NO: 4599708 - DNA, 10 bp, Homo sapiens
catcaactga

SEQ ID NO: 4599709 - DNA, 14 bp, Homo sapiens
catcaactgaatga

SEQ ID NO: 4599710 - DNA, 22 bp, Homo sapiens
catcacaggacacggggcagtg

SEQ ID NO: 4599711 - DNA, 18 bp, Homo sapiens
catcagcacgatttctgt

SEQ ID NO: 4599712 - DNA, 19 bp, Homo sapiens
catcagcacgatttctgtt

SEQ ID NO: 4599713 - DNA, 19 bp, Homo sapiens
catccctttggttaataaa

SEQ ID NO: 4599714 - DNA, 21 bp, Homo sapiens
catcctctctatgggccatat

SEQ ID NO: 4599715 - DNA, 17 bp, Homo sapiens
catctcattccaacttc

SEQ ID NO: 4599716 - DNA, 17 bp, Homo sapiens
catctcccttttccatg

SEQ ID NO: 4599717 - DNA, 13 bp, Homo sapiens
catctctctgccc

SEQ ID NO: 4599718 - DNA, 15 bp, Homo sapiens
catctctctgcccaa

SEQ ID NO: 4599719 - DNA, 18 bp, Homo sapiens
catctctctgcccaaccc

SEQ ID NO: 4599720 - DNA, 15 bp, Homo sapiens
catctcttgaggcca

SEQ ID NO: 4599721 - DNA, 15 bp, Homo sapiens
catgaaaacacattt

SEQ ID NO: 4599722 - DNA, 17 bp, Homo sapiens
catgaaaacacattttt

SEQ ID NO: 4599723 - DNA, 19 bp, Homo sapiens
catgaaaacacatttttct

SEQ ID NO: 4599724 - DNA, 21 bp, Homo sapiens
catgaaaacacatttttctta

SEQ ID NO: 4599725 - DNA, 19 bp, Homo sapiens
catgaagtaatatgcacac

SEQ ID NO: 4599726 - DNA, 23 bp, Homo sapiens
catgaagtaatatgcacacattt

SEQ ID NO: 4599727 - DNA, 19 bp, Homo sapiens
catgacctagttttccatg

SEQ ID NO: 4599728 - DNA, 23 bp, Homo sapiens
catgaggcaatgtcaggaacaga

SEQ ID NO: 4599729 - DNA, 15 bp, Homo sapiens
catgatggcaacaga

SEQ ID NO: 4599730 - DNA, 16 bp, Homo sapiens
catgcactgtgaagga

SEQ ID NO: 4599731 - DNA, 18 bp, Homo sapiens
catgcactgtgaaggacc

SEQ ID NO: 4599732 - DNA, 22 bp, Homo sapiens
catgcactgtgaaggacccttg

SEQ ID NO: 4599733 - DNA, 16 bp, Homo sapiens
catgcatgtcctgtaa

SEQ ID NO: 4599734 - DNA, 18 bp, Homo sapiens
catgcatgtcctgtaaag

SEQ ID NO: 4599735 - DNA, 22 bp, Homo sapiens
catgccacaccggtaccctcct

SEQ ID NO: 4599736 - DNA, 13 bp, Homo sapiens
catgcccctgaac

SEQ ID NO: 4599737 - DNA, 17 bp, Homo sapiens
catgcgtgtttctgact

SEQ ID NO: 4599738 - DNA, 14 bp, Homo sapiens
catgctacacactg

SEQ ID NO: 4599739 - DNA, 19 bp, Homo sapiens
catggatgggggaactcag

SEQ ID NO: 4599740 - DNA, 21 bp, Homo sapiens
catggcagaataatctttggg

SEQ ID NO: 4599741 - DNA, 18 bp, Homo sapiens
catgggtgactatctccc

SEQ ID NO: 4599742 - DNA, 16 bp, Homo sapiens
catggtgccccaggac

SEQ ID NO: 4599743 - DNA, 17 bp, Homo sapiens
catggtgccccaggacc

SEQ ID NO: 4599744 - DNA, 18 bp, Homo sapiens
catggtgccccaggacca

SEQ ID NO: 4599745 - DNA, 19 bp, Homo sapiens
catggtgccccaggaccag

SEQ ID NO: 4599746 - DNA, 14 bp, Homo sapiens
catgtcctgtaaag

SEQ ID NO: 4599747 - DNA, 16 bp, Homo sapiens
catgtctattcagctt

SEQ ID NO: 4599748 - DNA, 13 bp, Homo sapiens
catgttcttaatt

SEQ ID NO: 4599749 - DNA, 12 bp, Homo sapiens
catgtttgtgat

SEQ ID NO: 4599750 - DNA, 15 bp, Homo sapiens
catgtttgtgattga

SEQ ID NO: 4599751 - DNA, 19 bp, Homo sapiens
cattaaacttttttaacca

SEQ ID NO: 4599752 - DNA, 22 bp, Homo sapiens
cattaaagttaaactgtatttt

SEQ ID NO: 4599753 - DNA, 15 bp, Homo sapiens
cattagttttgaaga

SEQ ID NO: 4599754 - DNA, 17 bp, Homo sapiens
cattatctagatactgt

SEQ ID NO: 4599755 - DNA, 17 bp, Homo sapiens
cattatgttaatatttc

SEQ ID NO: 4599756 - DNA, 15 bp, Homo sapiens
cattcacttcataat

SEQ ID NO: 4599757 - DNA, 17 bp, Homo sapiens
tatagttttacttttaa

SEQ ID NO: 4599758 - DNA, 22 bp, Homo sapiens
tatagttttacttttaaactgt

SEQ ID NO: 4599759 - DNA, 14 bp, Homo sapiens
aacccagactcaga

SEQ ID NO: 4599760 - DNA, 18 bp, Homo sapiens
aacccagactcagacatt

SEQ ID NO: 4599761 - DNA, 12 bp, Homo sapiens
aaccccagctcc

SEQ ID NO: 4599762 - DNA, 11 bp, Homo sapiens
aacctcagcct

SEQ ID NO: 4599763 - DNA, 14 bp, Homo sapiens
aacctcagcctggc

SEQ ID NO: 4599764 - DNA, 18 bp, Homo sapiens
aacctgagccccaaaagg

SEQ ID NO: 4599765 - DNA, 15 bp, Homo sapiens
aactaaaataatttt

SEQ ID NO: 4599766 - DNA, 19 bp, Homo sapiens
aactaaaataattttgtaa

SEQ ID NO: 4599767 - DNA, 12 bp, Homo sapiens
aactaatgcctt

SEQ ID NO: 4599768 - DNA, 17 bp, Homo sapiens
aactatgcatggtgccc

SEQ ID NO: 4599769 - DNA, 18 bp, Homo sapiens
aactcaaatggggccaga

SEQ ID NO: 4599770 - DNA, 23 bp, Homo sapiens
aactcaaatggggccagatccag

SEQ ID NO: 4599771 - DNA, 12 bp, Homo sapiens
aactcagatcca

SEQ ID NO: 4599772 - DNA, 14 bp, Homo sapiens
aactcagatccagg

SEQ ID NO: 4599773 - DNA, 22 bp, Homo sapiens
aactctgggctgctacccagaa

SEQ ID NO: 4599774 - DNA, 20 bp, Homo sapiens
aactgcctactccaaaatgt

SEQ ID NO: 4599775 - DNA, 21 bp, Homo sapiens
aactgggggagggtgaagtga

SEQ ID NO: 4599776 - DNA, 22 bp, Homo sapiens
aactgggggagggtgaagtgaa

SEQ ID NO: 4599777 - DNA, 20 bp, Homo sapiens
aactgtgtacataactgaaa

SEQ ID NO: 4599778 - DNA, 17 bp, Homo sapiens
aacttaaataatgtgaa

SEQ ID NO: 4599779 - DNA, 18 bp, Homo sapiens
aacttaatctaaatggaa

SEQ ID NO: 4599780 - DNA, 14 bp, Homo sapiens
aacttcacatattg

SEQ ID NO: 4599781 - DNA, 22 bp, Homo sapiens
aacttcacatattgatttccgt

SEQ ID NO: 4599782 - DNA, 13 bp, Homo sapiens
aacttcagacata

SEQ ID NO: 4599783 - DNA, 21 bp, Homo sapiens
aacttggggagttaagacctg

SEQ ID NO: 4599784 - DNA, 21 bp, Homo sapiens
aactttaagaactaaaatgtt

SEQ ID NO: 4599785 - DNA, 21 bp, Homo sapiens
aactttaccttttttatacat

SEQ ID NO: 4599786 - DNA, 22 bp, Homo sapiens
aactttaccttttttatacata

SEQ ID NO: 4599787 - DNA, 23 bp, Homo sapiens
aactttaccttttttatacataa

SEQ ID NO: 4599788 - DNA, 21 bp, Homo sapiens
aactttatgctaagtgaaata

SEQ ID NO: 4599789 - DNA, 20 bp, Homo sapiens
aactttgacctctgcagcaa

SEQ ID NO: 4599790 - DNA, 20 bp, Homo sapiens
aagaaccagtccccccaccc

SEQ ID NO: 4599791 - DNA, 19 bp, Homo sapiens
aagaagcccccagctaaga

SEQ ID NO: 4599792 - DNA, 11 bp, Homo sapiens
aagaaggaagt

SEQ ID NO: 4599793 - DNA, 16 bp, Homo sapiens
aagaagtgaaaatcta

SEQ ID NO: 4599794 - DNA, 16 bp, Homo sapiens
aagaataatcacgctt

SEQ ID NO: 4599795 - DNA, 22 bp, Homo sapiens
aagaataatcacgctttcctga

SEQ ID NO: 4599796 - DNA, 17 bp, Homo sapiens
aagaatagcattgtaaa

SEQ ID NO: 4599797 - DNA, 22 bp, Homo sapiens
aagacaatgacttactgtacat

SEQ ID NO: 4599798 - DNA, 13 bp, Homo sapiens
aagacatgtctgt

SEQ ID NO: 4599799 - DNA, 13 bp, Homo sapiens
aagacccaaaagg

SEQ ID NO: 4599800 - DNA, 23 bp, Homo sapiens
aagactgagtacgttgtgcattt

SEQ ID NO: 4599801 - DNA, 15 bp, Homo sapiens
aagaggcagggacct

SEQ ID NO: 4599802 - DNA, 20 bp, Homo sapiens
aagatattttgctttgtgat

SEQ ID NO: 4599803 - DNA, 17 bp, Homo sapiens
aagatatttttatcttt

SEQ ID NO: 4599804 - DNA, 17 bp, Homo sapiens
aagatcactttctcagt

SEQ ID NO: 4599805 - DNA, 19 bp, Homo sapiens
aagatctgtcctcagcctt

SEQ ID NO: 4599806 - DNA, 13 bp, Homo sapiens
aagatgtagagga

SEQ ID NO: 4599807 - DNA, 22 bp, Homo sapiens
aagattctatgttaatatttta

SEQ ID NO: 4599808 - DNA, 12 bp, Homo sapiens
aagattgctgaa

SEQ ID NO: 4599809 - DNA, 15 bp, Homo sapiens
aagattgctgaaatt

SEQ ID NO: 4599810 - DNA, 16 bp, Homo sapiens
aagattgctgaaattt

SEQ ID NO: 4599811 - DNA, 12 bp, Homo sapiens
aagcattttgta

SEQ ID NO: 4599812 - DNA, 21 bp, Homo sapiens
aagccagatgctagagcctct

SEQ ID NO: 4599813 - DNA, 14 bp, Homo sapiens
aagccagctttccc

SEQ ID NO: 4599814 - DNA, 17 bp, Homo sapiens
aagccagctttccctgc

SEQ ID NO: 4599815 - DNA, 22 bp, Homo sapiens
aagccaggaatttcccaggacc

SEQ ID NO: 4599816 - DNA, 23 bp, Homo sapiens
aagccaggaatttcccaggaccc

SEQ ID NO: 4599817 - DNA, 14 bp, Homo sapiens
aagccgggaacaga

SEQ ID NO: 4599818 - DNA, 11 bp, Homo sapiens
aagcctcagag

SEQ ID NO: 4599819 - DNA, 22 bp, Homo sapiens
aagcctgcacaataaaaatgtt

SEQ ID NO: 4599820 - DNA, 18 bp, Homo sapiens
aagctcctctccccagcc

SEQ ID NO: 4599821 - DNA, 20 bp, Homo sapiens
aagctcctctccccagccca

SEQ ID NO: 4599822 - DNA, 21 bp, Homo sapiens
aagctcctctccccagcccag

SEQ ID NO: 4599823 - DNA, 23 bp, Homo sapiens
aagctttttattcctcctgctca

SEQ ID NO: 4599824 - DNA, 13 bp, Homo sapiens
aaggaaggaaaga

SEQ ID NO: 4599825 - DNA, 19 bp, Homo sapiens
aaggatagatgctggccca

SEQ ID NO: 4599826 - DNA, 18 bp, Homo sapiens
aaggatgcacagagttgt

SEQ ID NO: 4599827 - DNA, 22 bp, Homo sapiens
aaggatgcacagagttgttaca

SEQ ID NO: 4599828 - DNA, 16 bp, Homo sapiens
aaggatgcttgtacat

SEQ ID NO: 4599829 - DNA, 21 bp, Homo sapiens
aaggcaaccaataaaagccag

SEQ ID NO: 4599830 - DNA, 13 bp, Homo sapiens
aaggctacctttg

SEQ ID NO: 4599831 - DNA, 15 bp, Homo sapiens
aaggctacctttgta

SEQ ID NO: 4599832 - DNA, 13 bp, Homo sapiens
aagggccagagcc

SEQ ID NO: 4599833 - DNA, 14 bp, Homo sapiens
aagggccagagcca

SEQ ID NO: 4599834 - DNA, 16 bp, Homo sapiens
aaggggagtaggtggg

SEQ ID NO: 4599835 - DNA, 22 bp, Homo sapiens
aaggggagtaggtgggggaaca

SEQ ID NO: 4599836 - DNA, 14 bp, Homo sapiens
aaggtagaatgttt

SEQ ID NO: 4599837 - DNA, 18 bp, Homo sapiens
aaggtgctgacggccagg

SEQ ID NO: 4599838 - DNA, 20 bp, Homo sapiens
aagtaatatgcacacatttt

SEQ ID NO: 4599839 - DNA, 19 bp, Homo sapiens
aagtacactgtttcaaact

SEQ ID NO: 4599840 - DNA, 15 bp, Homo sapiens
aagtattataccttt

SEQ ID NO: 4599841 - DNA, 15 bp, Homo sapiens
aagtattatgtctct

SEQ ID NO: 4599842 - DNA, 15 bp, Homo sapiens
aagtattttgctgga

SEQ ID NO: 4599843 - DNA, 14 bp, Homo sapiens
aagtattttttcaa

SEQ ID NO: 4599844 - DNA, 16 bp, Homo sapiens
aagtcacatcacagga

SEQ ID NO: 4599845 - DNA, 17 bp, Homo sapiens
aagtcatagccataaat

SEQ ID NO: 4599846 - DNA, 15 bp, Homo sapiens
aagtcatgaagccca

SEQ ID NO: 4599847 - DNA, 23 bp, Homo sapiens
aagtcatgaagcccaagtgaaat

SEQ ID NO: 4599848 - DNA, 13 bp, Homo sapiens
aagtcttctattt

SEQ ID NO: 4599849 - DNA, 12 bp, Homo sapiens
aagtgaaaactt

SEQ ID NO: 4599850 - DNA, 14 bp, Homo sapiens
aagtgaaaatatag

SEQ ID NO: 4599851 - DNA, 23 bp, Homo sapiens
aagtgcaataaatctgacccagt

SEQ ID NO: 4599852 - DNA, 14 bp, Homo sapiens
aagtgctgcattta

SEQ ID NO: 4599853 - DNA, 16 bp, Homo sapiens
aagtgggtggggacag

SEQ ID NO: 4599854 - DNA, 15 bp, Homo sapiens
aagtgtgttggatta

SEQ ID NO: 4599855 - DNA, 23 bp, Homo sapiens
aagttcaaattcttctgaactca

SEQ ID NO: 4599856 - DNA, 17 bp, Homo sapiens
aagttctgcagataaac

SEQ ID NO: 4599857 - DNA, 14 bp, Homo sapiens
aataaaacttttta

SEQ ID NO: 4599858 - DNA, 15 bp, Homo sapiens
aataaaactttttaa

SEQ ID NO: 4599859 - DNA, 18 bp, Homo sapiens
aataaaactttttaaaat

SEQ ID NO: 4599860 - DNA, 11 bp, Homo sapiens
aataaagtctc

SEQ ID NO: 4599861 - DNA, 18 bp, Homo sapiens
aataaagtctcttcctcc

SEQ ID NO: 4599862 - DNA, 17 bp, Homo sapiens
aataaatctgacccagt

SEQ ID NO: 4599863 - DNA, 21 bp, Homo sapiens
aataagttcaaattcttctga

SEQ ID NO: 4599864 - DNA, 14 bp, Homo sapiens
aataatctttgggt

SEQ ID NO: 4599865 - DNA, 16 bp, Homo sapiens
aatacaccactacatt

SEQ ID NO: 4599866 - DNA, 20 bp, Homo sapiens
aatacatttaaaacattaaa

SEQ ID NO: 4599867 - DNA, 21 bp, Homo sapiens
aatacatttaaaacattaaaa

SEQ ID NO: 4599868 - DNA, 18 bp, Homo sapiens
aatactaattttccataa

SEQ ID NO: 4599869 - DNA, 22 bp, Homo sapiens
aatagaagctaaggtttagata

SEQ ID NO: 4599870 - DNA, 18 bp, Homo sapiens
aatagacaatttattatg

SEQ ID NO: 4599871 - DNA, 23 bp, Homo sapiens
aatagacaatttattatggcaca

SEQ ID NO: 4599872 - DNA, 15 bp, Homo sapiens
aatagctttaatgat

SEQ ID NO: 4599873 - DNA, 16 bp, Homo sapiens
aatagtggtgtgattt

SEQ ID NO: 4599874 - DNA, 22 bp, Homo sapiens
aatagtggtgtgatttggggat

SEQ ID NO: 4599875 - DNA, 13 bp, Homo sapiens
aatataaaaataa

SEQ ID NO: 4599876 - DNA, 16 bp, Homo sapiens
aatatgcacacatttt

SEQ ID NO: 4599877 - DNA, 18 bp, Homo sapiens
aatatggtcttttggtta

SEQ ID NO: 4599878 - DNA, 12 bp, Homo sapiens
aatcagaactca

SEQ ID NO: 4599879 - DNA, 23 bp, Homo sapiens
aatcattaggtgtgactgaattt

SEQ ID NO: 4599880 - DNA, 17 bp, Homo sapiens
aatccaggcagatccag

SEQ ID NO: 4599881 - DNA, 20 bp, Homo sapiens
aatccaggcagatccaggac

SEQ ID NO: 4599882 - DNA, 16 bp, Homo sapiens
aatctcaaatttctaa

SEQ ID NO: 4599883 - DNA, 18 bp, Homo sapiens
aatctcaaatttctaaat

SEQ ID NO: 4599884 - DNA, 13 bp, Homo sapiens
aatctccaaaata

SEQ ID NO: 4599885 - DNA, 13 bp, Homo sapiens
aatctgacccagt

SEQ ID NO: 4599886 - DNA, 11 bp, Homo sapiens
aatctgtaaac

SEQ ID NO: 4599887 - DNA, 16 bp, Homo sapiens
aatctgtaaactgtgt

SEQ ID NO: 4599888 - DNA, 23 bp, Homo sapiens
aatgaccaagctcagttcaatga

SEQ ID NO: 4599889 - DNA, 16 bp, Homo sapiens
acccagaatccctcta

SEQ ID NO: 4599890 - DNA, 15 bp, Homo sapiens
acccagactcagaca

SEQ ID NO: 4599891 - DNA, 18 bp, Homo sapiens
acccagtgcccccactga

SEQ ID NO: 4599892 - DNA, 22 bp, Homo sapiens
acccagtgcccccactgaccag

SEQ ID NO: 4599893 - DNA, 14 bp, Homo sapiens
acccctttctccag

SEQ ID NO: 4599894 - DNA, 14 bp, Homo sapiens
accctcatgttctt

SEQ ID NO: 4599895 - DNA, 18 bp, Homo sapiens
accctgaaggggccatga

SEQ ID NO: 4599896 - DNA, 20 bp, Homo sapiens
accctgatttaggagaagcc

SEQ ID NO: 4599897 - DNA, 23 bp, Homo sapiens
accctgatttaggagaagccagg

SEQ ID NO: 4599898 - DNA, 21 bp, Homo sapiens
accctgtctctactaaaaata

SEQ ID NO: 4599899 - DNA, 16 bp, Homo sapiens
acctcaactgcctact

SEQ ID NO: 4599900 - DNA, 13 bp, Homo sapiens
acctcagcctggc

SEQ ID NO: 4599901 - DNA, 20 bp, Homo sapiens
acctcagcctggccagacac

SEQ ID NO: 4599902 - DNA, 18 bp, Homo sapiens
acctctgcagcaataaag

SEQ ID NO: 4599903 - DNA, 21 bp, Homo sapiens
acctctgcagcaataaagcag

SEQ ID NO: 4599904 - DNA, 17 bp, Homo sapiens
acctcttgagccttgaa

SEQ ID NO: 4599905 - DNA, 19 bp, Homo sapiens
acctcttgagccttgaact

SEQ ID NO: 4599906 - DNA, 21 bp, Homo sapiens
acctcttgagccttgaacttt

SEQ ID NO: 4599907 - DNA, 15 bp, Homo sapiens
acctgacccctgctc

SEQ ID NO: 4599908 - DNA, 12 bp, Homo sapiens
acctgagcccca

SEQ ID NO: 4599909 - DNA, 21 bp, Homo sapiens
acctgagtcgtacagaaagct

SEQ ID NO: 4599910 - DNA, 22 bp, Homo sapiens
acctgatcctggaggcccagtt

SEQ ID NO: 4599911 - DNA, 11 bp, Homo sapiens
acctgattttt

SEQ ID NO: 4599912 - DNA, 17 bp, Homo sapiens
acctgattttttttcct

SEQ ID NO: 4599913 - DNA, 15 bp, Homo sapiens
acctgcaaagatctg

SEQ ID NO: 4599914 - DNA, 20 bp, Homo sapiens
acctggaatatataaccagt

SEQ ID NO: 4599915 - DNA, 14 bp, Homo sapiens
acctggcagctctg

SEQ ID NO: 4599916 - DNA, 17 bp, Homo sapiens
acctgttacctactttg

SEQ ID NO: 4599917 - DNA, 19 bp, Homo sapiens
acctttgtattctctcctg

SEQ ID NO: 4599918 - DNA, 16 bp, Homo sapiens
accttttttatacata

SEQ ID NO: 4599919 - DNA, 17 bp, Homo sapiens
accttttttatacataa

SEQ ID NO: 4599920 - DNA, 20 bp, Homo sapiens
accttttttatacataaaca

SEQ ID NO: 4599921 - DNA, 21 bp, Homo sapiens
accttttttatacataaacaa

SEQ ID NO: 4599922 - DNA, 23 bp, Homo sapiens
acggccagggagaagctcctctc

SEQ ID NO: 4599923 - DNA, 13 bp, Homo sapiens
acgtacacatttt

SEQ ID NO: 4599924 - DNA, 12 bp, Homo sapiens
acgtttctaaag

SEQ ID NO: 4599925 - DNA, 16 bp, Homo sapiens
acgtttctaaaggcta

SEQ ID NO: 4599926 - DNA, 22 bp, Homo sapiens
acgtttctaaaggctacctttg

SEQ ID NO: 4599927 - DNA, 13 bp, Homo sapiens
actaaaaatacaa

SEQ ID NO: 4599928 - DNA, 15 bp, Homo sapiens
actaaaataattttg

SEQ ID NO: 4599929 - DNA, 19 bp, Homo sapiens
actaaaataattttgtaat

SEQ ID NO: 4599930 - DNA, 14 bp, Homo sapiens
actaaaatgttcta

SEQ ID NO: 4599931 - DNA, 20 bp, Homo sapiens
actaattggcctctttaaga

SEQ ID NO: 4599932 - DNA, 20 bp, Homo sapiens
actaattttccataagctat

SEQ ID NO: 4599933 - DNA, 13 bp, Homo sapiens
actacagtttgtt

SEQ ID NO: 4599934 - DNA, 17 bp, Homo sapiens
actagcccaatgaaatg

SEQ ID NO: 4599935 - DNA, 20 bp, Homo sapiens
actatgcatggtgccccagg

SEQ ID NO: 4599936 - DNA, 21 bp, Homo sapiens
actatgcatggtgccccagga

SEQ ID NO: 4599937 - DNA, 23 bp, Homo sapiens
actatgcatggtgccccaggacc

SEQ ID NO: 4599938 - DNA, 23 bp, Homo sapiens
actcaaactgaggaatttcacct

SEQ ID NO: 4599939 - DNA, 21 bp, Homo sapiens
actcaaatggggccagatcca

SEQ ID NO: 4599940 - DNA, 22 bp, Homo sapiens
actcaaatggggccagatccag

SEQ ID NO: 4599941 - DNA, 23 bp, Homo sapiens
actcaaatggggccagatccagc

SEQ ID NO: 4599942 - DNA, 14 bp, Homo sapiens
actcagaattctct

SEQ ID NO: 4599943 - DNA, 16 bp, Homo sapiens
actcagatccagggac

SEQ ID NO: 4599944 - DNA, 17 bp, Homo sapiens
actcaggaggctgaggc

SEQ ID NO: 4599945 - DNA, 18 bp, Homo sapiens
actccagcctgggcaaca

SEQ ID NO: 4599946 - DNA, 19 bp, Homo sapiens
actccagtgagacagctct

SEQ ID NO: 4599947 - DNA, 20 bp, Homo sapiens
actctctccaccctatatgt

SEQ ID NO: 4599948 - DNA, 16 bp, Homo sapiens
actctgcttgattttt

SEQ ID NO: 4599949 - DNA, 15 bp, Homo sapiens
actctgtctcagtcc

SEQ ID NO: 4599950 - DNA, 18 bp, Homo sapiens
actctgtctcagtccatg

SEQ ID NO: 4599951 - DNA, 20 bp, Homo sapiens
actctgtctcagtccatgaa

SEQ ID NO: 4599952 - DNA, 19 bp, Homo sapiens
actcttcttgaaattttaa

SEQ ID NO: 4599953 - DNA, 19 bp, Homo sapiens
actgaaaatgtgctatact

SEQ ID NO: 4599954 - DNA, 12 bp, Homo sapiens
actgaatgaggt

SEQ ID NO: 4599955 - DNA, 12 bp, Homo sapiens
actgaatttctt

SEQ ID NO: 4599956 - DNA, 12 bp, Homo sapiens
actgaccagaac

SEQ ID NO: 4599957 - DNA, 12 bp, Homo sapiens
actgagaaagag

SEQ ID NO: 4599958 - DNA, 18 bp, Homo sapiens
actgagagtgaacaaatt

SEQ ID NO: 4599959 - DNA, 17 bp, Homo sapiens
actgaggggaggggagc

SEQ ID NO: 4599960 - DNA, 18 bp, Homo sapiens
actgagtacgttgtgcat

SEQ ID NO: 4599961 - DNA, 21 bp, Homo sapiens
actgagtacgttgtgcatttg

SEQ ID NO: 4599962 - DNA, 16 bp, Homo sapiens
actgatatattttaca

SEQ ID NO: 4599963 - DNA, 17 bp, Homo sapiens
actgatatattttacaa

SEQ ID NO: 4599964 - DNA, 12 bp, Homo sapiens
actgatgctgcc

SEQ ID NO: 4599965 - DNA, 15 bp, Homo sapiens
actgatgctgcccct

SEQ ID NO: 4599966 - DNA, 20 bp, Homo sapiens
actgcactccagcctgggca

SEQ ID NO: 4599967 - DNA, 23 bp, Homo sapiens
actgcatactttttaaatgtaaa

SEQ ID NO: 4599968 - DNA, 16 bp, Homo sapiens
actgcatgtttgtgat

SEQ ID NO: 4599969 - DNA, 21 bp, Homo sapiens
actggtccaaaagattgctga

SEQ ID NO: 4599970 - DNA, 22 bp, Homo sapiens
actggtccaaaagattgctgaa

SEQ ID NO: 4599971 - DNA, 14 bp, Homo sapiens
actgtacatgaaaa

SEQ ID NO: 4599972 - DNA, 23 bp, Homo sapiens
actgtacatgaaaacacattttt

SEQ ID NO: 4599973 - DNA, 20 bp, Homo sapiens
actgtatcatgacaaagact

SEQ ID NO: 4599974 - DNA, 14 bp, Homo sapiens
actgtattttatgt

SEQ ID NO: 4599975 - DNA, 18 bp, Homo sapiens
actgtcctattatattca

SEQ ID NO: 4599976 - DNA, 16 bp, Homo sapiens
actgtcctgggcctgc

SEQ ID NO: 4599977 - DNA, 17 bp, Homo sapiens
actgtcctgggcctgca

SEQ ID NO: 4599978 - DNA, 15 bp, Homo sapiens
actgtgaaggaccct

SEQ ID NO: 4599979 - DNA, 16 bp, Homo sapiens
actgtgaaggaccctt

SEQ ID NO: 4599980 - DNA, 16 bp, Homo sapiens
actgtgtattccaaga

SEQ ID NO: 4599981 - DNA, 14 bp, Homo sapiens
actgtttagatgaa

SEQ ID NO: 4599982 - DNA, 13 bp, Homo sapiens
actgtttcaaact

SEQ ID NO: 4599983 - DNA, 22 bp, Homo sapiens
acttaaaaatggtttaaatggt

SEQ ID NO: 4599984 - DNA, 14 bp, Homo sapiens
acttaaataatgtg

SEQ ID NO: 4599985 - DNA, 15 bp, Homo sapiens
acttaaataatgtga

SEQ ID NO: 4599986 - DNA, 13 bp, Homo sapiens
acttaatctaaat

SEQ ID NO: 4599987 - DNA, 16 bp, Homo sapiens
acttaatctaaatgga

SEQ ID NO: 4599988 - DNA, 15 bp, Homo sapiens
acttactgtacatga

SEQ ID NO: 4599989 - DNA, 23 bp, Homo sapiens
acttcccagttcaggagtcccaa

SEQ ID NO: 4599990 - DNA, 18 bp, Homo sapiens
acttcctgtccagctcca

SEQ ID NO: 4599991 - DNA, 19 bp, Homo sapiens
acttgaacccgggaggcag

SEQ ID NO: 4599992 - DNA, 14 bp, Homo sapiens
acttgaagggccag

SEQ ID NO: 4599993 - DNA, 17 bp, Homo sapiens
acttgaagggccagagc

SEQ ID NO: 4599994 - DNA, 21 bp, Homo sapiens
acttggggagttaagacctgg

SEQ ID NO: 4599995 - DNA, 22 bp, Homo sapiens
acttgtccaattaatgaagttg

SEQ ID NO: 4599996 - DNA, 20 bp, Homo sapiens
actttaattaccaacctgtt

SEQ ID NO: 4599997 - DNA, 18 bp, Homo sapiens
actttaccttttttatac

SEQ ID NO: 4599998 - DNA, 22 bp, Homo sapiens
actttaccttttttatacataa

SEQ ID NO: 4599999 - DNA, 12 bp, Homo sapiens
actttatgctaa

SEQ ID NO: 4600000 - DNA, 17 bp, Homo sapiens
actttctcagttttcat

SEQ ID NO: 4600001 - DNA, 12 bp, Homo sapiens
actttgacctct

SEQ ID NO: 4600002 - DNA, 15 bp, Homo sapiens
actttgacctctgca

SEQ ID NO: 4600003 - DNA, 16 bp, Homo sapiens
actttgacctctgcag

SEQ ID NO: 4600004 - DNA, 21 bp, Homo sapiens
actttgactttttgcatttaa

SEQ ID NO: 4600005 - DNA, 14 bp, Homo sapiens
acttttaaactgtg

SEQ ID NO: 4600006 - DNA, 17 bp, Homo sapiens
acttttaaactgtgtac

SEQ ID NO: 4600007 - DNA, 24 bp, Homo sapiens
acttttcttaaaccttcagttatg

SEQ ID NO: 4600008 - DNA, 18 bp, Homo sapiens
actttttaaaaaatgctg

SEQ ID NO: 4600009 - DNA, 17 bp, Homo sapiens
agaaaaaggatgcacag

SEQ ID NO: 4600010 - DNA, 13 bp, Homo sapiens
agaaaatcactta

SEQ ID NO: 4600011 - DNA, 16 bp, Homo sapiens
agaaaatcaggctggc

SEQ ID NO: 4600012 - DNA, 15 bp, Homo sapiens
agaaactggaactct

SEQ ID NO: 4600013 - DNA, 14 bp, Homo sapiens
agaaagaaaatcag

SEQ ID NO: 4600014 - DNA, 18 bp, Homo sapiens
agaaagaaggaagtgaag

SEQ ID NO: 4600015 - DNA, 17 bp, Homo sapiens
agaaagcagaacagtga

SEQ ID NO: 4600016 - DNA, 18 bp, Homo sapiens
agaaagcagaacagtgat

SEQ ID NO: 4600017 - DNA, 19 bp, Homo sapiens
agaaaggcaaccaataaaa

SEQ ID NO: 4600018 - DNA, 14 bp, Homo sapiens
agaaaggggagccc

SEQ ID NO: 4600019 - DNA, 17 bp, Homo sapiens
agctgcactgatgctgc

SEQ ID NO: 4600020 - DNA, 19 bp, Homo sapiens
agctgcactgatgctgccc

SEQ ID NO: 4600021 - DNA, 15 bp, Homo sapiens
agcttatctcctcct

SEQ ID NO: 4600022 - DNA, 16 bp, Homo sapiens
agctttccctgcctct

SEQ ID NO: 4600023 - DNA, 13 bp, Homo sapiens
aggaacagaagga

SEQ ID NO: 4600024 - DNA, 13 bp, Homo sapiens
aggaagtagagga

SEQ ID NO: 4600025 - DNA, 14 bp, Homo sapiens
aggaccagctcagg

SEQ ID NO: 4600026 - DNA, 18 bp, Homo sapiens
aggaccagctcaggacag

SEQ ID NO: 4600027 - DNA, 23 bp, Homo sapiens
aggaccagctcaggacagatgcc

SEQ ID NO: 4600028 - DNA, 18 bp, Homo sapiens
aggagaaactggaactct

SEQ ID NO: 4600029 - DNA, 14 bp, Homo sapiens
aggagaagccagga

SEQ ID NO: 4600030 - DNA, 23 bp, Homo sapiens
aggagaagtcttctatttattta

SEQ ID NO: 4600031 - DNA, 21 bp, Homo sapiens
aggaggattgcttgagcccag

SEQ ID NO: 4600032 - DNA, 23 bp, Homo sapiens
aggaggattgcttgagcccagga

SEQ ID NO: 4600033 - DNA, 14 bp, Homo sapiens
aggagtcccaagga

SEQ ID NO: 4600034 - DNA, 17 bp, Homo sapiens
aggagtcccaaggaaag

SEQ ID NO: 4600035 - DNA, 21 bp, Homo sapiens
aggatacaaaagcatgtgaga

SEQ ID NO: 4600036 - DNA, 14 bp, Homo sapiens
aggatagatgctgg

SEQ ID NO: 4600037 - DNA, 21 bp, Homo sapiens
aggatagatgctggcccaggg

SEQ ID NO: 4600038 - DNA, 22 bp, Homo sapiens
aggatagatgctggcccagggc

SEQ ID NO: 4600039 - DNA, 13 bp, Homo sapiens
aggatcctggaga

SEQ ID NO: 4600040 - DNA, 19 bp, Homo sapiens
aggatgaatgaggtcccag

SEQ ID NO: 4600041 - DNA, 20 bp, Homo sapiens
aggatgaatgaggtcccagg

SEQ ID NO: 4600042 - DNA, 21 bp, Homo sapiens
aggatgcttgtacataatgcg

SEQ ID NO: 4600043 - DNA, 18 bp, Homo sapiens
aggattgcttgagcccag

SEQ ID NO: 4600044 - DNA, 17 bp, Homo sapiens
aggcaatgtcaggaaca

SEQ ID NO: 4600045 - DNA, 23 bp, Homo sapiens
aggcaatgtcaggaacagaagga

SEQ ID NO: 4600046 - DNA, 14 bp, Homo sapiens
aggcagagaatcat

SEQ ID NO: 4600047 - DNA, 22 bp, Homo sapiens
aggcagagaatcatacttagca

SEQ ID NO: 4600048 - DNA, 20 bp, Homo sapiens
aggcagaggttgcagtgagc

SEQ ID NO: 4600049 - DNA, 11 bp, Homo sapiens
aggcagatcca

SEQ ID NO: 4600050 - DNA, 16 bp, Homo sapiens
aggcagatccaggact

SEQ ID NO: 4600051 - DNA, 22 bp, Homo sapiens
aggcagggacctaaagggacta

SEQ ID NO: 4600052 - DNA, 18 bp, Homo sapiens
aggcatttgtttgaactg

SEQ ID NO: 4600053 - DNA, 11 bp, Homo sapiens
aggccaggagt

SEQ ID NO: 4600054 - DNA, 14 bp, Homo sapiens
aggccaggccaccc

SEQ ID NO: 4600055 - DNA, 18 bp, Homo sapiens
aggccaggccaccctgcc

SEQ ID NO: 4600056 - DNA, 20 bp, Homo sapiens
aggccctccctgttccccag

SEQ ID NO: 4600057 - DNA, 23 bp, Homo sapiens
aggccctccctgttccccagaga

SEQ ID NO: 4600058 - DNA, 15 bp, Homo sapiens
aggccgtcaccctgg

SEQ ID NO: 4600059 - DNA, 14 bp, Homo sapiens
aggctacctttgta

SEQ ID NO: 4600060 - DNA, 21 bp, Homo sapiens
aggctgagggtcgtgggaaag

SEQ ID NO: 4600061 - DNA, 14 bp, Homo sapiens
aggcttccacactt

SEQ ID NO: 4600062 - DNA, 17 bp, Homo sapiens
agggaaagccagcctgg

SEQ ID NO: 4600063 - DNA, 17 bp, Homo sapiens
agggacagaggccccag

SEQ ID NO: 4600064 - DNA, 20 bp, Homo sapiens
agggacagaggccccagcct

SEQ ID NO: 4600065 - DNA, 16 bp, Homo sapiens
agggactacctctgtg

SEQ ID NO: 4600066 - DNA, 17 bp, Homo sapiens
agggactacctctgtgc

SEQ ID NO: 4600067 - DNA, 18 bp, Homo sapiens
agggactacctctgtgcc

SEQ ID NO: 4600068 - DNA, 15 bp, Homo sapiens
agggactgaggggag

SEQ ID NO: 4600069 - DNA, 11 bp, Homo sapiens
agggccagagc

SEQ ID NO: 4600070 - DNA, 14 bp, Homo sapiens
agggcccagagccc

SEQ ID NO: 4600071 - DNA, 17 bp, Homo sapiens
agggcccagagcccagc

SEQ ID NO: 4600072 - DNA, 19 bp, Homo sapiens
agggcccagagcccagctc

SEQ ID NO: 4600073 - DNA, 21 bp, Homo sapiens
agggcccagagcccagctcca

SEQ ID NO: 4600074 - DNA, 15 bp, Homo sapiens
aggggaatcagaact

SEQ ID NO: 4600075 - DNA, 18 bp, Homo sapiens
aggggagcatgggaagtg

SEQ ID NO: 4600076 - DNA, 12 bp, Homo sapiens
aggggctggggc

SEQ ID NO: 4600077 - DNA, 12 bp, Homo sapiens
agggtaagtatt

SEQ ID NO: 4600078 - DNA, 14 bp, Homo sapiens
agggtttagtgctt

SEQ ID NO: 4600079 - DNA, 17 bp, Homo sapiens
aggtagaatgttttcaa

SEQ ID NO: 4600080 - DNA, 15 bp, Homo sapiens
aggtcagcatgtcta

SEQ ID NO: 4600081 - DNA, 20 bp, Homo sapiens
aggtcattttttttaagaaa

SEQ ID NO: 4600082 - DNA, 22 bp, Homo sapiens
aggtcattttttttaagaaaaa

SEQ ID NO: 4600083 - DNA, 16 bp, Homo sapiens
aggtctgttctttcca

SEQ ID NO: 4600084 - DNA, 23 bp, Homo sapiens
aggtctgttctttccaaagtaca

SEQ ID NO: 4600085 - DNA, 19 bp, Homo sapiens
aggtgaaactccagatgcc

SEQ ID NO: 4600086 - DNA, 22 bp, Homo sapiens
aggtgaaactccagatgccaca

SEQ ID NO: 4600087 - DNA, 14 bp, Homo sapiens
aggtggacacacaa

SEQ ID NO: 4600088 - DNA, 21 bp, Homo sapiens
aggtgggggaacactgagaaa

SEQ ID NO: 4600089 - DNA, 17 bp, Homo sapiens
aggttcaaagatatttt

SEQ ID NO: 4600090 - DNA, 21 bp, Homo sapiens
agtaaatgggggtgcatttga

SEQ ID NO: 4600091 - DNA, 14 bp, Homo sapiens
agtaatatgcacac

SEQ ID NO: 4600092 - DNA, 15 bp, Homo sapiens
agtaatatgcacaca

SEQ ID NO: 4600093 - DNA, 14 bp, Homo sapiens
agtacactgtttca

SEQ ID NO: 4600094 - DNA, 21 bp, Homo sapiens
agtacactgtttcaaacttta

SEQ ID NO: 4600095 - DNA, 23 bp, Homo sapiens
agtacactgtttcaaactttact

SEQ ID NO: 4600096 - DNA, 14 bp, Homo sapiens
agtacgttgtgcat

SEQ ID NO: 4600097 - DNA, 16 bp, Homo sapiens
agtacgttgtgcattt

SEQ ID NO: 4600098 - DNA, 13 bp, Homo sapiens
agtactcatacat

SEQ ID NO: 4600099 - DNA, 15 bp, Homo sapiens
agtatacctgatttt

SEQ ID NO: 4600100 - DNA, 20 bp, Homo sapiens
agtatgaggcatttgtttga

SEQ ID NO: 4600101 - DNA, 21 bp, Homo sapiens
agtatgaggcatttgtttgaa

SEQ ID NO: 4600102 - DNA, 23 bp, Homo sapiens
agtatgaggcatttgtttgaact

SEQ ID NO: 4600103 - DNA, 15 bp, Homo sapiens
agtcacatcacagga

SEQ ID NO: 4600104 - DNA, 20 bp, Homo sapiens
agtcctggaagccagctttc

SEQ ID NO: 4600105 - DNA, 22 bp, Homo sapiens
agtcctggaagccagctttccc

SEQ ID NO: 4600106 - DNA, 15 bp, Homo sapiens
agtcttcctgacact

SEQ ID NO: 4600107 - DNA, 15 bp, Homo sapiens
agtgaaaactttgta

SEQ ID NO: 4600108 - DNA, 20 bp, Homo sapiens
agtgaacaaatttacagaga

SEQ ID NO: 4600109 - DNA, 23 bp, Homo sapiens
agtgaacaaatttacagagacag

SEQ ID NO: 4600110 - DNA, 16 bp, Homo sapiens
agtgaagacaatgact

SEQ ID NO: 4600111 - DNA, 19 bp, Homo sapiens
agtgaagagggagaaggga

SEQ ID NO: 4600112 - DNA, 14 bp, Homo sapiens
agtgagacagctct

SEQ ID NO: 4600113 - DNA, 16 bp, Homo sapiens
agtgatccttacaagt

SEQ ID NO: 4600114 - DNA, 18 bp, Homo sapiens
agtgattaccagggactg

SEQ ID NO: 4600115 - DNA, 20 bp, Homo sapiens
agtgcaataaatctgaccca

SEQ ID NO: 4600116 - DNA, 20 bp, Homo sapiens
agtgcagcaagcctggcccc

SEQ ID NO: 4600117 - DNA, 13 bp, Homo sapiens
agtgctgcattta

SEQ ID NO: 4600118 - DNA, 16 bp, Homo sapiens
agtgctgcatttaaaa

SEQ ID NO: 4600119 - DNA, 19 bp, Homo sapiens
agtgctgcatttaaaagat

SEQ ID NO: 4600120 - DNA, 22 bp, Homo sapiens
agtggccaagatcacagtggcc

SEQ ID NO: 4600121 - DNA, 21 bp, Homo sapiens
agtgggtggggacagaccagc

SEQ ID NO: 4600122 - DNA, 17 bp, Homo sapiens
agtggtggttttctgtt

SEQ ID NO: 4600123 - DNA, 20 bp, Homo sapiens
agtggtggttttctgttctt

SEQ ID NO: 4600124 - DNA, 21 bp, Homo sapiens
agtggtggttttctgttcttt

SEQ ID NO: 4600125 - DNA, 18 bp, Homo sapiens
agtgtatttttttactaa

SEQ ID NO: 4600126 - DNA, 14 bp, Homo sapiens
agtgtctaaaaaca

SEQ ID NO: 4600127 - DNA, 13 bp, Homo sapiens
agttccactgaga

SEQ ID NO: 4600128 - DNA, 15 bp, Homo sapiens
agttctttgggccag

SEQ ID NO: 4600129 - DNA, 17 bp, Homo sapiens
agttctttgggccagac

SEQ ID NO: 4600130 - DNA, 18 bp, Homo sapiens
agttgatctggaacccag

SEQ ID NO: 4600131 - DNA, 17 bp, Homo sapiens
agttgctgcaaacctga

SEQ ID NO: 4600132 - DNA, 19 bp, Homo sapiens
agttggagggaaagccagc

SEQ ID NO: 4600133 - DNA, 18 bp, Homo sapiens
agttgtaaataatttatt

SEQ ID NO: 4600134 - DNA, 17 bp, Homo sapiens
agttgttatttattgaa

SEQ ID NO: 4600135 - DNA, 18 bp, Homo sapiens
agtttgattaaattcttg

SEQ ID NO: 4600136 - DNA, 20 bp, Homo sapiens
agttttacttttaaactgtg

SEQ ID NO: 4600137 - DNA, 18 bp, Homo sapiens
ataaaaagatcactttct

SEQ ID NO: 4600138 - DNA, 22 bp, Homo sapiens
ataaaaagatcactttctcagt

SEQ ID NO: 4600139 - DNA, 17 bp, Homo sapiens
ataaaactttttaaaat

SEQ ID NO: 4600140 - DNA, 23 bp, Homo sapiens
ataaacaagaccacgtttctaaa

SEQ ID NO: 4600141 - DNA, 13 bp, Homo sapiens
ataaagcagcgtt

SEQ ID NO: 4600142 - DNA, 19 bp, Homo sapiens
ataaagcagcgtttctatg

SEQ ID NO: 4600143 - DNA, 15 bp, Homo sapiens
ataaatctgacccag

SEQ ID NO: 4600144 - DNA, 18 bp, Homo sapiens
ataaatctgacccagtgc

SEQ ID NO: 4600145 - DNA, 15 bp, Homo sapiens
ataactgaaaatgtg

SEQ ID NO: 4600146 - DNA, 15 bp, Homo sapiens
ataagctattttggt

SEQ ID NO: 4600147 - DNA, 20 bp, Homo sapiens
ataagttcaaattcttctga

SEQ ID NO: 4600148 - DNA, 24 bp, Homo sapiens
ataagttcaaattcttctgaactc

SEQ ID NO: 4600149 - DNA, 18 bp, Homo sapiens
atgttggtcattttatgt

SEQ ID NO: 4600150 - DNA, 20 bp, Homo sapiens
atgtttatgcaaggaaggaa

SEQ ID NO: 4600151 - DNA, 22 bp, Homo sapiens
atgtttatgcaaggaaggaaag

SEQ ID NO: 4600152 - DNA, 22 bp, Homo sapiens
attaaaaatctcaaatttctaa

SEQ ID NO: 4600153 - DNA, 23 bp, Homo sapiens
attaaaaatctcaaatttctaaa

SEQ ID NO: 4600154 - DNA, 18 bp, Homo sapiens
attaaaatataatctcta

SEQ ID NO: 4600155 - DNA, 16 bp, Homo sapiens
attaaacttaatctaa

SEQ ID NO: 4600156 - DNA, 21 bp, Homo sapiens
attaaacttaatctaaatgga

SEQ ID NO: 4600157 - DNA, 11 bp, Homo sapiens
attaagaaata

SEQ ID NO: 4600158 - DNA, 14 bp, Homo sapiens
attaatgaagttga

SEQ ID NO: 4600159 - DNA, 14 bp, Homo sapiens
attaccaacctgtt

SEQ ID NO: 4600160 - DNA, 16 bp, Homo sapiens
attaccaacctgttac

SEQ ID NO: 4600161 - DNA, 12 bp, Homo sapiens
attaccagggac

SEQ ID NO: 4600162 - DNA, 20 bp, Homo sapiens
attactgccattcacttcat

SEQ ID NO: 4600163 - DNA, 18 bp, Homo sapiens
attaggtgtgactgaatt

SEQ ID NO: 4600164 - DNA, 14 bp, Homo sapiens
attatctagatact

SEQ ID NO: 4600165 - DNA, 18 bp, Homo sapiens
attatctagatactgtat

SEQ ID NO: 4600166 - DNA, 23 bp, Homo sapiens
attatgcatgaagtaatatgcac

SEQ ID NO: 4600167 - DNA, 16 bp, Homo sapiens
attcaatctgtaaact

SEQ ID NO: 4600168 - DNA, 22 bp, Homo sapiens
attcacagttctttgggccaga

SEQ ID NO: 4600169 - DNA, 19 bp, Homo sapiens
attcatagcagcttattca

SEQ ID NO: 4600170 - DNA, 16 bp, Homo sapiens
attcattctttttgaa

SEQ ID NO: 4600171 - DNA, 22 bp, Homo sapiens
attccaagacatgtctgttcta

SEQ ID NO: 4600172 - DNA, 20 bp, Homo sapiens
attccacttataggaattga

SEQ ID NO: 4600173 - DNA, 14 bp, Homo sapiens
attcctcctgctca

SEQ ID NO: 4600174 - DNA, 16 bp, Homo sapiens
attcctgaagaaccag

SEQ ID NO: 4600175 - DNA, 19 bp, Homo sapiens
attctccttgtgttactaa

SEQ ID NO: 4600176 - DNA, 21 bp, Homo sapiens
attctctcctgtacctcttga

SEQ ID NO: 4600177 - DNA, 18 bp, Homo sapiens
attctgaccttaaatgca

SEQ ID NO: 4600178 - DNA, 20 bp, Homo sapiens
attctgctctaaataaagac

SEQ ID NO: 4600179 - DNA, 14 bp, Homo sapiens
attcttgcaaagta

SEQ ID NO: 4600180 - DNA, 21 bp, Homo sapiens
attcttttgtttatattgttt

SEQ ID NO: 4600181 - DNA, 21 bp, Homo sapiens
attgaattatcttggttgaaa

SEQ ID NO: 4600182 - DNA, 15 bp, Homo sapiens
attgacacttaaaaa

SEQ ID NO: 4600183 - DNA, 17 bp, Homo sapiens
attgataacatggaaat

SEQ ID NO: 4600184 - DNA, 16 bp, Homo sapiens
attgatgttttcatag

SEQ ID NO: 4600185 - DNA, 16 bp, Homo sapiens
attgctgaaattttat

SEQ ID NO: 4600186 - DNA, 19 bp, Homo sapiens
attggctagaggttcaaag

SEQ ID NO: 4600187 - DNA, 20 bp, Homo sapiens
attggctagaggttcaaaga

SEQ ID NO: 4600188 - DNA, 23 bp, Homo sapiens
attggctagaggttcaaagatat

SEQ ID NO: 4600189 - DNA, 13 bp, Homo sapiens
attgtaaaagcat

SEQ ID NO: 4600190 - DNA, 13 bp, Homo sapiens
attgtaaaatggt

SEQ ID NO: 4600191 - DNA, 18 bp, Homo sapiens
attgtgattctgcctttg

SEQ ID NO: 4600192 - DNA, 15 bp, Homo sapiens
atttaaaacagacac

SEQ ID NO: 4600193 - DNA, 16 bp, Homo sapiens
atttaaaacagacact

SEQ ID NO: 4600194 - DNA, 21 bp, Homo sapiens
atttaaaacattaaaatataa

SEQ ID NO: 4600195 - DNA, 13 bp, Homo sapiens
atttaaaagatac

SEQ ID NO: 4600196 - DNA, 19 bp, Homo sapiens
atttaacagaaatgtacag

SEQ ID NO: 4600197 - DNA, 22 bp, Homo sapiens
atttaatggaagtgtatttatt

SEQ ID NO: 4600198 - DNA, 13 bp, Homo sapiens
atttaatttgaag

SEQ ID NO: 4600199 - DNA, 22 bp, Homo sapiens
atttaatttgaaggtagaatgt

SEQ ID NO: 4600200 - DNA, 17 bp, Homo sapiens
atttaggagaagccagg

SEQ ID NO: 4600201 - DNA, 14 bp, Homo sapiens
atttattcattagt

SEQ ID NO: 4600202 - DNA, 13 bp, Homo sapiens
atttattgaaatg

SEQ ID NO: 4600203 - DNA, 12 bp, Homo sapiens
atttatttaata

SEQ ID NO: 4600204 - DNA, 16 bp, Homo sapiens
atttcaagttccaagt

SEQ ID NO: 4600205 - DNA, 16 bp, Homo sapiens
atttcacctgtaaacc

SEQ ID NO: 4600206 - DNA, 19 bp, Homo sapiens
atttcacctgtaaacctga

SEQ ID NO: 4600207 - DNA, 13 bp, Homo sapiens
atttcatctattt

SEQ ID NO: 4600208 - DNA, 13 bp, Homo sapiens
atttcccaggacc

SEQ ID NO: 4600209 - DNA, 14 bp, Homo sapiens
atttcccaggaccc

SEQ ID NO: 4600210 - DNA, 15 bp, Homo sapiens
atttccgttaaaata

SEQ ID NO: 4600211 - DNA, 14 bp, Homo sapiens
atttctaaaaaaca

SEQ ID NO: 4600212 - DNA, 14 bp, Homo sapiens
atttctgtttagat

SEQ ID NO: 4600213 - DNA, 20 bp, Homo sapiens
atttcttttgccgttattaa

SEQ ID NO: 4600214 - DNA, 14 bp, Homo sapiens
atttgaaaattttg

SEQ ID NO: 4600215 - DNA, 15 bp, Homo sapiens
atttgaaaattttga

SEQ ID NO: 4600216 - DNA, 18 bp, Homo sapiens
atttgaaggtagaatgtt

SEQ ID NO: 4600217 - DNA, 18 bp, Homo sapiens
atttgagagaaatatgaa

SEQ ID NO: 4600218 - DNA, 15 bp, Homo sapiens
atttgaggtctgttc

SEQ ID NO: 4600219 - DNA, 17 bp, Homo sapiens
atttgaggtctgttctt

SEQ ID NO: 4600220 - DNA, 18 bp, Homo sapiens
atttgaggtctgttcttt

SEQ ID NO: 4600221 - DNA, 20 bp, Homo sapiens
atttgatgtttacaggtgga

SEQ ID NO: 4600222 - DNA, 13 bp, Homo sapiens
atttgctttggaa

SEQ ID NO: 4600223 - DNA, 14 bp, Homo sapiens
atttgctttggaag

SEQ ID NO: 4600224 - DNA, 21 bp, Homo sapiens
atttgggcctgctccagacct

SEQ ID NO: 4600225 - DNA, 17 bp, Homo sapiens
atttgggggggaataag

SEQ ID NO: 4600226 - DNA, 19 bp, Homo sapiens
atttgggggggaataagat

SEQ ID NO: 4600227 - DNA, 15 bp, Homo sapiens
atttgtgatacaatg

SEQ ID NO: 4600228 - DNA, 20 bp, Homo sapiens
atttgtttctttctctgagg

SEQ ID NO: 4600229 - DNA, 20 bp, Homo sapiens
atttgtttgaactgataaag

SEQ ID NO: 4600230 - DNA, 15 bp, Homo sapiens
attttaaacagagga

SEQ ID NO: 4600231 - DNA, 12 bp, Homo sapiens
attttacaattt

SEQ ID NO: 4600232 - DNA, 22 bp, Homo sapiens
attttacagctcattaaacttt

SEQ ID NO: 4600233 - DNA, 21 bp, Homo sapiens
attttatatcaatttaaaaaa

SEQ ID NO: 4600234 - DNA, 20 bp, Homo sapiens
attttatgttatttatagct

SEQ ID NO: 4600235 - DNA, 17 bp, Homo sapiens
attttattatgcatgaa

SEQ ID NO: 4600236 - DNA, 24 bp, Homo sapiens
attttcaagaataatcacgctttc

SEQ ID NO: 4600237 - DNA, 17 bp, Homo sapiens
attttcagcaaactctt

SEQ ID NO: 4600238 - DNA, 18 bp, Homo sapiens
attttcagcaaactcttt

SEQ ID NO: 4600239 - DNA, 17 bp, Homo sapiens
attttcatgtatatgtg

SEQ ID NO: 4600240 - DNA, 18 bp, Homo sapiens
attttcatgtatatgtgt

SEQ ID NO: 4600241 - DNA, 18 bp, Homo sapiens
attttcctggtgccaatt

SEQ ID NO: 4600242 - DNA, 19 bp, Homo sapiens
attttcctgttgtcaagaa

SEQ ID NO: 4600243 - DNA, 20 bp, Homo sapiens
attttctgtgcctgaatatt

SEQ ID NO: 4600244 - DNA, 21 bp, Homo sapiens
attttctgtgcctgaatattt

SEQ ID NO: 4600245 - DNA, 17 bp, Homo sapiens
attttgatgtaaagatg

SEQ ID NO: 4600246 - DNA, 14 bp, Homo sapiens
attttgctggaata

SEQ ID NO: 4600247 - DNA, 18 bp, Homo sapiens
attttgctttgtgatttt

SEQ ID NO: 4600248 - DNA, 21 bp, Homo sapiens
attttggagagtttcctgaaa

SEQ ID NO: 4600249 - DNA, 22 bp, Homo sapiens
attttggagagtttcctgaaac

SEQ ID NO: 4600250 - DNA, 19 bp, Homo sapiens
attttgtaataataaagaa

SEQ ID NO: 4600251 - DNA, 16 bp, Homo sapiens
attttgtgtaagaaat

SEQ ID NO: 4600252 - DNA, 17 bp, Homo sapiens
attttgtgtaagaaata

SEQ ID NO: 4600253 - DNA, 18 bp, Homo sapiens
atttttaagtgctgcatt

SEQ ID NO: 4600254 - DNA, 22 bp, Homo sapiens
atttttcttagggaaggataca

SEQ ID NO: 4600255 - DNA, 12 bp, Homo sapiens
atttttgcctct

SEQ ID NO: 4600256 - DNA, 18 bp, Homo sapiens
atttttgcctcttccagt

SEQ ID NO: 4600257 - DNA, 21 bp, Homo sapiens
atttttgcctcttccagtctt

SEQ ID NO: 4600258 - DNA, 12 bp, Homo sapiens
atttttgtaatt

SEQ ID NO: 4600259 - DNA, 14 bp, Homo sapiens
attttttaaatgca

SEQ ID NO: 4600260 - DNA, 21 bp, Homo sapiens
attttttaagtgaaaatatag

SEQ ID NO: 4600261 - DNA, 18 bp, Homo sapiens
atttttttactaatagac

SEQ ID NO: 4600262 - DNA, 12 bp, Homo sapiens
caaaacaaaggc

SEQ ID NO: 4600263 - DNA, 17 bp, Homo sapiens
caaaagaagcccccagc

SEQ ID NO: 4600264 - DNA, 18 bp, Homo sapiens
caaaagaagcccccagct

SEQ ID NO: 4600265 - DNA, 16 bp, Homo sapiens
caaaagattgctgaaa

SEQ ID NO: 4600266 - DNA, 19 bp, Homo sapiens
caaaagattgctgaaattt

SEQ ID NO: 4600267 - DNA, 20 bp, Homo sapiens
caaaagattgctgaaatttt

SEQ ID NO: 4600268 - DNA, 12 bp, Homo sapiens
caaaataaaact

SEQ ID NO: 4600269 - DNA, 14 bp, Homo sapiens
caaaataaaacttt

SEQ ID NO: 4600270 - DNA, 16 bp, Homo sapiens
caaagatattttgctt

SEQ ID NO: 4600271 - DNA, 22 bp, Homo sapiens
caaagatattttgctttgtgat

SEQ ID NO: 4600272 - DNA, 21 bp, Homo sapiens
caaagatctgtcctcagcctt

SEQ ID NO: 4600273 - DNA, 11 bp, Homo sapiens
caaataaagtc

SEQ ID NO: 4600274 - DNA, 14 bp, Homo sapiens
caaataaagtctct

SEQ ID NO: 4600275 - DNA, 23 bp, Homo sapiens
caaatatttagatgtaattttgt

SEQ ID NO: 4600276 - DNA, 17 bp, Homo sapiens
caaatggggccagatcc

SEQ ID NO: 4600277 - DNA, 18 bp, Homo sapiens
caaatgttcatcaatgaa

SEQ ID NO: 4600278 - DNA, 15 bp, Homo sapiens
caaattcttctgaac

SEQ ID NO: 4600279 - DNA, 17 bp, Homo sapiens
cagcctggccagacaca

SEQ ID NO: 4600280 - DNA, 20 bp, Homo sapiens
cagcctgggcaacagagcaa

SEQ ID NO: 4600281 - DNA, 19 bp, Homo sapiens
cagcctggggtctggagtt

SEQ ID NO: 4600282 - DNA, 16 bp, Homo sapiens
cagccttgccagagat

SEQ ID NO: 4600283 - DNA, 16 bp, Homo sapiens
cagcgtttctatgaca

SEQ ID NO: 4600284 - DNA, 19 bp, Homo sapiens
cagcgtttctatgacacat

SEQ ID NO: 4600285 - DNA, 14 bp, Homo sapiens
cagctcattaaact

SEQ ID NO: 4600286 - DNA, 17 bp, Homo sapiens
cagctccaacctgcaaa

SEQ ID NO: 4600287 - DNA, 15 bp, Homo sapiens
cagctccctaggaga

SEQ ID NO: 4600288 - DNA, 18 bp, Homo sapiens
cagctccctaggagacca

SEQ ID NO: 4600289 - DNA, 21 bp, Homo sapiens
cagctctggacagccccaccc

SEQ ID NO: 4600290 - DNA, 18 bp, Homo sapiens
cagctgcactgatgctgc

SEQ ID NO: 4600291 - DNA, 12 bp, Homo sapiens
caggaacagaag

SEQ ID NO: 4600292 - DNA, 15 bp, Homo sapiens
caggaacagaaggat

SEQ ID NO: 4600293 - DNA, 18 bp, Homo sapiens
caggaacagaaggatgaa

SEQ ID NO: 4600294 - DNA, 16 bp, Homo sapiens
caggaagtagaggagg

SEQ ID NO: 4600295 - DNA, 18 bp, Homo sapiens
caggaatttcccaggacc

SEQ ID NO: 4600296 - DNA, 19 bp, Homo sapiens
caggaatttcccaggaccc

SEQ ID NO: 4600297 - DNA, 15 bp, Homo sapiens
caggacacggggcag

SEQ ID NO: 4600298 - DNA, 13 bp, Homo sapiens
caggacagatgcc

SEQ ID NO: 4600299 - DNA, 17 bp, Homo sapiens
caggacagatgccacac

SEQ ID NO: 4600300 - DNA, 14 bp, Homo sapiens
caggaccagctcag

SEQ ID NO: 4600301 - DNA, 20 bp, Homo sapiens
caggaccagctcaggacaga

SEQ ID NO: 4600302 - DNA, 13 bp, Homo sapiens
caggaccctgaag

SEQ ID NO: 4600303 - DNA, 14 bp, Homo sapiens
caggaccctgaagg

SEQ ID NO: 4600304 - DNA, 16 bp, Homo sapiens
caggaccctgaagggg

SEQ ID NO: 4600305 - DNA, 17 bp, Homo sapiens
caggaccctgaaggggc

SEQ ID NO: 4600306 - DNA, 17 bp, Homo sapiens
caggagctttggaccta

SEQ ID NO: 4600307 - DNA, 12 bp, Homo sapiens
caggaggctgag

SEQ ID NO: 4600308 - DNA, 15 bp, Homo sapiens
caggaggctgaggca

SEQ ID NO: 4600309 - DNA, 17 bp, Homo sapiens
caggaggctgaggcagg

SEQ ID NO: 4600310 - DNA, 19 bp, Homo sapiens
caggaggctgaggcaggag

SEQ ID NO: 4600311 - DNA, 20 bp, Homo sapiens
caggaggctgaggcaggagg

SEQ ID NO: 4600312 - DNA, 17 bp, Homo sapiens
caggagtcccaaggaaa

SEQ ID NO: 4600313 - DNA, 18 bp, Homo sapiens
caggagtcccaaggaaag

SEQ ID NO: 4600314 - DNA, 23 bp, Homo sapiens
caggcagagaatcatacttagca

SEQ ID NO: 4600315 - DNA, 23 bp, Homo sapiens
caggccctccctgttccccagag

SEQ ID NO: 4600316 - DNA, 22 bp, Homo sapiens
caggccgtcaccctgggagcag

SEQ ID NO: 4600317 - DNA, 15 bp, Homo sapiens
caggcctgtccaaca

SEQ ID NO: 4600318 - DNA, 12 bp, Homo sapiens
caggcttccaca

SEQ ID NO: 4600319 - DNA, 21 bp, Homo sapiens
cagggacctaaagggactacc

SEQ ID NO: 4600320 - DNA, 12 bp, Homo sapiens
cagggcccagag

SEQ ID NO: 4600321 - DNA, 14 bp, Homo sapiens
cagggcccagagcc

SEQ ID NO: 4600322 - DNA, 19 bp, Homo sapiens
cagggcccagagcccagct

SEQ ID NO: 4600323 - DNA, 22 bp, Homo sapiens
cagggcccagagcccagctcca

SEQ ID NO: 4600324 - DNA, 20 bp, Homo sapiens
cagtaaatgggggtgcattt

SEQ ID NO: 4600325 - DNA, 22 bp, Homo sapiens
cagtaaatgggggtgcatttga

SEQ ID NO: 4600326 - DNA, 22 bp, Homo sapiens
cagtacatgggtgactatctcc

SEQ ID NO: 4600327 - DNA, 12 bp, Homo sapiens
cagtatggcagc

SEQ ID NO: 4600328 - DNA, 13 bp, Homo sapiens
cagtccatgaaga

SEQ ID NO: 4600329 - DNA, 18 bp, Homo sapiens
cagtcttcctgacacttt

SEQ ID NO: 4600330 - DNA, 17 bp, Homo sapiens
cagtgattaccagggac

SEQ ID NO: 4600331 - DNA, 17 bp, Homo sapiens
cagtgcagcaagcctgg

SEQ ID NO: 4600332 - DNA, 20 bp, Homo sapiens
cagtgcagcaagcctggccc

SEQ ID NO: 4600333 - DNA, 17 bp, Homo sapiens
cagtgcccccactgacc

SEQ ID NO: 4600334 - DNA, 23 bp, Homo sapiens
cagtgcccccactgaccagaact

SEQ ID NO: 4600335 - DNA, 14 bp, Homo sapiens
cagtggccacggcc

SEQ ID NO: 4600336 - DNA, 21 bp, Homo sapiens
cagtggtggttttctgttctt

SEQ ID NO: 4600337 - DNA, 20 bp, Homo sapiens
cagtgttgtggatttaacag

SEQ ID NO: 4600338 - DNA, 14 bp, Homo sapiens
cagttactcagaat

SEQ ID NO: 4600339 - DNA, 22 bp, Homo sapiens
cagttctttgggccagacatgc

SEQ ID NO: 4600340 - DNA, 22 bp, Homo sapiens
cagttggagggaaagccagcct

SEQ ID NO: 4600341 - DNA, 23 bp, Homo sapiens
cagttggagggaaagccagcctg

SEQ ID NO: 4600342 - DNA, 21 bp, Homo sapiens
cagttgttatttattgaaatg

SEQ ID NO: 4600343 - DNA, 20 bp, Homo sapiens
cataaacaagaccacgtttc

SEQ ID NO: 4600344 - DNA, 22 bp, Homo sapiens
cataaacaagaccacgtttcta

SEQ ID NO: 4600345 - DNA, 13 bp, Homo sapiens
cataagctatttt

SEQ ID NO: 4600346 - DNA, 14 bp, Homo sapiens
cataatgcgtgcat

SEQ ID NO: 4600347 - DNA, 13 bp, Homo sapiens
catacgtacacat

SEQ ID NO: 4600348 - DNA, 16 bp, Homo sapiens
catacgtacacatttt

SEQ ID NO: 4600349 - DNA, 17 bp, Homo sapiens
catacttgaagggccag

SEQ ID NO: 4600350 - DNA, 22 bp, Homo sapiens
catagtttgctttgtttaagca

SEQ ID NO: 4600351 - DNA, 17 bp, Homo sapiens
catattaccacagacat

SEQ ID NO: 4600352 - DNA, 21 bp, Homo sapiens
catattaccacagacatacta

SEQ ID NO: 4600353 - DNA, 17 bp, Homo sapiens
catattgatttccgtta

SEQ ID NO: 4600354 - DNA, 21 bp, Homo sapiens
catattgatttccgttaaaat

SEQ ID NO: 4600355 - DNA, 20 bp, Homo sapiens
catattgtgattctgccttt

SEQ ID NO: 4600356 - DNA, 17 bp, Homo sapiens
catatttaatttgaagg

SEQ ID NO: 4600357 - DNA, 18 bp, Homo sapiens
catattttaaacagagga

SEQ ID NO: 4600358 - DNA, 16 bp, Homo sapiens
catccctttgcccaga

SEQ ID NO: 4600359 - DNA, 18 bp, Homo sapiens
catcctggggttgccctg

SEQ ID NO: 4600360 - DNA, 22 bp, Homo sapiens
catccttcaagaactctgggct

SEQ ID NO: 4600361 - DNA, 20 bp, Homo sapiens
catctcttgaggccaggagt

SEQ ID NO: 4600362 - DNA, 13 bp, Homo sapiens
catgaaaacacat

SEQ ID NO: 4600363 - DNA, 14 bp, Homo sapiens
catgaaaacacatt

SEQ ID NO: 4600364 - DNA, 16 bp, Homo sapiens
catgaaaacacatttt

SEQ ID NO: 4600365 - DNA, 15 bp, Homo sapiens
catgaagtaatatgc

SEQ ID NO: 4600366 - DNA, 22 bp, Homo sapiens
catgaagtaatatgcacacatt

SEQ ID NO: 4600367 - DNA, 22 bp, Homo sapiens
catgaatggtatggaactctct

SEQ ID NO: 4600368 - DNA, 13 bp, Homo sapiens
catgacaaagact

SEQ ID NO: 4600369 - DNA, 24 bp, Homo sapiens
catgaggcaatgtcaggaacagaa

SEQ ID NO: 4600370 - DNA, 20 bp, Homo sapiens
catgatggcaacagatctgg

SEQ ID NO: 4600371 - DNA, 12 bp, Homo sapiens
catgcaaggtca

SEQ ID NO: 4600372 - DNA, 18 bp, Homo sapiens
catgcaaggtcatttttt

SEQ ID NO: 4600373 - DNA, 22 bp, Homo sapiens
catgcaaggtcattttttttaa

SEQ ID NO: 4600374 - DNA, 10 bp, Homo sapiens
catgcactgt

SEQ ID NO: 4600375 - DNA, 17 bp, Homo sapiens
catgcactgtgaaggac

SEQ ID NO: 4600376 - DNA, 20 bp, Homo sapiens
catgcactgtgaaggaccct

SEQ ID NO: 4600377 - DNA, 21 bp, Homo sapiens
catgcatgtcctgtaaaggtt

SEQ ID NO: 4600378 - DNA, 20 bp, Homo sapiens
catgctacacactgcatgtt

SEQ ID NO: 4600379 - DNA, 21 bp, Homo sapiens
catggagggtttagtgcttat

SEQ ID NO: 4600380 - DNA, 18 bp, Homo sapiens
catggatatagttttact

SEQ ID NO: 4600381 - DNA, 21 bp, Homo sapiens
catggcctcttcagatctcta

SEQ ID NO: 4600382 - DNA, 16 bp, Homo sapiens
catggtcggaaaacat

SEQ ID NO: 4600383 - DNA, 17 bp, Homo sapiens
catggtcggaaaacatg

SEQ ID NO: 4600384 - DNA, 15 bp, Homo sapiens
catgtcctgtaaagg

SEQ ID NO: 4600385 - DNA, 16 bp, Homo sapiens
catgttcttaattctt

SEQ ID NO: 4600386 - DNA, 18 bp, Homo sapiens
catgttcttaattcttag

SEQ ID NO: 4600387 - DNA, 14 bp, Homo sapiens
catgtttgtgattg

SEQ ID NO: 4600388 - DNA, 11 bp, Homo sapiens
cattaaacttt

SEQ ID NO: 4600389 - DNA, 19 bp, Homo sapiens
cattataaaataagaaaaa

SEQ ID NO: 4600390 - DNA, 16 bp, Homo sapiens
cattatctagatactg

SEQ ID NO: 4600391 - DNA, 18 bp, Homo sapiens
cattatctagatactgta

SEQ ID NO: 4600392 - DNA, 23 bp, Homo sapiens
cattatctagatactgtatcatg

SEQ ID NO: 4600393 - DNA, 15 bp, Homo sapiens
cattatgttaatatt

SEQ ID NO: 4600394 - DNA, 22 bp, Homo sapiens
cattcacagttctttgggccag

SEQ ID NO: 4600395 - DNA, 11 bp, Homo sapiens
cattcacttca

SEQ ID NO: 4600396 - DNA, 13 bp, Homo sapiens
cattcctgaagaa

SEQ ID NO: 4600397 - DNA, 21 bp, Homo sapiens
cattcctgaagaaccagtccc

SEQ ID NO: 4600398 - DNA, 14 bp, Homo sapiens
cattctttttgaaa

SEQ ID NO: 4600399 - DNA, 20 bp, Homo sapiens
cattgtaaaagcattttgta

SEQ ID NO: 4600400 - DNA, 21 bp, Homo sapiens
cattgtaaaagcattttgtaa

SEQ ID NO: 4600401 - DNA, 23 bp, Homo sapiens
cattgtaaaagcattttgtaata

SEQ ID NO: 4600402 - DNA, 21 bp, Homo sapiens
catttaaaacattaaaatata

SEQ ID NO: 4600403 - DNA, 15 bp, Homo sapiens
catttaaaagataca

SEQ ID NO: 4600404 - DNA, 21 bp, Homo sapiens
catttaaaagatacagttact

SEQ ID NO: 4600405 - DNA, 18 bp, Homo sapiens
catttaaatttttttcct

SEQ ID NO: 4600406 - DNA, 17 bp, Homo sapiens
catttgaaaattttgat

SEQ ID NO: 4600407 - DNA, 14 bp, Homo sapiens
catttgctttggaa

SEQ ID NO: 4600408 - DNA, 23 bp, Homo sapiens
cccttgggtgcggtttgctcagc

SEQ ID NO: 4600409 - DNA, 24 bp, Homo sapiens
cccttgggtgcggtttgctcagcc

SEQ ID NO: 4600410 - DNA, 14 bp, Homo sapiens
ccctttctccagcc

SEQ ID NO: 4600411 - DNA, 17 bp, Homo sapiens
ccctttctccagccctg

SEQ ID NO: 4600412 - DNA, 18 bp, Homo sapiens
ccgactgaccactggcct

SEQ ID NO: 4600413 - DNA, 18 bp, Homo sapiens
ccgtacattcaatgttta

SEQ ID NO: 4600414 - DNA, 12 bp, Homo sapiens
ccgtcaccctgg

SEQ ID NO: 4600415 - DNA, 16 bp, Homo sapiens
ccgtcaccctgggagc

SEQ ID NO: 4600416 - DNA, 13 bp, Homo sapiens
cctaaagggacta

SEQ ID NO: 4600417 - DNA, 23 bp, Homo sapiens
cctaaagggactacctctgtgcc

SEQ ID NO: 4600418 - DNA, 21 bp, Homo sapiens
cctaacaacattgtagcctca

SEQ ID NO: 4600419 - DNA, 22 bp, Homo sapiens
cctaataaacatccttcaagaa

SEQ ID NO: 4600420 - DNA, 14 bp, Homo sapiens
cctaatccaggcag

SEQ ID NO: 4600421 - DNA, 19 bp, Homo sapiens
cctagcatacgtacacatt

SEQ ID NO: 4600422 - DNA, 13 bp, Homo sapiens
cctagttttccat

SEQ ID NO: 4600423 - DNA, 15 bp, Homo sapiens
cctagttttccatgc

SEQ ID NO: 4600424 - DNA, 14 bp, Homo sapiens
cctcaaaacaaagg

SEQ ID NO: 4600425 - DNA, 15 bp, Homo sapiens
cctcaactgcctact

SEQ ID NO: 4600426 - DNA, 16 bp, Homo sapiens
cctcaccttggcacca

SEQ ID NO: 4600427 - DNA, 11 bp, Homo sapiens
cctcagcctgg

SEQ ID NO: 4600428 - DNA, 12 bp, Homo sapiens
cctcagcctggc

SEQ ID NO: 4600429 - DNA, 22 bp, Homo sapiens
cctcagccttgccagagatcca

SEQ ID NO: 4600430 - DNA, 14 bp, Homo sapiens
cctcaggtgacttt

SEQ ID NO: 4600431 - DNA, 20 bp, Homo sapiens
cctcatctctctgcccaacc

SEQ ID NO: 4600432 - DNA, 15 bp, Homo sapiens
cctcccccccatgca

SEQ ID NO: 4600433 - DNA, 19 bp, Homo sapiens
cctcccccccatgcactgt

SEQ ID NO: 4600434 - DNA, 14 bp, Homo sapiens
cctccccctgccag

SEQ ID NO: 4600435 - DNA, 16 bp, Homo sapiens
cctccccctgccagga

SEQ ID NO: 4600436 - DNA, 12 bp, Homo sapiens
cctctccccagc

SEQ ID NO: 4600437 - DNA, 17 bp, Homo sapiens
cctctccccagcccaga

SEQ ID NO: 4600438 - DNA, 18 bp, Homo sapiens
cctctccccagcccagag

SEQ ID NO: 4600439 - DNA, 19 bp, Homo sapiens
cctctcttggaccctggga

SEQ ID NO: 4600440 - DNA, 18 bp, Homo sapiens
cctctgcagcaataaagc

SEQ ID NO: 4600441 - DNA, 16 bp, Homo sapiens
cctctgcctgacagca

SEQ ID NO: 4600442 - DNA, 18 bp, Homo sapiens
cctcttcatggatggggg

SEQ ID NO: 4600443 - DNA, 13 bp, Homo sapiens
cctgaagaaccag

SEQ ID NO: 4600444 - DNA, 17 bp, Homo sapiens
cctgaatccaaactaat

SEQ ID NO: 4600445 - DNA, 20 bp, Homo sapiens
cctgaatccaaactaatcca

SEQ ID NO: 4600446 - DNA, 21 bp, Homo sapiens
cctgaatccaaactaatccat

SEQ ID NO: 4600447 - DNA, 14 bp, Homo sapiens
cctgacactttaat

SEQ ID NO: 4600448 - DNA, 17 bp, Homo sapiens
cctgacagcatcctctc

SEQ ID NO: 4600449 - DNA, 20 bp, Homo sapiens
cctgactaaactaccacctc

SEQ ID NO: 4600450 - DNA, 23 bp, Homo sapiens
cctgactaaactaccacctcagg

SEQ ID NO: 4600451 - DNA, 22 bp, Homo sapiens
cctgagaagtgtctaaaaacac

SEQ ID NO: 4600452 - DNA, 19 bp, Homo sapiens
cctgagtcgtacagaaagc

SEQ ID NO: 4600453 - DNA, 15 bp, Homo sapiens
cctgatcctggaggc

SEQ ID NO: 4600454 - DNA, 19 bp, Homo sapiens
cctgatcctggaggcccag

SEQ ID NO: 4600455 - DNA, 19 bp, Homo sapiens
cctgatttaggagaagcca

SEQ ID NO: 4600456 - DNA, 22 bp, Homo sapiens
cctgatttaggagaagccagga

SEQ ID NO: 4600457 - DNA, 16 bp, Homo sapiens
cctgattttttttcct

SEQ ID NO: 4600458 - DNA, 20 bp, Homo sapiens
cctgcacaataaaaatgttt

SEQ ID NO: 4600459 - DNA, 17 bp, Homo sapiens
cctgcccctgagcccat

SEQ ID NO: 4600460 - DNA, 20 bp, Homo sapiens
cctgcctctcatcaactgaa

SEQ ID NO: 4600461 - DNA, 22 bp, Homo sapiens
cctgcgttttggaagctctgaa

SEQ ID NO: 4600462 - DNA, 15 bp, Homo sapiens
cctgctccagacctg

SEQ ID NO: 4600463 - DNA, 16 bp, Homo sapiens
cctgctccagacctga

SEQ ID NO: 4600464 - DNA, 22 bp, Homo sapiens
cctgctccagacctgatcctgg

SEQ ID NO: 4600465 - DNA, 17 bp, Homo sapiens
cctggaacttggggagt

SEQ ID NO: 4600466 - DNA, 14 bp, Homo sapiens
cctggaggcccagt

SEQ ID NO: 4600467 - DNA, 22 bp, Homo sapiens
cctggcacggtggctcaggcct

SEQ ID NO: 4600468 - DNA, 19 bp, Homo sapiens
cctggcagctctggacagc

SEQ ID NO: 4600469 - DNA, 23 bp, Homo sapiens
cctggcagctctggacagcccca

SEQ ID NO: 4600470 - DNA, 16 bp, Homo sapiens
cctggccagacacagg

SEQ ID NO: 4600471 - DNA, 19 bp, Homo sapiens
cctggccagacacaggccc

SEQ ID NO: 4600472 - DNA, 20 bp, Homo sapiens
cctggcccccgacccagctc

SEQ ID NO: 4600473 - DNA, 21 bp, Homo sapiens
cctggcccccgacccagctct

SEQ ID NO: 4600474 - DNA, 18 bp, Homo sapiens
cctgggggataccagctg

SEQ ID NO: 4600475 - DNA, 13 bp, Homo sapiens
cctgtaaacctga

SEQ ID NO: 4600476 - DNA, 12 bp, Homo sapiens
cctgtacctctt

SEQ ID NO: 4600477 - DNA, 14 bp, Homo sapiens
cctgtccagctcca

SEQ ID NO: 4600478 - DNA, 19 bp, Homo sapiens
cctgtccagctccaacctg

SEQ ID NO: 4600479 - DNA, 17 bp, Homo sapiens
cctgttacctactttga

SEQ ID NO: 4600480 - DNA, 18 bp, Homo sapiens
cctgttacctactttgac

SEQ ID NO: 4600481 - DNA, 18 bp, Homo sapiens
cctgtttcagaggctcag

SEQ ID NO: 4600482 - DNA, 22 bp, Homo sapiens
ccttacaagttagaaaacataa

SEQ ID NO: 4600483 - DNA, 16 bp, Homo sapiens
ccttactcttcttgaa

SEQ ID NO: 4600484 - DNA, 12 bp, Homo sapiens
ccttcagcctga

SEQ ID NO: 4600485 - DNA, 20 bp, Homo sapiens
ccttcagtcttgaatttcta

SEQ ID NO: 4600486 - DNA, 18 bp, Homo sapiens
ccttcagttatgattttt

SEQ ID NO: 4600487 - DNA, 17 bp, Homo sapiens
ccttgaactttgacctc

SEQ ID NO: 4600488 - DNA, 18 bp, Homo sapiens
ccttgccacattaaattg

SEQ ID NO: 4600489 - DNA, 17 bp, Homo sapiens
ccttgctggatgctgct

SEQ ID NO: 4600490 - DNA, 20 bp, Homo sapiens
ccttgctggatgctgctgta

SEQ ID NO: 4600491 - DNA, 16 bp, Homo sapiens
ccttggacattttatg

SEQ ID NO: 4600492 - DNA, 15 bp, Homo sapiens
ccttggcaccagaca

SEQ ID NO: 4600493 - DNA, 21 bp, Homo sapiens
ccttggcaccagacacccagg

SEQ ID NO: 4600494 - DNA, 23 bp, Homo sapiens
ccttggcaccagacacccaggac

SEQ ID NO: 4600495 - DNA, 22 bp, Homo sapiens
ccttggctcaatcctctaagct

SEQ ID NO: 4600496 - DNA, 16 bp, Homo sapiens
cctttgcccagaaaga

SEQ ID NO: 4600497 - DNA, 15 bp, Homo sapiens
cctttgtattctctc

SEQ ID NO: 4600498 - DNA, 24 bp, Homo sapiens
cctttgtattctctcctgtacctc

SEQ ID NO: 4600499 - DNA, 12 bp, Homo sapiens
ccttttttatac

SEQ ID NO: 4600500 - DNA, 15 bp, Homo sapiens
cgacagtgagactct

SEQ ID NO: 4600501 - DNA, 11 bp, Homo sapiens
cgcccaggaga

SEQ ID NO: 4600502 - DNA, 15 bp, Homo sapiens
cggaaaacatgctac

SEQ ID NO: 4600503 - DNA, 18 bp, Homo sapiens
cggccacggccacagtca

SEQ ID NO: 4600504 - DNA, 16 bp, Homo sapiens
cggccagggagaagct

SEQ ID NO: 4600505 - DNA, 20 bp, Homo sapiens
cgggaggcagaggttgcagt

SEQ ID NO: 4600506 - DNA, 15 bp, Homo sapiens
cggtttgctcagccc

SEQ ID NO: 4600507 - DNA, 20 bp, Homo sapiens
cgtaaatacacaacacacac

SEQ ID NO: 4600508 - DNA, 13 bp, Homo sapiens
cgtacacatttta

SEQ ID NO: 4600509 - DNA, 17 bp, Homo sapiens
cgtacattcaatgttta

SEQ ID NO: 4600510 - DNA, 14 bp, Homo sapiens
cgtcaccctgggag

SEQ ID NO: 4600511 - DNA, 14 bp, Homo sapiens
cgtgcataccactt

SEQ ID NO: 4600512 - DNA, 18 bp, Homo sapiens
cgtgcataccacttttgt

SEQ ID NO: 4600513 - DNA, 19 bp, Homo sapiens
cgtgcataccacttttgtt

SEQ ID NO: 4600514 - DNA, 23 bp, Homo sapiens
cgtgcataccacttttgttcttg

SEQ ID NO: 4600515 - DNA, 14 bp, Homo sapiens
cgttaaaaacagat

SEQ ID NO: 4600516 - DNA, 21 bp, Homo sapiens
cgttaaaaacagatttggaaa

SEQ ID NO: 4600517 - DNA, 15 bp, Homo sapiens
cgtttattttcaaga

SEQ ID NO: 4600518 - DNA, 19 bp, Homo sapiens
cgtttctaaaggctacctt

SEQ ID NO: 4600519 - DNA, 20 bp, Homo sapiens
cgtttctatgacacatgcaa

SEQ ID NO: 4600520 - DNA, 14 bp, Homo sapiens
ctaaactaccacct

SEQ ID NO: 4600521 - DNA, 22 bp, Homo sapiens
ctaaagtgtatttttttactaa

SEQ ID NO: 4600522 - DNA, 21 bp, Homo sapiens
ctaaatctccaaaataaaact

SEQ ID NO: 4600523 - DNA, 19 bp, Homo sapiens
ctaaatggtcgcccaggag

SEQ ID NO: 4600524 - DNA, 19 bp, Homo sapiens
ctaaattgttgtaattgca

SEQ ID NO: 4600525 - DNA, 20 bp, Homo sapiens
ctaacaacattgtagcctca

SEQ ID NO: 4600526 - DNA, 14 bp, Homo sapiens
ctaagaacctggaa

SEQ ID NO: 4600527 - DNA, 20 bp, Homo sapiens
ctaagtttttatggcttttg

SEQ ID NO: 4600528 - DNA, 23 bp, Homo sapiens
ctaatccaggcagatccaggact

SEQ ID NO: 4600529 - DNA, 19 bp, Homo sapiens
ctaattggcctctttaaga

SEQ ID NO: 4600530 - DNA, 22 bp, Homo sapiens
ctaattttccataagctatttt

SEQ ID NO: 4600531 - DNA, 13 bp, Homo sapiens
ctacacactgcat

SEQ ID NO: 4600532 - DNA, 15 bp, Homo sapiens
ctacacactgcatgt

SEQ ID NO: 4600533 - DNA, 13 bp, Homo sapiens
ctacattctgtta

SEQ ID NO: 4600534 - DNA, 17 bp, Homo sapiens
ctaccacctcaggtgac

SEQ ID NO: 4600535 - DNA, 14 bp, Homo sapiens
ctacctctgtgcct

SEQ ID NO: 4600536 - DNA, 17 bp, Homo sapiens
ctacctttgtattctct

SEQ ID NO: 4600537 - DNA, 21 bp, Homo sapiens
ctactgtaatttgtgatacaa

SEQ ID NO: 4600538 - DNA, 16 bp, Homo sapiens
ctgcctgccagctgca

SEQ ID NO: 4600539 - DNA, 20 bp, Homo sapiens
ctgcctgccagctgcactga

SEQ ID NO: 4600540 - DNA, 18 bp, Homo sapiens
ctgctcagtaaagcactt

SEQ ID NO: 4600541 - DNA, 19 bp, Homo sapiens
ctgctcatattgtgattct

SEQ ID NO: 4600542 - DNA, 20 bp, Homo sapiens
ctgcttaacttcacatattg

SEQ ID NO: 4600543 - DNA, 12 bp, Homo sapiens
ctggaacctcag

SEQ ID NO: 4600544 - DNA, 15 bp, Homo sapiens
ctggaacctcagcct

SEQ ID NO: 4600545 - DNA, 20 bp, Homo sapiens
ctggaacctcagcctggcca

SEQ ID NO: 4600546 - DNA, 23 bp, Homo sapiens
ctggaacctcagcctggccagac

SEQ ID NO: 4600547 - DNA, 14 bp, Homo sapiens
ctggaacttgggga

SEQ ID NO: 4600548 - DNA, 16 bp, Homo sapiens
ctggaagccagctttc

SEQ ID NO: 4600549 - DNA, 14 bp, Homo sapiens
ctggaataagttca

SEQ ID NO: 4600550 - DNA, 19 bp, Homo sapiens
ctggacagccccaccctgg

SEQ ID NO: 4600551 - DNA, 12 bp, Homo sapiens
ctggagaagtgg

SEQ ID NO: 4600552 - DNA, 23 bp, Homo sapiens
ctggagaagtgggtggggacaga

SEQ ID NO: 4600553 - DNA, 13 bp, Homo sapiens
ctggagctctgcc

SEQ ID NO: 4600554 - DNA, 16 bp, Homo sapiens
ctggagctctgcccat

SEQ ID NO: 4600555 - DNA, 21 bp, Homo sapiens
ctggaggcccagttcaccctg

SEQ ID NO: 4600556 - DNA, 22 bp, Homo sapiens
ctggagttgatctggaacccag

SEQ ID NO: 4600557 - DNA, 21 bp, Homo sapiens
ctggcagctctggacagcccc

SEQ ID NO: 4600558 - DNA, 13 bp, Homo sapiens
ctggccagacaca

SEQ ID NO: 4600559 - DNA, 17 bp, Homo sapiens
ctggccagacacaggcc

SEQ ID NO: 4600560 - DNA, 11 bp, Homo sapiens
ctggcccaggg

SEQ ID NO: 4600561 - DNA, 19 bp, Homo sapiens
ctggcccagggcccagagc

SEQ ID NO: 4600562 - DNA, 21 bp, Homo sapiens
ctggcccagggcccagagccc

SEQ ID NO: 4600563 - DNA, 22 bp, Homo sapiens
ctggcccagggcccagagccca

SEQ ID NO: 4600564 - DNA, 16 bp, Homo sapiens
ctggcccccgacccag

SEQ ID NO: 4600565 - DNA, 20 bp, Homo sapiens
ctggcccccgacccagctct

SEQ ID NO: 4600566 - DNA, 21 bp, Homo sapiens
ctggcctacccctttctccag

SEQ ID NO: 4600567 - DNA, 23 bp, Homo sapiens
ctggcctacccctttctccagcc

SEQ ID NO: 4600568 - DNA, 14 bp, Homo sapiens
ctggcctagcatac

SEQ ID NO: 4600569 - DNA, 15 bp, Homo sapiens
ctggctatgcatttg

SEQ ID NO: 4600570 - DNA, 22 bp, Homo sapiens
ctggctatgcatttgaaaattt

SEQ ID NO: 4600571 - DNA, 15 bp, Homo sapiens
ctgggcaacagagca

SEQ ID NO: 4600572 - DNA, 18 bp, Homo sapiens
ctgggcaacagagcaaga

SEQ ID NO: 4600573 - DNA, 13 bp, Homo sapiens
ctgggcctgcaga

SEQ ID NO: 4600574 - DNA, 18 bp, Homo sapiens
ctggggccaaataaagtc

SEQ ID NO: 4600575 - DNA, 19 bp, Homo sapiens
ctggggccaaataaagtct

SEQ ID NO: 4600576 - DNA, 18 bp, Homo sapiens
ctgggggataccagctga

SEQ ID NO: 4600577 - DNA, 20 bp, Homo sapiens
ctggggttgccctgggggat

SEQ ID NO: 4600578 - DNA, 15 bp, Homo sapiens
ctgggtacttcttga

SEQ ID NO: 4600579 - DNA, 23 bp, Homo sapiens
ctgggtacttcttgaaggtgctg

SEQ ID NO: 4600580 - DNA, 20 bp, Homo sapiens
ctgtaaactgtgtattccaa

SEQ ID NO: 4600581 - DNA, 23 bp, Homo sapiens
ctgtaatcacagctacttgggag

SEQ ID NO: 4600582 - DNA, 15 bp, Homo sapiens
ctgtaatttgtgata

SEQ ID NO: 4600583 - DNA, 17 bp, Homo sapiens
ctgtaatttgtgataca

SEQ ID NO: 4600584 - DNA, 21 bp, Homo sapiens
ctgtacatgaaaacacatttt

SEQ ID NO: 4600585 - DNA, 21 bp, Homo sapiens
ctgtacctcttgagccttgaa

SEQ ID NO: 4600586 - DNA, 22 bp, Homo sapiens
ctgtacctcttgagccttgaac

SEQ ID NO: 4600587 - DNA, 20 bp, Homo sapiens
ctgtagtcctagccactcag

SEQ ID NO: 4600588 - DNA, 22 bp, Homo sapiens
ctgtagtcctagccactcagga

SEQ ID NO: 4600589 - DNA, 13 bp, Homo sapiens
ctgtcaaggctca

SEQ ID NO: 4600590 - DNA, 14 bp, Homo sapiens
ctgtccagctccaa

SEQ ID NO: 4600591 - DNA, 21 bp, Homo sapiens
ctgtccagctccaacctgcaa

SEQ ID NO: 4600592 - DNA, 15 bp, Homo sapiens
ctgtcctattatatt

SEQ ID NO: 4600593 - DNA, 18 bp, Homo sapiens
ctgtcctgggcctgcaga

SEQ ID NO: 4600594 - DNA, 15 bp, Homo sapiens
ctgtcgttaaaaaca

SEQ ID NO: 4600595 - DNA, 18 bp, Homo sapiens
ctgtctctactaaaaata

SEQ ID NO: 4600596 - DNA, 23 bp, Homo sapiens
ctgtgccttgccacattaaattg

SEQ ID NO: 4600597 - DNA, 20 bp, Homo sapiens
ctgtggggctaggggctggg

SEQ ID NO: 4600598 - DNA, 17 bp, Homo sapiens
ctgtgtaaatgctccag

SEQ ID NO: 4600599 - DNA, 19 bp, Homo sapiens
ctgtgtattccaagacatg

SEQ ID NO: 4600600 - DNA, 12 bp, Homo sapiens
ctgtgtttagct

SEQ ID NO: 4600601 - DNA, 16 bp, Homo sapiens
ctgtgtttagctattt

SEQ ID NO: 4600602 - DNA, 19 bp, Homo sapiens
ctgttacactttttggaag

SEQ ID NO: 4600603 - DNA, 19 bp, Homo sapiens
ctgttatgctgtgacacat

SEQ ID NO: 4600604 - DNA, 16 bp, Homo sapiens
ctgttctttccaaagt

SEQ ID NO: 4600605 - DNA, 21 bp, Homo sapiens
ctgttctttccaaagtacact

SEQ ID NO: 4600606 - DNA, 17 bp, Homo sapiens
ctgtttcaaactttact

SEQ ID NO: 4600607 - DNA, 13 bp, Homo sapiens
ctgtttttcacat

SEQ ID NO: 4600608 - DNA, 13 bp, Homo sapiens
cttaaaaatggtt

SEQ ID NO: 4600609 - DNA, 21 bp, Homo sapiens
cttaaaaatggtttaaatggt

SEQ ID NO: 4600610 - DNA, 22 bp, Homo sapiens
cttaaatgcaaccatttgaaac

SEQ ID NO: 4600611 - DNA, 16 bp, Homo sapiens
cttaacttcacatatt

SEQ ID NO: 4600612 - DNA, 16 bp, Homo sapiens
cttaatctaaatggaa

SEQ ID NO: 4600613 - DNA, 18 bp, Homo sapiens
cttaccctcatgttctta

SEQ ID NO: 4600614 - DNA, 19 bp, Homo sapiens
cttaccctcatgttcttaa

SEQ ID NO: 4600615 - DNA, 19 bp, Homo sapiens
cttacctttttatttgcat

SEQ ID NO: 4600616 - DNA, 19 bp, Homo sapiens
cttactagtttcccttgca

SEQ ID NO: 4600617 - DNA, 19 bp, Homo sapiens
cttactcttcttgaaattt

SEQ ID NO: 4600618 - DNA, 16 bp, Homo sapiens
cttactgtacatgaaa

SEQ ID NO: 4600619 - DNA, 22 bp, Homo sapiens
cttagctcattctccttgtgtt

SEQ ID NO: 4600620 - DNA, 21 bp, Homo sapiens
cttagggaaggatacaaaagc

SEQ ID NO: 4600621 - DNA, 19 bp, Homo sapiens
cttataggaattgacccac

SEQ ID NO: 4600622 - DNA, 17 bp, Homo sapiens
cttattggaactctgct

SEQ ID NO: 4600623 - DNA, 21 bp, Homo sapiens
cttcaaaagtttgtttgctta

SEQ ID NO: 4600624 - DNA, 14 bp, Homo sapiens
cttcacatattgat

SEQ ID NO: 4600625 - DNA, 17 bp, Homo sapiens
cttcagttatgattttt

SEQ ID NO: 4600626 - DNA, 13 bp, Homo sapiens
cttcatggatggg

SEQ ID NO: 4600627 - DNA, 16 bp, Homo sapiens
cttcctgacactttaa

SEQ ID NO: 4600628 - DNA, 17 bp, Homo sapiens
cttcctgacactttaat

SEQ ID NO: 4600629 - DNA, 16 bp, Homo sapiens
cttcctgtccagctcc

SEQ ID NO: 4600630 - DNA, 16 bp, Homo sapiens
cttcctgtttttcaca

SEQ ID NO: 4600631 - DNA, 23 bp, Homo sapiens
cttcctgtttttcacattttcct

SEQ ID NO: 4600632 - DNA, 15 bp, Homo sapiens
cttcgtttattttca

SEQ ID NO: 4600633 - DNA, 22 bp, Homo sapiens
cttctatttatttatttattca

SEQ ID NO: 4600634 - DNA, 14 bp, Homo sapiens
cttctcatgatcca

SEQ ID NO: 4600635 - DNA, 22 bp, Homo sapiens
cttctgaactcaaactgaggaa

SEQ ID NO: 4600636 - DNA, 18 bp, Homo sapiens
cttctgagctatttcatc

SEQ ID NO: 4600637 - DNA, 15 bp, Homo sapiens
cttctgggcctctct

SEQ ID NO: 4600638 - DNA, 22 bp, Homo sapiens
cttctgggcttcatctggcaac

SEQ ID NO: 4600639 - DNA, 12 bp, Homo sapiens
cttcttgaaggt

SEQ ID NO: 4600640 - DNA, 14 bp, Homo sapiens
cttgaacccgggag

SEQ ID NO: 4600641 - DNA, 20 bp, Homo sapiens
cttgaacccgggaggcagag

SEQ ID NO: 4600642 - DNA, 13 bp, Homo sapiens
cttgaagggccag

SEQ ID NO: 4600643 - DNA, 14 bp, Homo sapiens
cttgaagggccaga

SEQ ID NO: 4600644 - DNA, 18 bp, Homo sapiens
cttgaagggccagagcca

SEQ ID NO: 4600645 - DNA, 21 bp, Homo sapiens
cttgaagggccagagccaggg

SEQ ID NO: 4600646 - DNA, 14 bp, Homo sapiens
cttgaaggtgctga

SEQ ID NO: 4600647 - DNA, 13 bp, Homo sapiens
cttgagcccagga

SEQ ID NO: 4600648 - DNA, 14 bp, Homo sapiens
cttgagcccaggag

SEQ ID NO: 4600649 - DNA, 22 bp, Homo sapiens
cttgagccttgaactttgacct

SEQ ID NO: 4600650 - DNA, 12 bp, Homo sapiens
cttgatttttgc

SEQ ID NO: 4600651 - DNA, 12 bp, Homo sapiens
cttgcaaagtat

SEQ ID NO: 4600652 - DNA, 23 bp, Homo sapiens
cttgccagagatccaaaagaagc

SEQ ID NO: 4600653 - DNA, 18 bp, Homo sapiens
cttggacattttatgtct

SEQ ID NO: 4600654 - DNA, 20 bp, Homo sapiens
cttggcaccagacacccagg

SEQ ID NO: 4600655 - DNA, 21 bp, Homo sapiens
cttggctcaatcctctaagct

SEQ ID NO: 4600656 - DNA, 16 bp, Homo sapiens
cttggctgtggggcta

SEQ ID NO: 4600657 - DNA, 19 bp, Homo sapiens
cttgggagctcatccctct

SEQ ID NO: 4600658 - DNA, 21 bp, Homo sapiens
cttgggagctcatccctctca

SEQ ID NO: 4600659 - DNA, 22 bp, Homo sapiens
cttggggagttaagacctggca

SEQ ID NO: 4600660 - DNA, 23 bp, Homo sapiens
cttggggagttaagacctggcag

SEQ ID NO: 4600661 - DNA, 15 bp, Homo sapiens
cttggtaagaagccg

SEQ ID NO: 4600662 - DNA, 23 bp, Homo sapiens
cttggtctcagtgtcaatgcagc

SEQ ID NO: 4600663 - DNA, 14 bp, Homo sapiens
cttggtttgtaaat

SEQ ID NO: 4600664 - DNA, 17 bp, Homo sapiens
cttgtaactaaaataat

SEQ ID NO: 4600665 - DNA, 22 bp, Homo sapiens
cttgtaactaaaataattttgt

SEQ ID NO: 4600666 - DNA, 22 bp, Homo sapiens
ctttaatgatatgcttgtaact

SEQ ID NO: 4600667 - DNA, 17 bp, Homo sapiens
gactaaactaccacctc

SEQ ID NO: 4600668 - DNA, 16 bp, Homo sapiens
gactacctctgtgcct

SEQ ID NO: 4600669 - DNA, 19 bp, Homo sapiens
gactacctctgtgccttgc

SEQ ID NO: 4600670 - DNA, 22 bp, Homo sapiens
gactacctctgtgccttgccac

SEQ ID NO: 4600671 - DNA, 13 bp, Homo sapiens
gactatctcccct

SEQ ID NO: 4600672 - DNA, 15 bp, Homo sapiens
gactatctcccctgt

SEQ ID NO: 4600673 - DNA, 22 bp, Homo sapiens
gactcccattcctgaagaacca

SEQ ID NO: 4600674 - DNA, 23 bp, Homo sapiens
gactcccattcctgaagaaccag

SEQ ID NO: 4600675 - DNA, 14 bp, Homo sapiens
gactgaatttcttt

SEQ ID NO: 4600676 - DNA, 16 bp, Homo sapiens
gactgaggggagggga

SEQ ID NO: 4600677 - DNA, 21 bp, Homo sapiens
gacttcctgtccagctccaac

SEQ ID NO: 4600678 - DNA, 22 bp, Homo sapiens
gacttcctgtccagctccaacc

SEQ ID NO: 4600679 - DNA, 23 bp, Homo sapiens
gactttttaaaaaatgctgggtt

SEQ ID NO: 4600680 - DNA, 12 bp, Homo sapiens
gagaagccagga

SEQ ID NO: 4600681 - DNA, 19 bp, Homo sapiens
gagaagctcctctccccag

SEQ ID NO: 4600682 - DNA, 16 bp, Homo sapiens
gagaagtgggtgggga

SEQ ID NO: 4600683 - DNA, 21 bp, Homo sapiens
gagaatcatacttagcaaagt

SEQ ID NO: 4600684 - DNA, 17 bp, Homo sapiens
gagacagactagaagtt

SEQ ID NO: 4600685 - DNA, 13 bp, Homo sapiens
gagacagctctgc

SEQ ID NO: 4600686 - DNA, 18 bp, Homo sapiens
gagaccaaggcgggagca

SEQ ID NO: 4600687 - DNA, 21 bp, Homo sapiens
gagatccaaaagaagccccca

SEQ ID NO: 4600688 - DNA, 24 bp, Homo sapiens
gagcctctgcctgacagcatcctc

SEQ ID NO: 4600689 - DNA, 22 bp, Homo sapiens
gagccttgaactttgacctctg

SEQ ID NO: 4600690 - DNA, 14 bp, Homo sapiens
gagctcatccctct

SEQ ID NO: 4600691 - DNA, 14 bp, Homo sapiens
gaggagaaactgga

SEQ ID NO: 4600692 - DNA, 19 bp, Homo sapiens
gaggagggggcaggctgag

SEQ ID NO: 4600693 - DNA, 18 bp, Homo sapiens
gaggattgcttgagccca

SEQ ID NO: 4600694 - DNA, 19 bp, Homo sapiens
gaggattgcttgagcccag

SEQ ID NO: 4600695 - DNA, 21 bp, Homo sapiens
gaggcaatgtcaggaacagaa

SEQ ID NO: 4600696 - DNA, 23 bp, Homo sapiens
gaggcaatgtcaggaacagaagg

SEQ ID NO: 4600697 - DNA, 23 bp, Homo sapiens
gaggcaggaggattgcttgagcc

SEQ ID NO: 4600698 - DNA, 12 bp, Homo sapiens
gaggccaggagt

SEQ ID NO: 4600699 - DNA, 12 bp, Homo sapiens
gaggccccagcc

SEQ ID NO: 4600700 - DNA, 18 bp, Homo sapiens
gaggctgagatgggagaa

SEQ ID NO: 4600701 - DNA, 13 bp, Homo sapiens
gaggctgaggcag

SEQ ID NO: 4600702 - DNA, 16 bp, Homo sapiens
gaggctgaggcaggag

SEQ ID NO: 4600703 - DNA, 18 bp, Homo sapiens
gagggaaagccagcctgg

SEQ ID NO: 4600704 - DNA, 13 bp, Homo sapiens
gagggagaaggga

SEQ ID NO: 4600705 - DNA, 22 bp, Homo sapiens
gagggtcgtgggaaaggggagt

SEQ ID NO: 4600706 - DNA, 14 bp, Homo sapiens
gaggtctgttcttt

SEQ ID NO: 4600707 - DNA, 16 bp, Homo sapiens
gagtacgttgtgcatt

SEQ ID NO: 4600708 - DNA, 15 bp, Homo sapiens
gagtcccaaggaaag

SEQ ID NO: 4600709 - DNA, 16 bp, Homo sapiens
gagtcccaaggaaagc

SEQ ID NO: 4600710 - DNA, 19 bp, Homo sapiens
gagtgaacaaatttacaga

SEQ ID NO: 4600711 - DNA, 22 bp, Homo sapiens
gagtgaacaaatttacagagac

SEQ ID NO: 4600712 - DNA, 23 bp, Homo sapiens
gagtgaacaaatttacagagaca

SEQ ID NO: 4600713 - DNA, 14 bp, Homo sapiens
gagtgagacagact

SEQ ID NO: 4600714 - DNA, 14 bp, Homo sapiens
gagttaagacctgg

SEQ ID NO: 4600715 - DNA, 21 bp, Homo sapiens
gagttaagacctggcagctct

SEQ ID NO: 4600716 - DNA, 19 bp, Homo sapiens
gagttgatactacagtttg

SEQ ID NO: 4600717 - DNA, 20 bp, Homo sapiens
gagttgatctggaacccaga

SEQ ID NO: 4600718 - DNA, 21 bp, Homo sapiens
gagttgatctggaacccagac

SEQ ID NO: 4600719 - DNA, 16 bp, Homo sapiens
gagttgttacattttt

SEQ ID NO: 4600720 - DNA, 13 bp, Homo sapiens
gataaacagtagt

SEQ ID NO: 4600721 - DNA, 21 bp, Homo sapiens
gataatacaccactacattct

SEQ ID NO: 4600722 - DNA, 24 bp, Homo sapiens
gataatacaccactacattctgtt

SEQ ID NO: 4600723 - DNA, 17 bp, Homo sapiens
gatacaaaagcatgtga

SEQ ID NO: 4600724 - DNA, 23 bp, Homo sapiens
gatacagttactcagaattctct

SEQ ID NO: 4600725 - DNA, 16 bp, Homo sapiens
gatactacagtttgtt

SEQ ID NO: 4600726 - DNA, 16 bp, Homo sapiens
gatagatgctggccca

SEQ ID NO: 4600727 - DNA, 18 bp, Homo sapiens
gatagatgctggcccagg

SEQ ID NO: 4600728 - DNA, 21 bp, Homo sapiens
gatcacagtggccacggccac

SEQ ID NO: 4600729 - DNA, 15 bp, Homo sapiens
gatcatccctttggt

SEQ ID NO: 4600730 - DNA, 23 bp, Homo sapiens
gatccaaaagaagcccccagcta

SEQ ID NO: 4600731 - DNA, 21 bp, Homo sapiens
gatccagcctggggtctggag

SEQ ID NO: 4600732 - DNA, 22 bp, Homo sapiens
gatccagggacagaggccccag

SEQ ID NO: 4600733 - DNA, 13 bp, Homo sapiens
gatccctcccccc

SEQ ID NO: 4600734 - DNA, 21 bp, Homo sapiens
gatccctcccccccatgcact

SEQ ID NO: 4600735 - DNA, 17 bp, Homo sapiens
gatcctggaggcccagt

SEQ ID NO: 4600736 - DNA, 14 bp, Homo sapiens
gatctggaacccag

SEQ ID NO: 4600737 - DNA, 20 bp, Homo sapiens
gatctggaacccagactcag

SEQ ID NO: 4600738 - DNA, 21 bp, Homo sapiens
gatctggaacctcagcctggc

SEQ ID NO: 4600739 - DNA, 15 bp, Homo sapiens
gatctgtcctcagcc

SEQ ID NO: 4600740 - DNA, 16 bp, Homo sapiens
gatctgtcctcagcct

SEQ ID NO: 4600741 - DNA, 17 bp, Homo sapiens
gatctgtcctcagcctt

SEQ ID NO: 4600742 - DNA, 23 bp, Homo sapiens
gatgaatgaggtcccaggcagag

SEQ ID NO: 4600743 - DNA, 13 bp, Homo sapiens
gatgaggcaaccc

SEQ ID NO: 4600744 - DNA, 16 bp, Homo sapiens
gatgagtgagcatgcc

SEQ ID NO: 4600745 - DNA, 13 bp, Homo sapiens
gatgctgcccctc

SEQ ID NO: 4600746 - DNA, 16 bp, Homo sapiens
gatgctggcccagggc

SEQ ID NO: 4600747 - DNA, 22 bp, Homo sapiens
gatgctggcccagggcccagag

SEQ ID NO: 4600748 - DNA, 16 bp, Homo sapiens
gatgcttgtacataat

SEQ ID NO: 4600749 - DNA, 21 bp, Homo sapiens
gatggcaacagatctggaacc

SEQ ID NO: 4600750 - DNA, 20 bp, Homo sapiens
gatgggggaactcagatcca

SEQ ID NO: 4600751 - DNA, 22 bp, Homo sapiens
gatgggggaactcagatccagg

SEQ ID NO: 4600752 - DNA, 17 bp, Homo sapiens
gatggttttaaactttc

SEQ ID NO: 4600753 - DNA, 13 bp, Homo sapiens
gatgtaaagatgt

SEQ ID NO: 4600754 - DNA, 14 bp, Homo sapiens
gatgtaaagatgtt

SEQ ID NO: 4600755 - DNA, 18 bp, Homo sapiens
gatgttctggataccatt

SEQ ID NO: 4600756 - DNA, 19 bp, Homo sapiens
gatgttgaaaaagttctgc

SEQ ID NO: 4600757 - DNA, 14 bp, Homo sapiens
gattcaatctgtaa

SEQ ID NO: 4600758 - DNA, 12 bp, Homo sapiens
gattcatattta

SEQ ID NO: 4600759 - DNA, 21 bp, Homo sapiens
gattctgaccttaaatgcaac

SEQ ID NO: 4600760 - DNA, 23 bp, Homo sapiens
gattgaagtattttgctggaata

SEQ ID NO: 4600761 - DNA, 23 bp, Homo sapiens
gattgtaatatgtaaatggtatg

SEQ ID NO: 4600762 - DNA, 13 bp, Homo sapiens
gatttaacagaaa

SEQ ID NO: 4600763 - DNA, 17 bp, Homo sapiens
gatttaacagaaatgta

SEQ ID NO: 4600764 - DNA, 19 bp, Homo sapiens
gatttctgtttagataata

SEQ ID NO: 4600765 - DNA, 21 bp, Homo sapiens
gatttctgtttagataataca

SEQ ID NO: 4600766 - DNA, 21 bp, Homo sapiens
gcaaacctgacccctgctcag

SEQ ID NO: 4600767 - DNA, 16 bp, Homo sapiens
gcaaagtataaaatta

SEQ ID NO: 4600768 - DNA, 14 bp, Homo sapiens
gcaacaatttatga

SEQ ID NO: 4600769 - DNA, 12 bp, Homo sapiens
gcaacagatctg

SEQ ID NO: 4600770 - DNA, 13 bp, Homo sapiens
gcaacagatctgg

SEQ ID NO: 4600771 - DNA, 18 bp, Homo sapiens
gcaacagatctggaacct

SEQ ID NO: 4600772 - DNA, 23 bp, Homo sapiens
gcaaccgtctgttatgctgtgac

SEQ ID NO: 4600773 - DNA, 13 bp, Homo sapiens
gcaaggaaggaaa

SEQ ID NO: 4600774 - DNA, 11 bp, Homo sapiens
gcaataaagca

SEQ ID NO: 4600775 - DNA, 21 bp, Homo sapiens
gcaataaagcagcgtttctat

SEQ ID NO: 4600776 - DNA, 19 bp, Homo sapiens
gcaataaatctgacccagt

SEQ ID NO: 4600777 - DNA, 20 bp, Homo sapiens
gcaatgtcaggaacagaagg

SEQ ID NO: 4600778 - DNA, 11 bp, Homo sapiens
gcacacatttt

SEQ ID NO: 4600779 - DNA, 21 bp, Homo sapiens
gcacatcagcacgatttctgt

SEQ ID NO: 4600780 - DNA, 15 bp, Homo sapiens
gcacatctgttttgt

SEQ ID NO: 4600781 - DNA, 23 bp, Homo sapiens
gcaccactgcactccagcctggg

SEQ ID NO: 4600782 - DNA, 14 bp, Homo sapiens
gcaccagacaccca

SEQ ID NO: 4600783 - DNA, 18 bp, Homo sapiens
gcaccagacacccaggac

SEQ ID NO: 4600784 - DNA, 21 bp, Homo sapiens
gcaccagacacccaggactta

SEQ ID NO: 4600785 - DNA, 18 bp, Homo sapiens
gcacccatcatgccacac

SEQ ID NO: 4600786 - DNA, 13 bp, Homo sapiens
gcacgatttctgt

SEQ ID NO: 4600787 - DNA, 16 bp, Homo sapiens
gcactccagcctgggc

SEQ ID NO: 4600788 - DNA, 19 bp, Homo sapiens
gcactgatgctgcccctca

SEQ ID NO: 4600789 - DNA, 11 bp, Homo sapiens
gcactgtgaag

SEQ ID NO: 4600790 - DNA, 18 bp, Homo sapiens
gcagaacagtgattacca

SEQ ID NO: 4600791 - DNA, 20 bp, Homo sapiens
gcagagaatcatacttagca

SEQ ID NO: 4600792 - DNA, 18 bp, Homo sapiens
gcagaggttgcagtgagc

SEQ ID NO: 4600793 - DNA, 14 bp, Homo sapiens
gcagatccaggact

SEQ ID NO: 4600794 - DNA, 21 bp, Homo sapiens
gcagattttcagcaaactctt

SEQ ID NO: 4600795 - DNA, 23 bp, Homo sapiens
gcaggctgagggtcgtgggaaag

SEQ ID NO: 4600796 - DNA, 15 bp, Homo sapiens
gcataccacttttgt

SEQ ID NO: 4600797 - DNA, 16 bp, Homo sapiens
gcataccacttttgtt

SEQ ID NO: 4600798 - DNA, 15 bp, Homo sapiens
gcatacgtacacatt

SEQ ID NO: 4600799 - DNA, 17 bp, Homo sapiens
gcatacgtacacatttt

SEQ ID NO: 4600800 - DNA, 18 bp, Homo sapiens
gcatacgtacacatttta

SEQ ID NO: 4600801 - DNA, 16 bp, Homo sapiens
gcatagcaagacacat

SEQ ID NO: 4600802 - DNA, 17 bp, Homo sapiens
gcatctcttgaggccag

SEQ ID NO: 4600803 - DNA, 23 bp, Homo sapiens
gcatgaagtaatatgcacacatt

SEQ ID NO: 4600804 - DNA, 20 bp, Homo sapiens
gcatggatatagttttactt

SEQ ID NO: 4600805 - DNA, 23 bp, Homo sapiens
gcatggtgccccaggaccagctc

SEQ ID NO: 4600806 - DNA, 19 bp, Homo sapiens
gcatgtcctgtaaaggtta

SEQ ID NO: 4600807 - DNA, 17 bp, Homo sapiens
gcattatctagatactg

SEQ ID NO: 4600808 - DNA, 18 bp, Homo sapiens
gcatttaaaacagacact

SEQ ID NO: 4600809 - DNA, 12 bp, Homo sapiens
gcatttaaaaga

SEQ ID NO: 4600810 - DNA, 22 bp, Homo sapiens
gcatttaaaagatacagttact

SEQ ID NO: 4600811 - DNA, 16 bp, Homo sapiens
gcatttgaaaattttg

SEQ ID NO: 4600812 - DNA, 18 bp, Homo sapiens
gcatttgaggtctgttct

SEQ ID NO: 4600813 - DNA, 23 bp, Homo sapiens
gcatttggtggtttcagaaatgt

SEQ ID NO: 4600814 - DNA, 22 bp, Homo sapiens
gcatttgtttctttctctgagg

SEQ ID NO: 4600815 - DNA, 22 bp, Homo sapiens
gcattttggagagtttcctgaa

SEQ ID NO: 4600816 - DNA, 13 bp, Homo sapiens
gccaaataaagtc

SEQ ID NO: 4600817 - DNA, 20 bp, Homo sapiens
gccaatttcaagttccaagt

SEQ ID NO: 4600818 - DNA, 14 bp, Homo sapiens
gccacaaggacttc

SEQ ID NO: 4600819 - DNA, 17 bp, Homo sapiens
gccacaaggacttcctg

SEQ ID NO: 4600820 - DNA, 21 bp, Homo sapiens
gccacaaggacttcctgtcca

SEQ ID NO: 4600821 - DNA, 17 bp, Homo sapiens
gccacagtcatggtggc

SEQ ID NO: 4600822 - DNA, 21 bp, Homo sapiens
gccactcaggaggctgaggca

SEQ ID NO: 4600823 - DNA, 16 bp, Homo sapiens
gccagacacaggccct

SEQ ID NO: 4600824 - DNA, 18 bp, Homo sapiens
gccagacatgccacaagg

SEQ ID NO: 4600825 - DNA, 20 bp, Homo sapiens
gccagagatccaaaagaagc

SEQ ID NO: 4600826 - DNA, 21 bp, Homo sapiens
gccagagatccaaaagaagcc

SEQ ID NO: 4600827 - DNA, 15 bp, Homo sapiens
gccagatccagcctg

SEQ ID NO: 4600828 - DNA, 17 bp, Homo sapiens
gccagatccagcctggg

SEQ ID NO: 4600829 - DNA, 20 bp, Homo sapiens
gccagatccagcctggggtc

SEQ ID NO: 4600830 - DNA, 20 bp, Homo sapiens
gccagatgctagagcctctg

SEQ ID NO: 4600831 - DNA, 16 bp, Homo sapiens
gccagctcagtcccat

SEQ ID NO: 4600832 - DNA, 12 bp, Homo sapiens
gccagtaaatgg

SEQ ID NO: 4600833 - DNA, 23 bp, Homo sapiens
gccagtaaatgggggtgcatttg

SEQ ID NO: 4600834 - DNA, 21 bp, Homo sapiens
gccatgatggcaacagatctg

SEQ ID NO: 4600835 - DNA, 16 bp, Homo sapiens
gcccaacccttccctc

SEQ ID NO: 4600836 - DNA, 13 bp, Homo sapiens
gcccagagcccag

SEQ ID NO: 4600837 - DNA, 14 bp, Homo sapiens
gcccagagcccagc

SEQ ID NO: 4600838 - DNA, 15 bp, Homo sapiens
gcccagctccaaggg

SEQ ID NO: 4600839 - DNA, 16 bp, Homo sapiens
gcccagggcccagagc

SEQ ID NO: 4600840 - DNA, 17 bp, Homo sapiens
gcccagggcccagagcc

SEQ ID NO: 4600841 - DNA, 18 bp, Homo sapiens
gcccagggcccagagccc

SEQ ID NO: 4600842 - DNA, 11 bp, Homo sapiens
gccccaaaagg

SEQ ID NO: 4600843 - DNA, 16 bp, Homo sapiens
gccccagcctccctga

SEQ ID NO: 4600844 - DNA, 16 bp, Homo sapiens
gccccaggaccagctc

SEQ ID NO: 4600845 - DNA, 18 bp, Homo sapiens
gccccaggaccagctcag

SEQ ID NO: 4600846 - DNA, 22 bp, Homo sapiens
gccccaggaccagctcaggaca

SEQ ID NO: 4600847 - DNA, 23 bp, Homo sapiens
gccccaggaccagctcaggacag

SEQ ID NO: 4600848 - DNA, 24 bp, Homo sapiens
gccccaggaccagctcaggacaga

SEQ ID NO: 4600849 - DNA, 12 bp, Homo sapiens
gcccccactgac

SEQ ID NO: 4600850 - DNA, 15 bp, Homo sapiens
gcccccagctaagaa

SEQ ID NO: 4600851 - DNA, 14 bp, Homo sapiens
gcccccgacccagc

SEQ ID NO: 4600852 - DNA, 18 bp, Homo sapiens
gcccccgacccagctcta

SEQ ID NO: 4600853 - DNA, 19 bp, Homo sapiens
gcccctgcactccagcctg

SEQ ID NO: 4600854 - DNA, 21 bp, Homo sapiens
gccctccctgttccccagaga

SEQ ID NO: 4600855 - DNA, 22 bp, Homo sapiens
gccgggaacagacaacagaagt

SEQ ID NO: 4600856 - DNA, 20 bp, Homo sapiens
gccgggcgtggtggtgagtg

SEQ ID NO: 4600857 - DNA, 16 bp, Homo sapiens
gccgtcaccctgggag

SEQ ID NO: 4600858 - DNA, 17 bp, Homo sapiens
gcctaagtgcagccccg

SEQ ID NO: 4600859 - DNA, 15 bp, Homo sapiens
gcctacccctttctc

SEQ ID NO: 4600860 - DNA, 12 bp, Homo sapiens
gcctagcatacg

SEQ ID NO: 4600861 - DNA, 22 bp, Homo sapiens
gcctatattttttgttaaatga

SEQ ID NO: 4600862 - DNA, 20 bp, Homo sapiens
gcctatcagagttgctgcaa

SEQ ID NO: 4600863 - DNA, 19 bp, Homo sapiens
gcctcatgtcaaatattta

SEQ ID NO: 4600864 - DNA, 22 bp, Homo sapiens
gcctccaaggaggggctgtaaa

SEQ ID NO: 4600865 - DNA, 13 bp, Homo sapiens
gcctccctgaagc

SEQ ID NO: 4600866 - DNA, 16 bp, Homo sapiens
gcctctacccaaccag

SEQ ID NO: 4600867 - DNA, 19 bp, Homo sapiens
gcctctcttggaccctggg

SEQ ID NO: 4600868 - DNA, 21 bp, Homo sapiens
gcctctcttggaccctgggag

SEQ ID NO: 4600869 - DNA, 19 bp, Homo sapiens
gcctgacagcatcctctct

SEQ ID NO: 4600870 - DNA, 14 bp, Homo sapiens
gcctgccagctgca

SEQ ID NO: 4600871 - DNA, 12 bp, Homo sapiens
gcctgctccaga

SEQ ID NO: 4600872 - DNA, 16 bp, Homo sapiens
gcctgggcaacagagc

SEQ ID NO: 4600873 - DNA, 14 bp, Homo sapiens
gcctgggggctggg

SEQ ID NO: 4600874 - DNA, 18 bp, Homo sapiens
gccttaccctcatgttct

SEQ ID NO: 4600875 - DNA, 17 bp, Homo sapiens
gccttctcatgatccaa

SEQ ID NO: 4600876 - DNA, 12 bp, Homo sapiens
gccttgccagag

SEQ ID NO: 4600877 - DNA, 17 bp, Homo sapiens
gccttgccagagatcca

SEQ ID NO: 4600878 - DNA, 20 bp, Homo sapiens
gccttgggagctcatccctc

SEQ ID NO: 4600879 - DNA, 15 bp, Homo sapiens
gccttgtttaatggt

SEQ ID NO: 4600880 - DNA, 23 bp, Homo sapiens
gccttgtttaatggtagttttac

SEQ ID NO: 4600881 - DNA, 23 bp, Homo sapiens
gcgctgtgtaaatgctccagcac

SEQ ID NO: 4600882 - DNA, 19 bp, Homo sapiens
gctaaatggtcgcccagga

SEQ ID NO: 4600883 - DNA, 16 bp, Homo sapiens
gctaagaacctggaac

SEQ ID NO: 4600884 - DNA, 23 bp, Homo sapiens
gctaagaacctggaacttgggga

SEQ ID NO: 4600885 - DNA, 19 bp, Homo sapiens
gctagaggttcaaagatat

SEQ ID NO: 4600886 - DNA, 16 bp, Homo sapiens
gctaggggctggggcc

SEQ ID NO: 4600887 - DNA, 16 bp, Homo sapiens
gctagtatcaaaagaa

SEQ ID NO: 4600888 - DNA, 12 bp, Homo sapiens
gctatgcatttg

SEQ ID NO: 4600889 - DNA, 15 bp, Homo sapiens
gctcacttctgggct

SEQ ID NO: 4600890 - DNA, 23 bp, Homo sapiens
gctcacttctgggcttcatctgg

SEQ ID NO: 4600891 - DNA, 23 bp, Homo sapiens
gctcagtcccatcagagagcgag

SEQ ID NO: 4600892 - DNA, 14 bp, Homo sapiens
gctcatccctctca

SEQ ID NO: 4600893 - DNA, 15 bp, Homo sapiens
gctcatccctctcac

SEQ ID NO: 4600894 - DNA, 20 bp, Homo sapiens
gctcatccctctcacccaga

SEQ ID NO: 4600895 - DNA, 21 bp, Homo sapiens
gctccaacctgcaaagatctg

SEQ ID NO: 4600896 - DNA, 21 bp, Homo sapiens
gctccaaggggaatcagaact

SEQ ID NO: 4600897 - DNA, 23 bp, Homo sapiens
gctccagacctgatcctggaggc

SEQ ID NO: 4600898 - DNA, 13 bp, Homo sapiens
gctctaaataaag

SEQ ID NO: 4600899 - DNA, 14 bp, Homo sapiens
gctctaaataaaga

SEQ ID NO: 4600900 - DNA, 20 bp, Homo sapiens
gctctaaataaagacgacta

SEQ ID NO: 4600901 - DNA, 23 bp, Homo sapiens
gctctgaagtcacatcacaggac

SEQ ID NO: 4600902 - DNA, 15 bp, Homo sapiens
gctctgcccatcctg

SEQ ID NO: 4600903 - DNA, 21 bp, Homo sapiens
gctctgcccatcctgcccctg

SEQ ID NO: 4600904 - DNA, 16 bp, Homo sapiens
gctctggacagcccca

SEQ ID NO: 4600905 - DNA, 20 bp, Homo sapiens
gctctggacagccccaccct

SEQ ID NO: 4600906 - DNA, 18 bp, Homo sapiens
gctgacagttggagggaa

SEQ ID NO: 4600907 - DNA, 19 bp, Homo sapiens
gctgagggtcgtgggaaag

SEQ ID NO: 4600908 - DNA, 21 bp, Homo sapiens
gctgattaaaccaaggctaga

SEQ ID NO: 4600909 - DNA, 20 bp, Homo sapiens
gctgcactgatgctgcccct

SEQ ID NO: 4600910 - DNA, 18 bp, Homo sapiens
gctgcatttaaaagatac

SEQ ID NO: 4600911 - DNA, 12 bp, Homo sapiens
gctgctacccag

SEQ ID NO: 4600912 - DNA, 15 bp, Homo sapiens
gctggcccagggccc

SEQ ID NO: 4600913 - DNA, 19 bp, Homo sapiens
gctggggccaaataaagtc

SEQ ID NO: 4600914 - DNA, 21 bp, Homo sapiens
gctgtggggctaggggctggg

SEQ ID NO: 4600915 - DNA, 16 bp, Homo sapiens
gcttaacttcacatat

SEQ ID NO: 4600916 - DNA, 17 bp, Homo sapiens
gcttcgtttattttcaa

SEQ ID NO: 4600917 - DNA, 12 bp, Homo sapiens
gcttgagcccag

SEQ ID NO: 4600918 - DNA, 15 bp, Homo sapiens
gcttgagcccaggag

SEQ ID NO: 4600919 - DNA, 16 bp, Homo sapiens
gcttgagcccaggagt

SEQ ID NO: 4600920 - DNA, 17 bp, Homo sapiens
gcttgccctggtgcctc

SEQ ID NO: 4600921 - DNA, 22 bp, Homo sapiens
gcttgtaactaaaataattttg

SEQ ID NO: 4600922 - DNA, 14 bp, Homo sapiens
gcttgtacataatg

SEQ ID NO: 4600923 - DNA, 12 bp, Homo sapiens
gctttcctgaat

SEQ ID NO: 4600924 - DNA, 18 bp, Homo sapiens
gctttgtctacttcaaaa

SEQ ID NO: 4600925 - DNA, 16 bp, Homo sapiens
ggtgctgacggccagg

SEQ ID NO: 4600926 - DNA, 22 bp, Homo sapiens
ggtggggacagaccagcccttc

SEQ ID NO: 4600927 - DNA, 17 bp, Homo sapiens
ggtggtttcagaaatgt

SEQ ID NO: 4600928 - DNA, 15 bp, Homo sapiens
ggtggttttctgttc

SEQ ID NO: 4600929 - DNA, 18 bp, Homo sapiens
ggtggttttctgttcttt

SEQ ID NO: 4600930 - DNA, 14 bp, Homo sapiens
ggttaataaataaa

SEQ ID NO: 4600931 - DNA, 18 bp, Homo sapiens
ggttctttcatttgcttt

SEQ ID NO: 4600932 - DNA, 19 bp, Homo sapiens
ggtttacattcatctcatt

SEQ ID NO: 4600933 - DNA, 13 bp, Homo sapiens
ggtttgctcagcc

SEQ ID NO: 4600934 - DNA, 14 bp, Homo sapiens
ggttttaaactttc

SEQ ID NO: 4600935 - DNA, 15 bp, Homo sapiens
ggttttctgttcttt

SEQ ID NO: 4600936 - DNA, 19 bp, Homo sapiens
gtaaaaagtattttttcaa

SEQ ID NO: 4600937 - DNA, 15 bp, Homo sapiens
gtaaataatttattt

SEQ ID NO: 4600938 - DNA, 19 bp, Homo sapiens
gtaaatgggggtgcatttg

SEQ ID NO: 4600939 - DNA, 22 bp, Homo sapiens
gtaaattaacttttataaactt

SEQ ID NO: 4600940 - DNA, 23 bp, Homo sapiens
gtaaattaacttttataaacttt

SEQ ID NO: 4600941 - DNA, 17 bp, Homo sapiens
gtaatatgcacacattt

SEQ ID NO: 4600942 - DNA, 18 bp, Homo sapiens
gtaatatgcacacatttt

SEQ ID NO: 4600943 - DNA, 15 bp, Homo sapiens
gtaatttgtgataca

SEQ ID NO: 4600944 - DNA, 16 bp, Homo sapiens
gtaattttgtgtaaga

SEQ ID NO: 4600945 - DNA, 20 bp, Homo sapiens
gtacagcaaggagatttaca

SEQ ID NO: 4600946 - DNA, 16 bp, Homo sapiens
gtacatgaaaacacat

SEQ ID NO: 4600947 - DNA, 17 bp, Homo sapiens
gtacattcaatgtttat

SEQ ID NO: 4600948 - DNA, 17 bp, Homo sapiens
gtaccctcctcccgact

SEQ ID NO: 4600949 - DNA, 19 bp, Homo sapiens
gtactccacatatttcagt

SEQ ID NO: 4600950 - DNA, 21 bp, Homo sapiens
gtagcctcaatcgagtgagac

SEQ ID NO: 4600951 - DNA, 16 bp, Homo sapiens
gtatattttatatcaa

SEQ ID NO: 4600952 - DNA, 19 bp, Homo sapiens
gtatcaaatacatttaaaa

SEQ ID NO: 4600953 - DNA, 22 bp, Homo sapiens
gtattggctagaggttcaaaga

SEQ ID NO: 4600954 - DNA, 13 bp, Homo sapiens
gtattttaatcac

SEQ ID NO: 4600955 - DNA, 14 bp, Homo sapiens
gtatttttttacta

SEQ ID NO: 4600956 - DNA, 15 bp, Homo sapiens
gtatttttttactaa

SEQ ID NO: 4600957 - DNA, 17 bp, Homo sapiens
gtatttttttactaata

SEQ ID NO: 4600958 - DNA, 13 bp, Homo sapiens
gtcaacatttctc

SEQ ID NO: 4600959 - DNA, 17 bp, Homo sapiens
gtcaggaacagaaggat

SEQ ID NO: 4600960 - DNA, 19 bp, Homo sapiens
gtcagtcatgatggcacca

SEQ ID NO: 4600961 - DNA, 21 bp, Homo sapiens
gtcattcgctactatgattta

SEQ ID NO: 4600962 - DNA, 19 bp, Homo sapiens
gtcattttttttaagaaaa

SEQ ID NO: 4600963 - DNA, 21 bp, Homo sapiens
gtccaattaatgaagttgatt

SEQ ID NO: 4600964 - DNA, 22 bp, Homo sapiens
gtccatgaagatgtagaggaga

SEQ ID NO: 4600965 - DNA, 19 bp, Homo sapiens
gtcctattatattcattct

SEQ ID NO: 4600966 - DNA, 21 bp, Homo sapiens
gtcctattatattcattcttt

SEQ ID NO: 4600967 - DNA, 16 bp, Homo sapiens
gtcctcagccttgcca

SEQ ID NO: 4600968 - DNA, 20 bp, Homo sapiens
gtcctcagccttgccagaga

SEQ ID NO: 4600969 - DNA, 21 bp, Homo sapiens
gtcctcagccttgccagagat

SEQ ID NO: 4600970 - DNA, 18 bp, Homo sapiens
gtcgtgggaaaggggagt

SEQ ID NO: 4600971 - DNA, 23 bp, Homo sapiens
gtctcagtccatgaagatgtaga

SEQ ID NO: 4600972 - DNA, 17 bp, Homo sapiens
gtctgttctttccaaag

SEQ ID NO: 4600973 - DNA, 14 bp, Homo sapiens
gtcttcctgacact

SEQ ID NO: 4600974 - DNA, 16 bp, Homo sapiens
gtcttttggttatgaa

SEQ ID NO: 4600975 - DNA, 13 bp, Homo sapiens
gtgaaggaccctt

SEQ ID NO: 4600976 - DNA, 22 bp, Homo sapiens
gtgactttttaaaaaatgctgg

SEQ ID NO: 4600977 - DNA, 23 bp, Homo sapiens
gtgactttttaaaaaatgctggg

SEQ ID NO: 4600978 - DNA, 18 bp, Homo sapiens
gtgagggtaagtattttc

SEQ ID NO: 4600979 - DNA, 17 bp, Homo sapiens
gtgattaccagggactg

SEQ ID NO: 4600980 - DNA, 14 bp, Homo sapiens
gtgattcaatctgt

SEQ ID NO: 4600981 - DNA, 21 bp, Homo sapiens
gtgattcaatctgtaaactgt

SEQ ID NO: 4600982 - DNA, 18 bp, Homo sapiens
gtgatttttgtaattttt

SEQ ID NO: 4600983 - DNA, 19 bp, Homo sapiens
gtgcaataaatctgaccca

SEQ ID NO: 4600984 - DNA, 21 bp, Homo sapiens
gtgcaataaatctgacccagt

SEQ ID NO: 4600985 - DNA, 17 bp, Homo sapiens
gtgcacatctgttttgt

SEQ ID NO: 4600986 - DNA, 23 bp, Homo sapiens
gtgcattatctagatactgtatc

SEQ ID NO: 4600987 - DNA, 17 bp, Homo sapiens
gtgcatttgaggtctgt

SEQ ID NO: 4600988 - DNA, 22 bp, Homo sapiens
gtgcatttgaggtctgttcttt

SEQ ID NO: 4600989 - DNA, 15 bp, Homo sapiens
gtgccccaggaccag

SEQ ID NO: 4600990 - DNA, 23 bp, Homo sapiens
gtgccttcctgtttttcacattt

SEQ ID NO: 4600991 - DNA, 22 bp, Homo sapiens
gtgctaaatggtcgcccaggag

SEQ ID NO: 4600992 - DNA, 21 bp, Homo sapiens
gtgctgacggccagggagaag

SEQ ID NO: 4600993 - DNA, 14 bp, Homo sapiens
gtggaagcctcaga

SEQ ID NO: 4600994 - DNA, 18 bp, Homo sapiens
gtggatttaacagaaatg

SEQ ID NO: 4600995 - DNA, 23 bp, Homo sapiens
gtggatttaacagaaatgtacag

SEQ ID NO: 4600996 - DNA, 17 bp, Homo sapiens
gtgggccaacaaagaac

SEQ ID NO: 4600997 - DNA, 15 bp, Homo sapiens
gtggggacagaccag

SEQ ID NO: 4600998 - DNA, 16 bp, Homo sapiens
gtggggacagaccagc

SEQ ID NO: 4600999 - DNA, 14 bp, Homo sapiens
gtgtacataactga

SEQ ID NO: 4601000 - DNA, 17 bp, Homo sapiens
gtgtatttttttactaa

SEQ ID NO: 4601001 - DNA, 14 bp, Homo sapiens
gtgtctaaaaacac

SEQ ID NO: 4601002 - DNA, 17 bp, Homo sapiens
gtgtctaaaaacaccaa

SEQ ID NO: 4601003 - DNA, 23 bp, Homo sapiens
gtgtgtggtcaacatttctcatg

SEQ ID NO: 4601004 - DNA, 14 bp, Homo sapiens
gtgttactaagttt

SEQ ID NO: 4601005 - DNA, 14 bp, Homo sapiens
gtgtttagctattt

SEQ ID NO: 4601006 - DNA, 13 bp, Homo sapiens
gtgtttctgactc

SEQ ID NO: 4601007 - DNA, 20 bp, Homo sapiens
gttaaaaacagatttggaaa

SEQ ID NO: 4601008 - DNA, 22 bp, Homo sapiens
gttaaaataccagccagtaaat

SEQ ID NO: 4601009 - DNA, 13 bp, Homo sapiens
gttaagacctggc

SEQ ID NO: 4601010 - DNA, 14 bp, Homo sapiens
gttaagacctggca

SEQ ID NO: 4601011 - DNA, 18 bp, Homo sapiens
gttacactttttggaagt

SEQ ID NO: 4601012 - DNA, 16 bp, Homo sapiens
gttacctactttgact

SEQ ID NO: 4601013 - DNA, 23 bp, Homo sapiens
gttactaattggcctctttaaga

SEQ ID NO: 4601014 - DNA, 13 bp, Homo sapiens
gttagattaagaa

SEQ ID NO: 4601015 - DNA, 17 bp, Homo sapiens
gttagtatgaggcattt

SEQ ID NO: 4601016 - DNA, 16 bp, Homo sapiens
gttagttccactgaga

SEQ ID NO: 4601017 - DNA, 20 bp, Homo sapiens
gttattttgatgtaaagatg

SEQ ID NO: 4601018 - DNA, 21 bp, Homo sapiens
gttcaaagatattttgctttg

SEQ ID NO: 4601019 - DNA, 23 bp, Homo sapiens
gttcaatctggattcatatttaa

SEQ ID NO: 4601020 - DNA, 18 bp, Homo sapiens
gttcaggagtcccaagga

SEQ ID NO: 4601021 - DNA, 21 bp, Homo sapiens
gttcaggagtcccaaggaaag

SEQ ID NO: 4601022 - DNA, 16 bp, Homo sapiens
gttcccatttcagctg

SEQ ID NO: 4601023 - DNA, 23 bp, Homo sapiens
gttcctagtgatggcttatgata

SEQ ID NO: 4601024 - DNA, 17 bp, Homo sapiens
gttctgcctgccagctg

SEQ ID NO: 4601025 - DNA, 13 bp, Homo sapiens
gttcttaattctt

SEQ ID NO: 4601026 - DNA, 17 bp, Homo sapiens
gttcttaattcttagct

SEQ ID NO: 4601027 - DNA, 18 bp, Homo sapiens
gttcttggtttgtaaatt

SEQ ID NO: 4601028 - DNA, 21 bp, Homo sapiens
gttcttggtttgtaaattaac

SEQ ID NO: 4601029 - DNA, 20 bp, Homo sapiens
gttctttcatttgctttgga

SEQ ID NO: 4601030 - DNA, 14 bp, Homo sapiens
gttctttccaaagt

SEQ ID NO: 4601031 - DNA, 16 bp, Homo sapiens
gttctttgggccagac

SEQ ID NO: 4601032 - DNA, 15 bp, Homo sapiens
gttgatctggaaccc

SEQ ID NO: 4601033 - DNA, 17 bp, Homo sapiens
gttgatctggaacccag

SEQ ID NO: 4601034 - DNA, 22 bp, Homo sapiens
gttggagggaaagccagcctgg

SEQ ID NO: 4601035 - DNA, 14 bp, Homo sapiens
gttgtcaagaatag

SEQ ID NO: 4601036 - DNA, 22 bp, Homo sapiens
gttgtcaagaatagcattgtaa

SEQ ID NO: 4601037 - DNA, 15 bp, Homo sapiens
gttgttacattttta

SEQ ID NO: 4601038 - DNA, 13 bp, Homo sapiens
gtttagaaagctt

SEQ ID NO: 4601039 - DNA, 15 bp, Homo sapiens
gtttagataatacac

SEQ ID NO: 4601040 - DNA, 17 bp, Homo sapiens
gtttagatgaatgtcag

SEQ ID NO: 4601041 - DNA, 17 bp, Homo sapiens
gtttatgcaaggaagga

SEQ ID NO: 4601042 - DNA, 14 bp, Homo sapiens
gtttcaaactttac

SEQ ID NO: 4601043 - DNA, 16 bp, Homo sapiens
gtttcacttgcacatc

SEQ ID NO: 4601044 - DNA, 13 bp, Homo sapiens
gtttcagaaatgt

SEQ ID NO: 4601045 - DNA, 19 bp, Homo sapiens
gtttctaaaggctaccttt

SEQ ID NO: 4601046 - DNA, 19 bp, Homo sapiens
gtttctttctctgaggaca

SEQ ID NO: 4601047 - DNA, 20 bp, Homo sapiens
gtttctttctctgaggacaa

SEQ ID NO: 4601048 - DNA, 23 bp, Homo sapiens
gtttctttcttttttttttcatt

SEQ ID NO: 4601049 - DNA, 23 bp, Homo sapiens
gtttgattaaattcttgcaaagt

SEQ ID NO: 4601050 - DNA, 18 bp, Homo sapiens
gttttaaggatgcttgta

SEQ ID NO: 4601051 - DNA, 21 bp, Homo sapiens
gttttacttttaaactgtgta

SEQ ID NO: 4601052 - DNA, 19 bp, Homo sapiens
gttttctgttctttctggc

SEQ ID NO: 4601053 - DNA, 20 bp, Homo sapiens
gttttgaagattctatgtta

SEQ ID NO: 4601054 - DNA, 17 bp, Homo sapiens
tactaatagacaattta

SEQ ID NO: 4601055 - DNA, 13 bp, Homo sapiens
tactacagtttgt

SEQ ID NO: 4601056 - DNA, 14 bp, Homo sapiens
tactcttcttgaaa

SEQ ID NO: 4601057 - DNA, 17 bp, Homo sapiens
tactcttcttgaaattt

SEQ ID NO: 4601058 - DNA, 18 bp, Homo sapiens
tactcttcttgaaatttt

SEQ ID NO: 4601059 - DNA, 17 bp, Homo sapiens
tactgcatactttttaa

SEQ ID NO: 4601060 - DNA, 18 bp, Homo sapiens
tactgcatactttttaaa

SEQ ID NO: 4601061 - DNA, 22 bp, Homo sapiens
tactgcatactttttaaatgta

SEQ ID NO: 4601062 - DNA, 20 bp, Homo sapiens
tactgccattcacttcataa

SEQ ID NO: 4601063 - DNA, 16 bp, Homo sapiens
tactgtaatttgtgat

SEQ ID NO: 4601064 - DNA, 17 bp, Homo sapiens
tactgtaatttgtgata

SEQ ID NO: 4601065 - DNA, 22 bp, Homo sapiens
tactgtacatgaaaacacattt

SEQ ID NO: 4601066 - DNA, 15 bp, Homo sapiens
tactgtgttcaatta

SEQ ID NO: 4601067 - DNA, 17 bp, Homo sapiens
tacttcaaaagtttgtt

SEQ ID NO: 4601068 - DNA, 18 bp, Homo sapiens
tacttgaagggccagagc

SEQ ID NO: 4601069 - DNA, 14 bp, Homo sapiens
tactttttaaatgt

SEQ ID NO: 4601070 - DNA, 23 bp, Homo sapiens
tagaactctccatcttattttca

SEQ ID NO: 4601071 - DNA, 16 bp, Homo sapiens
tagaattaacacatga

SEQ ID NO: 4601072 - DNA, 14 bp, Homo sapiens
tagacagcatgaga

SEQ ID NO: 4601073 - DNA, 16 bp, Homo sapiens
tagaggttcaaagata

SEQ ID NO: 4601074 - DNA, 21 bp, Homo sapiens
tagaggttcaaagatattttg

SEQ ID NO: 4601075 - DNA, 22 bp, Homo sapiens
tagatgctggcccagggcccag

SEQ ID NO: 4601076 - DNA, 16 bp, Homo sapiens
tagatgtaattttgtg

SEQ ID NO: 4601077 - DNA, 12 bp, Homo sapiens
tagcaagacaca

SEQ ID NO: 4601078 - DNA, 18 bp, Homo sapiens
tagcatacgtacacattt

SEQ ID NO: 4601079 - DNA, 19 bp, Homo sapiens
tagcatacgtacacatttt

SEQ ID NO: 4601080 - DNA, 13 bp, Homo sapiens
tagccactcagga

SEQ ID NO: 4601081 - DNA, 22 bp, Homo sapiens
tagctatttaatactaattttc

SEQ ID NO: 4601082 - DNA, 19 bp, Homo sapiens
tagctgtaggttttctgtg

SEQ ID NO: 4601083 - DNA, 21 bp, Homo sapiens
taggaacttaaataatgtgaa

SEQ ID NO: 4601084 - DNA, 12 bp, Homo sapiens
taggaattgacc

SEQ ID NO: 4601085 - DNA, 20 bp, Homo sapiens
taggaattgacccacaagaa

SEQ ID NO: 4601086 - DNA, 23 bp, Homo sapiens
taggaattgacccacaagaaatg

SEQ ID NO: 4601087 - DNA, 14 bp, Homo sapiens
taggagaccaaggc

SEQ ID NO: 4601088 - DNA, 12 bp, Homo sapiens
taggggctgggg

SEQ ID NO: 4601089 - DNA, 19 bp, Homo sapiens
taggtgtgactgaatttct

SEQ ID NO: 4601090 - DNA, 21 bp, Homo sapiens
taggtgtgactgaatttcttt

SEQ ID NO: 4601091 - DNA, 14 bp, Homo sapiens
tagtataaagaaaa

SEQ ID NO: 4601092 - DNA, 15 bp, Homo sapiens
tagtatgaggcattt

SEQ ID NO: 4601093 - DNA, 14 bp, Homo sapiens
tagttccactgaga

SEQ ID NO: 4601094 - DNA, 17 bp, Homo sapiens
tataaactttacctttt

SEQ ID NO: 4601095 - DNA, 18 bp, Homo sapiens
tataaactttaccttttt

SEQ ID NO: 4601096 - DNA, 17 bp, Homo sapiens
tatactgcatacttttt

SEQ ID NO: 4601097 - DNA, 19 bp, Homo sapiens
tatattcattctttttgaa

SEQ ID NO: 4601098 - DNA, 19 bp, Homo sapiens
tatattttttgttaaatga

SEQ ID NO: 4601099 - DNA, 21 bp, Homo sapiens
tatattttttgttaaatgatt

SEQ ID NO: 4601100 - DNA, 14 bp, Homo sapiens
tatcaaaagaaaga

SEQ ID NO: 4601101 - DNA, 18 bp, Homo sapiens
tatcaagtattatacctt

SEQ ID NO: 4601102 - DNA, 21 bp, Homo sapiens
tatcaagtattataccttttt

SEQ ID NO: 4601103 - DNA, 16 bp, Homo sapiens
tatcatgacaaagact

SEQ ID NO: 4601104 - DNA, 19 bp, Homo sapiens
tatcatgcatgtcctgtaa

SEQ ID NO: 4601105 - DNA, 13 bp, Homo sapiens
tatccaaaagctt

SEQ ID NO: 4601106 - DNA, 19 bp, Homo sapiens
tatccctactgtaatttgt

SEQ ID NO: 4601107 - DNA, 18 bp, Homo sapiens
tatcccttggacatttta

SEQ ID NO: 4601108 - DNA, 16 bp, Homo sapiens
tatcgtcactgcttaa

SEQ ID NO: 4601109 - DNA, 19 bp, Homo sapiens
tatcgtcactgcttaactt

SEQ ID NO: 4601110 - DNA, 19 bp, Homo sapiens
tatctagatactgtatcat

SEQ ID NO: 4601111 - DNA, 17 bp, Homo sapiens
tatgaacatattgttga

SEQ ID NO: 4601112 - DNA, 23 bp, Homo sapiens
tatgaggcatttgtttgaactga

SEQ ID NO: 4601113 - DNA, 19 bp, Homo sapiens
tatgatttttttttcatac

SEQ ID NO: 4601114 - DNA, 18 bp, Homo sapiens
tatgcatggtgccccagg

SEQ ID NO: 4601115 - DNA, 22 bp, Homo sapiens
tatgcatggtgccccaggacca

SEQ ID NO: 4601116 - DNA, 23 bp, Homo sapiens
tatgcatggtgccccaggaccag

SEQ ID NO: 4601117 - DNA, 24 bp, Homo sapiens
tatgcatttgaaaattttgatgtt

SEQ ID NO: 4601118 - DNA, 14 bp, Homo sapiens
tatgccagctcagt

SEQ ID NO: 4601119 - DNA, 21 bp, Homo sapiens
tatgcttactgatatatttta

SEQ ID NO: 4601120 - DNA, 13 bp, Homo sapiens
tatggaactctct

SEQ ID NO: 4601121 - DNA, 23 bp, Homo sapiens
tatggcttttgtgcattatctag

SEQ ID NO: 4601122 - DNA, 21 bp, Homo sapiens
tatgtaaatggtatgtcattc

SEQ ID NO: 4601123 - DNA, 23 bp, Homo sapiens
tatgtgggcagattttcagcaaa

SEQ ID NO: 4601124 - DNA, 19 bp, Homo sapiens
tatgttaagggaagaattc

SEQ ID NO: 4601125 - DNA, 16 bp, Homo sapiens
tattaaaaatctcaaa

SEQ ID NO: 4601126 - DNA, 12 bp, Homo sapiens
tattataccttt

SEQ ID NO: 4601127 - DNA, 14 bp, Homo sapiens
tattataccttttt

SEQ ID NO: 4601128 - DNA, 13 bp, Homo sapiens
tattatattcatt

SEQ ID NO: 4601129 - DNA, 21 bp, Homo sapiens
tattatgtctcttctgagcta

SEQ ID NO: 4601130 - DNA, 17 bp, Homo sapiens
tattccaagacatgtct

SEQ ID NO: 4601131 - DNA, 17 bp, Homo sapiens
tattctctcctgtacct

SEQ ID NO: 4601132 - DNA, 13 bp, Homo sapiens
tattgatgttttc

SEQ ID NO: 4601133 - DNA, 24 bp, Homo sapiens
tatttaaactctgttgcaagtgca

SEQ ID NO: 4601134 - DNA, 14 bp, Homo sapiens
tatttaatatttaa

SEQ ID NO: 4601135 - DNA, 20 bp, Homo sapiens
tatttattgaaatgatttca

SEQ ID NO: 4601136 - DNA, 15 bp, Homo sapiens
tatttctgtatataa

SEQ ID NO: 4601137 - DNA, 14 bp, Homo sapiens
tattttgctggaat

SEQ ID NO: 4601138 - DNA, 15 bp, Homo sapiens
tattttggtttagtg

SEQ ID NO: 4601139 - DNA, 11 bp, Homo sapiens
tattttttcaa

SEQ ID NO: 4601140 - DNA, 14 bp, Homo sapiens
tatttttttactaa

SEQ ID NO: 4601141 - DNA, 15 bp, Homo sapiens
tatttttttactaat

SEQ ID NO: 4601142 - DNA, 13 bp, Homo sapiens
tcaaactttacta

SEQ ID NO: 4601143 - DNA, 16 bp, Homo sapiens
tcaaactttactatgg

SEQ ID NO: 4601144 - DNA, 13 bp, Homo sapiens
tcaaagatatttt

SEQ ID NO: 4601145 - DNA, 22 bp, Homo sapiens
tcaaatacatttaaaacattaa

SEQ ID NO: 4601146 - DNA, 18 bp, Homo sapiens
tcaaatggggccagatcc

SEQ ID NO: 4601147 - DNA, 21 bp, Homo sapiens
tcaaattcttctgaactcaaa

SEQ ID NO: 4601148 - DNA, 17 bp, Homo sapiens
tcaacatttctcatgtt

SEQ ID NO: 4601149 - DNA, 18 bp, Homo sapiens
tcaactgcctactccaaa

SEQ ID NO: 4601150 - DNA, 21 bp, Homo sapiens
tcaagaataatcacgctttcc

SEQ ID NO: 4601151 - DNA, 19 bp, Homo sapiens
tcaatctggattcatattt

SEQ ID NO: 4601152 - DNA, 17 bp, Homo sapiens
tcaatctgtaaactgtg

SEQ ID NO: 4601153 - DNA, 21 bp, Homo sapiens
tcaatgtttatgcaaggaagg

SEQ ID NO: 4601154 - DNA, 16 bp, Homo sapiens
tcaattactggtccaa

SEQ ID NO: 4601155 - DNA, 15 bp, Homo sapiens
tcaattatctttatc

SEQ ID NO: 4601156 - DNA, 12 bp, Homo sapiens
tcaatttaaaaa

SEQ ID NO: 4601157 - DNA, 14 bp, Homo sapiens
tcacaggaagtaga

SEQ ID NO: 4601158 - DNA, 19 bp, Homo sapiens
tcacaggaagtagaggagg

SEQ ID NO: 4601159 - DNA, 18 bp, Homo sapiens
tcacagtggccacggcca

SEQ ID NO: 4601160 - DNA, 13 bp, Homo sapiens
tcacatcacagga

SEQ ID NO: 4601161 - DNA, 17 bp, Homo sapiens
tcacattttccttttca

SEQ ID NO: 4601162 - DNA, 20 bp, Homo sapiens
tcacccagaatccctctaac

SEQ ID NO: 4601163 - DNA, 13 bp, Homo sapiens
tcaccctgggagc

SEQ ID NO: 4601164 - DNA, 18 bp, Homo sapiens
tcaccggggtggtttagt

SEQ ID NO: 4601165 - DNA, 19 bp, Homo sapiens
tcacctgtaaacctgagtc

SEQ ID NO: 4601166 - DNA, 19 bp, Homo sapiens
tcaccttggcaccagacac

SEQ ID NO: 4601167 - DNA, 23 bp, Homo sapiens
tcaccttggcaccagacacccag

SEQ ID NO: 4601168 - DNA, 15 bp, Homo sapiens
tcactgcttaacttc

SEQ ID NO: 4601169 - DNA, 16 bp, Homo sapiens
tcagaattctctagtt

SEQ ID NO: 4601170 - DNA, 22 bp, Homo sapiens
tcagactcccattcctgaagaa

SEQ ID NO: 4601171 - DNA, 12 bp, Homo sapiens
tcagaggccttg

SEQ ID NO: 4601172 - DNA, 14 bp, Homo sapiens
tcagatccagggac

SEQ ID NO: 4601173 - DNA, 15 bp, Homo sapiens
tcagcaaactctttt

SEQ ID NO: 4601174 - DNA, 16 bp, Homo sapiens
tcagcaactcgcttta

SEQ ID NO: 4601175 - DNA, 17 bp, Homo sapiens
tcagcacgatttctgtt

SEQ ID NO: 4601176 - DNA, 19 bp, Homo sapiens
tcagcacgatttctgttta

SEQ ID NO: 4601177 - DNA, 19 bp, Homo sapiens
tcagcatgtctattcagct

SEQ ID NO: 4601178 - DNA, 21 bp, Homo sapiens
tcagcatgtctattcagcttc

SEQ ID NO: 4601179 - DNA, 12 bp, Homo sapiens
tcagcctggcca

SEQ ID NO: 4601180 - DNA, 15 bp, Homo sapiens
tcagccttgccagag

SEQ ID NO: 4601181 - DNA, 19 bp, Homo sapiens
tcagcttcgtttattttca

SEQ ID NO: 4601182 - DNA, 13 bp, Homo sapiens
tcaggaacagaag

SEQ ID NO: 4601183 - DNA, 18 bp, Homo sapiens
tcaggcctataaccccag

SEQ ID NO: 4601184 - DNA, 22 bp, Homo sapiens
tctgggctgctacccagaaatc

SEQ ID NO: 4601185 - DNA, 12 bp, Homo sapiens
tctgtaaactgt

SEQ ID NO: 4601186 - DNA, 14 bp, Homo sapiens
tctgtaaactgtgt

SEQ ID NO: 4601187 - DNA, 16 bp, Homo sapiens
tctgtaaactgtgtat

SEQ ID NO: 4601188 - DNA, 21 bp, Homo sapiens
tctgtcctcagccttgccaga

SEQ ID NO: 4601189 - DNA, 13 bp, Homo sapiens
tctgttctttcca

SEQ ID NO: 4601190 - DNA, 14 bp, Homo sapiens
tcttcagatctcta

SEQ ID NO: 4601191 - DNA, 21 bp, Homo sapiens
tcttccagtcttcctgacact

SEQ ID NO: 4601192 - DNA, 13 bp, Homo sapiens
tcttcctgacact

SEQ ID NO: 4601193 - DNA, 21 bp, Homo sapiens
tcttctgagctatttcatcta

SEQ ID NO: 4601194 - DNA, 16 bp, Homo sapiens
tcttcttggtctcagt

SEQ ID NO: 4601195 - DNA, 20 bp, Homo sapiens
tcttgaaatataggaactta

SEQ ID NO: 4601196 - DNA, 13 bp, Homo sapiens
tcttgaaggtgct

SEQ ID NO: 4601197 - DNA, 18 bp, Homo sapiens
tcttgaatttctaaaaaa

SEQ ID NO: 4601198 - DNA, 17 bp, Homo sapiens
tcttgagccttgaactt

SEQ ID NO: 4601199 - DNA, 15 bp, Homo sapiens
tcttgaggccaggag

SEQ ID NO: 4601200 - DNA, 21 bp, Homo sapiens
tcttgcaagcaacaagctatt

SEQ ID NO: 4601201 - DNA, 13 bp, Homo sapiens
tcttggaccctgg

SEQ ID NO: 4601202 - DNA, 15 bp, Homo sapiens
tctttatatgaagaa

SEQ ID NO: 4601203 - DNA, 15 bp, Homo sapiens
tctttctctgaggac

SEQ ID NO: 4601204 - DNA, 18 bp, Homo sapiens
tctttctggctatgcatt

SEQ ID NO: 4601205 - DNA, 19 bp, Homo sapiens
tctttctggctatgcattt

SEQ ID NO: 4601206 - DNA, 20 bp, Homo sapiens
tctttgggccagacatgcca

SEQ ID NO: 4601207 - DNA, 15 bp, Homo sapiens
tgaaaacacattttt

SEQ ID NO: 4601208 - DNA, 19 bp, Homo sapiens
tgaaaacacatttttctta

SEQ ID NO: 4601209 - DNA, 19 bp, Homo sapiens
tgaaaactttatgctaagt

SEQ ID NO: 4601210 - DNA, 13 bp, Homo sapiens
tgaaaactttgta

SEQ ID NO: 4601211 - DNA, 16 bp, Homo sapiens
tgaaaactttgtagta

SEQ ID NO: 4601212 - DNA, 21 bp, Homo sapiens
tgaaaataaaaagatcacttt

SEQ ID NO: 4601213 - DNA, 19 bp, Homo sapiens
tgaaaatgtgctatactgc

SEQ ID NO: 4601214 - DNA, 20 bp, Homo sapiens
tgaaaatgtgctatactgca

SEQ ID NO: 4601215 - DNA, 19 bp, Homo sapiens
tgaaactccagatgccaca

SEQ ID NO: 4601216 - DNA, 18 bp, Homo sapiens
tgaaagcagggacttgaa

SEQ ID NO: 4601217 - DNA, 19 bp, Homo sapiens
tgaaagcagggacttgaac

SEQ ID NO: 4601218 - DNA, 18 bp, Homo sapiens
tgaaataagccagacatc

SEQ ID NO: 4601219 - DNA, 20 bp, Homo sapiens
tgaaattttaacctatgata

SEQ ID NO: 4601220 - DNA, 18 bp, Homo sapiens
tgaaattttatatgctta

SEQ ID NO: 4601221 - DNA, 22 bp, Homo sapiens
tgaacccatatttgtacaccaa

SEQ ID NO: 4601222 - DNA, 18 bp, Homo sapiens
tgaacccgggaggcagag

SEQ ID NO: 4601223 - DNA, 21 bp, Homo sapiens
tgaagacaatgacttactgta

SEQ ID NO: 4601224 - DNA, 17 bp, Homo sapiens
tgaagagggagaaggga

SEQ ID NO: 4601225 - DNA, 16 bp, Homo sapiens
tgaagctcacttctgg

SEQ ID NO: 4601226 - DNA, 12 bp, Homo sapiens
tgaagggccaga

SEQ ID NO: 4601227 - DNA, 17 bp, Homo sapiens
tgaagggccagagccag

SEQ ID NO: 4601228 - DNA, 18 bp, Homo sapiens
tgaaggtagaatgttttc

SEQ ID NO: 4601229 - DNA, 15 bp, Homo sapiens
tgaagtaatatgcac

SEQ ID NO: 4601230 - DNA, 16 bp, Homo sapiens
tgaagtaatatgcaca

SEQ ID NO: 4601231 - DNA, 16 bp, Homo sapiens
tgaagttgattcatat

SEQ ID NO: 4601232 - DNA, 20 bp, Homo sapiens
tgaagttgattcatattgca

SEQ ID NO: 4601233 - DNA, 18 bp, Homo sapiens
tgaatattgccattatgc

SEQ ID NO: 4601234 - DNA, 15 bp, Homo sapiens
tgaatccaaactaat

SEQ ID NO: 4601235 - DNA, 20 bp, Homo sapiens
tgaatgaatggctaagcaaa

SEQ ID NO: 4601236 - DNA, 18 bp, Homo sapiens
tgaatgaggtcccaggca

SEQ ID NO: 4601237 - DNA, 22 bp, Homo sapiens
tgaatgaggtcccaggcagaga

SEQ ID NO: 4601238 - DNA, 23 bp, Homo sapiens
tgaattctgctctaaataaagac

SEQ ID NO: 4601239 - DNA, 15 bp, Homo sapiens
tgaatttcttttgcc

SEQ ID NO: 4601240 - DNA, 14 bp, Homo sapiens
tgaccactggccta

SEQ ID NO: 4601241 - DNA, 17 bp, Homo sapiens
tgacccagtgcccccac

SEQ ID NO: 4601242 - DNA, 23 bp, Homo sapiens
tgacccagtgcccccactgacca

SEQ ID NO: 4601243 - DNA, 22 bp, Homo sapiens
tgacctagttttccatgcgtgt

SEQ ID NO: 4601244 - DNA, 21 bp, Homo sapiens
tgacctctgcagcaataaagc

SEQ ID NO: 4601245 - DNA, 14 bp, Homo sapiens
tgactatctcccct

SEQ ID NO: 4601246 - DNA, 15 bp, Homo sapiens
tgactgaatttcttt

SEQ ID NO: 4601247 - DNA, 20 bp, Homo sapiens
tgacttactgtacatgaaaa

SEQ ID NO: 4601248 - DNA, 22 bp, Homo sapiens
tgactttttaaaaaatgctggg

SEQ ID NO: 4601249 - DNA, 23 bp, Homo sapiens
tgactttttgcatttaaaacaga

SEQ ID NO: 4601250 - DNA, 14 bp, Homo sapiens
tgagacagctctgc

SEQ ID NO: 4601251 - DNA, 16 bp, Homo sapiens
tgagacagctctgcat

SEQ ID NO: 4601252 - DNA, 17 bp, Homo sapiens
tgagaccagcctgggca

SEQ ID NO: 4601253 - DNA, 23 bp, Homo sapiens
tgagcatcgcttaggagaagtct

SEQ ID NO: 4601254 - DNA, 12 bp, Homo sapiens
tgagcccaggag

SEQ ID NO: 4601255 - DNA, 18 bp, Homo sapiens
tgagccttgaactttgac

SEQ ID NO: 4601256 - DNA, 19 bp, Homo sapiens
tgagccttgaactttgacc

SEQ ID NO: 4601257 - DNA, 15 bp, Homo sapiens
tgagctatttcatct

SEQ ID NO: 4601258 - DNA, 12 bp, Homo sapiens
tgagctctctgt

SEQ ID NO: 4601259 - DNA, 20 bp, Homo sapiens
tgaggcaatgtcaggaacag

SEQ ID NO: 4601260 - DNA, 20 bp, Homo sapiens
tgaggcatttgtttgaactg

SEQ ID NO: 4601261 - DNA, 13 bp, Homo sapiens
tgaggccaggagt

SEQ ID NO: 4601262 - DNA, 17 bp, Homo sapiens
tgagtcgtacagaaagc

SEQ ID NO: 4601263 - DNA, 14 bp, Homo sapiens
tgataacatggaaa

SEQ ID NO: 4601264 - DNA, 18 bp, Homo sapiens
tgatagcaaatggcctca

SEQ ID NO: 4601265 - DNA, 22 bp, Homo sapiens
tgataggttattttgatgtaaa

SEQ ID NO: 4601266 - DNA, 24 bp, Homo sapiens
tgatagttgtaccgcaatgtgact

SEQ ID NO: 4601267 - DNA, 14 bp, Homo sapiens
tgatatattttaca

SEQ ID NO: 4601268 - DNA, 15 bp, Homo sapiens
tgatatattttacaa

SEQ ID NO: 4601269 - DNA, 13 bp, Homo sapiens
tgatctggaaccc

SEQ ID NO: 4601270 - DNA, 17 bp, Homo sapiens
tgatctggaacccagac

SEQ ID NO: 4601271 - DNA, 19 bp, Homo sapiens
tgatctggaacccagactc

SEQ ID NO: 4601272 - DNA, 18 bp, Homo sapiens
tgatggcaacagatctgg

SEQ ID NO: 4601273 - DNA, 22 bp, Homo sapiens
tgatggcaccactgcactccag

SEQ ID NO: 4601274 - DNA, 17 bp, Homo sapiens
tgatgttttaaggatgc

SEQ ID NO: 4601275 - DNA, 12 bp, Homo sapiens
tgattaaaccaa

SEQ ID NO: 4601276 - DNA, 20 bp, Homo sapiens
tgattaaattcttgcaaagt

SEQ ID NO: 4601277 - DNA, 14 bp, Homo sapiens
tgattaccagggac

SEQ ID NO: 4601278 - DNA, 17 bp, Homo sapiens
tgattcaatctgtaaac

SEQ ID NO: 4601279 - DNA, 22 bp, Homo sapiens
tgattcaatctgtaaactgtgt

SEQ ID NO: 4601280 - DNA, 23 bp, Homo sapiens
tgattcaatctgtaaactgtgta

SEQ ID NO: 4601281 - DNA, 14 bp, Homo sapiens
tgattcatattgca

SEQ ID NO: 4601282 - DNA, 15 bp, Homo sapiens
tgattcatattgcat

SEQ ID NO: 4601283 - DNA, 12 bp, Homo sapiens
tgattctgcctt

SEQ ID NO: 4601284 - DNA, 15 bp, Homo sapiens
tgatttaatttgaaa

SEQ ID NO: 4601285 - DNA, 20 bp, Homo sapiens
tgatttaggagaagccagga

SEQ ID NO: 4601286 - DNA, 22 bp, Homo sapiens
tgcaaacctgacccctgctcag

SEQ ID NO: 4601287 - DNA, 23 bp, Homo sapiens
tgcaaagatctgtcctcagcctt

SEQ ID NO: 4601288 - DNA, 16 bp, Homo sapiens
tgcaaccgtctgttat

SEQ ID NO: 4601289 - DNA, 12 bp, Homo sapiens
tgcaaggaagga

SEQ ID NO: 4601290 - DNA, 16 bp, Homo sapiens
tgcaaggaaggaaaga

SEQ ID NO: 4601291 - DNA, 21 bp, Homo sapiens
tgcaataaatctgacccagtg

SEQ ID NO: 4601292 - DNA, 11 bp, Homo sapiens
tgcacacattt

SEQ ID NO: 4601293 - DNA, 20 bp, Homo sapiens
tgcacacattttttaaatgc

SEQ ID NO: 4601294 - DNA, 21 bp, Homo sapiens
tgcacactgtcctattatatt

SEQ ID NO: 4601295 - DNA, 18 bp, Homo sapiens
tgcacagagttgttacat

SEQ ID NO: 4601296 - DNA, 19 bp, Homo sapiens
tgcacagagttgttacatt

SEQ ID NO: 4601297 - DNA, 20 bp, Homo sapiens
tgcacagagttgttacattt

SEQ ID NO: 4601298 - DNA, 15 bp, Homo sapiens
tgcactgtgaaggac

SEQ ID NO: 4601299 - DNA, 14 bp, Homo sapiens
tgcagaagacagta

SEQ ID NO: 4601300 - DNA, 15 bp, Homo sapiens
tgcagaagacagtat

SEQ ID NO: 4601301 - DNA, 14 bp, Homo sapiens
tgcagcaagcctgg

SEQ ID NO: 4601302 - DNA, 23 bp, Homo sapiens
tgcagcacagctgagaggctgtc

SEQ ID NO: 4601303 - DNA, 22 bp, Homo sapiens
tgcatactttttaaatgtaaag

SEQ ID NO: 4601304 - DNA, 20 bp, Homo sapiens
tgcatgaagtaatatgcaca

SEQ ID NO: 4601305 - DNA, 22 bp, Homo sapiens
tgcatgaagtaatatgcacaca

SEQ ID NO: 4601306 - DNA, 21 bp, Homo sapiens
tgcatggtgccccaggaccag

SEQ ID NO: 4601307 - DNA, 15 bp, Homo sapiens
tgcatgtttgtgatt

SEQ ID NO: 4601308 - DNA, 22 bp, Homo sapiens
tgcatttaaaacagacactggc

SEQ ID NO: 4601309 - DNA, 18 bp, Homo sapiens
tgcatttgaggtctgttc

SEQ ID NO: 4601310 - DNA, 19 bp, Homo sapiens
tgccacaaggacttcctgt

SEQ ID NO: 4601311 - DNA, 15 bp, Homo sapiens
tgccacattaaattg

SEQ ID NO: 4601312 - DNA, 20 bp, Homo sapiens
tgccactaaattgacactta

SEQ ID NO: 4601313 - DNA, 23 bp, Homo sapiens
tgtcatttgctggagctctgccc

SEQ ID NO: 4601314 - DNA, 16 bp, Homo sapiens
tgtccagctccaacct

SEQ ID NO: 4601315 - DNA, 20 bp, Homo sapiens
tgtccagctccaacctgcaa

SEQ ID NO: 4601316 - DNA, 15 bp, Homo sapiens
tgtcctattatattc

SEQ ID NO: 4601317 - DNA, 22 bp, Homo sapiens
tgtcctgtaaaggttacaagcc

SEQ ID NO: 4601318 - DNA, 17 bp, Homo sapiens
tgtctctactaaaaata

SEQ ID NO: 4601319 - DNA, 13 bp, Homo sapiens
tgtctcttctgag

SEQ ID NO: 4601320 - DNA, 16 bp, Homo sapiens
tgtctcttctgagcta

SEQ ID NO: 4601321 - DNA, 18 bp, Homo sapiens
tgtcttaattttctttca

SEQ ID NO: 4601322 - DNA, 14 bp, Homo sapiens
tgtctttaaggaaa

SEQ ID NO: 4601323 - DNA, 17 bp, Homo sapiens
tgtgcacatctgttttg

SEQ ID NO: 4601324 - DNA, 16 bp, Homo sapiens
tgtgcattatctagat

SEQ ID NO: 4601325 - DNA, 19 bp, Homo sapiens
tgtgcattatctagatact

SEQ ID NO: 4601326 - DNA, 23 bp, Homo sapiens
tgtgcatttggtggtttcagaaa

SEQ ID NO: 4601327 - DNA, 18 bp, Homo sapiens
tgtgctatactgcatact

SEQ ID NO: 4601328 - DNA, 20 bp, Homo sapiens
tgtgctatactgcatacttt

SEQ ID NO: 4601329 - DNA, 21 bp, Homo sapiens
tgtgctatactgcatactttt

SEQ ID NO: 4601330 - DNA, 20 bp, Homo sapiens
tgtggatttaacagaaatgt

SEQ ID NO: 4601331 - DNA, 17 bp, Homo sapiens
tgtgtacataactgaaa

SEQ ID NO: 4601332 - DNA, 14 bp, Homo sapiens
tgtgtattccaaga

SEQ ID NO: 4601333 - DNA, 23 bp, Homo sapiens
tgtgtggtcaacatttctcatgt

SEQ ID NO: 4601334 - DNA, 23 bp, Homo sapiens
tgtgttatcacccagaagaaaat

SEQ ID NO: 4601335 - DNA, 17 bp, Homo sapiens
tgttatgtagataacaa

SEQ ID NO: 4601336 - DNA, 13 bp, Homo sapiens
tgttatttattga

SEQ ID NO: 4601337 - DNA, 15 bp, Homo sapiens
tgttatttattgaaa

SEQ ID NO: 4601338 - DNA, 17 bp, Homo sapiens
tgttatttattgaaatg

SEQ ID NO: 4601339 - DNA, 14 bp, Homo sapiens
tgttccccagagaa

SEQ ID NO: 4601340 - DNA, 22 bp, Homo sapiens
tgttctaaatatcccttggaca

SEQ ID NO: 4601341 - DNA, 22 bp, Homo sapiens
tgttcttggtttgtaaattaac

SEQ ID NO: 4601342 - DNA, 13 bp, Homo sapiens
tgttctttccaaa

SEQ ID NO: 4601343 - DNA, 15 bp, Homo sapiens
tgttgattaaagatg

SEQ ID NO: 4601344 - DNA, 14 bp, Homo sapiens
tgttggtcatttta

SEQ ID NO: 4601345 - DNA, 15 bp, Homo sapiens
tgtttagatgaatgt

SEQ ID NO: 4601346 - DNA, 20 bp, Homo sapiens
tgtttagctatttaatacta

SEQ ID NO: 4601347 - DNA, 21 bp, Homo sapiens
tgtttatgcaaggaaggaaag

SEQ ID NO: 4601348 - DNA, 13 bp, Homo sapiens
tgtttgtgattga

SEQ ID NO: 4601349 - DNA, 23 bp, Homo sapiens
tgttttaaggatgcttgtacata

SEQ ID NO: 4601350 - DNA, 13 bp, Homo sapiens
tgttttcaaatgt

SEQ ID NO: 4601351 - DNA, 19 bp, Homo sapiens
ttaaaaaaaactatttaac

SEQ ID NO: 4601352 - DNA, 20 bp, Homo sapiens
ttaaaaatctcaaatttcta

SEQ ID NO: 4601353 - DNA, 14 bp, Homo sapiens
ttaaaacagacact

SEQ ID NO: 4601354 - DNA, 17 bp, Homo sapiens
ttaaaagatacagttac

SEQ ID NO: 4601355 - DNA, 22 bp, Homo sapiens
ttaaactgtattttatgttatt

SEQ ID NO: 4601356 - DNA, 18 bp, Homo sapiens
ttaaacttaatctaaatg

SEQ ID NO: 4601357 - DNA, 20 bp, Homo sapiens
ttaaacttaatctaaatgga

SEQ ID NO: 4601358 - DNA, 15 bp, Homo sapiens
ttaaacttttttaac

SEQ ID NO: 4601359 - DNA, 19 bp, Homo sapiens
ttaaataatgtgaaactgg

SEQ ID NO: 4601360 - DNA, 11 bp, Homo sapiens
ttaaatgcacc

SEQ ID NO: 4601361 - DNA, 12 bp, Homo sapiens
ttaacagaaatg

SEQ ID NO: 4601362 - DNA, 19 bp, Homo sapiens
ttaacagaaatgtacagca

SEQ ID NO: 4601363 - DNA, 16 bp, Homo sapiens
ttaacttcacatattg

SEQ ID NO: 4601364 - DNA, 12 bp, Homo sapiens
ttaacttttata

SEQ ID NO: 4601365 - DNA, 21 bp, Homo sapiens
ttaagaaaaaggatgcacaga

SEQ ID NO: 4601366 - DNA, 16 bp, Homo sapiens
ttaagaactaaaatgt

SEQ ID NO: 4601367 - DNA, 11 bp, Homo sapiens
ttaagacctgg

SEQ ID NO: 4601368 - DNA, 19 bp, Homo sapiens
ttaaggatgcttgtacata

SEQ ID NO: 4601369 - DNA, 20 bp, Homo sapiens
ttaaggatgcttgtacataa

SEQ ID NO: 4601370 - DNA, 22 bp, Homo sapiens
ttaaggatgcttgtacataatg

SEQ ID NO: 4601371 - DNA, 13 bp, Homo sapiens
ttaagggtatgat

SEQ ID NO: 4601372 - DNA, 22 bp, Homo sapiens
ttaagtgctgcatttaaaagat

SEQ ID NO: 4601373 - DNA, 20 bp, Homo sapiens
ttaatactaattttccataa

SEQ ID NO: 4601374 - DNA, 13 bp, Homo sapiens
ttaatcattaggt

SEQ ID NO: 4601375 - DNA, 17 bp, Homo sapiens
ttaatctctaacagtgg

SEQ ID NO: 4601376 - DNA, 21 bp, Homo sapiens
ttaatgatatgcttgtaacta

SEQ ID NO: 4601377 - DNA, 15 bp, Homo sapiens
ttaatttgaaatatg

SEQ ID NO: 4601378 - DNA, 15 bp, Homo sapiens
ttacaattttttatc

SEQ ID NO: 4601379 - DNA, 17 bp, Homo sapiens
ttacaattttttatcat

SEQ ID NO: 4601380 - DNA, 18 bp, Homo sapiens
ttacaattttttatcatg

SEQ ID NO: 4601381 - DNA, 16 bp, Homo sapiens
ttacactttttggaag

SEQ ID NO: 4601382 - DNA, 19 bp, Homo sapiens
ttacagctcattaaacttt

SEQ ID NO: 4601383 - DNA, 18 bp, Homo sapiens
ttacaggtggacacacaa

SEQ ID NO: 4601384 - DNA, 12 bp, Homo sapiens
ttacatttttaa

SEQ ID NO: 4601385 - DNA, 17 bp, Homo sapiens
ttacatttttaagtgct

SEQ ID NO: 4601386 - DNA, 20 bp, Homo sapiens
ttacatttttaagtgctgca

SEQ ID NO: 4601387 - DNA, 13 bp, Homo sapiens
ttacctactttga

SEQ ID NO: 4601388 - DNA, 23 bp, Homo sapiens
ttactcagaattctctagtttga

SEQ ID NO: 4601389 - DNA, 14 bp, Homo sapiens
ttactgatatattt

SEQ ID NO: 4601390 - DNA, 12 bp, Homo sapiens
ttactgtacatg

SEQ ID NO: 4601391 - DNA, 13 bp, Homo sapiens
ttactgtacatga

SEQ ID NO: 4601392 - DNA, 22 bp, Homo sapiens
ttactgtacatgaaaacacatt

SEQ ID NO: 4601393 - DNA, 23 bp, Homo sapiens
ttactgtacatgaaaacacattt

SEQ ID NO: 4601394 - DNA, 15 bp, Homo sapiens
ttacttttaaactgt

SEQ ID NO: 4601395 - DNA, 21 bp, Homo sapiens
ttagaaaacataatcttctgc

SEQ ID NO: 4601396 - DNA, 16 bp, Homo sapiens
ttagatgtaattttgt

SEQ ID NO: 4601397 - DNA, 21 bp, Homo sapiens
ttaggtgtgactgaatttctt

SEQ ID NO: 4601398 - DNA, 17 bp, Homo sapiens
ttagtgcttatctaatt

SEQ ID NO: 4601399 - DNA, 16 bp, Homo sapiens
ttagtggctcaacatt

SEQ ID NO: 4601400 - DNA, 20 bp, Homo sapiens
ttagtggctcaacattgtgt

SEQ ID NO: 4601401 - DNA, 23 bp, Homo sapiens
ttagtggctcaacattgtgttcc

SEQ ID NO: 4601402 - DNA, 16 bp, Homo sapiens
ttagttccactgagac

SEQ ID NO: 4601403 - DNA, 15 bp, Homo sapiens
ttatatgaagaaaat

SEQ ID NO: 4601404 - DNA, 18 bp, Homo sapiens
ttatcacccagaagaaaa

SEQ ID NO: 4601405 - DNA, 21 bp, Homo sapiens
ttatcataaacattttacatg

SEQ ID NO: 4601406 - DNA, 17 bp, Homo sapiens
ttatctaatttgtgcct

SEQ ID NO: 4601407 - DNA, 17 bp, Homo sapiens
ttatcttggttgaaaat

SEQ ID NO: 4601408 - DNA, 22 bp, Homo sapiens
ttatgatagcaaatggcctcat

SEQ ID NO: 4601409 - DNA, 20 bp, Homo sapiens
ttatgatggttttaaacttt

SEQ ID NO: 4601410 - DNA, 17 bp, Homo sapiens
ttatgcaaggaaggaaa

SEQ ID NO: 4601411 - DNA, 22 bp, Homo sapiens
ttatgcaaggaaggaaagaaag

SEQ ID NO: 4601412 - DNA, 17 bp, Homo sapiens
ttatgctgtgacacatg

SEQ ID NO: 4601413 - DNA, 15 bp, Homo sapiens
ttatgggccctgcct

SEQ ID NO: 4601414 - DNA, 13 bp, Homo sapiens
ttatgttaatatt

SEQ ID NO: 4601415 - DNA, 16 bp, Homo sapiens
ttattcctcctgctca

SEQ ID NO: 4601416 - DNA, 20 bp, Homo sapiens
ttattcctcctgctcatatt

SEQ ID NO: 4601417 - DNA, 15 bp, Homo sapiens
ttattggctgagata

SEQ ID NO: 4601418 - DNA, 16 bp, Homo sapiens
ttcaaattcttctgaa

SEQ ID NO: 4601419 - DNA, 17 bp, Homo sapiens
ttcaatctgtaaactgt

SEQ ID NO: 4601420 - DNA, 18 bp, Homo sapiens
ttcaatctgtaaactgtg

SEQ ID NO: 4601421 - DNA, 19 bp, Homo sapiens
ttcacattttccttttcaa

SEQ ID NO: 4601422 - DNA, 17 bp, Homo sapiens
ttcacctgtaaacctga

SEQ ID NO: 4601423 - DNA, 14 bp, Homo sapiens
ttcacttgcacatc

SEQ ID NO: 4601424 - DNA, 18 bp, Homo sapiens
ttcacttgcacatcatgg

SEQ ID NO: 4601425 - DNA, 20 bp, Homo sapiens
ttcagacatagaattaacac

SEQ ID NO: 4601426 - DNA, 13 bp, Homo sapiens
ttcagaggctcag

SEQ ID NO: 4601427 - DNA, 22 bp, Homo sapiens
ttcagaggctcagattgtaata

SEQ ID NO: 4601428 - DNA, 21 bp, Homo sapiens
ttcatattttaaacagaggat

SEQ ID NO: 4601429 - DNA, 14 bp, Homo sapiens
ttcattagttttga

SEQ ID NO: 4601430 - DNA, 16 bp, Homo sapiens
ttccaagttgctaata

SEQ ID NO: 4601431 - DNA, 12 bp, Homo sapiens
ttccacacttct

SEQ ID NO: 4601432 - DNA, 14 bp, Homo sapiens
ttccacagaggaca

SEQ ID NO: 4601433 - DNA, 20 bp, Homo sapiens
ttccagtcttcctgacactt

SEQ ID NO: 4601434 - DNA, 18 bp, Homo sapiens
ttccagtggatcataaga

SEQ ID NO: 4601435 - DNA, 14 bp, Homo sapiens
ttccataagctatt

SEQ ID NO: 4601436 - DNA, 15 bp, Homo sapiens
ttccataagctattt

SEQ ID NO: 4601437 - DNA, 16 bp, Homo sapiens
ttccataagctatttt

SEQ ID NO: 4601438 - DNA, 14 bp, Homo sapiens
ttccctgcctctca

SEQ ID NO: 4601439 - DNA, 23 bp, Homo sapiens
ttccctgcctctcatcaactgaa

SEQ ID NO: 4601440 - DNA, 21 bp, Homo sapiens
ttccgcactgggcacaggccg

SEQ ID NO: 4601441 - DNA, 19 bp, Homo sapiens
ttcctgaagaaccagtccc

SEQ ID NO: 4601442 - DNA, 22 bp, Homo sapiens
ttcctgtccagctccaacctgc

SEQ ID NO: 4601443 - DNA, 13 bp, Homo sapiens
aaaaatacaaaaa

SEQ ID NO: 4601444 - DNA, 12 bp, Homo sapiens
aaaaatgctggg

SEQ ID NO: 4601445 - DNA, 13 bp, Homo sapiens
aaaacacattttt

SEQ ID NO: 4601446 - DNA, 15 bp, Homo sapiens
aaaacacatttttct

SEQ ID NO: 4601447 - DNA, 17 bp, Homo sapiens
aaaacataatcttctgc

SEQ ID NO: 4601448 - DNA, 13 bp, Homo sapiens
aaaacatgctaca

SEQ ID NO: 4601449 - DNA, 14 bp, Homo sapiens
aaaacatgctacac

SEQ ID NO: 4601450 - DNA, 16 bp, Homo sapiens
aaaaccactagaactc

SEQ ID NO: 4601451 - DNA, 14 bp, Homo sapiens
aaaactatttaaca

SEQ ID NO: 4601452 - DNA, 16 bp, Homo sapiens
aaaagattgctgaaat

SEQ ID NO: 4601453 - DNA, 18 bp, Homo sapiens
aaaagattgctgaaattt

SEQ ID NO: 4601454 - DNA, 21 bp, Homo sapiens
aaaagattgctgaaattttat

SEQ ID NO: 4601455 - DNA, 15 bp, Homo sapiens
aaaagcattttgtaa

SEQ ID NO: 4601456 - DNA, 16 bp, Homo sapiens
aaaagcattttgtaat

SEQ ID NO: 4601457 - DNA, 15 bp, Homo sapiens
aaaaggatgcacaga

SEQ ID NO: 4601458 - DNA, 22 bp, Homo sapiens
aaaaggatgcacagagttgtta

SEQ ID NO: 4601459 - DNA, 20 bp, Homo sapiens
aaaagtaggtttacattcat

SEQ ID NO: 4601460 - DNA, 18 bp, Homo sapiens
aaaagttctgcagataaa

SEQ ID NO: 4601461 - DNA, 20 bp, Homo sapiens
aaaattagaaattggctgga

SEQ ID NO: 4601462 - DNA, 14 bp, Homo sapiens
aaaattatatttgg

SEQ ID NO: 4601463 - DNA, 12 bp, Homo sapiens
aaacagacactg

SEQ ID NO: 4601464 - DNA, 20 bp, Homo sapiens
aaacagaggccatggcagaa

SEQ ID NO: 4601465 - DNA, 20 bp, Homo sapiens
aaacataatcttctgccttc

SEQ ID NO: 4601466 - DNA, 14 bp, Homo sapiens
aaacattttacatg

SEQ ID NO: 4601467 - DNA, 16 bp, Homo sapiens
aaaccactagaactct

SEQ ID NO: 4601468 - DNA, 21 bp, Homo sapiens
aaaccctgtctctactaaaaa

SEQ ID NO: 4601469 - DNA, 18 bp, Homo sapiens
aaacctgacccctgctca

SEQ ID NO: 4601470 - DNA, 22 bp, Homo sapiens
aaactccagatgccacaatgga

SEQ ID NO: 4601471 - DNA, 16 bp, Homo sapiens
aaactgtgtattccaa

SEQ ID NO: 4601472 - DNA, 16 bp, Homo sapiens
aaacttaatctaaatg

SEQ ID NO: 4601473 - DNA, 19 bp, Homo sapiens
aaacttaatctaaatggaa

SEQ ID NO: 4601474 - DNA, 17 bp, Homo sapiens
aaactttacctttttta

SEQ ID NO: 4601475 - DNA, 18 bp, Homo sapiens
aaactttactatggccct

SEQ ID NO: 4601476 - DNA, 15 bp, Homo sapiens
aaagaggaatgaagt

SEQ ID NO: 4601477 - DNA, 18 bp, Homo sapiens
aaagatctgtcctcagcc

SEQ ID NO: 4601478 - DNA, 19 bp, Homo sapiens
aaagattgctgaaatttta

SEQ ID NO: 4601479 - DNA, 16 bp, Homo sapiens
aaagcagcgtttctat

SEQ ID NO: 4601480 - DNA, 22 bp, Homo sapiens
aaagcagcgtttctatgacaca

SEQ ID NO: 4601481 - DNA, 17 bp, Homo sapiens
aaagcagggacttgaac

SEQ ID NO: 4601482 - DNA, 14 bp, Homo sapiens
aaagcattttgtaa

SEQ ID NO: 4601483 - DNA, 21 bp, Homo sapiens
aaagcattttgtaataataaa

SEQ ID NO: 4601484 - DNA, 12 bp, Homo sapiens
aaagccagcctg

SEQ ID NO: 4601485 - DNA, 13 bp, Homo sapiens
aaagccagcctgg

SEQ ID NO: 4601486 - DNA, 16 bp, Homo sapiens
aaaggcaaccaataaa

SEQ ID NO: 4601487 - DNA, 14 bp, Homo sapiens
aaaggcagaagcaa

SEQ ID NO: 4601488 - DNA, 17 bp, Homo sapiens
aaaggctacctttgtat

SEQ ID NO: 4601489 - DNA, 20 bp, Homo sapiens
aaaggtattttaatcaccaa

SEQ ID NO: 4601490 - DNA, 18 bp, Homo sapiens
aaagtctgttgattaaag

SEQ ID NO: 4601491 - DNA, 19 bp, Homo sapiens
aaagtctgttgattaaaga

SEQ ID NO: 4601492 - DNA, 14 bp, Homo sapiens
aaagtgtatttttt

SEQ ID NO: 4601493 - DNA, 22 bp, Homo sapiens
aaagtgtatttttttactaata

SEQ ID NO: 4601494 - DNA, 16 bp, Homo sapiens
aaataaaactttttaa

SEQ ID NO: 4601495 - DNA, 14 bp, Homo sapiens
aaataattttgtaa

SEQ ID NO: 4601496 - DNA, 21 bp, Homo sapiens
aaataccagccagtaaatggg

SEQ ID NO: 4601497 - DNA, 15 bp, Homo sapiens
aaatataggaactta

SEQ ID NO: 4601498 - DNA, 23 bp, Homo sapiens
aaatatcccttggacattttatg

SEQ ID NO: 4601499 - DNA, 19 bp, Homo sapiens
aaatatggtcttttggtta

SEQ ID NO: 4601500 - DNA, 22 bp, Homo sapiens
aaatatttagatgtaattttgt

SEQ ID NO: 4601501 - DNA, 19 bp, Homo sapiens
aaatctcaaatttctaaat

SEQ ID NO: 4601502 - DNA, 14 bp, Homo sapiens
aaatctgacccagt

SEQ ID NO: 4601503 - DNA, 18 bp, Homo sapiens
aaatctgacccagtgccc

SEQ ID NO: 4601504 - DNA, 15 bp, Homo sapiens
aaatgatttcacagt

SEQ ID NO: 4601505 - DNA, 14 bp, Homo sapiens
aaatgcacctggaa

SEQ ID NO: 4601506 - DNA, 22 bp, Homo sapiens
aaatgcacctggaatatataac

SEQ ID NO: 4601507 - DNA, 23 bp, Homo sapiens
aaatgccttaccctcatgttctt

SEQ ID NO: 4601508 - DNA, 21 bp, Homo sapiens
aaatggggccagatccagcct

SEQ ID NO: 4601509 - DNA, 16 bp, Homo sapiens
aaatgggggtgcattt

SEQ ID NO: 4601510 - DNA, 18 bp, Homo sapiens
aaatgggggtgcatttga

SEQ ID NO: 4601511 - DNA, 20 bp, Homo sapiens
aaatgttcatcaatgaatga

SEQ ID NO: 4601512 - DNA, 14 bp, Homo sapiens
aaattaacttttat

SEQ ID NO: 4601513 - DNA, 19 bp, Homo sapiens
aaattaacttttataaact

SEQ ID NO: 4601514 - DNA, 22 bp, Homo sapiens
aaattaacttttataaacttta

SEQ ID NO: 4601515 - DNA, 15 bp, Homo sapiens
aaattcttgcaaagt

SEQ ID NO: 4601516 - DNA, 19 bp, Homo sapiens
aaattgacacttaaaaatg

SEQ ID NO: 4601517 - DNA, 19 bp, Homo sapiens
aaattgataacatggaaat

SEQ ID NO: 4601518 - DNA, 12 bp, Homo sapiens
aaatttctaaat

SEQ ID NO: 4601519 - DNA, 22 bp, Homo sapiens
aacaaaggcctaattctatgcc

SEQ ID NO: 4601520 - DNA, 17 bp, Homo sapiens
aacaagaccacgtttct

SEQ ID NO: 4601521 - DNA, 19 bp, Homo sapiens
aacaagaccacgtttctaa

SEQ ID NO: 4601522 - DNA, 23 bp, Homo sapiens
aacaagacctcagtgccttcctg

SEQ ID NO: 4601523 - DNA, 11 bp, Homo sapiens
aacagaaatgt

SEQ ID NO: 4601524 - DNA, 12 bp, Homo sapiens
aacagaaatgta

SEQ ID NO: 4601525 - DNA, 14 bp, Homo sapiens
aacagaaatgtaca

SEQ ID NO: 4601526 - DNA, 13 bp, Homo sapiens
aacagaaggatga

SEQ ID NO: 4601527 - DNA, 16 bp, Homo sapiens
aacagacaacagaagt

SEQ ID NO: 4601528 - DNA, 21 bp, Homo sapiens
aacagatctggaacctcagcc

SEQ ID NO: 4601529 - DNA, 13 bp, Homo sapiens
aacagatttggaa

SEQ ID NO: 4601530 - DNA, 19 bp, Homo sapiens
aacatccttcaagaactct

SEQ ID NO: 4601531 - DNA, 14 bp, Homo sapiens
aacattgtagcctc

SEQ ID NO: 4601532 - DNA, 13 bp, Homo sapiens
aacattgtgttcc

SEQ ID NO: 4601533 - DNA, 23 bp, Homo sapiens
aacattgtgttcccatttcagct

SEQ ID NO: 4601534 - DNA, 22 bp, Homo sapiens
aaccactctatcaagtattata

SEQ ID NO: 4601535 - DNA, 18 bp, Homo sapiens
aaccagggccccggggcc

SEQ ID NO: 4601536 - DNA, 13 bp, Homo sapiens
aacccaaatgttc

SEQ ID NO: 4601537 - DNA, 16 bp, Homo sapiens
aacccagactcagaca

SEQ ID NO: 4601538 - DNA, 17 bp, Homo sapiens
aacccctgtaggcctca

SEQ ID NO: 4601539 - DNA, 22 bp, Homo sapiens
aacctatgatattttctgtgcc

SEQ ID NO: 4601540 - DNA, 18 bp, Homo sapiens
aacctcaactgcctactc

SEQ ID NO: 4601541 - DNA, 12 bp, Homo sapiens
aacctcagcctg

SEQ ID NO: 4601542 - DNA, 20 bp, Homo sapiens
aatgaccaagctcagttcaa

SEQ ID NO: 4601543 - DNA, 19 bp, Homo sapiens
aatgaggtcagcatgtcta

SEQ ID NO: 4601544 - DNA, 15 bp, Homo sapiens
aatgaggtcccaggc

SEQ ID NO: 4601545 - DNA, 18 bp, Homo sapiens
aatgataccctgaatttg

SEQ ID NO: 4601546 - DNA, 23 bp, Homo sapiens
aatgccttaccctcatgttctta

SEQ ID NO: 4601547 - DNA, 18 bp, Homo sapiens
aatgcgtgcataccactt

SEQ ID NO: 4601548 - DNA, 21 bp, Homo sapiens
aatgcgtgcataccacttttg

SEQ ID NO: 4601549 - DNA, 22 bp, Homo sapiens
aatggaccctttttgttatgat

SEQ ID NO: 4601550 - DNA, 12 bp, Homo sapiens
aatggggccaga

SEQ ID NO: 4601551 - DNA, 14 bp, Homo sapiens
aatggggccagatc

SEQ ID NO: 4601552 - DNA, 20 bp, Homo sapiens
aatggtactccacatatttc

SEQ ID NO: 4601553 - DNA, 14 bp, Homo sapiens
aatggtagttttac

SEQ ID NO: 4601554 - DNA, 16 bp, Homo sapiens
aatggtcgcccaggag

SEQ ID NO: 4601555 - DNA, 18 bp, Homo sapiens
aatgtcaggaacagaagg

SEQ ID NO: 4601556 - DNA, 16 bp, Homo sapiens
aatgttcatcaatgaa

SEQ ID NO: 4601557 - DNA, 23 bp, Homo sapiens
aatgttggtcattttatgttaag

SEQ ID NO: 4601558 - DNA, 23 bp, Homo sapiens
aatgtttatgcaaggaaggaaag

SEQ ID NO: 4601559 - DNA, 19 bp, Homo sapiens
aattaatgaagttgattca

SEQ ID NO: 4601560 - DNA, 15 bp, Homo sapiens
aattaccaacctgtt

SEQ ID NO: 4601561 - DNA, 14 bp, Homo sapiens
aattactggtccaa

SEQ ID NO: 4601562 - DNA, 13 bp, Homo sapiens
aattctatgcctg

SEQ ID NO: 4601563 - DNA, 13 bp, Homo sapiens
aattcttctgaac

SEQ ID NO: 4601564 - DNA, 15 bp, Homo sapiens
aattcttctgaactc

SEQ ID NO: 4601565 - DNA, 16 bp, Homo sapiens
aattgacccacaagaa

SEQ ID NO: 4601566 - DNA, 21 bp, Homo sapiens
aattgacccacaagaaatgaa

SEQ ID NO: 4601567 - DNA, 22 bp, Homo sapiens
aattgacccacaagaaatgaaa

SEQ ID NO: 4601568 - DNA, 23 bp, Homo sapiens
aatttatgaattgaattatcttg

SEQ ID NO: 4601569 - DNA, 14 bp, Homo sapiens
aatttattatggca

SEQ ID NO: 4601570 - DNA, 23 bp, Homo sapiens
aatttcagactcccattcctgaa

SEQ ID NO: 4601571 - DNA, 22 bp, Homo sapiens
aatttcccaggaccctgaaggg

SEQ ID NO: 4601572 - DNA, 14 bp, Homo sapiens
aatttgtgatacaa

SEQ ID NO: 4601573 - DNA, 16 bp, Homo sapiens
aattttccataagcta

SEQ ID NO: 4601574 - DNA, 14 bp, Homo sapiens
aattttgatgtttt

SEQ ID NO: 4601575 - DNA, 14 bp, Homo sapiens
aattttgtgtaaga

SEQ ID NO: 4601576 - DNA, 13 bp, Homo sapiens
acaaagactgagt

SEQ ID NO: 4601577 - DNA, 13 bp, Homo sapiens
acaagaaatgaaa

SEQ ID NO: 4601578 - DNA, 19 bp, Homo sapiens
acaagaccacgtttctaaa

SEQ ID NO: 4601579 - DNA, 17 bp, Homo sapiens
acaaggatagatgctgg

SEQ ID NO: 4601580 - DNA, 16 bp, Homo sapiens
acaataaaaatgttta

SEQ ID NO: 4601581 - DNA, 17 bp, Homo sapiens
acaatgacttactgtac

SEQ ID NO: 4601582 - DNA, 20 bp, Homo sapiens
acaatgacttactgtacatg

SEQ ID NO: 4601583 - DNA, 24 bp, Homo sapiens
acaatgctgtgccctaaagtgtat

SEQ ID NO: 4601584 - DNA, 18 bp, Homo sapiens
acaatggaccctttttgt

SEQ ID NO: 4601585 - DNA, 18 bp, Homo sapiens
acaatttatgaattgaat

SEQ ID NO: 4601586 - DNA, 16 bp, Homo sapiens
acaatttattatggca

SEQ ID NO: 4601587 - DNA, 16 bp, Homo sapiens
acacaggccctccctg

SEQ ID NO: 4601588 - DNA, 19 bp, Homo sapiens
acacatgcaaggtcatttt

SEQ ID NO: 4601589 - DNA, 14 bp, Homo sapiens
acacattttatttt

SEQ ID NO: 4601590 - DNA, 20 bp, Homo sapiens
acacattttattttattatg

SEQ ID NO: 4601591 - DNA, 16 bp, Homo sapiens
acacattttttaaatg

SEQ ID NO: 4601592 - DNA, 18 bp, Homo sapiens
acacattttttaaatgca

SEQ ID NO: 4601593 - DNA, 15 bp, Homo sapiens
acaccaatattcata

SEQ ID NO: 4601594 - DNA, 17 bp, Homo sapiens
acaccactacattctgt

SEQ ID NO: 4601595 - DNA, 18 bp, Homo sapiens
acaccggtaccctcctcc

SEQ ID NO: 4601596 - DNA, 17 bp, Homo sapiens
acactagcccaatgaaa

SEQ ID NO: 4601597 - DNA, 20 bp, Homo sapiens
acactagcccaatgaaatga

SEQ ID NO: 4601598 - DNA, 13 bp, Homo sapiens
acacttaaaaatg

SEQ ID NO: 4601599 - DNA, 12 bp, Homo sapiens
accctgaagggg

SEQ ID NO: 4601600 - DNA, 17 bp, Homo sapiens
accctgaaggggccatg

SEQ ID NO: 4601601 - DNA, 22 bp, Homo sapiens
accctgatttaggagaagccag

SEQ ID NO: 4601602 - DNA, 20 bp, Homo sapiens
accctgcctctacccaacca

SEQ ID NO: 4601603 - DNA, 15 bp, Homo sapiens
accggtaccctcctc

SEQ ID NO: 4601604 - DNA, 21 bp, Homo sapiens
acctaaagggactacctctgt

SEQ ID NO: 4601605 - DNA, 20 bp, Homo sapiens
acctaacaacattgtagcct

SEQ ID NO: 4601606 - DNA, 11 bp, Homo sapiens
acctaatccaa

SEQ ID NO: 4601607 - DNA, 15 bp, Homo sapiens
acctaatccaggcag

SEQ ID NO: 4601608 - DNA, 22 bp, Homo sapiens
acctcaactgcctactccaaaa

SEQ ID NO: 4601609 - DNA, 15 bp, Homo sapiens
acctcaggtgacttt

SEQ ID NO: 4601610 - DNA, 23 bp, Homo sapiens
acctcagtgccttcctgtttttc

SEQ ID NO: 4601611 - DNA, 15 bp, Homo sapiens
acctctgtgccttgc

SEQ ID NO: 4601612 - DNA, 20 bp, Homo sapiens
acctcttgagccttgaactt

SEQ ID NO: 4601613 - DNA, 17 bp, Homo sapiens
acctgacccctgctcag

SEQ ID NO: 4601614 - DNA, 23 bp, Homo sapiens
acctgacccctgctcagtaaagc

SEQ ID NO: 4601615 - DNA, 17 bp, Homo sapiens
acctgagccccaaaagg

SEQ ID NO: 4601616 - DNA, 13 bp, Homo sapiens
acctgatcctgga

SEQ ID NO: 4601617 - DNA, 22 bp, Homo sapiens
acctgcaaagatctgtcctcag

SEQ ID NO: 4601618 - DNA, 20 bp, Homo sapiens
acctgcacactgtcctatta

SEQ ID NO: 4601619 - DNA, 17 bp, Homo sapiens
acctggaatatataacc

SEQ ID NO: 4601620 - DNA, 17 bp, Homo sapiens
acctggcagctctggac

SEQ ID NO: 4601621 - DNA, 19 bp, Homo sapiens
accttgaaaactttatgct

SEQ ID NO: 4601622 - DNA, 14 bp, Homo sapiens
accttggcaccaga

SEQ ID NO: 4601623 - DNA, 16 bp, Homo sapiens
accttggcaccagaca

SEQ ID NO: 4601624 - DNA, 18 bp, Homo sapiens
accttggcaccagacacc

SEQ ID NO: 4601625 - DNA, 15 bp, Homo sapiens
acctttgtattctct

SEQ ID NO: 4601626 - DNA, 23 bp, Homo sapiens
acctttgtattctctcctgtacc

SEQ ID NO: 4601627 - DNA, 22 bp, Homo sapiens
accttttttatacataaacaag

SEQ ID NO: 4601628 - DNA, 13 bp, Homo sapiens
acgatttctgttt

SEQ ID NO: 4601629 - DNA, 23 bp, Homo sapiens
acgatttctgtttagataataca

SEQ ID NO: 4601630 - DNA, 16 bp, Homo sapiens
acgcctgtagtcctag

SEQ ID NO: 4601631 - DNA, 18 bp, Homo sapiens
acggccagggagaagctc

SEQ ID NO: 4601632 - DNA, 12 bp, Homo sapiens
acgtacacattt

SEQ ID NO: 4601633 - DNA, 14 bp, Homo sapiens
acgtttctaaaggc

SEQ ID NO: 4601634 - DNA, 14 bp, Homo sapiens
actaaaataatttt

SEQ ID NO: 4601635 - DNA, 17 bp, Homo sapiens
actaaaataattttgta

SEQ ID NO: 4601636 - DNA, 16 bp, Homo sapiens
actaaccagcagaaat

SEQ ID NO: 4601637 - DNA, 17 bp, Homo sapiens
actaaccagcagaaatg

SEQ ID NO: 4601638 - DNA, 22 bp, Homo sapiens
actaagtttttatggcttttgt

SEQ ID NO: 4601639 - DNA, 24 bp, Homo sapiens
actaatgccttactcttcttgaaa

SEQ ID NO: 4601640 - DNA, 11 bp, Homo sapiens
actacattctg

SEQ ID NO: 4601641 - DNA, 12 bp, Homo sapiens
actacattctgt

SEQ ID NO: 4601642 - DNA, 14 bp, Homo sapiens
actacattctgtta

SEQ ID NO: 4601643 - DNA, 13 bp, Homo sapiens
actaccacctcag

SEQ ID NO: 4601644 - DNA, 15 bp, Homo sapiens
actaccacctcaggt

SEQ ID NO: 4601645 - DNA, 22 bp, Homo sapiens
actacctgtaatgacaggcctg

SEQ ID NO: 4601646 - DNA, 13 bp, Homo sapiens
actagaactctcc

SEQ ID NO: 4601647 - DNA, 16 bp, Homo sapiens
actagaactctccatc

SEQ ID NO: 4601648 - DNA, 18 bp, Homo sapiens
actaggaaatccattcac

SEQ ID NO: 4601649 - DNA, 23 bp, Homo sapiens
actatatttgggcctgctccaga

SEQ ID NO: 4601650 - DNA, 19 bp, Homo sapiens
actatgatttaatttgaaa

SEQ ID NO: 4601651 - DNA, 14 bp, Homo sapiens
actcaaactgagga

SEQ ID NO: 4601652 - DNA, 20 bp, Homo sapiens
actcaaatggggccagatcc

SEQ ID NO: 4601653 - DNA, 19 bp, Homo sapiens
actcaataaagtgggcttt

SEQ ID NO: 4601654 - DNA, 14 bp, Homo sapiens
actcagatccaggg

SEQ ID NO: 4601655 - DNA, 14 bp, Homo sapiens
actcaggaggctga

SEQ ID NO: 4601656 - DNA, 18 bp, Homo sapiens
actcaggaggctgaggca

SEQ ID NO: 4601657 - DNA, 19 bp, Homo sapiens
actcaggaggctgaggcag

SEQ ID NO: 4601658 - DNA, 22 bp, Homo sapiens
actccaaaatgttggtcatttt

SEQ ID NO: 4601659 - DNA, 23 bp, Homo sapiens
actccagcctgggcaacagagca

SEQ ID NO: 4601660 - DNA, 22 bp, Homo sapiens
actcccattcctgaagaaccag

SEQ ID NO: 4601661 - DNA, 23 bp, Homo sapiens
actctatcaagtattataccttt

SEQ ID NO: 4601662 - DNA, 13 bp, Homo sapiens
actctctccaccc

SEQ ID NO: 4601663 - DNA, 21 bp, Homo sapiens
actctctccaccctatatgta

SEQ ID NO: 4601664 - DNA, 15 bp, Homo sapiens
actcttcttgaaatt

SEQ ID NO: 4601665 - DNA, 20 bp, Homo sapiens
actgaatgaggtcagcatgt

SEQ ID NO: 4601666 - DNA, 15 bp, Homo sapiens
actgagaaagaggca

SEQ ID NO: 4601667 - DNA, 22 bp, Homo sapiens
actgaggggaggggagcatggg

SEQ ID NO: 4601668 - DNA, 13 bp, Homo sapiens
actgataaagatg

SEQ ID NO: 4601669 - DNA, 11 bp, Homo sapiens
actgatgctgc

SEQ ID NO: 4601670 - DNA, 18 bp, Homo sapiens
actgcatactttttaaat

SEQ ID NO: 4601671 - DNA, 20 bp, Homo sapiens
actgcatactttttaaatgt

SEQ ID NO: 4601672 - DNA, 18 bp, Homo sapiens
actgcttaacttcacata

SEQ ID NO: 4601673 - DNA, 22 bp, Homo sapiens
actggattaaacttaatctaaa

SEQ ID NO: 4601674 - DNA, 23 bp, Homo sapiens
actggcatggatatagttttact

SEQ ID NO: 4601675 - DNA, 23 bp, Homo sapiens
actggcctacccctttctccagc

SEQ ID NO: 4601676 - DNA, 19 bp, Homo sapiens
actgtaatttgtgatacaa

SEQ ID NO: 4601677 - DNA, 21 bp, Homo sapiens
actgtacatgaaaacacattt

SEQ ID NO: 4601678 - DNA, 15 bp, Homo sapiens
actgtcctattatat

SEQ ID NO: 4601679 - DNA, 16 bp, Homo sapiens
actgtcctattatatt

SEQ ID NO: 4601680 - DNA, 19 bp, Homo sapiens
actgtcctgggcctgcaga

SEQ ID NO: 4601681 - DNA, 21 bp, Homo sapiens
actgtcttggctgtggggcta

SEQ ID NO: 4601682 - DNA, 16 bp, Homo sapiens
actgtgtacataactg

SEQ ID NO: 4601683 - DNA, 18 bp, Homo sapiens
actgtttcaaactttact

SEQ ID NO: 4601684 - DNA, 13 bp, Homo sapiens
acttaaaaatggt

SEQ ID NO: 4601685 - DNA, 21 bp, Homo sapiens
acttaaaaatggtttaaatgg

SEQ ID NO: 4601686 - DNA, 18 bp, Homo sapiens
acttaaataatgtgaaac

SEQ ID NO: 4601687 - DNA, 20 bp, Homo sapiens
acttaaataatgtgaaactg

SEQ ID NO: 4601688 - DNA, 17 bp, Homo sapiens
acttaatctaaatggaa

SEQ ID NO: 4601689 - DNA, 19 bp, Homo sapiens
acttaatctaaatggaacc

SEQ ID NO: 4601690 - DNA, 21 bp, Homo sapiens
acttactgtacatgaaaacac

SEQ ID NO: 4601691 - DNA, 22 bp, Homo sapiens
acttactgtacatgaaaacaca

SEQ ID NO: 4601692 - DNA, 20 bp, Homo sapiens
acttattggaactctgcttg

SEQ ID NO: 4601693 - DNA, 15 bp, Homo sapiens
acttatttaaactct

SEQ ID NO: 4601694 - DNA, 19 bp, Homo sapiens
acttcacatattgatttcc

SEQ ID NO: 4601695 - DNA, 23 bp, Homo sapiens
acttcctgtccagctccaacctg

SEQ ID NO: 4601696 - DNA, 22 bp, Homo sapiens
acttctgggcttcatctggcaa

SEQ ID NO: 4601697 - DNA, 12 bp, Homo sapiens
acttcttgaagg

SEQ ID NO: 4601698 - DNA, 20 bp, Homo sapiens
acttcttgaaggtgctgacg

SEQ ID NO: 4601699 - DNA, 21 bp, Homo sapiens
acttgaacccatatttgtaca

SEQ ID NO: 4601700 - DNA, 20 bp, Homo sapiens
acttgaacccgggaggcaga

SEQ ID NO: 4601701 - DNA, 18 bp, Homo sapiens
acttgaagggccagagcc

SEQ ID NO: 4601702 - DNA, 21 bp, Homo sapiens
acttgcaaccgtctgttatgc

SEQ ID NO: 4601703 - DNA, 19 bp, Homo sapiens
actttaattaccaacctgt

SEQ ID NO: 4601704 - DNA, 19 bp, Homo sapiens
actttaccttttttataca

SEQ ID NO: 4601705 - DNA, 17 bp, Homo sapiens
actttatgctaagtgaa

SEQ ID NO: 4601706 - DNA, 13 bp, Homo sapiens
actttctcagttt

SEQ ID NO: 4601707 - DNA, 18 bp, Homo sapiens
actttctcagttttcata

SEQ ID NO: 4601708 - DNA, 13 bp, Homo sapiens
acttttaaactgt

SEQ ID NO: 4601709 - DNA, 15 bp, Homo sapiens
acttttaaactgtgt

SEQ ID NO: 4601710 - DNA, 22 bp, Homo sapiens
acttttataaactttacctttt

SEQ ID NO: 4601711 - DNA, 18 bp, Homo sapiens
actttttaaatgtaaaga

SEQ ID NO: 4601712 - DNA, 13 bp, Homo sapiens
actttttgcattt

SEQ ID NO: 4601713 - DNA, 20 bp, Homo sapiens
agaaaaatattaataagaca

SEQ ID NO: 4601714 - DNA, 23 bp, Homo sapiens
agaaaacataatcttctgccttc

SEQ ID NO: 4601715 - DNA, 14 bp, Homo sapiens
agaaagaaggaagt

SEQ ID NO: 4601716 - DNA, 16 bp, Homo sapiens
agaaaggggagcccac

SEQ ID NO: 4601717 - DNA, 15 bp, Homo sapiens
agaaattggctggat

SEQ ID NO: 4601718 - DNA, 22 bp, Homo sapiens
agaagccaggaatttcccagga

SEQ ID NO: 4601719 - DNA, 17 bp, Homo sapiens
agaagcccccagctaag

SEQ ID NO: 4601720 - DNA, 16 bp, Homo sapiens
agaagccgggaacaga

SEQ ID NO: 4601721 - DNA, 17 bp, Homo sapiens
agaagctcctctcccca

SEQ ID NO: 4601722 - DNA, 18 bp, Homo sapiens
agaagtcttctatttatt

SEQ ID NO: 4601723 - DNA, 20 bp, Homo sapiens
agaagtgggtggggacagac

SEQ ID NO: 4601724 - DNA, 20 bp, Homo sapiens
agaataatcacgctttcctg

SEQ ID NO: 4601725 - DNA, 13 bp, Homo sapiens
agaataatctttg

SEQ ID NO: 4601726 - DNA, 17 bp, Homo sapiens
agaatatccatgaccta

SEQ ID NO: 4601727 - DNA, 14 bp, Homo sapiens
agaatcacttgaac

SEQ ID NO: 4601728 - DNA, 20 bp, Homo sapiens
aggacttcctgtccagctcc

SEQ ID NO: 4601729 - DNA, 22 bp, Homo sapiens
aggacttcctgtccagctccaa

SEQ ID NO: 4601730 - DNA, 22 bp, Homo sapiens
aggagaagtcttctatttattt

SEQ ID NO: 4601731 - DNA, 16 bp, Homo sapiens
aggagtcccaaggaaa

SEQ ID NO: 4601732 - DNA, 16 bp, Homo sapiens
aggagttcgaggctgc

SEQ ID NO: 4601733 - DNA, 17 bp, Homo sapiens
aggagttcgaggctgca

SEQ ID NO: 4601734 - DNA, 16 bp, Homo sapiens
aggagtttgagaccag

SEQ ID NO: 4601735 - DNA, 20 bp, Homo sapiens
aggatagatgctggcccagg

SEQ ID NO: 4601736 - DNA, 17 bp, Homo sapiens
aggatatcggcatttgt

SEQ ID NO: 4601737 - DNA, 22 bp, Homo sapiens
aggatgaatgaggtcccaggca

SEQ ID NO: 4601738 - DNA, 22 bp, Homo sapiens
aggatgcacagagttgttacat

SEQ ID NO: 4601739 - DNA, 23 bp, Homo sapiens
aggatgcttgtacataatgcgtg

SEQ ID NO: 4601740 - DNA, 14 bp, Homo sapiens
aggatgttgaaaaa

SEQ ID NO: 4601741 - DNA, 22 bp, Homo sapiens
aggattgcttgagcccaggagt

SEQ ID NO: 4601742 - DNA, 14 bp, Homo sapiens
aggcaaccaataaa

SEQ ID NO: 4601743 - DNA, 15 bp, Homo sapiens
aggcagatccaggac

SEQ ID NO: 4601744 - DNA, 18 bp, Homo sapiens
aggcagggacctaaaggg

SEQ ID NO: 4601745 - DNA, 19 bp, Homo sapiens
aggcctaattctatgcctg

SEQ ID NO: 4601746 - DNA, 22 bp, Homo sapiens
aggcctaattctatgcctgtct

SEQ ID NO: 4601747 - DNA, 21 bp, Homo sapiens
aggctagaaccacctgcctat

SEQ ID NO: 4601748 - DNA, 15 bp, Homo sapiens
aggctgaggcaggag

SEQ ID NO: 4601749 - DNA, 21 bp, Homo sapiens
aggctgcagtcagtcatgatg

SEQ ID NO: 4601750 - DNA, 18 bp, Homo sapiens
agggaaagccagcctggg

SEQ ID NO: 4601751 - DNA, 22 bp, Homo sapiens
agggaaggatacaaaagcatgt

SEQ ID NO: 4601752 - DNA, 16 bp, Homo sapiens
agggacagaggcccca

SEQ ID NO: 4601753 - DNA, 21 bp, Homo sapiens
agggacagaggccccagcctc

SEQ ID NO: 4601754 - DNA, 14 bp, Homo sapiens
agggccagagccag

SEQ ID NO: 4601755 - DNA, 15 bp, Homo sapiens
agggccagagccagg

SEQ ID NO: 4601756 - DNA, 16 bp, Homo sapiens
agggccagagccaggg

SEQ ID NO: 4601757 - DNA, 18 bp, Homo sapiens
agggcccagagcccagct

SEQ ID NO: 4601758 - DNA, 14 bp, Homo sapiens
agggccccggggcc

SEQ ID NO: 4601759 - DNA, 17 bp, Homo sapiens
agggctgagctctctgt

SEQ ID NO: 4601760 - DNA, 13 bp, Homo sapiens
aggggagcccact

SEQ ID NO: 4601761 - DNA, 13 bp, Homo sapiens
aggggctggggcc

SEQ ID NO: 4601762 - DNA, 17 bp, Homo sapiens
agggtcgtgggaaaggg

SEQ ID NO: 4601763 - DNA, 21 bp, Homo sapiens
agggtcgtgggaaaggggagt

SEQ ID NO: 4601764 - DNA, 22 bp, Homo sapiens
agggtcgtgggaaaggggagta

SEQ ID NO: 4601765 - DNA, 20 bp, Homo sapiens
agggtttatgtttaggatgt

SEQ ID NO: 4601766 - DNA, 17 bp, Homo sapiens
aggtcattttttttaag

SEQ ID NO: 4601767 - DNA, 13 bp, Homo sapiens
aggtcccaggcag

SEQ ID NO: 4601768 - DNA, 18 bp, Homo sapiens
aggtctgttctttccaaa

SEQ ID NO: 4601769 - DNA, 22 bp, Homo sapiens
aggtctgttctttccaaagtac

SEQ ID NO: 4601770 - DNA, 21 bp, Homo sapiens
aggtgaaactccagatgccac

SEQ ID NO: 4601771 - DNA, 14 bp, Homo sapiens
aggtgaacattggt

SEQ ID NO: 4601772 - DNA, 21 bp, Homo sapiens
aggtgaacattggttctttca

SEQ ID NO: 4601773 - DNA, 23 bp, Homo sapiens
aggtgctaaatggtcgcccagga

SEQ ID NO: 4601774 - DNA, 17 bp, Homo sapiens
aggtgctgacggccagg

SEQ ID NO: 4601775 - DNA, 18 bp, Homo sapiens
aggtgtgactgaatttct

SEQ ID NO: 4601776 - DNA, 20 bp, Homo sapiens
aggtgtgactgaatttcttt

SEQ ID NO: 4601777 - DNA, 15 bp, Homo sapiens
aggttacaagcctgc

SEQ ID NO: 4601778 - DNA, 14 bp, Homo sapiens
aggttcaaagatat

SEQ ID NO: 4601779 - DNA, 18 bp, Homo sapiens
aggttccacagaggacac

SEQ ID NO: 4601780 - DNA, 15 bp, Homo sapiens
aggttttctgtgttt

SEQ ID NO: 4601781 - DNA, 19 bp, Homo sapiens
agtaaatgggggtgcattt

SEQ ID NO: 4601782 - DNA, 18 bp, Homo sapiens
agtaatatgcacacattt

SEQ ID NO: 4601783 - DNA, 20 bp, Homo sapiens
agtaatatgcacacattttt

SEQ ID NO: 4601784 - DNA, 22 bp, Homo sapiens
agtacatgggtgactatctccc

SEQ ID NO: 4601785 - DNA, 15 bp, Homo sapiens
agtacgttgtgcatt

SEQ ID NO: 4601786 - DNA, 17 bp, Homo sapiens
agtaggtgggggaacac

SEQ ID NO: 4601787 - DNA, 20 bp, Homo sapiens
agtaggtgggggaacactga

SEQ ID NO: 4601788 - DNA, 13 bp, Homo sapiens
agtataaaattat

SEQ ID NO: 4601789 - DNA, 15 bp, Homo sapiens
agtataaaattatat

SEQ ID NO: 4601790 - DNA, 16 bp, Homo sapiens
agtatgaggcatttgt

SEQ ID NO: 4601791 - DNA, 17 bp, Homo sapiens
agtattttgctggaata

SEQ ID NO: 4601792 - DNA, 19 bp, Homo sapiens
agtattttttcaagttgta

SEQ ID NO: 4601793 - DNA, 20 bp, Homo sapiens
agtcacattccaagcctcat

SEQ ID NO: 4601794 - DNA, 21 bp, Homo sapiens
agtcagtcatgatggcaccac

SEQ ID NO: 4601795 - DNA, 21 bp, Homo sapiens
agtcatgaagcccaagtgaaa

SEQ ID NO: 4601796 - DNA, 18 bp, Homo sapiens
agtcattatgttaatatt

SEQ ID NO: 4601797 - DNA, 14 bp, Homo sapiens
agtccaagctgtgc

SEQ ID NO: 4601798 - DNA, 14 bp, Homo sapiens
agtcggtcctcttt

SEQ ID NO: 4601799 - DNA, 12 bp, Homo sapiens
tatatggacttt

SEQ ID NO: 4601800 - DNA, 18 bp, Homo sapiens
tatattgttttgtctcct

SEQ ID NO: 4601801 - DNA, 23 bp, Homo sapiens
tatcaaatacatttaaaacatta

SEQ ID NO: 4601802 - DNA, 18 bp, Homo sapiens
tatcacccagaagaaaat

SEQ ID NO: 4601803 - DNA, 17 bp, Homo sapiens
tatcatgcatgtcctgt

SEQ ID NO: 4601804 - DNA, 19 bp, Homo sapiens
tatcccttggacattttat

SEQ ID NO: 4601805 - DNA, 14 bp, Homo sapiens
tatctaatttgtgc

SEQ ID NO: 4601806 - DNA, 14 bp, Homo sapiens
tatgaacatattgt

SEQ ID NO: 4601807 - DNA, 14 bp, Homo sapiens
tatgaagaactgag

SEQ ID NO: 4601808 - DNA, 16 bp, Homo sapiens
tatgaagaactgagga

SEQ ID NO: 4601809 - DNA, 22 bp, Homo sapiens
tatgacacatgcaaggtcattt

SEQ ID NO: 4601810 - DNA, 24 bp, Homo sapiens
tatgataggttattttgatgtaaa

SEQ ID NO: 4601811 - DNA, 17 bp, Homo sapiens
tatgatttttttttcat

SEQ ID NO: 4601812 - DNA, 20 bp, Homo sapiens
tatgcaaggaaggaaagaaa

SEQ ID NO: 4601813 - DNA, 17 bp, Homo sapiens
tatgccagctcagtccc

SEQ ID NO: 4601814 - DNA, 13 bp, Homo sapiens
tatgctatttctg

SEQ ID NO: 4601815 - DNA, 16 bp, Homo sapiens
tatgcttactgatata

SEQ ID NO: 4601816 - DNA, 20 bp, Homo sapiens
tatgcttgtaactaaaataa

SEQ ID NO: 4601817 - DNA, 17 bp, Homo sapiens
tatggaactctctccac

SEQ ID NO: 4601818 - DNA, 20 bp, Homo sapiens
tatggccctggcctagcata

SEQ ID NO: 4601819 - DNA, 16 bp, Homo sapiens
tatggcttttgtgcat

SEQ ID NO: 4601820 - DNA, 20 bp, Homo sapiens
tatgtaaatggtatgtcatt

SEQ ID NO: 4601821 - DNA, 13 bp, Homo sapiens
tatgttaatattt

SEQ ID NO: 4601822 - DNA, 16 bp, Homo sapiens
tatgttaatatttctg

SEQ ID NO: 4601823 - DNA, 14 bp, Homo sapiens
tatgttaatatttt

SEQ ID NO: 4601824 - DNA, 18 bp, Homo sapiens
tattaaaaatctcaaatt

SEQ ID NO: 4601825 - DNA, 22 bp, Homo sapiens
tattaaaaatctcaaatttcta

SEQ ID NO: 4601826 - DNA, 23 bp, Homo sapiens
tattaaaaatctcaaatttctaa

SEQ ID NO: 4601827 - DNA, 17 bp, Homo sapiens
tattatattcattcttt

SEQ ID NO: 4601828 - DNA, 23 bp, Homo sapiens
tattcatagcagcttattcacaa

SEQ ID NO: 4601829 - DNA, 18 bp, Homo sapiens
tattcattctttttgaaa

SEQ ID NO: 4601830 - DNA, 19 bp, Homo sapiens
tattccaagacatgtctgt

SEQ ID NO: 4601831 - DNA, 20 bp, Homo sapiens
tatttaatggaagtgtattt

SEQ ID NO: 4601832 - DNA, 23 bp, Homo sapiens
tatttaatttgaaggtagaatgt

SEQ ID NO: 4601833 - DNA, 12 bp, Homo sapiens
tatttattgaaa

SEQ ID NO: 4601834 - DNA, 16 bp, Homo sapiens
tatttattgaaatgat

SEQ ID NO: 4601835 - DNA, 23 bp, Homo sapiens
tattttacaattttttatcatgc

SEQ ID NO: 4601836 - DNA, 21 bp, Homo sapiens
tattttacagctcattaaact

SEQ ID NO: 4601837 - DNA, 17 bp, Homo sapiens
tattttattatgcatga

SEQ ID NO: 4601838 - DNA, 13 bp, Homo sapiens
tattttgctttgt

SEQ ID NO: 4601839 - DNA, 15 bp, Homo sapiens
tattttgctttgtga

SEQ ID NO: 4601840 - DNA, 16 bp, Homo sapiens
tcaaaacaaaggccta

SEQ ID NO: 4601841 - DNA, 18 bp, Homo sapiens
tcaaaacggggcagccaa

SEQ ID NO: 4601842 - DNA, 15 bp, Homo sapiens
tcaaactgaggaatt

SEQ ID NO: 4601843 - DNA, 20 bp, Homo sapiens
tcaaagatattttgctttgt

SEQ ID NO: 4601844 - DNA, 22 bp, Homo sapiens
tcaaagatattttgctttgtga

SEQ ID NO: 4601845 - DNA, 15 bp, Homo sapiens
tcaaattcttctgaa

SEQ ID NO: 4601846 - DNA, 14 bp, Homo sapiens
tcaactgcctactc

SEQ ID NO: 4601847 - DNA, 20 bp, Homo sapiens
tcaactgcctactccaaaat

SEQ ID NO: 4601848 - DNA, 19 bp, Homo sapiens
tcaagaatagcattgtaaa

SEQ ID NO: 4601849 - DNA, 11 bp, Homo sapiens
tcaagtattat

SEQ ID NO: 4601850 - DNA, 15 bp, Homo sapiens
tcaagtattatacct

SEQ ID NO: 4601851 - DNA, 14 bp, Homo sapiens
tcaatcctctaagc

SEQ ID NO: 4601852 - DNA, 13 bp, Homo sapiens
tcaatctgtaaac

SEQ ID NO: 4601853 - DNA, 14 bp, Homo sapiens
tcaatctgtaaact

SEQ ID NO: 4601854 - DNA, 22 bp, Homo sapiens
tcaatgtttatgcaaggaagga

SEQ ID NO: 4601855 - DNA, 14 bp, Homo sapiens
tcaattgtcacttt

SEQ ID NO: 4601856 - DNA, 17 bp, Homo sapiens
tcaattgtcacttttta

SEQ ID NO: 4601857 - DNA, 13 bp, Homo sapiens
tcaatttaaaaaa

SEQ ID NO: 4601858 - DNA, 22 bp, Homo sapiens
tcacaagacccaaaaggcagaa

SEQ ID NO: 4601859 - DNA, 19 bp, Homo sapiens
tcacagttctttgggccag

SEQ ID NO: 4601860 - DNA, 11 bp, Homo sapiens
tcacattttcc

SEQ ID NO: 4601861 - DNA, 14 bp, Homo sapiens
tcacattttccttt

SEQ ID NO: 4601862 - DNA, 14 bp, Homo sapiens
tcaccaaggctgat

SEQ ID NO: 4601863 - DNA, 18 bp, Homo sapiens
tcacccagaatccctcta

SEQ ID NO: 4601864 - DNA, 17 bp, Homo sapiens
tcaccctgggagcagtc

SEQ ID NO: 4601865 - DNA, 14 bp, Homo sapiens
tcacgctttcctga

SEQ ID NO: 4601866 - DNA, 16 bp, Homo sapiens
tcacgctttcctgaat

SEQ ID NO: 4601867 - DNA, 22 bp, Homo sapiens
tcacgctttcctgaatccaaac

SEQ ID NO: 4601868 - DNA, 20 bp, Homo sapiens
tcactgcttaacttcacata

SEQ ID NO: 4601869 - DNA, 16 bp, Homo sapiens
tcacttcataatccag

SEQ ID NO: 4601870 - DNA, 13 bp, Homo sapiens
tcacttgcacatc

SEQ ID NO: 4601871 - DNA, 14 bp, Homo sapiens
tcactttctcagtt

SEQ ID NO: 4601872 - DNA, 10 bp, Homo sapiens
tcagaaatgt

SEQ ID NO: 4601873 - DNA, 15 bp, Homo sapiens
tcagaaatgtgttat

SEQ ID NO: 4601874 - DNA, 21 bp, Homo sapiens
tcagactcccattcctgaaga

SEQ ID NO: 4601875 - DNA, 15 bp, Homo sapiens
tcagatccagggaca

SEQ ID NO: 4601876 - DNA, 18 bp, Homo sapiens
tcagcacgatttctgttt

SEQ ID NO: 4601877 - DNA, 17 bp, Homo sapiens
tcagcagcctccctgaa

SEQ ID NO: 4601878 - DNA, 14 bp, Homo sapiens
tcagcctggccaga

SEQ ID NO: 4601879 - DNA, 18 bp, Homo sapiens
tcagcctggccagacaca

SEQ ID NO: 4601880 - DNA, 16 bp, Homo sapiens
tcagccttgccagaga

SEQ ID NO: 4601881 - DNA, 17 bp, Homo sapiens
tcagccttgccagagat

SEQ ID NO: 4601882 - DNA, 14 bp, Homo sapiens
tcaggacagatgcc

SEQ ID NO: 4601883 - DNA, 19 bp, Homo sapiens
tcaggagtcccaaggaaag

SEQ ID NO: 4601884 - DNA, 22 bp, Homo sapiens
tcaggcctataaccccagctcc

SEQ ID NO: 4601885 - DNA, 17 bp, Homo sapiens
tcagtcccatcagagag

SEQ ID NO: 4601886 - DNA, 17 bp, Homo sapiens
tcatagccataaatgat

SEQ ID NO: 4601887 - DNA, 13 bp, Homo sapiens
tcatccctttggt

SEQ ID NO: 4601888 - DNA, 14 bp, Homo sapiens
tcatctctctgccc

SEQ ID NO: 4601889 - DNA, 23 bp, Homo sapiens
tcatgccacaccggtaccctcct

SEQ ID NO: 4601890 - DNA, 19 bp, Homo sapiens
tcattactgtgttcaatta

SEQ ID NO: 4601891 - DNA, 16 bp, Homo sapiens
tcattaggtgtgactg

SEQ ID NO: 4601892 - DNA, 14 bp, Homo sapiens
tcattagttttgaa

SEQ ID NO: 4601893 - DNA, 16 bp, Homo sapiens
tcattatgttaatatt

SEQ ID NO: 4601894 - DNA, 17 bp, Homo sapiens
tcattatgttaatattt

SEQ ID NO: 4601895 - DNA, 23 bp, Homo sapiens
tcattcgctactatgatttaatt

SEQ ID NO: 4601896 - DNA, 18 bp, Homo sapiens
tcattttacccttggctc

SEQ ID NO: 4601897 - DNA, 15 bp, Homo sapiens
tccaaaagaagcccc

SEQ ID NO: 4601898 - DNA, 18 bp, Homo sapiens
tccaaaagaagcccccag

SEQ ID NO: 4601899 - DNA, 20 bp, Homo sapiens
tccaaaagattgctgaaatt

SEQ ID NO: 4601900 - DNA, 22 bp, Homo sapiens
tccaaaatgttggtcattttat

SEQ ID NO: 4601901 - DNA, 19 bp, Homo sapiens
tccaactaatgccttactc

SEQ ID NO: 4601902 - DNA, 22 bp, Homo sapiens
tccaagacatgtctgttctaca

SEQ ID NO: 4601903 - DNA, 21 bp, Homo sapiens
tccaaggggaatcagaactca

SEQ ID NO: 4601904 - DNA, 15 bp, Homo sapiens
tccacagaggacaca

SEQ ID NO: 4601905 - DNA, 17 bp, Homo sapiens
tccagcactcaataaag

SEQ ID NO: 4601906 - DNA, 20 bp, Homo sapiens
tccaggactatatttgggcc

SEQ ID NO: 4601907 - DNA, 23 bp, Homo sapiens
tccaggactatatttgggcctgc

SEQ ID NO: 4601908 - DNA, 17 bp, Homo sapiens
tccaggcagatccagga

SEQ ID NO: 4601909 - DNA, 21 bp, Homo sapiens
tccagggacagaggccccagc

SEQ ID NO: 4601910 - DNA, 16 bp, Homo sapiens
tccagtaggatccagt

SEQ ID NO: 4601911 - DNA, 14 bp, Homo sapiens
tccagtgagacagc

SEQ ID NO: 4601912 - DNA, 17 bp, Homo sapiens
tccagtggatcataaga

SEQ ID NO: 4601913 - DNA, 13 bp, Homo sapiens
tccataagctatt

SEQ ID NO: 4601914 - DNA, 14 bp, Homo sapiens
tccataagctattt

SEQ ID NO: 4601915 - DNA, 13 bp, Homo sapiens
tccatgaagatgt

SEQ ID NO: 4601916 - DNA, 19 bp, Homo sapiens
tccatgcgtgtttctgact

SEQ ID NO: 4601917 - DNA, 17 bp, Homo sapiens
tcccaatttcagactcc

SEQ ID NO: 4601918 - DNA, 23 bp, Homo sapiens
tcccaatttcagactcccattcc

SEQ ID NO: 4601919 - DNA, 12 bp, Homo sapiens
tcccaggaccct

SEQ ID NO: 4601920 - DNA, 16 bp, Homo sapiens
tcccaggaccctgaag

SEQ ID NO: 4601921 - DNA, 15 bp, Homo sapiens
tcccagttcaggagt

SEQ ID NO: 4601922 - DNA, 20 bp, Homo sapiens
tcccagttcaggagtcccaa

SEQ ID NO: 4601923 - DNA, 12 bp, Homo sapiens
tccccagcccag

SEQ ID NO: 4601924 - DNA, 14 bp, Homo sapiens
tccccagcccagag

SEQ ID NO: 4601925 - DNA, 16 bp, Homo sapiens
tccccagcccagagac

SEQ ID NO: 4601926 - DNA, 16 bp, Homo sapiens
tgaactcaaactgagg

SEQ ID NO: 4601927 - DNA, 17 bp, Homo sapiens
tgaactcaaactgagga

SEQ ID NO: 4601928 - DNA, 15 bp, Homo sapiens
tgaactgataaagat

SEQ ID NO: 4601929 - DNA, 11 bp, Homo sapiens
tgaactttgac

SEQ ID NO: 4601930 - DNA, 19 bp, Homo sapiens
tgaactttgacctctgcag

SEQ ID NO: 4601931 - DNA, 19 bp, Homo sapiens
tgaagaactgaggaggaaa

SEQ ID NO: 4601932 - DNA, 13 bp, Homo sapiens
tgaagacaatgac

SEQ ID NO: 4601933 - DNA, 13 bp, Homo sapiens
tgaagaggaaggg

SEQ ID NO: 4601934 - DNA, 16 bp, Homo sapiens
tgaagcccaagtgaaa

SEQ ID NO: 4601935 - DNA, 14 bp, Homo sapiens
tgaagggccagagc

SEQ ID NO: 4601936 - DNA, 19 bp, Homo sapiens
tgaaggtagaatgttttca

SEQ ID NO: 4601937 - DNA, 19 bp, Homo sapiens
tgaaggtgctgacggccag

SEQ ID NO: 4601938 - DNA, 21 bp, Homo sapiens
tgaagtaatatgcacacattt

SEQ ID NO: 4601939 - DNA, 17 bp, Homo sapiens
tgaagtactcatacatg

SEQ ID NO: 4601940 - DNA, 18 bp, Homo sapiens
tgaagtcacatcacagga

SEQ ID NO: 4601941 - DNA, 18 bp, Homo sapiens
tgaagttgattcatattg

SEQ ID NO: 4601942 - DNA, 15 bp, Homo sapiens
tgaatgaatggctaa

SEQ ID NO: 4601943 - DNA, 13 bp, Homo sapiens
tgaatttctaaaa

SEQ ID NO: 4601944 - DNA, 20 bp, Homo sapiens
tgaatttggcctgcactaat

SEQ ID NO: 4601945 - DNA, 21 bp, Homo sapiens
tgaatttggcctgcactaatt

SEQ ID NO: 4601946 - DNA, 22 bp, Homo sapiens
tgaatttttaaaacccatttaa

SEQ ID NO: 4601947 - DNA, 20 bp, Homo sapiens
tgacacatgcaaggtcattt

SEQ ID NO: 4601948 - DNA, 16 bp, Homo sapiens
tgacacttaaaaatgg

SEQ ID NO: 4601949 - DNA, 17 bp, Homo sapiens
tgacacttaaaaatggt

SEQ ID NO: 4601950 - DNA, 18 bp, Homo sapiens
tgacccagtgcccccact

SEQ ID NO: 4601951 - DNA, 13 bp, Homo sapiens
tgacccctgctca

SEQ ID NO: 4601952 - DNA, 17 bp, Homo sapiens
tgacctagttttccatg

SEQ ID NO: 4601953 - DNA, 13 bp, Homo sapiens
tgacctctgcagc

SEQ ID NO: 4601954 - DNA, 16 bp, Homo sapiens
tgacctctgcagcaat

SEQ ID NO: 4601955 - DNA, 14 bp, Homo sapiens
tgaccttaaatgca

SEQ ID NO: 4601956 - DNA, 16 bp, Homo sapiens
tgaccttaaatgcaac

SEQ ID NO: 4601957 - DNA, 19 bp, Homo sapiens
tgacggccagggagaagct

SEQ ID NO: 4601958 - DNA, 17 bp, Homo sapiens
tgactaaactaccacct

SEQ ID NO: 4601959 - DNA, 15 bp, Homo sapiens
tgactgctgattctc

SEQ ID NO: 4601960 - DNA, 21 bp, Homo sapiens
tgactgtggtagccagcatcg

SEQ ID NO: 4601961 - DNA, 20 bp, Homo sapiens
tgactttttaaaaaatgctg

SEQ ID NO: 4601962 - DNA, 20 bp, Homo sapiens
tgagactctgtctcagtcca

SEQ ID NO: 4601963 - DNA, 13 bp, Homo sapiens
tgagcccaggagt

SEQ ID NO: 4601964 - DNA, 15 bp, Homo sapiens
tgagccttgaacttt

SEQ ID NO: 4601965 - DNA, 17 bp, Homo sapiens
tgagccttgaactttga

SEQ ID NO: 4601966 - DNA, 16 bp, Homo sapiens
tgagcgacagtgagac

SEQ ID NO: 4601967 - DNA, 16 bp, Homo sapiens
tgaggcaatgtcagga

SEQ ID NO: 4601968 - DNA, 21 bp, Homo sapiens
tgaggcaatgtcaggaacaga

SEQ ID NO: 4601969 - DNA, 21 bp, Homo sapiens
tgaggcatttgtttgaactga

SEQ ID NO: 4601970 - DNA, 23 bp, Homo sapiens
tgaggcatttgtttgaactgata

SEQ ID NO: 4601971 - DNA, 16 bp, Homo sapiens
tgagggtcgtgggaaa

SEQ ID NO: 4601972 - DNA, 17 bp, Homo sapiens
tgaggtactgagagtga

SEQ ID NO: 4601973 - DNA, 15 bp, Homo sapiens
tgaggtcccaggcag

SEQ ID NO: 4601974 - DNA, 14 bp, Homo sapiens
tgaggtctgttctt

SEQ ID NO: 4601975 - DNA, 16 bp, Homo sapiens
tgagtacgttgtgcat

SEQ ID NO: 4601976 - DNA, 19 bp, Homo sapiens
tgagtacgttgtgcatttg

SEQ ID NO: 4601977 - DNA, 19 bp, Homo sapiens
tgagtcgtacagaaagctg

SEQ ID NO: 4601978 - DNA, 20 bp, Homo sapiens
tgagtctgaattctgctcta

SEQ ID NO: 4601979 - DNA, 14 bp, Homo sapiens
tgagtgagcatgcc

SEQ ID NO: 4601980 - DNA, 15 bp, Homo sapiens
tgatacaatgctgtg

SEQ ID NO: 4601981 - DNA, 14 bp, Homo sapiens
tgatactacagttt

SEQ ID NO: 4601982 - DNA, 13 bp, Homo sapiens
tgatatattttac

SEQ ID NO: 4601983 - DNA, 14 bp, Homo sapiens
tgatccaactaatg

SEQ ID NO: 4601984 - DNA, 15 bp, Homo sapiens
tgatcctggaggccc

SEQ ID NO: 4601985 - DNA, 16 bp, Homo sapiens
tgatcctggaggccca

SEQ ID NO: 4601986 - DNA, 17 bp, Homo sapiens
tgatcctggaggcccag

SEQ ID NO: 4601987 - DNA, 20 bp, Homo sapiens
tgatcctggaggcccagttc

SEQ ID NO: 4601988 - DNA, 18 bp, Homo sapiens
tgatgttttaaggatgct

SEQ ID NO: 4601989 - DNA, 22 bp, Homo sapiens
tgattaaagatgagctttgtct

SEQ ID NO: 4601990 - DNA, 19 bp, Homo sapiens
tgattaaattcttgcaaag

SEQ ID NO: 4601991 - DNA, 16 bp, Homo sapiens
tgattaccagggactg

SEQ ID NO: 4601992 - DNA, 16 bp, Homo sapiens
tgattcaatctgtaaa

SEQ ID NO: 4601993 - DNA, 16 bp, Homo sapiens
tgatttaggagaagcc

SEQ ID NO: 4601994 - DNA, 14 bp, Homo sapiens
tgatttcacagtgt

SEQ ID NO: 4601995 - DNA, 16 bp, Homo sapiens
tgatttcacagtgtgt

SEQ ID NO: 4601996 - DNA, 13 bp, Homo sapiens
tgatttcattcaa

SEQ ID NO: 4601997 - DNA, 21 bp, Homo sapiens
tgatttttgcctcttccagtc

SEQ ID NO: 4601998 - DNA, 22 bp, Homo sapiens
tgatttttgcctcttccagtct

SEQ ID NO: 4601999 - DNA, 18 bp, Homo sapiens
tgatttttttttcataca

SEQ ID NO: 4602000 - DNA, 22 bp, Homo sapiens
tgatttttttttcatacactta

SEQ ID NO: 4602001 - DNA, 16 bp, Homo sapiens
tgcaaccatttgaaac

SEQ ID NO: 4602002 - DNA, 15 bp, Homo sapiens
tgcaaggtcattttt

SEQ ID NO: 4602003 - DNA, 20 bp, Homo sapiens
tgcaataaatctgacccagt

SEQ ID NO: 4602004 - DNA, 21 bp, Homo sapiens
tgcacaataaaaatgtttaac

SEQ ID NO: 4602005 - DNA, 10 bp, Homo sapiens
tgcacacatt

SEQ ID NO: 4602006 - DNA, 12 bp, Homo sapiens
tgcacacatttt

SEQ ID NO: 4602007 - DNA, 13 bp, Homo sapiens
tgcacacattttt

SEQ ID NO: 4602008 - DNA, 14 bp, Homo sapiens
tgcacactgtccta

SEQ ID NO: 4602009 - DNA, 22 bp, Homo sapiens
tgcacagagttgttacattttt

SEQ ID NO: 4602010 - DNA, 23 bp, Homo sapiens
tgcacagagttgttacattttta

SEQ ID NO: 4602011 - DNA, 17 bp, Homo sapiens
tgcacatctgttttgta

SEQ ID NO: 4602012 - DNA, 17 bp, Homo sapiens
tgcactgatgctgcccc

SEQ ID NO: 4602013 - DNA, 21 bp, Homo sapiens
tgcactgatgctgcccctcat

SEQ ID NO: 4602014 - DNA, 16 bp, Homo sapiens
tgcagataaacagtag

SEQ ID NO: 4602015 - DNA, 19 bp, Homo sapiens
tgcagataaacagtagtga

SEQ ID NO: 4602016 - DNA, 18 bp, Homo sapiens
tgcagcaagcctggcccc

SEQ ID NO: 4602017 - DNA, 14 bp, Homo sapiens
tgcagcaataaagc

SEQ ID NO: 4602018 - DNA, 15 bp, Homo sapiens
tgcagcaataaagca

SEQ ID NO: 4602019 - DNA, 16 bp, Homo sapiens
tgcataccacttttgt

SEQ ID NO: 4602020 - DNA, 18 bp, Homo sapiens
tgcataccacttttgttc

SEQ ID NO: 4602021 - DNA, 23 bp, Homo sapiens
tgcatactttttaaatgtaaaga

SEQ ID NO: 4602022 - DNA, 17 bp, Homo sapiens
tgcatcatagtttgctt

SEQ ID NO: 4602023 - DNA, 17 bp, Homo sapiens
tgcatggtgccccagga

SEQ ID NO: 4602024 - DNA, 22 bp, Homo sapiens
tgcatggtgccccaggaccagc

SEQ ID NO: 4602025 - DNA, 12 bp, Homo sapiens
tgcattatctag

SEQ ID NO: 4602026 - DNA, 21 bp, Homo sapiens
tgcattatctagatactgtat

SEQ ID NO: 4602027 - DNA, 17 bp, Homo sapiens
tgcatttaaaacagaca

SEQ ID NO: 4602028 - DNA, 21 bp, Homo sapiens
tgcatttgaggtctgttcttt

SEQ ID NO: 4602029 - DNA, 23 bp, Homo sapiens
tgcatttggtggtttcagaaatg

SEQ ID NO: 4602030 - DNA, 16 bp, Homo sapiens
tgccacaaggacttcc

SEQ ID NO: 4602031 - DNA, 17 bp, Homo sapiens
tgccacaccggtaccct

SEQ ID NO: 4602032 - DNA, 17 bp, Homo sapiens
tgccagccactgtgata

SEQ ID NO: 4602033 - DNA, 15 bp, Homo sapiens
tgccagctgcactga

SEQ ID NO: 4602034 - DNA, 13 bp, Homo sapiens
tgccataattact

SEQ ID NO: 4602035 - DNA, 22 bp, Homo sapiens
tgcccaacccttccctcacctt

SEQ ID NO: 4602036 - DNA, 14 bp, Homo sapiens
tgccccaggaccag

SEQ ID NO: 4602037 - DNA, 19 bp, Homo sapiens
tgccccaggaccagctcag

SEQ ID NO: 4602038 - DNA, 23 bp, Homo sapiens
tgccctgggggataccagctgag

SEQ ID NO: 4602039 - DNA, 15 bp, Homo sapiens
tgcctgacagcatcc

SEQ ID NO: 4602040 - DNA, 17 bp, Homo sapiens
tgcctgacagcatcctc

SEQ ID NO: 4602041 - DNA, 21 bp, Homo sapiens
tgccttaccctcatgttctta

SEQ ID NO: 4602042 - DNA, 23 bp, Homo sapiens
tgcgtacgtttcctgagaagtgt

SEQ ID NO: 4602043 - DNA, 13 bp, Homo sapiens
tgcgttactaatt

SEQ ID NO: 4602044 - DNA, 20 bp, Homo sapiens
tgctaaatggtcgcccagga

SEQ ID NO: 4602045 - DNA, 11 bp, Homo sapiens
tgctacacact

SEQ ID NO: 4602046 - DNA, 16 bp, Homo sapiens
tgctcagctgtcaagg

SEQ ID NO: 4602047 - DNA, 20 bp, Homo sapiens
tgctgacggccagggagaag

SEQ ID NO: 4602048 - DNA, 13 bp, Homo sapiens
tgctgcaaacctg

SEQ ID NO: 4602049 - DNA, 17 bp, Homo sapiens
tgctgcatttaaaagat

SEQ ID NO: 4602050 - DNA, 18 bp, Homo sapiens
tgctgcatttaaaagata

SEQ ID NO: 4602051 - DNA, 20 bp, Homo sapiens
tgctgctgtacaacttctgg

SEQ ID NO: 4602052 - DNA, 17 bp, Homo sapiens
tgctggaataagttcaa

SEQ ID NO: 4602053 - DNA, 12 bp, Homo sapiens
tgctggcccagg

SEQ ID NO: 4602054 - DNA, 17 bp, Homo sapiens
tgctggcccagggccca

SEQ ID NO: 4602055 - DNA, 19 bp, Homo sapiens
tgctggcccagggcccaga

SEQ ID NO: 4602056 - DNA, 23 bp, Homo sapiens
tgctggcccagggcccagagccc

SEQ ID NO: 4602057 - DNA, 18 bp, Homo sapiens
gtccaaaagattgctgaa

SEQ ID NO: 4602058 - DNA, 14 bp, Homo sapiens
gtccagctccaacc

SEQ ID NO: 4602059 - DNA, 23 bp, Homo sapiens
gtccatgaagatgtagaggagaa

SEQ ID NO: 4602060 - DNA, 22 bp, Homo sapiens
gtccccccaccctcattctact

SEQ ID NO: 4602061 - DNA, 19 bp, Homo sapiens
gtcctagccactcaggagg

SEQ ID NO: 4602062 - DNA, 21 bp, Homo sapiens
gtcctcccaatttcagactcc

SEQ ID NO: 4602063 - DNA, 14 bp, Homo sapiens
gtcctgggcctgca

SEQ ID NO: 4602064 - DNA, 13 bp, Homo sapiens
gtcgcccaggaga

SEQ ID NO: 4602065 - DNA, 23 bp, Homo sapiens
gtcgttaaaaacagatttggaaa

SEQ ID NO: 4602066 - DNA, 14 bp, Homo sapiens
gtctcttctgagct

SEQ ID NO: 4602067 - DNA, 22 bp, Homo sapiens
gtctcttctgagctatttcatc

SEQ ID NO: 4602068 - DNA, 21 bp, Homo sapiens
gtctggagttgatctggaacc

SEQ ID NO: 4602069 - DNA, 14 bp, Homo sapiens
gtctgttctttcca

SEQ ID NO: 4602070 - DNA, 16 bp, Homo sapiens
gtctgttgattaaaga

SEQ ID NO: 4602071 - DNA, 19 bp, Homo sapiens
gtcttcctgacactttaat

SEQ ID NO: 4602072 - DNA, 12 bp, Homo sapiens
gtgaaaagaata

SEQ ID NO: 4602073 - DNA, 12 bp, Homo sapiens
gtgaaactggat

SEQ ID NO: 4602074 - DNA, 21 bp, Homo sapiens
gtgaacaaatttacagagaca

SEQ ID NO: 4602075 - DNA, 13 bp, Homo sapiens
gtgactatctccc

SEQ ID NO: 4602076 - DNA, 16 bp, Homo sapiens
gtgactgaatttcttt

SEQ ID NO: 4602077 - DNA, 18 bp, Homo sapiens
gtgactgaatttcttttg

SEQ ID NO: 4602078 - DNA, 18 bp, Homo sapiens
gtgagggtgggtgtgggt

SEQ ID NO: 4602079 - DNA, 17 bp, Homo sapiens
gtgatacaatgctgtgc

SEQ ID NO: 4602080 - DNA, 16 bp, Homo sapiens
gtgattaccagggact

SEQ ID NO: 4602081 - DNA, 16 bp, Homo sapiens
gtgattcaatctgtaa

SEQ ID NO: 4602082 - DNA, 13 bp, Homo sapiens
gtgatttttgtaa

SEQ ID NO: 4602083 - DNA, 14 bp, Homo sapiens
gtgcagcaagcctg

SEQ ID NO: 4602084 - DNA, 15 bp, Homo sapiens
gtgcagcaagcctgg

SEQ ID NO: 4602085 - DNA, 16 bp, Homo sapiens
gtgcagcaagcctggc

SEQ ID NO: 4602086 - DNA, 21 bp, Homo sapiens
gtgcataccacttttgttctt

SEQ ID NO: 4602087 - DNA, 20 bp, Homo sapiens
gtgcatttgaggtctgttct

SEQ ID NO: 4602088 - DNA, 19 bp, Homo sapiens
gtgcccccactgaccagaa

SEQ ID NO: 4602089 - DNA, 20 bp, Homo sapiens
gtgccttgccacattaaatt

SEQ ID NO: 4602090 - DNA, 22 bp, Homo sapiens
gtgcgagggggccttgctggat

SEQ ID NO: 4602091 - DNA, 19 bp, Homo sapiens
gtgctgcatttaaaagata

SEQ ID NO: 4602092 - DNA, 20 bp, Homo sapiens
gtgctgcatttaaaagatac

SEQ ID NO: 4602093 - DNA, 20 bp, Homo sapiens
gtggatttaacagaaatgta

SEQ ID NO: 4602094 - DNA, 18 bp, Homo sapiens
gtggggacagaccagccc

SEQ ID NO: 4602095 - DNA, 18 bp, Homo sapiens
gtggggctaggggctggg

SEQ ID NO: 4602096 - DNA, 20 bp, Homo sapiens
gtgggggaacactgagaaag

SEQ ID NO: 4602097 - DNA, 21 bp, Homo sapiens
gtgggggaacactgagaaaga

SEQ ID NO: 4602098 - DNA, 15 bp, Homo sapiens
gtggtttcagaaatg

SEQ ID NO: 4602099 - DNA, 17 bp, Homo sapiens
gtggttttctgttcttt

SEQ ID NO: 4602100 - DNA, 17 bp, Homo sapiens
gtgtaaatgctccagca

SEQ ID NO: 4602101 - DNA, 16 bp, Homo sapiens
gtgtacataactgaaa

SEQ ID NO: 4602102 - DNA, 17 bp, Homo sapiens
gtgttcccatttcagct

SEQ ID NO: 4602103 - DNA, 21 bp, Homo sapiens
gtgttcccatttcagctgatc

SEQ ID NO: 4602104 - DNA, 15 bp, Homo sapiens
gtgtttagctattta

SEQ ID NO: 4602105 - DNA, 16 bp, Homo sapiens
gttaagacctggcagc

SEQ ID NO: 4602106 - DNA, 17 bp, Homo sapiens
gttacactttttggaag

SEQ ID NO: 4602107 - DNA, 21 bp, Homo sapiens
gttacatttttaagtgctgca

SEQ ID NO: 4602108 - DNA, 15 bp, Homo sapiens
gttactcagaattct

SEQ ID NO: 4602109 - DNA, 20 bp, Homo sapiens
gttagtatgaggcatttgtt

SEQ ID NO: 4602110 - DNA, 24 bp, Homo sapiens
gttagttcaatctggattcatatt

SEQ ID NO: 4602111 - DNA, 20 bp, Homo sapiens
gttatgatttttttttcata

SEQ ID NO: 4602112 - DNA, 19 bp, Homo sapiens
gttattaaaaatctcaaat

SEQ ID NO: 4602113 - DNA, 22 bp, Homo sapiens
gttattggtgtaaggtactttc

SEQ ID NO: 4602114 - DNA, 18 bp, Homo sapiens
gttattttgatgtaaaga

SEQ ID NO: 4602115 - DNA, 20 bp, Homo sapiens
gttcaaagatattttgcttt

SEQ ID NO: 4602116 - DNA, 22 bp, Homo sapiens
gttcaaagatattttgctttgt

SEQ ID NO: 4602117 - DNA, 20 bp, Homo sapiens
gttcaattatctttatcata

SEQ ID NO: 4602118 - DNA, 15 bp, Homo sapiens
gttcaggagtcccaa

SEQ ID NO: 4602119 - DNA, 16 bp, Homo sapiens
gttcatcaatgaatga

SEQ ID NO: 4602120 - DNA, 16 bp, Homo sapiens
gttcattaaagcatga

SEQ ID NO: 4602121 - DNA, 20 bp, Homo sapiens
gttcattaaagcatgaatgg

SEQ ID NO: 4602122 - DNA, 13 bp, Homo sapiens
gttccactgagac

SEQ ID NO: 4602123 - DNA, 13 bp, Homo sapiens
gttccccagagaa

SEQ ID NO: 4602124 - DNA, 22 bp, Homo sapiens
gttctgcctgccagctgcactg

SEQ ID NO: 4602125 - DNA, 22 bp, Homo sapiens
gttctttcatttgctttggaag

SEQ ID NO: 4602126 - DNA, 15 bp, Homo sapiens
gttgaagaggaaggg

SEQ ID NO: 4602127 - DNA, 16 bp, Homo sapiens
gttgatctggaaccca

SEQ ID NO: 4602128 - DNA, 14 bp, Homo sapiens
gttgattaaagatg

SEQ ID NO: 4602129 - DNA, 16 bp, Homo sapiens
gttgattcatattgca

SEQ ID NO: 4602130 - DNA, 19 bp, Homo sapiens
gttggaggtttcacttgca

SEQ ID NO: 4602131 - DNA, 18 bp, Homo sapiens
gttgtaaataatttattt

SEQ ID NO: 4602132 - DNA, 12 bp, Homo sapiens
gttgtattcatt

SEQ ID NO: 4602133 - DNA, 22 bp, Homo sapiens
gttgtggatttaacagaaatgt

SEQ ID NO: 4602134 - DNA, 14 bp, Homo sapiens
gttgttacattttt

SEQ ID NO: 4602135 - DNA, 12 bp, Homo sapiens
gtttaatggtag

SEQ ID NO: 4602136 - DNA, 17 bp, Homo sapiens
gtttagaaagcttgccc

SEQ ID NO: 4602137 - DNA, 18 bp, Homo sapiens
gtttagatgaatgtcagt

SEQ ID NO: 4602138 - DNA, 14 bp, Homo sapiens
gtttatgattccac

SEQ ID NO: 4602139 - DNA, 17 bp, Homo sapiens
gtttcaaactttactat

SEQ ID NO: 4602140 - DNA, 18 bp, Homo sapiens
gtttcagaaatgtgttat

SEQ ID NO: 4602141 - DNA, 22 bp, Homo sapiens
gtttcctgaaacaacttggaaa

SEQ ID NO: 4602142 - DNA, 22 bp, Homo sapiens
gtttctaaaggctacctttgta

SEQ ID NO: 4602143 - DNA, 22 bp, Homo sapiens
gtttctatgacacatgcaaggt

SEQ ID NO: 4602144 - DNA, 17 bp, Homo sapiens
gtttgattaaattcttg

SEQ ID NO: 4602145 - DNA, 19 bp, Homo sapiens
gtttgattaaattcttgca

SEQ ID NO: 4602146 - DNA, 19 bp, Homo sapiens
gtttgtaaattaactttta

SEQ ID NO: 4602147 - DNA, 20 bp, Homo sapiens
gtttgtaaattaacttttat

SEQ ID NO: 4602148 - DNA, 16 bp, Homo sapiens
gttttaaactttcaat

SEQ ID NO: 4602149 - DNA, 14 bp, Homo sapiens
gttttacagtgttt

SEQ ID NO: 4602150 - DNA, 11 bp, Homo sapiens
gttttctgttc

SEQ ID NO: 4602151 - DNA, 12 bp, Homo sapiens
gttttctgttct

SEQ ID NO: 4602152 - DNA, 16 bp, Homo sapiens
gttttctgttctttct

SEQ ID NO: 4602153 - DNA, 16 bp, Homo sapiens
gttttgaagattctat

SEQ ID NO: 4602154 - DNA, 14 bp, Homo sapiens
taaaaaatgctggg

SEQ ID NO: 4602155 - DNA, 20 bp, Homo sapiens
taaaaagattgaagtatttt

SEQ ID NO: 4602156 - DNA, 15 bp, Homo sapiens
taaaaatctcaaatt

SEQ ID NO: 4602157 - DNA, 19 bp, Homo sapiens
taaaaatctcaaatttcta

SEQ ID NO: 4602158 - DNA, 17 bp, Homo sapiens
taaaacagacactggca

SEQ ID NO: 4602159 - DNA, 12 bp, Homo sapiens
taaaacttttta

SEQ ID NO: 4602160 - DNA, 15 bp, Homo sapiens
taaaactttttaaaa

SEQ ID NO: 4602161 - DNA, 17 bp, Homo sapiens
taaaagcattttgtaat

SEQ ID NO: 4602162 - DNA, 13 bp, Homo sapiens
taaaataattttg

SEQ ID NO: 4602163 - DNA, 19 bp, Homo sapiens
taaacaagaccacgtttct

SEQ ID NO: 4602164 - DNA, 21 bp, Homo sapiens
taaacaagaccacgtttctaa

SEQ ID NO: 4602165 - DNA, 22 bp, Homo sapiens
taaacaagaccacgtttctaaa

SEQ ID NO: 4602166 - DNA, 17 bp, Homo sapiens
taaacatccttcaagaa

SEQ ID NO: 4602167 - DNA, 15 bp, Homo sapiens
taaacattttacatg

SEQ ID NO: 4602168 - DNA, 16 bp, Homo sapiens
taaactgtattttatg

SEQ ID NO: 4602169 - DNA, 22 bp, Homo sapiens
taaactgtgtattccaagacat

SEQ ID NO: 4602170 - DNA, 22 bp, Homo sapiens
taaagcatgaatggtatggaac

SEQ ID NO: 4602171 - DNA, 21 bp, Homo sapiens
taaaggctacctttgtattct

SEQ ID NO: 4602172 - DNA, 19 bp, Homo sapiens
taaagggactacctctgtg

SEQ ID NO: 4602173 - DNA, 19 bp, Homo sapiens
taaagtgtatttttttact

SEQ ID NO: 4602174 - DNA, 18 bp, Homo sapiens
taaatacacaacacacac

SEQ ID NO: 4602175 - DNA, 14 bp, Homo sapiens
taaatctccaaaat

SEQ ID NO: 4602176 - DNA, 22 bp, Homo sapiens
taaatctccaaaataaaacttt

SEQ ID NO: 4602177 - DNA, 23 bp, Homo sapiens
taaatgcacctggaatatataac

SEQ ID NO: 4602178 - DNA, 13 bp, Homo sapiens
taaatgtaaagat

SEQ ID NO: 4602179 - DNA, 17 bp, Homo sapiens
taaatgtaaagatattt

SEQ ID NO: 4602180 - DNA, 17 bp, Homo sapiens
taaattaacttttataa

SEQ ID NO: 4602181 - DNA, 21 bp, Homo sapiens
taaattaacttttataaactt

SEQ ID NO: 4602182 - DNA, 18 bp, Homo sapiens
taaattcttgcaaagtat

SEQ ID NO: 4602183 - DNA, 13 bp, Homo sapiens
taacagaaatgta

SEQ ID NO: 4602184 - DNA, 19 bp, Homo sapiens
taacattcttttgtttata

SEQ ID NO: 4602185 - DNA, 13 bp, Homo sapiens
taaccacggaaaa

SEQ ID NO: 4602186 - DNA, 15 bp, Homo sapiens
taaccacggaaaaga

SEQ ID NO: 4602187 - DNA, 20 bp, Homo sapiens
taacctatgatattttctgt

SEQ ID NO: 4602188 - DNA, 18 bp, Homo sapiens
taactaaaataattttgt

SEQ ID NO: 4602189 - DNA, 21 bp, Homo sapiens
taactaaaataattttgtaat

SEQ ID NO: 4602190 - DNA, 20 bp, Homo sapiens
taactgaaaatgtgctatac

SEQ ID NO: 4602191 - DNA, 17 bp, Homo sapiens
taacttttataaacttt

SEQ ID NO: 4602192 - DNA, 19 bp, Homo sapiens
taacttttataaactttac

SEQ ID NO: 4602193 - DNA, 18 bp, Homo sapiens
taagaaaaaggatgcaca

SEQ ID NO: 4602194 - DNA, 19 bp, Homo sapiens
taagaaaaaggatgcacag

SEQ ID NO: 4602195 - DNA, 20 bp, Homo sapiens
taagaaaggcaaccaataaa

SEQ ID NO: 4602196 - DNA, 16 bp, Homo sapiens
taagaactaaaatgtt

SEQ ID NO: 4602197 - DNA, 18 bp, Homo sapiens
taagaagtgaaaatctac

SEQ ID NO: 4602198 - DNA, 16 bp, Homo sapiens
taagctaacccccttc

SEQ ID NO: 4602199 - DNA, 22 bp, Homo sapiens
taagctaacccccttctactga

SEQ ID NO: 4602200 - DNA, 10 bp, Homo sapiens
taagctattt

SEQ ID NO: 4602201 - DNA, 18 bp, Homo sapiens
taaggatgcttgtacata

SEQ ID NO: 4602202 - DNA, 22 bp, Homo sapiens
taaggatgcttgtacataatgc

SEQ ID NO: 4602203 - DNA, 13 bp, Homo sapiens
taagggaagaatt

SEQ ID NO: 4602204 - DNA, 17 bp, Homo sapiens
taagtattatgtctctt

SEQ ID NO: 4602205 - DNA, 20 bp, Homo sapiens
taagtattttcctgttgtca

SEQ ID NO: 4602206 - DNA, 14 bp, Homo sapiens
taagtgctgcattt

SEQ ID NO: 4602207 - DNA, 15 bp, Homo sapiens
taagtgctgcattta

SEQ ID NO: 4602208 - DNA, 16 bp, Homo sapiens
taagtgctgcatttaa

SEQ ID NO: 4602209 - DNA, 19 bp, Homo sapiens
taagttagttccactgaga

SEQ ID NO: 4602210 - DNA, 20 bp, Homo sapiens
taagttagttccactgagac

SEQ ID NO: 4602211 - DNA, 19 bp, Homo sapiens
taagttcaaattcttctga

SEQ ID NO: 4602212 - DNA, 13 bp, Homo sapiens
taataaaaagatt

SEQ ID NO: 4602213 - DNA, 22 bp, Homo sapiens
taataaacatccttcaagaact

SEQ ID NO: 4602214 - DNA, 14 bp, Homo sapiens
taataaataaatgt

SEQ ID NO: 4602215 - DNA, 16 bp, Homo sapiens
taataataaagaatag

SEQ ID NO: 4602216 - DNA, 18 bp, Homo sapiens
taatacaccactacattc

SEQ ID NO: 4602217 - DNA, 22 bp, Homo sapiens
taatacaccactacattctgtt

SEQ ID NO: 4602218 - DNA, 21 bp, Homo sapiens
taatacagcaacaatttatga

SEQ ID NO: 4602219 - DNA, 17 bp, Homo sapiens
taatatgcacacatttt

SEQ ID NO: 4602220 - DNA, 17 bp, Homo sapiens
taatcacgctttcctga

SEQ ID NO: 4602221 - DNA, 17 bp, Homo sapiens
taatccaggcagatcca

SEQ ID NO: 4602222 - DNA, 18 bp, Homo sapiens
taatccaggcagatccag

SEQ ID NO: 4602223 - DNA, 23 bp, Homo sapiens
taatccaggcagatccaggacta

SEQ ID NO: 4602224 - DNA, 15 bp, Homo sapiens
taatgatatgcttgt

SEQ ID NO: 4602225 - DNA, 15 bp, Homo sapiens
taatgccttactctt

SEQ ID NO: 4602226 - DNA, 14 bp, Homo sapiens
taatgcgtgcatac

SEQ ID NO: 4602227 - DNA, 19 bp, Homo sapiens
taatggaagtgtatttatt

SEQ ID NO: 4602228 - DNA, 20 bp, Homo sapiens
taatggaagtgtatttattt

SEQ ID NO: 4602229 - DNA, 23 bp, Homo sapiens
taatgtgaaactggattaaactt

SEQ ID NO: 4602230 - DNA, 18 bp, Homo sapiens
taattattgatgttttca

SEQ ID NO: 4602231 - DNA, 20 bp, Homo sapiens
taatttatttaatatttaat

SEQ ID NO: 4602232 - DNA, 18 bp, Homo sapiens
taatttgtgatacaatgc

SEQ ID NO: 4602233 - DNA, 20 bp, Homo sapiens
taattttccataagctattt

SEQ ID NO: 4602234 - DNA, 19 bp, Homo sapiens
taattttgtaatgtatcaa

SEQ ID NO: 4602235 - DNA, 14 bp, Homo sapiens
tacaacttctgggc

SEQ ID NO: 4602236 - DNA, 20 bp, Homo sapiens
tacaacttctgggcctctct

SEQ ID NO: 4602237 - DNA, 16 bp, Homo sapiens
tacaagcctgcacaat

SEQ ID NO: 4602238 - DNA, 15 bp, Homo sapiens
tacaagttagaaaac

SEQ ID NO: 4602239 - DNA, 21 bp, Homo sapiens
tacaatgctgtgccctaaagt

SEQ ID NO: 4602240 - DNA, 17 bp, Homo sapiens
tacaattttttatcatg

SEQ ID NO: 4602241 - DNA, 23 bp, Homo sapiens
tacaattttttatcatgcatgtc

SEQ ID NO: 4602242 - DNA, 15 bp, Homo sapiens
tacacactgcatgtt

SEQ ID NO: 4602243 - DNA, 19 bp, Homo sapiens
tacaccactacattctgtt

SEQ ID NO: 4602244 - DNA, 20 bp, Homo sapiens
tacagcaacaatttatgaat

SEQ ID NO: 4602245 - DNA, 16 bp, Homo sapiens
tacagctcattaaact

SEQ ID NO: 4602246 - DNA, 19 bp, Homo sapiens
tacagttactcagaattct

SEQ ID NO: 4602247 - DNA, 17 bp, Homo sapiens
tacataatgcgtgcata

SEQ ID NO: 4602248 - DNA, 17 bp, Homo sapiens
tacatagatgcttagtc

SEQ ID NO: 4602249 - DNA, 16 bp, Homo sapiens
tacatgaaaacacatt

SEQ ID NO: 4602250 - DNA, 17 bp, Homo sapiens
tacatgaaaacacattt

SEQ ID NO: 4602251 - DNA, 15 bp, Homo sapiens
tacatttaaaacatt

SEQ ID NO: 4602252 - DNA, 19 bp, Homo sapiens
tacatttttaagtgctgca

SEQ ID NO: 4602253 - DNA, 12 bp, Homo sapiens
taccaacctgtt

SEQ ID NO: 4602254 - DNA, 19 bp, Homo sapiens
taccacctcaggtgacttt

SEQ ID NO: 4602255 - DNA, 14 bp, Homo sapiens
tacctactttgact

SEQ ID NO: 4602256 - DNA, 13 bp, Homo sapiens
tacctctgtgcct

SEQ ID NO: 4602257 - DNA, 22 bp, Homo sapiens
tacctcttgagccttgaacttt

SEQ ID NO: 4602258 - DNA, 23 bp, Homo sapiens
tacctcttgagccttgaactttg

SEQ ID NO: 4602259 - DNA, 12 bp, Homo sapiens
tacctgattttt

SEQ ID NO: 4602260 - DNA, 18 bp, Homo sapiens
tacctgattttttttcct

SEQ ID NO: 4602261 - DNA, 22 bp, Homo sapiens
taccttttttatacataaacaa

SEQ ID NO: 4602262 - DNA, 13 bp, Homo sapiens
tacgttgtgcatt

SEQ ID NO: 4602263 - DNA, 18 bp, Homo sapiens
tactaaaaatacaaaaaa

SEQ ID NO: 4602264 - DNA, 18 bp, Homo sapiens
tactaaccagcagaaatg

SEQ ID NO: 4602265 - DNA, 19 bp, Homo sapiens
tactaaccagcagaaatgc

SEQ ID NO: 4602266 - DNA, 15 bp, Homo sapiens
tactaatagacaatt

SEQ ID NO: 4602267 - DNA, 20 bp, Homo sapiens
tactaatagacaatttatta

SEQ ID NO: 4602268 - DNA, 23 bp, Homo sapiens
tactaattttccataagctattt

SEQ ID NO: 4602269 - DNA, 14 bp, Homo sapiens
tactacagtttgtt

SEQ ID NO: 4602270 - DNA, 19 bp, Homo sapiens
tactgagagtgaacaaatt

SEQ ID NO: 4602271 - DNA, 16 bp, Homo sapiens
tactgatatattttac

SEQ ID NO: 4602272 - DNA, 13 bp, Homo sapiens
tactgcatacttt

SEQ ID NO: 4602273 - DNA, 18 bp, Homo sapiens
tactggtccaaaagattg

SEQ ID NO: 4602274 - DNA, 15 bp, Homo sapiens
tactgtaatttgtga

SEQ ID NO: 4602275 - DNA, 18 bp, Homo sapiens
tactgtaatttgtgatac

SEQ ID NO: 4602276 - DNA, 19 bp, Homo sapiens
tactgtaatttgtgataca

SEQ ID NO: 4602277 - DNA, 21 bp, Homo sapiens
tactgtacatgaaaacacatt

SEQ ID NO: 4602278 - DNA, 18 bp, Homo sapiens
tacttagcaaagttttac

SEQ ID NO: 4602279 - DNA, 14 bp, Homo sapiens
tacttcttgaaggt

SEQ ID NO: 4602280 - DNA, 12 bp, Homo sapiens
tacttgaagggc

SEQ ID NO: 4602281 - DNA, 16 bp, Homo sapiens
tacttgaagggccaga

SEQ ID NO: 4602282 - DNA, 14 bp, Homo sapiens
tacttttaaactgt

SEQ ID NO: 4602283 - DNA, 16 bp, Homo sapiens
tagaaaacataatctt

SEQ ID NO: 4602284 - DNA, 19 bp, Homo sapiens
tagaatgttttcaaatgtt

SEQ ID NO: 4602285 - DNA, 18 bp, Homo sapiens
tagacaatttattatggc

SEQ ID NO: 4602286 - DNA, 22 bp, Homo sapiens
tagaggagaaactggaactctc

SEQ ID NO: 4602287 - DNA, 15 bp, Homo sapiens
tagaggttcaaagat

SEQ ID NO: 4602288 - DNA, 17 bp, Homo sapiens
tagagttgatactacag

SEQ ID NO: 4602289 - DNA, 16 bp, Homo sapiens
tagatactgtatcatg

SEQ ID NO: 4602290 - DNA, 13 bp, Homo sapiens
tagatgctggccc

SEQ ID NO: 4602291 - DNA, 15 bp, Homo sapiens
tagatgctggcccag

SEQ ID NO: 4602292 - DNA, 16 bp, Homo sapiens
tagatgctggcccagg

SEQ ID NO: 4602293 - DNA, 21 bp, Homo sapiens
tagatgctggcccagggccca

SEQ ID NO: 4602294 - DNA, 17 bp, Homo sapiens
tagcaagacacatccct

SEQ ID NO: 4602295 - DNA, 16 bp, Homo sapiens
tagcatacgtacacat

SEQ ID NO: 4602296 - DNA, 18 bp, Homo sapiens
tagcattgtaaaagcatt

SEQ ID NO: 4602297 - DNA, 19 bp, Homo sapiens
tagctaataacatgtgaaa

SEQ ID NO: 4602298 - DNA, 12 bp, Homo sapiens
tagctatttaat

SEQ ID NO: 4602299 - DNA, 13 bp, Homo sapiens
tagctatttaata

SEQ ID NO: 4602300 - DNA, 22 bp, Homo sapiens
tagctcattctccttgtgttac

SEQ ID NO: 4602301 - DNA, 23 bp, Homo sapiens
taggaaatggctttgtgattcaa

SEQ ID NO: 4602302 - DNA, 12 bp, Homo sapiens
taggagaagcca

SEQ ID NO: 4602303 - DNA, 16 bp, Homo sapiens
taggagaagccaggaa

SEQ ID NO: 4602304 - DNA, 21 bp, Homo sapiens
taggagaccaaggcgggagca

SEQ ID NO: 4602305 - DNA, 21 bp, Homo sapiens
taggatccagtgatccttaca

SEQ ID NO: 4602306 - DNA, 19 bp, Homo sapiens
taggcctcaggtgaaactc

SEQ ID NO: 4602307 - DNA, 21 bp, Homo sapiens
tagggaaggatacaaaagcat

SEQ ID NO: 4602308 - DNA, 14 bp, Homo sapiens
taggggctggggcc

SEQ ID NO: 4602309 - DNA, 23 bp, Homo sapiens
taggggctggggccaaataaagt

SEQ ID NO: 4602310 - DNA, 22 bp, Homo sapiens
taggttattttgatgtaaagat

SEQ ID NO: 4602311 - DNA, 13 bp, Homo sapiens
tagtatcaaaaga

SEQ ID NO: 4602312 - DNA, 18 bp, Homo sapiens
tagtatgaggcatttgtt

SEQ ID NO: 4602313 - DNA, 21 bp, Homo sapiens
tagttgtaccgcaatgtgact

SEQ ID NO: 4602314 - DNA, 15 bp, Homo sapiens
tagtttgattaaatt

SEQ ID NO: 4602315 - DNA, 20 bp, Homo sapiens
tagttttacttttaaactgt

SEQ ID NO: 4602316 - DNA, 11 bp, Homo sapiens
tataaacttta

SEQ ID NO: 4602317 - DNA, 20 bp, Homo sapiens
tataaccagtgttgtggatt

SEQ ID NO: 4602318 - DNA, 22 bp, Homo sapiens
tataaccagtgttgtggattta

SEQ ID NO: 4602319 - DNA, 12 bp, Homo sapiens
tatactgcatac

SEQ ID NO: 4602320 - DNA, 19 bp, Homo sapiens
tataggaattgacccacaa

SEQ ID NO: 4602321 - DNA, 15 bp, Homo sapiens
tatagttttactttt

SEQ ID NO: 4602322 - DNA, 17 bp, Homo sapiens
ggagcccactgtcctgg

SEQ ID NO: 4602323 - DNA, 22 bp, Homo sapiens
ggagcccactgtcctgggcctg

SEQ ID NO: 4602324 - DNA, 21 bp, Homo sapiens
ggaggatcctggagaagtggg

SEQ ID NO: 4602325 - DNA, 17 bp, Homo sapiens
ggaggccattgtgtgag

SEQ ID NO: 4602326 - DNA, 17 bp, Homo sapiens
ggagtcccaaggaaagc

SEQ ID NO: 4602327 - DNA, 22 bp, Homo sapiens
ggagttgatctggaacccagac

SEQ ID NO: 4602328 - DNA, 13 bp, Homo sapiens
ggataccagctga

SEQ ID NO: 4602329 - DNA, 21 bp, Homo sapiens
ggatagatgctggcccagggc

SEQ ID NO: 4602330 - DNA, 16 bp, Homo sapiens
ggatatagttttactt

SEQ ID NO: 4602331 - DNA, 23 bp, Homo sapiens
ggatgggggaactcagatccagg

SEQ ID NO: 4602332 - DNA, 18 bp, Homo sapiens
ggcaatgtcaggaacaga

SEQ ID NO: 4602333 - DNA, 18 bp, Homo sapiens
ggcacaggccgtcaccct

SEQ ID NO: 4602334 - DNA, 23 bp, Homo sapiens
ggcacagtgcagcaagcctggcc

SEQ ID NO: 4602335 - DNA, 13 bp, Homo sapiens
ggcacatcagcac

SEQ ID NO: 4602336 - DNA, 16 bp, Homo sapiens
ggcaccagacacccag

SEQ ID NO: 4602337 - DNA, 16 bp, Homo sapiens
ggcacctaatccaggc

SEQ ID NO: 4602338 - DNA, 22 bp, Homo sapiens
ggcacctaatccaggcagatcc

SEQ ID NO: 4602339 - DNA, 14 bp, Homo sapiens
ggcagatccaggac

SEQ ID NO: 4602340 - DNA, 15 bp, Homo sapiens
ggcaggctgagggtc

SEQ ID NO: 4602341 - DNA, 16 bp, Homo sapiens
ggcagggacctaaagg

SEQ ID NO: 4602342 - DNA, 20 bp, Homo sapiens
ggcagtggtggttttctgtt

SEQ ID NO: 4602343 - DNA, 17 bp, Homo sapiens
ggcatttgtttgaactg

SEQ ID NO: 4602344 - DNA, 22 bp, Homo sapiens
ggccacagtcatggtggccacg

SEQ ID NO: 4602345 - DNA, 18 bp, Homo sapiens
ggccagacatgccacaag

SEQ ID NO: 4602346 - DNA, 16 bp, Homo sapiens
ggccagatccagcctg

SEQ ID NO: 4602347 - DNA, 19 bp, Homo sapiens
ggccaggagtttgagacca

SEQ ID NO: 4602348 - DNA, 16 bp, Homo sapiens
ggccagggagaagctc

SEQ ID NO: 4602349 - DNA, 17 bp, Homo sapiens
ggccagggagaagctcc

SEQ ID NO: 4602350 - DNA, 17 bp, Homo sapiens
ggcccagagcccagctc

SEQ ID NO: 4602351 - DNA, 19 bp, Homo sapiens
ggccctccctgttccccag

SEQ ID NO: 4602352 - DNA, 21 bp, Homo sapiens
ggccctccctgttccccagag

SEQ ID NO: 4602353 - DNA, 18 bp, Homo sapiens
ggcctgctccagacctga

SEQ ID NO: 4602354 - DNA, 16 bp, Homo sapiens
ggcgggagcatctctt

SEQ ID NO: 4602355 - DNA, 13 bp, Homo sapiens
ggctaggggctgg

SEQ ID NO: 4602356 - DNA, 15 bp, Homo sapiens
ggctaggggctgggg

SEQ ID NO: 4602357 - DNA, 15 bp, Homo sapiens
ggctgagatatgaac

SEQ ID NO: 4602358 - DNA, 15 bp, Homo sapiens
ggctgagctctctgt

SEQ ID NO: 4602359 - DNA, 20 bp, Homo sapiens
ggctgagctctctgtgggct

SEQ ID NO: 4602360 - DNA, 15 bp, Homo sapiens
ggctgagggtcgtgg

SEQ ID NO: 4602361 - DNA, 18 bp, Homo sapiens
ggctgagggtcgtgggaa

SEQ ID NO: 4602362 - DNA, 21 bp, Homo sapiens
ggctgagggtcgtgggaaagg

SEQ ID NO: 4602363 - DNA, 20 bp, Homo sapiens
ggctgcgaatctagaggagg

SEQ ID NO: 4602364 - DNA, 16 bp, Homo sapiens
ggctgctacccagaaa

SEQ ID NO: 4602365 - DNA, 14 bp, Homo sapiens
gggaaagccagcct

SEQ ID NO: 4602366 - DNA, 15 bp, Homo sapiens
gggaacactgagaaa

SEQ ID NO: 4602367 - DNA, 17 bp, Homo sapiens
gggaacactgagaaaga

SEQ ID NO: 4602368 - DNA, 20 bp, Homo sapiens
gggacagaccagcccttccc

SEQ ID NO: 4602369 - DNA, 18 bp, Homo sapiens
gggacagaggccccagcc

SEQ ID NO: 4602370 - DNA, 20 bp, Homo sapiens
gggacagaggccccagcctc

SEQ ID NO: 4602371 - DNA, 21 bp, Homo sapiens
gggacagaggccccagcctcc

SEQ ID NO: 4602372 - DNA, 21 bp, Homo sapiens
gggactgaggggaggggagca

SEQ ID NO: 4602373 - DNA, 20 bp, Homo sapiens
gggagcccactgtcctgggc

SEQ ID NO: 4602374 - DNA, 23 bp, Homo sapiens
gggagttaagacctggcagctct

SEQ ID NO: 4602375 - DNA, 20 bp, Homo sapiens
gggcagcatagcaagacaca

SEQ ID NO: 4602376 - DNA, 11 bp, Homo sapiens
gggccagagcc

SEQ ID NO: 4602377 - DNA, 15 bp, Homo sapiens
gggccagagccaggg

SEQ ID NO: 4602378 - DNA, 13 bp, Homo sapiens
gggccagatccag

SEQ ID NO: 4602379 - DNA, 19 bp, Homo sapiens
gggccagatccagcctggg

SEQ ID NO: 4602380 - DNA, 22 bp, Homo sapiens
gggccatgatggcaacagatct

SEQ ID NO: 4602381 - DNA, 23 bp, Homo sapiens
gggccatgatggcaacagatctg

SEQ ID NO: 4602382 - DNA, 12 bp, Homo sapiens
gggcccagagcc

SEQ ID NO: 4602383 - DNA, 21 bp, Homo sapiens
gggcctctcttggaccctggg

SEQ ID NO: 4602384 - DNA, 14 bp, Homo sapiens
gggcctgctccaga

SEQ ID NO: 4602385 - DNA, 16 bp, Homo sapiens
gggctaggggctgggg

SEQ ID NO: 4602386 - DNA, 22 bp, Homo sapiens
gggctggggccaaataaagtct

SEQ ID NO: 4602387 - DNA, 18 bp, Homo sapiens
ggggaacactgagaaaga

SEQ ID NO: 4602388 - DNA, 18 bp, Homo sapiens
ggggaactcagatccagg

SEQ ID NO: 4602389 - DNA, 21 bp, Homo sapiens
ggggaactcagatccagggac

SEQ ID NO: 4602390 - DNA, 14 bp, Homo sapiens
ggggacagaccagc

SEQ ID NO: 4602391 - DNA, 21 bp, Homo sapiens
ggggagttaagacctggcagc

SEQ ID NO: 4602392 - DNA, 18 bp, Homo sapiens
ggggccaaataaagtctc

SEQ ID NO: 4602393 - DNA, 14 bp, Homo sapiens
ggggccagatccag

SEQ ID NO: 4602394 - DNA, 19 bp, Homo sapiens
ggggccagatccagcctgg

SEQ ID NO: 4602395 - DNA, 21 bp, Homo sapiens
ggggctggggccaaataaagt

SEQ ID NO: 4602396 - DNA, 15 bp, Homo sapiens
gggggataccagctg

SEQ ID NO: 4602397 - DNA, 16 bp, Homo sapiens
gggggataccagctga

SEQ ID NO: 4602398 - DNA, 13 bp, Homo sapiens
ggggttgccctgg

SEQ ID NO: 4602399 - DNA, 22 bp, Homo sapiens
gggtctggagttgatctggaac

SEQ ID NO: 4602400 - DNA, 14 bp, Homo sapiens
gggtgaggagctgg

SEQ ID NO: 4602401 - DNA, 20 bp, Homo sapiens
gggtgcggtttgctcagccc

SEQ ID NO: 4602402 - DNA, 20 bp, Homo sapiens
gggttctgcctgccagctgc

SEQ ID NO: 4602403 - DNA, 19 bp, Homo sapiens
ggtacttcttgaaggtgct

SEQ ID NO: 4602404 - DNA, 23 bp, Homo sapiens
ggtagaatgttttcaaatgttct

SEQ ID NO: 4602405 - DNA, 12 bp, Homo sapiens
ggtcgcccagga

SEQ ID NO: 4602406 - DNA, 13 bp, Homo sapiens
ggtcgcccaggag

SEQ ID NO: 4602407 - DNA, 21 bp, Homo sapiens
ggtgaagctcacttctgggct

SEQ ID NO: 4602408 - DNA, 18 bp, Homo sapiens
ggtgaagtgaagacaatg

SEQ ID NO: 4602409 - DNA, 13 bp, Homo sapiens
ggtgccccaggac

SEQ ID NO: 4602410 - DNA, 21 bp, Homo sapiens
ggtgctaaatggtcgcccagg

SEQ ID NO: 4602411 - DNA, 17 bp, Homo sapiens
ggtgctgacggccaggg

SEQ ID NO: 4602412 - DNA, 15 bp, Homo sapiens
ggtggcatacgcctg

SEQ ID NO: 4602413 - DNA, 20 bp, Homo sapiens
ggtggggacagaccagccct

SEQ ID NO: 4602414 - DNA, 16 bp, Homo sapiens
ggtgtgactgaatttc

SEQ ID NO: 4602415 - DNA, 19 bp, Homo sapiens
ggttctgcctgccagctgc

SEQ ID NO: 4602416 - DNA, 14 bp, Homo sapiens
ggtttcagaaatgt

SEQ ID NO: 4602417 - DNA, 19 bp, Homo sapiens
gtaaagatatttttatctt

SEQ ID NO: 4602418 - DNA, 22 bp, Homo sapiens
gtaaagatatttttatctttat

SEQ ID NO: 4602419 - DNA, 19 bp, Homo sapiens
gtaaatacacaacacacac

SEQ ID NO: 4602420 - DNA, 18 bp, Homo sapiens
gtaaatgggggtgcattt

SEQ ID NO: 4602421 - DNA, 15 bp, Homo sapiens
gtaactaaaataatt

SEQ ID NO: 4602422 - DNA, 13 bp, Homo sapiens
gtaagaaatacag

SEQ ID NO: 4602423 - DNA, 14 bp, Homo sapiens
gtaatatgcacaca

SEQ ID NO: 4602424 - DNA, 22 bp, Homo sapiens
gtaatttgtgatacaatgctgt

SEQ ID NO: 4602425 - DNA, 18 bp, Homo sapiens
gtacactgtttcaaactt

SEQ ID NO: 4602426 - DNA, 13 bp, Homo sapiens
gtacagaaagctg

SEQ ID NO: 4602427 - DNA, 14 bp, Homo sapiens
gtacagaaagctgc

SEQ ID NO: 4602428 - DNA, 15 bp, Homo sapiens
gtacatgggtgacta

SEQ ID NO: 4602429 - DNA, 18 bp, Homo sapiens
gtacattcaatgtttatg

SEQ ID NO: 4602430 - DNA, 22 bp, Homo sapiens
gtaccatttaatggggaggaca

SEQ ID NO: 4602431 - DNA, 13 bp, Homo sapiens
gtacctcttgagc

SEQ ID NO: 4602432 - DNA, 14 bp, Homo sapiens
gtagaatgttttca

SEQ ID NO: 4602433 - DNA, 22 bp, Homo sapiens
gtagcctcaatcgagtgagaca

SEQ ID NO: 4602434 - DNA, 22 bp, Homo sapiens
gtagtatgataggttattttga

SEQ ID NO: 4602435 - DNA, 13 bp, Homo sapiens
gtataaagaaaag

SEQ ID NO: 4602436 - DNA, 17 bp, Homo sapiens
gtatgaggcatttgttt

SEQ ID NO: 4602437 - DNA, 14 bp, Homo sapiens
gtattatacctttt

SEQ ID NO: 4602438 - DNA, 18 bp, Homo sapiens
gtattctctcctgtacct

SEQ ID NO: 4602439 - DNA, 21 bp, Homo sapiens
gtattctctcctgtacctctt

SEQ ID NO: 4602440 - DNA, 21 bp, Homo sapiens
gtatttttttactaatagaca

SEQ ID NO: 4602441 - DNA, 21 bp, Homo sapiens
gtcaattttgttatgtatatt

SEQ ID NO: 4602442 - DNA, 13 bp, Homo sapiens
gtcacaggaagta

SEQ ID NO: 4602443 - DNA, 15 bp, Homo sapiens
gtcacaggaagtaga

SEQ ID NO: 4602444 - DNA, 20 bp, Homo sapiens
gtcacaggaagtagaggagg

SEQ ID NO: 4602445 - DNA, 13 bp, Homo sapiens
gtcaccctgggag

SEQ ID NO: 4602446 - DNA, 14 bp, Homo sapiens
gtcaccctgggagc

SEQ ID NO: 4602447 - DNA, 10 bp, Homo sapiens
gtcactgctt

SEQ ID NO: 4602448 - DNA, 15 bp, Homo sapiens
gtcactgcttaactt

SEQ ID NO: 4602449 - DNA, 21 bp, Homo sapiens
gtcactgcttaacttcacata

SEQ ID NO: 4602450 - DNA, 14 bp, Homo sapiens
gtcactttttatgc

SEQ ID NO: 4602451 - DNA, 16 bp, Homo sapiens
gtcaggaacagaagga

SEQ ID NO: 4602452 - DNA, 17 bp, Homo sapiens
gtcagttgttatttatt

SEQ ID NO: 4602453 - DNA, 14 bp, Homo sapiens
gtcatgaagcccaa

SEQ ID NO: 4602454 - DNA, 20 bp, Homo sapiens
gtcatggtggccacggccac

SEQ ID NO: 4602455 - DNA, 17 bp, Homo sapiens
gtcattatgttaatatt

SEQ ID NO: 4602456 - DNA, 14 bp, Homo sapiens
gaggaatttcacct

SEQ ID NO: 4602457 - DNA, 18 bp, Homo sapiens
gaggacaagagaaaaaag

SEQ ID NO: 4602458 - DNA, 13 bp, Homo sapiens
gaggacacagaga

SEQ ID NO: 4602459 - DNA, 12 bp, Homo sapiens
gaggagaaactg

SEQ ID NO: 4602460 - DNA, 22 bp, Homo sapiens
gaggattgcttgagcccaggag

SEQ ID NO: 4602461 - DNA, 16 bp, Homo sapiens
gaggcagggacctaaa

SEQ ID NO: 4602462 - DNA, 21 bp, Homo sapiens
gaggcatttgtttgaactgat

SEQ ID NO: 4602463 - DNA, 19 bp, Homo sapiens
gaggccattgtgtgagcct

SEQ ID NO: 4602464 - DNA, 13 bp, Homo sapiens
gaggcccagttca

SEQ ID NO: 4602465 - DNA, 13 bp, Homo sapiens
gaggccccagcct

SEQ ID NO: 4602466 - DNA, 19 bp, Homo sapiens
gaggccccagcctccctga

SEQ ID NO: 4602467 - DNA, 22 bp, Homo sapiens
gaggccccagcctccctgaagc

SEQ ID NO: 4602468 - DNA, 17 bp, Homo sapiens
gaggctgaggcaggagg

SEQ ID NO: 4602469 - DNA, 13 bp, Homo sapiens
gagggaaagccag

SEQ ID NO: 4602470 - DNA, 15 bp, Homo sapiens
gagggaaagccagcc

SEQ ID NO: 4602471 - DNA, 16 bp, Homo sapiens
gagggaaagccagcct

SEQ ID NO: 4602472 - DNA, 19 bp, Homo sapiens
gagggtcgtgggaaagggg

SEQ ID NO: 4602473 - DNA, 13 bp, Homo sapiens
gaggtctgttctt

SEQ ID NO: 4602474 - DNA, 19 bp, Homo sapiens
gaggttcaaagatattttg

SEQ ID NO: 4602475 - DNA, 18 bp, Homo sapiens
gagtcccaaggaaagccc

SEQ ID NO: 4602476 - DNA, 10 bp, Homo sapiens
gcccagagac

SEQ ID NO: 4602477 - DNA, 18 bp, Homo sapiens
gcccagagcccagctcca

SEQ ID NO: 4602478 - DNA, 14 bp, Homo sapiens
gcccagggcccaga

SEQ ID NO: 4602479 - DNA, 15 bp, Homo sapiens
gcccagggcccagag

SEQ ID NO: 4602480 - DNA, 19 bp, Homo sapiens
gcccagggcccagagccca

SEQ ID NO: 4602481 - DNA, 12 bp, Homo sapiens
gccccaggacca

SEQ ID NO: 4602482 - DNA, 15 bp, Homo sapiens
gccccaggaccagct

SEQ ID NO: 4602483 - DNA, 19 bp, Homo sapiens
gccccaggaccagctcagg

SEQ ID NO: 4602484 - DNA, 22 bp, Homo sapiens
gcccccagctaagaacctggaa

SEQ ID NO: 4602485 - DNA, 16 bp, Homo sapiens
gcccctccccctgcca

SEQ ID NO: 4602486 - DNA, 18 bp, Homo sapiens
gccctccctgttccccag

SEQ ID NO: 4602487 - DNA, 22 bp, Homo sapiens
gccctccctgttccccagagaa

SEQ ID NO: 4602488 - DNA, 23 bp, Homo sapiens
gccctgactaaactaccacctca

SEQ ID NO: 4602489 - DNA, 16 bp, Homo sapiens
gccctgggggatacca

SEQ ID NO: 4602490 - DNA, 20 bp, Homo sapiens
gccctgggggataccagctg

SEQ ID NO: 4602491 - DNA, 17 bp, Homo sapiens
gcctactccaaaatgtt

SEQ ID NO: 4602492 - DNA, 20 bp, Homo sapiens
gcctagcatacgtacacatt

SEQ ID NO: 4602493 - DNA, 21 bp, Homo sapiens
gcctagcatacgtacacattt

SEQ ID NO: 4602494 - DNA, 20 bp, Homo sapiens
gcctcagaggccttgggagc

SEQ ID NO: 4602495 - DNA, 22 bp, Homo sapiens
gcctccaattttttaagtgaaa

SEQ ID NO: 4602496 - DNA, 18 bp, Homo sapiens
gcctctcttggaccctgg

SEQ ID NO: 4602497 - DNA, 16 bp, Homo sapiens
gcctgacagcatcctc

SEQ ID NO: 4602498 - DNA, 17 bp, Homo sapiens
gcctgagcgacagtgag

SEQ ID NO: 4602499 - DNA, 15 bp, Homo sapiens
gcctgccagctgcac

SEQ ID NO: 4602500 - DNA, 13 bp, Homo sapiens
gcctgctccagac

SEQ ID NO: 4602501 - DNA, 14 bp, Homo sapiens
gcctgctccagacc

SEQ ID NO: 4602502 - DNA, 15 bp, Homo sapiens
gcctgctccagacct

SEQ ID NO: 4602503 - DNA, 17 bp, Homo sapiens
gcctgctccagacctga

SEQ ID NO: 4602504 - DNA, 21 bp, Homo sapiens
gcctgctccagacctgatcct

SEQ ID NO: 4602505 - DNA, 16 bp, Homo sapiens
gcctggccagacacag

SEQ ID NO: 4602506 - DNA, 20 bp, Homo sapiens
gcctggccagacacaggccc

SEQ ID NO: 4602507 - DNA, 20 bp, Homo sapiens
gcctgggcaacagagcaaga

SEQ ID NO: 4602508 - DNA, 19 bp, Homo sapiens
gccttcctgtttttcacat

SEQ ID NO: 4602509 - DNA, 13 bp, Homo sapiens
gccttgccagaga

SEQ ID NO: 4602510 - DNA, 14 bp, Homo sapiens
gccttgccagagat

SEQ ID NO: 4602511 - DNA, 17 bp, Homo sapiens
gcgaatctagaggaggg

SEQ ID NO: 4602512 - DNA, 15 bp, Homo sapiens
gcggtttgctcagcc

SEQ ID NO: 4602513 - DNA, 16 bp, Homo sapiens
gcgttactaattggcc

SEQ ID NO: 4602514 - DNA, 18 bp, Homo sapiens
gcgtttctatgacacatg

SEQ ID NO: 4602515 - DNA, 17 bp, Homo sapiens
gctaagcaaaatgtgat

SEQ ID NO: 4602516 - DNA, 17 bp, Homo sapiens
gctacttgggaggctga

SEQ ID NO: 4602517 - DNA, 18 bp, Homo sapiens
gctagaggttcaaagata

SEQ ID NO: 4602518 - DNA, 14 bp, Homo sapiens
gctcaatcctctaa

SEQ ID NO: 4602519 - DNA, 16 bp, Homo sapiens
gctcaatcctctaagc

SEQ ID NO: 4602520 - DNA, 17 bp, Homo sapiens
gctcaggacagatgcca

SEQ ID NO: 4602521 - DNA, 20 bp, Homo sapiens
gctcaggacagatgccacac

SEQ ID NO: 4602522 - DNA, 18 bp, Homo sapiens
gctccaacctgcaaagat

SEQ ID NO: 4602523 - DNA, 20 bp, Homo sapiens
gctccaaggggaatcagaac

SEQ ID NO: 4602524 - DNA, 23 bp, Homo sapiens
gctccaaggggaatcagaactca

SEQ ID NO: 4602525 - DNA, 12 bp, Homo sapiens
gctccagacctg

SEQ ID NO: 4602526 - DNA, 22 bp, Homo sapiens
gctccagacctgatcctggagg

SEQ ID NO: 4602527 - DNA, 19 bp, Homo sapiens
gctcccctaaagcctcaaa

SEQ ID NO: 4602528 - DNA, 15 bp, Homo sapiens
gctcctctccccagc

SEQ ID NO: 4602529 - DNA, 20 bp, Homo sapiens
gctcctctccccagcccaga

SEQ ID NO: 4602530 - DNA, 21 bp, Homo sapiens
gctcctctccccagcccagag

SEQ ID NO: 4602531 - DNA, 22 bp, Homo sapiens
gctcctctccccagcccagaga

SEQ ID NO: 4602532 - DNA, 19 bp, Homo sapiens
gctctggacagccccaccc

SEQ ID NO: 4602533 - DNA, 15 bp, Homo sapiens
gctgaaattttatat

SEQ ID NO: 4602534 - DNA, 17 bp, Homo sapiens
gctgaaattttatatgc

SEQ ID NO: 4602535 - DNA, 13 bp, Homo sapiens
gctgacggccagg

SEQ ID NO: 4602536 - DNA, 15 bp, Homo sapiens
gctgacggccaggga

SEQ ID NO: 4602537 - DNA, 15 bp, Homo sapiens
gctgaggcaggagga

SEQ ID NO: 4602538 - DNA, 22 bp, Homo sapiens
gctgagggtcgtgggaaagggg

SEQ ID NO: 4602539 - DNA, 18 bp, Homo sapiens
gctgagtctgaattctgc

SEQ ID NO: 4602540 - DNA, 16 bp, Homo sapiens
gctgatcagtgggcct

SEQ ID NO: 4602541 - DNA, 17 bp, Homo sapiens
gctgcatttaaaagata

SEQ ID NO: 4602542 - DNA, 21 bp, Homo sapiens
gctgcgaatctagaggagggg

SEQ ID NO: 4602543 - DNA, 19 bp, Homo sapiens
gctgctgtacaacttctgg

SEQ ID NO: 4602544 - DNA, 14 bp, Homo sapiens
gctggagctctgcc

SEQ ID NO: 4602545 - DNA, 17 bp, Homo sapiens
gctggagctctgcccat

SEQ ID NO: 4602546 - DNA, 19 bp, Homo sapiens
gctggcccagggcccagag

SEQ ID NO: 4602547 - DNA, 16 bp, Homo sapiens
gctggggccaaataaa

SEQ ID NO: 4602548 - DNA, 14 bp, Homo sapiens
gctgtcaaggctca

SEQ ID NO: 4602549 - DNA, 21 bp, Homo sapiens
gctgtgtaaatgctccagcac

SEQ ID NO: 4602550 - DNA, 14 bp, Homo sapiens
gcttaacttcacat

SEQ ID NO: 4602551 - DNA, 15 bp, Homo sapiens
gcttatctcctcctc

SEQ ID NO: 4602552 - DNA, 23 bp, Homo sapiens
gcttatgatagcaaatggcctca

SEQ ID NO: 4602553 - DNA, 16 bp, Homo sapiens
gcttccacacttctgg

SEQ ID NO: 4602554 - DNA, 19 bp, Homo sapiens
gcttgccctggtgcctcac

SEQ ID NO: 4602555 - DNA, 16 bp, Homo sapiens
gcttgtacataatgcg

SEQ ID NO: 4602556 - DNA, 15 bp, Homo sapiens
gctttccctgcctct

SEQ ID NO: 4602557 - DNA, 15 bp, Homo sapiens
gctttgtgatttttg

SEQ ID NO: 4602558 - DNA, 21 bp, Homo sapiens
gctttgtttaagcatcacatt

SEQ ID NO: 4602559 - DNA, 12 bp, Homo sapiens
gcttttgtgcat

SEQ ID NO: 4602560 - DNA, 19 bp, Homo sapiens
gctttttattcctcctgct

SEQ ID NO: 4602561 - DNA, 18 bp, Homo sapiens
ggaaaacatgctacacac

SEQ ID NO: 4602562 - DNA, 15 bp, Homo sapiens
ggaaagccagcctgg

SEQ ID NO: 4602563 - DNA, 11 bp, Homo sapiens
ggaaaggggag

SEQ ID NO: 4602564 - DNA, 18 bp, Homo sapiens
ggaacactgagaaagagg

SEQ ID NO: 4602565 - DNA, 23 bp, Homo sapiens
ggaacagaagaggaaagagagac

SEQ ID NO: 4602566 - DNA, 12 bp, Homo sapiens
ggaacagaagga

SEQ ID NO: 4602567 - DNA, 19 bp, Homo sapiens
ggaacagaaggatgaatga

SEQ ID NO: 4602568 - DNA, 20 bp, Homo sapiens
ggaacagacaacagaagtca

SEQ ID NO: 4602569 - DNA, 21 bp, Homo sapiens
ggaacagacaacagaagtcat

SEQ ID NO: 4602570 - DNA, 13 bp, Homo sapiens
ggaacccagactc

SEQ ID NO: 4602571 - DNA, 13 bp, Homo sapiens
ggaacctcagcct

SEQ ID NO: 4602572 - DNA, 23 bp, Homo sapiens
ggaacctcagcctggccagacac

SEQ ID NO: 4602573 - DNA, 16 bp, Homo sapiens
ggaactcagatccagg

SEQ ID NO: 4602574 - DNA, 23 bp, Homo sapiens
ggaacttggggagttaagacctg

SEQ ID NO: 4602575 - DNA, 16 bp, Homo sapiens
ggaagccagctttccc

SEQ ID NO: 4602576 - DNA, 18 bp, Homo sapiens
ggaagctctgaagtcaca

SEQ ID NO: 4602577 - DNA, 15 bp, Homo sapiens
ggaatttcccaggac

SEQ ID NO: 4602578 - DNA, 13 bp, Homo sapiens
ggacacacaaggt

SEQ ID NO: 4602579 - DNA, 21 bp, Homo sapiens
ggacacacaaggtgcaaatca

SEQ ID NO: 4602580 - DNA, 17 bp, Homo sapiens
ggacagaggccccagcc

SEQ ID NO: 4602581 - DNA, 15 bp, Homo sapiens
ggacagccccaccct

SEQ ID NO: 4602582 - DNA, 16 bp, Homo sapiens
ggacagccccaccctg

SEQ ID NO: 4602583 - DNA, 17 bp, Homo sapiens
ggacagccccaccctgg

SEQ ID NO: 4602584 - DNA, 16 bp, Homo sapiens
ggaccagctcaggaca

SEQ ID NO: 4602585 - DNA, 18 bp, Homo sapiens
ggaccagctcaggacaga

SEQ ID NO: 4602586 - DNA, 22 bp, Homo sapiens
ggaccagctcaggacagatgcc

SEQ ID NO: 4602587 - DNA, 18 bp, Homo sapiens
ggaccctttttgttatga

SEQ ID NO: 4602588 - DNA, 18 bp, Homo sapiens
ggacttcctgtccagctc

SEQ ID NO: 4602589 - DNA, 19 bp, Homo sapiens
ggacttcctgtccagctcc

SEQ ID NO: 4602590 - DNA, 13 bp, Homo sapiens
ggagaagccagga

SEQ ID NO: 4602591 - DNA, 19 bp, Homo sapiens
ggagaagtcttctatttat

SEQ ID NO: 4602592 - DNA, 21 bp, Homo sapiens
ggagaagtgggtggggacaga

SEQ ID NO: 4602593 - DNA, 19 bp, Homo sapiens
ggagaatcacttgaacccg

SEQ ID NO: 4602594 - DNA, 23 bp, Homo sapiens
atgtcaaatatttagatgtaatt

SEQ ID NO: 4602595 - DNA, 17 bp, Homo sapiens
atgtcaggaacagaagg

SEQ ID NO: 4602596 - DNA, 15 bp, Homo sapiens
atgtcagttgttatt

SEQ ID NO: 4602597 - DNA, 17 bp, Homo sapiens
atgtccactggttcttc

SEQ ID NO: 4602598 - DNA, 14 bp, Homo sapiens
atgtcctgtaaagg

SEQ ID NO: 4602599 - DNA, 14 bp, Homo sapiens
atgtctattcagct

SEQ ID NO: 4602600 - DNA, 16 bp, Homo sapiens
atgtctcttctgagct

SEQ ID NO: 4602601 - DNA, 17 bp, Homo sapiens
atgtctcttctgagcta

SEQ ID NO: 4602602 - DNA, 16 bp, Homo sapiens
atgtctgttctacata

SEQ ID NO: 4602603 - DNA, 20 bp, Homo sapiens
atgttaagggaagaattcca

SEQ ID NO: 4602604 - DNA, 13 bp, Homo sapiens
atgttaatatttt

SEQ ID NO: 4602605 - DNA, 17 bp, Homo sapiens
atgttctaagaagtgaa

SEQ ID NO: 4602606 - DNA, 15 bp, Homo sapiens
atgttttcaaatgtt

SEQ ID NO: 4602607 - DNA, 19 bp, Homo sapiens
attaaaaatctcaaatttc

SEQ ID NO: 4602608 - DNA, 17 bp, Homo sapiens
attaaacttaatctaaa

SEQ ID NO: 4602609 - DNA, 19 bp, Homo sapiens
attaaacttaatctaaatg

SEQ ID NO: 4602610 - DNA, 17 bp, Homo sapiens
attaacttttataaact

SEQ ID NO: 4602611 - DNA, 19 bp, Homo sapiens
attaacttttataaacttt

SEQ ID NO: 4602612 - DNA, 23 bp, Homo sapiens
attaacttttataaactttacct

SEQ ID NO: 4602613 - DNA, 12 bp, Homo sapiens
attaagaaatag

SEQ ID NO: 4602614 - DNA, 21 bp, Homo sapiens
attaggtgtgactgaatttct

SEQ ID NO: 4602615 - DNA, 14 bp, Homo sapiens
attatgttaatatt

SEQ ID NO: 4602616 - DNA, 17 bp, Homo sapiens
attatgttaatatttct

SEQ ID NO: 4602617 - DNA, 17 bp, Homo sapiens
attcaatctgtaaactg

SEQ ID NO: 4602618 - DNA, 22 bp, Homo sapiens
attcaatctgtaaactgtgtat

SEQ ID NO: 4602619 - DNA, 18 bp, Homo sapiens
attcacaagacccaaaag

SEQ ID NO: 4602620 - DNA, 23 bp, Homo sapiens
attcacagttctttgggccagac

SEQ ID NO: 4602621 - DNA, 17 bp, Homo sapiens
attcatattgcatcata

SEQ ID NO: 4602622 - DNA, 15 bp, Homo sapiens
attcattagttttga

SEQ ID NO: 4602623 - DNA, 15 bp, Homo sapiens
attcctcctgctcat

SEQ ID NO: 4602624 - DNA, 15 bp, Homo sapiens
attcctgaagaacca

SEQ ID NO: 4602625 - DNA, 21 bp, Homo sapiens
attcgctactatgatttaatt

SEQ ID NO: 4602626 - DNA, 18 bp, Homo sapiens
attctatgttaatatttt

SEQ ID NO: 4602627 - DNA, 16 bp, Homo sapiens
attctccttgtgttac

SEQ ID NO: 4602628 - DNA, 17 bp, Homo sapiens
attctccttgtgttact

SEQ ID NO: 4602629 - DNA, 18 bp, Homo sapiens
attctccttgtgttacta

SEQ ID NO: 4602630 - DNA, 21 bp, Homo sapiens
attctccttgtgttactaagt

SEQ ID NO: 4602631 - DNA, 22 bp, Homo sapiens
attctccttgtgttactaagtt

SEQ ID NO: 4602632 - DNA, 19 bp, Homo sapiens
attctctagtttgattaaa

SEQ ID NO: 4602633 - DNA, 23 bp, Homo sapiens
attctctagtttgattaaattct

SEQ ID NO: 4602634 - DNA, 16 bp, Homo sapiens
attctctcctgtacct

SEQ ID NO: 4602635 - DNA, 14 bp, Homo sapiens
attctgaccttaaa

SEQ ID NO: 4602636 - DNA, 18 bp, Homo sapiens
attctgctctaaataaag

SEQ ID NO: 4602637 - DNA, 13 bp, Homo sapiens
attcttctgaact

SEQ ID NO: 4602638 - DNA, 21 bp, Homo sapiens
attcttctgaactcaaactga

SEQ ID NO: 4602639 - DNA, 21 bp, Homo sapiens
attgacccacaagaaatgaaa

SEQ ID NO: 4602640 - DNA, 21 bp, Homo sapiens
attgatttccgttaaaatacc

SEQ ID NO: 4602641 - DNA, 15 bp, Homo sapiens
attgcattataaaat

SEQ ID NO: 4602642 - DNA, 12 bp, Homo sapiens
attgctgaaatt

SEQ ID NO: 4602643 - DNA, 18 bp, Homo sapiens
attgcttgagcccaggag

SEQ ID NO: 4602644 - DNA, 20 bp, Homo sapiens
attgtaaaagcattttgtaa

SEQ ID NO: 4602645 - DNA, 21 bp, Homo sapiens
attgtaaaagcattttgtaat

SEQ ID NO: 4602646 - DNA, 15 bp, Homo sapiens
attgtgttcccattt

SEQ ID NO: 4602647 - DNA, 20 bp, Homo sapiens
attgtgttcccatttcagct

SEQ ID NO: 4602648 - DNA, 17 bp, Homo sapiens
atttaaaacagacactg

SEQ ID NO: 4602649 - DNA, 14 bp, Homo sapiens
atttaaaagataca

SEQ ID NO: 4602650 - DNA, 17 bp, Homo sapiens
atttaaatttttttcct

SEQ ID NO: 4602651 - DNA, 20 bp, Homo sapiens
atttaacagaaatgtacagc

SEQ ID NO: 4602652 - DNA, 17 bp, Homo sapiens
atttaatggggaggaca

SEQ ID NO: 4602653 - DNA, 15 bp, Homo sapiens
atttaatttgaaggt

SEQ ID NO: 4602654 - DNA, 22 bp, Homo sapiens
atttacaactgggggagggtga

SEQ ID NO: 4602655 - DNA, 14 bp, Homo sapiens
atttaggagaagcc

SEQ ID NO: 4602656 - DNA, 23 bp, Homo sapiens
atttatgaattgaattatcttgg

SEQ ID NO: 4602657 - DNA, 22 bp, Homo sapiens
atttattgaaatgatttcacag

SEQ ID NO: 4602658 - DNA, 15 bp, Homo sapiens
atttatttaatattt

SEQ ID NO: 4602659 - DNA, 14 bp, Homo sapiens
atttatttattcat

SEQ ID NO: 4602660 - DNA, 16 bp, Homo sapiens
atttatttatttattc

SEQ ID NO: 4602661 - DNA, 23 bp, Homo sapiens
atttcaagttccaagttgctaat

SEQ ID NO: 4602662 - DNA, 17 bp, Homo sapiens
atttcacagtgtgtggt

SEQ ID NO: 4602663 - DNA, 15 bp, Homo sapiens
atttcacctgtaaac

SEQ ID NO: 4602664 - DNA, 23 bp, Homo sapiens
atttcagactcccattcctgaag

SEQ ID NO: 4602665 - DNA, 14 bp, Homo sapiens
atttcatctatttt

SEQ ID NO: 4602666 - DNA, 17 bp, Homo sapiens
atttccgttaaaatacc

SEQ ID NO: 4602667 - DNA, 21 bp, Homo sapiens
atttctaaaaaacagaggcca

SEQ ID NO: 4602668 - DNA, 12 bp, Homo sapiens
atttctaaatct

SEQ ID NO: 4602669 - DNA, 21 bp, Homo sapiens
atttctaaatctccaaaataa

SEQ ID NO: 4602670 - DNA, 19 bp, Homo sapiens
atttctgtttagataatac

SEQ ID NO: 4602671 - DNA, 19 bp, Homo sapiens
atttcttggtaagaagccg

SEQ ID NO: 4602672 - DNA, 22 bp, Homo sapiens
atttgaggtctgttctttccaa

SEQ ID NO: 4602673 - DNA, 23 bp, Homo sapiens
atttgaggtctgttctttccaaa

SEQ ID NO: 4602674 - DNA, 15 bp, Homo sapiens
atttgctttggaagt

SEQ ID NO: 4602675 - DNA, 16 bp, Homo sapiens
atttggcctgcactaa

SEQ ID NO: 4602676 - DNA, 19 bp, Homo sapiens
atttggcctgcactaattt

SEQ ID NO: 4602677 - DNA, 23 bp, Homo sapiens
atttgggcctgctccagacctga

SEQ ID NO: 4602678 - DNA, 17 bp, Homo sapiens
atttgggttctgcctgc

SEQ ID NO: 4602679 - DNA, 14 bp, Homo sapiens
atttgtgatacaat

SEQ ID NO: 4602680 - DNA, 20 bp, Homo sapiens
atttgtgatacaatgctgtg

SEQ ID NO: 4602681 - DNA, 22 bp, Homo sapiens
atttgtttgaactgataaagat

SEQ ID NO: 4602682 - DNA, 22 bp, Homo sapiens
attttaacctatgatattttct

SEQ ID NO: 4602683 - DNA, 15 bp, Homo sapiens
attttatatgcttac

SEQ ID NO: 4602684 - DNA, 16 bp, Homo sapiens
attttatatgcttact

SEQ ID NO: 4602685 - DNA, 13 bp, Homo sapiens
attttattatgca

SEQ ID NO: 4602686 - DNA, 18 bp, Homo sapiens
attttccataagctattt

SEQ ID NO: 4602687 - DNA, 23 bp, Homo sapiens
attttcctggtgccaatttcaag

SEQ ID NO: 4602688 - DNA, 14 bp, Homo sapiens
attttccttttcaa

SEQ ID NO: 4602689 - DNA, 18 bp, Homo sapiens
attttgatgtaaagatgt

SEQ ID NO: 4602690 - DNA, 20 bp, Homo sapiens
attttgctttgtgatttttg

SEQ ID NO: 4602691 - DNA, 15 bp, Homo sapiens
attttggtttagtgc

SEQ ID NO: 4602692 - DNA, 14 bp, Homo sapiens
attttgtaataata

SEQ ID NO: 4602693 - DNA, 13 bp, Homo sapiens
atttttaagtgct

SEQ ID NO: 4602694 - DNA, 14 bp, Homo sapiens
atttttttttcata

SEQ ID NO: 4602695 - DNA, 16 bp, Homo sapiens
atttttttttcataca

SEQ ID NO: 4602696 - DNA, 20 bp, Homo sapiens
atttttttttcatacactta

SEQ ID NO: 4602697 - DNA, 20 bp, Homo sapiens
caaaaaaaaaaaaaaattag

SEQ ID NO: 4602698 - DNA, 15 bp, Homo sapiens
caaaacaaaggccta

SEQ ID NO: 4602699 - DNA, 15 bp, Homo sapiens
caaaaggcagaagca

SEQ ID NO: 4602700 - DNA, 21 bp, Homo sapiens
caaaaggtattttaatcacca

SEQ ID NO: 4602701 - DNA, 18 bp, Homo sapiens
caaaatgttggtcatttt

SEQ ID NO: 4602702 - DNA, 22 bp, Homo sapiens
caaactgaggaatttcacctgt

SEQ ID NO: 4602703 - DNA, 20 bp, Homo sapiens
caaagatctgtcctcagcct

SEQ ID NO: 4602704 - DNA, 20 bp, Homo sapiens
caaagtacactgtttcaaac

SEQ ID NO: 4602705 - DNA, 21 bp, Homo sapiens
caaagtacactgtttcaaact

SEQ ID NO: 4602706 - DNA, 22 bp, Homo sapiens
caaagtacactgtttcaaactt

SEQ ID NO: 4602707 - DNA, 19 bp, Homo sapiens
caaagtatccctactgtaa

SEQ ID NO: 4602708 - DNA, 21 bp, Homo sapiens
caaagtatccctactgtaatt

SEQ ID NO: 4602709 - DNA, 12 bp, Homo sapiens
caaataaagtct

SEQ ID NO: 4602710 - DNA, 21 bp, Homo sapiens
caaatatttagatgtaatttt

SEQ ID NO: 4602711 - DNA, 15 bp, Homo sapiens
caaatggggccagat

SEQ ID NO: 4602712 - DNA, 23 bp, Homo sapiens
caaatggggccagatccagcctg

SEQ ID NO: 4602713 - DNA, 14 bp, Homo sapiens
caaatgttcatcaa

SEQ ID NO: 4602714 - DNA, 20 bp, Homo sapiens
caaatgttcatcaatgaatg

SEQ ID NO: 4602715 - DNA, 15 bp, Homo sapiens
caaatttacagagac

SEQ ID NO: 4602716 - DNA, 11 bp, Homo sapiens
caaatttctaa

SEQ ID NO: 4602717 - DNA, 12 bp, Homo sapiens
caaatttctaaa

SEQ ID NO: 4602718 - DNA, 19 bp, Homo sapiens
caacaacctcaactgccta

SEQ ID NO: 4602719 - DNA, 17 bp, Homo sapiens
caacaatttatgaattg

SEQ ID NO: 4602720 - DNA, 13 bp, Homo sapiens
caacacaaagatt

SEQ ID NO: 4602721 - DNA, 23 bp, Homo sapiens
caacagaagtcatgaagcccaag

SEQ ID NO: 4602722 - DNA, 14 bp, Homo sapiens
caacagatctggaa

SEQ ID NO: 4602723 - DNA, 13 bp, Homo sapiens
ctggaggcccagt

SEQ ID NO: 4602724 - DNA, 15 bp, Homo sapiens
ctggaggcccagttc

SEQ ID NO: 4602725 - DNA, 15 bp, Homo sapiens
ctggagttgatctgg

SEQ ID NO: 4602726 - DNA, 15 bp, Homo sapiens
ctggatgtaccacca

SEQ ID NO: 4602727 - DNA, 23 bp, Homo sapiens
ctggattaaacttaatctaaatg

SEQ ID NO: 4602728 - DNA, 17 bp, Homo sapiens
ctggcagctctggacag

SEQ ID NO: 4602729 - DNA, 22 bp, Homo sapiens
ctggcagtcctggaagccagct

SEQ ID NO: 4602730 - DNA, 12 bp, Homo sapiens
ctggcccagggc

SEQ ID NO: 4602731 - DNA, 13 bp, Homo sapiens
ctggcccagggcc

SEQ ID NO: 4602732 - DNA, 15 bp, Homo sapiens
ctggcccagggccca

SEQ ID NO: 4602733 - DNA, 20 bp, Homo sapiens
ctggcccagggcccagagcc

SEQ ID NO: 4602734 - DNA, 17 bp, Homo sapiens
ctggcccccgacccagc

SEQ ID NO: 4602735 - DNA, 21 bp, Homo sapiens
ctggcccccgacccagctcta

SEQ ID NO: 4602736 - DNA, 14 bp, Homo sapiens
ctggctatgcattt

SEQ ID NO: 4602737 - DNA, 15 bp, Homo sapiens
ctgggcacaggccgt

SEQ ID NO: 4602738 - DNA, 18 bp, Homo sapiens
ctgggcagcatagcaaga

SEQ ID NO: 4602739 - DNA, 19 bp, Homo sapiens
ctgggctgctacccagaaa

SEQ ID NO: 4602740 - DNA, 19 bp, Homo sapiens
ctgggcttcatctggcaac

SEQ ID NO: 4602741 - DNA, 17 bp, Homo sapiens
ctgggggataccagctg

SEQ ID NO: 4602742 - DNA, 22 bp, Homo sapiens
ctggggtctggagttgatctgg

SEQ ID NO: 4602743 - DNA, 15 bp, Homo sapiens
ctggggttgccctgg

SEQ ID NO: 4602744 - DNA, 20 bp, Homo sapiens
ctgggtacttcttgaaggtg

SEQ ID NO: 4602745 - DNA, 19 bp, Homo sapiens
ctggtatatccaaaagctt

SEQ ID NO: 4602746 - DNA, 22 bp, Homo sapiens
ctggtccaaaagattgctgaaa

SEQ ID NO: 4602747 - DNA, 16 bp, Homo sapiens
ctggtgccaatttcaa

SEQ ID NO: 4602748 - DNA, 18 bp, Homo sapiens
ctggtgccaatttcaagt

SEQ ID NO: 4602749 - DNA, 20 bp, Homo sapiens
ctggtgccaatttcaagttc

SEQ ID NO: 4602750 - DNA, 12 bp, Homo sapiens
ctggtgcctcac

SEQ ID NO: 4602751 - DNA, 16 bp, Homo sapiens
ctggttccatggcctc

SEQ ID NO: 4602752 - DNA, 14 bp, Homo sapiens
ctgtaaactgtgta

SEQ ID NO: 4602753 - DNA, 14 bp, Homo sapiens
ctgtaatttgtgat

SEQ ID NO: 4602754 - DNA, 22 bp, Homo sapiens
ctgtaatttgtgatacaatgct

SEQ ID NO: 4602755 - DNA, 14 bp, Homo sapiens
ctgtacaacttctg

SEQ ID NO: 4602756 - DNA, 15 bp, Homo sapiens
ctgtacaacttctgg

SEQ ID NO: 4602757 - DNA, 23 bp, Homo sapiens
ctgtacaacttctgggcctctct

SEQ ID NO: 4602758 - DNA, 20 bp, Homo sapiens
ctgtacatgaaaacacattt

SEQ ID NO: 4602759 - DNA, 20 bp, Homo sapiens
ctgtaggttttctgtgttta

SEQ ID NO: 4602760 - DNA, 17 bp, Homo sapiens
ctgtccagctccaacct

SEQ ID NO: 4602761 - DNA, 13 bp, Homo sapiens
ctgtcctcagcct

SEQ ID NO: 4602762 - DNA, 14 bp, Homo sapiens
ctgtcctgggcctg

SEQ ID NO: 4602763 - DNA, 19 bp, Homo sapiens
ctgtctgttgtattcattg

SEQ ID NO: 4602764 - DNA, 16 bp, Homo sapiens
ctgtctttaaggaaaa

SEQ ID NO: 4602765 - DNA, 18 bp, Homo sapiens
ctgtgcgagggggccttg

SEQ ID NO: 4602766 - DNA, 21 bp, Homo sapiens
ctgtggggctaggggctgggg

SEQ ID NO: 4602767 - DNA, 22 bp, Homo sapiens
ctgtggggctaggggctggggc

SEQ ID NO: 4602768 - DNA, 21 bp, Homo sapiens
ctgtgtaaatgctccagcact

SEQ ID NO: 4602769 - DNA, 19 bp, Homo sapiens
ctgtgtacataactgaaaa

SEQ ID NO: 4602770 - DNA, 20 bp, Homo sapiens
ctgtgtacataactgaaaat

SEQ ID NO: 4602771 - DNA, 22 bp, Homo sapiens
ctgtgtacataactgaaaatgt

SEQ ID NO: 4602772 - DNA, 15 bp, Homo sapiens
ctgtgtattccaaga

SEQ ID NO: 4602773 - DNA, 18 bp, Homo sapiens
ctgttacactttttggaa

SEQ ID NO: 4602774 - DNA, 14 bp, Homo sapiens
ctgttatgctgtga

SEQ ID NO: 4602775 - DNA, 15 bp, Homo sapiens
ctgttctttccaaag

SEQ ID NO: 4602776 - DNA, 13 bp, Homo sapiens
ctgttctttctgg

SEQ ID NO: 4602777 - DNA, 14 bp, Homo sapiens
ctgttctttctggc

SEQ ID NO: 4602778 - DNA, 23 bp, Homo sapiens
ctgttctttctggctatgcattt

SEQ ID NO: 4602779 - DNA, 18 bp, Homo sapiens
ctgtttagataatacacc

SEQ ID NO: 4602780 - DNA, 15 bp, Homo sapiens
ctgtttcaaacttta

SEQ ID NO: 4602781 - DNA, 12 bp, Homo sapiens
cttaaaaatggt

SEQ ID NO: 4602782 - DNA, 16 bp, Homo sapiens
cttaaataatgtgaaa

SEQ ID NO: 4602783 - DNA, 15 bp, Homo sapiens
cttaacttcacatat

SEQ ID NO: 4602784 - DNA, 21 bp, Homo sapiens
cttaagttagttccactgaga

SEQ ID NO: 4602785 - DNA, 14 bp, Homo sapiens
cttaatctaaatgg

SEQ ID NO: 4602786 - DNA, 18 bp, Homo sapiens
cttaatgccactaaattg

SEQ ID NO: 4602787 - DNA, 20 bp, Homo sapiens
cttaattcttagctcattct

SEQ ID NO: 4602788 - DNA, 12 bp, Homo sapiens
cttactgatata

SEQ ID NO: 4602789 - DNA, 15 bp, Homo sapiens
cttactgatatattt

SEQ ID NO: 4602790 - DNA, 19 bp, Homo sapiens
cttagggaaggatacaaaa

SEQ ID NO: 4602791 - DNA, 23 bp, Homo sapiens
cttatgatagcaaatggcctcat

SEQ ID NO: 4602792 - DNA, 11 bp, Homo sapiens
cttcagacata

SEQ ID NO: 4602793 - DNA, 23 bp, Homo sapiens
cttcatctggcaacatctttatc

SEQ ID NO: 4602794 - DNA, 21 bp, Homo sapiens
cttccagtcttcctgacactt

SEQ ID NO: 4602795 - DNA, 23 bp, Homo sapiens
cttcccagttcaggagtcccaag

SEQ ID NO: 4602796 - DNA, 17 bp, Homo sapiens
cttccctcaccttggca

SEQ ID NO: 4602797 - DNA, 18 bp, Homo sapiens
cttcctgtccagctccaa

SEQ ID NO: 4602798 - DNA, 17 bp, Homo sapiens
cttcctgtttttcacat

SEQ ID NO: 4602799 - DNA, 18 bp, Homo sapiens
cttcgtttattttcaaga

SEQ ID NO: 4602800 - DNA, 16 bp, Homo sapiens
cttctgagctatttca

SEQ ID NO: 4602801 - DNA, 13 bp, Homo sapiens
cttgaaattttaa

SEQ ID NO: 4602802 - DNA, 19 bp, Homo sapiens
cttgaacccgggaggcaga

SEQ ID NO: 4602803 - DNA, 15 bp, Homo sapiens
cttgaactttgacct

SEQ ID NO: 4602804 - DNA, 17 bp, Homo sapiens
cttgaactttgacctct

SEQ ID NO: 4602805 - DNA, 15 bp, Homo sapiens
cttgagccttgaact

SEQ ID NO: 4602806 - DNA, 22 bp, Homo sapiens
cttgcaaagtatccctactgta

SEQ ID NO: 4602807 - DNA, 21 bp, Homo sapiens
cttgcaagcaacaagctattt

SEQ ID NO: 4602808 - DNA, 21 bp, Homo sapiens
cttgcatggtttagaaagctt

SEQ ID NO: 4602809 - DNA, 11 bp, Homo sapiens
cttgccagaga

SEQ ID NO: 4602810 - DNA, 16 bp, Homo sapiens
cttgccagagatccaa

SEQ ID NO: 4602811 - DNA, 19 bp, Homo sapiens
cttggcaccagacacccag

SEQ ID NO: 4602812 - DNA, 20 bp, Homo sapiens
cttgggagctcatccctctc

SEQ ID NO: 4602813 - DNA, 19 bp, Homo sapiens
cttggggagttaagacctg

SEQ ID NO: 4602814 - DNA, 20 bp, Homo sapiens
cttggggagttaagacctgg

SEQ ID NO: 4602815 - DNA, 20 bp, Homo sapiens
cttggtttgtaaattaactt

SEQ ID NO: 4602816 - DNA, 21 bp, Homo sapiens
cttgtacataatgcgtgcata

SEQ ID NO: 4602817 - DNA, 22 bp, Homo sapiens
cttgtacataatgcgtgcatac

SEQ ID NO: 4602818 - DNA, 16 bp, Homo sapiens
cttgtttaatggtagt

SEQ ID NO: 4602819 - DNA, 15 bp, Homo sapiens
ctttaagaactaaaa

SEQ ID NO: 4602820 - DNA, 21 bp, Homo sapiens
ctttaatgatatgcttgtaac

SEQ ID NO: 4602821 - DNA, 19 bp, Homo sapiens
ctttaccttttttatacat

SEQ ID NO: 4602822 - DNA, 13 bp, Homo sapiens
ctttatatgaaga

SEQ ID NO: 4602823 - DNA, 23 bp, Homo sapiens
ctttatcataaacattttacatg

SEQ ID NO: 4602824 - DNA, 16 bp, Homo sapiens
ctttattggctgagat

SEQ ID NO: 4602825 - DNA, 20 bp, Homo sapiens
ctttcaattgtcacttttta

SEQ ID NO: 4602826 - DNA, 16 bp, Homo sapiens
ctttccaaagtacact

SEQ ID NO: 4602827 - DNA, 22 bp, Homo sapiens
ctttctcagccgcttctgactg

SEQ ID NO: 4602828 - DNA, 16 bp, Homo sapiens
ctttctcagttttcat

SEQ ID NO: 4602829 - DNA, 17 bp, Homo sapiens
ctttctcagttttcata

SEQ ID NO: 4602830 - DNA, 17 bp, Homo sapiens
ctttctccagccctgac

SEQ ID NO: 4602831 - DNA, 20 bp, Homo sapiens
ctttctggctatgcatttga

SEQ ID NO: 4602832 - DNA, 16 bp, Homo sapiens
ctttggacctaatcca

SEQ ID NO: 4602833 - DNA, 20 bp, Homo sapiens
ctttggttaataaataaatg

SEQ ID NO: 4602834 - DNA, 23 bp, Homo sapiens
ctttgtgattcaatctgtaaact

SEQ ID NO: 4602835 - DNA, 18 bp, Homo sapiens
ctttgtgatttttgtaat

SEQ ID NO: 4602836 - DNA, 13 bp, Homo sapiens
cttttaaactgtg

SEQ ID NO: 4602837 - DNA, 15 bp, Homo sapiens
cttttaaactgtgta

SEQ ID NO: 4602838 - DNA, 15 bp, Homo sapiens
cttttataaacttta

SEQ ID NO: 4602839 - DNA, 16 bp, Homo sapiens
cttttcttaaaccttc

SEQ ID NO: 4602840 - DNA, 16 bp, Homo sapiens
cttttgccgttattaa

SEQ ID NO: 4602841 - DNA, 12 bp, Homo sapiens
cttttgttcttg

SEQ ID NO: 4602842 - DNA, 19 bp, Homo sapiens
ctttttaaaaaatgctggg

SEQ ID NO: 4602843 - DNA, 20 bp, Homo sapiens
ctttttaaaaaatgctgggt

SEQ ID NO: 4602844 - DNA, 15 bp, Homo sapiens
ctttttatgctattt

SEQ ID NO: 4602845 - DNA, 15 bp, Homo sapiens
ctttttatttgcatg

SEQ ID NO: 4602846 - DNA, 21 bp, Homo sapiens
ctttttttttttttttgacaa

SEQ ID NO: 4602847 - DNA, 11 bp, Homo sapiens
gaaaaatatta

SEQ ID NO: 4602848 - DNA, 14 bp, Homo sapiens
gaaaacacattttt

SEQ ID NO: 4602849 - DNA, 18 bp, Homo sapiens
gaaaacacatttttctta

SEQ ID NO: 4602850 - DNA, 12 bp, Homo sapiens
gaaaacatgcta

SEQ ID NO: 4602851 - DNA, 16 bp, Homo sapiens
gaaaacatgctacaca

SEQ ID NO: 4602852 - DNA, 18 bp, Homo sapiens
gaaaacatgctacacact

SEQ ID NO: 4602853 - DNA, 15 bp, Homo sapiens
tggagggaaagccag

SEQ ID NO: 4602854 - DNA, 16 bp, Homo sapiens
tggagggaaagccagc

SEQ ID NO: 4602855 - DNA, 19 bp, Homo sapiens
tggagggaaagccagcctg

SEQ ID NO: 4602856 - DNA, 17 bp, Homo sapiens
tggagttgatctggaac

SEQ ID NO: 4602857 - DNA, 19 bp, Homo sapiens
tggagttgatctggaaccc

SEQ ID NO: 4602858 - DNA, 15 bp, Homo sapiens
tggataccattatat

SEQ ID NO: 4602859 - DNA, 23 bp, Homo sapiens
tggatgggggaactcagatccag

SEQ ID NO: 4602860 - DNA, 14 bp, Homo sapiens
tggattcatattta

SEQ ID NO: 4602861 - DNA, 20 bp, Homo sapiens
tggattgtgcctaatgtgtt

SEQ ID NO: 4602862 - DNA, 20 bp, Homo sapiens
tggatttaacagaaatgtac

SEQ ID NO: 4602863 - DNA, 24 bp, Homo sapiens
tggatttaacagaaatgtacagca

SEQ ID NO: 4602864 - DNA, 13 bp, Homo sapiens
tggcaacagatct

SEQ ID NO: 4602865 - DNA, 15 bp, Homo sapiens
tggcaacagatctgg

SEQ ID NO: 4602866 - DNA, 16 bp, Homo sapiens
tggcaacagatctgga

SEQ ID NO: 4602867 - DNA, 22 bp, Homo sapiens
tggcaacagatctggaacctca

SEQ ID NO: 4602868 - DNA, 22 bp, Homo sapiens
tggcaaccttgtctctatgcca

SEQ ID NO: 4602869 - DNA, 18 bp, Homo sapiens
tggcaccactgcactcca

SEQ ID NO: 4602870 - DNA, 19 bp, Homo sapiens
tggcaccactgcactccag

SEQ ID NO: 4602871 - DNA, 17 bp, Homo sapiens
tggcaccagacacccag

SEQ ID NO: 4602872 - DNA, 21 bp, Homo sapiens
tggcaccagacacccaggact

SEQ ID NO: 4602873 - DNA, 23 bp, Homo sapiens
tggcaccagacacccaggactta

SEQ ID NO: 4602874 - DNA, 19 bp, Homo sapiens
tggcacggtggctcaggcc

SEQ ID NO: 4602875 - DNA, 19 bp, Homo sapiens
tggcagaataatctttggg

SEQ ID NO: 4602876 - DNA, 20 bp, Homo sapiens
tggcagaataatctttgggt

SEQ ID NO: 4602877 - DNA, 22 bp, Homo sapiens
tggcagtctgaatttttaaaac

SEQ ID NO: 4602878 - DNA, 18 bp, Homo sapiens
tggccagacacaggccct

SEQ ID NO: 4602879 - DNA, 20 bp, Homo sapiens
tggcccagggcccagagccc

SEQ ID NO: 4602880 - DNA, 20 bp, Homo sapiens
tggcctacccctttctccag

SEQ ID NO: 4602881 - DNA, 16 bp, Homo sapiens
tggcctgcactaattt

SEQ ID NO: 4602882 - DNA, 19 bp, Homo sapiens
tggctgagatatgaacata

SEQ ID NO: 4602883 - DNA, 22 bp, Homo sapiens
tggcttttctggaatggaattg

SEQ ID NO: 4602884 - DNA, 16 bp, Homo sapiens
tggcttttgtgcatta

SEQ ID NO: 4602885 - DNA, 13 bp, Homo sapiens
tgggaaaggggag

SEQ ID NO: 4602886 - DNA, 19 bp, Homo sapiens
tgggaggctgagatgggag

SEQ ID NO: 4602887 - DNA, 12 bp, Homo sapiens
tgggcaacagag

SEQ ID NO: 4602888 - DNA, 17 bp, Homo sapiens
tgggcagattttcagca

SEQ ID NO: 4602889 - DNA, 16 bp, Homo sapiens
tgggcagcatagcaag

SEQ ID NO: 4602890 - DNA, 18 bp, Homo sapiens
tgggcagcatagcaagac

SEQ ID NO: 4602891 - DNA, 18 bp, Homo sapiens
tgggccagacatgccaca

SEQ ID NO: 4602892 - DNA, 19 bp, Homo sapiens
tgggcctgctccagacctg

SEQ ID NO: 4602893 - DNA, 20 bp, Homo sapiens
tgggcctgctccagacctga

SEQ ID NO: 4602894 - DNA, 19 bp, Homo sapiens
tgggctggcagtcctggaa

SEQ ID NO: 4602895 - DNA, 20 bp, Homo sapiens
tggggacagaccagcccttc

SEQ ID NO: 4602896 - DNA, 16 bp, Homo sapiens
tggggccagatccagc

SEQ ID NO: 4602897 - DNA, 19 bp, Homo sapiens
tggggccagatccagcctg

SEQ ID NO: 4602898 - DNA, 19 bp, Homo sapiens
tgggggaacactgagaaag

SEQ ID NO: 4602899 - DNA, 15 bp, Homo sapiens
tgggggtgcatttga

SEQ ID NO: 4602900 - DNA, 18 bp, Homo sapiens
tgggtggaagcctcagag

SEQ ID NO: 4602901 - DNA, 19 bp, Homo sapiens
tgggtggggacagaccagc

SEQ ID NO: 4602902 - DNA, 20 bp, Homo sapiens
tgggtggggacagaccagcc

SEQ ID NO: 4602903 - DNA, 14 bp, Homo sapiens
tgggttctgcctgc

SEQ ID NO: 4602904 - DNA, 19 bp, Homo sapiens
tggtatatccaaaagcttt

SEQ ID NO: 4602905 - DNA, 23 bp, Homo sapiens
tggtattggctagaggttcaaag

SEQ ID NO: 4602906 - DNA, 18 bp, Homo sapiens
tggtcattttatgttaag

SEQ ID NO: 4602907 - DNA, 13 bp, Homo sapiens
tggtcgcccagga

SEQ ID NO: 4602908 - DNA, 15 bp, Homo sapiens
tggtcgcccaggaga

SEQ ID NO: 4602909 - DNA, 17 bp, Homo sapiens
tggtcggaaaacatgct

SEQ ID NO: 4602910 - DNA, 15 bp, Homo sapiens
tggtgccaatttcaa

SEQ ID NO: 4602911 - DNA, 14 bp, Homo sapiens
tggtgccccaggac

SEQ ID NO: 4602912 - DNA, 21 bp, Homo sapiens
tggtgccccaggaccagctca

SEQ ID NO: 4602913 - DNA, 23 bp, Homo sapiens
tggtgggccaacaaagaacacta

SEQ ID NO: 4602914 - DNA, 21 bp, Homo sapiens
tggtttgtaaattaactttta

SEQ ID NO: 4602915 - DNA, 11 bp, Homo sapiens
tgtaaaatggt

SEQ ID NO: 4602916 - DNA, 19 bp, Homo sapiens
tgtaaactgtgtattccaa

SEQ ID NO: 4602917 - DNA, 22 bp, Homo sapiens
tgtaaactgtgtattccaagac

SEQ ID NO: 4602918 - DNA, 15 bp, Homo sapiens
tgtaaataatttatt

SEQ ID NO: 4602919 - DNA, 13 bp, Homo sapiens
tgtaaattaactt

SEQ ID NO: 4602920 - DNA, 16 bp, Homo sapiens
tgtaaattaactttta

SEQ ID NO: 4602921 - DNA, 23 bp, Homo sapiens
tgtaactaaaataattttgtaat

SEQ ID NO: 4602922 - DNA, 14 bp, Homo sapiens
tgtaatttgtgata

SEQ ID NO: 4602923 - DNA, 16 bp, Homo sapiens
tgtaatttgtgataca

SEQ ID NO: 4602924 - DNA, 14 bp, Homo sapiens
tgtacatgaaaaca

SEQ ID NO: 4602925 - DNA, 20 bp, Homo sapiens
tgtacatgaaaacacatttt

SEQ ID NO: 4602926 - DNA, 15 bp, Homo sapiens
tgtattccaagacat

SEQ ID NO: 4602927 - DNA, 21 bp, Homo sapiens
tgtattccaagacatgtctgt

SEQ ID NO: 4602928 - DNA, 19 bp, Homo sapiens
tgtattctctcctgtacct

SEQ ID NO: 4602929 - DNA, 20 bp, Homo sapiens
tgtattctctcctgtacctc

SEQ ID NO: 4602930 - DNA, 22 bp, Homo sapiens
tgtattctctcctgtacctctt

SEQ ID NO: 4602931 - DNA, 12 bp, Homo sapiens
tgtcacttttta

SEQ ID NO: 4602932 - DNA, 22 bp, Homo sapiens
tgtcagttgttatttattgaaa

SEQ ID NO: 4602933 - DNA, 12 bp, Homo sapiens
tgtcctcagcct

SEQ ID NO: 4602934 - DNA, 16 bp, Homo sapiens
tgtcctcagccttgcc

SEQ ID NO: 4602935 - DNA, 14 bp, Homo sapiens
tgtcctgggcctgc

SEQ ID NO: 4602936 - DNA, 17 bp, Homo sapiens
tgtcctgggcctgcaga

SEQ ID NO: 4602937 - DNA, 15 bp, Homo sapiens
tgtcctgtaaaggtt

SEQ ID NO: 4602938 - DNA, 14 bp, Homo sapiens
tgtctattcagctt

SEQ ID NO: 4602939 - DNA, 21 bp, Homo sapiens
tgtctcagtccatgaagatgt

SEQ ID NO: 4602940 - DNA, 15 bp, Homo sapiens
tgtctttaaggaaaa

SEQ ID NO: 4602941 - DNA, 22 bp, Homo sapiens
tgtgaccactgcagaagacagt

SEQ ID NO: 4602942 - DNA, 21 bp, Homo sapiens
tgtgatacaatgctgtgccct

SEQ ID NO: 4602943 - DNA, 14 bp, Homo sapiens
tgtgcattatctag

SEQ ID NO: 4602944 - DNA, 23 bp, Homo sapiens
tgtgcattatctagatactgtat

SEQ ID NO: 4602945 - DNA, 20 bp, Homo sapiens
tgtgccctaaagtgtatttt

SEQ ID NO: 4602946 - DNA, 17 bp, Homo sapiens
tgtgcctaatgtgtttg

SEQ ID NO: 4602947 - DNA, 22 bp, Homo sapiens
tgtggtcaacatttctcatgtt

SEQ ID NO: 4602948 - DNA, 22 bp, Homo sapiens
tgtgttatcacccagaagaaaa

SEQ ID NO: 4602949 - DNA, 19 bp, Homo sapiens
tgtgtttagctatttaata

SEQ ID NO: 4602950 - DNA, 13 bp, Homo sapiens
tgttaatatttta

SEQ ID NO: 4602951 - DNA, 18 bp, Homo sapiens
tgttacactttttggaag

SEQ ID NO: 4602952 - DNA, 16 bp, Homo sapiens
tgttacctactttgac

SEQ ID NO: 4602953 - DNA, 17 bp, Homo sapiens
tgttagtatgaggcatt

SEQ ID NO: 4602954 - DNA, 20 bp, Homo sapiens
tgttagtatgaggcatttgt

SEQ ID NO: 4602955 - DNA, 16 bp, Homo sapiens
tgttcccatttcagct

SEQ ID NO: 4602956 - DNA, 16 bp, Homo sapiens
tgttcttaattcttag

SEQ ID NO: 4602957 - DNA, 20 bp, Homo sapiens
tgttctttccaaagtacact

SEQ ID NO: 4602958 - DNA, 24 bp, Homo sapiens
tgttgaaaggtaatttgagagaaa

SEQ ID NO: 4602959 - DNA, 17 bp, Homo sapiens
tgttgcaagtgcaataa

SEQ ID NO: 4602960 - DNA, 14 bp, Homo sapiens
tgttgtattcattg

SEQ ID NO: 4602961 - DNA, 20 bp, Homo sapiens
tgttgtcaagaatagcattg

SEQ ID NO: 4602962 - DNA, 15 bp, Homo sapiens
tgtttaatggtagtt

SEQ ID NO: 4602963 - DNA, 20 bp, Homo sapiens
tgtttagataatacaccact

SEQ ID NO: 4602964 - DNA, 20 bp, Homo sapiens
tgtttagatgaatgtcagtt

SEQ ID NO: 4602965 - DNA, 20 bp, Homo sapiens
tgtttctttctctgaggaca

SEQ ID NO: 4602966 - DNA, 13 bp, Homo sapiens
aaaaaaagacaag

SEQ ID NO: 4602967 - DNA, 21 bp, Homo sapiens
aaaaaggatgcacagagttgt

SEQ ID NO: 4602968 - DNA, 17 bp, Homo sapiens
aaaaatggtttaaatgg

SEQ ID NO: 4602969 - DNA, 20 bp, Homo sapiens
aaaacataatcttctgcctt

SEQ ID NO: 4602970 - DNA, 17 bp, Homo sapiens
aaaaccactagaactct

SEQ ID NO: 4602971 - DNA, 14 bp, Homo sapiens
aaaagattgctgaa

SEQ ID NO: 4602972 - DNA, 17 bp, Homo sapiens
aaaagccagatgctaga

SEQ ID NO: 4602973 - DNA, 13 bp, Homo sapiens
aaaaggatgcaca

SEQ ID NO: 4602974 - DNA, 14 bp, Homo sapiens
aaaaggatgcacag

SEQ ID NO: 4602975 - DNA, 14 bp, Homo sapiens
aaaataaaactttt

SEQ ID NO: 4602976 - DNA, 17 bp, Homo sapiens
aaaataagaaaaatatt

SEQ ID NO: 4602977 - DNA, 13 bp, Homo sapiens
aaaataattttgt

SEQ ID NO: 4602978 - DNA, 14 bp, Homo sapiens
aaaataattttgta

SEQ ID NO: 4602979 - DNA, 18 bp, Homo sapiens
aaaatagtggtgtgattt

SEQ ID NO: 4602980 - DNA, 13 bp, Homo sapiens
aaaatatagctaa

SEQ ID NO: 4602981 - DNA, 22 bp, Homo sapiens
aaaatggaggccattgtgtgag

SEQ ID NO: 4602982 - DNA, 18 bp, Homo sapiens
aaaatggtttaaatggtc

SEQ ID NO: 4602983 - DNA, 21 bp, Homo sapiens
aaaatgttggtcattttatgt

SEQ ID NO: 4602984 - DNA, 14 bp, Homo sapiens
aaaattagaaattg

SEQ ID NO: 4602985 - DNA, 18 bp, Homo sapiens
aaacaagaccacgtttct

SEQ ID NO: 4602986 - DNA, 17 bp, Homo sapiens
aaacagatttggaaaga

SEQ ID NO: 4602987 - DNA, 20 bp, Homo sapiens
aaacatccttcaagaactct

SEQ ID NO: 4602988 - DNA, 16 bp, Homo sapiens
aaacatgctacacact

SEQ ID NO: 4602989 - DNA, 11 bp, Homo sapiens
aaactaatcca

SEQ ID NO: 4602990 - DNA, 16 bp, Homo sapiens
aaactatttaacattc

SEQ ID NO: 4602991 - DNA, 22 bp, Homo sapiens
aaactctgttacactttttgga

SEQ ID NO: 4602992 - DNA, 19 bp, Homo sapiens
aaactctgttgcaagtgca

SEQ ID NO: 4602993 - DNA, 20 bp, Homo sapiens
aaactctgttgcaagtgcaa

SEQ ID NO: 4602994 - DNA, 21 bp, Homo sapiens
aaactgtgtacataactgaaa

SEQ ID NO: 4602995 - DNA, 17 bp, Homo sapiens
aaacttaatctaaatgg

SEQ ID NO: 4602996 - DNA, 18 bp, Homo sapiens
aaacttaatctaaatgga

SEQ ID NO: 4602997 - DNA, 22 bp, Homo sapiens
aaactttaccttttttatacat

SEQ ID NO: 4602998 - DNA, 12 bp, Homo sapiens
aaactttactat

SEQ ID NO: 4602999 - DNA, 23 bp, Homo sapiens
aaagaaccaacaacctcaactgc

SEQ ID NO: 4603000 - DNA, 16 bp, Homo sapiens
aaagaagcccccagct

SEQ ID NO: 4603001 - DNA, 16 bp, Homo sapiens
aaagaatagaagctaa

SEQ ID NO: 4603002 - DNA, 23 bp, Homo sapiens
aaagactgagtacgttgtgcatt

SEQ ID NO: 4603003 - DNA, 18 bp, Homo sapiens
aaagaggtcgcttgggaa

SEQ ID NO: 4603004 - DNA, 19 bp, Homo sapiens
aaagatctgtcctcagcct

SEQ ID NO: 4603005 - DNA, 20 bp, Homo sapiens
aaagatgagctttgtctact

SEQ ID NO: 4603006 - DNA, 16 bp, Homo sapiens
aaagatgttctggata

SEQ ID NO: 4603007 - DNA, 22 bp, Homo sapiens
aaagattctgaccttaaatgca

SEQ ID NO: 4603008 - DNA, 23 bp, Homo sapiens
aaagattgaagtattttgctgga

SEQ ID NO: 4603009 - DNA, 16 bp, Homo sapiens
aaagcagaacagtgat

SEQ ID NO: 4603010 - DNA, 14 bp, Homo sapiens
aaagcatgaatggt

SEQ ID NO: 4603011 - DNA, 13 bp, Homo sapiens
aaagcattttgta

SEQ ID NO: 4603012 - DNA, 20 bp, Homo sapiens
aaagccagatgctagagcct

SEQ ID NO: 4603013 - DNA, 20 bp, Homo sapiens
aaagccagcctgggggctgg

SEQ ID NO: 4603014 - DNA, 17 bp, Homo sapiens
aaaggcaaccaataaaa

SEQ ID NO: 4603015 - DNA, 10 bp, Homo sapiens
aaaggggagt

SEQ ID NO: 4603016 - DNA, 20 bp, Homo sapiens
aaagtacactgtttcaaact

SEQ ID NO: 4603017 - DNA, 21 bp, Homo sapiens
aaagtatccctactgtaattt

SEQ ID NO: 4603018 - DNA, 20 bp, Homo sapiens
aaagtctgttgattaaagat

SEQ ID NO: 4603019 - DNA, 21 bp, Homo sapiens
aaagtgtatttttttactaat

SEQ ID NO: 4603020 - DNA, 23 bp, Homo sapiens
aaagttctgcagataaacagtag

SEQ ID NO: 4603021 - DNA, 13 bp, Homo sapiens
aaataaaactttt

SEQ ID NO: 4603022 - DNA, 11 bp, Homo sapiens
aaataaagtct

SEQ ID NO: 4603023 - DNA, 13 bp, Homo sapiens
aaataatgtgaaa

SEQ ID NO: 4603024 - DNA, 12 bp, Homo sapiens
aaataattttgt

SEQ ID NO: 4603025 - DNA, 20 bp, Homo sapiens
aaataccagccagtaaatgg

SEQ ID NO: 4603026 - DNA, 19 bp, Homo sapiens
aaatagtggtgtgatttgg

SEQ ID NO: 4603027 - DNA, 22 bp, Homo sapiens
aaatatcccttggacattttat

SEQ ID NO: 4603028 - DNA, 17 bp, Homo sapiens
aaatatgaagaactgag

SEQ ID NO: 4603029 - DNA, 23 bp, Homo sapiens
aaatcaattactggtccaaaaga

SEQ ID NO: 4603030 - DNA, 20 bp, Homo sapiens
aaatctgacccagtgccccc

SEQ ID NO: 4603031 - DNA, 22 bp, Homo sapiens
aaatgctccagcactcaataaa

SEQ ID NO: 4603032 - DNA, 22 bp, Homo sapiens
aaatggggccagatccagcctg

SEQ ID NO: 4603033 - DNA, 16 bp, Homo sapiens
aaatggtcgcccagga

SEQ ID NO: 4603034 - DNA, 18 bp, Homo sapiens
aaatggtcgcccaggaga

SEQ ID NO: 4603035 - DNA, 13 bp, Homo sapiens
aaatgttcatcaa

SEQ ID NO: 4603036 - DNA, 21 bp, Homo sapiens
aaattaacttttataaacttt

SEQ ID NO: 4603037 - DNA, 22 bp, Homo sapiens
aaattgacacttaaaaatggtt

SEQ ID NO: 4603038 - DNA, 13 bp, Homo sapiens
aaatttctaaatc

SEQ ID NO: 4603039 - DNA, 19 bp, Homo sapiens
aaatttctaaatctccaaa

SEQ ID NO: 4603040 - DNA, 12 bp, Homo sapiens
aaattttatatg

SEQ ID NO: 4603041 - DNA, 16 bp, Homo sapiens
aacaagaccacgtttc

SEQ ID NO: 4603042 - DNA, 22 bp, Homo sapiens
aacaagacctcagtgccttcct

SEQ ID NO: 4603043 - DNA, 16 bp, Homo sapiens
aacaatttatgaattg

SEQ ID NO: 4603044 - DNA, 19 bp, Homo sapiens
aacacatttttcttaggga

SEQ ID NO: 4603045 - DNA, 18 bp, Homo sapiens
aacactaactatgcatgg

SEQ ID NO: 4603046 - DNA, 10 bp, Homo sapiens
aacagaaatg

SEQ ID NO: 4603047 - DNA, 13 bp, Homo sapiens
aacagaaatgtac

SEQ ID NO: 4603048 - DNA, 12 bp, Homo sapiens
aacagaggatat

SEQ ID NO: 4603049 - DNA, 13 bp, Homo sapiens
aacagatctggaa

SEQ ID NO: 4603050 - DNA, 22 bp, Homo sapiens
aacagatctggaacctcagcct

SEQ ID NO: 4603051 - DNA, 15 bp, Homo sapiens
aacagatttggaaag

SEQ ID NO: 4603052 - DNA, 22 bp, Homo sapiens
aacataatcttctgccttctca

SEQ ID NO: 4603053 - DNA, 22 bp, Homo sapiens
aacatgctacacactgcatgtt

SEQ ID NO: 4603054 - DNA, 16 bp, Homo sapiens
aacattgtagcctcaa

SEQ ID NO: 4603055 - DNA, 14 bp, Homo sapiens
aaccacggaaaaga

SEQ ID NO: 4603056 - DNA, 21 bp, Homo sapiens
aaccagggccccggggcctgt

SEQ ID NO: 4603057 - DNA, 22 bp, Homo sapiens
aaccagtccccccaccctcatt

SEQ ID NO: 4603058 - DNA, 19 bp, Homo sapiens
aaccagtgttgtggattta

SEQ ID NO: 4603059 - DNA, 23 bp, Homo sapiens
aacccaaatgttcatcaatgaat

SEQ ID NO: 4603060 - DNA, 14 bp, Homo sapiens
aatgacttactgta

SEQ ID NO: 4603061 - DNA, 18 bp, Homo sapiens
aatgacttactgtacatg

SEQ ID NO: 4603062 - DNA, 15 bp, Homo sapiens
aatgaggtcagcatg

SEQ ID NO: 4603063 - DNA, 16 bp, Homo sapiens
aatgaggtcccaggca

SEQ ID NO: 4603064 - DNA, 17 bp, Homo sapiens
aatgcaaccatttgaaa

SEQ ID NO: 4603065 - DNA, 10 bp, Homo sapiens
aatgctgggt

SEQ ID NO: 4603066 - DNA, 20 bp, Homo sapiens
aatgctgtgccctaaagtgt

SEQ ID NO: 4603067 - DNA, 17 bp, Homo sapiens
aatggaggccattgtgt

SEQ ID NO: 4603068 - DNA, 13 bp, Homo sapiens
aatggggccagat

SEQ ID NO: 4603069 - DNA, 17 bp, Homo sapiens
aatgggggtgcatttga

SEQ ID NO: 4603070 - DNA, 16 bp, Homo sapiens
aatggtttaaatggtc

SEQ ID NO: 4603071 - DNA, 21 bp, Homo sapiens
aatgtacagcaaggagattta

SEQ ID NO: 4603072 - DNA, 18 bp, Homo sapiens
aatgtatcaaatacattt

SEQ ID NO: 4603073 - DNA, 19 bp, Homo sapiens
aatgtcagttgttatttat

SEQ ID NO: 4603074 - DNA, 15 bp, Homo sapiens
aatgtgaaactggat

SEQ ID NO: 4603075 - DNA, 18 bp, Homo sapiens
aatgtgctatactgcata

SEQ ID NO: 4603076 - DNA, 20 bp, Homo sapiens
aatgttcatcaatgaatgaa

SEQ ID NO: 4603077 - DNA, 18 bp, Homo sapiens
aattaacttttataaact

SEQ ID NO: 4603078 - DNA, 22 bp, Homo sapiens
aattaacttttataaactttac

SEQ ID NO: 4603079 - DNA, 17 bp, Homo sapiens
aattattgatgttttca

SEQ ID NO: 4603080 - DNA, 22 bp, Homo sapiens
aattccacttataggaattgac

SEQ ID NO: 4603081 - DNA, 19 bp, Homo sapiens
aattctgctctaaataaag

SEQ ID NO: 4603082 - DNA, 21 bp, Homo sapiens
aattctgctctaaataaagac

SEQ ID NO: 4603083 - DNA, 20 bp, Homo sapiens
aattcttgcaaagtatccct

SEQ ID NO: 4603084 - DNA, 13 bp, Homo sapiens
aattgacccacaa

SEQ ID NO: 4603085 - DNA, 18 bp, Homo sapiens
aatttacagagacagaaa

SEQ ID NO: 4603086 - DNA, 21 bp, Homo sapiens
aatttatgaattgaattatct

SEQ ID NO: 4603087 - DNA, 13 bp, Homo sapiens
aatttattatggc

SEQ ID NO: 4603088 - DNA, 20 bp, Homo sapiens
aatttcacctgtaaacctga

SEQ ID NO: 4603089 - DNA, 12 bp, Homo sapiens
aatttcccagga

SEQ ID NO: 4603090 - DNA, 16 bp, Homo sapiens
aatttcccaggaccct

SEQ ID NO: 4603091 - DNA, 22 bp, Homo sapiens
aatttctaaaaaacagaggcca

SEQ ID NO: 4603092 - DNA, 17 bp, Homo sapiens
aatttcttggtaagaag

SEQ ID NO: 4603093 - DNA, 20 bp, Homo sapiens
aatttcttggtaagaagccg

SEQ ID NO: 4603094 - DNA, 17 bp, Homo sapiens
aatttgtgatacaatgc

SEQ ID NO: 4603095 - DNA, 20 bp, Homo sapiens
aatttgtgatacaatgctgt

SEQ ID NO: 4603096 - DNA, 19 bp, Homo sapiens
aattttccataagctattt

SEQ ID NO: 4603097 - DNA, 12 bp, Homo sapiens
aattttctttca

SEQ ID NO: 4603098 - DNA, 17 bp, Homo sapiens
aattttgtgtaagaaat

SEQ ID NO: 4603099 - DNA, 18 bp, Homo sapiens
aattttgtgtaagaaata

SEQ ID NO: 4603100 - DNA, 18 bp, Homo sapiens
aattttttatcatgcatg

SEQ ID NO: 4603101 - DNA, 20 bp, Homo sapiens
aattttttatcatgcatgtc

SEQ ID NO: 4603102 - DNA, 20 bp, Homo sapiens
aatttttttccttacctttt

SEQ ID NO: 4603103 - DNA, 13 bp, Homo sapiens
acaacagaagtca

SEQ ID NO: 4603104 - DNA, 16 bp, Homo sapiens
acaacctcaactgcct

SEQ ID NO: 4603105 - DNA, 16 bp, Homo sapiens
acaagaaatgaaagca

SEQ ID NO: 4603106 - DNA, 16 bp, Homo sapiens
acaagaccacgtttct

SEQ ID NO: 4603107 - DNA, 17 bp, Homo sapiens
acaagaccacgtttcta

SEQ ID NO: 4603108 - DNA, 16 bp, Homo sapiens
acaaggatagatgctg

SEQ ID NO: 4603109 - DNA, 22 bp, Homo sapiens
acaaggatagatgctggcccag

SEQ ID NO: 4603110 - DNA, 12 bp, Homo sapiens
acaatgacttac

SEQ ID NO: 4603111 - DNA, 18 bp, Homo sapiens
acaatgacttactgtaca

SEQ ID NO: 4603112 - DNA, 19 bp, Homo sapiens
acaatgacttactgtacat

SEQ ID NO: 4603113 - DNA, 23 bp, Homo sapiens
acaatgctgtgccctaaagtgta

SEQ ID NO: 4603114 - DNA, 13 bp, Homo sapiens
acaatttattatg

SEQ ID NO: 4603115 - DNA, 14 bp, Homo sapiens
acaatttattatgg

SEQ ID NO: 4603116 - DNA, 15 bp, Homo sapiens
acaatttattatggc

SEQ ID NO: 4603117 - DNA, 22 bp, Homo sapiens
acaattttttatcatgcatgtc

SEQ ID NO: 4603118 - DNA, 19 bp, Homo sapiens
acacaaggatagatgctgg

SEQ ID NO: 4603119 - DNA, 21 bp, Homo sapiens
acacactgcatgtttgtgatt

SEQ ID NO: 4603120 - DNA, 19 bp, Homo sapiens
acacattttattttattat

SEQ ID NO: 4603121 - DNA, 21 bp, Homo sapiens
acacattttattttattatgc

SEQ ID NO: 4603122 - DNA, 12 bp, Homo sapiens
acacatttttct

SEQ ID NO: 4603123 - DNA, 19 bp, Homo sapiens
acacattttttaaatgcac

SEQ ID NO: 4603124 - DNA, 15 bp, Homo sapiens
acaccactacattct

SEQ ID NO: 4603125 - DNA, 20 bp, Homo sapiens
acaccactacattctgttaa

SEQ ID NO: 4603126 - DNA, 19 bp, Homo sapiens
acaccggtaccctcctccc

SEQ ID NO: 4603127 - DNA, 12 bp, Homo sapiens
acactgagaaag

SEQ ID NO: 4603128 - DNA, 18 bp, Homo sapiens
acactgtttcaaacttta

SEQ ID NO: 4603129 - DNA, 23 bp, Homo sapiens
acactgtttcaaactttactatg

SEQ ID NO: 4603130 - DNA, 13 bp, Homo sapiens
acagaaagctgcc

SEQ ID NO: 4603131 - DNA, 14 bp, Homo sapiens
acagaaatgtacag

SEQ ID NO: 4603132 - DNA, 14 bp, Homo sapiens
acagacaacagaag

SEQ ID NO: 4603133 - DNA, 16 bp, Homo sapiens
acagaccagcccttcc

SEQ ID NO: 4603134 - DNA, 16 bp, Homo sapiens
acagaggacacagaga

SEQ ID NO: 4603135 - DNA, 17 bp, Homo sapiens
acagaggccccagcctc

SEQ ID NO: 4603136 - DNA, 19 bp, Homo sapiens
acagagttgttacattttt

SEQ ID NO: 4603137 - DNA, 18 bp, Homo sapiens
acagatgccacacaagga

SEQ ID NO: 4603138 - DNA, 14 bp, Homo sapiens
acagatttggaaag

SEQ ID NO: 4603139 - DNA, 21 bp, Homo sapiens
acagatttggaaagactggac

SEQ ID NO: 4603140 - DNA, 16 bp, Homo sapiens
acagcaaggagattta

SEQ ID NO: 4603141 - DNA, 14 bp, Homo sapiens
acagcatcctctct

SEQ ID NO: 4603142 - DNA, 13 bp, Homo sapiens
acagccccaccct

SEQ ID NO: 4603143 - DNA, 14 bp, Homo sapiens
acagctcattaaac

SEQ ID NO: 4603144 - DNA, 23 bp, Homo sapiens
acaggccctccctgttccccaga

SEQ ID NO: 4603145 - DNA, 16 bp, Homo sapiens
acagtcatggtggcca

SEQ ID NO: 4603146 - DNA, 21 bp, Homo sapiens
acagtcatggtggccacggcc

SEQ ID NO: 4603147 - DNA, 18 bp, Homo sapiens
acagtgagactctgtctc

SEQ ID NO: 4603148 - DNA, 18 bp, Homo sapiens
acagtgcagcaagcctgg

SEQ ID NO: 4603149 - DNA, 22 bp, Homo sapiens
acagttggagggaaagccagcc

SEQ ID NO: 4603150 - DNA, 20 bp, Homo sapiens
acataactgaaaatgtgcta

SEQ ID NO: 4603151 - DNA, 22 bp, Homo sapiens
acataatgcgtgcataccactt

SEQ ID NO: 4603152 - DNA, 13 bp, Homo sapiens
acatactaaccag

SEQ ID NO: 4603153 - DNA, 20 bp, Homo sapiens
acatacttgaagggccagag

SEQ ID NO: 4603154 - DNA, 22 bp, Homo sapiens
acatacttgaagggccagagcc

SEQ ID NO: 4603155 - DNA, 23 bp, Homo sapiens
acatacttgaagggccagagcca

SEQ ID NO: 4603156 - DNA, 14 bp, Homo sapiens
acatagaattaaca

SEQ ID NO: 4603157 - DNA, 19 bp, Homo sapiens
acatcagcacgatttctgt

SEQ ID NO: 4603158 - DNA, 21 bp, Homo sapiens
acatcagcacgatttctgttt

SEQ ID NO: 4603159 - DNA, 23 bp, Homo sapiens
acatccctacaaaaaattagaaa

SEQ ID NO: 4603160 - DNA, 13 bp, Homo sapiens
acatctgttttgt

SEQ ID NO: 4603161 - DNA, 15 bp, Homo sapiens
acatgaaaacacatt

SEQ ID NO: 4603162 - DNA, 23 bp, Homo sapiens
acatgaaaacacatttttcttag

SEQ ID NO: 4603163 - DNA, 20 bp, Homo sapiens
acatgaggtactgagagtga

SEQ ID NO: 4603164 - DNA, 18 bp, Homo sapiens
acatgcaaggtcattttt

SEQ ID NO: 4603165 - DNA, 19 bp, Homo sapiens
acatgcaaggtcatttttt

SEQ ID NO: 4603166 - DNA, 14 bp, Homo sapiens
acatgccacaagga

SEQ ID NO: 4603167 - DNA, 13 bp, Homo sapiens
acattaaagttaa

SEQ ID NO: 4603168 - DNA, 12 bp, Homo sapiens
acattctgttaa

SEQ ID NO: 4603169 - DNA, 14 bp, Homo sapiens
acattttacatgca

SEQ ID NO: 4603170 - DNA, 13 bp, Homo sapiens
acattttatgtct

SEQ ID NO: 4603171 - DNA, 15 bp, Homo sapiens
acatttttaagtgct

SEQ ID NO: 4603172 - DNA, 19 bp, Homo sapiens
accaccaactactacctgt

SEQ ID NO: 4603173 - DNA, 17 bp, Homo sapiens
accactacattctgtta

SEQ ID NO: 4603174 - DNA, 13 bp, Homo sapiens
accactagaactc

SEQ ID NO: 4603175 - DNA, 18 bp, Homo sapiens
accactgcactccagcct

SEQ ID NO: 4603176 - DNA, 14 bp, Homo sapiens
accactgcagaaga

SEQ ID NO: 4603177 - DNA, 15 bp, Homo sapiens
accactggcctaccc

SEQ ID NO: 4603178 - DNA, 15 bp, Homo sapiens
accacttttgttctt

SEQ ID NO: 4603179 - DNA, 16 bp, Homo sapiens
accacttttgttcttg

SEQ ID NO: 4603180 - DNA, 22 bp, Homo sapiens
accacttttgttcttggtttgt

SEQ ID NO: 4603181 - DNA, 16 bp, Homo sapiens
accagacacccaggac

SEQ ID NO: 4603182 - DNA, 13 bp, Homo sapiens
accagcagaaatg

SEQ ID NO: 4603183 - DNA, 14 bp, Homo sapiens
accagcctgggcag

SEQ ID NO: 4603184 - DNA, 15 bp, Homo sapiens
accagctcaggacag

SEQ ID NO: 4603185 - DNA, 15 bp, Homo sapiens
accagtgttgtggat

SEQ ID NO: 4603186 - DNA, 17 bp, Homo sapiens
accagtgttgtggattt

SEQ ID NO: 4603187 - DNA, 21 bp, Homo sapiens
accagtgttgtggatttaaca

SEQ ID NO: 4603188 - DNA, 16 bp, Homo sapiens
acccaaatgttcatca

SEQ ID NO: 4603189 - DNA, 21 bp, Homo sapiens
acccaaatgttcatcaatgaa

SEQ ID NO: 4603190 - DNA, 17 bp, Homo sapiens
agaaaggggagcccact

SEQ ID NO: 4603191 - DNA, 15 bp, Homo sapiens
agaaatgccttaccc

SEQ ID NO: 4603192 - DNA, 16 bp, Homo sapiens
agaaccagtcccccca

SEQ ID NO: 4603193 - DNA, 20 bp, Homo sapiens
agaacctggaacttggggag

SEQ ID NO: 4603194 - DNA, 17 bp, Homo sapiens
agaactaaaatgttcta

SEQ ID NO: 4603195 - DNA, 19 bp, Homo sapiens
agaactcaaatggggccag

SEQ ID NO: 4603196 - DNA, 14 bp, Homo sapiens
agaactctgggctg

SEQ ID NO: 4603197 - DNA, 19 bp, Homo sapiens
agaagcaacccaaatgttc

SEQ ID NO: 4603198 - DNA, 13 bp, Homo sapiens
agaagccaggaat

SEQ ID NO: 4603199 - DNA, 14 bp, Homo sapiens
agaagcccccagct

SEQ ID NO: 4603200 - DNA, 14 bp, Homo sapiens
agaagccgggaaca

SEQ ID NO: 4603201 - DNA, 22 bp, Homo sapiens
agaagccgggaacagacaacag

SEQ ID NO: 4603202 - DNA, 18 bp, Homo sapiens
agaagctcctctccccag

SEQ ID NO: 4603203 - DNA, 22 bp, Homo sapiens
agaagctcctctccccagccca

SEQ ID NO: 4603204 - DNA, 9 bp, Homo sapiens
agaaggaag

SEQ ID NO: 4603205 - DNA, 13 bp, Homo sapiens
agaagtcatgaag

SEQ ID NO: 4603206 - DNA, 20 bp, Homo sapiens
agaagtcatgaagcccaagt

SEQ ID NO: 4603207 - DNA, 21 bp, Homo sapiens
agaagtcttctatttatttat

SEQ ID NO: 4603208 - DNA, 17 bp, Homo sapiens
agaataatcacgctttc

SEQ ID NO: 4603209 - DNA, 16 bp, Homo sapiens
agaataatctttgggt

SEQ ID NO: 4603210 - DNA, 21 bp, Homo sapiens
agaatttcttggtaagaagcc

SEQ ID NO: 4603211 - DNA, 22 bp, Homo sapiens
agaatttcttggtaagaagccg

SEQ ID NO: 4603212 - DNA, 13 bp, Homo sapiens
agacaatgactta

SEQ ID NO: 4603213 - DNA, 21 bp, Homo sapiens
agacaatgacttactgtacat

SEQ ID NO: 4603214 - DNA, 21 bp, Homo sapiens
agacaatttattatggcacat

SEQ ID NO: 4603215 - DNA, 13 bp, Homo sapiens
agacacaggccct

SEQ ID NO: 4603216 - DNA, 13 bp, Homo sapiens
agacacccaggac

SEQ ID NO: 4603217 - DNA, 15 bp, Homo sapiens
agacacccaggactt

SEQ ID NO: 4603218 - DNA, 19 bp, Homo sapiens
agacatactaaccagcaga

SEQ ID NO: 4603219 - DNA, 14 bp, Homo sapiens
agacatacttgaag

SEQ ID NO: 4603220 - DNA, 16 bp, Homo sapiens
agacatacttgaaggg

SEQ ID NO: 4603221 - DNA, 20 bp, Homo sapiens
agacatacttgaagggccag

SEQ ID NO: 4603222 - DNA, 18 bp, Homo sapiens
agacatcaacagataaat

SEQ ID NO: 4603223 - DNA, 23 bp, Homo sapiens
agacatgccacaaggacttcctg

SEQ ID NO: 4603224 - DNA, 18 bp, Homo sapiens
agacatgtctgttctaca

SEQ ID NO: 4603225 - DNA, 14 bp, Homo sapiens
agaccaaggcggga

SEQ ID NO: 4603226 - DNA, 17 bp, Homo sapiens
agaccaaggcgggagca

SEQ ID NO: 4603227 - DNA, 23 bp, Homo sapiens
agaccaaggcgggagcatctctt

SEQ ID NO: 4603228 - DNA, 17 bp, Homo sapiens
agaccagcccttcccca

SEQ ID NO: 4603229 - DNA, 20 bp, Homo sapiens
agacctcagtgccttcctgt

SEQ ID NO: 4603230 - DNA, 19 bp, Homo sapiens
agacctgatcctggaggcc

SEQ ID NO: 4603231 - DNA, 21 bp, Homo sapiens
agacctgatcctggaggccca

SEQ ID NO: 4603232 - DNA, 22 bp, Homo sapiens
agacctgatcctggaggcccag

SEQ ID NO: 4603233 - DNA, 11 bp, Homo sapiens
agacctggcag

SEQ ID NO: 4603234 - DNA, 14 bp, Homo sapiens
agacctggcagctc

SEQ ID NO: 4603235 - DNA, 15 bp, Homo sapiens
agacctggcagctct

SEQ ID NO: 4603236 - DNA, 11 bp, Homo sapiens
agacgactaca

SEQ ID NO: 4603237 - DNA, 19 bp, Homo sapiens
agactcccattcctgaaga

SEQ ID NO: 4603238 - DNA, 19 bp, Homo sapiens
agagaaaggggagcccact

SEQ ID NO: 4603239 - DNA, 14 bp, Homo sapiens
agagaaatatgaag

SEQ ID NO: 4603240 - DNA, 13 bp, Homo sapiens
agaggaatgaagt

SEQ ID NO: 4603241 - DNA, 23 bp, Homo sapiens
agaggccatggcagaataatctt

SEQ ID NO: 4603242 - DNA, 16 bp, Homo sapiens
agaggccccagcctcc

SEQ ID NO: 4603243 - DNA, 10 bp, Homo sapiens
agaggctcag

SEQ ID NO: 4603244 - DNA, 19 bp, Homo sapiens
agagggagaagggatggag

SEQ ID NO: 4603245 - DNA, 13 bp, Homo sapiens
agaggttcaaaga

SEQ ID NO: 4603246 - DNA, 22 bp, Homo sapiens
agagtgaacaaatttacagaga

SEQ ID NO: 4603247 - DNA, 19 bp, Homo sapiens
agagttagtttctttggga

SEQ ID NO: 4603248 - DNA, 16 bp, Homo sapiens
agagttgttacatttt

SEQ ID NO: 4603249 - DNA, 19 bp, Homo sapiens
agagttgttacatttttaa

SEQ ID NO: 4603250 - DNA, 13 bp, Homo sapiens
agataactaggaa

SEQ ID NO: 4603251 - DNA, 20 bp, Homo sapiens
agatatttttatctttatat

SEQ ID NO: 4603252 - DNA, 23 bp, Homo sapiens
agatccaaaagaagcccccagct

SEQ ID NO: 4603253 - DNA, 19 bp, Homo sapiens
agatccagggacagaggcc

SEQ ID NO: 4603254 - DNA, 14 bp, Homo sapiens
agatctggaacctc

SEQ ID NO: 4603255 - DNA, 17 bp, Homo sapiens
agatctggaacctcagc

SEQ ID NO: 4603256 - DNA, 20 bp, Homo sapiens
agatctggaacctcagcctg

SEQ ID NO: 4603257 - DNA, 15 bp, Homo sapiens
agatctgtcctcagc

SEQ ID NO: 4603258 - DNA, 14 bp, Homo sapiens
agatgagtgagcat

SEQ ID NO: 4603259 - DNA, 14 bp, Homo sapiens
agatgctggcccag

SEQ ID NO: 4603260 - DNA, 19 bp, Homo sapiens
agatgctggcccagggccc

SEQ ID NO: 4603261 - DNA, 20 bp, Homo sapiens
agatgctggcccagggccca

SEQ ID NO: 4603262 - DNA, 23 bp, Homo sapiens
agatgctggcccagggcccagag

SEQ ID NO: 4603263 - DNA, 17 bp, Homo sapiens
agatgtaattttgtgta

SEQ ID NO: 4603264 - DNA, 13 bp, Homo sapiens
agattaagaaata

SEQ ID NO: 4603265 - DNA, 22 bp, Homo sapiens
agattgctgaaattttatatgc

SEQ ID NO: 4603266 - DNA, 20 bp, Homo sapiens
agcaaatggcctcatgtcaa

SEQ ID NO: 4603267 - DNA, 17 bp, Homo sapiens
agcaaggagatttacaa

SEQ ID NO: 4603268 - DNA, 22 bp, Homo sapiens
agcaatttcgccgttgaagagg

SEQ ID NO: 4603269 - DNA, 18 bp, Homo sapiens
agcacccatcatgccaca

SEQ ID NO: 4603270 - DNA, 21 bp, Homo sapiens
agcacgatttctgtttagata

SEQ ID NO: 4603271 - DNA, 14 bp, Homo sapiens
agcactcaataaag

SEQ ID NO: 4603272 - DNA, 12 bp, Homo sapiens
agcagaaatgcc

SEQ ID NO: 4603273 - DNA, 19 bp, Homo sapiens
agcagaaatgccttaccct

SEQ ID NO: 4603274 - DNA, 18 bp, Homo sapiens
agcagcgtttctatgaca

SEQ ID NO: 4603275 - DNA, 18 bp, Homo sapiens
agcatacgtacacatttt

SEQ ID NO: 4603276 - DNA, 19 bp, Homo sapiens
agcatacgtacacatttta

SEQ ID NO: 4603277 - DNA, 20 bp, Homo sapiens
agcatacgtacacattttat

SEQ ID NO: 4603278 - DNA, 21 bp, Homo sapiens
agcatacgtacacattttatt

SEQ ID NO: 4603279 - DNA, 17 bp, Homo sapiens
agcatctcttgaggcca

SEQ ID NO: 4603280 - DNA, 17 bp, Homo sapiens
agcatgtctattcagct

SEQ ID NO: 4603281 - DNA, 15 bp, Homo sapiens
agccactcaggaggc

SEQ ID NO: 4603282 - DNA, 11 bp, Homo sapiens
agccagcctgg

SEQ ID NO: 4603283 - DNA, 16 bp, Homo sapiens
agccagctttccctgc

SEQ ID NO: 4603284 - DNA, 18 bp, Homo sapiens
agccagctttccctgcct

SEQ ID NO: 4603285 - DNA, 23 bp, Homo sapiens
agccaggaatttcccaggaccct

SEQ ID NO: 4603286 - DNA, 21 bp, Homo sapiens
agccagtaaatgggggtgcat

SEQ ID NO: 4603287 - DNA, 23 bp, Homo sapiens
agccagtaaatgggggtgcattt

SEQ ID NO: 4603288 - DNA, 17 bp, Homo sapiens
agcccactgtcctgggc

SEQ ID NO: 4603289 - DNA, 23 bp, Homo sapiens
agcccactgtcctgggcctgcag

SEQ ID NO: 4603290 - DNA, 10 bp, Homo sapiens
agcccagaga

SEQ ID NO: 4603291 - DNA, 12 bp, Homo sapiens
agcccagagaca

SEQ ID NO: 4603292 - DNA, 21 bp, Homo sapiens
agcccagagacatacttgaag

SEQ ID NO: 4603293 - DNA, 12 bp, Homo sapiens
agcccagctcca

SEQ ID NO: 4603294 - DNA, 18 bp, Homo sapiens
agcccatggcactctatg

SEQ ID NO: 4603295 - DNA, 19 bp, Homo sapiens
agccccagcttatctcctc

SEQ ID NO: 4603296 - DNA, 12 bp, Homo sapiens
agcccccagcta

SEQ ID NO: 4603297 - DNA, 22 bp, Homo sapiens
agcccccagctaagaacctgga

SEQ ID NO: 4603298 - DNA, 18 bp, Homo sapiens
agcctcaaaacaaaggcc

SEQ ID NO: 4603299 - DNA, 15 bp, Homo sapiens
agcctcagaggcctt

SEQ ID NO: 4603300 - DNA, 15 bp, Homo sapiens
agcctccctgaagcc

SEQ ID NO: 4603301 - DNA, 16 bp, Homo sapiens
agcctccctgaagcct

SEQ ID NO: 4603302 - DNA, 18 bp, Homo sapiens
agcctggccagacacagg

SEQ ID NO: 4603303 - DNA, 22 bp, Homo sapiens
agcctggccagacacaggccct

SEQ ID NO: 4603304 - DNA, 18 bp, Homo sapiens
agcctgggcaacagagca

SEQ ID NO: 4603305 - DNA, 13 bp, Homo sapiens
agccttgaacttt

SEQ ID NO: 4603306 - DNA, 19 bp, Homo sapiens
agccttgccagagatccaa

SEQ ID NO: 4603307 - DNA, 17 bp, Homo sapiens
agcgacagtgagactct

SEQ ID NO: 4603308 - DNA, 13 bp, Homo sapiens
agctaagaacctg

SEQ ID NO: 4603309 - DNA, 11 bp, Homo sapiens
agctatttaat

SEQ ID NO: 4603310 - DNA, 23 bp, Homo sapiens
agctcacttctgggcttcatctg

SEQ ID NO: 4603311 - DNA, 13 bp, Homo sapiens
agctcagtcccat

SEQ ID NO: 4603312 - DNA, 15 bp, Homo sapiens
agctcatccctctca

SEQ ID NO: 4603313 - DNA, 16 bp, Homo sapiens
agctcattaaactttt

SEQ ID NO: 4603314 - DNA, 19 bp, Homo sapiens
agctcattaaactttttta

SEQ ID NO: 4603315 - DNA, 20 bp, Homo sapiens
agctcattctccttgtgtta

SEQ ID NO: 4603316 - DNA, 17 bp, Homo sapiens
agctcctctccccagcc

SEQ ID NO: 4603317 - DNA, 23 bp, Homo sapiens
agctctgaagtcacatcacagga

SEQ ID NO: 4603318 - DNA, 18 bp, Homo sapiens
agctctggacagccccac

SEQ ID NO: 4603319 - DNA, 21 bp, Homo sapiens
agctctggacagccccaccct

SEQ ID NO: 4603320 - DNA, 12 bp, Homo sapiens
ataatacaccac

SEQ ID NO: 4603321 - DNA, 21 bp, Homo sapiens
ataatacaccactacattctg

SEQ ID NO: 4603322 - DNA, 15 bp, Homo sapiens
ataatcttctgcctt

SEQ ID NO: 4603323 - DNA, 21 bp, Homo sapiens
ataatgcgtgcataccacttt

SEQ ID NO: 4603324 - DNA, 18 bp, Homo sapiens
ataatgtgaaactggatt

SEQ ID NO: 4603325 - DNA, 19 bp, Homo sapiens
ataatgtgaaactggatta

SEQ ID NO: 4603326 - DNA, 21 bp, Homo sapiens
ataatgtgaaactggattaaa

SEQ ID NO: 4603327 - DNA, 23 bp, Homo sapiens
ataattttgtaatgtatcaaata

SEQ ID NO: 4603328 - DNA, 12 bp, Homo sapiens
atacaaaagcat

SEQ ID NO: 4603329 - DNA, 14 bp, Homo sapiens
atacaatgctgtgc

SEQ ID NO: 4603330 - DNA, 15 bp, Homo sapiens
atacaccactacatt

SEQ ID NO: 4603331 - DNA, 17 bp, Homo sapiens
atacaccactacattct

SEQ ID NO: 4603332 - DNA, 20 bp, Homo sapiens
atacaccactacattctgtt

SEQ ID NO: 4603333 - DNA, 21 bp, Homo sapiens
atacaccactacattctgtta

SEQ ID NO: 4603334 - DNA, 14 bp, Homo sapiens
ataccttttttaga

SEQ ID NO: 4603335 - DNA, 13 bp, Homo sapiens
atactacagtttg

SEQ ID NO: 4603336 - DNA, 20 bp, Homo sapiens
atactacagtttgttagtat

SEQ ID NO: 4603337 - DNA, 16 bp, Homo sapiens
atactcattaggatgg

SEQ ID NO: 4603338 - DNA, 20 bp, Homo sapiens
atacttgaagggccagagcc

SEQ ID NO: 4603339 - DNA, 21 bp, Homo sapiens
atacttgaagggccagagcca

SEQ ID NO: 4603340 - DNA, 22 bp, Homo sapiens
atacttgaagggccagagccag

SEQ ID NO: 4603341 - DNA, 17 bp, Homo sapiens
atagaattaacacatga

SEQ ID NO: 4603342 - DNA, 16 bp, Homo sapiens
atagatgctggcccag

SEQ ID NO: 4603343 - DNA, 15 bp, Homo sapiens
atagcagcttattca

SEQ ID NO: 4603344 - DNA, 18 bp, Homo sapiens
atagcagcttattcacaa

SEQ ID NO: 4603345 - DNA, 21 bp, Homo sapiens
ataggaattgacccacaagaa

SEQ ID NO: 4603346 - DNA, 17 bp, Homo sapiens
atagggctgagctctct

SEQ ID NO: 4603347 - DNA, 12 bp, Homo sapiens
ataggttatttt

SEQ ID NO: 4603348 - DNA, 15 bp, Homo sapiens
atagtggtgtgattt

SEQ ID NO: 4603349 - DNA, 15 bp, Homo sapiens
atagttttactttta

SEQ ID NO: 4603350 - DNA, 23 bp, Homo sapiens
atagttttacttttaaactgtgt

SEQ ID NO: 4603351 - DNA, 16 bp, Homo sapiens
atataggaacttaaat

SEQ ID NO: 4603352 - DNA, 23 bp, Homo sapiens
atatcccttggacattttatgtc

SEQ ID NO: 4603353 - DNA, 14 bp, Homo sapiens
atatgcacacattt

SEQ ID NO: 4603354 - DNA, 16 bp, Homo sapiens
atatgcacacattttt

SEQ ID NO: 4603355 - DNA, 18 bp, Homo sapiens
atatgtagtataaagaaa

SEQ ID NO: 4603356 - DNA, 22 bp, Homo sapiens
atattgatttccgttaaaatac

SEQ ID NO: 4603357 - DNA, 14 bp, Homo sapiens
atattgtgattctg

SEQ ID NO: 4603358 - DNA, 18 bp, Homo sapiens
atatttttttcttttctt

SEQ ID NO: 4603359 - DNA, 14 bp, Homo sapiens
atcaaatacattta

SEQ ID NO: 4603360 - DNA, 14 bp, Homo sapiens
atcaacagataaat

SEQ ID NO: 4603361 - DNA, 13 bp, Homo sapiens
atcaagtattata

SEQ ID NO: 4603362 - DNA, 18 bp, Homo sapiens
atcacagtggccacggcc

SEQ ID NO: 4603363 - DNA, 16 bp, Homo sapiens
atcactttctcagttt

SEQ ID NO: 4603364 - DNA, 20 bp, Homo sapiens
atcactttctcagttttcat

SEQ ID NO: 4603365 - DNA, 17 bp, Homo sapiens
atcagagttgctgcaaa

SEQ ID NO: 4603366 - DNA, 16 bp, Homo sapiens
atcagcacgatttctg

SEQ ID NO: 4603367 - DNA, 17 bp, Homo sapiens
atcagcacgatttctgt

SEQ ID NO: 4603368 - DNA, 19 bp, Homo sapiens
atcagcacgatttctgttt

SEQ ID NO: 4603369 - DNA, 14 bp, Homo sapiens
atcataaacatttt

SEQ ID NO: 4603370 - DNA, 21 bp, Homo sapiens
atcatagtttgctttgtttaa

SEQ ID NO: 4603371 - DNA, 12 bp, Homo sapiens
atccagcctggg

SEQ ID NO: 4603372 - DNA, 22 bp, Homo sapiens
atccaggactatatttgggcct

SEQ ID NO: 4603373 - DNA, 16 bp, Homo sapiens
atccaggcagatccag

SEQ ID NO: 4603374 - DNA, 19 bp, Homo sapiens
atccaggcagatccaggac

SEQ ID NO: 4603375 - DNA, 19 bp, Homo sapiens
atccctcccccccatgcac

SEQ ID NO: 4603376 - DNA, 21 bp, Homo sapiens
atccctcccccccatgcactg

SEQ ID NO: 4603377 - DNA, 22 bp, Homo sapiens
atccctcccccccatgcactgt

SEQ ID NO: 4603378 - DNA, 15 bp, Homo sapiens
atccctctcacccag

SEQ ID NO: 4603379 - DNA, 16 bp, Homo sapiens
atcctgcaattccact

SEQ ID NO: 4603380 - DNA, 16 bp, Homo sapiens
atcctggaggcccagt

SEQ ID NO: 4603381 - DNA, 20 bp, Homo sapiens
atctagaggagggggcaggc

SEQ ID NO: 4603382 - DNA, 23 bp, Homo sapiens
atctatttttggcagtctgaatt

SEQ ID NO: 4603383 - DNA, 20 bp, Homo sapiens
atctccaaaataaaactttt

SEQ ID NO: 4603384 - DNA, 22 bp, Homo sapiens
atctccatactgtttctttctt

SEQ ID NO: 4603385 - DNA, 13 bp, Homo sapiens
atctgacccagtg

SEQ ID NO: 4603386 - DNA, 18 bp, Homo sapiens
atctggaacccagactca

SEQ ID NO: 4603387 - DNA, 23 bp, Homo sapiens
atctggaacccagactcagacat

SEQ ID NO: 4603388 - DNA, 11 bp, Homo sapiens
atctggaacct

SEQ ID NO: 4603389 - DNA, 17 bp, Homo sapiens
atctggaacctcagcct

SEQ ID NO: 4603390 - DNA, 13 bp, Homo sapiens
atctgtaaactgt

SEQ ID NO: 4603391 - DNA, 14 bp, Homo sapiens
atctgtaaactgtg

SEQ ID NO: 4603392 - DNA, 14 bp, Homo sapiens
atctgtcctcagcc

SEQ ID NO: 4603393 - DNA, 18 bp, Homo sapiens
atcttctgccttctcatg

SEQ ID NO: 4603394 - DNA, 15 bp, Homo sapiens
atgaagaactgagga

SEQ ID NO: 4603395 - DNA, 18 bp, Homo sapiens
atgaagttgattcatatt

SEQ ID NO: 4603396 - DNA, 20 bp, Homo sapiens
atgaagttgattcatattgc

SEQ ID NO: 4603397 - DNA, 13 bp, Homo sapiens
atgaatgaatggc

SEQ ID NO: 4603398 - DNA, 15 bp, Homo sapiens
atgacaggcctgtcc

SEQ ID NO: 4603399 - DNA, 14 bp, Homo sapiens
atgaggcatttgtt

SEQ ID NO: 4603400 - DNA, 21 bp, Homo sapiens
atgaggcatttgtttgaactg

SEQ ID NO: 4603401 - DNA, 22 bp, Homo sapiens
atgaggcatttgtttgaactga

SEQ ID NO: 4603402 - DNA, 15 bp, Homo sapiens
atgaggtactgagag

SEQ ID NO: 4603403 - DNA, 18 bp, Homo sapiens
atgaggtactgagagtga

SEQ ID NO: 4603404 - DNA, 17 bp, Homo sapiens
atgaggtcccaggcaga

SEQ ID NO: 4603405 - DNA, 13 bp, Homo sapiens
atgatttcacagt

SEQ ID NO: 4603406 - DNA, 21 bp, Homo sapiens
atgatttttttttcatacact

SEQ ID NO: 4603407 - DNA, 14 bp, Homo sapiens
atgcacacattttt

SEQ ID NO: 4603408 - DNA, 15 bp, Homo sapiens
atgcacacatttttt

SEQ ID NO: 4603409 - DNA, 23 bp, Homo sapiens
atgcacacattttttaaatgcac

SEQ ID NO: 4603410 - DNA, 19 bp, Homo sapiens
atgcacagagttgttacat

SEQ ID NO: 4603411 - DNA, 22 bp, Homo sapiens
atgcacagagttgttacatttt

SEQ ID NO: 4603412 - DNA, 13 bp, Homo sapiens
atgcacctggaat

SEQ ID NO: 4603413 - DNA, 14 bp, Homo sapiens
atgcacctggaata

SEQ ID NO: 4603414 - DNA, 16 bp, Homo sapiens
atgcacctggaatata

SEQ ID NO: 4603415 - DNA, 18 bp, Homo sapiens
atgcactgtgaaggaccc

SEQ ID NO: 4603416 - DNA, 16 bp, Homo sapiens
atgcatggtgccccag

SEQ ID NO: 4603417 - DNA, 21 bp, Homo sapiens
atgcatggtgccccaggacca

SEQ ID NO: 4603418 - DNA, 22 bp, Homo sapiens
atgcatggtgccccaggaccag

SEQ ID NO: 4603419 - DNA, 16 bp, Homo sapiens
atgccacaaggacttc

SEQ ID NO: 4603420 - DNA, 15 bp, Homo sapiens
atgccactaaattga

SEQ ID NO: 4603421 - DNA, 19 bp, Homo sapiens
atgccagctcagtcccatc

SEQ ID NO: 4603422 - DNA, 17 bp, Homo sapiens
atgcgtgtttctgactc

SEQ ID NO: 4603423 - DNA, 18 bp, Homo sapiens
atgctacacactgcatgt

SEQ ID NO: 4603424 - DNA, 14 bp, Homo sapiens
atgctagagcctct

SEQ ID NO: 4603425 - DNA, 23 bp, Homo sapiens
atgctggcccagggcccagagcc

SEQ ID NO: 4603426 - DNA, 19 bp, Homo sapiens
atgctgtgccctaaagtgt

SEQ ID NO: 4603427 - DNA, 13 bp, Homo sapiens
atgcttgtacata

SEQ ID NO: 4603428 - DNA, 22 bp, Homo sapiens
atggatatagttttacttttaa

SEQ ID NO: 4603429 - DNA, 15 bp, Homo sapiens
atggcaacagatctg

SEQ ID NO: 4603430 - DNA, 23 bp, Homo sapiens
atggcacatcagcacgatttctg

SEQ ID NO: 4603431 - DNA, 18 bp, Homo sapiens
atggcctcttcagatctc

SEQ ID NO: 4603432 - DNA, 17 bp, Homo sapiens
atggggaggacaaaatg

SEQ ID NO: 4603433 - DNA, 19 bp, Homo sapiens
atggggccagatccagcct

SEQ ID NO: 4603434 - DNA, 21 bp, Homo sapiens
atggggccagatccagcctgg

SEQ ID NO: 4603435 - DNA, 22 bp, Homo sapiens
atggggccagatccagcctggg

SEQ ID NO: 4603436 - DNA, 21 bp, Homo sapiens
atggtagttttacagtgtttc

SEQ ID NO: 4603437 - DNA, 15 bp, Homo sapiens
atggtcgcccaggag

SEQ ID NO: 4603438 - DNA, 22 bp, Homo sapiens
atggtgccccaggaccagctca

SEQ ID NO: 4603439 - DNA, 14 bp, Homo sapiens
atggttttaaactt

SEQ ID NO: 4603440 - DNA, 14 bp, Homo sapiens
atgtaaagatattt

SEQ ID NO: 4603441 - DNA, 21 bp, Homo sapiens
atgtaaagatatttttatctt

SEQ ID NO: 4603442 - DNA, 16 bp, Homo sapiens
atgtaattttgtgtaa

SEQ ID NO: 4603443 - DNA, 22 bp, Homo sapiens
atgtaattttgtgtaagaaata

SEQ ID NO: 4603444 - DNA, 19 bp, Homo sapiens
atgtagataacaagacctc

SEQ ID NO: 4603445 - DNA, 19 bp, Homo sapiens
atgtcaaatatttagatgt

SEQ ID NO: 4603446 - DNA, 19 bp, Homo sapiens
atgtcaggaacagaaggat

SEQ ID NO: 4603447 - DNA, 14 bp, Homo sapiens
atgtctgttctaca

SEQ ID NO: 4603448 - DNA, 18 bp, Homo sapiens
atgttcatcaatgaatga

SEQ ID NO: 4603449 - DNA, 19 bp, Homo sapiens
atgttcatcaatgaatgaa

SEQ ID NO: 4603450 - DNA, 14 bp, Homo sapiens
caaatttacagaga

SEQ ID NO: 4603451 - DNA, 22 bp, Homo sapiens
caacagaagtcatgaagcccaa

SEQ ID NO: 4603452 - DNA, 17 bp, Homo sapiens
caacagatctggaacct

SEQ ID NO: 4603453 - DNA, 19 bp, Homo sapiens
caaccagggccccggggcc

SEQ ID NO: 4603454 - DNA, 19 bp, Homo sapiens
caacccaaatgttcatcaa

SEQ ID NO: 4603455 - DNA, 20 bp, Homo sapiens
caacctgttacctactttga

SEQ ID NO: 4603456 - DNA, 23 bp, Homo sapiens
caacctgttacctactttgactt

SEQ ID NO: 4603457 - DNA, 19 bp, Homo sapiens
caactcgctttaggtcagc

SEQ ID NO: 4603458 - DNA, 14 bp, Homo sapiens
caactgcctactcc

SEQ ID NO: 4603459 - DNA, 15 bp, Homo sapiens
caactgcctactcca

SEQ ID NO: 4603460 - DNA, 22 bp, Homo sapiens
caactgcctactccaaaatgtt

SEQ ID NO: 4603461 - DNA, 23 bp, Homo sapiens
caacttcccagttcaggagtccc

SEQ ID NO: 4603462 - DNA, 18 bp, Homo sapiens
caacttctgggcctctct

SEQ ID NO: 4603463 - DNA, 14 bp, Homo sapiens
caagaactctgggc

SEQ ID NO: 4603464 - DNA, 15 bp, Homo sapiens
caagacatgtctgtt

SEQ ID NO: 4603465 - DNA, 19 bp, Homo sapiens
caagatcctgtctttaagg

SEQ ID NO: 4603466 - DNA, 23 bp, Homo sapiens
caagcctgcacaataaaaatgtt

SEQ ID NO: 4603467 - DNA, 18 bp, Homo sapiens
caaggaggggctgtaaaa

SEQ ID NO: 4603468 - DNA, 17 bp, Homo sapiens
caaggatagaagtatac

SEQ ID NO: 4603469 - DNA, 17 bp, Homo sapiens
caaggatagatgctggc

SEQ ID NO: 4603470 - DNA, 14 bp, Homo sapiens
caaggtcatttttt

SEQ ID NO: 4603471 - DNA, 22 bp, Homo sapiens
caagtattataccttttttaga

SEQ ID NO: 4603472 - DNA, 13 bp, Homo sapiens
caataaaaatgtt

SEQ ID NO: 4603473 - DNA, 17 bp, Homo sapiens
caataaatctgacccag

SEQ ID NO: 4603474 - DNA, 18 bp, Homo sapiens
caataaatctgacccagt

SEQ ID NO: 4603475 - DNA, 20 bp, Homo sapiens
caataaatctgacccagtgc

SEQ ID NO: 4603476 - DNA, 16 bp, Homo sapiens
caatctggattcatat

SEQ ID NO: 4603477 - DNA, 11 bp, Homo sapiens
caatgaaatga

SEQ ID NO: 4603478 - DNA, 22 bp, Homo sapiens
caatgctgtgccctaaagtgta

SEQ ID NO: 4603479 - DNA, 14 bp, Homo sapiens
caatgtcaggaaca

SEQ ID NO: 4603480 - DNA, 16 bp, Homo sapiens
caatgtcaggaacaga

SEQ ID NO: 4603481 - DNA, 19 bp, Homo sapiens
caatgtcaggaacagaagg

SEQ ID NO: 4603482 - DNA, 17 bp, Homo sapiens
caattactggtccaaaa

SEQ ID NO: 4603483 - DNA, 20 bp, Homo sapiens
caatttattatggcacatca

SEQ ID NO: 4603484 - DNA, 20 bp, Homo sapiens
caattttttaagtgaaaata

SEQ ID NO: 4603485 - DNA, 21 bp, Homo sapiens
caattttttaagtgaaaatat

SEQ ID NO: 4603486 - DNA, 21 bp, Homo sapiens
caattttttatcatgcatgtc

SEQ ID NO: 4603487 - DNA, 20 bp, Homo sapiens
cacaagaaatgaaagcaggg

SEQ ID NO: 4603488 - DNA, 21 bp, Homo sapiens
cacaagaaatgaaagcaggga

SEQ ID NO: 4603489 - DNA, 16 bp, Homo sapiens
cacaaggacttcctgt

SEQ ID NO: 4603490 - DNA, 22 bp, Homo sapiens
cacaaggatagatgctggccca

SEQ ID NO: 4603491 - DNA, 17 bp, Homo sapiens
cacaaggtgcaaatcaa

SEQ ID NO: 4603492 - DNA, 19 bp, Homo sapiens
cacacaaggatagatgctg

SEQ ID NO: 4603493 - DNA, 11 bp, Homo sapiens
cacacattttt

SEQ ID NO: 4603494 - DNA, 18 bp, Homo sapiens
cacagacatactaaccag

SEQ ID NO: 4603495 - DNA, 15 bp, Homo sapiens
cacagaggacacaga

SEQ ID NO: 4603496 - DNA, 16 bp, Homo sapiens
cacagagttgttacat

SEQ ID NO: 4603497 - DNA, 14 bp, Homo sapiens
cacagctgagaggc

SEQ ID NO: 4603498 - DNA, 15 bp, Homo sapiens
cacaggaagtagagg

SEQ ID NO: 4603499 - DNA, 19 bp, Homo sapiens
cacagtcatggtggccacg

SEQ ID NO: 4603500 - DNA, 12 bp, Homo sapiens
cacagtgcagca

SEQ ID NO: 4603501 - DNA, 22 bp, Homo sapiens
cacagtggccaagatcacagtg

SEQ ID NO: 4603502 - DNA, 13 bp, Homo sapiens
cacagtggccacg

SEQ ID NO: 4603503 - DNA, 21 bp, Homo sapiens
cacagtgtgtggtcaacattt

SEQ ID NO: 4603504 - DNA, 18 bp, Homo sapiens
cacagttctttgggccag

SEQ ID NO: 4603505 - DNA, 20 bp, Homo sapiens
cacagttctttgggccagac

SEQ ID NO: 4603506 - DNA, 22 bp, Homo sapiens
cacataccctcttcatggatgg

SEQ ID NO: 4603507 - DNA, 22 bp, Homo sapiens
cacatataaatgtactttttct

SEQ ID NO: 4603508 - DNA, 17 bp, Homo sapiens
cacattttattttatta

SEQ ID NO: 4603509 - DNA, 20 bp, Homo sapiens
cacattttattttattatgc

SEQ ID NO: 4603510 - DNA, 13 bp, Homo sapiens
cacatttttctta

SEQ ID NO: 4603511 - DNA, 18 bp, Homo sapiens
caccaactactacctgta

SEQ ID NO: 4603512 - DNA, 17 bp, Homo sapiens
caccactacattctgtt

SEQ ID NO: 4603513 - DNA, 19 bp, Homo sapiens
caccactacattctgttaa

SEQ ID NO: 4603514 - DNA, 13 bp, Homo sapiens
caccactgcactc

SEQ ID NO: 4603515 - DNA, 17 bp, Homo sapiens
caccctcattctactga

SEQ ID NO: 4603516 - DNA, 18 bp, Homo sapiens
caccctgcctctacccaa

SEQ ID NO: 4603517 - DNA, 12 bp, Homo sapiens
caccctgggagc

SEQ ID NO: 4603518 - DNA, 15 bp, Homo sapiens
caccctggtgggcca

SEQ ID NO: 4603519 - DNA, 14 bp, Homo sapiens
cacctgtaaacctg

SEQ ID NO: 4603520 - DNA, 16 bp, Homo sapiens
cacctgtaaacctgag

SEQ ID NO: 4603521 - DNA, 13 bp, Homo sapiens
cactacattctgt

SEQ ID NO: 4603522 - DNA, 17 bp, Homo sapiens
cactacattctgttaat

SEQ ID NO: 4603523 - DNA, 16 bp, Homo sapiens
cactagcccaatgaaa

SEQ ID NO: 4603524 - DNA, 20 bp, Homo sapiens
cactcaggaggctgaggcag

SEQ ID NO: 4603525 - DNA, 21 bp, Homo sapiens
cactccagtgagacagctctg

SEQ ID NO: 4603526 - DNA, 13 bp, Homo sapiens
cactgaccagaac

SEQ ID NO: 4603527 - DNA, 15 bp, Homo sapiens
cactgaccagaacta

SEQ ID NO: 4603528 - DNA, 12 bp, Homo sapiens
cactgatgctgc

SEQ ID NO: 4603529 - DNA, 16 bp, Homo sapiens
cactgcactccagcct

SEQ ID NO: 4603530 - DNA, 16 bp, Homo sapiens
cactgcatgtttgtga

SEQ ID NO: 4603531 - DNA, 15 bp, Homo sapiens
cactggcctacccct

SEQ ID NO: 4603532 - DNA, 13 bp, Homo sapiens
cactgtgaaggac

SEQ ID NO: 4603533 - DNA, 15 bp, Homo sapiens
cactgtgaaggaccc

SEQ ID NO: 4603534 - DNA, 21 bp, Homo sapiens
cacttattggaactctgcttg

SEQ ID NO: 4603535 - DNA, 17 bp, Homo sapiens
cagaaatgtgttatcac

SEQ ID NO: 4603536 - DNA, 17 bp, Homo sapiens
cagaacagtgattacca

SEQ ID NO: 4603537 - DNA, 19 bp, Homo sapiens
cagaagcaacccaaatgtt

SEQ ID NO: 4603538 - DNA, 19 bp, Homo sapiens
cagaagtcatgaagcccaa

SEQ ID NO: 4603539 - DNA, 15 bp, Homo sapiens
cagaattctctagtt

SEQ ID NO: 4603540 - DNA, 15 bp, Homo sapiens
cagacaacagaagtc

SEQ ID NO: 4603541 - DNA, 17 bp, Homo sapiens
cagacaacagaagtcat

SEQ ID NO: 4603542 - DNA, 22 bp, Homo sapiens
cagacaacagaagtcatgaagc

SEQ ID NO: 4603543 - DNA, 15 bp, Homo sapiens
cagacacaggccctc

SEQ ID NO: 4603544 - DNA, 13 bp, Homo sapiens
cagacacccagga

SEQ ID NO: 4603545 - DNA, 14 bp, Homo sapiens
cagacacccaggac

SEQ ID NO: 4603546 - DNA, 19 bp, Homo sapiens
cagacatactaaccagcag

SEQ ID NO: 4603547 - DNA, 18 bp, Homo sapiens
cagacatgccacaaggac

SEQ ID NO: 4603548 - DNA, 14 bp, Homo sapiens
cagacctgatcctg

SEQ ID NO: 4603549 - DNA, 19 bp, Homo sapiens
cagagaatcatacttagca

SEQ ID NO: 4603550 - DNA, 17 bp, Homo sapiens
cagagacatacttgaag

SEQ ID NO: 4603551 - DNA, 20 bp, Homo sapiens
cagagacatacttgaagggc

SEQ ID NO: 4603552 - DNA, 19 bp, Homo sapiens
cagagatccaaaagaagcc

SEQ ID NO: 4603553 - DNA, 20 bp, Homo sapiens
cagagatccaaaagaagccc

SEQ ID NO: 4603554 - DNA, 23 bp, Homo sapiens
cagagatccaaaagaagccccca

SEQ ID NO: 4603555 - DNA, 15 bp, Homo sapiens
cagaggacacagaga

SEQ ID NO: 4603556 - DNA, 16 bp, Homo sapiens
cagaggccccagcctc

SEQ ID NO: 4603557 - DNA, 18 bp, Homo sapiens
cagaggccttgggagctc

SEQ ID NO: 4603558 - DNA, 16 bp, Homo sapiens
cagaggttgcagtgag

SEQ ID NO: 4603559 - DNA, 14 bp, Homo sapiens
cagagttgttacat

SEQ ID NO: 4603560 - DNA, 23 bp, Homo sapiens
cagataaatagtttatgattcca

SEQ ID NO: 4603561 - DNA, 14 bp, Homo sapiens
cagatccagggaca

SEQ ID NO: 4603562 - DNA, 15 bp, Homo sapiens
cagatccagggacag

SEQ ID NO: 4603563 - DNA, 15 bp, Homo sapiens
cagatctggaacctc

SEQ ID NO: 4603564 - DNA, 21 bp, Homo sapiens
cagatctggaacctcagcctg

SEQ ID NO: 4603565 - DNA, 22 bp, Homo sapiens
cagatctggaacctcagcctgg

SEQ ID NO: 4603566 - DNA, 23 bp, Homo sapiens
cagatctggaacctcagcctggc

SEQ ID NO: 4603567 - DNA, 17 bp, Homo sapiens
cagatgctagagcctct

SEQ ID NO: 4603568 - DNA, 21 bp, Homo sapiens
cagatgctagagcctctgcct

SEQ ID NO: 4603569 - DNA, 18 bp, Homo sapiens
cagcaaggagatttacaa

SEQ ID NO: 4603570 - DNA, 19 bp, Homo sapiens
cagcacgatttctgtttag

SEQ ID NO: 4603571 - DNA, 10 bp, Homo sapiens
cagcactaac

SEQ ID NO: 4603572 - DNA, 19 bp, Homo sapiens
cagcagaaatgccttaccc

SEQ ID NO: 4603573 - DNA, 18 bp, Homo sapiens
cagcatgtctattcagct

SEQ ID NO: 4603574 - DNA, 22 bp, Homo sapiens
cagccagtaaatgggggtgcat

SEQ ID NO: 4603575 - DNA, 13 bp, Homo sapiens
cagcccagagaca

SEQ ID NO: 4603576 - DNA, 19 bp, Homo sapiens
cagcctgagcgacagtgag

SEQ ID NO: 4603577 - DNA, 22 bp, Homo sapiens
cagcctgagcgacagtgagact

SEQ ID NO: 4603578 - DNA, 13 bp, Homo sapiens
cagcctggccaga

SEQ ID NO: 4603579 - DNA, 14 bp, Homo sapiens
cagcctggccagac

SEQ ID NO: 4603580 - DNA, 15 bp, Homo sapiens
catttgctttggaag

SEQ ID NO: 4603581 - DNA, 21 bp, Homo sapiens
catttgtttctttctctgagg

SEQ ID NO: 4603582 - DNA, 22 bp, Homo sapiens
catttgtttctttctctgagga

SEQ ID NO: 4603583 - DNA, 16 bp, Homo sapiens
cattttgtaataataa

SEQ ID NO: 4603584 - DNA, 23 bp, Homo sapiens
catttttcttagggaaggataca

SEQ ID NO: 4603585 - DNA, 16 bp, Homo sapiens
cattttttaaatgcac

SEQ ID NO: 4603586 - DNA, 22 bp, Homo sapiens
ccaaaagattgctgaaatttta

SEQ ID NO: 4603587 - DNA, 21 bp, Homo sapiens
ccaaaataaaactttttaaaa

SEQ ID NO: 4603588 - DNA, 17 bp, Homo sapiens
ccaaatgttcatcaatg

SEQ ID NO: 4603589 - DNA, 19 bp, Homo sapiens
ccaactaatgccttactct

SEQ ID NO: 4603590 - DNA, 17 bp, Homo sapiens
ccaagatcacagtggcc

SEQ ID NO: 4603591 - DNA, 20 bp, Homo sapiens
ccaatattcatagcagctta

SEQ ID NO: 4603592 - DNA, 22 bp, Homo sapiens
ccacaagaaatgaaagcaggga

SEQ ID NO: 4603593 - DNA, 18 bp, Homo sapiens
ccaccctgcctctaccca

SEQ ID NO: 4603594 - DNA, 16 bp, Homo sapiens
ccacctcaggtgactt

SEQ ID NO: 4603595 - DNA, 23 bp, Homo sapiens
ccactaatcaggaggccaggcca

SEQ ID NO: 4603596 - DNA, 11 bp, Homo sapiens
ccactacattc

SEQ ID NO: 4603597 - DNA, 14 bp, Homo sapiens
ccactacattctgt

SEQ ID NO: 4603598 - DNA, 16 bp, Homo sapiens
ccactacattctgtta

SEQ ID NO: 4603599 - DNA, 18 bp, Homo sapiens
ccactacattctgttaat

SEQ ID NO: 4603600 - DNA, 13 bp, Homo sapiens
ccactgaccagaa

SEQ ID NO: 4603601 - DNA, 18 bp, Homo sapiens
ccactgcagaagacagta

SEQ ID NO: 4603602 - DNA, 15 bp, Homo sapiens
ccactgtcctgggcc

SEQ ID NO: 4603603 - DNA, 14 bp, Homo sapiens
ccacttttgttctt

SEQ ID NO: 4603604 - DNA, 21 bp, Homo sapiens
ccacttttgttcttggtttgt

SEQ ID NO: 4603605 - DNA, 22 bp, Homo sapiens
ccacttttgttcttggtttgta

SEQ ID NO: 4603606 - DNA, 17 bp, Homo sapiens
ccagaatccctctaacc

SEQ ID NO: 4603607 - DNA, 14 bp, Homo sapiens
ccagacatcaacag

SEQ ID NO: 4603608 - DNA, 18 bp, Homo sapiens
ccagacctgatcctggag

SEQ ID NO: 4603609 - DNA, 21 bp, Homo sapiens
ccagacctgatcctggaggcc

SEQ ID NO: 4603610 - DNA, 20 bp, Homo sapiens
ccagagaaaggggagcccac

SEQ ID NO: 4603611 - DNA, 17 bp, Homo sapiens
ccagagacatacttgaa

SEQ ID NO: 4603612 - DNA, 20 bp, Homo sapiens
ccagagacatacttgaaggg

SEQ ID NO: 4603613 - DNA, 22 bp, Homo sapiens
ccagagacatacttgaagggcc

SEQ ID NO: 4603614 - DNA, 12 bp, Homo sapiens
ccagagccaggg

SEQ ID NO: 4603615 - DNA, 22 bp, Homo sapiens
ccagagccaggggggtgaggag

SEQ ID NO: 4603616 - DNA, 12 bp, Homo sapiens
ccagagcccagc

SEQ ID NO: 4603617 - DNA, 14 bp, Homo sapiens
ccagatccagcctg

SEQ ID NO: 4603618 - DNA, 15 bp, Homo sapiens
ccagatccagcctgg

SEQ ID NO: 4603619 - DNA, 16 bp, Homo sapiens
ccagatccagcctggg

SEQ ID NO: 4603620 - DNA, 22 bp, Homo sapiens
ccagatgctagagcctctgcct

SEQ ID NO: 4603621 - DNA, 16 bp, Homo sapiens
ccagcactcaataaag

SEQ ID NO: 4603622 - DNA, 16 bp, Homo sapiens
ccagcagaaatgcctt

SEQ ID NO: 4603623 - DNA, 23 bp, Homo sapiens
ccagcccagagacatacttgaag

SEQ ID NO: 4603624 - DNA, 15 bp, Homo sapiens
ccagccctgactaaa

SEQ ID NO: 4603625 - DNA, 15 bp, Homo sapiens
ccagcctccctgaag

SEQ ID NO: 4603626 - DNA, 21 bp, Homo sapiens
ccagcctccctgaagcctttg

SEQ ID NO: 4603627 - DNA, 18 bp, Homo sapiens
ccagcctgggggctggga

SEQ ID NO: 4603628 - DNA, 13 bp, Homo sapiens
ccagcctggggtc

SEQ ID NO: 4603629 - DNA, 19 bp, Homo sapiens
ccagctaagaacctggaac

SEQ ID NO: 4603630 - DNA, 19 bp, Homo sapiens
ccagctcaggacagatgcc

SEQ ID NO: 4603631 - DNA, 15 bp, Homo sapiens
ccagctccaacctgc

SEQ ID NO: 4603632 - DNA, 22 bp, Homo sapiens
ccagctccaaggggaatcagaa

SEQ ID NO: 4603633 - DNA, 13 bp, Homo sapiens
ccagctctactcc

SEQ ID NO: 4603634 - DNA, 14 bp, Homo sapiens
ccagctctactcca

SEQ ID NO: 4603635 - DNA, 17 bp, Homo sapiens
ccagctctactccaggc

SEQ ID NO: 4603636 - DNA, 18 bp, Homo sapiens
ccagctgcactgatgctg

SEQ ID NO: 4603637 - DNA, 12 bp, Homo sapiens
ccagctttccct

SEQ ID NO: 4603638 - DNA, 14 bp, Homo sapiens
ccaggaatttccca

SEQ ID NO: 4603639 - DNA, 16 bp, Homo sapiens
ccaggaatttcccagg

SEQ ID NO: 4603640 - DNA, 23 bp, Homo sapiens
ccaggaatttcccaggaccctga

SEQ ID NO: 4603641 - DNA, 16 bp, Homo sapiens
ccaggaccagctcagg

SEQ ID NO: 4603642 - DNA, 20 bp, Homo sapiens
ccaggaccagctcaggacag

SEQ ID NO: 4603643 - DNA, 18 bp, Homo sapiens
ccaggaccctgaaggggc

SEQ ID NO: 4603644 - DNA, 23 bp, Homo sapiens
ccaggaccctgaaggggccatga

SEQ ID NO: 4603645 - DNA, 17 bp, Homo sapiens
ccaggagtttgagacca

SEQ ID NO: 4603646 - DNA, 17 bp, Homo sapiens
ccaggcagatccaggac

SEQ ID NO: 4603647 - DNA, 19 bp, Homo sapiens
ccaggcagatccaggacta

SEQ ID NO: 4603648 - DNA, 15 bp, Homo sapiens
ccagggagaagctcc

SEQ ID NO: 4603649 - DNA, 15 bp, Homo sapiens
ccagggcccagagcc

SEQ ID NO: 4603650 - DNA, 16 bp, Homo sapiens
ccagggcccagagccc

SEQ ID NO: 4603651 - DNA, 22 bp, Homo sapiens
ccagggcccagagcccagctcc

SEQ ID NO: 4603652 - DNA, 17 bp, Homo sapiens
ccaggggggtgaggagc

SEQ ID NO: 4603653 - DNA, 20 bp, Homo sapiens
ccaggggggtgaggagctgg

SEQ ID NO: 4603654 - DNA, 15 bp, Homo sapiens
ccagtccccccaccc

SEQ ID NO: 4603655 - DNA, 14 bp, Homo sapiens
ccagtgcccccact

SEQ ID NO: 4603656 - DNA, 22 bp, Homo sapiens
ccagtgttgtggatttaacaga

SEQ ID NO: 4603657 - DNA, 13 bp, Homo sapiens
ccagttcaccctg

SEQ ID NO: 4603658 - DNA, 21 bp, Homo sapiens
ccagttcaggagtcccaagga

SEQ ID NO: 4603659 - DNA, 13 bp, Homo sapiens
ccatcatgccaca

SEQ ID NO: 4603660 - DNA, 14 bp, Homo sapiens
ccatcctggggttg

SEQ ID NO: 4603661 - DNA, 19 bp, Homo sapiens
ccatcctggggttgccctg

SEQ ID NO: 4603662 - DNA, 15 bp, Homo sapiens
ccatgcactgtgaag

SEQ ID NO: 4603663 - DNA, 19 bp, Homo sapiens
ccatgcactgtgaaggacc

SEQ ID NO: 4603664 - DNA, 13 bp, Homo sapiens
cccaaaaggcaga

SEQ ID NO: 4603665 - DNA, 17 bp, Homo sapiens
cccaacccttccctcac

SEQ ID NO: 4603666 - DNA, 14 bp, Homo sapiens
cccaaggaaagccc

SEQ ID NO: 4603667 - DNA, 19 bp, Homo sapiens
cccaaggaaagccccagca

SEQ ID NO: 4603668 - DNA, 15 bp, Homo sapiens
cccagaatccctcta

SEQ ID NO: 4603669 - DNA, 18 bp, Homo sapiens
cccagaatccctctaacc

SEQ ID NO: 4603670 - DNA, 21 bp, Homo sapiens
cccagaatccctctaacccct

SEQ ID NO: 4603671 - DNA, 22 bp, Homo sapiens
cccagagaaaggggagcccact

SEQ ID NO: 4603672 - DNA, 18 bp, Homo sapiens
cccagagacatacttgaa

SEQ ID NO: 4603673 - DNA, 23 bp, Homo sapiens
cccagagacatacttgaagggcc

SEQ ID NO: 4603674 - DNA, 14 bp, Homo sapiens
cccagcccagagac

SEQ ID NO: 4603675 - DNA, 18 bp, Homo sapiens
cccagcctccctgaagcc

SEQ ID NO: 4603676 - DNA, 19 bp, Homo sapiens
cccagctaagaacctggaa

SEQ ID NO: 4603677 - DNA, 15 bp, Homo sapiens
cccagctccctagga

SEQ ID NO: 4603678 - DNA, 16 bp, Homo sapiens
cccagctctactccag

SEQ ID NO: 4603679 - DNA, 18 bp, Homo sapiens
cccagcttatctcctcct

SEQ ID NO: 4603680 - DNA, 19 bp, Homo sapiens
cccagcttatctcctcctc

SEQ ID NO: 4603681 - DNA, 16 bp, Homo sapiens
cccaggaccagctcag

SEQ ID NO: 4603682 - DNA, 20 bp, Homo sapiens
cccagtgcccccactgacca

SEQ ID NO: 4603683 - DNA, 19 bp, Homo sapiens
cccagttcaggagtcccaa

SEQ ID NO: 4603684 - DNA, 12 bp, Homo sapiens
cccatgcactgt

SEQ ID NO: 4603685 - DNA, 13 bp, Homo sapiens
cccattcctgaag

SEQ ID NO: 4603686 - DNA, 12 bp, Homo sapiens
cccatttcagct

SEQ ID NO: 4603687 - DNA, 12 bp, Homo sapiens
ccccaccctcat

SEQ ID NO: 4603688 - DNA, 20 bp, Homo sapiens
ccccaccctggtgggccaac

SEQ ID NO: 4603689 - DNA, 11 bp, Homo sapiens
ccccaggacca

SEQ ID NO: 4603690 - DNA, 13 bp, Homo sapiens
ccccatgcactgt

SEQ ID NO: 4603691 - DNA, 19 bp, Homo sapiens
ccccatgcactgtgaagga

SEQ ID NO: 4603692 - DNA, 18 bp, Homo sapiens
cccccagctaagaacctg

SEQ ID NO: 4603693 - DNA, 19 bp, Homo sapiens
cccctaaagcctcaaaaca

SEQ ID NO: 4603694 - DNA, 13 bp, Homo sapiens
cccctgcactcca

SEQ ID NO: 4603695 - DNA, 14 bp, Homo sapiens
cccgacccagctct

SEQ ID NO: 4603696 - DNA, 23 bp, Homo sapiens
cccgggaggcagaggttgcagtg

SEQ ID NO: 4603697 - DNA, 17 bp, Homo sapiens
ccctcatctctctgccc

SEQ ID NO: 4603698 - DNA, 20 bp, Homo sapiens
ccctccctgttccccagaga

SEQ ID NO: 4603699 - DNA, 17 bp, Homo sapiens
ccctgaaggggccatga

SEQ ID NO: 4603700 - DNA, 19 bp, Homo sapiens
ccctgactaaactaccacc

SEQ ID NO: 4603701 - DNA, 21 bp, Homo sapiens
ccctgactaaactaccacctc

SEQ ID NO: 4603702 - DNA, 22 bp, Homo sapiens
ccctgactaaactaccacctca

SEQ ID NO: 4603703 - DNA, 22 bp, Homo sapiens
ccctgccaggagctttggacct

SEQ ID NO: 4603704 - DNA, 19 bp, Homo sapiens
ccctgcctctacccaacca

SEQ ID NO: 4603705 - DNA, 20 bp, Homo sapiens
ccctgggggataccagctga

SEQ ID NO: 4603706 - DNA, 17 bp, Homo sapiens
ccctgttccccagagaa

SEQ ID NO: 4603707 - DNA, 19 bp, Homo sapiens
ccctgtttcagaggctcag

SEQ ID NO: 4603708 - DNA, 13 bp, Homo sapiens
cccttccctcacc

SEQ ID NO: 4603709 - DNA, 15 bp, Homo sapiens
cccttggctcaatcc

SEQ ID NO: 4603710 - DNA, 15 bp, Homo sapiens
ctacttgggaggctg

SEQ ID NO: 4603711 - DNA, 19 bp, Homo sapiens
ctactttgactttttgcat

SEQ ID NO: 4603712 - DNA, 21 bp, Homo sapiens
ctactttgactttttgcattt

SEQ ID NO: 4603713 - DNA, 13 bp, Homo sapiens
ctagagcctctgc

SEQ ID NO: 4603714 - DNA, 13 bp, Homo sapiens
ctaggggctgggg

SEQ ID NO: 4603715 - DNA, 23 bp, Homo sapiens
ctagtatcaaaagaaagaaaatc

SEQ ID NO: 4603716 - DNA, 19 bp, Homo sapiens
ctagtttgattaaattctt

SEQ ID NO: 4603717 - DNA, 21 bp, Homo sapiens
ctagtttgattaaattcttgc

SEQ ID NO: 4603718 - DNA, 18 bp, Homo sapiens
ctataaccccagctccct

SEQ ID NO: 4603719 - DNA, 22 bp, Homo sapiens
ctataaccccagctccctagga

SEQ ID NO: 4603720 - DNA, 15 bp, Homo sapiens
ctatacaactggaca

SEQ ID NO: 4603721 - DNA, 17 bp, Homo sapiens
ctatactgcatactttt

SEQ ID NO: 4603722 - DNA, 21 bp, Homo sapiens
ctatactgcatactttttaaa

SEQ ID NO: 4603723 - DNA, 19 bp, Homo sapiens
ctatgcatggtgccccagg

SEQ ID NO: 4603724 - DNA, 21 bp, Homo sapiens
ctatgcatggtgccccaggac

SEQ ID NO: 4603725 - DNA, 11 bp, Homo sapiens
ctatgcatttg

SEQ ID NO: 4603726 - DNA, 12 bp, Homo sapiens
ctatgcatttga

SEQ ID NO: 4603727 - DNA, 19 bp, Homo sapiens
ctatgccagctcagtccca

SEQ ID NO: 4603728 - DNA, 23 bp, Homo sapiens
ctatgtcatttgctggagctctg

SEQ ID NO: 4603729 - DNA, 15 bp, Homo sapiens
ctatgttaatatttt

SEQ ID NO: 4603730 - DNA, 9 bp, Homo sapiens
ctatttaac

SEQ ID NO: 4603731 - DNA, 19 bp, Homo sapiens
ctcaaactgaggaatttca

SEQ ID NO: 4603732 - DNA, 17 bp, Homo sapiens
ctcaaatggggccagat

SEQ ID NO: 4603733 - DNA, 13 bp, Homo sapiens
ctcaaatttctaa

SEQ ID NO: 4603734 - DNA, 17 bp, Homo sapiens
ctcaaatttctaaatct

SEQ ID NO: 4603735 - DNA, 13 bp, Homo sapiens
ctcaactgcctac

SEQ ID NO: 4603736 - DNA, 10 bp, Homo sapiens
ctcagatcca

SEQ ID NO: 4603737 - DNA, 17 bp, Homo sapiens
ctcagatccagggacag

SEQ ID NO: 4603738 - DNA, 20 bp, Homo sapiens
ctcagatccagggacagagg

SEQ ID NO: 4603739 - DNA, 22 bp, Homo sapiens
ctcagatccagggacagaggcc

SEQ ID NO: 4603740 - DNA, 22 bp, Homo sapiens
ctcagattgtaatatgtaaatg

SEQ ID NO: 4603741 - DNA, 13 bp, Homo sapiens
ctcagcctggcca

SEQ ID NO: 4603742 - DNA, 14 bp, Homo sapiens
ctcagcctggccag

SEQ ID NO: 4603743 - DNA, 15 bp, Homo sapiens
ctcagcctggccaga

SEQ ID NO: 4603744 - DNA, 17 bp, Homo sapiens
ctcagcctggccagaca

SEQ ID NO: 4603745 - DNA, 18 bp, Homo sapiens
ctcagccttgccagagat

SEQ ID NO: 4603746 - DNA, 20 bp, Homo sapiens
ctcagccttgccagagatcc

SEQ ID NO: 4603747 - DNA, 21 bp, Homo sapiens
ctcagccttgccagagatcca

SEQ ID NO: 4603748 - DNA, 22 bp, Homo sapiens
ctcagccttgccagagatccaa

SEQ ID NO: 4603749 - DNA, 12 bp, Homo sapiens
ctcaggacagat

SEQ ID NO: 4603750 - DNA, 19 bp, Homo sapiens
ctcaggacagatgccacac

SEQ ID NO: 4603751 - DNA, 16 bp, Homo sapiens
ctcagtccatgaagat

SEQ ID NO: 4603752 - DNA, 19 bp, Homo sapiens
ctcatattgtgattctgcc

SEQ ID NO: 4603753 - DNA, 13 bp, Homo sapiens
ctcatcaactgaa

SEQ ID NO: 4603754 - DNA, 14 bp, Homo sapiens
ctcatcaactgaat

SEQ ID NO: 4603755 - DNA, 19 bp, Homo sapiens
ctcatccctctcacccaga

SEQ ID NO: 4603756 - DNA, 16 bp, Homo sapiens
ctcatctctctgccca

SEQ ID NO: 4603757 - DNA, 17 bp, Homo sapiens
ctcatctctctgcccaa

SEQ ID NO: 4603758 - DNA, 16 bp, Homo sapiens
ctcatgcaaatcaatt

SEQ ID NO: 4603759 - DNA, 19 bp, Homo sapiens
ctcatgcaaatcaattact

SEQ ID NO: 4603760 - DNA, 20 bp, Homo sapiens
ctcatgcaaatcaattactg

SEQ ID NO: 4603761 - DNA, 17 bp, Homo sapiens
ctcatgttgaaacttta

SEQ ID NO: 4603762 - DNA, 15 bp, Homo sapiens
ctcattaaacttttt

SEQ ID NO: 4603763 - DNA, 18 bp, Homo sapiens
ctcattctccttgtgtta

SEQ ID NO: 4603764 - DNA, 18 bp, Homo sapiens
ctccaaaataaaactttt

SEQ ID NO: 4603765 - DNA, 22 bp, Homo sapiens
ctccaaaatgttggtcatttta

SEQ ID NO: 4603766 - DNA, 23 bp, Homo sapiens
ctccagacctgatcctggaggcc

SEQ ID NO: 4603767 - DNA, 12 bp, Homo sapiens
ctccatcttatt

SEQ ID NO: 4603768 - DNA, 19 bp, Homo sapiens
ctcccaatttcagactccc

SEQ ID NO: 4603769 - DNA, 21 bp, Homo sapiens
ctcccaatttcagactcccat

SEQ ID NO: 4603770 - DNA, 15 bp, Homo sapiens
ctccccagcccagag

SEQ ID NO: 4603771 - DNA, 16 bp, Homo sapiens
ctccccagcccagaga

SEQ ID NO: 4603772 - DNA, 15 bp, Homo sapiens
ctcccccccatgcac

SEQ ID NO: 4603773 - DNA, 18 bp, Homo sapiens
ctcccgactgaccactgg

SEQ ID NO: 4603774 - DNA, 18 bp, Homo sapiens
ctcctcccgactgaccac

SEQ ID NO: 4603775 - DNA, 14 bp, Homo sapiens
ctcctctccccagc

SEQ ID NO: 4603776 - DNA, 22 bp, Homo sapiens
ctcctctccccagcccagagac

SEQ ID NO: 4603777 - DNA, 14 bp, Homo sapiens
ctccttgtgttact

SEQ ID NO: 4603778 - DNA, 15 bp, Homo sapiens
ctctaacagtggaca

SEQ ID NO: 4603779 - DNA, 22 bp, Homo sapiens
ctctactccaggcttccacact

SEQ ID NO: 4603780 - DNA, 15 bp, Homo sapiens
ctctagtttgattaa

SEQ ID NO: 4603781 - DNA, 21 bp, Homo sapiens
ctctatgccagctcagtccca

SEQ ID NO: 4603782 - DNA, 17 bp, Homo sapiens
ctctcatcaactgaatg

SEQ ID NO: 4603783 - DNA, 18 bp, Homo sapiens
ctctcatcaactgaatga

SEQ ID NO: 4603784 - DNA, 15 bp, Homo sapiens
ctctccccagcccag

SEQ ID NO: 4603785 - DNA, 14 bp, Homo sapiens
ctctctccacccta

SEQ ID NO: 4603786 - DNA, 16 bp, Homo sapiens
ctctcttggaccctgg

SEQ ID NO: 4603787 - DNA, 19 bp, Homo sapiens
ctctcttggaccctgggag

SEQ ID NO: 4603788 - DNA, 13 bp, Homo sapiens
ctctgcagcaata

SEQ ID NO: 4603789 - DNA, 19 bp, Homo sapiens
ctctgcagcaataaagcag

SEQ ID NO: 4603790 - DNA, 13 bp, Homo sapiens
ctctgcctgacag

SEQ ID NO: 4603791 - DNA, 23 bp, Homo sapiens
ctctgcctgacagcatcctctct

SEQ ID NO: 4603792 - DNA, 22 bp, Homo sapiens
ctcttccagtcttcctgacact

SEQ ID NO: 4603793 - DNA, 22 bp, Homo sapiens
ctcttctgagctatttcatcta

SEQ ID NO: 4603794 - DNA, 17 bp, Homo sapiens
ctcttgagccttgaact

SEQ ID NO: 4603795 - DNA, 18 bp, Homo sapiens
ctcttgagccttgaactt

SEQ ID NO: 4603796 - DNA, 14 bp, Homo sapiens
ctcttgaggccagg

SEQ ID NO: 4603797 - DNA, 16 bp, Homo sapiens
ctgaaacaacttggaa

SEQ ID NO: 4603798 - DNA, 20 bp, Homo sapiens
ctgaaacaacttggaaagat

SEQ ID NO: 4603799 - DNA, 17 bp, Homo sapiens
ctgaaagaggaatgaag

SEQ ID NO: 4603800 - DNA, 18 bp, Homo sapiens
ctgaactcaaactgagga

SEQ ID NO: 4603801 - DNA, 22 bp, Homo sapiens
ctgaagaaccagtccccccacc

SEQ ID NO: 4603802 - DNA, 15 bp, Homo sapiens
ctgaaggggccatga

SEQ ID NO: 4603803 - DNA, 23 bp, Homo sapiens
ctgaaggggccatgatggcaaca

SEQ ID NO: 4603804 - DNA, 14 bp, Homo sapiens
ctgaatttcttttg

SEQ ID NO: 4603805 - DNA, 19 bp, Homo sapiens
ctgacactttaattaccaa

SEQ ID NO: 4603806 - DNA, 10 bp, Homo sapiens
ctgacccagt

SEQ ID NO: 4603807 - DNA, 12 bp, Homo sapiens
ctgacccagtgc

SEQ ID NO: 4603808 - DNA, 18 bp, Homo sapiens
ctgacccagtgcccccac

SEQ ID NO: 4603809 - DNA, 21 bp, Homo sapiens
ctgactaaactaccacctcag

SEQ ID NO: 4603810 - DNA, 12 bp, Homo sapiens
ctgagatatgaa

SEQ ID NO: 4603811 - DNA, 15 bp, Homo sapiens
ctgagatatgaacat

SEQ ID NO: 4603812 - DNA, 17 bp, Homo sapiens
ctgagccttcagtcttg

SEQ ID NO: 4603813 - DNA, 15 bp, Homo sapiens
ctgaggcaggaggat

SEQ ID NO: 4603814 - DNA, 15 bp, Homo sapiens
ctgagggtcgtggga

SEQ ID NO: 4603815 - DNA, 19 bp, Homo sapiens
ctgagggtcgtgggaaagg

SEQ ID NO: 4603816 - DNA, 22 bp, Homo sapiens
ctgagggtcgtgggaaagggga

SEQ ID NO: 4603817 - DNA, 23 bp, Homo sapiens
ctgagggtcgtgggaaaggggag

SEQ ID NO: 4603818 - DNA, 17 bp, Homo sapiens
ctgagtacgttgtgcat

SEQ ID NO: 4603819 - DNA, 18 bp, Homo sapiens
ctgagtcgtacagaaagc

SEQ ID NO: 4603820 - DNA, 19 bp, Homo sapiens
ctgagtcgtacagaaagct

SEQ ID NO: 4603821 - DNA, 13 bp, Homo sapiens
ctgataaagatga

SEQ ID NO: 4603822 - DNA, 22 bp, Homo sapiens
ctgatcagtgggcctccaagga

SEQ ID NO: 4603823 - DNA, 16 bp, Homo sapiens
ctgatttaggagaagc

SEQ ID NO: 4603824 - DNA, 17 bp, Homo sapiens
ctgatttaggagaagcc

SEQ ID NO: 4603825 - DNA, 20 bp, Homo sapiens
ctgatttaggagaagccagg

SEQ ID NO: 4603826 - DNA, 21 bp, Homo sapiens
ctgatttaggagaagccagga

SEQ ID NO: 4603827 - DNA, 22 bp, Homo sapiens
ctgatttaggagaagccaggaa

SEQ ID NO: 4603828 - DNA, 18 bp, Homo sapiens
ctgcaaacctgacccctg

SEQ ID NO: 4603829 - DNA, 15 bp, Homo sapiens
ctgcactgatgctgc

SEQ ID NO: 4603830 - DNA, 18 bp, Homo sapiens
ctgcactgatgctgcccc

SEQ ID NO: 4603831 - DNA, 15 bp, Homo sapiens
ctgcagcaataaagc

SEQ ID NO: 4603832 - DNA, 14 bp, Homo sapiens
ctgcatttaaaaga

SEQ ID NO: 4603833 - DNA, 17 bp, Homo sapiens
ctgcatttaaaagatac

SEQ ID NO: 4603834 - DNA, 18 bp, Homo sapiens
ctgcatttaaaagataca

SEQ ID NO: 4603835 - DNA, 20 bp, Homo sapiens
ctgcatttaaaagatacagt

SEQ ID NO: 4603836 - DNA, 12 bp, Homo sapiens
ctgccagctgca

SEQ ID NO: 4603837 - DNA, 19 bp, Homo sapiens
ctgcctctacccaaccagg

SEQ ID NO: 4603838 - DNA, 15 bp, Homo sapiens
ctgcctgacagcatc

SEQ ID NO: 4603839 - DNA, 21 bp, Homo sapiens
ctgcctgacagcatcctctct

SEQ ID NO: 4603840 - DNA, 19 bp, Homo sapiens
ctttaattaccaacctgtt

SEQ ID NO: 4603841 - DNA, 20 bp, Homo sapiens
ctttaccttttttatacata

SEQ ID NO: 4603842 - DNA, 22 bp, Homo sapiens
ctttatatgaagaaaatcactt

SEQ ID NO: 4603843 - DNA, 18 bp, Homo sapiens
ctttattggctgagatat

SEQ ID NO: 4603844 - DNA, 19 bp, Homo sapiens
ctttcatattttaaacaga

SEQ ID NO: 4603845 - DNA, 12 bp, Homo sapiens
ctttctccagcc

SEQ ID NO: 4603846 - DNA, 17 bp, Homo sapiens
ctttctggctatgcatt

SEQ ID NO: 4603847 - DNA, 18 bp, Homo sapiens
ctttctggctatgcattt

SEQ ID NO: 4603848 - DNA, 13 bp, Homo sapiens
ctttgacctctgc

SEQ ID NO: 4603849 - DNA, 14 bp, Homo sapiens
ctttgacctctgca

SEQ ID NO: 4603850 - DNA, 24 bp, Homo sapiens
ctttgacctctgcagcaataaagc

SEQ ID NO: 4603851 - DNA, 17 bp, Homo sapiens
ctttgactttttgcatt

SEQ ID NO: 4603852 - DNA, 13 bp, Homo sapiens
ctttgggccagac

SEQ ID NO: 4603853 - DNA, 22 bp, Homo sapiens
ctttgtattctctcctgtacct

SEQ ID NO: 4603854 - DNA, 22 bp, Homo sapiens
ctttgtgattcaatctgtaaac

SEQ ID NO: 4603855 - DNA, 17 bp, Homo sapiens
ctttgtgatttttgtaa

SEQ ID NO: 4603856 - DNA, 14 bp, Homo sapiens
cttttataaacttt

SEQ ID NO: 4603857 - DNA, 21 bp, Homo sapiens
cttttataaactttacctttt

SEQ ID NO: 4603858 - DNA, 19 bp, Homo sapiens
cttttctggaatggaattg

SEQ ID NO: 4603859 - DNA, 18 bp, Homo sapiens
cttttgccgttattaaaa

SEQ ID NO: 4603860 - DNA, 21 bp, Homo sapiens
cttttggttatgaatactttg

SEQ ID NO: 4603861 - DNA, 18 bp, Homo sapiens
cttttgtgcattatctag

SEQ ID NO: 4603862 - DNA, 11 bp, Homo sapiens
cttttgttctt

SEQ ID NO: 4603863 - DNA, 20 bp, Homo sapiens
cttttgttcttggtttgtaa

SEQ ID NO: 4603864 - DNA, 22 bp, Homo sapiens
cttttgttcttggtttgtaaat

SEQ ID NO: 4603865 - DNA, 20 bp, Homo sapiens
ctttttaaatgtaaagatat

SEQ ID NO: 4603866 - DNA, 14 bp, Homo sapiens
ctttttatttgcat

SEQ ID NO: 4603867 - DNA, 16 bp, Homo sapiens
cttttttatacataaa

SEQ ID NO: 4603868 - DNA, 18 bp, Homo sapiens
cttttttatacataaaca

SEQ ID NO: 4603869 - DNA, 13 bp, Homo sapiens
gaaaacacatttt

SEQ ID NO: 4603870 - DNA, 14 bp, Homo sapiens
gaaaacatgctaca

SEQ ID NO: 4603871 - DNA, 15 bp, Homo sapiens
gaaaacatgctacac

SEQ ID NO: 4603872 - DNA, 21 bp, Homo sapiens
gaaaactttatgctaagtgaa

SEQ ID NO: 4603873 - DNA, 14 bp, Homo sapiens
gaaaagaatagaag

SEQ ID NO: 4603874 - DNA, 18 bp, Homo sapiens
gaaaattttgatgtttta

SEQ ID NO: 4603875 - DNA, 14 bp, Homo sapiens
gaaacaacttggaa

SEQ ID NO: 4603876 - DNA, 14 bp, Homo sapiens
gaaaccctgtctct

SEQ ID NO: 4603877 - DNA, 15 bp, Homo sapiens
gaaagaaagaaggaa

SEQ ID NO: 4603878 - DNA, 21 bp, Homo sapiens
gaaagaggaatgaagtactca

SEQ ID NO: 4603879 - DNA, 14 bp, Homo sapiens
gaaagaggcaggga

SEQ ID NO: 4603880 - DNA, 14 bp, Homo sapiens
gaaagcagggactt

SEQ ID NO: 4603881 - DNA, 14 bp, Homo sapiens
gaaagccagcctgg

SEQ ID NO: 4603882 - DNA, 13 bp, Homo sapiens
gaaaggggagccc

SEQ ID NO: 4603883 - DNA, 17 bp, Homo sapiens
gaaatacagactggatg

SEQ ID NO: 4603884 - DNA, 17 bp, Homo sapiens
gaaatataggaacttaa

SEQ ID NO: 4603885 - DNA, 17 bp, Homo sapiens
gaaatgaaagcagggac

SEQ ID NO: 4603886 - DNA, 22 bp, Homo sapiens
gaaattttaacctatgatattt

SEQ ID NO: 4603887 - DNA, 22 bp, Homo sapiens
gaaattttatatgcttactgat

SEQ ID NO: 4603888 - DNA, 18 bp, Homo sapiens
gaacaaatttacagagac

SEQ ID NO: 4603889 - DNA, 18 bp, Homo sapiens
gaacagacaacagaagtc

SEQ ID NO: 4603890 - DNA, 19 bp, Homo sapiens
gaacagacaacagaagtca

SEQ ID NO: 4603891 - DNA, 16 bp, Homo sapiens
gaacagtgattaccag

SEQ ID NO: 4603892 - DNA, 18 bp, Homo sapiens
gaacatattgttgaaagg

SEQ ID NO: 4603893 - DNA, 15 bp, Homo sapiens
gaacattggttcttt

SEQ ID NO: 4603894 - DNA, 19 bp, Homo sapiens
gaaccagtccccccaccct

SEQ ID NO: 4603895 - DNA, 19 bp, Homo sapiens
gaacccagactcagacatt

SEQ ID NO: 4603896 - DNA, 17 bp, Homo sapiens
gaacccgggaggcagag

SEQ ID NO: 4603897 - DNA, 14 bp, Homo sapiens
gaacctcagcctgg

SEQ ID NO: 4603898 - DNA, 16 bp, Homo sapiens
gaacctggaacttggg

SEQ ID NO: 4603899 - DNA, 20 bp, Homo sapiens
gaactcaaatggggccagat

SEQ ID NO: 4603900 - DNA, 23 bp, Homo sapiens
gaactcaaatggggccagatcca

SEQ ID NO: 4603901 - DNA, 15 bp, Homo sapiens
gaactcagatccagg

SEQ ID NO: 4603902 - DNA, 16 bp, Homo sapiens
gaactcagatccaggg

SEQ ID NO: 4603903 - DNA, 17 bp, Homo sapiens
gaactctctccacccta

SEQ ID NO: 4603904 - DNA, 14 bp, Homo sapiens
gaacttaaataatg

SEQ ID NO: 4603905 - DNA, 17 bp, Homo sapiens
gaacttaaataatgtga

SEQ ID NO: 4603906 - DNA, 19 bp, Homo sapiens
gaagaaccagtccccccac

SEQ ID NO: 4603907 - DNA, 22 bp, Homo sapiens
gaagaaccagtccccccaccct

SEQ ID NO: 4603908 - DNA, 16 bp, Homo sapiens
gaagacaatgacttac

SEQ ID NO: 4603909 - DNA, 22 bp, Homo sapiens
gaagacaatgacttactgtaca

SEQ ID NO: 4603910 - DNA, 23 bp, Homo sapiens
gaagcaacccaaatgttcatcaa

SEQ ID NO: 4603911 - DNA, 23 bp, Homo sapiens
gaagccaggaatttcccaggacc

SEQ ID NO: 4603912 - DNA, 15 bp, Homo sapiens
gaagcccaagtgaaa

SEQ ID NO: 4603913 - DNA, 21 bp, Homo sapiens
gaagcccccagctaagaacct

SEQ ID NO: 4603914 - DNA, 19 bp, Homo sapiens
gaagctcctctccccagcc

SEQ ID NO: 4603915 - DNA, 23 bp, Homo sapiens
gaagctcctctccccagcccaga

SEQ ID NO: 4603916 - DNA, 13 bp, Homo sapiens
gaagctctgaagt

SEQ ID NO: 4603917 - DNA, 12 bp, Homo sapiens
gaaggatacaaa

SEQ ID NO: 4603918 - DNA, 19 bp, Homo sapiens
gaaggatacaaaagcatgt

SEQ ID NO: 4603919 - DNA, 14 bp, Homo sapiens
gaagggccagagcc

SEQ ID NO: 4603920 - DNA, 17 bp, Homo sapiens
gaaggtagaatgttttc

SEQ ID NO: 4603921 - DNA, 18 bp, Homo sapiens
gaaggtgctgacggccag

SEQ ID NO: 4603922 - DNA, 21 bp, Homo sapiens
gaaggtgctgacggccaggga

SEQ ID NO: 4603923 - DNA, 19 bp, Homo sapiens
gaagtattttgctggaata

SEQ ID NO: 4603924 - DNA, 15 bp, Homo sapiens
gaagtcatgaagccc

SEQ ID NO: 4603925 - DNA, 19 bp, Homo sapiens
gaagtgggtggggacagac

SEQ ID NO: 4603926 - DNA, 17 bp, Homo sapiens
gaagttgattcatattg

SEQ ID NO: 4603927 - DNA, 21 bp, Homo sapiens
gaataatcacgctttcctgaa

SEQ ID NO: 4603928 - DNA, 22 bp, Homo sapiens
gaataatctttgggtaacttca

SEQ ID NO: 4603929 - DNA, 15 bp, Homo sapiens
gaatatataaccagt

SEQ ID NO: 4603930 - DNA, 14 bp, Homo sapiens
gaatctagaggagg

SEQ ID NO: 4603931 - DNA, 16 bp, Homo sapiens
gaatctagaggagggg

SEQ ID NO: 4603932 - DNA, 16 bp, Homo sapiens
gaatgaggtcccaggc

SEQ ID NO: 4603933 - DNA, 17 bp, Homo sapiens
gaatgaggtcccaggca

SEQ ID NO: 4603934 - DNA, 21 bp, Homo sapiens
gaatgaggtcccaggcagaga

SEQ ID NO: 4603935 - DNA, 17 bp, Homo sapiens
gaatgtcagttgttatt

SEQ ID NO: 4603936 - DNA, 21 bp, Homo sapiens
gaatgtcagttgttatttatt

SEQ ID NO: 4603937 - DNA, 17 bp, Homo sapiens
gaatgttttcaaatgtt

SEQ ID NO: 4603938 - DNA, 15 bp, Homo sapiens
gaattaacacatgat

SEQ ID NO: 4603939 - DNA, 17 bp, Homo sapiens
gaattctctagtttgat

SEQ ID NO: 4603940 - DNA, 19 bp, Homo sapiens
gaattctctagtttgatta

SEQ ID NO: 4603941 - DNA, 12 bp, Homo sapiens
gaatttcacctg

SEQ ID NO: 4603942 - DNA, 17 bp, Homo sapiens
gaatttcacctgtaaac

SEQ ID NO: 4603943 - DNA, 21 bp, Homo sapiens
gaatttcacctgtaaacctga

SEQ ID NO: 4603944 - DNA, 12 bp, Homo sapiens
gaatttctaaaa

SEQ ID NO: 4603945 - DNA, 22 bp, Homo sapiens
gaatttcttttgccgttattaa

SEQ ID NO: 4603946 - DNA, 18 bp, Homo sapiens
gaattttattgacacagt

SEQ ID NO: 4603947 - DNA, 12 bp, Homo sapiens
gacaacagaagt

SEQ ID NO: 4603948 - DNA, 14 bp, Homo sapiens
gacaacagaagtca

SEQ ID NO: 4603949 - DNA, 21 bp, Homo sapiens
gacaatgacttactgtacatg

SEQ ID NO: 4603950 - DNA, 19 bp, Homo sapiens
gacacatgcaaggtcattt

SEQ ID NO: 4603951 - DNA, 16 bp, Homo sapiens
gacacttaaaaatggt

SEQ ID NO: 4603952 - DNA, 14 bp, Homo sapiens
gacagaaagcagaa

SEQ ID NO: 4603953 - DNA, 13 bp, Homo sapiens
gacagaggcccca

SEQ ID NO: 4603954 - DNA, 12 bp, Homo sapiens
gacagctctgca

SEQ ID NO: 4603955 - DNA, 21 bp, Homo sapiens
gacagttggagggaaagccag

SEQ ID NO: 4603956 - DNA, 15 bp, Homo sapiens
gacatactaaccagc

SEQ ID NO: 4603957 - DNA, 22 bp, Homo sapiens
gacatacttgaagggccagagc

SEQ ID NO: 4603958 - DNA, 18 bp, Homo sapiens
gaccactgcagaagacag

SEQ ID NO: 4603959 - DNA, 11 bp, Homo sapiens
gaccactggcc

SEQ ID NO: 4603960 - DNA, 12 bp, Homo sapiens
gaccagcctggg

SEQ ID NO: 4603961 - DNA, 22 bp, Homo sapiens
gaccagctcaggacagatgcca

SEQ ID NO: 4603962 - DNA, 20 bp, Homo sapiens
gacccaaaaggcagaagcaa

SEQ ID NO: 4603963 - DNA, 22 bp, Homo sapiens
gacccacaagaaatgaaagcag

SEQ ID NO: 4603964 - DNA, 19 bp, Homo sapiens
gacccagctctactccagg

SEQ ID NO: 4603965 - DNA, 17 bp, Homo sapiens
gacccagtgcccccact

SEQ ID NO: 4603966 - DNA, 20 bp, Homo sapiens
gacccagtgcccccactgac

SEQ ID NO: 4603967 - DNA, 16 bp, Homo sapiens
gaccctgaaggggcca

SEQ ID NO: 4603968 - DNA, 16 bp, Homo sapiens
gacctctgcagcaata

SEQ ID NO: 4603969 - DNA, 14 bp, Homo sapiens
gacctgatcctgga

SEQ ID NO: 4603970 - DNA, 13 bp, Homo sapiens
gcttttgtgcatt

SEQ ID NO: 4603971 - DNA, 13 bp, Homo sapiens
ggaaagccagcct

SEQ ID NO: 4603972 - DNA, 14 bp, Homo sapiens
ggaacccagactca

SEQ ID NO: 4603973 - DNA, 16 bp, Homo sapiens
ggaacctcagcctggc

SEQ ID NO: 4603974 - DNA, 15 bp, Homo sapiens
ggaactcagatccag

SEQ ID NO: 4603975 - DNA, 17 bp, Homo sapiens
ggaactcagatccaggg

SEQ ID NO: 4603976 - DNA, 22 bp, Homo sapiens
ggaacttggggagttaagacct

SEQ ID NO: 4603977 - DNA, 23 bp, Homo sapiens
ggaagtgaagagggagaagggat

SEQ ID NO: 4603978 - DNA, 16 bp, Homo sapiens
ggaatttcccaggacc

SEQ ID NO: 4603979 - DNA, 12 bp, Homo sapiens
ggacagaccagc

SEQ ID NO: 4603980 - DNA, 17 bp, Homo sapiens
ggacagaccagcccttc

SEQ ID NO: 4603981 - DNA, 15 bp, Homo sapiens
ggacagaggccccag

SEQ ID NO: 4603982 - DNA, 13 bp, Homo sapiens
ggaccctgaaggg

SEQ ID NO: 4603983 - DNA, 11 bp, Homo sapiens
ggacttcctgt

SEQ ID NO: 4603984 - DNA, 12 bp, Homo sapiens
ggagaagccagg

SEQ ID NO: 4603985 - DNA, 14 bp, Homo sapiens
ggagaagggatgga

SEQ ID NO: 4603986 - DNA, 21 bp, Homo sapiens
ggagaagggatggaggtcaca

SEQ ID NO: 4603987 - DNA, 16 bp, Homo sapiens
ggagaagtgggtgggg

SEQ ID NO: 4603988 - DNA, 15 bp, Homo sapiens
ggagaatcacttgaa

SEQ ID NO: 4603989 - DNA, 16 bp, Homo sapiens
ggagcatctcttgagg

SEQ ID NO: 4603990 - DNA, 20 bp, Homo sapiens
ggagcatctcttgaggccag

SEQ ID NO: 4603991 - DNA, 21 bp, Homo sapiens
ggagcatctcttgaggccagg

SEQ ID NO: 4603992 - DNA, 23 bp, Homo sapiens
ggagctcatccctctcacccaga

SEQ ID NO: 4603993 - DNA, 17 bp, Homo sapiens
ggagctggggatccctc

SEQ ID NO: 4603994 - DNA, 20 bp, Homo sapiens
ggaggattgcttgagcccag

SEQ ID NO: 4603995 - DNA, 15 bp, Homo sapiens
ggaggctgagatggg

SEQ ID NO: 4603996 - DNA, 17 bp, Homo sapiens
ggaggctgaggcaggag

SEQ ID NO: 4603997 - DNA, 14 bp, Homo sapiens
ggagggaaagccag

SEQ ID NO: 4603998 - DNA, 19 bp, Homo sapiens
ggagggaaagccagcctgg

SEQ ID NO: 4603999 - DNA, 19 bp, Homo sapiens
ggaggggagcatgggaagt

SEQ ID NO: 4604000 - DNA, 15 bp, Homo sapiens
ggagggggcaggctg

SEQ ID NO: 4604001 - DNA, 23 bp, Homo sapiens
ggagttaagacctggcagctctg

SEQ ID NO: 4604002 - DNA, 21 bp, Homo sapiens
ggagttgatctggaacccaga

SEQ ID NO: 4604003 - DNA, 14 bp, Homo sapiens
ggatagatgctggc

SEQ ID NO: 4604004 - DNA, 19 bp, Homo sapiens
ggatagatgctggcccagg

SEQ ID NO: 4604005 - DNA, 17 bp, Homo sapiens
ggatccctcccccccat

SEQ ID NO: 4604006 - DNA, 14 bp, Homo sapiens
ggatgaatgaggtc

SEQ ID NO: 4604007 - DNA, 23 bp, Homo sapiens
ggatgcacagagttgttacattt

SEQ ID NO: 4604008 - DNA, 23 bp, Homo sapiens
ggatgctgctgtacaacttctgg

SEQ ID NO: 4604009 - DNA, 16 bp, Homo sapiens
ggattgctatgaatga

SEQ ID NO: 4604010 - DNA, 12 bp, Homo sapiens
ggatttaacaga

SEQ ID NO: 4604011 - DNA, 16 bp, Homo sapiens
ggatttaacagaaatg

SEQ ID NO: 4604012 - DNA, 14 bp, Homo sapiens
ggcaacagatctgg

SEQ ID NO: 4604013 - DNA, 19 bp, Homo sapiens
ggcaacagatctggaacct

SEQ ID NO: 4604014 - DNA, 14 bp, Homo sapiens
ggcaaccaataaaa

SEQ ID NO: 4604015 - DNA, 19 bp, Homo sapiens
ggcacagtgcagcaagcct

SEQ ID NO: 4604016 - DNA, 17 bp, Homo sapiens
ggcaccagacacccagg

SEQ ID NO: 4604017 - DNA, 19 bp, Homo sapiens
ggcaccagacacccaggac

SEQ ID NO: 4604018 - DNA, 15 bp, Homo sapiens
ggcacctaatccagg

SEQ ID NO: 4604019 - DNA, 17 bp, Homo sapiens
ggcacctaatccaggca

SEQ ID NO: 4604020 - DNA, 18 bp, Homo sapiens
ggcacctaatccaggcag

SEQ ID NO: 4604021 - DNA, 16 bp, Homo sapiens
ggcagatccaggacta

SEQ ID NO: 4604022 - DNA, 19 bp, Homo sapiens
ggcagcatagcaagacaca

SEQ ID NO: 4604023 - DNA, 24 bp, Homo sapiens
ggcaggaggattgcttgagcccag

SEQ ID NO: 4604024 - DNA, 14 bp, Homo sapiens
ggcagtaataaaaa

SEQ ID NO: 4604025 - DNA, 13 bp, Homo sapiens
ggccaaataaagt

SEQ ID NO: 4604026 - DNA, 17 bp, Homo sapiens
ggccaaataaagtctct

SEQ ID NO: 4604027 - DNA, 14 bp, Homo sapiens
ggccaacaaagaac

SEQ ID NO: 4604028 - DNA, 17 bp, Homo sapiens
ggccagacacaggccct

SEQ ID NO: 4604029 - DNA, 11 bp, Homo sapiens
ggccagagcca

SEQ ID NO: 4604030 - DNA, 13 bp, Homo sapiens
ggccagagccagg

SEQ ID NO: 4604031 - DNA, 13 bp, Homo sapiens
ggccagatccagc

SEQ ID NO: 4604032 - DNA, 20 bp, Homo sapiens
ggccaggagtttgagaccag

SEQ ID NO: 4604033 - DNA, 21 bp, Homo sapiens
ggccatattccgcactgggca

SEQ ID NO: 4604034 - DNA, 16 bp, Homo sapiens
ggcccagagcccagct

SEQ ID NO: 4604035 - DNA, 19 bp, Homo sapiens
ggcccagagcccagctcca

SEQ ID NO: 4604036 - DNA, 16 bp, Homo sapiens
ggcccagggcccagag

SEQ ID NO: 4604037 - DNA, 17 bp, Homo sapiens
ggcccagggcccagagc

SEQ ID NO: 4604038 - DNA, 18 bp, Homo sapiens
ggcccagggcccagagcc

SEQ ID NO: 4604039 - DNA, 23 bp, Homo sapiens
ggccctccctgttccccagagaa

SEQ ID NO: 4604040 - DNA, 21 bp, Homo sapiens
ggcctacccctttctccagcc

SEQ ID NO: 4604041 - DNA, 18 bp, Homo sapiens
ggcctgtccaacacatct

SEQ ID NO: 4604042 - DNA, 19 bp, Homo sapiens
ggccttgctggatgctgct

SEQ ID NO: 4604043 - DNA, 15 bp, Homo sapiens
ggctatgcatttgaa

SEQ ID NO: 4604044 - DNA, 16 bp, Homo sapiens
ggctcagattgtaata

SEQ ID NO: 4604045 - DNA, 14 bp, Homo sapiens
ggctgaggcaggag

SEQ ID NO: 4604046 - DNA, 17 bp, Homo sapiens
ggctgagggtcgtggga

SEQ ID NO: 4604047 - DNA, 15 bp, Homo sapiens
ggctggatgtggtgg

SEQ ID NO: 4604048 - DNA, 18 bp, Homo sapiens
ggctggatgtggtggcat

SEQ ID NO: 4604049 - DNA, 17 bp, Homo sapiens
ggctgtctgttgtattc

SEQ ID NO: 4604050 - DNA, 21 bp, Homo sapiens
ggcttaattattgatgttttc

SEQ ID NO: 4604051 - DNA, 16 bp, Homo sapiens
ggcttccacacttctg

SEQ ID NO: 4604052 - DNA, 12 bp, Homo sapiens
gggaaagccagc

SEQ ID NO: 4604053 - DNA, 17 bp, Homo sapiens
gggaaagccagcctggg

SEQ ID NO: 4604054 - DNA, 13 bp, Homo sapiens
gggaaggatacaa

SEQ ID NO: 4604055 - DNA, 14 bp, Homo sapiens
gggaatcagaactc

SEQ ID NO: 4604056 - DNA, 10 bp, Homo sapiens
gggagcccac

SEQ ID NO: 4604057 - DNA, 14 bp, Homo sapiens
gggaggatcctgga

SEQ ID NO: 4604058 - DNA, 16 bp, Homo sapiens
gggagttaagacctgg

SEQ ID NO: 4604059 - DNA, 16 bp, Homo sapiens
gggattgtaaaatggt

SEQ ID NO: 4604060 - DNA, 22 bp, Homo sapiens
gggcaacagagcaagatcctgt

SEQ ID NO: 4604061 - DNA, 17 bp, Homo sapiens
gggcagccaaacccatg

SEQ ID NO: 4604062 - DNA, 12 bp, Homo sapiens
gggccagagcca

SEQ ID NO: 4604063 - DNA, 13 bp, Homo sapiens
gggccagagccag

SEQ ID NO: 4604064 - DNA, 11 bp, Homo sapiens
gggcccagagc

SEQ ID NO: 4604065 - DNA, 13 bp, Homo sapiens
gggcccagagccc

SEQ ID NO: 4604066 - DNA, 15 bp, Homo sapiens
gggcccagagcccag

SEQ ID NO: 4604067 - DNA, 16 bp, Homo sapiens
gggcccagagcccagc

SEQ ID NO: 4604068 - DNA, 17 bp, Homo sapiens
gggcccagagcccagct

SEQ ID NO: 4604069 - DNA, 19 bp, Homo sapiens
gggcccagagcccagctcc

SEQ ID NO: 4604070 - DNA, 15 bp, Homo sapiens
gggcctgctccagac

SEQ ID NO: 4604071 - DNA, 17 bp, Homo sapiens
gggcctgctccagacct

SEQ ID NO: 4604072 - DNA, 18 bp, Homo sapiens
gggcctgctccagacctg

SEQ ID NO: 4604073 - DNA, 19 bp, Homo sapiens
gggccttgctggatgctgc

SEQ ID NO: 4604074 - DNA, 15 bp, Homo sapiens
gggcgtggtggtgag

SEQ ID NO: 4604075 - DNA, 18 bp, Homo sapiens
gggctaggggctggggcc

SEQ ID NO: 4604076 - DNA, 19 bp, Homo sapiens
ggggacagaccagcccttc

SEQ ID NO: 4604077 - DNA, 21 bp, Homo sapiens
ggggacagaccagcccttccc

SEQ ID NO: 4604078 - DNA, 19 bp, Homo sapiens
ggggagcccactgtcctgg

SEQ ID NO: 4604079 - DNA, 17 bp, Homo sapiens
ggggataccagctgagt

SEQ ID NO: 4604080 - DNA, 21 bp, Homo sapiens
ggggatccctcccccccatgc

SEQ ID NO: 4604081 - DNA, 14 bp, Homo sapiens
ggggcaggctgagg

SEQ ID NO: 4604082 - DNA, 13 bp, Homo sapiens
ggggcagtggcaa

SEQ ID NO: 4604083 - DNA, 16 bp, Homo sapiens
ggggctaggggctggg

SEQ ID NO: 4604084 - DNA, 19 bp, Homo sapiens
ggggctaggggctggggcc

SEQ ID NO: 4604085 - DNA, 17 bp, Homo sapiens
ggggttgccctggggga

SEQ ID NO: 4604086 - DNA, 13 bp, Homo sapiens
gggtcgtgggaaa

SEQ ID NO: 4604087 - DNA, 20 bp, Homo sapiens
gggtcgtgggaaaggggagt

SEQ ID NO: 4604088 - DNA, 22 bp, Homo sapiens
gggtggaagcctcagaggcctt

SEQ ID NO: 4604089 - DNA, 18 bp, Homo sapiens
ggtaaaaagtattttttc

SEQ ID NO: 4604090 - DNA, 15 bp, Homo sapiens
ggtacttcttgaagg

SEQ ID NO: 4604091 - DNA, 16 bp, Homo sapiens
ggtatatccaaaagct

SEQ ID NO: 4604092 - DNA, 14 bp, Homo sapiens
ggtcccaggcagag

SEQ ID NO: 4604093 - DNA, 13 bp, Homo sapiens
ggtcggaaaacat

SEQ ID NO: 4604094 - DNA, 15 bp, Homo sapiens
ggtcgtgggaaaggg

SEQ ID NO: 4604095 - DNA, 19 bp, Homo sapiens
ggtcgtgggaaaggggagt

SEQ ID NO: 4604096 - DNA, 22 bp, Homo sapiens
ggtcgtgggaaaggggagtagg

SEQ ID NO: 4604097 - DNA, 12 bp, Homo sapiens
ggtctgttcttt

SEQ ID NO: 4604098 - DNA, 14 bp, Homo sapiens
ggtgccccaggacc

SEQ ID NO: 4604099 - DNA, 15 bp, Homo sapiens
ggtgccccaggacca

SEQ ID NO: 4604100 - DNA, 17 bp, Homo sapiens
ggtgccccaggaccagc

SEQ ID NO: 4604101 - DNA, 20 bp, Homo sapiens
ggtgctaaatggtcgcccag

SEQ ID NO: 4604102 - DNA, 16 bp, Homo sapiens
gttttggaagctctga

SEQ ID NO: 4604103 - DNA, 19 bp, Homo sapiens
gtttttatggcttttgtgc

SEQ ID NO: 4604104 - DNA, 14 bp, Homo sapiens
gtttttcacatttt

SEQ ID NO: 4604105 - DNA, 18 bp, Homo sapiens
taaaaagtattttttcaa

SEQ ID NO: 4604106 - DNA, 16 bp, Homo sapiens
taaaaatctcaaattt

SEQ ID NO: 4604107 - DNA, 17 bp, Homo sapiens
taaaaatctcaaatttc

SEQ ID NO: 4604108 - DNA, 23 bp, Homo sapiens
taaaaatctcaaatttctaaatc

SEQ ID NO: 4604109 - DNA, 18 bp, Homo sapiens
taaaaatggtttaaatgg

SEQ ID NO: 4604110 - DNA, 13 bp, Homo sapiens
taaaacagacact

SEQ ID NO: 4604111 - DNA, 16 bp, Homo sapiens
taaaacattaaaatat

SEQ ID NO: 4604112 - DNA, 19 bp, Homo sapiens
taaaacattaaaatataat

SEQ ID NO: 4604113 - DNA, 14 bp, Homo sapiens
taaaagatacagtt

SEQ ID NO: 4604114 - DNA, 15 bp, Homo sapiens
taaaagcattttgta

SEQ ID NO: 4604115 - DNA, 21 bp, Homo sapiens
taaaataccagccagtaaatg

SEQ ID NO: 4604116 - DNA, 13 bp, Homo sapiens
taaaattatattt

SEQ ID NO: 4604117 - DNA, 20 bp, Homo sapiens
taaacaagaccacgtttcta

SEQ ID NO: 4604118 - DNA, 14 bp, Homo sapiens
taaactaccacctc

SEQ ID NO: 4604119 - DNA, 15 bp, Homo sapiens
taaactctgttgcaa

SEQ ID NO: 4604120 - DNA, 18 bp, Homo sapiens
taaactgtgtacataact

SEQ ID NO: 4604121 - DNA, 18 bp, Homo sapiens
taaacttaatctaaatgg

SEQ ID NO: 4604122 - DNA, 18 bp, Homo sapiens
taaagatatttttatctt

SEQ ID NO: 4604123 - DNA, 21 bp, Homo sapiens
taaagatatttttatctttat

SEQ ID NO: 4604124 - DNA, 22 bp, Homo sapiens
taaagatatttttatctttata

SEQ ID NO: 4604125 - DNA, 16 bp, Homo sapiens
taaagcagcgtttcta

SEQ ID NO: 4604126 - DNA, 15 bp, Homo sapiens
taaaggctacctttg

SEQ ID NO: 4604127 - DNA, 17 bp, Homo sapiens
taaagggactacctctg

SEQ ID NO: 4604128 - DNA, 14 bp, Homo sapiens
taaagtgtattttt

SEQ ID NO: 4604129 - DNA, 22 bp, Homo sapiens
taaagtgtatttttttactaat

SEQ ID NO: 4604130 - DNA, 17 bp, Homo sapiens
taaataatttatttaat

SEQ ID NO: 4604131 - DNA, 15 bp, Homo sapiens
taaatctccaaaata

SEQ ID NO: 4604132 - DNA, 20 bp, Homo sapiens
taaatctccaaaataaaact

SEQ ID NO: 4604133 - DNA, 21 bp, Homo sapiens
taaatctccaaaataaaactt

SEQ ID NO: 4604134 - DNA, 15 bp, Homo sapiens
taaatctgacccagt

SEQ ID NO: 4604135 - DNA, 17 bp, Homo sapiens
taaatctgacccagtgc

SEQ ID NO: 4604136 - DNA, 14 bp, Homo sapiens
taaatgggggtgca

SEQ ID NO: 4604137 - DNA, 17 bp, Homo sapiens
taaatgggggtgcattt

SEQ ID NO: 4604138 - DNA, 19 bp, Homo sapiens
taaatgggggtgcatttga

SEQ ID NO: 4604139 - DNA, 22 bp, Homo sapiens
taaattaacttttataaacttt

SEQ ID NO: 4604140 - DNA, 16 bp, Homo sapiens
taaattcttgcaaagt

SEQ ID NO: 4604141 - DNA, 20 bp, Homo sapiens
taaattgacacttaaaaatg

SEQ ID NO: 4604142 - DNA, 23 bp, Homo sapiens
taaattgacacttaaaaatggtt

SEQ ID NO: 4604143 - DNA, 18 bp, Homo sapiens
taaattgttgtaattgca

SEQ ID NO: 4604144 - DNA, 14 bp, Homo sapiens
taaatttttttcct

SEQ ID NO: 4604145 - DNA, 14 bp, Homo sapiens
taacagaaatgtac

SEQ ID NO: 4604146 - DNA, 15 bp, Homo sapiens
taacagaaatgtaca

SEQ ID NO: 4604147 - DNA, 12 bp, Homo sapiens
taactaaaataa

SEQ ID NO: 4604148 - DNA, 20 bp, Homo sapiens
taactaaaataattttgtaa

SEQ ID NO: 4604149 - DNA, 14 bp, Homo sapiens
taactgaaaatgtg

SEQ ID NO: 4604150 - DNA, 21 bp, Homo sapiens
taacttcacatattgatttcc

SEQ ID NO: 4604151 - DNA, 14 bp, Homo sapiens
taacttcaccatat

SEQ ID NO: 4604152 - DNA, 15 bp, Homo sapiens
taacttttataaact

SEQ ID NO: 4604153 - DNA, 18 bp, Homo sapiens
taacttttataaacttta

SEQ ID NO: 4604154 - DNA, 16 bp, Homo sapiens
taagaaaaaggatgca

SEQ ID NO: 4604155 - DNA, 23 bp, Homo sapiens
taagaaaaaggatgcacagagtt

SEQ ID NO: 4604156 - DNA, 16 bp, Homo sapiens
taagaaaaatattaat

SEQ ID NO: 4604157 - DNA, 15 bp, Homo sapiens
taagaaatacagact

SEQ ID NO: 4604158 - DNA, 13 bp, Homo sapiens
taagaagtgaaaa

SEQ ID NO: 4604159 - DNA, 11 bp, Homo sapiens
taagacctggc

SEQ ID NO: 4604160 - DNA, 21 bp, Homo sapiens
taagagttagtttctttggga

SEQ ID NO: 4604161 - DNA, 13 bp, Homo sapiens
taagccagacatc

SEQ ID NO: 4604162 - DNA, 20 bp, Homo sapiens
taagccagacatcaacagat

SEQ ID NO: 4604163 - DNA, 19 bp, Homo sapiens
taaggatgcttgtacataa

SEQ ID NO: 4604164 - DNA, 21 bp, Homo sapiens
taaggatgcttgtacataatg

SEQ ID NO: 4604165 - DNA, 23 bp, Homo sapiens
taaggatgcttgtacataatgcg

SEQ ID NO: 4604166 - DNA, 18 bp, Homo sapiens
taagtgctgcatttaaaa

SEQ ID NO: 4604167 - DNA, 17 bp, Homo sapiens
taagttagttccactga

SEQ ID NO: 4604168 - DNA, 16 bp, Homo sapiens
taataaaaagattgaa

SEQ ID NO: 4604169 - DNA, 16 bp, Homo sapiens
taatacaccactacat

SEQ ID NO: 4604170 - DNA, 19 bp, Homo sapiens
taatacaccactacattct

SEQ ID NO: 4604171 - DNA, 22 bp, Homo sapiens
taatacagcaacaatttatgaa

SEQ ID NO: 4604172 - DNA, 14 bp, Homo sapiens
taatagacaattta

SEQ ID NO: 4604173 - DNA, 18 bp, Homo sapiens
taatagacaatttattat

SEQ ID NO: 4604174 - DNA, 15 bp, Homo sapiens
taatcacgctttcct

SEQ ID NO: 4604175 - DNA, 19 bp, Homo sapiens
taatccaggcagatccagg

SEQ ID NO: 4604176 - DNA, 11 bp, Homo sapiens
taatctaaatg

SEQ ID NO: 4604177 - DNA, 13 bp, Homo sapiens
taatctaaatgga

SEQ ID NO: 4604178 - DNA, 15 bp, Homo sapiens
taatgacaggcctgt

SEQ ID NO: 4604179 - DNA, 20 bp, Homo sapiens
taatgacaggcctgtccaac

SEQ ID NO: 4604180 - DNA, 19 bp, Homo sapiens
taatgccactaaattgaca

SEQ ID NO: 4604181 - DNA, 15 bp, Homo sapiens
taatgcgtgcatacc

SEQ ID NO: 4604182 - DNA, 19 bp, Homo sapiens
taatgcgtgcataccactt

SEQ ID NO: 4604183 - DNA, 22 bp, Homo sapiens
taatgcgtgcataccacttttg

SEQ ID NO: 4604184 - DNA, 23 bp, Homo sapiens
taatgcgtgcataccacttttgt

SEQ ID NO: 4604185 - DNA, 19 bp, Homo sapiens
taatgtatcaaatacattt

SEQ ID NO: 4604186 - DNA, 20 bp, Homo sapiens
taatgtgaaactggattaaa

SEQ ID NO: 4604187 - DNA, 20 bp, Homo sapiens
taatttgaaggtagaatgtt

SEQ ID NO: 4604188 - DNA, 15 bp, Homo sapiens
taatttgtgatacaa

SEQ ID NO: 4604189 - DNA, 12 bp, Homo sapiens
taatttgtgcct

SEQ ID NO: 4604190 - DNA, 12 bp, Homo sapiens
taattttgtaat

SEQ ID NO: 4604191 - DNA, 19 bp, Homo sapiens
taattttgtgtaagaaata

SEQ ID NO: 4604192 - DNA, 13 bp, Homo sapiens
tacaatgctgtgc

SEQ ID NO: 4604193 - DNA, 16 bp, Homo sapiens
tacaatgctgtgccct

SEQ ID NO: 4604194 - DNA, 22 bp, Homo sapiens
tacacactgcatgtttgtgatt

SEQ ID NO: 4604195 - DNA, 23 bp, Homo sapiens
tacacattttattttattatgca

SEQ ID NO: 4604196 - DNA, 14 bp, Homo sapiens
tacactgtttcaaa

SEQ ID NO: 4604197 - DNA, 22 bp, Homo sapiens
tacactgtttcaaactttacta

SEQ ID NO: 4604198 - DNA, 19 bp, Homo sapiens
tacagactggatgtaccac

SEQ ID NO: 4604199 - DNA, 17 bp, Homo sapiens
tacagagacagaaagca

SEQ ID NO: 4604200 - DNA, 21 bp, Homo sapiens
tacagtttgttagtatgaggc

SEQ ID NO: 4604201 - DNA, 13 bp, Homo sapiens
tacataactgaaa

SEQ ID NO: 4604202 - DNA, 15 bp, Homo sapiens
tacataactgaaaat

SEQ ID NO: 4604203 - DNA, 15 bp, Homo sapiens
tacataatgcgtgca

SEQ ID NO: 4604204 - DNA, 19 bp, Homo sapiens
tacataatgcgtgcatacc

SEQ ID NO: 4604205 - DNA, 20 bp, Homo sapiens
tacataatgcgtgcatacca

SEQ ID NO: 4604206 - DNA, 23 bp, Homo sapiens
tacataatgcgtgcataccactt

SEQ ID NO: 4604207 - DNA, 24 bp, Homo sapiens
tacataatgcgtgcataccacttt

SEQ ID NO: 4604208 - DNA, 23 bp, Homo sapiens
tacatgaaaacacatttttctta

SEQ ID NO: 4604209 - DNA, 15 bp, Homo sapiens
tacattcaatgttta

SEQ ID NO: 4604210 - DNA, 12 bp, Homo sapiens
tacattctgtta

SEQ ID NO: 4604211 - DNA, 13 bp, Homo sapiens
tacattctgttaa

SEQ ID NO: 4604212 - DNA, 20 bp, Homo sapiens
tacatttaaaacattaaaat

SEQ ID NO: 4604213 - DNA, 23 bp, Homo sapiens
tacatttttaagtgctgcattta

SEQ ID NO: 4604214 - DNA, 13 bp, Homo sapiens
taccacagacata

SEQ ID NO: 4604215 - DNA, 17 bp, Homo sapiens
taccagctgagtctgaa

SEQ ID NO: 4604216 - DNA, 22 bp, Homo sapiens
taccagctgagtctgaattctg

SEQ ID NO: 4604217 - DNA, 19 bp, Homo sapiens
taccagggactgaggggag

SEQ ID NO: 4604218 - DNA, 23 bp, Homo sapiens
tacccaaccagggccccggggcc

SEQ ID NO: 4604219 - DNA, 21 bp, Homo sapiens
tacccacttctaaatagcaat

SEQ ID NO: 4604220 - DNA, 17 bp, Homo sapiens
tacccctttctccagcc

SEQ ID NO: 4604221 - DNA, 15 bp, Homo sapiens
taccctcatgttctt

SEQ ID NO: 4604222 - DNA, 22 bp, Homo sapiens
taccctcttcatggatggggga

SEQ ID NO: 4604223 - DNA, 20 bp, Homo sapiens
tacccttggctcaatcctct

SEQ ID NO: 4604224 - DNA, 21 bp, Homo sapiens
tacctcttgagccttgaactt

SEQ ID NO: 4604225 - DNA, 13 bp, Homo sapiens
taccttttttaga

SEQ ID NO: 4604226 - DNA, 22 bp, Homo sapiens
taccttttttagagttgatact

SEQ ID NO: 4604227 - DNA, 13 bp, Homo sapiens
taccttttttata

SEQ ID NO: 4604228 - DNA, 16 bp, Homo sapiens
taccttttttatacat

SEQ ID NO: 4604229 - DNA, 20 bp, Homo sapiens
taccttttttatacataaac

SEQ ID NO: 4604230 - DNA, 13 bp, Homo sapiens
tacgtacacattt

SEQ ID NO: 4604231 - DNA, 14 bp, Homo sapiens
tacgtacacatttt

SEQ ID NO: 4604232 - DNA, 15 bp, Homo sapiens
tcagttgttatttat

SEQ ID NO: 4604233 - DNA, 20 bp, Homo sapiens
tcagttgttatttattgaaa

SEQ ID NO: 4604234 - DNA, 19 bp, Homo sapiens
tcataaacattttacatgc

SEQ ID NO: 4604235 - DNA, 20 bp, Homo sapiens
tcataagtattatgtctctt

SEQ ID NO: 4604236 - DNA, 21 bp, Homo sapiens
tcatattgtgattctgccttt

SEQ ID NO: 4604237 - DNA, 20 bp, Homo sapiens
tcatattttaaacagaggat

SEQ ID NO: 4604238 - DNA, 15 bp, Homo sapiens
tcatcaactgaatga

SEQ ID NO: 4604239 - DNA, 13 bp, Homo sapiens
tcatgaagcccaa

SEQ ID NO: 4604240 - DNA, 16 bp, Homo sapiens
tcatgatccaactaat

SEQ ID NO: 4604241 - DNA, 23 bp, Homo sapiens
tcatggtggccacggccacagcc

SEQ ID NO: 4604242 - DNA, 11 bp, Homo sapiens
tcatgttctta

SEQ ID NO: 4604243 - DNA, 21 bp, Homo sapiens
tcattaggtgtgactgaattt

SEQ ID NO: 4604244 - DNA, 22 bp, Homo sapiens
tcattaggtgtgactgaatttc

SEQ ID NO: 4604245 - DNA, 23 bp, Homo sapiens
tcattagttttgaagattctatg

SEQ ID NO: 4604246 - DNA, 21 bp, Homo sapiens
tcattctccttgtgttactaa

SEQ ID NO: 4604247 - DNA, 16 bp, Homo sapiens
tcatttgctttggaag

SEQ ID NO: 4604248 - DNA, 15 bp, Homo sapiens
tcattttatgttaag

SEQ ID NO: 4604249 - DNA, 13 bp, Homo sapiens
tcattttttttaa

SEQ ID NO: 4604250 - DNA, 18 bp, Homo sapiens
tcattttttttaagaaaa

SEQ ID NO: 4604251 - DNA, 22 bp, Homo sapiens
tccaaaagattgctgaaatttt

SEQ ID NO: 4604252 - DNA, 16 bp, Homo sapiens
tccaaaataaaacttt

SEQ ID NO: 4604253 - DNA, 17 bp, Homo sapiens
tccaaaataaaactttt

SEQ ID NO: 4604254 - DNA, 12 bp, Homo sapiens
tccacacttctg

SEQ ID NO: 4604255 - DNA, 17 bp, Homo sapiens
tccacagaggacacaga

SEQ ID NO: 4604256 - DNA, 14 bp, Homo sapiens
tccacctacatgag

SEQ ID NO: 4604257 - DNA, 15 bp, Homo sapiens
tccagatgccacaat

SEQ ID NO: 4604258 - DNA, 19 bp, Homo sapiens
tccagccctgactaaacta

SEQ ID NO: 4604259 - DNA, 20 bp, Homo sapiens
tccagcctgagcgacagtga

SEQ ID NO: 4604260 - DNA, 21 bp, Homo sapiens
tccagcctgagcgacagtgag

SEQ ID NO: 4604261 - DNA, 16 bp, Homo sapiens
tccagctccaacctgc

SEQ ID NO: 4604262 - DNA, 13 bp, Homo sapiens
tccaggcagatcc

SEQ ID NO: 4604263 - DNA, 14 bp, Homo sapiens
tccaggcagatcca

SEQ ID NO: 4604264 - DNA, 16 bp, Homo sapiens
tccaggcagatccagg

SEQ ID NO: 4604265 - DNA, 18 bp, Homo sapiens
tccaggcagatccaggac

SEQ ID NO: 4604266 - DNA, 19 bp, Homo sapiens
tccaggcagatccaggact

SEQ ID NO: 4604267 - DNA, 21 bp, Homo sapiens
tccaggcttccacacttctgg

SEQ ID NO: 4604268 - DNA, 15 bp, Homo sapiens
tccagggacagaggc

SEQ ID NO: 4604269 - DNA, 19 bp, Homo sapiens
tccagggacagaggcccca

SEQ ID NO: 4604270 - DNA, 23 bp, Homo sapiens
tccagggacagaggccccagcct

SEQ ID NO: 4604271 - DNA, 14 bp, Homo sapiens
tccagtcattatgt

SEQ ID NO: 4604272 - DNA, 15 bp, Homo sapiens
tccagtcattatgtt

SEQ ID NO: 4604273 - DNA, 21 bp, Homo sapiens
tccagtcattatgttaatatt

SEQ ID NO: 4604274 - DNA, 23 bp, Homo sapiens
tccagtcattatgttaatatttc

SEQ ID NO: 4604275 - DNA, 20 bp, Homo sapiens
tccatgcgtgtttctgactc

SEQ ID NO: 4604276 - DNA, 22 bp, Homo sapiens
tccatgcgtgtttctgactctg

SEQ ID NO: 4604277 - DNA, 22 bp, Homo sapiens
tccattcacagttctttgggcc

SEQ ID NO: 4604278 - DNA, 18 bp, Homo sapiens
tcccaaggaaagccccag

SEQ ID NO: 4604279 - DNA, 13 bp, Homo sapiens
tcccattcctgaa

SEQ ID NO: 4604280 - DNA, 14 bp, Homo sapiens
tcccattcctgaag

SEQ ID NO: 4604281 - DNA, 15 bp, Homo sapiens
tcccattcctgaaga

SEQ ID NO: 4604282 - DNA, 17 bp, Homo sapiens
tcccattcctgaagaac

SEQ ID NO: 4604283 - DNA, 11 bp, Homo sapiens
tccccagagaa

SEQ ID NO: 4604284 - DNA, 22 bp, Homo sapiens
tccccagagaaaggggagccca

SEQ ID NO: 4604285 - DNA, 23 bp, Homo sapiens
tccccagagaaaggggagcccac

SEQ ID NO: 4604286 - DNA, 13 bp, Homo sapiens
tcccccccatgca

SEQ ID NO: 4604287 - DNA, 15 bp, Homo sapiens
tcccctaaagcctca

SEQ ID NO: 4604288 - DNA, 17 bp, Homo sapiens
tcccgactgaccactgg

SEQ ID NO: 4604289 - DNA, 22 bp, Homo sapiens
tccctcaccttggcaccagaca

SEQ ID NO: 4604290 - DNA, 12 bp, Homo sapiens
tccctccccccc

SEQ ID NO: 4604291 - DNA, 21 bp, Homo sapiens
tccctcccccccatgcactgt

SEQ ID NO: 4604292 - DNA, 23 bp, Homo sapiens
tccctgcctctcatcaactgaat

SEQ ID NO: 4604293 - DNA, 15 bp, Homo sapiens
tccctgttccccaga

SEQ ID NO: 4604294 - DNA, 16 bp, Homo sapiens
tccctgttccccagag

SEQ ID NO: 4604295 - DNA, 17 bp, Homo sapiens
tccctttgcccagaaag

SEQ ID NO: 4604296 - DNA, 17 bp, Homo sapiens
tcctagccactcaggag

SEQ ID NO: 4604297 - DNA, 18 bp, Homo sapiens
tcctcagccttgccagag

SEQ ID NO: 4604298 - DNA, 21 bp, Homo sapiens
tcctcagccttgccagagatc

SEQ ID NO: 4604299 - DNA, 16 bp, Homo sapiens
tcctcccgactgacca

SEQ ID NO: 4604300 - DNA, 15 bp, Homo sapiens
tcctctccccagccc

SEQ ID NO: 4604301 - DNA, 18 bp, Homo sapiens
tcctctccccagcccaga

SEQ ID NO: 4604302 - DNA, 14 bp, Homo sapiens
tcctgaagaaccag

SEQ ID NO: 4604303 - DNA, 23 bp, Homo sapiens
tcctgaagaaccagtccccccac

SEQ ID NO: 4604304 - DNA, 13 bp, Homo sapiens
tcctgacacttta

SEQ ID NO: 4604305 - DNA, 18 bp, Homo sapiens
tcctgcccctgagcccat

SEQ ID NO: 4604306 - DNA, 18 bp, Homo sapiens
tcctggaagccagctttc

SEQ ID NO: 4604307 - DNA, 20 bp, Homo sapiens
tcctggaagccagctttccc

SEQ ID NO: 4604308 - DNA, 14 bp, Homo sapiens
tcctggaggcccag

SEQ ID NO: 4604309 - DNA, 21 bp, Homo sapiens
tcctggtgccaatttcaagtt

SEQ ID NO: 4604310 - DNA, 20 bp, Homo sapiens
tcctgtacctcttgagcctt

SEQ ID NO: 4604311 - DNA, 22 bp, Homo sapiens
tcctgtacctcttgagccttga

SEQ ID NO: 4604312 - DNA, 14 bp, Homo sapiens
tcctgtccagctcc

SEQ ID NO: 4604313 - DNA, 17 bp, Homo sapiens
tcctgtctttaaggaaa

SEQ ID NO: 4604314 - DNA, 21 bp, Homo sapiens
tccttcaagaactctgggctg

SEQ ID NO: 4604315 - DNA, 13 bp, Homo sapiens
tccttcagcctga

SEQ ID NO: 4604316 - DNA, 14 bp, Homo sapiens
tcctttctcagccg

SEQ ID NO: 4604317 - DNA, 17 bp, Homo sapiens
tccttttaattttcctg

SEQ ID NO: 4604318 - DNA, 14 bp, Homo sapiens
tcgagtgagacaga

SEQ ID NO: 4604319 - DNA, 18 bp, Homo sapiens
tcggaaaacatgctacac

SEQ ID NO: 4604320 - DNA, 19 bp, Homo sapiens
tcgtgggaaaggggagtag

SEQ ID NO: 4604321 - DNA, 16 bp, Homo sapiens
tctaaaggctaccttt

SEQ ID NO: 4604322 - DNA, 17 bp, Homo sapiens
tctaaaggctacctttg

SEQ ID NO: 4604323 - DNA, 19 bp, Homo sapiens
tctaaaggctacctttgta

SEQ ID NO: 4604324 - DNA, 22 bp, Homo sapiens
tctaaatatcccttggacattt

SEQ ID NO: 4604325 - DNA, 19 bp, Homo sapiens
tctactaaaaatacaaaaa

SEQ ID NO: 4604326 - DNA, 21 bp, Homo sapiens
tctatcaagtattataccttt

SEQ ID NO: 4604327 - DNA, 12 bp, Homo sapiens
tctattcagctt

SEQ ID NO: 4604328 - DNA, 18 bp, Homo sapiens
tctcaaatttctaaatct

SEQ ID NO: 4604329 - DNA, 17 bp, Homo sapiens
tctcacccagaatccct

SEQ ID NO: 4604330 - DNA, 23 bp, Homo sapiens
tctcagtccatgaagatgtagag

SEQ ID NO: 4604331 - DNA, 17 bp, Homo sapiens
tctcatcaactgaatga

SEQ ID NO: 4604332 - DNA, 19 bp, Homo sapiens
tctccaaaataaaactttt

SEQ ID NO: 4604333 - DNA, 15 bp, Homo sapiens
tctccccagcccaga

SEQ ID NO: 4604334 - DNA, 18 bp, Homo sapiens
tctccccagcccagagac

SEQ ID NO: 4604335 - DNA, 19 bp, Homo sapiens
tctccccagcccagagaca

SEQ ID NO: 4604336 - DNA, 15 bp, Homo sapiens
tctcccttttccatg

SEQ ID NO: 4604337 - DNA, 16 bp, Homo sapiens
tctcctgtacctcttg

SEQ ID NO: 4604338 - DNA, 13 bp, Homo sapiens
tctccttgtgtta

SEQ ID NO: 4604339 - DNA, 12 bp, Homo sapiens
tctctaacttca

SEQ ID NO: 4604340 - DNA, 19 bp, Homo sapiens
tctctaacttcaccatatt

SEQ ID NO: 4604341 - DNA, 19 bp, Homo sapiens
tctctagtttgattaaatt

SEQ ID NO: 4604342 - DNA, 22 bp, Homo sapiens
tctctcctgtacctcttgagcc

SEQ ID NO: 4604343 - DNA, 12 bp, Homo sapiens
tctctctgccca

SEQ ID NO: 4604344 - DNA, 21 bp, Homo sapiens
tctcttctgagctatttcatc

SEQ ID NO: 4604345 - DNA, 22 bp, Homo sapiens
tctcttctgagctatttcatct

SEQ ID NO: 4604346 - DNA, 16 bp, Homo sapiens
tctcttggaccctggg

SEQ ID NO: 4604347 - DNA, 19 bp, Homo sapiens
tctcttggaccctgggagt

SEQ ID NO: 4604348 - DNA, 14 bp, Homo sapiens
tctgaactcaaact

SEQ ID NO: 4604349 - DNA, 14 bp, Homo sapiens
tctgacccagtgcc

SEQ ID NO: 4604350 - DNA, 23 bp, Homo sapiens
tctgacccagtgcccccactgac

SEQ ID NO: 4604351 - DNA, 14 bp, Homo sapiens
tctgaggacaagag

SEQ ID NO: 4604352 - DNA, 20 bp, Homo sapiens
tctgcccatcctgcccctga

SEQ ID NO: 4604353 - DNA, 22 bp, Homo sapiens
tctgcctgacagcatcctctct

SEQ ID NO: 4604354 - DNA, 22 bp, Homo sapiens
tctgcctttggggacttttctt

SEQ ID NO: 4604355 - DNA, 23 bp, Homo sapiens
tctggaacccagactcagacatt

SEQ ID NO: 4604356 - DNA, 15 bp, Homo sapiens
tctggaacctcagcc

SEQ ID NO: 4604357 - DNA, 17 bp, Homo sapiens
tctggaacctcagcctg

SEQ ID NO: 4604358 - DNA, 20 bp, Homo sapiens
tctggacagccccaccctgg

SEQ ID NO: 4604359 - DNA, 17 bp, Homo sapiens
tctggagttgatctgga

SEQ ID NO: 4604360 - DNA, 19 bp, Homo sapiens
tctggctatgcatttgaaa

SEQ ID NO: 4604361 - DNA, 16 bp, Homo sapiens
tgccattcacttcata

SEQ ID NO: 4604362 - DNA, 19 bp, Homo sapiens
tgcccaacccttccctcac

SEQ ID NO: 4604363 - DNA, 13 bp, Homo sapiens
tgccccaggacca

SEQ ID NO: 4604364 - DNA, 20 bp, Homo sapiens
tgccccaggaccagctcagg

SEQ ID NO: 4604365 - DNA, 18 bp, Homo sapiens
tgcctctcatcaactgaa

SEQ ID NO: 4604366 - DNA, 21 bp, Homo sapiens
tgcctcttccagtcttcctga

SEQ ID NO: 4604367 - DNA, 16 bp, Homo sapiens
tgcctgacagcatcct

SEQ ID NO: 4604368 - DNA, 16 bp, Homo sapiens
tgcctgccagctgcac

SEQ ID NO: 4604369 - DNA, 20 bp, Homo sapiens
tgccttaccctcatgttctt

SEQ ID NO: 4604370 - DNA, 20 bp, Homo sapiens
tgcgtacgtttcctgagaag

SEQ ID NO: 4604371 - DNA, 13 bp, Homo sapiens
tgctatactgcat

SEQ ID NO: 4604372 - DNA, 13 bp, Homo sapiens
tgctatgaatgat

SEQ ID NO: 4604373 - DNA, 22 bp, Homo sapiens
tgctcagccccagcttatctcc

SEQ ID NO: 4604374 - DNA, 21 bp, Homo sapiens
tgctcatattgtgattctgcc

SEQ ID NO: 4604375 - DNA, 14 bp, Homo sapiens
tgctccagacctga

SEQ ID NO: 4604376 - DNA, 14 bp, Homo sapiens
tgctccagcactca

SEQ ID NO: 4604377 - DNA, 14 bp, Homo sapiens
tgctgacggccagg

SEQ ID NO: 4604378 - DNA, 17 bp, Homo sapiens
tgctgattctcccgttc

SEQ ID NO: 4604379 - DNA, 14 bp, Homo sapiens
tgctgcatttaaaa

SEQ ID NO: 4604380 - DNA, 23 bp, Homo sapiens
tgctgcatttaaaagatacagtt

SEQ ID NO: 4604381 - DNA, 16 bp, Homo sapiens
tgctgctgtacaactt

SEQ ID NO: 4604382 - DNA, 18 bp, Homo sapiens
tgctgctgtacaacttct

SEQ ID NO: 4604383 - DNA, 13 bp, Homo sapiens
tgctggatgctgc

SEQ ID NO: 4604384 - DNA, 13 bp, Homo sapiens
tgctggcccaggg

SEQ ID NO: 4604385 - DNA, 18 bp, Homo sapiens
tgctggcccagggcccag

SEQ ID NO: 4604386 - DNA, 20 bp, Homo sapiens
tgctggcccagggcccagag

SEQ ID NO: 4604387 - DNA, 15 bp, Homo sapiens
tgctgtacaacttct

SEQ ID NO: 4604388 - DNA, 13 bp, Homo sapiens
tgcttaacttcac

SEQ ID NO: 4604389 - DNA, 14 bp, Homo sapiens
tgcttaacttcaca

SEQ ID NO: 4604390 - DNA, 13 bp, Homo sapiens
tgcttgagcccag

SEQ ID NO: 4604391 - DNA, 19 bp, Homo sapiens
tgcttgcctgcgttttgga

SEQ ID NO: 4604392 - DNA, 12 bp, Homo sapiens
tggaacccagac

SEQ ID NO: 4604393 - DNA, 14 bp, Homo sapiens
tggaacccagactc

SEQ ID NO: 4604394 - DNA, 15 bp, Homo sapiens
tggaacctcagcctg

SEQ ID NO: 4604395 - DNA, 16 bp, Homo sapiens
tggaacctcagcctgg

SEQ ID NO: 4604396 - DNA, 13 bp, Homo sapiens
tggaactctgctt

SEQ ID NO: 4604397 - DNA, 18 bp, Homo sapiens
tggaagccagctttccct

SEQ ID NO: 4604398 - DNA, 22 bp, Homo sapiens
tggaagtgtatttattttacag

SEQ ID NO: 4604399 - DNA, 17 bp, Homo sapiens
tggaatggaattggaca

SEQ ID NO: 4604400 - DNA, 14 bp, Homo sapiens
tggaattggacata

SEQ ID NO: 4604401 - DNA, 12 bp, Homo sapiens
tggacagcccca

SEQ ID NO: 4604402 - DNA, 23 bp, Homo sapiens
tggacatagcccaagaacagaaa

SEQ ID NO: 4604403 - DNA, 21 bp, Homo sapiens
tggaccaatagggctgagctc

SEQ ID NO: 4604404 - DNA, 11 bp, Homo sapiens
tggaccctggg

SEQ ID NO: 4604405 - DNA, 15 bp, Homo sapiens
tggaggcccagttca

SEQ ID NO: 4604406 - DNA, 17 bp, Homo sapiens
tggagggaaagccagcc

SEQ ID NO: 4604407 - DNA, 15 bp, Homo sapiens
tggagttgatctgga

SEQ ID NO: 4604408 - DNA, 16 bp, Homo sapiens
tggatatagttttact

SEQ ID NO: 4604409 - DNA, 21 bp, Homo sapiens
tggatgggggaactcagatcc

SEQ ID NO: 4604410 - DNA, 17 bp, Homo sapiens
tggattcatatttaatt

SEQ ID NO: 4604411 - DNA, 19 bp, Homo sapiens
tggattgtgcctaatgtgt

SEQ ID NO: 4604412 - DNA, 15 bp, Homo sapiens
tggatttaacagaaa

SEQ ID NO: 4604413 - DNA, 23 bp, Homo sapiens
tggcacatcagcacgatttctgt

SEQ ID NO: 4604414 - DNA, 14 bp, Homo sapiens
tggcaccagacacc

SEQ ID NO: 4604415 - DNA, 16 bp, Homo sapiens
tggcaccagacaccca

SEQ ID NO: 4604416 - DNA, 11 bp, Homo sapiens
tggcagctctg

SEQ ID NO: 4604417 - DNA, 20 bp, Homo sapiens
tggccaagatcacagtggcc

SEQ ID NO: 4604418 - DNA, 12 bp, Homo sapiens
tggccagacaca

SEQ ID NO: 4604419 - DNA, 14 bp, Homo sapiens
tggcccagggccca

SEQ ID NO: 4604420 - DNA, 16 bp, Homo sapiens
tggcccagggcccaga

SEQ ID NO: 4604421 - DNA, 18 bp, Homo sapiens
tggcccagggcccagagc

SEQ ID NO: 4604422 - DNA, 21 bp, Homo sapiens
tggcccagggcccagagccca

SEQ ID NO: 4604423 - DNA, 22 bp, Homo sapiens
tggcccagggcccagagcccag

SEQ ID NO: 4604424 - DNA, 18 bp, Homo sapiens
tggcccccgacccagctc

SEQ ID NO: 4604425 - DNA, 20 bp, Homo sapiens
tggcctagcatacgtacaca

SEQ ID NO: 4604426 - DNA, 14 bp, Homo sapiens
tggcctgcactaat

SEQ ID NO: 4604427 - DNA, 15 bp, Homo sapiens
tggctatgcatttga

SEQ ID NO: 4604428 - DNA, 17 bp, Homo sapiens
tggctatgcatttgaaa

SEQ ID NO: 4604429 - DNA, 19 bp, Homo sapiens
tggctatgcatttgaaaat

SEQ ID NO: 4604430 - DNA, 16 bp, Homo sapiens
tggctcaatcctctaa

SEQ ID NO: 4604431 - DNA, 23 bp, Homo sapiens
tggctgtggggctaggggctggg

SEQ ID NO: 4604432 - DNA, 15 bp, Homo sapiens
tggcttttgtgcatt

SEQ ID NO: 4604433 - DNA, 20 bp, Homo sapiens
tgggagctcatccctctcac

SEQ ID NO: 4604434 - DNA, 23 bp, Homo sapiens
tgggcacaggccgtcaccctggg

SEQ ID NO: 4604435 - DNA, 23 bp, Homo sapiens
tgggccaacaaagaacactaact

SEQ ID NO: 4604436 - DNA, 13 bp, Homo sapiens
tgggccagacatg

SEQ ID NO: 4604437 - DNA, 16 bp, Homo sapiens
tgggcctgctccagac

SEQ ID NO: 4604438 - DNA, 18 bp, Homo sapiens
tgggcctgctccagacct

SEQ ID NO: 4604439 - DNA, 17 bp, Homo sapiens
tgggctgctacccagaa

SEQ ID NO: 4604440 - DNA, 14 bp, Homo sapiens
tggggacagaccag

SEQ ID NO: 4604441 - DNA, 20 bp, Homo sapiens
tggggatccctcccccccat

SEQ ID NO: 4604442 - DNA, 14 bp, Homo sapiens
tggggccagatcca

SEQ ID NO: 4604443 - DNA, 20 bp, Homo sapiens
tggggccagatccagcctgg

SEQ ID NO: 4604444 - DNA, 21 bp, Homo sapiens
tggggccagatccagcctggg

SEQ ID NO: 4604445 - DNA, 21 bp, Homo sapiens
tgggggaacactgagaaagag

SEQ ID NO: 4604446 - DNA, 18 bp, Homo sapiens
tgggggaactcagatcca

SEQ ID NO: 4604447 - DNA, 18 bp, Homo sapiens
tgggggataccagctgag

SEQ ID NO: 4604448 - DNA, 21 bp, Homo sapiens
tggggttgccctgggggatac

SEQ ID NO: 4604449 - DNA, 16 bp, Homo sapiens
tgggtacttcttgaag

SEQ ID NO: 4604450 - DNA, 19 bp, Homo sapiens
tgggttctgcctgccagct

SEQ ID NO: 4604451 - DNA, 21 bp, Homo sapiens
tgggttctgcctgccagctgc

SEQ ID NO: 4604452 - DNA, 22 bp, Homo sapiens
tgggttctgcctgccagctgca

SEQ ID NO: 4604453 - DNA, 22 bp, Homo sapiens
tggtaagaagccgggaacagac

SEQ ID NO: 4604454 - DNA, 16 bp, Homo sapiens
tggtatatccaaaagc

SEQ ID NO: 4604455 - DNA, 14 bp, Homo sapiens
tggtcaacatttct

SEQ ID NO: 4604456 - DNA, 14 bp, Homo sapiens
tggtcgcccaggag

SEQ ID NO: 4604457 - DNA, 14 bp, Homo sapiens
tggtcttttggtta

SEQ ID NO: 4604458 - DNA, 13 bp, Homo sapiens
tggtgccccagga

SEQ ID NO: 4604459 - DNA, 18 bp, Homo sapiens
tggtgccccaggaccagc

SEQ ID NO: 4604460 - DNA, 23 bp, Homo sapiens
tggtgccccaggaccagctcagg

SEQ ID NO: 4604461 - DNA, 23 bp, Homo sapiens
tggtgtgaccactgcagaagaca

SEQ ID NO: 4604462 - DNA, 17 bp, Homo sapiens
tggttatgaatactttg

SEQ ID NO: 4604463 - DNA, 16 bp, Homo sapiens
tggttgaaaataaaaa

SEQ ID NO: 4604464 - DNA, 15 bp, Homo sapiens
tggtttgtaaattaa

SEQ ID NO: 4604465 - DNA, 12 bp, Homo sapiens
tggttttctgtt

SEQ ID NO: 4604466 - DNA, 15 bp, Homo sapiens
tggttttctgttctt

SEQ ID NO: 4604467 - DNA, 13 bp, Homo sapiens
tgtaaactgtgta

SEQ ID NO: 4604468 - DNA, 14 bp, Homo sapiens
tgtaaactgtgtat

SEQ ID NO: 4604469 - DNA, 17 bp, Homo sapiens
tgtaaattaacttttat

SEQ ID NO: 4604470 - DNA, 15 bp, Homo sapiens
tgtaactaaaataat

SEQ ID NO: 4604471 - DNA, 21 bp, Homo sapiens
tgtaactgtttagatgaatgt

SEQ ID NO: 4604472 - DNA, 17 bp, Homo sapiens
tgtaagaaatacagact

SEQ ID NO: 4604473 - DNA, 12 bp, Homo sapiens
tgtaatgacagg

SEQ ID NO: 4604474 - DNA, 17 bp, Homo sapiens
tgtaatttgtgatacaa

SEQ ID NO: 4604475 - DNA, 15 bp, Homo sapiens
tgtacataactgaaa

SEQ ID NO: 4604476 - DNA, 19 bp, Homo sapiens
tgtacataatgcgtgcata

SEQ ID NO: 4604477 - DNA, 16 bp, Homo sapiens
tgtacatgaaaacaca

SEQ ID NO: 4604478 - DNA, 19 bp, Homo sapiens
tgtacatgaaaacacattt

SEQ ID NO: 4604479 - DNA, 15 bp, Homo sapiens
tgtaccgcaatgtga

SEQ ID NO: 4604480 - DNA, 22 bp, Homo sapiens
tgtacctcttgagccttgaact

SEQ ID NO: 4604481 - DNA, 23 bp, Homo sapiens
tgtagcctcaatcgagtgagaca

SEQ ID NO: 4604482 - DNA, 14 bp, Homo sapiens
tgtatcaaatacat

SEQ ID NO: 4604483 - DNA, 23 bp, Homo sapiens
tgtatcaaatacatttaaaacat

SEQ ID NO: 4604484 - DNA, 13 bp, Homo sapiens
tgtattccaagac

SEQ ID NO: 4604485 - DNA, 20 bp, Homo sapiens
tgtattccaagacatgtctg

SEQ ID NO: 4604486 - DNA, 21 bp, Homo sapiens
tgtcaagaatagcattgtaaa

SEQ ID NO: 4604487 - DNA, 16 bp, Homo sapiens
tgtcactttttatgct

SEQ ID NO: 4604488 - DNA, 18 bp, Homo sapiens
tgtcaggaacagaaggat

SEQ ID NO: 4604489 - DNA, 20 bp, Homo sapiens
tgtcaggaacagaaggatga

SEQ ID NO: 4604490 - DNA, 17 bp, Homo sapiens
tgtcagttgttatttat

SEQ ID NO: 4604491 - DNA, 23 bp, Homo sapiens
tgtcattcgctactatgatttaa

SEQ ID NO: 4604492 - DNA, 12 bp, Homo sapiens
ttccttttaatt

SEQ ID NO: 4604493 - DNA, 15 bp, Homo sapiens
ttcgtttattttcaa

SEQ ID NO: 4604494 - DNA, 22 bp, Homo sapiens
ttctaaatatcccttggacatt

SEQ ID NO: 4604495 - DNA, 19 bp, Homo sapiens
ttctaaatctccaaaataa

SEQ ID NO: 4604496 - DNA, 16 bp, Homo sapiens
ttctatgacacatgca

SEQ ID NO: 4604497 - DNA, 17 bp, Homo sapiens
ttctatgacacatgcaa

SEQ ID NO: 4604498 - DNA, 21 bp, Homo sapiens
ttctatttatttatttattca

SEQ ID NO: 4604499 - DNA, 15 bp, Homo sapiens
ttctccagccctgac

SEQ ID NO: 4604500 - DNA, 21 bp, Homo sapiens
ttctccttgtgttactaagtt

SEQ ID NO: 4604501 - DNA, 17 bp, Homo sapiens
ttctctagtttgattaa

SEQ ID NO: 4604502 - DNA, 14 bp, Homo sapiens
ttctctcctgtacc

SEQ ID NO: 4604503 - DNA, 13 bp, Homo sapiens
ttctctgaggaca

SEQ ID NO: 4604504 - DNA, 16 bp, Homo sapiens
ttctgactctgagcta

SEQ ID NO: 4604505 - DNA, 16 bp, Homo sapiens
ttctgcctgccagctg

SEQ ID NO: 4604506 - DNA, 16 bp, Homo sapiens
ttctgtgcctgaatat

SEQ ID NO: 4604507 - DNA, 23 bp, Homo sapiens
ttcttctgaactcaaactgagga

SEQ ID NO: 4604508 - DNA, 12 bp, Homo sapiens
ttcttgcaaagt

SEQ ID NO: 4604509 - DNA, 23 bp, Homo sapiens
ttcttgcaagcaacaagctattt

SEQ ID NO: 4604510 - DNA, 23 bp, Homo sapiens
ttcttggtttgtaaattaacttt

SEQ ID NO: 4604511 - DNA, 12 bp, Homo sapiens
ttctttctggct

SEQ ID NO: 4604512 - DNA, 20 bp, Homo sapiens
ttctttctggctatgcattt

SEQ ID NO: 4604513 - DNA, 13 bp, Homo sapiens
ttctttgggccag

SEQ ID NO: 4604514 - DNA, 17 bp, Homo sapiens
ttcttttttttttcatt

SEQ ID NO: 4604515 - DNA, 20 bp, Homo sapiens
ttgaaatataggaacttaaa

SEQ ID NO: 4604516 - DNA, 21 bp, Homo sapiens
ttgaaatatggtcttttggtt

SEQ ID NO: 4604517 - DNA, 13 bp, Homo sapiens
ttgaagattctat

SEQ ID NO: 4604518 - DNA, 15 bp, Homo sapiens
ttgaagggccagagc

SEQ ID NO: 4604519 - DNA, 19 bp, Homo sapiens
ttgaagggccagagccagg

SEQ ID NO: 4604520 - DNA, 13 bp, Homo sapiens
ttgaattatcttg

SEQ ID NO: 4604521 - DNA, 18 bp, Homo sapiens
ttgaattatcttggttga

SEQ ID NO: 4604522 - DNA, 22 bp, Homo sapiens
ttgaattatcttggttgaaaat

SEQ ID NO: 4604523 - DNA, 23 bp, Homo sapiens
ttgacactagcccaatgaaatga

SEQ ID NO: 4604524 - DNA, 14 bp, Homo sapiens
ttgacccacaagaa

SEQ ID NO: 4604525 - DNA, 15 bp, Homo sapiens
ttgacctctgcagca

SEQ ID NO: 4604526 - DNA, 13 bp, Homo sapiens
ttgagaccagcct

SEQ ID NO: 4604527 - DNA, 16 bp, Homo sapiens
ttgagccttgaacttt

SEQ ID NO: 4604528 - DNA, 17 bp, Homo sapiens
ttgataacatggaaatg

SEQ ID NO: 4604529 - DNA, 15 bp, Homo sapiens
ttgatactacagttt

SEQ ID NO: 4604530 - DNA, 14 bp, Homo sapiens
ttgatgtaaagatg

SEQ ID NO: 4604531 - DNA, 14 bp, Homo sapiens
ttgattaaagatga

SEQ ID NO: 4604532 - DNA, 15 bp, Homo sapiens
ttgattaaattcttg

SEQ ID NO: 4604533 - DNA, 20 bp, Homo sapiens
ttgattcatattgcatcata

SEQ ID NO: 4604534 - DNA, 19 bp, Homo sapiens
ttgcaagcaacaagctatt

SEQ ID NO: 4604535 - DNA, 13 bp, Homo sapiens
ttgctgcaaacct

SEQ ID NO: 4604536 - DNA, 21 bp, Homo sapiens
ttgctggaataagttcaaatt

SEQ ID NO: 4604537 - DNA, 18 bp, Homo sapiens
ttgcttgagcccaggagt

SEQ ID NO: 4604538 - DNA, 20 bp, Homo sapiens
ttgctttgtgatttttgtaa

SEQ ID NO: 4604539 - DNA, 15 bp, Homo sapiens
ttggaagttttaatc

SEQ ID NO: 4604540 - DNA, 15 bp, Homo sapiens
ttggacattttatgt

SEQ ID NO: 4604541 - DNA, 16 bp, Homo sapiens
ttggacattttatgtc

SEQ ID NO: 4604542 - DNA, 15 bp, Homo sapiens
ttggagagtttcctg

SEQ ID NO: 4604543 - DNA, 21 bp, Homo sapiens
ttggagagtttcctgaaacaa

SEQ ID NO: 4604544 - DNA, 16 bp, Homo sapiens
ttggagggaaagccag

SEQ ID NO: 4604545 - DNA, 18 bp, Homo sapiens
ttggagggaaagccagcc

SEQ ID NO: 4604546 - DNA, 20 bp, Homo sapiens
ttggcaccagacacccagga

SEQ ID NO: 4604547 - DNA, 21 bp, Homo sapiens
ttggcacctaatccaggcaga

SEQ ID NO: 4604548 - DNA, 18 bp, Homo sapiens
ttggctagaggttcaaag

SEQ ID NO: 4604549 - DNA, 23 bp, Homo sapiens
ttggctgagatatgaacatattg

SEQ ID NO: 4604550 - DNA, 14 bp, Homo sapiens
ttgggaattttatt

SEQ ID NO: 4604551 - DNA, 20 bp, Homo sapiens
ttgggagctcatccctctca

SEQ ID NO: 4604552 - DNA, 14 bp, Homo sapiens
ttgggccagacatg

SEQ ID NO: 4604553 - DNA, 20 bp, Homo sapiens
ttgggcctgctccagacctg

SEQ ID NO: 4604554 - DNA, 17 bp, Homo sapiens
ttggggagttaagacct

SEQ ID NO: 4604555 - DNA, 14 bp, Homo sapiens
ttggtttgtaaatt

SEQ ID NO: 4604556 - DNA, 18 bp, Homo sapiens
ttgtaaaagcattttgta

SEQ ID NO: 4604557 - DNA, 19 bp, Homo sapiens
ttgtaaaagcattttgtaa

SEQ ID NO: 4604558 - DNA, 20 bp, Homo sapiens
ttgtaaaatggtgtgaccac

SEQ ID NO: 4604559 - DNA, 16 bp, Homo sapiens
ttgtaaattaactttt

SEQ ID NO: 4604560 - DNA, 21 bp, Homo sapiens
ttgtaactgtttagatgaatg

SEQ ID NO: 4604561 - DNA, 15 bp, Homo sapiens
ttgtaatatgtaaat

SEQ ID NO: 4604562 - DNA, 16 bp, Homo sapiens
ttgtaccgcaatgtga

SEQ ID NO: 4604563 - DNA, 22 bp, Homo sapiens
ttgtcaagaatagcattgtaaa

SEQ ID NO: 4604564 - DNA, 21 bp, Homo sapiens
ttgtcactttttatgctattt

SEQ ID NO: 4604565 - DNA, 21 bp, Homo sapiens
ttgtccaattaatgaagttga

SEQ ID NO: 4604566 - DNA, 15 bp, Homo sapiens
ttgtctcctaaattg

SEQ ID NO: 4604567 - DNA, 16 bp, Homo sapiens
ttgtctcctaaattgt

SEQ ID NO: 4604568 - DNA, 22 bp, Homo sapiens
ttgtgaaggcaggggaatgtat

SEQ ID NO: 4604569 - DNA, 20 bp, Homo sapiens
ttgtgatacaatgctgtgcc

SEQ ID NO: 4604570 - DNA, 19 bp, Homo sapiens
ttgtgattcaatctgtaaa

SEQ ID NO: 4604571 - DNA, 15 bp, Homo sapiens
ttgtgcctaatgtgt

SEQ ID NO: 4604572 - DNA, 18 bp, Homo sapiens
ttgtgcctaatgtgtttg

SEQ ID NO: 4604573 - DNA, 23 bp, Homo sapiens
ttgtggatttaacagaaatgtac

SEQ ID NO: 4604574 - DNA, 18 bp, Homo sapiens
ttgtgtaagaaatacaga

SEQ ID NO: 4604575 - DNA, 21 bp, Homo sapiens
ttgttagtatgaggcatttgt

SEQ ID NO: 4604576 - DNA, 15 bp, Homo sapiens
ttgttatttattgaa

SEQ ID NO: 4604577 - DNA, 19 bp, Homo sapiens
ttgttcttggtttgtaaat

SEQ ID NO: 4604578 - DNA, 23 bp, Homo sapiens
ttgtttaatggtagttttacagt

SEQ ID NO: 4604579 - DNA, 20 bp, Homo sapiens
ttgtttctttctctgaggac

SEQ ID NO: 4604580 - DNA, 11 bp, Homo sapiens
tttaaactttc

SEQ ID NO: 4604581 - DNA, 11 bp, Homo sapiens
tttaaatgcac

SEQ ID NO: 4604582 - DNA, 15 bp, Homo sapiens
tttaaatgtaaagat

SEQ ID NO: 4604583 - DNA, 13 bp, Homo sapiens
tttaacagaaatg

SEQ ID NO: 4604584 - DNA, 22 bp, Homo sapiens
tttaagaaaaaggatgcacaga

SEQ ID NO: 4604585 - DNA, 21 bp, Homo sapiens
tttaaggatgcttgtacataa

SEQ ID NO: 4604586 - DNA, 19 bp, Homo sapiens
tttacaattttttatcatg

SEQ ID NO: 4604587 - DNA, 13 bp, Homo sapiens
tttacccttggct

SEQ ID NO: 4604588 - DNA, 20 bp, Homo sapiens
tttaccttttttatacataa

SEQ ID NO: 4604589 - DNA, 18 bp, Homo sapiens
tttactaatagacaattt

SEQ ID NO: 4604590 - DNA, 13 bp, Homo sapiens
tttagataataca

SEQ ID NO: 4604591 - DNA, 23 bp, Homo sapiens
tttagtgcaaagtataaaattat

SEQ ID NO: 4604592 - DNA, 16 bp, Homo sapiens
tttatattgttttgtc

SEQ ID NO: 4604593 - DNA, 23 bp, Homo sapiens
tttatcatgcatgtcctgtaaag

SEQ ID NO: 4604594 - DNA, 21 bp, Homo sapiens
tttatcgtcactgcttaactt

SEQ ID NO: 4604595 - DNA, 20 bp, Homo sapiens
tttatggcttttgtgcatta

SEQ ID NO: 4604596 - DNA, 19 bp, Homo sapiens
tttattttacagctcatta

SEQ ID NO: 4604597 - DNA, 12 bp, Homo sapiens
tttcaaacttta

SEQ ID NO: 4604598 - DNA, 19 bp, Homo sapiens
tttcaaatagggtctaact

SEQ ID NO: 4604599 - DNA, 13 bp, Homo sapiens
tttcacctgtaaa

SEQ ID NO: 4604600 - DNA, 12 bp, Homo sapiens
tttcagaaatgt

SEQ ID NO: 4604601 - DNA, 11 bp, Homo sapiens
tttcagactcc

SEQ ID NO: 4604602 - DNA, 14 bp, Homo sapiens
tttcatacacttat

SEQ ID NO: 4604603 - DNA, 14 bp, Homo sapiens
tttccataagctat

SEQ ID NO: 4604604 - DNA, 19 bp, Homo sapiens
tttccatgcgtgtttctga

SEQ ID NO: 4604605 - DNA, 11 bp, Homo sapiens
tttcccaggac

SEQ ID NO: 4604606 - DNA, 18 bp, Homo sapiens
tttcccaggaccctgaag

SEQ ID NO: 4604607 - DNA, 16 bp, Homo sapiens
tttccctgcctctcat

SEQ ID NO: 4604608 - DNA, 21 bp, Homo sapiens
tttctatgacacatgcaaggt

SEQ ID NO: 4604609 - DNA, 18 bp, Homo sapiens
tttctggaatggaattgg

SEQ ID NO: 4604610 - DNA, 19 bp, Homo sapiens
tttctggctatgcatttga

SEQ ID NO: 4604611 - DNA, 13 bp, Homo sapiens
tttctgtgtttag

SEQ ID NO: 4604612 - DNA, 22 bp, Homo sapiens
tttctgtgtttagctatttaat

SEQ ID NO: 4604613 - DNA, 16 bp, Homo sapiens
tttcttaaaccttcag

SEQ ID NO: 4604614 - DNA, 22 bp, Homo sapiens
tttgaaacccctgtaggcctca

SEQ ID NO: 4604615 - DNA, 16 bp, Homo sapiens
tttgaagattctatgt

SEQ ID NO: 4604616 - DNA, 12 bp, Homo sapiens
tttgacctctgc

SEQ ID NO: 4604617 - DNA, 21 bp, Homo sapiens
tttgagagaaatatgaagaac

SEQ ID NO: 4604618 - DNA, 17 bp, Homo sapiens
tttgaggtctgttcttt

SEQ ID NO: 4604619 - DNA, 20 bp, Homo sapiens
tttgatgtaaagatgttctg

SEQ ID NO: 4604620 - DNA, 22 bp, Homo sapiens
tttgcagtacatgggtgactat

SEQ ID NO: 4604621 - DNA, 17 bp, Homo sapiens
tttgcatttaaaacaga

SEQ ID NO: 4604622 - DNA, 20 bp, Homo sapiens
tttgctggagctctgcccat

SEQ ID NO: 4604623 - DNA, 16 bp, Homo sapiens
tttggaaagactggac

SEQ ID NO: 4604624 - DNA, 18 bp, Homo sapiens
tttggagagtttcctgaa

SEQ ID NO: 4604625 - DNA, 21 bp, Homo sapiens
tttgggggggaataagattat

SEQ ID NO: 4604626 - DNA, 14 bp, Homo sapiens
tttgggttctgcct

SEQ ID NO: 4604627 - DNA, 20 bp, Homo sapiens
tttggttatgaatactttgc

SEQ ID NO: 4604628 - DNA, 15 bp, Homo sapiens
tttgtgatacaatgc

SEQ ID NO: 4604629 - DNA, 17 bp, Homo sapiens
tttgtttctttctctga

SEQ ID NO: 4604630 - DNA, 12 bp, Homo sapiens
tttgtttgaact

SEQ ID NO: 4604631 - DNA, 14 bp, Homo sapiens
tttgtttgaactga

SEQ ID NO: 4604632 - DNA, 20 bp, Homo sapiens
ttttaaactgtgtacataac

SEQ ID NO: 4604633 - DNA, 21 bp, Homo sapiens
ttttaaatgcacctggaatat

SEQ ID NO: 4604634 - DNA, 17 bp, Homo sapiens
ttttaagtgctgcattt

SEQ ID NO: 4604635 - DNA, 17 bp, Homo sapiens
ttttacttttaaactgt

SEQ ID NO: 4604636 - DNA, 18 bp, Homo sapiens
ttttacttttaaactgtg

SEQ ID NO: 4604637 - DNA, 14 bp, Homo sapiens
ttttataaacttta

SEQ ID NO: 4604638 - DNA, 19 bp, Homo sapiens
ttttatcgtcactgcttaa

SEQ ID NO: 4604639 - DNA, 13 bp, Homo sapiens
ttttatgttattt

SEQ ID NO: 4604640 - DNA, 13 bp, Homo sapiens
ttttattatgcat

SEQ ID NO: 4604641 - DNA, 15 bp, Homo sapiens
ttttatttgcatgtg

SEQ ID NO: 4604642 - DNA, 11 bp, Homo sapiens
ttttattttat

SEQ ID NO: 4604643 - DNA, 19 bp, Homo sapiens
ttttcagcaaactcttttc

SEQ ID NO: 4604644 - DNA, 16 bp, Homo sapiens
ttttccataagctatt

SEQ ID NO: 4604645 - DNA, 20 bp, Homo sapiens
ttttccatgcgtgtttctga

SEQ ID NO: 4604646 - DNA, 20 bp, Homo sapiens
ttttctggaatggaattgga

SEQ ID NO: 4604647 - DNA, 13 bp, Homo sapiens
ttttgaaatgtca

SEQ ID NO: 4604648 - DNA, 18 bp, Homo sapiens
ttttgcatttaaaacaga

SEQ ID NO: 4604649 - DNA, 17 bp, Homo sapiens
ttttgtaataataaaga

SEQ ID NO: 4604650 - DNA, 18 bp, Homo sapiens
tttttaagtgctgcattt

SEQ ID NO: 4604651 - DNA, 20 bp, Homo sapiens
tttttatggcttttgtgcat

SEQ ID NO: 4604652 - DNA, 19 bp, Homo sapiens
tttttcaagttgtaaataa

SEQ ID NO: 4604653 - DNA, 17 bp, Homo sapiens
tttttgcatttaaaaca

SEQ ID NO: 4604654 - DNA, 15 bp, Homo sapiens
tttttggaagtgaaa

SEQ ID NO: 4604655 - DNA, 11 bp, Homo sapiens
tttttttacta

SEQ ID NO: 4604656 - DNA, 13 bp, Homo sapiens
ttttttttgacaa

SEQ ID NO: 4604657 - DNA, 15 bp, Homo sapiens
aaaaaggatacataa

SEQ ID NO: 4604658 - DNA, 17 bp, Homo sapiens
aaaaaggatacataatg

SEQ ID NO: 4604659 - DNA, 21 bp, Homo sapiens
aaaaatatgaccacactccag

SEQ ID NO: 4604660 - DNA, 22 bp, Homo sapiens
aaaagtccaattttaatttagt

SEQ ID NO: 4604661 - DNA, 14 bp, Homo sapiens
aaaataaatttata

SEQ ID NO: 4604662 - DNA, 20 bp, Homo sapiens
aaaataaatttatatgaaaa

SEQ ID NO: 4604663 - DNA, 19 bp, Homo sapiens
aaaatactttttctaatga

SEQ ID NO: 4604664 - DNA, 12 bp, Homo sapiens
aaaatagaaaag

SEQ ID NO: 4604665 - DNA, 14 bp, Homo sapiens
aaaatatatgtatt

SEQ ID NO: 4604666 - DNA, 12 bp, Homo sapiens
aaaatatttaaa

SEQ ID NO: 4604667 - DNA, 16 bp, Homo sapiens
aaaatatttaaaaatg

SEQ ID NO: 4604668 - DNA, 19 bp, Homo sapiens
aaaatatttaaaaatgtct

SEQ ID NO: 4604669 - DNA, 23 bp, Homo sapiens
aaacaagccaagaaagatgtata

SEQ ID NO: 4604670 - DNA, 13 bp, Homo sapiens
aaagtattgtaaa

SEQ ID NO: 4604671 - DNA, 16 bp, Homo sapiens
aaagtattgtaaatta

SEQ ID NO: 4604672 - DNA, 20 bp, Homo sapiens
aaagtattgtaaattatatt

SEQ ID NO: 4604673 - DNA, 13 bp, Homo sapiens
aaagttatatttc

SEQ ID NO: 4604674 - DNA, 24 bp, Homo sapiens
aaagttatatttcagatgtaatgt

SEQ ID NO: 4604675 - DNA, 11 bp, Homo sapiens
aaatatatgta

SEQ ID NO: 4604676 - DNA, 22 bp, Homo sapiens
aaatatatgtatttttatataa

SEQ ID NO: 4604677 - DNA, 14 bp, Homo sapiens
aaatatttaaaaat

SEQ ID NO: 4604678 - DNA, 17 bp, Homo sapiens
aaatggatgccttgaat

SEQ ID NO: 4604679 - DNA, 20 bp, Homo sapiens
aaatgtacagacatatttaa

SEQ ID NO: 4604680 - DNA, 20 bp, Homo sapiens
aaatgttatcttatactgta

SEQ ID NO: 4604681 - DNA, 21 bp, Homo sapiens
aaatgttatcttatactgtac

SEQ ID NO: 4604682 - DNA, 14 bp, Homo sapiens
aaattttgtaatga

SEQ ID NO: 4604683 - DNA, 15 bp, Homo sapiens
aaattttgtaatgaa

SEQ ID NO: 4604684 - DNA, 18 bp, Homo sapiens
aaattttgtaatgaattc

SEQ ID NO: 4604685 - DNA, 21 bp, Homo sapiens
aacctgcaaaaaatacttttt

SEQ ID NO: 4604686 - DNA, 16 bp, Homo sapiens
aactgaactctgacaa

SEQ ID NO: 4604687 - DNA, 23 bp, Homo sapiens
aactgaactctgacaacagactt

SEQ ID NO: 4604688 - DNA, 23 bp, Homo sapiens
aagaccccttaccactgctctga

SEQ ID NO: 4604689 - DNA, 17 bp, Homo sapiens
aagattcaatcccagga

SEQ ID NO: 4604690 - DNA, 14 bp, Homo sapiens
aagccaagaaagat

SEQ ID NO: 4604691 - DNA, 22 bp, Homo sapiens
aagctgacattgccaaaaagga

SEQ ID NO: 4604692 - DNA, 13 bp, Homo sapiens
aaggacagcccct

SEQ ID NO: 4604693 - DNA, 22 bp, Homo sapiens
aaggaggggaaaaaaatgttgt

SEQ ID NO: 4604694 - DNA, 20 bp, Homo sapiens
aagtattgtaaattatattt

SEQ ID NO: 4604695 - DNA, 21 bp, Homo sapiens
aagtattgtaaattatatttg

SEQ ID NO: 4604696 - DNA, 22 bp, Homo sapiens
aagtattgtaaattatatttgt

SEQ ID NO: 4604697 - DNA, 12 bp, Homo sapiens
aagttaatagat

SEQ ID NO: 4604698 - DNA, 12 bp, Homo sapiens
aagttatatttc

SEQ ID NO: 4604699 - DNA, 23 bp, Homo sapiens
aagttatatttcagatgtaatgt

SEQ ID NO: 4604700 - DNA, 23 bp, Homo sapiens
aataaaaacattgcctttgaatg

SEQ ID NO: 4604701 - DNA, 18 bp, Homo sapiens
aataaatttatatgaaaa

SEQ ID NO: 4604702 - DNA, 14 bp, Homo sapiens
aataagcaggatgt

SEQ ID NO: 4604703 - DNA, 13 bp, Homo sapiens
aatatatgtattt

SEQ ID NO: 4604704 - DNA, 14 bp, Homo sapiens
aatatatgtatttt

SEQ ID NO: 4604705 - DNA, 22 bp, Homo sapiens
aatatatgtatttttatataat

SEQ ID NO: 4604706 - DNA, 22 bp, Homo sapiens
aatatcaaatgcagtatatttc

SEQ ID NO: 4604707 - DNA, 21 bp, Homo sapiens
aatattagtgacctcagcttt

SEQ ID NO: 4604708 - DNA, 16 bp, Homo sapiens
aatgaggagagaaaat

SEQ ID NO: 4604709 - DNA, 15 bp, Homo sapiens
aatgcagtatatttc

SEQ ID NO: 4604710 - DNA, 15 bp, Homo sapiens
aatgtacagacatat

SEQ ID NO: 4604711 - DNA, 21 bp, Homo sapiens
aatgtacagacatatttaact

SEQ ID NO: 4604712 - DNA, 17 bp, Homo sapiens
aatgtcttgctgttgac

SEQ ID NO: 4604713 - DNA, 22 bp, Homo sapiens
aatgttaattttttggtacaaa

SEQ ID NO: 4604714 - DNA, 19 bp, Homo sapiens
aatgttatcttatactgta

SEQ ID NO: 4604715 - DNA, 14 bp, Homo sapiens
aatgttttaaatgt

SEQ ID NO: 4604716 - DNA, 16 bp, Homo sapiens
aatgttttaaatgtac

SEQ ID NO: 4604717 - DNA, 19 bp, Homo sapiens
aatgttttaaatgtacaga

SEQ ID NO: 4604718 - DNA, 13 bp, Homo sapiens
aatgttttctttg

SEQ ID NO: 4604719 - DNA, 17 bp, Homo sapiens
aatgttttctttgcaaa

SEQ ID NO: 4604720 - DNA, 13 bp, Homo sapiens
aattaaaatggat

SEQ ID NO: 4604721 - DNA, 14 bp, Homo sapiens
aattcctagaatta

SEQ ID NO: 4604722 - DNA, 17 bp, Homo sapiens
aattcttttgaattgtt

SEQ ID NO: 4604723 - DNA, 18 bp, Homo sapiens
aatttagaaactaattga

SEQ ID NO: 4604724 - DNA, 16 bp, Homo sapiens
aatttagtaaatgtta

SEQ ID NO: 4604725 - DNA, 14 bp, Homo sapiens
aattttaatttagt

SEQ ID NO: 4604726 - DNA, 20 bp, Homo sapiens
aattttttggtacaaaaata

SEQ ID NO: 4604727 - DNA, 21 bp, Homo sapiens
aattttttggtacaaaaataa

SEQ ID NO: 4604728 - DNA, 12 bp, Homo sapiens
acaagccaagaa

SEQ ID NO: 4604729 - DNA, 21 bp, Homo sapiens
acaaggacagcccctcctcca

SEQ ID NO: 4604730 - DNA, 18 bp, Homo sapiens
acaagtgccgcaaattgt

SEQ ID NO: 4604731 - DNA, 16 bp, Homo sapiens
acaatggtttttaaat

SEQ ID NO: 4604732 - DNA, 18 bp, Homo sapiens
acaatggtttttaaattt

SEQ ID NO: 4604733 - DNA, 21 bp, Homo sapiens
acaccttagcctgccctcctt

SEQ ID NO: 4604734 - DNA, 14 bp, Homo sapiens
acacgctccttcct

SEQ ID NO: 4604735 - DNA, 16 bp, Homo sapiens
acacgctccttcctct

SEQ ID NO: 4604736 - DNA, 17 bp, Homo sapiens
acacgctccttcctctg

SEQ ID NO: 4604737 - DNA, 14 bp, Homo sapiens
acagacttctgaaa

SEQ ID NO: 4604738 - DNA, 16 bp, Homo sapiens
acagcccctcctccat

SEQ ID NO: 4604739 - DNA, 13 bp, Homo sapiens
caaaatatttaaa

SEQ ID NO: 4604740 - DNA, 14 bp, Homo sapiens
caaaatatttaaaa

SEQ ID NO: 4604741 - DNA, 18 bp, Homo sapiens
caaagtattgtaaattat

SEQ ID NO: 4604742 - DNA, 22 bp, Homo sapiens
caaagtattgtaaattatattt

SEQ ID NO: 4604743 - DNA, 16 bp, Homo sapiens
caaatgcagtatattt

SEQ ID NO: 4604744 - DNA, 15 bp, Homo sapiens
caaatgtcttcctgg

SEQ ID NO: 4604745 - DNA, 14 bp, Homo sapiens
caaattcttttgaa

SEQ ID NO: 4604746 - DNA, 21 bp, Homo sapiens
caaatttagaaactaattgac

SEQ ID NO: 4604747 - DNA, 17 bp, Homo sapiens
caagccaagaaagatgt

SEQ ID NO: 4604748 - DNA, 16 bp, Homo sapiens
caagcctgtgcaaaaa

SEQ ID NO: 4604749 - DNA, 17 bp, Homo sapiens
caagtgccgcaaattgt

SEQ ID NO: 4604750 - DNA, 18 bp, Homo sapiens
caagtgccgcaaattgta

SEQ ID NO: 4604751 - DNA, 20 bp, Homo sapiens
caataaaaacattgcctttg

SEQ ID NO: 4604752 - DNA, 18 bp, Homo sapiens
caatggtttttaaatttt

SEQ ID NO: 4604753 - DNA, 22 bp, Homo sapiens
caattgaaggatcatctgaagg

SEQ ID NO: 4604754 - DNA, 18 bp, Homo sapiens
caattttaatttagtaaa

SEQ ID NO: 4604755 - DNA, 14 bp, Homo sapiens
cacactccagctgg

SEQ ID NO: 4604756 - DNA, 13 bp, Homo sapiens
cacatgtggactt

SEQ ID NO: 4604757 - DNA, 22 bp, Homo sapiens
caccaggtgcctttcaaattta

SEQ ID NO: 4604758 - DNA, 18 bp, Homo sapiens
caccataggtcaccttta

SEQ ID NO: 4604759 - DNA, 14 bp, Homo sapiens
cacgcgtatttaca

SEQ ID NO: 4604760 - DNA, 14 bp, Homo sapiens
cacgctccttcctc

SEQ ID NO: 4604761 - DNA, 13 bp, Homo sapiens
cacgtgacagccg

SEQ ID NO: 4604762 - DNA, 11 bp, Homo sapiens
cactccagctg

SEQ ID NO: 4604763 - DNA, 15 bp, Homo sapiens
cactccagctgggat

SEQ ID NO: 4604764 - DNA, 12 bp, Homo sapiens
cactttgtaaat

SEQ ID NO: 4604765 - DNA, 17 bp, Homo sapiens
cagacatatttaactgg

SEQ ID NO: 4604766 - DNA, 13 bp, Homo sapiens
cagatgtaatgtt

SEQ ID NO: 4604767 - DNA, 15 bp, Homo sapiens
cagatgtaatgtttt

SEQ ID NO: 4604768 - DNA, 18 bp, Homo sapiens
cagcaaaaaagtccaatt

SEQ ID NO: 4604769 - DNA, 22 bp, Homo sapiens
cagctttaaaaaattaatctgg

SEQ ID NO: 4604770 - DNA, 14 bp, Homo sapiens
caggaagcagcttt

SEQ ID NO: 4604771 - DNA, 15 bp, Homo sapiens
caggtgcctttcaaa

SEQ ID NO: 4604772 - DNA, 24 bp, Homo sapiens
cagtatccatgctcttgaccttgt

SEQ ID NO: 4604773 - DNA, 15 bp, Homo sapiens
cagtgccctccagga

SEQ ID NO: 4604774 - DNA, 17 bp, Homo sapiens
cagtttttggagtgtta

SEQ ID NO: 4604775 - DNA, 21 bp, Homo sapiens
catatttaatgttttaaatgt

SEQ ID NO: 4604776 - DNA, 22 bp, Homo sapiens
catatttaatgttttaaatgta

SEQ ID NO: 4604777 - DNA, 22 bp, Homo sapiens
catcatgctggaacctgcaaaa

SEQ ID NO: 4604778 - DNA, 22 bp, Homo sapiens
catgctggaacctgcaaaaaat

SEQ ID NO: 4604779 - DNA, 23 bp, Homo sapiens
catgctggaacctgcaaaaaata

SEQ ID NO: 4604780 - DNA, 14 bp, Homo sapiens
catggccgtgaact

SEQ ID NO: 4604781 - DNA, 15 bp, Homo sapiens
catggtgtgttacac

SEQ ID NO: 4604782 - DNA, 14 bp, Homo sapiens
catgtctcgactca

SEQ ID NO: 4604783 - DNA, 13 bp, Homo sapiens
cattatgatgtgt

SEQ ID NO: 4604784 - DNA, 18 bp, Homo sapiens
cattctaggtttgcaaga

SEQ ID NO: 4604785 - DNA, 17 bp, Homo sapiens
cattgcctttgaatgtt

SEQ ID NO: 4604786 - DNA, 12 bp, Homo sapiens
ccaaatgcagct

SEQ ID NO: 4604787 - DNA, 13 bp, Homo sapiens
ccaaatgcagctt

SEQ ID NO: 4604788 - DNA, 15 bp, Homo sapiens
ccaaatgcagcttta

SEQ ID NO: 4604789 - DNA, 15 bp, Homo sapiens
ccaagaaagatgtat

SEQ ID NO: 4604790 - DNA, 22 bp, Homo sapiens
ccaattttaatttagtaaatgt

SEQ ID NO: 4604791 - DNA, 17 bp, Homo sapiens
ccacactccagctggga

SEQ ID NO: 4604792 - DNA, 16 bp, Homo sapiens
ccaccaggtgcctttc

SEQ ID NO: 4604793 - DNA, 19 bp, Homo sapiens
ccaccaggtgcctttcaaa

SEQ ID NO: 4604794 - DNA, 21 bp, Homo sapiens
ccaggtgcctttcaaatttag

SEQ ID NO: 4604795 - DNA, 16 bp, Homo sapiens
ccagtgggagatgtta

SEQ ID NO: 4604796 - DNA, 12 bp, Homo sapiens
ccataggtcacc

SEQ ID NO: 4604797 - DNA, 22 bp, Homo sapiens
ccatttcatttgtgccagaatg

SEQ ID NO: 4604798 - DNA, 23 bp, Homo sapiens
cccaagcctacttttgccattga

SEQ ID NO: 4604799 - DNA, 19 bp, Homo sapiens
cccagggtgggaagggcta

SEQ ID NO: 4604800 - DNA, 22 bp, Homo sapiens
cccctcctcctggactcctgca

SEQ ID NO: 4604801 - DNA, 11 bp, Homo sapiens
ccctcctcctg

SEQ ID NO: 4604802 - DNA, 17 bp, Homo sapiens
cccttaccactgctctg

SEQ ID NO: 4604803 - DNA, 18 bp, Homo sapiens
ccgtctctggttcctccc

SEQ ID NO: 4604804 - DNA, 17 bp, Homo sapiens
cctaatatcaaatgcag

SEQ ID NO: 4604805 - DNA, 21 bp, Homo sapiens
cctcactaggcttctggttga

SEQ ID NO: 4604806 - DNA, 15 bp, Homo sapiens
cctcccctcctcctg

SEQ ID NO: 4604807 - DNA, 14 bp, Homo sapiens
cctcctcctggact

SEQ ID NO: 4604808 - DNA, 15 bp, Homo sapiens
cctctgctgatcctc

SEQ ID NO: 4604809 - DNA, 19 bp, Homo sapiens
cctgtcctgcctaaggctg

SEQ ID NO: 4604810 - DNA, 17 bp, Homo sapiens
cctgtgaactgaactct

SEQ ID NO: 4604811 - DNA, 22 bp, Homo sapiens
cctttcaaatttagaaactaat

SEQ ID NO: 4604812 - DNA, 12 bp, Homo sapiens
cgcagctgaagt

SEQ ID NO: 4604813 - DNA, 23 bp, Homo sapiens
cggtgtttaagacatttttggaa

SEQ ID NO: 4604814 - DNA, 13 bp, Homo sapiens
ctaaagttatatt

SEQ ID NO: 4604815 - DNA, 22 bp, Homo sapiens
ctaaagttatatttcagatgta

SEQ ID NO: 4604816 - DNA, 21 bp, Homo sapiens
ctaaggaggggaaaaaaatgt

SEQ ID NO: 4604817 - DNA, 20 bp, Homo sapiens
ctaattgactttagaaagct

SEQ ID NO: 4604818 - DNA, 12 bp, Homo sapiens
ctatagtatttg

SEQ ID NO: 4604819 - DNA, 15 bp, Homo sapiens
ctatagtatttgatt

SEQ ID NO: 4604820 - DNA, 19 bp, Homo sapiens
ctcctcctggactcctgca

SEQ ID NO: 4604821 - DNA, 11 bp, Homo sapiens
ctcctggactc

SEQ ID NO: 4604822 - DNA, 19 bp, Homo sapiens
ctcttcagttaagcctttg

SEQ ID NO: 4604823 - DNA, 23 bp, Homo sapiens
ctcttcagttaagcctttggaaa

SEQ ID NO: 4604824 - DNA, 21 bp, Homo sapiens
ctgacattgccaaaaaggata

SEQ ID NO: 4604825 - DNA, 13 bp, Homo sapiens
ctgcaaaaaatac

SEQ ID NO: 4604826 - DNA, 22 bp, Homo sapiens
ctgcacacgctccttcctctga

SEQ ID NO: 4604827 - DNA, 12 bp, Homo sapiens
ctgggccagaat

SEQ ID NO: 4604828 - DNA, 18 bp, Homo sapiens
ctggtgcactttgtaaat

SEQ ID NO: 4604829 - DNA, 23 bp, Homo sapiens
ctggttaatatttataggtcact

SEQ ID NO: 4604830 - DNA, 13 bp, Homo sapiens
ctggttcctcccc

SEQ ID NO: 4604831 - DNA, 17 bp, Homo sapiens
ctggttgatgcctgtga

SEQ ID NO: 4604832 - DNA, 11 bp, Homo sapiens
ctgtacaataa

SEQ ID NO: 4604833 - DNA, 15 bp, Homo sapiens
ctgtgaactgaactc

SEQ ID NO: 4604834 - DNA, 15 bp, Homo sapiens
ctgttgacatattta

SEQ ID NO: 4604835 - DNA, 16 bp, Homo sapiens
cttaagtttatactct

SEQ ID NO: 4604836 - DNA, 16 bp, Homo sapiens
cttatactgtacaata

SEQ ID NO: 4604837 - DNA, 18 bp, Homo sapiens
cttcagttaagcctttgg

SEQ ID NO: 4604838 - DNA, 13 bp, Homo sapiens
cttcgttcttttt

SEQ ID NO: 4604839 - DNA, 15 bp, Homo sapiens
cttcgttctttttaa

SEQ ID NO: 4604840 - DNA, 14 bp, Homo sapiens
cttctggttgatgc

SEQ ID NO: 4604841 - DNA, 14 bp, Homo sapiens
cttgaataataagc

SEQ ID NO: 4604842 - DNA, 19 bp, Homo sapiens
cttgtcaagcctgtgcaaa

SEQ ID NO: 4604843 - DNA, 14 bp, Homo sapiens
cttgttttctggga

SEQ ID NO: 4604844 - DNA, 11 bp, Homo sapiens
ctttcaaattt

SEQ ID NO: 4604845 - DNA, 14 bp, Homo sapiens
ctttcaaatttaga

SEQ ID NO: 4604846 - DNA, 19 bp, Homo sapiens
ctttcaaatttagaaacta

SEQ ID NO: 4604847 - DNA, 15 bp, Homo sapiens
ctttccccatgtctc

SEQ ID NO: 4604848 - DNA, 14 bp, Homo sapiens
cttttgaattgtta

SEQ ID NO: 4604849 - DNA, 20 bp, Homo sapiens
ctttttctaatgaggagaga

SEQ ID NO: 4604850 - DNA, 16 bp, Homo sapiens
cttttttgttttttca

SEQ ID NO: 4604851 - DNA, 12 bp, Homo sapiens
tatatgtatttt

SEQ ID NO: 4604852 - DNA, 17 bp, Homo sapiens
tatatgtatttttatat

SEQ ID NO: 4604853 - DNA, 21 bp, Homo sapiens
tatcaaatgcagtatatttct

SEQ ID NO: 4604854 - DNA, 23 bp, Homo sapiens
tatcaaatgcagtatatttcttc

SEQ ID NO: 4604855 - DNA, 14 bp, Homo sapiens
tatgaccacactcc

SEQ ID NO: 4604856 - DNA, 19 bp, Homo sapiens
tatgaccacactccagctg

SEQ ID NO: 4604857 - DNA, 19 bp, Homo sapiens
tattagtgacctcagcttt

SEQ ID NO: 4604858 - DNA, 12 bp, Homo sapiens
tatttaaaaatg

SEQ ID NO: 4604859 - DNA, 16 bp, Homo sapiens
tatttaaaaatgtctt

SEQ ID NO: 4604860 - DNA, 23 bp, Homo sapiens
tatttaactggtgcactttgtaa

SEQ ID NO: 4604861 - DNA, 15 bp, Homo sapiens
tatttaatgttttaa

SEQ ID NO: 4604862 - DNA, 17 bp, Homo sapiens
tatttaatgttttaaat

SEQ ID NO: 4604863 - DNA, 18 bp, Homo sapiens
tatttaatgttttaaatg

SEQ ID NO: 4604864 - DNA, 20 bp, Homo sapiens
tatttaatgttttaaatgta

SEQ ID NO: 4604865 - DNA, 21 bp, Homo sapiens
tatttgattcaaaatatttaa

SEQ ID NO: 4604866 - DNA, 19 bp, Homo sapiens
tatttttatataatatcta

SEQ ID NO: 4604867 - DNA, 22 bp, Homo sapiens
tatttttatataatatctaaag

SEQ ID NO: 4604868 - DNA, 12 bp, Homo sapiens
tcaaaatattta

SEQ ID NO: 4604869 - DNA, 13 bp, Homo sapiens
tcaaaatatttaa

SEQ ID NO: 4604870 - DNA, 14 bp, Homo sapiens
tcaaaatatttaaa

SEQ ID NO: 4604871 - DNA, 15 bp, Homo sapiens
tcaaaatatttaaaa

SEQ ID NO: 4604872 - DNA, 21 bp, Homo sapiens
tcaaaatatttaaaaatgtct

SEQ ID NO: 4604873 - DNA, 23 bp, Homo sapiens
tcaaaatatttaaaaatgtcttg

SEQ ID NO: 4604874 - DNA, 23 bp, Homo sapiens
tcaaacggcctcactaggcttct

SEQ ID NO: 4604875 - DNA, 15 bp, Homo sapiens
tcaagcctgtgcaaa

SEQ ID NO: 4604876 - DNA, 18 bp, Homo sapiens
tcaagcctgtgcaaaaaa

SEQ ID NO: 4604877 - DNA, 16 bp, Homo sapiens
tcactaggcttctggt

SEQ ID NO: 4604878 - DNA, 13 bp, Homo sapiens
tcagacttgtcaa

SEQ ID NO: 4604879 - DNA, 21 bp, Homo sapiens
tcagaggggaataaactgttg

SEQ ID NO: 4604880 - DNA, 14 bp, Homo sapiens
tcagatgtaatgtt

SEQ ID NO: 4604881 - DNA, 17 bp, Homo sapiens
tcagatgtaatgttttc

SEQ ID NO: 4604882 - DNA, 17 bp, Homo sapiens
tcagtatccatgctctt

SEQ ID NO: 4604883 - DNA, 13 bp, Homo sapiens
tcatccatccagg

SEQ ID NO: 4604884 - DNA, 18 bp, Homo sapiens
tcatctagcgcaattgaa

SEQ ID NO: 4604885 - DNA, 19 bp, Homo sapiens
tcatgctggaacctgcaaa

SEQ ID NO: 4604886 - DNA, 20 bp, Homo sapiens
tcatgctggaacctgcaaaa

SEQ ID NO: 4604887 - DNA, 18 bp, Homo sapiens
tcatttgtgccagaatgc

SEQ ID NO: 4604888 - DNA, 15 bp, Homo sapiens
tccaattttaattta

SEQ ID NO: 4604889 - DNA, 22 bp, Homo sapiens
tcctcccctcctcctggactcc

SEQ ID NO: 4604890 - DNA, 22 bp, Homo sapiens
tcctgcacacgctccttcctct

SEQ ID NO: 4604891 - DNA, 17 bp, Homo sapiens
tcctggatgtttggaaa

SEQ ID NO: 4604892 - DNA, 16 bp, Homo sapiens
tccttcctctgaggct

SEQ ID NO: 4604893 - DNA, 14 bp, Homo sapiens
tcgttctttttaag

SEQ ID NO: 4604894 - DNA, 18 bp, Homo sapiens
tcgttctttttaagttaa

SEQ ID NO: 4604895 - DNA, 17 bp, Homo sapiens
tctaaagttatatttca

SEQ ID NO: 4604896 - DNA, 15 bp, Homo sapiens
tctgacaacagactt

SEQ ID NO: 4604897 - DNA, 15 bp, Homo sapiens
tctgggccagaattt

SEQ ID NO: 4604898 - DNA, 20 bp, Homo sapiens
tctgtcaagagtagttatat

SEQ ID NO: 4604899 - DNA, 20 bp, Homo sapiens
tcttcagttaagcctttgga

SEQ ID NO: 4604900 - DNA, 14 bp, Homo sapiens
tcttgctgttgaca

SEQ ID NO: 4604901 - DNA, 15 bp, Homo sapiens
tcttgctgttgacat

SEQ ID NO: 4604902 - DNA, 21 bp, Homo sapiens
tcttgctgttgacatatttaa

SEQ ID NO: 4604903 - DNA, 12 bp, Homo sapiens
tctttgcaaagt

SEQ ID NO: 4604904 - DNA, 15 bp, Homo sapiens
tctttgcaaagtatt

SEQ ID NO: 4604905 - DNA, 23 bp, Homo sapiens
tctttgcaaagtattgtaaatta

SEQ ID NO: 4604906 - DNA, 21 bp, Homo sapiens
tgaaatctgtcaagagtagtt

SEQ ID NO: 4604907 - DNA, 12 bp, Homo sapiens
tgaagcctttgt

SEQ ID NO: 4604908 - DNA, 16 bp, Homo sapiens
tgaataataagcagga

SEQ ID NO: 4604909 - DNA, 16 bp, Homo sapiens
tgaatgttaatttttt

SEQ ID NO: 4604910 - DNA, 16 bp, Homo sapiens
tgaattcctagaatta

SEQ ID NO: 4604911 - DNA, 19 bp, Homo sapiens
tgacaacagacttctgaaa

SEQ ID NO: 4604912 - DNA, 13 bp, Homo sapiens
tgacatatttaat

SEQ ID NO: 4604913 - DNA, 18 bp, Homo sapiens
tgacatatttaatgtttt

SEQ ID NO: 4604914 - DNA, 22 bp, Homo sapiens
tgacatatttaatgttttaaat

SEQ ID NO: 4604915 - DNA, 23 bp, Homo sapiens
tgacatatttaatgttttaaatg

SEQ ID NO: 4604916 - DNA, 12 bp, Homo sapiens
tgaccacactcc

SEQ ID NO: 4604917 - DNA, 17 bp, Homo sapiens
tgaccacactccagctg

SEQ ID NO: 4604918 - DNA, 19 bp, Homo sapiens
tgaccacactccagctggg

SEQ ID NO: 4604919 - DNA, 16 bp, Homo sapiens
tgacctcagctttgat

SEQ ID NO: 4604920 - DNA, 22 bp, Homo sapiens
tgaccttatgagaaactgcatg

SEQ ID NO: 4604921 - DNA, 22 bp, Homo sapiens
tgagtttgggccccagaggctg

SEQ ID NO: 4604922 - DNA, 23 bp, Homo sapiens
tgagtttgggccccagaggctgg

SEQ ID NO: 4604923 - DNA, 14 bp, Homo sapiens
tgatgaagaggagt

SEQ ID NO: 4604924 - DNA, 15 bp, Homo sapiens
tgatgcctgtgaact

SEQ ID NO: 4604925 - DNA, 14 bp, Homo sapiens
tgattcaaaatatt

SEQ ID NO: 4604926 - DNA, 17 bp, Homo sapiens
tgattcaaaatatttaa

SEQ ID NO: 4604927 - DNA, 16 bp, Homo sapiens
tgcaaagtattgtaaa

SEQ ID NO: 4604928 - DNA, 15 bp, Homo sapiens
tgcactttgtaaatt

SEQ ID NO: 4604929 - DNA, 14 bp, Homo sapiens
tgcagtatatttct

SEQ ID NO: 4604930 - DNA, 14 bp, Homo sapiens
tgcctgtgaactga

SEQ ID NO: 4604931 - DNA, 17 bp, Homo sapiens
tgcctgtgaactgaact

SEQ ID NO: 4604932 - DNA, 14 bp, Homo sapiens
tgctatagtatttg

SEQ ID NO: 4604933 - DNA, 20 bp, Homo sapiens
tgctatagtatttgattcaa

SEQ ID NO: 4604934 - DNA, 13 bp, Homo sapiens
tgctgtgcaaatg

SEQ ID NO: 4604935 - DNA, 21 bp, Homo sapiens
tgctgttgacatatttaatgt

SEQ ID NO: 4604936 - DNA, 14 bp, Homo sapiens
tgcttgttaactga

SEQ ID NO: 4604937 - DNA, 18 bp, Homo sapiens
tgcttgttaactgagtgc

SEQ ID NO: 4604938 - DNA, 22 bp, Homo sapiens
tggaaacagctcgactttaaaa

SEQ ID NO: 4604939 - DNA, 18 bp, Homo sapiens
tggaaacattttttaaaa

SEQ ID NO: 4604940 - DNA, 19 bp, Homo sapiens
tggaacctgcaaaaaatac

SEQ ID NO: 4604941 - DNA, 15 bp, Homo sapiens
tggactcctgcacac

SEQ ID NO: 4604942 - DNA, 20 bp, Homo sapiens
tggagaggcccggcctctca

SEQ ID NO: 4604943 - DNA, 22 bp, Homo sapiens
tggccaccaggtgcctttcaaa

SEQ ID NO: 4604944 - DNA, 20 bp, Homo sapiens
tgggaacaccataggtcacc

SEQ ID NO: 4604945 - DNA, 14 bp, Homo sapiens
tgggactggcctct

SEQ ID NO: 4604946 - DNA, 19 bp, Homo sapiens
tgggatcacatgtggactt

SEQ ID NO: 4604947 - DNA, 15 bp, Homo sapiens
tggtacaaaaataaa

SEQ ID NO: 4604948 - DNA, 18 bp, Homo sapiens
tggtacaaaaataaattt

SEQ ID NO: 4604949 - DNA, 19 bp, Homo sapiens
tggtacaaaaataaattta

SEQ ID NO: 4604950 - DNA, 15 bp, Homo sapiens
tggtgcactttgtaa

SEQ ID NO: 4604951 - DNA, 15 bp, Homo sapiens
tggtttttaaatttt

SEQ ID NO: 4604952 - DNA, 20 bp, Homo sapiens
tgtacaaggacagcccctcc

SEQ ID NO: 4604953 - DNA, 16 bp, Homo sapiens
tgtatttttatataat

SEQ ID NO: 4604954 - DNA, 20 bp, Homo sapiens
tgtcaagagtagttatataa

SEQ ID NO: 4604955 - DNA, 18 bp, Homo sapiens
tgtcaagcctgtgcaaaa

SEQ ID NO: 4604956 - DNA, 19 bp, Homo sapiens
tgtcttgctgttgacatat

SEQ ID NO: 4604957 - DNA, 20 bp, Homo sapiens
tgtgcaaaaaaattaaaatg

SEQ ID NO: 4604958 - DNA, 17 bp, Homo sapiens
tgtgctatagtatttga

SEQ ID NO: 4604959 - DNA, 16 bp, Homo sapiens
tgtgtgagactactaa

SEQ ID NO: 4604960 - DNA, 19 bp, Homo sapiens
tgttaattttttggtacaa

SEQ ID NO: 4604961 - DNA, 22 bp, Homo sapiens
tgttacacaatggtttttaaat

SEQ ID NO: 4604962 - DNA, 18 bp, Homo sapiens
acagccgtttgttcccca

SEQ ID NO: 4604963 - DNA, 23 bp, Homo sapiens
acataatgggccactgaaatctg

SEQ ID NO: 4604964 - DNA, 13 bp, Homo sapiens
acatatttaactg

SEQ ID NO: 4604965 - DNA, 14 bp, Homo sapiens
acattgccaaaaag

SEQ ID NO: 4604966 - DNA, 23 bp, Homo sapiens
acattgccaaaaaggatacataa

SEQ ID NO: 4604967 - DNA, 13 bp, Homo sapiens
accaggtgccttt

SEQ ID NO: 4604968 - DNA, 14 bp, Homo sapiens
accttagcctgccc

SEQ ID NO: 4604969 - DNA, 13 bp, Homo sapiens
acctttattctgg

SEQ ID NO: 4604970 - DNA, 20 bp, Homo sapiens
accttttttgttttttcaaa

SEQ ID NO: 4604971 - DNA, 17 bp, Homo sapiens
actctgacaacagactt

SEQ ID NO: 4604972 - DNA, 22 bp, Homo sapiens
actctgacaacagacttctgaa

SEQ ID NO: 4604973 - DNA, 20 bp, Homo sapiens
actgaactctgacaacagac

SEQ ID NO: 4604974 - DNA, 14 bp, Homo sapiens
actggcctctgctg

SEQ ID NO: 4604975 - DNA, 23 bp, Homo sapiens
actggcctctgctgatcctccca

SEQ ID NO: 4604976 - DNA, 18 bp, Homo sapiens
actttagaaagctgacat

SEQ ID NO: 4604977 - DNA, 12 bp, Homo sapiens
agaaaagttatt

SEQ ID NO: 4604978 - DNA, 14 bp, Homo sapiens
agaaaatatatgta

SEQ ID NO: 4604979 - DNA, 14 bp, Homo sapiens
agaaagatgtatat

SEQ ID NO: 4604980 - DNA, 20 bp, Homo sapiens
agaaagatgtatataggtgt

SEQ ID NO: 4604981 - DNA, 22 bp, Homo sapiens
agacttgtcaagcctgtgcaaa

SEQ ID NO: 4604982 - DNA, 19 bp, Homo sapiens
agagaaaatatatgtattt

SEQ ID NO: 4604983 - DNA, 21 bp, Homo sapiens
agattttttcagacttgtcaa

SEQ ID NO: 4604984 - DNA, 22 bp, Homo sapiens
agattttttcagacttgtcaag

SEQ ID NO: 4604985 - DNA, 17 bp, Homo sapiens
agccaagaaagatgtat

SEQ ID NO: 4604986 - DNA, 15 bp, Homo sapiens
agcctttggaaacag

SEQ ID NO: 4604987 - DNA, 22 bp, Homo sapiens
agctgggatcacatgtggactt

SEQ ID NO: 4604988 - DNA, 21 bp, Homo sapiens
aggagggagcatcagtgccct

SEQ ID NO: 4604989 - DNA, 20 bp, Homo sapiens
aggccattccccgtctctgg

SEQ ID NO: 4604990 - DNA, 14 bp, Homo sapiens
aggcccggcctctc

SEQ ID NO: 4604991 - DNA, 20 bp, Homo sapiens
aggctgaacttgttttctgg

SEQ ID NO: 4604992 - DNA, 18 bp, Homo sapiens
agggagcatcagtgccct

SEQ ID NO: 4604993 - DNA, 17 bp, Homo sapiens
aggggaaaaaaatgttg

SEQ ID NO: 4604994 - DNA, 21 bp, Homo sapiens
aggggaataaactgttgagtc

SEQ ID NO: 4604995 - DNA, 19 bp, Homo sapiens
aggtcacctttattctggc

SEQ ID NO: 4604996 - DNA, 23 bp, Homo sapiens
agtaaatgttatcttatactgta

SEQ ID NO: 4604997 - DNA, 22 bp, Homo sapiens
agtatatttcttcgttcttttt

SEQ ID NO: 4604998 - DNA, 16 bp, Homo sapiens
agtattgtaaattata

SEQ ID NO: 4604999 - DNA, 19 bp, Homo sapiens
agtccaattttaatttagt

SEQ ID NO: 4605000 - DNA, 18 bp, Homo sapiens
agtgacctcagctttgat

SEQ ID NO: 4605001 - DNA, 17 bp, Homo sapiens
agtgccgcaaattgtac

SEQ ID NO: 4605002 - DNA, 22 bp, Homo sapiens
agttatatttcagatgtaatgt

SEQ ID NO: 4605003 - DNA, 22 bp, Homo sapiens
agtttttggagtgttatgtatt

SEQ ID NO: 4605004 - DNA, 14 bp, Homo sapiens
ataatatctaaagt

SEQ ID NO: 4605005 - DNA, 17 bp, Homo sapiens
ataatgggccactgaaa

SEQ ID NO: 4605006 - DNA, 22 bp, Homo sapiens
ataatgggccactgaaatctgt

SEQ ID NO: 4605007 - DNA, 12 bp, Homo sapiens
ataattgttgaa

SEQ ID NO: 4605008 - DNA, 13 bp, Homo sapiens
atagaaaagttat

SEQ ID NO: 4605009 - DNA, 15 bp, Homo sapiens
atagaaaagttatta

SEQ ID NO: 4605010 - DNA, 21 bp, Homo sapiens
atagtatttgattcaaaatat

SEQ ID NO: 4605011 - DNA, 10 bp, Homo sapiens
atatatgtat

SEQ ID NO: 4605012 - DNA, 21 bp, Homo sapiens
atatcaaatgcagtatatttc

SEQ ID NO: 4605013 - DNA, 15 bp, Homo sapiens
atatctaaagttata

SEQ ID NO: 4605014 - DNA, 19 bp, Homo sapiens
atatctaaagttatatttc

SEQ ID NO: 4605015 - DNA, 21 bp, Homo sapiens
atatctaaagttatatttcag

SEQ ID NO: 4605016 - DNA, 11 bp, Homo sapiens
atatgtatttt

SEQ ID NO: 4605017 - DNA, 16 bp, Homo sapiens
atatttaaaaatgtct

SEQ ID NO: 4605018 - DNA, 13 bp, Homo sapiens
atatttaactggt

SEQ ID NO: 4605019 - DNA, 20 bp, Homo sapiens
atatttaatgttttaaatgt

SEQ ID NO: 4605020 - DNA, 22 bp, Homo sapiens
atatttaatgttttaaatgtac

SEQ ID NO: 4605021 - DNA, 15 bp, Homo sapiens
atatttcagatgtaa

SEQ ID NO: 4605022 - DNA, 18 bp, Homo sapiens
atatttcagatgtaatgt

SEQ ID NO: 4605023 - DNA, 17 bp, Homo sapiens
atcccaggatgtacaag

SEQ ID NO: 4605024 - DNA, 17 bp, Homo sapiens
atctaaagttatatttc

SEQ ID NO: 4605025 - DNA, 18 bp, Homo sapiens
atctgaaggggcaaattc

SEQ ID NO: 4605026 - DNA, 17 bp, Homo sapiens
atctgggccagaatttc

SEQ ID NO: 4605027 - DNA, 21 bp, Homo sapiens
atctgtcaagagtagttatat

SEQ ID NO: 4605028 - DNA, 13 bp, Homo sapiens
atcttatactgta

SEQ ID NO: 4605029 - DNA, 19 bp, Homo sapiens
atcttatactgtacaataa

SEQ ID NO: 4605030 - DNA, 16 bp, Homo sapiens
atgaattcctagaatt

SEQ ID NO: 4605031 - DNA, 15 bp, Homo sapiens
atgaccacactccag

SEQ ID NO: 4605032 - DNA, 21 bp, Homo sapiens
atgctcttgaccttgtagaga

SEQ ID NO: 4605033 - DNA, 21 bp, Homo sapiens
atgctttaggatgtacagtta

SEQ ID NO: 4605034 - DNA, 18 bp, Homo sapiens
atggtttttaaattttgt

SEQ ID NO: 4605035 - DNA, 18 bp, Homo sapiens
atgtacagacatatttaa

SEQ ID NO: 4605036 - DNA, 19 bp, Homo sapiens
atgtacagacatatttaac

SEQ ID NO: 4605037 - DNA, 19 bp, Homo sapiens
atgttaattttttggtaca

SEQ ID NO: 4605038 - DNA, 23 bp, Homo sapiens
atgttaattttttggtacaaaaa

SEQ ID NO: 4605039 - DNA, 21 bp, Homo sapiens
atgttatcttatactgtacaa

SEQ ID NO: 4605040 - DNA, 16 bp, Homo sapiens
atgttgaagcctttgt

SEQ ID NO: 4605041 - DNA, 13 bp, Homo sapiens
attaaaatggatg

SEQ ID NO: 4605042 - DNA, 19 bp, Homo sapiens
attatatttgtgctatagt

SEQ ID NO: 4605043 - DNA, 16 bp, Homo sapiens
attcaaaatatttaaa

SEQ ID NO: 4605044 - DNA, 16 bp, Homo sapiens
attcaaaatgatgtat

SEQ ID NO: 4605045 - DNA, 23 bp, Homo sapiens
attccccgtctctggttcctccc

SEQ ID NO: 4605046 - DNA, 16 bp, Homo sapiens
attcctagaattaaac

SEQ ID NO: 4605047 - DNA, 16 bp, Homo sapiens
attcttttgaattgtt

SEQ ID NO: 4605048 - DNA, 11 bp, Homo sapiens
attgacttctt

SEQ ID NO: 4605049 - DNA, 15 bp, Homo sapiens
attgccaaaaaggat

SEQ ID NO: 4605050 - DNA, 18 bp, Homo sapiens
attgcctttgaatgttaa

SEQ ID NO: 4605051 - DNA, 22 bp, Homo sapiens
attgcctttgaatgttaatttt

SEQ ID NO: 4605052 - DNA, 15 bp, Homo sapiens
attgtaaattatatt

SEQ ID NO: 4605053 - DNA, 13 bp, Homo sapiens
atttaaaaatgtc

SEQ ID NO: 4605054 - DNA, 16 bp, Homo sapiens
atttaaaaatgtcttg

SEQ ID NO: 4605055 - DNA, 18 bp, Homo sapiens
atttaactggtgcacttt

SEQ ID NO: 4605056 - DNA, 12 bp, Homo sapiens
atttaatgtttt

SEQ ID NO: 4605057 - DNA, 21 bp, Homo sapiens
atttaatgttttaaatgtaca

SEQ ID NO: 4605058 - DNA, 23 bp, Homo sapiens
atttaatgttttaaatgtacaga

SEQ ID NO: 4605059 - DNA, 18 bp, Homo sapiens
atttagaaactaattgac

SEQ ID NO: 4605060 - DNA, 11 bp, Homo sapiens
atttatatgaa

SEQ ID NO: 4605061 - DNA, 17 bp, Homo sapiens
atttcagatgtaatgtt

SEQ ID NO: 4605062 - DNA, 20 bp, Homo sapiens
atttccagtgaaatcagtta

SEQ ID NO: 4605063 - DNA, 21 bp, Homo sapiens
atttgtgctatagtatttgat

SEQ ID NO: 4605064 - DNA, 15 bp, Homo sapiens
attttaatttagtaa

SEQ ID NO: 4605065 - DNA, 19 bp, Homo sapiens
attttaatttagtaaatgt

SEQ ID NO: 4605066 - DNA, 20 bp, Homo sapiens
attttaatttagtaaatgtt

SEQ ID NO: 4605067 - DNA, 16 bp, Homo sapiens
attttgtaatgaattc

SEQ ID NO: 4605068 - DNA, 21 bp, Homo sapiens
atttttatataatatctaaag

SEQ ID NO: 4605069 - DNA, 23 bp, Homo sapiens
atttttatataatatctaaagtt

SEQ ID NO: 4605070 - DNA, 20 bp, Homo sapiens
attttttcagacttgtcaag

SEQ ID NO: 4605071 - DNA, 22 bp, Homo sapiens
caaaaaagtccaattttaattt

SEQ ID NO: 4605072 - DNA, 14 bp, Homo sapiens
caaaatagaaaagt

SEQ ID NO: 4605073 - DNA, 10 bp, Homo sapiens
gaaaagttat

SEQ ID NO: 4605074 - DNA, 16 bp, Homo sapiens
gaaaatatatgtattt

SEQ ID NO: 4605075 - DNA, 20 bp, Homo sapiens
gaaactaattgactttagaa

SEQ ID NO: 4605076 - DNA, 21 bp, Homo sapiens
gaaactaattgactttagaaa

SEQ ID NO: 4605077 - DNA, 17 bp, Homo sapiens
gaacacataattcagga

SEQ ID NO: 4605078 - DNA, 11 bp, Homo sapiens
gaagcctttgt

SEQ ID NO: 4605079 - DNA, 14 bp, Homo sapiens
gaataataagcagg

SEQ ID NO: 4605080 - DNA, 16 bp, Homo sapiens
gacaacagacttctga

SEQ ID NO: 4605081 - DNA, 16 bp, Homo sapiens
gacatatttaatgttt

SEQ ID NO: 4605082 - DNA, 17 bp, Homo sapiens
gacatatttaatgtttt

SEQ ID NO: 4605083 - DNA, 18 bp, Homo sapiens
gacatatttaatgtttta

SEQ ID NO: 4605084 - DNA, 18 bp, Homo sapiens
gacattgccaaaaaggat

SEQ ID NO: 4605085 - DNA, 14 bp, Homo sapiens
gaccacactccagc

SEQ ID NO: 4605086 - DNA, 22 bp, Homo sapiens
gaccacactccagctgggatca

SEQ ID NO: 4605087 - DNA, 19 bp, Homo sapiens
gactcatggtgtgttacac

SEQ ID NO: 4605088 - DNA, 19 bp, Homo sapiens
gactttagaaagctgacat

SEQ ID NO: 4605089 - DNA, 17 bp, Homo sapiens
gagagaaaatatatgta

SEQ ID NO: 4605090 - DNA, 21 bp, Homo sapiens
gagagaaaatatatgtatttt

SEQ ID NO: 4605091 - DNA, 16 bp, Homo sapiens
gaggagagaaaatata

SEQ ID NO: 4605092 - DNA, 14 bp, Homo sapiens
gagtgttatgtatt

SEQ ID NO: 4605093 - DNA, 15 bp, Homo sapiens
gagtgttatgtattt

SEQ ID NO: 4605094 - DNA, 21 bp, Homo sapiens
gatgtatgttgaagcctttgt

SEQ ID NO: 4605095 - DNA, 14 bp, Homo sapiens
gattcaaaatattt

SEQ ID NO: 4605096 - DNA, 22 bp, Homo sapiens
gattcaaaatatttaaaaatgt

SEQ ID NO: 4605097 - DNA, 23 bp, Homo sapiens
gattcaaaatatttaaaaatgtc

SEQ ID NO: 4605098 - DNA, 12 bp, Homo sapiens
gcaaaaaatact

SEQ ID NO: 4605099 - DNA, 21 bp, Homo sapiens
gcaaaaaatactttttctaat

SEQ ID NO: 4605100 - DNA, 17 bp, Homo sapiens
gcaaagtattgtaaatt

SEQ ID NO: 4605101 - DNA, 21 bp, Homo sapiens
gcaaagtattgtaaattatat

SEQ ID NO: 4605102 - DNA, 12 bp, Homo sapiens
gcaaattctttt

SEQ ID NO: 4605103 - DNA, 16 bp, Homo sapiens
gcaaattcttttgaat

SEQ ID NO: 4605104 - DNA, 17 bp, Homo sapiens
gcaaattcttttgaatt

SEQ ID NO: 4605105 - DNA, 15 bp, Homo sapiens
gcatcagtgccctcc

SEQ ID NO: 4605106 - DNA, 13 bp, Homo sapiens
gccaaaaaggata

SEQ ID NO: 4605107 - DNA, 16 bp, Homo sapiens
gccaaaaaggatacat

SEQ ID NO: 4605108 - DNA, 19 bp, Homo sapiens
gccaagaaagatgtatata

SEQ ID NO: 4605109 - DNA, 15 bp, Homo sapiens
gccactgaaatctgt

SEQ ID NO: 4605110 - DNA, 15 bp, Homo sapiens
gccagaatttcaaac

SEQ ID NO: 4605111 - DNA, 22 bp, Homo sapiens
gccctgtcctgcctaaggctga

SEQ ID NO: 4605112 - DNA, 22 bp, Homo sapiens
gccgcaaattgtaccttttttg

SEQ ID NO: 4605113 - DNA, 14 bp, Homo sapiens
gccttgaataataa

SEQ ID NO: 4605114 - DNA, 15 bp, Homo sapiens
gcctttcaaatttag

SEQ ID NO: 4605115 - DNA, 14 bp, Homo sapiens
gcctttgaatgtta

SEQ ID NO: 4605116 - DNA, 14 bp, Homo sapiens
gctatagtatttga

SEQ ID NO: 4605117 - DNA, 20 bp, Homo sapiens
gctccttcctctgaggctga

SEQ ID NO: 4605118 - DNA, 18 bp, Homo sapiens
gctcttgaccttgtagag

SEQ ID NO: 4605119 - DNA, 21 bp, Homo sapiens
gctggaacctgcaaaaaatac

SEQ ID NO: 4605120 - DNA, 23 bp, Homo sapiens
gctgttgacatatttaatgtttt

SEQ ID NO: 4605121 - DNA, 16 bp, Homo sapiens
ggaacctgcaaaaaat

SEQ ID NO: 4605122 - DNA, 21 bp, Homo sapiens
ggagcaattacggggtgacct

SEQ ID NO: 4605123 - DNA, 14 bp, Homo sapiens
ggagtgttatgtat

SEQ ID NO: 4605124 - DNA, 23 bp, Homo sapiens
ggatgttggccaccaggtgcctt

SEQ ID NO: 4605125 - DNA, 14 bp, Homo sapiens
ggcaaattcttttg

SEQ ID NO: 4605126 - DNA, 22 bp, Homo sapiens
ggctacaccttagcctgccctc

SEQ ID NO: 4605127 - DNA, 15 bp, Homo sapiens
gggaaaaaaatgttg

SEQ ID NO: 4605128 - DNA, 18 bp, Homo sapiens
ggtttttaaattttgtaa

SEQ ID NO: 4605129 - DNA, 19 bp, Homo sapiens
ggtttttaaattttgtaat

SEQ ID NO: 4605130 - DNA, 19 bp, Homo sapiens
gtaaattatatttgtgcta

SEQ ID NO: 4605131 - DNA, 17 bp, Homo sapiens
gtacagacatatttaac

SEQ ID NO: 4605132 - DNA, 23 bp, Homo sapiens
gtaccttttttgttttttcaaaa

SEQ ID NO: 4605133 - DNA, 12 bp, Homo sapiens
gtattgtaaatt

SEQ ID NO: 4605134 - DNA, 15 bp, Homo sapiens
gtcttgctgttgaca

SEQ ID NO: 4605135 - DNA, 22 bp, Homo sapiens
gtgacatgtgttggcagcctct

SEQ ID NO: 4605136 - DNA, 15 bp, Homo sapiens
gtgagcaggctgtga

SEQ ID NO: 4605137 - DNA, 12 bp, Homo sapiens
gtgcctttcaaa

SEQ ID NO: 4605138 - DNA, 13 bp, Homo sapiens
gtgcctttcaaat

SEQ ID NO: 4605139 - DNA, 18 bp, Homo sapiens
gtgcctttcaaatttaga

SEQ ID NO: 4605140 - DNA, 17 bp, Homo sapiens
gtgggaagggctacacc

SEQ ID NO: 4605141 - DNA, 13 bp, Homo sapiens
gtgttatgtattt

SEQ ID NO: 4605142 - DNA, 14 bp, Homo sapiens
gtgttatgtatttc

SEQ ID NO: 4605143 - DNA, 18 bp, Homo sapiens
gttaattttttggtacaa

SEQ ID NO: 4605144 - DNA, 10 bp, Homo sapiens
gttatatttc

SEQ ID NO: 4605145 - DNA, 15 bp, Homo sapiens
gttatatttcagatg

SEQ ID NO: 4605146 - DNA, 23 bp, Homo sapiens
gttatcttatactgtacaataaa

SEQ ID NO: 4605147 - DNA, 23 bp, Homo sapiens
gttatgtatttcctggatgtttg

SEQ ID NO: 4605148 - DNA, 23 bp, Homo sapiens
gttcctcccctcctcctggactc

SEQ ID NO: 4605149 - DNA, 15 bp, Homo sapiens
gttctttttaagtta

SEQ ID NO: 4605150 - DNA, 17 bp, Homo sapiens
gttctttttaagttaat

SEQ ID NO: 4605151 - DNA, 13 bp, Homo sapiens
gttgaagcctttg

SEQ ID NO: 4605152 - DNA, 18 bp, Homo sapiens
gtttgttccccaagacat

SEQ ID NO: 4605153 - DNA, 13 bp, Homo sapiens
gttttaaatgtac

SEQ ID NO: 4605154 - DNA, 15 bp, Homo sapiens
gttttaaatgtacag

SEQ ID NO: 4605155 - DNA, 18 bp, Homo sapiens
gttttttcaaaatagaaa

SEQ ID NO: 4605156 - DNA, 19 bp, Homo sapiens
taaaaacattgcctttgaa

SEQ ID NO: 4605157 - DNA, 21 bp, Homo sapiens
taaaaacattgcctttgaatg

SEQ ID NO: 4605158 - DNA, 22 bp, Homo sapiens
taaaaagctccaaatgcagctt

SEQ ID NO: 4605159 - DNA, 18 bp, Homo sapiens
taaaatggatgccttgaa

SEQ ID NO: 4605160 - DNA, 18 bp, Homo sapiens
taaatgtacagacatatt

SEQ ID NO: 4605161 - DNA, 21 bp, Homo sapiens
taaatgtacagacatatttaa

SEQ ID NO: 4605162 - DNA, 14 bp, Homo sapiens
taaattttgtaatg

SEQ ID NO: 4605163 - DNA, 20 bp, Homo sapiens
taaggaggggaaaaaaatgt

SEQ ID NO: 4605164 - DNA, 15 bp, Homo sapiens
taatatctaaagtta

SEQ ID NO: 4605165 - DNA, 15 bp, Homo sapiens
taatgttttaaatgt

SEQ ID NO: 4605166 - DNA, 21 bp, Homo sapiens
taatgttttctttgcaaagta

SEQ ID NO: 4605167 - DNA, 16 bp, Homo sapiens
taatttagtaaatgtt

SEQ ID NO: 4605168 - DNA, 20 bp, Homo sapiens
taatttagtaaatgttatct

SEQ ID NO: 4605169 - DNA, 15 bp, Homo sapiens
taattttttggtaca

SEQ ID NO: 4605170 - DNA, 17 bp, Homo sapiens
taattttttggtacaaa

SEQ ID NO: 4605171 - DNA, 15 bp, Homo sapiens
tacaaaaataaattt

SEQ ID NO: 4605172 - DNA, 22 bp, Homo sapiens
tacaaaaataaatttatatgaa

SEQ ID NO: 4605173 - DNA, 22 bp, Homo sapiens
tactcttcagttaagcctttgg

SEQ ID NO: 4605174 - DNA, 12 bp, Homo sapiens
tactttttctaa

SEQ ID NO: 4605175 - DNA, 14 bp, Homo sapiens
tactttttctaatg

SEQ ID NO: 4605176 - DNA, 21 bp, Homo sapiens
tagaaagctgacattgccaaa

SEQ ID NO: 4605177 - DNA, 20 bp, Homo sapiens
tagagaacacgcgtatttac

SEQ ID NO: 4605178 - DNA, 17 bp, Homo sapiens
taggccgttccttcaaa

SEQ ID NO: 4605179 - DNA, 11 bp, Homo sapiens
tagtaaatgtt

SEQ ID NO: 4605180 - DNA, 13 bp, Homo sapiens
tagtaaatgttat

SEQ ID NO: 4605181 - DNA, 20 bp, Homo sapiens
tagtggtttatcagcaaaaa

SEQ ID NO: 4605182 - DNA, 14 bp, Homo sapiens
tataatatctaaag

SEQ ID NO: 4605183 - DNA, 22 bp, Homo sapiens
tatactgtacaataaaaacatt

SEQ ID NO: 4605184 - DNA, 12 bp, Homo sapiens
tatataatatct

SEQ ID NO: 4605185 - DNA, 15 bp, Homo sapiens
tgttagactcatggt

SEQ ID NO: 4605186 - DNA, 19 bp, Homo sapiens
tgttgacatatttaatgtt

SEQ ID NO: 4605187 - DNA, 21 bp, Homo sapiens
tgttgtttcctaatatcaaat

SEQ ID NO: 4605188 - DNA, 14 bp, Homo sapiens
tgttttaaatgtac

SEQ ID NO: 4605189 - DNA, 15 bp, Homo sapiens
tgttttaaatgtaca

SEQ ID NO: 4605190 - DNA, 23 bp, Homo sapiens
tgttttaaatgtacagacatatt

SEQ ID NO: 4605191 - DNA, 16 bp, Homo sapiens
ttaaatgtacagacat

SEQ ID NO: 4605192 - DNA, 16 bp, Homo sapiens
ttaaattttgtaatga

SEQ ID NO: 4605193 - DNA, 23 bp, Homo sapiens
ttaactggtgcactttgtaaatt

SEQ ID NO: 4605194 - DNA, 23 bp, Homo sapiens
ttaagacatttttggaaggggac

SEQ ID NO: 4605195 - DNA, 22 bp, Homo sapiens
ttaatatttataggtcactttg

SEQ ID NO: 4605196 - DNA, 18 bp, Homo sapiens
ttaattttttggtacaaa

SEQ ID NO: 4605197 - DNA, 20 bp, Homo sapiens
ttaattttttggtacaaaaa

SEQ ID NO: 4605198 - DNA, 22 bp, Homo sapiens
ttagactcatggtgtgttacac

SEQ ID NO: 4605199 - DNA, 19 bp, Homo sapiens
ttagtgacctcagctttga

SEQ ID NO: 4605200 - DNA, 17 bp, Homo sapiens
ttatactgtacaataaa

SEQ ID NO: 4605201 - DNA, 18 bp, Homo sapiens
ttatataatatctaaagt

SEQ ID NO: 4605202 - DNA, 20 bp, Homo sapiens
ttatataatatctaaagtta

SEQ ID NO: 4605203 - DNA, 21 bp, Homo sapiens
ttatataatatctaaagttat

SEQ ID NO: 4605204 - DNA, 20 bp, Homo sapiens
ttatcttatactgtacaata

SEQ ID NO: 4605205 - DNA, 22 bp, Homo sapiens
ttatcttatactgtacaataaa

SEQ ID NO: 4605206 - DNA, 13 bp, Homo sapiens
ttatgagaaactg

SEQ ID NO: 4605207 - DNA, 19 bp, Homo sapiens
ttatgtatttcctggatgt

SEQ ID NO: 4605208 - DNA, 13 bp, Homo sapiens
ttcaaaatattta

SEQ ID NO: 4605209 - DNA, 15 bp, Homo sapiens
ttcaaagcaaatgtc

SEQ ID NO: 4605210 - DNA, 15 bp, Homo sapiens
ttcacttacagcacc

SEQ ID NO: 4605211 - DNA, 15 bp, Homo sapiens
ttcagacttgtcaag

SEQ ID NO: 4605212 - DNA, 13 bp, Homo sapiens
ttcagatgtaatg

SEQ ID NO: 4605213 - DNA, 16 bp, Homo sapiens
ttcagatgtaatgttt

SEQ ID NO: 4605214 - DNA, 18 bp, Homo sapiens
ttcagatgtaatgttttc

SEQ ID NO: 4605215 - DNA, 19 bp, Homo sapiens
ttcctaatatcaaatgcag

SEQ ID NO: 4605216 - DNA, 23 bp, Homo sapiens
ttctaatgaggagagaaaatata

SEQ ID NO: 4605217 - DNA, 12 bp, Homo sapiens
ttgaataataag

SEQ ID NO: 4605218 - DNA, 13 bp, Homo sapiens
ttgacatatttaa

SEQ ID NO: 4605219 - DNA, 17 bp, Homo sapiens
ttgacatatttaatgtt

SEQ ID NO: 4605220 - DNA, 18 bp, Homo sapiens
ttgcaaagtattgtaaat

SEQ ID NO: 4605221 - DNA, 16 bp, Homo sapiens
ttggagtgttatgtat

SEQ ID NO: 4605222 - DNA, 18 bp, Homo sapiens
ttgggccccagaggctgg

SEQ ID NO: 4605223 - DNA, 12 bp, Homo sapiens
ttgtaaattata

SEQ ID NO: 4605224 - DNA, 14 bp, Homo sapiens
ttgtaaattatatt

SEQ ID NO: 4605225 - DNA, 13 bp, Homo sapiens
ttgtaaattgtca

SEQ ID NO: 4605226 - DNA, 22 bp, Homo sapiens
ttgtaatgaattcctagaatta

SEQ ID NO: 4605227 - DNA, 15 bp, Homo sapiens
ttgttttactgtctt

SEQ ID NO: 4605228 - DNA, 17 bp, Homo sapiens
ttgttttttcaaaatag

SEQ ID NO: 4605229 - DNA, 17 bp, Homo sapiens
tttaaaaatgtcttgct

SEQ ID NO: 4605230 - DNA, 22 bp, Homo sapiens
tttaactggtgcactttgtaaa

SEQ ID NO: 4605231 - DNA, 23 bp, Homo sapiens
tttaactggtgcactttgtaaat

SEQ ID NO: 4605232 - DNA, 17 bp, Homo sapiens
tttaagttaatagattt

SEQ ID NO: 4605233 - DNA, 15 bp, Homo sapiens
tttaatgttttaaat

SEQ ID NO: 4605234 - DNA, 16 bp, Homo sapiens
tttaatttagtaaatg

SEQ ID NO: 4605235 - DNA, 12 bp, Homo sapiens
tttagtaaatgt

SEQ ID NO: 4605236 - DNA, 14 bp, Homo sapiens
tttatataatatct

SEQ ID NO: 4605237 - DNA, 19 bp, Homo sapiens
tttcaaaatagaaaagtta

SEQ ID NO: 4605238 - DNA, 23 bp, Homo sapiens
tttcaaatttagaaactaattga

SEQ ID NO: 4605239 - DNA, 23 bp, Homo sapiens
tttctaatgaggagagaaaatat

SEQ ID NO: 4605240 - DNA, 14 bp, Homo sapiens
tttctttgcaaagt

SEQ ID NO: 4605241 - DNA, 13 bp, Homo sapiens
tttggtacaaaaa

SEQ ID NO: 4605242 - DNA, 11 bp, Homo sapiens
tttgtaaattc

SEQ ID NO: 4605243 - DNA, 16 bp, Homo sapiens
tttgtgagcaggctgt

SEQ ID NO: 4605244 - DNA, 22 bp, Homo sapiens
ttttaaatgtacagacatattt

SEQ ID NO: 4605245 - DNA, 16 bp, Homo sapiens
ttttaaattttgtaat

SEQ ID NO: 4605246 - DNA, 18 bp, Homo sapiens
ttttaaattttgtaatga

SEQ ID NO: 4605247 - DNA, 15 bp, Homo sapiens
ttttaagttaataga

SEQ ID NO: 4605248 - DNA, 18 bp, Homo sapiens
ttttaagttaatagattt

SEQ ID NO: 4605249 - DNA, 10 bp, Homo sapiens
ttttaattta

SEQ ID NO: 4605250 - DNA, 22 bp, Homo sapiens
ttttatataatatctaaagtta

SEQ ID NO: 4605251 - DNA, 16 bp, Homo sapiens
ttttcagacttgtcaa

SEQ ID NO: 4605252 - DNA, 16 bp, Homo sapiens
ttttgaattgttacat

SEQ ID NO: 4605253 - DNA, 14 bp, Homo sapiens
ttttggtacaaaaa

SEQ ID NO: 4605254 - DNA, 12 bp, Homo sapiens
tttttggtacaa

SEQ ID NO: 4605255 - DNA, 16 bp, Homo sapiens
ttttttggtacaaaaa

SEQ ID NO: 4605256 - DNA, 13 bp, Homo sapiens
aaaaaaatgttgt

SEQ ID NO: 4605257 - DNA, 20 bp, Homo sapiens
aaaaagtccaattttaattt

SEQ ID NO: 4605258 - DNA, 21 bp, Homo sapiens
aaaaatactttttctaatgag

SEQ ID NO: 4605259 - DNA, 21 bp, Homo sapiens
aaaaatgtcttgctgttgaca

SEQ ID NO: 4605260 - DNA, 11 bp, Homo sapiens
aaaaattaaaa

SEQ ID NO: 4605261 - DNA, 17 bp, Homo sapiens
aaaaattaaaatggatg

SEQ ID NO: 4605262 - DNA, 22 bp, Homo sapiens
aaaacattgcctttgaatgtta

SEQ ID NO: 4605263 - DNA, 15 bp, Homo sapiens
aaaaggatacataat

SEQ ID NO: 4605264 - DNA, 16 bp, Homo sapiens
aaaatatatgtatttt

SEQ ID NO: 4605265 - DNA, 22 bp, Homo sapiens
aaaatatgaccacactccagct

SEQ ID NO: 4605266 - DNA, 21 bp, Homo sapiens
aaaatggatgccttgaataat

SEQ ID NO: 4605267 - DNA, 23 bp, Homo sapiens
aaaatggatgccttgaataataa

SEQ ID NO: 4605268 - DNA, 19 bp, Homo sapiens
aaacattgcctttgaatgt

SEQ ID NO: 4605269 - DNA, 13 bp, Homo sapiens
aaagatgtatata

SEQ ID NO: 4605270 - DNA, 13 bp, Homo sapiens
aaagcaaatgtct

SEQ ID NO: 4605271 - DNA, 14 bp, Homo sapiens
aaagtattgtaaat

SEQ ID NO: 4605272 - DNA, 23 bp, Homo sapiens
aaagtattgtaaattatatttgt

SEQ ID NO: 4605273 - DNA, 22 bp, Homo sapiens
aaagttatatttcagatgtaat

SEQ ID NO: 4605274 - DNA, 16 bp, Homo sapiens
aaataaatttatatga

SEQ ID NO: 4605275 - DNA, 15 bp, Homo sapiens
aaatagaaaagttat

SEQ ID NO: 4605276 - DNA, 17 bp, Homo sapiens
aaatagaaaagttatta

SEQ ID NO: 4605277 - DNA, 18 bp, Homo sapiens
aaatgcagtatatttctt

SEQ ID NO: 4605278 - DNA, 21 bp, Homo sapiens
aaatggatgccttgaataata

SEQ ID NO: 4605279 - DNA, 19 bp, Homo sapiens
aaatgtacagacatattta

SEQ ID NO: 4605280 - DNA, 12 bp, Homo sapiens
aaatgtcttgct

SEQ ID NO: 4605281 - DNA, 23 bp, Homo sapiens
aaatgttatcttatactgtacaa

SEQ ID NO: 4605282 - DNA, 14 bp, Homo sapiens
aaattaaaatggat

SEQ ID NO: 4605283 - DNA, 14 bp, Homo sapiens
aaatttatatgaaa

SEQ ID NO: 4605284 - DNA, 16 bp, Homo sapiens
aactctgacaacagac

SEQ ID NO: 4605285 - DNA, 20 bp, Homo sapiens
aactctgacaacagacttct

SEQ ID NO: 4605286 - DNA, 16 bp, Homo sapiens
aactgagtgccttttg

SEQ ID NO: 4605287 - DNA, 20 bp, Homo sapiens
aactggtgcactttgtaaat

SEQ ID NO: 4605288 - DNA, 17 bp, Homo sapiens
aagaaagatgtatatag

SEQ ID NO: 4605289 - DNA, 10 bp, Homo sapiens
aagcctttgt

SEQ ID NO: 4605290 - DNA, 17 bp, Homo sapiens
aagctgacattgccaaa

SEQ ID NO: 4605291 - DNA, 19 bp, Homo sapiens
aaggacagcccctcctcca

SEQ ID NO: 4605292 - DNA, 17 bp, Homo sapiens
aaggaggggaaaaaaat

SEQ ID NO: 4605293 - DNA, 21 bp, Homo sapiens
aaggaggggaaaaaaatgttg

SEQ ID NO: 4605294 - DNA, 14 bp, Homo sapiens
aagtattgtaaatt

SEQ ID NO: 4605295 - DNA, 15 bp, Homo sapiens
aagtattgtaaatta

SEQ ID NO: 4605296 - DNA, 18 bp, Homo sapiens
aagtccaattttaattta

SEQ ID NO: 4605297 - DNA, 16 bp, Homo sapiens
aagtgccgcaaattgt

SEQ ID NO: 4605298 - DNA, 13 bp, Homo sapiens
aagttatatttca

SEQ ID NO: 4605299 - DNA, 17 bp, Homo sapiens
aagttattagtggttta

SEQ ID NO: 4605300 - DNA, 16 bp, Homo sapiens
aatactttttctaatg

SEQ ID NO: 4605301 - DNA, 15 bp, Homo sapiens
aatagaaaagttatt

SEQ ID NO: 4605302 - DNA, 19 bp, Homo sapiens
aatagaaaagttattagtg

SEQ ID NO: 4605303 - DNA, 20 bp, Homo sapiens
aatatcaaatgcagtatatt

SEQ ID NO: 4605304 - DNA, 14 bp, Homo sapiens
aatatctaaagtta

SEQ ID NO: 4605305 - DNA, 17 bp, Homo sapiens
aatatttaaaaatgtct

SEQ ID NO: 4605306 - DNA, 16 bp, Homo sapiens
aatctgggccagaatt

SEQ ID NO: 4605307 - DNA, 17 bp, Homo sapiens
aatctgggccagaattt

SEQ ID NO: 4605308 - DNA, 19 bp, Homo sapiens
aatctgtcaagagtagtta

SEQ ID NO: 4605309 - DNA, 17 bp, Homo sapiens
aatgaattcctagaatt

SEQ ID NO: 4605310 - DNA, 19 bp, Homo sapiens
aatgaggagagaaaatata

SEQ ID NO: 4605311 - DNA, 22 bp, Homo sapiens
aatgaggagagaaaatatatgt

SEQ ID NO: 4605312 - DNA, 17 bp, Homo sapiens
aatggtttttaaatttt

SEQ ID NO: 4605313 - DNA, 22 bp, Homo sapiens
aatgtcttgctgttgacatatt

SEQ ID NO: 4605314 - DNA, 20 bp, Homo sapiens
aatgttaattttttggtaca

SEQ ID NO: 4605315 - DNA, 21 bp, Homo sapiens
aatgttatcttatactgtaca

SEQ ID NO: 4605316 - DNA, 22 bp, Homo sapiens
aatgttttctttgcaaagtatt

SEQ ID NO: 4605317 - DNA, 21 bp, Homo sapiens
aattaaaatggatgccttgaa

SEQ ID NO: 4605318 - DNA, 21 bp, Homo sapiens
aattgttgaacaggtgttttt

SEQ ID NO: 4605319 - DNA, 13 bp, Homo sapiens
aatttagaaacta

SEQ ID NO: 4605320 - DNA, 19 bp, Homo sapiens
aatttagaaactaattgac

SEQ ID NO: 4605321 - DNA, 14 bp, Homo sapiens
aatttatatgaaaa

SEQ ID NO: 4605322 - DNA, 12 bp, Homo sapiens
aattttaattta

SEQ ID NO: 4605323 - DNA, 15 bp, Homo sapiens
aattttttggtacaa

SEQ ID NO: 4605324 - DNA, 17 bp, Homo sapiens
acaagtgccgcaaattg

SEQ ID NO: 4605325 - DNA, 20 bp, Homo sapiens
acaagtgccgcaaattgtac

SEQ ID NO: 4605326 - DNA, 23 bp, Homo sapiens
acacaatggtttttaaattttgt

SEQ ID NO: 4605327 - DNA, 14 bp, Homo sapiens
acagacatatttaa

SEQ ID NO: 4605328 - DNA, 13 bp, Homo sapiens
acagacttctgaa

SEQ ID NO: 4605329 - DNA, 22 bp, Homo sapiens
acataatgggccactgaaatct

SEQ ID NO: 4605330 - DNA, 15 bp, Homo sapiens
acatatttaactggt

SEQ ID NO: 4605331 - DNA, 20 bp, Homo sapiens
acatatttaatgttttaaat

SEQ ID NO: 4605332 - DNA, 21 bp, Homo sapiens
acatatttaatgttttaaatg

SEQ ID NO: 4605333 - DNA, 17 bp, Homo sapiens
acatgtgttggcagcct

SEQ ID NO: 4605334 - DNA, 12 bp, Homo sapiens
acattgcctttg

SEQ ID NO: 4605335 - DNA, 15 bp, Homo sapiens
accactgctctgatg

SEQ ID NO: 4605336 - DNA, 17 bp, Homo sapiens
accactgctctgatgaa

SEQ ID NO: 4605337 - DNA, 18 bp, Homo sapiens
accttatgagaaactgca

SEQ ID NO: 4605338 - DNA, 12 bp, Homo sapiens
acctttattctg

SEQ ID NO: 4605339 - DNA, 12 bp, Homo sapiens
acgcgtatttac

SEQ ID NO: 4605340 - DNA, 23 bp, Homo sapiens
actcctgcacacgctccttcctc

SEQ ID NO: 4605341 - DNA, 18 bp, Homo sapiens
actctgacaacagacttc

SEQ ID NO: 4605342 - DNA, 14 bp, Homo sapiens
actgaaatctgtca

SEQ ID NO: 4605343 - DNA, 16 bp, Homo sapiens
actggcctctgctgat

SEQ ID NO: 4605344 - DNA, 17 bp, Homo sapiens
aggggcaaattcttttg

SEQ ID NO: 4605345 - DNA, 15 bp, Homo sapiens
aggtgcctttcaaat

SEQ ID NO: 4605346 - DNA, 18 bp, Homo sapiens
aggtgcctttcaaattta

SEQ ID NO: 4605347 - DNA, 13 bp, Homo sapiens
agtagttatataa

SEQ ID NO: 4605348 - DNA, 17 bp, Homo sapiens
agtattgtaaattatat

SEQ ID NO: 4605349 - DNA, 14 bp, Homo sapiens
agtccaattttaat

SEQ ID NO: 4605350 - DNA, 16 bp, Homo sapiens
agtgccctccaggata

SEQ ID NO: 4605351 - DNA, 14 bp, Homo sapiens
agtgttatgtattt

SEQ ID NO: 4605352 - DNA, 15 bp, Homo sapiens
agtgttatgtatttc

SEQ ID NO: 4605353 - DNA, 14 bp, Homo sapiens
agttaagcctttgg

SEQ ID NO: 4605354 - DNA, 19 bp, Homo sapiens
agttatatttcagatgtaa

SEQ ID NO: 4605355 - DNA, 23 bp, Homo sapiens
agttatatttcagatgtaatgtt

SEQ ID NO: 4605356 - DNA, 23 bp, Homo sapiens
ataaaaacattgcctttgaatgt

SEQ ID NO: 4605357 - DNA, 15 bp, Homo sapiens
ataaatttatatgaa

SEQ ID NO: 4605358 - DNA, 17 bp, Homo sapiens
ataatatctaaagttat

SEQ ID NO: 4605359 - DNA, 18 bp, Homo sapiens
ataatatctaaagttata

SEQ ID NO: 4605360 - DNA, 20 bp, Homo sapiens
ataatatctaaagttatatt

SEQ ID NO: 4605361 - DNA, 13 bp, Homo sapiens
atactgtacaata

SEQ ID NO: 4605362 - DNA, 20 bp, Homo sapiens
atactgtacaataaaaacat

SEQ ID NO: 4605363 - DNA, 13 bp, Homo sapiens
atactttttctaa

SEQ ID NO: 4605364 - DNA, 18 bp, Homo sapiens
atagacccacaagaggca

SEQ ID NO: 4605365 - DNA, 20 bp, Homo sapiens
atagtatttgattcaaaata

SEQ ID NO: 4605366 - DNA, 22 bp, Homo sapiens
atagtatttgattcaaaatatt

SEQ ID NO: 4605367 - DNA, 12 bp, Homo sapiens
atatcaaatgca

SEQ ID NO: 4605368 - DNA, 14 bp, Homo sapiens
atatctaaagttat

SEQ ID NO: 4605369 - DNA, 16 bp, Homo sapiens
atatctaaagttatat

SEQ ID NO: 4605370 - DNA, 16 bp, Homo sapiens
atatttaactggtgca

SEQ ID NO: 4605371 - DNA, 19 bp, Homo sapiens
atatttcagatgtaatgtt

SEQ ID NO: 4605372 - DNA, 21 bp, Homo sapiens
atatttcagatgtaatgtttt

SEQ ID NO: 4605373 - DNA, 19 bp, Homo sapiens
atatttcttcgttcttttt

SEQ ID NO: 4605374 - DNA, 17 bp, Homo sapiens
atatttgtgctatagta

SEQ ID NO: 4605375 - DNA, 12 bp, Homo sapiens
atcagcaaaaaa

SEQ ID NO: 4605376 - DNA, 13 bp, Homo sapiens
atcagcaaaaaag

SEQ ID NO: 4605377 - DNA, 23 bp, Homo sapiens
atcatctgaaggggcaaattctt

SEQ ID NO: 4605378 - DNA, 12 bp, Homo sapiens
atcctcccaggc

SEQ ID NO: 4605379 - DNA, 18 bp, Homo sapiens
atctaaagttatatttca

SEQ ID NO: 4605380 - DNA, 17 bp, Homo sapiens
atctagcgcaattgaag

SEQ ID NO: 4605381 - DNA, 21 bp, Homo sapiens
atctgaaggggcaaattcttt

SEQ ID NO: 4605382 - DNA, 22 bp, Homo sapiens
atctgtcaagagtagttatata

SEQ ID NO: 4605383 - DNA, 14 bp, Homo sapiens
atgagaaactgcat

SEQ ID NO: 4605384 - DNA, 19 bp, Homo sapiens
atgaggagagaaaatatat

SEQ ID NO: 4605385 - DNA, 23 bp, Homo sapiens
atgatgtatgttgaagcctttgt

SEQ ID NO: 4605386 - DNA, 16 bp, Homo sapiens
atgatgtgtgaaaact

SEQ ID NO: 4605387 - DNA, 15 bp, Homo sapiens
atgccttgaataata

SEQ ID NO: 4605388 - DNA, 18 bp, Homo sapiens
atgctggaacctgcaaaa

SEQ ID NO: 4605389 - DNA, 18 bp, Homo sapiens
atgctttaggatgtacag

SEQ ID NO: 4605390 - DNA, 16 bp, Homo sapiens
atgggccactgaaatc

SEQ ID NO: 4605391 - DNA, 19 bp, Homo sapiens
atgggccactgaaatctgt

SEQ ID NO: 4605392 - DNA, 23 bp, Homo sapiens
atgggccactgaaatctgtcaag

SEQ ID NO: 4605393 - DNA, 23 bp, Homo sapiens
atgtacagacatatttaactggt

SEQ ID NO: 4605394 - DNA, 19 bp, Homo sapiens
atgtatttcctggatgttt

SEQ ID NO: 4605395 - DNA, 13 bp, Homo sapiens
atgtcttcctgga

SEQ ID NO: 4605396 - DNA, 19 bp, Homo sapiens
atgtcttgctgttgacata

SEQ ID NO: 4605397 - DNA, 20 bp, Homo sapiens
atgtcttgctgttgacatat

SEQ ID NO: 4605398 - DNA, 15 bp, Homo sapiens
atgttgaagcctttg

SEQ ID NO: 4605399 - DNA, 18 bp, Homo sapiens
atgttttaaatgtacaga

SEQ ID NO: 4605400 - DNA, 18 bp, Homo sapiens
atgttttctttgcaaagt

SEQ ID NO: 4605401 - DNA, 22 bp, Homo sapiens
attcaaaatatttaaaaatgtc

SEQ ID NO: 4605402 - DNA, 22 bp, Homo sapiens
attcaggaagcagctttcccca

SEQ ID NO: 4605403 - DNA, 16 bp, Homo sapiens
attgccaaaaaggata

SEQ ID NO: 4605404 - DNA, 16 bp, Homo sapiens
attgcctttgaatgtt

SEQ ID NO: 4605405 - DNA, 15 bp, Homo sapiens
atttaaaaatgtctt

SEQ ID NO: 4605406 - DNA, 18 bp, Homo sapiens
atttaaaaatgtcttgct

SEQ ID NO: 4605407 - DNA, 19 bp, Homo sapiens
atttaatgttttaaatgta

SEQ ID NO: 4605408 - DNA, 20 bp, Homo sapiens
atttaatgttttaaatgtac

SEQ ID NO: 4605409 - DNA, 23 bp, Homo sapiens
atttacagccagtgggagatgtt

SEQ ID NO: 4605410 - DNA, 22 bp, Homo sapiens
atttagaaactaattgacttta

SEQ ID NO: 4605411 - DNA, 16 bp, Homo sapiens
atttcaaacggcctca

SEQ ID NO: 4605412 - DNA, 16 bp, Homo sapiens
atttcagatgtaatgt

SEQ ID NO: 4605413 - DNA, 20 bp, Homo sapiens
atttcagatgtaatgttttc

SEQ ID NO: 4605414 - DNA, 17 bp, Homo sapiens
atttcttcgttcttttt

SEQ ID NO: 4605415 - DNA, 15 bp, Homo sapiens
atttgattcaaaata

SEQ ID NO: 4605416 - DNA, 18 bp, Homo sapiens
atttgtgctatagtattt

SEQ ID NO: 4605417 - DNA, 12 bp, Homo sapiens
attttgtaatga

SEQ ID NO: 4605418 - DNA, 17 bp, Homo sapiens
atttttatataatatct

SEQ ID NO: 4605419 - DNA, 18 bp, Homo sapiens
caaaaaagtccaatttta

SEQ ID NO: 4605420 - DNA, 10 bp, Homo sapiens
caaaaataaa

SEQ ID NO: 4605421 - DNA, 12 bp, Homo sapiens
caaaaataaatt

SEQ ID NO: 4605422 - DNA, 14 bp, Homo sapiens
caaaaataaattta

SEQ ID NO: 4605423 - DNA, 17 bp, Homo sapiens
caaaatatttaaaaatg

SEQ ID NO: 4605424 - DNA, 14 bp, Homo sapiens
caaagtattgtaaa

SEQ ID NO: 4605425 - DNA, 16 bp, Homo sapiens
caaagtattgtaaatt

SEQ ID NO: 4605426 - DNA, 19 bp, Homo sapiens
caaagtattgtaaattata

SEQ ID NO: 4605427 - DNA, 13 bp, Homo sapiens
caaatgcagcttt

SEQ ID NO: 4605428 - DNA, 14 bp, Homo sapiens
gaaagtttacagga

SEQ ID NO: 4605429 - DNA, 16 bp, Homo sapiens
gaaagtttacaggaaa

SEQ ID NO: 4605430 - DNA, 17 bp, Homo sapiens
gaacacgcgtatttaca

SEQ ID NO: 4605431 - DNA, 23 bp, Homo sapiens
gaaggggcaaattcttttgaatt

SEQ ID NO: 4605432 - DNA, 16 bp, Homo sapiens
gaataataagcaggat

SEQ ID NO: 4605433 - DNA, 23 bp, Homo sapiens
gaataataagcaggatgttggcc

SEQ ID NO: 4605434 - DNA, 20 bp, Homo sapiens
gaatattagtgacctcagct

SEQ ID NO: 4605435 - DNA, 13 bp, Homo sapiens
gaatgctttagga

SEQ ID NO: 4605436 - DNA, 13 bp, Homo sapiens
gaatgttaatttt

SEQ ID NO: 4605437 - DNA, 23 bp, Homo sapiens
gaatgttaattttttggtacaaa

SEQ ID NO: 4605438 - DNA, 17 bp, Homo sapiens
gaattcctagaattaaa

SEQ ID NO: 4605439 - DNA, 14 bp, Homo sapiens
gacatatttaactg

SEQ ID NO: 4605440 - DNA, 20 bp, Homo sapiens
gacatatttaatgttttaaa

SEQ ID NO: 4605441 - DNA, 16 bp, Homo sapiens
gaccacactccagctg

SEQ ID NO: 4605442 - DNA, 23 bp, Homo sapiens
gactcctgcacacgctccttcct

SEQ ID NO: 4605443 - DNA, 11 bp, Homo sapiens
gagaaaatata

SEQ ID NO: 4605444 - DNA, 16 bp, Homo sapiens
gagaaaatatatgtat

SEQ ID NO: 4605445 - DNA, 17 bp, Homo sapiens
gagaaaatatatgtatt

SEQ ID NO: 4605446 - DNA, 18 bp, Homo sapiens
gagaaaatatatgtattt

SEQ ID NO: 4605447 - DNA, 13 bp, Homo sapiens
gagagaaaatata

SEQ ID NO: 4605448 - DNA, 17 bp, Homo sapiens
gaggggaaaaaaatgtt

SEQ ID NO: 4605449 - DNA, 23 bp, Homo sapiens
gagtagttatataattgttgaac

SEQ ID NO: 4605450 - DNA, 16 bp, Homo sapiens
gatcacatgtggactt

SEQ ID NO: 4605451 - DNA, 20 bp, Homo sapiens
gatgcctgtgaactgaactc

SEQ ID NO: 4605452 - DNA, 20 bp, Homo sapiens
gatgtgcttgttaactgagt

SEQ ID NO: 4605453 - DNA, 13 bp, Homo sapiens
gattcaaaatatt

SEQ ID NO: 4605454 - DNA, 21 bp, Homo sapiens
gattttttcagacttgtcaag

SEQ ID NO: 4605455 - DNA, 21 bp, Homo sapiens
gcaaaaaaattaaaatggatg

SEQ ID NO: 4605456 - DNA, 21 bp, Homo sapiens
gcaaaaaagtccaattttaat

SEQ ID NO: 4605457 - DNA, 20 bp, Homo sapiens
gcaaagtattgtaaattata

SEQ ID NO: 4605458 - DNA, 20 bp, Homo sapiens
gcaaattcttttgaattgtt

SEQ ID NO: 4605459 - DNA, 13 bp, Homo sapiens
gcactttgtaaat

SEQ ID NO: 4605460 - DNA, 18 bp, Homo sapiens
gccattccccgtctctgg

SEQ ID NO: 4605461 - DNA, 16 bp, Homo sapiens
gcctaaggctgaactt

SEQ ID NO: 4605462 - DNA, 17 bp, Homo sapiens
gcctgtgaactgaactc

SEQ ID NO: 4605463 - DNA, 22 bp, Homo sapiens
gcctttggaaacagctcgactt

SEQ ID NO: 4605464 - DNA, 22 bp, Homo sapiens
gctaaggaggggaaaaaaatgt

SEQ ID NO: 4605465 - DNA, 20 bp, Homo sapiens
gctatagtatttgattcaaa

SEQ ID NO: 4605466 - DNA, 20 bp, Homo sapiens
gctgaacttgttttctggga

SEQ ID NO: 4605467 - DNA, 14 bp, Homo sapiens
gctgttgacatatt

SEQ ID NO: 4605468 - DNA, 19 bp, Homo sapiens
gctgttgacatatttaatg

SEQ ID NO: 4605469 - DNA, 12 bp, Homo sapiens
ggaaaaaaatgt

SEQ ID NO: 4605470 - DNA, 17 bp, Homo sapiens
ggaacaccataggtcac

SEQ ID NO: 4605471 - DNA, 15 bp, Homo sapiens
ggacagcccctcctc

SEQ ID NO: 4605472 - DNA, 16 bp, Homo sapiens
ggacagcccctcctcc

SEQ ID NO: 4605473 - DNA, 18 bp, Homo sapiens
ggacttttatttccagtg

SEQ ID NO: 4605474 - DNA, 14 bp, Homo sapiens
ggagagaaaatata

SEQ ID NO: 4605475 - DNA, 15 bp, Homo sapiens
ggagagaaaatatat

SEQ ID NO: 4605476 - DNA, 16 bp, Homo sapiens
ggagcatcagtgccct

SEQ ID NO: 4605477 - DNA, 18 bp, Homo sapiens
ggaggggaaaaaaatgtt

SEQ ID NO: 4605478 - DNA, 18 bp, Homo sapiens
ggccaccaggtgcctttc

SEQ ID NO: 4605479 - DNA, 23 bp, Homo sapiens
ggctacaccttagcctgccctcc

SEQ ID NO: 4605480 - DNA, 23 bp, Homo sapiens
gggctacaccttagcctgccctc

SEQ ID NO: 4605481 - DNA, 15 bp, Homo sapiens
ggtacaaaaataaat

SEQ ID NO: 4605482 - DNA, 19 bp, Homo sapiens
ggtacaaaaataaatttat

SEQ ID NO: 4605483 - DNA, 19 bp, Homo sapiens
ggtgcctttcaaatttaga

SEQ ID NO: 4605484 - DNA, 16 bp, Homo sapiens
ggttcctcccctcctc

SEQ ID NO: 4605485 - DNA, 23 bp, Homo sapiens
gtaaattatatttgtgctatagt

SEQ ID NO: 4605486 - DNA, 19 bp, Homo sapiens
gtaatgttttctttgcaaa

SEQ ID NO: 4605487 - DNA, 12 bp, Homo sapiens
gtacaaaaataa

SEQ ID NO: 4605488 - DNA, 18 bp, Homo sapiens
gtacaaaaataaatttat

SEQ ID NO: 4605489 - DNA, 17 bp, Homo sapiens
gtagttatataattgtt

SEQ ID NO: 4605490 - DNA, 14 bp, Homo sapiens
gtatccatgctctt

SEQ ID NO: 4605491 - DNA, 17 bp, Homo sapiens
gtatgttgaagcctttg

SEQ ID NO: 4605492 - DNA, 13 bp, Homo sapiens
gtattgtaaatta

SEQ ID NO: 4605493 - DNA, 20 bp, Homo sapiens
gtattgtaaattatatttgt

SEQ ID NO: 4605494 - DNA, 17 bp, Homo sapiens
gtcaagagtagttatat

SEQ ID NO: 4605495 - DNA, 16 bp, Homo sapiens
gtccaattttaattta

SEQ ID NO: 4605496 - DNA, 19 bp, Homo sapiens
gtcttgctgttgacatatt

SEQ ID NO: 4605497 - DNA, 16 bp, Homo sapiens
gtgacctcagctttga

SEQ ID NO: 4605498 - DNA, 15 bp, Homo sapiens
gtgcactttgtaaat

SEQ ID NO: 4605499 - DNA, 15 bp, Homo sapiens
gtgctatagtatttg

SEQ ID NO: 4605500 - DNA, 18 bp, Homo sapiens
gtggagaggcccggcctc

SEQ ID NO: 4605501 - DNA, 22 bp, Homo sapiens
gtgtttaagacatttttggaag

SEQ ID NO: 4605502 - DNA, 18 bp, Homo sapiens
gttaactgagtgcctttt

SEQ ID NO: 4605503 - DNA, 16 bp, Homo sapiens
gttaagcctttggaaa

SEQ ID NO: 4605504 - DNA, 20 bp, Homo sapiens
gttaattttttggtacaaaa

SEQ ID NO: 4605505 - DNA, 23 bp, Homo sapiens
gttactcttcagttaagcctttg

SEQ ID NO: 4605506 - DNA, 12 bp, Homo sapiens
gttatatttcag

SEQ ID NO: 4605507 - DNA, 19 bp, Homo sapiens
gttatcttatactgtacaa

SEQ ID NO: 4605508 - DNA, 13 bp, Homo sapiens
gttatgtatttcc

SEQ ID NO: 4605509 - DNA, 15 bp, Homo sapiens
gttccccaagacatt

SEQ ID NO: 4605510 - DNA, 14 bp, Homo sapiens
gttgacatatttaa

SEQ ID NO: 4605511 - DNA, 19 bp, Homo sapiens
gttgacatatttaatgttt

SEQ ID NO: 4605512 - DNA, 20 bp, Homo sapiens
gttgacatatttaatgtttt

SEQ ID NO: 4605513 - DNA, 20 bp, Homo sapiens
gtttgggccccagaggctgg

SEQ ID NO: 4605514 - DNA, 20 bp, Homo sapiens
gttttctttgcaaagtattg

SEQ ID NO: 4605515 - DNA, 22 bp, Homo sapiens
taaaatggatgccttgaataat

SEQ ID NO: 4605516 - DNA, 13 bp, Homo sapiens
taaagttatattt

SEQ ID NO: 4605517 - DNA, 17 bp, Homo sapiens
taaattatatttgtgct

SEQ ID NO: 4605518 - DNA, 17 bp, Homo sapiens
taactgagtgccttttg

SEQ ID NO: 4605519 - DNA, 20 bp, Homo sapiens
taactggtgcactttgtaaa

SEQ ID NO: 4605520 - DNA, 17 bp, Homo sapiens
taagacatttttggaag

SEQ ID NO: 4605521 - DNA, 21 bp, Homo sapiens
taagcctttggaaacagctcg

SEQ ID NO: 4605522 - DNA, 22 bp, Homo sapiens
taaggaggggaaaaaaatgttg

SEQ ID NO: 4605523 - DNA, 21 bp, Homo sapiens
taatatctaaagttatatttc

SEQ ID NO: 4605524 - DNA, 23 bp, Homo sapiens
taatctgggccagaatttcaaac

SEQ ID NO: 4605525 - DNA, 13 bp, Homo sapiens
taatgttttcttt

SEQ ID NO: 4605526 - DNA, 19 bp, Homo sapiens
taatgttttctttgcaaag

SEQ ID NO: 4605527 - DNA, 20 bp, Homo sapiens
taattgttgaacaggtgttt

SEQ ID NO: 4605528 - DNA, 18 bp, Homo sapiens
taattttttggtacaaaa

SEQ ID NO: 4605529 - DNA, 12 bp, Homo sapiens
tacaaaaataaa

SEQ ID NO: 4605530 - DNA, 14 bp, Homo sapiens
tacaaaaataaatt

SEQ ID NO: 4605531 - DNA, 17 bp, Homo sapiens
tacaaaaataaatttat

SEQ ID NO: 4605532 - DNA, 14 bp, Homo sapiens
tacaaggacagccc

SEQ ID NO: 4605533 - DNA, 13 bp, Homo sapiens
tacagacatattt

SEQ ID NO: 4605534 - DNA, 14 bp, Homo sapiens
tacagacatattta

SEQ ID NO: 4605535 - DNA, 19 bp, Homo sapiens
tacagacatatttaactgg

SEQ ID NO: 4605536 - DNA, 19 bp, Homo sapiens
tacataatgggccactgaa

SEQ ID NO: 4605537 - DNA, 21 bp, Homo sapiens
taccttttttgttttttcaaa

SEQ ID NO: 4605538 - DNA, 22 bp, Homo sapiens
taccttttttgttttttcaaaa

SEQ ID NO: 4605539 - DNA, 23 bp, Homo sapiens
tccaattttaatttagtaaatgt

SEQ ID NO: 4605540 - DNA, 21 bp, Homo sapiens
tccacaagtgccgcaaattgt

SEQ ID NO: 4605541 - DNA, 20 bp, Homo sapiens
tccctggggaaaacttgcag

SEQ ID NO: 4605542 - DNA, 18 bp, Homo sapiens
tccggtgtttaagacatt

SEQ ID NO: 4605543 - DNA, 16 bp, Homo sapiens
tcctgcctaaggctga

SEQ ID NO: 4605544 - DNA, 24 bp, Homo sapiens
tctaatgaggagagaaaatatatg

SEQ ID NO: 4605545 - DNA, 14 bp, Homo sapiens
tctgggccagaatt

SEQ ID NO: 4605546 - DNA, 18 bp, Homo sapiens
tcttatactgtacaataa

SEQ ID NO: 4605547 - DNA, 19 bp, Homo sapiens
tcttcagttaagcctttgg

SEQ ID NO: 4605548 - DNA, 17 bp, Homo sapiens
tcttcctggattattca

SEQ ID NO: 4605549 - DNA, 18 bp, Homo sapiens
tcttgctgttgacatatt

SEQ ID NO: 4605550 - DNA, 21 bp, Homo sapiens
tctttgcaaagtattgtaaat

SEQ ID NO: 4605551 - DNA, 14 bp, Homo sapiens
tcttttgaattgtt

SEQ ID NO: 4605552 - DNA, 17 bp, Homo sapiens
tgaaatcagttactctt

SEQ ID NO: 4605553 - DNA, 16 bp, Homo sapiens
tgaactctgacaacag

SEQ ID NO: 4605554 - DNA, 17 bp, Homo sapiens
tgaactgaactctgaca

SEQ ID NO: 4605555 - DNA, 20 bp, Homo sapiens
tgaataataagcaggatgtt

SEQ ID NO: 4605556 - DNA, 18 bp, Homo sapiens
tgaattcctagaattaaa

SEQ ID NO: 4605557 - DNA, 13 bp, Homo sapiens
tgaattgttacat

SEQ ID NO: 4605558 - DNA, 15 bp, Homo sapiens
tgacaacagacttct

SEQ ID NO: 4605559 - DNA, 14 bp, Homo sapiens
tgacatatttaatg

SEQ ID NO: 4605560 - DNA, 15 bp, Homo sapiens
tgacatatttaatgt

SEQ ID NO: 4605561 - DNA, 19 bp, Homo sapiens
tgacattgccaaaaaggat

SEQ ID NO: 4605562 - DNA, 20 bp, Homo sapiens
tgaccacactccagctggga

SEQ ID NO: 4605563 - DNA, 20 bp, Homo sapiens
tgactttagaaagctgacat

SEQ ID NO: 4605564 - DNA, 17 bp, Homo sapiens
tgaggagagaaaatata

SEQ ID NO: 4605565 - DNA, 20 bp, Homo sapiens
tgatgcctgtgaactgaact

SEQ ID NO: 4605566 - DNA, 19 bp, Homo sapiens
tgattcaaaatatttaaaa

SEQ ID NO: 4605567 - DNA, 22 bp, Homo sapiens
tgcaaaaaatactttttctaat

SEQ ID NO: 4605568 - DNA, 18 bp, Homo sapiens
tgcaaagtattgtaaatt

SEQ ID NO: 4605569 - DNA, 12 bp, Homo sapiens
tgcactttgtaa

SEQ ID NO: 4605570 - DNA, 16 bp, Homo sapiens
tgcactttgtaaattc

SEQ ID NO: 4605571 - DNA, 13 bp, Homo sapiens
tgcagctttaaaa

SEQ ID NO: 4605572 - DNA, 13 bp, Homo sapiens
tgcagtatatttc

SEQ ID NO: 4605573 - DNA, 19 bp, Homo sapiens
tgccaaaaaggatacataa

SEQ ID NO: 4605574 - DNA, 20 bp, Homo sapiens
tgccaaaaaggatacataat

SEQ ID NO: 4605575 - DNA, 21 bp, Homo sapiens
tgcctgtgaactgaactctga

SEQ ID NO: 4605576 - DNA, 15 bp, Homo sapiens
tgccttgaataataa

SEQ ID NO: 4605577 - DNA, 12 bp, Homo sapiens
tgcctttcaaat

SEQ ID NO: 4605578 - DNA, 13 bp, Homo sapiens
tgcctttcaaatt

SEQ ID NO: 4605579 - DNA, 12 bp, Homo sapiens
tgcctttgaatg

SEQ ID NO: 4605580 - DNA, 13 bp, Homo sapiens
tgctatagtattt

SEQ ID NO: 4605581 - DNA, 16 bp, Homo sapiens
tgcttgttaactgagt

SEQ ID NO: 4605582 - DNA, 16 bp, Homo sapiens
tggcagcctcttcaaa

SEQ ID NO: 4605583 - DNA, 16 bp, Homo sapiens
tgggactggcctctgc

SEQ ID NO: 4605584 - DNA, 19 bp, Homo sapiens
tggtgcactttgtaaattc

SEQ ID NO: 4605585 - DNA, 18 bp, Homo sapiens
tggttcctcccctcctcc

SEQ ID NO: 4605586 - DNA, 23 bp, Homo sapiens
tggttcctcccctcctcctggac

SEQ ID NO: 4605587 - DNA, 18 bp, Homo sapiens
tggtttatcagcaaaaaa

SEQ ID NO: 4605588 - DNA, 15 bp, Homo sapiens
tgtaaattatatttg

SEQ ID NO: 4605589 - DNA, 22 bp, Homo sapiens
tgtaaattatatttgtgctata

SEQ ID NO: 4605590 - DNA, 21 bp, Homo sapiens
tgtaatgttttctttgcaaag

SEQ ID NO: 4605591 - DNA, 16 bp, Homo sapiens
tgtacaataaaaacat

SEQ ID NO: 4605592 - DNA, 20 bp, Homo sapiens
tgtacaataaaaacattgcc

SEQ ID NO: 4605593 - DNA, 17 bp, Homo sapiens
tgtacagacatatttaa

SEQ ID NO: 4605594 - DNA, 23 bp, Homo sapiens
tgtatttttatataatatctaaa

SEQ ID NO: 4605595 - DNA, 17 bp, Homo sapiens
tgtcaagagtagttata

SEQ ID NO: 4605596 - DNA, 16 bp, Homo sapiens
tgtcaagcctgtgcaa

SEQ ID NO: 4605597 - DNA, 20 bp, Homo sapiens
tgtcaagcctgtgcaaaaaa

SEQ ID NO: 4605598 - DNA, 22 bp, Homo sapiens
tgtcctgcctaaggctgaactt

SEQ ID NO: 4605599 - DNA, 20 bp, Homo sapiens
tgtcttgctgttgacatatt

SEQ ID NO: 4605600 - DNA, 14 bp, Homo sapiens
tgtgaactgaactc

SEQ ID NO: 4605601 - DNA, 23 bp, Homo sapiens
tgtgaactgaactctgacaacag

SEQ ID NO: 4605602 - DNA, 13 bp, Homo sapiens
tgtgctatagtat

SEQ ID NO: 4605603 - DNA, 21 bp, Homo sapiens
tgttaattttttggtacaaaa

SEQ ID NO: 4605604 - DNA, 22 bp, Homo sapiens
tgttatcttatactgtacaata

SEQ ID NO: 4605605 - DNA, 15 bp, Homo sapiens
tgttgaagcctttgt

SEQ ID NO: 4605606 - DNA, 15 bp, Homo sapiens
tgttgacatatttaa

SEQ ID NO: 4605607 - DNA, 14 bp, Homo sapiens
tgtttggaaacatt

SEQ ID NO: 4605608 - DNA, 13 bp, Homo sapiens
tgttttttcaaaa

SEQ ID NO: 4605609 - DNA, 14 bp, Homo sapiens
tgttttttcaaaat

SEQ ID NO: 4605610 - DNA, 23 bp, Homo sapiens
tgttttttcaaaatagaaaagtt

SEQ ID NO: 4605611 - DNA, 21 bp, Homo sapiens
ttaaaatggatgccttgaata

SEQ ID NO: 4605612 - DNA, 19 bp, Homo sapiens
ttaaaccagattggagcaa

SEQ ID NO: 4605613 - DNA, 14 bp, Homo sapiens
ttaaattttgtaat

SEQ ID NO: 4605614 - DNA, 21 bp, Homo sapiens
ttaactggtgcactttgtaaa

SEQ ID NO: 4605615 - DNA, 22 bp, Homo sapiens
ttaactggtgcactttgtaaat

SEQ ID NO: 4605616 - DNA, 18 bp, Homo sapiens
ttaagacatttttggaag

SEQ ID NO: 4605617 - DNA, 16 bp, Homo sapiens
ttaagcctttggaaac

SEQ ID NO: 4605618 - DNA, 21 bp, Homo sapiens
ttaatctgggccagaatttca

SEQ ID NO: 4605619 - DNA, 19 bp, Homo sapiens
ttaatttagtaaatgttat

SEQ ID NO: 4605620 - DNA, 18 bp, Homo sapiens
ttatactgtacaataaaa

SEQ ID NO: 4605621 - DNA, 12 bp, Homo sapiens
ttatataattgt

SEQ ID NO: 4605622 - DNA, 16 bp, Homo sapiens
ttatataattgttgaa

SEQ ID NO: 4605623 - DNA, 11 bp, Homo sapiens
ttatatttcag

SEQ ID NO: 4605624 - DNA, 22 bp, Homo sapiens
ttatatttcagatgtaatgttt

SEQ ID NO: 4605625 - DNA, 14 bp, Homo sapiens
ttatcagcaaaaaa

SEQ ID NO: 4605626 - DNA, 18 bp, Homo sapiens
ttatcttatactgtacaa

SEQ ID NO: 4605627 - DNA, 21 bp, Homo sapiens
ttatcttatactgtacaataa

SEQ ID NO: 4605628 - DNA, 11 bp, Homo sapiens
ttatgtatttc

SEQ ID NO: 4605629 - DNA, 22 bp, Homo sapiens
ttcaaaatatttaaaaatgtct

SEQ ID NO: 4605630 - DNA, 11 bp, Homo sapiens
ttcaaatttag

SEQ ID NO: 4605631 - DNA, 14 bp, Homo sapiens
ttcagatgtaatgt

SEQ ID NO: 4605632 - DNA, 22 bp, Homo sapiens
ttccacaagtgccgcaaattgt

SEQ ID NO: 4605633 - DNA, 21 bp, Homo sapiens
ttcctctgaggctgaaattca

SEQ ID NO: 4605634 - DNA, 22 bp, Homo sapiens
ttctggttgatgcctgtgaact

SEQ ID NO: 4605635 - DNA, 12 bp, Homo sapiens
ttcttttgaatt

SEQ ID NO: 4605636 - DNA, 20 bp, Homo sapiens
ttgaataataagcaggatgt

SEQ ID NO: 4605637 - DNA, 14 bp, Homo sapiens
ttgaattgttacat

SEQ ID NO: 4605638 - DNA, 16 bp, Homo sapiens
ttgacatatttaatgt

SEQ ID NO: 4605639 - DNA, 15 bp, Homo sapiens
ttgattcaaaatatt

SEQ ID NO: 4605640 - DNA, 18 bp, Homo sapiens
ttgattcaaaatatttaa

SEQ ID NO: 4605641 - DNA, 20 bp, Homo sapiens
ttgcaaagtattgtaaatta

SEQ ID NO: 4605642 - DNA, 16 bp, Homo sapiens
ttgcctttgaatgtta

SEQ ID NO: 4605643 - DNA, 22 bp, Homo sapiens
ttggaaacattttttaaaacaa

SEQ ID NO: 4605644 - DNA, 18 bp, Homo sapiens
ttggagtgttatgtattt

SEQ ID NO: 4605645 - DNA, 20 bp, Homo sapiens
ttgtaaattatatttgtgct

SEQ ID NO: 4605646 - DNA, 18 bp, Homo sapiens
ttgtaatgaattcctaga

SEQ ID NO: 4605647 - DNA, 23 bp, Homo sapiens
ttgtaccttttttgttttttcaa

SEQ ID NO: 4605648 - DNA, 21 bp, Homo sapiens
tttaaaaaattaatctgggcc

SEQ ID NO: 4605649 - DNA, 11 bp, Homo sapiens
tttaaaaatgt

SEQ ID NO: 4605650 - DNA, 12 bp, Homo sapiens
tttaaaaatgtc

SEQ ID NO: 4605651 - DNA, 11 bp, Homo sapiens
tttaaatgtac

SEQ ID NO: 4605652 - DNA, 19 bp, Homo sapiens
tttaatttagtaaatgtta

SEQ ID NO: 4605653 - DNA, 23 bp, Homo sapiens
tttacagccagtgggagatgtta

SEQ ID NO: 4605654 - DNA, 17 bp, Homo sapiens
tttagtaaatgttatct

SEQ ID NO: 4605655 - DNA, 13 bp, Homo sapiens
tttatttccagtg

SEQ ID NO: 4605656 - DNA, 21 bp, Homo sapiens
tttcaaaatagaaaagttatt

SEQ ID NO: 4605657 - DNA, 18 bp, Homo sapiens
tttcaaatttagaaacta

SEQ ID NO: 4605658 - DNA, 15 bp, Homo sapiens
tttcagacttgtcaa

SEQ ID NO: 4605659 - DNA, 18 bp, Homo sapiens
tttcagatgtaatgtttt

SEQ ID NO: 4605660 - DNA, 19 bp, Homo sapiens
tttcagatgtaatgttttc

SEQ ID NO: 4605661 - DNA, 15 bp, Homo sapiens
tttctttgcaaagta

SEQ ID NO: 4605662 - DNA, 13 bp, Homo sapiens
tttgaatgttaat

SEQ ID NO: 4605663 - DNA, 14 bp, Homo sapiens
tttgaattgttaca

SEQ ID NO: 4605664 - DNA, 15 bp, Homo sapiens
tttgattcaaaatat

SEQ ID NO: 4605665 - DNA, 19 bp, Homo sapiens
tttggagtgttatgtattt

SEQ ID NO: 4605666 - DNA, 13 bp, Homo sapiens
tttgtaaattgtc

SEQ ID NO: 4605667 - DNA, 20 bp, Homo sapiens
tttgtgctatagtatttgat

SEQ ID NO: 4605668 - DNA, 14 bp, Homo sapiens
ttttaaatgtacag

SEQ ID NO: 4605669 - DNA, 15 bp, Homo sapiens
ttttaaattttgtaa

SEQ ID NO: 4605670 - DNA, 12 bp, Homo sapiens
ttttaatttagt

SEQ ID NO: 4605671 - DNA, 14 bp, Homo sapiens
ttttaatttagtaa

SEQ ID NO: 4605672 - DNA, 15 bp, Homo sapiens
ttttctttgcaaagt

SEQ ID NO: 4605673 - DNA, 14 bp, Homo sapiens
ttttgaattgttac

SEQ ID NO: 4605674 - DNA, 13 bp, Homo sapiens
ttttgtaatgaat

SEQ ID NO: 4605675 - DNA, 20 bp, Homo sapiens
tttttggagtgttatgtatt

SEQ ID NO: 4605676 - DNA, 18 bp, Homo sapiens
ttttttcaaaatagaaaa

SEQ ID NO: 4605677 - DNA, 11 bp, Homo sapiens
aaaaaatgttg

SEQ ID NO: 4605678 - DNA, 15 bp, Homo sapiens
aaaaacattgccttt

SEQ ID NO: 4605679 - DNA, 20 bp, Homo sapiens
aaaaagctccaaatgcagct

SEQ ID NO: 4605680 - DNA, 23 bp, Homo sapiens
aaaaagtccaattttaatttagt

SEQ ID NO: 4605681 - DNA, 18 bp, Homo sapiens
aaaaatactttttctaat

SEQ ID NO: 4605682 - DNA, 23 bp, Homo sapiens
aaaaatatgaccacactccagct

SEQ ID NO: 4605683 - DNA, 18 bp, Homo sapiens
aaaagtccaattttaatt

SEQ ID NO: 4605684 - DNA, 12 bp, Homo sapiens
aaaatatatgta

SEQ ID NO: 4605685 - DNA, 15 bp, Homo sapiens
aaaatatatgtattt

SEQ ID NO: 4605686 - DNA, 23 bp, Homo sapiens
aaaattaatctgggccagaattt

SEQ ID NO: 4605687 - DNA, 18 bp, Homo sapiens
aaacattgcctttgaatg

SEQ ID NO: 4605688 - DNA, 15 bp, Homo sapiens
aaagctgacattgcc

SEQ ID NO: 4605689 - DNA, 18 bp, Homo sapiens
aaagctgacattgccaaa

SEQ ID NO: 4605690 - DNA, 15 bp, Homo sapiens
aaagtattgtaaatt

SEQ ID NO: 4605691 - DNA, 21 bp, Homo sapiens
aaagtattgtaaattatattt

SEQ ID NO: 4605692 - DNA, 19 bp, Homo sapiens
aaagtccaattttaattta

SEQ ID NO: 4605693 - DNA, 14 bp, Homo sapiens
aaagttatatttca

SEQ ID NO: 4605694 - DNA, 18 bp, Homo sapiens
aaagttattagtggttta

SEQ ID NO: 4605695 - DNA, 14 bp, Homo sapiens
aaataaatttatat

SEQ ID NO: 4605696 - DNA, 17 bp, Homo sapiens
aaataaatttatatgaa

SEQ ID NO: 4605697 - DNA, 18 bp, Homo sapiens
aaatactttttctaatga

SEQ ID NO: 4605698 - DNA, 14 bp, Homo sapiens
aaatagaaaagtta

SEQ ID NO: 4605699 - DNA, 14 bp, Homo sapiens
aaatatatgtattt

SEQ ID NO: 4605700 - DNA, 16 bp, Homo sapiens
aaatctgtcaagagta

SEQ ID NO: 4605701 - DNA, 14 bp, Homo sapiens
aaatgcagtatatt

SEQ ID NO: 4605702 - DNA, 22 bp, Homo sapiens
aaatggatgccttgaataataa

SEQ ID NO: 4605703 - DNA, 16 bp, Homo sapiens
aaatgtacagacatat

SEQ ID NO: 4605704 - DNA, 18 bp, Homo sapiens
aaattatatttgtgctat

SEQ ID NO: 4605705 - DNA, 22 bp, Homo sapiens
aaattatatttgtgctatagta

SEQ ID NO: 4605706 - DNA, 15 bp, Homo sapiens
aaattgtaccttttt

SEQ ID NO: 4605707 - DNA, 18 bp, Homo sapiens
aaattgtcagatgctgtg

SEQ ID NO: 4605708 - DNA, 17 bp, Homo sapiens
aaatttagaaactaatt

SEQ ID NO: 4605709 - DNA, 12 bp, Homo sapiens
aaattttgtaat

SEQ ID NO: 4605710 - DNA, 18 bp, Homo sapiens
aacattgcctttgaatgt

SEQ ID NO: 4605711 - DNA, 22 bp, Homo sapiens
aacattgcctttgaatgttaat

SEQ ID NO: 4605712 - DNA, 18 bp, Homo sapiens
aactaattgactttagaa

SEQ ID NO: 4605713 - DNA, 14 bp, Homo sapiens
aactgaactctgac

SEQ ID NO: 4605714 - DNA, 19 bp, Homo sapiens
aactgaactctgacaacag

SEQ ID NO: 4605715 - DNA, 20 bp, Homo sapiens
aactgaactctgacaacaga

SEQ ID NO: 4605716 - DNA, 18 bp, Homo sapiens
aactggtgcactttgtaa

SEQ ID NO: 4605717 - DNA, 21 bp, Homo sapiens
aactggtgcactttgtaaatt

SEQ ID NO: 4605718 - DNA, 13 bp, Homo sapiens
aacttgttttctg

SEQ ID NO: 4605719 - DNA, 14 bp, Homo sapiens
aagatgtatatagg

SEQ ID NO: 4605720 - DNA, 13 bp, Homo sapiens
aagcctgtgcaaa

SEQ ID NO: 4605721 - DNA, 16 bp, Homo sapiens
aagcctgtgcaaaaaa

SEQ ID NO: 4605722 - DNA, 18 bp, Homo sapiens
aagcctgtgcaaaaaaat

SEQ ID NO: 4605723 - DNA, 18 bp, Homo sapiens
aaggaggggaaaaaaatg

SEQ ID NO: 4605724 - DNA, 20 bp, Homo sapiens
aaggaggggaaaaaaatgtt

SEQ ID NO: 4605725 - DNA, 14 bp, Homo sapiens
aaggatacataatg

SEQ ID NO: 4605726 - DNA, 12 bp, Homo sapiens
aagtattgtaaa

SEQ ID NO: 4605727 - DNA, 13 bp, Homo sapiens
aagtattgtaaat

SEQ ID NO: 4605728 - DNA, 17 bp, Homo sapiens
aagtattgtaaattata

SEQ ID NO: 4605729 - DNA, 19 bp, Homo sapiens
aagtccaattttaatttag

SEQ ID NO: 4605730 - DNA, 19 bp, Homo sapiens
aagtgccgcaaattgtacc

SEQ ID NO: 4605731 - DNA, 14 bp, Homo sapiens
aagttatatttcag

SEQ ID NO: 4605732 - DNA, 17 bp, Homo sapiens
aagttatatttcagatg

SEQ ID NO: 4605733 - DNA, 20 bp, Homo sapiens
aagttattagtggtttatca

SEQ ID NO: 4605734 - DNA, 17 bp, Homo sapiens
aatactttttctaatga

SEQ ID NO: 4605735 - DNA, 14 bp, Homo sapiens
aatagaaaagttat

SEQ ID NO: 4605736 - DNA, 14 bp, Homo sapiens
aatatcaaatgcag

SEQ ID NO: 4605737 - DNA, 21 bp, Homo sapiens
aatatcaaatgcagtatattt

SEQ ID NO: 4605738 - DNA, 12 bp, Homo sapiens
aatatctaaagt

SEQ ID NO: 4605739 - DNA, 15 bp, Homo sapiens
aatatctaaagttat

SEQ ID NO: 4605740 - DNA, 16 bp, Homo sapiens
aatatctaaagttata

SEQ ID NO: 4605741 - DNA, 14 bp, Homo sapiens
aatatttaaaaatg

SEQ ID NO: 4605742 - DNA, 20 bp, Homo sapiens
aatctgtcaagagtagttat

SEQ ID NO: 4605743 - DNA, 21 bp, Homo sapiens
aatgaattcctagaattaaac

SEQ ID NO: 4605744 - DNA, 20 bp, Homo sapiens
aatgatgtatgttgaagcct

SEQ ID NO: 4605745 - DNA, 23 bp, Homo sapiens
aatgatgtatgttgaagcctttg

SEQ ID NO: 4605746 - DNA, 22 bp, Homo sapiens
aatggatgccttgaataataag

SEQ ID NO: 4605747 - DNA, 20 bp, Homo sapiens
aatgggccactgaaatctgt

SEQ ID NO: 4605748 - DNA, 16 bp, Homo sapiens
aatggtttttaaattt

SEQ ID NO: 4605749 - DNA, 16 bp, Homo sapiens
aatgtacagacatatt

SEQ ID NO: 4605750 - DNA, 17 bp, Homo sapiens
aatgtacagacatattt

SEQ ID NO: 4605751 - DNA, 21 bp, Homo sapiens
aatgttaattttttggtacaa

SEQ ID NO: 4605752 - DNA, 23 bp, Homo sapiens
aatgttgtttcctaatatcaaat

SEQ ID NO: 4605753 - DNA, 15 bp, Homo sapiens
aatgttttaaatgta

SEQ ID NO: 4605754 - DNA, 22 bp, Homo sapiens
aattaatctgggccagaatttc

SEQ ID NO: 4605755 - DNA, 13 bp, Homo sapiens
aattatatttgtg

SEQ ID NO: 4605756 - DNA, 22 bp, Homo sapiens
aattatatttgtgctatagtat

SEQ ID NO: 4605757 - DNA, 23 bp, Homo sapiens
aattatatttgtgctatagtatt

SEQ ID NO: 4605758 - DNA, 17 bp, Homo sapiens
aattcctagaattaaac

SEQ ID NO: 4605759 - DNA, 14 bp, Homo sapiens
aattcttttgaatt

SEQ ID NO: 4605760 - DNA, 22 bp, Homo sapiens
aattgtaccttttttgtttttt

SEQ ID NO: 4605761 - DNA, 20 bp, Homo sapiens
aattgttgaacaggtgtttt

SEQ ID NO: 4605762 - DNA, 22 bp, Homo sapiens
aattgttgaacaggtgtttttc

SEQ ID NO: 4605763 - DNA, 14 bp, Homo sapiens
aatttagtaaatgt

SEQ ID NO: 4605764 - DNA, 15 bp, Homo sapiens
aatttagtaaatgtt

SEQ ID NO: 4605765 - DNA, 20 bp, Homo sapiens
aatttagtaaatgttatctt

SEQ ID NO: 4605766 - DNA, 10 bp, Homo sapiens
acaaaaataa

SEQ ID NO: 4605767 - DNA, 14 bp, Homo sapiens
acaaaaataaattt

SEQ ID NO: 4605768 - DNA, 22 bp, Homo sapiens
acaaggacagcccctcctccat

SEQ ID NO: 4605769 - DNA, 23 bp, Homo sapiens
acaagtgccgcaaattgtacctt

SEQ ID NO: 4605770 - DNA, 22 bp, Homo sapiens
acacaatggtttttaaattttg

SEQ ID NO: 4605771 - DNA, 19 bp, Homo sapiens
acacgctccttcctctgag

SEQ ID NO: 4605772 - DNA, 19 bp, Homo sapiens
acataatgggccactgaaa

SEQ ID NO: 4605773 - DNA, 20 bp, Homo sapiens
acataattcaggaagcagct

SEQ ID NO: 4605774 - DNA, 14 bp, Homo sapiens
acatatttaactgg

SEQ ID NO: 4605775 - DNA, 18 bp, Homo sapiens
acatatttaactggtgca

SEQ ID NO: 4605776 - DNA, 20 bp, Homo sapiens
acatatttaactggtgcact

SEQ ID NO: 4605777 - DNA, 12 bp, Homo sapiens
acatatttaatg

SEQ ID NO: 4605778 - DNA, 16 bp, Homo sapiens
acatatttaatgtttt

SEQ ID NO: 4605779 - DNA, 17 bp, Homo sapiens
acattgccaaaaaggat

SEQ ID NO: 4605780 - DNA, 16 bp, Homo sapiens
acattgcctttgaatg

SEQ ID NO: 4605781 - DNA, 23 bp, Homo sapiens
acattgcctttgaatgttaattt

SEQ ID NO: 4605782 - DNA, 12 bp, Homo sapiens
acattttttaaa

SEQ ID NO: 4605783 - DNA, 14 bp, Homo sapiens
accacactccagct

SEQ ID NO: 4605784 - DNA, 17 bp, Homo sapiens
accaggtgcctttcaaa

SEQ ID NO: 4605785 - DNA, 23 bp, Homo sapiens
accaggtgcctttcaaatttaga

SEQ ID NO: 4605786 - DNA, 18 bp, Homo sapiens
accctggcacccagggtg

SEQ ID NO: 4605787 - DNA, 13 bp, Homo sapiens
acctgcaaaaaat

SEQ ID NO: 4605788 - DNA, 15 bp, Homo sapiens
acctgcaaaaaatac

SEQ ID NO: 4605789 - DNA, 14 bp, Homo sapiens
acgctccttcctct

SEQ ID NO: 4605790 - DNA, 15 bp, Homo sapiens
acgctccttcctctg

SEQ ID NO: 4605791 - DNA, 20 bp, Homo sapiens
actctgacaacagacttctg

SEQ ID NO: 4605792 - DNA, 17 bp, Homo sapiens
actgaaatctgtcaaga

SEQ ID NO: 4605793 - DNA, 20 bp, Homo sapiens
actggtgcactttgtaaatt

SEQ ID NO: 4605794 - DNA, 11 bp, Homo sapiens
actgtacaata

SEQ ID NO: 4605795 - DNA, 17 bp, Homo sapiens
actgtacaataaaaaca

SEQ ID NO: 4605796 - DNA, 18 bp, Homo sapiens
actgtacaataaaaacat

SEQ ID NO: 4605797 - DNA, 18 bp, Homo sapiens
acttgtcaagcctgtgca

SEQ ID NO: 4605798 - DNA, 13 bp, Homo sapiens
actttgtaaattc

SEQ ID NO: 4605799 - DNA, 23 bp, Homo sapiens
acttttatttccagtgaaatcag

SEQ ID NO: 4605800 - DNA, 11 bp, Homo sapiens
agaaaagttat

SEQ ID NO: 4605801 - DNA, 13 bp, Homo sapiens
agaaaagttatta

SEQ ID NO: 4605802 - DNA, 23 bp, Homo sapiens
agaaaatatatgtatttttatat

SEQ ID NO: 4605803 - DNA, 14 bp, Homo sapiens
agaacacgcgtatt

SEQ ID NO: 4605804 - DNA, 14 bp, Homo sapiens
agacatatttaact

SEQ ID NO: 4605805 - DNA, 16 bp, Homo sapiens
agacatatttaactgg

SEQ ID NO: 4605806 - DNA, 14 bp, Homo sapiens
agagaaaatatatg

SEQ ID NO: 4605807 - DNA, 23 bp, Homo sapiens
agagtagttatataattgttgaa

SEQ ID NO: 4605808 - DNA, 17 bp, Homo sapiens
agatgtaatgttttctt

SEQ ID NO: 4605809 - DNA, 23 bp, Homo sapiens
agatgtaatgttttctttgcaaa

SEQ ID NO: 4605810 - DNA, 15 bp, Homo sapiens
agatgttagactcat

SEQ ID NO: 4605811 - DNA, 16 bp, Homo sapiens
agattcaatcccagga

SEQ ID NO: 4605812 - DNA, 16 bp, Homo sapiens
agattttttcagactt

SEQ ID NO: 4605813 - DNA, 22 bp, Homo sapiens
agcaaaaaagtccaattttaat

SEQ ID NO: 4605814 - DNA, 20 bp, Homo sapiens
agcaaatgtcttcctggatt

SEQ ID NO: 4605815 - DNA, 15 bp, Homo sapiens
agcaggctgtgagtt

SEQ ID NO: 4605816 - DNA, 20 bp, Homo sapiens
agcctgtgcaaaaaaattaa

SEQ ID NO: 4605817 - DNA, 22 bp, Homo sapiens
agctttccccatgtctcgactc

SEQ ID NO: 4605818 - DNA, 18 bp, Homo sapiens
aggaagcagctttcccca

SEQ ID NO: 4605819 - DNA, 17 bp, Homo sapiens
aggacagcccctcctcc

SEQ ID NO: 4605820 - DNA, 17 bp, Homo sapiens
aggaggggaaaaaaatg

SEQ ID NO: 4605821 - DNA, 13 bp, Homo sapiens
aggcccggcctct

SEQ ID NO: 4605822 - DNA, 19 bp, Homo sapiens
aggtgcctttcaaatttag

SEQ ID NO: 4605823 - DNA, 16 bp, Homo sapiens
aggtgtgtgagactac

SEQ ID NO: 4605824 - DNA, 21 bp, Homo sapiens
agtatccatgctcttgacctt

SEQ ID NO: 4605825 - DNA, 13 bp, Homo sapiens
agtattgtaaatt

SEQ ID NO: 4605826 - DNA, 14 bp, Homo sapiens
agtattgtaaatta

SEQ ID NO: 4605827 - DNA, 15 bp, Homo sapiens
agtattgtaaattat

SEQ ID NO: 4605828 - DNA, 22 bp, Homo sapiens
agtattgtaaattatatttgtg

SEQ ID NO: 4605829 - DNA, 13 bp, Homo sapiens
agtatttgattca

SEQ ID NO: 4605830 - DNA, 15 bp, Homo sapiens
agtccaattttaatt

SEQ ID NO: 4605831 - DNA, 13 bp, Homo sapiens
agtgttatgtatt

SEQ ID NO: 4605832 - DNA, 13 bp, Homo sapiens
agttaagcctttg

SEQ ID NO: 4605833 - DNA, 21 bp, Homo sapiens
agttactcttcagttaagcct

SEQ ID NO: 4605834 - DNA, 23 bp, Homo sapiens
agtttttggagtgttatgtattt

SEQ ID NO: 4605835 - DNA, 17 bp, Homo sapiens
ataataagcaggatgtt

SEQ ID NO: 4605836 - DNA, 19 bp, Homo sapiens
ataatatctaaagttatat

SEQ ID NO: 4605837 - DNA, 21 bp, Homo sapiens
ataatgggccactgaaatctg

SEQ ID NO: 4605838 - DNA, 23 bp, Homo sapiens
ataatgggccactgaaatctgtc

SEQ ID NO: 4605839 - DNA, 20 bp, Homo sapiens
ataattcaggaagcagcttt

SEQ ID NO: 4605840 - DNA, 12 bp, Homo sapiens
atacataatggg

SEQ ID NO: 4605841 - DNA, 14 bp, Homo sapiens
atagaaaagttatt

SEQ ID NO: 4605842 - DNA, 20 bp, Homo sapiens
atataatatctaaagttata

SEQ ID NO: 4605843 - DNA, 13 bp, Homo sapiens
atatatgtatttt

SEQ ID NO: 4605844 - DNA, 20 bp, Homo sapiens
atatctaaagttatatttca

SEQ ID NO: 4605845 - DNA, 14 bp, Homo sapiens
atatttaaaaatgt

SEQ ID NO: 4605846 - DNA, 15 bp, Homo sapiens
atatttaaaaatgtc

SEQ ID NO: 4605847 - DNA, 18 bp, Homo sapiens
atatttaaaaatgtcttg

SEQ ID NO: 4605848 - DNA, 13 bp, Homo sapiens
atatttaatgttt

SEQ ID NO: 4605849 - DNA, 17 bp, Homo sapiens
atcaaatgcagtatatt

SEQ ID NO: 4605850 - DNA, 15 bp, Homo sapiens
atcacatgtggactt

SEQ ID NO: 4605851 - DNA, 13 bp, Homo sapiens
atcagtgccctcc

SEQ ID NO: 4605852 - DNA, 19 bp, Homo sapiens
atcatgctggaacctgcaa

SEQ ID NO: 4605853 - DNA, 22 bp, Homo sapiens
atcatgctggaacctgcaaaaa

SEQ ID NO: 4605854 - DNA, 12 bp, Homo sapiens
atctaaagttat

SEQ ID NO: 4605855 - DNA, 15 bp, Homo sapiens
atctaaagttatatt

SEQ ID NO: 4605856 - DNA, 16 bp, Homo sapiens
atctaaagttatattt

SEQ ID NO: 4605857 - DNA, 18 bp, Homo sapiens
atgaccacactccagctg

SEQ ID NO: 4605858 - DNA, 17 bp, Homo sapiens
atgaggagagaaaatat

SEQ ID NO: 4605859 - DNA, 17 bp, Homo sapiens
atgctggaacctgcaaa

SEQ ID NO: 4605860 - DNA, 23 bp, Homo sapiens
atgctggaacctgcaaaaaatac

SEQ ID NO: 4605861 - DNA, 16 bp, Homo sapiens
atggtttttaaatttt

SEQ ID NO: 4605862 - DNA, 21 bp, Homo sapiens
atggtttttaaattttgtaat

SEQ ID NO: 4605863 - DNA, 12 bp, Homo sapiens
atgtaatgtttt

SEQ ID NO: 4605864 - DNA, 22 bp, Homo sapiens
atgttaattttttggtacaaaa

SEQ ID NO: 4605865 - DNA, 24 bp, Homo sapiens
atgttagactcatggtgtgttaca

SEQ ID NO: 4605866 - DNA, 14 bp, Homo sapiens
atgttttaaatgta

SEQ ID NO: 4605867 - DNA, 15 bp, Homo sapiens
atgttttaaatgtac

SEQ ID NO: 4605868 - DNA, 17 bp, Homo sapiens
atgttttctttgcaaag

SEQ ID NO: 4605869 - DNA, 21 bp, Homo sapiens
atgttttctttgcaaagtatt

SEQ ID NO: 4605870 - DNA, 12 bp, Homo sapiens
attaaaatggat

SEQ ID NO: 4605871 - DNA, 14 bp, Homo sapiens
attcaaaatattta

SEQ ID NO: 4605872 - DNA, 21 bp, Homo sapiens
attcctagaattaaaccagat

SEQ ID NO: 4605873 - DNA, 18 bp, Homo sapiens
attgaaggatcatctgaa

SEQ ID NO: 4605874 - DNA, 21 bp, Homo sapiens
attgactttagaaagctgaca

SEQ ID NO: 4605875 - DNA, 14 bp, Homo sapiens
atttaaaaatgtct

SEQ ID NO: 4605876 - DNA, 21 bp, Homo sapiens
atttaactggtgcactttgta

SEQ ID NO: 4605877 - DNA, 22 bp, Homo sapiens
atttaactggtgcactttgtaa

SEQ ID NO: 4605878 - DNA, 23 bp, Homo sapiens
atttaactggtgcactttgtaaa

SEQ ID NO: 4605879 - DNA, 14 bp, Homo sapiens
atttagtaaatgtt

SEQ ID NO: 4605880 - DNA, 15 bp, Homo sapiens
atttagtaaatgtta

SEQ ID NO: 4605881 - DNA, 18 bp, Homo sapiens
atttcagatgtaatgttt

SEQ ID NO: 4605882 - DNA, 15 bp, Homo sapiens
atttcctggatgttt

SEQ ID NO: 4605883 - DNA, 19 bp, Homo sapiens
atttcttcgttctttttaa

SEQ ID NO: 4605884 - DNA, 20 bp, Homo sapiens
atttgattcaaaatatttaa

SEQ ID NO: 4605885 - DNA, 17 bp, Homo sapiens
attttttggtacaaaaa

SEQ ID NO: 4605886 - DNA, 17 bp, Homo sapiens
caaaaaagtccaatttt

SEQ ID NO: 4605887 - DNA, 17 bp, Homo sapiens
caaaaaggatacataat

SEQ ID NO: 4605888 - DNA, 12 bp, Homo sapiens
caaaatagaaaa

SEQ ID NO: 4605889 - DNA, 17 bp, Homo sapiens
caaaatagaaaagttat

SEQ ID NO: 4605890 - DNA, 12 bp, Homo sapiens
caaaatatttaa

SEQ ID NO: 4605891 - DNA, 18 bp, Homo sapiens
caaaatatttaaaaatgt

SEQ ID NO: 4605892 - DNA, 20 bp, Homo sapiens
caaaatatttaaaaatgtct

SEQ ID NO: 4605893 - DNA, 21 bp, Homo sapiens
caaaatatttaaaaatgtctt

SEQ ID NO: 4605894 - DNA, 15 bp, Homo sapiens
caaagtattgtaaat

SEQ ID NO: 4605895 - DNA, 17 bp, Homo sapiens
caaagtattgtaaatta

SEQ ID NO: 4605896 - DNA, 20 bp, Homo sapiens
caaagtattgtaaattatat

SEQ ID NO: 4605897 - DNA, 16 bp, Homo sapiens
caaattcttttgaatt

SEQ ID NO: 4605898 - DNA, 23 bp, Homo sapiens
caaattcttttgaattgttacat

SEQ ID NO: 4605899 - DNA, 22 bp, Homo sapiens
caagagtagttatataattgtt

SEQ ID NO: 4605900 - DNA, 18 bp, Homo sapiens
caaggacagcccctcctc

SEQ ID NO: 4605901 - DNA, 16 bp, Homo sapiens
caatggtttttaaatt

SEQ ID NO: 4605902 - DNA, 20 bp, Homo sapiens
caattgaaggatcatctgaa

SEQ ID NO: 4605903 - DNA, 17 bp, Homo sapiens
cacaatggtttttaaat

SEQ ID NO: 4605904 - DNA, 12 bp, Homo sapiens
cactccagctgg

SEQ ID NO: 4605905 - DNA, 13 bp, Homo sapiens
cagacttgtcaag

SEQ ID NO: 4605906 - DNA, 15 bp, Homo sapiens
cagatgctgtgcaaa

SEQ ID NO: 4605907 - DNA, 21 bp, Homo sapiens
cagctaaggaggggaaaaaaa

SEQ ID NO: 4605908 - DNA, 19 bp, Homo sapiens
caggatgtacaaggacagc

SEQ ID NO: 4605909 - DNA, 14 bp, Homo sapiens
caggctgtgagttt

SEQ ID NO: 4605910 - DNA, 21 bp, Homo sapiens
caggtgcctttcaaatttaga

SEQ ID NO: 4605911 - DNA, 14 bp, Homo sapiens
caggtgtttttcca

SEQ ID NO: 4605912 - DNA, 15 bp, Homo sapiens
cagtgggagatgtta

SEQ ID NO: 4605913 - DNA, 19 bp, Homo sapiens
cataatgggccactgaaat

SEQ ID NO: 4605914 - DNA, 21 bp, Homo sapiens
cataatgggccactgaaatct

SEQ ID NO: 4605915 - DNA, 23 bp, Homo sapiens
catatttaatgttttaaatgtac

SEQ ID NO: 4605916 - DNA, 21 bp, Homo sapiens
catcatgctggaacctgcaaa

SEQ ID NO: 4605917 - DNA, 21 bp, Homo sapiens
catctgaaggggcaaattctt

SEQ ID NO: 4605918 - DNA, 18 bp, Homo sapiens
catgctggaacctgcaaa

SEQ ID NO: 4605919 - DNA, 14 bp, Homo sapiens
catggtgtgttaca

SEQ ID NO: 4605920 - DNA, 18 bp, Homo sapiens
catgtgttggcagcctct

SEQ ID NO: 4605921 - DNA, 18 bp, Homo sapiens
catttcatttgtgccaga

SEQ ID NO: 4605922 - DNA, 18 bp, Homo sapiens
ccaaccctggcacccagg

SEQ ID NO: 4605923 - DNA, 22 bp, Homo sapiens
ccaagaaagatgtatataggtg

SEQ ID NO: 4605924 - DNA, 21 bp, Homo sapiens
ccaattttaatttagtaaatg

SEQ ID NO: 4605925 - DNA, 23 bp, Homo sapiens
ccaattttaatttagtaaatgtt

SEQ ID NO: 4605926 - DNA, 16 bp, Homo sapiens
ccaggtgcctttcaaa

SEQ ID NO: 4605927 - DNA, 14 bp, Homo sapiens
ccatgtctcgactc

SEQ ID NO: 4605928 - DNA, 16 bp, Homo sapiens
cccagaggctgggtga

SEQ ID NO: 4605929 - DNA, 21 bp, Homo sapiens
cccttaccactgctctgatga

SEQ ID NO: 4605930 - DNA, 13 bp, Homo sapiens
cctcctggactcc

SEQ ID NO: 4605931 - DNA, 14 bp, Homo sapiens
cctgcaaaaaatac

SEQ ID NO: 4605932 - DNA, 17 bp, Homo sapiens
cctgtgcaaaaaaatta

SEQ ID NO: 4605933 - DNA, 18 bp, Homo sapiens
actggtgcactttgtaaa

SEQ ID NO: 4605934 - DNA, 17 bp, Homo sapiens
actttagaaagctgaca

SEQ ID NO: 4605935 - DNA, 12 bp, Homo sapiens
actttgtaaatt

SEQ ID NO: 4605936 - DNA, 19 bp, Homo sapiens
agaaaaatatgaccacact

SEQ ID NO: 4605937 - DNA, 15 bp, Homo sapiens
agaaaatatatgtat

SEQ ID NO: 4605938 - DNA, 17 bp, Homo sapiens
agaaaatatatgtattt

SEQ ID NO: 4605939 - DNA, 12 bp, Homo sapiens
agaaagatgtat

SEQ ID NO: 4605940 - DNA, 14 bp, Homo sapiens
agaaagctgacatt

SEQ ID NO: 4605941 - DNA, 15 bp, Homo sapiens
agagaaaatatatgt

SEQ ID NO: 4605942 - DNA, 23 bp, Homo sapiens
agagaaaatatatgtatttttat

SEQ ID NO: 4605943 - DNA, 23 bp, Homo sapiens
agaggagggagcatcagtgccct

SEQ ID NO: 4605944 - DNA, 14 bp, Homo sapiens
agagtagttatata

SEQ ID NO: 4605945 - DNA, 17 bp, Homo sapiens
agcaaatgtcttcctgg

SEQ ID NO: 4605946 - DNA, 16 bp, Homo sapiens
agccaagaaagatgta

SEQ ID NO: 4605947 - DNA, 19 bp, Homo sapiens
agccgtttgttccccaaga

SEQ ID NO: 4605948 - DNA, 23 bp, Homo sapiens
agccgtttgttccccaagacatt

SEQ ID NO: 4605949 - DNA, 12 bp, Homo sapiens
agcctgccctcc

SEQ ID NO: 4605950 - DNA, 16 bp, Homo sapiens
agcctgtgcaaaaaaa

SEQ ID NO: 4605951 - DNA, 21 bp, Homo sapiens
agcctgtgcaaaaaaattaaa

SEQ ID NO: 4605952 - DNA, 18 bp, Homo sapiens
agctgacattgccaaaaa

SEQ ID NO: 4605953 - DNA, 15 bp, Homo sapiens
aggagagaaaatata

SEQ ID NO: 4605954 - DNA, 17 bp, Homo sapiens
aggagagaaaatatatg

SEQ ID NO: 4605955 - DNA, 22 bp, Homo sapiens
aggagagaaaatatatgtattt

SEQ ID NO: 4605956 - DNA, 19 bp, Homo sapiens
aggaggggaaaaaaatgtt

SEQ ID NO: 4605957 - DNA, 22 bp, Homo sapiens
aggatgtacaaggacagcccct

SEQ ID NO: 4605958 - DNA, 15 bp, Homo sapiens
aggcccggcctctca

SEQ ID NO: 4605959 - DNA, 23 bp, Homo sapiens
aggcttctggttgatgcctgtga

SEQ ID NO: 4605960 - DNA, 18 bp, Homo sapiens
caaattcttttgaattgt

SEQ ID NO: 4605961 - DNA, 21 bp, Homo sapiens
caaattcttttgaattgttac

SEQ ID NO: 4605962 - DNA, 22 bp, Homo sapiens
caaatttagaaactaattgact

SEQ ID NO: 4605963 - DNA, 21 bp, Homo sapiens
caagcctgtgcaaaaaaatta

SEQ ID NO: 4605964 - DNA, 17 bp, Homo sapiens
caatggtttttaaattt

SEQ ID NO: 4605965 - DNA, 19 bp, Homo sapiens
caattttaatttagtaaat

SEQ ID NO: 4605966 - DNA, 21 bp, Homo sapiens
caattttaatttagtaaatgt

SEQ ID NO: 4605967 - DNA, 22 bp, Homo sapiens
caattttaatttagtaaatgtt

SEQ ID NO: 4605968 - DNA, 21 bp, Homo sapiens
cacaagtgccgcaaattgtac

SEQ ID NO: 4605969 - DNA, 19 bp, Homo sapiens
caccaggtgcctttcaaat

SEQ ID NO: 4605970 - DNA, 14 bp, Homo sapiens
cactaggcttctgg

SEQ ID NO: 4605971 - DNA, 13 bp, Homo sapiens
cactttgtaaatt

SEQ ID NO: 4605972 - DNA, 15 bp, Homo sapiens
cagaacacataattc

SEQ ID NO: 4605973 - DNA, 22 bp, Homo sapiens
cagaatattagtgacctcagct

SEQ ID NO: 4605974 - DNA, 14 bp, Homo sapiens
cagacatatttaac

SEQ ID NO: 4605975 - DNA, 12 bp, Homo sapiens
cagatgtaatgt

SEQ ID NO: 4605976 - DNA, 22 bp, Homo sapiens
cagatgtaatgttttctttgca

SEQ ID NO: 4605977 - DNA, 23 bp, Homo sapiens
cagctgggatcacatgtggactt

SEQ ID NO: 4605978 - DNA, 23 bp, Homo sapiens
cagctttccccatgtctcgactc

SEQ ID NO: 4605979 - DNA, 14 bp, Homo sapiens
cagctttgatattt

SEQ ID NO: 4605980 - DNA, 13 bp, Homo sapiens
caggatagacttt

SEQ ID NO: 4605981 - DNA, 18 bp, Homo sapiens
caggccattccccgtctc

SEQ ID NO: 4605982 - DNA, 21 bp, Homo sapiens
caggccattccccgtctctgg

SEQ ID NO: 4605983 - DNA, 14 bp, Homo sapiens
caggtgcctttcaa

SEQ ID NO: 4605984 - DNA, 17 bp, Homo sapiens
cagtgggagatgttaga

SEQ ID NO: 4605985 - DNA, 14 bp, Homo sapiens
cagttaagcctttg

SEQ ID NO: 4605986 - DNA, 22 bp, Homo sapiens
cataatgggccactgaaatctg

SEQ ID NO: 4605987 - DNA, 14 bp, Homo sapiens
catatttaactggt

SEQ ID NO: 4605988 - DNA, 15 bp, Homo sapiens
catatttaatgtttt

SEQ ID NO: 4605989 - DNA, 18 bp, Homo sapiens
catatttaatgttttaaa

SEQ ID NO: 4605990 - DNA, 12 bp, Homo sapiens
catccatccagg

SEQ ID NO: 4605991 - DNA, 19 bp, Homo sapiens
catctgaaggggcaaattc

SEQ ID NO: 4605992 - DNA, 22 bp, Homo sapiens
catctgaaggggcaaattcttt

SEQ ID NO: 4605993 - DNA, 21 bp, Homo sapiens
catgctcttgaccttgtagag

SEQ ID NO: 4605994 - DNA, 15 bp, Homo sapiens
cattgccaaaaagga

SEQ ID NO: 4605995 - DNA, 14 bp, Homo sapiens
cattgcctttgaat

SEQ ID NO: 4605996 - DNA, 18 bp, Homo sapiens
ccaaatgcagctttaaaa

SEQ ID NO: 4605997 - DNA, 16 bp, Homo sapiens
ccaattttaatttagt

SEQ ID NO: 4605998 - DNA, 20 bp, Homo sapiens
ccacaagtgccgcaaattgt

SEQ ID NO: 4605999 - DNA, 12 bp, Homo sapiens
ccacactccagc

SEQ ID NO: 4606000 - DNA, 14 bp, Homo sapiens
ccactgaaatctgt

SEQ ID NO: 4606001 - DNA, 20 bp, Homo sapiens
ccaggtgcctttcaaattta

SEQ ID NO: 4606002 - DNA, 15 bp, Homo sapiens
ccatgtctcgactca

SEQ ID NO: 4606003 - DNA, 21 bp, Homo sapiens
ccatttcatttgtgccagaat

SEQ ID NO: 4606004 - DNA, 15 bp, Homo sapiens
cccaaccctggcacc

SEQ ID NO: 4606005 - DNA, 16 bp, Homo sapiens
cccatgtctcgactca

SEQ ID NO: 4606006 - DNA, 17 bp, Homo sapiens
cccatgtctcgactcat

SEQ ID NO: 4606007 - DNA, 17 bp, Homo sapiens
ccccagaggctgggtga

SEQ ID NO: 4606008 - DNA, 21 bp, Homo sapiens
ccccgtctctggttcctcccc

SEQ ID NO: 4606009 - DNA, 18 bp, Homo sapiens
cccctcctcctggactcc

SEQ ID NO: 4606010 - DNA, 22 bp, Homo sapiens
cccgtctctggttcctcccctc

SEQ ID NO: 4606011 - DNA, 16 bp, Homo sapiens
ccctcctcctggactc

SEQ ID NO: 4606012 - DNA, 18 bp, Homo sapiens
ccctcctcctggactcct

SEQ ID NO: 4606013 - DNA, 18 bp, Homo sapiens
cctctgctgatcctccca

SEQ ID NO: 4606014 - DNA, 15 bp, Homo sapiens
cctgcaaaaaatact

SEQ ID NO: 4606015 - DNA, 21 bp, Homo sapiens
cctgcacacgctccttcctct

SEQ ID NO: 4606016 - DNA, 12 bp, Homo sapiens
cctggatgtttg

SEQ ID NO: 4606017 - DNA, 17 bp, Homo sapiens
cctgtcctgcctaaggc

SEQ ID NO: 4606018 - DNA, 15 bp, Homo sapiens
ccttcaaagcaaatg

SEQ ID NO: 4606019 - DNA, 19 bp, Homo sapiens
ccttcaaagcaaatgtctt

SEQ ID NO: 4606020 - DNA, 13 bp, Homo sapiens
ccttcctctgagg

SEQ ID NO: 4606021 - DNA, 13 bp, Homo sapiens
ccttgaataataa

SEQ ID NO: 4606022 - DNA, 14 bp, Homo sapiens
cctttattctggca

SEQ ID NO: 4606023 - DNA, 15 bp, Homo sapiens
cctttcaaatttaga

SEQ ID NO: 4606024 - DNA, 23 bp, Homo sapiens
ccttttttgttttttcaaaatag

SEQ ID NO: 4606025 - DNA, 22 bp, Homo sapiens
cgttccttcaaagcaaatgtct

SEQ ID NO: 4606026 - DNA, 15 bp, Homo sapiens
ctaaagttatatttc

SEQ ID NO: 4606027 - DNA, 20 bp, Homo sapiens
ctaaggaggggaaaaaaatg

SEQ ID NO: 4606028 - DNA, 17 bp, Homo sapiens
ctaatgaggagagaaaa

SEQ ID NO: 4606029 - DNA, 19 bp, Homo sapiens
ctaatgaggagagaaaata

SEQ ID NO: 4606030 - DNA, 22 bp, Homo sapiens
ctatagtatttgattcaaaata

SEQ ID NO: 4606031 - DNA, 23 bp, Homo sapiens
ctatagtatttgattcaaaatat

SEQ ID NO: 4606032 - DNA, 20 bp, Homo sapiens
ctcccctcctcctggactcc

SEQ ID NO: 4606033 - DNA, 22 bp, Homo sapiens
ctctgacaacagacttctgaaa

SEQ ID NO: 4606034 - DNA, 18 bp, Homo sapiens
ctgacaacagacttctga

SEQ ID NO: 4606035 - DNA, 19 bp, Homo sapiens
ctgacaacagacttctgaa

SEQ ID NO: 4606036 - DNA, 16 bp, Homo sapiens
ctgacattgccaaaaa

SEQ ID NO: 4606037 - DNA, 15 bp, Homo sapiens
ctgagtgccttttgg

SEQ ID NO: 4606038 - DNA, 20 bp, Homo sapiens
ctgcacacgctccttcctct

SEQ ID NO: 4606039 - DNA, 20 bp, Homo sapiens
ctgctctgatgaagaggagt

SEQ ID NO: 4606040 - DNA, 16 bp, Homo sapiens
ctggaacctgcaaaaa

SEQ ID NO: 4606041 - DNA, 18 bp, Homo sapiens
ctggaacctgcaaaaaat

SEQ ID NO: 4606042 - DNA, 15 bp, Homo sapiens
ctggatgtttggaaa

SEQ ID NO: 4606043 - DNA, 14 bp, Homo sapiens
ctgggccagaattt

SEQ ID NO: 4606044 - DNA, 13 bp, Homo sapiens
ctgtgaactgaac

SEQ ID NO: 4606045 - DNA, 16 bp, Homo sapiens
ctgttgacatatttaa

SEQ ID NO: 4606046 - DNA, 15 bp, Homo sapiens
cttatactgtacaat

SEQ ID NO: 4606047 - DNA, 17 bp, Homo sapiens
cttcagttaagcctttg

SEQ ID NO: 4606048 - DNA, 15 bp, Homo sapiens
cttgaccttgtagag

SEQ ID NO: 4606049 - DNA, 19 bp, Homo sapiens
cttgctgttgacatattta

SEQ ID NO: 4606050 - DNA, 18 bp, Homo sapiens
cttgtcaagcctgtgcaa

SEQ ID NO: 4606051 - DNA, 23 bp, Homo sapiens
cttgtcaagcctgtgcaaaaaaa

SEQ ID NO: 4606052 - DNA, 22 bp, Homo sapiens
ctttaaaaaattaatctgggcc

SEQ ID NO: 4606053 - DNA, 21 bp, Homo sapiens
ctttaaaaagctccaaatgca

SEQ ID NO: 4606054 - DNA, 20 bp, Homo sapiens
ctttattctggcagaggagg

SEQ ID NO: 4606055 - DNA, 21 bp, Homo sapiens
ctttcaaatttagaaactaat

SEQ ID NO: 4606056 - DNA, 20 bp, Homo sapiens
ctttccccatgtctcgactc

SEQ ID NO: 4606057 - DNA, 21 bp, Homo sapiens
ctttccccatgtctcgactca

SEQ ID NO: 4606058 - DNA, 13 bp, Homo sapiens
ctttgaatgttaa

SEQ ID NO: 4606059 - DNA, 14 bp, Homo sapiens
ctttgaatgttaat

SEQ ID NO: 4606060 - DNA, 21 bp, Homo sapiens
ctttgcaaagtattgtaaatt

SEQ ID NO: 4606061 - DNA, 22 bp, Homo sapiens
ctttgcaaagtattgtaaatta

SEQ ID NO: 4606062 - DNA, 17 bp, Homo sapiens
ctttgttttactgtctt

SEQ ID NO: 4606063 - DNA, 13 bp, Homo sapiens
cttttgccattga

SEQ ID NO: 4606064 - DNA, 12 bp, Homo sapiens
ctttttctaatg

SEQ ID NO: 4606065 - DNA, 21 bp, Homo sapiens
gaaaaaaatgttgtttcctaa

SEQ ID NO: 4606066 - DNA, 17 bp, Homo sapiens
gaaaatatatgtatttt

SEQ ID NO: 4606067 - DNA, 20 bp, Homo sapiens
gaaaatatatgtatttttat

SEQ ID NO: 4606068 - DNA, 16 bp, Homo sapiens
gaaacattttttaaaa

SEQ ID NO: 4606069 - DNA, 15 bp, Homo sapiens
tactgtacaataaaa

SEQ ID NO: 4606070 - DNA, 18 bp, Homo sapiens
tactgtacaataaaaaca

SEQ ID NO: 4606071 - DNA, 12 bp, Homo sapiens
tagaaaagttat

SEQ ID NO: 4606072 - DNA, 18 bp, Homo sapiens
tagaaagctgacattgcc

SEQ ID NO: 4606073 - DNA, 17 bp, Homo sapiens
tagtatttgattcaaaa

SEQ ID NO: 4606074 - DNA, 23 bp, Homo sapiens
tagtatttgattcaaaatattta

SEQ ID NO: 4606075 - DNA, 18 bp, Homo sapiens
tatagtatttgattcaaa

SEQ ID NO: 4606076 - DNA, 13 bp, Homo sapiens
tatataatatcta

SEQ ID NO: 4606077 - DNA, 19 bp, Homo sapiens
tatataatatctaaagtta

SEQ ID NO: 4606078 - DNA, 19 bp, Homo sapiens
tatatttcagatgtaatgt

SEQ ID NO: 4606079 - DNA, 16 bp, Homo sapiens
tatatttgtgctatag

SEQ ID NO: 4606080 - DNA, 20 bp, Homo sapiens
tatatttgtgctatagtatt

SEQ ID NO: 4606081 - DNA, 19 bp, Homo sapiens
tatcaaatgcagtatattt

SEQ ID NO: 4606082 - DNA, 18 bp, Homo sapiens
tatctaaagttatatttc

SEQ ID NO: 4606083 - DNA, 20 bp, Homo sapiens
tatctaaagttatatttcag

SEQ ID NO: 4606084 - DNA, 13 bp, Homo sapiens
tattgtaaattat

SEQ ID NO: 4606085 - DNA, 13 bp, Homo sapiens
tatttaatgtttt

SEQ ID NO: 4606086 - DNA, 16 bp, Homo sapiens
tatttcagatgtaatg

SEQ ID NO: 4606087 - DNA, 21 bp, Homo sapiens
tatttcagatgtaatgttttc

SEQ ID NO: 4606088 - DNA, 19 bp, Homo sapiens
tatttcttcgttcttttta

SEQ ID NO: 4606089 - DNA, 18 bp, Homo sapiens
tatttgtgctatagtatt

SEQ ID NO: 4606090 - DNA, 21 bp, Homo sapiens
tatttgtgctatagtatttga

SEQ ID NO: 4606091 - DNA, 18 bp, Homo sapiens
tatttttatataatatct

SEQ ID NO: 4606092 - DNA, 23 bp, Homo sapiens
tatttttatataatatctaaagt

SEQ ID NO: 4606093 - DNA, 19 bp, Homo sapiens
tcaaaatagaaaagttatt

SEQ ID NO: 4606094 - DNA, 23 bp, Homo sapiens
tcaaagcaaatgtcttcctggat

SEQ ID NO: 4606095 - DNA, 16 bp, Homo sapiens
tcaaatgcagtatatt

SEQ ID NO: 4606096 - DNA, 19 bp, Homo sapiens
tcaagcctgtgcaaaaaaa

SEQ ID NO: 4606097 - DNA, 15 bp, Homo sapiens
tcagacttgtcaagc

SEQ ID NO: 4606098 - DNA, 21 bp, Homo sapiens
tcagatgctgtgcaaatgtta

SEQ ID NO: 4606099 - DNA, 13 bp, Homo sapiens
tcagatgtaatgt

SEQ ID NO: 4606100 - DNA, 23 bp, Homo sapiens
tcatctgaaggggcaaattcttt

SEQ ID NO: 4606101 - DNA, 22 bp, Homo sapiens
tcatgctggaacctgcaaaaaa

SEQ ID NO: 4606102 - DNA, 17 bp, Homo sapiens
ccttaccactgctctga

SEQ ID NO: 4606103 - DNA, 20 bp, Homo sapiens
ccttaccactgctctgatga

SEQ ID NO: 4606104 - DNA, 14 bp, Homo sapiens
ccttcctctgaggc

SEQ ID NO: 4606105 - DNA, 16 bp, Homo sapiens
cctttcaaatttagaa

SEQ ID NO: 4606106 - DNA, 18 bp, Homo sapiens
cctttgaatgttaatttt

SEQ ID NO: 4606107 - DNA, 21 bp, Homo sapiens
cctttgtaaattgtcagatgc

SEQ ID NO: 4606108 - DNA, 23 bp, Homo sapiens
cctttgtaaattgtcagatgctg

SEQ ID NO: 4606109 - DNA, 10 bp, Homo sapiens
ctaaagttat

SEQ ID NO: 4606110 - DNA, 11 bp, Homo sapiens
ctaaagttata

SEQ ID NO: 4606111 - DNA, 14 bp, Homo sapiens
ctaaagttatattt

SEQ ID NO: 4606112 - DNA, 16 bp, Homo sapiens
ctaaagttatatttca

SEQ ID NO: 4606113 - DNA, 22 bp, Homo sapiens
ctaaggaggggaaaaaaatgtt

SEQ ID NO: 4606114 - DNA, 23 bp, Homo sapiens
ctaaggaggggaaaaaaatgttg

SEQ ID NO: 4606115 - DNA, 14 bp, Homo sapiens
ctaaggctgaactt

SEQ ID NO: 4606116 - DNA, 15 bp, Homo sapiens
ctaatatcaaatgca

SEQ ID NO: 4606117 - DNA, 23 bp, Homo sapiens
ctaatatcaaatgcagtatattt

SEQ ID NO: 4606118 - DNA, 18 bp, Homo sapiens
ctaatgaggagagaaaat

SEQ ID NO: 4606119 - DNA, 20 bp, Homo sapiens
ctaatgaggagagaaaatat

SEQ ID NO: 4606120 - DNA, 11 bp, Homo sapiens
ctcacaaaaga

SEQ ID NO: 4606121 - DNA, 13 bp, Homo sapiens
ctcactaggcttc

SEQ ID NO: 4606122 - DNA, 16 bp, Homo sapiens
ctcactaggcttctgg

SEQ ID NO: 4606123 - DNA, 14 bp, Homo sapiens
ctcctcctggactc

SEQ ID NO: 4606124 - DNA, 15 bp, Homo sapiens
ctcctggactcctgc

SEQ ID NO: 4606125 - DNA, 17 bp, Homo sapiens
ctctgatgaagaggagt

SEQ ID NO: 4606126 - DNA, 16 bp, Homo sapiens
ctcttgaccttgtaga

SEQ ID NO: 4606127 - DNA, 15 bp, Homo sapiens
ctgacaacagacttc

SEQ ID NO: 4606128 - DNA, 14 bp, Homo sapiens
ctgacattgccaaa

SEQ ID NO: 4606129 - DNA, 17 bp, Homo sapiens
ctgacattgccaaaaag

SEQ ID NO: 4606130 - DNA, 20 bp, Homo sapiens
ctgacattgccaaaaaggat

SEQ ID NO: 4606131 - DNA, 14 bp, Homo sapiens
ctgagtgccttttg

SEQ ID NO: 4606132 - DNA, 16 bp, Homo sapiens
ctgagtgccttttggt

SEQ ID NO: 4606133 - DNA, 12 bp, Homo sapiens
ctgctctgatga

SEQ ID NO: 4606134 - DNA, 20 bp, Homo sapiens
ctgggatcacatgtggactt

SEQ ID NO: 4606135 - DNA, 16 bp, Homo sapiens
ctggtgcactttgtaa

SEQ ID NO: 4606136 - DNA, 17 bp, Homo sapiens
ctggtgcactttgtaaa

SEQ ID NO: 4606137 - DNA, 19 bp, Homo sapiens
ctggtgcactttgtaaatt

SEQ ID NO: 4606138 - DNA, 12 bp, Homo sapiens
ctgtcctgccta

SEQ ID NO: 4606139 - DNA, 16 bp, Homo sapiens
ctgtgaactgaactct

SEQ ID NO: 4606140 - DNA, 17 bp, Homo sapiens
ctgttgacatatttaat

SEQ ID NO: 4606141 - DNA, 19 bp, Homo sapiens
ctgttgacatatttaatgt

SEQ ID NO: 4606142 - DNA, 20 bp, Homo sapiens
ctgttgacatatttaatgtt

SEQ ID NO: 4606143 - DNA, 21 bp, Homo sapiens
ctgttgacatatttaatgttt

SEQ ID NO: 4606144 - DNA, 22 bp, Homo sapiens
ctgttgacatatttaatgtttt

SEQ ID NO: 4606145 - DNA, 23 bp, Homo sapiens
ctgttgacatatttaatgtttta

SEQ ID NO: 4606146 - DNA, 19 bp, Homo sapiens
cttatactgtacaataaaa

SEQ ID NO: 4606147 - DNA, 14 bp, Homo sapiens
cttatagacaacat

SEQ ID NO: 4606148 - DNA, 13 bp, Homo sapiens
cttatgagaaact

SEQ ID NO: 4606149 - DNA, 17 bp, Homo sapiens
cttcaaagcaaatgtct

SEQ ID NO: 4606150 - DNA, 16 bp, Homo sapiens
cttcctctgaggctga

SEQ ID NO: 4606151 - DNA, 22 bp, Homo sapiens
cttcctctgaggctgaaattca

SEQ ID NO: 4606152 - DNA, 18 bp, Homo sapiens
cttcgttctttttaagtt

SEQ ID NO: 4606153 - DNA, 19 bp, Homo sapiens
cttcgttctttttaagtta

SEQ ID NO: 4606154 - DNA, 18 bp, Homo sapiens
cttgcagctaaggagggg

SEQ ID NO: 4606155 - DNA, 21 bp, Homo sapiens
cttgctgttgacatatttaat

SEQ ID NO: 4606156 - DNA, 23 bp, Homo sapiens
cttgctgttgacatatttaatgt

SEQ ID NO: 4606157 - DNA, 19 bp, Homo sapiens
ctttagaaagctgacattg

SEQ ID NO: 4606158 - DNA, 15 bp, Homo sapiens
ctttgcaaagtattg

SEQ ID NO: 4606159 - DNA, 20 bp, Homo sapiens
ctttgcaaagtattgtaaat

SEQ ID NO: 4606160 - DNA, 21 bp, Homo sapiens
cttttttgttttttcaaaata

SEQ ID NO: 4606161 - DNA, 20 bp, Homo sapiens
gaaacagctcgactttaaaa

SEQ ID NO: 4606162 - DNA, 20 bp, Homo sapiens
gaacacataattcaggaagc

SEQ ID NO: 4606163 - DNA, 15 bp, Homo sapiens
gaacaggtgtttttc

SEQ ID NO: 4606164 - DNA, 16 bp, Homo sapiens
gaacctgcaaaaaata

SEQ ID NO: 4606165 - DNA, 22 bp, Homo sapiens
gaatgttaattttttggtacaa

SEQ ID NO: 4606166 - DNA, 12 bp, Homo sapiens
gaattgttacat

SEQ ID NO: 4606167 - DNA, 22 bp, Homo sapiens
gacatatttaatgttttaaatg

SEQ ID NO: 4606168 - DNA, 18 bp, Homo sapiens
gacttttatttccagtga

SEQ ID NO: 4606169 - DNA, 19 bp, Homo sapiens
gagaaaatatatgtatttt

SEQ ID NO: 4606170 - DNA, 15 bp, Homo sapiens
gagactactaagagg

SEQ ID NO: 4606171 - DNA, 13 bp, Homo sapiens
gaggcccggcctc

SEQ ID NO: 4606172 - DNA, 20 bp, Homo sapiens
gatgtatgttgaagcctttg

SEQ ID NO: 4606173 - DNA, 18 bp, Homo sapiens
gcaaaaaatactttttct

SEQ ID NO: 4606174 - DNA, 15 bp, Homo sapiens
gcaaagtattgtaaa

SEQ ID NO: 4606175 - DNA, 18 bp, Homo sapiens
gcaaagtattgtaaatta

SEQ ID NO: 4606176 - DNA, 15 bp, Homo sapiens
gcactttgtaaattc

SEQ ID NO: 4606177 - DNA, 12 bp, Homo sapiens
gcagtatatttc

SEQ ID NO: 4606178 - DNA, 23 bp, Homo sapiens
gcatcagtgccctccaggataga

SEQ ID NO: 4606179 - DNA, 21 bp, Homo sapiens
gccaccaggtgcctttcaaat

SEQ ID NO: 4606180 - DNA, 17 bp, Homo sapiens
gccattccccgtctctg

SEQ ID NO: 4606181 - DNA, 19 bp, Homo sapiens
gcctctgctgatcctccca

SEQ ID NO: 4606182 - DNA, 13 bp, Homo sapiens
gctatagtatttg

SEQ ID NO: 4606183 - DNA, 16 bp, Homo sapiens
gctatagtatttgatt

SEQ ID NO: 4606184 - DNA, 17 bp, Homo sapiens
gctgttgacatatttaa

SEQ ID NO: 4606185 - DNA, 22 bp, Homo sapiens
gctttccccatgtctcgactca

SEQ ID NO: 4606186 - DNA, 13 bp, Homo sapiens
ggaaaaaaatgtt

SEQ ID NO: 4606187 - DNA, 15 bp, Homo sapiens
ggaacctgcaaaaaa

SEQ ID NO: 4606188 - DNA, 16 bp, Homo sapiens
ggagtgttatgtattt

SEQ ID NO: 4606189 - DNA, 21 bp, Homo sapiens
ggatgtacaaggacagcccct

SEQ ID NO: 4606190 - DNA, 18 bp, Homo sapiens
ggcaaattcttttgaatt

SEQ ID NO: 4606191 - DNA, 13 bp, Homo sapiens
ggtacaaaaataa

SEQ ID NO: 4606192 - DNA, 14 bp, Homo sapiens
ggtacaaaaataaa

SEQ ID NO: 4606193 - DNA, 15 bp, Homo sapiens
ggtgcactttgtaaa

SEQ ID NO: 4606194 - DNA, 16 bp, Homo sapiens
ggtgcactttgtaaat

SEQ ID NO: 4606195 - DNA, 18 bp, Homo sapiens
ggtgcctttcaaatttag

SEQ ID NO: 4606196 - DNA, 22 bp, Homo sapiens
gtaaatgttatcttatactgta

SEQ ID NO: 4606197 - DNA, 14 bp, Homo sapiens
gtaaattatatttg

SEQ ID NO: 4606198 - DNA, 21 bp, Homo sapiens
gtaatgttttctttgcaaagt

SEQ ID NO: 4606199 - DNA, 11 bp, Homo sapiens
gtacaataaaa

SEQ ID NO: 4606200 - DNA, 16 bp, Homo sapiens
gtacagacatatttaa

SEQ ID NO: 4606201 - DNA, 16 bp, Homo sapiens
gtatgggactggcctc

SEQ ID NO: 4606202 - DNA, 19 bp, Homo sapiens
gtattgtaaattatatttg

SEQ ID NO: 4606203 - DNA, 14 bp, Homo sapiens
gtatttttatataa

SEQ ID NO: 4606204 - DNA, 22 bp, Homo sapiens
gtcagatgctgtgcaaatgtta

SEQ ID NO: 4606205 - DNA, 23 bp, Homo sapiens
gtcatctagcgcaattgaaggat

SEQ ID NO: 4606206 - DNA, 18 bp, Homo sapiens
gtccaattttaatttagt

SEQ ID NO: 4606207 - DNA, 17 bp, Homo sapiens
gtgagcaggctgtgagt

SEQ ID NO: 4606208 - DNA, 13 bp, Homo sapiens
gtggacttttatt

SEQ ID NO: 4606209 - DNA, 13 bp, Homo sapiens
gtgtttaagacat

SEQ ID NO: 4606210 - DNA, 14 bp, Homo sapiens
gtgtttaagacatt

SEQ ID NO: 4606211 - DNA, 13 bp, Homo sapiens
gttaagcctttgg

SEQ ID NO: 4606212 - DNA, 19 bp, Homo sapiens
gttaatatttataggtcac

SEQ ID NO: 4606213 - DNA, 23 bp, Homo sapiens
gttatatttcagatgtaatgttt

SEQ ID NO: 4606214 - DNA, 20 bp, Homo sapiens
gttatcttatactgtacaat

SEQ ID NO: 4606215 - DNA, 17 bp, Homo sapiens
gttgacatatttaatgt

SEQ ID NO: 4606216 - DNA, 20 bp, Homo sapiens
gtttaagacatttttggaag

SEQ ID NO: 4606217 - DNA, 15 bp, Homo sapiens
gtttatcagcaaaaa

SEQ ID NO: 4606218 - DNA, 22 bp, Homo sapiens
gttttaaatgtacagacatatt

SEQ ID NO: 4606219 - DNA, 15 bp, Homo sapiens
gtttttaaattttgt

SEQ ID NO: 4606220 - DNA, 19 bp, Homo sapiens
gtttttaaattttgtaatg

SEQ ID NO: 4606221 - DNA, 22 bp, Homo sapiens
taaaaatgtcttgctgttgaca

SEQ ID NO: 4606222 - DNA, 23 bp, Homo sapiens
taaaaatgtcttgctgttgacat

SEQ ID NO: 4606223 - DNA, 16 bp, Homo sapiens
taaagttatatttcag

SEQ ID NO: 4606224 - DNA, 15 bp, Homo sapiens
taaattttgtaatga

SEQ ID NO: 4606225 - DNA, 22 bp, Homo sapiens
taactggtgcactttgtaaatt

SEQ ID NO: 4606226 - DNA, 14 bp, Homo sapiens
taagcctttggaaa

SEQ ID NO: 4606227 - DNA, 22 bp, Homo sapiens
taatagattttttcagacttgt

SEQ ID NO: 4606228 - DNA, 23 bp, Homo sapiens
taatagattttttcagacttgtc

SEQ ID NO: 4606229 - DNA, 21 bp, Homo sapiens
taatatcaaatgcagtatatt

SEQ ID NO: 4606230 - DNA, 18 bp, Homo sapiens
taatctgggccagaattt

SEQ ID NO: 4606231 - DNA, 17 bp, Homo sapiens
taatgttttaaatgtac

SEQ ID NO: 4606232 - DNA, 15 bp, Homo sapiens
taatttagtaaatgt

SEQ ID NO: 4606233 - DNA, 13 bp, Homo sapiens
tacaataaaaaca

SEQ ID NO: 4606234 - DNA, 23 bp, Homo sapiens
tacataatgggccactgaaatct

SEQ ID NO: 4606235 - DNA, 22 bp, Homo sapiens
tacatcatgctggaacctgcaa

SEQ ID NO: 4606236 - DNA, 18 bp, Homo sapiens
tactcttatagacaacat

SEQ ID NO: 4606237 - DNA, 13 bp, Homo sapiens
tactttttctaat

SEQ ID NO: 4606238 - DNA, 14 bp, Homo sapiens
tagaaaagttatta

SEQ ID NO: 4606239 - DNA, 19 bp, Homo sapiens
tagaaactaattgacttta

SEQ ID NO: 4606240 - DNA, 12 bp, Homo sapiens
tagattttttca

SEQ ID NO: 4606241 - DNA, 15 bp, Homo sapiens
tagttatataattgt

SEQ ID NO: 4606242 - DNA, 13 bp, Homo sapiens
tatactgtacaat

SEQ ID NO: 4606243 - DNA, 17 bp, Homo sapiens
tatactgtacaataaaa

SEQ ID NO: 4606244 - DNA, 14 bp, Homo sapiens
tatatgaaaacctg

SEQ ID NO: 4606245 - DNA, 11 bp, Homo sapiens
tatatgtattt

SEQ ID NO: 4606246 - DNA, 16 bp, Homo sapiens
tatatttcagatgtaa

SEQ ID NO: 4606247 - DNA, 22 bp, Homo sapiens
tatatttgtgctatagtatttg

SEQ ID NO: 4606248 - DNA, 14 bp, Homo sapiens
tatcagcaaaaaag

SEQ ID NO: 4606249 - DNA, 13 bp, Homo sapiens
tatctaaagttat

SEQ ID NO: 4606250 - DNA, 14 bp, Homo sapiens
tatctaaagttata

SEQ ID NO: 4606251 - DNA, 19 bp, Homo sapiens
tatctaaagttatatttca

SEQ ID NO: 4606252 - DNA, 18 bp, Homo sapiens
tatcttatactgtacaat

SEQ ID NO: 4606253 - DNA, 11 bp, Homo sapiens
tatgtatttcc

SEQ ID NO: 4606254 - DNA, 10 bp, Homo sapiens
tatgtatttt

SEQ ID NO: 4606255 - DNA, 17 bp, Homo sapiens
tatgttgaagcctttgt

SEQ ID NO: 4606256 - DNA, 18 bp, Homo sapiens
tatttaaaaatgtcttgc

SEQ ID NO: 4606257 - DNA, 12 bp, Homo sapiens
tatttaatgttt

SEQ ID NO: 4606258 - DNA, 21 bp, Homo sapiens
tatttaatgttttaaatgtac

SEQ ID NO: 4606259 - DNA, 13 bp, Homo sapiens
tatttcagatgta

SEQ ID NO: 4606260 - DNA, 19 bp, Homo sapiens
tatttcagatgtaatgttt

SEQ ID NO: 4606261 - DNA, 20 bp, Homo sapiens
tatttcagatgtaatgtttt

SEQ ID NO: 4606262 - DNA, 17 bp, Homo sapiens
tatttgattcaaaatat

SEQ ID NO: 4606263 - DNA, 17 bp, Homo sapiens
tatttgtgctatagtat

SEQ ID NO: 4606264 - DNA, 15 bp, Homo sapiens
tcaaaatagaaaagt

SEQ ID NO: 4606265 - DNA, 20 bp, Homo sapiens
tcaaaatatttaaaaatgtc

SEQ ID NO: 4606266 - DNA, 22 bp, Homo sapiens
tcaaaatatttaaaaatgtctt

SEQ ID NO: 4606267 - DNA, 15 bp, Homo sapiens
tcaaagcaaatgtct

SEQ ID NO: 4606268 - DNA, 19 bp, Homo sapiens
tcaaatgcagtatatttct

SEQ ID NO: 4606269 - DNA, 20 bp, Homo sapiens
tcaaatgcagtatatttctt

SEQ ID NO: 4606270 - DNA, 22 bp, Homo sapiens
tcaaatttagaaactaattgac

SEQ ID NO: 4606271 - DNA, 13 bp, Homo sapiens
tcacctttattct

SEQ ID NO: 4606272 - DNA, 14 bp, Homo sapiens
tcagacttgtcaag

SEQ ID NO: 4606273 - DNA, 15 bp, Homo sapiens
tcagatgtaatgttt

SEQ ID NO: 4606274 - DNA, 20 bp, Homo sapiens
tcagtatccatgctcttgac

SEQ ID NO: 4606275 - DNA, 20 bp, Homo sapiens
tcagtgccctccaggataga

SEQ ID NO: 4606276 - DNA, 20 bp, Homo sapiens
tcagtggggcccatggatgt

SEQ ID NO: 4606277 - DNA, 16 bp, Homo sapiens
tcagttaagcctttgg

SEQ ID NO: 4606278 - DNA, 15 bp, Homo sapiens
tcagttactcttcag

SEQ ID NO: 4606279 - DNA, 16 bp, Homo sapiens
tcatggtgtgttacac

SEQ ID NO: 4606280 - DNA, 19 bp, Homo sapiens
tccaaatgcagctttaaaa

SEQ ID NO: 4606281 - DNA, 16 bp, Homo sapiens
tcccaggatgtacaag

SEQ ID NO: 4606282 - DNA, 16 bp, Homo sapiens
tcctcccctcctcctg

SEQ ID NO: 4606283 - DNA, 18 bp, Homo sapiens
tcctcccctcctcctgga

SEQ ID NO: 4606284 - DNA, 20 bp, Homo sapiens
tcctcccctcctcctggact

SEQ ID NO: 4606285 - DNA, 13 bp, Homo sapiens
tcctcctggactc

SEQ ID NO: 4606286 - DNA, 14 bp, Homo sapiens
tcctgcacacgctc

SEQ ID NO: 4606287 - DNA, 21 bp, Homo sapiens
tcctgcacacgctccttcctc

SEQ ID NO: 4606288 - DNA, 19 bp, Homo sapiens
tcctgcctaaggctgaact

SEQ ID NO: 4606289 - DNA, 16 bp, Homo sapiens
tccttcaaagcaaatg

SEQ ID NO: 4606290 - DNA, 12 bp, Homo sapiens
tctaaagttata

SEQ ID NO: 4606291 - DNA, 19 bp, Homo sapiens
tctgaaggggcaaattctt

SEQ ID NO: 4606292 - DNA, 11 bp, Homo sapiens
tctgaggctga

SEQ ID NO: 4606293 - DNA, 23 bp, Homo sapiens
tctgaggctgaaattcagaatat

SEQ ID NO: 4606294 - DNA, 22 bp, Homo sapiens
tctgctgatcctcccaggcttc

SEQ ID NO: 4606295 - DNA, 17 bp, Homo sapiens
tctgtcaagagtagtta

SEQ ID NO: 4606296 - DNA, 22 bp, Homo sapiens
tctgtcaagagtagttatataa

SEQ ID NO: 4606297 - DNA, 14 bp, Homo sapiens
tcttatactgtaca

SEQ ID NO: 4606298 - DNA, 15 bp, Homo sapiens
tcttatactgtacaa

SEQ ID NO: 4606299 - DNA, 17 bp, Homo sapiens
tcttcaaaatgagccct

SEQ ID NO: 4606300 - DNA, 22 bp, Homo sapiens
tctttgcaaagtattgtaaatt

SEQ ID NO: 4606301 - DNA, 17 bp, Homo sapiens
tcttttgaattgttaca

SEQ ID NO: 4606302 - DNA, 15 bp, Homo sapiens
tctttttaagttaat

SEQ ID NO: 4606303 - DNA, 23 bp, Homo sapiens
tgaaatagacccacaagaggcag

SEQ ID NO: 4606304 - DNA, 15 bp, Homo sapiens
tgaaatctgtcaaga

SEQ ID NO: 4606305 - DNA, 19 bp, Homo sapiens
tgacatatttaatgtttta

SEQ ID NO: 4606306 - DNA, 20 bp, Homo sapiens
tgacatatttaatgttttaa

SEQ ID NO: 4606307 - DNA, 21 bp, Homo sapiens
tgacatatttaatgttttaaa

SEQ ID NO: 4606308 - DNA, 19 bp, Homo sapiens
tgacatgtgttggcagcct

SEQ ID NO: 4606309 - DNA, 14 bp, Homo sapiens
tgacattgccaaaa

SEQ ID NO: 4606310 - DNA, 21 bp, Homo sapiens
tgatgcctgtgaactgaactc

SEQ ID NO: 4606311 - DNA, 23 bp, Homo sapiens
tgattcaaaatatttaaaaatgt

SEQ ID NO: 4606312 - DNA, 13 bp, Homo sapiens
tgcactttgtaaa

SEQ ID NO: 4606313 - DNA, 14 bp, Homo sapiens
tgcactttgtaaat

SEQ ID NO: 4606314 - DNA, 22 bp, Homo sapiens
tgcagctttaaaaaattaatct

SEQ ID NO: 4606315 - DNA, 15 bp, Homo sapiens
tgccgcaaattgtac

SEQ ID NO: 4606316 - DNA, 18 bp, Homo sapiens
tgcctgtgaactgaactc

SEQ ID NO: 4606317 - DNA, 15 bp, Homo sapiens
tgctatagtatttga

SEQ ID NO: 4606318 - DNA, 22 bp, Homo sapiens
tgctatagtatttgattcaaaa

SEQ ID NO: 4606319 - DNA, 18 bp, Homo sapiens
tgctctgatgaagaggag

SEQ ID NO: 4606320 - DNA, 20 bp, Homo sapiens
tgctcttgaccttgtagaga

SEQ ID NO: 4606321 - DNA, 19 bp, Homo sapiens
tgctggaacctgcaaaaaa

SEQ ID NO: 4606322 - DNA, 15 bp, Homo sapiens
tgctgttgacatatt

SEQ ID NO: 4606323 - DNA, 18 bp, Homo sapiens
tgctgttgacatatttaa

SEQ ID NO: 4606324 - DNA, 17 bp, Homo sapiens
tggaaacagctcgactt

SEQ ID NO: 4606325 - DNA, 23 bp, Homo sapiens
tggaaggggacacgtgacagccg

SEQ ID NO: 4606326 - DNA, 12 bp, Homo sapiens
tggatgccttga

SEQ ID NO: 4606327 - DNA, 15 bp, Homo sapiens
tggcagcctcttcaa

SEQ ID NO: 4606328 - DNA, 21 bp, Homo sapiens
tggcctctgctgatcctccca

SEQ ID NO: 4606329 - DNA, 17 bp, Homo sapiens
tgggccagaatttcaaa

SEQ ID NO: 4606330 - DNA, 21 bp, Homo sapiens
tggtggagaggcccggcctct

SEQ ID NO: 4606331 - DNA, 19 bp, Homo sapiens
tggtttatcagcaaaaaag

SEQ ID NO: 4606332 - DNA, 21 bp, Homo sapiens
tggtttttaaattttgtaatg

SEQ ID NO: 4606333 - DNA, 19 bp, Homo sapiens
tgtaatgaattcctagaat

SEQ ID NO: 4606334 - DNA, 13 bp, Homo sapiens
tgtaatgttttct

SEQ ID NO: 4606335 - DNA, 19 bp, Homo sapiens
tgtaatgttttctttgcaa

SEQ ID NO: 4606336 - DNA, 16 bp, Homo sapiens
tgtacaaggacagccc

SEQ ID NO: 4606337 - DNA, 12 bp, Homo sapiens
tgtacaataaaa

SEQ ID NO: 4606338 - DNA, 14 bp, Homo sapiens
tgtacagacatatt

SEQ ID NO: 4606339 - DNA, 21 bp, Homo sapiens
tgtaccttttttgttttttca

SEQ ID NO: 4606340 - DNA, 17 bp, Homo sapiens
tgtcaagcctgtgcaaa

SEQ ID NO: 4606341 - DNA, 23 bp, Homo sapiens
tgtgcaaaaaaattaaaatggat

SEQ ID NO: 4606342 - DNA, 14 bp, Homo sapiens
tgtgcttgttaact

SEQ ID NO: 4606343 - DNA, 22 bp, Homo sapiens
tgttaactgagtgccttttggt

SEQ ID NO: 4606344 - DNA, 22 bp, Homo sapiens
tgttaattttttggtacaaaaa

SEQ ID NO: 4606345 - DNA, 13 bp, Homo sapiens
tgttatgtatttc

SEQ ID NO: 4606346 - DNA, 14 bp, Homo sapiens
tgttatgtatttcc

SEQ ID NO: 4606347 - DNA, 18 bp, Homo sapiens
tgttgacatatttaatgt

SEQ ID NO: 4606348 - DNA, 21 bp, Homo sapiens
tgttgacatatttaatgtttt

SEQ ID NO: 4606349 - DNA, 23 bp, Homo sapiens
tgttgacatatttaatgttttaa

SEQ ID NO: 4606350 - DNA, 14 bp, Homo sapiens
tgttggcagcctct

SEQ ID NO: 4606351 - DNA, 17 bp, Homo sapiens
tgtttcctaatatcaaa

SEQ ID NO: 4606352 - DNA, 16 bp, Homo sapiens
tgttttttcaaaatag

SEQ ID NO: 4606353 - DNA, 19 bp, Homo sapiens
ttaaatgtacagacatatt

SEQ ID NO: 4606354 - DNA, 15 bp, Homo sapiens
ttaaattttgtaatg

SEQ ID NO: 4606355 - DNA, 20 bp, Homo sapiens
ttaactggtgcactttgtaa

SEQ ID NO: 4606356 - DNA, 15 bp, Homo sapiens
ttaagcctttggaaa

SEQ ID NO: 4606357 - DNA, 18 bp, Homo sapiens
ttaatgttttaaatgtac

SEQ ID NO: 4606358 - DNA, 17 bp, Homo sapiens
ttaatttagtaaatgtt

SEQ ID NO: 4606359 - DNA, 18 bp, Homo sapiens
ttaatttagtaaatgtta

SEQ ID NO: 4606360 - DNA, 18 bp, Homo sapiens
ttacacaatggtttttaa

SEQ ID NO: 4606361 - DNA, 23 bp, Homo sapiens
ttactcttcagttaagcctttgg

SEQ ID NO: 4606362 - DNA, 22 bp, Homo sapiens
ttagaaagctgacattgccaaa

SEQ ID NO: 4606363 - DNA, 21 bp, Homo sapiens
ttagactcatggtgtgttaca

SEQ ID NO: 4606364 - DNA, 13 bp, Homo sapiens
ttatactgtacaa

SEQ ID NO: 4606365 - DNA, 14 bp, Homo sapiens
ttatactgtacaat

SEQ ID NO: 4606366 - DNA, 15 bp, Homo sapiens
ttatactgtacaata

SEQ ID NO: 4606367 - DNA, 15 bp, Homo sapiens
ttcaaaatatttaaa

SEQ ID NO: 4606368 - DNA, 14 bp, Homo sapiens
ttcagacttgtcaa

SEQ ID NO: 4606369 - DNA, 17 bp, Homo sapiens
ttcagatgtaatgtttt

SEQ ID NO: 4606370 - DNA, 14 bp, Homo sapiens
ttccccaagacatt

SEQ ID NO: 4606371 - DNA, 19 bp, Homo sapiens
ttccccatgtctcgactca

SEQ ID NO: 4606372 - DNA, 20 bp, Homo sapiens
ttccctggggaaaacttgca

SEQ ID NO: 4606373 - DNA, 16 bp, Homo sapiens
ttcctaatatcaaatg

SEQ ID NO: 4606374 - DNA, 20 bp, Homo sapiens
ttccttcaaagcaaatgtct

SEQ ID NO: 4606375 - DNA, 21 bp, Homo sapiens
ttctaatgaggagagaaaata

SEQ ID NO: 4606376 - DNA, 13 bp, Homo sapiens
ttgaagcctttgt

SEQ ID NO: 4606377 - DNA, 13 bp, Homo sapiens
ttgaattgttaca

SEQ ID NO: 4606378 - DNA, 17 bp, Homo sapiens
ttgcaaagtattgtaaa

SEQ ID NO: 4606379 - DNA, 15 bp, Homo sapiens
ttgccaaaaaggata

SEQ ID NO: 4606380 - DNA, 17 bp, Homo sapiens
ttgcctttgaatgttaa

SEQ ID NO: 4606381 - DNA, 12 bp, Homo sapiens
ttgctgttgaca

SEQ ID NO: 4606382 - DNA, 20 bp, Homo sapiens
ttgctgttgacatatttaat

SEQ ID NO: 4606383 - DNA, 20 bp, Homo sapiens
ttggccaccaggtgcctttc

SEQ ID NO: 4606384 - DNA, 14 bp, Homo sapiens
ttggtacaaaaata

SEQ ID NO: 4606385 - DNA, 15 bp, Homo sapiens
ttggtacaaaaataa

SEQ ID NO: 4606386 - DNA, 15 bp, Homo sapiens
ttgtaaattatattt

SEQ ID NO: 4606387 - DNA, 16 bp, Homo sapiens
ttgtgccagaatgctt

SEQ ID NO: 4606388 - DNA, 19 bp, Homo sapiens
ttgtgctatagtatttgat

SEQ ID NO: 4606389 - DNA, 21 bp, Homo sapiens
ttgttttttcaaaatagaaaa

SEQ ID NO: 4606390 - DNA, 17 bp, Homo sapiens
tttaaaaaattaatctg

SEQ ID NO: 4606391 - DNA, 14 bp, Homo sapiens
tttaaaaatgtctt

SEQ ID NO: 4606392 - DNA, 15 bp, Homo sapiens
tttaaattttgtaat

SEQ ID NO: 4606393 - DNA, 13 bp, Homo sapiens
tttaactggtgca

SEQ ID NO: 4606394 - DNA, 19 bp, Homo sapiens
tttaagacatttttggaag

SEQ ID NO: 4606395 - DNA, 16 bp, Homo sapiens
tttagtaaatgttatc

SEQ ID NO: 4606396 - DNA, 17 bp, Homo sapiens
tttatataatatctaaa

SEQ ID NO: 4606397 - DNA, 22 bp, Homo sapiens
tttatataatatctaaagttat

SEQ ID NO: 4606398 - DNA, 15 bp, Homo sapiens
tttatcagcaaaaaa

SEQ ID NO: 4606399 - DNA, 11 bp, Homo sapiens
tttcaaaatag

SEQ ID NO: 4606400 - DNA, 20 bp, Homo sapiens
tttcaaaatagaaaagttat

SEQ ID NO: 4606401 - DNA, 14 bp, Homo sapiens
tttcaaatttagaa

SEQ ID NO: 4606402 - DNA, 20 bp, Homo sapiens
tttcaaatttagaaactaat

SEQ ID NO: 4606403 - DNA, 16 bp, Homo sapiens
tttcagatgtaatgtt

SEQ ID NO: 4606404 - DNA, 11 bp, Homo sapiens
tttgaatgtta

SEQ ID NO: 4606405 - DNA, 12 bp, Homo sapiens
tttgaatgttaa

SEQ ID NO: 4606406 - DNA, 16 bp, Homo sapiens
tttgaatgttaatttt

SEQ ID NO: 4606407 - DNA, 22 bp, Homo sapiens
tttggagtgttatgtatttcct

SEQ ID NO: 4606408 - DNA, 14 bp, Homo sapiens
tttgtaatgaattc

SEQ ID NO: 4606409 - DNA, 20 bp, Homo sapiens
tttgtaatgaattcctagaa

SEQ ID NO: 4606410 - DNA, 15 bp, Homo sapiens
ttttaaatgtacaga

SEQ ID NO: 4606411 - DNA, 18 bp, Homo sapiens
ttttaatttagtaaatgt

SEQ ID NO: 4606412 - DNA, 12 bp, Homo sapiens
ttttctttgcaa

SEQ ID NO: 4606413 - DNA, 17 bp, Homo sapiens
ttttggagtgttatgta

SEQ ID NO: 4606414 - DNA, 20 bp, Homo sapiens
ttttggagtgttatgtattt

SEQ ID NO: 4606415 - DNA, 16 bp, Homo sapiens
ttttggtacaaaaata

SEQ ID NO: 4606416 - DNA, 19 bp, Homo sapiens
ttttgttttttcaaaatag

SEQ ID NO: 4606417 - DNA, 19 bp, Homo sapiens
tttttaaattttgtaatga

SEQ ID NO: 4606418 - DNA, 18 bp, Homo sapiens
tttttaagttaatagatt

SEQ ID NO: 4606419 - DNA, 13 bp, Homo sapiens
tttttggtacaaa

SEQ ID NO: 4606420 - DNA, 14 bp, Homo sapiens
tttttggtacaaaa

SEQ ID NO: 4606421 - DNA, 13 bp, Homo sapiens
ttttttggtacaa

SEQ ID NO: 4606422 - DNA, 13 bp, Homo sapiens
aaaaaatgttgtt

SEQ ID NO: 4606423 - DNA, 12 bp, Homo sapiens
aaaaacattgcc

SEQ ID NO: 4606424 - DNA, 16 bp, Homo sapiens
aaaaagtccaatttta

SEQ ID NO: 4606425 - DNA, 13 bp, Homo sapiens
aaaaattaaaatg

SEQ ID NO: 4606426 - DNA, 13 bp, Homo sapiens
aaaagtccaattt

SEQ ID NO: 4606427 - DNA, 12 bp, Homo sapiens
aaaataaattta

SEQ ID NO: 4606428 - DNA, 15 bp, Homo sapiens
aaaatagaaaagtta

SEQ ID NO: 4606429 - DNA, 16 bp, Homo sapiens
aaaatagaaaagttat

SEQ ID NO: 4606430 - DNA, 13 bp, Homo sapiens
aaaatatatgtat

SEQ ID NO: 4606431 - DNA, 20 bp, Homo sapiens
aaaatatttaaaaatgtctt

SEQ ID NO: 4606432 - DNA, 12 bp, Homo sapiens
aaaattaaaatg

SEQ ID NO: 4606433 - DNA, 15 bp, Homo sapiens
aaacattatgatgtg

SEQ ID NO: 4606434 - DNA, 17 bp, Homo sapiens
aaacattgcctttgaat

SEQ ID NO: 4606435 - DNA, 23 bp, Homo sapiens
aaacggcctcactaggcttctgg

SEQ ID NO: 4606436 - DNA, 19 bp, Homo sapiens
aaagctgacattgccaaaa

SEQ ID NO: 4606437 - DNA, 20 bp, Homo sapiens
aaagtccaattttaatttag

SEQ ID NO: 4606438 - DNA, 16 bp, Homo sapiens
aaatactttttctaat

SEQ ID NO: 4606439 - DNA, 16 bp, Homo sapiens
aaatagaaaagttatt

SEQ ID NO: 4606440 - DNA, 20 bp, Homo sapiens
aaatctgtcaagagtagtta

SEQ ID NO: 4606441 - DNA, 23 bp, Homo sapiens
aaatggatgccttgaataataag

SEQ ID NO: 4606442 - DNA, 17 bp, Homo sapiens
aaatgtacagacatatt

SEQ ID NO: 4606443 - DNA, 14 bp, Homo sapiens
aaatgtcttcctgg

SEQ ID NO: 4606444 - DNA, 22 bp, Homo sapiens
aaatgtcttgctgttgacatat

SEQ ID NO: 4606445 - DNA, 23 bp, Homo sapiens
aaatgtcttgctgttgacatatt

SEQ ID NO: 4606446 - DNA, 14 bp, Homo sapiens
aaattaatctgggc

SEQ ID NO: 4606447 - DNA, 13 bp, Homo sapiens
aaatttagaaact

SEQ ID NO: 4606448 - DNA, 18 bp, Homo sapiens
aacaagccaagaaagatg

SEQ ID NO: 4606449 - DNA, 16 bp, Homo sapiens
aacacgcgtatttaca

SEQ ID NO: 4606450 - DNA, 13 bp, Homo sapiens
aacagctcgactt

SEQ ID NO: 4606451 - DNA, 14 bp, Homo sapiens
aacctgcaaaaaat

SEQ ID NO: 4606452 - DNA, 20 bp, Homo sapiens
aactaattgactttagaaag

SEQ ID NO: 4606453 - DNA, 22 bp, Homo sapiens
aactctgacaacagacttctga

SEQ ID NO: 4606454 - DNA, 23 bp, Homo sapiens
aactctgacaacagacttctgaa

SEQ ID NO: 4606455 - DNA, 12 bp, Homo sapiens
aagcaaatgtct

SEQ ID NO: 4606456 - DNA, 17 bp, Homo sapiens
aagcctgtgcaaaaaaa

SEQ ID NO: 4606457 - DNA, 19 bp, Homo sapiens
aaggaggggaaaaaaatgt

SEQ ID NO: 4606458 - DNA, 13 bp, Homo sapiens
aaggatcatctga

SEQ ID NO: 4606459 - DNA, 15 bp, Homo sapiens
aagtgccgcaaattg

SEQ ID NO: 4606460 - DNA, 15 bp, Homo sapiens
aataaatttatatga

SEQ ID NO: 4606461 - DNA, 18 bp, Homo sapiens
aatagacccacaagaggc

SEQ ID NO: 4606462 - DNA, 20 bp, Homo sapiens
aatatctaaagttatatttc

SEQ ID NO: 4606463 - DNA, 15 bp, Homo sapiens
aatatttaaaaatgt

SEQ ID NO: 4606464 - DNA, 15 bp, Homo sapiens
aatatttataggtca

SEQ ID NO: 4606465 - DNA, 12 bp, Homo sapiens
aatcccaggatg

SEQ ID NO: 4606466 - DNA, 18 bp, Homo sapiens
aatctgggccagaatttc

SEQ ID NO: 4606467 - DNA, 13 bp, Homo sapiens
aatctgtcaagag

SEQ ID NO: 4606468 - DNA, 16 bp, Homo sapiens
aatgaattcctagaat

SEQ ID NO: 4606469 - DNA, 17 bp, Homo sapiens
aatggatgccttgaata

SEQ ID NO: 4606470 - DNA, 21 bp, Homo sapiens
aatggtttttaaattttgtaa

SEQ ID NO: 4606471 - DNA, 19 bp, Homo sapiens
aatgtcttgctgttgacat

SEQ ID NO: 4606472 - DNA, 23 bp, Homo sapiens
aatgtcttgctgttgacatattt

SEQ ID NO: 4606473 - DNA, 13 bp, Homo sapiens
aatgttaattttt

SEQ ID NO: 4606474 - DNA, 22 bp, Homo sapiens
aatgttatcttatactgtacaa

SEQ ID NO: 4606475 - DNA, 23 bp, Homo sapiens
aatgttatcttatactgtacaat

SEQ ID NO: 4606476 - DNA, 12 bp, Homo sapiens
aatgttgtttcc

SEQ ID NO: 4606477 - DNA, 22 bp, Homo sapiens
aatgttgtttcctaatatcaaa

SEQ ID NO: 4606478 - DNA, 17 bp, Homo sapiens
aatgttttaaatgtaca

SEQ ID NO: 4606479 - DNA, 16 bp, Homo sapiens
aatgttttctttgcaa

SEQ ID NO: 4606480 - DNA, 20 bp, Homo sapiens
aattatatttgtgctatagt

SEQ ID NO: 4606481 - DNA, 14 bp, Homo sapiens
aattccctggggaa

SEQ ID NO: 4606482 - DNA, 21 bp, Homo sapiens
aatttagaaactaattgactt

SEQ ID NO: 4606483 - DNA, 22 bp, Homo sapiens
aatttagaaactaattgacttt

SEQ ID NO: 4606484 - DNA, 13 bp, Homo sapiens
aattttgtaatga

SEQ ID NO: 4606485 - DNA, 16 bp, Homo sapiens
aattttttggtacaaa

SEQ ID NO: 4606486 - DNA, 12 bp, Homo sapiens
acaaaaataaat

SEQ ID NO: 4606487 - DNA, 20 bp, Homo sapiens
acaaaaataaatttatatga

SEQ ID NO: 4606488 - DNA, 16 bp, Homo sapiens
acacaatggtttttaa

SEQ ID NO: 4606489 - DNA, 21 bp, Homo sapiens
acagaacacataattcaggaa

SEQ ID NO: 4606490 - DNA, 21 bp, Homo sapiens
acagccagtgggagatgttag

SEQ ID NO: 4606491 - DNA, 14 bp, Homo sapiens
acagcccctcctcc

SEQ ID NO: 4606492 - DNA, 20 bp, Homo sapiens
acataatgggccactgaaat

SEQ ID NO: 4606493 - DNA, 21 bp, Homo sapiens
acataatgggccactgaaatc

SEQ ID NO: 4606494 - DNA, 13 bp, Homo sapiens
acatatttaatgt

SEQ ID NO: 4606495 - DNA, 14 bp, Homo sapiens
acatatttaatgtt

SEQ ID NO: 4606496 - DNA, 15 bp, Homo sapiens
acatatttaatgttt

SEQ ID NO: 4606497 - DNA, 17 bp, Homo sapiens
acatatttaatgtttta

SEQ ID NO: 4606498 - DNA, 17 bp, Homo sapiens
acattgcctttgaatgt

SEQ ID NO: 4606499 - DNA, 18 bp, Homo sapiens
acattgcctttgaatgtt

SEQ ID NO: 4606500 - DNA, 23 bp, Homo sapiens
accactgctctgatgaagaggag

SEQ ID NO: 4606501 - DNA, 22 bp, Homo sapiens
accaggtgcctttcaaatttag

SEQ ID NO: 4606502 - DNA, 13 bp, Homo sapiens
actctgacaacag

SEQ ID NO: 4606503 - DNA, 23 bp, Homo sapiens
actctgacaacagacttctgaaa

SEQ ID NO: 4606504 - DNA, 20 bp, Homo sapiens
actcttcagttaagcctttg

SEQ ID NO: 4606505 - DNA, 21 bp, Homo sapiens
actcttcagttaagcctttgg

SEQ ID NO: 4606506 - DNA, 16 bp, Homo sapiens
actgagtgccttttgg

SEQ ID NO: 4606507 - DNA, 12 bp, Homo sapiens
actgctctgatg

SEQ ID NO: 4606508 - DNA, 13 bp, Homo sapiens
actggtgcacttt

SEQ ID NO: 4606509 - DNA, 16 bp, Homo sapiens
actggtgcactttgta

SEQ ID NO: 4606510 - DNA, 21 bp, Homo sapiens
actggtgcactttgtaaattc

SEQ ID NO: 4606511 - DNA, 22 bp, Homo sapiens
actggtgcactttgtaaattcc

SEQ ID NO: 4606512 - DNA, 20 bp, Homo sapiens
acttgtcaagcctgtgcaaa

SEQ ID NO: 4606513 - DNA, 16 bp, Homo sapiens
acttgttttctgggaa

SEQ ID NO: 4606514 - DNA, 17 bp, Homo sapiens
agaaactaattgacttt

SEQ ID NO: 4606515 - DNA, 15 bp, Homo sapiens
agacatatttaactg

SEQ ID NO: 4606516 - DNA, 14 bp, Homo sapiens
agactactaagagg

SEQ ID NO: 4606517 - DNA, 12 bp, Homo sapiens
agagaaaatata

SEQ ID NO: 4606518 - DNA, 16 bp, Homo sapiens
agagaaaatatatgta

SEQ ID NO: 4606519 - DNA, 15 bp, Homo sapiens
agagggtgtcatcta

SEQ ID NO: 4606520 - DNA, 14 bp, Homo sapiens
agatgtaatgtttt

SEQ ID NO: 4606521 - DNA, 23 bp, Homo sapiens
agctaaggaggggaaaaaaatgt

SEQ ID NO: 4606522 - DNA, 16 bp, Homo sapiens
agctgacattgccaaa

SEQ ID NO: 4606523 - DNA, 14 bp, Homo sapiens
aggagagaaaatat

SEQ ID NO: 4606524 - DNA, 16 bp, Homo sapiens
aggagagaaaatatat

SEQ ID NO: 4606525 - DNA, 13 bp, Homo sapiens
aggatcatctgaa

SEQ ID NO: 4606526 - DNA, 21 bp, Homo sapiens
aggctgaacttgttttctggg

SEQ ID NO: 4606527 - DNA, 15 bp, Homo sapiens
aggggaaaaaaatgt

SEQ ID NO: 4606528 - DNA, 16 bp, Homo sapiens
aggggaaaaaaatgtt

SEQ ID NO: 4606529 - DNA, 18 bp, Homo sapiens
aggtcacctttattctgg

SEQ ID NO: 4606530 - DNA, 10 bp, Homo sapiens
agtaaatgtt

SEQ ID NO: 4606531 - DNA, 22 bp, Homo sapiens
agtaaatgttatcttatactgt

SEQ ID NO: 4606532 - DNA, 18 bp, Homo sapiens
agtagttatataattgtt

SEQ ID NO: 4606533 - DNA, 17 bp, Homo sapiens
agtatgggactggcctc

SEQ ID NO: 4606534 - DNA, 20 bp, Homo sapiens
agtatgggactggcctctgc

SEQ ID NO: 4606535 - DNA, 12 bp, Homo sapiens
agtattgtaaat

SEQ ID NO: 4606536 - DNA, 18 bp, Homo sapiens
agtattgtaaattatatt

SEQ ID NO: 4606537 - DNA, 17 bp, Homo sapiens
agtatttgattcaaaat

SEQ ID NO: 4606538 - DNA, 19 bp, Homo sapiens
agtatttgattcaaaatat

SEQ ID NO: 4606539 - DNA, 20 bp, Homo sapiens
agtatttgattcaaaatatt

SEQ ID NO: 4606540 - DNA, 23 bp, Homo sapiens
agtatttgattcaaaatatttaa

SEQ ID NO: 4606541 - DNA, 17 bp, Homo sapiens
agtccaattttaattta

SEQ ID NO: 4606542 - DNA, 21 bp, Homo sapiens
agtccaattttaatttagtaa

SEQ ID NO: 4606543 - DNA, 17 bp, Homo sapiens
agtgacctcagctttga

SEQ ID NO: 4606544 - DNA, 22 bp, Homo sapiens
atacataatgggccactgaaat

SEQ ID NO: 4606545 - DNA, 18 bp, Homo sapiens
atactcttatagacaaca

SEQ ID NO: 4606546 - DNA, 17 bp, Homo sapiens
atactttttctaatgag

SEQ ID NO: 4606547 - DNA, 12 bp, Homo sapiens
atagtatttgat

SEQ ID NO: 4606548 - DNA, 17 bp, Homo sapiens
atataatatctaaagtt

SEQ ID NO: 4606549 - DNA, 12 bp, Homo sapiens
atatatgtattt

SEQ ID NO: 4606550 - DNA, 13 bp, Homo sapiens
atatcaaatgcag

SEQ ID NO: 4606551 - DNA, 17 bp, Homo sapiens
atatgtatttttatata

SEQ ID NO: 4606552 - DNA, 17 bp, Homo sapiens
atatttaaaaatgtctt

SEQ ID NO: 4606553 - DNA, 14 bp, Homo sapiens
atatttaatgtttt

SEQ ID NO: 4606554 - DNA, 15 bp, Homo sapiens
atatttaatgtttta

SEQ ID NO: 4606555 - DNA, 21 bp, Homo sapiens
atatttaatgttttaaatgta

SEQ ID NO: 4606556 - DNA, 20 bp, Homo sapiens
atatttcagatgtaatgttt

SEQ ID NO: 4606557 - DNA, 22 bp, Homo sapiens
atatttgtgctatagtatttga

SEQ ID NO: 4606558 - DNA, 19 bp, Homo sapiens
atcaaatgcagtatatttc

SEQ ID NO: 4606559 - DNA, 15 bp, Homo sapiens
atcagtgccctccag

SEQ ID NO: 4606560 - DNA, 17 bp, Homo sapiens
atcagtgccctccagga

SEQ ID NO: 4606561 - DNA, 13 bp, Homo sapiens
atctaaagttata

SEQ ID NO: 4606562 - DNA, 14 bp, Homo sapiens
atctaaagttatat

SEQ ID NO: 4606563 - DNA, 23 bp, Homo sapiens
atctgaaggggcaaattcttttg

SEQ ID NO: 4606564 - DNA, 15 bp, Homo sapiens
atctgggccagaatt

SEQ ID NO: 4606565 - DNA, 16 bp, Homo sapiens
atcttatactgtacaa

SEQ ID NO: 4606566 - DNA, 17 bp, Homo sapiens
atcttatactgtacaat

SEQ ID NO: 4606567 - DNA, 11 bp, Homo sapiens
atgaagaggag

SEQ ID NO: 4606568 - DNA, 11 bp, Homo sapiens
atgagaaactg

SEQ ID NO: 4606569 - DNA, 18 bp, Homo sapiens
atgaggagagaaaatata

SEQ ID NO: 4606570 - DNA, 23 bp, Homo sapiens
atgccttgaataataagcaggat

SEQ ID NO: 4606571 - DNA, 15 bp, Homo sapiens
atgggactggcctct

SEQ ID NO: 4606572 - DNA, 14 bp, Homo sapiens
atggtgtgttacac

SEQ ID NO: 4606573 - DNA, 21 bp, Homo sapiens
atgtaatgttttctttgcaaa

SEQ ID NO: 4606574 - DNA, 23 bp, Homo sapiens
atgtaatgttttctttgcaaagt

SEQ ID NO: 4606575 - DNA, 22 bp, Homo sapiens
atgtcttgctgttgacatattt

SEQ ID NO: 4606576 - DNA, 22 bp, Homo sapiens
atgtgccccttcgcagctgaag

SEQ ID NO: 4606577 - DNA, 17 bp, Homo sapiens
atgttaattttttggta

SEQ ID NO: 4606578 - DNA, 20 bp, Homo sapiens
atgttaattttttggtacaa

SEQ ID NO: 4606579 - DNA, 22 bp, Homo sapiens
atgttagactcatggtgtgtta

SEQ ID NO: 4606580 - DNA, 23 bp, Homo sapiens
atgttggccaccaggtgcctttc

SEQ ID NO: 4606581 - DNA, 23 bp, Homo sapiens
atgttgtttcctaatatcaaatg

SEQ ID NO: 4606582 - DNA, 16 bp, Homo sapiens
atgttttctttgcaaa

SEQ ID NO: 4606583 - DNA, 12 bp, Homo sapiens
attcaaaatatt

SEQ ID NO: 4606584 - DNA, 15 bp, Homo sapiens
attcaaaatatttaa

SEQ ID NO: 4606585 - DNA, 15 bp, Homo sapiens
attcttttgaattgt

SEQ ID NO: 4606586 - DNA, 17 bp, Homo sapiens
attgcctttgaatgtta

SEQ ID NO: 4606587 - DNA, 21 bp, Homo sapiens
attgtaaattatatttgtgct

SEQ ID NO: 4606588 - DNA, 12 bp, Homo sapiens
atttaaaaatgt

SEQ ID NO: 4606589 - DNA, 17 bp, Homo sapiens
atttaatgttttaaatg

SEQ ID NO: 4606590 - DNA, 18 bp, Homo sapiens
atttaatgttttaaatgt

SEQ ID NO: 4606591 - DNA, 13 bp, Homo sapiens
atttcagatgtaa

SEQ ID NO: 4606592 - DNA, 14 bp, Homo sapiens
atttcagatgtaat

SEQ ID NO: 4606593 - DNA, 15 bp, Homo sapiens
atttcagatgtaatg

SEQ ID NO: 4606594 - DNA, 19 bp, Homo sapiens
atttcagatgtaatgtttt

SEQ ID NO: 4606595 - DNA, 22 bp, Homo sapiens
atttcatttgtgccagaatgct

SEQ ID NO: 4606596 - DNA, 14 bp, Homo sapiens
atttcctggatgtt

SEQ ID NO: 4606597 - DNA, 16 bp, Homo sapiens
atttgattcaaaatat

SEQ ID NO: 4606598 - DNA, 14 bp, Homo sapiens
atttgtgccagaat

SEQ ID NO: 4606599 - DNA, 21 bp, Homo sapiens
attttaatttagtaaatgtta

SEQ ID NO: 4606600 - DNA, 22 bp, Homo sapiens
attttttaaaacaagccaagaa

SEQ ID NO: 4606601 - DNA, 23 bp, Homo sapiens
attttttaaaacaagccaagaaa

SEQ ID NO: 4606602 - DNA, 21 bp, Homo sapiens
caaaaaaattaaaatggatgc

SEQ ID NO: 4606603 - DNA, 19 bp, Homo sapiens
caaaaaatactttttctaa

SEQ ID NO: 4606604 - DNA, 19 bp, Homo sapiens
caaaatatttaaaaatgtc

SEQ ID NO: 4606605 - DNA, 21 bp, Homo sapiens
caaaatgagccctgtcctgcc

SEQ ID NO: 4606606 - DNA, 18 bp, Homo sapiens
caaatgcagtatatttct

SEQ ID NO: 4606607 - DNA, 18 bp, Homo sapiens
caaatgtcttcctggatt

SEQ ID NO: 4606608 - DNA, 17 bp, Homo sapiens
caaattcttttgaattg

SEQ ID NO: 4606609 - DNA, 17 bp, Homo sapiens
caaccctggcacccagg

SEQ ID NO: 4606610 - DNA, 14 bp, Homo sapiens
caagaaagatgtat

SEQ ID NO: 4606611 - DNA, 19 bp, Homo sapiens
caagagtagttatataatt

SEQ ID NO: 4606612 - DNA, 19 bp, Homo sapiens
caagcctgtgcaaaaaaat

SEQ ID NO: 4606613 - DNA, 16 bp, Homo sapiens
caagtgccgcaaattg

SEQ ID NO: 4606614 - DNA, 21 bp, Homo sapiens
caatggtttttaaattttgta

SEQ ID NO: 4606615 - DNA, 23 bp, Homo sapiens
caatggtttttaaattttgtaat

SEQ ID NO: 4606616 - DNA, 23 bp, Homo sapiens
caattttaatttagtaaatgtta

SEQ ID NO: 4606617 - DNA, 19 bp, Homo sapiens
cacaagtgccgcaaattgt

SEQ ID NO: 4606618 - DNA, 22 bp, Homo sapiens
cacaatggtttttaaattttgt

SEQ ID NO: 4606619 - DNA, 22 bp, Homo sapiens
cacataattcaggaagcagctt

SEQ ID NO: 4606620 - DNA, 22 bp, Homo sapiens
caccttagcctgccctcctttc

SEQ ID NO: 4606621 - DNA, 14 bp, Homo sapiens
cacctttattctgg

SEQ ID NO: 4606622 - DNA, 23 bp, Homo sapiens
cacctttattctggcagaggagg

SEQ ID NO: 4606623 - DNA, 17 bp, Homo sapiens
cactgaaatctgtcaag

SEQ ID NO: 4606624 - DNA, 20 bp, Homo sapiens
cactgctctgatgaagagga

SEQ ID NO: 4606625 - DNA, 13 bp, Homo sapiens
cagacatatttaa

SEQ ID NO: 4606626 - DNA, 15 bp, Homo sapiens
cagacatatttaact

SEQ ID NO: 4606627 - DNA, 14 bp, Homo sapiens
cagatgtaatgttt

SEQ ID NO: 4606628 - DNA, 16 bp, Homo sapiens
cagatgtaatgttttc

SEQ ID NO: 4606629 - DNA, 23 bp, Homo sapiens
cagatgtaatgttttctttgcaa

SEQ ID NO: 4606630 - DNA, 22 bp, Homo sapiens
cagctaaggaggggaaaaaaat

SEQ ID NO: 4606631 - DNA, 17 bp, Homo sapiens
caggtgcctttcaaatt

SEQ ID NO: 4606632 - DNA, 15 bp, Homo sapiens
cagttaagcctttgg

SEQ ID NO: 4606633 - DNA, 17 bp, Homo sapiens
cagttaagcctttggaa

SEQ ID NO: 4606634 - DNA, 20 bp, Homo sapiens
cagttaagcctttggaaaca

SEQ ID NO: 4606635 - DNA, 23 bp, Homo sapiens
cataatgggccactgaaatctgt

SEQ ID NO: 4606636 - DNA, 13 bp, Homo sapiens
catatttaactgg

SEQ ID NO: 4606637 - DNA, 10 bp, Homo sapiens
catatttaat

SEQ ID NO: 4606638 - DNA, 13 bp, Homo sapiens
catatttaatgtt

SEQ ID NO: 4606639 - DNA, 14 bp, Homo sapiens
catatttaatgttt

SEQ ID NO: 4606640 - DNA, 16 bp, Homo sapiens
catatttaatgtttta

SEQ ID NO: 4606641 - DNA, 20 bp, Homo sapiens
catatttaatgttttaaatg

SEQ ID NO: 4606642 - DNA, 17 bp, Homo sapiens
cattccccgtctctggt

SEQ ID NO: 4606643 - DNA, 22 bp, Homo sapiens
cattgcctttgaatgttaattt

SEQ ID NO: 4606644 - DNA, 22 bp, Homo sapiens
ccaagcctacttttgccattga

SEQ ID NO: 4606645 - DNA, 21 bp, Homo sapiens
ccacaagtgccgcaaattgta

SEQ ID NO: 4606646 - DNA, 13 bp, Homo sapiens
ccacactccagct

SEQ ID NO: 4606647 - DNA, 14 bp, Homo sapiens
ccacactccagctg

SEQ ID NO: 4606648 - DNA, 20 bp, Homo sapiens
ccaccaggtgcctttcaaat

SEQ ID NO: 4606649 - DNA, 16 bp, Homo sapiens
ccagaatgctttagga

SEQ ID NO: 4606650 - DNA, 13 bp, Homo sapiens
ccagaatttcaaa

SEQ ID NO: 4606651 - DNA, 22 bp, Homo sapiens
ccaggatgtacaaggacagccc

SEQ ID NO: 4606652 - DNA, 18 bp, Homo sapiens
ccaggtgcctttcaaatt

SEQ ID NO: 4606653 - DNA, 20 bp, Homo sapiens
ccagtgaaatcagttactct

SEQ ID NO: 4606654 - DNA, 21 bp, Homo sapiens
ccatagtatgggactggcctc

SEQ ID NO: 4606655 - DNA, 13 bp, Homo sapiens
ccccagaggctgg

SEQ ID NO: 4606656 - DNA, 14 bp, Homo sapiens
ccccttaccactgc

SEQ ID NO: 4606657 - DNA, 13 bp, Homo sapiens
cctctgaggctga

SEQ ID NO: 4606658 - DNA, 14 bp, Homo sapiens
cctggactcctgca

SEQ ID NO: 4606659 - DNA, 16 bp, Homo sapiens
cctgtgaactgaactc

SEQ ID NO: 4606660 - DNA, 14 bp, Homo sapiens
cctttcaaatttag

SEQ ID NO: 4606661 - DNA, 21 bp, Homo sapiens
cctttcaaatttagaaactaa

SEQ ID NO: 4606662 - DNA, 22 bp, Homo sapiens
ccttttttgttttttcaaaata

SEQ ID NO: 4606663 - DNA, 20 bp, Homo sapiens
cgtttgttccccaagacatt

SEQ ID NO: 4606664 - DNA, 17 bp, Homo sapiens
ctaaggaggggaaaaaa

SEQ ID NO: 4606665 - DNA, 21 bp, Homo sapiens
ctaatgaggagagaaaatata

SEQ ID NO: 4606666 - DNA, 23 bp, Homo sapiens
ctaatgaggagagaaaatatatg

SEQ ID NO: 4606667 - DNA, 12 bp, Homo sapiens
ctaattgacttt

SEQ ID NO: 4606668 - DNA, 13 bp, Homo sapiens
ctaattgacttta

SEQ ID NO: 4606669 - DNA, 17 bp, Homo sapiens
ctaattgactttagaaa

SEQ ID NO: 4606670 - DNA, 18 bp, Homo sapiens
ctatagtatttgattcaa

SEQ ID NO: 4606671 - DNA, 20 bp, Homo sapiens
ctcactaggcttctggttga

SEQ ID NO: 4606672 - DNA, 12 bp, Homo sapiens
ctcccctcctcc

SEQ ID NO: 4606673 - DNA, 15 bp, Homo sapiens
ctcctcctggactcc

SEQ ID NO: 4606674 - DNA, 12 bp, Homo sapiens
ctcctggactcc

SEQ ID NO: 4606675 - DNA, 16 bp, Homo sapiens
ctctgacaacagactt

SEQ ID NO: 4606676 - DNA, 21 bp, Homo sapiens
ctctgacaacagacttctgaa

SEQ ID NO: 4606677 - DNA, 14 bp, Homo sapiens
ctctggttcctccc

SEQ ID NO: 4606678 - DNA, 20 bp, Homo sapiens
ctcttcagttaagcctttgg

SEQ ID NO: 4606679 - DNA, 22 bp, Homo sapiens
ctgaaatagacccacaagaggc

SEQ ID NO: 4606680 - DNA, 16 bp, Homo sapiens
ctgaactctgacaaca

SEQ ID NO: 4606681 - DNA, 17 bp, Homo sapiens
ctgaactctgacaacag

SEQ ID NO: 4606682 - DNA, 23 bp, Homo sapiens
ctgcaaaaaatactttttctaat

SEQ ID NO: 4606683 - DNA, 15 bp, Homo sapiens
ctggaacctgcaaaa

SEQ ID NO: 4606684 - DNA, 21 bp, Homo sapiens
ctggaacctgcaaaaaatact

SEQ ID NO: 4606685 - DNA, 23 bp, Homo sapiens
ctggattattcaaaatgatgtat

SEQ ID NO: 4606686 - DNA, 14 bp, Homo sapiens
ctggcagaggaggg

SEQ ID NO: 4606687 - DNA, 19 bp, Homo sapiens
ctgggaacaccataggtca

SEQ ID NO: 4606688 - DNA, 12 bp, Homo sapiens
ctggttcctccc

SEQ ID NO: 4606689 - DNA, 19 bp, Homo sapiens
ctgtcaagagtagttatat

SEQ ID NO: 4606690 - DNA, 22 bp, Homo sapiens
ctgtcaagagtagttatataat

SEQ ID NO: 4606691 - DNA, 15 bp, Homo sapiens
ctgtgcaaaaaaatt

SEQ ID NO: 4606692 - DNA, 16 bp, Homo sapiens
ctgtgcaaaaaaatta

SEQ ID NO: 4606693 - DNA, 18 bp, Homo sapiens
ctgttgacatatttaatg

SEQ ID NO: 4606694 - DNA, 18 bp, Homo sapiens
cttatactgtacaataaa

SEQ ID NO: 4606695 - DNA, 20 bp, Homo sapiens
cttgctgttgacatatttaa

SEQ ID NO: 4606696 - DNA, 21 bp, Homo sapiens
ctttccggtgtttaagacatt

SEQ ID NO: 4606697 - DNA, 17 bp, Homo sapiens
ctttgaatgttaatttt

SEQ ID NO: 4606698 - DNA, 19 bp, Homo sapiens
ctttgcaaagtattgtaaa

SEQ ID NO: 4606699 - DNA, 15 bp, Homo sapiens
ctttgtaaattgtca

SEQ ID NO: 4606700 - DNA, 16 bp, Homo sapiens
cttttgaattgttaca

SEQ ID NO: 4606701 - DNA, 13 bp, Homo sapiens
ctttttctaatga

SEQ ID NO: 4606702 - DNA, 22 bp, Homo sapiens
ctttttctaatgaggagagaaa

SEQ ID NO: 4606703 - DNA, 22 bp, Homo sapiens
cttttttgttttttcaaaatag

SEQ ID NO: 4606704 - DNA, 13 bp, Homo sapiens
gaaaaaaatgttg

SEQ ID NO: 4606705 - DNA, 15 bp, Homo sapiens
gaaaatatatgtatt

SEQ ID NO: 4606706 - DNA, 22 bp, Homo sapiens
gaaaatatatgtatttttatat

SEQ ID NO: 4606707 - DNA, 15 bp, Homo sapiens
gaaacagctcgactt

SEQ ID NO: 4606708 - DNA, 20 bp, Homo sapiens
gaaatctgtcaagagtagtt

SEQ ID NO: 4606709 - DNA, 16 bp, Homo sapiens
gaacacgcgtatttac

SEQ ID NO: 4606710 - DNA, 20 bp, Homo sapiens
gaactctgacaacagacttc

SEQ ID NO: 4606711 - DNA, 15 bp, Homo sapiens
gaacttgttttctgg

SEQ ID NO: 4606712 - DNA, 10 bp, Homo sapiens
gaagcctttg

SEQ ID NO: 4606713 - DNA, 11 bp, Homo sapiens
gacatatttaa

SEQ ID NO: 4606714 - DNA, 15 bp, Homo sapiens
gacatatttaactgg

SEQ ID NO: 4606715 - DNA, 12 bp, Homo sapiens
gacatatttaat

SEQ ID NO: 4606716 - DNA, 21 bp, Homo sapiens
gacatatttaatgttttaaat

SEQ ID NO: 4606717 - DNA, 23 bp, Homo sapiens
gacatatttaatgttttaaatgt

SEQ ID NO: 4606718 - DNA, 18 bp, Homo sapiens
gactcatggtgtgttaca

SEQ ID NO: 4606719 - DNA, 22 bp, Homo sapiens
gagccctgtcctgcctaaggct

SEQ ID NO: 4606720 - DNA, 16 bp, Homo sapiens
gatcctcccaggcttc

SEQ ID NO: 4606721 - DNA, 13 bp, Homo sapiens
gatgtaatgtttt

SEQ ID NO: 4606722 - DNA, 19 bp, Homo sapiens
gatgtgcttgttaactgag

SEQ ID NO: 4606723 - DNA, 15 bp, Homo sapiens
gattcaaaatattta

SEQ ID NO: 4606724 - DNA, 16 bp, Homo sapiens
gattcaaaatatttaa

SEQ ID NO: 4606725 - DNA, 18 bp, Homo sapiens
gattcaaaatatttaaaa

SEQ ID NO: 4606726 - DNA, 12 bp, Homo sapiens
gcaaaaaaatta

SEQ ID NO: 4606727 - DNA, 16 bp, Homo sapiens
gcaaaaaagtccaatt

SEQ ID NO: 4606728 - DNA, 11 bp, Homo sapiens
gcaaaaaatac

SEQ ID NO: 4606729 - DNA, 20 bp, Homo sapiens
gcaaaaaatactttttctaa

SEQ ID NO: 4606730 - DNA, 16 bp, Homo sapiens
gcaaagtattgtaaat

SEQ ID NO: 4606731 - DNA, 14 bp, Homo sapiens
gcactttgtaaatt

SEQ ID NO: 4606732 - DNA, 19 bp, Homo sapiens
gccaaaaaggatacataat

SEQ ID NO: 4606733 - DNA, 20 bp, Homo sapiens
gccaccaggtgcctttcaaa

SEQ ID NO: 4606734 - DNA, 17 bp, Homo sapiens
gccattgacttcttccc

SEQ ID NO: 4606735 - DNA, 18 bp, Homo sapiens
gcctctgctgatcctccc

SEQ ID NO: 4606736 - DNA, 15 bp, Homo sapiens
gcctttgaatgttaa

SEQ ID NO: 4606737 - DNA, 20 bp, Homo sapiens
gcctttgaatgttaattttt

SEQ ID NO: 4606738 - DNA, 16 bp, Homo sapiens
gctccaaatgcagctt

SEQ ID NO: 4606739 - DNA, 18 bp, Homo sapiens
gctccttcctctgaggct

SEQ ID NO: 4606740 - DNA, 21 bp, Homo sapiens
gctttccccatgtctcgactc

SEQ ID NO: 4606741 - DNA, 22 bp, Homo sapiens
ggaaaacttgcagctaaggagg

SEQ ID NO: 4606742 - DNA, 13 bp, Homo sapiens
ggaagcagctttc

SEQ ID NO: 4606743 - DNA, 18 bp, Homo sapiens
ggactggcctctgctgat

SEQ ID NO: 4606744 - DNA, 16 bp, Homo sapiens
ggagagaaaatatatg

SEQ ID NO: 4606745 - DNA, 17 bp, Homo sapiens
ggaggggaaaaaaatgt

SEQ ID NO: 4606746 - DNA, 16 bp, Homo sapiens
ggcagcctcttcaaaa

SEQ ID NO: 4606747 - DNA, 19 bp, Homo sapiens
ggcctcactaggcttctgg

SEQ ID NO: 4606748 - DNA, 14 bp, Homo sapiens
gggccccagaggct

SEQ ID NO: 4606749 - DNA, 14 bp, Homo sapiens
ggggaaaaaaatgt

SEQ ID NO: 4606750 - DNA, 15 bp, Homo sapiens
gtaaattatatttgt

SEQ ID NO: 4606751 - DNA, 20 bp, Homo sapiens
gtaaattatatttgtgctat

SEQ ID NO: 4606752 - DNA, 22 bp, Homo sapiens
gtaccttttttgttttttcaaa

SEQ ID NO: 4606753 - DNA, 18 bp, Homo sapiens
gtatttgattcaaaatat

SEQ ID NO: 4606754 - DNA, 19 bp, Homo sapiens
gtatttgattcaaaatatt

SEQ ID NO: 4606755 - DNA, 17 bp, Homo sapiens
gtcactttgttttactg

SEQ ID NO: 4606756 - DNA, 16 bp, Homo sapiens
gtctctggttcctccc

SEQ ID NO: 4606757 - DNA, 17 bp, Homo sapiens
gtctctggttcctcccc

SEQ ID NO: 4606758 - DNA, 13 bp, Homo sapiens
gtgcactttgtaa

SEQ ID NO: 4606759 - DNA, 14 bp, Homo sapiens
gtgcactttgtaaa

SEQ ID NO: 4606760 - DNA, 13 bp, Homo sapiens
gtgctatagtatt

SEQ ID NO: 4606761 - DNA, 14 bp, Homo sapiens
gtgctatagtattt

SEQ ID NO: 4606762 - DNA, 12 bp, Homo sapiens
gttaagcctttg

SEQ ID NO: 4606763 - DNA, 21 bp, Homo sapiens
gttaattttttggtacaaaaa

SEQ ID NO: 4606764 - DNA, 21 bp, Homo sapiens
gttatatttcagatgtaatgt

SEQ ID NO: 4606765 - DNA, 22 bp, Homo sapiens
gttatcttatactgtacaataa

SEQ ID NO: 4606766 - DNA, 12 bp, Homo sapiens
gttatgtatttc

SEQ ID NO: 4606767 - DNA, 14 bp, Homo sapiens
gttgaagcctttgt

SEQ ID NO: 4606768 - DNA, 18 bp, Homo sapiens
gttgacatatttaatgtt

SEQ ID NO: 4606769 - DNA, 22 bp, Homo sapiens
gttgacatatttaatgttttaa

SEQ ID NO: 4606770 - DNA, 23 bp, Homo sapiens
gttgacatatttaatgttttaaa

SEQ ID NO: 4606771 - DNA, 21 bp, Homo sapiens
gttgatgcctgtgaactgaac

SEQ ID NO: 4606772 - DNA, 14 bp, Homo sapiens
gttttaaatgtaca

SEQ ID NO: 4606773 - DNA, 20 bp, Homo sapiens
gtttttaaattttgtaatga

SEQ ID NO: 4606774 - DNA, 14 bp, Homo sapiens
gttttttcaaaata

SEQ ID NO: 4606775 - DNA, 15 bp, Homo sapiens
gttttttcaaaatag

SEQ ID NO: 4606776 - DNA, 21 bp, Homo sapiens
taaattatatttgtgctatag

SEQ ID NO: 4606777 - DNA, 13 bp, Homo sapiens
taaattttgtaat

SEQ ID NO: 4606778 - DNA, 16 bp, Homo sapiens
taactgagtgcctttt

SEQ ID NO: 4606779 - DNA, 17 bp, Homo sapiens
taactggtgcactttgt

SEQ ID NO: 4606780 - DNA, 17 bp, Homo sapiens
taagcctttggaaacag

SEQ ID NO: 4606781 - DNA, 16 bp, Homo sapiens
taatatctaaagttat

SEQ ID NO: 4606782 - DNA, 23 bp, Homo sapiens
taatgaggagagaaaatatatgt

SEQ ID NO: 4606783 - DNA, 16 bp, Homo sapiens
taatgttttaaatgta

SEQ ID NO: 4606784 - DNA, 20 bp, Homo sapiens
taatgttttaaatgtacaga

SEQ ID NO: 4606785 - DNA, 18 bp, Homo sapiens
taatgttttctttgcaaa

SEQ ID NO: 4606786 - DNA, 20 bp, Homo sapiens
taatgttttctttgcaaagt

SEQ ID NO: 4606787 - DNA, 22 bp, Homo sapiens
taatgttttctttgcaaagtat

SEQ ID NO: 4606788 - DNA, 17 bp, Homo sapiens
taatttagtaaatgtta

SEQ ID NO: 4606789 - DNA, 17 bp, Homo sapiens
tacacaatggtttttaa

SEQ ID NO: 4606790 - DNA, 20 bp, Homo sapiens
tacacaatggtttttaaatt

SEQ ID NO: 4606791 - DNA, 21 bp, Homo sapiens
tacacaatggtttttaaattt

SEQ ID NO: 4606792 - DNA, 15 bp, Homo sapiens
tacagacatatttaa

SEQ ID NO: 4606793 - DNA, 18 bp, Homo sapiens
tacagacatatttaactg

SEQ ID NO: 4606794 - DNA, 23 bp, Homo sapiens
taccttttttgttttttcaaaat

SEQ ID NO: 4606795 - DNA, 14 bp, Homo sapiens
tactgtacaataaa

SEQ ID NO: 4606796 - DNA, 16 bp, Homo sapiens
tactttttctaatgag

SEQ ID NO: 4606797 - DNA, 21 bp, Homo sapiens
tagactcatggtgtgttacac

SEQ ID NO: 4606798 - DNA, 12 bp, Homo sapiens
tagtatttgatt

SEQ ID NO: 4606799 - DNA, 20 bp, Homo sapiens
tagtatttgattcaaaatat

SEQ ID NO: 4606800 - DNA, 20 bp, Homo sapiens
tataatatctaaagttatat

SEQ ID NO: 4606801 - DNA, 20 bp, Homo sapiens
tatactcttatagacaacat

SEQ ID NO: 4606802 - DNA, 15 bp, Homo sapiens
tatactgtacaataa

SEQ ID NO: 4606803 - DNA, 21 bp, Homo sapiens
tatactgtacaataaaaacat

SEQ ID NO: 4606804 - DNA, 19 bp, Homo sapiens
tatagtatttgattcaaaa

SEQ ID NO: 4606805 - DNA, 17 bp, Homo sapiens
tatataatatctaaagt

SEQ ID NO: 4606806 - DNA, 17 bp, Homo sapiens
tatatttgtgctatagt

SEQ ID NO: 4606807 - DNA, 21 bp, Homo sapiens
tatatttgtgctatagtattt

SEQ ID NO: 4606808 - DNA, 12 bp, Homo sapiens
tatctaaagtta

SEQ ID NO: 4606809 - DNA, 21 bp, Homo sapiens
tattagtgacctcagctttga

SEQ ID NO: 4606810 - DNA, 22 bp, Homo sapiens
tattagtggtttatcagcaaaa

SEQ ID NO: 4606811 - DNA, 13 bp, Homo sapiens
tatttaaaaatgt

SEQ ID NO: 4606812 - DNA, 15 bp, Homo sapiens
tatttaaaaatgtct

SEQ ID NO: 4606813 - DNA, 17 bp, Homo sapiens
tatttaaaaatgtcttg

SEQ ID NO: 4606814 - DNA, 15 bp, Homo sapiens
tatttaactggtgca

SEQ ID NO: 4606815 - DNA, 22 bp, Homo sapiens
tatttaactggtgcactttgta

SEQ ID NO: 4606816 - DNA, 16 bp, Homo sapiens
tatttaatgttttaaa

SEQ ID NO: 4606817 - DNA, 22 bp, Homo sapiens
tatttaatgttttaaatgtaca

SEQ ID NO: 4606818 - DNA, 18 bp, Homo sapiens
tatttcctggatgtttgg

SEQ ID NO: 4606819 - DNA, 15 bp, Homo sapiens
tatttgattcaaaat

SEQ ID NO: 4606820 - DNA, 16 bp, Homo sapiens
tatttgattcaaaata

SEQ ID NO: 4606821 - DNA, 14 bp, Homo sapiens
tcaaaatagaaaag

SEQ ID NO: 4606822 - DNA, 19 bp, Homo sapiens
tcaaaatatttaaaaatgt

SEQ ID NO: 4606823 - DNA, 23 bp, Homo sapiens
tcaaatttagaaactaattgact

SEQ ID NO: 4606824 - DNA, 16 bp, Homo sapiens
tcagatgtaatgtttt

SEQ ID NO: 4606825 - DNA, 17 bp, Homo sapiens
tcagttaagcctttgga

SEQ ID NO: 4606826 - DNA, 13 bp, Homo sapiens
tcatctgaagggg

SEQ ID NO: 4606827 - DNA, 14 bp, Homo sapiens
tccaaatgcagctt

SEQ ID NO: 4606828 - DNA, 15 bp, Homo sapiens
tccaaatgcagcttt

SEQ ID NO: 4606829 - DNA, 17 bp, Homo sapiens
tccaattttaatttagt

SEQ ID NO: 4606830 - DNA, 16 bp, Homo sapiens
tccatccaggccattc

SEQ ID NO: 4606831 - DNA, 17 bp, Homo sapiens
tccccatgtctcgactc

SEQ ID NO: 4606832 - DNA, 14 bp, Homo sapiens
tcctaatatcaaat

SEQ ID NO: 4606833 - DNA, 14 bp, Homo sapiens
tcctctgaggctga

SEQ ID NO: 4606834 - DNA, 14 bp, Homo sapiens
tctaaagttatatt

SEQ ID NO: 4606835 - DNA, 22 bp, Homo sapiens
tctaatgaggagagaaaatata

SEQ ID NO: 4606836 - DNA, 16 bp, Homo sapiens
tctgacaacagacttc

SEQ ID NO: 4606837 - DNA, 13 bp, Homo sapiens
tctggttcctccc

SEQ ID NO: 4606838 - DNA, 20 bp, Homo sapiens
tctggttcctcccctcctcc

SEQ ID NO: 4606839 - DNA, 21 bp, Homo sapiens
tctggttcctcccctcctcct

SEQ ID NO: 4606840 - DNA, 16 bp, Homo sapiens
tcttatactgtacaat

SEQ ID NO: 4606841 - DNA, 21 bp, Homo sapiens
tcttatactgtacaataaaaa

SEQ ID NO: 4606842 - DNA, 22 bp, Homo sapiens
tcttcagttaagcctttggaaa

SEQ ID NO: 4606843 - DNA, 19 bp, Homo sapiens
tcttcgttctttttaagtt

SEQ ID NO: 4606844 - DNA, 19 bp, Homo sapiens
tcttgctgttgacatattt

SEQ ID NO: 4606845 - DNA, 18 bp, Homo sapiens
tcttttgaattgttacat

SEQ ID NO: 4606846 - DNA, 16 bp, Homo sapiens
tgaaatcagttactct

SEQ ID NO: 4606847 - DNA, 14 bp, Homo sapiens
tgaactgaactctg

SEQ ID NO: 4606848 - DNA, 19 bp, Homo sapiens
tgaactgaactctgacaac

SEQ ID NO: 4606849 - DNA, 23 bp, Homo sapiens
tgaaggggcaaattcttttgaat

SEQ ID NO: 4606850 - DNA, 18 bp, Homo sapiens
tgacaacagacttctgaa

SEQ ID NO: 4606851 - DNA, 11 bp, Homo sapiens
tgacatattta

SEQ ID NO: 4606852 - DNA, 12 bp, Homo sapiens
tgacatatttaa

SEQ ID NO: 4606853 - DNA, 16 bp, Homo sapiens
tgacatatttaatgtt

SEQ ID NO: 4606854 - DNA, 17 bp, Homo sapiens
tgacatatttaatgttt

SEQ ID NO: 4606855 - DNA, 18 bp, Homo sapiens
tgacattgccaaaaagga

SEQ ID NO: 4606856 - DNA, 22 bp, Homo sapiens
tgacctcagctttgatatttca

SEQ ID NO: 4606857 - DNA, 21 bp, Homo sapiens
tgactttagaaagctgacatt

SEQ ID NO: 4606858 - DNA, 18 bp, Homo sapiens
tgagccctgtcctgccta

SEQ ID NO: 4606859 - DNA, 21 bp, Homo sapiens
tgaggagagaaaatatatgta

SEQ ID NO: 4606860 - DNA, 13 bp, Homo sapiens
tgatgaagaggag

SEQ ID NO: 4606861 - DNA, 13 bp, Homo sapiens
tgattcaaaatat

SEQ ID NO: 4606862 - DNA, 18 bp, Homo sapiens
tgcaaaaaaattaaaatg

SEQ ID NO: 4606863 - DNA, 12 bp, Homo sapiens
tgcaaagtattg

SEQ ID NO: 4606864 - DNA, 17 bp, Homo sapiens
tgcaaagtattgtaaat

SEQ ID NO: 4606865 - DNA, 20 bp, Homo sapiens
tgcaaagtattgtaaattat

SEQ ID NO: 4606866 - DNA, 17 bp, Homo sapiens
tgcactttgtaaattcc

SEQ ID NO: 4606867 - DNA, 21 bp, Homo sapiens
tgccaaaaaggatacataatg

SEQ ID NO: 4606868 - DNA, 19 bp, Homo sapiens
tgcctaaggctgaacttgt

SEQ ID NO: 4606869 - DNA, 12 bp, Homo sapiens
tgccttgaataa

SEQ ID NO: 4606870 - DNA, 17 bp, Homo sapiens
tgcctttcaaatttaga

SEQ ID NO: 4606871 - DNA, 21 bp, Homo sapiens
tgctatagtatttgattcaaa

SEQ ID NO: 4606872 - DNA, 19 bp, Homo sapiens
tgctctgatgaagaggagt

SEQ ID NO: 4606873 - DNA, 17 bp, Homo sapiens
tgctggaacctgcaaaa

SEQ ID NO: 4606874 - DNA, 16 bp, Homo sapiens
tggaacctgcaaaaaa

SEQ ID NO: 4606875 - DNA, 18 bp, Homo sapiens
tggagtgttatgtatttc

SEQ ID NO: 4606876 - DNA, 12 bp, Homo sapiens
tggcagaggagg

SEQ ID NO: 4606877 - DNA, 13 bp, Homo sapiens
tgggactggcctc

SEQ ID NO: 4606878 - DNA, 14 bp, Homo sapiens
tgggagatgttaga

SEQ ID NO: 4606879 - DNA, 18 bp, Homo sapiens
tgggccagaatttcaaac

SEQ ID NO: 4606880 - DNA, 14 bp, Homo sapiens
tggtacaaaaataa

SEQ ID NO: 4606881 - DNA, 21 bp, Homo sapiens
tggtacaaaaataaatttata

SEQ ID NO: 4606882 - DNA, 17 bp, Homo sapiens
tggtgcactttgtaaat

SEQ ID NO: 4606883 - DNA, 12 bp, Homo sapiens
tggttcctcccc

SEQ ID NO: 4606884 - DNA, 20 bp, Homo sapiens
tggtttttaaattttgtaat

SEQ ID NO: 4606885 - DNA, 13 bp, Homo sapiens
tgtaaattatatt

SEQ ID NO: 4606886 - DNA, 18 bp, Homo sapiens
tgtaatgttttctttgca

SEQ ID NO: 4606887 - DNA, 23 bp, Homo sapiens
tgtacaaggacagcccctcctcc

SEQ ID NO: 4606888 - DNA, 19 bp, Homo sapiens
tgtacagacatatttaact

SEQ ID NO: 4606889 - DNA, 20 bp, Homo sapiens
tgtacagacatatttaactg

SEQ ID NO: 4606890 - DNA, 22 bp, Homo sapiens
tgtacagacatatttaactggt

SEQ ID NO: 4606891 - DNA, 23 bp, Homo sapiens
tgtagagaacacgcgtatttaca

SEQ ID NO: 4606892 - DNA, 22 bp, Homo sapiens
tgtcaagagtagttatataatt

SEQ ID NO: 4606893 - DNA, 15 bp, Homo sapiens
tgtgagactactaag

SEQ ID NO: 4606894 - DNA, 17 bp, Homo sapiens
tgtgcaaaaaaattaaa

SEQ ID NO: 4606895 - DNA, 18 bp, Homo sapiens
tgtgctatagtatttgat

SEQ ID NO: 4606896 - DNA, 16 bp, Homo sapiens
tgttaactgagtgcct

SEQ ID NO: 4606897 - DNA, 16 bp, Homo sapiens
tgttacacaatggttt

SEQ ID NO: 4606898 - DNA, 19 bp, Homo sapiens
tgttatcttatactgtaca

SEQ ID NO: 4606899 - DNA, 21 bp, Homo sapiens
tgttatcttatactgtacaat

SEQ ID NO: 4606900 - DNA, 12 bp, Homo sapiens
tgttatgtattt

SEQ ID NO: 4606901 - DNA, 20 bp, Homo sapiens
tgttgaacaggtgtttttcc

SEQ ID NO: 4606902 - DNA, 16 bp, Homo sapiens
tgttgacatatttaat

SEQ ID NO: 4606903 - DNA, 20 bp, Homo sapiens
tgttgacatatttaatgttt

SEQ ID NO: 4606904 - DNA, 21 bp, Homo sapiens
tgtttcctaatatcaaatgca

SEQ ID NO: 4606905 - DNA, 21 bp, Homo sapiens
ttaaatgtacagacatattta

SEQ ID NO: 4606906 - DNA, 10 bp, Homo sapiens
ttaatgtttt

SEQ ID NO: 4606907 - DNA, 16 bp, Homo sapiens
ttaatgttttaaatgt

SEQ ID NO: 4606908 - DNA, 23 bp, Homo sapiens
ttaatgttttaaatgtacagaca

SEQ ID NO: 4606909 - DNA, 17 bp, Homo sapiens
ttaattttttggtacaa

SEQ ID NO: 4606910 - DNA, 20 bp, Homo sapiens
ttacacaatggtttttaaat

SEQ ID NO: 4606911 - DNA, 22 bp, Homo sapiens
ttacacaatggtttttaaattt

SEQ ID NO: 4606912 - DNA, 13 bp, Homo sapiens
ttagtaaatgtta

SEQ ID NO: 4606913 - DNA, 19 bp, Homo sapiens
ttagtggtttatcagcaaa

SEQ ID NO: 4606914 - DNA, 15 bp, Homo sapiens
ttatatttcagatgt

SEQ ID NO: 4606915 - DNA, 21 bp, Homo sapiens
ttatatttcagatgtaatgtt

SEQ ID NO: 4606916 - DNA, 18 bp, Homo sapiens
ttatatttgtgctatagt

SEQ ID NO: 4606917 - DNA, 20 bp, Homo sapiens
ttatgtatttcctggatgtt

SEQ ID NO: 4606918 - DNA, 20 bp, Homo sapiens
ttcaaaatatttaaaaatgt

SEQ ID NO: 4606919 - DNA, 16 bp, Homo sapiens
ttcaatcccaggatgt

SEQ ID NO: 4606920 - DNA, 15 bp, Homo sapiens
ttcagatgtaatgtt

SEQ ID NO: 4606921 - DNA, 22 bp, Homo sapiens
ttccagtgaaatcagttactct

SEQ ID NO: 4606922 - DNA, 17 bp, Homo sapiens
ttcgcagctgaagtgga

SEQ ID NO: 4606923 - DNA, 14 bp, Homo sapiens
ttcgttctttttaa

SEQ ID NO: 4606924 - DNA, 15 bp, Homo sapiens
ttctggcagaggagg

SEQ ID NO: 4606925 - DNA, 18 bp, Homo sapiens
ttcttcgttctttttaag

SEQ ID NO: 4606926 - DNA, 12 bp, Homo sapiens
ttctttgcaaag

SEQ ID NO: 4606927 - DNA, 16 bp, Homo sapiens
ttctttgcaaagtatt

SEQ ID NO: 4606928 - DNA, 15 bp, Homo sapiens
ttcttttgaattgtt

SEQ ID NO: 4606929 - DNA, 16 bp, Homo sapiens
ttgaaagtttacagga

SEQ ID NO: 4606930 - DNA, 18 bp, Homo sapiens
ttgacatatttaatgttt

SEQ ID NO: 4606931 - DNA, 12 bp, Homo sapiens
ttgattcaaaat

SEQ ID NO: 4606932 - DNA, 22 bp, Homo sapiens
ttgattcaaaatatttaaaaat

SEQ ID NO: 4606933 - DNA, 21 bp, Homo sapiens
ttgcaaagtattgtaaattat

SEQ ID NO: 4606934 - DNA, 23 bp, Homo sapiens
ttgcagctaaggaggggaaaaaa

SEQ ID NO: 4606935 - DNA, 13 bp, Homo sapiens
ttggtacaaaaat

SEQ ID NO: 4606936 - DNA, 16 bp, Homo sapiens
ttgtaaattatatttg

SEQ ID NO: 4606937 - DNA, 17 bp, Homo sapiens
ttgtaaattatatttgt

SEQ ID NO: 4606938 - DNA, 23 bp, Homo sapiens
ttgtagagaacacgcgtatttac

SEQ ID NO: 4606939 - DNA, 21 bp, Homo sapiens
ttgtgccagaatgctttagga

SEQ ID NO: 4606940 - DNA, 14 bp, Homo sapiens
ttgtgctatagtat

SEQ ID NO: 4606941 - DNA, 17 bp, Homo sapiens
ttgttgaacaggtgttt

SEQ ID NO: 4606942 - DNA, 13 bp, Homo sapiens
tttaaaaatgtct

SEQ ID NO: 4606943 - DNA, 20 bp, Homo sapiens
tttaaatgtacagacatatt

SEQ ID NO: 4606944 - DNA, 19 bp, Homo sapiens
tttaactggtgcactttgt

SEQ ID NO: 4606945 - DNA, 18 bp, Homo sapiens
tttaatgttttaaatgta

SEQ ID NO: 4606946 - DNA, 19 bp, Homo sapiens
tttaatgttttaaatgtac

SEQ ID NO: 4606947 - DNA, 18 bp, Homo sapiens
tttaatttagtaaatgtt

SEQ ID NO: 4606948 - DNA, 22 bp, Homo sapiens
tttacagccagtgggagatgtt

SEQ ID NO: 4606949 - DNA, 16 bp, Homo sapiens
tttagaaagctgacat

SEQ ID NO: 4606950 - DNA, 14 bp, Homo sapiens
tttatcagcaaaaa

SEQ ID NO: 4606951 - DNA, 21 bp, Homo sapiens
tttcaaatttagaaactaatt

SEQ ID NO: 4606952 - DNA, 15 bp, Homo sapiens
tttcagatgtaatgt

SEQ ID NO: 4606953 - DNA, 17 bp, Homo sapiens
tttcagatgtaatgttt

SEQ ID NO: 4606954 - DNA, 15 bp, Homo sapiens
tttcctaatatcaaa

SEQ ID NO: 4606955 - DNA, 19 bp, Homo sapiens
tttctaatgaggagagaaa

SEQ ID NO: 4606956 - DNA, 19 bp, Homo sapiens
tttgaatgttaattttttg

SEQ ID NO: 4606957 - DNA, 15 bp, Homo sapiens
tttgaattgttacat

SEQ ID NO: 4606958 - DNA, 22 bp, Homo sapiens
tttgattcaaaatatttaaaaa

SEQ ID NO: 4606959 - DNA, 19 bp, Homo sapiens
tttgcaaagtattgtaaat

SEQ ID NO: 4606960 - DNA, 22 bp, Homo sapiens
tttgcaaagtattgtaaattat

SEQ ID NO: 4606961 - DNA, 16 bp, Homo sapiens
tttggtacaaaaataa

SEQ ID NO: 4606962 - DNA, 17 bp, Homo sapiens
ttttaaattttgtaatg

SEQ ID NO: 4606963 - DNA, 23 bp, Homo sapiens
ttttaagttaatagattttttca

SEQ ID NO: 4606964 - DNA, 20 bp, Homo sapiens
ttttaatttagtaaatgtta

SEQ ID NO: 4606965 - DNA, 19 bp, Homo sapiens
ttttcaaaatagaaaagtt

SEQ ID NO: 4606966 - DNA, 20 bp, Homo sapiens
ttttcaaaatagaaaagtta

SEQ ID NO: 4606967 - DNA, 21 bp, Homo sapiens
ttttctaatgaggagagaaaa

SEQ ID NO: 4606968 - DNA, 15 bp, Homo sapiens
ttttgaattgttaca

SEQ ID NO: 4606969 - DNA, 16 bp, Homo sapiens
ttttggagtgttatgt

SEQ ID NO: 4606970 - DNA, 18 bp, Homo sapiens
ttttgttttttcaaaata

SEQ ID NO: 4606971 - DNA, 16 bp, Homo sapiens
tttttaaattttgtaa

SEQ ID NO: 4606972 - DNA, 15 bp, Homo sapiens
tttttcaaaatagaa

SEQ ID NO: 4606973 - DNA, 20 bp, Homo sapiens
tttttcaaaatagaaaagtt

SEQ ID NO: 4606974 - DNA, 14 bp, Homo sapiens
tttttggagtgtta

SEQ ID NO: 4606975 - DNA, 19 bp, Homo sapiens
tttttggagtgttatgtat

SEQ ID NO: 4606976 - DNA, 20 bp, Homo sapiens
aagactgtgaacagcttgct

SEQ ID NO: 4606977 - DNA, 11 bp, Homo sapiens
aagagaaactt

SEQ ID NO: 4606978 - DNA, 18 bp, Homo sapiens
aagagagaagccagccac

SEQ ID NO: 4606979 - DNA, 23 bp, Homo sapiens
aagagagaccccagtcaagctcc

SEQ ID NO: 4606980 - DNA, 13 bp, Homo sapiens
aagagagggacag

SEQ ID NO: 4606981 - DNA, 16 bp, Homo sapiens
aagagagggacaggca

SEQ ID NO: 4606982 - DNA, 14 bp, Homo sapiens
aagagatacagagg

SEQ ID NO: 4606983 - DNA, 15 bp, Homo sapiens
aagagcatcatgcct

SEQ ID NO: 4606984 - DNA, 22 bp, Homo sapiens
aagagcatcatgcctctgaggc

SEQ ID NO: 4606985 - DNA, 23 bp, Homo sapiens
aagagcatcatgcctctgaggcc

SEQ ID NO: 4606986 - DNA, 24 bp, Homo sapiens
aagagcatcatgcctctgaggcca

SEQ ID NO: 4606987 - DNA, 11 bp, Homo sapiens
aagagccacct

SEQ ID NO: 4606988 - DNA, 20 bp, Homo sapiens
aagagctagaaaaataaaat

SEQ ID NO: 4606989 - DNA, 15 bp, Homo sapiens
aagagctgcctggat

SEQ ID NO: 4606990 - DNA, 22 bp, Homo sapiens
aagaggctgaggctggcacagg

SEQ ID NO: 4606991 - DNA, 21 bp, Homo sapiens
aagaggtgaccccagggcaca

SEQ ID NO: 4606992 - DNA, 17 bp, Homo sapiens
aagagtggagagaagct

SEQ ID NO: 4606993 - DNA, 14 bp, Homo sapiens
aagatatatgtgta

SEQ ID NO: 4606994 - DNA, 21 bp, Homo sapiens
aagatatgccactaacttcta

SEQ ID NO: 4606995 - DNA, 20 bp, Homo sapiens
aagatattgatcaaatatag

SEQ ID NO: 4606996 - DNA, 16 bp, Homo sapiens
aagatctgccagacct

SEQ ID NO: 4606997 - DNA, 13 bp, Homo sapiens
aagatgagcctgg

SEQ ID NO: 4606998 - DNA, 16 bp, Homo sapiens
aagatgagcctgggct

SEQ ID NO: 4606999 - DNA, 17 bp, Homo sapiens
aagatgagcctgggctc

SEQ ID NO: 4607000 - DNA, 22 bp, Homo sapiens
aagatgatcgctgtattttgag

SEQ ID NO: 4607001 - DNA, 12 bp, Homo sapiens
aagatgcttggt

SEQ ID NO: 4607002 - DNA, 15 bp, Homo sapiens
aagatgttgtgtctt

SEQ ID NO: 4607003 - DNA, 16 bp, Homo sapiens
aagattaatctttaaa

SEQ ID NO: 4607004 - DNA, 20 bp, Homo sapiens
aagattttgttttgttggac

SEQ ID NO: 4607005 - DNA, 22 bp, Homo sapiens
aagcaaactatgatttattttg

SEQ ID NO: 4607006 - DNA, 19 bp, Homo sapiens
aagcaaagtgctttgactt

SEQ ID NO: 4607007 - DNA, 16 bp, Homo sapiens
aagcaagcaacacaga

SEQ ID NO: 4607008 - DNA, 17 bp, Homo sapiens
aagcaatgtgttttttc

SEQ ID NO: 4607009 - DNA, 23 bp, Homo sapiens
aagcacaccatatgtccactgtt

SEQ ID NO: 4607010 - DNA, 15 bp, Homo sapiens
aagcacagctcctgc

SEQ ID NO: 4607011 - DNA, 17 bp, Homo sapiens
aagcagaaacagcatat

SEQ ID NO: 4607012 - DNA, 15 bp, Homo sapiens
aagcagcccttgctt

SEQ ID NO: 4607013 - DNA, 22 bp, Homo sapiens
aagcagcccttgctttcggagc

SEQ ID NO: 4607014 - DNA, 18 bp, Homo sapiens
aagcagcctttgtggttt

SEQ ID NO: 4607015 - DNA, 19 bp, Homo sapiens
aagcaggactgtgcctcca

SEQ ID NO: 4607016 - DNA, 14 bp, Homo sapiens
aagcaggccgccct

SEQ ID NO: 4607017 - DNA, 22 bp, Homo sapiens
aagcagggcagcagggaacaaa

SEQ ID NO: 4607018 - DNA, 19 bp, Homo sapiens
aagcaggttcccaagctca

SEQ ID NO: 4607019 - DNA, 14 bp, Homo sapiens
aagcatactttgta

SEQ ID NO: 4607020 - DNA, 18 bp, Homo sapiens
aagcatactttgtaaata

SEQ ID NO: 4607021 - DNA, 20 bp, Homo sapiens
aagcatgaataacatttaaa

SEQ ID NO: 4607022 - DNA, 23 bp, Homo sapiens
aagcatgcattgaaaaatttcta

SEQ ID NO: 4607023 - DNA, 23 bp, Homo sapiens
aagcatggtcccacatccctggg

SEQ ID NO: 4607024 - DNA, 20 bp, Homo sapiens
aagcatgtgatgttgtctta

SEQ ID NO: 4607025 - DNA, 11 bp, Homo sapiens
aagcatttcat

SEQ ID NO: 4607026 - DNA, 19 bp, Homo sapiens
aagcatttcatgaaaaagc

SEQ ID NO: 4607027 - DNA, 23 bp, Homo sapiens
aagcatttcatgaaaaagctgct

SEQ ID NO: 4607028 - DNA, 19 bp, Homo sapiens
aagcattttgaaacaaagt

SEQ ID NO: 4607029 - DNA, 22 bp, Homo sapiens
aagccaaagaaacaagctgtgc

SEQ ID NO: 4607030 - DNA, 17 bp, Homo sapiens
aagccaattcagacagg

SEQ ID NO: 4607031 - DNA, 21 bp, Homo sapiens
aagccacttctggcttcagcc

SEQ ID NO: 4607032 - DNA, 13 bp, Homo sapiens
aagccagccacag

SEQ ID NO: 4607033 - DNA, 18 bp, Homo sapiens
aagccaggagcagccctg

SEQ ID NO: 4607034 - DNA, 19 bp, Homo sapiens
aagccaggagcagccctgg

SEQ ID NO: 4607035 - DNA, 12 bp, Homo sapiens
aagccagggtct

SEQ ID NO: 4607036 - DNA, 16 bp, Homo sapiens
aagccatgtataaatg

SEQ ID NO: 4607037 - DNA, 14 bp, Homo sapiens
aagcccaggatctc

SEQ ID NO: 4607038 - DNA, 20 bp, Homo sapiens
aagcccccaccgtgggcagg

SEQ ID NO: 4607039 - DNA, 23 bp, Homo sapiens
aagcccgaccgggccaggcctgg

SEQ ID NO: 4607040 - DNA, 21 bp, Homo sapiens
aagccctgtgctccatggctg

SEQ ID NO: 4607041 - DNA, 17 bp, Homo sapiens
aagccgactctggccct

SEQ ID NO: 4607042 - DNA, 19 bp, Homo sapiens
aagccgactctggccctgg

SEQ ID NO: 4607043 - DNA, 17 bp, Homo sapiens
aagcctaagggatcctg

SEQ ID NO: 4607044 - DNA, 22 bp, Homo sapiens
aagcctaagggatcctgcctgc

SEQ ID NO: 4607045 - DNA, 22 bp, Homo sapiens
aagcctcttattccaggagaag

SEQ ID NO: 4607046 - DNA, 12 bp, Homo sapiens
aagcctgcaact

SEQ ID NO: 4607047 - DNA, 20 bp, Homo sapiens
aagcctgggggcctggctgg

SEQ ID NO: 4607048 - DNA, 21 bp, Homo sapiens
aagcctgggggcctggctggc

SEQ ID NO: 4607049 - DNA, 23 bp, Homo sapiens
aagcctgggggcctggctggctg

SEQ ID NO: 4607050 - DNA, 20 bp, Homo sapiens
aagccttcccccagcaaggc

SEQ ID NO: 4607051 - DNA, 14 bp, Homo sapiens
aagcctttaaattg

SEQ ID NO: 4607052 - DNA, 13 bp, Homo sapiens
aagcgaacatctt

SEQ ID NO: 4607053 - DNA, 14 bp, Homo sapiens
aagcgaacatcttc

SEQ ID NO: 4607054 - DNA, 15 bp, Homo sapiens
aagcgtttttaacct

SEQ ID NO: 4607055 - DNA, 21 bp, Homo sapiens
aagcgtttttaacctgttttg

SEQ ID NO: 4607056 - DNA, 20 bp, Homo sapiens
aagctaacagggaaggcagg

SEQ ID NO: 4607057 - DNA, 22 bp, Homo sapiens
aagctaacagggaaggcaggca

SEQ ID NO: 4607058 - DNA, 23 bp, Homo sapiens
aagctaacagggaaggcaggcag

SEQ ID NO: 4607059 - DNA, 13 bp, Homo sapiens
aagctagaaatga

SEQ ID NO: 4607060 - DNA, 14 bp, Homo sapiens
aagctaggccccag

SEQ ID NO: 4607061 - DNA, 19 bp, Homo sapiens
aagctaggccccagaggcc

SEQ ID NO: 4607062 - DNA, 22 bp, Homo sapiens
aagctaggccccagaggccctg

SEQ ID NO: 4607063 - DNA, 15 bp, Homo sapiens
aagctatattagctg

SEQ ID NO: 4607064 - DNA, 17 bp, Homo sapiens
aagctatattagctgaa

SEQ ID NO: 4607065 - DNA, 21 bp, Homo sapiens
aagctatcttaggtggagcta

SEQ ID NO: 4607066 - DNA, 12 bp, Homo sapiens
aagctatggtga

SEQ ID NO: 4607067 - DNA, 17 bp, Homo sapiens
aagctatttatctgtag

SEQ ID NO: 4607068 - DNA, 22 bp, Homo sapiens
aagctcaaagtatgcaatgctt

SEQ ID NO: 4607069 - DNA, 14 bp, Homo sapiens
aagctctgcccctt

SEQ ID NO: 4607070 - DNA, 13 bp, Homo sapiens
aagctgaggtgcc

SEQ ID NO: 4607071 - DNA, 21 bp, Homo sapiens
aagctgcaaaaattatatatt

SEQ ID NO: 4607072 - DNA, 13 bp, Homo sapiens
aagctgcactgtg

SEQ ID NO: 4607073 - DNA, 16 bp, Homo sapiens
aagctgcactgtgaac

SEQ ID NO: 4607074 - DNA, 17 bp, Homo sapiens
aagctgctccaggcctg

SEQ ID NO: 4607075 - DNA, 15 bp, Homo sapiens
aagctgctgaggccc

SEQ ID NO: 4607076 - DNA, 15 bp, Homo sapiens
aagctggccaaagtc

SEQ ID NO: 4607077 - DNA, 13 bp, Homo sapiens
aagcttggaggag

SEQ ID NO: 4607078 - DNA, 15 bp, Homo sapiens
aagcttgtaaatatg

SEQ ID NO: 4607079 - DNA, 17 bp, Homo sapiens
aagcttgtcaaagatgc

SEQ ID NO: 4607080 - DNA, 20 bp, Homo sapiens
aagctttgctccttcagttc

SEQ ID NO: 4607081 - DNA, 17 bp, Homo sapiens
aagcttttcacaaacat

SEQ ID NO: 4607082 - DNA, 19 bp, Homo sapiens
aaggaaaagaggcccaagt

SEQ ID NO: 4607083 - DNA, 14 bp, Homo sapiens
aaggaaaagcaaga

SEQ ID NO: 4607084 - DNA, 16 bp, Homo sapiens
aaggaaacattttatc

SEQ ID NO: 4607085 - DNA, 17 bp, Homo sapiens
aagtggactcagggcag

SEQ ID NO: 4607086 - DNA, 13 bp, Homo sapiens
aagtggcagggac

SEQ ID NO: 4607087 - DNA, 17 bp, Homo sapiens
aagtggcctctttgtct

SEQ ID NO: 4607088 - DNA, 22 bp, Homo sapiens
aagtggcctctttgtctaaaac

SEQ ID NO: 4607089 - DNA, 16 bp, Homo sapiens
aagtggctatttcttt

SEQ ID NO: 4607090 - DNA, 16 bp, Homo sapiens
aagtgtaaaaaatgtc

SEQ ID NO: 4607091 - DNA, 21 bp, Homo sapiens
aagtgtacttcataagatatt

SEQ ID NO: 4607092 - DNA, 15 bp, Homo sapiens
aagtgtgacttctta

SEQ ID NO: 4607093 - DNA, 19 bp, Homo sapiens
aagttactttgtcagaggc

SEQ ID NO: 4607094 - DNA, 21 bp, Homo sapiens
aagttagaaaattcagctcct

SEQ ID NO: 4607095 - DNA, 22 bp, Homo sapiens
aagttagaactagccaaaccag

SEQ ID NO: 4607096 - DNA, 20 bp, Homo sapiens
aagttgtgcttgagccagga

SEQ ID NO: 4607097 - DNA, 17 bp, Homo sapiens
aagttgtgcttttctgt

SEQ ID NO: 4607098 - DNA, 18 bp, Homo sapiens
aagttgtgcttttctgtt

SEQ ID NO: 4607099 - DNA, 16 bp, Homo sapiens
aagttgttgcattccc

SEQ ID NO: 4607100 - DNA, 12 bp, Homo sapiens
aagtttctattc

SEQ ID NO: 4607101 - DNA, 22 bp, Homo sapiens
aagtttgatttttgtttttgta

SEQ ID NO: 4607102 - DNA, 19 bp, Homo sapiens
aagtttgtagttgttttaa

SEQ ID NO: 4607103 - DNA, 16 bp, Homo sapiens
aagttttgaaggaaac

SEQ ID NO: 4607104 - DNA, 17 bp, Homo sapiens
aataaaaatatgtaatt

SEQ ID NO: 4607105 - DNA, 14 bp, Homo sapiens
aataaaacacacct

SEQ ID NO: 4607106 - DNA, 15 bp, Homo sapiens
aataaaatgaacatc

SEQ ID NO: 4607107 - DNA, 18 bp, Homo sapiens
aataaaatgtttcattat

SEQ ID NO: 4607108 - DNA, 19 bp, Homo sapiens
aataaaatgtttcattatg

SEQ ID NO: 4607109 - DNA, 18 bp, Homo sapiens
aataaaattttttttcat

SEQ ID NO: 4607110 - DNA, 19 bp, Homo sapiens
aataaaattttttttcatg

SEQ ID NO: 4607111 - DNA, 22 bp, Homo sapiens
aataaagacttgtgcatccctc

SEQ ID NO: 4607112 - DNA, 13 bp, Homo sapiens
aataaagctttat

SEQ ID NO: 4607113 - DNA, 24 bp, Homo sapiens
aataaaggataactctgtattaca

SEQ ID NO: 4607114 - DNA, 16 bp, Homo sapiens
aataaaggtgtagaaa

SEQ ID NO: 4607115 - DNA, 21 bp, Homo sapiens
aataaagttctgcaaaataca

SEQ ID NO: 4607116 - DNA, 14 bp, Homo sapiens
aataaagttgttgc

SEQ ID NO: 4607117 - DNA, 15 bp, Homo sapiens
aataaagttgttgca

SEQ ID NO: 4607118 - DNA, 15 bp, Homo sapiens
aataaatatctgtac

SEQ ID NO: 4607119 - DNA, 20 bp, Homo sapiens
aataaatctaaatgattatc

SEQ ID NO: 4607120 - DNA, 22 bp, Homo sapiens
aataaatctaaatgattatctt

SEQ ID NO: 4607121 - DNA, 13 bp, Homo sapiens
aataaatgtttcc

SEQ ID NO: 4607122 - DNA, 18 bp, Homo sapiens
aataaatgtttcccccac

SEQ ID NO: 4607123 - DNA, 15 bp, Homo sapiens
aataacaaaatggac

SEQ ID NO: 4607124 - DNA, 13 bp, Homo sapiens
aataacatttaaa

SEQ ID NO: 4607125 - DNA, 15 bp, Homo sapiens
aataacccagttact

SEQ ID NO: 4607126 - DNA, 17 bp, Homo sapiens
aataacccagttacttt

SEQ ID NO: 4607127 - DNA, 17 bp, Homo sapiens
aataacctgcacaggct

SEQ ID NO: 4607128 - DNA, 23 bp, Homo sapiens
aataacctgcacaggcttgctgt

SEQ ID NO: 4607129 - DNA, 12 bp, Homo sapiens
aataactgaaaa

SEQ ID NO: 4607130 - DNA, 16 bp, Homo sapiens
aataactgaaaatgaa

SEQ ID NO: 4607131 - DNA, 17 bp, Homo sapiens
aataacttttatattaa

SEQ ID NO: 4607132 - DNA, 12 bp, Homo sapiens
aataactttttt

SEQ ID NO: 4607133 - DNA, 20 bp, Homo sapiens
aataagcagaacatactgtt

SEQ ID NO: 4607134 - DNA, 12 bp, Homo sapiens
aataatgaaaat

SEQ ID NO: 4607135 - DNA, 13 bp, Homo sapiens
aataatgaaaata

SEQ ID NO: 4607136 - DNA, 19 bp, Homo sapiens
aataatgacagatggtgaa

SEQ ID NO: 4607137 - DNA, 20 bp, Homo sapiens
aataatgacagatggtgaag

SEQ ID NO: 4607138 - DNA, 12 bp, Homo sapiens
aataatggcact

SEQ ID NO: 4607139 - DNA, 12 bp, Homo sapiens
aaaaaagaaatt

SEQ ID NO: 4607140 - DNA, 12 bp, Homo sapiens
aaaaaatcttgt

SEQ ID NO: 4607141 - DNA, 20 bp, Homo sapiens
aaaaacagcattgctttctg

SEQ ID NO: 4607142 - DNA, 13 bp, Homo sapiens
aaaaactacacat

SEQ ID NO: 4607143 - DNA, 15 bp, Homo sapiens
aaaaactctttattt

SEQ ID NO: 4607144 - DNA, 13 bp, Homo sapiens
aaaaacttaaata

SEQ ID NO: 4607145 - DNA, 21 bp, Homo sapiens
aaaaacttaaatattgtaata

SEQ ID NO: 4607146 - DNA, 12 bp, Homo sapiens
aaaaagacattt

SEQ ID NO: 4607147 - DNA, 18 bp, Homo sapiens
aaaaagatgatcgctgta

SEQ ID NO: 4607148 - DNA, 17 bp, Homo sapiens
aaaaagcaggactgtgc

SEQ ID NO: 4607149 - DNA, 19 bp, Homo sapiens
aaaaagcaggactgtgcct

SEQ ID NO: 4607150 - DNA, 21 bp, Homo sapiens
aaaaagcaggactgtgcctcc

SEQ ID NO: 4607151 - DNA, 21 bp, Homo sapiens
aaaaagctgcaaaaattatat

SEQ ID NO: 4607152 - DNA, 15 bp, Homo sapiens
aaaaaggaaacttcc

SEQ ID NO: 4607153 - DNA, 18 bp, Homo sapiens
aaaaaggtctgttaatgt

SEQ ID NO: 4607154 - DNA, 19 bp, Homo sapiens
aaaaagtattattttccaa

SEQ ID NO: 4607155 - DNA, 13 bp, Homo sapiens
aaaaataaaatgt

SEQ ID NO: 4607156 - DNA, 22 bp, Homo sapiens
aaaaatactcttgatttcacat

SEQ ID NO: 4607157 - DNA, 12 bp, Homo sapiens
aaaaatataatg

SEQ ID NO: 4607158 - DNA, 20 bp, Homo sapiens
aaaaatctagcacactcttc

SEQ ID NO: 4607159 - DNA, 13 bp, Homo sapiens
aaaaatctgagaa

SEQ ID NO: 4607160 - DNA, 18 bp, Homo sapiens
aaaaatgatcctcagtgc

SEQ ID NO: 4607161 - DNA, 19 bp, Homo sapiens
aaaaatgatcctcagtgca

SEQ ID NO: 4607162 - DNA, 20 bp, Homo sapiens
aaaaatgcaaatcctatgtg

SEQ ID NO: 4607163 - DNA, 15 bp, Homo sapiens
aaaaatgtacattta

SEQ ID NO: 4607164 - DNA, 20 bp, Homo sapiens
aaaaattacctttaatttta

SEQ ID NO: 4607165 - DNA, 13 bp, Homo sapiens
aaaaattttagct

SEQ ID NO: 4607166 - DNA, 22 bp, Homo sapiens
aaaacaaaatttgactaatttt

SEQ ID NO: 4607167 - DNA, 23 bp, Homo sapiens
aaaacaaccaacagaaaacatcc

SEQ ID NO: 4607168 - DNA, 12 bp, Homo sapiens
aaaacaagtgaa

SEQ ID NO: 4607169 - DNA, 16 bp, Homo sapiens
aaaacacacctcgtgg

SEQ ID NO: 4607170 - DNA, 23 bp, Homo sapiens
aaaacagggccacatagatgctg

SEQ ID NO: 4607171 - DNA, 22 bp, Homo sapiens
aaaacagtttcatctaaatgaa

SEQ ID NO: 4607172 - DNA, 23 bp, Homo sapiens
aaaacatagaaatggaaattttg

SEQ ID NO: 4607173 - DNA, 14 bp, Homo sapiens
aaaacatatttcat

SEQ ID NO: 4607174 - DNA, 15 bp, Homo sapiens
aaaaccaaacttgtt

SEQ ID NO: 4607175 - DNA, 15 bp, Homo sapiens
aaaactcatgatcaa

SEQ ID NO: 4607176 - DNA, 17 bp, Homo sapiens
aaaactctagcagttgt

SEQ ID NO: 4607177 - DNA, 24 bp, Homo sapiens
aaaacttcttgtcagacataaagc

SEQ ID NO: 4607178 - DNA, 18 bp, Homo sapiens
aaaacttgacatgtagct

SEQ ID NO: 4607179 - DNA, 11 bp, Homo sapiens
aaaactttatt

SEQ ID NO: 4607180 - DNA, 16 bp, Homo sapiens
aaaactttattaaaag

SEQ ID NO: 4607181 - DNA, 17 bp, Homo sapiens
aaaagaaaaaaaaaaga

SEQ ID NO: 4607182 - DNA, 19 bp, Homo sapiens
aaaagaaatccagtttgtg

SEQ ID NO: 4607183 - DNA, 20 bp, Homo sapiens
aaaagaaattcgcatgttta

SEQ ID NO: 4607184 - DNA, 21 bp, Homo sapiens
aaaagaaggaccctttttgga

SEQ ID NO: 4607185 - DNA, 16 bp, Homo sapiens
aaaagaagtttcagtt

SEQ ID NO: 4607186 - DNA, 22 bp, Homo sapiens
aaaagaatgagtgaagtattgc

SEQ ID NO: 4607187 - DNA, 11 bp, Homo sapiens
aaaagacattt

SEQ ID NO: 4607188 - DNA, 20 bp, Homo sapiens
aaaagaggtttaagtttgtt

SEQ ID NO: 4607189 - DNA, 20 bp, Homo sapiens
aaaagatgatcgctgtattt

SEQ ID NO: 4607190 - DNA, 18 bp, Homo sapiens
aaaagccttccagttttg

SEQ ID NO: 4607191 - DNA, 18 bp, Homo sapiens
aaaagctgcaaaaattat

SEQ ID NO: 4607192 - DNA, 16 bp, Homo sapiens
aaaaggaacaaataaa

SEQ ID NO: 4607193 - DNA, 23 bp, Homo sapiens
aaaaggaacagttgcatttagct

SEQ ID NO: 4607194 - DNA, 15 bp, Homo sapiens
aaaaggcctcttgta

SEQ ID NO: 4607195 - DNA, 23 bp, Homo sapiens
aaaaggcctcttgtaaagactgg

SEQ ID NO: 4607196 - DNA, 11 bp, Homo sapiens
aaaaggcctgg

SEQ ID NO: 4607197 - DNA, 12 bp, Homo sapiens
aaaaggcctggg

SEQ ID NO: 4607198 - DNA, 21 bp, Homo sapiens
aaaagggtcttgggaaatatg

SEQ ID NO: 4607199 - DNA, 24 bp, Homo sapiens
aaaagtaatgaagaatcacgattt

SEQ ID NO: 4607200 - DNA, 21 bp, Homo sapiens
aaaagtaatgacttagaaact

SEQ ID NO: 4607201 - DNA, 19 bp, Homo sapiens
aaaagttttgatatttatt

SEQ ID NO: 4607202 - DNA, 20 bp, Homo sapiens
aaaagttttttattatgcat

SEQ ID NO: 4607203 - DNA, 17 bp, Homo sapiens
aaaataaaaaacatata

SEQ ID NO: 4607204 - DNA, 12 bp, Homo sapiens
aaaataaaatgt

SEQ ID NO: 4607205 - DNA, 14 bp, Homo sapiens
aaaataaaatgttt

SEQ ID NO: 4607206 - DNA, 13 bp, Homo sapiens
aaaatacttctat

SEQ ID NO: 4607207 - DNA, 19 bp, Homo sapiens
aaaatacttctttttcatt

SEQ ID NO: 4607208 - DNA, 20 bp, Homo sapiens
aaaatagagcaaaatcaaca

SEQ ID NO: 4607209 - DNA, 21 bp, Homo sapiens
aaaatagagcaaaatcaacat

SEQ ID NO: 4607210 - DNA, 21 bp, Homo sapiens
aaaatagcaataactgaaaat

SEQ ID NO: 4607211 - DNA, 10 bp, Homo sapiens
aaaatataaa

SEQ ID NO: 4607212 - DNA, 13 bp, Homo sapiens
aaaatataaattg

SEQ ID NO: 4607213 - DNA, 17 bp, Homo sapiens
aaaatatatctggaact

SEQ ID NO: 4607214 - DNA, 19 bp, Homo sapiens
aaaatatattgctgcattt

SEQ ID NO: 4607215 - DNA, 15 bp, Homo sapiens
aaaatattgtttctg

SEQ ID NO: 4607216 - DNA, 16 bp, Homo sapiens
aaaatattgtttctgc

SEQ ID NO: 4607217 - DNA, 23 bp, Homo sapiens
aaaatattttctctgtacttttc

SEQ ID NO: 4607218 - DNA, 22 bp, Homo sapiens
aaaatattttgttaacttttgt

SEQ ID NO: 4607219 - DNA, 16 bp, Homo sapiens
aaaatcaaaacaagtg

SEQ ID NO: 4607220 - DNA, 14 bp, Homo sapiens
aaaatcaacatgac

SEQ ID NO: 4607221 - DNA, 16 bp, Homo sapiens
aaaatcagtttttcat

SEQ ID NO: 4607222 - DNA, 20 bp, Homo sapiens
aaaatccaataatcagaaaa

SEQ ID NO: 4607223 - DNA, 17 bp, Homo sapiens
aaaatccccttcgctga

SEQ ID NO: 4607224 - DNA, 15 bp, Homo sapiens
aaaatgaaatccttt

SEQ ID NO: 4607225 - DNA, 16 bp, Homo sapiens
aaaatgaaatgctaca

SEQ ID NO: 4607226 - DNA, 20 bp, Homo sapiens
aaaatgaacatctcttgaaa

SEQ ID NO: 4607227 - DNA, 12 bp, Homo sapiens
aaaatgacaaac

SEQ ID NO: 4607228 - DNA, 18 bp, Homo sapiens
aaaatgacaaacatgata

SEQ ID NO: 4607229 - DNA, 24 bp, Homo sapiens
aaaatgacaaacatgatactgctg

SEQ ID NO: 4607230 - DNA, 17 bp, Homo sapiens
aaaatgatcctcagtgc

SEQ ID NO: 4607231 - DNA, 22 bp, Homo sapiens
aaaatgcaaatcctatgtgatt

SEQ ID NO: 4607232 - DNA, 17 bp, Homo sapiens
aaaatgcctagagatat

SEQ ID NO: 4607233 - DNA, 21 bp, Homo sapiens
aaaatgcctagagatatttca

SEQ ID NO: 4607234 - DNA, 18 bp, Homo sapiens
aaaatgtaggctttcatg

SEQ ID NO: 4607235 - DNA, 16 bp, Homo sapiens
aaaatgtattgattca

SEQ ID NO: 4607236 - DNA, 11 bp, Homo sapiens
aaaatgtttaa

SEQ ID NO: 4607237 - DNA, 15 bp, Homo sapiens
aaaatgtttcattat

SEQ ID NO: 4607238 - DNA, 13 bp, Homo sapiens
aaaattaactttt

SEQ ID NO: 4607239 - DNA, 18 bp, Homo sapiens
aaaattacctttaatttt

SEQ ID NO: 4607240 - DNA, 21 bp, Homo sapiens
aaaattatttgaaaacatata

SEQ ID NO: 4607241 - DNA, 15 bp, Homo sapiens
aaaattatttgctat

SEQ ID NO: 4607242 - DNA, 15 bp, Homo sapiens
aaaattcatttctaa

SEQ ID NO: 4607243 - DNA, 22 bp, Homo sapiens
aaaattgaactaatttatactt

SEQ ID NO: 4607244 - DNA, 17 bp, Homo sapiens
aaaatttaaaaacttaa

SEQ ID NO: 4607245 - DNA, 12 bp, Homo sapiens
aaaatttattct

SEQ ID NO: 4607246 - DNA, 19 bp, Homo sapiens
aaaatttgtttgaaatctt

SEQ ID NO: 4607247 - DNA, 12 bp, Homo sapiens
aaaattttagct

SEQ ID NO: 4607248 - DNA, 17 bp, Homo sapiens
aaaattttttttcatgt

SEQ ID NO: 4607249 - DNA, 17 bp, Homo sapiens
aaacaaaatttgactaa

SEQ ID NO: 4607250 - DNA, 11 bp, Homo sapiens
aaacaaagaag

SEQ ID NO: 4607251 - DNA, 16 bp, Homo sapiens
aaacaaagtactcttt

SEQ ID NO: 4607252 - DNA, 17 bp, Homo sapiens
aaacaaccagttaaagc

SEQ ID NO: 4607253 - DNA, 13 bp, Homo sapiens
aaacaagctgtgc

SEQ ID NO: 4607254 - DNA, 20 bp, Homo sapiens
aaacaccacttaatcttctc

SEQ ID NO: 4607255 - DNA, 22 bp, Homo sapiens
aaacacgtggtcatgaatagaa

SEQ ID NO: 4607256 - DNA, 14 bp, Homo sapiens
aaacactctttgag

SEQ ID NO: 4607257 - DNA, 22 bp, Homo sapiens
aaacagagtggcctccctgctg

SEQ ID NO: 4607258 - DNA, 17 bp, Homo sapiens
aaacagctcagccagtg

SEQ ID NO: 4607259 - DNA, 15 bp, Homo sapiens
aaacagggctgcctt

SEQ ID NO: 4607260 - DNA, 22 bp, Homo sapiens
aaacagttgctgtgaactttca

SEQ ID NO: 4607261 - DNA, 14 bp, Homo sapiens
aaacatagaaatgg

SEQ ID NO: 4607262 - DNA, 21 bp, Homo sapiens
aaacatagaaatggaaatttt

SEQ ID NO: 4607263 - DNA, 17 bp, Homo sapiens
aaacatgatactgctgc

SEQ ID NO: 4607264 - DNA, 22 bp, Homo sapiens
aaacatgcagctcttcaacatg

SEQ ID NO: 4607265 - DNA, 12 bp, Homo sapiens
aaacatgtttaa

SEQ ID NO: 4607266 - DNA, 19 bp, Homo sapiens
aaacattatatgtatacat

SEQ ID NO: 4607267 - DNA, 13 bp, Homo sapiens
aaacattgtaaat

SEQ ID NO: 4607268 - DNA, 23 bp, Homo sapiens
aaacatttggaaaagacagaaaa

SEQ ID NO: 4607269 - DNA, 18 bp, Homo sapiens
aaaccaaacttgttcatt

SEQ ID NO: 4607270 - DNA, 18 bp, Homo sapiens
aaaccaattaagcagctt

SEQ ID NO: 4607271 - DNA, 13 bp, Homo sapiens
aaaccacttctcc

SEQ ID NO: 4607272 - DNA, 16 bp, Homo sapiens
aaaccagaacccagtg

SEQ ID NO: 4607273 - DNA, 22 bp, Homo sapiens
aaaccagctctgaacttccaag

SEQ ID NO: 4607274 - DNA, 15 bp, Homo sapiens
aaaccatgcctggta

SEQ ID NO: 4607275 - DNA, 18 bp, Homo sapiens
aaaccattgtaactatta

SEQ ID NO: 4607276 - DNA, 22 bp, Homo sapiens
aaaccattgtaactattaacct

SEQ ID NO: 4607277 - DNA, 22 bp, Homo sapiens
aaaccctggtggtattttattt

SEQ ID NO: 4607278 - DNA, 16 bp, Homo sapiens
aaacccttgctttcct

SEQ ID NO: 4607279 - DNA, 15 bp, Homo sapiens
aaacctacatattcc

SEQ ID NO: 4607280 - DNA, 21 bp, Homo sapiens
aaacctctgttcagtgtaaat

SEQ ID NO: 4607281 - DNA, 18 bp, Homo sapiens
aaacctggggtgaatact

SEQ ID NO: 4607282 - DNA, 11 bp, Homo sapiens
aaaccttcaca

SEQ ID NO: 4607283 - DNA, 21 bp, Homo sapiens
aaaccttgtggataagtggct

SEQ ID NO: 4607284 - DNA, 20 bp, Homo sapiens
aaaccttgttctatttttca

SEQ ID NO: 4607285 - DNA, 13 bp, Homo sapiens
aaacctttgcccc

SEQ ID NO: 4607286 - DNA, 22 bp, Homo sapiens
aaacgtgttgtatctacagtaa

SEQ ID NO: 4607287 - DNA, 14 bp, Homo sapiens
aaactaaacagaaa

SEQ ID NO: 4607288 - DNA, 17 bp, Homo sapiens
aaactaaacagaaaact

SEQ ID NO: 4607289 - DNA, 16 bp, Homo sapiens
aaactactgattactt

SEQ ID NO: 4607290 - DNA, 17 bp, Homo sapiens
aaactatgatttatttt

SEQ ID NO: 4607291 - DNA, 22 bp, Homo sapiens
aaactatttatctgtgtttttg

SEQ ID NO: 4607292 - DNA, 22 bp, Homo sapiens
aaactcactgtgatcaatattt

SEQ ID NO: 4607293 - DNA, 13 bp, Homo sapiens
aaactcaggcaga

SEQ ID NO: 4607294 - DNA, 17 bp, Homo sapiens
aaactcatgatcaagat

SEQ ID NO: 4607295 - DNA, 21 bp, Homo sapiens
aaactcatgatcaagatatat

SEQ ID NO: 4607296 - DNA, 11 bp, Homo sapiens
aaactcctgac

SEQ ID NO: 4607297 - DNA, 14 bp, Homo sapiens
aaactcctgacctc

SEQ ID NO: 4607298 - DNA, 14 bp, Homo sapiens
aaactctacagatg

SEQ ID NO: 4607299 - DNA, 22 bp, Homo sapiens
aaactgagatccttccttttga

SEQ ID NO: 4607300 - DNA, 13 bp, Homo sapiens
aaactgaggccca

SEQ ID NO: 4607301 - DNA, 21 bp, Homo sapiens
aaactgggtatgcgtttcatg

SEQ ID NO: 4607302 - DNA, 15 bp, Homo sapiens
aaactgtgttgccac

SEQ ID NO: 4607303 - DNA, 12 bp, Homo sapiens
aaactgtttgtt

SEQ ID NO: 4607304 - DNA, 18 bp, Homo sapiens
aaacttaaatattgtaat

SEQ ID NO: 4607305 - DNA, 22 bp, Homo sapiens
aaacttaaatattgtaatatga

SEQ ID NO: 4607306 - DNA, 15 bp, Homo sapiens
aaacttacactgttt

SEQ ID NO: 4607307 - DNA, 23 bp, Homo sapiens
aaacttcttgtcagacataaagc

SEQ ID NO: 4607308 - DNA, 18 bp, Homo sapiens
aaacttggaatcaaggta

SEQ ID NO: 4607309 - DNA, 22 bp, Homo sapiens
aaacttgtcttttcaaaatatt

SEQ ID NO: 4607310 - DNA, 20 bp, Homo sapiens
aaactttattaaaagaatga

SEQ ID NO: 4607311 - DNA, 20 bp, Homo sapiens
aaactttattgggtttttat

SEQ ID NO: 4607312 - DNA, 15 bp, Homo sapiens
aaactttctccattt

SEQ ID NO: 4607313 - DNA, 18 bp, Homo sapiens
aaactttctccatttaag

SEQ ID NO: 4607314 - DNA, 14 bp, Homo sapiens
aaagaaacaagctg

SEQ ID NO: 4607315 - DNA, 17 bp, Homo sapiens
aaagaaacaagctgtgc

SEQ ID NO: 4607316 - DNA, 19 bp, Homo sapiens
aaagaaacaccacttaatc

SEQ ID NO: 4607317 - DNA, 20 bp, Homo sapiens
aaagaaagggacccacctgc

SEQ ID NO: 4607318 - DNA, 11 bp, Homo sapiens
aaagaaattcg

SEQ ID NO: 4607319 - DNA, 16 bp, Homo sapiens
aaagaagatagtgaga

SEQ ID NO: 4607320 - DNA, 12 bp, Homo sapiens
aaagaagcaaga

SEQ ID NO: 4607321 - DNA, 14 bp, Homo sapiens
aaagaagcaagaca

SEQ ID NO: 4607322 - DNA, 23 bp, Homo sapiens
aaagaagggggccctgctacctg

SEQ ID NO: 4607323 - DNA, 15 bp, Homo sapiens
aaagaatattttgat

SEQ ID NO: 4607324 - DNA, 19 bp, Homo sapiens
aaagaatcagtaggaccag

SEQ ID NO: 4607325 - DNA, 22 bp, Homo sapiens
aaagacaaattcggatgtatga

SEQ ID NO: 4607326 - DNA, 20 bp, Homo sapiens
aaagaccctgatgcaggtca

SEQ ID NO: 4607327 - DNA, 22 bp, Homo sapiens
aaagaccctgatgcaggtcagc

SEQ ID NO: 4607328 - DNA, 17 bp, Homo sapiens
aaagactggttttctgc

SEQ ID NO: 4607329 - DNA, 13 bp, Homo sapiens
aaagagagaagcc

SEQ ID NO: 4607330 - DNA, 14 bp, Homo sapiens
aaagagagaagcca

SEQ ID NO: 4607331 - DNA, 16 bp, Homo sapiens
aaagagagaagccagc

SEQ ID NO: 4607332 - DNA, 12 bp, Homo sapiens
aaagagggacag

SEQ ID NO: 4607333 - DNA, 18 bp, Homo sapiens
aaagaggtgaccccaggg

SEQ ID NO: 4607334 - DNA, 19 bp, Homo sapiens
aaagaggtgaccccagggc

SEQ ID NO: 4607335 - DNA, 21 bp, Homo sapiens
aaagaggtgaccccagggcac

SEQ ID NO: 4607336 - DNA, 18 bp, Homo sapiens
aaagatgatcgctgtatt

SEQ ID NO: 4607337 - DNA, 20 bp, Homo sapiens
aaagatgtccttggagatga

SEQ ID NO: 4607338 - DNA, 19 bp, Homo sapiens
aaagattctggggctgtgt

SEQ ID NO: 4607339 - DNA, 14 bp, Homo sapiens
aaagattttgtttt

SEQ ID NO: 4607340 - DNA, 20 bp, Homo sapiens
aaagcacaatcactaaactt

SEQ ID NO: 4607341 - DNA, 12 bp, Homo sapiens
aaagcacatcca

SEQ ID NO: 4607342 - DNA, 15 bp, Homo sapiens
aaagcagccacgagg

SEQ ID NO: 4607343 - DNA, 17 bp, Homo sapiens
aaagcaggactgtgcct

SEQ ID NO: 4607344 - DNA, 16 bp, Homo sapiens
aaagccaaacaaaact

SEQ ID NO: 4607345 - DNA, 13 bp, Homo sapiens
aaagccaggagca

SEQ ID NO: 4607346 - DNA, 14 bp, Homo sapiens
aaagccatttctta

SEQ ID NO: 4607347 - DNA, 13 bp, Homo sapiens
aaagccctgtgct

SEQ ID NO: 4607348 - DNA, 17 bp, Homo sapiens
aaagccttccagttttg

SEQ ID NO: 4607349 - DNA, 21 bp, Homo sapiens
aaagccttccagttttgtgga

SEQ ID NO: 4607350 - DNA, 16 bp, Homo sapiens
aaagcctttaaattgt

SEQ ID NO: 4607351 - DNA, 14 bp, Homo sapiens
aaagcggtccctgt

SEQ ID NO: 4607352 - DNA, 15 bp, Homo sapiens
aaagcggtccctgtc

SEQ ID NO: 4607353 - DNA, 15 bp, Homo sapiens
aaagctaaaaatatt

SEQ ID NO: 4607354 - DNA, 15 bp, Homo sapiens
aaagctatggtgaga

SEQ ID NO: 4607355 - DNA, 21 bp, Homo sapiens
aaagctcttcctaatcgctaa

SEQ ID NO: 4607356 - DNA, 20 bp, Homo sapiens
aaagctgcaaaaattatata

SEQ ID NO: 4607357 - DNA, 21 bp, Homo sapiens
aaagctttcctgtttccaggg

SEQ ID NO: 4607358 - DNA, 23 bp, Homo sapiens
aaagctttcctgtttccagggtc

SEQ ID NO: 4607359 - DNA, 12 bp, Homo sapiens
aaaggaagccaa

SEQ ID NO: 4607360 - DNA, 15 bp, Homo sapiens
aaaggaagccaaaga

SEQ ID NO: 4607361 - DNA, 13 bp, Homo sapiens
aaaggaatataag

SEQ ID NO: 4607362 - DNA, 11 bp, Homo sapiens
aaaggagcctg

SEQ ID NO: 4607363 - DNA, 12 bp, Homo sapiens
aaaggagcctgt

SEQ ID NO: 4607364 - DNA, 14 bp, Homo sapiens
aaaggataactctg

SEQ ID NO: 4607365 - DNA, 18 bp, Homo sapiens
aaaggataactctgtatt

SEQ ID NO: 4607366 - DNA, 18 bp, Homo sapiens
aaaggccaaacctctgtt

SEQ ID NO: 4607367 - DNA, 20 bp, Homo sapiens
aaaggccaaacctctgttca

SEQ ID NO: 4607368 - DNA, 20 bp, Homo sapiens
aaaggccagacctgcagacg

SEQ ID NO: 4607369 - DNA, 17 bp, Homo sapiens
aaaggccttcagacaca

SEQ ID NO: 4607370 - DNA, 19 bp, Homo sapiens
aaagggaacaagatgctga

SEQ ID NO: 4607371 - DNA, 16 bp, Homo sapiens
aaagggcactcccaac

SEQ ID NO: 4607372 - DNA, 10 bp, Homo sapiens
aaagggtgaa

SEQ ID NO: 4607373 - DNA, 23 bp, Homo sapiens
aaaggttttggatcttgaatgtg

SEQ ID NO: 4607374 - DNA, 13 bp, Homo sapiens
aaagtaatgtaaa

SEQ ID NO: 4607375 - DNA, 13 bp, Homo sapiens
aaagtaattttgt

SEQ ID NO: 4607376 - DNA, 18 bp, Homo sapiens
aaagtaattttgtcacat

SEQ ID NO: 4607377 - DNA, 17 bp, Homo sapiens
aaagtacaaatgaagaa

SEQ ID NO: 4607378 - DNA, 16 bp, Homo sapiens
aaagtacatgttaaac

SEQ ID NO: 4607379 - DNA, 16 bp, Homo sapiens
aaagtattattttcca

SEQ ID NO: 4607380 - DNA, 17 bp, Homo sapiens
aaagtattattttccaa

SEQ ID NO: 4607381 - DNA, 17 bp, Homo sapiens
aagaatattttgatgca

SEQ ID NO: 4607382 - DNA, 19 bp, Homo sapiens
aagaatgaaaaatataatg

SEQ ID NO: 4607383 - DNA, 16 bp, Homo sapiens
aagaatgactatataa

SEQ ID NO: 4607384 - DNA, 20 bp, Homo sapiens
aagaatgagtgaagtattgc

SEQ ID NO: 4607385 - DNA, 20 bp, Homo sapiens
aagaatttggggcaggaaat

SEQ ID NO: 4607386 - DNA, 20 bp, Homo sapiens
aagaattttatttttctgtg

SEQ ID NO: 4607387 - DNA, 16 bp, Homo sapiens
aagacaaaagtctgtc

SEQ ID NO: 4607388 - DNA, 18 bp, Homo sapiens
aagacaccgttcattcag

SEQ ID NO: 4607389 - DNA, 13 bp, Homo sapiens
aagacagagggga

SEQ ID NO: 4607390 - DNA, 14 bp, Homo sapiens
aagacagaggggag

SEQ ID NO: 4607391 - DNA, 22 bp, Homo sapiens
aagacagggctcatttttgcac

SEQ ID NO: 4607392 - DNA, 23 bp, Homo sapiens
aagacagggctcatttttgcact

SEQ ID NO: 4607393 - DNA, 14 bp, Homo sapiens
aagacattttctct

SEQ ID NO: 4607394 - DNA, 20 bp, Homo sapiens
aagacattttttaaaagcct

SEQ ID NO: 4607395 - DNA, 15 bp, Homo sapiens
aagaccaccttccct

SEQ ID NO: 4607396 - DNA, 21 bp, Homo sapiens
aagaccaccttcccttcctca

SEQ ID NO: 4607397 - DNA, 19 bp, Homo sapiens
aagacccaacacatgggac

SEQ ID NO: 4607398 - DNA, 14 bp, Homo sapiens
aagaccctgatgca

SEQ ID NO: 4607399 - DNA, 13 bp, Homo sapiens
aagaccctgcctc

SEQ ID NO: 4607400 - DNA, 19 bp, Homo sapiens
aagacctcatctgtggagc

SEQ ID NO: 4607401 - DNA, 20 bp, Homo sapiens
aagacctcatctgtggagct

SEQ ID NO: 4607402 - DNA, 22 bp, Homo sapiens
aagacctcatctgtggagctgc

SEQ ID NO: 4607403 - DNA, 13 bp, Homo sapiens
aagacgaggggca

SEQ ID NO: 4607404 - DNA, 14 bp, Homo sapiens
aagacgaggggcag

SEQ ID NO: 4607405 - DNA, 19 bp, Homo sapiens
aagacgggaggggaggcat

SEQ ID NO: 4607406 - DNA, 22 bp, Homo sapiens
aagacgtgattttgctgtagaa

SEQ ID NO: 4607407 - DNA, 14 bp, Homo sapiens
aagactgagaactt

SEQ ID NO: 4607408 - DNA, 15 bp, Homo sapiens
aagactggttttctg

SEQ ID NO: 4607409 - DNA, 17 bp, Homo sapiens
aagactggttttctgcc

SEQ ID NO: 4607410 - DNA, 17 bp, Homo sapiens
aagacttagattgtgct

SEQ ID NO: 4607411 - DNA, 19 bp, Homo sapiens
aagacttgtaatattttta

SEQ ID NO: 4607412 - DNA, 20 bp, Homo sapiens
aagactttgggataggaaaa

SEQ ID NO: 4607413 - DNA, 22 bp, Homo sapiens
aagagaagtttaacaagtattt

SEQ ID NO: 4607414 - DNA, 15 bp, Homo sapiens
aagagacagcccagg

SEQ ID NO: 4607415 - DNA, 16 bp, Homo sapiens
aagagacagcccagga

SEQ ID NO: 4607416 - DNA, 15 bp, Homo sapiens
aagagatcccaggag

SEQ ID NO: 4607417 - DNA, 21 bp, Homo sapiens
aagagcacttgagctgtctga

SEQ ID NO: 4607418 - DNA, 21 bp, Homo sapiens
aagagcatcatgcctctgagg

SEQ ID NO: 4607419 - DNA, 14 bp, Homo sapiens
aagagccacctgca

SEQ ID NO: 4607420 - DNA, 16 bp, Homo sapiens
aagagccacctgcaag

SEQ ID NO: 4607421 - DNA, 18 bp, Homo sapiens
aagagccacctgcaagat

SEQ ID NO: 4607422 - DNA, 22 bp, Homo sapiens
aagagctagaaaaataaaatgt

SEQ ID NO: 4607423 - DNA, 13 bp, Homo sapiens
aagagctgcctgg

SEQ ID NO: 4607424 - DNA, 16 bp, Homo sapiens
aagagctgcctggatg

SEQ ID NO: 4607425 - DNA, 18 bp, Homo sapiens
aagagctgcctggatgag

SEQ ID NO: 4607426 - DNA, 14 bp, Homo sapiens
aagagcttaagaac

SEQ ID NO: 4607427 - DNA, 23 bp, Homo sapiens
aagaggagatgtgatcaggcccc

SEQ ID NO: 4607428 - DNA, 16 bp, Homo sapiens
aagaggtgaccccagg

SEQ ID NO: 4607429 - DNA, 17 bp, Homo sapiens
aagaggtgaccccaggg

SEQ ID NO: 4607430 - DNA, 19 bp, Homo sapiens
aagaggtgaccccagggca

SEQ ID NO: 4607431 - DNA, 13 bp, Homo sapiens
aagatagaacaca

SEQ ID NO: 4607432 - DNA, 15 bp, Homo sapiens
aagatagaacacaaa

SEQ ID NO: 4607433 - DNA, 22 bp, Homo sapiens
aagatattgatcaaatatagaa

SEQ ID NO: 4607434 - DNA, 14 bp, Homo sapiens
aagatcattggagt

SEQ ID NO: 4607435 - DNA, 19 bp, Homo sapiens
aagatctgccagacctgca

SEQ ID NO: 4607436 - DNA, 17 bp, Homo sapiens
aagatgaacagactgac

SEQ ID NO: 4607437 - DNA, 19 bp, Homo sapiens
aagatggacacgagccaca

SEQ ID NO: 4607438 - DNA, 18 bp, Homo sapiens
aagatggcagatacagga

SEQ ID NO: 4607439 - DNA, 17 bp, Homo sapiens
aagatgtacttctctgt

SEQ ID NO: 4607440 - DNA, 18 bp, Homo sapiens
aagatgttgtgtcttgtg

SEQ ID NO: 4607441 - DNA, 12 bp, Homo sapiens
aagattaatttt

SEQ ID NO: 4607442 - DNA, 23 bp, Homo sapiens
aagattcctcgttattgttgttg

SEQ ID NO: 4607443 - DNA, 21 bp, Homo sapiens
aagattgtaattaaaatgata

SEQ ID NO: 4607444 - DNA, 20 bp, Homo sapiens
aagattttcctcttgtgatt

SEQ ID NO: 4607445 - DNA, 22 bp, Homo sapiens
aagcaaagtgctttgacttctt

SEQ ID NO: 4607446 - DNA, 13 bp, Homo sapiens
aagcaagaaacag

SEQ ID NO: 4607447 - DNA, 14 bp, Homo sapiens
aagcaagaaacagt

SEQ ID NO: 4607448 - DNA, 15 bp, Homo sapiens
aagcaagtatattta

SEQ ID NO: 4607449 - DNA, 14 bp, Homo sapiens
aagcaatcatttta

SEQ ID NO: 4607450 - DNA, 16 bp, Homo sapiens
aagcacagcagcctgg

SEQ ID NO: 4607451 - DNA, 19 bp, Homo sapiens
aagcactcggggtccctgg

SEQ ID NO: 4607452 - DNA, 22 bp, Homo sapiens
aagcactgtgtttatatgtctt

SEQ ID NO: 4607453 - DNA, 17 bp, Homo sapiens
aagcagaacatactgtt

SEQ ID NO: 4607454 - DNA, 15 bp, Homo sapiens
aagcagacagctcca

SEQ ID NO: 4607455 - DNA, 14 bp, Homo sapiens
aagcagcccttgct

SEQ ID NO: 4607456 - DNA, 12 bp, Homo sapiens
aagcagggcagc

SEQ ID NO: 4607457 - DNA, 16 bp, Homo sapiens
aagcataatctgaaaa

SEQ ID NO: 4607458 - DNA, 16 bp, Homo sapiens
aagcatatagagatga

SEQ ID NO: 4607459 - DNA, 18 bp, Homo sapiens
aagcatattgtaccccct

SEQ ID NO: 4607460 - DNA, 15 bp, Homo sapiens
aagcattggagtttc

SEQ ID NO: 4607461 - DNA, 17 bp, Homo sapiens
aagcattttgaaacaaa

SEQ ID NO: 4607462 - DNA, 19 bp, Homo sapiens
aagcattttttataatttt

SEQ ID NO: 4607463 - DNA, 15 bp, Homo sapiens
aagccaaagaaacaa

SEQ ID NO: 4607464 - DNA, 10 bp, Homo sapiens
aagccagcca

SEQ ID NO: 4607465 - DNA, 20 bp, Homo sapiens
aagccagccacagacccctg

SEQ ID NO: 4607466 - DNA, 23 bp, Homo sapiens
aagccagccacagacccctggga

SEQ ID NO: 4607467 - DNA, 12 bp, Homo sapiens
aagccaggagca

SEQ ID NO: 4607468 - DNA, 17 bp, Homo sapiens
aagccaggagcagccct

SEQ ID NO: 4607469 - DNA, 20 bp, Homo sapiens
aagccagggtctctccctca

SEQ ID NO: 4607470 - DNA, 23 bp, Homo sapiens
aagccagggtctctccctcaggt

SEQ ID NO: 4607471 - DNA, 14 bp, Homo sapiens
aagccaggtacagg

SEQ ID NO: 4607472 - DNA, 15 bp, Homo sapiens
aagccaggtacagga

SEQ ID NO: 4607473 - DNA, 22 bp, Homo sapiens
aagccaggtacaggagaggcag

SEQ ID NO: 4607474 - DNA, 11 bp, Homo sapiens
aagcccaggat

SEQ ID NO: 4607475 - DNA, 14 bp, Homo sapiens
aagcccagttcatc

SEQ ID NO: 4607476 - DNA, 15 bp, Homo sapiens
aagccccatttcctc

SEQ ID NO: 4607477 - DNA, 13 bp, Homo sapiens
aagccccctgccc

SEQ ID NO: 4607478 - DNA, 11 bp, Homo sapiens
aagccctgccc

SEQ ID NO: 4607479 - DNA, 14 bp, Homo sapiens
aagccctgcccaca

SEQ ID NO: 4607480 - DNA, 17 bp, Homo sapiens
aagccctgcccacagaa

SEQ ID NO: 4607481 - DNA, 15 bp, Homo sapiens
aagccgaccttccct

SEQ ID NO: 4607482 - DNA, 18 bp, Homo sapiens
aagccgactctggccctg

SEQ ID NO: 4607483 - DNA, 22 bp, Homo sapiens
aagccgtgctcgccccagcagg

SEQ ID NO: 4607484 - DNA, 17 bp, Homo sapiens
aagccgttgacaaggct

SEQ ID NO: 4607485 - DNA, 13 bp, Homo sapiens
aagcctaaaattg

SEQ ID NO: 4607486 - DNA, 14 bp, Homo sapiens
aagcctaaaattga

SEQ ID NO: 4607487 - DNA, 19 bp, Homo sapiens
aagcctgaggacagaaaga

SEQ ID NO: 4607488 - DNA, 22 bp, Homo sapiens
aagcctgaggacagaaagaccc

SEQ ID NO: 4607489 - DNA, 22 bp, Homo sapiens
aagcctgcctcgccttgtgtta

SEQ ID NO: 4607490 - DNA, 15 bp, Homo sapiens
aagcctgggggcctg

SEQ ID NO: 4607491 - DNA, 17 bp, Homo sapiens
aagcctgggggcctggc

SEQ ID NO: 4607492 - DNA, 17 bp, Homo sapiens
aagcctttaaattgttc

SEQ ID NO: 4607493 - DNA, 15 bp, Homo sapiens
aaccctgccctgctc

SEQ ID NO: 4607494 - DNA, 12 bp, Homo sapiens
aaccctgggctg

SEQ ID NO: 4607495 - DNA, 22 bp, Homo sapiens
aaccggaaggaggccaaccagc

SEQ ID NO: 4607496 - DNA, 11 bp, Homo sapiens
aaccgtggccc

SEQ ID NO: 4607497 - DNA, 20 bp, Homo sapiens
aacctaataattgtatctac

SEQ ID NO: 4607498 - DNA, 13 bp, Homo sapiens
aacctaggagggc

SEQ ID NO: 4607499 - DNA, 13 bp, Homo sapiens
aacctcctctgtg

SEQ ID NO: 4607500 - DNA, 16 bp, Homo sapiens
aacctctacatattta

SEQ ID NO: 4607501 - DNA, 15 bp, Homo sapiens
aacctctgcctcctg

SEQ ID NO: 4607502 - DNA, 16 bp, Homo sapiens
aacctctgcttcccag

SEQ ID NO: 4607503 - DNA, 12 bp, Homo sapiens
aacctctgttca

SEQ ID NO: 4607504 - DNA, 18 bp, Homo sapiens
aacctctgttcagtgtaa

SEQ ID NO: 4607505 - DNA, 21 bp, Homo sapiens
aacctggggtgaatacttatt

SEQ ID NO: 4607506 - DNA, 18 bp, Homo sapiens
aacctgttcttagagtgt

SEQ ID NO: 4607507 - DNA, 22 bp, Homo sapiens
aacctgttcttagagtgtagct

SEQ ID NO: 4607508 - DNA, 16 bp, Homo sapiens
aacctgttttgttaat

SEQ ID NO: 4607509 - DNA, 21 bp, Homo sapiens
aacctgttttgttaatgctct

SEQ ID NO: 4607510 - DNA, 21 bp, Homo sapiens
aaccttgctcttggggaaggg

SEQ ID NO: 4607511 - DNA, 15 bp, Homo sapiens
aaccttgttctattt

SEQ ID NO: 4607512 - DNA, 19 bp, Homo sapiens
aaccttgttctctgcttga

SEQ ID NO: 4607513 - DNA, 19 bp, Homo sapiens
aaccttttttgtcttattg

SEQ ID NO: 4607514 - DNA, 13 bp, Homo sapiens
aacgagttaatga

SEQ ID NO: 4607515 - DNA, 22 bp, Homo sapiens
aacgagttaatgatggcagagg

SEQ ID NO: 4607516 - DNA, 13 bp, Homo sapiens
aacgcctgagccc

SEQ ID NO: 4607517 - DNA, 18 bp, Homo sapiens
aacgcctgagcccaggga

SEQ ID NO: 4607518 - DNA, 14 bp, Homo sapiens
aacgggtcagtatt

SEQ ID NO: 4607519 - DNA, 16 bp, Homo sapiens
aacggtctggcagggc

SEQ ID NO: 4607520 - DNA, 20 bp, Homo sapiens
aacggtgctaaaaatgaaaa

SEQ ID NO: 4607521 - DNA, 19 bp, Homo sapiens
aacggtttaattctgtctt

SEQ ID NO: 4607522 - DNA, 21 bp, Homo sapiens
aacgtatgcatgtgaagaaag

SEQ ID NO: 4607523 - DNA, 16 bp, Homo sapiens
aacgtgagagaaagag

SEQ ID NO: 4607524 - DNA, 20 bp, Homo sapiens
aacgtgagagaaagagagaa

SEQ ID NO: 4607525 - DNA, 15 bp, Homo sapiens
aactaagcaagtata

SEQ ID NO: 4607526 - DNA, 21 bp, Homo sapiens
aactaagcaagtatatttatt

SEQ ID NO: 4607527 - DNA, 21 bp, Homo sapiens
aactaaggcttttatttctgt

SEQ ID NO: 4607528 - DNA, 14 bp, Homo sapiens
aactaatgtttgaa

SEQ ID NO: 4607529 - DNA, 20 bp, Homo sapiens
aactaatgtttgaacaaagc

SEQ ID NO: 4607530 - DNA, 15 bp, Homo sapiens
aactactattcaaaa

SEQ ID NO: 4607531 - DNA, 18 bp, Homo sapiens
aactactgattacttgta

SEQ ID NO: 4607532 - DNA, 22 bp, Homo sapiens
aactagaggtgttacagaggac

SEQ ID NO: 4607533 - DNA, 21 bp, Homo sapiens
aactagccaaaccaggaccct

SEQ ID NO: 4607534 - DNA, 22 bp, Homo sapiens
aactatgttcctaacaaaatga

SEQ ID NO: 4607535 - DNA, 13 bp, Homo sapiens
aactatttatctg

SEQ ID NO: 4607536 - DNA, 21 bp, Homo sapiens
aactcctcacacaccctgagg

SEQ ID NO: 4607537 - DNA, 15 bp, Homo sapiens
aactcctgacctcag

SEQ ID NO: 4607538 - DNA, 19 bp, Homo sapiens
aactccttccatccttgac

SEQ ID NO: 4607539 - DNA, 17 bp, Homo sapiens
aactctacacagctcag

SEQ ID NO: 4607540 - DNA, 22 bp, Homo sapiens
aactctcaccatgatgtgaaga

SEQ ID NO: 4607541 - DNA, 19 bp, Homo sapiens
aactctcccctccccatct

SEQ ID NO: 4607542 - DNA, 20 bp, Homo sapiens
aactctgtcttcacctgatt

SEQ ID NO: 4607543 - DNA, 16 bp, Homo sapiens
aactgaaccacaaaaa

SEQ ID NO: 4607544 - DNA, 15 bp, Homo sapiens
aactgactatcataa

SEQ ID NO: 4607545 - DNA, 18 bp, Homo sapiens
aactgagatccttccttt

SEQ ID NO: 4607546 - DNA, 20 bp, Homo sapiens
aactgaggagatgaccaggg

SEQ ID NO: 4607547 - DNA, 21 bp, Homo sapiens
aactgattaaatatttgaaga

SEQ ID NO: 4607548 - DNA, 19 bp, Homo sapiens
aactgattgctcccaggat

SEQ ID NO: 4607549 - DNA, 16 bp, Homo sapiens
aactgctaatgcaaat

SEQ ID NO: 4607550 - DNA, 18 bp, Homo sapiens
aactgctaatgcaaatta

SEQ ID NO: 4607551 - DNA, 17 bp, Homo sapiens
aactggaagccttcccc

SEQ ID NO: 4607552 - DNA, 19 bp, Homo sapiens
aactggccaagctgaggtg

SEQ ID NO: 4607553 - DNA, 22 bp, Homo sapiens
aactgtaccatgtgctacaggg

SEQ ID NO: 4607554 - DNA, 17 bp, Homo sapiens
aactgtcctgtcctgct

SEQ ID NO: 4607555 - DNA, 18 bp, Homo sapiens
aactgtcctgtcctgctc

SEQ ID NO: 4607556 - DNA, 14 bp, Homo sapiens
aactgtcttagact

SEQ ID NO: 4607557 - DNA, 13 bp, Homo sapiens
aactgtgtttcaa

SEQ ID NO: 4607558 - DNA, 16 bp, Homo sapiens
aactgtgtttcaaatg

SEQ ID NO: 4607559 - DNA, 17 bp, Homo sapiens
aacttaaatattgtaat

SEQ ID NO: 4607560 - DNA, 22 bp, Homo sapiens
aacttaatgttcttatgcaaaa

SEQ ID NO: 4607561 - DNA, 16 bp, Homo sapiens
aacttacactgtttca

SEQ ID NO: 4607562 - DNA, 22 bp, Homo sapiens
aacttatagttaatattttgtt

SEQ ID NO: 4607563 - DNA, 15 bp, Homo sapiens
aacttattacctcag

SEQ ID NO: 4607564 - DNA, 23 bp, Homo sapiens
aacttccttattgggacttttct

SEQ ID NO: 4607565 - DNA, 17 bp, Homo sapiens
aacttctgtaaggggca

SEQ ID NO: 4607566 - DNA, 18 bp, Homo sapiens
aacttctgtaaggggcag

SEQ ID NO: 4607567 - DNA, 16 bp, Homo sapiens
aacttcttgtcagaca

SEQ ID NO: 4607568 - DNA, 20 bp, Homo sapiens
aacttcttgtcagacataaa

SEQ ID NO: 4607569 - DNA, 21 bp, Homo sapiens
aacttcttgtcagacataaag

SEQ ID NO: 4607570 - DNA, 20 bp, Homo sapiens
aacttgacatgtagcttctt

SEQ ID NO: 4607571 - DNA, 14 bp, Homo sapiens
aacttgactgggtg

SEQ ID NO: 4607572 - DNA, 11 bp, Homo sapiens
aacttgttcat

SEQ ID NO: 4607573 - DNA, 16 bp, Homo sapiens
aacttgttcatttaga

SEQ ID NO: 4607574 - DNA, 21 bp, Homo sapiens
aacttgttcatttagataatt

SEQ ID NO: 4607575 - DNA, 13 bp, Homo sapiens
aactttattaaaa

SEQ ID NO: 4607576 - DNA, 23 bp, Homo sapiens
aactttattaaaagaatgagtga

SEQ ID NO: 4607577 - DNA, 21 bp, Homo sapiens
aactttattgggtttttattg

SEQ ID NO: 4607578 - DNA, 14 bp, Homo sapiens
aactttatttgtaa

SEQ ID NO: 4607579 - DNA, 20 bp, Homo sapiens
aactttcagaagtgccactt

SEQ ID NO: 4607580 - DNA, 17 bp, Homo sapiens
aacttttagtaaagtca

SEQ ID NO: 4607581 - DNA, 18 bp, Homo sapiens
aacttttttgaggccttt

SEQ ID NO: 4607582 - DNA, 15 bp, Homo sapiens
aagaaaaaaaaaaga

SEQ ID NO: 4607583 - DNA, 12 bp, Homo sapiens
aagaaaatgcct

SEQ ID NO: 4607584 - DNA, 15 bp, Homo sapiens
aagaaaatgcctaga

SEQ ID NO: 4607585 - DNA, 15 bp, Homo sapiens
aagaaacaagctgtg

SEQ ID NO: 4607586 - DNA, 17 bp, Homo sapiens
aagaaactaaaaatata

SEQ ID NO: 4607587 - DNA, 13 bp, Homo sapiens
aagaaaggaagca

SEQ ID NO: 4607588 - DNA, 17 bp, Homo sapiens
aagaaagggacccacct

SEQ ID NO: 4607589 - DNA, 16 bp, Homo sapiens
aagaaagggtgttttt

SEQ ID NO: 4607590 - DNA, 15 bp, Homo sapiens
aagaaatatattttt

SEQ ID NO: 4607591 - DNA, 14 bp, Homo sapiens
aagaacaagaaatg

SEQ ID NO: 4607592 - DNA, 23 bp, Homo sapiens
aagaacatccctgtcttaactgg

SEQ ID NO: 4607593 - DNA, 21 bp, Homo sapiens
aagaactgcttcatgtgaaca

SEQ ID NO: 4607594 - DNA, 16 bp, Homo sapiens
aagaagccccttattt

SEQ ID NO: 4607595 - DNA, 17 bp, Homo sapiens
aagaagccccttatttt

SEQ ID NO: 4607596 - DNA, 12 bp, Homo sapiens
aagaagctttat

SEQ ID NO: 4607597 - DNA, 13 bp, Homo sapiens
aagaagctttatc

SEQ ID NO: 4607598 - DNA, 13 bp, Homo sapiens
aagaaggaaagaa

SEQ ID NO: 4607599 - DNA, 13 bp, Homo sapiens
aagaaggaaggcc

SEQ ID NO: 4607600 - DNA, 18 bp, Homo sapiens
aagaaggaaggcctgagc

SEQ ID NO: 4607601 - DNA, 17 bp, Homo sapiens
aagaagggggccctgct

SEQ ID NO: 4607602 - DNA, 19 bp, Homo sapiens
aagaagggggccctgctac

SEQ ID NO: 4607603 - DNA, 14 bp, Homo sapiens
aagaagtggagaca

SEQ ID NO: 4607604 - DNA, 13 bp, Homo sapiens
aaattaatcacaa

SEQ ID NO: 4607605 - DNA, 13 bp, Homo sapiens
aaattacaatttt

SEQ ID NO: 4607606 - DNA, 16 bp, Homo sapiens
aaattagccacatgta

SEQ ID NO: 4607607 - DNA, 13 bp, Homo sapiens
aaattatttgcta

SEQ ID NO: 4607608 - DNA, 18 bp, Homo sapiens
aaattcaagagctagaaa

SEQ ID NO: 4607609 - DNA, 12 bp, Homo sapiens
aaattcagctcc

SEQ ID NO: 4607610 - DNA, 12 bp, Homo sapiens
aaattcatttct

SEQ ID NO: 4607611 - DNA, 13 bp, Homo sapiens
aaattcattttta

SEQ ID NO: 4607612 - DNA, 17 bp, Homo sapiens
aaattctgacttatgaa

SEQ ID NO: 4607613 - DNA, 22 bp, Homo sapiens
aaattgacagatcaagctgtga

SEQ ID NO: 4607614 - DNA, 23 bp, Homo sapiens
aaattggattcccttaaacaaaa

SEQ ID NO: 4607615 - DNA, 18 bp, Homo sapiens
aaattgtcgtttttattc

SEQ ID NO: 4607616 - DNA, 21 bp, Homo sapiens
aaatttaatgtttttctggaa

SEQ ID NO: 4607617 - DNA, 16 bp, Homo sapiens
aaatttcattgcactt

SEQ ID NO: 4607618 - DNA, 17 bp, Homo sapiens
aaatttcattgcacttt

SEQ ID NO: 4607619 - DNA, 14 bp, Homo sapiens
aaatttgtttgaaa

SEQ ID NO: 4607620 - DNA, 12 bp, Homo sapiens
aaattttatctg

SEQ ID NO: 4607621 - DNA, 13 bp, Homo sapiens
aaattttcagcat

SEQ ID NO: 4607622 - DNA, 20 bp, Homo sapiens
aaatttttcagatgcttctg

SEQ ID NO: 4607623 - DNA, 21 bp, Homo sapiens
aaatttttcagatgcttctgg

SEQ ID NO: 4607624 - DNA, 19 bp, Homo sapiens
aaatttttcttttcttgat

SEQ ID NO: 4607625 - DNA, 15 bp, Homo sapiens
aaattttttttcatg

SEQ ID NO: 4607626 - DNA, 18 bp, Homo sapiens
aaattttttttgtttcat

SEQ ID NO: 4607627 - DNA, 14 bp, Homo sapiens
aacaaaacagaagg

SEQ ID NO: 4607628 - DNA, 22 bp, Homo sapiens
aacaaaagggttcatagaaact

SEQ ID NO: 4607629 - DNA, 12 bp, Homo sapiens
aacaaacaagcc

SEQ ID NO: 4607630 - DNA, 17 bp, Homo sapiens
aacaaacgagcaggcat

SEQ ID NO: 4607631 - DNA, 14 bp, Homo sapiens
aacaaatgtcttaa

SEQ ID NO: 4607632 - DNA, 14 bp, Homo sapiens
aacaaatttcattg

SEQ ID NO: 4607633 - DNA, 13 bp, Homo sapiens
aacaacaattggt

SEQ ID NO: 4607634 - DNA, 14 bp, Homo sapiens
aacaacaattggta

SEQ ID NO: 4607635 - DNA, 12 bp, Homo sapiens
aacaagctgtgc

SEQ ID NO: 4607636 - DNA, 14 bp, Homo sapiens
aacaagctgtgcag

SEQ ID NO: 4607637 - DNA, 14 bp, Homo sapiens
aacaagtatataat

SEQ ID NO: 4607638 - DNA, 17 bp, Homo sapiens
aacaagtatttattccc

SEQ ID NO: 4607639 - DNA, 20 bp, Homo sapiens
aacaagtatttattcccata

SEQ ID NO: 4607640 - DNA, 14 bp, Homo sapiens
aacaagtcaattct

SEQ ID NO: 4607641 - DNA, 23 bp, Homo sapiens
aacaagtcaattctgtgtggtat

SEQ ID NO: 4607642 - DNA, 21 bp, Homo sapiens
aacaagtgaaataacaaaatg

SEQ ID NO: 4607643 - DNA, 16 bp, Homo sapiens
aacaagtggatgtttt

SEQ ID NO: 4607644 - DNA, 22 bp, Homo sapiens
aacaatcctagtgctttccttt

SEQ ID NO: 4607645 - DNA, 17 bp, Homo sapiens
aacaattggtaaaactc

SEQ ID NO: 4607646 - DNA, 23 bp, Homo sapiens
aacaattggtaaaactcactgtg

SEQ ID NO: 4607647 - DNA, 22 bp, Homo sapiens
aacacagaggaatttatacctc

SEQ ID NO: 4607648 - DNA, 14 bp, Homo sapiens
aacaccaagcacag

SEQ ID NO: 4607649 - DNA, 19 bp, Homo sapiens
aacaccaagcacagcagcc

SEQ ID NO: 4607650 - DNA, 15 bp, Homo sapiens
aacaccacttaatct

SEQ ID NO: 4607651 - DNA, 14 bp, Homo sapiens
aacacgcacctgcc

SEQ ID NO: 4607652 - DNA, 15 bp, Homo sapiens
aacacgcacctgcct

SEQ ID NO: 4607653 - DNA, 16 bp, Homo sapiens
aacactcagaagcctg

SEQ ID NO: 4607654 - DNA, 17 bp, Homo sapiens
aacactcagaagcctgg

SEQ ID NO: 4607655 - DNA, 14 bp, Homo sapiens
aacagaaaacatcc

SEQ ID NO: 4607656 - DNA, 13 bp, Homo sapiens
aacagaacagggt

SEQ ID NO: 4607657 - DNA, 14 bp, Homo sapiens
aacagaacagggtc

SEQ ID NO: 4607658 - DNA, 23 bp, Homo sapiens
aacagagggagtttaatacagga

SEQ ID NO: 4607659 - DNA, 17 bp, Homo sapiens
aacagataaagaaactg

SEQ ID NO: 4607660 - DNA, 21 bp, Homo sapiens
aacagatgcaatgtgctactg

SEQ ID NO: 4607661 - DNA, 23 bp, Homo sapiens
aacagatgcaatgtgctactgat

SEQ ID NO: 4607662 - DNA, 17 bp, Homo sapiens
aacagatgtttgttttc

SEQ ID NO: 4607663 - DNA, 20 bp, Homo sapiens
aacagcaagtgtttgtggga

SEQ ID NO: 4607664 - DNA, 14 bp, Homo sapiens
aacagcattgcttt

SEQ ID NO: 4607665 - DNA, 20 bp, Homo sapiens
aacagcattgctttctgaaa

SEQ ID NO: 4607666 - DNA, 15 bp, Homo sapiens
aacagcctgtgtctt

SEQ ID NO: 4607667 - DNA, 11 bp, Homo sapiens
aacagctcagc

SEQ ID NO: 4607668 - DNA, 14 bp, Homo sapiens
aacagctcagccag

SEQ ID NO: 4607669 - DNA, 18 bp, Homo sapiens
aacagctcagccagtggg

SEQ ID NO: 4607670 - DNA, 19 bp, Homo sapiens
aacagctggaggaatacat

SEQ ID NO: 4607671 - DNA, 22 bp, Homo sapiens
aacagctggaggaatacatttt

SEQ ID NO: 4607672 - DNA, 23 bp, Homo sapiens
aacagctggaggaatacatttta

SEQ ID NO: 4607673 - DNA, 14 bp, Homo sapiens
aacagcttgctgtc

SEQ ID NO: 4607674 - DNA, 15 bp, Homo sapiens
aacagctttgtatgt

SEQ ID NO: 4607675 - DNA, 19 bp, Homo sapiens
aacaggaactagtaaacat

SEQ ID NO: 4607676 - DNA, 15 bp, Homo sapiens
aacagggagcacctg

SEQ ID NO: 4607677 - DNA, 20 bp, Homo sapiens
aacagggccacatagatgct

SEQ ID NO: 4607678 - DNA, 13 bp, Homo sapiens
aacaggtattttg

SEQ ID NO: 4607679 - DNA, 14 bp, Homo sapiens
aacagttgctgtga

SEQ ID NO: 4607680 - DNA, 14 bp, Homo sapiens
aacagtttcatcta

SEQ ID NO: 4607681 - DNA, 17 bp, Homo sapiens
aacagtttcttgcttgg

SEQ ID NO: 4607682 - DNA, 22 bp, Homo sapiens
aacagtttcttgcttggaagcc

SEQ ID NO: 4607683 - DNA, 15 bp, Homo sapiens
aacataatgaaaata

SEQ ID NO: 4607684 - DNA, 17 bp, Homo sapiens
aacatacaagaaaatgt

SEQ ID NO: 4607685 - DNA, 20 bp, Homo sapiens
aacatactgtaatcaaaagg

SEQ ID NO: 4607686 - DNA, 17 bp, Homo sapiens
aacatatttcattttaa

SEQ ID NO: 4607687 - DNA, 19 bp, Homo sapiens
aacatgatactgctgcttg

SEQ ID NO: 4607688 - DNA, 19 bp, Homo sapiens
aacatgcactgatgttgtg

SEQ ID NO: 4607689 - DNA, 18 bp, Homo sapiens
aacatggccagactccct

SEQ ID NO: 4607690 - DNA, 14 bp, Homo sapiens
aacattcagctctg

SEQ ID NO: 4607691 - DNA, 17 bp, Homo sapiens
aacattcagctctggag

SEQ ID NO: 4607692 - DNA, 18 bp, Homo sapiens
aacattcagctctggaga

SEQ ID NO: 4607693 - DNA, 19 bp, Homo sapiens
aacattcagctctggagaa

SEQ ID NO: 4607694 - DNA, 20 bp, Homo sapiens
aacattggacagaaaatgca

SEQ ID NO: 4607695 - DNA, 19 bp, Homo sapiens
aacattttatcattaaaaa

SEQ ID NO: 4607696 - DNA, 23 bp, Homo sapiens
aacattttgagctatttccttcc

SEQ ID NO: 4607697 - DNA, 22 bp, Homo sapiens
aaccaaatggttcttacttttc

SEQ ID NO: 4607698 - DNA, 21 bp, Homo sapiens
aaccaaggaaatatattttac

SEQ ID NO: 4607699 - DNA, 12 bp, Homo sapiens
aaccaaggccct

SEQ ID NO: 4607700 - DNA, 17 bp, Homo sapiens
aaccacggttatttaag

SEQ ID NO: 4607701 - DNA, 18 bp, Homo sapiens
aaccacttcgcacacacc

SEQ ID NO: 4607702 - DNA, 19 bp, Homo sapiens
aaccacttctccatgctgc

SEQ ID NO: 4607703 - DNA, 12 bp, Homo sapiens
aaccagaaccca

SEQ ID NO: 4607704 - DNA, 18 bp, Homo sapiens
aaccagaacgtggtttgc

SEQ ID NO: 4607705 - DNA, 14 bp, Homo sapiens
aaccagtgccaagg

SEQ ID NO: 4607706 - DNA, 15 bp, Homo sapiens
aaccagtgccaagga

SEQ ID NO: 4607707 - DNA, 14 bp, Homo sapiens
aaccatggcaaagt

SEQ ID NO: 4607708 - DNA, 14 bp, Homo sapiens
aaccattatacctt

SEQ ID NO: 4607709 - DNA, 19 bp, Homo sapiens
aacccagtctcctctccat

SEQ ID NO: 4607710 - DNA, 20 bp, Homo sapiens
aaccccaaggactgagggca

SEQ ID NO: 4607711 - DNA, 20 bp, Homo sapiens
aaccccctccctgtcccagg

SEQ ID NO: 4607712 - DNA, 15 bp, Homo sapiens
aacccctccactgct

SEQ ID NO: 4607713 - DNA, 14 bp, Homo sapiens
aacccgtgccaagt

SEQ ID NO: 4607714 - DNA, 17 bp, Homo sapiens
aaccctacaaagagcct

SEQ ID NO: 4607715 - DNA, 17 bp, Homo sapiens
aaccctgagagtctgag

SEQ ID NO: 4607716 - DNA, 19 bp, Homo sapiens
aaagtatttataaaaatat

SEQ ID NO: 4607717 - DNA, 20 bp, Homo sapiens
aaagtatttataaaaatata

SEQ ID NO: 4607718 - DNA, 22 bp, Homo sapiens
aaagtatttataaaaatataaa

SEQ ID NO: 4607719 - DNA, 22 bp, Homo sapiens
aaagtcacttactattgttgct

SEQ ID NO: 4607720 - DNA, 12 bp, Homo sapiens
aaagtccccaga

SEQ ID NO: 4607721 - DNA, 15 bp, Homo sapiens
aaagtcccccctcgc

SEQ ID NO: 4607722 - DNA, 12 bp, Homo sapiens
aaagtgacattt

SEQ ID NO: 4607723 - DNA, 13 bp, Homo sapiens
aaagtgacatttg

SEQ ID NO: 4607724 - DNA, 16 bp, Homo sapiens
aaagtggcagggaccg

SEQ ID NO: 4607725 - DNA, 14 bp, Homo sapiens
aaagtggcctcttt

SEQ ID NO: 4607726 - DNA, 18 bp, Homo sapiens
aaagtggcctctttgtct

SEQ ID NO: 4607727 - DNA, 17 bp, Homo sapiens
aaagtggtatagaaatg

SEQ ID NO: 4607728 - DNA, 18 bp, Homo sapiens
aaagttaatgggatggtc

SEQ ID NO: 4607729 - DNA, 21 bp, Homo sapiens
aaagttctgtgtaaacagaag

SEQ ID NO: 4607730 - DNA, 13 bp, Homo sapiens
aaagttgcagatg

SEQ ID NO: 4607731 - DNA, 13 bp, Homo sapiens
aaagttgtaaaat

SEQ ID NO: 4607732 - DNA, 15 bp, Homo sapiens
aaagttgttgcattc

SEQ ID NO: 4607733 - DNA, 20 bp, Homo sapiens
aaagtttaaaacagaagcct

SEQ ID NO: 4607734 - DNA, 13 bp, Homo sapiens
aaagtttaaatac

SEQ ID NO: 4607735 - DNA, 15 bp, Homo sapiens
aaagtttaaatacca

SEQ ID NO: 4607736 - DNA, 21 bp, Homo sapiens
aaagtttaaataccagtactt

SEQ ID NO: 4607737 - DNA, 18 bp, Homo sapiens
aaagtttcctaggatgtc

SEQ ID NO: 4607738 - DNA, 16 bp, Homo sapiens
aaagttttgatattta

SEQ ID NO: 4607739 - DNA, 19 bp, Homo sapiens
aaataaaaagtaatgactt

SEQ ID NO: 4607740 - DNA, 15 bp, Homo sapiens
aaataaaatgaaaat

SEQ ID NO: 4607741 - DNA, 15 bp, Homo sapiens
aaataaaatgaacat

SEQ ID NO: 4607742 - DNA, 20 bp, Homo sapiens
aaataaaatgtttcattatg

SEQ ID NO: 4607743 - DNA, 19 bp, Homo sapiens
aaataataaaagctaggcg

SEQ ID NO: 4607744 - DNA, 11 bp, Homo sapiens
aaataataaag

SEQ ID NO: 4607745 - DNA, 14 bp, Homo sapiens
aaatacatttgtaa

SEQ ID NO: 4607746 - DNA, 14 bp, Homo sapiens
aaataccagtactt

SEQ ID NO: 4607747 - DNA, 22 bp, Homo sapiens
aaatacgagaaaatctgcatgt

SEQ ID NO: 4607748 - DNA, 19 bp, Homo sapiens
aaatacttctttttcatta

SEQ ID NO: 4607749 - DNA, 15 bp, Homo sapiens
aaatagagcaaaatc

SEQ ID NO: 4607750 - DNA, 18 bp, Homo sapiens
aaatagagcaaaatcaac

SEQ ID NO: 4607751 - DNA, 23 bp, Homo sapiens
aaatagagcaaaatcaacatgac

SEQ ID NO: 4607752 - DNA, 13 bp, Homo sapiens
aaatagcaataac

SEQ ID NO: 4607753 - DNA, 18 bp, Homo sapiens
aaatagctaataatgtta

SEQ ID NO: 4607754 - DNA, 19 bp, Homo sapiens
aaatagctaataatgttaa

SEQ ID NO: 4607755 - DNA, 14 bp, Homo sapiens
aaataggattttta

SEQ ID NO: 4607756 - DNA, 16 bp, Homo sapiens
aaataggatttttaga

SEQ ID NO: 4607757 - DNA, 12 bp, Homo sapiens
aaatagtgttcc

SEQ ID NO: 4607758 - DNA, 17 bp, Homo sapiens
aaatataaggacttttt

SEQ ID NO: 4607759 - DNA, 20 bp, Homo sapiens
aaatataagtctatactaat

SEQ ID NO: 4607760 - DNA, 22 bp, Homo sapiens
aaatataatgttgataatatat

SEQ ID NO: 4607761 - DNA, 16 bp, Homo sapiens
aaatatacattttcta

SEQ ID NO: 4607762 - DNA, 18 bp, Homo sapiens
aaatatacattttctaaa

SEQ ID NO: 4607763 - DNA, 19 bp, Homo sapiens
aaatatacattttctaaat

SEQ ID NO: 4607764 - DNA, 20 bp, Homo sapiens
aaatatacattttctaaata

SEQ ID NO: 4607765 - DNA, 24 bp, Homo sapiens
aaatatagaaagttgatattcaac

SEQ ID NO: 4607766 - DNA, 13 bp, Homo sapiens
aaatatagcaaat

SEQ ID NO: 4607767 - DNA, 19 bp, Homo sapiens
aaatatagcaaatgcagaa

SEQ ID NO: 4607768 - DNA, 15 bp, Homo sapiens
aaatatatattttgt

SEQ ID NO: 4607769 - DNA, 15 bp, Homo sapiens
aaatatcattctttg

SEQ ID NO: 4607770 - DNA, 12 bp, Homo sapiens
aaatatgaatgc

SEQ ID NO: 4607771 - DNA, 12 bp, Homo sapiens
aaatatgtaatt

SEQ ID NO: 4607772 - DNA, 20 bp, Homo sapiens
aaatatgtaatttcaaaata

SEQ ID NO: 4607773 - DNA, 14 bp, Homo sapiens
aaatattgctctat

SEQ ID NO: 4607774 - DNA, 20 bp, Homo sapiens
aaatattgtaatatgacaga

SEQ ID NO: 4607775 - DNA, 21 bp, Homo sapiens
aaatattgtaatatgacagat

SEQ ID NO: 4607776 - DNA, 15 bp, Homo sapiens
aaatatttactcttt

SEQ ID NO: 4607777 - DNA, 19 bp, Homo sapiens
aaatatttactctttgcaa

SEQ ID NO: 4607778 - DNA, 15 bp, Homo sapiens
aaatattttctctgt

SEQ ID NO: 4607779 - DNA, 15 bp, Homo sapiens
aaatattttttacag

SEQ ID NO: 4607780 - DNA, 18 bp, Homo sapiens
aaatcacagaaaatttaa

SEQ ID NO: 4607781 - DNA, 13 bp, Homo sapiens
aaatcagaaagta

SEQ ID NO: 4607782 - DNA, 16 bp, Homo sapiens
aaatcagaaagtaaca

SEQ ID NO: 4607783 - DNA, 16 bp, Homo sapiens
aaatcagtttttcata

SEQ ID NO: 4607784 - DNA, 20 bp, Homo sapiens
aaatccacccatatgttaaa

SEQ ID NO: 4607785 - DNA, 21 bp, Homo sapiens
aaatccatactgtagacactc

SEQ ID NO: 4607786 - DNA, 19 bp, Homo sapiens
aaatccgccagtgtttctg

SEQ ID NO: 4607787 - DNA, 14 bp, Homo sapiens
aaatcctaccaaag

SEQ ID NO: 4607788 - DNA, 21 bp, Homo sapiens
aaatcctatgtgattttaact

SEQ ID NO: 4607789 - DNA, 17 bp, Homo sapiens
aaatctaccactgtatg

SEQ ID NO: 4607790 - DNA, 16 bp, Homo sapiens
aaatctgtaaagccag

SEQ ID NO: 4607791 - DNA, 23 bp, Homo sapiens
aaatctgtaacaggtattttgtt

SEQ ID NO: 4607792 - DNA, 13 bp, Homo sapiens
aaatcttgtgtta

SEQ ID NO: 4607793 - DNA, 22 bp, Homo sapiens
aaatcttttaaaaattcaaatg

SEQ ID NO: 4607794 - DNA, 19 bp, Homo sapiens
aaatgaacatctcttgaaa

SEQ ID NO: 4607795 - DNA, 16 bp, Homo sapiens
aaatgacaaacatgat

SEQ ID NO: 4607796 - DNA, 20 bp, Homo sapiens
aaatgacttatttctgctct

SEQ ID NO: 4607797 - DNA, 14 bp, Homo sapiens
aaatgcaaatttct

SEQ ID NO: 4607798 - DNA, 21 bp, Homo sapiens
aaatgcaaatttctataaatt

SEQ ID NO: 4607799 - DNA, 20 bp, Homo sapiens
aaatgcaacagtttttaaaa

SEQ ID NO: 4607800 - DNA, 19 bp, Homo sapiens
aaatgcagaaccacaaaca

SEQ ID NO: 4607801 - DNA, 22 bp, Homo sapiens
aaatgcctagagatatttcaag

SEQ ID NO: 4607802 - DNA, 15 bp, Homo sapiens
aaatgccttaaaatg

SEQ ID NO: 4607803 - DNA, 17 bp, Homo sapiens
aaatgccttaaaatgga

SEQ ID NO: 4607804 - DNA, 22 bp, Homo sapiens
aaatgctctctcaaattgtcag

SEQ ID NO: 4607805 - DNA, 23 bp, Homo sapiens
aaatgctgctttttctcaaaatg

SEQ ID NO: 4607806 - DNA, 22 bp, Homo sapiens
aaatggaattgaaaaactcttt

SEQ ID NO: 4607807 - DNA, 15 bp, Homo sapiens
aaatggacatggtgg

SEQ ID NO: 4607808 - DNA, 19 bp, Homo sapiens
aaatggctgtaatcatttg

SEQ ID NO: 4607809 - DNA, 18 bp, Homo sapiens
aaatggttcttacttttc

SEQ ID NO: 4607810 - DNA, 12 bp, Homo sapiens
aaatgtacactt

SEQ ID NO: 4607811 - DNA, 15 bp, Homo sapiens
aaatgtacacttttt

SEQ ID NO: 4607812 - DNA, 13 bp, Homo sapiens
aaatgtacttttg

SEQ ID NO: 4607813 - DNA, 14 bp, Homo sapiens
aaatgtattgattc

SEQ ID NO: 4607814 - DNA, 15 bp, Homo sapiens
aaatgtgaggcaata

SEQ ID NO: 4607815 - DNA, 15 bp, Homo sapiens
aaatgtgcattttgt

SEQ ID NO: 4607816 - DNA, 14 bp, Homo sapiens
aaatgtggccaagc

SEQ ID NO: 4607817 - DNA, 19 bp, Homo sapiens
aaatgtggttgcttaattc

SEQ ID NO: 4607818 - DNA, 21 bp, Homo sapiens
aaatgtgtacagtgaacaaat

SEQ ID NO: 4607819 - DNA, 14 bp, Homo sapiens
aaatgttctcaaat

SEQ ID NO: 4607820 - DNA, 15 bp, Homo sapiens
aaatgttctcaaata

SEQ ID NO: 4607821 - DNA, 22 bp, Homo sapiens
aaatgtttaataaagctttata

SEQ ID NO: 4607822 - DNA, 12 bp, Homo sapiens
aaatgtttcccc

SEQ ID NO: 4607823 - DNA, 14 bp, Homo sapiens
aaattaaaacaaat

SEQ ID NO: 4607824 - DNA, 22 bp, Homo sapiens
aaattaaaacatatttcatttt

SEQ ID NO: 4607825 - DNA, 20 bp, Homo sapiens
aaattaaatctagacattct

SEQ ID NO: 4607826 - DNA, 19 bp, Homo sapiens
aaattaacacaaaggaagt

SEQ ID NO: 4607827 - DNA, 17 bp, Homo sapiens
aagtagggatgcggatc

SEQ ID NO: 4607828 - DNA, 19 bp, Homo sapiens
aagtataatctttctatag

SEQ ID NO: 4607829 - DNA, 23 bp, Homo sapiens
aagtatattatatggcaggagct

SEQ ID NO: 4607830 - DNA, 15 bp, Homo sapiens
aagtatattcttatt

SEQ ID NO: 4607831 - DNA, 22 bp, Homo sapiens
aagtatgcaatgcttcattatt

SEQ ID NO: 4607832 - DNA, 15 bp, Homo sapiens
aagtatttattccca

SEQ ID NO: 4607833 - DNA, 13 bp, Homo sapiens
aagtcaaaaaatt

SEQ ID NO: 4607834 - DNA, 18 bp, Homo sapiens
aagtcaaataaatgtttc

SEQ ID NO: 4607835 - DNA, 14 bp, Homo sapiens
aagtcaattctgtg

SEQ ID NO: 4607836 - DNA, 21 bp, Homo sapiens
aagtcaattctgtgtggtata

SEQ ID NO: 4607837 - DNA, 23 bp, Homo sapiens
aagtcacatatcagaataggaag

SEQ ID NO: 4607838 - DNA, 14 bp, Homo sapiens
aagtcacccaggga

SEQ ID NO: 4607839 - DNA, 19 bp, Homo sapiens
aagtcagcccaacaggcag

SEQ ID NO: 4607840 - DNA, 21 bp, Homo sapiens
aagtcaggacagcttgtatgt

SEQ ID NO: 4607841 - DNA, 15 bp, Homo sapiens
aagtcaggtccaatt

SEQ ID NO: 4607842 - DNA, 13 bp, Homo sapiens
aagtccaggtcct

SEQ ID NO: 4607843 - DNA, 21 bp, Homo sapiens
aagtccaggtcctggtggggc

SEQ ID NO: 4607844 - DNA, 13 bp, Homo sapiens
aagtcccccctcg

SEQ ID NO: 4607845 - DNA, 23 bp, Homo sapiens
aagtcccccctcgccccaaagtt

SEQ ID NO: 4607846 - DNA, 15 bp, Homo sapiens
aagtccttggactgt

SEQ ID NO: 4607847 - DNA, 21 bp, Homo sapiens
aagtcgtccttactcctgtgg

SEQ ID NO: 4607848 - DNA, 22 bp, Homo sapiens
aagtcgtccttactcctgtggg

SEQ ID NO: 4607849 - DNA, 14 bp, Homo sapiens
aagtctgctgctgt

SEQ ID NO: 4607850 - DNA, 15 bp, Homo sapiens
aagtctgtctttcct

SEQ ID NO: 4607851 - DNA, 22 bp, Homo sapiens
aagtctgtctttcctgaaccat

SEQ ID NO: 4607852 - DNA, 18 bp, Homo sapiens
aagtgaaataacaaaatg

SEQ ID NO: 4607853 - DNA, 18 bp, Homo sapiens
aagtgaaattaagcattt

SEQ ID NO: 4607854 - DNA, 11 bp, Homo sapiens
aagtgaggaag

SEQ ID NO: 4607855 - DNA, 18 bp, Homo sapiens
aagtgaggtgacactcca

SEQ ID NO: 4607856 - DNA, 15 bp, Homo sapiens
aagtgcgtgaatgta

SEQ ID NO: 4607857 - DNA, 20 bp, Homo sapiens
aagtgcgtgccgtgtgagtg

SEQ ID NO: 4607858 - DNA, 17 bp, Homo sapiens
aagtgctcatctgttgt

SEQ ID NO: 4607859 - DNA, 13 bp, Homo sapiens
aagtgctgcggag

SEQ ID NO: 4607860 - DNA, 19 bp, Homo sapiens
aagtgctgcggagcaagag

SEQ ID NO: 4607861 - DNA, 16 bp, Homo sapiens
aagtgcttaaaaatac

SEQ ID NO: 4607862 - DNA, 23 bp, Homo sapiens
aagtggactggtgtcataaactt

SEQ ID NO: 4607863 - DNA, 16 bp, Homo sapiens
aagtggagacagtcct

SEQ ID NO: 4607864 - DNA, 16 bp, Homo sapiens
aagtggatgtttttaa

SEQ ID NO: 4607865 - DNA, 22 bp, Homo sapiens
aagtggcagggaccggcagagc

SEQ ID NO: 4607866 - DNA, 14 bp, Homo sapiens
aagtggcctctttg

SEQ ID NO: 4607867 - DNA, 14 bp, Homo sapiens
aagtgtaaaaaatg

SEQ ID NO: 4607868 - DNA, 16 bp, Homo sapiens
aagtgtcacctccttc

SEQ ID NO: 4607869 - DNA, 17 bp, Homo sapiens
aagtgtctcattctcag

SEQ ID NO: 4607870 - DNA, 18 bp, Homo sapiens
aagtgtgccaaatcagtt

SEQ ID NO: 4607871 - DNA, 18 bp, Homo sapiens
aagtgtgctgtgacaagc

SEQ ID NO: 4607872 - DNA, 20 bp, Homo sapiens
aagttagaaaattcagctcc

SEQ ID NO: 4607873 - DNA, 24 bp, Homo sapiens
aagttagaaggcttaagaactgct

SEQ ID NO: 4607874 - DNA, 21 bp, Homo sapiens
aagttatttccaagtttgtgt

SEQ ID NO: 4607875 - DNA, 15 bp, Homo sapiens
aagttcttagttgct

SEQ ID NO: 4607876 - DNA, 18 bp, Homo sapiens
aagttgaggattgttgaa

SEQ ID NO: 4607877 - DNA, 21 bp, Homo sapiens
aagttgtataggctaaatgtt

SEQ ID NO: 4607878 - DNA, 18 bp, Homo sapiens
aagttgtggaggaggtga

SEQ ID NO: 4607879 - DNA, 13 bp, Homo sapiens
aagttgttgcatt

SEQ ID NO: 4607880 - DNA, 14 bp, Homo sapiens
aagttgttgcattc

SEQ ID NO: 4607881 - DNA, 12 bp, Homo sapiens
aagtttaaatac

SEQ ID NO: 4607882 - DNA, 14 bp, Homo sapiens
aagtttaaatacca

SEQ ID NO: 4607883 - DNA, 16 bp, Homo sapiens
aagtttaacaagtatt

SEQ ID NO: 4607884 - DNA, 15 bp, Homo sapiens
aagtttaggtcgagg

SEQ ID NO: 4607885 - DNA, 15 bp, Homo sapiens
aagtttgatttttgt

SEQ ID NO: 4607886 - DNA, 13 bp, Homo sapiens
aagtttgtagcca

SEQ ID NO: 4607887 - DNA, 16 bp, Homo sapiens
aagttttcaaatttgt

SEQ ID NO: 4607888 - DNA, 16 bp, Homo sapiens
aataaaagtgaccttt

SEQ ID NO: 4607889 - DNA, 22 bp, Homo sapiens
aataaaatatcataaagcattt

SEQ ID NO: 4607890 - DNA, 13 bp, Homo sapiens
aataaaatgaaaa

SEQ ID NO: 4607891 - DNA, 19 bp, Homo sapiens
aataaaatgaaaattgtat

SEQ ID NO: 4607892 - DNA, 18 bp, Homo sapiens
aataaaggataactctgt

SEQ ID NO: 4607893 - DNA, 9 bp, Homo sapiens
aataaagtt

SEQ ID NO: 4607894 - DNA, 21 bp, Homo sapiens
aataaatgtttcccccactcc

SEQ ID NO: 4607895 - DNA, 16 bp, Homo sapiens
aataacaagtcgatga

SEQ ID NO: 4607896 - DNA, 12 bp, Homo sapiens
aataacccagtt

SEQ ID NO: 4607897 - DNA, 20 bp, Homo sapiens
aataactggaacaaattatt

SEQ ID NO: 4607898 - DNA, 21 bp, Homo sapiens
aataactggaacaaattattt

SEQ ID NO: 4607899 - DNA, 21 bp, Homo sapiens
aataaggcaggcattgaggaa

SEQ ID NO: 4607900 - DNA, 15 bp, Homo sapiens
aataagtttttgcta

SEQ ID NO: 4607901 - DNA, 14 bp, Homo sapiens
aataatatcaaata

SEQ ID NO: 4607902 - DNA, 11 bp, Homo sapiens
aataatgctgc

SEQ ID NO: 4607903 - DNA, 12 bp, Homo sapiens
aataatgctgca

SEQ ID NO: 4607904 - DNA, 19 bp, Homo sapiens
aataatggcactgaccggt

SEQ ID NO: 4607905 - DNA, 19 bp, Homo sapiens
aataattcatattcttcat

SEQ ID NO: 4607906 - DNA, 13 bp, Homo sapiens
aataattgtatct

SEQ ID NO: 4607907 - DNA, 20 bp, Homo sapiens
aataatttcctggtgtgaag

SEQ ID NO: 4607908 - DNA, 21 bp, Homo sapiens
aataatttcctggtgtgaagg

SEQ ID NO: 4607909 - DNA, 15 bp, Homo sapiens
aatacaatcacatta

SEQ ID NO: 4607910 - DNA, 16 bp, Homo sapiens
aatacacgtttatctt

SEQ ID NO: 4607911 - DNA, 20 bp, Homo sapiens
aatacatgcaacagaagtga

SEQ ID NO: 4607912 - DNA, 19 bp, Homo sapiens
aatacattaacggtgctaa

SEQ ID NO: 4607913 - DNA, 17 bp, Homo sapiens
aatacatttgtaagtgt

SEQ ID NO: 4607914 - DNA, 12 bp, Homo sapiens
aatacattttaa

SEQ ID NO: 4607915 - DNA, 12 bp, Homo sapiens
aatacattttat

SEQ ID NO: 4607916 - DNA, 14 bp, Homo sapiens
aataccagtacttg

SEQ ID NO: 4607917 - DNA, 15 bp, Homo sapiens
aatacctctgtgtgc

SEQ ID NO: 4607918 - DNA, 12 bp, Homo sapiens
aatacctttaaa

SEQ ID NO: 4607919 - DNA, 13 bp, Homo sapiens
aatacctttaaat

SEQ ID NO: 4607920 - DNA, 14 bp, Homo sapiens
aatacctttaaata

SEQ ID NO: 4607921 - DNA, 23 bp, Homo sapiens
aatactgcacactgcacatttgc

SEQ ID NO: 4607922 - DNA, 15 bp, Homo sapiens
aatactgttttaaaa

SEQ ID NO: 4607923 - DNA, 20 bp, Homo sapiens
aatactgttttaaaatgtga

SEQ ID NO: 4607924 - DNA, 11 bp, Homo sapiens
aatacttattt

SEQ ID NO: 4607925 - DNA, 16 bp, Homo sapiens
aatagagcaaaatcaa

SEQ ID NO: 4607926 - DNA, 12 bp, Homo sapiens
aatagagtactt

SEQ ID NO: 4607927 - DNA, 13 bp, Homo sapiens
aatagagtactta

SEQ ID NO: 4607928 - DNA, 16 bp, Homo sapiens
aatagctaagcatctc

SEQ ID NO: 4607929 - DNA, 18 bp, Homo sapiens
aatagctaataatgttaa

SEQ ID NO: 4607930 - DNA, 20 bp, Homo sapiens
aatagtgtcatataaactca

SEQ ID NO: 4607931 - DNA, 15 bp, Homo sapiens
aatagttactccagt

SEQ ID NO: 4607932 - DNA, 18 bp, Homo sapiens
aatagttactccagtgcc

SEQ ID NO: 4607933 - DNA, 19 bp, Homo sapiens
aatagttagatctaccctg

SEQ ID NO: 4607934 - DNA, 18 bp, Homo sapiens
aatagttcaggagacttt

SEQ ID NO: 4607935 - DNA, 19 bp, Homo sapiens
aatagttcttagctttgaa

SEQ ID NO: 4607936 - DNA, 15 bp, Homo sapiens
aatagttgtctgtgc

SEQ ID NO: 4607937 - DNA, 12 bp, Homo sapiens
aatataaagctt

SEQ ID NO: 4607938 - DNA, 19 bp, Homo sapiens
aatataaattgtacatttt

SEQ ID NO: 4607939 - DNA, 22 bp, Homo sapiens
aagcctttaaattgttcctctt

SEQ ID NO: 4607940 - DNA, 16 bp, Homo sapiens
aagcgaacatcttcat

SEQ ID NO: 4607941 - DNA, 19 bp, Homo sapiens
aagcgaacatcttcatata

SEQ ID NO: 4607942 - DNA, 16 bp, Homo sapiens
aagcgttaagggcaga

SEQ ID NO: 4607943 - DNA, 14 bp, Homo sapiens
aagctaaatcatat

SEQ ID NO: 4607944 - DNA, 16 bp, Homo sapiens
aagctagactgtgtct

SEQ ID NO: 4607945 - DNA, 17 bp, Homo sapiens
aagctagactgtgtctg

SEQ ID NO: 4607946 - DNA, 15 bp, Homo sapiens
aagctatggtgagat

SEQ ID NO: 4607947 - DNA, 18 bp, Homo sapiens
aagctatggtgagatgca

SEQ ID NO: 4607948 - DNA, 21 bp, Homo sapiens
aagctatggtgagatgcagct

SEQ ID NO: 4607949 - DNA, 22 bp, Homo sapiens
aagctatggtgagatgcagctg

SEQ ID NO: 4607950 - DNA, 15 bp, Homo sapiens
aagctcatgtcatta

SEQ ID NO: 4607951 - DNA, 18 bp, Homo sapiens
aagctcttcccttgctca

SEQ ID NO: 4607952 - DNA, 17 bp, Homo sapiens
aagctgacgaacttcca

SEQ ID NO: 4607953 - DNA, 22 bp, Homo sapiens
aagctgacgaacttccatggcc

SEQ ID NO: 4607954 - DNA, 20 bp, Homo sapiens
aagctgcgggggcaggccgg

SEQ ID NO: 4607955 - DNA, 13 bp, Homo sapiens
aagctggtgctac

SEQ ID NO: 4607956 - DNA, 14 bp, Homo sapiens
aagctgtccctgca

SEQ ID NO: 4607957 - DNA, 13 bp, Homo sapiens
aagctgtgagaca

SEQ ID NO: 4607958 - DNA, 22 bp, Homo sapiens
aagctgtgagacagtgggaaat

SEQ ID NO: 4607959 - DNA, 10 bp, Homo sapiens
aagctgtgca

SEQ ID NO: 4607960 - DNA, 16 bp, Homo sapiens
aagcttaataaaaaca

SEQ ID NO: 4607961 - DNA, 16 bp, Homo sapiens
aagcttggaggagggt

SEQ ID NO: 4607962 - DNA, 20 bp, Homo sapiens
aagcttggcttcctcttctt

SEQ ID NO: 4607963 - DNA, 20 bp, Homo sapiens
aagcttgtaaatatggggat

SEQ ID NO: 4607964 - DNA, 21 bp, Homo sapiens
aagctttatttatagaaatga

SEQ ID NO: 4607965 - DNA, 16 bp, Homo sapiens
aagctttcctgtttcc

SEQ ID NO: 4607966 - DNA, 16 bp, Homo sapiens
aaggaaaagcaagaaa

SEQ ID NO: 4607967 - DNA, 19 bp, Homo sapiens
aaggaaaagcaagaaacag

SEQ ID NO: 4607968 - DNA, 21 bp, Homo sapiens
aaggaaacttctgatgtttat

SEQ ID NO: 4607969 - DNA, 21 bp, Homo sapiens
aaggaacagttgcatttagct

SEQ ID NO: 4607970 - DNA, 15 bp, Homo sapiens
aaggaaccgcccagt

SEQ ID NO: 4607971 - DNA, 14 bp, Homo sapiens
aaggaaggagggca

SEQ ID NO: 4607972 - DNA, 21 bp, Homo sapiens
aaggaaggggctatcctggga

SEQ ID NO: 4607973 - DNA, 14 bp, Homo sapiens
aaggaatataagaa

SEQ ID NO: 4607974 - DNA, 15 bp, Homo sapiens
aaggacaggaccctc

SEQ ID NO: 4607975 - DNA, 13 bp, Homo sapiens
aaggacataaaat

SEQ ID NO: 4607976 - DNA, 19 bp, Homo sapiens
aaggacatgagatcagggc

SEQ ID NO: 4607977 - DNA, 22 bp, Homo sapiens
aaggactgagggcagtgccctt

SEQ ID NO: 4607978 - DNA, 14 bp, Homo sapiens
aaggactgtgcttt

SEQ ID NO: 4607979 - DNA, 15 bp, Homo sapiens
aaggagaaggctgga

SEQ ID NO: 4607980 - DNA, 17 bp, Homo sapiens
aaggagaaggctggaga

SEQ ID NO: 4607981 - DNA, 21 bp, Homo sapiens
aaggagcctaggccaggtgca

SEQ ID NO: 4607982 - DNA, 10 bp, Homo sapiens
aaggagcctg

SEQ ID NO: 4607983 - DNA, 18 bp, Homo sapiens
aaggaggaccagtcagga

SEQ ID NO: 4607984 - DNA, 18 bp, Homo sapiens
aaggagtaatctgtgtac

SEQ ID NO: 4607985 - DNA, 19 bp, Homo sapiens
aaggagtaatctgtgtaca

SEQ ID NO: 4607986 - DNA, 12 bp, Homo sapiens
aaggcacagcta

SEQ ID NO: 4607987 - DNA, 12 bp, Homo sapiens
aaggcacagtgg

SEQ ID NO: 4607988 - DNA, 21 bp, Homo sapiens
aaggcagaagcttggaggagg

SEQ ID NO: 4607989 - DNA, 16 bp, Homo sapiens
aaggcagcaaggcccg

SEQ ID NO: 4607990 - DNA, 15 bp, Homo sapiens
aaggcattgattgca

SEQ ID NO: 4607991 - DNA, 16 bp, Homo sapiens
aaggccaaacctctgt

SEQ ID NO: 4607992 - DNA, 17 bp, Homo sapiens
aaggccagacctgcaga

SEQ ID NO: 4607993 - DNA, 20 bp, Homo sapiens
aaggccagacctgcagacgc

SEQ ID NO: 4607994 - DNA, 14 bp, Homo sapiens
aaggcccgagcagc

SEQ ID NO: 4607995 - DNA, 16 bp, Homo sapiens
aaggcccgagcagctg

SEQ ID NO: 4607996 - DNA, 20 bp, Homo sapiens
aaggcccgagcagctgagca

SEQ ID NO: 4607997 - DNA, 19 bp, Homo sapiens
aaggccctgcatctgtctg

SEQ ID NO: 4607998 - DNA, 15 bp, Homo sapiens
aaggcctcgcaggaa

SEQ ID NO: 4607999 - DNA, 17 bp, Homo sapiens
aaggcctcgcaggaaga

SEQ ID NO: 4608000 - DNA, 13 bp, Homo sapiens
aaggcctcttgta

SEQ ID NO: 4608001 - DNA, 21 bp, Homo sapiens
aaggcctcttgtaaagactgg

SEQ ID NO: 4608002 - DNA, 11 bp, Homo sapiens
aaggcctgagc

SEQ ID NO: 4608003 - DNA, 14 bp, Homo sapiens
aaggcctgagcccc

SEQ ID NO: 4608004 - DNA, 11 bp, Homo sapiens
aaggcctgggg

SEQ ID NO: 4608005 - DNA, 15 bp, Homo sapiens
aaggcctggtctggg

SEQ ID NO: 4608006 - DNA, 17 bp, Homo sapiens
aaggccttcagacacat

SEQ ID NO: 4608007 - DNA, 21 bp, Homo sapiens
aaggccttcagtttatttcca

SEQ ID NO: 4608008 - DNA, 22 bp, Homo sapiens
aaggcgtagcatcatcctgcag

SEQ ID NO: 4608009 - DNA, 20 bp, Homo sapiens
aaggctacttcggggctggg

SEQ ID NO: 4608010 - DNA, 14 bp, Homo sapiens
aaggctggctgtgt

SEQ ID NO: 4608011 - DNA, 13 bp, Homo sapiens
aaggctgttgcat

SEQ ID NO: 4608012 - DNA, 23 bp, Homo sapiens
aaggctgttgcatgggctaatga

SEQ ID NO: 4608013 - DNA, 14 bp, Homo sapiens
aaggcttctctctc

SEQ ID NO: 4608014 - DNA, 15 bp, Homo sapiens
aaggcttctctctca

SEQ ID NO: 4608015 - DNA, 16 bp, Homo sapiens
aagggacccacctgct

SEQ ID NO: 4608016 - DNA, 13 bp, Homo sapiens
aagggaccccccc

SEQ ID NO: 4608017 - DNA, 15 bp, Homo sapiens
aagggaggaacacta

SEQ ID NO: 4608018 - DNA, 18 bp, Homo sapiens
aagggagggctctgaggc

SEQ ID NO: 4608019 - DNA, 19 bp, Homo sapiens
aagggagggctctgaggcg

SEQ ID NO: 4608020 - DNA, 13 bp, Homo sapiens
aagggatcctgcc

SEQ ID NO: 4608021 - DNA, 16 bp, Homo sapiens
aagggatcctgcctgc

SEQ ID NO: 4608022 - DNA, 18 bp, Homo sapiens
aagggcacttaatttgta

SEQ ID NO: 4608023 - DNA, 21 bp, Homo sapiens
aagggcacttaatttgtaaac

SEQ ID NO: 4608024 - DNA, 22 bp, Homo sapiens
aagggcagggcccacgtgtata

SEQ ID NO: 4608025 - DNA, 16 bp, Homo sapiens
aagggccctggcaccc

SEQ ID NO: 4608026 - DNA, 22 bp, Homo sapiens
aaggggcagcagttgaggtggg

SEQ ID NO: 4608027 - DNA, 19 bp, Homo sapiens
aaggggctagggaggacca

SEQ ID NO: 4608028 - DNA, 20 bp, Homo sapiens
aaggggctatcctgggacct

SEQ ID NO: 4608029 - DNA, 14 bp, Homo sapiens
aagggggccctgct

SEQ ID NO: 4608030 - DNA, 15 bp, Homo sapiens
aagggggccctgcta

SEQ ID NO: 4608031 - DNA, 16 bp, Homo sapiens
aagggggctctgcccc

SEQ ID NO: 4608032 - DNA, 18 bp, Homo sapiens
aaggggtcccatcagtga

SEQ ID NO: 4608033 - DNA, 20 bp, Homo sapiens
aaggtcctctgtcagtcaca

SEQ ID NO: 4608034 - DNA, 14 bp, Homo sapiens
aaggtttcaacaaa

SEQ ID NO: 4608035 - DNA, 17 bp, Homo sapiens
aaggtttttaaaagtaa

SEQ ID NO: 4608036 - DNA, 20 bp, Homo sapiens
aagtaaacctagtaaaacct

SEQ ID NO: 4608037 - DNA, 16 bp, Homo sapiens
aagtaacatgcatact

SEQ ID NO: 4608038 - DNA, 18 bp, Homo sapiens
aagtaacatgcatacttt

SEQ ID NO: 4608039 - DNA, 22 bp, Homo sapiens
aagtaacatgcatactttattg

SEQ ID NO: 4608040 - DNA, 13 bp, Homo sapiens
aagtaatgaagaa

SEQ ID NO: 4608041 - DNA, 16 bp, Homo sapiens
aagtaatgaagaatca

SEQ ID NO: 4608042 - DNA, 22 bp, Homo sapiens
aagtaatggaggtcccagccct

SEQ ID NO: 4608043 - DNA, 14 bp, Homo sapiens
aagtaattttgtca

SEQ ID NO: 4608044 - DNA, 17 bp, Homo sapiens
aagtaattttgtcacat

SEQ ID NO: 4608045 - DNA, 22 bp, Homo sapiens
aagtaattttgtcacattattt

SEQ ID NO: 4608046 - DNA, 17 bp, Homo sapiens
aagtacaaatgaagaaa

SEQ ID NO: 4608047 - DNA, 21 bp, Homo sapiens
aagtacaataattcatattct

SEQ ID NO: 4608048 - DNA, 21 bp, Homo sapiens
aagtacatatttattttcttt

SEQ ID NO: 4608049 - DNA, 18 bp, Homo sapiens
aagtactacacattttta

SEQ ID NO: 4608050 - DNA, 15 bp, Homo sapiens
aagtagcagtgtgaa

SEQ ID NO: 4608051 - DNA, 21 bp, Homo sapiens
aatataagaaaagtaatgaag

SEQ ID NO: 4608052 - DNA, 19 bp, Homo sapiens
aatataaggactttttgat

SEQ ID NO: 4608053 - DNA, 17 bp, Homo sapiens
aatatacattttctaaa

SEQ ID NO: 4608054 - DNA, 19 bp, Homo sapiens
aatatacattttctaaata

SEQ ID NO: 4608055 - DNA, 21 bp, Homo sapiens
aatatacattttctaaataaa

SEQ ID NO: 4608056 - DNA, 11 bp, Homo sapiens
aatatactcag

SEQ ID NO: 4608057 - DNA, 16 bp, Homo sapiens
aatatactcagggatt

SEQ ID NO: 4608058 - DNA, 19 bp, Homo sapiens
aatatagacattctcacat

SEQ ID NO: 4608059 - DNA, 20 bp, Homo sapiens
aatatagacattctcacata

SEQ ID NO: 4608060 - DNA, 15 bp, Homo sapiens
aatatagctgagact

SEQ ID NO: 4608061 - DNA, 15 bp, Homo sapiens
aatatatacattttt

SEQ ID NO: 4608062 - DNA, 13 bp, Homo sapiens
aatatatatatat

SEQ ID NO: 4608063 - DNA, 19 bp, Homo sapiens
aatatatattatatacata

SEQ ID NO: 4608064 - DNA, 14 bp, Homo sapiens
aatatatctctatt

SEQ ID NO: 4608065 - DNA, 14 bp, Homo sapiens
aatatcaaagcatt

SEQ ID NO: 4608066 - DNA, 15 bp, Homo sapiens
aatatcaaagcattt

SEQ ID NO: 4608067 - DNA, 17 bp, Homo sapiens
aatatcaaagcatttta

SEQ ID NO: 4608068 - DNA, 17 bp, Homo sapiens
aatatcactgtaatgag

SEQ ID NO: 4608069 - DNA, 16 bp, Homo sapiens
aatatcataaagcatt

SEQ ID NO: 4608070 - DNA, 21 bp, Homo sapiens
aatatcattctttgtatctta

SEQ ID NO: 4608071 - DNA, 13 bp, Homo sapiens
aatatcattgatt

SEQ ID NO: 4608072 - DNA, 14 bp, Homo sapiens
aatatgaatctata

SEQ ID NO: 4608073 - DNA, 12 bp, Homo sapiens
aatatgaatgcc

SEQ ID NO: 4608074 - DNA, 13 bp, Homo sapiens
aatatgacagata

SEQ ID NO: 4608075 - DNA, 16 bp, Homo sapiens
aatatgagtacaaatg

SEQ ID NO: 4608076 - DNA, 21 bp, Homo sapiens
aatatgagtacaaatgcctta

SEQ ID NO: 4608077 - DNA, 23 bp, Homo sapiens
aatatggaaatcttttacatttt

SEQ ID NO: 4608078 - DNA, 21 bp, Homo sapiens
aatatggggatagtctgggtc

SEQ ID NO: 4608079 - DNA, 22 bp, Homo sapiens
aatatgtaatttcaaaatacat

SEQ ID NO: 4608080 - DNA, 15 bp, Homo sapiens
aatatgtttaaaata

SEQ ID NO: 4608081 - DNA, 23 bp, Homo sapiens
aatatgtttagttttacatttta

SEQ ID NO: 4608082 - DNA, 15 bp, Homo sapiens
aatattaccatctta

SEQ ID NO: 4608083 - DNA, 20 bp, Homo sapiens
aatattaccatcttaatctt

SEQ ID NO: 4608084 - DNA, 22 bp, Homo sapiens
aatattaccatcttaatcttta

SEQ ID NO: 4608085 - DNA, 21 bp, Homo sapiens
aatattgtaatatgacagata

SEQ ID NO: 4608086 - DNA, 14 bp, Homo sapiens
aatattgtttctgc

SEQ ID NO: 4608087 - DNA, 23 bp, Homo sapiens
aatattgtttctgcattcatttt

SEQ ID NO: 4608088 - DNA, 19 bp, Homo sapiens
aatatttactaactaaata

SEQ ID NO: 4608089 - DNA, 13 bp, Homo sapiens
aatatttactctt

SEQ ID NO: 4608090 - DNA, 11 bp, Homo sapiens
aatatttgaat

SEQ ID NO: 4608091 - DNA, 13 bp, Homo sapiens
aatattttctatt

SEQ ID NO: 4608092 - DNA, 23 bp, Homo sapiens
aatattttctctgtacttttcat

SEQ ID NO: 4608093 - DNA, 11 bp, Homo sapiens
aatattttgat

SEQ ID NO: 4608094 - DNA, 18 bp, Homo sapiens
aatattttgatgcagata

SEQ ID NO: 4608095 - DNA, 10 bp, Homo sapiens
aatattttgg

SEQ ID NO: 4608096 - DNA, 21 bp, Homo sapiens
aatattttgtatattatgttt

SEQ ID NO: 4608097 - DNA, 16 bp, Homo sapiens
aatattttgttcttat

SEQ ID NO: 4608098 - DNA, 15 bp, Homo sapiens
aatatttttatatca

SEQ ID NO: 4608099 - DNA, 17 bp, Homo sapiens
aatcaaagccagggtct

SEQ ID NO: 4608100 - DNA, 14 bp, Homo sapiens
aatcaactctcttc

SEQ ID NO: 4608101 - DNA, 21 bp, Homo sapiens
aatcaatctgcagtttaacaa

SEQ ID NO: 4608102 - DNA, 15 bp, Homo sapiens
aatcacagaaaattt

SEQ ID NO: 4608103 - DNA, 16 bp, Homo sapiens
aatcacagaaaattta

SEQ ID NO: 4608104 - DNA, 19 bp, Homo sapiens
aatcacattaacattttga

SEQ ID NO: 4608105 - DNA, 14 bp, Homo sapiens
aatcagaaaagtaa

SEQ ID NO: 4608106 - DNA, 22 bp, Homo sapiens
aatcagaaaagtaattttgtca

SEQ ID NO: 4608107 - DNA, 19 bp, Homo sapiens
aatcagagtgtacaaattg

SEQ ID NO: 4608108 - DNA, 13 bp, Homo sapiens
aatcaggcaagga

SEQ ID NO: 4608109 - DNA, 16 bp, Homo sapiens
aatcaggcaaggagga

SEQ ID NO: 4608110 - DNA, 15 bp, Homo sapiens
aatcagtaggaccag

SEQ ID NO: 4608111 - DNA, 13 bp, Homo sapiens
aatcagtttttca

SEQ ID NO: 4608112 - DNA, 13 bp, Homo sapiens
aatcatacaaact

SEQ ID NO: 4608113 - DNA, 21 bp, Homo sapiens
aatcatacaaactctcaccat

SEQ ID NO: 4608114 - DNA, 15 bp, Homo sapiens
aatcatacttaacat

SEQ ID NO: 4608115 - DNA, 22 bp, Homo sapiens
aatcatcaaaaagtaattataa

SEQ ID NO: 4608116 - DNA, 12 bp, Homo sapiens
aatcatgtctgt

SEQ ID NO: 4608117 - DNA, 13 bp, Homo sapiens
aatcatgtctgta

SEQ ID NO: 4608118 - DNA, 15 bp, Homo sapiens
aatcatgtctgtatc

SEQ ID NO: 4608119 - DNA, 23 bp, Homo sapiens
aatcattgaagtatattcttatt

SEQ ID NO: 4608120 - DNA, 14 bp, Homo sapiens
aatcattgttgcct

SEQ ID NO: 4608121 - DNA, 14 bp, Homo sapiens
aatcatttgtttac

SEQ ID NO: 4608122 - DNA, 20 bp, Homo sapiens
aatccagtttgtgtttttct

SEQ ID NO: 4608123 - DNA, 20 bp, Homo sapiens
aatccatgtgattaatgttt

SEQ ID NO: 4608124 - DNA, 15 bp, Homo sapiens
aatcccaatgtttga

SEQ ID NO: 4608125 - DNA, 17 bp, Homo sapiens
aatcccacccacatgtg

SEQ ID NO: 4608126 - DNA, 17 bp, Homo sapiens
aatcccagtactttgga

SEQ ID NO: 4608127 - DNA, 17 bp, Homo sapiens
aatccctgggcattgct

SEQ ID NO: 4608128 - DNA, 22 bp, Homo sapiens
aatccctgtaatatttagctgt

SEQ ID NO: 4608129 - DNA, 17 bp, Homo sapiens
aatcccttttatctatt

SEQ ID NO: 4608130 - DNA, 20 bp, Homo sapiens
aatccgaacctcctctgtga

SEQ ID NO: 4608131 - DNA, 22 bp, Homo sapiens
aatcctatatagaatgctgcac

SEQ ID NO: 4608132 - DNA, 20 bp, Homo sapiens
aatcctatgtgattttaact

SEQ ID NO: 4608133 - DNA, 21 bp, Homo sapiens
aatcctatgtgattttaactc

SEQ ID NO: 4608134 - DNA, 13 bp, Homo sapiens
aatcctccccgct

SEQ ID NO: 4608135 - DNA, 21 bp, Homo sapiens
aatcctcctgagtagctggga

SEQ ID NO: 4608136 - DNA, 20 bp, Homo sapiens
aatcctctgttaatgtggac

SEQ ID NO: 4608137 - DNA, 19 bp, Homo sapiens
aatccttctattctagcct

SEQ ID NO: 4608138 - DNA, 22 bp, Homo sapiens
aatccttctattctagcctgca

SEQ ID NO: 4608139 - DNA, 13 bp, Homo sapiens
aatcggactgcca

SEQ ID NO: 4608140 - DNA, 14 bp, Homo sapiens
aatcggactgccaa

SEQ ID NO: 4608141 - DNA, 16 bp, Homo sapiens
aatcggactgccaaat

SEQ ID NO: 4608142 - DNA, 20 bp, Homo sapiens
aatctaaatgattatcttga

SEQ ID NO: 4608143 - DNA, 20 bp, Homo sapiens
aatctagtgggttgaccttt

SEQ ID NO: 4608144 - DNA, 20 bp, Homo sapiens
aatctataagtagtaaatca

SEQ ID NO: 4608145 - DNA, 18 bp, Homo sapiens
aatctatggcttatttct

SEQ ID NO: 4608146 - DNA, 20 bp, Homo sapiens
aatctatggcttatttctat

SEQ ID NO: 4608147 - DNA, 22 bp, Homo sapiens
aatctatggcttatttctatga

SEQ ID NO: 4608148 - DNA, 17 bp, Homo sapiens
aatctattgtttctcct

SEQ ID NO: 4608149 - DNA, 19 bp, Homo sapiens
aatctctcaaatctgttat

SEQ ID NO: 4608150 - DNA, 13 bp, Homo sapiens
aatctctgcctcc

SEQ ID NO: 4608151 - DNA, 12 bp, Homo sapiens
aatctgcttttc

SEQ ID NO: 4608152 - DNA, 18 bp, Homo sapiens
aatctgcttttcctctgc

SEQ ID NO: 4608153 - DNA, 19 bp, Homo sapiens
aatctgcttttcctctgcc

SEQ ID NO: 4608154 - DNA, 21 bp, Homo sapiens
aatctgtaacaggtattttgt

SEQ ID NO: 4608155 - DNA, 13 bp, Homo sapiens
aatctgtgtacaa

SEQ ID NO: 4608156 - DNA, 20 bp, Homo sapiens
aatctgtgtacaaagaaata

SEQ ID NO: 4608157 - DNA, 12 bp, Homo sapiens
aatcttatacaa

SEQ ID NO: 4608158 - DNA, 18 bp, Homo sapiens
aatcttgatcattccggt

SEQ ID NO: 4608159 - DNA, 13 bp, Homo sapiens
aatcttgctttct

SEQ ID NO: 4608160 - DNA, 21 bp, Homo sapiens
aatcttgctttctttagaatt

SEQ ID NO: 4608161 - DNA, 12 bp, Homo sapiens
aatcttgtgtta

SEQ ID NO: 4608162 - DNA, 18 bp, Homo sapiens
aatgaaaaatataatgtt

SEQ ID NO: 4608163 - DNA, 22 bp, Homo sapiens
aatgaaaataaaacacacctcg

SEQ ID NO: 4608164 - DNA, 17 bp, Homo sapiens
aatgaaaattgtattat

SEQ ID NO: 4608165 - DNA, 15 bp, Homo sapiens
aatgaaagtgttaat

SEQ ID NO: 4608166 - DNA, 22 bp, Homo sapiens
aatgaaattaacacaaaggaag

SEQ ID NO: 4608167 - DNA, 13 bp, Homo sapiens
aatgaacatctct

SEQ ID NO: 4608168 - DNA, 22 bp, Homo sapiens
aatgaacccccatgatgtaagt

SEQ ID NO: 4608169 - DNA, 23 bp, Homo sapiens
aatgaagaaagtcaaaaaattat

SEQ ID NO: 4608170 - DNA, 17 bp, Homo sapiens
aatgacccttttgtgtc

SEQ ID NO: 4608171 - DNA, 15 bp, Homo sapiens
aatgactatataatt

SEQ ID NO: 4608172 - DNA, 15 bp, Homo sapiens
aatgacttagaaact

SEQ ID NO: 4608173 - DNA, 16 bp, Homo sapiens
aatgacttagaaactg

SEQ ID NO: 4608174 - DNA, 19 bp, Homo sapiens
aatgacttctaatttatat

SEQ ID NO: 4608175 - DNA, 18 bp, Homo sapiens
aatgagagcgacacagac

SEQ ID NO: 4608176 - DNA, 19 bp, Homo sapiens
aatgagagcgacacagacg

SEQ ID NO: 4608177 - DNA, 13 bp, Homo sapiens
aatgagcccagag

SEQ ID NO: 4608178 - DNA, 21 bp, Homo sapiens
aatgagtgaagtattgctgaa

SEQ ID NO: 4608179 - DNA, 13 bp, Homo sapiens
aatgagtgtgcat

SEQ ID NO: 4608180 - DNA, 18 bp, Homo sapiens
aatgatagataatgcctt

SEQ ID NO: 4608181 - DNA, 16 bp, Homo sapiens
aatgatccccagctgt

SEQ ID NO: 4608182 - DNA, 23 bp, Homo sapiens
aatgattttggaactgtgtttca

SEQ ID NO: 4608183 - DNA, 16 bp, Homo sapiens
aatgcaaatcctatgt

SEQ ID NO: 4608184 - DNA, 13 bp, Homo sapiens
aatgcaaattaaa

SEQ ID NO: 4608185 - DNA, 21 bp, Homo sapiens
aatgcaaattaaaacatattt

SEQ ID NO: 4608186 - DNA, 18 bp, Homo sapiens
aatgcacgtttcaaagct

SEQ ID NO: 4608187 - DNA, 13 bp, Homo sapiens
aatgcactgtttt

SEQ ID NO: 4608188 - DNA, 21 bp, Homo sapiens
aatgcagaaccacaaacaatt

SEQ ID NO: 4608189 - DNA, 17 bp, Homo sapiens
aatgccaccacacgtgt

SEQ ID NO: 4608190 - DNA, 15 bp, Homo sapiens
aatgcccccagctgg

SEQ ID NO: 4608191 - DNA, 17 bp, Homo sapiens
aatgcccccagctggcc

SEQ ID NO: 4608192 - DNA, 18 bp, Homo sapiens
aatgcccccagctggccc

SEQ ID NO: 4608193 - DNA, 15 bp, Homo sapiens
aatgcctcctgtggg

SEQ ID NO: 4608194 - DNA, 16 bp, Homo sapiens
aatgcctcgctccctt

SEQ ID NO: 4608195 - DNA, 12 bp, Homo sapiens
aatgcctgccca

SEQ ID NO: 4608196 - DNA, 16 bp, Homo sapiens
aatgctacaaaaattg

SEQ ID NO: 4608197 - DNA, 21 bp, Homo sapiens
aatgctatcagaaatagattt

SEQ ID NO: 4608198 - DNA, 16 bp, Homo sapiens
aatgctatttgaacaa

SEQ ID NO: 4608199 - DNA, 14 bp, Homo sapiens
aatgctctatgttt

SEQ ID NO: 4608200 - DNA, 17 bp, Homo sapiens
aatgctggactggaggc

SEQ ID NO: 4608201 - DNA, 12 bp, Homo sapiens
aatgctgggctg

SEQ ID NO: 4608202 - DNA, 22 bp, Homo sapiens
aatgctgtttctaagaaaatgt

SEQ ID NO: 4608203 - DNA, 15 bp, Homo sapiens
aatgcttattgatga

SEQ ID NO: 4608204 - DNA, 17 bp, Homo sapiens
aatgcttccgagacacc

SEQ ID NO: 4608205 - DNA, 17 bp, Homo sapiens
aatggaaattttgctat

SEQ ID NO: 4608206 - DNA, 17 bp, Homo sapiens
aatggaggagccaggcc

SEQ ID NO: 4608207 - DNA, 18 bp, Homo sapiens
aatggaggagccaggccc

SEQ ID NO: 4608208 - DNA, 14 bp, Homo sapiens
aatggaggtcccag

SEQ ID NO: 4608209 - DNA, 13 bp, Homo sapiens
aatggcatttctc

SEQ ID NO: 4608210 - DNA, 14 bp, Homo sapiens
aatggccaggggcc

SEQ ID NO: 4608211 - DNA, 16 bp, Homo sapiens
aatggccggctggaaa

SEQ ID NO: 4608212 - DNA, 23 bp, Homo sapiens
aatgggatggtcggatctcacag

SEQ ID NO: 4608213 - DNA, 14 bp, Homo sapiens
aatggggtgagctc

SEQ ID NO: 4608214 - DNA, 19 bp, Homo sapiens
aatggtatcctactgagca

SEQ ID NO: 4608215 - DNA, 13 bp, Homo sapiens
aatggtgggatta

SEQ ID NO: 4608216 - DNA, 23 bp, Homo sapiens
aatgtaaactaggattggagtat

SEQ ID NO: 4608217 - DNA, 21 bp, Homo sapiens
aatgtacactttttacagcag

SEQ ID NO: 4608218 - DNA, 16 bp, Homo sapiens
aatgtacagttgaaat

SEQ ID NO: 4608219 - DNA, 20 bp, Homo sapiens
aatgtactaggatactgctg

SEQ ID NO: 4608220 - DNA, 19 bp, Homo sapiens
aatgtagttatctattgaa

SEQ ID NO: 4608221 - DNA, 14 bp, Homo sapiens
aatgtatcttaaag

SEQ ID NO: 4608222 - DNA, 18 bp, Homo sapiens
aatgtatcttaaaggaca

SEQ ID NO: 4608223 - DNA, 19 bp, Homo sapiens
aatgtatgtaatgtgtggt

SEQ ID NO: 4608224 - DNA, 14 bp, Homo sapiens
aatgtcttgtgtat

SEQ ID NO: 4608225 - DNA, 21 bp, Homo sapiens
aatgtcttgtgtatttctctg

SEQ ID NO: 4608226 - DNA, 22 bp, Homo sapiens
aatgtcttgtgtatttctctgt

SEQ ID NO: 4608227 - DNA, 20 bp, Homo sapiens
aatgtgaactctcccctccc

SEQ ID NO: 4608228 - DNA, 15 bp, Homo sapiens
aatgtgaataatggc

SEQ ID NO: 4608229 - DNA, 21 bp, Homo sapiens
aatgtgatcatatgaggacct

SEQ ID NO: 4608230 - DNA, 19 bp, Homo sapiens
aatgtgctactgattgttt

SEQ ID NO: 4608231 - DNA, 15 bp, Homo sapiens
aatgtggtctcagga

SEQ ID NO: 4608232 - DNA, 18 bp, Homo sapiens
aatgtggttgcttaattc

SEQ ID NO: 4608233 - DNA, 16 bp, Homo sapiens
aatgtgtggtggcctc

SEQ ID NO: 4608234 - DNA, 19 bp, Homo sapiens
aatgtgtgtgtgtggcagg

SEQ ID NO: 4608235 - DNA, 13 bp, Homo sapiens
aatgtgtttcaaa

SEQ ID NO: 4608236 - DNA, 22 bp, Homo sapiens
aatgttcttatgcaaaatggaa

SEQ ID NO: 4608237 - DNA, 12 bp, Homo sapiens
aatgttgagaag

SEQ ID NO: 4608238 - DNA, 21 bp, Homo sapiens
aatgttgagaagcgtttttaa

SEQ ID NO: 4608239 - DNA, 16 bp, Homo sapiens
aatgttgtacttgaaa

SEQ ID NO: 4608240 - DNA, 18 bp, Homo sapiens
aatgtttaataaagcttt

SEQ ID NO: 4608241 - DNA, 19 bp, Homo sapiens
aatgtttaataaagcttta

SEQ ID NO: 4608242 - DNA, 20 bp, Homo sapiens
aatgtttactaagtggactg

SEQ ID NO: 4608243 - DNA, 15 bp, Homo sapiens
aatgtttcccccact

SEQ ID NO: 4608244 - DNA, 23 bp, Homo sapiens
aatgtttgtgggtatttcttggc

SEQ ID NO: 4608245 - DNA, 20 bp, Homo sapiens
aatgtttgtgtctgtggttg

SEQ ID NO: 4608246 - DNA, 13 bp, Homo sapiens
aatgttttcatta

SEQ ID NO: 4608247 - DNA, 21 bp, Homo sapiens
aattaaaacaaatatacattt

SEQ ID NO: 4608248 - DNA, 16 bp, Homo sapiens
aattaagcagaaacag

SEQ ID NO: 4608249 - DNA, 13 bp, Homo sapiens
aattaatgtttgt

SEQ ID NO: 4608250 - DNA, 19 bp, Homo sapiens
aattacaattttatctgtt

SEQ ID NO: 4608251 - DNA, 14 bp, Homo sapiens
aattaccttctatt

SEQ ID NO: 4608252 - DNA, 16 bp, Homo sapiens
aattacctttaatttt

SEQ ID NO: 4608253 - DNA, 20 bp, Homo sapiens
aattacctttaattttaatg

SEQ ID NO: 4608254 - DNA, 23 bp, Homo sapiens
aattagatgattatatattgttg

SEQ ID NO: 4608255 - DNA, 16 bp, Homo sapiens
aattagcatggcggca

SEQ ID NO: 4608256 - DNA, 18 bp, Homo sapiens
aattagtggtcataaaat

SEQ ID NO: 4608257 - DNA, 22 bp, Homo sapiens
aattagtgtgacagtttccaaa

SEQ ID NO: 4608258 - DNA, 23 bp, Homo sapiens
aattagtgtgacagtttccaaat

SEQ ID NO: 4608259 - DNA, 13 bp, Homo sapiens
aattataaatgtg

SEQ ID NO: 4608260 - DNA, 19 bp, Homo sapiens
aattatctgattaagcatt

SEQ ID NO: 4608261 - DNA, 16 bp, Homo sapiens
aattattgtagacatg

SEQ ID NO: 4608262 - DNA, 12 bp, Homo sapiens
aattatttgcta

SEQ ID NO: 4608263 - DNA, 23 bp, Homo sapiens
aattcaagtgcttaaaaatactt

SEQ ID NO: 4608264 - DNA, 13 bp, Homo sapiens
aattcacccactc

SEQ ID NO: 4608265 - DNA, 14 bp, Homo sapiens
aattcatactctgt

SEQ ID NO: 4608266 - DNA, 22 bp, Homo sapiens
aattcatactctgttgcctcct

SEQ ID NO: 4608267 - DNA, 23 bp, Homo sapiens
aattcatactctgttgcctcctc

SEQ ID NO: 4608268 - DNA, 13 bp, Homo sapiens
aattcatattctt

SEQ ID NO: 4608269 - DNA, 12 bp, Homo sapiens
aattcatttcta

SEQ ID NO: 4608270 - DNA, 16 bp, Homo sapiens
aattccaccagggcca

SEQ ID NO: 4608271 - DNA, 21 bp, Homo sapiens
aattccaccagggccagagca

SEQ ID NO: 4608272 - DNA, 21 bp, Homo sapiens
aattccttcgaaaggccttca

SEQ ID NO: 4608273 - DNA, 22 bp, Homo sapiens
aattccttcgaaaggccttcag

SEQ ID NO: 4608274 - DNA, 23 bp, Homo sapiens
aattccttcgaaaggccttcaga

SEQ ID NO: 4608275 - DNA, 14 bp, Homo sapiens
aattcgcatgttta

SEQ ID NO: 4608276 - DNA, 16 bp, Homo sapiens
aattctaccctggaaa

SEQ ID NO: 4608277 - DNA, 19 bp, Homo sapiens
aattctaccctggaaaagt

SEQ ID NO: 4608278 - DNA, 14 bp, Homo sapiens
aattctctttcaaa

SEQ ID NO: 4608279 - DNA, 22 bp, Homo sapiens
aattctgtcttgttcattttga

SEQ ID NO: 4608280 - DNA, 19 bp, Homo sapiens
aattcttcagcgtaaaatg

SEQ ID NO: 4608281 - DNA, 21 bp, Homo sapiens
aattcttcagcgtaaaatggt

SEQ ID NO: 4608282 - DNA, 13 bp, Homo sapiens
aattcttttctga

SEQ ID NO: 4608283 - DNA, 14 bp, Homo sapiens
aattcttttctgag

SEQ ID NO: 4608284 - DNA, 17 bp, Homo sapiens
aattgaaaaactcttta

SEQ ID NO: 4608285 - DNA, 14 bp, Homo sapiens
aattgacaaatgat

SEQ ID NO: 4608286 - DNA, 18 bp, Homo sapiens
aattgacagatcaagctg

SEQ ID NO: 4608287 - DNA, 21 bp, Homo sapiens
aattgatgtcggtcatagttt

SEQ ID NO: 4608288 - DNA, 14 bp, Homo sapiens
aattgcacatctaa

SEQ ID NO: 4608289 - DNA, 16 bp, Homo sapiens
aattgctacatctaaa

SEQ ID NO: 4608290 - DNA, 12 bp, Homo sapiens
aattgctctgtt

SEQ ID NO: 4608291 - DNA, 23 bp, Homo sapiens
aattgctctttcacaggtagcct

SEQ ID NO: 4608292 - DNA, 12 bp, Homo sapiens
aattggaatcaa

SEQ ID NO: 4608293 - DNA, 20 bp, Homo sapiens
aattggtgctatttgaagaa

SEQ ID NO: 4608294 - DNA, 20 bp, Homo sapiens
aattggttattaaactgaat

SEQ ID NO: 4608295 - DNA, 18 bp, Homo sapiens
aattgtaaatcctgtgtt

SEQ ID NO: 4608296 - DNA, 10 bp, Homo sapiens
aattgtaagt

SEQ ID NO: 4608297 - DNA, 18 bp, Homo sapiens
aattgtaagtgaaattaa

SEQ ID NO: 4608298 - DNA, 15 bp, Homo sapiens
aattgtacattttgt

SEQ ID NO: 4608299 - DNA, 14 bp, Homo sapiens
aattgttcctcttt

SEQ ID NO: 4608300 - DNA, 17 bp, Homo sapiens
aattgttttgcactttt

SEQ ID NO: 4608301 - DNA, 14 bp, Homo sapiens
aatttaaaaactta

SEQ ID NO: 4608302 - DNA, 21 bp, Homo sapiens
aatttaactagacacagataa

SEQ ID NO: 4608303 - DNA, 15 bp, Homo sapiens
aatttacaaaattta

SEQ ID NO: 4608304 - DNA, 15 bp, Homo sapiens
aatttactttacaca

SEQ ID NO: 4608305 - DNA, 14 bp, Homo sapiens
aatttactttgtag

SEQ ID NO: 4608306 - DNA, 18 bp, Homo sapiens
aatttactttgtagactg

SEQ ID NO: 4608307 - DNA, 23 bp, Homo sapiens
aatttattctcaggtaatcattt

SEQ ID NO: 4608308 - DNA, 11 bp, Homo sapiens
aatttcaaaat

SEQ ID NO: 4608309 - DNA, 23 bp, Homo sapiens
aatttcaaaatacatttgtaagt

SEQ ID NO: 4608310 - DNA, 15 bp, Homo sapiens
aatttcaaaatttaa

SEQ ID NO: 4608311 - DNA, 12 bp, Homo sapiens
aatttcaggaaa

SEQ ID NO: 4608312 - DNA, 22 bp, Homo sapiens
aatttctataaatttaagaaaa

SEQ ID NO: 4608313 - DNA, 14 bp, Homo sapiens
aatttctcatcaca

SEQ ID NO: 4608314 - DNA, 17 bp, Homo sapiens
aatttgaataagcagaa

SEQ ID NO: 4608315 - DNA, 18 bp, Homo sapiens
aatttgatcgttccagtt

SEQ ID NO: 4608316 - DNA, 20 bp, Homo sapiens
aatttggtcttagctttaca

SEQ ID NO: 4608317 - DNA, 22 bp, Homo sapiens
aatttgtaaaaacagcattgct

SEQ ID NO: 4608318 - DNA, 24 bp, Homo sapiens
aatttgtaaaaacagcattgcttt

SEQ ID NO: 4608319 - DNA, 20 bp, Homo sapiens
aatttgtaaacttctgaaga

SEQ ID NO: 4608320 - DNA, 14 bp, Homo sapiens
aatttgtaatgatt

SEQ ID NO: 4608321 - DNA, 22 bp, Homo sapiens
aatttgtaatgattttggaact

SEQ ID NO: 4608322 - DNA, 17 bp, Homo sapiens
aattttaagaaggcatt

SEQ ID NO: 4608323 - DNA, 22 bp, Homo sapiens
aattttaatgctgtttctaaga

SEQ ID NO: 4608324 - DNA, 16 bp, Homo sapiens
aattttacagcccttg

SEQ ID NO: 4608325 - DNA, 19 bp, Homo sapiens
aattttatctgtttcctga

SEQ ID NO: 4608326 - DNA, 16 bp, Homo sapiens
aattttatttttctgt

SEQ ID NO: 4608327 - DNA, 18 bp, Homo sapiens
aattttcaaggccttcag

SEQ ID NO: 4608328 - DNA, 13 bp, Homo sapiens
aattttgatttct

SEQ ID NO: 4608329 - DNA, 18 bp, Homo sapiens
aattttgcatactgaaaa

SEQ ID NO: 4608330 - DNA, 14 bp, Homo sapiens
aatttttaatgatg

SEQ ID NO: 4608331 - DNA, 19 bp, Homo sapiens
aatttttcagatgcttctg

SEQ ID NO: 4608332 - DNA, 22 bp, Homo sapiens
aatttttcttttcttgattttt

SEQ ID NO: 4608333 - DNA, 15 bp, Homo sapiens
aatttttgtctcaga

SEQ ID NO: 4608334 - DNA, 20 bp, Homo sapiens
acaaaactgttcttttgcat

SEQ ID NO: 4608335 - DNA, 17 bp, Homo sapiens
acaaaacttcttgtcag

SEQ ID NO: 4608336 - DNA, 20 bp, Homo sapiens
acaaaagaaggtcaaactgt

SEQ ID NO: 4608337 - DNA, 21 bp, Homo sapiens
acaaaagggtttaaactgatt

SEQ ID NO: 4608338 - DNA, 11 bp, Homo sapiens
acaaaatggac

SEQ ID NO: 4608339 - DNA, 18 bp, Homo sapiens
acaaacaagccccctgcc

SEQ ID NO: 4608340 - DNA, 20 bp, Homo sapiens
acaaacagggctgccttctg

SEQ ID NO: 4608341 - DNA, 14 bp, Homo sapiens
acaaacatgaatcc

SEQ ID NO: 4608342 - DNA, 14 bp, Homo sapiens
acaaacattagtat

SEQ ID NO: 4608343 - DNA, 19 bp, Homo sapiens
acaaactcatcctctttta

SEQ ID NO: 4608344 - DNA, 22 bp, Homo sapiens
acaaactcatcctcttttaatg

SEQ ID NO: 4608345 - DNA, 18 bp, Homo sapiens
acaaagacaaaagtctgt

SEQ ID NO: 4608346 - DNA, 16 bp, Homo sapiens
acaaagagatatttag

SEQ ID NO: 4608347 - DNA, 17 bp, Homo sapiens
acaaagcataatcaata

SEQ ID NO: 4608348 - DNA, 14 bp, Homo sapiens
acaaaggagcctgt

SEQ ID NO: 4608349 - DNA, 23 bp, Homo sapiens
acaaaggagcctgtgaacccagg

SEQ ID NO: 4608350 - DNA, 23 bp, Homo sapiens
acaaagtactctttaacatacaa

SEQ ID NO: 4608351 - DNA, 18 bp, Homo sapiens
acaaagtgctatgcggag

SEQ ID NO: 4608352 - DNA, 19 bp, Homo sapiens
acaaagtggcataaaaaac

SEQ ID NO: 4608353 - DNA, 18 bp, Homo sapiens
acaaataagtttttgcta

SEQ ID NO: 4608354 - DNA, 15 bp, Homo sapiens
acaaataattttagt

SEQ ID NO: 4608355 - DNA, 21 bp, Homo sapiens
acaaatgaagaaagtcaaaaa

SEQ ID NO: 4608356 - DNA, 13 bp, Homo sapiens
acaaatgtggcca

SEQ ID NO: 4608357 - DNA, 21 bp, Homo sapiens
acaaatgtggccaagcctatc

SEQ ID NO: 4608358 - DNA, 14 bp, Homo sapiens
acaaattatttttg

SEQ ID NO: 4608359 - DNA, 19 bp, Homo sapiens
acaaatttcattgcacttt

SEQ ID NO: 4608360 - DNA, 20 bp, Homo sapiens
acaaatttcattgcactttc

SEQ ID NO: 4608361 - DNA, 19 bp, Homo sapiens
acaacaattggtaaaactc

SEQ ID NO: 4608362 - DNA, 15 bp, Homo sapiens
acaacagctgaagca

SEQ ID NO: 4608363 - DNA, 20 bp, Homo sapiens
acaacatcaccagtgccacg

SEQ ID NO: 4608364 - DNA, 20 bp, Homo sapiens
acaacatcagaaagaattga

SEQ ID NO: 4608365 - DNA, 15 bp, Homo sapiens
acaaccagaaggccc

SEQ ID NO: 4608366 - DNA, 16 bp, Homo sapiens
acaacctgaaggaata

SEQ ID NO: 4608367 - DNA, 19 bp, Homo sapiens
acaactccttccatccttg

SEQ ID NO: 4608368 - DNA, 20 bp, Homo sapiens
acaactccttccatccttga

SEQ ID NO: 4608369 - DNA, 14 bp, Homo sapiens
acaacttagtgtaa

SEQ ID NO: 4608370 - DNA, 13 bp, Homo sapiens
acaagaatgtccc

SEQ ID NO: 4608371 - DNA, 15 bp, Homo sapiens
acaagacagagggga

SEQ ID NO: 4608372 - DNA, 19 bp, Homo sapiens
acaagagtggagagaagct

SEQ ID NO: 4608373 - DNA, 18 bp, Homo sapiens
acaagatagagagctatt

SEQ ID NO: 4608374 - DNA, 17 bp, Homo sapiens
acaagccaatgtgaatt

SEQ ID NO: 4608375 - DNA, 15 bp, Homo sapiens
acaagccccctgccc

SEQ ID NO: 4608376 - DNA, 16 bp, Homo sapiens
acaagctgcactgtga

SEQ ID NO: 4608377 - DNA, 18 bp, Homo sapiens
acaagctgcactgtgaac

SEQ ID NO: 4608378 - DNA, 18 bp, Homo sapiens
acaagctgtccctgcagg

SEQ ID NO: 4608379 - DNA, 19 bp, Homo sapiens
acaagctgtccctgcaggg

SEQ ID NO: 4608380 - DNA, 12 bp, Homo sapiens
acaagctgtgca

SEQ ID NO: 4608381 - DNA, 18 bp, Homo sapiens
acaagctgtgcaggcatg

SEQ ID NO: 4608382 - DNA, 12 bp, Homo sapiens
acaaggcctggt

SEQ ID NO: 4608383 - DNA, 17 bp, Homo sapiens
acaaggcctggtctggg

SEQ ID NO: 4608384 - DNA, 21 bp, Homo sapiens
acaaggtacccctttctggct

SEQ ID NO: 4608385 - DNA, 19 bp, Homo sapiens
acaaggtgctaacatagat

SEQ ID NO: 4608386 - DNA, 17 bp, Homo sapiens
acaagtatataatttac

SEQ ID NO: 4608387 - DNA, 15 bp, Homo sapiens
acaagtctttctcct

SEQ ID NO: 4608388 - DNA, 18 bp, Homo sapiens
acaagtggactcagggca

SEQ ID NO: 4608389 - DNA, 21 bp, Homo sapiens
acaagtgtaggccaccattat

SEQ ID NO: 4608390 - DNA, 12 bp, Homo sapiens
acaagtgtctaa

SEQ ID NO: 4608391 - DNA, 23 bp, Homo sapiens
acaagttagaaaattcagctcct

SEQ ID NO: 4608392 - DNA, 14 bp, Homo sapiens
acaataaaattttt

SEQ ID NO: 4608393 - DNA, 23 bp, Homo sapiens
acaataaaattttttttcatgtt

SEQ ID NO: 4608394 - DNA, 15 bp, Homo sapiens
acaataacccagtta

SEQ ID NO: 4608395 - DNA, 22 bp, Homo sapiens
acaatagttcttagctttgaaa

SEQ ID NO: 4608396 - DNA, 23 bp, Homo sapiens
acaatcctagtgctttccttttt

SEQ ID NO: 4608397 - DNA, 15 bp, Homo sapiens
acaatcttgggaaca

SEQ ID NO: 4608398 - DNA, 17 bp, Homo sapiens
acaatgtgaataatggc

SEQ ID NO: 4608399 - DNA, 17 bp, Homo sapiens
acaatgttgtcctcctg

SEQ ID NO: 4608400 - DNA, 20 bp, Homo sapiens
acaattgggagctgccaaga

SEQ ID NO: 4608401 - DNA, 19 bp, Homo sapiens
acaatttggtcttagcttt

SEQ ID NO: 4608402 - DNA, 20 bp, Homo sapiens
acaatttggtcttagcttta

SEQ ID NO: 4608403 - DNA, 15 bp, Homo sapiens
acacaaaacttgaaa

SEQ ID NO: 4608404 - DNA, 17 bp, Homo sapiens
acacaaaacttgaaaga

SEQ ID NO: 4608405 - DNA, 13 bp, Homo sapiens
acacaccctgagg

SEQ ID NO: 4608406 - DNA, 23 bp, Homo sapiens
acacagacgttaggcatttcctg

SEQ ID NO: 4608407 - DNA, 21 bp, Homo sapiens
acacagactgttgtccctgca

SEQ ID NO: 4608408 - DNA, 10 bp, Homo sapiens
acacagagaa

SEQ ID NO: 4608409 - DNA, 15 bp, Homo sapiens
acacagagaaggcta

SEQ ID NO: 4608410 - DNA, 14 bp, Homo sapiens
acacagctgagcac

SEQ ID NO: 4608411 - DNA, 12 bp, Homo sapiens
acacaggcagcc

SEQ ID NO: 4608412 - DNA, 18 bp, Homo sapiens
acacaggcagccagccgt

SEQ ID NO: 4608413 - DNA, 20 bp, Homo sapiens
acacaggcatttcctgggtg

SEQ ID NO: 4608414 - DNA, 16 bp, Homo sapiens
acacagttcctgggaa

SEQ ID NO: 4608415 - DNA, 23 bp, Homo sapiens
acacatatatataacaaataata

SEQ ID NO: 4608416 - DNA, 15 bp, Homo sapiens
acacatcttcaacag

SEQ ID NO: 4608417 - DNA, 16 bp, Homo sapiens
acaccaagcacagcag

SEQ ID NO: 4608418 - DNA, 19 bp, Homo sapiens
acaccaagcacagcagcct

SEQ ID NO: 4608419 - DNA, 19 bp, Homo sapiens
acaccactttctgctttcc

SEQ ID NO: 4608420 - DNA, 20 bp, Homo sapiens
acacccacccaaaagtcacc

SEQ ID NO: 4608421 - DNA, 19 bp, Homo sapiens
acacccaccccctgcctgg

SEQ ID NO: 4608422 - DNA, 14 bp, Homo sapiens
acaccctccagaga

SEQ ID NO: 4608423 - DNA, 11 bp, Homo sapiens
acaccctggcc

SEQ ID NO: 4608424 - DNA, 16 bp, Homo sapiens
acacctccctgtgaag

SEQ ID NO: 4608425 - DNA, 14 bp, Homo sapiens
acacgattttattg

SEQ ID NO: 4608426 - DNA, 15 bp, Homo sapiens
acacgctgttctaat

SEQ ID NO: 4608427 - DNA, 14 bp, Homo sapiens
acacggccacatca

SEQ ID NO: 4608428 - DNA, 23 bp, Homo sapiens
acacgtggcctcgtgaggggcaa

SEQ ID NO: 4608429 - DNA, 18 bp, Homo sapiens
acactaaccaaatctctc

SEQ ID NO: 4608430 - DNA, 19 bp, Homo sapiens
acactcagaagcctggggg

SEQ ID NO: 4608431 - DNA, 14 bp, Homo sapiens
acactccaagatat

SEQ ID NO: 4608432 - DNA, 18 bp, Homo sapiens
acactccaccctccacct

SEQ ID NO: 4608433 - DNA, 17 bp, Homo sapiens
acactctgacaagctgg

SEQ ID NO: 4608434 - DNA, 20 bp, Homo sapiens
acactctgacaagctggcca

SEQ ID NO: 4608435 - DNA, 13 bp, Homo sapiens
acactcttcagtg

SEQ ID NO: 4608436 - DNA, 19 bp, Homo sapiens
acactcttcagtgactcct

SEQ ID NO: 4608437 - DNA, 13 bp, Homo sapiens
acactgataatca

SEQ ID NO: 4608438 - DNA, 16 bp, Homo sapiens
acactgttgtttagtt

SEQ ID NO: 4608439 - DNA, 18 bp, Homo sapiens
acactgtttcatctcagc

SEQ ID NO: 4608440 - DNA, 14 bp, Homo sapiens
acacttaacagatg

SEQ ID NO: 4608441 - DNA, 16 bp, Homo sapiens
acacttaacagatgca

SEQ ID NO: 4608442 - DNA, 19 bp, Homo sapiens
acacttatctcactgtttt

SEQ ID NO: 4608443 - DNA, 15 bp, Homo sapiens
acacttcgctcttga

SEQ ID NO: 4608444 - DNA, 23 bp, Homo sapiens
acacttctcaggacacaggcctg

SEQ ID NO: 4608445 - DNA, 13 bp, Homo sapiens
acacttcttaaat

SEQ ID NO: 4608446 - DNA, 19 bp, Homo sapiens
acacttgtccccaaatccg

SEQ ID NO: 4608447 - DNA, 11 bp, Homo sapiens
acacttttatg

SEQ ID NO: 4608448 - DNA, 18 bp, Homo sapiens
acactttttacagcagca

SEQ ID NO: 4608449 - DNA, 13 bp, Homo sapiens
acagaaaatgcaa

SEQ ID NO: 4608450 - DNA, 22 bp, Homo sapiens
acagaaacatgtcttgactgtt

SEQ ID NO: 4608451 - DNA, 20 bp, Homo sapiens
acagaacaggaggtgtgaat

SEQ ID NO: 4608452 - DNA, 19 bp, Homo sapiens
acagaaccttgttatttct

SEQ ID NO: 4608453 - DNA, 23 bp, Homo sapiens
acagaaccttgttatttctcaga

SEQ ID NO: 4608454 - DNA, 18 bp, Homo sapiens
acagaagtgaggatgaga

SEQ ID NO: 4608455 - DNA, 22 bp, Homo sapiens
acagaagtgaggatgagaccca

SEQ ID NO: 4608456 - DNA, 15 bp, Homo sapiens
acagacaagcagccc

SEQ ID NO: 4608457 - DNA, 20 bp, Homo sapiens
acagacacgagccacctcac

SEQ ID NO: 4608458 - DNA, 14 bp, Homo sapiens
acagacccctggga

SEQ ID NO: 4608459 - DNA, 15 bp, Homo sapiens
acagacccctgggag

SEQ ID NO: 4608460 - DNA, 22 bp, Homo sapiens
acagacgttaggcatttcctgc

SEQ ID NO: 4608461 - DNA, 23 bp, Homo sapiens
acagactagcaggctactgggac

SEQ ID NO: 4608462 - DNA, 12 bp, Homo sapiens
acagactgaaag

SEQ ID NO: 4608463 - DNA, 22 bp, Homo sapiens
acagactgaaaggtgtgaacag

SEQ ID NO: 4608464 - DNA, 23 bp, Homo sapiens
acagagaagtttgtagccaggta

SEQ ID NO: 4608465 - DNA, 18 bp, Homo sapiens
acagagcaagtcctcact

SEQ ID NO: 4608466 - DNA, 18 bp, Homo sapiens
acagagcacctgtagctg

SEQ ID NO: 4608467 - DNA, 14 bp, Homo sapiens
acagagcatcagaa

SEQ ID NO: 4608468 - DNA, 21 bp, Homo sapiens
acagaggaatttatacctcaa

SEQ ID NO: 4608469 - DNA, 13 bp, Homo sapiens
acagagggagttt

SEQ ID NO: 4608470 - DNA, 18 bp, Homo sapiens
acagaggggagcagtggc

SEQ ID NO: 4608471 - DNA, 19 bp, Homo sapiens
acagagtgggccccgggct

SEQ ID NO: 4608472 - DNA, 13 bp, Homo sapiens
acagataaacaaa

SEQ ID NO: 4608473 - DNA, 21 bp, Homo sapiens
acagataacctaataattgta

SEQ ID NO: 4608474 - DNA, 21 bp, Homo sapiens
acagataataatgggtttctt

SEQ ID NO: 4608475 - DNA, 14 bp, Homo sapiens
acagataatgcttt

SEQ ID NO: 4608476 - DNA, 18 bp, Homo sapiens
acagatcaagctgtgaga

SEQ ID NO: 4608477 - DNA, 14 bp, Homo sapiens
acagcaaccccagg

SEQ ID NO: 4608478 - DNA, 12 bp, Homo sapiens
acagcaagtcag

SEQ ID NO: 4608479 - DNA, 12 bp, Homo sapiens
acagcacagcca

SEQ ID NO: 4608480 - DNA, 21 bp, Homo sapiens
acagcactactgggtgtcatt

SEQ ID NO: 4608481 - DNA, 22 bp, Homo sapiens
acagcaggatcgaagggttttt

SEQ ID NO: 4608482 - DNA, 16 bp, Homo sapiens
acagcaggcagcgcca

SEQ ID NO: 4608483 - DNA, 11 bp, Homo sapiens
acagcattgct

SEQ ID NO: 4608484 - DNA, 15 bp, Homo sapiens
acagcattgctttct

SEQ ID NO: 4608485 - DNA, 22 bp, Homo sapiens
acagccaacacgcacctgcctc

SEQ ID NO: 4608486 - DNA, 13 bp, Homo sapiens
acagccaggtagt

SEQ ID NO: 4608487 - DNA, 18 bp, Homo sapiens
acagcccagagcctggct

SEQ ID NO: 4608488 - DNA, 18 bp, Homo sapiens
acagcccagcacaggtat

SEQ ID NO: 4608489 - DNA, 20 bp, Homo sapiens
acagcccaggatactggcac

SEQ ID NO: 4608490 - DNA, 18 bp, Homo sapiens
acagcctcacccctgccc

SEQ ID NO: 4608491 - DNA, 13 bp, Homo sapiens
acagcctcttttt

SEQ ID NO: 4608492 - DNA, 19 bp, Homo sapiens
acagccttccctctgcatt

SEQ ID NO: 4608493 - DNA, 19 bp, Homo sapiens
acagcgaagtagcttgctc

SEQ ID NO: 4608494 - DNA, 15 bp, Homo sapiens
acagctcagcagaca

SEQ ID NO: 4608495 - DNA, 13 bp, Homo sapiens
acatgtttataaa

SEQ ID NO: 4608496 - DNA, 13 bp, Homo sapiens
acattaaaatgac

SEQ ID NO: 4608497 - DNA, 23 bp, Homo sapiens
acattaaaatgacaaacatgata

SEQ ID NO: 4608498 - DNA, 17 bp, Homo sapiens
acattaacggtgctaaa

SEQ ID NO: 4608499 - DNA, 13 bp, Homo sapiens
acattagtatagt

SEQ ID NO: 4608500 - DNA, 16 bp, Homo sapiens
acattataatgtacag

SEQ ID NO: 4608501 - DNA, 13 bp, Homo sapiens
acattatgaagaa

SEQ ID NO: 4608502 - DNA, 13 bp, Homo sapiens
acattccagtaga

SEQ ID NO: 4608503 - DNA, 16 bp, Homo sapiens
acattcgtgagctggg

SEQ ID NO: 4608504 - DNA, 12 bp, Homo sapiens
acattctaatgc

SEQ ID NO: 4608505 - DNA, 17 bp, Homo sapiens
acattctaatgcatatt

SEQ ID NO: 4608506 - DNA, 19 bp, Homo sapiens
acattctaatgcatattta

SEQ ID NO: 4608507 - DNA, 18 bp, Homo sapiens
acattctacagttgtgat

SEQ ID NO: 4608508 - DNA, 13 bp, Homo sapiens
acattctcacata

SEQ ID NO: 4608509 - DNA, 18 bp, Homo sapiens
acattctgcctagagtgt

SEQ ID NO: 4608510 - DNA, 19 bp, Homo sapiens
acattctgcctagagtgta

SEQ ID NO: 4608511 - DNA, 22 bp, Homo sapiens
acattctgcctagagtgtagcc

SEQ ID NO: 4608512 - DNA, 14 bp, Homo sapiens
acattcttttaatg

SEQ ID NO: 4608513 - DNA, 15 bp, Homo sapiens
acattggacagaaaa

SEQ ID NO: 4608514 - DNA, 16 bp, Homo sapiens
acattggacagaaaat

SEQ ID NO: 4608515 - DNA, 17 bp, Homo sapiens
acattggacagaaaatg

SEQ ID NO: 4608516 - DNA, 19 bp, Homo sapiens
acattggacagaaaatgca

SEQ ID NO: 4608517 - DNA, 20 bp, Homo sapiens
acattggacagaaaatgcaa

SEQ ID NO: 4608518 - DNA, 21 bp, Homo sapiens
acattggacagaaaatgcaat

SEQ ID NO: 4608519 - DNA, 23 bp, Homo sapiens
acattgtaaatatttactctttg

SEQ ID NO: 4608520 - DNA, 19 bp, Homo sapiens
acattgtctcctatatatt

SEQ ID NO: 4608521 - DNA, 20 bp, Homo sapiens
acattgttcaactcccttct

SEQ ID NO: 4608522 - DNA, 16 bp, Homo sapiens
acatttcattgtacaa

SEQ ID NO: 4608523 - DNA, 13 bp, Homo sapiens
acatttcccaggg

SEQ ID NO: 4608524 - DNA, 20 bp, Homo sapiens
acatttctactctagatggc

SEQ ID NO: 4608525 - DNA, 14 bp, Homo sapiens
acatttcttaaaac

SEQ ID NO: 4608526 - DNA, 22 bp, Homo sapiens
acatttgatgcatgtcttttaa

SEQ ID NO: 4608527 - DNA, 21 bp, Homo sapiens
acatttgtaagtgtaaaaaat

SEQ ID NO: 4608528 - DNA, 23 bp, Homo sapiens
acatttgtaagtgtaaaaaatgt

SEQ ID NO: 4608529 - DNA, 18 bp, Homo sapiens
acattttatcattaaaaa

SEQ ID NO: 4608530 - DNA, 22 bp, Homo sapiens
acattttatcattaaaaattac

SEQ ID NO: 4608531 - DNA, 16 bp, Homo sapiens
acattttatgagagtt

SEQ ID NO: 4608532 - DNA, 12 bp, Homo sapiens
acattttctaaa

SEQ ID NO: 4608533 - DNA, 14 bp, Homo sapiens
acattttctaaata

SEQ ID NO: 4608534 - DNA, 14 bp, Homo sapiens
acattttctcttag

SEQ ID NO: 4608535 - DNA, 13 bp, Homo sapiens
acattttgtaaaa

SEQ ID NO: 4608536 - DNA, 20 bp, Homo sapiens
acatttttaaattgttagct

SEQ ID NO: 4608537 - DNA, 17 bp, Homo sapiens
acattttttctaataaa

SEQ ID NO: 4608538 - DNA, 16 bp, Homo sapiens
accaaacttgttcatt

SEQ ID NO: 4608539 - DNA, 19 bp, Homo sapiens
accaaacttgttcatttag

SEQ ID NO: 4608540 - DNA, 23 bp, Homo sapiens
accaaagaaacaccacttaatct

SEQ ID NO: 4608541 - DNA, 20 bp, Homo sapiens
accaaatctctcaaatctgt

SEQ ID NO: 4608542 - DNA, 12 bp, Homo sapiens
accaacctgacc

SEQ ID NO: 4608543 - DNA, 13 bp, Homo sapiens
accaagagacaca

SEQ ID NO: 4608544 - DNA, 14 bp, Homo sapiens
accaagagacacaa

SEQ ID NO: 4608545 - DNA, 16 bp, Homo sapiens
accaagcacagcagcc

SEQ ID NO: 4608546 - DNA, 15 bp, Homo sapiens
accaagcatctttgt

SEQ ID NO: 4608547 - DNA, 23 bp, Homo sapiens
accaaggccctgcatctgtctgc

SEQ ID NO: 4608548 - DNA, 15 bp, Homo sapiens
accaagggacaggag

SEQ ID NO: 4608549 - DNA, 23 bp, Homo sapiens
accaagttggaacatccttggaa

SEQ ID NO: 4608550 - DNA, 18 bp, Homo sapiens
accaagttgtgcttttct

SEQ ID NO: 4608551 - DNA, 20 bp, Homo sapiens
accaagttgtgcttttctgt

SEQ ID NO: 4608552 - DNA, 21 bp, Homo sapiens
accaagttgtgcttttctgtt

SEQ ID NO: 4608553 - DNA, 14 bp, Homo sapiens
accaatattgtaca

SEQ ID NO: 4608554 - DNA, 16 bp, Homo sapiens
accaatattgtacagt

SEQ ID NO: 4608555 - DNA, 14 bp, Homo sapiens
accaatgtacccac

SEQ ID NO: 4608556 - DNA, 21 bp, Homo sapiens
accacaaggctgttgcatggg

SEQ ID NO: 4608557 - DNA, 14 bp, Homo sapiens
accacacattttat

SEQ ID NO: 4608558 - DNA, 16 bp, Homo sapiens
accacagcacagccaa

SEQ ID NO: 4608559 - DNA, 17 bp, Homo sapiens
accacctcctctgccag

SEQ ID NO: 4608560 - DNA, 22 bp, Homo sapiens
accacctcctctgccagcagga

SEQ ID NO: 4608561 - DNA, 23 bp, Homo sapiens
accacctcctctgccagcaggaa

SEQ ID NO: 4608562 - DNA, 15 bp, Homo sapiens
accacgtctggctcc

SEQ ID NO: 4608563 - DNA, 12 bp, Homo sapiens
accactctggca

SEQ ID NO: 4608564 - DNA, 15 bp, Homo sapiens
accactctggcagcc

SEQ ID NO: 4608565 - DNA, 17 bp, Homo sapiens
accactgcactttccaa

SEQ ID NO: 4608566 - DNA, 18 bp, Homo sapiens
accactgtgcacttagcc

SEQ ID NO: 4608567 - DNA, 13 bp, Homo sapiens
accacttaatctt

SEQ ID NO: 4608568 - DNA, 14 bp, Homo sapiens
accacttaatcttc

SEQ ID NO: 4608569 - DNA, 17 bp, Homo sapiens
accacttcgcacacacc

SEQ ID NO: 4608570 - DNA, 13 bp, Homo sapiens
accagaaggccct

SEQ ID NO: 4608571 - DNA, 16 bp, Homo sapiens
accagagtcagcacag

SEQ ID NO: 4608572 - DNA, 18 bp, Homo sapiens
accagcccgacagtgcca

SEQ ID NO: 4608573 - DNA, 17 bp, Homo sapiens
accagcctgctgacaga

SEQ ID NO: 4608574 - DNA, 22 bp, Homo sapiens
accagcctgctgacagacacta

SEQ ID NO: 4608575 - DNA, 12 bp, Homo sapiens
accaggaccctg

SEQ ID NO: 4608576 - DNA, 13 bp, Homo sapiens
accaggatggagc

SEQ ID NO: 4608577 - DNA, 24 bp, Homo sapiens
accaggatggagcaagctcttccc

SEQ ID NO: 4608578 - DNA, 11 bp, Homo sapiens
accaggccacc

SEQ ID NO: 4608579 - DNA, 19 bp, Homo sapiens
accagggagctgcaggggc

SEQ ID NO: 4608580 - DNA, 9 bp, Homo sapiens
accagggat

SEQ ID NO: 4608581 - DNA, 18 bp, Homo sapiens
accagggatgctgggctg

SEQ ID NO: 4608582 - DNA, 20 bp, Homo sapiens
accagggatgctgggctggg

SEQ ID NO: 4608583 - DNA, 22 bp, Homo sapiens
accagggatgctgggctgggcc

SEQ ID NO: 4608584 - DNA, 16 bp, Homo sapiens
accagggccagagcag

SEQ ID NO: 4608585 - DNA, 19 bp, Homo sapiens
accagggccagagcagctc

SEQ ID NO: 4608586 - DNA, 20 bp, Homo sapiens
accaggggaaggaaggaggg

SEQ ID NO: 4608587 - DNA, 18 bp, Homo sapiens
accaggggacactttgtt

SEQ ID NO: 4608588 - DNA, 14 bp, Homo sapiens
accagtctgaccct

SEQ ID NO: 4608589 - DNA, 16 bp, Homo sapiens
accagtgacgctgctg

SEQ ID NO: 4608590 - DNA, 18 bp, Homo sapiens
accagttaaagccacaga

SEQ ID NO: 4608591 - DNA, 19 bp, Homo sapiens
accatcaaaggaatataag

SEQ ID NO: 4608592 - DNA, 22 bp, Homo sapiens
accatcaaaggaatataagaaa

SEQ ID NO: 4608593 - DNA, 14 bp, Homo sapiens
accatcttaatctt

SEQ ID NO: 4608594 - DNA, 23 bp, Homo sapiens
accatcttaatctttattttatt

SEQ ID NO: 4608595 - DNA, 19 bp, Homo sapiens
accatgatggccaggctga

SEQ ID NO: 4608596 - DNA, 22 bp, Homo sapiens
accatgtgctacaggggccaga

SEQ ID NO: 4608597 - DNA, 14 bp, Homo sapiens
accattcaattagt

SEQ ID NO: 4608598 - DNA, 22 bp, Homo sapiens
accattcactactcatgcgtga

SEQ ID NO: 4608599 - DNA, 16 bp, Homo sapiens
accattgagtccctgc

SEQ ID NO: 4608600 - DNA, 22 bp, Homo sapiens
acccaaagcggtccctgtccct

SEQ ID NO: 4608601 - DNA, 18 bp, Homo sapiens
acccaccccctgcctggt

SEQ ID NO: 4608602 - DNA, 14 bp, Homo sapiens
acccaccgggccac

SEQ ID NO: 4608603 - DNA, 22 bp, Homo sapiens
acccaccgggccactccttcct

SEQ ID NO: 4608604 - DNA, 11 bp, Homo sapiens
acccacctgct

SEQ ID NO: 4608605 - DNA, 13 bp, Homo sapiens
acccactcccttg

SEQ ID NO: 4608606 - DNA, 14 bp, Homo sapiens
acccagaaaggcta

SEQ ID NO: 4608607 - DNA, 14 bp, Homo sapiens
acccagcatctccc

SEQ ID NO: 4608608 - DNA, 16 bp, Homo sapiens
acccagcatctcccag

SEQ ID NO: 4608609 - DNA, 18 bp, Homo sapiens
acccagcatctcccagca

SEQ ID NO: 4608610 - DNA, 19 bp, Homo sapiens
acccagccccttcccctgg

SEQ ID NO: 4608611 - DNA, 20 bp, Homo sapiens
acccagccccttcccctggg

SEQ ID NO: 4608612 - DNA, 15 bp, Homo sapiens
acccagcgtggcctc

SEQ ID NO: 4608613 - DNA, 21 bp, Homo sapiens
acccaggaatgacccttttgt

SEQ ID NO: 4608614 - DNA, 17 bp, Homo sapiens
acccaggacaagcatgg

SEQ ID NO: 4608615 - DNA, 20 bp, Homo sapiens
acccaggctggagtgcagtg

SEQ ID NO: 4608616 - DNA, 22 bp, Homo sapiens
acccagttcttcatttggagga

SEQ ID NO: 4608617 - DNA, 22 bp, Homo sapiens
acccatagaaaacttgacatgt

SEQ ID NO: 4608618 - DNA, 23 bp, Homo sapiens
acccatatccttaccctccttgg

SEQ ID NO: 4608619 - DNA, 14 bp, Homo sapiens
acccatcttgcttc

SEQ ID NO: 4608620 - DNA, 16 bp, Homo sapiens
acccatcttgcttcca

SEQ ID NO: 4608621 - DNA, 17 bp, Homo sapiens
acccatcttgcttccaa

SEQ ID NO: 4608622 - DNA, 21 bp, Homo sapiens
acccatcttgcttccaagacc

SEQ ID NO: 4608623 - DNA, 17 bp, Homo sapiens
acccatgtaaccactgc

SEQ ID NO: 4608624 - DNA, 18 bp, Homo sapiens
acccattgttcccttcct

SEQ ID NO: 4608625 - DNA, 17 bp, Homo sapiens
accccacccttgcccac

SEQ ID NO: 4608626 - DNA, 20 bp, Homo sapiens
accccacccttgcccacccc

SEQ ID NO: 4608627 - DNA, 10 bp, Homo sapiens
accccagggc

SEQ ID NO: 4608628 - DNA, 11 bp, Homo sapiens
accccagggca

SEQ ID NO: 4608629 - DNA, 15 bp, Homo sapiens
accccagggcacagg

SEQ ID NO: 4608630 - DNA, 21 bp, Homo sapiens
acccccacaagctgtccctgc

SEQ ID NO: 4608631 - DNA, 23 bp, Homo sapiens
acccccacaagctgtccctgcag

SEQ ID NO: 4608632 - DNA, 15 bp, Homo sapiens
acccccaccaagggc

SEQ ID NO: 4608633 - DNA, 15 bp, Homo sapiens
acccccactccagct

SEQ ID NO: 4608634 - DNA, 14 bp, Homo sapiens
acccccagccctgg

SEQ ID NO: 4608635 - DNA, 16 bp, Homo sapiens
acccccagcctgggcc

SEQ ID NO: 4608636 - DNA, 17 bp, Homo sapiens
acccccagtcctcccta

SEQ ID NO: 4608637 - DNA, 20 bp, Homo sapiens
acccccagttcctatgacac

SEQ ID NO: 4608638 - DNA, 19 bp, Homo sapiens
acccccgtcctcttcgaga

SEQ ID NO: 4608639 - DNA, 13 bp, Homo sapiens
accccctccctgt

SEQ ID NO: 4608640 - DNA, 15 bp, Homo sapiens
accccctgcagcttg

SEQ ID NO: 4608641 - DNA, 12 bp, Homo sapiens
accccctgcctg

SEQ ID NO: 4608642 - DNA, 13 bp, Homo sapiens
accccctgcctgg

SEQ ID NO: 4608643 - DNA, 15 bp, Homo sapiens
accccgcacccggct

SEQ ID NO: 4608644 - DNA, 23 bp, Homo sapiens
accccggggtgcccacaggccgc

SEQ ID NO: 4608645 - DNA, 21 bp, Homo sapiens
acccctcatacctacacccaa

SEQ ID NO: 4608646 - DNA, 17 bp, Homo sapiens
acccctcccctgggact

SEQ ID NO: 4608647 - DNA, 18 bp, Homo sapiens
acccctctcgcctcatta

SEQ ID NO: 4608648 - DNA, 12 bp, Homo sapiens
acccctgcccct

SEQ ID NO: 4608649 - DNA, 13 bp, Homo sapiens
acccctgcccctg

SEQ ID NO: 4608650 - DNA, 14 bp, Homo sapiens
acccctgcccctgt

SEQ ID NO: 4608651 - DNA, 21 bp, Homo sapiens
acccctgcccctgtgggactc

SEQ ID NO: 4608652 - DNA, 15 bp, Homo sapiens
acccctggccacagc

SEQ ID NO: 4608653 - DNA, 19 bp, Homo sapiens
acccctggccacagccttc

SEQ ID NO: 4608654 - DNA, 20 bp, Homo sapiens
acccctgtaatcaggcaagg

SEQ ID NO: 4608655 - DNA, 21 bp, Homo sapiens
acccctgtaatcaggcaagga

SEQ ID NO: 4608656 - DNA, 20 bp, Homo sapiens
accccttaagccctggcccc

SEQ ID NO: 4608657 - DNA, 19 bp, Homo sapiens
accccttggaggagagaga

SEQ ID NO: 4608658 - DNA, 22 bp, Homo sapiens
accccttggaggagagagaccc

SEQ ID NO: 4608659 - DNA, 17 bp, Homo sapiens
acccctttctggctctc

SEQ ID NO: 4608660 - DNA, 16 bp, Homo sapiens
acccgcaagtcaagcc

SEQ ID NO: 4608661 - DNA, 23 bp, Homo sapiens
acccgcggcccgcgcagctgcct

SEQ ID NO: 4608662 - DNA, 22 bp, Homo sapiens
acccgctcggacttactgcctg

SEQ ID NO: 4608663 - DNA, 23 bp, Homo sapiens
acccgctcggacttactgcctga

SEQ ID NO: 4608664 - DNA, 20 bp, Homo sapiens
acccggcaccccctgcagct

SEQ ID NO: 4608665 - DNA, 13 bp, Homo sapiens
acccgtccccaca

SEQ ID NO: 4608666 - DNA, 23 bp, Homo sapiens
acccgtgccaagtccaggtcctg

SEQ ID NO: 4608667 - DNA, 17 bp, Homo sapiens
acccgtggaggctgctc

SEQ ID NO: 4608668 - DNA, 14 bp, Homo sapiens
accctatgggtcta

SEQ ID NO: 4608669 - DNA, 19 bp, Homo sapiens
accctatgggtctaggaca

SEQ ID NO: 4608670 - DNA, 12 bp, Homo sapiens
accctccacctt

SEQ ID NO: 4608671 - DNA, 17 bp, Homo sapiens
accctcccatgagactg

SEQ ID NO: 4608672 - DNA, 21 bp, Homo sapiens
accctcccatgagactgccct

SEQ ID NO: 4608673 - DNA, 22 bp, Homo sapiens
accctcccatgagactgccctg

SEQ ID NO: 4608674 - DNA, 14 bp, Homo sapiens
accctccctagctc

SEQ ID NO: 4608675 - DNA, 15 bp, Homo sapiens
accctccctagctct

SEQ ID NO: 4608676 - DNA, 17 bp, Homo sapiens
accctgagagtctgaga

SEQ ID NO: 4608677 - DNA, 17 bp, Homo sapiens
accctgaggagtctgag

SEQ ID NO: 4608678 - DNA, 22 bp, Homo sapiens
accctgaggagtctgaggtcct

SEQ ID NO: 4608679 - DNA, 18 bp, Homo sapiens
accctgcaggacttgcca

SEQ ID NO: 4608680 - DNA, 22 bp, Homo sapiens
accctgccccccctaagagaca

SEQ ID NO: 4608681 - DNA, 20 bp, Homo sapiens
accctgcccttgacatctgg

SEQ ID NO: 4608682 - DNA, 16 bp, Homo sapiens
accctggatcagtcct

SEQ ID NO: 4608683 - DNA, 18 bp, Homo sapiens
accctgggctggggagga

SEQ ID NO: 4608684 - DNA, 19 bp, Homo sapiens
accctgtacatatgtaaac

SEQ ID NO: 4608685 - DNA, 19 bp, Homo sapiens
accctgtatccaattttaa

SEQ ID NO: 4608686 - DNA, 11 bp, Homo sapiens
accctgtcccc

SEQ ID NO: 4608687 - DNA, 17 bp, Homo sapiens
accctgtcccctaggga

SEQ ID NO: 4608688 - DNA, 20 bp, Homo sapiens
accctgtcccctagggactg

SEQ ID NO: 4608689 - DNA, 21 bp, Homo sapiens
acccttattgctgtcctggag

SEQ ID NO: 4608690 - DNA, 15 bp, Homo sapiens
acccttgctttcctg

SEQ ID NO: 4608691 - DNA, 19 bp, Homo sapiens
acccttttccttttttggg

SEQ ID NO: 4608692 - DNA, 15 bp, Homo sapiens
accctttttcattta

SEQ ID NO: 4608693 - DNA, 19 bp, Homo sapiens
accctttttcatttaactt

SEQ ID NO: 4608694 - DNA, 11 bp, Homo sapiens
accctttttgg

SEQ ID NO: 4608695 - DNA, 17 bp, Homo sapiens
accgactcacctgcgca

SEQ ID NO: 4608696 - DNA, 19 bp, Homo sapiens
accgcctgaaggcacagct

SEQ ID NO: 4608697 - DNA, 19 bp, Homo sapiens
accgcgtctaccctgggat

SEQ ID NO: 4608698 - DNA, 19 bp, Homo sapiens
accgctacaccactctggc

SEQ ID NO: 4608699 - DNA, 21 bp, Homo sapiens
accgctacaccactctggcag

SEQ ID NO: 4608700 - DNA, 15 bp, Homo sapiens
accgctggccctgcc

SEQ ID NO: 4608701 - DNA, 14 bp, Homo sapiens
accggattctctct

SEQ ID NO: 4608702 - DNA, 18 bp, Homo sapiens
accggcctgtgggtctct

SEQ ID NO: 4608703 - DNA, 21 bp, Homo sapiens
accggcctgtgggtctctgaa

SEQ ID NO: 4608704 - DNA, 20 bp, Homo sapiens
accgggccactccttcctgc

SEQ ID NO: 4608705 - DNA, 17 bp, Homo sapiens
accggtgctgcaggagt

SEQ ID NO: 4608706 - DNA, 13 bp, Homo sapiens
accggtgctttta

SEQ ID NO: 4608707 - DNA, 15 bp, Homo sapiens
accggttcccacaag

SEQ ID NO: 4608708 - DNA, 18 bp, Homo sapiens
accggttcccacaagcct

SEQ ID NO: 4608709 - DNA, 18 bp, Homo sapiens
accgtaattgctttgtgc

SEQ ID NO: 4608710 - DNA, 21 bp, Homo sapiens
accgtaattgctttgtgcctt

SEQ ID NO: 4608711 - DNA, 18 bp, Homo sapiens
accgtcgacaagaatgtc

SEQ ID NO: 4608712 - DNA, 14 bp, Homo sapiens
accgtgcctggctg

SEQ ID NO: 4608713 - DNA, 15 bp, Homo sapiens
accgtgcctggctga

SEQ ID NO: 4608714 - DNA, 23 bp, Homo sapiens
accgtgcctggctgattcagcat

SEQ ID NO: 4608715 - DNA, 19 bp, Homo sapiens
accgtggcccttcctggac

SEQ ID NO: 4608716 - DNA, 14 bp, Homo sapiens
acctaataattgta

SEQ ID NO: 4608717 - DNA, 14 bp, Homo sapiens
acagctcagccagt

SEQ ID NO: 4608718 - DNA, 17 bp, Homo sapiens
acagctccaccctggcc

SEQ ID NO: 4608719 - DNA, 15 bp, Homo sapiens
acagctcctgccagg

SEQ ID NO: 4608720 - DNA, 22 bp, Homo sapiens
acagctgactgaatgcagaacg

SEQ ID NO: 4608721 - DNA, 21 bp, Homo sapiens
acagctggaggaatacatttt

SEQ ID NO: 4608722 - DNA, 12 bp, Homo sapiens
acagctgtgcct

SEQ ID NO: 4608723 - DNA, 14 bp, Homo sapiens
acagctgtttgaaa

SEQ ID NO: 4608724 - DNA, 15 bp, Homo sapiens
acagctgtttgaaat

SEQ ID NO: 4608725 - DNA, 16 bp, Homo sapiens
acagcttgctgtcact

SEQ ID NO: 4608726 - DNA, 21 bp, Homo sapiens
acagctttgtatgtttatgaa

SEQ ID NO: 4608727 - DNA, 13 bp, Homo sapiens
acaggaccacctc

SEQ ID NO: 4608728 - DNA, 16 bp, Homo sapiens
acaggactaacactca

SEQ ID NO: 4608729 - DNA, 18 bp, Homo sapiens
acaggactaacactcaga

SEQ ID NO: 4608730 - DNA, 20 bp, Homo sapiens
acaggactaacactcagaag

SEQ ID NO: 4608731 - DNA, 23 bp, Homo sapiens
acaggactaacactcagaagcct

SEQ ID NO: 4608732 - DNA, 15 bp, Homo sapiens
acaggactggttcct

SEQ ID NO: 4608733 - DNA, 23 bp, Homo sapiens
acaggagggtatggtgctgctct

SEQ ID NO: 4608734 - DNA, 18 bp, Homo sapiens
acaggaggtgtgaatgca

SEQ ID NO: 4608735 - DNA, 23 bp, Homo sapiens
acaggcagccagccgtggccaga

SEQ ID NO: 4608736 - DNA, 20 bp, Homo sapiens
acaggcatttcctgggtggc

SEQ ID NO: 4608737 - DNA, 19 bp, Homo sapiens
acaggcctgtgtagctgtg

SEQ ID NO: 4608738 - DNA, 19 bp, Homo sapiens
acaggctacaaagcagaga

SEQ ID NO: 4608739 - DNA, 19 bp, Homo sapiens
acagggaaggcaggcaggg

SEQ ID NO: 4608740 - DNA, 16 bp, Homo sapiens
acagggagctgggaca

SEQ ID NO: 4608741 - DNA, 20 bp, Homo sapiens
acagggatttagacttacta

SEQ ID NO: 4608742 - DNA, 13 bp, Homo sapiens
acagggcacaggc

SEQ ID NO: 4608743 - DNA, 18 bp, Homo sapiens
acagggccagtggggcct

SEQ ID NO: 4608744 - DNA, 19 bp, Homo sapiens
acagggccagtggggcctg

SEQ ID NO: 4608745 - DNA, 12 bp, Homo sapiens
acaggggccaga

SEQ ID NO: 4608746 - DNA, 15 bp, Homo sapiens
acagggtacctcaag

SEQ ID NO: 4608747 - DNA, 16 bp, Homo sapiens
acaggtaaaacagggc

SEQ ID NO: 4608748 - DNA, 18 bp, Homo sapiens
acagtaatgaaatgttta

SEQ ID NO: 4608749 - DNA, 17 bp, Homo sapiens
acagtacagcatgtgcc

SEQ ID NO: 4608750 - DNA, 13 bp, Homo sapiens
acagtcacctcac

SEQ ID NO: 4608751 - DNA, 14 bp, Homo sapiens
acagtcatcatcag

SEQ ID NO: 4608752 - DNA, 12 bp, Homo sapiens
acagtggcagga

SEQ ID NO: 4608753 - DNA, 19 bp, Homo sapiens
acagtgtgaataaagtgct

SEQ ID NO: 4608754 - DNA, 16 bp, Homo sapiens
acagttatcaaaaagt

SEQ ID NO: 4608755 - DNA, 14 bp, Homo sapiens
acagttccatttat

SEQ ID NO: 4608756 - DNA, 21 bp, Homo sapiens
acagttgcatttagcttcttt

SEQ ID NO: 4608757 - DNA, 23 bp, Homo sapiens
acagttgtgataatagcattttt

SEQ ID NO: 4608758 - DNA, 12 bp, Homo sapiens
acagtttttaaa

SEQ ID NO: 4608759 - DNA, 15 bp, Homo sapiens
acagtttttattgct

SEQ ID NO: 4608760 - DNA, 19 bp, Homo sapiens
acataaaatttaaaaactt

SEQ ID NO: 4608761 - DNA, 13 bp, Homo sapiens
acataatgaaaat

SEQ ID NO: 4608762 - DNA, 13 bp, Homo sapiens
acatacagagtgg

SEQ ID NO: 4608763 - DNA, 17 bp, Homo sapiens
acatacatgatacattt

SEQ ID NO: 4608764 - DNA, 15 bp, Homo sapiens
acatactgttctcaa

SEQ ID NO: 4608765 - DNA, 23 bp, Homo sapiens
acatactgttctcaacatactgt

SEQ ID NO: 4608766 - DNA, 20 bp, Homo sapiens
acatagagagggagaagaag

SEQ ID NO: 4608767 - DNA, 22 bp, Homo sapiens
acatagcaaataaaataaatga

SEQ ID NO: 4608768 - DNA, 22 bp, Homo sapiens
acataggtcataaagcattgga

SEQ ID NO: 4608769 - DNA, 17 bp, Homo sapiens
acatagtctttgtttac

SEQ ID NO: 4608770 - DNA, 19 bp, Homo sapiens
acatatcagaataggaaga

SEQ ID NO: 4608771 - DNA, 15 bp, Homo sapiens
acatatgcaccttgt

SEQ ID NO: 4608772 - DNA, 16 bp, Homo sapiens
acatatgcaccttgtg

SEQ ID NO: 4608773 - DNA, 20 bp, Homo sapiens
acatatgcaccttgtgtctg

SEQ ID NO: 4608774 - DNA, 19 bp, Homo sapiens
acatatgctgatcttttaa

SEQ ID NO: 4608775 - DNA, 14 bp, Homo sapiens
acatatgtcttact

SEQ ID NO: 4608776 - DNA, 13 bp, Homo sapiens
acatattttctgt

SEQ ID NO: 4608777 - DNA, 21 bp, Homo sapiens
acatcaccagtgccacgtcat

SEQ ID NO: 4608778 - DNA, 14 bp, Homo sapiens
acatcaggagttca

SEQ ID NO: 4608779 - DNA, 14 bp, Homo sapiens
acatcattgtcagc

SEQ ID NO: 4608780 - DNA, 19 bp, Homo sapiens
acatccaaagcagacagct

SEQ ID NO: 4608781 - DNA, 13 bp, Homo sapiens
acatccataaaga

SEQ ID NO: 4608782 - DNA, 15 bp, Homo sapiens
acatccataaagaag

SEQ ID NO: 4608783 - DNA, 19 bp, Homo sapiens
acatccataaagaagcaat

SEQ ID NO: 4608784 - DNA, 23 bp, Homo sapiens
acatcccccaatgaccttagccc

SEQ ID NO: 4608785 - DNA, 12 bp, Homo sapiens
acatccctgggc

SEQ ID NO: 4608786 - DNA, 16 bp, Homo sapiens
acatccctgggcctgc

SEQ ID NO: 4608787 - DNA, 18 bp, Homo sapiens
acatccctgggcctgctg

SEQ ID NO: 4608788 - DNA, 19 bp, Homo sapiens
acatccctgggcctgctgc

SEQ ID NO: 4608789 - DNA, 15 bp, Homo sapiens
acatctcttgaaacc

SEQ ID NO: 4608790 - DNA, 14 bp, Homo sapiens
acatctctttgaat

SEQ ID NO: 4608791 - DNA, 21 bp, Homo sapiens
acatctgcacactctcttctc

SEQ ID NO: 4608792 - DNA, 23 bp, Homo sapiens
acatctgcacactctcttctcca

SEQ ID NO: 4608793 - DNA, 20 bp, Homo sapiens
acatcttaaatctaaacaaa

SEQ ID NO: 4608794 - DNA, 15 bp, Homo sapiens
acatcttcatataaa

SEQ ID NO: 4608795 - DNA, 16 bp, Homo sapiens
acatcttcatataaac

SEQ ID NO: 4608796 - DNA, 15 bp, Homo sapiens
acatgaaaaatttta

SEQ ID NO: 4608797 - DNA, 21 bp, Homo sapiens
acatgaaagtagcagtgtgaa

SEQ ID NO: 4608798 - DNA, 20 bp, Homo sapiens
acatgaatcccacccacatg

SEQ ID NO: 4608799 - DNA, 21 bp, Homo sapiens
acatgaatcccacccacatgt

SEQ ID NO: 4608800 - DNA, 13 bp, Homo sapiens
acatgacatccag

SEQ ID NO: 4608801 - DNA, 17 bp, Homo sapiens
acatgacattcttagct

SEQ ID NO: 4608802 - DNA, 17 bp, Homo sapiens
acatgagatcagggcct

SEQ ID NO: 4608803 - DNA, 13 bp, Homo sapiens
acatgagttcaaa

SEQ ID NO: 4608804 - DNA, 14 bp, Homo sapiens
acatgatacatttt

SEQ ID NO: 4608805 - DNA, 15 bp, Homo sapiens
acatgatactgctgc

SEQ ID NO: 4608806 - DNA, 23 bp, Homo sapiens
acatgatactgctgcttgtcaaa

SEQ ID NO: 4608807 - DNA, 14 bp, Homo sapiens
acatgatgttatgt

SEQ ID NO: 4608808 - DNA, 22 bp, Homo sapiens
acatgatgttatgtaccatatg

SEQ ID NO: 4608809 - DNA, 16 bp, Homo sapiens
acatgcaccttgctcc

SEQ ID NO: 4608810 - DNA, 23 bp, Homo sapiens
acatgcaccttgctcccaatggt

SEQ ID NO: 4608811 - DNA, 16 bp, Homo sapiens
acatgcccaaaactta

SEQ ID NO: 4608812 - DNA, 22 bp, Homo sapiens
acatgcggtagccagcacacag

SEQ ID NO: 4608813 - DNA, 15 bp, Homo sapiens
acatgctatgttctg

SEQ ID NO: 4608814 - DNA, 22 bp, Homo sapiens
acatgctatgttctgtcttccc

SEQ ID NO: 4608815 - DNA, 20 bp, Homo sapiens
acatgcttttctgccactcc

SEQ ID NO: 4608816 - DNA, 21 bp, Homo sapiens
acatgcttttctgccactcca

SEQ ID NO: 4608817 - DNA, 20 bp, Homo sapiens
acatggcctatgcacatatg

SEQ ID NO: 4608818 - DNA, 13 bp, Homo sapiens
acatgtaatttga

SEQ ID NO: 4608819 - DNA, 14 bp, Homo sapiens
acatgtagcttctt

SEQ ID NO: 4608820 - DNA, 21 bp, Homo sapiens
acatgtaggtaggaagcactg

SEQ ID NO: 4608821 - DNA, 15 bp, Homo sapiens
acatgtcagttttat

SEQ ID NO: 4608822 - DNA, 19 bp, Homo sapiens
acatgtcttgtacatgtgt

SEQ ID NO: 4608823 - DNA, 15 bp, Homo sapiens
acatgtgacacatat

SEQ ID NO: 4608824 - DNA, 23 bp, Homo sapiens
acatgtggttacacagtgtgaat

SEQ ID NO: 4608825 - DNA, 20 bp, Homo sapiens
acatgtgtatattcctttta

SEQ ID NO: 4608826 - DNA, 19 bp, Homo sapiens
acatgtgtgcagagcagac

SEQ ID NO: 4608827 - DNA, 22 bp, Homo sapiens
acatgtgtgcagagcagacagg

SEQ ID NO: 4608828 - DNA, 22 bp, Homo sapiens
acctaataattgtatctacatt

SEQ ID NO: 4608829 - DNA, 15 bp, Homo sapiens
acctacaagatttcc

SEQ ID NO: 4608830 - DNA, 16 bp, Homo sapiens
acctacagtgtacagt

SEQ ID NO: 4608831 - DNA, 20 bp, Homo sapiens
acctacatattccatgtttg

SEQ ID NO: 4608832 - DNA, 14 bp, Homo sapiens
acctactcacacag

SEQ ID NO: 4608833 - DNA, 14 bp, Homo sapiens
acctagcagcaccg

SEQ ID NO: 4608834 - DNA, 15 bp, Homo sapiens
acctagcagcctcaa

SEQ ID NO: 4608835 - DNA, 18 bp, Homo sapiens
acctagctggctctgtga

SEQ ID NO: 4608836 - DNA, 17 bp, Homo sapiens
acctatctgtggaaagc

SEQ ID NO: 4608837 - DNA, 16 bp, Homo sapiens
acctcaaactatctgg

SEQ ID NO: 4608838 - DNA, 20 bp, Homo sapiens
acctcaaactatctggccat

SEQ ID NO: 4608839 - DNA, 20 bp, Homo sapiens
acctcaagtgatcctcccac

SEQ ID NO: 4608840 - DNA, 16 bp, Homo sapiens
acctcacaactccttc

SEQ ID NO: 4608841 - DNA, 12 bp, Homo sapiens
acctcaccccac

SEQ ID NO: 4608842 - DNA, 13 bp, Homo sapiens
acctcagaagtaa

SEQ ID NO: 4608843 - DNA, 20 bp, Homo sapiens
acctcagaagtaaaggaatt

SEQ ID NO: 4608844 - DNA, 18 bp, Homo sapiens
acctcatctgtggagctg

SEQ ID NO: 4608845 - DNA, 19 bp, Homo sapiens
acctccaaaagccctgagt

SEQ ID NO: 4608846 - DNA, 14 bp, Homo sapiens
acctccaggcctgt

SEQ ID NO: 4608847 - DNA, 14 bp, Homo sapiens
acctccccagccca

SEQ ID NO: 4608848 - DNA, 19 bp, Homo sapiens
acctcctctgccagcagga

SEQ ID NO: 4608849 - DNA, 14 bp, Homo sapiens
acctcctctgtgaa

SEQ ID NO: 4608850 - DNA, 18 bp, Homo sapiens
acctcctctgtgaagcat

SEQ ID NO: 4608851 - DNA, 12 bp, Homo sapiens
acctcctgctgg

SEQ ID NO: 4608852 - DNA, 13 bp, Homo sapiens
acctcctgctggg

SEQ ID NO: 4608853 - DNA, 16 bp, Homo sapiens
acctcctgctgggcag

SEQ ID NO: 4608854 - DNA, 14 bp, Homo sapiens
acctccttccccag

SEQ ID NO: 4608855 - DNA, 22 bp, Homo sapiens
acctcggagggatggagaaaga

SEQ ID NO: 4608856 - DNA, 13 bp, Homo sapiens
acctcggggtggg

SEQ ID NO: 4608857 - DNA, 14 bp, Homo sapiens
acctcggggtgggg

SEQ ID NO: 4608858 - DNA, 21 bp, Homo sapiens
acctctcttggaaagacacaa

SEQ ID NO: 4608859 - DNA, 14 bp, Homo sapiens
acctctgcttccca

SEQ ID NO: 4608860 - DNA, 17 bp, Homo sapiens
acctctgcttcccaggt

SEQ ID NO: 4608861 - DNA, 19 bp, Homo sapiens
acctctgcttcccaggttc

SEQ ID NO: 4608862 - DNA, 21 bp, Homo sapiens
acctctggattaggtctctgt

SEQ ID NO: 4608863 - DNA, 15 bp, Homo sapiens
acctctgggacccca

SEQ ID NO: 4608864 - DNA, 20 bp, Homo sapiens
acctctgggaccccagctgc

SEQ ID NO: 4608865 - DNA, 19 bp, Homo sapiens
acctctgtcttggctttca

SEQ ID NO: 4608866 - DNA, 17 bp, Homo sapiens
acctctgttcagtgtaa

SEQ ID NO: 4608867 - DNA, 19 bp, Homo sapiens
acctctgttccccacccag

SEQ ID NO: 4608868 - DNA, 18 bp, Homo sapiens
acctgaaagaacatacat

SEQ ID NO: 4608869 - DNA, 10 bp, Homo sapiens
acctgagcct

SEQ ID NO: 4608870 - DNA, 12 bp, Homo sapiens
acctgagcctgc

SEQ ID NO: 4608871 - DNA, 13 bp, Homo sapiens
acctgagcctgcc

SEQ ID NO: 4608872 - DNA, 21 bp, Homo sapiens
acctgagcctgccgagcaacc

SEQ ID NO: 4608873 - DNA, 20 bp, Homo sapiens
acctgcatggtcaagcctct

SEQ ID NO: 4608874 - DNA, 13 bp, Homo sapiens
acctgccaagagt

SEQ ID NO: 4608875 - DNA, 13 bp, Homo sapiens
acctgccagccac

SEQ ID NO: 4608876 - DNA, 19 bp, Homo sapiens
acctgccccgtagagaatg

SEQ ID NO: 4608877 - DNA, 19 bp, Homo sapiens
acctgctagtcgcccctca

SEQ ID NO: 4608878 - DNA, 21 bp, Homo sapiens
acctgctagtcgcccctcaga

SEQ ID NO: 4608879 - DNA, 22 bp, Homo sapiens
acctgctagtcgcccctcagag

SEQ ID NO: 4608880 - DNA, 23 bp, Homo sapiens
acctgctagtcgcccctcagagc

SEQ ID NO: 4608881 - DNA, 11 bp, Homo sapiens
acctgctgagc

SEQ ID NO: 4608882 - DNA, 14 bp, Homo sapiens
acctgctgagctct

SEQ ID NO: 4608883 - DNA, 15 bp, Homo sapiens
acctgctgagctctg

SEQ ID NO: 4608884 - DNA, 14 bp, Homo sapiens
acctggaggggaga

SEQ ID NO: 4608885 - DNA, 21 bp, Homo sapiens
acctggaggggagaggtcagc

SEQ ID NO: 4608886 - DNA, 23 bp, Homo sapiens
acctggccttaaagagggacagg

SEQ ID NO: 4608887 - DNA, 11 bp, Homo sapiens
acctggccttc

SEQ ID NO: 4608888 - DNA, 23 bp, Homo sapiens
acctgggacaagcaggccgccct

SEQ ID NO: 4608889 - DNA, 10 bp, Homo sapiens
acctgggacc

SEQ ID NO: 4608890 - DNA, 14 bp, Homo sapiens
acctggggtgaata

SEQ ID NO: 4608891 - DNA, 17 bp, Homo sapiens
acctggggtgaatactt

SEQ ID NO: 4608892 - DNA, 18 bp, Homo sapiens
acctggggtgaatactta

SEQ ID NO: 4608893 - DNA, 14 bp, Homo sapiens
acctgtccccaccc

SEQ ID NO: 4608894 - DNA, 21 bp, Homo sapiens
acctgtccccaccctccactc

SEQ ID NO: 4608895 - DNA, 17 bp, Homo sapiens
acctgtctctctcttct

SEQ ID NO: 4608896 - DNA, 23 bp, Homo sapiens
acctgtctctctcttctctctag

SEQ ID NO: 4608897 - DNA, 17 bp, Homo sapiens
acctgtgagcccagctg

SEQ ID NO: 4608898 - DNA, 16 bp, Homo sapiens
acctgtgcctgcttct

SEQ ID NO: 4608899 - DNA, 12 bp, Homo sapiens
acctgtgggtgt

SEQ ID NO: 4608900 - DNA, 16 bp, Homo sapiens
acctgttcttgggcct

SEQ ID NO: 4608901 - DNA, 21 bp, Homo sapiens
accttaaaatgtgtacagtga

SEQ ID NO: 4608902 - DNA, 13 bp, Homo sapiens
accttactaatta

SEQ ID NO: 4608903 - DNA, 23 bp, Homo sapiens
accttagccccattgctccattc

SEQ ID NO: 4608904 - DNA, 23 bp, Homo sapiens
accttaggaataatctcctgtta

SEQ ID NO: 4608905 - DNA, 22 bp, Homo sapiens
accttcatgattatagcaacta

SEQ ID NO: 4608906 - DNA, 21 bp, Homo sapiens
accttcccttcctcagcaggc

SEQ ID NO: 4608907 - DNA, 14 bp, Homo sapiens
accttctcccaggc

SEQ ID NO: 4608908 - DNA, 17 bp, Homo sapiens
accttgatgagctgtgc

SEQ ID NO: 4608909 - DNA, 21 bp, Homo sapiens
accttgctcccaatggtgctt

SEQ ID NO: 4608910 - DNA, 15 bp, Homo sapiens
accttgctcttgggg

SEQ ID NO: 4608911 - DNA, 15 bp, Homo sapiens
accttggtgagatgg

SEQ ID NO: 4608912 - DNA, 14 bp, Homo sapiens
accttgttctattt

SEQ ID NO: 4608913 - DNA, 20 bp, Homo sapiens
accttgttctatttttcaat

SEQ ID NO: 4608914 - DNA, 17 bp, Homo sapiens
accttgtttattagcat

SEQ ID NO: 4608915 - DNA, 12 bp, Homo sapiens
acctttaaatat

SEQ ID NO: 4608916 - DNA, 20 bp, Homo sapiens
acctttaaatatcattcttt

SEQ ID NO: 4608917 - DNA, 17 bp, Homo sapiens
acctttaaatgcaacag

SEQ ID NO: 4608918 - DNA, 18 bp, Homo sapiens
acctttaaatgcaacagt

SEQ ID NO: 4608919 - DNA, 18 bp, Homo sapiens
acgaacctcggggtgggg

SEQ ID NO: 4608920 - DNA, 14 bp, Homo sapiens
acgagactttctcc

SEQ ID NO: 4608921 - DNA, 19 bp, Homo sapiens
acgagccacaagctgcact

SEQ ID NO: 4608922 - DNA, 20 bp, Homo sapiens
acgagccacaagctgcactg

SEQ ID NO: 4608923 - DNA, 21 bp, Homo sapiens
acgagttaatgatggcagagg

SEQ ID NO: 4608924 - DNA, 14 bp, Homo sapiens
acgatatttcgttt

SEQ ID NO: 4608925 - DNA, 16 bp, Homo sapiens
acgcaccgcctgaagg

SEQ ID NO: 4608926 - DNA, 16 bp, Homo sapiens
acgcactggacagcat

SEQ ID NO: 4608927 - DNA, 15 bp, Homo sapiens
acgccagataaaatg

SEQ ID NO: 4608928 - DNA, 16 bp, Homo sapiens
acgcccgagagcctcg

SEQ ID NO: 4608929 - DNA, 18 bp, Homo sapiens
acgcctgagcccagggag

SEQ ID NO: 4608930 - DNA, 15 bp, Homo sapiens
acgccttccctaagt

SEQ ID NO: 4608931 - DNA, 22 bp, Homo sapiens
acgctgttctaatggcacttat

SEQ ID NO: 4608932 - DNA, 23 bp, Homo sapiens
acgcttgtagaactcactctggg

SEQ ID NO: 4608933 - DNA, 21 bp, Homo sapiens
acggaagtggtggctgtggaa

SEQ ID NO: 4608934 - DNA, 17 bp, Homo sapiens
acggatgcgtgggcaga

SEQ ID NO: 4608935 - DNA, 18 bp, Homo sapiens
acggatgcgtgggcagag

SEQ ID NO: 4608936 - DNA, 19 bp, Homo sapiens
acggcacctgggccctggg

SEQ ID NO: 4608937 - DNA, 21 bp, Homo sapiens
acggcacctgggccctggggc

SEQ ID NO: 4608938 - DNA, 16 bp, Homo sapiens
acggcactgtggcctt

SEQ ID NO: 4608939 - DNA, 22 bp, Homo sapiens
acggccatctctttgtacagga

SEQ ID NO: 4608940 - DNA, 12 bp, Homo sapiens
acggccctggcc

SEQ ID NO: 4608941 - DNA, 14 bp, Homo sapiens
acggccctggcctt

SEQ ID NO: 4608942 - DNA, 23 bp, Homo sapiens
acggccctggccttgggccctct

SEQ ID NO: 4608943 - DNA, 17 bp, Homo sapiens
acggccttgatcccctt

SEQ ID NO: 4608944 - DNA, 23 bp, Homo sapiens
acggctcccacggagcatctcag

SEQ ID NO: 4608945 - DNA, 12 bp, Homo sapiens
acgggaggggag

SEQ ID NO: 4608946 - DNA, 13 bp, Homo sapiens
acgggaggggagg

SEQ ID NO: 4608947 - DNA, 19 bp, Homo sapiens
acgggaggggaggcattga

SEQ ID NO: 4608948 - DNA, 13 bp, Homo sapiens
acggtctggcagg

SEQ ID NO: 4608949 - DNA, 20 bp, Homo sapiens
acggtctgttcttgaagcag

SEQ ID NO: 4608950 - DNA, 13 bp, Homo sapiens
acggtgctaaaaa

SEQ ID NO: 4608951 - DNA, 16 bp, Homo sapiens
acggttatttaagcat

SEQ ID NO: 4608952 - DNA, 16 bp, Homo sapiens
acggtttcagctagac

SEQ ID NO: 4608953 - DNA, 14 bp, Homo sapiens
acgtaatcctcctg

SEQ ID NO: 4608954 - DNA, 13 bp, Homo sapiens
acgtatgcatgtg

SEQ ID NO: 4608955 - DNA, 19 bp, Homo sapiens
acgtcatgagcgtcaaaga

SEQ ID NO: 4608956 - DNA, 20 bp, Homo sapiens
acgtcatgagcgtcaaagaa

SEQ ID NO: 4608957 - DNA, 19 bp, Homo sapiens
acgtcccagcatccctgga

SEQ ID NO: 4608958 - DNA, 22 bp, Homo sapiens
acgtcccagcatccctggagca

SEQ ID NO: 4608959 - DNA, 18 bp, Homo sapiens
acgtctggactgctattc

SEQ ID NO: 4608960 - DNA, 12 bp, Homo sapiens
acgtctggctcc

SEQ ID NO: 4608961 - DNA, 22 bp, Homo sapiens
acgtctgggagaaattgacaga

SEQ ID NO: 4608962 - DNA, 19 bp, Homo sapiens
acgtgagagaaagagagaa

SEQ ID NO: 4608963 - DNA, 21 bp, Homo sapiens
acgtgagagaaagagagaagc

SEQ ID NO: 4608964 - DNA, 23 bp, Homo sapiens
acgtgagagaaagagagaagcca

SEQ ID NO: 4608965 - DNA, 15 bp, Homo sapiens
acgtggctctgctgg

SEQ ID NO: 4608966 - DNA, 13 bp, Homo sapiens
acgtgtgaaatct

SEQ ID NO: 4608967 - DNA, 18 bp, Homo sapiens
acgtgtgaaatctgtctt

SEQ ID NO: 4608968 - DNA, 14 bp, Homo sapiens
acgtgttgtatcta

SEQ ID NO: 4608969 - DNA, 20 bp, Homo sapiens
acgttaggcatttcctgctg

SEQ ID NO: 4608970 - DNA, 21 bp, Homo sapiens
acgtttgcagttgatgtgtct

SEQ ID NO: 4608971 - DNA, 17 bp, Homo sapiens
acgttttttcctcagtg

SEQ ID NO: 4608972 - DNA, 18 bp, Homo sapiens
acgttttttcctcagtgc

SEQ ID NO: 4608973 - DNA, 13 bp, Homo sapiens
actaaaaatatag

SEQ ID NO: 4608974 - DNA, 15 bp, Homo sapiens
actaaacagaaaact

SEQ ID NO: 4608975 - DNA, 19 bp, Homo sapiens
actaaatatatattatgca

SEQ ID NO: 4608976 - DNA, 15 bp, Homo sapiens
actaacactcagaag

SEQ ID NO: 4608977 - DNA, 17 bp, Homo sapiens
actaacactcagaagcc

SEQ ID NO: 4608978 - DNA, 13 bp, Homo sapiens
actaacttctaaa

SEQ ID NO: 4608979 - DNA, 15 bp, Homo sapiens
actaacttctaaaga

SEQ ID NO: 4608980 - DNA, 17 bp, Homo sapiens
actaatatagtagattt

SEQ ID NO: 4608981 - DNA, 21 bp, Homo sapiens
actaatgagggaaatctgtaa

SEQ ID NO: 4608982 - DNA, 22 bp, Homo sapiens
actaatgcttacaactttctaa

SEQ ID NO: 4608983 - DNA, 15 bp, Homo sapiens
actaatgtaaaatga

SEQ ID NO: 4608984 - DNA, 17 bp, Homo sapiens
actaattatactacttt

SEQ ID NO: 4608985 - DNA, 19 bp, Homo sapiens
actaatttttgtattattt

SEQ ID NO: 4608986 - DNA, 13 bp, Homo sapiens
actacacattttt

SEQ ID NO: 4608987 - DNA, 15 bp, Homo sapiens
actacacatttttaa

SEQ ID NO: 4608988 - DNA, 15 bp, Homo sapiens
actacatattgtctg

SEQ ID NO: 4608989 - DNA, 15 bp, Homo sapiens
actacattttttcta

SEQ ID NO: 4608990 - DNA, 21 bp, Homo sapiens
actaccctttgctggaagaaa

SEQ ID NO: 4608991 - DNA, 14 bp, Homo sapiens
actacggttgggag

SEQ ID NO: 4608992 - DNA, 12 bp, Homo sapiens
actactgcagca

SEQ ID NO: 4608993 - DNA, 12 bp, Homo sapiens
actactgggtgt

SEQ ID NO: 4608994 - DNA, 18 bp, Homo sapiens
actactgggtgtcatttc

SEQ ID NO: 4608995 - DNA, 19 bp, Homo sapiens
actactgggtgtcatttca

SEQ ID NO: 4608996 - DNA, 22 bp, Homo sapiens
actactttgttaggattttcac

SEQ ID NO: 4608997 - DNA, 13 bp, Homo sapiens
actagaattctgt

SEQ ID NO: 4608998 - DNA, 21 bp, Homo sapiens
actagcaggctactgggacct

SEQ ID NO: 4608999 - DNA, 14 bp, Homo sapiens
actagccaaaccag

SEQ ID NO: 4609000 - DNA, 18 bp, Homo sapiens
actagccaaaccaggacc

SEQ ID NO: 4609001 - DNA, 15 bp, Homo sapiens
actaggatactgctg

SEQ ID NO: 4609002 - DNA, 23 bp, Homo sapiens
actaggctgagcaatctgaccct

SEQ ID NO: 4609003 - DNA, 23 bp, Homo sapiens
actaggtatttctaacgccagca

SEQ ID NO: 4609004 - DNA, 18 bp, Homo sapiens
actaggttagcatcctgc

SEQ ID NO: 4609005 - DNA, 14 bp, Homo sapiens
actagtagatttct

SEQ ID NO: 4609006 - DNA, 17 bp, Homo sapiens
actagtgcaattccaag

SEQ ID NO: 4609007 - DNA, 18 bp, Homo sapiens
actagttttactttgaac

SEQ ID NO: 4609008 - DNA, 19 bp, Homo sapiens
actatataatttatttcca

SEQ ID NO: 4609009 - DNA, 15 bp, Homo sapiens
actatcaccagtgca

SEQ ID NO: 4609010 - DNA, 14 bp, Homo sapiens
actatcataaaatc

SEQ ID NO: 4609011 - DNA, 13 bp, Homo sapiens
actatgttcctaa

SEQ ID NO: 4609012 - DNA, 17 bp, Homo sapiens
actattaaaatattttg

SEQ ID NO: 4609013 - DNA, 13 bp, Homo sapiens
actattaaccttt

SEQ ID NO: 4609014 - DNA, 14 bp, Homo sapiens
actattaacctttt

SEQ ID NO: 4609015 - DNA, 15 bp, Homo sapiens
actattcatggctac

SEQ ID NO: 4609016 - DNA, 13 bp, Homo sapiens
actattttcaaag

SEQ ID NO: 4609017 - DNA, 15 bp, Homo sapiens
actcaagaagcacac

SEQ ID NO: 4609018 - DNA, 22 bp, Homo sapiens
actcaagtgtcacctccttccc

SEQ ID NO: 4609019 - DNA, 23 bp, Homo sapiens
actcaagtgtcacctccttcccc

SEQ ID NO: 4609020 - DNA, 12 bp, Homo sapiens
actcacacaggc

SEQ ID NO: 4609021 - DNA, 13 bp, Homo sapiens
actcacacaggca

SEQ ID NO: 4609022 - DNA, 14 bp, Homo sapiens
actcacacaggcat

SEQ ID NO: 4609023 - DNA, 19 bp, Homo sapiens
actcacacaggcatttcct

SEQ ID NO: 4609024 - DNA, 20 bp, Homo sapiens
actcacacaggcatttcctg

SEQ ID NO: 4609025 - DNA, 22 bp, Homo sapiens
actcacacaggcatttcctggg

SEQ ID NO: 4609026 - DNA, 15 bp, Homo sapiens
actcacacccctgcc

SEQ ID NO: 4609027 - DNA, 11 bp, Homo sapiens
actcacctgcg

SEQ ID NO: 4609028 - DNA, 13 bp, Homo sapiens
actcactctgggc

SEQ ID NO: 4609029 - DNA, 15 bp, Homo sapiens
actcagaagcctggg

SEQ ID NO: 4609030 - DNA, 17 bp, Homo sapiens
actcagaagcctggggg

SEQ ID NO: 4609031 - DNA, 21 bp, Homo sapiens
actcagaagcctgggggcctg

SEQ ID NO: 4609032 - DNA, 22 bp, Homo sapiens
actcagaagcctgggggcctgg

SEQ ID NO: 4609033 - DNA, 15 bp, Homo sapiens
actcagcacaaggcc

SEQ ID NO: 4609034 - DNA, 17 bp, Homo sapiens
actcagggaccggtgct

SEQ ID NO: 4609035 - DNA, 23 bp, Homo sapiens
actcagggaccggtgctgcagga

SEQ ID NO: 4609036 - DNA, 17 bp, Homo sapiens
actcagggcagcgccag

SEQ ID NO: 4609037 - DNA, 21 bp, Homo sapiens
actcagggcagcgccaggctg

SEQ ID NO: 4609038 - DNA, 23 bp, Homo sapiens
actcagtttatgttgtacaatgt

SEQ ID NO: 4609039 - DNA, 16 bp, Homo sapiens
actcagttttttgtaa

SEQ ID NO: 4609040 - DNA, 18 bp, Homo sapiens
actcatagccacttttat

SEQ ID NO: 4609041 - DNA, 23 bp, Homo sapiens
actcatcctcttttaatggcatt

SEQ ID NO: 4609042 - DNA, 18 bp, Homo sapiens
actcatccttgcccaggt

SEQ ID NO: 4609043 - DNA, 16 bp, Homo sapiens
actccaaacctgtctt

SEQ ID NO: 4609044 - DNA, 19 bp, Homo sapiens
actccaagatatggacaca

SEQ ID NO: 4609045 - DNA, 20 bp, Homo sapiens
actccacggatgcgtgggca

SEQ ID NO: 4609046 - DNA, 22 bp, Homo sapiens
actccacggatgcgtgggcaga

SEQ ID NO: 4609047 - DNA, 21 bp, Homo sapiens
actccagggaagattttatat

SEQ ID NO: 4609048 - DNA, 14 bp, Homo sapiens
actccagttgcaga

SEQ ID NO: 4609049 - DNA, 16 bp, Homo sapiens
actcccaaccctggct

SEQ ID NO: 4609050 - DNA, 17 bp, Homo sapiens
actccccagagctgtgc

SEQ ID NO: 4609051 - DNA, 19 bp, Homo sapiens
actccccagagctgtgcca

SEQ ID NO: 4609052 - DNA, 20 bp, Homo sapiens
actccccagagctgtgccag

SEQ ID NO: 4609053 - DNA, 16 bp, Homo sapiens
actccctaggcccaag

SEQ ID NO: 4609054 - DNA, 17 bp, Homo sapiens
actccctaggcccaagt

SEQ ID NO: 4609055 - DNA, 12 bp, Homo sapiens
actccctccacc

SEQ ID NO: 4609056 - DNA, 13 bp, Homo sapiens
actccctccacca

SEQ ID NO: 4609057 - DNA, 14 bp, Homo sapiens
actccctccaccag

SEQ ID NO: 4609058 - DNA, 16 bp, Homo sapiens
actccctccaccagcc

SEQ ID NO: 4609059 - DNA, 21 bp, Homo sapiens
actccctccaccagcctgctg

SEQ ID NO: 4609060 - DNA, 15 bp, Homo sapiens
actccctcttgtcag

SEQ ID NO: 4609061 - DNA, 15 bp, Homo sapiens
actcccttctgcttg

SEQ ID NO: 4609062 - DNA, 21 bp, Homo sapiens
actccgaggtggttcagacaa

SEQ ID NO: 4609063 - DNA, 17 bp, Homo sapiens
actccgccagccacagg

SEQ ID NO: 4609064 - DNA, 19 bp, Homo sapiens
actccgccagccacaggac

SEQ ID NO: 4609065 - DNA, 20 bp, Homo sapiens
actccgccagccacaggacc

SEQ ID NO: 4609066 - DNA, 22 bp, Homo sapiens
actccgccagccacaggaccac

SEQ ID NO: 4609067 - DNA, 19 bp, Homo sapiens
actccgcgccgatgccacc

SEQ ID NO: 4609068 - DNA, 19 bp, Homo sapiens
actcctaaacctttgcccc

SEQ ID NO: 4609069 - DNA, 18 bp, Homo sapiens
actcctaacctcaagtga

SEQ ID NO: 4609070 - DNA, 16 bp, Homo sapiens
actcctgacctcaggt

SEQ ID NO: 4609071 - DNA, 13 bp, Homo sapiens
actcctgacctcg

SEQ ID NO: 4609072 - DNA, 21 bp, Homo sapiens
actcctgaggacagctgtcct

SEQ ID NO: 4609073 - DNA, 18 bp, Homo sapiens
actcctgctggtacctgc

SEQ ID NO: 4609074 - DNA, 22 bp, Homo sapiens
actcctgctggtacctgccctc

SEQ ID NO: 4609075 - DNA, 16 bp, Homo sapiens
actcctgtgggagcct

SEQ ID NO: 4609076 - DNA, 19 bp, Homo sapiens
actcctgtgggagcctcgc

SEQ ID NO: 4609077 - DNA, 14 bp, Homo sapiens
actccttccatcct

SEQ ID NO: 4609078 - DNA, 14 bp, Homo sapiens
actccttcctgccc

SEQ ID NO: 4609079 - DNA, 21 bp, Homo sapiens
actccttctctcactgtgtta

SEQ ID NO: 4609080 - DNA, 20 bp, Homo sapiens
actcctttccaatagaaaga

SEQ ID NO: 4609081 - DNA, 15 bp, Homo sapiens
actcggggtccctgg

SEQ ID NO: 4609082 - DNA, 14 bp, Homo sapiens
actctacacagctc

SEQ ID NO: 4609083 - DNA, 19 bp, Homo sapiens
actctaggttatacaataa

SEQ ID NO: 4609084 - DNA, 12 bp, Homo sapiens
actctcaccatg

SEQ ID NO: 4609085 - DNA, 21 bp, Homo sapiens
actctcaccatgatgtgaaga

SEQ ID NO: 4609086 - DNA, 11 bp, Homo sapiens
actctccaggg

SEQ ID NO: 4609087 - DNA, 13 bp, Homo sapiens
actctcccctccc

SEQ ID NO: 4609088 - DNA, 16 bp, Homo sapiens
actctcccctccccat

SEQ ID NO: 4609089 - DNA, 18 bp, Homo sapiens
actctcccctccccatct

SEQ ID NO: 4609090 - DNA, 23 bp, Homo sapiens
actctcccctccccatctgtgtt

SEQ ID NO: 4609091 - DNA, 13 bp, Homo sapiens
actctcctctttt

SEQ ID NO: 4609092 - DNA, 13 bp, Homo sapiens
actctcctggcct

SEQ ID NO: 4609093 - DNA, 22 bp, Homo sapiens
actctctggaagcccctgggcc

SEQ ID NO: 4609094 - DNA, 14 bp, Homo sapiens
actctcttctccat

SEQ ID NO: 4609095 - DNA, 21 bp, Homo sapiens
actctcttctccattccctag

SEQ ID NO: 4609096 - DNA, 13 bp, Homo sapiens
actctgacaagct

SEQ ID NO: 4609097 - DNA, 17 bp, Homo sapiens
actctgcacatgtcttg

SEQ ID NO: 4609098 - DNA, 16 bp, Homo sapiens
actctgctctgatgca

SEQ ID NO: 4609099 - DNA, 22 bp, Homo sapiens
actctgctgtctaacctgtgac

SEQ ID NO: 4609100 - DNA, 23 bp, Homo sapiens
actctgctgtctaacctgtgacc

SEQ ID NO: 4609101 - DNA, 13 bp, Homo sapiens
actctggcagcca

SEQ ID NO: 4609102 - DNA, 15 bp, Homo sapiens
actctggcagccaca

SEQ ID NO: 4609103 - DNA, 16 bp, Homo sapiens
actctggcagccacac

SEQ ID NO: 4609104 - DNA, 17 bp, Homo sapiens
actctggcagccacact

SEQ ID NO: 4609105 - DNA, 13 bp, Homo sapiens
actctggccctgg

SEQ ID NO: 4609106 - DNA, 16 bp, Homo sapiens
actctggccctggccc

SEQ ID NO: 4609107 - DNA, 11 bp, Homo sapiens
actctgtccag

SEQ ID NO: 4609108 - DNA, 15 bp, Homo sapiens
actctgtgccagagc

SEQ ID NO: 4609109 - DNA, 22 bp, Homo sapiens
actctgtgtctgagtggcttca

SEQ ID NO: 4609110 - DNA, 16 bp, Homo sapiens
actctgttcctggctc

SEQ ID NO: 4609111 - DNA, 16 bp, Homo sapiens
actctgttgcctcctc

SEQ ID NO: 4609112 - DNA, 19 bp, Homo sapiens
actctgttgcctcctctct

SEQ ID NO: 4609113 - DNA, 21 bp, Homo sapiens
actctgttgcctcctctctcc

SEQ ID NO: 4609114 - DNA, 16 bp, Homo sapiens
actcttgctcctgctt

SEQ ID NO: 4609115 - DNA, 18 bp, Homo sapiens
actcttgttgaagtgctg

SEQ ID NO: 4609116 - DNA, 13 bp, Homo sapiens
actctttaataaa

SEQ ID NO: 4609117 - DNA, 15 bp, Homo sapiens
actcttttgctgtgc

SEQ ID NO: 4609118 - DNA, 18 bp, Homo sapiens
actctttttgttttttgt

SEQ ID NO: 4609119 - DNA, 13 bp, Homo sapiens
actgaacattcca

SEQ ID NO: 4609120 - DNA, 17 bp, Homo sapiens
actgaaccacaaaaaaa

SEQ ID NO: 4609121 - DNA, 19 bp, Homo sapiens
actgaagcgaacatcttca

SEQ ID NO: 4609122 - DNA, 20 bp, Homo sapiens
actgaagcgaacatcttcat

SEQ ID NO: 4609123 - DNA, 23 bp, Homo sapiens
actgaagcgaacatcttcatata

SEQ ID NO: 4609124 - DNA, 13 bp, Homo sapiens
actgaaggaaaag

SEQ ID NO: 4609125 - DNA, 22 bp, Homo sapiens
actgaataatatcaaataaaat

SEQ ID NO: 4609126 - DNA, 17 bp, Homo sapiens
actgaatataaagctta

SEQ ID NO: 4609127 - DNA, 21 bp, Homo sapiens
actgaatataaagcttaataa

SEQ ID NO: 4609128 - DNA, 14 bp, Homo sapiens
actgacaacattat

SEQ ID NO: 4609129 - DNA, 12 bp, Homo sapiens
actgacacaggg

SEQ ID NO: 4609130 - DNA, 20 bp, Homo sapiens
actgacaggcagcctggaca

SEQ ID NO: 4609131 - DNA, 19 bp, Homo sapiens
actgaccttgatgagctgt

SEQ ID NO: 4609132 - DNA, 21 bp, Homo sapiens
actgactggattcattctcat

SEQ ID NO: 4609133 - DNA, 18 bp, Homo sapiens
actgagaatctaggccac

SEQ ID NO: 4609134 - DNA, 22 bp, Homo sapiens
actgaggagatgaccagggatg

SEQ ID NO: 4609135 - DNA, 23 bp, Homo sapiens
actgaggcccaaagcacttgctt

SEQ ID NO: 4609136 - DNA, 23 bp, Homo sapiens
actgaggcccacggtttcagcta

SEQ ID NO: 4609137 - DNA, 19 bp, Homo sapiens
actgataaaagttttgata

SEQ ID NO: 4609138 - DNA, 17 bp, Homo sapiens
actgatgagtaaactga

SEQ ID NO: 4609139 - DNA, 16 bp, Homo sapiens
actgatgagtcttgat

SEQ ID NO: 4609140 - DNA, 16 bp, Homo sapiens
actgattgctcccagg

SEQ ID NO: 4609141 - DNA, 18 bp, Homo sapiens
actgcaacctctgcctcc

SEQ ID NO: 4609142 - DNA, 19 bp, Homo sapiens
actgcaacctctgcctcct

SEQ ID NO: 4609143 - DNA, 19 bp, Homo sapiens
actgcaatctctgcctccc

SEQ ID NO: 4609144 - DNA, 15 bp, Homo sapiens
actgcactccagcct

SEQ ID NO: 4609145 - DNA, 21 bp, Homo sapiens
actgcactttccaatgccaca

SEQ ID NO: 4609146 - DNA, 22 bp, Homo sapiens
actgcactttccaatgccacag

SEQ ID NO: 4609147 - DNA, 14 bp, Homo sapiens
actgccaagccaga

SEQ ID NO: 4609148 - DNA, 12 bp, Homo sapiens
actgccaggagg

SEQ ID NO: 4609149 - DNA, 13 bp, Homo sapiens
actgccaggaggg

SEQ ID NO: 4609150 - DNA, 14 bp, Homo sapiens
actgccaggaggga

SEQ ID NO: 4609151 - DNA, 13 bp, Homo sapiens
actgccaggctgt

SEQ ID NO: 4609152 - DNA, 16 bp, Homo sapiens
actgcccatggacagg

SEQ ID NO: 4609153 - DNA, 21 bp, Homo sapiens
actgcccatggacaggctggc

SEQ ID NO: 4609154 - DNA, 18 bp, Homo sapiens
actgccccacgttgtccc

SEQ ID NO: 4609155 - DNA, 17 bp, Homo sapiens
actgccccctcctgtgt

SEQ ID NO: 4609156 - DNA, 20 bp, Homo sapiens
actgcctataatcttataca

SEQ ID NO: 4609157 - DNA, 16 bp, Homo sapiens
actgcctgaccttgga

SEQ ID NO: 4609158 - DNA, 14 bp, Homo sapiens
actgcctgcttggg

SEQ ID NO: 4609159 - DNA, 19 bp, Homo sapiens
actgcctttggcagagttc

SEQ ID NO: 4609160 - DNA, 17 bp, Homo sapiens
actgctattctagagct

SEQ ID NO: 4609161 - DNA, 14 bp, Homo sapiens
actgctgcttctcc

SEQ ID NO: 4609162 - DNA, 23 bp, Homo sapiens
actgcttgaactaggctgagcaa

SEQ ID NO: 4609163 - DNA, 15 bp, Homo sapiens
actgctttgcaaaga

SEQ ID NO: 4609164 - DNA, 20 bp, Homo sapiens
actgcttttttgattctgaa

SEQ ID NO: 4609165 - DNA, 17 bp, Homo sapiens
actggaggagagaagaa

SEQ ID NO: 4609166 - DNA, 14 bp, Homo sapiens
actggccaagctga

SEQ ID NO: 4609167 - DNA, 17 bp, Homo sapiens
actggcctaaatttctt

SEQ ID NO: 4609168 - DNA, 11 bp, Homo sapiens
actgggaaggc

SEQ ID NO: 4609169 - DNA, 15 bp, Homo sapiens
actgggccccacatg

SEQ ID NO: 4609170 - DNA, 20 bp, Homo sapiens
actgggccttagtgggccag

SEQ ID NO: 4609171 - DNA, 23 bp, Homo sapiens
actggggactttatttatttcta

SEQ ID NO: 4609172 - DNA, 19 bp, Homo sapiens
actggtaagcgatttgaaa

SEQ ID NO: 4609173 - DNA, 23 bp, Homo sapiens
actggtgtcataaactttctcca

SEQ ID NO: 4609174 - DNA, 22 bp, Homo sapiens
actggttatcttgttattattg

SEQ ID NO: 4609175 - DNA, 17 bp, Homo sapiens
actggttttaagtgctt

SEQ ID NO: 4609176 - DNA, 12 bp, Homo sapiens
actgtaaatcat

SEQ ID NO: 4609177 - DNA, 17 bp, Homo sapiens
actgtaatcaaaaggag

SEQ ID NO: 4609178 - DNA, 16 bp, Homo sapiens
actgtaatttctttga

SEQ ID NO: 4609179 - DNA, 14 bp, Homo sapiens
actgtacattatga

SEQ ID NO: 4609180 - DNA, 15 bp, Homo sapiens
actgtactgggccat

SEQ ID NO: 4609181 - DNA, 23 bp, Homo sapiens
actgtagaaaagggaactgaaca

SEQ ID NO: 4609182 - DNA, 16 bp, Homo sapiens
actgtagacactctga

SEQ ID NO: 4609183 - DNA, 15 bp, Homo sapiens
actgtagcttctctt

SEQ ID NO: 4609184 - DNA, 16 bp, Homo sapiens
actgtatgccttctgt

SEQ ID NO: 4609185 - DNA, 17 bp, Homo sapiens
actgtatgccttctgta

SEQ ID NO: 4609186 - DNA, 23 bp, Homo sapiens
actgtcctagccaggtctcctgg

SEQ ID NO: 4609187 - DNA, 13 bp, Homo sapiens
actgtcctgtcct

SEQ ID NO: 4609188 - DNA, 15 bp, Homo sapiens
actgtcctgtcctgc

SEQ ID NO: 4609189 - DNA, 17 bp, Homo sapiens
actgtcctgtcctgctc

SEQ ID NO: 4609190 - DNA, 16 bp, Homo sapiens
actgtcgccacacgcc

SEQ ID NO: 4609191 - DNA, 21 bp, Homo sapiens
actgtcgccacacgcctctgt

SEQ ID NO: 4609192 - DNA, 16 bp, Homo sapiens
actgtgaacagcttgc

SEQ ID NO: 4609193 - DNA, 21 bp, Homo sapiens
actgtgaacagcttgctgtca

SEQ ID NO: 4609194 - DNA, 13 bp, Homo sapiens
actgtgaacttga

SEQ ID NO: 4609195 - DNA, 22 bp, Homo sapiens
actgtgaacttgactgggtgag

SEQ ID NO: 4609196 - DNA, 21 bp, Homo sapiens
actgtgacccccagctccggc

SEQ ID NO: 4609197 - DNA, 22 bp, Homo sapiens
actgtgaggccatacttgtgaa

SEQ ID NO: 4609198 - DNA, 23 bp, Homo sapiens
actgtgaggccatacttgtgaaa

SEQ ID NO: 4609199 - DNA, 15 bp, Homo sapiens
actgtgatacagttt

SEQ ID NO: 4609200 - DNA, 18 bp, Homo sapiens
actgtggaaggcctccct

SEQ ID NO: 4609201 - DNA, 15 bp, Homo sapiens
actgtggccttggtc

SEQ ID NO: 4609202 - DNA, 18 bp, Homo sapiens
actgtggtctggtgttcc

SEQ ID NO: 4609203 - DNA, 21 bp, Homo sapiens
actgtggtgacttctgctgct

SEQ ID NO: 4609204 - DNA, 18 bp, Homo sapiens
actgtgtccctctctctg

SEQ ID NO: 4609205 - DNA, 19 bp, Homo sapiens
actgtgtccctctctctgg

SEQ ID NO: 4609206 - DNA, 21 bp, Homo sapiens
actgtgtccctctctctggaa

SEQ ID NO: 4609207 - DNA, 12 bp, Homo sapiens
actgtgttactg

SEQ ID NO: 4609208 - DNA, 23 bp, Homo sapiens
actgtgttactgctttgcaaaga

SEQ ID NO: 4609209 - DNA, 14 bp, Homo sapiens
actgtgttgccaca

SEQ ID NO: 4609210 - DNA, 17 bp, Homo sapiens
actgtgtttcaaatgga

SEQ ID NO: 4609211 - DNA, 21 bp, Homo sapiens
actgtgtttcaaatggactgt

SEQ ID NO: 4609212 - DNA, 17 bp, Homo sapiens
actgtgtttgatttgtc

SEQ ID NO: 4609213 - DNA, 23 bp, Homo sapiens
actgttaaggacccttttaagca

SEQ ID NO: 4609214 - DNA, 16 bp, Homo sapiens
actgttcatacagttt

SEQ ID NO: 4609215 - DNA, 15 bp, Homo sapiens
actgttcttttgcat

SEQ ID NO: 4609216 - DNA, 16 bp, Homo sapiens
actgttcttttgcatt

SEQ ID NO: 4609217 - DNA, 21 bp, Homo sapiens
actgttgcctttgctcttata

SEQ ID NO: 4609218 - DNA, 15 bp, Homo sapiens
actgttgtccctgca

SEQ ID NO: 4609219 - DNA, 18 bp, Homo sapiens
actgtttcatagttttct

SEQ ID NO: 4609220 - DNA, 13 bp, Homo sapiens
actgtttcatctc

SEQ ID NO: 4609221 - DNA, 19 bp, Homo sapiens
actgtttcatctcagcttt

SEQ ID NO: 4609222 - DNA, 14 bp, Homo sapiens
actgtttccctgct

SEQ ID NO: 4609223 - DNA, 15 bp, Homo sapiens
actgtttccctgctg

SEQ ID NO: 4609224 - DNA, 21 bp, Homo sapiens
actgtttgtttttatttaaat

SEQ ID NO: 4609225 - DNA, 24 bp, Homo sapiens
actgttttaatttatactggcatg

SEQ ID NO: 4609226 - DNA, 17 bp, Homo sapiens
actgttttccagttcat

SEQ ID NO: 4609227 - DNA, 12 bp, Homo sapiens
acttaaatattg

SEQ ID NO: 4609228 - DNA, 21 bp, Homo sapiens
acttaaatattgtaatatgac

SEQ ID NO: 4609229 - DNA, 12 bp, Homo sapiens
acttaacatttc

SEQ ID NO: 4609230 - DNA, 20 bp, Homo sapiens
acttaaggaagtttgatttt

SEQ ID NO: 4609231 - DNA, 17 bp, Homo sapiens
acttaagggagaaaaaa

SEQ ID NO: 4609232 - DNA, 16 bp, Homo sapiens
acttaatcttctctct

SEQ ID NO: 4609233 - DNA, 19 bp, Homo sapiens
acttaatcttctctcttga

SEQ ID NO: 4609234 - DNA, 15 bp, Homo sapiens
acttaatttgtaaac

SEQ ID NO: 4609235 - DNA, 16 bp, Homo sapiens
acttaatttgtaaact

SEQ ID NO: 4609236 - DNA, 18 bp, Homo sapiens
acttaatttgtaaacttc

SEQ ID NO: 4609237 - DNA, 22 bp, Homo sapiens
acttaatttgtaaacttctgaa

SEQ ID NO: 4609238 - DNA, 17 bp, Homo sapiens
acttacactgtttcatc

SEQ ID NO: 4609239 - DNA, 23 bp, Homo sapiens
acttacactgtttcatctcagct

SEQ ID NO: 4609240 - DNA, 13 bp, Homo sapiens
acttactgcctga

SEQ ID NO: 4609241 - DNA, 12 bp, Homo sapiens
acttagaaactg

SEQ ID NO: 4609242 - DNA, 15 bp, Homo sapiens
acttagacctgccag

SEQ ID NO: 4609243 - DNA, 21 bp, Homo sapiens
acttagacctgccagccactg

SEQ ID NO: 4609244 - DNA, 14 bp, Homo sapiens
acttagattcatta

SEQ ID NO: 4609245 - DNA, 16 bp, Homo sapiens
acttagccatgatggc

SEQ ID NO: 4609246 - DNA, 11 bp, Homo sapiens
acttatacctg

SEQ ID NO: 4609247 - DNA, 15 bp, Homo sapiens
acttatagttaatat

SEQ ID NO: 4609248 - DNA, 14 bp, Homo sapiens
acttatccctctcc

SEQ ID NO: 4609249 - DNA, 15 bp, Homo sapiens
acttatccctctcca

SEQ ID NO: 4609250 - DNA, 18 bp, Homo sapiens
acttatctcactgtttta

SEQ ID NO: 4609251 - DNA, 16 bp, Homo sapiens
acttattacctcaggt

SEQ ID NO: 4609252 - DNA, 15 bp, Homo sapiens
acttatttatataaa

SEQ ID NO: 4609253 - DNA, 16 bp, Homo sapiens
acttcaagatgagcct

SEQ ID NO: 4609254 - DNA, 14 bp, Homo sapiens
acttcactaggcat

SEQ ID NO: 4609255 - DNA, 23 bp, Homo sapiens
acttcataagatattctttacaa

SEQ ID NO: 4609256 - DNA, 22 bp, Homo sapiens
acttcattcagaggttttgtta

SEQ ID NO: 4609257 - DNA, 18 bp, Homo sapiens
acttccatggccctcatt

SEQ ID NO: 4609258 - DNA, 20 bp, Homo sapiens
acttccatggccctcattaa

SEQ ID NO: 4609259 - DNA, 13 bp, Homo sapiens
acttccgctgagg

SEQ ID NO: 4609260 - DNA, 14 bp, Homo sapiens
acttccgctgaggg

SEQ ID NO: 4609261 - DNA, 16 bp, Homo sapiens
acttcctctgtgaact

SEQ ID NO: 4609262 - DNA, 16 bp, Homo sapiens
acttcctgactctcac

SEQ ID NO: 4609263 - DNA, 21 bp, Homo sapiens
acttcctttgcccttcctcct

SEQ ID NO: 4609264 - DNA, 22 bp, Homo sapiens
acttcctttgcccttcctcctg

SEQ ID NO: 4609265 - DNA, 23 bp, Homo sapiens
acttcctttgcccttcctcctgc

SEQ ID NO: 4609266 - DNA, 19 bp, Homo sapiens
acttcgctcttgaggagct

SEQ ID NO: 4609267 - DNA, 20 bp, Homo sapiens
acttcgctcttgaggagctc

SEQ ID NO: 4609268 - DNA, 13 bp, Homo sapiens
acttctaatttat

SEQ ID NO: 4609269 - DNA, 13 bp, Homo sapiens
acttctagctcat

SEQ ID NO: 4609270 - DNA, 17 bp, Homo sapiens
acttctcaggacacagg

SEQ ID NO: 4609271 - DNA, 22 bp, Homo sapiens
acttctcaggacacaggcctgt

SEQ ID NO: 4609272 - DNA, 14 bp, Homo sapiens
acttctctgtgtgc

SEQ ID NO: 4609273 - DNA, 20 bp, Homo sapiens
acttctgaagactgagaact

SEQ ID NO: 4609274 - DNA, 15 bp, Homo sapiens
acttctgctgctggc

SEQ ID NO: 4609275 - DNA, 16 bp, Homo sapiens
acttctgctgctggcc

SEQ ID NO: 4609276 - DNA, 23 bp, Homo sapiens
acttctggcttcagcccccacca

SEQ ID NO: 4609277 - DNA, 13 bp, Homo sapiens
acttcttcacctc

SEQ ID NO: 4609278 - DNA, 19 bp, Homo sapiens
acttcttcacctcttccac

SEQ ID NO: 4609279 - DNA, 20 bp, Homo sapiens
acttcttcacctcttccact

SEQ ID NO: 4609280 - DNA, 17 bp, Homo sapiens
acttcttgtcagacata

SEQ ID NO: 4609281 - DNA, 16 bp, Homo sapiens
acttgaaggagtttaa

SEQ ID NO: 4609282 - DNA, 17 bp, Homo sapiens
acttgaaggtacacccc

SEQ ID NO: 4609283 - DNA, 16 bp, Homo sapiens
acttgacatgtagctt

SEQ ID NO: 4609284 - DNA, 18 bp, Homo sapiens
acttgacatgtagcttct

SEQ ID NO: 4609285 - DNA, 15 bp, Homo sapiens
acttgagctgtctga

SEQ ID NO: 4609286 - DNA, 16 bp, Homo sapiens
acttgcttctctagct

SEQ ID NO: 4609287 - DNA, 20 bp, Homo sapiens
acttgctttcaattgacaaa

SEQ ID NO: 4609288 - DNA, 21 bp, Homo sapiens
acttgctttcaattgacaaat

SEQ ID NO: 4609289 - DNA, 23 bp, Homo sapiens
acttggaactgaagggggcggcc

SEQ ID NO: 4609290 - DNA, 20 bp, Homo sapiens
acttgggcacccccagcctg

SEQ ID NO: 4609291 - DNA, 21 bp, Homo sapiens
acttgggcacccccagcctgg

SEQ ID NO: 4609292 - DNA, 14 bp, Homo sapiens
acttgtaaaaccac

SEQ ID NO: 4609293 - DNA, 22 bp, Homo sapiens
acttgtccccaaatccgaacct

SEQ ID NO: 4609294 - DNA, 19 bp, Homo sapiens
acttgtcctttgaggcccc

SEQ ID NO: 4609295 - DNA, 23 bp, Homo sapiens
acttgtcctttgaggccccaact

SEQ ID NO: 4609296 - DNA, 13 bp, Homo sapiens
acttgtctgcctc

SEQ ID NO: 4609297 - DNA, 16 bp, Homo sapiens
acttgtctgcctcctg

SEQ ID NO: 4609298 - DNA, 21 bp, Homo sapiens
acttgtctgcctcctgctttg

SEQ ID NO: 4609299 - DNA, 12 bp, Homo sapiens
acttgttcattt

SEQ ID NO: 4609300 - DNA, 13 bp, Homo sapiens
acttgttcattta

SEQ ID NO: 4609301 - DNA, 21 bp, Homo sapiens
actttaaatcctaccaaagta

SEQ ID NO: 4609302 - DNA, 21 bp, Homo sapiens
actttacaaacctttgtttca

SEQ ID NO: 4609303 - DNA, 23 bp, Homo sapiens
actttacaaacctttgtttcaac

SEQ ID NO: 4609304 - DNA, 14 bp, Homo sapiens
actttacagaaatg

SEQ ID NO: 4609305 - DNA, 19 bp, Homo sapiens
actttacagaaatggactg

SEQ ID NO: 4609306 - DNA, 20 bp, Homo sapiens
actttataacttaaatattg

SEQ ID NO: 4609307 - DNA, 22 bp, Homo sapiens
actttataacttaaatattgct

SEQ ID NO: 4609308 - DNA, 23 bp, Homo sapiens
actttatctaatacctctgtgtg

SEQ ID NO: 4609309 - DNA, 15 bp, Homo sapiens
actttattaaaagaa

SEQ ID NO: 4609310 - DNA, 17 bp, Homo sapiens
actttatttatttctag

SEQ ID NO: 4609311 - DNA, 19 bp, Homo sapiens
actttccaatgccacagac

SEQ ID NO: 4609312 - DNA, 22 bp, Homo sapiens
actttccccgtgggccatggca

SEQ ID NO: 4609313 - DNA, 13 bp, Homo sapiens
actttcctttcaa

SEQ ID NO: 4609314 - DNA, 17 bp, Homo sapiens
actttcctttcaataaa

SEQ ID NO: 4609315 - DNA, 16 bp, Homo sapiens
actttctccatttaag

SEQ ID NO: 4609316 - DNA, 16 bp, Homo sapiens
actttctctgccatca

SEQ ID NO: 4609317 - DNA, 22 bp, Homo sapiens
actttctcttaagattaatttt

SEQ ID NO: 4609318 - DNA, 17 bp, Homo sapiens
actttctggtgctgtct

SEQ ID NO: 4609319 - DNA, 18 bp, Homo sapiens
actttctgttccctatgg

SEQ ID NO: 4609320 - DNA, 15 bp, Homo sapiens
actttgctttcatga

SEQ ID NO: 4609321 - DNA, 16 bp, Homo sapiens
actttgtgactgtcac

SEQ ID NO: 4609322 - DNA, 19 bp, Homo sapiens
actttgtgttcatttcatt

SEQ ID NO: 4609323 - DNA, 20 bp, Homo sapiens
actttgttaggattttcaca

SEQ ID NO: 4609324 - DNA, 14 bp, Homo sapiens
acttttacagatta

SEQ ID NO: 4609325 - DNA, 18 bp, Homo sapiens
acttttagaaatgcatat

SEQ ID NO: 4609326 - DNA, 20 bp, Homo sapiens
acttttagtagagacagtgt

SEQ ID NO: 4609327 - DNA, 15 bp, Homo sapiens
acttttatgagcttc

SEQ ID NO: 4609328 - DNA, 18 bp, Homo sapiens
acttttcattctctttta

SEQ ID NO: 4609329 - DNA, 14 bp, Homo sapiens
acttttgttctact

SEQ ID NO: 4609330 - DNA, 14 bp, Homo sapiens
actttttacagcag

SEQ ID NO: 4609331 - DNA, 19 bp, Homo sapiens
actttttacagcagcaata

SEQ ID NO: 4609332 - DNA, 22 bp, Homo sapiens
actttttgatggaattaaatgt

SEQ ID NO: 4609333 - DNA, 21 bp, Homo sapiens
acttttttctagtacactttt

SEQ ID NO: 4609334 - DNA, 19 bp, Homo sapiens
agaaaaataaaaatctctt

SEQ ID NO: 4609335 - DNA, 13 bp, Homo sapiens
agaaaaataaaat

SEQ ID NO: 4609336 - DNA, 15 bp, Homo sapiens
agaaaacaagtatat

SEQ ID NO: 4609337 - DNA, 17 bp, Homo sapiens
agaaaacaagtatataa

SEQ ID NO: 4609338 - DNA, 20 bp, Homo sapiens
agaaaacatgtataaatata

SEQ ID NO: 4609339 - DNA, 13 bp, Homo sapiens
agaaaacattttt

SEQ ID NO: 4609340 - DNA, 21 bp, Homo sapiens
agaaaacttgacatgtagctt

SEQ ID NO: 4609341 - DNA, 20 bp, Homo sapiens
agaaaagggaactgaacatt

SEQ ID NO: 4609342 - DNA, 13 bp, Homo sapiens
agaaaagtaatga

SEQ ID NO: 4609343 - DNA, 15 bp, Homo sapiens
agaaaagtaatgaag

SEQ ID NO: 4609344 - DNA, 21 bp, Homo sapiens
agaaaataaaggaaaatgact

SEQ ID NO: 4609345 - DNA, 15 bp, Homo sapiens
agaaaatatcactgt

SEQ ID NO: 4609346 - DNA, 20 bp, Homo sapiens
agaaaatatcactgtaatga

SEQ ID NO: 4609347 - DNA, 23 bp, Homo sapiens
agaaaatgacttatttctgctct

SEQ ID NO: 4609348 - DNA, 22 bp, Homo sapiens
agaaaatgcctagagatatttc

SEQ ID NO: 4609349 - DNA, 11 bp, Homo sapiens
agaaaatgtag

SEQ ID NO: 4609350 - DNA, 12 bp, Homo sapiens
agaaaatttaca

SEQ ID NO: 4609351 - DNA, 13 bp, Homo sapiens
agaaacaagctgt

SEQ ID NO: 4609352 - DNA, 15 bp, Homo sapiens
agaaacaagctgtgc

SEQ ID NO: 4609353 - DNA, 14 bp, Homo sapiens
agaaacaccactta

SEQ ID NO: 4609354 - DNA, 19 bp, Homo sapiens
agaaacaccacttaatctt

SEQ ID NO: 4609355 - DNA, 20 bp, Homo sapiens
agaaacagagtggcctccct

SEQ ID NO: 4609356 - DNA, 13 bp, Homo sapiens
agaaacagccagc

SEQ ID NO: 4609357 - DNA, 18 bp, Homo sapiens
agaaacagctcagccagt

SEQ ID NO: 4609358 - DNA, 13 bp, Homo sapiens
agaaacagtttct

SEQ ID NO: 4609359 - DNA, 21 bp, Homo sapiens
agaaacctggggtgaatactt

SEQ ID NO: 4609360 - DNA, 12 bp, Homo sapiens
agaaactgaggc

SEQ ID NO: 4609361 - DNA, 18 bp, Homo sapiens
agaaactgaggcccacgg

SEQ ID NO: 4609362 - DNA, 21 bp, Homo sapiens
agaaagaaacttcattcagag

SEQ ID NO: 4609363 - DNA, 22 bp, Homo sapiens
agaaagaaacttcattcagagg

SEQ ID NO: 4609364 - DNA, 17 bp, Homo sapiens
agaaagaccctgatgca

SEQ ID NO: 4609365 - DNA, 23 bp, Homo sapiens
agaaagaccctgatgcaggtcag

SEQ ID NO: 4609366 - DNA, 18 bp, Homo sapiens
agaaagagagaagccagc

SEQ ID NO: 4609367 - DNA, 21 bp, Homo sapiens
agaaagagagaagccagccac

SEQ ID NO: 4609368 - DNA, 15 bp, Homo sapiens
agaaagagctgcctg

SEQ ID NO: 4609369 - DNA, 19 bp, Homo sapiens
agaaagagctgcctggatg

SEQ ID NO: 4609370 - DNA, 20 bp, Homo sapiens
agaaagaggtgaccccaggg

SEQ ID NO: 4609371 - DNA, 21 bp, Homo sapiens
agaaagaggtgaccccagggc

SEQ ID NO: 4609372 - DNA, 22 bp, Homo sapiens
agaaagaggtgaccccagggca

SEQ ID NO: 4609373 - DNA, 19 bp, Homo sapiens
agaaagatttgatgggcca

SEQ ID NO: 4609374 - DNA, 20 bp, Homo sapiens
agaaagccaggagcagccct

SEQ ID NO: 4609375 - DNA, 13 bp, Homo sapiens
agaaaggaagcaa

SEQ ID NO: 4609376 - DNA, 18 bp, Homo sapiens
agaaaggctctgaaggtc

SEQ ID NO: 4609377 - DNA, 14 bp, Homo sapiens
agaaagggacccac

SEQ ID NO: 4609378 - DNA, 17 bp, Homo sapiens
agaaagggacccacctg

SEQ ID NO: 4609379 - DNA, 17 bp, Homo sapiens
agaaagggagggctctg

SEQ ID NO: 4609380 - DNA, 21 bp, Homo sapiens
agaaagggagggctctgaggc

SEQ ID NO: 4609381 - DNA, 17 bp, Homo sapiens
agaaagggtgtttttct

SEQ ID NO: 4609382 - DNA, 23 bp, Homo sapiens
agaaagttctgtgtaaacagaag

SEQ ID NO: 4609383 - DNA, 19 bp, Homo sapiens
agaaatagttggttcctaa

SEQ ID NO: 4609384 - DNA, 19 bp, Homo sapiens
agaaatagttgtctgtgct

SEQ ID NO: 4609385 - DNA, 17 bp, Homo sapiens
agaaatgacaatagagg

SEQ ID NO: 4609386 - DNA, 20 bp, Homo sapiens
agaaatgctggtttttcagt

SEQ ID NO: 4609387 - DNA, 21 bp, Homo sapiens
agaaatgtcttaatttttgaa

SEQ ID NO: 4609388 - DNA, 11 bp, Homo sapiens
agaaattttca

SEQ ID NO: 4609389 - DNA, 22 bp, Homo sapiens
agaaatttttcagatgcttctg

SEQ ID NO: 4609390 - DNA, 18 bp, Homo sapiens
agaacacaaaacttgaaa

SEQ ID NO: 4609391 - DNA, 23 bp, Homo sapiens
agaacaggaggtgtgaatgcacg

SEQ ID NO: 4609392 - DNA, 17 bp, Homo sapiens
agaacaggtttttttgt

SEQ ID NO: 4609393 - DNA, 17 bp, Homo sapiens
agaacatactgttctca

SEQ ID NO: 4609394 - DNA, 21 bp, Homo sapiens
agaacatccctgtcttaactg

SEQ ID NO: 4609395 - DNA, 16 bp, Homo sapiens
agaacattcagctctg

SEQ ID NO: 4609396 - DNA, 17 bp, Homo sapiens
agaacattcagctctgg

SEQ ID NO: 4609397 - DNA, 22 bp, Homo sapiens
agaacctggccttcagtgtacc

SEQ ID NO: 4609398 - DNA, 23 bp, Homo sapiens
agaacggtttttggatctggcat

SEQ ID NO: 4609399 - DNA, 20 bp, Homo sapiens
agaacgttttttcctcagtg

SEQ ID NO: 4609400 - DNA, 17 bp, Homo sapiens
agaactagccaaaccag

SEQ ID NO: 4609401 - DNA, 15 bp, Homo sapiens
agaactcactctggg

SEQ ID NO: 4609402 - DNA, 20 bp, Homo sapiens
agaactcactctgggctgta

SEQ ID NO: 4609403 - DNA, 16 bp, Homo sapiens
agaactgaagtgtgct

SEQ ID NO: 4609404 - DNA, 20 bp, Homo sapiens
agaactgaagtgtgctgtga

SEQ ID NO: 4609405 - DNA, 22 bp, Homo sapiens
agaactgcctttggcagagttc

SEQ ID NO: 4609406 - DNA, 19 bp, Homo sapiens
agaactgcttcatgtgaac

SEQ ID NO: 4609407 - DNA, 20 bp, Homo sapiens
agaactgcttcatgtgaaca

SEQ ID NO: 4609408 - DNA, 19 bp, Homo sapiens
agaacttcaagatgagcct

SEQ ID NO: 4609409 - DNA, 13 bp, Homo sapiens
agaagaattttat

SEQ ID NO: 4609410 - DNA, 18 bp, Homo sapiens
agaagacgtggtctagac

SEQ ID NO: 4609411 - DNA, 14 bp, Homo sapiens
agaagatagtgaga

SEQ ID NO: 4609412 - DNA, 16 bp, Homo sapiens
agaagatcattgccat

SEQ ID NO: 4609413 - DNA, 22 bp, Homo sapiens
agaagattgttggtgaattttc

SEQ ID NO: 4609414 - DNA, 15 bp, Homo sapiens
agaagcacagctcct

SEQ ID NO: 4609415 - DNA, 18 bp, Homo sapiens
agaagcacagctcctgcc

SEQ ID NO: 4609416 - DNA, 20 bp, Homo sapiens
agaagcacagctcctgccag

SEQ ID NO: 4609417 - DNA, 21 bp, Homo sapiens
agaagcacagctcctgccagg

SEQ ID NO: 4609418 - DNA, 12 bp, Homo sapiens
agaagcagaggg

SEQ ID NO: 4609419 - DNA, 22 bp, Homo sapiens
agaagcagagggacaaccagaa

SEQ ID NO: 4609420 - DNA, 12 bp, Homo sapiens
agaagccagcca

SEQ ID NO: 4609421 - DNA, 13 bp, Homo sapiens
agaagccagccac

SEQ ID NO: 4609422 - DNA, 14 bp, Homo sapiens
agaagccagccaca

SEQ ID NO: 4609423 - DNA, 18 bp, Homo sapiens
agaagccagccacagacc

SEQ ID NO: 4609424 - DNA, 17 bp, Homo sapiens
agaagcctgggggcctg

SEQ ID NO: 4609425 - DNA, 21 bp, Homo sapiens
agaagcctgggggcctggctg

SEQ ID NO: 4609426 - DNA, 15 bp, Homo sapiens
agaagcgtttttaac

SEQ ID NO: 4609427 - DNA, 22 bp, Homo sapiens
agaagctatattagctgaaaca

SEQ ID NO: 4609428 - DNA, 19 bp, Homo sapiens
agaagctctgaagaactct

SEQ ID NO: 4609429 - DNA, 20 bp, Homo sapiens
agaagctgctccaggcctgc

SEQ ID NO: 4609430 - DNA, 23 bp, Homo sapiens
agaagctgctccaggcctgcagc

SEQ ID NO: 4609431 - DNA, 15 bp, Homo sapiens
agaagcttggaggag

SEQ ID NO: 4609432 - DNA, 13 bp, Homo sapiens
agaaggaaagaag

SEQ ID NO: 4609433 - DNA, 23 bp, Homo sapiens
agaaggctggagaaggacatgag

SEQ ID NO: 4609434 - DNA, 18 bp, Homo sapiens
agaagggggccctgctac

SEQ ID NO: 4609435 - DNA, 20 bp, Homo sapiens
agaagggggccctgctacct

SEQ ID NO: 4609436 - DNA, 21 bp, Homo sapiens
agaagggggccctgctacctg

SEQ ID NO: 4609437 - DNA, 16 bp, Homo sapiens
agaagggggctctgcc

SEQ ID NO: 4609438 - DNA, 20 bp, Homo sapiens
agaaggttaccaagaagcct

SEQ ID NO: 4609439 - DNA, 19 bp, Homo sapiens
agaaggtttgtgtttttct

SEQ ID NO: 4609440 - DNA, 13 bp, Homo sapiens
agaagtttaacaa

SEQ ID NO: 4609441 - DNA, 19 bp, Homo sapiens
agaataattcttttctgag

SEQ ID NO: 4609442 - DNA, 15 bp, Homo sapiens
agaatacccaggaag

SEQ ID NO: 4609443 - DNA, 16 bp, Homo sapiens
agaatacccaggaaga

SEQ ID NO: 4609444 - DNA, 16 bp, Homo sapiens
agaatatgacttttta

SEQ ID NO: 4609445 - DNA, 21 bp, Homo sapiens
agaatatttactaactaaata

SEQ ID NO: 4609446 - DNA, 16 bp, Homo sapiens
agaatcagtaggacca

SEQ ID NO: 4609447 - DNA, 21 bp, Homo sapiens
agaatcagtaggaccaggcca

SEQ ID NO: 4609448 - DNA, 17 bp, Homo sapiens
agaatcatacttaacat

SEQ ID NO: 4609449 - DNA, 20 bp, Homo sapiens
agaatccagcaccggcccca

SEQ ID NO: 4609450 - DNA, 17 bp, Homo sapiens
agaatcccaatgtttga

SEQ ID NO: 4609451 - DNA, 18 bp, Homo sapiens
agaatgagagcgacacag

SEQ ID NO: 4609452 - DNA, 19 bp, Homo sapiens
agaatgagagcgacacaga

SEQ ID NO: 4609453 - DNA, 19 bp, Homo sapiens
agaatgtgtttcaaaacca

SEQ ID NO: 4609454 - DNA, 22 bp, Homo sapiens
agaatgttactgactcctcagt

SEQ ID NO: 4609455 - DNA, 18 bp, Homo sapiens
agaatgttgtacttgaaa

SEQ ID NO: 4609456 - DNA, 23 bp, Homo sapiens
agaattatacagacctaatatca

SEQ ID NO: 4609457 - DNA, 20 bp, Homo sapiens
agaattccttcgaaaggcct

SEQ ID NO: 4609458 - DNA, 13 bp, Homo sapiens
agaattggctcaa

SEQ ID NO: 4609459 - DNA, 19 bp, Homo sapiens
agaattttatttttctgtg

SEQ ID NO: 4609460 - DNA, 23 bp, Homo sapiens
agaattttcctgagacaaatttt

SEQ ID NO: 4609461 - DNA, 16 bp, Homo sapiens
agacaacagcacacag

SEQ ID NO: 4609462 - DNA, 12 bp, Homo sapiens
agacaaggtgct

SEQ ID NO: 4609463 - DNA, 13 bp, Homo sapiens
agacacaggatga

SEQ ID NO: 4609464 - DNA, 21 bp, Homo sapiens
agacacatgctatgttctgtc

SEQ ID NO: 4609465 - DNA, 22 bp, Homo sapiens
agacacattgactcctttccaa

SEQ ID NO: 4609466 - DNA, 18 bp, Homo sapiens
agacactcccccctccat

SEQ ID NO: 4609467 - DNA, 23 bp, Homo sapiens
agacactctgacaagctggccaa

SEQ ID NO: 4609468 - DNA, 18 bp, Homo sapiens
agacactgatctggctgc

SEQ ID NO: 4609469 - DNA, 17 bp, Homo sapiens
agacagaaacatgtctt

SEQ ID NO: 4609470 - DNA, 18 bp, Homo sapiens
agacagaaccttgttatt

SEQ ID NO: 4609471 - DNA, 14 bp, Homo sapiens
agacagaggggagc

SEQ ID NO: 4609472 - DNA, 15 bp, Homo sapiens
agacagaggggagca

SEQ ID NO: 4609473 - DNA, 14 bp, Homo sapiens
agacagcaggcagc

SEQ ID NO: 4609474 - DNA, 18 bp, Homo sapiens
agacagccacattgggca

SEQ ID NO: 4609475 - DNA, 13 bp, Homo sapiens
agacagccaggta

SEQ ID NO: 4609476 - DNA, 22 bp, Homo sapiens
agacagcccaggatactggcac

SEQ ID NO: 4609477 - DNA, 13 bp, Homo sapiens
agacagtgggaaa

SEQ ID NO: 4609478 - DNA, 14 bp, Homo sapiens
agacagtgggaaat

SEQ ID NO: 4609479 - DNA, 15 bp, Homo sapiens
agacagtgggaaata

SEQ ID NO: 4609480 - DNA, 20 bp, Homo sapiens
agacagtgtttcgtcatgtt

SEQ ID NO: 4609481 - DNA, 13 bp, Homo sapiens
agacataaagcca

SEQ ID NO: 4609482 - DNA, 23 bp, Homo sapiens
agacatatgggatattcccaagc

SEQ ID NO: 4609483 - DNA, 19 bp, Homo sapiens
agacatccataaagaagca

SEQ ID NO: 4609484 - DNA, 14 bp, Homo sapiens
agacattctcacat

SEQ ID NO: 4609485 - DNA, 13 bp, Homo sapiens
agaccaccttccc

SEQ ID NO: 4609486 - DNA, 23 bp, Homo sapiens
agaccaccttcccttcctcagca

SEQ ID NO: 4609487 - DNA, 21 bp, Homo sapiens
agaccagggctgctctttcca

SEQ ID NO: 4609488 - DNA, 17 bp, Homo sapiens
agaccatcgcacaccaa

SEQ ID NO: 4609489 - DNA, 15 bp, Homo sapiens
agaccatttgtagtg

SEQ ID NO: 4609490 - DNA, 22 bp, Homo sapiens
agacccaaagcggtccctgtcc

SEQ ID NO: 4609491 - DNA, 22 bp, Homo sapiens
agacccagccccttcccctggg

SEQ ID NO: 4609492 - DNA, 18 bp, Homo sapiens
agaccccagtcaagctcc

SEQ ID NO: 4609493 - DNA, 17 bp, Homo sapiens
agaccccgcacccggct

SEQ ID NO: 4609494 - DNA, 12 bp, Homo sapiens
agaccctgccct

SEQ ID NO: 4609495 - DNA, 21 bp, Homo sapiens
agacccttattgctgtcctgg

SEQ ID NO: 4609496 - DNA, 22 bp, Homo sapiens
agacccttattgctgtcctgga

SEQ ID NO: 4609497 - DNA, 20 bp, Homo sapiens
agacctaatatcattttatt

SEQ ID NO: 4609498 - DNA, 20 bp, Homo sapiens
agacctcatctgtggagctg

SEQ ID NO: 4609499 - DNA, 13 bp, Homo sapiens
agacctctgccta

SEQ ID NO: 4609500 - DNA, 23 bp, Homo sapiens
agacctctggattaggtctctgt

SEQ ID NO: 4609501 - DNA, 18 bp, Homo sapiens
agacctctgtgcacttat

SEQ ID NO: 4609502 - DNA, 19 bp, Homo sapiens
agacctgcagacgcccaga

SEQ ID NO: 4609503 - DNA, 17 bp, Homo sapiens
agacctgccagccactg

SEQ ID NO: 4609504 - DNA, 22 bp, Homo sapiens
agacctgccagccactgtcacc

SEQ ID NO: 4609505 - DNA, 15 bp, Homo sapiens
agacctgtctcctgg

SEQ ID NO: 4609506 - DNA, 18 bp, Homo sapiens
agacctttctagacatca

SEQ ID NO: 4609507 - DNA, 12 bp, Homo sapiens
agacgaggggca

SEQ ID NO: 4609508 - DNA, 21 bp, Homo sapiens
agacgaggggcagggaaggac

SEQ ID NO: 4609509 - DNA, 20 bp, Homo sapiens
agacgcacacagctgagcac

SEQ ID NO: 4609510 - DNA, 15 bp, Homo sapiens
agacgggaggggagg

SEQ ID NO: 4609511 - DNA, 16 bp, Homo sapiens
agacggtgttttgcca

SEQ ID NO: 4609512 - DNA, 16 bp, Homo sapiens
agacgtggtctagacc

SEQ ID NO: 4609513 - DNA, 23 bp, Homo sapiens
agacgtggtctagaccagggctg

SEQ ID NO: 4609514 - DNA, 18 bp, Homo sapiens
agactactattttctttt

SEQ ID NO: 4609515 - DNA, 19 bp, Homo sapiens
agactactattttcttttt

SEQ ID NO: 4609516 - DNA, 21 bp, Homo sapiens
agactcactgttaagaataga

SEQ ID NO: 4609517 - DNA, 22 bp, Homo sapiens
agactcctgaggacagctgtcc

SEQ ID NO: 4609518 - DNA, 15 bp, Homo sapiens
agactctaggttata

SEQ ID NO: 4609519 - DNA, 18 bp, Homo sapiens
agactctaggttatacaa

SEQ ID NO: 4609520 - DNA, 20 bp, Homo sapiens
agactctcgcatcttcccaa

SEQ ID NO: 4609521 - DNA, 12 bp, Homo sapiens
agactcttgctc

SEQ ID NO: 4609522 - DNA, 15 bp, Homo sapiens
agactcttgctcctg

SEQ ID NO: 4609523 - DNA, 21 bp, Homo sapiens
agactcttgctcctgcttctc

SEQ ID NO: 4609524 - DNA, 22 bp, Homo sapiens
agactctttaataaattgctta

SEQ ID NO: 4609525 - DNA, 22 bp, Homo sapiens
agactgaccaatattgtacagt

SEQ ID NO: 4609526 - DNA, 18 bp, Homo sapiens
agactgagaacttttttg

SEQ ID NO: 4609527 - DNA, 21 bp, Homo sapiens
agactgattgattattcaaca

SEQ ID NO: 4609528 - DNA, 14 bp, Homo sapiens
agactgccctgccc

SEQ ID NO: 4609529 - DNA, 15 bp, Homo sapiens
agactgccctgccca

SEQ ID NO: 4609530 - DNA, 20 bp, Homo sapiens
agactgccctgcccaggtat

SEQ ID NO: 4609531 - DNA, 12 bp, Homo sapiens
agactgctagct

SEQ ID NO: 4609532 - DNA, 13 bp, Homo sapiens
agactgggcccca

SEQ ID NO: 4609533 - DNA, 17 bp, Homo sapiens
agactgggccccacatg

SEQ ID NO: 4609534 - DNA, 16 bp, Homo sapiens
agactggttttctgcc

SEQ ID NO: 4609535 - DNA, 18 bp, Homo sapiens
agactggttttctgccaa

SEQ ID NO: 4609536 - DNA, 15 bp, Homo sapiens
agactgtagcttctc

SEQ ID NO: 4609537 - DNA, 16 bp, Homo sapiens
agactgtagcttctct

SEQ ID NO: 4609538 - DNA, 14 bp, Homo sapiens
agactgtgaacagc

SEQ ID NO: 4609539 - DNA, 19 bp, Homo sapiens
agactgtgaacagcttgct

SEQ ID NO: 4609540 - DNA, 18 bp, Homo sapiens
agactgtgaacttgactg

SEQ ID NO: 4609541 - DNA, 14 bp, Homo sapiens
agacttgtgcatcc

SEQ ID NO: 4609542 - DNA, 19 bp, Homo sapiens
agactttacaaacctttgt

SEQ ID NO: 4609543 - DNA, 13 bp, Homo sapiens
agactttctcctg

SEQ ID NO: 4609544 - DNA, 19 bp, Homo sapiens
agactttgtgactgtcact

SEQ ID NO: 4609545 - DNA, 20 bp, Homo sapiens
agactttgtgactgtcactt

SEQ ID NO: 4609546 - DNA, 15 bp, Homo sapiens
agacttttttctagt

SEQ ID NO: 4609547 - DNA, 21 bp, Homo sapiens
agagaaacatttggaaaagac

SEQ ID NO: 4609548 - DNA, 10 bp, Homo sapiens
agagaaactt

SEQ ID NO: 4609549 - DNA, 16 bp, Homo sapiens
agagaaacttcaaagt

SEQ ID NO: 4609550 - DNA, 16 bp, Homo sapiens
agagaaagagagaagc

SEQ ID NO: 4609551 - DNA, 12 bp, Homo sapiens
agagaagccagc

SEQ ID NO: 4609552 - DNA, 14 bp, Homo sapiens
agagaagccagcca

SEQ ID NO: 4609553 - DNA, 16 bp, Homo sapiens
agagaagccagccaca

SEQ ID NO: 4609554 - DNA, 20 bp, Homo sapiens
agagaagtttgtagccaggt

SEQ ID NO: 4609555 - DNA, 14 bp, Homo sapiens
agagaatgagagcg

SEQ ID NO: 4609556 - DNA, 17 bp, Homo sapiens
agagaatgagagcgaca

SEQ ID NO: 4609557 - DNA, 18 bp, Homo sapiens
agagaatgtgtttcaaaa

SEQ ID NO: 4609558 - DNA, 12 bp, Homo sapiens
agagaattggct

SEQ ID NO: 4609559 - DNA, 16 bp, Homo sapiens
agagacagaggatgtg

SEQ ID NO: 4609560 - DNA, 14 bp, Homo sapiens
agagacagcccagg

SEQ ID NO: 4609561 - DNA, 15 bp, Homo sapiens
agagacagcccagga

SEQ ID NO: 4609562 - DNA, 17 bp, Homo sapiens
agagaccacacatttta

SEQ ID NO: 4609563 - DNA, 15 bp, Homo sapiens
agagacggtgttttg

SEQ ID NO: 4609564 - DNA, 15 bp, Homo sapiens
agagagaatgagagc

SEQ ID NO: 4609565 - DNA, 16 bp, Homo sapiens
agagaggccttgtccc

SEQ ID NO: 4609566 - DNA, 16 bp, Homo sapiens
agagagggacaggcac

SEQ ID NO: 4609567 - DNA, 20 bp, Homo sapiens
agagagtgtgtgtttgtgtg

SEQ ID NO: 4609568 - DNA, 13 bp, Homo sapiens
agagatacagagg

SEQ ID NO: 4609569 - DNA, 22 bp, Homo sapiens
agagatatttaggaaaatgctt

SEQ ID NO: 4609570 - DNA, 16 bp, Homo sapiens
agagatatttcaagct

SEQ ID NO: 4609571 - DNA, 19 bp, Homo sapiens
agagatcccaggaggtgca

SEQ ID NO: 4609572 - DNA, 15 bp, Homo sapiens
agagatccctgcaga

SEQ ID NO: 4609573 - DNA, 16 bp, Homo sapiens
agagatcgacagacag

SEQ ID NO: 4609574 - DNA, 14 bp, Homo sapiens
agagatgagcccac

SEQ ID NO: 4609575 - DNA, 17 bp, Homo sapiens
agagatgagcccaccct

SEQ ID NO: 4609576 - DNA, 22 bp, Homo sapiens
agagatgggccaggcagagaac

SEQ ID NO: 4609577 - DNA, 16 bp, Homo sapiens
agagattttcatttta

SEQ ID NO: 4609578 - DNA, 20 bp, Homo sapiens
agagcacttgagctgtctga

SEQ ID NO: 4609579 - DNA, 23 bp, Homo sapiens
agagcagacaggctacaaagcag

SEQ ID NO: 4609580 - DNA, 14 bp, Homo sapiens
agagcatcatgcct

SEQ ID NO: 4609581 - DNA, 18 bp, Homo sapiens
agagcatcatgcctctga

SEQ ID NO: 4609582 - DNA, 21 bp, Homo sapiens
agagccacaaaagaaaagact

SEQ ID NO: 4609583 - DNA, 17 bp, Homo sapiens
agagccacctgcaagat

SEQ ID NO: 4609584 - DNA, 20 bp, Homo sapiens
agagccacctgcaagatgga

SEQ ID NO: 4609585 - DNA, 17 bp, Homo sapiens
agagcccattaatcttg

SEQ ID NO: 4609586 - DNA, 18 bp, Homo sapiens
agagcccattaatcttga

SEQ ID NO: 4609587 - DNA, 20 bp, Homo sapiens
agagcccattaatcttgatc

SEQ ID NO: 4609588 - DNA, 17 bp, Homo sapiens
agagcccccagccctgg

SEQ ID NO: 4609589 - DNA, 23 bp, Homo sapiens
agagcccctcctccagcccctgt

SEQ ID NO: 4609590 - DNA, 20 bp, Homo sapiens
agagcccgtgccacccccag

SEQ ID NO: 4609591 - DNA, 15 bp, Homo sapiens
agagccctgggaccg

SEQ ID NO: 4609592 - DNA, 14 bp, Homo sapiens
agagcctcgctttt

SEQ ID NO: 4609593 - DNA, 17 bp, Homo sapiens
agagcctcgctttttca

SEQ ID NO: 4609594 - DNA, 10 bp, Homo sapiens
agagcctggg

SEQ ID NO: 4609595 - DNA, 12 bp, Homo sapiens
agagcctggggc

SEQ ID NO: 4609596 - DNA, 13 bp, Homo sapiens
agagcgacacaga

SEQ ID NO: 4609597 - DNA, 14 bp, Homo sapiens
agagcgacacagac

SEQ ID NO: 4609598 - DNA, 19 bp, Homo sapiens
agagcgtccttggctgccg

SEQ ID NO: 4609599 - DNA, 21 bp, Homo sapiens
agagctagaaaaataaaatgt

SEQ ID NO: 4609600 - DNA, 18 bp, Homo sapiens
agagctaggagcaaagcc

SEQ ID NO: 4609601 - DNA, 15 bp, Homo sapiens
agagctcatcccccc

SEQ ID NO: 4609602 - DNA, 17 bp, Homo sapiens
agagctctacaggcctg

SEQ ID NO: 4609603 - DNA, 20 bp, Homo sapiens
agagctctacaggcctgcag

SEQ ID NO: 4609604 - DNA, 12 bp, Homo sapiens
agagctgcctgg

SEQ ID NO: 4609605 - DNA, 10 bp, Homo sapiens
agagctgtgc

SEQ ID NO: 4609606 - DNA, 12 bp, Homo sapiens
agagctgtgcca

SEQ ID NO: 4609607 - DNA, 22 bp, Homo sapiens
agagcttttatttggtgtgttc

SEQ ID NO: 4609608 - DNA, 19 bp, Homo sapiens
agaggaaataacagagaga

SEQ ID NO: 4609609 - DNA, 11 bp, Homo sapiens
agaggagatgt

SEQ ID NO: 4609610 - DNA, 14 bp, Homo sapiens
agaggatgaaggaa

SEQ ID NO: 4609611 - DNA, 17 bp, Homo sapiens
agaggcatttgagcagc

SEQ ID NO: 4609612 - DNA, 18 bp, Homo sapiens
agaggcatttgagcagct

SEQ ID NO: 4609613 - DNA, 12 bp, Homo sapiens
agaggccctgga

SEQ ID NO: 4609614 - DNA, 20 bp, Homo sapiens
agaggccctggatcagcgtg

SEQ ID NO: 4609615 - DNA, 21 bp, Homo sapiens
agaggctgaggctggcacagg

SEQ ID NO: 4609616 - DNA, 14 bp, Homo sapiens
agaggcttccctac

SEQ ID NO: 4609617 - DNA, 23 bp, Homo sapiens
agaggcttccctacacagggcct

SEQ ID NO: 4609618 - DNA, 21 bp, Homo sapiens
agaggcttgaaggccagcagc

SEQ ID NO: 4609619 - DNA, 17 bp, Homo sapiens
agagggccgggcagagg

SEQ ID NO: 4609620 - DNA, 14 bp, Homo sapiens
agagggtgaaggag

SEQ ID NO: 4609621 - DNA, 22 bp, Homo sapiens
agagggtgacaagatagagagc

SEQ ID NO: 4609622 - DNA, 16 bp, Homo sapiens
agaggtcaccagctgc

SEQ ID NO: 4609623 - DNA, 23 bp, Homo sapiens
agaggtgaccccagggcacagga

SEQ ID NO: 4609624 - DNA, 13 bp, Homo sapiens
agaggttctgcct

SEQ ID NO: 4609625 - DNA, 15 bp, Homo sapiens
agaggttctgcctct

SEQ ID NO: 4609626 - DNA, 16 bp, Homo sapiens
agagtaaattgctctg

SEQ ID NO: 4609627 - DNA, 17 bp, Homo sapiens
agagtacctgtgtgttt

SEQ ID NO: 4609628 - DNA, 21 bp, Homo sapiens
agagtcagccccgacttcctg

SEQ ID NO: 4609629 - DNA, 18 bp, Homo sapiens
agagtggagagaagctct

SEQ ID NO: 4609630 - DNA, 17 bp, Homo sapiens
agagtggcctccctgct

SEQ ID NO: 4609631 - DNA, 20 bp, Homo sapiens
agagtggcctccctgctgtg

SEQ ID NO: 4609632 - DNA, 20 bp, Homo sapiens
agagtgggccccgggctgga

SEQ ID NO: 4609633 - DNA, 20 bp, Homo sapiens
agagtgtagcctaaagggca

SEQ ID NO: 4609634 - DNA, 21 bp, Homo sapiens
agagtgtagcctaaagggcag

SEQ ID NO: 4609635 - DNA, 11 bp, Homo sapiens
agagtgtagct

SEQ ID NO: 4609636 - DNA, 14 bp, Homo sapiens
agagtgtagctgta

SEQ ID NO: 4609637 - DNA, 19 bp, Homo sapiens
agagtgtagctgtaagggc

SEQ ID NO: 4609638 - DNA, 22 bp, Homo sapiens
agagtgtagctgtaagggcagt

SEQ ID NO: 4609639 - DNA, 11 bp, Homo sapiens
agagtgtgtgt

SEQ ID NO: 4609640 - DNA, 23 bp, Homo sapiens
agagtttggaattattgtagaca

SEQ ID NO: 4609641 - DNA, 23 bp, Homo sapiens
agagtttggggccgaaaatgttt

SEQ ID NO: 4609642 - DNA, 20 bp, Homo sapiens
agataacctaataattgtat

SEQ ID NO: 4609643 - DNA, 22 bp, Homo sapiens
agataataatgggtttctttca

SEQ ID NO: 4609644 - DNA, 13 bp, Homo sapiens
agatactggtgga

SEQ ID NO: 4609645 - DNA, 14 bp, Homo sapiens
agatactggtggaa

SEQ ID NO: 4609646 - DNA, 17 bp, Homo sapiens
agatacttatgcaagat

SEQ ID NO: 4609647 - DNA, 16 bp, Homo sapiens
agatacttcctgccct

SEQ ID NO: 4609648 - DNA, 17 bp, Homo sapiens
agatagaagaattttat

SEQ ID NO: 4609649 - DNA, 17 bp, Homo sapiens
agatagcattgtgaact

SEQ ID NO: 4609650 - DNA, 22 bp, Homo sapiens
agatagcattgtgaactgacag

SEQ ID NO: 4609651 - DNA, 19 bp, Homo sapiens
agatatgccactaacttct

SEQ ID NO: 4609652 - DNA, 12 bp, Homo sapiens
agatattcttta

SEQ ID NO: 4609653 - DNA, 14 bp, Homo sapiens
agatattctttaca

SEQ ID NO: 4609654 - DNA, 15 bp, Homo sapiens
agatattctttacaa

SEQ ID NO: 4609655 - DNA, 14 bp, Homo sapiens
agatcaagctgtga

SEQ ID NO: 4609656 - DNA, 14 bp, Homo sapiens
agatcacagcccca

SEQ ID NO: 4609657 - DNA, 15 bp, Homo sapiens
agatcacagccccac

SEQ ID NO: 4609658 - DNA, 20 bp, Homo sapiens
agatcagggcctgccccctg

SEQ ID NO: 4609659 - DNA, 19 bp, Homo sapiens
agatcattggagtttagga

SEQ ID NO: 4609660 - DNA, 21 bp, Homo sapiens
agatcgacagacagccaggta

SEQ ID NO: 4609661 - DNA, 14 bp, Homo sapiens
agatctaatgtgaa

SEQ ID NO: 4609662 - DNA, 15 bp, Homo sapiens
agatctaatgtgaaa

SEQ ID NO: 4609663 - DNA, 21 bp, Homo sapiens
agatctaccctgcctgtacta

SEQ ID NO: 4609664 - DNA, 19 bp, Homo sapiens
agatctgccagacctgcat

SEQ ID NO: 4609665 - DNA, 13 bp, Homo sapiens
agatctggggagg

SEQ ID NO: 4609666 - DNA, 20 bp, Homo sapiens
agatctgtgccatagaacaa

SEQ ID NO: 4609667 - DNA, 19 bp, Homo sapiens
agatgaccagggatgctgg

SEQ ID NO: 4609668 - DNA, 13 bp, Homo sapiens
agatgagcccacc

SEQ ID NO: 4609669 - DNA, 16 bp, Homo sapiens
agatgagcctgggctc

SEQ ID NO: 4609670 - DNA, 15 bp, Homo sapiens
agatgaggccctgca

SEQ ID NO: 4609671 - DNA, 18 bp, Homo sapiens
agatgaggccctgcacct

SEQ ID NO: 4609672 - DNA, 18 bp, Homo sapiens
agatgcaatgtgctactg

SEQ ID NO: 4609673 - DNA, 12 bp, Homo sapiens
agatgcagctgg

SEQ ID NO: 4609674 - DNA, 16 bp, Homo sapiens
agatgcagggcagtca

SEQ ID NO: 4609675 - DNA, 16 bp, Homo sapiens
agatgccccctccagg

SEQ ID NO: 4609676 - DNA, 22 bp, Homo sapiens
agatgcccttgctgggcctggg

SEQ ID NO: 4609677 - DNA, 18 bp, Homo sapiens
agatgcctcctgtcagat

SEQ ID NO: 4609678 - DNA, 15 bp, Homo sapiens
agatgctcactttat

SEQ ID NO: 4609679 - DNA, 16 bp, Homo sapiens
agatgctcactttatt

SEQ ID NO: 4609680 - DNA, 16 bp, Homo sapiens
agatggagggcttggc

SEQ ID NO: 4609681 - DNA, 17 bp, Homo sapiens
agatggagggcttggcc

SEQ ID NO: 4609682 - DNA, 23 bp, Homo sapiens
agatggagtcccttttcattctc

SEQ ID NO: 4609683 - DNA, 21 bp, Homo sapiens
agatggagtctcactcttgtc

SEQ ID NO: 4609684 - DNA, 14 bp, Homo sapiens
agatggtatgaaat

SEQ ID NO: 4609685 - DNA, 16 bp, Homo sapiens
agatgtacctggtgga

SEQ ID NO: 4609686 - DNA, 17 bp, Homo sapiens
agatgtacttctctgtg

SEQ ID NO: 4609687 - DNA, 15 bp, Homo sapiens
agatgtaggagggac

SEQ ID NO: 4609688 - DNA, 14 bp, Homo sapiens
agatgtattcttta

SEQ ID NO: 4609689 - DNA, 16 bp, Homo sapiens
agatgtattctttata

SEQ ID NO: 4609690 - DNA, 17 bp, Homo sapiens
agatgtgatcaggcccc

SEQ ID NO: 4609691 - DNA, 11 bp, Homo sapiens
agattaatttt

SEQ ID NO: 4609692 - DNA, 13 bp, Homo sapiens
agattctcttgaa

SEQ ID NO: 4609693 - DNA, 15 bp, Homo sapiens
agattgcatgtgact

SEQ ID NO: 4609694 - DNA, 16 bp, Homo sapiens
agattgcatgtgactc

SEQ ID NO: 4609695 - DNA, 15 bp, Homo sapiens
agattgtactgttca

SEQ ID NO: 4609696 - DNA, 22 bp, Homo sapiens
agattgtactgttcatacagtt

SEQ ID NO: 4609697 - DNA, 13 bp, Homo sapiens
agatttaacccct

SEQ ID NO: 4609698 - DNA, 23 bp, Homo sapiens
agatttaagtgaatacattaacg

SEQ ID NO: 4609699 - DNA, 12 bp, Homo sapiens
agatttagtgta

SEQ ID NO: 4609700 - DNA, 19 bp, Homo sapiens
agatttagtgtaataagac

SEQ ID NO: 4609701 - DNA, 20 bp, Homo sapiens
agatttccttaaaatctcta

SEQ ID NO: 4609702 - DNA, 12 bp, Homo sapiens
agatttctatga

SEQ ID NO: 4609703 - DNA, 13 bp, Homo sapiens
agattttcatttt

SEQ ID NO: 4609704 - DNA, 19 bp, Homo sapiens
agatttttaaaaaatattt

SEQ ID NO: 4609705 - DNA, 15 bp, Homo sapiens
agatttttttgtaag

SEQ ID NO: 4609706 - DNA, 13 bp, Homo sapiens
agcaaaatcaaca

SEQ ID NO: 4609707 - DNA, 21 bp, Homo sapiens
agcaaacagatgtttgttttc

SEQ ID NO: 4609708 - DNA, 22 bp, Homo sapiens
agcaaagcctgttcatggcaga

SEQ ID NO: 4609709 - DNA, 23 bp, Homo sapiens
agcaacaacaattggtaaaactc

SEQ ID NO: 4609710 - DNA, 15 bp, Homo sapiens
agcaacacagaggaa

SEQ ID NO: 4609711 - DNA, 22 bp, Homo sapiens
agcaacacagaggaatttatac

SEQ ID NO: 4609712 - DNA, 14 bp, Homo sapiens
agcaaccccaggct

SEQ ID NO: 4609713 - DNA, 20 bp, Homo sapiens
agcaaccgcctcaaaatgtg

SEQ ID NO: 4609714 - DNA, 19 bp, Homo sapiens
agcaaccgtggcccttcct

SEQ ID NO: 4609715 - DNA, 20 bp, Homo sapiens
agcaaccgtggcccttcctg

SEQ ID NO: 4609716 - DNA, 17 bp, Homo sapiens
agcaacgcttgtagaac

SEQ ID NO: 4609717 - DNA, 17 bp, Homo sapiens
agcaacggccccagcgc

SEQ ID NO: 4609718 - DNA, 12 bp, Homo sapiens
agcaagaaacag

SEQ ID NO: 4609719 - DNA, 16 bp, Homo sapiens
agcaagaccctgcctc

SEQ ID NO: 4609720 - DNA, 14 bp, Homo sapiens
agcaagactgggcc

SEQ ID NO: 4609721 - DNA, 15 bp, Homo sapiens
agcaagactgggccc

SEQ ID NO: 4609722 - DNA, 16 bp, Homo sapiens
agcaagcaacacagag

SEQ ID NO: 4609723 - DNA, 16 bp, Homo sapiens
agcaagcctgaattgg

SEQ ID NO: 4609724 - DNA, 18 bp, Homo sapiens
agcaaggcccgagcagct

SEQ ID NO: 4609725 - DNA, 21 bp, Homo sapiens
agcaaggcccgagcagctgag

SEQ ID NO: 4609726 - DNA, 18 bp, Homo sapiens
agcaagtcctcactcttc

SEQ ID NO: 4609727 - DNA, 16 bp, Homo sapiens
agcaataaagaagagt

SEQ ID NO: 4609728 - DNA, 14 bp, Homo sapiens
agcaatcattttat

SEQ ID NO: 4609729 - DNA, 16 bp, Homo sapiens
agcaatctgaccctat

SEQ ID NO: 4609730 - DNA, 19 bp, Homo sapiens
agcaatttaactagacaca

SEQ ID NO: 4609731 - DNA, 17 bp, Homo sapiens
agcacaatcactaaact

SEQ ID NO: 4609732 - DNA, 18 bp, Homo sapiens
agcacacaggcagccagc

SEQ ID NO: 4609733 - DNA, 14 bp, Homo sapiens
agcacacattattt

SEQ ID NO: 4609734 - DNA, 23 bp, Homo sapiens
agcacagcagcctggggctggcc

SEQ ID NO: 4609735 - DNA, 13 bp, Homo sapiens
agcacagccaaca

SEQ ID NO: 4609736 - DNA, 15 bp, Homo sapiens
agcacagctcctgcc

SEQ ID NO: 4609737 - DNA, 17 bp, Homo sapiens
agcacatattttctgtt

SEQ ID NO: 4609738 - DNA, 22 bp, Homo sapiens
agcacatccaggcaatggccta

SEQ ID NO: 4609739 - DNA, 23 bp, Homo sapiens
agcaccagtgggactgtggtgac

SEQ ID NO: 4609740 - DNA, 15 bp, Homo sapiens
agcacctccaggcct

SEQ ID NO: 4609741 - DNA, 13 bp, Homo sapiens
agcacctgtctgg

SEQ ID NO: 4609742 - DNA, 23 bp, Homo sapiens
agcacctgtgcccatggcttctg

SEQ ID NO: 4609743 - DNA, 18 bp, Homo sapiens
agcacgggacggaagtgc

SEQ ID NO: 4609744 - DNA, 17 bp, Homo sapiens
agcactacctaagtaat

SEQ ID NO: 4609745 - DNA, 17 bp, Homo sapiens
agcactactgggtgtca

SEQ ID NO: 4609746 - DNA, 18 bp, Homo sapiens
agcactccccagagctgt

SEQ ID NO: 4609747 - DNA, 20 bp, Homo sapiens
agcactccccagagctgtgc

SEQ ID NO: 4609748 - DNA, 17 bp, Homo sapiens
agcactcggggtccctg

SEQ ID NO: 4609749 - DNA, 18 bp, Homo sapiens
agcactcggggtccctgg

SEQ ID NO: 4609750 - DNA, 20 bp, Homo sapiens
agcactcggggtccctggag

SEQ ID NO: 4609751 - DNA, 14 bp, Homo sapiens
agcactgccaggag

SEQ ID NO: 4609752 - DNA, 17 bp, Homo sapiens
agcactgccaggaggga

SEQ ID NO: 4609753 - DNA, 15 bp, Homo sapiens
agcactgtggacacc

SEQ ID NO: 4609754 - DNA, 14 bp, Homo sapiens
agcactgtgtttat

SEQ ID NO: 4609755 - DNA, 22 bp, Homo sapiens
agcactgtgtttatatgtcttg

SEQ ID NO: 4609756 - DNA, 17 bp, Homo sapiens
agcacttagacctgcca

SEQ ID NO: 4609757 - DNA, 16 bp, Homo sapiens
agcacttgagctgtct

SEQ ID NO: 4609758 - DNA, 23 bp, Homo sapiens
agcacttgagctgtctgaagccc

SEQ ID NO: 4609759 - DNA, 14 bp, Homo sapiens
agcagaactgaagt

SEQ ID NO: 4609760 - DNA, 21 bp, Homo sapiens
agcagacaataacttcttaaa

SEQ ID NO: 4609761 - DNA, 20 bp, Homo sapiens
agcagacctaaagcaagcct

SEQ ID NO: 4609762 - DNA, 22 bp, Homo sapiens
agcagagatcgacagacagcca

SEQ ID NO: 4609763 - DNA, 22 bp, Homo sapiens
agcagagggacaaccagaaggc

SEQ ID NO: 4609764 - DNA, 19 bp, Homo sapiens
agcagcaccgttctgtgca

SEQ ID NO: 4609765 - DNA, 13 bp, Homo sapiens
agcagccagccct

SEQ ID NO: 4609766 - DNA, 15 bp, Homo sapiens
agcagccagccctgc

SEQ ID NO: 4609767 - DNA, 17 bp, Homo sapiens
agcagccagccctgcct

SEQ ID NO: 4609768 - DNA, 20 bp, Homo sapiens
agcagccagccctgcctgga

SEQ ID NO: 4609769 - DNA, 22 bp, Homo sapiens
agcagccagccctgcctggagg

SEQ ID NO: 4609770 - DNA, 20 bp, Homo sapiens
agcagctccaccactgtgca

SEQ ID NO: 4609771 - DNA, 12 bp, Homo sapiens
agcagctgagca

SEQ ID NO: 4609772 - DNA, 14 bp, Homo sapiens
agcagctgagcagg

SEQ ID NO: 4609773 - DNA, 16 bp, Homo sapiens
agcagctgagcagggc

SEQ ID NO: 4609774 - DNA, 18 bp, Homo sapiens
agcagctgagcagggccg

SEQ ID NO: 4609775 - DNA, 19 bp, Homo sapiens
agcagctgagcagggccgg

SEQ ID NO: 4609776 - DNA, 23 bp, Homo sapiens
agcaggaacttctagctcattta

SEQ ID NO: 4609777 - DNA, 15 bp, Homo sapiens
agcaggaataaagac

SEQ ID NO: 4609778 - DNA, 15 bp, Homo sapiens
agcaggactgtgcct

SEQ ID NO: 4609779 - DNA, 19 bp, Homo sapiens
agcaggagccccgccacag

SEQ ID NO: 4609780 - DNA, 16 bp, Homo sapiens
agcaggaggtgcctga

SEQ ID NO: 4609781 - DNA, 20 bp, Homo sapiens
agcaggagtggtgcagacag

SEQ ID NO: 4609782 - DNA, 21 bp, Homo sapiens
agcaggagtggtgcagacaga

SEQ ID NO: 4609783 - DNA, 19 bp, Homo sapiens
agcaggatcgaagggtttt

SEQ ID NO: 4609784 - DNA, 20 bp, Homo sapiens
agcaggatcgaagggttttt

SEQ ID NO: 4609785 - DNA, 19 bp, Homo sapiens
agcaggcaatgctgtactt

SEQ ID NO: 4609786 - DNA, 16 bp, Homo sapiens
agcaggcaccgccacg

SEQ ID NO: 4609787 - DNA, 16 bp, Homo sapiens
agcaggcagcgccaag

SEQ ID NO: 4609788 - DNA, 19 bp, Homo sapiens
agcaggccaaacatggcca

SEQ ID NO: 4609789 - DNA, 12 bp, Homo sapiens
agcaggccgccc

SEQ ID NO: 4609790 - DNA, 19 bp, Homo sapiens
agcaggccgccctcggact

SEQ ID NO: 4609791 - DNA, 22 bp, Homo sapiens
agcagggccggggaactggcca

SEQ ID NO: 4609792 - DNA, 20 bp, Homo sapiens
agcagggctggtcacctccc

SEQ ID NO: 4609793 - DNA, 19 bp, Homo sapiens
agcaggggggctgtgccaa

SEQ ID NO: 4609794 - DNA, 23 bp, Homo sapiens
agcaggggggctgtgccaacctg

SEQ ID NO: 4609795 - DNA, 23 bp, Homo sapiens
agcagggtcttttcatctgggaa

SEQ ID NO: 4609796 - DNA, 21 bp, Homo sapiens
agcaggttccccaagggccct

SEQ ID NO: 4609797 - DNA, 23 bp, Homo sapiens
agcaggttccccaagggccctgg

SEQ ID NO: 4609798 - DNA, 14 bp, Homo sapiens
agcagtcactggga

SEQ ID NO: 4609799 - DNA, 17 bp, Homo sapiens
agcataatctgaaaaca

SEQ ID NO: 4609800 - DNA, 21 bp, Homo sapiens
agcataatctgaaaacatcta

SEQ ID NO: 4609801 - DNA, 13 bp, Homo sapiens
agcatacttcaaa

SEQ ID NO: 4609802 - DNA, 22 bp, Homo sapiens
agcatatcgtttaattttaaga

SEQ ID NO: 4609803 - DNA, 14 bp, Homo sapiens
agcatattttctta

SEQ ID NO: 4609804 - DNA, 20 bp, Homo sapiens
agcatattttcttactttta

SEQ ID NO: 4609805 - DNA, 14 bp, Homo sapiens
agcatcatcctgca

SEQ ID NO: 4609806 - DNA, 13 bp, Homo sapiens
agcatcatgcctc

SEQ ID NO: 4609807 - DNA, 16 bp, Homo sapiens
agcatcatgcctctga

SEQ ID NO: 4609808 - DNA, 19 bp, Homo sapiens
agcatcatgcctctgaggc

SEQ ID NO: 4609809 - DNA, 13 bp, Homo sapiens
agcatccctggag

SEQ ID NO: 4609810 - DNA, 14 bp, Homo sapiens
agcatccctggagc

SEQ ID NO: 4609811 - DNA, 18 bp, Homo sapiens
agcatgaataacatttaa

SEQ ID NO: 4609812 - DNA, 19 bp, Homo sapiens
agcatgaataacatttaaa

SEQ ID NO: 4609813 - DNA, 22 bp, Homo sapiens
agcatgatgggaggtgtgccag

SEQ ID NO: 4609814 - DNA, 20 bp, Homo sapiens
agcatgcctgtcctttcagt

SEQ ID NO: 4609815 - DNA, 14 bp, Homo sapiens
agcatgcttgggct

SEQ ID NO: 4609816 - DNA, 16 bp, Homo sapiens
agcatgcttgggctga

SEQ ID NO: 4609817 - DNA, 17 bp, Homo sapiens
agcatgcttgggctgac

SEQ ID NO: 4609818 - DNA, 21 bp, Homo sapiens
agcatggtcccacatccctgg

SEQ ID NO: 4609819 - DNA, 22 bp, Homo sapiens
agcatggtcccacatccctggg

SEQ ID NO: 4609820 - DNA, 14 bp, Homo sapiens
agcatggtgtcagt

SEQ ID NO: 4609821 - DNA, 20 bp, Homo sapiens
agcattaagctgttcctgtt

SEQ ID NO: 4609822 - DNA, 23 bp, Homo sapiens
agcattgaagtatggtgtgttca

SEQ ID NO: 4609823 - DNA, 11 bp, Homo sapiens
agcattgcttt

SEQ ID NO: 4609824 - DNA, 12 bp, Homo sapiens
agcattgctttc

SEQ ID NO: 4609825 - DNA, 14 bp, Homo sapiens
agcattgctttctg

SEQ ID NO: 4609826 - DNA, 17 bp, Homo sapiens
agcattgctttctgaaa

SEQ ID NO: 4609827 - DNA, 23 bp, Homo sapiens
agcatttggtggcctaatttaca

SEQ ID NO: 4609828 - DNA, 20 bp, Homo sapiens
agcattttttatcaggcagg

SEQ ID NO: 4609829 - DNA, 15 bp, Homo sapiens
agccaaagaaacaag

SEQ ID NO: 4609830 - DNA, 17 bp, Homo sapiens
agccaaagaaacaagct

SEQ ID NO: 4609831 - DNA, 19 bp, Homo sapiens
agccaaagaaacaagctgt

SEQ ID NO: 4609832 - DNA, 23 bp, Homo sapiens
agccaaccttgctcttggggaag

SEQ ID NO: 4609833 - DNA, 17 bp, Homo sapiens
agccaactgtttccctg

SEQ ID NO: 4609834 - DNA, 19 bp, Homo sapiens
agccaactgtttccctgct

SEQ ID NO: 4609835 - DNA, 21 bp, Homo sapiens
agccaactgtttccctgctga

SEQ ID NO: 4609836 - DNA, 19 bp, Homo sapiens
agccaagtgccaaatgctc

SEQ ID NO: 4609837 - DNA, 16 bp, Homo sapiens
agccaattcagacagg

SEQ ID NO: 4609838 - DNA, 18 bp, Homo sapiens
agccaattcagacaggca

SEQ ID NO: 4609839 - DNA, 14 bp, Homo sapiens
agccacaagctgca

SEQ ID NO: 4609840 - DNA, 15 bp, Homo sapiens
agccacaagctgcac

SEQ ID NO: 4609841 - DNA, 21 bp, Homo sapiens
agccacaagctgcactgtgaa

SEQ ID NO: 4609842 - DNA, 23 bp, Homo sapiens
agccacacttctcaggacacagg

SEQ ID NO: 4609843 - DNA, 16 bp, Homo sapiens
agccacagacccctgg

SEQ ID NO: 4609844 - DNA, 16 bp, Homo sapiens
agccacaggaccacct

SEQ ID NO: 4609845 - DNA, 13 bp, Homo sapiens
agccacccctgag

SEQ ID NO: 4609846 - DNA, 18 bp, Homo sapiens
agccaccctgaggagtct

SEQ ID NO: 4609847 - DNA, 13 bp, Homo sapiens
agccactctgttc

SEQ ID NO: 4609848 - DNA, 12 bp, Homo sapiens
agccactgtcac

SEQ ID NO: 4609849 - DNA, 14 bp, Homo sapiens
agccactgtcaccg

SEQ ID NO: 4609850 - DNA, 21 bp, Homo sapiens
agccacttctggcttcagccc

SEQ ID NO: 4609851 - DNA, 22 bp, Homo sapiens
agccagaacgtggctctgctgg

SEQ ID NO: 4609852 - DNA, 21 bp, Homo sapiens
agccagaattctaccctggaa

SEQ ID NO: 4609853 - DNA, 15 bp, Homo sapiens
agccagaccagcagg

SEQ ID NO: 4609854 - DNA, 19 bp, Homo sapiens
agccagcacacagggcagt

SEQ ID NO: 4609855 - DNA, 20 bp, Homo sapiens
agccagcacttgtccagctg

SEQ ID NO: 4609856 - DNA, 22 bp, Homo sapiens
agccagcacttgtccagctgag

SEQ ID NO: 4609857 - DNA, 15 bp, Homo sapiens
agccagccaggtgca

SEQ ID NO: 4609858 - DNA, 14 bp, Homo sapiens
agccagccctgcct

SEQ ID NO: 4609859 - DNA, 17 bp, Homo sapiens
agccagccctgcctgga

SEQ ID NO: 4609860 - DNA, 18 bp, Homo sapiens
agccagccctgcctggag

SEQ ID NO: 4609861 - DNA, 23 bp, Homo sapiens
agccagccctgcctggaggacct

SEQ ID NO: 4609862 - DNA, 19 bp, Homo sapiens
agccagccggggcgagtgg

SEQ ID NO: 4609863 - DNA, 16 bp, Homo sapiens
agccaggaggcctgct

SEQ ID NO: 4609864 - DNA, 17 bp, Homo sapiens
agccaggccccacccct

SEQ ID NO: 4609865 - DNA, 19 bp, Homo sapiens
agccaggccccaccccttc

SEQ ID NO: 4609866 - DNA, 16 bp, Homo sapiens
agccagggtctctccc

SEQ ID NO: 4609867 - DNA, 20 bp, Homo sapiens
agccagggtctctccctcag

SEQ ID NO: 4609868 - DNA, 15 bp, Homo sapiens
agccaggtacaggag

SEQ ID NO: 4609869 - DNA, 21 bp, Homo sapiens
agccaggtacaggagaggcag

SEQ ID NO: 4609870 - DNA, 17 bp, Homo sapiens
agccaggtatggctctg

SEQ ID NO: 4609871 - DNA, 15 bp, Homo sapiens
agccaggtctcctgg

SEQ ID NO: 4609872 - DNA, 17 bp, Homo sapiens
agccaggtctcctggga

SEQ ID NO: 4609873 - DNA, 13 bp, Homo sapiens
agccataattttg

SEQ ID NO: 4609874 - DNA, 22 bp, Homo sapiens
agccatttagagggtgaaggag

SEQ ID NO: 4609875 - DNA, 13 bp, Homo sapiens
agcccaaagcctg

SEQ ID NO: 4609876 - DNA, 19 bp, Homo sapiens
agcccaaggacagttcaga

SEQ ID NO: 4609877 - DNA, 23 bp, Homo sapiens
agcccaaggacagttcagagatc

SEQ ID NO: 4609878 - DNA, 14 bp, Homo sapiens
agcccagagaacag

SEQ ID NO: 4609879 - DNA, 17 bp, Homo sapiens
agcccagcgccatcctg

SEQ ID NO: 4609880 - DNA, 13 bp, Homo sapiens
agcccagctgggt

SEQ ID NO: 4609881 - DNA, 17 bp, Homo sapiens
agcccagctgggtcagg

SEQ ID NO: 4609882 - DNA, 19 bp, Homo sapiens
agcccagctgggtcaggca

SEQ ID NO: 4609883 - DNA, 21 bp, Homo sapiens
agcccagctgggtcaggcagg

SEQ ID NO: 4609884 - DNA, 19 bp, Homo sapiens
agcccaggatactggcaca

SEQ ID NO: 4609885 - DNA, 23 bp, Homo sapiens
agcccaggatactggcacagagg

SEQ ID NO: 4609886 - DNA, 14 bp, Homo sapiens
agcccagtgcaaac

SEQ ID NO: 4609887 - DNA, 17 bp, Homo sapiens
agcccatggaggcagat

SEQ ID NO: 4609888 - DNA, 19 bp, Homo sapiens
agcccatggaggcagatgc

SEQ ID NO: 4609889 - DNA, 17 bp, Homo sapiens
agcccattaatcttgat

SEQ ID NO: 4609890 - DNA, 16 bp, Homo sapiens
agcccattgctgccaa

SEQ ID NO: 4609891 - DNA, 20 bp, Homo sapiens
agccccagagaaactgccac

SEQ ID NO: 4609892 - DNA, 15 bp, Homo sapiens
agccccatttcctca

SEQ ID NO: 4609893 - DNA, 16 bp, Homo sapiens
agcccccaccagggga

SEQ ID NO: 4609894 - DNA, 21 bp, Homo sapiens
agccccctcctggtgccacct

SEQ ID NO: 4609895 - DNA, 13 bp, Homo sapiens
agccccctgccct

SEQ ID NO: 4609896 - DNA, 15 bp, Homo sapiens
agccccgacttcctg

SEQ ID NO: 4609897 - DNA, 15 bp, Homo sapiens
agcccctcacttcca

SEQ ID NO: 4609898 - DNA, 22 bp, Homo sapiens
agcccctcctccagcccctgtc

SEQ ID NO: 4609899 - DNA, 12 bp, Homo sapiens
agcccctgaccc

SEQ ID NO: 4609900 - DNA, 16 bp, Homo sapiens
agcccctgggcccagt

SEQ ID NO: 4609901 - DNA, 13 bp, Homo sapiens
agccccttcccct

SEQ ID NO: 4609902 - DNA, 18 bp, Homo sapiens
agccccttcccctgggaa

SEQ ID NO: 4609903 - DNA, 19 bp, Homo sapiens
agccccttcccctgggaac

SEQ ID NO: 4609904 - DNA, 18 bp, Homo sapiens
agcccgaagtctgctgct

SEQ ID NO: 4609905 - DNA, 16 bp, Homo sapiens
agcccgacagtgccat

SEQ ID NO: 4609906 - DNA, 17 bp, Homo sapiens
agcccgtgccaccccca

SEQ ID NO: 4609907 - DNA, 18 bp, Homo sapiens
agcccgtgccacccccag

SEQ ID NO: 4609908 - DNA, 22 bp, Homo sapiens
agccctcagacatttatatatt

SEQ ID NO: 4609909 - DNA, 17 bp, Homo sapiens
agccctcagactgtcag

SEQ ID NO: 4609910 - DNA, 16 bp, Homo sapiens
agccctcagctggtcc

SEQ ID NO: 4609911 - DNA, 20 bp, Homo sapiens
agccctcagctggtcctgac

SEQ ID NO: 4609912 - DNA, 23 bp, Homo sapiens
agccctcgggtccatagagatga

SEQ ID NO: 4609913 - DNA, 18 bp, Homo sapiens
agccctctcactgtgtcc

SEQ ID NO: 4609914 - DNA, 19 bp, Homo sapiens
agccctctcactgtgtccc

SEQ ID NO: 4609915 - DNA, 14 bp, Homo sapiens
agccctgcccacag

SEQ ID NO: 4609916 - DNA, 22 bp, Homo sapiens
agccctgcctggaggacctgag

SEQ ID NO: 4609917 - DNA, 19 bp, Homo sapiens
agccctggcccccatcagc

SEQ ID NO: 4609918 - DNA, 19 bp, Homo sapiens
agccctgggaaccactccc

SEQ ID NO: 4609919 - DNA, 14 bp, Homo sapiens
agccctgggaccgc

SEQ ID NO: 4609920 - DNA, 12 bp, Homo sapiens
agccgactctgg

SEQ ID NO: 4609921 - DNA, 13 bp, Homo sapiens
agccgactctggc

SEQ ID NO: 4609922 - DNA, 20 bp, Homo sapiens
agccgactctggccctggcc

SEQ ID NO: 4609923 - DNA, 21 bp, Homo sapiens
agccgactctggccctggccc

SEQ ID NO: 4609924 - DNA, 17 bp, Homo sapiens
agccggtaactgtcctg

SEQ ID NO: 4609925 - DNA, 23 bp, Homo sapiens
agcctaatccctgggcattgctt

SEQ ID NO: 4609926 - DNA, 18 bp, Homo sapiens
agcctaccgctggccctg

SEQ ID NO: 4609927 - DNA, 14 bp, Homo sapiens
agcctacctgtatg

SEQ ID NO: 4609928 - DNA, 12 bp, Homo sapiens
agcctaggccag

SEQ ID NO: 4609929 - DNA, 13 bp, Homo sapiens
agcctaggccagg

SEQ ID NO: 4609930 - DNA, 18 bp, Homo sapiens
agcctcacccctgcccct

SEQ ID NO: 4609931 - DNA, 19 bp, Homo sapiens
agcctcacccctgcccctg

SEQ ID NO: 4609932 - DNA, 15 bp, Homo sapiens
agcctcacttccttt

SEQ ID NO: 4609933 - DNA, 20 bp, Homo sapiens
agcctcatagttattatcca

SEQ ID NO: 4609934 - DNA, 17 bp, Homo sapiens
agcctcccatccagggc

SEQ ID NO: 4609935 - DNA, 18 bp, Homo sapiens
agcctcccatccagggcc

SEQ ID NO: 4609936 - DNA, 12 bp, Homo sapiens
agcctccctgcc

SEQ ID NO: 4609937 - DNA, 13 bp, Homo sapiens
agcctccctgcct

SEQ ID NO: 4609938 - DNA, 14 bp, Homo sapiens
agcctcctcctccg

SEQ ID NO: 4609939 - DNA, 21 bp, Homo sapiens
agcctcgcaacccgtgccaag

SEQ ID NO: 4609940 - DNA, 17 bp, Homo sapiens
agcctcgctttttcatc

SEQ ID NO: 4609941 - DNA, 13 bp, Homo sapiens
agcctctggtcct

SEQ ID NO: 4609942 - DNA, 17 bp, Homo sapiens
agcctcttattccagga

SEQ ID NO: 4609943 - DNA, 15 bp, Homo sapiens
agcctgaggacagaa

SEQ ID NO: 4609944 - DNA, 21 bp, Homo sapiens
agcctgaggacagaaagaccc

SEQ ID NO: 4609945 - DNA, 22 bp, Homo sapiens
agcctgaggacagaaagaccct

SEQ ID NO: 4609946 - DNA, 15 bp, Homo sapiens
agcctgaggtgccca

SEQ ID NO: 4609947 - DNA, 18 bp, Homo sapiens
agcctgaggtgcccactc

SEQ ID NO: 4609948 - DNA, 20 bp, Homo sapiens
agcctgaggtgcccactccg

SEQ ID NO: 4609949 - DNA, 19 bp, Homo sapiens
agcctgatgagatttttaa

SEQ ID NO: 4609950 - DNA, 17 bp, Homo sapiens
agcctgcaaagctggtt

SEQ ID NO: 4609951 - DNA, 21 bp, Homo sapiens
agcctgcaactcatctttcat

SEQ ID NO: 4609952 - DNA, 21 bp, Homo sapiens
agcctgcctcgccttgtgtta

SEQ ID NO: 4609953 - DNA, 15 bp, Homo sapiens
agcctggcctcctgc

SEQ ID NO: 4609954 - DNA, 17 bp, Homo sapiens
agcctggcctcctgcct

SEQ ID NO: 4609955 - DNA, 20 bp, Homo sapiens
agcctgggcctatggagagc

SEQ ID NO: 4609956 - DNA, 22 bp, Homo sapiens
agcctgggcctatggagagccc

SEQ ID NO: 4609957 - DNA, 21 bp, Homo sapiens
agcctgggctcatagtgagaa

SEQ ID NO: 4609958 - DNA, 14 bp, Homo sapiens
agcctggggctcta

SEQ ID NO: 4609959 - DNA, 15 bp, Homo sapiens
agcctggggctctaa

SEQ ID NO: 4609960 - DNA, 15 bp, Homo sapiens
agcctgtgaacccag

SEQ ID NO: 4609961 - DNA, 18 bp, Homo sapiens
agcctgtgaacccaggac

SEQ ID NO: 4609962 - DNA, 17 bp, Homo sapiens
agcctgtggcctttgca

SEQ ID NO: 4609963 - DNA, 11 bp, Homo sapiens
agcctgtttca

SEQ ID NO: 4609964 - DNA, 18 bp, Homo sapiens
agccttattttgagtaaa

SEQ ID NO: 4609965 - DNA, 14 bp, Homo sapiens
agccttccagtttt

SEQ ID NO: 4609966 - DNA, 17 bp, Homo sapiens
agccttccctctgcatt

SEQ ID NO: 4609967 - DNA, 22 bp, Homo sapiens
agccttgacctaatgaggtagc

SEQ ID NO: 4609968 - DNA, 13 bp, Homo sapiens
agcctttaaattg

SEQ ID NO: 4609969 - DNA, 21 bp, Homo sapiens
agcctttaaattgttcctctt

SEQ ID NO: 4609970 - DNA, 16 bp, Homo sapiens
agcctttgtggtttag

SEQ ID NO: 4609971 - DNA, 12 bp, Homo sapiens
agcgaacatctt

SEQ ID NO: 4609972 - DNA, 17 bp, Homo sapiens
agcgaagtagcttgctc

SEQ ID NO: 4609973 - DNA, 18 bp, Homo sapiens
agcgatgtatgcagctat

SEQ ID NO: 4609974 - DNA, 19 bp, Homo sapiens
agcgattccctctcccagg

SEQ ID NO: 4609975 - DNA, 15 bp, Homo sapiens
agcgccaagtgcgtg

SEQ ID NO: 4609976 - DNA, 20 bp, Homo sapiens
agcgccaagtgcgtgccgtg

SEQ ID NO: 4609977 - DNA, 21 bp, Homo sapiens
agcgccctgcagaccctgccc

SEQ ID NO: 4609978 - DNA, 18 bp, Homo sapiens
agcggccggccagcccct

SEQ ID NO: 4609979 - DNA, 15 bp, Homo sapiens
agcgtgggctcagca

SEQ ID NO: 4609980 - DNA, 16 bp, Homo sapiens
agcgttaagggcagag

SEQ ID NO: 4609981 - DNA, 17 bp, Homo sapiens
agcgtttttaacctgtt

SEQ ID NO: 4609982 - DNA, 18 bp, Homo sapiens
agcgtttttaacctgttt

SEQ ID NO: 4609983 - DNA, 16 bp, Homo sapiens
agctaaaaatattact

SEQ ID NO: 4609984 - DNA, 19 bp, Homo sapiens
agctaacagggaaggcagg

SEQ ID NO: 4609985 - DNA, 15 bp, Homo sapiens
agctaactgtaaatc

SEQ ID NO: 4609986 - DNA, 16 bp, Homo sapiens
agctaactgtaaatca

SEQ ID NO: 4609987 - DNA, 22 bp, Homo sapiens
agctaagggtgggtgctcagaa

SEQ ID NO: 4609988 - DNA, 23 bp, Homo sapiens
agctaagggtgggtgctcagaat

SEQ ID NO: 4609989 - DNA, 15 bp, Homo sapiens
agctaataatgttaa

SEQ ID NO: 4609990 - DNA, 22 bp, Homo sapiens
agctacctgtgtggacaggact

SEQ ID NO: 4609991 - DNA, 18 bp, Homo sapiens
agctagaaaaataaaatg

SEQ ID NO: 4609992 - DNA, 15 bp, Homo sapiens
agctaggagcaaagc

SEQ ID NO: 4609993 - DNA, 19 bp, Homo sapiens
agctaggagcaaagcctgt

SEQ ID NO: 4609994 - DNA, 21 bp, Homo sapiens
agctaggccccagaggccctg

SEQ ID NO: 4609995 - DNA, 22 bp, Homo sapiens
agctaggccccagaggccctgg

SEQ ID NO: 4609996 - DNA, 23 bp, Homo sapiens
agctaggcttcccaggctgggct

SEQ ID NO: 4609997 - DNA, 19 bp, Homo sapiens
agctagtaatatattctga

SEQ ID NO: 4609998 - DNA, 12 bp, Homo sapiens
agctagtttgct

SEQ ID NO: 4609999 - DNA, 17 bp, Homo sapiens
agctagtttgctttttg

SEQ ID NO: 4610000 - DNA, 18 bp, Homo sapiens
agctatagttgcagccca

SEQ ID NO: 4610001 - DNA, 19 bp, Homo sapiens
agctatagttgcagcccaa

SEQ ID NO: 4610002 - DNA, 20 bp, Homo sapiens
agctatagttgcagcccaag

SEQ ID NO: 4610003 - DNA, 15 bp, Homo sapiens
agctatcacctagca

SEQ ID NO: 4610004 - DNA, 20 bp, Homo sapiens
agctatggtgagatgcagct

SEQ ID NO: 4610005 - DNA, 20 bp, Homo sapiens
agctatttccttccagcctt

SEQ ID NO: 4610006 - DNA, 21 bp, Homo sapiens
agctatttccttccagccttt

SEQ ID NO: 4610007 - DNA, 18 bp, Homo sapiens
agctcaaaaatactcttg

SEQ ID NO: 4610008 - DNA, 19 bp, Homo sapiens
agctcaacggtctggcagg

SEQ ID NO: 4610009 - DNA, 15 bp, Homo sapiens
agctcacaaggcagc

SEQ ID NO: 4610010 - DNA, 19 bp, Homo sapiens
agctcagaggcgcactgtg

SEQ ID NO: 4610011 - DNA, 13 bp, Homo sapiens
agctcatcccccc

SEQ ID NO: 4610012 - DNA, 16 bp, Homo sapiens
agctcatcccccctgc

SEQ ID NO: 4610013 - DNA, 18 bp, Homo sapiens
agctcatcccccctgctg

SEQ ID NO: 4610014 - DNA, 20 bp, Homo sapiens
agctcatcccccctgctgcc

SEQ ID NO: 4610015 - DNA, 21 bp, Homo sapiens
agctcatcccccctgctgccc

SEQ ID NO: 4610016 - DNA, 23 bp, Homo sapiens
agctcatcccccctgctgcccag

SEQ ID NO: 4610017 - DNA, 19 bp, Homo sapiens
agctccaaatccaaggaaa

SEQ ID NO: 4610018 - DNA, 15 bp, Homo sapiens
agctccaccctggcc

SEQ ID NO: 4610019 - DNA, 18 bp, Homo sapiens
agctccatgttctcccaa

SEQ ID NO: 4610020 - DNA, 10 bp, Homo sapiens
agctccccca

SEQ ID NO: 4610021 - DNA, 14 bp, Homo sapiens
agctcccctgcctt

SEQ ID NO: 4610022 - DNA, 17 bp, Homo sapiens
agctccgcctcccgggt

SEQ ID NO: 4610023 - DNA, 24 bp, Homo sapiens
agctcctctgtctcgagcgccctg

SEQ ID NO: 4610024 - DNA, 20 bp, Homo sapiens
agctcctttctgtcctggag

SEQ ID NO: 4610025 - DNA, 23 bp, Homo sapiens
agctctacaggcctgcagcccct

SEQ ID NO: 4610026 - DNA, 22 bp, Homo sapiens
agctctctaggcctctccagtt

SEQ ID NO: 4610027 - DNA, 14 bp, Homo sapiens
agctctctctagaa

SEQ ID NO: 4610028 - DNA, 17 bp, Homo sapiens
agctctgagaggccctg

SEQ ID NO: 4610029 - DNA, 18 bp, Homo sapiens
agctctgagaggccctgg

SEQ ID NO: 4610030 - DNA, 20 bp, Homo sapiens
agctctgagaggccctggat

SEQ ID NO: 4610031 - DNA, 13 bp, Homo sapiens
agctctgcccctt

SEQ ID NO: 4610032 - DNA, 20 bp, Homo sapiens
agctcttagactcgcctatc

SEQ ID NO: 4610033 - DNA, 23 bp, Homo sapiens
agctcttagactcgcctatctta

SEQ ID NO: 4610034 - DNA, 13 bp, Homo sapiens
agctcttcaatag

SEQ ID NO: 4610035 - DNA, 21 bp, Homo sapiens
agctcttccccatctcactct

SEQ ID NO: 4610036 - DNA, 22 bp, Homo sapiens
agctcttccccatctcactctt

SEQ ID NO: 4610037 - DNA, 18 bp, Homo sapiens
agctcttcccttgctcat

SEQ ID NO: 4610038 - DNA, 19 bp, Homo sapiens
agctcttcccttgctcatg

SEQ ID NO: 4610039 - DNA, 22 bp, Homo sapiens
agctcttcccttgctcatgagc

SEQ ID NO: 4610040 - DNA, 13 bp, Homo sapiens
agctctttccaaa

SEQ ID NO: 4610041 - DNA, 14 bp, Homo sapiens
agctctttccaaat

SEQ ID NO: 4610042 - DNA, 21 bp, Homo sapiens
agctctttccaaattaaaaca

SEQ ID NO: 4610043 - DNA, 18 bp, Homo sapiens
agctcttttttgtttgtt

SEQ ID NO: 4610044 - DNA, 12 bp, Homo sapiens
agctgaaaaggg

SEQ ID NO: 4610045 - DNA, 17 bp, Homo sapiens
agctgaaaagggcactc

SEQ ID NO: 4610046 - DNA, 20 bp, Homo sapiens
agctgaaaagggcactccca

SEQ ID NO: 4610047 - DNA, 22 bp, Homo sapiens
agctgaaaagggcactcccaac

SEQ ID NO: 4610048 - DNA, 17 bp, Homo sapiens
agctgaatgcctcctgt

SEQ ID NO: 4610049 - DNA, 18 bp, Homo sapiens
agctgaatgcctcctgtg

SEQ ID NO: 4610050 - DNA, 13 bp, Homo sapiens
aggacaaaacttc

SEQ ID NO: 4610051 - DNA, 21 bp, Homo sapiens
aggacaaaacttcttgtcaga

SEQ ID NO: 4610052 - DNA, 23 bp, Homo sapiens
aggacaaaacttcttgtcagaca

SEQ ID NO: 4610053 - DNA, 13 bp, Homo sapiens
aggacaagcatgg

SEQ ID NO: 4610054 - DNA, 11 bp, Homo sapiens
aggacacaggc

SEQ ID NO: 4610055 - DNA, 15 bp, Homo sapiens
aggacacaggcctgt

SEQ ID NO: 4610056 - DNA, 20 bp, Homo sapiens
aggacacccaggaatgaccc

SEQ ID NO: 4610057 - DNA, 15 bp, Homo sapiens
aggacagaggcgagg

SEQ ID NO: 4610058 - DNA, 12 bp, Homo sapiens
aggacagctgtc

SEQ ID NO: 4610059 - DNA, 20 bp, Homo sapiens
aggacaggaccctcaggaat

SEQ ID NO: 4610060 - DNA, 14 bp, Homo sapiens
aggacagttcagag

SEQ ID NO: 4610061 - DNA, 23 bp, Homo sapiens
aggacatcttaaatctaaacaaa

SEQ ID NO: 4610062 - DNA, 20 bp, Homo sapiens
aggacatgcggtagccagca

SEQ ID NO: 4610063 - DNA, 22 bp, Homo sapiens
aggacatgcggtagccagcaca

SEQ ID NO: 4610064 - DNA, 21 bp, Homo sapiens
aggaccacctcctctgccagc

SEQ ID NO: 4610065 - DNA, 14 bp, Homo sapiens
aggacccagccctc

SEQ ID NO: 4610066 - DNA, 13 bp, Homo sapiens
aggaccctcagga

SEQ ID NO: 4610067 - DNA, 16 bp, Homo sapiens
aggaccggcggctcgg

SEQ ID NO: 4610068 - DNA, 12 bp, Homo sapiens
aggacctgagcc

SEQ ID NO: 4610069 - DNA, 15 bp, Homo sapiens
aggacctgagcctgc

SEQ ID NO: 4610070 - DNA, 16 bp, Homo sapiens
aggacctgagcctgcc

SEQ ID NO: 4610071 - DNA, 21 bp, Homo sapiens
aggacctgagcctgccgagca

SEQ ID NO: 4610072 - DNA, 17 bp, Homo sapiens
aggactaacactcagaa

SEQ ID NO: 4610073 - DNA, 21 bp, Homo sapiens
aggactgagggcagtgccctt

SEQ ID NO: 4610074 - DNA, 22 bp, Homo sapiens
aggagaagcacagctcctgcca

SEQ ID NO: 4610075 - DNA, 14 bp, Homo sapiens
aggagaaggagtgc

SEQ ID NO: 4610076 - DNA, 19 bp, Homo sapiens
aggagaaggctggagaagg

SEQ ID NO: 4610077 - DNA, 15 bp, Homo sapiens
aggagacaggatgag

SEQ ID NO: 4610078 - DNA, 15 bp, Homo sapiens
aggagagaagaatga

SEQ ID NO: 4610079 - DNA, 12 bp, Homo sapiens
aggagagagacc

SEQ ID NO: 4610080 - DNA, 16 bp, Homo sapiens
aggagagagaccccgc

SEQ ID NO: 4610081 - DNA, 16 bp, Homo sapiens
aggagaggcagcatgc

SEQ ID NO: 4610082 - DNA, 22 bp, Homo sapiens
aggagatccagggcaaggccat

SEQ ID NO: 4610083 - DNA, 16 bp, Homo sapiens
aggagatgaccaggga

SEQ ID NO: 4610084 - DNA, 19 bp, Homo sapiens
aggagatgtgatcaggccc

SEQ ID NO: 4610085 - DNA, 20 bp, Homo sapiens
aggagatgtgatcaggcccc

SEQ ID NO: 4610086 - DNA, 22 bp, Homo sapiens
aggagatgtgatcaggccccac

SEQ ID NO: 4610087 - DNA, 13 bp, Homo sapiens
aggagcaaagcct

SEQ ID NO: 4610088 - DNA, 12 bp, Homo sapiens
aggagcagccct

SEQ ID NO: 4610089 - DNA, 16 bp, Homo sapiens
aggagccaggccccac

SEQ ID NO: 4610090 - DNA, 22 bp, Homo sapiens
aggagccaggccccaccccttc

SEQ ID NO: 4610091 - DNA, 24 bp, Homo sapiens
aggagccagtgaacttggctttcc

SEQ ID NO: 4610092 - DNA, 13 bp, Homo sapiens
aggagccccaggc

SEQ ID NO: 4610093 - DNA, 14 bp, Homo sapiens
aggagccccgccac

SEQ ID NO: 4610094 - DNA, 23 bp, Homo sapiens
aggagcccgaagtctgctgctgt

SEQ ID NO: 4610095 - DNA, 15 bp, Homo sapiens
aggagcctaggccag

SEQ ID NO: 4610096 - DNA, 17 bp, Homo sapiens
aggagcctatggcatct

SEQ ID NO: 4610097 - DNA, 21 bp, Homo sapiens
aggagcctgtgcgtcccagct

SEQ ID NO: 4610098 - DNA, 22 bp, Homo sapiens
aggagcctgtgcgtcccagctg

SEQ ID NO: 4610099 - DNA, 23 bp, Homo sapiens
aggagcctgtgcgtcccagctga

SEQ ID NO: 4610100 - DNA, 14 bp, Homo sapiens
aggagctacctgtg

SEQ ID NO: 4610101 - DNA, 17 bp, Homo sapiens
aggagctacctgtgtgg

SEQ ID NO: 4610102 - DNA, 22 bp, Homo sapiens
aggagctacctgtgtggacagg

SEQ ID NO: 4610103 - DNA, 19 bp, Homo sapiens
aggagctcaacggtctggc

SEQ ID NO: 4610104 - DNA, 21 bp, Homo sapiens
aggaggagctctcaattttat

SEQ ID NO: 4610105 - DNA, 21 bp, Homo sapiens
aggaggatgtccctgggccag

SEQ ID NO: 4610106 - DNA, 22 bp, Homo sapiens
aggaggccaaccagcccgacag

SEQ ID NO: 4610107 - DNA, 13 bp, Homo sapiens
aggaggcccactg

SEQ ID NO: 4610108 - DNA, 20 bp, Homo sapiens
aggaggcggaggttgcagta

SEQ ID NO: 4610109 - DNA, 18 bp, Homo sapiens
aggaggctttctgggctc

SEQ ID NO: 4610110 - DNA, 15 bp, Homo sapiens
aggaggctttggtaa

SEQ ID NO: 4610111 - DNA, 23 bp, Homo sapiens
aggagggacaaaggagcctgtga

SEQ ID NO: 4610112 - DNA, 19 bp, Homo sapiens
aggagggtttgggcagagc

SEQ ID NO: 4610113 - DNA, 18 bp, Homo sapiens
aggaggtccttaggcctc

SEQ ID NO: 4610114 - DNA, 13 bp, Homo sapiens
aggaggtgcagtg

SEQ ID NO: 4610115 - DNA, 20 bp, Homo sapiens
aggaggtgcagtggaggggg

SEQ ID NO: 4610116 - DNA, 14 bp, Homo sapiens
aggaggtgtgaatg

SEQ ID NO: 4610117 - DNA, 21 bp, Homo sapiens
aggagtaatctgtgtacaaag

SEQ ID NO: 4610118 - DNA, 23 bp, Homo sapiens
aggagtcagatgaggccctgcac

SEQ ID NO: 4610119 - DNA, 16 bp, Homo sapiens
aggagtctgaggtcct

SEQ ID NO: 4610120 - DNA, 18 bp, Homo sapiens
aggagtctgaggtcctga

SEQ ID NO: 4610121 - DNA, 22 bp, Homo sapiens
aggagtggtacttaagctcccc

SEQ ID NO: 4610122 - DNA, 21 bp, Homo sapiens
aggataagaaagcctaaaatt

SEQ ID NO: 4610123 - DNA, 13 bp, Homo sapiens
aggatactgctgc

SEQ ID NO: 4610124 - DNA, 20 bp, Homo sapiens
aggatagctaactgtaaatc

SEQ ID NO: 4610125 - DNA, 23 bp, Homo sapiens
aggatagctaactgtaaatcatg

SEQ ID NO: 4610126 - DNA, 19 bp, Homo sapiens
aggatatccttatcagagc

SEQ ID NO: 4610127 - DNA, 20 bp, Homo sapiens
aggatatccttatcagagct

SEQ ID NO: 4610128 - DNA, 21 bp, Homo sapiens
aggatatccttatcagagcta

SEQ ID NO: 4610129 - DNA, 23 bp, Homo sapiens
aggatatccttatcagagctaag

SEQ ID NO: 4610130 - DNA, 23 bp, Homo sapiens
aggatcgaagggtttttagagaa

SEQ ID NO: 4610131 - DNA, 12 bp, Homo sapiens
aggatgaaggaa

SEQ ID NO: 4610132 - DNA, 19 bp, Homo sapiens
aggatgagacccagcccct

SEQ ID NO: 4610133 - DNA, 14 bp, Homo sapiens
aggatggagcaagc

SEQ ID NO: 4610134 - DNA, 17 bp, Homo sapiens
aggatgtcatgtctgct

SEQ ID NO: 4610135 - DNA, 22 bp, Homo sapiens
aggatgtccctgggccagggtc

SEQ ID NO: 4610136 - DNA, 19 bp, Homo sapiens
aggatgttgctccatcctt

SEQ ID NO: 4610137 - DNA, 15 bp, Homo sapiens
aggatttcctacccc

SEQ ID NO: 4610138 - DNA, 19 bp, Homo sapiens
aggatttttttcctcccca

SEQ ID NO: 4610139 - DNA, 22 bp, Homo sapiens
aggcaaggaacagaagtgagga

SEQ ID NO: 4610140 - DNA, 15 bp, Homo sapiens
aggcaaggaggagga

SEQ ID NO: 4610141 - DNA, 17 bp, Homo sapiens
aggcaatgctgtacttt

SEQ ID NO: 4610142 - DNA, 20 bp, Homo sapiens
aggcacagtgggagctgagc

SEQ ID NO: 4610143 - DNA, 14 bp, Homo sapiens
aggcaccattgctt

SEQ ID NO: 4610144 - DNA, 18 bp, Homo sapiens
aggcagaaatagttgtct

SEQ ID NO: 4610145 - DNA, 22 bp, Homo sapiens
aggcagaaatagttgtctgtgc

SEQ ID NO: 4610146 - DNA, 19 bp, Homo sapiens
aggcagaagcttggaggag

SEQ ID NO: 4610147 - DNA, 15 bp, Homo sapiens
aggcagacagcaggc

SEQ ID NO: 4610148 - DNA, 18 bp, Homo sapiens
aggcagatgcccttgctg

SEQ ID NO: 4610149 - DNA, 20 bp, Homo sapiens
aggcagatgcccttgctggg

SEQ ID NO: 4610150 - DNA, 17 bp, Homo sapiens
aggcagcaaggcccgag

SEQ ID NO: 4610151 - DNA, 18 bp, Homo sapiens
aggcagcaaggcccgagc

SEQ ID NO: 4610152 - DNA, 24 bp, Homo sapiens
aggcagcatgcttgggctgaccca

SEQ ID NO: 4610153 - DNA, 15 bp, Homo sapiens
aggcagccagccgtg

SEQ ID NO: 4610154 - DNA, 17 bp, Homo sapiens
aggcagccagccgtggc

SEQ ID NO: 4610155 - DNA, 21 bp, Homo sapiens
aggcagcgccaagtgcgtgcc

SEQ ID NO: 4610156 - DNA, 19 bp, Homo sapiens
aggcaggaacaaacagggc

SEQ ID NO: 4610157 - DNA, 15 bp, Homo sapiens
aggcaggcagggctc

SEQ ID NO: 4610158 - DNA, 18 bp, Homo sapiens
aggcaggcagggctctcc

SEQ ID NO: 4610159 - DNA, 15 bp, Homo sapiens
aggcaggcattcctg

SEQ ID NO: 4610160 - DNA, 13 bp, Homo sapiens
aggcaggcattga

SEQ ID NO: 4610161 - DNA, 23 bp, Homo sapiens
aggcaggcattgaggaagagtct

SEQ ID NO: 4610162 - DNA, 12 bp, Homo sapiens
aggcagggctct

SEQ ID NO: 4610163 - DNA, 13 bp, Homo sapiens
aggcagggctctc

SEQ ID NO: 4610164 - DNA, 23 bp, Homo sapiens
aggcagggctctcctggcttccc

SEQ ID NO: 4610165 - DNA, 16 bp, Homo sapiens
aggcaggtgggcagac

SEQ ID NO: 4610166 - DNA, 23 bp, Homo sapiens
aggcatggtcccttaaggcacag

SEQ ID NO: 4610167 - DNA, 20 bp, Homo sapiens
aggcattacttgctttcaat

SEQ ID NO: 4610168 - DNA, 22 bp, Homo sapiens
aggcattacttgctttcaattg

SEQ ID NO: 4610169 - DNA, 17 bp, Homo sapiens
aggcattcctgaaggga

SEQ ID NO: 4610170 - DNA, 14 bp, Homo sapiens
aggcattgaggaag

SEQ ID NO: 4610171 - DNA, 18 bp, Homo sapiens
aggcattgtgatgtttag

SEQ ID NO: 4610172 - DNA, 12 bp, Homo sapiens
aggcatttcctg

SEQ ID NO: 4610173 - DNA, 15 bp, Homo sapiens
aggcatttcctgctg

SEQ ID NO: 4610174 - DNA, 14 bp, Homo sapiens
aggcatttcctggg

SEQ ID NO: 4610175 - DNA, 15 bp, Homo sapiens
aggcatttcctgggt

SEQ ID NO: 4610176 - DNA, 20 bp, Homo sapiens
aggcatttcctgggtggcta

SEQ ID NO: 4610177 - DNA, 17 bp, Homo sapiens
aggcatttgagcagctg

SEQ ID NO: 4610178 - DNA, 18 bp, Homo sapiens
aggcatttgagcagctga

SEQ ID NO: 4610179 - DNA, 18 bp, Homo sapiens
aggccaaacctctgttca

SEQ ID NO: 4610180 - DNA, 14 bp, Homo sapiens
aggccaaccagccc

SEQ ID NO: 4610181 - DNA, 17 bp, Homo sapiens
aggccacactcagcaca

SEQ ID NO: 4610182 - DNA, 16 bp, Homo sapiens
aggccaccccaacctc

SEQ ID NO: 4610183 - DNA, 12 bp, Homo sapiens
aggccagcaacg

SEQ ID NO: 4610184 - DNA, 17 bp, Homo sapiens
aggccagcaacgcttgt

SEQ ID NO: 4610185 - DNA, 18 bp, Homo sapiens
aggccagcctggcctcct

SEQ ID NO: 4610186 - DNA, 21 bp, Homo sapiens
aggccagcctggcctcctgcc

SEQ ID NO: 4610187 - DNA, 14 bp, Homo sapiens
aggccatctcagga

SEQ ID NO: 4610188 - DNA, 17 bp, Homo sapiens
aggccatctcaggagat

SEQ ID NO: 4610189 - DNA, 19 bp, Homo sapiens
aggccccacaaggcctggt

SEQ ID NO: 4610190 - DNA, 12 bp, Homo sapiens
aggccccacccc

SEQ ID NO: 4610191 - DNA, 13 bp, Homo sapiens
aggccccacccct

SEQ ID NO: 4610192 - DNA, 14 bp, Homo sapiens
aggccccacccctg

SEQ ID NO: 4610193 - DNA, 15 bp, Homo sapiens
aggccccagaggccc

SEQ ID NO: 4610194 - DNA, 16 bp, Homo sapiens
aggccccagaggccct

SEQ ID NO: 4610195 - DNA, 21 bp, Homo sapiens
aggccccagaggccctggagg

SEQ ID NO: 4610196 - DNA, 14 bp, Homo sapiens
aggcccccaccctt

SEQ ID NO: 4610197 - DNA, 14 bp, Homo sapiens
aggcccctggagcc

SEQ ID NO: 4610198 - DNA, 19 bp, Homo sapiens
aggcccgagcagctgagca

SEQ ID NO: 4610199 - DNA, 15 bp, Homo sapiens
aggccctcctgtgct

SEQ ID NO: 4610200 - DNA, 21 bp, Homo sapiens
aggccctcctgtgctggggga

SEQ ID NO: 4610201 - DNA, 13 bp, Homo sapiens
aggccctgcacct

SEQ ID NO: 4610202 - DNA, 18 bp, Homo sapiens
aggccctgcatctgtctg

SEQ ID NO: 4610203 - DNA, 20 bp, Homo sapiens
aggccctgcatctgtctgct

SEQ ID NO: 4610204 - DNA, 21 bp, Homo sapiens
aggccctgcatctgtctgctc

SEQ ID NO: 4610205 - DNA, 12 bp, Homo sapiens
aggccctgcccc

SEQ ID NO: 4610206 - DNA, 21 bp, Homo sapiens
aggccctggatcagcgtggcc

SEQ ID NO: 4610207 - DNA, 23 bp, Homo sapiens
aggccctggatcagcgtggcctt

SEQ ID NO: 4610208 - DNA, 13 bp, Homo sapiens
aggccctgtctct

SEQ ID NO: 4610209 - DNA, 16 bp, Homo sapiens
aggccctgtctctggc

SEQ ID NO: 4610210 - DNA, 23 bp, Homo sapiens
aggccgaagctaacagggaaggc

SEQ ID NO: 4610211 - DNA, 20 bp, Homo sapiens
aggccgatggggaaggagaa

SEQ ID NO: 4610212 - DNA, 22 bp, Homo sapiens
aggccgatggggaaggagaagg

SEQ ID NO: 4610213 - DNA, 22 bp, Homo sapiens
aggcctagtaaccaaggccctg

SEQ ID NO: 4610214 - DNA, 16 bp, Homo sapiens
aggcctagtacaatct

SEQ ID NO: 4610215 - DNA, 19 bp, Homo sapiens
aggcctagtacaatcttgg

SEQ ID NO: 4610216 - DNA, 18 bp, Homo sapiens
aggcctcacccctcccct

SEQ ID NO: 4610217 - DNA, 19 bp, Homo sapiens
aggcctcacccctcccctg

SEQ ID NO: 4610218 - DNA, 20 bp, Homo sapiens
aggcctcacccctcccctgg

SEQ ID NO: 4610219 - DNA, 12 bp, Homo sapiens
aggcctctgccc

SEQ ID NO: 4610220 - DNA, 19 bp, Homo sapiens
aggcctctgccccaagagc

SEQ ID NO: 4610221 - DNA, 22 bp, Homo sapiens
aggcctctgccccaagagcagg

SEQ ID NO: 4610222 - DNA, 12 bp, Homo sapiens
aggcctgagccc

SEQ ID NO: 4610223 - DNA, 13 bp, Homo sapiens
aggcctgcagccc

SEQ ID NO: 4610224 - DNA, 16 bp, Homo sapiens
aggcctgcagccccta

SEQ ID NO: 4610225 - DNA, 11 bp, Homo sapiens
aggcctggggt

SEQ ID NO: 4610226 - DNA, 21 bp, Homo sapiens
aggcctggggtgacccggcac

SEQ ID NO: 4610227 - DNA, 21 bp, Homo sapiens
aggcctgggtgatctgctgct

SEQ ID NO: 4610228 - DNA, 17 bp, Homo sapiens
aggcctggtctgggagt

SEQ ID NO: 4610229 - DNA, 20 bp, Homo sapiens
aggcctgtgtagctgtgacc

SEQ ID NO: 4610230 - DNA, 23 bp, Homo sapiens
aggcctgtgtagctgtgacctgc

SEQ ID NO: 4610231 - DNA, 15 bp, Homo sapiens
aggccttcagacaca

SEQ ID NO: 4610232 - DNA, 18 bp, Homo sapiens
aggccttcagacacatgc

SEQ ID NO: 4610233 - DNA, 13 bp, Homo sapiens
aggcggtacacta

SEQ ID NO: 4610234 - DNA, 12 bp, Homo sapiens
aggctaaatgtt

SEQ ID NO: 4610235 - DNA, 14 bp, Homo sapiens
aggctaagctgccg

SEQ ID NO: 4610236 - DNA, 18 bp, Homo sapiens
aggctactagaattctgt

SEQ ID NO: 4610237 - DNA, 22 bp, Homo sapiens
aggctactagaattctgtattg

SEQ ID NO: 4610238 - DNA, 20 bp, Homo sapiens
aggctacttcggggctggga

SEQ ID NO: 4610239 - DNA, 22 bp, Homo sapiens
aggctacttcggggctgggaag

SEQ ID NO: 4610240 - DNA, 16 bp, Homo sapiens
aggctagccctgccct

SEQ ID NO: 4610241 - DNA, 16 bp, Homo sapiens
aggctcaggtccctgg

SEQ ID NO: 4610242 - DNA, 14 bp, Homo sapiens
aggctgaggctggc

SEQ ID NO: 4610243 - DNA, 15 bp, Homo sapiens
aggctgaggctggca

SEQ ID NO: 4610244 - DNA, 15 bp, Homo sapiens
aggctgaggtgagaa

SEQ ID NO: 4610245 - DNA, 17 bp, Homo sapiens
aggctgattcctctcat

SEQ ID NO: 4610246 - DNA, 21 bp, Homo sapiens
aggctgattcctctcatttcc

SEQ ID NO: 4610247 - DNA, 17 bp, Homo sapiens
aggctgcaaaattaaat

SEQ ID NO: 4610248 - DNA, 10 bp, Homo sapiens
aggctgctgc

SEQ ID NO: 4610249 - DNA, 13 bp, Homo sapiens
aggctgctgcaca

SEQ ID NO: 4610250 - DNA, 16 bp, Homo sapiens
aggctgctgctgtgac

SEQ ID NO: 4610251 - DNA, 12 bp, Homo sapiens
aggctggagaag

SEQ ID NO: 4610252 - DNA, 14 bp, Homo sapiens
aggctggcacagga

SEQ ID NO: 4610253 - DNA, 17 bp, Homo sapiens
aggctggcacaggacat

SEQ ID NO: 4610254 - DNA, 18 bp, Homo sapiens
aggctggcacaggacatg

SEQ ID NO: 4610255 - DNA, 17 bp, Homo sapiens
aggctgggctctgcctg

SEQ ID NO: 4610256 - DNA, 18 bp, Homo sapiens
aggctggtttcaaactcc

SEQ ID NO: 4610257 - DNA, 21 bp, Homo sapiens
aggctggtttcaaactcctga

SEQ ID NO: 4610258 - DNA, 17 bp, Homo sapiens
aggctgtaactgagaga

SEQ ID NO: 4610259 - DNA, 14 bp, Homo sapiens
aggcttaagaactg

SEQ ID NO: 4610260 - DNA, 20 bp, Homo sapiens
aggcttccctacacagggcc

SEQ ID NO: 4610261 - DNA, 12 bp, Homo sapiens
aggcttctctct

SEQ ID NO: 4610262 - DNA, 16 bp, Homo sapiens
aggcttctctctcacc

SEQ ID NO: 4610263 - DNA, 14 bp, Homo sapiens
aggctttcagggcc

SEQ ID NO: 4610264 - DNA, 16 bp, Homo sapiens
aggctttctgggctct

SEQ ID NO: 4610265 - DNA, 23 bp, Homo sapiens
aggctttctgggctctggactcc

SEQ ID NO: 4610266 - DNA, 23 bp, Homo sapiens
agggaaatgtacactttttacag

SEQ ID NO: 4610267 - DNA, 22 bp, Homo sapiens
agggaaattgtaaatcctgtgt

SEQ ID NO: 4610268 - DNA, 20 bp, Homo sapiens
agggaacaaaactgttcttt

SEQ ID NO: 4610269 - DNA, 13 bp, Homo sapiens
agggaacttagta

SEQ ID NO: 4610270 - DNA, 15 bp, Homo sapiens
agggaagagtagctg

SEQ ID NO: 4610271 - DNA, 17 bp, Homo sapiens
agggaagtaacagacac

SEQ ID NO: 4610272 - DNA, 20 bp, Homo sapiens
agctgacttggttctgaagc

SEQ ID NO: 4610273 - DNA, 21 bp, Homo sapiens
agctgagcacttagcaggcac

SEQ ID NO: 4610274 - DNA, 17 bp, Homo sapiens
agctgagctcacaaggc

SEQ ID NO: 4610275 - DNA, 19 bp, Homo sapiens
agctgagctggaaggggcc

SEQ ID NO: 4610276 - DNA, 20 bp, Homo sapiens
agctgagctggaaggggcca

SEQ ID NO: 4610277 - DNA, 15 bp, Homo sapiens
agctgcactgtgaac

SEQ ID NO: 4610278 - DNA, 14 bp, Homo sapiens
agctgccaagagtg

SEQ ID NO: 4610279 - DNA, 16 bp, Homo sapiens
agctgccccaatgtga

SEQ ID NO: 4610280 - DNA, 14 bp, Homo sapiens
agctgcccctctct

SEQ ID NO: 4610281 - DNA, 15 bp, Homo sapiens
agctgcccctctctg

SEQ ID NO: 4610282 - DNA, 14 bp, Homo sapiens
agctgcctggatga

SEQ ID NO: 4610283 - DNA, 17 bp, Homo sapiens
agctgcctggatgagaa

SEQ ID NO: 4610284 - DNA, 13 bp, Homo sapiens
agctgcgggggca

SEQ ID NO: 4610285 - DNA, 17 bp, Homo sapiens
agctgctccaggcctgc

SEQ ID NO: 4610286 - DNA, 17 bp, Homo sapiens
agctgctccccagcagc

SEQ ID NO: 4610287 - DNA, 20 bp, Homo sapiens
agctgctccccagcagcgga

SEQ ID NO: 4610288 - DNA, 18 bp, Homo sapiens
agctgctgtgccccacca

SEQ ID NO: 4610289 - DNA, 19 bp, Homo sapiens
agctgctgtgccccaccac

SEQ ID NO: 4610290 - DNA, 18 bp, Homo sapiens
agctggaaacttctgtaa

SEQ ID NO: 4610291 - DNA, 20 bp, Homo sapiens
agctggaggaatacatttta

SEQ ID NO: 4610292 - DNA, 14 bp, Homo sapiens
agctggccaaagtc

SEQ ID NO: 4610293 - DNA, 23 bp, Homo sapiens
agctggccaaagtcacttcccca

SEQ ID NO: 4610294 - DNA, 20 bp, Homo sapiens
agctggcctggcccccagct

SEQ ID NO: 4610295 - DNA, 21 bp, Homo sapiens
agctggctctgtgagggtgct

SEQ ID NO: 4610296 - DNA, 15 bp, Homo sapiens
agctggggactcagg

SEQ ID NO: 4610297 - DNA, 14 bp, Homo sapiens
agctgggtcaggca

SEQ ID NO: 4610298 - DNA, 15 bp, Homo sapiens
agctggtcctgacca

SEQ ID NO: 4610299 - DNA, 21 bp, Homo sapiens
agctggtcctgaccaggatgg

SEQ ID NO: 4610300 - DNA, 14 bp, Homo sapiens
agctgtaagggcag

SEQ ID NO: 4610301 - DNA, 12 bp, Homo sapiens
agctgtactctt

SEQ ID NO: 4610302 - DNA, 23 bp, Homo sapiens
agctgtactcttctgactgcccc

SEQ ID NO: 4610303 - DNA, 15 bp, Homo sapiens
agctgtccctgcagg

SEQ ID NO: 4610304 - DNA, 19 bp, Homo sapiens
agctgtccctgcagggcca

SEQ ID NO: 4610305 - DNA, 14 bp, Homo sapiens
agctgtcctgcagc

SEQ ID NO: 4610306 - DNA, 15 bp, Homo sapiens
agctgtcctgcagca

SEQ ID NO: 4610307 - DNA, 22 bp, Homo sapiens
agctgtcctgcagcaaacactc

SEQ ID NO: 4610308 - DNA, 18 bp, Homo sapiens
agctgtctcttcggcagg

SEQ ID NO: 4610309 - DNA, 23 bp, Homo sapiens
agctgtctgaagcccaaagcctg

SEQ ID NO: 4610310 - DNA, 23 bp, Homo sapiens
agctgtgacctgctgagctctga

SEQ ID NO: 4610311 - DNA, 21 bp, Homo sapiens
agctgtgagacagtgggaaat

SEQ ID NO: 4610312 - DNA, 16 bp, Homo sapiens
agctgtgcaggcatgg

SEQ ID NO: 4610313 - DNA, 17 bp, Homo sapiens
agctgtgccagcagggg

SEQ ID NO: 4610314 - DNA, 15 bp, Homo sapiens
agctgttagggctga

SEQ ID NO: 4610315 - DNA, 16 bp, Homo sapiens
agctgttcctgttcag

SEQ ID NO: 4610316 - DNA, 18 bp, Homo sapiens
agctgtttatagagaatg

SEQ ID NO: 4610317 - DNA, 14 bp, Homo sapiens
agctgtttgaaatg

SEQ ID NO: 4610318 - DNA, 20 bp, Homo sapiens
agcttccaaggggcaaattt

SEQ ID NO: 4610319 - DNA, 16 bp, Homo sapiens
agcttccgagaatagc

SEQ ID NO: 4610320 - DNA, 22 bp, Homo sapiens
agcttccgctttgaaagaagca

SEQ ID NO: 4610321 - DNA, 14 bp, Homo sapiens
agcttcctggggac

SEQ ID NO: 4610322 - DNA, 18 bp, Homo sapiens
agcttcctggggaccaag

SEQ ID NO: 4610323 - DNA, 20 bp, Homo sapiens
agcttcctggggaccaagat

SEQ ID NO: 4610324 - DNA, 18 bp, Homo sapiens
agcttctcagtttctgcc

SEQ ID NO: 4610325 - DNA, 14 bp, Homo sapiens
agcttcttctgaaa

SEQ ID NO: 4610326 - DNA, 22 bp, Homo sapiens
agcttctttcccttagtgactc

SEQ ID NO: 4610327 - DNA, 19 bp, Homo sapiens
agcttgcctgtttcttctc

SEQ ID NO: 4610328 - DNA, 16 bp, Homo sapiens
agcttgctccctgtgt

SEQ ID NO: 4610329 - DNA, 17 bp, Homo sapiens
agcttgctccctgtgtc

SEQ ID NO: 4610330 - DNA, 15 bp, Homo sapiens
agcttgctgtcactt

SEQ ID NO: 4610331 - DNA, 19 bp, Homo sapiens
agcttgctgtcacttcttc

SEQ ID NO: 4610332 - DNA, 20 bp, Homo sapiens
agcttgctgtcacttcttca

SEQ ID NO: 4610333 - DNA, 23 bp, Homo sapiens
agcttgctgtcacttcttcacct

SEQ ID NO: 4610334 - DNA, 15 bp, Homo sapiens
agcttggtattgcag

SEQ ID NO: 4610335 - DNA, 17 bp, Homo sapiens
agcttggtattgcagag

SEQ ID NO: 4610336 - DNA, 15 bp, Homo sapiens
agcttgtagccagcc

SEQ ID NO: 4610337 - DNA, 17 bp, Homo sapiens
agcttgtatgcaatgga

SEQ ID NO: 4610338 - DNA, 22 bp, Homo sapiens
agcttgtccaggttgatcttga

SEQ ID NO: 4610339 - DNA, 15 bp, Homo sapiens
agctttataaacttt

SEQ ID NO: 4610340 - DNA, 18 bp, Homo sapiens
agctttatcgaacgtggt

SEQ ID NO: 4610341 - DNA, 22 bp, Homo sapiens
agctttatcgaacgtggtctga

SEQ ID NO: 4610342 - DNA, 12 bp, Homo sapiens
agctttcctgga

SEQ ID NO: 4610343 - DNA, 23 bp, Homo sapiens
agctttgctccttcagttctgct

SEQ ID NO: 4610344 - DNA, 12 bp, Homo sapiens
agctttgtagtt

SEQ ID NO: 4610345 - DNA, 14 bp, Homo sapiens
agcttttatttctt

SEQ ID NO: 4610346 - DNA, 21 bp, Homo sapiens
agcttttatttggtgtgttcg

SEQ ID NO: 4610347 - DNA, 15 bp, Homo sapiens
aggaaaagaggccca

SEQ ID NO: 4610348 - DNA, 15 bp, Homo sapiens
aggaaaaggcctggg

SEQ ID NO: 4610349 - DNA, 16 bp, Homo sapiens
aggaaaaggcctgggg

SEQ ID NO: 4610350 - DNA, 17 bp, Homo sapiens
aggaaaaggcctggggt

SEQ ID NO: 4610351 - DNA, 20 bp, Homo sapiens
aggaaaatgacttgtaaggt

SEQ ID NO: 4610352 - DNA, 16 bp, Homo sapiens
aggaaagaagggggcc

SEQ ID NO: 4610353 - DNA, 22 bp, Homo sapiens
aggaaagaagggggccctgcta

SEQ ID NO: 4610354 - DNA, 21 bp, Homo sapiens
aggaaagcatgcattgaaaaa

SEQ ID NO: 4610355 - DNA, 12 bp, Homo sapiens
aggaaaggagga

SEQ ID NO: 4610356 - DNA, 13 bp, Homo sapiens
aggaaaggaggac

SEQ ID NO: 4610357 - DNA, 16 bp, Homo sapiens
aggaaataacagagag

SEQ ID NO: 4610358 - DNA, 14 bp, Homo sapiens
aggaacaaacaggg

SEQ ID NO: 4610359 - DNA, 14 bp, Homo sapiens
aggaacagcccagc

SEQ ID NO: 4610360 - DNA, 16 bp, Homo sapiens
aggaacagcccagcac

SEQ ID NO: 4610361 - DNA, 17 bp, Homo sapiens
aggaaccgcccagtgca

SEQ ID NO: 4610362 - DNA, 22 bp, Homo sapiens
aggaaccgcccagtgcaggtat

SEQ ID NO: 4610363 - DNA, 16 bp, Homo sapiens
aggaactagtaaacat

SEQ ID NO: 4610364 - DNA, 21 bp, Homo sapiens
aggaagaaaaaagatccctat

SEQ ID NO: 4610365 - DNA, 18 bp, Homo sapiens
aggaagacccaacacatg

SEQ ID NO: 4610366 - DNA, 13 bp, Homo sapiens
aggaagactttgt

SEQ ID NO: 4610367 - DNA, 12 bp, Homo sapiens
aggaagagccac

SEQ ID NO: 4610368 - DNA, 13 bp, Homo sapiens
aggaagagccacc

SEQ ID NO: 4610369 - DNA, 14 bp, Homo sapiens
aggaagagccacct

SEQ ID NO: 4610370 - DNA, 14 bp, Homo sapiens
aggaagagtttatg

SEQ ID NO: 4610371 - DNA, 23 bp, Homo sapiens
aggaagcactgaaaatagtgttc

SEQ ID NO: 4610372 - DNA, 22 bp, Homo sapiens
aggaagctgcctggtgtggagt

SEQ ID NO: 4610373 - DNA, 21 bp, Homo sapiens
aggaaggccaaaatcaagagt

SEQ ID NO: 4610374 - DNA, 21 bp, Homo sapiens
aggaagggccattttggtgct

SEQ ID NO: 4610375 - DNA, 23 bp, Homo sapiens
aggaagggccattttggtgctta

SEQ ID NO: 4610376 - DNA, 21 bp, Homo sapiens
aggaaggggctatcctgggac

SEQ ID NO: 4610377 - DNA, 16 bp, Homo sapiens
aggaatacattttatt

SEQ ID NO: 4610378 - DNA, 22 bp, Homo sapiens
aggaatatacatagtctttgtt

SEQ ID NO: 4610379 - DNA, 15 bp, Homo sapiens
aggaatcaccccatt

SEQ ID NO: 4610380 - DNA, 13 bp, Homo sapiens
aggaatggaggag

SEQ ID NO: 4610381 - DNA, 21 bp, Homo sapiens
aggaatggaggagccaggccc

SEQ ID NO: 4610382 - DNA, 15 bp, Homo sapiens
aggaattcagtgcct

SEQ ID NO: 4610383 - DNA, 15 bp, Homo sapiens
agggaagtagtcctt

SEQ ID NO: 4610384 - DNA, 18 bp, Homo sapiens
agggaatttaatactttt

SEQ ID NO: 4610385 - DNA, 15 bp, Homo sapiens
agggacaaaggagcc

SEQ ID NO: 4610386 - DNA, 18 bp, Homo sapiens
agggacaaaggagcctgt

SEQ ID NO: 4610387 - DNA, 20 bp, Homo sapiens
agggacaaaggagcctgtga

SEQ ID NO: 4610388 - DNA, 21 bp, Homo sapiens
agggacaaaggagcctgtgaa

SEQ ID NO: 4610389 - DNA, 21 bp, Homo sapiens
agggacaaccagaaggccctt

SEQ ID NO: 4610390 - DNA, 16 bp, Homo sapiens
agggacaggctgaaga

SEQ ID NO: 4610391 - DNA, 18 bp, Homo sapiens
agggacaggctgaagaga

SEQ ID NO: 4610392 - DNA, 20 bp, Homo sapiens
agggacaggctgaagagagg

SEQ ID NO: 4610393 - DNA, 14 bp, Homo sapiens
agggacccacctgc

SEQ ID NO: 4610394 - DNA, 17 bp, Homo sapiens
agggacccacctgctag

SEQ ID NO: 4610395 - DNA, 15 bp, Homo sapiens
agggaccggcagagc

SEQ ID NO: 4610396 - DNA, 18 bp, Homo sapiens
agggaccggcagagctct

SEQ ID NO: 4610397 - DNA, 20 bp, Homo sapiens
agggaccggtgctgcaggag

SEQ ID NO: 4610398 - DNA, 21 bp, Homo sapiens
agggaccggtgctgcaggagt

SEQ ID NO: 4610399 - DNA, 18 bp, Homo sapiens
agggactgccaggctgtt

SEQ ID NO: 4610400 - DNA, 16 bp, Homo sapiens
agggactgtcctagcc

SEQ ID NO: 4610401 - DNA, 23 bp, Homo sapiens
agggactgtcctagccaggtctc

SEQ ID NO: 4610402 - DNA, 22 bp, Homo sapiens
agggactgtcgctgcttcgtgg

SEQ ID NO: 4610403 - DNA, 13 bp, Homo sapiens
agggagaggtcac

SEQ ID NO: 4610404 - DNA, 21 bp, Homo sapiens
agggagaggtcaccagctgct

SEQ ID NO: 4610405 - DNA, 19 bp, Homo sapiens
agggagcaagtccttccct

SEQ ID NO: 4610406 - DNA, 17 bp, Homo sapiens
agggagcacctgtctgg

SEQ ID NO: 4610407 - DNA, 13 bp, Homo sapiens
agggagctgggac

SEQ ID NO: 4610408 - DNA, 14 bp, Homo sapiens
agggaggccgaagc

SEQ ID NO: 4610409 - DNA, 16 bp, Homo sapiens
agggaggccgaagcta

SEQ ID NO: 4610410 - DNA, 16 bp, Homo sapiens
agggagggctctgagg

SEQ ID NO: 4610411 - DNA, 17 bp, Homo sapiens
agggagggctctgaggc

SEQ ID NO: 4610412 - DNA, 15 bp, Homo sapiens
agggagggctgtcat

SEQ ID NO: 4610413 - DNA, 14 bp, Homo sapiens
agggagtctctctt

SEQ ID NO: 4610414 - DNA, 17 bp, Homo sapiens
agggagtgctggctcac

SEQ ID NO: 4610415 - DNA, 18 bp, Homo sapiens
agggagtgtactcccagg

SEQ ID NO: 4610416 - DNA, 23 bp, Homo sapiens
agggatgcggatcctgctggggc

SEQ ID NO: 4610417 - DNA, 13 bp, Homo sapiens
agggatggagaaa

SEQ ID NO: 4610418 - DNA, 18 bp, Homo sapiens
agggatggagaaagaagt

SEQ ID NO: 4610419 - DNA, 16 bp, Homo sapiens
agggatgtctgttgaa

SEQ ID NO: 4610420 - DNA, 17 bp, Homo sapiens
agggatgtctgttgaaa

SEQ ID NO: 4610421 - DNA, 13 bp, Homo sapiens
agggcaagaggat

SEQ ID NO: 4610422 - DNA, 18 bp, Homo sapiens
agggcaagccctgcccac

SEQ ID NO: 4610423 - DNA, 21 bp, Homo sapiens
agggcaagccctgcccacaga

SEQ ID NO: 4610424 - DNA, 19 bp, Homo sapiens
agggcacaggagctacctg

SEQ ID NO: 4610425 - DNA, 14 bp, Homo sapiens
agggcacaggccat

SEQ ID NO: 4610426 - DNA, 21 bp, Homo sapiens
agggcacattaactccctcca

SEQ ID NO: 4610427 - DNA, 16 bp, Homo sapiens
agggcactgggctgtt

SEQ ID NO: 4610428 - DNA, 16 bp, Homo sapiens
agggcacttaatttgt

SEQ ID NO: 4610429 - DNA, 17 bp, Homo sapiens
agggcacttaatttgta

SEQ ID NO: 4610430 - DNA, 18 bp, Homo sapiens
agggcacttaatttgtaa

SEQ ID NO: 4610431 - DNA, 20 bp, Homo sapiens
agggcacttaatttgtaaac

SEQ ID NO: 4610432 - DNA, 13 bp, Homo sapiens
agggcagcagcca

SEQ ID NO: 4610433 - DNA, 16 bp, Homo sapiens
agggcagcagccagcc

SEQ ID NO: 4610434 - DNA, 17 bp, Homo sapiens
agggcagcagccagccc

SEQ ID NO: 4610435 - DNA, 18 bp, Homo sapiens
agggcagcagccagccct

SEQ ID NO: 4610436 - DNA, 13 bp, Homo sapiens
agggcagccccct

SEQ ID NO: 4610437 - DNA, 16 bp, Homo sapiens
agggcagcgccaggct

SEQ ID NO: 4610438 - DNA, 20 bp, Homo sapiens
agggcagtcattggctgtct

SEQ ID NO: 4610439 - DNA, 13 bp, Homo sapiens
agggcagtgccct

SEQ ID NO: 4610440 - DNA, 15 bp, Homo sapiens
agggcagtgcccttt

SEQ ID NO: 4610441 - DNA, 14 bp, Homo sapiens
agggcagttcgcag

SEQ ID NO: 4610442 - DNA, 16 bp, Homo sapiens
agggcagttcgcagcc

SEQ ID NO: 4610443 - DNA, 20 bp, Homo sapiens
agggcagttcgcagccaccc

SEQ ID NO: 4610444 - DNA, 21 bp, Homo sapiens
agggcagttcgcagccaccct

SEQ ID NO: 4610445 - DNA, 18 bp, Homo sapiens
agggccacatagatgctg

SEQ ID NO: 4610446 - DNA, 17 bp, Homo sapiens
agggccacggggaggcc

SEQ ID NO: 4610447 - DNA, 14 bp, Homo sapiens
agggccagagcagc

SEQ ID NO: 4610448 - DNA, 17 bp, Homo sapiens
agggccagagcagctcc

SEQ ID NO: 4610449 - DNA, 17 bp, Homo sapiens
agggccagtggggcctg

SEQ ID NO: 4610450 - DNA, 19 bp, Homo sapiens
agggccagttggtgttcct

SEQ ID NO: 4610451 - DNA, 23 bp, Homo sapiens
agggcctgagtgacctccttctg

SEQ ID NO: 4610452 - DNA, 17 bp, Homo sapiens
agggcctgccccctggg

SEQ ID NO: 4610453 - DNA, 19 bp, Homo sapiens
agggcctgccccctgggga

SEQ ID NO: 4610454 - DNA, 15 bp, Homo sapiens
agggcctggggcctg

SEQ ID NO: 4610455 - DNA, 19 bp, Homo sapiens
agggcctggggcctgagag

SEQ ID NO: 4610456 - DNA, 19 bp, Homo sapiens
agggctcatttttgcactt

SEQ ID NO: 4610457 - DNA, 16 bp, Homo sapiens
agggctctcctggctt

SEQ ID NO: 4610458 - DNA, 21 bp, Homo sapiens
agggctctgagccaaccttgc

SEQ ID NO: 4610459 - DNA, 14 bp, Homo sapiens
agggctctgaggcg

SEQ ID NO: 4610460 - DNA, 20 bp, Homo sapiens
agggctgccttctggccttg

SEQ ID NO: 4610461 - DNA, 14 bp, Homo sapiens
agggctgctctttc

SEQ ID NO: 4610462 - DNA, 16 bp, Homo sapiens
agggctgctctttcca

SEQ ID NO: 4610463 - DNA, 10 bp, Homo sapiens
agggctgggg

SEQ ID NO: 4610464 - DNA, 18 bp, Homo sapiens
agggcttggcccagcgcc

SEQ ID NO: 4610465 - DNA, 11 bp, Homo sapiens
aggggaaggaa

SEQ ID NO: 4610466 - DNA, 12 bp, Homo sapiens
aggggaaggaag

SEQ ID NO: 4610467 - DNA, 21 bp, Homo sapiens
aggggagacctcagaagtaaa

SEQ ID NO: 4610468 - DNA, 14 bp, Homo sapiens
aggggagaggtcag

SEQ ID NO: 4610469 - DNA, 16 bp, Homo sapiens
aggggaggagcctgtg

SEQ ID NO: 4610470 - DNA, 18 bp, Homo sapiens
aggggagggtcagccagg

SEQ ID NO: 4610471 - DNA, 19 bp, Homo sapiens
aggggagggtcagccaggg

SEQ ID NO: 4610472 - DNA, 20 bp, Homo sapiens
aggggatatttactgctctt

SEQ ID NO: 4610473 - DNA, 16 bp, Homo sapiens
aggggatccagccact

SEQ ID NO: 4610474 - DNA, 17 bp, Homo sapiens
aggggatccagccactt

SEQ ID NO: 4610475 - DNA, 12 bp, Homo sapiens
aggggcaaacat

SEQ ID NO: 4610476 - DNA, 15 bp, Homo sapiens
aggggcagatggaaa

SEQ ID NO: 4610477 - DNA, 16 bp, Homo sapiens
aggggcagggaaggac

SEQ ID NO: 4610478 - DNA, 13 bp, Homo sapiens
aggggcatgggaa

SEQ ID NO: 4610479 - DNA, 13 bp, Homo sapiens
aggggcctgcaga

SEQ ID NO: 4610480 - DNA, 15 bp, Homo sapiens
aggggcctgcagaag

SEQ ID NO: 4610481 - DNA, 20 bp, Homo sapiens
aggggcctgcagaaggaaag

SEQ ID NO: 4610482 - DNA, 19 bp, Homo sapiens
aggggccttagggcactgg

SEQ ID NO: 4610483 - DNA, 16 bp, Homo sapiens
aggggcgggcggaggg

SEQ ID NO: 4610484 - DNA, 12 bp, Homo sapiens
aggggctaggga

SEQ ID NO: 4610485 - DNA, 18 bp, Homo sapiens
aggggctatcctgggacc

SEQ ID NO: 4610486 - DNA, 14 bp, Homo sapiens
aggggctggggact

SEQ ID NO: 4610487 - DNA, 21 bp, Homo sapiens
aggggctggggacttgtgtct

SEQ ID NO: 4610488 - DNA, 15 bp, Homo sapiens
agggggcaggggcag

SEQ ID NO: 4610489 - DNA, 18 bp, Homo sapiens
agggggccccgccagggc

SEQ ID NO: 4610490 - DNA, 20 bp, Homo sapiens
agggggccccgccagggctg

SEQ ID NO: 4610491 - DNA, 21 bp, Homo sapiens
agggggcctcattgtgtctcc

SEQ ID NO: 4610492 - DNA, 17 bp, Homo sapiens
agggggctctgccccag

SEQ ID NO: 4610493 - DNA, 12 bp, Homo sapiens
aggggggctgtg

SEQ ID NO: 4610494 - DNA, 16 bp, Homo sapiens
agggggtcgtggagag

SEQ ID NO: 4610495 - DNA, 23 bp, Homo sapiens
agggggtcgtggagagctaggag

SEQ ID NO: 4610496 - DNA, 20 bp, Homo sapiens
aggggttctatttattcctg

SEQ ID NO: 4610497 - DNA, 21 bp, Homo sapiens
aggggttctatttattcctgt

SEQ ID NO: 4610498 - DNA, 18 bp, Homo sapiens
agggtcctctacttcagg

SEQ ID NO: 4610499 - DNA, 11 bp, Homo sapiens
agggtctgagt

SEQ ID NO: 4610500 - DNA, 20 bp, Homo sapiens
agggtgcagtatcatgccct

SEQ ID NO: 4610501 - DNA, 18 bp, Homo sapiens
agggtgggaaggggctag

SEQ ID NO: 4610502 - DNA, 15 bp, Homo sapiens
agggtgggtgctcag

SEQ ID NO: 4610503 - DNA, 17 bp, Homo sapiens
agggtgggtgctcagaa

SEQ ID NO: 4610504 - DNA, 14 bp, Homo sapiens
agggttggagcagt

SEQ ID NO: 4610505 - DNA, 16 bp, Homo sapiens
aggtaaatcccacatc

SEQ ID NO: 4610506 - DNA, 15 bp, Homo sapiens
aggtaatcattttaa

SEQ ID NO: 4610507 - DNA, 21 bp, Homo sapiens
aggtacccctttctggctctc

SEQ ID NO: 4610508 - DNA, 14 bp, Homo sapiens
aggtactagaatgc

SEQ ID NO: 4610509 - DNA, 18 bp, Homo sapiens
aggtagagccacaaaaga

SEQ ID NO: 4610510 - DNA, 23 bp, Homo sapiens
aggtagctatagttgcagcccaa

SEQ ID NO: 4610511 - DNA, 17 bp, Homo sapiens
aggtagtcatgctgtgc

SEQ ID NO: 4610512 - DNA, 17 bp, Homo sapiens
aggtatttcagaaggag

SEQ ID NO: 4610513 - DNA, 12 bp, Homo sapiens
aggtcaccagct

SEQ ID NO: 4610514 - DNA, 14 bp, Homo sapiens
aggtcaccagctgc

SEQ ID NO: 4610515 - DNA, 18 bp, Homo sapiens
aggtcaccagctgctgtg

SEQ ID NO: 4610516 - DNA, 20 bp, Homo sapiens
aggtcaccaggggaggagcc

SEQ ID NO: 4610517 - DNA, 22 bp, Homo sapiens
aggtcaccaggggaggagcctg

SEQ ID NO: 4610518 - DNA, 12 bp, Homo sapiens
aggtcagccttg

SEQ ID NO: 4610519 - DNA, 13 bp, Homo sapiens
aggtcataaagca

SEQ ID NO: 4610520 - DNA, 17 bp, Homo sapiens
aggtcataaagcattgg

SEQ ID NO: 4610521 - DNA, 22 bp, Homo sapiens
aggtccacggtctgttcttgaa

SEQ ID NO: 4610522 - DNA, 14 bp, Homo sapiens
aggtcccagccctg

SEQ ID NO: 4610523 - DNA, 18 bp, Homo sapiens
aggtcccagccctggggg

SEQ ID NO: 4610524 - DNA, 12 bp, Homo sapiens
aggtcctgagca

SEQ ID NO: 4610525 - DNA, 13 bp, Homo sapiens
aggtcctgagcac

SEQ ID NO: 4610526 - DNA, 19 bp, Homo sapiens
aggtcctgagcactgccag

SEQ ID NO: 4610527 - DNA, 21 bp, Homo sapiens
aggtcctgagcactgccagga

SEQ ID NO: 4610528 - DNA, 22 bp, Homo sapiens
aggtcctgagcactgccaggag

SEQ ID NO: 4610529 - DNA, 23 bp, Homo sapiens
aggtcctgagcactgccaggagg

SEQ ID NO: 4610530 - DNA, 20 bp, Homo sapiens
aggtcctggtggggcagctc

SEQ ID NO: 4610531 - DNA, 21 bp, Homo sapiens
aggtcctttggacagctgact

SEQ ID NO: 4610532 - DNA, 16 bp, Homo sapiens
aggtcgcgctcttgca

SEQ ID NO: 4610533 - DNA, 21 bp, Homo sapiens
aggtctccaggggcctgcaga

SEQ ID NO: 4610534 - DNA, 17 bp, Homo sapiens
aggtctcctgggaaagg

SEQ ID NO: 4610535 - DNA, 15 bp, Homo sapiens
aggtctcgaccctgt

SEQ ID NO: 4610536 - DNA, 23 bp, Homo sapiens
aggtctcgaccctgtcccctagg

SEQ ID NO: 4610537 - DNA, 19 bp, Homo sapiens
aggtctgacagtagctctt

SEQ ID NO: 4610538 - DNA, 17 bp, Homo sapiens
aggtgaatactcttgaa

SEQ ID NO: 4610539 - DNA, 19 bp, Homo sapiens
aggtgaccccagggcacag

SEQ ID NO: 4610540 - DNA, 22 bp, Homo sapiens
aggtgaggggaagacaaagcac

SEQ ID NO: 4610541 - DNA, 22 bp, Homo sapiens
aggtgcaacaaggtcctctgtc

SEQ ID NO: 4610542 - DNA, 15 bp, Homo sapiens
aggtgcagtggaggg

SEQ ID NO: 4610543 - DNA, 17 bp, Homo sapiens
aggtgcagtggaggggg

SEQ ID NO: 4610544 - DNA, 23 bp, Homo sapiens
aggtgcagtggagggggcaagct

SEQ ID NO: 4610545 - DNA, 12 bp, Homo sapiens
aggtgccaccac

SEQ ID NO: 4610546 - DNA, 20 bp, Homo sapiens
aggtgccacccagtagccca

SEQ ID NO: 4610547 - DNA, 22 bp, Homo sapiens
aggtgccacccagtagcccaga

SEQ ID NO: 4610548 - DNA, 17 bp, Homo sapiens
aggtgccatctcaggag

SEQ ID NO: 4610549 - DNA, 21 bp, Homo sapiens
aggtgcccactccgccagcca

SEQ ID NO: 4610550 - DNA, 22 bp, Homo sapiens
aggtgcccactccgccagccac

SEQ ID NO: 4610551 - DNA, 12 bp, Homo sapiens
aggtgcccagga

SEQ ID NO: 4610552 - DNA, 18 bp, Homo sapiens
aggtggaaggcagacagc

SEQ ID NO: 4610553 - DNA, 20 bp, Homo sapiens
aggtgtgaatgcacgtttca

SEQ ID NO: 4610554 - DNA, 17 bp, Homo sapiens
aggtgtgtgggccaccg

SEQ ID NO: 4610555 - DNA, 22 bp, Homo sapiens
aggtgtgtgggccaccgtgcct

SEQ ID NO: 4610556 - DNA, 23 bp, Homo sapiens
aggtgtgtgggccaccgtgcctg

SEQ ID NO: 4610557 - DNA, 23 bp, Homo sapiens
aggtgtttaacggcactgtggcc

SEQ ID NO: 4610558 - DNA, 19 bp, Homo sapiens
aggtgttttttatgaagtg

SEQ ID NO: 4610559 - DNA, 20 bp, Homo sapiens
aggttatacaataacccagt

SEQ ID NO: 4610560 - DNA, 19 bp, Homo sapiens
aggttccccaagggccctg

SEQ ID NO: 4610561 - DNA, 19 bp, Homo sapiens
aggttcttaaaaaggaaca

SEQ ID NO: 4610562 - DNA, 23 bp, Homo sapiens
aggttgatcttgaactcctgacc

SEQ ID NO: 4610563 - DNA, 14 bp, Homo sapiens
aggtttctctccct

SEQ ID NO: 4610564 - DNA, 15 bp, Homo sapiens
aggtttctctccctc

SEQ ID NO: 4610565 - DNA, 14 bp, Homo sapiens
agtaaaaagacatt

SEQ ID NO: 4610566 - DNA, 17 bp, Homo sapiens
agtaaaaagacattttt

SEQ ID NO: 4610567 - DNA, 16 bp, Homo sapiens
agtaaaaccttgttct

SEQ ID NO: 4610568 - DNA, 20 bp, Homo sapiens
agtaaaaccttgttctattt

SEQ ID NO: 4610569 - DNA, 23 bp, Homo sapiens
agtaaaataggcaccattgctta

SEQ ID NO: 4610570 - DNA, 14 bp, Homo sapiens
agtaaactgaggcc

SEQ ID NO: 4610571 - DNA, 17 bp, Homo sapiens
agtaaattaaacatttt

SEQ ID NO: 4610572 - DNA, 13 bp, Homo sapiens
agtaacaaataaa

SEQ ID NO: 4610573 - DNA, 13 bp, Homo sapiens
agtaacaatctat

SEQ ID NO: 4610574 - DNA, 17 bp, Homo sapiens
agtaacaatctatggct

SEQ ID NO: 4610575 - DNA, 21 bp, Homo sapiens
agtaagaacatccctgtctta

SEQ ID NO: 4610576 - DNA, 15 bp, Homo sapiens
agtaatatattctga

SEQ ID NO: 4610577 - DNA, 13 bp, Homo sapiens
agtaatatcaaag

SEQ ID NO: 4610578 - DNA, 14 bp, Homo sapiens
agtaatgaaatgtt

SEQ ID NO: 4610579 - DNA, 19 bp, Homo sapiens
agtaatgaagaatcacgat

SEQ ID NO: 4610580 - DNA, 16 bp, Homo sapiens
agtaatgacttagaaa

SEQ ID NO: 4610581 - DNA, 19 bp, Homo sapiens
agtaatgacttagaaactg

SEQ ID NO: 4610582 - DNA, 19 bp, Homo sapiens
agtaatggaggtcccagcc

SEQ ID NO: 4610583 - DNA, 21 bp, Homo sapiens
agtaatggaggtcccagccct

SEQ ID NO: 4610584 - DNA, 23 bp, Homo sapiens
agtaatggaggtcccagccctgg

SEQ ID NO: 4610585 - DNA, 20 bp, Homo sapiens
agtaattttgtcacattatt

SEQ ID NO: 4610586 - DNA, 15 bp, Homo sapiens
agtacaaatgaagaa

SEQ ID NO: 4610587 - DNA, 18 bp, Homo sapiens
agtacaaatgaagaaagt

SEQ ID NO: 4610588 - DNA, 23 bp, Homo sapiens
agtacaaatgccttaaaatggaa

SEQ ID NO: 4610589 - DNA, 17 bp, Homo sapiens
agtacatatttattttc

SEQ ID NO: 4610590 - DNA, 17 bp, Homo sapiens
agtactaacacaaggac

SEQ ID NO: 4610591 - DNA, 18 bp, Homo sapiens
agtactaacacaaggaca

SEQ ID NO: 4610592 - DNA, 22 bp, Homo sapiens
agtactacacatttttaaattg

SEQ ID NO: 4610593 - DNA, 23 bp, Homo sapiens
agtactacacatttttaaattgt

SEQ ID NO: 4610594 - DNA, 12 bp, Homo sapiens
agtacttaacat

SEQ ID NO: 4610595 - DNA, 15 bp, Homo sapiens
agtacttaatatact

SEQ ID NO: 4610596 - DNA, 16 bp, Homo sapiens
agtacttacattccag

SEQ ID NO: 4610597 - DNA, 18 bp, Homo sapiens
agtacttacattccagta

SEQ ID NO: 4610598 - DNA, 13 bp, Homo sapiens
agtactttgtgca

SEQ ID NO: 4610599 - DNA, 16 bp, Homo sapiens
agtacttttttaaata

SEQ ID NO: 4610600 - DNA, 18 bp, Homo sapiens
agtagaggtactagaatg

SEQ ID NO: 4610601 - DNA, 19 bp, Homo sapiens
agtagattttaaagacaaa

SEQ ID NO: 4610602 - DNA, 23 bp, Homo sapiens
agtagctgagctcacaaggcagc

SEQ ID NO: 4610603 - DNA, 14 bp, Homo sapiens
agtagctgggatta

SEQ ID NO: 4610604 - DNA, 16 bp, Homo sapiens
agtagcttgctccctg

SEQ ID NO: 4610605 - DNA, 18 bp, Homo sapiens
agtagcttgctccctgtg

SEQ ID NO: 4610606 - DNA, 19 bp, Homo sapiens
agtagggatgcggatcctg

SEQ ID NO: 4610607 - DNA, 16 bp, Homo sapiens
agtataagaaatgcat

SEQ ID NO: 4610608 - DNA, 12 bp, Homo sapiens
agtataatcttt

SEQ ID NO: 4610609 - DNA, 13 bp, Homo sapiens
agtatacggaaac

SEQ ID NO: 4610610 - DNA, 23 bp, Homo sapiens
agtatacggaaacaaaaatgatc

SEQ ID NO: 4610611 - DNA, 19 bp, Homo sapiens
agtatcatgccctgtgcaa

SEQ ID NO: 4610612 - DNA, 14 bp, Homo sapiens
agtatgcaatgctt

SEQ ID NO: 4610613 - DNA, 13 bp, Homo sapiens
agtattattttcc

SEQ ID NO: 4610614 - DNA, 17 bp, Homo sapiens
agtatttaactaattat

SEQ ID NO: 4610615 - DNA, 17 bp, Homo sapiens
agtatttataaaaatat

SEQ ID NO: 4610616 - DNA, 18 bp, Homo sapiens
agtatttccacttgttct

SEQ ID NO: 4610617 - DNA, 22 bp, Homo sapiens
agtatttctgggttaaatgaaa

SEQ ID NO: 4610618 - DNA, 15 bp, Homo sapiens
agtatttctgttcct

SEQ ID NO: 4610619 - DNA, 22 bp, Homo sapiens
agtatttctgttcctttttgta

SEQ ID NO: 4610620 - DNA, 14 bp, Homo sapiens
agtcaaaaaattat

SEQ ID NO: 4610621 - DNA, 20 bp, Homo sapiens
agtcaaaaaattatttgcta

SEQ ID NO: 4610622 - DNA, 17 bp, Homo sapiens
agtcaaataaatgtttc

SEQ ID NO: 4610623 - DNA, 19 bp, Homo sapiens
agtcaaataaatgtttccc

SEQ ID NO: 4610624 - DNA, 21 bp, Homo sapiens
agtcaaataaatgtttccccc

SEQ ID NO: 4610625 - DNA, 22 bp, Homo sapiens
agtcaagtgaggtgacactcca

SEQ ID NO: 4610626 - DNA, 16 bp, Homo sapiens
agtcaattctgtgtgg

SEQ ID NO: 4610627 - DNA, 13 bp, Homo sapiens
agtcacagccacc

SEQ ID NO: 4610628 - DNA, 13 bp, Homo sapiens
agtcactgggaga

SEQ ID NO: 4610629 - DNA, 16 bp, Homo sapiens
agtcacttactattgt

SEQ ID NO: 4610630 - DNA, 16 bp, Homo sapiens
agtcagatgaggccct

SEQ ID NO: 4610631 - DNA, 20 bp, Homo sapiens
agtcaggaatcattaatttc

SEQ ID NO: 4610632 - DNA, 19 bp, Homo sapiens
agtcaggacagcttgtatg

SEQ ID NO: 4610633 - DNA, 17 bp, Homo sapiens
agtcaggatgaggcccc

SEQ ID NO: 4610634 - DNA, 19 bp, Homo sapiens
agtcaggatgaggccccgc

SEQ ID NO: 4610635 - DNA, 18 bp, Homo sapiens
agtcatataaaagctatg

SEQ ID NO: 4610636 - DNA, 16 bp, Homo sapiens
agtcatcatcagggcc

SEQ ID NO: 4610637 - DNA, 17 bp, Homo sapiens
agtcatcatcagggcct

SEQ ID NO: 4610638 - DNA, 23 bp, Homo sapiens
agtcattcagcagcaaattttca

SEQ ID NO: 4610639 - DNA, 13 bp, Homo sapiens
agtccaggtcctg

SEQ ID NO: 4610640 - DNA, 14 bp, Homo sapiens
agtccaggtcctgg

SEQ ID NO: 4610641 - DNA, 15 bp, Homo sapiens
agtccaggtcctggt

SEQ ID NO: 4610642 - DNA, 18 bp, Homo sapiens
agtccaggtcctggtggg

SEQ ID NO: 4610643 - DNA, 20 bp, Homo sapiens
agtcccattgtcagaaatat

SEQ ID NO: 4610644 - DNA, 21 bp, Homo sapiens
agtcccccctcgccccaaagt

SEQ ID NO: 4610645 - DNA, 22 bp, Homo sapiens
agtccctcttctggtttccctt

SEQ ID NO: 4610646 - DNA, 18 bp, Homo sapiens
agtccctgcaggtgaata

SEQ ID NO: 4610647 - DNA, 18 bp, Homo sapiens
agtccgtgtggatccaat

SEQ ID NO: 4610648 - DNA, 13 bp, Homo sapiens
agtcctagcccct

SEQ ID NO: 4610649 - DNA, 16 bp, Homo sapiens
agtccttcacctcact

SEQ ID NO: 4610650 - DNA, 17 bp, Homo sapiens
agtccttcacctcactg

SEQ ID NO: 4610651 - DNA, 15 bp, Homo sapiens
agtcggccccatctc

SEQ ID NO: 4610652 - DNA, 19 bp, Homo sapiens
agtcgtccttactcctgtg

SEQ ID NO: 4610653 - DNA, 20 bp, Homo sapiens
agtcgtccttactcctgtgg

SEQ ID NO: 4610654 - DNA, 15 bp, Homo sapiens
agtcgtgcactttct

SEQ ID NO: 4610655 - DNA, 16 bp, Homo sapiens
agtctatgttcaaaga

SEQ ID NO: 4610656 - DNA, 14 bp, Homo sapiens
agtctcactcttgt

SEQ ID NO: 4610657 - DNA, 18 bp, Homo sapiens
agtctcactgcttgaact

SEQ ID NO: 4610658 - DNA, 14 bp, Homo sapiens
agtctcattgtcac

SEQ ID NO: 4610659 - DNA, 16 bp, Homo sapiens
agtctcattgtcacct

SEQ ID NO: 4610660 - DNA, 17 bp, Homo sapiens
agtctcattgtcacctc

SEQ ID NO: 4610661 - DNA, 20 bp, Homo sapiens
agtctcctaggggcttggtc

SEQ ID NO: 4610662 - DNA, 11 bp, Homo sapiens
agtctcctcaa

SEQ ID NO: 4610663 - DNA, 23 bp, Homo sapiens
agtctcctcaatttttgtctcag

SEQ ID NO: 4610664 - DNA, 13 bp, Homo sapiens
agtctcctctcca

SEQ ID NO: 4610665 - DNA, 13 bp, Homo sapiens
agtctctcttcca

SEQ ID NO: 4610666 - DNA, 19 bp, Homo sapiens
agtctgaggtcctgagcac

SEQ ID NO: 4610667 - DNA, 15 bp, Homo sapiens
agtctgcacagagca

SEQ ID NO: 4610668 - DNA, 11 bp, Homo sapiens
agtctgggtca

SEQ ID NO: 4610669 - DNA, 19 bp, Homo sapiens
agtctgggtcagacccatc

SEQ ID NO: 4610670 - DNA, 23 bp, Homo sapiens
agtctgggtcagacccatctctc

SEQ ID NO: 4610671 - DNA, 16 bp, Homo sapiens
agtctgtttcccaagc

SEQ ID NO: 4610672 - DNA, 12 bp, Homo sapiens
agtcttgatcta

SEQ ID NO: 4610673 - DNA, 23 bp, Homo sapiens
agtcttggtttctctctacagtg

SEQ ID NO: 4610674 - DNA, 16 bp, Homo sapiens
agtctttcccccagga

SEQ ID NO: 4610675 - DNA, 15 bp, Homo sapiens
agtctttctcctctt

SEQ ID NO: 4610676 - DNA, 17 bp, Homo sapiens
agtctttgccagtcatt

SEQ ID NO: 4610677 - DNA, 22 bp, Homo sapiens
agtctttgccagtcattcagca

SEQ ID NO: 4610678 - DNA, 12 bp, Homo sapiens
agtgaaataaca

SEQ ID NO: 4610679 - DNA, 18 bp, Homo sapiens
agtgaagtctagaatcat

SEQ ID NO: 4610680 - DNA, 15 bp, Homo sapiens
agtgaatacattaac

SEQ ID NO: 4610681 - DNA, 23 bp, Homo sapiens
agtgaatacattaacggtgctaa

SEQ ID NO: 4610682 - DNA, 14 bp, Homo sapiens
agtgaatattgctt

SEQ ID NO: 4610683 - DNA, 15 bp, Homo sapiens
agtgacggctggcat

SEQ ID NO: 4610684 - DNA, 12 bp, Homo sapiens
agtgagaggccc

SEQ ID NO: 4610685 - DNA, 14 bp, Homo sapiens
agtgagaggccccc

SEQ ID NO: 4610686 - DNA, 18 bp, Homo sapiens
agtgagaggcccccaccc

SEQ ID NO: 4610687 - DNA, 18 bp, Homo sapiens
agtgagatggtatgaaat

SEQ ID NO: 4610688 - DNA, 17 bp, Homo sapiens
agtgagatgtagaaagt

SEQ ID NO: 4610689 - DNA, 18 bp, Homo sapiens
agtgagatgtagaaagtt

SEQ ID NO: 4610690 - DNA, 14 bp, Homo sapiens
agtgagcgagtgga

SEQ ID NO: 4610691 - DNA, 23 bp, Homo sapiens
agtgaggatgagacccagcccct

SEQ ID NO: 4610692 - DNA, 16 bp, Homo sapiens
agtgaggtgttgcagc

SEQ ID NO: 4610693 - DNA, 18 bp, Homo sapiens
agtgatatctagaaaggg

SEQ ID NO: 4610694 - DNA, 15 bp, Homo sapiens
agtgatcctcccacc

SEQ ID NO: 4610695 - DNA, 18 bp, Homo sapiens
agtgcaaaatgtcttgtg

SEQ ID NO: 4610696 - DNA, 16 bp, Homo sapiens
agtgcaaacacagcat

SEQ ID NO: 4610697 - DNA, 16 bp, Homo sapiens
agtgcaaattcatttt

SEQ ID NO: 4610698 - DNA, 15 bp, Homo sapiens
agtgcaacctctgct

SEQ ID NO: 4610699 - DNA, 21 bp, Homo sapiens
agtgcaattccaagaaaatat

SEQ ID NO: 4610700 - DNA, 21 bp, Homo sapiens
agtgcaggggatggggtgggg

SEQ ID NO: 4610701 - DNA, 17 bp, Homo sapiens
agtgcatcacatctgca

SEQ ID NO: 4610702 - DNA, 12 bp, Homo sapiens
agtgcatcatta

SEQ ID NO: 4610703 - DNA, 21 bp, Homo sapiens
agtgcatttgtgctagaaatt

SEQ ID NO: 4610704 - DNA, 14 bp, Homo sapiens
agtgccaaatgctc

SEQ ID NO: 4610705 - DNA, 16 bp, Homo sapiens
agtgccaactcctcac

SEQ ID NO: 4610706 - DNA, 16 bp, Homo sapiens
agtgccacgtcatgag

SEQ ID NO: 4610707 - DNA, 16 bp, Homo sapiens
agtgccataccttctc

SEQ ID NO: 4610708 - DNA, 18 bp, Homo sapiens
agtgccataccttctccc

SEQ ID NO: 4610709 - DNA, 20 bp, Homo sapiens
agtgccataccttctcccag

SEQ ID NO: 4610710 - DNA, 21 bp, Homo sapiens
agtgccataccttctcccagg

SEQ ID NO: 4610711 - DNA, 18 bp, Homo sapiens
agtgcccggtgcagggcc

SEQ ID NO: 4610712 - DNA, 23 bp, Homo sapiens
agtgcccggtgcagggcctggca

SEQ ID NO: 4610713 - DNA, 23 bp, Homo sapiens
agtgcctgcacatcatgagcctt

SEQ ID NO: 4610714 - DNA, 11 bp, Homo sapiens
agtgcctggga

SEQ ID NO: 4610715 - DNA, 20 bp, Homo sapiens
agtgccttctttagaccctc

SEQ ID NO: 4610716 - DNA, 15 bp, Homo sapiens
agtgctaaactactg

SEQ ID NO: 4610717 - DNA, 21 bp, Homo sapiens
agtgctaaactactgattact

SEQ ID NO: 4610718 - DNA, 22 bp, Homo sapiens
agtgctatgcggaggaaagcaa

SEQ ID NO: 4610719 - DNA, 12 bp, Homo sapiens
agtgctccagcc

SEQ ID NO: 4610720 - DNA, 13 bp, Homo sapiens
agtgctggctcac

SEQ ID NO: 4610721 - DNA, 14 bp, Homo sapiens
agtgctggctcaca

SEQ ID NO: 4610722 - DNA, 18 bp, Homo sapiens
agtgctggctcacagtac

SEQ ID NO: 4610723 - DNA, 20 bp, Homo sapiens
agtgctggctcacagtacag

SEQ ID NO: 4610724 - DNA, 20 bp, Homo sapiens
agtgctgggattacaggcgt

SEQ ID NO: 4610725 - DNA, 14 bp, Homo sapiens
agtggaaaacaaag

SEQ ID NO: 4610726 - DNA, 22 bp, Homo sapiens
agtggaatcctatatagaatgc

SEQ ID NO: 4610727 - DNA, 12 bp, Homo sapiens
agtggagacagt

SEQ ID NO: 4610728 - DNA, 12 bp, Homo sapiens
agtggcagagaa

SEQ ID NO: 4610729 - DNA, 16 bp, Homo sapiens
agtggcaggacaggaa

SEQ ID NO: 4610730 - DNA, 17 bp, Homo sapiens
agtggcaggacaggaaa

SEQ ID NO: 4610731 - DNA, 12 bp, Homo sapiens
agtggcagggac

SEQ ID NO: 4610732 - DNA, 13 bp, Homo sapiens
agtggcataaaaa

SEQ ID NO: 4610733 - DNA, 12 bp, Homo sapiens
agtggcctccct

SEQ ID NO: 4610734 - DNA, 14 bp, Homo sapiens
agtggcctccctgc

SEQ ID NO: 4610735 - DNA, 17 bp, Homo sapiens
agtggcctccctgctgt

SEQ ID NO: 4610736 - DNA, 14 bp, Homo sapiens
agtggcctctttgt

SEQ ID NO: 4610737 - DNA, 21 bp, Homo sapiens
agtggcctctttgtctaaaac

SEQ ID NO: 4610738 - DNA, 23 bp, Homo sapiens
agtggcctctttgtctaaaacaa

SEQ ID NO: 4610739 - DNA, 18 bp, Homo sapiens
agtggcgccatctcggct

SEQ ID NO: 4610740 - DNA, 18 bp, Homo sapiens
agtggcttcactcctgct

SEQ ID NO: 4610741 - DNA, 20 bp, Homo sapiens
agtggcttcactcctgctgt

SEQ ID NO: 4610742 - DNA, 21 bp, Homo sapiens
agtggcttcactcctgctgta

SEQ ID NO: 4610743 - DNA, 21 bp, Homo sapiens
agtgggactgtggtgacttct

SEQ ID NO: 4610744 - DNA, 16 bp, Homo sapiens
agtgggagctgagctg

SEQ ID NO: 4610745 - DNA, 12 bp, Homo sapiens
agtgggccaggg

SEQ ID NO: 4610746 - DNA, 18 bp, Homo sapiens
agtgggccccgggctgga

SEQ ID NO: 4610747 - DNA, 21 bp, Homo sapiens
agtgggccccgggctggagaa

SEQ ID NO: 4610748 - DNA, 21 bp, Homo sapiens
agtggggatgaggtcaccagg

SEQ ID NO: 4610749 - DNA, 12 bp, Homo sapiens
agtggggcctgt

SEQ ID NO: 4610750 - DNA, 21 bp, Homo sapiens
agtggggtcaagctgagctgg

SEQ ID NO: 4610751 - DNA, 23 bp, Homo sapiens
agtggtacttaagctcccctgcc

SEQ ID NO: 4610752 - DNA, 18 bp, Homo sapiens
agtggtatagaaatgctg

SEQ ID NO: 4610753 - DNA, 14 bp, Homo sapiens
agtggttgcctggg

SEQ ID NO: 4610754 - DNA, 13 bp, Homo sapiens
agtgtaataagac

SEQ ID NO: 4610755 - DNA, 13 bp, Homo sapiens
agtgtacagtctt

SEQ ID NO: 4610756 - DNA, 16 bp, Homo sapiens
agtgtacagtcttgta

SEQ ID NO: 4610757 - DNA, 17 bp, Homo sapiens
agtgtacagtcttgtat

SEQ ID NO: 4610758 - DNA, 16 bp, Homo sapiens
agtgtacgattcttaa

SEQ ID NO: 4610759 - DNA, 14 bp, Homo sapiens
agtgtactcccagg

SEQ ID NO: 4610760 - DNA, 22 bp, Homo sapiens
agtgtacttcataagatattct

SEQ ID NO: 4610761 - DNA, 19 bp, Homo sapiens
agtgtagcctaaagggcag

SEQ ID NO: 4610762 - DNA, 22 bp, Homo sapiens
agtgtagcctaaagggcagggc

SEQ ID NO: 4610763 - DNA, 23 bp, Homo sapiens
agtgtagcctaaagggcagggcc

SEQ ID NO: 4610764 - DNA, 20 bp, Homo sapiens
agtgtagctgtaagggcagt

SEQ ID NO: 4610765 - DNA, 18 bp, Homo sapiens
agtgtcacctccttcccc

SEQ ID NO: 4610766 - DNA, 16 bp, Homo sapiens
agtgtcacttgactct

SEQ ID NO: 4610767 - DNA, 17 bp, Homo sapiens
agtgtcacttgactctt

SEQ ID NO: 4610768 - DNA, 12 bp, Homo sapiens
agtgtcctgccc

SEQ ID NO: 4610769 - DNA, 16 bp, Homo sapiens
agtgtcctgcccatgc

SEQ ID NO: 4610770 - DNA, 16 bp, Homo sapiens
agtgtgacagggccag

SEQ ID NO: 4610771 - DNA, 22 bp, Homo sapiens
agtgtgacagggccagtggggc

SEQ ID NO: 4610772 - DNA, 12 bp, Homo sapiens
agtgtgacttct

SEQ ID NO: 4610773 - DNA, 14 bp, Homo sapiens
agtgtgacttctta

SEQ ID NO: 4610774 - DNA, 18 bp, Homo sapiens
agtgtgcatggaggccct

SEQ ID NO: 4610775 - DNA, 19 bp, Homo sapiens
agtgtgcatggaggccctc

SEQ ID NO: 4610776 - DNA, 21 bp, Homo sapiens
agtgtgtgtttgtgtgtttca

SEQ ID NO: 4610777 - DNA, 18 bp, Homo sapiens
agtgtttctgaatgtttg

SEQ ID NO: 4610778 - DNA, 19 bp, Homo sapiens
agtgtttctgaatgtttgt

SEQ ID NO: 4610779 - DNA, 16 bp, Homo sapiens
agtgtttttacctctg

SEQ ID NO: 4610780 - DNA, 12 bp, Homo sapiens
agttaaagccac

SEQ ID NO: 4610781 - DNA, 19 bp, Homo sapiens
agttacacatttttcagat

SEQ ID NO: 4610782 - DNA, 21 bp, Homo sapiens
agttactccagtgccaacaat

SEQ ID NO: 4610783 - DNA, 19 bp, Homo sapiens
agttactttgtcagaggca

SEQ ID NO: 4610784 - DNA, 23 bp, Homo sapiens
agttagaaaattcagctcctttc

SEQ ID NO: 4610785 - DNA, 17 bp, Homo sapiens
agttagctccataaagt

SEQ ID NO: 4610786 - DNA, 21 bp, Homo sapiens
agttattttaatacctttaaa

SEQ ID NO: 4610787 - DNA, 16 bp, Homo sapiens
agttcaaaccctgtat

SEQ ID NO: 4610788 - DNA, 18 bp, Homo sapiens
agttcaataaatgtctgt

SEQ ID NO: 4610789 - DNA, 18 bp, Homo sapiens
agttcatcgattttctat

SEQ ID NO: 4610790 - DNA, 22 bp, Homo sapiens
agttcatgtgtggaaatgggac

SEQ ID NO: 4610791 - DNA, 15 bp, Homo sapiens
agttccatagaaaag

SEQ ID NO: 4610792 - DNA, 14 bp, Homo sapiens
agttccctctgcct

SEQ ID NO: 4610793 - DNA, 19 bp, Homo sapiens
agttccctctgcctgggat

SEQ ID NO: 4610794 - DNA, 13 bp, Homo sapiens
agttcctgctgcc

SEQ ID NO: 4610795 - DNA, 14 bp, Homo sapiens
agttcctgctgcct

SEQ ID NO: 4610796 - DNA, 17 bp, Homo sapiens
agttcgcagccaccctg

SEQ ID NO: 4610797 - DNA, 21 bp, Homo sapiens
agttcgcagccaccctgagga

SEQ ID NO: 4610798 - DNA, 19 bp, Homo sapiens
agttctataagtgaggaag

SEQ ID NO: 4610799 - DNA, 13 bp, Homo sapiens
agttctgaaagct

SEQ ID NO: 4610800 - DNA, 16 bp, Homo sapiens
agttcttagttgctgt

SEQ ID NO: 4610801 - DNA, 20 bp, Homo sapiens
agttcttagttgctgtatgt

SEQ ID NO: 4610802 - DNA, 14 bp, Homo sapiens
agttcttgtgccat

SEQ ID NO: 4610803 - DNA, 12 bp, Homo sapiens
agttctttcctc

SEQ ID NO: 4610804 - DNA, 16 bp, Homo sapiens
agttgagattgtactg

SEQ ID NO: 4610805 - DNA, 17 bp, Homo sapiens
agttgagattgtactgt

SEQ ID NO: 4610806 - DNA, 18 bp, Homo sapiens
agttgagattgtactgtt

SEQ ID NO: 4610807 - DNA, 20 bp, Homo sapiens
agttgagattgtactgttca

SEQ ID NO: 4610808 - DNA, 22 bp, Homo sapiens
agttgcatttagcttctttccc

SEQ ID NO: 4610809 - DNA, 16 bp, Homo sapiens
agttgcgtggactctg

SEQ ID NO: 4610810 - DNA, 21 bp, Homo sapiens
agttgctcaccgactcacctg

SEQ ID NO: 4610811 - DNA, 19 bp, Homo sapiens
agttgctgtgaactttcat

SEQ ID NO: 4610812 - DNA, 20 bp, Homo sapiens
agttgctgtgtgtctgtcct

SEQ ID NO: 4610813 - DNA, 13 bp, Homo sapiens
agttgtctgtgct

SEQ ID NO: 4610814 - DNA, 21 bp, Homo sapiens
agttgtctgtgcttccttggt

SEQ ID NO: 4610815 - DNA, 19 bp, Homo sapiens
agttgtgataatagcattt

SEQ ID NO: 4610816 - DNA, 19 bp, Homo sapiens
agttgtgatggaggggaga

SEQ ID NO: 4610817 - DNA, 21 bp, Homo sapiens
agttgtgatggaggggagagg

SEQ ID NO: 4610818 - DNA, 13 bp, Homo sapiens
agttgtggaggag

SEQ ID NO: 4610819 - DNA, 14 bp, Homo sapiens
agttgttgcattcc

SEQ ID NO: 4610820 - DNA, 12 bp, Homo sapiens
agtttaaatacc

SEQ ID NO: 4610821 - DNA, 13 bp, Homo sapiens
agtttaaatacca

SEQ ID NO: 4610822 - DNA, 14 bp, Homo sapiens
agtttaaataccag

SEQ ID NO: 4610823 - DNA, 16 bp, Homo sapiens
agtttaaataccagta

SEQ ID NO: 4610824 - DNA, 17 bp, Homo sapiens
agtttaatacaggaaat

SEQ ID NO: 4610825 - DNA, 23 bp, Homo sapiens
agtttaatacaggaaattgactt

SEQ ID NO: 4610826 - DNA, 14 bp, Homo sapiens
agtttaattgactt

SEQ ID NO: 4610827 - DNA, 22 bp, Homo sapiens
agtttaggaattggaggctgca

SEQ ID NO: 4610828 - DNA, 17 bp, Homo sapiens
agtttatggcaaagatt

SEQ ID NO: 4610829 - DNA, 21 bp, Homo sapiens
agtttatttccactattttca

SEQ ID NO: 4610830 - DNA, 16 bp, Homo sapiens
agtttcaaagtgtctc

SEQ ID NO: 4610831 - DNA, 15 bp, Homo sapiens
agtttcagctggaaa

SEQ ID NO: 4610832 - DNA, 19 bp, Homo sapiens
agtttccttttctgtctct

SEQ ID NO: 4610833 - DNA, 13 bp, Homo sapiens
agtttctgcctgg

SEQ ID NO: 4610834 - DNA, 21 bp, Homo sapiens
agtttcttgcttggaagccag

SEQ ID NO: 4610835 - DNA, 23 bp, Homo sapiens
agtttcttgcttggaagccaggt

SEQ ID NO: 4610836 - DNA, 23 bp, Homo sapiens
agtttgatttttgtttttgtaat

SEQ ID NO: 4610837 - DNA, 23 bp, Homo sapiens
agtttgctttttgcgtacacaga

SEQ ID NO: 4610838 - DNA, 17 bp, Homo sapiens
agtttgtagaactttat

SEQ ID NO: 4610839 - DNA, 17 bp, Homo sapiens
agtttgtagttgtttta

SEQ ID NO: 4610840 - DNA, 21 bp, Homo sapiens
agtttgtgtatatattataaa

SEQ ID NO: 4610841 - DNA, 20 bp, Homo sapiens
agttttataccctttttcat

SEQ ID NO: 4610842 - DNA, 17 bp, Homo sapiens
agttttggccaccacat

SEQ ID NO: 4610843 - DNA, 17 bp, Homo sapiens
agtttttatatgttgta

SEQ ID NO: 4610844 - DNA, 23 bp, Homo sapiens
agtttttatttagcatggggatt

SEQ ID NO: 4610845 - DNA, 11 bp, Homo sapiens
agtttttctga

SEQ ID NO: 4610846 - DNA, 12 bp, Homo sapiens
agtttttctgaa

SEQ ID NO: 4610847 - DNA, 19 bp, Homo sapiens
ataaaaatataaattgtac

SEQ ID NO: 4610848 - DNA, 14 bp, Homo sapiens
ataaaacacacctc

SEQ ID NO: 4610849 - DNA, 12 bp, Homo sapiens
ataaaacatcat

SEQ ID NO: 4610850 - DNA, 15 bp, Homo sapiens
ataaaaggaagccaa

SEQ ID NO: 4610851 - DNA, 17 bp, Homo sapiens
ataaaaggaagccaaag

SEQ ID NO: 4610852 - DNA, 20 bp, Homo sapiens
ataaaaggaagccaaagagt

SEQ ID NO: 4610853 - DNA, 12 bp, Homo sapiens
ataaaatatcat

SEQ ID NO: 4610854 - DNA, 17 bp, Homo sapiens
ataaaatatcataaagc

SEQ ID NO: 4610855 - DNA, 20 bp, Homo sapiens
ataaaatatcataaagcatt

SEQ ID NO: 4610856 - DNA, 16 bp, Homo sapiens
ataaaatcaaaacaag

SEQ ID NO: 4610857 - DNA, 21 bp, Homo sapiens
ataaaatcaaaacaagtgaaa

SEQ ID NO: 4610858 - DNA, 19 bp, Homo sapiens
ataaaatgaaaattgtatt

SEQ ID NO: 4610859 - DNA, 16 bp, Homo sapiens
ataaaatggctgtaat

SEQ ID NO: 4610860 - DNA, 14 bp, Homo sapiens
ataaaatgtttcat

SEQ ID NO: 4610861 - DNA, 19 bp, Homo sapiens
ataaaattttttttcatgt

SEQ ID NO: 4610862 - DNA, 20 bp, Homo sapiens
ataaagacttgtgcatccct

SEQ ID NO: 4610863 - DNA, 14 bp, Homo sapiens
ataaagatcattta

SEQ ID NO: 4610864 - DNA, 11 bp, Homo sapiens
ataaagcttta

SEQ ID NO: 4610865 - DNA, 16 bp, Homo sapiens
ataaaggataactctg

SEQ ID NO: 4610866 - DNA, 16 bp, Homo sapiens
ataaaggctaactatg

SEQ ID NO: 4610867 - DNA, 22 bp, Homo sapiens
ataaagtacaaatgaagaaagt

SEQ ID NO: 4610868 - DNA, 22 bp, Homo sapiens
ataaagtgctgcggagcaagag

SEQ ID NO: 4610869 - DNA, 23 bp, Homo sapiens
ataaagttggttcacttcaaagc

SEQ ID NO: 4610870 - DNA, 18 bp, Homo sapiens
ataaagttgttgcattcc

SEQ ID NO: 4610871 - DNA, 21 bp, Homo sapiens
ataaatctaaatgattatctt

SEQ ID NO: 4610872 - DNA, 23 bp, Homo sapiens
ataaatctaaatgattatcttga

SEQ ID NO: 4610873 - DNA, 17 bp, Homo sapiens
ataaatcttcttattaa

SEQ ID NO: 4610874 - DNA, 16 bp, Homo sapiens
ataaatgatatcaaag

SEQ ID NO: 4610875 - DNA, 12 bp, Homo sapiens
ataaatgtctgt

SEQ ID NO: 4610876 - DNA, 15 bp, Homo sapiens
ataaatgtttccccc

SEQ ID NO: 4610877 - DNA, 19 bp, Homo sapiens
ataaattctgacttatgaa

SEQ ID NO: 4610878 - DNA, 17 bp, Homo sapiens
ataaattgcttactgat

SEQ ID NO: 4610879 - DNA, 13 bp, Homo sapiens
ataacaaaatgga

SEQ ID NO: 4610880 - DNA, 16 bp, Homo sapiens
ataaccaatttgtaat

SEQ ID NO: 4610881 - DNA, 17 bp, Homo sapiens
ataaccaatttgtaatg

SEQ ID NO: 4610882 - DNA, 14 bp, Homo sapiens
ataacccagttact

SEQ ID NO: 4610883 - DNA, 16 bp, Homo sapiens
ataacctgcacaggct

SEQ ID NO: 4610884 - DNA, 20 bp, Homo sapiens
ataactaagcaagtatattt

SEQ ID NO: 4610885 - DNA, 18 bp, Homo sapiens
ataacttttttttaagtt

SEQ ID NO: 4610886 - DNA, 20 bp, Homo sapiens
ataagaaagcctaaaattga

SEQ ID NO: 4610887 - DNA, 17 bp, Homo sapiens
ataagacttagattgtg

SEQ ID NO: 4610888 - DNA, 14 bp, Homo sapiens
ataagagcatgaaa

SEQ ID NO: 4610889 - DNA, 18 bp, Homo sapiens
ataagatattctttacaa

SEQ ID NO: 4610890 - DNA, 19 bp, Homo sapiens
ataagatgtattctttata

SEQ ID NO: 4610891 - DNA, 20 bp, Homo sapiens
ataagcagaacatactgttc

SEQ ID NO: 4610892 - DNA, 11 bp, Homo sapiens
ataaggaaact

SEQ ID NO: 4610893 - DNA, 16 bp, Homo sapiens
ataaggactttttgat

SEQ ID NO: 4610894 - DNA, 22 bp, Homo sapiens
ataagtgagatggtatgaaata

SEQ ID NO: 4610895 - DNA, 23 bp, Homo sapiens
ataagttgtataggctaaatgtt

SEQ ID NO: 4610896 - DNA, 21 bp, Homo sapiens
ataataaacataatgaaaata

SEQ ID NO: 4610897 - DNA, 21 bp, Homo sapiens
ataatagcatttttgtaactt

SEQ ID NO: 4610898 - DNA, 17 bp, Homo sapiens
ataataggggattttaa

SEQ ID NO: 4610899 - DNA, 19 bp, Homo sapiens
ataatatttttgtatttct

SEQ ID NO: 4610900 - DNA, 20 bp, Homo sapiens
ataatcagaaaagtaatttt

SEQ ID NO: 4610901 - DNA, 15 bp, Homo sapiens
ataatcccagcactt

SEQ ID NO: 4610902 - DNA, 16 bp, Homo sapiens
ataatcccagcacttt

SEQ ID NO: 4610903 - DNA, 17 bp, Homo sapiens
ataatcccagcactttg

SEQ ID NO: 4610904 - DNA, 18 bp, Homo sapiens
ataatctctccattcccg

SEQ ID NO: 4610905 - DNA, 13 bp, Homo sapiens
ataatcttataca

SEQ ID NO: 4610906 - DNA, 21 bp, Homo sapiens
ataatgaaaataaaacacacc

SEQ ID NO: 4610907 - DNA, 17 bp, Homo sapiens
ataatgggtttctttca

SEQ ID NO: 4610908 - DNA, 11 bp, Homo sapiens
ataatgtgaac

SEQ ID NO: 4610909 - DNA, 19 bp, Homo sapiens
ataatgttaaccaaggaaa

SEQ ID NO: 4610910 - DNA, 20 bp, Homo sapiens
ataatgttaaccaaggaaat

SEQ ID NO: 4610911 - DNA, 15 bp, Homo sapiens
ataatgttattcatt

SEQ ID NO: 4610912 - DNA, 12 bp, Homo sapiens
ataattaatgtt

SEQ ID NO: 4610913 - DNA, 21 bp, Homo sapiens
ataattagatgattatatatt

SEQ ID NO: 4610914 - DNA, 19 bp, Homo sapiens
ataattagtcgggcatgag

SEQ ID NO: 4610915 - DNA, 15 bp, Homo sapiens
ataattatgaaaact

SEQ ID NO: 4610916 - DNA, 16 bp, Homo sapiens
ataattattattatta

SEQ ID NO: 4610917 - DNA, 13 bp, Homo sapiens
ataattcatattc

SEQ ID NO: 4610918 - DNA, 15 bp, Homo sapiens
ataattctggagata

SEQ ID NO: 4610919 - DNA, 15 bp, Homo sapiens
ataattcttttctga

SEQ ID NO: 4610920 - DNA, 17 bp, Homo sapiens
ataattggtgctatttg

SEQ ID NO: 4610921 - DNA, 20 bp, Homo sapiens
ataattggtgctatttgaag

SEQ ID NO: 4610922 - DNA, 23 bp, Homo sapiens
ataattggtgctatttgaagaaa

SEQ ID NO: 4610923 - DNA, 13 bp, Homo sapiens
ataattgtatcta

SEQ ID NO: 4610924 - DNA, 20 bp, Homo sapiens
ataatttatttccactaaaa

SEQ ID NO: 4610925 - DNA, 13 bp, Homo sapiens
ataattttgcata

SEQ ID NO: 4610926 - DNA, 15 bp, Homo sapiens
atacaaactctcacc

SEQ ID NO: 4610927 - DNA, 16 bp, Homo sapiens
atacaaactctcacca

SEQ ID NO: 4610928 - DNA, 16 bp, Homo sapiens
atacaaagtggaaact

SEQ ID NO: 4610929 - DNA, 14 bp, Homo sapiens
atacaagaaaatgt

SEQ ID NO: 4610930 - DNA, 16 bp, Homo sapiens
atacaagaaaatgtat

SEQ ID NO: 4610931 - DNA, 14 bp, Homo sapiens
atacaataacccag

SEQ ID NO: 4610932 - DNA, 21 bp, Homo sapiens
atacacgtttatcttacattc

SEQ ID NO: 4610933 - DNA, 18 bp, Homo sapiens
atacagacctaatatcat

SEQ ID NO: 4610934 - DNA, 12 bp, Homo sapiens
atacagaggaaa

SEQ ID NO: 4610935 - DNA, 15 bp, Homo sapiens
atacagttttgagta

SEQ ID NO: 4610936 - DNA, 22 bp, Homo sapiens
atacataggtctgtatggctgt

SEQ ID NO: 4610937 - DNA, 23 bp, Homo sapiens
atacataggtctgtatggctgta

SEQ ID NO: 4610938 - DNA, 15 bp, Homo sapiens
atacattaaaataac

SEQ ID NO: 4610939 - DNA, 16 bp, Homo sapiens
atcattgtcagccttg

SEQ ID NO: 4610940 - DNA, 14 bp, Homo sapiens
atcattgttgcctc

SEQ ID NO: 4610941 - DNA, 18 bp, Homo sapiens
atcatttataatactgtt

SEQ ID NO: 4610942 - DNA, 13 bp, Homo sapiens
atcattttaaaaa

SEQ ID NO: 4610943 - DNA, 14 bp, Homo sapiens
atcattttattcac

SEQ ID NO: 4610944 - DNA, 11 bp, Homo sapiens
atcattttcat

SEQ ID NO: 4610945 - DNA, 23 bp, Homo sapiens
atcatttttgtaggaagcatttt

SEQ ID NO: 4610946 - DNA, 14 bp, Homo sapiens
atccaaggaaacat

SEQ ID NO: 4610947 - DNA, 17 bp, Homo sapiens
atccaattgctctttca

SEQ ID NO: 4610948 - DNA, 20 bp, Homo sapiens
atccacaactaatgagggaa

SEQ ID NO: 4610949 - DNA, 14 bp, Homo sapiens
atccagagatgact

SEQ ID NO: 4610950 - DNA, 17 bp, Homo sapiens
atccagcagcagcactt

SEQ ID NO: 4610951 - DNA, 10 bp, Homo sapiens
atccagccac

SEQ ID NO: 4610952 - DNA, 15 bp, Homo sapiens
atccaggcaatggcc

SEQ ID NO: 4610953 - DNA, 22 bp, Homo sapiens
atccagtcattttattttgtaa

SEQ ID NO: 4610954 - DNA, 22 bp, Homo sapiens
atccatactgtagacactctga

SEQ ID NO: 4610955 - DNA, 17 bp, Homo sapiens
atccattaggccagcaa

SEQ ID NO: 4610956 - DNA, 18 bp, Homo sapiens
atccattaggccagcaac

SEQ ID NO: 4610957 - DNA, 11 bp, Homo sapiens
atccattttag

SEQ ID NO: 4610958 - DNA, 15 bp, Homo sapiens
atcccacccacatgt

SEQ ID NO: 4610959 - DNA, 14 bp, Homo sapiens
atcccactgactgt

SEQ ID NO: 4610960 - DNA, 20 bp, Homo sapiens
atcccactgtatagatccac

SEQ ID NO: 4610961 - DNA, 17 bp, Homo sapiens
atcccagtactttggaa

SEQ ID NO: 4610962 - DNA, 11 bp, Homo sapiens
atcccatcagt

SEQ ID NO: 4610963 - DNA, 13 bp, Homo sapiens
atcccccctgctg

SEQ ID NO: 4610964 - DNA, 22 bp, Homo sapiens
atcccgtaagaccaccttccct

SEQ ID NO: 4610965 - DNA, 13 bp, Homo sapiens
atccctgggcctg

SEQ ID NO: 4610966 - DNA, 15 bp, Homo sapiens
atccctgggcctgct

SEQ ID NO: 4610967 - DNA, 17 bp, Homo sapiens
atccctgggcctgctgc

SEQ ID NO: 4610968 - DNA, 22 bp, Homo sapiens
atccctgggcctgctgctgaga

SEQ ID NO: 4610969 - DNA, 15 bp, Homo sapiens
atcccttaagaagtt

SEQ ID NO: 4610970 - DNA, 17 bp, Homo sapiens
atcccttattagttaca

SEQ ID NO: 4610971 - DNA, 16 bp, Homo sapiens
atccgccagtgtttct

SEQ ID NO: 4610972 - DNA, 18 bp, Homo sapiens
atccgcccacctcagcct

SEQ ID NO: 4610973 - DNA, 19 bp, Homo sapiens
atccgcccacctcagcctc

SEQ ID NO: 4610974 - DNA, 21 bp, Homo sapiens
atccgcccacctcagcctccc

SEQ ID NO: 4610975 - DNA, 18 bp, Homo sapiens
atccgtgaggcagggaca

SEQ ID NO: 4610976 - DNA, 16 bp, Homo sapiens
atcctactgagcattt

SEQ ID NO: 4610977 - DNA, 20 bp, Homo sapiens
atcctatatagaatgctgca

SEQ ID NO: 4610978 - DNA, 14 bp, Homo sapiens
atcctatgtgattt

SEQ ID NO: 4610979 - DNA, 17 bp, Homo sapiens
atcctatgtgattttaa

SEQ ID NO: 4610980 - DNA, 11 bp, Homo sapiens
atcctcagtgc

SEQ ID NO: 4610981 - DNA, 14 bp, Homo sapiens
atcctcagttcctg

SEQ ID NO: 4610982 - DNA, 13 bp, Homo sapiens
atcctcctgagta

SEQ ID NO: 4610983 - DNA, 16 bp, Homo sapiens
atcctgaaagggcact

SEQ ID NO: 4610984 - DNA, 12 bp, Homo sapiens
atcctgcctgcc

SEQ ID NO: 4610985 - DNA, 13 bp, Homo sapiens
atcctgctaagtt

SEQ ID NO: 4610986 - DNA, 11 bp, Homo sapiens
atcctgctggg

SEQ ID NO: 4610987 - DNA, 11 bp, Homo sapiens
atcctgggacc

SEQ ID NO: 4610988 - DNA, 18 bp, Homo sapiens
atcctgggcatccttctt

SEQ ID NO: 4610989 - DNA, 19 bp, Homo sapiens
atcctggggcagcactccc

SEQ ID NO: 4610990 - DNA, 15 bp, Homo sapiens
atcctgggggaagag

SEQ ID NO: 4610991 - DNA, 19 bp, Homo sapiens
atcctggttaccactcttt

SEQ ID NO: 4610992 - DNA, 12 bp, Homo sapiens
atcctgtgaagt

SEQ ID NO: 4610993 - DNA, 18 bp, Homo sapiens
atccttacaatgtgaata

SEQ ID NO: 4610994 - DNA, 14 bp, Homo sapiens
atccttacactccc

SEQ ID NO: 4610995 - DNA, 15 bp, Homo sapiens
atccttacactcccc

SEQ ID NO: 4610996 - DNA, 20 bp, Homo sapiens
atccttcaaaataaaaagta

SEQ ID NO: 4610997 - DNA, 15 bp, Homo sapiens
atccttccattccat

SEQ ID NO: 4610998 - DNA, 13 bp, Homo sapiens
atccttgactgaa

SEQ ID NO: 4610999 - DNA, 23 bp, Homo sapiens
atccttgcccaggtgagggaagg

SEQ ID NO: 4611000 - DNA, 19 bp, Homo sapiens
atccttgtgttcagctctt

SEQ ID NO: 4611001 - DNA, 18 bp, Homo sapiens
atccttttttgtcatttt

SEQ ID NO: 4611002 - DNA, 21 bp, Homo sapiens
atcgaagggtttttagagaat

SEQ ID NO: 4611003 - DNA, 15 bp, Homo sapiens
atcgatgttatgtaa

SEQ ID NO: 4611004 - DNA, 15 bp, Homo sapiens
atcgattcccaagct

SEQ ID NO: 4611005 - DNA, 18 bp, Homo sapiens
atcgctgtattttgagtt

SEQ ID NO: 4611006 - DNA, 18 bp, Homo sapiens
atcggacattctaatgca

SEQ ID NO: 4611007 - DNA, 23 bp, Homo sapiens
atcggccaagaatacttgaagaa

SEQ ID NO: 4611008 - DNA, 15 bp, Homo sapiens
atctaaagcagcagg

SEQ ID NO: 4611009 - DNA, 21 bp, Homo sapiens
atctaaagcagcaggtctaga

SEQ ID NO: 4611010 - DNA, 15 bp, Homo sapiens
atctaaatgaaagtg

SEQ ID NO: 4611011 - DNA, 18 bp, Homo sapiens
atctaaatgattatcttg

SEQ ID NO: 4611012 - DNA, 14 bp, Homo sapiens
atctaaattctgat

SEQ ID NO: 4611013 - DNA, 14 bp, Homo sapiens
atctacagtaatga

SEQ ID NO: 4611014 - DNA, 15 bp, Homo sapiens
atctacagtaatgaa

SEQ ID NO: 4611015 - DNA, 19 bp, Homo sapiens
atctagacattcttttaat

SEQ ID NO: 4611016 - DNA, 23 bp, Homo sapiens
atctagatacaggactggttcct

SEQ ID NO: 4611017 - DNA, 15 bp, Homo sapiens
atctagctagtaata

SEQ ID NO: 4611018 - DNA, 22 bp, Homo sapiens
atctatatgtacttgtcaaaga

SEQ ID NO: 4611019 - DNA, 23 bp, Homo sapiens
atctatatgtacttgtcaaagaa

SEQ ID NO: 4611020 - DNA, 14 bp, Homo sapiens
atctatcactgcat

SEQ ID NO: 4611021 - DNA, 13 bp, Homo sapiens
atctatgaggaaa

SEQ ID NO: 4611022 - DNA, 15 bp, Homo sapiens
atctcacctcctgct

SEQ ID NO: 4611023 - DNA, 16 bp, Homo sapiens
atctcacctcctgctg

SEQ ID NO: 4611024 - DNA, 20 bp, Homo sapiens
atctcacctcctgctgggca

SEQ ID NO: 4611025 - DNA, 21 bp, Homo sapiens
atctcacctcctgctgggcag

SEQ ID NO: 4611026 - DNA, 19 bp, Homo sapiens
atctcctgccagcccagct

SEQ ID NO: 4611027 - DNA, 23 bp, Homo sapiens
atctcgaatttgaagagattgct

SEQ ID NO: 4611028 - DNA, 15 bp, Homo sapiens
atctcggctcagtgc

SEQ ID NO: 4611029 - DNA, 16 bp, Homo sapiens
atctctcaaatctgtt

SEQ ID NO: 4611030 - DNA, 13 bp, Homo sapiens
atctctctcttgc

SEQ ID NO: 4611031 - DNA, 14 bp, Homo sapiens
atctctttctttct

SEQ ID NO: 4611032 - DNA, 21 bp, Homo sapiens
atctctttctttctctttctg

SEQ ID NO: 4611033 - DNA, 22 bp, Homo sapiens
atctctttctttctctttctgt

SEQ ID NO: 4611034 - DNA, 21 bp, Homo sapiens
atctgaccctatgggtctagg

SEQ ID NO: 4611035 - DNA, 11 bp, Homo sapiens
atctgcaaaag

SEQ ID NO: 4611036 - DNA, 21 bp, Homo sapiens
atctgcacactctcttctcca

SEQ ID NO: 4611037 - DNA, 23 bp, Homo sapiens
atctgcacactctcttctccatt

SEQ ID NO: 4611038 - DNA, 12 bp, Homo sapiens
atctgccagacc

SEQ ID NO: 4611039 - DNA, 16 bp, Homo sapiens
atctgctgtcctgttt

SEQ ID NO: 4611040 - DNA, 23 bp, Homo sapiens
atctggaaacctctacatattta

SEQ ID NO: 4611041 - DNA, 23 bp, Homo sapiens
atctggaaataatatcatttata

SEQ ID NO: 4611042 - DNA, 16 bp, Homo sapiens
atctgggttaagtgtt

SEQ ID NO: 4611043 - DNA, 13 bp, Homo sapiens
atctgtaaagcca

SEQ ID NO: 4611044 - DNA, 20 bp, Homo sapiens
atctgtaacaggtattttgt

SEQ ID NO: 4611045 - DNA, 16 bp, Homo sapiens
atctgtaatcctagct

SEQ ID NO: 4611046 - DNA, 17 bp, Homo sapiens
atctgtacttcttcgat

SEQ ID NO: 4611047 - DNA, 22 bp, Homo sapiens
atctgtatataagttgctgtgt

SEQ ID NO: 4611048 - DNA, 17 bp, Homo sapiens
atctgtctgctctgcat

SEQ ID NO: 4611049 - DNA, 22 bp, Homo sapiens
atctgtctttgcggggcctgtc

SEQ ID NO: 4611050 - DNA, 21 bp, Homo sapiens
atctgtcttttatttaacaaa

SEQ ID NO: 4611051 - DNA, 12 bp, Homo sapiens
atatgaatctat

SEQ ID NO: 4611052 - DNA, 14 bp, Homo sapiens
atatgaatctataa

SEQ ID NO: 4611053 - DNA, 13 bp, Homo sapiens
atatgatctgttt

SEQ ID NO: 4611054 - DNA, 19 bp, Homo sapiens
atatgcaaggcggtacact

SEQ ID NO: 4611055 - DNA, 19 bp, Homo sapiens
atatgccactaacttctaa

SEQ ID NO: 4611056 - DNA, 15 bp, Homo sapiens
atatgctgatctttt

SEQ ID NO: 4611057 - DNA, 16 bp, Homo sapiens
atatgctgatctttta

SEQ ID NO: 4611058 - DNA, 14 bp, Homo sapiens
atatggaaatcttt

SEQ ID NO: 4611059 - DNA, 19 bp, Homo sapiens
atatggaaatcttttacat

SEQ ID NO: 4611060 - DNA, 17 bp, Homo sapiens
atatggatttgttacag

SEQ ID NO: 4611061 - DNA, 18 bp, Homo sapiens
atatggcaggagctactg

SEQ ID NO: 4611062 - DNA, 13 bp, Homo sapiens
atatgtctctttg

SEQ ID NO: 4611063 - DNA, 20 bp, Homo sapiens
atatgtcttactactttaaa

SEQ ID NO: 4611064 - DNA, 22 bp, Homo sapiens
atatgtcttactactttaaatc

SEQ ID NO: 4611065 - DNA, 23 bp, Homo sapiens
atatgtcttactactttaaatcc

SEQ ID NO: 4611066 - DNA, 16 bp, Homo sapiens
atatgtcttgcaaagc

SEQ ID NO: 4611067 - DNA, 21 bp, Homo sapiens
atatgtgacactgcagcagaa

SEQ ID NO: 4611068 - DNA, 16 bp, Homo sapiens
atatgtgtatacatac

SEQ ID NO: 4611069 - DNA, 21 bp, Homo sapiens
atatgtttaaaataaaatgaa

SEQ ID NO: 4611070 - DNA, 22 bp, Homo sapiens
atatgtttagttttacatttta

SEQ ID NO: 4611071 - DNA, 21 bp, Homo sapiens
atattaattttctacaaataa

SEQ ID NO: 4611072 - DNA, 19 bp, Homo sapiens
atattaccatcttaatctt

SEQ ID NO: 4611073 - DNA, 20 bp, Homo sapiens
atattaccatcttaatcttt

SEQ ID NO: 4611074 - DNA, 21 bp, Homo sapiens
atattaccatcttaatcttta

SEQ ID NO: 4611075 - DNA, 11 bp, Homo sapiens
atattatagaa

SEQ ID NO: 4611076 - DNA, 14 bp, Homo sapiens
atattatagaaaat

SEQ ID NO: 4611077 - DNA, 13 bp, Homo sapiens
atattatatacat

SEQ ID NO: 4611078 - DNA, 15 bp, Homo sapiens
atattatatggcagg

SEQ ID NO: 4611079 - DNA, 12 bp, Homo sapiens
atattcacagtt

SEQ ID NO: 4611080 - DNA, 12 bp, Homo sapiens
atattcagaaat

SEQ ID NO: 4611081 - DNA, 19 bp, Homo sapiens
atattccttttaaagaagc

SEQ ID NO: 4611082 - DNA, 21 bp, Homo sapiens
atattccttttaaagaagctt

SEQ ID NO: 4611083 - DNA, 21 bp, Homo sapiens
atattcttattggaaatgtac

SEQ ID NO: 4611084 - DNA, 22 bp, Homo sapiens
atattctttacaaactgaagat

SEQ ID NO: 4611085 - DNA, 14 bp, Homo sapiens
atattgatcaaata

SEQ ID NO: 4611086 - DNA, 22 bp, Homo sapiens
atattggaagctgctgaggccc

SEQ ID NO: 4611087 - DNA, 16 bp, Homo sapiens
atattgtaatatgaca

SEQ ID NO: 4611088 - DNA, 19 bp, Homo sapiens
atatttagcaaataatttc

SEQ ID NO: 4611089 - DNA, 14 bp, Homo sapiens
atatttagctgtaa

SEQ ID NO: 4611090 - DNA, 14 bp, Homo sapiens
atatttaggaaaat

SEQ ID NO: 4611091 - DNA, 21 bp, Homo sapiens
atatttaggaaaatgcttatt

SEQ ID NO: 4611092 - DNA, 19 bp, Homo sapiens
atatttattgttagaaaat

SEQ ID NO: 4611093 - DNA, 19 bp, Homo sapiens
atatttcaagctcatgtca

SEQ ID NO: 4611094 - DNA, 14 bp, Homo sapiens
atatttgatttcta

SEQ ID NO: 4611095 - DNA, 13 bp, Homo sapiens
atatttgcttttt

SEQ ID NO: 4611096 - DNA, 21 bp, Homo sapiens
atattttaatcattatttgag

SEQ ID NO: 4611097 - DNA, 14 bp, Homo sapiens
atattttctatttt

SEQ ID NO: 4611098 - DNA, 13 bp, Homo sapiens
atattttctctgt

SEQ ID NO: 4611099 - DNA, 21 bp, Homo sapiens
atattttgtatattatgttta

SEQ ID NO: 4611100 - DNA, 19 bp, Homo sapiens
atattttgttaacttttgt

SEQ ID NO: 4611101 - DNA, 14 bp, Homo sapiens
atattttgttctta

SEQ ID NO: 4611102 - DNA, 19 bp, Homo sapiens
atatttttaaaaaatgaaa

SEQ ID NO: 4611103 - DNA, 20 bp, Homo sapiens
atattttttggtgtgccctg

SEQ ID NO: 4611104 - DNA, 20 bp, Homo sapiens
atcaaaaggaggaatttcag

SEQ ID NO: 4611105 - DNA, 13 bp, Homo sapiens
atcaaagccaggg

SEQ ID NO: 4611106 - DNA, 20 bp, Homo sapiens
atcaaaggaatataagaaaa

SEQ ID NO: 4611107 - DNA, 21 bp, Homo sapiens
atcaacctattaaaatacatt

SEQ ID NO: 4611108 - DNA, 14 bp, Homo sapiens
atcaagagaaactt

SEQ ID NO: 4611109 - DNA, 16 bp, Homo sapiens
atcaagggcactgtga

SEQ ID NO: 4611110 - DNA, 21 bp, Homo sapiens
atcacatttttttatgctctt

SEQ ID NO: 4611111 - DNA, 21 bp, Homo sapiens
atcacgtaaagctagaaatga

SEQ ID NO: 4611112 - DNA, 13 bp, Homo sapiens
atcactaaacttt

SEQ ID NO: 4611113 - DNA, 14 bp, Homo sapiens
atcactaaacttta

SEQ ID NO: 4611114 - DNA, 21 bp, Homo sapiens
atcactctgtgtctgagtggc

SEQ ID NO: 4611115 - DNA, 19 bp, Homo sapiens
atcactgcattatcttgct

SEQ ID NO: 4611116 - DNA, 23 bp, Homo sapiens
atcagaaaagtaattttgtcaca

SEQ ID NO: 4611117 - DNA, 17 bp, Homo sapiens
atcagaaagggagggct

SEQ ID NO: 4611118 - DNA, 19 bp, Homo sapiens
atcagaaagggagggctct

SEQ ID NO: 4611119 - DNA, 20 bp, Homo sapiens
atcagaaagggagggctctg

SEQ ID NO: 4611120 - DNA, 23 bp, Homo sapiens
atcagaaagggagggctctgagg

SEQ ID NO: 4611121 - DNA, 22 bp, Homo sapiens
atcagaaatcctctgttaatgt

SEQ ID NO: 4611122 - DNA, 22 bp, Homo sapiens
atcagaacattcagctctggag

SEQ ID NO: 4611123 - DNA, 16 bp, Homo sapiens
atcagactcagttttt

SEQ ID NO: 4611124 - DNA, 17 bp, Homo sapiens
atcagagcgcacaggga

SEQ ID NO: 4611125 - DNA, 23 bp, Homo sapiens
atcagaggcatttgagcagctga

SEQ ID NO: 4611126 - DNA, 13 bp, Homo sapiens
atcagcatgcctg

SEQ ID NO: 4611127 - DNA, 10 bp, Homo sapiens
atcagccctg

SEQ ID NO: 4611128 - DNA, 23 bp, Homo sapiens
atcagccctgcccttcagcatcc

SEQ ID NO: 4611129 - DNA, 15 bp, Homo sapiens
atcagctaccattca

SEQ ID NO: 4611130 - DNA, 13 bp, Homo sapiens
atcaggcaaggag

SEQ ID NO: 4611131 - DNA, 17 bp, Homo sapiens
atcaggcaaggaggagg

SEQ ID NO: 4611132 - DNA, 11 bp, Homo sapiens
atcaggcccca

SEQ ID NO: 4611133 - DNA, 15 bp, Homo sapiens
atcaggccccacccc

SEQ ID NO: 4611134 - DNA, 20 bp, Homo sapiens
atcaggctagccctgccctc

SEQ ID NO: 4611135 - DNA, 14 bp, Homo sapiens
atcagggcctgccc

SEQ ID NO: 4611136 - DNA, 19 bp, Homo sapiens
atcagggcctgccccctgg

SEQ ID NO: 4611137 - DNA, 20 bp, Homo sapiens
atcagggcctgccccctggg

SEQ ID NO: 4611138 - DNA, 21 bp, Homo sapiens
atcagggcctgccccctgggg

SEQ ID NO: 4611139 - DNA, 14 bp, Homo sapiens
atcagggcctgggg

SEQ ID NO: 4611140 - DNA, 15 bp, Homo sapiens
atcagggcctggggc

SEQ ID NO: 4611141 - DNA, 21 bp, Homo sapiens
atcagggcctggggcctgaga

SEQ ID NO: 4611142 - DNA, 22 bp, Homo sapiens
atcagggcctggggcctgagag

SEQ ID NO: 4611143 - DNA, 12 bp, Homo sapiens
atcagtaaatag

SEQ ID NO: 4611144 - DNA, 22 bp, Homo sapiens
atcagtaaatagtgtcatataa

SEQ ID NO: 4611145 - DNA, 14 bp, Homo sapiens
atcagtaggctaat

SEQ ID NO: 4611146 - DNA, 11 bp, Homo sapiens
atcataaatct

SEQ ID NO: 4611147 - DNA, 15 bp, Homo sapiens
atcatacttaacatt

SEQ ID NO: 4611148 - DNA, 18 bp, Homo sapiens
atcatacttaacatttca

SEQ ID NO: 4611149 - DNA, 15 bp, Homo sapiens
atcatctttgtgaag

SEQ ID NO: 4611150 - DNA, 13 bp, Homo sapiens
atcatgagccttc

SEQ ID NO: 4611151 - DNA, 12 bp, Homo sapiens
atcatgccctgt

SEQ ID NO: 4611152 - DNA, 15 bp, Homo sapiens
atcatgcctctgagg

SEQ ID NO: 4611153 - DNA, 17 bp, Homo sapiens
atcatgcctctgaggcc

SEQ ID NO: 4611154 - DNA, 13 bp, Homo sapiens
atcatgtctgtat

SEQ ID NO: 4611155 - DNA, 22 bp, Homo sapiens
atcatgtctgtatccccagtgc

SEQ ID NO: 4611156 - DNA, 15 bp, Homo sapiens
atcattgaagtatat

SEQ ID NO: 4611157 - DNA, 19 bp, Homo sapiens
atcattgaagtatattctt

SEQ ID NO: 4611158 - DNA, 18 bp, Homo sapiens
atcattgccatcaccatt

SEQ ID NO: 4611159 - DNA, 15 bp, Homo sapiens
atcattgctcccctg

SEQ ID NO: 4611160 - DNA, 16 bp, Homo sapiens
atcattgctcccctga

SEQ ID NO: 4611161 - DNA, 17 bp, Homo sapiens
atcattgctcccctgat

SEQ ID NO: 4611162 - DNA, 16 bp, Homo sapiens
atacattaaaataact

SEQ ID NO: 4611163 - DNA, 12 bp, Homo sapiens
atacatttgtaa

SEQ ID NO: 4611164 - DNA, 16 bp, Homo sapiens
atacattttctaaata

SEQ ID NO: 4611165 - DNA, 17 bp, Homo sapiens
atacattttctaaataa

SEQ ID NO: 4611166 - DNA, 22 bp, Homo sapiens
atacattttttaggacatctta

SEQ ID NO: 4611167 - DNA, 23 bp, Homo sapiens
atacccaggaagactttgtgact

SEQ ID NO: 4611168 - DNA, 15 bp, Homo sapiens
atacccatgaactta

SEQ ID NO: 4611169 - DNA, 16 bp, Homo sapiens
ataccccatatattac

SEQ ID NO: 4611170 - DNA, 16 bp, Homo sapiens
atacctctgtgtgctc

SEQ ID NO: 4611171 - DNA, 17 bp, Homo sapiens
atacctgctatcagcag

SEQ ID NO: 4611172 - DNA, 17 bp, Homo sapiens
ataccttctcccaggcc

SEQ ID NO: 4611173 - DNA, 18 bp, Homo sapiens
ataccttctcccaggcct

SEQ ID NO: 4611174 - DNA, 12 bp, Homo sapiens
atacctttaaat

SEQ ID NO: 4611175 - DNA, 22 bp, Homo sapiens
atacgagaaaatctgcatgttt

SEQ ID NO: 4611176 - DNA, 22 bp, Homo sapiens
atactaatagagtacttaatat

SEQ ID NO: 4611177 - DNA, 15 bp, Homo sapiens
atactcaagctgtct

SEQ ID NO: 4611178 - DNA, 12 bp, Homo sapiens
atactctgttgc

SEQ ID NO: 4611179 - DNA, 13 bp, Homo sapiens
atactctgttgcc

SEQ ID NO: 4611180 - DNA, 14 bp, Homo sapiens
atactctgttgcct

SEQ ID NO: 4611181 - DNA, 20 bp, Homo sapiens
atactctgttgcctcctctc

SEQ ID NO: 4611182 - DNA, 22 bp, Homo sapiens
atactctgttgcctcctctctc

SEQ ID NO: 4611183 - DNA, 17 bp, Homo sapiens
atactgaaaatccaata

SEQ ID NO: 4611184 - DNA, 15 bp, Homo sapiens
atactgacagaagtt

SEQ ID NO: 4611185 - DNA, 12 bp, Homo sapiens
atactgagaatc

SEQ ID NO: 4611186 - DNA, 19 bp, Homo sapiens
atactgctgcttgtcaaat

SEQ ID NO: 4611187 - DNA, 15 bp, Homo sapiens
atactggcacagagg

SEQ ID NO: 4611188 - DNA, 12 bp, Homo sapiens
atactggcatgc

SEQ ID NO: 4611189 - DNA, 16 bp, Homo sapiens
atactggcatgctaaa

SEQ ID NO: 4611190 - DNA, 15 bp, Homo sapiens
atactgtacatgaaa

SEQ ID NO: 4611191 - DNA, 17 bp, Homo sapiens
atacttcaaaactgttt

SEQ ID NO: 4611192 - DNA, 20 bp, Homo sapiens
atacttgagattttcctcca

SEQ ID NO: 4611193 - DNA, 12 bp, Homo sapiens
atacttgtgaaa

SEQ ID NO: 4611194 - DNA, 19 bp, Homo sapiens
atagaaagttgatattcaa

SEQ ID NO: 4611195 - DNA, 19 bp, Homo sapiens
atagaacacaaaacttgaa

SEQ ID NO: 4611196 - DNA, 18 bp, Homo sapiens
atagaataaaatataatt

SEQ ID NO: 4611197 - DNA, 14 bp, Homo sapiens
atagaataattctt

SEQ ID NO: 4611198 - DNA, 19 bp, Homo sapiens
atagaataattcttttctg

SEQ ID NO: 4611199 - DNA, 15 bp, Homo sapiens
atagacattctcaca

SEQ ID NO: 4611200 - DNA, 16 bp, Homo sapiens
atagacattctcacat

SEQ ID NO: 4611201 - DNA, 22 bp, Homo sapiens
atagaccactgggtttggcaaa

SEQ ID NO: 4611202 - DNA, 18 bp, Homo sapiens
atagagcaaaatcaacat

SEQ ID NO: 4611203 - DNA, 22 bp, Homo sapiens
atagagcaaaatcaacatgact

SEQ ID NO: 4611204 - DNA, 22 bp, Homo sapiens
atagaggaaattcaaatccctt

SEQ ID NO: 4611205 - DNA, 23 bp, Homo sapiens
atagaggatagggagaatattta

SEQ ID NO: 4611206 - DNA, 21 bp, Homo sapiens
atagagggccacggggaggcc

SEQ ID NO: 4611207 - DNA, 23 bp, Homo sapiens
atagatcctggttaccactcttt

SEQ ID NO: 4611208 - DNA, 16 bp, Homo sapiens
atagattaggtttgcg

SEQ ID NO: 4611209 - DNA, 16 bp, Homo sapiens
atagcaactaatgttt

SEQ ID NO: 4611210 - DNA, 17 bp, Homo sapiens
atagcaactaatgtttg

SEQ ID NO: 4611211 - DNA, 20 bp, Homo sapiens
atagcaagatattgatcaaa

SEQ ID NO: 4611212 - DNA, 21 bp, Homo sapiens
atagcaagatattgatcaaat

SEQ ID NO: 4611213 - DNA, 22 bp, Homo sapiens
atagcaagatattgatcaaata

SEQ ID NO: 4611214 - DNA, 11 bp, Homo sapiens
atagcaataac

SEQ ID NO: 4611215 - DNA, 13 bp, Homo sapiens
atagcaataactg

SEQ ID NO: 4611216 - DNA, 15 bp, Homo sapiens
atagcaataactgaa

SEQ ID NO: 4611217 - DNA, 20 bp, Homo sapiens
atagcataaaatgaaatgct

SEQ ID NO: 4611218 - DNA, 22 bp, Homo sapiens
atagccaactgctaatgcaaat

SEQ ID NO: 4611219 - DNA, 16 bp, Homo sapiens
atagctaactgtaaat

SEQ ID NO: 4611220 - DNA, 17 bp, Homo sapiens
atagctaataatgttaa

SEQ ID NO: 4611221 - DNA, 18 bp, Homo sapiens
atagctgaaaagggcact

SEQ ID NO: 4611222 - DNA, 15 bp, Homo sapiens
ataggaacagcccag

SEQ ID NO: 4611223 - DNA, 16 bp, Homo sapiens
ataggaacagcccagc

SEQ ID NO: 4611224 - DNA, 17 bp, Homo sapiens
ataggaagacgcagagc

SEQ ID NO: 4611225 - DNA, 13 bp, Homo sapiens
ataggaaggaaac

SEQ ID NO: 4611226 - DNA, 15 bp, Homo sapiens
ataggctaaatgttg

SEQ ID NO: 4611227 - DNA, 17 bp, Homo sapiens
ataggtctgtatggctg

SEQ ID NO: 4611228 - DNA, 17 bp, Homo sapiens
atagtagttaaataact

SEQ ID NO: 4611229 - DNA, 22 bp, Homo sapiens
atagtatctgtatataagttgc

SEQ ID NO: 4611230 - DNA, 15 bp, Homo sapiens
atagtctgggtcaga

SEQ ID NO: 4611231 - DNA, 21 bp, Homo sapiens
atagtgtcatataaactcatt

SEQ ID NO: 4611232 - DNA, 18 bp, Homo sapiens
atagttattttaatacct

SEQ ID NO: 4611233 - DNA, 22 bp, Homo sapiens
atagttattttaatacctttaa

SEQ ID NO: 4611234 - DNA, 19 bp, Homo sapiens
atagttcttagctttgaaa

SEQ ID NO: 4611235 - DNA, 20 bp, Homo sapiens
atagttgagattgtactgtt

SEQ ID NO: 4611236 - DNA, 15 bp, Homo sapiens
atagttgcagcccaa

SEQ ID NO: 4611237 - DNA, 15 bp, Homo sapiens
atataaactgtgcca

SEQ ID NO: 4611238 - DNA, 18 bp, Homo sapiens
atataaagcttaataaaa

SEQ ID NO: 4611239 - DNA, 20 bp, Homo sapiens
atataaagggggagggaaat

SEQ ID NO: 4611240 - DNA, 21 bp, Homo sapiens
atataaagggggagggaaata

SEQ ID NO: 4611241 - DNA, 19 bp, Homo sapiens
atataaattgtacattttg

SEQ ID NO: 4611242 - DNA, 17 bp, Homo sapiens
atataaattttttttgt

SEQ ID NO: 4611243 - DNA, 21 bp, Homo sapiens
atataagaaaagtaatgaaga

SEQ ID NO: 4611244 - DNA, 15 bp, Homo sapiens
atataatgttgataa

SEQ ID NO: 4611245 - DNA, 20 bp, Homo sapiens
atataatgttgataatatat

SEQ ID NO: 4611246 - DNA, 13 bp, Homo sapiens
atatacagaggaa

SEQ ID NO: 4611247 - DNA, 17 bp, Homo sapiens
atatacattttctaaat

SEQ ID NO: 4611248 - DNA, 23 bp, Homo sapiens
atatacattttctaaataaaaat

SEQ ID NO: 4611249 - DNA, 15 bp, Homo sapiens
atatagaatgctgca

SEQ ID NO: 4611250 - DNA, 12 bp, Homo sapiens
atatagactgta

SEQ ID NO: 4611251 - DNA, 23 bp, Homo sapiens
atatagccattgatcataaactg

SEQ ID NO: 4611252 - DNA, 13 bp, Homo sapiens
atatatacatttt

SEQ ID NO: 4611253 - DNA, 15 bp, Homo sapiens
atatatacatttttt

SEQ ID NO: 4611254 - DNA, 17 bp, Homo sapiens
atatatgtgtatacata

SEQ ID NO: 4611255 - DNA, 20 bp, Homo sapiens
atatatgtgtatacatacat

SEQ ID NO: 4611256 - DNA, 19 bp, Homo sapiens
atatattaccccttcatgt

SEQ ID NO: 4611257 - DNA, 12 bp, Homo sapiens
atatatttctat

SEQ ID NO: 4611258 - DNA, 17 bp, Homo sapiens
atatatttctattatta

SEQ ID NO: 4611259 - DNA, 21 bp, Homo sapiens
atatcaaataaaatatcataa

SEQ ID NO: 4611260 - DNA, 14 bp, Homo sapiens
atatcactaaataa

SEQ ID NO: 4611261 - DNA, 13 bp, Homo sapiens
atatcatgcaaaa

SEQ ID NO: 4611262 - DNA, 20 bp, Homo sapiens
atatcatgcaaaatatgttt

SEQ ID NO: 4611263 - DNA, 13 bp, Homo sapiens
atatcatgtaaag

SEQ ID NO: 4611264 - DNA, 22 bp, Homo sapiens
atatcatgtaaagaaatgtctt

SEQ ID NO: 4611265 - DNA, 13 bp, Homo sapiens
atatcattctttg

SEQ ID NO: 4611266 - DNA, 20 bp, Homo sapiens
atatcattctttgtatctta

SEQ ID NO: 4611267 - DNA, 17 bp, Homo sapiens
atatcattgattttata

SEQ ID NO: 4611268 - DNA, 12 bp, Homo sapiens
atatcattttaa

SEQ ID NO: 4611269 - DNA, 17 bp, Homo sapiens
atatcattttaaaaact

SEQ ID NO: 4611270 - DNA, 19 bp, Homo sapiens
atatcattttaaaaacttt

SEQ ID NO: 4611271 - DNA, 17 bp, Homo sapiens
atatcattttattcaca

SEQ ID NO: 4611272 - DNA, 13 bp, Homo sapiens
atatctttcagtt

SEQ ID NO: 4611273 - DNA, 13 bp, Homo sapiens
atctgtggaaagc

SEQ ID NO: 4611274 - DNA, 10 bp, Homo sapiens
atctgtgttc

SEQ ID NO: 4611275 - DNA, 12 bp, Homo sapiens
atctgtgttcta

SEQ ID NO: 4611276 - DNA, 16 bp, Homo sapiens
atctgtgtttttgaaa

SEQ ID NO: 4611277 - DNA, 17 bp, Homo sapiens
atctgtttaaagcatat

SEQ ID NO: 4611278 - DNA, 22 bp, Homo sapiens
atctgtttaaagcatatagaga

SEQ ID NO: 4611279 - DNA, 24 bp, Homo sapiens
atctgtttaaagcatatagagatg

SEQ ID NO: 4611280 - DNA, 13 bp, Homo sapiens
atcttaaaggaca

SEQ ID NO: 4611281 - DNA, 15 bp, Homo sapiens
atcttaaatctgtga

SEQ ID NO: 4611282 - DNA, 15 bp, Homo sapiens
atcttaatctttatt

SEQ ID NO: 4611283 - DNA, 20 bp, Homo sapiens
atcttaatctttattttatt

SEQ ID NO: 4611284 - DNA, 15 bp, Homo sapiens
atcttaatttattat

SEQ ID NO: 4611285 - DNA, 18 bp, Homo sapiens
atcttacttgtcctttga

SEQ ID NO: 4611286 - DNA, 12 bp, Homo sapiens
atcttatacaac

SEQ ID NO: 4611287 - DNA, 21 bp, Homo sapiens
atcttctctcttgattgattt

SEQ ID NO: 4611288 - DNA, 20 bp, Homo sapiens
atcttctggagaaaaaggtg

SEQ ID NO: 4611289 - DNA, 19 bp, Homo sapiens
atcttgaatgtggtctcag

SEQ ID NO: 4611290 - DNA, 14 bp, Homo sapiens
atcttgctttcttt

SEQ ID NO: 4611291 - DNA, 19 bp, Homo sapiens
atcttgctttctttagaat

SEQ ID NO: 4611292 - DNA, 21 bp, Homo sapiens
atcttggcctaaacctcagtt

SEQ ID NO: 4611293 - DNA, 23 bp, Homo sapiens
atcttgggaacagggttactgta

SEQ ID NO: 4611294 - DNA, 17 bp, Homo sapiens
atcttggggacatctct

SEQ ID NO: 4611295 - DNA, 21 bp, Homo sapiens
atcttgttattattgttaata

SEQ ID NO: 4611296 - DNA, 21 bp, Homo sapiens
atctttaaaaaaaaatcttgt

SEQ ID NO: 4611297 - DNA, 18 bp, Homo sapiens
atctttattttattattc

SEQ ID NO: 4611298 - DNA, 20 bp, Homo sapiens
atctttattttattattcag

SEQ ID NO: 4611299 - DNA, 14 bp, Homo sapiens
atctttcagttatt

SEQ ID NO: 4611300 - DNA, 20 bp, Homo sapiens
atctttcattaaaggcttct

SEQ ID NO: 4611301 - DNA, 12 bp, Homo sapiens
atctttgtgaag

SEQ ID NO: 4611302 - DNA, 15 bp, Homo sapiens
atcttttacattttt

SEQ ID NO: 4611303 - DNA, 17 bp, Homo sapiens
atcttttgaattcttga

SEQ ID NO: 4611304 - DNA, 16 bp, Homo sapiens
atcttttttagcataa

SEQ ID NO: 4611305 - DNA, 18 bp, Homo sapiens
atcttttttagcataaaa

SEQ ID NO: 4611306 - DNA, 20 bp, Homo sapiens
atgaaaactcatgatcaaga

SEQ ID NO: 4611307 - DNA, 14 bp, Homo sapiens
atgaaaataaaaca

SEQ ID NO: 4611308 - DNA, 20 bp, Homo sapiens
atgaaaataaaacacacctc

SEQ ID NO: 4611309 - DNA, 15 bp, Homo sapiens
atgaaagtgttaatt

SEQ ID NO: 4611310 - DNA, 21 bp, Homo sapiens
atgaaagtgttaattttacct

SEQ ID NO: 4611311 - DNA, 24 bp, Homo sapiens
atgaaataaattctgacttatgaa

SEQ ID NO: 4611312 - DNA, 14 bp, Homo sapiens
atgaacacagacaa

SEQ ID NO: 4611313 - DNA, 11 bp, Homo sapiens
atgaaccctgc

SEQ ID NO: 4611314 - DNA, 19 bp, Homo sapiens
atgaaccctgccctgctct

SEQ ID NO: 4611315 - DNA, 18 bp, Homo sapiens
atgaagaaagtcaaaaaa

SEQ ID NO: 4611316 - DNA, 16 bp, Homo sapiens
atgaagaagacacctc

SEQ ID NO: 4611317 - DNA, 21 bp, Homo sapiens
atgaagaatacccaggaagac

SEQ ID NO: 4611318 - DNA, 15 bp, Homo sapiens
atgaagaatcacgat

SEQ ID NO: 4611319 - DNA, 22 bp, Homo sapiens
atgaagtttgtagttgttttaa

SEQ ID NO: 4611320 - DNA, 18 bp, Homo sapiens
atgaataacatttaaatt

SEQ ID NO: 4611321 - DNA, 22 bp, Homo sapiens
atgaatatcattgattttataa

SEQ ID NO: 4611322 - DNA, 18 bp, Homo sapiens
atgaatgcccccagctgg

SEQ ID NO: 4611323 - DNA, 21 bp, Homo sapiens
atgaatgcccccagctggccc

SEQ ID NO: 4611324 - DNA, 14 bp, Homo sapiens
atgaattcatactc

SEQ ID NO: 4611325 - DNA, 17 bp, Homo sapiens
atgacaaaaaatgtttt

SEQ ID NO: 4611326 - DNA, 23 bp, Homo sapiens
atgacaaaatcatctttgtgaag

SEQ ID NO: 4611327 - DNA, 15 bp, Homo sapiens
atgacaaacatgata

SEQ ID NO: 4611328 - DNA, 21 bp, Homo sapiens
atgacaaacatgatactgctg

SEQ ID NO: 4611329 - DNA, 13 bp, Homo sapiens
atgacaccctggc

SEQ ID NO: 4611330 - DNA, 16 bp, Homo sapiens
atgacaccctggcctg

SEQ ID NO: 4611331 - DNA, 16 bp, Homo sapiens
atgacagataacctaa

SEQ ID NO: 4611332 - DNA, 17 bp, Homo sapiens
atgacagataacctaat

SEQ ID NO: 4611333 - DNA, 19 bp, Homo sapiens
atgacagatggtgaagtaa

SEQ ID NO: 4611334 - DNA, 20 bp, Homo sapiens
atgacataaccaatttgtaa

SEQ ID NO: 4611335 - DNA, 15 bp, Homo sapiens
atgacattatgtgga

SEQ ID NO: 4611336 - DNA, 21 bp, Homo sapiens
atgacatttcttaaaacttta

SEQ ID NO: 4611337 - DNA, 14 bp, Homo sapiens
atgaccagggatgc

SEQ ID NO: 4611338 - DNA, 23 bp, Homo sapiens
atgaccagggatgctgggctggg

SEQ ID NO: 4611339 - DNA, 20 bp, Homo sapiens
atgaccattgagtccctgct

SEQ ID NO: 4611340 - DNA, 20 bp, Homo sapiens
atgacccctggccacagcct

SEQ ID NO: 4611341 - DNA, 21 bp, Homo sapiens
atgacccctggccacagcctt

SEQ ID NO: 4611342 - DNA, 13 bp, Homo sapiens
atgacctccagct

SEQ ID NO: 4611343 - DNA, 21 bp, Homo sapiens
atgacctccagctttcctgta

SEQ ID NO: 4611344 - DNA, 21 bp, Homo sapiens
atgacgccagataaaatgttc

SEQ ID NO: 4611345 - DNA, 20 bp, Homo sapiens
atgactgtcgccacacgcct

SEQ ID NO: 4611346 - DNA, 19 bp, Homo sapiens
atgacttatttctgctctg

SEQ ID NO: 4611347 - DNA, 15 bp, Homo sapiens
atgactttttataaa

SEQ ID NO: 4611348 - DNA, 16 bp, Homo sapiens
atgagaaacagctcag

SEQ ID NO: 4611349 - DNA, 14 bp, Homo sapiens
atgagacacaggat

SEQ ID NO: 4611350 - DNA, 18 bp, Homo sapiens
atgagactgccctgccca

SEQ ID NO: 4611351 - DNA, 15 bp, Homo sapiens
atgagagcgacacag

SEQ ID NO: 4611352 - DNA, 16 bp, Homo sapiens
atgagagcgacacaga

SEQ ID NO: 4611353 - DNA, 15 bp, Homo sapiens
atgagatcagggcct

SEQ ID NO: 4611354 - DNA, 17 bp, Homo sapiens
atgagatctgaatgtgg

SEQ ID NO: 4611355 - DNA, 12 bp, Homo sapiens
atgagcccagag

SEQ ID NO: 4611356 - DNA, 19 bp, Homo sapiens
atgagcctacgctgaagat

SEQ ID NO: 4611357 - DNA, 23 bp, Homo sapiens
atgagcctgggctcatagtgaga

SEQ ID NO: 4611358 - DNA, 20 bp, Homo sapiens
atgagctcctgatcagaggc

SEQ ID NO: 4611359 - DNA, 12 bp, Homo sapiens
atgagctgatca

SEQ ID NO: 4611360 - DNA, 18 bp, Homo sapiens
atgagctgtgcacaaagt

SEQ ID NO: 4611361 - DNA, 23 bp, Homo sapiens
atgaggccactgctgcttctcca

SEQ ID NO: 4611362 - DNA, 14 bp, Homo sapiens
atgagggcagcagc

SEQ ID NO: 4611363 - DNA, 20 bp, Homo sapiens
atgagggcagcagccagccc

SEQ ID NO: 4611364 - DNA, 20 bp, Homo sapiens
atgaggtagctatagttgca

SEQ ID NO: 4611365 - DNA, 18 bp, Homo sapiens
atgaggtcaccaggggag

SEQ ID NO: 4611366 - DNA, 14 bp, Homo sapiens
atgagtacaaatgc

SEQ ID NO: 4611367 - DNA, 18 bp, Homo sapiens
atgagtctgtttcccaag

SEQ ID NO: 4611368 - DNA, 16 bp, Homo sapiens
atgagtgaagtattgc

SEQ ID NO: 4611369 - DNA, 17 bp, Homo sapiens
atgagtggctttaatga

SEQ ID NO: 4611370 - DNA, 12 bp, Homo sapiens
atgagtgtgcat

SEQ ID NO: 4611371 - DNA, 13 bp, Homo sapiens
atgagtgtgcatg

SEQ ID NO: 4611372 - DNA, 14 bp, Homo sapiens
atgataaaagagaa

SEQ ID NO: 4611373 - DNA, 13 bp, Homo sapiens
atgatacattttt

SEQ ID NO: 4611374 - DNA, 13 bp, Homo sapiens
atgatcaagatat

SEQ ID NO: 4611375 - DNA, 17 bp, Homo sapiens
atgatcaagatatatgt

SEQ ID NO: 4611376 - DNA, 17 bp, Homo sapiens
atgatccttttttgtca

SEQ ID NO: 4611377 - DNA, 19 bp, Homo sapiens
atgatccttttttgtcatt

SEQ ID NO: 4611378 - DNA, 23 bp, Homo sapiens
atgatccttttttgtcattttat

SEQ ID NO: 4611379 - DNA, 18 bp, Homo sapiens
atgatcgctgtattttga

SEQ ID NO: 4611380 - DNA, 22 bp, Homo sapiens
atgatcgctgtattttgagttt

SEQ ID NO: 4611381 - DNA, 18 bp, Homo sapiens
atgatctctctagctttg

SEQ ID NO: 4611382 - DNA, 15 bp, Homo sapiens
atgatggatggcaga

SEQ ID NO: 4611383 - DNA, 17 bp, Homo sapiens
atgatggatggcagact

SEQ ID NO: 4611384 - DNA, 18 bp, Homo sapiens
caagatgagcctgggctc

SEQ ID NO: 4611385 - DNA, 21 bp, Homo sapiens
caagatggtgttatcttttga

SEQ ID NO: 4611386 - DNA, 21 bp, Homo sapiens
caagatttccttaaaatctct

SEQ ID NO: 4611387 - DNA, 18 bp, Homo sapiens
caagcaacacagaggaat

SEQ ID NO: 4611388 - DNA, 16 bp, Homo sapiens
caagcaggccgccctc

SEQ ID NO: 4611389 - DNA, 12 bp, Homo sapiens
caagcatttcat

SEQ ID NO: 4611390 - DNA, 13 bp, Homo sapiens
caagcatttcatg

SEQ ID NO: 4611391 - DNA, 18 bp, Homo sapiens
caagccaaaatgggagca

SEQ ID NO: 4611392 - DNA, 19 bp, Homo sapiens
caagccagattctcttgaa

SEQ ID NO: 4611393 - DNA, 17 bp, Homo sapiens
caagccatgtataaatg

SEQ ID NO: 4611394 - DNA, 15 bp, Homo sapiens
caagccccctgccct

SEQ ID NO: 4611395 - DNA, 14 bp, Homo sapiens
caagccctcagctg

SEQ ID NO: 4611396 - DNA, 13 bp, Homo sapiens
caagccctgccca

SEQ ID NO: 4611397 - DNA, 17 bp, Homo sapiens
caagccctgcccacaga

SEQ ID NO: 4611398 - DNA, 20 bp, Homo sapiens
caagccggtgggctagaaag

SEQ ID NO: 4611399 - DNA, 12 bp, Homo sapiens
caagcctgcctc

SEQ ID NO: 4611400 - DNA, 18 bp, Homo sapiens
caagcgattctcctgcct

SEQ ID NO: 4611401 - DNA, 16 bp, Homo sapiens
caagctagactgtgtc

SEQ ID NO: 4611402 - DNA, 15 bp, Homo sapiens
caagctaggccccag

SEQ ID NO: 4611403 - DNA, 17 bp, Homo sapiens
caagctaggccccagag

SEQ ID NO: 4611404 - DNA, 19 bp, Homo sapiens
caagctaggccccagaggc

SEQ ID NO: 4611405 - DNA, 21 bp, Homo sapiens
caagctcagaggcgcactgtg

SEQ ID NO: 4611406 - DNA, 14 bp, Homo sapiens
caagctcatgtcat

SEQ ID NO: 4611407 - DNA, 15 bp, Homo sapiens
caagctcatgtcatt

SEQ ID NO: 4611408 - DNA, 16 bp, Homo sapiens
caagctcttcccttgc

SEQ ID NO: 4611409 - DNA, 21 bp, Homo sapiens
caagctcttcccttgctcatg

SEQ ID NO: 4611410 - DNA, 14 bp, Homo sapiens
caagctgagctggc

SEQ ID NO: 4611411 - DNA, 16 bp, Homo sapiens
caagctgagctggctt

SEQ ID NO: 4611412 - DNA, 20 bp, Homo sapiens
caagctgaggtgcccaggag

SEQ ID NO: 4611413 - DNA, 17 bp, Homo sapiens
caagctgcactgtgaac

SEQ ID NO: 4611414 - DNA, 12 bp, Homo sapiens
caagctggccaa

SEQ ID NO: 4611415 - DNA, 21 bp, Homo sapiens
caagctggccaaagtcacttc

SEQ ID NO: 4611416 - DNA, 17 bp, Homo sapiens
caagctgtccctgcagg

SEQ ID NO: 4611417 - DNA, 19 bp, Homo sapiens
caagctgtccctgcagggc

SEQ ID NO: 4611418 - DNA, 15 bp, Homo sapiens
caagctttgctcctt

SEQ ID NO: 4611419 - DNA, 21 bp, Homo sapiens
caagctttgctccttcagttc

SEQ ID NO: 4611420 - DNA, 15 bp, Homo sapiens
caaggaaacatttta

SEQ ID NO: 4611421 - DNA, 12 bp, Homo sapiens
caaggaagcaga

SEQ ID NO: 4611422 - DNA, 21 bp, Homo sapiens
caaggacagttcagagatcag

SEQ ID NO: 4611423 - DNA, 12 bp, Homo sapiens
caaggacccagc

SEQ ID NO: 4611424 - DNA, 16 bp, Homo sapiens
caaggacccagccctc

SEQ ID NO: 4611425 - DNA, 17 bp, Homo sapiens
caaggacccagccctcg

SEQ ID NO: 4611426 - DNA, 18 bp, Homo sapiens
caaggacccagccctcgc

SEQ ID NO: 4611427 - DNA, 14 bp, Homo sapiens
caaggactgagggc

SEQ ID NO: 4611428 - DNA, 17 bp, Homo sapiens
caaggactgagggcagt

SEQ ID NO: 4611429 - DNA, 15 bp, Homo sapiens
caaggaggaggagtc

SEQ ID NO: 4611430 - DNA, 18 bp, Homo sapiens
caaggagggggcctcatt

SEQ ID NO: 4611431 - DNA, 15 bp, Homo sapiens
caaggcagcaaggcc

SEQ ID NO: 4611432 - DNA, 20 bp, Homo sapiens
caaggcagcctgaacactca

SEQ ID NO: 4611433 - DNA, 21 bp, Homo sapiens
caaggcccgagcagctgagca

SEQ ID NO: 4611434 - DNA, 12 bp, Homo sapiens
caaggccctgca

SEQ ID NO: 4611435 - DNA, 15 bp, Homo sapiens
caaggccctgcatct

SEQ ID NO: 4611436 - DNA, 15 bp, Homo sapiens
caaggcctggtctgg

SEQ ID NO: 4611437 - DNA, 12 bp, Homo sapiens
caaggccttcag

SEQ ID NO: 4611438 - DNA, 14 bp, Homo sapiens
caaggctgttgcat

SEQ ID NO: 4611439 - DNA, 21 bp, Homo sapiens
caagggacaggagaagagagg

SEQ ID NO: 4611440 - DNA, 15 bp, Homo sapiens
caagggccctggcac

SEQ ID NO: 4611441 - DNA, 22 bp, Homo sapiens
caaggtaactgtactgggccat

SEQ ID NO: 4611442 - DNA, 20 bp, Homo sapiens
caaggtcctctgtcagtcac

SEQ ID NO: 4611443 - DNA, 20 bp, Homo sapiens
caaggtgccaccaccctgcc

SEQ ID NO: 4611444 - DNA, 21 bp, Homo sapiens
caagtaatggaggtcccagcc

SEQ ID NO: 4611445 - DNA, 22 bp, Homo sapiens
caagtaatggaggtcccagccc

SEQ ID NO: 4611446 - DNA, 15 bp, Homo sapiens
caagtatataattta

SEQ ID NO: 4611447 - DNA, 15 bp, Homo sapiens
caagtccaataagac

SEQ ID NO: 4611448 - DNA, 17 bp, Homo sapiens
caagtcgatgaactatt

SEQ ID NO: 4611449 - DNA, 22 bp, Homo sapiens
caagtctttctcctctttgaga

SEQ ID NO: 4611450 - DNA, 20 bp, Homo sapiens
caagtgaaataacaaaatgg

SEQ ID NO: 4611451 - DNA, 21 bp, Homo sapiens
caagtgaaataacaaaatgga

SEQ ID NO: 4611452 - DNA, 12 bp, Homo sapiens
caagtgcctggg

SEQ ID NO: 4611453 - DNA, 14 bp, Homo sapiens
caagtgcctgggat

SEQ ID NO: 4611454 - DNA, 15 bp, Homo sapiens
caagtgtcacctcct

SEQ ID NO: 4611455 - DNA, 22 bp, Homo sapiens
caagtgtcacctccttccccag

SEQ ID NO: 4611456 - DNA, 23 bp, Homo sapiens
caagtgtcacctccttccccagc

SEQ ID NO: 4611457 - DNA, 23 bp, Homo sapiens
caagttagaaaattcagctcctt

SEQ ID NO: 4611458 - DNA, 12 bp, Homo sapiens
caagttgtgctt

SEQ ID NO: 4611459 - DNA, 18 bp, Homo sapiens
caataaaattttttttca

SEQ ID NO: 4611460 - DNA, 16 bp, Homo sapiens
caataaacaacagctg

SEQ ID NO: 4611461 - DNA, 21 bp, Homo sapiens
caataaacaacagctgaagca

SEQ ID NO: 4611462 - DNA, 15 bp, Homo sapiens
caataaatgtctgtt

SEQ ID NO: 4611463 - DNA, 18 bp, Homo sapiens
caataacaaaacgaaact

SEQ ID NO: 4611464 - DNA, 18 bp, Homo sapiens
caataacccagttacttt

SEQ ID NO: 4611465 - DNA, 19 bp, Homo sapiens
caataacccagttactttt

SEQ ID NO: 4611466 - DNA, 16 bp, Homo sapiens
caataactgaaaatga

SEQ ID NO: 4611467 - DNA, 21 bp, Homo sapiens
caataagagaactctcctctt

SEQ ID NO: 4611468 - DNA, 21 bp, Homo sapiens
caatactgtatgccttctgta

SEQ ID NO: 4611469 - DNA, 15 bp, Homo sapiens
caatagaaagaaact

SEQ ID NO: 4611470 - DNA, 16 bp, Homo sapiens
caatagaaagaaacta

SEQ ID NO: 4611471 - DNA, 19 bp, Homo sapiens
caatagctaagcatctcct

SEQ ID NO: 4611472 - DNA, 20 bp, Homo sapiens
caatatagaaaaataaaaat

SEQ ID NO: 4611473 - DNA, 14 bp, Homo sapiens
caatatcagacttt

SEQ ID NO: 4611474 - DNA, 16 bp, Homo sapiens
caatatgaatctataa

SEQ ID NO: 4611475 - DNA, 17 bp, Homo sapiens
caatatgtgtttacttt

SEQ ID NO: 4611476 - DNA, 18 bp, Homo sapiens
caatatgtgtttacttta

SEQ ID NO: 4611477 - DNA, 14 bp, Homo sapiens
caatattccttagt

SEQ ID NO: 4611478 - DNA, 19 bp, Homo sapiens
caatcactaaactttattt

SEQ ID NO: 4611479 - DNA, 18 bp, Homo sapiens
caatcagcccagtgcaaa

SEQ ID NO: 4611480 - DNA, 19 bp, Homo sapiens
caatcagcccagtgcaaac

SEQ ID NO: 4611481 - DNA, 17 bp, Homo sapiens
caatcattgaagtatat

SEQ ID NO: 4611482 - DNA, 22 bp, Homo sapiens
caatcattgaagtatattctta

SEQ ID NO: 4611483 - DNA, 12 bp, Homo sapiens
caatcctccccg

SEQ ID NO: 4611484 - DNA, 19 bp, Homo sapiens
caatcctccccgctctgcc

SEQ ID NO: 4611485 - DNA, 14 bp, Homo sapiens
caatcggactgcca

SEQ ID NO: 4611486 - DNA, 15 bp, Homo sapiens
caatcggactgccaa

SEQ ID NO: 4611487 - DNA, 12 bp, Homo sapiens
caatctaatttt

SEQ ID NO: 4611488 - DNA, 21 bp, Homo sapiens
caatctatggcttatttctat

SEQ ID NO: 4611489 - DNA, 11 bp, Homo sapiens
caatcttggga

SEQ ID NO: 4611490 - DNA, 19 bp, Homo sapiens
caatgaccattcaattagt

SEQ ID NO: 4611491 - DNA, 15 bp, Homo sapiens
caatgatttggccag

SEQ ID NO: 4611492 - DNA, 22 bp, Homo sapiens
caatgctagcacaatattccta

SEQ ID NO: 4611493 - DNA, 19 bp, Homo sapiens
caatgggagctgaggccac

SEQ ID NO: 4611494 - DNA, 18 bp, Homo sapiens
caatggtgcttggagggg

SEQ ID NO: 4611495 - DNA, 22 bp, Homo sapiens
caatgtactaggatactgctgc

SEQ ID NO: 4611496 - DNA, 16 bp, Homo sapiens
caaaggagcctgtgaa

SEQ ID NO: 4611497 - DNA, 20 bp, Homo sapiens
caaagggtgaagctatttat

SEQ ID NO: 4611498 - DNA, 23 bp, Homo sapiens
caaagggtgaagctatttatctg

SEQ ID NO: 4611499 - DNA, 23 bp, Homo sapiens
caaagtaacctgggcttaagttt

SEQ ID NO: 4611500 - DNA, 20 bp, Homo sapiens
caaagtactctttaacatac

SEQ ID NO: 4611501 - DNA, 15 bp, Homo sapiens
caaagtataatcttt

SEQ ID NO: 4611502 - DNA, 19 bp, Homo sapiens
caaagtcacttccccaaga

SEQ ID NO: 4611503 - DNA, 20 bp, Homo sapiens
caaagtcacttccccaagat

SEQ ID NO: 4611504 - DNA, 22 bp, Homo sapiens
caaagtcacttccccaagatct

SEQ ID NO: 4611505 - DNA, 20 bp, Homo sapiens
caaagtgctatgcggaggaa

SEQ ID NO: 4611506 - DNA, 19 bp, Homo sapiens
caaagtgctgggattacag

SEQ ID NO: 4611507 - DNA, 14 bp, Homo sapiens
caaagtggcaggga

SEQ ID NO: 4611508 - DNA, 18 bp, Homo sapiens
caaagtggtatagaaatg

SEQ ID NO: 4611509 - DNA, 22 bp, Homo sapiens
caaagtgtctcattctcagagt

SEQ ID NO: 4611510 - DNA, 20 bp, Homo sapiens
caaagttatattcacagttt

SEQ ID NO: 4611511 - DNA, 15 bp, Homo sapiens
caaagttgctcaccg

SEQ ID NO: 4611512 - DNA, 12 bp, Homo sapiens
caaataaaatat

SEQ ID NO: 4611513 - DNA, 15 bp, Homo sapiens
caaataaatgtttcc

SEQ ID NO: 4611514 - DNA, 22 bp, Homo sapiens
caaataaatgtttcccccactc

SEQ ID NO: 4611515 - DNA, 20 bp, Homo sapiens
caaatacaaagtggaaactt

SEQ ID NO: 4611516 - DNA, 21 bp, Homo sapiens
caaatatacattttctaaata

SEQ ID NO: 4611517 - DNA, 16 bp, Homo sapiens
caaatatagaaagttg

SEQ ID NO: 4611518 - DNA, 23 bp, Homo sapiens
caaatatagaaagttgatattca

SEQ ID NO: 4611519 - DNA, 22 bp, Homo sapiens
caaatatgagtacaaatgcctt

SEQ ID NO: 4611520 - DNA, 18 bp, Homo sapiens
caaatcagtttgactact

SEQ ID NO: 4611521 - DNA, 16 bp, Homo sapiens
caaatccaaggaaaca

SEQ ID NO: 4611522 - DNA, 18 bp, Homo sapiens
caaatccaaggaaacatg

SEQ ID NO: 4611523 - DNA, 16 bp, Homo sapiens
caaatccgaacctcct

SEQ ID NO: 4611524 - DNA, 22 bp, Homo sapiens
caaatccgaacctcctctgtga

SEQ ID NO: 4611525 - DNA, 15 bp, Homo sapiens
caaatcctatgtgat

SEQ ID NO: 4611526 - DNA, 16 bp, Homo sapiens
caaatcctatgtgatt

SEQ ID NO: 4611527 - DNA, 18 bp, Homo sapiens
caaatctaccactgtatg

SEQ ID NO: 4611528 - DNA, 20 bp, Homo sapiens
caaatcttcagtattttctc

SEQ ID NO: 4611529 - DNA, 21 bp, Homo sapiens
caaatcttggcaatattcctt

SEQ ID NO: 4611530 - DNA, 12 bp, Homo sapiens
caaatgcaaatt

SEQ ID NO: 4611531 - DNA, 17 bp, Homo sapiens
caaatgccttaaaatgg

SEQ ID NO: 4611532 - DNA, 12 bp, Homo sapiens
caaatggactgt

SEQ ID NO: 4611533 - DNA, 13 bp, Homo sapiens
caaatggttctta

SEQ ID NO: 4611534 - DNA, 20 bp, Homo sapiens
caaatgtaatagtttatctt

SEQ ID NO: 4611535 - DNA, 21 bp, Homo sapiens
caaatgtaatagtttatctta

SEQ ID NO: 4611536 - DNA, 20 bp, Homo sapiens
caaatgttcatatttattga

SEQ ID NO: 4611537 - DNA, 14 bp, Homo sapiens
caaattaaaacaaa

SEQ ID NO: 4611538 - DNA, 20 bp, Homo sapiens
caaattaaaacatatttcat

SEQ ID NO: 4611539 - DNA, 20 bp, Homo sapiens
caaattgccctatgctgtgc

SEQ ID NO: 4611540 - DNA, 14 bp, Homo sapiens
caaattgtcagcaa

SEQ ID NO: 4611541 - DNA, 18 bp, Homo sapiens
caaattgtcgtttttatt

SEQ ID NO: 4611542 - DNA, 20 bp, Homo sapiens
caaatttcattgcactttcc

SEQ ID NO: 4611543 - DNA, 19 bp, Homo sapiens
caaatttctataaatttaa

SEQ ID NO: 4611544 - DNA, 23 bp, Homo sapiens
caaatttctataaatttaagaaa

SEQ ID NO: 4611545 - DNA, 14 bp, Homo sapiens
caaatttggcaaaa

SEQ ID NO: 4611546 - DNA, 23 bp, Homo sapiens
caacaaatgtggccaagcctatc

SEQ ID NO: 4611547 - DNA, 14 bp, Homo sapiens
caacaaatttcatt

SEQ ID NO: 4611548 - DNA, 18 bp, Homo sapiens
caacaacgtgagagaaag

SEQ ID NO: 4611549 - DNA, 23 bp, Homo sapiens
caacaacgtgagagaaagagaga

SEQ ID NO: 4611550 - DNA, 15 bp, Homo sapiens
caacaatcctagtgc

SEQ ID NO: 4611551 - DNA, 15 bp, Homo sapiens
caacaattggtaaaa

SEQ ID NO: 4611552 - DNA, 16 bp, Homo sapiens
caacacagaggaattt

SEQ ID NO: 4611553 - DNA, 19 bp, Homo sapiens
caacagaaaccaagagaca

SEQ ID NO: 4611554 - DNA, 14 bp, Homo sapiens
caacagcaagtgtt

SEQ ID NO: 4611555 - DNA, 15 bp, Homo sapiens
caacagcacacaggc

SEQ ID NO: 4611556 - DNA, 18 bp, Homo sapiens
caacagcacacaggcagc

SEQ ID NO: 4611557 - DNA, 23 bp, Homo sapiens
caacaggtaaaacagggccacat

SEQ ID NO: 4611558 - DNA, 17 bp, Homo sapiens
caacatcaccagtgcca

SEQ ID NO: 4611559 - DNA, 23 bp, Homo sapiens
caacatgtagggcaagaggatga

SEQ ID NO: 4611560 - DNA, 23 bp, Homo sapiens
caacatttgtgcagaaatttgaa

SEQ ID NO: 4611561 - DNA, 15 bp, Homo sapiens
caaccagaaggccct

SEQ ID NO: 4611562 - DNA, 15 bp, Homo sapiens
caaccagtgccaagg

SEQ ID NO: 4611563 - DNA, 19 bp, Homo sapiens
caaccagtgccaaggacct

SEQ ID NO: 4611564 - DNA, 19 bp, Homo sapiens
caaccccttaagccctggc

SEQ ID NO: 4611565 - DNA, 16 bp, Homo sapiens
caacccgtgccaagtc

SEQ ID NO: 4611566 - DNA, 17 bp, Homo sapiens
caacccgtggaggctgc

SEQ ID NO: 4611567 - DNA, 17 bp, Homo sapiens
caaccgcctcaaaatgt

SEQ ID NO: 4611568 - DNA, 19 bp, Homo sapiens
caaccgtggcccttcctgg

SEQ ID NO: 4611569 - DNA, 23 bp, Homo sapiens
caaccgtggcccttcctggacag

SEQ ID NO: 4611570 - DNA, 23 bp, Homo sapiens
caacctattaaaatacattttaa

SEQ ID NO: 4611571 - DNA, 20 bp, Homo sapiens
caacctccgcctcccaggtt

SEQ ID NO: 4611572 - DNA, 18 bp, Homo sapiens
caaccttgctcttgggga

SEQ ID NO: 4611573 - DNA, 23 bp, Homo sapiens
caacgcttgtagaactcactctg

SEQ ID NO: 4611574 - DNA, 19 bp, Homo sapiens
caactataagcccactgtt

SEQ ID NO: 4611575 - DNA, 19 bp, Homo sapiens
caactcaagtgtcacctcc

SEQ ID NO: 4611576 - DNA, 22 bp, Homo sapiens
caactcacattgttcaactccc

SEQ ID NO: 4611577 - DNA, 20 bp, Homo sapiens
caactcccttctgcttgtcc

SEQ ID NO: 4611578 - DNA, 24 bp, Homo sapiens
caactctcccctgacctgtgagcc

SEQ ID NO: 4611579 - DNA, 15 bp, Homo sapiens
caactgctaatgcaa

SEQ ID NO: 4611580 - DNA, 20 bp, Homo sapiens
caactgctaatgcaaattaa

SEQ ID NO: 4611581 - DNA, 17 bp, Homo sapiens
caactgtttccctgctg

SEQ ID NO: 4611582 - DNA, 18 bp, Homo sapiens
caactttcagaagtgcca

SEQ ID NO: 4611583 - DNA, 20 bp, Homo sapiens
caactttcttatctggaaat

SEQ ID NO: 4611584 - DNA, 18 bp, Homo sapiens
caagaaacagccagcaag

SEQ ID NO: 4611585 - DNA, 20 bp, Homo sapiens
caagaaataaaaggaagcca

SEQ ID NO: 4611586 - DNA, 21 bp, Homo sapiens
caagaatgaaaaatataatgt

SEQ ID NO: 4611587 - DNA, 22 bp, Homo sapiens
caagaatttgatcgttccagtt

SEQ ID NO: 4611588 - DNA, 14 bp, Homo sapiens
caagacagagggga

SEQ ID NO: 4611589 - DNA, 13 bp, Homo sapiens
caagaccctgcct

SEQ ID NO: 4611590 - DNA, 14 bp, Homo sapiens
caagaccctgcctc

SEQ ID NO: 4611591 - DNA, 23 bp, Homo sapiens
caagacctcatctgtggagctgc

SEQ ID NO: 4611592 - DNA, 14 bp, Homo sapiens
caagacgaggggca

SEQ ID NO: 4611593 - DNA, 15 bp, Homo sapiens
caagacgaggggcag

SEQ ID NO: 4611594 - DNA, 20 bp, Homo sapiens
caagacgaggggcagggaag

SEQ ID NO: 4611595 - DNA, 19 bp, Homo sapiens
caagagcatcatgcctctg

SEQ ID NO: 4611596 - DNA, 20 bp, Homo sapiens
caagagcatcatgcctctga

SEQ ID NO: 4611597 - DNA, 21 bp, Homo sapiens
caagagctagaaaaataaaat

SEQ ID NO: 4611598 - DNA, 15 bp, Homo sapiens
caagagggaacaaaa

SEQ ID NO: 4611599 - DNA, 15 bp, Homo sapiens
caagatatggacaca

SEQ ID NO: 4611600 - DNA, 13 bp, Homo sapiens
caagatctgccag

SEQ ID NO: 4611601 - DNA, 17 bp, Homo sapiens
caagatctgccagacct

SEQ ID NO: 4611602 - DNA, 18 bp, Homo sapiens
caagatctgccagacctg

SEQ ID NO: 4611603 - DNA, 21 bp, Homo sapiens
caagatctgccagacctgcat

SEQ ID NO: 4611604 - DNA, 23 bp, Homo sapiens
caagatctgccagacctgcatgg

SEQ ID NO: 4611605 - DNA, 15 bp, Homo sapiens
attttataattggtg

SEQ ID NO: 4611606 - DNA, 13 bp, Homo sapiens
attttattattca

SEQ ID NO: 4611607 - DNA, 16 bp, Homo sapiens
attttattcacatatg

SEQ ID NO: 4611608 - DNA, 17 bp, Homo sapiens
attttcaaggccttcag

SEQ ID NO: 4611609 - DNA, 17 bp, Homo sapiens
attttcagtaccaaaga

SEQ ID NO: 4611610 - DNA, 21 bp, Homo sapiens
attttcagtaccaaagaaaca

SEQ ID NO: 4611611 - DNA, 15 bp, Homo sapiens
attttcagtgcatca

SEQ ID NO: 4611612 - DNA, 13 bp, Homo sapiens
attttccttccat

SEQ ID NO: 4611613 - DNA, 18 bp, Homo sapiens
attttccttccatgctcc

SEQ ID NO: 4611614 - DNA, 23 bp, Homo sapiens
attttctattttaagactgattt

SEQ ID NO: 4611615 - DNA, 23 bp, Homo sapiens
attttctcccttaggaatataca

SEQ ID NO: 4611616 - DNA, 14 bp, Homo sapiens
attttctcttagag

SEQ ID NO: 4611617 - DNA, 19 bp, Homo sapiens
attttctgtgggcaggcct

SEQ ID NO: 4611618 - DNA, 23 bp, Homo sapiens
attttctgtgttttgctgtacca

SEQ ID NO: 4611619 - DNA, 14 bp, Homo sapiens
attttcttactttt

SEQ ID NO: 4611620 - DNA, 21 bp, Homo sapiens
attttgagtttcagctggaaa

SEQ ID NO: 4611621 - DNA, 22 bp, Homo sapiens
attttgagtttcagctggaaac

SEQ ID NO: 4611622 - DNA, 19 bp, Homo sapiens
attttgctatcaacaataa

SEQ ID NO: 4611623 - DNA, 21 bp, Homo sapiens
attttgctttagagaatgcca

SEQ ID NO: 4611624 - DNA, 21 bp, Homo sapiens
attttggaactgtgtttcaaa

SEQ ID NO: 4611625 - DNA, 18 bp, Homo sapiens
attttggtgcacaaatac

SEQ ID NO: 4611626 - DNA, 19 bp, Homo sapiens
attttgtcacattatttat

SEQ ID NO: 4611627 - DNA, 14 bp, Homo sapiens
attttgttaacttt

SEQ ID NO: 4611628 - DNA, 16 bp, Homo sapiens
attttgtttcttttaa

SEQ ID NO: 4611629 - DNA, 23 bp, Homo sapiens
atttttaaaaaatattttctctg

SEQ ID NO: 4611630 - DNA, 22 bp, Homo sapiens
atttttaaaaaatgaaatcctt

SEQ ID NO: 4611631 - DNA, 21 bp, Homo sapiens
atttttagaattaaaaaagca

SEQ ID NO: 4611632 - DNA, 18 bp, Homo sapiens
atttttagccataatttt

SEQ ID NO: 4611633 - DNA, 13 bp, Homo sapiens
atttttatagcaa

SEQ ID NO: 4611634 - DNA, 22 bp, Homo sapiens
atttttatatctatatgtactt

SEQ ID NO: 4611635 - DNA, 14 bp, Homo sapiens
atttttcagatgct

SEQ ID NO: 4611636 - DNA, 18 bp, Homo sapiens
atttttcagatgcttctg

SEQ ID NO: 4611637 - DNA, 16 bp, Homo sapiens
atttttctgactttta

SEQ ID NO: 4611638 - DNA, 22 bp, Homo sapiens
atttttctgacttttacagatt

SEQ ID NO: 4611639 - DNA, 17 bp, Homo sapiens
atttttcttttcttgat

SEQ ID NO: 4611640 - DNA, 17 bp, Homo sapiens
atttttgaaaaaagtac

SEQ ID NO: 4611641 - DNA, 12 bp, Homo sapiens
atttttgtaact

SEQ ID NO: 4611642 - DNA, 17 bp, Homo sapiens
atttttgtacttttagt

SEQ ID NO: 4611643 - DNA, 11 bp, Homo sapiens
atttttgttgg

SEQ ID NO: 4611644 - DNA, 20 bp, Homo sapiens
attttttaaagttactttgt

SEQ ID NO: 4611645 - DNA, 18 bp, Homo sapiens
atttttttgtaattgctt

SEQ ID NO: 4611646 - DNA, 14 bp, Homo sapiens
attttttttatatt

SEQ ID NO: 4611647 - DNA, 15 bp, Homo sapiens
attttttttcatgtt

SEQ ID NO: 4611648 - DNA, 20 bp, Homo sapiens
attttttttcatgttttaac

SEQ ID NO: 4611649 - DNA, 16 bp, Homo sapiens
attttttttttaaatc

SEQ ID NO: 4611650 - DNA, 17 bp, Homo sapiens
attttttttttcattgg

SEQ ID NO: 4611651 - DNA, 15 bp, Homo sapiens
caaaaagtattatca

SEQ ID NO: 4611652 - DNA, 17 bp, Homo sapiens
caaaaatgatcctcagt

SEQ ID NO: 4611653 - DNA, 19 bp, Homo sapiens
caaaaatgatcctcagtgc

SEQ ID NO: 4611654 - DNA, 15 bp, Homo sapiens
caaaaattatatatt

SEQ ID NO: 4611655 - DNA, 14 bp, Homo sapiens
caaaacctcaaacc

SEQ ID NO: 4611656 - DNA, 19 bp, Homo sapiens
caaaacctcaaaccagtca

SEQ ID NO: 4611657 - DNA, 17 bp, Homo sapiens
caaaacgggtcagtatt

SEQ ID NO: 4611658 - DNA, 13 bp, Homo sapiens
caaaactcaggca

SEQ ID NO: 4611659 - DNA, 11 bp, Homo sapiens
caaaacttctt

SEQ ID NO: 4611660 - DNA, 17 bp, Homo sapiens
caaaacttcttgtcaga

SEQ ID NO: 4611661 - DNA, 23 bp, Homo sapiens
caaaactttaggccctgccccag

SEQ ID NO: 4611662 - DNA, 18 bp, Homo sapiens
caaaagattaatctttaa

SEQ ID NO: 4611663 - DNA, 22 bp, Homo sapiens
caaaaggcctcttgtaaagact

SEQ ID NO: 4611664 - DNA, 20 bp, Homo sapiens
caaaagggtttaaactgatt

SEQ ID NO: 4611665 - DNA, 22 bp, Homo sapiens
caaaagggtttaaactgattca

SEQ ID NO: 4611666 - DNA, 17 bp, Homo sapiens
caaaagtcacccaggga

SEQ ID NO: 4611667 - DNA, 19 bp, Homo sapiens
caaaagtctgtctttcctg

SEQ ID NO: 4611668 - DNA, 14 bp, Homo sapiens
caaaagtggcctct

SEQ ID NO: 4611669 - DNA, 20 bp, Homo sapiens
caaaagtggcctctttgtct

SEQ ID NO: 4611670 - DNA, 20 bp, Homo sapiens
caaaatacacgtttatctta

SEQ ID NO: 4611671 - DNA, 15 bp, Homo sapiens
caaaatacatttgta

SEQ ID NO: 4611672 - DNA, 16 bp, Homo sapiens
caaaatacatttgtaa

SEQ ID NO: 4611673 - DNA, 14 bp, Homo sapiens
caaaatcaacatga

SEQ ID NO: 4611674 - DNA, 16 bp, Homo sapiens
caaaatcaacatgact

SEQ ID NO: 4611675 - DNA, 13 bp, Homo sapiens
caaaatcaagagt

SEQ ID NO: 4611676 - DNA, 13 bp, Homo sapiens
caaaatgtcttgt

SEQ ID NO: 4611677 - DNA, 19 bp, Homo sapiens
caaaatgtcttgtgtattt

SEQ ID NO: 4611678 - DNA, 16 bp, Homo sapiens
caaaattaaatctaga

SEQ ID NO: 4611679 - DNA, 18 bp, Homo sapiens
caaaattcatttctaatt

SEQ ID NO: 4611680 - DNA, 16 bp, Homo sapiens
caaacaagccccctgc

SEQ ID NO: 4611681 - DNA, 15 bp, Homo sapiens
caaacagaacagggt

SEQ ID NO: 4611682 - DNA, 14 bp, Homo sapiens
caaacagacaaaac

SEQ ID NO: 4611683 - DNA, 20 bp, Homo sapiens
caaacatcccccaatgacct

SEQ ID NO: 4611684 - DNA, 20 bp, Homo sapiens
caaacatgatactgctgctt

SEQ ID NO: 4611685 - DNA, 12 bp, Homo sapiens
caaaccatgcct

SEQ ID NO: 4611686 - DNA, 18 bp, Homo sapiens
caaacctccaaaagccct

SEQ ID NO: 4611687 - DNA, 17 bp, Homo sapiens
caaacgagactttctcc

SEQ ID NO: 4611688 - DNA, 21 bp, Homo sapiens
caaacgagactttctcctggc

SEQ ID NO: 4611689 - DNA, 15 bp, Homo sapiens
caaacttagaaaggg

SEQ ID NO: 4611690 - DNA, 16 bp, Homo sapiens
caaacttgttcattta

SEQ ID NO: 4611691 - DNA, 13 bp, Homo sapiens
caaagaaacaagc

SEQ ID NO: 4611692 - DNA, 19 bp, Homo sapiens
caaagaaacaagctgtgca

SEQ ID NO: 4611693 - DNA, 20 bp, Homo sapiens
caaagaaacaagctgtgcag

SEQ ID NO: 4611694 - DNA, 22 bp, Homo sapiens
caaagaaacaccacttaatctt

SEQ ID NO: 4611695 - DNA, 23 bp, Homo sapiens
caaagaaacaccacttaatcttc

SEQ ID NO: 4611696 - DNA, 19 bp, Homo sapiens
caaagaactccagagtcag

SEQ ID NO: 4611697 - DNA, 15 bp, Homo sapiens
caaagaatattttga

SEQ ID NO: 4611698 - DNA, 21 bp, Homo sapiens
caaagactgtgaacagcttgc

SEQ ID NO: 4611699 - DNA, 22 bp, Homo sapiens
caaagagcacttgagctgtctg

SEQ ID NO: 4611700 - DNA, 19 bp, Homo sapiens
caaagattgattgattttc

SEQ ID NO: 4611701 - DNA, 13 bp, Homo sapiens
caaagatttttgg

SEQ ID NO: 4611702 - DNA, 13 bp, Homo sapiens
caaagcagacagc

SEQ ID NO: 4611703 - DNA, 15 bp, Homo sapiens
caaagccaaacaaaa

SEQ ID NO: 4611704 - DNA, 15 bp, Homo sapiens
caaagccagggtctc

SEQ ID NO: 4611705 - DNA, 17 bp, Homo sapiens
caaagcccaaagtggta

SEQ ID NO: 4611706 - DNA, 19 bp, Homo sapiens
caaagcccaaagtggtata

SEQ ID NO: 4611707 - DNA, 12 bp, Homo sapiens
caaagcctgagg

SEQ ID NO: 4611708 - DNA, 13 bp, Homo sapiens
caaagcctgagga

SEQ ID NO: 4611709 - DNA, 19 bp, Homo sapiens
caaagcctgttcatggcag

SEQ ID NO: 4611710 - DNA, 20 bp, Homo sapiens
caaagcctgttcatggcaga

SEQ ID NO: 4611711 - DNA, 14 bp, Homo sapiens
caaagcctttaaat

SEQ ID NO: 4611712 - DNA, 19 bp, Homo sapiens
caaagcggtccctgtccct

SEQ ID NO: 4611713 - DNA, 18 bp, Homo sapiens
caaagctttcctgtttcc

SEQ ID NO: 4611714 - DNA, 18 bp, Homo sapiens
caaaggaatataagaaaa

SEQ ID NO: 4611715 - DNA, 22 bp, Homo sapiens
caaaggagacccgccccagggc

SEQ ID NO: 4611716 - DNA, 20 bp, Homo sapiens
attgtgcagtactttgtgca

SEQ ID NO: 4611717 - DNA, 20 bp, Homo sapiens
attgtgggccatgaaccaaa

SEQ ID NO: 4611718 - DNA, 12 bp, Homo sapiens
attgtgtctccc

SEQ ID NO: 4611719 - DNA, 21 bp, Homo sapiens
attgttagaaaatgacttatt

SEQ ID NO: 4611720 - DNA, 18 bp, Homo sapiens
attgttagcttccttaag

SEQ ID NO: 4611721 - DNA, 16 bp, Homo sapiens
attgttgctgaaactt

SEQ ID NO: 4611722 - DNA, 20 bp, Homo sapiens
attgtttgaaacaaagaagg

SEQ ID NO: 4611723 - DNA, 22 bp, Homo sapiens
atttaaaaacaaccaacagaaa

SEQ ID NO: 4611724 - DNA, 14 bp, Homo sapiens
atttaaattccaca

SEQ ID NO: 4611725 - DNA, 19 bp, Homo sapiens
atttaacaaaaaatgtaat

SEQ ID NO: 4611726 - DNA, 13 bp, Homo sapiens
atttaagacacat

SEQ ID NO: 4611727 - DNA, 22 bp, Homo sapiens
atttaagttcctgctgcctggg

SEQ ID NO: 4611728 - DNA, 14 bp, Homo sapiens
atttaatatatata

SEQ ID NO: 4611729 - DNA, 21 bp, Homo sapiens
atttaatatggatttgttaca

SEQ ID NO: 4611730 - DNA, 15 bp, Homo sapiens
atttaatgcctgccc

SEQ ID NO: 4611731 - DNA, 21 bp, Homo sapiens
atttaatggccggctggaaat

SEQ ID NO: 4611732 - DNA, 15 bp, Homo sapiens
atttacaaaatttat

SEQ ID NO: 4611733 - DNA, 16 bp, Homo sapiens
atttactaactaaata

SEQ ID NO: 4611734 - DNA, 15 bp, Homo sapiens
atttactctttgcaa

SEQ ID NO: 4611735 - DNA, 17 bp, Homo sapiens
atttactgctctttatt

SEQ ID NO: 4611736 - DNA, 21 bp, Homo sapiens
atttactgctctttattgcag

SEQ ID NO: 4611737 - DNA, 22 bp, Homo sapiens
atttactgctctttattgcaga

SEQ ID NO: 4611738 - DNA, 20 bp, Homo sapiens
atttactggacataacattt

SEQ ID NO: 4611739 - DNA, 19 bp, Homo sapiens
atttagagggtgaaggaga

SEQ ID NO: 4611740 - DNA, 19 bp, Homo sapiens
atttagaggtaaaagtaca

SEQ ID NO: 4611741 - DNA, 21 bp, Homo sapiens
atttagctccaaaccttcaca

SEQ ID NO: 4611742 - DNA, 14 bp, Homo sapiens
atttagctgtaaac

SEQ ID NO: 4611743 - DNA, 15 bp, Homo sapiens
atttagcttctttcc

SEQ ID NO: 4611744 - DNA, 21 bp, Homo sapiens
atttagtgtttttacctctgt

SEQ ID NO: 4611745 - DNA, 21 bp, Homo sapiens
atttataaaaagatgatcgct

SEQ ID NO: 4611746 - DNA, 20 bp, Homo sapiens
atttataaaaatataaattg

SEQ ID NO: 4611747 - DNA, 12 bp, Homo sapiens
atttataaaggg

SEQ ID NO: 4611748 - DNA, 18 bp, Homo sapiens
atttataatactgtttta

SEQ ID NO: 4611749 - DNA, 22 bp, Homo sapiens
atttatacctcaaactatctgg

SEQ ID NO: 4611750 - DNA, 15 bp, Homo sapiens
atttatactggcatg

SEQ ID NO: 4611751 - DNA, 16 bp, Homo sapiens
atttatactggcatgc

SEQ ID NO: 4611752 - DNA, 14 bp, Homo sapiens
atttatagaaatga

SEQ ID NO: 4611753 - DNA, 22 bp, Homo sapiens
atttatgccttgatgatttaat

SEQ ID NO: 4611754 - DNA, 15 bp, Homo sapiens
atttattaaaaatgt

SEQ ID NO: 4611755 - DNA, 15 bp, Homo sapiens
atttattagccaact

SEQ ID NO: 4611756 - DNA, 21 bp, Homo sapiens
atttattattttttttatatt

SEQ ID NO: 4611757 - DNA, 20 bp, Homo sapiens
atttattgattaaaaatgtg

SEQ ID NO: 4611758 - DNA, 21 bp, Homo sapiens
atttatttccactaaaaatat

SEQ ID NO: 4611759 - DNA, 22 bp, Homo sapiens
atttatttccactaaaaatatt

SEQ ID NO: 4611760 - DNA, 12 bp, Homo sapiens
atttatttctag

SEQ ID NO: 4611761 - DNA, 16 bp, Homo sapiens
atttattttcttttga

SEQ ID NO: 4611762 - DNA, 21 bp, Homo sapiens
atttattttttaagaaaaaaa

SEQ ID NO: 4611763 - DNA, 15 bp, Homo sapiens
atttcaagctcatgt

SEQ ID NO: 4611764 - DNA, 20 bp, Homo sapiens
atttcaatagctttgtagtt

SEQ ID NO: 4611765 - DNA, 19 bp, Homo sapiens
atttcaatcattgaagtat

SEQ ID NO: 4611766 - DNA, 19 bp, Homo sapiens
atttcacacgctgttctaa

SEQ ID NO: 4611767 - DNA, 15 bp, Homo sapiens
atttcagaaggagaa

SEQ ID NO: 4611768 - DNA, 20 bp, Homo sapiens
atttcaggaaaatgtattga

SEQ ID NO: 4611769 - DNA, 14 bp, Homo sapiens
atttcatgaaaaag

SEQ ID NO: 4611770 - DNA, 17 bp, Homo sapiens
atttcatgaaaaagctg

SEQ ID NO: 4611771 - DNA, 11 bp, Homo sapiens
atttcattcca

SEQ ID NO: 4611772 - DNA, 12 bp, Homo sapiens
atttcattccat

SEQ ID NO: 4611773 - DNA, 15 bp, Homo sapiens
atttcattgcacttt

SEQ ID NO: 4611774 - DNA, 17 bp, Homo sapiens
atttcctggtgtgaagg

SEQ ID NO: 4611775 - DNA, 21 bp, Homo sapiens
atttcctggtgtgaaggtcct

SEQ ID NO: 4611776 - DNA, 15 bp, Homo sapiens
atttccttccagcct

SEQ ID NO: 4611777 - DNA, 16 bp, Homo sapiens
atttccttccagcctt

SEQ ID NO: 4611778 - DNA, 21 bp, Homo sapiens
atttcgtttggtcttaggtct

SEQ ID NO: 4611779 - DNA, 19 bp, Homo sapiens
atttctacaactggagttt

SEQ ID NO: 4611780 - DNA, 14 bp, Homo sapiens
atttctataaattt

SEQ ID NO: 4611781 - DNA, 21 bp, Homo sapiens
atttctataaatttaagaaaa

SEQ ID NO: 4611782 - DNA, 13 bp, Homo sapiens
atttctatgacaa

SEQ ID NO: 4611783 - DNA, 20 bp, Homo sapiens
atttctatgatccttttttg

SEQ ID NO: 4611784 - DNA, 17 bp, Homo sapiens
atttctctaattatgca

SEQ ID NO: 4611785 - DNA, 18 bp, Homo sapiens
atttctctacttgtcata

SEQ ID NO: 4611786 - DNA, 20 bp, Homo sapiens
atttctcttctacccttttc

SEQ ID NO: 4611787 - DNA, 16 bp, Homo sapiens
atttctgcaggttctt

SEQ ID NO: 4611788 - DNA, 23 bp, Homo sapiens
atttctgttatttttaagctttt

SEQ ID NO: 4611789 - DNA, 21 bp, Homo sapiens
atttcttgtagctaaaaataa

SEQ ID NO: 4611790 - DNA, 22 bp, Homo sapiens
atttctttatatttatccacta

SEQ ID NO: 4611791 - DNA, 17 bp, Homo sapiens
atttgaatgggtccatt

SEQ ID NO: 4611792 - DNA, 13 bp, Homo sapiens
atttgactaattt

SEQ ID NO: 4611793 - DNA, 17 bp, Homo sapiens
atttgatcgttccagtt

SEQ ID NO: 4611794 - DNA, 13 bp, Homo sapiens
atttgatttctaa

SEQ ID NO: 4611795 - DNA, 14 bp, Homo sapiens
atttgatttctaat

SEQ ID NO: 4611796 - DNA, 15 bp, Homo sapiens
atttgccttctgaaa

SEQ ID NO: 4611797 - DNA, 23 bp, Homo sapiens
atttgctaatcaaagccagggtc

SEQ ID NO: 4611798 - DNA, 21 bp, Homo sapiens
atttgggagggaaaagggaag

SEQ ID NO: 4611799 - DNA, 19 bp, Homo sapiens
atttgggtttttttgttgt

SEQ ID NO: 4611800 - DNA, 14 bp, Homo sapiens
atttggtcttagct

SEQ ID NO: 4611801 - DNA, 16 bp, Homo sapiens
atttggtcttagcttt

SEQ ID NO: 4611802 - DNA, 21 bp, Homo sapiens
atttggtcttagctttacatt

SEQ ID NO: 4611803 - DNA, 20 bp, Homo sapiens
atttggtggcctaatttaca

SEQ ID NO: 4611804 - DNA, 22 bp, Homo sapiens
atttggtggcctaatttacaag

SEQ ID NO: 4611805 - DNA, 13 bp, Homo sapiens
atttggtgtgttc

SEQ ID NO: 4611806 - DNA, 14 bp, Homo sapiens
atttggtgtgttcg

SEQ ID NO: 4611807 - DNA, 23 bp, Homo sapiens
atttgtaaaaacagcattgcttt

SEQ ID NO: 4611808 - DNA, 14 bp, Homo sapiens
atttgtaaaccatt

SEQ ID NO: 4611809 - DNA, 15 bp, Homo sapiens
atttgtaaacttctg

SEQ ID NO: 4611810 - DNA, 22 bp, Homo sapiens
atttgtaatatggaaatctttt

SEQ ID NO: 4611811 - DNA, 19 bp, Homo sapiens
atttgtagtggaaacattt

SEQ ID NO: 4611812 - DNA, 23 bp, Homo sapiens
atttgtatgaataatgaaaataa

SEQ ID NO: 4611813 - DNA, 16 bp, Homo sapiens
atttgttcttcaagaa

SEQ ID NO: 4611814 - DNA, 14 bp, Homo sapiens
attttaaaaacttt

SEQ ID NO: 4611815 - DNA, 13 bp, Homo sapiens
attttaacatgat

SEQ ID NO: 4611816 - DNA, 16 bp, Homo sapiens
attttaacatgatttc

SEQ ID NO: 4611817 - DNA, 19 bp, Homo sapiens
attttaacatgatttcaaa

SEQ ID NO: 4611818 - DNA, 16 bp, Homo sapiens
attttaactctgtctt

SEQ ID NO: 4611819 - DNA, 16 bp, Homo sapiens
attttaagactgattt

SEQ ID NO: 4611820 - DNA, 19 bp, Homo sapiens
attttaatacctttaaata

SEQ ID NO: 4611821 - DNA, 22 bp, Homo sapiens
attttaatacctttaaatatca

SEQ ID NO: 4611822 - DNA, 20 bp, Homo sapiens
attttaatagggaatatatc

SEQ ID NO: 4611823 - DNA, 16 bp, Homo sapiens
attttaatcattattt

SEQ ID NO: 4611824 - DNA, 16 bp, Homo sapiens
attttaatttcaggaa

SEQ ID NO: 4611825 - DNA, 22 bp, Homo sapiens
attttaggcactgttcaatact

SEQ ID NO: 4611826 - DNA, 22 bp, Homo sapiens
attttagtgtatctttaaaaaa

SEQ ID NO: 4611827 - DNA, 17 bp, Homo sapiens
atggccaccttttcagc

SEQ ID NO: 4611828 - DNA, 15 bp, Homo sapiens
atggccaggggccag

SEQ ID NO: 4611829 - DNA, 16 bp, Homo sapiens
atggccaggggccagg

SEQ ID NO: 4611830 - DNA, 17 bp, Homo sapiens
atggccaggggccagga

SEQ ID NO: 4611831 - DNA, 19 bp, Homo sapiens
atggccaggggccaggagt

SEQ ID NO: 4611832 - DNA, 21 bp, Homo sapiens
atggccccgcaaggcctccag

SEQ ID NO: 4611833 - DNA, 18 bp, Homo sapiens
atggcctatgcacatatg

SEQ ID NO: 4611834 - DNA, 20 bp, Homo sapiens
atggccttgaaacagttcca

SEQ ID NO: 4611835 - DNA, 13 bp, Homo sapiens
atggctacctcag

SEQ ID NO: 4611836 - DNA, 14 bp, Homo sapiens
atggcttatttcta

SEQ ID NO: 4611837 - DNA, 15 bp, Homo sapiens
atggcttatttctat

SEQ ID NO: 4611838 - DNA, 17 bp, Homo sapiens
atgggacggaggtcctt

SEQ ID NO: 4611839 - DNA, 21 bp, Homo sapiens
atgggatggtcggatctcaca

SEQ ID NO: 4611840 - DNA, 20 bp, Homo sapiens
atgggcaaagcttgtcaaag

SEQ ID NO: 4611841 - DNA, 16 bp, Homo sapiens
atggggatagtctggg

SEQ ID NO: 4611842 - DNA, 20 bp, Homo sapiens
atggggatagtctgggtcag

SEQ ID NO: 4611843 - DNA, 14 bp, Homo sapiens
atggggtagaaaca

SEQ ID NO: 4611844 - DNA, 13 bp, Homo sapiens
atggggtgggggg

SEQ ID NO: 4611845 - DNA, 16 bp, Homo sapiens
atggtacttcctctgt

SEQ ID NO: 4611846 - DNA, 19 bp, Homo sapiens
atggtacttcctctgtgaa

SEQ ID NO: 4611847 - DNA, 15 bp, Homo sapiens
atggtcctagacaaa

SEQ ID NO: 4611848 - DNA, 15 bp, Homo sapiens
atggtcggatctcac

SEQ ID NO: 4611849 - DNA, 22 bp, Homo sapiens
atggtcggatctcacaggctga

SEQ ID NO: 4611850 - DNA, 14 bp, Homo sapiens
atggtgaagtaaca

SEQ ID NO: 4611851 - DNA, 18 bp, Homo sapiens
atggtgaagtaacatgca

SEQ ID NO: 4611852 - DNA, 18 bp, Homo sapiens
atggtgagatgcagctgg

SEQ ID NO: 4611853 - DNA, 17 bp, Homo sapiens
atggtgcttggaggggg

SEQ ID NO: 4611854 - DNA, 12 bp, Homo sapiens
atggtgtgttca

SEQ ID NO: 4611855 - DNA, 15 bp, Homo sapiens
atgtaaaaggccaaa

SEQ ID NO: 4611856 - DNA, 22 bp, Homo sapiens
atgtaaaaggccaaacctctgt

SEQ ID NO: 4611857 - DNA, 23 bp, Homo sapiens
atgtaaaaggccaaacctctgtt

SEQ ID NO: 4611858 - DNA, 16 bp, Homo sapiens
atgtaagcatactttg

SEQ ID NO: 4611859 - DNA, 22 bp, Homo sapiens
atgtaagcatactttgtaaata

SEQ ID NO: 4611860 - DNA, 14 bp, Homo sapiens
atgtaataactttc

SEQ ID NO: 4611861 - DNA, 19 bp, Homo sapiens
atgtaatttaatgcctgcc

SEQ ID NO: 4611862 - DNA, 21 bp, Homo sapiens
atgtaatttaatgcctgccca

SEQ ID NO: 4611863 - DNA, 19 bp, Homo sapiens
atgtaatttcaaaatacat

SEQ ID NO: 4611864 - DNA, 21 bp, Homo sapiens
atgtaatttcaaaatacattt

SEQ ID NO: 4611865 - DNA, 21 bp, Homo sapiens
atgtacactttttacagcagc

SEQ ID NO: 4611866 - DNA, 20 bp, Homo sapiens
atgtaccaagtaaccatttc

SEQ ID NO: 4611867 - DNA, 16 bp, Homo sapiens
atgtacccaccgggcc

SEQ ID NO: 4611868 - DNA, 20 bp, Homo sapiens
atgtactaggatactgctgc

SEQ ID NO: 4611869 - DNA, 14 bp, Homo sapiens
atgtacttctctgt

SEQ ID NO: 4611870 - DNA, 19 bp, Homo sapiens
atgtacttgtcaaagaagg

SEQ ID NO: 4611871 - DNA, 20 bp, Homo sapiens
atgtagaaagttgtaaaata

SEQ ID NO: 4611872 - DNA, 14 bp, Homo sapiens
atgtagccacccaa

SEQ ID NO: 4611873 - DNA, 12 bp, Homo sapiens
atgtaggaggga

SEQ ID NO: 4611874 - DNA, 13 bp, Homo sapiens
atgtaggagggac

SEQ ID NO: 4611875 - DNA, 14 bp, Homo sapiens
atgtagggcaagag

SEQ ID NO: 4611876 - DNA, 19 bp, Homo sapiens
atgtagggcaagaggatga

SEQ ID NO: 4611877 - DNA, 15 bp, Homo sapiens
atgtagtcataataa

SEQ ID NO: 4611878 - DNA, 18 bp, Homo sapiens
atgtagttatctattgaa

SEQ ID NO: 4611879 - DNA, 17 bp, Homo sapiens
atgtatctggttaatga

SEQ ID NO: 4611880 - DNA, 12 bp, Homo sapiens
atgtatcttaaa

SEQ ID NO: 4611881 - DNA, 13 bp, Homo sapiens
atgtatcttaaag

SEQ ID NO: 4611882 - DNA, 17 bp, Homo sapiens
atgtatcttaaaggaca

SEQ ID NO: 4611883 - DNA, 19 bp, Homo sapiens
atgtatcttaaaggacata

SEQ ID NO: 4611884 - DNA, 17 bp, Homo sapiens
atgtatgcagctatctg

SEQ ID NO: 4611885 - DNA, 15 bp, Homo sapiens
atgtattctttataa

SEQ ID NO: 4611886 - DNA, 18 bp, Homo sapiens
atgtattttcctaatgtg

SEQ ID NO: 4611887 - DNA, 20 bp, Homo sapiens
atgtattttcctaatgtgat

SEQ ID NO: 4611888 - DNA, 16 bp, Homo sapiens
atgtattttgacactg

SEQ ID NO: 4611889 - DNA, 19 bp, Homo sapiens
atgtcaataaacaacagct

SEQ ID NO: 4611890 - DNA, 23 bp, Homo sapiens
atgtcaataaacaacagctgaag

SEQ ID NO: 4611891 - DNA, 22 bp, Homo sapiens
atgtcactagaatggataaaat

SEQ ID NO: 4611892 - DNA, 19 bp, Homo sapiens
atgtcaggtcagccaactg

SEQ ID NO: 4611893 - DNA, 21 bp, Homo sapiens
atgtcatggccttgaaacagt

SEQ ID NO: 4611894 - DNA, 16 bp, Homo sapiens
atgtcattatgacatt

SEQ ID NO: 4611895 - DNA, 15 bp, Homo sapiens
atgtccctgggccag

SEQ ID NO: 4611896 - DNA, 18 bp, Homo sapiens
atgtccctgggccagggt

SEQ ID NO: 4611897 - DNA, 20 bp, Homo sapiens
atgtcctaaagaagacattt

SEQ ID NO: 4611898 - DNA, 21 bp, Homo sapiens
atgtctgtatccccagtgccc

SEQ ID NO: 4611899 - DNA, 16 bp, Homo sapiens
atgtcttggacactgt

SEQ ID NO: 4611900 - DNA, 14 bp, Homo sapiens
atgtcttgtacatg

SEQ ID NO: 4611901 - DNA, 22 bp, Homo sapiens
atgtcttgtacatgtgtagcct

SEQ ID NO: 4611902 - DNA, 22 bp, Homo sapiens
atgtcttgtgtatttctctgtg

SEQ ID NO: 4611903 - DNA, 23 bp, Homo sapiens
atgtcttgtgtatttctctgtga

SEQ ID NO: 4611904 - DNA, 13 bp, Homo sapiens
atgtgaaaaatta

SEQ ID NO: 4611905 - DNA, 18 bp, Homo sapiens
atgtgaaaaattaacttt

SEQ ID NO: 4611906 - DNA, 19 bp, Homo sapiens
atgtgaaaaattaactttt

SEQ ID NO: 4611907 - DNA, 18 bp, Homo sapiens
atgtgaactctcccctcc

SEQ ID NO: 4611908 - DNA, 19 bp, Homo sapiens
atgtgacattccatgacga

SEQ ID NO: 4611909 - DNA, 15 bp, Homo sapiens
atgtgacattcctga

SEQ ID NO: 4611910 - DNA, 13 bp, Homo sapiens
atgtgactctgaa

SEQ ID NO: 4611911 - DNA, 19 bp, Homo sapiens
atgtgactgttgagggcct

SEQ ID NO: 4611912 - DNA, 16 bp, Homo sapiens
atgtgagtatttctgt

SEQ ID NO: 4611913 - DNA, 22 bp, Homo sapiens
atgtgagtatttctgttccttt

SEQ ID NO: 4611914 - DNA, 14 bp, Homo sapiens
atgtgattttaact

SEQ ID NO: 4611915 - DNA, 18 bp, Homo sapiens
atgtgattttaactctgt

SEQ ID NO: 4611916 - DNA, 15 bp, Homo sapiens
atgtgccacattttc

SEQ ID NO: 4611917 - DNA, 16 bp, Homo sapiens
atgtgcccaggggagc

SEQ ID NO: 4611918 - DNA, 13 bp, Homo sapiens
atgtgctacaggg

SEQ ID NO: 4611919 - DNA, 14 bp, Homo sapiens
atgtggaggaagag

SEQ ID NO: 4611920 - DNA, 17 bp, Homo sapiens
atgtggaggaagagcca

SEQ ID NO: 4611921 - DNA, 19 bp, Homo sapiens
atgtggaggaagagccacc

SEQ ID NO: 4611922 - DNA, 20 bp, Homo sapiens
atgtggcaaactgaagctgc

SEQ ID NO: 4611923 - DNA, 23 bp, Homo sapiens
atgtgggctatgtagtcataata

SEQ ID NO: 4611924 - DNA, 17 bp, Homo sapiens
atgtgtatattcctttt

SEQ ID NO: 4611925 - DNA, 15 bp, Homo sapiens
atgtgtcaaaataaa

SEQ ID NO: 4611926 - DNA, 23 bp, Homo sapiens
atgtgtgcagagcagacaggcta

SEQ ID NO: 4611927 - DNA, 17 bp, Homo sapiens
atgtgtggtggcctcag

SEQ ID NO: 4611928 - DNA, 12 bp, Homo sapiens
atgtgtttcaaa

SEQ ID NO: 4611929 - DNA, 17 bp, Homo sapiens
atgttacttctctgagt

SEQ ID NO: 4611930 - DNA, 19 bp, Homo sapiens
atgttacttctctgagttt

SEQ ID NO: 4611931 - DNA, 19 bp, Homo sapiens
atgttagtaatggcagagc

SEQ ID NO: 4611932 - DNA, 22 bp, Homo sapiens
atgttagtaatggcagagcagt

SEQ ID NO: 4611933 - DNA, 12 bp, Homo sapiens
atgttcaaagac

SEQ ID NO: 4611934 - DNA, 16 bp, Homo sapiens
atgttcctaacaaaat

SEQ ID NO: 4611935 - DNA, 17 bp, Homo sapiens
atgttcctaacaaaatg

SEQ ID NO: 4611936 - DNA, 18 bp, Homo sapiens
atgttcctaacaaaatga

SEQ ID NO: 4611937 - DNA, 23 bp, Homo sapiens
atgttctaaaatgtcaaggcagt

SEQ ID NO: 4611938 - DNA, 14 bp, Homo sapiens
atgatggcaacaga

SEQ ID NO: 4611939 - DNA, 13 bp, Homo sapiens
atgatggcagagg

SEQ ID NO: 4611940 - DNA, 18 bp, Homo sapiens
atgatgtttccctctcct

SEQ ID NO: 4611941 - DNA, 20 bp, Homo sapiens
atgattgtttctcaaatctt

SEQ ID NO: 4611942 - DNA, 17 bp, Homo sapiens
atgatttcaatagcttt

SEQ ID NO: 4611943 - DNA, 17 bp, Homo sapiens
atgatttggccaggcct

SEQ ID NO: 4611944 - DNA, 17 bp, Homo sapiens
atgatttgtagtggaaa

SEQ ID NO: 4611945 - DNA, 17 bp, Homo sapiens
atgcaaaatatgtttaa

SEQ ID NO: 4611946 - DNA, 18 bp, Homo sapiens
atgcaaatcctatgtgat

SEQ ID NO: 4611947 - DNA, 16 bp, Homo sapiens
atgcaacaaatgtggc

SEQ ID NO: 4611948 - DNA, 17 bp, Homo sapiens
atgcaatgtgctactga

SEQ ID NO: 4611949 - DNA, 19 bp, Homo sapiens
atgcacatatggactctgc

SEQ ID NO: 4611950 - DNA, 14 bp, Homo sapiens
atgcacatccctgg

SEQ ID NO: 4611951 - DNA, 12 bp, Homo sapiens
atgcaccttgct

SEQ ID NO: 4611952 - DNA, 19 bp, Homo sapiens
atgcaccttgtgtctgtac

SEQ ID NO: 4611953 - DNA, 16 bp, Homo sapiens
atgcactgatgttgtg

SEQ ID NO: 4611954 - DNA, 22 bp, Homo sapiens
atgcacttttagaaatgcatat

SEQ ID NO: 4611955 - DNA, 18 bp, Homo sapiens
atgcagaaccacaaacaa

SEQ ID NO: 4611956 - DNA, 23 bp, Homo sapiens
atgcagaggtctccaaactgatt

SEQ ID NO: 4611957 - DNA, 22 bp, Homo sapiens
atgcagctcttcaacatgacat

SEQ ID NO: 4611958 - DNA, 15 bp, Homo sapiens
atgcagggcagtcat

SEQ ID NO: 4611959 - DNA, 11 bp, Homo sapiens
atgcaggtcag

SEQ ID NO: 4611960 - DNA, 23 bp, Homo sapiens
atgcatatgtcactagaatggat

SEQ ID NO: 4611961 - DNA, 19 bp, Homo sapiens
atgcatatttataagagaa

SEQ ID NO: 4611962 - DNA, 14 bp, Homo sapiens
atgcatatttgcca

SEQ ID NO: 4611963 - DNA, 15 bp, Homo sapiens
atgcatcagaaaggg

SEQ ID NO: 4611964 - DNA, 14 bp, Homo sapiens
atgcatgtgaagaa

SEQ ID NO: 4611965 - DNA, 14 bp, Homo sapiens
atgcatttgcattt

SEQ ID NO: 4611966 - DNA, 21 bp, Homo sapiens
atgccagctccatgttctccc

SEQ ID NO: 4611967 - DNA, 12 bp, Homo sapiens
atgccagtctca

SEQ ID NO: 4611968 - DNA, 13 bp, Homo sapiens
atgccagtctcat

SEQ ID NO: 4611969 - DNA, 21 bp, Homo sapiens
atgccagtctcattgtcacct

SEQ ID NO: 4611970 - DNA, 16 bp, Homo sapiens
atgccatttgtactga

SEQ ID NO: 4611971 - DNA, 14 bp, Homo sapiens
atgcccaaaactta

SEQ ID NO: 4611972 - DNA, 13 bp, Homo sapiens
atgcccagatgaa

SEQ ID NO: 4611973 - DNA, 24 bp, Homo sapiens
atgccccctccaggagagagccag

SEQ ID NO: 4611974 - DNA, 23 bp, Homo sapiens
atgccctgtgcaacctcttggcc

SEQ ID NO: 4611975 - DNA, 13 bp, Homo sapiens
atgcccttccccc

SEQ ID NO: 4611976 - DNA, 14 bp, Homo sapiens
atgcccttgctggg

SEQ ID NO: 4611977 - DNA, 15 bp, Homo sapiens
atgcccttgctgggc

SEQ ID NO: 4611978 - DNA, 19 bp, Homo sapiens
atgccgtcctgcagtcctt

SEQ ID NO: 4611979 - DNA, 15 bp, Homo sapiens
atgcctagagatatt

SEQ ID NO: 4611980 - DNA, 21 bp, Homo sapiens
atgcctagagatatttcaagc

SEQ ID NO: 4611981 - DNA, 20 bp, Homo sapiens
atgcctcactaatttttgta

SEQ ID NO: 4611982 - DNA, 15 bp, Homo sapiens
atgcctcctgtgggg

SEQ ID NO: 4611983 - DNA, 15 bp, Homo sapiens
atgcctcgctccctt

SEQ ID NO: 4611984 - DNA, 16 bp, Homo sapiens
atgcctcgctcccttc

SEQ ID NO: 4611985 - DNA, 12 bp, Homo sapiens
atgcctctgagg

SEQ ID NO: 4611986 - DNA, 14 bp, Homo sapiens
atgcctctgaggcc

SEQ ID NO: 4611987 - DNA, 20 bp, Homo sapiens
atgcctctgaggccagcctg

SEQ ID NO: 4611988 - DNA, 23 bp, Homo sapiens
atgcctctgaggccagcctggcc

SEQ ID NO: 4611989 - DNA, 20 bp, Homo sapiens
atgcctgcccattagagaag

SEQ ID NO: 4611990 - DNA, 12 bp, Homo sapiens
atgcctgtcctt

SEQ ID NO: 4611991 - DNA, 15 bp, Homo sapiens
atgccttaaaatgga

SEQ ID NO: 4611992 - DNA, 20 bp, Homo sapiens
atgccttcttattgctttta

SEQ ID NO: 4611993 - DNA, 22 bp, Homo sapiens
atgccttggggaggacaaaact

SEQ ID NO: 4611994 - DNA, 14 bp, Homo sapiens
atgcggatcctgct

SEQ ID NO: 4611995 - DNA, 21 bp, Homo sapiens
atgcgggccagtgctccagcc

SEQ ID NO: 4611996 - DNA, 18 bp, Homo sapiens
atgcggtagccagcacac

SEQ ID NO: 4611997 - DNA, 12 bp, Homo sapiens
atgcgtgggcag

SEQ ID NO: 4611998 - DNA, 23 bp, Homo sapiens
atgctaacaaagacaaaagtctg

SEQ ID NO: 4611999 - DNA, 16 bp, Homo sapiens
atgctagcacaatatt

SEQ ID NO: 4612000 - DNA, 22 bp, Homo sapiens
atgctagcacaatattcctatg

SEQ ID NO: 4612001 - DNA, 13 bp, Homo sapiens
atgctcactttat

SEQ ID NO: 4612002 - DNA, 15 bp, Homo sapiens
atgctcactttatta

SEQ ID NO: 4612003 - DNA, 17 bp, Homo sapiens
atgctcccaactccctt

SEQ ID NO: 4612004 - DNA, 20 bp, Homo sapiens
atgctcccaactcccttctg

SEQ ID NO: 4612005 - DNA, 21 bp, Homo sapiens
atgctcttgaaatattcagaa

SEQ ID NO: 4612006 - DNA, 15 bp, Homo sapiens
atgctgatcttttaa

SEQ ID NO: 4612007 - DNA, 17 bp, Homo sapiens
atgctgcaaaggagaag

SEQ ID NO: 4612008 - DNA, 13 bp, Homo sapiens
atgctggcaaagg

SEQ ID NO: 4612009 - DNA, 14 bp, Homo sapiens
atgctgggctgggc

SEQ ID NO: 4612010 - DNA, 17 bp, Homo sapiens
atgctgggctgggccct

SEQ ID NO: 4612011 - DNA, 18 bp, Homo sapiens
atgctgggctgggccctc

SEQ ID NO: 4612012 - DNA, 13 bp, Homo sapiens
atgctggtttttc

SEQ ID NO: 4612013 - DNA, 14 bp, Homo sapiens
atgctgtttctaag

SEQ ID NO: 4612014 - DNA, 20 bp, Homo sapiens
atgctgtttctaagaaaatg

SEQ ID NO: 4612015 - DNA, 24 bp, Homo sapiens
atgctgtttctaagaaaatgtagt

SEQ ID NO: 4612016 - DNA, 23 bp, Homo sapiens
atgcttacgtgatcctctcacct

SEQ ID NO: 4612017 - DNA, 20 bp, Homo sapiens
atgcttcattattcaagaat

SEQ ID NO: 4612018 - DNA, 19 bp, Homo sapiens
atgcttctatcagactcag

SEQ ID NO: 4612019 - DNA, 18 bp, Homo sapiens
atgcttgcataagagctt

SEQ ID NO: 4612020 - DNA, 15 bp, Homo sapiens
atggacacgagccac

SEQ ID NO: 4612021 - DNA, 16 bp, Homo sapiens
atggacacgagccaca

SEQ ID NO: 4612022 - DNA, 20 bp, Homo sapiens
atggacacgagccacaagct

SEQ ID NO: 4612023 - DNA, 13 bp, Homo sapiens
atggacatggtgg

SEQ ID NO: 4612024 - DNA, 22 bp, Homo sapiens
atggactgttacagactgaaag

SEQ ID NO: 4612025 - DNA, 15 bp, Homo sapiens
atggagaaagaagtg

SEQ ID NO: 4612026 - DNA, 13 bp, Homo sapiens
atggagagccctg

SEQ ID NO: 4612027 - DNA, 14 bp, Homo sapiens
atggagaggcttcc

SEQ ID NO: 4612028 - DNA, 14 bp, Homo sapiens
atggaggagccagg

SEQ ID NO: 4612029 - DNA, 15 bp, Homo sapiens
atggaggagccaggc

SEQ ID NO: 4612030 - DNA, 17 bp, Homo sapiens
atggaggagccaggccc

SEQ ID NO: 4612031 - DNA, 21 bp, Homo sapiens
atggaggagccaggccccacc

SEQ ID NO: 4612032 - DNA, 16 bp, Homo sapiens
atggaggccctcctgt

SEQ ID NO: 4612033 - DNA, 14 bp, Homo sapiens
atggaggggagagg

SEQ ID NO: 4612034 - DNA, 17 bp, Homo sapiens
atggaggtcccagccct

SEQ ID NO: 4612035 - DNA, 18 bp, Homo sapiens
atggaggtcccagccctg

SEQ ID NO: 4612036 - DNA, 15 bp, Homo sapiens
atggagtagcctgga

SEQ ID NO: 4612037 - DNA, 19 bp, Homo sapiens
atggagtagcctggactgt

SEQ ID NO: 4612038 - DNA, 21 bp, Homo sapiens
atggataaaataatgctgcaa

SEQ ID NO: 4612039 - DNA, 19 bp, Homo sapiens
atggatgcccagaggactc

SEQ ID NO: 4612040 - DNA, 12 bp, Homo sapiens
atggatggaaaa

SEQ ID NO: 4612041 - DNA, 22 bp, Homo sapiens
atggatgttttagccattgttg

SEQ ID NO: 4612042 - DNA, 18 bp, Homo sapiens
atggcaacattggacaga

SEQ ID NO: 4612043 - DNA, 19 bp, Homo sapiens
atggcaacattggacagaa

SEQ ID NO: 4612044 - DNA, 22 bp, Homo sapiens
atggcaacattggacagaaaat

SEQ ID NO: 4612045 - DNA, 13 bp, Homo sapiens
atggcagactctt

SEQ ID NO: 4612046 - DNA, 19 bp, Homo sapiens
atggcagatgtaggaggga

SEQ ID NO: 4612047 - DNA, 20 bp, Homo sapiens
atggcagatgtaggagggac

SEQ ID NO: 4612048 - DNA, 16 bp, Homo sapiens
atggcatcctgtgaag

SEQ ID NO: 4612049 - DNA, 23 bp, Homo sapiens
atggcatggagtatagtgcaaat

SEQ ID NO: 4612050 - DNA, 16 bp, Homo sapiens
attattttccttccat

SEQ ID NO: 4612051 - DNA, 14 bp, Homo sapiens
attatttttgtaga

SEQ ID NO: 4612052 - DNA, 20 bp, Homo sapiens
attcaaaaggtttttaaaag

SEQ ID NO: 4612053 - DNA, 21 bp, Homo sapiens
attcaaatcgtttatttcaca

SEQ ID NO: 4612054 - DNA, 14 bp, Homo sapiens
attcaactaaaaaa

SEQ ID NO: 4612055 - DNA, 19 bp, Homo sapiens
attcaactaatacatggtt

SEQ ID NO: 4612056 - DNA, 18 bp, Homo sapiens
attcaagaatgaaaaata

SEQ ID NO: 4612057 - DNA, 20 bp, Homo sapiens
attcaagagctagaaaaata

SEQ ID NO: 4612058 - DNA, 19 bp, Homo sapiens
attcaatcatttattcatt

SEQ ID NO: 4612059 - DNA, 24 bp, Homo sapiens
attcaattagtggtcataaaatag

SEQ ID NO: 4612060 - DNA, 20 bp, Homo sapiens
attcacagttttttaaaaat

SEQ ID NO: 4612061 - DNA, 23 bp, Homo sapiens
attcactcccaggtgagaattca

SEQ ID NO: 4612062 - DNA, 12 bp, Homo sapiens
attcacttcacg

SEQ ID NO: 4612063 - DNA, 12 bp, Homo sapiens
attcagaaaaaa

SEQ ID NO: 4612064 - DNA, 14 bp, Homo sapiens
attcagaaatgtgg

SEQ ID NO: 4612065 - DNA, 22 bp, Homo sapiens
attcagaggttttgttaggtta

SEQ ID NO: 4612066 - DNA, 17 bp, Homo sapiens
attcagattgttatcta

SEQ ID NO: 4612067 - DNA, 12 bp, Homo sapiens
attcagctcctt

SEQ ID NO: 4612068 - DNA, 15 bp, Homo sapiens
attcagctctggaga

SEQ ID NO: 4612069 - DNA, 17 bp, Homo sapiens
attcaggaaaaggcctg

SEQ ID NO: 4612070 - DNA, 22 bp, Homo sapiens
attcagtgggaattgcagcata

SEQ ID NO: 4612071 - DNA, 16 bp, Homo sapiens
attcatggagtagcct

SEQ ID NO: 4612072 - DNA, 19 bp, Homo sapiens
attcatggctacctcagaa

SEQ ID NO: 4612073 - DNA, 13 bp, Homo sapiens
attcatttttaag

SEQ ID NO: 4612074 - DNA, 15 bp, Homo sapiens
attccaactttcagg

SEQ ID NO: 4612075 - DNA, 14 bp, Homo sapiens
attccaagaaaata

SEQ ID NO: 4612076 - DNA, 11 bp, Homo sapiens
attcccacccc

SEQ ID NO: 4612077 - DNA, 14 bp, Homo sapiens
attccctctcccag

SEQ ID NO: 4612078 - DNA, 16 bp, Homo sapiens
attccctctcccaggc

SEQ ID NO: 4612079 - DNA, 17 bp, Homo sapiens
attcctaaagaaaaata

SEQ ID NO: 4612080 - DNA, 13 bp, Homo sapiens
attcctacagcac

SEQ ID NO: 4612081 - DNA, 23 bp, Homo sapiens
attcctacagcactactgggtgt

SEQ ID NO: 4612082 - DNA, 22 bp, Homo sapiens
attcctatgatggatggcagac

SEQ ID NO: 4612083 - DNA, 24 bp, Homo sapiens
attcctatgatggatggcagactc

SEQ ID NO: 4612084 - DNA, 20 bp, Homo sapiens
attccttcgaaaggccttca

SEQ ID NO: 4612085 - DNA, 20 bp, Homo sapiens
attccttttaaagaagcttt

SEQ ID NO: 4612086 - DNA, 23 bp, Homo sapiens
attcgaatggggtagaaacattg

SEQ ID NO: 4612087 - DNA, 17 bp, Homo sapiens
attcgagacagaacctt

SEQ ID NO: 4612088 - DNA, 14 bp, Homo sapiens
attcgcatgtttaa

SEQ ID NO: 4612089 - DNA, 14 bp, Homo sapiens
attcgtgagctggg

SEQ ID NO: 4612090 - DNA, 22 bp, Homo sapiens
attctactagcaggcaatgctg

SEQ ID NO: 4612091 - DNA, 22 bp, Homo sapiens
attctagataaccttgtttatt

SEQ ID NO: 4612092 - DNA, 23 bp, Homo sapiens
attctaggaaatcagaagtagtt

SEQ ID NO: 4612093 - DNA, 19 bp, Homo sapiens
attctcataattcctacag

SEQ ID NO: 4612094 - DNA, 11 bp, Homo sapiens
attctcctcct

SEQ ID NO: 4612095 - DNA, 16 bp, Homo sapiens
attctcctcctcctcc

SEQ ID NO: 4612096 - DNA, 18 bp, Homo sapiens
attctcctcctcctccct

SEQ ID NO: 4612097 - DNA, 23 bp, Homo sapiens
attctcctcctcctccctcctca

SEQ ID NO: 4612098 - DNA, 17 bp, Homo sapiens
attctctcccatcctgg

SEQ ID NO: 4612099 - DNA, 20 bp, Homo sapiens
attctctcccatcctggggc

SEQ ID NO: 4612100 - DNA, 14 bp, Homo sapiens
attctcttgaataa

SEQ ID NO: 4612101 - DNA, 12 bp, Homo sapiens
attctcttttaa

SEQ ID NO: 4612102 - DNA, 19 bp, Homo sapiens
attctcttttatctgttta

SEQ ID NO: 4612103 - DNA, 11 bp, Homo sapiens
attctgtcttg

SEQ ID NO: 4612104 - DNA, 21 bp, Homo sapiens
attctgtcttgttcattttga

SEQ ID NO: 4612105 - DNA, 22 bp, Homo sapiens
attctgtgtggtatattgttta

SEQ ID NO: 4612106 - DNA, 23 bp, Homo sapiens
attcttaccctgtacatatgtaa

SEQ ID NO: 4612107 - DNA, 14 bp, Homo sapiens
attcttattggaaa

SEQ ID NO: 4612108 - DNA, 16 bp, Homo sapiens
attctttataattgaa

SEQ ID NO: 4612109 - DNA, 13 bp, Homo sapiens
attctttattctt

SEQ ID NO: 4612110 - DNA, 14 bp, Homo sapiens
attctttgtatctt

SEQ ID NO: 4612111 - DNA, 19 bp, Homo sapiens
attgaaaaaaaaaatgttg

SEQ ID NO: 4612112 - DNA, 17 bp, Homo sapiens
attgaaaaactctttat

SEQ ID NO: 4612113 - DNA, 13 bp, Homo sapiens
attgaaaatatat

SEQ ID NO: 4612114 - DNA, 16 bp, Homo sapiens
attgaagtatattctt

SEQ ID NO: 4612115 - DNA, 21 bp, Homo sapiens
attgacagatcaagctgtgag

SEQ ID NO: 4612116 - DNA, 16 bp, Homo sapiens
attgacctggagggga

SEQ ID NO: 4612117 - DNA, 17 bp, Homo sapiens
attgactcttatttata

SEQ ID NO: 4612118 - DNA, 19 bp, Homo sapiens
attgactcttatttataga

SEQ ID NO: 4612119 - DNA, 19 bp, Homo sapiens
attgactttcagtaaacat

SEQ ID NO: 4612120 - DNA, 19 bp, Homo sapiens
attgagcatattttcttac

SEQ ID NO: 4612121 - DNA, 23 bp, Homo sapiens
attgagcatattttcttactttt

SEQ ID NO: 4612122 - DNA, 14 bp, Homo sapiens
attgagcttgcatg

SEQ ID NO: 4612123 - DNA, 21 bp, Homo sapiens
attgatactctttctaatgct

SEQ ID NO: 4612124 - DNA, 21 bp, Homo sapiens
attgatcaaatatagaaagtt

SEQ ID NO: 4612125 - DNA, 15 bp, Homo sapiens
attgatcataaactg

SEQ ID NO: 4612126 - DNA, 17 bp, Homo sapiens
attgcactcatcatatt

SEQ ID NO: 4612127 - DNA, 20 bp, Homo sapiens
attgcactgcttatatgcca

SEQ ID NO: 4612128 - DNA, 17 bp, Homo sapiens
attgcagacctgtcacc

SEQ ID NO: 4612129 - DNA, 19 bp, Homo sapiens
attgcagagtgaccagcac

SEQ ID NO: 4612130 - DNA, 13 bp, Homo sapiens
attgcatgtgact

SEQ ID NO: 4612131 - DNA, 14 bp, Homo sapiens
attgcatgtgactc

SEQ ID NO: 4612132 - DNA, 17 bp, Homo sapiens
attgccctatgctgtgc

SEQ ID NO: 4612133 - DNA, 14 bp, Homo sapiens
attgctcccaggat

SEQ ID NO: 4612134 - DNA, 19 bp, Homo sapiens
attgctctatgttagtata

SEQ ID NO: 4612135 - DNA, 15 bp, Homo sapiens
attgctctgttccca

SEQ ID NO: 4612136 - DNA, 14 bp, Homo sapiens
attgctgatgtagt

SEQ ID NO: 4612137 - DNA, 16 bp, Homo sapiens
attgctgatgtagtat

SEQ ID NO: 4612138 - DNA, 17 bp, Homo sapiens
attgctggggccaggcc

SEQ ID NO: 4612139 - DNA, 23 bp, Homo sapiens
attgctggggccaggccccatgg

SEQ ID NO: 4612140 - DNA, 14 bp, Homo sapiens
attgcttactgata

SEQ ID NO: 4612141 - DNA, 16 bp, Homo sapiens
attgcttgagcccaga

SEQ ID NO: 4612142 - DNA, 21 bp, Homo sapiens
attgctttaatttgatgggaa

SEQ ID NO: 4612143 - DNA, 17 bp, Homo sapiens
attgctttctgaaatta

SEQ ID NO: 4612144 - DNA, 14 bp, Homo sapiens
attggcatctgctt

SEQ ID NO: 4612145 - DNA, 14 bp, Homo sapiens
attgggcagcgccc

SEQ ID NO: 4612146 - DNA, 10 bp, Homo sapiens
attggtgtac

SEQ ID NO: 4612147 - DNA, 20 bp, Homo sapiens
attgtaaatatttactcttt

SEQ ID NO: 4612148 - DNA, 16 bp, Homo sapiens
attgtaaatcctgtgt

SEQ ID NO: 4612149 - DNA, 13 bp, Homo sapiens
attgtaatatgac

SEQ ID NO: 4612150 - DNA, 14 bp, Homo sapiens
attgtaatatgaca

SEQ ID NO: 4612151 - DNA, 15 bp, Homo sapiens
attgtaatatgacag

SEQ ID NO: 4612152 - DNA, 16 bp, Homo sapiens
attgtaatatgacaga

SEQ ID NO: 4612153 - DNA, 13 bp, Homo sapiens
attgtacagtttt

SEQ ID NO: 4612154 - DNA, 15 bp, Homo sapiens
attgtactgttcata

SEQ ID NO: 4612155 - DNA, 13 bp, Homo sapiens
attgtagacatgc

SEQ ID NO: 4612156 - DNA, 13 bp, Homo sapiens
attgtcacctctg

SEQ ID NO: 4612157 - DNA, 20 bp, Homo sapiens
attgtcagaaatattcttat

SEQ ID NO: 4612158 - DNA, 14 bp, Homo sapiens
attgtcagccttgc

SEQ ID NO: 4612159 - DNA, 14 bp, Homo sapiens
attgtcgtttttat

SEQ ID NO: 4612160 - DNA, 22 bp, Homo sapiens
attgtctcctatatatttctat

SEQ ID NO: 4612161 - DNA, 22 bp, Homo sapiens
attgtgaatcgattcccaagct

SEQ ID NO: 4612162 - DNA, 18 bp, Homo sapiens
atgttctgtcttcccaaa

SEQ ID NO: 4612163 - DNA, 23 bp, Homo sapiens
atgttctgtcttcccaaacccag

SEQ ID NO: 4612164 - DNA, 11 bp, Homo sapiens
atgttgagaag

SEQ ID NO: 4612165 - DNA, 18 bp, Homo sapiens
atgttgatcatgtacttt

SEQ ID NO: 4612166 - DNA, 16 bp, Homo sapiens
atgttgctctttcacc

SEQ ID NO: 4612167 - DNA, 20 bp, Homo sapiens
atgttggccaggctggtttc

SEQ ID NO: 4612168 - DNA, 17 bp, Homo sapiens
atgttgtaatatttctt

SEQ ID NO: 4612169 - DNA, 19 bp, Homo sapiens
atgttgtaatatttcttca

SEQ ID NO: 4612170 - DNA, 11 bp, Homo sapiens
atgttgtacaa

SEQ ID NO: 4612171 - DNA, 23 bp, Homo sapiens
atgttgtacttgaaaatgctata

SEQ ID NO: 4612172 - DNA, 15 bp, Homo sapiens
atgtttaaaagaaat

SEQ ID NO: 4612173 - DNA, 17 bp, Homo sapiens
atgtttaataaagcttt

SEQ ID NO: 4612174 - DNA, 15 bp, Homo sapiens
atgtttaatgtgaac

SEQ ID NO: 4612175 - DNA, 19 bp, Homo sapiens
atgtttaggggcaaacatc

SEQ ID NO: 4612176 - DNA, 22 bp, Homo sapiens
atgtttatcaaagagcacttga

SEQ ID NO: 4612177 - DNA, 21 bp, Homo sapiens
atgtttcattatgcactttta

SEQ ID NO: 4612178 - DNA, 11 bp, Homo sapiens
atgtttccccc

SEQ ID NO: 4612179 - DNA, 14 bp, Homo sapiens
atgtttcccccact

SEQ ID NO: 4612180 - DNA, 16 bp, Homo sapiens
atgtttcccccactcc

SEQ ID NO: 4612181 - DNA, 18 bp, Homo sapiens
atgtttccctctccttcc

SEQ ID NO: 4612182 - DNA, 13 bp, Homo sapiens
atgtttgaacaaa

SEQ ID NO: 4612183 - DNA, 14 bp, Homo sapiens
atgtttggatggtt

SEQ ID NO: 4612184 - DNA, 17 bp, Homo sapiens
atgtttgtgtctgtggt

SEQ ID NO: 4612185 - DNA, 12 bp, Homo sapiens
atgttttcatta

SEQ ID NO: 4612186 - DNA, 17 bp, Homo sapiens
atgttttcattatgttc

SEQ ID NO: 4612187 - DNA, 20 bp, Homo sapiens
atgttttccattgtttgaaa

SEQ ID NO: 4612188 - DNA, 14 bp, Homo sapiens
attaaaaatgttct

SEQ ID NO: 4612189 - DNA, 22 bp, Homo sapiens
attaaaaattacctttaatttt

SEQ ID NO: 4612190 - DNA, 22 bp, Homo sapiens
attaaaagaatgagtgaagtat

SEQ ID NO: 4612191 - DNA, 14 bp, Homo sapiens
attaaaatacattt

SEQ ID NO: 4612192 - DNA, 17 bp, Homo sapiens
attaaaatacattttaa

SEQ ID NO: 4612193 - DNA, 15 bp, Homo sapiens
attaaaatattttgg

SEQ ID NO: 4612194 - DNA, 20 bp, Homo sapiens
attaaacgtatgcatgtgaa

SEQ ID NO: 4612195 - DNA, 19 bp, Homo sapiens
attaaaggcttctctctca

SEQ ID NO: 4612196 - DNA, 18 bp, Homo sapiens
attaaatctagacattct

SEQ ID NO: 4612197 - DNA, 18 bp, Homo sapiens
attaaatgaacttatgta

SEQ ID NO: 4612198 - DNA, 11 bp, Homo sapiens
attaaattaca

SEQ ID NO: 4612199 - DNA, 22 bp, Homo sapiens
attaaattacacaattacactt

SEQ ID NO: 4612200 - DNA, 18 bp, Homo sapiens
attaaatttaattcttca

SEQ ID NO: 4612201 - DNA, 18 bp, Homo sapiens
attaacaacaataacact

SEQ ID NO: 4612202 - DNA, 21 bp, Homo sapiens
attaaccttttttgtcttatt

SEQ ID NO: 4612203 - DNA, 13 bp, Homo sapiens
attaactccctcc

SEQ ID NO: 4612204 - DNA, 18 bp, Homo sapiens
attaagcagaaacagcat

SEQ ID NO: 4612205 - DNA, 20 bp, Homo sapiens
attaagcattttgaaacaaa

SEQ ID NO: 4612206 - DNA, 17 bp, Homo sapiens
attaagggcattttacc

SEQ ID NO: 4612207 - DNA, 14 bp, Homo sapiens
attaagttgttaat

SEQ ID NO: 4612208 - DNA, 19 bp, Homo sapiens
attaagttgttaataaaag

SEQ ID NO: 4612209 - DNA, 21 bp, Homo sapiens
attaatatttaggagtctatt

SEQ ID NO: 4612210 - DNA, 11 bp, Homo sapiens
attaatcaaga

SEQ ID NO: 4612211 - DNA, 17 bp, Homo sapiens
attaatcaagagaaact

SEQ ID NO: 4612212 - DNA, 20 bp, Homo sapiens
attaatcaagagaaacttca

SEQ ID NO: 4612213 - DNA, 16 bp, Homo sapiens
attaatcatacaaact

SEQ ID NO: 4612214 - DNA, 18 bp, Homo sapiens
attaatcatacaaactct

SEQ ID NO: 4612215 - DNA, 12 bp, Homo sapiens
attaatcttgat

SEQ ID NO: 4612216 - DNA, 16 bp, Homo sapiens
attaatgcttagtgaa

SEQ ID NO: 4612217 - DNA, 13 bp, Homo sapiens
attaattaaacat

SEQ ID NO: 4612218 - DNA, 17 bp, Homo sapiens
attaattaaatgaactt

SEQ ID NO: 4612219 - DNA, 16 bp, Homo sapiens
attacaaacaagtgga

SEQ ID NO: 4612220 - DNA, 16 bp, Homo sapiens
attacagggcacaggc

SEQ ID NO: 4612221 - DNA, 19 bp, Homo sapiens
attacaggtgtgtgggcca

SEQ ID NO: 4612222 - DNA, 18 bp, Homo sapiens
attacataatctgtacaa

SEQ ID NO: 4612223 - DNA, 21 bp, Homo sapiens
attacataatctgtacaatga

SEQ ID NO: 4612224 - DNA, 14 bp, Homo sapiens
attaccatcttaat

SEQ ID NO: 4612225 - DNA, 15 bp, Homo sapiens
attaccatcttaatc

SEQ ID NO: 4612226 - DNA, 16 bp, Homo sapiens
attaccatcttaatct

SEQ ID NO: 4612227 - DNA, 17 bp, Homo sapiens
attaccatcttaatctt

SEQ ID NO: 4612228 - DNA, 14 bp, Homo sapiens
attacccccagtcc

SEQ ID NO: 4612229 - DNA, 23 bp, Homo sapiens
attacccccagtcctccctagct

SEQ ID NO: 4612230 - DNA, 20 bp, Homo sapiens
attacctcaggtgccaaccc

SEQ ID NO: 4612231 - DNA, 23 bp, Homo sapiens
attacgcaggtatttagaagcag

SEQ ID NO: 4612232 - DNA, 16 bp, Homo sapiens
attactctagtttatt

SEQ ID NO: 4612233 - DNA, 15 bp, Homo sapiens
attactcttaaggaa

SEQ ID NO: 4612234 - DNA, 16 bp, Homo sapiens
attactgaataatatc

SEQ ID NO: 4612235 - DNA, 13 bp, Homo sapiens
attactgggcctt

SEQ ID NO: 4612236 - DNA, 22 bp, Homo sapiens
attacttgctttcaattgacaa

SEQ ID NO: 4612237 - DNA, 11 bp, Homo sapiens
attagagaagt

SEQ ID NO: 4612238 - DNA, 13 bp, Homo sapiens
attagataatatt

SEQ ID NO: 4612239 - DNA, 15 bp, Homo sapiens
attagataatatttt

SEQ ID NO: 4612240 - DNA, 19 bp, Homo sapiens
attagcagccatattgtca

SEQ ID NO: 4612241 - DNA, 19 bp, Homo sapiens
attagtcgggcatgagtct

SEQ ID NO: 4612242 - DNA, 20 bp, Homo sapiens
attagtggtcataaaataga

SEQ ID NO: 4612243 - DNA, 20 bp, Homo sapiens
attagtgtgacagtttccaa

SEQ ID NO: 4612244 - DNA, 22 bp, Homo sapiens
attagtgtgacagtttccaaat

SEQ ID NO: 4612245 - DNA, 13 bp, Homo sapiens
attataaaaatta

SEQ ID NO: 4612246 - DNA, 15 bp, Homo sapiens
attataaaaattaca

SEQ ID NO: 4612247 - DNA, 15 bp, Homo sapiens
attataaatgtgttt

SEQ ID NO: 4612248 - DNA, 15 bp, Homo sapiens
attatacaccatttt

SEQ ID NO: 4612249 - DNA, 20 bp, Homo sapiens
attatacagacctaatatca

SEQ ID NO: 4612250 - DNA, 16 bp, Homo sapiens
attatacttgagattt

SEQ ID NO: 4612251 - DNA, 23 bp, Homo sapiens
attatacttgagattttcctcca

SEQ ID NO: 4612252 - DNA, 11 bp, Homo sapiens
attatagaaaa

SEQ ID NO: 4612253 - DNA, 18 bp, Homo sapiens
attatatattgcaaggtg

SEQ ID NO: 4612254 - DNA, 16 bp, Homo sapiens
attatatggcaggagc

SEQ ID NO: 4612255 - DNA, 21 bp, Homo sapiens
attatcattgctcccctgata

SEQ ID NO: 4612256 - DNA, 19 bp, Homo sapiens
attatccatcctctgagat

SEQ ID NO: 4612257 - DNA, 23 bp, Homo sapiens
attatgaagaatacccaggaaga

SEQ ID NO: 4612258 - DNA, 14 bp, Homo sapiens
attatgacatttct

SEQ ID NO: 4612259 - DNA, 21 bp, Homo sapiens
attatgacatttcttaaaact

SEQ ID NO: 4612260 - DNA, 22 bp, Homo sapiens
attatgacatttcttaaaactt

SEQ ID NO: 4612261 - DNA, 13 bp, Homo sapiens
attatgttcatgt

SEQ ID NO: 4612262 - DNA, 14 bp, Homo sapiens
attattatacttca

SEQ ID NO: 4612263 - DNA, 13 bp, Homo sapiens
attattattatta

SEQ ID NO: 4612264 - DNA, 16 bp, Homo sapiens
attattattgctgaag

SEQ ID NO: 4612265 - DNA, 13 bp, Homo sapiens
attattcaacaca

SEQ ID NO: 4612266 - DNA, 20 bp, Homo sapiens
attattcagaattatacaga

SEQ ID NO: 4612267 - DNA, 14 bp, Homo sapiens
attattctctttta

SEQ ID NO: 4612268 - DNA, 18 bp, Homo sapiens
attattctcttttatctg

SEQ ID NO: 4612269 - DNA, 21 bp, Homo sapiens
attattctcttttatctgttt

SEQ ID NO: 4612270 - DNA, 16 bp, Homo sapiens
attattgtagacatgc

SEQ ID NO: 4612271 - DNA, 15 bp, Homo sapiens
attatttgccttctg

SEQ ID NO: 4612272 - DNA, 20 bp, Homo sapiens
attattttagagttctaata

SEQ ID NO: 4612273 - DNA, 13 bp, Homo sapiens
attattttccttc

SEQ ID NO: 4612274 - DNA, 21 bp, Homo sapiens
tctgcattcatttttatagca

SEQ ID NO: 4612275 - DNA, 16 bp, Homo sapiens
tctgccagacctgcat

SEQ ID NO: 4612276 - DNA, 19 bp, Homo sapiens
tctgccagacctgcatggt

SEQ ID NO: 4612277 - DNA, 21 bp, Homo sapiens
tctgccagacctgcatggtca

SEQ ID NO: 4612278 - DNA, 21 bp, Homo sapiens
tctgccagcaggaataaagac

SEQ ID NO: 4612279 - DNA, 15 bp, Homo sapiens
tctgcccaccctcct

SEQ ID NO: 4612280 - DNA, 15 bp, Homo sapiens
tctgccccaggccct

SEQ ID NO: 4612281 - DNA, 13 bp, Homo sapiens
tctgccccttccc

SEQ ID NO: 4612282 - DNA, 18 bp, Homo sapiens
tctgccctcattactggg

SEQ ID NO: 4612283 - DNA, 21 bp, Homo sapiens
tctgccctcattactgggcct

SEQ ID NO: 4612284 - DNA, 18 bp, Homo sapiens
tctgccgccgcccgctgg

SEQ ID NO: 4612285 - DNA, 19 bp, Homo sapiens
tctgcctagagtgtagcct

SEQ ID NO: 4612286 - DNA, 12 bp, Homo sapiens
tctgcctcctgc

SEQ ID NO: 4612287 - DNA, 15 bp, Homo sapiens
tctgcctcctgcttt

SEQ ID NO: 4612288 - DNA, 22 bp, Homo sapiens
tctgcctcctgctttgggaaga

SEQ ID NO: 4612289 - DNA, 23 bp, Homo sapiens
tctgcctggagacaaggtgctaa

SEQ ID NO: 4612290 - DNA, 22 bp, Homo sapiens
tctgcctgggatgcccttcccc

SEQ ID NO: 4612291 - DNA, 13 bp, Homo sapiens
tctgcctgtctgg

SEQ ID NO: 4612292 - DNA, 23 bp, Homo sapiens
tctgccttaaacacacattgcag

SEQ ID NO: 4612293 - DNA, 18 bp, Homo sapiens
tctgcgagaatgaacata

SEQ ID NO: 4612294 - DNA, 14 bp, Homo sapiens
tctgcgcgttcctc

SEQ ID NO: 4612295 - DNA, 14 bp, Homo sapiens
tctgctcagctctg

SEQ ID NO: 4612296 - DNA, 16 bp, Homo sapiens
tctgctcagctctggg

SEQ ID NO: 4612297 - DNA, 12 bp, Homo sapiens
tctgctctggaa

SEQ ID NO: 4612298 - DNA, 14 bp, Homo sapiens
tctgctgtttacaa

SEQ ID NO: 4612299 - DNA, 13 bp, Homo sapiens
tctgcttcccagg

SEQ ID NO: 4612300 - DNA, 16 bp, Homo sapiens
tctgcttccgttcctc

SEQ ID NO: 4612301 - DNA, 13 bp, Homo sapiens
tctgcttgacaga

SEQ ID NO: 4612302 - DNA, 21 bp, Homo sapiens
tctgcttgctcccaagcccct

SEQ ID NO: 4612303 - DNA, 17 bp, Homo sapiens
tctgcttgtcaaaagaa

SEQ ID NO: 4612304 - DNA, 14 bp, Homo sapiens
tctgcttttcctct

SEQ ID NO: 4612305 - DNA, 18 bp, Homo sapiens
tctgcttttcctctgcct

SEQ ID NO: 4612306 - DNA, 16 bp, Homo sapiens
tctggaaataatatca

SEQ ID NO: 4612307 - DNA, 19 bp, Homo sapiens
tctggaaatttagagttct

SEQ ID NO: 4612308 - DNA, 18 bp, Homo sapiens
tctggagtgagaggcccc

SEQ ID NO: 4612309 - DNA, 17 bp, Homo sapiens
tctggattaggtctctg

SEQ ID NO: 4612310 - DNA, 11 bp, Homo sapiens
tctggcagcca

SEQ ID NO: 4612311 - DNA, 12 bp, Homo sapiens
tctggcagccac

SEQ ID NO: 4612312 - DNA, 15 bp, Homo sapiens
tctggcagccacact

SEQ ID NO: 4612313 - DNA, 21 bp, Homo sapiens
tctggcagccacacttctcag

SEQ ID NO: 4612314 - DNA, 23 bp, Homo sapiens
tctggcagccacacttctcagga

SEQ ID NO: 4612315 - DNA, 16 bp, Homo sapiens
tctggcagcctcccat

SEQ ID NO: 4612316 - DNA, 21 bp, Homo sapiens
tctggcagcctcccatccagg

SEQ ID NO: 4612317 - DNA, 21 bp, Homo sapiens
tctggccatatttactacctt

SEQ ID NO: 4612318 - DNA, 15 bp, Homo sapiens
tctggctccctgccc

SEQ ID NO: 4612319 - DNA, 20 bp, Homo sapiens
tctggcttcagcccccacca

SEQ ID NO: 4612320 - DNA, 17 bp, Homo sapiens
tctgggaaacagtcccg

SEQ ID NO: 4612321 - DNA, 21 bp, Homo sapiens
tctgggaagtcctagcccctc

SEQ ID NO: 4612322 - DNA, 17 bp, Homo sapiens
tctgggaccccagctgc

SEQ ID NO: 4612323 - DNA, 18 bp, Homo sapiens
tctgggaccccagctgct

SEQ ID NO: 4612324 - DNA, 21 bp, Homo sapiens
tctgggccattctccacagca

SEQ ID NO: 4612325 - DNA, 16 bp, Homo sapiens
tctgggctctggactc

SEQ ID NO: 4612326 - DNA, 22 bp, Homo sapiens
tctgggctgtaacgtggcactg

SEQ ID NO: 4612327 - DNA, 22 bp, Homo sapiens
tctggggaggcaggcattcctg

SEQ ID NO: 4612328 - DNA, 15 bp, Homo sapiens
tctggggctgtgtta

SEQ ID NO: 4612329 - DNA, 22 bp, Homo sapiens
tctggggtctttttatgcattt

SEQ ID NO: 4612330 - DNA, 15 bp, Homo sapiens
tctggggttggaagt

SEQ ID NO: 4612331 - DNA, 11 bp, Homo sapiens
tctgggtcaga

SEQ ID NO: 4612332 - DNA, 15 bp, Homo sapiens
tctgggtcagaccca

SEQ ID NO: 4612333 - DNA, 21 bp, Homo sapiens
tctggtcaacctcctggacat

SEQ ID NO: 4612334 - DNA, 14 bp, Homo sapiens
tctgtagtgagata

SEQ ID NO: 4612335 - DNA, 19 bp, Homo sapiens
tctgtatataagttgctgt

SEQ ID NO: 4612336 - DNA, 17 bp, Homo sapiens
tctgtatcactctgtgt

SEQ ID NO: 4612337 - DNA, 21 bp, Homo sapiens
tctgtatccccagtgcccggt

SEQ ID NO: 4612338 - DNA, 19 bp, Homo sapiens
tctgtcagtcacagccacc

SEQ ID NO: 4612339 - DNA, 20 bp, Homo sapiens
tctgtccgttcacatgtgtg

SEQ ID NO: 4612340 - DNA, 22 bp, Homo sapiens
tctgtctcgagcgccctgcaga

SEQ ID NO: 4612341 - DNA, 15 bp, Homo sapiens
tctgtctgctctgca

SEQ ID NO: 4612342 - DNA, 17 bp, Homo sapiens
tctgtctgctctgcata

SEQ ID NO: 4612343 - DNA, 22 bp, Homo sapiens
tctgtcttcccaaacccagtct

SEQ ID NO: 4612344 - DNA, 22 bp, Homo sapiens
tctgtctttgcggggcctgtct

SEQ ID NO: 4612345 - DNA, 17 bp, Homo sapiens
tctgtgaacagagagac

SEQ ID NO: 4612346 - DNA, 13 bp, Homo sapiens
tctgtgaactgtg

SEQ ID NO: 4612347 - DNA, 16 bp, Homo sapiens
tctgtgacccctcctt

SEQ ID NO: 4612348 - DNA, 20 bp, Homo sapiens
tctgtgacccctccttgtca

SEQ ID NO: 4612349 - DNA, 17 bp, Homo sapiens
tctgtgccagagcctgg

SEQ ID NO: 4612350 - DNA, 18 bp, Homo sapiens
tctgtgccatagaacaag

SEQ ID NO: 4612351 - DNA, 15 bp, Homo sapiens
tctgtgtacaaagaa

SEQ ID NO: 4612352 - DNA, 16 bp, Homo sapiens
tctgtgtacaaagaaa

SEQ ID NO: 4612353 - DNA, 23 bp, Homo sapiens
tctgtgtacatgtgtgcagagca

SEQ ID NO: 4612354 - DNA, 19 bp, Homo sapiens
tctgttcatttcacacagt

SEQ ID NO: 4612355 - DNA, 14 bp, Homo sapiens
tctgttctacccgt

SEQ ID NO: 4612356 - DNA, 12 bp, Homo sapiens
tctgttgaaata

SEQ ID NO: 4612357 - DNA, 17 bp, Homo sapiens
tctgttgaaataaaaca

SEQ ID NO: 4612358 - DNA, 13 bp, Homo sapiens
tctgttgcctcct

SEQ ID NO: 4612359 - DNA, 16 bp, Homo sapiens
tctgttgtcaccttca

SEQ ID NO: 4612360 - DNA, 22 bp, Homo sapiens
tctgtttaaagcatatagagat

SEQ ID NO: 4612361 - DNA, 14 bp, Homo sapiens
tctgtttcctggcc

SEQ ID NO: 4612362 - DNA, 17 bp, Homo sapiens
tctgttttgtatcttaa

SEQ ID NO: 4612363 - DNA, 20 bp, Homo sapiens
tcttaaaacttgtggttgaa

SEQ ID NO: 4612364 - DNA, 12 bp, Homo sapiens
tcttaaaagtac

SEQ ID NO: 4612365 - DNA, 17 bp, Homo sapiens
tcttaaaggacataaaa

SEQ ID NO: 4612366 - DNA, 23 bp, Homo sapiens
tcttaactggcctaaatttcttc

SEQ ID NO: 4612367 - DNA, 16 bp, Homo sapiens
tcttaatctttatttt

SEQ ID NO: 4612368 - DNA, 19 bp, Homo sapiens
tcttaccattaacattttt

SEQ ID NO: 4612369 - DNA, 14 bp, Homo sapiens
tcttactaatgtaa

SEQ ID NO: 4612370 - DNA, 16 bp, Homo sapiens
tcttactaatgtaaaa

SEQ ID NO: 4612371 - DNA, 15 bp, Homo sapiens
tcttacttggaactg

SEQ ID NO: 4612372 - DNA, 14 bp, Homo sapiens
tcttagactcgcct

SEQ ID NO: 4612373 - DNA, 11 bp, Homo sapiens
tcttagcatgg

SEQ ID NO: 4612374 - DNA, 15 bp, Homo sapiens
tcttagctttgaaac

SEQ ID NO: 4612375 - DNA, 22 bp, Homo sapiens
tcttatacaacagcaaaccctg

SEQ ID NO: 4612376 - DNA, 17 bp, Homo sapiens
tcttatgcaaaatggaa

SEQ ID NO: 4612377 - DNA, 13 bp, Homo sapiens
tcttatgggggtg

SEQ ID NO: 4612378 - DNA, 16 bp, Homo sapiens
tcttattggaaatgta

SEQ ID NO: 4612379 - DNA, 21 bp, Homo sapiens
tcttattgggatatcatttta

SEQ ID NO: 4612380 - DNA, 14 bp, Homo sapiens
tcttatttatagaa

SEQ ID NO: 4612381 - DNA, 14 bp, Homo sapiens
tcttcaacatgaca

SEQ ID NO: 4612382 - DNA, 14 bp, Homo sapiens
tcttcaatagctaa

SEQ ID NO: 4612383 - DNA, 23 bp, Homo sapiens
tcttcacctgattcaactaaaaa

SEQ ID NO: 4612384 - DNA, 16 bp, Homo sapiens
tcttcagtgactcctg

SEQ ID NO: 4612385 - DNA, 16 bp, Homo sapiens
tctcaggacacaggcc

SEQ ID NO: 4612386 - DNA, 17 bp, Homo sapiens
tctcaggacacaggcct

SEQ ID NO: 4612387 - DNA, 19 bp, Homo sapiens
tctcaggacacaggcctgt

SEQ ID NO: 4612388 - DNA, 16 bp, Homo sapiens
tctcaggagatggagg

SEQ ID NO: 4612389 - DNA, 23 bp, Homo sapiens
tctcaggatatccttatcagagc

SEQ ID NO: 4612390 - DNA, 17 bp, Homo sapiens
tctcagtttctgcctgg

SEQ ID NO: 4612391 - DNA, 18 bp, Homo sapiens
tctcataattcctacagc

SEQ ID NO: 4612392 - DNA, 20 bp, Homo sapiens
tctcataattcctacagcac

SEQ ID NO: 4612393 - DNA, 22 bp, Homo sapiens
tctcatagaggaaattcaaatc

SEQ ID NO: 4612394 - DNA, 11 bp, Homo sapiens
tctcatatatt

SEQ ID NO: 4612395 - DNA, 16 bp, Homo sapiens
tctcatccttttggat

SEQ ID NO: 4612396 - DNA, 18 bp, Homo sapiens
tctcatgcccctggctgg

SEQ ID NO: 4612397 - DNA, 19 bp, Homo sapiens
tctcatggtacttcctctg

SEQ ID NO: 4612398 - DNA, 20 bp, Homo sapiens
tctcatggtacttcctctgt

SEQ ID NO: 4612399 - DNA, 14 bp, Homo sapiens
tctcattgtcacct

SEQ ID NO: 4612400 - DNA, 16 bp, Homo sapiens
tctcattgtcacctct

SEQ ID NO: 4612401 - DNA, 21 bp, Homo sapiens
tctcatttccagcttctcagt

SEQ ID NO: 4612402 - DNA, 16 bp, Homo sapiens
tctcatttgggctaga

SEQ ID NO: 4612403 - DNA, 14 bp, Homo sapiens
tctccaccctccca

SEQ ID NO: 4612404 - DNA, 20 bp, Homo sapiens
tctccaggggcctgcagaag

SEQ ID NO: 4612405 - DNA, 23 bp, Homo sapiens
tctccaggggcctgcagaaggaa

SEQ ID NO: 4612406 - DNA, 21 bp, Homo sapiens
tctccataaccccacccttgc

SEQ ID NO: 4612407 - DNA, 22 bp, Homo sapiens
tctccataaccccacccttgcc

SEQ ID NO: 4612408 - DNA, 13 bp, Homo sapiens
tctccatgctgca

SEQ ID NO: 4612409 - DNA, 15 bp, Homo sapiens
tctccatgctgcaaa

SEQ ID NO: 4612410 - DNA, 20 bp, Homo sapiens
tctccatggccaccttttca

SEQ ID NO: 4612411 - DNA, 14 bp, Homo sapiens
tctccattccctag

SEQ ID NO: 4612412 - DNA, 17 bp, Homo sapiens
tctccatttaagacaca

SEQ ID NO: 4612413 - DNA, 15 bp, Homo sapiens
tctccattttagccc

SEQ ID NO: 4612414 - DNA, 14 bp, Homo sapiens
tctcccacatgagg

SEQ ID NO: 4612415 - DNA, 20 bp, Homo sapiens
tctcccaggccccatgacct

SEQ ID NO: 4612416 - DNA, 23 bp, Homo sapiens
tctcccaggccccatgacctcca

SEQ ID NO: 4612417 - DNA, 24 bp, Homo sapiens
tctcccatcctggggcagcactcc

SEQ ID NO: 4612418 - DNA, 16 bp, Homo sapiens
tctccctgcctcacat

SEQ ID NO: 4612419 - DNA, 15 bp, Homo sapiens
tctcccttccacctc

SEQ ID NO: 4612420 - DNA, 15 bp, Homo sapiens
tctcctctttgagac

SEQ ID NO: 4612421 - DNA, 16 bp, Homo sapiens
tctcctgatcctgcaa

SEQ ID NO: 4612422 - DNA, 19 bp, Homo sapiens
tctcctgccagcccagctg

SEQ ID NO: 4612423 - DNA, 15 bp, Homo sapiens
tctcctgcctcagcc

SEQ ID NO: 4612424 - DNA, 21 bp, Homo sapiens
tctcctggactggttatcttg

SEQ ID NO: 4612425 - DNA, 16 bp, Homo sapiens
tctcctggcccctgcc

SEQ ID NO: 4612426 - DNA, 13 bp, Homo sapiens
tctcctggcttcc

SEQ ID NO: 4612427 - DNA, 15 bp, Homo sapiens
tctcctggcttccca

SEQ ID NO: 4612428 - DNA, 23 bp, Homo sapiens
tctcctggcttcccatccccagc

SEQ ID NO: 4612429 - DNA, 22 bp, Homo sapiens
tctcctttttattttaggcact

SEQ ID NO: 4612430 - DNA, 14 bp, Homo sapiens
tctcgaccctgtcc

SEQ ID NO: 4612431 - DNA, 18 bp, Homo sapiens
tctcgaccggccctgcat

SEQ ID NO: 4612432 - DNA, 13 bp, Homo sapiens
tctctagctttgt

SEQ ID NO: 4612433 - DNA, 22 bp, Homo sapiens
tctctaggtgtcaggagaaagt

SEQ ID NO: 4612434 - DNA, 13 bp, Homo sapiens
tctctatttgaga

SEQ ID NO: 4612435 - DNA, 23 bp, Homo sapiens
tctctattttcataatcagtaaa

SEQ ID NO: 4612436 - DNA, 15 bp, Homo sapiens
tctctcaaattgtca

SEQ ID NO: 4612437 - DNA, 17 bp, Homo sapiens
tctctcatctaactgat

SEQ ID NO: 4612438 - DNA, 17 bp, Homo sapiens
tctctcccatcctgggg

SEQ ID NO: 4612439 - DNA, 23 bp, Homo sapiens
tctctcccttacccatcttgctt

SEQ ID NO: 4612440 - DNA, 22 bp, Homo sapiens
tctctcctggactggttatctt

SEQ ID NO: 4612441 - DNA, 15 bp, Homo sapiens
tctctctacagtgcc

SEQ ID NO: 4612442 - DNA, 15 bp, Homo sapiens
tctctgaattttcag

SEQ ID NO: 4612443 - DNA, 13 bp, Homo sapiens
tctctgcctggca

SEQ ID NO: 4612444 - DNA, 17 bp, Homo sapiens
tctctgcttccgttcct

SEQ ID NO: 4612445 - DNA, 20 bp, Homo sapiens
tctctgcttccgttcctccc

SEQ ID NO: 4612446 - DNA, 14 bp, Homo sapiens
tctctggttgtcta

SEQ ID NO: 4612447 - DNA, 17 bp, Homo sapiens
tctctgtgaatccatgg

SEQ ID NO: 4612448 - DNA, 21 bp, Homo sapiens
tctcttagagattttcatttt

SEQ ID NO: 4612449 - DNA, 17 bp, Homo sapiens
tctcttcggcagggagg

SEQ ID NO: 4612450 - DNA, 19 bp, Homo sapiens
tctcttgaaacctgttaaa

SEQ ID NO: 4612451 - DNA, 18 bp, Homo sapiens
tctcttggctggcttcct

SEQ ID NO: 4612452 - DNA, 18 bp, Homo sapiens
tctctttctgtttcctgg

SEQ ID NO: 4612453 - DNA, 20 bp, Homo sapiens
tctctttctttctctttctg

SEQ ID NO: 4612454 - DNA, 22 bp, Homo sapiens
tctgaaagaattatttgccttc

SEQ ID NO: 4612455 - DNA, 17 bp, Homo sapiens
tctgaagaaggaaggcc

SEQ ID NO: 4612456 - DNA, 19 bp, Homo sapiens
tctgaagaaggaaggcctg

SEQ ID NO: 4612457 - DNA, 21 bp, Homo sapiens
tctgaagaaggaaggcctgag

SEQ ID NO: 4612458 - DNA, 19 bp, Homo sapiens
tctgaagactgagaacttt

SEQ ID NO: 4612459 - DNA, 19 bp, Homo sapiens
tctgaagatcagaacattc

SEQ ID NO: 4612460 - DNA, 16 bp, Homo sapiens
tctgaataacactgga

SEQ ID NO: 4612461 - DNA, 12 bp, Homo sapiens
tctgaatgtttg

SEQ ID NO: 4612462 - DNA, 19 bp, Homo sapiens
tctgaatgtttgtgtctgt

SEQ ID NO: 4612463 - DNA, 15 bp, Homo sapiens
tctgacagtagctct

SEQ ID NO: 4612464 - DNA, 17 bp, Homo sapiens
tctgactagtagatttc

SEQ ID NO: 4612465 - DNA, 20 bp, Homo sapiens
tctgactagtagatttctat

SEQ ID NO: 4612466 - DNA, 16 bp, Homo sapiens
tctgactgccaagcca

SEQ ID NO: 4612467 - DNA, 17 bp, Homo sapiens
tctgactgccaagccag

SEQ ID NO: 4612468 - DNA, 12 bp, Homo sapiens
tctgactgcccc

SEQ ID NO: 4612469 - DNA, 20 bp, Homo sapiens
tctgacttaagctgcctcaa

SEQ ID NO: 4612470 - DNA, 24 bp, Homo sapiens
tctgagaagctctgaagaactctc

SEQ ID NO: 4612471 - DNA, 14 bp, Homo sapiens
tctgagaggccctg

SEQ ID NO: 4612472 - DNA, 18 bp, Homo sapiens
tctgagaggccctggatc

SEQ ID NO: 4612473 - DNA, 19 bp, Homo sapiens
tctgagatgctcactttat

SEQ ID NO: 4612474 - DNA, 21 bp, Homo sapiens
tctgagatgctcactttatta

SEQ ID NO: 4612475 - DNA, 17 bp, Homo sapiens
tctgaggactcctgagg

SEQ ID NO: 4612476 - DNA, 22 bp, Homo sapiens
tctgaggatagtagttaaataa

SEQ ID NO: 4612477 - DNA, 23 bp, Homo sapiens
tctgaggatagtagttaaataac

SEQ ID NO: 4612478 - DNA, 15 bp, Homo sapiens
tctgaggccagcctg

SEQ ID NO: 4612479 - DNA, 17 bp, Homo sapiens
tctgaggccagcctggc

SEQ ID NO: 4612480 - DNA, 19 bp, Homo sapiens
tctgaggccagcctggcct

SEQ ID NO: 4612481 - DNA, 15 bp, Homo sapiens
tctgaggtcctgagc

SEQ ID NO: 4612482 - DNA, 16 bp, Homo sapiens
tctgaggtcctgagca

SEQ ID NO: 4612483 - DNA, 17 bp, Homo sapiens
tctgaggtcctgagcac

SEQ ID NO: 4612484 - DNA, 21 bp, Homo sapiens
tctgaggtcctgagcactgcc

SEQ ID NO: 4612485 - DNA, 17 bp, Homo sapiens
tctgagtggcttcactc

SEQ ID NO: 4612486 - DNA, 21 bp, Homo sapiens
tctgagtggcttcactcctgc

SEQ ID NO: 4612487 - DNA, 21 bp, Homo sapiens
tctgatatgtatccatcagga

SEQ ID NO: 4612488 - DNA, 19 bp, Homo sapiens
tctgattatacaccatttt

SEQ ID NO: 4612489 - DNA, 22 bp, Homo sapiens
tctgattatacaccatttttga

SEQ ID NO: 4612490 - DNA, 14 bp, Homo sapiens
tctgattttgaggt

SEQ ID NO: 4612491 - DNA, 18 bp, Homo sapiens
tctgcaaagtggcaggga

SEQ ID NO: 4612492 - DNA, 12 bp, Homo sapiens
tctgcacatgtc

SEQ ID NO: 4612493 - DNA, 16 bp, Homo sapiens
tctgcagcattgaagt

SEQ ID NO: 4612494 - DNA, 18 bp, Homo sapiens
tctgcagcattgaagtat

SEQ ID NO: 4612495 - DNA, 18 bp, Homo sapiens
tcttcagtgactcctgct

SEQ ID NO: 4612496 - DNA, 19 bp, Homo sapiens
tcttcagtgactcctgctg

SEQ ID NO: 4612497 - DNA, 18 bp, Homo sapiens
tcttcagttctctactcc

SEQ ID NO: 4612498 - DNA, 19 bp, Homo sapiens
tcttcatttggaggaatca

SEQ ID NO: 4612499 - DNA, 21 bp, Homo sapiens
tcttccactccttctctcact

SEQ ID NO: 4612500 - DNA, 20 bp, Homo sapiens
tcttccccaacgaaaagcac

SEQ ID NO: 4612501 - DNA, 11 bp, Homo sapiens
tcttcccttgc

SEQ ID NO: 4612502 - DNA, 12 bp, Homo sapiens
tcttcctgccct

SEQ ID NO: 4612503 - DNA, 14 bp, Homo sapiens
tcttcctgcccttg

SEQ ID NO: 4612504 - DNA, 13 bp, Homo sapiens
tcttcctgtggct

SEQ ID NO: 4612505 - DNA, 14 bp, Homo sapiens
tcttcctgtggctc

SEQ ID NO: 4612506 - DNA, 15 bp, Homo sapiens
tcttcctgtggctcc

SEQ ID NO: 4612507 - DNA, 17 bp, Homo sapiens
tcttcctgtggctccct

SEQ ID NO: 4612508 - DNA, 20 bp, Homo sapiens
tcttcctgtggctccctctc

SEQ ID NO: 4612509 - DNA, 14 bp, Homo sapiens
tcttctaccctttt

SEQ ID NO: 4612510 - DNA, 10 bp, Homo sapiens
tcttctatta

SEQ ID NO: 4612511 - DNA, 14 bp, Homo sapiens
tcttctcagccact

SEQ ID NO: 4612512 - DNA, 20 bp, Homo sapiens
tcttctccattccctagcag

SEQ ID NO: 4612513 - DNA, 20 bp, Homo sapiens
tcttctctcttgattgattt

SEQ ID NO: 4612514 - DNA, 14 bp, Homo sapiens
tcttctggtagtgt

SEQ ID NO: 4612515 - DNA, 17 bp, Homo sapiens
tcttctggtttcccttt

SEQ ID NO: 4612516 - DNA, 18 bp, Homo sapiens
tcttgaaaaagtattgtt

SEQ ID NO: 4612517 - DNA, 16 bp, Homo sapiens
tcttgaaatattcaga

SEQ ID NO: 4612518 - DNA, 20 bp, Homo sapiens
tcttgaaatattcagaaatt

SEQ ID NO: 4612519 - DNA, 14 bp, Homo sapiens
tcttgaactcctga

SEQ ID NO: 4612520 - DNA, 17 bp, Homo sapiens
tcttgagcaagttcctt

SEQ ID NO: 4612521 - DNA, 19 bp, Homo sapiens
tcttgagtataagaaatgc

SEQ ID NO: 4612522 - DNA, 20 bp, Homo sapiens
tcttgatcggaaagctcttc

SEQ ID NO: 4612523 - DNA, 16 bp, Homo sapiens
tcttgattgattttta

SEQ ID NO: 4612524 - DNA, 19 bp, Homo sapiens
tcttgatttcacatttcta

SEQ ID NO: 4612525 - DNA, 16 bp, Homo sapiens
tcttgcaaagccttta

SEQ ID NO: 4612526 - DNA, 13 bp, Homo sapiens
tcttgctcctgct

SEQ ID NO: 4612527 - DNA, 15 bp, Homo sapiens
tcttgctcctgcttc

SEQ ID NO: 4612528 - DNA, 14 bp, Homo sapiens
tcttgcttcagtca

SEQ ID NO: 4612529 - DNA, 14 bp, Homo sapiens
tcttgctttcttta

SEQ ID NO: 4612530 - DNA, 17 bp, Homo sapiens
tcttggcaatattcctt

SEQ ID NO: 4612531 - DNA, 16 bp, Homo sapiens
tcttggcatgcatctt

SEQ ID NO: 4612532 - DNA, 19 bp, Homo sapiens
tcttggctgcctgtgggct

SEQ ID NO: 4612533 - DNA, 15 bp, Homo sapiens
tcttggcttaatcat

SEQ ID NO: 4612534 - DNA, 16 bp, Homo sapiens
tcttggcttaatcatt

SEQ ID NO: 4612535 - DNA, 18 bp, Homo sapiens
tcttggcttaatcatttt

SEQ ID NO: 4612536 - DNA, 19 bp, Homo sapiens
tcttggcttaatcattttc

SEQ ID NO: 4612537 - DNA, 12 bp, Homo sapiens
tcttgggaaata

SEQ ID NO: 4612538 - DNA, 22 bp, Homo sapiens
tcttgggaacagggttactgta

SEQ ID NO: 4612539 - DNA, 20 bp, Homo sapiens
tcttgggcctcaggctctgc

SEQ ID NO: 4612540 - DNA, 21 bp, Homo sapiens
tcttggggacatctctttgaa

SEQ ID NO: 4612541 - DNA, 21 bp, Homo sapiens
tcttggggccactttcagagc

SEQ ID NO: 4612542 - DNA, 17 bp, Homo sapiens
tcttgtaaagactggtt

SEQ ID NO: 4612543 - DNA, 24 bp, Homo sapiens
tcttgtacatgtgtagcctgtgca

SEQ ID NO: 4612544 - DNA, 14 bp, Homo sapiens
tcttgtattcatga

SEQ ID NO: 4612545 - DNA, 19 bp, Homo sapiens
tcttgtcacccaggctgga

SEQ ID NO: 4612546 - DNA, 13 bp, Homo sapiens
tcttgtcagacat

SEQ ID NO: 4612547 - DNA, 17 bp, Homo sapiens
tcttgtcagtgtagaca

SEQ ID NO: 4612548 - DNA, 20 bp, Homo sapiens
tcttgtgtatttctctgtga

SEQ ID NO: 4612549 - DNA, 18 bp, Homo sapiens
tcttgtgttaacttgcct

SEQ ID NO: 4612550 - DNA, 12 bp, Homo sapiens
tcttgttattat

SEQ ID NO: 4612551 - DNA, 13 bp, Homo sapiens
tcttgttattatt

SEQ ID NO: 4612552 - DNA, 20 bp, Homo sapiens
tcttgttgaagtgctgtttt

SEQ ID NO: 4612553 - DNA, 13 bp, Homo sapiens
tcttgtttcattt

SEQ ID NO: 4612554 - DNA, 22 bp, Homo sapiens
tctttaaaaaaaaatcttgtgt

SEQ ID NO: 4612555 - DNA, 21 bp, Homo sapiens
tctttaaaatttaagtatctt

SEQ ID NO: 4612556 - DNA, 14 bp, Homo sapiens
tctttaaactatgt

SEQ ID NO: 4612557 - DNA, 16 bp, Homo sapiens
tctttaaatgctgctt

SEQ ID NO: 4612558 - DNA, 12 bp, Homo sapiens
tctttagaattt

SEQ ID NO: 4612559 - DNA, 16 bp, Homo sapiens
tctttattctttacta

SEQ ID NO: 4612560 - DNA, 20 bp, Homo sapiens
tctttcagctgaattatatt

SEQ ID NO: 4612561 - DNA, 23 bp, Homo sapiens
tctttcagtacttttttaaatat

SEQ ID NO: 4612562 - DNA, 15 bp, Homo sapiens
tctttccacttgccc

SEQ ID NO: 4612563 - DNA, 20 bp, Homo sapiens
tctttccacttgccctgtgt

SEQ ID NO: 4612564 - DNA, 20 bp, Homo sapiens
tctttccccaaggacccagc

SEQ ID NO: 4612565 - DNA, 22 bp, Homo sapiens
tctttccccaaggacccagccc

SEQ ID NO: 4612566 - DNA, 16 bp, Homo sapiens
tctttcccccaggaaa

SEQ ID NO: 4612567 - DNA, 14 bp, Homo sapiens
tctttccctgcgag

SEQ ID NO: 4612568 - DNA, 15 bp, Homo sapiens
tctttcctcacattt

SEQ ID NO: 4612569 - DNA, 15 bp, Homo sapiens
tctttcctccccctg

SEQ ID NO: 4612570 - DNA, 19 bp, Homo sapiens
tctttctagttcagctgcc

SEQ ID NO: 4612571 - DNA, 13 bp, Homo sapiens
tctttctcctctt

SEQ ID NO: 4612572 - DNA, 17 bp, Homo sapiens
tctttgaattttctgtg

SEQ ID NO: 4612573 - DNA, 21 bp, Homo sapiens
tctttgacaattgggagctgc

SEQ ID NO: 4612574 - DNA, 19 bp, Homo sapiens
tctttgcggggcctgtctc

SEQ ID NO: 4612575 - DNA, 21 bp, Homo sapiens
tctttgcggggcctgtctcag

SEQ ID NO: 4612576 - DNA, 20 bp, Homo sapiens
tctttgtatcttaaatctgt

SEQ ID NO: 4612577 - DNA, 19 bp, Homo sapiens
tctttgtctaaaacaataa

SEQ ID NO: 4612578 - DNA, 11 bp, Homo sapiens
tctttgtgaag

SEQ ID NO: 4612579 - DNA, 19 bp, Homo sapiens
tctttgtttaacaaaagat

SEQ ID NO: 4612580 - DNA, 21 bp, Homo sapiens
tcttttaatgaggaccaatgt

SEQ ID NO: 4612581 - DNA, 16 bp, Homo sapiens
tcttttatttaacaaa

SEQ ID NO: 4612582 - DNA, 14 bp, Homo sapiens
tcttttgaattgtt

SEQ ID NO: 4612583 - DNA, 16 bp, Homo sapiens
tcttttggggaagtga

SEQ ID NO: 4612584 - DNA, 23 bp, Homo sapiens
tcttttgttctctgaattttcag

SEQ ID NO: 4612585 - DNA, 12 bp, Homo sapiens
tctttttcttgg

SEQ ID NO: 4612586 - DNA, 13 bp, Homo sapiens
tctttttcttggg

SEQ ID NO: 4612587 - DNA, 20 bp, Homo sapiens
tcttttttagcataaaattt

SEQ ID NO: 4612588 - DNA, 22 bp, Homo sapiens
tcttttttatgttaaaaagaaa

SEQ ID NO: 4612589 - DNA, 16 bp, Homo sapiens
tgaaaaagctgcttct

SEQ ID NO: 4612590 - DNA, 20 bp, Homo sapiens
tgaaaaatattccaagcttc

SEQ ID NO: 4612591 - DNA, 21 bp, Homo sapiens
tgaaaaatggagcagtaatgc

SEQ ID NO: 4612592 - DNA, 14 bp, Homo sapiens
tgaaaaattaactt

SEQ ID NO: 4612593 - DNA, 17 bp, Homo sapiens
tgaaaacatctggaagg

SEQ ID NO: 4612594 - DNA, 18 bp, Homo sapiens
tgaaaacctaaaagacag

SEQ ID NO: 4612595 - DNA, 16 bp, Homo sapiens
tgaaaacctacatatt

SEQ ID NO: 4612596 - DNA, 16 bp, Homo sapiens
tgaaaagatgtacctg

SEQ ID NO: 4612597 - DNA, 14 bp, Homo sapiens
tgaaaagggcactc

SEQ ID NO: 4612598 - DNA, 21 bp, Homo sapiens
tgaaaatatagacattctcac

SEQ ID NO: 4612599 - DNA, 20 bp, Homo sapiens
tgaaaatcatcactcaagat

SEQ ID NO: 4612600 - DNA, 17 bp, Homo sapiens
tgaaacaaagtactctt

SEQ ID NO: 4612601 - DNA, 19 bp, Homo sapiens
tgaaacaaagtactcttta

SEQ ID NO: 4612602 - DNA, 19 bp, Homo sapiens
tgaaacaactccttttact

SEQ ID NO: 4612603 - DNA, 13 bp, Homo sapiens
tgaaacagttcca

SEQ ID NO: 4612604 - DNA, 16 bp, Homo sapiens
tgaaacagttgctgtg

SEQ ID NO: 4612605 - DNA, 20 bp, Homo sapiens
tgaaacgcaattttacctag

SEQ ID NO: 4612606 - DNA, 16 bp, Homo sapiens
tgaaacgtctggactg

SEQ ID NO: 4612607 - DNA, 19 bp, Homo sapiens
tgaaacttacactgtttca

SEQ ID NO: 4612608 - DNA, 21 bp, Homo sapiens
tgaaagaaagggacccacctg

SEQ ID NO: 4612609 - DNA, 23 bp, Homo sapiens
tgaaagaaagggacccacctgct

SEQ ID NO: 4612610 - DNA, 13 bp, Homo sapiens
tgaaagaagcaag

SEQ ID NO: 4612611 - DNA, 21 bp, Homo sapiens
tgaaagaatcagtaggaccag

SEQ ID NO: 4612612 - DNA, 23 bp, Homo sapiens
tgaaagaatcagtaggaccaggc

SEQ ID NO: 4612613 - DNA, 13 bp, Homo sapiens
tgaaagggcactt

SEQ ID NO: 4612614 - DNA, 21 bp, Homo sapiens
tgaaagggcacttaatttgta

SEQ ID NO: 4612615 - DNA, 22 bp, Homo sapiens
tgaaagggcacttaatttgtaa

SEQ ID NO: 4612616 - DNA, 17 bp, Homo sapiens
tgaaaggtgtgaacagc

SEQ ID NO: 4612617 - DNA, 20 bp, Homo sapiens
tgaaataacaaaatggacat

SEQ ID NO: 4612618 - DNA, 14 bp, Homo sapiens
tgaaatacatcctt

SEQ ID NO: 4612619 - DNA, 16 bp, Homo sapiens
tgaaatagttatttta

SEQ ID NO: 4612620 - DNA, 19 bp, Homo sapiens
tgaaatagttattttaata

SEQ ID NO: 4612621 - DNA, 15 bp, Homo sapiens
tgaaatatgtgaagt

SEQ ID NO: 4612622 - DNA, 15 bp, Homo sapiens
tgaaatattcagaaa

SEQ ID NO: 4612623 - DNA, 21 bp, Homo sapiens
tgaaatgtttaataaagcttt

SEQ ID NO: 4612624 - DNA, 22 bp, Homo sapiens
tgaaatgtttactaagtggact

SEQ ID NO: 4612625 - DNA, 21 bp, Homo sapiens
tgaaattaacacaaaggaagt

SEQ ID NO: 4612626 - DNA, 24 bp, Homo sapiens
tgaaattaagcattttgaaacaaa

SEQ ID NO: 4612627 - DNA, 22 bp, Homo sapiens
tgaaatttttaaaaatacactt

SEQ ID NO: 4612628 - DNA, 14 bp, Homo sapiens
tgaacaaagcagcc

SEQ ID NO: 4612629 - DNA, 17 bp, Homo sapiens
tgaacagactgaccttg

SEQ ID NO: 4612630 - DNA, 14 bp, Homo sapiens
tgaacagcttgctg

SEQ ID NO: 4612631 - DNA, 16 bp, Homo sapiens
tgaacatctcttgaaa

SEQ ID NO: 4612632 - DNA, 15 bp, Homo sapiens
tgaaccctgccctgc

SEQ ID NO: 4612633 - DNA, 16 bp, Homo sapiens
tgaacgttattatatt

SEQ ID NO: 4612634 - DNA, 23 bp, Homo sapiens
tgaactgacaggcagcctggaca

SEQ ID NO: 4612635 - DNA, 23 bp, Homo sapiens
tgaactgaggagatgaccaggga

SEQ ID NO: 4612636 - DNA, 23 bp, Homo sapiens
tgaactgcaggataaaatggtac

SEQ ID NO: 4612637 - DNA, 16 bp, Homo sapiens
tgaacttccaagctcc

SEQ ID NO: 4612638 - DNA, 17 bp, Homo sapiens
tgaacttctttgaattt

SEQ ID NO: 4612639 - DNA, 20 bp, Homo sapiens
tgaagaaagggtgtttttct

SEQ ID NO: 4612640 - DNA, 22 bp, Homo sapiens
tgaagaaagtcagctcttgtca

SEQ ID NO: 4612641 - DNA, 19 bp, Homo sapiens
tgaagaaggaaagaaccga

SEQ ID NO: 4612642 - DNA, 23 bp, Homo sapiens
tgaagaatcacgatttcatcctt

SEQ ID NO: 4612643 - DNA, 13 bp, Homo sapiens
tgaagactgagaa

SEQ ID NO: 4612644 - DNA, 15 bp, Homo sapiens
tgaagactgagaact

SEQ ID NO: 4612645 - DNA, 12 bp, Homo sapiens
tgaagagaggga

SEQ ID NO: 4612646 - DNA, 19 bp, Homo sapiens
tgaagagatccttccattc

SEQ ID NO: 4612647 - DNA, 15 bp, Homo sapiens
tgaagatcagaacat

SEQ ID NO: 4612648 - DNA, 19 bp, Homo sapiens
tgaagatggcatcctgtga

SEQ ID NO: 4612649 - DNA, 22 bp, Homo sapiens
tgaagatggcatcctgtgaagt

SEQ ID NO: 4612650 - DNA, 19 bp, Homo sapiens
tgaagcaggttcccaagct

SEQ ID NO: 4612651 - DNA, 14 bp, Homo sapiens
tgaagcccaaagcc

SEQ ID NO: 4612652 - DNA, 15 bp, Homo sapiens
tgaagccgactctgg

SEQ ID NO: 4612653 - DNA, 19 bp, Homo sapiens
tgaagctatttatctgtag

SEQ ID NO: 4612654 - DNA, 21 bp, Homo sapiens
tgaaggaaaagcaagaaacag

SEQ ID NO: 4612655 - DNA, 11 bp, Homo sapiens
tgaaggaaggg

SEQ ID NO: 4612656 - DNA, 23 bp, Homo sapiens
tgaaggaaggggctatcctggga

SEQ ID NO: 4612657 - DNA, 16 bp, Homo sapiens
tgaaggagaaataccc

SEQ ID NO: 4612658 - DNA, 13 bp, Homo sapiens
tgaagggaaagat

SEQ ID NO: 4612659 - DNA, 19 bp, Homo sapiens
tgaagggaactagaggtgt

SEQ ID NO: 4612660 - DNA, 23 bp, Homo sapiens
tgaagtaacatgcatactttatt

SEQ ID NO: 4612661 - DNA, 13 bp, Homo sapiens
tgaagtagaacaa

SEQ ID NO: 4612662 - DNA, 14 bp, Homo sapiens
tgaagtatattctt

SEQ ID NO: 4612663 - DNA, 16 bp, Homo sapiens
tgaagtctagaatcat

SEQ ID NO: 4612664 - DNA, 13 bp, Homo sapiens
tgaagtgcgtgaa

SEQ ID NO: 4612665 - DNA, 16 bp, Homo sapiens
tgaagtgcgtgaatgt

SEQ ID NO: 4612666 - DNA, 15 bp, Homo sapiens
tgaagtgctgtttta

SEQ ID NO: 4612667 - DNA, 18 bp, Homo sapiens
tgaataacatttaaattc

SEQ ID NO: 4612668 - DNA, 16 bp, Homo sapiens
tgaataacctgcacag

SEQ ID NO: 4612669 - DNA, 19 bp, Homo sapiens
tgaataacctgcacaggct

SEQ ID NO: 4612670 - DNA, 20 bp, Homo sapiens
tgaataacctgcacaggctt

SEQ ID NO: 4612671 - DNA, 17 bp, Homo sapiens
tgaataagcagaacata

SEQ ID NO: 4612672 - DNA, 16 bp, Homo sapiens
tgaataatatcaaata

SEQ ID NO: 4612673 - DNA, 13 bp, Homo sapiens
tgaatacattaac

SEQ ID NO: 4612674 - DNA, 20 bp, Homo sapiens
tgaatacattaacggtgcta

SEQ ID NO: 4612675 - DNA, 14 bp, Homo sapiens
tgaatactcttgaa

SEQ ID NO: 4612676 - DNA, 13 bp, Homo sapiens
tgaatacttattt

SEQ ID NO: 4612677 - DNA, 22 bp, Homo sapiens
tgaatagatgtgcccttttata

SEQ ID NO: 4612678 - DNA, 19 bp, Homo sapiens
tgaatagtgctgcaataaa

SEQ ID NO: 4612679 - DNA, 14 bp, Homo sapiens
tgaatataaagctt

SEQ ID NO: 4612680 - DNA, 17 bp, Homo sapiens
tgaatcacgtaaagcta

SEQ ID NO: 4612681 - DNA, 20 bp, Homo sapiens
tgaatcccacccacatgtga

SEQ ID NO: 4612682 - DNA, 22 bp, Homo sapiens
tgaatctataagtagtaaatca

SEQ ID NO: 4612683 - DNA, 22 bp, Homo sapiens
tgaatctattgtttctcctctg

SEQ ID NO: 4612684 - DNA, 20 bp, Homo sapiens
tgaatctgcttttcctctgc

SEQ ID NO: 4612685 - DNA, 12 bp, Homo sapiens
tgaatcttctgg

SEQ ID NO: 4612686 - DNA, 18 bp, Homo sapiens
tgaatgatttgtgtttct

SEQ ID NO: 4612687 - DNA, 15 bp, Homo sapiens
tgaatgcagaacggt

SEQ ID NO: 4612688 - DNA, 20 bp, Homo sapiens
tgaatgcccccagctggccc

SEQ ID NO: 4612689 - DNA, 16 bp, Homo sapiens
tgaatgtgggcactgg

SEQ ID NO: 4612690 - DNA, 18 bp, Homo sapiens
tgaatgtttgtgtctgtg

SEQ ID NO: 4612691 - DNA, 16 bp, Homo sapiens
tgaattcatactctgt

SEQ ID NO: 4612692 - DNA, 16 bp, Homo sapiens
tgaattttcaaggcct

SEQ ID NO: 4612693 - DNA, 20 bp, Homo sapiens
tgaattttcaaggccttcag

SEQ ID NO: 4612694 - DNA, 21 bp, Homo sapiens
tgaattttcaaggccttcagt

SEQ ID NO: 4612695 - DNA, 12 bp, Homo sapiens
tgacaacacagc

SEQ ID NO: 4612696 - DNA, 18 bp, Homo sapiens
tgacaagccaatgtgaat

SEQ ID NO: 4612697 - DNA, 15 bp, Homo sapiens
tgacaatgttgtcct

SEQ ID NO: 4612698 - DNA, 16 bp, Homo sapiens
tgacaattctgttttt

SEQ ID NO: 4612699 - DNA, 17 bp, Homo sapiens
tgacaattctgttttta

SEQ ID NO: 4612700 - DNA, 17 bp, Homo sapiens
tgacacatatgaacaca

SEQ ID NO: 4612701 - DNA, 18 bp, Homo sapiens
tgacacatatgaacacag

SEQ ID NO: 4612702 - DNA, 22 bp, Homo sapiens
tgacacatatgcaccttgtgtc

SEQ ID NO: 4612703 - DNA, 14 bp, Homo sapiens
tgacaccctggcct

SEQ ID NO: 4612704 - DNA, 18 bp, Homo sapiens
tgacaccctggcctgaac

SEQ ID NO: 4612705 - DNA, 14 bp, Homo sapiens
tgacagactcctga

SEQ ID NO: 4612706 - DNA, 17 bp, Homo sapiens
tgacagactcctgagga

SEQ ID NO: 4612707 - DNA, 17 bp, Homo sapiens
tgacagatcaagctgtg

SEQ ID NO: 4612708 - DNA, 18 bp, Homo sapiens
tgacagatcaagctgtga

SEQ ID NO: 4612709 - DNA, 11 bp, Homo sapiens
tgacagggcca

SEQ ID NO: 4612710 - DNA, 21 bp, Homo sapiens
tgacagggccagtggggcctg

SEQ ID NO: 4612711 - DNA, 18 bp, Homo sapiens
tgacagtagctcttagac

SEQ ID NO: 4612712 - DNA, 13 bp, Homo sapiens
tgacagtcatcat

SEQ ID NO: 4612713 - DNA, 13 bp, Homo sapiens
tgacagtgaaata

SEQ ID NO: 4612714 - DNA, 14 bp, Homo sapiens
tgacagtttccaaa

SEQ ID NO: 4612715 - DNA, 16 bp, Homo sapiens
tgacagtttccaaatt

SEQ ID NO: 4612716 - DNA, 17 bp, Homo sapiens
tgacagtttccaaattg

SEQ ID NO: 4612717 - DNA, 19 bp, Homo sapiens
tgacataggtcataaagca

SEQ ID NO: 4612718 - DNA, 20 bp, Homo sapiens
tgatgtgaagagtttcacaa

SEQ ID NO: 4612719 - DNA, 15 bp, Homo sapiens
tgatgtgaattattt

SEQ ID NO: 4612720 - DNA, 21 bp, Homo sapiens
tgatgtgacattccatgacga

SEQ ID NO: 4612721 - DNA, 21 bp, Homo sapiens
tgatgtggaggaagagccacc

SEQ ID NO: 4612722 - DNA, 17 bp, Homo sapiens
tgatgttgctgttcaca

SEQ ID NO: 4612723 - DNA, 17 bp, Homo sapiens
tgatgtttccctctcct

SEQ ID NO: 4612724 - DNA, 15 bp, Homo sapiens
tgattaaatatttga

SEQ ID NO: 4612725 - DNA, 14 bp, Homo sapiens
tgattatatattgt

SEQ ID NO: 4612726 - DNA, 17 bp, Homo sapiens
tgattattcaacacatt

SEQ ID NO: 4612727 - DNA, 12 bp, Homo sapiens
tgattcagcatt

SEQ ID NO: 4612728 - DNA, 13 bp, Homo sapiens
tgattcagcattt

SEQ ID NO: 4612729 - DNA, 21 bp, Homo sapiens
tgattcctctcatttccagct

SEQ ID NO: 4612730 - DNA, 14 bp, Homo sapiens
tgattctgtttcct

SEQ ID NO: 4612731 - DNA, 22 bp, Homo sapiens
tgatttagtgtttttacctctg

SEQ ID NO: 4612732 - DNA, 16 bp, Homo sapiens
tgatttatctttcaag

SEQ ID NO: 4612733 - DNA, 11 bp, Homo sapiens
tgatttctaat

SEQ ID NO: 4612734 - DNA, 12 bp, Homo sapiens
tgatttctaatt

SEQ ID NO: 4612735 - DNA, 18 bp, Homo sapiens
tgatttctttaaaagaat

SEQ ID NO: 4612736 - DNA, 21 bp, Homo sapiens
tgatttctttaaaagaatgac

SEQ ID NO: 4612737 - DNA, 21 bp, Homo sapiens
tgatttgggtttttttgttgt

SEQ ID NO: 4612738 - DNA, 13 bp, Homo sapiens
tgattttgaggtt

SEQ ID NO: 4612739 - DNA, 17 bp, Homo sapiens
tgattttggaactgtgt

SEQ ID NO: 4612740 - DNA, 23 bp, Homo sapiens
tgattttggaactgtgtttcaaa

SEQ ID NO: 4612741 - DNA, 14 bp, Homo sapiens
tgatttttaaagtt

SEQ ID NO: 4612742 - DNA, 23 bp, Homo sapiens
tgatttttgtttttgtaatgcac

SEQ ID NO: 4612743 - DNA, 17 bp, Homo sapiens
tgatttttttaaacata

SEQ ID NO: 4612744 - DNA, 16 bp, Homo sapiens
tgcaaaaattatatat

SEQ ID NO: 4612745 - DNA, 17 bp, Homo sapiens
tgcaaaaattatatatt

SEQ ID NO: 4612746 - DNA, 14 bp, Homo sapiens
tgcaaaagttctca

SEQ ID NO: 4612747 - DNA, 14 bp, Homo sapiens
tgcaaacagaacag

SEQ ID NO: 4612748 - DNA, 18 bp, Homo sapiens
tgcaaacagaacagggtc

SEQ ID NO: 4612749 - DNA, 13 bp, Homo sapiens
tgcaaagccttta

SEQ ID NO: 4612750 - DNA, 16 bp, Homo sapiens
tgcaaagcctttaaat

SEQ ID NO: 4612751 - DNA, 19 bp, Homo sapiens
tgcaaagtggcagggaccg

SEQ ID NO: 4612752 - DNA, 12 bp, Homo sapiens
tgcaaatcctat

SEQ ID NO: 4612753 - DNA, 14 bp, Homo sapiens
tgcaaatcctatgt

SEQ ID NO: 4612754 - DNA, 21 bp, Homo sapiens
tgcaaattaaaacatatttca

SEQ ID NO: 4612755 - DNA, 19 bp, Homo sapiens
tgcaaatttctataaattt

SEQ ID NO: 4612756 - DNA, 17 bp, Homo sapiens
tgcaaccagggagctgc

SEQ ID NO: 4612757 - DNA, 20 bp, Homo sapiens
tgcaaccagggagctgcagg

SEQ ID NO: 4612758 - DNA, 17 bp, Homo sapiens
tgcaacctctgcctcct

SEQ ID NO: 4612759 - DNA, 18 bp, Homo sapiens
tgcaacctctgcttccca

SEQ ID NO: 4612760 - DNA, 20 bp, Homo sapiens
tgcaacctctgcttcccagg

SEQ ID NO: 4612761 - DNA, 15 bp, Homo sapiens
tgcaagatgcttggt

SEQ ID NO: 4612762 - DNA, 19 bp, Homo sapiens
tgcaagatgcttggttgtg

SEQ ID NO: 4612763 - DNA, 22 bp, Homo sapiens
tgcaagatggacacgagccaca

SEQ ID NO: 4612764 - DNA, 12 bp, Homo sapiens
tgcaagcactcg

SEQ ID NO: 4612765 - DNA, 22 bp, Homo sapiens
tgcaagcactcggggtccctgg

SEQ ID NO: 4612766 - DNA, 17 bp, Homo sapiens
tgcaatctctgcctccc

SEQ ID NO: 4612767 - DNA, 18 bp, Homo sapiens
tgcaattccaagaaaata

SEQ ID NO: 4612768 - DNA, 20 bp, Homo sapiens
tgcacaccaaggccctgcat

SEQ ID NO: 4612769 - DNA, 17 bp, Homo sapiens
tgcacactctcttctcc

SEQ ID NO: 4612770 - DNA, 15 bp, Homo sapiens
tgcacactgcacatt

SEQ ID NO: 4612771 - DNA, 22 bp, Homo sapiens
tgcacagagcaagtcctcactc

SEQ ID NO: 4612772 - DNA, 12 bp, Homo sapiens
tgcacaggaggg

SEQ ID NO: 4612773 - DNA, 15 bp, Homo sapiens
tgcacaggagggggt

SEQ ID NO: 4612774 - DNA, 18 bp, Homo sapiens
tgcacaggctggaggagg

SEQ ID NO: 4612775 - DNA, 17 bp, Homo sapiens
tgcacatatggactctg

SEQ ID NO: 4612776 - DNA, 18 bp, Homo sapiens
tgcacatatggactctgc

SEQ ID NO: 4612777 - DNA, 19 bp, Homo sapiens
tgcacatatggactctgca

SEQ ID NO: 4612778 - DNA, 20 bp, Homo sapiens
tgcacatcatgagccttcag

SEQ ID NO: 4612779 - DNA, 12 bp, Homo sapiens
tgcacatccctg

SEQ ID NO: 4612780 - DNA, 19 bp, Homo sapiens
tgcacatgtcttgtacatg

SEQ ID NO: 4612781 - DNA, 22 bp, Homo sapiens
tgcacatgtcttgtacatgtgt

SEQ ID NO: 4612782 - DNA, 21 bp, Homo sapiens
tgcaccaaactgcctcaatcc

SEQ ID NO: 4612783 - DNA, 17 bp, Homo sapiens
tgcacctctgttcattt

SEQ ID NO: 4612784 - DNA, 19 bp, Homo sapiens
tgcacctctgttcatttca

SEQ ID NO: 4612785 - DNA, 13 bp, Homo sapiens
tgcacctgtcccc

SEQ ID NO: 4612786 - DNA, 14 bp, Homo sapiens
tgcaccttgtgtct

SEQ ID NO: 4612787 - DNA, 16 bp, Homo sapiens
tgcaccttgtgtctgt

SEQ ID NO: 4612788 - DNA, 14 bp, Homo sapiens
tgcactagtgcaat

SEQ ID NO: 4612789 - DNA, 14 bp, Homo sapiens
tgcactcatcatat

SEQ ID NO: 4612790 - DNA, 19 bp, Homo sapiens
tgcactgcccatggacagg

SEQ ID NO: 4612791 - DNA, 21 bp, Homo sapiens
tgcactgcccatggacaggct

SEQ ID NO: 4612792 - DNA, 14 bp, Homo sapiens
tgcactgtttttaa

SEQ ID NO: 4612793 - DNA, 15 bp, Homo sapiens
tgcacttagccatga

SEQ ID NO: 4612794 - DNA, 21 bp, Homo sapiens
tgcacttatctcgaatttgaa

SEQ ID NO: 4612795 - DNA, 23 bp, Homo sapiens
tgcacttatctcgaatttgaaga

SEQ ID NO: 4612796 - DNA, 22 bp, Homo sapiens
tgcacttatttatgaacctgcc

SEQ ID NO: 4612797 - DNA, 20 bp, Homo sapiens
tgcactttccaatgccacag

SEQ ID NO: 4612798 - DNA, 19 bp, Homo sapiens
tgcactttcctttcaataa

SEQ ID NO: 4612799 - DNA, 20 bp, Homo sapiens
tgcactttcctttcaataaa

SEQ ID NO: 4612800 - DNA, 22 bp, Homo sapiens
tgcactttcctttcaataaagt

SEQ ID NO: 4612801 - DNA, 21 bp, Homo sapiens
tgcacttttagaaatgcatat

SEQ ID NO: 4612802 - DNA, 18 bp, Homo sapiens
tgcagaaccacaaacaat

SEQ ID NO: 4612803 - DNA, 15 bp, Homo sapiens
tgcagaaggaaagaa

SEQ ID NO: 4612804 - DNA, 16 bp, Homo sapiens
tgcagaatgaagccat

SEQ ID NO: 4612805 - DNA, 15 bp, Homo sapiens
tgcagaccctgccct

SEQ ID NO: 4612806 - DNA, 13 bp, Homo sapiens
tgcagagcagaca

SEQ ID NO: 4612807 - DNA, 15 bp, Homo sapiens
tgcagagcagacagg

SEQ ID NO: 4612808 - DNA, 15 bp, Homo sapiens
tgcagaggtctccaa

SEQ ID NO: 4612809 - DNA, 16 bp, Homo sapiens
tgcagaggtctccaaa

SEQ ID NO: 4612810 - DNA, 18 bp, Homo sapiens
tgcagagtaaattgctct

SEQ ID NO: 4612811 - DNA, 20 bp, Homo sapiens
tgcagagtaaattgctctgt

SEQ ID NO: 4612812 - DNA, 18 bp, Homo sapiens
tgcagagtgaccagcaca

SEQ ID NO: 4612813 - DNA, 22 bp, Homo sapiens
tgcagcaaacactccaccctcc

SEQ ID NO: 4612814 - DNA, 12 bp, Homo sapiens
tgcagcacctcc

SEQ ID NO: 4612815 - DNA, 12 bp, Homo sapiens
tgcagcccaagg

SEQ ID NO: 4612816 - DNA, 16 bp, Homo sapiens
tgcagcccaaggacag

SEQ ID NO: 4612817 - DNA, 23 bp, Homo sapiens
tgcagcccaaggacagttcagag

SEQ ID NO: 4612818 - DNA, 13 bp, Homo sapiens
tgcagctatctgg

SEQ ID NO: 4612819 - DNA, 17 bp, Homo sapiens
tgcagcttgtagccagc

SEQ ID NO: 4612820 - DNA, 14 bp, Homo sapiens
tgcaggataataat

SEQ ID NO: 4612821 - DNA, 13 bp, Homo sapiens
tgcagggaggagt

SEQ ID NO: 4612822 - DNA, 22 bp, Homo sapiens
tgcagggcctggcatagagtag

SEQ ID NO: 4612823 - DNA, 21 bp, Homo sapiens
tgcaggggatggggtgggggg

SEQ ID NO: 4612824 - DNA, 13 bp, Homo sapiens
tgcaggggtgacg

SEQ ID NO: 4612825 - DNA, 20 bp, Homo sapiens
tgcaggtatttcagaaggag

SEQ ID NO: 4612826 - DNA, 17 bp, Homo sapiens
tgcaggtcagcccatgg

SEQ ID NO: 4612827 - DNA, 17 bp, Homo sapiens
tgcagtactttgtgcat

SEQ ID NO: 4612828 - DNA, 16 bp, Homo sapiens
tgcagtatcatgccct

SEQ ID NO: 4612829 - DNA, 16 bp, Homo sapiens
tgcagtggagggggca

SEQ ID NO: 4612830 - DNA, 21 bp, Homo sapiens
tgcagtggagggggcaagctt

SEQ ID NO: 4612831 - DNA, 21 bp, Homo sapiens
tgcagtggcgcattctaggct

SEQ ID NO: 4612832 - DNA, 16 bp, Homo sapiens
tgcagtttcttttcac

SEQ ID NO: 4612833 - DNA, 18 bp, Homo sapiens
tgcagttttggtgtgtaa

SEQ ID NO: 4612834 - DNA, 11 bp, Homo sapiens
tgcataataaa

SEQ ID NO: 4612835 - DNA, 13 bp, Homo sapiens
tgcatactttatt

SEQ ID NO: 4612836 - DNA, 23 bp, Homo sapiens
tgcatatttgccacaaaacctgt

SEQ ID NO: 4612837 - DNA, 14 bp, Homo sapiens
tgcatcacatctgc

SEQ ID NO: 4612838 - DNA, 17 bp, Homo sapiens
tgcatcacatctgcaca

SEQ ID NO: 4612839 - DNA, 18 bp, Homo sapiens
tgcatcacatctgcacac

SEQ ID NO: 4612840 - DNA, 21 bp, Homo sapiens
tgcatcagaaagggagggctc

SEQ ID NO: 4612841 - DNA, 23 bp, Homo sapiens
tgcatcagaaagggagggctctg

SEQ ID NO: 4612842 - DNA, 13 bp, Homo sapiens
tgcatctgtctgc

SEQ ID NO: 4612843 - DNA, 18 bp, Homo sapiens
tgcatctgtctgctctgc

SEQ ID NO: 4612844 - DNA, 19 bp, Homo sapiens
tgcatgggctaatgaagat

SEQ ID NO: 4612845 - DNA, 13 bp, Homo sapiens
tgcatgtatgtct

SEQ ID NO: 4612846 - DNA, 14 bp, Homo sapiens
tgcatgtatgtctt

SEQ ID NO: 4612847 - DNA, 16 bp, Homo sapiens
tgcatgtgactctgaa

SEQ ID NO: 4612848 - DNA, 20 bp, Homo sapiens
tgcatgtgactctgaagctg

SEQ ID NO: 4612849 - DNA, 22 bp, Homo sapiens
tgcattatatcaaatctaccac

SEQ ID NO: 4612850 - DNA, 14 bp, Homo sapiens
tgcattcattttta

SEQ ID NO: 4612851 - DNA, 15 bp, Homo sapiens
tgcattcatttttat

SEQ ID NO: 4612852 - DNA, 12 bp, Homo sapiens
tgcattcctgaa

SEQ ID NO: 4612853 - DNA, 13 bp, Homo sapiens
tgcattctactag

SEQ ID NO: 4612854 - DNA, 19 bp, Homo sapiens
tgcattctagataaccttg

SEQ ID NO: 4612855 - DNA, 15 bp, Homo sapiens
tgcattgacctggag

SEQ ID NO: 4612856 - DNA, 16 bp, Homo sapiens
tgcattgacctggagg

SEQ ID NO: 4612857 - DNA, 14 bp, Homo sapiens
tgcatttagcttct

SEQ ID NO: 4612858 - DNA, 16 bp, Homo sapiens
tgcatttagcttcttt

SEQ ID NO: 4612859 - DNA, 19 bp, Homo sapiens
tgcatttagcttctttccc

SEQ ID NO: 4612860 - DNA, 18 bp, Homo sapiens
tgcatttgtgctagaaat

SEQ ID NO: 4612861 - DNA, 19 bp, Homo sapiens
tgccaaaattcatttctaa

SEQ ID NO: 4612862 - DNA, 12 bp, Homo sapiens
tgccaaatgctc

SEQ ID NO: 4612863 - DNA, 20 bp, Homo sapiens
tgccaacaatcctagtgctt

SEQ ID NO: 4612864 - DNA, 21 bp, Homo sapiens
tgccaactattctcaggccaa

SEQ ID NO: 4612865 - DNA, 13 bp, Homo sapiens
tgccaactcctca

SEQ ID NO: 4612866 - DNA, 22 bp, Homo sapiens
tgccaagagtcaacaggtcact

SEQ ID NO: 4612867 - DNA, 17 bp, Homo sapiens
tgccaagtccaggtcct

SEQ ID NO: 4612868 - DNA, 16 bp, Homo sapiens
tgccacacctggcctt

SEQ ID NO: 4612869 - DNA, 20 bp, Homo sapiens
tgccacacttcgctcttgag

SEQ ID NO: 4612870 - DNA, 22 bp, Homo sapiens
tgccacagtagaactgtctgtg

SEQ ID NO: 4612871 - DNA, 12 bp, Homo sapiens
tgccacatccct

SEQ ID NO: 4612872 - DNA, 12 bp, Homo sapiens
tgccacattttc

SEQ ID NO: 4612873 - DNA, 17 bp, Homo sapiens
tgccaccaccctgcccc

SEQ ID NO: 4612874 - DNA, 14 bp, Homo sapiens
tgccacccccagcc

SEQ ID NO: 4612875 - DNA, 22 bp, Homo sapiens
tgccacccccagttcctatgac

SEQ ID NO: 4612876 - DNA, 15 bp, Homo sapiens
tgccactgcactcca

SEQ ID NO: 4612877 - DNA, 19 bp, Homo sapiens
tgccactgcactccagcct

SEQ ID NO: 4612878 - DNA, 22 bp, Homo sapiens
tgccactgcactccagcctggg

SEQ ID NO: 4612879 - DNA, 15 bp, Homo sapiens
tgccagaaagtcccc

SEQ ID NO: 4612880 - DNA, 12 bp, Homo sapiens
tgccagagcctg

SEQ ID NO: 4612881 - DNA, 19 bp, Homo sapiens
tgccagagcctggggctct

SEQ ID NO: 4612882 - DNA, 12 bp, Homo sapiens
tgccagcaggaa

SEQ ID NO: 4612883 - DNA, 14 bp, Homo sapiens
tgccagcaggaata

SEQ ID NO: 4612884 - DNA, 17 bp, Homo sapiens
tgccagcaggaataaag

SEQ ID NO: 4612885 - DNA, 21 bp, Homo sapiens
tgccagcaggggggctgtgcc

SEQ ID NO: 4612886 - DNA, 15 bp, Homo sapiens
tgccagccactgtca

SEQ ID NO: 4612887 - DNA, 11 bp, Homo sapiens
tgccagcctga

SEQ ID NO: 4612888 - DNA, 21 bp, Homo sapiens
tgccaggagggacaaaggagc

SEQ ID NO: 4612889 - DNA, 16 bp, Homo sapiens
tgccaggctgtttcag

SEQ ID NO: 4612890 - DNA, 16 bp, Homo sapiens
tgccataccttctccc

SEQ ID NO: 4612891 - DNA, 18 bp, Homo sapiens
tgccataccttctcccag

SEQ ID NO: 4612892 - DNA, 18 bp, Homo sapiens
tgccatagtcacatggcc

SEQ ID NO: 4612893 - DNA, 21 bp, Homo sapiens
tgccatccagatgtgtgcaat

SEQ ID NO: 4612894 - DNA, 22 bp, Homo sapiens
tgccatctcacctcctgctggg

SEQ ID NO: 4612895 - DNA, 15 bp, Homo sapiens
tgccatgctgggcca

SEQ ID NO: 4612896 - DNA, 15 bp, Homo sapiens
tgccatgttggccag

SEQ ID NO: 4612897 - DNA, 20 bp, Homo sapiens
tgccattctgcatgagctga

SEQ ID NO: 4612898 - DNA, 22 bp, Homo sapiens
tgcccacagaaagccaggagca

SEQ ID NO: 4612899 - DNA, 12 bp, Homo sapiens
tgcccaccccac

SEQ ID NO: 4612900 - DNA, 19 bp, Homo sapiens
tgcccactccgccagccac

SEQ ID NO: 4612901 - DNA, 12 bp, Homo sapiens
tgcccaggagaa

SEQ ID NO: 4612902 - DNA, 21 bp, Homo sapiens
tgcccaggggagcgtgttcct

SEQ ID NO: 4612903 - DNA, 18 bp, Homo sapiens
tgcccagtgcaaaccact

SEQ ID NO: 4612904 - DNA, 18 bp, Homo sapiens
tgcccatcatgtggcccc

SEQ ID NO: 4612905 - DNA, 21 bp, Homo sapiens
tgcccatgtgtacattctgcc

SEQ ID NO: 4612906 - DNA, 18 bp, Homo sapiens
tgccccaactccttccag

SEQ ID NO: 4612907 - DNA, 19 bp, Homo sapiens
tgccccaactccttccagc

SEQ ID NO: 4612908 - DNA, 22 bp, Homo sapiens
tgccccaactccttccagctag

SEQ ID NO: 4612909 - DNA, 21 bp, Homo sapiens
tgccccagtcggccccatctc

SEQ ID NO: 4612910 - DNA, 13 bp, Homo sapiens
tgcccccagctgg

SEQ ID NO: 4612911 - DNA, 19 bp, Homo sapiens
tgccccccctaagagacac

SEQ ID NO: 4612912 - DNA, 23 bp, Homo sapiens
tgccccctccaggagagagccag

SEQ ID NO: 4612913 - DNA, 12 bp, Homo sapiens
tgccccctgggg

SEQ ID NO: 4612914 - DNA, 12 bp, Homo sapiens
tgcccctctctg

SEQ ID NO: 4612915 - DNA, 16 bp, Homo sapiens
tgcccctctctgggcc

SEQ ID NO: 4612916 - DNA, 21 bp, Homo sapiens
tgcccctctctgggcctcaga

SEQ ID NO: 4612917 - DNA, 20 bp, Homo sapiens
tgccccttaaccccaaggac

SEQ ID NO: 4612918 - DNA, 23 bp, Homo sapiens
tgcccgagggcagccccctccct

SEQ ID NO: 4612919 - DNA, 17 bp, Homo sapiens
tgcccgcagacctctgg

SEQ ID NO: 4612920 - DNA, 16 bp, Homo sapiens
tgcccggtgcagggcc

SEQ ID NO: 4612921 - DNA, 17 bp, Homo sapiens
tgcccggtgcagggcct

SEQ ID NO: 4612922 - DNA, 19 bp, Homo sapiens
tgcccggtgcagggcctgg

SEQ ID NO: 4612923 - DNA, 22 bp, Homo sapiens
tgcccggtgcagggcctggcat

SEQ ID NO: 4612924 - DNA, 22 bp, Homo sapiens
tgccctaactctgcccaccctc

SEQ ID NO: 4612925 - DNA, 18 bp, Homo sapiens
tgccctcattactgggcc

SEQ ID NO: 4612926 - DNA, 23 bp, Homo sapiens
tgccctcattactgggccttagt

SEQ ID NO: 4612927 - DNA, 24 bp, Homo sapiens
tgccctctatttattagccaactg

SEQ ID NO: 4612928 - DNA, 15 bp, Homo sapiens
tgccctgctctgccc

SEQ ID NO: 4612929 - DNA, 19 bp, Homo sapiens
tgccctgctctgcccaggc

SEQ ID NO: 4612930 - DNA, 12 bp, Homo sapiens
tgccctgtgcaa

SEQ ID NO: 4612931 - DNA, 14 bp, Homo sapiens
tgccctgtgtgtgt

SEQ ID NO: 4612932 - DNA, 19 bp, Homo sapiens
tgccctgtgttctttcccc

SEQ ID NO: 4612933 - DNA, 16 bp, Homo sapiens
tgcccttacctgtctc

SEQ ID NO: 4612934 - DNA, 23 bp, Homo sapiens
tgcccttcagcatcctcagttcc

SEQ ID NO: 4612935 - DNA, 11 bp, Homo sapiens
tgcccttcccc

SEQ ID NO: 4612936 - DNA, 14 bp, Homo sapiens
tgcccttccccctt

SEQ ID NO: 4612937 - DNA, 14 bp, Homo sapiens
tgcccttcctcctg

SEQ ID NO: 4612938 - DNA, 18 bp, Homo sapiens
tgcccttgctgggcctgg

SEQ ID NO: 4612939 - DNA, 20 bp, Homo sapiens
tgcccttgctgggcctgggg

SEQ ID NO: 4612940 - DNA, 14 bp, Homo sapiens
tgacattctacagt

SEQ ID NO: 4612941 - DNA, 20 bp, Homo sapiens
tgacattctacagttgtgat

SEQ ID NO: 4612942 - DNA, 14 bp, Homo sapiens
tgacattcttagct

SEQ ID NO: 4612943 - DNA, 18 bp, Homo sapiens
tgacattcttagctgtaa

SEQ ID NO: 4612944 - DNA, 14 bp, Homo sapiens
tgacatttcttaaa

SEQ ID NO: 4612945 - DNA, 13 bp, Homo sapiens
tgacatttgcttt

SEQ ID NO: 4612946 - DNA, 19 bp, Homo sapiens
tgaccacagcacagccaac

SEQ ID NO: 4612947 - DNA, 18 bp, Homo sapiens
tgaccacatagcatgagg

SEQ ID NO: 4612948 - DNA, 14 bp, Homo sapiens
tgaccacccctctc

SEQ ID NO: 4612949 - DNA, 19 bp, Homo sapiens
tgaccagggatgctgggct

SEQ ID NO: 4612950 - DNA, 22 bp, Homo sapiens
tgacccagagccaccaaagtca

SEQ ID NO: 4612951 - DNA, 18 bp, Homo sapiens
tgacccagcatctcccag

SEQ ID NO: 4612952 - DNA, 18 bp, Homo sapiens
tgaccccagggcacagga

SEQ ID NO: 4612953 - DNA, 21 bp, Homo sapiens
tgaccccagtggaaaacaaag

SEQ ID NO: 4612954 - DNA, 14 bp, Homo sapiens
tgacccccagctcc

SEQ ID NO: 4612955 - DNA, 14 bp, Homo sapiens
tgacccctccttgt

SEQ ID NO: 4612956 - DNA, 17 bp, Homo sapiens
tgacccctggccacagc

SEQ ID NO: 4612957 - DNA, 18 bp, Homo sapiens
tgacccggcaccccctgc

SEQ ID NO: 4612958 - DNA, 19 bp, Homo sapiens
tgacccggcaccccctgca

SEQ ID NO: 4612959 - DNA, 20 bp, Homo sapiens
tgacccggcaccccctgcag

SEQ ID NO: 4612960 - DNA, 19 bp, Homo sapiens
tgacctcaggtgatccgcc

SEQ ID NO: 4612961 - DNA, 20 bp, Homo sapiens
tgacctcaggtgatccgccc

SEQ ID NO: 4612962 - DNA, 18 bp, Homo sapiens
tgacctcatgatctgccc

SEQ ID NO: 4612963 - DNA, 18 bp, Homo sapiens
tgacctccagctttcctg

SEQ ID NO: 4612964 - DNA, 18 bp, Homo sapiens
tgacctcgtgatccaccc

SEQ ID NO: 4612965 - DNA, 16 bp, Homo sapiens
tgacctcgtgatctac

SEQ ID NO: 4612966 - DNA, 21 bp, Homo sapiens
tgacctctctaggtgtgtcca

SEQ ID NO: 4612967 - DNA, 13 bp, Homo sapiens
tgacctgctgagc

SEQ ID NO: 4612968 - DNA, 16 bp, Homo sapiens
tgacctgctgagctct

SEQ ID NO: 4612969 - DNA, 17 bp, Homo sapiens
tgacctgctgagctctg

SEQ ID NO: 4612970 - DNA, 18 bp, Homo sapiens
tgacctgctgagctctga

SEQ ID NO: 4612971 - DNA, 20 bp, Homo sapiens
tgacctgctgagctctgaga

SEQ ID NO: 4612972 - DNA, 20 bp, Homo sapiens
tgacctgtgagcccagctgg

SEQ ID NO: 4612973 - DNA, 22 bp, Homo sapiens
tgaccttagccccattgctcca

SEQ ID NO: 4612974 - DNA, 14 bp, Homo sapiens
tgacggccctcatc

SEQ ID NO: 4612975 - DNA, 15 bp, Homo sapiens
tgactaattttacat

SEQ ID NO: 4612976 - DNA, 23 bp, Homo sapiens
tgactatataatttatttccact

SEQ ID NO: 4612977 - DNA, 15 bp, Homo sapiens
tgactcctgctggta

SEQ ID NO: 4612978 - DNA, 21 bp, Homo sapiens
tgactcctgctggtacctgcc

SEQ ID NO: 4612979 - DNA, 20 bp, Homo sapiens
tgactcctttccaatagaaa

SEQ ID NO: 4612980 - DNA, 16 bp, Homo sapiens
tgactctcacctgtac

SEQ ID NO: 4612981 - DNA, 15 bp, Homo sapiens
tgactctccagggag

SEQ ID NO: 4612982 - DNA, 13 bp, Homo sapiens
tgactcttattta

SEQ ID NO: 4612983 - DNA, 14 bp, Homo sapiens
tgactcttatttat

SEQ ID NO: 4612984 - DNA, 17 bp, Homo sapiens
tgactgaagcgaacatc

SEQ ID NO: 4612985 - DNA, 20 bp, Homo sapiens
tgactgaagcgaacatcttc

SEQ ID NO: 4612986 - DNA, 13 bp, Homo sapiens
tgactgaatgcag

SEQ ID NO: 4612987 - DNA, 16 bp, Homo sapiens
tgactgccaagccaga

SEQ ID NO: 4612988 - DNA, 17 bp, Homo sapiens
tgactgccaagccagat

SEQ ID NO: 4612989 - DNA, 20 bp, Homo sapiens
tgactgccaagccagattct

SEQ ID NO: 4612990 - DNA, 21 bp, Homo sapiens
tgactgccaagccagattctc

SEQ ID NO: 4612991 - DNA, 20 bp, Homo sapiens
tgactggccaaacccttgct

SEQ ID NO: 4612992 - DNA, 17 bp, Homo sapiens
tgactgttagttgtcca

SEQ ID NO: 4612993 - DNA, 17 bp, Homo sapiens
tgacttatcccattttc

SEQ ID NO: 4612994 - DNA, 20 bp, Homo sapiens
tgacttatttatataaattt

SEQ ID NO: 4612995 - DNA, 12 bp, Homo sapiens
tgacttatttct

SEQ ID NO: 4612996 - DNA, 13 bp, Homo sapiens
tgacttatttctg

SEQ ID NO: 4612997 - DNA, 15 bp, Homo sapiens
tgacttctgctgctg

SEQ ID NO: 4612998 - DNA, 23 bp, Homo sapiens
tgacttgggcacccccagcctgg

SEQ ID NO: 4612999 - DNA, 15 bp, Homo sapiens
tgacttgtctgcctc

SEQ ID NO: 4613000 - DNA, 16 bp, Homo sapiens
tgacttgtctgcctcc

SEQ ID NO: 4613001 - DNA, 18 bp, Homo sapiens
tgacttgtctgcctcctg

SEQ ID NO: 4613002 - DNA, 23 bp, Homo sapiens
tgacttgtctgcctcctgctttg

SEQ ID NO: 4613003 - DNA, 14 bp, Homo sapiens
tgactttcagtaaa

SEQ ID NO: 4613004 - DNA, 23 bp, Homo sapiens
tgagaaaaatagagcaaaatcaa

SEQ ID NO: 4613005 - DNA, 21 bp, Homo sapiens
tgagaaacagctcagccagtg

SEQ ID NO: 4613006 - DNA, 12 bp, Homo sapiens
tgagaacctggc

SEQ ID NO: 4613007 - DNA, 17 bp, Homo sapiens
tgagaagcgtttttaac

SEQ ID NO: 4613008 - DNA, 21 bp, Homo sapiens
tgagaagcgtttttaacctgt

SEQ ID NO: 4613009 - DNA, 12 bp, Homo sapiens
tgagaagctctg

SEQ ID NO: 4613010 - DNA, 21 bp, Homo sapiens
tgagaagctgctccaggcctg

SEQ ID NO: 4613011 - DNA, 17 bp, Homo sapiens
tgagaatctaggccacc

SEQ ID NO: 4613012 - DNA, 18 bp, Homo sapiens
tgagaatctaggccaccc

SEQ ID NO: 4613013 - DNA, 16 bp, Homo sapiens
tgagacacaggatgaa

SEQ ID NO: 4613014 - DNA, 19 bp, Homo sapiens
tgagacacaggatgaagca

SEQ ID NO: 4613015 - DNA, 15 bp, Homo sapiens
tgagacagtcttgct

SEQ ID NO: 4613016 - DNA, 16 bp, Homo sapiens
tgagacagtgggaaat

SEQ ID NO: 4613017 - DNA, 17 bp, Homo sapiens
tgagacagtgggaaata

SEQ ID NO: 4613018 - DNA, 10 bp, Homo sapiens
tgagacccag

SEQ ID NO: 4613019 - DNA, 19 bp, Homo sapiens
tgagaccccagtgcctgca

SEQ ID NO: 4613020 - DNA, 22 bp, Homo sapiens
tgagaccccagtgcctgcacat

SEQ ID NO: 4613021 - DNA, 16 bp, Homo sapiens
tgagactgccctgccc

SEQ ID NO: 4613022 - DNA, 22 bp, Homo sapiens
tgagactgtcctgtgcctgatt

SEQ ID NO: 4613023 - DNA, 16 bp, Homo sapiens
tgagagacctctgcct

SEQ ID NO: 4613024 - DNA, 16 bp, Homo sapiens
tgagagcgacacagac

SEQ ID NO: 4613025 - DNA, 15 bp, Homo sapiens
tgagaggcccccacc

SEQ ID NO: 4613026 - DNA, 14 bp, Homo sapiens
tgagaggccctgga

SEQ ID NO: 4613027 - DNA, 22 bp, Homo sapiens
tgagagtacaggtgcatattaa

SEQ ID NO: 4613028 - DNA, 18 bp, Homo sapiens
tgagatagcattgtgaac

SEQ ID NO: 4613029 - DNA, 20 bp, Homo sapiens
tgagatcagggcctgccccc

SEQ ID NO: 4613030 - DNA, 18 bp, Homo sapiens
tgagatccttccttttga

SEQ ID NO: 4613031 - DNA, 23 bp, Homo sapiens
tgagatctaatgtgaaaatcatc

SEQ ID NO: 4613032 - DNA, 22 bp, Homo sapiens
tgagatctgctgtcctgtttct

SEQ ID NO: 4613033 - DNA, 16 bp, Homo sapiens
tgagatctggggaggc

SEQ ID NO: 4613034 - DNA, 20 bp, Homo sapiens
tgagatgatacatccaaagc

SEQ ID NO: 4613035 - DNA, 16 bp, Homo sapiens
tgagatggtatgaaat

SEQ ID NO: 4613036 - DNA, 16 bp, Homo sapiens
tgagatgtagaaagtt

SEQ ID NO: 4613037 - DNA, 20 bp, Homo sapiens
tgagatttaacccctccact

SEQ ID NO: 4613038 - DNA, 20 bp, Homo sapiens
tgagatttaagttcctgctg

SEQ ID NO: 4613039 - DNA, 14 bp, Homo sapiens
tgagcactgccagg

SEQ ID NO: 4613040 - DNA, 16 bp, Homo sapiens
tgagcactgccaggag

SEQ ID NO: 4613041 - DNA, 18 bp, Homo sapiens
tgagcactgccaggaggg

SEQ ID NO: 4613042 - DNA, 15 bp, Homo sapiens
tgagcacttagcagg

SEQ ID NO: 4613043 - DNA, 22 bp, Homo sapiens
tgagcagaatgttgtacttgaa

SEQ ID NO: 4613044 - DNA, 15 bp, Homo sapiens
tgagcagctgaataa

SEQ ID NO: 4613045 - DNA, 20 bp, Homo sapiens
tgagcagggccggggaactg

SEQ ID NO: 4613046 - DNA, 20 bp, Homo sapiens
tgagcagggtcaagcctctt

SEQ ID NO: 4613047 - DNA, 21 bp, Homo sapiens
tgagcagggtcaagcctctta

SEQ ID NO: 4613048 - DNA, 17 bp, Homo sapiens
tgagcatacctgtctca

SEQ ID NO: 4613049 - DNA, 13 bp, Homo sapiens
tgagcatttgcac

SEQ ID NO: 4613050 - DNA, 12 bp, Homo sapiens
tgagccaacctt

SEQ ID NO: 4613051 - DNA, 19 bp, Homo sapiens
tgagccatgagtatgccac

SEQ ID NO: 4613052 - DNA, 15 bp, Homo sapiens
tgagcccagagaaca

SEQ ID NO: 4613053 - DNA, 16 bp, Homo sapiens
tgagcccagagaacag

SEQ ID NO: 4613054 - DNA, 21 bp, Homo sapiens
tgagcccagctgggtcaggca

SEQ ID NO: 4613055 - DNA, 15 bp, Homo sapiens
tgagcccagggaggc

SEQ ID NO: 4613056 - DNA, 20 bp, Homo sapiens
tgagcccctttgcctgtcaa

SEQ ID NO: 4613057 - DNA, 13 bp, Homo sapiens
tgagcctgggctc

SEQ ID NO: 4613058 - DNA, 15 bp, Homo sapiens
tgagccttcagtcag

SEQ ID NO: 4613059 - DNA, 12 bp, Homo sapiens
tgagcgagtgga

SEQ ID NO: 4613060 - DNA, 12 bp, Homo sapiens
tgagcgccagga

SEQ ID NO: 4613061 - DNA, 15 bp, Homo sapiens
tgagcgtcaaagaaa

SEQ ID NO: 4613062 - DNA, 18 bp, Homo sapiens
tgagctcacaaggcagca

SEQ ID NO: 4613063 - DNA, 19 bp, Homo sapiens
tgagctcacaaggcagcaa

SEQ ID NO: 4613064 - DNA, 20 bp, Homo sapiens
tgagctcacaaggcagcaag
